United States Patent 11,421,016 (CANCER NEOEPITOPES) - sequence listing, part 22

SEQ ID NO: 972523 - protein, 9 aa, Homo Sapiens
VPAHVYLPF

SEQ ID NO: 972524 - protein, 9 aa, Homo Sapiens
SLDAWEAME

SEQ ID NO: 972525 - protein, 9 aa, Homo Sapiens
LVLIDKLLS

SEQ ID NO: 972526 - protein, 9 aa, Homo Sapiens
YFTEAGLKA

SEQ ID NO: 972527 - protein, 9 aa, Homo Sapiens
SEQRVIFVM

SEQ ID NO: 972528 - protein, 9 aa, Homo Sapiens
AFSNQMDQN

SEQ ID NO: 972529 - protein, 9 aa, Homo Sapiens
KRVFNVLSS

SEQ ID NO: 972530 - protein, 9 aa, Homo Sapiens
HNKCTKDAP

SEQ ID NO: 972531 - protein, 9 aa, Homo Sapiens
QAYIFYYNF

SEQ ID NO: 972532 - protein, 9 aa, Homo Sapiens
GPGTEKGSQ

SEQ ID NO: 972533 - protein, 9 aa, Homo Sapiens
KTFQRDFFF

SEQ ID NO: 972534 - protein, 9 aa, Homo Sapiens
REPQRNLSS

SEQ ID NO: 972535 - protein, 9 aa, Homo Sapiens
KISFIPKNN

SEQ ID NO: 972536 - protein, 9 aa, Homo Sapiens
QQVESITPK

SEQ ID NO: 972537 - protein, 9 aa, Homo Sapiens
PIKDLDLEG

SEQ ID NO: 972538 - protein, 9 aa, Homo Sapiens
IYLITVIEN

SEQ ID NO: 972539 - protein, 9 aa, Homo Sapiens
PNSLTGKGT

SEQ ID NO: 972540 - protein, 9 aa, Homo Sapiens
DQIKMFIQQ

SEQ ID NO: 972541 - protein, 9 aa, Homo Sapiens
GNKKAINLL

SEQ ID NO: 972542 - protein, 9 aa, Homo Sapiens
VYKGHEKFI

SEQ ID NO: 972543 - protein, 9 aa, Homo Sapiens
DLWDAWGPW

SEQ ID NO: 972544 - protein, 9 aa, Homo Sapiens
NKKAINLLE

SEQ ID NO: 972545 - protein, 9 aa, Homo Sapiens
KCSDFLRSR

SEQ ID NO: 972546 - protein, 9 aa, Homo Sapiens
FCLEIFMTY

SEQ ID NO: 972547 - protein, 9 aa, Homo Sapiens
ITDEEMKSG

SEQ ID NO: 972548 - protein, 9 aa, Homo Sapiens
HCIDPPYFS

SEQ ID NO: 972549 - protein, 9 aa, Homo Sapiens
ENLKKRDMD

SEQ ID NO: 972550 - protein, 9 aa, Homo Sapiens
AEAKRKFLE

SEQ ID NO: 972551 - protein, 9 aa, Homo Sapiens
NAIGGKATS

SEQ ID NO: 972552 - protein, 9 aa, Homo Sapiens
IRLEKDLSF

SEQ ID NO: 972553 - protein, 9 aa, Homo Sapiens
SGMEKHRYT

SEQ ID NO: 972554 - protein, 9 aa, Homo Sapiens
LWCSTMPNG

SEQ ID NO: 972555 - protein, 9 aa, Homo Sapiens
PVFQNAKMA

SEQ ID NO: 972556 - protein, 9 aa, Homo Sapiens
TKGEKEDLG

SEQ ID NO: 972557 - protein, 9 aa, Homo Sapiens
IFRMFSKDM

SEQ ID NO: 972558 - protein, 9 aa, Homo Sapiens
HGKRKNVGD

SEQ ID NO: 972559 - protein, 9 aa, Homo Sapiens
APMNKNLNE

SEQ ID NO: 972560 - protein, 9 aa, Homo Sapiens
NPVYTFSIS

SEQ ID NO: 972561 - protein, 9 aa, Homo Sapiens
PRNGIPKLA

SEQ ID NO: 972562 - protein, 9 aa, Homo Sapiens
GTVVPDSPA

SEQ ID NO: 972563 - protein, 9 aa, Homo Sapiens
KEDFDSKEW

SEQ ID NO: 972564 - protein, 9 aa, Homo Sapiens
SKTPPHELT

SEQ ID NO: 972565 - protein, 9 aa, Homo Sapiens
KIGGPAPSI

SEQ ID NO: 972566 - protein, 9 aa, Homo Sapiens
NSSTLMAPT

SEQ ID NO: 972567 - protein, 9 aa, Homo Sapiens
RGKIIPEEL

SEQ ID NO: 972568 - protein, 9 aa, Homo Sapiens
KNNEKQIIL

SEQ ID NO: 972569 - protein, 9 aa, Homo Sapiens
LTFTCKPKS

SEQ ID NO: 972570 - protein, 9 aa, Homo Sapiens
HLEHAPFPS

SEQ ID NO: 972571 - protein, 9 aa, Homo Sapiens
DRLGDIFRW

SEQ ID NO: 972572 - protein, 9 aa, Homo Sapiens
LELNGLEFG

SEQ ID NO: 972573 - protein, 9 aa, Homo Sapiens
VCGGDNTSC

SEQ ID NO: 972574 - protein, 9 aa, Homo Sapiens
LLITTNPYN

SEQ ID NO: 972575 - protein, 9 aa, Homo Sapiens
NLFKVELAE

SEQ ID NO: 972576 - protein, 9 aa, Homo Sapiens
ESSYMEIKG

SEQ ID NO: 972577 - protein, 9 aa, Homo Sapiens
PLATSQGPA

SEQ ID NO: 972578 - protein, 9 aa, Homo Sapiens
DRHEDSAMH

SEQ ID NO: 972579 - protein, 9 aa, Homo Sapiens
TESKHLSEP

SEQ ID NO: 972580 - protein, 9 aa, Homo Sapiens
RKVVVEEED

SEQ ID NO: 972581 - protein, 9 aa, Homo Sapiens
AFSCGESSY

SEQ ID NO: 972582 - protein, 9 aa, Homo Sapiens
GIKYSVFYF

SEQ ID NO: 972583 - protein, 9 aa, Homo Sapiens
PLTVSMFLS

SEQ ID NO: 972584 - protein, 9 aa, Homo Sapiens
LDTRKKAEP

SEQ ID NO: 972585 - protein, 9 aa, Homo Sapiens
SARGGLLKG

SEQ ID NO: 972586 - protein, 9 aa, Homo Sapiens
AAPGSSYHR

SEQ ID NO: 972587 - protein, 9 aa, Homo Sapiens
NVDAEERKV

SEQ ID NO: 972588 - protein, 9 aa, Homo Sapiens
FPAGASAAV

SEQ ID NO: 972589 - protein, 9 aa, Homo Sapiens
LFKVELAEI

SEQ ID NO: 972590 - protein, 9 aa, Homo Sapiens
PLVLLVTVG

SEQ ID NO: 972591 - protein, 9 aa, Homo Sapiens
PKIDFSLKN

SEQ ID NO: 972592 - protein, 9 aa, Homo Sapiens
GAEANPLAT

SEQ ID NO: 972593 - protein, 9 aa, Homo Sapiens
LQDLLPKII

SEQ ID NO: 972594 - protein, 9 aa, Homo Sapiens
RGSTPKEMS

SEQ ID NO: 972595 - protein, 9 aa, Homo Sapiens
EDLKIIVDQ

SEQ ID NO: 972596 - protein, 9 aa, Homo Sapiens
KLIFSYVEL

SEQ ID NO: 972597 - protein, 9 aa, Homo Sapiens
NPAFGGKHE

SEQ ID NO: 972598 - protein, 9 aa, Homo Sapiens
KLFYLPRVC

SEQ ID NO: 972599 - protein, 9 aa, Homo Sapiens
IIKAVRAHF

SEQ ID NO: 972600 - protein, 9 aa, Homo Sapiens
ESPQEKVLQ

SEQ ID NO: 972601 - protein, 9 aa, Homo Sapiens
SPAPMNWDM

SEQ ID NO: 972602 - protein, 9 aa, Homo Sapiens
GFSVEEVVR

SEQ ID NO: 972603 - protein, 9 aa, Homo Sapiens
TTLFQTTSS

SEQ ID NO: 972604 - protein, 9 aa, Homo Sapiens
CAYTFILSE

SEQ ID NO: 972605 - protein, 9 aa, Homo Sapiens
LTEKAEKKR

SEQ ID NO: 972606 - protein, 9 aa, Homo Sapiens
SNKETFTCW

SEQ ID NO: 972607 - protein, 9 aa, Homo Sapiens
AKKRSLINK

SEQ ID NO: 972608 - protein, 9 aa, Homo Sapiens
ESITPKPVL

SEQ ID NO: 972609 - protein, 9 aa, Homo Sapiens
YRIYTKVSR

SEQ ID NO: 972610 - protein, 9 aa, Homo Sapiens
SIQEETLAD

SEQ ID NO: 972611 - protein, 9 aa, Homo Sapiens
GTLFAALSL

SEQ ID NO: 972612 - protein, 9 aa, Homo Sapiens
IIPEELEKQ

SEQ ID NO: 972613 - protein, 9 aa, Homo Sapiens
MIEEFREVA

SEQ ID NO: 972614 - protein, 9 aa, Homo Sapiens
SLKIIKEYE

SEQ ID NO: 972615 - protein, 9 aa, Homo Sapiens
QKGEIRAIN

SEQ ID NO: 972616 - protein, 9 aa, Homo Sapiens
YGADAHFDD

SEQ ID NO: 972617 - protein, 9 aa, Homo Sapiens
PSSLFLVEI

SEQ ID NO: 972618 - protein, 9 aa, Homo Sapiens
INRERVPCI

SEQ ID NO: 972619 - protein, 9 aa, Homo Sapiens
TWVSSSATK

SEQ ID NO: 972620 - protein, 9 aa, Homo Sapiens
APQTYVEYA

SEQ ID NO: 972621 - protein, 9 aa, Homo Sapiens
LNFETTRGK

SEQ ID NO: 972622 - protein, 9 aa, Homo Sapiens
VFGGDVPIS

SEQ ID NO: 972623 - protein, 9 aa, Homo Sapiens
TLFSSSKKL

SEQ ID NO: 972624 - protein, 9 aa, Homo Sapiens
MERYASIAK

SEQ ID NO: 972625 - protein, 9 aa, Homo Sapiens
IFLVLGATE

SEQ ID NO: 972626 - protein, 9 aa, Homo Sapiens
YTLCWNGVK

SEQ ID NO: 972627 - protein, 9 aa, Homo Sapiens
TELCPAAES

SEQ ID NO: 972628 - protein, 9 aa, Homo Sapiens
EFIDSLMNK

SEQ ID NO: 972629 - protein, 9 aa, Homo Sapiens
AALSLGPPA

SEQ ID NO: 972630 - protein, 9 aa, Homo Sapiens
AFSSFVILD

SEQ ID NO: 972631 - protein, 9 aa, Homo Sapiens
TEPDGRVSH

SEQ ID NO: 972632 - protein, 9 aa, Homo Sapiens
SEEDRDDLW

SEQ ID NO: 972633 - protein, 9 aa, Homo Sapiens
MRREAETHY

SEQ ID NO: 972634 - protein, 9 aa, Homo Sapiens
MSLKIIKEY

SEQ ID NO: 972635 - protein, 9 aa, Homo Sapiens
LEAKAVACH

SEQ ID NO: 972636 - protein, 9 aa, Homo Sapiens
LEEPPERRS

SEQ ID NO: 972637 - protein, 9 aa, Homo Sapiens
TFDNFSQAL

SEQ ID NO: 972638 - protein, 9 aa, Homo Sapiens
FMLCAGRRT

SEQ ID NO: 972639 - protein, 9 aa, Homo Sapiens
PCLLNKNCF

SEQ ID NO: 972640 - protein, 9 aa, Homo Sapiens
IKAVRAHFG

SEQ ID NO: 972641 - protein, 9 aa, Homo Sapiens
DLRLQALFK

SEQ ID NO: 972642 - protein, 9 aa, Homo Sapiens
KIFFCAWCT

SEQ ID NO: 972643 - protein, 9 aa, Homo Sapiens
RTTKAERRH

SEQ ID NO: 972644 - protein, 9 aa, Homo Sapiens
IIHLHTLAT

SEQ ID NO: 972645 - protein, 9 aa, Homo Sapiens
TLPTRGHSI

SEQ ID NO: 972646 - protein, 9 aa, Homo Sapiens
HAFSNQMDQ

SEQ ID NO: 972647 - protein, 9 aa, Homo Sapiens
PPPPLPPPH

SEQ ID NO: 972648 - protein, 9 aa, Homo Sapiens
IENKGTALL

SEQ ID NO: 972649 - protein, 9 aa, Homo Sapiens
TWSNDPVAT

SEQ ID NO: 972650 - protein, 9 aa, Homo Sapiens
LRLQFGRTP

SEQ ID NO: 972651 - protein, 9 aa, Homo Sapiens
ILEKLQLNT

SEQ ID NO: 972652 - protein, 9 aa, Homo Sapiens
SSPSSSSTL

SEQ ID NO: 972653 - protein, 9 aa, Homo Sapiens
LELVKALRL

SEQ ID NO: 972654 - protein, 9 aa, Homo Sapiens
DNLPELEEG

SEQ ID NO: 972655 - protein, 9 aa, Homo Sapiens
VPRPPSHGS

SEQ ID NO: 972656 - protein, 9 aa, Homo Sapiens
FFRVLNFNK

SEQ ID NO: 972657 - protein, 9 aa, Homo Sapiens
ILEKRNKYF

SEQ ID NO: 972658 - protein, 9 aa, Homo Sapiens
ELLNKFWNK

SEQ ID NO: 972659 - protein, 9 aa, Homo Sapiens
RMCVNGLCK

SEQ ID NO: 972660 - protein, 9 aa, Homo Sapiens
ELLSDEAVE

SEQ ID NO: 972661 - protein, 9 aa, Homo Sapiens
SMPVSVPAS

SEQ ID NO: 972662 - protein, 9 aa, Homo Sapiens
EEQKFPEAD

SEQ ID NO: 972663 - protein, 9 aa, Homo Sapiens
LVTVGLGRT

SEQ ID NO: 972664 - protein, 9 aa, Homo Sapiens
ELEANSVFC

SEQ ID NO: 972665 - protein, 9 aa, Homo Sapiens
GRSRQLTEK

SEQ ID NO: 972666 - protein, 9 aa, Homo Sapiens
EQGFDFFFQ

SEQ ID NO: 972667 - protein, 9 aa, Homo Sapiens
VILDNHLYS

SEQ ID NO: 972668 - protein, 9 aa, Homo Sapiens
KDLGSKSVG

SEQ ID NO: 972669 - protein, 9 aa, Homo Sapiens
SPHWRETLQ

SEQ ID NO: 972670 - protein, 9 aa, Homo Sapiens
MAYCLISAK

SEQ ID NO: 972671 - protein, 9 aa, Homo Sapiens
KLFETVRFP

SEQ ID NO: 972672 - protein, 9 aa, Homo Sapiens
ASLHGGNLV

SEQ ID NO: 972673 - protein, 9 aa, Homo Sapiens
IDQLDAIGT

SEQ ID NO: 972674 - protein, 9 aa, Homo Sapiens
SIFYYGCAL

SEQ ID NO: 972675 - protein, 9 aa, Homo Sapiens
IFGLTIPCY

SEQ ID NO: 972676 - protein, 9 aa, Homo Sapiens
KGCEDQARL

SEQ ID NO: 972677 - protein, 9 aa, Homo Sapiens
EQDYVVTLS

SEQ ID NO: 972678 - protein, 9 aa, Homo Sapiens
IYLDPTHLS

SEQ ID NO: 972679 - protein, 9 aa, Homo Sapiens
EFAIAKYNA

SEQ ID NO: 972680 - protein, 9 aa, Homo Sapiens
IMRANFNKT

SEQ ID NO: 972681 - protein, 9 aa, Homo Sapiens
GNVFRHFYI

SEQ ID NO: 972682 - protein, 9 aa, Homo Sapiens
EKKEESYSN

SEQ ID NO: 972683 - protein, 9 aa, Homo Sapiens
IVDRSQLRG

SEQ ID NO: 972684 - protein, 9 aa, Homo Sapiens
PSVQTIIPR

SEQ ID NO: 972685 - protein, 9 aa, Homo Sapiens
NGLVTCSIS

SEQ ID NO: 972686 - protein, 9 aa, Homo Sapiens
RVCAAGIET

SEQ ID NO: 972687 - protein, 9 aa, Homo Sapiens
AKKDWCAKC

SEQ ID NO: 972688 - protein, 9 aa, Homo Sapiens
FSCEFCEPL

SEQ ID NO: 972689 - protein, 9 aa, Homo Sapiens
APENPIFRF

SEQ ID NO: 972690 - protein, 9 aa, Homo Sapiens
REAETHYEE

SEQ ID NO: 972691 - protein, 9 aa, Homo Sapiens
NTEFRYLEN

SEQ ID NO: 972692 - protein, 9 aa, Homo Sapiens
ESGLQIQMS

SEQ ID NO: 972693 - protein, 9 aa, Homo Sapiens
CGHVAQPAY

SEQ ID NO: 972694 - protein, 9 aa, Homo Sapiens
SEKRLGFRR

SEQ ID NO: 972695 - protein, 9 aa, Homo Sapiens
WARQPGGDT

SEQ ID NO: 972696 - protein, 9 aa, Homo Sapiens
DEHQGGSNN

SEQ ID NO: 972697 - protein, 9 aa, Homo Sapiens
KHCFIAFAS

SEQ ID NO: 972698 - protein, 9 aa, Homo Sapiens
SEYYEPRYV

SEQ ID NO: 972699 - protein, 9 aa, Homo Sapiens
RVAQLCGAG

SEQ ID NO: 972700 - protein, 9 aa, Homo Sapiens
WVEEKRQEQ

SEQ ID NO: 972701 - protein, 9 aa, Homo Sapiens
GRAGHGGPQ

SEQ ID NO: 972702 - protein, 9 aa, Homo Sapiens
VGADAAIVV

SEQ ID NO: 972703 - protein, 9 aa, Homo Sapiens
VPLPEPLKV

SEQ ID NO: 972704 - protein, 9 aa, Homo Sapiens
AIFLTISRE

SEQ ID NO: 972705 - protein, 9 aa, Homo Sapiens
PNGKVFKLE

SEQ ID NO: 972706 - protein, 9 aa, Homo Sapiens
HLPQDSKRF

SEQ ID NO: 972707 - protein, 9 aa, Homo Sapiens
RTSSSLDDS

SEQ ID NO: 972708 - protein, 9 aa, Homo Sapiens
LQWVGELMD

SEQ ID NO: 972709 - protein, 9 aa, Homo Sapiens
DRSQLRGTL

SEQ ID NO: 972710 - protein, 9 aa, Homo Sapiens
PQEKVLQII

SEQ ID NO: 972711 - protein, 9 aa, Homo Sapiens
LSWPAPDAA

SEQ ID NO: 972712 - protein, 9 aa, Homo Sapiens
HRVAKVLLN

SEQ ID NO: 972713 - protein, 9 aa, Homo Sapiens
ESESPMLQI

SEQ ID NO: 972714 - protein, 9 aa, Homo Sapiens
SNRLSRLNG

SEQ ID NO: 972715 - protein, 9 aa, Homo Sapiens
NFSAVSSPT

SEQ ID NO: 972716 - protein, 9 aa, Homo Sapiens
SIDYVTSVL

SEQ ID NO: 972717 - protein, 9 aa, Homo Sapiens
AFDSLYFLR

SEQ ID NO: 972718 - protein, 9 aa, Homo Sapiens
ISENESDDE

SEQ ID NO: 972719 - protein, 9 aa, Homo Sapiens
PQERKQASS

SEQ ID NO: 972720 - protein, 9 aa, Homo Sapiens
FTIQTRRTA

SEQ ID NO: 972721 - protein, 9 aa, Homo Sapiens
NISKVQKDV

SEQ ID NO: 972722 - protein, 9 aa, Homo Sapiens
PWLLVTHLE

SEQ ID NO: 972723 - protein, 9 aa, Homo Sapiens
LGPQGPNGL

SEQ ID NO: 972724 - protein, 9 aa, Homo Sapiens
GLLAPSNCI

SEQ ID NO: 972725 - protein, 9 aa, Homo Sapiens
MPNGKVFKL

SEQ ID NO: 972726 - protein, 9 aa, Homo Sapiens
NLEETLKVM

SEQ ID NO: 972727 - protein, 9 aa, Homo Sapiens
DPSRPYGFS

SEQ ID NO: 972728 - protein, 9 aa, Homo Sapiens
IYFENEKRA

SEQ ID NO: 972729 - protein, 9 aa, Homo Sapiens
DTTQLSLLS

SEQ ID NO: 972730 - protein, 9 aa, Homo Sapiens
STSIIGEVW

SEQ ID NO: 972731 - protein, 9 aa, Homo Sapiens
DLDEGLNED

SEQ ID NO: 972732 - protein, 9 aa, Homo Sapiens
ILHRGLVHP

SEQ ID NO: 972733 - protein, 9 aa, Homo Sapiens
ESTSTNAIL

SEQ ID NO: 972734 - protein, 9 aa, Homo Sapiens
RELKDKLEF

SEQ ID NO: 972735 - protein, 9 aa, Homo Sapiens
IYVHCLSAL

SEQ ID NO: 972736 - protein, 9 aa, Homo Sapiens
KFKRGSGHP

SEQ ID NO: 972737 - protein, 9 aa, Homo Sapiens
FKVSNGLIK

SEQ ID NO: 972738 - protein, 9 aa, Homo Sapiens
ERATASIIE

SEQ ID NO: 972739 - protein, 9 aa, Homo Sapiens
RRARRCRAG

SEQ ID NO: 972740 - protein, 9 aa, Homo Sapiens
TREKAYKCN

SEQ ID NO: 972741 - protein, 9 aa, Homo Sapiens
GNFKNSKVS

SEQ ID NO: 972742 - protein, 9 aa, Homo Sapiens
ANFIENKGT

SEQ ID NO: 972743 - protein, 9 aa, Homo Sapiens
GGSSAQKAS

SEQ ID NO: 972744 - protein, 9 aa, Homo Sapiens
QKKALLNEK

SEQ ID NO: 972745 - protein, 9 aa, Homo Sapiens
LEHAPFPSD

SEQ ID NO: 972746 - protein, 9 aa, Homo Sapiens
YTELCLPAF

SEQ ID NO: 972747 - protein, 9 aa, Homo Sapiens
RNSPLTVSM

SEQ ID NO: 972748 - protein, 9 aa, Homo Sapiens
FGNGDEEAV

SEQ ID NO: 972749 - protein, 9 aa, Homo Sapiens
LPNQYSVHQ

SEQ ID NO: 972750 - protein, 9 aa, Homo Sapiens
GMALAALLL

SEQ ID NO: 972751 - protein, 9 aa, Homo Sapiens
DRDDLWDAW

SEQ ID NO: 972752 - protein, 9 aa, Homo Sapiens
SSDLRLQAL

SEQ ID NO: 972753 - protein, 9 aa, Homo Sapiens
YSRSPVSKR

SEQ ID NO: 972754 - protein, 9 aa, Homo Sapiens
AQQRIRELK

SEQ ID NO: 972755 - protein, 9 aa, Homo Sapiens
ECGKTFFVN

SEQ ID NO: 972756 - protein, 9 aa, Homo Sapiens
NVSFECENG

SEQ ID NO: 972757 - protein, 9 aa, Homo Sapiens
VLLGLYTAL

SEQ ID NO: 972758 - protein, 9 aa, Homo Sapiens
ITKEREESS

SEQ ID NO: 972759 - protein, 9 aa, Homo Sapiens
EKNCGCKER

SEQ ID NO: 972760 - protein, 9 aa, Homo Sapiens
YQKLNFETT

SEQ ID NO: 972761 - protein, 9 aa, Homo Sapiens
FNLIIYSLR

SEQ ID NO: 972762 - protein, 9 aa, Homo Sapiens
AGPASASMP

SEQ ID NO: 972763 - protein, 9 aa, Homo Sapiens
YFKCQAKYG

SEQ ID NO: 972764 - protein, 9 aa, Homo Sapiens
VQEREKVIF

SEQ ID NO: 972765 - protein, 9 aa, Homo Sapiens
LLIDFLNEF

SEQ ID NO: 972766 - protein, 9 aa, Homo Sapiens
GKRKNVGDL

SEQ ID NO: 972767 - protein, 9 aa, Homo Sapiens
NACVSQIFF

SEQ ID NO: 972768 - protein, 9 aa, Homo Sapiens
NVSRNHNGS

SEQ ID NO: 972769 - protein, 9 aa, Homo Sapiens
PTQSSEFEA

SEQ ID NO: 972770 - protein, 9 aa, Homo Sapiens
HHLEIEAFS

SEQ ID NO: 972771 - protein, 9 aa, Homo Sapiens
KIFLSEPVF

SEQ ID NO: 972772 - protein, 9 aa, Homo Sapiens
SRVNTTGII

SEQ ID NO: 972773 - protein, 9 aa, Homo Sapiens
VVILPNKTE

SEQ ID NO: 972774 - protein, 9 aa, Homo Sapiens
NLHSKFPAE

SEQ ID NO: 972775 - protein, 9 aa, Homo Sapiens
GSDHVKVGW

SEQ ID NO: 972776 - protein, 9 aa, Homo Sapiens
LVEGEKKEE

SEQ ID NO: 972777 - protein, 9 aa, Homo Sapiens
NIIYTDTLR

SEQ ID NO: 972778 - protein, 9 aa, Homo Sapiens
SYNTIGGFS

SEQ ID NO: 972779 - protein, 9 aa, Homo Sapiens
SGLQIQMSP

SEQ ID NO: 972780 - protein, 9 aa, Homo Sapiens
LFRAWVWAG

SEQ ID NO: 972781 - protein, 9 aa, Homo Sapiens
EGHALPQSE

SEQ ID NO: 972782 - protein, 9 aa, Homo Sapiens
PSVANMKAV

SEQ ID NO: 972783 - protein, 9 aa, Homo Sapiens
SLRATESGH

SEQ ID NO: 972784 - protein, 9 aa, Homo Sapiens
KFDDDTYDN

SEQ ID NO: 972785 - protein, 9 aa, Homo Sapiens
TVSMFLSLF

SEQ ID NO: 972786 - protein, 9 aa, Homo Sapiens
DELKKVNKK

SEQ ID NO: 972787 - protein, 9 aa, Homo Sapiens
YNGKTSISR

SEQ ID NO: 972788 - protein, 9 aa, Homo Sapiens
SQKSVFQML

SEQ ID NO: 972789 - protein, 9 aa, Homo Sapiens
SSELLPVII

SEQ ID NO: 972790 - protein, 9 aa, Homo Sapiens
TGKGTQLVP

SEQ ID NO: 972791 - protein, 9 aa, Homo Sapiens
EDIIYSFSS

SEQ ID NO: 972792 - protein, 9 aa, Homo Sapiens
TSQPEGEAR

SEQ ID NO: 972793 - protein, 9 aa, Homo Sapiens
GLVTCSISR

SEQ ID NO: 972794 - protein, 9 aa, Homo Sapiens
EEFLRTVEC

SEQ ID NO: 972795 - protein, 9 aa, Homo Sapiens
GNEPLSAPA

SEQ ID NO: 972796 - protein, 9 aa, Homo Sapiens
YKGGAVSVH

SEQ ID NO: 972797 - protein, 9 aa, Homo Sapiens
NVGDLMLSF

SEQ ID NO: 972798 - protein, 9 aa, Homo Sapiens
TSTSKEILR

SEQ ID NO: 972799 - protein, 9 aa, Homo Sapiens
NREEFLRTV

SEQ ID NO: 972800 - protein, 9 aa, Homo Sapiens
IAQQTFKVP

SEQ ID NO: 972801 - protein, 9 aa, Homo Sapiens
RNLVYLGIA

SEQ ID NO: 972802 - protein, 9 aa, Homo Sapiens
VLAERKQKL

SEQ ID NO: 972803 - protein, 9 aa, Homo Sapiens
ISVISELLE

SEQ ID NO: 972804 - protein, 9 aa, Homo Sapiens
SFILQVYSS

SEQ ID NO: 972805 - protein, 9 aa, Homo Sapiens
ECNHHSGDY

SEQ ID NO: 972806 - protein, 9 aa, Homo Sapiens
LPTCSLFIT

SEQ ID NO: 972807 - protein, 9 aa, Homo Sapiens
LKIDLLIDF

SEQ ID NO: 972808 - protein, 9 aa, Homo Sapiens
ASATCCLWC

SEQ ID NO: 972809 - protein, 9 aa, Homo Sapiens
LDKLNIDIS

SEQ ID NO: 972810 - protein, 9 aa, Homo Sapiens
LDAYGVNPA

SEQ ID NO: 972811 - protein, 9 aa, Homo Sapiens
ETGPYQCKI

SEQ ID NO: 972812 - protein, 9 aa, Homo Sapiens
SSAFADSFC

SEQ ID NO: 972813 - protein, 9 aa, Homo Sapiens
GSPTRDLQS

SEQ ID NO: 972814 - protein, 9 aa, Homo Sapiens
ADAAIVVTP

SEQ ID NO: 972815 - protein, 9 aa, Homo Sapiens
GAEAKRKFL

SEQ ID NO: 972816 - protein, 9 aa, Homo Sapiens
VPLMPKLLY

SEQ ID NO: 972817 - protein, 9 aa, Homo Sapiens
NEKRATKPK

SEQ ID NO: 972818 - protein, 9 aa, Homo Sapiens
RGHSIAGRT

SEQ ID NO: 972819 - protein, 9 aa, Homo Sapiens
MTFFPEWLT

SEQ ID NO: 972820 - protein, 9 aa, Homo Sapiens
ELVKALRLN

SEQ ID NO: 972821 - protein, 9 aa, Homo Sapiens
EDSAMHLAL

SEQ ID NO: 972822 - protein, 9 aa, Homo Sapiens
NSVCSQESL

SEQ ID NO: 972823 - protein, 9 aa, Homo Sapiens
NPIFRFSSL

SEQ ID NO: 972824 - protein, 9 aa, Homo Sapiens
DSRKFGCAK

SEQ ID NO: 972825 - protein, 9 aa, Homo Sapiens
NLSSSTEPS

SEQ ID NO: 972826 - protein, 9 aa, Homo Sapiens
KPLGLLPRK

SEQ ID NO: 972827 - protein, 9 aa, Homo Sapiens
SQLSIFGKF

SEQ ID NO: 972828 - protein, 9 aa, Homo Sapiens
FSSKHRRSS

SEQ ID NO: 972829 - protein, 9 aa, Homo Sapiens
DPFKLAKCK

SEQ ID NO: 972830 - protein, 9 aa, Homo Sapiens
FLKAWKHSV

SEQ ID NO: 972831 - protein, 9 aa, Homo Sapiens
DEENDSKTP

SEQ ID NO: 972832 - protein, 9 aa, Homo Sapiens
ESTETGNAC

SEQ ID NO: 972833 - protein, 9 aa, Homo Sapiens
PYSRSPVSK

SEQ ID NO: 972834 - protein, 9 aa, Homo Sapiens
KSKDVNGLE

SEQ ID NO: 972835 - protein, 9 aa, Homo Sapiens
EKKSSFKDS

SEQ ID NO: 972836 - protein, 9 aa, Homo Sapiens
LWTWSRRAT

SEQ ID NO: 972837 - protein, 9 aa, Homo Sapiens
MTGRAGHGG

SEQ ID NO: 972838 - protein, 9 aa, Homo Sapiens
EYFMAETLV

SEQ ID NO: 972839 - protein, 9 aa, Homo Sapiens
NQNILIQMD

SEQ ID NO: 972840 - protein, 9 aa, Homo Sapiens
RVSHFPCYQ

SEQ ID NO: 972841 - protein, 9 aa, Homo Sapiens
APDTFDDNY

SEQ ID NO: 972842 - protein, 9 aa, Homo Sapiens
REKFFQCNE

SEQ ID NO: 972843 - protein, 9 aa, Homo Sapiens
NDPAWDEIN

SEQ ID NO: 972844 - protein, 9 aa, Homo Sapiens
GMKGTQRDL

SEQ ID NO: 972845 - protein, 9 aa, Homo Sapiens
FSSRHTTLL

SEQ ID NO: 972846 - protein, 9 aa, Homo Sapiens
TGVTGSSRT

SEQ ID NO: 972847 - protein, 9 aa, Homo Sapiens
DNPSSLFLV

SEQ ID NO: 972848 - protein, 9 aa, Homo Sapiens
MKGKYRIYT

SEQ ID NO: 972849 - protein, 9 aa, Homo Sapiens
IDLPREDTV

SEQ ID NO: 972850 - protein, 9 aa, Homo Sapiens
ASIERKYCR

SEQ ID NO: 972851 - protein, 9 aa, Homo Sapiens
LRTIFSNIQ

SEQ ID NO: 972852 - protein, 9 aa, Homo Sapiens
KAIDPALEG

SEQ ID NO: 972853 - protein, 9 aa, Homo Sapiens
EEKALNPSQ

SEQ ID NO: 972854 - protein, 9 aa, Homo Sapiens
DGGGRSRGT

SEQ ID NO: 972855 - protein, 9 aa, Homo Sapiens
LPANALVAE

SEQ ID NO: 972856 - protein, 9 aa, Homo Sapiens
QGREYDKDR

SEQ ID NO: 972857 - protein, 9 aa, Homo Sapiens
MKFIKYLKS

SEQ ID NO: 972858 - protein, 9 aa, Homo Sapiens
WSSQVEARS

SEQ ID NO: 972859 - protein, 9 aa, Homo Sapiens
VYEHVVILP

SEQ ID NO: 972860 - protein, 9 aa, Homo Sapiens
SYSNDQSPQ

SEQ ID NO: 972861 - protein, 9 aa, Homo Sapiens
DGKKNFTVD

SEQ ID NO: 972862 - protein, 9 aa, Homo Sapiens
TAKNRPQVF

SEQ ID NO: 972863 - protein, 9 aa, Homo Sapiens
LTFDEAEVC

SEQ ID NO: 972864 - protein, 9 aa, Homo Sapiens
QDSQDLVFG

SEQ ID NO: 972865 - protein, 9 aa, Homo Sapiens
SPSSSSTLE

SEQ ID NO: 972866 - protein, 9 aa, Homo Sapiens
PNAKGKNWQ

SEQ ID NO: 972867 - protein, 9 aa, Homo Sapiens
QNPHAFSNQ

SEQ ID NO: 972868 - protein, 9 aa, Homo Sapiens
KRAETLGFG

SEQ ID NO: 972869 - protein, 9 aa, Homo Sapiens
SITPKPVLQ

SEQ ID NO: 972870 - protein, 9 aa, Homo Sapiens
TQALRLPPT

SEQ ID NO: 972871 - protein, 9 aa, Homo Sapiens
WAGLGGRHV

SEQ ID NO: 972872 - protein, 9 aa, Homo Sapiens
ENRDRNIMA

SEQ ID NO: 972873 - protein, 9 aa, Homo Sapiens
PGLPRIPGQ

SEQ ID NO: 972874 - protein, 9 aa, Homo Sapiens
VATILLCKK

SEQ ID NO: 972875 - protein, 9 aa, Homo Sapiens
SGDPQETLR

SEQ ID NO: 972876 - protein, 9 aa, Homo Sapiens
LGQLFKLKE

SEQ ID NO: 972877 - protein, 9 aa, Homo Sapiens
LSFPFARGG

SEQ ID NO: 972878 - protein, 9 aa, Homo Sapiens
YTAIPEAIY

SEQ ID NO: 972879 - protein, 9 aa, Homo Sapiens
DIYVHCLSA

SEQ ID NO: 972880 - protein, 9 aa, Homo Sapiens
GDKGPPGLV

SEQ ID NO: 972881 - protein, 9 aa, Homo Sapiens
RSSALDTRK

SEQ ID NO: 972882 - protein, 9 aa, Homo Sapiens
LKREAISGE

SEQ ID NO: 972883 - protein, 9 aa, Homo Sapiens
SLSWFREEK

SEQ ID NO: 972884 - protein, 9 aa, Homo Sapiens
ATQETTNKK

SEQ ID NO: 972885 - protein, 9 aa, Homo Sapiens
YMVFGSLLK

SEQ ID NO: 972886 - protein, 9 aa, Homo Sapiens
TDTLRTIFS

SEQ ID NO: 972887 - protein, 9 aa, Homo Sapiens
PCWLLERWC

SEQ ID NO: 972888 - protein, 9 aa, Homo Sapiens
IFSIDYVTS

SEQ ID NO: 972889 - protein, 9 aa, Homo Sapiens
AGNFWNIIY

SEQ ID NO: 972890 - protein, 9 aa, Homo Sapiens
NGPDGPHSD

SEQ ID NO: 972891 - protein, 9 aa, Homo Sapiens
LCSSAWFRT

SEQ ID NO: 972892 - protein, 9 aa, Homo Sapiens
TVSNLQHAA

SEQ ID NO: 972893 - protein, 9 aa, Homo Sapiens
YIRERSVRV

SEQ ID NO: 972894 - protein, 9 aa, Homo Sapiens
LHDGETLCI

SEQ ID NO: 972895 - protein, 9 aa, Homo Sapiens
REAISGEGR

SEQ ID NO: 972896 - protein, 9 aa, Homo Sapiens
CLKREGLDG

SEQ ID NO: 972897 - protein, 9 aa, Homo Sapiens
LNTYCTKQE

SEQ ID NO: 972898 - protein, 9 aa, Homo Sapiens
YFGVGDSLT

SEQ ID NO: 972899 - protein, 9 aa, Homo Sapiens
IFSYVELDL

SEQ ID NO: 972900 - protein, 9 aa, Homo Sapiens
PLLPLPPLP

SEQ ID NO: 972901 - protein, 9 aa, Homo Sapiens
EDTLFSSSK

SEQ ID NO: 972902 - protein, 9 aa, Homo Sapiens
GADAHFDDD

SEQ ID NO: 972903 - protein, 9 aa, Homo Sapiens
STLGLNDKK

SEQ ID NO: 972904 - protein, 9 aa, Homo Sapiens
KIEATNAVL

SEQ ID NO: 972905 - protein, 9 aa, Homo Sapiens
TSFSKVIFN

SEQ ID NO: 972906 - protein, 9 aa, Homo Sapiens
IVVTPCYYR

SEQ ID NO: 972907 - protein, 9 aa, Homo Sapiens
SKDVNGLEP

SEQ ID NO: 972908 - protein, 9 aa, Homo Sapiens
GKLSQLHRL

SEQ ID NO: 972909 - protein, 9 aa, Homo Sapiens
QCKIRDRYG

SEQ ID NO: 972910 - protein, 9 aa, Homo Sapiens
PNKPTGCEE

SEQ ID NO: 972911 - protein, 9 aa, Homo Sapiens
NLGLIFDRV

SEQ ID NO: 972912 - protein, 9 aa, Homo Sapiens
ALEAFSCGE

SEQ ID NO: 972913 - protein, 9 aa, Homo Sapiens
WYDRRLKFH

SEQ ID NO: 972914 - protein, 9 aa, Homo Sapiens
AYTFILSEH

SEQ ID NO: 972915 - protein, 9 aa, Homo Sapiens
LTEPLEKFS

SEQ ID NO: 972916 - protein, 9 aa, Homo Sapiens
MPANGALFV

SEQ ID NO: 972917 - protein, 9 aa, Homo Sapiens
GMMAKGTTG

SEQ ID NO: 972918 - protein, 9 aa, Homo Sapiens
TLAGSRTQH

SEQ ID NO: 972919 - protein, 9 aa, Homo Sapiens
FQNYKLYYM

SEQ ID NO: 972920 - protein, 9 aa, Homo Sapiens
LMPKLLYVR

SEQ ID NO: 972921 - protein, 9 aa, Homo Sapiens
GGLLKGMRQ

SEQ ID NO: 972922 - protein, 9 aa, Homo Sapiens
PSSGELYAV

SEQ ID NO: 972923 - protein, 9 aa, Homo Sapiens
FILSEHDGN

SEQ ID NO: 972924 - protein, 9 aa, Homo Sapiens
GSIPGMGKL

SEQ ID NO: 972925 - protein, 9 aa, Homo Sapiens
LSWFREEKA

SEQ ID NO: 972926 - protein, 9 aa, Homo Sapiens
FLNIATRIM

SEQ ID NO: 972927 - protein, 9 aa, Homo Sapiens
TSFTKKAYK

SEQ ID NO: 972928 - protein, 9 aa, Homo Sapiens
RIPYLGMTN

SEQ ID NO: 972929 - protein, 9 aa, Homo Sapiens
ERLSQTYFY

SEQ ID NO: 972930 - protein, 9 aa, Homo Sapiens
CSGMEKHRY

SEQ ID NO: 972931 - protein, 9 aa, Homo Sapiens
GSKCSDFLR

SEQ ID NO: 972932 - protein, 9 aa, Homo Sapiens
YTFCKQIGT

SEQ ID NO: 972933 - protein, 9 aa, Homo Sapiens
STKSGAGVI

SEQ ID NO: 972934 - protein, 9 aa, Homo Sapiens
VEDNPSSLF

SEQ ID NO: 972935 - protein, 9 aa, Homo Sapiens
SFVKTPKPV

SEQ ID NO: 972936 - protein, 9 aa, Homo Sapiens
KRQNSARNF

SEQ ID NO: 972937 - protein, 9 aa, Homo Sapiens
KKTFSLYPL

SEQ ID NO: 972938 - protein, 9 aa, Homo Sapiens
DLSTLQRER

SEQ ID NO: 972939 - protein, 9 aa, Homo Sapiens
YKGHEKFIT

SEQ ID NO: 972940 - protein, 9 aa, Homo Sapiens
THQPPGAAS

SEQ ID NO: 972941 - protein, 9 aa, Homo Sapiens
MNKNLNELQ

SEQ ID NO: 972942 - protein, 9 aa, Homo Sapiens
PFRAETIIK

SEQ ID NO: 972943 - protein, 9 aa, Homo Sapiens
GDSLTIPDK

SEQ ID NO: 972944 - protein, 9 aa, Homo Sapiens
PEEQKNIPR

SEQ ID NO: 972945 - protein, 9 aa, Homo Sapiens
QDFVSLAPW

SEQ ID NO: 972946 - protein, 9 aa, Homo Sapiens
WDLFSPILY

SEQ ID NO: 972947 - protein, 9 aa, Homo Sapiens
YSKRTLPYS

SEQ ID NO: 972948 - protein, 9 aa, Homo Sapiens
DLYLKISIQ

SEQ ID NO: 972949 - protein, 9 aa, Homo Sapiens
LDGYDNRLQ

SEQ ID NO: 972950 - protein, 9 aa, Homo Sapiens
FTWSMNEKL

SEQ ID NO: 972951 - protein, 9 aa, Homo Sapiens
CPPRSAPAT

SEQ ID NO: 972952 - protein, 9 aa, Homo Sapiens
EGKKVDESR

SEQ ID NO: 972953 - protein, 9 aa, Homo Sapiens
CGKTFFVNS

SEQ ID NO: 972954 - protein, 9 aa, Homo Sapiens
AAQKIYVEI

SEQ ID NO: 972955 - protein, 9 aa, Homo Sapiens
IGGKATSLD

SEQ ID NO: 972956 - protein, 9 aa, Homo Sapiens
RLWKKFHIY

SEQ ID NO: 972957 - protein, 9 aa, Homo Sapiens
GFIYQEKIP

SEQ ID NO: 972958 - protein, 9 aa, Homo Sapiens
RRNWVLAGL

SEQ ID NO: 972959 - protein, 9 aa, Homo Sapiens
GTTGKGKVP

SEQ ID NO: 972960 - protein, 9 aa, Homo Sapiens
RKDGNLCLL

SEQ ID NO: 972961 - protein, 9 aa, Homo Sapiens
TLSWPAPDA

SEQ ID NO: 972962 - protein, 9 aa, Homo Sapiens
LYGPSFILQ

SEQ ID NO: 972963 - protein, 9 aa, Homo Sapiens
HRAGLTARF

SEQ ID NO: 972964 - protein, 9 aa, Homo Sapiens
IRAMPANGA

SEQ ID NO: 972965 - protein, 9 aa, Homo Sapiens
EMHLTESFK

SEQ ID NO: 972966 - protein, 9 aa, Homo Sapiens
RFSNSMEFL

SEQ ID NO: 972967 - protein, 9 aa, Homo Sapiens
QKLNFETTR

SEQ ID NO: 972968 - protein, 9 aa, Homo Sapiens
YCWLSPALQ

SEQ ID NO: 972969 - protein, 9 aa, Homo Sapiens
MKVHVNLSQ

SEQ ID NO: 972970 - protein, 9 aa, Homo Sapiens
EEEEKKEQG

SEQ ID NO: 972971 - protein, 9 aa, Homo Sapiens
ATMIRAMPA

SEQ ID NO: 972972 - protein, 9 aa, Homo Sapiens
TLLACLQLA

SEQ ID NO: 972973 - protein, 9 aa, Homo Sapiens
LDSVRRNIK

SEQ ID NO: 972974 - protein, 9 aa, Homo Sapiens
GFSNSTSSP

SEQ ID NO: 972975 - protein, 9 aa, Homo Sapiens
SSSSTLERG

SEQ ID NO: 972976 - protein, 9 aa, Homo Sapiens
GQQIRMNLS

SEQ ID NO: 972977 - protein, 9 aa, Homo Sapiens
LGPPAPADP

SEQ ID NO: 972978 - protein, 9 aa, Homo Sapiens
TESFTREST

SEQ ID NO: 972979 - protein, 9 aa, Homo Sapiens
HIIMIDFPQ

SEQ ID NO: 972980 - protein, 9 aa, Homo Sapiens
KYEEKLVRR

SEQ ID NO: 972981 - protein, 9 aa, Homo Sapiens
GSSSGTRRS

SEQ ID NO: 972982 - protein, 9 aa, Homo Sapiens
ASGPPRCCS

SEQ ID NO: 972983 - protein, 9 aa, Homo Sapiens
LLGLYTALL

SEQ ID NO: 972984 - protein, 9 aa, Homo Sapiens
EHPCETTDK

SEQ ID NO: 972985 - protein, 9 aa, Homo Sapiens
GQEPQAPFS

SEQ ID NO: 972986 - protein, 9 aa, Homo Sapiens
QWEPVFQNA

SEQ ID NO: 972987 - protein, 9 aa, Homo Sapiens
VISGPGTEK

SEQ ID NO: 972988 - protein, 9 aa, Homo Sapiens
EKDESTVSI

SEQ ID NO: 972989 - protein, 9 aa, Homo Sapiens
HVYLPFYQE

SEQ ID NO: 972990 - protein, 9 aa, Homo Sapiens
LVWPFSAIC

SEQ ID NO: 972991 - protein, 9 aa, Homo Sapiens
FSESSTMDR

SEQ ID NO: 972992 - protein, 9 aa, Homo Sapiens
LPKIIQDYY

SEQ ID NO: 972993 - protein, 9 aa, Homo Sapiens
LRAVGHHQF

SEQ ID NO: 972994 - protein, 9 aa, Homo Sapiens
GVTGSSRTR

SEQ ID NO: 972995 - protein, 9 aa, Homo Sapiens
KNFTASQTT

SEQ ID NO: 972996 - protein, 9 aa, Homo Sapiens
CSERIKNQK

SEQ ID NO: 972997 - protein, 9 aa, Homo Sapiens
CVATEEEGG

SEQ ID NO: 972998 - protein, 9 aa, Homo Sapiens
FTSPHRPRF

SEQ ID NO: 972999 - protein, 9 aa, Homo Sapiens
TRLYSCLAN

SEQ ID NO: 973000 - protein, 9 aa, Homo Sapiens
PKVVKNPTV

SEQ ID NO: 973001 - protein, 9 aa, Homo Sapiens
LRVVNVGVA

SEQ ID NO: 973002 - protein, 9 aa, Homo Sapiens
FLVLLGLYT

SEQ ID NO: 973003 - protein, 9 aa, Homo Sapiens
YLNFKSINH

SEQ ID NO: 973004 - protein, 9 aa, Homo Sapiens
VSNLQHAAL

SEQ ID NO: 973005 - protein, 9 aa, Homo Sapiens
QQLEVVEGN

SEQ ID NO: 973006 - protein, 9 aa, Homo Sapiens
TAAEFLLPA

SEQ ID NO: 973007 - protein, 9 aa, Homo Sapiens
DAFTWSMNE

SEQ ID NO: 973008 - protein, 9 aa, Homo Sapiens
FYPRNYPNN

SEQ ID NO: 973009 - protein, 9 aa, Homo Sapiens
LDESDHIIM

SEQ ID NO: 973010 - protein, 9 aa, Homo Sapiens
EEIRMKFIK

SEQ ID NO: 973011 - protein, 9 aa, Homo Sapiens
MTTIGFGIG

SEQ ID NO: 973012 - protein, 9 aa, Homo Sapiens
KGEDALCQY

SEQ ID NO: 973013 - protein, 9 aa, Homo Sapiens
SLLVILPII

SEQ ID NO: 973014 - protein, 9 aa, Homo Sapiens
NAPAFAQTS

SEQ ID NO: 973015 - protein, 9 aa, Homo Sapiens
SFLTILAKV

SEQ ID NO: 973016 - protein, 9 aa, Homo Sapiens
TAQFPRACG

SEQ ID NO: 973017 - protein, 9 aa, Homo Sapiens
IVEQTEFIY

SEQ ID NO: 973018 - protein, 9 aa, Homo Sapiens
QEGFLEVKN

SEQ ID NO: 973019 - protein, 9 aa, Homo Sapiens
RVIFVMFLL

SEQ ID NO: 973020 - protein, 9 aa, Homo Sapiens
EENDSKTPP

SEQ ID NO: 973021 - protein, 9 aa, Homo Sapiens
NRDRNIMAT

SEQ ID NO: 973022 - protein, 9 aa, Homo Sapiens
QQTFKVPDL

SEQ ID NO: 973023 - protein, 9 aa, Homo Sapiens
MAVSQDDSR

SEQ ID NO: 973024 - protein, 9 aa, Homo Sapiens
SSTLMAPTF

SEQ ID NO: 973025 - protein, 9 aa, Homo Sapiens
NYVGCAEEM

SEQ ID NO: 973026 - protein, 9 aa, Homo Sapiens
QYTHKFDGD

SEQ ID NO: 973027 - protein, 9 aa, Homo Sapiens
ENERMKGTF

SEQ ID NO: 973028 - protein, 9 aa, Homo Sapiens
SDGSTSIIG

SEQ ID NO: 973029 - protein, 9 aa, Homo Sapiens
MVSGLSSSR

SEQ ID NO: 973030 - protein, 9 aa, Homo Sapiens
QCRPRSSFT

SEQ ID NO: 973031 - protein, 9 aa, Homo Sapiens
GKKNFTVDE

SEQ ID NO: 973032 - protein, 9 aa, Homo Sapiens
HQNDPFRAE

SEQ ID NO: 973033 - protein, 9 aa, Homo Sapiens
LTARFQQSP

SEQ ID NO: 973034 - protein, 9 aa, Homo Sapiens
GQLVEVERT

SEQ ID NO: 973035 - protein, 9 aa, Homo Sapiens
IHPFTGLIY

SEQ ID NO: 973036 - protein, 9 aa, Homo Sapiens
ATFSSRTIE

SEQ ID NO: 973037 - protein, 9 aa, Homo Sapiens
IHWKGNFKN

SEQ ID NO: 973038 - protein, 9 aa, Homo Sapiens
LRTLGSKCS

SEQ ID NO: 973039 - protein, 9 aa, Homo Sapiens
ESTVSICED

SEQ ID NO: 973040 - protein, 9 aa, Homo Sapiens
EIGLDLENS

SEQ ID NO: 973041 - protein, 9 aa, Homo Sapiens
VRLYGPSFI

SEQ ID NO: 973042 - protein, 9 aa, Homo Sapiens
LFLLVLTLL

SEQ ID NO: 973043 - protein, 9 aa, Homo Sapiens
PMNWDMLME

SEQ ID NO: 973044 - protein, 9 aa, Homo Sapiens
GSVLIECPA

SEQ ID NO: 973045 - protein, 9 aa, Homo Sapiens
SALSSSFLT

SEQ ID NO: 973046 - protein, 9 aa, Homo Sapiens
ATFCMLMPK

SEQ ID NO: 973047 - protein, 9 aa, Homo Sapiens
SLRRVMNLY

SEQ ID NO: 973048 - protein, 9 aa, Homo Sapiens
YCTKQEVLS

SEQ ID NO: 973049 - protein, 9 aa, Homo Sapiens
RENILEYDT

SEQ ID NO: 973050 - protein, 9 aa, Homo Sapiens
HLQATSDPY

SEQ ID NO: 973051 - protein, 9 aa, Homo Sapiens
FPRACGLRC

SEQ ID NO: 973052 - protein, 9 aa, Homo Sapiens
FFRSVIEVI

SEQ ID NO: 973053 - protein, 9 aa, Homo Sapiens
QESSEKRLG

SEQ ID NO: 973054 - protein, 9 aa, Homo Sapiens
LTLLACLQL

SEQ ID NO: 973055 - protein, 9 aa, Homo Sapiens
LQVHQVSRV

SEQ ID NO: 973056 - protein, 9 aa, Homo Sapiens
ARDGGSPLL

SEQ ID NO: 973057 - protein, 9 aa, Homo Sapiens
TSIVQEENP

SEQ ID NO: 973058 - protein, 9 aa, Homo Sapiens
ITYNACVSQ

SEQ ID NO: 973059 - protein, 9 aa, Homo Sapiens
LPSMPVSVP

SEQ ID NO: 973060 - protein, 9 aa, Homo Sapiens
PVLRVTNGT

SEQ ID NO: 973061 - protein, 9 aa, Homo Sapiens
EKVLQIIVW

SEQ ID NO: 973062 - protein, 9 aa, Homo Sapiens
LVPLEGKKV

SEQ ID NO: 973063 - protein, 9 aa, Homo Sapiens
LEEVIAKLY

SEQ ID NO: 973064 - protein, 9 aa, Homo Sapiens
MTQLRVMKH

SEQ ID NO: 973065 - protein, 9 aa, Homo Sapiens
HICDLRKVR

SEQ ID NO: 973066 - protein, 9 aa, Homo Sapiens
GHEKFITSW

SEQ ID NO: 973067 - protein, 9 aa, Homo Sapiens
VCPPERRLH

SEQ ID NO: 973068 - protein, 9 aa, Homo Sapiens
SPILYMLSI

SEQ ID NO: 973069 - protein, 9 aa, Homo Sapiens
SSPSLDNDS

SEQ ID NO: 973070 - protein, 9 aa, Homo Sapiens
NYPLCIGDN

SEQ ID NO: 973071 - protein, 9 aa, Homo Sapiens
SSKTAHVTD

SEQ ID NO: 973072 - protein, 9 aa, Homo Sapiens
DTFHVLVFT

SEQ ID NO: 973073 - protein, 9 aa, Homo Sapiens
GTYHCSGME

SEQ ID NO: 973074 - protein, 9 aa, Homo Sapiens
EQRFLRTMG

SEQ ID NO: 973075 - protein, 9 aa, Homo Sapiens
GSSAQKASL

SEQ ID NO: 973076 - protein, 9 aa, Homo Sapiens
TCGYIPELK

SEQ ID NO: 973077 - protein, 9 aa, Homo Sapiens
ETIAFCQRN

SEQ ID NO: 973078 - protein, 9 aa, Homo Sapiens
AGGQFLEVY

SEQ ID NO: 973079 - protein, 9 aa, Homo Sapiens
KAETEPHEG

SEQ ID NO: 973080 - protein, 9 aa, Homo Sapiens
MCVNGLCKA

SEQ ID NO: 973081 - protein, 9 aa, Homo Sapiens
NDVREVVDD

SEQ ID NO: 973082 - protein, 9 aa, Homo Sapiens
SSLPSSGEL

SEQ ID NO: 973083 - protein, 9 aa, Homo Sapiens
PNSSTLMAP

SEQ ID NO: 973084 - protein, 9 aa, Homo Sapiens
QVHQVSRVF

SEQ ID NO: 973085 - protein, 9 aa, Homo Sapiens
RFTNKYSLI

SEQ ID NO: 973086 - protein, 9 aa, Homo Sapiens
PGPNYGADA

SEQ ID NO: 973087 - protein, 9 aa, Homo Sapiens
VKKVEKGCL

SEQ ID NO: 973088 - protein, 9 aa, Homo Sapiens
REINVLRQK

SEQ ID NO: 973089 - protein, 9 aa, Homo Sapiens
GREQKIRLP

SEQ ID NO: 973090 - protein, 9 aa, Homo Sapiens
ATENFSAVS

SEQ ID NO: 973091 - protein, 9 aa, Homo Sapiens
LLYSKTAKQ

SEQ ID NO: 973092 - protein, 9 aa, Homo Sapiens
KTSPCDPTF

SEQ ID NO: 973093 - protein, 9 aa, Homo Sapiens
VLRQKLAQP

SEQ ID NO: 973094 - protein, 9 aa, Homo Sapiens
SVVGLGSIP

SEQ ID NO: 973095 - protein, 9 aa, Homo Sapiens
RNMNYREHP

SEQ ID NO: 973096 - protein, 9 aa, Homo Sapiens
HVNLSQSLL

SEQ ID NO: 973097 - protein, 9 aa, Homo Sapiens
HEETVLPSL

SEQ ID NO: 973098 - protein, 9 aa, Homo Sapiens
EIFRMFSKD

SEQ ID NO: 973099 - protein, 9 aa, Homo Sapiens
CSCNISIQS

SEQ ID NO: 973100 - protein, 9 aa, Homo Sapiens
APSICFKCN

SEQ ID NO: 973101 - protein, 9 aa, Homo Sapiens
EPGTMNSVR

SEQ ID NO: 973102 - protein, 9 aa, Homo Sapiens
LTVLIQRST

SEQ ID NO: 973103 - protein, 9 aa, Homo Sapiens
RMRREAETH

SEQ ID NO: 973104 - protein, 9 aa, Homo Sapiens
LCKKYTQKK

SEQ ID NO: 973105 - protein, 9 aa, Homo Sapiens
LESSTSDHH

SEQ ID NO: 973106 - protein, 9 aa, Homo Sapiens
IHGKRKNVG

SEQ ID NO: 973107 - protein, 9 aa, Homo Sapiens
LPQSESIWA

SEQ ID NO: 973108 - protein, 9 aa, Homo Sapiens
VIENLLIIL

SEQ ID NO: 973109 - protein, 9 aa, Homo Sapiens
APPGAVKRT

SEQ ID NO: 973110 - protein, 9 aa, Homo Sapiens
GRRATGVRL

SEQ ID NO: 973111 - protein, 9 aa, Homo Sapiens
SSRVGDSQN

SEQ ID NO: 973112 - protein, 9 aa, Homo Sapiens
GSFRVVSTH

SEQ ID NO: 973113 - protein, 9 aa, Homo Sapiens
AKDLGQLFK

SEQ ID NO: 973114 - protein, 9 aa, Homo Sapiens
IREGGSIPV

SEQ ID NO: 973115 - protein, 9 aa, Homo Sapiens
KTKKKMNNF

SEQ ID NO: 973116 - protein, 9 aa, Homo Sapiens
SPRNYAKLS

SEQ ID NO: 973117 - protein, 9 aa, Homo Sapiens
FMFVKRNGP

SEQ ID NO: 973118 - protein, 9 aa, Homo Sapiens
EKNMRDLMA

SEQ ID NO: 973119 - protein, 9 aa, Homo Sapiens
DGFKAMCVN

SEQ ID NO: 973120 - protein, 9 aa, Homo Sapiens
PKENFTADH

SEQ ID NO: 973121 - protein, 9 aa, Homo Sapiens
KPEPPEGPA

SEQ ID NO: 973122 - protein, 9 aa, Homo Sapiens
AAEPLDGPA

SEQ ID NO: 973123 - protein, 9 aa, Homo Sapiens
KEEQKFPEA

SEQ ID NO: 973124 - protein, 9 aa, Homo Sapiens
DEAQGPVAP

SEQ ID NO: 973125 - protein, 9 aa, Homo Sapiens
SHSSQVTKD

SEQ ID NO: 973126 - protein, 9 aa, Homo Sapiens
LQFGRTPTL

SEQ ID NO: 973127 - protein, 9 aa, Homo Sapiens
SECKEKSVS

SEQ ID NO: 973128 - protein, 9 aa, Homo Sapiens
DDHDFVDKI

SEQ ID NO: 973129 - protein, 9 aa, Homo Sapiens
PPRSAPATL

SEQ ID NO: 973130 - protein, 9 aa, Homo Sapiens
GASGLLRAN

SEQ ID NO: 973131 - protein, 9 aa, Homo Sapiens
DLTKLLNGM

SEQ ID NO: 973132 - protein, 9 aa, Homo Sapiens
FTKKAYKKY

SEQ ID NO: 973133 - protein, 9 aa, Homo Sapiens
SLVTPRKDS

SEQ ID NO: 973134 - protein, 9 aa, Homo Sapiens
PHASYSALP

SEQ ID NO: 973135 - protein, 9 aa, Homo Sapiens
ARVRVESNS

SEQ ID NO: 973136 - protein, 9 aa, Homo Sapiens
PLKALRENP

SEQ ID NO: 973137 - protein, 9 aa, Homo Sapiens
DEYLRVVNV

SEQ ID NO: 973138 - protein, 9 aa, Homo Sapiens
ESSEKRLGF

SEQ ID NO: 973139 - protein, 9 aa, Homo Sapiens
FFNPDLYLK

SEQ ID NO: 973140 - protein, 9 aa, Homo Sapiens
LFLKAWKHS

SEQ ID NO: 973141 - protein, 9 aa, Homo Sapiens
LVTTFVGLP

SEQ ID NO: 973142 - protein, 9 aa, Homo Sapiens
ERETQREKI

SEQ ID NO: 973143 - protein, 9 aa, Homo Sapiens
HDLSTLQRE

SEQ ID NO: 973144 - protein, 9 aa, Homo Sapiens
LQFYLFAFF

SEQ ID NO: 973145 - protein, 9 aa, Homo Sapiens
STKALPEKA

SEQ ID NO: 973146 - protein, 9 aa, Homo Sapiens
GLLCVFFVS

SEQ ID NO: 973147 - protein, 9 aa, Homo Sapiens
CAWDLEQTM

SEQ ID NO: 973148 - protein, 9 aa, Homo Sapiens
TISREHERV

SEQ ID NO: 973149 - protein, 9 aa, Homo Sapiens
PPGKHLVTK

SEQ ID NO: 973150 - protein, 9 aa, Homo Sapiens
KEAVQGMMA

SEQ ID NO: 973151 - protein, 9 aa, Homo Sapiens
FHEKPPDPA

SEQ ID NO: 973152 - protein, 9 aa, Homo Sapiens
LEVKNASLF

SEQ ID NO: 973153 - protein, 9 aa, Homo Sapiens
ISEAFSGAL

SEQ ID NO: 973154 - protein, 9 aa, Homo Sapiens
PTPPASPSV

SEQ ID NO: 973155 - protein, 9 aa, Homo Sapiens
DRLAACAPE

SEQ ID NO: 973156 - protein, 9 aa, Homo Sapiens
SDSVFDSIP

SEQ ID NO: 973157 - protein, 9 aa, Homo Sapiens
MLRLAENER

SEQ ID NO: 973158 - protein, 9 aa, Homo Sapiens
CGYIPELKY

SEQ ID NO: 973159 - protein, 9 aa, Homo Sapiens
VTSIVQEEN

SEQ ID NO: 973160 - protein, 9 aa, Homo Sapiens
NLQKNSQEV

SEQ ID NO: 973161 - protein, 9 aa, Homo Sapiens
PTSSVSPVA

SEQ ID NO: 973162 - protein, 9 aa, Homo Sapiens
YGLQWVGEL

SEQ ID NO: 973163 - protein, 9 aa, Homo Sapiens
HERIHFGEK

SEQ ID NO: 973164 - protein, 9 aa, Homo Sapiens
TFKVPDLVK

SEQ ID NO: 973165 - protein, 9 aa, Homo Sapiens
DLKIIVDQK

SEQ ID NO: 973166 - protein, 9 aa, Homo Sapiens
LEGPQEEGE

SEQ ID NO: 973167 - protein, 9 aa, Homo Sapiens
EHLASMIYL

SEQ ID NO: 973168 - protein, 9 aa, Homo Sapiens
RLSWFGIPK

SEQ ID NO: 973169 - protein, 9 aa, Homo Sapiens
KVPDLVKIL

SEQ ID NO: 973170 - protein, 9 aa, Homo Sapiens
NPGLPRIPG

SEQ ID NO: 973171 - protein, 9 aa, Homo Sapiens
TLLGAWRGV

SEQ ID NO: 973172 - protein, 9 aa, Homo Sapiens
AKYNAPCSK

SEQ ID NO: 973173 - protein, 9 aa, Homo Sapiens
GCRVRDLDR

SEQ ID NO: 973174 - protein, 9 aa, Homo Sapiens
KCKEKRYNQ

SEQ ID NO: 973175 - protein, 9 aa, Homo Sapiens
SRPYGFSNM

SEQ ID NO: 973176 - protein, 9 aa, Homo Sapiens
LQADLPLGQ

SEQ ID NO: 973177 - protein, 9 aa, Homo Sapiens
GHVLSFALQ

SEQ ID NO: 973178 - protein, 9 aa, Homo Sapiens
YPRNYPNNA

SEQ ID NO: 973179 - protein, 9 aa, Homo Sapiens
KSGAKCDAQ

SEQ ID NO: 973180 - protein, 9 aa, Homo Sapiens
DFSQIELLK

SEQ ID NO: 973181 - protein, 9 aa, Homo Sapiens
CIDPPYFSP

SEQ ID NO: 973182 - protein, 9 aa, Homo Sapiens
IVDHQNDPF

SEQ ID NO: 973183 - protein, 9 aa, Homo Sapiens
QDQVPLNPS

SEQ ID NO: 973184 - protein, 9 aa, Homo Sapiens
TVLIQRSTH

SEQ ID NO: 973185 - protein, 9 aa, Homo Sapiens
TGGRTQCVK

SEQ ID NO: 973186 - protein, 9 aa, Homo Sapiens
TTDKCKEKR

SEQ ID NO: 973187 - protein, 9 aa, Homo Sapiens
EKFITSWPW

SEQ ID NO: 973188 - protein, 9 aa, Homo Sapiens
TPEAFSQLS

SEQ ID NO: 973189 - protein, 9 aa, Homo Sapiens
RTEPDHQPP

SEQ ID NO: 973190 - protein, 9 aa, Homo Sapiens
YKSLGEGPS

SEQ ID NO: 973191 - protein, 9 aa, Homo Sapiens
APLSTLKGK

SEQ ID NO: 973192 - protein, 9 aa, Homo Sapiens
VQVWKNFTA

SEQ ID NO: 973193 - protein, 9 aa, Homo Sapiens
FFAVVMRTG

SEQ ID NO: 973194 - protein, 9 aa, Homo Sapiens
LSPNDIEQW

SEQ ID NO: 973195 - protein, 9 aa, Homo Sapiens
PPLPPPHLS

SEQ ID NO: 973196 - protein, 9 aa, Homo Sapiens
TKTSPCDPT

SEQ ID NO: 973197 - protein, 9 aa, Homo Sapiens
FLEVYVGKE

SEQ ID NO: 973198 - protein, 9 aa, Homo Sapiens
FFSRRILTT

SEQ ID NO: 973199 - protein, 9 aa, Homo Sapiens
TRMKIFRNI

SEQ ID NO: 973200 - protein, 9 aa, Homo Sapiens
DRFSNSMEF

SEQ ID NO: 973201 - protein, 9 aa, Homo Sapiens
LATSQGPAA

SEQ ID NO: 973202 - protein, 9 aa, Homo Sapiens
TFLESSTSD

SEQ ID NO: 973203 - protein, 9 aa, Homo Sapiens
ETGTKGEKE

SEQ ID NO: 973204 - protein, 9 aa, Homo Sapiens
DSVVGESDR

SEQ ID NO: 973205 - protein, 9 aa, Homo Sapiens
LKGCEDQAR

SEQ ID NO: 973206 - protein, 9 aa, Homo Sapiens
SCFNELKVC

SEQ ID NO: 973207 - protein, 9 aa, Homo Sapiens
IQRSTHAGG

SEQ ID NO: 973208 - protein, 9 aa, Homo Sapiens
IHQSPHWRE

SEQ ID NO: 973209 - protein, 9 aa, Homo Sapiens
PFLDETIIK

SEQ ID NO: 973210 - protein, 9 aa, Homo Sapiens
SRSSSPYSR

SEQ ID NO: 973211 - protein, 9 aa, Homo Sapiens
QFGEKMMKR

SEQ ID NO: 973212 - protein, 9 aa, Homo Sapiens
LMASIERKY

SEQ ID NO: 973213 - protein, 9 aa, Homo Sapiens
LNPSGTDHV

SEQ ID NO: 973214 - protein, 9 aa, Homo Sapiens
GEDALCQYF

SEQ ID NO: 973215 - protein, 9 aa, Homo Sapiens
TSHTGEKPY

SEQ ID NO: 973216 - protein, 9 aa, Homo Sapiens
EPQAPFSSK

SEQ ID NO: 973217 - protein, 9 aa, Homo Sapiens
IFICDRNSH

SEQ ID NO: 973218 - protein, 9 aa, Homo Sapiens
EAKDLLSDN

SEQ ID NO: 973219 - protein, 9 aa, Homo Sapiens
LIALIPFWN

SEQ ID NO: 973220 - protein, 9 aa, Homo Sapiens
VGLGSIPGM

SEQ ID NO: 973221 - protein, 9 aa, Homo Sapiens
ELNGLEFGN

SEQ ID NO: 973222 - protein, 9 aa, Homo Sapiens
EMSWARQPG

SEQ ID NO: 973223 - protein, 9 aa, Homo Sapiens
AIWKYLYQS

SEQ ID NO: 973224 - protein, 9 aa, Homo Sapiens
AVACHRQGE

SEQ ID NO: 973225 - protein, 9 aa, Homo Sapiens
LLSPTFRPE

SEQ ID NO: 973226 - protein, 9 aa, Homo Sapiens
ANPLATSQG

SEQ ID NO: 973227 - protein, 9 aa, Homo Sapiens
EGLNMFDVI

SEQ ID NO: 973228 - protein, 9 aa, Homo Sapiens
SIRIGRYRD

SEQ ID NO: 973229 - protein, 9 aa, Homo Sapiens
YFLGSTECF

SEQ ID NO: 973230 - protein, 9 aa, Homo Sapiens
EKEDFDSKE

SEQ ID NO: 973231 - protein, 9 aa, Homo Sapiens
RPEAPSGQT

SEQ ID NO: 973232 - protein, 9 aa, Homo Sapiens
CYVLVKLHD

SEQ ID NO: 973233 - protein, 9 aa, Homo Sapiens
LCPAAESRP

SEQ ID NO: 973234 - protein, 9 aa, Homo Sapiens
QREKKEESY

SEQ ID NO: 973235 - protein, 9 aa, Homo Sapiens
HAPFPSDVS

SEQ ID NO: 973236 - protein, 9 aa, Homo Sapiens
AKFILFSCL

SEQ ID NO: 973237 - protein, 9 aa, Homo Sapiens
GYDNRLQPG

SEQ ID NO: 973238 - protein, 9 aa, Homo Sapiens
FRIQVRLGE

SEQ ID NO: 973239 - protein, 9 aa, Homo Sapiens
EKPAETVSS

SEQ ID NO: 973240 - protein, 9 aa, Homo Sapiens
IWMSLKIIK

SEQ ID NO: 973241 - protein, 9 aa, Homo Sapiens
PLRLQFGRT

SEQ ID NO: 973242 - protein, 9 aa, Homo Sapiens
ICSESANHR

SEQ ID NO: 973243 - protein, 9 aa, Homo Sapiens
QMSPEPEVL

SEQ ID NO: 973244 - protein, 9 aa, Homo Sapiens
GWKLTFVIL

SEQ ID NO: 973245 - protein, 9 aa, Homo Sapiens
NLRAVGHHQ

SEQ ID NO: 973246 - protein, 9 aa, Homo Sapiens
KRNGPDGPH

SEQ ID NO: 973247 - protein, 9 aa, Homo Sapiens
ALSSSFLTE

SEQ ID NO: 973248 - protein, 9 aa, Homo Sapiens
HCSGMEKHR

SEQ ID NO: 973249 - protein, 9 aa, Homo Sapiens
WWINGQSLP

SEQ ID NO: 973250 - protein, 9 aa, Homo Sapiens
LRKAWAEAE

SEQ ID NO: 973251 - protein, 9 aa, Homo Sapiens
IRAHLPQDS

SEQ ID NO: 973252 - protein, 9 aa, Homo Sapiens
LEKARLVLL

SEQ ID NO: 973253 - protein, 9 aa, Homo Sapiens
LKSGAKCDA

SEQ ID NO: 973254 - protein, 9 aa, Homo Sapiens
KDSSRVGDS

SEQ ID NO: 973255 - protein, 9 aa, Homo Sapiens
NYGADAHFD

SEQ ID NO: 973256 - protein, 9 aa, Homo Sapiens
SVANMKAVP

SEQ ID NO: 973257 - protein, 9 aa, Homo Sapiens
CHFSISEAF

SEQ ID NO: 973258 - protein, 9 aa, Homo Sapiens
YNVSRNHNG

SEQ ID NO: 973259 - protein, 9 aa, Homo Sapiens
DRQGQLVEV

SEQ ID NO: 973260 - protein, 9 aa, Homo Sapiens
SLSENLLQP

SEQ ID NO: 973261 - protein, 9 aa, Homo Sapiens
VQTPDPSRP

SEQ ID NO: 973262 - protein, 9 aa, Homo Sapiens
NLLVMRTDR

SEQ ID NO: 973263 - protein, 9 aa, Homo Sapiens
YAEVGRALL

SEQ ID NO: 973264 - protein, 9 aa, Homo Sapiens
LKIIVDQKQ

SEQ ID NO: 973265 - protein, 9 aa, Homo Sapiens
VTTFVGLPQ

SEQ ID NO: 973266 - protein, 9 aa, Homo Sapiens
IEKKVMLCI

SEQ ID NO: 973267 - protein, 9 aa, Homo Sapiens
SIGDVTIAP

SEQ ID NO: 973268 - protein, 9 aa, Homo Sapiens
STAPPLSSP

SEQ ID NO: 973269 - protein, 9 aa, Homo Sapiens
QERKQASST

SEQ ID NO: 973270 - protein, 9 aa, Homo Sapiens
SSYMEIKGP

SEQ ID NO: 973271 - protein, 9 aa, Homo Sapiens
RNYPNNAKC

SEQ ID NO: 973272 - protein, 9 aa, Homo Sapiens
SDAESDSGK

SEQ ID NO: 973273 - protein, 9 aa, Homo Sapiens
IGLLAPSNC

SEQ ID NO: 973274 - protein, 9 aa, Homo Sapiens
MINATATIN

SEQ ID NO: 973275 - protein, 9 aa, Homo Sapiens
SGQYTHKFD

SEQ ID NO: 973276 - protein, 9 aa, Homo Sapiens
SYHRLLTCL

SEQ ID NO: 973277 - protein, 9 aa, Homo Sapiens
LNMFDVITD

SEQ ID NO: 973278 - protein, 9 aa, Homo Sapiens
VLVTTFVGL

SEQ ID NO: 973279 - protein, 9 aa, Homo Sapiens
PSMPVSVPA

SEQ ID NO: 973280 - protein, 9 aa, Homo Sapiens
LIHPFTGLI

SEQ ID NO: 973281 - protein, 9 aa, Homo Sapiens
PLDGPAREQ

SEQ ID NO: 973282 - protein, 9 aa, Homo Sapiens
SFCLKREGL

SEQ ID NO: 973283 - protein, 9 aa, Homo Sapiens
FAFFSFFTH

SEQ ID NO: 973284 - protein, 9 aa, Homo Sapiens
GMGKPELHG

SEQ ID NO: 973285 - protein, 9 aa, Homo Sapiens
YSTVINSRA

SEQ ID NO: 973286 - protein, 9 aa, Homo Sapiens
YKEGDLQKE

SEQ ID NO: 973287 - protein, 9 aa, Homo Sapiens
FWYGCWGFW

SEQ ID NO: 973288 - protein, 9 aa, Homo Sapiens
YQLQSFKPH

SEQ ID NO: 973289 - protein, 9 aa, Homo Sapiens
TETLSWPAP

SEQ ID NO: 973290 - protein, 9 aa, Homo Sapiens
SERIKNQKV

SEQ ID NO: 973291 - protein, 9 aa, Homo Sapiens
MLWCSTMPN

SEQ ID NO: 973292 - protein, 9 aa, Homo Sapiens
ESDSGKLSQ

SEQ ID NO: 973293 - protein, 9 aa, Homo Sapiens
QEGLICSRV

SEQ ID NO: 973294 - protein, 9 aa, Homo Sapiens
DFFQGRQKS

SEQ ID NO: 973295 - protein, 9 aa, Homo Sapiens
LSTLQRERM

SEQ ID NO: 973296 - protein, 9 aa, Homo Sapiens
VTAIIASFN

SEQ ID NO: 973297 - protein, 9 aa, Homo Sapiens
RNWVLAGLY

SEQ ID NO: 973298 - protein, 9 aa, Homo Sapiens
GLQWVGELM

SEQ ID NO: 973299 - protein, 9 aa, Homo Sapiens
PPRGPLNLD

SEQ ID NO: 973300 - protein, 9 aa, Homo Sapiens
TLMAPTFLL

SEQ ID NO: 973301 - protein, 9 aa, Homo Sapiens
GGKATSLDA

SEQ ID NO: 973302 - protein, 9 aa, Homo Sapiens
LRSSSSPSG

SEQ ID NO: 973303 - protein, 9 aa, Homo Sapiens
SCEFCEPLH

SEQ ID NO: 973304 - protein, 9 aa, Homo Sapiens
ETHSRGEGS

SEQ ID NO: 973305 - protein, 9 aa, Homo Sapiens
EQSRRDNLE

SEQ ID NO: 973306 - protein, 9 aa, Homo Sapiens
SLKPGVPLP

SEQ ID NO: 973307 - protein, 9 aa, Homo Sapiens
DEEMKSGDP

SEQ ID NO: 973308 - protein, 9 aa, Homo Sapiens
VMRTDRRFD

SEQ ID NO: 973309 - protein, 9 aa, Homo Sapiens
KYLYQSPTD

SEQ ID NO: 973310 - protein, 9 aa, Homo Sapiens
RNLRPWWKN

SEQ ID NO: 973311 - protein, 9 aa, Homo Sapiens
FLTILAKVY

SEQ ID NO: 973312 - protein, 9 aa, Homo Sapiens
TCVMKGKDI

SEQ ID NO: 973313 - protein, 9 aa, Homo Sapiens
SVILNREIQ

SEQ ID NO: 973314 - protein, 9 aa, Homo Sapiens
IVQEENPNE

SEQ ID NO: 973315 - protein, 9 aa, Homo Sapiens
LRAVTKKTF

SEQ ID NO: 973316 - protein, 9 aa, Homo Sapiens
SQAYIFYYN

SEQ ID NO: 973317 - protein, 9 aa, Homo Sapiens
SVTKNMFCA

SEQ ID NO: 973318 - protein, 9 aa, Homo Sapiens
LTSDLEKQI

SEQ ID NO: 973319 - protein, 9 aa, Homo Sapiens
TAHQRCPRE

SEQ ID NO: 973320 - protein, 9 aa, Homo Sapiens
VIQKSVGPA

SEQ ID NO: 973321 - protein, 9 aa, Homo Sapiens
VCDQKWLAM

SEQ ID NO: 973322 - protein, 9 aa, Homo Sapiens
HKCRSLRAT

SEQ ID NO: 973323 - protein, 9 aa, Homo Sapiens
YLGIAVSKP

SEQ ID NO: 973324 - protein, 9 aa, Homo Sapiens
AAYCPASVV

SEQ ID NO: 973325 - protein, 9 aa, Homo Sapiens
DEETHSRGE

SEQ ID NO: 973326 - protein, 9 aa, Homo Sapiens
IRIGRYRDH

SEQ ID NO: 973327 - protein, 9 aa, Homo Sapiens
VTFDHEHHS

SEQ ID NO: 973328 - protein, 9 aa, Homo Sapiens
NRMAVSQDD

SEQ ID NO: 973329 - protein, 9 aa, Homo Sapiens
PLQYSTVIN

SEQ ID NO: 973330 - protein, 9 aa, Homo Sapiens
FTLKRYEGV

SEQ ID NO: 973331 - protein, 9 aa, Homo Sapiens
IDEVIIEQL

SEQ ID NO: 973332 - protein, 9 aa, Homo Sapiens
RKNVGDLML

SEQ ID NO: 973333 - protein, 9 aa, Homo Sapiens
DLRDGYNLI

SEQ ID NO: 973334 - protein, 9 aa, Homo Sapiens
RGHHVFCQQ

SEQ ID NO: 973335 - protein, 9 aa, Homo Sapiens
TTIRIINLQ

SEQ ID NO: 973336 - protein, 9 aa, Homo Sapiens
QPGGDTSSV

SEQ ID NO: 973337 - protein, 9 aa, Homo Sapiens
NDIEQWFTE

SEQ ID NO: 973338 - protein, 9 aa, Homo Sapiens
GAHVYEKRH

SEQ ID NO: 973339 - protein, 9 aa, Homo Sapiens
ERWCTTRAP

SEQ ID NO: 973340 - protein, 9 aa, Homo Sapiens
KRNSPLTVS

SEQ ID NO: 973341 - protein, 9 aa, Homo Sapiens
AAALELLSD

SEQ ID NO: 973342 - protein, 9 aa, Homo Sapiens
LKAFRICSE

SEQ ID NO: 973343 - protein, 9 aa, Homo Sapiens
PLSPSRRFG

SEQ ID NO: 973344 - protein, 9 aa, Homo Sapiens
REYDKDRNL

SEQ ID NO: 973345 - protein, 9 aa, Homo Sapiens
SCKNNMFAQ

SEQ ID NO: 973346 - protein, 9 aa, Homo Sapiens
LVILPIIIY

SEQ ID NO: 973347 - protein, 9 aa, Homo Sapiens
PLLWATASV

SEQ ID NO: 973348 - protein, 9 aa, Homo Sapiens
PALPFPGPG

SEQ ID NO: 973349 - protein, 9 aa, Homo Sapiens
HPLFLRREP

SEQ ID NO: 973350 - protein, 9 aa, Homo Sapiens
EKKVMLCIQ

SEQ ID NO: 973351 - protein, 9 aa, Homo Sapiens
TPTWVSSSA

SEQ ID NO: 973352 - protein, 9 aa, Homo Sapiens
CVCPPERRL

SEQ ID NO: 973353 - protein, 9 aa, Homo Sapiens
TETGNACCS

SEQ ID NO: 973354 - protein, 9 aa, Homo Sapiens
VTVGLGRTK

SEQ ID NO: 973355 - protein, 9 aa, Homo Sapiens
TLRTIFSNI

SEQ ID NO: 973356 - protein, 9 aa, Homo Sapiens
KNICSTFFS

SEQ ID NO: 973357 - protein, 9 aa, Homo Sapiens
TIPCYTGPG

SEQ ID NO: 973358 - protein, 9 aa, Homo Sapiens
PSGTDHVTV

SEQ ID NO: 973359 - protein, 9 aa, Homo Sapiens
CEPASIGYN

SEQ ID NO: 973360 - protein, 9 aa, Homo Sapiens
PERRLHWNG

SEQ ID NO: 973361 - protein, 9 aa, Homo Sapiens
MAHRMQKKI

SEQ ID NO: 973362 - protein, 9 aa, Homo Sapiens
NGTVVPDSP

SEQ ID NO: 973363 - protein, 9 aa, Homo Sapiens
CVTEPDGRV

SEQ ID NO: 973364 - protein, 9 aa, Homo Sapiens
PGAMFSESS

SEQ ID NO: 973365 - protein, 9 aa, Homo Sapiens
SAKEKKSSF

SEQ ID NO: 973366 - protein, 9 aa, Homo Sapiens
DAEERKVVV

SEQ ID NO: 973367 - protein, 9 aa, Homo Sapiens
GVQWRDLSL

SEQ ID NO: 973368 - protein, 9 aa, Homo Sapiens
QVFHEKPPD

SEQ ID NO: 973369 - protein, 9 aa, Homo Sapiens
DLIREGGSI

SEQ ID NO: 973370 - protein, 9 aa, Homo Sapiens
EEDTRLYSC

SEQ ID NO: 973371 - protein, 9 aa, Homo Sapiens
SLFIFGYCW

SEQ ID NO: 973372 - protein, 9 aa, Homo Sapiens
KSKKKSSSR

SEQ ID NO: 973373 - protein, 9 aa, Homo Sapiens
HVNPQRWGF

SEQ ID NO: 973374 - protein, 9 aa, Homo Sapiens
PPRDEAQGP

SEQ ID NO: 973375 - protein, 9 aa, Homo Sapiens
LHRAHCFLS

SEQ ID NO: 973376 - protein, 9 aa, Homo Sapiens
RRCVENAGG

SEQ ID NO: 973377 - protein, 9 aa, Homo Sapiens
GYNIGDVQV

SEQ ID NO: 973378 - protein, 9 aa, Homo Sapiens
TFLNDPVCP

SEQ ID NO: 973379 - protein, 9 aa, Homo Sapiens
EKNIMRANF

SEQ ID NO: 973380 - protein, 9 aa, Homo Sapiens
DSVFDSIPA

SEQ ID NO: 973381 - protein, 9 aa, Homo Sapiens
AIGPTETLS

SEQ ID NO: 973382 - protein, 9 aa, Homo Sapiens
KEETISSSL

SEQ ID NO: 973383 - protein, 9 aa, Homo Sapiens
VEDNIFQHF

SEQ ID NO: 973384 - protein, 9 aa, Homo Sapiens
TAVKMRCNS

SEQ ID NO: 973385 - protein, 9 aa, Homo Sapiens
PENLDSFFR

SEQ ID NO: 973386 - protein, 9 aa, Homo Sapiens
MKDTSCKNN

SEQ ID NO: 973387 - protein, 9 aa, Homo Sapiens
IRERSVRVW

SEQ ID NO: 973388 - protein, 9 aa, Homo Sapiens
QRNLSSSTE

SEQ ID NO: 973389 - protein, 9 aa, Homo Sapiens
HQVSRVFWE

SEQ ID NO: 973390 - protein, 9 aa, Homo Sapiens
SPTKMDLLY

SEQ ID NO: 973391 - protein, 9 aa, Homo Sapiens
LSMIRDWLR

SEQ ID NO: 973392 - protein, 9 aa, Homo Sapiens
AIIASFNIT

SEQ ID NO: 973393 - protein, 9 aa, Homo Sapiens
THFIVVALF

SEQ ID NO: 973394 - protein, 9 aa, Homo Sapiens
IPIEDKDFI

SEQ ID NO: 973395 - protein, 9 aa, Homo Sapiens
RPKSPSFGS

SEQ ID NO: 973396 - protein, 9 aa, Homo Sapiens
GMFFNPDLY

SEQ ID NO: 973397 - protein, 9 aa, Homo Sapiens
WAKYSNGDC

SEQ ID NO: 973398 - protein, 9 aa, Homo Sapiens
DRSISYSRC

SEQ ID NO: 973399 - protein, 9 aa, Homo Sapiens
YLGMTNPEV

SEQ ID NO: 973400 - protein, 9 aa, Homo Sapiens
QPDSRKFGC

SEQ ID NO: 973401 - protein, 9 aa, Homo Sapiens
RDRSISYSR

SEQ ID NO: 973402 - protein, 9 aa, Homo Sapiens
IQAFALGQK

SEQ ID NO: 973403 - protein, 9 aa, Homo Sapiens
RAVGHHQFL

SEQ ID NO: 973404 - protein, 9 aa, Homo Sapiens
IAMIFYLLK

SEQ ID NO: 973405 - protein, 9 aa, Homo Sapiens
DVFSVDNKK

SEQ ID NO: 973406 - protein, 9 aa, Homo Sapiens
PLEGKKVDE

SEQ ID NO: 973407 - protein, 9 aa, Homo Sapiens
FICDRNSHG

SEQ ID NO: 973408 - protein, 9 aa, Homo Sapiens
EASQVVSME

SEQ ID NO: 973409 - protein, 9 aa, Homo Sapiens
LVMRTDRRF

SEQ ID NO: 973410 - protein, 9 aa, Homo Sapiens
FKPHTAHQR

SEQ ID NO: 973411 - protein, 9 aa, Homo Sapiens
PEFDPRTPW

SEQ ID NO: 973412 - protein, 9 aa, Homo Sapiens
SSMFERETQ

SEQ ID NO: 973413 - protein, 9 aa, Homo Sapiens
KRAFSSFVI

SEQ ID NO: 973414 - protein, 9 aa, Homo Sapiens
LNFNKKCDT

SEQ ID NO: 973415 - protein, 9 aa, Homo Sapiens
SKGGGNQIS

SEQ ID NO: 973416 - protein, 9 aa, Homo Sapiens
VLTFTCKPK

SEQ ID NO: 973417 - protein, 9 aa, Homo Sapiens
YFSPSRASV

SEQ ID NO: 973418 - protein, 9 aa, Homo Sapiens
YDNRLQPGL

SEQ ID NO: 973419 - protein, 9 aa, Homo Sapiens
KQHMLIHSE

SEQ ID NO: 973420 - protein, 9 aa, Homo Sapiens
GSAQPVAFS

SEQ ID NO: 973421 - protein, 9 aa, Homo Sapiens
PQREPQRNL

SEQ ID NO: 973422 - protein, 9 aa, Homo Sapiens
SVFQMLQRC

SEQ ID NO: 973423 - protein, 9 aa, Homo Sapiens
AKLSAKHTS

SEQ ID NO: 973424 - protein, 9 aa, Homo Sapiens
YDGESIENC

SEQ ID NO: 973425 - protein, 9 aa, Homo Sapiens
GNIKVSHTS

SEQ ID NO: 973426 - protein, 9 aa, Homo Sapiens
DQKMRKAET

SEQ ID NO: 973427 - protein, 9 aa, Homo Sapiens
PLKVAHDLS

SEQ ID NO: 973428 - protein, 9 aa, Homo Sapiens
LQFRPGYNG

SEQ ID NO: 973429 - protein, 9 aa, Homo Sapiens
TEFLLNTYC

SEQ ID NO: 973430 - protein, 9 aa, Homo Sapiens
SQVEARSSS

SEQ ID NO: 973431 - protein, 9 aa, Homo Sapiens
RLYGPSFIL

SEQ ID NO: 973432 - protein, 9 aa, Homo Sapiens
RGGLLKGMR

SEQ ID NO: 973433 - protein, 9 aa, Homo Sapiens
LDQLKTLRR

SEQ ID NO: 973434 - protein, 9 aa, Homo Sapiens
ENDVREVVD

SEQ ID NO: 973435 - protein, 9 aa, Homo Sapiens
MEIKGPPSG

SEQ ID NO: 973436 - protein, 9 aa, Homo Sapiens
SFKPHTAHQ

SEQ ID NO: 973437 - protein, 9 aa, Homo Sapiens
NETGPYQCK

SEQ ID NO: 973438 - protein, 9 aa, Homo Sapiens
RESTSTNAI

SEQ ID NO: 973439 - protein, 9 aa, Homo Sapiens
YVRKDGNLC

SEQ ID NO: 973440 - protein, 9 aa, Homo Sapiens
PLPPGTPMA

SEQ ID NO: 973441 - protein, 9 aa, Homo Sapiens
LSEPQYQLQ

SEQ ID NO: 973442 - protein, 9 aa, Homo Sapiens
GYIPELKYG

SEQ ID NO: 973443 - protein, 9 aa, Homo Sapiens
DDAGIKYSV

SEQ ID NO: 973444 - protein, 9 aa, Homo Sapiens
DELDQKMRK

SEQ ID NO: 973445 - protein, 9 aa, Homo Sapiens
LQHQHRGLR

SEQ ID NO: 973446 - protein, 9 aa, Homo Sapiens
EIKGPPSGS

SEQ ID NO: 973447 - protein, 9 aa, Homo Sapiens
QTYFYRASL

SEQ ID NO: 973448 - protein, 9 aa, Homo Sapiens
MLCAGRRTG

SEQ ID NO: 973449 - protein, 9 aa, Homo Sapiens
SRGEGSSGG

SEQ ID NO: 973450 - protein, 9 aa, Homo Sapiens
HEQEKIWVE

SEQ ID NO: 973451 - protein, 9 aa, Homo Sapiens
QSNISKVQK

SEQ ID NO: 973452 - protein, 9 aa, Homo Sapiens
CSISRSLPF

SEQ ID NO: 973453 - protein, 9 aa, Homo Sapiens
RSSFTTDTA

SEQ ID NO: 973454 - protein, 9 aa, Homo Sapiens
KEKRTLLEK

SEQ ID NO: 973455 - protein, 9 aa, Homo Sapiens
YFAAFLLND

SEQ ID NO: 973456 - protein, 9 aa, Homo Sapiens
YLIYLDPTH

SEQ ID NO: 973457 - protein, 9 aa, Homo Sapiens
RSRGTGSAQ

SEQ ID NO: 973458 - protein, 9 aa, Homo Sapiens
GPGQRVRHR

SEQ ID NO: 973459 - protein, 9 aa, Homo Sapiens
LSRLNGATF

SEQ ID NO: 973460 - protein, 9 aa, Homo Sapiens
LTVSMFLSL

SEQ ID NO: 973461 - protein, 9 aa, Homo Sapiens
GVELEIEDK

SEQ ID NO: 973462 - protein, 9 aa, Homo Sapiens
SGVISITMG

SEQ ID NO: 973463 - protein, 9 aa, Homo Sapiens
TKKTFSLYP

SEQ ID NO: 973464 - protein, 9 aa, Homo Sapiens
PLPANALVA

SEQ ID NO: 973465 - protein, 9 aa, Homo Sapiens
NLQHAALMA

SEQ ID NO: 973466 - protein, 9 aa, Homo Sapiens
SDSGKLSQL

SEQ ID NO: 973467 - protein, 9 aa, Homo Sapiens
GTVESPRFP

SEQ ID NO: 973468 - protein, 9 aa, Homo Sapiens
RANCRKQEN

SEQ ID NO: 973469 - protein, 9 aa, Homo Sapiens
KIWVEEKRQ

SEQ ID NO: 973470 - protein, 9 aa, Homo Sapiens
CQNNLHYLN

SEQ ID NO: 973471 - protein, 9 aa, Homo Sapiens
TQWNLVCDQ

SEQ ID NO: 973472 - protein, 9 aa, Homo Sapiens
TCSLFITTR

SEQ ID NO: 973473 - protein, 9 aa, Homo Sapiens
SGAGMALAA

SEQ ID NO: 973474 - protein, 9 aa, Homo Sapiens
KDSGNKPLG

SEQ ID NO: 973475 - protein, 9 aa, Homo Sapiens
LHTKPEPPE

SEQ ID NO: 973476 - protein, 9 aa, Homo Sapiens
DCGVYTPQR

SEQ ID NO: 973477 - protein, 9 aa, Homo Sapiens
PLNDMVQSN

SEQ ID NO: 973478 - protein, 9 aa, Homo Sapiens
PRPPSHGSP

SEQ ID NO: 973479 - protein, 9 aa, Homo Sapiens
GPHLPLKAL

SEQ ID NO: 973480 - protein, 9 aa, Homo Sapiens
KSPSFGSGG

SEQ ID NO: 973481 - protein, 9 aa, Homo Sapiens
YMDGKKNFT

SEQ ID NO: 973482 - protein, 9 aa, Homo Sapiens
HYPNGIVTE

SEQ ID NO: 973483 - protein, 9 aa, Homo Sapiens
LLKKKLEKH

SEQ ID NO: 973484 - protein, 9 aa, Homo Sapiens
MAKGTTGYK

SEQ ID NO: 973485 - protein, 9 aa, Homo Sapiens
SSLNKTDVI

SEQ ID NO: 973486 - protein, 9 aa, Homo Sapiens
DLELNGLEF

SEQ ID NO: 973487 - protein, 9 aa, Homo Sapiens
LQITAPLPP

SEQ ID NO: 973488 - protein, 9 aa, Homo Sapiens
KFGCAKTLY

SEQ ID NO: 973489 - protein, 9 aa, Homo Sapiens
QSVEVDING

SEQ ID NO: 973490 - protein, 9 aa, Homo Sapiens
ERIFAHNSV

SEQ ID NO: 973491 - protein, 9 aa, Homo Sapiens
SRRIGFYFG

SEQ ID NO: 973492 - protein, 9 aa, Homo Sapiens
HYEKNMRDL

SEQ ID NO: 973493 - protein, 9 aa, Homo Sapiens
IPEAIYGTS

SEQ ID NO: 973494 - protein, 9 aa, Homo Sapiens
CSEDYDSYR

SEQ ID NO: 973495 - protein, 9 aa, Homo Sapiens
DNKKLQGGF

SEQ ID NO: 973496 - protein, 9 aa, Homo Sapiens
IKTKKKMNN

SEQ ID NO: 973497 - protein, 9 aa, Homo Sapiens
IEKHKEEHG

SEQ ID NO: 973498 - protein, 9 aa, Homo Sapiens
MSPEPEVLS

SEQ ID NO: 973499 - protein, 9 aa, Homo Sapiens
QSPHWRETL

SEQ ID NO: 973500 - protein, 9 aa, Homo Sapiens
WPAMKFKRG

SEQ ID NO: 973501 - protein, 9 aa, Homo Sapiens
LTILAKVYP

SEQ ID NO: 973502 - protein, 9 aa, Homo Sapiens
EKARLVLLK

SEQ ID NO: 973503 - protein, 9 aa, Homo Sapiens
RSSRNNYVL

SEQ ID NO: 973504 - protein, 9 aa, Homo Sapiens
IATENFSAV

SEQ ID NO: 973505 - protein, 9 aa, Homo Sapiens
QNSARNFGA

SEQ ID NO: 973506 - protein, 9 aa, Homo Sapiens
AAGIETRGI

SEQ ID NO: 973507 - protein, 9 aa, Homo Sapiens
LSKLKAGGH

SEQ ID NO: 973508 - protein, 9 aa, Homo Sapiens
RIPKPNQNI

SEQ ID NO: 973509 - protein, 9 aa, Homo Sapiens
IYNVSRNHN

SEQ ID NO: 973510 - protein, 9 aa, Homo Sapiens
CPICKKEFE

SEQ ID NO: 973511 - protein, 9 aa, Homo Sapiens
WEFLPKNCK

SEQ ID NO: 973512 - protein, 9 aa, Homo Sapiens
PEAPSGQTV

SEQ ID NO: 973513 - protein, 9 aa, Homo Sapiens
INGQSLPMT

SEQ ID NO: 973514 - protein, 9 aa, Homo Sapiens
TEFQRSQTD

SEQ ID NO: 973515 - protein, 9 aa, Homo Sapiens
IGKPDMAYC

SEQ ID NO: 973516 - protein, 9 aa, Homo Sapiens
RHHEETVLP

SEQ ID NO: 973517 - protein, 9 aa, Homo Sapiens
GEWNDVLCN

SEQ ID NO: 973518 - protein, 9 aa, Homo Sapiens
ALLYSETAD

SEQ ID NO: 973519 - protein, 9 aa, Homo Sapiens
LDVFSVDNK

SEQ ID NO: 973520 - protein, 9 aa, Homo Sapiens
PQGPLGPQG

SEQ ID NO: 973521 - protein, 9 aa, Homo Sapiens
GLRMLSKGL

SEQ ID NO: 973522 - protein, 9 aa, Homo Sapiens
MPKHPNSLT

SEQ ID NO: 973523 - protein, 9 aa, Homo Sapiens
KNPQVPLDG

SEQ ID NO: 973524 - protein, 9 aa, Homo Sapiens
SFVILDNHL

SEQ ID NO: 973525 - protein, 9 aa, Homo Sapiens
KCLSLNNFS

SEQ ID NO: 973526 - protein, 9 aa, Homo Sapiens
REGHALPQS

SEQ ID NO: 973527 - protein, 9 aa, Homo Sapiens
KNVGDLMLS

SEQ ID NO: 973528 - protein, 9 aa, Homo Sapiens
QVTKDSGVG

SEQ ID NO: 973529 - protein, 9 aa, Homo Sapiens
KSGDPQETL

SEQ ID NO: 973530 - protein, 9 aa, Homo Sapiens
LGAWRGVLF

SEQ ID NO: 973531 - protein, 9 aa, Homo Sapiens
VTYNNEGGG

SEQ ID NO: 973532 - protein, 9 aa, Homo Sapiens
TIPFSVPNK

SEQ ID NO: 973533 - protein, 9 aa, Homo Sapiens
RFWDPGTAA

SEQ ID NO: 973534 - protein, 9 aa, Homo Sapiens
AEKEDFDSK

SEQ ID NO: 973535 - protein, 9 aa, Homo Sapiens
DYMDGKKNF

SEQ ID NO: 973536 - protein, 9 aa, Homo Sapiens
LSSTGKKAP

SEQ ID NO: 973537 - protein, 9 aa, Homo Sapiens
KLLSKLKAG

SEQ ID NO: 973538 - protein, 9 aa, Homo Sapiens
PSALSSSFL

SEQ ID NO: 973539 - protein, 9 aa, Homo Sapiens
EDSEAESTK

SEQ ID NO: 973540 - protein, 9 aa, Homo Sapiens
ILDTAGKEE

SEQ ID NO: 973541 - protein, 9 aa, Homo Sapiens
APKTQRLRW

SEQ ID NO: 973542 - protein, 9 aa, Homo Sapiens
SNGTVVPDS

SEQ ID NO: 973543 - protein, 9 aa, Homo Sapiens
DKGPPGLVG

SEQ ID NO: 973544 - protein, 9 aa, Homo Sapiens
ASVIFICDR

SEQ ID NO: 973545 - protein, 9 aa, Homo Sapiens
KCFSLAATW

SEQ ID NO: 973546 - protein, 9 aa, Homo Sapiens
ETIIKSRNN

SEQ ID NO: 973547 - protein, 9 aa, Homo Sapiens
AEFLLPAIF

SEQ ID NO: 973548 - protein, 9 aa, Homo Sapiens
QPCLLNKNC

SEQ ID NO: 973549 - protein, 9 aa, Homo Sapiens
KIYVEIKFT

SEQ ID NO: 973550 - protein, 9 aa, Homo Sapiens
PEDLNTVLE

SEQ ID NO: 973551 - protein, 9 aa, Homo Sapiens
LGASSSELL

SEQ ID NO: 973552 - protein, 9 aa, Homo Sapiens
NDPFRAETI

SEQ ID NO: 973553 - protein, 9 aa, Homo Sapiens
LRIPKPNQN

SEQ ID NO: 973554 - protein, 9 aa, Homo Sapiens
LSENKSIFY

SEQ ID NO: 973555 - protein, 9 aa, Homo Sapiens
FYQEIMERS

SEQ ID NO: 973556 - protein, 9 aa, Homo Sapiens
NGRLKLGWQ

SEQ ID NO: 973557 - protein, 9 aa, Homo Sapiens
ESPMLQITA

SEQ ID NO: 973558 - protein, 9 aa, Homo Sapiens
PLENKETKV

SEQ ID NO: 973559 - protein, 9 aa, Homo Sapiens
PGSPPMLTE

SEQ ID NO: 973560 - protein, 9 aa, Homo Sapiens
RASKLVPVG

SEQ ID NO: 973561 - protein, 9 aa, Homo Sapiens
TLPQRFHTG

SEQ ID NO: 973562 - protein, 9 aa, Homo Sapiens
CSGNVFRHF

SEQ ID NO: 973563 - protein, 9 aa, Homo Sapiens
EGFSKFKEN

SEQ ID NO: 973564 - protein, 9 aa, Homo Sapiens
YEKNMRDLM

SEQ ID NO: 973565 - protein, 9 aa, Homo Sapiens
FSSRTIEIC

SEQ ID NO: 973566 - protein, 9 aa, Homo Sapiens
MKGTQRDLE

SEQ ID NO: 973567 - protein, 9 aa, Homo Sapiens
KCKLSNLII

SEQ ID NO: 973568 - protein, 9 aa, Homo Sapiens
GKAFIYSSL

SEQ ID NO: 973569 - protein, 9 aa, Homo Sapiens
AASATCCLW

SEQ ID NO: 973570 - protein, 9 aa, Homo Sapiens
DQEQEVCFA

SEQ ID NO: 973571 - protein, 9 aa, Homo Sapiens
PILIFLKHG

SEQ ID NO: 973572 - protein, 9 aa, Homo Sapiens
RYEGVPAIT

SEQ ID NO: 973573 - protein, 9 aa, Homo Sapiens
PGRPVSAGN

SEQ ID NO: 973574 - protein, 9 aa, Homo Sapiens
VFFHGDLRR

SEQ ID NO: 973575 - protein, 9 aa, Homo Sapiens
SGLTIEKFW

SEQ ID NO: 973576 - protein, 9 aa, Homo Sapiens
QKVEHALSS

SEQ ID NO: 973577 - protein, 9 aa, Homo Sapiens
RKKDLCRKI

SEQ ID NO: 973578 - protein, 9 aa, Homo Sapiens
FLSPVLYFE

SEQ ID NO: 973579 - protein, 9 aa, Homo Sapiens
ILELAGNGS

SEQ ID NO: 973580 - protein, 9 aa, Homo Sapiens
RRVAQLCGA

SEQ ID NO: 973581 - protein, 9 aa, Homo Sapiens
NMKAVPAAS

SEQ ID NO: 973582 - protein, 9 aa, Homo Sapiens
LKLGWQMPP

SEQ ID NO: 973583 - protein, 9 aa, Homo Sapiens
FPPGPNYGA

SEQ ID NO: 973584 - protein, 9 aa, Homo Sapiens
EVVAAPGSS

SEQ ID NO: 973585 - protein, 9 aa, Homo Sapiens
LGVLRCYCP

SEQ ID NO: 973586 - protein, 9 aa, Homo Sapiens
AKDVTVRTL

SEQ ID NO: 973587 - protein, 9 aa, Homo Sapiens
TFTYHKKTH

SEQ ID NO: 973588 - protein, 9 aa, Homo Sapiens
SPNDIEQWF

SEQ ID NO: 973589 - protein, 9 aa, Homo Sapiens
SFPHNFVLL

SEQ ID NO: 973590 - protein, 9 aa, Homo Sapiens
PTFNLIIYS

SEQ ID NO: 973591 - protein, 9 aa, Homo Sapiens
NNKECRKVF

SEQ ID NO: 973592 - protein, 9 aa, Homo Sapiens
LSDGSFSSR

SEQ ID NO: 973593 - protein, 9 aa, Homo Sapiens
TSRGRGRGG

SEQ ID NO: 973594 - protein, 9 aa, Homo Sapiens
SESIWAKYS

SEQ ID NO: 973595 - protein, 9 aa, Homo Sapiens
YLQESSRRA

SEQ ID NO: 973596 - protein, 9 aa, Homo Sapiens
QRFLRTMGA

SEQ ID NO: 973597 - protein, 9 aa, Homo Sapiens
SVHQTSSPL

SEQ ID NO: 973598 - protein, 9 aa, Homo Sapiens
ALCQYFSNE

SEQ ID NO: 973599 - protein, 9 aa, Homo Sapiens
DEIGLDLEN

SEQ ID NO: 973600 - protein, 9 aa, Homo Sapiens
VIKEENLQK

SEQ ID NO: 973601 - protein, 9 aa, Homo Sapiens
SKNSGKSGQ

SEQ ID NO: 973602 - protein, 9 aa, Homo Sapiens
CFEEETDDI

SEQ ID NO: 973603 - protein, 9 aa, Homo Sapiens
SFSSRHTTL

SEQ ID NO: 973604 - protein, 9 aa, Homo Sapiens
QFLEVYVGK

SEQ ID NO: 973605 - protein, 9 aa, Homo Sapiens
QKDKDNFSP

SEQ ID NO: 973606 - protein, 9 aa, Homo Sapiens
AQAQTKVTW

SEQ ID NO: 973607 - protein, 9 aa, Homo Sapiens
CRSSNKETF

SEQ ID NO: 973608 - protein, 9 aa, Homo Sapiens
THSRGEGSS

SEQ ID NO: 973609 - protein, 9 aa, Homo Sapiens
VTFEEGTLI

SEQ ID NO: 973610 - protein, 9 aa, Homo Sapiens
HAEDIPNTD

SEQ ID NO: 973611 - protein, 9 aa, Homo Sapiens
SSSLNKTDV

SEQ ID NO: 973612 - protein, 9 aa, Homo Sapiens
ANSVGTSFS

SEQ ID NO: 973613 - protein, 9 aa, Homo Sapiens
KKEEEETPP

SEQ ID NO: 973614 - protein, 9 aa, Homo Sapiens
LIREGGSIP

SEQ ID NO: 973615 - protein, 9 aa, Homo Sapiens
RRHETSHTG

SEQ ID NO: 973616 - protein, 9 aa, Homo Sapiens
SRNNYVLTQ

SEQ ID NO: 973617 - protein, 9 aa, Homo Sapiens
AQQTFKVPD

SEQ ID NO: 973618 - protein, 9 aa, Homo Sapiens
GRNLFKVEL

SEQ ID NO: 973619 - protein, 9 aa, Homo Sapiens
EFNNLLVMR

SEQ ID NO: 973620 - protein, 9 aa, Homo Sapiens
RTQESLAEK

SEQ ID NO: 973621 - protein, 9 aa, Homo Sapiens
EALKRYSEQ

SEQ ID NO: 973622 - protein, 9 aa, Homo Sapiens
LALLYSETA

SEQ ID NO: 973623 - protein, 9 aa, Homo Sapiens
APAFAQTSY

SEQ ID NO: 973624 - protein, 9 aa, Homo Sapiens
DLEPGTMNS

SEQ ID NO: 973625 - protein, 9 aa, Homo Sapiens
SQSEQTTTS

SEQ ID NO: 973626 - protein, 9 aa, Homo Sapiens
VHIESWSLG

SEQ ID NO: 973627 - protein, 9 aa, Homo Sapiens
AMCVNLTLT

SEQ ID NO: 973628 - protein, 9 aa, Homo Sapiens
SLETHNKIP

SEQ ID NO: 973629 - protein, 9 aa, Homo Sapiens
YHCSGMEKH

SEQ ID NO: 973630 - protein, 9 aa, Homo Sapiens
HDPDTAIPA

SEQ ID NO: 973631 - protein, 9 aa, Homo Sapiens
EESCGSLSE

SEQ ID NO: 973632 - protein, 9 aa, Homo Sapiens
DLKEELTEA

SEQ ID NO: 973633 - protein, 9 aa, Homo Sapiens
LFLVEIYKQ

SEQ ID NO: 973634 - protein, 9 aa, Homo Sapiens
FFWYGCWGF

SEQ ID NO: 973635 - protein, 9 aa, Homo Sapiens
HGRIPYLGM

SEQ ID NO: 973636 - protein, 9 aa, Homo Sapiens
LFGLLSPRV

SEQ ID NO: 973637 - protein, 9 aa, Homo Sapiens
THNKIPYES

SEQ ID NO: 973638 - protein, 9 aa, Homo Sapiens
DEPVNWAAA

SEQ ID NO: 973639 - protein, 9 aa, Homo Sapiens
IGRYRDHFA

SEQ ID NO: 973640 - protein, 9 aa, Homo Sapiens
ASADAKKNP

SEQ ID NO: 973641 - protein, 9 aa, Homo Sapiens
TERTEPDHQ

SEQ ID NO: 973642 - protein, 9 aa, Homo Sapiens
ITPKPVLQE

SEQ ID NO: 973643 - protein, 9 aa, Homo Sapiens
TMTKLTRGG

SEQ ID NO: 973644 - protein, 9 aa, Homo Sapiens
ESSRRAELP

SEQ ID NO: 973645 - protein, 9 aa, Homo Sapiens
TFHVLVFTL

SEQ ID NO: 973646 - protein, 9 aa, Homo Sapiens
LKKKLEKHL

SEQ ID NO: 973647 - protein, 9 aa, Homo Sapiens
HMLIHSEIK

SEQ ID NO: 973648 - protein, 9 aa, Homo Sapiens
LVRNKANAT

SEQ ID NO: 973649 - protein, 9 aa, Homo Sapiens
KDKLEFQKR

SEQ ID NO: 973650 - protein, 9 aa, Homo Sapiens
MQVLESKGR

SEQ ID NO: 973651 - protein, 9 aa, Homo Sapiens
QRHLENLEE

SEQ ID NO: 973652 - protein, 9 aa, Homo Sapiens
AAAPPPKRE

SEQ ID NO: 973653 - protein, 9 aa, Homo Sapiens
VKNICSTFF

SEQ ID NO: 973654 - protein, 9 aa, Homo Sapiens
TLGHFKRRY

SEQ ID NO: 973655 - protein, 9 aa, Homo Sapiens
APVRTTKAE

SEQ ID NO: 973656 - protein, 9 aa, Homo Sapiens
KNDHSPKFP

SEQ ID NO: 973657 - protein, 9 aa, Homo Sapiens
NKQQRIKKE

SEQ ID NO: 973658 - protein, 9 aa, Homo Sapiens
EKLFYLPRV

SEQ ID NO: 973659 - protein, 9 aa, Homo Sapiens
KNADPILIF

SEQ ID NO: 973660 - protein, 9 aa, Homo Sapiens
TAPCWLLER

SEQ ID NO: 973661 - protein, 9 aa, Homo Sapiens
APKKERPQD

SEQ ID NO: 973662 - protein, 9 aa, Homo Sapiens
PLDRKAIDP

SEQ ID NO: 973663 - protein, 9 aa, Homo Sapiens
HHVFCQQPL

SEQ ID NO: 973664 - protein, 9 aa, Homo Sapiens
FVILDNHLY

SEQ ID NO: 973665 - protein, 9 aa, Homo Sapiens
LTSGKCKQL

SEQ ID NO: 973666 - protein, 9 aa, Homo Sapiens
KRVLLTGLH

SEQ ID NO: 973667 - protein, 9 aa, Homo Sapiens
FIDSLMNKK

SEQ ID NO: 973668 - protein, 9 aa, Homo Sapiens
YAVCQFLLK

SEQ ID NO: 973669 - protein, 9 aa, Homo Sapiens
ANVRTPEAF

SEQ ID NO: 973670 - protein, 9 aa, Homo Sapiens
KEILEKLQL

SEQ ID NO: 973671 - protein, 9 aa, Homo Sapiens
TPPPLIFFG

SEQ ID NO: 973672 - protein, 9 aa, Homo Sapiens
CRPRSSFTT

SEQ ID NO: 973673 - protein, 9 aa, Homo Sapiens
DADGFHQSG

SEQ ID NO: 973674 - protein, 9 aa, Homo Sapiens
SVFDSIPAN

SEQ ID NO: 973675 - protein, 9 aa, Homo Sapiens
LTVLGRNLF

SEQ ID NO: 973676 - protein, 9 aa, Homo Sapiens
RKQKLDESQ

SEQ ID NO: 973677 - protein, 9 aa, Homo Sapiens
GSTPKEMSR

SEQ ID NO: 973678 - protein, 9 aa, Homo Sapiens
DAFCQGKDS

SEQ ID NO: 973679 - protein, 9 aa, Homo Sapiens
PLIFFGVPI

SEQ ID NO: 973680 - protein, 9 aa, Homo Sapiens
LNLFVPGIH

SEQ ID NO: 973681 - protein, 9 aa, Homo Sapiens
RQSRLFKSV

SEQ ID NO: 973682 - protein, 9 aa, Homo Sapiens
LLQVHQVSR

SEQ ID NO: 973683 - protein, 9 aa, Homo Sapiens
RIKRENTTL

SEQ ID NO: 973684 - protein, 9 aa, Homo Sapiens
NQFFIQPKE

SEQ ID NO: 973685 - protein, 9 aa, Homo Sapiens
GKCKQLSRL

SEQ ID NO: 973686 - protein, 9 aa, Homo Sapiens
TVVPDSPAS

SEQ ID NO: 973687 - protein, 9 aa, Homo Sapiens
EDLTKLLNG

SEQ ID NO: 973688 - protein, 9 aa, Homo Sapiens
EFEASQVVS

SEQ ID NO: 973689 - protein, 9 aa, Homo Sapiens
LENKETKVD

SEQ ID NO: 973690 - protein, 9 aa, Homo Sapiens
AIVVTPCYY

SEQ ID NO: 973691 - protein, 9 aa, Homo Sapiens
QEEEEEKKE

SEQ ID NO: 973692 - protein, 9 aa, Homo Sapiens
NERMKGTFC

SEQ ID NO: 973693 - protein, 9 aa, Homo Sapiens
SCLVRNKAN

SEQ ID NO: 973694 - protein, 9 aa, Homo Sapiens
DMTATFSSR

SEQ ID NO: 973695 - protein, 9 aa, Homo Sapiens
KDEENDSKT

SEQ ID NO: 973696 - protein, 9 aa, Homo Sapiens
SLNCSYTIS

SEQ ID NO: 973697 - protein, 9 aa, Homo Sapiens
AQQARQNAG

SEQ ID NO: 973698 - protein, 9 aa, Homo Sapiens
QKIISVISE

SEQ ID NO: 973699 - protein, 9 aa, Homo Sapiens
NGEFQNYKL

SEQ ID NO: 973700 - protein, 9 aa, Homo Sapiens
QEDFFQGRQ

SEQ ID NO: 973701 - protein, 9 aa, Homo Sapiens
YSLPQSSIV

SEQ ID NO: 973702 - protein, 9 aa, Homo Sapiens
VTLSEPVPP

SEQ ID NO: 973703 - protein, 9 aa, Homo Sapiens
CAPECVESL

SEQ ID NO: 973704 - protein, 9 aa, Homo Sapiens
KTQRLRWPW

SEQ ID NO: 973705 - protein, 9 aa, Homo Sapiens
AWDLFSPIL

SEQ ID NO: 973706 - protein, 9 aa, Homo Sapiens
CENGFILRG

SEQ ID NO: 973707 - protein, 9 aa, Homo Sapiens
VLECNHHSG

SEQ ID NO: 973708 - protein, 9 aa, Homo Sapiens
SSSKKLKKD

SEQ ID NO: 973709 - protein, 9 aa, Homo Sapiens
FLDETIIKS

SEQ ID NO: 973710 - protein, 9 aa, Homo Sapiens
HLYTSLSSL

SEQ ID NO: 973711 - protein, 9 aa, Homo Sapiens
HCYKFRIQV

SEQ ID NO: 973712 - protein, 9 aa, Homo Sapiens
RSGNYSVTK

SEQ ID NO: 973713 - protein, 9 aa, Homo Sapiens
ETGNACCSI

SEQ ID NO: 973714 - protein, 9 aa, Homo Sapiens
TIPDKFTED

SEQ ID NO: 973715 - protein, 9 aa, Homo Sapiens
ILDESDHII

SEQ ID NO: 973716 - protein, 9 aa, Homo Sapiens
WTWSRRATR

SEQ ID NO: 973717 - protein, 9 aa, Homo Sapiens
EVSALQHVK

SEQ ID NO: 973718 - protein, 9 aa, Homo Sapiens
QKHLEHAPF

SEQ ID NO: 973719 - protein, 9 aa, Homo Sapiens
GHRGDPGPF

SEQ ID NO: 973720 - protein, 9 aa, Homo Sapiens
PIYLITVIE

SEQ ID NO: 973721 - protein, 9 aa, Homo Sapiens
YASVKKFLE

SEQ ID NO: 973722 - protein, 9 aa, Homo Sapiens
RWTVVDSEG

SEQ ID NO: 973723 - protein, 9 aa, Homo Sapiens
ATSLDAWEA

SEQ ID NO: 973724 - protein, 9 aa, Homo Sapiens
VLLVTVGLG

SEQ ID NO: 973725 - protein, 9 aa, Homo Sapiens
LTKLLNGMD

SEQ ID NO: 973726 - protein, 9 aa, Homo Sapiens
SIDLPREDT

SEQ ID NO: 973727 - protein, 9 aa, Homo Sapiens
GTSFSKDVL

SEQ ID NO: 973728 - protein, 9 aa, Homo Sapiens
EVVDDWKFI

SEQ ID NO: 973729 - protein, 9 aa, Homo Sapiens
ITDGEGLNM

SEQ ID NO: 973730 - protein, 9 aa, Homo Sapiens
ASHDPDTAI

SEQ ID NO: 973731 - protein, 9 aa, Homo Sapiens
EAPSGQTVP

SEQ ID NO: 973732 - protein, 9 aa, Homo Sapiens
VHAAVTGFS

SEQ ID NO: 973733 - protein, 9 aa, Homo Sapiens
PYFAAFLLN

SEQ ID NO: 973734 - protein, 9 aa, Homo Sapiens
GREYDKDRN

SEQ ID NO: 973735 - protein, 9 aa, Homo Sapiens
NKFWNKEFA

SEQ ID NO: 973736 - protein, 9 aa, Homo Sapiens
KFSLKPGVP

SEQ ID NO: 973737 - protein, 9 aa, Homo Sapiens
PEPLKVAHD

SEQ ID NO: 973738 - protein, 9 aa, Homo Sapiens
LTEHTPPYD

SEQ ID NO: 973739 - protein, 9 aa, Homo Sapiens
RMSGFIYQE

SEQ ID NO: 973740 - protein, 9 aa, Homo Sapiens
SRTRLPPTP

SEQ ID NO: 973741 - protein, 9 aa, Homo Sapiens
RRLSDGSFS

SEQ ID NO: 973742 - protein, 9 aa, Homo Sapiens
FVNSAFDGH

SEQ ID NO: 973743 - protein, 9 aa, Homo Sapiens
FSKVIFNVK

SEQ ID NO: 973744 - protein, 9 aa, Homo Sapiens
KRHPDMLTK

SEQ ID NO: 973745 - protein, 9 aa, Homo Sapiens
RQLLCYYDQ

SEQ ID NO: 973746 - protein, 9 aa, Homo Sapiens
FDFFFQDNS

SEQ ID NO: 973747 - protein, 9 aa, Homo Sapiens
FPSGNYPLC

SEQ ID NO: 973748 - protein, 9 aa, Homo Sapiens
PGLVGANGS

SEQ ID NO: 973749 - protein, 9 aa, Homo Sapiens
TPYFAAFLL

SEQ ID NO: 973750 - protein, 9 aa, Homo Sapiens
NEKVARRAE

SEQ ID NO: 973751 - protein, 9 aa, Homo Sapiens
KYNAPCSKD

SEQ ID NO: 973752 - protein, 9 aa, Homo Sapiens
GLNMFDVIT

SEQ ID NO: 973753 - protein, 9 aa, Homo Sapiens
ICYVLVKLH

SEQ ID NO: 973754 - protein, 9 aa, Homo Sapiens
VFQMLQRCT

SEQ ID NO: 973755 - protein, 9 aa, Homo Sapiens
VRTPEAFSQ

SEQ ID NO: 973756 - protein, 9 aa, Homo Sapiens
PGSRKMKFK

SEQ ID NO: 973757 - protein, 9 aa, Homo Sapiens
SFKDSRPSQ

SEQ ID NO: 973758 - protein, 9 aa, Homo Sapiens
RAVTKKTFS

SEQ ID NO: 973759 - protein, 9 aa, Homo Sapiens
EQKIRLPEQ

SEQ ID NO: 973760 - protein, 9 aa, Homo Sapiens
FHSTIKVLR

SEQ ID NO: 973761 - protein, 9 aa, Homo Sapiens
GTPQPGFSN

SEQ ID NO: 973762 - protein, 9 aa, Homo Sapiens
TETPPMKET

SEQ ID NO: 973763 - protein, 9 aa, Homo Sapiens
TATFSSRTI

SEQ ID NO: 973764 - protein, 9 aa, Homo Sapiens
VTTVVVFGL

SEQ ID NO: 973765 - protein, 9 aa, Homo Sapiens
EMDEYLRVV

SEQ ID NO: 973766 - protein, 9 aa, Homo Sapiens
ASMIYLTPT

SEQ ID NO: 973767 - protein, 9 aa, Homo Sapiens
CQKVEMSYQ

SEQ ID NO: 973768 - protein, 9 aa, Homo Sapiens
LLTYMTLMS

SEQ ID NO: 973769 - protein, 9 aa, Homo Sapiens
SSRNNYVLT

SEQ ID NO: 973770 - protein, 9 aa, Homo Sapiens
YAKLSAKHT

SEQ ID NO: 973771 - protein, 9 aa, Homo Sapiens
LTEKGLPTN

SEQ ID NO: 973772 - protein, 9 aa, Homo Sapiens
QVSSRVTFL

SEQ ID NO: 973773 - protein, 9 aa, Homo Sapiens
LGTPQPGFS

SEQ ID NO: 973774 - protein, 9 aa, Homo Sapiens
EPLKVAHDL

SEQ ID NO: 973775 - protein, 9 aa, Homo Sapiens
ILTPTWVSS

SEQ ID NO: 973776 - protein, 9 aa, Homo Sapiens
DWVRDVAWT

SEQ ID NO: 973777 - protein, 9 aa, Homo Sapiens
DSQDLVFGG

SEQ ID NO: 973778 - protein, 9 aa, Homo Sapiens
EDFVLSSTG

SEQ ID NO: 973779 - protein, 9 aa, Homo Sapiens
LPPTFNLII

SEQ ID NO: 973780 - protein, 9 aa, Homo Sapiens
HMFFWEKSS

SEQ ID NO: 973781 - protein, 9 aa, Homo Sapiens
WKYLKENRD

SEQ ID NO: 973782 - protein, 9 aa, Homo Sapiens
LRDIKYFYF

SEQ ID NO: 973783 - protein, 9 aa, Homo Sapiens
VLIECPARA

SEQ ID NO: 973784 - protein, 9 aa, Homo Sapiens
ALPFPGPGP

SEQ ID NO: 973785 - protein, 9 aa, Homo Sapiens
REILGLDSK

SEQ ID NO: 973786 - protein, 9 aa, Homo Sapiens
PFTGLIYTQ

SEQ ID NO: 973787 - protein, 9 aa, Homo Sapiens
DRFQELKQR

SEQ ID NO: 973788 - protein, 9 aa, Homo Sapiens
EIKPFQCDR

SEQ ID NO: 973789 - protein, 9 aa, Homo Sapiens
TYVEYAISQ

SEQ ID NO: 973790 - protein, 9 aa, Homo Sapiens
ATLLGAWRG

SEQ ID NO: 973791 - protein, 9 aa, Homo Sapiens
ESPRFPYGY

SEQ ID NO: 973792 - protein, 9 aa, Homo Sapiens
GGMFTQKQQ

SEQ ID NO: 973793 - protein, 9 aa, Homo Sapiens
RHPSGMTFV

SEQ ID NO: 973794 - protein, 9 aa, Homo Sapiens
LAKCKLAII

SEQ ID NO: 973795 - protein, 9 aa, Homo Sapiens
AHFHIHQSP

SEQ ID NO: 973796 - protein, 9 aa, Homo Sapiens
TMVETIAFC

SEQ ID NO: 973797 - protein, 9 aa, Homo Sapiens
LVFPTALTS

SEQ ID NO: 973798 - protein, 9 aa, Homo Sapiens
NSLTGKGTQ

SEQ ID NO: 973799 - protein, 9 aa, Homo Sapiens
NGKTSISRW

SEQ ID NO: 973800 - protein, 9 aa, Homo Sapiens
FALGQKFGS

SEQ ID NO: 973801 - protein, 9 aa, Homo Sapiens
LKEKIFLSE

SEQ ID NO: 973802 - protein, 9 aa, Homo Sapiens
TGRAGHGGP

SEQ ID NO: 973803 - protein, 9 aa, Homo Sapiens
FSHKEKPDL

SEQ ID NO: 973804 - protein, 9 aa, Homo Sapiens
IQMSPEPEV

SEQ ID NO: 973805 - protein, 9 aa, Homo Sapiens
PIIIYAGLR

SEQ ID NO: 973806 - protein, 9 aa, Homo Sapiens
DHIIMIDFP

SEQ ID NO: 973807 - protein, 9 aa, Homo Sapiens
EIFKCRSSN

SEQ ID NO: 973808 - protein, 9 aa, Homo Sapiens
FIFGYCWLS

SEQ ID NO: 973809 - protein, 9 aa, Homo Sapiens
SEHPCETTD

SEQ ID NO: 973810 - protein, 9 aa, Homo Sapiens
VDDWKFIAQ

SEQ ID NO: 973811 - protein, 9 aa, Homo Sapiens
CKPKSKNYT

SEQ ID NO: 973812 - protein, 9 aa, Homo Sapiens
MKLSQDFSQ

SEQ ID NO: 973813 - protein, 9 aa, Homo Sapiens
GSEDIRAHL

SEQ ID NO: 973814 - protein, 9 aa, Homo Sapiens
AYKCNEYCK

SEQ ID NO: 973815 - protein, 9 aa, Homo Sapiens
QSFKPHTAH

SEQ ID NO: 973816 - protein, 9 aa, Homo Sapiens
ILTSGKCKQ

SEQ ID NO: 973817 - protein, 9 aa, Homo Sapiens
EMKFYEVIT

SEQ ID NO: 973818 - protein, 9 aa, Homo Sapiens
FECENGFIL

SEQ ID NO: 973819 - protein, 9 aa, Homo Sapiens
GEKMMKRAL

SEQ ID NO: 973820 - protein, 9 aa, Homo Sapiens
RPCFLALEV

SEQ ID NO: 973821 - protein, 9 aa, Homo Sapiens
NLSQSLLTL

SEQ ID NO: 973822 - protein, 9 aa, Homo Sapiens
IFYLLKIFF

SEQ ID NO: 973823 - protein, 9 aa, Homo Sapiens
CETTDKCKE

SEQ ID NO: 973824 - protein, 9 aa, Homo Sapiens
TTGGKYIRE

SEQ ID NO: 973825 - protein, 9 aa, Homo Sapiens
ANADAPAGT

SEQ ID NO: 973826 - protein, 9 aa, Homo Sapiens
DNLEALGHM

SEQ ID NO: 973827 - protein, 9 aa, Homo Sapiens
TPRKDSQET

SEQ ID NO: 973828 - protein, 9 aa, Homo Sapiens
EELRRLSWF

SEQ ID NO: 973829 - protein, 9 aa, Homo Sapiens
DSLYKENAM

SEQ ID NO: 973830 - protein, 9 aa, Homo Sapiens
PFPGPGPTL

SEQ ID NO: 973831 - protein, 9 aa, Homo Sapiens
YLLDKETLE

SEQ ID NO: 973832 - protein, 9 aa, Homo Sapiens
QSPKPITVG

SEQ ID NO: 973833 - protein, 9 aa, Homo Sapiens
GLEFGNGDE

SEQ ID NO: 973834 - protein, 9 aa, Homo Sapiens
ETCWEWQKA

SEQ ID NO: 973835 - protein, 9 aa, Homo Sapiens
KMKFKGNYW

SEQ ID NO: 973836 - protein, 9 aa, Homo Sapiens
PEEIRMKFI

SEQ ID NO: 973837 - protein, 9 aa, Homo Sapiens
DCQNNLHYL

SEQ ID NO: 973838 - protein, 9 aa, Homo Sapiens
AAAAPPPKR

SEQ ID NO: 973839 - protein, 9 aa, Homo Sapiens
PPTFNLIIY

SEQ ID NO: 973840 - protein, 9 aa, Homo Sapiens
VQSNDLCSK

SEQ ID NO: 973841 - protein, 9 aa, Homo Sapiens
QIAPNSSTL

SEQ ID NO: 973842 - protein, 9 aa, Homo Sapiens
RLGDIFRWK

SEQ ID NO: 973843 - protein, 9 aa, Homo Sapiens
ETTDKCKEK

SEQ ID NO: 973844 - protein, 9 aa, Homo Sapiens
SFTKKAYKK

SEQ ID NO: 973845 - protein, 9 aa, Homo Sapiens
AFCQGKDSK

SEQ ID NO: 973846 - protein, 9 aa, Homo Sapiens
FPAPMNKNL

SEQ ID NO: 973847 - protein, 9 aa, Homo Sapiens
EAQGPVAPR

SEQ ID NO: 973848 - protein, 9 aa, Homo Sapiens
VLVKLHDGE

SEQ ID NO: 973849 - protein, 9 aa, Homo Sapiens
DAKKNPAFG

SEQ ID NO: 973850 - protein, 9 aa, Homo Sapiens
EEETDDIQG

SEQ ID NO: 973851 - protein, 9 aa, Homo Sapiens
IHLHTLATA

SEQ ID NO: 973852 - protein, 9 aa, Homo Sapiens
DTSCKNNMF

SEQ ID NO: 973853 - protein, 9 aa, Homo Sapiens
FLTIDHVVE

SEQ ID NO: 973854 - protein, 9 aa, Homo Sapiens
YSEAFKGQM

SEQ ID NO: 973855 - protein, 9 aa, Homo Sapiens
THQPLGSFR

SEQ ID NO: 973856 - protein, 9 aa, Homo Sapiens
NYSVTKNMF

SEQ ID NO: 973857 - protein, 9 aa, Homo Sapiens
VEEGVGILR

SEQ ID NO: 973858 - protein, 9 aa, Homo Sapiens
VLEPGRPVS

SEQ ID NO: 973859 - protein, 9 aa, Homo Sapiens
LRRSPGPKG

SEQ ID NO: 973860 - protein, 9 aa, Homo Sapiens
DLRKVRPMK

SEQ ID NO: 973861 - protein, 9 aa, Homo Sapiens
EKLTAYTAI

SEQ ID NO: 973862 - protein, 9 aa, Homo Sapiens
GLICSRVSG

SEQ ID NO: 973863 - protein, 9 aa, Homo Sapiens
PTMTTIGFG

SEQ ID NO: 973864 - protein, 9 aa, Homo Sapiens
MFERETQRE

SEQ ID NO: 973865 - protein, 9 aa, Homo Sapiens
TQRLRWPWQ

SEQ ID NO: 973866 - protein, 9 aa, Homo Sapiens
RDMDDYIFT

SEQ ID NO: 973867 - protein, 9 aa, Homo Sapiens
EREESSCDR

SEQ ID NO: 973868 - protein, 9 aa, Homo Sapiens
LYMLSILQI

SEQ ID NO: 973869 - protein, 9 aa, Homo Sapiens
KVQKDVFLV

SEQ ID NO: 973870 - protein, 9 aa, Homo Sapiens
IFSMMRKKD

SEQ ID NO: 973871 - protein, 9 aa, Homo Sapiens
PKLIRIGCF

SEQ ID NO: 973872 - protein, 9 aa, Homo Sapiens
VVEGNLMKT

SEQ ID NO: 973873 - protein, 9 aa, Homo Sapiens
LLDSEFIDS

SEQ ID NO: 973874 - protein, 9 aa, Homo Sapiens
IYWEKAEQA

SEQ ID NO: 973875 - protein, 9 aa, Homo Sapiens
LSQDFSQIE

SEQ ID NO: 973876 - protein, 9 aa, Homo Sapiens
YLPFYQEIM

SEQ ID NO: 973877 - protein, 9 aa, Homo Sapiens
VTPRKDSQE

SEQ ID NO: 973878 - protein, 9 aa, Homo Sapiens
STEPSSQYS

SEQ ID NO: 973879 - protein, 9 aa, Homo Sapiens
KDPVTKERT

SEQ ID NO: 973880 - protein, 9 aa, Homo Sapiens
CEKLDKLNI

SEQ ID NO: 973881 - protein, 9 aa, Homo Sapiens
LLVPLALWG

SEQ ID NO: 973882 - protein, 9 aa, Homo Sapiens
FAASATCCL

SEQ ID NO: 973883 - protein, 9 aa, Homo Sapiens
PNYADTLFS

SEQ ID NO: 973884 - protein, 9 aa, Homo Sapiens
QVWKNFTAS

SEQ ID NO: 973885 - protein, 9 aa, Homo Sapiens
RREINVLRQ

SEQ ID NO: 973886 - protein, 9 aa, Homo Sapiens
SEDIRAHLP

SEQ ID NO: 973887 - protein, 9 aa, Homo Sapiens
MTIKTKKKM

SEQ ID NO: 973888 - protein, 9 aa, Homo Sapiens
DERLFECAV

SEQ ID NO: 973889 - protein, 9 aa, Homo Sapiens
TRRKTNRSF

SEQ ID NO: 973890 - protein, 9 aa, Homo Sapiens
PKAKTPDWL

SEQ ID NO: 973891 - protein, 9 aa, Homo Sapiens
NLKKRDMDD

SEQ ID NO: 973892 - protein, 9 aa, Homo Sapiens
QLYFFYFLG

SEQ ID NO: 973893 - protein, 9 aa, Homo Sapiens
TKPEPPEGP

SEQ ID NO: 973894 - protein, 9 aa, Homo Sapiens
LLVTVGLGR

SEQ ID NO: 973895 - protein, 9 aa, Homo Sapiens
KAKTPDWLV

SEQ ID NO: 973896 - protein, 9 aa, Homo Sapiens
AWTPSIGLP

SEQ ID NO: 973897 - protein, 9 aa, Homo Sapiens
VERRNWVLA

SEQ ID NO: 973898 - protein, 9 aa, Homo Sapiens
VSGLSSSRT

SEQ ID NO: 973899 - protein, 9 aa, Homo Sapiens
SDLRLQALF

SEQ ID NO: 973900 - protein, 9 aa, Homo Sapiens
HSTIKVLRL

SEQ ID NO: 973901 - protein, 9 aa, Homo Sapiens
PAMKFKRGS

SEQ ID NO: 973902 - protein, 9 aa, Homo Sapiens
QLSSSFLTE

SEQ ID NO: 973903 - protein, 9 aa, Homo Sapiens
PKSPSFGSG

SEQ ID NO: 973904 - protein, 9 aa, Homo Sapiens
WLLERWCTT

SEQ ID NO: 973905 - protein, 9 aa, Homo Sapiens
LMPKENFTA

SEQ ID NO: 973906 - protein, 9 aa, Homo Sapiens
IEKFWRELV

SEQ ID NO: 973907 - protein, 9 aa, Homo Sapiens
LLPKIIQDY

SEQ ID NO: 973908 - protein, 9 aa, Homo Sapiens
LHRLQHQHR

SEQ ID NO: 973909 - protein, 9 aa, Homo Sapiens
SDLEKQIKL

SEQ ID NO: 973910 - protein, 9 aa, Homo Sapiens
EERWTVVDS

SEQ ID NO: 973911 - protein, 9 aa, Homo Sapiens
IIMIDFPQM

SEQ ID NO: 973912 - protein, 9 aa, Homo Sapiens
QISLLNIMM

SEQ ID NO: 973913 - protein, 9 aa, Homo Sapiens
HTRKHPRLE

SEQ ID NO: 973914 - protein, 9 aa, Homo Sapiens
LLDKETLEE

SEQ ID NO: 973915 - protein, 9 aa, Homo Sapiens
SKTTYNRFC

SEQ ID NO: 973916 - protein, 9 aa, Homo Sapiens
IYTDTLRTI

SEQ ID NO: 973917 - protein, 9 aa, Homo Sapiens
ERVPCILTY

SEQ ID NO: 973918 - protein, 9 aa, Homo Sapiens
LHVQKIISV

SEQ ID NO: 973919 - protein, 9 aa, Homo Sapiens
INSRACYAM

SEQ ID NO: 973920 - protein, 9 aa, Homo Sapiens
TPPMKETQQ

SEQ ID NO: 973921 - protein, 9 aa, Homo Sapiens
KFWRELVPG

SEQ ID NO: 973922 - protein, 9 aa, Homo Sapiens
SSSPYSRSP

SEQ ID NO: 973923 - protein, 9 aa, Homo Sapiens
KNASLFLQK

SEQ ID NO: 973924 - protein, 9 aa, Homo Sapiens
PTVEDTPKA

SEQ ID NO: 973925 - protein, 9 aa, Homo Sapiens
GRRARRCRA

SEQ ID NO: 973926 - protein, 9 aa, Homo Sapiens
KCNEYCKAF

SEQ ID NO: 973927 - protein, 9 aa, Homo Sapiens
NTSCQVVSG

SEQ ID NO: 973928 - protein, 9 aa, Homo Sapiens
LDFKVSNGL

SEQ ID NO: 973929 - protein, 9 aa, Homo Sapiens
VKSMGKSQS

SEQ ID NO: 973930 - protein, 9 aa, Homo Sapiens
ILLELVKAL

SEQ ID NO: 973931 - protein, 9 aa, Homo Sapiens
VRTTKAERR

SEQ ID NO: 973932 - protein, 9 aa, Homo Sapiens
VIFNVKDAN

SEQ ID NO: 973933 - protein, 9 aa, Homo Sapiens
TVLGRNLFK

SEQ ID NO: 973934 - protein, 9 aa, Homo Sapiens
QEKIPIAGT

SEQ ID NO: 973935 - protein, 9 aa, Homo Sapiens
PLDGGVRLN

SEQ ID NO: 973936 - protein, 9 aa, Homo Sapiens
IPELKYGYV

SEQ ID NO: 973937 - protein, 9 aa, Homo Sapiens
QATHYYYSE

SEQ ID NO: 973938 - protein, 9 aa, Homo Sapiens
IFAAKAKEQ

SEQ ID NO: 973939 - protein, 9 aa, Homo Sapiens
ILEGPQEEG

SEQ ID NO: 973940 - protein, 9 aa, Homo Sapiens
FVPKVVIFA

SEQ ID NO: 973941 - protein, 9 aa, Homo Sapiens
IKDLDLEGQ

SEQ ID NO: 973942 - protein, 9 aa, Homo Sapiens
SGGRERGQS

SEQ ID NO: 973943 - protein, 9 aa, Homo Sapiens
WSWLEFFFT

SEQ ID NO: 973944 - protein, 9 aa, Homo Sapiens
SVEERGVPG

SEQ ID NO: 973945 - protein, 9 aa, Homo Sapiens
CAAGIETRG

SEQ ID NO: 973946 - protein, 9 aa, Homo Sapiens
SGFIYQEKI

SEQ ID NO: 973947 - protein, 9 aa, Homo Sapiens
REDFVLSST

SEQ ID NO: 973948 - protein, 9 aa, Homo Sapiens
GLQIQMSPE

SEQ ID NO: 973949 - protein, 9 aa, Homo Sapiens
SVVKSVPGC

SEQ ID NO: 973950 - protein, 9 aa, Homo Sapiens
GKPELHGQP

SEQ ID NO: 973951 - protein, 9 aa, Homo Sapiens
FSSSKKLKK

SEQ ID NO: 973952 - protein, 9 aa, Homo Sapiens
QSSPSLDND

SEQ ID NO: 973953 - protein, 9 aa, Homo Sapiens
ATILLCKKY

SEQ ID NO: 973954 - protein, 9 aa, Homo Sapiens
FTGLIYTQP

SEQ ID NO: 973955 - protein, 9 aa, Homo Sapiens
YPGNPGLPR

SEQ ID NO: 973956 - protein, 9 aa, Homo Sapiens
APFSSKHRR

SEQ ID NO: 973957 - protein, 9 aa, Homo Sapiens
ASSTRRDSA

SEQ ID NO: 973958 - protein, 9 aa, Homo Sapiens
EFQRSQTDE

SEQ ID NO: 973959 - protein, 9 aa, Homo Sapiens
STFTYHKKT

SEQ ID NO: 973960 - protein, 9 aa, Homo Sapiens
TPSSPLPSM

SEQ ID NO: 973961 - protein, 9 aa, Homo Sapiens
FKRRYPQVV

SEQ ID NO: 973962 - protein, 9 aa, Homo Sapiens
IIWQNPFLQ

SEQ ID NO: 973963 - protein, 9 aa, Homo Sapiens
LEVYVGKET

SEQ ID NO: 973964 - protein, 9 aa, Homo Sapiens
VSLSENLLQ

SEQ ID NO: 973965 - protein, 9 aa, Homo Sapiens
FKVELAEIC

SEQ ID NO: 973966 - protein, 9 aa, Homo Sapiens
VLSSTGKKA

SEQ ID NO: 973967 - protein, 9 aa, Homo Sapiens
GQITTLGAL

SEQ ID NO: 973968 - protein, 9 aa, Homo Sapiens
VNPARVVVC

SEQ ID NO: 973969 - protein, 9 aa, Homo Sapiens
PCTEGTTQA

SEQ ID NO: 973970 - protein, 9 aa, Homo Sapiens
KVEDNIFQH

SEQ ID NO: 973971 - protein, 9 aa, Homo Sapiens
FLSEPVFLT

SEQ ID NO: 973972 - protein, 9 aa, Homo Sapiens
CLEIFMTYY

SEQ ID NO: 973973 - protein, 9 aa, Homo Sapiens
WKYLYQSPT

SEQ ID NO: 973974 - protein, 9 aa, Homo Sapiens
EQAFFVREA

SEQ ID NO: 973975 - protein, 9 aa, Homo Sapiens
KEWKGGIQH

SEQ ID NO: 973976 - protein, 9 aa, Homo Sapiens
SSEKRLGFR

SEQ ID NO: 973977 - protein, 9 aa, Homo Sapiens
LEAKDVTVR

SEQ ID NO: 973978 - protein, 9 aa, Homo Sapiens
NPTVLELRS

SEQ ID NO: 973979 - protein, 9 aa, Homo Sapiens
TSCKNNMFA

SEQ ID NO: 973980 - protein, 9 aa, Homo Sapiens
STVSNLQHA

SEQ ID NO: 973981 - protein, 9 aa, Homo Sapiens
WTLAGESTE

SEQ ID NO: 973982 - protein, 9 aa, Homo Sapiens
HIISENESD

SEQ ID NO: 973983 - protein, 9 aa, Homo Sapiens
AQAQQARQN

SEQ ID NO: 973984 - protein, 9 aa, Homo Sapiens
DGRRATGVR

SEQ ID NO: 973985 - protein, 9 aa, Homo Sapiens
KFLELASLG

SEQ ID NO: 973986 - protein, 9 aa, Homo Sapiens
RKFLELASL

SEQ ID NO: 973987 - protein, 9 aa, Homo Sapiens
KLLNGMDEE

SEQ ID NO: 973988 - protein, 9 aa, Homo Sapiens
RGTGSAQPE

SEQ ID NO: 973989 - protein, 9 aa, Homo Sapiens
RKTNRSFVK

SEQ ID NO: 973990 - protein, 9 aa, Homo Sapiens
KEENLQKNS

SEQ ID NO: 973991 - protein, 9 aa, Homo Sapiens
GPRRLESGM

SEQ ID NO: 973992 - protein, 9 aa, Homo Sapiens
KLWDTFHVL

SEQ ID NO: 973993 - protein, 9 aa, Homo Sapiens
KVEHALSSG

SEQ ID NO: 973994 - protein, 9 aa, Homo Sapiens
MFTQKQQRM

SEQ ID NO: 973995 - protein, 9 aa, Homo Sapiens
VSRRVAQLC

SEQ ID NO: 973996 - protein, 9 aa, Homo Sapiens
NLSLLKEFE

SEQ ID NO: 973997 - protein, 9 aa, Homo Sapiens
NPARVVVCG

SEQ ID NO: 973998 - protein, 9 aa, Homo Sapiens
QLEVVEGNL

SEQ ID NO: 973999 - protein, 9 aa, Homo Sapiens
SGNKPLGLL

SEQ ID NO: 974000 - protein, 9 aa, Homo Sapiens
VSKSALIPV

SEQ ID NO: 974001 - protein, 9 aa, Homo Sapiens
LMLSPNDIE

SEQ ID NO: 974002 - protein, 9 aa, Homo Sapiens
SSIVRAFFG

SEQ ID NO: 974003 - protein, 9 aa, Homo Sapiens
VTIAPPEVT

SEQ ID NO: 974004 - protein, 9 aa, Homo Sapiens
AAAQQLHLK

SEQ ID NO: 974005 - protein, 9 aa, Homo Sapiens
MKDRFQELK

SEQ ID NO: 974006 - protein, 9 aa, Homo Sapiens
SIYCYALLV

SEQ ID NO: 974007 - protein, 9 aa, Homo Sapiens
GHFKRRYPQ

SEQ ID NO: 974008 - protein, 9 aa, Homo Sapiens
GIVTELCPA

SEQ ID NO: 974009 - protein, 9 aa, Homo Sapiens
YNLISLLEV

SEQ ID NO: 974010 - protein, 9 aa, Homo Sapiens
ASSSELLPV

SEQ ID NO: 974011 - protein, 9 aa, Homo Sapiens
PLSAPAMEP

SEQ ID NO: 974012 - protein, 9 aa, Homo Sapiens
PPEGPALSH

SEQ ID NO: 974013 - protein, 9 aa, Homo Sapiens
ETDEFAIAK

SEQ ID NO: 974014 - protein, 9 aa, Homo Sapiens
VKMRCNSTK

SEQ ID NO: 974015 - protein, 9 aa, Homo Sapiens
LLRHHEETV

SEQ ID NO: 974016 - protein, 9 aa, Homo Sapiens
VLLNKGAKP

SEQ ID NO: 974017 - protein, 9 aa, Homo Sapiens
AEVGRALLD

SEQ ID NO: 974018 - protein, 9 aa, Homo Sapiens
ASKTGSLLF

SEQ ID NO: 974019 - protein, 9 aa, Homo Sapiens
EEGFQPMLS

SEQ ID NO: 974020 - protein, 9 aa, Homo Sapiens
PVLYFEQCR

SEQ ID NO: 974021 - protein, 9 aa, Homo Sapiens
GRGKIIPEE

SEQ ID NO: 974022 - protein, 9 aa, Homo Sapiens
RTPEAFSQL

SEQ ID NO: 974023 - protein, 9 aa, Homo Sapiens
KNNLILEKR

SEQ ID NO: 974024 - protein, 9 aa, Homo Sapiens
AKHCFIAFA

SEQ ID NO: 974025 - protein, 9 aa, Homo Sapiens
SRKFGCAKT

SEQ ID NO: 974026 - protein, 9 aa, Homo Sapiens
RWPAMKFKR

SEQ ID NO: 974027 - protein, 9 aa, Homo Sapiens
GLVQWAKFI

SEQ ID NO: 974028 - protein, 9 aa, Homo Sapiens
FKEAVQGMM

SEQ ID NO: 974029 - protein, 9 aa, Homo Sapiens
VSQDDSRTD

SEQ ID NO: 974030 - protein, 9 aa, Homo Sapiens
FRHFYIMPQ

SEQ ID NO: 974031 - protein, 9 aa, Homo Sapiens
RRIGFYFGV

SEQ ID NO: 974032 - protein, 9 aa, Homo Sapiens
FLRFLFGLL

SEQ ID NO: 974033 - protein, 9 aa, Homo Sapiens
PSPSTFHYE

SEQ ID NO: 974034 - protein, 9 aa, Homo Sapiens
TSDLEKQIK

SEQ ID NO: 974035 - protein, 9 aa, Homo Sapiens
KAYKCNEYC

SEQ ID NO: 974036 - protein, 9 aa, Homo Sapiens
FLLASIMKS

SEQ ID NO: 974037 - protein, 9 aa, Homo Sapiens
SYTISGLRG

SEQ ID NO: 974038 - protein, 9 aa, Homo Sapiens
YQHGSVSDS

SEQ ID NO: 974039 - protein, 9 aa, Homo Sapiens
GYACSGNVF

SEQ ID NO: 974040 - protein, 9 aa, Homo Sapiens
VCDEIIQCR

SEQ ID NO: 974041 - protein, 9 aa, Homo Sapiens
YMCRDMKQK

SEQ ID NO: 974042 - protein, 9 aa, Homo Sapiens
LRDVLDQPL

SEQ ID NO: 974043 - protein, 9 aa, Homo Sapiens
YSLQPVPES

SEQ ID NO: 974044 - protein, 9 aa, Homo Sapiens
TAIPEAIYG

SEQ ID NO: 974045 - protein, 9 aa, Homo Sapiens
SLLLPFLFP

SEQ ID NO: 974046 - protein, 9 aa, Homo Sapiens
PGSPAEQGP

SEQ ID NO: 974047 - protein, 9 aa, Homo Sapiens
YVAICHLLT

SEQ ID NO: 974048 - protein, 9 aa, Homo Sapiens
GYDGESIEN

SEQ ID NO: 974049 - protein, 9 aa, Homo Sapiens
QRTCCRPKT

SEQ ID NO: 974050 - protein, 9 aa, Homo Sapiens
WSNDPVATA

SEQ ID NO: 974051 - protein, 9 aa, Homo Sapiens
SLMEPPSSR

SEQ ID NO: 974052 - protein, 9 aa, Homo Sapiens
EQKNIPREV

SEQ ID NO: 974053 - protein, 9 aa, Homo Sapiens
LGLLCVFFV

SEQ ID NO: 974054 - protein, 9 aa, Homo Sapiens
AGSRTCLPA

SEQ ID NO: 974055 - protein, 9 aa, Homo Sapiens
GFVYKGHEK

SEQ ID NO: 974056 - protein, 9 aa, Homo Sapiens
DTFDDNYVG

SEQ ID NO: 974057 - protein, 9 aa, Homo Sapiens
ILKPLENKE

SEQ ID NO: 974058 - protein, 9 aa, Homo Sapiens
AFTWSMNEK

SEQ ID NO: 974059 - protein, 9 aa, Homo Sapiens
LLKIFFCAW

SEQ ID NO: 974060 - protein, 9 aa, Homo Sapiens
DMPELFSSK

SEQ ID NO: 974061 - protein, 9 aa, Homo Sapiens
PGTMNSVRS

SEQ ID NO: 974062 - protein, 9 aa, Homo Sapiens
WTVVDSEGR

SEQ ID NO: 974063 - protein, 9 aa, Homo Sapiens
KSLGEGPSA

SEQ ID NO: 974064 - protein, 9 aa, Homo Sapiens
TGSSRTRLP

SEQ ID NO: 974065 - protein, 9 aa, Homo Sapiens
KKEESYSND

SEQ ID NO: 974066 - protein, 9 aa, Homo Sapiens
TTHVFFRSV

SEQ ID NO: 974067 - protein, 9 aa, Homo Sapiens
YYNFNKTLP

SEQ ID NO: 974068 - protein, 9 aa, Homo Sapiens
FIYQEKIPI

SEQ ID NO: 974069 - protein, 9 aa, Homo Sapiens
NKNLNELQK

SEQ ID NO: 974070 - protein, 9 aa, Homo Sapiens
FFFAIFSID

SEQ ID NO: 974071 - protein, 9 aa, Homo Sapiens
LSPSRRFGL

SEQ ID NO: 974072 - protein, 9 aa, Homo Sapiens
SFCPSTSLL

SEQ ID NO: 974073 - protein, 9 aa, Homo Sapiens
KPDMAYCLI

SEQ ID NO: 974074 - protein, 9 aa, Homo Sapiens
SMMRKKDLC

SEQ ID NO: 974075 - protein, 9 aa, Homo Sapiens
LKHCGNGVV

SEQ ID NO: 974076 - protein, 9 aa, Homo Sapiens
IFCQRKQNT

SEQ ID NO: 974077 - protein, 9 aa, Homo Sapiens
SYKEGDLQK

SEQ ID NO: 974078 - protein, 9 aa, Homo Sapiens
TFPISIWMS

SEQ ID NO: 974079 - protein, 9 aa, Homo Sapiens
DYKLEKDPV

SEQ ID NO: 974080 - protein, 9 aa, Homo Sapiens
TFNLIIYSL

SEQ ID NO: 974081 - protein, 9 aa, Homo Sapiens
FKLAKCKLA

SEQ ID NO: 974082 - protein, 9 aa, Homo Sapiens
PFKLAKCKL

SEQ ID NO: 974083 - protein, 9 aa, Homo Sapiens
GSDCGHMFF

SEQ ID NO: 974084 - protein, 9 aa, Homo Sapiens
YRRFEGCTP

SEQ ID NO: 974085 - protein, 9 aa, Homo Sapiens
RVPCILTYD

SEQ ID NO: 974086 - protein, 9 aa, Homo Sapiens
IVMKRENIL

SEQ ID NO: 974087 - protein, 9 aa, Homo Sapiens
FVYKGHEKF

SEQ ID NO: 974088 - protein, 9 aa, Homo Sapiens
LKQVIILRR

SEQ ID NO: 974089 - protein, 9 aa, Homo Sapiens
KKKMNNFYV

SEQ ID NO: 974090 - protein, 9 aa, Homo Sapiens
FLLNTYCTK

SEQ ID NO: 974091 - protein, 9 aa, Homo Sapiens
LSPAPMNWD

SEQ ID NO: 974092 - protein, 9 aa, Homo Sapiens
FEQQPDSRK

SEQ ID NO: 974093 - protein, 9 aa, Homo Sapiens
VIFMFFLNL

SEQ ID NO: 974094 - protein, 9 aa, Homo Sapiens
GPAAAPSSL

SEQ ID NO: 974095 - protein, 9 aa, Homo Sapiens
SGEQSWLLA

SEQ ID NO: 974096 - protein, 9 aa, Homo Sapiens
TAYTAIPEA

SEQ ID NO: 974097 - protein, 9 aa, Homo Sapiens
GRWEFLPKN

SEQ ID NO: 974098 - protein, 9 aa, Homo Sapiens
LNGATFASL

SEQ ID NO: 974099 - protein, 9 aa, Homo Sapiens
TMIRAMPAN

SEQ ID NO: 974100 - protein, 9 aa, Homo Sapiens
LQDVPQRRV

SEQ ID NO: 974101 - protein, 9 aa, Homo Sapiens
FSLAATWSN

SEQ ID NO: 974102 - protein, 9 aa, Homo Sapiens
VGESDRIDD

SEQ ID NO: 974103 - protein, 9 aa, Homo Sapiens
ELGGHTMLP

SEQ ID NO: 974104 - protein, 9 aa, Homo Sapiens
RSLRATESG

SEQ ID NO: 974105 - protein, 9 aa, Homo Sapiens
GLRGHHVFC

SEQ ID NO: 974106 - protein, 9 aa, Homo Sapiens
RNLSSSTEP

SEQ ID NO: 974107 - protein, 9 aa, Homo Sapiens
LPEQIYEDP

SEQ ID NO: 974108 - protein, 9 aa, Homo Sapiens
SDEDLKIIV

SEQ ID NO: 974109 - protein, 9 aa, Homo Sapiens
VKVGWRAFL

SEQ ID NO: 974110 - protein, 9 aa, Homo Sapiens
KGPPGRKGQ

SEQ ID NO: 974111 - protein, 9 aa, Homo Sapiens
VTGFSVEEV

SEQ ID NO: 974112 - protein, 9 aa, Homo Sapiens
FLSENKSIF

SEQ ID NO: 974113 - protein, 9 aa, Homo Sapiens
STSSVQRDN

SEQ ID NO: 974114 - protein, 9 aa, Homo Sapiens
DSFEMKFYE

SEQ ID NO: 974115 - protein, 9 aa, Homo Sapiens
LLERWCTTR

SEQ ID NO: 974116 - protein, 9 aa, Homo Sapiens
SYTMQLTMN

SEQ ID NO: 974117 - protein, 9 aa, Homo Sapiens
QFLLKSGAK

SEQ ID NO: 974118 - protein, 9 aa, Homo Sapiens
TPSIGLPTS

SEQ ID NO: 974119 - protein, 9 aa, Homo Sapiens
NFIENKGTA

SEQ ID NO: 974120 - protein, 9 aa, Homo Sapiens
YFEVHIPGV

SEQ ID NO: 974121 - protein, 9 aa, Homo Sapiens
FITKRHPDM

SEQ ID NO: 974122 - protein, 9 aa, Homo Sapiens
SGTRRSGSR

SEQ ID NO: 974123 - protein, 9 aa, Homo Sapiens
SVFCQKVEM

SEQ ID NO: 974124 - protein, 9 aa, Homo Sapiens
ICFKCNRGD

SEQ ID NO: 974125 - protein, 9 aa, Homo Sapiens
MIPAAKIYT

SEQ ID NO: 974126 - protein, 9 aa, Homo Sapiens
ESEFLVFPT

SEQ ID NO: 974127 - protein, 9 aa, Homo Sapiens
QAAPQTYVE

SEQ ID NO: 974128 - protein, 9 aa, Homo Sapiens
TFVPKVVIF

SEQ ID NO: 974129 - protein, 9 aa, Homo Sapiens
NNNKIKSFQ

SEQ ID NO: 974130 - protein, 9 aa, Homo Sapiens
CAGRRTGGK

SEQ ID NO: 974131 - protein, 9 aa, Homo Sapiens
ALQHVKAID

SEQ ID NO: 974132 - protein, 9 aa, Homo Sapiens
NKLEVLTMT

SEQ ID NO: 974133 - protein, 9 aa, Homo Sapiens
AMKFKRGSG

SEQ ID NO: 974134 - protein, 9 aa, Homo Sapiens
THKFDGDEQ

SEQ ID NO: 974135 - protein, 9 aa, Homo Sapiens
SVPLAEKED

SEQ ID NO: 974136 - protein, 9 aa, Homo Sapiens
HHHLEIEAF

SEQ ID NO: 974137 - protein, 9 aa, Homo Sapiens
RKGQPGDPG

SEQ ID NO: 974138 - protein, 9 aa, Homo Sapiens
RAINQTTCE

SEQ ID NO: 974139 - protein, 9 aa, Homo Sapiens
PANALVAEQ

SEQ ID NO: 974140 - protein, 9 aa, Homo Sapiens
GRPVSAGNA

SEQ ID NO: 974141 - protein, 9 aa, Homo Sapiens
YVVTLSEPV

SEQ ID NO: 974142 - protein, 9 aa, Homo Sapiens
ILYMLSILQ

SEQ ID NO: 974143 - protein, 9 aa, Homo Sapiens
PENEEDTRL

SEQ ID NO: 974144 - protein, 9 aa, Homo Sapiens
KLNVVKKVE

SEQ ID NO: 974145 - protein, 9 aa, Homo Sapiens
TLIEPLSVG

SEQ ID NO: 974146 - protein, 9 aa, Homo Sapiens
RENTTLEST

SEQ ID NO: 974147 - protein, 9 aa, Homo Sapiens
STQIRQNTR

SEQ ID NO: 974148 - protein, 9 aa, Homo Sapiens
GRRTGGKST

SEQ ID NO: 974149 - protein, 9 aa, Homo Sapiens
KQVIILRRN

SEQ ID NO: 974150 - protein, 9 aa, Homo Sapiens
SILLELVKA

SEQ ID NO: 974151 - protein, 9 aa, Homo Sapiens
GGLYESHVE

SEQ ID NO: 974152 - protein, 9 aa, Homo Sapiens
LEICKLSGL

SEQ ID NO: 974153 - protein, 9 aa, Homo Sapiens
INADSSSLF

SEQ ID NO: 974154 - protein, 9 aa, Homo Sapiens
QLLQVHQVS

SEQ ID NO: 974155 - protein, 9 aa, Homo Sapiens
YGADLQKQG

SEQ ID NO: 974156 - protein, 9 aa, Homo Sapiens
PLCIGDNRD

SEQ ID NO: 974157 - protein, 9 aa, Homo Sapiens
FLNLFVPGI

SEQ ID NO: 974158 - protein, 9 aa, Homo Sapiens
KENTSNSQW

SEQ ID NO: 974159 - protein, 9 aa, Homo Sapiens
LLNTYCTKQ

SEQ ID NO: 974160 - protein, 9 aa, Homo Sapiens
FTRESTSTN

SEQ ID NO: 974161 - protein, 9 aa, Homo Sapiens
LALGLAIFI

SEQ ID NO: 974162 - protein, 9 aa, Homo Sapiens
TRRTAEPIT

SEQ ID NO: 974163 - protein, 9 aa, Homo Sapiens
SKNPQVPLD

SEQ ID NO: 974164 - protein, 9 aa, Homo Sapiens
AIPEAIYGT

SEQ ID NO: 974165 - protein, 9 aa, Homo Sapiens
RKDSQETYR

SEQ ID NO: 974166 - protein, 9 aa, Homo Sapiens
AYGADLQKQ

SEQ ID NO: 974167 - protein, 9 aa, Homo Sapiens
QKQTFLGLD

SEQ ID NO: 974168 - protein, 9 aa, Homo Sapiens
GNYPLCIGD

SEQ ID NO: 974169 - protein, 9 aa, Homo Sapiens
PKPEEQKNI

SEQ ID NO: 974170 - protein, 9 aa, Homo Sapiens
KYIRERSVR

SEQ ID NO: 974171 - protein, 9 aa, Homo Sapiens
TLPTCSLFI

SEQ ID NO: 974172 - protein, 9 aa, Homo Sapiens
ANMPLNLEE

SEQ ID NO: 974173 - protein, 9 aa, Homo Sapiens
QNAGILAVQ

SEQ ID NO: 974174 - protein, 9 aa, Homo Sapiens
TILAKVYPS

SEQ ID NO: 974175 - protein, 9 aa, Homo Sapiens
LIPFWNKDY

SEQ ID NO: 974176 - protein, 9 aa, Homo Sapiens
IDELKSKKK

SEQ ID NO: 974177 - protein, 9 aa, Homo Sapiens
LRSLEAKDV

SEQ ID NO: 974178 - protein, 9 aa, Homo Sapiens
KMVSLAAEE

SEQ ID NO: 974179 - protein, 9 aa, Homo Sapiens
TGKGKVPDG

SEQ ID NO: 974180 - protein, 9 aa, Homo Sapiens
RDGYNLISL

SEQ ID NO: 974181 - protein, 9 aa, Homo Sapiens
KRLLRHHEE

SEQ ID NO: 974182 - protein, 9 aa, Homo Sapiens
LASKRGGSS

SEQ ID NO: 974183 - protein, 9 aa, Homo Sapiens
HWIKVARKC

SEQ ID NO: 974184 - protein, 9 aa, Homo Sapiens
SHLYTSLSS

SEQ ID NO: 974185 - protein, 9 aa, Homo Sapiens
VKSKTDARL

SEQ ID NO: 974186 - protein, 9 aa, Homo Sapiens
FEELNDPNK

SEQ ID NO: 974187 - protein, 9 aa, Homo Sapiens
SFSMKSQAK

SEQ ID NO: 974188 - protein, 9 aa, Homo Sapiens
PQRFHTGEK

SEQ ID NO: 974189 - protein, 9 aa, Homo Sapiens
SSTRLPHTT

SEQ ID NO: 974190 - protein, 9 aa, Homo Sapiens
ECRKVFSHH

SEQ ID NO: 974191 - protein, 9 aa, Homo Sapiens
PGRIAATLA

SEQ ID NO: 974192 - protein, 9 aa, Homo Sapiens
ASMPTDGAK

SEQ ID NO: 974193 - protein, 9 aa, Homo Sapiens
RHETSHTGE

SEQ ID NO: 974194 - protein, 9 aa, Homo Sapiens
PFGPPGPPG

SEQ ID NO: 974195 - protein, 9 aa, Homo Sapiens
PREDTVCSS

SEQ ID NO: 974196 - protein, 9 aa, Homo Sapiens
NKANATRCV

SEQ ID NO: 974197 - protein, 9 aa, Homo Sapiens
KHLEHAPFP

SEQ ID NO: 974198 - protein, 9 aa, Homo Sapiens
LPRIPGQDG

SEQ ID NO: 974199 - protein, 9 aa, Homo Sapiens
LEAFSCGES

SEQ ID NO: 974200 - protein, 9 aa, Homo Sapiens
RDVAWTPSI

SEQ ID NO: 974201 - protein, 9 aa, Homo Sapiens
KLTAYTAIP

SEQ ID NO: 974202 - protein, 9 aa, Homo Sapiens
ANSVFCQKV

SEQ ID NO: 974203 - protein, 9 aa, Homo Sapiens
QLSIFGKFS

SEQ ID NO: 974204 - protein, 9 aa, Homo Sapiens
TLTEKAEKK

SEQ ID NO: 974205 - protein, 9 aa, Homo Sapiens
LDETIIKSR

SEQ ID NO: 974206 - protein, 9 aa, Homo Sapiens
EDEETHSRG

SEQ ID NO: 974207 - protein, 9 aa, Homo Sapiens
WEPKDDANV

SEQ ID NO: 974208 - protein, 9 aa, Homo Sapiens
VIVDRSQLR

SEQ ID NO: 974209 - protein, 9 aa, Homo Sapiens
PFARGGRAG

SEQ ID NO: 974210 - protein, 9 aa, Homo Sapiens
QPKEWKGGI

SEQ ID NO: 974211 - protein, 9 aa, Homo Sapiens
TSARGGLLK

SEQ ID NO: 974212 - protein, 9 aa, Homo Sapiens
VILNREIQD

SEQ ID NO: 974213 - protein, 9 aa, Homo Sapiens
NRMTIKTKK

SEQ ID NO: 974214 - protein, 9 aa, Homo Sapiens
LLRKIEATN

SEQ ID NO: 974215 - protein, 9 aa, Homo Sapiens
RILKPLENK

SEQ ID NO: 974216 - protein, 9 aa, Homo Sapiens
SEKVQLEIL

SEQ ID NO: 974217 - protein, 9 aa, Homo Sapiens
EELNDPNKP

SEQ ID NO: 974218 - protein, 9 aa, Homo Sapiens
QQPLSEPQY

SEQ ID NO: 974219 - protein, 9 aa, Homo Sapiens
GQFLEVYVG

SEQ ID NO: 974220 - protein, 9 aa, Homo Sapiens
SAPATLTAP

SEQ ID NO: 974221 - protein, 9 aa, Homo Sapiens
GSTSIIGEV

SEQ ID NO: 974222 - protein, 9 aa, Homo Sapiens
SLENDKIRL

SEQ ID NO: 974223 - protein, 9 aa, Homo Sapiens
PQSSIVRAF

SEQ ID NO: 974224 - protein, 9 aa, Homo Sapiens
NKYSLIMRN

SEQ ID NO: 974225 - protein, 9 aa, Homo Sapiens
NNYVLTQCD

SEQ ID NO: 974226 - protein, 9 aa, Homo Sapiens
VVDDWKFIA

SEQ ID NO: 974227 - protein, 9 aa, Homo Sapiens
SEELFDQDE

SEQ ID NO: 974228 - protein, 9 aa, Homo Sapiens
VLLSYIQIA

SEQ ID NO: 974229 - protein, 9 aa, Homo Sapiens
SRRFGLCSP

SEQ ID NO: 974230 - protein, 9 aa, Homo Sapiens
PLSEPQYQL

SEQ ID NO: 974231 - protein, 9 aa, Homo Sapiens
EGFQPMLSI

SEQ ID NO: 974232 - protein, 9 aa, Homo Sapiens
VRSSRNNYV

SEQ ID NO: 974233 - protein, 9 aa, Homo Sapiens
DNDSLGSAN

SEQ ID NO: 974234 - protein, 9 aa, Homo Sapiens
SYECVCPPE

SEQ ID NO: 974235 - protein, 9 aa, Homo Sapiens
YNREEFLRT

SEQ ID NO: 974236 - protein, 9 aa, Homo Sapiens
EHTVIPHSS

SEQ ID NO: 974237 - protein, 9 aa, Homo Sapiens
FEMKFYEVI

SEQ ID NO: 974238 - protein, 9 aa, Homo Sapiens
KTNLDFKVS

SEQ ID NO: 974239 - protein, 9 aa, Homo Sapiens
EFLRTVECY

SEQ ID NO: 974240 - protein, 9 aa, Homo Sapiens
NLSGRVDFD

SEQ ID NO: 974241 - protein, 9 aa, Homo Sapiens
QAFFVREAL

SEQ ID NO: 974242 - protein, 9 aa, Homo Sapiens
DGLVWRASK

SEQ ID NO: 974243 - protein, 9 aa, Homo Sapiens
CSTMPNGKV

SEQ ID NO: 974244 - protein, 9 aa, Homo Sapiens
SHLLLTLCR

SEQ ID NO: 974245 - protein, 9 aa, Homo Sapiens
SEDVDVDKP

SEQ ID NO: 974246 - protein, 9 aa, Homo Sapiens
SEPPIKPRL

SEQ ID NO: 974247 - protein, 9 aa, Homo Sapiens
KLHDGETLC

SEQ ID NO: 974248 - protein, 9 aa, Homo Sapiens
SRHPSGMTF

SEQ ID NO: 974249 - protein, 9 aa, Homo Sapiens
LKQECRNGS

SEQ ID NO: 974250 - protein, 9 aa, Homo Sapiens
ENPIFRFSS

SEQ ID NO: 974251 - protein, 9 aa, Homo Sapiens
ASASMPTDG

SEQ ID NO: 974252 - protein, 9 aa, Homo Sapiens
GNACCSISA

SEQ ID NO: 974253 - protein, 9 aa, Homo Sapiens
NKECRKVFS

SEQ ID NO: 974254 - protein, 9 aa, Homo Sapiens
AVVCTLPLG

SEQ ID NO: 974255 - protein, 9 aa, Homo Sapiens
FTCKPKSKN

SEQ ID NO: 974256 - protein, 9 aa, Homo Sapiens
LIDKLLSKL

SEQ ID NO: 974257 - protein, 9 aa, Homo Sapiens
EQPEKEEKR

SEQ ID NO: 974258 - protein, 9 aa, Homo Sapiens
GDIFRWKGE

SEQ ID NO: 974259 - protein, 9 aa, Homo Sapiens
IVTELCPAA

SEQ ID NO: 974260 - protein, 9 aa, Homo Sapiens
EEGVGILRI

SEQ ID NO: 974261 - protein, 9 aa, Homo Sapiens
DDPEEIRMK

SEQ ID NO: 974262 - protein, 9 aa, Homo Sapiens
AYTAIPEAI

SEQ ID NO: 974263 - protein, 9 aa, Homo Sapiens
TPSGQITTL

SEQ ID NO: 974264 - protein, 9 aa, Homo Sapiens
EQSEQKTSD

SEQ ID NO: 974265 - protein, 9 aa, Homo Sapiens
LVQWAKFIL

SEQ ID NO: 974266 - protein, 9 aa, Homo Sapiens
AMSSIPMSR

SEQ ID NO: 974267 - protein, 9 aa, Homo Sapiens
HLLTVQELR

SEQ ID NO: 974268 - protein, 9 aa, Homo Sapiens
LKEELTEAL

SEQ ID NO: 974269 - protein, 9 aa, Homo Sapiens
EHQGGSNNI

SEQ ID NO: 974270 - protein, 9 aa, Homo Sapiens
GFLFFWYGC

SEQ ID NO: 974271 - protein, 9 aa, Homo Sapiens
SLSVGLWVP

SEQ ID NO: 974272 - protein, 9 aa, Homo Sapiens
DYASVKKFL

SEQ ID NO: 974273 - protein, 9 aa, Homo Sapiens
GRQATHYYY

SEQ ID NO: 974274 - protein, 9 aa, Homo Sapiens
LENGGLERK

SEQ ID NO: 974275 - protein, 9 aa, Homo Sapiens
LICSRVSGW

SEQ ID NO: 974276 - protein, 9 aa, Homo Sapiens
LDQKMRKAE

SEQ ID NO: 974277 - protein, 9 aa, Homo Sapiens
DEDLKIIVD

SEQ ID NO: 974278 - protein, 9 aa, Homo Sapiens
GEARVRVES

SEQ ID NO: 974279 - protein, 9 aa, Homo Sapiens
DAAIVVTPC

SEQ ID NO: 974280 - protein, 9 aa, Homo Sapiens
SIWAKYSNG

SEQ ID NO: 974281 - protein, 9 aa, Homo Sapiens
QQRSASFLE

SEQ ID NO: 974282 - protein, 9 aa, Homo Sapiens
VHQTSSPLC

SEQ ID NO: 974283 - protein, 9 aa, Homo Sapiens
RGHTRKHPR

SEQ ID NO: 974284 - protein, 9 aa, Homo Sapiens
TCHRAGLTA

SEQ ID NO: 974285 - protein, 9 aa, Homo Sapiens
RDMKQKGGC

SEQ ID NO: 974286 - protein, 9 aa, Homo Sapiens
SFRVVSTHS

SEQ ID NO: 974287 - protein, 9 aa, Homo Sapiens
PRRLESGMK

SEQ ID NO: 974288 - protein, 9 aa, Homo Sapiens
GESIENCPF

SEQ ID NO: 974289 - protein, 9 aa, Homo Sapiens
KKVDESRRE

SEQ ID NO: 974290 - protein, 9 aa, Homo Sapiens
SITDGEGLN

SEQ ID NO: 974291 - protein, 9 aa, Homo Sapiens
GGGRSRGTG

SEQ ID NO: 974292 - protein, 9 aa, Homo Sapiens
SKFPAERDI

SEQ ID NO: 974293 - protein, 9 aa, Homo Sapiens
EDIPNTDSG

SEQ ID NO: 974294 - protein, 9 aa, Homo Sapiens
LTASVEERG

SEQ ID NO: 974295 - protein, 9 aa, Homo Sapiens
TGCSPGAMF

SEQ ID NO: 974296 - protein, 9 aa, Homo Sapiens
VNDIILAVL

SEQ ID NO: 974297 - protein, 9 aa, Homo Sapiens
LLNKNCFQF

SEQ ID NO: 974298 - protein, 9 aa, Homo Sapiens
ATLTAPCWL

SEQ ID NO: 974299 - protein, 9 aa, Homo Sapiens
DGATTGGPR

SEQ ID NO: 974300 - protein, 9 aa, Homo Sapiens
EANPLATSQ

SEQ ID NO: 974301 - protein, 9 aa, Homo Sapiens
RMKIFRNIF

SEQ ID NO: 974302 - protein, 9 aa, Homo Sapiens
LLNKFWNKE

SEQ ID NO: 974303 - protein, 9 aa, Homo Sapiens
YTMQLTMNI

SEQ ID NO: 974304 - protein, 9 aa, Homo Sapiens
TVIENLLII

SEQ ID NO: 974305 - protein, 9 aa, Homo Sapiens
VKALRLNGE

SEQ ID NO: 974306 - protein, 9 aa, Homo Sapiens
GCSPGAMFS

SEQ ID NO: 974307 - protein, 9 aa, Homo Sapiens
KNSQEVGTY

SEQ ID NO: 974308 - protein, 9 aa, Homo Sapiens
WPKQPMELY

SEQ ID NO: 974309 - protein, 9 aa, Homo Sapiens
LNKNCFQFQ

SEQ ID NO: 974310 - protein, 9 aa, Homo Sapiens
YTSLSSLGL

SEQ ID NO: 974311 - protein, 9 aa, Homo Sapiens
RDIKYFYFR

SEQ ID NO: 974312 - protein, 9 aa, Homo Sapiens
WVSSSATKQ

SEQ ID NO: 974313 - protein, 9 aa, Homo Sapiens
VTFDDHDFV

SEQ ID NO: 974314 - protein, 9 aa, Homo Sapiens
SPVLYFEQC

SEQ ID NO: 974315 - protein, 9 aa, Homo Sapiens
GGSPLLWAT

SEQ ID NO: 974316 - protein, 9 aa, Homo Sapiens
VDHQNDPFR

SEQ ID NO: 974317 - protein, 9 aa, Homo Sapiens
CDAVVCTLP

SEQ ID NO: 974318 - protein, 9 aa, Homo Sapiens
LSLMQPPPP

SEQ ID NO: 974319 - protein, 9 aa, Homo Sapiens
ASPHTVQER

SEQ ID NO: 974320 - protein, 9 aa, Homo Sapiens
SHDPDTAIP

SEQ ID NO: 974321 - protein, 9 aa, Homo Sapiens
SSSLLASPP

SEQ ID NO: 974322 - protein, 9 aa, Homo Sapiens
EPLEKFSLK

SEQ ID NO: 974323 - protein, 9 aa, Homo Sapiens
TFPKNPVYT

SEQ ID NO: 974324 - protein, 9 aa, Homo Sapiens
PNGIVTELC

SEQ ID NO: 974325 - protein, 9 aa, Homo Sapiens
SASNTSDKN

SEQ ID NO: 974326 - protein, 9 aa, Homo Sapiens
PCSEDYDSY

SEQ ID NO: 974327 - protein, 9 aa, Homo Sapiens
VTKNMFCAG

SEQ ID NO: 974328 - protein, 9 aa, Homo Sapiens
GHPLFLRRE

SEQ ID NO: 974329 - protein, 9 aa, Homo Sapiens
FSIDYVTSV

SEQ ID NO: 974330 - protein, 9 aa, Homo Sapiens
DPKVTRDQI

SEQ ID NO: 974331 - protein, 9 aa, Homo Sapiens
PNTDSGEQS

SEQ ID NO: 974332 - protein, 9 aa, Homo Sapiens
GPYQCKIRD

SEQ ID NO: 974333 - protein, 9 aa, Homo Sapiens
FKCRSSNKE

SEQ ID NO: 974334 - protein, 9 aa, Homo Sapiens
ACVVFIKWI

SEQ ID NO: 974335 - protein, 9 aa, Homo Sapiens
LGEIFMLKH

SEQ ID NO: 974336 - protein, 9 aa, Homo Sapiens
KRGGSSAQK

SEQ ID NO: 974337 - protein, 9 aa, Homo Sapiens
SPFYPRNYP

SEQ ID NO: 974338 - protein, 9 aa, Homo Sapiens
SPHTVQERE

SEQ ID NO: 974339 - protein, 9 aa, Homo Sapiens
RLENQSFNS

SEQ ID NO: 974340 - protein, 9 aa, Homo Sapiens
TPDPSRPYG

SEQ ID NO: 974341 - protein, 9 aa, Homo Sapiens
LSQLHRLQH

SEQ ID NO: 974342 - protein, 9 aa, Homo Sapiens
GRTPTLPGS

SEQ ID NO: 974343 - protein, 9 aa, Homo Sapiens
KEQSRRDNL

SEQ ID NO: 974344 - protein, 9 aa, Homo Sapiens
MPEKSQKRG

SEQ ID NO: 974345 - protein, 9 aa, Homo Sapiens
KTNRSFVKT

SEQ ID NO: 974346 - protein, 9 aa, Homo Sapiens
RAGLTARFQ

SEQ ID NO: 974347 - protein, 9 aa, Homo Sapiens
MNLSGRVDF

SEQ ID NO: 974348 - protein, 9 aa, Homo Sapiens
SAGNFWNII

SEQ ID NO: 974349 - protein, 9 aa, Homo Sapiens
VQPCPICKK

SEQ ID NO: 974350 - protein, 9 aa, Homo Sapiens
QREKILEAR

SEQ ID NO: 974351 - protein, 9 aa, Homo Sapiens
LCEPASIGY

SEQ ID NO: 974352 - protein, 9 aa, Homo Sapiens
WNQCDLVAF

SEQ ID NO: 974353 - protein, 9 aa, Homo Sapiens
VIANFIENK

SEQ ID NO: 974354 - protein, 9 aa, Homo Sapiens
CKALSTCGT

SEQ ID NO: 974355 - protein, 9 aa, Homo Sapiens
VRVGDFGSV

SEQ ID NO: 974356 - protein, 9 aa, Homo Sapiens
VSQIFFVIL

SEQ ID NO: 974357 - protein, 9 aa, Homo Sapiens
PENYRRFAA

SEQ ID NO: 974358 - protein, 9 aa, Homo Sapiens
AFLSPVLYF

SEQ ID NO: 974359 - protein, 9 aa, Homo Sapiens
ERKQASSTR

SEQ ID NO: 974360 - protein, 9 aa, Homo Sapiens
EDNIFQHFC

SEQ ID NO: 974361 - protein, 9 aa, Homo Sapiens
QGFDFFFQD

SEQ ID NO: 974362 - protein, 9 aa, Homo Sapiens
YIPELKYGY

SEQ ID NO: 974363 - protein, 9 aa, Homo Sapiens
DMKQKGGCP

SEQ ID NO: 974364 - protein, 9 aa, Homo Sapiens
DVTVRTLSA

SEQ ID NO: 974365 - protein, 9 aa, Homo Sapiens
DQDMIESLF

SEQ ID NO: 974366 - protein, 9 aa, Homo Sapiens
NEGGGEEDT

SEQ ID NO: 974367 - protein, 9 aa, Homo Sapiens
GRERGQSKE

SEQ ID NO: 974368 - protein, 9 aa, Homo Sapiens
DTPKAKTPD

SEQ ID NO: 974369 - protein, 9 aa, Homo Sapiens
AVSIFFMII

SEQ ID NO: 974370 - protein, 9 aa, Homo Sapiens
FFYFLGSTE

SEQ ID NO: 974371 - protein, 9 aa, Homo Sapiens
GDKASLAHF

SEQ ID NO: 974372 - protein, 9 aa, Homo Sapiens
NDSLGSANS

SEQ ID NO: 974373 - protein, 9 aa, Homo Sapiens
RPVLRVTNG

SEQ ID NO: 974374 - protein, 9 aa, Homo Sapiens
LAGSRTQHL

SEQ ID NO: 974375 - protein, 9 aa, Homo Sapiens
LVSPNGRLK

SEQ ID NO: 974376 - protein, 9 aa, Homo Sapiens
KRTYAFREK

SEQ ID NO: 974377 - protein, 9 aa, Homo Sapiens
IVKMVSLAA

SEQ ID NO: 974378 - protein, 9 aa, Homo Sapiens
PKSSGMPSG

SEQ ID NO: 974379 - protein, 9 aa, Homo Sapiens
HLLLTLCRV

SEQ ID NO: 974380 - protein, 9 aa, Homo Sapiens
FWRWNLVRK

SEQ ID NO: 974381 - protein, 9 aa, Homo Sapiens
LSFIKASFM

SEQ ID NO: 974382 - protein, 9 aa, Homo Sapiens
PPGPPGSPA

SEQ ID NO: 974383 - protein, 9 aa, Homo Sapiens
FLIHPFTGL

SEQ ID NO: 974384 - protein, 9 aa, Homo Sapiens
EERGVPGED

SEQ ID NO: 974385 - protein, 9 aa, Homo Sapiens
MEKLFYLPR

SEQ ID NO: 974386 - protein, 9 aa, Homo Sapiens
PYFSPSRAS

SEQ ID NO: 974387 - protein, 9 aa, Homo Sapiens
VCTLPLGVL

SEQ ID NO: 974388 - protein, 9 aa, Homo Sapiens
VSFSAARSR

SEQ ID NO: 974389 - protein, 9 aa, Homo Sapiens
GLLRANADA

SEQ ID NO: 974390 - protein, 9 aa, Homo Sapiens
QEENPNEEL

SEQ ID NO: 974391 - protein, 9 aa, Homo Sapiens
TGGPRRLES

SEQ ID NO: 974392 - protein, 9 aa, Homo Sapiens
GNEAKDLLS

SEQ ID NO: 974393 - protein, 9 aa, Homo Sapiens
SNLQHAALM

SEQ ID NO: 974394 - protein, 9 aa, Homo Sapiens
PMLQITAPL

SEQ ID NO: 974395 - protein, 9 aa, Homo Sapiens
SSSFSTLIH

SEQ ID NO: 974396 - protein, 9 aa, Homo Sapiens
TLHTKPEPP

SEQ ID NO: 974397 - protein, 9 aa, Homo Sapiens
VAKVLLNKG

SEQ ID NO: 974398 - protein, 9 aa, Homo Sapiens
SKNEDLTKL

SEQ ID NO: 974399 - protein, 9 aa, Homo Sapiens
PAMLRFLRS

SEQ ID NO: 974400 - protein, 9 aa, Homo Sapiens
FADSFCPST

SEQ ID NO: 974401 - protein, 9 aa, Homo Sapiens
FKDSRPSQA

SEQ ID NO: 974402 - protein, 9 aa, Homo Sapiens
NACCSISAW

SEQ ID NO: 974403 - protein, 9 aa, Homo Sapiens
GDPGPFGPP

SEQ ID NO: 974404 - protein, 9 aa, Homo Sapiens
KRADSGEEN

SEQ ID NO: 974405 - protein, 9 aa, Homo Sapiens
PASVVKSVP

SEQ ID NO: 974406 - protein, 9 aa, Homo Sapiens
FPRVIMQKV

SEQ ID NO: 974407 - protein, 9 aa, Homo Sapiens
GTGSAQPEP

SEQ ID NO: 974408 - protein, 9 aa, Homo Sapiens
KIYTELCLP

SEQ ID NO: 974409 - protein, 9 aa, Homo Sapiens
ILGLDSKTT

SEQ ID NO: 974410 - protein, 9 aa, Homo Sapiens
HSKNSGKSG

SEQ ID NO: 974411 - protein, 9 aa, Homo Sapiens
ALPPVSSSD

SEQ ID NO: 974412 - protein, 9 aa, Homo Sapiens
LVDVIRSPT

SEQ ID NO: 974413 - protein, 9 aa, Homo Sapiens
MFFWEKSSC

SEQ ID NO: 974414 - protein, 9 aa, Homo Sapiens
QLSSPDGVY

SEQ ID NO: 974415 - protein, 9 aa, Homo Sapiens
KRYSEQAFF

SEQ ID NO: 974416 - protein, 9 aa, Homo Sapiens
ATHYYYSEA

SEQ ID NO: 974417 - protein, 9 aa, Homo Sapiens
SAKQKQKLT

SEQ ID NO: 974418 - protein, 9 aa, Homo Sapiens
TTGKGKVPD

SEQ ID NO: 974419 - protein, 9 aa, Homo Sapiens
SRTCLPAPI

SEQ ID NO: 974420 - protein, 9 aa, Homo Sapiens
GLLRKIEAT

SEQ ID NO: 974421 - protein, 9 aa, Homo Sapiens
FFTSIFSAL

SEQ ID NO: 974422 - protein, 9 aa, Homo Sapiens
GTELSKKDR

SEQ ID NO: 974423 - protein, 9 aa, Homo Sapiens
EQEKIWVEE

SEQ ID NO: 974424 - protein, 9 aa, Homo Sapiens
YIFYYNFNK

SEQ ID NO: 974425 - protein, 9 aa, Homo Sapiens
FFLNLFVPG

SEQ ID NO: 974426 - protein, 9 aa, Homo Sapiens
HTLPTCSLF

SEQ ID NO: 974427 - protein, 9 aa, Homo Sapiens
AAVNVWQKN

SEQ ID NO: 974428 - protein, 9 aa, Homo Sapiens
SNDKATKDS

SEQ ID NO: 974429 - protein, 9 aa, Homo Sapiens
RRAELPPPY

SEQ ID NO: 974430 - protein, 9 aa, Homo Sapiens
LTEALRDLK

SEQ ID NO: 974431 - protein, 9 aa, Homo Sapiens
ALTASVEER

SEQ ID NO: 974432 - protein, 9 aa, Homo Sapiens
SGQITTLGA

SEQ ID NO: 974433 - protein, 9 aa, Homo Sapiens
LLDSVRRNI

SEQ ID NO: 974434 - protein, 9 aa, Homo Sapiens
PHTVQEREK

SEQ ID NO: 974435 - protein, 9 aa, Homo Sapiens
PEQVSLSEN

SEQ ID NO: 974436 - protein, 9 aa, Homo Sapiens
CAMKGKYRI

SEQ ID NO: 974437 - protein, 9 aa, Homo Sapiens
RFLCKKSKP

SEQ ID NO: 974438 - protein, 9 aa, Homo Sapiens
SQTDERLFE

SEQ ID NO: 974439 - protein, 9 aa, Homo Sapiens
EVKSMGKSQ

SEQ ID NO: 974440 - protein, 9 aa, Homo Sapiens
FKENTSNSQ

SEQ ID NO: 974441 - protein, 9 aa, Homo Sapiens
GVYTPQRFL

SEQ ID NO: 974442 - protein, 9 aa, Homo Sapiens
IFAHNSVCS

SEQ ID NO: 974443 - protein, 9 aa, Homo Sapiens
EKALNPSQT

SEQ ID NO: 974444 - protein, 9 aa, Homo Sapiens
CDEIIQCRD

SEQ ID NO: 974445 - protein, 9 aa, Homo Sapiens
NVGCGPAEK

SEQ ID NO: 974446 - protein, 9 aa, Homo Sapiens
EKGEWNDVL

SEQ ID NO: 974447 - protein, 9 aa, Homo Sapiens
VGCGPAEKR

SEQ ID NO: 974448 - protein, 9 aa, Homo Sapiens
IRMNLSGRV

SEQ ID NO: 974449 - protein, 9 aa, Homo Sapiens
EPNVTSRGR

SEQ ID NO: 974450 - protein, 9 aa, Homo Sapiens
PVQVWKNFT

SEQ ID NO: 974451 - protein, 9 aa, Homo Sapiens
ETDGRGKII

SEQ ID NO: 974452 - protein, 9 aa, Homo Sapiens
FYLFAFFSF

SEQ ID NO: 974453 - protein, 9 aa, Homo Sapiens
VIFKKKVSF

SEQ ID NO: 974454 - protein, 9 aa, Homo Sapiens
PPTPPASPS

SEQ ID NO: 974455 - protein, 9 aa, Homo Sapiens
ESVEGTTIY

SEQ ID NO: 974456 - protein, 9 aa, Homo Sapiens
SLQVFHEKP

SEQ ID NO: 974457 - protein, 9 aa, Homo Sapiens
FFHGDLRRN

SEQ ID NO: 974458 - protein, 9 aa, Homo Sapiens
LFKSVFVPT

SEQ ID NO: 974459 - protein, 9 aa, Homo Sapiens
FYFGVGDSL

SEQ ID NO: 974460 - protein, 9 aa, Homo Sapiens
TKMDLLYSK

SEQ ID NO: 974461 - protein, 9 aa, Homo Sapiens
RWEFLPKNC

SEQ ID NO: 974462 - protein, 9 aa, Homo Sapiens
TKSDSLPFF

SEQ ID NO: 974463 - protein, 9 aa, Homo Sapiens
KFITSWPWN

SEQ ID NO: 974464 - protein, 9 aa, Homo Sapiens
SRRDNLEAL

SEQ ID NO: 974465 - protein, 9 aa, Homo Sapiens
PKKERPQDP

SEQ ID NO: 974466 - protein, 9 aa, Homo Sapiens
SVQTIIPRS

SEQ ID NO: 974467 - protein, 9 aa, Homo Sapiens
ITTTFPKNP

SEQ ID NO: 974468 - protein, 9 aa, Homo Sapiens
DVLTFTCKP

SEQ ID NO: 974469 - protein, 9 aa, Homo Sapiens
IPREVSPLL

SEQ ID NO: 974470 - protein, 9 aa, Homo Sapiens
AVQGMMAKG

SEQ ID NO: 974471 - protein, 9 aa, Homo Sapiens
VSFWTLAGE

SEQ ID NO: 974472 - protein, 9 aa, Homo Sapiens
LEGKKVDES

SEQ ID NO: 974473 - protein, 9 aa, Homo Sapiens
LPPVPPSSF

SEQ ID NO: 974474 - protein, 9 aa, Homo Sapiens
KRLGFRRQA

SEQ ID NO: 974475 - protein, 9 aa, Homo Sapiens
NCSSLETHN

SEQ ID NO: 974476 - protein, 9 aa, Homo Sapiens
SLYFLRTEN

SEQ ID NO: 974477 - protein, 9 aa, Homo Sapiens
NGVQAQMTK

SEQ ID NO: 974478 - protein, 9 aa, Homo Sapiens
FCQQPLSEP

SEQ ID NO: 974479 - protein, 9 aa, Homo Sapiens
SVSTSQRTC

SEQ ID NO: 974480 - protein, 9 aa, Homo Sapiens
LEEELRKAW

SEQ ID NO: 974481 - protein, 9 aa, Homo Sapiens
AVPTDQTGR

SEQ ID NO: 974482 - protein, 9 aa, Homo Sapiens
FFDRDPKVF

SEQ ID NO: 974483 - protein, 9 aa, Homo Sapiens
ADPFKLAKC

SEQ ID NO: 974484 - protein, 9 aa, Homo Sapiens
DLVAFTCFL

SEQ ID NO: 974485 - protein, 9 aa, Homo Sapiens
GVCGGDNTS

SEQ ID NO: 974486 - protein, 9 aa, Homo Sapiens
VPCILTYDF

SEQ ID NO: 974487 - protein, 9 aa, Homo Sapiens
RERVPCILT

SEQ ID NO: 974488 - protein, 9 aa, Homo Sapiens
LRLQALFKS

SEQ ID NO: 974489 - protein, 9 aa, Homo Sapiens
LDHINNHAA

SEQ ID NO: 974490 - protein, 9 aa, Homo Sapiens
ENKVCNHYK

SEQ ID NO: 974491 - protein, 9 aa, Homo Sapiens
FWEKLGSCV

SEQ ID NO: 974492 - protein, 9 aa, Homo Sapiens
LRGHTRKHP

SEQ ID NO: 974493 - protein, 9 aa, Homo Sapiens
LVNCSERIK

SEQ ID NO: 974494 - protein, 9 aa, Homo Sapiens
HSEIKPFQC

SEQ ID NO: 974495 - protein, 9 aa, Homo Sapiens
RRNIKKVDR

SEQ ID NO: 974496 - protein, 9 aa, Homo Sapiens
DGRVSHFPC

SEQ ID NO: 974497 - protein, 9 aa, Homo Sapiens
MALTSDLEK

SEQ ID NO: 974498 - protein, 9 aa, Homo Sapiens
LLRREINVL

SEQ ID NO: 974499 - protein, 9 aa, Homo Sapiens
PLQRTQESL

SEQ ID NO: 974500 - protein, 9 aa, Homo Sapiens
QETTNKKIG

SEQ ID NO: 974501 - protein, 9 aa, Homo Sapiens
YTFVFFHGD

SEQ ID NO: 974502 - protein, 9 aa, Homo Sapiens
DNIFQHFCE

SEQ ID NO: 974503 - protein, 9 aa, Homo Sapiens
ANGVQAQMT

SEQ ID NO: 974504 - protein, 9 aa, Homo Sapiens
LGQKFGSHP

SEQ ID NO: 974505 - protein, 9 aa, Homo Sapiens
LRRLSWFGI

SEQ ID NO: 974506 - protein, 9 aa, Homo Sapiens
YRRFAATLQ

SEQ ID NO: 974507 - protein, 9 aa, Homo Sapiens
FLVEIYKQR

SEQ ID NO: 974508 - protein, 9 aa, Homo Sapiens
GGPAPSICF

SEQ ID NO: 974509 - protein, 9 aa, Homo Sapiens
NGLCKARKH

SEQ ID NO: 974510 - protein, 9 aa, Homo Sapiens
RFLRTMGAI

SEQ ID NO: 974511 - protein, 9 aa, Homo Sapiens
IAFCQRNSH

SEQ ID NO: 974512 - protein, 9 aa, Homo Sapiens
ECAMKGKYR

SEQ ID NO: 974513 - protein, 9 aa, Homo Sapiens
VNLSQSLLT

SEQ ID NO: 974514 - protein, 9 aa, Homo Sapiens
LPQSSIVRA

SEQ ID NO: 974515 - protein, 9 aa, Homo Sapiens
VMKGKDIED

SEQ ID NO: 974516 - protein, 9 aa, Homo Sapiens
EVGRALLDK

SEQ ID NO: 974517 - protein, 9 aa, Homo Sapiens
DNAPAFAQT

SEQ ID NO: 974518 - protein, 9 aa, Homo Sapiens
EFDPRTPWL

SEQ ID NO: 974519 - protein, 9 aa, Homo Sapiens
VISELLERL

SEQ ID NO: 974520 - protein, 9 aa, Homo Sapiens
RRTVHYKGG

SEQ ID NO: 974521 - protein, 9 aa, Homo Sapiens
HEKFITSWP

SEQ ID NO: 974522 - protein, 9 aa, Homo Sapiens
SFYSAYYGK

SEQ ID NO: 974523 - protein, 9 aa, Homo Sapiens
KKESQKLLE

SEQ ID NO: 974524 - protein, 9 aa, Homo Sapiens
GPFNLVYGA

SEQ ID NO: 974525 - protein, 9 aa, Homo Sapiens
PGAHVYEKR

SEQ ID NO: 974526 - protein, 9 aa, Homo Sapiens
FAIAKYNAP

SEQ ID NO: 974527 - protein, 9 aa, Homo Sapiens
DLESSREQK

SEQ ID NO: 974528 - protein, 9 aa, Homo Sapiens
FLRSLVFPG

SEQ ID NO: 974529 - protein, 9 aa, Homo Sapiens
TSCQVVSGV

SEQ ID NO: 974530 - protein, 9 aa, Homo Sapiens
LAGNGSRDN

SEQ ID NO: 974531 - protein, 9 aa, Homo Sapiens
QPMELYNLS

SEQ ID NO: 974532 - protein, 9 aa, Homo Sapiens
LLGRSRQLT

SEQ ID NO: 974533 - protein, 9 aa, Homo Sapiens
KATKDSSRV

SEQ ID NO: 974534 - protein, 9 aa, Homo Sapiens
SPLPELVLR

SEQ ID NO: 974535 - protein, 9 aa, Homo Sapiens
QLSLLSHFA

SEQ ID NO: 974536 - protein, 9 aa, Homo Sapiens
VLHAERTQK

SEQ ID NO: 974537 - protein, 9 aa, Homo Sapiens
KRNKYFNPH

SEQ ID NO: 974538 - protein, 9 aa, Homo Sapiens
RIRMQSLVD

SEQ ID NO: 974539 - protein, 9 aa, Homo Sapiens
EPVFQNAKM

SEQ ID NO: 974540 - protein, 9 aa, Homo Sapiens
GGGGRRARR

SEQ ID NO: 974541 - protein, 9 aa, Homo Sapiens
ASKNPQVPL

SEQ ID NO: 974542 - protein, 9 aa, Homo Sapiens
KASARLLGA

SEQ ID NO: 974543 - protein, 9 aa, Homo Sapiens
RDLSLMQPP

SEQ ID NO: 974544 - protein, 9 aa, Homo Sapiens
PGNPGLPRI

SEQ ID NO: 974545 - protein, 9 aa, Homo Sapiens
AGEEARRKM

SEQ ID NO: 974546 - protein, 9 aa, Homo Sapiens
KKPTETPPM

SEQ ID NO: 974547 - protein, 9 aa, Homo Sapiens
LGALTFDRA

SEQ ID NO: 974548 - protein, 9 aa, Homo Sapiens
EQTTTSPKR

SEQ ID NO: 974549 - protein, 9 aa, Homo Sapiens
GVDKLFGKE

SEQ ID NO: 974550 - protein, 9 aa, Homo Sapiens
QEKVLQIIV

SEQ ID NO: 974551 - protein, 9 aa, Homo Sapiens
GDLQKEEHV

SEQ ID NO: 974552 - protein, 9 aa, Homo Sapiens
FLALEVDET

SEQ ID NO: 974553 - protein, 9 aa, Homo Sapiens
AEDALDADT

SEQ ID NO: 974554 - protein, 9 aa, Homo Sapiens
VNRRPCFLA

SEQ ID NO: 974555 - protein, 9 aa, Homo Sapiens
VTKKTFSLY

SEQ ID NO: 974556 - protein, 9 aa, Homo Sapiens
SPQEKVLQI

SEQ ID NO: 974557 - protein, 9 aa, Homo Sapiens
LKKVNKKIV

SEQ ID NO: 974558 - protein, 9 aa, Homo Sapiens
LDVFLRFLF

SEQ ID NO: 974559 - protein, 9 aa, Homo Sapiens
SSGPGQRVR

SEQ ID NO: 974560 - protein, 9 aa, Homo Sapiens
GSVAEMSFY

SEQ ID NO: 974561 - protein, 9 aa, Homo Sapiens
YALLVPLAL

SEQ ID NO: 974562 - protein, 9 aa, Homo Sapiens
KTTTLSFRF

SEQ ID NO: 974563 - protein, 9 aa, Homo Sapiens
NGTVESPRF

SEQ ID NO: 974564 - protein, 9 aa, Homo Sapiens
SILSHFQSF

SEQ ID NO: 974565 - protein, 9 aa, Homo Sapiens
DNIVTYNNE

SEQ ID NO: 974566 - protein, 9 aa, Homo Sapiens
CGVVSRRVA

SEQ ID NO: 974567 - protein, 9 aa, Homo Sapiens
KVSSHSSQV

SEQ ID NO: 974568 - protein, 9 aa, Homo Sapiens
YFFYFLGST

SEQ ID NO: 974569 - protein, 9 aa, Homo Sapiens
RSASFLEWE

SEQ ID NO: 974570 - protein, 9 aa, Homo Sapiens
SKIYLEFVL

SEQ ID NO: 974571 - protein, 9 aa, Homo Sapiens
FNPDLYLKI

SEQ ID NO: 974572 - protein, 9 aa, Homo Sapiens
HEESLQDVP

SEQ ID NO: 974573 - protein, 9 aa, Homo Sapiens
GCHFSISEA

SEQ ID NO: 974574 - protein, 9 aa, Homo Sapiens
EPQYQLQSF

SEQ ID NO: 974575 - protein, 9 aa, Homo Sapiens
SSALDTRKK

SEQ ID NO: 974576 - protein, 9 aa, Homo Sapiens
GAGGQFLEV

SEQ ID NO: 974577 - protein, 9 aa, Homo Sapiens
DAADAISPS

SEQ ID NO: 974578 - protein, 9 aa, Homo Sapiens
RTDRRFDED

SEQ ID NO: 974579 - protein, 9 aa, Homo Sapiens
FKLKEHMIR

SEQ ID NO: 974580 - protein, 9 aa, Homo Sapiens
DSSSLFPNG

SEQ ID NO: 974581 - protein, 9 aa, Homo Sapiens
WFGIPKPVR

SEQ ID NO: 974582 - protein, 9 aa, Homo Sapiens
TVVVFGLDG

SEQ ID NO: 974583 - protein, 9 aa, Homo Sapiens
FLFSEYYEP

SEQ ID NO: 974584 - protein, 9 aa, Homo Sapiens
SSPDGVYTD

SEQ ID NO: 974585 - protein, 9 aa, Homo Sapiens
LVKLHDGET

SEQ ID NO: 974586 - protein, 9 aa, Homo Sapiens
HAFLELKFS

SEQ ID NO: 974587 - protein, 9 aa, Homo Sapiens
TRPTRPKSS

SEQ ID NO: 974588 - protein, 9 aa, Homo Sapiens
EKGLPTNVS

SEQ ID NO: 974589 - protein, 9 aa, Homo Sapiens
PDLIYNVSR

SEQ ID NO: 974590 - protein, 9 aa, Homo Sapiens
YSVTKNMFC

SEQ ID NO: 974591 - protein, 9 aa, Homo Sapiens
SDMTATFSS

SEQ ID NO: 974592 - protein, 9 aa, Homo Sapiens
RRTAEPITV

SEQ ID NO: 974593 - protein, 9 aa, Homo Sapiens
ASISEKVQL

SEQ ID NO: 974594 - protein, 9 aa, Homo Sapiens
NQRGGAPHR

SEQ ID NO: 974595 - protein, 9 aa, Homo Sapiens
YMIPLKYVP

SEQ ID NO: 974596 - protein, 9 aa, Homo Sapiens
AELLNKFWN

SEQ ID NO: 974597 - protein, 9 aa, Homo Sapiens
SNSTSSPPH

SEQ ID NO: 974598 - protein, 9 aa, Homo Sapiens
FIFLVLGAT

SEQ ID NO: 974599 - protein, 9 aa, Homo Sapiens
LKENRDRNI

SEQ ID NO: 974600 - protein, 9 aa, Homo Sapiens
KAVRAHFGG

SEQ ID NO: 974601 - protein, 9 aa, Homo Sapiens
HPCETTDKC

SEQ ID NO: 974602 - protein, 9 aa, Homo Sapiens
EEWGPFNLV

SEQ ID NO: 974603 - protein, 9 aa, Homo Sapiens
PCYTGPGSI

SEQ ID NO: 974604 - protein, 9 aa, Homo Sapiens
GSQPLLELI

SEQ ID NO: 974605 - protein, 9 aa, Homo Sapiens
QSRLFKSVF

SEQ ID NO: 974606 - protein, 9 aa, Homo Sapiens
PLGSFRVVS

SEQ ID NO: 974607 - protein, 9 aa, Homo Sapiens
TFMTLQWHL

SEQ ID NO: 974608 - protein, 9 aa, Homo Sapiens
CPSAFDSLY

SEQ ID NO: 974609 - protein, 9 aa, Homo Sapiens
DRNIMATKI

SEQ ID NO: 974610 - protein, 9 aa, Homo Sapiens
TCCLWCCAL

SEQ ID NO: 974611 - protein, 9 aa, Homo Sapiens
CYTFILLWT

SEQ ID NO: 974612 - protein, 9 aa, Homo Sapiens
CKKSKPKKC

SEQ ID NO: 974613 - protein, 9 aa, Homo Sapiens
DGAGGQFLE

SEQ ID NO: 974614 - protein, 9 aa, Homo Sapiens
VFFVSHFYT

SEQ ID NO: 974615 - protein, 9 aa, Homo Sapiens
PTETPPMKE

SEQ ID NO: 974616 - protein, 9 aa, Homo Sapiens
QRIRELKDK

SEQ ID NO: 974617 - protein, 9 aa, Homo Sapiens
VVSLFIFGY

SEQ ID NO: 974618 - protein, 9 aa, Homo Sapiens
TTTFFFSRY

SEQ ID NO: 974619 - protein, 9 aa, Homo Sapiens
EKFWRELVP

SEQ ID NO: 974620 - protein, 9 aa, Homo Sapiens
DEAEVCKII

SEQ ID NO: 974621 - protein, 9 aa, Homo Sapiens
PQSESIWAK

SEQ ID NO: 974622 - protein, 9 aa, Homo Sapiens
YRSYTMQLT

SEQ ID NO: 974623 - protein, 9 aa, Homo Sapiens
ACHRQGEQE

SEQ ID NO: 974624 - protein, 9 aa, Homo Sapiens
PHNFVLLVQ

SEQ ID NO: 974625 - protein, 9 aa, Homo Sapiens
TTQALRLPP

SEQ ID NO: 974626 - protein, 9 aa, Homo Sapiens
VSLCSSAWF

SEQ ID NO: 974627 - protein, 9 aa, Homo Sapiens
LHTLATAAV

SEQ ID NO: 974628 - protein, 9 aa, Homo Sapiens
SWARQPGGD

SEQ ID NO: 974629 - protein, 9 aa, Homo Sapiens
KEMSRETTK

SEQ ID NO: 974630 - protein, 9 aa, Homo Sapiens
LVFTIQTRR

SEQ ID NO: 974631 - protein, 9 aa, Homo Sapiens
EVCKIIRVC

SEQ ID NO: 974632 - protein, 9 aa, Homo Sapiens
TGSAQPEPQ

SEQ ID NO: 974633 - protein, 9 aa, Homo Sapiens
KKSSFKDSR

SEQ ID NO: 974634 - protein, 9 aa, Homo Sapiens
GSFSSRHTT

SEQ ID NO: 974635 - protein, 9 aa, Homo Sapiens
MTKQQEQDP

SEQ ID NO: 974636 - protein, 9 aa, Homo Sapiens
RSQTDERLF

SEQ ID NO: 974637 - protein, 9 aa, Homo Sapiens
APPPKREAR

SEQ ID NO: 974638 - protein, 9 aa, Homo Sapiens
ERSKIYLEF

SEQ ID NO: 974639 - protein, 9 aa, Homo Sapiens
LSDEAVEVE

SEQ ID NO: 974640 - protein, 9 aa, Homo Sapiens
ERTQKDKDN

SEQ ID NO: 974641 - protein, 9 aa, Homo Sapiens
REKNIMRAN

SEQ ID NO: 974642 - protein, 9 aa, Homo Sapiens
NDPVCPPRS

SEQ ID NO: 974643 - protein, 9 aa, Homo Sapiens
LPSSGELYA

SEQ ID NO: 974644 - protein, 9 aa, Homo Sapiens
MNDYKLEKD

SEQ ID NO: 974645 - protein, 9 aa, Homo Sapiens
LKLSREKAQ

SEQ ID NO: 974646 - protein, 9 aa, Homo Sapiens
EVLKKEIGK

SEQ ID NO: 974647 - protein, 9 aa, Homo Sapiens
INVLRQKLA

SEQ ID NO: 974648 - protein, 9 aa, Homo Sapiens
FEHHLLSAA

SEQ ID NO: 974649 - protein, 9 aa, Homo Sapiens
GKGKVPDGY

SEQ ID NO: 974650 - protein, 9 aa, Homo Sapiens
VLESKGRQH

SEQ ID NO: 974651 - protein, 9 aa, Homo Sapiens
EKKEQGEAS

SEQ ID NO: 974652 - protein, 9 aa, Homo Sapiens
NGIYYQLSS

SEQ ID NO: 974653 - protein, 9 aa, Homo Sapiens
ENILEYDTP

SEQ ID NO: 974654 - protein, 9 aa, Homo Sapiens
PLAEKEDFD

SEQ ID NO: 974655 - protein, 9 aa, Homo Sapiens
VEERWTVVD

SEQ ID NO: 974656 - protein, 9 aa, Homo Sapiens
MVFGSLLKE

SEQ ID NO: 974657 - protein, 9 aa, Homo Sapiens
FQPMLSITI

SEQ ID NO: 974658 - protein, 9 aa, Homo Sapiens
IKGPPSGSP

SEQ ID NO: 974659 - protein, 9 aa, Homo Sapiens
VFTIQTRRT

SEQ ID NO: 974660 - protein, 9 aa, Homo Sapiens
SPLNDMVQS

SEQ ID NO: 974661 - protein, 9 aa, Homo Sapiens
APFPSDVSN

SEQ ID NO: 974662 - protein, 9 aa, Homo Sapiens
GSIQEETLA

SEQ ID NO: 974663 - protein, 9 aa, Homo Sapiens
ESHRKAFTT

SEQ ID NO: 974664 - protein, 9 aa, Homo Sapiens
HVKVGWRAF

SEQ ID NO: 974665 - protein, 9 aa, Homo Sapiens
EFIYDQTFQ

SEQ ID NO: 974666 - protein, 9 aa, Homo Sapiens
EFITKRHPD

SEQ ID NO: 974667 - protein, 9 aa, Homo Sapiens
PQVSYKEGD

SEQ ID NO: 974668 - protein, 9 aa, Homo Sapiens
GWASTADSL

SEQ ID NO: 974669 - protein, 9 aa, Homo Sapiens
FAQTSYTLF

SEQ ID NO: 974670 - protein, 9 aa, Homo Sapiens
DHQITKERE

SEQ ID NO: 974671 - protein, 9 aa, Homo Sapiens
GTTIYLPGP

SEQ ID NO: 974672 - protein, 9 aa, Homo Sapiens
HTVQEREKV

SEQ ID NO: 974673 - protein, 9 aa, Homo Sapiens
LYFEQCRRD

SEQ ID NO: 974674 - protein, 9 aa, Homo Sapiens
GFWRWNLVR

SEQ ID NO: 974675 - protein, 9 aa, Homo Sapiens
ASTDDAGIK

SEQ ID NO: 974676 - protein, 9 aa, Homo Sapiens
ITFLESSTS

SEQ ID NO: 974677 - protein, 9 aa, Homo Sapiens
VVIFAAKAK

SEQ ID NO: 974678 - protein, 9 aa, Homo Sapiens
SNTANHNLK

SEQ ID NO: 974679 - protein, 9 aa, Homo Sapiens
SLRGHTRKH

SEQ ID NO: 974680 - protein, 9 aa, Homo Sapiens
SAWFRTPGL

SEQ ID NO: 974681 - protein, 9 aa, Homo Sapiens
LALEVDETY

SEQ ID NO: 974682 - protein, 9 aa, Homo Sapiens
TENQSGGSL

SEQ ID NO: 974683 - protein, 9 aa, Homo Sapiens
CVMKGKDIE

SEQ ID NO: 974684 - protein, 9 aa, Homo Sapiens
DCEELMINA

SEQ ID NO: 974685 - protein, 9 aa, Homo Sapiens
FIYDQTFQP

SEQ ID NO: 974686 - protein, 9 aa, Homo Sapiens
PATLTAPCW

SEQ ID NO: 974687 - protein, 9 aa, Homo Sapiens
NFKSINHMN

SEQ ID NO: 974688 - protein, 9 aa, Homo Sapiens
SDGSFSSRH

SEQ ID NO: 974689 - protein, 9 aa, Homo Sapiens
PDKFTEDEK

SEQ ID NO: 974690 - protein, 9 aa, Homo Sapiens
IRPHDIFCQ

SEQ ID NO: 974691 - protein, 9 aa, Homo Sapiens
PTYNPGSPP

SEQ ID NO: 974692 - protein, 9 aa, Homo Sapiens
VGVVIANFI

SEQ ID NO: 974693 - protein, 9 aa, Homo Sapiens
WKLTFVILA

SEQ ID NO: 974694 - protein, 9 aa, Homo Sapiens
KKEFELRPQ

SEQ ID NO: 974695 - protein, 9 aa, Homo Sapiens
ARNFGASDS

SEQ ID NO: 974696 - protein, 9 aa, Homo Sapiens
KRTGQEHQG

SEQ ID NO: 974697 - protein, 9 aa, Homo Sapiens
AVKRTGQEH

SEQ ID NO: 974698 - protein, 9 aa, Homo Sapiens
IINLQILTN

SEQ ID NO: 974699 - protein, 9 aa, Homo Sapiens
KKRSLINKF

SEQ ID NO: 974700 - protein, 9 aa, Homo Sapiens
ELKYEEKLV

SEQ ID NO: 974701 - protein, 9 aa, Homo Sapiens
FQMLQRCTK

SEQ ID NO: 974702 - protein, 9 aa, Homo Sapiens
SRIGLLAPS

SEQ ID NO: 974703 - protein, 9 aa, Homo Sapiens
GVGQEEEED

SEQ ID NO: 974704 - protein, 9 aa, Homo Sapiens
RATESGHLP

SEQ ID NO: 974705 - protein, 9 aa, Homo Sapiens
NSPLTVSMF

SEQ ID NO: 974706 - protein, 9 aa, Homo Sapiens
PNDIEQWFT

SEQ ID NO: 974707 - protein, 9 aa, Homo Sapiens
VLGATEYLL

SEQ ID NO: 974708 - protein, 9 aa, Homo Sapiens
IFMTYYILK

SEQ ID NO: 974709 - protein, 9 aa, Homo Sapiens
SEQDIVKMV

SEQ ID NO: 974710 - protein, 9 aa, Homo Sapiens
SVEGTTIYL

SEQ ID NO: 974711 - protein, 9 aa, Homo Sapiens
VQKDVFLVV

SEQ ID NO: 974712 - protein, 9 aa, Homo Sapiens
QLGVLRCYC

SEQ ID NO: 974713 - protein, 9 aa, Homo Sapiens
LTRKLYDQI

SEQ ID NO: 974714 - protein, 9 aa, Homo Sapiens
EILEGPQEE

SEQ ID NO: 974715 - protein, 9 aa, Homo Sapiens
PKFPKKEFQ

SEQ ID NO: 974716 - protein, 9 aa, Homo Sapiens
MEFLSSRRG

SEQ ID NO: 974717 - protein, 9 aa, Homo Sapiens
VGGMFTQKQ

SEQ ID NO: 974718 - protein, 9 aa, Homo Sapiens
SIIEDVMGP

SEQ ID NO: 974719 - protein, 9 aa, Homo Sapiens
KKFDDDTYD

SEQ ID NO: 974720 - protein, 9 aa, Homo Sapiens
KGEWNDVLC

SEQ ID NO: 974721 - protein, 9 aa, Homo Sapiens
TAMVTSIEM

SEQ ID NO: 974722 - protein, 9 aa, Homo Sapiens
TPWLLVTHL

SEQ ID NO: 974723 - protein, 9 aa, Homo Sapiens
QLFIFLVLG

SEQ ID NO: 974724 - protein, 9 aa, Homo Sapiens
VQELRVRAK

SEQ ID NO: 974725 - protein, 9 aa, Homo Sapiens
FLTVLIQRS

SEQ ID NO: 974726 - protein, 9 aa, Homo Sapiens
PQRNLSSST

SEQ ID NO: 974727 - protein, 9 aa, Homo Sapiens
KPYNNKECR

SEQ ID NO: 974728 - protein, 9 aa, Homo Sapiens
IQTRRTAEP

SEQ ID NO: 974729 - protein, 9 aa, Homo Sapiens
AQAAPQTYV

SEQ ID NO: 974730 - protein, 9 aa, Homo Sapiens
FSLYPLHLA

SEQ ID NO: 974731 - protein, 9 aa, Homo Sapiens
FLESSTSDH

SEQ ID NO: 974732 - protein, 9 aa, Homo Sapiens
FSRRILTTS

SEQ ID NO: 974733 - protein, 9 aa, Homo Sapiens
VVFGLDGVR

SEQ ID NO: 974734 - protein, 9 aa, Homo Sapiens
SVIFICDRN

SEQ ID NO: 974735 - protein, 9 aa, Homo Sapiens
YSWIEFITK

SEQ ID NO: 974736 - protein, 9 aa, Homo Sapiens
ASYLWWING

SEQ ID NO: 974737 - protein, 9 aa, Homo Sapiens
TSSVSPVAG

SEQ ID NO: 974738 - protein, 9 aa, Homo Sapiens
KLGSCVATE

SEQ ID NO: 974739 - protein, 9 aa, Homo Sapiens
VEPDLIREG

SEQ ID NO: 974740 - protein, 9 aa, Homo Sapiens
QLDAIGTKR

SEQ ID NO: 974741 - protein, 9 aa, Homo Sapiens
EGVGILRIP

SEQ ID NO: 974742 - protein, 9 aa, Homo Sapiens
RKTKTSPCD

SEQ ID NO: 974743 - protein, 9 aa, Homo Sapiens
PPERRLHWN

SEQ ID NO: 974744 - protein, 9 aa, Homo Sapiens
YFRPVMDTY

SEQ ID NO: 974745 - protein, 9 aa, Homo Sapiens
ELLLFVGRG

SEQ ID NO: 974746 - protein, 9 aa, Homo Sapiens
YTRMKIFRN

SEQ ID NO: 974747 - protein, 9 aa, Homo Sapiens
CIPSYNTIG

SEQ ID NO: 974748 - protein, 9 aa, Homo Sapiens
PRVAAEPLD

SEQ ID NO: 974749 - protein, 9 aa, Homo Sapiens
QEIFRMFSK

SEQ ID NO: 974750 - protein, 9 aa, Homo Sapiens
FYYGCALQF

SEQ ID NO: 974751 - protein, 9 aa, Homo Sapiens
DFMFVKRNG

SEQ ID NO: 974752 - protein, 9 aa, Homo Sapiens
LHSKNSGKS

SEQ ID NO: 974753 - protein, 9 aa, Homo Sapiens
LLIQDFVSL

SEQ ID NO: 974754 - protein, 9 aa, Homo Sapiens
ACEQDYVVT

SEQ ID NO: 974755 - protein, 9 aa, Homo Sapiens
LNEDIIYSF

SEQ ID NO: 974756 - protein, 9 aa, Homo Sapiens
KRDMDDYIF

SEQ ID NO: 974757 - protein, 9 aa, Homo Sapiens
GYRGFDCQN

SEQ ID NO: 974758 - protein, 9 aa, Homo Sapiens
QTFKVPDLV

SEQ ID NO: 974759 - protein, 9 aa, Homo Sapiens
NQISLLNIM

SEQ ID NO: 974760 - protein, 9 aa, Homo Sapiens
LAPDTFDDN

SEQ ID NO: 974761 - protein, 9 aa, Homo Sapiens
LVWRASKLV

SEQ ID NO: 974762 - protein, 9 aa, Homo Sapiens
SNISKVQKD

SEQ ID NO: 974763 - protein, 9 aa, Homo Sapiens
YTDDDLPKS

SEQ ID NO: 974764 - protein, 9 aa, Homo Sapiens
RTGISAGFN

SEQ ID NO: 974765 - protein, 9 aa, Homo Sapiens
KEKIFLSEP

SEQ ID NO: 974766 - protein, 9 aa, Homo Sapiens
ADAISPSRA

SEQ ID NO: 974767 - protein, 9 aa, Homo Sapiens
GQYTHKFDG

SEQ ID NO: 974768 - protein, 9 aa, Homo Sapiens
AMTQLRVMK

SEQ ID NO: 974769 - protein, 9 aa, Homo Sapiens
YFENEKRAT

SEQ ID NO: 974770 - protein, 9 aa, Homo Sapiens
ALSLGPPAP

SEQ ID NO: 974771 - protein, 9 aa, Homo Sapiens
SSSTEPSSQ

SEQ ID NO: 974772 - protein, 9 aa, Homo Sapiens
YYYSEAFKG

SEQ ID NO: 974773 - protein, 9 aa, Homo Sapiens
SFGSGGGGP

SEQ ID NO: 974774 - protein, 9 aa, Homo Sapiens
SWIEFITKR

SEQ ID NO: 974775 - protein, 9 aa, Homo Sapiens
AKGKNWQML

SEQ ID NO: 974776 - protein, 9 aa, Homo Sapiens
GLKEKIFLS

SEQ ID NO: 974777 - protein, 9 aa, Homo Sapiens
AESDSGKLS

SEQ ID NO: 974778 - protein, 9 aa, Homo Sapiens
MCVNLTLTG

SEQ ID NO: 974779 - protein, 9 aa, Homo Sapiens
MALQVQLAI

SEQ ID NO: 974780 - protein, 9 aa, Homo Sapiens
VARKCLSLN

SEQ ID NO: 974781 - protein, 9 aa, Homo Sapiens
RETQREKIL

SEQ ID NO: 974782 - protein, 9 aa, Homo Sapiens
LTIPDKFTE

SEQ ID NO: 974783 - protein, 9 aa, Homo Sapiens
RKAETEPHE

SEQ ID NO: 974784 - protein, 9 aa, Homo Sapiens
KEEYSAMRD

SEQ ID NO: 974785 - protein, 9 aa, Homo Sapiens
LACLQLALG

SEQ ID NO: 974786 - protein, 9 aa, Homo Sapiens
MLPPTFNLI

SEQ ID NO: 974787 - protein, 9 aa, Homo Sapiens
QGQHEESLQ

SEQ ID NO: 974788 - protein, 9 aa, Homo Sapiens
DGSLTGHKE

SEQ ID NO: 974789 - protein, 9 aa, Homo Sapiens
LVQLGVLRC

SEQ ID NO: 974790 - protein, 9 aa, Homo Sapiens
AMPANGALF

SEQ ID NO: 974791 - protein, 9 aa, Homo Sapiens
KEEEETPPS

SEQ ID NO: 974792 - protein, 9 aa, Homo Sapiens
ETKNSSYQT

SEQ ID NO: 974793 - protein, 9 aa, Homo Sapiens
SPSLDNDSL

SEQ ID NO: 974794 - protein, 9 aa, Homo Sapiens
KRGSGHPAY

SEQ ID NO: 974795 - protein, 9 aa, Homo Sapiens
VTEPDGRVS

SEQ ID NO: 974796 - protein, 9 aa, Homo Sapiens
RAHLPQDSK

SEQ ID NO: 974797 - protein, 9 aa, Homo Sapiens
GTLIEPLSV

SEQ ID NO: 974798 - protein, 9 aa, Homo Sapiens
LECNHHSGD

SEQ ID NO: 974799 - protein, 9 aa, Homo Sapiens
IPLPANALV

SEQ ID NO: 974800 - protein, 9 aa, Homo Sapiens
ISIQSKCRR

SEQ ID NO: 974801 - protein, 9 aa, Homo Sapiens
ALSTCGTHF

SEQ ID NO: 974802 - protein, 9 aa, Homo Sapiens
FSNSMEFLS

SEQ ID NO: 974803 - protein, 9 aa, Homo Sapiens
WDTFHVLVF

SEQ ID NO: 974804 - protein, 9 aa, Homo Sapiens
GPGCHFSIS

SEQ ID NO: 974805 - protein, 9 aa, Homo Sapiens
VVNSGDAVT

SEQ ID NO: 974806 - protein, 9 aa, Homo Sapiens
DQKWLAMLI

SEQ ID NO: 974807 - protein, 9 aa, Homo Sapiens
ERPMGLKGY

SEQ ID NO: 974808 - protein, 9 aa, Homo Sapiens
CGHMFFWEK

SEQ ID NO: 974809 - protein, 9 aa, Homo Sapiens
LDSFFRNEI

SEQ ID NO: 974810 - protein, 9 aa, Homo Sapiens
YDQTFQPHR

SEQ ID NO: 974811 - protein, 9 aa, Homo Sapiens
VGRALLDKG

SEQ ID NO: 974812 - protein, 9 aa, Homo Sapiens
EQQPDSRKF

SEQ ID NO: 974813 - protein, 9 aa, Homo Sapiens
FPFARGGRA

SEQ ID NO: 974814 - protein, 9 aa, Homo Sapiens
SVLIECPAR

SEQ ID NO: 974815 - protein, 9 aa, Homo Sapiens
RGSDHVKVG

SEQ ID NO: 974816 - protein, 9 aa, Homo Sapiens
QVESITPKP

SEQ ID NO: 974817 - protein, 9 aa, Homo Sapiens
EKGCLGWTE

SEQ ID NO: 974818 - protein, 9 aa, Homo Sapiens
RPRSSFTTD

SEQ ID NO: 974819 - protein, 9 aa, Homo Sapiens
ESFTRESTS

SEQ ID NO: 974820 - protein, 9 aa, Homo Sapiens
GGGRRARRC

SEQ ID NO: 974821 - protein, 9 aa, Homo Sapiens
ISSSLNKTD

SEQ ID NO: 974822 - protein, 9 aa, Homo Sapiens
SAFDSLYFL

SEQ ID NO: 974823 - protein, 9 aa, Homo Sapiens
SVGTSFSKD

SEQ ID NO: 974824 - protein, 9 aa, Homo Sapiens
CTEGTTQAL

SEQ ID NO: 974825 - protein, 9 aa, Homo Sapiens
SEQKTSDPE

SEQ ID NO: 974826 - protein, 9 aa, Homo Sapiens
PLKYVPGMD

SEQ ID NO: 974827 - protein, 9 aa, Homo Sapiens
LTKHKIIHV

SEQ ID NO: 974828 - protein, 9 aa, Homo Sapiens
GAVKRTGQE

SEQ ID NO: 974829 - protein, 9 aa, Homo Sapiens
SLIMRNLGQ

SEQ ID NO: 974830 - protein, 9 aa, Homo Sapiens
SVPPRDEAQ

SEQ ID NO: 974831 - protein, 9 aa, Homo Sapiens
LTAPCWLLE

SEQ ID NO: 974832 - protein, 9 aa, Homo Sapiens
LQYSTVINS

SEQ ID NO: 974833 - protein, 9 aa, Homo Sapiens
QESSRRAEL

SEQ ID NO: 974834 - protein, 9 aa, Homo Sapiens
AFSEYSGFS

SEQ ID NO: 974835 - protein, 9 aa, Homo Sapiens
NKPTGCEEG

SEQ ID NO: 974836 - protein, 9 aa, Homo Sapiens
KAMCVNLTL

SEQ ID NO: 974837 - protein, 9 aa, Homo Sapiens
TTGGPRRLE

SEQ ID NO: 974838 - protein, 9 aa, Homo Sapiens
SLSSLGLEQ

SEQ ID NO: 974839 - protein, 9 aa, Homo Sapiens
LKFSHKEKP

SEQ ID NO: 974840 - protein, 9 aa, Homo Sapiens
VHPGHHHLE

SEQ ID NO: 974841 - protein, 9 aa, Homo Sapiens
DHVKVGWRA

SEQ ID NO: 974842 - protein, 9 aa, Homo Sapiens
HTKPEPPEG

SEQ ID NO: 974843 - protein, 9 aa, Homo Sapiens
SVTFDHEHH

SEQ ID NO: 974844 - protein, 9 aa, Homo Sapiens
GFDCQNNLH

SEQ ID NO: 974845 - protein, 9 aa, Homo Sapiens
GKIIPEELE

SEQ ID NO: 974846 - protein, 9 aa, Homo Sapiens
MAYWKKESQ

SEQ ID NO: 974847 - protein, 9 aa, Homo Sapiens
NDKATKDSS

SEQ ID NO: 974848 - protein, 9 aa, Homo Sapiens
LTDLSADLK

SEQ ID NO: 974849 - protein, 9 aa, Homo Sapiens
SAMLLFVFF

SEQ ID NO: 974850 - protein, 9 aa, Homo Sapiens
ENGFILRGS

SEQ ID NO: 974851 - protein, 9 aa, Homo Sapiens
VPLEGKKVD

SEQ ID NO: 974852 - protein, 9 aa, Homo Sapiens
YGPSFILQV

SEQ ID NO: 974853 - protein, 9 aa, Homo Sapiens
ETDDIQGES

SEQ ID NO: 974854 - protein, 9 aa, Homo Sapiens
PLPPPHLSL

SEQ ID NO: 974855 - protein, 9 aa, Homo Sapiens
RADSGEENT

SEQ ID NO: 974856 - protein, 9 aa, Homo Sapiens
PPTSSVSPV

SEQ ID NO: 974857 - protein, 9 aa, Homo Sapiens
KIYLEFVLS

SEQ ID NO: 974858 - protein, 9 aa, Homo Sapiens
FGVEPDLIR

SEQ ID NO: 974859 - protein, 9 aa, Homo Sapiens
GSPAEQGPS

SEQ ID NO: 974860 - protein, 9 aa, Homo Sapiens
VTTNETGGE

SEQ ID NO: 974861 - protein, 9 aa, Homo Sapiens
VSLFIFGYC

SEQ ID NO: 974862 - protein, 9 aa, Homo Sapiens
TGLFRAWVW

SEQ ID NO: 974863 - protein, 9 aa, Homo Sapiens
DISRIKREN

SEQ ID NO: 974864 - protein, 9 aa, Homo Sapiens
EDLRDGYNL

SEQ ID NO: 974865 - protein, 9 aa, Homo Sapiens
VTFLDDIRQ

SEQ ID NO: 974866 - protein, 9 aa, Homo Sapiens
AGYDGESIE

SEQ ID NO: 974867 - protein, 9 aa, Homo Sapiens
QYSAGNFWN

SEQ ID NO: 974868 - protein, 9 aa, Homo Sapiens
FAHNSVCSQ

SEQ ID NO: 974869 - protein, 9 aa, Homo Sapiens
DSKTTYNRF

SEQ ID NO: 974870 - protein, 9 aa, Homo Sapiens
ISFLTILAK

SEQ ID NO: 974871 - protein, 9 aa, Homo Sapiens
MFKVIQKSV

SEQ ID NO: 974872 - protein, 9 aa, Homo Sapiens
FREEKALNP

SEQ ID NO: 974873 - protein, 9 aa, Homo Sapiens
LSFEESPQE

SEQ ID NO: 974874 - protein, 9 aa, Homo Sapiens
ILPDNLPEL

SEQ ID NO: 974875 - protein, 9 aa, Homo Sapiens
IIYAGLRSN

SEQ ID NO: 974876 - protein, 9 aa, Homo Sapiens
AMKGKYRIY

SEQ ID NO: 974877 - protein, 9 aa, Homo Sapiens
VEERGVPGE

SEQ ID NO: 974878 - protein, 9 aa, Homo Sapiens
CIWCELGGH

SEQ ID NO: 974879 - protein, 9 aa, Homo Sapiens
SGMTFVILF

SEQ ID NO: 974880 - protein, 9 aa, Homo Sapiens
VLPHSHVEK

SEQ ID NO: 974881 - protein, 9 aa, Homo Sapiens
STADSLSNM

SEQ ID NO: 974882 - protein, 9 aa, Homo Sapiens
VRHCSAPEN

SEQ ID NO: 974883 - protein, 9 aa, Homo Sapiens
RFLDQWASN

SEQ ID NO: 974884 - protein, 9 aa, Homo Sapiens
FIDQLDAIG

SEQ ID NO: 974885 - protein, 9 aa, Homo Sapiens
VKRNGPDGP

SEQ ID NO: 974886 - protein, 9 aa, Homo Sapiens
KDRFQELKQ

SEQ ID NO: 974887 - protein, 9 aa, Homo Sapiens
QADLPLGQQ

SEQ ID NO: 974888 - protein, 9 aa, Homo Sapiens
QLKTLRREN

SEQ ID NO: 974889 - protein, 9 aa, Homo Sapiens
KNIPREVSP

SEQ ID NO: 974890 - protein, 9 aa, Homo Sapiens
RCPREGHAL

SEQ ID NO: 974891 - protein, 9 aa, Homo Sapiens
GQSKERKHL

SEQ ID NO: 974892 - protein, 9 aa, Homo Sapiens
HMGSGESHR

SEQ ID NO: 974893 - protein, 9 aa, Homo Sapiens
HYKGGAVSV

SEQ ID NO: 974894 - protein, 9 aa, Homo Sapiens
DFVDKIVIQ

SEQ ID NO: 974895 - protein, 9 aa, Homo Sapiens
KNMRDLMAS

SEQ ID NO: 974896 - protein, 9 aa, Homo Sapiens
WCCALRSSS

SEQ ID NO: 974897 - protein, 9 aa, Homo Sapiens
ESHVECRPY

SEQ ID NO: 974898 - protein, 9 aa, Homo Sapiens
LKALRENPC

SEQ ID NO: 974899 - protein, 9 aa, Homo Sapiens
NTYCTKQEV

SEQ ID NO: 974900 - protein, 9 aa, Homo Sapiens
RVRVESNSD

SEQ ID NO: 974901 - protein, 9 aa, Homo Sapiens
HGGNLVVSY

SEQ ID NO: 974902 - protein, 9 aa, Homo Sapiens
IIEQLVESH

SEQ ID NO: 974903 - protein, 9 aa, Homo Sapiens
NKIKSFQKQ

SEQ ID NO: 974904 - protein, 9 aa, Homo Sapiens
ESDHIIMID

SEQ ID NO: 974905 - protein, 9 aa, Homo Sapiens
LQLALGLAI

SEQ ID NO: 974906 - protein, 9 aa, Homo Sapiens
EQQNSTQIR

SEQ ID NO: 974907 - protein, 9 aa, Homo Sapiens
ITAPKTQRL

SEQ ID NO: 974908 - protein, 9 aa, Homo Sapiens
AQTKVTWYK

SEQ ID NO: 974909 - protein, 9 aa, Homo Sapiens
NWQMLAQKN

SEQ ID NO: 974910 - protein, 9 aa, Homo Sapiens
EHHLLSAAE

SEQ ID NO: 974911 - protein, 9 aa, Homo Sapiens
CWEWQKAHE

SEQ ID NO: 974912 - protein, 9 aa, Homo Sapiens
ICDLRKVRP

SEQ ID NO: 974913 - protein, 9 aa, Homo Sapiens
VLRVTNGTS

SEQ ID NO: 974914 - protein, 9 aa, Homo Sapiens
DDLWDAWGP

SEQ ID NO: 974915 - protein, 9 aa, Homo Sapiens
HWKGNFKNS

SEQ ID NO: 974916 - protein, 9 aa, Homo Sapiens
IDKVEDNIF

SEQ ID NO: 974917 - protein, 9 aa, Homo Sapiens
YLKENRDRN

SEQ ID NO: 974918 - protein, 9 aa, Homo Sapiens
SQTYFYRAS

SEQ ID NO: 974919 - protein, 9 aa, Homo Sapiens
FPFTLKIFK

SEQ ID NO: 974920 - protein, 9 aa, Homo Sapiens
SPLLWATAS

SEQ ID NO: 974921 - protein, 9 aa, Homo Sapiens
AVNVWQKNL

SEQ ID NO: 974922 - protein, 9 aa, Homo Sapiens
EKLEFTRGQ

SEQ ID NO: 974923 - protein, 9 aa, Homo Sapiens
YSSEPGNEA

SEQ ID NO: 974924 - protein, 9 aa, Homo Sapiens
TSAELLNKF

SEQ ID NO: 974925 - protein, 9 aa, Homo Sapiens
KFLEEAEIY

SEQ ID NO: 974926 - protein, 9 aa, Homo Sapiens
QDLEACCQL

SEQ ID NO: 974927 - protein, 9 aa, Homo Sapiens
RLLDSEDVD

SEQ ID NO: 974928 - protein, 9 aa, Homo Sapiens
VLVFTLVDA

SEQ ID NO: 974929 - protein, 9 aa, Homo Sapiens
KRSLINKFD

SEQ ID NO: 974930 - protein, 9 aa, Homo Sapiens
RGPLNLDSQ

SEQ ID NO: 974931 - protein, 9 aa, Homo Sapiens
LSSDLRLQA

SEQ ID NO: 974932 - protein, 9 aa, Homo Sapiens
DSQETYRDY

SEQ ID NO: 974933 - protein, 9 aa, Homo Sapiens
PSLMEPPSS

SEQ ID NO: 974934 - protein, 9 aa, Homo Sapiens
FGSQPLLEL

SEQ ID NO: 974935 - protein, 9 aa, Homo Sapiens
LVLRKVGAP

SEQ ID NO: 974936 - protein, 9 aa, Homo Sapiens
QIKMFIQQE

SEQ ID NO: 974937 - protein, 9 aa, Homo Sapiens
MKFKRGSGH

SEQ ID NO: 974938 - protein, 9 aa, Homo Sapiens
EESLDQLKT

SEQ ID NO: 974939 - protein, 9 aa, Homo Sapiens
IENKVCNHY

SEQ ID NO: 974940 - protein, 9 aa, Homo Sapiens
AVCQFLLKS

SEQ ID NO: 974941 - protein, 9 aa, Homo Sapiens
FHIHQSPHW

SEQ ID NO: 974942 - protein, 9 aa, Homo Sapiens
QQLHLKIDS

SEQ ID NO: 974943 - protein, 9 aa, Homo Sapiens
LRKTGVELE

SEQ ID NO: 974944 - protein, 9 aa, Homo Sapiens
KGLPTNVST

SEQ ID NO: 974945 - protein, 9 aa, Homo Sapiens
LSTCGTHFI

SEQ ID NO: 974946 - protein, 9 aa, Homo Sapiens
FVLSSTGKK

SEQ ID NO: 974947 - protein, 9 aa, Homo Sapiens
IRAINQTTC

SEQ ID NO: 974948 - protein, 9 aa, Homo Sapiens
LKTVINDSL

SEQ ID NO: 974949 - protein, 9 aa, Homo Sapiens
LAGESTETG

SEQ ID NO: 974950 - protein, 9 aa, Homo Sapiens
YLPRVCSYT

SEQ ID NO: 974951 - protein, 9 aa, Homo Sapiens
SKLKAGGHR

SEQ ID NO: 974952 - protein, 9 aa, Homo Sapiens
ERRNWVLAG

SEQ ID NO: 974953 - protein, 9 aa, Homo Sapiens
NMTTHVFFR

SEQ ID NO: 974954 - protein, 9 aa, Homo Sapiens
ILRRNEKDL

SEQ ID NO: 974955 - protein, 9 aa, Homo Sapiens
FNNLLVMRT

SEQ ID NO: 974956 - protein, 9 aa, Homo Sapiens
FYFMVETAF

SEQ ID NO: 974957 - protein, 9 aa, Homo Sapiens
VQWRDLSLM

SEQ ID NO: 974958 - protein, 9 aa, Homo Sapiens
CEELMINAT

SEQ ID NO: 974959 - protein, 9 aa, Homo Sapiens
PTETLSWPA

SEQ ID NO: 974960 - protein, 9 aa, Homo Sapiens
VFLLASIMK

SEQ ID NO: 974961 - protein, 9 aa, Homo Sapiens
QRCPREGHA

SEQ ID NO: 974962 - protein, 9 aa, Homo Sapiens
ISPSPPGPQ

SEQ ID NO: 974963 - protein, 9 aa, Homo Sapiens
NCSERIKNQ

SEQ ID NO: 974964 - protein, 9 aa, Homo Sapiens
LTGKGTQLV

SEQ ID NO: 974965 - protein, 9 aa, Homo Sapiens
DPALLDRHE

SEQ ID NO: 974966 - protein, 9 aa, Homo Sapiens
YDRRLKFHS

SEQ ID NO: 974967 - protein, 9 aa, Homo Sapiens
MKRENILEY

SEQ ID NO: 974968 - protein, 9 aa, Homo Sapiens
VSAGNALKG

SEQ ID NO: 974969 - protein, 9 aa, Homo Sapiens
KRENTTLES

SEQ ID NO: 974970 - protein, 9 aa, Homo Sapiens
MRTGISAGF

SEQ ID NO: 974971 - protein, 9 aa, Homo Sapiens
FSVEEVVRR

SEQ ID NO: 974972 - protein, 9 aa, Homo Sapiens
HPGHHHLEI

SEQ ID NO: 974973 - protein, 9 aa, Homo Sapiens
HQTSSPLCT

SEQ ID NO: 974974 - protein, 9 aa, Homo Sapiens
CGPAEKRVL

SEQ ID NO: 974975 - protein, 9 aa, Homo Sapiens
VDSFEMKFY

SEQ ID NO: 974976 - protein, 9 aa, Homo Sapiens
HEDSAMHLA

SEQ ID NO: 974977 - protein, 9 aa, Homo Sapiens
KEIGKLEEF

SEQ ID NO: 974978 - protein, 9 aa, Homo Sapiens
RAFSSFVIL

SEQ ID NO: 974979 - protein, 9 aa, Homo Sapiens
SGLMSKLVP

SEQ ID NO: 974980 - protein, 9 aa, Homo Sapiens
TGHKEHTVI

SEQ ID NO: 974981 - protein, 9 aa, Homo Sapiens
STSVTTNET

SEQ ID NO: 974982 - protein, 9 aa, Homo Sapiens
QLDGLVWRA

SEQ ID NO: 974983 - protein, 9 aa, Homo Sapiens
WNCTRGIRK

SEQ ID NO: 974984 - protein, 9 aa, Homo Sapiens
RQGQLVEVE

SEQ ID NO: 974985 - protein, 9 aa, Homo Sapiens
AKGAEDALD

SEQ ID NO: 974986 - protein, 9 aa, Homo Sapiens
QSLWVRVCA

SEQ ID NO: 974987 - protein, 9 aa, Homo Sapiens
KVARKCLSL

SEQ ID NO: 974988 - protein, 9 aa, Homo Sapiens
LAPSNCISE

SEQ ID NO: 974989 - protein, 9 aa, Homo Sapiens
VHVNLSQSL

SEQ ID NO: 974990 - protein, 9 aa, Homo Sapiens
PLLDHINNH

SEQ ID NO: 974991 - protein, 9 aa, Homo Sapiens
YMAACVVFI

SEQ ID NO: 974992 - protein, 9 aa, Homo Sapiens
LYSKTAKQC

SEQ ID NO: 974993 - protein, 9 aa, Homo Sapiens
TDDAGIKYS

SEQ ID NO: 974994 - protein, 9 aa, Homo Sapiens
EEAGPSPST

SEQ ID NO: 974995 - protein, 9 aa, Homo Sapiens
LQSFKPHTA

SEQ ID NO: 974996 - protein, 9 aa, Homo Sapiens
ELRLEKARL

SEQ ID NO: 974997 - protein, 9 aa, Homo Sapiens
TFFFSRYKS

SEQ ID NO: 974998 - protein, 9 aa, Homo Sapiens
ELRKTKTSP

SEQ ID NO: 974999 - protein, 9 aa, Homo Sapiens
AVFKRFLTI

SEQ ID NO: 975000 - protein, 9 aa, Homo Sapiens
ENTTLESTD

SEQ ID NO: 975001 - protein, 9 aa, Homo Sapiens
IKSRNNEVT

SEQ ID NO: 975002 - protein, 9 aa, Homo Sapiens
SISEKVQLE

SEQ ID NO: 975003 - protein, 9 aa, Homo Sapiens
KCRSLRATE

SEQ ID NO: 975004 - protein, 9 aa, Homo Sapiens
SKKKSSSRK

SEQ ID NO: 975005 - protein, 9 aa, Homo Sapiens
KGMRQADIR

SEQ ID NO: 975006 - protein, 9 aa, Homo Sapiens
SLMNKKARI

SEQ ID NO: 975007 - protein, 9 aa, Homo Sapiens
WYDFVWNCT

SEQ ID NO: 975008 - protein, 9 aa, Homo Sapiens
MKDSGNKPL

SEQ ID NO: 975009 - protein, 9 aa, Homo Sapiens
SSLRRHETS

SEQ ID NO: 975010 - protein, 9 aa, Homo Sapiens
GEGPSANPP

SEQ ID NO: 975011 - protein, 9 aa, Homo Sapiens
ALELLSDEA

SEQ ID NO: 975012 - protein, 9 aa, Homo Sapiens
VDINGLRRV

SEQ ID NO: 975013 - protein, 9 aa, Homo Sapiens
SPMPEKSQK

SEQ ID NO: 975014 - protein, 9 aa, Homo Sapiens
FINTANWRV

SEQ ID NO: 975015 - protein, 9 aa, Homo Sapiens
CVLGLISCS

SEQ ID NO: 975016 - protein, 9 aa, Homo Sapiens
DAESDSGKL

SEQ ID NO: 975017 - protein, 9 aa, Homo Sapiens
EHYEKNMRD

SEQ ID NO: 975018 - protein, 9 aa, Homo Sapiens
WINGQSLPM

SEQ ID NO: 975019 - protein, 9 aa, Homo Sapiens
SSSLDDSKR

SEQ ID NO: 975020 - protein, 9 aa, Homo Sapiens
CQAPVSKSA

SEQ ID NO: 975021 - protein, 9 aa, Homo Sapiens
LTLCRVAPP

SEQ ID NO: 975022 - protein, 9 aa, Homo Sapiens
LNSEYFMAE

SEQ ID NO: 975023 - protein, 9 aa, Homo Sapiens
EEGTLIEPL

SEQ ID NO: 975024 - protein, 9 aa, Homo Sapiens
RESSYMEIK

SEQ ID NO: 975025 - protein, 9 aa, Homo Sapiens
GSRKMKFKG

SEQ ID NO: 975026 - protein, 9 aa, Homo Sapiens
IPTMTTIGF

SEQ ID NO: 975027 - protein, 9 aa, Homo Sapiens
PSRRFGLCS

SEQ ID NO: 975028 - protein, 9 aa, Homo Sapiens
KDSTKALPE

SEQ ID NO: 975029 - protein, 9 aa, Homo Sapiens
GRLKLGWQM

SEQ ID NO: 975030 - protein, 9 aa, Homo Sapiens
GNLMKTEDE

SEQ ID NO: 975031 - protein, 9 aa, Homo Sapiens
VWRASKLVP

SEQ ID NO: 975032 - protein, 9 aa, Homo Sapiens
KEILRPFLI

SEQ ID NO: 975033 - protein, 9 aa, Homo Sapiens
VHSWSSQVE

SEQ ID NO: 975034 - protein, 9 aa, Homo Sapiens
NLVYGATPP

SEQ ID NO: 975035 - protein, 9 aa, Homo Sapiens
YYEPRYVLN

SEQ ID NO: 975036 - protein, 9 aa, Homo Sapiens
TLQIFPFPS

SEQ ID NO: 975037 - protein, 9 aa, Homo Sapiens
FDDNYVGCA

SEQ ID NO: 975038 - protein, 9 aa, Homo Sapiens
SLVEGEKKE

SEQ ID NO: 975039 - protein, 9 aa, Homo Sapiens
GFDFFFQDN

SEQ ID NO: 975040 - protein, 9 aa, Homo Sapiens
ALDTRKKAE

SEQ ID NO: 975041 - protein, 9 aa, Homo Sapiens
SFTRESTST

SEQ ID NO: 975042 - protein, 9 aa, Homo Sapiens
WKNFTASQT

SEQ ID NO: 975043 - protein, 9 aa, Homo Sapiens
TAVNDIILA

SEQ ID NO: 975044 - protein, 9 aa, Homo Sapiens
NSVILNREI

SEQ ID NO: 975045 - protein, 9 aa, Homo Sapiens
GKFSRNSEV

SEQ ID NO: 975046 - protein, 9 aa, Homo Sapiens
AMYDRQGQL

SEQ ID NO: 975047 - protein, 9 aa, Homo Sapiens
RIYTKVSRY

SEQ ID NO: 975048 - protein, 9 aa, Homo Sapiens
PYQCKIRDR

SEQ ID NO: 975049 - protein, 9 aa, Homo Sapiens
VACHRQGEQ

SEQ ID NO: 975050 - protein, 9 aa, Homo Sapiens
TTFFFSRYK

SEQ ID NO: 975051 - protein, 9 aa, Homo Sapiens
GLPTNVSTT

SEQ ID NO: 975052 - protein, 9 aa, Homo Sapiens
RLFKSVFVP

SEQ ID NO: 975053 - protein, 9 aa, Homo Sapiens
IEQQNSTQI

SEQ ID NO: 975054 - protein, 9 aa, Homo Sapiens
MRANFNKTN

SEQ ID NO: 975055 - protein, 9 aa, Homo Sapiens
TLKIFKDNE

SEQ ID NO: 975056 - protein, 9 aa, Homo Sapiens
SLVWPFSAI

SEQ ID NO: 975057 - protein, 9 aa, Homo Sapiens
CKQLSRLCR

SEQ ID NO: 975058 - protein, 9 aa, Homo Sapiens
ENGNLRRSP

SEQ ID NO: 975059 - protein, 9 aa, Homo Sapiens
ETLSWPAPD

SEQ ID NO: 975060 - protein, 9 aa, Homo Sapiens
LLVIENKVC

SEQ ID NO: 975061 - protein, 9 aa, Homo Sapiens
FKCNRGDPE

SEQ ID NO: 975062 - protein, 9 aa, Homo Sapiens
THYEEQIGK

SEQ ID NO: 975063 - protein, 9 aa, Homo Sapiens
KDVLTFTCK

SEQ ID NO: 975064 - protein, 9 aa, Homo Sapiens
YRRDCVPLM

SEQ ID NO: 975065 - protein, 9 aa, Homo Sapiens
VFATNNKLE

SEQ ID NO: 975066 - protein, 9 aa, Homo Sapiens
SSGMPSGNG

SEQ ID NO: 975067 - protein, 9 aa, Homo Sapiens
VTSRGRGRG

SEQ ID NO: 975068 - protein, 9 aa, Homo Sapiens
LSHVHIESW

SEQ ID NO: 975069 - protein, 9 aa, Homo Sapiens
ERFMERYAS

SEQ ID NO: 975070 - protein, 9 aa, Homo Sapiens
ELRVRAKYR

SEQ ID NO: 975071 - protein, 9 aa, Homo Sapiens
KDLDLEGQK

SEQ ID NO: 975072 - protein, 9 aa, Homo Sapiens
EGAEANPLA

SEQ ID NO: 975073 - protein, 9 aa, Homo Sapiens
EKLDKLNID

SEQ ID NO: 975074 - protein, 9 aa, Homo Sapiens
PEPPEGPAL

SEQ ID NO: 975075 - protein, 9 aa, Homo Sapiens
AKEKLEFTR

SEQ ID NO: 975076 - protein, 9 aa, Homo Sapiens
LQKEKKDSQ

SEQ ID NO: 975077 - protein, 9 aa, Homo Sapiens
GRAGFLFFW

SEQ ID NO: 975078 - protein, 9 aa, Homo Sapiens
FNEKPAETV

SEQ ID NO: 975079 - protein, 9 aa, Homo Sapiens
AADAISPSR

SEQ ID NO: 975080 - protein, 9 aa, Homo Sapiens
SGEGRKAAK

SEQ ID NO: 975081 - protein, 9 aa, Homo Sapiens
YLITVIENL

SEQ ID NO: 975082 - protein, 9 aa, Homo Sapiens
QVQLAISPS

SEQ ID NO: 975083 - protein, 9 aa, Homo Sapiens
FTNKYSLIM

SEQ ID NO: 975084 - protein, 9 aa, Homo Sapiens
DGESIENCP

SEQ ID NO: 975085 - protein, 9 aa, Homo Sapiens
EIFMTYYIL

SEQ ID NO: 975086 - protein, 9 aa, Homo Sapiens
LVTCSISRS

SEQ ID NO: 975087 - protein, 9 aa, Homo Sapiens
QKWSFTSPH

SEQ ID NO: 975088 - protein, 9 aa, Homo Sapiens
YEGVPAITQ

SEQ ID NO: 975089 - protein, 9 aa, Homo Sapiens
EEKKEQGEA

SEQ ID NO: 975090 - protein, 9 aa, Homo Sapiens
QRDNFHWEE

SEQ ID NO: 975091 - protein, 9 aa, Homo Sapiens
AFCQRNSHN

SEQ ID NO: 975092 - protein, 9 aa, Homo Sapiens
YPLCIGDNR

SEQ ID NO: 975093 - protein, 9 aa, Homo Sapiens
IMIDFPQMV

SEQ ID NO: 975094 - protein, 9 aa, Homo Sapiens
GGNSVILNR

SEQ ID NO: 975095 - protein, 9 aa, Homo Sapiens
DCGHMFFWE

SEQ ID NO: 975096 - protein, 9 aa, Homo Sapiens
KNMFCAGYY

SEQ ID NO: 975097 - protein, 9 aa, Homo Sapiens
SICFKCNRG

SEQ ID NO: 975098 - protein, 9 aa, Homo Sapiens
KNSGKSGQE

SEQ ID NO: 975099 - protein, 9 aa, Homo Sapiens
LPTNVSTTV

SEQ ID NO: 975100 - protein, 9 aa, Homo Sapiens
RLGFRRQAS

SEQ ID NO: 975101 - protein, 9 aa, Homo Sapiens
RVLNFNKKC

SEQ ID NO: 975102 - protein, 9 aa, Homo Sapiens
LSLLKEFEH

SEQ ID NO: 975103 - protein, 9 aa, Homo Sapiens
KCRSSNKET

SEQ ID NO: 975104 - protein, 9 aa, Homo Sapiens
TKVTWYKDG

SEQ ID NO: 975105 - protein, 9 aa, Homo Sapiens
KKCKLSNLI

SEQ ID NO: 975106 - protein, 9 aa, Homo Sapiens
IRIGCFLMG

SEQ ID NO: 975107 - protein, 9 aa, Homo Sapiens
LVAFTCFLL

SEQ ID NO: 975108 - protein, 9 aa, Homo Sapiens
GKRYFKCQA

SEQ ID NO: 975109 - protein, 9 aa, Homo Sapiens
TNKYSLIMR

SEQ ID NO: 975110 - protein, 9 aa, Homo Sapiens
VDAEERKVV

SEQ ID NO: 975111 - protein, 9 aa, Homo Sapiens
ELTEALRDL

SEQ ID NO: 975112 - protein, 9 aa, Homo Sapiens
FCKQIGTLL

SEQ ID NO: 975113 - protein, 9 aa, Homo Sapiens
RDPKVFRCV

SEQ ID NO: 975114 - protein, 9 aa, Homo Sapiens
FVKTPKPVE

SEQ ID NO: 975115 - protein, 9 aa, Homo Sapiens
FIYSSLLNQ

SEQ ID NO: 975116 - protein, 9 aa, Homo Sapiens
EAKDVTVRT

SEQ ID NO: 975117 - protein, 9 aa, Homo Sapiens
AQPVAFSVV

SEQ ID NO: 975118 - protein, 9 aa, Homo Sapiens
IYSSLLNQH

SEQ ID NO: 975119 - protein, 9 aa, Homo Sapiens
LGSFRVVST

SEQ ID NO: 975120 - protein, 9 aa, Homo Sapiens
WSMNEKLMT

SEQ ID NO: 975121 - protein, 9 aa, Homo Sapiens
ELDQKMRKA

SEQ ID NO: 975122 - protein, 9 aa, Homo Sapiens
KGEKGDERP

SEQ ID NO: 975123 - protein, 9 aa, Homo Sapiens
LRVMKHPLG

SEQ ID NO: 975124 - protein, 9 aa, Homo Sapiens
KCTKDAPAC

SEQ ID NO: 975125 - protein, 9 aa, Homo Sapiens
TTIGFGIGI

SEQ ID NO: 975126 - protein, 9 aa, Homo Sapiens
DLSADLKQE

SEQ ID NO: 975127 - protein, 9 aa, Homo Sapiens
KFRIQVRLG

SEQ ID NO: 975128 - protein, 9 aa, Homo Sapiens
DPGPFGPPG

SEQ ID NO: 975129 - protein, 9 aa, Homo Sapiens
GSTAPPLSS

SEQ ID NO: 975130 - protein, 9 aa, Homo Sapiens
SADLKQECR

SEQ ID NO: 975131 - protein, 9 aa, Homo Sapiens
QCQAPVSKS

SEQ ID NO: 975132 - protein, 9 aa, Homo Sapiens
TLFAALSLG

SEQ ID NO: 975133 - protein, 9 aa, Homo Sapiens
AVFPQQQQC

SEQ ID NO: 975134 - protein, 9 aa, Homo Sapiens
SFQPVQVWK

SEQ ID NO: 975135 - protein, 9 aa, Homo Sapiens
FTCFLLGVG

SEQ ID NO: 975136 - protein, 9 aa, Homo Sapiens
KASFMSHLQ

SEQ ID NO: 975137 - protein, 9 aa, Homo Sapiens
GKYRIYTKV

SEQ ID NO: 975138 - protein, 9 aa, Homo Sapiens
EGTTQALRL

SEQ ID NO: 975139 - protein, 9 aa, Homo Sapiens
WYGCWGFWR

SEQ ID NO: 975140 - protein, 9 aa, Homo Sapiens
SILTPTWVS

SEQ ID NO: 975141 - protein, 9 aa, Homo Sapiens
GFFSAMLLF

SEQ ID NO: 975142 - protein, 9 aa, Homo Sapiens
VLLTRKLYD

SEQ ID NO: 975143 - protein, 9 aa, Homo Sapiens
NKETKVDTT

SEQ ID NO: 975144 - protein, 9 aa, Homo Sapiens
GAGMALAAL

SEQ ID NO: 975145 - protein, 9 aa, Homo Sapiens
LEKFSLKPG

SEQ ID NO: 975146 - protein, 9 aa, Homo Sapiens
PKLFETVRF

SEQ ID NO: 975147 - protein, 9 aa, Homo Sapiens
IFYYNFNKT

SEQ ID NO: 975148 - protein, 9 aa, Homo Sapiens
LQIQMSPEP

SEQ ID NO: 975149 - protein, 9 aa, Homo Sapiens
YQCKIRDRY

SEQ ID NO: 975150 - protein, 9 aa, Homo Sapiens
LRVRAKYRG

SEQ ID NO: 975151 - protein, 9 aa, Homo Sapiens
SKSALIPVI

SEQ ID NO: 975152 - protein, 9 aa, Homo Sapiens
PMSHPLPPG

SEQ ID NO: 975153 - protein, 9 aa, Homo Sapiens
QVLESKGRQ

SEQ ID NO: 975154 - protein, 9 aa, Homo Sapiens
LYVRKDGNL

SEQ ID NO: 975155 - protein, 9 aa, Homo Sapiens
NSARNFGAS

SEQ ID NO: 975156 - protein, 9 aa, Homo Sapiens
DTAVNDIIL

SEQ ID NO: 975157 - protein, 9 aa, Homo Sapiens
EAEVCKIIR

SEQ ID NO: 975158 - protein, 9 aa, Homo Sapiens
ARAAQRRRC

SEQ ID NO: 975159 - protein, 9 aa, Homo Sapiens
PDLYLKISI

SEQ ID NO: 975160 - protein, 9 aa, Homo Sapiens
LKYGYVQPS

SEQ ID NO: 975161 - protein, 9 aa, Homo Sapiens
DEGLNEDII

SEQ ID NO: 975162 - protein, 9 aa, Homo Sapiens
EKRTLLEKK

SEQ ID NO: 975163 - protein, 9 aa, Homo Sapiens
LQATSDPYG

SEQ ID NO: 975164 - protein, 9 aa, Homo Sapiens
PSYNTIGGF

SEQ ID NO: 975165 - protein, 9 aa, Homo Sapiens
RQATHYYYS

SEQ ID NO: 975166 - protein, 9 aa, Homo Sapiens
PASHDPDTA

SEQ ID NO: 975167 - protein, 9 aa, Homo Sapiens
GMEKHRYTS

SEQ ID NO: 975168 - protein, 9 aa, Homo Sapiens
DNFSQALLT

SEQ ID NO: 975169 - protein, 9 aa, Homo Sapiens
ESVPPRDEA

SEQ ID NO: 975170 - protein, 9 aa, Homo Sapiens
PSGNYPLCI

SEQ ID NO: 975171 - protein, 9 aa, Homo Sapiens
LMQPPPPGF

SEQ ID NO: 975172 - protein, 9 aa, Homo Sapiens
LCDTHQPPG

SEQ ID NO: 975173 - protein, 9 aa, Homo Sapiens
GPALEAFSC

SEQ ID NO: 975174 - protein, 9 aa, Homo Sapiens
TYFYRASLG

SEQ ID NO: 975175 - protein, 9 aa, Homo Sapiens
GFKAMCVNL

SEQ ID NO: 975176 - protein, 9 aa, Homo Sapiens
EPPEGPALS

SEQ ID NO: 975177 - protein, 9 aa, Homo Sapiens
HTHPGYISP

SEQ ID NO: 975178 - protein, 9 aa, Homo Sapiens
SSVQRDNFH

SEQ ID NO: 975179 - protein, 9 aa, Homo Sapiens
SMGKSQSKK

SEQ ID NO: 975180 - protein, 9 aa, Homo Sapiens
DFCLMDRKP

SEQ ID NO: 975181 - protein, 9 aa, Homo Sapiens
RRGPKCQIE

SEQ ID NO: 975182 - protein, 9 aa, Homo Sapiens
RLAACAPEC

SEQ ID NO: 975183 - protein, 9 aa, Homo Sapiens
FLSSRRGPS

SEQ ID NO: 975184 - protein, 9 aa, Homo Sapiens
TRGWKLTFV

SEQ ID NO: 975185 - protein, 9 aa, Homo Sapiens
RGPKCQIEI

SEQ ID NO: 975186 - protein, 9 aa, Homo Sapiens
NNMTTHVFF

SEQ ID NO: 975187 - protein, 9 aa, Homo Sapiens
GTFLNDPVC

SEQ ID NO: 975188 - protein, 9 aa, Homo Sapiens
CELKYEEKL

SEQ ID NO: 975189 - protein, 9 aa, Homo Sapiens
IDPPYFSPS

SEQ ID NO: 975190 - protein, 9 aa, Homo Sapiens
EDALDADTA

SEQ ID NO: 975191 - protein, 9 aa, Homo Sapiens
FFVSHFYTP

SEQ ID NO: 975192 - protein, 9 aa, Homo Sapiens
CTVRRLDRE

SEQ ID NO: 975193 - protein, 9 aa, Homo Sapiens
PVSAGNALK

SEQ ID NO: 975194 - protein, 9 aa, Homo Sapiens
FAAVNVWQK

SEQ ID NO: 975195 - protein, 9 aa, Homo Sapiens
LWLKREAIS

SEQ ID NO: 975196 - protein, 9 aa, Homo Sapiens
EDVLQDLLP

SEQ ID NO: 975197 - protein, 9 aa, Homo Sapiens
NYTRMKIFR

SEQ ID NO: 975198 - protein, 9 aa, Homo Sapiens
IDYMDGKKN

SEQ ID NO: 975199 - protein, 9 aa, Homo Sapiens
RIIKAVRAH

SEQ ID NO: 975200 - protein, 9 aa, Homo Sapiens
LYTSLSSLG

SEQ ID NO: 975201 - protein, 9 aa, Homo Sapiens
NDYKLEKDP

SEQ ID NO: 975202 - protein, 9 aa, Homo Sapiens
RTCEKLDKL

SEQ ID NO: 975203 - protein, 9 aa, Homo Sapiens
AAESRPPCN

SEQ ID NO: 975204 - protein, 9 aa, Homo Sapiens
KAFRICSES

SEQ ID NO: 975205 - protein, 9 aa, Homo Sapiens
TTNETGGEN

SEQ ID NO: 975206 - protein, 9 aa, Homo Sapiens
VPAGSAQPV

SEQ ID NO: 975207 - protein, 9 aa, Homo Sapiens
LEKKLSLEN

SEQ ID NO: 975208 - protein, 9 aa, Homo Sapiens
CQKWSFTSP

SEQ ID NO: 975209 - protein, 9 aa, Homo Sapiens
HFPCSESQH

SEQ ID NO: 975210 - protein, 9 aa, Homo Sapiens
TGSLLFVKK

SEQ ID NO: 975211 - protein, 9 aa, Homo Sapiens
IFPFTLKIF

SEQ ID NO: 975212 - protein, 9 aa, Homo Sapiens
RKGEDALCQ

SEQ ID NO: 975213 - protein, 9 aa, Homo Sapiens
FQNAKMALL

SEQ ID NO: 975214 - protein, 9 aa, Homo Sapiens
EESLQDVPQ

SEQ ID NO: 975215 - protein, 9 aa, Homo Sapiens
LENLEEPPE

SEQ ID NO: 975216 - protein, 9 aa, Homo Sapiens
DFGSVTFDH

SEQ ID NO: 975217 - protein, 9 aa, Homo Sapiens
SVSPVAGAP

SEQ ID NO: 975218 - protein, 9 aa, Homo Sapiens
MQLTMNIPF

SEQ ID NO: 975219 - protein, 9 aa, Homo Sapiens
WRDLSLMQP

SEQ ID NO: 975220 - protein, 9 aa, Homo Sapiens
PPYFSPSRA

SEQ ID NO: 975221 - protein, 9 aa, Homo Sapiens
GTQRDLEAF

SEQ ID NO: 975222 - protein, 9 aa, Homo Sapiens
LVEVERTAF

SEQ ID NO: 975223 - protein, 9 aa, Homo Sapiens
SHVEKDTDP

SEQ ID NO: 975224 - protein, 9 aa, Homo Sapiens
YRGFDCQNN

SEQ ID NO: 975225 - protein, 9 aa, Homo Sapiens
YWKKESQKL

SEQ ID NO: 975226 - protein, 9 aa, Homo Sapiens
TLFSEESCE

SEQ ID NO: 975227 - protein, 9 aa, Homo Sapiens
QDRQLLCYY

SEQ ID NO: 975228 - protein, 9 aa, Homo Sapiens
LDLETKNSS

SEQ ID NO: 975229 - protein, 9 aa, Homo Sapiens
LGFGAVTFG

SEQ ID NO: 975230 - protein, 9 aa, Homo Sapiens
NQCQAPVSK

SEQ ID NO: 975231 - protein, 9 aa, Homo Sapiens
SSLGLEQPL

SEQ ID NO: 975232 - protein, 9 aa, Homo Sapiens
ICSTFFSRR

SEQ ID NO: 975233 - protein, 9 aa, Homo Sapiens
QRQRHLENL

SEQ ID NO: 975234 - protein, 9 aa, Homo Sapiens
GVLPTYSKR

SEQ ID NO: 975235 - protein, 9 aa, Homo Sapiens
SSRTRTSST

SEQ ID NO: 975236 - protein, 9 aa, Homo Sapiens
HGSPTRDLQ

SEQ ID NO: 975237 - protein, 9 aa, Homo Sapiens
NAIFLTISR

SEQ ID NO: 975238 - protein, 9 aa, Homo Sapiens
DGVDKLFGK

SEQ ID NO: 975239 - protein, 9 aa, Homo Sapiens
PKLAPGDNP

SEQ ID NO: 975240 - protein, 9 aa, Homo Sapiens
VAEMSFYHH

SEQ ID NO: 975241 - protein, 9 aa, Homo Sapiens
RDGGSPLLW

SEQ ID NO: 975242 - protein, 9 aa, Homo Sapiens
KFKGNYWHE

SEQ ID NO: 975243 - protein, 9 aa, Homo Sapiens
MPELFSSKT

SEQ ID NO: 975244 - protein, 9 aa, Homo Sapiens
SRSPSVANM

SEQ ID NO: 975245 - protein, 9 aa, Homo Sapiens
DIFCQRKQN

SEQ ID NO: 975246 - protein, 9 aa, Homo Sapiens
NIMRANFNK

SEQ ID NO: 975247 - protein, 9 aa, Homo Sapiens
ESKGRQHLE

SEQ ID NO: 975248 - protein, 9 aa, Homo Sapiens
YEEKLVRRT

SEQ ID NO: 975249 - protein, 9 aa, Homo Sapiens
YIQIAMAII

SEQ ID NO: 975250 - protein, 9 aa, Homo Sapiens
QDVLRSRVN

SEQ ID NO: 975251 - protein, 9 aa, Homo Sapiens
HIPGVYRDL

SEQ ID NO: 975252 - protein, 9 aa, Homo Sapiens
EYLRVVNVG

SEQ ID NO: 975253 - protein, 9 aa, Homo Sapiens
RGFDCQNNL

SEQ ID NO: 975254 - protein, 9 aa, Homo Sapiens
DTLRTIFSN

SEQ ID NO: 975255 - protein, 9 aa, Homo Sapiens
AVAGSGPAA

SEQ ID NO: 975256 - protein, 9 aa, Homo Sapiens
SPLPSMPVS

SEQ ID NO: 975257 - protein, 9 aa, Homo Sapiens
NVFFCVKKG

SEQ ID NO: 975258 - protein, 9 aa, Homo Sapiens
PPMKETQQE

SEQ ID NO: 975259 - protein, 9 aa, Homo Sapiens
IAPPEVTPE

SEQ ID NO: 975260 - protein, 9 aa, Homo Sapiens
FTPYFAAFL

SEQ ID NO: 975261 - protein, 9 aa, Homo Sapiens
FQKQTFLGL

SEQ ID NO: 975262 - protein, 9 aa, Homo Sapiens
EEAGSTAPP

SEQ ID NO: 975263 - protein, 9 aa, Homo Sapiens
TLTAPCWLL

SEQ ID NO: 975264 - protein, 9 aa, Homo Sapiens
QGQLVEVER

SEQ ID NO: 975265 - protein, 9 aa, Homo Sapiens
SVDNKKLQG

SEQ ID NO: 975266 - protein, 9 aa, Homo Sapiens
GFVQTLKGC

SEQ ID NO: 975267 - protein, 9 aa, Homo Sapiens
GLFLFSEYY

SEQ ID NO: 975268 - protein, 9 aa, Homo Sapiens
WHSLGLEQR

SEQ ID NO: 975269 - protein, 9 aa, Homo Sapiens
HTTCFEEET

SEQ ID NO: 975270 - protein, 9 aa, Homo Sapiens
NKNCFQFQY

SEQ ID NO: 975271 - protein, 9 aa, Homo Sapiens
EVHIPGVYR

SEQ ID NO: 975272 - protein, 9 aa, Homo Sapiens
QQPDSRKFG

SEQ ID NO: 975273 - protein, 9 aa, Homo Sapiens
GSHLYTSLS

SEQ ID NO: 975274 - protein, 9 aa, Homo Sapiens
HQHRGLRGH

SEQ ID NO: 975275 - protein, 9 aa, Homo Sapiens
ESTKSVPLV

SEQ ID NO: 975276 - protein, 9 aa, Homo Sapiens
VAWTPSIGL

SEQ ID NO: 975277 - protein, 9 aa, Homo Sapiens
PYFIYSCVL

SEQ ID NO: 975278 - protein, 9 aa, Homo Sapiens
DQVPLNPSG

SEQ ID NO: 975279 - protein, 9 aa, Homo Sapiens
RMNLSGRVD

SEQ ID NO: 975280 - protein, 9 aa, Homo Sapiens
AGHGGPQFV

SEQ ID NO: 975281 - protein, 9 aa, Homo Sapiens
INLQILTNP

SEQ ID NO: 975282 - protein, 9 aa, Homo Sapiens
AEKRVLLTG

SEQ ID NO: 975283 - protein, 9 aa, Homo Sapiens
PDMAYCLIS

SEQ ID NO: 975284 - protein, 9 aa, Homo Sapiens
DLLPKIIQD

SEQ ID NO: 975285 - protein, 9 aa, Homo Sapiens
DDGAGGQFL

SEQ ID NO: 975286 - protein, 9 aa, Homo Sapiens
ILDNHLYSL

SEQ ID NO: 975287 - protein, 9 aa, Homo Sapiens
ESQHLNGQF

SEQ ID NO: 975288 - protein, 9 aa, Homo Sapiens
PFSVPNKDV

SEQ ID NO: 975289 - protein, 9 aa, Homo Sapiens
ENLQKNSQE

SEQ ID NO: 975290 - protein, 9 aa, Homo Sapiens
PLSPTIEKK

SEQ ID NO: 975291 - protein, 9 aa, Homo Sapiens
SYITLALLY

SEQ ID NO: 975292 - protein, 9 aa, Homo Sapiens
LSKGLAWPQ

SEQ ID NO: 975293 - protein, 9 aa, Homo Sapiens
LCIGDNRDL

SEQ ID NO: 975294 - protein, 9 aa, Homo Sapiens
KKAINLLEP

SEQ ID NO: 975295 - protein, 9 aa, Homo Sapiens
TAVFKRFLT

SEQ ID NO: 975296 - protein, 9 aa, Homo Sapiens
YLWWINGQS

SEQ ID NO: 975297 - protein, 9 aa, Homo Sapiens
QSGGSLGVD

SEQ ID NO: 975298 - protein, 9 aa, Homo Sapiens
GPLGPQGPN

SEQ ID NO: 975299 - protein, 9 aa, Homo Sapiens
RSEEDRDDL

SEQ ID NO: 975300 - protein, 9 aa, Homo Sapiens
ESIENCPFS

SEQ ID NO: 975301 - protein, 9 aa, Homo Sapiens
PALLDRHED

SEQ ID NO: 975302 - protein, 9 aa, Homo Sapiens
AISFLTILA

SEQ ID NO: 975303 - protein, 9 aa, Homo Sapiens
KVLAERKQK

SEQ ID NO: 975304 - protein, 9 aa, Homo Sapiens
EDEFYDADG

SEQ ID NO: 975305 - protein, 9 aa, Homo Sapiens
TDERLFECA

SEQ ID NO: 975306 - protein, 9 aa, Homo Sapiens
SGNVFRHFY

SEQ ID NO: 975307 - protein, 9 aa, Homo Sapiens
VKPPPERGV

SEQ ID NO: 975308 - protein, 9 aa, Homo Sapiens
FNKKCDTSK

SEQ ID NO: 975309 - protein, 9 aa, Homo Sapiens
SKEILEKLQ

SEQ ID NO: 975310 - protein, 9 aa, Homo Sapiens
CHRAGLTAR

SEQ ID NO: 975311 - protein, 9 aa, Homo Sapiens
HHEETVLPS

SEQ ID NO: 975312 - protein, 9 aa, Homo Sapiens
FFPEWLTRS

SEQ ID NO: 975313 - protein, 9 aa, Homo Sapiens
DHQNDPFRA

SEQ ID NO: 975314 - protein, 9 aa, Homo Sapiens
MKETQQEPD

SEQ ID NO: 975315 - protein, 9 aa, Homo Sapiens
EKRNKYFNP

SEQ ID NO: 975316 - protein, 9 aa, Homo Sapiens
LVFTLVDAD

SEQ ID NO: 975317 - protein, 9 aa, Homo Sapiens
QHLGGSEKF

SEQ ID NO: 975318 - protein, 9 aa, Homo Sapiens
GPLNLDSQR

SEQ ID NO: 975319 - protein, 9 aa, Homo Sapiens
REEKALNPS

SEQ ID NO: 975320 - protein, 9 aa, Homo Sapiens
RCVENAGGS

SEQ ID NO: 975321 - protein, 9 aa, Homo Sapiens
GLYESHVEC

SEQ ID NO: 975322 - protein, 9 aa, Homo Sapiens
LITTNPYNY

SEQ ID NO: 975323 - protein, 9 aa, Homo Sapiens
FGYRGFDCQ

SEQ ID NO: 975324 - protein, 9 aa, Homo Sapiens
EPTSGIVCT

SEQ ID NO: 975325 - protein, 9 aa, Homo Sapiens
CYYDQCETH

SEQ ID NO: 975326 - protein, 9 aa, Homo Sapiens
FAAFLLNDR

SEQ ID NO: 975327 - protein, 9 aa, Homo Sapiens
AFSQLSIFG

SEQ ID NO: 975328 - protein, 9 aa, Homo Sapiens
QPGFSNSTS

SEQ ID NO: 975329 - protein, 9 aa, Homo Sapiens
ARKCLSLNN

SEQ ID NO: 975330 - protein, 9 aa, Homo Sapiens
NTSDKNRVK

SEQ ID NO: 975331 - protein, 9 aa, Homo Sapiens
SEVSALQHV

SEQ ID NO: 975332 - protein, 9 aa, Homo Sapiens
YPFLDETII

SEQ ID NO: 975333 - protein, 9 aa, Homo Sapiens
RVNTTGIIE

SEQ ID NO: 975334 - protein, 9 aa, Homo Sapiens
LRKIEATNA

SEQ ID NO: 975335 - protein, 9 aa, Homo Sapiens
VSIFFMIIF

SEQ ID NO: 975336 - protein, 9 aa, Homo Sapiens
IKVARKCLS

SEQ ID NO: 975337 - protein, 9 aa, Homo Sapiens
VPKVVIFAA

SEQ ID NO: 975338 - protein, 9 aa, Homo Sapiens
CPARAARYH

SEQ ID NO: 975339 - protein, 9 aa, Homo Sapiens
VEGEKKEEE

SEQ ID NO: 975340 - protein, 9 aa, Homo Sapiens
KDSQETYRD

SEQ ID NO: 975341 - protein, 9 aa, Homo Sapiens
KREGLDGSF

SEQ ID NO: 975342 - protein, 9 aa, Homo Sapiens
LSRMGSIQE

SEQ ID NO: 975343 - protein, 9 aa, Homo Sapiens
QLRVMKHPL

SEQ ID NO: 975344 - protein, 9 aa, Homo Sapiens
GFLTVLIQR

SEQ ID NO: 975345 - protein, 9 aa, Homo Sapiens
QDFSQIELL

SEQ ID NO: 975346 - protein, 9 aa, Homo Sapiens
YACSGNVFR

SEQ ID NO: 975347 - protein, 9 aa, Homo Sapiens
RHCSAPENP

SEQ ID NO: 975348 - protein, 9 aa, Homo Sapiens
PTSGIVCTV

SEQ ID NO: 975349 - protein, 9 aa, Homo Sapiens
LKKRDMDDY

SEQ ID NO: 975350 - protein, 9 aa, Homo Sapiens
GRRRDAGPG

SEQ ID NO: 975351 - protein, 9 aa, Homo Sapiens
DPILIFLKH

SEQ ID NO: 975352 - protein, 9 aa, Homo Sapiens
EKAYKCNEY

SEQ ID NO: 975353 - protein, 9 aa, Homo Sapiens
EELGSGEIL

SEQ ID NO: 975354 - protein, 9 aa, Homo Sapiens
DANLHSKFP

SEQ ID NO: 975355 - protein, 9 aa, Homo Sapiens
IVTYNNEGG

SEQ ID NO: 975356 - protein, 9 aa, Homo Sapiens
EFEHHLLSA

SEQ ID NO: 975357 - protein, 9 aa, Homo Sapiens
TKQQEQDPT

SEQ ID NO: 975358 - protein, 9 aa, Homo Sapiens
NPFLQQPMY

SEQ ID NO: 975359 - protein, 9 aa, Homo Sapiens
FSNSTSSPP

SEQ ID NO: 975360 - protein, 9 aa, Homo Sapiens
RGCQLTIPF

SEQ ID NO: 975361 - protein, 9 aa, Homo Sapiens
QPVAFSVVP

SEQ ID NO: 975362 - protein, 9 aa, Homo Sapiens
THLLTVQEL

SEQ ID NO: 975363 - protein, 9 aa, Homo Sapiens
KEKKDSQLM

SEQ ID NO: 975364 - protein, 9 aa, Homo Sapiens
NNEKQIILD

SEQ ID NO: 975365 - protein, 9 aa, Homo Sapiens
VAAPGSSYH

SEQ ID NO: 975366 - protein, 9 aa, Homo Sapiens
CYALLVPLA

SEQ ID NO: 975367 - protein, 9 aa, Homo Sapiens
KQEGLICSR

SEQ ID NO: 975368 - protein, 9 aa, Homo Sapiens
CKKEFELRP

SEQ ID NO: 975369 - protein, 9 aa, Homo Sapiens
AVPASLVQL

SEQ ID NO: 975370 - protein, 9 aa, Homo Sapiens
IFLSEPVFL

SEQ ID NO: 975371 - protein, 9 aa, Homo Sapiens
EIRAINQTT

SEQ ID NO: 975372 - protein, 9 aa, Homo Sapiens
LVIENKVCN

SEQ ID NO: 975373 - protein, 9 aa, Homo Sapiens
PMSRILPNH

SEQ ID NO: 975374 - protein, 9 aa, Homo Sapiens
KAPIKDLDL

SEQ ID NO: 975375 - protein, 9 aa, Homo Sapiens
QTLKGCEDQ

SEQ ID NO: 975376 - protein, 9 aa, Homo Sapiens
AENERMKGT

SEQ ID NO: 975377 - protein, 9 aa, Homo Sapiens
FPENEEDTR

SEQ ID NO: 975378 - protein, 9 aa, Homo Sapiens
KRFLCKKSK

SEQ ID NO: 975379 - protein, 9 aa, Homo Sapiens
LMDRKPLVL

SEQ ID NO: 975380 - protein, 9 aa, Homo Sapiens
SGESHRKAF

SEQ ID NO: 975381 - protein, 9 aa, Homo Sapiens
PRVCSYTCL

SEQ ID NO: 975382 - protein, 9 aa, Homo Sapiens
EREKVIFLC

SEQ ID NO: 975383 - protein, 9 aa, Homo Sapiens
DKLNIDISN

SEQ ID NO: 975384 - protein, 9 aa, Homo Sapiens
VMTGRAGHG

SEQ ID NO: 975385 - protein, 9 aa, Homo Sapiens
NPHASYSAL

SEQ ID NO: 975386 - protein, 9 aa, Homo Sapiens
GVYFEVHIP

SEQ ID NO: 975387 - protein, 9 aa, Homo Sapiens
EELRKAWAE

SEQ ID NO: 975388 - protein, 9 aa, Homo Sapiens
RYLENGGLE

SEQ ID NO: 975389 - protein, 9 aa, Homo Sapiens
GASSSELLP

SEQ ID NO: 975390 - protein, 9 aa, Homo Sapiens
DTCDEDSVV

SEQ ID NO: 975391 - protein, 9 aa, Homo Sapiens
IPMSRILPN

SEQ ID NO: 975392 - protein, 9 aa, Homo Sapiens
TSGKCKQLS

SEQ ID NO: 975393 - protein, 9 aa, Homo Sapiens
WTPSIGLPT

SEQ ID NO: 975394 - protein, 9 aa, Homo Sapiens
PPPLPPPHL

SEQ ID NO: 975395 - protein, 9 aa, Homo Sapiens
RLHHSASNT

SEQ ID NO: 975396 - protein, 9 aa, Homo Sapiens
MTTHVFFRS

SEQ ID NO: 975397 - protein, 9 aa, Homo Sapiens
QEREKVIFL

SEQ ID NO: 975398 - protein, 9 aa, Homo Sapiens
KLSAKHTSH

SEQ ID NO: 975399 - protein, 9 aa, Homo Sapiens
EDRLAACAP

SEQ ID NO: 975400 - protein, 9 aa, Homo Sapiens
QIAMAIIRI

SEQ ID NO: 975401 - protein, 9 aa, Homo Sapiens
PDTFDDNYV

SEQ ID NO: 975402 - protein, 9 aa, Homo Sapiens
ELRRLSWFG

SEQ ID NO: 975403 - protein, 9 aa, Homo Sapiens
DGIVEERWT

SEQ ID NO: 975404 - protein, 9 aa, Homo Sapiens
SGLVQWAKF

SEQ ID NO: 975405 - protein, 9 aa, Homo Sapiens
LEKLQLNTK

SEQ ID NO: 975406 - protein, 9 aa, Homo Sapiens
TQLSLLSHF

SEQ ID NO: 975407 - protein, 9 aa, Homo Sapiens
FPHNFVLLV

SEQ ID NO: 975408 - protein, 9 aa, Homo Sapiens
FFRVSTLPL

SEQ ID NO: 975409 - protein, 9 aa, Homo Sapiens
DKLKKCKLS

SEQ ID NO: 975410 - protein, 9 aa, Homo Sapiens
CSRVSGWRA

SEQ ID NO: 975411 - protein, 9 aa, Homo Sapiens
LEANSVFCQ

SEQ ID NO: 975412 - protein, 9 aa, Homo Sapiens
KYIVHKKFD

SEQ ID NO: 975413 - protein, 9 aa, Homo Sapiens
FSQIELLKE

SEQ ID NO: 975414 - protein, 9 aa, Homo Sapiens
CQDQEQEVC

SEQ ID NO: 975415 - protein, 9 aa, Homo Sapiens
SKTGSLLFV

SEQ ID NO: 975416 - protein, 9 aa, Homo Sapiens
FLQQPMYIF

SEQ ID NO: 975417 - protein, 9 aa, Homo Sapiens
VIIEQLVES

SEQ ID NO: 975418 - protein, 9 aa, Homo Sapiens
VKEVCPILS

SEQ ID NO: 975419 - protein, 9 aa, Homo Sapiens
FEEGTLIEP

SEQ ID NO: 975420 - protein, 9 aa, Homo Sapiens
IESLHSKNS

SEQ ID NO: 975421 - protein, 9 aa, Homo Sapiens
PRVFYFMVE

SEQ ID NO: 975422 - protein, 9 aa, Homo Sapiens
QEVYMREKF

SEQ ID NO: 975423 - protein, 9 aa, Homo Sapiens
PEIFKCRSS

SEQ ID NO: 975424 - protein, 9 aa, Homo Sapiens
IGLVNCSER

SEQ ID NO: 975425 - protein, 9 aa, Homo Sapiens
RRLESGMKE

SEQ ID NO: 975426 - protein, 9 aa, Homo Sapiens
LFVPGIHLD

SEQ ID NO: 975427 - protein, 9 aa, Homo Sapiens
SEPQYQLQS

SEQ ID NO: 975428 - protein, 9 aa, Homo Sapiens
LYQSPTDFM

SEQ ID NO: 975429 - protein, 9 aa, Homo Sapiens
ASILLELVK

SEQ ID NO: 975430 - protein, 9 aa, Homo Sapiens
RRFGLCSPS

SEQ ID NO: 975431 - protein, 9 aa, Homo Sapiens
CILTYDFVH

SEQ ID NO: 975432 - protein, 9 aa, Homo Sapiens
KMRECDGLT

SEQ ID NO: 975433 - protein, 9 aa, Homo Sapiens
TASIIEDVM

SEQ ID NO: 975434 - protein, 9 aa, Homo Sapiens
SPSFGSGGG

SEQ ID NO: 975435 - protein, 9 aa, Homo Sapiens
GEENTKNGG

SEQ ID NO: 975436 - protein, 9 aa, Homo Sapiens
GGSEKFWYN

SEQ ID NO: 975437 - protein, 9 aa, Homo Sapiens
SATCCLWCC

SEQ ID NO: 975438 - protein, 9 aa, Homo Sapiens
WSEQRVIFV

SEQ ID NO: 975439 - protein, 9 aa, Homo Sapiens
SWFREEKAL

SEQ ID NO: 975440 - protein, 9 aa, Homo Sapiens
FLVEKDFCL

SEQ ID NO: 975441 - protein, 9 aa, Homo Sapiens
GTAADPLTD

SEQ ID NO: 975442 - protein, 9 aa, Homo Sapiens
PCILTYDFV

SEQ ID NO: 975443 - protein, 9 aa, Homo Sapiens
DQLKTLRRE

SEQ ID NO: 975444 - protein, 9 aa, Homo Sapiens
PSLTCVMKG

SEQ ID NO: 975445 - protein, 9 aa, Homo Sapiens
KRYFKCQAK

SEQ ID NO: 975446 - protein, 9 aa, Homo Sapiens
KRYEGVPAI

SEQ ID NO: 975447 - protein, 9 aa, Homo Sapiens
DVLRSRVNT

SEQ ID NO: 975448 - protein, 9 aa, Homo Sapiens
YHDLSTLQR

SEQ ID NO: 975449 - protein, 9 aa, Homo Sapiens
DPKVFRCVL

SEQ ID NO: 975450 - protein, 9 aa, Homo Sapiens
DSLMNKKAR

SEQ ID NO: 975451 - protein, 9 aa, Homo Sapiens
FCQRKQNTS

SEQ ID NO: 975452 - protein, 9 aa, Homo Sapiens
RRPCFLALE

SEQ ID NO: 975453 - protein, 9 aa, Homo Sapiens
TTWTALLGR

SEQ ID NO: 975454 - protein, 9 aa, Homo Sapiens
RPKLIRIGC

SEQ ID NO: 975455 - protein, 9 aa, Homo Sapiens
VESITPKPV

SEQ ID NO: 975456 - protein, 9 aa, Homo Sapiens
DDLMLSPND

SEQ ID NO: 975457 - protein, 9 aa, Homo Sapiens
KQKQKLTEH

SEQ ID NO: 975458 - protein, 9 aa, Homo Sapiens
KTSNYLIYL

SEQ ID NO: 975459 - protein, 9 aa, Homo Sapiens
MPGSRKMKF

SEQ ID NO: 975460 - protein, 9 aa, Homo Sapiens
GDGFKAMCV

SEQ ID NO: 975461 - protein, 9 aa, Homo Sapiens
KDFFRVLNF

SEQ ID NO: 975462 - protein, 9 aa, Homo Sapiens
AVGHHQFLG

SEQ ID NO: 975463 - protein, 9 aa, Homo Sapiens
NGKVFKLEM

SEQ ID NO: 975464 - protein, 9 aa, Homo Sapiens
NECGKTFFV

SEQ ID NO: 975465 - protein, 9 aa, Homo Sapiens
WLDSIRIGR

SEQ ID NO: 975466 - protein, 9 aa, Homo Sapiens
DHSPKFPKK

SEQ ID NO: 975467 - protein, 9 aa, Homo Sapiens
FLSSLKSKQ

SEQ ID NO: 975468 - protein, 9 aa, Homo Sapiens
TIYLPGPDR

SEQ ID NO: 975469 - protein, 9 aa, Homo Sapiens
AQDRQLLCY

SEQ ID NO: 975470 - protein, 9 aa, Homo Sapiens
ITKRHPDML

SEQ ID NO: 975471 - protein, 9 aa, Homo Sapiens
KECRKVFSH

SEQ ID NO: 975472 - protein, 9 aa, Homo Sapiens
VHIPGVYRD

SEQ ID NO: 975473 - protein, 9 aa, Homo Sapiens
LLIRNMNYR

SEQ ID NO: 975474 - protein, 9 aa, Homo Sapiens
FLEWEPEPH

SEQ ID NO: 975475 - protein, 9 aa, Homo Sapiens
IEQLVESHP

SEQ ID NO: 975476 - protein, 9 aa, Homo Sapiens
SIWMSLKII

SEQ ID NO: 975477 - protein, 9 aa, Homo Sapiens
IPCYTGPGS

SEQ ID NO: 975478 - protein, 9 aa, Homo Sapiens
RPGYNGKTS

SEQ ID NO: 975479 - protein, 9 aa, Homo Sapiens
SHGSPTRDL

SEQ ID NO: 975480 - protein, 9 aa, Homo Sapiens
GEFQNYKLY

SEQ ID NO: 975481 - protein, 9 aa, Homo Sapiens
RNHNGSLFC

SEQ ID NO: 975482 - protein, 9 aa, Homo Sapiens
DNRLQPGLG

SEQ ID NO: 975483 - protein, 9 aa, Homo Sapiens
MAISFLTIL

SEQ ID NO: 975484 - protein, 9 aa, Homo Sapiens
NALVAEQVS

SEQ ID NO: 975485 - protein, 9 aa, Homo Sapiens
DLEAFLVQI

SEQ ID NO: 975486 - protein, 9 aa, Homo Sapiens
QKLLDLETK

SEQ ID NO: 975487 - protein, 9 aa, Homo Sapiens
IILTSGKCK

SEQ ID NO: 975488 - protein, 9 aa, Homo Sapiens
RCIIHLHTL

SEQ ID NO: 975489 - protein, 9 aa, Homo Sapiens
LPAMLRFLR

SEQ ID NO: 975490 - protein, 9 aa, Homo Sapiens
DIKYFYFRP

SEQ ID NO: 975491 - protein, 9 aa, Homo Sapiens
RQEKRVFNV

SEQ ID NO: 975492 - protein, 9 aa, Homo Sapiens
TIQFGEKMM

SEQ ID NO: 975493 - protein, 9 aa, Homo Sapiens
EPPRDWFPH

SEQ ID NO: 975494 - protein, 9 aa, Homo Sapiens
GDPRQSRLF

SEQ ID NO: 975495 - protein, 9 aa, Homo Sapiens
QMAISFLTI

SEQ ID NO: 975496 - protein, 9 aa, Homo Sapiens
KPFKRFLCK

SEQ ID NO: 975497 - protein, 9 aa, Homo Sapiens
KQPPPPLPP

SEQ ID NO: 975498 - protein, 9 aa, Homo Sapiens
FSKDMPYYR

SEQ ID NO: 975499 - protein, 9 aa, Homo Sapiens
EYSGFSAHL

SEQ ID NO: 975500 - protein, 9 aa, Homo Sapiens
QSFSYSLAE

SEQ ID NO: 975501 - protein, 9 aa, Homo Sapiens
LIFLKHGYI

SEQ ID NO: 975502 - protein, 9 aa, Homo Sapiens
NVSCSVLEE

SEQ ID NO: 975503 - protein, 9 aa, Homo Sapiens
KGLAWPQCR

SEQ ID NO: 975504 - protein, 9 aa, Homo Sapiens
VLELRSFTQ

SEQ ID NO: 975505 - protein, 9 aa, Homo Sapiens
QPVQVWKNF

SEQ ID NO: 975506 - protein, 9 aa, Homo Sapiens
SSHSSQVTK

SEQ ID NO: 975507 - protein, 9 aa, Homo Sapiens
TAIPAPTAT

SEQ ID NO: 975508 - protein, 9 aa, Homo Sapiens
QPNYADTLF

SEQ ID NO: 975509 - protein, 9 aa, Homo Sapiens
IFMFFLNLF

SEQ ID NO: 975510 - protein, 9 aa, Homo Sapiens
QPEGEARVR

SEQ ID NO: 975511 - protein, 9 aa, Homo Sapiens
QATSDPYGL

SEQ ID NO: 975512 - protein, 9 aa, Homo Sapiens
VFFRSVIEV

SEQ ID NO: 975513 - protein, 9 aa, Homo Sapiens
AAVYEHVVI

SEQ ID NO: 975514 - protein, 9 aa, Homo Sapiens
EETISSSLN

SEQ ID NO: 975515 - protein, 9 aa, Homo Sapiens
LCVSLEPLL

SEQ ID NO: 975516 - protein, 9 aa, Homo Sapiens
TFAASATCC

SEQ ID NO: 975517 - protein, 9 aa, Homo Sapiens
RDVLDQPLH

SEQ ID NO: 975518 - protein, 9 aa, Homo Sapiens
QGMMAKGTT

SEQ ID NO: 975519 - protein, 9 aa, Homo Sapiens
EEYHDLSTL

SEQ ID NO: 975520 - protein, 9 aa, Homo Sapiens
NFNKTNELL

SEQ ID NO: 975521 - protein, 9 aa, Homo Sapiens
NVRTPEAFS

SEQ ID NO: 975522 - protein, 9 aa, Homo Sapiens
LSLGPPAPA

SEQ ID NO: 975523 - protein, 9 aa, Homo Sapiens
SPMLQITAP

SEQ ID NO: 975524 - protein, 9 aa, Homo Sapiens
TIKTKKKMN

SEQ ID NO: 975525 - protein, 9 aa, Homo Sapiens
PASPSVQTI

SEQ ID NO: 975526 - protein, 9 aa, Homo Sapiens
PKNPVYTFS

SEQ ID NO: 975527 - protein, 9 aa, Homo Sapiens
YKLEKDPVT

SEQ ID NO: 975528 - protein, 9 aa, Homo Sapiens
KNEDLTKLL

SEQ ID NO: 975529 - protein, 9 aa, Homo Sapiens
PAPKKERPQ

SEQ ID NO: 975530 - protein, 9 aa, Homo Sapiens
AFREKEWQA

SEQ ID NO: 975531 - protein, 9 aa, Homo Sapiens
IFMLKHCGN

SEQ ID NO: 975532 - protein, 9 aa, Homo Sapiens
SIVQEENPN

SEQ ID NO: 975533 - protein, 9 aa, Homo Sapiens
AKCKLAIIH

SEQ ID NO: 975534 - protein, 9 aa, Homo Sapiens
DFVWNCTRG

SEQ ID NO: 975535 - protein, 9 aa, Homo Sapiens
NYTLCWNGV

SEQ ID NO: 975536 - protein, 9 aa, Homo Sapiens
NNKLEVLTM

SEQ ID NO: 975537 - protein, 9 aa, Homo Sapiens
IIASFNITS

SEQ ID NO: 975538 - protein, 9 aa, Homo Sapiens
SPLQRTQES

SEQ ID NO: 975539 - protein, 9 aa, Homo Sapiens
FLQFYLFAF

SEQ ID NO: 975540 - protein, 9 aa, Homo Sapiens
KKYTQKKKK

SEQ ID NO: 975541 - protein, 9 aa, Homo Sapiens
CLPAPIPPH

SEQ ID NO: 975542 - protein, 9 aa, Homo Sapiens
LHRPKLIRI

SEQ ID NO: 975543 - protein, 9 aa, Homo Sapiens
GTMNSVRSG

SEQ ID NO: 975544 - protein, 9 aa, Homo Sapiens
KEHYEKNMR

SEQ ID NO: 975545 - protein, 9 aa, Homo Sapiens
LLSDEAVEV

SEQ ID NO: 975546 - protein, 9 aa, Homo Sapiens
DKVEDNIFQ

SEQ ID NO: 975547 - protein, 9 aa, Homo Sapiens
ASVVKSVPG

SEQ ID NO: 975548 - protein, 9 aa, Homo Sapiens
FEASQVVSM

SEQ ID NO: 975549 - protein, 9 aa, Homo Sapiens
AERTQKDKD

SEQ ID NO: 975550 - protein, 9 aa, Homo Sapiens
WEPVFQNAK

SEQ ID NO: 975551 - protein, 9 aa, Homo Sapiens
THPGYISPS

SEQ ID NO: 975552 - protein, 9 aa, Homo Sapiens
LPEPLKVAH

SEQ ID NO: 975553 - protein, 9 aa, Homo Sapiens
TITFLESST

SEQ ID NO: 975554 - protein, 9 aa, Homo Sapiens
LKQVEYVFL

SEQ ID NO: 975555 - protein, 9 aa, Homo Sapiens
SSSGTRRSG

SEQ ID NO: 975556 - protein, 9 aa, Homo Sapiens
ETLCLTWDQ

SEQ ID NO: 975557 - protein, 9 aa, Homo Sapiens
DDANVRTPE

SEQ ID NO: 975558 - protein, 9 aa, Homo Sapiens
DAQLIYFEN

SEQ ID NO: 975559 - protein, 9 aa, Homo Sapiens
LVVRSSRNN

SEQ ID NO: 975560 - protein, 9 aa, Homo Sapiens
KCNRGDPEH

SEQ ID NO: 975561 - protein, 9 aa, Homo Sapiens
CDTHQPPGA

SEQ ID NO: 975562 - protein, 9 aa, Homo Sapiens
SMKSQAKTT

SEQ ID NO: 975563 - protein, 9 aa, Homo Sapiens
GEILEGPQE

SEQ ID NO: 975564 - protein, 9 aa, Homo Sapiens
GSVTFDHEH

SEQ ID NO: 975565 - protein, 9 aa, Homo Sapiens
DASYLWWIN

SEQ ID NO: 975566 - protein, 9 aa, Homo Sapiens
WCELGGHTM

SEQ ID NO: 975567 - protein, 9 aa, Homo Sapiens
IWVEEKRQE

SEQ ID NO: 975568 - protein, 9 aa, Homo Sapiens
AGRRTGGKS

SEQ ID NO: 975569 - protein, 9 aa, Homo Sapiens
VLNFNKKCD

SEQ ID NO: 975570 - protein, 9 aa, Homo Sapiens
IESLFYTVI

SEQ ID NO: 975571 - protein, 9 aa, Homo Sapiens
PMKETQQEP

SEQ ID NO: 975572 - protein, 9 aa, Homo Sapiens
VREVVDDWK

SEQ ID NO: 975573 - protein, 9 aa, Homo Sapiens
EKKLSLENK

SEQ ID NO: 975574 - protein, 9 aa, Homo Sapiens
VLSSTSAII

SEQ ID NO: 975575 - protein, 9 aa, Homo Sapiens
EPPSSREDM

SEQ ID NO: 975576 - protein, 9 aa, Homo Sapiens
VGLKEKIFL

SEQ ID NO: 975577 - protein, 9 aa, Homo Sapiens
TIEKKVMLC

SEQ ID NO: 975578 - protein, 9 aa, Homo Sapiens
GPKCQIEIS

SEQ ID NO: 975579 - protein, 9 aa, Homo Sapiens
FPFPSSSFS

SEQ ID NO: 975580 - protein, 9 aa, Homo Sapiens
GGRRARRCR

SEQ ID NO: 975581 - protein, 9 aa, Homo Sapiens
IKGEKGDER

SEQ ID NO: 975582 - protein, 9 aa, Homo Sapiens
LLKLSREKA

SEQ ID NO: 975583 - protein, 9 aa, Homo Sapiens
GVISITMGP

SEQ ID NO: 975584 - protein, 9 aa, Homo Sapiens
PAPSICFKC

SEQ ID NO: 975585 - protein, 9 aa, Homo Sapiens
AGGVDTTFM

SEQ ID NO: 975586 - protein, 9 aa, Homo Sapiens
RERSVRVWG

SEQ ID NO: 975587 - protein, 9 aa, Homo Sapiens
KNRMAVSQD

SEQ ID NO: 975588 - protein, 9 aa, Homo Sapiens
LQIFPFPSS

SEQ ID NO: 975589 - protein, 9 aa, Homo Sapiens
SPSRASGPP

SEQ ID NO: 975590 - protein, 9 aa, Homo Sapiens
LGMTNPEVI

SEQ ID NO: 975591 - protein, 9 aa, Homo Sapiens
QAAVKPPPE

SEQ ID NO: 975592 - protein, 9 aa, Homo Sapiens
ELCPAAESR

SEQ ID NO: 975593 - protein, 9 aa, Homo Sapiens
IRMQSLVDV

SEQ ID NO: 975594 - protein, 9 aa, Homo Sapiens
AMIFYLLKI

SEQ ID NO: 975595 - protein, 9 aa, Homo Sapiens
VNPQRWGFG

SEQ ID NO: 975596 - protein, 9 aa, Homo Sapiens
KDWCAKCQL

SEQ ID NO: 975597 - protein, 9 aa, Homo Sapiens
VALKGEGTR

SEQ ID NO: 975598 - protein, 9 aa, Homo Sapiens
GLKQVIILR

SEQ ID NO: 975599 - protein, 9 aa, Homo Sapiens
NVTSRGRGR

SEQ ID NO: 975600 - protein, 9 aa, Homo Sapiens
DGYNLISLL

SEQ ID NO: 975601 - protein, 9 aa, Homo Sapiens
TFILSEHDG

SEQ ID NO: 975602 - protein, 9 aa, Homo Sapiens
RLLRHHEET

SEQ ID NO: 975603 - protein, 9 aa, Homo Sapiens
MIESLFYTV

SEQ ID NO: 975604 - protein, 9 aa, Homo Sapiens
TVGLKEKIF

SEQ ID NO: 975605 - protein, 9 aa, Homo Sapiens
MALCDTHQP

SEQ ID NO: 975606 - protein, 9 aa, Homo Sapiens
VQLAISPSP

SEQ ID NO: 975607 - protein, 9 aa, Homo Sapiens
YNNEGGGEE

SEQ ID NO: 975608 - protein, 9 aa, Homo Sapiens
MSFYHHGEM

SEQ ID NO: 975609 - protein, 9 aa, Homo Sapiens
NRLQPGLGD

SEQ ID NO: 975610 - protein, 9 aa, Homo Sapiens
YTTWTALLG

SEQ ID NO: 975611 - protein, 9 aa, Homo Sapiens
SKQEGLICS

SEQ ID NO: 975612 - protein, 9 aa, Homo Sapiens
KKVMLCIQE

SEQ ID NO: 975613 - protein, 9 aa, Homo Sapiens
NVTFEEGTL

SEQ ID NO: 975614 - protein, 9 aa, Homo Sapiens
LNTVLEDVD

SEQ ID NO: 975615 - protein, 9 aa, Homo Sapiens
DSQLMTFNL

SEQ ID NO: 975616 - protein, 9 aa, Homo Sapiens
RGWKLTFVI

SEQ ID NO: 975617 - protein, 9 aa, Homo Sapiens
TYHCSGMEK

SEQ ID NO: 975618 - protein, 9 aa, Homo Sapiens
SENKSIFYY

SEQ ID NO: 975619 - protein, 9 aa, Homo Sapiens
PTAGVGQEE

SEQ ID NO: 975620 - protein, 9 aa, Homo Sapiens
PSCSFPHNF

SEQ ID NO: 975621 - protein, 9 aa, Homo Sapiens
IVCTVRRLD

SEQ ID NO: 975622 - protein, 9 aa, Homo Sapiens
LEKRNKYFN

SEQ ID NO: 975623 - protein, 9 aa, Homo Sapiens
VTSIEMHLT

SEQ ID NO: 975624 - protein, 9 aa, Homo Sapiens
SAFADSFCP

SEQ ID NO: 975625 - protein, 9 aa, Homo Sapiens
LLPFLFPLF

SEQ ID NO: 975626 - protein, 9 aa, Homo Sapiens
EELMINATA

SEQ ID NO: 975627 - protein, 9 aa, Homo Sapiens
LETKNSSYQ

SEQ ID NO: 975628 - protein, 9 aa, Homo Sapiens
RREPVLSFQ

SEQ ID NO: 975629 - protein, 9 aa, Homo Sapiens
SSEELFDQD

SEQ ID NO: 975630 - protein, 9 aa, Homo Sapiens
SLPSSGELY

SEQ ID NO: 975631 - protein, 9 aa, Homo Sapiens
IPYMAACVV

SEQ ID NO: 975632 - protein, 9 aa, Homo Sapiens
PDGIVEERW

SEQ ID NO: 975633 - protein, 9 aa, Homo Sapiens
TVKRTYAFR

SEQ ID NO: 975634 - protein, 9 aa, Homo Sapiens
LCAGRRTGG

SEQ ID NO: 975635 - protein, 9 aa, Homo Sapiens
HRGDPGPFG

SEQ ID NO: 975636 - protein, 9 aa, Homo Sapiens
QRFLDQWAS

SEQ ID NO: 975637 - protein, 9 aa, Homo Sapiens
KSLDAYGVN

SEQ ID NO: 975638 - protein, 9 aa, Homo Sapiens
TFFVNSAFD

SEQ ID NO: 975639 - protein, 9 aa, Homo Sapiens
ACVSQIFFV

SEQ ID NO: 975640 - protein, 9 aa, Homo Sapiens
KLEKHLEKL

SEQ ID NO: 975641 - protein, 9 aa, Homo Sapiens
GYNGKTSIS

SEQ ID NO: 975642 - protein, 9 aa, Homo Sapiens
NLILEKRNK

SEQ ID NO: 975643 - protein, 9 aa, Homo Sapiens
KEKLEFTRG

SEQ ID NO: 975644 - protein, 9 aa, Homo Sapiens
GKYIRERSV

SEQ ID NO: 975645 - protein, 9 aa, Homo Sapiens
NAKLTADDF

SEQ ID NO: 975646 - protein, 9 aa, Homo Sapiens
DAISPSRAS

SEQ ID NO: 975647 - protein, 9 aa, Homo Sapiens
EQKTSDPER

SEQ ID NO: 975648 - protein, 9 aa, Homo Sapiens
QRSASFLEW

SEQ ID NO: 975649 - protein, 9 aa, Homo Sapiens
RRFAATLQQ

SEQ ID NO: 975650 - protein, 9 aa, Homo Sapiens
VLLKLSREK

SEQ ID NO: 975651 - protein, 9 aa, Homo Sapiens
RLPHTTLSP

SEQ ID NO: 975652 - protein, 9 aa, Homo Sapiens
LKIFFCAWC

SEQ ID NO: 975653 - protein, 9 aa, Homo Sapiens
ALGVERRNW

SEQ ID NO: 975654 - protein, 9 aa, Homo Sapiens
EKMMKRALQ

SEQ ID NO: 975655 - protein, 9 aa, Homo Sapiens
VRGATLLGA

SEQ ID NO: 975656 - protein, 9 aa, Homo Sapiens
KKLNSEYFM

SEQ ID NO: 975657 - protein, 9 aa, Homo Sapiens
ACIAQQTFK

SEQ ID NO: 975658 - protein, 9 aa, Homo Sapiens
KAKKDWCAK

SEQ ID NO: 975659 - protein, 9 aa, Homo Sapiens
IEEFREVAS

SEQ ID NO: 975660 - protein, 9 aa, Homo Sapiens
SAGEEARRK

SEQ ID NO: 975661 - protein, 9 aa, Homo Sapiens
LVSSSLLAS

SEQ ID NO: 975662 - protein, 9 aa, Homo Sapiens
KRSTFDNFS

SEQ ID NO: 975663 - protein, 9 aa, Homo Sapiens
PDSQEDFFQ

SEQ ID NO: 975664 - protein, 9 aa, Homo Sapiens
EDGAFAAEP

SEQ ID NO: 975665 - protein, 9 aa, Homo Sapiens
ASTADSLSN

SEQ ID NO: 975666 - protein, 9 aa, Homo Sapiens
CTTRAPCVH

SEQ ID NO: 975667 - protein, 9 aa, Homo Sapiens
FLVLGATEY

SEQ ID NO: 975668 - protein, 9 aa, Homo Sapiens
VNGLCKARK

SEQ ID NO: 975669 - protein, 9 aa, Homo Sapiens
LCYYDQCET

SEQ ID NO: 975670 - protein, 9 aa, Homo Sapiens
NELKVCIHP

SEQ ID NO: 975671 - protein, 9 aa, Homo Sapiens
KVSFLNIAT

SEQ ID NO: 975672 - protein, 9 aa, Homo Sapiens
QEEEDGAFA

SEQ ID NO: 975673 - protein, 9 aa, Homo Sapiens
HFQSFSYSL

SEQ ID NO: 975674 - protein, 9 aa, Homo Sapiens
ESDGSTSII

SEQ ID NO: 975675 - protein, 9 aa, Homo Sapiens
TSLSSLGLE

SEQ ID NO: 975676 - protein, 9 aa, Homo Sapiens
AGHCYKFRI

SEQ ID NO: 975677 - protein, 9 aa, Homo Sapiens
VSRSPMPEK

SEQ ID NO: 975678 - protein, 9 aa, Homo Sapiens
IEPSVSSTS

SEQ ID NO: 975679 - protein, 9 aa, Homo Sapiens
VSYKEGDLQ

SEQ ID NO: 975680 - protein, 9 aa, Homo Sapiens
GKVPDGYSV

SEQ ID NO: 975681 - protein, 9 aa, Homo Sapiens
VGILRIPVH

SEQ ID NO: 975682 - protein, 9 aa, Homo Sapiens
RTQKDKDNF

SEQ ID NO: 975683 - protein, 9 aa, Homo Sapiens
VPASDSKTK

SEQ ID NO: 975684 - protein, 9 aa, Homo Sapiens
VWNCTRGIR

SEQ ID NO: 975685 - protein, 9 aa, Homo Sapiens
SAQPVAFSV

SEQ ID NO: 975686 - protein, 9 aa, Homo Sapiens
MVETIAFCQ

SEQ ID NO: 975687 - protein, 9 aa, Homo Sapiens
RTQCVKEVC

SEQ ID NO: 975688 - protein, 9 aa, Homo Sapiens
KQLSRLCRN

SEQ ID NO: 975689 - protein, 9 aa, Homo Sapiens
GQGQHEESL

SEQ ID NO: 975690 - protein, 9 aa, Homo Sapiens
RQRHLENLE

SEQ ID NO: 975691 - protein, 9 aa, Homo Sapiens
EQDIVKMVS

SEQ ID NO: 975692 - protein, 9 aa, Homo Sapiens
VFRHFYIMP

SEQ ID NO: 975693 - protein, 9 aa, Homo Sapiens
YVLECNHHS

SEQ ID NO: 975694 - protein, 9 aa, Homo Sapiens
WVGELMDQE

SEQ ID NO: 975695 - protein, 9 aa, Homo Sapiens
LDSKTTYNR

SEQ ID NO: 975696 - protein, 9 aa, Homo Sapiens
PNGRLKLGW

SEQ ID NO: 975697 - protein, 9 aa, Homo Sapiens
EFLLPAIFG

SEQ ID NO: 975698 - protein, 9 aa, Homo Sapiens
CSPGAMFSE

SEQ ID NO: 975699 - protein, 9 aa, Homo Sapiens
FDRVDPCQA

SEQ ID NO: 975700 - protein, 9 aa, Homo Sapiens
LERWCTTRA

SEQ ID NO: 975701 - protein, 9 aa, Homo Sapiens
DLPREDTVC

SEQ ID NO: 975702 - protein, 9 aa, Homo Sapiens
VVKKVEKGC

SEQ ID NO: 975703 - protein, 9 aa, Homo Sapiens
FFCVKKGEV

SEQ ID NO: 975704 - protein, 9 aa, Homo Sapiens
IWQNPFLQQ

SEQ ID NO: 975705 - protein, 9 aa, Homo Sapiens
PNVTSRGRG

SEQ ID NO: 975706 - protein, 9 aa, Homo Sapiens
LVLTLLACL

SEQ ID NO: 975707 - protein, 9 aa, Homo Sapiens
VQNPHAFSN

SEQ ID NO: 975708 - protein, 9 aa, Homo Sapiens
SPRFPYGYP

SEQ ID NO: 975709 - protein, 9 aa, Homo Sapiens
MPGRIAATL

SEQ ID NO: 975710 - protein, 9 aa, Homo Sapiens
TKKKMNNFY

SEQ ID NO: 975711 - protein, 9 aa, Homo Sapiens
VELQVASLG

SEQ ID NO: 975712 - protein, 9 aa, Homo Sapiens
IDLLIDFLN

SEQ ID NO: 975713 - protein, 9 aa, Homo Sapiens
CTPPPLIFF

SEQ ID NO: 975714 - protein, 9 aa, Homo Sapiens
EDTPKAKTP

SEQ ID NO: 975715 - protein, 9 aa, Homo Sapiens
LERSKIYLE

SEQ ID NO: 975716 - protein, 9 aa, Homo Sapiens
GLLEKCCQD

SEQ ID NO: 975717 - protein, 9 aa, Homo Sapiens
NPSSLFLVE

SEQ ID NO: 975718 - protein, 9 aa, Homo Sapiens
RATASIIED

SEQ ID NO: 975719 - protein, 9 aa, Homo Sapiens
LQKGEIRAI

SEQ ID NO: 975720 - protein, 9 aa, Homo Sapiens
YVLLTRKLY

SEQ ID NO: 975721 - protein, 9 aa, Homo Sapiens
NEYCKAFNW

SEQ ID NO: 975722 - protein, 9 aa, Homo Sapiens
FLGEKASAR

SEQ ID NO: 975723 - protein, 9 aa, Homo Sapiens
VETDGRGKI

SEQ ID NO: 975724 - protein, 9 aa, Homo Sapiens
ETQREKILE

SEQ ID NO: 975725 - protein, 9 aa, Homo Sapiens
PYMAACVVF

SEQ ID NO: 975726 - protein, 9 aa, Homo Sapiens
NRGDPEHHV

SEQ ID NO: 975727 - protein, 9 aa, Homo Sapiens
EETHSRGEG

SEQ ID NO: 975728 - protein, 9 aa, Homo Sapiens
GPTETLSWP

SEQ ID NO: 975729 - protein, 9 aa, Homo Sapiens
SKDMPYYRS

SEQ ID NO: 975730 - protein, 9 aa, Homo Sapiens
LEDEETHSR

SEQ ID NO: 975731 - protein, 9 aa, Homo Sapiens
AYWKKESQK

SEQ ID NO: 975732 - protein, 9 aa, Homo Sapiens
ATCCLWCCA

SEQ ID NO: 975733 - protein, 9 aa, Homo Sapiens
NLSNNSFSN

SEQ ID NO: 975734 - protein, 9 aa, Homo Sapiens
MGSGESHRK

SEQ ID NO: 975735 - protein, 9 aa, Homo Sapiens
KEREESSCD

SEQ ID NO: 975736 - protein, 9 aa, Homo Sapiens
NYADTLFSE

SEQ ID NO: 975737 - protein, 9 aa, Homo Sapiens
AQLYFFYFL

SEQ ID NO: 975738 - protein, 9 aa, Homo Sapiens
FGEKMMKRA

SEQ ID NO: 975739 - protein, 9 aa, Homo Sapiens
RMGSIQEET

SEQ ID NO: 975740 - protein, 9 aa, Homo Sapiens
IGYNIGDVQ

SEQ ID NO: 975741 - protein, 9 aa, Homo Sapiens
SLTTTFFFS

SEQ ID NO: 975742 - protein, 9 aa, Homo Sapiens
KDLPAMLRF

SEQ ID NO: 975743 - protein, 9 aa, Homo Sapiens
MASIERKYC

SEQ ID NO: 975744 - protein, 9 aa, Homo Sapiens
SQDDSRTDK

SEQ ID NO: 975745 - protein, 9 aa, Homo Sapiens
LFAFFSFFT

SEQ ID NO: 975746 - protein, 9 aa, Homo Sapiens
GFSKFKENT

SEQ ID NO: 975747 - protein, 9 aa, Homo Sapiens
GAAAAPPPK

SEQ ID NO: 975748 - protein, 9 aa, Homo Sapiens
KGEKEDLGL

SEQ ID NO: 975749 - protein, 9 aa, Homo Sapiens
RDDLWDAWG

SEQ ID NO: 975750 - protein, 9 aa, Homo Sapiens
DANMEQIEP

SEQ ID NO: 975751 - protein, 9 aa, Homo Sapiens
FLLVLTLLA

SEQ ID NO: 975752 - protein, 9 aa, Homo Sapiens
ESEIAKEKL

SEQ ID NO: 975753 - protein, 9 aa, Homo Sapiens
ASVKKFLEE

SEQ ID NO: 975754 - protein, 9 aa, Homo Sapiens
TPQRFLDQW

SEQ ID NO: 975755 - protein, 9 aa, Homo Sapiens
AGLRMLSKG

SEQ ID NO: 975756 - protein, 9 aa, Homo Sapiens
FDGWKISFI

SEQ ID NO: 975757 - protein, 9 aa, Homo Sapiens
TQCVKEVCP

SEQ ID NO: 975758 - protein, 9 aa, Homo Sapiens
EIGKLEEFF

SEQ ID NO: 975759 - protein, 9 aa, Homo Sapiens
FRPGYNGKT

SEQ ID NO: 975760 - protein, 9 aa, Homo Sapiens
SFECENGFI

SEQ ID NO: 975761 - protein, 9 aa, Homo Sapiens
GGKYIRERS

SEQ ID NO: 975762 - protein, 9 aa, Homo Sapiens
EKIPIAGTV

SEQ ID NO: 975763 - protein, 9 aa, Homo Sapiens
ARGGRAGFL

SEQ ID NO: 975764 - protein, 9 aa, Homo Sapiens
KLQLNTKFS

SEQ ID NO: 975765 - protein, 9 aa, Homo Sapiens
SRVTFLDDI

SEQ ID NO: 975766 - protein, 9 aa, Homo Sapiens
YIVHKKFDD

SEQ ID NO: 975767 - protein, 9 aa, Homo Sapiens
AQQLHLKID

SEQ ID NO: 975768 - protein, 9 aa, Homo Sapiens
RTCCRPKTH

SEQ ID NO: 975769 - protein, 9 aa, Homo Sapiens
DANVRTPEA

SEQ ID NO: 975770 - protein, 9 aa, Homo Sapiens
ALLDRHEDS

SEQ ID NO: 975771 - protein, 9 aa, Homo Sapiens
EVELQVASL

SEQ ID NO: 975772 - protein, 9 aa, Homo Sapiens
MLSPNDIEQ

SEQ ID NO: 975773 - protein, 9 aa, Homo Sapiens
IENCPFSQR

SEQ ID NO: 975774 - protein, 9 aa, Homo Sapiens
RKAWAEAED

SEQ ID NO: 975775 - protein, 9 aa, Homo Sapiens
ESSTSDHHW

SEQ ID NO: 975776 - protein, 9 aa, Homo Sapiens
LLRANADAP

SEQ ID NO: 975777 - protein, 9 aa, Homo Sapiens
LKRYEGVPA

SEQ ID NO: 975778 - protein, 9 aa, Homo Sapiens
SLMQPPPPG

SEQ ID NO: 975779 - protein, 9 aa, Homo Sapiens
PRCCSCNIS

SEQ ID NO: 975780 - protein, 9 aa, Homo Sapiens
LLYVRKDGN

SEQ ID NO: 975781 - protein, 9 aa, Homo Sapiens
IFRWKGENV

SEQ ID NO: 975782 - protein, 9 aa, Homo Sapiens
AHVYLPFYQ

SEQ ID NO: 975783 - protein, 9 aa, Homo Sapiens
MNDPAWDEI

SEQ ID NO: 975784 - protein, 9 aa, Homo Sapiens
SKRLLRHHE

SEQ ID NO: 975785 - protein, 9 aa, Homo Sapiens
TFVILFHCV

SEQ ID NO: 975786 - protein, 9 aa, Homo Sapiens
LSQTYFYRA

SEQ ID NO: 975787 - protein, 9 aa, Homo Sapiens
ALLGRSRQL

SEQ ID NO: 975788 - protein, 9 aa, Homo Sapiens
SSAKQKQKL

SEQ ID NO: 975789 - protein, 9 aa, Homo Sapiens
IILAVLVAF

SEQ ID NO: 975790 - protein, 9 aa, Homo Sapiens
VIHGKRKNV

SEQ ID NO: 975791 - protein, 9 aa, Homo Sapiens
EVLNETLCL

SEQ ID NO: 975792 - protein, 9 aa, Homo Sapiens
RSGGRERGQ

SEQ ID NO: 975793 - protein, 9 aa, Homo Sapiens
KCQAKYGAF

SEQ ID NO: 975794 - protein, 9 aa, Homo Sapiens
CALRSSSSP

SEQ ID NO: 975795 - protein, 9 aa, Homo Sapiens
TIFSNIQSV

SEQ ID NO: 975796 - protein, 9 aa, Homo Sapiens
PEQIYEDPM

SEQ ID NO: 975797 - protein, 9 aa, Homo Sapiens
FVLLSYIQI

SEQ ID NO: 975798 - protein, 9 aa, Homo Sapiens
ISREHERVG

SEQ ID NO: 975799 - protein, 9 aa, Homo Sapiens
PDGRRATGV

SEQ ID NO: 975800 - protein, 9 aa, Homo Sapiens
PDGRVSHFP

SEQ ID NO: 975801 - protein, 9 aa, Homo Sapiens
QKKQVQIKK

SEQ ID NO: 975802 - protein, 9 aa, Homo Sapiens
MYDRQGQLV

SEQ ID NO: 975803 - protein, 9 aa, Homo Sapiens
ELKDKLEFQ

SEQ ID NO: 975804 - protein, 9 aa, Homo Sapiens
VSFLNIATR

SEQ ID NO: 975805 - protein, 9 aa, Homo Sapiens
QPCPICKKE

SEQ ID NO: 975806 - protein, 9 aa, Homo Sapiens
GRSRGTGSA

SEQ ID NO: 975807 - protein, 9 aa, Homo Sapiens
LTWDQMLVF

SEQ ID NO: 975808 - protein, 9 aa, Homo Sapiens
VFGLDGVRR

SEQ ID NO: 975809 - protein, 9 aa, Homo Sapiens
GCQLEKTEQ

SEQ ID NO: 975810 - protein, 9 aa, Homo Sapiens
CMLMPKENF

SEQ ID NO: 975811 - protein, 9 aa, Homo Sapiens
FAIFSIDYV

SEQ ID NO: 975812 - protein, 9 aa, Homo Sapiens
TDGVDKLFG

SEQ ID NO: 975813 - protein, 9 aa, Homo Sapiens
VSILPDNLP

SEQ ID NO: 975814 - protein, 9 aa, Homo Sapiens
IAPNSSTLM

SEQ ID NO: 975815 - protein, 9 aa, Homo Sapiens
VHIISENES

SEQ ID NO: 975816 - protein, 9 aa, Homo Sapiens
RSFVKTPKP

SEQ ID NO: 975817 - protein, 9 aa, Homo Sapiens
SLTCVMKGK

SEQ ID NO: 975818 - protein, 9 aa, Homo Sapiens
VETAFANST

SEQ ID NO: 975819 - protein, 9 aa, Homo Sapiens
ACLQLALGL

SEQ ID NO: 975820 - protein, 9 aa, Homo Sapiens
GPAPSICFK

SEQ ID NO: 975821 - protein, 9 aa, Homo Sapiens
RMIEEFREV

SEQ ID NO: 975822 - protein, 9 aa, Homo Sapiens
KKVNKKIVR

SEQ ID NO: 975823 - protein, 9 aa, Homo Sapiens
TCELKYEEK

SEQ ID NO: 975824 - protein, 9 aa, Homo Sapiens
KLAPGDNPY

SEQ ID NO: 975825 - protein, 9 aa, Homo Sapiens
YRNLVYLGI

SEQ ID NO: 975826 - protein, 9 aa, Homo Sapiens
PPSSFLSSL

SEQ ID NO: 975827 - protein, 9 aa, Homo Sapiens
DIILAVLVA

SEQ ID NO: 975828 - protein, 9 aa, Homo Sapiens
IAKYNAPCS

SEQ ID NO: 975829 - protein, 9 aa, Homo Sapiens
TGNACCSIS

SEQ ID NO: 975830 - protein, 9 aa, Homo Sapiens
QCDLVAFTC

SEQ ID NO: 975831 - protein, 9 aa, Homo Sapiens
AGSAQPVAF

SEQ ID NO: 975832 - protein, 9 aa, Homo Sapiens
DCHLRDFEP

SEQ ID NO: 975833 - protein, 9 aa, Homo Sapiens
ASIIEDVMG

SEQ ID NO: 975834 - protein, 9 aa, Homo Sapiens
VWAGLGGRH

SEQ ID NO: 975835 - protein, 9 aa, Homo Sapiens
EANSVFCQK

SEQ ID NO: 975836 - protein, 9 aa, Homo Sapiens
LASVIFICD

SEQ ID NO: 975837 - protein, 9 aa, Homo Sapiens
IRIINLQIL

SEQ ID NO: 975838 - protein, 9 aa, Homo Sapiens
GTAPSALSS

SEQ ID NO: 975839 - protein, 9 aa, Homo Sapiens
GGNQISLLN

SEQ ID NO: 975840 - protein, 9 aa, Homo Sapiens
LIRIGCFLM

SEQ ID NO: 975841 - protein, 9 aa, Homo Sapiens
AWKHSVGII

SEQ ID NO: 975842 - protein, 9 aa, Homo Sapiens
TKNSSYQTG

SEQ ID NO: 975843 - protein, 9 aa, Homo Sapiens
GLAGELLLF

SEQ ID NO: 975844 - protein, 9 aa, Homo Sapiens
EARVRVESN

SEQ ID NO: 975845 - protein, 9 aa, Homo Sapiens
PISIWMSLK

SEQ ID NO: 975846 - protein, 9 aa, Homo Sapiens
ERGVPGEDP

SEQ ID NO: 975847 - protein, 9 aa, Homo Sapiens
PVHSSTRLP

SEQ ID NO: 975848 - protein, 9 aa, Homo Sapiens
YLRVVNVGV

SEQ ID NO: 975849 - protein, 9 aa, Homo Sapiens
FGIPKPVRP

SEQ ID NO: 975850 - protein, 9 aa, Homo Sapiens
RRSGSRGSD

SEQ ID NO: 975851 - protein, 9 aa, Homo Sapiens
QVTYTTLFQ

SEQ ID NO: 975852 - protein, 9 aa, Homo Sapiens
DLMLSPNDI

SEQ ID NO: 975853 - protein, 9 aa, Homo Sapiens
FDSLYFLRT

SEQ ID NO: 975854 - protein, 9 aa, Homo Sapiens
PGAVKRTGQ

SEQ ID NO: 975855 - protein, 9 aa, Homo Sapiens
AGPSPSTFH

SEQ ID NO: 975856 - protein, 9 aa, Homo Sapiens
FDKVLAERK

SEQ ID NO: 975857 - protein, 9 aa, Homo Sapiens
EKDTDPNSV

SEQ ID NO: 975858 - protein, 9 aa, Homo Sapiens
DKVLAERKQ

SEQ ID NO: 975859 - protein, 9 aa, Homo Sapiens
QLMTFNLCL

SEQ ID NO: 975860 - protein, 9 aa, Homo Sapiens
LETHNKIPY

SEQ ID NO: 975861 - protein, 9 aa, Homo Sapiens
CVFLQFYLF

SEQ ID NO: 975862 - protein, 9 aa, Homo Sapiens
SSSLFPNGH

SEQ ID NO: 975863 - protein, 9 aa, Homo Sapiens
KQPMELYNL

SEQ ID NO: 975864 - protein, 9 aa, Homo Sapiens
NGIPKLAPG

SEQ ID NO: 975865 - protein, 9 aa, Homo Sapiens
NLRKTGVEL

SEQ ID NO: 975866 - protein, 9 aa, Homo Sapiens
PNQNILIQM

SEQ ID NO: 975867 - protein, 9 aa, Homo Sapiens
MPVSVPASD

SEQ ID NO: 975868 - protein, 9 aa, Homo Sapiens
STDDAGIKY

SEQ ID NO: 975869 - protein, 9 aa, Homo Sapiens
HSPIKEESC

SEQ ID NO: 975870 - protein, 9 aa, Homo Sapiens
LLTVQELRV

SEQ ID NO: 975871 - protein, 9 aa, Homo Sapiens
HASYSALPP

SEQ ID NO: 975872 - protein, 9 aa, Homo Sapiens
SARNFGASD

SEQ ID NO: 975873 - protein, 9 aa, Homo Sapiens
GGGNQISLL

SEQ ID NO: 975874 - protein, 9 aa, Homo Sapiens
VLPTYSKRT

SEQ ID NO: 975875 - protein, 9 aa, Homo Sapiens
DVAVFPQQQ

SEQ ID NO: 975876 - protein, 9 aa, Homo Sapiens
HKEEHGKIK

SEQ ID NO: 975877 - protein, 9 aa, Homo Sapiens
NKSIFYYGC

SEQ ID NO: 975878 - protein, 9 aa, Homo Sapiens
STQTVRIIK

SEQ ID NO: 975879 - protein, 9 aa, Homo Sapiens
CPREGHALP

SEQ ID NO: 975880 - protein, 9 aa, Homo Sapiens
EGFLEVKNA

SEQ ID NO: 975881 - protein, 9 aa, Homo Sapiens
LSNLIILEE

SEQ ID NO: 975882 - protein, 9 aa, Homo Sapiens
FRVLNFNKK

SEQ ID NO: 975883 - protein, 9 aa, Homo Sapiens
WLLEQPEKE

SEQ ID NO: 975884 - protein, 9 aa, Homo Sapiens
PSGQYTHKF

SEQ ID NO: 975885 - protein, 9 aa, Homo Sapiens
GEKGDERPM

SEQ ID NO: 975886 - protein, 9 aa, Homo Sapiens
AGGYNREEF

SEQ ID NO: 975887 - protein, 9 aa, Homo Sapiens
NEPLSAPAM

SEQ ID NO: 975888 - protein, 9 aa, Homo Sapiens
SFQKQTFLG

SEQ ID NO: 975889 - protein, 9 aa, Homo Sapiens
QYSVHQTSS

SEQ ID NO: 975890 - protein, 9 aa, Homo Sapiens
IFPFPSSSF

SEQ ID NO: 975891 - protein, 9 aa, Homo Sapiens
SSGELYAVQ

SEQ ID NO: 975892 - protein, 9 aa, Homo Sapiens
VAAYCPASV

SEQ ID NO: 975893 - protein, 9 aa, Homo Sapiens
DESTVSICE

SEQ ID NO: 975894 - protein, 9 aa, Homo Sapiens
SIGYNIGDV

SEQ ID NO: 975895 - protein, 9 aa, Homo Sapiens
DYMIPLKYV

SEQ ID NO: 975896 - protein, 9 aa, Homo Sapiens
LEVVEGNLM

SEQ ID NO: 975897 - protein, 9 aa, Homo Sapiens
TITYNACVS

SEQ ID NO: 975898 - protein, 9 aa, Homo Sapiens
RGRGGGGGR

SEQ ID NO: 975899 - protein, 9 aa, Homo Sapiens
TTFMTLQWH

SEQ ID NO: 975900 - protein, 9 aa, Homo Sapiens
ADLPLGQQD

SEQ ID NO: 975901 - protein, 9 aa, Homo Sapiens
EKGDERPMG

SEQ ID NO: 975902 - protein, 9 aa, Homo Sapiens
CWGFWRWNL

SEQ ID NO: 975903 - protein, 9 aa, Homo Sapiens
ARGGLLKGM

SEQ ID NO: 975904 - protein, 9 aa, Homo Sapiens
NKFDLVCGM

SEQ ID NO: 975905 - protein, 9 aa, Homo Sapiens
ENLEEPPER

SEQ ID NO: 975906 - protein, 9 aa, Homo Sapiens
APATLTAPC

SEQ ID NO: 975907 - protein, 9 aa, Homo Sapiens
IYKCDAVVC

SEQ ID NO: 975908 - protein, 9 aa, Homo Sapiens
GRALLDKGA

SEQ ID NO: 975909 - protein, 9 aa, Homo Sapiens
FHVLVFTLV

SEQ ID NO: 975910 - protein, 9 aa, Homo Sapiens
PLNPSGTDH

SEQ ID NO: 975911 - protein, 9 aa, Homo Sapiens
TPPASPSVQ

SEQ ID NO: 975912 - protein, 9 aa, Homo Sapiens
SISEAFSGA

SEQ ID NO: 975913 - protein, 9 aa, Homo Sapiens
PIEDKDFIN

SEQ ID NO: 975914 - protein, 9 aa, Homo Sapiens
SGIVCTVRR

SEQ ID NO: 975915 - protein, 9 aa, Homo Sapiens
GHHVFCQQP

SEQ ID NO: 975916 - protein, 9 aa, Homo Sapiens
DKATKDSSR

SEQ ID NO: 975917 - protein, 9 aa, Homo Sapiens
EQSWLLAPT

SEQ ID NO: 975918 - protein, 9 aa, Homo Sapiens
KALRLNGEL

SEQ ID NO: 975919 - protein, 9 aa, Homo Sapiens
THYYYSEAF

SEQ ID NO: 975920 - protein, 9 aa, Homo Sapiens
GSEKFWYNS

SEQ ID NO: 975921 - protein, 9 aa, Homo Sapiens
RRRCVENAG

SEQ ID NO: 975922 - protein, 9 aa, Homo Sapiens
NITSVQRSD

SEQ ID NO: 975923 - protein, 9 aa, Homo Sapiens
STLQRERME

SEQ ID NO: 975924 - protein, 9 aa, Homo Sapiens
SALQHVKAI

SEQ ID NO: 975925 - protein, 9 aa, Homo Sapiens
SYSRCMIQL

SEQ ID NO: 975926 - protein, 9 aa, Homo Sapiens
KKAYKKYIK

SEQ ID NO: 975927 - protein, 9 aa, Homo Sapiens
SPSVANMKA

SEQ ID NO: 975928 - protein, 9 aa, Homo Sapiens
TYTTLFQTT

SEQ ID NO: 975929 - protein, 9 aa, Homo Sapiens
SVAEMSFYH

SEQ ID NO: 975930 - protein, 9 aa, Homo Sapiens
AVSQDDSRT

SEQ ID NO: 975931 - protein, 9 aa, Homo Sapiens
EDDAFCQGK

SEQ ID NO: 975932 - protein, 9 aa, Homo Sapiens
NLEEPPERR

SEQ ID NO: 975933 - protein, 9 aa, Homo Sapiens
LLNEKVARR

SEQ ID NO: 975934 - protein, 9 aa, Homo Sapiens
PRNYPNNAK

SEQ ID NO: 975935 - protein, 9 aa, Homo Sapiens
SEAFSGALA

SEQ ID NO: 975936 - protein, 9 aa, Homo Sapiens
NGLEPLNSR

SEQ ID NO: 975937 - protein, 9 aa, Homo Sapiens
LGRNLFKVE

SEQ ID NO: 975938 - protein, 9 aa, Homo Sapiens
MGSIQEETL

SEQ ID NO: 975939 - protein, 9 aa, Homo Sapiens
CQQPLSEPQ

SEQ ID NO: 975940 - protein, 9 aa, Homo Sapiens
IKVSHTSYF

SEQ ID NO: 975941 - protein, 9 aa, Homo Sapiens
GISIYCYAL

SEQ ID NO: 975942 - protein, 9 aa, Homo Sapiens
KLFTAAEFL

SEQ ID NO: 975943 - protein, 9 aa, Homo Sapiens
KETLEEVIA

SEQ ID NO: 975944 - protein, 9 aa, Homo Sapiens
HDIFCQRKQ

SEQ ID NO: 975945 - protein, 9 aa, Homo Sapiens
MRCNSTKSG

SEQ ID NO: 975946 - protein, 9 aa, Homo Sapiens
LTPTWVSSS

SEQ ID NO: 975947 - protein, 9 aa, Homo Sapiens
LPHVNPQRW

SEQ ID NO: 975948 - protein, 9 aa, Homo Sapiens
EGPSANPPV

SEQ ID NO: 975949 - protein, 9 aa, Homo Sapiens
TTRAPCVHV

SEQ ID NO: 975950 - protein, 9 aa, Homo Sapiens
KIRDRYGGI

SEQ ID NO: 975951 - protein, 9 aa, Homo Sapiens
EDLNTVLED

SEQ ID NO: 975952 - protein, 9 aa, Homo Sapiens
LPEGTLGHF

SEQ ID NO: 975953 - protein, 9 aa, Homo Sapiens
AVKPPPERG

SEQ ID NO: 975954 - protein, 9 aa, Homo Sapiens
QKFPEADVA

SEQ ID NO: 975955 - protein, 9 aa, Homo Sapiens
KFHIYWEKA

SEQ ID NO: 975956 - protein, 9 aa, Homo Sapiens
KLSGLMSKL

SEQ ID NO: 975957 - protein, 9 aa, Homo Sapiens
YKKDEIGLD

SEQ ID NO: 975958 - protein, 9 aa, Homo Sapiens
TDAADAISP

SEQ ID NO: 975959 - protein, 9 aa, Homo Sapiens
TGSEDIRAH

SEQ ID NO: 975960 - protein, 9 aa, Homo Sapiens
LSWFGIPKP

SEQ ID NO: 975961 - protein, 9 aa, Homo Sapiens
ERMQVLESK

SEQ ID NO: 975962 - protein, 9 aa, Homo Sapiens
QKNSQEVGT

SEQ ID NO: 975963 - protein, 9 aa, Homo Sapiens
LRSRVNTTG

SEQ ID NO: 975964 - protein, 9 aa, Homo Sapiens
HVHIESWSL

SEQ ID NO: 975965 - protein, 9 aa, Homo Sapiens
YHKKTHTGE

SEQ ID NO: 975966 - protein, 9 aa, Homo Sapiens
VNVWQKNLQ

SEQ ID NO: 975967 - protein, 9 aa, Homo Sapiens
WVRDVAWTP

SEQ ID NO: 975968 - protein, 9 aa, Homo Sapiens
GFQPMLSIT

SEQ ID NO: 975969 - protein, 9 aa, Homo Sapiens
TEKGLPTNV

SEQ ID NO: 975970 - protein, 9 aa, Homo Sapiens
LKEFEHHLL

SEQ ID NO: 975971 - protein, 9 aa, Homo Sapiens
TRKLYDQIM

SEQ ID NO: 975972 - protein, 9 aa, Homo Sapiens
LGSIPGMGK

SEQ ID NO: 975973 - protein, 9 aa, Homo Sapiens
IGFYFGVGD

SEQ ID NO: 975974 - protein, 9 aa, Homo Sapiens
AGKEEYSAM

SEQ ID NO: 975975 - protein, 9 aa, Homo Sapiens
KKEETISSS

SEQ ID NO: 975976 - protein, 9 aa, Homo Sapiens
QRRRCVENA

SEQ ID NO: 975977 - protein, 9 aa, Homo Sapiens
LPTRGHSIA

SEQ ID NO: 975978 - protein, 9 aa, Homo Sapiens
TTFVGLPQN

SEQ ID NO: 975979 - protein, 9 aa, Homo Sapiens
DEVIIEQLV

SEQ ID NO: 975980 - protein, 9 aa, Homo Sapiens
FSCGESSYD

SEQ ID NO: 975981 - protein, 9 aa, Homo Sapiens
QQAIEKHKE

SEQ ID NO: 975982 - protein, 9 aa, Homo Sapiens
LKYHLERQD

SEQ ID NO: 975983 - protein, 9 aa, Homo Sapiens
NEKPAETVS

SEQ ID NO: 975984 - protein, 9 aa, Homo Sapiens
MTKSDSLPF

SEQ ID NO: 975985 - protein, 9 aa, Homo Sapiens
RDEAQGPVA

SEQ ID NO: 975986 - protein, 9 aa, Homo Sapiens
NDFCIWCEL

SEQ ID NO: 975987 - protein, 9 aa, Homo Sapiens
DFWEKLGSC

SEQ ID NO: 975988 - protein, 9 aa, Homo Sapiens
EFERATQET

SEQ ID NO: 975989 - protein, 9 aa, Homo Sapiens
IDMPELFSS

SEQ ID NO: 975990 - protein, 9 aa, Homo Sapiens
SEAESTKSV

SEQ ID NO: 975991 - protein, 9 aa, Homo Sapiens
RRKMRECDG

SEQ ID NO: 975992 - protein, 9 aa, Homo Sapiens
TKNMFCAGY

SEQ ID NO: 975993 - protein, 9 aa, Homo Sapiens
HPGYISPSH

SEQ ID NO: 975994 - protein, 9 aa, Homo Sapiens
KAFIYSSLL

SEQ ID NO: 975995 - protein, 9 aa, Homo Sapiens
TLCLTWDQM

SEQ ID NO: 975996 - protein, 9 aa, Homo Sapiens
ALQVQLAIS

SEQ ID NO: 975997 - protein, 9 aa, Homo Sapiens
DSKTKCTAL

SEQ ID NO: 975998 - protein, 9 aa, Homo Sapiens
GAFAAEPTS

SEQ ID NO: 975999 - protein, 9 aa, Homo Sapiens
SVKKFLEEA

SEQ ID NO: 976000 - protein, 9 aa, Homo Sapiens
TSPCDPTFI

SEQ ID NO: 976001 - protein, 9 aa, Homo Sapiens
PKVTRDQIK

SEQ ID NO: 976002 - protein, 9 aa, Homo Sapiens
IKSRPVLRV

SEQ ID NO: 976003 - protein, 9 aa, Homo Sapiens
PKDDANVRT

SEQ ID NO: 976004 - protein, 9 aa, Homo Sapiens
TMTTIGFGI

SEQ ID NO: 976005 - protein, 9 aa, Homo Sapiens
IKASFMSHL

SEQ ID NO: 976006 - protein, 9 aa, Homo Sapiens
PFFRVSTLP

SEQ ID NO: 976007 - protein, 9 aa, Homo Sapiens
GSSRTRLPP

SEQ ID NO: 976008 - protein, 9 aa, Homo Sapiens
LLELVKALR

SEQ ID NO: 976009 - protein, 9 aa, Homo Sapiens
YVEIKFTLR

SEQ ID NO: 976010 - protein, 9 aa, Homo Sapiens
RIGLLAPSN

SEQ ID NO: 976011 - protein, 9 aa, Homo Sapiens
LLHLAQTER

SEQ ID NO: 976012 - protein, 9 aa, Homo Sapiens
HCLSALIGS

SEQ ID NO: 976013 - protein, 9 aa, Homo Sapiens
DPEEIRMKF

SEQ ID NO: 976014 - protein, 9 aa, Homo Sapiens
VSGNGEFQN

SEQ ID NO: 976015 - protein, 9 aa, Homo Sapiens
IKYSVFYFN

SEQ ID NO: 976016 - protein, 9 aa, Homo Sapiens
AVLSMIRDW

SEQ ID NO: 976017 - protein, 9 aa, Homo Sapiens
ANMEQIEPS

SEQ ID NO: 976018 - protein, 9 aa, Homo Sapiens
LPLFLLVLT

SEQ ID NO: 976019 - protein, 9 aa, Homo Sapiens
ISGEGRKAA

SEQ ID NO: 976020 - protein, 9 aa, Homo Sapiens
ARRKMRECD

SEQ ID NO: 976021 - protein, 9 aa, Homo Sapiens
SRPVLRVTN

SEQ ID NO: 976022 - protein, 9 aa, Homo Sapiens
KFKENTSNS

SEQ ID NO: 976023 - protein, 9 aa, Homo Sapiens
DTLFSSSKK

SEQ ID NO: 976024 - protein, 9 aa, Homo Sapiens
NYRNLVYLG

SEQ ID NO: 976025 - protein, 9 aa, Homo Sapiens
RRDCVPLMP

SEQ ID NO: 976026 - protein, 9 aa, Homo Sapiens
KQVEYVFLV

SEQ ID NO: 976027 - protein, 9 aa, Homo Sapiens
FAAKAKEQE

SEQ ID NO: 976028 - protein, 9 aa, Homo Sapiens
DPAWDEINL

SEQ ID NO: 976029 - protein, 9 aa, Homo Sapiens
QPQVSYKEG

SEQ ID NO: 976030 - protein, 9 aa, Homo Sapiens
CLLSFPFAR

SEQ ID NO: 976031 - protein, 9 aa, Homo Sapiens
WNIIYTDTL

SEQ ID NO: 976032 - protein, 9 aa, Homo Sapiens
KKERPQDPL

SEQ ID NO: 976033 - protein, 9 aa, Homo Sapiens
EKTRLENQS

SEQ ID NO: 976034 - protein, 9 aa, Homo Sapiens
KTSDPERGQ

SEQ ID NO: 976035 - protein, 9 aa, Homo Sapiens
YKFRIQVRL

SEQ ID NO: 976036 - protein, 9 aa, Homo Sapiens
WLEFFFTSI

SEQ ID NO: 976037 - protein, 9 aa, Homo Sapiens
QKWLAMLIQ

SEQ ID NO: 976038 - protein, 9 aa, Homo Sapiens
LEPGRPVSA

SEQ ID NO: 976039 - protein, 9 aa, Homo Sapiens
TRPKSSGMP

SEQ ID NO: 976040 - protein, 9 aa, Homo Sapiens
DGSFSSRHT

SEQ ID NO: 976041 - protein, 9 aa, Homo Sapiens
NWDMLMEPP

SEQ ID NO: 976042 - protein, 9 aa, Homo Sapiens
VETEDFSVE

SEQ ID NO: 976043 - protein, 9 aa, Homo Sapiens
KEFEHHLLS

SEQ ID NO: 976044 - protein, 9 aa, Homo Sapiens
TCWEWQKAH

SEQ ID NO: 976045 - protein, 9 aa, Homo Sapiens
EICYVLVKL

SEQ ID NO: 976046 - protein, 9 aa, Homo Sapiens
GDVTIAPPE

SEQ ID NO: 976047 - protein, 9 aa, Homo Sapiens
RVMKHPLGL

SEQ ID NO: 976048 - protein, 9 aa, Homo Sapiens
RLKEHYEKN

SEQ ID NO: 976049 - protein, 9 aa, Homo Sapiens
RNNMTTHVF

SEQ ID NO: 976050 - protein, 9 aa, Homo Sapiens
LAPPGAVKR

SEQ ID NO: 976051 - protein, 9 aa, Homo Sapiens
GSGPAAAPS

SEQ ID NO: 976052 - protein, 9 aa, Homo Sapiens
ETDSESEFL

SEQ ID NO: 976053 - protein, 9 aa, Homo Sapiens
KCHNKCTKD

SEQ ID NO: 976054 - protein, 9 aa, Homo Sapiens
TPNAKGKNW

SEQ ID NO: 976055 - protein, 9 aa, Homo Sapiens
NDVLCNYHL

SEQ ID NO: 976056 - protein, 9 aa, Homo Sapiens
STFFSRRIL

SEQ ID NO: 976057 - protein, 9 aa, Homo Sapiens
YKCNEYCKA

SEQ ID NO: 976058 - protein, 9 aa, Homo Sapiens
QKSVGPASL

SEQ ID NO: 976059 - protein, 9 aa, Homo Sapiens
APMNWDMLM

SEQ ID NO: 976060 - protein, 9 aa, Homo Sapiens
EYMVFGSLL

SEQ ID NO: 976061 - protein, 9 aa, Homo Sapiens
FIYSCVLGL

SEQ ID NO: 976062 - protein, 9 aa, Homo Sapiens
LNDPVCPPR

SEQ ID NO: 976063 - protein, 9 aa, Homo Sapiens
NCTRGIRKD

SEQ ID NO: 976064 - protein, 9 aa, Homo Sapiens
APNSSTLMA

SEQ ID NO: 976065 - protein, 9 aa, Homo Sapiens
MLKHCGNGV

SEQ ID NO: 976066 - protein, 9 aa, Homo Sapiens
SLTGKGTQL

SEQ ID NO: 976067 - protein, 9 aa, Homo Sapiens
HETSHTGEK

SEQ ID NO: 976068 - protein, 9 aa, Homo Sapiens
GLEQRFLRT

SEQ ID NO: 976069 - protein, 9 aa, Homo Sapiens
VDLEPGTMN

SEQ ID NO: 976070 - protein, 9 aa, Homo Sapiens
PHAFSNQMD

SEQ ID NO: 976071 - protein, 9 aa, Homo Sapiens
CDANLHSKF

SEQ ID NO: 976072 - protein, 9 aa, Homo Sapiens
TPALPFPGP

SEQ ID NO: 976073 - protein, 9 aa, Homo Sapiens
HVECRPYSI

SEQ ID NO: 976074 - protein, 9 aa, Homo Sapiens
EENPNEELS

SEQ ID NO: 976075 - protein, 9 aa, Homo Sapiens
EPASIGYNI

SEQ ID NO: 976076 - protein, 9 aa, Homo Sapiens
ALTSDLEKQ

SEQ ID NO: 976077 - protein, 9 aa, Homo Sapiens
TDEEMKSGD

SEQ ID NO: 976078 - protein, 9 aa, Homo Sapiens
SIEMHLTES

SEQ ID NO: 976079 - protein, 9 aa, Homo Sapiens
QFRPGYNGK

SEQ ID NO: 976080 - protein, 9 aa, Homo Sapiens
RLQPGLGDA

SEQ ID NO: 976081 - protein, 9 aa, Homo Sapiens
YYQLSSSFL

SEQ ID NO: 976082 - protein, 9 aa, Homo Sapiens
EAVQGMMAK

SEQ ID NO: 976083 - protein, 9 aa, Homo Sapiens
VPLDGGVRL

SEQ ID NO: 976084 - protein, 9 aa, Homo Sapiens
TSIEMHLTE

SEQ ID NO: 976085 - protein, 9 aa, Homo Sapiens
SVFATNNKL

SEQ ID NO: 976086 - protein, 9 aa, Homo Sapiens
VWPFSAICN

SEQ ID NO: 976087 - protein, 9 aa, Homo Sapiens
SKGRQHLEE

SEQ ID NO: 976088 - protein, 9 aa, Homo Sapiens
EFFFTSIFS

SEQ ID NO: 976089 - protein, 9 aa, Homo Sapiens
AAPPPKREA

SEQ ID NO: 976090 - protein, 9 aa, Homo Sapiens
PAEQGPSGA

SEQ ID NO: 976091 - protein, 9 aa, Homo Sapiens
KFPSGNYPL

SEQ ID NO: 976092 - protein, 9 aa, Homo Sapiens
GNYSVTKNM

SEQ ID NO: 976093 - protein, 9 aa, Homo Sapiens
YKCDAVVCT

SEQ ID NO: 976094 - protein, 9 aa, Homo Sapiens
SGEENTKNG

SEQ ID NO: 976095 - protein, 9 aa, Homo Sapiens
MKQKGGCPR

SEQ ID NO: 976096 - protein, 9 aa, Homo Sapiens
QKKIAALAP

SEQ ID NO: 976097 - protein, 9 aa, Homo Sapiens
GATTGGPRR

SEQ ID NO: 976098 - protein, 9 aa, Homo Sapiens
REHLASMIY

SEQ ID NO: 976099 - protein, 9 aa, Homo Sapiens
YFMAETLVG

SEQ ID NO: 976100 - protein, 9 aa, Homo Sapiens
LQHAALMAP

SEQ ID NO: 976101 - protein, 9 aa, Homo Sapiens
INESDGSTS

SEQ ID NO: 976102 - protein, 9 aa, Homo Sapiens
EHAPFPSDV

SEQ ID NO: 976103 - protein, 9 aa, Homo Sapiens
LIRNMNYRE

SEQ ID NO: 976104 - protein, 9 aa, Homo Sapiens
SSLDDSKRS

SEQ ID NO: 976105 - protein, 9 aa, Homo Sapiens
YSAYYGKIP

SEQ ID NO: 976106 - protein, 9 aa, Homo Sapiens
LAEMLLQAD

SEQ ID NO: 976107 - protein, 9 aa, Homo Sapiens
YISPSHAWS

SEQ ID NO: 976108 - protein, 9 aa, Homo Sapiens
SSCEVHERI

SEQ ID NO: 976109 - protein, 9 aa, Homo Sapiens
SKCRRTSEA

SEQ ID NO: 976110 - protein, 9 aa, Homo Sapiens
CVSQIFFVI

SEQ ID NO: 976111 - protein, 9 aa, Homo Sapiens
EQRVIFVMF

SEQ ID NO: 976112 - protein, 9 aa, Homo Sapiens
AFALGQKFG

SEQ ID NO: 976113 - protein, 9 aa, Homo Sapiens
KEKSVSCPR

SEQ ID NO: 976114 - protein, 9 aa, Homo Sapiens
KFMLCAGRR

SEQ ID NO: 976115 - protein, 9 aa, Homo Sapiens
SNNIEGINR

SEQ ID NO: 976116 - protein, 9 aa, Homo Sapiens
QARLTRFYG

SEQ ID NO: 976117 - protein, 9 aa, Homo Sapiens
QDPPLVSSS

SEQ ID NO: 976118 - protein, 9 aa, Homo Sapiens
QGPSCSFPH

SEQ ID NO: 976119 - protein, 9 aa, Homo Sapiens
FFAIFSIDY

SEQ ID NO: 976120 - protein, 9 aa, Homo Sapiens
FMFFLNLFV

SEQ ID NO: 976121 - protein, 9 aa, Homo Sapiens
MTSLENDKI

SEQ ID NO: 976122 - protein, 9 aa, Homo Sapiens
MDDLMLSPN

SEQ ID NO: 976123 - protein, 9 aa, Homo Sapiens
RVCSYTCLS

SEQ ID NO: 976124 - protein, 9 aa, Homo Sapiens
LLSFPFARG

SEQ ID NO: 976125 - protein, 9 aa, Homo Sapiens
FGTELSKKD

SEQ ID NO: 976126 - protein, 9 aa, Homo Sapiens
AGTFLNDPV

SEQ ID NO: 976127 - protein, 9 aa, Homo Sapiens
DGEGLNMFD

SEQ ID NO: 976128 - protein, 9 aa, Homo Sapiens
SGLSSSRTR

SEQ ID NO: 976129 - protein, 9 aa, Homo Sapiens
VIILRRNEK

SEQ ID NO: 976130 - protein, 9 aa, Homo Sapiens
EDSVVGESD

SEQ ID NO: 976131 - protein, 9 aa, Homo Sapiens
RVSFSAARS

SEQ ID NO: 976132 - protein, 9 aa, Homo Sapiens
GTLGHFKRR

SEQ ID NO: 976133 - protein, 9 aa, Homo Sapiens
RMQVLESKG

SEQ ID NO: 976134 - protein, 9 aa, Homo Sapiens
ETISSSLNK

SEQ ID NO: 976135 - protein, 9 aa, Homo Sapiens
YTDTLRTIF

SEQ ID NO: 976136 - protein, 9 aa, Homo Sapiens
CQLTIPFSV

SEQ ID NO: 976137 - protein, 9 aa, Homo Sapiens
AKRKFLELA

SEQ ID NO: 976138 - protein, 9 aa, Homo Sapiens
MFFNPDLYL

SEQ ID NO: 976139 - protein, 9 aa, Homo Sapiens
GSRDNKKTR

SEQ ID NO: 976140 - protein, 9 aa, Homo Sapiens
LGVERRNWV

SEQ ID NO: 976141 - protein, 9 aa, Homo Sapiens
VAQGLAGEL

SEQ ID NO: 976142 - protein, 9 aa, Homo Sapiens
KKMNNFYVE

SEQ ID NO: 976143 - protein, 9 aa, Homo Sapiens
EKDFCLMDR

SEQ ID NO: 976144 - protein, 9 aa, Homo Sapiens
SEFIDSLMN

SEQ ID NO: 976145 - protein, 9 aa, Homo Sapiens
SRSVSRSPM

SEQ ID NO: 976146 - protein, 9 aa, Homo Sapiens
AGSVAEMSF

SEQ ID NO: 976147 - protein, 9 aa, Homo Sapiens
RANADAPAG

SEQ ID NO: 976148 - protein, 9 aa, Homo Sapiens
NLFVPGIHL

SEQ ID NO: 976149 - protein, 9 aa, Homo Sapiens
GELLLFVGR

SEQ ID NO: 976150 - protein, 9 aa, Homo Sapiens
SPSRRFGLC

SEQ ID NO: 976151 - protein, 9 aa, Homo Sapiens
IFLKHGYIP

SEQ ID NO: 976152 - protein, 9 aa, Homo Sapiens
FTFAASATC

SEQ ID NO: 976153 - protein, 9 aa, Homo Sapiens
ELKKVNKKI

SEQ ID NO: 976154 - protein, 9 aa, Homo Sapiens
PFNEKPAET

SEQ ID NO: 976155 - protein, 9 aa, Homo Sapiens
LLKSGAKCD

SEQ ID NO: 976156 - protein, 9 aa, Homo Sapiens
GKSQSKKLQ

SEQ ID NO: 976157 - protein, 9 aa, Homo Sapiens
RGQSKERKH

SEQ ID NO: 976158 - protein, 9 aa, Homo Sapiens
AATLAGSRT

SEQ ID NO: 976159 - protein, 9 aa, Homo Sapiens
ICKKEFELR

SEQ ID NO: 976160 - protein, 9 aa, Homo Sapiens
GWKISFIPK

SEQ ID NO: 976161 - protein, 9 aa, Homo Sapiens
HGSVSDSVF

SEQ ID NO: 976162 - protein, 9 aa, Homo Sapiens
CDQKWLAML

SEQ ID NO: 976163 - protein, 9 aa, Homo Sapiens
IHSEIKPFQ

SEQ ID NO: 976164 - protein, 9 aa, Homo Sapiens
QLSRMGSIQ

SEQ ID NO: 976165 - protein, 9 aa, Homo Sapiens
IKAPIKDLD

SEQ ID NO: 976166 - protein, 9 aa, Homo Sapiens
HQITKEREE

SEQ ID NO: 976167 - protein, 9 aa, Homo Sapiens
QKLTEHTPP

SEQ ID NO: 976168 - protein, 9 aa, Homo Sapiens
FERATQETT

SEQ ID NO: 976169 - protein, 9 aa, Homo Sapiens
PLPSMPVSV

SEQ ID NO: 976170 - protein, 9 aa, Homo Sapiens
KATSLDAWE

SEQ ID NO: 976171 - protein, 9 aa, Homo Sapiens
REKKEESYS

SEQ ID NO: 976172 - protein, 9 aa, Homo Sapiens
TQETTNKKI

SEQ ID NO: 976173 - protein, 9 aa, Homo Sapiens
GLVVNSGDA

SEQ ID NO: 976174 - protein, 9 aa, Homo Sapiens
GELMDQEDS

SEQ ID NO: 976175 - protein, 9 aa, Homo Sapiens
FTTESFTRE

SEQ ID NO: 976176 - protein, 9 aa, Homo Sapiens
LDISRIKRE

SEQ ID NO: 976177 - protein, 9 aa, Homo Sapiens
CLSQSEQTT

SEQ ID NO: 976178 - protein, 9 aa, Homo Sapiens
DNVTFEEGT

SEQ ID NO: 976179 - protein, 9 aa, Homo Sapiens
KNFTVDEVA

SEQ ID NO: 976180 - protein, 9 aa, Homo Sapiens
HKFDGDEQF

SEQ ID NO: 976181 - protein, 9 aa, Homo Sapiens
TFQRDFFFL

SEQ ID NO: 976182 - protein, 9 aa, Homo Sapiens
DKKILETEI

SEQ ID NO: 976183 - protein, 9 aa, Homo Sapiens
TCGTHFIVV

SEQ ID NO: 976184 - protein, 9 aa, Homo Sapiens
IRGHVLSFA

SEQ ID NO: 976185 - protein, 9 aa, Homo Sapiens
IFYYGCALQ

SEQ ID NO: 976186 - protein, 9 aa, Homo Sapiens
VGHHQFLGD

SEQ ID NO: 976187 - protein, 9 aa, Homo Sapiens
LGRSRQLTE

SEQ ID NO: 976188 - protein, 9 aa, Homo Sapiens
SIAGRTAGR

SEQ ID NO: 976189 - protein, 9 aa, Homo Sapiens
ATESGHLPR

SEQ ID NO: 976190 - protein, 9 aa, Homo Sapiens
ATKDSSRVG

SEQ ID NO: 976191 - protein, 9 aa, Homo Sapiens
SPSTFHYEV

SEQ ID NO: 976192 - protein, 9 aa, Homo Sapiens
DALDADTAI

SEQ ID NO: 976193 - protein, 9 aa, Homo Sapiens
QPPGAASGP

SEQ ID NO: 976194 - protein, 9 aa, Homo Sapiens
PPVPPSSFL

SEQ ID NO: 976195 - protein, 9 aa, Homo Sapiens
EQVSLSENL

SEQ ID NO: 976196 - protein, 9 aa, Homo Sapiens
GESTETGNA

SEQ ID NO: 976197 - protein, 9 aa, Homo Sapiens
FMLKHCGNG

SEQ ID NO: 976198 - protein, 9 aa, Homo Sapiens
VILPIIIYA

SEQ ID NO: 976199 - protein, 9 aa, Homo Sapiens
KLLYVRKDG

SEQ ID NO: 976200 - protein, 9 aa, Homo Sapiens
FREKHDNCT

SEQ ID NO: 976201 - protein, 9 aa, Homo Sapiens
NDNAKLTAD

SEQ ID NO: 976202 - protein, 9 aa, Homo Sapiens
SSSRTRTSS

SEQ ID NO: 976203 - protein, 9 aa, Homo Sapiens
GQEEEEDNL

SEQ ID NO: 976204 - protein, 9 aa, Homo Sapiens
LEVELQVAS

SEQ ID NO: 976205 - protein, 9 aa, Homo Sapiens
KQVQIKKEK

SEQ ID NO: 976206 - protein, 9 aa, Homo Sapiens
TFRPEAPSG

SEQ ID NO: 976207 - protein, 9 aa, Homo Sapiens
QETSFTKKA

SEQ ID NO: 976208 - protein, 9 aa, Homo Sapiens
RRTGGKSTC

SEQ ID NO: 976209 - protein, 9 aa, Homo Sapiens
FFFTSIFSA

SEQ ID NO: 976210 - protein, 9 aa, Homo Sapiens
AQARLTRFY

SEQ ID NO: 976211 - protein, 9 aa, Homo Sapiens
EWGPFNLVY

SEQ ID NO: 976212 - protein, 9 aa, Homo Sapiens
KPPPERGVR

SEQ ID NO: 976213 - protein, 9 aa, Homo Sapiens
WVLAALLTM

SEQ ID NO: 976214 - protein, 9 aa, Homo Sapiens
RKVFSHHAY

SEQ ID NO: 976215 - protein, 9 aa, Homo Sapiens
GTGNKKAIN

SEQ ID NO: 976216 - protein, 9 aa, Homo Sapiens
PHSHVEKDT

SEQ ID NO: 976217 - protein, 9 aa, Homo Sapiens
NWVLAGLYM

SEQ ID NO: 976218 - protein, 9 aa, Homo Sapiens
EEARRKMRE

SEQ ID NO: 976219 - protein, 9 aa, Homo Sapiens
LWDTFHVLV

SEQ ID NO: 976220 - protein, 9 aa, Homo Sapiens
TMPNGKVFK

SEQ ID NO: 976221 - protein, 9 aa, Homo Sapiens
PTWVSSSAT

SEQ ID NO: 976222 - protein, 9 aa, Homo Sapiens
EPVLSFQGS

SEQ ID NO: 976223 - protein, 9 aa, Homo Sapiens
RHTHPGYIS

SEQ ID NO: 976224 - protein, 9 aa, Homo Sapiens
HPFTGLIYT

SEQ ID NO: 976225 - protein, 9 aa, Homo Sapiens
SPPMLTEEN

SEQ ID NO: 976226 - protein, 9 aa, Homo Sapiens
FKCQAKYGA

SEQ ID NO: 976227 - protein, 9 aa, Homo Sapiens
VSLEPLLPL

SEQ ID NO: 976228 - protein, 9 aa, Homo Sapiens
QCAYTFILS

SEQ ID NO: 976229 - protein, 9 aa, Homo Sapiens
SYVLLTRKL

SEQ ID NO: 976230 - protein, 9 aa, Homo Sapiens
EHVVILPNK

SEQ ID NO: 976231 - protein, 9 aa, Homo Sapiens
PKHPNSLTG

SEQ ID NO: 976232 - protein, 9 aa, Homo Sapiens
KLEKDPVTK

SEQ ID NO: 976233 - protein, 9 aa, Homo Sapiens
NTCIPSYNT

SEQ ID NO: 976234 - protein, 9 aa, Homo Sapiens
IRDWLRVIS

SEQ ID NO: 976235 - protein, 9 aa, Homo Sapiens
SHSYQLTLP

SEQ ID NO: 976236 - protein, 9 aa, Homo Sapiens
SSREDMRLL

SEQ ID NO: 976237 - protein, 9 aa, Homo Sapiens
RAHCFLSAG

SEQ ID NO: 976238 - protein, 9 aa, Homo Sapiens
PQRFLDQWA

SEQ ID NO: 976239 - protein, 9 aa, Homo Sapiens
DPRTPWLLV

SEQ ID NO: 976240 - protein, 9 aa, Homo Sapiens
AGELLLFVG

SEQ ID NO: 976241 - protein, 9 aa, Homo Sapiens
FFRNEIDLQ

SEQ ID NO: 976242 - protein, 9 aa, Homo Sapiens
GKTFFVNSA

SEQ ID NO: 976243 - protein, 9 aa, Homo Sapiens
NNLLVMRTD

SEQ ID NO: 976244 - protein, 9 aa, Homo Sapiens
KREARAQEP

SEQ ID NO: 976245 - protein, 9 aa, Homo Sapiens
VVGLGSIPG

SEQ ID NO: 976246 - protein, 9 aa, Homo Sapiens
AWDLEQTMT

SEQ ID NO: 976247 - protein, 9 aa, Homo Sapiens
GSPHICDLR

SEQ ID NO: 976248 - protein, 9 aa, Homo Sapiens
YQEKIPIAG

SEQ ID NO: 976249 - protein, 9 aa, Homo Sapiens
LQRTQESLA

SEQ ID NO: 976250 - protein, 9 aa, Homo Sapiens
HDEPVNWAA

SEQ ID NO: 976251 - protein, 9 aa, Homo Sapiens
YQCIFCLEI

SEQ ID NO: 976252 - protein, 9 aa, Homo Sapiens
YEESLDQLK

SEQ ID NO: 976253 - protein, 9 aa, Homo Sapiens
VCGVVSRRV

SEQ ID NO: 976254 - protein, 9 aa, Homo Sapiens
KLGWQMPPA

SEQ ID NO: 976255 - protein, 9 aa, Homo Sapiens
LFLIHPFTG

SEQ ID NO: 976256 - protein, 9 aa, Homo Sapiens
GNQISLLNI

SEQ ID NO: 976257 - protein, 9 aa, Homo Sapiens
SFTTDTALL

SEQ ID NO: 976258 - protein, 9 aa, Homo Sapiens
IILRRNEKD

SEQ ID NO: 976259 - protein, 9 aa, Homo Sapiens
TITDEEMKS

SEQ ID NO: 976260 - protein, 9 aa, Homo Sapiens
AYSLPQSSI

SEQ ID NO: 976261 - protein, 9 aa, Homo Sapiens
PAGSAQPVA

SEQ ID NO: 976262 - protein, 9 aa, Homo Sapiens
SLTGHKEHT

SEQ ID NO: 976263 - protein, 9 aa, Homo Sapiens
KQDKKILET

SEQ ID NO: 976264 - protein, 9 aa, Homo Sapiens
IGPTETLSW

SEQ ID NO: 976265 - protein, 9 aa, Homo Sapiens
RGEGSSGGA

SEQ ID NO: 976266 - protein, 9 aa, Homo Sapiens
RDLEAFLVQ

SEQ ID NO: 976267 - protein, 9 aa, Homo Sapiens
GSPLLWATA

SEQ ID NO: 976268 - protein, 9 aa, Homo Sapiens
QDMIESLFY

SEQ ID NO: 976269 - protein, 9 aa, Homo Sapiens
CWNGVKEKH

SEQ ID NO: 976270 - protein, 9 aa, Homo Sapiens
TPMSHPLPP

SEQ ID NO: 976271 - protein, 9 aa, Homo Sapiens
KQKLTEHTP

SEQ ID NO: 976272 - protein, 9 aa, Homo Sapiens
TCEKLDKLN

SEQ ID NO: 976273 - protein, 9 aa, Homo Sapiens
LFIFGYCWL

SEQ ID NO: 976274 - protein, 9 aa, Homo Sapiens
QLEKTEQGF

SEQ ID NO: 976275 - protein, 9 aa, Homo Sapiens
AGFLIALIP

SEQ ID NO: 976276 - protein, 9 aa, Homo Sapiens
HRGLVHPGH

SEQ ID NO: 976277 - protein, 9 aa, Homo Sapiens
DLGLIRMIE

SEQ ID NO: 976278 - protein, 9 aa, Homo Sapiens
EQTMTKLTR

SEQ ID NO: 976279 - protein, 9 aa, Homo Sapiens
AIAKYNAPC

SEQ ID NO: 976280 - protein, 9 aa, Homo Sapiens
VMKRENILE

SEQ ID NO: 976281 - protein, 9 aa, Homo Sapiens
QASSTRRDS

SEQ ID NO: 976282 - protein, 9 aa, Homo Sapiens
ETEDFSVEN

SEQ ID NO: 976283 - protein, 9 aa, Homo Sapiens
DKCKEKRYN

SEQ ID NO: 976284 - protein, 9 aa, Homo Sapiens
CFIAFASDR

SEQ ID NO: 976285 - protein, 9 aa, Homo Sapiens
VKSQDVAVF

SEQ ID NO: 976286 - protein, 9 aa, Homo Sapiens
SFMSHLQSL

SEQ ID NO: 976287 - protein, 9 aa, Homo Sapiens
QQRIRELKD

SEQ ID NO: 976288 - protein, 9 aa, Homo Sapiens
STLERGQMG

SEQ ID NO: 976289 - protein, 9 aa, Homo Sapiens
TLHDEPVNW

SEQ ID NO: 976290 - protein, 9 aa, Homo Sapiens
EWQKAHEPG

SEQ ID NO: 976291 - protein, 9 aa, Homo Sapiens
LEFFAVVMR

SEQ ID NO: 976292 - protein, 9 aa, Homo Sapiens
ENYRRFAAT

SEQ ID NO: 976293 - protein, 9 aa, Homo Sapiens
FSPILYMLS

SEQ ID NO: 976294 - protein, 9 aa, Homo Sapiens
NESDGSTSI

SEQ ID NO: 976295 - protein, 9 aa, Homo Sapiens
WEDAVHIIS

SEQ ID NO: 976296 - protein, 9 aa, Homo Sapiens
YDADGFHQS

SEQ ID NO: 976297 - protein, 9 aa, Homo Sapiens
FLTISREHE

SEQ ID NO: 976298 - protein, 9 aa, Homo Sapiens
TPPHELTEE

SEQ ID NO: 976299 - protein, 9 aa, Homo Sapiens
KLFGKEQSF

SEQ ID NO: 976300 - protein, 9 aa, Homo Sapiens
VLGLISCSV

SEQ ID NO: 976301 - protein, 9 aa, Homo Sapiens
MGWASTADS

SEQ ID NO: 976302 - protein, 9 aa, Homo Sapiens
LLSPAPMNW

SEQ ID NO: 976303 - protein, 9 aa, Homo Sapiens
PLMPKLLYV

SEQ ID NO: 976304 - protein, 9 aa, Homo Sapiens
KEDLGLPGS

SEQ ID NO: 976305 - protein, 9 aa, Homo Sapiens
CLTWDQMLV

SEQ ID NO: 976306 - protein, 9 aa, Homo Sapiens
DVFLRFLFG

SEQ ID NO: 976307 - protein, 9 aa, Homo Sapiens
ASLSWFREE

SEQ ID NO: 976308 - protein, 9 aa, Homo Sapiens
KKEKDQLQG

SEQ ID NO: 976309 - protein, 9 aa, Homo Sapiens
RKQASSTRR

SEQ ID NO: 976310 - protein, 9 aa, Homo Sapiens
LGLNDKKDL

SEQ ID NO: 976311 - protein, 9 aa, Homo Sapiens
KEESYSNDQ

SEQ ID NO: 976312 - protein, 9 aa, Homo Sapiens
DLVFGGDVP

SEQ ID NO: 976313 - protein, 9 aa, Homo Sapiens
QNRRANCRK

SEQ ID NO: 976314 - protein, 9 aa, Homo Sapiens
EIFMLKHCG

SEQ ID NO: 976315 - protein, 9 aa, Homo Sapiens
KLIRIGCFL

SEQ ID NO: 976316 - protein, 9 aa, Homo Sapiens
QSESIWAKY

SEQ ID NO: 976317 - protein, 9 aa, Homo Sapiens
YADTLFSEE

SEQ ID NO: 976318 - protein, 9 aa, Homo Sapiens
EFLLNTYCT

SEQ ID NO: 976319 - protein, 9 aa, Homo Sapiens
RDRFWDPGT

SEQ ID NO: 976320 - protein, 9 aa, Homo Sapiens
IFCLEIFMT

SEQ ID NO: 976321 - protein, 9 aa, Homo Sapiens
SESQHLNGQ

SEQ ID NO: 976322 - protein, 9 aa, Homo Sapiens
LEETLKVMK

SEQ ID NO: 976323 - protein, 9 aa, Homo Sapiens
TWTALLGRS

SEQ ID NO: 976324 - protein, 9 aa, Homo Sapiens
KMKDTSCKN

SEQ ID NO: 976325 - protein, 9 aa, Homo Sapiens
GGGGGRRAR

SEQ ID NO: 976326 - protein, 9 aa, Homo Sapiens
SLDQLKTLR

SEQ ID NO: 976327 - protein, 9 aa, Homo Sapiens
NSTKSGAGV

SEQ ID NO: 976328 - protein, 9 aa, Homo Sapiens
HVFCQQPLS

SEQ ID NO: 976329 - protein, 9 aa, Homo Sapiens
VSPVAGAPS

SEQ ID NO: 976330 - protein, 9 aa, Homo Sapiens
GSPTKAKKD

SEQ ID NO: 976331 - protein, 9 aa, Homo Sapiens
FLDDIRQIC

SEQ ID NO: 976332 - protein, 9 aa, Homo Sapiens
HSNGTVVPD

SEQ ID NO: 976333 - protein, 9 aa, Homo Sapiens
YLTPTQVKI

SEQ ID NO: 976334 - protein, 9 aa, Homo Sapiens
SFNITSVQR

SEQ ID NO: 976335 - protein, 9 aa, Homo Sapiens
RWCTTRAPC

SEQ ID NO: 976336 - protein, 9 aa, Homo Sapiens
NFGASDSSR

SEQ ID NO: 976337 - protein, 9 aa, Homo Sapiens
HLHTLATAA

SEQ ID NO: 976338 - protein, 9 aa, Homo Sapiens
VKNPTVLEL

SEQ ID NO: 976339 - protein, 9 aa, Homo Sapiens
CKIRDRYGG

SEQ ID NO: 976340 - protein, 9 aa, Homo Sapiens
TYHKKTHTG

SEQ ID NO: 976341 - protein, 9 aa, Homo Sapiens
LFETVRFPL

SEQ ID NO: 976342 - protein, 9 aa, Homo Sapiens
NNSFSNLAP

SEQ ID NO: 976343 - protein, 9 aa, Homo Sapiens
LRQSVEVDI

SEQ ID NO: 976344 - protein, 9 aa, Homo Sapiens
HCGNGVVER

SEQ ID NO: 976345 - protein, 9 aa, Homo Sapiens
SLHGGNLVV

SEQ ID NO: 976346 - protein, 9 aa, Homo Sapiens
DITTTFPKN

SEQ ID NO: 976347 - protein, 9 aa, Homo Sapiens
RTLMDIYVH

SEQ ID NO: 976348 - protein, 9 aa, Homo Sapiens
FKNSKVSVV

SEQ ID NO: 976349 - protein, 9 aa, Homo Sapiens
TTIYLPGPD

SEQ ID NO: 976350 - protein, 9 aa, Homo Sapiens
RSQAYIFYY

SEQ ID NO: 976351 - protein, 9 aa, Homo Sapiens
FSAHLVIHT

SEQ ID NO: 976352 - protein, 9 aa, Homo Sapiens
KNCGCKERD

SEQ ID NO: 976353 - protein, 9 aa, Homo Sapiens
LNDMVQSND

SEQ ID NO: 976354 - protein, 9 aa, Homo Sapiens
FSFSFDGWK

SEQ ID NO: 976355 - protein, 9 aa, Homo Sapiens
RDFEPDAIG

SEQ ID NO: 976356 - protein, 9 aa, Homo Sapiens
SQVTKDSGV

SEQ ID NO: 976357 - protein, 9 aa, Homo Sapiens
GCGPAEKRV

SEQ ID NO: 976358 - protein, 9 aa, Homo Sapiens
QVFLLASIM

SEQ ID NO: 976359 - protein, 9 aa, Homo Sapiens
DTRKKAEPT

SEQ ID NO: 976360 - protein, 9 aa, Homo Sapiens
RSISYSRCM

SEQ ID NO: 976361 - protein, 9 aa, Homo Sapiens
ATLAGSRTQ

SEQ ID NO: 976362 - protein, 9 aa, Homo Sapiens
SLFPNGHAQ

SEQ ID NO: 976363 - protein, 9 aa, Homo Sapiens
VHCLSALIG

SEQ ID NO: 976364 - protein, 9 aa, Homo Sapiens
HVLVFTLVD

SEQ ID NO: 976365 - protein, 9 aa, Homo Sapiens
SEYFMAETL

SEQ ID NO: 976366 - protein, 9 aa, Homo Sapiens
TTRPTRPKS

SEQ ID NO: 976367 - protein, 9 aa, Homo Sapiens
ETNLRKTGV

SEQ ID NO: 976368 - protein, 9 aa, Homo Sapiens
NTDSGEQSW

SEQ ID NO: 976369 - protein, 9 aa, Homo Sapiens
TFVILAISP

SEQ ID NO: 976370 - protein, 9 aa, Homo Sapiens
LDDTTQLSL

SEQ ID NO: 976371 - protein, 9 aa, Homo Sapiens
LVGANGSPG

SEQ ID NO: 976372 - protein, 9 aa, Homo Sapiens
LRLAENERM

SEQ ID NO: 976373 - protein, 9 aa, Homo Sapiens
GAASGPPRC

SEQ ID NO: 976374 - protein, 9 aa, Homo Sapiens
CVFFVSHFY

SEQ ID NO: 976375 - protein, 9 aa, Homo Sapiens
KIDSYSLNI

SEQ ID NO: 976376 - protein, 9 aa, Homo Sapiens
ENLRAVGHH

SEQ ID NO: 976377 - protein, 9 aa, Homo Sapiens
KYFYFRPVM

SEQ ID NO: 976378 - protein, 9 aa, Homo Sapiens
RTPWLLVTH

SEQ ID NO: 976379 - protein, 9 aa, Homo Sapiens
PFLQQPMYI

SEQ ID NO: 976380 - protein, 9 aa, Homo Sapiens
VVIANFIEN

SEQ ID NO: 976381 - protein, 9 aa, Homo Sapiens
KSSLQVFHE

SEQ ID NO: 976382 - protein, 9 aa, Homo Sapiens
PKEMSRETT

SEQ ID NO: 976383 - protein, 9 aa, Homo Sapiens
SLGLEQRFL

SEQ ID NO: 976384 - protein, 9 aa, Homo Sapiens
KQKGGCPRG

SEQ ID NO: 976385 - protein, 9 aa, Homo Sapiens
PQVFLLASI

SEQ ID NO: 976386 - protein, 9 aa, Homo Sapiens
KHPRLECGA

SEQ ID NO: 976387 - protein, 9 aa, Homo Sapiens
IAIRNVFFC

SEQ ID NO: 976388 - protein, 9 aa, Homo Sapiens
PIKEESCGS

SEQ ID NO: 976389 - protein, 9 aa, Homo Sapiens
DFEPDAIGG

SEQ ID NO: 976390 - protein, 9 aa, Homo Sapiens
PLLELIRLW

SEQ ID NO: 976391 - protein, 9 aa, Homo Sapiens
SSIATENFS

SEQ ID NO: 976392 - protein, 9 aa, Homo Sapiens
DSLTIPDKF

SEQ ID NO: 976393 - protein, 9 aa, Homo Sapiens
YYGKIPKAP

SEQ ID NO: 976394 - protein, 9 aa, Homo Sapiens
LSYIQIAMA

SEQ ID NO: 976395 - protein, 9 aa, Homo Sapiens
LRDAFTWSM

SEQ ID NO: 976396 - protein, 9 aa, Homo Sapiens
SRVFWEDGI

SEQ ID NO: 976397 - protein, 9 aa, Homo Sapiens
CNEYCKAFN

SEQ ID NO: 976398 - protein, 9 aa, Homo Sapiens
LGLAIFILG

SEQ ID NO: 976399 - protein, 9 aa, Homo Sapiens
VLIDKLLSK

SEQ ID NO: 976400 - protein, 9 aa, Homo Sapiens
AEVCKIIRV

SEQ ID NO: 976401 - protein, 9 aa, Homo Sapiens
TNVSTTVSR

SEQ ID NO: 976402 - protein, 9 aa, Homo Sapiens
IKEKLIFSY

SEQ ID NO: 976403 - protein, 9 aa, Homo Sapiens
NTIGGFSQH

SEQ ID NO: 976404 - protein, 9 aa, Homo Sapiens
VTGLVVNSG

SEQ ID NO: 976405 - protein, 9 aa, Homo Sapiens
MPVHSSTRL

SEQ ID NO: 976406 - protein, 9 aa, Homo Sapiens
LLEKCCQDQ

SEQ ID NO: 976407 - protein, 9 aa, Homo Sapiens
DRVDPCQAC

SEQ ID NO: 976408 - protein, 9 aa, Homo Sapiens
GLEPLNSRS

SEQ ID NO: 976409 - protein, 9 aa, Homo Sapiens
AEMLLQADL

SEQ ID NO: 976410 - protein, 9 aa, Homo Sapiens
NQEIFRMFS

SEQ ID NO: 976411 - protein, 9 aa, Homo Sapiens
LFSEESCEK

SEQ ID NO: 976412 - protein, 9 aa, Homo Sapiens
PGCHFSISE

SEQ ID NO: 976413 - protein, 9 aa, Homo Sapiens
LGLLPRKGL

SEQ ID NO: 976414 - protein, 9 aa, Homo Sapiens
AYAVSIFFM

SEQ ID NO: 976415 - protein, 9 aa, Homo Sapiens
TGNKKAINL

SEQ ID NO: 976416 - protein, 9 aa, Homo Sapiens
KSVPLVCKS

SEQ ID NO: 976417 - protein, 9 aa, Homo Sapiens
TEKGSQDHS

SEQ ID NO: 976418 - protein, 9 aa, Homo Sapiens
SRRVAQLCG

SEQ ID NO: 976419 - protein, 9 aa, Homo Sapiens
PSPLPELVL

SEQ ID NO: 976420 - protein, 9 aa, Homo Sapiens
PRIPGQDGP

SEQ ID NO: 976421 - protein, 9 aa, Homo Sapiens
FNQFFIQPK

SEQ ID NO: 976422 - protein, 9 aa, Homo Sapiens
IPRLLDSED

SEQ ID NO: 976423 - protein, 9 aa, Homo Sapiens
RIHFGEKPY

SEQ ID NO: 976424 - protein, 9 aa, Homo Sapiens
CRDMKQKGG

SEQ ID NO: 976425 - protein, 9 aa, Homo Sapiens
VYSSEPGNE

SEQ ID NO: 976426 - protein, 9 aa, Homo Sapiens
GMFTQKQQR

SEQ ID NO: 976427 - protein, 9 aa, Homo Sapiens
LDRKAIDPA

SEQ ID NO: 976428 - protein, 9 aa, Homo Sapiens
NDKKDLGSK

SEQ ID NO: 976429 - protein, 9 aa, Homo Sapiens
QRLRWPWQA

SEQ ID NO: 976430 - protein, 9 aa, Homo Sapiens
MQKKIAALA

SEQ ID NO: 976431 - protein, 9 aa, Homo Sapiens
RVVSTHSST

SEQ ID NO: 976432 - protein, 9 aa, Homo Sapiens
VPDSPASPA

SEQ ID NO: 976433 - protein, 9 aa, Homo Sapiens
SENLLQPPV

SEQ ID NO: 976434 - protein, 9 aa, Homo Sapiens
YNFNKTLPA

SEQ ID NO: 976435 - protein, 9 aa, Homo Sapiens
LLTLCRVAP

SEQ ID NO: 976436 - protein, 9 aa, Homo Sapiens
RNGIPKLAP

SEQ ID NO: 976437 - protein, 9 aa, Homo Sapiens
SQRRGPKCQ

SEQ ID NO: 976438 - protein, 9 aa, Homo Sapiens
QFFIQPKEW

SEQ ID NO: 976439 - protein, 9 aa, Homo Sapiens
PSSPLPSMP

SEQ ID NO: 976440 - protein, 9 aa, Homo Sapiens
RDRLGDIFR

SEQ ID NO: 976441 - protein, 9 aa, Homo Sapiens
RGDPEHHVF

SEQ ID NO: 976442 - protein, 9 aa, Homo Sapiens
KALSTCGTH

SEQ ID NO: 976443 - protein, 9 aa, Homo Sapiens
SLDDCEELM

SEQ ID NO: 976444 - protein, 9 aa, Homo Sapiens
FGIGIFGVA

SEQ ID NO: 976445 - protein, 9 aa, Homo Sapiens
APSALSSSF

SEQ ID NO: 976446 - protein, 9 aa, Homo Sapiens
QTERTEPDH

SEQ ID NO: 976447 - protein, 9 aa, Homo Sapiens
YQLTLPQRF

SEQ ID NO: 976448 - protein, 9 aa, Homo Sapiens
VLRSRVNTT

SEQ ID NO: 976449 - protein, 9 aa, Homo Sapiens
HLRDFEPDA

SEQ ID NO: 976450 - protein, 9 aa, Homo Sapiens
KNRPQVFLL

SEQ ID NO: 976451 - protein, 9 aa, Homo Sapiens
DKLFGKEQS

SEQ ID NO: 976452 - protein, 9 aa, Homo Sapiens
RQPGGDTSS

SEQ ID NO: 976453 - protein, 9 aa, Homo Sapiens
SLFLVEIYK

SEQ ID NO: 976454 - protein, 9 aa, Homo Sapiens
NPGSPPMLT

SEQ ID NO: 976455 - protein, 9 aa, Homo Sapiens
PHVNPQRWG

SEQ ID NO: 976456 - protein, 9 aa, Homo Sapiens
GNLRRSPGP

SEQ ID NO: 976457 - protein, 9 aa, Homo Sapiens
ATWSNDPVA

SEQ ID NO: 976458 - protein, 9 aa, Homo Sapiens
DSGLTIEKF

SEQ ID NO: 976459 - protein, 9 aa, Homo Sapiens
KHSVGIICF

SEQ ID NO: 976460 - protein, 9 aa, Homo Sapiens
RKTGVELEI

SEQ ID NO: 976461 - protein, 9 aa, Homo Sapiens
ERYASIAKD

SEQ ID NO: 976462 - protein, 9 aa, Homo Sapiens
LQSSPSLDN

SEQ ID NO: 976463 - protein, 9 aa, Homo Sapiens
SQEEEDGAF

SEQ ID NO: 976464 - protein, 9 aa, Homo Sapiens
DDGCRVRDL

SEQ ID NO: 976465 - protein, 9 aa, Homo Sapiens
PYNYPFVSQ

SEQ ID NO: 976466 - protein, 9 aa, Homo Sapiens
FGPPGPPGD

SEQ ID NO: 976467 - protein, 9 aa, Homo Sapiens
DGCRVRDLD

SEQ ID NO: 976468 - protein, 9 aa, Homo Sapiens
SQYSAGNFW

SEQ ID NO: 976469 - protein, 9 aa, Homo Sapiens
SKKEETISS

SEQ ID NO: 976470 - protein, 9 aa, Homo Sapiens
LYEDLRDGY

SEQ ID NO: 976471 - protein, 9 aa, Homo Sapiens
DQTGRRRDA

SEQ ID NO: 976472 - protein, 9 aa, Homo Sapiens
SGGSLGVDS

SEQ ID NO: 976473 - protein, 9 aa, Homo Sapiens
LEIFMTYYI

SEQ ID NO: 976474 - protein, 9 aa, Homo Sapiens
GKEQSRRDN

SEQ ID NO: 976475 - protein, 9 aa, Homo Sapiens
AAHFHIHQS

SEQ ID NO: 976476 - protein, 9 aa, Homo Sapiens
LFQTTSSSL

SEQ ID NO: 976477 - protein, 9 aa, Homo Sapiens
ITLALLYSE

SEQ ID NO: 976478 - protein, 9 aa, Homo Sapiens
RGQEPQAPF

SEQ ID NO: 976479 - protein, 9 aa, Homo Sapiens
LHEPPKLFE

SEQ ID NO: 976480 - protein, 9 aa, Homo Sapiens
LRIPVHPIG

SEQ ID NO: 976481 - protein, 9 aa, Homo Sapiens
RFQELKQRT

SEQ ID NO: 976482 - protein, 9 aa, Homo Sapiens
IEFITKRHP

SEQ ID NO: 976483 - protein, 9 aa, Homo Sapiens
EKRVFNVLS

SEQ ID NO: 976484 - protein, 9 aa, Homo Sapiens
VLRKVGAPS

SEQ ID NO: 976485 - protein, 9 aa, Homo Sapiens
HLNGLLRKI

SEQ ID NO: 976486 - protein, 9 aa, Homo Sapiens
PTVLELRSF

SEQ ID NO: 976487 - protein, 9 aa, Homo Sapiens
PTGVTGSSR

SEQ ID NO: 976488 - protein, 9 aa, Homo Sapiens
LDGGVRLNK

SEQ ID NO: 976489 - protein, 9 aa, Homo Sapiens
QKIYVEIKF

SEQ ID NO: 976490 - protein, 9 aa, Homo Sapiens
GEIRAINQT

SEQ ID NO: 976491 - protein, 9 aa, Homo Sapiens
PPLVSSSLL

SEQ ID NO: 976492 - protein, 9 aa, Homo Sapiens
YLENGGLER

SEQ ID NO: 976493 - protein, 9 aa, Homo Sapiens
LEKTEQGFE

SEQ ID NO: 976494 - protein, 9 aa, Homo Sapiens
TCFEEETDD

SEQ ID NO: 976495 - protein, 9 aa, Homo Sapiens
NLVCDQKWL

SEQ ID NO: 976496 - protein, 9 aa, Homo Sapiens
EAGPSPSTF

SEQ ID NO: 976497 - protein, 9 aa, Homo Sapiens
KLSSDEDLK

SEQ ID NO: 976498 - protein, 9 aa, Homo Sapiens
PSLDNDSLG

SEQ ID NO: 976499 - protein, 9 aa, Homo Sapiens
MTFVILFHC

SEQ ID NO: 976500 - protein, 9 aa, Homo Sapiens
KFFQCNESG

SEQ ID NO: 976501 - protein, 9 aa, Homo Sapiens
VSPNGRLKL

SEQ ID NO: 976502 - protein, 9 aa, Homo Sapiens
VGTSFSKDV

SEQ ID NO: 976503 - protein, 9 aa, Homo Sapiens
YAVSIFFMI

SEQ ID NO: 976504 - protein, 9 aa, Homo Sapiens
VKDSTKALP

SEQ ID NO: 976505 - protein, 9 aa, Homo Sapiens
ERIHFGEKP

SEQ ID NO: 976506 - protein, 9 aa, Homo Sapiens
TARDGGSPL

SEQ ID NO: 976507 - protein, 9 aa, Homo Sapiens
HCFIAFASD

SEQ ID NO: 976508 - protein, 9 aa, Homo Sapiens
FNELKVCIH

SEQ ID NO: 976509 - protein, 9 aa, Homo Sapiens
PLGLLPRKG

SEQ ID NO: 976510 - protein, 9 aa, Homo Sapiens
KKFHIYWEK

SEQ ID NO: 976511 - protein, 9 aa, Homo Sapiens
DCDDDSDEK

SEQ ID NO: 976512 - protein, 9 aa, Homo Sapiens
SISRSLPFE

SEQ ID NO: 976513 - protein, 9 aa, Homo Sapiens
RPVSAGNAL

SEQ ID NO: 976514 - protein, 9 aa, Homo Sapiens
FLSAGIVAV

SEQ ID NO: 976515 - protein, 9 aa, Homo Sapiens
VIFICDRNS

SEQ ID NO: 976516 - protein, 9 aa, Homo Sapiens
YEPRYVLNA

SEQ ID NO: 976517 - protein, 9 aa, Homo Sapiens
SLQDVPQRR

SEQ ID NO: 976518 - protein, 9 aa, Homo Sapiens
WQKAHEPGM

SEQ ID NO: 976519 - protein, 9 aa, Homo Sapiens
QPAYGADLQ

SEQ ID NO: 976520 - protein, 9 aa, Homo Sapiens
PAGTFLNDP

SEQ ID NO: 976521 - protein, 9 aa, Homo Sapiens
KIDFSLKNN

SEQ ID NO: 976522 - protein, 9 aa, Homo Sapiens
LEFGNGDEE

SEQ ID NO: 976523 - protein, 9 aa, Homo Sapiens
IPFSVPNKD

SEQ ID NO: 976524 - protein, 9 aa, Homo Sapiens
HPSGMTFVI

SEQ ID NO: 976525 - protein, 9 aa, Homo Sapiens
PPGRKGQPG

SEQ ID NO: 976526 - protein, 9 aa, Homo Sapiens
DEAPLSTLK

SEQ ID NO: 976527 - protein, 9 aa, Homo Sapiens
SPTIEKKVM

SEQ ID NO: 976528 - protein, 9 aa, Homo Sapiens
TSEPPIKPR

SEQ ID NO: 976529 - protein, 9 aa, Homo Sapiens
SEFEASQVV

SEQ ID NO: 976530 - protein, 9 aa, Homo Sapiens
GHKEHTVIP

SEQ ID NO: 976531 - protein, 9 aa, Homo Sapiens
QMTKQQEQD

SEQ ID NO: 976532 - protein, 9 aa, Homo Sapiens
LPCTEGTTQ

SEQ ID NO: 976533 - protein, 9 aa, Homo Sapiens
FSEESCEKS

SEQ ID NO: 976534 - protein, 9 aa, Homo Sapiens
FSEYYEPRY

SEQ ID NO: 976535 - protein, 9 aa, Homo Sapiens
RSPSVANMK

SEQ ID NO: 976536 - protein, 9 aa, Homo Sapiens
VFLQFYLFA

SEQ ID NO: 976537 - protein, 9 aa, Homo Sapiens
GNLVVSYPF

SEQ ID NO: 976538 - protein, 9 aa, Homo Sapiens
EILEKLQLN

SEQ ID NO: 976539 - protein, 9 aa, Homo Sapiens
NTANHNLKQ

SEQ ID NO: 976540 - protein, 9 aa, Homo Sapiens
AEPLDGPAR

SEQ ID NO: 976541 - protein, 9 aa, Homo Sapiens
NSVGTSFSK

SEQ ID NO: 976542 - protein, 9 aa, Homo Sapiens
IKYFYFRPV

SEQ ID NO: 976543 - protein, 9 aa, Homo Sapiens
LGYTFCKQI

SEQ ID NO: 976544 - protein, 9 aa, Homo Sapiens
PLGPQGPNG

SEQ ID NO: 976545 - protein, 9 aa, Homo Sapiens
HLKIDSYSL

SEQ ID NO: 976546 - protein, 9 aa, Homo Sapiens
YESHVECRP

SEQ ID NO: 976547 - protein, 9 aa, Homo Sapiens
GHALPQSES

SEQ ID NO: 976548 - protein, 9 aa, Homo Sapiens
TEGTTQALR

SEQ ID NO: 976549 - protein, 9 aa, Homo Sapiens
SVSDSVFDS

SEQ ID NO: 976550 - protein, 9 aa, Homo Sapiens
TSLENDKIR

SEQ ID NO: 976551 - protein, 9 aa, Homo Sapiens
CLQLALGLA

SEQ ID NO: 976552 - protein, 9 aa, Homo Sapiens
VCPPRSAPA

SEQ ID NO: 976553 - protein, 9 aa, Homo Sapiens
INDSLYKEN

SEQ ID NO: 976554 - protein, 9 aa, Homo Sapiens
FSYSLAERS

SEQ ID NO: 976555 - protein, 9 aa, Homo Sapiens
LVLLVTVGL

SEQ ID NO: 976556 - protein, 9 aa, Homo Sapiens
AAQRRRCVE

SEQ ID NO: 976557 - protein, 9 aa, Homo Sapiens
LFPNGHAQI

SEQ ID NO: 976558 - protein, 9 aa, Homo Sapiens
SVNGKRYFK

SEQ ID NO: 976559 - protein, 9 aa, Homo Sapiens
PSHGSPTRD

SEQ ID NO: 976560 - protein, 9 aa, Homo Sapiens
GEIESLHSK

SEQ ID NO: 976561 - protein, 9 aa, Homo Sapiens
PSRPYGFSN

SEQ ID NO: 976562 - protein, 9 aa, Homo Sapiens
YLDPTHLSR

SEQ ID NO: 976563 - protein, 9 aa, Homo Sapiens
LTMPVMVLR

SEQ ID NO: 976564 - protein, 9 aa, Homo Sapiens
DYQKLNFET

SEQ ID NO: 976565 - protein, 9 aa, Homo Sapiens
GDNTSCQVV

SEQ ID NO: 976566 - protein, 9 aa, Homo Sapiens
FCQGKDSKV

SEQ ID NO: 976567 - protein, 9 aa, Homo Sapiens
QPLSEPQYQ

SEQ ID NO: 976568 - protein, 9 aa, Homo Sapiens
ALLNEKVAR

SEQ ID NO: 976569 - protein, 9 aa, Homo Sapiens
ESSREQKDL

SEQ ID NO: 976570 - protein, 9 aa, Homo Sapiens
VMKHPLGLS

SEQ ID NO: 976571 - protein, 9 aa, Homo Sapiens
SYMEIKGPP

SEQ ID NO: 976572 - protein, 9 aa, Homo Sapiens
TENFSAVSS

SEQ ID NO: 976573 - protein, 9 aa, Homo Sapiens
TGLVVNSGD

SEQ ID NO: 976574 - protein, 9 aa, Homo Sapiens
GAMFSESST

SEQ ID NO: 976575 - protein, 9 aa, Homo Sapiens
LSIFGKFSR

SEQ ID NO: 976576 - protein, 9 aa, Homo Sapiens
APEKDESTV

SEQ ID NO: 976577 - protein, 9 aa, Homo Sapiens
LGEKASARL

SEQ ID NO: 976578 - protein, 9 aa, Homo Sapiens
PPASPSVQT

SEQ ID NO: 976579 - protein, 9 aa, Homo Sapiens
TVSICEDHE

SEQ ID NO: 976580 - protein, 9 aa, Homo Sapiens
ACSGNVFRH

SEQ ID NO: 976581 - protein, 9 aa, Homo Sapiens
KSIFYYGCA

SEQ ID NO: 976582 - protein, 9 aa, Homo Sapiens
KSFQKQTFL

SEQ ID NO: 976583 - protein, 9 aa, Homo Sapiens
REQKIRLPE

SEQ ID NO: 976584 - protein, 9 aa, Homo Sapiens
FKKKVSFLN

SEQ ID NO: 976585 - protein, 9 aa, Homo Sapiens
IKMFIQQEF

SEQ ID NO: 976586 - protein, 9 aa, Homo Sapiens
GLCKARKHR

SEQ ID NO: 976587 - protein, 9 aa, Homo Sapiens
KYGYVQPSV

SEQ ID NO: 976588 - protein, 9 aa, Homo Sapiens
KIISVISEL

SEQ ID NO: 976589 - protein, 9 aa, Homo Sapiens
KVIFNVKDA

SEQ ID NO: 976590 - protein, 9 aa, Homo Sapiens
NIFQHFCEE

SEQ ID NO: 976591 - protein, 9 aa, Homo Sapiens
VPKEEQKFP

SEQ ID NO: 976592 - protein, 9 aa, Homo Sapiens
WNGVKEKHG

SEQ ID NO: 976593 - protein, 9 aa, Homo Sapiens
AATWSNDPV

SEQ ID NO: 976594 - protein, 9 aa, Homo Sapiens
SQEDFFQGR

SEQ ID NO: 976595 - protein, 9 aa, Homo Sapiens
CDLVAFTCF

SEQ ID NO: 976596 - protein, 9 aa, Homo Sapiens
LMDIYVHCL

SEQ ID NO: 976597 - protein, 9 aa, Homo Sapiens
LLDRHEDSA

SEQ ID NO: 976598 - protein, 9 aa, Homo Sapiens
LENDKIRLE

SEQ ID NO: 976599 - protein, 9 aa, Homo Sapiens
VWFQNRRAN

SEQ ID NO: 976600 - protein, 9 aa, Homo Sapiens
CSSAWFRTP

SEQ ID NO: 976601 - protein, 9 aa, Homo Sapiens
PDGVYTDDD

SEQ ID NO: 976602 - protein, 9 aa, Homo Sapiens
FLNDPVCPP

SEQ ID NO: 976603 - protein, 9 aa, Homo Sapiens
FSLLLPFLF

SEQ ID NO: 976604 - protein, 9 aa, Homo Sapiens
GYNLISLLE

SEQ ID NO: 976605 - protein, 9 aa, Homo Sapiens
ELHGQPGPA

SEQ ID NO: 976606 - protein, 9 aa, Homo Sapiens
MVCDEIIQC

SEQ ID NO: 976607 - protein, 9 aa, Homo Sapiens
EVAQAQTKV

SEQ ID NO: 976608 - protein, 9 aa, Homo Sapiens
LAACAPECV

SEQ ID NO: 976609 - protein, 9 aa, Homo Sapiens
KAWAEAEDA

SEQ ID NO: 976610 - protein, 9 aa, Homo Sapiens
ENEEDTRLY

SEQ ID NO: 976611 - protein, 9 aa, Homo Sapiens
AICHLLTYM

SEQ ID NO: 976612 - protein, 9 aa, Homo Sapiens
EKQDKKILE

SEQ ID NO: 976613 - protein, 9 aa, Homo Sapiens
KDNDPAPKK

SEQ ID NO: 976614 - protein, 9 aa, Homo Sapiens
FNITSVQRS

SEQ ID NO: 976615 - protein, 9 aa, Homo Sapiens
FFVNSAFDG

SEQ ID NO: 976616 - protein, 9 aa, Homo Sapiens
VEVDINGLR

SEQ ID NO: 976617 - protein, 9 aa, Homo Sapiens
ASLVQLGVL

SEQ ID NO: 976618 - protein, 9 aa, Homo Sapiens
WKKFHIYWE

SEQ ID NO: 976619 - protein, 9 aa, Homo Sapiens
VFGFVQTLK

SEQ ID NO: 976620 - protein, 9 aa, Homo Sapiens
VCKIIRVCK

SEQ ID NO: 976621 - protein, 9 aa, Homo Sapiens
HSASNTSDK

SEQ ID NO: 976622 - protein, 9 aa, Homo Sapiens
VLVPAGSAQ

SEQ ID NO: 976623 - protein, 9 aa, Homo Sapiens
GNGEFQNYK

SEQ ID NO: 976624 - protein, 9 aa, Homo Sapiens
EFQNYKLYY

SEQ ID NO: 976625 - protein, 9 aa, Homo Sapiens
LIRMIEEFR

SEQ ID NO: 976626 - protein, 9 aa, Homo Sapiens
SSEPGNEAK

SEQ ID NO: 976627 - protein, 9 aa, Homo Sapiens
LSFALQMYG

SEQ ID NO: 976628 - protein, 9 aa, Homo Sapiens
NDPNKPTGC

SEQ ID NO: 976629 - protein, 9 aa, Homo Sapiens
RIRELKDKL

SEQ ID NO: 976630 - protein, 9 aa, Homo Sapiens
SGNEPLSAP

SEQ ID NO: 976631 - protein, 9 aa, Homo Sapiens
SYKKDEIGL

SEQ ID NO: 976632 - protein, 9 aa, Homo Sapiens
ELLPVIIVG

SEQ ID NO: 976633 - protein, 9 aa, Homo Sapiens
SQETYRDYV

SEQ ID NO: 976634 - protein, 9 aa, Homo Sapiens
IQDFVSLAP

SEQ ID NO: 976635 - protein, 9 aa, Homo Sapiens
AKLTADDFR

SEQ ID NO: 976636 - protein, 9 aa, Homo Sapiens
SHFQSFSYS

SEQ ID NO: 976637 - protein, 9 aa, Homo Sapiens
SPVAGAPSV

SEQ ID NO: 976638 - protein, 9 aa, Homo Sapiens
AAIVVTPCY

SEQ ID NO: 976639 - protein, 9 aa, Homo Sapiens
KFSHKEKPD

SEQ ID NO: 976640 - protein, 9 aa, Homo Sapiens
INNHAAELG

SEQ ID NO: 976641 - protein, 9 aa, Homo Sapiens
FLEVKNASL

SEQ ID NO: 976642 - protein, 9 aa, Homo Sapiens
DSQEDFFQG

SEQ ID NO: 976643 - protein, 9 aa, Homo Sapiens
NFSQALLTV

SEQ ID NO: 976644 - protein, 9 aa, Homo Sapiens
PDASYLWWI

SEQ ID NO: 976645 - protein, 9 aa, Homo Sapiens
FIAFASDRI

SEQ ID NO: 976646 - protein, 9 aa, Homo Sapiens
SWSSQVEAR

SEQ ID NO: 976647 - protein, 9 aa, Homo Sapiens
KDGNLCLLS

SEQ ID NO: 976648 - protein, 9 aa, Homo Sapiens
GPDCHLRDF

SEQ ID NO: 976649 - protein, 9 aa, Homo Sapiens
PRKDSQETY

SEQ ID NO: 976650 - protein, 9 aa, Homo Sapiens
QLVESHPNG

SEQ ID NO: 976651 - protein, 9 aa, Homo Sapiens
EAKGAEDAL

SEQ ID NO: 976652 - protein, 9 aa, Homo Sapiens
DIFRWKGEN

SEQ ID NO: 976653 - protein, 9 aa, Homo Sapiens
PTYLNFKSI

SEQ ID NO: 976654 - protein, 9 aa, Homo Sapiens
SFEESPQEK

SEQ ID NO: 976655 - protein, 9 aa, Homo Sapiens
GGSLGVDSP

SEQ ID NO: 976656 - protein, 9 aa, Homo Sapiens
HPNSLTGKG

SEQ ID NO: 976657 - protein, 9 aa, Homo Sapiens
RNNYVLTQC

SEQ ID NO: 976658 - protein, 9 aa, Homo Sapiens
QIKKEKDQL

SEQ ID NO: 976659 - protein, 9 aa, Homo Sapiens
YFYRASLGL

SEQ ID NO: 976660 - protein, 9 aa, Homo Sapiens
RCNSTKSGA

SEQ ID NO: 976661 - protein, 9 aa, Homo Sapiens
WIKVARKCL

SEQ ID NO: 976662 - protein, 9 aa, Homo Sapiens
LSSLGLEQP

SEQ ID NO: 976663 - protein, 9 aa, Homo Sapiens
VSLAPWEVG

SEQ ID NO: 976664 - protein, 9 aa, Homo Sapiens
FEVHIPGVY

SEQ ID NO: 976665 - protein, 9 aa, Homo Sapiens
RATGVRLAV

SEQ ID NO: 976666 - protein, 9 aa, Homo Sapiens
KERPQDPLV

SEQ ID NO: 976667 - protein, 9 aa, Homo Sapiens
APCVHVRVG

SEQ ID NO: 976668 - protein, 9 aa, Homo Sapiens
PTITFLESS

SEQ ID NO: 976669 - protein, 9 aa, Homo Sapiens
ETPPMKETQ

SEQ ID NO: 976670 - protein, 9 aa, Homo Sapiens
AFREKHDNC

SEQ ID NO: 976671 - protein, 9 aa, Homo Sapiens
YNLSSPSPS

SEQ ID NO: 976672 - protein, 9 aa, Homo Sapiens
TWSMNEKLM

SEQ ID NO: 976673 - protein, 9 aa, Homo Sapiens
YFMVETAFA

SEQ ID NO: 976674 - protein, 9 aa, Homo Sapiens
GPPGSPAEQ

SEQ ID NO: 976675 - protein, 9 aa, Homo Sapiens
LTELSSDLR

SEQ ID NO: 976676 - protein, 9 aa, Homo Sapiens
SRLNGATFA

SEQ ID NO: 976677 - protein, 9 aa, Homo Sapiens
LYFFYFLGS

SEQ ID NO: 976678 - protein, 9 aa, Homo Sapiens
QLQSFKPHT

SEQ ID NO: 976679 - protein, 9 aa, Homo Sapiens
LSGLMSKLV

SEQ ID NO: 976680 - protein, 9 aa, Homo Sapiens
EENLQKNSQ

SEQ ID NO: 976681 - protein, 9 aa, Homo Sapiens
ECKEKSVSC

SEQ ID NO: 976682 - protein, 9 aa, Homo Sapiens
EESESFIQA

SEQ ID NO: 976683 - protein, 9 aa, Homo Sapiens
LVGGMFTQK

SEQ ID NO: 976684 - protein, 9 aa, Homo Sapiens
VSALQHVKA

SEQ ID NO: 976685 - protein, 9 aa, Homo Sapiens
IAGRTAGRA

SEQ ID NO: 976686 - protein, 9 aa, Homo Sapiens
AQFPRACGL

SEQ ID NO: 976687 - protein, 9 aa, Homo Sapiens
IAAVYEHVV

SEQ ID NO: 976688 - protein, 9 aa, Homo Sapiens
SLPLFLLVL

SEQ ID NO: 976689 - protein, 9 aa, Homo Sapiens
QTGRRRDAG

SEQ ID NO: 976690 - protein, 9 aa, Homo Sapiens
HNLKQVEYV

SEQ ID NO: 976691 - protein, 9 aa, Homo Sapiens
KLSREKAQN

SEQ ID NO: 976692 - protein, 9 aa, Homo Sapiens
LGLDSKTTY

SEQ ID NO: 976693 - protein, 9 aa, Homo Sapiens
DPLLDHINN

SEQ ID NO: 976694 - protein, 9 aa, Homo Sapiens
GSPPMLTEE

SEQ ID NO: 976695 - protein, 9 aa, Homo Sapiens
SYLWWINGQ

SEQ ID NO: 976696 - protein, 9 aa, Homo Sapiens
KWSFTSPHR

SEQ ID NO: 976697 - protein, 9 aa, Homo Sapiens
AHQRCPREG

SEQ ID NO: 976698 - protein, 9 aa, Homo Sapiens
DCVPLMPKL

SEQ ID NO: 976699 - protein, 9 aa, Homo Sapiens
KVIQKSVGP

SEQ ID NO: 976700 - protein, 9 aa, Homo Sapiens
QSLVDVIRS

SEQ ID NO: 976701 - protein, 9 aa, Homo Sapiens
LHDEPVNWA

SEQ ID NO: 976702 - protein, 9 aa, Homo Sapiens
GYCWLSPAL

SEQ ID NO: 976703 - protein, 9 aa, Homo Sapiens
QNDPFRAET

SEQ ID NO: 976704 - protein, 9 aa, Homo Sapiens
LKRYSEQAF

SEQ ID NO: 976705 - protein, 9 aa, Homo Sapiens
SFSLLLPFL

SEQ ID NO: 976706 - protein, 9 aa, Homo Sapiens
FPGPGPTLA

SEQ ID NO: 976707 - protein, 9 aa, Homo Sapiens
ANGNIKVSH

SEQ ID NO: 976708 - protein, 9 aa, Homo Sapiens
CDEDSVVGE

SEQ ID NO: 976709 - protein, 9 aa, Homo Sapiens
STKSVPLVC

SEQ ID NO: 976710 - protein, 9 aa, Homo Sapiens
KDKVALLIR

SEQ ID NO: 976711 - protein, 9 aa, Homo Sapiens
FCLMDRKPL

SEQ ID NO: 976712 - protein, 9 aa, Homo Sapiens
FRAWVWAGL

SEQ ID NO: 976713 - protein, 9 aa, Homo Sapiens
LYGCWMTFF

SEQ ID NO: 976714 - protein, 9 aa, Homo Sapiens
DSYRRFEGC

SEQ ID NO: 976715 - protein, 9 aa, Homo Sapiens
KLTADDFRL

SEQ ID NO: 976716 - protein, 9 aa, Homo Sapiens
TDGRGKIIP

SEQ ID NO: 976717 - protein, 9 aa, Homo Sapiens
RTLLEKKLS

SEQ ID NO: 976718 - protein, 9 aa, Homo Sapiens
EPLLPLPPL

SEQ ID NO: 976719 - protein, 9 aa, Homo Sapiens
ELRKAWAEA

SEQ ID NO: 976720 - protein, 9 aa, Homo Sapiens
WKKESQKLL

SEQ ID NO: 976721 - protein, 9 aa, Homo Sapiens
QHMLIHSEI

SEQ ID NO: 976722 - protein, 9 aa, Homo Sapiens
DAVHIISEN

SEQ ID NO: 976723 - protein, 9 aa, Homo Sapiens
YGCWGFWRW

SEQ ID NO: 976724 - protein, 9 aa, Homo Sapiens
ITTLGALTF

SEQ ID NO: 976725 - protein, 9 aa, Homo Sapiens
CEQDYVVTL

SEQ ID NO: 976726 - protein, 9 aa, Homo Sapiens
RTIFSNIQS

SEQ ID NO: 976727 - protein, 9 aa, Homo Sapiens
GTHFIVVAL

SEQ ID NO: 976728 - protein, 9 aa, Homo Sapiens
QWVGELMDQ

SEQ ID NO: 976729 - protein, 9 aa, Homo Sapiens
EPQRNLSSS

SEQ ID NO: 976730 - protein, 9 aa, Homo Sapiens
ADDQDMIES

SEQ ID NO: 976731 - protein, 9 aa, Homo Sapiens
IQPKEWKGG

SEQ ID NO: 976732 - protein, 9 aa, Homo Sapiens
HIHQSPHWR

SEQ ID NO: 976733 - protein, 9 aa, Homo Sapiens
CPPERRLHW

SEQ ID NO: 976734 - protein, 9 aa, Homo Sapiens
NSGDAVTCT

SEQ ID NO: 976735 - protein, 9 aa, Homo Sapiens
LEDVDPSYE

SEQ ID NO: 976736 - protein, 9 aa, Homo Sapiens
IDKLLSKLK

SEQ ID NO: 976737 - protein, 9 aa, Homo Sapiens
SSPFYPRNY

SEQ ID NO: 976738 - protein, 9 aa, Homo Sapiens
CKLSNLIIL

SEQ ID NO: 976739 - protein, 9 aa, Homo Sapiens
VIVMKRENI

SEQ ID NO: 976740 - protein, 9 aa, Homo Sapiens
QLLCYYDQC

SEQ ID NO: 976741 - protein, 9 aa, Homo Sapiens
MREKFFQCN

SEQ ID NO: 976742 - protein, 9 aa, Homo Sapiens
PKREARAQE

SEQ ID NO: 976743 - protein, 9 aa, Homo Sapiens
GTTQALRLP

SEQ ID NO: 976744 - protein, 9 aa, Homo Sapiens
IKEENLQKN

SEQ ID NO: 976745 - protein, 9 aa, Homo Sapiens
CAGTGNKKA

SEQ ID NO: 976746 - protein, 9 aa, Homo Sapiens
SNTSDKNRV

SEQ ID NO: 976747 - protein, 9 aa, Homo Sapiens
ARQNAGILA

SEQ ID NO: 976748 - protein, 9 aa, Homo Sapiens
GYNREEFLR

SEQ ID NO: 976749 - protein, 9 aa, Homo Sapiens
IPNTDSGEQ

SEQ ID NO: 976750 - protein, 9 aa, Homo Sapiens
GGRTQCVKE

SEQ ID NO: 976751 - protein, 9 aa, Homo Sapiens
FPCSESQHL

SEQ ID NO: 976752 - protein, 9 aa, Homo Sapiens
YLLKIFFCA

SEQ ID NO: 976753 - protein, 9 aa, Homo Sapiens
IWAKYSNGD

SEQ ID NO: 976754 - protein, 9 aa, Homo Sapiens
KQASSTRRD

SEQ ID NO: 976755 - protein, 9 aa, Homo Sapiens
YEKRHQVSV

SEQ ID NO: 976756 - protein, 9 aa, Homo Sapiens
LPQERKQAS

SEQ ID NO: 976757 - protein, 9 aa, Homo Sapiens
IGAEAKRKF

SEQ ID NO: 976758 - protein, 9 aa, Homo Sapiens
ANALVAEQV

SEQ ID NO: 976759 - protein, 9 aa, Homo Sapiens
GEKASARLL

SEQ ID NO: 976760 - protein, 9 aa, Homo Sapiens
ASVEERGVP

SEQ ID NO: 976761 - protein, 9 aa, Homo Sapiens
GRTQCVKEV

SEQ ID NO: 976762 - protein, 9 aa, Homo Sapiens
TCKPKSKNY

SEQ ID NO: 976763 - protein, 9 aa, Homo Sapiens
NSVFCQKVE

SEQ ID NO: 976764 - protein, 9 aa, Homo Sapiens
RSTHAGGFH

SEQ ID NO: 976765 - protein, 9 aa, Homo Sapiens
CWLLERWCT

SEQ ID NO: 976766 - protein, 9 aa, Homo Sapiens
LAATWSNDP

SEQ ID NO: 976767 - protein, 9 aa, Homo Sapiens
KRENILEYD

SEQ ID NO: 976768 - protein, 9 aa, Homo Sapiens
DLGQLFKLK

SEQ ID NO: 976769 - protein, 9 aa, Homo Sapiens
AAVLSMIRD

SEQ ID NO: 976770 - protein, 9 aa, Homo Sapiens
KGMFFNPDL

SEQ ID NO: 976771 - protein, 9 aa, Homo Sapiens
QHEESLQDV

SEQ ID NO: 976772 - protein, 9 aa, Homo Sapiens
FHTTCFEEE

SEQ ID NO: 976773 - protein, 9 aa, Homo Sapiens
KLRDAFTWS

SEQ ID NO: 976774 - protein, 9 aa, Homo Sapiens
TLLEKKLSL

SEQ ID NO: 976775 - protein, 9 aa, Homo Sapiens
GVDEAPLST

SEQ ID NO: 976776 - protein, 9 aa, Homo Sapiens
FLFFWYGCW

SEQ ID NO: 976777 - protein, 9 aa, Homo Sapiens
PLRIPKPNQ

SEQ ID NO: 976778 - protein, 9 aa, Homo Sapiens
RIGFYFGVG

SEQ ID NO: 976779 - protein, 9 aa, Homo Sapiens
PGPSVVGLG

SEQ ID NO: 976780 - protein, 9 aa, Homo Sapiens
VLQNDNAKL

SEQ ID NO: 976781 - protein, 9 aa, Homo Sapiens
YQSPTDFMR

SEQ ID NO: 976782 - protein, 9 aa, Homo Sapiens
FSYVELDLH

SEQ ID NO: 976783 - protein, 9 aa, Homo Sapiens
KLVVRSSRN

SEQ ID NO: 976784 - protein, 9 aa, Homo Sapiens
EKSVSCPRC

SEQ ID NO: 976785 - protein, 9 aa, Homo Sapiens
APCWLLERW

SEQ ID NO: 976786 - protein, 9 aa, Homo Sapiens
LLLTLCRVA

SEQ ID NO: 976787 - protein, 9 aa, Homo Sapiens
KLAKCKLAI

SEQ ID NO: 976788 - protein, 9 aa, Homo Sapiens
LFSSSKKLK

SEQ ID NO: 976789 - protein, 9 aa, Homo Sapiens
IDFLNEFYA

SEQ ID NO: 976790 - protein, 9 aa, Homo Sapiens
PRTSSSLDD

SEQ ID NO: 976791 - protein, 9 aa, Homo Sapiens
GPPGPQGPL

SEQ ID NO: 976792 - protein, 9 aa, Homo Sapiens
VLLKKKLEK

SEQ ID NO: 976793 - protein, 9 aa, Homo Sapiens
HPSLTCVMK

SEQ ID NO: 976794 - protein, 9 aa, Homo Sapiens
DENLRAVGH

SEQ ID NO: 976795 - protein, 9 aa, Homo Sapiens
VYFEVHIPG

SEQ ID NO: 976796 - protein, 9 aa, Homo Sapiens
RVTFLDDIR

SEQ ID NO: 976797 - protein, 9 aa, Homo Sapiens
EKLIFSYVE

SEQ ID NO: 976798 - protein, 9 aa, Homo Sapiens
PCNQRGGAP

SEQ ID NO: 976799 - protein, 9 aa, Homo Sapiens
ASPSVQTII

SEQ ID NO: 976800 - protein, 9 aa, Homo Sapiens
NGKRYFKCQ

SEQ ID NO: 976801 - protein, 9 aa, Homo Sapiens
HRGLRGHHV

SEQ ID NO: 976802 - protein, 9 aa, Homo Sapiens
ELSKKDRET

SEQ ID NO: 976803 - protein, 9 aa, Homo Sapiens
LEQTMTKLT

SEQ ID NO: 976804 - protein, 9 aa, Homo Sapiens
YVHCLSALI

SEQ ID NO: 976805 - protein, 9 aa, Homo Sapiens
GESHRKAFT

SEQ ID NO: 976806 - protein, 9 aa, Homo Sapiens
GPSCSFPHN

SEQ ID NO: 976807 - protein, 9 aa, Homo Sapiens
SQDLVFGGD

SEQ ID NO: 976808 - protein, 9 aa, Homo Sapiens
SSTEPSSQY

SEQ ID NO: 976809 - protein, 9 aa, Homo Sapiens
EDYDSYRRF

SEQ ID NO: 976810 - protein, 9 aa, Homo Sapiens
NFTVDEVAY

SEQ ID NO: 976811 - protein, 9 aa, Homo Sapiens
ELKSKKKSS

SEQ ID NO: 976812 - protein, 9 aa, Homo Sapiens
FCMLMPKEN

SEQ ID NO: 976813 - protein, 9 aa, Homo Sapiens
RSPVSKRRG

SEQ ID NO: 976814 - protein, 9 aa, Homo Sapiens
FLELASLGY

SEQ ID NO: 976815 - protein, 9 aa, Homo Sapiens
LPLQYSTVI

SEQ ID NO: 976816 - protein, 9 aa, Homo Sapiens
GFHQSGSSP

SEQ ID NO: 976817 - protein, 9 aa, Homo Sapiens
GSRTCLPAP

SEQ ID NO: 976818 - protein, 9 aa, Homo Sapiens
KEWQAAVKP

SEQ ID NO: 976819 - protein, 9 aa, Homo Sapiens
FTTDTALLL

SEQ ID NO: 976820 - protein, 9 aa, Homo Sapiens
PYLQESSRR

SEQ ID NO: 976821 - protein, 9 aa, Homo Sapiens
PKVFRCVLN

SEQ ID NO: 976822 - protein, 9 aa, Homo Sapiens
LFLFSEYYE

SEQ ID NO: 976823 - protein, 9 aa, Homo Sapiens
LDEGLNEDI

SEQ ID NO: 976824 - protein, 9 aa, Homo Sapiens
LNETLCLTW

SEQ ID NO: 976825 - protein, 9 aa, Homo Sapiens
KAINLLEPM

SEQ ID NO: 976826 - protein, 9 aa, Homo Sapiens
QEPQAPFSS

SEQ ID NO: 976827 - protein, 9 aa, Homo Sapiens
AFSRRIGFY

SEQ ID NO: 976828 - protein, 9 aa, Homo Sapiens
VAAEPLDGP

SEQ ID NO: 976829 - protein, 9 aa, Homo Sapiens
LIFFGVPIP

SEQ ID NO: 976830 - protein, 9 aa, Homo Sapiens
LVLGATEYL

SEQ ID NO: 976831 - protein, 9 aa, Homo Sapiens
VKLHDGETL

SEQ ID NO: 976832 - protein, 9 aa, Homo Sapiens
ALRDVLDQP

SEQ ID NO: 976833 - protein, 9 aa, Homo Sapiens
GEIFMLKHC

SEQ ID NO: 976834 - protein, 9 aa, Homo Sapiens
DGAFAAEPT

SEQ ID NO: 976835 - protein, 9 aa, Homo Sapiens
EMSFYHHGE

SEQ ID NO: 976836 - protein, 9 aa, Homo Sapiens
KKQVQIKKE

SEQ ID NO: 976837 - protein, 9 aa, Homo Sapiens
AHLPQDSKR

SEQ ID NO: 976838 - protein, 9 aa, Homo Sapiens
PLSTLKGKT

SEQ ID NO: 976839 - protein, 9 aa, Homo Sapiens
CPASVVKSV

SEQ ID NO: 976840 - protein, 9 aa, Homo Sapiens
PKLLYVRKD

SEQ ID NO: 976841 - protein, 9 aa, Homo Sapiens
KDVFLVVNI

SEQ ID NO: 976842 - protein, 9 aa, Homo Sapiens
AFIYSSLLN

SEQ ID NO: 976843 - protein, 9 aa, Homo Sapiens
LKTLRRENK

SEQ ID NO: 976844 - protein, 9 aa, Homo Sapiens
DDNYVGCAE

SEQ ID NO: 976845 - protein, 9 aa, Homo Sapiens
LLCVFFVSH

SEQ ID NO: 976846 - protein, 9 aa, Homo Sapiens
SSGTRRSGS

SEQ ID NO: 976847 - protein, 9 aa, Homo Sapiens
SRWPAMKFK

SEQ ID NO: 976848 - protein, 9 aa, Homo Sapiens
LRDELRLEK

SEQ ID NO: 976849 - protein, 9 aa, Homo Sapiens
GGDNTSCQV

SEQ ID NO: 976850 - protein, 9 aa, Homo Sapiens
STFDNFSQA

SEQ ID NO: 976851 - protein, 9 aa, Homo Sapiens
LGGSEKFWY

SEQ ID NO: 976852 - protein, 9 aa, Homo Sapiens
RIPLPANAL

SEQ ID NO: 976853 - protein, 9 aa, Homo Sapiens
KIAALAPSM

SEQ ID NO: 976854 - protein, 9 aa, Homo Sapiens
LSSSTEPSS

SEQ ID NO: 976855 - protein, 9 aa, Homo Sapiens
QLTIPFSVP

SEQ ID NO: 976856 - protein, 9 aa, Homo Sapiens
QRTDYQKLN

SEQ ID NO: 976857 - protein, 9 aa, Homo Sapiens
KKLQGGFML

SEQ ID NO: 976858 - protein, 9 aa, Homo Sapiens
NVVKKVEKG

SEQ ID NO: 976859 - protein, 9 aa, Homo Sapiens
IDFSLKNNE

SEQ ID NO: 976860 - protein, 9 aa, Homo Sapiens
QAQQARQNA

SEQ ID NO: 976861 - protein, 9 aa, Homo Sapiens
SEFLVFPTA

SEQ ID NO: 976862 - protein, 9 aa, Homo Sapiens
VSDSVFDSI

SEQ ID NO: 976863 - protein, 9 aa, Homo Sapiens
GKPGMGKPE

SEQ ID NO: 976864 - protein, 9 aa, Homo Sapiens
KRHQVSVSR

SEQ ID NO: 976865 - protein, 9 aa, Homo Sapiens
FPISIWMSL

SEQ ID NO: 976866 - protein, 9 aa, Homo Sapiens
MCFLVLLGL

SEQ ID NO: 976867 - protein, 9 aa, Homo Sapiens
RFLRSLVFP

SEQ ID NO: 976868 - protein, 9 aa, Homo Sapiens
EFRYLENGG

SEQ ID NO: 976869 - protein, 9 aa, Homo Sapiens
KGDKGPPGR

SEQ ID NO: 976870 - protein, 9 aa, Homo Sapiens
FPEADVAVF

SEQ ID NO: 976871 - protein, 9 aa, Homo Sapiens
ILPIIIYAG

SEQ ID NO: 976872 - protein, 9 aa, Homo Sapiens
SKPVLVTTF

SEQ ID NO: 976873 - protein, 9 aa, Homo Sapiens
KGDKGPPGL

SEQ ID NO: 976874 - protein, 9 aa, Homo Sapiens
CSSCLVRNK

SEQ ID NO: 976875 - protein, 9 aa, Homo Sapiens
KGQGRWEFL

SEQ ID NO: 976876 - protein, 9 aa, Homo Sapiens
MHEQEKIWV

SEQ ID NO: 976877 - protein, 9 aa, Homo Sapiens
RNYAKLSAK

SEQ ID NO: 976878 - protein, 9 aa, Homo Sapiens
EQRRTVHYK

SEQ ID NO: 976879 - protein, 9 aa, Homo Sapiens
LGHFKRRYP

SEQ ID NO: 976880 - protein, 9 aa, Homo Sapiens
AQMTKQQEQ

SEQ ID NO: 976881 - protein, 9 aa, Homo Sapiens
LKREGLDGS

SEQ ID NO: 976882 - protein, 9 aa, Homo Sapiens
GILRIPVHP

SEQ ID NO: 976883 - protein, 9 aa, Homo Sapiens
SAKHTSHNK

SEQ ID NO: 976884 - protein, 9 aa, Homo Sapiens
TVLELRSFT

SEQ ID NO: 976885 - protein, 9 aa, Homo Sapiens
TVGLGAFTK

SEQ ID NO: 976886 - protein, 9 aa, Homo Sapiens
QEKRVFNVL

SEQ ID NO: 976887 - protein, 9 aa, Homo Sapiens
ERATQETTN

SEQ ID NO: 976888 - protein, 9 aa, Homo Sapiens
IFNVKDANA

SEQ ID NO: 976889 - protein, 9 aa, Homo Sapiens
PGTAADPLT

SEQ ID NO: 976890 - protein, 9 aa, Homo Sapiens
MELYNLSSP

SEQ ID NO: 976891 - protein, 9 aa, Homo Sapiens
CSAMTQLRV

SEQ ID NO: 976892 - protein, 9 aa, Homo Sapiens
LPLFLKAWK

SEQ ID NO: 976893 - protein, 9 aa, Homo Sapiens
FFSAMLLFV

SEQ ID NO: 976894 - protein, 9 aa, Homo Sapiens
QVGADAAIV

SEQ ID NO: 976895 - protein, 9 aa, Homo Sapiens
HNSVCSQES

SEQ ID NO: 976896 - protein, 9 aa, Homo Sapiens
WTALLGRSR

SEQ ID NO: 976897 - protein, 9 aa, Homo Sapiens
QCIFCLEIF

SEQ ID NO: 976898 - protein, 9 aa, Homo Sapiens
KKNFTVDEV

SEQ ID NO: 976899 - protein, 9 aa, Homo Sapiens
HLGGSEKFW

SEQ ID NO: 976900 - protein, 9 aa, Homo Sapiens
SRILPNHGL

SEQ ID NO: 976901 - protein, 9 aa, Homo Sapiens
LPELVLRKV

SEQ ID NO: 976902 - protein, 9 aa, Homo Sapiens
ESCGSLSET

SEQ ID NO: 976903 - protein, 9 aa, Homo Sapiens
VSCFNELKV

SEQ ID NO: 976904 - protein, 9 aa, Homo Sapiens
RHLGYTFCK

SEQ ID NO: 976905 - protein, 9 aa, Homo Sapiens
HLSEPPRDW

SEQ ID NO: 976906 - protein, 9 aa, Homo Sapiens
EEMKSGDPQ

SEQ ID NO: 976907 - protein, 9 aa, Homo Sapiens
RTVHYKGGA

SEQ ID NO: 976908 - protein, 9 aa, Homo Sapiens
QAIEKHKEE

SEQ ID NO: 976909 - protein, 9 aa, Homo Sapiens
SGPGQRVRH

SEQ ID NO: 976910 - protein, 9 aa, Homo Sapiens
TKHKIIHVG

SEQ ID NO: 976911 - protein, 9 aa, Homo Sapiens
RVGDFGSVT

SEQ ID NO: 976912 - protein, 9 aa, Homo Sapiens
WIEFITKRH

SEQ ID NO: 976913 - protein, 9 aa, Homo Sapiens
YSGFSAHLV

SEQ ID NO: 976914 - protein, 9 aa, Homo Sapiens
FRYLENGGL

SEQ ID NO: 976915 - protein, 9 aa, Homo Sapiens
YDRQGQLVE

SEQ ID NO: 976916 - protein, 9 aa, Homo Sapiens
AVHIISENE

SEQ ID NO: 976917 - protein, 9 aa, Homo Sapiens
KRFLTIDHV

SEQ ID NO: 976918 - protein, 9 aa, Homo Sapiens
LEFVLSHRA

SEQ ID NO: 976919 - protein, 9 aa, Homo Sapiens
GGPDCHLRD

SEQ ID NO: 976920 - protein, 9 aa, Homo Sapiens
GVERRNWVL

SEQ ID NO: 976921 - protein, 9 aa, Homo Sapiens
WTYTFVFFH

SEQ ID NO: 976922 - protein, 9 aa, Homo Sapiens
MAGFLIALI

SEQ ID NO: 976923 - protein, 9 aa, Homo Sapiens
ATGVRLAVT

SEQ ID NO: 976924 - protein, 9 aa, Homo Sapiens
CQFLLKSGA

SEQ ID NO: 976925 - protein, 9 aa, Homo Sapiens
AKTTTLSFR

SEQ ID NO: 976926 - protein, 9 aa, Homo Sapiens
RGGGGGRRA

SEQ ID NO: 976927 - protein, 9 aa, Homo Sapiens
CKEKSVSCP

SEQ ID NO: 976928 - protein, 9 aa, Homo Sapiens
DSGEQSWLL

SEQ ID NO: 976929 - protein, 9 aa, Homo Sapiens
MFSKDMPYY

SEQ ID NO: 976930 - protein, 9 aa, Homo Sapiens
QVTCVPREV

SEQ ID NO: 976931 - protein, 9 aa, Homo Sapiens
HRSSPSSSS

SEQ ID NO: 976932 - protein, 9 aa, Homo Sapiens
RHEDSAMHL

SEQ ID NO: 976933 - protein, 9 aa, Homo Sapiens
KFPEADVAV

SEQ ID NO: 976934 - protein, 9 aa, Homo Sapiens
VAIKSRPVL

SEQ ID NO: 976935 - protein, 9 aa, Homo Sapiens
TRLPHTTLS

SEQ ID NO: 976936 - protein, 9 aa, Homo Sapiens
AGSGPAAAP

SEQ ID NO: 976937 - protein, 9 aa, Homo Sapiens
SGELYAVQV

SEQ ID NO: 976938 - protein, 9 aa, Homo Sapiens
SCPRCVRRE

SEQ ID NO: 976939 - protein, 9 aa, Homo Sapiens
FTEAGLKAF

SEQ ID NO: 976940 - protein, 9 aa, Homo Sapiens
LFAALSLGP

SEQ ID NO: 976941 - protein, 9 aa, Homo Sapiens
LTIEKFWRE

SEQ ID NO: 976942 - protein, 9 aa, Homo Sapiens
ACVTGLVVN

SEQ ID NO: 976943 - protein, 9 aa, Homo Sapiens
KDTDPNSVH

SEQ ID NO: 976944 - protein, 9 aa, Homo Sapiens
RSQLRGTLY

SEQ ID NO: 976945 - protein, 9 aa, Homo Sapiens
KVTWYKDGK

SEQ ID NO: 976946 - protein, 9 aa, Homo Sapiens
STFHYEVVQ

SEQ ID NO: 976947 - protein, 9 aa, Homo Sapiens
AEMEHFLER

SEQ ID NO: 976948 - protein, 9 aa, Homo Sapiens
DTPLPHVNP

SEQ ID NO: 976949 - protein, 9 aa, Homo Sapiens
NDSLYKENA

SEQ ID NO: 976950 - protein, 9 aa, Homo Sapiens
AQTSYTLFV

SEQ ID NO: 976951 - protein, 9 aa, Homo Sapiens
VLGRNLFKV

SEQ ID NO: 976952 - protein, 9 aa, Homo Sapiens
EKLGSCVAT

SEQ ID NO: 976953 - protein, 9 aa, Homo Sapiens
SVPLPEPLK

SEQ ID NO: 976954 - protein, 9 aa, Homo Sapiens
YVEYAISQP

SEQ ID NO: 976955 - protein, 9 aa, Homo Sapiens
VISITMGPK

SEQ ID NO: 976956 - protein, 9 aa, Homo Sapiens
ELKYGYVQP

SEQ ID NO: 976957 - protein, 9 aa, Homo Sapiens
KSVFQMLQR

SEQ ID NO: 976958 - protein, 9 aa, Homo Sapiens
LAALLTMPV

SEQ ID NO: 976959 - protein, 9 aa, Homo Sapiens
DGVYTDDDL

SEQ ID NO: 976960 - protein, 9 aa, Homo Sapiens
VTCSISRSL

SEQ ID NO: 976961 - protein, 9 aa, Homo Sapiens
IVEERWTVV

SEQ ID NO: 976962 - protein, 9 aa, Homo Sapiens
SSIPMSRIL

SEQ ID NO: 976963 - protein, 9 aa, Homo Sapiens
YEHVVILPN

SEQ ID NO: 976964 - protein, 9 aa, Homo Sapiens
FRVVSTHSS

SEQ ID NO: 976965 - protein, 9 aa, Homo Sapiens
RFLFGLLSP

SEQ ID NO: 976966 - protein, 9 aa, Homo Sapiens
PYNNKECRK

SEQ ID NO: 976967 - protein, 9 aa, Homo Sapiens
PSSQYSAGN

SEQ ID NO: 976968 - protein, 9 aa, Homo Sapiens
KKALLNEKV

SEQ ID NO: 976969 - protein, 9 aa, Homo Sapiens
SFFRNEIDL

SEQ ID NO: 976970 - protein, 9 aa, Homo Sapiens
EAKAVACHR

SEQ ID NO: 976971 - protein, 9 aa, Homo Sapiens
IAKEKLEFT

SEQ ID NO: 976972 - protein, 9 aa, Homo Sapiens
VYTPQRFLD

SEQ ID NO: 976973 - protein, 9 aa, Homo Sapiens
RKMKFKGNY

SEQ ID NO: 976974 - protein, 9 aa, Homo Sapiens
QDIVKMVSL

SEQ ID NO: 976975 - protein, 9 aa, Homo Sapiens
NWAAAGDHV

SEQ ID NO: 976976 - protein, 9 aa, Homo Sapiens
ECVCPPERR

SEQ ID NO: 976977 - protein, 9 aa, Homo Sapiens
TKEREESSC

SEQ ID NO: 976978 - protein, 9 aa, Homo Sapiens
VQTLKGCED

SEQ ID NO: 976979 - protein, 9 aa, Homo Sapiens
ASFNITSVQ

SEQ ID NO: 976980 - protein, 9 aa, Homo Sapiens
YFIYSCVLG

SEQ ID NO: 976981 - protein, 9 aa, Homo Sapiens
QTTTSPKRL

SEQ ID NO: 976982 - protein, 9 aa, Homo Sapiens
TILLCKKYT

SEQ ID NO: 976983 - protein, 9 aa, Homo Sapiens
VAQLFIFLV

SEQ ID NO: 976984 - protein, 9 aa, Homo Sapiens
RRKTNRSFV

SEQ ID NO: 976985 - protein, 9 aa, Homo Sapiens
LCQYFSNER

SEQ ID NO: 976986 - protein, 9 aa, Homo Sapiens
TYAFREKHD

SEQ ID NO: 976987 - protein, 9 aa, Homo Sapiens
TLGALTFDR

SEQ ID NO: 976988 - protein, 9 aa, Homo Sapiens
FHLQATSDP

SEQ ID NO: 976989 - protein, 9 aa, Homo Sapiens
DEQQVESIT

SEQ ID NO: 976990 - protein, 9 aa, Homo Sapiens
ELFDQDESS

SEQ ID NO: 976991 - protein, 9 aa, Homo Sapiens
PKCQIEISS

SEQ ID NO: 976992 - protein, 9 aa, Homo Sapiens
QALRLPPTT

SEQ ID NO: 976993 - protein, 9 aa, Homo Sapiens
EMEHFLERS

SEQ ID NO: 976994 - protein, 9 aa, Homo Sapiens
AFAQTSYTL

SEQ ID NO: 976995 - protein, 9 aa, Homo Sapiens
ALPQSESIW

SEQ ID NO: 976996 - protein, 9 aa, Homo Sapiens
PRGPLNLDS

SEQ ID NO: 976997 - protein, 9 aa, Homo Sapiens
LLDLETKNS

SEQ ID NO: 976998 - protein, 9 aa, Homo Sapiens
ICHLLTYMT

SEQ ID NO: 976999 - protein, 9 aa, Homo Sapiens
AAKIYTELC

SEQ ID NO: 977000 - protein, 9 aa, Homo Sapiens
IPGVYRDLF

SEQ ID NO: 977001 - protein, 9 aa, Homo Sapiens
QYSTVINSR

SEQ ID NO: 977002 - protein, 9 aa, Homo Sapiens
PENPIFRFS

SEQ ID NO: 977003 - protein, 9 aa, Homo Sapiens
PELKYGYVQ

SEQ ID NO: 977004 - protein, 9 aa, Homo Sapiens
PRDEAQGPV

SEQ ID NO: 977005 - protein, 9 aa, Homo Sapiens
LDSIRIGRY

SEQ ID NO: 977006 - protein, 9 aa, Homo Sapiens
TRRSGSRGS

SEQ ID NO: 977007 - protein, 9 aa, Homo Sapiens
CKIIRVCKG

SEQ ID NO: 977008 - protein, 9 aa, Homo Sapiens
YCLISAKMP

SEQ ID NO: 977009 - protein, 9 aa, Homo Sapiens
AENPTAGVG

SEQ ID NO: 977010 - protein, 9 aa, Homo Sapiens
VFCQKVEMS

SEQ ID NO: 977011 - protein, 9 aa, Homo Sapiens
SLGVDSPSA

SEQ ID NO: 977012 - protein, 9 aa, Homo Sapiens
ENPNEELSK

SEQ ID NO: 977013 - protein, 9 aa, Homo Sapiens
FARGGRAGF

SEQ ID NO: 977014 - protein, 9 aa, Homo Sapiens
NPFNEKPAE

SEQ ID NO: 977015 - protein, 9 aa, Homo Sapiens
LPTYSKRTL

SEQ ID NO: 977016 - protein, 9 aa, Homo Sapiens
RFYNYTLCW

SEQ ID NO: 977017 - protein, 9 aa, Homo Sapiens
KENFTADHP

SEQ ID NO: 977018 - protein, 9 aa, Homo Sapiens
IYYQLSSSF

SEQ ID NO: 977019 - protein, 9 aa, Homo Sapiens
DKFTEDEKK

SEQ ID NO: 977020 - protein, 9 aa, Homo Sapiens
PREGHALPQ

SEQ ID NO: 977021 - protein, 9 aa, Homo Sapiens
GDYASVKKF

SEQ ID NO: 977022 - protein, 9 aa, Homo Sapiens
GNPGLPRIP

SEQ ID NO: 977023 - protein, 9 aa, Homo Sapiens
IFTPYFAAF

SEQ ID NO: 977024 - protein, 9 aa, Homo Sapiens
NKKLQGGFM

SEQ ID NO: 977025 - protein, 9 aa, Homo Sapiens
FIYKCDAVV

SEQ ID NO: 977026 - protein, 9 aa, Homo Sapiens
KKKVSFLNI

SEQ ID NO: 977027 - protein, 9 aa, Homo Sapiens
KVPDGYSVS

SEQ ID NO: 977028 - protein, 9 aa, Homo Sapiens
LAENERMKG

SEQ ID NO: 977029 - protein, 9 aa, Homo Sapiens
SAVSSPTQL

SEQ ID NO: 977030 - protein, 9 aa, Homo Sapiens
SVRRNIKKV

SEQ ID NO: 977031 - protein, 9 aa, Homo Sapiens
VYLGIAVSK

SEQ ID NO: 977032 - protein, 9 aa, Homo Sapiens
KCQIEISSP

SEQ ID NO: 977033 - protein, 9 aa, Homo Sapiens
VVAAPGSSY

SEQ ID NO: 977034 - protein, 9 aa, Homo Sapiens
TDYQKLNFE

SEQ ID NO: 977035 - protein, 9 aa, Homo Sapiens
FSSFVILDN

SEQ ID NO: 977036 - protein, 9 aa, Homo Sapiens
GLPRIPGQD

SEQ ID NO: 977037 - protein, 9 aa, Homo Sapiens
STLMAPTFL

SEQ ID NO: 977038 - protein, 9 aa, Homo Sapiens
SMIYLTPTQ

SEQ ID NO: 977039 - protein, 9 aa, Homo Sapiens
EKEWQAAVK

SEQ ID NO: 977040 - protein, 9 aa, Homo Sapiens
SASLHGGNL

SEQ ID NO: 977041 - protein, 9 aa, Homo Sapiens
GYAEVGRAL

SEQ ID NO: 977042 - protein, 9 aa, Homo Sapiens
DGGSPLLWA

SEQ ID NO: 977043 - protein, 9 aa, Homo Sapiens
EPSSQYSAG

SEQ ID NO: 977044 - protein, 9 aa, Homo Sapiens
TSPTKMDLL

SEQ ID NO: 977045 - protein, 9 aa, Homo Sapiens
GNVSFECEN

SEQ ID NO: 977046 - protein, 9 aa, Homo Sapiens
ELAGNGSRD

SEQ ID NO: 977047 - protein, 9 aa, Homo Sapiens
DSLPFFRVS

SEQ ID NO: 977048 - protein, 9 aa, Homo Sapiens
FPILHRGLV

SEQ ID NO: 977049 - protein, 9 aa, Homo Sapiens
KFGSHPGSV

SEQ ID NO: 977050 - protein, 9 aa, Homo Sapiens
LMSKLVPAI

SEQ ID NO: 977051 - protein, 9 aa, Homo Sapiens
FVSLAPWEV

SEQ ID NO: 977052 - protein, 9 aa, Homo Sapiens
VINSRACYA

SEQ ID NO: 977053 - protein, 9 aa, Homo Sapiens
HAAVTGFSV

SEQ ID NO: 977054 - protein, 9 aa, Homo Sapiens
KVARRAEKL

SEQ ID NO: 977055 - protein, 9 aa, Homo Sapiens
TLQFRPGYN

SEQ ID NO: 977056 - protein, 9 aa, Homo Sapiens
DSGEENTKN

SEQ ID NO: 977057 - protein, 9 aa, Homo Sapiens
EMLLQADLP

SEQ ID NO: 977058 - protein, 9 aa, Homo Sapiens
RSIGDVTIA

SEQ ID NO: 977059 - protein, 9 aa, Homo Sapiens
SSSTLERGQ

SEQ ID NO: 977060 - protein, 9 aa, Homo Sapiens
DTAIPAPTA

SEQ ID NO: 977061 - protein, 9 aa, Homo Sapiens
MRVKDSTKA

SEQ ID NO: 977062 - protein, 9 aa, Homo Sapiens
GARHLGYTF

SEQ ID NO: 977063 - protein, 9 aa, Homo Sapiens
DSDEKNCGC

SEQ ID NO: 977064 - protein, 9 aa, Homo Sapiens
LFGKEQSFT

SEQ ID NO: 977065 - protein, 9 aa, Homo Sapiens
GSYYRVSFS

SEQ ID NO: 977066 - protein, 9 aa, Homo Sapiens
ILLCKKYTQ

SEQ ID NO: 977067 - protein, 9 aa, Homo Sapiens
IRILKPLEN

SEQ ID NO: 977068 - protein, 9 aa, Homo Sapiens
TIAFCQRNS

SEQ ID NO: 977069 - protein, 9 aa, Homo Sapiens
DRYVAICHL

SEQ ID NO: 977070 - protein, 9 aa, Homo Sapiens
PTKAKKDWC

SEQ ID NO: 977071 - protein, 9 aa, Homo Sapiens
GGSNNIEGI

SEQ ID NO: 977072 - protein, 9 aa, Homo Sapiens
HLENLEEPP

SEQ ID NO: 977073 - protein, 9 aa, Homo Sapiens
SLFITTRPL

SEQ ID NO: 977074 - protein, 9 aa, Homo Sapiens
KPRPKSPSF

SEQ ID NO: 977075 - protein, 9 aa, Homo Sapiens
SLHEPPKLF

SEQ ID NO: 977076 - protein, 9 aa, Homo Sapiens
EKKDSQLMT

SEQ ID NO: 977077 - protein, 9 aa, Homo Sapiens
VETIAFCQR

SEQ ID NO: 977078 - protein, 9 aa, Homo Sapiens
MTATFSSRT

SEQ ID NO: 977079 - protein, 9 aa, Homo Sapiens
DSGKLSQLH

SEQ ID NO: 977080 - protein, 9 aa, Homo Sapiens
FKRFLTIDH

SEQ ID NO: 977081 - protein, 9 aa, Homo Sapiens
KPLENKETK

SEQ ID NO: 977082 - protein, 9 aa, Homo Sapiens
RLSRLNGAT

SEQ ID NO: 977083 - protein, 9 aa, Homo Sapiens
LHLAQTERT

SEQ ID NO: 977084 - protein, 9 aa, Homo Sapiens
VFCQQPLSE

SEQ ID NO: 977085 - protein, 9 aa, Homo Sapiens
SADAKKNPA

SEQ ID NO: 977086 - protein, 9 aa, Homo Sapiens
FLFGLLSPR

SEQ ID NO: 977087 - protein, 9 aa, Homo Sapiens
LSSDEDLKI

SEQ ID NO: 977088 - protein, 9 aa, Homo Sapiens
PFLFPLFPG

SEQ ID NO: 977089 - protein, 9 aa, Homo Sapiens
RERIRMQSL

SEQ ID NO: 977090 - protein, 9 aa, Homo Sapiens
NRRPCFLAL

SEQ ID NO: 977091 - protein, 9 aa, Homo Sapiens
SQPEGEARV

SEQ ID NO: 977092 - protein, 9 aa, Homo Sapiens
VAQLCGAGM

SEQ ID NO: 977093 - protein, 9 aa, Homo Sapiens
PGVLPTYSK

SEQ ID NO: 977094 - protein, 9 aa, Homo Sapiens
NKGAKPNSR

SEQ ID NO: 977095 - protein, 9 aa, Homo Sapiens
VKNASLFLQ

SEQ ID NO: 977096 - protein, 9 aa, Homo Sapiens
MQKVEHALS

SEQ ID NO: 977097 - protein, 9 aa, Homo Sapiens
SVQTPDPSR

SEQ ID NO: 977098 - protein, 9 aa, Homo Sapiens
GPPGLVGAN

SEQ ID NO: 977099 - protein, 9 aa, Homo Sapiens
NRLTLTEKA

SEQ ID NO: 977100 - protein, 9 aa, Homo Sapiens
ALKRYSEQA

SEQ ID NO: 977101 - protein, 9 aa, Homo Sapiens
LHSKFPAER

SEQ ID NO: 977102 - protein, 9 aa, Homo Sapiens
DFSVENPEQ

SEQ ID NO: 977103 - protein, 9 aa, Homo Sapiens
WQAAVKPPP

SEQ ID NO: 977104 - protein, 9 aa, Homo Sapiens
GHHQFLGDQ

SEQ ID NO: 977105 - protein, 9 aa, Homo Sapiens
VPLAEKEDF

SEQ ID NO: 977106 - protein, 9 aa, Homo Sapiens
RVFNVLSST

SEQ ID NO: 977107 - protein, 9 aa, Homo Sapiens
KARKHRHLC

SEQ ID NO: 977108 - protein, 9 aa, Homo Sapiens
VVCTLPLGV

SEQ ID NO: 977109 - protein, 9 aa, Homo Sapiens
GMTFVILFH

SEQ ID NO: 977110 - protein, 9 aa, Homo Sapiens
RERIFAHNS

SEQ ID NO: 977111 - protein, 9 aa, Homo Sapiens
KHSPIKEES

SEQ ID NO: 977112 - protein, 9 aa, Homo Sapiens
MCRDMKQKG

SEQ ID NO: 977113 - protein, 9 aa, Homo Sapiens
SSSFYSAYY

SEQ ID NO: 977114 - protein, 9 aa, Homo Sapiens
IQKSVGPAS

SEQ ID NO: 977115 - protein, 9 aa, Homo Sapiens
KKVEKGCLG

SEQ ID NO: 977116 - protein, 9 aa, Homo Sapiens
DWLDSIRIG

SEQ ID NO: 977117 - protein, 9 aa, Homo Sapiens
WGPFNLVYG

SEQ ID NO: 977118 - protein, 9 aa, Homo Sapiens
KCKLAIIHC

SEQ ID NO: 977119 - protein, 9 aa, Homo Sapiens
SSFKDSRPS

SEQ ID NO: 977120 - protein, 9 aa, Homo Sapiens
CFLALEVDE

SEQ ID NO: 977121 - protein, 9 aa, Homo Sapiens
PAPMNKNLN

SEQ ID NO: 977122 - protein, 9 aa, Homo Sapiens
LTVQELRVR

SEQ ID NO: 977123 - protein, 9 aa, Homo Sapiens
GEAKHCFIA

SEQ ID NO: 977124 - protein, 9 aa, Homo Sapiens
ALKGEGTRS

SEQ ID NO: 977125 - protein, 9 aa, Homo Sapiens
NLCLLSFPF

SEQ ID NO: 977126 - protein, 9 aa, Homo Sapiens
CFNELKVCI

SEQ ID NO: 977127 - protein, 9 aa, Homo Sapiens
TDQTGRRRD

SEQ ID NO: 977128 - protein, 9 aa, Homo Sapiens
KIFKDNEFE

SEQ ID NO: 977129 - protein, 9 aa, Homo Sapiens
HLPLKALRE

SEQ ID NO: 977130 - protein, 9 aa, Homo Sapiens
SNGIYYQLS

SEQ ID NO: 977131 - protein, 9 aa, Homo Sapiens
AMFSESSTM

SEQ ID NO: 977132 - protein, 9 aa, Homo Sapiens
MSHPLPPGT

SEQ ID NO: 977133 - protein, 9 aa, Homo Sapiens
FFQDNSRYS

SEQ ID NO: 977134 - protein, 9 aa, Homo Sapiens
VNTTGIIET

SEQ ID NO: 977135 - protein, 9 aa, Homo Sapiens
LMAYWKKES

SEQ ID NO: 977136 - protein, 9 aa, Homo Sapiens
NSKGGGNQI

SEQ ID NO: 977137 - protein, 9 aa, Homo Sapiens
TTVETEDFS

SEQ ID NO: 977138 - protein, 9 aa, Homo Sapiens
SALPPVSSS

SEQ ID NO: 977139 - protein, 9 aa, Homo Sapiens
DPALRDVLD

SEQ ID NO: 977140 - protein, 9 aa, Homo Sapiens
FKVIQKSVG

SEQ ID NO: 977141 - protein, 9 aa, Homo Sapiens
IHMGSGESH

SEQ ID NO: 977142 - protein, 9 aa, Homo Sapiens
PPRCCSCNI

SEQ ID NO: 977143 - protein, 9 aa, Homo Sapiens
TNNKLEVLT

SEQ ID NO: 977144 - protein, 9 aa, Homo Sapiens
NPDLYLKIS

SEQ ID NO: 977145 - protein, 9 aa, Homo Sapiens
NADSSSLFP

SEQ ID NO: 977146 - protein, 9 aa, Homo Sapiens
FVQTLKGCE

SEQ ID NO: 977147 - protein, 9 aa, Homo Sapiens
VNWAAAGDH

SEQ ID NO: 977148 - protein, 9 aa, Homo Sapiens
HSHVEKDTD

SEQ ID NO: 977149 - protein, 9 aa, Homo Sapiens
PVSKSALIP

SEQ ID NO: 977150 - protein, 9 aa, Homo Sapiens
KEKLIFSYV

SEQ ID NO: 977151 - protein, 9 aa, Homo Sapiens
AGESTETGN

SEQ ID NO: 977152 - protein, 9 aa, Homo Sapiens
EQEEEEEKK

SEQ ID NO: 977153 - protein, 9 aa, Homo Sapiens
GIFPFTLKI

SEQ ID NO: 977154 - protein, 9 aa, Homo Sapiens
GIRPHDIFC

SEQ ID NO: 977155 - protein, 9 aa, Homo Sapiens
YDKDRNLRP

SEQ ID NO: 977156 - protein, 9 aa, Homo Sapiens
TLKGCEDQA

SEQ ID NO: 977157 - protein, 9 aa, Homo Sapiens
VNVGVAEVK

SEQ ID NO: 977158 - protein, 9 aa, Homo Sapiens
CSVLEESES

SEQ ID NO: 977159 - protein, 9 aa, Homo Sapiens
QKMRKAETE

SEQ ID NO: 977160 - protein, 9 aa, Homo Sapiens
LGSCVATEE

SEQ ID NO: 977161 - protein, 9 aa, Homo Sapiens
EEEREDDAF

SEQ ID NO: 977162 - protein, 9 aa, Homo Sapiens
EDTVCSSQE

SEQ ID NO: 977163 - protein, 9 aa, Homo Sapiens
FSAVSSPTQ

SEQ ID NO: 977164 - protein, 9 aa, Homo Sapiens
KDVNGLEPL

SEQ ID NO: 977165 - protein, 9 aa, Homo Sapiens
EARRKMREC

SEQ ID NO: 977166 - protein, 9 aa, Homo Sapiens
STCGTHFIV

SEQ ID NO: 977167 - protein, 9 aa, Homo Sapiens
SLAPWEVGA

SEQ ID NO: 977168 - protein, 9 aa, Homo Sapiens
ADSFCPSTS

SEQ ID NO: 977169 - protein, 9 aa, Homo Sapiens
RIGRYRDHF

SEQ ID NO: 977170 - protein, 9 aa, Homo Sapiens
TPKEMSRET

SEQ ID NO: 977171 - protein, 9 aa, Homo Sapiens
VFHLQATSD

SEQ ID NO: 977172 - protein, 9 aa, Homo Sapiens
PGTPMSHPL

SEQ ID NO: 977173 - protein, 9 aa, Homo Sapiens
LRKTKTSPC

SEQ ID NO: 977174 - protein, 9 aa, Homo Sapiens
EETDDIQGE

SEQ ID NO: 977175 - protein, 9 aa, Homo Sapiens
IYCYALLVP

SEQ ID NO: 977176 - protein, 9 aa, Homo Sapiens
LGLEQRFLR

SEQ ID NO: 977177 - protein, 9 aa, Homo Sapiens
DEFAIAKYN

SEQ ID NO: 977178 - protein, 9 aa, Homo Sapiens
GGRSRGTGS

SEQ ID NO: 977179 - protein, 9 aa, Homo Sapiens
SELLPVIIV

SEQ ID NO: 977180 - protein, 9 aa, Homo Sapiens
RARRCRAGG

SEQ ID NO: 977181 - protein, 9 aa, Homo Sapiens
QSWLLAPTL

SEQ ID NO: 977182 - protein, 9 aa, Homo Sapiens
DMDDYIFTY

SEQ ID NO: 977183 - protein, 9 aa, Homo Sapiens
VQGMMAKGT

SEQ ID NO: 977184 - protein, 9 aa, Homo Sapiens
MPTDGAKKP

SEQ ID NO: 977185 - protein, 9 aa, Homo Sapiens
TFVGLPQNL

SEQ ID NO: 977186 - protein, 9 aa, Homo Sapiens
TNRSFVKTP

SEQ ID NO: 977187 - protein, 9 aa, Homo Sapiens
EFFAVVMRT

SEQ ID NO: 977188 - protein, 9 aa, Homo Sapiens
IVLQNDNAK

SEQ ID NO: 977189 - protein, 9 aa, Homo Sapiens
VIMQKVEHA

SEQ ID NO: 977190 - protein, 9 aa, Homo Sapiens
NKKIVRNIC

SEQ ID NO: 977191 - protein, 9 aa, Homo Sapiens
AGLKQVIIL

SEQ ID NO: 977192 - protein, 9 aa, Homo Sapiens
RRANCRKQE

SEQ ID NO: 977193 - protein, 9 aa, Homo Sapiens
QAKTTTLSF

SEQ ID NO: 977194 - protein, 9 aa, Homo Sapiens
PTRGHSIAG

SEQ ID NO: 977195 - protein, 9 aa, Homo Sapiens
PTIHWKGNF

SEQ ID NO: 977196 - protein, 9 aa, Homo Sapiens
FYFLGSTEC

SEQ ID NO: 977197 - protein, 9 aa, Homo Sapiens
FYHHGEMSL

SEQ ID NO: 977198 - protein, 9 aa, Homo Sapiens
LWVRVCAAG

SEQ ID NO: 977199 - protein, 9 aa, Homo Sapiens
KDESTVSIC

SEQ ID NO: 977200 - protein, 9 aa, Homo Sapiens
PTDQTGRRR

SEQ ID NO: 977201 - protein, 9 aa, Homo Sapiens
RVFYFMVET

SEQ ID NO: 977202 - protein, 9 aa, Homo Sapiens
EPLSAPAME

SEQ ID NO: 977203 - protein, 9 aa, Homo Sapiens
KEDVLQDLL

SEQ ID NO: 977204 - protein, 9 aa, Homo Sapiens
TESGHLPRD

SEQ ID NO: 977205 - protein, 9 aa, Homo Sapiens
PSEPPTATS

SEQ ID NO: 977206 - protein, 9 aa, Homo Sapiens
VIFAAKAKE

SEQ ID NO: 977207 - protein, 9 aa, Homo Sapiens
KHKIIHVGE

SEQ ID NO: 977208 - protein, 9 aa, Homo Sapiens
GVEPDLIRE

SEQ ID NO: 977209 - protein, 9 aa, Homo Sapiens
SPKPITVGL

SEQ ID NO: 977210 - protein, 9 aa, Homo Sapiens
YRLWKKFHI

SEQ ID NO: 977211 - protein, 9 aa, Homo Sapiens
VSCPRCVRR

SEQ ID NO: 977212 - protein, 9 aa, Homo Sapiens
ENKETKVDT

SEQ ID NO: 977213 - protein, 9 aa, Homo Sapiens
GRVSHFPCY

SEQ ID NO: 977214 - protein, 9 aa, Homo Sapiens
SFSFDGWKI

SEQ ID NO: 977215 - protein, 9 aa, Homo Sapiens
LCKARKHRH

SEQ ID NO: 977216 - protein, 9 aa, Homo Sapiens
IVHKKFDDD

SEQ ID NO: 977217 - protein, 9 aa, Homo Sapiens
VPREVSCVD

SEQ ID NO: 977218 - protein, 9 aa, Homo Sapiens
QKNLQDRKS

SEQ ID NO: 977219 - protein, 9 aa, Homo Sapiens
SSLLASPPL

SEQ ID NO: 977220 - protein, 9 aa, Homo Sapiens
SSAQKASLC

SEQ ID NO: 977221 - protein, 9 aa, Homo Sapiens
VRIIKAVRA

SEQ ID NO: 977222 - protein, 9 aa, Homo Sapiens
LIFSYVELD

SEQ ID NO: 977223 - protein, 9 aa, Homo Sapiens
GLMASIERK

SEQ ID NO: 977224 - protein, 9 aa, Homo Sapiens
FMTLQWHLY

SEQ ID NO: 977225 - protein, 9 aa, Homo Sapiens
EQLVESHPN

SEQ ID NO: 977226 - protein, 9 aa, Homo Sapiens
GGRAGFLFF

SEQ ID NO: 977227 - protein, 9 aa, Homo Sapiens
EYFFDRDPK

SEQ ID NO: 977228 - protein, 9 aa, Homo Sapiens
YLFAFFSFF

SEQ ID NO: 977229 - protein, 9 aa, Homo Sapiens
RNFGASDSS

SEQ ID NO: 977230 - protein, 9 aa, Homo Sapiens
PASASMPTD

SEQ ID NO: 977231 - protein, 9 aa, Homo Sapiens
AFTCFLLGV

SEQ ID NO: 977232 - protein, 9 aa, Homo Sapiens
SPDGVYTDD

SEQ ID NO: 977233 - protein, 9 aa, Homo Sapiens
KHLSEPPRD

SEQ ID NO: 977234 - protein, 9 aa, Homo Sapiens
KLNFETTRG

SEQ ID NO: 977235 - protein, 9 aa, Homo Sapiens
DESDHIIMI

SEQ ID NO: 977236 - protein, 9 aa, Homo Sapiens
DTHQPPGAA

SEQ ID NO: 977237 - protein, 9 aa, Homo Sapiens
AGSPTKAKK

SEQ ID NO: 977238 - protein, 9 aa, Homo Sapiens
KNPTVLELR

SEQ ID NO: 977239 - protein, 9 aa, Homo Sapiens
NIDMPELFS

SEQ ID NO: 977240 - protein, 9 aa, Homo Sapiens
STMPNGKVF

SEQ ID NO: 977241 - protein, 9 aa, Homo Sapiens
LSGRVDFDD

SEQ ID NO: 977242 - protein, 9 aa, Homo Sapiens
AFADSFCPS

SEQ ID NO: 977243 - protein, 9 aa, Homo Sapiens
NMEQIEPSV

SEQ ID NO: 977244 - protein, 9 aa, Homo Sapiens
SGNYSVTKN

SEQ ID NO: 977245 - protein, 9 aa, Homo Sapiens
IIYTDTLRT

SEQ ID NO: 977246 - protein, 9 aa, Homo Sapiens
PAAKIYTEL

SEQ ID NO: 977247 - protein, 9 aa, Homo Sapiens
RSSNKETFT

SEQ ID NO: 977248 - protein, 9 aa, Homo Sapiens
RALLDKGAD

SEQ ID NO: 977249 - protein, 9 aa, Homo Sapiens
RGGRAGFLF

SEQ ID NO: 977250 - protein, 9 aa, Homo Sapiens
FGKFSRNSE

SEQ ID NO: 977251 - protein, 9 aa, Homo Sapiens
LSEPPRDWF

SEQ ID NO: 977252 - protein, 9 aa, Homo Sapiens
TSSSLDDSK

SEQ ID NO: 977253 - protein, 9 aa, Homo Sapiens
FHIYWEKAE

SEQ ID NO: 977254 - protein, 9 aa, Homo Sapiens
ERGVRDLRE

SEQ ID NO: 977255 - protein, 9 aa, Homo Sapiens
GQLFKLKEH

SEQ ID NO: 977256 - protein, 9 aa, Homo Sapiens
TSQRTCCRP

SEQ ID NO: 977257 - protein, 9 aa, Homo Sapiens
DDCEELMIN

SEQ ID NO: 977258 - protein, 9 aa, Homo Sapiens
VEKGCLGWT

SEQ ID NO: 977259 - protein, 9 aa, Homo Sapiens
TYCTKQEVL

SEQ ID NO: 977260 - protein, 9 aa, Homo Sapiens
ADLFLIHPF

SEQ ID NO: 977261 - protein, 9 aa, Homo Sapiens
FPQQQQCSK

SEQ ID NO: 977262 - protein, 9 aa, Homo Sapiens
IKRENTTLE

SEQ ID NO: 977263 - protein, 9 aa, Homo Sapiens
QRDLEAFLV

SEQ ID NO: 977264 - protein, 9 aa, Homo Sapiens
RIPGQDGPP

SEQ ID NO: 977265 - protein, 9 aa, Homo Sapiens
PPERGVRDL

SEQ ID NO: 977266 - protein, 9 aa, Homo Sapiens
AHVYEKRHQ

SEQ ID NO: 977267 - protein, 9 aa, Homo Sapiens
SPHICDLRK

SEQ ID NO: 977268 - protein, 9 aa, Homo Sapiens
TNPYNYPFV

SEQ ID NO: 977269 - protein, 9 aa, Homo Sapiens
ISIWMSLKI

SEQ ID NO: 977270 - protein, 9 aa, Homo Sapiens
LSSSLPSSG

SEQ ID NO: 977271 - protein, 9 aa, Homo Sapiens
PLPELVLRK

SEQ ID NO: 977272 - protein, 9 aa, Homo Sapiens
HFKRRYPQV

SEQ ID NO: 977273 - protein, 9 aa, Homo Sapiens
PDPSRPYGF

SEQ ID NO: 977274 - protein, 9 aa, Homo Sapiens
KVFRCVLNF

SEQ ID NO: 977275 - protein, 9 aa, Homo Sapiens
SSAWFRTPG

SEQ ID NO: 977276 - protein, 9 aa, Homo Sapiens
SYVELDLHS

SEQ ID NO: 977277 - protein, 9 aa, Homo Sapiens
GLNEDIIYS

SEQ ID NO: 977278 - protein, 9 aa, Homo Sapiens
FYSAYYGKI

SEQ ID NO: 977279 - protein, 9 aa, Homo Sapiens
TIAPPEVTP

SEQ ID NO: 977280 - protein, 9 aa, Homo Sapiens
VWQKNLQDR

SEQ ID NO: 977281 - protein, 9 aa, Homo Sapiens
LLRNYTRMK

SEQ ID NO: 977282 - protein, 9 aa, Homo Sapiens
YNNKECRKV

SEQ ID NO: 977283 - protein, 9 aa, Homo Sapiens
NNKIKSFQK

SEQ ID NO: 977284 - protein, 9 aa, Homo Sapiens
EKVARRAEK

SEQ ID NO: 977285 - protein, 9 aa, Homo Sapiens
ITTNPYNYP

SEQ ID NO: 977286 - protein, 9 aa, Homo Sapiens
PCFLALEVD

SEQ ID NO: 977287 - protein, 9 aa, Homo Sapiens
TVINDSLYK

SEQ ID NO: 977288 - protein, 9 aa, Homo Sapiens
IFKCRSSNK

SEQ ID NO: 977289 - protein, 9 aa, Homo Sapiens
GLGSIPGMG

SEQ ID NO: 977290 - protein, 9 aa, Homo Sapiens
LTGHKEHTV

SEQ ID NO: 977291 - protein, 9 aa, Homo Sapiens
VRVCAAGIE

SEQ ID NO: 977292 - protein, 9 aa, Homo Sapiens
DVREVVDDW

SEQ ID NO: 977293 - protein, 9 aa, Homo Sapiens
FWRELVPGH

SEQ ID NO: 977294 - protein, 9 aa, Homo Sapiens
SESPMLQIT

SEQ ID NO: 977295 - protein, 9 aa, Homo Sapiens
HQPLGSFRV

SEQ ID NO: 977296 - protein, 9 aa, Homo Sapiens
EKHLEKLHE

SEQ ID NO: 977297 - protein, 9 aa, Homo Sapiens
SFGTELSKK

SEQ ID NO: 977298 - protein, 9 aa, Homo Sapiens
QDLLPKIIQ

SEQ ID NO: 977299 - protein, 9 aa, Homo Sapiens
PQPGFSNST

SEQ ID NO: 977300 - protein, 9 aa, Homo Sapiens
IKSSLQVFH

SEQ ID NO: 977301 - protein, 9 aa, Homo Sapiens
GVEAFPAGA

SEQ ID NO: 977302 - protein, 9 aa, Homo Sapiens
EIRMKFIKY

SEQ ID NO: 977303 - protein, 9 aa, Homo Sapiens
SFDGWKISF

SEQ ID NO: 977304 - protein, 9 aa, Homo Sapiens
VAQPAYGAD

SEQ ID NO: 977305 - protein, 9 aa, Homo Sapiens
GLAIFILGG

SEQ ID NO: 977306 - protein, 9 aa, Homo Sapiens
LEAFLVQIV

SEQ ID NO: 977307 - protein, 9 aa, Homo Sapiens
PSICFKCNR

SEQ ID NO: 977308 - protein, 9 aa, Homo Sapiens
SKRAETLGF

SEQ ID NO: 977309 - protein, 9 aa, Homo Sapiens
LQDPPLVSS

SEQ ID NO: 977310 - protein, 9 aa, Homo Sapiens
EKHKEEHGK

SEQ ID NO: 977311 - protein, 9 aa, Homo Sapiens
VGFFSAMLL

SEQ ID NO: 977312 - protein, 9 aa, Homo Sapiens
FYNYTLCWN

SEQ ID NO: 977313 - protein, 9 aa, Homo Sapiens
EESEIAKEK

SEQ ID NO: 977314 - protein, 9 aa, Homo Sapiens
PSSREDMRL

SEQ ID NO: 977315 - protein, 9 aa, Homo Sapiens
GCQLTIPFS

SEQ ID NO: 977316 - protein, 9 aa, Homo Sapiens
WMSLKIIKE

SEQ ID NO: 977317 - protein, 9 aa, Homo Sapiens
PPSHGSPTR

SEQ ID NO: 977318 - protein, 9 aa, Homo Sapiens
PELVLRKVG

SEQ ID NO: 977319 - protein, 9 aa, Homo Sapiens
GKKVDESRR

SEQ ID NO: 977320 - protein, 9 aa, Homo Sapiens
KVALLIRNM

SEQ ID NO: 977321 - protein, 9 aa, Homo Sapiens
IPSYNTIGG

SEQ ID NO: 977322 - protein, 9 aa, Homo Sapiens
HQGGSNNIE

SEQ ID NO: 977323 - protein, 9 aa, Homo Sapiens
PYLGMTNPE

SEQ ID NO: 977324 - protein, 9 aa, Homo Sapiens
QDDSRTDKL

SEQ ID NO: 977325 - protein, 9 aa, Homo Sapiens
FRICSESAN

SEQ ID NO: 977326 - protein, 9 aa, Homo Sapiens
FLERSWYAV

SEQ ID NO: 977327 - protein, 9 aa, Homo Sapiens
DKIRLEKDL

SEQ ID NO: 977328 - protein, 9 aa, Homo Sapiens
IANFIENKG

SEQ ID NO: 977329 - protein, 9 aa, Homo Sapiens
QITTLGALT

SEQ ID NO: 977330 - protein, 9 aa, Homo Sapiens
GGVYFEVHI

SEQ ID NO: 977331 - protein, 9 aa, Homo Sapiens
RNLGPLDRK

SEQ ID NO: 977332 - protein, 9 aa, Homo Sapiens
RPRVAAEPL

SEQ ID NO: 977333 - protein, 9 aa, Homo Sapiens
DVEEGVGIL

SEQ ID NO: 977334 - protein, 9 aa, Homo Sapiens
NNIEGINRE

SEQ ID NO: 977335 - protein, 9 aa, Homo Sapiens
DFCIWCELG

SEQ ID NO: 977336 - protein, 9 aa, Homo Sapiens
EKHRYTSAG

SEQ ID NO: 977337 - protein, 9 aa, Homo Sapiens
IYVEIKFTL

SEQ ID NO: 977338 - protein, 9 aa, Homo Sapiens
AQHLGGSEK

SEQ ID NO: 977339 - protein, 9 aa, Homo Sapiens
KLEEFFQDV

SEQ ID NO: 977340 - protein, 9 aa, Homo Sapiens
VHQVSRVFW

SEQ ID NO: 977341 - protein, 9 aa, Homo Sapiens
AQKIYVEIK

SEQ ID NO: 977342 - protein, 9 aa, Homo Sapiens
ELYNLSSPS

SEQ ID NO: 977343 - protein, 9 aa, Homo Sapiens
CIAQQTFKV

SEQ ID NO: 977344 - protein, 9 aa, Homo Sapiens
RQNAGILAV

SEQ ID NO: 977345 - protein, 9 aa, Homo Sapiens
KGGAVSVHA

SEQ ID NO: 977346 - protein, 9 aa, Homo Sapiens
KPTGCEEGN

SEQ ID NO: 977347 - protein, 9 aa, Homo Sapiens
LRVTNGTSN

SEQ ID NO: 977348 - protein, 9 aa, Homo Sapiens
AKVLLNKGA

SEQ ID NO: 977349 - protein, 9 aa, Homo Sapiens
WAEAEDARQ

SEQ ID NO: 977350 - protein, 9 aa, Homo Sapiens
YTPQRFLDQ

SEQ ID NO: 977351 - protein, 9 aa, Homo Sapiens
SVSRSPMPE

SEQ ID NO: 977352 - protein, 9 aa, Homo Sapiens
NMRDLMAST

SEQ ID NO: 977353 - protein, 9 aa, Homo Sapiens
DMAYCLISA

SEQ ID NO: 977354 - protein, 9 aa, Homo Sapiens
DPEDLNTVL

SEQ ID NO: 977355 - protein, 9 aa, Homo Sapiens
LAQTERTEP

SEQ ID NO: 977356 - protein, 9 aa, Homo Sapiens
ELKFSHKEK

SEQ ID NO: 977357 - protein, 9 aa, Homo Sapiens
KHCGNGVVE

SEQ ID NO: 977358 - protein, 9 aa, Homo Sapiens
SLGPPAPAD

SEQ ID NO: 977359 - protein, 9 aa, Homo Sapiens
GPAEKRVLL

SEQ ID NO: 977360 - protein, 9 aa, Homo Sapiens
TAGVGQEEE

SEQ ID NO: 977361 - protein, 9 aa, Homo Sapiens
LGLYTALLV

SEQ ID NO: 977362 - protein, 9 aa, Homo Sapiens
PSIIFIDQL

SEQ ID NO: 977363 - protein, 9 aa, Homo Sapiens
GKNWQMLAQ

SEQ ID NO: 977364 - protein, 9 aa, Homo Sapiens
ISIYCYALL

SEQ ID NO: 977365 - protein, 9 aa, Homo Sapiens
KIIVDQKQG

SEQ ID NO: 977366 - protein, 9 aa, Homo Sapiens
PEGEARVRV

SEQ ID NO: 977367 - protein, 9 aa, Homo Sapiens
AKMALLASN

SEQ ID NO: 977368 - protein, 9 aa, Homo Sapiens
TEPSSQYSA

SEQ ID NO: 977369 - protein, 9 aa, Homo Sapiens
KDAPACRIS

SEQ ID NO: 977370 - protein, 9 aa, Homo Sapiens
EKIDKVEDN

SEQ ID NO: 977371 - protein, 9 aa, Homo Sapiens
SWLEFFFTS

SEQ ID NO: 977372 - protein, 9 aa, Homo Sapiens
HTAHQRCPR

SEQ ID NO: 977373 - protein, 9 aa, Homo Sapiens
TLMDIYVHC

SEQ ID NO: 977374 - protein, 9 aa, Homo Sapiens
MPKLLYVRK

SEQ ID NO: 977375 - protein, 9 aa, Homo Sapiens
FEEETDDIQ

SEQ ID NO: 977376 - protein, 9 aa, Homo Sapiens
EASKGCQLE

SEQ ID NO: 977377 - protein, 9 aa, Homo Sapiens
DRKAIDPAL

SEQ ID NO: 977378 - protein, 9 aa, Homo Sapiens
NIEQQNSTQ

SEQ ID NO: 977379 - protein, 9 aa, Homo Sapiens
SAGHCYKFR

SEQ ID NO: 977380 - protein, 9 aa, Homo Sapiens
VSRNHNGSL

SEQ ID NO: 977381 - protein, 9 aa, Homo Sapiens
VLYFEQCRR

SEQ ID NO: 977382 - protein, 9 aa, Homo Sapiens
YYSEAFKGQ

SEQ ID NO: 977383 - protein, 9 aa, Homo Sapiens
LFTAAEFLL

SEQ ID NO: 977384 - protein, 9 aa, Homo Sapiens
QGPLGPQGP

SEQ ID NO: 977385 - protein, 9 aa, Homo Sapiens
NLVYLGIAV

SEQ ID NO: 977386 - protein, 9 aa, Homo Sapiens
KNKEQSEQK

SEQ ID NO: 977387 - protein, 9 aa, Homo Sapiens
KSMGKSQSK

SEQ ID NO: 977388 - protein, 9 aa, Homo Sapiens
MPLNLEETL

SEQ ID NO: 977389 - protein, 9 aa, Homo Sapiens
LLEKKLSLE

SEQ ID NO: 977390 - protein, 9 aa, Homo Sapiens
TFFIFLLFP

SEQ ID NO: 977391 - protein, 9 aa, Homo Sapiens
CLVRNKANA

SEQ ID NO: 977392 - protein, 9 aa, Homo Sapiens
SLWVRVCAA

SEQ ID NO: 977393 - protein, 9 aa, Homo Sapiens
RKMRECDGL

SEQ ID NO: 977394 - protein, 9 aa, Homo Sapiens
PRVIMQKVE

SEQ ID NO: 977395 - protein, 9 aa, Homo Sapiens
TKKAYKKYI

SEQ ID NO: 977396 - protein, 9 aa, Homo Sapiens
SDSLPFFRV

SEQ ID NO: 977397 - protein, 9 aa, Homo Sapiens
AETLGFGAV

SEQ ID NO: 977398 - protein, 9 aa, Homo Sapiens
DVAWTPSIG

SEQ ID NO: 977399 - protein, 9 aa, Homo Sapiens
DRYRLDDGC

SEQ ID NO: 977400 - protein, 9 aa, Homo Sapiens
ALDADTAII

SEQ ID NO: 977401 - protein, 9 aa, Homo Sapiens
PKQPMELYN

SEQ ID NO: 977402 - protein, 9 aa, Homo Sapiens
KTTIRIINL

SEQ ID NO: 977403 - protein, 9 aa, Homo Sapiens
YNACVSQIF

SEQ ID NO: 977404 - protein, 9 aa, Homo Sapiens
GKATSLDAW

SEQ ID NO: 977405 - protein, 9 aa, Homo Sapiens
ELMINATAT

SEQ ID NO: 977406 - protein, 9 aa, Homo Sapiens
NSFSNLAPG

SEQ ID NO: 977407 - protein, 9 aa, Homo Sapiens
EKTEQGFEN

SEQ ID NO: 977408 - protein, 9 aa, Homo Sapiens
ERQDLEACC

SEQ ID NO: 977409 - protein, 9 aa, Homo Sapiens
FYLLKIFFC

SEQ ID NO: 977410 - protein, 9 aa, Homo Sapiens
MKFKGNYWH

SEQ ID NO: 977411 - protein, 9 aa, Homo Sapiens
LDSEDVDVD

SEQ ID NO: 977412 - protein, 9 aa, Homo Sapiens
IEDKDFINT

SEQ ID NO: 977413 - protein, 9 aa, Homo Sapiens
PLPHVNPQR

SEQ ID NO: 977414 - protein, 9 aa, Homo Sapiens
LVPAGSAQP

SEQ ID NO: 977415 - protein, 9 aa, Homo Sapiens
SCGSLSETV

SEQ ID NO: 977416 - protein, 9 aa, Homo Sapiens
SSEFEASQV

SEQ ID NO: 977417 - protein, 9 aa, Homo Sapiens
KDLGQLFKL

SEQ ID NO: 977418 - protein, 9 aa, Homo Sapiens
SMFLSLFSR

SEQ ID NO: 977419 - protein, 9 aa, Homo Sapiens
FQQAIEKHK

SEQ ID NO: 977420 - protein, 9 aa, Homo Sapiens
PPPKREARA

SEQ ID NO: 977421 - protein, 9 aa, Homo Sapiens
AIFSIDYVT

SEQ ID NO: 977422 - protein, 9 aa, Homo Sapiens
LSEHPCETT

SEQ ID NO: 977423 - protein, 9 aa, Homo Sapiens
GDAGSRTCL

SEQ ID NO: 977424 - protein, 9 aa, Homo Sapiens
TCQKWSFTS

SEQ ID NO: 977425 - protein, 9 aa, Homo Sapiens
NITAPKTQR

SEQ ID NO: 977426 - protein, 9 aa, Homo Sapiens
QSKCRRTSE

SEQ ID NO: 977427 - protein, 9 aa, Homo Sapiens
RIKNQKVFS

SEQ ID NO: 977428 - protein, 9 aa, Homo Sapiens
TLSCVGFFS

SEQ ID NO: 977429 - protein, 9 aa, Homo Sapiens
QSEQKTSDP

SEQ ID NO: 977430 - protein, 9 aa, Homo Sapiens
GQVTYTTLF

SEQ ID NO: 977431 - protein, 9 aa, Homo Sapiens
SMNEKLMTP

SEQ ID NO: 977432 - protein, 9 aa, Homo Sapiens
FYRSYTMQL

SEQ ID NO: 977433 - protein, 9 aa, Homo Sapiens
EGDPRQSRL

SEQ ID NO: 977434 - protein, 9 aa, Homo Sapiens
NGNLRRSPG

SEQ ID NO: 977435 - protein, 9 aa, Homo Sapiens
FITTRPLAL

SEQ ID NO: 977436 - protein, 9 aa, Homo Sapiens
AWAEAEDAR

SEQ ID NO: 977437 - protein, 9 aa, Homo Sapiens
KLSQDFSQI

SEQ ID NO: 977438 - protein, 9 aa, Homo Sapiens
AGMALAALL

SEQ ID NO: 977439 - protein, 9 aa, Homo Sapiens
LEPGTMNSV

SEQ ID NO: 977440 - protein, 9 aa, Homo Sapiens
EKFSLKPGV

SEQ ID NO: 977441 - protein, 9 aa, Homo Sapiens
IQSKCRRTS

SEQ ID NO: 977442 - protein, 9 aa, Homo Sapiens
PVRTTKAER

SEQ ID NO: 977443 - protein, 9 aa, Homo Sapiens
PRFPYGYPN

SEQ ID NO: 977444 - protein, 9 aa, Homo Sapiens
NPYNYPFVS

SEQ ID NO: 977445 - protein, 9 aa, Homo Sapiens
WVLAGLYMG

SEQ ID NO: 977446 - protein, 9 aa, Homo Sapiens
FGYCWLSPA

SEQ ID NO: 977447 - protein, 9 aa, Homo Sapiens
FMERYASIA

SEQ ID NO: 977448 - protein, 9 aa, Homo Sapiens
TQREKILEA

SEQ ID NO: 977449 - protein, 9 aa, Homo Sapiens
PGYISPSHA

SEQ ID NO: 977450 - protein, 9 aa, Homo Sapiens
GVQAQMTKQ

SEQ ID NO: 977451 - protein, 9 aa, Homo Sapiens
VEKYIVHKK

SEQ ID NO: 977452 - protein, 9 aa, Homo Sapiens
LCLTWDQML

SEQ ID NO: 977453 - protein, 9 aa, Homo Sapiens
VTCVPREVS

SEQ ID NO: 977454 - protein, 9 aa, Homo Sapiens
FVDKIVIQK

SEQ ID NO: 977455 - protein, 9 aa, Homo Sapiens
RKAIDPALE

SEQ ID NO: 977456 - protein, 9 aa, Homo Sapiens
DHDFVDKIV

SEQ ID NO: 977457 - protein, 9 aa, Homo Sapiens
RLAENERMK

SEQ ID NO: 977458 - protein, 9 aa, Homo Sapiens
EFYDADGFH

SEQ ID NO: 977459 - protein, 9 aa, Homo Sapiens
PPYLQESSR

SEQ ID NO: 977460 - protein, 9 aa, Homo Sapiens
NLRRSPGPK

SEQ ID NO: 977461 - protein, 9 aa, Homo Sapiens
IFKKKVSFL

SEQ ID NO: 977462 - protein, 9 aa, Homo Sapiens
EREILGLDS

SEQ ID NO: 977463 - protein, 9 aa, Homo Sapiens
MKSGDPQET

SEQ ID NO: 977464 - protein, 9 aa, Homo Sapiens
ENGGLERKF

SEQ ID NO: 977465 - protein, 9 aa, Homo Sapiens
ADTDPALRD

SEQ ID NO: 977466 - protein, 9 aa, Homo Sapiens
ALKTVINDS

SEQ ID NO: 977467 - protein, 9 aa, Homo Sapiens
NNEGGGEED

SEQ ID NO: 977468 - protein, 9 aa, Homo Sapiens
DSGNKPLGL

SEQ ID NO: 977469 - protein, 9 aa, Homo Sapiens
KLNSEYFMA

SEQ ID NO: 977470 - protein, 9 aa, Homo Sapiens
TQKDKDNFS

SEQ ID NO: 977471 - protein, 9 aa, Homo Sapiens
PKDYMIPLK

SEQ ID NO: 977472 - protein, 9 aa, Homo Sapiens
REESSCDRL

SEQ ID NO: 977473 - protein, 9 aa, Homo Sapiens
AGVGQEEEE

SEQ ID NO: 977474 - protein, 9 aa, Homo Sapiens
EERKVVVEE

SEQ ID NO: 977475 - protein, 9 aa, Homo Sapiens
RDGVSLCSS

SEQ ID NO: 977476 - protein, 9 aa, Homo Sapiens
VQEENPNEE

SEQ ID NO: 977477 - protein, 9 aa, Homo Sapiens
EDALCQYFS

SEQ ID NO: 977478 - protein, 9 aa, Homo Sapiens
VVMRTGISA

SEQ ID NO: 977479 - protein, 9 aa, Homo Sapiens
TTCFEEETD

SEQ ID NO: 977480 - protein, 9 aa, Homo Sapiens
PPKLFETVR

SEQ ID NO: 977481 - protein, 9 aa, Homo Sapiens
SIIFIDQLD

SEQ ID NO: 977482 - protein, 9 aa, Homo Sapiens
LAGGVDTTF

SEQ ID NO: 977483 - protein, 9 aa, Homo Sapiens
LCNYHLPFT

SEQ ID NO: 977484 - protein, 9 aa, Homo Sapiens
YTISGLRGL

SEQ ID NO: 977485 - protein, 9 aa, Homo Sapiens
CLISAKMPE

SEQ ID NO: 977486 - protein, 9 aa, Homo Sapiens
RTDYQKLNF

SEQ ID NO: 977487 - protein, 9 aa, Homo Sapiens
PITVGLGAF

SEQ ID NO: 977488 - protein, 9 aa, Homo Sapiens
AAQQLHLKI

SEQ ID NO: 977489 - protein, 9 aa, Homo Sapiens
QLASVIFIC

SEQ ID NO: 977490 - protein, 9 aa, Homo Sapiens
APGSSYHRL

SEQ ID NO: 977491 - protein, 9 aa, Homo Sapiens
LHHSASNTS

SEQ ID NO: 977492 - protein, 9 aa, Homo Sapiens
HNKIPYESP

SEQ ID NO: 977493 - protein, 9 aa, Homo Sapiens
VFYFMVETA

SEQ ID NO: 977494 - protein, 9 aa, Homo Sapiens
RDFFFLLSK

SEQ ID NO: 977495 - protein, 9 aa, Homo Sapiens
SQDVAVFPQ

SEQ ID NO: 977496 - protein, 9 aa, Homo Sapiens
RLSQTYFYR

SEQ ID NO: 977497 - protein, 9 aa, Homo Sapiens
ANFNKTNEL

SEQ ID NO: 977498 - protein, 9 aa, Homo Sapiens
SFLSSLKSK

SEQ ID NO: 977499 - protein, 9 aa, Homo Sapiens
HLAQTERTE

SEQ ID NO: 977500 - protein, 9 aa, Homo Sapiens
ATTGGPRRL

SEQ ID NO: 977501 - protein, 9 aa, Homo Sapiens
PREVSCVDG

SEQ ID NO: 977502 - protein, 9 aa, Homo Sapiens
KDDANVRTP

SEQ ID NO: 977503 - protein, 9 aa, Homo Sapiens
LEKHLEKLH

SEQ ID NO: 977504 - protein, 9 aa, Homo Sapiens
CEVAQAQTK

SEQ ID NO: 977505 - protein, 9 aa, Homo Sapiens
SIPMSRILP

SEQ ID NO: 977506 - protein, 9 aa, Homo Sapiens
WNLVCDQKW

SEQ ID NO: 977507 - protein, 9 aa, Homo Sapiens
PQVPLDGGV

SEQ ID NO: 977508 - protein, 9 aa, Homo Sapiens
SKFKENTSN

SEQ ID NO: 977509 - protein, 9 aa, Homo Sapiens
LGDIFRWKG

SEQ ID NO: 977510 - protein, 9 aa, Homo Sapiens
IGAYAVSIF

SEQ ID NO: 977511 - protein, 9 aa, Homo Sapiens
LCSVFATNN

SEQ ID NO: 977512 - protein, 9 aa, Homo Sapiens
CSTFFSRRI

SEQ ID NO: 977513 - protein, 9 aa, Homo Sapiens
RFLTIDHVV

SEQ ID NO: 977514 - protein, 9 aa, Homo Sapiens
YSAGNFWNI

SEQ ID NO: 977515 - protein, 9 aa, Homo Sapiens
TPTLPGSAA

SEQ ID NO: 977516 - protein, 9 aa, Homo Sapiens
REEFLRTVE

SEQ ID NO: 977517 - protein, 9 aa, Homo Sapiens
NGGLERKFS

SEQ ID NO: 977518 - protein, 9 aa, Homo Sapiens
SQDFSQIEL

SEQ ID NO: 977519 - protein, 9 aa, Homo Sapiens
SVLEPGRPV

SEQ ID NO: 977520 - protein, 9 aa, Homo Sapiens
LYLKISIQP

SEQ ID NO: 977521 - protein, 9 aa, Homo Sapiens
PHTAHQRCP

SEQ ID NO: 977522 - protein, 9 aa, Homo Sapiens
LGLIFDRVD

SEQ ID NO: 977523 - protein, 9 aa, Homo Sapiens
EEDRDDLWD

SEQ ID NO: 977524 - protein, 9 aa, Homo Sapiens
DVLQDLLPK

SEQ ID NO: 977525 - protein, 9 aa, Homo Sapiens
ETHYEEQIG

SEQ ID NO: 977526 - protein, 9 aa, Homo Sapiens
SGKCKQLSR

SEQ ID NO: 977527 - protein, 9 aa, Homo Sapiens
LDRHEDSAM

SEQ ID NO: 977528 - protein, 9 aa, Homo Sapiens
PAHVYLPFY

SEQ ID NO: 977529 - protein, 9 aa, Homo Sapiens
PGPFGPPGP

SEQ ID NO: 977530 - protein, 9 aa, Homo Sapiens
SSSLPSSGE

SEQ ID NO: 977531 - protein, 9 aa, Homo Sapiens
HRMQKKIAA

SEQ ID NO: 977532 - protein, 9 aa, Homo Sapiens
NICSTFFSR

SEQ ID NO: 977533 - protein, 9 aa, Homo Sapiens
GSGEILEGP

SEQ ID NO: 977534 - protein, 9 aa, Homo Sapiens
KGAEDALDA

SEQ ID NO: 977535 - protein, 9 aa, Homo Sapiens
QRSQTDERL

SEQ ID NO: 977536 - protein, 9 aa, Homo Sapiens
ARHLGYTFC

SEQ ID NO: 977537 - protein, 9 aa, Homo Sapiens
GCWGFWRWN

SEQ ID NO: 977538 - protein, 9 aa, Homo Sapiens
SEHDGNCRE

SEQ ID NO: 977539 - protein, 9 aa, Homo Sapiens
CNISIQSKC

SEQ ID NO: 977540 - protein, 9 aa, Homo Sapiens
ENFSAVSSP

SEQ ID NO: 977541 - protein, 9 aa, Homo Sapiens
CQRKQNTSR

SEQ ID NO: 977542 - protein, 9 aa, Homo Sapiens
VIENKVCNH

SEQ ID NO: 977543 - protein, 9 aa, Homo Sapiens
FSISEAFSG

SEQ ID NO: 977544 - protein, 9 aa, Homo Sapiens
CCSCNISIQ

SEQ ID NO: 977545 - protein, 9 aa, Homo Sapiens
EELTEALRD

SEQ ID NO: 977546 - protein, 9 aa, Homo Sapiens
VHSSTRLPH

SEQ ID NO: 977547 - protein, 9 aa, Homo Sapiens
VFFCVKKGE

SEQ ID NO: 977548 - protein, 9 aa, Homo Sapiens
PVPPSSFLS

SEQ ID NO: 977549 - protein, 9 aa, Homo Sapiens
EMKSGDPQE

SEQ ID NO: 977550 - protein, 9 aa, Homo Sapiens
SDHIIMIDF

SEQ ID NO: 977551 - protein, 9 aa, Homo Sapiens
SLKIDLLID

SEQ ID NO: 977552 - protein, 9 aa, Homo Sapiens
KKKSSSRKG

SEQ ID NO: 977553 - protein, 9 aa, Homo Sapiens
LDDGCRVRD

SEQ ID NO: 977554 - protein, 9 aa, Homo Sapiens
AAVAGSGPA

SEQ ID NO: 977555 - protein, 9 aa, Homo Sapiens
LRFLRSLVF

SEQ ID NO: 977556 - protein, 9 aa, Homo Sapiens
TFPRVIMQK

SEQ ID NO: 977557 - protein, 9 aa, Homo Sapiens
FLLKSGAKC

SEQ ID NO: 977558 - protein, 9 aa, Homo Sapiens
FKVPDLVKI

SEQ ID NO: 977559 - protein, 9 aa, Homo Sapiens
PELHGQPGP

SEQ ID NO: 977560 - protein, 9 aa, Homo Sapiens
QNSTQIRQN

SEQ ID NO: 977561 - protein, 9 aa, Homo Sapiens
RVVNVGVAE

SEQ ID NO: 977562 - protein, 9 aa, Homo Sapiens
ASFMSHLQS

SEQ ID NO: 977563 - protein, 9 aa, Homo Sapiens
QLIYFENEK

SEQ ID NO: 977564 - protein, 9 aa, Homo Sapiens
GQHEESLQD

SEQ ID NO: 977565 - protein, 9 aa, Homo Sapiens
LNLEETLKV

SEQ ID NO: 977566 - protein, 9 aa, Homo Sapiens
KIRLEKDLS

SEQ ID NO: 977567 - protein, 9 aa, Homo Sapiens
LYTALLVML

SEQ ID NO: 977568 - protein, 9 aa, Homo Sapiens
GHHHLEIEA

SEQ ID NO: 977569 - protein, 9 aa, Homo Sapiens
DAPACRISF

SEQ ID NO: 977570 - protein, 9 aa, Homo Sapiens
VWKNFTASQ

SEQ ID NO: 977571 - protein, 9 aa, Homo Sapiens
ERGQSKERK

SEQ ID NO: 977572 - protein, 9 aa, Homo Sapiens
YGKIPKAPG

SEQ ID NO: 977573 - protein, 9 aa, Homo Sapiens
LINKFDLVC

SEQ ID NO: 977574 - protein, 9 aa, Homo Sapiens
RRDNLEALG

SEQ ID NO: 977575 - protein, 9 aa, Homo Sapiens
IGDVTIAPP

SEQ ID NO: 977576 - protein, 9 aa, Homo Sapiens
LVEKDFCLM

SEQ ID NO: 977577 - protein, 9 aa, Homo Sapiens
HQPPGAASG

SEQ ID NO: 977578 - protein, 9 aa, Homo Sapiens
AHNSVCSQE

SEQ ID NO: 977579 - protein, 9 aa, Homo Sapiens
SSCLVRNKA

SEQ ID NO: 977580 - protein, 9 aa, Homo Sapiens
KVAHDLSKS

SEQ ID NO: 977581 - protein, 9 aa, Homo Sapiens
KKDSQLMTF

SEQ ID NO: 977582 - protein, 9 aa, Homo Sapiens
GDKGPPGRK

SEQ ID NO: 977583 - protein, 9 aa, Homo Sapiens
ARSEEDRDD

SEQ ID NO: 977584 - protein, 9 aa, Homo Sapiens
FFQGRQKSK

SEQ ID NO: 977585 - protein, 9 aa, Homo Sapiens
FSMKSQAKT

SEQ ID NO: 977586 - protein, 9 aa, Homo Sapiens
DEIIQCRDG

SEQ ID NO: 977587 - protein, 9 aa, Homo Sapiens
PSSFLSSLK

SEQ ID NO: 977588 - protein, 9 aa, Homo Sapiens
NCSYTISGL

SEQ ID NO: 977589 - protein, 9 aa, Homo Sapiens
KLSNLIILE

SEQ ID NO: 977590 - protein, 9 aa, Homo Sapiens
GLLKGMRQA

SEQ ID NO: 977591 - protein, 9 aa, Homo Sapiens
NCDANLHSK

SEQ ID NO: 977592 - protein, 9 aa, Homo Sapiens
RSSSSPSGT

SEQ ID NO: 977593 - protein, 9 aa, Homo Sapiens
PEGTLGHFK

SEQ ID NO: 977594 - protein, 9 aa, Homo Sapiens
MFGSQPLLE

SEQ ID NO: 977595 - protein, 9 aa, Homo Sapiens
LVAEQVSAL

SEQ ID NO: 977596 - protein, 9 aa, Homo Sapiens
NPHAFSNQM

SEQ ID NO: 977597 - protein, 9 aa, Homo Sapiens
LDGLVWRAS

SEQ ID NO: 977598 - protein, 9 aa, Homo Sapiens
EPDGRVSHF

SEQ ID NO: 977599 - protein, 9 aa, Homo Sapiens
LSADLKQEC

SEQ ID NO: 977600 - protein, 9 aa, Homo Sapiens
VLKKEIGKL

SEQ ID NO: 977601 - protein, 9 aa, Homo Sapiens
TPLPHVNPQ

SEQ ID NO: 977602 - protein, 9 aa, Homo Sapiens
HSWSSQVEA

SEQ ID NO: 977603 - protein, 9 aa, Homo Sapiens
KHKEEHGKI

SEQ ID NO: 977604 - protein, 9 aa, Homo Sapiens
EYHDLSTLQ

SEQ ID NO: 977605 - protein, 9 aa, Homo Sapiens
VDNKKLQGG

SEQ ID NO: 977606 - protein, 9 aa, Homo Sapiens
SSLFPNGHA

SEQ ID NO: 977607 - protein, 9 aa, Homo Sapiens
VPASLVQLG

SEQ ID NO: 977608 - protein, 9 aa, Homo Sapiens
HINNHAAEL

SEQ ID NO: 977609 - protein, 9 aa, Homo Sapiens
LVLLGLYTA

SEQ ID NO: 977610 - protein, 9 aa, Homo Sapiens
GSGESHRKA

SEQ ID NO: 977611 - protein, 9 aa, Homo Sapiens
ISPSRASGP

SEQ ID NO: 977612 - protein, 9 aa, Homo Sapiens
FCIWCELGG

SEQ ID NO: 977613 - protein, 9 aa, Homo Sapiens
CFLSAGIVA

SEQ ID NO: 977614 - protein, 9 aa, Homo Sapiens
KVGWRAFLP

SEQ ID NO: 977615 - protein, 9 aa, Homo Sapiens
SASMPTDGA

SEQ ID NO: 977616 - protein, 9 aa, Homo Sapiens
VLAALLTMP

SEQ ID NO: 977617 - protein, 9 aa, Homo Sapiens
SFSDSSEEL

SEQ ID NO: 977618 - protein, 9 aa, Homo Sapiens
RKCLSLNNF

SEQ ID NO: 977619 - protein, 9 aa, Homo Sapiens
GTEKGSQDH

SEQ ID NO: 977620 - protein, 9 aa, Homo Sapiens
EVYMREKFF

SEQ ID NO: 977621 - protein, 9 aa, Homo Sapiens
DNYRNLVYL

SEQ ID NO: 977622 - protein, 9 aa, Homo Sapiens
LDTAGKEEY

SEQ ID NO: 977623 - protein, 9 aa, Homo Sapiens
LLWTWSRRA

SEQ ID NO: 977624 - protein, 9 aa, Homo Sapiens
EDFSVENPE

SEQ ID NO: 977625 - protein, 9 aa, Homo Sapiens
CWMTFFPEW

SEQ ID NO: 977626 - protein, 9 aa, Homo Sapiens
CFSLAATWS

SEQ ID NO: 977627 - protein, 9 aa, Homo Sapiens
ASDSKTKCT

SEQ ID NO: 977628 - protein, 9 aa, Homo Sapiens
AWVWAGLGG

SEQ ID NO: 977629 - protein, 9 aa, Homo Sapiens
YTFILLWTW

SEQ ID NO: 977630 - protein, 9 aa, Homo Sapiens
ILSHFQSFS

SEQ ID NO: 977631 - protein, 9 aa, Homo Sapiens
DVTIAPPEV

SEQ ID NO: 977632 - protein, 9 aa, Homo Sapiens
QHVKAIDLS

SEQ ID NO: 977633 - protein, 9 aa, Homo Sapiens
IWTYTFVFF

SEQ ID NO: 977634 - protein, 9 aa, Homo Sapiens
NCRKQENQL

SEQ ID NO: 977635 - protein, 9 aa, Homo Sapiens
LDADTAIIN

SEQ ID NO: 977636 - protein, 9 aa, Homo Sapiens
VKAIDLSRN

SEQ ID NO: 977637 - protein, 9 aa, Homo Sapiens
SGEILEGPQ

SEQ ID NO: 977638 - protein, 9 aa, Homo Sapiens
RYRLDDGCR

SEQ ID NO: 977639 - protein, 9 aa, Homo Sapiens
TEDFSVENP

SEQ ID NO: 977640 - protein, 9 aa, Homo Sapiens
MGKPELHGQ

SEQ ID NO: 977641 - protein, 9 aa, Homo Sapiens
RDAFTWSMN

SEQ ID NO: 977642 - protein, 9 aa, Homo Sapiens
KPITVGLGA

SEQ ID NO: 977643 - protein, 9 aa, Homo Sapiens
EREDDAFCQ

SEQ ID NO: 977644 - protein, 9 aa, Homo Sapiens
GFYFGVGDS

SEQ ID NO: 977645 - protein, 9 aa, Homo Sapiens
APIKDLDLE

SEQ ID NO: 977646 - protein, 9 aa, Homo Sapiens
KIPYMAACV

SEQ ID NO: 977647 - protein, 9 aa, Homo Sapiens
HRPKLIRIG

SEQ ID NO: 977648 - protein, 9 aa, Homo Sapiens
LDGPAREQP

SEQ ID NO: 977649 - protein, 9 aa, Homo Sapiens
IFGKFSRNS

SEQ ID NO: 977650 - protein, 9 aa, Homo Sapiens
ETLGFGAVT

SEQ ID NO: 977651 - protein, 9 aa, Homo Sapiens
GTPMSHPLP

SEQ ID NO: 977652 - protein, 9 aa, Homo Sapiens
PDCHLRDFE

SEQ ID NO: 977653 - protein, 9 aa, Homo Sapiens
CKKYTQKKK

SEQ ID NO: 977654 - protein, 9 aa, Homo Sapiens
EPKDDANVR

SEQ ID NO: 977655 - protein, 9 aa, Homo Sapiens
PRTPWLLVT

SEQ ID NO: 977656 - protein, 9 aa, Homo Sapiens
AKIYTELCL

SEQ ID NO: 977657 - protein, 9 aa, Homo Sapiens
KYSVFYFNF

SEQ ID NO: 977658 - protein, 9 aa, Homo Sapiens
CFLVLLGLY

SEQ ID NO: 977659 - protein, 9 aa, Homo Sapiens
LLVILPIII

SEQ ID NO: 977660 - protein, 9 aa, Homo Sapiens
SEKFWYNST

SEQ ID NO: 977661 - protein, 9 aa, Homo Sapiens
SKTSNYLIY

SEQ ID NO: 977662 - protein, 9 aa, Homo Sapiens
QRRTVHYKG

SEQ ID NO: 977663 - protein, 9 aa, Homo Sapiens
TKDAPACRI

SEQ ID NO: 977664 - protein, 9 aa, Homo Sapiens
KALRENPCF

SEQ ID NO: 977665 - protein, 9 aa, Homo Sapiens
SFYHHGEMS

SEQ ID NO: 977666 - protein, 9 aa, Homo Sapiens
SHKEKPDLE

SEQ ID NO: 977667 - protein, 9 aa, Homo Sapiens
EESSCDRLT

SEQ ID NO: 977668 - protein, 9 aa, Homo Sapiens
LEKCCQDQE

SEQ ID NO: 977669 - protein, 9 aa, Homo Sapiens
LDSEFIDSL

SEQ ID NO: 977670 - protein, 9 aa, Homo Sapiens
KRKFLELAS

SEQ ID NO: 977671 - protein, 9 aa, Homo Sapiens
GAPVRTTKA

SEQ ID NO: 977672 - protein, 9 aa, Homo Sapiens
EGTLIEPLS

SEQ ID NO: 977673 - protein, 9 aa, Homo Sapiens
IRSGNEPLS

SEQ ID NO: 977674 - protein, 9 aa, Homo Sapiens
FIFLLFPIL

SEQ ID NO: 977675 - protein, 9 aa, Homo Sapiens
KIRLPEQIY

SEQ ID NO: 977676 - protein, 9 aa, Homo Sapiens
KLTEHTPPY

SEQ ID NO: 977677 - protein, 9 aa, Homo Sapiens
MVQSNDLCS

SEQ ID NO: 977678 - protein, 9 aa, Homo Sapiens
QKQKLTEHT

SEQ ID NO: 977679 - protein, 9 aa, Homo Sapiens
KSSFKDSRP

SEQ ID NO: 977680 - protein, 9 aa, Homo Sapiens
SGSRGSDSR

SEQ ID NO: 977681 - protein, 9 aa, Homo Sapiens
ALLVPLALW

SEQ ID NO: 977682 - protein, 9 aa, Homo Sapiens
SGPGTEKGS

SEQ ID NO: 977683 - protein, 9 aa, Homo Sapiens
YDFVWNCTR

SEQ ID NO: 977684 - protein, 9 aa, Homo Sapiens
TVESPRFPY

SEQ ID NO: 977685 - protein, 9 aa, Homo Sapiens
INKFDLVCG

SEQ ID NO: 977686 - protein, 9 aa, Homo Sapiens
YNIGDVQVM

SEQ ID NO: 977687 - protein, 9 aa, Homo Sapiens
YTAIFTPYF

SEQ ID NO: 977688 - protein, 9 aa, Homo Sapiens
LQKNSQEVG

SEQ ID NO: 977689 - protein, 9 aa, Homo Sapiens
FPKKEFQAT

SEQ ID NO: 977690 - protein, 9 aa, Homo Sapiens
WKISFIPKN

SEQ ID NO: 977691 - protein, 9 aa, Homo Sapiens
PSGMTFVIL

SEQ ID NO: 977692 - protein, 9 aa, Homo Sapiens
TDLSADLKQ

SEQ ID NO: 977693 - protein, 9 aa, Homo Sapiens
NAGILAVQG

SEQ ID NO: 977694 - protein, 9 aa, Homo Sapiens
LLTMPVMVL

SEQ ID NO: 977695 - protein, 9 aa, Homo Sapiens
KVVIFAAKA

SEQ ID NO: 977696 - protein, 9 aa, Homo Sapiens
VTHGRIPYL

SEQ ID NO: 977697 - protein, 9 aa, Homo Sapiens
VHERIHFGE

SEQ ID NO: 977698 - protein, 9 aa, Homo Sapiens
EGTLGHFKR

SEQ ID NO: 977699 - protein, 9 aa, Homo Sapiens
ENDSKTPPH

SEQ ID NO: 977700 - protein, 9 aa, Homo Sapiens
DGFHQSGSS

SEQ ID NO: 977701 - protein, 9 aa, Homo Sapiens
EEEDGAFAA

SEQ ID NO: 977702 - protein, 9 aa, Homo Sapiens
GEKKEEEET

SEQ ID NO: 977703 - protein, 9 aa, Homo Sapiens
VRDVAWTPS

SEQ ID NO: 977704 - protein, 9 aa, Homo Sapiens
KFIKYLKSI

SEQ ID NO: 977705 - protein, 9 aa, Homo Sapiens
PPLSPSRRF

SEQ ID NO: 977706 - protein, 9 aa, Homo Sapiens
FPGAHVYEK

SEQ ID NO: 977707 - protein, 9 aa, Homo Sapiens
WFQNRRANC

SEQ ID NO: 977708 - protein, 9 aa, Homo Sapiens
KMDLLYSKT

SEQ ID NO: 977709 - protein, 9 aa, Homo Sapiens
SSFLSSLKS

SEQ ID NO: 977710 - protein, 9 aa, Homo Sapiens
EKIWVEEKR

SEQ ID NO: 977711 - protein, 9 aa, Homo Sapiens
FSDSSEELF

SEQ ID NO: 977712 - protein, 9 aa, Homo Sapiens
PDNLPELEE

SEQ ID NO: 977713 - protein, 9 aa, Homo Sapiens
GSLRRVMNL

SEQ ID NO: 977714 - protein, 9 aa, Homo Sapiens
IFIDQLDAI

SEQ ID NO: 977715 - protein, 9 aa, Homo Sapiens
DPYGLNFSE

SEQ ID NO: 977716 - protein, 9 aa, Homo Sapiens
IVENLKKRD

SEQ ID NO: 977717 - protein, 9 aa, Homo Sapiens
NLVPLEGKK

SEQ ID NO: 977718 - protein, 9 aa, Homo Sapiens
PMLSITIRP

SEQ ID NO: 977719 - protein, 9 aa, Homo Sapiens
LSHFQSFSY

SEQ ID NO: 977720 - protein, 9 aa, Homo Sapiens
DFKVSNGLI

SEQ ID NO: 977721 - protein, 9 aa, Homo Sapiens
SGLLRANAD

SEQ ID NO: 977722 - protein, 9 aa, Homo Sapiens
QESEEAGST

SEQ ID NO: 977723 - protein, 9 aa, Homo Sapiens
FGGDVPISS

SEQ ID NO: 977724 - protein, 9 aa, Homo Sapiens
FATNNKLEV

SEQ ID NO: 977725 - protein, 9 aa, Homo Sapiens
ATASIIEDV

SEQ ID NO: 977726 - protein, 9 aa, Homo Sapiens
EVDINGLRR

SEQ ID NO: 977727 - protein, 9 aa, Homo Sapiens
VQRDNFHWE

SEQ ID NO: 977728 - protein, 9 aa, Homo Sapiens
PASLVQLGV

SEQ ID NO: 977729 - protein, 9 aa, Homo Sapiens
ADTLFSEES

SEQ ID NO: 977730 - protein, 9 aa, Homo Sapiens
EVIIEQLVE

SEQ ID NO: 977731 - protein, 9 aa, Homo Sapiens
LEQPEKEEK

SEQ ID NO: 977732 - protein, 9 aa, Homo Sapiens
LPHTTLSPA

SEQ ID NO: 977733 - protein, 9 aa, Homo Sapiens
LQILTNPSH

SEQ ID NO: 977734 - protein, 9 aa, Homo Sapiens
SRCMIQLFF

SEQ ID NO: 977735 - protein, 9 aa, Homo Sapiens
NGIVTELCP

SEQ ID NO: 977736 - protein, 9 aa, Homo Sapiens
EPGNEAKDL

SEQ ID NO: 977737 - protein, 9 aa, Homo Sapiens
AGPALEAFS

SEQ ID NO: 977738 - protein, 9 aa, Homo Sapiens
ALLIRNMNY

SEQ ID NO: 977739 - protein, 9 aa, Homo Sapiens
PMNKNLNEL

SEQ ID NO: 977740 - protein, 9 aa, Homo Sapiens
LSEHDGNCR

SEQ ID NO: 977741 - protein, 9 aa, Homo Sapiens
RKLYDQIML

SEQ ID NO: 977742 - protein, 9 aa, Homo Sapiens
RACGLRCRN

SEQ ID NO: 977743 - protein, 9 aa, Homo Sapiens
SCNISIQSK

SEQ ID NO: 977744 - protein, 9 aa, Homo Sapiens
YSEQAFFVR

SEQ ID NO: 977745 - protein, 9 aa, Homo Sapiens
NGLEFGNGD

SEQ ID NO: 977746 - protein, 9 aa, Homo Sapiens
IYQEKIPIA

SEQ ID NO: 977747 - protein, 9 aa, Homo Sapiens
LAEYMVFGS

SEQ ID NO: 977748 - protein, 9 aa, Homo Sapiens
RGHVLSFAL

SEQ ID NO: 977749 - protein, 9 aa, Homo Sapiens
DSSRVGDSQ

SEQ ID NO: 977750 - protein, 9 aa, Homo Sapiens
QKAHEPGMD

SEQ ID NO: 977751 - protein, 9 aa, Homo Sapiens
NFHWEEYLK

SEQ ID NO: 977752 - protein, 9 aa, Homo Sapiens
ADTAVNDII

SEQ ID NO: 977753 - protein, 9 aa, Homo Sapiens
DELRLEKAR

SEQ ID NO: 977754 - protein, 9 aa, Homo Sapiens
KQECRNGSL

SEQ ID NO: 977755 - protein, 9 aa, Homo Sapiens
SLLKEFEHH

SEQ ID NO: 977756 - protein, 9 aa, Homo Sapiens
DGRGKIIPE

SEQ ID NO: 977757 - protein, 9 aa, Homo Sapiens
LVHPGHHHL

SEQ ID NO: 977758 - protein, 9 aa, Homo Sapiens
KANATRCVA

SEQ ID NO: 977759 - protein, 9 aa, Homo Sapiens
CTRGIRKDI

SEQ ID NO: 977760 - protein, 9 aa, Homo Sapiens
QITAPLPPG

SEQ ID NO: 977761 - protein, 9 aa, Homo Sapiens
PPTATSEPP

SEQ ID NO: 977762 - protein, 9 aa, Homo Sapiens
DSLSNMVLT

SEQ ID NO: 977763 - protein, 9 aa, Homo Sapiens
IKHANSVGT

SEQ ID NO: 977764 - protein, 9 aa, Homo Sapiens
GGPRRLESG

SEQ ID NO: 977765 - protein, 9 aa, Homo Sapiens
NLEALGHMF

SEQ ID NO: 977766 - protein, 9 aa, Homo Sapiens
KKRDMDDYI

SEQ ID NO: 977767 - protein, 9 aa, Homo Sapiens
CSFPHNFVL

SEQ ID NO: 977768 - protein, 9 aa, Homo Sapiens
SPSHAWSGA

SEQ ID NO: 977769 - protein, 9 aa, Homo Sapiens
LVKALRLNG

SEQ ID NO: 977770 - protein, 9 aa, Homo Sapiens
DSEDVDVDK

SEQ ID NO: 977771 - protein, 9 aa, Homo Sapiens
CQLEKTEQG

SEQ ID NO: 977772 - protein, 9 aa, Homo Sapiens
VPPRDEAQG

SEQ ID NO: 977773 - protein, 9 aa, Homo Sapiens
KKIAIRNVF

SEQ ID NO: 977774 - protein, 9 aa, Homo Sapiens
TKDSSRVGD

SEQ ID NO: 977775 - protein, 9 aa, Homo Sapiens
MEMSWARQP

SEQ ID NO: 977776 - protein, 9 aa, Homo Sapiens
KGKVPDGYS

SEQ ID NO: 977777 - protein, 9 aa, Homo Sapiens
REDTVCSSQ

SEQ ID NO: 977778 - protein, 9 aa, Homo Sapiens
PVSGNGEFQ

SEQ ID NO: 977779 - protein, 9 aa, Homo Sapiens
GRKGQPGDP

SEQ ID NO: 977780 - protein, 9 aa, Homo Sapiens
KTVINDSLY

SEQ ID NO: 977781 - protein, 9 aa, Homo Sapiens
GFQYVLECN

SEQ ID NO: 977782 - protein, 9 aa, Homo Sapiens
EAFSQLSIF

SEQ ID NO: 977783 - protein, 9 aa, Homo Sapiens
NSVRSGPFG

SEQ ID NO: 977784 - protein, 9 aa, Homo Sapiens
EDAVHIISE

SEQ ID NO: 977785 - protein, 9 aa, Homo Sapiens
GNLCLLSFP

SEQ ID NO: 977786 - protein, 9 aa, Homo Sapiens
LNKGAKPNS

SEQ ID NO: 977787 - protein, 9 aa, Homo Sapiens
LPPVSSSDS

SEQ ID NO: 977788 - protein, 9 aa, Homo Sapiens
YSGVISITM

SEQ ID NO: 977789 - protein, 9 aa, Homo Sapiens
SMFERETQR

SEQ ID NO: 977790 - protein, 9 aa, Homo Sapiens
LQPGLGDAV

SEQ ID NO: 977791 - protein, 9 aa, Homo Sapiens
MALAALLLA

SEQ ID NO: 977792 - protein, 9 aa, Homo Sapiens
RRLKFHSTI

SEQ ID NO: 977793 - protein, 9 aa, Homo Sapiens
HNSILTPTW

SEQ ID NO: 977794 - protein, 9 aa, Homo Sapiens
KLDKLNIDI

SEQ ID NO: 977795 - protein, 9 aa, Homo Sapiens
NRRANCRKQ

SEQ ID NO: 977796 - protein, 9 aa, Homo Sapiens
QNILIQMDL

SEQ ID NO: 977797 - protein, 9 aa, Homo Sapiens
TFSSRTIEI

SEQ ID NO: 977798 - protein, 9 aa, Homo Sapiens
LQHVKAIDL

SEQ ID NO: 977799 - protein, 9 aa, Homo Sapiens
GINRERVPC

SEQ ID NO: 977800 - protein, 9 aa, Homo Sapiens
FQPVQVWKN

SEQ ID NO: 977801 - protein, 9 aa, Homo Sapiens
RVAKVLLNK

SEQ ID NO: 977802 - protein, 9 aa, Homo Sapiens
VEELRKTKT

SEQ ID NO: 977803 - protein, 9 aa, Homo Sapiens
LRREPVLSF

SEQ ID NO: 977804 - protein, 9 aa, Homo Sapiens
RIRGHVLSF

SEQ ID NO: 977805 - protein, 9 aa, Homo Sapiens
PAYGADLQK

SEQ ID NO: 977806 - protein, 9 aa, Homo Sapiens
RGATLLGAW

SEQ ID NO: 977807 - protein, 9 aa, Homo Sapiens
FILLWTWSR

SEQ ID NO: 977808 - protein, 9 aa, Homo Sapiens
CADTAVNDI

SEQ ID NO: 977809 - protein, 9 aa, Homo Sapiens
SGPPRCCSC

SEQ ID NO: 977810 - protein, 9 aa, Homo Sapiens
DDSDEKNCG

SEQ ID NO: 977811 - protein, 9 aa, Homo Sapiens
KEHTVIPHS

SEQ ID NO: 977812 - protein, 9 aa, Homo Sapiens
GLVHPGHHH

SEQ ID NO: 977813 - protein, 9 aa, Homo Sapiens
CQYFSNERI

SEQ ID NO: 977814 - protein, 9 aa, Homo Sapiens
QLAISPSPP

SEQ ID NO: 977815 - protein, 9 aa, Homo Sapiens
CETCWEWQK

SEQ ID NO: 977816 - protein, 9 aa, Homo Sapiens
IPAAKIYTE

SEQ ID NO: 977817 - protein, 9 aa, Homo Sapiens
GITCQKWSF

SEQ ID NO: 977818 - protein, 9 aa, Homo Sapiens
SPTVEDTPK

SEQ ID NO: 977819 - protein, 9 aa, Homo Sapiens
LRRNEKDLE

SEQ ID NO: 977820 - protein, 9 aa, Homo Sapiens
EDNPSSLFL

SEQ ID NO: 977821 - protein, 9 aa, Homo Sapiens
QLVEVERTA

SEQ ID NO: 977822 - protein, 9 aa, Homo Sapiens
TEKAEKKRC

SEQ ID NO: 977823 - protein, 9 aa, Homo Sapiens
SKEILRPFL

SEQ ID NO: 977824 - protein, 9 aa, Homo Sapiens
CYKFRIQVR

SEQ ID NO: 977825 - protein, 9 aa, Homo Sapiens
DVNGLEPLN

SEQ ID NO: 977826 - protein, 9 aa, Homo Sapiens
WQKNLQDRK

SEQ ID NO: 977827 - protein, 9 aa, Homo Sapiens
LSKEILEKL

SEQ ID NO: 977828 - protein, 9 aa, Homo Sapiens
NTSFSKVIF

SEQ ID NO: 977829 - protein, 9 aa, Homo Sapiens
TIQTRRTAE

SEQ ID NO: 977830 - protein, 9 aa, Homo Sapiens
ERIKNQKVF

SEQ ID NO: 977831 - protein, 9 aa, Homo Sapiens
ESLVEGEKK

SEQ ID NO: 977832 - protein, 9 aa, Homo Sapiens
LTIPCYTGP

SEQ ID NO: 977833 - protein, 9 aa, Homo Sapiens
KVLLKLSRE

SEQ ID NO: 977834 - protein, 9 aa, Homo Sapiens
NDSKTPPHE

SEQ ID NO: 977835 - protein, 9 aa, Homo Sapiens
SSTLERGQM

SEQ ID NO: 977836 - protein, 9 aa, Homo Sapiens
TQSSEFEAS

SEQ ID NO: 977837 - protein, 9 aa, Homo Sapiens
ETAFANSTC

SEQ ID NO: 977838 - protein, 9 aa, Homo Sapiens
LPYFIYSCV

SEQ ID NO: 977839 - protein, 9 aa, Homo Sapiens
AYGVNPARV

SEQ ID NO: 977840 - protein, 9 aa, Homo Sapiens
RPYGFSNMR

SEQ ID NO: 977841 - protein, 9 aa, Homo Sapiens
LTLTEKAEK

SEQ ID NO: 977842 - protein, 9 aa, Homo Sapiens
EKEDLGLPG

SEQ ID NO: 977843 - protein, 9 aa, Homo Sapiens
SMIRDWLRV

SEQ ID NO: 977844 - protein, 9 aa, Homo Sapiens
LSNNSFSNL

SEQ ID NO: 977845 - protein, 9 aa, Homo Sapiens
ESIWAKYSN

SEQ ID NO: 977846 - protein, 9 aa, Homo Sapiens
AGFLFFWYG

SEQ ID NO: 977847 - protein, 9 aa, Homo Sapiens
NSEYFMAET

SEQ ID NO: 977848 - protein, 9 aa, Homo Sapiens
LSSSFLTED

SEQ ID NO: 977849 - protein, 9 aa, Homo Sapiens
RLQFGRTPT

SEQ ID NO: 977850 - protein, 9 aa, Homo Sapiens
SQLMTFNLC

SEQ ID NO: 977851 - protein, 9 aa, Homo Sapiens
ICVTEPDGR

SEQ ID NO: 977852 - protein, 9 aa, Homo Sapiens
IKEESCGSL

SEQ ID NO: 977853 - protein, 9 aa, Homo Sapiens
VKRTGQEHQ

SEQ ID NO: 977854 - protein, 9 aa, Homo Sapiens
LWKKFHIYW

SEQ ID NO: 977855 - protein, 9 aa, Homo Sapiens
ARTCEKLDK

SEQ ID NO: 977856 - protein, 9 aa, Homo Sapiens
VAGPALEAF

SEQ ID NO: 977857 - protein, 9 aa, Homo Sapiens
LLPLPPLPP

SEQ ID NO: 977858 - protein, 9 aa, Homo Sapiens
WFREEKALN

SEQ ID NO: 977859 - protein, 9 aa, Homo Sapiens
EGLNEDIIY

SEQ ID NO: 977860 - protein, 9 aa, Homo Sapiens
QKDVFLVVN

SEQ ID NO: 977861 - protein, 9 aa, Homo Sapiens
KPKSKNYTY

SEQ ID NO: 977862 - protein, 9 aa, Homo Sapiens
VLCNYHLPF

SEQ ID NO: 977863 - protein, 9 aa, Homo Sapiens
SKVQKDVFL

SEQ ID NO: 977864 - protein, 9 aa, Homo Sapiens
AINQTTCEN

SEQ ID NO: 977865 - protein, 9 aa, Homo Sapiens
SYIQIAMAI

SEQ ID NO: 977866 - protein, 9 aa, Homo Sapiens
FKAMCVNLT

SEQ ID NO: 977867 - protein, 9 aa, Homo Sapiens
DNAKLTADD

SEQ ID NO: 977868 - protein, 9 aa, Homo Sapiens
VGLGRTKGL

SEQ ID NO: 977869 - protein, 9 aa, Homo Sapiens
AGSTAPPLS

SEQ ID NO: 977870 - protein, 9 aa, Homo Sapiens
EEDAGVEAF

SEQ ID NO: 977871 - protein, 9 aa, Homo Sapiens
AESTKSVPL

SEQ ID NO: 977872 - protein, 9 aa, Homo Sapiens
CSESQHLNG

SEQ ID NO: 977873 - protein, 9 aa, Homo Sapiens
VNGKRYFKC

SEQ ID NO: 977874 - protein, 9 aa, Homo Sapiens
GLMSKLVPA

SEQ ID NO: 977875 - protein, 9 aa, Homo Sapiens
SPTRDLQSS

SEQ ID NO: 977876 - protein, 9 aa, Homo Sapiens
ALGLAIFIL

SEQ ID NO: 977877 - protein, 9 aa, Homo Sapiens
LAYSLPQSS

SEQ ID NO: 977878 - protein, 9 aa, Homo Sapiens
LFPILHRGL

SEQ ID NO: 977879 - protein, 9 aa, Homo Sapiens
KSSGMPSGN

SEQ ID NO: 977880 - protein, 9 aa, Homo Sapiens
TKAERRHQE

SEQ ID NO: 977881 - protein, 9 aa, Homo Sapiens
RDNIVTYNN

SEQ ID NO: 977882 - protein, 9 aa, Homo Sapiens
IDFSFCLKR

SEQ ID NO: 977883 - protein, 9 aa, Homo Sapiens
LRLEKARLV

SEQ ID NO: 977884 - protein, 9 aa, Homo Sapiens
SQAKTTTLS

SEQ ID NO: 977885 - protein, 9 aa, Homo Sapiens
VHPTPALPF

SEQ ID NO: 977886 - protein, 9 aa, Homo Sapiens
MDEYLRVVN

SEQ ID NO: 977887 - protein, 9 aa, Homo Sapiens
LIQDFVSLA

SEQ ID NO: 977888 - protein, 9 aa, Homo Sapiens
EAPLSTLKG

SEQ ID NO: 977889 - protein, 9 aa, Homo Sapiens
KDMFGSQPL

SEQ ID NO: 977890 - protein, 9 aa, Homo Sapiens
PMPEKSQKR

SEQ ID NO: 977891 - protein, 9 aa, Homo Sapiens
QPMLSITIR

SEQ ID NO: 977892 - protein, 9 aa, Homo Sapiens
VPLNPSGTD

SEQ ID NO: 977893 - protein, 9 aa, Homo Sapiens
SVPKEEQKF

SEQ ID NO: 977894 - protein, 9 aa, Homo Sapiens
TRDQIKMFI

SEQ ID NO: 977895 - protein, 9 aa, Homo Sapiens
RKHPRLECG

SEQ ID NO: 977896 - protein, 9 aa, Homo Sapiens
FTLKIFKDN

SEQ ID NO: 977897 - protein, 9 aa, Homo Sapiens
PDTPLPHVN

SEQ ID NO: 977898 - protein, 9 aa, Homo Sapiens
ILSEHDGNC

SEQ ID NO: 977899 - protein, 9 aa, Homo Sapiens
TAIIASFNI

SEQ ID NO: 977900 - protein, 9 aa, Homo Sapiens
KTTVETEDF

SEQ ID NO: 977901 - protein, 9 aa, Homo Sapiens
HAALMAPSS

SEQ ID NO: 977902 - protein, 9 aa, Homo Sapiens
GKTIQFGEK

SEQ ID NO: 977903 - protein, 9 aa, Homo Sapiens
RSGSRGSDS

SEQ ID NO: 977904 - protein, 9 aa, Homo Sapiens
KDLKEELTE

SEQ ID NO: 977905 - protein, 9 aa, Homo Sapiens
AALLTMPVM

SEQ ID NO: 977906 - protein, 9 aa, Homo Sapiens
FFFLLSKFG

SEQ ID NO: 977907 - protein, 9 aa, Homo Sapiens
VDTTFMTLQ

SEQ ID NO: 977908 - protein, 9 aa, Homo Sapiens
QTVRIIKAV

SEQ ID NO: 977909 - protein, 9 aa, Homo Sapiens
LIQRSTHAG

SEQ ID NO: 977910 - protein, 9 aa, Homo Sapiens
EIESLHSKN

SEQ ID NO: 977911 - protein, 9 aa, Homo Sapiens
KGGGNQISL

SEQ ID NO: 977912 - protein, 9 aa, Homo Sapiens
DFVLSSTGK

SEQ ID NO: 977913 - protein, 9 aa, Homo Sapiens
VVSRRVAQL

SEQ ID NO: 977914 - protein, 9 aa, Homo Sapiens
SSPLPSMPV

SEQ ID NO: 977915 - protein, 9 aa, Homo Sapiens
ESEEAGSTA

SEQ ID NO: 977916 - protein, 9 aa, Homo Sapiens
YFFDRDPKV

SEQ ID NO: 977917 - protein, 9 aa, Homo Sapiens
ALAEYMVFG

SEQ ID NO: 977918 - protein, 9 aa, Homo Sapiens
FDNFSQALL

SEQ ID NO: 977919 - protein, 9 aa, Homo Sapiens
TSLDAWEAM

SEQ ID NO: 977920 - protein, 9 aa, Homo Sapiens
SGKLSQLHR

SEQ ID NO: 977921 - protein, 9 aa, Homo Sapiens
KSPLQRTQE

SEQ ID NO: 977922 - protein, 9 aa, Homo Sapiens
RLPEQIYED

SEQ ID NO: 977923 - protein, 9 aa, Homo Sapiens
IESWSLGMV

SEQ ID NO: 977924 - protein, 9 aa, Homo Sapiens
NAKGKNWQM

SEQ ID NO: 977925 - protein, 9 aa, Homo Sapiens
FVMFLLMYT

SEQ ID NO: 977926 - protein, 9 aa, Homo Sapiens
LEKQIKLKE

SEQ ID NO: 977927 - protein, 9 aa, Homo Sapiens
LLVLTLLAC

SEQ ID NO: 977928 - protein, 9 aa, Homo Sapiens
FFGVPIPSS

SEQ ID NO: 977929 - protein, 9 aa, Homo Sapiens
YTFILSEHD

SEQ ID NO: 977930 - protein, 9 aa, Homo Sapiens
QMKLSQDFS

SEQ ID NO: 977931 - protein, 9 aa, Homo Sapiens
LDDCEELMI

SEQ ID NO: 977932 - protein, 9 aa, Homo Sapiens
EETVLPSLD

SEQ ID NO: 977933 - protein, 9 aa, Homo Sapiens
HCFLSAGIV

SEQ ID NO: 977934 - protein, 9 aa, Homo Sapiens
AVHAAVTGF

SEQ ID NO: 977935 - protein, 9 aa, Homo Sapiens
LTIDHVVEA

SEQ ID NO: 977936 - protein, 9 aa, Homo Sapiens
GGNLVVSYP

SEQ ID NO: 977937 - protein, 9 aa, Homo Sapiens
GNFWNIIYT

SEQ ID NO: 977938 - protein, 9 aa, Homo Sapiens
NEDLTKLLN

SEQ ID NO: 977939 - protein, 9 aa, Homo Sapiens
KSVGPASLS

SEQ ID NO: 977940 - protein, 9 aa, Homo Sapiens
CIIHLHTLA

SEQ ID NO: 977941 - protein, 9 aa, Homo Sapiens
ICYTFILLW

SEQ ID NO: 977942 - protein, 9 aa, Homo Sapiens
QRTQESLAE

SEQ ID NO: 977943 - protein, 9 aa, Homo Sapiens
SSFVILDNH

SEQ ID NO: 977944 - protein, 9 aa, Homo Sapiens
NEAKDLLSD

SEQ ID NO: 977945 - protein, 9 aa, Homo Sapiens
SRGTGSAQP

SEQ ID NO: 977946 - protein, 9 aa, Homo Sapiens
GPSGQYTHK

SEQ ID NO: 977947 - protein, 9 aa, Homo Sapiens
HGIFPFTLK

SEQ ID NO: 977948 - protein, 9 aa, Homo Sapiens
IECPARAAR

SEQ ID NO: 977949 - protein, 9 aa, Homo Sapiens
PHICDLRKV

SEQ ID NO: 977950 - protein, 9 aa, Homo Sapiens
AIGGKATSL

SEQ ID NO: 977951 - protein, 9 aa, Homo Sapiens
VHYKGGAVS

SEQ ID NO: 977952 - protein, 9 aa, Homo Sapiens
LLCKKYTQK

SEQ ID NO: 977953 - protein, 9 aa, Homo Sapiens
RCVRLYGPS

SEQ ID NO: 977954 - protein, 9 aa, Homo Sapiens
LLVRGATLL

SEQ ID NO: 977955 - protein, 9 aa, Homo Sapiens
GLIFDRVDP

SEQ ID NO: 977956 - protein, 9 aa, Homo Sapiens
ESESFIQAQ

SEQ ID NO: 977957 - protein, 9 aa, Homo Sapiens
KFPAERDIS

SEQ ID NO: 977958 - protein, 9 aa, Homo Sapiens
FGLCSPSYV

SEQ ID NO: 977959 - protein, 9 aa, Homo Sapiens
GLDSKTTYN

SEQ ID NO: 977960 - protein, 9 aa, Homo Sapiens
FPSSSFSTL

SEQ ID NO: 977961 - protein, 9 aa, Homo Sapiens
SESEFLVFP

SEQ ID NO: 977962 - protein, 9 aa, Homo Sapiens
RSYTMQLTM

SEQ ID NO: 977963 - protein, 9 aa, Homo Sapiens
LTENQSGGS

SEQ ID NO: 977964 - protein, 9 aa, Homo Sapiens
SPIKEESCG

SEQ ID NO: 977965 - protein, 9 aa, Homo Sapiens
TFDDNYVGC

SEQ ID NO: 977966 - protein, 9 aa, Homo Sapiens
ILVGGMFTQ

SEQ ID NO: 977967 - protein, 9 aa, Homo Sapiens
QTEFIYDQT

SEQ ID NO: 977968 - protein, 9 aa, Homo Sapiens
LCTPPPLIF

SEQ ID NO: 977969 - protein, 9 aa, Homo Sapiens
QRVIFVMFL

SEQ ID NO: 977970 - protein, 9 aa, Homo Sapiens
CKARKHRHL

SEQ ID NO: 977971 - protein, 9 aa, Homo Sapiens
HSSQVTKDS

SEQ ID NO: 977972 - protein, 9 aa, Homo Sapiens
TRKHPRLEC

SEQ ID NO: 977973 - protein, 9 aa, Homo Sapiens
LRATESGHL

SEQ ID NO: 977974 - protein, 9 aa, Homo Sapiens
DRNLRPWWK

SEQ ID NO: 977975 - protein, 9 aa, Homo Sapiens
SSNKETFTC

SEQ ID NO: 977976 - protein, 9 aa, Homo Sapiens
FAATLQQEK

SEQ ID NO: 977977 - protein, 9 aa, Homo Sapiens
SPSRASVHA

SEQ ID NO: 977978 - protein, 9 aa, Homo Sapiens
VQANMPLNL

SEQ ID NO: 977979 - protein, 9 aa, Homo Sapiens
VSMFLSLFS

SEQ ID NO: 977980 - protein, 9 aa, Homo Sapiens
VNGLEPLNS

SEQ ID NO: 977981 - protein, 9 aa, Homo Sapiens
QPGLGDAVT

SEQ ID NO: 977982 - protein, 9 aa, Homo Sapiens
SYLLDKETL

SEQ ID NO: 977983 - protein, 9 aa, Homo Sapiens
SANPPVPVL

SEQ ID NO: 977984 - protein, 9 aa, Homo Sapiens
TAIFTPYFA

SEQ ID NO: 977985 - protein, 9 aa, Homo Sapiens
IDYVTSVLG

SEQ ID NO: 977986 - protein, 9 aa, Homo Sapiens
RSVSRSPMP

SEQ ID NO: 977987 - protein, 9 aa, Homo Sapiens
TLASKRGGS

SEQ ID NO: 977988 - protein, 9 aa, Homo Sapiens
ERSIGDVTI

SEQ ID NO: 977989 - protein, 9 aa, Homo Sapiens
CVAQLYFFY

SEQ ID NO: 977990 - protein, 9 aa, Homo Sapiens
FCQKVEMSY

SEQ ID NO: 977991 - protein, 9 aa, Homo Sapiens
RPMGLKGYL

SEQ ID NO: 977992 - protein, 9 aa, Homo Sapiens
VGDFGSVTF

SEQ ID NO: 977993 - protein, 9 aa, Homo Sapiens
PTATSEPPI

SEQ ID NO: 977994 - protein, 9 aa, Homo Sapiens
AEERKVVVE

SEQ ID NO: 977995 - protein, 9 aa, Homo Sapiens
KVVKNPTVL

SEQ ID NO: 977996 - protein, 9 aa, Homo Sapiens
NEDIIYSFS

SEQ ID NO: 977997 - protein, 9 aa, Homo Sapiens
GYISPSHAW

SEQ ID NO: 977998 - protein, 9 aa, Homo Sapiens
SSDEDLKII

SEQ ID NO: 977999 - protein, 9 aa, Homo Sapiens
IISVISELL

SEQ ID NO: 978000 - protein, 9 aa, Homo Sapiens
TTQLSLLSH

SEQ ID NO: 978001 - protein, 9 aa, Homo Sapiens
NVLRQKLAQ

SEQ ID NO: 978002 - protein, 9 aa, Homo Sapiens
EKEEKRKTM

SEQ ID NO: 978003 - protein, 9 aa, Homo Sapiens
CVMLSHVHI

SEQ ID NO: 978004 - protein, 9 aa, Homo Sapiens
RTGGKSTCS

SEQ ID NO: 978005 - protein, 9 aa, Homo Sapiens
KGRQHLEEA

SEQ ID NO: 978006 - protein, 9 aa, Homo Sapiens
AFPAGASAA

SEQ ID NO: 978007 - protein, 9 aa, Homo Sapiens
KDYMIPLKY

SEQ ID NO: 978008 - protein, 9 aa, Homo Sapiens
SESANHRSS

SEQ ID NO: 978009 - protein, 9 aa, Homo Sapiens
DRQLLCYYD

SEQ ID NO: 978010 - protein, 9 aa, Homo Sapiens
KARLVLLKK

SEQ ID NO: 978011 - protein, 9 aa, Homo Sapiens
RLRSLEAKD

SEQ ID NO: 978012 - protein, 9 aa, Homo Sapiens
AKKNPAFGG

SEQ ID NO: 978013 - protein, 9 aa, Homo Sapiens
LFITTRPLA

SEQ ID NO: 978014 - protein, 9 aa, Homo Sapiens
VTYTTLFQT

SEQ ID NO: 978015 - protein, 9 aa, Homo Sapiens
VNSGDAVTC

SEQ ID NO: 978016 - protein, 9 aa, Homo Sapiens
DAVVCTLPL

SEQ ID NO: 978017 - protein, 9 aa, Homo Sapiens
QDVAVFPQQ

SEQ ID NO: 978018 - protein, 9 aa, Homo Sapiens
LIYNVSRNH

SEQ ID NO: 978019 - protein, 9 aa, Homo Sapiens
WKGNFKNSK

SEQ ID NO: 978020 - protein, 9 aa, Homo Sapiens
RTGQEHQGQ

SEQ ID NO: 978021 - protein, 9 aa, Homo Sapiens
VYMREKFFQ

SEQ ID NO: 978022 - protein, 9 aa, Homo Sapiens
NHHSGDYKH

SEQ ID NO: 978023 - protein, 9 aa, Homo Sapiens
IIIWQNPFL

SEQ ID NO: 978024 - protein, 9 aa, Homo Sapiens
THGRIPYLG

SEQ ID NO: 978025 - protein, 9 aa, Homo Sapiens
EAISGEGRK

SEQ ID NO: 978026 - protein, 9 aa, Homo Sapiens
EILGLDSKT

SEQ ID NO: 978027 - protein, 9 aa, Homo Sapiens
LIECPARAA

SEQ ID NO: 978028 - protein, 9 aa, Homo Sapiens
LNEKVARRA

SEQ ID NO: 978029 - protein, 9 aa, Homo Sapiens
WSFTSPHRP

SEQ ID NO: 978030 - protein, 9 aa, Homo Sapiens
ILAKVYPSS

SEQ ID NO: 978031 - protein, 9 aa, Homo Sapiens
LEGFSKFKE

SEQ ID NO: 978032 - protein, 9 aa, Homo Sapiens
ADPILIFLK

SEQ ID NO: 978033 - protein, 9 aa, Homo Sapiens
KMRKAETEP

SEQ ID NO: 978034 - protein, 9 aa, Homo Sapiens
LSRSPSVAN

SEQ ID NO: 978035 - protein, 9 aa, Homo Sapiens
QSSEFEASQ

SEQ ID NO: 978036 - protein, 9 aa, Homo Sapiens
TVINSRACY

SEQ ID NO: 978037 - protein, 9 aa, Homo Sapiens
TAGTTGKGK

SEQ ID NO: 978038 - protein, 9 aa, Homo Sapiens
KKILETEIE

SEQ ID NO: 978039 - protein, 9 aa, Homo Sapiens
TEPLEKFSL

SEQ ID NO: 978040 - protein, 9 aa, Homo Sapiens
VAQAQTKVT

SEQ ID NO: 978041 - protein, 9 aa, Homo Sapiens
VVVFGLDGV

SEQ ID NO: 978042 - protein, 9 aa, Homo Sapiens
TAADPLTDL

SEQ ID NO: 978043 - protein, 9 aa, Homo Sapiens
PKTQRLRWP

SEQ ID NO: 978044 - protein, 9 aa, Homo Sapiens
RSVPLAEKE

SEQ ID NO: 978045 - protein, 9 aa, Homo Sapiens
QREPQRNLS

SEQ ID NO: 978046 - protein, 9 aa, Homo Sapiens
EAKHCFIAF

SEQ ID NO: 978047 - protein, 9 aa, Homo Sapiens
CVGFFSAML

SEQ ID NO: 978048 - protein, 9 aa, Homo Sapiens
ERGCQLTIP

SEQ ID NO: 978049 - protein, 9 aa, Homo Sapiens
PALRDVLDQ

SEQ ID NO: 978050 - protein, 9 aa, Homo Sapiens
SKRTLPYSY

SEQ ID NO: 978051 - protein, 9 aa, Homo Sapiens
IIDELKSKK

SEQ ID NO: 978052 - protein, 9 aa, Homo Sapiens
SIIGEVWPG

SEQ ID NO: 978053 - protein, 9 aa, Homo Sapiens
SPKFPKKEF

SEQ ID NO: 978054 - protein, 9 aa, Homo Sapiens
QNAKMALLA

SEQ ID NO: 978055 - protein, 9 aa, Homo Sapiens
MEHFLERSW

SEQ ID NO: 978056 - protein, 9 aa, Homo Sapiens
DQLDAIGTK

SEQ ID NO: 978057 - protein, 9 aa, Homo Sapiens
ELGSGEILE

SEQ ID NO: 978058 - protein, 9 aa, Homo Sapiens
SDLKASKTG

SEQ ID NO: 978059 - protein, 9 aa, Homo Sapiens
KIDKVEDNI

SEQ ID NO: 978060 - protein, 9 aa, Homo Sapiens
LFFWYGCWG

SEQ ID NO: 978061 - protein, 9 aa, Homo Sapiens
STAVFKRFL

SEQ ID NO: 978062 - protein, 9 aa, Homo Sapiens
EPDLIREGG

SEQ ID NO: 978063 - protein, 9 aa, Homo Sapiens
SSIDLPRED

SEQ ID NO: 978064 - protein, 9 aa, Homo Sapiens
PPMLTEENS

SEQ ID NO: 978065 - protein, 9 aa, Homo Sapiens
DEPNVTSRG

SEQ ID NO: 978066 - protein, 9 aa, Homo Sapiens
RYSEQAFFV

SEQ ID NO: 978067 - protein, 9 aa, Homo Sapiens
AKKLNSEYF

SEQ ID NO: 978068 - protein, 9 aa, Homo Sapiens
RRRLSDGSF

SEQ ID NO: 978069 - protein, 9 aa, Homo Sapiens
AGLKAFRIC

SEQ ID NO: 978070 - protein, 9 aa, Homo Sapiens
VEEKRQEQE

SEQ ID NO: 978071 - protein, 9 aa, Homo Sapiens
KDVTVRTLS

SEQ ID NO: 978072 - protein, 9 aa, Homo Sapiens
TLGFGAVTF

SEQ ID NO: 978073 - protein, 9 aa, Homo Sapiens
SLKNNEKQI

SEQ ID NO: 978074 - protein, 9 aa, Homo Sapiens
HIYWEKAEQ

SEQ ID NO: 978075 - protein, 9 aa, Homo Sapiens
NNHAAELGV

SEQ ID NO: 978076 - protein, 9 aa, Homo Sapiens
DQEGFLEVK

SEQ ID NO: 978077 - protein, 9 aa, Homo Sapiens
NETLCLTWD

SEQ ID NO: 978078 - protein, 9 aa, Homo Sapiens
LRHHEETVL

SEQ ID NO: 978079 - protein, 9 aa, Homo Sapiens
NLMKTEDEY

SEQ ID NO: 978080 - protein, 9 aa, Homo Sapiens
MPKENFTAD

SEQ ID NO: 978081 - protein, 9 aa, Homo Sapiens
KKLEKHLEK

SEQ ID NO: 978082 - protein, 9 aa, Homo Sapiens
DFSSPFYPR

SEQ ID NO: 978083 - protein, 9 aa, Homo Sapiens
KREAISGEG

SEQ ID NO: 978084 - protein, 9 aa, Homo Sapiens
SSSFLTEDC

SEQ ID NO: 978085 - protein, 9 aa, Homo Sapiens
LKIFKDNEF

SEQ ID NO: 978086 - protein, 9 aa, Homo Sapiens
AEDIPNTDS

SEQ ID NO: 978087 - protein, 9 aa, Homo Sapiens
IFLLFPILH

SEQ ID NO: 978088 - protein, 9 aa, Homo Sapiens
KSQSKKLQG

SEQ ID NO: 978089 - protein, 9 aa, Homo Sapiens
RNVFFCVKK

SEQ ID NO: 978090 - protein, 9 aa, Homo Sapiens
TRGHSIAGR

SEQ ID NO: 978091 - protein, 9 aa, Homo Sapiens
SFALQMYGC

SEQ ID NO: 978092 - protein, 9 aa, Homo Sapiens
LLGAWRGVL

SEQ ID NO: 978093 - protein, 9 aa, Homo Sapiens
PRNYAKLSA

SEQ ID NO: 978094 - protein, 9 aa, Homo Sapiens
LGSGEILEG

SEQ ID NO: 978095 - protein, 9 aa, Homo Sapiens
IVEEYHDLS

SEQ ID NO: 978096 - protein, 9 aa, Homo Sapiens
SIQSKCRRT

SEQ ID NO: 978097 - protein, 9 aa, Homo Sapiens
MIFYLLKIF

SEQ ID NO: 978098 - protein, 9 aa, Homo Sapiens
VFQNAKMAL

SEQ ID NO: 978099 - protein, 9 aa, Homo Sapiens
QSRRDNLEA

SEQ ID NO: 978100 - protein, 9 aa, Homo Sapiens
RDCVPLMPK

SEQ ID NO: 978101 - protein, 9 aa, Homo Sapiens
HANSVGTSF

SEQ ID NO: 978102 - protein, 9 aa, Homo Sapiens
EQKFPEADV

SEQ ID NO: 978103 - protein, 9 aa, Homo Sapiens
QADDQDMIE

SEQ ID NO: 978104 - protein, 9 aa, Homo Sapiens
MLLQADLPL

SEQ ID NO: 978105 - protein, 9 aa, Homo Sapiens
HFSISEAFS

SEQ ID NO: 978106 - protein, 9 aa, Homo Sapiens
EKFWYNSTL

SEQ ID NO: 978107 - protein, 9 aa, Homo Sapiens
PKPITVGLG

SEQ ID NO: 978108 - protein, 9 aa, Homo Sapiens
RCMIQLFFF

SEQ ID NO: 978109 - protein, 9 aa, Homo Sapiens
NVSTTVSRK

SEQ ID NO: 978110 - protein, 9 aa, Homo Sapiens
SPTKAKKDW

SEQ ID NO: 978111 - protein, 9 aa, Homo Sapiens
SLHSKNSGK

SEQ ID NO: 978112 - protein, 9 aa, Homo Sapiens
CHLLTYMTL

SEQ ID NO: 978113 - protein, 9 aa, Homo Sapiens
SSLLNQHQR

SEQ ID NO: 978114 - protein, 9 aa, Homo Sapiens
TQLRVMKHP

SEQ ID NO: 978115 - protein, 9 aa, Homo Sapiens
STETGNACC

SEQ ID NO: 978116 - protein, 9 aa, Homo Sapiens
IENLLIILA

SEQ ID NO: 978117 - protein, 9 aa, Homo Sapiens
FPASHDPDT

SEQ ID NO: 978118 - protein, 9 aa, Homo Sapiens
LSTLKGKTN

SEQ ID NO: 978119 - protein, 9 aa, Homo Sapiens
RTPTLPGSA

SEQ ID NO: 978120 - protein, 9 aa, Homo Sapiens
SENESDDEE

SEQ ID NO: 978121 - protein, 9 aa, Homo Sapiens
CLMDRKPLV

SEQ ID NO: 978122 - protein, 9 aa, Homo Sapiens
LEKMKDTSC

SEQ ID NO: 978123 - protein, 9 aa, Homo Sapiens
KDRNLRPWW

SEQ ID NO: 978124 - protein, 9 aa, Homo Sapiens
VLEDVDPSY

SEQ ID NO: 978125 - protein, 9 aa, Homo Sapiens
NIVTYNNEG

SEQ ID NO: 978126 - protein, 9 aa, Homo Sapiens
YNPGSPPML

SEQ ID NO: 978127 - protein, 9 aa, Homo Sapiens
STVSICEDH

SEQ ID NO: 978128 - protein, 9 aa, Homo Sapiens
QQNSTQIRQ

SEQ ID NO: 978129 - protein, 9 aa, Homo Sapiens
TEFRYLENG

SEQ ID NO: 978130 - protein, 9 aa, Homo Sapiens
KVLLNKGAK

SEQ ID NO: 978131 - protein, 9 aa, Homo Sapiens
QYVLECNHH

SEQ ID NO: 978132 - protein, 9 aa, Homo Sapiens
GVVSRRVAQ

SEQ ID NO: 978133 - protein, 9 aa, Homo Sapiens
FSAARSRKL

SEQ ID NO: 978134 - protein, 9 aa, Homo Sapiens
REKEWQAAV

SEQ ID NO: 978135 - protein, 9 aa, Homo Sapiens
KPHTAHQRC

SEQ ID NO: 978136 - protein, 9 aa, Homo Sapiens
RSTFDNFSQ

SEQ ID NO: 978137 - protein, 9 aa, Homo Sapiens
LGDGFKAMC

SEQ ID NO: 978138 - protein, 9 aa, Homo Sapiens
SHPLPPGTP

SEQ ID NO: 978139 - protein, 9 aa, Homo Sapiens
PSFILQVYS

SEQ ID NO: 978140 - protein, 9 aa, Homo Sapiens
TDSGEQSWL

SEQ ID NO: 978141 - protein, 9 aa, Homo Sapiens
ACCSISAWV

SEQ ID NO: 978142 - protein, 9 aa, Homo Sapiens
LLCYYDQCE

SEQ ID NO: 978143 - protein, 9 aa, Homo Sapiens
YITLALLYS

SEQ ID NO: 978144 - protein, 9 aa, Homo Sapiens
VSGSDCGHM

SEQ ID NO: 978145 - protein, 9 aa, Homo Sapiens
STPKEMSRE

SEQ ID NO: 978146 - protein, 9 aa, Homo Sapiens
LPIIIYAGL

SEQ ID NO: 978147 - protein, 9 aa, Homo Sapiens
CPAAESRPP

SEQ ID NO: 978148 - protein, 9 aa, Homo Sapiens
QHRGLRGHH

SEQ ID NO: 978149 - protein, 9 aa, Homo Sapiens
FLCKKSKPK

SEQ ID NO: 978150 - protein, 9 aa, Homo Sapiens
EMSRETTKV

SEQ ID NO: 978151 - protein, 9 aa, Homo Sapiens
KFPAPMNKN

SEQ ID NO: 978152 - protein, 9 aa, Homo Sapiens
LEPLLPLPP

SEQ ID NO: 978153 - protein, 9 aa, Homo Sapiens
GHVAQPAYG

SEQ ID NO: 978154 - protein, 9 aa, Homo Sapiens
CGTHFIVVA

SEQ ID NO: 978155 - protein, 9 aa, Homo Sapiens
SIVQNPHAF

SEQ ID NO: 978156 - protein, 9 aa, Homo Sapiens
TMLRLAENE

SEQ ID NO: 978157 - protein, 9 aa, Homo Sapiens
RDNLEALGH

SEQ ID NO: 978158 - protein, 9 aa, Homo Sapiens
LLNKGAKPN

SEQ ID NO: 978159 - protein, 9 aa, Homo Sapiens
LESKGRQHL

SEQ ID NO: 978160 - protein, 9 aa, Homo Sapiens
TVQEREKVI

SEQ ID NO: 978161 - protein, 9 aa, Homo Sapiens
ERIRMQSLV

SEQ ID NO: 978162 - protein, 9 aa, Homo Sapiens
MEQIEPSVS

SEQ ID NO: 978163 - protein, 9 aa, Homo Sapiens
LDDSKRSPL

SEQ ID NO: 978164 - protein, 9 aa, Homo Sapiens
RYVAICHLL

SEQ ID NO: 978165 - protein, 9 aa, Homo Sapiens
EEEEEKKEQ

SEQ ID NO: 978166 - protein, 9 aa, Homo Sapiens
FHGDLRRNG

SEQ ID NO: 978167 - protein, 9 aa, Homo Sapiens
IAFASDRIS

SEQ ID NO: 978168 - protein, 9 aa, Homo Sapiens
CLLDSVRRN

SEQ ID NO: 978169 - protein, 9 aa, Homo Sapiens
KPEEQKNIP

SEQ ID NO: 978170 - protein, 9 aa, Homo Sapiens
QLHRLQHQH

SEQ ID NO: 978171 - protein, 9 aa, Homo Sapiens
SSLNCSYTI

SEQ ID NO: 978172 - protein, 9 aa, Homo Sapiens
HYYYSEAFK

SEQ ID NO: 978173 - protein, 9 aa, Homo Sapiens
LYESHVECR

SEQ ID NO: 978174 - protein, 9 aa, Homo Sapiens
SSVSPVAGA

SEQ ID NO: 978175 - protein, 9 aa, Homo Sapiens
CNHHSGDYK

SEQ ID NO: 978176 - protein, 9 aa, Homo Sapiens
NFKNSKVSV

SEQ ID NO: 978177 - protein, 9 aa, Homo Sapiens
WMTFFPEWL

SEQ ID NO: 978178 - protein, 9 aa, Homo Sapiens
SNYLIYLDP

SEQ ID NO: 978179 - protein, 9 aa, Homo Sapiens
QNPFLQQPM

SEQ ID NO: 978180 - protein, 9 aa, Homo Sapiens
SQALLTVFQ

SEQ ID NO: 978181 - protein, 9 aa, Homo Sapiens
EGVPAITQM

SEQ ID NO: 978182 - protein, 9 aa, Homo Sapiens
WKHSVGIIC

SEQ ID NO: 978183 - protein, 9 aa, Homo Sapiens
QRRGPKCQI

SEQ ID NO: 978184 - protein, 9 aa, Homo Sapiens
TCSISRSLP

SEQ ID NO: 978185 - protein, 9 aa, Homo Sapiens
VAPEKDEST

SEQ ID NO: 978186 - protein, 9 aa, Homo Sapiens
ESRIPNRYL

SEQ ID NO: 978187 - protein, 9 aa, Homo Sapiens
KPVLVTTFV

SEQ ID NO: 978188 - protein, 9 aa, Homo Sapiens
RHLENLEEP

SEQ ID NO: 978189 - protein, 9 aa, Homo Sapiens
DLNTVLEDV

SEQ ID NO: 978190 - protein, 9 aa, Homo Sapiens
TTFPKNPVY

SEQ ID NO: 978191 - protein, 9 aa, Homo Sapiens
PLNLEETLK

SEQ ID NO: 978192 - protein, 9 aa, Homo Sapiens
LLDHINNHA

SEQ ID NO: 978193 - protein, 9 aa, Homo Sapiens
CTKQEVLSH

SEQ ID NO: 978194 - protein, 9 aa, Homo Sapiens
LPPGTPMAH

SEQ ID NO: 978195 - protein, 9 aa, Homo Sapiens
LKEKQDKKI

SEQ ID NO: 978196 - protein, 9 aa, Homo Sapiens
LKVAHDLSK

SEQ ID NO: 978197 - protein, 9 aa, Homo Sapiens
IEDVMGPTL

SEQ ID NO: 978198 - protein, 9 aa, Homo Sapiens
CSLFITTRP

SEQ ID NO: 978199 - protein, 9 aa, Homo Sapiens
PPDSQEDFF

SEQ ID NO: 978200 - protein, 9 aa, Homo Sapiens
SSTGKKAPG

SEQ ID NO: 978201 - protein, 9 aa, Homo Sapiens
ATSDPYGLN

SEQ ID NO: 978202 - protein, 9 aa, Homo Sapiens
STVTAQFPR

SEQ ID NO: 978203 - protein, 9 aa, Homo Sapiens
INQCQAPVS

SEQ ID NO: 978204 - protein, 9 aa, Homo Sapiens
HQSPHWRET

SEQ ID NO: 978205 - protein, 9 aa, Homo Sapiens
SRRAELPPP

SEQ ID NO: 978206 - protein, 9 aa, Homo Sapiens
SYQLTLPQR

SEQ ID NO: 978207 - protein, 9 aa, Homo Sapiens
NADAPAGTA

SEQ ID NO: 978208 - protein, 9 aa, Homo Sapiens
TVEDTPKAK

SEQ ID NO: 978209 - protein, 9 aa, Homo Sapiens
TISGLRGLF

SEQ ID NO: 978210 - protein, 9 aa, Homo Sapiens
FQYVLECNH

SEQ ID NO: 978211 - protein, 9 aa, Homo Sapiens
IYTELCLPA

SEQ ID NO: 978212 - protein, 9 aa, Homo Sapiens
PFPSSSFST

SEQ ID NO: 978213 - protein, 9 aa, Homo Sapiens
RDRNIMATK

SEQ ID NO: 978214 - protein, 9 aa, Homo Sapiens
SARLLGAHA

SEQ ID NO: 978215 - protein, 9 aa, Homo Sapiens
GLYTALLVM

SEQ ID NO: 978216 - protein, 9 aa, Homo Sapiens
NKVCNHYKY

SEQ ID NO: 978217 - protein, 9 aa, Homo Sapiens
PGSSYHRLL

SEQ ID NO: 978218 - protein, 9 aa, Homo Sapiens
KGEIRAINQ

SEQ ID NO: 978219 - protein, 9 aa, Homo Sapiens
VLSMIRDWL

SEQ ID NO: 978220 - protein, 9 aa, Homo Sapiens
IDSLMNKKA

SEQ ID NO: 978221 - protein, 9 aa, Homo Sapiens
PPGSPAEQG

SEQ ID NO: 978222 - protein, 9 aa, Homo Sapiens
LKATMIRAM

SEQ ID NO: 978223 - protein, 9 aa, Homo Sapiens
FFQCNESGK

SEQ ID NO: 978224 - protein, 9 aa, Homo Sapiens
KRTLPYSYN

SEQ ID NO: 978225 - protein, 9 aa, Homo Sapiens
DLFLIHPFT

SEQ ID NO: 978226 - protein, 9 aa, Homo Sapiens
FQSFSYSLA

SEQ ID NO: 978227 - protein, 9 aa, Homo Sapiens
DHINNHAAE

SEQ ID NO: 978228 - protein, 9 aa, Homo Sapiens
LIGAYAVSI

SEQ ID NO: 978229 - protein, 9 aa, Homo Sapiens
KESYITLAL

SEQ ID NO: 978230 - protein, 9 aa, Homo Sapiens
KLNIDISNI

SEQ ID NO: 978231 - protein, 9 aa, Homo Sapiens
LKSKKKSSS

SEQ ID NO: 978232 - protein, 9 aa, Homo Sapiens
SEPPTATSE

SEQ ID NO: 978233 - protein, 9 aa, Homo Sapiens
CVNGLCKAR

SEQ ID NO: 978234 - protein, 9 aa, Homo Sapiens
AIFTPYFAA

SEQ ID NO: 978235 - protein, 9 aa, Homo Sapiens
RFAATLQQE

SEQ ID NO: 978236 - protein, 9 aa, Homo Sapiens
PESRIPNRY

SEQ ID NO: 978237 - protein, 9 aa, Homo Sapiens
KGCQLEKTE

SEQ ID NO: 978238 - protein, 9 aa, Homo Sapiens
RSAPATLTA

SEQ ID NO: 978239 - protein, 9 aa, Homo Sapiens
FKRGSGHPA

SEQ ID NO: 978240 - protein, 9 aa, Homo Sapiens
PICKKEFEL

SEQ ID NO: 978241 - protein, 9 aa, Homo Sapiens
QNPFNEKPA

SEQ ID NO: 978242 - protein, 9 aa, Homo Sapiens
RDELRLEKA

SEQ ID NO: 978243 - protein, 9 aa, Homo Sapiens
IMALCDTHQ

SEQ ID NO: 978244 - protein, 9 aa, Homo Sapiens
TLNLSNNSF

SEQ ID NO: 978245 - protein, 9 aa, Homo Sapiens
EALMAYWKK

SEQ ID NO: 978246 - protein, 9 aa, Homo Sapiens
DRRLKFHST

SEQ ID NO: 978247 - protein, 9 aa, Homo Sapiens
KHLEKLHEA

SEQ ID NO: 978248 - protein, 9 aa, Homo Sapiens
RAIGPTETL

SEQ ID NO: 978249 - protein, 9 aa, Homo Sapiens
RLSDGSFSS

SEQ ID NO: 978250 - protein, 9 aa, Homo Sapiens
SLYKENAMK

SEQ ID NO: 978251 - protein, 9 aa, Homo Sapiens
QLLVIENKV

SEQ ID NO: 978252 - protein, 9 aa, Homo Sapiens
CYSGVISIT

SEQ ID NO: 978253 - protein, 9 aa, Homo Sapiens
MLQITAPLP

SEQ ID NO: 978254 - protein, 9 aa, Homo Sapiens
KLLEDTLFS

SEQ ID NO: 978255 - protein, 9 aa, Homo Sapiens
HSSTRLPHT

SEQ ID NO: 978256 - protein, 9 aa, Homo Sapiens
AASGPPRCC

SEQ ID NO: 978257 - protein, 9 aa, Homo Sapiens
CSAFLSPVL

SEQ ID NO: 978258 - protein, 9 aa, Homo Sapiens
KIIPEELEK

SEQ ID NO: 978259 - protein, 9 aa, Homo Sapiens
EGNLMKTED

SEQ ID NO: 978260 - protein, 9 aa, Homo Sapiens
QLDDTTQLS

SEQ ID NO: 978261 - protein, 9 aa, Homo Sapiens
GNSVILNRE

SEQ ID NO: 978262 - protein, 9 aa, Homo Sapiens
DFSFCLKRE

SEQ ID NO: 978263 - protein, 9 aa, Homo Sapiens
YNTIGGFSQ

SEQ ID NO: 978264 - protein, 9 aa, Homo Sapiens
CIFCLEIFM

SEQ ID NO: 978265 - protein, 9 aa, Homo Sapiens
MEPPSSRED

SEQ ID NO: 978266 - protein, 9 aa, Homo Sapiens
LSCVGFFSA

SEQ ID NO: 978267 - protein, 9 aa, Homo Sapiens
DFFFQDNSR

SEQ ID NO: 978268 - protein, 9 aa, Homo Sapiens
LLLFVGRGY

SEQ ID NO: 978269 - protein, 9 aa, Homo Sapiens
KGKYRIYTK

SEQ ID NO: 978270 - protein, 9 aa, Homo Sapiens
RESVPPRDE

SEQ ID NO: 978271 - protein, 9 aa, Homo Sapiens
GPQGPLGPQ

SEQ ID NO: 978272 - protein, 9 aa, Homo Sapiens
SKHLSEPPR

SEQ ID NO: 978273 - protein, 9 aa, Homo Sapiens
TTNPYNYPF

SEQ ID NO: 978274 - protein, 9 aa, Homo Sapiens
CCALRSSSS

SEQ ID NO: 978275 - protein, 9 aa, Homo Sapiens
GPPRCCSCN

SEQ ID NO: 978276 - protein, 9 aa, Homo Sapiens
SRNHNGSLF

SEQ ID NO: 978277 - protein, 9 aa, Homo Sapiens
TSSVQRDNF

SEQ ID NO: 978278 - protein, 9 aa, Homo Sapiens
GLTIPCYTG

SEQ ID NO: 978279 - protein, 9 aa, Homo Sapiens
KLKEKQDKK

SEQ ID NO: 978280 - protein, 9 aa, Homo Sapiens
ELFSSKTAH

SEQ ID NO: 978281 - protein, 9 aa, Homo Sapiens
AQPAYGADL

SEQ ID NO: 978282 - protein, 9 aa, Homo Sapiens
QGLAGELLL

SEQ ID NO: 978283 - protein, 9 aa, Homo Sapiens
PGRKGQPGD

SEQ ID NO: 978284 - protein, 9 aa, Homo Sapiens
LLWATASVS

SEQ ID NO: 978285 - protein, 9 aa, Homo Sapiens
PSAFDSLYF

SEQ ID NO: 978286 - protein, 9 aa, Homo Sapiens
IRLPEQIYE

SEQ ID NO: 978287 - protein, 9 aa, Homo Sapiens
FDCQNNLHY

SEQ ID NO: 978288 - protein, 9 aa, Homo Sapiens
VIFVMFLLM

SEQ ID NO: 978289 - protein, 9 aa, Homo Sapiens
PERGVRDLR

SEQ ID NO: 978290 - protein, 9 aa, Homo Sapiens
CSAPENPIF

SEQ ID NO: 978291 - protein, 9 aa, Homo Sapiens
RNYTRMKIF

SEQ ID NO: 978292 - protein, 9 aa, Homo Sapiens
LLRDIKYFY

SEQ ID NO: 978293 - protein, 9 aa, Homo Sapiens
KGHEKFITS

SEQ ID NO: 978294 - protein, 9 aa, Homo Sapiens
WEKLGSCVA

SEQ ID NO: 978295 - protein, 9 aa, Homo Sapiens
PGNEAKDLL

SEQ ID NO: 978296 - protein, 9 aa, Homo Sapiens
NQSGGSLGV

SEQ ID NO: 978297 - protein, 9 aa, Homo Sapiens
HVYEKRHQV

SEQ ID NO: 978298 - protein, 9 aa, Homo Sapiens
MMAKGTTGY

SEQ ID NO: 978299 - protein, 9 aa, Homo Sapiens
LEQRFLRTM

SEQ ID NO: 978300 - protein, 9 aa, Homo Sapiens
IYDQTFQPH

SEQ ID NO: 978301 - protein, 9 aa, Homo Sapiens
LLSYIQIAM

SEQ ID NO: 978302 - protein, 9 aa, Homo Sapiens
PRLLDSEDV

SEQ ID NO: 978303 - protein, 9 aa, Homo Sapiens
EEEKKEQGE

SEQ ID NO: 978304 - protein, 9 aa, Homo Sapiens
RRRDAGPGL

SEQ ID NO: 978305 - protein, 9 aa, Homo Sapiens
LFSPILYML

SEQ ID NO: 978306 - protein, 9 aa, Homo Sapiens
DYVTSVLGN

SEQ ID NO: 978307 - protein, 9 aa, Homo Sapiens
TFTCKPKSK

SEQ ID NO: 978308 - protein, 9 aa, Homo Sapiens
TGGVMTGRA

SEQ ID NO: 978309 - protein, 9 aa, Homo Sapiens
PPGLVGANG

SEQ ID NO: 978310 - protein, 9 aa, Homo Sapiens
RAAQRRRCV

SEQ ID NO: 978311 - protein, 9 aa, Homo Sapiens
YSYKKDEIG

SEQ ID NO: 978312 - protein, 9 aa, Homo Sapiens
EYDKDRNLR

SEQ ID NO: 978313 - protein, 9 aa, Homo Sapiens
LPLPPLPPL

SEQ ID NO: 978314 - protein, 9 aa, Homo Sapiens
FSLKPGVPL

SEQ ID NO: 978315 - protein, 9 aa, Homo Sapiens
TWLLEQPEK

SEQ ID NO: 978316 - protein, 9 aa, Homo Sapiens
HVAQPAYGA

SEQ ID NO: 978317 - protein, 9 aa, Homo Sapiens
HLASMIYLT

SEQ ID NO: 978318 - protein, 9 aa, Homo Sapiens
ICDRNSHGQ

SEQ ID NO: 978319 - protein, 9 aa, Homo Sapiens
SINHMNYLP

SEQ ID NO: 978320 - protein, 9 aa, Homo Sapiens
LAGELLLFV

SEQ ID NO: 978321 - protein, 9 aa, Homo Sapiens
DCYSGVISI

SEQ ID NO: 978322 - protein, 9 aa, Homo Sapiens
AKAVACHRQ

SEQ ID NO: 978323 - protein, 9 aa, Homo Sapiens
PEGPALSHS

SEQ ID NO: 978324 - protein, 9 aa, Homo Sapiens
DSLYFLRTE

SEQ ID NO: 978325 - protein, 9 aa, Homo Sapiens
LKASKTGSL

SEQ ID NO: 978326 - protein, 9 aa, Homo Sapiens
ASIGYNIGD

SEQ ID NO: 978327 - protein, 9 aa, Homo Sapiens
EEELRKAWA

SEQ ID NO: 978328 - protein, 9 aa, Homo Sapiens
AGTGNKKAI

SEQ ID NO: 978329 - protein, 9 aa, Homo Sapiens
HLGYTFCKQ

SEQ ID NO: 978330 - protein, 9 aa, Homo Sapiens
LRDGYNLIS

SEQ ID NO: 978331 - protein, 9 aa, Homo Sapiens
KRTLLEKKL

SEQ ID NO: 978332 - protein, 9 aa, Homo Sapiens
PTRPKSSGM

SEQ ID NO: 978333 - protein, 9 aa, Homo Sapiens
GTKGEKEDL

SEQ ID NO: 978334 - protein, 9 aa, Homo Sapiens
AFLELKFSH

SEQ ID NO: 978335 - protein, 9 aa, Homo Sapiens
HFHIHQSPH

SEQ ID NO: 978336 - protein, 9 aa, Homo Sapiens
EDAAALELL

SEQ ID NO: 978337 - protein, 9 aa, Homo Sapiens
RLDDGCRVR

SEQ ID NO: 978338 - protein, 9 aa, Homo Sapiens
RGLRGHHVF

SEQ ID NO: 978339 - protein, 9 aa, Homo Sapiens
NAKFPAPMN

SEQ ID NO: 978340 - protein, 9 aa, Homo Sapiens
PLPEPLKVA

SEQ ID NO: 978341 - protein, 9 aa, Homo Sapiens
YSRCMIQLF

SEQ ID NO: 978342 - protein, 9 aa, Homo Sapiens
EVSILPDNL

SEQ ID NO: 978343 - protein, 9 aa, Homo Sapiens
DDANMEQIE

SEQ ID NO: 978344 - protein, 9 aa, Homo Sapiens
VRRNIKKVD

SEQ ID NO: 978345 - protein, 9 aa, Homo Sapiens
QQARQNAGI

SEQ ID NO: 978346 - protein, 9 aa, Homo Sapiens
ENKSIFYYG

SEQ ID NO: 978347 - protein, 9 aa, Homo Sapiens
GADAAIVVT

SEQ ID NO: 978348 - protein, 9 aa, Homo Sapiens
EAGSTAPPL

SEQ ID NO: 978349 - protein, 9 aa, Homo Sapiens
NRLSRLNGA

SEQ ID NO: 978350 - protein, 9 aa, Homo Sapiens
ECPARAARY

SEQ ID NO: 978351 - protein, 9 aa, Homo Sapiens
SLSNMVLTF

SEQ ID NO: 978352 - protein, 9 aa, Homo Sapiens
RIINLQILT

SEQ ID NO: 978353 - protein, 9 aa, Homo Sapiens
KSQDVAVFP

SEQ ID NO: 978354 - protein, 9 aa, Homo Sapiens
EGLICSRVS

SEQ ID NO: 978355 - protein, 9 aa, Homo Sapiens
EKCCQDQEQ

SEQ ID NO: 978356 - protein, 9 aa, Homo Sapiens
SMIPAAKIY

SEQ ID NO: 978357 - protein, 9 aa, Homo Sapiens
PGPPGSPAE

SEQ ID NO: 978358 - protein, 9 aa, Homo Sapiens
TLEEVIAKL

SEQ ID NO: 978359 - protein, 9 aa, Homo Sapiens
QARQNAGIL

SEQ ID NO: 978360 - protein, 9 aa, Homo Sapiens
KRKVLLKLS

SEQ ID NO: 978361 - protein, 9 aa, Homo Sapiens
TDKCKEKRY

SEQ ID NO: 978362 - protein, 9 aa, Homo Sapiens
VSAGHCYKF

SEQ ID NO: 978363 - protein, 9 aa, Homo Sapiens
REDDAFCQG

SEQ ID NO: 978364 - protein, 9 aa, Homo Sapiens
QFQQAIEKH

SEQ ID NO: 978365 - protein, 9 aa, Homo Sapiens
ENLLQPPVP

SEQ ID NO: 978366 - protein, 9 aa, Homo Sapiens
LKYEEKLVR

SEQ ID NO: 978367 - protein, 9 aa, Homo Sapiens
QPEKEEKRK

SEQ ID NO: 978368 - protein, 9 aa, Homo Sapiens
RNGPDGPHS

SEQ ID NO: 978369 - protein, 9 aa, Homo Sapiens
IRMKFIKYL

SEQ ID NO: 978370 - protein, 9 aa, Homo Sapiens
FSFDGWKIS

SEQ ID NO: 978371 - protein, 9 aa, Homo Sapiens
TLKRYEGVP

SEQ ID NO: 978372 - protein, 9 aa, Homo Sapiens
QSSIVRAFF

SEQ ID NO: 978373 - protein, 9 aa, Homo Sapiens
PFSSKHRRS

SEQ ID NO: 978374 - protein, 9 aa, Homo Sapiens
DGYDNRLQP

SEQ ID NO: 978375 - protein, 9 aa, Homo Sapiens
LFIFLVLGA

SEQ ID NO: 978376 - protein, 9 aa, Homo Sapiens
RLQALFKSV

SEQ ID NO: 978377 - protein, 9 aa, Homo Sapiens
SVEVDINGL

SEQ ID NO: 978378 - protein, 9 aa, Homo Sapiens
SPGAMFSES

SEQ ID NO: 978379 - protein, 9 aa, Homo Sapiens
VQAQMTKQQ

SEQ ID NO: 978380 - protein, 9 aa, Homo Sapiens
NNLILEKRN

SEQ ID NO: 978381 - protein, 9 aa, Homo Sapiens
DVLCNYHLP

SEQ ID NO: 978382 - protein, 9 aa, Homo Sapiens
TSKEILRPF

SEQ ID NO: 978383 - protein, 9 aa, Homo Sapiens
RLKFHSTIK

SEQ ID NO: 978384 - protein, 9 aa, Homo Sapiens
AIEKHKEEH

SEQ ID NO: 978385 - protein, 9 aa, Homo Sapiens
GFSAHLVIH

SEQ ID NO: 978386 - protein, 9 aa, Homo Sapiens
SAFLSPVLY

SEQ ID NO: 978387 - protein, 9 aa, Homo Sapiens
YCPASVVKS

SEQ ID NO: 978388 - protein, 9 aa, Homo Sapiens
RALEAKAVA

SEQ ID NO: 978389 - protein, 9 aa, Homo Sapiens
DYDSYRRFE

SEQ ID NO: 978390 - protein, 9 aa, Homo Sapiens
TDGEGLNMF

SEQ ID NO: 978391 - protein, 9 aa, Homo Sapiens
VVGESDRID

SEQ ID NO: 978392 - protein, 9 aa, Homo Sapiens
SPDGRRATG

SEQ ID NO: 978393 - protein, 9 aa, Homo Sapiens
TKRHPDMLT

SEQ ID NO: 978394 - protein, 9 aa, Homo Sapiens
EIIQCRDGS

SEQ ID NO: 978395 - protein, 9 aa, Homo Sapiens
TIIKSRNNE

SEQ ID NO: 978396 - protein, 9 aa, Homo Sapiens
REVVDDWKF

SEQ ID NO: 978397 - protein, 9 aa, Homo Sapiens
HVLSFALQM

SEQ ID NO: 978398 - protein, 9 aa, Homo Sapiens
ILIFLKHGY

SEQ ID NO: 978399 - protein, 9 aa, Homo Sapiens
EEQKNIPRE

SEQ ID NO: 978400 - protein, 9 aa, Homo Sapiens
VKMVSLAAE

SEQ ID NO: 978401 - protein, 9 aa, Homo Sapiens
KKVSFLNIA

SEQ ID NO: 978402 - protein, 9 aa, Homo Sapiens
GVNPARVVV

SEQ ID NO: 978403 - protein, 9 aa, Homo Sapiens
AGVEAFPAG

SEQ ID NO: 978404 - protein, 9 aa, Homo Sapiens
ECPENYRRF

SEQ ID NO: 978405 - protein, 9 aa, Homo Sapiens
SMEFLSSRR

SEQ ID NO: 978406 - protein, 9 aa, Homo Sapiens
TELSSDLRL

SEQ ID NO: 978407 - protein, 9 aa, Homo Sapiens
NMPLNLEET

SEQ ID NO: 978408 - protein, 9 aa, Homo Sapiens
VAVFPQQQQ

SEQ ID NO: 978409 - protein, 9 aa, Homo Sapiens
GKLEEFFQD

SEQ ID NO: 978410 - protein, 9 aa, Homo Sapiens
GLVWRASKL

SEQ ID NO: 978411 - protein, 9 aa, Homo Sapiens
GGYNREEFL

SEQ ID NO: 978412 - protein, 9 aa, Homo Sapiens
LVNRRPCFL

SEQ ID NO: 978413 - protein, 9 aa, Homo Sapiens
SGNGEFQNY

SEQ ID NO: 978414 - protein, 9 aa, Homo Sapiens
QVPLNPSGT

SEQ ID NO: 978415 - protein, 9 aa, Homo Sapiens
LFLRREPVL

SEQ ID NO: 978416 - protein, 9 aa, Homo Sapiens
ANLHSKFPA

SEQ ID NO: 978417 - protein, 9 aa, Homo Sapiens
QKFGSHPGS

SEQ ID NO: 978418 - protein, 9 aa, Homo Sapiens
IFGYCWLSP

SEQ ID NO: 978419 - protein, 9 aa, Homo Sapiens
VEEYHDLST

SEQ ID NO: 978420 - protein, 9 aa, Homo Sapiens
FLRTVECYN

SEQ ID NO: 978421 - protein, 9 aa, Homo Sapiens
LLEQPEKEE

SEQ ID NO: 978422 - protein, 9 aa, Homo Sapiens
DLPAMLRFL

SEQ ID NO: 978423 - protein, 9 aa, Homo Sapiens
MVTSIEMHL

SEQ ID NO: 978424 - protein, 9 aa, Homo Sapiens
DGWKISFIP

SEQ ID NO: 978425 - protein, 9 aa, Homo Sapiens
YGVNPARVV

SEQ ID NO: 978426 - protein, 9 aa, Homo Sapiens
ENCPFSQRL

SEQ ID NO: 978427 - protein, 9 aa, Homo Sapiens
QRSTHAGGF

SEQ ID NO: 978428 - protein, 9 aa, Homo Sapiens
ERKQKLDES

SEQ ID NO: 978429 - protein, 9 aa, Homo Sapiens
WVWAGLGGR

SEQ ID NO: 978430 - protein, 9 aa, Homo Sapiens
GLKAFRICS

SEQ ID NO: 978431 - protein, 9 aa, Homo Sapiens
LCWNGVKEK

SEQ ID NO: 978432 - protein, 9 aa, Homo Sapiens
SYSALPPVS

SEQ ID NO: 978433 - protein, 9 aa, Homo Sapiens
RSSSPYSRS

SEQ ID NO: 978434 - protein, 9 aa, Homo Sapiens
VFSVDNKKL

SEQ ID NO: 978435 - protein, 9 aa, Homo Sapiens
TFVFFHGDL

SEQ ID NO: 978436 - protein, 9 aa, Homo Sapiens
NIKKVDREL

SEQ ID NO: 978437 - protein, 9 aa, Homo Sapiens
SISYSRCMI

SEQ ID NO: 978438 - protein, 9 aa, Homo Sapiens
DVDSFEMKF

SEQ ID NO: 978439 - protein, 9 aa, Homo Sapiens
QNTCIPSYN

SEQ ID NO: 978440 - protein, 9 aa, Homo Sapiens
IPDKFTEDE

SEQ ID NO: 978441 - protein, 9 aa, Homo Sapiens
IFFMIIFYN

SEQ ID NO: 978442 - protein, 9 aa, Homo Sapiens
RGEAKHCFI

SEQ ID NO: 978443 - protein, 9 aa, Homo Sapiens
TDEFAIAKY

SEQ ID NO: 978444 - protein, 9 aa, Homo Sapiens
KLHRPKLIR

SEQ ID NO: 978445 - protein, 9 aa, Homo Sapiens
VRKDGNLCL

SEQ ID NO: 978446 - protein, 9 aa, Homo Sapiens
ALRSSSSPS

SEQ ID NO: 978447 - protein, 9 aa, Homo Sapiens
YHLERQDLE

SEQ ID NO: 978448 - protein, 9 aa, Homo Sapiens
VGSLRRVMN

SEQ ID NO: 978449 - protein, 9 aa, Homo Sapiens
DNDPAPKKE

SEQ ID NO: 978450 - protein, 9 aa, Homo Sapiens
NLDFKVSNG

SEQ ID NO: 978451 - protein, 9 aa, Homo Sapiens
ELVLRKVGA

SEQ ID NO: 978452 - protein, 9 aa, Homo Sapiens
LFKLKEHMI

SEQ ID NO: 978453 - protein, 9 aa, Homo Sapiens
EWNDVLCNY

SEQ ID NO: 978454 - protein, 9 aa, Homo Sapiens
IACEQDYVV

SEQ ID NO: 978455 - protein, 9 aa, Homo Sapiens
EHWIKVARK

SEQ ID NO: 978456 - protein, 9 aa, Homo Sapiens
TASVEERGV

SEQ ID NO: 978457 - protein, 9 aa, Homo Sapiens
LPAPIPPHT

SEQ ID NO: 978458 - protein, 9 aa, Homo Sapiens
STGKKAPGC

SEQ ID NO: 978459 - protein, 9 aa, Homo Sapiens
KDFCLMDRK

SEQ ID NO: 978460 - protein, 9 aa, Homo Sapiens
IIEDVMGPT

SEQ ID NO: 978461 - protein, 9 aa, Homo Sapiens
ATNNKLEVL

SEQ ID NO: 978462 - protein, 9 aa, Homo Sapiens
DDWKFIAQV

SEQ ID NO: 978463 - protein, 9 aa, Homo Sapiens
HRAHCFLSA

SEQ ID NO: 978464 - protein, 9 aa, Homo Sapiens
KNPVYTFSI

SEQ ID NO: 978465 - protein, 9 aa, Homo Sapiens
MGKSQSKKL

SEQ ID NO: 978466 - protein, 9 aa, Homo Sapiens
TCDEDSVVG

SEQ ID NO: 978467 - protein, 9 aa, Homo Sapiens
PEKEEKRKT

SEQ ID NO: 978468 - protein, 9 aa, Homo Sapiens
NAKMALLAS

SEQ ID NO: 978469 - protein, 9 aa, Homo Sapiens
FKSINHMNY

SEQ ID NO: 978470 - protein, 9 aa, Homo Sapiens
SVTTNETGG

SEQ ID NO: 978471 - protein, 9 aa, Homo Sapiens
EQENGNLRR

SEQ ID NO: 978472 - protein, 9 aa, Homo Sapiens
RGVRDLREP

SEQ ID NO: 978473 - protein, 9 aa, Homo Sapiens
ASNTSDKNR

SEQ ID NO: 978474 - protein, 9 aa, Homo Sapiens
TLCWNGVKE

SEQ ID NO: 978475 - protein, 9 aa, Homo Sapiens
EAESTKSVP

SEQ ID NO: 978476 - protein, 9 aa, Homo Sapiens
PEKDESTVS

SEQ ID NO: 978477 - protein, 9 aa, Homo Sapiens
VFLRFLFGL

SEQ ID NO: 978478 - protein, 9 aa, Homo Sapiens
DFINTANWR

SEQ ID NO: 978479 - protein, 9 aa, Homo Sapiens
DGSTSIIGE

SEQ ID NO: 978480 - protein, 9 aa, Homo Sapiens
SAPENPIFR

SEQ ID NO: 978481 - protein, 9 aa, Homo Sapiens
KMRCNSTKS

SEQ ID NO: 978482 - protein, 9 aa, Homo Sapiens
SSLKIDLLI

SEQ ID NO: 978483 - protein, 9 aa, Homo Sapiens
ENPTAGVGQ

SEQ ID NO: 978484 - protein, 9 aa, Homo Sapiens
TLFQTTSSS

SEQ ID NO: 978485 - protein, 9 aa, Homo Sapiens
KIFRNIFGN

SEQ ID NO: 978486 - protein, 9 aa, Homo Sapiens
TVLEDVDPS

SEQ ID NO: 978487 - protein, 9 aa, Homo Sapiens
DTDPALRDV

SEQ ID NO: 978488 - protein, 9 aa, Homo Sapiens
MEKHRYTSA

SEQ ID NO: 978489 - protein, 9 aa, Homo Sapiens
FSVDNKKLQ

SEQ ID NO: 978490 - protein, 9 aa, Homo Sapiens
RIFAHNSVC

SEQ ID NO: 978491 - protein, 9 aa, Homo Sapiens
SCVLGLISC

SEQ ID NO: 978492 - protein, 9 aa, Homo Sapiens
QTMLRLAEN

SEQ ID NO: 978493 - protein, 9 aa, Homo Sapiens
DSKTPPHEL

SEQ ID NO: 978494 - protein, 9 aa, Homo Sapiens
RSPMPEKSQ

SEQ ID NO: 978495 - protein, 9 aa, Homo Sapiens
IYLTPTQVK

SEQ ID NO: 978496 - protein, 9 aa, Homo Sapiens
ASYSALPPV

SEQ ID NO: 978497 - protein, 9 aa, Homo Sapiens
HQGPSCSFP

SEQ ID NO: 978498 - protein, 9 aa, Homo Sapiens
EKIFLSEPV

SEQ ID NO: 978499 - protein, 9 aa, Homo Sapiens
NLVVSYPFD

SEQ ID NO: 978500 - protein, 9 aa, Homo Sapiens
ISEKVQLEI

SEQ ID NO: 978501 - protein, 9 aa, Homo Sapiens
GSLGVDSPS

SEQ ID NO: 978502 - protein, 9 aa, Homo Sapiens
KKNPAFGGK

SEQ ID NO: 978503 - protein, 9 aa, Homo Sapiens
DMVQSNDLC

SEQ ID NO: 978504 - protein, 9 aa, Homo Sapiens
VFPQQQQCS

SEQ ID NO: 978505 - protein, 9 aa, Homo Sapiens
SSLETHNKI

SEQ ID NO: 978506 - protein, 9 aa, Homo Sapiens
SEYSGFSAH

SEQ ID NO: 978507 - protein, 9 aa, Homo Sapiens
FSSKTAHVT

SEQ ID NO: 978508 - protein, 9 aa, Homo Sapiens
EGEARVRVE

SEQ ID NO: 978509 - protein, 9 aa, Homo Sapiens
AVTGFSVEE

SEQ ID NO: 978510 - protein, 9 aa, Homo Sapiens
NDPAPKKER

SEQ ID NO: 978511 - protein, 9 aa, Homo Sapiens
LSAKHTSHN

SEQ ID NO: 978512 - protein, 9 aa, Homo Sapiens
FGRTPTLPG

SEQ ID NO: 978513 - protein, 9 aa, Homo Sapiens
RQNSARNFG

SEQ ID NO: 978514 - protein, 9 aa, Homo Sapiens
PKKEFQATV

SEQ ID NO: 978515 - protein, 9 aa, Homo Sapiens
VVNVGVAEV

SEQ ID NO: 978516 - protein, 9 aa, Homo Sapiens
PKVVIFAAK

SEQ ID NO: 978517 - protein, 9 aa, Homo Sapiens
PFPSDVSNA

SEQ ID NO: 978518 - protein, 9 aa, Homo Sapiens
PGPQGPLGP

SEQ ID NO: 978519 - protein, 9 aa, Homo Sapiens
EVVEGNLMK

SEQ ID NO: 978520 - protein, 9 aa, Homo Sapiens
HQCRPRSSF

SEQ ID NO: 978521 - protein, 9 aa, Homo Sapiens
FQELKQRTK

SEQ ID NO: 978522 - protein, 9 aa, Homo Sapiens
GEKEDLGLP

SEQ ID NO: 978523 - protein, 9 aa, Homo Sapiens
KKDEIGLDL

SEQ ID NO: 978524 - protein, 9 aa, Homo Sapiens
AFAAEPTSS

SEQ ID NO: 978525 - protein, 9 aa, Homo Sapiens
FQNRRANCR

SEQ ID NO: 978526 - protein, 9 aa, Homo Sapiens
RIGCFLMGT

SEQ ID NO: 978527 - protein, 9 aa, Homo Sapiens
PLNLDSQRM

SEQ ID NO: 978528 - protein, 9 aa, Homo Sapiens
AAPQTYVEY

SEQ ID NO: 978529 - protein, 9 aa, Homo Sapiens
MDIYVHCLS

SEQ ID NO: 978530 - protein, 9 aa, Homo Sapiens
FVFFHGDLR

SEQ ID NO: 978531 - protein, 9 aa, Homo Sapiens
TEAGLKAFR

SEQ ID NO: 978532 - protein, 9 aa, Homo Sapiens
IPKLAPGDN

SEQ ID NO: 978533 - protein, 9 aa, Homo Sapiens
NDHSPKFPK

SEQ ID NO: 978534 - protein, 9 aa, Homo Sapiens
KSRPVLRVT

SEQ ID NO: 978535 - protein, 9 aa, Homo Sapiens
AKFPAPMNK

SEQ ID NO: 978536 - protein, 9 aa, Homo Sapiens
IASFNITSV

SEQ ID NO: 978537 - protein, 9 aa, Homo Sapiens
VWSWLEFFF

SEQ ID NO: 978538 - protein, 9 aa, Homo Sapiens
KTIQFGEKM

SEQ ID NO: 978539 - protein, 9 aa, Homo Sapiens
GSLTGHKEH

SEQ ID NO: 978540 - protein, 9 aa, Homo Sapiens
RVKDSTKAL

SEQ ID NO: 978541 - protein, 9 aa, Homo Sapiens
SNSMEFLSS

SEQ ID NO: 978542 - protein, 9 aa, Homo Sapiens
QVSLSENLL

SEQ ID NO: 978543 - protein, 9 aa, Homo Sapiens
FLEEAEIYF

SEQ ID NO: 978544 - protein, 9 aa, Homo Sapiens
WRASKLVPV

SEQ ID NO: 978545 - protein, 9 aa, Homo Sapiens
KCKQLSRLC

SEQ ID NO: 978546 - protein, 9 aa, Homo Sapiens
PGAASGPPR

SEQ ID NO: 978547 - protein, 9 aa, Homo Sapiens
GSNNIEGIN

SEQ ID NO: 978548 - protein, 9 aa, Homo Sapiens
TAGKEEYSA

SEQ ID NO: 978549 - protein, 9 aa, Homo Sapiens
LLPVIIVGN

SEQ ID NO: 978550 - protein, 9 aa, Homo Sapiens
AAEFLLPAI

SEQ ID NO: 978551 - protein, 9 aa, Homo Sapiens
PLSLVWPFS

SEQ ID NO: 978552 - protein, 9 aa, Homo Sapiens
DVAAYCPAS

SEQ ID NO: 978553 - protein, 9 aa, Homo Sapiens
VRNKANATR

SEQ ID NO: 978554 - protein, 9 aa, Homo Sapiens
ARAARYHSC

SEQ ID NO: 978555 - protein, 9 aa, Homo Sapiens
PLFLRREPV

SEQ ID NO: 978556 - protein, 9 aa, Homo Sapiens
FMVETAFAN

SEQ ID NO: 978557 - protein, 9 aa, Homo Sapiens
WNDVLCNYH

SEQ ID NO: 978558 - protein, 9 aa, Homo Sapiens
SLTIPDKFT

SEQ ID NO: 978559 - protein, 9 aa, Homo Sapiens
SSQVTKDSG

SEQ ID NO: 978560 - protein, 9 aa, Homo Sapiens
EIMALCDTH

SEQ ID NO: 978561 - protein, 9 aa, Homo Sapiens
DLSLMQPPP

SEQ ID NO: 978562 - protein, 9 aa, Homo Sapiens
SIENCPFSQ

SEQ ID NO: 978563 - protein, 9 aa, Homo Sapiens
ALSKEILEK

SEQ ID NO: 978564 - protein, 9 aa, Homo Sapiens
KFYEVITSP

SEQ ID NO: 978565 - protein, 9 aa, Homo Sapiens
SSRIGLLAP

SEQ ID NO: 978566 - protein, 9 aa, Homo Sapiens
PASIGYNIG

SEQ ID NO: 978567 - protein, 9 aa, Homo Sapiens
LVCDQKWLA

SEQ ID NO: 978568 - protein, 9 aa, Homo Sapiens
TGRRRDAGP

SEQ ID NO: 978569 - protein, 9 aa, Homo Sapiens
KNWQMLAQK

SEQ ID NO: 978570 - protein, 9 aa, Homo Sapiens
VAGSGPAAA

SEQ ID NO: 978571 - protein, 9 aa, Homo Sapiens
CRKVFSHHA

SEQ ID NO: 978572 - protein, 9 aa, Homo Sapiens
VCAAGIETR

SEQ ID NO: 978573 - protein, 9 aa, Homo Sapiens
KVIKAPIKD

SEQ ID NO: 978574 - protein, 9 aa, Homo Sapiens
PECVESLHQ

SEQ ID NO: 978575 - protein, 9 aa, Homo Sapiens
LHRGLVHPG

SEQ ID NO: 978576 - protein, 9 aa, Homo Sapiens
TYTFVFFHG

SEQ ID NO: 978577 - protein, 9 aa, Homo Sapiens
SKKDRETLY

SEQ ID NO: 978578 - protein, 9 aa, Homo Sapiens
VEARSSSWN

SEQ ID NO: 978579 - protein, 9 aa, Homo Sapiens
RTRLPPTPK

SEQ ID NO: 978580 - protein, 9 aa, Homo Sapiens
TFILLWTWS

SEQ ID NO: 978581 - protein, 9 aa, Homo Sapiens
TVQELRVRA

SEQ ID NO: 978582 - protein, 9 aa, Homo Sapiens
ILLWTWSRR

SEQ ID NO: 978583 - protein, 9 aa, Homo Sapiens
RSKIYLEFV

SEQ ID NO: 978584 - protein, 9 aa, Homo Sapiens
TSNYLIYLD

SEQ ID NO: 978585 - protein, 9 aa, Homo Sapiens
IVQNPHAFS

SEQ ID NO: 978586 - protein, 9 aa, Homo Sapiens
SQRTCCRPK

SEQ ID NO: 978587 - protein, 9 aa, Homo Sapiens
MRTDRRFDE

SEQ ID NO: 978588 - protein, 9 aa, Homo Sapiens
LRREINVLR

SEQ ID NO: 978589 - protein, 9 aa, Homo Sapiens
YLEFVLSHR

SEQ ID NO: 978590 - protein, 9 aa, Homo Sapiens
VVRSSRNNY

SEQ ID NO: 978591 - protein, 9 aa, Homo Sapiens
FPSDVSNAP

SEQ ID NO: 978592 - protein, 9 aa, Homo Sapiens
AEKKRCEIL

SEQ ID NO: 978593 - protein, 9 aa, Homo Sapiens
ELMDQEDSE

SEQ ID NO: 978594 - protein, 9 aa, Homo Sapiens
VTESKHLSE

SEQ ID NO: 978595 - protein, 9 aa, Homo Sapiens
VPPTSSVSP

SEQ ID NO: 978596 - protein, 9 aa, Homo Sapiens
LITVIENLL

SEQ ID NO: 978597 - protein, 9 aa, Homo Sapiens
DSESEFLVF

SEQ ID NO: 978598 - protein, 9 aa, Homo Sapiens
WDPGTAADP

SEQ ID NO: 978599 - protein, 9 aa, Homo Sapiens
SAYYGKIPK

SEQ ID NO: 978600 - protein, 9 aa, Homo Sapiens
HDFVDKIVI

SEQ ID NO: 978601 - protein, 9 aa, Homo Sapiens
FYLPRVCSY

SEQ ID NO: 978602 - protein, 9 aa, Homo Sapiens
QANMPLNLE

SEQ ID NO: 978603 - protein, 9 aa, Homo Sapiens
RSLTTTFFF

SEQ ID NO: 978604 - protein, 9 aa, Homo Sapiens
SLPFFRVST

SEQ ID NO: 978605 - protein, 9 aa, Homo Sapiens
FWNKEFAYQ

SEQ ID NO: 978606 - protein, 9 aa, Homo Sapiens
RKFGCAKTL

SEQ ID NO: 978607 - protein, 9 aa, Homo Sapiens
CAHSPCVNG

SEQ ID NO: 978608 - protein, 9 aa, Homo Sapiens
LGVVTRHLA

SEQ ID NO: 978609 - protein, 9 aa, Homo Sapiens
GELATWGAR

SEQ ID NO: 978610 - protein, 9 aa, Homo Sapiens
GYPLWMVTF

SEQ ID NO: 978611 - protein, 9 aa, Homo Sapiens
WVKPIIIGC

SEQ ID NO: 978612 - protein, 9 aa, Homo Sapiens
TVIIFPYLY

SEQ ID NO: 978613 - protein, 9 aa, Homo Sapiens
MSCGGGRSF

SEQ ID NO: 978614 - protein, 9 aa, Homo Sapiens
VDVGGLRSE

SEQ ID NO: 978615 - protein, 9 aa, Homo Sapiens
WGARMHYKG

SEQ ID NO: 978616 - protein, 9 aa, Homo Sapiens
VGLRNRTEL

SEQ ID NO: 978617 - protein, 9 aa, Homo Sapiens
DSLYVPCAH

SEQ ID NO: 978618 - protein, 9 aa, Homo Sapiens
QKVNVVTVL

SEQ ID NO: 978619 - protein, 9 aa, Homo Sapiens
VVTRHLAAG

SEQ ID NO: 978620 - protein, 9 aa, Homo Sapiens
LRNRTELLE

SEQ ID NO: 978621 - protein, 9 aa, Homo Sapiens
PVVVESCIR

SEQ ID NO: 978622 - protein, 9 aa, Homo Sapiens
NSYPRNLYR

SEQ ID NO: 978623 - protein, 9 aa, Homo Sapiens
AHLELPTVV

SEQ ID NO: 978624 - protein, 9 aa, Homo Sapiens
RQPIHFQNH

SEQ ID NO: 978625 - protein, 9 aa, Homo Sapiens
LATWGARMH

SEQ ID NO: 978626 - protein, 9 aa, Homo Sapiens
HIELSDQKV

SEQ ID NO: 978627 - protein, 9 aa, Homo Sapiens
CHYDLAEIQ

SEQ ID NO: 978628 - protein, 9 aa, Homo Sapiens
STLQLAASV

SEQ ID NO: 978629 - protein, 9 aa, Homo Sapiens
GLPVLLAPK

SEQ ID NO: 978630 - protein, 9 aa, Homo Sapiens
EGYPLWMVT

SEQ ID NO: 978631 - protein, 9 aa, Homo Sapiens
DWVGLRNRT

SEQ ID NO: 978632 - protein, 9 aa, Homo Sapiens
WMVTFPVRV

SEQ ID NO: 978633 - protein, 9 aa, Homo Sapiens
LGVGELATW

SEQ ID NO: 978634 - protein, 9 aa, Homo Sapiens
ASAICHYDL

SEQ ID NO: 978635 - protein, 9 aa, Homo Sapiens
IIGCHAYGD

SEQ ID NO: 978636 - protein, 9 aa, Homo Sapiens
ECLNSYPRN

SEQ ID NO: 978637 - protein, 9 aa, Homo Sapiens
FVTAFLGVF

SEQ ID NO: 978638 - protein, 9 aa, Homo Sapiens
ELSDQKVNV

SEQ ID NO: 978639 - protein, 9 aa, Homo Sapiens
VIIFPYLYE

SEQ ID NO: 978640 - protein, 9 aa, Homo Sapiens
PCAHSPCVN

SEQ ID NO: 978641 - protein, 9 aa, Homo Sapiens
SDQKVNVVT

SEQ ID NO: 978642 - protein, 9 aa, Homo Sapiens
DNMDEYVHN

SEQ ID NO: 978643 - protein, 9 aa, Homo Sapiens
IDNMDEYVH

SEQ ID NO: 978644 - protein, 9 aa, Homo Sapiens
DAAVEDAQG

SEQ ID NO: 978645 - protein, 9 aa, Homo Sapiens
PEFVTAFLG

SEQ ID NO: 978646 - protein, 9 aa, Homo Sapiens
VTVLSLEGL

SEQ ID NO: 978647 - protein, 9 aa, Homo Sapiens
ELATWGARM

SEQ ID NO: 978648 - protein, 9 aa, Homo Sapiens
GSSAPEFVT

SEQ ID NO: 978649 - protein, 9 aa, Homo Sapiens
SQAIPVVVE

SEQ ID NO: 978650 - protein, 9 aa, Homo Sapiens
AIPVVVESC

SEQ ID NO: 978651 - protein, 9 aa, Homo Sapiens
LGPPLIRVT

SEQ ID NO: 978652 - protein, 9 aa, Homo Sapiens
IIIGCHAYG

SEQ ID NO: 978653 - protein, 9 aa, Homo Sapiens
QIPPLELGN

SEQ ID NO: 978654 - protein, 9 aa, Homo Sapiens
YPLWMVTFP

SEQ ID NO: 978655 - protein, 9 aa, Homo Sapiens
RHLAAGHRL

SEQ ID NO: 978656 - protein, 9 aa, Homo Sapiens
SAICHYDLA

SEQ ID NO: 978657 - protein, 9 aa, Homo Sapiens
PPLELGNDQ

SEQ ID NO: 978658 - protein, 9 aa, Homo Sapiens
RMVDVGGLR

SEQ ID NO: 978659 - protein, 9 aa, Homo Sapiens
HLAAGHRLE

SEQ ID NO: 978660 - protein, 9 aa, Homo Sapiens
LYVPCAHSP

SEQ ID NO: 978661 - protein, 9 aa, Homo Sapiens
RMSCGGGRS

SEQ ID NO: 978662 - protein, 9 aa, Homo Sapiens
VVVESCIRF

SEQ ID NO: 978663 - protein, 9 aa, Homo Sapiens
LRSERRKWI

SEQ ID NO: 978664 - protein, 9 aa, Homo Sapiens
MVTFPVRVF

SEQ ID NO: 978665 - protein, 9 aa, Homo Sapiens
VLSLEGLGD

SEQ ID NO: 978666 - protein, 9 aa, Homo Sapiens
IELSDQKVN

SEQ ID NO: 978667 - protein, 9 aa, Homo Sapiens
HYDLAEIQA

SEQ ID NO: 978668 - protein, 9 aa, Homo Sapiens
LLGVVTRHL

SEQ ID NO: 978669 - protein, 9 aa, Homo Sapiens
HLLGPPLIR

SEQ ID NO: 978670 - protein, 9 aa, Homo Sapiens
IPVVVESCI

SEQ ID NO: 978671 - protein, 9 aa, Homo Sapiens
HFQNHVAHL

SEQ ID NO: 978672 - protein, 9 aa, Homo Sapiens
TRHLAAGHR

SEQ ID NO: 978673 - protein, 9 aa, Homo Sapiens
PVLLAPKRQ

SEQ ID NO: 978674 - protein, 9 aa, Homo Sapiens
VAHLELPTV

SEQ ID NO: 978675 - protein, 9 aa, Homo Sapiens
ALRDWSTLQ

SEQ ID NO: 978676 - protein, 9 aa, Homo Sapiens
KRQPIHFQN

SEQ ID NO: 978677 - protein, 9 aa, Homo Sapiens
PPQIPPLEL

SEQ ID NO: 978678 - protein, 9 aa, Homo Sapiens
GLRSERRKW

SEQ ID NO: 978679 - protein, 9 aa, Homo Sapiens
VFKTHLLGP

SEQ ID NO: 978680 - protein, 9 aa, Homo Sapiens
AAVEDAQGH

SEQ ID NO: 978681 - protein, 9 aa, Homo Sapiens
QNHVAHLEL

SEQ ID NO: 978682 - protein, 9 aa, Homo Sapiens
EWECLNSYP

SEQ ID NO: 978683 - protein, 9 aa, Homo Sapiens
FKTHLLGPP

SEQ ID NO: 978684 - protein, 9 aa, Homo Sapiens
IFPYLYESY

SEQ ID NO: 978685 - protein, 9 aa, Homo Sapiens
THTVIIFPY

SEQ ID NO: 978686 - protein, 9 aa, Homo Sapiens
LRDWSTLQL

SEQ ID NO: 978687 - protein, 9 aa, Homo Sapiens
AFALRDWST

SEQ ID NO: 978688 - protein, 9 aa, Homo Sapiens
NDNTPTFHN

SEQ ID NO: 978689 - protein, 9 aa, Homo Sapiens
VTRHLAAGH

SEQ ID NO: 978690 - protein, 9 aa, Homo Sapiens
GGGRSFCPP

SEQ ID NO: 978691 - protein, 9 aa, Homo Sapiens
AVEDAQGHI

SEQ ID NO: 978692 - protein, 9 aa, Homo Sapiens
PIHFQNHVA

SEQ ID NO: 978693 - protein, 9 aa, Homo Sapiens
LNSYPRNLY

SEQ ID NO: 978694 - protein, 9 aa, Homo Sapiens
CHAYGDQYR

SEQ ID NO: 978695 - protein, 9 aa, Homo Sapiens
GGRSFCPPG

SEQ ID NO: 978696 - protein, 9 aa, Homo Sapiens
LEHHIELSD

SEQ ID NO: 978697 - protein, 9 aa, Homo Sapiens
LSDQKVNVV

SEQ ID NO: 978698 - protein, 9 aa, Homo Sapiens
SPVDAAVED

SEQ ID NO: 978699 - protein, 9 aa, Homo Sapiens
VVTVLSLEG

SEQ ID NO: 978700 - protein, 9 aa, Homo Sapiens
LGDNAGGLP

SEQ ID NO: 978701 - protein, 9 aa, Homo Sapiens
YEGYPLWMV

SEQ ID NO: 978702 - protein, 9 aa, Homo Sapiens
APEFVTAFL

SEQ ID NO: 978703 - protein, 9 aa, Homo Sapiens
LPVLLAPKR

SEQ ID NO: 978704 - protein, 9 aa, Homo Sapiens
AHSPCVNGG

SEQ ID NO: 978705 - protein, 9 aa, Homo Sapiens
YVHNTTARA

SEQ ID NO: 978706 - protein, 9 aa, Homo Sapiens
ICHYDLAEI

SEQ ID NO: 978707 - protein, 9 aa, Homo Sapiens
PLWMVTFPV

SEQ ID NO: 978708 - protein, 9 aa, Homo Sapiens
QVGDVNDNT

SEQ ID NO: 978709 - protein, 9 aa, Homo Sapiens
LSLEGLGDN

SEQ ID NO: 978710 - protein, 9 aa, Homo Sapiens
NVVTVLSLE

SEQ ID NO: 978711 - protein, 9 aa, Homo Sapiens
IIFPYLYES

SEQ ID NO: 978712 - protein, 9 aa, Homo Sapiens
DEYVHNTTA

SEQ ID NO: 978713 - protein, 9 aa, Homo Sapiens
FQNHVAHLE

SEQ ID NO: 978714 - protein, 9 aa, Homo Sapiens
DQKVNVVTV

SEQ ID NO: 978715 - protein, 9 aa, Homo Sapiens
CGGGRSFCP

SEQ ID NO: 978716 - protein, 9 aa, Homo Sapiens
DNAGGLPVL

SEQ ID NO: 978717 - protein, 9 aa, Homo Sapiens
VEDAQGHIW

SEQ ID NO: 978718 - protein, 9 aa, Homo Sapiens
SHDWVGLRN

SEQ ID NO: 978719 - protein, 9 aa, Homo Sapiens
WSTLQLAAS

SEQ ID NO: 978720 - protein, 9 aa, Homo Sapiens
PRNLYRDVI

SEQ ID NO: 978721 - protein, 9 aa, Homo Sapiens
HHIELSDQK

SEQ ID NO: 978722 - protein, 9 aa, Homo Sapiens
DVGGLRSER

SEQ ID NO: 978723 - protein, 9 aa, Homo Sapiens
MDEYVHNTT

SEQ ID NO: 978724 - protein, 9 aa, Homo Sapiens
SFCPPGHPL

SEQ ID NO: 978725 - protein, 9 aa, Homo Sapiens
QDSSQAIPV

SEQ ID NO: 978726 - protein, 9 aa, Homo Sapiens
LAAGHRLEE

SEQ ID NO: 978727 - protein, 9 aa, Homo Sapiens
GLGDNAGGL

SEQ ID NO: 978728 - protein, 9 aa, Homo Sapiens
APKRQPIHF

SEQ ID NO: 978729 - protein, 9 aa, Homo Sapiens
IGCHAYGDQ

SEQ ID NO: 978730 - protein, 9 aa, Homo Sapiens
EYVHNTTAR

SEQ ID NO: 978731 - protein, 9 aa, Homo Sapiens
DTHTVIIFP

SEQ ID NO: 978732 - protein, 9 aa, Homo Sapiens
TVLSLEGLG

SEQ ID NO: 978733 - protein, 9 aa, Homo Sapiens
LEASAICHY

SEQ ID NO: 978734 - protein, 9 aa, Homo Sapiens
TLEASAICH

SEQ ID NO: 978735 - protein, 9 aa, Homo Sapiens
FPYLYESYS

SEQ ID NO: 978736 - protein, 9 aa, Homo Sapiens
YVPCAHSPC

SEQ ID NO: 978737 - protein, 9 aa, Homo Sapiens
NTPTFHNQP

SEQ ID NO: 978738 - protein, 9 aa, Homo Sapiens
PVDAAVEDA

SEQ ID NO: 978739 - protein, 9 aa, Homo Sapiens
LPPQIPPLE

SEQ ID NO: 978740 - protein, 9 aa, Homo Sapiens
LLGPPLIRV

SEQ ID NO: 978741 - protein, 9 aa, Homo Sapiens
KPIIIGCHA

SEQ ID NO: 978742 - protein, 9 aa, Homo Sapiens
DVNDNTPTF

SEQ ID NO: 978743 - protein, 9 aa, Homo Sapiens
LAFALRDWS

SEQ ID NO: 978744 - protein, 9 aa, Homo Sapiens
GDVNDNTPT

SEQ ID NO: 978745 - protein, 9 aa, Homo Sapiens
PIIIGCHAY

SEQ ID NO: 978746 - protein, 9 aa, Homo Sapiens
IHFQNHVAH

SEQ ID NO: 978747 - protein, 9 aa, Homo Sapiens
GRSFCPPGH

SEQ ID NO: 978748 - protein, 9 aa, Homo Sapiens
FALRDWSTL

SEQ ID NO: 978749 - protein, 9 aa, Homo Sapiens
VNDNTPTFH

SEQ ID NO: 978750 - protein, 9 aa, Homo Sapiens
SSAPEFVTA

SEQ ID NO: 978751 - protein, 9 aa, Homo Sapiens
LEGLGDNAG

SEQ ID NO: 978752 - protein, 9 aa, Homo Sapiens
DNTPTFHNQ

SEQ ID NO: 978753 - protein, 9 aa, Homo Sapiens
SSQAIPVVV

SEQ ID NO: 978754 - protein, 9 aa, Homo Sapiens
RDWSTLQLA

SEQ ID NO: 978755 - protein, 9 aa, Homo Sapiens
GPPLIRVTG

SEQ ID NO: 978756 - protein, 9 aa, Homo Sapiens
SAPEFVTAF

SEQ ID NO: 978757 - protein, 9 aa, Homo Sapiens
SCGGGRSFC

SEQ ID NO: 978758 - protein, 9 aa, Homo Sapiens
VHNTTARAF

SEQ ID NO: 978759 - protein, 9 aa, Homo Sapiens
VPCAHSPCV

SEQ ID NO: 978760 - protein, 9 aa, Homo Sapiens
YPRNLYRDV

SEQ ID NO: 978761 - protein, 9 aa, Homo Sapiens
EASAICHYD

SEQ ID NO: 978762 - protein, 9 aa, Homo Sapiens
HNTTARAFA

SEQ ID NO: 978763 - protein, 9 aa, Homo Sapiens
HTVIIFPYL

SEQ ID NO: 978764 - protein, 9 aa, Homo Sapiens
GGLPVLLAP

SEQ ID NO: 978765 - protein, 9 aa, Homo Sapiens
EGLGDNAGG

SEQ ID NO: 978766 - protein, 9 aa, Homo Sapiens
QAIPVVVES

SEQ ID NO: 978767 - protein, 9 aa, Homo Sapiens
FRMVDVGGL

SEQ ID NO: 978768 - protein, 9 aa, Homo Sapiens
KTHLLGPPL

SEQ ID NO: 978769 - protein, 9 aa, Homo Sapiens
GGLRSERRK

SEQ ID NO: 978770 - protein, 9 aa, Homo Sapiens
LPSPVDAAV

SEQ ID NO: 978771 - protein, 9 aa, Homo Sapiens
GLRNRTELL

SEQ ID NO: 978772 - protein, 9 aa, Homo Sapiens
EFVTAFLGV

SEQ ID NO: 978773 - protein, 9 aa, Homo Sapiens
SLYVPCAHS

SEQ ID NO: 978774 - protein, 9 aa, Homo Sapiens
HSPCVNGGT

SEQ ID NO: 978775 - protein, 9 aa, Homo Sapiens
HDWVGLRNR

SEQ ID NO: 978776 - protein, 9 aa, Homo Sapiens
VNVVTVLSL

SEQ ID NO: 978777 - protein, 9 aa, Homo Sapiens
RNRTELLEN

SEQ ID NO: 978778 - protein, 9 aa, Homo Sapiens
PKRQPIHFQ

SEQ ID NO: 978779 - protein, 9 aa, Homo Sapiens
MYEGYPLWM

SEQ ID NO: 978780 - protein, 9 aa, Homo Sapiens
LDTHTVIIF

SEQ ID NO: 978781 - protein, 9 aa, Homo Sapiens
AGSSAPEFV

SEQ ID NO: 978782 - protein, 9 aa, Homo Sapiens
LAPKRQPIH

SEQ ID NO: 978783 - protein, 9 aa, Homo Sapiens
GVVTRHLAA

SEQ ID NO: 978784 - protein, 9 aa, Homo Sapiens
TWGARMHYK

SEQ ID NO: 978785 - protein, 9 aa, Homo Sapiens
NMDEYVHNT

SEQ ID NO: 978786 - protein, 9 aa, Homo Sapiens
NHVAHLELP

SEQ ID NO: 978787 - protein, 9 aa, Homo Sapiens
VGDVNDNTP

SEQ ID NO: 978788 - protein, 9 aa, Homo Sapiens
LWMVTFPVR

SEQ ID NO: 978789 - protein, 9 aa, Homo Sapiens
KVNVVTVLS

SEQ ID NO: 978790 - protein, 9 aa, Homo Sapiens
TPTFHNQPY

SEQ ID NO: 978791 - protein, 9 aa, Homo Sapiens
GCHAYGDQY

SEQ ID NO: 978792 - protein, 9 aa, Homo Sapiens
THLLGPPLI

SEQ ID NO: 978793 - protein, 9 aa, Homo Sapiens
QPIHFQNHV

SEQ ID NO: 978794 - protein, 9 aa, Homo Sapiens
HLELPTVVS

SEQ ID NO: 978795 - protein, 9 aa, Homo Sapiens
VKPIIIGCH

SEQ ID NO: 978796 - protein, 9 aa, Homo Sapiens
AAGSSAPEF

SEQ ID NO: 978797 - protein, 9 aa, Homo Sapiens
SYPRNLYRD

SEQ ID NO: 978798 - protein, 9 aa, Homo Sapiens
VDAAVEDAQ

SEQ ID NO: 978799 - protein, 9 aa, Homo Sapiens
IPPLELGND

SEQ ID NO: 978800 - protein, 9 aa, Homo Sapiens
HVAHLELPT

SEQ ID NO: 978801 - protein, 9 aa, Homo Sapiens
NAGGLPVLL

SEQ ID NO: 978802 - protein, 9 aa, Homo Sapiens
VKLPPQIPP

SEQ ID NO: 978803 - protein, 9 aa, Homo Sapiens
DSSQAIPVV

SEQ ID NO: 978804 - protein, 9 aa, Homo Sapiens
HSHDWVGLR

SEQ ID NO: 978805 - protein, 9 aa, Homo Sapiens
ATWGARMHY

SEQ ID NO: 978806 - protein, 9 aa, Homo Sapiens
KLPPQIPPL

SEQ ID NO: 978807 - protein, 9 aa, Homo Sapiens
RSFCPPGHP

SEQ ID NO: 978808 - protein, 9 aa, Homo Sapiens
WECLNSYPR

SEQ ID NO: 978809 - protein, 9 aa, Homo Sapiens
PLELGNDQE

SEQ ID NO: 978810 - protein, 9 aa, Homo Sapiens
CLNSYPRNL

SEQ ID NO: 978811 - protein, 9 aa, Homo Sapiens
SLEGLGDNA

SEQ ID NO: 978812 - protein, 9 aa, Homo Sapiens
AICHYDLAE

SEQ ID NO: 978813 - protein, 9 aa, Homo Sapiens
WVGLRNRTE

SEQ ID NO: 978814 - protein, 9 aa, Homo Sapiens
MVDVGGLRS

SEQ ID NO: 978815 - protein, 9 aa, Homo Sapiens
PSPVDAAVE

SEQ ID NO: 978816 - protein, 9 aa, Homo Sapiens
GVGELATWG

SEQ ID NO: 978817 - protein, 9 aa, Homo Sapiens
AGGLPVLLA

SEQ ID NO: 978818 - protein, 9 aa, Homo Sapiens
VGGLRSERR

SEQ ID NO: 978819 - protein, 9 aa, Homo Sapiens
EHHIELSDQ

SEQ ID NO: 978820 - protein, 9 aa, Homo Sapiens
DWSTLQLAA

SEQ ID NO: 978821 - protein, 9 aa, Homo Sapiens
PPLIRVTGA

SEQ ID NO: 978822 - protein, 9 aa, Homo Sapiens
VGELATWGA

SEQ ID NO: 978823 - protein, 9 aa, Homo Sapiens
GDNAGGLPV

SEQ ID NO: 978824 - protein, 9 aa, Homo Sapiens
VLLAPKRQP

SEQ ID NO: 978825 - protein, 9 aa, Homo Sapiens
LLAPKRQPI

SEQ ID NO: 978826 - protein, 9 aa, Homo Sapiens
PQIPPLELG

SEQ ID NO: 978827 - protein, 9 aa, Homo Sapiens
RGRSAWTVR

SEQ ID NO: 978828 - protein, 9 aa, Homo Sapiens
SVEADLQVL

SEQ ID NO: 978829 - protein, 9 aa, Homo Sapiens
ENEYIVVME

SEQ ID NO: 978830 - protein, 9 aa, Homo Sapiens
DLQVLQGNL

SEQ ID NO: 978831 - protein, 9 aa, Homo Sapiens
FLMKDDMGR

SEQ ID NO: 978832 - protein, 9 aa, Homo Sapiens
DQSFYIRDD

SEQ ID NO: 978833 - protein, 9 aa, Homo Sapiens
LVVVGARGV

SEQ ID NO: 978834 - protein, 9 aa, Homo Sapiens
AYMIINGFP

SEQ ID NO: 978835 - protein, 9 aa, Homo Sapiens
SLGKADSPP

SEQ ID NO: 978836 - protein, 9 aa, Homo Sapiens
VQRSMWGGY

SEQ ID NO: 978837 - protein, 9 aa, Homo Sapiens
TVRAPRRPS

SEQ ID NO: 978838 - protein, 9 aa, Homo Sapiens
HKTDHIHHQ

SEQ ID NO: 978839 - protein, 9 aa, Homo Sapiens
LQVPLQSLE

SEQ ID NO: 978840 - protein, 9 aa, Homo Sapiens
QQEEELLES

SEQ ID NO: 978841 - protein, 9 aa, Homo Sapiens
QAGGAEQLH

SEQ ID NO: 978842 - protein, 9 aa, Homo Sapiens
TSHTASPLP

SEQ ID NO: 978843 - protein, 9 aa, Homo Sapiens
ECLDLDLTA

SEQ ID NO: 978844 - protein, 9 aa, Homo Sapiens
TAAAAACPA

SEQ ID NO: 978845 - protein, 9 aa, Homo Sapiens
AALRGGPEY

SEQ ID NO: 978846 - protein, 9 aa, Homo Sapiens
FLSEFGAPR

SEQ ID NO: 978847 - protein, 9 aa, Homo Sapiens
RAACRRRGR

SEQ ID NO: 978848 - protein, 9 aa, Homo Sapiens
TTWSSIAST

SEQ ID NO: 978849 - protein, 9 aa, Homo Sapiens
EVLPDEFPA

SEQ ID NO: 978850 - protein, 9 aa, Homo Sapiens
RRRTIARAS

SEQ ID NO: 978851 - protein, 9 aa, Homo Sapiens
LRGPSSPPT

SEQ ID NO: 978852 - protein, 9 aa, Homo Sapiens
TIARASAWT

SEQ ID NO: 978853 - protein, 9 aa, Homo Sapiens
LDCHSPQLL

SEQ ID NO: 978854 - protein, 9 aa, Homo Sapiens
KGLIKQWVK

SEQ ID NO: 978855 - protein, 9 aa, Homo Sapiens
DYLNTRSLN

SEQ ID NO: 978856 - protein, 9 aa, Homo Sapiens
VLLVLLGLP

SEQ ID NO: 978857 - protein, 9 aa, Homo Sapiens
AIGVQGQQA

SEQ ID NO: 978858 - protein, 9 aa, Homo Sapiens
QPIDELAYM

SEQ ID NO: 978859 - protein, 9 aa, Homo Sapiens
RGNGLQYWK

SEQ ID NO: 978860 - protein, 9 aa, Homo Sapiens
LQLQVPLQS

SEQ ID NO: 978861 - protein, 9 aa, Homo Sapiens
LNHHNLLFC

SEQ ID NO: 978862 - protein, 9 aa, Homo Sapiens
WGGYIGSTY

SEQ ID NO: 978863 - protein, 9 aa, Homo Sapiens
CEQCGKFFI

SEQ ID NO: 978864 - protein, 9 aa, Homo Sapiens
GAAPRAACR

SEQ ID NO: 978865 - protein, 9 aa, Homo Sapiens
SIDQYYCLV

SEQ ID NO: 978866 - protein, 9 aa, Homo Sapiens
NEYIVVMET

SEQ ID NO: 978867 - protein, 9 aa, Homo Sapiens
QGQLDKGVA

SEQ ID NO: 978868 - protein, 9 aa, Homo Sapiens
DEHEAHQER

SEQ ID NO: 978869 - protein, 9 aa, Homo Sapiens
GCIFAELGN

SEQ ID NO: 978870 - protein, 9 aa, Homo Sapiens
FSHFYWRQK

SEQ ID NO: 978871 - protein, 9 aa, Homo Sapiens
RRPSPCPRP

SEQ ID NO: 978872 - protein, 9 aa, Homo Sapiens
FSRRSSQDY

SEQ ID NO: 978873 - protein, 9 aa, Homo Sapiens
CKKSRCSCC

SEQ ID NO: 978874 - protein, 9 aa, Homo Sapiens
GRLQLQVPL

SEQ ID NO: 978875 - protein, 9 aa, Homo Sapiens
GGLDCHSPQ

SEQ ID NO: 978876 - protein, 9 aa, Homo Sapiens
TNLLAVNTD

SEQ ID NO: 978877 - protein, 9 aa, Homo Sapiens
QLLLRGAVG

SEQ ID NO: 978878 - protein, 9 aa, Homo Sapiens
GLDCHSPQL

SEQ ID NO: 978879 - protein, 9 aa, Homo Sapiens
ASTAFTTGG

SEQ ID NO: 978880 - protein, 9 aa, Homo Sapiens
LLDLNGKNL

SEQ ID NO: 978881 - protein, 9 aa, Homo Sapiens
RTSRPRTVR

SEQ ID NO: 978882 - protein, 9 aa, Homo Sapiens
PSPCPRPPP

SEQ ID NO: 978883 - protein, 9 aa, Homo Sapiens
HTQLLLRGA

SEQ ID NO: 978884 - protein, 9 aa, Homo Sapiens
DHDQSFYIR

SEQ ID NO: 978885 - protein, 9 aa, Homo Sapiens
VSLECLDLD

SEQ ID NO: 978886 - protein, 9 aa, Homo Sapiens
PPRRRTIAR

SEQ ID NO: 978887 - protein, 9 aa, Homo Sapiens
KVPRVSLEC

SEQ ID NO: 978888 - protein, 9 aa, Homo Sapiens
AEQLHTQLL

SEQ ID NO: 978889 - protein, 9 aa, Homo Sapiens
ARLSRHQEF

SEQ ID NO: 978890 - protein, 9 aa, Homo Sapiens
CTGRGHVKS

SEQ ID NO: 978891 - protein, 9 aa, Homo Sapiens
GQQAGGAEQ

SEQ ID NO: 978892 - protein, 9 aa, Homo Sapiens
LNGKNLTFF

SEQ ID NO: 978893 - protein, 9 aa, Homo Sapiens
ALRGGPEYA

SEQ ID NO: 978894 - protein, 9 aa, Homo Sapiens
LAETPSTPS

SEQ ID NO: 978895 - protein, 9 aa, Homo Sapiens
PPSRKTESP

SEQ ID NO: 978896 - protein, 9 aa, Homo Sapiens
PLIPSTRTT

SEQ ID NO: 978897 - protein, 9 aa, Homo Sapiens
PRAACRRRG

SEQ ID NO: 978898 - protein, 9 aa, Homo Sapiens
GKNLTFFIN

SEQ ID NO: 978899 - protein, 9 aa, Homo Sapiens
SSKVSIEAA

SEQ ID NO: 978900 - protein, 9 aa, Homo Sapiens
LLHQQYTSH

SEQ ID NO: 978901 - protein, 9 aa, Homo Sapiens
SAWTVRIPR

SEQ ID NO: 978902 - protein, 9 aa, Homo Sapiens
SLIFLMKDD

SEQ ID NO: 978903 - protein, 9 aa, Homo Sapiens
SRLFPNTSQ

SEQ ID NO: 978904 - protein, 9 aa, Homo Sapiens
LQRLLVEHE

SEQ ID NO: 978905 - protein, 9 aa, Homo Sapiens
DQFRRRFGD

SEQ ID NO: 978906 - protein, 9 aa, Homo Sapiens
QVPLQSLEG

SEQ ID NO: 978907 - protein, 9 aa, Homo Sapiens
PGWGTRVPG

SEQ ID NO: 978908 - protein, 9 aa, Homo Sapiens
AGCIFAELG

SEQ ID NO: 978909 - protein, 9 aa, Homo Sapiens
WGHPAAATS

SEQ ID NO: 978910 - protein, 9 aa, Homo Sapiens
SGTNLLAVN

SEQ ID NO: 978911 - protein, 9 aa, Homo Sapiens
ASRIKGYIV

SEQ ID NO: 978912 - protein, 9 aa, Homo Sapiens
LPSVPKEAV

SEQ ID NO: 978913 - protein, 9 aa, Homo Sapiens
GWGHPAAAT

SEQ ID NO: 978914 - protein, 9 aa, Homo Sapiens
VSVPQPHSP

SEQ ID NO: 978915 - protein, 9 aa, Homo Sapiens
EKIMKLSLP

SEQ ID NO: 978916 - protein, 9 aa, Homo Sapiens
GGSVQGLGW

SEQ ID NO: 978917 - protein, 9 aa, Homo Sapiens
QGQQAGGAE

SEQ ID NO: 978918 - protein, 9 aa, Homo Sapiens
EGSKRAATL

SEQ ID NO: 978919 - protein, 9 aa, Homo Sapiens
GPEKLAETP

SEQ ID NO: 978920 - protein, 9 aa, Homo Sapiens
KSIDQYYCL

SEQ ID NO: 978921 - protein, 9 aa, Homo Sapiens
QEFKGLIKQ

SEQ ID NO: 978922 - protein, 9 aa, Homo Sapiens
SRDEHEAHQ

SEQ ID NO: 978923 - protein, 9 aa, Homo Sapiens
RRRGRSAWT

SEQ ID NO: 978924 - protein, 9 aa, Homo Sapiens
SQQEEELLE

SEQ ID NO: 978925 - protein, 9 aa, Homo Sapiens
QDTTWSSIA

SEQ ID NO: 978926 - protein, 9 aa, Homo Sapiens
AAAAPPRCP

SEQ ID NO: 978927 - protein, 9 aa, Homo Sapiens
IGVLLDLNG

SEQ ID NO: 978928 - protein, 9 aa, Homo Sapiens
LSRHQEFKG

SEQ ID NO: 978929 - protein, 9 aa, Homo Sapiens
TTKIIQLIS

SEQ ID NO: 978930 - protein, 9 aa, Homo Sapiens
FLKRLTRWG

SEQ ID NO: 978931 - protein, 9 aa, Homo Sapiens
TLPSPSRFA

SEQ ID NO: 978932 - protein, 9 aa, Homo Sapiens
GVQGQQAGG

SEQ ID NO: 978933 - protein, 9 aa, Homo Sapiens
PSRFALRGP

SEQ ID NO: 978934 - protein, 9 aa, Homo Sapiens
SPSRFALRG

SEQ ID NO: 978935 - protein, 9 aa, Homo Sapiens
APPRCPRSR

SEQ ID NO: 978936 - protein, 9 aa, Homo Sapiens
IGPPGKAGR

SEQ ID NO: 978937 - protein, 9 aa, Homo Sapiens
IFAELGNAG

SEQ ID NO: 978938 - protein, 9 aa, Homo Sapiens
YHRLKEEGS

SEQ ID NO: 978939 - protein, 9 aa, Homo Sapiens
RPPPRRRTI

SEQ ID NO: 978940 - protein, 9 aa, Homo Sapiens
NVQRSMWGG

SEQ ID NO: 978941 - protein, 9 aa, Homo Sapiens
VIDEVKRIL

SEQ ID NO: 978942 - protein, 9 aa, Homo Sapiens
LIGPPGKAG

SEQ ID NO: 978943 - protein, 9 aa, Homo Sapiens
LRGKPVISS

SEQ ID NO: 978944 - protein, 9 aa, Homo Sapiens
VGGLDCHSP

SEQ ID NO: 978945 - protein, 9 aa, Homo Sapiens
SLEGGSVQG

SEQ ID NO: 978946 - protein, 9 aa, Homo Sapiens
HLLSSKVSI

SEQ ID NO: 978947 - protein, 9 aa, Homo Sapiens
SRCSCCPVG

SEQ ID NO: 978948 - protein, 9 aa, Homo Sapiens
WVKVLLVLL

SEQ ID NO: 978949 - protein, 9 aa, Homo Sapiens
EFPAGGRLQ

SEQ ID NO: 978950 - protein, 9 aa, Homo Sapiens
LECLDLDLT

SEQ ID NO: 978951 - protein, 9 aa, Homo Sapiens
LIASGTNLL

SEQ ID NO: 978952 - protein, 9 aa, Homo Sapiens
PKSIRQQSL

SEQ ID NO: 978953 - protein, 9 aa, Homo Sapiens
KSIRQQSLC

SEQ ID NO: 978954 - protein, 9 aa, Homo Sapiens
LDKGVAGAI

SEQ ID NO: 978955 - protein, 9 aa, Homo Sapiens
GNAPGRRPC

SEQ ID NO: 978956 - protein, 9 aa, Homo Sapiens
HFYWRQKQL

SEQ ID NO: 978957 - protein, 9 aa, Homo Sapiens
HYQQQQVAG

SEQ ID NO: 978958 - protein, 9 aa, Homo Sapiens
ILHKKHTKN

SEQ ID NO: 978959 - protein, 9 aa, Homo Sapiens
AEILGANTR

SEQ ID NO: 978960 - protein, 9 aa, Homo Sapiens
LDLNGKNLT

SEQ ID NO: 978961 - protein, 9 aa, Homo Sapiens
RGPQGLIGP

SEQ ID NO: 978962 - protein, 9 aa, Homo Sapiens
PESVSLDRE

SEQ ID NO: 978963 - protein, 9 aa, Homo Sapiens
RAPRRPSPC

SEQ ID NO: 978964 - protein, 9 aa, Homo Sapiens
LALVLLRGN

SEQ ID NO: 978965 - protein, 9 aa, Homo Sapiens
CLDLDLTAD

SEQ ID NO: 978966 - protein, 9 aa, Homo Sapiens
PPKNDGASR

SEQ ID NO: 978967 - protein, 9 aa, Homo Sapiens
ALNHHNLLF

SEQ ID NO: 978968 - protein, 9 aa, Homo Sapiens
YMIINGFPI

SEQ ID NO: 978969 - protein, 9 aa, Homo Sapiens
GNGLQYWKQ

SEQ ID NO: 978970 - protein, 9 aa, Homo Sapiens
LLRGGFCLL

SEQ ID NO: 978971 - protein, 9 aa, Homo Sapiens
RTTLPSPSR

SEQ ID NO: 978972 - protein, 9 aa, Homo Sapiens
RRPCASRTS

SEQ ID NO: 978973 - protein, 9 aa, Homo Sapiens
PKNDGASRI

SEQ ID NO: 978974 - protein, 9 aa, Homo Sapiens
SVSLDRETK

SEQ ID NO: 978975 - protein, 9 aa, Homo Sapiens
MKDDMGRGK

SEQ ID NO: 978976 - protein, 9 aa, Homo Sapiens
ATSAPLIPS

SEQ ID NO: 978977 - protein, 9 aa, Homo Sapiens
ADGNAPGRR

SEQ ID NO: 978978 - protein, 9 aa, Homo Sapiens
AAAAACPAG

SEQ ID NO: 978979 - protein, 9 aa, Homo Sapiens
DQYYCLVTA

SEQ ID NO: 978980 - protein, 9 aa, Homo Sapiens
LPSPKSIRQ

SEQ ID NO: 978981 - protein, 9 aa, Homo Sapiens
ANTRTARIQ

SEQ ID NO: 978982 - protein, 9 aa, Homo Sapiens
ETPSTPSLP

SEQ ID NO: 978983 - protein, 9 aa, Homo Sapiens
PSTRTTLPS

SEQ ID NO: 978984 - protein, 9 aa, Homo Sapiens
VSIEAALQI

SEQ ID NO: 978985 - protein, 9 aa, Homo Sapiens
SPKSIRQQS

SEQ ID NO: 978986 - protein, 9 aa, Homo Sapiens
GASRIKGYI

SEQ ID NO: 978987 - protein, 9 aa, Homo Sapiens
LVEHEASPS

SEQ ID NO: 978988 - protein, 9 aa, Homo Sapiens
YIRDDPDDN

SEQ ID NO: 978989 - protein, 9 aa, Homo Sapiens
LLVLLGLPG

SEQ ID NO: 978990 - protein, 9 aa, Homo Sapiens
QADGNAPGR

SEQ ID NO: 978991 - protein, 9 aa, Homo Sapiens
DLNGKNLTF

SEQ ID NO: 978992 - protein, 9 aa, Homo Sapiens
TMEEVVVLA

SEQ ID NO: 978993 - protein, 9 aa, Homo Sapiens
GPRGPQGLI

SEQ ID NO: 978994 - protein, 9 aa, Homo Sapiens
VELLIASGT

SEQ ID NO: 978995 - protein, 9 aa, Homo Sapiens
NTSQHITPS

SEQ ID NO: 978996 - protein, 9 aa, Homo Sapiens
LPSPSRFAL

SEQ ID NO: 978997 - protein, 9 aa, Homo Sapiens
FYIRDDPDD

SEQ ID NO: 978998 - protein, 9 aa, Homo Sapiens
EADLQVLQG

SEQ ID NO: 978999 - protein, 9 aa, Homo Sapiens
HNLLFCSVT

SEQ ID NO: 979000 - protein, 9 aa, Homo Sapiens
GANTRTARI

SEQ ID NO: 979001 - protein, 9 aa, Homo Sapiens
GDLALPSVP

SEQ ID NO: 979002 - protein, 9 aa, Homo Sapiens
MPGLQGQLD

SEQ ID NO: 979003 - protein, 9 aa, Homo Sapiens
YYRLLLVVI

SEQ ID NO: 979004 - protein, 9 aa, Homo Sapiens
ADLQVLQGN

SEQ ID NO: 979005 - protein, 9 aa, Homo Sapiens
TPSTPSLPS

SEQ ID NO: 979006 - protein, 9 aa, Homo Sapiens
VLLDLNGKN

SEQ ID NO: 979007 - protein, 9 aa, Homo Sapiens
AACRRRGRS

SEQ ID NO: 979008 - protein, 9 aa, Homo Sapiens
EYAEVEVEP

SEQ ID NO: 979009 - protein, 9 aa, Homo Sapiens
EHEASPSGA

SEQ ID NO: 979010 - protein, 9 aa, Homo Sapiens
HETTVDILH

SEQ ID NO: 979011 - protein, 9 aa, Homo Sapiens
DGASRIKGY

SEQ ID NO: 979012 - protein, 9 aa, Homo Sapiens
PRSRAPTAA

SEQ ID NO: 979013 - protein, 9 aa, Homo Sapiens
LQGQLDKGV

SEQ ID NO: 979014 - protein, 9 aa, Homo Sapiens
DSPPSRKTE

SEQ ID NO: 979015 - protein, 9 aa, Homo Sapiens
ASQQEEELL

SEQ ID NO: 979016 - protein, 9 aa, Homo Sapiens
LAAASQQEE

SEQ ID NO: 979017 - protein, 9 aa, Homo Sapiens
KCTSCKKSR

SEQ ID NO: 979018 - protein, 9 aa, Homo Sapiens
GLQGQLDKG

SEQ ID NO: 979019 - protein, 9 aa, Homo Sapiens
TGKSGTMEE

SEQ ID NO: 979020 - protein, 9 aa, Homo Sapiens
GAEQLHTQL

SEQ ID NO: 979021 - protein, 9 aa, Homo Sapiens
GDPGWGTRV

SEQ ID NO: 979022 - protein, 9 aa, Homo Sapiens
KSRCSCCPV

SEQ ID NO: 979023 - protein, 9 aa, Homo Sapiens
VRIPRRRRP

SEQ ID NO: 979024 - protein, 9 aa, Homo Sapiens
RVSLECLDL

SEQ ID NO: 979025 - protein, 9 aa, Homo Sapiens
ARASAWTTS

SEQ ID NO: 979026 - protein, 9 aa, Homo Sapiens
YCFDQFRRR

SEQ ID NO: 979027 - protein, 9 aa, Homo Sapiens
QLRELMPGL

SEQ ID NO: 979028 - protein, 9 aa, Homo Sapiens
DGNAPGRRP

SEQ ID NO: 979029 - protein, 9 aa, Homo Sapiens
GGQLRELMP

SEQ ID NO: 979030 - protein, 9 aa, Homo Sapiens
APLIPSTRT

SEQ ID NO: 979031 - protein, 9 aa, Homo Sapiens
SPQLLRGGF

SEQ ID NO: 979032 - protein, 9 aa, Homo Sapiens
CHETTVDIL

SEQ ID NO: 979033 - protein, 9 aa, Homo Sapiens
SVPKEAVSG

SEQ ID NO: 979034 - protein, 9 aa, Homo Sapiens
TTVDILHKK

SEQ ID NO: 979035 - protein, 9 aa, Homo Sapiens
RDEHEAHQE

SEQ ID NO: 979036 - protein, 9 aa, Homo Sapiens
PAAATSAPL

SEQ ID NO: 979037 - protein, 9 aa, Homo Sapiens
QQYTSHTAS

SEQ ID NO: 979038 - protein, 9 aa, Homo Sapiens
TVDILHKKH

SEQ ID NO: 979039 - protein, 9 aa, Homo Sapiens
RETKPEIHD

SEQ ID NO: 979040 - protein, 9 aa, Homo Sapiens
EHEAHQERV

SEQ ID NO: 979041 - protein, 9 aa, Homo Sapiens
EKDLRYKKT

SEQ ID NO: 979042 - protein, 9 aa, Homo Sapiens
RGVGKSALT

SEQ ID NO: 979043 - protein, 9 aa, Homo Sapiens
AAATSAPLI

SEQ ID NO: 979044 - protein, 9 aa, Homo Sapiens
AAHWLTAPT

SEQ ID NO: 979045 - protein, 9 aa, Homo Sapiens
VLPDEFPAG

SEQ ID NO: 979046 - protein, 9 aa, Homo Sapiens
PTPRPRPRR

SEQ ID NO: 979047 - protein, 9 aa, Homo Sapiens
AASQQEEEL

SEQ ID NO: 979048 - protein, 9 aa, Homo Sapiens
LLFCSVTDF

SEQ ID NO: 979049 - protein, 9 aa, Homo Sapiens
DLRYKKTLV

SEQ ID NO: 979050 - protein, 9 aa, Homo Sapiens
QRLLVEHEA

SEQ ID NO: 979051 - protein, 9 aa, Homo Sapiens
IFLMKDDMG

SEQ ID NO: 979052 - protein, 9 aa, Homo Sapiens
LMKDDMGRG

SEQ ID NO: 979053 - protein, 9 aa, Homo Sapiens
KHKTDHIHH

SEQ ID NO: 979054 - protein, 9 aa, Homo Sapiens
WTVRIPRRR

SEQ ID NO: 979055 - protein, 9 aa, Homo Sapiens
HHLLSSKVS

SEQ ID NO: 979056 - protein, 9 aa, Homo Sapiens
RLLVEHEAS

SEQ ID NO: 979057 - protein, 9 aa, Homo Sapiens
KKSRCSCCP

SEQ ID NO: 979058 - protein, 9 aa, Homo Sapiens
GVLLDLNGK

SEQ ID NO: 979059 - protein, 9 aa, Homo Sapiens
LHQQYTSHT

SEQ ID NO: 979060 - protein, 9 aa, Homo Sapiens
VPQPHSPRW

SEQ ID NO: 979061 - protein, 9 aa, Homo Sapiens
HDQSFYIRD

SEQ ID NO: 979062 - protein, 9 aa, Homo Sapiens
QRSMWGGYI

SEQ ID NO: 979063 - protein, 9 aa, Homo Sapiens
PQLLRGGFC

SEQ ID NO: 979064 - protein, 9 aa, Homo Sapiens
KIMKLSLPE

SEQ ID NO: 979065 - protein, 9 aa, Homo Sapiens
FCLLLDSAA

SEQ ID NO: 979066 - protein, 9 aa, Homo Sapiens
KFEENEYIV

SEQ ID NO: 979067 - protein, 9 aa, Homo Sapiens
SLALVLLRG

SEQ ID NO: 979068 - protein, 9 aa, Homo Sapiens
TGRGHVKSN

SEQ ID NO: 979069 - protein, 9 aa, Homo Sapiens
HHNLLFCSV

SEQ ID NO: 979070 - protein, 9 aa, Homo Sapiens
VTLRGKPVI

SEQ ID NO: 979071 - protein, 9 aa, Homo Sapiens
PTAAAAACP

SEQ ID NO: 979072 - protein, 9 aa, Homo Sapiens
GKDLTTKII

SEQ ID NO: 979073 - protein, 9 aa, Homo Sapiens
KQWVKVLLV

SEQ ID NO: 979074 - protein, 9 aa, Homo Sapiens
MWGGYIGST

SEQ ID NO: 979075 - protein, 9 aa, Homo Sapiens
HQQQQQQMQ

SEQ ID NO: 979076 - protein, 9 aa, Homo Sapiens
CIFAELGNA

SEQ ID NO: 979077 - protein, 9 aa, Homo Sapiens
FPNTSQHIT

SEQ ID NO: 979078 - protein, 9 aa, Homo Sapiens
GSKRAATLA

SEQ ID NO: 979079 - protein, 9 aa, Homo Sapiens
EEGSKRAAT

SEQ ID NO: 979080 - protein, 9 aa, Homo Sapiens
SPPTQNWTI

SEQ ID NO: 979081 - protein, 9 aa, Homo Sapiens
VLLRGNGLQ

SEQ ID NO: 979082 - protein, 9 aa, Homo Sapiens
QSLEGGSVQ

SEQ ID NO: 979083 - protein, 9 aa, Homo Sapiens
IPRRRRPRP

SEQ ID NO: 979084 - protein, 9 aa, Homo Sapiens
YSRLFPNTS

SEQ ID NO: 979085 - protein, 9 aa, Homo Sapiens
LLDSAAEVL

SEQ ID NO: 979086 - protein, 9 aa, Homo Sapiens
SIASTAFTT

SEQ ID NO: 979087 - protein, 9 aa, Homo Sapiens
KIYPSRDEH

SEQ ID NO: 979088 - protein, 9 aa, Homo Sapiens
RFALRGPSS

SEQ ID NO: 979089 - protein, 9 aa, Homo Sapiens
LHTQLLLRG

SEQ ID NO: 979090 - protein, 9 aa, Homo Sapiens
GLIGPPGKA

SEQ ID NO: 979091 - protein, 9 aa, Homo Sapiens
RRSSQDYLN

SEQ ID NO: 979092 - protein, 9 aa, Homo Sapiens
LEGGSVQGL

SEQ ID NO: 979093 - protein, 9 aa, Homo Sapiens
PAGGRLQLQ

SEQ ID NO: 979094 - protein, 9 aa, Homo Sapiens
ESVSLDRET

SEQ ID NO: 979095 - protein, 9 aa, Homo Sapiens
ATALSVEAD

SEQ ID NO: 979096 - protein, 9 aa, Homo Sapiens
LLSSKVSIE

SEQ ID NO: 979097 - protein, 9 aa, Homo Sapiens
PRPPPWAAA

SEQ ID NO: 979098 - protein, 9 aa, Homo Sapiens
QLHTQLLLR

SEQ ID NO: 979099 - protein, 9 aa, Homo Sapiens
DMGRGKISK

SEQ ID NO: 979100 - protein, 9 aa, Homo Sapiens
HTASPLPLR

SEQ ID NO: 979101 - protein, 9 aa, Homo Sapiens
MAEILGANT

SEQ ID NO: 979102 - protein, 9 aa, Homo Sapiens
RGAVGGLDC

SEQ ID NO: 979103 - protein, 9 aa, Homo Sapiens
TWSSIASTA

SEQ ID NO: 979104 - protein, 9 aa, Homo Sapiens
LIKQWVKVL

SEQ ID NO: 979105 - protein, 9 aa, Homo Sapiens
EILGANTRT

SEQ ID NO: 979106 - protein, 9 aa, Homo Sapiens
LRCRFLSEF

SEQ ID NO: 979107 - protein, 9 aa, Homo Sapiens
CTSCKKSRC

SEQ ID NO: 979108 - protein, 9 aa, Homo Sapiens
SRFALRGPS

SEQ ID NO: 979109 - protein, 9 aa, Homo Sapiens
ADSPPSRKT

SEQ ID NO: 979110 - protein, 9 aa, Homo Sapiens
WLTAPTPRP

SEQ ID NO: 979111 - protein, 9 aa, Homo Sapiens
DGTGKSGTM

SEQ ID NO: 979112 - protein, 9 aa, Homo Sapiens
QSFYIRDDP

SEQ ID NO: 979113 - protein, 9 aa, Homo Sapiens
RDSFLKRLT

SEQ ID NO: 979114 - protein, 9 aa, Homo Sapiens
RGRLAAASQ

SEQ ID NO: 979115 - protein, 9 aa, Homo Sapiens
NKFSHFYWR

SEQ ID NO: 979116 - protein, 9 aa, Homo Sapiens
RLAAASQQE

SEQ ID NO: 979117 - protein, 9 aa, Homo Sapiens
SRTSRPRTV

SEQ ID NO: 979118 - protein, 9 aa, Homo Sapiens
FKHKTDHIH

SEQ ID NO: 979119 - protein, 9 aa, Homo Sapiens
GLPGGQLRE

SEQ ID NO: 979120 - protein, 9 aa, Homo Sapiens
AAACPAGAA

SEQ ID NO: 979121 - protein, 9 aa, Homo Sapiens
RSAWTVRIP

SEQ ID NO: 979122 - protein, 9 aa, Homo Sapiens
PSQLRCRFL

SEQ ID NO: 979123 - protein, 9 aa, Homo Sapiens
PRRRTIARA

SEQ ID NO: 979124 - protein, 9 aa, Homo Sapiens
FKGLIKQWV

SEQ ID NO: 979125 - protein, 9 aa, Homo Sapiens
TQLLLRGAV

SEQ ID NO: 979126 - protein, 9 aa, Homo Sapiens
EASPSGASG

SEQ ID NO: 979127 - protein, 9 aa, Homo Sapiens
CGKFFISVP

SEQ ID NO: 979128 - protein, 9 aa, Homo Sapiens
ELGWGHPAA

SEQ ID NO: 979129 - protein, 9 aa, Homo Sapiens
RELMPGLQG

SEQ ID NO: 979130 - protein, 9 aa, Homo Sapiens
QDYLNTRSL

SEQ ID NO: 979131 - protein, 9 aa, Homo Sapiens
LLVVIDEVK

SEQ ID NO: 979132 - protein, 9 aa, Homo Sapiens
GLGWQATAL

SEQ ID NO: 979133 - protein, 9 aa, Homo Sapiens
WRQKQLESA

SEQ ID NO: 979134 - protein, 9 aa, Homo Sapiens
RSRAPTAAA

SEQ ID NO: 979135 - protein, 9 aa, Homo Sapiens
STPSLPSPK

SEQ ID NO: 979136 - protein, 9 aa, Homo Sapiens
HRLKEEGSK

SEQ ID NO: 979137 - protein, 9 aa, Homo Sapiens
QNVQRSMWG

SEQ ID NO: 979138 - protein, 9 aa, Homo Sapiens
FISVPGVRR

SEQ ID NO: 979139 - protein, 9 aa, Homo Sapiens
SIEAALQIF

SEQ ID NO: 979140 - protein, 9 aa, Homo Sapiens
NDGASRIKG

SEQ ID NO: 979141 - protein, 9 aa, Homo Sapiens
QVLQGNLQP

SEQ ID NO: 979142 - protein, 9 aa, Homo Sapiens
SHTASPLPL

SEQ ID NO: 979143 - protein, 9 aa, Homo Sapiens
EQLHTQLLL

SEQ ID NO: 979144 - protein, 9 aa, Homo Sapiens
EFKGLIKQW

SEQ ID NO: 979145 - protein, 9 aa, Homo Sapiens
PCPRPPPWA

SEQ ID NO: 979146 - protein, 9 aa, Homo Sapiens
EQCGKFFIS

SEQ ID NO: 979147 - protein, 9 aa, Homo Sapiens
RRPRPPPRR

SEQ ID NO: 979148 - protein, 9 aa, Homo Sapiens
RSMWGGYIG

SEQ ID NO: 979149 - protein, 9 aa, Homo Sapiens
GHVKSNRNT

SEQ ID NO: 979150 - protein, 9 aa, Homo Sapiens
QPHSPRWPV

SEQ ID NO: 979151 - protein, 9 aa, Homo Sapiens
AVVSVPQPH

SEQ ID NO: 979152 - protein, 9 aa, Homo Sapiens
EKSIDQYYC

SEQ ID NO: 979153 - protein, 9 aa, Homo Sapiens
VDILHKKHT

SEQ ID NO: 979154 - protein, 9 aa, Homo Sapiens
TTLPSPSRF

SEQ ID NO: 979155 - protein, 9 aa, Homo Sapiens
PAGAAPRAA

SEQ ID NO: 979156 - protein, 8 aa, Homo Sapiens
MMCAATAS

SEQ ID NO: 979157 - protein, 9 aa, Homo Sapiens
AAAACPAGA

SEQ ID NO: 979158 - protein, 9 aa, Homo Sapiens
DSAAEVLPD

SEQ ID NO: 979159 - protein, 9 aa, Homo Sapiens
HEAHQERVL

SEQ ID NO: 979160 - protein, 9 aa, Homo Sapiens
RPSPCPRPP

SEQ ID NO: 979161 - protein, 9 aa, Homo Sapiens
GAVGGLDCH

SEQ ID NO: 979162 - protein, 9 aa, Homo Sapiens
FDQFRRRFG

SEQ ID NO: 979163 - protein, 9 aa, Homo Sapiens
RPPPWAAAA

SEQ ID NO: 979164 - protein, 9 aa, Homo Sapiens
KDLRYKKTL

SEQ ID NO: 979165 - protein, 9 aa, Homo Sapiens
APGRRPCAS

SEQ ID NO: 979166 - protein, 9 aa, Homo Sapiens
QATALSVEA

SEQ ID NO: 979167 - protein, 9 aa, Homo Sapiens
PRRPSPCPR

SEQ ID NO: 979168 - protein, 9 aa, Homo Sapiens
LLLDSAAEV

SEQ ID NO: 979169 - protein, 9 aa, Homo Sapiens
RIPRRRRPR

SEQ ID NO: 979170 - protein, 9 aa, Homo Sapiens
KFFISVPGV

SEQ ID NO: 979171 - protein, 9 aa, Homo Sapiens
IDQYYCLVT

SEQ ID NO: 979172 - protein, 9 aa, Homo Sapiens
QCGKFFISV

SEQ ID NO: 979173 - protein, 9 aa, Homo Sapiens
NTRTARIQD

SEQ ID NO: 979174 - protein, 9 aa, Homo Sapiens
TSRPRTVRA

SEQ ID NO: 979175 - protein, 9 aa, Homo Sapiens
GPQGLIGPP

SEQ ID NO: 979176 - protein, 9 aa, Homo Sapiens
GLIKQWVKV

SEQ ID NO: 979177 - protein, 9 aa, Homo Sapiens
QGLGWQATA

SEQ ID NO: 979178 - protein, 9 aa, Homo Sapiens
FPAGGRLQL

SEQ ID NO: 979179 - protein, 9 aa, Homo Sapiens
YTSHTASPL

SEQ ID NO: 979180 - protein, 9 aa, Homo Sapiens
AEVLPDEFP

SEQ ID NO: 979181 - protein, 9 aa, Homo Sapiens
PLLAHRDSF

SEQ ID NO: 979182 - protein, 9 aa, Homo Sapiens
CGGDLALPS

SEQ ID NO: 979183 - protein, 9 aa, Homo Sapiens
AEKDLRYKK

SEQ ID NO: 979184 - protein, 9 aa, Homo Sapiens
QYTSHTASP

SEQ ID NO: 979185 - protein, 9 aa, Homo Sapiens
PNTSQHITP

SEQ ID NO: 979186 - protein, 9 aa, Homo Sapiens
FAELGNAGR

SEQ ID NO: 979187 - protein, 9 aa, Homo Sapiens
RPRPPPRRR

SEQ ID NO: 979188 - protein, 9 aa, Homo Sapiens
IARASAWTT

SEQ ID NO: 979189 - protein, 9 aa, Homo Sapiens
KLSLPESLK

SEQ ID NO: 979190 - protein, 9 aa, Homo Sapiens
DTTWSSIAS

SEQ ID NO: 979191 - protein, 9 aa, Homo Sapiens
ACPAGAAPR

SEQ ID NO: 979192 - protein, 9 aa, Homo Sapiens
LSVEADLQV

SEQ ID NO: 979193 - protein, 9 aa, Homo Sapiens
DDMGRGKIS

SEQ ID NO: 979194 - protein, 9 aa, Homo Sapiens
KGVAGAIGV

SEQ ID NO: 979195 - protein, 9 aa, Homo Sapiens
DEFPAGGRL

SEQ ID NO: 979196 - protein, 9 aa, Homo Sapiens
PRVSLECLD

SEQ ID NO: 979197 - protein, 9 aa, Homo Sapiens
VKSNRNTHR

SEQ ID NO: 979198 - protein, 9 aa, Homo Sapiens
RRGRSAWTV

SEQ ID NO: 979199 - protein, 9 aa, Homo Sapiens
PPWAAAAPP

SEQ ID NO: 979200 - protein, 9 aa, Homo Sapiens
KNDGASRIK

SEQ ID NO: 979201 - protein, 9 aa, Homo Sapiens
LIFLMKDDM

SEQ ID NO: 979202 - protein, 9 aa, Homo Sapiens
PGGQLRELM

SEQ ID NO: 979203 - protein, 9 aa, Homo Sapiens
VVIDEVKRI

SEQ ID NO: 979204 - protein, 9 aa, Homo Sapiens
YQHYQQQQV

SEQ ID NO: 979205 - protein, 9 aa, Homo Sapiens
GQLDKGVAG

SEQ ID NO: 979206 - protein, 9 aa, Homo Sapiens
LRGGFCLLL

SEQ ID NO: 979207 - protein, 9 aa, Homo Sapiens
LQSLEGGSV

SEQ ID NO: 979208 - protein, 9 aa, Homo Sapiens
YRLLLVVID

SEQ ID NO: 979209 - protein, 9 aa, Homo Sapiens
RYKKTLVII

SEQ ID NO: 979210 - protein, 9 aa, Homo Sapiens
FYWRQKQLE

SEQ ID NO: 979211 - protein, 9 aa, Homo Sapiens
ACRRRGRSA

SEQ ID NO: 979212 - protein, 9 aa, Homo Sapiens
PSPKSIRQQ

SEQ ID NO: 979213 - protein, 9 aa, Homo Sapiens
PYCFDQFRR

SEQ ID NO: 979214 - protein, 9 aa, Homo Sapiens
VEHEASPSG

SEQ ID NO: 979215 - protein, 9 aa, Homo Sapiens
GGFCLLLDS

SEQ ID NO: 979216 - protein, 9 aa, Homo Sapiens
IDELAYMII

SEQ ID NO: 979217 - protein, 9 aa, Homo Sapiens
LLGLPGGQL

SEQ ID NO: 979218 - protein, 9 aa, Homo Sapiens
PWAAAAPPR

SEQ ID NO: 979219 - protein, 9 aa, Homo Sapiens
HWLTAPTPR

SEQ ID NO: 979220 - protein, 9 aa, Homo Sapiens
LGLPGGQLR

SEQ ID NO: 979221 - protein, 9 aa, Homo Sapiens
GRLAAASQQ

SEQ ID NO: 979222 - protein, 9 aa, Homo Sapiens
LRELMPGLQ

SEQ ID NO: 979223 - protein, 9 aa, Homo Sapiens
IGVQGQQAG

SEQ ID NO: 979224 - protein, 9 aa, Homo Sapiens
GWGTRVPGG

SEQ ID NO: 979225 - protein, 9 aa, Homo Sapiens
SPPSRKTES

SEQ ID NO: 979226 - protein, 9 aa, Homo Sapiens
AHRDSFLKR

SEQ ID NO: 979227 - protein, 9 aa, Homo Sapiens
RAPTAAAAA

SEQ ID NO: 979228 - protein, 9 aa, Homo Sapiens
GKPVISSVV

SEQ ID NO: 979229 - protein, 9 aa, Homo Sapiens
LALPSVPKE

SEQ ID NO: 979230 - protein, 9 aa, Homo Sapiens
SKVSIEAAL

SEQ ID NO: 979231 - protein, 9 aa, Homo Sapiens
GNLQPVGSQ

SEQ ID NO: 979232 - protein, 9 aa, Homo Sapiens
EYIVVMETK

SEQ ID NO: 979233 - protein, 9 aa, Homo Sapiens
VLQGNLQPV

SEQ ID NO: 979234 - protein, 9 aa, Homo Sapiens
ALVLLRGNG

SEQ ID NO: 979235 - protein, 9 aa, Homo Sapiens
AGGRLQLQV

SEQ ID NO: 979236 - protein, 9 aa, Homo Sapiens
ALSVEADLQ

SEQ ID NO: 979237 - protein, 9 aa, Homo Sapiens
MHQQQQQQM

SEQ ID NO: 979238 - protein, 9 aa, Homo Sapiens
IQLISIAPE

SEQ ID NO: 979239 - protein, 9 aa, Homo Sapiens
IYPSRDEHE

SEQ ID NO: 979240 - protein, 9 aa, Homo Sapiens
SSQDYLNTR

SEQ ID NO: 979241 - protein, 9 aa, Homo Sapiens
IMKLSLPES

SEQ ID NO: 979242 - protein, 9 aa, Homo Sapiens
CPRSRAPTA

SEQ ID NO: 979243 - protein, 9 aa, Homo Sapiens
ASGTNLLAV

SEQ ID NO: 979244 - protein, 9 aa, Homo Sapiens
LPDEFPAGG

SEQ ID NO: 979245 - protein, 9 aa, Homo Sapiens
PGLQGQLDK

SEQ ID NO: 979246 - protein, 9 aa, Homo Sapiens
VISSVVLAQ

SEQ ID NO: 979247 - protein, 9 aa, Homo Sapiens
KIIQLISIA

SEQ ID NO: 979248 - protein, 9 aa, Homo Sapiens
WPESVSLDR

SEQ ID NO: 979249 - protein, 9 aa, Homo Sapiens
PPPRRRTIA

SEQ ID NO: 979250 - protein, 9 aa, Homo Sapiens
RSKFEENEY

SEQ ID NO: 979251 - protein, 9 aa, Homo Sapiens
HEASPSGAS

SEQ ID NO: 979252 - protein, 9 aa, Homo Sapiens
TPYCFDQFR

SEQ ID NO: 979253 - protein, 9 aa, Homo Sapiens
HQQYTSHTA

SEQ ID NO: 979254 - protein, 9 aa, Homo Sapiens
VKVLLVLLG

SEQ ID NO: 979255 - protein, 9 aa, Homo Sapiens
QGNLQPVGS

SEQ ID NO: 979256 - protein, 9 aa, Homo Sapiens
REKIMKLSL

SEQ ID NO: 979257 - protein, 9 aa, Homo Sapiens
TKIIQLISI

SEQ ID NO: 979258 - protein, 9 aa, Homo Sapiens
TPSLPSPKS

SEQ ID NO: 979259 - protein, 9 aa, Homo Sapiens
NLLFCSVTD

SEQ ID NO: 979260 - protein, 9 aa, Homo Sapiens
FCSVTDFYP

SEQ ID NO: 979261 - protein, 9 aa, Homo Sapiens
SFYIRDDPD

SEQ ID NO: 979262 - protein, 9 aa, Homo Sapiens
GGAEQLHTQ

SEQ ID NO: 979263 - protein, 9 aa, Homo Sapiens
AHWLTAPTP

SEQ ID NO: 979264 - protein, 9 aa, Homo Sapiens
WDPPKNDGA

SEQ ID NO: 979265 - protein, 9 aa, Homo Sapiens
RRRPRPPPR

SEQ ID NO: 979266 - protein, 9 aa, Homo Sapiens
LVVIDEVKR

SEQ ID NO: 979267 - protein, 9 aa, Homo Sapiens
AAASQQEEE

SEQ ID NO: 979268 - protein, 9 aa, Homo Sapiens
SQLRCRFLS

SEQ ID NO: 979269 - protein, 9 aa, Homo Sapiens
SVQGLGWQA

SEQ ID NO: 979270 - protein, 9 aa, Homo Sapiens
TSAPLIPST

SEQ ID NO: 979271 - protein, 9 aa, Homo Sapiens
DPGWGTRVP

SEQ ID NO: 979272 - protein, 9 aa, Homo Sapiens
PIDELAYMI

SEQ ID NO: 979273 - protein, 9 aa, Homo Sapiens
STRTTLPSP

SEQ ID NO: 979274 - protein, 9 aa, Homo Sapiens
GKFFISVPG

SEQ ID NO: 979275 - protein, 9 aa, Homo Sapiens
FEENEYIVV

SEQ ID NO: 979276 - protein, 9 aa, Homo Sapiens
VLLGLPGGQ

SEQ ID NO: 979277 - protein, 9 aa, Homo Sapiens
PVISSVVLA

SEQ ID NO: 979278 - protein, 9 aa, Homo Sapiens
PSRDEHEAH

SEQ ID NO: 979279 - protein, 9 aa, Homo Sapiens
PELGWGHPA

SEQ ID NO: 979280 - protein, 9 aa, Homo Sapiens
CPAGAAPRA

SEQ ID NO: 979281 - protein, 9 aa, Homo Sapiens
AAPPRCPRS

SEQ ID NO: 979282 - protein, 9 aa, Homo Sapiens
SLPESLKAY

SEQ ID NO: 979283 - protein, 9 aa, Homo Sapiens
IKQWVKVLL

SEQ ID NO: 979284 - protein, 9 aa, Homo Sapiens
DPPKNDGAS

SEQ ID NO: 979285 - protein, 9 aa, Homo Sapiens
GTGKSGTME

SEQ ID NO: 979286 - protein, 9 aa, Homo Sapiens
RGGFCLLLD

SEQ ID NO: 979287 - protein, 9 aa, Homo Sapiens
CHSPQLLRG

SEQ ID NO: 979288 - protein, 9 aa, Homo Sapiens
PSPSRFALR

SEQ ID NO: 979289 - protein, 9 aa, Homo Sapiens
KSNRNTHRS

SEQ ID NO: 979290 - protein, 9 aa, Homo Sapiens
AATSAPLIP

SEQ ID NO: 979291 - protein, 9 aa, Homo Sapiens
ELGNAGRPL

SEQ ID NO: 979292 - protein, 9 aa, Homo Sapiens
LAYMIINGF

SEQ ID NO: 979293 - protein, 9 aa, Homo Sapiens
RGHVKSNRN

SEQ ID NO: 979294 - protein, 9 aa, Homo Sapiens
LQGNLQPVG

SEQ ID NO: 979295 - protein, 9 aa, Homo Sapiens
GGRLQLQVP

SEQ ID NO: 979296 - protein, 9 aa, Homo Sapiens
SGTMEEVVV

SEQ ID NO: 979297 - protein, 9 aa, Homo Sapiens
PRCPRSRAP

SEQ ID NO: 979298 - protein, 9 aa, Homo Sapiens
LKEEGSKRA

SEQ ID NO: 979299 - protein, 9 aa, Homo Sapiens
VPRVSLECL

SEQ ID NO: 979300 - protein, 9 aa, Homo Sapiens
GHPAAATSA

SEQ ID NO: 979301 - protein, 9 aa, Homo Sapiens
QYYCLVTAT

SEQ ID NO: 979302 - protein, 9 aa, Homo Sapiens
RCRFLSEFG

SEQ ID NO: 979303 - protein, 9 aa, Homo Sapiens
LLLVVIDEV

SEQ ID NO: 979304 - protein, 9 aa, Homo Sapiens
CRRRGRSAW

SEQ ID NO: 979305 - protein, 9 aa, Homo Sapiens
CPRPPPWAA

SEQ ID NO: 979306 - protein, 9 aa, Homo Sapiens
LLRGAVGGL

SEQ ID NO: 979307 - protein, 9 aa, Homo Sapiens
RDDPDDNAD

SEQ ID NO: 979308 - protein, 9 aa, Homo Sapiens
LAARLSRHQ

SEQ ID NO: 979309 - protein, 9 aa, Homo Sapiens
GCTGRGHVK

SEQ ID NO: 979310 - protein, 9 aa, Homo Sapiens
LTAPTPRPR

SEQ ID NO: 979311 - protein, 9 aa, Homo Sapiens
WQATALSVE

SEQ ID NO: 979312 - protein, 9 aa, Homo Sapiens
LRGNGLQYW

SEQ ID NO: 979313 - protein, 9 aa, Homo Sapiens
AARLSRHQE

SEQ ID NO: 979314 - protein, 9 aa, Homo Sapiens
ASRTSRPRT

SEQ ID NO: 979315 - protein, 9 aa, Homo Sapiens
QGLIGPPGK

SEQ ID NO: 979316 - protein, 9 aa, Homo Sapiens
SQDYLNTRS

SEQ ID NO: 979317 - protein, 9 aa, Homo Sapiens
HPAAATSAP

SEQ ID NO: 979318 - protein, 9 aa, Homo Sapiens
CRFLSEFGA

SEQ ID NO: 979319 - protein, 9 aa, Homo Sapiens
AAAPPRCPR

SEQ ID NO: 979320 - protein, 9 aa, Homo Sapiens
TSQHITPSY

SEQ ID NO: 979321 - protein, 9 aa, Homo Sapiens
GGPEYAEVE

SEQ ID NO: 979322 - protein, 9 aa, Homo Sapiens
QQGPEKLAE

SEQ ID NO: 979323 - protein, 9 aa, Homo Sapiens
AGAIGVQGQ

SEQ ID NO: 979324 - protein, 9 aa, Homo Sapiens
IASGTNLLA

SEQ ID NO: 979325 - protein, 9 aa, Homo Sapiens
KVLLVLLGL

SEQ ID NO: 979326 - protein, 9 aa, Homo Sapiens
PPRCPRSRA

SEQ ID NO: 979327 - protein, 9 aa, Homo Sapiens
EKLAETPST

SEQ ID NO: 979328 - protein, 9 aa, Homo Sapiens
GAIGVQGQQ

SEQ ID NO: 979329 - protein, 9 aa, Homo Sapiens
GQLRELMPG

SEQ ID NO: 979330 - protein, 9 aa, Homo Sapiens
GRRPCASRT

SEQ ID NO: 979331 - protein, 9 aa, Homo Sapiens
KFSHFYWRQ

SEQ ID NO: 979332 - protein, 9 aa, Homo Sapiens
RPCASRTSR

SEQ ID NO: 979333 - protein, 9 aa, Homo Sapiens
SRPRTVRAP

SEQ ID NO: 979334 - protein, 9 aa, Homo Sapiens
LGKADSPPS

SEQ ID NO: 979335 - protein, 9 aa, Homo Sapiens
KDDMGRGKI

SEQ ID NO: 979336 - protein, 9 aa, Homo Sapiens
LFCSVTDFY

SEQ ID NO: 979337 - protein, 9 aa, Homo Sapiens
GGDLALPSV

SEQ ID NO: 979338 - protein, 9 aa, Homo Sapiens
PEKLAETPS

SEQ ID NO: 979339 - protein, 9 aa, Homo Sapiens
QHYQQQQVA

SEQ ID NO: 979340 - protein, 9 aa, Homo Sapiens
HSPQLLRGG

SEQ ID NO: 979341 - protein, 9 aa, Homo Sapiens
AELGNAGRP

SEQ ID NO: 979342 - protein, 9 aa, Homo Sapiens
LLVEHEASP

SEQ ID NO: 979343 - protein, 9 aa, Homo Sapiens
PSSPPTQNW

SEQ ID NO: 979344 - protein, 9 aa, Homo Sapiens
LAHRDSFLK

SEQ ID NO: 979345 - protein, 9 aa, Homo Sapiens
GPSSPPTQN

SEQ ID NO: 979346 - protein, 9 aa, Homo Sapiens
PDEFPAGGR

SEQ ID NO: 979347 - protein, 9 aa, Homo Sapiens
LVLLGLPGG

SEQ ID NO: 979348 - protein, 9 aa, Homo Sapiens
KYHRLKEEG

SEQ ID NO: 979349 - protein, 9 aa, Homo Sapiens
KEEGSKRAA

SEQ ID NO: 979350 - protein, 9 aa, Homo Sapiens
SSIASTAFT

SEQ ID NO: 979351 - protein, 9 aa, Homo Sapiens
GFCLLLDSA

SEQ ID NO: 979352 - protein, 9 aa, Homo Sapiens
LLAHRDSFL

SEQ ID NO: 979353 - protein, 9 aa, Homo Sapiens
MKLSLPESL

SEQ ID NO: 979354 - protein, 9 aa, Homo Sapiens
GVAGAIGVQ

SEQ ID NO: 979355 - protein, 9 aa, Homo Sapiens
LRGGPEYAE

SEQ ID NO: 979356 - protein, 9 aa, Homo Sapiens
LRGAVGGLD

SEQ ID NO: 979357 - protein, 9 aa, Homo Sapiens
PEYAEVEVE

SEQ ID NO: 979358 - protein, 9 aa, Homo Sapiens
RLKEEGSKR

SEQ ID NO: 979359 - protein, 9 aa, Homo Sapiens
CASRTSRPR

SEQ ID NO: 979360 - protein, 9 aa, Homo Sapiens
TPRPRPRRP

SEQ ID NO: 979361 - protein, 9 aa, Homo Sapiens
PSTPSLPSP

SEQ ID NO: 979362 - protein, 9 aa, Homo Sapiens
TVRIPRRRR

SEQ ID NO: 979363 - protein, 9 aa, Homo Sapiens
CLLLDSAAE

SEQ ID NO: 979364 - protein, 9 aa, Homo Sapiens
RLFPNTSQH

SEQ ID NO: 979365 - protein, 9 aa, Homo Sapiens
GPEYAEVEV

SEQ ID NO: 979366 - protein, 9 aa, Homo Sapiens
LQVLQGNLQ

SEQ ID NO: 979367 - protein, 9 aa, Homo Sapiens
APRAACRRR

SEQ ID NO: 979368 - protein, 9 aa, Homo Sapiens
VVVGARGVG

SEQ ID NO: 979369 - protein, 9 aa, Homo Sapiens
SMWGGYIGS

SEQ ID NO: 979370 - protein, 9 aa, Homo Sapiens
TAPTPRPRP

SEQ ID NO: 979371 - protein, 9 aa, Homo Sapiens
LLIASGTNL

SEQ ID NO: 979372 - protein, 9 aa, Homo Sapiens
APTPRPRPR

SEQ ID NO: 979373 - protein, 9 aa, Homo Sapiens
FYYRLLLVV

SEQ ID NO: 979374 - protein, 9 aa, Homo Sapiens
AETPSTPSL

SEQ ID NO: 979375 - protein, 9 aa, Homo Sapiens
DLTTKIIQL

SEQ ID NO: 979376 - protein, 9 aa, Homo Sapiens
LLLRGAVGG

SEQ ID NO: 979377 - protein, 9 aa, Homo Sapiens
NTPYCFDQF

SEQ ID NO: 979378 - protein, 9 aa, Homo Sapiens
IRDDPDDNA

SEQ ID NO: 979379 - protein, 9 aa, Homo Sapiens
RGPSSPPTQ

SEQ ID NO: 979380 - protein, 9 aa, Homo Sapiens
YWRQKQLES

SEQ ID NO: 979381 - protein, 9 aa, Homo Sapiens
SAPLIPSTR

SEQ ID NO: 979382 - protein, 9 aa, Homo Sapiens
AVGGLDCHS

SEQ ID NO: 979383 - protein, 9 aa, Homo Sapiens
LSSKVSIEA

SEQ ID NO: 979384 - protein, 9 aa, Homo Sapiens
ALPSVPKEA

SEQ ID NO: 979385 - protein, 9 aa, Homo Sapiens
QLLRGGFCL

SEQ ID NO: 979386 - protein, 9 aa, Homo Sapiens
QLRCRFLSE

SEQ ID NO: 979387 - protein, 9 aa, Homo Sapiens
EGGSVQGLG

SEQ ID NO: 979388 - protein, 9 aa, Homo Sapiens
AGGAEQLHT

SEQ ID NO: 979389 - protein, 9 aa, Homo Sapiens
PSLPSPKSI

SEQ ID NO: 979390 - protein, 9 aa, Homo Sapiens
WSSIASTAF

SEQ ID NO: 979391 - protein, 9 aa, Homo Sapiens
SLPSPKSIR

SEQ ID NO: 979392 - protein, 9 aa, Homo Sapiens
FRRRFGDVF

SEQ ID NO: 979393 - protein, 9 aa, Homo Sapiens
LREKIMKLS

SEQ ID NO: 979394 - protein, 9 aa, Homo Sapiens
GRSAWTVRI

SEQ ID NO: 979395 - protein, 9 aa, Homo Sapiens
VQGLGWQAT

SEQ ID NO: 979396 - protein, 9 aa, Homo Sapiens
KPVISSVVL

SEQ ID NO: 979397 - protein, 9 aa, Homo Sapiens
LIPSTRTTL

SEQ ID NO: 979398 - protein, 9 aa, Homo Sapiens
PRPPPRRRT

SEQ ID NO: 979399 - protein, 9 aa, Homo Sapiens
DLALPSVPK

SEQ ID NO: 979400 - protein, 9 aa, Homo Sapiens
IPSTRTTLP

SEQ ID NO: 979401 - protein, 9 aa, Homo Sapiens
HVKSNRNTH

SEQ ID NO: 979402 - protein, 9 aa, Homo Sapiens
NAPGRRPCA

SEQ ID NO: 979403 - protein, 9 aa, Homo Sapiens
YKKTLVIIL

SEQ ID NO: 979404 - protein, 9 aa, Homo Sapiens
RTIARASAW

SEQ ID NO: 979405 - protein, 9 aa, Homo Sapiens
YQQQQVAGG

SEQ ID NO: 979406 - protein, 9 aa, Homo Sapiens
RRRRPRPPP

SEQ ID NO: 979407 - protein, 9 aa, Homo Sapiens
RGKPVISSV

SEQ ID NO: 979408 - protein, 9 aa, Homo Sapiens
PHSPRWPVV

SEQ ID NO: 979409 - protein, 9 aa, Homo Sapiens
LTTKIIQLI

SEQ ID NO: 979410 - protein, 9 aa, Homo Sapiens
CPSLAARLS

SEQ ID NO: 979411 - protein, 9 aa, Homo Sapiens
LSLPESLKA

SEQ ID NO: 979412 - protein, 9 aa, Homo Sapiens
PRRRRPRPP

SEQ ID NO: 979413 - protein, 9 aa, Homo Sapiens
LGWGHPAAA

SEQ ID NO: 979414 - protein, 9 aa, Homo Sapiens
LVLLRGNGL

SEQ ID NO: 979415 - protein, 9 aa, Homo Sapiens
ARGVGKSAL

SEQ ID NO: 979416 - protein, 9 aa, Homo Sapiens
YPSRDEHEA

SEQ ID NO: 979417 - protein, 9 aa, Homo Sapiens
QWVKVLLVL

SEQ ID NO: 979418 - protein, 9 aa, Homo Sapiens
TLRGKPVIS

SEQ ID NO: 979419 - protein, 9 aa, Homo Sapiens
KLAETPSTP

SEQ ID NO: 979420 - protein, 9 aa, Homo Sapiens
YIVVMETKL

SEQ ID NO: 979421 - protein, 9 aa, Homo Sapiens
ELLIASGTN

SEQ ID NO: 979422 - protein, 9 aa, Homo Sapiens
PSLAARLSR

SEQ ID NO: 979423 - protein, 9 aa, Homo Sapiens
QQAGGAEQL

SEQ ID NO: 979424 - protein, 9 aa, Homo Sapiens
ILGANTRTA

SEQ ID NO: 979425 - protein, 9 aa, Homo Sapiens
ELAYMIING

SEQ ID NO: 979426 - protein, 9 aa, Homo Sapiens
VPLQSLEGG

SEQ ID NO: 979427 - protein, 9 aa, Homo Sapiens
AAEVLPDEF

SEQ ID NO: 979428 - protein, 9 aa, Homo Sapiens
SLDRETKPE

SEQ ID NO: 979429 - protein, 9 aa, Homo Sapiens
RFLSEFGAP

SEQ ID NO: 979430 - protein, 9 aa, Homo Sapiens
KDLTTKIIQ

SEQ ID NO: 979431 - protein, 9 aa, Homo Sapiens
AWTVRIPRR

SEQ ID NO: 979432 - protein, 9 aa, Homo Sapiens
ISSVVLAQS

SEQ ID NO: 979433 - protein, 9 aa, Homo Sapiens
ETTVDILHK

SEQ ID NO: 979434 - protein, 9 aa, Homo Sapiens
ELMPGLQGQ

SEQ ID NO: 979435 - protein, 9 aa, Homo Sapiens
SLECLDLDL

SEQ ID NO: 979436 - protein, 9 aa, Homo Sapiens
DKGVAGAIG

SEQ ID NO: 979437 - protein, 9 aa, Homo Sapiens
SVPQPHSPR

SEQ ID NO: 979438 - protein, 9 aa, Homo Sapiens
QGPEKLAET

SEQ ID NO: 979439 - protein, 9 aa, Homo Sapiens
HIHHQRVHT

SEQ ID NO: 979440 - protein, 9 aa, Homo Sapiens
DSFLKRLTR

SEQ ID NO: 979441 - protein, 9 aa, Homo Sapiens
SFLKRLTRW

SEQ ID NO: 979442 - protein, 9 aa, Homo Sapiens
SLAARLSRH

SEQ ID NO: 979443 - protein, 9 aa, Homo Sapiens
VVSVPQPHS

SEQ ID NO: 979444 - protein, 9 aa, Homo Sapiens
GKSGTMEEV

SEQ ID NO: 979445 - protein, 9 aa, Homo Sapiens
DELAYMIIN

SEQ ID NO: 979446 - protein, 9 aa, Homo Sapiens
KTDHIHHQR

SEQ ID NO: 979447 - protein, 9 aa, Homo Sapiens
TALSVEADL

SEQ ID NO: 979448 - protein, 9 aa, Homo Sapiens
LGWQATALS

SEQ ID NO: 979449 - protein, 9 aa, Homo Sapiens
NLQPVGSQG

SEQ ID NO: 979450 - protein, 9 aa, Homo Sapiens
GRGHVKSNR

SEQ ID NO: 979451 - protein, 9 aa, Homo Sapiens
AGAAPRAAC

SEQ ID NO: 979452 - protein, 9 aa, Homo Sapiens
DILHKKHTK

SEQ ID NO: 979453 - protein, 9 aa, Homo Sapiens
SKFEENEYI

SEQ ID NO: 979454 - protein, 9 aa, Homo Sapiens
DHIHHQRVH

SEQ ID NO: 979455 - protein, 9 aa, Homo Sapiens
SSPPTQNWT

SEQ ID NO: 979456 - protein, 9 aa, Homo Sapiens
YYCLVTATS

SEQ ID NO: 979457 - protein, 9 aa, Homo Sapiens
KSGTMEEVV

SEQ ID NO: 979458 - protein, 9 aa, Homo Sapiens
GKADSPPSR

SEQ ID NO: 979459 - protein, 9 aa, Homo Sapiens
LRYKKTLVI

SEQ ID NO: 979460 - protein, 9 aa, Homo Sapiens
RPRTVRAPR

SEQ ID NO: 979461 - protein, 9 aa, Homo Sapiens
RLLLVVIDE

SEQ ID NO: 979462 - protein, 9 aa, Homo Sapiens
RHQEFKGLI

SEQ ID NO: 979463 - protein, 9 aa, Homo Sapiens
QLQVPLQSL

SEQ ID NO: 979464 - protein, 9 aa, Homo Sapiens
PPPWAAAAP

SEQ ID NO: 979465 - protein, 9 aa, Homo Sapiens
RLSRHQEFK

SEQ ID NO: 979466 - protein, 9 aa, Homo Sapiens
LLRGNGLQY

SEQ ID NO: 979467 - protein, 9 aa, Homo Sapiens
IASTAFTTG

SEQ ID NO: 979468 - protein, 9 aa, Homo Sapiens
AAPRAACRR

SEQ ID NO: 979469 - protein, 9 aa, Homo Sapiens
PSVPKEAVS

SEQ ID NO: 979470 - protein, 9 aa, Homo Sapiens
TDHIHHQRV

SEQ ID NO: 979471 - protein, 9 aa, Homo Sapiens
APSQLRCRF

SEQ ID NO: 979472 - protein, 9 aa, Homo Sapiens
TRTTLPSPS

SEQ ID NO: 979473 - protein, 9 aa, Homo Sapiens
EENEYIVVM

SEQ ID NO: 979474 - protein, 9 aa, Homo Sapiens
IIQLISIAP

SEQ ID NO: 979475 - protein, 9 aa, Homo Sapiens
NGKNLTFFI

SEQ ID NO: 979476 - protein, 9 aa, Homo Sapiens
WAAAAPPRC

SEQ ID NO: 979477 - protein, 9 aa, Homo Sapiens
RTVRAPRRP

SEQ ID NO: 979478 - protein, 9 aa, Homo Sapiens
SAAEVLPDE

SEQ ID NO: 979479 - protein, 9 aa, Homo Sapiens
APTAAAAAC

SEQ ID NO: 979480 - protein, 9 aa, Homo Sapiens
RSSQDYLNT

SEQ ID NO: 979481 - protein, 9 aa, Homo Sapiens
GWQATALSV

SEQ ID NO: 979482 - protein, 9 aa, Homo Sapiens
RCSCCPVGC

SEQ ID NO: 979483 - protein, 9 aa, Homo Sapiens
LFPNTSQHI

SEQ ID NO: 979484 - protein, 9 aa, Homo Sapiens
LDSAAEVLP

SEQ ID NO: 979485 - protein, 9 aa, Homo Sapiens
GTMEEVVVL

SEQ ID NO: 979486 - protein, 9 aa, Homo Sapiens
VRAPRRPSP

SEQ ID NO: 979487 - protein, 9 aa, Homo Sapiens
EQNVQRSMW

SEQ ID NO: 979488 - protein, 9 aa, Homo Sapiens
YLNTRSLNS

SEQ ID NO: 979489 - protein, 9 aa, Homo Sapiens
VSLGKADSP

SEQ ID NO: 979490 - protein, 9 aa, Homo Sapiens
KKTLVIILN

SEQ ID NO: 979491 - protein, 9 aa, Homo Sapiens
GTNLLAVNT

SEQ ID NO: 979492 - protein, 9 aa, Homo Sapiens
LGANTRTAR

SEQ ID NO: 979493 - protein, 9 aa, Homo Sapiens
CFDQFRRRF

SEQ ID NO: 979494 - protein, 9 aa, Homo Sapiens
HSPRWPVVV

SEQ ID NO: 979495 - protein, 9 aa, Homo Sapiens
EMAEILGAN

SEQ ID NO: 979496 - protein, 9 aa, Homo Sapiens
HQPIDELAY

SEQ ID NO: 979497 - protein, 9 aa, Homo Sapiens
FNKFSHFYW

SEQ ID NO: 979498 - protein, 9 aa, Homo Sapiens
LDRETKPEI

SEQ ID NO: 979499 - protein, 9 aa, Homo Sapiens
CLVTATSLD

SEQ ID NO: 979500 - protein, 9 aa, Homo Sapiens
VEADLQVLQ

SEQ ID NO: 979501 - protein, 9 aa, Homo Sapiens
KLVVVGARG

SEQ ID NO: 979502 - protein, 9 aa, Homo Sapiens
RLQLQVPLQ

SEQ ID NO: 979503 - protein, 9 aa, Homo Sapiens
PRGPQGLIG

SEQ ID NO: 979504 - protein, 9 aa, Homo Sapiens
SCKKSRCSC

SEQ ID NO: 979505 - protein, 9 aa, Homo Sapiens
KVSIEAALQ

SEQ ID NO: 979506 - protein, 9 aa, Homo Sapiens
SRRSSQDYL

SEQ ID NO: 979507 - protein, 9 aa, Homo Sapiens
QFRRRFGDV

SEQ ID NO: 979508 - protein, 9 aa, Homo Sapiens
APRRPSPCP

SEQ ID NO: 979509 - protein, 9 aa, Homo Sapiens
VSLDRETKP

SEQ ID NO: 979510 - protein, 9 aa, Homo Sapiens
DCHSPQLLR

SEQ ID NO: 979511 - protein, 9 aa, Homo Sapiens
KADSPPSRK

SEQ ID NO: 979512 - protein, 9 aa, Homo Sapiens
SRAPTAAAA

SEQ ID NO: 979513 - protein, 9 aa, Homo Sapiens
SHFYWRQKQ

SEQ ID NO: 979514 - protein, 9 aa, Homo Sapiens
VQGQQAGGA

SEQ ID NO: 979515 - protein, 9 aa, Homo Sapiens
PQGLIGPPG

SEQ ID NO: 979516 - protein, 9 aa, Homo Sapiens
NHHNLLFCS

SEQ ID NO: 979517 - protein, 9 aa, Homo Sapiens
LAEKDLRYK

SEQ ID NO: 979518 - protein, 9 aa, Homo Sapiens
HQEFKGLIK

SEQ ID NO: 979519 - protein, 9 aa, Homo Sapiens
SRHQEFKGL

SEQ ID NO: 979520 - protein, 9 aa, Homo Sapiens
PCASRTSRP

SEQ ID NO: 979521 - protein, 9 aa, Homo Sapiens
RRTIARASA

SEQ ID NO: 979522 - protein, 9 aa, Homo Sapiens
ISVPGVRRH

SEQ ID NO: 979523 - protein, 9 aa, Homo Sapiens
ALRGPSSPP

SEQ ID NO: 979524 - protein, 9 aa, Homo Sapiens
HRDSFLKRL

SEQ ID NO: 979525 - protein, 9 aa, Homo Sapiens
PLQSLEGGS

SEQ ID NO: 979526 - protein, 9 aa, Homo Sapiens
LHKKHTKNI

SEQ ID NO: 979527 - protein, 9 aa, Homo Sapiens
SPCPRPPPW

SEQ ID NO: 979528 - protein, 9 aa, Homo Sapiens
LPGGQLREL

SEQ ID NO: 979529 - protein, 9 aa, Homo Sapiens
FALRGPSSP

SEQ ID NO: 979530 - protein, 9 aa, Homo Sapiens
LGNAGRPLF

SEQ ID NO: 979531 - protein, 9 aa, Homo Sapiens
VAGAIGVQG

SEQ ID NO: 979532 - protein, 9 aa, Homo Sapiens
PGRRPCASR

SEQ ID NO: 979533 - protein, 9 aa, Homo Sapiens
FFISVPGVR

SEQ ID NO: 979534 - protein, 9 aa, Homo Sapiens
AACPAGAAP

SEQ ID NO: 979535 - protein, 9 aa, Homo Sapiens
GNAGRPLFP

SEQ ID NO: 979536 - protein, 9 aa, Homo Sapiens
QYSRLFPNT

SEQ ID NO: 979537 - protein, 9 aa, Homo Sapiens
MEEVVVLAV

SEQ ID NO: 979538 - protein, 9 aa, Homo Sapiens
RCPRSRAPT

SEQ ID NO: 979539 - protein, 9 aa, Homo Sapiens
PQPHSPRWP

SEQ ID NO: 979540 - protein, 9 aa, Homo Sapiens
RGGPEYAEV

SEQ ID NO: 979541 - protein, 9 aa, Homo Sapiens
LMPGLQGQL

SEQ ID NO: 979542 - protein, 9 aa, Homo Sapiens
YKLVVVGAR

SEQ ID NO: 979543 - protein, 9 aa, Homo Sapiens
GSVQGLGWQ

SEQ ID NO: 979544 - protein, 9 aa, Homo Sapiens
DRETKPEIH

SEQ ID NO: 979545 - protein, 9 aa, Homo Sapiens
TSCKKSRCS

SEQ ID NO: 979546 - protein, 9 aa, Homo Sapiens
QLDKGVAGA

SEQ ID NO: 979547 - protein, 9 aa, Homo Sapiens
PRTVRAPRR

SEQ ID NO: 979548 - protein, 9 aa, Homo Sapiens
YCLVTATSL

SEQ ID NO: 979549 - protein, 9 aa, Homo Sapiens
YAEVEVEPC

SEQ ID NO: 979550 - protein, 9 aa, Homo Sapiens
LNEDGEEID

SEQ ID NO: 979551 - protein, 9 aa, Homo Sapiens
TPLKIQGIE

SEQ ID NO: 979552 - protein, 9 aa, Homo Sapiens
GKRLGLDFR

SEQ ID NO: 979553 - protein, 9 aa, Homo Sapiens
GLFSSGLYH

SEQ ID NO: 979554 - protein, 9 aa, Homo Sapiens
ENESRFWEP

SEQ ID NO: 979555 - protein, 9 aa, Homo Sapiens
KMVMIDVDG

SEQ ID NO: 979556 - protein, 9 aa, Homo Sapiens
IFFRALFGA

SEQ ID NO: 979557 - protein, 9 aa, Homo Sapiens
KKGKEGKEI

SEQ ID NO: 979558 - protein, 9 aa, Homo Sapiens
PLLHPPESK

SEQ ID NO: 979559 - protein, 9 aa, Homo Sapiens
KSRDFCKGK

SEQ ID NO: 979560 - protein, 9 aa, Homo Sapiens
EACSVFKEK

SEQ ID NO: 979561 - protein, 9 aa, Homo Sapiens
SGFFLSQDP

SEQ ID NO: 979562 - protein, 9 aa, Homo Sapiens
LRETLVRAA

SEQ ID NO: 979563 - protein, 9 aa, Homo Sapiens
AMYADLNQN

SEQ ID NO: 979564 - protein, 9 aa, Homo Sapiens
PSTSRACAS

SEQ ID NO: 979565 - protein, 9 aa, Homo Sapiens
TNPETSEML

SEQ ID NO: 979566 - protein, 9 aa, Homo Sapiens
PEYNVIITA

SEQ ID NO: 979567 - protein, 9 aa, Homo Sapiens
NLFFSDLLV

SEQ ID NO: 979568 - protein, 9 aa, Homo Sapiens
AVNPHTVSP

SEQ ID NO: 979569 - protein, 9 aa, Homo Sapiens
CTLTVFSPE

SEQ ID NO: 979570 - protein, 9 aa, Homo Sapiens
RWAEKTPEP

SEQ ID NO: 979571 - protein, 9 aa, Homo Sapiens
RQLNPNIWV

SEQ ID NO: 979572 - protein, 9 aa, Homo Sapiens
IVQEILQSQ

SEQ ID NO: 979573 - protein, 9 aa, Homo Sapiens
TKIKKKTKY

SEQ ID NO: 979574 - protein, 9 aa, Homo Sapiens
MEPGKTRRN

SEQ ID NO: 979575 - protein, 9 aa, Homo Sapiens
QEENFKYQD

SEQ ID NO: 979576 - protein, 9 aa, Homo Sapiens
VLKKMTDGG

SEQ ID NO: 979577 - protein, 9 aa, Homo Sapiens
HSKEIIYRD

SEQ ID NO: 979578 - protein, 9 aa, Homo Sapiens
GITLYSHPF

SEQ ID NO: 979579 - protein, 9 aa, Homo Sapiens
LKNGDPSGL

SEQ ID NO: 979580 - protein, 9 aa, Homo Sapiens
DPYIVIRLG

SEQ ID NO: 979581 - protein, 9 aa, Homo Sapiens
FYQLIFRRS

SEQ ID NO: 979582 - protein, 9 aa, Homo Sapiens
EFCGLPCLE

SEQ ID NO: 979583 - protein, 9 aa, Homo Sapiens
FFRLSGGSR

SEQ ID NO: 979584 - protein, 9 aa, Homo Sapiens
IFRRSPSQK

SEQ ID NO: 979585 - protein, 9 aa, Homo Sapiens
LGEATGPDP

SEQ ID NO: 979586 - protein, 9 aa, Homo Sapiens
GSTSFISIG

SEQ ID NO: 979587 - protein, 9 aa, Homo Sapiens
AWSLGPSVQ

SEQ ID NO: 979588 - protein, 9 aa, Homo Sapiens
GGQENSLLC

SEQ ID NO: 979589 - protein, 9 aa, Homo Sapiens
YISPQGIVH

SEQ ID NO: 979590 - protein, 9 aa, Homo Sapiens
SWNKSRDFC

SEQ ID NO: 979591 - protein, 9 aa, Homo Sapiens
VVRALNIDG

SEQ ID NO: 979592 - protein, 9 aa, Homo Sapiens
PGSERKRLL

SEQ ID NO: 979593 - protein, 9 aa, Homo Sapiens
LDHEFRTSP

SEQ ID NO: 979594 - protein, 9 aa, Homo Sapiens
YLHGNKGFF

SEQ ID NO: 979595 - protein, 9 aa, Homo Sapiens
SFKEVVEAI

SEQ ID NO: 979596 - protein, 9 aa, Homo Sapiens
PRVKVGNKF

SEQ ID NO: 979597 - protein, 9 aa, Homo Sapiens
NMEVEIKTS

SEQ ID NO: 979598 - protein, 9 aa, Homo Sapiens
EGYFMNVLV

SEQ ID NO: 979599 - protein, 9 aa, Homo Sapiens
YMDEKGDCV

SEQ ID NO: 979600 - protein, 9 aa, Homo Sapiens
ISSHTANLA

SEQ ID NO: 979601 - protein, 9 aa, Homo Sapiens
ETRSHNEVL

SEQ ID NO: 979602 - protein, 9 aa, Homo Sapiens
KEWLLNEIR

SEQ ID NO: 979603 - protein, 9 aa, Homo Sapiens
FSENQTYIC

SEQ ID NO: 979604 - protein, 9 aa, Homo Sapiens
LLKGFRCQT

SEQ ID NO: 979605 - protein, 9 aa, Homo Sapiens
YHCHSWEKM

SEQ ID NO: 979606 - protein, 9 aa, Homo Sapiens
SESENNVEE

SEQ ID NO: 979607 - protein, 9 aa, Homo Sapiens
LFPACQRPP

SEQ ID NO: 979608 - protein, 9 aa, Homo Sapiens
NDISHEGVF

SEQ ID NO: 979609 - protein, 9 aa, Homo Sapiens
ECSADEDPQ

SEQ ID NO: 979610 - protein, 9 aa, Homo Sapiens
EQLKVKFQK

SEQ ID NO: 979611 - protein, 9 aa, Homo Sapiens
KECANEPSQ

SEQ ID NO: 979612 - protein, 9 aa, Homo Sapiens
LFYSLTLME

SEQ ID NO: 979613 - protein, 9 aa, Homo Sapiens
IQAASQPQL

SEQ ID NO: 979614 - protein, 9 aa, Homo Sapiens
GEGHVCVSA

SEQ ID NO: 979615 - protein, 9 aa, Homo Sapiens
PHFTPLLSS

SEQ ID NO: 979616 - protein, 9 aa, Homo Sapiens
NILEYGNRT

SEQ ID NO: 979617 - protein, 9 aa, Homo Sapiens
ICQKFLLKG

SEQ ID NO: 979618 - protein, 9 aa, Homo Sapiens
IPFSYNFHD

SEQ ID NO: 979619 - protein, 9 aa, Homo Sapiens
NTPPPTPSE

SEQ ID NO: 979620 - protein, 9 aa, Homo Sapiens
KEDLLGYYV

SEQ ID NO: 979621 - protein, 9 aa, Homo Sapiens
VGFSKGLWI

SEQ ID NO: 979622 - protein, 9 aa, Homo Sapiens
TVAPEEKAG

SEQ ID NO: 979623 - protein, 9 aa, Homo Sapiens
VSLSHSGLA

SEQ ID NO: 979624 - protein, 9 aa, Homo Sapiens
VNCINTLLQ

SEQ ID NO: 979625 - protein, 9 aa, Homo Sapiens
LTRKSQKII

SEQ ID NO: 979626 - protein, 9 aa, Homo Sapiens
NVEIKKFLW

SEQ ID NO: 979627 - protein, 9 aa, Homo Sapiens
LCLDFLRCV

SEQ ID NO: 979628 - protein, 9 aa, Homo Sapiens
ITKINKTTA

SEQ ID NO: 979629 - protein, 9 aa, Homo Sapiens
GATKALNYS

SEQ ID NO: 979630 - protein, 9 aa, Homo Sapiens
SSVSQLLSH

SEQ ID NO: 979631 - protein, 9 aa, Homo Sapiens
QWDRPKHKE

SEQ ID NO: 979632 - protein, 9 aa, Homo Sapiens
HTVSPACPE

SEQ ID NO: 979633 - protein, 9 aa, Homo Sapiens
RVRQKLEAA

SEQ ID NO: 979634 - protein, 9 aa, Homo Sapiens
KRHDSTEEP

SEQ ID NO: 979635 - protein, 9 aa, Homo Sapiens
KQEAQKNWD

SEQ ID NO: 979636 - protein, 9 aa, Homo Sapiens
IIYEKRQKA

SEQ ID NO: 979637 - protein, 9 aa, Homo Sapiens
GREEYSAMR

SEQ ID NO: 979638 - protein, 9 aa, Homo Sapiens
EDRILLCRK

SEQ ID NO: 979639 - protein, 9 aa, Homo Sapiens
GERPSQAFL

SEQ ID NO: 979640 - protein, 9 aa, Homo Sapiens
PFSLDHEFR

SEQ ID NO: 979641 - protein, 9 aa, Homo Sapiens
CPFCTCSAR

SEQ ID NO: 979642 - protein, 9 aa, Homo Sapiens
KRESCEEVD

SEQ ID NO: 979643 - protein, 9 aa, Homo Sapiens
LIFYLFILI

SEQ ID NO: 979644 - protein, 9 aa, Homo Sapiens
SRKMGDSPN

SEQ ID NO: 979645 - protein, 9 aa, Homo Sapiens
QIFCLDSYT

SEQ ID NO: 979646 - protein, 9 aa, Homo Sapiens
ATARWGPGE

SEQ ID NO: 979647 - protein, 9 aa, Homo Sapiens
GGQKDPAPE

SEQ ID NO: 979648 - protein, 9 aa, Homo Sapiens
RHDSTEEPP

SEQ ID NO: 979649 - protein, 9 aa, Homo Sapiens
NIISLKDNK

SEQ ID NO: 979650 - protein, 9 aa, Homo Sapiens
GTFQGGGVC

SEQ ID NO: 979651 - protein, 9 aa, Homo Sapiens
LTLINEEEE

SEQ ID NO: 979652 - protein, 9 aa, Homo Sapiens
LEKPHEMHF

SEQ ID NO: 979653 - protein, 9 aa, Homo Sapiens
ILVCAGLGL

SEQ ID NO: 979654 - protein, 9 aa, Homo Sapiens
YTGHSSIDS

SEQ ID NO: 979655 - protein, 9 aa, Homo Sapiens
AHGASTVLS

SEQ ID NO: 979656 - protein, 9 aa, Homo Sapiens
VASAGVTLK

SEQ ID NO: 979657 - protein, 9 aa, Homo Sapiens
LAQIRQGGS

SEQ ID NO: 979658 - protein, 9 aa, Homo Sapiens
FKVVVTAAT

SEQ ID NO: 979659 - protein, 9 aa, Homo Sapiens
SKCDADHSF

SEQ ID NO: 979660 - protein, 9 aa, Homo Sapiens
TADQGHARR

SEQ ID NO: 979661 - protein, 9 aa, Homo Sapiens
GLPFSSKLA

SEQ ID NO: 979662 - protein, 9 aa, Homo Sapiens
PLPPPPPLL

SEQ ID NO: 979663 - protein, 9 aa, Homo Sapiens
VADRRLLLY

SEQ ID NO: 979664 - protein, 9 aa, Homo Sapiens
GTIICVYFK

SEQ ID NO: 979665 - protein, 9 aa, Homo Sapiens
EQYLHGNKG

SEQ ID NO: 979666 - protein, 9 aa, Homo Sapiens
KNTIFYSEC

SEQ ID NO: 979667 - protein, 9 aa, Homo Sapiens
FPQSQYLQY

SEQ ID NO: 979668 - protein, 9 aa, Homo Sapiens
GPGSGNTYR

SEQ ID NO: 979669 - protein, 9 aa, Homo Sapiens
KHTEYLHLS

SEQ ID NO: 979670 - protein, 9 aa, Homo Sapiens
AKTQAGRSL

SEQ ID NO: 979671 - protein, 9 aa, Homo Sapiens
KVSGPCHEN

SEQ ID NO: 979672 - protein, 9 aa, Homo Sapiens
IFPVSVGRG

SEQ ID NO: 979673 - protein, 9 aa, Homo Sapiens
LKLAKLLSS

SEQ ID NO: 979674 - protein, 9 aa, Homo Sapiens
DAQVQKLFQ

SEQ ID NO: 979675 - protein, 9 aa, Homo Sapiens
LLRETLVRA

SEQ ID NO: 979676 - protein, 9 aa, Homo Sapiens
FLKLAKLLS

SEQ ID NO: 979677 - protein, 9 aa, Homo Sapiens
KRKLCPEFS

SEQ ID NO: 979678 - protein, 9 aa, Homo Sapiens
ASSLGEATG

SEQ ID NO: 979679 - protein, 9 aa, Homo Sapiens
LEGSPTLHF

SEQ ID NO: 979680 - protein, 9 aa, Homo Sapiens
VPCPEEKFS

SEQ ID NO: 979681 - protein, 9 aa, Homo Sapiens
GSERKRLLP

SEQ ID NO: 979682 - protein, 9 aa, Homo Sapiens
SSGLYHRPP

SEQ ID NO: 979683 - protein, 9 aa, Homo Sapiens
LAWDNKMRV

SEQ ID NO: 979684 - protein, 9 aa, Homo Sapiens
DRRLLLYKY

SEQ ID NO: 979685 - protein, 9 aa, Homo Sapiens
RLDYSMCII

SEQ ID NO: 979686 - protein, 9 aa, Homo Sapiens
YHLHSFLMF

SEQ ID NO: 979687 - protein, 9 aa, Homo Sapiens
KKFLWHIKR

SEQ ID NO: 979688 - protein, 9 aa, Homo Sapiens
KVGNKFVTK

SEQ ID NO: 979689 - protein, 9 aa, Homo Sapiens
FLKACELWE

SEQ ID NO: 979690 - protein, 9 aa, Homo Sapiens
RPKHKEDLL

SEQ ID NO: 979691 - protein, 9 aa, Homo Sapiens
QPSFCHRSD

SEQ ID NO: 979692 - protein, 9 aa, Homo Sapiens
LTEQFCIPK

SEQ ID NO: 979693 - protein, 9 aa, Homo Sapiens
MVTMFPRVC

SEQ ID NO: 979694 - protein, 9 aa, Homo Sapiens
ILLCRKAGS

SEQ ID NO: 979695 - protein, 9 aa, Homo Sapiens
EEKAGPILT

SEQ ID NO: 979696 - protein, 9 aa, Homo Sapiens
RQKRTKIKK

SEQ ID NO: 979697 - protein, 9 aa, Homo Sapiens
KGHLTDSSE

SEQ ID NO: 979698 - protein, 9 aa, Homo Sapiens
DNKMRVTEY

SEQ ID NO: 979699 - protein, 9 aa, Homo Sapiens
EVDRSNFLE

SEQ ID NO: 979700 - protein, 9 aa, Homo Sapiens
SSSGPALFG

SEQ ID NO: 979701 - protein, 9 aa, Homo Sapiens
SFNTLKKWV

SEQ ID NO: 979702 - protein, 9 aa, Homo Sapiens
KFLRNGDTV

SEQ ID NO: 979703 - protein, 9 aa, Homo Sapiens
AASRALYSL

SEQ ID NO: 979704 - protein, 9 aa, Homo Sapiens
EQRQLQKKL

SEQ ID NO: 979705 - protein, 9 aa, Homo Sapiens
SSLRLKDKF

SEQ ID NO: 979706 - protein, 9 aa, Homo Sapiens
QRFRKKSTE

SEQ ID NO: 979707 - protein, 9 aa, Homo Sapiens
AILGSDYFF

SEQ ID NO: 979708 - protein, 9 aa, Homo Sapiens
GTGGGPWGK

SEQ ID NO: 979709 - protein, 9 aa, Homo Sapiens
FWEVFYELP

SEQ ID NO: 979710 - protein, 9 aa, Homo Sapiens
NKLRRNIVP

SEQ ID NO: 979711 - protein, 9 aa, Homo Sapiens
DGTFQGGGV

SEQ ID NO: 979712 - protein, 9 aa, Homo Sapiens
GRVEIYYEG

SEQ ID NO: 979713 - protein, 9 aa, Homo Sapiens
VAQIFCLDS

SEQ ID NO: 979714 - protein, 9 aa, Homo Sapiens
IELVVASAG

SEQ ID NO: 979715 - protein, 9 aa, Homo Sapiens
KDKNLFNME

SEQ ID NO: 979716 - protein, 9 aa, Homo Sapiens
SYQDIRLEV

SEQ ID NO: 979717 - protein, 9 aa, Homo Sapiens
EKLWYNERC

SEQ ID NO: 979718 - protein, 9 aa, Homo Sapiens
LRRNIVPEA

SEQ ID NO: 979719 - protein, 9 aa, Homo Sapiens
KILCKLSLE

SEQ ID NO: 979720 - protein, 9 aa, Homo Sapiens
EGLCEASEA

SEQ ID NO: 979721 - protein, 9 aa, Homo Sapiens
NINQLIINA

SEQ ID NO: 979722 - protein, 9 aa, Homo Sapiens
CHPLRKRCK

SEQ ID NO: 979723 - protein, 9 aa, Homo Sapiens
KYLSDFCSP

SEQ ID NO: 979724 - protein, 9 aa, Homo Sapiens
AMKRTRTAG

SEQ ID NO: 979725 - protein, 9 aa, Homo Sapiens
TRLEECCEQ

SEQ ID NO: 979726 - protein, 9 aa, Homo Sapiens
LLHPPESKS

SEQ ID NO: 979727 - protein, 9 aa, Homo Sapiens
SYPRFPFIF

SEQ ID NO: 979728 - protein, 9 aa, Homo Sapiens
VLFSFDVKN

SEQ ID NO: 979729 - protein, 9 aa, Homo Sapiens
SYHQRQLNP

SEQ ID NO: 979730 - protein, 9 aa, Homo Sapiens
EKVRWRTKQ

SEQ ID NO: 979731 - protein, 9 aa, Homo Sapiens
WYWQLEKEC

SEQ ID NO: 979732 - protein, 9 aa, Homo Sapiens
LFLEIYVVT

SEQ ID NO: 979733 - protein, 9 aa, Homo Sapiens
EASEACVND

SEQ ID NO: 979734 - protein, 9 aa, Homo Sapiens
VAKIDAALP

SEQ ID NO: 979735 - protein, 9 aa, Homo Sapiens
LSDFCSPRS

SEQ ID NO: 979736 - protein, 9 aa, Homo Sapiens
WIECATHST

SEQ ID NO: 979737 - protein, 9 aa, Homo Sapiens
LASLASSTT

SEQ ID NO: 979738 - protein, 9 aa, Homo Sapiens
PFLKLAKLL

SEQ ID NO: 979739 - protein, 9 aa, Homo Sapiens
WIVNCINTL

SEQ ID NO: 979740 - protein, 9 aa, Homo Sapiens
SGPASELHT

SEQ ID NO: 979741 - protein, 9 aa, Homo Sapiens
EVEIKTSGM

SEQ ID NO: 979742 - protein, 9 aa, Homo Sapiens
YLQYYGSSY

SEQ ID NO: 979743 - protein, 9 aa, Homo Sapiens
ALPEGRQEF

SEQ ID NO: 979744 - protein, 9 aa, Homo Sapiens
GFDGLSGLP

SEQ ID NO: 979745 - protein, 9 aa, Homo Sapiens
FKEKHIQNL

SEQ ID NO: 979746 - protein, 9 aa, Homo Sapiens
FIYAFIVVE

SEQ ID NO: 979747 - protein, 9 aa, Homo Sapiens
EPEEDGEGH

SEQ ID NO: 979748 - protein, 9 aa, Homo Sapiens
CGSEKICIR

SEQ ID NO: 979749 - protein, 9 aa, Homo Sapiens
NQYHEMLNN

SEQ ID NO: 979750 - protein, 9 aa, Homo Sapiens
SKINHIYRE

SEQ ID NO: 979751 - protein, 9 aa, Homo Sapiens
HKRIYTGEK

SEQ ID NO: 979752 - protein, 9 aa, Homo Sapiens
LQLLCSWAP

SEQ ID NO: 979753 - protein, 9 aa, Homo Sapiens
KKNSHQVKE

SEQ ID NO: 979754 - protein, 9 aa, Homo Sapiens
KGLSERVMN

SEQ ID NO: 979755 - protein, 9 aa, Homo Sapiens
LYSHPFGGA

SEQ ID NO: 979756 - protein, 9 aa, Homo Sapiens
KRIYTGEKP

SEQ ID NO: 979757 - protein, 9 aa, Homo Sapiens
NIKLKERSD

SEQ ID NO: 979758 - protein, 9 aa, Homo Sapiens
LLDDYVYWT

SEQ ID NO: 979759 - protein, 9 aa, Homo Sapiens
RALVPGKVA

SEQ ID NO: 979760 - protein, 9 aa, Homo Sapiens
AFIVVENLV

SEQ ID NO: 979761 - protein, 9 aa, Homo Sapiens
LIAYPKAVT

SEQ ID NO: 979762 - protein, 9 aa, Homo Sapiens
NIVPEALFL

SEQ ID NO: 979763 - protein, 9 aa, Homo Sapiens
QGHARRCWL

SEQ ID NO: 979764 - protein, 9 aa, Homo Sapiens
ANDKFTLSE

SEQ ID NO: 979765 - protein, 9 aa, Homo Sapiens
MYTIYKILC

SEQ ID NO: 979766 - protein, 9 aa, Homo Sapiens
ATYEPGTTI

SEQ ID NO: 979767 - protein, 9 aa, Homo Sapiens
VFSVTAVAK

SEQ ID NO: 979768 - protein, 9 aa, Homo Sapiens
KEFSENQTY

SEQ ID NO: 979769 - protein, 9 aa, Homo Sapiens
AVQKVFSNK

SEQ ID NO: 979770 - protein, 9 aa, Homo Sapiens
ENARFGQGS

SEQ ID NO: 979771 - protein, 9 aa, Homo Sapiens
GQERRGEPR

SEQ ID NO: 979772 - protein, 9 aa, Homo Sapiens
HSFINPGKI

SEQ ID NO: 979773 - protein, 9 aa, Homo Sapiens
LFFEIGAIF

SEQ ID NO: 979774 - protein, 9 aa, Homo Sapiens
GPVPATSFQ

SEQ ID NO: 979775 - protein, 9 aa, Homo Sapiens
IKNVQKMSQ

SEQ ID NO: 979776 - protein, 9 aa, Homo Sapiens
RPARENCRG

SEQ ID NO: 979777 - protein, 9 aa, Homo Sapiens
GFLRKGGHT

SEQ ID NO: 979778 - protein, 9 aa, Homo Sapiens
ITHLQKQIV

SEQ ID NO: 979779 - protein, 9 aa, Homo Sapiens
KRQKRTKIK

SEQ ID NO: 979780 - protein, 9 aa, Homo Sapiens
MSHLGQHKN

SEQ ID NO: 979781 - protein, 9 aa, Homo Sapiens
NNTVVLSEN

SEQ ID NO: 979782 - protein, 9 aa, Homo Sapiens
PFCTCSARP

SEQ ID NO: 979783 - protein, 9 aa, Homo Sapiens
YSVEDIEPD

SEQ ID NO: 979784 - protein, 9 aa, Homo Sapiens
SCAPCQPCS

SEQ ID NO: 979785 - protein, 9 aa, Homo Sapiens
FNTLKKWVK

SEQ ID NO: 979786 - protein, 9 aa, Homo Sapiens
DNASQLTLT

SEQ ID NO: 979787 - protein, 9 aa, Homo Sapiens
CLANQFLDI

SEQ ID NO: 979788 - protein, 9 aa, Homo Sapiens
PRIPGRMLP

SEQ ID NO: 979789 - protein, 9 aa, Homo Sapiens
ARPITDGRA

SEQ ID NO: 979790 - protein, 9 aa, Homo Sapiens
FPHTRTIVK

SEQ ID NO: 979791 - protein, 9 aa, Homo Sapiens
KSAIFIAED

SEQ ID NO: 979792 - protein, 9 aa, Homo Sapiens
FSTGSAFGF

SEQ ID NO: 979793 - protein, 9 aa, Homo Sapiens
TKAYYQGAQ

SEQ ID NO: 979794 - protein, 9 aa, Homo Sapiens
FRWEHKMVM

SEQ ID NO: 979795 - protein, 9 aa, Homo Sapiens
VTMFPRVCF

SEQ ID NO: 979796 - protein, 9 aa, Homo Sapiens
SFISIGRRT

SEQ ID NO: 979797 - protein, 9 aa, Homo Sapiens
AGKILWACQ

SEQ ID NO: 979798 - protein, 9 aa, Homo Sapiens
TNIALKVFF

SEQ ID NO: 979799 - protein, 9 aa, Homo Sapiens
RHLFEKKLA

SEQ ID NO: 979800 - protein, 9 aa, Homo Sapiens
SAASIRSRN

SEQ ID NO: 979801 - protein, 9 aa, Homo Sapiens
CGVPCPEEK

SEQ ID NO: 979802 - protein, 9 aa, Homo Sapiens
YAILGSDYF

SEQ ID NO: 979803 - protein, 9 aa, Homo Sapiens
LGLSIPLMS

SEQ ID NO: 979804 - protein, 9 aa, Homo Sapiens
SLNREGISQ

SEQ ID NO: 979805 - protein, 9 aa, Homo Sapiens
SPLTEHSQG

SEQ ID NO: 979806 - protein, 9 aa, Homo Sapiens
ESSGGPVSR

SEQ ID NO: 979807 - protein, 9 aa, Homo Sapiens
HPFGGALLN

SEQ ID NO: 979808 - protein, 9 aa, Homo Sapiens
TEKNIEQLH

SEQ ID NO: 979809 - protein, 9 aa, Homo Sapiens
EHSSELFFE

SEQ ID NO: 979810 - protein, 9 aa, Homo Sapiens
SIFPEGGDK

SEQ ID NO: 979811 - protein, 9 aa, Homo Sapiens
STPVTTSAK

SEQ ID NO: 979812 - protein, 9 aa, Homo Sapiens
QPPLPPSTS

SEQ ID NO: 979813 - protein, 9 aa, Homo Sapiens
TCMLNIPFS

SEQ ID NO: 979814 - protein, 9 aa, Homo Sapiens
NQFLDISFC

SEQ ID NO: 979815 - protein, 9 aa, Homo Sapiens
SYTGHSSID

SEQ ID NO: 979816 - protein, 9 aa, Homo Sapiens
VVASAGVTL

SEQ ID NO: 979817 - protein, 9 aa, Homo Sapiens
YNDISHEGV

SEQ ID NO: 979818 - protein, 9 aa, Homo Sapiens
ETFGDSKEK

SEQ ID NO: 979819 - protein, 9 aa, Homo Sapiens
EVCPQRFPV

SEQ ID NO: 979820 - protein, 9 aa, Homo Sapiens
YSFEDNANY

SEQ ID NO: 979821 - protein, 9 aa, Homo Sapiens
SSKPQVSFL

SEQ ID NO: 979822 - protein, 9 aa, Homo Sapiens
DEVHKNSRS

SEQ ID NO: 979823 - protein, 9 aa, Homo Sapiens
QAEKGYKEW

SEQ ID NO: 979824 - protein, 9 aa, Homo Sapiens
IFGGQENSL

SEQ ID NO: 979825 - protein, 9 aa, Homo Sapiens
QPLFPACQR

SEQ ID NO: 979826 - protein, 9 aa, Homo Sapiens
LTDSSEEAE

SEQ ID NO: 979827 - protein, 9 aa, Homo Sapiens
CYCGEKSFL

SEQ ID NO: 979828 - protein, 9 aa, Homo Sapiens
DISHEGVFE

SEQ ID NO: 979829 - protein, 9 aa, Homo Sapiens
LLYKYVYKR

SEQ ID NO: 979830 - protein, 9 aa, Homo Sapiens
KGIKKPYNL

SEQ ID NO: 979831 - protein, 9 aa, Homo Sapiens
DVSSFSSRK

SEQ ID NO: 979832 - protein, 9 aa, Homo Sapiens
KILQGNKNG

SEQ ID NO: 979833 - protein, 9 aa, Homo Sapiens
KVAATKSQA

SEQ ID NO: 979834 - protein, 9 aa, Homo Sapiens
PEGRQEFVR

SEQ ID NO: 979835 - protein, 9 aa, Homo Sapiens
SSQDSKDTP

SEQ ID NO: 979836 - protein, 9 aa, Homo Sapiens
HTRRVVSQE

SEQ ID NO: 979837 - protein, 9 aa, Homo Sapiens
KFGVNAILG

SEQ ID NO: 979838 - protein, 9 aa, Homo Sapiens
KLKEPGKKG

SEQ ID NO: 979839 - protein, 9 aa, Homo Sapiens
ESKSPGEYV

SEQ ID NO: 979840 - protein, 9 aa, Homo Sapiens
NQLIINAYN

SEQ ID NO: 979841 - protein, 9 aa, Homo Sapiens
LASSESENN

SEQ ID NO: 979842 - protein, 9 aa, Homo Sapiens
LTTNSDHIT

SEQ ID NO: 979843 - protein, 9 aa, Homo Sapiens
CKPRQDSRT

SEQ ID NO: 979844 - protein, 9 aa, Homo Sapiens
GHTLTTKIS

SEQ ID NO: 979845 - protein, 9 aa, Homo Sapiens
TAQGGFDTS

SEQ ID NO: 979846 - protein, 9 aa, Homo Sapiens
RFWEPVLPF

SEQ ID NO: 979847 - protein, 9 aa, Homo Sapiens
CHRSDDPVG

SEQ ID NO: 979848 - protein, 9 aa, Homo Sapiens
TAVDLNEGT

SEQ ID NO: 979849 - protein, 9 aa, Homo Sapiens
FCSPRSLAG

SEQ ID NO: 979850 - protein, 9 aa, Homo Sapiens
NNEFNISFI

SEQ ID NO: 979851 - protein, 9 aa, Homo Sapiens
SKEKVRWRT

SEQ ID NO: 979852 - protein, 9 aa, Homo Sapiens
ENSVPTTAS

SEQ ID NO: 979853 - protein, 9 aa, Homo Sapiens
VNLFFSDLL

SEQ ID NO: 979854 - protein, 9 aa, Homo Sapiens
SAKTSSSPT

SEQ ID NO: 979855 - protein, 9 aa, Homo Sapiens
GKVDSRPPW

SEQ ID NO: 979856 - protein, 9 aa, Homo Sapiens
VIPLANKSE

SEQ ID NO: 979857 - protein, 9 aa, Homo Sapiens
IISLKDNKI

SEQ ID NO: 979858 - protein, 9 aa, Homo Sapiens
KHKKIYTGE

SEQ ID NO: 979859 - protein, 9 aa, Homo Sapiens
FYPNGGDQE

SEQ ID NO: 979860 - protein, 9 aa, Homo Sapiens
GGGAGSRFG

SEQ ID NO: 979861 - protein, 9 aa, Homo Sapiens
YVVSIFVLT

SEQ ID NO: 979862 - protein, 9 aa, Homo Sapiens
SQLVAKRQK

SEQ ID NO: 979863 - protein, 9 aa, Homo Sapiens
FQITKINKT

SEQ ID NO: 979864 - protein, 9 aa, Homo Sapiens
APLSAATKY

SEQ ID NO: 979865 - protein, 9 aa, Homo Sapiens
LFSSGLYHR

SEQ ID NO: 979866 - protein, 9 aa, Homo Sapiens
TLVHTVMDN

SEQ ID NO: 979867 - protein, 9 aa, Homo Sapiens
KISSMSQRK

SEQ ID NO: 979868 - protein, 9 aa, Homo Sapiens
RGRQRSSGF

SEQ ID NO: 979869 - protein, 9 aa, Homo Sapiens
FKFDQYMHT

SEQ ID NO: 979870 - protein, 9 aa, Homo Sapiens
LECSADEDP

SEQ ID NO: 979871 - protein, 9 aa, Homo Sapiens
NASEIIQRP

SEQ ID NO: 979872 - protein, 9 aa, Homo Sapiens
NSTNIALKV

SEQ ID NO: 979873 - protein, 9 aa, Homo Sapiens
VICNFFTIC

SEQ ID NO: 979874 - protein, 9 aa, Homo Sapiens
PLVYTATSL

SEQ ID NO: 979875 - protein, 9 aa, Homo Sapiens
KSLEKAEIY

SEQ ID NO: 979876 - protein, 9 aa, Homo Sapiens
SDMYPMPNI

SEQ ID NO: 979877 - protein, 9 aa, Homo Sapiens
WKYLYLPST

SEQ ID NO: 979878 - protein, 9 aa, Homo Sapiens
PLPPPEASI

SEQ ID NO: 979879 - protein, 9 aa, Homo Sapiens
LEQFIATYE

SEQ ID NO: 979880 - protein, 9 aa, Homo Sapiens
STMGANVSQ

SEQ ID NO: 979881 - protein, 9 aa, Homo Sapiens
KVVVTAATM

SEQ ID NO: 979882 - protein, 9 aa, Homo Sapiens
SKNKLHSLS

SEQ ID NO: 979883 - protein, 9 aa, Homo Sapiens
RKKSTEQEL

SEQ ID NO: 979884 - protein, 9 aa, Homo Sapiens
LLRPKGPPG

SEQ ID NO: 979885 - protein, 9 aa, Homo Sapiens
EVFYELPLE

SEQ ID NO: 979886 - protein, 9 aa, Homo Sapiens
TVANFLFLF

SEQ ID NO: 979887 - protein, 9 aa, Homo Sapiens
VENRPKNAG

SEQ ID NO: 979888 - protein, 9 aa, Homo Sapiens
PPAPPARLP

SEQ ID NO: 979889 - protein, 9 aa, Homo Sapiens
FVPEIFYRI

SEQ ID NO: 979890 - protein, 9 aa, Homo Sapiens
STVLSSVSQ

SEQ ID NO: 979891 - protein, 9 aa, Homo Sapiens
LDISFCPAL

SEQ ID NO: 979892 - protein, 9 aa, Homo Sapiens
LKEPGKKGK

SEQ ID NO: 979893 - protein, 9 aa, Homo Sapiens
GNFSSVFHI

SEQ ID NO: 979894 - protein, 9 aa, Homo Sapiens
KSRPLKLQI

SEQ ID NO: 979895 - protein, 9 aa, Homo Sapiens
LPIFSYNVV

SEQ ID NO: 979896 - protein, 9 aa, Homo Sapiens
GLAPSPQLP

SEQ ID NO: 979897 - protein, 9 aa, Homo Sapiens
TEIQAASQP

SEQ ID NO: 979898 - protein, 9 aa, Homo Sapiens
DCLQQSRKM

SEQ ID NO: 979899 - protein, 9 aa, Homo Sapiens
ILEYGNRTY

SEQ ID NO: 979900 - protein, 9 aa, Homo Sapiens
PTKQKSSIS

SEQ ID NO: 979901 - protein, 9 aa, Homo Sapiens
VDRSNFLER

SEQ ID NO: 979902 - protein, 9 aa, Homo Sapiens
MKSAIFIAE

SEQ ID NO: 979903 - protein, 9 aa, Homo Sapiens
KAPNHFRKE

SEQ ID NO: 979904 - protein, 9 aa, Homo Sapiens
YLSGYRICL

SEQ ID NO: 979905 - protein, 9 aa, Homo Sapiens
KLQRLQQAE

SEQ ID NO: 979906 - protein, 9 aa, Homo Sapiens
TGEQTKKMW

SEQ ID NO: 979907 - protein, 9 aa, Homo Sapiens
LKISSMSQR

SEQ ID NO: 979908 - protein, 9 aa, Homo Sapiens
VQKLFQSLA

SEQ ID NO: 979909 - protein, 9 aa, Homo Sapiens
FQPPPSCLC

SEQ ID NO: 979910 - protein, 9 aa, Homo Sapiens
LNIPFSYNF

SEQ ID NO: 979911 - protein, 9 aa, Homo Sapiens
GVPSVIVAW

SEQ ID NO: 979912 - protein, 9 aa, Homo Sapiens
PQAEETEKN

SEQ ID NO: 979913 - protein, 9 aa, Homo Sapiens
DICQKFLLK

SEQ ID NO: 979914 - protein, 9 aa, Homo Sapiens
EKLFQKPRS

SEQ ID NO: 979915 - protein, 9 aa, Homo Sapiens
RMVIGFKFD

SEQ ID NO: 979916 - protein, 9 aa, Homo Sapiens
ASLNREGIS

SEQ ID NO: 979917 - protein, 9 aa, Homo Sapiens
EPHHIRAIA

SEQ ID NO: 979918 - protein, 9 aa, Homo Sapiens
PPESKSPGE

SEQ ID NO: 979919 - protein, 9 aa, Homo Sapiens
NHFRKETTQ

SEQ ID NO: 979920 - protein, 9 aa, Homo Sapiens
IIRTILKIS

SEQ ID NO: 979921 - protein, 9 aa, Homo Sapiens
KKSTEQELM

SEQ ID NO: 979922 - protein, 9 aa, Homo Sapiens
QYLQYYGSS

SEQ ID NO: 979923 - protein, 9 aa, Homo Sapiens
SRPLKLQIT

SEQ ID NO: 979924 - protein, 9 aa, Homo Sapiens
WCALSHHKR

SEQ ID NO: 979925 - protein, 9 aa, Homo Sapiens
VIRLGKTDI

SEQ ID NO: 979926 - protein, 9 aa, Homo Sapiens
GEFLCHNHV

SEQ ID NO: 979927 - protein, 9 aa, Homo Sapiens
FCYCGEKSF

SEQ ID NO: 979928 - protein, 9 aa, Homo Sapiens
YNPFSQVST

SEQ ID NO: 979929 - protein, 9 aa, Homo Sapiens
GNKFVTKGQ

SEQ ID NO: 979930 - protein, 9 aa, Homo Sapiens
LSTSVLNNE

SEQ ID NO: 979931 - protein, 9 aa, Homo Sapiens
VRMVIGFKF

SEQ ID NO: 979932 - protein, 9 aa, Homo Sapiens
INWLCLDFL

SEQ ID NO: 979933 - protein, 9 aa, Homo Sapiens
SPSRSGTAL

SEQ ID NO: 979934 - protein, 9 aa, Homo Sapiens
TQSPLVYTA

SEQ ID NO: 979935 - protein, 9 aa, Homo Sapiens
FSSKLATGV

SEQ ID NO: 979936 - protein, 9 aa, Homo Sapiens
ERLAQIRQG

SEQ ID NO: 979937 - protein, 9 aa, Homo Sapiens
SSMSQRKKA

SEQ ID NO: 979938 - protein, 9 aa, Homo Sapiens
MFFRLSGGS

SEQ ID NO: 979939 - protein, 9 aa, Homo Sapiens
VPSETYQQG

SEQ ID NO: 979940 - protein, 9 aa, Homo Sapiens
LYVVSIFVL

SEQ ID NO: 979941 - protein, 9 aa, Homo Sapiens
VGLTAPEKD

SEQ ID NO: 979942 - protein, 9 aa, Homo Sapiens
LKERSDRKY

SEQ ID NO: 979943 - protein, 9 aa, Homo Sapiens
QMSYQDIRL

SEQ ID NO: 979944 - protein, 9 aa, Homo Sapiens
EKNIEQLHE

SEQ ID NO: 979945 - protein, 9 aa, Homo Sapiens
MGIVNASEI

SEQ ID NO: 979946 - protein, 9 aa, Homo Sapiens
FIVMQRRKN

SEQ ID NO: 979947 - protein, 9 aa, Homo Sapiens
GALGIANLL

SEQ ID NO: 979948 - protein, 9 aa, Homo Sapiens
DNMNNCFLI

SEQ ID NO: 979949 - protein, 9 aa, Homo Sapiens
PTSIRKRVK

SEQ ID NO: 979950 - protein, 9 aa, Homo Sapiens
CINTLLQPD

SEQ ID NO: 979951 - protein, 9 aa, Homo Sapiens
RNYLENILQ

SEQ ID NO: 979952 - protein, 9 aa, Homo Sapiens
TVKPRVIQA

SEQ ID NO: 979953 - protein, 9 aa, Homo Sapiens
VDEPAMKRT

SEQ ID NO: 979954 - protein, 9 aa, Homo Sapiens
SSFSSRKMF

SEQ ID NO: 979955 - protein, 9 aa, Homo Sapiens
CYDGKFPTI

SEQ ID NO: 979956 - protein, 9 aa, Homo Sapiens
GNFLKACEL

SEQ ID NO: 979957 - protein, 9 aa, Homo Sapiens
NDETLAKLI

SEQ ID NO: 979958 - protein, 9 aa, Homo Sapiens
EKSFLGQGD

SEQ ID NO: 979959 - protein, 9 aa, Homo Sapiens
NKGFFQSAI

SEQ ID NO: 979960 - protein, 9 aa, Homo Sapiens
EGHVCVSAS

SEQ ID NO: 979961 - protein, 9 aa, Homo Sapiens
LGARASGFL

SEQ ID NO: 979962 - protein, 9 aa, Homo Sapiens
DKFTLSEQV

SEQ ID NO: 979963 - protein, 9 aa, Homo Sapiens
PEDRILLCR

SEQ ID NO: 979964 - protein, 9 aa, Homo Sapiens
KNHLNDETL

SEQ ID NO: 979965 - protein, 9 aa, Homo Sapiens
STLPGWPES

SEQ ID NO: 979966 - protein, 9 aa, Homo Sapiens
QIYLSGFLS

SEQ ID NO: 979967 - protein, 9 aa, Homo Sapiens
RAASILVSE

SEQ ID NO: 979968 - protein, 9 aa, Homo Sapiens
SSISFFQCV

SEQ ID NO: 979969 - protein, 9 aa, Homo Sapiens
SQSSGCSQH

SEQ ID NO: 979970 - protein, 9 aa, Homo Sapiens
IECATHSTG

SEQ ID NO: 979971 - protein, 9 aa, Homo Sapiens
SSTGPVPAT

SEQ ID NO: 979972 - protein, 9 aa, Homo Sapiens
VNAILGVSL

SEQ ID NO: 979973 - protein, 9 aa, Homo Sapiens
KYLYLPSTL

SEQ ID NO: 979974 - protein, 9 aa, Homo Sapiens
GTERLAQIR

SEQ ID NO: 979975 - protein, 9 aa, Homo Sapiens
YYQGAQACV

SEQ ID NO: 979976 - protein, 9 aa, Homo Sapiens
IRSRNKARY

SEQ ID NO: 979977 - protein, 9 aa, Homo Sapiens
YYDASKRDR

SEQ ID NO: 979978 - protein, 9 aa, Homo Sapiens
ATGPDPLRA

SEQ ID NO: 979979 - protein, 9 aa, Homo Sapiens
LSTVVAHEV

SEQ ID NO: 979980 - protein, 9 aa, Homo Sapiens
EFSKTSKKH

SEQ ID NO: 979981 - protein, 9 aa, Homo Sapiens
WQLEKECAN

SEQ ID NO: 979982 - protein, 9 aa, Homo Sapiens
TVFSPEETT

SEQ ID NO: 979983 - protein, 9 aa, Homo Sapiens
RHGSVRLCG

SEQ ID NO: 979984 - protein, 9 aa, Homo Sapiens
PEEELNEDG

SEQ ID NO: 979985 - protein, 9 aa, Homo Sapiens
RLFDDNETG

SEQ ID NO: 979986 - protein, 9 aa, Homo Sapiens
AKIDAALPL

SEQ ID NO: 979987 - protein, 9 aa, Homo Sapiens
LVKKKGFQE

SEQ ID NO: 979988 - protein, 9 aa, Homo Sapiens
IYFCIYHTF

SEQ ID NO: 979989 - protein, 9 aa, Homo Sapiens
QSQYLQYYG

SEQ ID NO: 979990 - protein, 9 aa, Homo Sapiens
EKAEIYFKI

SEQ ID NO: 979991 - protein, 9 aa, Homo Sapiens
RSSGFGEQG

SEQ ID NO: 979992 - protein, 9 aa, Homo Sapiens
EKECANEPS

SEQ ID NO: 979993 - protein, 9 aa, Homo Sapiens
LVVASAGVT

SEQ ID NO: 979994 - protein, 9 aa, Homo Sapiens
DASKRDRKE

SEQ ID NO: 979995 - protein, 9 aa, Homo Sapiens
CSEVDRSNF

SEQ ID NO: 979996 - protein, 9 aa, Homo Sapiens
ERVELAPLL

SEQ ID NO: 979997 - protein, 9 aa, Homo Sapiens
SQVSTGEVF

SEQ ID NO: 979998 - protein, 9 aa, Homo Sapiens
RIELVVASA

SEQ ID NO: 979999 - protein, 9 aa, Homo Sapiens
DILDTAGRE

SEQ ID NO: 980000 - protein, 9 aa, Homo Sapiens
ARASGFLRK

SEQ ID NO: 980001 - protein, 9 aa, Homo Sapiens
RYIVNPVNN

SEQ ID NO: 980002 - protein, 9 aa, Homo Sapiens
HWEVCPQRF

SEQ ID NO: 980003 - protein, 9 aa, Homo Sapiens
PVNNTVVLS

SEQ ID NO: 980004 - protein, 9 aa, Homo Sapiens
LPQLCLDQK

SEQ ID NO: 980005 - protein, 9 aa, Homo Sapiens
VVHSFRLSQ

SEQ ID NO: 980006 - protein, 9 aa, Homo Sapiens
PSQHMVFRP

SEQ ID NO: 980007 - protein, 9 aa, Homo Sapiens
NHVTCVSQS

SEQ ID NO: 980008 - protein, 9 aa, Homo Sapiens
YDASKRDRK

SEQ ID NO: 980009 - protein, 9 aa, Homo Sapiens
VLASSESEN

SEQ ID NO: 980010 - protein, 9 aa, Homo Sapiens
ENVTASKSD

SEQ ID NO: 980011 - protein, 9 aa, Homo Sapiens
TDSKYYCNC

SEQ ID NO: 980012 - protein, 9 aa, Homo Sapiens
FTLLDDYVY

SEQ ID NO: 980013 - protein, 9 aa, Homo Sapiens
KHTEIQAAS

SEQ ID NO: 980014 - protein, 9 aa, Homo Sapiens
PPGRLDYSM

SEQ ID NO: 980015 - protein, 9 aa, Homo Sapiens
SLGESEHLL

SEQ ID NO: 980016 - protein, 9 aa, Homo Sapiens
FCRRPASST

SEQ ID NO: 980017 - protein, 9 aa, Homo Sapiens
PHTVSPACP

SEQ ID NO: 980018 - protein, 9 aa, Homo Sapiens
PKPHKKPPS

SEQ ID NO: 980019 - protein, 9 aa, Homo Sapiens
WNHRDAGAP

SEQ ID NO: 980020 - protein, 9 aa, Homo Sapiens
NETGKISFK

SEQ ID NO: 980021 - protein, 9 aa, Homo Sapiens
RFDRINWLC

SEQ ID NO: 980022 - protein, 9 aa, Homo Sapiens
EDQKCYCEQ

SEQ ID NO: 980023 - protein, 9 aa, Homo Sapiens
PFSPEPITQ

SEQ ID NO: 980024 - protein, 9 aa, Homo Sapiens
TKQDSFNTL

SEQ ID NO: 980025 - protein, 9 aa, Homo Sapiens
CEASEACVN

SEQ ID NO: 980026 - protein, 9 aa, Homo Sapiens
FQASRSNAG

SEQ ID NO: 980027 - protein, 9 aa, Homo Sapiens
PTLASLASS

SEQ ID NO: 980028 - protein, 9 aa, Homo Sapiens
LQWGTIVQE

SEQ ID NO: 980029 - protein, 9 aa, Homo Sapiens
CHSWEKMAV

SEQ ID NO: 980030 - protein, 9 aa, Homo Sapiens
EVRLDLSDA

SEQ ID NO: 980031 - protein, 9 aa, Homo Sapiens
EKGDCVPKA

SEQ ID NO: 980032 - protein, 9 aa, Homo Sapiens
AGGNAKFKS

SEQ ID NO: 980033 - protein, 9 aa, Homo Sapiens
GFQECFPAI

SEQ ID NO: 980034 - protein, 9 aa, Homo Sapiens
YKTLINFKS

SEQ ID NO: 980035 - protein, 9 aa, Homo Sapiens
ELNEDGEEI

SEQ ID NO: 980036 - protein, 9 aa, Homo Sapiens
YELPLEKKK

SEQ ID NO: 980037 - protein, 9 aa, Homo Sapiens
SLGGLNFSW

SEQ ID NO: 980038 - protein, 9 aa, Homo Sapiens
FDGLSGLPG

SEQ ID NO: 980039 - protein, 9 aa, Homo Sapiens
IHVKDYNSP

SEQ ID NO: 980040 - protein, 9 aa, Homo Sapiens
RDVTLEIFR

SEQ ID NO: 980041 - protein, 9 aa, Homo Sapiens
SQAFLTPVA

SEQ ID NO: 980042 - protein, 9 aa, Homo Sapiens
LVPGKVANL

SEQ ID NO: 980043 - protein, 9 aa, Homo Sapiens
YLEKNVATH

SEQ ID NO: 980044 - protein, 9 aa, Homo Sapiens
TAGKYLSDF

SEQ ID NO: 980045 - protein, 9 aa, Homo Sapiens
VIPMTGEVR

SEQ ID NO: 980046 - protein, 9 aa, Homo Sapiens
KRPARENCR

SEQ ID NO: 980047 - protein, 9 aa, Homo Sapiens
LLTCLSIDQ

SEQ ID NO: 980048 - protein, 9 aa, Homo Sapiens
FEELQRERG

SEQ ID NO: 980049 - protein, 9 aa, Homo Sapiens
FDTNSTNIA

SEQ ID NO: 980050 - protein, 9 aa, Homo Sapiens
SINQAKDSI

SEQ ID NO: 980051 - protein, 9 aa, Homo Sapiens
CRYPSMARI

SEQ ID NO: 980052 - protein, 9 aa, Homo Sapiens
MYANTNQYH

SEQ ID NO: 980053 - protein, 9 aa, Homo Sapiens
ELARKCTKL

SEQ ID NO: 980054 - protein, 9 aa, Homo Sapiens
HTRLEECCE

SEQ ID NO: 980055 - protein, 9 aa, Homo Sapiens
ERFQITKIN

SEQ ID NO: 980056 - protein, 9 aa, Homo Sapiens
LLTTNSDHI

SEQ ID NO: 980057 - protein, 9 aa, Homo Sapiens
SHTFCRNYL

SEQ ID NO: 980058 - protein, 9 aa, Homo Sapiens
GTVCNDDFS

SEQ ID NO: 980059 - protein, 9 aa, Homo Sapiens
HLIQLGLSR

SEQ ID NO: 980060 - protein, 9 aa, Homo Sapiens
PSATLSEET

SEQ ID NO: 980061 - protein, 9 aa, Homo Sapiens
QKVLSGHSL

SEQ ID NO: 980062 - protein, 9 aa, Homo Sapiens
LFEKKLAGQ

SEQ ID NO: 980063 - protein, 9 aa, Homo Sapiens
QGDVSISIK

SEQ ID NO: 980064 - protein, 9 aa, Homo Sapiens
ARKCTKLIS

SEQ ID NO: 980065 - protein, 9 aa, Homo Sapiens
NSVPTTASF

SEQ ID NO: 980066 - protein, 9 aa, Homo Sapiens
KERTRMHGL

SEQ ID NO: 980067 - protein, 9 aa, Homo Sapiens
DSPFSTGSA

SEQ ID NO: 980068 - protein, 9 aa, Homo Sapiens
LLPTSIIIT

SEQ ID NO: 980069 - protein, 9 aa, Homo Sapiens
PTNPETSEM

SEQ ID NO: 980070 - protein, 9 aa, Homo Sapiens
LEDKNSFLR

SEQ ID NO: 980071 - protein, 9 aa, Homo Sapiens
DFKQQKLKQ

SEQ ID NO: 980072 - protein, 9 aa, Homo Sapiens
NECGKIFKQ

SEQ ID NO: 980073 - protein, 9 aa, Homo Sapiens
DSKEKVRWR

SEQ ID NO: 980074 - protein, 9 aa, Homo Sapiens
KASCCLEDT

SEQ ID NO: 980075 - protein, 9 aa, Homo Sapiens
FGDSKEKVR

SEQ ID NO: 980076 - protein, 9 aa, Homo Sapiens
ELQRERGLG

SEQ ID NO: 980077 - protein, 9 aa, Homo Sapiens
VPRLHRDEE

SEQ ID NO: 980078 - protein, 9 aa, Homo Sapiens
DVKSVDNNE

SEQ ID NO: 980079 - protein, 9 aa, Homo Sapiens
PLRKRCKRK

SEQ ID NO: 980080 - protein, 9 aa, Homo Sapiens
TRLTTTEAQ

SEQ ID NO: 980081 - protein, 9 aa, Homo Sapiens
SSSSAASIR

SEQ ID NO: 980082 - protein, 9 aa, Homo Sapiens
PTPSEQDKE

SEQ ID NO: 980083 - protein, 9 aa, Homo Sapiens
STEVLENID

SEQ ID NO: 980084 - protein, 9 aa, Homo Sapiens
YAIWKYLYL

SEQ ID NO: 980085 - protein, 9 aa, Homo Sapiens
KAFRLFDDN

SEQ ID NO: 980086 - protein, 9 aa, Homo Sapiens
AKRQKSSYN

SEQ ID NO: 980087 - protein, 9 aa, Homo Sapiens
YLDRSFQAD

SEQ ID NO: 980088 - protein, 9 aa, Homo Sapiens
IQKNHLNDE

SEQ ID NO: 980089 - protein, 9 aa, Homo Sapiens
LEEVTNKSG

SEQ ID NO: 980090 - protein, 9 aa, Homo Sapiens
AFAKVICNF

SEQ ID NO: 980091 - protein, 9 aa, Homo Sapiens
HKRLKCDEW

SEQ ID NO: 980092 - protein, 9 aa, Homo Sapiens
EAQTTRLTT

SEQ ID NO: 980093 - protein, 9 aa, Homo Sapiens
SPRSSSKPQ

SEQ ID NO: 980094 - protein, 9 aa, Homo Sapiens
QKSSISFFQ

SEQ ID NO: 980095 - protein, 9 aa, Homo Sapiens
FKSLFKNCD

SEQ ID NO: 980096 - protein, 9 aa, Homo Sapiens
QSRKMGDSP

SEQ ID NO: 980097 - protein, 9 aa, Homo Sapiens
QQRFGRLVE

SEQ ID NO: 980098 - protein, 9 aa, Homo Sapiens
YQGQTKDMK

SEQ ID NO: 980099 - protein, 9 aa, Homo Sapiens
FDVKNLENF

SEQ ID NO: 980100 - protein, 9 aa, Homo Sapiens
DGATKALNY

SEQ ID NO: 980101 - protein, 9 aa, Homo Sapiens
RLEEVTNKS

SEQ ID NO: 980102 - protein, 9 aa, Homo Sapiens
IFCRGISGG

SEQ ID NO: 980103 - protein, 9 aa, Homo Sapiens
LRSIFPEGG

SEQ ID NO: 980104 - protein, 9 aa, Homo Sapiens
NGFVHVSSQ

SEQ ID NO: 980105 - protein, 9 aa, Homo Sapiens
DPRIPGRML

SEQ ID NO: 980106 - protein, 9 aa, Homo Sapiens
FSFDVKNLE

SEQ ID NO: 980107 - protein, 9 aa, Homo Sapiens
TLASLASST

SEQ ID NO: 980108 - protein, 9 aa, Homo Sapiens
MICNIISLK

SEQ ID NO: 980109 - protein, 9 aa, Homo Sapiens
FPTDSSTGV

SEQ ID NO: 980110 - protein, 9 aa, Homo Sapiens
SMFLSVREN

SEQ ID NO: 980111 - protein, 9 aa, Homo Sapiens
NPKYHLHSF

SEQ ID NO: 980112 - protein, 9 aa, Homo Sapiens
GPASELHTR

SEQ ID NO: 980113 - protein, 9 aa, Homo Sapiens
SDAPSLQNC

SEQ ID NO: 980114 - protein, 9 aa, Homo Sapiens
SFLLKERAG

SEQ ID NO: 980115 - protein, 9 aa, Homo Sapiens
DGMGVSTMT

SEQ ID NO: 980116 - protein, 9 aa, Homo Sapiens
GDGMGVSTM

SEQ ID NO: 980117 - protein, 9 aa, Homo Sapiens
MENGIILGL

SEQ ID NO: 980118 - protein, 9 aa, Homo Sapiens
SVSLSHSGL

SEQ ID NO: 980119 - protein, 9 aa, Homo Sapiens
NNEFEELQR

SEQ ID NO: 980120 - protein, 9 aa, Homo Sapiens
IQEVLKKMT

SEQ ID NO: 980121 - protein, 9 aa, Homo Sapiens
PQLCLDQKV

SEQ ID NO: 980122 - protein, 9 aa, Homo Sapiens
RLLPVVRAL

SEQ ID NO: 980123 - protein, 9 aa, Homo Sapiens
LYRLISVVS

SEQ ID NO: 980124 - protein, 9 aa, Homo Sapiens
SRMRTQSPL

SEQ ID NO: 980125 - protein, 9 aa, Homo Sapiens
RESCEEVDC

SEQ ID NO: 980126 - protein, 9 aa, Homo Sapiens
RSHNEVLRV

SEQ ID NO: 980127 - protein, 9 aa, Homo Sapiens
QKIINCEQS

SEQ ID NO: 980128 - protein, 9 aa, Homo Sapiens
LSGFLSKCD

SEQ ID NO: 980129 - protein, 9 aa, Homo Sapiens
EFLCHNHVT

SEQ ID NO: 980130 - protein, 9 aa, Homo Sapiens
KITALAPST

SEQ ID NO: 980131 - protein, 9 aa, Homo Sapiens
VDEDYYLTE

SEQ ID NO: 980132 - protein, 9 aa, Homo Sapiens
PVLEEWTPD

SEQ ID NO: 980133 - protein, 9 aa, Homo Sapiens
RSSSKPQVS

SEQ ID NO: 980134 - protein, 9 aa, Homo Sapiens
PKHKEDLLG

SEQ ID NO: 980135 - protein, 9 aa, Homo Sapiens
ILAMPKDEA

SEQ ID NO: 980136 - protein, 9 aa, Homo Sapiens
RVVSQELEE

SEQ ID NO: 980137 - protein, 9 aa, Homo Sapiens
PIFSYNVVF

SEQ ID NO: 980138 - protein, 9 aa, Homo Sapiens
WLARPLPPP

SEQ ID NO: 980139 - protein, 9 aa, Homo Sapiens
CNFFTICNA

SEQ ID NO: 980140 - protein, 9 aa, Homo Sapiens
FSSSSSSAS

SEQ ID NO: 980141 - protein, 9 aa, Homo Sapiens
ASKSDAEVE

SEQ ID NO: 980142 - protein, 9 aa, Homo Sapiens
KLCPEFSKT

SEQ ID NO: 980143 - protein, 9 aa, Homo Sapiens
PIFPVSVGR

SEQ ID NO: 980144 - protein, 9 aa, Homo Sapiens
KELYSMIEE

SEQ ID NO: 980145 - protein, 9 aa, Homo Sapiens
AEKTPEPDP

SEQ ID NO: 980146 - protein, 9 aa, Homo Sapiens
MHVNNGVKY

SEQ ID NO: 980147 - protein, 9 aa, Homo Sapiens
RSPRRAQAS

SEQ ID NO: 980148 - protein, 9 aa, Homo Sapiens
YSMCIIPWP

SEQ ID NO: 980149 - protein, 9 aa, Homo Sapiens
ELMQMLIQI

SEQ ID NO: 980150 - protein, 9 aa, Homo Sapiens
QQMYANTNQ

SEQ ID NO: 980151 - protein, 9 aa, Homo Sapiens
VQKFLRNGD

SEQ ID NO: 980152 - protein, 9 aa, Homo Sapiens
CNECGKIFK

SEQ ID NO: 980153 - protein, 9 aa, Homo Sapiens
YLTGEQTKK

SEQ ID NO: 980154 - protein, 9 aa, Homo Sapiens
DENIRKWFK

SEQ ID NO: 980155 - protein, 9 aa, Homo Sapiens
LKPGSERKR

SEQ ID NO: 980156 - protein, 9 aa, Homo Sapiens
AKERTRMHG

SEQ ID NO: 980157 - protein, 9 aa, Homo Sapiens
KNQPAQKNS

SEQ ID NO: 980158 - protein, 9 aa, Homo Sapiens
NAKERTRMH

SEQ ID NO: 980159 - protein, 9 aa, Homo Sapiens
AGRVEIYYE

SEQ ID NO: 980160 - protein, 9 aa, Homo Sapiens
ASIRSRNKA

SEQ ID NO: 980161 - protein, 9 aa, Homo Sapiens
DVNDNASQL

SEQ ID NO: 980162 - protein, 9 aa, Homo Sapiens
PPPLLKTPR

SEQ ID NO: 980163 - protein, 9 aa, Homo Sapiens
HRDLRAASI

SEQ ID NO: 980164 - protein, 9 aa, Homo Sapiens
SKCKEIWEE

SEQ ID NO: 980165 - protein, 9 aa, Homo Sapiens
QAWLCELLR

SEQ ID NO: 980166 - protein, 9 aa, Homo Sapiens
LEGFSQYPR

SEQ ID NO: 980167 - protein, 9 aa, Homo Sapiens
MAHCEFSLL

SEQ ID NO: 980168 - protein, 9 aa, Homo Sapiens
FSVTAVAKT

SEQ ID NO: 980169 - protein, 9 aa, Homo Sapiens
VKKKGFQEC

SEQ ID NO: 980170 - protein, 9 aa, Homo Sapiens
FCIPKPHKK

SEQ ID NO: 980171 - protein, 9 aa, Homo Sapiens
QSVAQPVRP

SEQ ID NO: 980172 - protein, 9 aa, Homo Sapiens
MGGTSDSYV

SEQ ID NO: 980173 - protein, 9 aa, Homo Sapiens
IVNASEIIQ

SEQ ID NO: 980174 - protein, 9 aa, Homo Sapiens
TPEYNVIIT

SEQ ID NO: 980175 - protein, 9 aa, Homo Sapiens
GDVSISIKC

SEQ ID NO: 980176 - protein, 9 aa, Homo Sapiens
HRFWIYFCI

SEQ ID NO: 980177 - protein, 9 aa, Homo Sapiens
LKFLVLFSF

SEQ ID NO: 980178 - protein, 9 aa, Homo Sapiens
CGKESKLLS

SEQ ID NO: 980179 - protein, 9 aa, Homo Sapiens
VFFGGNFSS

SEQ ID NO: 980180 - protein, 9 aa, Homo Sapiens
KWCALSHHK

SEQ ID NO: 980181 - protein, 9 aa, Homo Sapiens
KRHLFEKKL

SEQ ID NO: 980182 - protein, 9 aa, Homo Sapiens
WNKSRDFCK

SEQ ID NO: 980183 - protein, 9 aa, Homo Sapiens
YQPLANCQA

SEQ ID NO: 980184 - protein, 9 aa, Homo Sapiens
KSLPSPELQ

SEQ ID NO: 980185 - protein, 9 aa, Homo Sapiens
SYVKVFLLP

SEQ ID NO: 980186 - protein, 9 aa, Homo Sapiens
PDIPSEPPP

SEQ ID NO: 980187 - protein, 9 aa, Homo Sapiens
VKEKLWYNE

SEQ ID NO: 980188 - protein, 9 aa, Homo Sapiens
QFCIPKPHK

SEQ ID NO: 980189 - protein, 9 aa, Homo Sapiens
SENLSKSGV

SEQ ID NO: 980190 - protein, 9 aa, Homo Sapiens
NCFLILKFR

SEQ ID NO: 980191 - protein, 9 aa, Homo Sapiens
SRFKSRSRT

SEQ ID NO: 980192 - protein, 9 aa, Homo Sapiens
WAEKTPEPD

SEQ ID NO: 980193 - protein, 9 aa, Homo Sapiens
FSSRKMFCQ

SEQ ID NO: 980194 - protein, 9 aa, Homo Sapiens
ESPHFTPLL

SEQ ID NO: 980195 - protein, 9 aa, Homo Sapiens
LKDTVEEVR

SEQ ID NO: 980196 - protein, 9 aa, Homo Sapiens
KMRVTEYLV

SEQ ID NO: 980197 - protein, 9 aa, Homo Sapiens
KRCKRKKKE

SEQ ID NO: 980198 - protein, 9 aa, Homo Sapiens
FLCHNHVTC

SEQ ID NO: 980199 - protein, 9 aa, Homo Sapiens
NKNGNFIIS

SEQ ID NO: 980200 - protein, 9 aa, Homo Sapiens
LYSFEDNAN

SEQ ID NO: 980201 - protein, 9 aa, Homo Sapiens
HQPLDKKRE

SEQ ID NO: 980202 - protein, 9 aa, Homo Sapiens
KTQNILLDT

SEQ ID NO: 980203 - protein, 9 aa, Homo Sapiens
EDAMNEGLE

SEQ ID NO: 980204 - protein, 9 aa, Homo Sapiens
AESGPGLAL

SEQ ID NO: 980205 - protein, 9 aa, Homo Sapiens
DVTLEIFRN

SEQ ID NO: 980206 - protein, 9 aa, Homo Sapiens
CTDSKYYCN

SEQ ID NO: 980207 - protein, 9 aa, Homo Sapiens
FSLSTMGAN

SEQ ID NO: 980208 - protein, 9 aa, Homo Sapiens
RFPKDLAQQ

SEQ ID NO: 980209 - protein, 9 aa, Homo Sapiens
KRFPKDLAQ

SEQ ID NO: 980210 - protein, 9 aa, Homo Sapiens
RPITDGRAT

SEQ ID NO: 980211 - protein, 9 aa, Homo Sapiens
SWIVNCINT

SEQ ID NO: 980212 - protein, 9 aa, Homo Sapiens
LRFFIVSSM

SEQ ID NO: 980213 - protein, 9 aa, Homo Sapiens
TEFVLTEFL

SEQ ID NO: 980214 - protein, 9 aa, Homo Sapiens
ASSESENNV

SEQ ID NO: 980215 - protein, 9 aa, Homo Sapiens
SVGLFFLLN

SEQ ID NO: 980216 - protein, 9 aa, Homo Sapiens
DQGHARRCW

SEQ ID NO: 980217 - protein, 9 aa, Homo Sapiens
PGKVANLAI

SEQ ID NO: 980218 - protein, 9 aa, Homo Sapiens
RNIVPEALF

SEQ ID NO: 980219 - protein, 9 aa, Homo Sapiens
IAGKILWAC

SEQ ID NO: 980220 - protein, 9 aa, Homo Sapiens
QVYNDISHE

SEQ ID NO: 980221 - protein, 9 aa, Homo Sapiens
WEKMAVSEP

SEQ ID NO: 980222 - protein, 9 aa, Homo Sapiens
PLFPHTRTI

SEQ ID NO: 980223 - protein, 9 aa, Homo Sapiens
RGFEIFQGR

SEQ ID NO: 980224 - protein, 9 aa, Homo Sapiens
IKIFWEVFY

SEQ ID NO: 980225 - protein, 9 aa, Homo Sapiens
YDQKFLMEC

SEQ ID NO: 980226 - protein, 9 aa, Homo Sapiens
THLQKQIVD

SEQ ID NO: 980227 - protein, 9 aa, Homo Sapiens
LLTEFVLTE

SEQ ID NO: 980228 - protein, 9 aa, Homo Sapiens
GEYQGIPSI

SEQ ID NO: 980229 - protein, 9 aa, Homo Sapiens
LEIFRNLAS

SEQ ID NO: 980230 - protein, 9 aa, Homo Sapiens
TKKMWQRLK

SEQ ID NO: 980231 - protein, 9 aa, Homo Sapiens
LTCLSIDQY

SEQ ID NO: 980232 - protein, 9 aa, Homo Sapiens
FNIKDKNLF

SEQ ID NO: 980233 - protein, 9 aa, Homo Sapiens
APPLSASNY

SEQ ID NO: 980234 - protein, 9 aa, Homo Sapiens
PRLEVVLFV

SEQ ID NO: 980235 - protein, 9 aa, Homo Sapiens
DFCSPRSLA

SEQ ID NO: 980236 - protein, 9 aa, Homo Sapiens
KNAKDAEEM

SEQ ID NO: 980237 - protein, 9 aa, Homo Sapiens
SENNVEEAS

SEQ ID NO: 980238 - protein, 9 aa, Homo Sapiens
ENTDNSSPL

SEQ ID NO: 980239 - protein, 9 aa, Homo Sapiens
CVPPTACSC

SEQ ID NO: 980240 - protein, 9 aa, Homo Sapiens
PSVIVAWNH

SEQ ID NO: 980241 - protein, 9 aa, Homo Sapiens
FLVCLAICI

SEQ ID NO: 980242 - protein, 9 aa, Homo Sapiens
ERCEWLLRE

SEQ ID NO: 980243 - protein, 9 aa, Homo Sapiens
SQFPQLNEW

SEQ ID NO: 980244 - protein, 9 aa, Homo Sapiens
PPLSASNYP

SEQ ID NO: 980245 - protein, 9 aa, Homo Sapiens
WTMNGLMLS

SEQ ID NO: 980246 - protein, 9 aa, Homo Sapiens
MYADLNQND

SEQ ID NO: 980247 - protein, 9 aa, Homo Sapiens
REPRGGRPF

SEQ ID NO: 980248 - protein, 9 aa, Homo Sapiens
NEFNISFIK

SEQ ID NO: 980249 - protein, 9 aa, Homo Sapiens
GVASRLVEM

SEQ ID NO: 980250 - protein, 9 aa, Homo Sapiens
PIQEVLKKM

SEQ ID NO: 980251 - protein, 9 aa, Homo Sapiens
LMEGYFMNV

SEQ ID NO: 980252 - protein, 9 aa, Homo Sapiens
CIKNAKDAE

SEQ ID NO: 980253 - protein, 9 aa, Homo Sapiens
VEKKPVKID

SEQ ID NO: 980254 - protein, 9 aa, Homo Sapiens
GIKKPYNLI

SEQ ID NO: 980255 - protein, 9 aa, Homo Sapiens
ITFLQRVKN

SEQ ID NO: 980256 - protein, 9 aa, Homo Sapiens
AGKYLSDFC

SEQ ID NO: 980257 - protein, 9 aa, Homo Sapiens
YCEQLKVKF

SEQ ID NO: 980258 - protein, 9 aa, Homo Sapiens
ILVNAGCPG

SEQ ID NO: 980259 - protein, 9 aa, Homo Sapiens
GNKGFFQSA

SEQ ID NO: 980260 - protein, 9 aa, Homo Sapiens
LCIFVYMRP

SEQ ID NO: 980261 - protein, 9 aa, Homo Sapiens
DVGMKSIAF

SEQ ID NO: 980262 - protein, 9 aa, Homo Sapiens
WEHKMVMID

SEQ ID NO: 980263 - protein, 9 aa, Homo Sapiens
AALEDKNSF

SEQ ID NO: 980264 - protein, 9 aa, Homo Sapiens
LRCPFCTCS

SEQ ID NO: 980265 - protein, 9 aa, Homo Sapiens
GGTSDSYVK

SEQ ID NO: 980266 - protein, 9 aa, Homo Sapiens
PGKKGKEGK

SEQ ID NO: 980267 - protein, 9 aa, Homo Sapiens
LSEQVEGVV

SEQ ID NO: 980268 - protein, 9 aa, Homo Sapiens
NYVYDVMWS

SEQ ID NO: 980269 - protein, 9 aa, Homo Sapiens
PGLALIAYP

SEQ ID NO: 980270 - protein, 9 aa, Homo Sapiens
SPQGIVHGT

SEQ ID NO: 980271 - protein, 9 aa, Homo Sapiens
AASIRSRNK

SEQ ID NO: 980272 - protein, 9 aa, Homo Sapiens
TKQKSSISF

SEQ ID NO: 980273 - protein, 9 aa, Homo Sapiens
LRLKDKFFE

SEQ ID NO: 980274 - protein, 9 aa, Homo Sapiens
KLQITVTRH

SEQ ID NO: 980275 - protein, 9 aa, Homo Sapiens
DYFFTQVYN

SEQ ID NO: 980276 - protein, 9 aa, Homo Sapiens
DHITFLQRV

SEQ ID NO: 980277 - protein, 9 aa, Homo Sapiens
ASRALYSLD

SEQ ID NO: 980278 - protein, 9 aa, Homo Sapiens
MYPMPNILE

SEQ ID NO: 980279 - protein, 9 aa, Homo Sapiens
CHGGPGPGG

SEQ ID NO: 980280 - protein, 9 aa, Homo Sapiens
IVPHVEKKP

SEQ ID NO: 980281 - protein, 9 aa, Homo Sapiens
SESAPLDFH

SEQ ID NO: 980282 - protein, 9 aa, Homo Sapiens
IATYEPGTT

SEQ ID NO: 980283 - protein, 9 aa, Homo Sapiens
TWVGIVIFL

SEQ ID NO: 980284 - protein, 9 aa, Homo Sapiens
HSFLMFKPG

SEQ ID NO: 980285 - protein, 9 aa, Homo Sapiens
IVNPVNNTV

SEQ ID NO: 980286 - protein, 9 aa, Homo Sapiens
IIIGCHAYG

SEQ ID NO: 980287 - protein, 9 aa, Homo Sapiens
RLEVVLFVF

SEQ ID NO: 980288 - protein, 9 aa, Homo Sapiens
LPTTELSSK

SEQ ID NO: 980289 - protein, 9 aa, Homo Sapiens
PITDGRATE

SEQ ID NO: 980290 - protein, 9 aa, Homo Sapiens
AVDLNEGTN

SEQ ID NO: 980291 - protein, 9 aa, Homo Sapiens
LDLSDANFV

SEQ ID NO: 980292 - protein, 9 aa, Homo Sapiens
ELYSMIEEY

SEQ ID NO: 980293 - protein, 9 aa, Homo Sapiens
SKRKRNSRV

SEQ ID NO: 980294 - protein, 9 aa, Homo Sapiens
GFTLLDDYV

SEQ ID NO: 980295 - protein, 9 aa, Homo Sapiens
LCLANQFLD

SEQ ID NO: 980296 - protein, 9 aa, Homo Sapiens
VYFKPPFQN

SEQ ID NO: 980297 - protein, 9 aa, Homo Sapiens
GGTRIIYDQ

SEQ ID NO: 980298 - protein, 9 aa, Homo Sapiens
EENFKYQDF

SEQ ID NO: 980299 - protein, 9 aa, Homo Sapiens
FILCIFVYM

SEQ ID NO: 980300 - protein, 9 aa, Homo Sapiens
LRPMKEELP

SEQ ID NO: 980301 - protein, 9 aa, Homo Sapiens
FGGALLNKD

SEQ ID NO: 980302 - protein, 9 aa, Homo Sapiens
FEKKLAGQS

SEQ ID NO: 980303 - protein, 9 aa, Homo Sapiens
QGAQACVLV

SEQ ID NO: 980304 - protein, 9 aa, Homo Sapiens
RGKRLGLDF

SEQ ID NO: 980305 - protein, 9 aa, Homo Sapiens
FGCRQSKIN

SEQ ID NO: 980306 - protein, 9 aa, Homo Sapiens
KNNIKLKER

SEQ ID NO: 980307 - protein, 9 aa, Homo Sapiens
ILWACQLFH

SEQ ID NO: 980308 - protein, 9 aa, Homo Sapiens
WSKCKEIWE

SEQ ID NO: 980309 - protein, 9 aa, Homo Sapiens
NVIITATDR

SEQ ID NO: 980310 - protein, 9 aa, Homo Sapiens
CNDDFSIHA

SEQ ID NO: 980311 - protein, 9 aa, Homo Sapiens
IKLKERSDR

SEQ ID NO: 980312 - protein, 9 aa, Homo Sapiens
ASNAQECGC

SEQ ID NO: 980313 - protein, 9 aa, Homo Sapiens
YQGIPSINQ

SEQ ID NO: 980314 - protein, 9 aa, Homo Sapiens
TRYALKDTV

SEQ ID NO: 980315 - protein, 9 aa, Homo Sapiens
AYYQGAQAC

SEQ ID NO: 980316 - protein, 9 aa, Homo Sapiens
CCGFEPHHI

SEQ ID NO: 980317 - protein, 9 aa, Homo Sapiens
GDQGQTGEK

SEQ ID NO: 980318 - protein, 9 aa, Homo Sapiens
TSRACASHN

SEQ ID NO: 980319 - protein, 9 aa, Homo Sapiens
NVHEKIRAM

SEQ ID NO: 980320 - protein, 9 aa, Homo Sapiens
HLILKPVSA

SEQ ID NO: 980321 - protein, 9 aa, Homo Sapiens
KGFRCQTCG

SEQ ID NO: 980322 - protein, 9 aa, Homo Sapiens
SSGFGEQGG

SEQ ID NO: 980323 - protein, 9 aa, Homo Sapiens
LTTKISFKE

SEQ ID NO: 980324 - protein, 9 aa, Homo Sapiens
SADQMIVSP

SEQ ID NO: 980325 - protein, 9 aa, Homo Sapiens
KEKLFQKPR

SEQ ID NO: 980326 - protein, 9 aa, Homo Sapiens
SSFYPNGGD

SEQ ID NO: 980327 - protein, 9 aa, Homo Sapiens
PVPEVAQPT

SEQ ID NO: 980328 - protein, 9 aa, Homo Sapiens
SDHITFLQR

SEQ ID NO: 980329 - protein, 9 aa, Homo Sapiens
SVTAVAKTQ

SEQ ID NO: 980330 - protein, 9 aa, Homo Sapiens
LVLWKARSL

SEQ ID NO: 980331 - protein, 9 aa, Homo Sapiens
PMPNILEYG

SEQ ID NO: 980332 - protein, 9 aa, Homo Sapiens
NANYVYDVM

SEQ ID NO: 980333 - protein, 9 aa, Homo Sapiens
RACTLTVFS

SEQ ID NO: 980334 - protein, 9 aa, Homo Sapiens
WDRALVPGK

SEQ ID NO: 980335 - protein, 9 aa, Homo Sapiens
RWGPGESAD

SEQ ID NO: 980336 - protein, 9 aa, Homo Sapiens
VPKTVKPRV

SEQ ID NO: 980337 - protein, 9 aa, Homo Sapiens
SQELEEETG

SEQ ID NO: 980338 - protein, 9 aa, Homo Sapiens
NLEDAMNEG

SEQ ID NO: 980339 - protein, 9 aa, Homo Sapiens
ANTNQYHEM

SEQ ID NO: 980340 - protein, 9 aa, Homo Sapiens
NIAIFFRAL

SEQ ID NO: 980341 - protein, 9 aa, Homo Sapiens
RKMGDSPNI

SEQ ID NO: 980342 - protein, 9 aa, Homo Sapiens
TKYRFKYVL

SEQ ID NO: 980343 - protein, 9 aa, Homo Sapiens
ETGNLPHLY

SEQ ID NO: 980344 - protein, 9 aa, Homo Sapiens
VENLVIITV

SEQ ID NO: 980345 - protein, 9 aa, Homo Sapiens
SGCSQHESG

SEQ ID NO: 980346 - protein, 9 aa, Homo Sapiens
SLASSTTLQ

SEQ ID NO: 980347 - protein, 9 aa, Homo Sapiens
NASQLTLTS

SEQ ID NO: 980348 - protein, 9 aa, Homo Sapiens
GQGDVSISI

SEQ ID NO: 980349 - protein, 9 aa, Homo Sapiens
SKSDAEVER

SEQ ID NO: 980350 - protein, 9 aa, Homo Sapiens
LDYSMCIIP

SEQ ID NO: 980351 - protein, 9 aa, Homo Sapiens
LFDDNETGK

SEQ ID NO: 980352 - protein, 9 aa, Homo Sapiens
VAATKSQAW

SEQ ID NO: 980353 - protein, 9 aa, Homo Sapiens
IVVFKIRNH

SEQ ID NO: 980354 - protein, 9 aa, Homo Sapiens
FCIYHTFHS

SEQ ID NO: 980355 - protein, 9 aa, Homo Sapiens
HSEREPGSP

SEQ ID NO: 980356 - protein, 9 aa, Homo Sapiens
MNGLMLSTD

SEQ ID NO: 980357 - protein, 9 aa, Homo Sapiens
VLGMIWSKC

SEQ ID NO: 980358 - protein, 9 aa, Homo Sapiens
GRLDYSMCI

SEQ ID NO: 980359 - protein, 9 aa, Homo Sapiens
MDEKGDCVP

SEQ ID NO: 980360 - protein, 9 aa, Homo Sapiens
WIYFCIYHT

SEQ ID NO: 980361 - protein, 9 aa, Homo Sapiens
GGLPFSSKL

SEQ ID NO: 980362 - protein, 9 aa, Homo Sapiens
ILKISSMSQ

SEQ ID NO: 980363 - protein, 9 aa, Homo Sapiens
GGKRHDSTE

SEQ ID NO: 980364 - protein, 9 aa, Homo Sapiens
QVLTEMDGP

SEQ ID NO: 980365 - protein, 9 aa, Homo Sapiens
KNIVNLLGA

SEQ ID NO: 980366 - protein, 9 aa, Homo Sapiens
VVSIFVLTI

SEQ ID NO: 980367 - protein, 9 aa, Homo Sapiens
SLPLRFFIV

SEQ ID NO: 980368 - protein, 9 aa, Homo Sapiens
VVRMVIGFK

SEQ ID NO: 980369 - protein, 9 aa, Homo Sapiens
QVQKLFQSL

SEQ ID NO: 980370 - protein, 9 aa, Homo Sapiens
PHLYRLISV

SEQ ID NO: 980371 - protein, 9 aa, Homo Sapiens
SSIQPSFCH

SEQ ID NO: 980372 - protein, 9 aa, Homo Sapiens
YSACCGGFC

SEQ ID NO: 980373 - protein, 9 aa, Homo Sapiens
EKKPVKIDP

SEQ ID NO: 980374 - protein, 9 aa, Homo Sapiens
EFSENQTYI

SEQ ID NO: 980375 - protein, 9 aa, Homo Sapiens
PGPRGLLRP

SEQ ID NO: 980376 - protein, 9 aa, Homo Sapiens
VLTEFLYQP

SEQ ID NO: 980377 - protein, 9 aa, Homo Sapiens
VSPKDGSTL

SEQ ID NO: 980378 - protein, 9 aa, Homo Sapiens
LNDETLAKL

SEQ ID NO: 980379 - protein, 9 aa, Homo Sapiens
VHVSSQDSK

SEQ ID NO: 980380 - protein, 9 aa, Homo Sapiens
KIRNHLISR

SEQ ID NO: 980381 - protein, 9 aa, Homo Sapiens
TERLAQIRQ

SEQ ID NO: 980382 - protein, 9 aa, Homo Sapiens
DHRVAQIFC

SEQ ID NO: 980383 - protein, 9 aa, Homo Sapiens
SEMHVNNGV

SEQ ID NO: 980384 - protein, 9 aa, Homo Sapiens
FYSLFQASD

SEQ ID NO: 980385 - protein, 9 aa, Homo Sapiens
MTVANFLFL

SEQ ID NO: 980386 - protein, 9 aa, Homo Sapiens
EVTNKSGYV

SEQ ID NO: 980387 - protein, 9 aa, Homo Sapiens
SSGCSQHES

SEQ ID NO: 980388 - protein, 9 aa, Homo Sapiens
NQCGKESKL

SEQ ID NO: 980389 - protein, 9 aa, Homo Sapiens
LWACQLFHR

SEQ ID NO: 980390 - protein, 9 aa, Homo Sapiens
NKNNIKLKE

SEQ ID NO: 980391 - protein, 9 aa, Homo Sapiens
AHSEREPGS

SEQ ID NO: 980392 - protein, 9 aa, Homo Sapiens
TAGREEYSA

SEQ ID NO: 980393 - protein, 9 aa, Homo Sapiens
TAVAKTQAG

SEQ ID NO: 980394 - protein, 9 aa, Homo Sapiens
PTSVPIFPV

SEQ ID NO: 980395 - protein, 9 aa, Homo Sapiens
HEVQKFLRN

SEQ ID NO: 980396 - protein, 9 aa, Homo Sapiens
HTEIQAASQ

SEQ ID NO: 980397 - protein, 9 aa, Homo Sapiens
ACCGGFCRR

SEQ ID NO: 980398 - protein, 9 aa, Homo Sapiens
PTAERDPRI

SEQ ID NO: 980399 - protein, 9 aa, Homo Sapiens
LDNKLNVKD

SEQ ID NO: 980400 - protein, 9 aa, Homo Sapiens
PEVAQPTHH

SEQ ID NO: 980401 - protein, 9 aa, Homo Sapiens
SQPQLDFQD

SEQ ID NO: 980402 - protein, 9 aa, Homo Sapiens
FLDISFCPA

SEQ ID NO: 980403 - protein, 9 aa, Homo Sapiens
VRENSVPTT

SEQ ID NO: 980404 - protein, 9 aa, Homo Sapiens
TLTTKISFK

SEQ ID NO: 980405 - protein, 9 aa, Homo Sapiens
QKRKRSFKV

SEQ ID NO: 980406 - protein, 9 aa, Homo Sapiens
KKSCFLEGS

SEQ ID NO: 980407 - protein, 9 aa, Homo Sapiens
QDENIRKWF

SEQ ID NO: 980408 - protein, 9 aa, Homo Sapiens
VCSSALESW

SEQ ID NO: 980409 - protein, 9 aa, Homo Sapiens
EIQAASQPQ

SEQ ID NO: 980410 - protein, 9 aa, Homo Sapiens
RSIFPEGGD

SEQ ID NO: 980411 - protein, 9 aa, Homo Sapiens
GVFICSMIF

SEQ ID NO: 980412 - protein, 9 aa, Homo Sapiens
KPTNPETSE

SEQ ID NO: 980413 - protein, 9 aa, Homo Sapiens
GGKEIEKNS

SEQ ID NO: 980414 - protein, 9 aa, Homo Sapiens
HIPPCIHIS

SEQ ID NO: 980415 - protein, 9 aa, Homo Sapiens
KFEDRNCRH

SEQ ID NO: 980416 - protein, 9 aa, Homo Sapiens
TNKSGYVDV

SEQ ID NO: 980417 - protein, 9 aa, Homo Sapiens
KEIEKNSTL

SEQ ID NO: 980418 - protein, 9 aa, Homo Sapiens
KGSLMTKVI

SEQ ID NO: 980419 - protein, 9 aa, Homo Sapiens
APLDFHFPL

SEQ ID NO: 980420 - protein, 9 aa, Homo Sapiens
EDGEGHVCV

SEQ ID NO: 980421 - protein, 9 aa, Homo Sapiens
GKILWACQL

SEQ ID NO: 980422 - protein, 9 aa, Homo Sapiens
LLGSEITHL

SEQ ID NO: 980423 - protein, 9 aa, Homo Sapiens
QYHEMLNNV

SEQ ID NO: 980424 - protein, 9 aa, Homo Sapiens
LTSLATKAW

SEQ ID NO: 980425 - protein, 9 aa, Homo Sapiens
APTKAFQRD

SEQ ID NO: 980426 - protein, 9 aa, Homo Sapiens
MHKFEDRNC

SEQ ID NO: 980427 - protein, 9 aa, Homo Sapiens
LSPTRLAYT

SEQ ID NO: 980428 - protein, 9 aa, Homo Sapiens
LDSPFSTGS

SEQ ID NO: 980429 - protein, 9 aa, Homo Sapiens
GLAWSLGPS

SEQ ID NO: 980430 - protein, 9 aa, Homo Sapiens
KPIIIGCHA

SEQ ID NO: 980431 - protein, 9 aa, Homo Sapiens
ILLDTHRMV

SEQ ID NO: 980432 - protein, 9 aa, Homo Sapiens
VSSQDSKDT

SEQ ID NO: 980433 - protein, 9 aa, Homo Sapiens
LFQKPVPKA

SEQ ID NO: 980434 - protein, 9 aa, Homo Sapiens
ISKDQKSEL

SEQ ID NO: 980435 - protein, 9 aa, Homo Sapiens
DQKCYCEQL

SEQ ID NO: 980436 - protein, 9 aa, Homo Sapiens
KSIAFYNVS

SEQ ID NO: 980437 - protein, 9 aa, Homo Sapiens
DRALVPGKV

SEQ ID NO: 980438 - protein, 9 aa, Homo Sapiens
SLPSATLSE

SEQ ID NO: 980439 - protein, 9 aa, Homo Sapiens
NLILGETFR

SEQ ID NO: 980440 - protein, 9 aa, Homo Sapiens
CINVPLQYG

SEQ ID NO: 980441 - protein, 9 aa, Homo Sapiens
VKVSGPCHE

SEQ ID NO: 980442 - protein, 9 aa, Homo Sapiens
GGNFSSVFH

SEQ ID NO: 980443 - protein, 9 aa, Homo Sapiens
KGFFQSAIK

SEQ ID NO: 980444 - protein, 9 aa, Homo Sapiens
MLGSSEQPG

SEQ ID NO: 980445 - protein, 9 aa, Homo Sapiens
ESGPGLALI

SEQ ID NO: 980446 - protein, 9 aa, Homo Sapiens
VILNVEQAC

SEQ ID NO: 980447 - protein, 9 aa, Homo Sapiens
SGSCEKVLV

SEQ ID NO: 980448 - protein, 9 aa, Homo Sapiens
CRHFGWMCP

SEQ ID NO: 980449 - protein, 9 aa, Homo Sapiens
KSESIHVIL

SEQ ID NO: 980450 - protein, 9 aa, Homo Sapiens
ASVKKSLEK

SEQ ID NO: 980451 - protein, 9 aa, Homo Sapiens
GSFSLSTMG

SEQ ID NO: 980452 - protein, 9 aa, Homo Sapiens
CNFAPTKAF

SEQ ID NO: 980453 - protein, 9 aa, Homo Sapiens
WIKGQNFGD

SEQ ID NO: 980454 - protein, 9 aa, Homo Sapiens
SSTLPGWPE

SEQ ID NO: 980455 - protein, 9 aa, Homo Sapiens
NGGDQETAK

SEQ ID NO: 980456 - protein, 9 aa, Homo Sapiens
TCVPPTACS

SEQ ID NO: 980457 - protein, 9 aa, Homo Sapiens
ESLPSATLS

SEQ ID NO: 980458 - protein, 9 aa, Homo Sapiens
GLMLSTDIK

SEQ ID NO: 980459 - protein, 9 aa, Homo Sapiens
CSSALESWS

SEQ ID NO: 980460 - protein, 9 aa, Homo Sapiens
HFRKETTQP

SEQ ID NO: 980461 - protein, 9 aa, Homo Sapiens
RGGILAMPK

SEQ ID NO: 980462 - protein, 9 aa, Homo Sapiens
NNIKLKERS

SEQ ID NO: 980463 - protein, 9 aa, Homo Sapiens
TGHSSIDSI

SEQ ID NO: 980464 - protein, 9 aa, Homo Sapiens
IKLNASNPD

SEQ ID NO: 980465 - protein, 9 aa, Homo Sapiens
DKSRPLKLQ

SEQ ID NO: 980466 - protein, 9 aa, Homo Sapiens
QSKINHIYR

SEQ ID NO: 980467 - protein, 9 aa, Homo Sapiens
FGIEICRKS

SEQ ID NO: 980468 - protein, 9 aa, Homo Sapiens
SHPFGGALL

SEQ ID NO: 980469 - protein, 9 aa, Homo Sapiens
SALEPVLEE

SEQ ID NO: 980470 - protein, 9 aa, Homo Sapiens
FDDNETGKI

SEQ ID NO: 980471 - protein, 9 aa, Homo Sapiens
VDEVHKNSR

SEQ ID NO: 980472 - protein, 9 aa, Homo Sapiens
DEQLLENYL

SEQ ID NO: 980473 - protein, 9 aa, Homo Sapiens
IFYRIKVTH

SEQ ID NO: 980474 - protein, 9 aa, Homo Sapiens
IWSKCKEIW

SEQ ID NO: 980475 - protein, 9 aa, Homo Sapiens
KFTLSEQVE

SEQ ID NO: 980476 - protein, 9 aa, Homo Sapiens
AKVARELDR

SEQ ID NO: 980477 - protein, 9 aa, Homo Sapiens
KRQKAPTNE

SEQ ID NO: 980478 - protein, 9 aa, Homo Sapiens
GNKNGNFII

SEQ ID NO: 980479 - protein, 9 aa, Homo Sapiens
KCYCEQLKV

SEQ ID NO: 980480 - protein, 9 aa, Homo Sapiens
RDQPLFPAC

SEQ ID NO: 980481 - protein, 8 aa, Homo Sapiens
SSDSELAV

SEQ ID NO: 980482 - protein, 9 aa, Homo Sapiens
LLKSYPRFP

SEQ ID NO: 980483 - protein, 9 aa, Homo Sapiens
GSLVKKKGF

SEQ ID NO: 980484 - protein, 9 aa, Homo Sapiens
LRKRCKRKK

SEQ ID NO: 980485 - protein, 9 aa, Homo Sapiens
PFGGALLNK

SEQ ID NO: 980486 - protein, 9 aa, Homo Sapiens
SPNLTSLAT

SEQ ID NO: 980487 - protein, 9 aa, Homo Sapiens
DRNQVAQTW

SEQ ID NO: 980488 - protein, 9 aa, Homo Sapiens
SLYPPSPPP

SEQ ID NO: 980489 - protein, 9 aa, Homo Sapiens
LVYCTDLLP

SEQ ID NO: 980490 - protein, 9 aa, Homo Sapiens
RRFWNFIVM

SEQ ID NO: 980491 - protein, 9 aa, Homo Sapiens
LLEEGLCEA

SEQ ID NO: 980492 - protein, 9 aa, Homo Sapiens
KMSQAEKLL

SEQ ID NO: 980493 - protein, 9 aa, Homo Sapiens
GLLATARWG

SEQ ID NO: 980494 - protein, 9 aa, Homo Sapiens
ERPSQAFLT

SEQ ID NO: 980495 - protein, 9 aa, Homo Sapiens
LGLDFRLGS

SEQ ID NO: 980496 - protein, 9 aa, Homo Sapiens
TGGGPWGKV

SEQ ID NO: 980497 - protein, 9 aa, Homo Sapiens
LESLPSATL

SEQ ID NO: 980498 - protein, 9 aa, Homo Sapiens
GSRFGFGGG

SEQ ID NO: 980499 - protein, 9 aa, Homo Sapiens
QGNKNGNFI

SEQ ID NO: 980500 - protein, 9 aa, Homo Sapiens
EPVIPLANK

SEQ ID NO: 980501 - protein, 9 aa, Homo Sapiens
VCNQCGKES

SEQ ID NO: 980502 - protein, 9 aa, Homo Sapiens
FLFTLLKSY

SEQ ID NO: 980503 - protein, 9 aa, Homo Sapiens
PKEKLFQKP

SEQ ID NO: 980504 - protein, 9 aa, Homo Sapiens
NSFLREVES

SEQ ID NO: 980505 - protein, 9 aa, Homo Sapiens
GSGNTYRPK

SEQ ID NO: 980506 - protein, 9 aa, Homo Sapiens
RAGRAFLMA

SEQ ID NO: 980507 - protein, 9 aa, Homo Sapiens
PPEASIHAQ

SEQ ID NO: 980508 - protein, 9 aa, Homo Sapiens
SEKWCLSTD

SEQ ID NO: 980509 - protein, 9 aa, Homo Sapiens
KLSLHSQGA

SEQ ID NO: 980510 - protein, 9 aa, Homo Sapiens
RVKVGNKFV

SEQ ID NO: 980511 - protein, 9 aa, Homo Sapiens
FSPEETTPS

SEQ ID NO: 980512 - protein, 9 aa, Homo Sapiens
RLCGGKNEF

SEQ ID NO: 980513 - protein, 9 aa, Homo Sapiens
IHEVQKFLR

SEQ ID NO: 980514 - protein, 9 aa, Homo Sapiens
FLTPVALDF

SEQ ID NO: 980515 - protein, 9 aa, Homo Sapiens
FWNFIVMQR

SEQ ID NO: 980516 - protein, 9 aa, Homo Sapiens
NIPFSYNFH

SEQ ID NO: 980517 - protein, 9 aa, Homo Sapiens
PTACSCTQH

SEQ ID NO: 980518 - protein, 9 aa, Homo Sapiens
SVKKSLEKA

SEQ ID NO: 980519 - protein, 9 aa, Homo Sapiens
AGKGTYVPL

SEQ ID NO: 980520 - protein, 9 aa, Homo Sapiens
RLHRDEERF

SEQ ID NO: 980521 - protein, 9 aa, Homo Sapiens
VTLEIFRNL

SEQ ID NO: 980522 - protein, 9 aa, Homo Sapiens
LGGLPFSSK

SEQ ID NO: 980523 - protein, 9 aa, Homo Sapiens
GQNFGDVSW

SEQ ID NO: 980524 - protein, 9 aa, Homo Sapiens
STLGPGEGS

SEQ ID NO: 980525 - protein, 9 aa, Homo Sapiens
AGRAFLMAG

SEQ ID NO: 980526 - protein, 9 aa, Homo Sapiens
WVGIVIFLV

SEQ ID NO: 980527 - protein, 9 aa, Homo Sapiens
FLKNGDPSG

SEQ ID NO: 980528 - protein, 9 aa, Homo Sapiens
TIVQEILQS

SEQ ID NO: 980529 - protein, 9 aa, Homo Sapiens
TRRVVSQEL

SEQ ID NO: 980530 - protein, 9 aa, Homo Sapiens
HMVFRPKPP

SEQ ID NO: 980531 - protein, 9 aa, Homo Sapiens
AKVICNFFT

SEQ ID NO: 980532 - protein, 9 aa, Homo Sapiens
RPKGPPGPP

SEQ ID NO: 980533 - protein, 9 aa, Homo Sapiens
QSPLVYTAT

SEQ ID NO: 980534 - protein, 9 aa, Homo Sapiens
GKSESIHVI

SEQ ID NO: 980535 - protein, 9 aa, Homo Sapiens
CRNYLENIL

SEQ ID NO: 980536 - protein, 9 aa, Homo Sapiens
TIICVYFKP

SEQ ID NO: 980537 - protein, 9 aa, Homo Sapiens
LGPSVQVSV

SEQ ID NO: 980538 - protein, 9 aa, Homo Sapiens
AETTADQGH

SEQ ID NO: 980539 - protein, 9 aa, Homo Sapiens
TALQKIFEK

SEQ ID NO: 980540 - protein, 9 aa, Homo Sapiens
LKQEAQKNW

SEQ ID NO: 980541 - protein, 9 aa, Homo Sapiens
TESPHFTPL

SEQ ID NO: 980542 - protein, 9 aa, Homo Sapiens
TPVTTSAKT

SEQ ID NO: 980543 - protein, 9 aa, Homo Sapiens
WEVFYELPL

SEQ ID NO: 980544 - protein, 9 aa, Homo Sapiens
VKDGTVCGS

SEQ ID NO: 980545 - protein, 9 aa, Homo Sapiens
TRDEKLVSE

SEQ ID NO: 980546 - protein, 9 aa, Homo Sapiens
NDDFSIHAA

SEQ ID NO: 980547 - protein, 9 aa, Homo Sapiens
ISKTLEVIP

SEQ ID NO: 980548 - protein, 9 aa, Homo Sapiens
PMRLVNFSM

SEQ ID NO: 980549 - protein, 9 aa, Homo Sapiens
CAGLGLDSK

SEQ ID NO: 980550 - protein, 9 aa, Homo Sapiens
SFRLSQFPD

SEQ ID NO: 980551 - protein, 9 aa, Homo Sapiens
RAMYADLNQ

SEQ ID NO: 980552 - protein, 9 aa, Homo Sapiens
FFSDLLVAI

SEQ ID NO: 980553 - protein, 9 aa, Homo Sapiens
PETSEMLLN

SEQ ID NO: 980554 - protein, 9 aa, Homo Sapiens
HISLANVCI

SEQ ID NO: 980555 - protein, 9 aa, Homo Sapiens
GGILAMPKD

SEQ ID NO: 980556 - protein, 9 aa, Homo Sapiens
KRKRSFKVV

SEQ ID NO: 980557 - protein, 9 aa, Homo Sapiens
PAGLTGPAG

SEQ ID NO: 980558 - protein, 9 aa, Homo Sapiens
EQLLENYLD

SEQ ID NO: 980559 - protein, 9 aa, Homo Sapiens
IRTILKISS

SEQ ID NO: 980560 - protein, 9 aa, Homo Sapiens
LGPGPFSLD

SEQ ID NO: 980561 - protein, 9 aa, Homo Sapiens
GPLRPMKEE

SEQ ID NO: 980562 - protein, 9 aa, Homo Sapiens
IQPSFCHRS

SEQ ID NO: 980563 - protein, 9 aa, Homo Sapiens
YFLKNGDPS

SEQ ID NO: 980564 - protein, 9 aa, Homo Sapiens
ATKGKRFPK

SEQ ID NO: 980565 - protein, 9 aa, Homo Sapiens
KPVSADQMI

SEQ ID NO: 980566 - protein, 9 aa, Homo Sapiens
ERSDRKYYA

SEQ ID NO: 980567 - protein, 9 aa, Homo Sapiens
RLRSIFPEG

SEQ ID NO: 980568 - protein, 9 aa, Homo Sapiens
EENITHLQK

SEQ ID NO: 980569 - protein, 9 aa, Homo Sapiens
NEDGEEIDH

SEQ ID NO: 980570 - protein, 9 aa, Homo Sapiens
PHVVPKTVK

SEQ ID NO: 980571 - protein, 9 aa, Homo Sapiens
TYVENRPKN

SEQ ID NO: 980572 - protein, 9 aa, Homo Sapiens
QKKITALAP

SEQ ID NO: 980573 - protein, 9 aa, Homo Sapiens
QKPVPKAAL

SEQ ID NO: 980574 - protein, 9 aa, Homo Sapiens
TLEVIPMTG

SEQ ID NO: 980575 - protein, 9 aa, Homo Sapiens
LFTLLKSYP

SEQ ID NO: 980576 - protein, 9 aa, Homo Sapiens
VPIFPVSVG

SEQ ID NO: 980577 - protein, 9 aa, Homo Sapiens
LYWHFQIPR

SEQ ID NO: 980578 - protein, 9 aa, Homo Sapiens
ISSILLDYY

SEQ ID NO: 980579 - protein, 9 aa, Homo Sapiens
ALVGRCSVP

SEQ ID NO: 980580 - protein, 9 aa, Homo Sapiens
HRSSPNVAD

SEQ ID NO: 980581 - protein, 9 aa, Homo Sapiens
LSHHKRLKC

SEQ ID NO: 980582 - protein, 9 aa, Homo Sapiens
LVCAGLGLD

SEQ ID NO: 980583 - protein, 9 aa, Homo Sapiens
GLWIECATH

SEQ ID NO: 980584 - protein, 9 aa, Homo Sapiens
KANAKERTR

SEQ ID NO: 980585 - protein, 9 aa, Homo Sapiens
RCGAWRGIV

SEQ ID NO: 980586 - protein, 9 aa, Homo Sapiens
RFPVQALQP

SEQ ID NO: 980587 - protein, 9 aa, Homo Sapiens
SENQTYICL

SEQ ID NO: 980588 - protein, 9 aa, Homo Sapiens
PLLPWQPVG

SEQ ID NO: 980589 - protein, 9 aa, Homo Sapiens
EFPAAFIII

SEQ ID NO: 980590 - protein, 9 aa, Homo Sapiens
FANGNFLKA

SEQ ID NO: 980591 - protein, 9 aa, Homo Sapiens
GIVIFLVCL

SEQ ID NO: 980592 - protein, 9 aa, Homo Sapiens
SFSSSSSSA

SEQ ID NO: 980593 - protein, 9 aa, Homo Sapiens
KTPEPDPRK

SEQ ID NO: 980594 - protein, 9 aa, Homo Sapiens
SLRLKDKFF

SEQ ID NO: 980595 - protein, 9 aa, Homo Sapiens
FGGGAGSRF

SEQ ID NO: 980596 - protein, 9 aa, Homo Sapiens
FFESFLQES

SEQ ID NO: 980597 - protein, 9 aa, Homo Sapiens
DGTVCGSEK

SEQ ID NO: 980598 - protein, 9 aa, Homo Sapiens
PENARFGQG

SEQ ID NO: 980599 - protein, 9 aa, Homo Sapiens
RQKAPTNEA

SEQ ID NO: 980600 - protein, 9 aa, Homo Sapiens
ASILVSEAL

SEQ ID NO: 980601 - protein, 9 aa, Homo Sapiens
TAGSYCYIS

SEQ ID NO: 980602 - protein, 9 aa, Homo Sapiens
RAFLMAGQV

SEQ ID NO: 980603 - protein, 9 aa, Homo Sapiens
DFFTVTDLK

SEQ ID NO: 980604 - protein, 9 aa, Homo Sapiens
VMEDSSSHE

SEQ ID NO: 980605 - protein, 9 aa, Homo Sapiens
LTEHSQGLE

SEQ ID NO: 980606 - protein, 9 aa, Homo Sapiens
FKGCDTQII

SEQ ID NO: 980607 - protein, 9 aa, Homo Sapiens
NARPITDGR

SEQ ID NO: 980608 - protein, 9 aa, Homo Sapiens
RNTQDENIR

SEQ ID NO: 980609 - protein, 9 aa, Homo Sapiens
YQQSRKDNF

SEQ ID NO: 980610 - protein, 9 aa, Homo Sapiens
KSRPRRRYQ

SEQ ID NO: 980611 - protein, 9 aa, Homo Sapiens
LFKGCDTQI

SEQ ID NO: 980612 - protein, 9 aa, Homo Sapiens
VEIKKFLWH

SEQ ID NO: 980613 - protein, 9 aa, Homo Sapiens
LDMGGTSDS

SEQ ID NO: 980614 - protein, 9 aa, Homo Sapiens
HEGVFEDGS

SEQ ID NO: 980615 - protein, 9 aa, Homo Sapiens
YWHFQIPRV

SEQ ID NO: 980616 - protein, 9 aa, Homo Sapiens
GHKASCCLE

SEQ ID NO: 980617 - protein, 9 aa, Homo Sapiens
CCLEDTSCD

SEQ ID NO: 980618 - protein, 9 aa, Homo Sapiens
FQGRLGPGR

SEQ ID NO: 980619 - protein, 9 aa, Homo Sapiens
CCQYRGWQG

SEQ ID NO: 980620 - protein, 9 aa, Homo Sapiens
RQRSSGFGE

SEQ ID NO: 980621 - protein, 9 aa, Homo Sapiens
PSGESGREG

SEQ ID NO: 980622 - protein, 9 aa, Homo Sapiens
YHQRQLNPN

SEQ ID NO: 980623 - protein, 9 aa, Homo Sapiens
LVITKMDKL

SEQ ID NO: 980624 - protein, 9 aa, Homo Sapiens
SSTGVELAP

SEQ ID NO: 980625 - protein, 9 aa, Homo Sapiens
SHGSPALST

SEQ ID NO: 980626 - protein, 9 aa, Homo Sapiens
LDVLEQQRF

SEQ ID NO: 980627 - protein, 9 aa, Homo Sapiens
RPLPPPEAS

SEQ ID NO: 980628 - protein, 9 aa, Homo Sapiens
EPPTSPTSI

SEQ ID NO: 980629 - protein, 9 aa, Homo Sapiens
SSLGLSIPL

SEQ ID NO: 980630 - protein, 9 aa, Homo Sapiens
VVVTFLVLP

SEQ ID NO: 980631 - protein, 9 aa, Homo Sapiens
WHFQIPRVV

SEQ ID NO: 980632 - protein, 9 aa, Homo Sapiens
MLNIPFSYN

SEQ ID NO: 980633 - protein, 9 aa, Homo Sapiens
LANKSEVVG

SEQ ID NO: 980634 - protein, 9 aa, Homo Sapiens
DAALPLEKV

SEQ ID NO: 980635 - protein, 9 aa, Homo Sapiens
DGRFKGSLM

SEQ ID NO: 980636 - protein, 9 aa, Homo Sapiens
TLILDKKGS

SEQ ID NO: 980637 - protein, 9 aa, Homo Sapiens
KRLLPVINT

SEQ ID NO: 980638 - protein, 9 aa, Homo Sapiens
RENCRGLTG

SEQ ID NO: 980639 - protein, 9 aa, Homo Sapiens
LLTYYDASK

SEQ ID NO: 980640 - protein, 9 aa, Homo Sapiens
SPTESPHFT

SEQ ID NO: 980641 - protein, 9 aa, Homo Sapiens
MRTQSPLVY

SEQ ID NO: 980642 - protein, 9 aa, Homo Sapiens
IFPEGGDKT

SEQ ID NO: 980643 - protein, 9 aa, Homo Sapiens
YEGSWGTIC

SEQ ID NO: 980644 - protein, 9 aa, Homo Sapiens
IPPCIHISL

SEQ ID NO: 980645 - protein, 9 aa, Homo Sapiens
VEPMSSSGP

SEQ ID NO: 980646 - protein, 9 aa, Homo Sapiens
KVLSGHSLQ

SEQ ID NO: 980647 - protein, 9 aa, Homo Sapiens
ANKSEVVGY

SEQ ID NO: 980648 - protein, 9 aa, Homo Sapiens
YLSDFCSPR

SEQ ID NO: 980649 - protein, 9 aa, Homo Sapiens
SGGVYALME

SEQ ID NO: 980650 - protein, 9 aa, Homo Sapiens
LKNLEDAMN

SEQ ID NO: 980651 - protein, 9 aa, Homo Sapiens
GELVLWKAR

SEQ ID NO: 980652 - protein, 9 aa, Homo Sapiens
EIEKNSTLP

SEQ ID NO: 980653 - protein, 9 aa, Homo Sapiens
AASPRSSSK

SEQ ID NO: 980654 - protein, 9 aa, Homo Sapiens
IGFKFDQYM

SEQ ID NO: 980655 - protein, 9 aa, Homo Sapiens
LEVIPMTGE

SEQ ID NO: 980656 - protein, 9 aa, Homo Sapiens
KYRFKYVLV

SEQ ID NO: 980657 - protein, 9 aa, Homo Sapiens
IISRLFHCH

SEQ ID NO: 980658 - protein, 9 aa, Homo Sapiens
MQKKITALA

SEQ ID NO: 980659 - protein, 9 aa, Homo Sapiens
AHKRIYTGE

SEQ ID NO: 980660 - protein, 9 aa, Homo Sapiens
MSSSENLSK

SEQ ID NO: 980661 - protein, 9 aa, Homo Sapiens
KGLAWSLGP

SEQ ID NO: 980662 - protein, 9 aa, Homo Sapiens
SLSTMGANV

SEQ ID NO: 980663 - protein, 9 aa, Homo Sapiens
RSSFYPNGG

SEQ ID NO: 980664 - protein, 9 aa, Homo Sapiens
QKGFQASRS

SEQ ID NO: 980665 - protein, 9 aa, Homo Sapiens
AHTRRVVSQ

SEQ ID NO: 980666 - protein, 9 aa, Homo Sapiens
KKKGFQECF

SEQ ID NO: 980667 - protein, 9 aa, Homo Sapiens
RDLRAASIL

SEQ ID NO: 980668 - protein, 9 aa, Homo Sapiens
SFDVKNLEN

SEQ ID NO: 980669 - protein, 9 aa, Homo Sapiens
VMNYIVSTW

SEQ ID NO: 980670 - protein, 9 aa, Homo Sapiens
GKTRRNSYP

SEQ ID NO: 980671 - protein, 9 aa, Homo Sapiens
PGFPQSQYL

SEQ ID NO: 980672 - protein, 9 aa, Homo Sapiens
SRAALVGRC

SEQ ID NO: 980673 - protein, 9 aa, Homo Sapiens
TAERDPRIP

SEQ ID NO: 980674 - protein, 9 aa, Homo Sapiens
KEKVRWRTK

SEQ ID NO: 980675 - protein, 9 aa, Homo Sapiens
YQDIRLEVM

SEQ ID NO: 980676 - protein, 9 aa, Homo Sapiens
LCRRSRAAL

SEQ ID NO: 980677 - protein, 9 aa, Homo Sapiens
GSVRLCGGK

SEQ ID NO: 980678 - protein, 9 aa, Homo Sapiens
GMIWSKCKE

SEQ ID NO: 980679 - protein, 9 aa, Homo Sapiens
ENIRKWFKV

SEQ ID NO: 980680 - protein, 9 aa, Homo Sapiens
SKPLTLINE

SEQ ID NO: 980681 - protein, 9 aa, Homo Sapiens
GKFFISKSQ

SEQ ID NO: 980682 - protein, 9 aa, Homo Sapiens
EGRQEFVRW

SEQ ID NO: 980683 - protein, 9 aa, Homo Sapiens
PLKLQITVT

SEQ ID NO: 980684 - protein, 9 aa, Homo Sapiens
LGGLNFSWM

SEQ ID NO: 980685 - protein, 9 aa, Homo Sapiens
AFVPEIFYR

SEQ ID NO: 980686 - protein, 9 aa, Homo Sapiens
FVLTEFLYQ

SEQ ID NO: 980687 - protein, 9 aa, Homo Sapiens
ESENNVEEA

SEQ ID NO: 980688 - protein, 9 aa, Homo Sapiens
ENADGRFKG

SEQ ID NO: 980689 - protein, 9 aa, Homo Sapiens
HNHVTCVSQ

SEQ ID NO: 980690 - protein, 9 aa, Homo Sapiens
LYSLDKLLD

SEQ ID NO: 980691 - protein, 9 aa, Homo Sapiens
FCLDSYTGE

SEQ ID NO: 980692 - protein, 9 aa, Homo Sapiens
EAEHSSELF

SEQ ID NO: 980693 - protein, 9 aa, Homo Sapiens
GVGIGDCFK

SEQ ID NO: 980694 - protein, 9 aa, Homo Sapiens
SPKDGSTLG

SEQ ID NO: 980695 - protein, 9 aa, Homo Sapiens
KDAEEMVRS

SEQ ID NO: 980696 - protein, 9 aa, Homo Sapiens
QPFSPEPIT

SEQ ID NO: 980697 - protein, 9 aa, Homo Sapiens
NASNPDEGA

SEQ ID NO: 980698 - protein, 9 aa, Homo Sapiens
LENIDTSCD

SEQ ID NO: 980699 - protein, 9 aa, Homo Sapiens
RFQITKINK

SEQ ID NO: 980700 - protein, 9 aa, Homo Sapiens
PPTPSEQDK

SEQ ID NO: 980701 - protein, 9 aa, Homo Sapiens
VKPIIIGCH

SEQ ID NO: 980702 - protein, 9 aa, Homo Sapiens
GIVNASEII

SEQ ID NO: 980703 - protein, 9 aa, Homo Sapiens
NHIHEVQKF

SEQ ID NO: 980704 - protein, 9 aa, Homo Sapiens
VRQKLEAAE

SEQ ID NO: 980705 - protein, 9 aa, Homo Sapiens
PREPRGGRP

SEQ ID NO: 980706 - protein, 9 aa, Homo Sapiens
MLIQIKLSL

SEQ ID NO: 980707 - protein, 9 aa, Homo Sapiens
THTMLGSSE

SEQ ID NO: 980708 - protein, 9 aa, Homo Sapiens
KDNKIEIRE

SEQ ID NO: 980709 - protein, 9 aa, Homo Sapiens
GLQLLCSWA

SEQ ID NO: 980710 - protein, 9 aa, Homo Sapiens
SGNLIDPIH

SEQ ID NO: 980711 - protein, 9 aa, Homo Sapiens
RRLLLYKYV

SEQ ID NO: 980712 - protein, 9 aa, Homo Sapiens
QEVLKKMTD

SEQ ID NO: 980713 - protein, 9 aa, Homo Sapiens
TSESSWNKS

SEQ ID NO: 980714 - protein, 9 aa, Homo Sapiens
VPEIFYRIK

SEQ ID NO: 980715 - protein, 9 aa, Homo Sapiens
NSRSDMMSA

SEQ ID NO: 980716 - protein, 9 aa, Homo Sapiens
IIILTIDRI

SEQ ID NO: 980717 - protein, 9 aa, Homo Sapiens
FRALFGALG

SEQ ID NO: 980718 - protein, 9 aa, Homo Sapiens
CGAWRGIVW

SEQ ID NO: 980719 - protein, 9 aa, Homo Sapiens
KIPRGFRFH

SEQ ID NO: 980720 - protein, 9 aa, Homo Sapiens
CRRFWNFIV

SEQ ID NO: 980721 - protein, 9 aa, Homo Sapiens
VAWNHRDAG

SEQ ID NO: 980722 - protein, 9 aa, Homo Sapiens
CPMRLVNFS

SEQ ID NO: 980723 - protein, 9 aa, Homo Sapiens
MNGELVLWK

SEQ ID NO: 980724 - protein, 9 aa, Homo Sapiens
IFVLTIPFL

SEQ ID NO: 980725 - protein, 9 aa, Homo Sapiens
SHLGQHKNI

SEQ ID NO: 980726 - protein, 9 aa, Homo Sapiens
YFCIYHTFH

SEQ ID NO: 980727 - protein, 9 aa, Homo Sapiens
FLGGVFICS

SEQ ID NO: 980728 - protein, 9 aa, Homo Sapiens
LGPFGVNYG

SEQ ID NO: 980729 - protein, 9 aa, Homo Sapiens
IADRMQKKI

SEQ ID NO: 980730 - protein, 9 aa, Homo Sapiens
VYKILQGNK

SEQ ID NO: 980731 - protein, 9 aa, Homo Sapiens
YKILCKLSL

SEQ ID NO: 980732 - protein, 9 aa, Homo Sapiens
KISKDQKSE

SEQ ID NO: 980733 - protein, 9 aa, Homo Sapiens
CGQERRGEP

SEQ ID NO: 980734 - protein, 9 aa, Homo Sapiens
SEQPGVIPR

SEQ ID NO: 980735 - protein, 9 aa, Homo Sapiens
VPTVSGFFL

SEQ ID NO: 980736 - protein, 9 aa, Homo Sapiens
PQSQYLQYY

SEQ ID NO: 980737 - protein, 9 aa, Homo Sapiens
RPSQAFLTP

SEQ ID NO: 980738 - protein, 9 aa, Homo Sapiens
RFWNFIVMQ

SEQ ID NO: 980739 - protein, 9 aa, Homo Sapiens
ILCQTHYEE

SEQ ID NO: 980740 - protein, 9 aa, Homo Sapiens
QFESARRVT

SEQ ID NO: 980741 - protein, 9 aa, Homo Sapiens
SLDKLLDRM

SEQ ID NO: 980742 - protein, 9 aa, Homo Sapiens
TGPKEKLFQ

SEQ ID NO: 980743 - protein, 9 aa, Homo Sapiens
IEICRKSTG

SEQ ID NO: 980744 - protein, 9 aa, Homo Sapiens
LQVLTEMDG

SEQ ID NO: 980745 - protein, 9 aa, Homo Sapiens
ELHTRLEEC

SEQ ID NO: 980746 - protein, 9 aa, Homo Sapiens
MKRTRTAGP

SEQ ID NO: 980747 - protein, 9 aa, Homo Sapiens
ITWVGIVIF

SEQ ID NO: 980748 - protein, 9 aa, Homo Sapiens
GNLLILLVV

SEQ ID NO: 980749 - protein, 9 aa, Homo Sapiens
FFISKSQLQ

SEQ ID NO: 980750 - protein, 9 aa, Homo Sapiens
EFLYQPQWK

SEQ ID NO: 980751 - protein, 9 aa, Homo Sapiens
PQRFPVQAL

SEQ ID NO: 980752 - protein, 9 aa, Homo Sapiens
QAEETEKNI

SEQ ID NO: 980753 - protein, 9 aa, Homo Sapiens
LGSMSWIFC

SEQ ID NO: 980754 - protein, 9 aa, Homo Sapiens
LSGYRICLG

SEQ ID NO: 980755 - protein, 9 aa, Homo Sapiens
EQAEKGYKE

SEQ ID NO: 980756 - protein, 9 aa, Homo Sapiens
AGSYCYISP

SEQ ID NO: 980757 - protein, 9 aa, Homo Sapiens
EVAALYFLK

SEQ ID NO: 980758 - protein, 9 aa, Homo Sapiens
ARRVTLFPD

SEQ ID NO: 980759 - protein, 9 aa, Homo Sapiens
DRILLCRKA

SEQ ID NO: 980760 - protein, 9 aa, Homo Sapiens
PPPSSLGLS

SEQ ID NO: 980761 - protein, 9 aa, Homo Sapiens
TSPTSIRKR

SEQ ID NO: 980762 - protein, 9 aa, Homo Sapiens
ASCCLEDTS

SEQ ID NO: 980763 - protein, 9 aa, Homo Sapiens
CNNCGKFFI

SEQ ID NO: 980764 - protein, 9 aa, Homo Sapiens
AEHSSELFF

SEQ ID NO: 980765 - protein, 9 aa, Homo Sapiens
GLSIPLMSG

SEQ ID NO: 980766 - protein, 9 aa, Homo Sapiens
HAASRALYS

SEQ ID NO: 980767 - protein, 9 aa, Homo Sapiens
ALEDKNSFL

SEQ ID NO: 980768 - protein, 9 aa, Homo Sapiens
QNILLDTHR

SEQ ID NO: 980769 - protein, 9 aa, Homo Sapiens
VTTSAKTSS

SEQ ID NO: 980770 - protein, 9 aa, Homo Sapiens
FGVNAILGV

SEQ ID NO: 980771 - protein, 9 aa, Homo Sapiens
SKPQVSFLH

SEQ ID NO: 980772 - protein, 9 aa, Homo Sapiens
PCLETPADL

SEQ ID NO: 980773 - protein, 9 aa, Homo Sapiens
NPDEGANGA

SEQ ID NO: 980774 - protein, 9 aa, Homo Sapiens
APGGQKDPA

SEQ ID NO: 980775 - protein, 9 aa, Homo Sapiens
AWNHRDAGA

SEQ ID NO: 980776 - protein, 9 aa, Homo Sapiens
TCFIYQPLA

SEQ ID NO: 980777 - protein, 9 aa, Homo Sapiens
LLLYKYVYK

SEQ ID NO: 980778 - protein, 9 aa, Homo Sapiens
NEFEELQRE

SEQ ID NO: 980779 - protein, 9 aa, Homo Sapiens
PFSTGSAFG

SEQ ID NO: 980780 - protein, 9 aa, Homo Sapiens
QKVFSNKRS

SEQ ID NO: 980781 - protein, 9 aa, Homo Sapiens
AHCEFSLLR

SEQ ID NO: 980782 - protein, 9 aa, Homo Sapiens
GEATGPDPL

SEQ ID NO: 980783 - protein, 9 aa, Homo Sapiens
IFDTVSQAK

SEQ ID NO: 980784 - protein, 9 aa, Homo Sapiens
TSSNTAQGG

SEQ ID NO: 980785 - protein, 9 aa, Homo Sapiens
RNSRVQVLP

SEQ ID NO: 980786 - protein, 9 aa, Homo Sapiens
KSFGWFYCY

SEQ ID NO: 980787 - protein, 9 aa, Homo Sapiens
EAGPAGLTG

SEQ ID NO: 980788 - protein, 9 aa, Homo Sapiens
GDQLVSQFP

SEQ ID NO: 980789 - protein, 9 aa, Homo Sapiens
MEGYFMNVL

SEQ ID NO: 980790 - protein, 9 aa, Homo Sapiens
PETGSGNLI

SEQ ID NO: 980791 - protein, 9 aa, Homo Sapiens
FGQIRYSVS

SEQ ID NO: 980792 - protein, 9 aa, Homo Sapiens
SAGVTLKEA

SEQ ID NO: 980793 - protein, 9 aa, Homo Sapiens
FINPGKIPR

SEQ ID NO: 980794 - protein, 9 aa, Homo Sapiens
HGASTVLSS

SEQ ID NO: 980795 - protein, 9 aa, Homo Sapiens
KLNVKDVDS

SEQ ID NO: 980796 - protein, 9 aa, Homo Sapiens
VPREPRGGR

SEQ ID NO: 980797 - protein, 9 aa, Homo Sapiens
TKMHKFEDR

SEQ ID NO: 980798 - protein, 9 aa, Homo Sapiens
TVCNDDFSI

SEQ ID NO: 980799 - protein, 9 aa, Homo Sapiens
GHVCVSASK

SEQ ID NO: 980800 - protein, 9 aa, Homo Sapiens
KLLALQVEE

SEQ ID NO: 980801 - protein, 9 aa, Homo Sapiens
KLISDIRYK

SEQ ID NO: 980802 - protein, 9 aa, Homo Sapiens
SPEETTPSP

SEQ ID NO: 980803 - protein, 9 aa, Homo Sapiens
KMPKKPKFE

SEQ ID NO: 980804 - protein, 9 aa, Homo Sapiens
RWEHKMVMI

SEQ ID NO: 980805 - protein, 9 aa, Homo Sapiens
QYLHGNKGF

SEQ ID NO: 980806 - protein, 9 aa, Homo Sapiens
KDNMNNCFL

SEQ ID NO: 980807 - protein, 9 aa, Homo Sapiens
DSYHQRQLN

SEQ ID NO: 980808 - protein, 9 aa, Homo Sapiens
SRFHFPFIV

SEQ ID NO: 980809 - protein, 9 aa, Homo Sapiens
SKDQKSELI

SEQ ID NO: 980810 - protein, 9 aa, Homo Sapiens
DSCAPCQPC

SEQ ID NO: 980811 - protein, 9 aa, Homo Sapiens
EIQCKSKRP

SEQ ID NO: 980812 - protein, 9 aa, Homo Sapiens
NPGKIPRGF

SEQ ID NO: 980813 - protein, 9 aa, Homo Sapiens
RALYSLDKL

SEQ ID NO: 980814 - protein, 9 aa, Homo Sapiens
MRLVNFSMD

SEQ ID NO: 980815 - protein, 9 aa, Homo Sapiens
LGESEHLLE

SEQ ID NO: 980816 - protein, 9 aa, Homo Sapiens
SGGIFGGQE

SEQ ID NO: 980817 - protein, 9 aa, Homo Sapiens
SSLGGLNFS

SEQ ID NO: 980818 - protein, 9 aa, Homo Sapiens
SKGDQGQTG

SEQ ID NO: 980819 - protein, 9 aa, Homo Sapiens
MPNILEYGN

SEQ ID NO: 980820 - protein, 9 aa, Homo Sapiens
ANYVYDVMW

SEQ ID NO: 980821 - protein, 9 aa, Homo Sapiens
SWYLEKNVA

SEQ ID NO: 980822 - protein, 9 aa, Homo Sapiens
NIDTSCDDG

SEQ ID NO: 980823 - protein, 9 aa, Homo Sapiens
WRGIVWHRF

SEQ ID NO: 980824 - protein, 9 aa, Homo Sapiens
RDEKLVSES

SEQ ID NO: 980825 - protein, 9 aa, Homo Sapiens
GLNFSWMES

SEQ ID NO: 980826 - protein, 9 aa, Homo Sapiens
TFLVLPIFS

SEQ ID NO: 980827 - protein, 9 aa, Homo Sapiens
SVVPREPRG

SEQ ID NO: 980828 - protein, 9 aa, Homo Sapiens
RFHFPFIVE

SEQ ID NO: 980829 - protein, 9 aa, Homo Sapiens
RSFKVVVTA

SEQ ID NO: 980830 - protein, 9 aa, Homo Sapiens
RALNIDGSD

SEQ ID NO: 980831 - protein, 9 aa, Homo Sapiens
NGRCDNTAG

SEQ ID NO: 980832 - protein, 9 aa, Homo Sapiens
WVDAQVQKL

SEQ ID NO: 980833 - protein, 9 aa, Homo Sapiens
LAPKTSTVR

SEQ ID NO: 980834 - protein, 9 aa, Homo Sapiens
QGIPSINQA

SEQ ID NO: 980835 - protein, 9 aa, Homo Sapiens
QTKKMWQRL

SEQ ID NO: 980836 - protein, 9 aa, Homo Sapiens
GSTLGPGEG

SEQ ID NO: 980837 - protein, 9 aa, Homo Sapiens
DIRLEVMEE

SEQ ID NO: 980838 - protein, 9 aa, Homo Sapiens
APENARFGQ

SEQ ID NO: 980839 - protein, 9 aa, Homo Sapiens
RQSKINHIY

SEQ ID NO: 980840 - protein, 9 aa, Homo Sapiens
IYAFIVVEN

SEQ ID NO: 980841 - protein, 9 aa, Homo Sapiens
NLTKHKKIY

SEQ ID NO: 980842 - protein, 9 aa, Homo Sapiens
RLSQFPDWI

SEQ ID NO: 980843 - protein, 9 aa, Homo Sapiens
PFSYNFHDF

SEQ ID NO: 980844 - protein, 9 aa, Homo Sapiens
PPTACSCTQ

SEQ ID NO: 980845 - protein, 9 aa, Homo Sapiens
FLSGGLFRS

SEQ ID NO: 980846 - protein, 9 aa, Homo Sapiens
CNIISLKDN

SEQ ID NO: 980847 - protein, 9 aa, Homo Sapiens
VEIYYEGSW

SEQ ID NO: 980848 - protein, 9 aa, Homo Sapiens
AIFIAEDEE

SEQ ID NO: 980849 - protein, 9 aa, Homo Sapiens
SFKVVVTAA

SEQ ID NO: 980850 - protein, 9 aa, Homo Sapiens
DQLLSTVVA

SEQ ID NO: 980851 - protein, 9 aa, Homo Sapiens
FPAAFIIIL

SEQ ID NO: 980852 - protein, 9 aa, Homo Sapiens
STGEVFYYS

SEQ ID NO: 980853 - protein, 9 aa, Homo Sapiens
RLFQKPVPK

SEQ ID NO: 980854 - protein, 9 aa, Homo Sapiens
VLWKARSLL

SEQ ID NO: 980855 - protein, 9 aa, Homo Sapiens
LLFLSGGLF

SEQ ID NO: 980856 - protein, 9 aa, Homo Sapiens
GFQASRSNA

SEQ ID NO: 980857 - protein, 9 aa, Homo Sapiens
DLCVNGRCD

SEQ ID NO: 980858 - protein, 9 aa, Homo Sapiens
GDSKEKVRW

SEQ ID NO: 980859 - protein, 9 aa, Homo Sapiens
ASNPDEGAN

SEQ ID NO: 980860 - protein, 9 aa, Homo Sapiens
GPAGLTGPA

SEQ ID NO: 980861 - protein, 9 aa, Homo Sapiens
SEKICIRKK

SEQ ID NO: 980862 - protein, 9 aa, Homo Sapiens
KSKRPRKNV

SEQ ID NO: 980863 - protein, 9 aa, Homo Sapiens
LNEGTNKAI

SEQ ID NO: 980864 - protein, 9 aa, Homo Sapiens
LDGTFQGGG

SEQ ID NO: 980865 - protein, 9 aa, Homo Sapiens
AQPTHHPVS

SEQ ID NO: 980866 - protein, 9 aa, Homo Sapiens
YALKDTVEE

SEQ ID NO: 980867 - protein, 9 aa, Homo Sapiens
IVKKLAVSP

SEQ ID NO: 980868 - protein, 9 aa, Homo Sapiens
LLLRCPFCT

SEQ ID NO: 980869 - protein, 9 aa, Homo Sapiens
SSTTLQSQM

SEQ ID NO: 980870 - protein, 9 aa, Homo Sapiens
AYANDKFTL

SEQ ID NO: 980871 - protein, 9 aa, Homo Sapiens
NIALKVFFF

SEQ ID NO: 980872 - protein, 9 aa, Homo Sapiens
ETGFGQIRY

SEQ ID NO: 980873 - protein, 9 aa, Homo Sapiens
CIHISLANV

SEQ ID NO: 980874 - protein, 9 aa, Homo Sapiens
YVENRPKNA

SEQ ID NO: 980875 - protein, 9 aa, Homo Sapiens
KMLSALIGH

SEQ ID NO: 980876 - protein, 9 aa, Homo Sapiens
GARASGFLR

SEQ ID NO: 980877 - protein, 9 aa, Homo Sapiens
VSSFSSRKM

SEQ ID NO: 980878 - protein, 9 aa, Homo Sapiens
ERDPRIPGR

SEQ ID NO: 980879 - protein, 9 aa, Homo Sapiens
CDTQIIYDM

SEQ ID NO: 980880 - protein, 9 aa, Homo Sapiens
KGKEGKEIK

SEQ ID NO: 980881 - protein, 9 aa, Homo Sapiens
GMGVSTMTA

SEQ ID NO: 980882 - protein, 9 aa, Homo Sapiens
PTWKKSCFL

SEQ ID NO: 980883 - protein, 9 aa, Homo Sapiens
SDFCSPRSL

SEQ ID NO: 980884 - protein, 9 aa, Homo Sapiens
VLEQQRFGR

SEQ ID NO: 980885 - protein, 9 aa, Homo Sapiens
KNVQKMSQA

SEQ ID NO: 980886 - protein, 9 aa, Homo Sapiens
AEGHKASCC

SEQ ID NO: 980887 - protein, 9 aa, Homo Sapiens
LSSVSQLLS

SEQ ID NO: 980888 - protein, 9 aa, Homo Sapiens
VDAQVQKLF

SEQ ID NO: 980889 - protein, 9 aa, Homo Sapiens
GCPSPDIPS

SEQ ID NO: 980890 - protein, 9 aa, Homo Sapiens
MNYIVSTWS

SEQ ID NO: 980891 - protein, 9 aa, Homo Sapiens
LVGRCSVPE

SEQ ID NO: 980892 - protein, 9 aa, Homo Sapiens
SLQPETGSG

SEQ ID NO: 980893 - protein, 9 aa, Homo Sapiens
NSYGRKSEE

SEQ ID NO: 980894 - protein, 9 aa, Homo Sapiens
ETLVRAAVR

SEQ ID NO: 980895 - protein, 9 aa, Homo Sapiens
EETEKNIEQ

SEQ ID NO: 980896 - protein, 9 aa, Homo Sapiens
TVIKLNASN

SEQ ID NO: 980897 - protein, 9 aa, Homo Sapiens
LDFHFPLEG

SEQ ID NO: 980898 - protein, 9 aa, Homo Sapiens
ENLVIITVV

SEQ ID NO: 980899 - protein, 9 aa, Homo Sapiens
CAPCQPCSS

SEQ ID NO: 980900 - protein, 9 aa, Homo Sapiens
SRSGTALVR

SEQ ID NO: 980901 - protein, 9 aa, Homo Sapiens
NRKRPAREN

SEQ ID NO: 980902 - protein, 9 aa, Homo Sapiens
EKLVSESSD

SEQ ID NO: 980903 - protein, 9 aa, Homo Sapiens
IPGRMLPTR

SEQ ID NO: 980904 - protein, 9 aa, Homo Sapiens
YRIKVTHDH

SEQ ID NO: 980905 - protein, 9 aa, Homo Sapiens
GHLTDSSEE

SEQ ID NO: 980906 - protein, 9 aa, Homo Sapiens
LDTAGREEY

SEQ ID NO: 980907 - protein, 9 aa, Homo Sapiens
SLQVLTEMD

SEQ ID NO: 980908 - protein, 9 aa, Homo Sapiens
HIHEVQKFL

SEQ ID NO: 980909 - protein, 9 aa, Homo Sapiens
KIRAMYADL

SEQ ID NO: 980910 - protein, 9 aa, Homo Sapiens
SQEKMLSAL

SEQ ID NO: 980911 - protein, 9 aa, Homo Sapiens
RTILKISSM

SEQ ID NO: 980912 - protein, 9 aa, Homo Sapiens
KKMTDGGVD

SEQ ID NO: 980913 - protein, 9 aa, Homo Sapiens
GNTYRPKRP

SEQ ID NO: 980914 - protein, 9 aa, Homo Sapiens
KLRRNIVPE

SEQ ID NO: 980915 - protein, 9 aa, Homo Sapiens
FVLTIPFLL

SEQ ID NO: 980916 - protein, 9 aa, Homo Sapiens
NMNNCFLIL

SEQ ID NO: 980917 - protein, 9 aa, Homo Sapiens
SASLNREGI

SEQ ID NO: 980918 - protein, 9 aa, Homo Sapiens
LYRDVTLEI

SEQ ID NO: 980919 - protein, 9 aa, Homo Sapiens
NPFSQVSTG

SEQ ID NO: 980920 - protein, 9 aa, Homo Sapiens
GCSQHESGS

SEQ ID NO: 980921 - protein, 9 aa, Homo Sapiens
SPNVADQPP

SEQ ID NO: 980922 - protein, 9 aa, Homo Sapiens
HLTAHKRIY

SEQ ID NO: 980923 - protein, 9 aa, Homo Sapiens
CQKFLLKGF

SEQ ID NO: 980924 - protein, 9 aa, Homo Sapiens
SKRHLFEKK

SEQ ID NO: 980925 - protein, 9 aa, Homo Sapiens
SSPTESPHF

SEQ ID NO: 980926 - protein, 9 aa, Homo Sapiens
SVDNNEFNI

SEQ ID NO: 980927 - protein, 9 aa, Homo Sapiens
LLYKTLINF

SEQ ID NO: 980928 - protein, 9 aa, Homo Sapiens
SPETLILDK

SEQ ID NO: 980929 - protein, 9 aa, Homo Sapiens
KEELPPPPA

SEQ ID NO: 980930 - protein, 9 aa, Homo Sapiens
YPNGGDQET

SEQ ID NO: 980931 - protein, 9 aa, Homo Sapiens
SLVPSETYQ

SEQ ID NO: 980932 - protein, 9 aa, Homo Sapiens
EKAGPILTN

SEQ ID NO: 980933 - protein, 9 aa, Homo Sapiens
GLALIAYPK

SEQ ID NO: 980934 - protein, 9 aa, Homo Sapiens
SRLFHCHGG

SEQ ID NO: 980935 - protein, 9 aa, Homo Sapiens
VSISIKCAP

SEQ ID NO: 980936 - protein, 9 aa, Homo Sapiens
ELFFEIGAI

SEQ ID NO: 980937 - protein, 9 aa, Homo Sapiens
AERDPRIPG

SEQ ID NO: 980938 - protein, 9 aa, Homo Sapiens
RGVLPRAGR

SEQ ID NO: 980939 - protein, 9 aa, Homo Sapiens
EGHKASCCL

SEQ ID NO: 980940 - protein, 9 aa, Homo Sapiens
VEENLGMVM

SEQ ID NO: 980941 - protein, 9 aa, Homo Sapiens
SHSGLAPDV

SEQ ID NO: 980942 - protein, 9 aa, Homo Sapiens
ERIVDEDYY

SEQ ID NO: 980943 - protein, 9 aa, Homo Sapiens
CTDLLPTSI

SEQ ID NO: 980944 - protein, 9 aa, Homo Sapiens
TENKSKFGV

SEQ ID NO: 980945 - protein, 9 aa, Homo Sapiens
EMHVNNGVK

SEQ ID NO: 980946 - protein, 9 aa, Homo Sapiens
AGLTGPAGE

SEQ ID NO: 980947 - protein, 9 aa, Homo Sapiens
DGDSKNINQ

SEQ ID NO: 980948 - protein, 9 aa, Homo Sapiens
KIFEKPLEK

SEQ ID NO: 980949 - protein, 9 aa, Homo Sapiens
VKSVDNNEF

SEQ ID NO: 980950 - protein, 9 aa, Homo Sapiens
KKKFQGKWT

SEQ ID NO: 980951 - protein, 9 aa, Homo Sapiens
PPARLPTTE

SEQ ID NO: 980952 - protein, 9 aa, Homo Sapiens
SQVLDSPFS

SEQ ID NO: 980953 - protein, 9 aa, Homo Sapiens
LSKCDADHS

SEQ ID NO: 980954 - protein, 9 aa, Homo Sapiens
VESNSYGRK

SEQ ID NO: 980955 - protein, 9 aa, Homo Sapiens
FYSACCGGF

SEQ ID NO: 980956 - protein, 9 aa, Homo Sapiens
FRCNFAPTK

SEQ ID NO: 980957 - protein, 9 aa, Homo Sapiens
VVPKTVKPR

SEQ ID NO: 980958 - protein, 9 aa, Homo Sapiens
SSESENNVE

SEQ ID NO: 980959 - protein, 9 aa, Homo Sapiens
QTTRTSAIF

SEQ ID NO: 980960 - protein, 9 aa, Homo Sapiens
EQQRFGRLV

SEQ ID NO: 980961 - protein, 9 aa, Homo Sapiens
TTSAKTSSS

SEQ ID NO: 980962 - protein, 9 aa, Homo Sapiens
YYLTEVDTM

SEQ ID NO: 980963 - protein, 9 aa, Homo Sapiens
ANGNFLKAC

SEQ ID NO: 980964 - protein, 9 aa, Homo Sapiens
FQADHVSKV

SEQ ID NO: 980965 - protein, 9 aa, Homo Sapiens
SESIHVILN

SEQ ID NO: 980966 - protein, 9 aa, Homo Sapiens
QRFPVQALQ

SEQ ID NO: 980967 - protein, 9 aa, Homo Sapiens
VTSVESNSY

SEQ ID NO: 980968 - protein, 9 aa, Homo Sapiens
ILSFILCIF

SEQ ID NO: 980969 - protein, 9 aa, Homo Sapiens
RKFSRTVQD

SEQ ID NO: 980970 - protein, 9 aa, Homo Sapiens
ASKRDRKER

SEQ ID NO: 980971 - protein, 9 aa, Homo Sapiens
PVRPIASTA

SEQ ID NO: 980972 - protein, 9 aa, Homo Sapiens
LVCSSALES

SEQ ID NO: 980973 - protein, 9 aa, Homo Sapiens
QYPRLEVVL

SEQ ID NO: 980974 - protein, 9 aa, Homo Sapiens
NNCFLILKF

SEQ ID NO: 980975 - protein, 9 aa, Homo Sapiens
GSKGDQGQT

SEQ ID NO: 980976 - protein, 9 aa, Homo Sapiens
TDSSTGVEL

SEQ ID NO: 980977 - protein, 9 aa, Homo Sapiens
PGPLRPMKE

SEQ ID NO: 980978 - protein, 9 aa, Homo Sapiens
GTSDSYVKV

SEQ ID NO: 980979 - protein, 9 aa, Homo Sapiens
NFSWMESSR

SEQ ID NO: 980980 - protein, 9 aa, Homo Sapiens
FSFPGLFSS

SEQ ID NO: 980981 - protein, 9 aa, Homo Sapiens
QGGFDTSIL

SEQ ID NO: 980982 - protein, 9 aa, Homo Sapiens
SNKRSFILT

SEQ ID NO: 980983 - protein, 9 aa, Homo Sapiens
NILIVNLFF

SEQ ID NO: 980984 - protein, 9 aa, Homo Sapiens
LKGFRCQTC

SEQ ID NO: 980985 - protein, 9 aa, Homo Sapiens
LGQHKNIVN

SEQ ID NO: 980986 - protein, 9 aa, Homo Sapiens
DDFDSYHQR

SEQ ID NO: 980987 - protein, 9 aa, Homo Sapiens
DNFNSLQVK

SEQ ID NO: 980988 - protein, 9 aa, Homo Sapiens
LALLRKVAR

SEQ ID NO: 980989 - protein, 9 aa, Homo Sapiens
APCQPCSSS

SEQ ID NO: 980990 - protein, 9 aa, Homo Sapiens
QERRGEPRD

SEQ ID NO: 980991 - protein, 9 aa, Homo Sapiens
NKSKFGVNA

SEQ ID NO: 980992 - protein, 9 aa, Homo Sapiens
EYQGIPSIN

SEQ ID NO: 980993 - protein, 9 aa, Homo Sapiens
VSESAPLDF

SEQ ID NO: 980994 - protein, 9 aa, Homo Sapiens
CCVSQEKML

SEQ ID NO: 980995 - protein, 9 aa, Homo Sapiens
ENMAHCEFS

SEQ ID NO: 980996 - protein, 9 aa, Homo Sapiens
PTSASLNRE

SEQ ID NO: 980997 - protein, 9 aa, Homo Sapiens
ENRPKNAGY

SEQ ID NO: 980998 - protein, 9 aa, Homo Sapiens
GEGRGFEIF

SEQ ID NO: 980999 - protein, 9 aa, Homo Sapiens
PNGGDQETA

SEQ ID NO: 981000 - protein, 9 aa, Homo Sapiens
MVFRPKPPL

SEQ ID NO: 981001 - protein, 9 aa, Homo Sapiens
WEQRQLQKK

SEQ ID NO: 981002 - protein, 9 aa, Homo Sapiens
PASELHTRL

SEQ ID NO: 981003 - protein, 9 aa, Homo Sapiens
RVCRALLRE

SEQ ID NO: 981004 - protein, 9 aa, Homo Sapiens
DENSSSTNF

SEQ ID NO: 981005 - protein, 9 aa, Homo Sapiens
PTKAFQRDV

SEQ ID NO: 981006 - protein, 9 aa, Homo Sapiens
QLGLSRSVP

SEQ ID NO: 981007 - protein, 9 aa, Homo Sapiens
RKRPARENC

SEQ ID NO: 981008 - protein, 9 aa, Homo Sapiens
CHENQTESH

SEQ ID NO: 981009 - protein, 9 aa, Homo Sapiens
GVPKPGSPR

SEQ ID NO: 981010 - protein, 9 aa, Homo Sapiens
VWHRFWIYF

SEQ ID NO: 981011 - protein, 9 aa, Homo Sapiens
IFLFTLLKS

SEQ ID NO: 981012 - protein, 9 aa, Homo Sapiens
LKPVSADQM

SEQ ID NO: 981013 - protein, 9 aa, Homo Sapiens
PLRFFIVSS

SEQ ID NO: 981014 - protein, 9 aa, Homo Sapiens
HITFLQRVK

SEQ ID NO: 981015 - protein, 9 aa, Homo Sapiens
EIFYSLFQA

SEQ ID NO: 981016 - protein, 9 aa, Homo Sapiens
EVIPMTGEV

SEQ ID NO: 981017 - protein, 9 aa, Homo Sapiens
GVNAILGVS

SEQ ID NO: 981018 - protein, 9 aa, Homo Sapiens
LAQNARPIT

SEQ ID NO: 981019 - protein, 9 aa, Homo Sapiens
KILWACQLF

SEQ ID NO: 981020 - protein, 9 aa, Homo Sapiens
LAPSPQLPE

SEQ ID NO: 981021 - protein, 9 aa, Homo Sapiens
CPIHRCGAW

SEQ ID NO: 981022 - protein, 9 aa, Homo Sapiens
FSSVFHIVV

SEQ ID NO: 981023 - protein, 9 aa, Homo Sapiens
FRLFDDNET

SEQ ID NO: 981024 - protein, 9 aa, Homo Sapiens
FTVTDLKIR

SEQ ID NO: 981025 - protein, 9 aa, Homo Sapiens
KNKLHSLSK

SEQ ID NO: 981026 - protein, 9 aa, Homo Sapiens
YSHPFGGAL

SEQ ID NO: 981027 - protein, 9 aa, Homo Sapiens
RRRKFSRTV

SEQ ID NO: 981028 - protein, 9 aa, Homo Sapiens
RDVALVITK

SEQ ID NO: 981029 - protein, 9 aa, Homo Sapiens
NKMRVTEYL

SEQ ID NO: 981030 - protein, 9 aa, Homo Sapiens
SSSPNLTSL

SEQ ID NO: 981031 - protein, 9 aa, Homo Sapiens
WACQLFHRI

SEQ ID NO: 981032 - protein, 9 aa, Homo Sapiens
FGFTLLDDY

SEQ ID NO: 981033 - protein, 9 aa, Homo Sapiens
KERAGVMSV

SEQ ID NO: 981034 - protein, 9 aa, Homo Sapiens
YCGQERRGE

SEQ ID NO: 981035 - protein, 9 aa, Homo Sapiens
QLLSTVVAH

SEQ ID NO: 981036 - protein, 9 aa, Homo Sapiens
SPTKQKSSI

SEQ ID NO: 981037 - protein, 9 aa, Homo Sapiens
NGNFLKACE

SEQ ID NO: 981038 - protein, 9 aa, Homo Sapiens
VAVEQKGFQ

SEQ ID NO: 981039 - protein, 9 aa, Homo Sapiens
TKGKRFPKD

SEQ ID NO: 981040 - protein, 9 aa, Homo Sapiens
WKKSCFLEG

SEQ ID NO: 981041 - protein, 9 aa, Homo Sapiens
AEETEKNIE

SEQ ID NO: 981042 - protein, 9 aa, Homo Sapiens
AGPSGESGR

SEQ ID NO: 981043 - protein, 9 aa, Homo Sapiens
RYALKDTVE

SEQ ID NO: 981044 - protein, 9 aa, Homo Sapiens
GFMKSAIFI

SEQ ID NO: 981045 - protein, 9 aa, Homo Sapiens
KTLEVIPMT

SEQ ID NO: 981046 - protein, 9 aa, Homo Sapiens
GSSQSSGCS

SEQ ID NO: 981047 - protein, 9 aa, Homo Sapiens
FFLLNTVSV

SEQ ID NO: 981048 - protein, 9 aa, Homo Sapiens
LTGEQTKKM

SEQ ID NO: 981049 - protein, 9 aa, Homo Sapiens
VSTMTAARI

SEQ ID NO: 981050 - protein, 9 aa, Homo Sapiens
IALSIILVC

SEQ ID NO: 981051 - protein, 9 aa, Homo Sapiens
VNGKEFSEN

SEQ ID NO: 981052 - protein, 9 aa, Homo Sapiens
EKNSTLPNS

SEQ ID NO: 981053 - protein, 9 aa, Homo Sapiens
HRGGKEIEK

SEQ ID NO: 981054 - protein, 9 aa, Homo Sapiens
KFLVLFSFD

SEQ ID NO: 981055 - protein, 9 aa, Homo Sapiens
ARTSQQKMG

SEQ ID NO: 981056 - protein, 9 aa, Homo Sapiens
LFHCHGGPG

SEQ ID NO: 981057 - protein, 9 aa, Homo Sapiens
KMTDGGVDF

SEQ ID NO: 981058 - protein, 9 aa, Homo Sapiens
TLLDDYVYW

SEQ ID NO: 981059 - protein, 9 aa, Homo Sapiens
LTTTEAQTT

SEQ ID NO: 981060 - protein, 9 aa, Homo Sapiens
KFQGKWTVS

SEQ ID NO: 981061 - protein, 9 aa, Homo Sapiens
IPSINQAKD

SEQ ID NO: 981062 - protein, 9 aa, Homo Sapiens
QPLPGVLLF

SEQ ID NO: 981063 - protein, 9 aa, Homo Sapiens
KSVDNNEFN

SEQ ID NO: 981064 - protein, 9 aa, Homo Sapiens
YYEGSWGTI

SEQ ID NO: 981065 - protein, 9 aa, Homo Sapiens
ALYFLKNGD

SEQ ID NO: 981066 - protein, 9 aa, Homo Sapiens
MLSLGESEH

SEQ ID NO: 981067 - protein, 9 aa, Homo Sapiens
QKLKQEAQK

SEQ ID NO: 981068 - protein, 9 aa, Homo Sapiens
FEDNANYVY

SEQ ID NO: 981069 - protein, 9 aa, Homo Sapiens
LSVRENSVP

SEQ ID NO: 981070 - protein, 9 aa, Homo Sapiens
REFCGLPCL

SEQ ID NO: 981071 - protein, 9 aa, Homo Sapiens
WVKPIIIGC

SEQ ID NO: 981072 - protein, 9 aa, Homo Sapiens
LLLTYYDAS

SEQ ID NO: 981073 - protein, 9 aa, Homo Sapiens
PPLLKTPRG

SEQ ID NO: 981074 - protein, 9 aa, Homo Sapiens
PVTTDQPFS

SEQ ID NO: 981075 - protein, 9 aa, Homo Sapiens
AFIIILTID

SEQ ID NO: 981076 - protein, 9 aa, Homo Sapiens
KKLSLHSQG

SEQ ID NO: 981077 - protein, 9 aa, Homo Sapiens
ASKPLTLIN

SEQ ID NO: 981078 - protein, 9 aa, Homo Sapiens
KAYYQGAQA

SEQ ID NO: 981079 - protein, 9 aa, Homo Sapiens
GLYMDEKGD

SEQ ID NO: 981080 - protein, 9 aa, Homo Sapiens
GHQPLDKKR

SEQ ID NO: 981081 - protein, 9 aa, Homo Sapiens
AWRGIVWHR

SEQ ID NO: 981082 - protein, 9 aa, Homo Sapiens
RASGFLRKG

SEQ ID NO: 981083 - protein, 9 aa, Homo Sapiens
LDILDTAGR

SEQ ID NO: 981084 - protein, 9 aa, Homo Sapiens
SESSWNKSR

SEQ ID NO: 981085 - protein, 9 aa, Homo Sapiens
TARWGPGES

SEQ ID NO: 981086 - protein, 9 aa, Homo Sapiens
SHLIQLGLS

SEQ ID NO: 981087 - protein, 9 aa, Homo Sapiens
QAFVPEIFY

SEQ ID NO: 981088 - protein, 9 aa, Homo Sapiens
SMDGHACPL

SEQ ID NO: 981089 - protein, 9 aa, Homo Sapiens
FRKETTQPQ

SEQ ID NO: 981090 - protein, 9 aa, Homo Sapiens
NYSVEDIEP

SEQ ID NO: 981091 - protein, 9 aa, Homo Sapiens
DFHFPLEGA

SEQ ID NO: 981092 - protein, 9 aa, Homo Sapiens
ASQSLDGTF

SEQ ID NO: 981093 - protein, 9 aa, Homo Sapiens
DKNSFLREV

SEQ ID NO: 981094 - protein, 9 aa, Homo Sapiens
FYSLTLMEN

SEQ ID NO: 981095 - protein, 9 aa, Homo Sapiens
YSLDKLLDR

SEQ ID NO: 981096 - protein, 9 aa, Homo Sapiens
RICLGSSTD

SEQ ID NO: 981097 - protein, 9 aa, Homo Sapiens
PSCLCFVQT

SEQ ID NO: 981098 - protein, 9 aa, Homo Sapiens
FCCVSQEKM

SEQ ID NO: 981099 - protein, 9 aa, Homo Sapiens
PKDGSTLGP

SEQ ID NO: 981100 - protein, 9 aa, Homo Sapiens
DRLEEVTNK

SEQ ID NO: 981101 - protein, 9 aa, Homo Sapiens
KKISKDQKS

SEQ ID NO: 981102 - protein, 9 aa, Homo Sapiens
PCIHISLAN

SEQ ID NO: 981103 - protein, 9 aa, Homo Sapiens
FHFPFIVEN

SEQ ID NO: 981104 - protein, 9 aa, Homo Sapiens
IWSAGCCCQ

SEQ ID NO: 981105 - protein, 9 aa, Homo Sapiens
GGLSVGLFF

SEQ ID NO: 981106 - protein, 9 aa, Homo Sapiens
YVKEKLWYN

SEQ ID NO: 981107 - protein, 9 aa, Homo Sapiens
RAQASNAQE

SEQ ID NO: 981108 - protein, 9 aa, Homo Sapiens
GPFSLDHEF

SEQ ID NO: 981109 - protein, 9 aa, Homo Sapiens
LPPPEASIH

SEQ ID NO: 981110 - protein, 9 aa, Homo Sapiens
DSKNINQLI

SEQ ID NO: 981111 - protein, 9 aa, Homo Sapiens
CLQQSRKMG

SEQ ID NO: 981112 - protein, 9 aa, Homo Sapiens
KQIVDGKMT

SEQ ID NO: 981113 - protein, 9 aa, Homo Sapiens
RRVKANAKE

SEQ ID NO: 981114 - protein, 9 aa, Homo Sapiens
LLREGVRGG

SEQ ID NO: 981115 - protein, 9 aa, Homo Sapiens
PRQDSRTDT

SEQ ID NO: 981116 - protein, 9 aa, Homo Sapiens
RVGRWAEKT

SEQ ID NO: 981117 - protein, 9 aa, Homo Sapiens
GSMSWIFCR

SEQ ID NO: 981118 - protein, 9 aa, Homo Sapiens
LNYSVEDIE

SEQ ID NO: 981119 - protein, 9 aa, Homo Sapiens
ASQPQLDFQ

SEQ ID NO: 981120 - protein, 9 aa, Homo Sapiens
KDLAQQNLI

SEQ ID NO: 981121 - protein, 9 aa, Homo Sapiens
VNGFVHVSS

SEQ ID NO: 981122 - protein, 9 aa, Homo Sapiens
NREGISQAP

SEQ ID NO: 981123 - protein, 9 aa, Homo Sapiens
LEEGLCEAS

SEQ ID NO: 981124 - protein, 9 aa, Homo Sapiens
KDGTVCGSE

SEQ ID NO: 981125 - protein, 9 aa, Homo Sapiens
GIGDCFKIE

SEQ ID NO: 981126 - protein, 9 aa, Homo Sapiens
TVVILSFIL

SEQ ID NO: 981127 - protein, 9 aa, Homo Sapiens
PAPPARLPT

SEQ ID NO: 981128 - protein, 9 aa, Homo Sapiens
FALLVTLIF

SEQ ID NO: 981129 - protein, 9 aa, Homo Sapiens
LPEGRQEFV

SEQ ID NO: 981130 - protein, 9 aa, Homo Sapiens
SVAQPVRPI

SEQ ID NO: 981131 - protein, 9 aa, Homo Sapiens
KMGLELPNQ

SEQ ID NO: 981132 - protein, 9 aa, Homo Sapiens
KPYNLILGE

SEQ ID NO: 981133 - protein, 9 aa, Homo Sapiens
VEGEGVASR

SEQ ID NO: 981134 - protein, 9 aa, Homo Sapiens
RALFGALGV

SEQ ID NO: 981135 - protein, 9 aa, Homo Sapiens
SPLVYTATS

SEQ ID NO: 981136 - protein, 9 aa, Homo Sapiens
KLKQEAQKN

SEQ ID NO: 981137 - protein, 9 aa, Homo Sapiens
VEFPAAFII

SEQ ID NO: 981138 - protein, 9 aa, Homo Sapiens
KMHKFEDRN

SEQ ID NO: 981139 - protein, 9 aa, Homo Sapiens
YEKRQKAPT

SEQ ID NO: 981140 - protein, 9 aa, Homo Sapiens
QIIYDMLLR

SEQ ID NO: 981141 - protein, 9 aa, Homo Sapiens
ISHEGVFED

SEQ ID NO: 981142 - protein, 9 aa, Homo Sapiens
VPLSPTRLA

SEQ ID NO: 981143 - protein, 9 aa, Homo Sapiens
FMKSAIFIA

SEQ ID NO: 981144 - protein, 9 aa, Homo Sapiens
DEDPQPVIS

SEQ ID NO: 981145 - protein, 9 aa, Homo Sapiens
NDKFTLSEQ

SEQ ID NO: 981146 - protein, 9 aa, Homo Sapiens
CKRKKKEEE

SEQ ID NO: 981147 - protein, 9 aa, Homo Sapiens
WHRFWIYFC

SEQ ID NO: 981148 - protein, 9 aa, Homo Sapiens
RSLVPSETY

SEQ ID NO: 981149 - protein, 9 aa, Homo Sapiens
AGPAGLTGP

SEQ ID NO: 981150 - protein, 9 aa, Homo Sapiens
GAGSRFGFG

SEQ ID NO: 981151 - protein, 9 aa, Homo Sapiens
PMVEGEGVA

SEQ ID NO: 981152 - protein, 9 aa, Homo Sapiens
YSMIEEYFQ

SEQ ID NO: 981153 - protein, 9 aa, Homo Sapiens
LHRDEERFF

SEQ ID NO: 981154 - protein, 9 aa, Homo Sapiens
TPSEQDKED

SEQ ID NO: 981155 - protein, 9 aa, Homo Sapiens
CAGRVEIYY

SEQ ID NO: 981156 - protein, 9 aa, Homo Sapiens
RKETTQPQV

SEQ ID NO: 981157 - protein, 9 aa, Homo Sapiens
KVDSRPPWG

SEQ ID NO: 981158 - protein, 9 aa, Homo Sapiens
PKTVKPRVI

SEQ ID NO: 981159 - protein, 9 aa, Homo Sapiens
ETTQPQVPS

SEQ ID NO: 981160 - protein, 9 aa, Homo Sapiens
SLDAETRSH

SEQ ID NO: 981161 - protein, 9 aa, Homo Sapiens
EKRQKAPTN

SEQ ID NO: 981162 - protein, 9 aa, Homo Sapiens
LFPMMGIVN

SEQ ID NO: 981163 - protein, 9 aa, Homo Sapiens
GIVVFKIRN

SEQ ID NO: 981164 - protein, 9 aa, Homo Sapiens
VHKNSRSDM

SEQ ID NO: 981165 - protein, 9 aa, Homo Sapiens
GLFFLLNTV

SEQ ID NO: 981166 - protein, 9 aa, Homo Sapiens
GTIVQEILQ

SEQ ID NO: 981167 - protein, 9 aa, Homo Sapiens
SQTGPKEKL

SEQ ID NO: 981168 - protein, 9 aa, Homo Sapiens
STSVLNNEF

SEQ ID NO: 981169 - protein, 9 aa, Homo Sapiens
NTDNSSPLT

SEQ ID NO: 981170 - protein, 9 aa, Homo Sapiens
DEKLVSESS

SEQ ID NO: 981171 - protein, 9 aa, Homo Sapiens
SKLIKNVQK

SEQ ID NO: 981172 - protein, 9 aa, Homo Sapiens
GPRGLLRPK

SEQ ID NO: 981173 - protein, 9 aa, Homo Sapiens
DIPSEPPPT

SEQ ID NO: 981174 - protein, 9 aa, Homo Sapiens
CRQSKINHI

SEQ ID NO: 981175 - protein, 9 aa, Homo Sapiens
AWLCELLRW

SEQ ID NO: 981176 - protein, 9 aa, Homo Sapiens
VFITVAPEE

SEQ ID NO: 981177 - protein, 9 aa, Homo Sapiens
NDNASQLTL

SEQ ID NO: 981178 - protein, 9 aa, Homo Sapiens
AAQFESARR

SEQ ID NO: 981179 - protein, 9 aa, Homo Sapiens
DQKVLSGHS

SEQ ID NO: 981180 - protein, 9 aa, Homo Sapiens
LSIPLMSGK

SEQ ID NO: 981181 - protein, 9 aa, Homo Sapiens
FSSGLYHRP

SEQ ID NO: 981182 - protein, 9 aa, Homo Sapiens
GWAMSAPEN

SEQ ID NO: 981183 - protein, 9 aa, Homo Sapiens
APSLQNCRY

SEQ ID NO: 981184 - protein, 9 aa, Homo Sapiens
NCINTLLQP

SEQ ID NO: 981185 - protein, 9 aa, Homo Sapiens
VAHSEREPG

SEQ ID NO: 981186 - protein, 9 aa, Homo Sapiens
QHMVFRPKP

SEQ ID NO: 981187 - protein, 9 aa, Homo Sapiens
CVNGRCDNT

SEQ ID NO: 981188 - protein, 9 aa, Homo Sapiens
INVPLQYGC

SEQ ID NO: 981189 - protein, 9 aa, Homo Sapiens
LVDEQLLEN

SEQ ID NO: 981190 - protein, 9 aa, Homo Sapiens
WGPGESADP

SEQ ID NO: 981191 - protein, 9 aa, Homo Sapiens
WNFIVMQRR

SEQ ID NO: 981192 - protein, 9 aa, Homo Sapiens
LTKHKKIYT

SEQ ID NO: 981193 - protein, 9 aa, Homo Sapiens
IVAWNHRDA

SEQ ID NO: 981194 - protein, 9 aa, Homo Sapiens
TASKSDAEV

SEQ ID NO: 981195 - protein, 9 aa, Homo Sapiens
QPSPETLIL

SEQ ID NO: 981196 - protein, 9 aa, Homo Sapiens
LLSTVVAHE

SEQ ID NO: 981197 - protein, 9 aa, Homo Sapiens
CICNPGYKR

SEQ ID NO: 981198 - protein, 9 aa, Homo Sapiens
SIKCAPGVV

SEQ ID NO: 981199 - protein, 9 aa, Homo Sapiens
RTIVKKLAV

SEQ ID NO: 981200 - protein, 9 aa, Homo Sapiens
FQKPVPKAA

SEQ ID NO: 981201 - protein, 9 aa, Homo Sapiens
GFVHVSSQD

SEQ ID NO: 981202 - protein, 9 aa, Homo Sapiens
FEKPLEKKA

SEQ ID NO: 981203 - protein, 9 aa, Homo Sapiens
CSADEDPQP

SEQ ID NO: 981204 - protein, 9 aa, Homo Sapiens
NLTSLATKA

SEQ ID NO: 981205 - protein, 9 aa, Homo Sapiens
KGLWIECAT

SEQ ID NO: 981206 - protein, 9 aa, Homo Sapiens
AKFKSLFKN

SEQ ID NO: 981207 - protein, 9 aa, Homo Sapiens
LLATARWGP

SEQ ID NO: 981208 - protein, 9 aa, Homo Sapiens
IMSHLGQHK

SEQ ID NO: 981209 - protein, 9 aa, Homo Sapiens
IDVNNEFEE

SEQ ID NO: 981210 - protein, 9 aa, Homo Sapiens
AIWKYLYLP

SEQ ID NO: 981211 - protein, 9 aa, Homo Sapiens
PIKIVPHVE

SEQ ID NO: 981212 - protein, 9 aa, Homo Sapiens
CGLPCLETP

SEQ ID NO: 981213 - protein, 9 aa, Homo Sapiens
LNFSWMESS

SEQ ID NO: 981214 - protein, 9 aa, Homo Sapiens
EITHLEFPR

SEQ ID NO: 981215 - protein, 9 aa, Homo Sapiens
LFLLFLEIY

SEQ ID NO: 981216 - protein, 9 aa, Homo Sapiens
TMNGLMLST

SEQ ID NO: 981217 - protein, 9 aa, Homo Sapiens
IKIVPHVEK

SEQ ID NO: 981218 - protein, 9 aa, Homo Sapiens
TNSTNIALK

SEQ ID NO: 981219 - protein, 9 aa, Homo Sapiens
KLSYTGHSS

SEQ ID NO: 981220 - protein, 9 aa, Homo Sapiens
FLEIYVVTV

SEQ ID NO: 981221 - protein, 9 aa, Homo Sapiens
PESSGGPVS

SEQ ID NO: 981222 - protein, 9 aa, Homo Sapiens
FSPEPITQP

SEQ ID NO: 981223 - protein, 9 aa, Homo Sapiens
PNLDEFVKP

SEQ ID NO: 981224 - protein, 9 aa, Homo Sapiens
RLGLDFRLG

SEQ ID NO: 981225 - protein, 9 aa, Homo Sapiens
ARWGPGESA

SEQ ID NO: 981226 - protein, 9 aa, Homo Sapiens
NHIYREETL

SEQ ID NO: 981227 - protein, 9 aa, Homo Sapiens
EFSLLRDLL

SEQ ID NO: 981228 - protein, 9 aa, Homo Sapiens
ERPRVSSSN

SEQ ID NO: 981229 - protein, 9 aa, Homo Sapiens
DSYVKVFLL

SEQ ID NO: 981230 - protein, 9 aa, Homo Sapiens
IKKFLWHIK

SEQ ID NO: 981231 - protein, 9 aa, Homo Sapiens
TGPDPLRAR

SEQ ID NO: 981232 - protein, 9 aa, Homo Sapiens
QDSFNTLKK

SEQ ID NO: 981233 - protein, 9 aa, Homo Sapiens
KDGSTLGPG

SEQ ID NO: 981234 - protein, 9 aa, Homo Sapiens
TEYLHLSSC

SEQ ID NO: 981235 - protein, 9 aa, Homo Sapiens
SRRVTKKNS

SEQ ID NO: 981236 - protein, 9 aa, Homo Sapiens
FLMFKPGRG

SEQ ID NO: 981237 - protein, 9 aa, Homo Sapiens
PMMGIVNAS

SEQ ID NO: 981238 - protein, 9 aa, Homo Sapiens
QSQGPGSGN

SEQ ID NO: 981239 - protein, 9 aa, Homo Sapiens
VGMKSIAFY

SEQ ID NO: 981240 - protein, 9 aa, Homo Sapiens
SGVGIGDCF

SEQ ID NO: 981241 - protein, 9 aa, Homo Sapiens
PEEKAGPIL

SEQ ID NO: 981242 - protein, 9 aa, Homo Sapiens
PVTTSAKTS

SEQ ID NO: 981243 - protein, 9 aa, Homo Sapiens
ATYLWWINN

SEQ ID NO: 981244 - protein, 9 aa, Homo Sapiens
IFQGRLGPG

SEQ ID NO: 981245 - protein, 9 aa, Homo Sapiens
EHKMVMIDV

SEQ ID NO: 981246 - protein, 9 aa, Homo Sapiens
ELVLWKARS

SEQ ID NO: 981247 - protein, 9 aa, Homo Sapiens
VTKKKFQGK

SEQ ID NO: 981248 - protein, 9 aa, Homo Sapiens
FSSGSCEKV

SEQ ID NO: 981249 - protein, 9 aa, Homo Sapiens
WAMSAPENA

SEQ ID NO: 981250 - protein, 9 aa, Homo Sapiens
PETLILDKK

SEQ ID NO: 981251 - protein, 9 aa, Homo Sapiens
HLGQHKNIV

SEQ ID NO: 981252 - protein, 9 aa, Homo Sapiens
QKLEAAEST

SEQ ID NO: 981253 - protein, 9 aa, Homo Sapiens
SGNTYRPKR

SEQ ID NO: 981254 - protein, 9 aa, Homo Sapiens
SLDGTFQGG

SEQ ID NO: 981255 - protein, 9 aa, Homo Sapiens
GGLNFSWME

SEQ ID NO: 981256 - protein, 9 aa, Homo Sapiens
KSSKNKLHS

SEQ ID NO: 981257 - protein, 9 aa, Homo Sapiens
KERSDRKYY

SEQ ID NO: 981258 - protein, 9 aa, Homo Sapiens
LWKARSLLY

SEQ ID NO: 981259 - protein, 9 aa, Homo Sapiens
CRDVALVIT

SEQ ID NO: 981260 - protein, 9 aa, Homo Sapiens
WIFCRGISG

SEQ ID NO: 981261 - protein, 9 aa, Homo Sapiens
WLLRETLVR

SEQ ID NO: 981262 - protein, 9 aa, Homo Sapiens
MMGIVNASE

SEQ ID NO: 981263 - protein, 9 aa, Homo Sapiens
SACCGGFCR

SEQ ID NO: 981264 - protein, 9 aa, Homo Sapiens
APSPQLPET

SEQ ID NO: 981265 - protein, 9 aa, Homo Sapiens
GVNMLSLGE

SEQ ID NO: 981266 - protein, 9 aa, Homo Sapiens
RIVDEDYYL

SEQ ID NO: 981267 - protein, 9 aa, Homo Sapiens
ILIVNLFFS

SEQ ID NO: 981268 - protein, 9 aa, Homo Sapiens
GCRQSKINH

SEQ ID NO: 981269 - protein, 9 aa, Homo Sapiens
FHFPLEGAS

SEQ ID NO: 981270 - protein, 9 aa, Homo Sapiens
VKDYNSPSE

SEQ ID NO: 981271 - protein, 9 aa, Homo Sapiens
LHTRLEECC

SEQ ID NO: 981272 - protein, 9 aa, Homo Sapiens
MVEGEGVAS

SEQ ID NO: 981273 - protein, 9 aa, Homo Sapiens
TSAKTSSSP

SEQ ID NO: 981274 - protein, 9 aa, Homo Sapiens
GFGEQGGSC

SEQ ID NO: 981275 - protein, 9 aa, Homo Sapiens
QEILQSQGQ

SEQ ID NO: 981276 - protein, 9 aa, Homo Sapiens
FCHRSDDPV

SEQ ID NO: 981277 - protein, 9 aa, Homo Sapiens
HLSSCVDSF

SEQ ID NO: 981278 - protein, 9 aa, Homo Sapiens
TDNSSPLTE

SEQ ID NO: 981279 - protein, 9 aa, Homo Sapiens
GCHAYGDQY

SEQ ID NO: 981280 - protein, 9 aa, Homo Sapiens
DSTEVLENI

SEQ ID NO: 981281 - protein, 9 aa, Homo Sapiens
ARRVKANAK

SEQ ID NO: 981282 - protein, 9 aa, Homo Sapiens
WEVCPQRFP

SEQ ID NO: 981283 - protein, 9 aa, Homo Sapiens
TVVAHEVPH

SEQ ID NO: 981284 - protein, 9 aa, Homo Sapiens
GGFCRRPAS

SEQ ID NO: 981285 - protein, 9 aa, Homo Sapiens
DFEADKDQH

SEQ ID NO: 981286 - protein, 9 aa, Homo Sapiens
GWPESSGGP

SEQ ID NO: 981287 - protein, 9 aa, Homo Sapiens
ATVTAVDLN

SEQ ID NO: 981288 - protein, 9 aa, Homo Sapiens
AKTSSSPTT

SEQ ID NO: 981289 - protein, 9 aa, Homo Sapiens
LRFYQLIFR

SEQ ID NO: 981290 - protein, 9 aa, Homo Sapiens
SIQPSFCHR

SEQ ID NO: 981291 - protein, 9 aa, Homo Sapiens
NTAQGGFDT

SEQ ID NO: 981292 - protein, 9 aa, Homo Sapiens
SQHESGSGP

SEQ ID NO: 981293 - protein, 9 aa, Homo Sapiens
FPGLFSSGL

SEQ ID NO: 981294 - protein, 9 aa, Homo Sapiens
EYNVIITAT

SEQ ID NO: 981295 - protein, 9 aa, Homo Sapiens
RLNIAIFFR

SEQ ID NO: 981296 - protein, 9 aa, Homo Sapiens
APEDRILLC

SEQ ID NO: 981297 - protein, 9 aa, Homo Sapiens
GCDTQIIYD

SEQ ID NO: 981298 - protein, 9 aa, Homo Sapiens
LQVEENLGM

SEQ ID NO: 981299 - protein, 9 aa, Homo Sapiens
FSAEAARRL

SEQ ID NO: 981300 - protein, 9 aa, Homo Sapiens
APVPEVAQP

SEQ ID NO: 981301 - protein, 9 aa, Homo Sapiens
VSGPCHENQ

SEQ ID NO: 981302 - protein, 9 aa, Homo Sapiens
TLYSHPFGG

SEQ ID NO: 981303 - protein, 9 aa, Homo Sapiens
QKDPAPEIP

SEQ ID NO: 981304 - protein, 9 aa, Homo Sapiens
FLLKGFRCQ

SEQ ID NO: 981305 - protein, 9 aa, Homo Sapiens
VKVGNKFVT

SEQ ID NO: 981306 - protein, 9 aa, Homo Sapiens
LHLSSCVDS

SEQ ID NO: 981307 - protein, 9 aa, Homo Sapiens
MCPIHRCGA

SEQ ID NO: 981308 - protein, 9 aa, Homo Sapiens
LPLFLLFLE

SEQ ID NO: 981309 - protein, 9 aa, Homo Sapiens
NCRGLTGPL

SEQ ID NO: 981310 - protein, 9 aa, Homo Sapiens
RSRAALVGR

SEQ ID NO: 981311 - protein, 9 aa, Homo Sapiens
SVRENSVPT

SEQ ID NO: 981312 - protein, 9 aa, Homo Sapiens
QTKLSNIQK

SEQ ID NO: 981313 - protein, 9 aa, Homo Sapiens
HWYWQLEKE

SEQ ID NO: 981314 - protein, 9 aa, Homo Sapiens
DTHRMVVKI

SEQ ID NO: 981315 - protein, 9 aa, Homo Sapiens
NFAPTKAFQ

SEQ ID NO: 981316 - protein, 9 aa, Homo Sapiens
SELHTRLEE

SEQ ID NO: 981317 - protein, 9 aa, Homo Sapiens
TKLSNIQKR

SEQ ID NO: 981318 - protein, 9 aa, Homo Sapiens
CEWLLRETL

SEQ ID NO: 981319 - protein, 9 aa, Homo Sapiens
VICKPRQDS

SEQ ID NO: 981320 - protein, 9 aa, Homo Sapiens
KVANLAIGK

SEQ ID NO: 981321 - protein, 9 aa, Homo Sapiens
LTAPEKDEE

SEQ ID NO: 981322 - protein, 9 aa, Homo Sapiens
LGIANLLLA

SEQ ID NO: 981323 - protein, 9 aa, Homo Sapiens
IFWEVFYEL

SEQ ID NO: 981324 - protein, 9 aa, Homo Sapiens
PEKDEEMAP

SEQ ID NO: 981325 - protein, 9 aa, Homo Sapiens
EEPEEDGEG

SEQ ID NO: 981326 - protein, 9 aa, Homo Sapiens
SSSHEALRC

SEQ ID NO: 981327 - protein, 9 aa, Homo Sapiens
NFLFLFLLP

SEQ ID NO: 981328 - protein, 9 aa, Homo Sapiens
SHNEVLRVK

SEQ ID NO: 981329 - protein, 9 aa, Homo Sapiens
EPGKKGKEG

SEQ ID NO: 981330 - protein, 9 aa, Homo Sapiens
DEVESEKWC

SEQ ID NO: 981331 - protein, 9 aa, Homo Sapiens
LAPDVPAVS

SEQ ID NO: 981332 - protein, 9 aa, Homo Sapiens
YMVTMFPRV

SEQ ID NO: 981333 - protein, 9 aa, Homo Sapiens
PPCQTKLSN

SEQ ID NO: 981334 - protein, 9 aa, Homo Sapiens
SIRSRNKAR

SEQ ID NO: 981335 - protein, 9 aa, Homo Sapiens
LLFLEIYVV

SEQ ID NO: 981336 - protein, 9 aa, Homo Sapiens
IICVYFKPP

SEQ ID NO: 981337 - protein, 9 aa, Homo Sapiens
EKKLAGQSR

SEQ ID NO: 981338 - protein, 9 aa, Homo Sapiens
GSDYFFTQV

SEQ ID NO: 981339 - protein, 9 aa, Homo Sapiens
LYPAFPTDS

SEQ ID NO: 981340 - protein, 9 aa, Homo Sapiens
FCRNYLENI

SEQ ID NO: 981341 - protein, 9 aa, Homo Sapiens
KLAGQSRAE

SEQ ID NO: 981342 - protein, 9 aa, Homo Sapiens
TKLISDIRY

SEQ ID NO: 981343 - protein, 9 aa, Homo Sapiens
LTAHKRIYT

SEQ ID NO: 981344 - protein, 9 aa, Homo Sapiens
SEREPGSPP

SEQ ID NO: 981345 - protein, 9 aa, Homo Sapiens
SNYPTISRP

SEQ ID NO: 981346 - protein, 9 aa, Homo Sapiens
LMENGIILG

SEQ ID NO: 981347 - protein, 9 aa, Homo Sapiens
TYEPGTTIF

SEQ ID NO: 981348 - protein, 9 aa, Homo Sapiens
LGRVRQKLE

SEQ ID NO: 981349 - protein, 9 aa, Homo Sapiens
WAGGNAKFK

SEQ ID NO: 981350 - protein, 9 aa, Homo Sapiens
RLAQNARPI

SEQ ID NO: 981351 - protein, 9 aa, Homo Sapiens
GISLSKQEA

SEQ ID NO: 981352 - protein, 9 aa, Homo Sapiens
DQPPSPGGK

SEQ ID NO: 981353 - protein, 9 aa, Homo Sapiens
PKNAGYSFE

SEQ ID NO: 981354 - protein, 9 aa, Homo Sapiens
HQRQLNPNI

SEQ ID NO: 981355 - protein, 9 aa, Homo Sapiens
HVNNGVKYS

SEQ ID NO: 981356 - protein, 9 aa, Homo Sapiens
ATKYRFKYV

SEQ ID NO: 981357 - protein, 9 aa, Homo Sapiens
VADQPPSPG

SEQ ID NO: 981358 - protein, 9 aa, Homo Sapiens
GVPCPEEKF

SEQ ID NO: 981359 - protein, 9 aa, Homo Sapiens
NKSGYVDVL

SEQ ID NO: 981360 - protein, 9 aa, Homo Sapiens
NMILCQTHY

SEQ ID NO: 981361 - protein, 9 aa, Homo Sapiens
EPRGGRPFQ

SEQ ID NO: 981362 - protein, 9 aa, Homo Sapiens
EIIYRDLKP

SEQ ID NO: 981363 - protein, 9 aa, Homo Sapiens
ENSLLCSYG

SEQ ID NO: 981364 - protein, 9 aa, Homo Sapiens
LIFRRSPSQ

SEQ ID NO: 981365 - protein, 9 aa, Homo Sapiens
ILLVVCLDS

SEQ ID NO: 981366 - protein, 9 aa, Homo Sapiens
ARLRSIFPE

SEQ ID NO: 981367 - protein, 9 aa, Homo Sapiens
PLPGVLLFL

SEQ ID NO: 981368 - protein, 9 aa, Homo Sapiens
FCVEDLQKN

SEQ ID NO: 981369 - protein, 9 aa, Homo Sapiens
NGKEFSENQ

SEQ ID NO: 981370 - protein, 9 aa, Homo Sapiens
SLSKQEASV

SEQ ID NO: 981371 - protein, 9 aa, Homo Sapiens
ENGIILGLI

SEQ ID NO: 981372 - protein, 9 aa, Homo Sapiens
IFKQGSCLT

SEQ ID NO: 981373 - protein, 9 aa, Homo Sapiens
AAPPLSASN

SEQ ID NO: 981374 - protein, 9 aa, Homo Sapiens
LARPLPPPE

SEQ ID NO: 981375 - protein, 9 aa, Homo Sapiens
TQNILLDTH

SEQ ID NO: 981376 - protein, 9 aa, Homo Sapiens
KEPGKKGKE

SEQ ID NO: 981377 - protein, 9 aa, Homo Sapiens
SEPPPTHLR

SEQ ID NO: 981378 - protein, 9 aa, Homo Sapiens
LPQFSAEAA

SEQ ID NO: 981379 - protein, 9 aa, Homo Sapiens
GMKSIAFYN

SEQ ID NO: 981380 - protein, 9 aa, Homo Sapiens
QLVAKRQKS

SEQ ID NO: 981381 - protein, 9 aa, Homo Sapiens
ALNYSVEDI

SEQ ID NO: 981382 - protein, 9 aa, Homo Sapiens
STALQKIFE

SEQ ID NO: 981383 - protein, 9 aa, Homo Sapiens
APEKDEEMA

SEQ ID NO: 981384 - protein, 9 aa, Homo Sapiens
CQYRGWQGR

SEQ ID NO: 981385 - protein, 9 aa, Homo Sapiens
DQLVSQFPQ

SEQ ID NO: 981386 - protein, 9 aa, Homo Sapiens
VGLFFLLNT

SEQ ID NO: 981387 - protein, 9 aa, Homo Sapiens
SKQEASVAS

SEQ ID NO: 981388 - protein, 9 aa, Homo Sapiens
DGEGHVCVS

SEQ ID NO: 981389 - protein, 9 aa, Homo Sapiens
ASQLTLTSL

SEQ ID NO: 981390 - protein, 9 aa, Homo Sapiens
MDVSSFSSR

SEQ ID NO: 981391 - protein, 9 aa, Homo Sapiens
GILRLSTSV

SEQ ID NO: 981392 - protein, 9 aa, Homo Sapiens
LESWSNSQQ

SEQ ID NO: 981393 - protein, 9 aa, Homo Sapiens
RPRKNVKQH

SEQ ID NO: 981394 - protein, 9 aa, Homo Sapiens
DRPKHKEDL

SEQ ID NO: 981395 - protein, 9 aa, Homo Sapiens
LQKKLQRLQ

SEQ ID NO: 981396 - protein, 9 aa, Homo Sapiens
IDVKSVDNN

SEQ ID NO: 981397 - protein, 9 aa, Homo Sapiens
YGVELHSDV

SEQ ID NO: 981398 - protein, 9 aa, Homo Sapiens
GRVRQKLEA

SEQ ID NO: 981399 - protein, 9 aa, Homo Sapiens
TKHKKIYTG

SEQ ID NO: 981400 - protein, 9 aa, Homo Sapiens
SNTAQGGFD

SEQ ID NO: 981401 - protein, 9 aa, Homo Sapiens
ALNIDGSDL

SEQ ID NO: 981402 - protein, 9 aa, Homo Sapiens
ETTADQGHA

SEQ ID NO: 981403 - protein, 9 aa, Homo Sapiens
RLKDKFFES

SEQ ID NO: 981404 - protein, 9 aa, Homo Sapiens
VKKIETRDE

SEQ ID NO: 981405 - protein, 9 aa, Homo Sapiens
QFIATYEPG

SEQ ID NO: 981406 - protein, 9 aa, Homo Sapiens
QLVSQFPQL

SEQ ID NO: 981407 - protein, 9 aa, Homo Sapiens
INFKSNHRL

SEQ ID NO: 981408 - protein, 9 aa, Homo Sapiens
LLLLGGLPF

SEQ ID NO: 981409 - protein, 9 aa, Homo Sapiens
VCPQRFPVQ

SEQ ID NO: 981410 - protein, 9 aa, Homo Sapiens
FLFLFLLPQ

SEQ ID NO: 981411 - protein, 9 aa, Homo Sapiens
AQNARPITD

SEQ ID NO: 981412 - protein, 9 aa, Homo Sapiens
YRDVTLEIF

SEQ ID NO: 981413 - protein, 9 aa, Homo Sapiens
ITHLEFPRR

SEQ ID NO: 981414 - protein, 9 aa, Homo Sapiens
FSMDGHACP

SEQ ID NO: 981415 - protein, 9 aa, Homo Sapiens
FLDVGMKSI

SEQ ID NO: 981416 - protein, 9 aa, Homo Sapiens
ISPQGIVHG

SEQ ID NO: 981417 - protein, 9 aa, Homo Sapiens
TLSEQVEGV

SEQ ID NO: 981418 - protein, 9 aa, Homo Sapiens
TGSGNLIDP

SEQ ID NO: 981419 - protein, 9 aa, Homo Sapiens
ISLSKQEAS

SEQ ID NO: 981420 - protein, 9 aa, Homo Sapiens
LCHNHVTCV

SEQ ID NO: 981421 - protein, 9 aa, Homo Sapiens
HTMLGSSEQ

SEQ ID NO: 981422 - protein, 9 aa, Homo Sapiens
TLMENGIIL

SEQ ID NO: 981423 - protein, 9 aa, Homo Sapiens
HVSSQDSKD

SEQ ID NO: 981424 - protein, 9 aa, Homo Sapiens
AWDNKMRVT

SEQ ID NO: 981425 - protein, 9 aa, Homo Sapiens
RLDLSDANF

SEQ ID NO: 981426 - protein, 9 aa, Homo Sapiens
APKTSTVRE

SEQ ID NO: 981427 - protein, 9 aa, Homo Sapiens
RGLLRPKGP

SEQ ID NO: 981428 - protein, 9 aa, Homo Sapiens
KVKMPKKPK

SEQ ID NO: 981429 - protein, 9 aa, Homo Sapiens
TLTVFSPEE

SEQ ID NO: 981430 - protein, 9 aa, Homo Sapiens
IFLVCLAIC

SEQ ID NO: 981431 - protein, 9 aa, Homo Sapiens
IETRDEKLV

SEQ ID NO: 981432 - protein, 9 aa, Homo Sapiens
ILQGNKNGN

SEQ ID NO: 981433 - protein, 9 aa, Homo Sapiens
LDEFVKPGA

SEQ ID NO: 981434 - protein, 9 aa, Homo Sapiens
STNIALKVF

SEQ ID NO: 981435 - protein, 9 aa, Homo Sapiens
SVIVAWNHR

SEQ ID NO: 981436 - protein, 9 aa, Homo Sapiens
RFGFGGGAG

SEQ ID NO: 981437 - protein, 9 aa, Homo Sapiens
GSEKICIRK

SEQ ID NO: 981438 - protein, 9 aa, Homo Sapiens
MNNCFLILK

SEQ ID NO: 981439 - protein, 9 aa, Homo Sapiens
GIANLLLAV

SEQ ID NO: 981440 - protein, 9 aa, Homo Sapiens
FKYQDFKRM

SEQ ID NO: 981441 - protein, 9 aa, Homo Sapiens
PTESPHFTP

SEQ ID NO: 981442 - protein, 9 aa, Homo Sapiens
KVFSNKRSF

SEQ ID NO: 981443 - protein, 9 aa, Homo Sapiens
KKHTEYLHL

SEQ ID NO: 981444 - protein, 9 aa, Homo Sapiens
FIAEDEEWK

SEQ ID NO: 981445 - protein, 9 aa, Homo Sapiens
RVELAPLLP

SEQ ID NO: 981446 - protein, 9 aa, Homo Sapiens
SSAASIRSR

SEQ ID NO: 981447 - protein, 9 aa, Homo Sapiens
YKPTNPETS

SEQ ID NO: 981448 - protein, 9 aa, Homo Sapiens
WLCLDFLRC

SEQ ID NO: 981449 - protein, 9 aa, Homo Sapiens
NFCVEDLQK

SEQ ID NO: 981450 - protein, 9 aa, Homo Sapiens
ARGHQPLDK

SEQ ID NO: 981451 - protein, 9 aa, Homo Sapiens
TSVPIFPVS

SEQ ID NO: 981452 - protein, 9 aa, Homo Sapiens
EEGLCEASE

SEQ ID NO: 981453 - protein, 9 aa, Homo Sapiens
VHEKIRAMY

SEQ ID NO: 981454 - protein, 9 aa, Homo Sapiens
LGMIWSKCK

SEQ ID NO: 981455 - protein, 9 aa, Homo Sapiens
SRACASHNP

SEQ ID NO: 981456 - protein, 9 aa, Homo Sapiens
LSASNYPTI

SEQ ID NO: 981457 - protein, 9 aa, Homo Sapiens
ESARRVTLF

SEQ ID NO: 981458 - protein, 9 aa, Homo Sapiens
SAGCCCQYR

SEQ ID NO: 981459 - protein, 9 aa, Homo Sapiens
QKNHLNDET

SEQ ID NO: 981460 - protein, 9 aa, Homo Sapiens
LNVKDVDST

SEQ ID NO: 981461 - protein, 9 aa, Homo Sapiens
GKIFKQGSC

SEQ ID NO: 981462 - protein, 9 aa, Homo Sapiens
RGHQPLDKK

SEQ ID NO: 981463 - protein, 9 aa, Homo Sapiens
WQRFRKKST

SEQ ID NO: 981464 - protein, 9 aa, Homo Sapiens
TSVLNNEFF

SEQ ID NO: 981465 - protein, 9 aa, Homo Sapiens
ENKSKFGVN

SEQ ID NO: 981466 - protein, 9 aa, Homo Sapiens
LTLMENGII

SEQ ID NO: 981467 - protein, 9 aa, Homo Sapiens
SRSDMMSAL

SEQ ID NO: 981468 - protein, 9 aa, Homo Sapiens
LQITVTRHD

SEQ ID NO: 981469 - protein, 9 aa, Homo Sapiens
HSGLAPDVP

SEQ ID NO: 981470 - protein, 9 aa, Homo Sapiens
VLPRAGRAF

SEQ ID NO: 981471 - protein, 9 aa, Homo Sapiens
SELFFEIGA

SEQ ID NO: 981472 - protein, 9 aa, Homo Sapiens
LRAASILVS

SEQ ID NO: 981473 - protein, 9 aa, Homo Sapiens
PKDLAQQNL

SEQ ID NO: 981474 - protein, 9 aa, Homo Sapiens
LPETPAPQN

SEQ ID NO: 981475 - protein, 9 aa, Homo Sapiens
ADQPPSPGG

SEQ ID NO: 981476 - protein, 9 aa, Homo Sapiens
KSDAEVERS

SEQ ID NO: 981477 - protein, 9 aa, Homo Sapiens
GRWAEKTPE

SEQ ID NO: 981478 - protein, 9 aa, Homo Sapiens
STSRACASH

SEQ ID NO: 981479 - protein, 9 aa, Homo Sapiens
KRNSRVQVL

SEQ ID NO: 981480 - protein, 9 aa, Homo Sapiens
KWCLSTDFP

SEQ ID NO: 981481 - protein, 9 aa, Homo Sapiens
KAEIYFKIN

SEQ ID NO: 981482 - protein, 9 aa, Homo Sapiens
NLLLAVPAP

SEQ ID NO: 981483 - protein, 9 aa, Homo Sapiens
PGALGIANL

SEQ ID NO: 981484 - protein, 9 aa, Homo Sapiens
ACSCTQHSL

SEQ ID NO: 981485 - protein, 9 aa, Homo Sapiens
QGIEEGIRI

SEQ ID NO: 981486 - protein, 9 aa, Homo Sapiens
SIFSSLPLR

SEQ ID NO: 981487 - protein, 9 aa, Homo Sapiens
TSQQKMGLE

SEQ ID NO: 981488 - protein, 9 aa, Homo Sapiens
GFGQIRYSV

SEQ ID NO: 981489 - protein, 9 aa, Homo Sapiens
VYCTDLLPT

SEQ ID NO: 981490 - protein, 9 aa, Homo Sapiens
NGLMLSTDI

SEQ ID NO: 981491 - protein, 9 aa, Homo Sapiens
TYGDQLVSQ

SEQ ID NO: 981492 - protein, 9 aa, Homo Sapiens
HVILNVEQA

SEQ ID NO: 981493 - protein, 9 aa, Homo Sapiens
TSTALQKIF

SEQ ID NO: 981494 - protein, 9 aa, Homo Sapiens
KLKERSDRK

SEQ ID NO: 981495 - protein, 9 aa, Homo Sapiens
FLFLLPQIT

SEQ ID NO: 981496 - protein, 9 aa, Homo Sapiens
GAETTADQG

SEQ ID NO: 981497 - protein, 9 aa, Homo Sapiens
IYYEGSWGT

SEQ ID NO: 981498 - protein, 9 aa, Homo Sapiens
VQKVFSNKR

SEQ ID NO: 981499 - protein, 9 aa, Homo Sapiens
PSSLGLSIP

SEQ ID NO: 981500 - protein, 9 aa, Homo Sapiens
SPTSIRKRV

SEQ ID NO: 981501 - protein, 9 aa, Homo Sapiens
LDTHRMVVK

SEQ ID NO: 981502 - protein, 9 aa, Homo Sapiens
VVMEDSSSH

SEQ ID NO: 981503 - protein, 9 aa, Homo Sapiens
MGLELPNQN

SEQ ID NO: 981504 - protein, 9 aa, Homo Sapiens
WREFCGLPC

SEQ ID NO: 981505 - protein, 9 aa, Homo Sapiens
VRALNIDGS

SEQ ID NO: 981506 - protein, 9 aa, Homo Sapiens
QVSTGEVFY

SEQ ID NO: 981507 - protein, 9 aa, Homo Sapiens
LMQMLIQIK

SEQ ID NO: 981508 - protein, 9 aa, Homo Sapiens
EDSRRVTKK

SEQ ID NO: 981509 - protein, 9 aa, Homo Sapiens
VNNGVKYSK

SEQ ID NO: 981510 - protein, 9 aa, Homo Sapiens
YKGKKISKD

SEQ ID NO: 981511 - protein, 9 aa, Homo Sapiens
RVEIYYEGS

SEQ ID NO: 981512 - protein, 9 aa, Homo Sapiens
LSSSSAASI

SEQ ID NO: 981513 - protein, 9 aa, Homo Sapiens
GPSGESGRE

SEQ ID NO: 981514 - protein, 9 aa, Homo Sapiens
KTVKPRVIQ

SEQ ID NO: 981515 - protein, 9 aa, Homo Sapiens
TAPEKDEEM

SEQ ID NO: 981516 - protein, 9 aa, Homo Sapiens
TMLGSSEQP

SEQ ID NO: 981517 - protein, 9 aa, Homo Sapiens
LDFRLGSSV

SEQ ID NO: 981518 - protein, 9 aa, Homo Sapiens
NGEISSILL

SEQ ID NO: 981519 - protein, 9 aa, Homo Sapiens
QKLFQSLAL

SEQ ID NO: 981520 - protein, 9 aa, Homo Sapiens
TTADQGHAR

SEQ ID NO: 981521 - protein, 9 aa, Homo Sapiens
ECINVPLQY

SEQ ID NO: 981522 - protein, 9 aa, Homo Sapiens
FFLSQDPEF

SEQ ID NO: 981523 - protein, 9 aa, Homo Sapiens
SMSWIFCRG

SEQ ID NO: 981524 - protein, 9 aa, Homo Sapiens
KRTKIKKKT

SEQ ID NO: 981525 - protein, 9 aa, Homo Sapiens
GLDLSKRKR

SEQ ID NO: 981526 - protein, 9 aa, Homo Sapiens
QPAQKNSPH

SEQ ID NO: 981527 - protein, 9 aa, Homo Sapiens
KQKSSISFF

SEQ ID NO: 981528 - protein, 9 aa, Homo Sapiens
RVAQIFCLD

SEQ ID NO: 981529 - protein, 9 aa, Homo Sapiens
RTKIKKKTK

SEQ ID NO: 981530 - protein, 9 aa, Homo Sapiens
PRGLLRPKG

SEQ ID NO: 981531 - protein, 9 aa, Homo Sapiens
CCHPLRKRC

SEQ ID NO: 981532 - protein, 9 aa, Homo Sapiens
VCAGLGLDS

SEQ ID NO: 981533 - protein, 9 aa, Homo Sapiens
VTAVDLNEG

SEQ ID NO: 981534 - protein, 9 aa, Homo Sapiens
LVNFSMDGH

SEQ ID NO: 981535 - protein, 9 aa, Homo Sapiens
AFLTPVALD

SEQ ID NO: 981536 - protein, 9 aa, Homo Sapiens
AFPTDSSTG

SEQ ID NO: 981537 - protein, 9 aa, Homo Sapiens
KNCRRFWNF

SEQ ID NO: 981538 - protein, 9 aa, Homo Sapiens
LLYMVTMFP

SEQ ID NO: 981539 - protein, 9 aa, Homo Sapiens
CPEFSKTSK

SEQ ID NO: 981540 - protein, 9 aa, Homo Sapiens
CKSKRPRKN

SEQ ID NO: 981541 - protein, 9 aa, Homo Sapiens
SQSAYYPEP

SEQ ID NO: 981542 - protein, 9 aa, Homo Sapiens
CTLVHTVMD

SEQ ID NO: 981543 - protein, 9 aa, Homo Sapiens
LLKERAGVM

SEQ ID NO: 981544 - protein, 9 aa, Homo Sapiens
EKTPEPDPR

SEQ ID NO: 981545 - protein, 9 aa, Homo Sapiens
LPFSSKLAT

SEQ ID NO: 981546 - protein, 9 aa, Homo Sapiens
LKTPRGGKR

SEQ ID NO: 981547 - protein, 9 aa, Homo Sapiens
NILLDTHRM

SEQ ID NO: 981548 - protein, 9 aa, Homo Sapiens
SSPNLTSLA

SEQ ID NO: 981549 - protein, 9 aa, Homo Sapiens
SETYQQGLM

SEQ ID NO: 981550 - protein, 9 aa, Homo Sapiens
GIVWHRFWI

SEQ ID NO: 981551 - protein, 9 aa, Homo Sapiens
FSYNFHDFQ

SEQ ID NO: 981552 - protein, 9 aa, Homo Sapiens
EVLENIDTS

SEQ ID NO: 981553 - protein, 9 aa, Homo Sapiens
PCHENQTES

SEQ ID NO: 981554 - protein, 9 aa, Homo Sapiens
YWQLEKECA

SEQ ID NO: 981555 - protein, 9 aa, Homo Sapiens
IGCHAYGDQ

SEQ ID NO: 981556 - protein, 9 aa, Homo Sapiens
GNLPHLYRL

SEQ ID NO: 981557 - protein, 9 aa, Homo Sapiens
HSFRLSQFP

SEQ ID NO: 981558 - protein, 9 aa, Homo Sapiens
EPHVVPKTV

SEQ ID NO: 981559 - protein, 9 aa, Homo Sapiens
SIMEPGKTR

SEQ ID NO: 981560 - protein, 9 aa, Homo Sapiens
GRQEFVRWA

SEQ ID NO: 981561 - protein, 9 aa, Homo Sapiens
PPSCLCFVQ

SEQ ID NO: 981562 - protein, 9 aa, Homo Sapiens
DVLEQQRFG

SEQ ID NO: 981563 - protein, 9 aa, Homo Sapiens
QTTRLTTTE

SEQ ID NO: 981564 - protein, 9 aa, Homo Sapiens
SSFLLKERA

SEQ ID NO: 981565 - protein, 9 aa, Homo Sapiens
QSRKDNFNS

SEQ ID NO: 981566 - protein, 9 aa, Homo Sapiens
PEEDGEGHV

SEQ ID NO: 981567 - protein, 9 aa, Homo Sapiens
ENITHLQKQ

SEQ ID NO: 981568 - protein, 9 aa, Homo Sapiens
KNLFNMEVL

SEQ ID NO: 981569 - protein, 9 aa, Homo Sapiens
NAKVARELD

SEQ ID NO: 981570 - protein, 9 aa, Homo Sapiens
CPRDQPLFP

SEQ ID NO: 981571 - protein, 9 aa, Homo Sapiens
FLREVESAK

SEQ ID NO: 981572 - protein, 9 aa, Homo Sapiens
CPEEKFSRS

SEQ ID NO: 981573 - protein, 9 aa, Homo Sapiens
PGKIPRGFR

SEQ ID NO: 981574 - protein, 9 aa, Homo Sapiens
KIETRDEKL

SEQ ID NO: 981575 - protein, 9 aa, Homo Sapiens
SLQNCRYPS

SEQ ID NO: 981576 - protein, 9 aa, Homo Sapiens
ELGARASGF

SEQ ID NO: 981577 - protein, 9 aa, Homo Sapiens
AGISLSKQE

SEQ ID NO: 981578 - protein, 9 aa, Homo Sapiens
ETEKNIEQL

SEQ ID NO: 981579 - protein, 9 aa, Homo Sapiens
FFTVTDLKI

SEQ ID NO: 981580 - protein, 9 aa, Homo Sapiens
PFSSKLATG

SEQ ID NO: 981581 - protein, 9 aa, Homo Sapiens
CALSHHKRL

SEQ ID NO: 981582 - protein, 9 aa, Homo Sapiens
GLSGLPGEK

SEQ ID NO: 981583 - protein, 9 aa, Homo Sapiens
LKIRLLRPA

SEQ ID NO: 981584 - protein, 9 aa, Homo Sapiens
QVLDSPFST

SEQ ID NO: 981585 - protein, 9 aa, Homo Sapiens
KPELLGSEI

SEQ ID NO: 981586 - protein, 9 aa, Homo Sapiens
SKGHLTDSS

SEQ ID NO: 981587 - protein, 9 aa, Homo Sapiens
GFLSKCDAD

SEQ ID NO: 981588 - protein, 9 aa, Homo Sapiens
DHVSKVTIF

SEQ ID NO: 981589 - protein, 9 aa, Homo Sapiens
RSNFLERRK

SEQ ID NO: 981590 - protein, 9 aa, Homo Sapiens
LPGGKRHDS

SEQ ID NO: 981591 - protein, 9 aa, Homo Sapiens
GSGVGIGDC

SEQ ID NO: 981592 - protein, 9 aa, Homo Sapiens
KTSTVRETQ

SEQ ID NO: 981593 - protein, 9 aa, Homo Sapiens
ADRILVNAG

SEQ ID NO: 981594 - protein, 9 aa, Homo Sapiens
GSCEKVLVW

SEQ ID NO: 981595 - protein, 9 aa, Homo Sapiens
QPTHHPVSS

SEQ ID NO: 981596 - protein, 9 aa, Homo Sapiens
LSYTGHSSI

SEQ ID NO: 981597 - protein, 9 aa, Homo Sapiens
SFQADHVSK

SEQ ID NO: 981598 - protein, 9 aa, Homo Sapiens
LLPWQPVGQ

SEQ ID NO: 981599 - protein, 9 aa, Homo Sapiens
QEKMLSALI

SEQ ID NO: 981600 - protein, 9 aa, Homo Sapiens
LQKQIVDGK

SEQ ID NO: 981601 - protein, 9 aa, Homo Sapiens
DRNCRHFGW

SEQ ID NO: 981602 - protein, 9 aa, Homo Sapiens
VNPVNNTVV

SEQ ID NO: 981603 - protein, 9 aa, Homo Sapiens
ITLYSHPFG

SEQ ID NO: 981604 - protein, 9 aa, Homo Sapiens
CQTHYEEGL

SEQ ID NO: 981605 - protein, 9 aa, Homo Sapiens
FNMEVEIKT

SEQ ID NO: 981606 - protein, 9 aa, Homo Sapiens
VAPEEKAGP

SEQ ID NO: 981607 - protein, 9 aa, Homo Sapiens
EEKFSRSGL

SEQ ID NO: 981608 - protein, 9 aa, Homo Sapiens
KALNYSVED

SEQ ID NO: 981609 - protein, 9 aa, Homo Sapiens
AALYFLKNG

SEQ ID NO: 981610 - protein, 9 aa, Homo Sapiens
GPWGKVDSR

SEQ ID NO: 981611 - protein, 9 aa, Homo Sapiens
GFPQSQYLQ

SEQ ID NO: 981612 - protein, 9 aa, Homo Sapiens
ILCIFVYMR

SEQ ID NO: 981613 - protein, 9 aa, Homo Sapiens
DGVLYWHFQ

SEQ ID NO: 981614 - protein, 9 aa, Homo Sapiens
HAGISLSKQ

SEQ ID NO: 981615 - protein, 9 aa, Homo Sapiens
SAATKYRFK

SEQ ID NO: 981616 - protein, 9 aa, Homo Sapiens
SAIFDTVSQ

SEQ ID NO: 981617 - protein, 9 aa, Homo Sapiens
EIFQGRLGP

SEQ ID NO: 981618 - protein, 9 aa, Homo Sapiens
FMTAQLPMM

SEQ ID NO: 981619 - protein, 9 aa, Homo Sapiens
VRLCGGKNE

SEQ ID NO: 981620 - protein, 9 aa, Homo Sapiens
IYDQKFLME

SEQ ID NO: 981621 - protein, 9 aa, Homo Sapiens
FQECFPAIC

SEQ ID NO: 981622 - protein, 9 aa, Homo Sapiens
TVMDNPVDL

SEQ ID NO: 981623 - protein, 9 aa, Homo Sapiens
KRLGLDFRL

SEQ ID NO: 981624 - protein, 9 aa, Homo Sapiens
PKKPKFELG

SEQ ID NO: 981625 - protein, 9 aa, Homo Sapiens
SFINPGKIP

SEQ ID NO: 981626 - protein, 9 aa, Homo Sapiens
ADPYIVIRL

SEQ ID NO: 981627 - protein, 9 aa, Homo Sapiens
TGFGQIRYS

SEQ ID NO: 981628 - protein, 9 aa, Homo Sapiens
SFILCIFVY

SEQ ID NO: 981629 - protein, 9 aa, Homo Sapiens
VAALYFLKN

SEQ ID NO: 981630 - protein, 9 aa, Homo Sapiens
VLPIFSYNV

SEQ ID NO: 981631 - protein, 9 aa, Homo Sapiens
KGKRFPKDL

SEQ ID NO: 981632 - protein, 9 aa, Homo Sapiens
RRSLVPSET

SEQ ID NO: 981633 - protein, 9 aa, Homo Sapiens
PRLHRDEER

SEQ ID NO: 981634 - protein, 9 aa, Homo Sapiens
IPLANKSEV

SEQ ID NO: 981635 - protein, 9 aa, Homo Sapiens
TEFDTNSTN

SEQ ID NO: 981636 - protein, 9 aa, Homo Sapiens
KKGFQECFP

SEQ ID NO: 981637 - protein, 9 aa, Homo Sapiens
FLSKCDADH

SEQ ID NO: 981638 - protein, 9 aa, Homo Sapiens
ISFKEVVEA

SEQ ID NO: 981639 - protein, 9 aa, Homo Sapiens
LPPGRLDYS

SEQ ID NO: 981640 - protein, 9 aa, Homo Sapiens
VEIKTSGMV

SEQ ID NO: 981641 - protein, 9 aa, Homo Sapiens
QALALLRKV

SEQ ID NO: 981642 - protein, 9 aa, Homo Sapiens
GCCGFEPHH

SEQ ID NO: 981643 - protein, 9 aa, Homo Sapiens
MTAARILKG

SEQ ID NO: 981644 - protein, 9 aa, Homo Sapiens
YKILQGNKN

SEQ ID NO: 981645 - protein, 9 aa, Homo Sapiens
SALESWSNS

SEQ ID NO: 981646 - protein, 9 aa, Homo Sapiens
TSASLNREG

SEQ ID NO: 981647 - protein, 9 aa, Homo Sapiens
PPSSLGLSI

SEQ ID NO: 981648 - protein, 9 aa, Homo Sapiens
VLGSMSWIF

SEQ ID NO: 981649 - protein, 9 aa, Homo Sapiens
RALLREGVR

SEQ ID NO: 981650 - protein, 9 aa, Homo Sapiens
PCSSSFSCG

SEQ ID NO: 981651 - protein, 9 aa, Homo Sapiens
DNKLRRNIV

SEQ ID NO: 981652 - protein, 9 aa, Homo Sapiens
SSHEALRCR

SEQ ID NO: 981653 - protein, 9 aa, Homo Sapiens
LMLSTDIKR

SEQ ID NO: 981654 - protein, 9 aa, Homo Sapiens
QLQKKLQRL

SEQ ID NO: 981655 - protein, 9 aa, Homo Sapiens
DSRRVTKKN

SEQ ID NO: 981656 - protein, 9 aa, Homo Sapiens
LLILLVVCL

SEQ ID NO: 981657 - protein, 9 aa, Homo Sapiens
AYPSQHMVF

SEQ ID NO: 981658 - protein, 9 aa, Homo Sapiens
LEKAEIYFK

SEQ ID NO: 981659 - protein, 9 aa, Homo Sapiens
FSLQPETGS

SEQ ID NO: 981660 - protein, 9 aa, Homo Sapiens
HFGWMCPIH

SEQ ID NO: 981661 - protein, 9 aa, Homo Sapiens
ARPLPPPEA

SEQ ID NO: 981662 - protein, 9 aa, Homo Sapiens
HEKIRAMYA

SEQ ID NO: 981663 - protein, 9 aa, Homo Sapiens
GLRSLYPPS

SEQ ID NO: 981664 - protein, 9 aa, Homo Sapiens
PALSTSSTC

SEQ ID NO: 981665 - protein, 9 aa, Homo Sapiens
LLCRKAGSI

SEQ ID NO: 981666 - protein, 9 aa, Homo Sapiens
AQFESARRV

SEQ ID NO: 981667 - protein, 9 aa, Homo Sapiens
FLWHIKRPW

SEQ ID NO: 981668 - protein, 9 aa, Homo Sapiens
APLLPWQPV

SEQ ID NO: 981669 - protein, 9 aa, Homo Sapiens
LIQLGLSRS

SEQ ID NO: 981670 - protein, 9 aa, Homo Sapiens
LPSPELQGP

SEQ ID NO: 981671 - protein, 9 aa, Homo Sapiens
IKERFQITK

SEQ ID NO: 981672 - protein, 9 aa, Homo Sapiens
SQYLQYYGS

SEQ ID NO: 981673 - protein, 9 aa, Homo Sapiens
FGWFYCYDG

SEQ ID NO: 981674 - protein, 9 aa, Homo Sapiens
ALSTSSTCR

SEQ ID NO: 981675 - protein, 9 aa, Homo Sapiens
RRVVSQELE

SEQ ID NO: 981676 - protein, 9 aa, Homo Sapiens
AALVGRCSV

SEQ ID NO: 981677 - protein, 9 aa, Homo Sapiens
LLKTPRGGK

SEQ ID NO: 981678 - protein, 9 aa, Homo Sapiens
KSGYVDVLT

SEQ ID NO: 981679 - protein, 9 aa, Homo Sapiens
IEEGIRIFS

SEQ ID NO: 981680 - protein, 9 aa, Homo Sapiens
CVSQEKMLS

SEQ ID NO: 981681 - protein, 9 aa, Homo Sapiens
KTRRNSYPR

SEQ ID NO: 981682 - protein, 9 aa, Homo Sapiens
PTSPTSIRK

SEQ ID NO: 981683 - protein, 9 aa, Homo Sapiens
APTLVDEQL

SEQ ID NO: 981684 - protein, 9 aa, Homo Sapiens
EGVASRLVE

SEQ ID NO: 981685 - protein, 9 aa, Homo Sapiens
SKEIIYRDL

SEQ ID NO: 981686 - protein, 9 aa, Homo Sapiens
PQLPETPAP

SEQ ID NO: 981687 - protein, 9 aa, Homo Sapiens
MDLSFMTAQ

SEQ ID NO: 981688 - protein, 9 aa, Homo Sapiens
IVIRLGKTD

SEQ ID NO: 981689 - protein, 9 aa, Homo Sapiens
EQKGFQASR

SEQ ID NO: 981690 - protein, 9 aa, Homo Sapiens
SPVSGVPKP

SEQ ID NO: 981691 - protein, 9 aa, Homo Sapiens
QFSAEAARR

SEQ ID NO: 981692 - protein, 9 aa, Homo Sapiens
CGKFFISKS

SEQ ID NO: 981693 - protein, 9 aa, Homo Sapiens
NTIFYSECM

SEQ ID NO: 981694 - protein, 9 aa, Homo Sapiens
FDTVSQAKV

SEQ ID NO: 981695 - protein, 9 aa, Homo Sapiens
GPDFEADKD

SEQ ID NO: 981696 - protein, 9 aa, Homo Sapiens
LSFMTAQLP

SEQ ID NO: 981697 - protein, 9 aa, Homo Sapiens
KDNFNSLQV

SEQ ID NO: 981698 - protein, 9 aa, Homo Sapiens
GVSTMTAAR

SEQ ID NO: 981699 - protein, 9 aa, Homo Sapiens
IQIKLSLVL

SEQ ID NO: 981700 - protein, 9 aa, Homo Sapiens
SNFLERRKG

SEQ ID NO: 981701 - protein, 9 aa, Homo Sapiens
LPGWPESSG

SEQ ID NO: 981702 - protein, 9 aa, Homo Sapiens
VQKMSQAEK

SEQ ID NO: 981703 - protein, 9 aa, Homo Sapiens
QLLENYLDM

SEQ ID NO: 981704 - protein, 9 aa, Homo Sapiens
LSTSSTCRL

SEQ ID NO: 981705 - protein, 9 aa, Homo Sapiens
KINKTTARL

SEQ ID NO: 981706 - protein, 9 aa, Homo Sapiens
QRFDRINWL

SEQ ID NO: 981707 - protein, 9 aa, Homo Sapiens
LIVNLFFSD

SEQ ID NO: 981708 - protein, 9 aa, Homo Sapiens
LSKQEASVA

SEQ ID NO: 981709 - protein, 9 aa, Homo Sapiens
SVFKEKHIQ

SEQ ID NO: 981710 - protein, 9 aa, Homo Sapiens
CFIYQPLAN

SEQ ID NO: 981711 - protein, 9 aa, Homo Sapiens
MGDSPNITE

SEQ ID NO: 981712 - protein, 9 aa, Homo Sapiens
RSLYPPSPP

SEQ ID NO: 981713 - protein, 9 aa, Homo Sapiens
SCEKVLVWA

SEQ ID NO: 981714 - protein, 9 aa, Homo Sapiens
KAGFRWEHK

SEQ ID NO: 981715 - protein, 9 aa, Homo Sapiens
PLKIQGIEE

SEQ ID NO: 981716 - protein, 9 aa, Homo Sapiens
MGVSTMTAA

SEQ ID NO: 981717 - protein, 9 aa, Homo Sapiens
SGPCHENQT

SEQ ID NO: 981718 - protein, 9 aa, Homo Sapiens
CRRSRAALV

SEQ ID NO: 981719 - protein, 9 aa, Homo Sapiens
HTANLAAFL

SEQ ID NO: 981720 - protein, 9 aa, Homo Sapiens
FSARGHQPL

SEQ ID NO: 981721 - protein, 9 aa, Homo Sapiens
RFKSRSRTR

SEQ ID NO: 981722 - protein, 9 aa, Homo Sapiens
PNLTSLATK

SEQ ID NO: 981723 - protein, 9 aa, Homo Sapiens
GEEIDHAER

SEQ ID NO: 981724 - protein, 9 aa, Homo Sapiens
PIIIGCHAY

SEQ ID NO: 981725 - protein, 9 aa, Homo Sapiens
TTRTSAIFD

SEQ ID NO: 981726 - protein, 9 aa, Homo Sapiens
GKVANLAIG

SEQ ID NO: 981727 - protein, 9 aa, Homo Sapiens
TYYDASKRD

SEQ ID NO: 981728 - protein, 9 aa, Homo Sapiens
SIILVCAGL

SEQ ID NO: 981729 - protein, 9 aa, Homo Sapiens
TRPRSRSRF

SEQ ID NO: 981730 - protein, 9 aa, Homo Sapiens
GEGVASRLV

SEQ ID NO: 981731 - protein, 9 aa, Homo Sapiens
NFIVMQRRK

SEQ ID NO: 981732 - protein, 9 aa, Homo Sapiens
VNDNASQLT

SEQ ID NO: 981733 - protein, 9 aa, Homo Sapiens
AQASNAQEC

SEQ ID NO: 981734 - protein, 9 aa, Homo Sapiens
SSENLSKSG

SEQ ID NO: 981735 - protein, 9 aa, Homo Sapiens
EKIRAMYAD

SEQ ID NO: 981736 - protein, 9 aa, Homo Sapiens
VFRPKPPLE

SEQ ID NO: 981737 - protein, 9 aa, Homo Sapiens
KNSHQVKEE

SEQ ID NO: 981738 - protein, 9 aa, Homo Sapiens
PFGVNYGVE

SEQ ID NO: 981739 - protein, 9 aa, Homo Sapiens
QRSSGFGEQ

SEQ ID NO: 981740 - protein, 9 aa, Homo Sapiens
PGERPSQAF

SEQ ID NO: 981741 - protein, 9 aa, Homo Sapiens
KFLWHIKRP

SEQ ID NO: 981742 - protein, 9 aa, Homo Sapiens
GIFLDVGMK

SEQ ID NO: 981743 - protein, 9 aa, Homo Sapiens
WFYCYDGKF

SEQ ID NO: 981744 - protein, 9 aa, Homo Sapiens
VAQPTHHPV

SEQ ID NO: 981745 - protein, 9 aa, Homo Sapiens
VQLECSADE

SEQ ID NO: 981746 - protein, 9 aa, Homo Sapiens
SKYYCNCDA

SEQ ID NO: 981747 - protein, 9 aa, Homo Sapiens
STSFISIGR

SEQ ID NO: 981748 - protein, 9 aa, Homo Sapiens
VAQPVRPIA

SEQ ID NO: 981749 - protein, 9 aa, Homo Sapiens
YTIYKILCK

SEQ ID NO: 981750 - protein, 9 aa, Homo Sapiens
YVDEVHKNS

SEQ ID NO: 981751 - protein, 9 aa, Homo Sapiens
GQTKDMKSR

SEQ ID NO: 981752 - protein, 9 aa, Homo Sapiens
RIIYDQKFL

SEQ ID NO: 981753 - protein, 9 aa, Homo Sapiens
KGYKEWLLN

SEQ ID NO: 981754 - protein, 9 aa, Homo Sapiens
LGSSEQPGV

SEQ ID NO: 981755 - protein, 9 aa, Homo Sapiens
NGLQLLCSW

SEQ ID NO: 981756 - protein, 9 aa, Homo Sapiens
AEKGYKEWL

SEQ ID NO: 981757 - protein, 9 aa, Homo Sapiens
PHWLKSLQV

SEQ ID NO: 981758 - protein, 9 aa, Homo Sapiens
ETLILDKKG

SEQ ID NO: 981759 - protein, 9 aa, Homo Sapiens
YDGVLYWHF

SEQ ID NO: 981760 - protein, 9 aa, Homo Sapiens
NDLGRVRQK

SEQ ID NO: 981761 - protein, 9 aa, Homo Sapiens
SYEVPRLHR

SEQ ID NO: 981762 - protein, 9 aa, Homo Sapiens
LVSQFPQLN

SEQ ID NO: 981763 - protein, 9 aa, Homo Sapiens
QPGPLRPMK

SEQ ID NO: 981764 - protein, 9 aa, Homo Sapiens
IVNCINTLL

SEQ ID NO: 981765 - protein, 9 aa, Homo Sapiens
SQKIINCEQ

SEQ ID NO: 981766 - protein, 9 aa, Homo Sapiens
LIVISSHTA

SEQ ID NO: 981767 - protein, 9 aa, Homo Sapiens
EGEGVASRL

SEQ ID NO: 981768 - protein, 9 aa, Homo Sapiens
EPGPRGLLR

SEQ ID NO: 981769 - protein, 9 aa, Homo Sapiens
SFSFPGLFS

SEQ ID NO: 981770 - protein, 9 aa, Homo Sapiens
VESEKWCLS

SEQ ID NO: 981771 - protein, 9 aa, Homo Sapiens
HCSIHTSEK

SEQ ID NO: 981772 - protein, 9 aa, Homo Sapiens
KEVRLDLSD

SEQ ID NO: 981773 - protein, 9 aa, Homo Sapiens
HKFEDRNCR

SEQ ID NO: 981774 - protein, 9 aa, Homo Sapiens
TPKEVRLDL

SEQ ID NO: 981775 - protein, 9 aa, Homo Sapiens
KSLQVLTEM

SEQ ID NO: 981776 - protein, 9 aa, Homo Sapiens
LSKRKRNSR

SEQ ID NO: 981777 - protein, 9 aa, Homo Sapiens
HCHGGPGPG

SEQ ID NO: 981778 - protein, 9 aa, Homo Sapiens
GWFYCYDGK

SEQ ID NO: 981779 - protein, 9 aa, Homo Sapiens
ISRLFHCHG

SEQ ID NO: 981780 - protein, 9 aa, Homo Sapiens
LANCQAPCS

SEQ ID NO: 981781 - protein, 9 aa, Homo Sapiens
EEMVRSFVG

SEQ ID NO: 981782 - protein, 9 aa, Homo Sapiens
RCNFAPTKA

SEQ ID NO: 981783 - protein, 9 aa, Homo Sapiens
KFVTKGQTV

SEQ ID NO: 981784 - protein, 9 aa, Homo Sapiens
PGPFSLDHE

SEQ ID NO: 981785 - protein, 9 aa, Homo Sapiens
NAKFKSLFK

SEQ ID NO: 981786 - protein, 9 aa, Homo Sapiens
SDAAPNLDE

SEQ ID NO: 981787 - protein, 9 aa, Homo Sapiens
TCVAHSERE

SEQ ID NO: 981788 - protein, 9 aa, Homo Sapiens
EPGKTRRNS

SEQ ID NO: 981789 - protein, 9 aa, Homo Sapiens
VIQKNHLND

SEQ ID NO: 981790 - protein, 9 aa, Homo Sapiens
SRGSFSLST

SEQ ID NO: 981791 - protein, 9 aa, Homo Sapiens
PCQPCSSSF

SEQ ID NO: 981792 - protein, 9 aa, Homo Sapiens
KSFLGQGDL

SEQ ID NO: 981793 - protein, 9 aa, Homo Sapiens
FISIGRRTY

SEQ ID NO: 981794 - protein, 9 aa, Homo Sapiens
LGGLSVGLF

SEQ ID NO: 981795 - protein, 9 aa, Homo Sapiens
NYLENILQA

SEQ ID NO: 981796 - protein, 9 aa, Homo Sapiens
DNSSPLTEH

SEQ ID NO: 981797 - protein, 9 aa, Homo Sapiens
GKADPYIVI

SEQ ID NO: 981798 - protein, 9 aa, Homo Sapiens
PENVTASKS

SEQ ID NO: 981799 - protein, 9 aa, Homo Sapiens
FCRDVALVI

SEQ ID NO: 981800 - protein, 9 aa, Homo Sapiens
VGNKFVTKG

SEQ ID NO: 981801 - protein, 9 aa, Homo Sapiens
FRKKSTEQE

SEQ ID NO: 981802 - protein, 9 aa, Homo Sapiens
IFYSECMVQ

SEQ ID NO: 981803 - protein, 9 aa, Homo Sapiens
EWIKGQNFG

SEQ ID NO: 981804 - protein, 9 aa, Homo Sapiens
IDTSCDDGL

SEQ ID NO: 981805 - protein, 9 aa, Homo Sapiens
RFWIYFCIY

SEQ ID NO: 981806 - protein, 9 aa, Homo Sapiens
IFYLFILIT

SEQ ID NO: 981807 - protein, 9 aa, Homo Sapiens
GSYCYISPQ

SEQ ID NO: 981808 - protein, 9 aa, Homo Sapiens
EDNKLRRNI

SEQ ID NO: 981809 - protein, 9 aa, Homo Sapiens
AVGLTAPEK

SEQ ID NO: 981810 - protein, 9 aa, Homo Sapiens
TNILIVNLF

SEQ ID NO: 981811 - protein, 9 aa, Homo Sapiens
QAFLTPVAL

SEQ ID NO: 981812 - protein, 9 aa, Homo Sapiens
FGDVSWSRC

SEQ ID NO: 981813 - protein, 9 aa, Homo Sapiens
RGGKEIEKN

SEQ ID NO: 981814 - protein, 9 aa, Homo Sapiens
FLRKGGHTH

SEQ ID NO: 981815 - protein, 9 aa, Homo Sapiens
FLLKERAGV

SEQ ID NO: 981816 - protein, 9 aa, Homo Sapiens
VNMLSLGES

SEQ ID NO: 981817 - protein, 9 aa, Homo Sapiens
ISSMSQRKK

SEQ ID NO: 981818 - protein, 9 aa, Homo Sapiens
HVKDYNSPS

SEQ ID NO: 981819 - protein, 9 aa, Homo Sapiens
ILTRRRKFS

SEQ ID NO: 981820 - protein, 9 aa, Homo Sapiens
KPRQDSRTD

SEQ ID NO: 981821 - protein, 9 aa, Homo Sapiens
DAPSLQNCR

SEQ ID NO: 981822 - protein, 9 aa, Homo Sapiens
ATPLKIQGI

SEQ ID NO: 981823 - protein, 9 aa, Homo Sapiens
LILGETFRC

SEQ ID NO: 981824 - protein, 9 aa, Homo Sapiens
KDMKSRPRR

SEQ ID NO: 981825 - protein, 9 aa, Homo Sapiens
TVSGFFLSQ

SEQ ID NO: 981826 - protein, 9 aa, Homo Sapiens
GYRICLGSS

SEQ ID NO: 981827 - protein, 9 aa, Homo Sapiens
LEQAEKGYK

SEQ ID NO: 981828 - protein, 9 aa, Homo Sapiens
NTYRPKRPT

SEQ ID NO: 981829 - protein, 9 aa, Homo Sapiens
CRIRGGILA

SEQ ID NO: 981830 - protein, 9 aa, Homo Sapiens
SSQSSGCSQ

SEQ ID NO: 981831 - protein, 9 aa, Homo Sapiens
SLVKKKGFQ

SEQ ID NO: 981832 - protein, 9 aa, Homo Sapiens
FSQSAYYPE

SEQ ID NO: 981833 - protein, 9 aa, Homo Sapiens
SSKNKLHSL

SEQ ID NO: 981834 - protein, 9 aa, Homo Sapiens
IILVCAGLG

SEQ ID NO: 981835 - protein, 9 aa, Homo Sapiens
LLCSWAPLS

SEQ ID NO: 981836 - protein, 9 aa, Homo Sapiens
HGSVRLCGG

SEQ ID NO: 981837 - protein, 9 aa, Homo Sapiens
IGTERLAQI

SEQ ID NO: 981838 - protein, 9 aa, Homo Sapiens
EKPNGEISS

SEQ ID NO: 981839 - protein, 9 aa, Homo Sapiens
PLDNKLNVK

SEQ ID NO: 981840 - protein, 9 aa, Homo Sapiens
LLVVCLDSR

SEQ ID NO: 981841 - protein, 9 aa, Homo Sapiens
LSLHSQGAF

SEQ ID NO: 981842 - protein, 9 aa, Homo Sapiens
VITKMDKLH

SEQ ID NO: 981843 - protein, 9 aa, Homo Sapiens
ADRRLLLYK

SEQ ID NO: 981844 - protein, 9 aa, Homo Sapiens
ITVAPEEKA

SEQ ID NO: 981845 - protein, 9 aa, Homo Sapiens
FAPTKAFQR

SEQ ID NO: 981846 - protein, 9 aa, Homo Sapiens
SGFLRKGGH

SEQ ID NO: 981847 - protein, 9 aa, Homo Sapiens
ITKQDSFNT

SEQ ID NO: 981848 - protein, 9 aa, Homo Sapiens
LVLPIFSYN

SEQ ID NO: 981849 - protein, 9 aa, Homo Sapiens
SAVGLTAPE

SEQ ID NO: 981850 - protein, 9 aa, Homo Sapiens
TRRRKFSRT

SEQ ID NO: 981851 - protein, 9 aa, Homo Sapiens
IKTSGMVIS

SEQ ID NO: 981852 - protein, 9 aa, Homo Sapiens
SGVPKPGSP

SEQ ID NO: 981853 - protein, 9 aa, Homo Sapiens
RNCTDSKYY

SEQ ID NO: 981854 - protein, 9 aa, Homo Sapiens
DQYLAIVHP

SEQ ID NO: 981855 - protein, 9 aa, Homo Sapiens
PVSADQMIV

SEQ ID NO: 981856 - protein, 9 aa, Homo Sapiens
LQGNKNGNF

SEQ ID NO: 981857 - protein, 9 aa, Homo Sapiens
FGWMCPIHR

SEQ ID NO: 981858 - protein, 9 aa, Homo Sapiens
GKEFSENQT

SEQ ID NO: 981859 - protein, 9 aa, Homo Sapiens
FQGGGVCID

SEQ ID NO: 981860 - protein, 9 aa, Homo Sapiens
LKERAGVMS

SEQ ID NO: 981861 - protein, 9 aa, Homo Sapiens
ASGFLRKGG

SEQ ID NO: 981862 - protein, 9 aa, Homo Sapiens
SKRKLCPEF

SEQ ID NO: 981863 - protein, 9 aa, Homo Sapiens
GPDPLRARR

SEQ ID NO: 981864 - protein, 9 aa, Homo Sapiens
EKVLVWAAE

SEQ ID NO: 981865 - protein, 9 aa, Homo Sapiens
NVKDVDSTK

SEQ ID NO: 981866 - protein, 9 aa, Homo Sapiens
DRSNFLERR

SEQ ID NO: 981867 - protein, 9 aa, Homo Sapiens
LASSTTLQS

SEQ ID NO: 981868 - protein, 9 aa, Homo Sapiens
YECNNCGKF

SEQ ID NO: 981869 - protein, 9 aa, Homo Sapiens
RLFHCHGGP

SEQ ID NO: 981870 - protein, 9 aa, Homo Sapiens
INQLIINAY

SEQ ID NO: 981871 - protein, 9 aa, Homo Sapiens
HLHSFLMFK

SEQ ID NO: 981872 - protein, 9 aa, Homo Sapiens
HKNIVNLLG

SEQ ID NO: 981873 - protein, 9 aa, Homo Sapiens
RETKSSKNK

SEQ ID NO: 981874 - protein, 9 aa, Homo Sapiens
KIVPHVEKK

SEQ ID NO: 981875 - protein, 9 aa, Homo Sapiens
GFFLSQDPE

SEQ ID NO: 981876 - protein, 9 aa, Homo Sapiens
LDAETRSHN

SEQ ID NO: 981877 - protein, 9 aa, Homo Sapiens
CEFSLLRDL

SEQ ID NO: 981878 - protein, 9 aa, Homo Sapiens
DCFKIEGRA

SEQ ID NO: 981879 - protein, 9 aa, Homo Sapiens
ADQGHARRC

SEQ ID NO: 981880 - protein, 9 aa, Homo Sapiens
WGKVDSRPP

SEQ ID NO: 981881 - protein, 9 aa, Homo Sapiens
DAMNEGLEI

SEQ ID NO: 981882 - protein, 9 aa, Homo Sapiens
PLDFHFPLE

SEQ ID NO: 981883 - protein, 9 aa, Homo Sapiens
SARRVTLFP

SEQ ID NO: 981884 - protein, 9 aa, Homo Sapiens
TKISFKEVV

SEQ ID NO: 981885 - protein, 9 aa, Homo Sapiens
LATARWGPG

SEQ ID NO: 981886 - protein, 9 aa, Homo Sapiens
KEKLWYNER

SEQ ID NO: 981887 - protein, 9 aa, Homo Sapiens
KDPAPEIPS

SEQ ID NO: 981888 - protein, 9 aa, Homo Sapiens
LLLGGLPFS

SEQ ID NO: 981889 - protein, 9 aa, Homo Sapiens
FSWMESSRR

SEQ ID NO: 981890 - protein, 9 aa, Homo Sapiens
CPSPDIPSE

SEQ ID NO: 981891 - protein, 9 aa, Homo Sapiens
ENNVEEASK

SEQ ID NO: 981892 - protein, 9 aa, Homo Sapiens
VHTVMDNPV

SEQ ID NO: 981893 - protein, 9 aa, Homo Sapiens
KSYPRFPFI

SEQ ID NO: 981894 - protein, 9 aa, Homo Sapiens
TKKNSHQVK

SEQ ID NO: 981895 - protein, 9 aa, Homo Sapiens
PLLKTPRGG

SEQ ID NO: 981896 - protein, 9 aa, Homo Sapiens
RILVNAGCP

SEQ ID NO: 981897 - protein, 9 aa, Homo Sapiens
PLSPTRLAY

SEQ ID NO: 981898 - protein, 9 aa, Homo Sapiens
AVVHSFRLS

SEQ ID NO: 981899 - protein, 9 aa, Homo Sapiens
TTKISFKEV

SEQ ID NO: 981900 - protein, 9 aa, Homo Sapiens
AAPNLDEFV

SEQ ID NO: 981901 - protein, 9 aa, Homo Sapiens
YLSGFLSKC

SEQ ID NO: 981902 - protein, 9 aa, Homo Sapiens
FTLLKSYPR

SEQ ID NO: 981903 - protein, 9 aa, Homo Sapiens
ERVMNYIVS

SEQ ID NO: 981904 - protein, 9 aa, Homo Sapiens
GGCCGFEPH

SEQ ID NO: 981905 - protein, 9 aa, Homo Sapiens
GVNYGVELH

SEQ ID NO: 981906 - protein, 9 aa, Homo Sapiens
GFGGGAGSR

SEQ ID NO: 981907 - protein, 9 aa, Homo Sapiens
VNLAWDNKM

SEQ ID NO: 981908 - protein, 9 aa, Homo Sapiens
VLTEMDGPS

SEQ ID NO: 981909 - protein, 9 aa, Homo Sapiens
NLPHLYRLI

SEQ ID NO: 981910 - protein, 9 aa, Homo Sapiens
NFLERRKGP

SEQ ID NO: 981911 - protein, 9 aa, Homo Sapiens
HTFCRNYLE

SEQ ID NO: 981912 - protein, 9 aa, Homo Sapiens
LFFSDLLVA

SEQ ID NO: 981913 - protein, 9 aa, Homo Sapiens
YRLHSAPNL

SEQ ID NO: 981914 - protein, 9 aa, Homo Sapiens
HFLNVILFS

SEQ ID NO: 981915 - protein, 9 aa, Homo Sapiens
HLFEKKLAG

SEQ ID NO: 981916 - protein, 9 aa, Homo Sapiens
QDSRTDTVS

SEQ ID NO: 981917 - protein, 9 aa, Homo Sapiens
YIVIRLGKT

SEQ ID NO: 981918 - protein, 9 aa, Homo Sapiens
IDRRSLVPS

SEQ ID NO: 981919 - protein, 9 aa, Homo Sapiens
LTEFLYQPQ

SEQ ID NO: 981920 - protein, 9 aa, Homo Sapiens
PFGIEICRK

SEQ ID NO: 981921 - protein, 9 aa, Homo Sapiens
PLLYMVTMF

SEQ ID NO: 981922 - protein, 9 aa, Homo Sapiens
FCRGISGGI

SEQ ID NO: 981923 - protein, 9 aa, Homo Sapiens
SISIKCAPG

SEQ ID NO: 981924 - protein, 9 aa, Homo Sapiens
SSELFFEIG

SEQ ID NO: 981925 - protein, 9 aa, Homo Sapiens
KFSRTVQDV

SEQ ID NO: 981926 - protein, 9 aa, Homo Sapiens
HVVPKTVKP

SEQ ID NO: 981927 - protein, 9 aa, Homo Sapiens
RELDRNQVA

SEQ ID NO: 981928 - protein, 9 aa, Homo Sapiens
TLINEEEEE

SEQ ID NO: 981929 - protein, 9 aa, Homo Sapiens
PPGLAGPSG

SEQ ID NO: 981930 - protein, 9 aa, Homo Sapiens
VWQRFRKKS

SEQ ID NO: 981931 - protein, 9 aa, Homo Sapiens
AHAGISLSK

SEQ ID NO: 981932 - protein, 9 aa, Homo Sapiens
ALYSLDKLL

SEQ ID NO: 981933 - protein, 9 aa, Homo Sapiens
VYNDISHEG

SEQ ID NO: 981934 - protein, 9 aa, Homo Sapiens
SPRRAQASN

SEQ ID NO: 981935 - protein, 9 aa, Homo Sapiens
LFPHTRTIV

SEQ ID NO: 981936 - protein, 9 aa, Homo Sapiens
YLHSKEIIY

SEQ ID NO: 981937 - protein, 9 aa, Homo Sapiens
VVFLGGVFI

SEQ ID NO: 981938 - protein, 9 aa, Homo Sapiens
RSSPNVADQ

SEQ ID NO: 981939 - protein, 9 aa, Homo Sapiens
FLLFLEIYV

SEQ ID NO: 981940 - protein, 9 aa, Homo Sapiens
CNQCGKESK

SEQ ID NO: 981941 - protein, 9 aa, Homo Sapiens
PELLGSEIT

SEQ ID NO: 981942 - protein, 9 aa, Homo Sapiens
LFLFLLPQI

SEQ ID NO: 981943 - protein, 9 aa, Homo Sapiens
SSRKMFCQY

SEQ ID NO: 981944 - protein, 9 aa, Homo Sapiens
KSQKIINCE

SEQ ID NO: 981945 - protein, 9 aa, Homo Sapiens
RVKANAKER

SEQ ID NO: 981946 - protein, 9 aa, Homo Sapiens
PADSFIHVK

SEQ ID NO: 981947 - protein, 9 aa, Homo Sapiens
SPPPQHLQM

SEQ ID NO: 981948 - protein, 9 aa, Homo Sapiens
ALSHHKRLK

SEQ ID NO: 981949 - protein, 9 aa, Homo Sapiens
SASNYPTIS

SEQ ID NO: 981950 - protein, 9 aa, Homo Sapiens
DLLPTSIII

SEQ ID NO: 981951 - protein, 9 aa, Homo Sapiens
SHEALRCRV

SEQ ID NO: 981952 - protein, 9 aa, Homo Sapiens
MKSRPRRRY

SEQ ID NO: 981953 - protein, 9 aa, Homo Sapiens
QQDPPCQTK

SEQ ID NO: 981954 - protein, 9 aa, Homo Sapiens
PATSFQTTT

SEQ ID NO: 981955 - protein, 9 aa, Homo Sapiens
ERKRLLPVI

SEQ ID NO: 981956 - protein, 9 aa, Homo Sapiens
VCRALLREG

SEQ ID NO: 981957 - protein, 9 aa, Homo Sapiens
VSPTKQKSS

SEQ ID NO: 981958 - protein, 9 aa, Homo Sapiens
TLQSVAQPV

SEQ ID NO: 981959 - protein, 9 aa, Homo Sapiens
VDGPDFEAD

SEQ ID NO: 981960 - protein, 9 aa, Homo Sapiens
YPPSPPPQH

SEQ ID NO: 981961 - protein, 9 aa, Homo Sapiens
DKNLFNMEV

SEQ ID NO: 981962 - protein, 9 aa, Homo Sapiens
HGSPALSTS

SEQ ID NO: 981963 - protein, 9 aa, Homo Sapiens
ALQVEENLG

SEQ ID NO: 981964 - protein, 9 aa, Homo Sapiens
VNFSMDGHA

SEQ ID NO: 981965 - protein, 9 aa, Homo Sapiens
PESKSPGEY

SEQ ID NO: 981966 - protein, 9 aa, Homo Sapiens
VFLGGVFIC

SEQ ID NO: 981967 - protein, 9 aa, Homo Sapiens
NFSMDGHAC

SEQ ID NO: 981968 - protein, 9 aa, Homo Sapiens
VPEVAQPTH

SEQ ID NO: 981969 - protein, 9 aa, Homo Sapiens
PHHIRAIAE

SEQ ID NO: 981970 - protein, 9 aa, Homo Sapiens
LWIECATHS

SEQ ID NO: 981971 - protein, 9 aa, Homo Sapiens
SSWNKSRDF

SEQ ID NO: 981972 - protein, 9 aa, Homo Sapiens
FIHVKDYNS

SEQ ID NO: 981973 - protein, 9 aa, Homo Sapiens
VFKIRNHLI

SEQ ID NO: 981974 - protein, 9 aa, Homo Sapiens
LGLSRSVPA

SEQ ID NO: 981975 - protein, 9 aa, Homo Sapiens
ASELHTRLE

SEQ ID NO: 981976 - protein, 9 aa, Homo Sapiens
FLRNGDTVY

SEQ ID NO: 981977 - protein, 9 aa, Homo Sapiens
KPGSPRSWL

SEQ ID NO: 981978 - protein, 9 aa, Homo Sapiens
DRRSLVPSE

SEQ ID NO: 981979 - protein, 9 aa, Homo Sapiens
VSTGEVFYY

SEQ ID NO: 981980 - protein, 9 aa, Homo Sapiens
QTKDMKSRP

SEQ ID NO: 981981 - protein, 9 aa, Homo Sapiens
QRFGRLVER

SEQ ID NO: 981982 - protein, 9 aa, Homo Sapiens
MVIGFKFDQ

SEQ ID NO: 981983 - protein, 9 aa, Homo Sapiens
NEGTNKAIT

SEQ ID NO: 981984 - protein, 9 aa, Homo Sapiens
NWLCLDFLR

SEQ ID NO: 981985 - protein, 9 aa, Homo Sapiens
WSLGPSVQV

SEQ ID NO: 981986 - protein, 9 aa, Homo Sapiens
YIVNPVNNT

SEQ ID NO: 981987 - protein, 9 aa, Homo Sapiens
KQEASVASP

SEQ ID NO: 981988 - protein, 9 aa, Homo Sapiens
LSHSGLAPD

SEQ ID NO: 981989 - protein, 9 aa, Homo Sapiens
NITHLQKQI

SEQ ID NO: 981990 - protein, 9 aa, Homo Sapiens
IQGIEEGIR

SEQ ID NO: 981991 - protein, 9 aa, Homo Sapiens
QWGTIVQEI

SEQ ID NO: 981992 - protein, 9 aa, Homo Sapiens
ERGKRLGLD

SEQ ID NO: 981993 - protein, 9 aa, Homo Sapiens
DAAPNLDEF

SEQ ID NO: 981994 - protein, 9 aa, Homo Sapiens
RCPFCTCSA

SEQ ID NO: 981995 - protein, 9 aa, Homo Sapiens
LEVMEETKE

SEQ ID NO: 981996 - protein, 9 aa, Homo Sapiens
CGGKNEFEG

SEQ ID NO: 981997 - protein, 9 aa, Homo Sapiens
QKIFEKPLE

SEQ ID NO: 981998 - protein, 9 aa, Homo Sapiens
NFNSLQVKT

SEQ ID NO: 981999 - protein, 9 aa, Homo Sapiens
PGEFLCHNH

SEQ ID NO: 982000 - protein, 9 aa, Homo Sapiens
CSWAPLSGP

SEQ ID NO: 982001 - protein, 9 aa, Homo Sapiens
GSPALSTSS

SEQ ID NO: 982002 - protein, 9 aa, Homo Sapiens
VTNKSGYVD

SEQ ID NO: 982003 - protein, 9 aa, Homo Sapiens
KNINQLIIN

SEQ ID NO: 982004 - protein, 9 aa, Homo Sapiens
ASSFLLKER

SEQ ID NO: 982005 - protein, 9 aa, Homo Sapiens
KKLQRLQQA

SEQ ID NO: 982006 - protein, 9 aa, Homo Sapiens
EIYVVTVVG

SEQ ID NO: 982007 - protein, 9 aa, Homo Sapiens
GPGPFSLDH

SEQ ID NO: 982008 - protein, 9 aa, Homo Sapiens
SSPLTEHSQ

SEQ ID NO: 982009 - protein, 9 aa, Homo Sapiens
KFLLKGFRC

SEQ ID NO: 982010 - protein, 9 aa, Homo Sapiens
FGGNFSSVF

SEQ ID NO: 982011 - protein, 9 aa, Homo Sapiens
NNVEEASKA

SEQ ID NO: 982012 - protein, 9 aa, Homo Sapiens
QLCLDQKVL

SEQ ID NO: 982013 - protein, 9 aa, Homo Sapiens
RTSQQKMGL

SEQ ID NO: 982014 - protein, 9 aa, Homo Sapiens
YCYISPQGI

SEQ ID NO: 982015 - protein, 9 aa, Homo Sapiens
RHFGWMCPI

SEQ ID NO: 982016 - protein, 9 aa, Homo Sapiens
DTGVNGEIF

SEQ ID NO: 982017 - protein, 9 aa, Homo Sapiens
LKKMTDGGV

SEQ ID NO: 982018 - protein, 9 aa, Homo Sapiens
PKPGSPRSW

SEQ ID NO: 982019 - protein, 9 aa, Homo Sapiens
MLSTDIKRR

SEQ ID NO: 982020 - protein, 9 aa, Homo Sapiens
RKRLLPVIN

SEQ ID NO: 982021 - protein, 9 aa, Homo Sapiens
VQEQLKSLP

SEQ ID NO: 982022 - protein, 9 aa, Homo Sapiens
YPSQHMVFR

SEQ ID NO: 982023 - protein, 9 aa, Homo Sapiens
KKMWQRLKG

SEQ ID NO: 982024 - protein, 9 aa, Homo Sapiens
AGCCCQYRG

SEQ ID NO: 982025 - protein, 9 aa, Homo Sapiens
LCGGKNEFE

SEQ ID NO: 982026 - protein, 9 aa, Homo Sapiens
LLGGLPFSS

SEQ ID NO: 982027 - protein, 9 aa, Homo Sapiens
NSDHITFLQ

SEQ ID NO: 982028 - protein, 9 aa, Homo Sapiens
NPLAPKTST

SEQ ID NO: 982029 - protein, 9 aa, Homo Sapiens
RTQSPLVYT

SEQ ID NO: 982030 - protein, 9 aa, Homo Sapiens
DLRAASILV

SEQ ID NO: 982031 - protein, 9 aa, Homo Sapiens
SFCHRSDDP

SEQ ID NO: 982032 - protein, 9 aa, Homo Sapiens
RCKRKKKEE

SEQ ID NO: 982033 - protein, 9 aa, Homo Sapiens
NAGYSFEKL

SEQ ID NO: 982034 - protein, 9 aa, Homo Sapiens
SGYRICLGS

SEQ ID NO: 982035 - protein, 9 aa, Homo Sapiens
HTLTTKISF

SEQ ID NO: 982036 - protein, 9 aa, Homo Sapiens
FPVSVGRGP

SEQ ID NO: 982037 - protein, 9 aa, Homo Sapiens
EELNEDGEE

SEQ ID NO: 982038 - protein, 9 aa, Homo Sapiens
SCFLEGSPT

SEQ ID NO: 982039 - protein, 9 aa, Homo Sapiens
ARLPTTELS

SEQ ID NO: 982040 - protein, 9 aa, Homo Sapiens
EKDEEMAPA

SEQ ID NO: 982041 - protein, 9 aa, Homo Sapiens
SSLGEATGP

SEQ ID NO: 982042 - protein, 9 aa, Homo Sapiens
FIATYEPGT

SEQ ID NO: 982043 - protein, 9 aa, Homo Sapiens
GQKDPAPEI

SEQ ID NO: 982044 - protein, 9 aa, Homo Sapiens
AKDAEEMVR

SEQ ID NO: 982045 - protein, 9 aa, Homo Sapiens
PPSTSRACA

SEQ ID NO: 982046 - protein, 9 aa, Homo Sapiens
FTPLLSSPD

SEQ ID NO: 982047 - protein, 9 aa, Homo Sapiens
KLAKLLSSL

SEQ ID NO: 982048 - protein, 9 aa, Homo Sapiens
SAEAARRLA

SEQ ID NO: 982049 - protein, 9 aa, Homo Sapiens
STNFCVEDL

SEQ ID NO: 982050 - protein, 9 aa, Homo Sapiens
PAMKRTRTA

SEQ ID NO: 982051 - protein, 9 aa, Homo Sapiens
IFLDVGMKS

SEQ ID NO: 982052 - protein, 9 aa, Homo Sapiens
WDRPKHKED

SEQ ID NO: 982053 - protein, 9 aa, Homo Sapiens
LVYTATSLS

SEQ ID NO: 982054 - protein, 9 aa, Homo Sapiens
GKGTYVPLS

SEQ ID NO: 982055 - protein, 9 aa, Homo Sapiens
RILLCRKAG

SEQ ID NO: 982056 - protein, 9 aa, Homo Sapiens
LNIAIFFRA

SEQ ID NO: 982057 - protein, 9 aa, Homo Sapiens
VIVAWNHRD

SEQ ID NO: 982058 - protein, 9 aa, Homo Sapiens
GPGLALIAY

SEQ ID NO: 982059 - protein, 9 aa, Homo Sapiens
LYLSGYRIC

SEQ ID NO: 982060 - protein, 9 aa, Homo Sapiens
GPPGLAGPS

SEQ ID NO: 982061 - protein, 9 aa, Homo Sapiens
PPPPLLKTP

SEQ ID NO: 982062 - protein, 9 aa, Homo Sapiens
PSPETLILD

SEQ ID NO: 982063 - protein, 9 aa, Homo Sapiens
LPVVRALNI

SEQ ID NO: 982064 - protein, 9 aa, Homo Sapiens
NNGVKYSKL

SEQ ID NO: 982065 - protein, 9 aa, Homo Sapiens
SIRKRVKFT

SEQ ID NO: 982066 - protein, 9 aa, Homo Sapiens
LLPPGRLDY

SEQ ID NO: 982067 - protein, 9 aa, Homo Sapiens
PGYKRESCE

SEQ ID NO: 982068 - protein, 9 aa, Homo Sapiens
EQFCIPKPH

SEQ ID NO: 982069 - protein, 9 aa, Homo Sapiens
ALPLEKVCL

SEQ ID NO: 982070 - protein, 9 aa, Homo Sapiens
KKPYNLILG

SEQ ID NO: 982071 - protein, 9 aa, Homo Sapiens
EPAMKRTRT

SEQ ID NO: 982072 - protein, 9 aa, Homo Sapiens
LGSDYFFTQ

SEQ ID NO: 982073 - protein, 9 aa, Homo Sapiens
RFFIVSSMV

SEQ ID NO: 982074 - protein, 9 aa, Homo Sapiens
LHGNKGFFQ

SEQ ID NO: 982075 - protein, 9 aa, Homo Sapiens
VSIFVLTIP

SEQ ID NO: 982076 - protein, 9 aa, Homo Sapiens
GGGPWGKVD

SEQ ID NO: 982077 - protein, 9 aa, Homo Sapiens
NVTASKSDA

SEQ ID NO: 982078 - protein, 9 aa, Homo Sapiens
PEASIHAQD

SEQ ID NO: 982079 - protein, 9 aa, Homo Sapiens
FNMDVSSFS

SEQ ID NO: 982080 - protein, 9 aa, Homo Sapiens
PGWPESSGG

SEQ ID NO: 982081 - protein, 9 aa, Homo Sapiens
ALGIANLLL

SEQ ID NO: 982082 - protein, 9 aa, Homo Sapiens
HTEYLHLSS

SEQ ID NO: 982083 - protein, 9 aa, Homo Sapiens
HNEVLRVKK

SEQ ID NO: 982084 - protein, 9 aa, Homo Sapiens
NFFTICNAE

SEQ ID NO: 982085 - protein, 9 aa, Homo Sapiens
EISSILLDY

SEQ ID NO: 982086 - protein, 9 aa, Homo Sapiens
MQMLIQIKL

SEQ ID NO: 982087 - protein, 9 aa, Homo Sapiens
IKDKNLFNM

SEQ ID NO: 982088 - protein, 9 aa, Homo Sapiens
LFSFDVKNL

SEQ ID NO: 982089 - protein, 9 aa, Homo Sapiens
ETFANGNFL

SEQ ID NO: 982090 - protein, 9 aa, Homo Sapiens
LAVVHSFRL

SEQ ID NO: 982091 - protein, 9 aa, Homo Sapiens
SHEGVFEDG

SEQ ID NO: 982092 - protein, 9 aa, Homo Sapiens
KISFKEVVE

SEQ ID NO: 982093 - protein, 9 aa, Homo Sapiens
IVAVEQKGF

SEQ ID NO: 982094 - protein, 9 aa, Homo Sapiens
PPGLYMDEK

SEQ ID NO: 982095 - protein, 9 aa, Homo Sapiens
VDNNEFNIS

SEQ ID NO: 982096 - protein, 9 aa, Homo Sapiens
PPSPPPQHL

SEQ ID NO: 982097 - protein, 9 aa, Homo Sapiens
IIYDQKFLM

SEQ ID NO: 982098 - protein, 9 aa, Homo Sapiens
LLLAVPAPS

SEQ ID NO: 982099 - protein, 9 aa, Homo Sapiens
KRPRKNVKQ

SEQ ID NO: 982100 - protein, 9 aa, Homo Sapiens
GLDFRLGSS

SEQ ID NO: 982101 - protein, 9 aa, Homo Sapiens
RQDSRTDTV

SEQ ID NO: 982102 - protein, 9 aa, Homo Sapiens
VILSFILCI

SEQ ID NO: 982103 - protein, 9 aa, Homo Sapiens
VPGKVANLA

SEQ ID NO: 982104 - protein, 9 aa, Homo Sapiens
DSFNTLKKW

SEQ ID NO: 982105 - protein, 9 aa, Homo Sapiens
SEITHLEFP

SEQ ID NO: 982106 - protein, 9 aa, Homo Sapiens
EIKTSGMVI

SEQ ID NO: 982107 - protein, 9 aa, Homo Sapiens
SSPNVADQP

SEQ ID NO: 982108 - protein, 9 aa, Homo Sapiens
GLSVGLFFL

SEQ ID NO: 982109 - protein, 9 aa, Homo Sapiens
YKEWLLNEI

SEQ ID NO: 982110 - protein, 9 aa, Homo Sapiens
TSDSYVKVF

SEQ ID NO: 982111 - protein, 9 aa, Homo Sapiens
ITKAYYQGA

SEQ ID NO: 982112 - protein, 9 aa, Homo Sapiens
TLLKSYPRF

SEQ ID NO: 982113 - protein, 9 aa, Homo Sapiens
QKFLLKGFR

SEQ ID NO: 982114 - protein, 9 aa, Homo Sapiens
NGELVLWKA

SEQ ID NO: 982115 - protein, 9 aa, Homo Sapiens
VPLQYGCPD

SEQ ID NO: 982116 - protein, 9 aa, Homo Sapiens
RPRSRSRFK

SEQ ID NO: 982117 - protein, 9 aa, Homo Sapiens
KVARLEAPL

SEQ ID NO: 982118 - protein, 9 aa, Homo Sapiens
FESARRVTL

SEQ ID NO: 982119 - protein, 9 aa, Homo Sapiens
ESWSNSQQR

SEQ ID NO: 982120 - protein, 9 aa, Homo Sapiens
IGDCFKIEG

SEQ ID NO: 982121 - protein, 9 aa, Homo Sapiens
FKIRNHLIS

SEQ ID NO: 982122 - protein, 9 aa, Homo Sapiens
SHLILKPVS

SEQ ID NO: 982123 - protein, 9 aa, Homo Sapiens
FERVDYVKE

SEQ ID NO: 982124 - protein, 9 aa, Homo Sapiens
PYNLILGET

SEQ ID NO: 982125 - protein, 9 aa, Homo Sapiens
KDKFFESFL

SEQ ID NO: 982126 - protein, 9 aa, Homo Sapiens
VTDLKIRLL

SEQ ID NO: 982127 - protein, 9 aa, Homo Sapiens
SERKRLLPV

SEQ ID NO: 982128 - protein, 9 aa, Homo Sapiens
KINHIYREE

SEQ ID NO: 982129 - protein, 9 aa, Homo Sapiens
QAVQKVFSN

SEQ ID NO: 982130 - protein, 9 aa, Homo Sapiens
RRSRAALVG

SEQ ID NO: 982131 - protein, 9 aa, Homo Sapiens
LDLSKRKRN

SEQ ID NO: 982132 - protein, 9 aa, Homo Sapiens
TDLKIRLLR

SEQ ID NO: 982133 - protein, 9 aa, Homo Sapiens
FLERRKGPL

SEQ ID NO: 982134 - protein, 9 aa, Homo Sapiens
VLNNEFFAY

SEQ ID NO: 982135 - protein, 9 aa, Homo Sapiens
TAQLPMMGG

SEQ ID NO: 982136 - protein, 9 aa, Homo Sapiens
SAPENARFG

SEQ ID NO: 982137 - protein, 9 aa, Homo Sapiens
EVPRLHRDE

SEQ ID NO: 982138 - protein, 9 aa, Homo Sapiens
FYSECMVQL

SEQ ID NO: 982139 - protein, 9 aa, Homo Sapiens
NKSRDFCKG

SEQ ID NO: 982140 - protein, 9 aa, Homo Sapiens
VVFKIRNHL

SEQ ID NO: 982141 - protein, 9 aa, Homo Sapiens
YAFIVVENL

SEQ ID NO: 982142 - protein, 9 aa, Homo Sapiens
MILCQTHYE

SEQ ID NO: 982143 - protein, 9 aa, Homo Sapiens
HRDEERFFV

SEQ ID NO: 982144 - protein, 9 aa, Homo Sapiens
DPGEFLCHN

SEQ ID NO: 982145 - protein, 9 aa, Homo Sapiens
EELQRERGL

SEQ ID NO: 982146 - protein, 9 aa, Homo Sapiens
RETLVRAAV

SEQ ID NO: 982147 - protein, 9 aa, Homo Sapiens
SGLGYRLHS

SEQ ID NO: 982148 - protein, 9 aa, Homo Sapiens
THCRIRGGI

SEQ ID NO: 982149 - protein, 9 aa, Homo Sapiens
CSQMSSSEN

SEQ ID NO: 982150 - protein, 9 aa, Homo Sapiens
SLSHSGLAP

SEQ ID NO: 982151 - protein, 9 aa, Homo Sapiens
NFKSNHRLL

SEQ ID NO: 982152 - protein, 9 aa, Homo Sapiens
HCRIRGGIL

SEQ ID NO: 982153 - protein, 9 aa, Homo Sapiens
SQAWLCELL

SEQ ID NO: 982154 - protein, 9 aa, Homo Sapiens
CLCFVQTNI

SEQ ID NO: 982155 - protein, 9 aa, Homo Sapiens
DDKELYSMI

SEQ ID NO: 982156 - protein, 9 aa, Homo Sapiens
WGTIVQEIL

SEQ ID NO: 982157 - protein, 9 aa, Homo Sapiens
GEISSILLD

SEQ ID NO: 982158 - protein, 9 aa, Homo Sapiens
ECNNCGKFF

SEQ ID NO: 982159 - protein, 9 aa, Homo Sapiens
FPACQRPPQ

SEQ ID NO: 982160 - protein, 9 aa, Homo Sapiens
GSYVEPMSS

SEQ ID NO: 982161 - protein, 9 aa, Homo Sapiens
MFPRVCFLL

SEQ ID NO: 982162 - protein, 9 aa, Homo Sapiens
TRKSQKIIN

SEQ ID NO: 982163 - protein, 9 aa, Homo Sapiens
EGRGFEIFQ

SEQ ID NO: 982164 - protein, 9 aa, Homo Sapiens
DAEEMVRSF

SEQ ID NO: 982165 - protein, 9 aa, Homo Sapiens
NVQKMSQAE

SEQ ID NO: 982166 - protein, 9 aa, Homo Sapiens
KLEAAESTH

SEQ ID NO: 982167 - protein, 9 aa, Homo Sapiens
NVPLQYGCP

SEQ ID NO: 982168 - protein, 9 aa, Homo Sapiens
VTLIFYLFI

SEQ ID NO: 982169 - protein, 9 aa, Homo Sapiens
PYIVIRLGK

SEQ ID NO: 982170 - protein, 9 aa, Homo Sapiens
PHEMHFLNV

SEQ ID NO: 982171 - protein, 9 aa, Homo Sapiens
GEKPNGEIS

SEQ ID NO: 982172 - protein, 9 aa, Homo Sapiens
ALLRKVARL

SEQ ID NO: 982173 - protein, 9 aa, Homo Sapiens
FYRIKVTHD

SEQ ID NO: 982174 - protein, 9 aa, Homo Sapiens
IVIFLVCLA

SEQ ID NO: 982175 - protein, 9 aa, Homo Sapiens
DQKFLMECR

SEQ ID NO: 982176 - protein, 9 aa, Homo Sapiens
KGKKISKDQ

SEQ ID NO: 982177 - protein, 9 aa, Homo Sapiens
HPFLKLAKL

SEQ ID NO: 982178 - protein, 9 aa, Homo Sapiens
NKSEVVGYK

SEQ ID NO: 982179 - protein, 9 aa, Homo Sapiens
VVDVNDNAS

SEQ ID NO: 982180 - protein, 9 aa, Homo Sapiens
QSLDGTFQG

SEQ ID NO: 982181 - protein, 9 aa, Homo Sapiens
FKPPFQNSQ

SEQ ID NO: 982182 - protein, 9 aa, Homo Sapiens
GKEIEKNST

SEQ ID NO: 982183 - protein, 9 aa, Homo Sapiens
VLYWHFQIP

SEQ ID NO: 982184 - protein, 9 aa, Homo Sapiens
CSIHTSEKP

SEQ ID NO: 982185 - protein, 9 aa, Homo Sapiens
FITVAPEEK

SEQ ID NO: 982186 - protein, 9 aa, Homo Sapiens
LGYRLHSAP

SEQ ID NO: 982187 - protein, 9 aa, Homo Sapiens
QIRQGGSVA

SEQ ID NO: 982188 - protein, 9 aa, Homo Sapiens
WKARSLLYQ

SEQ ID NO: 982189 - protein, 9 aa, Homo Sapiens
WPESSGGPV

SEQ ID NO: 982190 - protein, 9 aa, Homo Sapiens
FLSQDPEFG

SEQ ID NO: 982191 - protein, 9 aa, Homo Sapiens
VAEGHKASC

SEQ ID NO: 982192 - protein, 9 aa, Homo Sapiens
LCQTHYEEG

SEQ ID NO: 982193 - protein, 9 aa, Homo Sapiens
VLLLRCPFC

SEQ ID NO: 982194 - protein, 9 aa, Homo Sapiens
RPLKLQITV

SEQ ID NO: 982195 - protein, 9 aa, Homo Sapiens
FEDRNCRHF

SEQ ID NO: 982196 - protein, 9 aa, Homo Sapiens
ITDGRATEE

SEQ ID NO: 982197 - protein, 9 aa, Homo Sapiens
PVVRALNID

SEQ ID NO: 982198 - protein, 9 aa, Homo Sapiens
LVICKPRQD

SEQ ID NO: 982199 - protein, 9 aa, Homo Sapiens
LPLRFFIVS

SEQ ID NO: 982200 - protein, 9 aa, Homo Sapiens
ELLGSEITH

SEQ ID NO: 982201 - protein, 9 aa, Homo Sapiens
KKFQGKWTV

SEQ ID NO: 982202 - protein, 9 aa, Homo Sapiens
LEKECANEP

SEQ ID NO: 982203 - protein, 9 aa, Homo Sapiens
EVVDGPDFE

SEQ ID NO: 982204 - protein, 9 aa, Homo Sapiens
ICSQMSSSE

SEQ ID NO: 982205 - protein, 9 aa, Homo Sapiens
LYMDEKGDC

SEQ ID NO: 982206 - protein, 9 aa, Homo Sapiens
TGVNMLSLG

SEQ ID NO: 982207 - protein, 9 aa, Homo Sapiens
YNLILGETF

SEQ ID NO: 982208 - protein, 9 aa, Homo Sapiens
RKDNFNSLQ

SEQ ID NO: 982209 - protein, 9 aa, Homo Sapiens
EEDGEGHVC

SEQ ID NO: 982210 - protein, 9 aa, Homo Sapiens
PLPGGKRHD

SEQ ID NO: 982211 - protein, 9 aa, Homo Sapiens
SYNFHDFQF

SEQ ID NO: 982212 - protein, 9 aa, Homo Sapiens
DDYVYWTDW

SEQ ID NO: 982213 - protein, 9 aa, Homo Sapiens
DMGGTSDSY

SEQ ID NO: 982214 - protein, 9 aa, Homo Sapiens
DYYLTEVDT

SEQ ID NO: 982215 - protein, 9 aa, Homo Sapiens
TKAFQRDVG

SEQ ID NO: 982216 - protein, 9 aa, Homo Sapiens
CSHTFCRNY

SEQ ID NO: 982217 - protein, 9 aa, Homo Sapiens
SQMSSSENL

SEQ ID NO: 982218 - protein, 9 aa, Homo Sapiens
KIFKQGSCL

SEQ ID NO: 982219 - protein, 9 aa, Homo Sapiens
EWLLRETLV

SEQ ID NO: 982220 - protein, 9 aa, Homo Sapiens
LSIDQYLAI

SEQ ID NO: 982221 - protein, 9 aa, Homo Sapiens
RMRTQSPLV

SEQ ID NO: 982222 - protein, 9 aa, Homo Sapiens
VPPTACSCT

SEQ ID NO: 982223 - protein, 9 aa, Homo Sapiens
HCEFSLLRD

SEQ ID NO: 982224 - protein, 9 aa, Homo Sapiens
VIKLNASNP

SEQ ID NO: 982225 - protein, 9 aa, Homo Sapiens
GKRHDSTEE

SEQ ID NO: 982226 - protein, 9 aa, Homo Sapiens
INQAKDSIV

SEQ ID NO: 982227 - protein, 9 aa, Homo Sapiens
FSLDHEFRT

SEQ ID NO: 982228 - protein, 9 aa, Homo Sapiens
YVDYKPTNP

SEQ ID NO: 982229 - protein, 9 aa, Homo Sapiens
AETRSHNEV

SEQ ID NO: 982230 - protein, 9 aa, Homo Sapiens
KIINCEQSS

SEQ ID NO: 982231 - protein, 9 aa, Homo Sapiens
KKIETRDEK

SEQ ID NO: 982232 - protein, 9 aa, Homo Sapiens
HFPFIVENY

SEQ ID NO: 982233 - protein, 9 aa, Homo Sapiens
HMNGELVLW

SEQ ID NO: 982234 - protein, 9 aa, Homo Sapiens
CYCEQLKVK

SEQ ID NO: 982235 - protein, 9 aa, Homo Sapiens
KGFQECFPA

SEQ ID NO: 982236 - protein, 9 aa, Homo Sapiens
QCGKESKLL

SEQ ID NO: 982237 - protein, 9 aa, Homo Sapiens
YLENILQAS

SEQ ID NO: 982238 - protein, 9 aa, Homo Sapiens
VYALMEGYF

SEQ ID NO: 982239 - protein, 9 aa, Homo Sapiens
DMKSRPRRR

SEQ ID NO: 982240 - protein, 9 aa, Homo Sapiens
KRKRNSRVQ

SEQ ID NO: 982241 - protein, 9 aa, Homo Sapiens
RRNTQDENI

SEQ ID NO: 982242 - protein, 9 aa, Homo Sapiens
CLSIDQYLA

SEQ ID NO: 982243 - protein, 9 aa, Homo Sapiens
RVTKKNSHQ

SEQ ID NO: 982244 - protein, 9 aa, Homo Sapiens
GLAGPSGES

SEQ ID NO: 982245 - protein, 9 aa, Homo Sapiens
RQKLEAAES

SEQ ID NO: 982246 - protein, 9 aa, Homo Sapiens
SKFGVNAIL

SEQ ID NO: 982247 - protein, 9 aa, Homo Sapiens
SSTEACSVF

SEQ ID NO: 982248 - protein, 9 aa, Homo Sapiens
DGSTLGPGE

SEQ ID NO: 982249 - protein, 9 aa, Homo Sapiens
TVSPACPEP

SEQ ID NO: 982250 - protein, 9 aa, Homo Sapiens
RKRCKRKKK

SEQ ID NO: 982251 - protein, 9 aa, Homo Sapiens
GFRWEHKMV

SEQ ID NO: 982252 - protein, 9 aa, Homo Sapiens
ESEKWCLST

SEQ ID NO: 982253 - protein, 9 aa, Homo Sapiens
GLGYRLHSA

SEQ ID NO: 982254 - protein, 9 aa, Homo Sapiens
ILKPVSADQ

SEQ ID NO: 982255 - protein, 9 aa, Homo Sapiens
PSPPPQHLQ

SEQ ID NO: 982256 - protein, 9 aa, Homo Sapiens
LALIAYPKA

SEQ ID NO: 982257 - protein, 9 aa, Homo Sapiens
QKFLMECRN

SEQ ID NO: 982258 - protein, 9 aa, Homo Sapiens
SVRLCGGKN

SEQ ID NO: 982259 - protein, 9 aa, Homo Sapiens
ESEMHVNNG

SEQ ID NO: 982260 - protein, 9 aa, Homo Sapiens
QLIFRRSPS

SEQ ID NO: 982261 - protein, 9 aa, Homo Sapiens
PVPATSFQT

SEQ ID NO: 982262 - protein, 9 aa, Homo Sapiens
FLGKKNTIF

SEQ ID NO: 982263 - protein, 9 aa, Homo Sapiens
EKMAVSEPS

SEQ ID NO: 982264 - protein, 9 aa, Homo Sapiens
KNPFGIEIC

SEQ ID NO: 982265 - protein, 9 aa, Homo Sapiens
WVADRRLLL

SEQ ID NO: 982266 - protein, 9 aa, Homo Sapiens
NESRFWEPV

SEQ ID NO: 982267 - protein, 9 aa, Homo Sapiens
QLKSLPSPE

SEQ ID NO: 982268 - protein, 9 aa, Homo Sapiens
LLDTHRMVV

SEQ ID NO: 982269 - protein, 9 aa, Homo Sapiens
YGRKSEEEN

SEQ ID NO: 982270 - protein, 9 aa, Homo Sapiens
SWIFCRGIS

SEQ ID NO: 982271 - protein, 9 aa, Homo Sapiens
KNSPHPTYL

SEQ ID NO: 982272 - protein, 9 aa, Homo Sapiens
GGIFGGQEN

SEQ ID NO: 982273 - protein, 9 aa, Homo Sapiens
QKQIVDGKM

SEQ ID NO: 982274 - protein, 9 aa, Homo Sapiens
SLHSQGAFR

SEQ ID NO: 982275 - protein, 9 aa, Homo Sapiens
EGGDKTNKK

SEQ ID NO: 982276 - protein, 9 aa, Homo Sapiens
AAFIIILTI

SEQ ID NO: 982277 - protein, 9 aa, Homo Sapiens
SADEDPQPV

SEQ ID NO: 982278 - protein, 9 aa, Homo Sapiens
KVARELDRN

SEQ ID NO: 982279 - protein, 9 aa, Homo Sapiens
RVMNYIVST

SEQ ID NO: 982280 - protein, 9 aa, Homo Sapiens
NCGKFFISK

SEQ ID NO: 982281 - protein, 9 aa, Homo Sapiens
SLLRDLLIR

SEQ ID NO: 982282 - protein, 9 aa, Homo Sapiens
KKSLEKAEI

SEQ ID NO: 982283 - protein, 9 aa, Homo Sapiens
QECINVPLQ

SEQ ID NO: 982284 - protein, 9 aa, Homo Sapiens
TSLATKAWT

SEQ ID NO: 982285 - protein, 9 aa, Homo Sapiens
KNSTLPNSF

SEQ ID NO: 982286 - protein, 9 aa, Homo Sapiens
CEQLKVKFQ

SEQ ID NO: 982287 - protein, 9 aa, Homo Sapiens
VKANAKERT

SEQ ID NO: 982288 - protein, 9 aa, Homo Sapiens
TWKKSCFLE

SEQ ID NO: 982289 - protein, 9 aa, Homo Sapiens
LGSEITHLE

SEQ ID NO: 982290 - protein, 9 aa, Homo Sapiens
EKFSRSGLM

SEQ ID NO: 982291 - protein, 9 aa, Homo Sapiens
RFGRLVERL

SEQ ID NO: 982292 - protein, 9 aa, Homo Sapiens
RINWLCLDF

SEQ ID NO: 982293 - protein, 9 aa, Homo Sapiens
EQAVQKVFS

SEQ ID NO: 982294 - protein, 9 aa, Homo Sapiens
YPMPNILEY

SEQ ID NO: 982295 - protein, 9 aa, Homo Sapiens
GIFGGQENS

SEQ ID NO: 982296 - protein, 9 aa, Homo Sapiens
CSVFKEKHI

SEQ ID NO: 982297 - protein, 9 aa, Homo Sapiens
PGSGNTYRP

SEQ ID NO: 982298 - protein, 9 aa, Homo Sapiens
STTLQSQML

SEQ ID NO: 982299 - protein, 9 aa, Homo Sapiens
TIFYSECMV

SEQ ID NO: 982300 - protein, 9 aa, Homo Sapiens
IERNCTDSK

SEQ ID NO: 982301 - protein, 9 aa, Homo Sapiens
YRICLGSST

SEQ ID NO: 982302 - protein, 9 aa, Homo Sapiens
IAIFFRALF

SEQ ID NO: 982303 - protein, 9 aa, Homo Sapiens
FCTCSARPE

SEQ ID NO: 982304 - protein, 9 aa, Homo Sapiens
THYYAIWKY

SEQ ID NO: 982305 - protein, 9 aa, Homo Sapiens
KPVPKAALH

SEQ ID NO: 982306 - protein, 9 aa, Homo Sapiens
DEKGDCVPK

SEQ ID NO: 982307 - protein, 9 aa, Homo Sapiens
FFSARGHQP

SEQ ID NO: 982308 - protein, 9 aa, Homo Sapiens
HGNKGFFQS

SEQ ID NO: 982309 - protein, 9 aa, Homo Sapiens
ECGKIFKQG

SEQ ID NO: 982310 - protein, 9 aa, Homo Sapiens
YKRESCEEV

SEQ ID NO: 982311 - protein, 9 aa, Homo Sapiens
GEAGPAGLT

SEQ ID NO: 982312 - protein, 9 aa, Homo Sapiens
CEERPRVSS

SEQ ID NO: 982313 - protein, 9 aa, Homo Sapiens
LSGLPGEKG

SEQ ID NO: 982314 - protein, 9 aa, Homo Sapiens
ASTVLSSVS

SEQ ID NO: 982315 - protein, 9 aa, Homo Sapiens
GNYDGVLYW

SEQ ID NO: 982316 - protein, 9 aa, Homo Sapiens
WVLGMIWSK

SEQ ID NO: 982317 - protein, 9 aa, Homo Sapiens
PEFSKTSKK

SEQ ID NO: 982318 - protein, 9 aa, Homo Sapiens
TRTAGPAVH

SEQ ID NO: 982319 - protein, 9 aa, Homo Sapiens
ICNIISLKD

SEQ ID NO: 982320 - protein, 9 aa, Homo Sapiens
KVRWRTKQN

SEQ ID NO: 982321 - protein, 9 aa, Homo Sapiens
LDQKVLSGH

SEQ ID NO: 982322 - protein, 9 aa, Homo Sapiens
LTGPAGECS

SEQ ID NO: 982323 - protein, 9 aa, Homo Sapiens
LSLGESEHL

SEQ ID NO: 982324 - protein, 9 aa, Homo Sapiens
IKKPYNLIL

SEQ ID NO: 982325 - protein, 9 aa, Homo Sapiens
SPHFTPLLS

SEQ ID NO: 982326 - protein, 9 aa, Homo Sapiens
EVLKKMTDG

SEQ ID NO: 982327 - protein, 9 aa, Homo Sapiens
VRPIASTAT

SEQ ID NO: 982328 - protein, 9 aa, Homo Sapiens
PLFPACQRP

SEQ ID NO: 982329 - protein, 9 aa, Homo Sapiens
CQTKLSNIQ

SEQ ID NO: 982330 - protein, 9 aa, Homo Sapiens
ESIHVILNV

SEQ ID NO: 982331 - protein, 9 aa, Homo Sapiens
TTDQPFSPE

SEQ ID NO: 982332 - protein, 9 aa, Homo Sapiens
GEQTKKMWQ

SEQ ID NO: 982333 - protein, 9 aa, Homo Sapiens
INCEQSSPD

SEQ ID NO: 982334 - protein, 9 aa, Homo Sapiens
ICTLVHTVM

SEQ ID NO: 982335 - protein, 9 aa, Homo Sapiens
NLAWDNKMR

SEQ ID NO: 982336 - protein, 9 aa, Homo Sapiens
DNNEFNISF

SEQ ID NO: 982337 - protein, 9 aa, Homo Sapiens
GIADRMQKK

SEQ ID NO: 982338 - protein, 9 aa, Homo Sapiens
MELARKCTK

SEQ ID NO: 982339 - protein, 9 aa, Homo Sapiens
LKNQPAQKN

SEQ ID NO: 982340 - protein, 9 aa, Homo Sapiens
RFRKKSTEQ

SEQ ID NO: 982341 - protein, 9 aa, Homo Sapiens
SAPGGQKDP

SEQ ID NO: 982342 - protein, 9 aa, Homo Sapiens
EGVFEDGSL

SEQ ID NO: 982343 - protein, 9 aa, Homo Sapiens
IPMTGEVRL

SEQ ID NO: 982344 - protein, 9 aa, Homo Sapiens
KDYNSPSEL

SEQ ID NO: 982345 - protein, 9 aa, Homo Sapiens
QPLANCQAP

SEQ ID NO: 982346 - protein, 9 aa, Homo Sapiens
AQGGFDTSI

SEQ ID NO: 982347 - protein, 9 aa, Homo Sapiens
KNLEDAMNE

SEQ ID NO: 982348 - protein, 9 aa, Homo Sapiens
LRSLYPPSP

SEQ ID NO: 982349 - protein, 9 aa, Homo Sapiens
VECEERPRV

SEQ ID NO: 982350 - protein, 9 aa, Homo Sapiens
PRAGRAFLM

SEQ ID NO: 982351 - protein, 9 aa, Homo Sapiens
IFYSLFQAS

SEQ ID NO: 982352 - protein, 9 aa, Homo Sapiens
YCYDGKFPT

SEQ ID NO: 982353 - protein, 9 aa, Homo Sapiens
LHSKEIIYR

SEQ ID NO: 982354 - protein, 9 aa, Homo Sapiens
PTVSGFFLS

SEQ ID NO: 982355 - protein, 9 aa, Homo Sapiens
LQKIFEKPL

SEQ ID NO: 982356 - protein, 9 aa, Homo Sapiens
VISSHTANL

SEQ ID NO: 982357 - protein, 9 aa, Homo Sapiens
LKLQITVTR

SEQ ID NO: 982358 - protein, 9 aa, Homo Sapiens
PMKEELPPP

SEQ ID NO: 982359 - protein, 9 aa, Homo Sapiens
CLDQKVLSG

SEQ ID NO: 982360 - protein, 9 aa, Homo Sapiens
SLANVCILA

SEQ ID NO: 982361 - protein, 9 aa, Homo Sapiens
PAPVPEVAQ

SEQ ID NO: 982362 - protein, 9 aa, Homo Sapiens
TRIIYDQKF

SEQ ID NO: 982363 - protein, 9 aa, Homo Sapiens
IIGCHAYGD

SEQ ID NO: 982364 - protein, 9 aa, Homo Sapiens
SWAPLSGPQ

SEQ ID NO: 982365 - protein, 9 aa, Homo Sapiens
RTRTAGPAV

SEQ ID NO: 982366 - protein, 9 aa, Homo Sapiens
SPTSVPIFP

SEQ ID NO: 982367 - protein, 9 aa, Homo Sapiens
VSIMEPGKT

SEQ ID NO: 982368 - protein, 9 aa, Homo Sapiens
QNCRYPSMA

SEQ ID NO: 982369 - protein, 9 aa, Homo Sapiens
GIERNCTDS

SEQ ID NO: 982370 - protein, 9 aa, Homo Sapiens
SSSAASIRS

SEQ ID NO: 982371 - protein, 9 aa, Homo Sapiens
SQHMVFRPK

SEQ ID NO: 982372 - protein, 9 aa, Homo Sapiens
ASPRSSSKP

SEQ ID NO: 982373 - protein, 9 aa, Homo Sapiens
FSNKRSFIL

SEQ ID NO: 982374 - protein, 9 aa, Homo Sapiens
LKSLQVLTE

SEQ ID NO: 982375 - protein, 9 aa, Homo Sapiens
HPLRKRCKR

SEQ ID NO: 982376 - protein, 9 aa, Homo Sapiens
QVEENLGMV

SEQ ID NO: 982377 - protein, 9 aa, Homo Sapiens
GAYPSQHMV

SEQ ID NO: 982378 - protein, 9 aa, Homo Sapiens
KAASPRSSS

SEQ ID NO: 982379 - protein, 9 aa, Homo Sapiens
FLILKFREL

SEQ ID NO: 982380 - protein, 9 aa, Homo Sapiens
VSRFHFPFI

SEQ ID NO: 982381 - protein, 9 aa, Homo Sapiens
VLRLFQKPV

SEQ ID NO: 982382 - protein, 9 aa, Homo Sapiens
GHSSIDSIS

SEQ ID NO: 982383 - protein, 9 aa, Homo Sapiens
LYFLKNGDP

SEQ ID NO: 982384 - protein, 9 aa, Homo Sapiens
IWKYLYLPS

SEQ ID NO: 982385 - protein, 9 aa, Homo Sapiens
SFGWFYCYD

SEQ ID NO: 982386 - protein, 9 aa, Homo Sapiens
NMDVSSFSS

SEQ ID NO: 982387 - protein, 9 aa, Homo Sapiens
KRTRTAGPA

SEQ ID NO: 982388 - protein, 9 aa, Homo Sapiens
NLFNMEVLV

SEQ ID NO: 982389 - protein, 9 aa, Homo Sapiens
STDIKRRKT

SEQ ID NO: 982390 - protein, 9 aa, Homo Sapiens
CVYFKPPFQ

SEQ ID NO: 982391 - protein, 9 aa, Homo Sapiens
PPPEASIHA

SEQ ID NO: 982392 - protein, 9 aa, Homo Sapiens
HFTPLLSSP

SEQ ID NO: 982393 - protein, 9 aa, Homo Sapiens
LCPEFSKTS

SEQ ID NO: 982394 - protein, 9 aa, Homo Sapiens
DNETGKISF

SEQ ID NO: 982395 - protein, 9 aa, Homo Sapiens
FYFSSGSCE

SEQ ID NO: 982396 - protein, 9 aa, Homo Sapiens
DVWQRFRKK

SEQ ID NO: 982397 - protein, 9 aa, Homo Sapiens
ENSSSTNFC

SEQ ID NO: 982398 - protein, 9 aa, Homo Sapiens
EFDTNSTNI

SEQ ID NO: 982399 - protein, 9 aa, Homo Sapiens
FSSLPLRFF

SEQ ID NO: 982400 - protein, 9 aa, Homo Sapiens
PKYHLHSFL

SEQ ID NO: 982401 - protein, 9 aa, Homo Sapiens
RSRFKSRSR

SEQ ID NO: 982402 - protein, 9 aa, Homo Sapiens
QHKNIVNLL

SEQ ID NO: 982403 - protein, 9 aa, Homo Sapiens
PGVLLFLSG

SEQ ID NO: 982404 - protein, 9 aa, Homo Sapiens
ALLREGVRG

SEQ ID NO: 982405 - protein, 9 aa, Homo Sapiens
KTQAGRSLP

SEQ ID NO: 982406 - protein, 9 aa, Homo Sapiens
FFTQVYNWD

SEQ ID NO: 982407 - protein, 9 aa, Homo Sapiens
LEKNVATHG

SEQ ID NO: 982408 - protein, 9 aa, Homo Sapiens
RGSFSLSTM

SEQ ID NO: 982409 - protein, 9 aa, Homo Sapiens
ILDKKGSKV

SEQ ID NO: 982410 - protein, 9 aa, Homo Sapiens
SQGAFRPLP

SEQ ID NO: 982411 - protein, 9 aa, Homo Sapiens
FPVQALQPL

SEQ ID NO: 982412 - protein, 9 aa, Homo Sapiens
GPFGVNYGV

SEQ ID NO: 982413 - protein, 9 aa, Homo Sapiens
SNPDEGANG

SEQ ID NO: 982414 - protein, 9 aa, Homo Sapiens
FTLSEQVEG

SEQ ID NO: 982415 - protein, 9 aa, Homo Sapiens
WYLEKNVAT

SEQ ID NO: 982416 - protein, 9 aa, Homo Sapiens
LEIYVVTVV

SEQ ID NO: 982417 - protein, 9 aa, Homo Sapiens
LKKLSLHSQ

SEQ ID NO: 982418 - protein, 9 aa, Homo Sapiens
ANVFFGGNF

SEQ ID NO: 982419 - protein, 9 aa, Homo Sapiens
QNARPITDG

SEQ ID NO: 982420 - protein, 9 aa, Homo Sapiens
LPSATLSEE

SEQ ID NO: 982421 - protein, 9 aa, Homo Sapiens
GVVRMVIGF

SEQ ID NO: 982422 - protein, 9 aa, Homo Sapiens
DYNPFSQVS

SEQ ID NO: 982423 - protein, 9 aa, Homo Sapiens
GGPWGKVDS

SEQ ID NO: 982424 - protein, 9 aa, Homo Sapiens
VEEVREFLH

SEQ ID NO: 982425 - protein, 9 aa, Homo Sapiens
TIVKKLAVS

SEQ ID NO: 982426 - protein, 9 aa, Homo Sapiens
IEVVDGPDF

SEQ ID NO: 982427 - protein, 9 aa, Homo Sapiens
KERFQITKI

SEQ ID NO: 982428 - protein, 9 aa, Homo Sapiens
KYLTGEQTK

SEQ ID NO: 982429 - protein, 9 aa, Homo Sapiens
NAKDAEEMV

SEQ ID NO: 982430 - protein, 9 aa, Homo Sapiens
QKCYCEQLK

SEQ ID NO: 982431 - protein, 9 aa, Homo Sapiens
PPPPPLLKT

SEQ ID NO: 982432 - protein, 9 aa, Homo Sapiens
LEEWTPDQP

SEQ ID NO: 982433 - protein, 9 aa, Homo Sapiens
ARELDRNQV

SEQ ID NO: 982434 - protein, 9 aa, Homo Sapiens
VIITATDRG

SEQ ID NO: 982435 - protein, 9 aa, Homo Sapiens
ETGSGNLID

SEQ ID NO: 982436 - protein, 9 aa, Homo Sapiens
GLSERVMNY

SEQ ID NO: 982437 - protein, 9 aa, Homo Sapiens
PCQTKLSNI

SEQ ID NO: 982438 - protein, 9 aa, Homo Sapiens
LFLSGGLFR

SEQ ID NO: 982439 - protein, 9 aa, Homo Sapiens
ERRGEPRDD

SEQ ID NO: 982440 - protein, 9 aa, Homo Sapiens
GDRGFDGLS

SEQ ID NO: 982441 - protein, 9 aa, Homo Sapiens
SLRFYQLIF

SEQ ID NO: 982442 - protein, 9 aa, Homo Sapiens
DISKTLEVI

SEQ ID NO: 982443 - protein, 9 aa, Homo Sapiens
IYKILCKLS

SEQ ID NO: 982444 - protein, 9 aa, Homo Sapiens
CHAYGDQYR

SEQ ID NO: 982445 - protein, 9 aa, Homo Sapiens
YEVPRLHRD

SEQ ID NO: 982446 - protein, 9 aa, Homo Sapiens
LAGPSGESG

SEQ ID NO: 982447 - protein, 9 aa, Homo Sapiens
LVLFSFDVK

SEQ ID NO: 982448 - protein, 9 aa, Homo Sapiens
AQKNSPHPT

SEQ ID NO: 982449 - protein, 9 aa, Homo Sapiens
VSQELEEET

SEQ ID NO: 982450 - protein, 9 aa, Homo Sapiens
LANQFLDIS

SEQ ID NO: 982451 - protein, 9 aa, Homo Sapiens
SHHKRLKCD

SEQ ID NO: 982452 - protein, 9 aa, Homo Sapiens
IITATDRGK

SEQ ID NO: 982453 - protein, 9 aa, Homo Sapiens
GEWIKGQNF

SEQ ID NO: 982454 - protein, 9 aa, Homo Sapiens
GCCCQYRGW

SEQ ID NO: 982455 - protein, 9 aa, Homo Sapiens
TQIIYDMLL

SEQ ID NO: 982456 - protein, 9 aa, Homo Sapiens
NTNQYHEML

SEQ ID NO: 982457 - protein, 9 aa, Homo Sapiens
FKQQKLKQE

SEQ ID NO: 982458 - protein, 9 aa, Homo Sapiens
PSETYQQGL

SEQ ID NO: 982459 - protein, 9 aa, Homo Sapiens
TKSQAWLCE

SEQ ID NO: 982460 - protein, 9 aa, Homo Sapiens
ASSTTLQSQ

SEQ ID NO: 982461 - protein, 9 aa, Homo Sapiens
DTQIIYDML

SEQ ID NO: 982462 - protein, 9 aa, Homo Sapiens
CLGSSTDKK

SEQ ID NO: 982463 - protein, 9 aa, Homo Sapiens
GWAGGNAKF

SEQ ID NO: 982464 - protein, 9 aa, Homo Sapiens
WKDNMNNCF

SEQ ID NO: 982465 - protein, 9 aa, Homo Sapiens
CFLILKFRE

SEQ ID NO: 982466 - protein, 9 aa, Homo Sapiens
IVPTVSGFF

SEQ ID NO: 982467 - protein, 9 aa, Homo Sapiens
SGESGREGA

SEQ ID NO: 982468 - protein, 9 aa, Homo Sapiens
LYKTLINFK

SEQ ID NO: 982469 - protein, 9 aa, Homo Sapiens
FPRVCFLLM

SEQ ID NO: 982470 - protein, 9 aa, Homo Sapiens
VFICSMIFN

SEQ ID NO: 982471 - protein, 9 aa, Homo Sapiens
TFANGNFLK

SEQ ID NO: 982472 - protein, 9 aa, Homo Sapiens
YFKPPFQNS

SEQ ID NO: 982473 - protein, 9 aa, Homo Sapiens
IVWHRFWIY

SEQ ID NO: 982474 - protein, 9 aa, Homo Sapiens
IFNIKDKNL

SEQ ID NO: 982475 - protein, 9 aa, Homo Sapiens
VHSFRLSQF

SEQ ID NO: 982476 - protein, 9 aa, Homo Sapiens
PLANKSEVV

SEQ ID NO: 982477 - protein, 9 aa, Homo Sapiens
RRAQASNAQ

SEQ ID NO: 982478 - protein, 9 aa, Homo Sapiens
PEGGDKTNK

SEQ ID NO: 982479 - protein, 9 aa, Homo Sapiens
DGQWGTVCN

SEQ ID NO: 982480 - protein, 9 aa, Homo Sapiens
CFKIEGRAV

SEQ ID NO: 982481 - protein, 9 aa, Homo Sapiens
NFKYQDFKR

SEQ ID NO: 982482 - protein, 9 aa, Homo Sapiens
DSFIHVKDY

SEQ ID NO: 982483 - protein, 9 aa, Homo Sapiens
ILGPFGVNY

SEQ ID NO: 982484 - protein, 9 aa, Homo Sapiens
CLETPADLS

SEQ ID NO: 982485 - protein, 9 aa, Homo Sapiens
DYKPTNPET

SEQ ID NO: 982486 - protein, 9 aa, Homo Sapiens
QDATYLWWI

SEQ ID NO: 982487 - protein, 9 aa, Homo Sapiens
ALIVISSHT

SEQ ID NO: 982488 - protein, 9 aa, Homo Sapiens
DGLSGLPGE

SEQ ID NO: 982489 - protein, 9 aa, Homo Sapiens
LGGVFICSM

SEQ ID NO: 982490 - protein, 9 aa, Homo Sapiens
NVFFGGNFS

SEQ ID NO: 982491 - protein, 9 aa, Homo Sapiens
SPQLPETPA

SEQ ID NO: 982492 - protein, 9 aa, Homo Sapiens
CTKLISDIR

SEQ ID NO: 982493 - protein, 9 aa, Homo Sapiens
LAWSLGPSV

SEQ ID NO: 982494 - protein, 9 aa, Homo Sapiens
LILKPVSAD

SEQ ID NO: 982495 - protein, 9 aa, Homo Sapiens
TAHKRIYTG

SEQ ID NO: 982496 - protein, 9 aa, Homo Sapiens
EKNVATHGS

SEQ ID NO: 982497 - protein, 9 aa, Homo Sapiens
KYHLHSFLM

SEQ ID NO: 982498 - protein, 9 aa, Homo Sapiens
QAVLRLFQK

SEQ ID NO: 982499 - protein, 9 aa, Homo Sapiens
TEQFCIPKP

SEQ ID NO: 982500 - protein, 9 aa, Homo Sapiens
PLTLINEEE

SEQ ID NO: 982501 - protein, 9 aa, Homo Sapiens
RTKGLAWSL

SEQ ID NO: 982502 - protein, 9 aa, Homo Sapiens
AALPLEKVC

SEQ ID NO: 982503 - protein, 9 aa, Homo Sapiens
FGGQENSLL

SEQ ID NO: 982504 - protein, 9 aa, Homo Sapiens
AQIFCLDSY

SEQ ID NO: 982505 - protein, 9 aa, Homo Sapiens
GRGFEIFQG

SEQ ID NO: 982506 - protein, 9 aa, Homo Sapiens
EDPQPVISW

SEQ ID NO: 982507 - protein, 9 aa, Homo Sapiens
NVVFLGGVF

SEQ ID NO: 982508 - protein, 9 aa, Homo Sapiens
TTEAQTTPL

SEQ ID NO: 982509 - protein, 9 aa, Homo Sapiens
ICLGSSTDK

SEQ ID NO: 982510 - protein, 9 aa, Homo Sapiens
QPLLHPPES

SEQ ID NO: 982511 - protein, 9 aa, Homo Sapiens
QQSRKDNFN

SEQ ID NO: 982512 - protein, 9 aa, Homo Sapiens
GFSKGLWIE

SEQ ID NO: 982513 - protein, 9 aa, Homo Sapiens
LPGVLLFLS

SEQ ID NO: 982514 - protein, 9 aa, Homo Sapiens
PCPEEKFSR

SEQ ID NO: 982515 - protein, 9 aa, Homo Sapiens
QKMGLELPN

SEQ ID NO: 982516 - protein, 9 aa, Homo Sapiens
DRGFDGLSG

SEQ ID NO: 982517 - protein, 9 aa, Homo Sapiens
KVICNFFTI

SEQ ID NO: 982518 - protein, 9 aa, Homo Sapiens
EQTPEYNVI

SEQ ID NO: 982519 - protein, 9 aa, Homo Sapiens
LREGVRGGL

SEQ ID NO: 982520 - protein, 9 aa, Homo Sapiens
AITKAYYQG

SEQ ID NO: 982521 - protein, 9 aa, Homo Sapiens
GWMCPIHRC

SEQ ID NO: 982522 - protein, 9 aa, Homo Sapiens
PNGEISSIL

SEQ ID NO: 982523 - protein, 9 aa, Homo Sapiens
PWGKVDSRP

SEQ ID NO: 982524 - protein, 9 aa, Homo Sapiens
KPHEMHFLN

SEQ ID NO: 982525 - protein, 9 aa, Homo Sapiens
VVVTAATMQ

SEQ ID NO: 982526 - protein, 9 aa, Homo Sapiens
GDSKNINQL

SEQ ID NO: 982527 - protein, 9 aa, Homo Sapiens
LLSSLTPLI

SEQ ID NO: 982528 - protein, 9 aa, Homo Sapiens
AVVMEDSSS

SEQ ID NO: 982529 - protein, 9 aa, Homo Sapiens
ALIAYPKAV

SEQ ID NO: 982530 - protein, 9 aa, Homo Sapiens
PMSSSGPAL

SEQ ID NO: 982531 - protein, 9 aa, Homo Sapiens
GQENSLLCS

SEQ ID NO: 982532 - protein, 9 aa, Homo Sapiens
TCLSIDQYL

SEQ ID NO: 982533 - protein, 9 aa, Homo Sapiens
LCSWAPLSG

SEQ ID NO: 982534 - protein, 9 aa, Homo Sapiens
NADGRFKGS

SEQ ID NO: 982535 - protein, 9 aa, Homo Sapiens
GFFSARGHQ

SEQ ID NO: 982536 - protein, 9 aa, Homo Sapiens
AIFDTVSQA

SEQ ID NO: 982537 - protein, 9 aa, Homo Sapiens
KRSFKVVVT

SEQ ID NO: 982538 - protein, 9 aa, Homo Sapiens
KPHKKPPSA

SEQ ID NO: 982539 - protein, 9 aa, Homo Sapiens
KIQGIEEGI

SEQ ID NO: 982540 - protein, 9 aa, Homo Sapiens
LHPPESKSP

SEQ ID NO: 982541 - protein, 9 aa, Homo Sapiens
FIIILTIDR

SEQ ID NO: 982542 - protein, 9 aa, Homo Sapiens
SKNINQLII

SEQ ID NO: 982543 - protein, 9 aa, Homo Sapiens
TLVCSSALE

SEQ ID NO: 982544 - protein, 9 aa, Homo Sapiens
RTSGLGYRL

SEQ ID NO: 982545 - protein, 9 aa, Homo Sapiens
QMSSSENLS

SEQ ID NO: 982546 - protein, 9 aa, Homo Sapiens
WLKSLQVLT

SEQ ID NO: 982547 - protein, 9 aa, Homo Sapiens
FPKDLAQQN

SEQ ID NO: 982548 - protein, 9 aa, Homo Sapiens
GTLCETGFG

SEQ ID NO: 982549 - protein, 9 aa, Homo Sapiens
LKACELWEQ

SEQ ID NO: 982550 - protein, 9 aa, Homo Sapiens
GVYALMEGY

SEQ ID NO: 982551 - protein, 9 aa, Homo Sapiens
DGPDFEADK

SEQ ID NO: 982552 - protein, 9 aa, Homo Sapiens
GSSEQPGVI

SEQ ID NO: 982553 - protein, 9 aa, Homo Sapiens
VAHEVPHLE

SEQ ID NO: 982554 - protein, 9 aa, Homo Sapiens
KFFISKSQL

SEQ ID NO: 982555 - protein, 9 aa, Homo Sapiens
FCGLPCLET

SEQ ID NO: 982556 - protein, 9 aa, Homo Sapiens
IHISLANVC

SEQ ID NO: 982557 - protein, 9 aa, Homo Sapiens
RAALVGRCS

SEQ ID NO: 982558 - protein, 9 aa, Homo Sapiens
GRSSFYPNG

SEQ ID NO: 982559 - protein, 9 aa, Homo Sapiens
NTQDENIRK

SEQ ID NO: 982560 - protein, 9 aa, Homo Sapiens
GSGNLIDPI

SEQ ID NO: 982561 - protein, 9 aa, Homo Sapiens
PEEKFSRSG

SEQ ID NO: 982562 - protein, 9 aa, Homo Sapiens
GVNGEIFYS

SEQ ID NO: 982563 - protein, 9 aa, Homo Sapiens
KNVATHGSQ

SEQ ID NO: 982564 - protein, 9 aa, Homo Sapiens
QMYANTNQY

SEQ ID NO: 982565 - protein, 9 aa, Homo Sapiens
FPEGGDKTN

SEQ ID NO: 982566 - protein, 9 aa, Homo Sapiens
EPVLEEWTP

SEQ ID NO: 982567 - protein, 9 aa, Homo Sapiens
QTPEYNVII

SEQ ID NO: 982568 - protein, 9 aa, Homo Sapiens
TNQYHEMLN

SEQ ID NO: 982569 - protein, 9 aa, Homo Sapiens
MKEELPPPP

SEQ ID NO: 982570 - protein, 9 aa, Homo Sapiens
LHSFLMFKP

SEQ ID NO: 982571 - protein, 9 aa, Homo Sapiens
YQGAQACVL

SEQ ID NO: 982572 - protein, 9 aa, Homo Sapiens
KGQNFGDVS

SEQ ID NO: 982573 - protein, 9 aa, Homo Sapiens
TYVPLSPTR

SEQ ID NO: 982574 - protein, 9 aa, Homo Sapiens
ISLKDNKIE

SEQ ID NO: 982575 - protein, 9 aa, Homo Sapiens
FRLSQFPDW

SEQ ID NO: 982576 - protein, 9 aa, Homo Sapiens
QKAPTNEAH

SEQ ID NO: 982577 - protein, 9 aa, Homo Sapiens
RQEFVRWAG

SEQ ID NO: 982578 - protein, 9 aa, Homo Sapiens
RRKFSRTVQ

SEQ ID NO: 982579 - protein, 9 aa, Homo Sapiens
EFVLTEFLY

SEQ ID NO: 982580 - protein, 9 aa, Homo Sapiens
IILSQLVAK

SEQ ID NO: 982581 - protein, 9 aa, Homo Sapiens
MEDSSSHEA

SEQ ID NO: 982582 - protein, 9 aa, Homo Sapiens
DNKLNVKDV

SEQ ID NO: 982583 - protein, 9 aa, Homo Sapiens
FKSRSRTRS

SEQ ID NO: 982584 - protein, 9 aa, Homo Sapiens
GYKRESCEE

SEQ ID NO: 982585 - protein, 9 aa, Homo Sapiens
PIGTERLAQ

SEQ ID NO: 982586 - protein, 9 aa, Homo Sapiens
PLRPMKEEL

SEQ ID NO: 982587 - protein, 9 aa, Homo Sapiens
ASAGVTLKE

SEQ ID NO: 982588 - protein, 9 aa, Homo Sapiens
ILRLSTSVL

SEQ ID NO: 982589 - protein, 9 aa, Homo Sapiens
KAVTKKKFQ

SEQ ID NO: 982590 - protein, 9 aa, Homo Sapiens
VELAPLLPW

SEQ ID NO: 982591 - protein, 9 aa, Homo Sapiens
AKIIYEKRQ

SEQ ID NO: 982592 - protein, 9 aa, Homo Sapiens
ICNFFTICN

SEQ ID NO: 982593 - protein, 9 aa, Homo Sapiens
LNASNPDEG

SEQ ID NO: 982594 - protein, 9 aa, Homo Sapiens
LWHIKRPWG

SEQ ID NO: 982595 - protein, 9 aa, Homo Sapiens
SKRDRKERT

SEQ ID NO: 982596 - protein, 9 aa, Homo Sapiens
EENESRFWE

SEQ ID NO: 982597 - protein, 9 aa, Homo Sapiens
LVNAGCPGP

SEQ ID NO: 982598 - protein, 9 aa, Homo Sapiens
GGVYALMEG

SEQ ID NO: 982599 - protein, 9 aa, Homo Sapiens
TSIRKRVKF

SEQ ID NO: 982600 - protein, 9 aa, Homo Sapiens
TLINFKSNH

SEQ ID NO: 982601 - protein, 9 aa, Homo Sapiens
NSSPLTEHS

SEQ ID NO: 982602 - protein, 9 aa, Homo Sapiens
KIRLLRPAV

SEQ ID NO: 982603 - protein, 9 aa, Homo Sapiens
TSVESNSYG

SEQ ID NO: 982604 - protein, 9 aa, Homo Sapiens
ALVITKMDK

SEQ ID NO: 982605 - protein, 9 aa, Homo Sapiens
GKRFPKDLA

SEQ ID NO: 982606 - protein, 9 aa, Homo Sapiens
IYHTFHSEY

SEQ ID NO: 982607 - protein, 9 aa, Homo Sapiens
KQQKLKQEA

SEQ ID NO: 982608 - protein, 9 aa, Homo Sapiens
PVIPLANKS

SEQ ID NO: 982609 - protein, 9 aa, Homo Sapiens
SDFKQQKLK

SEQ ID NO: 982610 - protein, 9 aa, Homo Sapiens
LIKNVQKMS

SEQ ID NO: 982611 - protein, 9 aa, Homo Sapiens
MIWSKCKEI

SEQ ID NO: 982612 - protein, 9 aa, Homo Sapiens
VNNTVVLSE

SEQ ID NO: 982613 - protein, 9 aa, Homo Sapiens
SFLREVESA

SEQ ID NO: 982614 - protein, 9 aa, Homo Sapiens
QENSLLCSY

SEQ ID NO: 982615 - protein, 9 aa, Homo Sapiens
KSSISFFQC

SEQ ID NO: 982616 - protein, 9 aa, Homo Sapiens
REEYSAMRD

SEQ ID NO: 982617 - protein, 9 aa, Homo Sapiens
ACGVPCPEE

SEQ ID NO: 982618 - protein, 9 aa, Homo Sapiens
SATLSEETN

SEQ ID NO: 982619 - protein, 9 aa, Homo Sapiens
FAYLHSKEI

SEQ ID NO: 982620 - protein, 9 aa, Homo Sapiens
RKRSFKVVV

SEQ ID NO: 982621 - protein, 9 aa, Homo Sapiens
NNMILCQTH

SEQ ID NO: 982622 - protein, 9 aa, Homo Sapiens
QYRGWQGRL

SEQ ID NO: 982623 - protein, 9 aa, Homo Sapiens
LTEFVLTEF

SEQ ID NO: 982624 - protein, 9 aa, Homo Sapiens
EQLKSLPSP

SEQ ID NO: 982625 - protein, 9 aa, Homo Sapiens
FYELPLEKK

SEQ ID NO: 982626 - protein, 9 aa, Homo Sapiens
LKLLALQVE

SEQ ID NO: 982627 - protein, 9 aa, Homo Sapiens
CMLNIPFSY

SEQ ID NO: 982628 - protein, 9 aa, Homo Sapiens
TKGLAWSLG

SEQ ID NO: 982629 - protein, 9 aa, Homo Sapiens
EEWTPDQPY

SEQ ID NO: 982630 - protein, 9 aa, Homo Sapiens
KLNASNPDE

SEQ ID NO: 982631 - protein, 9 aa, Homo Sapiens
RPKNAGYSF

SEQ ID NO: 982632 - protein, 9 aa, Homo Sapiens
EICRKSTGT

SEQ ID NO: 982633 - protein, 9 aa, Homo Sapiens
PTLVDEQLL

SEQ ID NO: 982634 - protein, 9 aa, Homo Sapiens
VMDNPVDLI

SEQ ID NO: 982635 - protein, 9 aa, Homo Sapiens
PLAPKTSTV

SEQ ID NO: 982636 - protein, 9 aa, Homo Sapiens
AASILVSEA

SEQ ID NO: 982637 - protein, 9 aa, Homo Sapiens
RRVTLFPDI

SEQ ID NO: 982638 - protein, 9 aa, Homo Sapiens
RKCTKLISD

SEQ ID NO: 982639 - protein, 9 aa, Homo Sapiens
PSRSGTALV

SEQ ID NO: 982640 - protein, 9 aa, Homo Sapiens
VARELDRNQ

SEQ ID NO: 982641 - protein, 9 aa, Homo Sapiens
YANDKFTLS

SEQ ID NO: 982642 - protein, 9 aa, Homo Sapiens
TNSDHITFL

SEQ ID NO: 982643 - protein, 9 aa, Homo Sapiens
VLEEWTPDQ

SEQ ID NO: 982644 - protein, 9 aa, Homo Sapiens
EPMSSSGPA

SEQ ID NO: 982645 - protein, 9 aa, Homo Sapiens
LAKLLSSLT

SEQ ID NO: 982646 - protein, 9 aa, Homo Sapiens
DRINWLCLD

SEQ ID NO: 982647 - protein, 9 aa, Homo Sapiens
TKDMKSRPR

SEQ ID NO: 982648 - protein, 9 aa, Homo Sapiens
GLKKLSLHS

SEQ ID NO: 982649 - protein, 9 aa, Homo Sapiens
SWEKMAVSE

SEQ ID NO: 982650 - protein, 9 aa, Homo Sapiens
DVSISIKCA

SEQ ID NO: 982651 - protein, 9 aa, Homo Sapiens
HRCGAWRGI

SEQ ID NO: 982652 - protein, 9 aa, Homo Sapiens
STCFIYQPL

SEQ ID NO: 982653 - protein, 9 aa, Homo Sapiens
VNPHTVSPA

SEQ ID NO: 982654 - protein, 9 aa, Homo Sapiens
SYKGKKISK

SEQ ID NO: 982655 - protein, 9 aa, Homo Sapiens
PRDQPLFPA

SEQ ID NO: 982656 - protein, 9 aa, Homo Sapiens
KGCDTQIIY

SEQ ID NO: 982657 - protein, 9 aa, Homo Sapiens
EDNANYVYD

SEQ ID NO: 982658 - protein, 9 aa, Homo Sapiens
TFCRNYLEN

SEQ ID NO: 982659 - protein, 9 aa, Homo Sapiens
DAETRSHNE

SEQ ID NO: 982660 - protein, 9 aa, Homo Sapiens
GFKFDQYMH

SEQ ID NO: 982661 - protein, 9 aa, Homo Sapiens
IIYDMLLRL

SEQ ID NO: 982662 - protein, 9 aa, Homo Sapiens
KNIEQLHER

SEQ ID NO: 982663 - protein, 9 aa, Homo Sapiens
HLTDSSEEA

SEQ ID NO: 982664 - protein, 9 aa, Homo Sapiens
PNVADQPPS

SEQ ID NO: 982665 - protein, 9 aa, Homo Sapiens
SIFVLTIPF

SEQ ID NO: 982666 - protein, 9 aa, Homo Sapiens
RIPGRMLPT

SEQ ID NO: 982667 - protein, 9 aa, Homo Sapiens
LSAATKYRF

SEQ ID NO: 982668 - protein, 9 aa, Homo Sapiens
LSVGLFFLL

SEQ ID NO: 982669 - protein, 9 aa, Homo Sapiens
ALESWSNSQ

SEQ ID NO: 982670 - protein, 9 aa, Homo Sapiens
TVNLAWDNK

SEQ ID NO: 982671 - protein, 9 aa, Homo Sapiens
HVIQKNHLN

SEQ ID NO: 982672 - protein, 9 aa, Homo Sapiens
STGPVPATS

SEQ ID NO: 982673 - protein, 9 aa, Homo Sapiens
PSPQLPETP

SEQ ID NO: 982674 - protein, 9 aa, Homo Sapiens
NLLILLVVC

SEQ ID NO: 982675 - protein, 9 aa, Homo Sapiens
IEDNKLRRN

SEQ ID NO: 982676 - protein, 9 aa, Homo Sapiens
FGEQGGSCE

SEQ ID NO: 982677 - protein, 9 aa, Homo Sapiens
TEFLYQPQW

SEQ ID NO: 982678 - protein, 9 aa, Homo Sapiens
REGVRGGLV

SEQ ID NO: 982679 - protein, 9 aa, Homo Sapiens
PLSAATKYR

SEQ ID NO: 982680 - protein, 9 aa, Homo Sapiens
EAPEDRILL

SEQ ID NO: 982681 - protein, 9 aa, Homo Sapiens
SEVDRSNFL

SEQ ID NO: 982682 - protein, 9 aa, Homo Sapiens
LDRSFQADH

SEQ ID NO: 982683 - protein, 9 aa, Homo Sapiens
TVSIMEPGK

SEQ ID NO: 982684 - protein, 9 aa, Homo Sapiens
ENCRGLTGP

SEQ ID NO: 982685 - protein, 9 aa, Homo Sapiens
TVTDLKIRL

SEQ ID NO: 982686 - protein, 9 aa, Homo Sapiens
EFEELQRER

SEQ ID NO: 982687 - protein, 9 aa, Homo Sapiens
KSEVVGYKV

SEQ ID NO: 982688 - protein, 9 aa, Homo Sapiens
QIKLSLVLN

SEQ ID NO: 982689 - protein, 9 aa, Homo Sapiens
NPFGIEICR

SEQ ID NO: 982690 - protein, 9 aa, Homo Sapiens
PSEPPPTHL

SEQ ID NO: 982691 - protein, 9 aa, Homo Sapiens
LGSTSFISI

SEQ ID NO: 982692 - protein, 9 aa, Homo Sapiens
NPHTVSPAC

SEQ ID NO: 982693 - protein, 9 aa, Homo Sapiens
ICNPGYKRE

SEQ ID NO: 982694 - protein, 9 aa, Homo Sapiens
GLELPNQNL

SEQ ID NO: 982695 - protein, 9 aa, Homo Sapiens
FGVNYGVEL

SEQ ID NO: 982696 - protein, 9 aa, Homo Sapiens
GKKNTIFYS

SEQ ID NO: 982697 - protein, 9 aa, Homo Sapiens
EQFIATYEP

SEQ ID NO: 982698 - protein, 9 aa, Homo Sapiens
ERNCTDSKY

SEQ ID NO: 982699 - protein, 9 aa, Homo Sapiens
NLDEFVKPG

SEQ ID NO: 982700 - protein, 9 aa, Homo Sapiens
SAPLDFHFP

SEQ ID NO: 982701 - protein, 9 aa, Homo Sapiens
FEDDKELYS

SEQ ID NO: 982702 - protein, 9 aa, Homo Sapiens
VAKRQKSSY

SEQ ID NO: 982703 - protein, 9 aa, Homo Sapiens
APPARLPTT

SEQ ID NO: 982704 - protein, 9 aa, Homo Sapiens
FSQVSTGEV

SEQ ID NO: 982705 - protein, 9 aa, Homo Sapiens
DNANYVYDV

SEQ ID NO: 982706 - protein, 9 aa, Homo Sapiens
KHKEDLLGY

SEQ ID NO: 982707 - protein, 9 aa, Homo Sapiens
AATKYRFKY

SEQ ID NO: 982708 - protein, 9 aa, Homo Sapiens
GIEEGIRIF

SEQ ID NO: 982709 - protein, 9 aa, Homo Sapiens
EATGPDPLR

SEQ ID NO: 982710 - protein, 9 aa, Homo Sapiens
TEVLENIDT

SEQ ID NO: 982711 - protein, 9 aa, Homo Sapiens
SPDIPSEPP

SEQ ID NO: 982712 - protein, 9 aa, Homo Sapiens
PQFSAEAAR

SEQ ID NO: 982713 - protein, 9 aa, Homo Sapiens
SQLTLTSLS

SEQ ID NO: 982714 - protein, 9 aa, Homo Sapiens
ACQLFHRIQ

SEQ ID NO: 982715 - protein, 9 aa, Homo Sapiens
CCCQYRGWQ

SEQ ID NO: 982716 - protein, 9 aa, Homo Sapiens
GDCFKIEGR

SEQ ID NO: 982717 - protein, 9 aa, Homo Sapiens
IVISSHTAN

SEQ ID NO: 982718 - protein, 9 aa, Homo Sapiens
LTVFSPEET

SEQ ID NO: 982719 - protein, 9 aa, Homo Sapiens
QASNAQECG

SEQ ID NO: 982720 - protein, 9 aa, Homo Sapiens
SCLCFVQTN

SEQ ID NO: 982721 - protein, 9 aa, Homo Sapiens
WGTVCNDDF

SEQ ID NO: 982722 - protein, 9 aa, Homo Sapiens
NPETSEMLL

SEQ ID NO: 982723 - protein, 9 aa, Homo Sapiens
LILDKKGSK

SEQ ID NO: 982724 - protein, 9 aa, Homo Sapiens
QFNMEVEIK

SEQ ID NO: 982725 - protein, 9 aa, Homo Sapiens
LILLVVCLD

SEQ ID NO: 982726 - protein, 9 aa, Homo Sapiens
KESKLLSKF

SEQ ID NO: 982727 - protein, 9 aa, Homo Sapiens
HWLKSLQVL

SEQ ID NO: 982728 - protein, 9 aa, Homo Sapiens
FFGGNFSSV

SEQ ID NO: 982729 - protein, 9 aa, Homo Sapiens
IRAMYADLN

SEQ ID NO: 982730 - protein, 9 aa, Homo Sapiens
AFRLFDDNE

SEQ ID NO: 982731 - protein, 9 aa, Homo Sapiens
QMLIQIKLS

SEQ ID NO: 982732 - protein, 9 aa, Homo Sapiens
EDKNSFLRE

SEQ ID NO: 982733 - protein, 9 aa, Homo Sapiens
SLGEATGPD

SEQ ID NO: 982734 - protein, 9 aa, Homo Sapiens
QKRTKIKKK

SEQ ID NO: 982735 - protein, 9 aa, Homo Sapiens
FYLFILITI

SEQ ID NO: 982736 - protein, 9 aa, Homo Sapiens
IKNAKDAEE

SEQ ID NO: 982737 - protein, 9 aa, Homo Sapiens
HTRTIVKKL

SEQ ID NO: 982738 - protein, 9 aa, Homo Sapiens
QQSRKMGDS

SEQ ID NO: 982739 - protein, 9 aa, Homo Sapiens
MKSIAFYNV

SEQ ID NO: 982740 - protein, 9 aa, Homo Sapiens
PPCIHISLA

SEQ ID NO: 982741 - protein, 9 aa, Homo Sapiens
LKSLPSPEL

SEQ ID NO: 982742 - protein, 9 aa, Homo Sapiens
PLPPSTSRA

SEQ ID NO: 982743 - protein, 9 aa, Homo Sapiens
TFQGGGVCI

SEQ ID NO: 982744 - protein, 9 aa, Homo Sapiens
PKEVRLDLS

SEQ ID NO: 982745 - protein, 9 aa, Homo Sapiens
LCFVQTNIS

SEQ ID NO: 982746 - protein, 9 aa, Homo Sapiens
ILDTAGREE

SEQ ID NO: 982747 - protein, 9 aa, Homo Sapiens
YPRVKVGNK

SEQ ID NO: 982748 - protein, 9 aa, Homo Sapiens
VNGRCDNTA

SEQ ID NO: 982749 - protein, 9 aa, Homo Sapiens
LYSMIEEYF

SEQ ID NO: 982750 - protein, 9 aa, Homo Sapiens
LLPVVRALN

SEQ ID NO: 982751 - protein, 9 aa, Homo Sapiens
PARENCRGL

SEQ ID NO: 982752 - protein, 9 aa, Homo Sapiens
MSWIFCRGI

SEQ ID NO: 982753 - protein, 9 aa, Homo Sapiens
VSADQMIVS

SEQ ID NO: 982754 - protein, 9 aa, Homo Sapiens
SILVSEALC

SEQ ID NO: 982755 - protein, 9 aa, Homo Sapiens
DLSKRKRNS

SEQ ID NO: 982756 - protein, 9 aa, Homo Sapiens
NMAHCEFSL

SEQ ID NO: 982757 - protein, 9 aa, Homo Sapiens
NIEQLHERV

SEQ ID NO: 982758 - protein, 9 aa, Homo Sapiens
SPALSTSST

SEQ ID NO: 982759 - protein, 9 aa, Homo Sapiens
PTDSSTGVE

SEQ ID NO: 982760 - protein, 9 aa, Homo Sapiens
GQWGTVCND

SEQ ID NO: 982761 - protein, 9 aa, Homo Sapiens
QVQEENFKY

SEQ ID NO: 982762 - protein, 9 aa, Homo Sapiens
VTAVAKTQA

SEQ ID NO: 982763 - protein, 9 aa, Homo Sapiens
CGKIFKQGS

SEQ ID NO: 982764 - protein, 9 aa, Homo Sapiens
EAARRLAGL

SEQ ID NO: 982765 - protein, 9 aa, Homo Sapiens
AQPVRPIAS

SEQ ID NO: 982766 - protein, 9 aa, Homo Sapiens
PLSASNYPT

SEQ ID NO: 982767 - protein, 9 aa, Homo Sapiens
GASTVLSSV

SEQ ID NO: 982768 - protein, 9 aa, Homo Sapiens
CVAHSEREP

SEQ ID NO: 982769 - protein, 9 aa, Homo Sapiens
PKTSTVRET

SEQ ID NO: 982770 - protein, 9 aa, Homo Sapiens
DKFFESFLQ

SEQ ID NO: 982771 - protein, 9 aa, Homo Sapiens
FKGSLMTKV

SEQ ID NO: 982772 - protein, 9 aa, Homo Sapiens
NDKSRPLKL

SEQ ID NO: 982773 - protein, 9 aa, Homo Sapiens
VGIGDCFKI

SEQ ID NO: 982774 - protein, 9 aa, Homo Sapiens
SLDHEFRTS

SEQ ID NO: 982775 - protein, 9 aa, Homo Sapiens
VALVITKMD

SEQ ID NO: 982776 - protein, 9 aa, Homo Sapiens
FLEGSPTLH

SEQ ID NO: 982777 - protein, 9 aa, Homo Sapiens
IKLSLVLNF

SEQ ID NO: 982778 - protein, 9 aa, Homo Sapiens
RGIVWHRFW

SEQ ID NO: 982779 - protein, 9 aa, Homo Sapiens
YNVIITATD

SEQ ID NO: 982780 - protein, 9 aa, Homo Sapiens
HTFHSEYLC

SEQ ID NO: 982781 - protein, 9 aa, Homo Sapiens
PSFCHRSDD

SEQ ID NO: 982782 - protein, 9 aa, Homo Sapiens
KMGDSPNIT

SEQ ID NO: 982783 - protein, 9 aa, Homo Sapiens
KSQAWLCEL

SEQ ID NO: 982784 - protein, 9 aa, Homo Sapiens
MSSSGPALF

SEQ ID NO: 982785 - protein, 9 aa, Homo Sapiens
KGDCVPKAQ

SEQ ID NO: 982786 - protein, 9 aa, Homo Sapiens
INPGKIPRG

SEQ ID NO: 982787 - protein, 9 aa, Homo Sapiens
SISFFQCVY

SEQ ID NO: 982788 - protein, 9 aa, Homo Sapiens
RDEERFFVE

SEQ ID NO: 982789 - protein, 9 aa, Homo Sapiens
GEKSFLGQG

SEQ ID NO: 982790 - protein, 9 aa, Homo Sapiens
KGTYVPLSP

SEQ ID NO: 982791 - protein, 9 aa, Homo Sapiens
RQLQKKLQR

SEQ ID NO: 982792 - protein, 9 aa, Homo Sapiens
LDGDSKNIN

SEQ ID NO: 982793 - protein, 9 aa, Homo Sapiens
LARKCTKLI

SEQ ID NO: 982794 - protein, 9 aa, Homo Sapiens
IKKKTKYTI

SEQ ID NO: 982795 - protein, 9 aa, Homo Sapiens
ITSHLIQLG

SEQ ID NO: 982796 - protein, 9 aa, Homo Sapiens
IRGGILAMP

SEQ ID NO: 982797 - protein, 9 aa, Homo Sapiens
KKLAGQSRA

SEQ ID NO: 982798 - protein, 9 aa, Homo Sapiens
TKSSKNKLH

SEQ ID NO: 982799 - protein, 9 aa, Homo Sapiens
SLATKAWTI

SEQ ID NO: 982800 - protein, 9 aa, Homo Sapiens
GNAKFKSLF

SEQ ID NO: 982801 - protein, 9 aa, Homo Sapiens
FVRKVKMPK

SEQ ID NO: 982802 - protein, 9 aa, Homo Sapiens
SVLNNEFFA

SEQ ID NO: 982803 - protein, 9 aa, Homo Sapiens
FVHVSSQDS

SEQ ID NO: 982804 - protein, 9 aa, Homo Sapiens
YLTEVDTMV

SEQ ID NO: 982805 - protein, 9 aa, Homo Sapiens
PAFPTDSST

SEQ ID NO: 982806 - protein, 9 aa, Homo Sapiens
EKAVTKKKF

SEQ ID NO: 982807 - protein, 9 aa, Homo Sapiens
LFQKPRSLD

SEQ ID NO: 982808 - protein, 9 aa, Homo Sapiens
VNAGCPGPV

SEQ ID NO: 982809 - protein, 9 aa, Homo Sapiens
SPACPEPQG

SEQ ID NO: 982810 - protein, 9 aa, Homo Sapiens
KPLTLINEE

SEQ ID NO: 982811 - protein, 9 aa, Homo Sapiens
LSTDIKRRK

SEQ ID NO: 982812 - protein, 9 aa, Homo Sapiens
AAAPPLSAS

SEQ ID NO: 982813 - protein, 9 aa, Homo Sapiens
GFEIFQGRL

SEQ ID NO: 982814 - protein, 9 aa, Homo Sapiens
VKMPKKPKF

SEQ ID NO: 982815 - protein, 9 aa, Homo Sapiens
FPFIVENYR

SEQ ID NO: 982816 - protein, 9 aa, Homo Sapiens
DLNEGTNKA

SEQ ID NO: 982817 - protein, 9 aa, Homo Sapiens
FSQYPRLEV

SEQ ID NO: 982818 - protein, 9 aa, Homo Sapiens
KNGNFIIST

SEQ ID NO: 982819 - protein, 9 aa, Homo Sapiens
SFEDNANYV

SEQ ID NO: 982820 - protein, 9 aa, Homo Sapiens
STGSAFGFS

SEQ ID NO: 982821 - protein, 9 aa, Homo Sapiens
YVEPMSSSG

SEQ ID NO: 982822 - protein, 9 aa, Homo Sapiens
SFYPNGGDQ

SEQ ID NO: 982823 - protein, 9 aa, Homo Sapiens
SIDQYLAIV

SEQ ID NO: 982824 - protein, 9 aa, Homo Sapiens
LQQSRKMGD

SEQ ID NO: 982825 - protein, 9 aa, Homo Sapiens
QIISRLFHC

SEQ ID NO: 982826 - protein, 9 aa, Homo Sapiens
GLTAPEKDE

SEQ ID NO: 982827 - protein, 9 aa, Homo Sapiens
RSRSRFKSR

SEQ ID NO: 982828 - protein, 9 aa, Homo Sapiens
RSHGSPALS

SEQ ID NO: 982829 - protein, 9 aa, Homo Sapiens
NYDGVLYWH

SEQ ID NO: 982830 - protein, 9 aa, Homo Sapiens
TQDENIRKW

SEQ ID NO: 982831 - protein, 9 aa, Homo Sapiens
SKPTSASLN

SEQ ID NO: 982832 - protein, 9 aa, Homo Sapiens
GTCVAHSER

SEQ ID NO: 982833 - protein, 9 aa, Homo Sapiens
QLEKECANE

SEQ ID NO: 982834 - protein, 9 aa, Homo Sapiens
IKGQNFGDV

SEQ ID NO: 982835 - protein, 9 aa, Homo Sapiens
LCLDQKVLS

SEQ ID NO: 982836 - protein, 9 aa, Homo Sapiens
EDPLPGGKR

SEQ ID NO: 982837 - protein, 9 aa, Homo Sapiens
RTSAIFDTV

SEQ ID NO: 982838 - protein, 9 aa, Homo Sapiens
HLQKQIVDG

SEQ ID NO: 982839 - protein, 9 aa, Homo Sapiens
LNVVFLGGV

SEQ ID NO: 982840 - protein, 9 aa, Homo Sapiens
GFCRRPASS

SEQ ID NO: 982841 - protein, 9 aa, Homo Sapiens
TFHSEYLCN

SEQ ID NO: 982842 - protein, 9 aa, Homo Sapiens
KADPYIVIR

SEQ ID NO: 982843 - protein, 9 aa, Homo Sapiens
ICVYFKPPF

SEQ ID NO: 982844 - protein, 9 aa, Homo Sapiens
IQLGLSRSV

SEQ ID NO: 982845 - protein, 9 aa, Homo Sapiens
LRLFQKPVP

SEQ ID NO: 982846 - protein, 9 aa, Homo Sapiens
RGRSSFYPN

SEQ ID NO: 982847 - protein, 9 aa, Homo Sapiens
ELVVASAGV

SEQ ID NO: 982848 - protein, 9 aa, Homo Sapiens
LLENYLDME

SEQ ID NO: 982849 - protein, 9 aa, Homo Sapiens
PGLFSSGLY

SEQ ID NO: 982850 - protein, 9 aa, Homo Sapiens
SLLYKTLIN

SEQ ID NO: 982851 - protein, 9 aa, Homo Sapiens
DEDYYLTEV

SEQ ID NO: 982852 - protein, 9 aa, Homo Sapiens
LEPVLEEWT

SEQ ID NO: 982853 - protein, 9 aa, Homo Sapiens
PGLAPSPQL

SEQ ID NO: 982854 - protein, 9 aa, Homo Sapiens
DKELYSMIE

SEQ ID NO: 982855 - protein, 9 aa, Homo Sapiens
PHVEKKPVK

SEQ ID NO: 982856 - protein, 9 aa, Homo Sapiens
NAGCPGPVK

SEQ ID NO: 982857 - protein, 9 aa, Homo Sapiens
DMYPMPNIL

SEQ ID NO: 982858 - protein, 9 aa, Homo Sapiens
VLLFLSGGL

SEQ ID NO: 982859 - protein, 9 aa, Homo Sapiens
CRALLREGV

SEQ ID NO: 982860 - protein, 9 aa, Homo Sapiens
AIFFRALFG

SEQ ID NO: 982861 - protein, 9 aa, Homo Sapiens
AMSAPENAR

SEQ ID NO: 982862 - protein, 9 aa, Homo Sapiens
LSSCVDSFG

SEQ ID NO: 982863 - protein, 9 aa, Homo Sapiens
FYCYDGKFP

SEQ ID NO: 982864 - protein, 9 aa, Homo Sapiens
LAPLLPWQP

SEQ ID NO: 982865 - protein, 9 aa, Homo Sapiens
IRKWFKVTI

SEQ ID NO: 982866 - protein, 9 aa, Homo Sapiens
ALEPVLEEW

SEQ ID NO: 982867 - protein, 9 aa, Homo Sapiens
VSQFPQLNE

SEQ ID NO: 982868 - protein, 9 aa, Homo Sapiens
YEPGTTIFS

SEQ ID NO: 982869 - protein, 9 aa, Homo Sapiens
QQKMGLELP

SEQ ID NO: 982870 - protein, 9 aa, Homo Sapiens
IRKRVKFTT

SEQ ID NO: 982871 - protein, 9 aa, Homo Sapiens
DRILVNAGC

SEQ ID NO: 982872 - protein, 9 aa, Homo Sapiens
EVHKNSRSD

SEQ ID NO: 982873 - protein, 9 aa, Homo Sapiens
DYSMCIIPW

SEQ ID NO: 982874 - protein, 9 aa, Homo Sapiens
NEEEEEKLY

SEQ ID NO: 982875 - protein, 9 aa, Homo Sapiens
CYCGQERRG

SEQ ID NO: 982876 - protein, 9 aa, Homo Sapiens
DLSDANFVD

SEQ ID NO: 982877 - protein, 9 aa, Homo Sapiens
SYVEPMSSS

SEQ ID NO: 982878 - protein, 9 aa, Homo Sapiens
RAGVMSVYL

SEQ ID NO: 982879 - protein, 9 aa, Homo Sapiens
HLNDETLAK

SEQ ID NO: 982880 - protein, 9 aa, Homo Sapiens
RKSQKIINC

SEQ ID NO: 982881 - protein, 9 aa, Homo Sapiens
LVQEQLKSL

SEQ ID NO: 982882 - protein, 9 aa, Homo Sapiens
QRQLNPNIW

SEQ ID NO: 982883 - protein, 9 aa, Homo Sapiens
SKTLEVIPM

SEQ ID NO: 982884 - protein, 9 aa, Homo Sapiens
ESSWNKSRD

SEQ ID NO: 982885 - protein, 9 aa, Homo Sapiens
VNASEIIQR

SEQ ID NO: 982886 - protein, 9 aa, Homo Sapiens
ICRKSTGTI

SEQ ID NO: 982887 - protein, 9 aa, Homo Sapiens
SSLPLRFFI

SEQ ID NO: 982888 - protein, 9 aa, Homo Sapiens
LALQVEENL

SEQ ID NO: 982889 - protein, 9 aa, Homo Sapiens
SQQKMGLEL

SEQ ID NO: 982890 - protein, 9 aa, Homo Sapiens
GFEPHHIRA

SEQ ID NO: 982891 - protein, 9 aa, Homo Sapiens
SVPIFPVSV

SEQ ID NO: 982892 - protein, 9 aa, Homo Sapiens
AKLLSSLTP

SEQ ID NO: 982893 - protein, 9 aa, Homo Sapiens
KISSYSLEK

SEQ ID NO: 982894 - protein, 9 aa, Homo Sapiens
VQHCSIHTS

SEQ ID NO: 982895 - protein, 9 aa, Homo Sapiens
KAVSRFHFP

SEQ ID NO: 982896 - protein, 9 aa, Homo Sapiens
RGFDGLSGL

SEQ ID NO: 982897 - protein, 9 aa, Homo Sapiens
RENSVPTTA

SEQ ID NO: 982898 - protein, 9 aa, Homo Sapiens
ANFLFLFLL

SEQ ID NO: 982899 - protein, 9 aa, Homo Sapiens
LYMVTMFPR

SEQ ID NO: 982900 - protein, 9 aa, Homo Sapiens
GAWRGIVWH

SEQ ID NO: 982901 - protein, 9 aa, Homo Sapiens
TSTVRETQT

SEQ ID NO: 982902 - protein, 9 aa, Homo Sapiens
QGPGSGNTY

SEQ ID NO: 982903 - protein, 9 aa, Homo Sapiens
QCKSKRPRK

SEQ ID NO: 982904 - protein, 9 aa, Homo Sapiens
TKALNYSVE

SEQ ID NO: 982905 - protein, 9 aa, Homo Sapiens
TSFISIGRR

SEQ ID NO: 982906 - protein, 9 aa, Homo Sapiens
VQWDRPKHK

SEQ ID NO: 982907 - protein, 9 aa, Homo Sapiens
STEACSVFK

SEQ ID NO: 982908 - protein, 9 aa, Homo Sapiens
SLPSPELQG

SEQ ID NO: 982909 - protein, 9 aa, Homo Sapiens
DGEEIDHAE

SEQ ID NO: 982910 - protein, 9 aa, Homo Sapiens
NSSSTNFCV

SEQ ID NO: 982911 - protein, 9 aa, Homo Sapiens
QSSGCSQHE

SEQ ID NO: 982912 - protein, 9 aa, Homo Sapiens
GRFKGSLMT

SEQ ID NO: 982913 - protein, 9 aa, Homo Sapiens
SSSENLSKS

SEQ ID NO: 982914 - protein, 9 aa, Homo Sapiens
LQSVAQPVR

SEQ ID NO: 982915 - protein, 9 aa, Homo Sapiens
KLHSLSKML

SEQ ID NO: 982916 - protein, 9 aa, Homo Sapiens
FEADKDQHP

SEQ ID NO: 982917 - protein, 9 aa, Homo Sapiens
SQSLDGTFQ

SEQ ID NO: 982918 - protein, 9 aa, Homo Sapiens
VVENLVIIT

SEQ ID NO: 982919 - protein, 9 aa, Homo Sapiens
QLKVKFQKM

SEQ ID NO: 982920 - protein, 9 aa, Homo Sapiens
RCEWLLRET

SEQ ID NO: 982921 - protein, 9 aa, Homo Sapiens
RQVQEENFK

SEQ ID NO: 982922 - protein, 9 aa, Homo Sapiens
AGFRWEHKM

SEQ ID NO: 982923 - protein, 9 aa, Homo Sapiens
RGEAGPAGL

SEQ ID NO: 982924 - protein, 9 aa, Homo Sapiens
VEQKGFQAS

SEQ ID NO: 982925 - protein, 9 aa, Homo Sapiens
ILKNQPAQK

SEQ ID NO: 982926 - protein, 9 aa, Homo Sapiens
NCRRFWNFI

SEQ ID NO: 982927 - protein, 9 aa, Homo Sapiens
ADRMQKKIT

SEQ ID NO: 982928 - protein, 9 aa, Homo Sapiens
LHSQGAFRP

SEQ ID NO: 982929 - protein, 9 aa, Homo Sapiens
PSINQAKDS

SEQ ID NO: 982930 - protein, 9 aa, Homo Sapiens
PRKNVKQHA

SEQ ID NO: 982931 - protein, 9 aa, Homo Sapiens
AVEQKGFQA

SEQ ID NO: 982932 - protein, 9 aa, Homo Sapiens
VPKPGSPRS

SEQ ID NO: 982933 - protein, 9 aa, Homo Sapiens
NYGVELHSD

SEQ ID NO: 982934 - protein, 9 aa, Homo Sapiens
ALVPGKVAN

SEQ ID NO: 982935 - protein, 9 aa, Homo Sapiens
KCTKLISDI

SEQ ID NO: 982936 - protein, 9 aa, Homo Sapiens
LCEASEACV

SEQ ID NO: 982937 - protein, 9 aa, Homo Sapiens
GYKEWLLNE

SEQ ID NO: 982938 - protein, 9 aa, Homo Sapiens
VCGSEKICI

SEQ ID NO: 982939 - protein, 9 aa, Homo Sapiens
NKLHSLSKM

SEQ ID NO: 982940 - protein, 9 aa, Homo Sapiens
EGFSQYPRL

SEQ ID NO: 982941 - protein, 9 aa, Homo Sapiens
KSKFGVNAI

SEQ ID NO: 982942 - protein, 9 aa, Homo Sapiens
PPPSCLCFV

SEQ ID NO: 982943 - protein, 9 aa, Homo Sapiens
ANGLQLLCS

SEQ ID NO: 982944 - protein, 9 aa, Homo Sapiens
HKASCCLED

SEQ ID NO: 982945 - protein, 9 aa, Homo Sapiens
LLRCPFCTC

SEQ ID NO: 982946 - protein, 9 aa, Homo Sapiens
SSGPALFGL

SEQ ID NO: 982947 - protein, 9 aa, Homo Sapiens
PGRLDYSMC

SEQ ID NO: 982948 - protein, 9 aa, Homo Sapiens
QNFGDVSWS

SEQ ID NO: 982949 - protein, 9 aa, Homo Sapiens
VVTFLVLPI

SEQ ID NO: 982950 - protein, 9 aa, Homo Sapiens
TRSHNEVLR

SEQ ID NO: 982951 - protein, 9 aa, Homo Sapiens
GLSRSVPAC

SEQ ID NO: 982952 - protein, 9 aa, Homo Sapiens
NHLNDETLA

SEQ ID NO: 982953 - protein, 9 aa, Homo Sapiens
TGPVPATSF

SEQ ID NO: 982954 - protein, 9 aa, Homo Sapiens
TTTEAQTTP

SEQ ID NO: 982955 - protein, 9 aa, Homo Sapiens
ILKLLALQV

SEQ ID NO: 982956 - protein, 9 aa, Homo Sapiens
LLCLANQFL

SEQ ID NO: 982957 - protein, 9 aa, Homo Sapiens
VNNEFEELQ

SEQ ID NO: 982958 - protein, 9 aa, Homo Sapiens
RFYQLIFRR

SEQ ID NO: 982959 - protein, 9 aa, Homo Sapiens
IEKNSTLPN

SEQ ID NO: 982960 - protein, 9 aa, Homo Sapiens
ETKSSKNKL

SEQ ID NO: 982961 - protein, 9 aa, Homo Sapiens
GGAETTADQ

SEQ ID NO: 982962 - protein, 9 aa, Homo Sapiens
VFVRKVKMP

SEQ ID NO: 982963 - protein, 9 aa, Homo Sapiens
EFVKPGAHV

SEQ ID NO: 982964 - protein, 9 aa, Homo Sapiens
SYCYISPQG

SEQ ID NO: 982965 - protein, 9 aa, Homo Sapiens
FFTICNAEM

SEQ ID NO: 982966 - protein, 9 aa, Homo Sapiens
VTKKNSHQV

SEQ ID NO: 982967 - protein, 9 aa, Homo Sapiens
SRFWEPVLP

SEQ ID NO: 982968 - protein, 9 aa, Homo Sapiens
SGLAPDVPA

SEQ ID NO: 982969 - protein, 9 aa, Homo Sapiens
IFGFTLLDD

SEQ ID NO: 982970 - protein, 9 aa, Homo Sapiens
VMTVANFLF

SEQ ID NO: 982971 - protein, 9 aa, Homo Sapiens
QQKLKQEAQ

SEQ ID NO: 982972 - protein, 9 aa, Homo Sapiens
VSQEKMLSA

SEQ ID NO: 982973 - protein, 9 aa, Homo Sapiens
WDNKMRVTE

SEQ ID NO: 982974 - protein, 9 aa, Homo Sapiens
QTHYEEGLM

SEQ ID NO: 982975 - protein, 9 aa, Homo Sapiens
QAASQPQLD

SEQ ID NO: 982976 - protein, 9 aa, Homo Sapiens
ISIGRRTYA

SEQ ID NO: 982977 - protein, 9 aa, Homo Sapiens
LPWQPVGQN

SEQ ID NO: 982978 - protein, 9 aa, Homo Sapiens
SFIHVKDYN

SEQ ID NO: 982979 - protein, 9 aa, Homo Sapiens
MNEGLEIVR

SEQ ID NO: 982980 - protein, 9 aa, Homo Sapiens
GGAGSRFGF

SEQ ID NO: 982981 - protein, 9 aa, Homo Sapiens
RLEVMEETK

SEQ ID NO: 982982 - protein, 9 aa, Homo Sapiens
TSAIFDTVS

SEQ ID NO: 982983 - protein, 9 aa, Homo Sapiens
AARRLAGLL

SEQ ID NO: 982984 - protein, 9 aa, Homo Sapiens
EERPRVSSS

SEQ ID NO: 982985 - protein, 9 aa, Homo Sapiens
GPCHENQTE

SEQ ID NO: 982986 - protein, 9 aa, Homo Sapiens
ACSVFKEKH

SEQ ID NO: 982987 - protein, 9 aa, Homo Sapiens
EILQSQGQK

SEQ ID NO: 982988 - protein, 9 aa, Homo Sapiens
NMLSLGESE

SEQ ID NO: 982989 - protein, 9 aa, Homo Sapiens
PAAFIIILT

SEQ ID NO: 982990 - protein, 9 aa, Homo Sapiens
TLEIFRNLA

SEQ ID NO: 982991 - protein, 9 aa, Homo Sapiens
IYLSGFLSK

SEQ ID NO: 982992 - protein, 9 aa, Homo Sapiens
SSALESWSN

SEQ ID NO: 982993 - protein, 9 aa, Homo Sapiens
NPGYKRESC

SEQ ID NO: 982994 - protein, 9 aa, Homo Sapiens
NVADQPPSP

SEQ ID NO: 982995 - protein, 9 aa, Homo Sapiens
NKLNVKDVD

SEQ ID NO: 982996 - protein, 9 aa, Homo Sapiens
LVAKRQKSS

SEQ ID NO: 982997 - protein, 9 aa, Homo Sapiens
LLRKVARLE

SEQ ID NO: 982998 - protein, 9 aa, Homo Sapiens
ESNSYGRKS

SEQ ID NO: 982999 - protein, 9 aa, Homo Sapiens
LPTSIIITF

SEQ ID NO: 983000 - protein, 9 aa, Homo Sapiens
TKKKFQGKW

SEQ ID NO: 983001 - protein, 9 aa, Homo Sapiens
NIRKWFKVT

SEQ ID NO: 983002 - protein, 9 aa, Homo Sapiens
VLDSPFSTG

SEQ ID NO: 983003 - protein, 9 aa, Homo Sapiens
IDAALPLEK

SEQ ID NO: 983004 - protein, 9 aa, Homo Sapiens
NCRHFGWMC

SEQ ID NO: 983005 - protein, 9 aa, Homo Sapiens
KLSNIQKRQ

SEQ ID NO: 983006 - protein, 9 aa, Homo Sapiens
ALLVTLIFY

SEQ ID NO: 983007 - protein, 9 aa, Homo Sapiens
AVLRLFQKP

SEQ ID NO: 983008 - protein, 9 aa, Homo Sapiens
APNLDEFVK

SEQ ID NO: 983009 - protein, 9 aa, Homo Sapiens
EDGEEIDHA

SEQ ID NO: 983010 - protein, 9 aa, Homo Sapiens
HVEKKPVKI

SEQ ID NO: 983011 - protein, 9 aa, Homo Sapiens
QPCSSSFSC

SEQ ID NO: 983012 - protein, 9 aa, Homo Sapiens
GGNAKFKSL

SEQ ID NO: 983013 - protein, 9 aa, Homo Sapiens
SPFSTGSAF

SEQ ID NO: 983014 - protein, 9 aa, Homo Sapiens
VTTDQPFSP

SEQ ID NO: 983015 - protein, 9 aa, Homo Sapiens
KTSSSPTTA

SEQ ID NO: 983016 - protein, 9 aa, Homo Sapiens
ECEERPRVS

SEQ ID NO: 983017 - protein, 9 aa, Homo Sapiens
HRVAQIFCL

SEQ ID NO: 983018 - protein, 9 aa, Homo Sapiens
AHEVPHLED

SEQ ID NO: 983019 - protein, 9 aa, Homo Sapiens
EGVRGGLVD

SEQ ID NO: 983020 - protein, 9 aa, Homo Sapiens
KMAVSEPSE

SEQ ID NO: 983021 - protein, 9 aa, Homo Sapiens
SQYPRLEVV

SEQ ID NO: 983022 - protein, 9 aa, Homo Sapiens
SYGRKSEEE

SEQ ID NO: 983023 - protein, 9 aa, Homo Sapiens
ARRLAGLLR

SEQ ID NO: 983024 - protein, 9 aa, Homo Sapiens
HKNSRSDMM

SEQ ID NO: 983025 - protein, 9 aa, Homo Sapiens
ENQTYICLA

SEQ ID NO: 983026 - protein, 9 aa, Homo Sapiens
DPPCQTKLS

SEQ ID NO: 983027 - protein, 9 aa, Homo Sapiens
SMIEEYFQG

SEQ ID NO: 983028 - protein, 9 aa, Homo Sapiens
VSGVPKPGS

SEQ ID NO: 983029 - protein, 9 aa, Homo Sapiens
VVDGPDFEA

SEQ ID NO: 983030 - protein, 9 aa, Homo Sapiens
KYQDFKRMV

SEQ ID NO: 983031 - protein, 9 aa, Homo Sapiens
PPLPPSTSR

SEQ ID NO: 983032 - protein, 9 aa, Homo Sapiens
KLFQSLALS

SEQ ID NO: 983033 - protein, 9 aa, Homo Sapiens
PAQKNSPHP

SEQ ID NO: 983034 - protein, 9 aa, Homo Sapiens
VPATSFQTT

SEQ ID NO: 983035 - protein, 9 aa, Homo Sapiens
ENLSKSGVK

SEQ ID NO: 983036 - protein, 9 aa, Homo Sapiens
FFRALFGAL

SEQ ID NO: 983037 - protein, 9 aa, Homo Sapiens
VDVNDNASQ

SEQ ID NO: 983038 - protein, 9 aa, Homo Sapiens
VDLNEGTNK

SEQ ID NO: 983039 - protein, 9 aa, Homo Sapiens
RRGEPRDDL

SEQ ID NO: 983040 - protein, 9 aa, Homo Sapiens
PGGQKDPAP

SEQ ID NO: 983041 - protein, 9 aa, Homo Sapiens
SSQECINVP

SEQ ID NO: 983042 - protein, 9 aa, Homo Sapiens
PRTSGLGYR

SEQ ID NO: 983043 - protein, 9 aa, Homo Sapiens
EVAQPTHHP

SEQ ID NO: 983044 - protein, 9 aa, Homo Sapiens
NPVNNTVVL

SEQ ID NO: 983045 - protein, 9 aa, Homo Sapiens
AGISVVPRE

SEQ ID NO: 983046 - protein, 9 aa, Homo Sapiens
LQYYGSSYN

SEQ ID NO: 983047 - protein, 9 aa, Homo Sapiens
ELAPLLPWQ

SEQ ID NO: 983048 - protein, 9 aa, Homo Sapiens
FIYQPLANC

SEQ ID NO: 983049 - protein, 9 aa, Homo Sapiens
GRQRSSGFG

SEQ ID NO: 983050 - protein, 9 aa, Homo Sapiens
SKGLWIECA

SEQ ID NO: 983051 - protein, 9 aa, Homo Sapiens
SGPGLALIA

SEQ ID NO: 983052 - protein, 9 aa, Homo Sapiens
IYQPLANCQ

SEQ ID NO: 983053 - protein, 9 aa, Homo Sapiens
CIPKPHKKP

SEQ ID NO: 983054 - protein, 9 aa, Homo Sapiens
YCTDLLPTS

SEQ ID NO: 983055 - protein, 9 aa, Homo Sapiens
TSYKGKKIS

SEQ ID NO: 983056 - protein, 9 aa, Homo Sapiens
ANKLESLPS

SEQ ID NO: 983057 - protein, 9 aa, Homo Sapiens
FLGQGDLKQ

SEQ ID NO: 983058 - protein, 9 aa, Homo Sapiens
DSRGSFSLS

SEQ ID NO: 983059 - protein, 9 aa, Homo Sapiens
KTSGMVIST

SEQ ID NO: 983060 - protein, 9 aa, Homo Sapiens
SLEKAEIYF

SEQ ID NO: 983061 - protein, 9 aa, Homo Sapiens
SEQDKEDFS

SEQ ID NO: 983062 - protein, 9 aa, Homo Sapiens
STVRETQTM

SEQ ID NO: 983063 - protein, 9 aa, Homo Sapiens
WHIKRPWGI

SEQ ID NO: 983064 - protein, 9 aa, Homo Sapiens
AEKAVTKKK

SEQ ID NO: 983065 - protein, 9 aa, Homo Sapiens
GQHKNIVNL

SEQ ID NO: 983066 - protein, 9 aa, Homo Sapiens
LEQQRFGRL

SEQ ID NO: 983067 - protein, 9 aa, Homo Sapiens
CEKVLVWAA

SEQ ID NO: 983068 - protein, 9 aa, Homo Sapiens
HIFGFTLLD

SEQ ID NO: 983069 - protein, 9 aa, Homo Sapiens
TLPGWPESS

SEQ ID NO: 983070 - protein, 9 aa, Homo Sapiens
SNSYGRKSE

SEQ ID NO: 983071 - protein, 9 aa, Homo Sapiens
SHTANLAAF

SEQ ID NO: 983072 - protein, 9 aa, Homo Sapiens
CRHGSVRLC

SEQ ID NO: 983073 - protein, 9 aa, Homo Sapiens
ENKSWYLEK

SEQ ID NO: 983074 - protein, 9 aa, Homo Sapiens
LGKKNTIFY

SEQ ID NO: 983075 - protein, 9 aa, Homo Sapiens
SGLPGEKGQ

SEQ ID NO: 983076 - protein, 9 aa, Homo Sapiens
LINEEEEEK

SEQ ID NO: 983077 - protein, 9 aa, Homo Sapiens
CSSSFSCGS

SEQ ID NO: 983078 - protein, 9 aa, Homo Sapiens
HKLSYTGHS

SEQ ID NO: 983079 - protein, 9 aa, Homo Sapiens
EREPGSPPR

SEQ ID NO: 983080 - protein, 9 aa, Homo Sapiens
FSLLRDLLI

SEQ ID NO: 983081 - protein, 9 aa, Homo Sapiens
SSILLDYYL

SEQ ID NO: 983082 - protein, 9 aa, Homo Sapiens
PNILEYGNR

SEQ ID NO: 983083 - protein, 9 aa, Homo Sapiens
FALIVISSH

SEQ ID NO: 983084 - protein, 9 aa, Homo Sapiens
YHTFHSEYL

SEQ ID NO: 983085 - protein, 9 aa, Homo Sapiens
QKNSPHPTY

SEQ ID NO: 983086 - protein, 9 aa, Homo Sapiens
SLKDNKIEI

SEQ ID NO: 983087 - protein, 9 aa, Homo Sapiens
TSHLIQLGL

SEQ ID NO: 983088 - protein, 9 aa, Homo Sapiens
YQLIFRRSP

SEQ ID NO: 983089 - protein, 9 aa, Homo Sapiens
NNCGKFFIS

SEQ ID NO: 983090 - protein, 9 aa, Homo Sapiens
KKNTIFYSE

SEQ ID NO: 983091 - protein, 9 aa, Homo Sapiens
LNIDGSDLH

SEQ ID NO: 983092 - protein, 9 aa, Homo Sapiens
AQVQKLFQS

SEQ ID NO: 983093 - protein, 9 aa, Homo Sapiens
QRSHGSPAL

SEQ ID NO: 983094 - protein, 9 aa, Homo Sapiens
GYRLHSAPN

SEQ ID NO: 983095 - protein, 9 aa, Homo Sapiens
AEEMVRSFV

SEQ ID NO: 983096 - protein, 9 aa, Homo Sapiens
GTRIIYDQK

SEQ ID NO: 983097 - protein, 9 aa, Homo Sapiens
FLSVRENSV

SEQ ID NO: 983098 - protein, 9 aa, Homo Sapiens
KLIKNVQKM

SEQ ID NO: 983099 - protein, 9 aa, Homo Sapiens
KLLSSLTPL

SEQ ID NO: 983100 - protein, 9 aa, Homo Sapiens
ATKALNYSV

SEQ ID NO: 983101 - protein, 9 aa, Homo Sapiens
CLDSYTGEI

SEQ ID NO: 983102 - protein, 9 aa, Homo Sapiens
IINCEQSSP

SEQ ID NO: 983103 - protein, 9 aa, Homo Sapiens
CQLFHRIQQ

SEQ ID NO: 983104 - protein, 9 aa, Homo Sapiens
TGNLPHLYR

SEQ ID NO: 983105 - protein, 9 aa, Homo Sapiens
NTVVLSENI

SEQ ID NO: 983106 - protein, 9 aa, Homo Sapiens
KIKKKTKYT

SEQ ID NO: 983107 - protein, 9 aa, Homo Sapiens
YVPLSPTRL

SEQ ID NO: 983108 - protein, 9 aa, Homo Sapiens
NCRYPSMAR

SEQ ID NO: 983109 - protein, 9 aa, Homo Sapiens
CYISPQGIV

SEQ ID NO: 983110 - protein, 9 aa, Homo Sapiens
EIFYRIKVT

SEQ ID NO: 983111 - protein, 9 aa, Homo Sapiens
PISSTGPVP

SEQ ID NO: 983112 - protein, 9 aa, Homo Sapiens
CGWAMSAPE

SEQ ID NO: 983113 - protein, 9 aa, Homo Sapiens
ANAKERTRM

SEQ ID NO: 983114 - protein, 9 aa, Homo Sapiens
HHKRLKCDE

SEQ ID NO: 983115 - protein, 9 aa, Homo Sapiens
DTVEEVREF

SEQ ID NO: 983116 - protein, 9 aa, Homo Sapiens
YSLTLMENG

SEQ ID NO: 983117 - protein, 9 aa, Homo Sapiens
KNSRSDMMS

SEQ ID NO: 983118 - protein, 9 aa, Homo Sapiens
TDQPFSPEP

SEQ ID NO: 983119 - protein, 9 aa, Homo Sapiens
RLVNFSMDG

SEQ ID NO: 983120 - protein, 9 aa, Homo Sapiens
GFSQYPRLE

SEQ ID NO: 983121 - protein, 9 aa, Homo Sapiens
SERVMNYIV

SEQ ID NO: 983122 - protein, 9 aa, Homo Sapiens
PSPDIPSEP

SEQ ID NO: 983123 - protein, 9 aa, Homo Sapiens
SAVNPHTVS

SEQ ID NO: 983124 - protein, 9 aa, Homo Sapiens
LLSAPGGQK

SEQ ID NO: 983125 - protein, 9 aa, Homo Sapiens
VFKEKHIQN

SEQ ID NO: 983126 - protein, 9 aa, Homo Sapiens
ADEDPQPVI

SEQ ID NO: 983127 - protein, 9 aa, Homo Sapiens
DSSTGVELA

SEQ ID NO: 983128 - protein, 9 aa, Homo Sapiens
VDYVKEKLW

SEQ ID NO: 983129 - protein, 9 aa, Homo Sapiens
EKPHEMHFL

SEQ ID NO: 983130 - protein, 9 aa, Homo Sapiens
EDYYLTEVD

SEQ ID NO: 983131 - protein, 9 aa, Homo Sapiens
PPGSKGDQG

SEQ ID NO: 983132 - protein, 9 aa, Homo Sapiens
LPHLYRLIS

SEQ ID NO: 983133 - protein, 9 aa, Homo Sapiens
TEACSVFKE

SEQ ID NO: 983134 - protein, 9 aa, Homo Sapiens
NQPAQKNSP

SEQ ID NO: 983135 - protein, 9 aa, Homo Sapiens
LNREGISQA

SEQ ID NO: 983136 - protein, 9 aa, Homo Sapiens
HPPESKSPG

SEQ ID NO: 983137 - protein, 9 aa, Homo Sapiens
SSEQPGVIP

SEQ ID NO: 983138 - protein, 9 aa, Homo Sapiens
PDFEADKDQ

SEQ ID NO: 983139 - protein, 9 aa, Homo Sapiens
KKITALAPS

SEQ ID NO: 983140 - protein, 9 aa, Homo Sapiens
PARLPTTEL

SEQ ID NO: 983141 - protein, 9 aa, Homo Sapiens
RIRGGILAM

SEQ ID NO: 983142 - protein, 9 aa, Homo Sapiens
PRRAQASNA

SEQ ID NO: 983143 - protein, 9 aa, Homo Sapiens
LRPKGPPGP

SEQ ID NO: 983144 - protein, 9 aa, Homo Sapiens
TSSIQPSFC

SEQ ID NO: 983145 - protein, 9 aa, Homo Sapiens
LVLLLRCPF

SEQ ID NO: 983146 - protein, 9 aa, Homo Sapiens
LKIQGIEEG

SEQ ID NO: 983147 - protein, 9 aa, Homo Sapiens
AQIRQGGSV

SEQ ID NO: 983148 - protein, 9 aa, Homo Sapiens
YPAFPTDSS

SEQ ID NO: 983149 - protein, 9 aa, Homo Sapiens
DPLPGGKRH

SEQ ID NO: 983150 - protein, 9 aa, Homo Sapiens
SFSSRKMFC

SEQ ID NO: 983151 - protein, 9 aa, Homo Sapiens
CIYHTFHSE

SEQ ID NO: 983152 - protein, 9 aa, Homo Sapiens
LRKVARLEA

SEQ ID NO: 983153 - protein, 9 aa, Homo Sapiens
DATYLWWIN

SEQ ID NO: 983154 - protein, 9 aa, Homo Sapiens
TNFCVEDLQ

SEQ ID NO: 983155 - protein, 9 aa, Homo Sapiens
ASILTRRRK

SEQ ID NO: 983156 - protein, 9 aa, Homo Sapiens
VGIVIFLVC

SEQ ID NO: 983157 - protein, 9 aa, Homo Sapiens
TNPLAPKTS

SEQ ID NO: 983158 - protein, 9 aa, Homo Sapiens
LEDAMNEGL

SEQ ID NO: 983159 - protein, 9 aa, Homo Sapiens
HHIRAIAEE

SEQ ID NO: 983160 - protein, 9 aa, Homo Sapiens
NGKADPYIV

SEQ ID NO: 983161 - protein, 9 aa, Homo Sapiens
FEPHHIRAI

SEQ ID NO: 983162 - protein, 9 aa, Homo Sapiens
NIKDKNLFN

SEQ ID NO: 983163 - protein, 9 aa, Homo Sapiens
PPPAPPARL

SEQ ID NO: 983164 - protein, 9 aa, Homo Sapiens
IHRDLRAAS

SEQ ID NO: 983165 - protein, 9 aa, Homo Sapiens
FLVLFSFDV

SEQ ID NO: 983166 - protein, 9 aa, Homo Sapiens
GFFQSAIKL

SEQ ID NO: 983167 - protein, 9 aa, Homo Sapiens
KIIYEKRQK

SEQ ID NO: 983168 - protein, 9 aa, Homo Sapiens
VKKSLEKAE

SEQ ID NO: 983169 - protein, 9 aa, Homo Sapiens
PERGKRLGL

SEQ ID NO: 983170 - protein, 9 aa, Homo Sapiens
VRLDLSDAN

SEQ ID NO: 983171 - protein, 9 aa, Homo Sapiens
KPTSASLNR

SEQ ID NO: 983172 - protein, 9 aa, Homo Sapiens
QGQTKDMKS

SEQ ID NO: 983173 - protein, 9 aa, Homo Sapiens
GPKEKLFQK

SEQ ID NO: 983174 - protein, 9 aa, Homo Sapiens
CRKSTGTII

SEQ ID NO: 983175 - protein, 9 aa, Homo Sapiens
QPVRPIAST

SEQ ID NO: 983176 - protein, 9 aa, Homo Sapiens
LQPETGSGN

SEQ ID NO: 983177 - protein, 9 aa, Homo Sapiens
ISLANVCIL

SEQ ID NO: 983178 - protein, 9 aa, Homo Sapiens
QFLDISFCP

SEQ ID NO: 983179 - protein, 9 aa, Homo Sapiens
DYVKEKLWY

SEQ ID NO: 983180 - protein, 9 aa, Homo Sapiens
NKFVTKGQT

SEQ ID NO: 983181 - protein, 9 aa, Homo Sapiens
GVLYWHFQI

SEQ ID NO: 983182 - protein, 9 aa, Homo Sapiens
VANFLFLFL

SEQ ID NO: 983183 - protein, 9 aa, Homo Sapiens
TLIFYLFIL

SEQ ID NO: 983184 - protein, 9 aa, Homo Sapiens
ALQKIFEKP

SEQ ID NO: 983185 - protein, 9 aa, Homo Sapiens
SRALYSLDK

SEQ ID NO: 983186 - protein, 9 aa, Homo Sapiens
MTAQLPMMG

SEQ ID NO: 983187 - protein, 9 aa, Homo Sapiens
HKKIYTGEK

SEQ ID NO: 983188 - protein, 9 aa, Homo Sapiens
KAFQRDVGR

SEQ ID NO: 983189 - protein, 9 aa, Homo Sapiens
QKKLQRLQQ

SEQ ID NO: 983190 - protein, 9 aa, Homo Sapiens
AMNEGLEIV

SEQ ID NO: 983191 - protein, 9 aa, Homo Sapiens
ANLLLAVPA

SEQ ID NO: 983192 - protein, 9 aa, Homo Sapiens
DEFVKPGAH

SEQ ID NO: 983193 - protein, 9 aa, Homo Sapiens
LLGSTSFIS

SEQ ID NO: 983194 - protein, 9 aa, Homo Sapiens
HKMVMIDVD

SEQ ID NO: 983195 - protein, 9 aa, Homo Sapiens
AGCPGPVKT

SEQ ID NO: 983196 - protein, 9 aa, Homo Sapiens
KGFQASRSN

SEQ ID NO: 983197 - protein, 9 aa, Homo Sapiens
EKWCLSTDF

SEQ ID NO: 983198 - protein, 9 aa, Homo Sapiens
LCRKAGSIM

SEQ ID NO: 983199 - protein, 9 aa, Homo Sapiens
DLKIRLLRP

SEQ ID NO: 983200 - protein, 9 aa, Homo Sapiens
DDNETGKIS

SEQ ID NO: 983201 - protein, 9 aa, Homo Sapiens
LTRRRKFSR

SEQ ID NO: 983202 - protein, 9 aa, Homo Sapiens
HTVMDNPVD

SEQ ID NO: 983203 - protein, 9 aa, Homo Sapiens
FDSYHQRQL

SEQ ID NO: 983204 - protein, 9 aa, Homo Sapiens
GVLPRAGRA

SEQ ID NO: 983205 - protein, 9 aa, Homo Sapiens
VSGFFLSQD

SEQ ID NO: 983206 - protein, 9 aa, Homo Sapiens
QHCSIHTSE

SEQ ID NO: 983207 - protein, 9 aa, Homo Sapiens
APNHFRKET

SEQ ID NO: 983208 - protein, 9 aa, Homo Sapiens
NAPLSAATK

SEQ ID NO: 983209 - protein, 9 aa, Homo Sapiens
THYEEGLMK

SEQ ID NO: 983210 - protein, 9 aa, Homo Sapiens
TTRLTTTEA

SEQ ID NO: 983211 - protein, 9 aa, Homo Sapiens
KIDAALPLE

SEQ ID NO: 983212 - protein, 9 aa, Homo Sapiens
SIGRRTYAS

SEQ ID NO: 983213 - protein, 9 aa, Homo Sapiens
HSSELFFEI

SEQ ID NO: 983214 - protein, 9 aa, Homo Sapiens
DLSFMTAQL

SEQ ID NO: 983215 - protein, 9 aa, Homo Sapiens
MLSALIGHT

SEQ ID NO: 983216 - protein, 9 aa, Homo Sapiens
KTLINFKSN

SEQ ID NO: 983217 - protein, 9 aa, Homo Sapiens
DTNSTNIAL

SEQ ID NO: 983218 - protein, 9 aa, Homo Sapiens
ISVVPREPR

SEQ ID NO: 983219 - protein, 9 aa, Homo Sapiens
SIPLMSGKR

SEQ ID NO: 983220 - protein, 9 aa, Homo Sapiens
CETGFGQIR

SEQ ID NO: 983221 - protein, 9 aa, Homo Sapiens
LIQIKLSLV

SEQ ID NO: 983222 - protein, 9 aa, Homo Sapiens
ALKDTVEEV

SEQ ID NO: 983223 - protein, 9 aa, Homo Sapiens
IYEKRQKAP

SEQ ID NO: 983224 - protein, 9 aa, Homo Sapiens
KDTVEEVRE

SEQ ID NO: 983225 - protein, 9 aa, Homo Sapiens
GKYLSDFCS

SEQ ID NO: 983226 - protein, 9 aa, Homo Sapiens
RLPTTELSS

SEQ ID NO: 983227 - protein, 9 aa, Homo Sapiens
ANQFLDISF

SEQ ID NO: 983228 - protein, 9 aa, Homo Sapiens
YPRLEVVLF

SEQ ID NO: 983229 - protein, 9 aa, Homo Sapiens
QLECSADED

SEQ ID NO: 983230 - protein, 9 aa, Homo Sapiens
PRSSSKPQV

SEQ ID NO: 983231 - protein, 9 aa, Homo Sapiens
RKVARLEAP

SEQ ID NO: 983232 - protein, 9 aa, Homo Sapiens
DAITKAYYQ

SEQ ID NO: 983233 - protein, 9 aa, Homo Sapiens
ENFKYQDFK

SEQ ID NO: 983234 - protein, 9 aa, Homo Sapiens
NKLESLPSA

SEQ ID NO: 983235 - protein, 9 aa, Homo Sapiens
IHVILNVEQ

SEQ ID NO: 983236 - protein, 9 aa, Homo Sapiens
APEEKAGPI

SEQ ID NO: 983237 - protein, 9 aa, Homo Sapiens
LGTLCETGF

SEQ ID NO: 983238 - protein, 9 aa, Homo Sapiens
LDKKGSKVE

SEQ ID NO: 983239 - protein, 9 aa, Homo Sapiens
ITKMDKLHL

SEQ ID NO: 983240 - protein, 9 aa, Homo Sapiens
IMEPGKTRR

SEQ ID NO: 983241 - protein, 9 aa, Homo Sapiens
THRMVVKIG

SEQ ID NO: 983242 - protein, 9 aa, Homo Sapiens
SILTRRRKF

SEQ ID NO: 983243 - protein, 9 aa, Homo Sapiens
ISIKCAPGV

SEQ ID NO: 983244 - protein, 9 aa, Homo Sapiens
DVALVITKM

SEQ ID NO: 983245 - protein, 9 aa, Homo Sapiens
SSTNFCVED

SEQ ID NO: 983246 - protein, 9 aa, Homo Sapiens
KFFESFLQE

SEQ ID NO: 983247 - protein, 9 aa, Homo Sapiens
TIYKILCKL

SEQ ID NO: 983248 - protein, 9 aa, Homo Sapiens
TILKISSMS

SEQ ID NO: 983249 - protein, 9 aa, Homo Sapiens
ILGSDYFFT

SEQ ID NO: 983250 - protein, 9 aa, Homo Sapiens
IRLEVMEET

SEQ ID NO: 983251 - protein, 9 aa, Homo Sapiens
HSQGAFRPL

SEQ ID NO: 983252 - protein, 9 aa, Homo Sapiens
NKSWYLEKN

SEQ ID NO: 983253 - protein, 9 aa, Homo Sapiens
LKDNKIEIR

SEQ ID NO: 983254 - protein, 9 aa, Homo Sapiens
EDDKELYSM

SEQ ID NO: 983255 - protein, 9 aa, Homo Sapiens
IVDEDYYLT

SEQ ID NO: 983256 - protein, 9 aa, Homo Sapiens
LSQLVAKRQ

SEQ ID NO: 983257 - protein, 9 aa, Homo Sapiens
INEEEEEKL

SEQ ID NO: 983258 - protein, 9 aa, Homo Sapiens
ALALLRKVA

SEQ ID NO: 983259 - protein, 9 aa, Homo Sapiens
TMTAARILK

SEQ ID NO: 983260 - protein, 9 aa, Homo Sapiens
QPPPSCLCF

SEQ ID NO: 983261 - protein, 9 aa, Homo Sapiens
CPQRFPVQA

SEQ ID NO: 983262 - protein, 9 aa, Homo Sapiens
TDLLPTSII

SEQ ID NO: 983263 - protein, 9 aa, Homo Sapiens
SKSPGEYVN

SEQ ID NO: 983264 - protein, 9 aa, Homo Sapiens
AYLHSKEII

SEQ ID NO: 983265 - protein, 9 aa, Homo Sapiens
EWTPDQPYR

SEQ ID NO: 983266 - protein, 9 aa, Homo Sapiens
EQTKKMWQR

SEQ ID NO: 983267 - protein, 9 aa, Homo Sapiens
NGVKYSKLK

SEQ ID NO: 983268 - protein, 9 aa, Homo Sapiens
LPRAGRAFL

SEQ ID NO: 983269 - protein, 9 aa, Homo Sapiens
RICTLVHTV

SEQ ID NO: 983270 - protein, 9 aa, Homo Sapiens
LSQFPDWIN

SEQ ID NO: 983271 - protein, 9 aa, Homo Sapiens
FFEIGAIFE

SEQ ID NO: 983272 - protein, 9 aa, Homo Sapiens
DRMQKKITA

SEQ ID NO: 983273 - protein, 9 aa, Homo Sapiens
CGFEPHHIR

SEQ ID NO: 983274 - protein, 9 aa, Homo Sapiens
ILSQLVAKR

SEQ ID NO: 983275 - protein, 9 aa, Homo Sapiens
IDQYLAIVH

SEQ ID NO: 983276 - protein, 9 aa, Homo Sapiens
SDYFFTQVY

SEQ ID NO: 983277 - protein, 9 aa, Homo Sapiens
LVPSETYQQ

SEQ ID NO: 983278 - protein, 9 aa, Homo Sapiens
QFPQLNEWC

SEQ ID NO: 983279 - protein, 9 aa, Homo Sapiens
VTASKSDAE

SEQ ID NO: 983280 - protein, 9 aa, Homo Sapiens
ADSFIHVKD

SEQ ID NO: 983281 - protein, 9 aa, Homo Sapiens
EPGTTIFSS

SEQ ID NO: 983282 - protein, 9 aa, Homo Sapiens
CLLEEGLCE

SEQ ID NO: 983283 - protein, 9 aa, Homo Sapiens
QITKINKTT

SEQ ID NO: 983284 - protein, 9 aa, Homo Sapiens
VPHVEKKPV

SEQ ID NO: 983285 - protein, 9 aa, Homo Sapiens
MEVEIKTSG

SEQ ID NO: 983286 - protein, 9 aa, Homo Sapiens
MSYQDIRLE

SEQ ID NO: 983287 - protein, 9 aa, Homo Sapiens
DITKQDSFN

SEQ ID NO: 983288 - protein, 9 aa, Homo Sapiens
PPTSPTSIR

SEQ ID NO: 983289 - protein, 9 aa, Homo Sapiens
TRTIVKKLA

SEQ ID NO: 983290 - protein, 9 aa, Homo Sapiens
YGCYCGQER

SEQ ID NO: 983291 - protein, 9 aa, Homo Sapiens
IVVENLVII

SEQ ID NO: 983292 - protein, 9 aa, Homo Sapiens
FAKVICNFF

SEQ ID NO: 983293 - protein, 9 aa, Homo Sapiens
HSWEKMAVS

SEQ ID NO: 983294 - protein, 9 aa, Homo Sapiens
NFLKACELW

SEQ ID NO: 983295 - protein, 9 aa, Homo Sapiens
QKMSQAEKL

SEQ ID NO: 983296 - protein, 9 aa, Homo Sapiens
LDDYVYWTD

SEQ ID NO: 983297 - protein, 9 aa, Homo Sapiens
SEPHVVPKT

SEQ ID NO: 983298 - protein, 9 aa, Homo Sapiens
RRNIVPEAL

SEQ ID NO: 983299 - protein, 9 aa, Homo Sapiens
VLYVVSIFV

SEQ ID NO: 983300 - protein, 9 aa, Homo Sapiens
NRPKNAGYS

SEQ ID NO: 983301 - protein, 9 aa, Homo Sapiens
EIYYEGSWG

SEQ ID NO: 983302 - protein, 9 aa, Homo Sapiens
SSNTAQGGF

SEQ ID NO: 983303 - protein, 9 aa, Homo Sapiens
PVSGVPKPG

SEQ ID NO: 983304 - protein, 9 aa, Homo Sapiens
CSQHESGSG

SEQ ID NO: 983305 - protein, 9 aa, Homo Sapiens
VVSQELEEE

SEQ ID NO: 983306 - protein, 9 aa, Homo Sapiens
PLTEHSQGL

SEQ ID NO: 983307 - protein, 9 aa, Homo Sapiens
EDRNCRHFG

SEQ ID NO: 983308 - protein, 9 aa, Homo Sapiens
TTNSDHITF

SEQ ID NO: 983309 - protein, 9 aa, Homo Sapiens
ISSTGPVPA

SEQ ID NO: 983310 - protein, 9 aa, Homo Sapiens
LDVGMKSIA

SEQ ID NO: 983311 - protein, 9 aa, Homo Sapiens
QRQLQKKLQ

SEQ ID NO: 983312 - protein, 9 aa, Homo Sapiens
RRVTKKNSH

SEQ ID NO: 983313 - protein, 9 aa, Homo Sapiens
FSKTSKKHH

SEQ ID NO: 983314 - protein, 9 aa, Homo Sapiens
PLGPGPFSL

SEQ ID NO: 983315 - protein, 9 aa, Homo Sapiens
ADHVSKVTI

SEQ ID NO: 983316 - protein, 9 aa, Homo Sapiens
TMFPRVCFL

SEQ ID NO: 983317 - protein, 9 aa, Homo Sapiens
VDEQLLENY

SEQ ID NO: 983318 - protein, 9 aa, Homo Sapiens
GSPVSGVPK

SEQ ID NO: 983319 - protein, 9 aa, Homo Sapiens
ICKPRQDSR

SEQ ID NO: 983320 - protein, 9 aa, Homo Sapiens
VCNDDFSIH

SEQ ID NO: 983321 - protein, 9 aa, Homo Sapiens
RLTTTEAQT

SEQ ID NO: 983322 - protein, 9 aa, Homo Sapiens
WCLSTDFPS

SEQ ID NO: 983323 - protein, 9 aa, Homo Sapiens
KFKSLFKNC

SEQ ID NO: 983324 - protein, 9 aa, Homo Sapiens
SQDSKDTPT

SEQ ID NO: 983325 - protein, 9 aa, Homo Sapiens
ASNYPTISR

SEQ ID NO: 983326 - protein, 9 aa, Homo Sapiens
DEPAMKRTR

SEQ ID NO: 983327 - protein, 9 aa, Homo Sapiens
AVAKTQAGR

SEQ ID NO: 983328 - protein, 9 aa, Homo Sapiens
CGGFCRRPA

SEQ ID NO: 983329 - protein, 9 aa, Homo Sapiens
KIFWEVFYE

SEQ ID NO: 983330 - protein, 9 aa, Homo Sapiens
FIVVENLVI

SEQ ID NO: 983331 - protein, 9 aa, Homo Sapiens
PPPTPSEQD

SEQ ID NO: 983332 - protein, 9 aa, Homo Sapiens
KETTQPQVP

SEQ ID NO: 983333 - protein, 9 aa, Homo Sapiens
PNHFRKETT

SEQ ID NO: 983334 - protein, 9 aa, Homo Sapiens
VGRWAEKTP

SEQ ID NO: 983335 - protein, 9 aa, Homo Sapiens
FHSFINPGK

SEQ ID NO: 983336 - protein, 9 aa, Homo Sapiens
DVNGKEFSE

SEQ ID NO: 983337 - protein, 9 aa, Homo Sapiens
VQEENFKYQ

SEQ ID NO: 983338 - protein, 9 aa, Homo Sapiens
YFFTQVYNW

SEQ ID NO: 983339 - protein, 9 aa, Homo Sapiens
DSSSHEALR

SEQ ID NO: 983340 - protein, 9 aa, Homo Sapiens
VAKTQAGRS

SEQ ID NO: 983341 - protein, 9 aa, Homo Sapiens
STMTAARIL

SEQ ID NO: 983342 - protein, 9 aa, Homo Sapiens
KLESLPSAT

SEQ ID NO: 983343 - protein, 9 aa, Homo Sapiens
TVTAVDLNE

SEQ ID NO: 983344 - protein, 9 aa, Homo Sapiens
IFIAEDEEW

SEQ ID NO: 983345 - protein, 9 aa, Homo Sapiens
MPKKPKFEL

SEQ ID NO: 983346 - protein, 9 aa, Homo Sapiens
GLTGPAGEC

SEQ ID NO: 983347 - protein, 9 aa, Homo Sapiens
ACTLTVFSP

SEQ ID NO: 983348 - protein, 9 aa, Homo Sapiens
TLGPGEGSQ

SEQ ID NO: 983349 - protein, 9 aa, Homo Sapiens
PSQAFLTPV

SEQ ID NO: 983350 - protein, 9 aa, Homo Sapiens
QTGPKEKLF

SEQ ID NO: 983351 - protein, 9 aa, Homo Sapiens
AQALALLRK

SEQ ID NO: 983352 - protein, 9 aa, Homo Sapiens
CHNHVTCVS

SEQ ID NO: 983353 - protein, 9 aa, Homo Sapiens
SFPGLFSSG

SEQ ID NO: 983354 - protein, 9 aa, Homo Sapiens
IHRCGAWRG

SEQ ID NO: 983355 - protein, 9 aa, Homo Sapiens
ERAGVMSVY

SEQ ID NO: 983356 - protein, 9 aa, Homo Sapiens
YCGEKSFLG

SEQ ID NO: 983357 - protein, 9 aa, Homo Sapiens
ARENCRGLT

SEQ ID NO: 983358 - protein, 9 aa, Homo Sapiens
SSSTNFCVE

SEQ ID NO: 983359 - protein, 9 aa, Homo Sapiens
AFAYLHSKE

SEQ ID NO: 983360 - protein, 9 aa, Homo Sapiens
YANTNQYHE

SEQ ID NO: 983361 - protein, 9 aa, Homo Sapiens
VTFLVLPIF

SEQ ID NO: 983362 - protein, 9 aa, Homo Sapiens
KNAGYSFEK

SEQ ID NO: 983363 - protein, 9 aa, Homo Sapiens
AASQPQLDF

SEQ ID NO: 983364 - protein, 9 aa, Homo Sapiens
VSPACPEPQ

SEQ ID NO: 983365 - protein, 9 aa, Homo Sapiens
FGRLVERLE

SEQ ID NO: 983366 - protein, 9 aa, Homo Sapiens
SRFGFGGGA

SEQ ID NO: 983367 - protein, 9 aa, Homo Sapiens
YLHLSSCVD

SEQ ID NO: 983368 - protein, 9 aa, Homo Sapiens
RLSTSVLNN

SEQ ID NO: 983369 - protein, 9 aa, Homo Sapiens
FDRINWLCL

SEQ ID NO: 983370 - protein, 9 aa, Homo Sapiens
LLALQVEEN

SEQ ID NO: 983371 - protein, 9 aa, Homo Sapiens
FRRSPSQKK

SEQ ID NO: 983372 - protein, 9 aa, Homo Sapiens
EIKKFLWHI

SEQ ID NO: 983373 - protein, 9 aa, Homo Sapiens
STVVAHEVP

SEQ ID NO: 983374 - protein, 9 aa, Homo Sapiens
QELEEETGL

SEQ ID NO: 983375 - protein, 9 aa, Homo Sapiens
LTYYDASKR

SEQ ID NO: 983376 - protein, 9 aa, Homo Sapiens
GEIFYSLFQ

SEQ ID NO: 983377 - protein, 9 aa, Homo Sapiens
SPRTSGLGY

SEQ ID NO: 983378 - protein, 9 aa, Homo Sapiens
TKAVSRFHF

SEQ ID NO: 983379 - protein, 9 aa, Homo Sapiens
PGKTRRNSY

SEQ ID NO: 983380 - protein, 9 aa, Homo Sapiens
PIHRCGAWR

SEQ ID NO: 983381 - protein, 9 aa, Homo Sapiens
SDSYVKVFL

SEQ ID NO: 983382 - protein, 9 aa, Homo Sapiens
YGDQLVSQF

SEQ ID NO: 983383 - protein, 9 aa, Homo Sapiens
VLENIDTSC

SEQ ID NO: 983384 - protein, 9 aa, Homo Sapiens
IQCKSKRPR

SEQ ID NO: 983385 - protein, 9 aa, Homo Sapiens
LGPGEGSQL

SEQ ID NO: 983386 - protein, 9 aa, Homo Sapiens
EYLHLSSCV

SEQ ID NO: 983387 - protein, 9 aa, Homo Sapiens
VNYGVELHS

SEQ ID NO: 983388 - protein, 9 aa, Homo Sapiens
PTGVNMLSL

SEQ ID NO: 983389 - protein, 9 aa, Homo Sapiens
SCTQHSLPW

SEQ ID NO: 983390 - protein, 9 aa, Homo Sapiens
QPETGSGNL

SEQ ID NO: 983391 - protein, 9 aa, Homo Sapiens
RSFQADHVS

SEQ ID NO: 983392 - protein, 9 aa, Homo Sapiens
CQPCSSSFS

SEQ ID NO: 983393 - protein, 9 aa, Homo Sapiens
VFSPEETTP

SEQ ID NO: 983394 - protein, 9 aa, Homo Sapiens
LSFILCIFV

SEQ ID NO: 983395 - protein, 9 aa, Homo Sapiens
VRKVKMPKK

SEQ ID NO: 983396 - protein, 9 aa, Homo Sapiens
CLSTDFPST

SEQ ID NO: 983397 - protein, 9 aa, Homo Sapiens
SLGPSVQVS

SEQ ID NO: 983398 - protein, 9 aa, Homo Sapiens
KKKTKYTIL

SEQ ID NO: 983399 - protein, 9 aa, Homo Sapiens
DFDSYHQRQ

SEQ ID NO: 983400 - protein, 9 aa, Homo Sapiens
LATKAWTIT

SEQ ID NO: 983401 - protein, 9 aa, Homo Sapiens
AGSRFGFGG

SEQ ID NO: 983402 - protein, 9 aa, Homo Sapiens
GKKISKDQK

SEQ ID NO: 983403 - protein, 9 aa, Homo Sapiens
KCKEIWEEG

SEQ ID NO: 983404 - protein, 9 aa, Homo Sapiens
GKIPRGFRF

SEQ ID NO: 983405 - protein, 9 aa, Homo Sapiens
PSLQNCRYP

SEQ ID NO: 983406 - protein, 9 aa, Homo Sapiens
GVKYSKLKS

SEQ ID NO: 983407 - protein, 9 aa, Homo Sapiens
VGFMKSAIF

SEQ ID NO: 983408 - protein, 9 aa, Homo Sapiens
PGGKRHDST

SEQ ID NO: 983409 - protein, 9 aa, Homo Sapiens
TVCNQCGKE

SEQ ID NO: 983410 - protein, 9 aa, Homo Sapiens
SQECINVPL

SEQ ID NO: 983411 - protein, 9 aa, Homo Sapiens
GILAMPKDE

SEQ ID NO: 983412 - protein, 9 aa, Homo Sapiens
GKKGKEGKE

SEQ ID NO: 983413 - protein, 9 aa, Homo Sapiens
KQDSFNTLK

SEQ ID NO: 983414 - protein, 9 aa, Homo Sapiens
QDIRLEVME

SEQ ID NO: 983415 - protein, 9 aa, Homo Sapiens
YFSSGSCEK

SEQ ID NO: 983416 - protein, 9 aa, Homo Sapiens
LSDANFVDV

SEQ ID NO: 983417 - protein, 9 aa, Homo Sapiens
NCTDSKYYC

SEQ ID NO: 983418 - protein, 9 aa, Homo Sapiens
PLFLLFLEI

SEQ ID NO: 983419 - protein, 9 aa, Homo Sapiens
CFLEGSPTL

SEQ ID NO: 983420 - protein, 9 aa, Homo Sapiens
VKDVDSTKN

SEQ ID NO: 983421 - protein, 9 aa, Homo Sapiens
RRVGRWAEK

SEQ ID NO: 983422 - protein, 9 aa, Homo Sapiens
HLYRLISVV

SEQ ID NO: 983423 - protein, 9 aa, Homo Sapiens
VPSVIVAWN

SEQ ID NO: 983424 - protein, 9 aa, Homo Sapiens
KTHTMLGSS

SEQ ID NO: 983425 - protein, 9 aa, Homo Sapiens
QWGTVCNDD

SEQ ID NO: 983426 - protein, 9 aa, Homo Sapiens
CGEKSFLGQ

SEQ ID NO: 983427 - protein, 9 aa, Homo Sapiens
KEIIYRDLK

SEQ ID NO: 983428 - protein, 9 aa, Homo Sapiens
PPMVEGEGV

SEQ ID NO: 983429 - protein, 9 aa, Homo Sapiens
WSAGCCCQY

SEQ ID NO: 983430 - protein, 9 aa, Homo Sapiens
DQPFSPEPI

SEQ ID NO: 983431 - protein, 9 aa, Homo Sapiens
GLAPDVPAV

SEQ ID NO: 983432 - protein, 9 aa, Homo Sapiens
HLVICKPRQ

SEQ ID NO: 983433 - protein, 9 aa, Homo Sapiens
VTVCNQCGK

SEQ ID NO: 983434 - protein, 9 aa, Homo Sapiens
LVEFPAAFI

SEQ ID NO: 983435 - protein, 9 aa, Homo Sapiens
SYHCHSWEK

SEQ ID NO: 983436 - protein, 9 aa, Homo Sapiens
ETRDEKLVS

SEQ ID NO: 983437 - protein, 9 aa, Homo Sapiens
SSSKPQVSF

SEQ ID NO: 983438 - protein, 9 aa, Homo Sapiens
SGFLSKCDA

SEQ ID NO: 983439 - protein, 9 aa, Homo Sapiens
TLCETGFGQ

SEQ ID NO: 983440 - protein, 9 aa, Homo Sapiens
NGEIFYSLF

SEQ ID NO: 983441 - protein, 9 aa, Homo Sapiens
CCGGFCRRP

SEQ ID NO: 983442 - protein, 9 aa, Homo Sapiens
PKSFGWFYC

SEQ ID NO: 983443 - protein, 9 aa, Homo Sapiens
EEVTNKSGY

SEQ ID NO: 983444 - protein, 9 aa, Homo Sapiens
SFMTAQLPM

SEQ ID NO: 983445 - protein, 9 aa, Homo Sapiens
LSTMGANVS

SEQ ID NO: 983446 - protein, 9 aa, Homo Sapiens
TVLSSVSQL

SEQ ID NO: 983447 - protein, 9 aa, Homo Sapiens
SRSRFKSRS

SEQ ID NO: 983448 - protein, 9 aa, Homo Sapiens
FLKPGSERK

SEQ ID NO: 983449 - protein, 9 aa, Homo Sapiens
RVDYVKEKL

SEQ ID NO: 983450 - protein, 9 aa, Homo Sapiens
AVLYVVSIF

SEQ ID NO: 983451 - protein, 9 aa, Homo Sapiens
RDPRIPGRM

SEQ ID NO: 983452 - protein, 9 aa, Homo Sapiens
EKGYKEWLL

SEQ ID NO: 983453 - protein, 9 aa, Homo Sapiens
ESAPLDFHF

SEQ ID NO: 983454 - protein, 9 aa, Homo Sapiens
DLGRVRQKL

SEQ ID NO: 983455 - protein, 9 aa, Homo Sapiens
ENIDTSCDD

SEQ ID NO: 983456 - protein, 9 aa, Homo Sapiens
SKLKEPGKK

SEQ ID NO: 983457 - protein, 9 aa, Homo Sapiens
VVAHEVPHL

SEQ ID NO: 983458 - protein, 9 aa, Homo Sapiens
VFSNKRSFI

SEQ ID NO: 983459 - protein, 9 aa, Homo Sapiens
REPGSPPRM

SEQ ID NO: 983460 - protein, 9 aa, Homo Sapiens
TVEEVREFL

SEQ ID NO: 983461 - protein, 9 aa, Homo Sapiens
IPKPHKKPP

SEQ ID NO: 983462 - protein, 9 aa, Homo Sapiens
LRLSTSVLN

SEQ ID NO: 983463 - protein, 9 aa, Homo Sapiens
LDRNQVAQT

SEQ ID NO: 983464 - protein, 9 aa, Homo Sapiens
LYKYVYKRY

SEQ ID NO: 983465 - protein, 9 aa, Homo Sapiens
CSCTQHSLP

SEQ ID NO: 983466 - protein, 9 aa, Homo Sapiens
QWVDAQVQK

SEQ ID NO: 983467 - protein, 9 aa, Homo Sapiens
DLEKPHEMH

SEQ ID NO: 983468 - protein, 9 aa, Homo Sapiens
SAIFIAEDE

SEQ ID NO: 983469 - protein, 9 aa, Homo Sapiens
FENADGRFK

SEQ ID NO: 983470 - protein, 9 aa, Homo Sapiens
TGLLATARW

SEQ ID NO: 983471 - protein, 9 aa, Homo Sapiens
KPGSERKRL

SEQ ID NO: 983472 - protein, 9 aa, Homo Sapiens
HCHSWEKMA

SEQ ID NO: 983473 - protein, 9 aa, Homo Sapiens
TGVNGEIFY

SEQ ID NO: 983474 - protein, 9 aa, Homo Sapiens
KDVDSTKNR

SEQ ID NO: 983475 - protein, 9 aa, Homo Sapiens
VLSSVSQLL

SEQ ID NO: 983476 - protein, 9 aa, Homo Sapiens
GSEITHLEF

SEQ ID NO: 983477 - protein, 9 aa, Homo Sapiens
DQPLFPACQ

SEQ ID NO: 983478 - protein, 9 aa, Homo Sapiens
GISVVPREP

SEQ ID NO: 983479 - protein, 9 aa, Homo Sapiens
QYLAIVHPM

SEQ ID NO: 983480 - protein, 9 aa, Homo Sapiens
SLGLSIPLM

SEQ ID NO: 983481 - protein, 9 aa, Homo Sapiens
DRSFQADHV

SEQ ID NO: 983482 - protein, 9 aa, Homo Sapiens
GGFDTSILP

SEQ ID NO: 983483 - protein, 9 aa, Homo Sapiens
IDVWQRFRK

SEQ ID NO: 983484 - protein, 9 aa, Homo Sapiens
FPMMGIVNA

SEQ ID NO: 983485 - protein, 9 aa, Homo Sapiens
PGLYMDEKG

SEQ ID NO: 983486 - protein, 9 aa, Homo Sapiens
VNGEIFYSL

SEQ ID NO: 983487 - protein, 9 aa, Homo Sapiens
EKMLSALIG

SEQ ID NO: 983488 - protein, 9 aa, Homo Sapiens
GTVCGSEKI

SEQ ID NO: 983489 - protein, 9 aa, Homo Sapiens
IFSSLPLRF

SEQ ID NO: 983490 - protein, 9 aa, Homo Sapiens
SFLMFKPGR

SEQ ID NO: 983491 - protein, 9 aa, Homo Sapiens
RKRNSRVQV

SEQ ID NO: 983492 - protein, 9 aa, Homo Sapiens
NTLKKWVKE

SEQ ID NO: 983493 - protein, 9 aa, Homo Sapiens
AEAARRLAG

SEQ ID NO: 983494 - protein, 9 aa, Homo Sapiens
LFNMEVLVD

SEQ ID NO: 983495 - protein, 9 aa, Homo Sapiens
ALMEGYFMN

SEQ ID NO: 983496 - protein, 9 aa, Homo Sapiens
PLANCQAPC

SEQ ID NO: 983497 - protein, 9 aa, Homo Sapiens
NYIVSTWSM

SEQ ID NO: 983498 - protein, 9 aa, Homo Sapiens
HKEDLLGYY

SEQ ID NO: 983499 - protein, 9 aa, Homo Sapiens
LSERVMNYI

SEQ ID NO: 983500 - protein, 9 aa, Homo Sapiens
EVESEKWCL

SEQ ID NO: 983501 - protein, 9 aa, Homo Sapiens
GLCEASEAC

SEQ ID NO: 983502 - protein, 9 aa, Homo Sapiens
IHWYWQLEK

SEQ ID NO: 983503 - protein, 9 aa, Homo Sapiens
QGQTGEKGP

SEQ ID NO: 983504 - protein, 9 aa, Homo Sapiens
NFGDVSWSR

SEQ ID NO: 983505 - protein, 9 aa, Homo Sapiens
GCPGPVKTD

SEQ ID NO: 983506 - protein, 9 aa, Homo Sapiens
AQTTRLTTT

SEQ ID NO: 983507 - protein, 9 aa, Homo Sapiens
LVHTVMDNP

SEQ ID NO: 983508 - protein, 9 aa, Homo Sapiens
KPPFQNSQY

SEQ ID NO: 983509 - protein, 9 aa, Homo Sapiens
ALSIILVCA

SEQ ID NO: 983510 - protein, 9 aa, Homo Sapiens
TLVDEQLLE

SEQ ID NO: 983511 - protein, 9 aa, Homo Sapiens
GKESKLLSK

SEQ ID NO: 983512 - protein, 9 aa, Homo Sapiens
QPLDKKREE

SEQ ID NO: 983513 - protein, 9 aa, Homo Sapiens
SVESNSYGR

SEQ ID NO: 983514 - protein, 9 aa, Homo Sapiens
FSKGLWIEC

SEQ ID NO: 983515 - protein, 9 aa, Homo Sapiens
SSHTANLAA

SEQ ID NO: 983516 - protein, 9 aa, Homo Sapiens
VVILSFILC

SEQ ID NO: 983517 - protein, 9 aa, Homo Sapiens
LKSYPRFPF

SEQ ID NO: 983518 - protein, 9 aa, Homo Sapiens
VVPREPRGG

SEQ ID NO: 983519 - protein, 9 aa, Homo Sapiens
ELDRNQVAQ

SEQ ID NO: 983520 - protein, 9 aa, Homo Sapiens
VQEILQSQG

SEQ ID NO: 983521 - protein, 9 aa, Homo Sapiens
CFVQTNISR

SEQ ID NO: 983522 - protein, 9 aa, Homo Sapiens
AETGNLPHL

SEQ ID NO: 983523 - protein, 9 aa, Homo Sapiens
SKRPRKNVK

SEQ ID NO: 983524 - protein, 9 aa, Homo Sapiens
TACSCTQHS

SEQ ID NO: 983525 - protein, 9 aa, Homo Sapiens
SRKDNFNSL

SEQ ID NO: 983526 - protein, 9 aa, Homo Sapiens
AVAKIDAAL

SEQ ID NO: 983527 - protein, 9 aa, Homo Sapiens
AVTKKKFQG

SEQ ID NO: 983528 - protein, 9 aa, Homo Sapiens
FLVLPIFSY

SEQ ID NO: 983529 - protein, 9 aa, Homo Sapiens
SFSLSTMGA

SEQ ID NO: 983530 - protein, 9 aa, Homo Sapiens
WMCPIHRCG

SEQ ID NO: 983531 - protein, 9 aa, Homo Sapiens
TSGLGYRLH

SEQ ID NO: 983532 - protein, 9 aa, Homo Sapiens
KHKLSYTGH

SEQ ID NO: 983533 - protein, 9 aa, Homo Sapiens
AATKSQAWL

SEQ ID NO: 983534 - protein, 9 aa, Homo Sapiens
EVQKFLRNG

SEQ ID NO: 983535 - protein, 9 aa, Homo Sapiens
FNSLQVKTC

SEQ ID NO: 983536 - protein, 9 aa, Homo Sapiens
LCETGFGQI

SEQ ID NO: 983537 - protein, 9 aa, Homo Sapiens
TFGDSKEKV

SEQ ID NO: 983538 - protein, 9 aa, Homo Sapiens
RLLLYKYVY

SEQ ID NO: 983539 - protein, 9 aa, Homo Sapiens
LPPSTSRAC

SEQ ID NO: 983540 - protein, 9 aa, Homo Sapiens
CNPGYKRES

SEQ ID NO: 983541 - protein, 9 aa, Homo Sapiens
ERVDYVKEK

SEQ ID NO: 983542 - protein, 9 aa, Homo Sapiens
IFCLDSYTG

SEQ ID NO: 983543 - protein, 9 aa, Homo Sapiens
PLKNLEDAM

SEQ ID NO: 983544 - protein, 9 aa, Homo Sapiens
LVTLIFYLF

SEQ ID NO: 983545 - protein, 9 aa, Homo Sapiens
PEVAALYFL

SEQ ID NO: 983546 - protein, 9 aa, Homo Sapiens
GIPSINQAK

SEQ ID NO: 983547 - protein, 9 aa, Homo Sapiens
SFLGQGDLK

SEQ ID NO: 983548 - protein, 9 aa, Homo Sapiens
QLPETPAPQ

SEQ ID NO: 983549 - protein, 9 aa, Homo Sapiens
GLPCLETPA

SEQ ID NO: 983550 - protein, 9 aa, Homo Sapiens
TVCGSEKIC

SEQ ID NO: 983551 - protein, 9 aa, Homo Sapiens
VDYKPTNPE

SEQ ID NO: 983552 - protein, 9 aa, Homo Sapiens
KLFQKPRSL

SEQ ID NO: 983553 - protein, 9 aa, Homo Sapiens
SSGSCEKVL

SEQ ID NO: 983554 - protein, 9 aa, Homo Sapiens
ILNVEQACY

SEQ ID NO: 983555 - protein, 9 aa, Homo Sapiens
RMQKKITAL

SEQ ID NO: 983556 - protein, 9 aa, Homo Sapiens
PGSKGDQGQ

SEQ ID NO: 983557 - protein, 9 aa, Homo Sapiens
FNTPPPTPS

SEQ ID NO: 983558 - protein, 9 aa, Homo Sapiens
RLAQIRQGG

SEQ ID NO: 983559 - protein, 9 aa, Homo Sapiens
IANLLLAVP

SEQ ID NO: 983560 - protein, 9 aa, Homo Sapiens
TRTSAIFDT

SEQ ID NO: 983561 - protein, 9 aa, Homo Sapiens
TKINKTTAR

SEQ ID NO: 983562 - protein, 9 aa, Homo Sapiens
SLTLMENGI

SEQ ID NO: 983563 - protein, 9 aa, Homo Sapiens
HEMHFLNVI

SEQ ID NO: 983564 - protein, 9 aa, Homo Sapiens
AVSRFHFPF

SEQ ID NO: 983565 - protein, 9 aa, Homo Sapiens
LFFLLNTVS

SEQ ID NO: 983566 - protein, 9 aa, Homo Sapiens
GSPSRSGTA

SEQ ID NO: 983567 - protein, 9 aa, Homo Sapiens
LCVNGRCDN

SEQ ID NO: 983568 - protein, 9 aa, Homo Sapiens
KGDQGQTGE

SEQ ID NO: 983569 - protein, 9 aa, Homo Sapiens
EEELNEDGE

SEQ ID NO: 983570 - protein, 9 aa, Homo Sapiens
KRLKCDEWS

SEQ ID NO: 983571 - protein, 9 aa, Homo Sapiens
SWMESSRRF

SEQ ID NO: 983572 - protein, 9 aa, Homo Sapiens
GIEICRKST

SEQ ID NO: 983573 - protein, 9 aa, Homo Sapiens
LPLEKVCLI

SEQ ID NO: 983574 - protein, 9 aa, Homo Sapiens
RKVKMPKKP

SEQ ID NO: 983575 - protein, 9 aa, Homo Sapiens
LPPPPPLLK

SEQ ID NO: 983576 - protein, 9 aa, Homo Sapiens
PRSRSRFKS

SEQ ID NO: 983577 - protein, 9 aa, Homo Sapiens
QKFLRNGDT

SEQ ID NO: 983578 - protein, 9 aa, Homo Sapiens
GTYVPLSPT

SEQ ID NO: 983579 - protein, 9 aa, Homo Sapiens
GTHYYAIWK

SEQ ID NO: 983580 - protein, 9 aa, Homo Sapiens
DVNNEFEEL

SEQ ID NO: 983581 - protein, 9 aa, Homo Sapiens
RVTLFPDIK

SEQ ID NO: 983582 - protein, 9 aa, Homo Sapiens
QEQLKSLPS

SEQ ID NO: 983583 - protein, 9 aa, Homo Sapiens
SQGPGSGNT

SEQ ID NO: 983584 - protein, 9 aa, Homo Sapiens
MFLSVRENS

SEQ ID NO: 983585 - protein, 9 aa, Homo Sapiens
LSPTSVPIF

SEQ ID NO: 983586 - protein, 9 aa, Homo Sapiens
GGVFICSMI

SEQ ID NO: 983587 - protein, 9 aa, Homo Sapiens
LLVTLIFYL

SEQ ID NO: 983588 - protein, 9 aa, Homo Sapiens
LPCLETPAD

SEQ ID NO: 983589 - protein, 9 aa, Homo Sapiens
QDPPCQTKL

SEQ ID NO: 983590 - protein, 9 aa, Homo Sapiens
GVLLFLSGG

SEQ ID NO: 983591 - protein, 9 aa, Homo Sapiens
TPPPTPSEQ

SEQ ID NO: 983592 - protein, 9 aa, Homo Sapiens
GRAFLMAGQ

SEQ ID NO: 983593 - protein, 9 aa, Homo Sapiens
RFKGSLMTK

SEQ ID NO: 983594 - protein, 9 aa, Homo Sapiens
SCCLEDTSC

SEQ ID NO: 983595 - protein, 9 aa, Homo Sapiens
ASLASSTTL

SEQ ID NO: 983596 - protein, 9 aa, Homo Sapiens
LLVYCTDLL

SEQ ID NO: 983597 - protein, 9 aa, Homo Sapiens
LQNCRYPSM

SEQ ID NO: 983598 - protein, 9 aa, Homo Sapiens
KPIQEVLKK

SEQ ID NO: 983599 - protein, 9 aa, Homo Sapiens
EMHFLNVIL

SEQ ID NO: 983600 - protein, 9 aa, Homo Sapiens
VFYELPLEK

SEQ ID NO: 983601 - protein, 9 aa, Homo Sapiens
LPENVTASK

SEQ ID NO: 983602 - protein, 9 aa, Homo Sapiens
SPVTTDQPF

SEQ ID NO: 983603 - protein, 9 aa, Homo Sapiens
INHIYREET

SEQ ID NO: 983604 - protein, 9 aa, Homo Sapiens
MSAPENARF

SEQ ID NO: 983605 - protein, 9 aa, Homo Sapiens
DQGQTGEKG

SEQ ID NO: 983606 - protein, 9 aa, Homo Sapiens
QADHVSKVT

SEQ ID NO: 983607 - protein, 9 aa, Homo Sapiens
KSWYLEKNV

SEQ ID NO: 983608 - protein, 9 aa, Homo Sapiens
PLQYGCPDE

SEQ ID NO: 983609 - protein, 9 aa, Homo Sapiens
NFSSVFHIV

SEQ ID NO: 983610 - protein, 9 aa, Homo Sapiens
IPSEPPPTH

SEQ ID NO: 983611 - protein, 9 aa, Homo Sapiens
PRIELVVAS

SEQ ID NO: 983612 - protein, 9 aa, Homo Sapiens
VIGFKFDQY

SEQ ID NO: 983613 - protein, 9 aa, Homo Sapiens
SIHVILNVE

SEQ ID NO: 983614 - protein, 9 aa, Homo Sapiens
LYPPSPPPQ

SEQ ID NO: 983615 - protein, 9 aa, Homo Sapiens
STSESSWNK

SEQ ID NO: 983616 - protein, 9 aa, Homo Sapiens
PHTRTIVKK

SEQ ID NO: 983617 - protein, 9 aa, Homo Sapiens
RNCRHFGWM

SEQ ID NO: 983618 - protein, 9 aa, Homo Sapiens
FWIYFCIYH

SEQ ID NO: 983619 - protein, 9 aa, Homo Sapiens
GLLRPKGPP

SEQ ID NO: 983620 - protein, 9 aa, Homo Sapiens
FEIFQGRLG

SEQ ID NO: 983621 - protein, 9 aa, Homo Sapiens
PSEQDKEDF

SEQ ID NO: 983622 - protein, 9 aa, Homo Sapiens
IFEKPLEKK

SEQ ID NO: 983623 - protein, 9 aa, Homo Sapiens
ESRFWEPVL

SEQ ID NO: 983624 - protein, 9 aa, Homo Sapiens
AGQGDVSIS

SEQ ID NO: 983625 - protein, 9 aa, Homo Sapiens
SGFGEQGGS

SEQ ID NO: 983626 - protein, 9 aa, Homo Sapiens
YALMEGYFM

SEQ ID NO: 983627 - protein, 9 aa, Homo Sapiens
GCYCGQERR

SEQ ID NO: 983628 - protein, 9 aa, Homo Sapiens
LSIILVCAG

SEQ ID NO: 983629 - protein, 9 aa, Homo Sapiens
ATKSQAWLC

SEQ ID NO: 983630 - protein, 9 aa, Homo Sapiens
KPNGEISSI

SEQ ID NO: 983631 - protein, 9 aa, Homo Sapiens
RKLCPEFSK

SEQ ID NO: 983632 - protein, 9 aa, Homo Sapiens
VIFLVCLAI

SEQ ID NO: 983633 - protein, 9 aa, Homo Sapiens
EDSSSHEAL

SEQ ID NO: 983634 - protein, 9 aa, Homo Sapiens
DTAGREEYS

SEQ ID NO: 983635 - protein, 9 aa, Homo Sapiens
FHCHGGPGP

SEQ ID NO: 983636 - protein, 9 aa, Homo Sapiens
DSKYYCNCD

SEQ ID NO: 983637 - protein, 9 aa, Homo Sapiens
HYEEGLMKE

SEQ ID NO: 983638 - protein, 9 aa, Homo Sapiens
KSCFLEGSP

SEQ ID NO: 983639 - protein, 9 aa, Homo Sapiens
PFSQVSTGE

SEQ ID NO: 983640 - protein, 9 aa, Homo Sapiens
MHFLNVILF

SEQ ID NO: 983641 - protein, 9 aa, Homo Sapiens
IVNLFFSDL

SEQ ID NO: 983642 - protein, 9 aa, Homo Sapiens
LINFKSNHR

SEQ ID NO: 983643 - protein, 9 aa, Homo Sapiens
QLLCSWAPL

SEQ ID NO: 983644 - protein, 9 aa, Homo Sapiens
KNSFLREVE

SEQ ID NO: 983645 - protein, 9 aa, Homo Sapiens
AGREEYSAM

SEQ ID NO: 983646 - protein, 9 aa, Homo Sapiens
KRQKSSYNY

SEQ ID NO: 983647 - protein, 9 aa, Homo Sapiens
GPPGSKGDQ

SEQ ID NO: 983648 - protein, 9 aa, Homo Sapiens
SARGHQPLD

SEQ ID NO: 983649 - protein, 9 aa, Homo Sapiens
LSAPGGQKD

SEQ ID NO: 983650 - protein, 9 aa, Homo Sapiens
VASRLVEMG

SEQ ID NO: 983651 - protein, 9 aa, Homo Sapiens
LKDKFFESF

SEQ ID NO: 983652 - protein, 9 aa, Homo Sapiens
ADGRFKGSL

SEQ ID NO: 983653 - protein, 9 aa, Homo Sapiens
EKHKLSYTG

SEQ ID NO: 983654 - protein, 9 aa, Homo Sapiens
PEIFYRIKV

SEQ ID NO: 983655 - protein, 9 aa, Homo Sapiens
NCPRDQPLF

SEQ ID NO: 983656 - protein, 9 aa, Homo Sapiens
RPMKEELPP

SEQ ID NO: 983657 - protein, 9 aa, Homo Sapiens
ALSSLPVSS

SEQ ID NO: 983658 - protein, 9 aa, Homo Sapiens
LYQVEKWKT

SEQ ID NO: 983659 - protein, 9 aa, Homo Sapiens
FSSDSDACG

SEQ ID NO: 983660 - protein, 9 aa, Homo Sapiens
QSRSEKRAQ

SEQ ID NO: 983661 - protein, 9 aa, Homo Sapiens
NFKVSQERL

SEQ ID NO: 983662 - protein, 9 aa, Homo Sapiens
TAWSLMDDF

SEQ ID NO: 983663 - protein, 9 aa, Homo Sapiens
IDSKERLDQ

SEQ ID NO: 983664 - protein, 9 aa, Homo Sapiens
EKRAQKAMS

SEQ ID NO: 983665 - protein, 9 aa, Homo Sapiens
SSRNMVLSY

SEQ ID NO: 983666 - protein, 9 aa, Homo Sapiens
EMEKQAAFL

SEQ ID NO: 983667 - protein, 9 aa, Homo Sapiens
CETRKADET

SEQ ID NO: 983668 - protein, 9 aa, Homo Sapiens
QQGYALKSF

SEQ ID NO: 983669 - protein, 9 aa, Homo Sapiens
VGEDAHLTQ

SEQ ID NO: 983670 - protein, 9 aa, Homo Sapiens
EVMSLGQCQ

SEQ ID NO: 983671 - protein, 9 aa, Homo Sapiens
EGDVTDKDE

SEQ ID NO: 983672 - protein, 9 aa, Homo Sapiens
CLLVAVRTN

SEQ ID NO: 983673 - protein, 9 aa, Homo Sapiens
SVSPHRGNN

SEQ ID NO: 983674 - protein, 9 aa, Homo Sapiens
FTISRQDRS

SEQ ID NO: 983675 - protein, 9 aa, Homo Sapiens
NCTTTHTFL

SEQ ID NO: 983676 - protein, 9 aa, Homo Sapiens
ARLLAGCED

SEQ ID NO: 983677 - protein, 9 aa, Homo Sapiens
REAQAGAAL

SEQ ID NO: 983678 - protein, 9 aa, Homo Sapiens
ALVTIETHA

SEQ ID NO: 983679 - protein, 9 aa, Homo Sapiens
GREGPPGFL

SEQ ID NO: 983680 - protein, 9 aa, Homo Sapiens
RTKDNDYFN

SEQ ID NO: 983681 - protein, 9 aa, Homo Sapiens
SFQIIRCSL

SEQ ID NO: 983682 - protein, 9 aa, Homo Sapiens
HEFEYENQF

SEQ ID NO: 983683 - protein, 9 aa, Homo Sapiens
KAPKGLTGE

SEQ ID NO: 983684 - protein, 9 aa, Homo Sapiens
IFCMNDDAT

SEQ ID NO: 983685 - protein, 9 aa, Homo Sapiens
QNVEETMSS

SEQ ID NO: 983686 - protein, 9 aa, Homo Sapiens
MVSTTSSER

SEQ ID NO: 983687 - protein, 9 aa, Homo Sapiens
DVFQILDRN

SEQ ID NO: 983688 - protein, 9 aa, Homo Sapiens
EISELIRVI

SEQ ID NO: 983689 - protein, 9 aa, Homo Sapiens
SLTSNYQKI

SEQ ID NO: 983690 - protein, 9 aa, Homo Sapiens
QQKPLPREQ

SEQ ID NO: 983691 - protein, 9 aa, Homo Sapiens
GRGGARGCA

SEQ ID NO: 983692 - protein, 9 aa, Homo Sapiens
DLNSYQYQY

SEQ ID NO: 983693 - protein, 9 aa, Homo Sapiens
QNERKNDPT

SEQ ID NO: 983694 - protein, 9 aa, Homo Sapiens
RKKKRGHGW

SEQ ID NO: 983695 - protein, 9 aa, Homo Sapiens
EFTDPRHPR

SEQ ID NO: 983696 - protein, 9 aa, Homo Sapiens
PTPAPCPIE

SEQ ID NO: 983697 - protein, 9 aa, Homo Sapiens
VAICNRLRY

SEQ ID NO: 983698 - protein, 9 aa, Homo Sapiens
TSFSYGTRR

SEQ ID NO: 983699 - protein, 9 aa, Homo Sapiens
GVFIFSDGG

SEQ ID NO: 983700 - protein, 9 aa, Homo Sapiens
VITPMLNPF

SEQ ID NO: 983701 - protein, 9 aa, Homo Sapiens
GSKSNEWRL

SEQ ID NO: 983702 - protein, 9 aa, Homo Sapiens
RQRSIFEYH

SEQ ID NO: 983703 - protein, 9 aa, Homo Sapiens
SGDDSTESE

SEQ ID NO: 983704 - protein, 9 aa, Homo Sapiens
EEKLVHSYS

SEQ ID NO: 983705 - protein, 9 aa, Homo Sapiens
PAPVLSPAL

SEQ ID NO: 983706 - protein, 9 aa, Homo Sapiens
VLKRDKVTQ

SEQ ID NO: 983707 - protein, 9 aa, Homo Sapiens
QKDGTSLKV

SEQ ID NO: 983708 - protein, 9 aa, Homo Sapiens
HNLFSNRCF

SEQ ID NO: 983709 - protein, 9 aa, Homo Sapiens
RPWWKNSFV

SEQ ID NO: 983710 - protein, 9 aa, Homo Sapiens
VISGRFRYP

SEQ ID NO: 983711 - protein, 9 aa, Homo Sapiens
IQNTTLRDV

SEQ ID NO: 983712 - protein, 9 aa, Homo Sapiens
VSRQIFQTQ

SEQ ID NO: 983713 - protein, 9 aa, Homo Sapiens
FLGGADVFS

SEQ ID NO: 983714 - protein, 9 aa, Homo Sapiens
TIMIRPLDF

SEQ ID NO: 983715 - protein, 9 aa, Homo Sapiens
IYNDAHILE

SEQ ID NO: 983716 - protein, 9 aa, Homo Sapiens
FSFFQELSD

SEQ ID NO: 983717 - protein, 9 aa, Homo Sapiens
LPESSVASA

SEQ ID NO: 983718 - protein, 9 aa, Homo Sapiens
RVPEYYGSY

SEQ ID NO: 983719 - protein, 9 aa, Homo Sapiens
EKQRQNGSA

SEQ ID NO: 983720 - protein, 9 aa, Homo Sapiens
INCYTDYLE

SEQ ID NO: 983721 - protein, 9 aa, Homo Sapiens
MWRDHSEYP

SEQ ID NO: 983722 - protein, 9 aa, Homo Sapiens
QTCGHGGQM

SEQ ID NO: 983723 - protein, 9 aa, Homo Sapiens
VHKNPPLER

SEQ ID NO: 983724 - protein, 9 aa, Homo Sapiens
YALKSFTGL

SEQ ID NO: 983725 - protein, 9 aa, Homo Sapiens
RQTPLTARL

SEQ ID NO: 983726 - protein, 9 aa, Homo Sapiens
SSSEIQEPI

SEQ ID NO: 983727 - protein, 9 aa, Homo Sapiens
ESRQRSIFE

SEQ ID NO: 983728 - protein, 9 aa, Homo Sapiens
NNNKIEKKR

SEQ ID NO: 983729 - protein, 9 aa, Homo Sapiens
EGSHPGTLF

SEQ ID NO: 983730 - protein, 9 aa, Homo Sapiens
DAISYRFSR

SEQ ID NO: 983731 - protein, 9 aa, Homo Sapiens
GKLFRWNVS

SEQ ID NO: 983732 - protein, 9 aa, Homo Sapiens
QACFLSRDE

SEQ ID NO: 983733 - protein, 9 aa, Homo Sapiens
GVRNVGKAT

SEQ ID NO: 983734 - protein, 9 aa, Homo Sapiens
DNFYCDVSQ

SEQ ID NO: 983735 - protein, 9 aa, Homo Sapiens
LPEDNLVLP

SEQ ID NO: 983736 - protein, 9 aa, Homo Sapiens
GQYSLQVNG

SEQ ID NO: 983737 - protein, 9 aa, Homo Sapiens
KKTTNHEFV

SEQ ID NO: 983738 - protein, 9 aa, Homo Sapiens
SHVNFKLHT

SEQ ID NO: 983739 - protein, 9 aa, Homo Sapiens
AYYTPRAQA

SEQ ID NO: 983740 - protein, 9 aa, Homo Sapiens
VSSSIAGPA

SEQ ID NO: 983741 - protein, 9 aa, Homo Sapiens
MNDCSEVED

SEQ ID NO: 983742 - protein, 9 aa, Homo Sapiens
LKPPFSPIP

SEQ ID NO: 983743 - protein, 9 aa, Homo Sapiens
EDENPLPDF

SEQ ID NO: 983744 - protein, 9 aa, Homo Sapiens
ALLQLSQIL

SEQ ID NO: 983745 - protein, 9 aa, Homo Sapiens
LTYTLMGKW

SEQ ID NO: 983746 - protein, 9 aa, Homo Sapiens
WHFFTDQFQ

SEQ ID NO: 983747 - protein, 9 aa, Homo Sapiens
SWCIWKQKG

SEQ ID NO: 983748 - protein, 9 aa, Homo Sapiens
ARHGGNVAL

SEQ ID NO: 983749 - protein, 9 aa, Homo Sapiens
AMYTNQAEH

SEQ ID NO: 983750 - protein, 9 aa, Homo Sapiens
AALKTRQDM

SEQ ID NO: 983751 - protein, 9 aa, Homo Sapiens
PKTVRSERK

SEQ ID NO: 983752 - protein, 9 aa, Homo Sapiens
LDDSDSLGN

SEQ ID NO: 983753 - protein, 9 aa, Homo Sapiens
AFSSDSDAC

SEQ ID NO: 983754 - protein, 9 aa, Homo Sapiens
ECILATILC

SEQ ID NO: 983755 - protein, 9 aa, Homo Sapiens
QEQTSSRPV

SEQ ID NO: 983756 - protein, 9 aa, Homo Sapiens
EELLLLKME

SEQ ID NO: 983757 - protein, 9 aa, Homo Sapiens
VRNVGKATT

SEQ ID NO: 983758 - protein, 9 aa, Homo Sapiens
TPRKDCNKH

SEQ ID NO: 983759 - protein, 9 aa, Homo Sapiens
GLHSFPRQA

SEQ ID NO: 983760 - protein, 9 aa, Homo Sapiens
YHGLYCEEK

SEQ ID NO: 983761 - protein, 9 aa, Homo Sapiens
PRSWTAADT

SEQ ID NO: 983762 - protein, 9 aa, Homo Sapiens
VEMNHFHQR

SEQ ID NO: 983763 - protein, 9 aa, Homo Sapiens
SAGTFKLCP

SEQ ID NO: 983764 - protein, 9 aa, Homo Sapiens
QPQGGDIRQ

SEQ ID NO: 983765 - protein, 9 aa, Homo Sapiens
MFFFHFLGG

SEQ ID NO: 983766 - protein, 9 aa, Homo Sapiens
QLPSNYLLG

SEQ ID NO: 983767 - protein, 9 aa, Homo Sapiens
VLTLKTVPS

SEQ ID NO: 983768 - protein, 9 aa, Homo Sapiens
EKEEGEEEG

SEQ ID NO: 983769 - protein, 9 aa, Homo Sapiens
LGYNRIQSL

SEQ ID NO: 983770 - protein, 9 aa, Homo Sapiens
PRDRIHCLQ

SEQ ID NO: 983771 - protein, 9 aa, Homo Sapiens
DALAGFCYD

SEQ ID NO: 983772 - protein, 9 aa, Homo Sapiens
CALVAAALA

SEQ ID NO: 983773 - protein, 9 aa, Homo Sapiens
KIHEFEYEN

SEQ ID NO: 983774 - protein, 9 aa, Homo Sapiens
ENRGLDSEE

SEQ ID NO: 983775 - protein, 9 aa, Homo Sapiens
NLPIYVISV

SEQ ID NO: 983776 - protein, 9 aa, Homo Sapiens
LWHFFTDQF

SEQ ID NO: 983777 - protein, 9 aa, Homo Sapiens
SKVEKNPKP

SEQ ID NO: 983778 - protein, 9 aa, Homo Sapiens
QAAPVEEVA

SEQ ID NO: 983779 - protein, 9 aa, Homo Sapiens
LLMWRDHSE

SEQ ID NO: 983780 - protein, 9 aa, Homo Sapiens
QNIFFPIWI

SEQ ID NO: 983781 - protein, 9 aa, Homo Sapiens
IQKLQNERK

SEQ ID NO: 983782 - protein, 9 aa, Homo Sapiens
LDVLKFYDF

SEQ ID NO: 983783 - protein, 9 aa, Homo Sapiens
NQRWVYDAI

SEQ ID NO: 983784 - protein, 9 aa, Homo Sapiens
ENQIILLKG

SEQ ID NO: 983785 - protein, 9 aa, Homo Sapiens
YRSKHQDEI

SEQ ID NO: 983786 - protein, 9 aa, Homo Sapiens
TVPQSGNGS

SEQ ID NO: 983787 - protein, 9 aa, Homo Sapiens
KVRYLEQQN

SEQ ID NO: 983788 - protein, 9 aa, Homo Sapiens
SVWPCQPLH

SEQ ID NO: 983789 - protein, 9 aa, Homo Sapiens
PQVFIFFLR

SEQ ID NO: 983790 - protein, 9 aa, Homo Sapiens
YFFQNPSSF

SEQ ID NO: 983791 - protein, 9 aa, Homo Sapiens
IYVTVSFMA

SEQ ID NO: 983792 - protein, 9 aa, Homo Sapiens
RRLVKISTM

SEQ ID NO: 983793 - protein, 9 aa, Homo Sapiens
PDSVTYPQD

SEQ ID NO: 983794 - protein, 9 aa, Homo Sapiens
PFLSRHEKE

SEQ ID NO: 983795 - protein, 9 aa, Homo Sapiens
LKLPDLKKN

SEQ ID NO: 983796 - protein, 9 aa, Homo Sapiens
MEQSLYRQQ

SEQ ID NO: 983797 - protein, 9 aa, Homo Sapiens
VARQRDINA

SEQ ID NO: 983798 - protein, 9 aa, Homo Sapiens
VKIAEFILK

SEQ ID NO: 983799 - protein, 9 aa, Homo Sapiens
ICSRVPTAK

SEQ ID NO: 983800 - protein, 9 aa, Homo Sapiens
ESLVNPLKP

SEQ ID NO: 983801 - protein, 9 aa, Homo Sapiens
TTTHTFLDH

SEQ ID NO: 983802 - protein, 9 aa, Homo Sapiens
MGAAASAES

SEQ ID NO: 983803 - protein, 9 aa, Homo Sapiens
ADEENYLNS

SEQ ID NO: 983804 - protein, 9 aa, Homo Sapiens
AGAGPQEIN

SEQ ID NO: 983805 - protein, 9 aa, Homo Sapiens
FVFYDHESC

SEQ ID NO: 983806 - protein, 9 aa, Homo Sapiens
PCREQRSQN

SEQ ID NO: 983807 - protein, 9 aa, Homo Sapiens
DGLGSAQLV

SEQ ID NO: 983808 - protein, 9 aa, Homo Sapiens
LLTINRYLA

SEQ ID NO: 983809 - protein, 9 aa, Homo Sapiens
EDPGQQEAL

SEQ ID NO: 983810 - protein, 9 aa, Homo Sapiens
RVFGCRKGP

SEQ ID NO: 983811 - protein, 9 aa, Homo Sapiens
RDHSESSFR

SEQ ID NO: 983812 - protein, 9 aa, Homo Sapiens
NDYFNAMTS

SEQ ID NO: 983813 - protein, 9 aa, Homo Sapiens
SSISETLLG

SEQ ID NO: 983814 - protein, 9 aa, Homo Sapiens
IRKAMAQKE

SEQ ID NO: 983815 - protein, 9 aa, Homo Sapiens
KKASTGRVP

SEQ ID NO: 983816 - protein, 9 aa, Homo Sapiens
QNIYTEERP

SEQ ID NO: 983817 - protein, 9 aa, Homo Sapiens
PHRGNNQGK

SEQ ID NO: 983818 - protein, 9 aa, Homo Sapiens
RPFRGDSPI

SEQ ID NO: 983819 - protein, 9 aa, Homo Sapiens
SQKVDSDLE

SEQ ID NO: 983820 - protein, 9 aa, Homo Sapiens
VNNAGIFLP

SEQ ID NO: 983821 - protein, 9 aa, Homo Sapiens
RSFDLVAIG

SEQ ID NO: 983822 - protein, 9 aa, Homo Sapiens
VNTTSAGCV

SEQ ID NO: 983823 - protein, 9 aa, Homo Sapiens
DCNKHGLTC

SEQ ID NO: 983824 - protein, 9 aa, Homo Sapiens
LVAPRPPAL

SEQ ID NO: 983825 - protein, 9 aa, Homo Sapiens
GCFAIFLLV

SEQ ID NO: 983826 - protein, 9 aa, Homo Sapiens
PCSYSAHYQ

SEQ ID NO: 983827 - protein, 9 aa, Homo Sapiens
GAAASAESA

SEQ ID NO: 983828 - protein, 9 aa, Homo Sapiens
QHVEDGVLF

SEQ ID NO: 983829 - protein, 9 aa, Homo Sapiens
VLKCNISDL

SEQ ID NO: 983830 - protein, 9 aa, Homo Sapiens
LKTVPSATS

SEQ ID NO: 983831 - protein, 9 aa, Homo Sapiens
RSHLNKEET

SEQ ID NO: 983832 - protein, 9 aa, Homo Sapiens
ILLEPILFY

SEQ ID NO: 983833 - protein, 9 aa, Homo Sapiens
MAEHSYLSL

SEQ ID NO: 983834 - protein, 9 aa, Homo Sapiens
ARGRARVFG

SEQ ID NO: 983835 - protein, 9 aa, Homo Sapiens
PNATIFPGQ

SEQ ID NO: 983836 - protein, 9 aa, Homo Sapiens
KLLRKSPWE

SEQ ID NO: 983837 - protein, 9 aa, Homo Sapiens
YKSSSEIQE

SEQ ID NO: 983838 - protein, 9 aa, Homo Sapiens
DVLNALDLM

SEQ ID NO: 983839 - protein, 9 aa, Homo Sapiens
FWAKMRYYM

SEQ ID NO: 983840 - protein, 9 aa, Homo Sapiens
PKSSSPSSL

SEQ ID NO: 983841 - protein, 9 aa, Homo Sapiens
CKHAHSKVE

SEQ ID NO: 983842 - protein, 9 aa, Homo Sapiens
SSLNSLSSP

SEQ ID NO: 983843 - protein, 9 aa, Homo Sapiens
CASALCLHG

SEQ ID NO: 983844 - protein, 9 aa, Homo Sapiens
YPWEVTFEV

SEQ ID NO: 983845 - protein, 9 aa, Homo Sapiens
ISYSDKGPD

SEQ ID NO: 983846 - protein, 9 aa, Homo Sapiens
DSDAVPFRE

SEQ ID NO: 983847 - protein, 9 aa, Homo Sapiens
LRYTTVTPE

SEQ ID NO: 983848 - protein, 9 aa, Homo Sapiens
EQNSDNANM

SEQ ID NO: 983849 - protein, 9 aa, Homo Sapiens
KDRTPIFTL

SEQ ID NO: 983850 - protein, 9 aa, Homo Sapiens
LLAGCEDGC

SEQ ID NO: 983851 - protein, 9 aa, Homo Sapiens
TASPSLRFP

SEQ ID NO: 983852 - protein, 9 aa, Homo Sapiens
APAEASPPS

SEQ ID NO: 983853 - protein, 9 aa, Homo Sapiens
NEHSKARYL

SEQ ID NO: 983854 - protein, 9 aa, Homo Sapiens
CSDTGQCCL

SEQ ID NO: 983855 - protein, 9 aa, Homo Sapiens
KVEADDVMR

SEQ ID NO: 983856 - protein, 9 aa, Homo Sapiens
YLVGNKLRR

SEQ ID NO: 983857 - protein, 9 aa, Homo Sapiens
LRHLVQEKA

SEQ ID NO: 983858 - protein, 9 aa, Homo Sapiens
PTRATANRL

SEQ ID NO: 983859 - protein, 9 aa, Homo Sapiens
YSGILEILL

SEQ ID NO: 983860 - protein, 9 aa, Homo Sapiens
KDLKDSLLR

SEQ ID NO: 983861 - protein, 9 aa, Homo Sapiens
RGGARGCAQ

SEQ ID NO: 983862 - protein, 9 aa, Homo Sapiens
YNVGMQLKS

SEQ ID NO: 983863 - protein, 9 aa, Homo Sapiens
FVVYSGILE

SEQ ID NO: 983864 - protein, 9 aa, Homo Sapiens
CRVEPRTPW

SEQ ID NO: 983865 - protein, 9 aa, Homo Sapiens
HFCLQLVTV

SEQ ID NO: 983866 - protein, 9 aa, Homo Sapiens
DSDSLGNSM

SEQ ID NO: 983867 - protein, 9 aa, Homo Sapiens
NPASAARQL

SEQ ID NO: 983868 - protein, 9 aa, Homo Sapiens
SQFLHGQKG

SEQ ID NO: 983869 - protein, 9 aa, Homo Sapiens
KYQRDIRKA

SEQ ID NO: 983870 - protein, 9 aa, Homo Sapiens
RHLWRIYYN

SEQ ID NO: 983871 - protein, 9 aa, Homo Sapiens
TDLNSYQYQ

SEQ ID NO: 983872 - protein, 9 aa, Homo Sapiens
EGKYQCFAR

SEQ ID NO: 983873 - protein, 9 aa, Homo Sapiens
REFQQKLLY

SEQ ID NO: 983874 - protein, 9 aa, Homo Sapiens
RKSPWEGRP

SEQ ID NO: 983875 - protein, 9 aa, Homo Sapiens
RKTAAHAIT

SEQ ID NO: 983876 - protein, 9 aa, Homo Sapiens
RYPTKCEVE

SEQ ID NO: 983877 - protein, 9 aa, Homo Sapiens
QLRFNSNSQ

SEQ ID NO: 983878 - protein, 9 aa, Homo Sapiens
FTCRLERDQ

SEQ ID NO: 983879 - protein, 9 aa, Homo Sapiens
SSLLRCCLH

SEQ ID NO: 983880 - protein, 9 aa, Homo Sapiens
SGVRNVGKA

SEQ ID NO: 983881 - protein, 9 aa, Homo Sapiens
LLLKEAGAL

SEQ ID NO: 983882 - protein, 9 aa, Homo Sapiens
TSRIWFLEG

SEQ ID NO: 983883 - protein, 9 aa, Homo Sapiens
KSLEQARTE

SEQ ID NO: 983884 - protein, 9 aa, Homo Sapiens
ARGVLKCNI

SEQ ID NO: 983885 - protein, 9 aa, Homo Sapiens
ENLAEKLAE

SEQ ID NO: 983886 - protein, 9 aa, Homo Sapiens
NSVPHFSGP

SEQ ID NO: 983887 - protein, 9 aa, Homo Sapiens
PVTTEENRK

SEQ ID NO: 983888 - protein, 9 aa, Homo Sapiens
IPKQEKKLL

SEQ ID NO: 983889 - protein, 9 aa, Homo Sapiens
YWFYYEDIT

SEQ ID NO: 983890 - protein, 9 aa, Homo Sapiens
HDEKAKSQS

SEQ ID NO: 983891 - protein, 9 aa, Homo Sapiens
WSPASCMSV

SEQ ID NO: 983892 - protein, 9 aa, Homo Sapiens
LIIDMVSDK

SEQ ID NO: 983893 - protein, 9 aa, Homo Sapiens
DLEKNDFKK

SEQ ID NO: 983894 - protein, 9 aa, Homo Sapiens
DSTESEPPL

SEQ ID NO: 983895 - protein, 9 aa, Homo Sapiens
VTVALGVLK

SEQ ID NO: 983896 - protein, 9 aa, Homo Sapiens
MNRGEKIQL

SEQ ID NO: 983897 - protein, 9 aa, Homo Sapiens
PAGDGVCHE

SEQ ID NO: 983898 - protein, 9 aa, Homo Sapiens
PELAVSGAT

SEQ ID NO: 983899 - protein, 9 aa, Homo Sapiens
TSLFENAMY

SEQ ID NO: 983900 - protein, 9 aa, Homo Sapiens
CEKSSARPG

SEQ ID NO: 983901 - protein, 9 aa, Homo Sapiens
RNDYKNINV

SEQ ID NO: 983902 - protein, 9 aa, Homo Sapiens
NSASVERLL

SEQ ID NO: 983903 - protein, 9 aa, Homo Sapiens
SKSEDSVKR

SEQ ID NO: 983904 - protein, 9 aa, Homo Sapiens
KKVKGSPSF

SEQ ID NO: 983905 - protein, 9 aa, Homo Sapiens
GNENDEQNS

SEQ ID NO: 983906 - protein, 9 aa, Homo Sapiens
LPGKDLRAR

SEQ ID NO: 983907 - protein, 9 aa, Homo Sapiens
KRKAAHVTL

SEQ ID NO: 983908 - protein, 9 aa, Homo Sapiens
NTKYQCDLV

SEQ ID NO: 983909 - protein, 9 aa, Homo Sapiens
RQMSDGDEE

SEQ ID NO: 983910 - protein, 9 aa, Homo Sapiens
LANGTLNAF

SEQ ID NO: 983911 - protein, 9 aa, Homo Sapiens
EKEYPLGRI

SEQ ID NO: 983912 - protein, 9 aa, Homo Sapiens
TQQTLYFDD

SEQ ID NO: 983913 - protein, 9 aa, Homo Sapiens
YKIRGYVII

SEQ ID NO: 983914 - protein, 9 aa, Homo Sapiens
PAKPSLLVL

SEQ ID NO: 983915 - protein, 9 aa, Homo Sapiens
AHAITKLYS

SEQ ID NO: 983916 - protein, 9 aa, Homo Sapiens
ILDTNNNSP

SEQ ID NO: 983917 - protein, 9 aa, Homo Sapiens
LYELPENIC

SEQ ID NO: 983918 - protein, 9 aa, Homo Sapiens
SDNAFGPDS

SEQ ID NO: 983919 - protein, 9 aa, Homo Sapiens
AEEKKEKIF

SEQ ID NO: 983920 - protein, 9 aa, Homo Sapiens
DFQNIILRA

SEQ ID NO: 983921 - protein, 9 aa, Homo Sapiens
RTGHFWGSV

SEQ ID NO: 983922 - protein, 9 aa, Homo Sapiens
HPVCSAGTF

SEQ ID NO: 983923 - protein, 9 aa, Homo Sapiens
FPSDYYAIE

SEQ ID NO: 983924 - protein, 9 aa, Homo Sapiens
FRCTCGQRY

SEQ ID NO: 983925 - protein, 9 aa, Homo Sapiens
LKLSQAQVY

SEQ ID NO: 983926 - protein, 9 aa, Homo Sapiens
RGSLIIDMV

SEQ ID NO: 983927 - protein, 9 aa, Homo Sapiens
KKVERSVVT

SEQ ID NO: 983928 - protein, 9 aa, Homo Sapiens
RDINASDFL

SEQ ID NO: 983929 - protein, 9 aa, Homo Sapiens
TMGLQCREC

SEQ ID NO: 983930 - protein, 9 aa, Homo Sapiens
SMDTRPAPP

SEQ ID NO: 983931 - protein, 9 aa, Homo Sapiens
DAKDAIKKN

SEQ ID NO: 983932 - protein, 9 aa, Homo Sapiens
RRNEISLIH

SEQ ID NO: 983933 - protein, 9 aa, Homo Sapiens
LKLIAEVKS

SEQ ID NO: 983934 - protein, 9 aa, Homo Sapiens
NNNRDHKEK

SEQ ID NO: 983935 - protein, 9 aa, Homo Sapiens
QSGNGSRSV

SEQ ID NO: 983936 - protein, 9 aa, Homo Sapiens
TLFSTEQSL

SEQ ID NO: 983937 - protein, 9 aa, Homo Sapiens
NELEQINCI

SEQ ID NO: 983938 - protein, 9 aa, Homo Sapiens
ETNSEEEWN

SEQ ID NO: 983939 - protein, 9 aa, Homo Sapiens
KRKLNIDSK

SEQ ID NO: 983940 - protein, 9 aa, Homo Sapiens
GGLLSTSID

SEQ ID NO: 983941 - protein, 9 aa, Homo Sapiens
KLQGPPPQG

SEQ ID NO: 983942 - protein, 9 aa, Homo Sapiens
GSPRDSDVE

SEQ ID NO: 983943 - protein, 9 aa, Homo Sapiens
FSYMDQQPN

SEQ ID NO: 983944 - protein, 9 aa, Homo Sapiens
LRILTCELS

SEQ ID NO: 983945 - protein, 9 aa, Homo Sapiens
VSIYFSTLE

SEQ ID NO: 983946 - protein, 9 aa, Homo Sapiens
KENKFKWNL

SEQ ID NO: 983947 - protein, 9 aa, Homo Sapiens
KVFSYMDQQ

SEQ ID NO: 983948 - protein, 9 aa, Homo Sapiens
PPGFSFFQE

SEQ ID NO: 983949 - protein, 9 aa, Homo Sapiens
SRRNKGVVG

SEQ ID NO: 983950 - protein, 9 aa, Homo Sapiens
NGQVLDTVA

SEQ ID NO: 983951 - protein, 9 aa, Homo Sapiens
AWSLMDDFE

SEQ ID NO: 983952 - protein, 9 aa, Homo Sapiens
LPVYSPKVP

SEQ ID NO: 983953 - protein, 9 aa, Homo Sapiens
YSYDWRTKK

SEQ ID NO: 983954 - protein, 9 aa, Homo Sapiens
QEIMKKYNI

SEQ ID NO: 983955 - protein, 9 aa, Homo Sapiens
ILYWFYYED

SEQ ID NO: 983956 - protein, 9 aa, Homo Sapiens
DSVTYPQDS

SEQ ID NO: 983957 - protein, 9 aa, Homo Sapiens
ELDKRAVQE

SEQ ID NO: 983958 - protein, 9 aa, Homo Sapiens
TEKLQGKQH

SEQ ID NO: 983959 - protein, 9 aa, Homo Sapiens
LPEFWEGSM

SEQ ID NO: 983960 - protein, 9 aa, Homo Sapiens
EPGVSGDAG

SEQ ID NO: 983961 - protein, 9 aa, Homo Sapiens
ICWLRDNLG

SEQ ID NO: 983962 - protein, 9 aa, Homo Sapiens
DFKEYKMYS

SEQ ID NO: 983963 - protein, 9 aa, Homo Sapiens
TVFQGLPGT

SEQ ID NO: 983964 - protein, 9 aa, Homo Sapiens
NDEYDNYNE

SEQ ID NO: 983965 - protein, 9 aa, Homo Sapiens
IDLVRLAIA

SEQ ID NO: 983966 - protein, 9 aa, Homo Sapiens
YHSLKWMVA

SEQ ID NO: 983967 - protein, 9 aa, Homo Sapiens
LFMYLVTVL

SEQ ID NO: 983968 - protein, 9 aa, Homo Sapiens
KDCNKHGLT

SEQ ID NO: 983969 - protein, 9 aa, Homo Sapiens
KITPLNEAI

SEQ ID NO: 983970 - protein, 9 aa, Homo Sapiens
LSPPPLPPG

SEQ ID NO: 983971 - protein, 9 aa, Homo Sapiens
PVFGTFEAG

SEQ ID NO: 983972 - protein, 9 aa, Homo Sapiens
GFTISRQDR

SEQ ID NO: 983973 - protein, 9 aa, Homo Sapiens
QCHLRFEKA

SEQ ID NO: 983974 - protein, 9 aa, Homo Sapiens
AGCEDGCCC

SEQ ID NO: 983975 - protein, 9 aa, Homo Sapiens
LFENAMYIC

SEQ ID NO: 983976 - protein, 9 aa, Homo Sapiens
IFFLREVIQ

SEQ ID NO: 983977 - protein, 9 aa, Homo Sapiens
STLQTVEKE

SEQ ID NO: 983978 - protein, 9 aa, Homo Sapiens
DPQPASKKL

SEQ ID NO: 983979 - protein, 9 aa, Homo Sapiens
DTTTFVRIG

SEQ ID NO: 983980 - protein, 9 aa, Homo Sapiens
VATISIVLL

SEQ ID NO: 983981 - protein, 9 aa, Homo Sapiens
VTIEKIYSY

SEQ ID NO: 983982 - protein, 9 aa, Homo Sapiens
HTGQESICS

SEQ ID NO: 983983 - protein, 9 aa, Homo Sapiens
DSFGPLYTH

SEQ ID NO: 983984 - protein, 9 aa, Homo Sapiens
PILYWFYYE

SEQ ID NO: 983985 - protein, 9 aa, Homo Sapiens
GPAPSLSVL

SEQ ID NO: 983986 - protein, 9 aa, Homo Sapiens
SIKSVPEKN

SEQ ID NO: 983987 - protein, 9 aa, Homo Sapiens
ELARLEEEV

SEQ ID NO: 983988 - protein, 9 aa, Homo Sapiens
KSKSGLKII

SEQ ID NO: 983989 - protein, 9 aa, Homo Sapiens
LVGPIMWFR

SEQ ID NO: 983990 - protein, 9 aa, Homo Sapiens
RRNKGVVGG

SEQ ID NO: 983991 - protein, 9 aa, Homo Sapiens
VCHEPGLQG

SEQ ID NO: 983992 - protein, 9 aa, Homo Sapiens
ALLQTALSS

SEQ ID NO: 983993 - protein, 9 aa, Homo Sapiens
ETLFGYLRD

SEQ ID NO: 983994 - protein, 9 aa, Homo Sapiens
KLLDAFDAK

SEQ ID NO: 983995 - protein, 9 aa, Homo Sapiens
NRKNSYNRS

SEQ ID NO: 983996 - protein, 9 aa, Homo Sapiens
FKKQQKKLH

SEQ ID NO: 983997 - protein, 9 aa, Homo Sapiens
LILDNCGNC

SEQ ID NO: 983998 - protein, 9 aa, Homo Sapiens
IYFSTLEWE

SEQ ID NO: 983999 - protein, 9 aa, Homo Sapiens
GRSGMALMK

SEQ ID NO: 984000 - protein, 9 aa, Homo Sapiens
NLKQKDGTS

SEQ ID NO: 984001 - protein, 9 aa, Homo Sapiens
AGRLKEQLG

SEQ ID NO: 984002 - protein, 9 aa, Homo Sapiens
TKYQCDLVS

SEQ ID NO: 984003 - protein, 9 aa, Homo Sapiens
KELASKKKV

SEQ ID NO: 984004 - protein, 9 aa, Homo Sapiens
FHQIPNSLR

SEQ ID NO: 984005 - protein, 9 aa, Homo Sapiens
IRSPAMSEG

SEQ ID NO: 984006 - protein, 9 aa, Homo Sapiens
TISIVLLLK

SEQ ID NO: 984007 - protein, 9 aa, Homo Sapiens
SVVHRFENS

SEQ ID NO: 984008 - protein, 9 aa, Homo Sapiens
KTDIPHNSE

SEQ ID NO: 984009 - protein, 9 aa, Homo Sapiens
RLAWQLKTT

SEQ ID NO: 984010 - protein, 9 aa, Homo Sapiens
EKLVHSYSY

SEQ ID NO: 984011 - protein, 9 aa, Homo Sapiens
RHGLKSLFA

SEQ ID NO: 984012 - protein, 9 aa, Homo Sapiens
PRAQALDRL

SEQ ID NO: 984013 - protein, 9 aa, Homo Sapiens
GPKSSSPSS

SEQ ID NO: 984014 - protein, 9 aa, Homo Sapiens
YTPLLIAVQ

SEQ ID NO: 984015 - protein, 9 aa, Homo Sapiens
DESRNDYKN

SEQ ID NO: 984016 - protein, 9 aa, Homo Sapiens
KSKSEDSVK

SEQ ID NO: 984017 - protein, 9 aa, Homo Sapiens
KDVARQRDI

SEQ ID NO: 984018 - protein, 9 aa, Homo Sapiens
PGTETASST

SEQ ID NO: 984019 - protein, 9 aa, Homo Sapiens
LDKLLDRMK

SEQ ID NO: 984020 - protein, 9 aa, Homo Sapiens
SSERTITST

SEQ ID NO: 984021 - protein, 9 aa, Homo Sapiens
FYSLFQASD

SEQ ID NO: 984022 - protein, 9 aa, Homo Sapiens
QLQNIVFTV

SEQ ID NO: 984023 - protein, 9 aa, Homo Sapiens
RIWFLEGKS

SEQ ID NO: 984024 - protein, 9 aa, Homo Sapiens
LTLKTVPSA

SEQ ID NO: 984025 - protein, 9 aa, Homo Sapiens
ACCGGFCRR

SEQ ID NO: 984026 - protein, 9 aa, Homo Sapiens
DRQSSVTLT

SEQ ID NO: 984027 - protein, 9 aa, Homo Sapiens
FLPPRPSKV

SEQ ID NO: 984028 - protein, 9 aa, Homo Sapiens
DSFVLDGTD

SEQ ID NO: 984029 - protein, 9 aa, Homo Sapiens
DSLYLEKEE

SEQ ID NO: 984030 - protein, 9 aa, Homo Sapiens
FDEARCGDE

SEQ ID NO: 984031 - protein, 9 aa, Homo Sapiens
LCQETLVNS

SEQ ID NO: 984032 - protein, 9 aa, Homo Sapiens
LVTVGNSGI

SEQ ID NO: 984033 - protein, 9 aa, Homo Sapiens
SDAVPFRET

SEQ ID NO: 984034 - protein, 9 aa, Homo Sapiens
PENHDIANK

SEQ ID NO: 984035 - protein, 9 aa, Homo Sapiens
NREQGDNGL

SEQ ID NO: 984036 - protein, 9 aa, Homo Sapiens
EQIKSLEQA

SEQ ID NO: 984037 - protein, 9 aa, Homo Sapiens
LVSITGRKN

SEQ ID NO: 984038 - protein, 9 aa, Homo Sapiens
SIHPSFRII

SEQ ID NO: 984039 - protein, 9 aa, Homo Sapiens
EAGLRLGPD

SEQ ID NO: 984040 - protein, 9 aa, Homo Sapiens
TDHLLYSRH

SEQ ID NO: 984041 - protein, 9 aa, Homo Sapiens
VPESRQRSI

SEQ ID NO: 984042 - protein, 9 aa, Homo Sapiens
GPPTRATAN

SEQ ID NO: 984043 - protein, 9 aa, Homo Sapiens
SCPRLCLTQ

SEQ ID NO: 984044 - protein, 9 aa, Homo Sapiens
SGNENDEQN

SEQ ID NO: 984045 - protein, 9 aa, Homo Sapiens
RLASSPVLC

SEQ ID NO: 984046 - protein, 9 aa, Homo Sapiens
QELDCMKEG

SEQ ID NO: 984047 - protein, 9 aa, Homo Sapiens
DFAYTTFKK

SEQ ID NO: 984048 - protein, 9 aa, Homo Sapiens
KERRPDYPT

SEQ ID NO: 984049 - protein, 9 aa, Homo Sapiens
DLGYNRIQS

SEQ ID NO: 984050 - protein, 9 aa, Homo Sapiens
AFRGAARLR

SEQ ID NO: 984051 - protein, 9 aa, Homo Sapiens
IPFILKIIN

SEQ ID NO: 984052 - protein, 9 aa, Homo Sapiens
EHSYLSLGL

SEQ ID NO: 984053 - protein, 9 aa, Homo Sapiens
MKKKGDIPE

SEQ ID NO: 984054 - protein, 9 aa, Homo Sapiens
TLGKRVVLY

SEQ ID NO: 984055 - protein, 9 aa, Homo Sapiens
YIITDQLPR

SEQ ID NO: 984056 - protein, 9 aa, Homo Sapiens
TPAQPAPVL

SEQ ID NO: 984057 - protein, 9 aa, Homo Sapiens
QGYALKSFT

SEQ ID NO: 984058 - protein, 9 aa, Homo Sapiens
YTNQAEHAA

SEQ ID NO: 984059 - protein, 9 aa, Homo Sapiens
VRAPQPLEL

SEQ ID NO: 984060 - protein, 9 aa, Homo Sapiens
VDTHQDKLL

SEQ ID NO: 984061 - protein, 9 aa, Homo Sapiens
RFWAKMRYY

SEQ ID NO: 984062 - protein, 9 aa, Homo Sapiens
PAEASPPSI

SEQ ID NO: 984063 - protein, 9 aa, Homo Sapiens
LQRLQKSLQ

SEQ ID NO: 984064 - protein, 9 aa, Homo Sapiens
SLHLSPLAP

SEQ ID NO: 984065 - protein, 9 aa, Homo Sapiens
MDSKIRFLE

SEQ ID NO: 984066 - protein, 9 aa, Homo Sapiens
VLCLSCADW

SEQ ID NO: 984067 - protein, 9 aa, Homo Sapiens
PTPGKHSEI

SEQ ID NO: 984068 - protein, 9 aa, Homo Sapiens
RFDRVQMRN

SEQ ID NO: 984069 - protein, 9 aa, Homo Sapiens
SVSSVVRCI

SEQ ID NO: 984070 - protein, 9 aa, Homo Sapiens
RDPFCNRMK

SEQ ID NO: 984071 - protein, 9 aa, Homo Sapiens
AKSKMISFS

SEQ ID NO: 984072 - protein, 9 aa, Homo Sapiens
FLMDFILLG

SEQ ID NO: 984073 - protein, 9 aa, Homo Sapiens
VLSGDDSTE

SEQ ID NO: 984074 - protein, 9 aa, Homo Sapiens
AGIFLPTAP

SEQ ID NO: 984075 - protein, 9 aa, Homo Sapiens
AQPAPVLSP

SEQ ID NO: 984076 - protein, 9 aa, Homo Sapiens
VPSHTVHSV

SEQ ID NO: 984077 - protein, 9 aa, Homo Sapiens
ETFNNNKIE

SEQ ID NO: 984078 - protein, 9 aa, Homo Sapiens
AWQLKTTES

SEQ ID NO: 984079 - protein, 9 aa, Homo Sapiens
ADLIQRRTK

SEQ ID NO: 984080 - protein, 9 aa, Homo Sapiens
TLKQPTTLV

SEQ ID NO: 984081 - protein, 9 aa, Homo Sapiens
LCHGHVPIR

SEQ ID NO: 984082 - protein, 9 aa, Homo Sapiens
YEGKYQCFA

SEQ ID NO: 984083 - protein, 9 aa, Homo Sapiens
VCNDKNPCE

SEQ ID NO: 984084 - protein, 9 aa, Homo Sapiens
DSFPKSKSE

SEQ ID NO: 984085 - protein, 9 aa, Homo Sapiens
MIQGNYGFF

SEQ ID NO: 984086 - protein, 9 aa, Homo Sapiens
TPSFYAPSH

SEQ ID NO: 984087 - protein, 9 aa, Homo Sapiens
RLGLMEIIA

SEQ ID NO: 984088 - protein, 9 aa, Homo Sapiens
VLEGTFLKN

SEQ ID NO: 984089 - protein, 9 aa, Homo Sapiens
SYMIVVSIS

SEQ ID NO: 984090 - protein, 9 aa, Homo Sapiens
EAFAAHVSY

SEQ ID NO: 984091 - protein, 9 aa, Homo Sapiens
SGMMRRMGF

SEQ ID NO: 984092 - protein, 9 aa, Homo Sapiens
SFVEAFKRQ

SEQ ID NO: 984093 - protein, 9 aa, Homo Sapiens
CLTLSGLSR

SEQ ID NO: 984094 - protein, 9 aa, Homo Sapiens
PKFERRNWV

SEQ ID NO: 984095 - protein, 9 aa, Homo Sapiens
QSPNINAVI

SEQ ID NO: 984096 - protein, 9 aa, Homo Sapiens
EAPGGTCWC

SEQ ID NO: 984097 - protein, 9 aa, Homo Sapiens
AQKAMSKLG

SEQ ID NO: 984098 - protein, 9 aa, Homo Sapiens
VQPKALNLC

SEQ ID NO: 984099 - protein, 9 aa, Homo Sapiens
KKEKIFLPP

SEQ ID NO: 984100 - protein, 9 aa, Homo Sapiens
KKILAVVRK

SEQ ID NO: 984101 - protein, 9 aa, Homo Sapiens
APRQTPLTA

SEQ ID NO: 984102 - protein, 9 aa, Homo Sapiens
TLSRIAGLC

SEQ ID NO: 984103 - protein, 9 aa, Homo Sapiens
HPLLSAPPR

SEQ ID NO: 984104 - protein, 9 aa, Homo Sapiens
CHCALCQGN

SEQ ID NO: 984105 - protein, 9 aa, Homo Sapiens
KPSLLVLVG

SEQ ID NO: 984106 - protein, 9 aa, Homo Sapiens
MGLGNESFL

SEQ ID NO: 984107 - protein, 9 aa, Homo Sapiens
YVTVSFMAL

SEQ ID NO: 984108 - protein, 9 aa, Homo Sapiens
SRNNRTCRF

SEQ ID NO: 984109 - protein, 9 aa, Homo Sapiens
DWALLREEK

SEQ ID NO: 984110 - protein, 9 aa, Homo Sapiens
SYCWKRDGR

SEQ ID NO: 984111 - protein, 9 aa, Homo Sapiens
EKANASAPA

SEQ ID NO: 984112 - protein, 9 aa, Homo Sapiens
VGKRIIEEE

SEQ ID NO: 984113 - protein, 9 aa, Homo Sapiens
CSAGTFKLC

SEQ ID NO: 984114 - protein, 9 aa, Homo Sapiens
KKKVEADDV

SEQ ID NO: 984115 - protein, 9 aa, Homo Sapiens
EAKSYKIQV

SEQ ID NO: 984116 - protein, 9 aa, Homo Sapiens
LVIKNTPLY

SEQ ID NO: 984117 - protein, 9 aa, Homo Sapiens
NLMERVEWL

SEQ ID NO: 984118 - protein, 9 aa, Homo Sapiens
SVPEKNRTT

SEQ ID NO: 984119 - protein, 9 aa, Homo Sapiens
DRLNNITMW

SEQ ID NO: 984120 - protein, 9 aa, Homo Sapiens
GLLSTSIDN

SEQ ID NO: 984121 - protein, 9 aa, Homo Sapiens
RSKHQDEIF

SEQ ID NO: 984122 - protein, 9 aa, Homo Sapiens
TTVIVSKML

SEQ ID NO: 984123 - protein, 9 aa, Homo Sapiens
GINKKITIP

SEQ ID NO: 984124 - protein, 9 aa, Homo Sapiens
LDGLGSAQL

SEQ ID NO: 984125 - protein, 9 aa, Homo Sapiens
IPVSFPAAG

SEQ ID NO: 984126 - protein, 9 aa, Homo Sapiens
KHVFVEYPM

SEQ ID NO: 984127 - protein, 9 aa, Homo Sapiens
KKQSEPLKI

SEQ ID NO: 984128 - protein, 9 aa, Homo Sapiens
DEKAKSQSS

SEQ ID NO: 984129 - protein, 9 aa, Homo Sapiens
SFPRQAPGS

SEQ ID NO: 984130 - protein, 9 aa, Homo Sapiens
EDAYKESCF

SEQ ID NO: 984131 - protein, 9 aa, Homo Sapiens
LHLVNTKVD

SEQ ID NO: 984132 - protein, 9 aa, Homo Sapiens
PETNSEEEW

SEQ ID NO: 984133 - protein, 9 aa, Homo Sapiens
YRFSRGVSR

SEQ ID NO: 984134 - protein, 9 aa, Homo Sapiens
EYGINKKIT

SEQ ID NO: 984135 - protein, 9 aa, Homo Sapiens
KLLGTVIQN

SEQ ID NO: 984136 - protein, 9 aa, Homo Sapiens
RVLDREKER

SEQ ID NO: 984137 - protein, 9 aa, Homo Sapiens
KLFRWNVSD

SEQ ID NO: 984138 - protein, 9 aa, Homo Sapiens
FYYLVQQSI

SEQ ID NO: 984139 - protein, 9 aa, Homo Sapiens
ITSNDAGTY

SEQ ID NO: 984140 - protein, 9 aa, Homo Sapiens
DVTNLLADP

SEQ ID NO: 984141 - protein, 9 aa, Homo Sapiens
DNPASAARQ

SEQ ID NO: 984142 - protein, 9 aa, Homo Sapiens
SQIYNDAHI

SEQ ID NO: 984143 - protein, 9 aa, Homo Sapiens
NSQPLEYSR

SEQ ID NO: 984144 - protein, 9 aa, Homo Sapiens
CQTKTTPHT

SEQ ID NO: 984145 - protein, 9 aa, Homo Sapiens
EKGKKASTG

SEQ ID NO: 984146 - protein, 9 aa, Homo Sapiens
LVAGDIVLY

SEQ ID NO: 984147 - protein, 9 aa, Homo Sapiens
ALPPGPPTR

SEQ ID NO: 984148 - protein, 9 aa, Homo Sapiens
PPVVANEKE

SEQ ID NO: 984149 - protein, 9 aa, Homo Sapiens
SPFSGRSAG

SEQ ID NO: 984150 - protein, 9 aa, Homo Sapiens
AAKASRRSL

SEQ ID NO: 984151 - protein, 9 aa, Homo Sapiens
TCNLLSLKE

SEQ ID NO: 984152 - protein, 9 aa, Homo Sapiens
GLPEDNLVL

SEQ ID NO: 984153 - protein, 9 aa, Homo Sapiens
HVEDGVLFM

SEQ ID NO: 984154 - protein, 9 aa, Homo Sapiens
CIWRYNQEL

SEQ ID NO: 984155 - protein, 9 aa, Homo Sapiens
ANEKEYPLG

SEQ ID NO: 984156 - protein, 9 aa, Homo Sapiens
IVFTFLLIS

SEQ ID NO: 984157 - protein, 9 aa, Homo Sapiens
VELKIQERW

SEQ ID NO: 984158 - protein, 9 aa, Homo Sapiens
GYGPQEEPG

SEQ ID NO: 984159 - protein, 9 aa, Homo Sapiens
GEDEEAKED

SEQ ID NO: 984160 - protein, 9 aa, Homo Sapiens
IPSPWVSNE

SEQ ID NO: 984161 - protein, 9 aa, Homo Sapiens
VSFEDRLNN

SEQ ID NO: 984162 - protein, 9 aa, Homo Sapiens
CGLMTAFFW

SEQ ID NO: 984163 - protein, 9 aa, Homo Sapiens
CCALVAAAL

SEQ ID NO: 984164 - protein, 9 aa, Homo Sapiens
VPKFERRNW

SEQ ID NO: 984165 - protein, 9 aa, Homo Sapiens
KNDFKKLKF

SEQ ID NO: 984166 - protein, 9 aa, Homo Sapiens
PLGDPGLPG

SEQ ID NO: 984167 - protein, 9 aa, Homo Sapiens
FEDRLNNIT

SEQ ID NO: 984168 - protein, 9 aa, Homo Sapiens
QDKLLCTVT

SEQ ID NO: 984169 - protein, 9 aa, Homo Sapiens
EEMGNYNEN

SEQ ID NO: 984170 - protein, 9 aa, Homo Sapiens
GPSGMMRRM

SEQ ID NO: 984171 - protein, 9 aa, Homo Sapiens
SDSEAKCFA

SEQ ID NO: 984172 - protein, 9 aa, Homo Sapiens
KSPKELLKK

SEQ ID NO: 984173 - protein, 9 aa, Homo Sapiens
LTVSSSSTG

SEQ ID NO: 984174 - protein, 9 aa, Homo Sapiens
VFRNTQFLI

SEQ ID NO: 984175 - protein, 9 aa, Homo Sapiens
CDVSQVLRL

SEQ ID NO: 984176 - protein, 9 aa, Homo Sapiens
YKSELDKRA

SEQ ID NO: 984177 - protein, 9 aa, Homo Sapiens
LFLFMYLVT

SEQ ID NO: 984178 - protein, 9 aa, Homo Sapiens
FQEKKKGNL

SEQ ID NO: 984179 - protein, 9 aa, Homo Sapiens
KNINVSANV

SEQ ID NO: 984180 - protein, 9 aa, Homo Sapiens
FEMKDMRVQ

SEQ ID NO: 984181 - protein, 9 aa, Homo Sapiens
GLSVVHRFE

SEQ ID NO: 984182 - protein, 9 aa, Homo Sapiens
FKEYKMYSM

SEQ ID NO: 984183 - protein, 9 aa, Homo Sapiens
YMGYGIETL

SEQ ID NO: 984184 - protein, 9 aa, Homo Sapiens
WEKFDPNAT

SEQ ID NO: 984185 - protein, 9 aa, Homo Sapiens
RIHSFHVRQ

SEQ ID NO: 984186 - protein, 9 aa, Homo Sapiens
PRLDLRYTT

SEQ ID NO: 984187 - protein, 9 aa, Homo Sapiens
QGGDIRQDS

SEQ ID NO: 984188 - protein, 9 aa, Homo Sapiens
YCEEKYNEC

SEQ ID NO: 984189 - protein, 9 aa, Homo Sapiens
VLSYECILA

SEQ ID NO: 984190 - protein, 9 aa, Homo Sapiens
EQPTFETLR

SEQ ID NO: 984191 - protein, 9 aa, Homo Sapiens
LLCSYRPAP

SEQ ID NO: 984192 - protein, 9 aa, Homo Sapiens
SGDAGMPGE

SEQ ID NO: 984193 - protein, 9 aa, Homo Sapiens
HEAPGGTCW

SEQ ID NO: 984194 - protein, 9 aa, Homo Sapiens
PQELPELPE

SEQ ID NO: 984195 - protein, 9 aa, Homo Sapiens
AVPFRETPS

SEQ ID NO: 984196 - protein, 9 aa, Homo Sapiens
VGDGNEDTD

SEQ ID NO: 984197 - protein, 9 aa, Homo Sapiens
QALQDKLRT

SEQ ID NO: 984198 - protein, 9 aa, Homo Sapiens
KQKIFELCI

SEQ ID NO: 984199 - protein, 9 aa, Homo Sapiens
LVTQQFSCQ

SEQ ID NO: 984200 - protein, 9 aa, Homo Sapiens
FPGIEKPGV

SEQ ID NO: 984201 - protein, 9 aa, Homo Sapiens
AIGPMILIH

SEQ ID NO: 984202 - protein, 9 aa, Homo Sapiens
ENPLPDFDG

SEQ ID NO: 984203 - protein, 9 aa, Homo Sapiens
ISELIRVIQ

SEQ ID NO: 984204 - protein, 9 aa, Homo Sapiens
GYGIETLFG

SEQ ID NO: 984205 - protein, 9 aa, Homo Sapiens
TSQFFFGNT

SEQ ID NO: 984206 - protein, 9 aa, Homo Sapiens
ENLILDNCG

SEQ ID NO: 984207 - protein, 9 aa, Homo Sapiens
YLDALAGFC

SEQ ID NO: 984208 - protein, 9 aa, Homo Sapiens
RMWPSAFGS

SEQ ID NO: 984209 - protein, 9 aa, Homo Sapiens
SPPPPSIPC

SEQ ID NO: 984210 - protein, 9 aa, Homo Sapiens
SCNEDVIAA

SEQ ID NO: 984211 - protein, 9 aa, Homo Sapiens
SPELLDSVW

SEQ ID NO: 984212 - protein, 9 aa, Homo Sapiens
GTAQPTLDL

SEQ ID NO: 984213 - protein, 9 aa, Homo Sapiens
KVFSASTSL

SEQ ID NO: 984214 - protein, 9 aa, Homo Sapiens
VLNALDLME

SEQ ID NO: 984215 - protein, 9 aa, Homo Sapiens
QKLGMAMRS

SEQ ID NO: 984216 - protein, 9 aa, Homo Sapiens
FVHCKGKIQ

SEQ ID NO: 984217 - protein, 9 aa, Homo Sapiens
DPRHPREML

SEQ ID NO: 984218 - protein, 9 aa, Homo Sapiens
YPPSSPDLG

SEQ ID NO: 984219 - protein, 9 aa, Homo Sapiens
SLATPPQAS

SEQ ID NO: 984220 - protein, 9 aa, Homo Sapiens
LLKDLKDSL

SEQ ID NO: 984221 - protein, 9 aa, Homo Sapiens
NRGTLSVIS

SEQ ID NO: 984222 - protein, 9 aa, Homo Sapiens
GNGFISKQK

SEQ ID NO: 984223 - protein, 9 aa, Homo Sapiens
PAGIYHRFM

SEQ ID NO: 984224 - protein, 9 aa, Homo Sapiens
MQAVFFSVF

SEQ ID NO: 984225 - protein, 9 aa, Homo Sapiens
VAEIVSFQT

SEQ ID NO: 984226 - protein, 9 aa, Homo Sapiens
IRFLEQRIV

SEQ ID NO: 984227 - protein, 9 aa, Homo Sapiens
SMSPDYPNL

SEQ ID NO: 984228 - protein, 9 aa, Homo Sapiens
ISSAIRSAI

SEQ ID NO: 984229 - protein, 9 aa, Homo Sapiens
FNEKGKKAS

SEQ ID NO: 984230 - protein, 9 aa, Homo Sapiens
LNEDPRSWT

SEQ ID NO: 984231 - protein, 9 aa, Homo Sapiens
SKEKLRSLS

SEQ ID NO: 984232 - protein, 9 aa, Homo Sapiens
VSGDAGMPG

SEQ ID NO: 984233 - protein, 9 aa, Homo Sapiens
KLRQSLKEL

SEQ ID NO: 984234 - protein, 9 aa, Homo Sapiens
QTASVFPSM

SEQ ID NO: 984235 - protein, 9 aa, Homo Sapiens
SPSELPGTE

SEQ ID NO: 984236 - protein, 9 aa, Homo Sapiens
VSGTMYNTE

SEQ ID NO: 984237 - protein, 9 aa, Homo Sapiens
KMISFSECK

SEQ ID NO: 984238 - protein, 9 aa, Homo Sapiens
EEYEGKYQC

SEQ ID NO: 984239 - protein, 9 aa, Homo Sapiens
GATTQIASS

SEQ ID NO: 984240 - protein, 9 aa, Homo Sapiens
YYKLYRRQI

SEQ ID NO: 984241 - protein, 9 aa, Homo Sapiens
SRPVIAKAL

SEQ ID NO: 984242 - protein, 9 aa, Homo Sapiens
HSESSFRSY

SEQ ID NO: 984243 - protein, 9 aa, Homo Sapiens
SIVTLSDEI

SEQ ID NO: 984244 - protein, 9 aa, Homo Sapiens
IQCRQDNPA

SEQ ID NO: 984245 - protein, 9 aa, Homo Sapiens
RTTCYRLSC

SEQ ID NO: 984246 - protein, 9 aa, Homo Sapiens
WAKMRYYMP

SEQ ID NO: 984247 - protein, 9 aa, Homo Sapiens
KGKEEFVTT

SEQ ID NO: 984248 - protein, 9 aa, Homo Sapiens
KIEISELIR

SEQ ID NO: 984249 - protein, 9 aa, Homo Sapiens
TPISHQRRS

SEQ ID NO: 984250 - protein, 9 aa, Homo Sapiens
KKMKKIVDV

SEQ ID NO: 984251 - protein, 9 aa, Homo Sapiens
DKGEVSDGY

SEQ ID NO: 984252 - protein, 9 aa, Homo Sapiens
PYRSSSLLR

SEQ ID NO: 984253 - protein, 9 aa, Homo Sapiens
HQSPNINAV

SEQ ID NO: 984254 - protein, 9 aa, Homo Sapiens
AASYRGISC

SEQ ID NO: 984255 - protein, 9 aa, Homo Sapiens
TMYNTERHV

SEQ ID NO: 984256 - protein, 9 aa, Homo Sapiens
NTKKNLCRK

SEQ ID NO: 984257 - protein, 9 aa, Homo Sapiens
LAVSGATLP

SEQ ID NO: 984258 - protein, 9 aa, Homo Sapiens
SVRKAAQQY

SEQ ID NO: 984259 - protein, 9 aa, Homo Sapiens
EQAYYTPRA

SEQ ID NO: 984260 - protein, 9 aa, Homo Sapiens
GPPESQGPR

SEQ ID NO: 984261 - protein, 9 aa, Homo Sapiens
SVIVPKFER

SEQ ID NO: 984262 - protein, 9 aa, Homo Sapiens
CEEKYNECL

SEQ ID NO: 984263 - protein, 9 aa, Homo Sapiens
SSLELNITD

SEQ ID NO: 984264 - protein, 9 aa, Homo Sapiens
KGKYWDTLL

SEQ ID NO: 984265 - protein, 9 aa, Homo Sapiens
KEYTLGRNH

SEQ ID NO: 984266 - protein, 9 aa, Homo Sapiens
FENSLHPIV

SEQ ID NO: 984267 - protein, 9 aa, Homo Sapiens
SGFGATTQI

SEQ ID NO: 984268 - protein, 9 aa, Homo Sapiens
AHMMPEDGN

SEQ ID NO: 984269 - protein, 9 aa, Homo Sapiens
FSPTCHFND

SEQ ID NO: 984270 - protein, 9 aa, Homo Sapiens
LLLSFFVLG

SEQ ID NO: 984271 - protein, 9 aa, Homo Sapiens
HQIPSLPTD

SEQ ID NO: 984272 - protein, 9 aa, Homo Sapiens
RLRYPVIMT

SEQ ID NO: 984273 - protein, 9 aa, Homo Sapiens
FSFNFVPSD

SEQ ID NO: 984274 - protein, 9 aa, Homo Sapiens
ASYPKMSLK

SEQ ID NO: 984275 - protein, 9 aa, Homo Sapiens
LLVLVGPRP

SEQ ID NO: 984276 - protein, 9 aa, Homo Sapiens
RPRKIAWKK

SEQ ID NO: 984277 - protein, 9 aa, Homo Sapiens
RRKGAKITE

SEQ ID NO: 984278 - protein, 9 aa, Homo Sapiens
FPPLYQPLP

SEQ ID NO: 984279 - protein, 9 aa, Homo Sapiens
ADVNTKYQC

SEQ ID NO: 984280 - protein, 9 aa, Homo Sapiens
RKLFTAAEF

SEQ ID NO: 984281 - protein, 9 aa, Homo Sapiens
LTIQALQDK

SEQ ID NO: 984282 - protein, 9 aa, Homo Sapiens
KKIKSFQGS

SEQ ID NO: 984283 - protein, 9 aa, Homo Sapiens
SSKSKLQTV

SEQ ID NO: 984284 - protein, 9 aa, Homo Sapiens
SAFGSGMGL

SEQ ID NO: 984285 - protein, 9 aa, Homo Sapiens
CQETLVNSS

SEQ ID NO: 984286 - protein, 9 aa, Homo Sapiens
KLNIDSKER

SEQ ID NO: 984287 - protein, 9 aa, Homo Sapiens
ASFIDKVRY

SEQ ID NO: 984288 - protein, 9 aa, Homo Sapiens
QELNPSALS

SEQ ID NO: 984289 - protein, 9 aa, Homo Sapiens
AIGRKATFL

SEQ ID NO: 984290 - protein, 9 aa, Homo Sapiens
GVMLLWHFF

SEQ ID NO: 984291 - protein, 9 aa, Homo Sapiens
SSLGAMFAT

SEQ ID NO: 984292 - protein, 9 aa, Homo Sapiens
TCHFNDGDE

SEQ ID NO: 984293 - protein, 9 aa, Homo Sapiens
PDYPNLMFE

SEQ ID NO: 984294 - protein, 9 aa, Homo Sapiens
LLKKKPFHS

SEQ ID NO: 984295 - protein, 9 aa, Homo Sapiens
LLRLGKIDG

SEQ ID NO: 984296 - protein, 9 aa, Homo Sapiens
KTSRIWFLE

SEQ ID NO: 984297 - protein, 9 aa, Homo Sapiens
NGSRDTESM

SEQ ID NO: 984298 - protein, 9 aa, Homo Sapiens
KAGRFDRVQ

SEQ ID NO: 984299 - protein, 9 aa, Homo Sapiens
MGNYNENTG

SEQ ID NO: 984300 - protein, 9 aa, Homo Sapiens
LYFSRDEVS

SEQ ID NO: 984301 - protein, 9 aa, Homo Sapiens
NYLLGSIIV

SEQ ID NO: 984302 - protein, 9 aa, Homo Sapiens
TPSEDDRNQ

SEQ ID NO: 984303 - protein, 9 aa, Homo Sapiens
LRCCLHEGL

SEQ ID NO: 984304 - protein, 9 aa, Homo Sapiens
HFLGGADVF

SEQ ID NO: 984305 - protein, 9 aa, Homo Sapiens
VNLTSNGQV

SEQ ID NO: 984306 - protein, 9 aa, Homo Sapiens
QFGRGSRTV

SEQ ID NO: 984307 - protein, 9 aa, Homo Sapiens
LGKPKRKRK

SEQ ID NO: 984308 - protein, 9 aa, Homo Sapiens
QQPYSHLLY

SEQ ID NO: 984309 - protein, 9 aa, Homo Sapiens
SRQDRSFDL

SEQ ID NO: 984310 - protein, 9 aa, Homo Sapiens
GVEGDVTDK

SEQ ID NO: 984311 - protein, 9 aa, Homo Sapiens
FFQNPSSFD

SEQ ID NO: 984312 - protein, 9 aa, Homo Sapiens
RFKALDKVC

SEQ ID NO: 984313 - protein, 9 aa, Homo Sapiens
GDSMDRIEN

SEQ ID NO: 984314 - protein, 9 aa, Homo Sapiens
QRYNAHMMP

SEQ ID NO: 984315 - protein, 9 aa, Homo Sapiens
FLADDPSPR

SEQ ID NO: 984316 - protein, 9 aa, Homo Sapiens
PFSPIPFFL

SEQ ID NO: 984317 - protein, 9 aa, Homo Sapiens
HQIPNSLRQ

SEQ ID NO: 984318 - protein, 9 aa, Homo Sapiens
KQSEPLKIT

SEQ ID NO: 984319 - protein, 9 aa, Homo Sapiens
YLWSPASCM

SEQ ID NO: 984320 - protein, 9 aa, Homo Sapiens
ENPYLIYDK

SEQ ID NO: 984321 - protein, 9 aa, Homo Sapiens
KLRTQRDLN

SEQ ID NO: 984322 - protein, 9 aa, Homo Sapiens
YKAIKKKPL

SEQ ID NO: 984323 - protein, 9 aa, Homo Sapiens
KRAVQEIEK

SEQ ID NO: 984324 - protein, 9 aa, Homo Sapiens
YIEYGINKK

SEQ ID NO: 984325 - protein, 9 aa, Homo Sapiens
NLSTEEKFI

SEQ ID NO: 984326 - protein, 9 aa, Homo Sapiens
ALTLRSKFM

SEQ ID NO: 984327 - protein, 9 aa, Homo Sapiens
LERVLDREK

SEQ ID NO: 984328 - protein, 9 aa, Homo Sapiens
NIKEYTLGR

SEQ ID NO: 984329 - protein, 9 aa, Homo Sapiens
RILTCELSQ

SEQ ID NO: 984330 - protein, 9 aa, Homo Sapiens
TFCILYAIF

SEQ ID NO: 984331 - protein, 9 aa, Homo Sapiens
VYQEATKKV

SEQ ID NO: 984332 - protein, 9 aa, Homo Sapiens
EDGLCHGHV

SEQ ID NO: 984333 - protein, 9 aa, Homo Sapiens
RPTRESENE

SEQ ID NO: 984334 - protein, 9 aa, Homo Sapiens
FRRISLRKK

SEQ ID NO: 984335 - protein, 9 aa, Homo Sapiens
SALRRMEAA

SEQ ID NO: 984336 - protein, 9 aa, Homo Sapiens
SPTKFEVVL

SEQ ID NO: 984337 - protein, 9 aa, Homo Sapiens
DLGLPEDNL

SEQ ID NO: 984338 - protein, 9 aa, Homo Sapiens
SKSIPIDFF

SEQ ID NO: 984339 - protein, 9 aa, Homo Sapiens
SPSPGGGGD

SEQ ID NO: 984340 - protein, 9 aa, Homo Sapiens
RKSSRSPSS

SEQ ID NO: 984341 - protein, 9 aa, Homo Sapiens
LYIEYGINK

SEQ ID NO: 984342 - protein, 9 aa, Homo Sapiens
LHIHQRLYI

SEQ ID NO: 984343 - protein, 9 aa, Homo Sapiens
LVKKGLASY

SEQ ID NO: 984344 - protein, 9 aa, Homo Sapiens
SLSVLNVTG

SEQ ID NO: 984345 - protein, 9 aa, Homo Sapiens
KQLLSEQFG

SEQ ID NO: 984346 - protein, 9 aa, Homo Sapiens
PPLERDHIN

SEQ ID NO: 984347 - protein, 9 aa, Homo Sapiens
LNDITQLRN

SEQ ID NO: 984348 - protein, 9 aa, Homo Sapiens
IYSYYVKAP

SEQ ID NO: 984349 - protein, 9 aa, Homo Sapiens
KKMKLAQKK

SEQ ID NO: 984350 - protein, 9 aa, Homo Sapiens
VTLLDKLGL

SEQ ID NO: 984351 - protein, 9 aa, Homo Sapiens
SRQIFQTQT

SEQ ID NO: 984352 - protein, 9 aa, Homo Sapiens
ISKQKLGMA

SEQ ID NO: 984353 - protein, 9 aa, Homo Sapiens
CWNAEPKEQ

SEQ ID NO: 984354 - protein, 9 aa, Homo Sapiens
SQILSLMET

SEQ ID NO: 984355 - protein, 9 aa, Homo Sapiens
VPQSGNGSR

SEQ ID NO: 984356 - protein, 9 aa, Homo Sapiens
LRPWWKNSF

SEQ ID NO: 984357 - protein, 9 aa, Homo Sapiens
TAASYRGIS

SEQ ID NO: 984358 - protein, 9 aa, Homo Sapiens
DSAERQKNF

SEQ ID NO: 984359 - protein, 9 aa, Homo Sapiens
SCQPYLCCL

SEQ ID NO: 984360 - protein, 9 aa, Homo Sapiens
STHYFHGLV

SEQ ID NO: 984361 - protein, 9 aa, Homo Sapiens
FCIWRYNQE

SEQ ID NO: 984362 - protein, 9 aa, Homo Sapiens
VTDHLLYSR

SEQ ID NO: 984363 - protein, 9 aa, Homo Sapiens
IEIENEFIS

SEQ ID NO: 984364 - protein, 9 aa, Homo Sapiens
IREDYLLSV

SEQ ID NO: 984365 - protein, 9 aa, Homo Sapiens
NNKIEKKRN

SEQ ID NO: 984366 - protein, 9 aa, Homo Sapiens
KLQNIFFPI

SEQ ID NO: 984367 - protein, 9 aa, Homo Sapiens
ESVTAMEFE

SEQ ID NO: 984368 - protein, 9 aa, Homo Sapiens
AMDHGAIKV

SEQ ID NO: 984369 - protein, 9 aa, Homo Sapiens
SVEAYNICT

SEQ ID NO: 984370 - protein, 9 aa, Homo Sapiens
SANKFEMKD

SEQ ID NO: 984371 - protein, 9 aa, Homo Sapiens
KKDDDKNGP

SEQ ID NO: 984372 - protein, 9 aa, Homo Sapiens
FKLIKTENL

SEQ ID NO: 984373 - protein, 9 aa, Homo Sapiens
SASDRTSSS

SEQ ID NO: 984374 - protein, 9 aa, Homo Sapiens
GLTVSSSST

SEQ ID NO: 984375 - protein, 9 aa, Homo Sapiens
KRKKKRGHG

SEQ ID NO: 984376 - protein, 9 aa, Homo Sapiens
RMNGDKFQK

SEQ ID NO: 984377 - protein, 9 aa, Homo Sapiens
AMMTKADNN

SEQ ID NO: 984378 - protein, 9 aa, Homo Sapiens
VMLLPKLQQ

SEQ ID NO: 984379 - protein, 9 aa, Homo Sapiens
KGDEGPLGD

SEQ ID NO: 984380 - protein, 9 aa, Homo Sapiens
YSLPALSYF

SEQ ID NO: 984381 - protein, 9 aa, Homo Sapiens
SFFVLGLFL

SEQ ID NO: 984382 - protein, 9 aa, Homo Sapiens
TIILVSHVN

SEQ ID NO: 984383 - protein, 9 aa, Homo Sapiens
RIISSAIRS

SEQ ID NO: 984384 - protein, 9 aa, Homo Sapiens
AGGLHSFPR

SEQ ID NO: 984385 - protein, 9 aa, Homo Sapiens
YLALNEDPR

SEQ ID NO: 984386 - protein, 9 aa, Homo Sapiens
ALVITSTPS

SEQ ID NO: 984387 - protein, 9 aa, Homo Sapiens
RGAQQKRAQ

SEQ ID NO: 984388 - protein, 9 aa, Homo Sapiens
ALYQKVFSE

SEQ ID NO: 984389 - protein, 9 aa, Homo Sapiens
FFPSEGSSL

SEQ ID NO: 984390 - protein, 9 aa, Homo Sapiens
VTLSLLVDW

SEQ ID NO: 984391 - protein, 9 aa, Homo Sapiens
GKRVVLYVL

SEQ ID NO: 984392 - protein, 9 aa, Homo Sapiens
PVSFPAAGM

SEQ ID NO: 984393 - protein, 9 aa, Homo Sapiens
GQELSKFNL

SEQ ID NO: 984394 - protein, 9 aa, Homo Sapiens
RINKSAWLK

SEQ ID NO: 984395 - protein, 9 aa, Homo Sapiens
VKENRGLDS

SEQ ID NO: 984396 - protein, 9 aa, Homo Sapiens
KSPWEGRPN

SEQ ID NO: 984397 - protein, 9 aa, Homo Sapiens
GFPGTPGSP

SEQ ID NO: 984398 - protein, 9 aa, Homo Sapiens
LTFTVGSGL

SEQ ID NO: 984399 - protein, 9 aa, Homo Sapiens
VISQEIMKK

SEQ ID NO: 984400 - protein, 9 aa, Homo Sapiens
LASKKKVKG

SEQ ID NO: 984401 - protein, 9 aa, Homo Sapiens
CRFKWGLET

SEQ ID NO: 984402 - protein, 9 aa, Homo Sapiens
EQCHQEGGS

SEQ ID NO: 984403 - protein, 9 aa, Homo Sapiens
QTSSRPVIA

SEQ ID NO: 984404 - protein, 9 aa, Homo Sapiens
ILKIINAVP

SEQ ID NO: 984405 - protein, 9 aa, Homo Sapiens
FEVYSVSLT

SEQ ID NO: 984406 - protein, 9 aa, Homo Sapiens
IGRICLNND

SEQ ID NO: 984407 - protein, 9 aa, Homo Sapiens
QLAPADLLI

SEQ ID NO: 984408 - protein, 9 aa, Homo Sapiens
AFASNIKEN

SEQ ID NO: 984409 - protein, 9 aa, Homo Sapiens
VGNSGIGKA

SEQ ID NO: 984410 - protein, 9 aa, Homo Sapiens
RIQSLARNV

SEQ ID NO: 984411 - protein, 9 aa, Homo Sapiens
FEMCETRKA

SEQ ID NO: 984412 - protein, 9 aa, Homo Sapiens
KARQCHLRF

SEQ ID NO: 984413 - protein, 9 aa, Homo Sapiens
TSTPCDFFG

SEQ ID NO: 984414 - protein, 9 aa, Homo Sapiens
YGIETLFGY

SEQ ID NO: 984415 - protein, 9 aa, Homo Sapiens
INKSAWLKD

SEQ ID NO: 984416 - protein, 9 aa, Homo Sapiens
DYPWEVTFE

SEQ ID NO: 984417 - protein, 9 aa, Homo Sapiens
PKGLTGERP

SEQ ID NO: 984418 - protein, 9 aa, Homo Sapiens
RPSKVLGLQ

SEQ ID NO: 984419 - protein, 9 aa, Homo Sapiens
QLISERVLW

SEQ ID NO: 984420 - protein, 9 aa, Homo Sapiens
KVIHTENYR

SEQ ID NO: 984421 - protein, 9 aa, Homo Sapiens
KIYRWPARE

SEQ ID NO: 984422 - protein, 9 aa, Homo Sapiens
AGLLRILVV

SEQ ID NO: 984423 - protein, 9 aa, Homo Sapiens
EKIFKTNSF

SEQ ID NO: 984424 - protein, 9 aa, Homo Sapiens
SSLLERASL

SEQ ID NO: 984425 - protein, 9 aa, Homo Sapiens
ARFLEAGLR

SEQ ID NO: 984426 - protein, 9 aa, Homo Sapiens
SEDVSQEEF

SEQ ID NO: 984427 - protein, 9 aa, Homo Sapiens
RLYLWSPAS

SEQ ID NO: 984428 - protein, 9 aa, Homo Sapiens
LTSNGQVLD

SEQ ID NO: 984429 - protein, 9 aa, Homo Sapiens
LNSNNIGNN

SEQ ID NO: 984430 - protein, 9 aa, Homo Sapiens
ENYLNSKIA

SEQ ID NO: 984431 - protein, 9 aa, Homo Sapiens
SEVPYVHKN

SEQ ID NO: 984432 - protein, 9 aa, Homo Sapiens
SPIPFFLAI

SEQ ID NO: 984433 - protein, 9 aa, Homo Sapiens
GGTCWCPIQ

SEQ ID NO: 984434 - protein, 9 aa, Homo Sapiens
LTGERPLAA

SEQ ID NO: 984435 - protein, 9 aa, Homo Sapiens
FVNYSDFKD

SEQ ID NO: 984436 - protein, 9 aa, Homo Sapiens
EKINKRIEH

SEQ ID NO: 984437 - protein, 9 aa, Homo Sapiens
ALSVAYAAS

SEQ ID NO: 984438 - protein, 9 aa, Homo Sapiens
KPDKKDDDK

SEQ ID NO: 984439 - protein, 9 aa, Homo Sapiens
GHLLLQKLF

SEQ ID NO: 984440 - protein, 9 aa, Homo Sapiens
GHFWGSVTY

SEQ ID NO: 984441 - protein, 9 aa, Homo Sapiens
NIGNNIFFS

SEQ ID NO: 984442 - protein, 9 aa, Homo Sapiens
GPLGDPGLP

SEQ ID NO: 984443 - protein, 9 aa, Homo Sapiens
DEVSLCWPG

SEQ ID NO: 984444 - protein, 9 aa, Homo Sapiens
EDEPDDGSN

SEQ ID NO: 984445 - protein, 9 aa, Homo Sapiens
PENGCRGGF

SEQ ID NO: 984446 - protein, 9 aa, Homo Sapiens
PPPDMTSFS

SEQ ID NO: 984447 - protein, 9 aa, Homo Sapiens
TLLGTDTFS

SEQ ID NO: 984448 - protein, 9 aa, Homo Sapiens
LMEIIAFAK

SEQ ID NO: 984449 - protein, 9 aa, Homo Sapiens
QTAAQDLQG

SEQ ID NO: 984450 - protein, 9 aa, Homo Sapiens
NFDSSYDKD

SEQ ID NO: 984451 - protein, 9 aa, Homo Sapiens
DCTCNLLSL

SEQ ID NO: 984452 - protein, 9 aa, Homo Sapiens
NLMNDCSEV

SEQ ID NO: 984453 - protein, 9 aa, Homo Sapiens
GWGTRGNCS

SEQ ID NO: 984454 - protein, 9 aa, Homo Sapiens
SSAAVSDGF

SEQ ID NO: 984455 - protein, 9 aa, Homo Sapiens
LDKVCIGAV

SEQ ID NO: 984456 - protein, 9 aa, Homo Sapiens
DGLCHGHVP

SEQ ID NO: 984457 - protein, 9 aa, Homo Sapiens
YLRPCDRKA

SEQ ID NO: 984458 - protein, 9 aa, Homo Sapiens
PDHLYFFRI

SEQ ID NO: 984459 - protein, 9 aa, Homo Sapiens
MTKADNNNR

SEQ ID NO: 984460 - protein, 9 aa, Homo Sapiens
EPHKFPCGE

SEQ ID NO: 984461 - protein, 9 aa, Homo Sapiens
NNSSEVPYL

SEQ ID NO: 984462 - protein, 9 aa, Homo Sapiens
EKLGGINSE

SEQ ID NO: 984463 - protein, 9 aa, Homo Sapiens
LEKNDFKKL

SEQ ID NO: 984464 - protein, 9 aa, Homo Sapiens
KEYKMYSME

SEQ ID NO: 984465 - protein, 9 aa, Homo Sapiens
FLENFSFLE

SEQ ID NO: 984466 - protein, 9 aa, Homo Sapiens
RQTFSLNET

SEQ ID NO: 984467 - protein, 9 aa, Homo Sapiens
WWKNSFVEA

SEQ ID NO: 984468 - protein, 9 aa, Homo Sapiens
EAQKGPIPS

SEQ ID NO: 984469 - protein, 9 aa, Homo Sapiens
NAGIFLPTA

SEQ ID NO: 984470 - protein, 9 aa, Homo Sapiens
TAAQDLQGQ

SEQ ID NO: 984471 - protein, 9 aa, Homo Sapiens
VQGPPKPWW

SEQ ID NO: 984472 - protein, 9 aa, Homo Sapiens
TRRAVMPPP

SEQ ID NO: 984473 - protein, 9 aa, Homo Sapiens
VSDGYVVSR

SEQ ID NO: 984474 - protein, 9 aa, Homo Sapiens
LRQDTIERE

SEQ ID NO: 984475 - protein, 9 aa, Homo Sapiens
CWTLIHIFI

SEQ ID NO: 984476 - protein, 9 aa, Homo Sapiens
AIKKKPLRK

SEQ ID NO: 984477 - protein, 9 aa, Homo Sapiens
DADEENYLN

SEQ ID NO: 984478 - protein, 9 aa, Homo Sapiens
RLRTRECNN

SEQ ID NO: 984479 - protein, 9 aa, Homo Sapiens
RTDLKKEHK

SEQ ID NO: 984480 - protein, 9 aa, Homo Sapiens
KSDIEIENE

SEQ ID NO: 984481 - protein, 9 aa, Homo Sapiens
FLSYHIFLI

SEQ ID NO: 984482 - protein, 9 aa, Homo Sapiens
SEAKCFAVR

SEQ ID NO: 984483 - protein, 9 aa, Homo Sapiens
KTFTSSEKF

SEQ ID NO: 984484 - protein, 9 aa, Homo Sapiens
QVRSHLNKE

SEQ ID NO: 984485 - protein, 9 aa, Homo Sapiens
LYQKVFSEQ

SEQ ID NO: 984486 - protein, 9 aa, Homo Sapiens
TPTPAPCPI

SEQ ID NO: 984487 - protein, 9 aa, Homo Sapiens
SSKNSYFFQ

SEQ ID NO: 984488 - protein, 9 aa, Homo Sapiens
WRDHSEYPF

SEQ ID NO: 984489 - protein, 9 aa, Homo Sapiens
IYYNITDVE

SEQ ID NO: 984490 - protein, 9 aa, Homo Sapiens
DDSTESEPP

SEQ ID NO: 984491 - protein, 9 aa, Homo Sapiens
FRQHGSGTG

SEQ ID NO: 984492 - protein, 9 aa, Homo Sapiens
KKLLPELSS

SEQ ID NO: 984493 - protein, 9 aa, Homo Sapiens
AFLRSLSYH

SEQ ID NO: 984494 - protein, 9 aa, Homo Sapiens
IGRKALKLE

SEQ ID NO: 984495 - protein, 9 aa, Homo Sapiens
FTDPRHPRE

SEQ ID NO: 984496 - protein, 9 aa, Homo Sapiens
HTPMYMFLE

SEQ ID NO: 984497 - protein, 9 aa, Homo Sapiens
PGLGIKFSA

SEQ ID NO: 984498 - protein, 9 aa, Homo Sapiens
SDRTSSSPF

SEQ ID NO: 984499 - protein, 9 aa, Homo Sapiens
LQNFDFEDQ

SEQ ID NO: 984500 - protein, 9 aa, Homo Sapiens
SFIDKVRYL

SEQ ID NO: 984501 - protein, 9 aa, Homo Sapiens
LHPVQEKIA

SEQ ID NO: 984502 - protein, 9 aa, Homo Sapiens
QCCLDHEGK

SEQ ID NO: 984503 - protein, 9 aa, Homo Sapiens
VLSYRAEDH

SEQ ID NO: 984504 - protein, 9 aa, Homo Sapiens
TDGAHCERG

SEQ ID NO: 984505 - protein, 9 aa, Homo Sapiens
IPMYLFFGS

SEQ ID NO: 984506 - protein, 9 aa, Homo Sapiens
SSASRRLVK

SEQ ID NO: 984507 - protein, 9 aa, Homo Sapiens
GGKTFCILY

SEQ ID NO: 984508 - protein, 9 aa, Homo Sapiens
QDSFPAQFG

SEQ ID NO: 984509 - protein, 9 aa, Homo Sapiens
LDSNLDQIE

SEQ ID NO: 984510 - protein, 9 aa, Homo Sapiens
LFLLWRQSC

SEQ ID NO: 984511 - protein, 9 aa, Homo Sapiens
QVYFEEALG

SEQ ID NO: 984512 - protein, 9 aa, Homo Sapiens
SGGPTPSFY

SEQ ID NO: 984513 - protein, 9 aa, Homo Sapiens
SSSLLPAPG

SEQ ID NO: 984514 - protein, 9 aa, Homo Sapiens
FFIQCRQDN

SEQ ID NO: 984515 - protein, 9 aa, Homo Sapiens
KIEVMSLGQ

SEQ ID NO: 984516 - protein, 9 aa, Homo Sapiens
RELREVRCV

SEQ ID NO: 984517 - protein, 9 aa, Homo Sapiens
IILRAPDFL

SEQ ID NO: 984518 - protein, 9 aa, Homo Sapiens
GQRSVLQVL

SEQ ID NO: 984519 - protein, 9 aa, Homo Sapiens
VRIGRILRL

SEQ ID NO: 984520 - protein, 9 aa, Homo Sapiens
LGQCQDNTT

SEQ ID NO: 984521 - protein, 9 aa, Homo Sapiens
KFNHYDTAA

SEQ ID NO: 984522 - protein, 9 aa, Homo Sapiens
KAFSTCSSY

SEQ ID NO: 984523 - protein, 9 aa, Homo Sapiens
RKLNIDSKE

SEQ ID NO: 984524 - protein, 9 aa, Homo Sapiens
RRRFSRAVQ

SEQ ID NO: 984525 - protein, 9 aa, Homo Sapiens
GGDDFLDCY

SEQ ID NO: 984526 - protein, 9 aa, Homo Sapiens
SEGIFAIRR

SEQ ID NO: 984527 - protein, 9 aa, Homo Sapiens
DKIDRLLQS

SEQ ID NO: 984528 - protein, 9 aa, Homo Sapiens
LLLQKLFRA

SEQ ID NO: 984529 - protein, 9 aa, Homo Sapiens
INTLFSTEQ

SEQ ID NO: 984530 - protein, 9 aa, Homo Sapiens
FFLKYITGD

SEQ ID NO: 984531 - protein, 9 aa, Homo Sapiens
TGSSASRRL

SEQ ID NO: 984532 - protein, 9 aa, Homo Sapiens
CMNDDATQQ

SEQ ID NO: 984533 - protein, 9 aa, Homo Sapiens
FLSRRNEIS

SEQ ID NO: 984534 - protein, 9 aa, Homo Sapiens
LMNDCSEVE

SEQ ID NO: 984535 - protein, 9 aa, Homo Sapiens
KFVSEGFKV

SEQ ID NO: 984536 - protein, 9 aa, Homo Sapiens
ASPPSIAPK

SEQ ID NO: 984537 - protein, 9 aa, Homo Sapiens
LVRIGRILR

SEQ ID NO: 984538 - protein, 9 aa, Homo Sapiens
TQNPLRQKI

SEQ ID NO: 984539 - protein, 9 aa, Homo Sapiens
GSSASRRLV

SEQ ID NO: 984540 - protein, 9 aa, Homo Sapiens
LELMRKEIS

SEQ ID NO: 984541 - protein, 9 aa, Homo Sapiens
GVFEENGSC

SEQ ID NO: 984542 - protein, 9 aa, Homo Sapiens
AKLNTPSFL

SEQ ID NO: 984543 - protein, 9 aa, Homo Sapiens
ALKLEALDV

SEQ ID NO: 984544 - protein, 9 aa, Homo Sapiens
QQKRAQPPA

SEQ ID NO: 984545 - protein, 9 aa, Homo Sapiens
RSERKAKGA

SEQ ID NO: 984546 - protein, 9 aa, Homo Sapiens
LKRDKVTQL

SEQ ID NO: 984547 - protein, 9 aa, Homo Sapiens
NNNSPEVAV

SEQ ID NO: 984548 - protein, 9 aa, Homo Sapiens
SEKAYSLGN

SEQ ID NO: 984549 - protein, 9 aa, Homo Sapiens
TDFCSSLAQ

SEQ ID NO: 984550 - protein, 9 aa, Homo Sapiens
KDNDYFNAM

SEQ ID NO: 984551 - protein, 9 aa, Homo Sapiens
TPRAQALDR

SEQ ID NO: 984552 - protein, 9 aa, Homo Sapiens
LDSSGLTFT

SEQ ID NO: 984553 - protein, 9 aa, Homo Sapiens
EMNSVPHFS

SEQ ID NO: 984554 - protein, 9 aa, Homo Sapiens
QEEFLFLIS

SEQ ID NO: 984555 - protein, 9 aa, Homo Sapiens
DQLPRMQCQ

SEQ ID NO: 984556 - protein, 9 aa, Homo Sapiens
LDPRLKVDS

SEQ ID NO: 984557 - protein, 9 aa, Homo Sapiens
SELWFVNSD

SEQ ID NO: 984558 - protein, 9 aa, Homo Sapiens
QVEEKLGGI

SEQ ID NO: 984559 - protein, 9 aa, Homo Sapiens
QLKTTESKP

SEQ ID NO: 984560 - protein, 9 aa, Homo Sapiens
LLQLSQILS

SEQ ID NO: 984561 - protein, 9 aa, Homo Sapiens
GLYECVAKN

SEQ ID NO: 984562 - protein, 9 aa, Homo Sapiens
INDQLVKKG

SEQ ID NO: 984563 - protein, 9 aa, Homo Sapiens
SPEDNMNDR

SEQ ID NO: 984564 - protein, 9 aa, Homo Sapiens
NKVRNALMK

SEQ ID NO: 984565 - protein, 9 aa, Homo Sapiens
PLSSRNMVL

SEQ ID NO: 984566 - protein, 9 aa, Homo Sapiens
RVCFLAGEK

SEQ ID NO: 984567 - protein, 9 aa, Homo Sapiens
IFFPIWIST

SEQ ID NO: 984568 - protein, 9 aa, Homo Sapiens
STTIMIRPL

SEQ ID NO: 984569 - protein, 9 aa, Homo Sapiens
GDIVLYKLG

SEQ ID NO: 984570 - protein, 9 aa, Homo Sapiens
DPNATQFIE

SEQ ID NO: 984571 - protein, 9 aa, Homo Sapiens
KRLEVDINI

SEQ ID NO: 984572 - protein, 9 aa, Homo Sapiens
QKAMSKLGL

SEQ ID NO: 984573 - protein, 9 aa, Homo Sapiens
NLYPLLLVN

SEQ ID NO: 984574 - protein, 9 aa, Homo Sapiens
CPVVNELEQ

SEQ ID NO: 984575 - protein, 9 aa, Homo Sapiens
KEMVTLLDK

SEQ ID NO: 984576 - protein, 9 aa, Homo Sapiens
LDGLTVSSS

SEQ ID NO: 984577 - protein, 9 aa, Homo Sapiens
GQDEPAFID

SEQ ID NO: 984578 - protein, 9 aa, Homo Sapiens
RLEEVSPWL

SEQ ID NO: 984579 - protein, 9 aa, Homo Sapiens
ATSSMEAAS

SEQ ID NO: 984580 - protein, 9 aa, Homo Sapiens
LRKSPWEGR

SEQ ID NO: 984581 - protein, 9 aa, Homo Sapiens
DKAPKGLTG

SEQ ID NO: 984582 - protein, 9 aa, Homo Sapiens
AQLRGETES

SEQ ID NO: 984583 - protein, 9 aa, Homo Sapiens
AIQGKLPKS

SEQ ID NO: 984584 - protein, 9 aa, Homo Sapiens
DYPNLMFEH

SEQ ID NO: 984585 - protein, 9 aa, Homo Sapiens
RKNSYNRSR

SEQ ID NO: 984586 - protein, 9 aa, Homo Sapiens
DLSWEARHG

SEQ ID NO: 984587 - protein, 9 aa, Homo Sapiens
VNFKLHTPM

SEQ ID NO: 984588 - protein, 9 aa, Homo Sapiens
IVLPAWIVD

SEQ ID NO: 984589 - protein, 9 aa, Homo Sapiens
GQLDLEPRG

SEQ ID NO: 984590 - protein, 9 aa, Homo Sapiens
YSPKVPSIS

SEQ ID NO: 984591 - protein, 9 aa, Homo Sapiens
LRNEKPVTT

SEQ ID NO: 984592 - protein, 9 aa, Homo Sapiens
KSYKIQVTA

SEQ ID NO: 984593 - protein, 9 aa, Homo Sapiens
ASFFTEIVV

SEQ ID NO: 984594 - protein, 9 aa, Homo Sapiens
SISETLLGT

SEQ ID NO: 984595 - protein, 9 aa, Homo Sapiens
LVAAALASD

SEQ ID NO: 984596 - protein, 9 aa, Homo Sapiens
LTQYSRDAQ

SEQ ID NO: 984597 - protein, 9 aa, Homo Sapiens
ERDTVSLVC

SEQ ID NO: 984598 - protein, 9 aa, Homo Sapiens
LVFLKCENV

SEQ ID NO: 984599 - protein, 9 aa, Homo Sapiens
HAITKLYSL

SEQ ID NO: 984600 - protein, 9 aa, Homo Sapiens
SSVVRCITH

SEQ ID NO: 984601 - protein, 9 aa, Homo Sapiens
QERLKLSND

SEQ ID NO: 984602 - protein, 9 aa, Homo Sapiens
IGVKGDRSE

SEQ ID NO: 984603 - protein, 9 aa, Homo Sapiens
QTQARCRGF

SEQ ID NO: 984604 - protein, 9 aa, Homo Sapiens
VFSQDLLEK

SEQ ID NO: 984605 - protein, 9 aa, Homo Sapiens
FTGLLSSFV

SEQ ID NO: 984606 - protein, 9 aa, Homo Sapiens
LLIKAIKDG

SEQ ID NO: 984607 - protein, 9 aa, Homo Sapiens
GLTQNPLRQ

SEQ ID NO: 984608 - protein, 9 aa, Homo Sapiens
RKLLRKSPW

SEQ ID NO: 984609 - protein, 9 aa, Homo Sapiens
LLKSGGFLV

SEQ ID NO: 984610 - protein, 9 aa, Homo Sapiens
KNSYFFQNP

SEQ ID NO: 984611 - protein, 9 aa, Homo Sapiens
EEKYNECLS

SEQ ID NO: 984612 - protein, 9 aa, Homo Sapiens
DTNNNSPEV

SEQ ID NO: 984613 - protein, 9 aa, Homo Sapiens
QDCYQGDGQ

SEQ ID NO: 984614 - protein, 9 aa, Homo Sapiens
YPNRGLQFF

SEQ ID NO: 984615 - protein, 9 aa, Homo Sapiens
AIFNSLSLP

SEQ ID NO: 984616 - protein, 9 aa, Homo Sapiens
RVHKDAELA

SEQ ID NO: 984617 - protein, 9 aa, Homo Sapiens
EDLKLDLGK

SEQ ID NO: 984618 - protein, 9 aa, Homo Sapiens
MSLASFVTP

SEQ ID NO: 984619 - protein, 9 aa, Homo Sapiens
NLHRILMDL

SEQ ID NO: 984620 - protein, 9 aa, Homo Sapiens
LLDMGLGTI

SEQ ID NO: 984621 - protein, 9 aa, Homo Sapiens
VQQSIHWLF

SEQ ID NO: 984622 - protein, 9 aa, Homo Sapiens
TLTEKEKKI

SEQ ID NO: 984623 - protein, 9 aa, Homo Sapiens
AISYRFSRG

SEQ ID NO: 984624 - protein, 9 aa, Homo Sapiens
TVEKEKTLI

SEQ ID NO: 984625 - protein, 9 aa, Homo Sapiens
FDVLNALDL

SEQ ID NO: 984626 - protein, 9 aa, Homo Sapiens
LPGGRSPGL

SEQ ID NO: 984627 - protein, 9 aa, Homo Sapiens
TYPQDSLAQ

SEQ ID NO: 984628 - protein, 9 aa, Homo Sapiens
FIQRGSLII

SEQ ID NO: 984629 - protein, 9 aa, Homo Sapiens
NICVSSAKK

SEQ ID NO: 984630 - protein, 9 aa, Homo Sapiens
QRRTKISRD

SEQ ID NO: 984631 - protein, 9 aa, Homo Sapiens
PRPSKVLGL

SEQ ID NO: 984632 - protein, 9 aa, Homo Sapiens
LDLGYNRIQ

SEQ ID NO: 984633 - protein, 9 aa, Homo Sapiens
RIQIVTNSA

SEQ ID NO: 984634 - protein, 9 aa, Homo Sapiens
SSQFLHGQK

SEQ ID NO: 984635 - protein, 9 aa, Homo Sapiens
RLTAEEKKA

SEQ ID NO: 984636 - protein, 9 aa, Homo Sapiens
SAQPLREGA

SEQ ID NO: 984637 - protein, 9 aa, Homo Sapiens
QEKIAKSHG

SEQ ID NO: 984638 - protein, 9 aa, Homo Sapiens
HGGQMSRTR

SEQ ID NO: 984639 - protein, 9 aa, Homo Sapiens
RSLSVSSPS

SEQ ID NO: 984640 - protein, 9 aa, Homo Sapiens
EINMKEPLA

SEQ ID NO: 984641 - protein, 9 aa, Homo Sapiens
EKEKTLITE

SEQ ID NO: 984642 - protein, 9 aa, Homo Sapiens
RAVMPPPMW

SEQ ID NO: 984643 - protein, 9 aa, Homo Sapiens
LPAPAIRKK

SEQ ID NO: 984644 - protein, 9 aa, Homo Sapiens
FFKRRMWPS

SEQ ID NO: 984645 - protein, 9 aa, Homo Sapiens
ALYVIYNIH

SEQ ID NO: 984646 - protein, 9 aa, Homo Sapiens
QARPFRGDS

SEQ ID NO: 984647 - protein, 9 aa, Homo Sapiens
SSVSFEDRL

SEQ ID NO: 984648 - protein, 9 aa, Homo Sapiens
KDAELAEHL

SEQ ID NO: 984649 - protein, 9 aa, Homo Sapiens
SPPVVANEK

SEQ ID NO: 984650 - protein, 9 aa, Homo Sapiens
SLGSMVYLP

SEQ ID NO: 984651 - protein, 9 aa, Homo Sapiens
SAHYQFLWG

SEQ ID NO: 984652 - protein, 9 aa, Homo Sapiens
GYFSGEQAR

SEQ ID NO: 984653 - protein, 9 aa, Homo Sapiens
SFYAPSHPP

SEQ ID NO: 984654 - protein, 9 aa, Homo Sapiens
VEKEKTLIT

SEQ ID NO: 984655 - protein, 9 aa, Homo Sapiens
FTVNLGCKL

SEQ ID NO: 984656 - protein, 9 aa, Homo Sapiens
NPFLNDITQ

SEQ ID NO: 984657 - protein, 9 aa, Homo Sapiens
MEAAITCNA

SEQ ID NO: 984658 - protein, 9 aa, Homo Sapiens
KVSYKGPGL

SEQ ID NO: 984659 - protein, 9 aa, Homo Sapiens
SSYMIVVSI

SEQ ID NO: 984660 - protein, 9 aa, Homo Sapiens
YLFQVEEKL

SEQ ID NO: 984661 - protein, 9 aa, Homo Sapiens
ERGYDLVTE

SEQ ID NO: 984662 - protein, 9 aa, Homo Sapiens
MEGNLKQKD

SEQ ID NO: 984663 - protein, 9 aa, Homo Sapiens
KTSDTSFTP

SEQ ID NO: 984664 - protein, 9 aa, Homo Sapiens
EPQQPYSHL

SEQ ID NO: 984665 - protein, 9 aa, Homo Sapiens
QQRLSSSLV

SEQ ID NO: 984666 - protein, 9 aa, Homo Sapiens
KDEEAVKDT

SEQ ID NO: 984667 - protein, 9 aa, Homo Sapiens
VFVEYPMTL

SEQ ID NO: 984668 - protein, 9 aa, Homo Sapiens
SVSLTKTEF

SEQ ID NO: 984669 - protein, 9 aa, Homo Sapiens
PQGGDIRQD

SEQ ID NO: 984670 - protein, 9 aa, Homo Sapiens
AEESLVNPL

SEQ ID NO: 984671 - protein, 9 aa, Homo Sapiens
YLSNLSRLG

SEQ ID NO: 984672 - protein, 9 aa, Homo Sapiens
LEAGLRLGP

SEQ ID NO: 984673 - protein, 9 aa, Homo Sapiens
EEPEVLQDL

SEQ ID NO: 984674 - protein, 9 aa, Homo Sapiens
VSLWPTPGK

SEQ ID NO: 984675 - protein, 9 aa, Homo Sapiens
VCWTLIHIF

SEQ ID NO: 984676 - protein, 9 aa, Homo Sapiens
AMDSKIRFL

SEQ ID NO: 984677 - protein, 9 aa, Homo Sapiens
EATKKVPTT

SEQ ID NO: 984678 - protein, 9 aa, Homo Sapiens
MKVNLLSGF

SEQ ID NO: 984679 - protein, 9 aa, Homo Sapiens
VDINIKIRS

SEQ ID NO: 984680 - protein, 9 aa, Homo Sapiens
DHLFALRSL

SEQ ID NO: 984681 - protein, 9 aa, Homo Sapiens
FSAQPLREG

SEQ ID NO: 984682 - protein, 9 aa, Homo Sapiens
GGPHIFYPP

SEQ ID NO: 984683 - protein, 9 aa, Homo Sapiens
LCQEQTSSR

SEQ ID NO: 984684 - protein, 9 aa, Homo Sapiens
VVIDLVRLA

SEQ ID NO: 984685 - protein, 9 aa, Homo Sapiens
KQAAFLVGS

SEQ ID NO: 984686 - protein, 9 aa, Homo Sapiens
VAPCSGESQ

SEQ ID NO: 984687 - protein, 9 aa, Homo Sapiens
PKPGFSEPT

SEQ ID NO: 984688 - protein, 9 aa, Homo Sapiens
GGSCPRLCL

SEQ ID NO: 984689 - protein, 9 aa, Homo Sapiens
DVNTKYQCD

SEQ ID NO: 984690 - protein, 9 aa, Homo Sapiens
IDGLNREQG

SEQ ID NO: 984691 - protein, 9 aa, Homo Sapiens
KDAIKKNPE

SEQ ID NO: 984692 - protein, 9 aa, Homo Sapiens
SFLMDFILL

SEQ ID NO: 984693 - protein, 9 aa, Homo Sapiens
PPQASRVLS

SEQ ID NO: 984694 - protein, 9 aa, Homo Sapiens
ANRWIRNKK

SEQ ID NO: 984695 - protein, 9 aa, Homo Sapiens
LGQAVPEGA

SEQ ID NO: 984696 - protein, 9 aa, Homo Sapiens
FYSACCGGF

SEQ ID NO: 984697 - protein, 9 aa, Homo Sapiens
KGLTGERPL

SEQ ID NO: 984698 - protein, 9 aa, Homo Sapiens
SGEQAREVL

SEQ ID NO: 984699 - protein, 9 aa, Homo Sapiens
SCGNILNML

SEQ ID NO: 984700 - protein, 9 aa, Homo Sapiens
WAGLLRILV

SEQ ID NO: 984701 - protein, 9 aa, Homo Sapiens
QEELSPPPL

SEQ ID NO: 984702 - protein, 9 aa, Homo Sapiens
KALKLEALD

SEQ ID NO: 984703 - protein, 9 aa, Homo Sapiens
DSIRHNLFS

SEQ ID NO: 984704 - protein, 9 aa, Homo Sapiens
RDHNAWKQA

SEQ ID NO: 984705 - protein, 9 aa, Homo Sapiens
LYECVAKNS

SEQ ID NO: 984706 - protein, 9 aa, Homo Sapiens
GKYWDTLLH

SEQ ID NO: 984707 - protein, 9 aa, Homo Sapiens
ESKISQKKI

SEQ ID NO: 984708 - protein, 9 aa, Homo Sapiens
WELSIILCK

SEQ ID NO: 984709 - protein, 9 aa, Homo Sapiens
RPVIAKALQ

SEQ ID NO: 984710 - protein, 9 aa, Homo Sapiens
FSYDVKMKK

SEQ ID NO: 984711 - protein, 9 aa, Homo Sapiens
GLFLFMYLV

SEQ ID NO: 984712 - protein, 9 aa, Homo Sapiens
GENFLHTYS

SEQ ID NO: 984713 - protein, 9 aa, Homo Sapiens
ERKNDPTHI

SEQ ID NO: 984714 - protein, 9 aa, Homo Sapiens
KVFKHLQNE

SEQ ID NO: 984715 - protein, 9 aa, Homo Sapiens
MEKQAAFLV

SEQ ID NO: 984716 - protein, 9 aa, Homo Sapiens
GSSQFLHGQ

SEQ ID NO: 984717 - protein, 9 aa, Homo Sapiens
ETLVNSSIG

SEQ ID NO: 984718 - protein, 9 aa, Homo Sapiens
NIFFPIWIS

SEQ ID NO: 984719 - protein, 9 aa, Homo Sapiens
INVTSVGKA

SEQ ID NO: 984720 - protein, 9 aa, Homo Sapiens
RWIRNKKSK

SEQ ID NO: 984721 - protein, 9 aa, Homo Sapiens
AILGAIKEH

SEQ ID NO: 984722 - protein, 9 aa, Homo Sapiens
LVNTKVDFG

SEQ ID NO: 984723 - protein, 9 aa, Homo Sapiens
SYHIFLIGW

SEQ ID NO: 984724 - protein, 9 aa, Homo Sapiens
STEEIFRRA

SEQ ID NO: 984725 - protein, 9 aa, Homo Sapiens
ARVFGCRKG

SEQ ID NO: 984726 - protein, 9 aa, Homo Sapiens
AFGPDSVQG

SEQ ID NO: 984727 - protein, 9 aa, Homo Sapiens
LQGIIFFFF

SEQ ID NO: 984728 - protein, 9 aa, Homo Sapiens
HSEYPFHDE

SEQ ID NO: 984729 - protein, 9 aa, Homo Sapiens
LYLLLDMGL

SEQ ID NO: 984730 - protein, 9 aa, Homo Sapiens
GNIYWLDSN

SEQ ID NO: 984731 - protein, 9 aa, Homo Sapiens
CRVQKLIKK

SEQ ID NO: 984732 - protein, 9 aa, Homo Sapiens
LKWMVAGNA

SEQ ID NO: 984733 - protein, 9 aa, Homo Sapiens
INFTINTNG

SEQ ID NO: 984734 - protein, 9 aa, Homo Sapiens
HLVQEKANA

SEQ ID NO: 984735 - protein, 9 aa, Homo Sapiens
VRKLFTAAE

SEQ ID NO: 984736 - protein, 9 aa, Homo Sapiens
TAAHAITKL

SEQ ID NO: 984737 - protein, 9 aa, Homo Sapiens
VCEKSSARP

SEQ ID NO: 984738 - protein, 9 aa, Homo Sapiens
LAQLITQTQ

SEQ ID NO: 984739 - protein, 9 aa, Homo Sapiens
IYHRFMVDE

SEQ ID NO: 984740 - protein, 9 aa, Homo Sapiens
SDISFGSLC

SEQ ID NO: 984741 - protein, 9 aa, Homo Sapiens
WSSATEKLQ

SEQ ID NO: 984742 - protein, 9 aa, Homo Sapiens
VSGATLPKF

SEQ ID NO: 984743 - protein, 9 aa, Homo Sapiens
PHFCLQLVT

SEQ ID NO: 984744 - protein, 9 aa, Homo Sapiens
TVIVSKMLV

SEQ ID NO: 984745 - protein, 9 aa, Homo Sapiens
GSGKLFRWN

SEQ ID NO: 984746 - protein, 9 aa, Homo Sapiens
VNTKYQCDL

SEQ ID NO: 984747 - protein, 9 aa, Homo Sapiens
VMSLGQCQD

SEQ ID NO: 984748 - protein, 9 aa, Homo Sapiens
FERKNNKKE

SEQ ID NO: 984749 - protein, 9 aa, Homo Sapiens
MGLGTIKIK

SEQ ID NO: 984750 - protein, 9 aa, Homo Sapiens
RCGSETMRA

SEQ ID NO: 984751 - protein, 9 aa, Homo Sapiens
ALDKVCIGA

SEQ ID NO: 984752 - protein, 9 aa, Homo Sapiens
YSRFKALDK

SEQ ID NO: 984753 - protein, 9 aa, Homo Sapiens
SPPRTFATA

SEQ ID NO: 984754 - protein, 9 aa, Homo Sapiens
AITSNDAGT

SEQ ID NO: 984755 - protein, 9 aa, Homo Sapiens
ISVVEKKIL

SEQ ID NO: 984756 - protein, 9 aa, Homo Sapiens
SRQVKKVAA

SEQ ID NO: 984757 - protein, 9 aa, Homo Sapiens
ILLTINRYL

SEQ ID NO: 984758 - protein, 9 aa, Homo Sapiens
SYAHETKLS

SEQ ID NO: 984759 - protein, 9 aa, Homo Sapiens
RASYPKMSL

SEQ ID NO: 984760 - protein, 9 aa, Homo Sapiens
NCPSSHSSI

SEQ ID NO: 984761 - protein, 9 aa, Homo Sapiens
ENEDEEERR

SEQ ID NO: 984762 - protein, 9 aa, Homo Sapiens
NCNNWLSRV

SEQ ID NO: 984763 - protein, 9 aa, Homo Sapiens
RPVTLSLLV

SEQ ID NO: 984764 - protein, 9 aa, Homo Sapiens
RDHINVTSV

SEQ ID NO: 984765 - protein, 9 aa, Homo Sapiens
QLRAKEASD

SEQ ID NO: 984766 - protein, 9 aa, Homo Sapiens
SLKWMVAGN

SEQ ID NO: 984767 - protein, 9 aa, Homo Sapiens
NTHTLGPLI

SEQ ID NO: 984768 - protein, 9 aa, Homo Sapiens
CFLSRDETS

SEQ ID NO: 984769 - protein, 9 aa, Homo Sapiens
PNRGLQFFL

SEQ ID NO: 984770 - protein, 9 aa, Homo Sapiens
CTPLLSMAG

SEQ ID NO: 984771 - protein, 9 aa, Homo Sapiens
KTERIYNVG

SEQ ID NO: 984772 - protein, 9 aa, Homo Sapiens
LLSEQFGRG

SEQ ID NO: 984773 - protein, 9 aa, Homo Sapiens
ERDQSVSVS

SEQ ID NO: 984774 - protein, 9 aa, Homo Sapiens
AAGGLHSFP

SEQ ID NO: 984775 - protein, 9 aa, Homo Sapiens
RNLGSLLKS

SEQ ID NO: 984776 - protein, 9 aa, Homo Sapiens
SRDAQTEWD

SEQ ID NO: 984777 - protein, 9 aa, Homo Sapiens
DLLDGCYST

SEQ ID NO: 984778 - protein, 9 aa, Homo Sapiens
NKMVSQEES

SEQ ID NO: 984779 - protein, 9 aa, Homo Sapiens
KILAVMKLA

SEQ ID NO: 984780 - protein, 9 aa, Homo Sapiens
INHFTCKIL

SEQ ID NO: 984781 - protein, 9 aa, Homo Sapiens
SRFGRPAEL

SEQ ID NO: 984782 - protein, 9 aa, Homo Sapiens
LPMHRQTFS

SEQ ID NO: 984783 - protein, 9 aa, Homo Sapiens
SKIEQLRTG

SEQ ID NO: 984784 - protein, 9 aa, Homo Sapiens
YNENTGEKL

SEQ ID NO: 984785 - protein, 9 aa, Homo Sapiens
KIQVTATDK

SEQ ID NO: 984786 - protein, 9 aa, Homo Sapiens
TPLLSMAGV

SEQ ID NO: 984787 - protein, 9 aa, Homo Sapiens
KKPTVDPIY

SEQ ID NO: 984788 - protein, 9 aa, Homo Sapiens
LKTENKEKF

SEQ ID NO: 984789 - protein, 9 aa, Homo Sapiens
PDYSSIRPP

SEQ ID NO: 984790 - protein, 9 aa, Homo Sapiens
LIVANRGTL

SEQ ID NO: 984791 - protein, 9 aa, Homo Sapiens
ELPESSVAS

SEQ ID NO: 984792 - protein, 9 aa, Homo Sapiens
VEKNLGKLV

SEQ ID NO: 984793 - protein, 9 aa, Homo Sapiens
PGLFVPLVA

SEQ ID NO: 984794 - protein, 9 aa, Homo Sapiens
SYQYQYMNG

SEQ ID NO: 984795 - protein, 9 aa, Homo Sapiens
SGPKPGFSE

SEQ ID NO: 984796 - protein, 9 aa, Homo Sapiens
IVLYFSLLN

SEQ ID NO: 984797 - protein, 9 aa, Homo Sapiens
DDKVNFYFI

SEQ ID NO: 984798 - protein, 9 aa, Homo Sapiens
WIAGNIYWL

SEQ ID NO: 984799 - protein, 9 aa, Homo Sapiens
SWPSSMDTR

SEQ ID NO: 984800 - protein, 9 aa, Homo Sapiens
LDLGKKVER

SEQ ID NO: 984801 - protein, 9 aa, Homo Sapiens
DYYAIESQL

SEQ ID NO: 984802 - protein, 9 aa, Homo Sapiens
SLYLEKEEY

SEQ ID NO: 984803 - protein, 9 aa, Homo Sapiens
DIRQDSSDD

SEQ ID NO: 984804 - protein, 9 aa, Homo Sapiens
GTNQPPSNL

SEQ ID NO: 984805 - protein, 9 aa, Homo Sapiens
AVRTMKIYV

SEQ ID NO: 984806 - protein, 9 aa, Homo Sapiens
FLLLWVLFD

SEQ ID NO: 984807 - protein, 9 aa, Homo Sapiens
HVCHLCHSN

SEQ ID NO: 984808 - protein, 9 aa, Homo Sapiens
ESLPRLTNQ

SEQ ID NO: 984809 - protein, 9 aa, Homo Sapiens
GERFQARVT

SEQ ID NO: 984810 - protein, 9 aa, Homo Sapiens
TNSEEEWNR

SEQ ID NO: 984811 - protein, 9 aa, Homo Sapiens
KLDVTNLLA

SEQ ID NO: 984812 - protein, 9 aa, Homo Sapiens
PNSLRQRLE

SEQ ID NO: 984813 - protein, 9 aa, Homo Sapiens
EPRGASARP

SEQ ID NO: 984814 - protein, 9 aa, Homo Sapiens
PRHSRRNKG

SEQ ID NO: 984815 - protein, 9 aa, Homo Sapiens
SSQFQALQN

SEQ ID NO: 984816 - protein, 9 aa, Homo Sapiens
GTVIQNGNV

SEQ ID NO: 984817 - protein, 9 aa, Homo Sapiens
GRKATFLDA

SEQ ID NO: 984818 - protein, 9 aa, Homo Sapiens
GLAFLRSLS

SEQ ID NO: 984819 - protein, 9 aa, Homo Sapiens
TVRSERKAK

SEQ ID NO: 984820 - protein, 9 aa, Homo Sapiens
TVPSHTVHS

SEQ ID NO: 984821 - protein, 9 aa, Homo Sapiens
FNDGDEVVC

SEQ ID NO: 984822 - protein, 9 aa, Homo Sapiens
NIVFTVNLG

SEQ ID NO: 984823 - protein, 9 aa, Homo Sapiens
RCTCGQRYQ

SEQ ID NO: 984824 - protein, 9 aa, Homo Sapiens
DNAFGPDSV

SEQ ID NO: 984825 - protein, 9 aa, Homo Sapiens
IPHELELMR

SEQ ID NO: 984826 - protein, 9 aa, Homo Sapiens
GYRSLELAE

SEQ ID NO: 984827 - protein, 9 aa, Homo Sapiens
PIPAEPEVL

SEQ ID NO: 984828 - protein, 9 aa, Homo Sapiens
ARQRDINAS

SEQ ID NO: 984829 - protein, 9 aa, Homo Sapiens
EKIIWNYAP

SEQ ID NO: 984830 - protein, 9 aa, Homo Sapiens
SMFYGIVTP

SEQ ID NO: 984831 - protein, 9 aa, Homo Sapiens
SDLEKNDFK

SEQ ID NO: 984832 - protein, 9 aa, Homo Sapiens
FTAAEFLLP

SEQ ID NO: 984833 - protein, 9 aa, Homo Sapiens
LSFFVLGLF

SEQ ID NO: 984834 - protein, 9 aa, Homo Sapiens
SRDTESMDP

SEQ ID NO: 984835 - protein, 9 aa, Homo Sapiens
GNLKQKDGT

SEQ ID NO: 984836 - protein, 9 aa, Homo Sapiens
VEVVQSKIE

SEQ ID NO: 984837 - protein, 9 aa, Homo Sapiens
ESSQAVMLL

SEQ ID NO: 984838 - protein, 9 aa, Homo Sapiens
RALRPEELE

SEQ ID NO: 984839 - protein, 9 aa, Homo Sapiens
VVYSGILEI

SEQ ID NO: 984840 - protein, 9 aa, Homo Sapiens
NDAGTYSCI

SEQ ID NO: 984841 - protein, 9 aa, Homo Sapiens
AFPFPRHPH

SEQ ID NO: 984842 - protein, 9 aa, Homo Sapiens
ILKITPLNE

SEQ ID NO: 984843 - protein, 9 aa, Homo Sapiens
KGLASYEIG

SEQ ID NO: 984844 - protein, 9 aa, Homo Sapiens
RGTAQPTLD

SEQ ID NO: 984845 - protein, 9 aa, Homo Sapiens
KFDKILYNK

SEQ ID NO: 984846 - protein, 9 aa, Homo Sapiens
GDLFLALDV

SEQ ID NO: 984847 - protein, 9 aa, Homo Sapiens
TLFRIVRLV

SEQ ID NO: 984848 - protein, 9 aa, Homo Sapiens
KSLTSNYQK

SEQ ID NO: 984849 - protein, 9 aa, Homo Sapiens
FAIFLLVSL

SEQ ID NO: 984850 - protein, 9 aa, Homo Sapiens
SKIEISELI

SEQ ID NO: 984851 - protein, 9 aa, Homo Sapiens
TCGQRYQLS

SEQ ID NO: 984852 - protein, 9 aa, Homo Sapiens
GASQLFCIW

SEQ ID NO: 984853 - protein, 9 aa, Homo Sapiens
WTPAWEQQE

SEQ ID NO: 984854 - protein, 9 aa, Homo Sapiens
HLLYQQSHL

SEQ ID NO: 984855 - protein, 9 aa, Homo Sapiens
TISRQDRSF

SEQ ID NO: 984856 - protein, 9 aa, Homo Sapiens
GAGPQEINM

SEQ ID NO: 984857 - protein, 9 aa, Homo Sapiens
IFSDGGNTW

SEQ ID NO: 984858 - protein, 9 aa, Homo Sapiens
KRRMWPSAF

SEQ ID NO: 984859 - protein, 9 aa, Homo Sapiens
APGPSGMMR

SEQ ID NO: 984860 - protein, 9 aa, Homo Sapiens
THASTHYFH

SEQ ID NO: 984861 - protein, 9 aa, Homo Sapiens
VAPHSFGLG

SEQ ID NO: 984862 - protein, 9 aa, Homo Sapiens
NCYTDYLEL

SEQ ID NO: 984863 - protein, 9 aa, Homo Sapiens
AITCNAPNV

SEQ ID NO: 984864 - protein, 9 aa, Homo Sapiens
EGSGKLFRW

SEQ ID NO: 984865 - protein, 9 aa, Homo Sapiens
VIFAVQEKQ

SEQ ID NO: 984866 - protein, 9 aa, Homo Sapiens
SGMALMKVN

SEQ ID NO: 984867 - protein, 9 aa, Homo Sapiens
FLEGKSIMT

SEQ ID NO: 984868 - protein, 9 aa, Homo Sapiens
ASGPRGIII

SEQ ID NO: 984869 - protein, 9 aa, Homo Sapiens
SENLILDNC

SEQ ID NO: 984870 - protein, 9 aa, Homo Sapiens
HLLLKSELW

SEQ ID NO: 984871 - protein, 9 aa, Homo Sapiens
INAVISLQK

SEQ ID NO: 984872 - protein, 9 aa, Homo Sapiens
LESQLEARE

SEQ ID NO: 984873 - protein, 9 aa, Homo Sapiens
FIILLTINR

SEQ ID NO: 984874 - protein, 9 aa, Homo Sapiens
LQVRSHLNK

SEQ ID NO: 984875 - protein, 9 aa, Homo Sapiens
LERCLDYNA

SEQ ID NO: 984876 - protein, 9 aa, Homo Sapiens
SCSINSDSE

SEQ ID NO: 984877 - protein, 9 aa, Homo Sapiens
LILVGPIMW

SEQ ID NO: 984878 - protein, 9 aa, Homo Sapiens
LRIKTKGQY

SEQ ID NO: 984879 - protein, 9 aa, Homo Sapiens
AVRDKIDRL

SEQ ID NO: 984880 - protein, 9 aa, Homo Sapiens
ENQFESEAM

SEQ ID NO: 984881 - protein, 9 aa, Homo Sapiens
QPHPLLSAP

SEQ ID NO: 984882 - protein, 9 aa, Homo Sapiens
GPTPSFYAP

SEQ ID NO: 984883 - protein, 9 aa, Homo Sapiens
GTFEAGVTS

SEQ ID NO: 984884 - protein, 9 aa, Homo Sapiens
NFPTFPRLA

SEQ ID NO: 984885 - protein, 9 aa, Homo Sapiens
PLFERKNNK

SEQ ID NO: 984886 - protein, 9 aa, Homo Sapiens
FQYVKENRG

SEQ ID NO: 984887 - protein, 9 aa, Homo Sapiens
LNAFILNSL

SEQ ID NO: 984888 - protein, 9 aa, Homo Sapiens
THQDKLLCT

SEQ ID NO: 984889 - protein, 9 aa, Homo Sapiens
GRKRKRKKP

SEQ ID NO: 984890 - protein, 9 aa, Homo Sapiens
EENYLNSKI

SEQ ID NO: 984891 - protein, 9 aa, Homo Sapiens
ELAVSGATL

SEQ ID NO: 984892 - protein, 9 aa, Homo Sapiens
AKEENIIYF

SEQ ID NO: 984893 - protein, 9 aa, Homo Sapiens
IGRKATFLD

SEQ ID NO: 984894 - protein, 9 aa, Homo Sapiens
IQAQLKELC

SEQ ID NO: 984895 - protein, 9 aa, Homo Sapiens
VFLPPRPSK

SEQ ID NO: 984896 - protein, 9 aa, Homo Sapiens
SHTFLDKKN

SEQ ID NO: 984897 - protein, 9 aa, Homo Sapiens
MKKIVDVVI

SEQ ID NO: 984898 - protein, 9 aa, Homo Sapiens
IVPKFERRN

SEQ ID NO: 984899 - protein, 9 aa, Homo Sapiens
EDGVLFMQV

SEQ ID NO: 984900 - protein, 9 aa, Homo Sapiens
VLVPRHSKY

SEQ ID NO: 984901 - protein, 9 aa, Homo Sapiens
ILDRNTKCF

SEQ ID NO: 984902 - protein, 9 aa, Homo Sapiens
FLSLLPYLG

SEQ ID NO: 984903 - protein, 9 aa, Homo Sapiens
LYLRPCDRK

SEQ ID NO: 984904 - protein, 9 aa, Homo Sapiens
LNIHRIFVR

SEQ ID NO: 984905 - protein, 9 aa, Homo Sapiens
SLQWSNPTQ

SEQ ID NO: 984906 - protein, 9 aa, Homo Sapiens
PHSFGLGGG

SEQ ID NO: 984907 - protein, 9 aa, Homo Sapiens
GLAIQGKLP

SEQ ID NO: 984908 - protein, 9 aa, Homo Sapiens
LSSRNMVLS

SEQ ID NO: 984909 - protein, 9 aa, Homo Sapiens
AVPTAFPAT

SEQ ID NO: 984910 - protein, 9 aa, Homo Sapiens
SHLLLKSEL

SEQ ID NO: 984911 - protein, 9 aa, Homo Sapiens
TSPPRTFAT

SEQ ID NO: 984912 - protein, 9 aa, Homo Sapiens
TMKIYVAQF

SEQ ID NO: 984913 - protein, 9 aa, Homo Sapiens
NIYTEERPH

SEQ ID NO: 984914 - protein, 9 aa, Homo Sapiens
AFSRGVSSS

SEQ ID NO: 984915 - protein, 9 aa, Homo Sapiens
IELVETRPA

SEQ ID NO: 984916 - protein, 9 aa, Homo Sapiens
TVLSYECIL

SEQ ID NO: 984917 - protein, 9 aa, Homo Sapiens
YHQVPCSYS

SEQ ID NO: 984918 - protein, 9 aa, Homo Sapiens
PSFSVQKGS

SEQ ID NO: 984919 - protein, 9 aa, Homo Sapiens
RSGMALMKV

SEQ ID NO: 984920 - protein, 9 aa, Homo Sapiens
VFENGTQTL

SEQ ID NO: 984921 - protein, 9 aa, Homo Sapiens
TSFGIVLPA

SEQ ID NO: 984922 - protein, 9 aa, Homo Sapiens
SELDKRAVQ

SEQ ID NO: 984923 - protein, 9 aa, Homo Sapiens
GPDSVQGFE

SEQ ID NO: 984924 - protein, 9 aa, Homo Sapiens
VPYLHFGNL

SEQ ID NO: 984925 - protein, 9 aa, Homo Sapiens
KIHHNLTKD

SEQ ID NO: 984926 - protein, 9 aa, Homo Sapiens
LSSPPPPTR

SEQ ID NO: 984927 - protein, 9 aa, Homo Sapiens
SPPPLPPGW

SEQ ID NO: 984928 - protein, 9 aa, Homo Sapiens
VIAALLNVF

SEQ ID NO: 984929 - protein, 9 aa, Homo Sapiens
QKNFTPMAP

SEQ ID NO: 984930 - protein, 9 aa, Homo Sapiens
EQPRRPIRA

SEQ ID NO: 984931 - protein, 9 aa, Homo Sapiens
VLDREKERV

SEQ ID NO: 984932 - protein, 9 aa, Homo Sapiens
LQVEMNHFH

SEQ ID NO: 984933 - protein, 9 aa, Homo Sapiens
FRGAARLRA

SEQ ID NO: 984934 - protein, 9 aa, Homo Sapiens
VSMFYGIVT

SEQ ID NO: 984935 - protein, 9 aa, Homo Sapiens
NHRNNVDLT

SEQ ID NO: 984936 - protein, 9 aa, Homo Sapiens
EAQAGAALK

SEQ ID NO: 984937 - protein, 9 aa, Homo Sapiens
LCARCSPHS

SEQ ID NO: 984938 - protein, 9 aa, Homo Sapiens
NLGSLLKSG

SEQ ID NO: 984939 - protein, 9 aa, Homo Sapiens
HPFLSRHEK

SEQ ID NO: 984940 - protein, 9 aa, Homo Sapiens
SPTSSFSSE

SEQ ID NO: 984941 - protein, 9 aa, Homo Sapiens
DRMKNYNIF

SEQ ID NO: 984942 - protein, 9 aa, Homo Sapiens
PSNYLLGSI

SEQ ID NO: 984943 - protein, 9 aa, Homo Sapiens
SINDQLVKK

SEQ ID NO: 984944 - protein, 9 aa, Homo Sapiens
GRARVFGCR

SEQ ID NO: 984945 - protein, 9 aa, Homo Sapiens
YGKDTTTFV

SEQ ID NO: 984946 - protein, 9 aa, Homo Sapiens
VFQGLPGTG

SEQ ID NO: 984947 - protein, 9 aa, Homo Sapiens
SDIYVTVSF

SEQ ID NO: 984948 - protein, 9 aa, Homo Sapiens
LLVSYRVII

SEQ ID NO: 984949 - protein, 9 aa, Homo Sapiens
DYNAKCPLC

SEQ ID NO: 984950 - protein, 9 aa, Homo Sapiens
CFMASFFTE

SEQ ID NO: 984951 - protein, 9 aa, Homo Sapiens
ILSLMETVK

SEQ ID NO: 984952 - protein, 9 aa, Homo Sapiens
FSSLELNIT

SEQ ID NO: 984953 - protein, 9 aa, Homo Sapiens
IFYSLFQAS

SEQ ID NO: 984954 - protein, 9 aa, Homo Sapiens
ARAYKHAKM

SEQ ID NO: 984955 - protein, 9 aa, Homo Sapiens
EIIFERDTV

SEQ ID NO: 984956 - protein, 9 aa, Homo Sapiens
NVFRNTQFL

SEQ ID NO: 984957 - protein, 9 aa, Homo Sapiens
GAALKTRQD

SEQ ID NO: 984958 - protein, 9 aa, Homo Sapiens
SMLENFLGP

SEQ ID NO: 984959 - protein, 9 aa, Homo Sapiens
SFFTEIVVM

SEQ ID NO: 984960 - protein, 9 aa, Homo Sapiens
KEAGALAVS

SEQ ID NO: 984961 - protein, 9 aa, Homo Sapiens
LPGTETASS

SEQ ID NO: 984962 - protein, 9 aa, Homo Sapiens
FLFEVQCMH

SEQ ID NO: 984963 - protein, 9 aa, Homo Sapiens
GQAVPEGAE

SEQ ID NO: 984964 - protein, 9 aa, Homo Sapiens
KEKEVHDLE

SEQ ID NO: 984965 - protein, 9 aa, Homo Sapiens
PLFVPTQQD

SEQ ID NO: 984966 - protein, 9 aa, Homo Sapiens
IPNFLKTYS

SEQ ID NO: 984967 - protein, 9 aa, Homo Sapiens
CGKVFSAST

SEQ ID NO: 984968 - protein, 9 aa, Homo Sapiens
LKTRQDMLP

SEQ ID NO: 984969 - protein, 9 aa, Homo Sapiens
PYLIYDKTD

SEQ ID NO: 984970 - protein, 9 aa, Homo Sapiens
AGAALKTRQ

SEQ ID NO: 984971 - protein, 9 aa, Homo Sapiens
AVQEKQFHW

SEQ ID NO: 984972 - protein, 9 aa, Homo Sapiens
LLPFEPDSS

SEQ ID NO: 984973 - protein, 9 aa, Homo Sapiens
EEATARRER

SEQ ID NO: 984974 - protein, 9 aa, Homo Sapiens
KISQKKIKS

SEQ ID NO: 984975 - protein, 9 aa, Homo Sapiens
TCSSYMIVV

SEQ ID NO: 984976 - protein, 9 aa, Homo Sapiens
LDDKNDNLD

SEQ ID NO: 984977 - protein, 9 aa, Homo Sapiens
LHQSPNINA

SEQ ID NO: 984978 - protein, 9 aa, Homo Sapiens
PLCPANFLY

SEQ ID NO: 984979 - protein, 9 aa, Homo Sapiens
HVIVTVALG

SEQ ID NO: 984980 - protein, 9 aa, Homo Sapiens
FGKLVCNDK

SEQ ID NO: 984981 - protein, 9 aa, Homo Sapiens
NRSRNSSLL

SEQ ID NO: 984982 - protein, 9 aa, Homo Sapiens
VIHTENYRL

SEQ ID NO: 984983 - protein, 9 aa, Homo Sapiens
SKNPVVYGV

SEQ ID NO: 984984 - protein, 9 aa, Homo Sapiens
KSSARPGGE

SEQ ID NO: 984985 - protein, 9 aa, Homo Sapiens
LLDKLGLSQ

SEQ ID NO: 984986 - protein, 9 aa, Homo Sapiens
NYQKISSGK

SEQ ID NO: 984987 - protein, 9 aa, Homo Sapiens
KGLVASYKV

SEQ ID NO: 984988 - protein, 9 aa, Homo Sapiens
LNYKIRGYV

SEQ ID NO: 984989 - protein, 9 aa, Homo Sapiens
DITDKGEVS

SEQ ID NO: 984990 - protein, 9 aa, Homo Sapiens
TAPQLRAKE

SEQ ID NO: 984991 - protein, 9 aa, Homo Sapiens
CTKQLLSEQ

SEQ ID NO: 984992 - protein, 9 aa, Homo Sapiens
TPSFLAVCA

SEQ ID NO: 984993 - protein, 9 aa, Homo Sapiens
YVHKNPPLE

SEQ ID NO: 984994 - protein, 9 aa, Homo Sapiens
GRASYPKMS

SEQ ID NO: 984995 - protein, 9 aa, Homo Sapiens
EPSSAAVSD

SEQ ID NO: 984996 - protein, 9 aa, Homo Sapiens
PTPLSPPPP

SEQ ID NO: 984997 - protein, 9 aa, Homo Sapiens
DLKNLYPLL

SEQ ID NO: 984998 - protein, 9 aa, Homo Sapiens
GAKRPLPVD

SEQ ID NO: 984999 - protein, 9 aa, Homo Sapiens
LSLLPYLGS

SEQ ID NO: 985000 - protein, 9 aa, Homo Sapiens
KKGRKRKRK

SEQ ID NO: 985001 - protein, 9 aa, Homo Sapiens
SYLFDVAFN

SEQ ID NO: 985002 - protein, 9 aa, Homo Sapiens
CAPEMNSVP

SEQ ID NO: 985003 - protein, 9 aa, Homo Sapiens
LLPYLGSWL

SEQ ID NO: 985004 - protein, 9 aa, Homo Sapiens
SSGFRQHGS

SEQ ID NO: 985005 - protein, 9 aa, Homo Sapiens
ISINRYIAV

SEQ ID NO: 985006 - protein, 9 aa, Homo Sapiens
ASHREWNLP

SEQ ID NO: 985007 - protein, 9 aa, Homo Sapiens
VFPSMPFSA

SEQ ID NO: 985008 - protein, 9 aa, Homo Sapiens
ALCQGNGVP

SEQ ID NO: 985009 - protein, 9 aa, Homo Sapiens
HELNDAEER

SEQ ID NO: 985010 - protein, 9 aa, Homo Sapiens
LSPPPPSIP

SEQ ID NO: 985011 - protein, 9 aa, Homo Sapiens
GELHSQLDR

SEQ ID NO: 985012 - protein, 9 aa, Homo Sapiens
SEETPMIGD

SEQ ID NO: 985013 - protein, 9 aa, Homo Sapiens
KDGTSLKVA

SEQ ID NO: 985014 - protein, 9 aa, Homo Sapiens
LLPAPGSLT

SEQ ID NO: 985015 - protein, 9 aa, Homo Sapiens
MGKWKMGPV

SEQ ID NO: 985016 - protein, 9 aa, Homo Sapiens
NNFSPTCHF

SEQ ID NO: 985017 - protein, 9 aa, Homo Sapiens
VLYFSLLNA

SEQ ID NO: 985018 - protein, 9 aa, Homo Sapiens
RLEEATARR

SEQ ID NO: 985019 - protein, 9 aa, Homo Sapiens
MPEDGNLTC

SEQ ID NO: 985020 - protein, 9 aa, Homo Sapiens
HACPLKFES

SEQ ID NO: 985021 - protein, 9 aa, Homo Sapiens
EWEKAGRFD

SEQ ID NO: 985022 - protein, 9 aa, Homo Sapiens
SYILRLEEV

SEQ ID NO: 985023 - protein, 9 aa, Homo Sapiens
AAIVVHIRY

SEQ ID NO: 985024 - protein, 9 aa, Homo Sapiens
KLVCNDKNP

SEQ ID NO: 985025 - protein, 9 aa, Homo Sapiens
NFLGPFPLF

SEQ ID NO: 985026 - protein, 9 aa, Homo Sapiens
TEKFPEVTL

SEQ ID NO: 985027 - protein, 9 aa, Homo Sapiens
HPQTVPQSG

SEQ ID NO: 985028 - protein, 9 aa, Homo Sapiens
VDDCGNQAN

SEQ ID NO: 985029 - protein, 9 aa, Homo Sapiens
DKLLDRMKN

SEQ ID NO: 985030 - protein, 9 aa, Homo Sapiens
ETHARDVLE

SEQ ID NO: 985031 - protein, 9 aa, Homo Sapiens
EEEAYGEDE

SEQ ID NO: 985032 - protein, 9 aa, Homo Sapiens
NNRTCRFKW

SEQ ID NO: 985033 - protein, 9 aa, Homo Sapiens
TCRLERDQS

SEQ ID NO: 985034 - protein, 9 aa, Homo Sapiens
IILLTINRY

SEQ ID NO: 985035 - protein, 9 aa, Homo Sapiens
KIFSSLELN

SEQ ID NO: 985036 - protein, 9 aa, Homo Sapiens
CFLAGEKRG

SEQ ID NO: 985037 - protein, 9 aa, Homo Sapiens
NKIEKKRNL

SEQ ID NO: 985038 - protein, 9 aa, Homo Sapiens
PSAPPNVSK

SEQ ID NO: 985039 - protein, 9 aa, Homo Sapiens
LSRVEGDRQ

SEQ ID NO: 985040 - protein, 9 aa, Homo Sapiens
HLSPLAPGF

SEQ ID NO: 985041 - protein, 9 aa, Homo Sapiens
AYAASGPRG

SEQ ID NO: 985042 - protein, 9 aa, Homo Sapiens
MEFEFKLLA

SEQ ID NO: 985043 - protein, 9 aa, Homo Sapiens
PCTPLLSMA

SEQ ID NO: 985044 - protein, 9 aa, Homo Sapiens
LSHLLLKSE

SEQ ID NO: 985045 - protein, 9 aa, Homo Sapiens
NTQFLIQYQ

SEQ ID NO: 985046 - protein, 9 aa, Homo Sapiens
SSRSRNKKD

SEQ ID NO: 985047 - protein, 9 aa, Homo Sapiens
QGAGEDPGQ

SEQ ID NO: 985048 - protein, 9 aa, Homo Sapiens
DEALYQKVF

SEQ ID NO: 985049 - protein, 9 aa, Homo Sapiens
FISKQKLGM

SEQ ID NO: 985050 - protein, 9 aa, Homo Sapiens
KQKDGTSLK

SEQ ID NO: 985051 - protein, 9 aa, Homo Sapiens
TMRASSTLL

SEQ ID NO: 985052 - protein, 9 aa, Homo Sapiens
PGTLFPLKI

SEQ ID NO: 985053 - protein, 9 aa, Homo Sapiens
FWGSVTYMD

SEQ ID NO: 985054 - protein, 9 aa, Homo Sapiens
TNTHTLGPL

SEQ ID NO: 985055 - protein, 9 aa, Homo Sapiens
SSHSSISRQ

SEQ ID NO: 985056 - protein, 9 aa, Homo Sapiens
ELIREPLED

SEQ ID NO: 985057 - protein, 9 aa, Homo Sapiens
EINRQSVVA

SEQ ID NO: 985058 - protein, 9 aa, Homo Sapiens
NVGKATTNA

SEQ ID NO: 985059 - protein, 9 aa, Homo Sapiens
IIVRGSPGP

SEQ ID NO: 985060 - protein, 9 aa, Homo Sapiens
GPSGEPGVS

SEQ ID NO: 985061 - protein, 9 aa, Homo Sapiens
KKKEDTPRE

SEQ ID NO: 985062 - protein, 9 aa, Homo Sapiens
ASNPFLNDI

SEQ ID NO: 985063 - protein, 9 aa, Homo Sapiens
FDKILYNKF

SEQ ID NO: 985064 - protein, 9 aa, Homo Sapiens
SQAEGKKKV

SEQ ID NO: 985065 - protein, 9 aa, Homo Sapiens
ATDADEENY

SEQ ID NO: 985066 - protein, 9 aa, Homo Sapiens
DNMNDRKLL

SEQ ID NO: 985067 - protein, 9 aa, Homo Sapiens
EKYNECLSA

SEQ ID NO: 985068 - protein, 9 aa, Homo Sapiens
KKPLRKDEN

SEQ ID NO: 985069 - protein, 9 aa, Homo Sapiens
DRLCVRVRP

SEQ ID NO: 985070 - protein, 9 aa, Homo Sapiens
IEEAEVIMK

SEQ ID NO: 985071 - protein, 9 aa, Homo Sapiens
AWNRELLNK

SEQ ID NO: 985072 - protein, 9 aa, Homo Sapiens
SKKKVKGSP

SEQ ID NO: 985073 - protein, 9 aa, Homo Sapiens
MGTRRAVMP

SEQ ID NO: 985074 - protein, 9 aa, Homo Sapiens
CWNEHSKAR

SEQ ID NO: 985075 - protein, 9 aa, Homo Sapiens
ATEKLQGKQ

SEQ ID NO: 985076 - protein, 9 aa, Homo Sapiens
KTHKDSDAV

SEQ ID NO: 985077 - protein, 9 aa, Homo Sapiens
PPQTAAQDL

SEQ ID NO: 985078 - protein, 9 aa, Homo Sapiens
PFRGIDDLA

SEQ ID NO: 985079 - protein, 9 aa, Homo Sapiens
TNRSRNSSL

SEQ ID NO: 985080 - protein, 9 aa, Homo Sapiens
NNKVRNALM

SEQ ID NO: 985081 - protein, 9 aa, Homo Sapiens
SYKVGQDLT

SEQ ID NO: 985082 - protein, 9 aa, Homo Sapiens
FGATTQIAS

SEQ ID NO: 985083 - protein, 9 aa, Homo Sapiens
PDFVVVDDV

SEQ ID NO: 985084 - protein, 9 aa, Homo Sapiens
IFLIGWDEN

SEQ ID NO: 985085 - protein, 9 aa, Homo Sapiens
NEKGKKAST

SEQ ID NO: 985086 - protein, 9 aa, Homo Sapiens
NFSPTCHFN

SEQ ID NO: 985087 - protein, 9 aa, Homo Sapiens
SHSSISRQL

SEQ ID NO: 985088 - protein, 9 aa, Homo Sapiens
YGSYSSQYP

SEQ ID NO: 985089 - protein, 9 aa, Homo Sapiens
FTHASTHYF

SEQ ID NO: 985090 - protein, 9 aa, Homo Sapiens
PEKNRTTSE

SEQ ID NO: 985091 - protein, 9 aa, Homo Sapiens
EEEMGNYNE

SEQ ID NO: 985092 - protein, 9 aa, Homo Sapiens
IYFFLGLAP

SEQ ID NO: 985093 - protein, 9 aa, Homo Sapiens
PPFSPIPFF

SEQ ID NO: 985094 - protein, 9 aa, Homo Sapiens
SNCTYGCTG

SEQ ID NO: 985095 - protein, 9 aa, Homo Sapiens
CVCMQPHKD

SEQ ID NO: 985096 - protein, 9 aa, Homo Sapiens
VVNKMCPNI

SEQ ID NO: 985097 - protein, 9 aa, Homo Sapiens
NLMFEHPLS

SEQ ID NO: 985098 - protein, 9 aa, Homo Sapiens
GLALVIKNT

SEQ ID NO: 985099 - protein, 9 aa, Homo Sapiens
NKFKWNLTT

SEQ ID NO: 985100 - protein, 9 aa, Homo Sapiens
LKCNISDLS

SEQ ID NO: 985101 - protein, 9 aa, Homo Sapiens
LLVAVRTNN

SEQ ID NO: 985102 - protein, 9 aa, Homo Sapiens
EESANKFEM

SEQ ID NO: 985103 - protein, 9 aa, Homo Sapiens
VLKLPYQEN

SEQ ID NO: 985104 - protein, 9 aa, Homo Sapiens
RKARQQWRF

SEQ ID NO: 985105 - protein, 9 aa, Homo Sapiens
SSISRQLSP

SEQ ID NO: 985106 - protein, 9 aa, Homo Sapiens
FLLISCCLT

SEQ ID NO: 985107 - protein, 9 aa, Homo Sapiens
VNKAGYRKN

SEQ ID NO: 985108 - protein, 9 aa, Homo Sapiens
AELIREPLE

SEQ ID NO: 985109 - protein, 9 aa, Homo Sapiens
KFQKFIKAP

SEQ ID NO: 985110 - protein, 9 aa, Homo Sapiens
VREIRQTRN

SEQ ID NO: 985111 - protein, 9 aa, Homo Sapiens
IEIYTYGQA

SEQ ID NO: 985112 - protein, 9 aa, Homo Sapiens
TRVHKDAEL

SEQ ID NO: 985113 - protein, 9 aa, Homo Sapiens
ILDNCGNCV

SEQ ID NO: 985114 - protein, 9 aa, Homo Sapiens
YKQKIFELC

SEQ ID NO: 985115 - protein, 9 aa, Homo Sapiens
SSPDLGRHY

SEQ ID NO: 985116 - protein, 9 aa, Homo Sapiens
RIYNVGMQL

SEQ ID NO: 985117 - protein, 9 aa, Homo Sapiens
LFQVEEKLG

SEQ ID NO: 985118 - protein, 9 aa, Homo Sapiens
KTVPSATSA

SEQ ID NO: 985119 - protein, 9 aa, Homo Sapiens
MDTRPAPPT

SEQ ID NO: 985120 - protein, 9 aa, Homo Sapiens
VDRLCVRVR

SEQ ID NO: 985121 - protein, 9 aa, Homo Sapiens
WARNQTEKF

SEQ ID NO: 985122 - protein, 9 aa, Homo Sapiens
VLVSITGRK

SEQ ID NO: 985123 - protein, 9 aa, Homo Sapiens
QVQGPPKPW

SEQ ID NO: 985124 - protein, 9 aa, Homo Sapiens
LVNPLKPLC

SEQ ID NO: 985125 - protein, 9 aa, Homo Sapiens
TFTSSEKFL

SEQ ID NO: 985126 - protein, 9 aa, Homo Sapiens
DTLLHAAAQ

SEQ ID NO: 985127 - protein, 9 aa, Homo Sapiens
KMKLAQKKE

SEQ ID NO: 985128 - protein, 9 aa, Homo Sapiens
VQTTLKQPT

SEQ ID NO: 985129 - protein, 9 aa, Homo Sapiens
MFLENFSFL

SEQ ID NO: 985130 - protein, 9 aa, Homo Sapiens
LSNLSRLGL

SEQ ID NO: 985131 - protein, 9 aa, Homo Sapiens
DENPLPDFD

SEQ ID NO: 985132 - protein, 9 aa, Homo Sapiens
EESLVNPLK

SEQ ID NO: 985133 - protein, 9 aa, Homo Sapiens
TEVSIFARQ

SEQ ID NO: 985134 - protein, 9 aa, Homo Sapiens
DGEDQTQDI

SEQ ID NO: 985135 - protein, 9 aa, Homo Sapiens
RKDLFSSKS

SEQ ID NO: 985136 - protein, 9 aa, Homo Sapiens
PSCSGSSIT

SEQ ID NO: 985137 - protein, 9 aa, Homo Sapiens
QSEPLKITL

SEQ ID NO: 985138 - protein, 9 aa, Homo Sapiens
TLKAGSVFE

SEQ ID NO: 985139 - protein, 9 aa, Homo Sapiens
RDEYNEVAM

SEQ ID NO: 985140 - protein, 9 aa, Homo Sapiens
GGLHSFPRQ

SEQ ID NO: 985141 - protein, 9 aa, Homo Sapiens
ASAESADLG

SEQ ID NO: 985142 - protein, 9 aa, Homo Sapiens
TIQALQDKL

SEQ ID NO: 985143 - protein, 9 aa, Homo Sapiens
PASISCAFF

SEQ ID NO: 985144 - protein, 9 aa, Homo Sapiens
EVLPAEVEE

SEQ ID NO: 985145 - protein, 9 aa, Homo Sapiens
LRFEKAVLS

SEQ ID NO: 985146 - protein, 9 aa, Homo Sapiens
TFNRGFKAE

SEQ ID NO: 985147 - protein, 9 aa, Homo Sapiens
EVKSKKQEL

SEQ ID NO: 985148 - protein, 9 aa, Homo Sapiens
KEDASKREW

SEQ ID NO: 985149 - protein, 9 aa, Homo Sapiens
SSPELLDSV

SEQ ID NO: 985150 - protein, 9 aa, Homo Sapiens
PTRESENED

SEQ ID NO: 985151 - protein, 9 aa, Homo Sapiens
NDALVYAQF

SEQ ID NO: 985152 - protein, 9 aa, Homo Sapiens
LSRQVKKVA

SEQ ID NO: 985153 - protein, 9 aa, Homo Sapiens
LLHAAAQQS

SEQ ID NO: 985154 - protein, 9 aa, Homo Sapiens
NLCGKVFTL

SEQ ID NO: 985155 - protein, 9 aa, Homo Sapiens
AFSTCSSYM

SEQ ID NO: 985156 - protein, 9 aa, Homo Sapiens
GKRKAAHVT

SEQ ID NO: 985157 - protein, 9 aa, Homo Sapiens
LITQTQARC

SEQ ID NO: 985158 - protein, 9 aa, Homo Sapiens
LDYNAKCPL

SEQ ID NO: 985159 - protein, 9 aa, Homo Sapiens
LDALAGFCY

SEQ ID NO: 985160 - protein, 9 aa, Homo Sapiens
KTTPHTQKA

SEQ ID NO: 985161 - protein, 9 aa, Homo Sapiens
KRVGNSEET

SEQ ID NO: 985162 - protein, 9 aa, Homo Sapiens
GNILNMLCF

SEQ ID NO: 985163 - protein, 9 aa, Homo Sapiens
LTSNYQKIS

SEQ ID NO: 985164 - protein, 9 aa, Homo Sapiens
FFLRRLITS

SEQ ID NO: 985165 - protein, 9 aa, Homo Sapiens
PGPSGMMRR

SEQ ID NO: 985166 - protein, 9 aa, Homo Sapiens
IKKNPEFDL

SEQ ID NO: 985167 - protein, 9 aa, Homo Sapiens
STESEPPLS

SEQ ID NO: 985168 - protein, 9 aa, Homo Sapiens
TLLDKLGLS

SEQ ID NO: 985169 - protein, 9 aa, Homo Sapiens
INKKITIPI

SEQ ID NO: 985170 - protein, 9 aa, Homo Sapiens
KRKRKKPNK

SEQ ID NO: 985171 - protein, 9 aa, Homo Sapiens
PPGLAIQGK

SEQ ID NO: 985172 - protein, 9 aa, Homo Sapiens
ELPCENQII

SEQ ID NO: 985173 - protein, 9 aa, Homo Sapiens
DDSLYLEKE

SEQ ID NO: 985174 - protein, 9 aa, Homo Sapiens
HVQSGPEKI

SEQ ID NO: 985175 - protein, 9 aa, Homo Sapiens
NNAGIFLPT

SEQ ID NO: 985176 - protein, 9 aa, Homo Sapiens
RVLIVSLLT

SEQ ID NO: 985177 - protein, 9 aa, Homo Sapiens
MNGDKFQKF

SEQ ID NO: 985178 - protein, 9 aa, Homo Sapiens
IGLLIVANR

SEQ ID NO: 985179 - protein, 9 aa, Homo Sapiens
ENDEQNSDN

SEQ ID NO: 985180 - protein, 9 aa, Homo Sapiens
GDEGPLGDP

SEQ ID NO: 985181 - protein, 9 aa, Homo Sapiens
HLCFISINR

SEQ ID NO: 985182 - protein, 9 aa, Homo Sapiens
WNAEPKEQP

SEQ ID NO: 985183 - protein, 9 aa, Homo Sapiens
LPPFPTPLS

SEQ ID NO: 985184 - protein, 9 aa, Homo Sapiens
THTFLDHCT

SEQ ID NO: 985185 - protein, 9 aa, Homo Sapiens
ERKAKGAKG

SEQ ID NO: 985186 - protein, 9 aa, Homo Sapiens
GRSPGLCRA

SEQ ID NO: 985187 - protein, 9 aa, Homo Sapiens
LPREQPRRP

SEQ ID NO: 985188 - protein, 9 aa, Homo Sapiens
TSLELSPML

SEQ ID NO: 985189 - protein, 9 aa, Homo Sapiens
ITSSSCALV

SEQ ID NO: 985190 - protein, 9 aa, Homo Sapiens
STVPKMLVH

SEQ ID NO: 985191 - protein, 9 aa, Homo Sapiens
SHTVHSVRG

SEQ ID NO: 985192 - protein, 9 aa, Homo Sapiens
IGVFIFSDG

SEQ ID NO: 985193 - protein, 9 aa, Homo Sapiens
EVISPTKFE

SEQ ID NO: 985194 - protein, 9 aa, Homo Sapiens
MFVIYEQLK

SEQ ID NO: 985195 - protein, 9 aa, Homo Sapiens
PAMSEGIFA

SEQ ID NO: 985196 - protein, 9 aa, Homo Sapiens
DVLKFYDFK

SEQ ID NO: 985197 - protein, 9 aa, Homo Sapiens
IFNSLSLPR

SEQ ID NO: 985198 - protein, 9 aa, Homo Sapiens
RAVHRLYTL

SEQ ID NO: 985199 - protein, 9 aa, Homo Sapiens
DRHAMALSE

SEQ ID NO: 985200 - protein, 9 aa, Homo Sapiens
VSPWLAAMT

SEQ ID NO: 985201 - protein, 9 aa, Homo Sapiens
AKDAIKKNP

SEQ ID NO: 985202 - protein, 9 aa, Homo Sapiens
MKGFDVLNA

SEQ ID NO: 985203 - protein, 9 aa, Homo Sapiens
SEYFLRLTP

SEQ ID NO: 985204 - protein, 9 aa, Homo Sapiens
PSEDDRNQS

SEQ ID NO: 985205 - protein, 9 aa, Homo Sapiens
ANDNVAEIV

SEQ ID NO: 985206 - protein, 9 aa, Homo Sapiens
NIILRAPDF

SEQ ID NO: 985207 - protein, 9 aa, Homo Sapiens
EQAREVLES

SEQ ID NO: 985208 - protein, 9 aa, Homo Sapiens
GLCHGHVPI

SEQ ID NO: 985209 - protein, 9 aa, Homo Sapiens
CVPPRFSIP

SEQ ID NO: 985210 - protein, 9 aa, Homo Sapiens
PYVHKNPPL

SEQ ID NO: 985211 - protein, 9 aa, Homo Sapiens
AVDRLCVRV

SEQ ID NO: 985212 - protein, 9 aa, Homo Sapiens
GVIPNFLKT

SEQ ID NO: 985213 - protein, 9 aa, Homo Sapiens
VSYRVIIFS

SEQ ID NO: 985214 - protein, 9 aa, Homo Sapiens
NDQLVKKGL

SEQ ID NO: 985215 - protein, 9 aa, Homo Sapiens
RSQNSRMTF

SEQ ID NO: 985216 - protein, 9 aa, Homo Sapiens
RSLELAEYS

SEQ ID NO: 985217 - protein, 9 aa, Homo Sapiens
TAFPATDST

SEQ ID NO: 985218 - protein, 9 aa, Homo Sapiens
SKNSYFFQN

SEQ ID NO: 985219 - protein, 9 aa, Homo Sapiens
MRMMMNFNG

SEQ ID NO: 985220 - protein, 9 aa, Homo Sapiens
SFGLGGGGV

SEQ ID NO: 985221 - protein, 9 aa, Homo Sapiens
RVQKLIKKM

SEQ ID NO: 985222 - protein, 9 aa, Homo Sapiens
DHVIVTVAL

SEQ ID NO: 985223 - protein, 9 aa, Homo Sapiens
ELPAELIRE

SEQ ID NO: 985224 - protein, 9 aa, Homo Sapiens
LELGAESPS

SEQ ID NO: 985225 - protein, 9 aa, Homo Sapiens
EWNLPIYVI

SEQ ID NO: 985226 - protein, 9 aa, Homo Sapiens
KVVNKMCPN

SEQ ID NO: 985227 - protein, 9 aa, Homo Sapiens
APPEFLFEV

SEQ ID NO: 985228 - protein, 9 aa, Homo Sapiens
ILYNKFNHY

SEQ ID NO: 985229 - protein, 9 aa, Homo Sapiens
IDSFGPLYT

SEQ ID NO: 985230 - protein, 9 aa, Homo Sapiens
RVVGFALQV

SEQ ID NO: 985231 - protein, 9 aa, Homo Sapiens
KALLKKYEN

SEQ ID NO: 985232 - protein, 9 aa, Homo Sapiens
CQTSKQAKI

SEQ ID NO: 985233 - protein, 9 aa, Homo Sapiens
PIKLVFSQD

SEQ ID NO: 985234 - protein, 9 aa, Homo Sapiens
DDKNGPKPN

SEQ ID NO: 985235 - protein, 9 aa, Homo Sapiens
LYLEKEEYL

SEQ ID NO: 985236 - protein, 9 aa, Homo Sapiens
SQEIMKKYN

SEQ ID NO: 985237 - protein, 9 aa, Homo Sapiens
FTCKILAVM

SEQ ID NO: 985238 - protein, 9 aa, Homo Sapiens
QALNYKIRG

SEQ ID NO: 985239 - protein, 9 aa, Homo Sapiens
IFFPSEGSS

SEQ ID NO: 985240 - protein, 9 aa, Homo Sapiens
EKITLRSRA

SEQ ID NO: 985241 - protein, 9 aa, Homo Sapiens
IREPLEDLD

SEQ ID NO: 985242 - protein, 9 aa, Homo Sapiens
VIVPKFERR

SEQ ID NO: 985243 - protein, 9 aa, Homo Sapiens
TTMVSTTSS

SEQ ID NO: 985244 - protein, 9 aa, Homo Sapiens
QEKQFHWYK

SEQ ID NO: 985245 - protein, 9 aa, Homo Sapiens
QAGAALKTR

SEQ ID NO: 985246 - protein, 9 aa, Homo Sapiens
HYQQRLAVI

SEQ ID NO: 985247 - protein, 9 aa, Homo Sapiens
PHNNITAED

SEQ ID NO: 985248 - protein, 9 aa, Homo Sapiens
DRIENDRLQ

SEQ ID NO: 985249 - protein, 9 aa, Homo Sapiens
VIDLVRLAI

SEQ ID NO: 985250 - protein, 9 aa, Homo Sapiens
EASPPSIAP

SEQ ID NO: 985251 - protein, 9 aa, Homo Sapiens
NYKSSSEIQ

SEQ ID NO: 985252 - protein, 9 aa, Homo Sapiens
RYRYVYHSL

SEQ ID NO: 985253 - protein, 9 aa, Homo Sapiens
SEYPFHDEY

SEQ ID NO: 985254 - protein, 9 aa, Homo Sapiens
LYRQQSRKY

SEQ ID NO: 985255 - protein, 9 aa, Homo Sapiens
PSWFCSILP

SEQ ID NO: 985256 - protein, 9 aa, Homo Sapiens
PHKFPCGEP

SEQ ID NO: 985257 - protein, 9 aa, Homo Sapiens
KTENKEKFV

SEQ ID NO: 985258 - protein, 9 aa, Homo Sapiens
TFTVGSGLP

SEQ ID NO: 985259 - protein, 9 aa, Homo Sapiens
ICYKAIKKK

SEQ ID NO: 985260 - protein, 9 aa, Homo Sapiens
HGAIKVKTG

SEQ ID NO: 985261 - protein, 9 aa, Homo Sapiens
LDNFDSSYD

SEQ ID NO: 985262 - protein, 9 aa, Homo Sapiens
PETSGERFQ

SEQ ID NO: 985263 - protein, 9 aa, Homo Sapiens
HFLLFDKKP

SEQ ID NO: 985264 - protein, 9 aa, Homo Sapiens
ENGTQTLTR

SEQ ID NO: 985265 - protein, 9 aa, Homo Sapiens
SSPVLCLSC

SEQ ID NO: 985266 - protein, 9 aa, Homo Sapiens
YGIVTPMLN

SEQ ID NO: 985267 - protein, 9 aa, Homo Sapiens
SDYYAIESQ

SEQ ID NO: 985268 - protein, 9 aa, Homo Sapiens
NVAEIVSFQ

SEQ ID NO: 985269 - protein, 9 aa, Homo Sapiens
MKLAQKKER

SEQ ID NO: 985270 - protein, 9 aa, Homo Sapiens
KRKGEEGTD

SEQ ID NO: 985271 - protein, 9 aa, Homo Sapiens
MPGLFVPLV

SEQ ID NO: 985272 - protein, 9 aa, Homo Sapiens
DLDSSGLTF

SEQ ID NO: 985273 - protein, 9 aa, Homo Sapiens
HNAWKQAEL

SEQ ID NO: 985274 - protein, 9 aa, Homo Sapiens
VQSGPEKIN

SEQ ID NO: 985275 - protein, 9 aa, Homo Sapiens
PVYSPKVPS

SEQ ID NO: 985276 - protein, 9 aa, Homo Sapiens
VDGEDEEAK

SEQ ID NO: 985277 - protein, 9 aa, Homo Sapiens
SGTDEGEDE

SEQ ID NO: 985278 - protein, 9 aa, Homo Sapiens
GKSKVGAWR

SEQ ID NO: 985279 - protein, 9 aa, Homo Sapiens
HEPGLQGSC

SEQ ID NO: 985280 - protein, 9 aa, Homo Sapiens
HETKLSYTC

SEQ ID NO: 985281 - protein, 9 aa, Homo Sapiens
KKIGRKALK

SEQ ID NO: 985282 - protein, 9 aa, Homo Sapiens
TVIQNGNVI

SEQ ID NO: 985283 - protein, 9 aa, Homo Sapiens
QPPYFPPLY

SEQ ID NO: 985284 - protein, 9 aa, Homo Sapiens
KSKKQELEV

SEQ ID NO: 985285 - protein, 9 aa, Homo Sapiens
GRENFFRLG

SEQ ID NO: 985286 - protein, 9 aa, Homo Sapiens
KCPHNNITA

SEQ ID NO: 985287 - protein, 9 aa, Homo Sapiens
TGWAAASFC

SEQ ID NO: 985288 - protein, 9 aa, Homo Sapiens
QAFPTPKSG

SEQ ID NO: 985289 - protein, 9 aa, Homo Sapiens
LDRSEVLLL

SEQ ID NO: 985290 - protein, 9 aa, Homo Sapiens
DVARQRDIN

SEQ ID NO: 985291 - protein, 9 aa, Homo Sapiens
HQDEIFWAE

SEQ ID NO: 985292 - protein, 9 aa, Homo Sapiens
KTYKPVEAA

SEQ ID NO: 985293 - protein, 9 aa, Homo Sapiens
AVLVSITDE

SEQ ID NO: 985294 - protein, 9 aa, Homo Sapiens
FCKHAHSKV

SEQ ID NO: 985295 - protein, 9 aa, Homo Sapiens
HFWGSVTYM

SEQ ID NO: 985296 - protein, 9 aa, Homo Sapiens
GNQANEDNC

SEQ ID NO: 985297 - protein, 9 aa, Homo Sapiens
ELNDAEERA

SEQ ID NO: 985298 - protein, 9 aa, Homo Sapiens
SVCSTAILG

SEQ ID NO: 985299 - protein, 9 aa, Homo Sapiens
RKLDVTNLL

SEQ ID NO: 985300 - protein, 9 aa, Homo Sapiens
QMSRTRFII

SEQ ID NO: 985301 - protein, 9 aa, Homo Sapiens
GFRQHGSGT

SEQ ID NO: 985302 - protein, 9 aa, Homo Sapiens
QCPDSVTYP

SEQ ID NO: 985303 - protein, 9 aa, Homo Sapiens
EIFCMNDDA

SEQ ID NO: 985304 - protein, 9 aa, Homo Sapiens
KMEQLEKEK

SEQ ID NO: 985305 - protein, 9 aa, Homo Sapiens
YKESCFVYS

SEQ ID NO: 985306 - protein, 9 aa, Homo Sapiens
IRILKPPFS

SEQ ID NO: 985307 - protein, 9 aa, Homo Sapiens
HEFKEDRSS

SEQ ID NO: 985308 - protein, 9 aa, Homo Sapiens
KNDYSPERI

SEQ ID NO: 985309 - protein, 9 aa, Homo Sapiens
PPKPWWHKN

SEQ ID NO: 985310 - protein, 9 aa, Homo Sapiens
REWNLPIYV

SEQ ID NO: 985311 - protein, 9 aa, Homo Sapiens
FGNVDCDFC

SEQ ID NO: 985312 - protein, 9 aa, Homo Sapiens
RGERGPQGI

SEQ ID NO: 985313 - protein, 9 aa, Homo Sapiens
TQTQARCRG

SEQ ID NO: 985314 - protein, 9 aa, Homo Sapiens
GNNIFFSSL

SEQ ID NO: 985315 - protein, 9 aa, Homo Sapiens
KILYNKFNH

SEQ ID NO: 985316 - protein, 9 aa, Homo Sapiens
LFRIVRLVR

SEQ ID NO: 985317 - protein, 9 aa, Homo Sapiens
GTPGSPGPK

SEQ ID NO: 985318 - protein, 9 aa, Homo Sapiens
CRQDNPASA

SEQ ID NO: 985319 - protein, 9 aa, Homo Sapiens
LFAYCMMIR

SEQ ID NO: 985320 - protein, 9 aa, Homo Sapiens
RSENRCEGN

SEQ ID NO: 985321 - protein, 9 aa, Homo Sapiens
SKQKLGMAM

SEQ ID NO: 985322 - protein, 9 aa, Homo Sapiens
KIGGPAPSL

SEQ ID NO: 985323 - protein, 9 aa, Homo Sapiens
HYYIAAEKI

SEQ ID NO: 985324 - protein, 9 aa, Homo Sapiens
DYLDALAGF

SEQ ID NO: 985325 - protein, 9 aa, Homo Sapiens
DYNLVQKVC

SEQ ID NO: 985326 - protein, 9 aa, Homo Sapiens
PRHPREMLK

SEQ ID NO: 985327 - protein, 9 aa, Homo Sapiens
DSFPAQFGG

SEQ ID NO: 985328 - protein, 9 aa, Homo Sapiens
DHNAWKQAE

SEQ ID NO: 985329 - protein, 9 aa, Homo Sapiens
CSINSDSEA

SEQ ID NO: 985330 - protein, 9 aa, Homo Sapiens
HLVNTKVDF

SEQ ID NO: 985331 - protein, 9 aa, Homo Sapiens
DFAFSPSPG

SEQ ID NO: 985332 - protein, 9 aa, Homo Sapiens
IKSQAADFL

SEQ ID NO: 985333 - protein, 9 aa, Homo Sapiens
SITSSSCAL

SEQ ID NO: 985334 - protein, 9 aa, Homo Sapiens
VLYKLGERL

SEQ ID NO: 985335 - protein, 9 aa, Homo Sapiens
RLSYDCEPN

SEQ ID NO: 985336 - protein, 9 aa, Homo Sapiens
ASFRVHILF

SEQ ID NO: 985337 - protein, 9 aa, Homo Sapiens
ANLYLGLQN

SEQ ID NO: 985338 - protein, 9 aa, Homo Sapiens
HIAGAYLSN

SEQ ID NO: 985339 - protein, 9 aa, Homo Sapiens
EIVQKQTFT

SEQ ID NO: 985340 - protein, 9 aa, Homo Sapiens
CEGNFLKRG

SEQ ID NO: 985341 - protein, 9 aa, Homo Sapiens
KEKTLITEK

SEQ ID NO: 985342 - protein, 9 aa, Homo Sapiens
AQVYFEEAL

SEQ ID NO: 985343 - protein, 9 aa, Homo Sapiens
EEGSQIYND

SEQ ID NO: 985344 - protein, 9 aa, Homo Sapiens
RQQSRKYPD

SEQ ID NO: 985345 - protein, 9 aa, Homo Sapiens
VHRFENSLH

SEQ ID NO: 985346 - protein, 9 aa, Homo Sapiens
IAGAYLSNL

SEQ ID NO: 985347 - protein, 9 aa, Homo Sapiens
LDLRYTTVT

SEQ ID NO: 985348 - protein, 9 aa, Homo Sapiens
PTSSLNSLS

SEQ ID NO: 985349 - protein, 9 aa, Homo Sapiens
LNALDLMEN

SEQ ID NO: 985350 - protein, 9 aa, Homo Sapiens
SENFIYTYI

SEQ ID NO: 985351 - protein, 9 aa, Homo Sapiens
LKMEQLEKE

SEQ ID NO: 985352 - protein, 9 aa, Homo Sapiens
ILFNDALVY

SEQ ID NO: 985353 - protein, 9 aa, Homo Sapiens
PTAVLVSIT

SEQ ID NO: 985354 - protein, 9 aa, Homo Sapiens
FQRRNPGVA

SEQ ID NO: 985355 - protein, 9 aa, Homo Sapiens
KGEEGTDPE

SEQ ID NO: 985356 - protein, 9 aa, Homo Sapiens
KGPGLGIKF

SEQ ID NO: 985357 - protein, 9 aa, Homo Sapiens
DFKETVNNQ

SEQ ID NO: 985358 - protein, 9 aa, Homo Sapiens
FVHPFLSRH

SEQ ID NO: 985359 - protein, 9 aa, Homo Sapiens
KKLLDAFDA

SEQ ID NO: 985360 - protein, 9 aa, Homo Sapiens
YRINKSAWL

SEQ ID NO: 985361 - protein, 9 aa, Homo Sapiens
TLMGKWKMG

SEQ ID NO: 985362 - protein, 9 aa, Homo Sapiens
DCYQGDGQS

SEQ ID NO: 985363 - protein, 9 aa, Homo Sapiens
IPIKRAGTT

SEQ ID NO: 985364 - protein, 9 aa, Homo Sapiens
NMVLSYELW

SEQ ID NO: 985365 - protein, 9 aa, Homo Sapiens
ALSERRQKE

SEQ ID NO: 985366 - protein, 9 aa, Homo Sapiens
YYNITDVEF

SEQ ID NO: 985367 - protein, 9 aa, Homo Sapiens
QALGGDDFL

SEQ ID NO: 985368 - protein, 9 aa, Homo Sapiens
KSCQLSDIS

SEQ ID NO: 985369 - protein, 9 aa, Homo Sapiens
VHVNTSQRE

SEQ ID NO: 985370 - protein, 9 aa, Homo Sapiens
NSRFGRPAE

SEQ ID NO: 985371 - protein, 9 aa, Homo Sapiens
PGLCRALEG

SEQ ID NO: 985372 - protein, 9 aa, Homo Sapiens
DKNDNLDPE

SEQ ID NO: 985373 - protein, 9 aa, Homo Sapiens
PIEPPPSPL

SEQ ID NO: 985374 - protein, 9 aa, Homo Sapiens
YSRDAQTEW

SEQ ID NO: 985375 - protein, 9 aa, Homo Sapiens
FQALQNSLQ

SEQ ID NO: 985376 - protein, 9 aa, Homo Sapiens
EFYSSQFQA

SEQ ID NO: 985377 - protein, 9 aa, Homo Sapiens
GEEGTDPEL

SEQ ID NO: 985378 - protein, 9 aa, Homo Sapiens
TAEEKKAPS

SEQ ID NO: 985379 - protein, 9 aa, Homo Sapiens
RSEVLLLTD

SEQ ID NO: 985380 - protein, 9 aa, Homo Sapiens
PSSAAVSDG

SEQ ID NO: 985381 - protein, 9 aa, Homo Sapiens
EDTPTSSLN

SEQ ID NO: 985382 - protein, 9 aa, Homo Sapiens
SLRQRLEEY

SEQ ID NO: 985383 - protein, 9 aa, Homo Sapiens
WLLEIGFSS

SEQ ID NO: 985384 - protein, 9 aa, Homo Sapiens
NLILDNCGN

SEQ ID NO: 985385 - protein, 9 aa, Homo Sapiens
ALLREEKKE

SEQ ID NO: 985386 - protein, 9 aa, Homo Sapiens
QGKERRPDY

SEQ ID NO: 985387 - protein, 9 aa, Homo Sapiens
VFSYGRASY

SEQ ID NO: 985388 - protein, 9 aa, Homo Sapiens
LGDPGLPGK

SEQ ID NO: 985389 - protein, 9 aa, Homo Sapiens
AGPQEINMK

SEQ ID NO: 985390 - protein, 9 aa, Homo Sapiens
NVTWLRNEK

SEQ ID NO: 985391 - protein, 9 aa, Homo Sapiens
VSQEESEVE

SEQ ID NO: 985392 - protein, 9 aa, Homo Sapiens
RAKEASDSA

SEQ ID NO: 985393 - protein, 9 aa, Homo Sapiens
KNSYNRSRS

SEQ ID NO: 985394 - protein, 9 aa, Homo Sapiens
RLAVILEAY

SEQ ID NO: 985395 - protein, 9 aa, Homo Sapiens
FLTPLQWCR

SEQ ID NO: 985396 - protein, 9 aa, Homo Sapiens
KVPTTDIDF

SEQ ID NO: 985397 - protein, 9 aa, Homo Sapiens
LAEDAYKES

SEQ ID NO: 985398 - protein, 9 aa, Homo Sapiens
PLDGLTVSS

SEQ ID NO: 985399 - protein, 9 aa, Homo Sapiens
ACPLKFESY

SEQ ID NO: 985400 - protein, 9 aa, Homo Sapiens
TLLFLADDP

SEQ ID NO: 985401 - protein, 9 aa, Homo Sapiens
YLFDVAFNF

SEQ ID NO: 985402 - protein, 9 aa, Homo Sapiens
KLHPVCSAG

SEQ ID NO: 985403 - protein, 9 aa, Homo Sapiens
SQHQEELSP

SEQ ID NO: 985404 - protein, 9 aa, Homo Sapiens
EDASKREWE

SEQ ID NO: 985405 - protein, 9 aa, Homo Sapiens
ATSALRRME

SEQ ID NO: 985406 - protein, 9 aa, Homo Sapiens
HNLTKDPRL

SEQ ID NO: 985407 - protein, 9 aa, Homo Sapiens
VKTLQEQLE

SEQ ID NO: 985408 - protein, 9 aa, Homo Sapiens
GCEDGCCCW

SEQ ID NO: 985409 - protein, 9 aa, Homo Sapiens
ETRELAPCI

SEQ ID NO: 985410 - protein, 9 aa, Homo Sapiens
VKKVAAQKP

SEQ ID NO: 985411 - protein, 9 aa, Homo Sapiens
QGIIFFFFL

SEQ ID NO: 985412 - protein, 9 aa, Homo Sapiens
NHKKVQANA

SEQ ID NO: 985413 - protein, 9 aa, Homo Sapiens
IPAITSNDA

SEQ ID NO: 985414 - protein, 9 aa, Homo Sapiens
CPLKFESYA

SEQ ID NO: 985415 - protein, 9 aa, Homo Sapiens
SPWEGRPNQ

SEQ ID NO: 985416 - protein, 9 aa, Homo Sapiens
CHLQEGAKR

SEQ ID NO: 985417 - protein, 9 aa, Homo Sapiens
NVPNATIFP

SEQ ID NO: 985418 - protein, 9 aa, Homo Sapiens
EEVRSLLKD

SEQ ID NO: 985419 - protein, 9 aa, Homo Sapiens
SGERFQARV

SEQ ID NO: 985420 - protein, 9 aa, Homo Sapiens
LFQRRNPGV

SEQ ID NO: 985421 - protein, 9 aa, Homo Sapiens
LMNFKDSKN

SEQ ID NO: 985422 - protein, 9 aa, Homo Sapiens
SQRYNAHMM

SEQ ID NO: 985423 - protein, 9 aa, Homo Sapiens
LVRSFRLRF

SEQ ID NO: 985424 - protein, 9 aa, Homo Sapiens
SSIRPPILI

SEQ ID NO: 985425 - protein, 9 aa, Homo Sapiens
LGLVGDLFL

SEQ ID NO: 985426 - protein, 9 aa, Homo Sapiens
TCRFKWGLE

SEQ ID NO: 985427 - protein, 9 aa, Homo Sapiens
CFTTVIVSK

SEQ ID NO: 985428 - protein, 9 aa, Homo Sapiens
KLKLPDLKK

SEQ ID NO: 985429 - protein, 9 aa, Homo Sapiens
IFAVQEKQF

SEQ ID NO: 985430 - protein, 9 aa, Homo Sapiens
RDYVESITS

SEQ ID NO: 985431 - protein, 9 aa, Homo Sapiens
STEEKFIIK

SEQ ID NO: 985432 - protein, 9 aa, Homo Sapiens
GKASFRVHI

SEQ ID NO: 985433 - protein, 9 aa, Homo Sapiens
LAGVFEENG

SEQ ID NO: 985434 - protein, 9 aa, Homo Sapiens
VHPFLSRHE

SEQ ID NO: 985435 - protein, 9 aa, Homo Sapiens
EIRQTRNSQ

SEQ ID NO: 985436 - protein, 9 aa, Homo Sapiens
GDRSEVGVP

SEQ ID NO: 985437 - protein, 9 aa, Homo Sapiens
KGFHEVDYN

SEQ ID NO: 985438 - protein, 9 aa, Homo Sapiens
PESQGPRGE

SEQ ID NO: 985439 - protein, 9 aa, Homo Sapiens
STRVRWCRP

SEQ ID NO: 985440 - protein, 9 aa, Homo Sapiens
ATFSSLGAM

SEQ ID NO: 985441 - protein, 9 aa, Homo Sapiens
KLCPPPRSR

SEQ ID NO: 985442 - protein, 9 aa, Homo Sapiens
LREGALVEL

SEQ ID NO: 985443 - protein, 9 aa, Homo Sapiens
DEIREDYLL

SEQ ID NO: 985444 - protein, 9 aa, Homo Sapiens
CNRLRYPVI

SEQ ID NO: 985445 - protein, 9 aa, Homo Sapiens
LVLTLKTVP

SEQ ID NO: 985446 - protein, 9 aa, Homo Sapiens
AICNRLRYP

SEQ ID NO: 985447 - protein, 9 aa, Homo Sapiens
ALSQVAGML

SEQ ID NO: 985448 - protein, 9 aa, Homo Sapiens
PRMQCQQQS

SEQ ID NO: 985449 - protein, 9 aa, Homo Sapiens
PDLKKNDYS

SEQ ID NO: 985450 - protein, 9 aa, Homo Sapiens
HLQEGAKRP

SEQ ID NO: 985451 - protein, 9 aa, Homo Sapiens
NVVMFVIYE

SEQ ID NO: 985452 - protein, 9 aa, Homo Sapiens
IGRAGRLKE

SEQ ID NO: 985453 - protein, 9 aa, Homo Sapiens
RAGRLKEQL

SEQ ID NO: 985454 - protein, 9 aa, Homo Sapiens
FTTVIVSKM

SEQ ID NO: 985455 - protein, 9 aa, Homo Sapiens
GAARGRARV

SEQ ID NO: 985456 - protein, 9 aa, Homo Sapiens
NKFNHYDTA

SEQ ID NO: 985457 - protein, 9 aa, Homo Sapiens
KLYRRQIAT

SEQ ID NO: 985458 - protein, 9 aa, Homo Sapiens
KDSLLRELA

SEQ ID NO: 985459 - protein, 9 aa, Homo Sapiens
AVEAFAAHV

SEQ ID NO: 985460 - protein, 9 aa, Homo Sapiens
TKDRTPIFT

SEQ ID NO: 985461 - protein, 9 aa, Homo Sapiens
GPLYTHEYK

SEQ ID NO: 985462 - protein, 9 aa, Homo Sapiens
PITDLNSYQ

SEQ ID NO: 985463 - protein, 9 aa, Homo Sapiens
RDLSWEARH

SEQ ID NO: 985464 - protein, 9 aa, Homo Sapiens
AEIVSFQTA

SEQ ID NO: 985465 - protein, 9 aa, Homo Sapiens
ASKKLKTSE

SEQ ID NO: 985466 - protein, 9 aa, Homo Sapiens
LCVRVRPGE

SEQ ID NO: 985467 - protein, 9 aa, Homo Sapiens
QLQKRSIFS

SEQ ID NO: 985468 - protein, 9 aa, Homo Sapiens
TALYVIYNI

SEQ ID NO: 985469 - protein, 9 aa, Homo Sapiens
KVGAWRDYD

SEQ ID NO: 985470 - protein, 9 aa, Homo Sapiens
LSYECILAT

SEQ ID NO: 985471 - protein, 9 aa, Homo Sapiens
KNPPLERDH

SEQ ID NO: 985472 - protein, 9 aa, Homo Sapiens
LEQEEYNLE

SEQ ID NO: 985473 - protein, 9 aa, Homo Sapiens
EFISESSSI

SEQ ID NO: 985474 - protein, 9 aa, Homo Sapiens
LWSSATEKL

SEQ ID NO: 985475 - protein, 9 aa, Homo Sapiens
RIDQLFAVE

SEQ ID NO: 985476 - protein, 9 aa, Homo Sapiens
VEETMSSLR

SEQ ID NO: 985477 - protein, 9 aa, Homo Sapiens
VANRGTLSV

SEQ ID NO: 985478 - protein, 9 aa, Homo Sapiens
YRKNLGAPK

SEQ ID NO: 985479 - protein, 9 aa, Homo Sapiens
VVEKKILAV

SEQ ID NO: 985480 - protein, 9 aa, Homo Sapiens
REMSSLWEM

SEQ ID NO: 985481 - protein, 9 aa, Homo Sapiens
LDRWSLRQL

SEQ ID NO: 985482 - protein, 9 aa, Homo Sapiens
PILFYCIPT

SEQ ID NO: 985483 - protein, 9 aa, Homo Sapiens
PPSIAPKPV

SEQ ID NO: 985484 - protein, 9 aa, Homo Sapiens
RRPDYPTRP

SEQ ID NO: 985485 - protein, 9 aa, Homo Sapiens
RDETSVQPW

SEQ ID NO: 985486 - protein, 9 aa, Homo Sapiens
VFVVCWTLI

SEQ ID NO: 985487 - protein, 9 aa, Homo Sapiens
PETSVSVVT

SEQ ID NO: 985488 - protein, 9 aa, Homo Sapiens
KFLDNFDSS

SEQ ID NO: 985489 - protein, 9 aa, Homo Sapiens
YDVKMKKKG

SEQ ID NO: 985490 - protein, 9 aa, Homo Sapiens
LGTVIQNGN

SEQ ID NO: 985491 - protein, 9 aa, Homo Sapiens
SEIMIMLWH

SEQ ID NO: 985492 - protein, 9 aa, Homo Sapiens
HLCHSNCTY

SEQ ID NO: 985493 - protein, 9 aa, Homo Sapiens
AGTNQPPSN

SEQ ID NO: 985494 - protein, 9 aa, Homo Sapiens
QKQTFTKWI

SEQ ID NO: 985495 - protein, 9 aa, Homo Sapiens
TYEIFQEKK

SEQ ID NO: 985496 - protein, 9 aa, Homo Sapiens
KMSSCIKNS

SEQ ID NO: 985497 - protein, 9 aa, Homo Sapiens
SHFLLFDKK

SEQ ID NO: 985498 - protein, 9 aa, Homo Sapiens
LSLWKCPHN

SEQ ID NO: 985499 - protein, 9 aa, Homo Sapiens
ISLIHFNTP

SEQ ID NO: 985500 - protein, 9 aa, Homo Sapiens
NEISLIHFN

SEQ ID NO: 985501 - protein, 9 aa, Homo Sapiens
NFLHTYSLS

SEQ ID NO: 985502 - protein, 9 aa, Homo Sapiens
SWEARHGGN

SEQ ID NO: 985503 - protein, 9 aa, Homo Sapiens
MSLGQCQDN

SEQ ID NO: 985504 - protein, 9 aa, Homo Sapiens
GAMFATRCD

SEQ ID NO: 985505 - protein, 9 aa, Homo Sapiens
DKFQKFIKA

SEQ ID NO: 985506 - protein, 9 aa, Homo Sapiens
ILKPPFSPI

SEQ ID NO: 985507 - protein, 9 aa, Homo Sapiens
EGPPGFLGL

SEQ ID NO: 985508 - protein, 9 aa, Homo Sapiens
SALFFQDYM

SEQ ID NO: 985509 - protein, 9 aa, Homo Sapiens
LSPDYWILR

SEQ ID NO: 985510 - protein, 9 aa, Homo Sapiens
FQARVTVSG

SEQ ID NO: 985511 - protein, 9 aa, Homo Sapiens
VIQNGNVIQ

SEQ ID NO: 985512 - protein, 9 aa, Homo Sapiens
MNSVPHFSG

SEQ ID NO: 985513 - protein, 9 aa, Homo Sapiens
VSITDENHS

SEQ ID NO: 985514 - protein, 9 aa, Homo Sapiens
TRIISSAIR

SEQ ID NO: 985515 - protein, 9 aa, Homo Sapiens
SRQRSIFEY

SEQ ID NO: 985516 - protein, 9 aa, Homo Sapiens
SIFSIHPSF

SEQ ID NO: 985517 - protein, 9 aa, Homo Sapiens
LNVQLERMK

SEQ ID NO: 985518 - protein, 9 aa, Homo Sapiens
IQERWGTVC

SEQ ID NO: 985519 - protein, 9 aa, Homo Sapiens
REQRSQNSR

SEQ ID NO: 985520 - protein, 9 aa, Homo Sapiens
MSSCIKNSK

SEQ ID NO: 985521 - protein, 9 aa, Homo Sapiens
PRDSDVESD

SEQ ID NO: 985522 - protein, 9 aa, Homo Sapiens
SKYNPQHSL

SEQ ID NO: 985523 - protein, 9 aa, Homo Sapiens
PEEYEGKYQ

SEQ ID NO: 985524 - protein, 9 aa, Homo Sapiens
CFVVYSGIL

SEQ ID NO: 985525 - protein, 9 aa, Homo Sapiens
SRTDLKKEH

SEQ ID NO: 985526 - protein, 9 aa, Homo Sapiens
VDAKDAIKK

SEQ ID NO: 985527 - protein, 9 aa, Homo Sapiens
QGKLPKSHL

SEQ ID NO: 985528 - protein, 9 aa, Homo Sapiens
AEVIMKLSH

SEQ ID NO: 985529 - protein, 9 aa, Homo Sapiens
TILRILSAS

SEQ ID NO: 985530 - protein, 9 aa, Homo Sapiens
VQYFEMCET

SEQ ID NO: 985531 - protein, 9 aa, Homo Sapiens
NCLLVAVRT

SEQ ID NO: 985532 - protein, 9 aa, Homo Sapiens
PTPAQPAPV

SEQ ID NO: 985533 - protein, 9 aa, Homo Sapiens
LLGSIIVES

SEQ ID NO: 985534 - protein, 9 aa, Homo Sapiens
YNPRDRIHC

SEQ ID NO: 985535 - protein, 9 aa, Homo Sapiens
MILIHQILQ

SEQ ID NO: 985536 - protein, 9 aa, Homo Sapiens
TICSRVPTA

SEQ ID NO: 985537 - protein, 9 aa, Homo Sapiens
HSWPSSMDT

SEQ ID NO: 985538 - protein, 9 aa, Homo Sapiens
WKNDGKLYA

SEQ ID NO: 985539 - protein, 9 aa, Homo Sapiens
CGHGGQMSR

SEQ ID NO: 985540 - protein, 9 aa, Homo Sapiens
RAQKAMSKL

SEQ ID NO: 985541 - protein, 9 aa, Homo Sapiens
HINCYTDYL

SEQ ID NO: 985542 - protein, 9 aa, Homo Sapiens
EFVTTFKGN

SEQ ID NO: 985543 - protein, 9 aa, Homo Sapiens
AMEFEFKLL

SEQ ID NO: 985544 - protein, 9 aa, Homo Sapiens
TCDATYKRL

SEQ ID NO: 985545 - protein, 9 aa, Homo Sapiens
LDNFYCDVS

SEQ ID NO: 985546 - protein, 9 aa, Homo Sapiens
GNLPMKLQR

SEQ ID NO: 985547 - protein, 9 aa, Homo Sapiens
EEAVKDTCK

SEQ ID NO: 985548 - protein, 9 aa, Homo Sapiens
KIEQLRTGF

SEQ ID NO: 985549 - protein, 9 aa, Homo Sapiens
QKVDSDLEE

SEQ ID NO: 985550 - protein, 9 aa, Homo Sapiens
KAERNMRRK

SEQ ID NO: 985551 - protein, 9 aa, Homo Sapiens
MYMFLENFS

SEQ ID NO: 985552 - protein, 9 aa, Homo Sapiens
LRTVLSPDY

SEQ ID NO: 985553 - protein, 9 aa, Homo Sapiens
TNLLADPVV

SEQ ID NO: 985554 - protein, 9 aa, Homo Sapiens
PGYHVPGFS

SEQ ID NO: 985555 - protein, 9 aa, Homo Sapiens
TGPHGYAGV

SEQ ID NO: 985556 - protein, 9 aa, Homo Sapiens
CNRMKKPLH

SEQ ID NO: 985557 - protein, 9 aa, Homo Sapiens
SRCCITAAS

SEQ ID NO: 985558 - protein, 9 aa, Homo Sapiens
SVFPSMPFS

SEQ ID NO: 985559 - protein, 9 aa, Homo Sapiens
QTRNSQPLE

SEQ ID NO: 985560 - protein, 9 aa, Homo Sapiens
YSPVALEVP

SEQ ID NO: 985561 - protein, 9 aa, Homo Sapiens
GIDDLAVAY

SEQ ID NO: 985562 - protein, 9 aa, Homo Sapiens
CITHPQTVP

SEQ ID NO: 985563 - protein, 9 aa, Homo Sapiens
WVSNEKNTP

SEQ ID NO: 985564 - protein, 9 aa, Homo Sapiens
MNFKDSKNP

SEQ ID NO: 985565 - protein, 9 aa, Homo Sapiens
LEEEVRSLL

SEQ ID NO: 985566 - protein, 9 aa, Homo Sapiens
SPLDDKNDN

SEQ ID NO: 985567 - protein, 9 aa, Homo Sapiens
SISCAFFLA

SEQ ID NO: 985568 - protein, 9 aa, Homo Sapiens
PDSVQGFEA

SEQ ID NO: 985569 - protein, 9 aa, Homo Sapiens
DIEIENEFI

SEQ ID NO: 985570 - protein, 9 aa, Homo Sapiens
TDSGPKSSS

SEQ ID NO: 985571 - protein, 9 aa, Homo Sapiens
PSSPDLGRH

SEQ ID NO: 985572 - protein, 9 aa, Homo Sapiens
ENRKNSYNR

SEQ ID NO: 985573 - protein, 9 aa, Homo Sapiens
GDGNEDTDS

SEQ ID NO: 985574 - protein, 9 aa, Homo Sapiens
ANEDNCGDN

SEQ ID NO: 985575 - protein, 9 aa, Homo Sapiens
TRHGLKSLF

SEQ ID NO: 985576 - protein, 9 aa, Homo Sapiens
WCIWKQKGR

SEQ ID NO: 985577 - protein, 9 aa, Homo Sapiens
KQTFTKWIN

SEQ ID NO: 985578 - protein, 9 aa, Homo Sapiens
GTCWCPIQG

SEQ ID NO: 985579 - protein, 9 aa, Homo Sapiens
QGRNSRFGR

SEQ ID NO: 985580 - protein, 9 aa, Homo Sapiens
FPAAGMGHQ

SEQ ID NO: 985581 - protein, 9 aa, Homo Sapiens
DYEEAKSYK

SEQ ID NO: 985582 - protein, 9 aa, Homo Sapiens
QCGKVFSAS

SEQ ID NO: 985583 - protein, 9 aa, Homo Sapiens
KTAAHAITK

SEQ ID NO: 985584 - protein, 9 aa, Homo Sapiens
VKSKKQELE

SEQ ID NO: 985585 - protein, 9 aa, Homo Sapiens
TSSMEAASI

SEQ ID NO: 985586 - protein, 9 aa, Homo Sapiens
YFLRLTPVG

SEQ ID NO: 985587 - protein, 9 aa, Homo Sapiens
ARCSPHSHS

SEQ ID NO: 985588 - protein, 9 aa, Homo Sapiens
SSIAGPAQP

SEQ ID NO: 985589 - protein, 9 aa, Homo Sapiens
SRDEVSLCW

SEQ ID NO: 985590 - protein, 9 aa, Homo Sapiens
KLLCTVTSQ

SEQ ID NO: 985591 - protein, 9 aa, Homo Sapiens
FGNTPSTLD

SEQ ID NO: 985592 - protein, 9 aa, Homo Sapiens
SLTPAHHYN

SEQ ID NO: 985593 - protein, 9 aa, Homo Sapiens
VEAFAAHVS

SEQ ID NO: 985594 - protein, 9 aa, Homo Sapiens
SGLTFTVGS

SEQ ID NO: 985595 - protein, 9 aa, Homo Sapiens
TETASSTKP

SEQ ID NO: 985596 - protein, 9 aa, Homo Sapiens
PCENQIILL

SEQ ID NO: 985597 - protein, 9 aa, Homo Sapiens
EDRSSYPQD

SEQ ID NO: 985598 - protein, 9 aa, Homo Sapiens
LVAVRTNNY

SEQ ID NO: 985599 - protein, 9 aa, Homo Sapiens
SLSYHDGAL

SEQ ID NO: 985600 - protein, 9 aa, Homo Sapiens
LPPRPSKVL

SEQ ID NO: 985601 - protein, 9 aa, Homo Sapiens
GMALMKVNL

SEQ ID NO: 985602 - protein, 9 aa, Homo Sapiens
RVPWSISLG

SEQ ID NO: 985603 - protein, 9 aa, Homo Sapiens
QPVDFVDQN

SEQ ID NO: 985604 - protein, 9 aa, Homo Sapiens
NAPNVNTTS

SEQ ID NO: 985605 - protein, 9 aa, Homo Sapiens
RQNGSAAMY

SEQ ID NO: 985606 - protein, 9 aa, Homo Sapiens
KPQYSLPAL

SEQ ID NO: 985607 - protein, 9 aa, Homo Sapiens
DLYLRPCDR

SEQ ID NO: 985608 - protein, 9 aa, Homo Sapiens
PDGSYQNTK

SEQ ID NO: 985609 - protein, 9 aa, Homo Sapiens
FDVAFNFTA

SEQ ID NO: 985610 - protein, 9 aa, Homo Sapiens
EPEVLPAEV

SEQ ID NO: 985611 - protein, 9 aa, Homo Sapiens
IQRGSLIID

SEQ ID NO: 985612 - protein, 9 aa, Homo Sapiens
HNNITAEDC

SEQ ID NO: 985613 - protein, 9 aa, Homo Sapiens
GTLFPLKIA

SEQ ID NO: 985614 - protein, 9 aa, Homo Sapiens
LKQKDGTSL

SEQ ID NO: 985615 - protein, 9 aa, Homo Sapiens
RQKNFTPMA

SEQ ID NO: 985616 - protein, 9 aa, Homo Sapiens
PSATSALRR

SEQ ID NO: 985617 - protein, 9 aa, Homo Sapiens
ASIREPSTT

SEQ ID NO: 985618 - protein, 9 aa, Homo Sapiens
VLSPDYWIL

SEQ ID NO: 985619 - protein, 9 aa, Homo Sapiens
KVAAQKPSE

SEQ ID NO: 985620 - protein, 9 aa, Homo Sapiens
PLLLSFFVL

SEQ ID NO: 985621 - protein, 9 aa, Homo Sapiens
NEKQRQNGS

SEQ ID NO: 985622 - protein, 9 aa, Homo Sapiens
LYYKLYRRQ

SEQ ID NO: 985623 - protein, 9 aa, Homo Sapiens
AEDAYKESC

SEQ ID NO: 985624 - protein, 9 aa, Homo Sapiens
TFPRLAASP

SEQ ID NO: 985625 - protein, 9 aa, Homo Sapiens
LQCRECAPG

SEQ ID NO: 985626 - protein, 9 aa, Homo Sapiens
APPNVSKEK

SEQ ID NO: 985627 - protein, 9 aa, Homo Sapiens
LPGSGGFPT

SEQ ID NO: 985628 - protein, 9 aa, Homo Sapiens
VEKWKTLVS

SEQ ID NO: 985629 - protein, 9 aa, Homo Sapiens
ITHPQTVPQ

SEQ ID NO: 985630 - protein, 9 aa, Homo Sapiens
PLDDKNDNL

SEQ ID NO: 985631 - protein, 9 aa, Homo Sapiens
DPQCPDSVT

SEQ ID NO: 985632 - protein, 9 aa, Homo Sapiens
FRVHILFNI

SEQ ID NO: 985633 - protein, 9 aa, Homo Sapiens
AAKYLPVYS

SEQ ID NO: 985634 - protein, 9 aa, Homo Sapiens
APRQQARPF

SEQ ID NO: 985635 - protein, 9 aa, Homo Sapiens
ETSVSVVTP

SEQ ID NO: 985636 - protein, 9 aa, Homo Sapiens
ISHQRRSIE

SEQ ID NO: 985637 - protein, 9 aa, Homo Sapiens
RLRALRPEE

SEQ ID NO: 985638 - protein, 9 aa, Homo Sapiens
LKKNDYSPE

SEQ ID NO: 985639 - protein, 9 aa, Homo Sapiens
FRAKNVQLS

SEQ ID NO: 985640 - protein, 9 aa, Homo Sapiens
ENFLGPFPL

SEQ ID NO: 985641 - protein, 9 aa, Homo Sapiens
QPTKTRFVD

SEQ ID NO: 985642 - protein, 9 aa, Homo Sapiens
EEEVRSLLK

SEQ ID NO: 985643 - protein, 9 aa, Homo Sapiens
ADQTAPRCQ

SEQ ID NO: 985644 - protein, 9 aa, Homo Sapiens
GLFVPLVAP

SEQ ID NO: 985645 - protein, 9 aa, Homo Sapiens
KQCGKVFSA

SEQ ID NO: 985646 - protein, 9 aa, Homo Sapiens
ETVDPELAV

SEQ ID NO: 985647 - protein, 9 aa, Homo Sapiens
LCCLCCALV

SEQ ID NO: 985648 - protein, 9 aa, Homo Sapiens
SLQVRSHLN

SEQ ID NO: 985649 - protein, 9 aa, Homo Sapiens
IIFFFFLIV

SEQ ID NO: 985650 - protein, 9 aa, Homo Sapiens
NKSEYFLRL

SEQ ID NO: 985651 - protein, 9 aa, Homo Sapiens
AKPSLLVLV

SEQ ID NO: 985652 - protein, 9 aa, Homo Sapiens
LHIPMYLFF

SEQ ID NO: 985653 - protein, 9 aa, Homo Sapiens
FVEPKVEKK

SEQ ID NO: 985654 - protein, 9 aa, Homo Sapiens
NITDVEFEL

SEQ ID NO: 985655 - protein, 9 aa, Homo Sapiens
VQRTDSILN

SEQ ID NO: 985656 - protein, 9 aa, Homo Sapiens
VMRPHFCLQ

SEQ ID NO: 985657 - protein, 9 aa, Homo Sapiens
VPQLQNIVF

SEQ ID NO: 985658 - protein, 9 aa, Homo Sapiens
WVEILDTNN

SEQ ID NO: 985659 - protein, 9 aa, Homo Sapiens
SRDCQTKTT

SEQ ID NO: 985660 - protein, 9 aa, Homo Sapiens
NSSEVPYLH

SEQ ID NO: 985661 - protein, 9 aa, Homo Sapiens
LIKTENLAE

SEQ ID NO: 985662 - protein, 9 aa, Homo Sapiens
CTCNLLSLK

SEQ ID NO: 985663 - protein, 9 aa, Homo Sapiens
LNTPSFLAV

SEQ ID NO: 985664 - protein, 9 aa, Homo Sapiens
LMFEHPLSE

SEQ ID NO: 985665 - protein, 9 aa, Homo Sapiens
LFVPLVAPR

SEQ ID NO: 985666 - protein, 9 aa, Homo Sapiens
HEVDYNTFH

SEQ ID NO: 985667 - protein, 9 aa, Homo Sapiens
APSCSGSSI

SEQ ID NO: 985668 - protein, 9 aa, Homo Sapiens
KKIHHNLTK

SEQ ID NO: 985669 - protein, 9 aa, Homo Sapiens
CGDEGKAID

SEQ ID NO: 985670 - protein, 9 aa, Homo Sapiens
TLNAFILNS

SEQ ID NO: 985671 - protein, 9 aa, Homo Sapiens
LQKRSIFSI

SEQ ID NO: 985672 - protein, 9 aa, Homo Sapiens
QELARLEEE

SEQ ID NO: 985673 - protein, 9 aa, Homo Sapiens
ALVQTAPWL

SEQ ID NO: 985674 - protein, 9 aa, Homo Sapiens
TERHVSLRL

SEQ ID NO: 985675 - protein, 9 aa, Homo Sapiens
RSAIDEDSP

SEQ ID NO: 985676 - protein, 9 aa, Homo Sapiens
GDVTDKDEG

SEQ ID NO: 985677 - protein, 9 aa, Homo Sapiens
LEKTSDTSF

SEQ ID NO: 985678 - protein, 9 aa, Homo Sapiens
DTESMDPDV

SEQ ID NO: 985679 - protein, 9 aa, Homo Sapiens
PLELGAESP

SEQ ID NO: 985680 - protein, 9 aa, Homo Sapiens
EGTDPELEG

SEQ ID NO: 985681 - protein, 9 aa, Homo Sapiens
ISGGPHIFY

SEQ ID NO: 985682 - protein, 9 aa, Homo Sapiens
FNDALVYAQ

SEQ ID NO: 985683 - protein, 9 aa, Homo Sapiens
ESICSQAIM

SEQ ID NO: 985684 - protein, 9 aa, Homo Sapiens
LFNDALVYA

SEQ ID NO: 985685 - protein, 9 aa, Homo Sapiens
LFDVAFNFT

SEQ ID NO: 985686 - protein, 9 aa, Homo Sapiens
APVLSPALG

SEQ ID NO: 985687 - protein, 9 aa, Homo Sapiens
VVRCITHPQ

SEQ ID NO: 985688 - protein, 9 aa, Homo Sapiens
WNLPIYVIS

SEQ ID NO: 985689 - protein, 9 aa, Homo Sapiens
IENEFISES

SEQ ID NO: 985690 - protein, 9 aa, Homo Sapiens
NDKNPCEGM

SEQ ID NO: 985691 - protein, 9 aa, Homo Sapiens
SLKELQRLH

SEQ ID NO: 985692 - protein, 9 aa, Homo Sapiens
SPGPKGISG

SEQ ID NO: 985693 - protein, 9 aa, Homo Sapiens
SPEETRELA

SEQ ID NO: 985694 - protein, 9 aa, Homo Sapiens
RRRRFSRAV

SEQ ID NO: 985695 - protein, 9 aa, Homo Sapiens
LTRDHNAWK

SEQ ID NO: 985696 - protein, 9 aa, Homo Sapiens
NLFLTNQFS

SEQ ID NO: 985697 - protein, 9 aa, Homo Sapiens
LKNHPQAQR

SEQ ID NO: 985698 - protein, 9 aa, Homo Sapiens
LEKEEYLGS

SEQ ID NO: 985699 - protein, 9 aa, Homo Sapiens
NVDCDFCPV

SEQ ID NO: 985700 - protein, 9 aa, Homo Sapiens
PQQRLSSSL

SEQ ID NO: 985701 - protein, 9 aa, Homo Sapiens
CSSYMIVVS

SEQ ID NO: 985702 - protein, 9 aa, Homo Sapiens
KKIFSSLEL

SEQ ID NO: 985703 - protein, 9 aa, Homo Sapiens
MTAFFWILG

SEQ ID NO: 985704 - protein, 9 aa, Homo Sapiens
EAYNICTDS

SEQ ID NO: 985705 - protein, 9 aa, Homo Sapiens
RAPSFSVQK

SEQ ID NO: 985706 - protein, 9 aa, Homo Sapiens
TDKAPKGLT

SEQ ID NO: 985707 - protein, 9 aa, Homo Sapiens
LSPLAPGFL

SEQ ID NO: 985708 - protein, 9 aa, Homo Sapiens
IKPDDESSS

SEQ ID NO: 985709 - protein, 9 aa, Homo Sapiens
GRNHSGVRN

SEQ ID NO: 985710 - protein, 9 aa, Homo Sapiens
EVSIFARQS

SEQ ID NO: 985711 - protein, 9 aa, Homo Sapiens
EYRFNGFRF

SEQ ID NO: 985712 - protein, 9 aa, Homo Sapiens
VESDAGKKE

SEQ ID NO: 985713 - protein, 9 aa, Homo Sapiens
GSEEASDKN

SEQ ID NO: 985714 - protein, 9 aa, Homo Sapiens
ALVAAALAS

SEQ ID NO: 985715 - protein, 9 aa, Homo Sapiens
EDVDTHQDK

SEQ ID NO: 985716 - protein, 9 aa, Homo Sapiens
PEKTSVYTS

SEQ ID NO: 985717 - protein, 9 aa, Homo Sapiens
HHNLTKDPR

SEQ ID NO: 985718 - protein, 9 aa, Homo Sapiens
PEDNLVLPD

SEQ ID NO: 985719 - protein, 9 aa, Homo Sapiens
DEGPLGDPG

SEQ ID NO: 985720 - protein, 9 aa, Homo Sapiens
CTCGQRYQL

SEQ ID NO: 985721 - protein, 9 aa, Homo Sapiens
EKIAKSHGS

SEQ ID NO: 985722 - protein, 9 aa, Homo Sapiens
KEEFVTTFK

SEQ ID NO: 985723 - protein, 9 aa, Homo Sapiens
SSVKAPALE

SEQ ID NO: 985724 - protein, 9 aa, Homo Sapiens
KGEVSDGYV

SEQ ID NO: 985725 - protein, 9 aa, Homo Sapiens
HLLYSRHCD

SEQ ID NO: 985726 - protein, 9 aa, Homo Sapiens
PQGITGKPG

SEQ ID NO: 985727 - protein, 9 aa, Homo Sapiens
GLQDSFPAQ

SEQ ID NO: 985728 - protein, 9 aa, Homo Sapiens
AGVFEENGS

SEQ ID NO: 985729 - protein, 9 aa, Homo Sapiens
TENYRLRLI

SEQ ID NO: 985730 - protein, 9 aa, Homo Sapiens
LGGINSEDQ

SEQ ID NO: 985731 - protein, 9 aa, Homo Sapiens
FRGDSPIME

SEQ ID NO: 985732 - protein, 9 aa, Homo Sapiens
KKSKSGLKI

SEQ ID NO: 985733 - protein, 9 aa, Homo Sapiens
GTRVEVSRQ

SEQ ID NO: 985734 - protein, 9 aa, Homo Sapiens
FGTFEAGVT

SEQ ID NO: 985735 - protein, 9 aa, Homo Sapiens
FRYPTKCEV

SEQ ID NO: 985736 - protein, 9 aa, Homo Sapiens
KSEDSVKRS

SEQ ID NO: 985737 - protein, 9 aa, Homo Sapiens
IKSLEQART

SEQ ID NO: 985738 - protein, 9 aa, Homo Sapiens
DTSLFENAM

SEQ ID NO: 985739 - protein, 9 aa, Homo Sapiens
ATSFGIVLP

SEQ ID NO: 985740 - protein, 9 aa, Homo Sapiens
MLLPKLQQV

SEQ ID NO: 985741 - protein, 9 aa, Homo Sapiens
ADHGPSRLS

SEQ ID NO: 985742 - protein, 9 aa, Homo Sapiens
RLEEEVRSL

SEQ ID NO: 985743 - protein, 9 aa, Homo Sapiens
IEEESRTGQ

SEQ ID NO: 985744 - protein, 9 aa, Homo Sapiens
VIDLIKNTK

SEQ ID NO: 985745 - protein, 9 aa, Homo Sapiens
SQKKIKSFQ

SEQ ID NO: 985746 - protein, 9 aa, Homo Sapiens
KHAHSKVEK

SEQ ID NO: 985747 - protein, 9 aa, Homo Sapiens
NRELLNKYC

SEQ ID NO: 985748 - protein, 9 aa, Homo Sapiens
MENTRQEMT

SEQ ID NO: 985749 - protein, 9 aa, Homo Sapiens
VVVDDVPVM

SEQ ID NO: 985750 - protein, 9 aa, Homo Sapiens
TAAEFLLPA

SEQ ID NO: 985751 - protein, 9 aa, Homo Sapiens
QATSFGIVL

SEQ ID NO: 985752 - protein, 9 aa, Homo Sapiens
ASDRTSSSP

SEQ ID NO: 985753 - protein, 9 aa, Homo Sapiens
CYGKKDLLF

SEQ ID NO: 985754 - protein, 9 aa, Homo Sapiens
CTTTHTFLD

SEQ ID NO: 985755 - protein, 9 aa, Homo Sapiens
EREFYSSQF

SEQ ID NO: 985756 - protein, 9 aa, Homo Sapiens
PAELIREPL

SEQ ID NO: 985757 - protein, 9 aa, Homo Sapiens
VQIHDEKAK

SEQ ID NO: 985758 - protein, 9 aa, Homo Sapiens
SYSSQYPDD

SEQ ID NO: 985759 - protein, 9 aa, Homo Sapiens
AKYLPVYSP

SEQ ID NO: 985760 - protein, 9 aa, Homo Sapiens
IFGLFLFMY

SEQ ID NO: 985761 - protein, 9 aa, Homo Sapiens
RYLQLWVQK

SEQ ID NO: 985762 - protein, 9 aa, Homo Sapiens
SATEKLQGK

SEQ ID NO: 985763 - protein, 9 aa, Homo Sapiens
KFEVYSVSL

SEQ ID NO: 985764 - protein, 9 aa, Homo Sapiens
TIFPGQSIQ

SEQ ID NO: 985765 - protein, 9 aa, Homo Sapiens
HGLYCEEKY

SEQ ID NO: 985766 - protein, 9 aa, Homo Sapiens
VLQDLLDGC

SEQ ID NO: 985767 - protein, 9 aa, Homo Sapiens
LRGETESVS

SEQ ID NO: 985768 - protein, 9 aa, Homo Sapiens
FCRRPASST

SEQ ID NO: 985769 - protein, 9 aa, Homo Sapiens
FLDGLGSAQ

SEQ ID NO: 985770 - protein, 9 aa, Homo Sapiens
EMKNHNSHD

SEQ ID NO: 985771 - protein, 9 aa, Homo Sapiens
GIFLPTAPN

SEQ ID NO: 985772 - protein, 9 aa, Homo Sapiens
ICFTTVIVS

SEQ ID NO: 985773 - protein, 9 aa, Homo Sapiens
IVFTVNLGC

SEQ ID NO: 985774 - protein, 9 aa, Homo Sapiens
LRPSRRHFS

SEQ ID NO: 985775 - protein, 9 aa, Homo Sapiens
SIRHNLFSN

SEQ ID NO: 985776 - protein, 9 aa, Homo Sapiens
WEGRPNQSL

SEQ ID NO: 985777 - protein, 9 aa, Homo Sapiens
TLCQETLVN

SEQ ID NO: 985778 - protein, 9 aa, Homo Sapiens
EDRLNNITM

SEQ ID NO: 985779 - protein, 9 aa, Homo Sapiens
GPKPGFSEP

SEQ ID NO: 985780 - protein, 9 aa, Homo Sapiens
QSLARNVFA

SEQ ID NO: 985781 - protein, 9 aa, Homo Sapiens
KSKARQCHL

SEQ ID NO: 985782 - protein, 9 aa, Homo Sapiens
EFCGAGSVI

SEQ ID NO: 985783 - protein, 9 aa, Homo Sapiens
SPRDSDVES

SEQ ID NO: 985784 - protein, 9 aa, Homo Sapiens
ITASPSLRF

SEQ ID NO: 985785 - protein, 9 aa, Homo Sapiens
FRGAQQKRA

SEQ ID NO: 985786 - protein, 9 aa, Homo Sapiens
NSDSEAKCF

SEQ ID NO: 985787 - protein, 9 aa, Homo Sapiens
TFGQYSLQV

SEQ ID NO: 985788 - protein, 9 aa, Homo Sapiens
DEEAKEDGR

SEQ ID NO: 985789 - protein, 9 aa, Homo Sapiens
LNDAEERAD

SEQ ID NO: 985790 - protein, 9 aa, Homo Sapiens
GLTQYSRDA

SEQ ID NO: 985791 - protein, 9 aa, Homo Sapiens
LLDSVWPCQ

SEQ ID NO: 985792 - protein, 9 aa, Homo Sapiens
LFKSRDPFC

SEQ ID NO: 985793 - protein, 9 aa, Homo Sapiens
DDFEWHRGY

SEQ ID NO: 985794 - protein, 9 aa, Homo Sapiens
HSKYNPQHS

SEQ ID NO: 985795 - protein, 9 aa, Homo Sapiens
VHFLSEKKN

SEQ ID NO: 985796 - protein, 9 aa, Homo Sapiens
SPEVSAFFG

SEQ ID NO: 985797 - protein, 9 aa, Homo Sapiens
ENAICSGKL

SEQ ID NO: 985798 - protein, 9 aa, Homo Sapiens
RLGKIDGRG

SEQ ID NO: 985799 - protein, 9 aa, Homo Sapiens
DSKNPVVYG

SEQ ID NO: 985800 - protein, 9 aa, Homo Sapiens
SSGAVSTRV

SEQ ID NO: 985801 - protein, 9 aa, Homo Sapiens
ESSFRSYGN

SEQ ID NO: 985802 - protein, 9 aa, Homo Sapiens
QPPEAPEKI

SEQ ID NO: 985803 - protein, 9 aa, Homo Sapiens
IYDKTDIPH

SEQ ID NO: 985804 - protein, 9 aa, Homo Sapiens
ARDGGSPLL

SEQ ID NO: 985805 - protein, 9 aa, Homo Sapiens
DDAISYRFS

SEQ ID NO: 985806 - protein, 9 aa, Homo Sapiens
EDAPRQTPL

SEQ ID NO: 985807 - protein, 9 aa, Homo Sapiens
HSKVEKNPK

SEQ ID NO: 985808 - protein, 9 aa, Homo Sapiens
LRLAWQLKT

SEQ ID NO: 985809 - protein, 9 aa, Homo Sapiens
VRCVPPRFS

SEQ ID NO: 985810 - protein, 9 aa, Homo Sapiens
QENATMLVV

SEQ ID NO: 985811 - protein, 9 aa, Homo Sapiens
YIAAEKIIW

SEQ ID NO: 985812 - protein, 9 aa, Homo Sapiens
IRVIQRLRS

SEQ ID NO: 985813 - protein, 9 aa, Homo Sapiens
FLKNHPQAQ

SEQ ID NO: 985814 - protein, 9 aa, Homo Sapiens
LSASNPFLN

SEQ ID NO: 985815 - protein, 9 aa, Homo Sapiens
LLSMAGVLA

SEQ ID NO: 985816 - protein, 9 aa, Homo Sapiens
FRIVRLVRI

SEQ ID NO: 985817 - protein, 9 aa, Homo Sapiens
VVVRLKSVQ

SEQ ID NO: 985818 - protein, 9 aa, Homo Sapiens
AKRPLPVDT

SEQ ID NO: 985819 - protein, 9 aa, Homo Sapiens
DLLIKAIKD

SEQ ID NO: 985820 - protein, 9 aa, Homo Sapiens
RQHGSGTGK

SEQ ID NO: 985821 - protein, 9 aa, Homo Sapiens
LCQTSKQAK

SEQ ID NO: 985822 - protein, 9 aa, Homo Sapiens
YTYGQAFGE

SEQ ID NO: 985823 - protein, 9 aa, Homo Sapiens
DEQNSDNAN

SEQ ID NO: 985824 - protein, 9 aa, Homo Sapiens
ILRLEEVSP

SEQ ID NO: 985825 - protein, 9 aa, Homo Sapiens
TQPETNSEE

SEQ ID NO: 985826 - protein, 9 aa, Homo Sapiens
RNLISAHCL

SEQ ID NO: 985827 - protein, 9 aa, Homo Sapiens
FNCNNWLSR

SEQ ID NO: 985828 - protein, 9 aa, Homo Sapiens
QDNPASAAR

SEQ ID NO: 985829 - protein, 9 aa, Homo Sapiens
FPIEMKNHN

SEQ ID NO: 985830 - protein, 9 aa, Homo Sapiens
LLLLVSYRV

SEQ ID NO: 985831 - protein, 9 aa, Homo Sapiens
QPYSHLLYQ

SEQ ID NO: 985832 - protein, 9 aa, Homo Sapiens
SSHLALSFQ

SEQ ID NO: 985833 - protein, 9 aa, Homo Sapiens
YTDYLELYD

SEQ ID NO: 985834 - protein, 9 aa, Homo Sapiens
SRRHFSRVM

SEQ ID NO: 985835 - protein, 9 aa, Homo Sapiens
LDAFDAKAR

SEQ ID NO: 985836 - protein, 9 aa, Homo Sapiens
TDYNLVQKV

SEQ ID NO: 985837 - protein, 9 aa, Homo Sapiens
ISGRFRYPT

SEQ ID NO: 985838 - protein, 9 aa, Homo Sapiens
KPPFSPIPF

SEQ ID NO: 985839 - protein, 9 aa, Homo Sapiens
DHESCRVEP

SEQ ID NO: 985840 - protein, 9 aa, Homo Sapiens
TLPDHAVPT

SEQ ID NO: 985841 - protein, 9 aa, Homo Sapiens
AVFVVCWTL

SEQ ID NO: 985842 - protein, 9 aa, Homo Sapiens
AQKKERWIN

SEQ ID NO: 985843 - protein, 9 aa, Homo Sapiens
EIMIMLWHR

SEQ ID NO: 985844 - protein, 9 aa, Homo Sapiens
LISCGVIPN

SEQ ID NO: 985845 - protein, 9 aa, Homo Sapiens
PAGKRKAAH

SEQ ID NO: 985846 - protein, 9 aa, Homo Sapiens
SFRCTCGQR

SEQ ID NO: 985847 - protein, 9 aa, Homo Sapiens
PLEVLKRDK

SEQ ID NO: 985848 - protein, 9 aa, Homo Sapiens
AAQLRGETE

SEQ ID NO: 985849 - protein, 9 aa, Homo Sapiens
TERIYNVGM

SEQ ID NO: 985850 - protein, 9 aa, Homo Sapiens
YSDKGPDAT

SEQ ID NO: 985851 - protein, 9 aa, Homo Sapiens
SLEQARTEN

SEQ ID NO: 985852 - protein, 9 aa, Homo Sapiens
SDFNHTGQE

SEQ ID NO: 985853 - protein, 9 aa, Homo Sapiens
SGPKSSSPS

SEQ ID NO: 985854 - protein, 9 aa, Homo Sapiens
FPELPAVGG

SEQ ID NO: 985855 - protein, 9 aa, Homo Sapiens
GKLGPPGPL

SEQ ID NO: 985856 - protein, 9 aa, Homo Sapiens
AAQDLQGQG

SEQ ID NO: 985857 - protein, 9 aa, Homo Sapiens
TRVRWCRPD

SEQ ID NO: 985858 - protein, 9 aa, Homo Sapiens
KQKVTEHIL

SEQ ID NO: 985859 - protein, 9 aa, Homo Sapiens
QTPNLPGSG

SEQ ID NO: 985860 - protein, 9 aa, Homo Sapiens
PQLQNIVFT

SEQ ID NO: 985861 - protein, 9 aa, Homo Sapiens
QPETNSEEE

SEQ ID NO: 985862 - protein, 9 aa, Homo Sapiens
YKRLRTREC

SEQ ID NO: 985863 - protein, 9 aa, Homo Sapiens
LIVSLLTLE

SEQ ID NO: 985864 - protein, 9 aa, Homo Sapiens
AHACPLKFE

SEQ ID NO: 985865 - protein, 9 aa, Homo Sapiens
RDTPISHQR

SEQ ID NO: 985866 - protein, 9 aa, Homo Sapiens
FLDKKNWTG

SEQ ID NO: 985867 - protein, 9 aa, Homo Sapiens
LSCGNILNM

SEQ ID NO: 985868 - protein, 9 aa, Homo Sapiens
KSEYFLRLT

SEQ ID NO: 985869 - protein, 9 aa, Homo Sapiens
IHHNLTKDP

SEQ ID NO: 985870 - protein, 9 aa, Homo Sapiens
LSVAYAASG

SEQ ID NO: 985871 - protein, 9 aa, Homo Sapiens
DCMKEGKLL

SEQ ID NO: 985872 - protein, 9 aa, Homo Sapiens
DILHQSPNI

SEQ ID NO: 985873 - protein, 9 aa, Homo Sapiens
GELPAELIR

SEQ ID NO: 985874 - protein, 9 aa, Homo Sapiens
QKPLPREQP

SEQ ID NO: 985875 - protein, 9 aa, Homo Sapiens
QIFQTQTSS

SEQ ID NO: 985876 - protein, 9 aa, Homo Sapiens
SENEDEEER

SEQ ID NO: 985877 - protein, 9 aa, Homo Sapiens
EVWEKFDPN

SEQ ID NO: 985878 - protein, 9 aa, Homo Sapiens
GPASISCAF

SEQ ID NO: 985879 - protein, 9 aa, Homo Sapiens
LLEPILFYC

SEQ ID NO: 985880 - protein, 9 aa, Homo Sapiens
RVHILFNIK

SEQ ID NO: 985881 - protein, 9 aa, Homo Sapiens
FPEVTLQLY

SEQ ID NO: 985882 - protein, 9 aa, Homo Sapiens
CLLLELCVQ

SEQ ID NO: 985883 - protein, 9 aa, Homo Sapiens
CENQIILLK

SEQ ID NO: 985884 - protein, 9 aa, Homo Sapiens
IFVRALRSL

SEQ ID NO: 985885 - protein, 9 aa, Homo Sapiens
NFIYTYIGT

SEQ ID NO: 985886 - protein, 9 aa, Homo Sapiens
NTPSTLDAY

SEQ ID NO: 985887 - protein, 9 aa, Homo Sapiens
LKAGSVFEE

SEQ ID NO: 985888 - protein, 9 aa, Homo Sapiens
SYDWRTKKP

SEQ ID NO: 985889 - protein, 9 aa, Homo Sapiens
MAPFFSDLG

SEQ ID NO: 985890 - protein, 9 aa, Homo Sapiens
PSDYYAIES

SEQ ID NO: 985891 - protein, 9 aa, Homo Sapiens
TIPVSFPAA

SEQ ID NO: 985892 - protein, 9 aa, Homo Sapiens
AKDSFSFNF

SEQ ID NO: 985893 - protein, 9 aa, Homo Sapiens
DQTQDIELV

SEQ ID NO: 985894 - protein, 9 aa, Homo Sapiens
FYPRSHFLY

SEQ ID NO: 985895 - protein, 9 aa, Homo Sapiens
EKQFHWYKD

SEQ ID NO: 985896 - protein, 9 aa, Homo Sapiens
ELSPMLPEF

SEQ ID NO: 985897 - protein, 9 aa, Homo Sapiens
VMEGNLKQK

SEQ ID NO: 985898 - protein, 9 aa, Homo Sapiens
LAERKLGAR

SEQ ID NO: 985899 - protein, 9 aa, Homo Sapiens
SAESADLGN

SEQ ID NO: 985900 - protein, 9 aa, Homo Sapiens
SKISQKKIK

SEQ ID NO: 985901 - protein, 9 aa, Homo Sapiens
GLYCEEKYN

SEQ ID NO: 985902 - protein, 9 aa, Homo Sapiens
ISRQDRSFD

SEQ ID NO: 985903 - protein, 9 aa, Homo Sapiens
EVAGEQRVM

SEQ ID NO: 985904 - protein, 9 aa, Homo Sapiens
RKQCKDEEA

SEQ ID NO: 985905 - protein, 9 aa, Homo Sapiens
LMERVEWLR

SEQ ID NO: 985906 - protein, 9 aa, Homo Sapiens
QESLPRLTN

SEQ ID NO: 985907 - protein, 9 aa, Homo Sapiens
GSHPGTLFP

SEQ ID NO: 985908 - protein, 9 aa, Homo Sapiens
SLPGKDLRA

SEQ ID NO: 985909 - protein, 9 aa, Homo Sapiens
AAVSDGFPA

SEQ ID NO: 985910 - protein, 9 aa, Homo Sapiens
EKFIIKEEM

SEQ ID NO: 985911 - protein, 9 aa, Homo Sapiens
MADQTAPRC

SEQ ID NO: 985912 - protein, 9 aa, Homo Sapiens
ENIIYFFLG

SEQ ID NO: 985913 - protein, 9 aa, Homo Sapiens
PAIRKKILS

SEQ ID NO: 985914 - protein, 9 aa, Homo Sapiens
SRSRNKKDK

SEQ ID NO: 985915 - protein, 9 aa, Homo Sapiens
REEQAYYTP

SEQ ID NO: 985916 - protein, 9 aa, Homo Sapiens
RFMVDEKNY

SEQ ID NO: 985917 - protein, 9 aa, Homo Sapiens
KRDKVTQLL

SEQ ID NO: 985918 - protein, 9 aa, Homo Sapiens
TPEIIFERD

SEQ ID NO: 985919 - protein, 9 aa, Homo Sapiens
IRTGHFWGS

SEQ ID NO: 985920 - protein, 9 aa, Homo Sapiens
ALWNWELSI

SEQ ID NO: 985921 - protein, 9 aa, Homo Sapiens
PSLPTDFCS

SEQ ID NO: 985922 - protein, 9 aa, Homo Sapiens
GIVTPMLNP

SEQ ID NO: 985923 - protein, 9 aa, Homo Sapiens
VANEKEYPL

SEQ ID NO: 985924 - protein, 9 aa, Homo Sapiens
KYNPQHSLL

SEQ ID NO: 985925 - protein, 9 aa, Homo Sapiens
KQAELSRLK

SEQ ID NO: 985926 - protein, 9 aa, Homo Sapiens
LCFISINRY

SEQ ID NO: 985927 - protein, 9 aa, Homo Sapiens
AEGKKKVEA

SEQ ID NO: 985928 - protein, 9 aa, Homo Sapiens
RCGDEGKAI

SEQ ID NO: 985929 - protein, 9 aa, Homo Sapiens
PGRIQIVTN

SEQ ID NO: 985930 - protein, 9 aa, Homo Sapiens
FKPVETPPE

SEQ ID NO: 985931 - protein, 9 aa, Homo Sapiens
AVQDVYYLP

SEQ ID NO: 985932 - protein, 9 aa, Homo Sapiens
SLELAEYSA

SEQ ID NO: 985933 - protein, 9 aa, Homo Sapiens
SSNDLGKNT

SEQ ID NO: 985934 - protein, 9 aa, Homo Sapiens
DQLFAVEGL

SEQ ID NO: 985935 - protein, 9 aa, Homo Sapiens
SWKKLLDAF

SEQ ID NO: 985936 - protein, 9 aa, Homo Sapiens
ILFYCIPTR

SEQ ID NO: 985937 - protein, 9 aa, Homo Sapiens
EIFRRAANE

SEQ ID NO: 985938 - protein, 9 aa, Homo Sapiens
VGFIDSFGP

SEQ ID NO: 985939 - protein, 9 aa, Homo Sapiens
FIDSFGPLY

SEQ ID NO: 985940 - protein, 9 aa, Homo Sapiens
HRNNVDLTE

SEQ ID NO: 985941 - protein, 9 aa, Homo Sapiens
CGPKYLEAP

SEQ ID NO: 985942 - protein, 9 aa, Homo Sapiens
PEGPITVNN

SEQ ID NO: 985943 - protein, 9 aa, Homo Sapiens
GAGSVIDLI

SEQ ID NO: 985944 - protein, 9 aa, Homo Sapiens
LWRIYYNIT

SEQ ID NO: 985945 - protein, 9 aa, Homo Sapiens
QVKKVAAQK

SEQ ID NO: 985946 - protein, 9 aa, Homo Sapiens
DLEHHINCY

SEQ ID NO: 985947 - protein, 9 aa, Homo Sapiens
LRNVNIKPD

SEQ ID NO: 985948 - protein, 9 aa, Homo Sapiens
LSSSLVPGN

SEQ ID NO: 985949 - protein, 9 aa, Homo Sapiens
LVGDLFLAL

SEQ ID NO: 985950 - protein, 9 aa, Homo Sapiens
AVKTLQEQL

SEQ ID NO: 985951 - protein, 9 aa, Homo Sapiens
ITCNAPNVN

SEQ ID NO: 985952 - protein, 9 aa, Homo Sapiens
YTPRAQALD

SEQ ID NO: 985953 - protein, 9 aa, Homo Sapiens
SRFRRISLR

SEQ ID NO: 985954 - protein, 9 aa, Homo Sapiens
VSHVNFKLH

SEQ ID NO: 985955 - protein, 9 aa, Homo Sapiens
PSGSRNVIS

SEQ ID NO: 985956 - protein, 9 aa, Homo Sapiens
QRLYIGEKP

SEQ ID NO: 985957 - protein, 9 aa, Homo Sapiens
AMAAVRDKI

SEQ ID NO: 985958 - protein, 9 aa, Homo Sapiens
CERGRENFF

SEQ ID NO: 985959 - protein, 9 aa, Homo Sapiens
IEISELIRV

SEQ ID NO: 985960 - protein, 9 aa, Homo Sapiens
DKNKGVGVF

SEQ ID NO: 985961 - protein, 9 aa, Homo Sapiens
IVELLFQRR

SEQ ID NO: 985962 - protein, 9 aa, Homo Sapiens
HLRFEKAVL

SEQ ID NO: 985963 - protein, 9 aa, Homo Sapiens
LCSYRPAPG

SEQ ID NO: 985964 - protein, 9 aa, Homo Sapiens
FGRPAELKV

SEQ ID NO: 985965 - protein, 9 aa, Homo Sapiens
NAAKASRRS

SEQ ID NO: 985966 - protein, 9 aa, Homo Sapiens
CGVIPNFLK

SEQ ID NO: 985967 - protein, 9 aa, Homo Sapiens
LIHIFILVE

SEQ ID NO: 985968 - protein, 9 aa, Homo Sapiens
GREGAKGKL

SEQ ID NO: 985969 - protein, 9 aa, Homo Sapiens
HREWNLPIY

SEQ ID NO: 985970 - protein, 9 aa, Homo Sapiens
LPRMQCQQQ

SEQ ID NO: 985971 - protein, 9 aa, Homo Sapiens
NRIQSLARN

SEQ ID NO: 985972 - protein, 9 aa, Homo Sapiens
LPALSYFSR

SEQ ID NO: 985973 - protein, 9 aa, Homo Sapiens
SKMISFSEC

SEQ ID NO: 985974 - protein, 9 aa, Homo Sapiens
ILRILSASQ

SEQ ID NO: 985975 - protein, 9 aa, Homo Sapiens
PTPSFYAPS

SEQ ID NO: 985976 - protein, 9 aa, Homo Sapiens
FLNDITQLR

SEQ ID NO: 985977 - protein, 9 aa, Homo Sapiens
EKKLLPELS

SEQ ID NO: 985978 - protein, 9 aa, Homo Sapiens
EIMKKYNIK

SEQ ID NO: 985979 - protein, 9 aa, Homo Sapiens
LVHGELRIK

SEQ ID NO: 985980 - protein, 9 aa, Homo Sapiens
IPSWFCSIL

SEQ ID NO: 985981 - protein, 9 aa, Homo Sapiens
YSAHYQFLW

SEQ ID NO: 985982 - protein, 9 aa, Homo Sapiens
GADSALFFQ

SEQ ID NO: 985983 - protein, 9 aa, Homo Sapiens
FSSKSKLQT

SEQ ID NO: 985984 - protein, 9 aa, Homo Sapiens
ATYKRLRTR

SEQ ID NO: 985985 - protein, 9 aa, Homo Sapiens
LLDRMKNYN

SEQ ID NO: 985986 - protein, 9 aa, Homo Sapiens
QCQDNTTTT

SEQ ID NO: 985987 - protein, 9 aa, Homo Sapiens
PSEGSSLTP

SEQ ID NO: 985988 - protein, 9 aa, Homo Sapiens
MRYYMPVKN

SEQ ID NO: 985989 - protein, 9 aa, Homo Sapiens
RKATFLDAW

SEQ ID NO: 985990 - protein, 9 aa, Homo Sapiens
FIDDGGFNL

SEQ ID NO: 985991 - protein, 9 aa, Homo Sapiens
GYDLVTEEQ

SEQ ID NO: 985992 - protein, 9 aa, Homo Sapiens
FCELPCENQ

SEQ ID NO: 985993 - protein, 9 aa, Homo Sapiens
LEVLKRDKV

SEQ ID NO: 985994 - protein, 9 aa, Homo Sapiens
LSKFNLCGK

SEQ ID NO: 985995 - protein, 9 aa, Homo Sapiens
PHRPGSQKV

SEQ ID NO: 985996 - protein, 9 aa, Homo Sapiens
EGLRHLMFY

SEQ ID NO: 985997 - protein, 9 aa, Homo Sapiens
NHSGVRNVG

SEQ ID NO: 985998 - protein, 9 aa, Homo Sapiens
DQLCARCSP

SEQ ID NO: 985999 - protein, 9 aa, Homo Sapiens
LPPGPPTRA

SEQ ID NO: 986000 - protein, 9 aa, Homo Sapiens
NIDSKERLD

SEQ ID NO: 986001 - protein, 9 aa, Homo Sapiens
LGNESFLMD

SEQ ID NO: 986002 - protein, 9 aa, Homo Sapiens
DAISYSDKG

SEQ ID NO: 986003 - protein, 9 aa, Homo Sapiens
GRLKEQLGR

SEQ ID NO: 986004 - protein, 9 aa, Homo Sapiens
VQSKIEQLR

SEQ ID NO: 986005 - protein, 9 aa, Homo Sapiens
ASYRGISCY

SEQ ID NO: 986006 - protein, 9 aa, Homo Sapiens
GNVFRNTQF

SEQ ID NO: 986007 - protein, 9 aa, Homo Sapiens
KVPSISYLC

SEQ ID NO: 986008 - protein, 9 aa, Homo Sapiens
LRQNVEETM

SEQ ID NO: 986009 - protein, 9 aa, Homo Sapiens
PSPSCQPYL

SEQ ID NO: 986010 - protein, 9 aa, Homo Sapiens
LRILVVVEL

SEQ ID NO: 986011 - protein, 9 aa, Homo Sapiens
NVNIKPDDE

SEQ ID NO: 986012 - protein, 9 aa, Homo Sapiens
SRRLVKIST

SEQ ID NO: 986013 - protein, 9 aa, Homo Sapiens
GADAGKLCP

SEQ ID NO: 986014 - protein, 9 aa, Homo Sapiens
SAAVSDGFP

SEQ ID NO: 986015 - protein, 9 aa, Homo Sapiens
AGKHVFVEY

SEQ ID NO: 986016 - protein, 9 aa, Homo Sapiens
KLRRADIHL

SEQ ID NO: 986017 - protein, 9 aa, Homo Sapiens
SDEIREDYL

SEQ ID NO: 986018 - protein, 9 aa, Homo Sapiens
GQVVSLILL

SEQ ID NO: 986019 - protein, 9 aa, Homo Sapiens
KKKVKGSPS

SEQ ID NO: 986020 - protein, 9 aa, Homo Sapiens
LALNEDPRS

SEQ ID NO: 986021 - protein, 9 aa, Homo Sapiens
FQNQRVKDK

SEQ ID NO: 986022 - protein, 9 aa, Homo Sapiens
WNYRHLPLC

SEQ ID NO: 986023 - protein, 9 aa, Homo Sapiens
PGFPGIEKP

SEQ ID NO: 986024 - protein, 9 aa, Homo Sapiens
DPHRPGSQK

SEQ ID NO: 986025 - protein, 9 aa, Homo Sapiens
KASFRVHIL

SEQ ID NO: 986026 - protein, 9 aa, Homo Sapiens
MDRIENDRL

SEQ ID NO: 986027 - protein, 9 aa, Homo Sapiens
LSLPRAVLA

SEQ ID NO: 986028 - protein, 9 aa, Homo Sapiens
LCRALEGGQ

SEQ ID NO: 986029 - protein, 9 aa, Homo Sapiens
NTKVDFGHC

SEQ ID NO: 986030 - protein, 9 aa, Homo Sapiens
KSVPEKNRT

SEQ ID NO: 986031 - protein, 9 aa, Homo Sapiens
NHDIANKVF

SEQ ID NO: 986032 - protein, 9 aa, Homo Sapiens
FVYTLPLER

SEQ ID NO: 986033 - protein, 9 aa, Homo Sapiens
AFPSDYYAI

SEQ ID NO: 986034 - protein, 9 aa, Homo Sapiens
LALIKKPTV

SEQ ID NO: 986035 - protein, 9 aa, Homo Sapiens
KPDDESSSG

SEQ ID NO: 986036 - protein, 9 aa, Homo Sapiens
EHSKARYLP

SEQ ID NO: 986037 - protein, 9 aa, Homo Sapiens
RRAPSFSVQ

SEQ ID NO: 986038 - protein, 9 aa, Homo Sapiens
GSYQNTKKN

SEQ ID NO: 986039 - protein, 9 aa, Homo Sapiens
MSSLWEMVQ

SEQ ID NO: 986040 - protein, 9 aa, Homo Sapiens
FSYGTRRSP

SEQ ID NO: 986041 - protein, 9 aa, Homo Sapiens
VNYFKFKPV

SEQ ID NO: 986042 - protein, 9 aa, Homo Sapiens
YSACCGGFC

SEQ ID NO: 986043 - protein, 9 aa, Homo Sapiens
QAVPEGAEA

SEQ ID NO: 986044 - protein, 9 aa, Homo Sapiens
GGLVNYFKF

SEQ ID NO: 986045 - protein, 9 aa, Homo Sapiens
KLQNERKND

SEQ ID NO: 986046 - protein, 9 aa, Homo Sapiens
VPLVAPRPP

SEQ ID NO: 986047 - protein, 9 aa, Homo Sapiens
KMKGFDVLN

SEQ ID NO: 986048 - protein, 9 aa, Homo Sapiens
VEYRINKSA

SEQ ID NO: 986049 - protein, 9 aa, Homo Sapiens
IDNFNVDGS

SEQ ID NO: 986050 - protein, 9 aa, Homo Sapiens
KKPFHSVPF

SEQ ID NO: 986051 - protein, 9 aa, Homo Sapiens
RLFTGKILR

SEQ ID NO: 986052 - protein, 9 aa, Homo Sapiens
QAEHAAKYL

SEQ ID NO: 986053 - protein, 9 aa, Homo Sapiens
LDNCGNCVP

SEQ ID NO: 986054 - protein, 9 aa, Homo Sapiens
NRLRYPVIM

SEQ ID NO: 986055 - protein, 9 aa, Homo Sapiens
GESVTAMEF

SEQ ID NO: 986056 - protein, 9 aa, Homo Sapiens
KNLLKDLKD

SEQ ID NO: 986057 - protein, 9 aa, Homo Sapiens
DAWNRELLN

SEQ ID NO: 986058 - protein, 9 aa, Homo Sapiens
RFEAQKGPI

SEQ ID NO: 986059 - protein, 9 aa, Homo Sapiens
SEPTNNTPK

SEQ ID NO: 986060 - protein, 9 aa, Homo Sapiens
LCLSCADWF

SEQ ID NO: 986061 - protein, 9 aa, Homo Sapiens
CNAPNVNTT

SEQ ID NO: 986062 - protein, 9 aa, Homo Sapiens
GLEVISPTK

SEQ ID NO: 986063 - protein, 9 aa, Homo Sapiens
AIKVKTGAL

SEQ ID NO: 986064 - protein, 9 aa, Homo Sapiens
VHILFNIKE

SEQ ID NO: 986065 - protein, 9 aa, Homo Sapiens
KELQRLHSQ

SEQ ID NO: 986066 - protein, 9 aa, Homo Sapiens
ENSLHPIVR

SEQ ID NO: 986067 - protein, 9 aa, Homo Sapiens
GLMEIIAFA

SEQ ID NO: 986068 - protein, 9 aa, Homo Sapiens
KANASAPAF

SEQ ID NO: 986069 - protein, 9 aa, Homo Sapiens
RPSRRHFSR

SEQ ID NO: 986070 - protein, 9 aa, Homo Sapiens
SDKNKGVGV

SEQ ID NO: 986071 - protein, 9 aa, Homo Sapiens
EEKEEEKEE

SEQ ID NO: 986072 - protein, 9 aa, Homo Sapiens
RIGRICLNN

SEQ ID NO: 986073 - protein, 9 aa, Homo Sapiens
NAMDSKIRF

SEQ ID NO: 986074 - protein, 9 aa, Homo Sapiens
VAVKTLQEQ

SEQ ID NO: 986075 - protein, 9 aa, Homo Sapiens
ALQDKLRTQ

SEQ ID NO: 986076 - protein, 9 aa, Homo Sapiens
DGNEDTDSA

SEQ ID NO: 986077 - protein, 9 aa, Homo Sapiens
HLPLCPANF

SEQ ID NO: 986078 - protein, 9 aa, Homo Sapiens
VEAAEPATT

SEQ ID NO: 986079 - protein, 9 aa, Homo Sapiens
RSVQTTLKQ

SEQ ID NO: 986080 - protein, 9 aa, Homo Sapiens
LPTDFCSSL

SEQ ID NO: 986081 - protein, 9 aa, Homo Sapiens
FCMNDDATQ

SEQ ID NO: 986082 - protein, 9 aa, Homo Sapiens
TRNCLFLLL

SEQ ID NO: 986083 - protein, 9 aa, Homo Sapiens
FFFLRRLIT

SEQ ID NO: 986084 - protein, 9 aa, Homo Sapiens
SLVPGNPFE

SEQ ID NO: 986085 - protein, 9 aa, Homo Sapiens
TKISRDLDE

SEQ ID NO: 986086 - protein, 9 aa, Homo Sapiens
DLKKEHKSS

SEQ ID NO: 986087 - protein, 9 aa, Homo Sapiens
QGKLRENPH

SEQ ID NO: 986088 - protein, 9 aa, Homo Sapiens
NPYLIYDKT

SEQ ID NO: 986089 - protein, 9 aa, Homo Sapiens
LSVIVPKFE

SEQ ID NO: 986090 - protein, 9 aa, Homo Sapiens
FKAERNMRR

SEQ ID NO: 986091 - protein, 9 aa, Homo Sapiens
EECWNEHSK

SEQ ID NO: 986092 - protein, 9 aa, Homo Sapiens
DFCSSLAQG

SEQ ID NO: 986093 - protein, 9 aa, Homo Sapiens
QSSVTLTES

SEQ ID NO: 986094 - protein, 9 aa, Homo Sapiens
CALCQGNGV

SEQ ID NO: 986095 - protein, 9 aa, Homo Sapiens
FGYRSLELA

SEQ ID NO: 986096 - protein, 9 aa, Homo Sapiens
NCGNCVPLP

SEQ ID NO: 986097 - protein, 9 aa, Homo Sapiens
YFNAMTSLS

SEQ ID NO: 986098 - protein, 9 aa, Homo Sapiens
RNEISLIHF

SEQ ID NO: 986099 - protein, 9 aa, Homo Sapiens
SSATEKLQG

SEQ ID NO: 986100 - protein, 9 aa, Homo Sapiens
LYKLGERLA

SEQ ID NO: 986101 - protein, 9 aa, Homo Sapiens
VEPKVEKKW

SEQ ID NO: 986102 - protein, 9 aa, Homo Sapiens
TQFLIQYQN

SEQ ID NO: 986103 - protein, 9 aa, Homo Sapiens
YRQQSRKYP

SEQ ID NO: 986104 - protein, 9 aa, Homo Sapiens
TSNGQVLDT

SEQ ID NO: 986105 - protein, 9 aa, Homo Sapiens
NEKPVTTGV

SEQ ID NO: 986106 - protein, 9 aa, Homo Sapiens
TPGSPGPKG

SEQ ID NO: 986107 - protein, 9 aa, Homo Sapiens
NIKENAICS

SEQ ID NO: 986108 - protein, 9 aa, Homo Sapiens
RLYIGEKPF

SEQ ID NO: 986109 - protein, 9 aa, Homo Sapiens
PIRSPAMSE

SEQ ID NO: 986110 - protein, 9 aa, Homo Sapiens
SKRKGEEGT

SEQ ID NO: 986111 - protein, 9 aa, Homo Sapiens
NLFRALWRS

SEQ ID NO: 986112 - protein, 9 aa, Homo Sapiens
ATRSSVSSV

SEQ ID NO: 986113 - protein, 9 aa, Homo Sapiens
PPILYWFYY

SEQ ID NO: 986114 - protein, 9 aa, Homo Sapiens
PKMLVHFLS

SEQ ID NO: 986115 - protein, 9 aa, Homo Sapiens
GPAGPPESQ

SEQ ID NO: 986116 - protein, 9 aa, Homo Sapiens
LLVGEDAHL

SEQ ID NO: 986117 - protein, 9 aa, Homo Sapiens
WLDSNLDQI

SEQ ID NO: 986118 - protein, 9 aa, Homo Sapiens
DGLTVSSSS

SEQ ID NO: 986119 - protein, 9 aa, Homo Sapiens
CLNNDGGHC

SEQ ID NO: 986120 - protein, 9 aa, Homo Sapiens
TAILGAIKE

SEQ ID NO: 986121 - protein, 9 aa, Homo Sapiens
ATPLFVPTQ

SEQ ID NO: 986122 - protein, 9 aa, Homo Sapiens
EEKKEKYAE

SEQ ID NO: 986123 - protein, 9 aa, Homo Sapiens
GSVTLQKNS

SEQ ID NO: 986124 - protein, 9 aa, Homo Sapiens
SRLLPFEPD

SEQ ID NO: 986125 - protein, 9 aa, Homo Sapiens
VSTLGKRVV

SEQ ID NO: 986126 - protein, 9 aa, Homo Sapiens
PQASRVLSA

SEQ ID NO: 986127 - protein, 9 aa, Homo Sapiens
AQGPENGCR

SEQ ID NO: 986128 - protein, 9 aa, Homo Sapiens
LVITSTPSA

SEQ ID NO: 986129 - protein, 9 aa, Homo Sapiens
QPLREGALV

SEQ ID NO: 986130 - protein, 9 aa, Homo Sapiens
AILWLLCSY

SEQ ID NO: 986131 - protein, 9 aa, Homo Sapiens
NEFISESSS

SEQ ID NO: 986132 - protein, 9 aa, Homo Sapiens
EVRCVPPRF

SEQ ID NO: 986133 - protein, 9 aa, Homo Sapiens
KQKGRCSVP

SEQ ID NO: 986134 - protein, 9 aa, Homo Sapiens
FKEDRSSYP

SEQ ID NO: 986135 - protein, 9 aa, Homo Sapiens
IQLPSNYLL

SEQ ID NO: 986136 - protein, 9 aa, Homo Sapiens
EDNMNDRKL

SEQ ID NO: 986137 - protein, 9 aa, Homo Sapiens
QQRLAVILE

SEQ ID NO: 986138 - protein, 9 aa, Homo Sapiens
FHFLGGADV

SEQ ID NO: 986139 - protein, 9 aa, Homo Sapiens
VVLSYRAED

SEQ ID NO: 986140 - protein, 9 aa, Homo Sapiens
PPSSPDLGR

SEQ ID NO: 986141 - protein, 9 aa, Homo Sapiens
CHQEGGSCP

SEQ ID NO: 986142 - protein, 9 aa, Homo Sapiens
RSRNSSLLE

SEQ ID NO: 986143 - protein, 9 aa, Homo Sapiens
KSELDKRAV

SEQ ID NO: 986144 - protein, 9 aa, Homo Sapiens
SLIIDMVSD

SEQ ID NO: 986145 - protein, 9 aa, Homo Sapiens
FQDYMDPSQ

SEQ ID NO: 986146 - protein, 9 aa, Homo Sapiens
SLLTLELSY

SEQ ID NO: 986147 - protein, 9 aa, Homo Sapiens
DYLVGNKLR

SEQ ID NO: 986148 - protein, 9 aa, Homo Sapiens
PLFIPPLKV

SEQ ID NO: 986149 - protein, 9 aa, Homo Sapiens
GKEEFVTTF

SEQ ID NO: 986150 - protein, 9 aa, Homo Sapiens
IAEVKSKKQ

SEQ ID NO: 986151 - protein, 9 aa, Homo Sapiens
SPTCHFNDG

SEQ ID NO: 986152 - protein, 9 aa, Homo Sapiens
ESFLMDFIL

SEQ ID NO: 986153 - protein, 9 aa, Homo Sapiens
GSVFEEISL

SEQ ID NO: 986154 - protein, 9 aa, Homo Sapiens
LIGLLQAKE

SEQ ID NO: 986155 - protein, 9 aa, Homo Sapiens
KKSLTSNYQ

SEQ ID NO: 986156 - protein, 9 aa, Homo Sapiens
SHPGTLFPL

SEQ ID NO: 986157 - protein, 9 aa, Homo Sapiens
FLFLISGKP

SEQ ID NO: 986158 - protein, 9 aa, Homo Sapiens
SGPPLFIPP

SEQ ID NO: 986159 - protein, 9 aa, Homo Sapiens
CELPCENQI

SEQ ID NO: 986160 - protein, 9 aa, Homo Sapiens
NEERLSYDC

SEQ ID NO: 986161 - protein, 9 aa, Homo Sapiens
KLAQLITQT

SEQ ID NO: 986162 - protein, 9 aa, Homo Sapiens
FFSVFYFAS

SEQ ID NO: 986163 - protein, 9 aa, Homo Sapiens
SCALVQTAP

SEQ ID NO: 986164 - protein, 9 aa, Homo Sapiens
NDYKNINVS

SEQ ID NO: 986165 - protein, 9 aa, Homo Sapiens
IEVMSLGQC

SEQ ID NO: 986166 - protein, 9 aa, Homo Sapiens
YNEEGSQIY

SEQ ID NO: 986167 - protein, 9 aa, Homo Sapiens
RDSDVESDA

SEQ ID NO: 986168 - protein, 9 aa, Homo Sapiens
AYKESCFVY

SEQ ID NO: 986169 - protein, 9 aa, Homo Sapiens
TLTYTLMGK

SEQ ID NO: 986170 - protein, 9 aa, Homo Sapiens
CNLLSLKEW

SEQ ID NO: 986171 - protein, 9 aa, Homo Sapiens
LGTSTPCDF

SEQ ID NO: 986172 - protein, 9 aa, Homo Sapiens
SSFSNSFPQ

SEQ ID NO: 986173 - protein, 9 aa, Homo Sapiens
AFILNSLYN

SEQ ID NO: 986174 - protein, 9 aa, Homo Sapiens
FCGAGSVID

SEQ ID NO: 986175 - protein, 9 aa, Homo Sapiens
KFEVVLYLN

SEQ ID NO: 986176 - protein, 9 aa, Homo Sapiens
LFRAKNVQL

SEQ ID NO: 986177 - protein, 9 aa, Homo Sapiens
AHSKVEKNP

SEQ ID NO: 986178 - protein, 9 aa, Homo Sapiens
RYLEQQNKV

SEQ ID NO: 986179 - protein, 9 aa, Homo Sapiens
LSIILCKKS

SEQ ID NO: 986180 - protein, 9 aa, Homo Sapiens
SSPFSGRSA

SEQ ID NO: 986181 - protein, 9 aa, Homo Sapiens
GRAGRLKEQ

SEQ ID NO: 986182 - protein, 9 aa, Homo Sapiens
GHRIIEINR

SEQ ID NO: 986183 - protein, 9 aa, Homo Sapiens
IGWDENQAL

SEQ ID NO: 986184 - protein, 9 aa, Homo Sapiens
ECGKFFNHS

SEQ ID NO: 986185 - protein, 9 aa, Homo Sapiens
SQNSRMTFR

SEQ ID NO: 986186 - protein, 9 aa, Homo Sapiens
WKRDGRCAT

SEQ ID NO: 986187 - protein, 9 aa, Homo Sapiens
HKDSDAVPF

SEQ ID NO: 986188 - protein, 9 aa, Homo Sapiens
DSSGLTFTV

SEQ ID NO: 986189 - protein, 9 aa, Homo Sapiens
SIHWLFMGY

SEQ ID NO: 986190 - protein, 9 aa, Homo Sapiens
SSEVPYLHF

SEQ ID NO: 986191 - protein, 9 aa, Homo Sapiens
SYRAEDHRA

SEQ ID NO: 986192 - protein, 9 aa, Homo Sapiens
LPLCPANFL

SEQ ID NO: 986193 - protein, 9 aa, Homo Sapiens
VDECASALC

SEQ ID NO: 986194 - protein, 9 aa, Homo Sapiens
YIGEKPFKC

SEQ ID NO: 986195 - protein, 9 aa, Homo Sapiens
RVGKRIIEE

SEQ ID NO: 986196 - protein, 9 aa, Homo Sapiens
LTCELSQNK

SEQ ID NO: 986197 - protein, 9 aa, Homo Sapiens
FFIILLTIN

SEQ ID NO: 986198 - protein, 9 aa, Homo Sapiens
PTEEANLLT

SEQ ID NO: 986199 - protein, 9 aa, Homo Sapiens
ALNLCSIPV

SEQ ID NO: 986200 - protein, 9 aa, Homo Sapiens
PPLSVIVPK

SEQ ID NO: 986201 - protein, 9 aa, Homo Sapiens
EHAAKYLPV

SEQ ID NO: 986202 - protein, 9 aa, Homo Sapiens
QENGFLSLL

SEQ ID NO: 986203 - protein, 9 aa, Homo Sapiens
VPNATIFPG

SEQ ID NO: 986204 - protein, 9 aa, Homo Sapiens
EREELLLLK

SEQ ID NO: 986205 - protein, 9 aa, Homo Sapiens
DPVLGEIDP

SEQ ID NO: 986206 - protein, 9 aa, Homo Sapiens
DTAPQLRAK

SEQ ID NO: 986207 - protein, 9 aa, Homo Sapiens
QVGLTQYSR

SEQ ID NO: 986208 - protein, 9 aa, Homo Sapiens
QPTLDLSRS

SEQ ID NO: 986209 - protein, 9 aa, Homo Sapiens
VRWCRPDCR

SEQ ID NO: 986210 - protein, 9 aa, Homo Sapiens
LLFQRRNPG

SEQ ID NO: 986211 - protein, 9 aa, Homo Sapiens
APNVNTTSA

SEQ ID NO: 986212 - protein, 9 aa, Homo Sapiens
NDITQLRNN

SEQ ID NO: 986213 - protein, 9 aa, Homo Sapiens
FTYMGYGIE

SEQ ID NO: 986214 - protein, 9 aa, Homo Sapiens
KMLVHFLSE

SEQ ID NO: 986215 - protein, 9 aa, Homo Sapiens
KLDLGKKVE

SEQ ID NO: 986216 - protein, 9 aa, Homo Sapiens
SPDYPNLMF

SEQ ID NO: 986217 - protein, 9 aa, Homo Sapiens
YSTDYNLVQ

SEQ ID NO: 986218 - protein, 9 aa, Homo Sapiens
ELSEGEDPI

SEQ ID NO: 986219 - protein, 9 aa, Homo Sapiens
PAAESVNNN

SEQ ID NO: 986220 - protein, 9 aa, Homo Sapiens
MKPPETSVS

SEQ ID NO: 986221 - protein, 9 aa, Homo Sapiens
DRNQSREHM

SEQ ID NO: 986222 - protein, 9 aa, Homo Sapiens
AAITCNAPN

SEQ ID NO: 986223 - protein, 9 aa, Homo Sapiens
IFYPPLHEW

SEQ ID NO: 986224 - protein, 9 aa, Homo Sapiens
QFLHGQKGQ

SEQ ID NO: 986225 - protein, 9 aa, Homo Sapiens
SRGVSRSLW

SEQ ID NO: 986226 - protein, 9 aa, Homo Sapiens
RQNVEETMS

SEQ ID NO: 986227 - protein, 9 aa, Homo Sapiens
LKIQERWGT

SEQ ID NO: 986228 - protein, 9 aa, Homo Sapiens
RLSCCVSTC

SEQ ID NO: 986229 - protein, 9 aa, Homo Sapiens
GVPEIPGAK

SEQ ID NO: 986230 - protein, 9 aa, Homo Sapiens
AIRKKILSP

SEQ ID NO: 986231 - protein, 9 aa, Homo Sapiens
VRLAIALQD

SEQ ID NO: 986232 - protein, 9 aa, Homo Sapiens
LAQKKERWI

SEQ ID NO: 986233 - protein, 9 aa, Homo Sapiens
HAHSKVEKN

SEQ ID NO: 986234 - protein, 9 aa, Homo Sapiens
EEAKSYKIQ

SEQ ID NO: 986235 - protein, 9 aa, Homo Sapiens
RPLGILPPG

SEQ ID NO: 986236 - protein, 9 aa, Homo Sapiens
LCQGNGVPV

SEQ ID NO: 986237 - protein, 9 aa, Homo Sapiens
NRGFKAERN

SEQ ID NO: 986238 - protein, 9 aa, Homo Sapiens
LARLEEEVR

SEQ ID NO: 986239 - protein, 9 aa, Homo Sapiens
RTAMDHGAI

SEQ ID NO: 986240 - protein, 9 aa, Homo Sapiens
FLMNFKDSK

SEQ ID NO: 986241 - protein, 9 aa, Homo Sapiens
LSTQPETNS

SEQ ID NO: 986242 - protein, 9 aa, Homo Sapiens
DLVTEEQAP

SEQ ID NO: 986243 - protein, 9 aa, Homo Sapiens
TLFPLKIAQ

SEQ ID NO: 986244 - protein, 9 aa, Homo Sapiens
RPDYPTRPT

SEQ ID NO: 986245 - protein, 9 aa, Homo Sapiens
IKTENLAEK

SEQ ID NO: 986246 - protein, 9 aa, Homo Sapiens
NFNGNNRGY

SEQ ID NO: 986247 - protein, 9 aa, Homo Sapiens
SPSLRFPMY

SEQ ID NO: 986248 - protein, 9 aa, Homo Sapiens
SSQESYAHE

SEQ ID NO: 986249 - protein, 9 aa, Homo Sapiens
PLSVIVPKF

SEQ ID NO: 986250 - protein, 9 aa, Homo Sapiens
LKKYENLLA

SEQ ID NO: 986251 - protein, 9 aa, Homo Sapiens
MMRRMGFPG

SEQ ID NO: 986252 - protein, 9 aa, Homo Sapiens
KNKGVGVFN

SEQ ID NO: 986253 - protein, 9 aa, Homo Sapiens
RFRRISLRK

SEQ ID NO: 986254 - protein, 9 aa, Homo Sapiens
EHETQVVVR

SEQ ID NO: 986255 - protein, 9 aa, Homo Sapiens
RHYQQRLAV

SEQ ID NO: 986256 - protein, 9 aa, Homo Sapiens
SNEEECWNE

SEQ ID NO: 986257 - protein, 9 aa, Homo Sapiens
VYFDAQKEI

SEQ ID NO: 986258 - protein, 9 aa, Homo Sapiens
KMRYYMPVK

SEQ ID NO: 986259 - protein, 9 aa, Homo Sapiens
EMVTLLDKL

SEQ ID NO: 986260 - protein, 9 aa, Homo Sapiens
FISINRYIA

SEQ ID NO: 986261 - protein, 9 aa, Homo Sapiens
LLRHLVQEK

SEQ ID NO: 986262 - protein, 9 aa, Homo Sapiens
SLVNPLKPL

SEQ ID NO: 986263 - protein, 9 aa, Homo Sapiens
TRDHNAWKQ

SEQ ID NO: 986264 - protein, 9 aa, Homo Sapiens
SGQSSGFRQ

SEQ ID NO: 986265 - protein, 9 aa, Homo Sapiens
SELPGTETA

SEQ ID NO: 986266 - protein, 9 aa, Homo Sapiens
IAAEKIIWN

SEQ ID NO: 986267 - protein, 9 aa, Homo Sapiens
RIATPLFVP

SEQ ID NO: 986268 - protein, 9 aa, Homo Sapiens
GFISKQKLG

SEQ ID NO: 986269 - protein, 9 aa, Homo Sapiens
FPSMPFSAS

SEQ ID NO: 986270 - protein, 9 aa, Homo Sapiens
PQTAAQDLQ

SEQ ID NO: 986271 - protein, 9 aa, Homo Sapiens
RATANRLRS

SEQ ID NO: 986272 - protein, 9 aa, Homo Sapiens
GLVNYFKFK

SEQ ID NO: 986273 - protein, 9 aa, Homo Sapiens
AKVETKTMS

SEQ ID NO: 986274 - protein, 9 aa, Homo Sapiens
RLHPVQEKI

SEQ ID NO: 986275 - protein, 9 aa, Homo Sapiens
GFSSSLLTQ

SEQ ID NO: 986276 - protein, 9 aa, Homo Sapiens
FFFFLIVYL

SEQ ID NO: 986277 - protein, 9 aa, Homo Sapiens
ARSRFRRIS

SEQ ID NO: 986278 - protein, 9 aa, Homo Sapiens
DTPTSSLNS

SEQ ID NO: 986279 - protein, 9 aa, Homo Sapiens
PGIEKPGVA

SEQ ID NO: 986280 - protein, 9 aa, Homo Sapiens
PELLDSVWP

SEQ ID NO: 986281 - protein, 9 aa, Homo Sapiens
KDEGAEMSQ

SEQ ID NO: 986282 - protein, 9 aa, Homo Sapiens
GWSQNLFRA

SEQ ID NO: 986283 - protein, 9 aa, Homo Sapiens
KIRGYVIIK

SEQ ID NO: 986284 - protein, 9 aa, Homo Sapiens
GPQGITGKP

SEQ ID NO: 986285 - protein, 9 aa, Homo Sapiens
RSLPGKDLR

SEQ ID NO: 986286 - protein, 9 aa, Homo Sapiens
NVTSVGKAS

SEQ ID NO: 986287 - protein, 9 aa, Homo Sapiens
TGHFWGSVT

SEQ ID NO: 986288 - protein, 9 aa, Homo Sapiens
PFFSDLGSE

SEQ ID NO: 986289 - protein, 9 aa, Homo Sapiens
NNETFGQYS

SEQ ID NO: 986290 - protein, 9 aa, Homo Sapiens
SYNPRDRIH

SEQ ID NO: 986291 - protein, 9 aa, Homo Sapiens
LFGYRSLEL

SEQ ID NO: 986292 - protein, 9 aa, Homo Sapiens
LSRRNEISL

SEQ ID NO: 986293 - protein, 9 aa, Homo Sapiens
QIPSLPTDF

SEQ ID NO: 986294 - protein, 9 aa, Homo Sapiens
CRTTCYRLS

SEQ ID NO: 986295 - protein, 9 aa, Homo Sapiens
QNKQNLIAE

SEQ ID NO: 986296 - protein, 9 aa, Homo Sapiens
IIQLPSNYL

SEQ ID NO: 986297 - protein, 9 aa, Homo Sapiens
PEVSAFFGV

SEQ ID NO: 986298 - protein, 9 aa, Homo Sapiens
TKTTPHTQK

SEQ ID NO: 986299 - protein, 9 aa, Homo Sapiens
YKCEECGKF

SEQ ID NO: 986300 - protein, 9 aa, Homo Sapiens
EMSSLWEMV

SEQ ID NO: 986301 - protein, 9 aa, Homo Sapiens
WLVEKNLGK

SEQ ID NO: 986302 - protein, 9 aa, Homo Sapiens
AEFLLPAIF

SEQ ID NO: 986303 - protein, 9 aa, Homo Sapiens
DNDHLFALR

SEQ ID NO: 986304 - protein, 9 aa, Homo Sapiens
QETLVNSSI

SEQ ID NO: 986305 - protein, 9 aa, Homo Sapiens
PHPLLSAPP

SEQ ID NO: 986306 - protein, 9 aa, Homo Sapiens
NDNVAEIVS

SEQ ID NO: 986307 - protein, 9 aa, Homo Sapiens
NQIILLKGC

SEQ ID NO: 986308 - protein, 9 aa, Homo Sapiens
YAQFSTHHV

SEQ ID NO: 986309 - protein, 9 aa, Homo Sapiens
DQCMTALNL

SEQ ID NO: 986310 - protein, 9 aa, Homo Sapiens
FMVDEKNYT

SEQ ID NO: 986311 - protein, 9 aa, Homo Sapiens
VLLPVPRSC

SEQ ID NO: 986312 - protein, 9 aa, Homo Sapiens
RSSSLLRCC

SEQ ID NO: 986313 - protein, 9 aa, Homo Sapiens
SPLAPGFLH

SEQ ID NO: 986314 - protein, 9 aa, Homo Sapiens
QEGAKRPLP

SEQ ID NO: 986315 - protein, 9 aa, Homo Sapiens
AGGKFVSEG

SEQ ID NO: 986316 - protein, 9 aa, Homo Sapiens
ELACTNTHT

SEQ ID NO: 986317 - protein, 9 aa, Homo Sapiens
KDSTLRRLH

SEQ ID NO: 986318 - protein, 9 aa, Homo Sapiens
EDPVLGEID

SEQ ID NO: 986319 - protein, 9 aa, Homo Sapiens
KTTFNEKGK

SEQ ID NO: 986320 - protein, 9 aa, Homo Sapiens
YQNTKKNLC

SEQ ID NO: 986321 - protein, 9 aa, Homo Sapiens
CAFFLARLG

SEQ ID NO: 986322 - protein, 9 aa, Homo Sapiens
EIDPLCCVW

SEQ ID NO: 986323 - protein, 9 aa, Homo Sapiens
DVSQEEFLF

SEQ ID NO: 986324 - protein, 9 aa, Homo Sapiens
WRRAPSFSV

SEQ ID NO: 986325 - protein, 9 aa, Homo Sapiens
VEILDTNNN

SEQ ID NO: 986326 - protein, 9 aa, Homo Sapiens
YRAEDHRAL

SEQ ID NO: 986327 - protein, 9 aa, Homo Sapiens
SKFNLCGKV

SEQ ID NO: 986328 - protein, 9 aa, Homo Sapiens
QVEYRINKS

SEQ ID NO: 986329 - protein, 9 aa, Homo Sapiens
TVSFMALAR

SEQ ID NO: 986330 - protein, 9 aa, Homo Sapiens
IDMSLASFV

SEQ ID NO: 986331 - protein, 9 aa, Homo Sapiens
ERVIPIKRA

SEQ ID NO: 986332 - protein, 9 aa, Homo Sapiens
NKEKFVYTL

SEQ ID NO: 986333 - protein, 9 aa, Homo Sapiens
PPEDKALLK

SEQ ID NO: 986334 - protein, 9 aa, Homo Sapiens
PTQQTLYFD

SEQ ID NO: 986335 - protein, 9 aa, Homo Sapiens
SPCTPLLSM

SEQ ID NO: 986336 - protein, 9 aa, Homo Sapiens
GLVGDLFLA

SEQ ID NO: 986337 - protein, 9 aa, Homo Sapiens
RGVLKCNIS

SEQ ID NO: 986338 - protein, 9 aa, Homo Sapiens
NYKIRGYVI

SEQ ID NO: 986339 - protein, 9 aa, Homo Sapiens
SACCGGFCR

SEQ ID NO: 986340 - protein, 9 aa, Homo Sapiens
TLRSKFMTS

SEQ ID NO: 986341 - protein, 9 aa, Homo Sapiens
DVGFIDSFG

SEQ ID NO: 986342 - protein, 9 aa, Homo Sapiens
PQCPDSVTY

SEQ ID NO: 986343 - protein, 9 aa, Homo Sapiens
RHAMALSER

SEQ ID NO: 986344 - protein, 9 aa, Homo Sapiens
DFFGIGVSV

SEQ ID NO: 986345 - protein, 9 aa, Homo Sapiens
GLMTAFFWI

SEQ ID NO: 986346 - protein, 9 aa, Homo Sapiens
LLVLEKTSD

SEQ ID NO: 986347 - protein, 9 aa, Homo Sapiens
DEYNEVAMP

SEQ ID NO: 986348 - protein, 9 aa, Homo Sapiens
KEKKIYRWP

SEQ ID NO: 986349 - protein, 9 aa, Homo Sapiens
YINTLFSTE

SEQ ID NO: 986350 - protein, 9 aa, Homo Sapiens
QSRKYPDSH

SEQ ID NO: 986351 - protein, 9 aa, Homo Sapiens
QAQLKELCY

SEQ ID NO: 986352 - protein, 9 aa, Homo Sapiens
QPRRPIRAM

SEQ ID NO: 986353 - protein, 9 aa, Homo Sapiens
TLDLSRSCQ

SEQ ID NO: 986354 - protein, 9 aa, Homo Sapiens
NFTATQEMV

SEQ ID NO: 986355 - protein, 9 aa, Homo Sapiens
HFNDGDEVV

SEQ ID NO: 986356 - protein, 9 aa, Homo Sapiens
PREQPRRPI

SEQ ID NO: 986357 - protein, 9 aa, Homo Sapiens
NGPSAALVI

SEQ ID NO: 986358 - protein, 9 aa, Homo Sapiens
QNTTLRDVL

SEQ ID NO: 986359 - protein, 9 aa, Homo Sapiens
VTEEQAPEK

SEQ ID NO: 986360 - protein, 9 aa, Homo Sapiens
ALDAISYSD

SEQ ID NO: 986361 - protein, 9 aa, Homo Sapiens
AYGEDENPL

SEQ ID NO: 986362 - protein, 9 aa, Homo Sapiens
MTSLILVGP

SEQ ID NO: 986363 - protein, 9 aa, Homo Sapiens
GRVFLVTVG

SEQ ID NO: 986364 - protein, 9 aa, Homo Sapiens
LDRQSSVTL

SEQ ID NO: 986365 - protein, 9 aa, Homo Sapiens
EAAITCNAP

SEQ ID NO: 986366 - protein, 9 aa, Homo Sapiens
NGDKFQKFI

SEQ ID NO: 986367 - protein, 9 aa, Homo Sapiens
KSKVGAWRD

SEQ ID NO: 986368 - protein, 9 aa, Homo Sapiens
EGLLSCGNI

SEQ ID NO: 986369 - protein, 9 aa, Homo Sapiens
CHLRFEKAV

SEQ ID NO: 986370 - protein, 9 aa, Homo Sapiens
RYVAICNRL

SEQ ID NO: 986371 - protein, 9 aa, Homo Sapiens
LGAIKEHPF

SEQ ID NO: 986372 - protein, 9 aa, Homo Sapiens
RRLLVGEDA

SEQ ID NO: 986373 - protein, 9 aa, Homo Sapiens
VVMFVIYEQ

SEQ ID NO: 986374 - protein, 9 aa, Homo Sapiens
KLVHSYSYD

SEQ ID NO: 986375 - protein, 9 aa, Homo Sapiens
SFSSEDKQH

SEQ ID NO: 986376 - protein, 9 aa, Homo Sapiens
KTRFVDGRA

SEQ ID NO: 986377 - protein, 9 aa, Homo Sapiens
MEIIAFAKL

SEQ ID NO: 986378 - protein, 9 aa, Homo Sapiens
KRLREMSSL

SEQ ID NO: 986379 - protein, 9 aa, Homo Sapiens
PGTMGLQCR

SEQ ID NO: 986380 - protein, 9 aa, Homo Sapiens
PDVGENFLH

SEQ ID NO: 986381 - protein, 9 aa, Homo Sapiens
ESYAHETKL

SEQ ID NO: 986382 - protein, 9 aa, Homo Sapiens
VAQRKPESF

SEQ ID NO: 986383 - protein, 9 aa, Homo Sapiens
NFKDSKNPV

SEQ ID NO: 986384 - protein, 9 aa, Homo Sapiens
LRIPFILKI

SEQ ID NO: 986385 - protein, 9 aa, Homo Sapiens
TVGNSGIGK

SEQ ID NO: 986386 - protein, 9 aa, Homo Sapiens
SQLAPADLL

SEQ ID NO: 986387 - protein, 9 aa, Homo Sapiens
GGPAPSLSV

SEQ ID NO: 986388 - protein, 9 aa, Homo Sapiens
YLPVYSPKV

SEQ ID NO: 986389 - protein, 9 aa, Homo Sapiens
VEGSGKLFR

SEQ ID NO: 986390 - protein, 9 aa, Homo Sapiens
LNSLSSPSP

SEQ ID NO: 986391 - protein, 9 aa, Homo Sapiens
SDTGQCCLD

SEQ ID NO: 986392 - protein, 9 aa, Homo Sapiens
IYEMRMMMN

SEQ ID NO: 986393 - protein, 9 aa, Homo Sapiens
RQLMKVVNK

SEQ ID NO: 986394 - protein, 9 aa, Homo Sapiens
FNFKVSQER

SEQ ID NO: 986395 - protein, 9 aa, Homo Sapiens
GIYHRFMVD

SEQ ID NO: 986396 - protein, 9 aa, Homo Sapiens
LFDKKPINV

SEQ ID NO: 986397 - protein, 9 aa, Homo Sapiens
TLGKHKYGI

SEQ ID NO: 986398 - protein, 9 aa, Homo Sapiens
AIVVHIRYY

SEQ ID NO: 986399 - protein, 9 aa, Homo Sapiens
SFVTPKMIT

SEQ ID NO: 986400 - protein, 9 aa, Homo Sapiens
QANEDNCGD

SEQ ID NO: 986401 - protein, 9 aa, Homo Sapiens
EESKISQKK

SEQ ID NO: 986402 - protein, 9 aa, Homo Sapiens
YGGESGSGG

SEQ ID NO: 986403 - protein, 9 aa, Homo Sapiens
CHLCHSNCT

SEQ ID NO: 986404 - protein, 9 aa, Homo Sapiens
GRVELKIQE

SEQ ID NO: 986405 - protein, 9 aa, Homo Sapiens
RQSSVTLTE

SEQ ID NO: 986406 - protein, 9 aa, Homo Sapiens
YIRTKDNDY

SEQ ID NO: 986407 - protein, 9 aa, Homo Sapiens
QIPHELELM

SEQ ID NO: 986408 - protein, 9 aa, Homo Sapiens
RHNLFSNRC

SEQ ID NO: 986409 - protein, 9 aa, Homo Sapiens
QKFIKAPPR

SEQ ID NO: 986410 - protein, 9 aa, Homo Sapiens
PVTLSLLVD

SEQ ID NO: 986411 - protein, 9 aa, Homo Sapiens
ASRVLSALA

SEQ ID NO: 986412 - protein, 9 aa, Homo Sapiens
KLEQEEYNL

SEQ ID NO: 986413 - protein, 9 aa, Homo Sapiens
LLISCCLTL

SEQ ID NO: 986414 - protein, 9 aa, Homo Sapiens
LKEAGALAV

SEQ ID NO: 986415 - protein, 9 aa, Homo Sapiens
HVFVEYPMT

SEQ ID NO: 986416 - protein, 9 aa, Homo Sapiens
ALKIEMNKR

SEQ ID NO: 986417 - protein, 9 aa, Homo Sapiens
KDSIRHNLF

SEQ ID NO: 986418 - protein, 9 aa, Homo Sapiens
IMAAIGPMI

SEQ ID NO: 986419 - protein, 9 aa, Homo Sapiens
LCCLLLLPC

SEQ ID NO: 986420 - protein, 9 aa, Homo Sapiens
FFQDYMDPS

SEQ ID NO: 986421 - protein, 9 aa, Homo Sapiens
KMAEHSYLS

SEQ ID NO: 986422 - protein, 9 aa, Homo Sapiens
CMKEGKLLK

SEQ ID NO: 986423 - protein, 9 aa, Homo Sapiens
IKKPTVDPI

SEQ ID NO: 986424 - protein, 9 aa, Homo Sapiens
TISFGNVDC

SEQ ID NO: 986425 - protein, 9 aa, Homo Sapiens
YFAPPEFLF

SEQ ID NO: 986426 - protein, 9 aa, Homo Sapiens
EDIQNTTLR

SEQ ID NO: 986427 - protein, 9 aa, Homo Sapiens
NLLADPVVR

SEQ ID NO: 986428 - protein, 9 aa, Homo Sapiens
LSTSIDNFN

SEQ ID NO: 986429 - protein, 9 aa, Homo Sapiens
GSTEQSEKK

SEQ ID NO: 986430 - protein, 9 aa, Homo Sapiens
VSYICRYDD

SEQ ID NO: 986431 - protein, 9 aa, Homo Sapiens
KKGLASYEI

SEQ ID NO: 986432 - protein, 9 aa, Homo Sapiens
GTFLKNHPQ

SEQ ID NO: 986433 - protein, 9 aa, Homo Sapiens
SKSNEWRLK

SEQ ID NO: 986434 - protein, 9 aa, Homo Sapiens
LGKKVERSV

SEQ ID NO: 986435 - protein, 9 aa, Homo Sapiens
SKMLVNFLS

SEQ ID NO: 986436 - protein, 9 aa, Homo Sapiens
PSKVLGLQG

SEQ ID NO: 986437 - protein, 9 aa, Homo Sapiens
SLWSSATEK

SEQ ID NO: 986438 - protein, 9 aa, Homo Sapiens
EAMAAVRDK

SEQ ID NO: 986439 - protein, 9 aa, Homo Sapiens
SSKGAGTNQ

SEQ ID NO: 986440 - protein, 9 aa, Homo Sapiens
DVPVMLPSY

SEQ ID NO: 986441 - protein, 9 aa, Homo Sapiens
ARFEAQKGP

SEQ ID NO: 986442 - protein, 9 aa, Homo Sapiens
FVIYEQLKR

SEQ ID NO: 986443 - protein, 9 aa, Homo Sapiens
VFYYSPVAL

SEQ ID NO: 986444 - protein, 9 aa, Homo Sapiens
AAAFSSDSD

SEQ ID NO: 986445 - protein, 9 aa, Homo Sapiens
ATYRRLLVG

SEQ ID NO: 986446 - protein, 9 aa, Homo Sapiens
RFSRGVSRS

SEQ ID NO: 986447 - protein, 9 aa, Homo Sapiens
ESVNNNVTE

SEQ ID NO: 986448 - protein, 9 aa, Homo Sapiens
RKNLGAPKG

SEQ ID NO: 986449 - protein, 9 aa, Homo Sapiens
YQVEKWKTL

SEQ ID NO: 986450 - protein, 9 aa, Homo Sapiens
VFFSVFYFA

SEQ ID NO: 986451 - protein, 9 aa, Homo Sapiens
KPGFSEPTN

SEQ ID NO: 986452 - protein, 9 aa, Homo Sapiens
YNICTDSWT

SEQ ID NO: 986453 - protein, 9 aa, Homo Sapiens
EKEKKIYRW

SEQ ID NO: 986454 - protein, 9 aa, Homo Sapiens
FSSPVDMLE

SEQ ID NO: 986455 - protein, 9 aa, Homo Sapiens
SGRFRYPTK

SEQ ID NO: 986456 - protein, 9 aa, Homo Sapiens
EQAFPFPRH

SEQ ID NO: 986457 - protein, 9 aa, Homo Sapiens
LYFSLLNAI

SEQ ID NO: 986458 - protein, 9 aa, Homo Sapiens
KSFTGLLSS

SEQ ID NO: 986459 - protein, 9 aa, Homo Sapiens
AKNSRGKNV

SEQ ID NO: 986460 - protein, 9 aa, Homo Sapiens
SINADNDHL

SEQ ID NO: 986461 - protein, 9 aa, Homo Sapiens
FQPQGGDIR

SEQ ID NO: 986462 - protein, 9 aa, Homo Sapiens
PSGMMRRMG

SEQ ID NO: 986463 - protein, 9 aa, Homo Sapiens
SQAVMLLPK

SEQ ID NO: 986464 - protein, 9 aa, Homo Sapiens
SGNGSRSVQ

SEQ ID NO: 986465 - protein, 9 aa, Homo Sapiens
PAITSNDAG

SEQ ID NO: 986466 - protein, 9 aa, Homo Sapiens
NLGAPKGIG

SEQ ID NO: 986467 - protein, 9 aa, Homo Sapiens
SYPKMSLKE

SEQ ID NO: 986468 - protein, 9 aa, Homo Sapiens
ILGAIKEHP

SEQ ID NO: 986469 - protein, 9 aa, Homo Sapiens
ELDDSLYLE

SEQ ID NO: 986470 - protein, 9 aa, Homo Sapiens
EDEEAKEDG

SEQ ID NO: 986471 - protein, 9 aa, Homo Sapiens
EILDTNNNS

SEQ ID NO: 986472 - protein, 9 aa, Homo Sapiens
FNGFRFDGV

SEQ ID NO: 986473 - protein, 9 aa, Homo Sapiens
KARGVLKCN

SEQ ID NO: 986474 - protein, 9 aa, Homo Sapiens
YKHAKMEEQ

SEQ ID NO: 986475 - protein, 9 aa, Homo Sapiens
LKDYPWEVT

SEQ ID NO: 986476 - protein, 9 aa, Homo Sapiens
IQALQDKLR

SEQ ID NO: 986477 - protein, 9 aa, Homo Sapiens
LSQILSLME

SEQ ID NO: 986478 - protein, 9 aa, Homo Sapiens
RLQKSLQQR

SEQ ID NO: 986479 - protein, 9 aa, Homo Sapiens
HETQVVVRL

SEQ ID NO: 986480 - protein, 9 aa, Homo Sapiens
STLEWEKLE

SEQ ID NO: 986481 - protein, 9 aa, Homo Sapiens
LFLADDPSP

SEQ ID NO: 986482 - protein, 9 aa, Homo Sapiens
VVHRFENSL

SEQ ID NO: 986483 - protein, 9 aa, Homo Sapiens
THKDSDAVP

SEQ ID NO: 986484 - protein, 9 aa, Homo Sapiens
IFSIHPSFR

SEQ ID NO: 986485 - protein, 9 aa, Homo Sapiens
KASRRSLSV

SEQ ID NO: 986486 - protein, 9 aa, Homo Sapiens
NEISGPPLF

SEQ ID NO: 986487 - protein, 9 aa, Homo Sapiens
PTWTTLSRI

SEQ ID NO: 986488 - protein, 9 aa, Homo Sapiens
VALVTIETH

SEQ ID NO: 986489 - protein, 9 aa, Homo Sapiens
RKRKLNIDS

SEQ ID NO: 986490 - protein, 9 aa, Homo Sapiens
AGVTSQFIS

SEQ ID NO: 986491 - protein, 9 aa, Homo Sapiens
DFNHTGQES

SEQ ID NO: 986492 - protein, 9 aa, Homo Sapiens
EAVKIAEFI

SEQ ID NO: 986493 - protein, 9 aa, Homo Sapiens
LLSCGNILN

SEQ ID NO: 986494 - protein, 9 aa, Homo Sapiens
RKNYKSSSE

SEQ ID NO: 986495 - protein, 9 aa, Homo Sapiens
PLVAPRPPA

SEQ ID NO: 986496 - protein, 9 aa, Homo Sapiens
VSLILLLLL

SEQ ID NO: 986497 - protein, 9 aa, Homo Sapiens
TPNLPGSGG

SEQ ID NO: 986498 - protein, 9 aa, Homo Sapiens
CADTSLFEN

SEQ ID NO: 986499 - protein, 9 aa, Homo Sapiens
SQGAGEDPG

SEQ ID NO: 986500 - protein, 9 aa, Homo Sapiens
PNLMFEHPL

SEQ ID NO: 986501 - protein, 9 aa, Homo Sapiens
ADIIVRGSP

SEQ ID NO: 986502 - protein, 9 aa, Homo Sapiens
VQKLAGVFE

SEQ ID NO: 986503 - protein, 9 aa, Homo Sapiens
IRLGLMEII

SEQ ID NO: 986504 - protein, 9 aa, Homo Sapiens
QQQAAPVEE

SEQ ID NO: 986505 - protein, 9 aa, Homo Sapiens
KIGRKALKL

SEQ ID NO: 986506 - protein, 9 aa, Homo Sapiens
FLPTAPNEL

SEQ ID NO: 986507 - protein, 9 aa, Homo Sapiens
YLEAPPSVR

SEQ ID NO: 986508 - protein, 9 aa, Homo Sapiens
VKGDRSEVG

SEQ ID NO: 986509 - protein, 9 aa, Homo Sapiens
RNSSLLERA

SEQ ID NO: 986510 - protein, 9 aa, Homo Sapiens
AGEDPGQQE

SEQ ID NO: 986511 - protein, 9 aa, Homo Sapiens
TTKAIFTSD

SEQ ID NO: 986512 - protein, 9 aa, Homo Sapiens
TTFKKQQKK

SEQ ID NO: 986513 - protein, 9 aa, Homo Sapiens
DVVIKYKDS

SEQ ID NO: 986514 - protein, 9 aa, Homo Sapiens
ASTEVSIFA

SEQ ID NO: 986515 - protein, 9 aa, Homo Sapiens
DEERLFQDL

SEQ ID NO: 986516 - protein, 9 aa, Homo Sapiens
ILWLLCSYR

SEQ ID NO: 986517 - protein, 9 aa, Homo Sapiens
LVGEDAHLT

SEQ ID NO: 986518 - protein, 9 aa, Homo Sapiens
ELISHQNIY

SEQ ID NO: 986519 - protein, 9 aa, Homo Sapiens
STPSPTSSF

SEQ ID NO: 986520 - protein, 9 aa, Homo Sapiens
VSEEQMGQL

SEQ ID NO: 986521 - protein, 9 aa, Homo Sapiens
CSRNNRTCR

SEQ ID NO: 986522 - protein, 9 aa, Homo Sapiens
PALHLVNTK

SEQ ID NO: 986523 - protein, 9 aa, Homo Sapiens
LLGTDTFSS

SEQ ID NO: 986524 - protein, 9 aa, Homo Sapiens
EGNLKQKDG

SEQ ID NO: 986525 - protein, 9 aa, Homo Sapiens
PFDLKNLYP

SEQ ID NO: 986526 - protein, 9 aa, Homo Sapiens
EAASIREPS

SEQ ID NO: 986527 - protein, 9 aa, Homo Sapiens
LHSQLDRSE

SEQ ID NO: 986528 - protein, 9 aa, Homo Sapiens
KMKKIVDVV

SEQ ID NO: 986529 - protein, 9 aa, Homo Sapiens
TQYSRDAQT

SEQ ID NO: 986530 - protein, 9 aa, Homo Sapiens
YMDQQPNLP

SEQ ID NO: 986531 - protein, 9 aa, Homo Sapiens
NLPGSGGFP

SEQ ID NO: 986532 - protein, 9 aa, Homo Sapiens
QKVYFDAQK

SEQ ID NO: 986533 - protein, 9 aa, Homo Sapiens
PPLFIPPLK

SEQ ID NO: 986534 - protein, 9 aa, Homo Sapiens
KQPTTLVLT

SEQ ID NO: 986535 - protein, 9 aa, Homo Sapiens
ITSSHLALS

SEQ ID NO: 986536 - protein, 9 aa, Homo Sapiens
NEQAFPFPR

SEQ ID NO: 986537 - protein, 9 aa, Homo Sapiens
TTQIASSGS

SEQ ID NO: 986538 - protein, 9 aa, Homo Sapiens
IASSGSSSS

SEQ ID NO: 986539 - protein, 9 aa, Homo Sapiens
QKLFRAKNV

SEQ ID NO: 986540 - protein, 9 aa, Homo Sapiens
PPYFPPLYQ

SEQ ID NO: 986541 - protein, 9 aa, Homo Sapiens
CRGGFGSRG

SEQ ID NO: 986542 - protein, 9 aa, Homo Sapiens
TTESKPGKQ

SEQ ID NO: 986543 - protein, 9 aa, Homo Sapiens
SYGRASYPK

SEQ ID NO: 986544 - protein, 9 aa, Homo Sapiens
LASFVTPKM

SEQ ID NO: 986545 - protein, 9 aa, Homo Sapiens
VSYKGPGLG

SEQ ID NO: 986546 - protein, 9 aa, Homo Sapiens
NLVQKVCPD

SEQ ID NO: 986547 - protein, 9 aa, Homo Sapiens
GRDEYNEVA

SEQ ID NO: 986548 - protein, 9 aa, Homo Sapiens
KALNLCSIP

SEQ ID NO: 986549 - protein, 9 aa, Homo Sapiens
EELARAYKH

SEQ ID NO: 986550 - protein, 9 aa, Homo Sapiens
RVDGEDEEA

SEQ ID NO: 986551 - protein, 9 aa, Homo Sapiens
AAVLAGTTK

SEQ ID NO: 986552 - protein, 9 aa, Homo Sapiens
QQYLMDYLN

SEQ ID NO: 986553 - protein, 9 aa, Homo Sapiens
LLSTQPETN

SEQ ID NO: 986554 - protein, 9 aa, Homo Sapiens
LNYPPSSPD

SEQ ID NO: 986555 - protein, 9 aa, Homo Sapiens
KSSISETLL

SEQ ID NO: 986556 - protein, 9 aa, Homo Sapiens
IKSVPEKNR

SEQ ID NO: 986557 - protein, 9 aa, Homo Sapiens
KKKPLRKDE

SEQ ID NO: 986558 - protein, 9 aa, Homo Sapiens
CQPYLCCLL

SEQ ID NO: 986559 - protein, 9 aa, Homo Sapiens
SSLTPAHHY

SEQ ID NO: 986560 - protein, 9 aa, Homo Sapiens
LDSVWPCQP

SEQ ID NO: 986561 - protein, 9 aa, Homo Sapiens
SQDLLEKGL

SEQ ID NO: 986562 - protein, 9 aa, Homo Sapiens
HDIANKVFK

SEQ ID NO: 986563 - protein, 9 aa, Homo Sapiens
DRSEVGVPG

SEQ ID NO: 986564 - protein, 9 aa, Homo Sapiens
DVRAPQPLE

SEQ ID NO: 986565 - protein, 9 aa, Homo Sapiens
EFLFLISGK

SEQ ID NO: 986566 - protein, 9 aa, Homo Sapiens
AASTEVSIF

SEQ ID NO: 986567 - protein, 9 aa, Homo Sapiens
QDRSFDLVA

SEQ ID NO: 986568 - protein, 9 aa, Homo Sapiens
PEIIFERDT

SEQ ID NO: 986569 - protein, 9 aa, Homo Sapiens
LRLGPDSLA

SEQ ID NO: 986570 - protein, 9 aa, Homo Sapiens
GERGKKGRK

SEQ ID NO: 986571 - protein, 9 aa, Homo Sapiens
LEVSEEQMG

SEQ ID NO: 986572 - protein, 9 aa, Homo Sapiens
CLDYNAKCP

SEQ ID NO: 986573 - protein, 9 aa, Homo Sapiens
KSDNVKENK

SEQ ID NO: 986574 - protein, 9 aa, Homo Sapiens
LPAEVEETP

SEQ ID NO: 986575 - protein, 9 aa, Homo Sapiens
TINRYLAIV

SEQ ID NO: 986576 - protein, 9 aa, Homo Sapiens
SAIGATRSS

SEQ ID NO: 986577 - protein, 9 aa, Homo Sapiens
IDMVSDKGN

SEQ ID NO: 986578 - protein, 9 aa, Homo Sapiens
DPGQQEALL

SEQ ID NO: 986579 - protein, 9 aa, Homo Sapiens
ELLDSVWPC

SEQ ID NO: 986580 - protein, 9 aa, Homo Sapiens
IYWLDSNLD

SEQ ID NO: 986581 - protein, 9 aa, Homo Sapiens
FPTPKSGST

SEQ ID NO: 986582 - protein, 9 aa, Homo Sapiens
IINHFTCKI

SEQ ID NO: 986583 - protein, 9 aa, Homo Sapiens
SVFEEISLL

SEQ ID NO: 986584 - protein, 9 aa, Homo Sapiens
AASSFSNSF

SEQ ID NO: 986585 - protein, 9 aa, Homo Sapiens
RLNEQAFPF

SEQ ID NO: 986586 - protein, 9 aa, Homo Sapiens
SLSVSSPSF

SEQ ID NO: 986587 - protein, 9 aa, Homo Sapiens
PSSHSSISR

SEQ ID NO: 986588 - protein, 9 aa, Homo Sapiens
RKQPQNWPE

SEQ ID NO: 986589 - protein, 9 aa, Homo Sapiens
PQYSLPALS

SEQ ID NO: 986590 - protein, 9 aa, Homo Sapiens
TDIGVFIFS

SEQ ID NO: 986591 - protein, 9 aa, Homo Sapiens
YVKENRGLD

SEQ ID NO: 986592 - protein, 9 aa, Homo Sapiens
KGAGTNQPP

SEQ ID NO: 986593 - protein, 9 aa, Homo Sapiens
RCITHPQTV

SEQ ID NO: 986594 - protein, 9 aa, Homo Sapiens
KTTESKPGK

SEQ ID NO: 986595 - protein, 9 aa, Homo Sapiens
RKRKKKRGH

SEQ ID NO: 986596 - protein, 9 aa, Homo Sapiens
SHQRRSIEC

SEQ ID NO: 986597 - protein, 9 aa, Homo Sapiens
FERDTVSLV

SEQ ID NO: 986598 - protein, 9 aa, Homo Sapiens
SSMEAASIR

SEQ ID NO: 986599 - protein, 9 aa, Homo Sapiens
LRKRFSENF

SEQ ID NO: 986600 - protein, 9 aa, Homo Sapiens
YEWEKAGRF

SEQ ID NO: 986601 - protein, 9 aa, Homo Sapiens
SVQTTLKQP

SEQ ID NO: 986602 - protein, 9 aa, Homo Sapiens
DCGNQANED

SEQ ID NO: 986603 - protein, 9 aa, Homo Sapiens
YNLVQKVCP

SEQ ID NO: 986604 - protein, 9 aa, Homo Sapiens
KYGIVRNSA

SEQ ID NO: 986605 - protein, 9 aa, Homo Sapiens
AERKLGARR

SEQ ID NO: 986606 - protein, 9 aa, Homo Sapiens
AFDIVLYFS

SEQ ID NO: 986607 - protein, 9 aa, Homo Sapiens
AVVLSYRAE

SEQ ID NO: 986608 - protein, 9 aa, Homo Sapiens
AAHVSYICR

SEQ ID NO: 986609 - protein, 9 aa, Homo Sapiens
EKSSARPGG

SEQ ID NO: 986610 - protein, 9 aa, Homo Sapiens
GEDPGQQEA

SEQ ID NO: 986611 - protein, 9 aa, Homo Sapiens
HAKDSFSFN

SEQ ID NO: 986612 - protein, 9 aa, Homo Sapiens
RGPQGITGK

SEQ ID NO: 986613 - protein, 9 aa, Homo Sapiens
VVQRTDSIL

SEQ ID NO: 986614 - protein, 9 aa, Homo Sapiens
EIFQEKKKG

SEQ ID NO: 986615 - protein, 9 aa, Homo Sapiens
LYLGLQNFD

SEQ ID NO: 986616 - protein, 9 aa, Homo Sapiens
QDEIFWAEY

SEQ ID NO: 986617 - protein, 9 aa, Homo Sapiens
KCNISDLSL

SEQ ID NO: 986618 - protein, 9 aa, Homo Sapiens
PPHGSVTLQ

SEQ ID NO: 986619 - protein, 9 aa, Homo Sapiens
TSSHLALSF

SEQ ID NO: 986620 - protein, 9 aa, Homo Sapiens
VDDKVNFYF

SEQ ID NO: 986621 - protein, 9 aa, Homo Sapiens
FSRAVQDVY

SEQ ID NO: 986622 - protein, 9 aa, Homo Sapiens
EKKEKIFLP

SEQ ID NO: 986623 - protein, 9 aa, Homo Sapiens
TFLDHCTFE

SEQ ID NO: 986624 - protein, 9 aa, Homo Sapiens
CPDGSYQNT

SEQ ID NO: 986625 - protein, 9 aa, Homo Sapiens
AEHSYLSLG

SEQ ID NO: 986626 - protein, 9 aa, Homo Sapiens
SYMDQQPNL

SEQ ID NO: 986627 - protein, 9 aa, Homo Sapiens
VSQVLRLAC

SEQ ID NO: 986628 - protein, 9 aa, Homo Sapiens
QIPNSLRQR

SEQ ID NO: 986629 - protein, 9 aa, Homo Sapiens
GSPGPPEDV

SEQ ID NO: 986630 - protein, 9 aa, Homo Sapiens
KLGPPGPLG

SEQ ID NO: 986631 - protein, 9 aa, Homo Sapiens
EKWKTLVSL

SEQ ID NO: 986632 - protein, 9 aa, Homo Sapiens
VNTSQREFQ

SEQ ID NO: 986633 - protein, 9 aa, Homo Sapiens
MFCELPCEN

SEQ ID NO: 986634 - protein, 9 aa, Homo Sapiens
TEHILPYDV

SEQ ID NO: 986635 - protein, 9 aa, Homo Sapiens
SKSIEIYTY

SEQ ID NO: 986636 - protein, 9 aa, Homo Sapiens
FYPPLHEWA

SEQ ID NO: 986637 - protein, 9 aa, Homo Sapiens
SFVLDGTDS

SEQ ID NO: 986638 - protein, 9 aa, Homo Sapiens
DKKPINVQV

SEQ ID NO: 986639 - protein, 9 aa, Homo Sapiens
CMTALNLFL

SEQ ID NO: 986640 - protein, 9 aa, Homo Sapiens
LLQAKEKEV

SEQ ID NO: 986641 - protein, 9 aa, Homo Sapiens
YSRHCDPET

SEQ ID NO: 986642 - protein, 9 aa, Homo Sapiens
RNSRFGRPA

SEQ ID NO: 986643 - protein, 9 aa, Homo Sapiens
QAADFLREL

SEQ ID NO: 986644 - protein, 9 aa, Homo Sapiens
HPSTSDLHI

SEQ ID NO: 986645 - protein, 9 aa, Homo Sapiens
SPHSHSAAP

SEQ ID NO: 986646 - protein, 9 aa, Homo Sapiens
RDEVSLCWP

SEQ ID NO: 986647 - protein, 9 aa, Homo Sapiens
YSSQFQALQ

SEQ ID NO: 986648 - protein, 9 aa, Homo Sapiens
NFDFEDQRP

SEQ ID NO: 986649 - protein, 9 aa, Homo Sapiens
ISETLLGTD

SEQ ID NO: 986650 - protein, 9 aa, Homo Sapiens
EKGDEGPLG

SEQ ID NO: 986651 - protein, 9 aa, Homo Sapiens
KSRTDLKKE

SEQ ID NO: 986652 - protein, 9 aa, Homo Sapiens
EKEEYLGSV

SEQ ID NO: 986653 - protein, 9 aa, Homo Sapiens
SFSYGTRRS

SEQ ID NO: 986654 - protein, 9 aa, Homo Sapiens
EAPEKIFKT

SEQ ID NO: 986655 - protein, 9 aa, Homo Sapiens
WLRNEKPVT

SEQ ID NO: 986656 - protein, 9 aa, Homo Sapiens
HCPDGSYQN

SEQ ID NO: 986657 - protein, 9 aa, Homo Sapiens
RCEGNFLKR

SEQ ID NO: 986658 - protein, 9 aa, Homo Sapiens
IVTVALGVL

SEQ ID NO: 986659 - protein, 9 aa, Homo Sapiens
RQDRSFDLV

SEQ ID NO: 986660 - protein, 9 aa, Homo Sapiens
GQCQDNTTT

SEQ ID NO: 986661 - protein, 9 aa, Homo Sapiens
AKITEFQND

SEQ ID NO: 986662 - protein, 9 aa, Homo Sapiens
LRSKFMTSE

SEQ ID NO: 986663 - protein, 9 aa, Homo Sapiens
PIEMKNHNS

SEQ ID NO: 986664 - protein, 9 aa, Homo Sapiens
GAYLSNLSR

SEQ ID NO: 986665 - protein, 9 aa, Homo Sapiens
KFVYTLPLE

SEQ ID NO: 986666 - protein, 9 aa, Homo Sapiens
ISRFEVFCG

SEQ ID NO: 986667 - protein, 9 aa, Homo Sapiens
FKLLATVFQ

SEQ ID NO: 986668 - protein, 9 aa, Homo Sapiens
LFKLLATVF

SEQ ID NO: 986669 - protein, 9 aa, Homo Sapiens
QCRDTPISH

SEQ ID NO: 986670 - protein, 9 aa, Homo Sapiens
IKEYTLGRN

SEQ ID NO: 986671 - protein, 9 aa, Homo Sapiens
LMGKWKMGP

SEQ ID NO: 986672 - protein, 9 aa, Homo Sapiens
GTMGLQCRE

SEQ ID NO: 986673 - protein, 9 aa, Homo Sapiens
LWPTPGKHS

SEQ ID NO: 986674 - protein, 9 aa, Homo Sapiens
DCFVVYSGI

SEQ ID NO: 986675 - protein, 9 aa, Homo Sapiens
KGNAIGRKA

SEQ ID NO: 986676 - protein, 9 aa, Homo Sapiens
WWALRPLGI

SEQ ID NO: 986677 - protein, 9 aa, Homo Sapiens
NLTSNGQVL

SEQ ID NO: 986678 - protein, 9 aa, Homo Sapiens
ALGVLKRQY

SEQ ID NO: 986679 - protein, 9 aa, Homo Sapiens
QTEKFPEVT

SEQ ID NO: 986680 - protein, 9 aa, Homo Sapiens
QYVTSELSE

SEQ ID NO: 986681 - protein, 9 aa, Homo Sapiens
KSRDPFCNR

SEQ ID NO: 986682 - protein, 9 aa, Homo Sapiens
RRARSRFRR

SEQ ID NO: 986683 - protein, 9 aa, Homo Sapiens
RSRAVHRLY

SEQ ID NO: 986684 - protein, 9 aa, Homo Sapiens
KVNFYFILF

SEQ ID NO: 986685 - protein, 9 aa, Homo Sapiens
DTGVNGEIF

SEQ ID NO: 986686 - protein, 9 aa, Homo Sapiens
SFYSTDYNL

SEQ ID NO: 986687 - protein, 9 aa, Homo Sapiens
LFSTEQSLA

SEQ ID NO: 986688 - protein, 9 aa, Homo Sapiens
SFGIVLPAW

SEQ ID NO: 986689 - protein, 9 aa, Homo Sapiens
FQCAPEMNS

SEQ ID NO: 986690 - protein, 9 aa, Homo Sapiens
QTQDIELVE

SEQ ID NO: 986691 - protein, 9 aa, Homo Sapiens
VNIKPDDES

SEQ ID NO: 986692 - protein, 9 aa, Homo Sapiens
AFSPSPGGG

SEQ ID NO: 986693 - protein, 9 aa, Homo Sapiens
KLAGVFEEN

SEQ ID NO: 986694 - protein, 9 aa, Homo Sapiens
LAGCEDGCC

SEQ ID NO: 986695 - protein, 9 aa, Homo Sapiens
YPNLMFEHP

SEQ ID NO: 986696 - protein, 9 aa, Homo Sapiens
LRLEEVSPW

SEQ ID NO: 986697 - protein, 9 aa, Homo Sapiens
DGQLDLEPR

SEQ ID NO: 986698 - protein, 9 aa, Homo Sapiens
EAPIKLVFS

SEQ ID NO: 986699 - protein, 9 aa, Homo Sapiens
STMQAVFFS

SEQ ID NO: 986700 - protein, 9 aa, Homo Sapiens
VPSGSRNVI

SEQ ID NO: 986701 - protein, 9 aa, Homo Sapiens
ASNIKENAI

SEQ ID NO: 986702 - protein, 9 aa, Homo Sapiens
ITGPHGYAG

SEQ ID NO: 986703 - protein, 9 aa, Homo Sapiens
SRSPSSRSR

SEQ ID NO: 986704 - protein, 9 aa, Homo Sapiens
CLCCALVAA

SEQ ID NO: 986705 - protein, 9 aa, Homo Sapiens
PWWKNSFVE

SEQ ID NO: 986706 - protein, 9 aa, Homo Sapiens
ISPEVSAFF

SEQ ID NO: 986707 - protein, 9 aa, Homo Sapiens
ISPLEVLKR

SEQ ID NO: 986708 - protein, 9 aa, Homo Sapiens
VLCKEMVTL

SEQ ID NO: 986709 - protein, 9 aa, Homo Sapiens
SNEKNTPSP

SEQ ID NO: 986710 - protein, 9 aa, Homo Sapiens
SVITGPHGY

SEQ ID NO: 986711 - protein, 9 aa, Homo Sapiens
VNTKVDFGH

SEQ ID NO: 986712 - protein, 9 aa, Homo Sapiens
EVIMKLSHP

SEQ ID NO: 986713 - protein, 9 aa, Homo Sapiens
FLVTVGNSG

SEQ ID NO: 986714 - protein, 9 aa, Homo Sapiens
LAKSKMISF

SEQ ID NO: 986715 - protein, 9 aa, Homo Sapiens
HCALCQGNG

SEQ ID NO: 986716 - protein, 9 aa, Homo Sapiens
TQQFSCQNP

SEQ ID NO: 986717 - protein, 9 aa, Homo Sapiens
RSRFRRISL

SEQ ID NO: 986718 - protein, 9 aa, Homo Sapiens
LFFGSLAFV

SEQ ID NO: 986719 - protein, 9 aa, Homo Sapiens
FNFTATQEM

SEQ ID NO: 986720 - protein, 9 aa, Homo Sapiens
LKITPLNEA

SEQ ID NO: 986721 - protein, 9 aa, Homo Sapiens
VNKMCPNIT

SEQ ID NO: 986722 - protein, 9 aa, Homo Sapiens
LERMKIETN

SEQ ID NO: 986723 - protein, 9 aa, Homo Sapiens
GFSRKSKKR

SEQ ID NO: 986724 - protein, 9 aa, Homo Sapiens
WAAASFCLL

SEQ ID NO: 986725 - protein, 9 aa, Homo Sapiens
SKARQCHLR

SEQ ID NO: 986726 - protein, 9 aa, Homo Sapiens
DELFQIQLL

SEQ ID NO: 986727 - protein, 9 aa, Homo Sapiens
TKGKEEFVT

SEQ ID NO: 986728 - protein, 9 aa, Homo Sapiens
LARVLIVSL

SEQ ID NO: 986729 - protein, 9 aa, Homo Sapiens
ALRPLGILP

SEQ ID NO: 986730 - protein, 9 aa, Homo Sapiens
KYQCFARNK

SEQ ID NO: 986731 - protein, 9 aa, Homo Sapiens
PMILIHQIL

SEQ ID NO: 986732 - protein, 9 aa, Homo Sapiens
EEFLFLISG

SEQ ID NO: 986733 - protein, 9 aa, Homo Sapiens
PPGKLQGPP

SEQ ID NO: 986734 - protein, 9 aa, Homo Sapiens
ERLSYDCEP

SEQ ID NO: 986735 - protein, 9 aa, Homo Sapiens
ISPSSSLLP

SEQ ID NO: 986736 - protein, 9 aa, Homo Sapiens
AGFCYDGLQ

SEQ ID NO: 986737 - protein, 9 aa, Homo Sapiens
SWNYRHLPL

SEQ ID NO: 986738 - protein, 9 aa, Homo Sapiens
EHHINCYTD

SEQ ID NO: 986739 - protein, 9 aa, Homo Sapiens
HGVAPCSGE

SEQ ID NO: 986740 - protein, 9 aa, Homo Sapiens
ISAHCLLLE

SEQ ID NO: 986741 - protein, 9 aa, Homo Sapiens
SFPAQFGGI

SEQ ID NO: 986742 - protein, 9 aa, Homo Sapiens
LVSINADND

SEQ ID NO: 986743 - protein, 9 aa, Homo Sapiens
ASSFSNSFP

SEQ ID NO: 986744 - protein, 9 aa, Homo Sapiens
PVEEVAGEQ

SEQ ID NO: 986745 - protein, 9 aa, Homo Sapiens
IGPMILIHQ

SEQ ID NO: 986746 - protein, 9 aa, Homo Sapiens
AGASQLFCI

SEQ ID NO: 986747 - protein, 9 aa, Homo Sapiens
VVTDHLLYS

SEQ ID NO: 986748 - protein, 9 aa, Homo Sapiens
ESVSQSSHA

SEQ ID NO: 986749 - protein, 9 aa, Homo Sapiens
FEAQKGPIP

SEQ ID NO: 986750 - protein, 9 aa, Homo Sapiens
ILVVVELLL

SEQ ID NO: 986751 - protein, 9 aa, Homo Sapiens
GNGSRSVQT

SEQ ID NO: 986752 - protein, 9 aa, Homo Sapiens
IQNGNVIQL

SEQ ID NO: 986753 - protein, 9 aa, Homo Sapiens
PSLSVLNVT

SEQ ID NO: 986754 - protein, 9 aa, Homo Sapiens
VRKLQNIFF

SEQ ID NO: 986755 - protein, 9 aa, Homo Sapiens
SFRLRFEAC

SEQ ID NO: 986756 - protein, 9 aa, Homo Sapiens
VLQVLLPVP

SEQ ID NO: 986757 - protein, 9 aa, Homo Sapiens
VPEKNRTTS

SEQ ID NO: 986758 - protein, 9 aa, Homo Sapiens
LTSRDSFVL

SEQ ID NO: 986759 - protein, 9 aa, Homo Sapiens
AFNFTATQE

SEQ ID NO: 986760 - protein, 9 aa, Homo Sapiens
KGRKLDVTN

SEQ ID NO: 986761 - protein, 9 aa, Homo Sapiens
IPRLDLRYT

SEQ ID NO: 986762 - protein, 9 aa, Homo Sapiens
VRSERKAKG

SEQ ID NO: 986763 - protein, 9 aa, Homo Sapiens
SEIQEPIKP

SEQ ID NO: 986764 - protein, 9 aa, Homo Sapiens
VTVGNSGIG

SEQ ID NO: 986765 - protein, 9 aa, Homo Sapiens
SPWVSNEKN

SEQ ID NO: 986766 - protein, 9 aa, Homo Sapiens
LYNKFNHYD

SEQ ID NO: 986767 - protein, 9 aa, Homo Sapiens
HGYAGVPQH

SEQ ID NO: 986768 - protein, 9 aa, Homo Sapiens
QKLAGVFEE

SEQ ID NO: 986769 - protein, 9 aa, Homo Sapiens
AGMLVFLKC

SEQ ID NO: 986770 - protein, 9 aa, Homo Sapiens
AWKKKEDTP

SEQ ID NO: 986771 - protein, 9 aa, Homo Sapiens
LDAISYSDK

SEQ ID NO: 986772 - protein, 9 aa, Homo Sapiens
KSELWFVNS

SEQ ID NO: 986773 - protein, 9 aa, Homo Sapiens
SNEHETQVV

SEQ ID NO: 986774 - protein, 9 aa, Homo Sapiens
LKEQLGRGS

SEQ ID NO: 986775 - protein, 9 aa, Homo Sapiens
VLIVSLLTL

SEQ ID NO: 986776 - protein, 9 aa, Homo Sapiens
VLSHLLLKS

SEQ ID NO: 986777 - protein, 9 aa, Homo Sapiens
IILLFRLEA

SEQ ID NO: 986778 - protein, 9 aa, Homo Sapiens
IFQEKKKGN

SEQ ID NO: 986779 - protein, 9 aa, Homo Sapiens
ASPSLRFPM

SEQ ID NO: 986780 - protein, 9 aa, Homo Sapiens
DYLALNEDP

SEQ ID NO: 986781 - protein, 9 aa, Homo Sapiens
SVTLQKNSN

SEQ ID NO: 986782 - protein, 9 aa, Homo Sapiens
NRFDCFVVY

SEQ ID NO: 986783 - protein, 9 aa, Homo Sapiens
SGGNYGGES

SEQ ID NO: 986784 - protein, 9 aa, Homo Sapiens
SQVLRLACT

SEQ ID NO: 986785 - protein, 9 aa, Homo Sapiens
LRFNSNSQA

SEQ ID NO: 986786 - protein, 9 aa, Homo Sapiens
IVAPHSFGL

SEQ ID NO: 986787 - protein, 9 aa, Homo Sapiens
RCLGHNHKK

SEQ ID NO: 986788 - protein, 9 aa, Homo Sapiens
QDLQGQGRV

SEQ ID NO: 986789 - protein, 9 aa, Homo Sapiens
EFEFKLLAS

SEQ ID NO: 986790 - protein, 9 aa, Homo Sapiens
KALDKVCIG

SEQ ID NO: 986791 - protein, 9 aa, Homo Sapiens
APKGLTGER

SEQ ID NO: 986792 - protein, 9 aa, Homo Sapiens
NAEPKEQPT

SEQ ID NO: 986793 - protein, 9 aa, Homo Sapiens
EGSSLTPAH

SEQ ID NO: 986794 - protein, 9 aa, Homo Sapiens
DIANKVFKH

SEQ ID NO: 986795 - protein, 9 aa, Homo Sapiens
APEKIFKTN

SEQ ID NO: 986796 - protein, 9 aa, Homo Sapiens
WKQAELSRL

SEQ ID NO: 986797 - protein, 9 aa, Homo Sapiens
SFMLLFLLW

SEQ ID NO: 986798 - protein, 9 aa, Homo Sapiens
PAFQTPNLP

SEQ ID NO: 986799 - protein, 9 aa, Homo Sapiens
IAQGPENGC

SEQ ID NO: 986800 - protein, 9 aa, Homo Sapiens
VSQERLKLS

SEQ ID NO: 986801 - protein, 9 aa, Homo Sapiens
AEQRHPEKT

SEQ ID NO: 986802 - protein, 9 aa, Homo Sapiens
DRSSYPQDF

SEQ ID NO: 986803 - protein, 9 aa, Homo Sapiens
VAGDIVLYK

SEQ ID NO: 986804 - protein, 9 aa, Homo Sapiens
ERLKLSNDM

SEQ ID NO: 986805 - protein, 9 aa, Homo Sapiens
SSCHCALCQ

SEQ ID NO: 986806 - protein, 9 aa, Homo Sapiens
PQATSFGIV

SEQ ID NO: 986807 - protein, 9 aa, Homo Sapiens
LRSTTIMIR

SEQ ID NO: 986808 - protein, 9 aa, Homo Sapiens
PTTLVLTLK

SEQ ID NO: 986809 - protein, 9 aa, Homo Sapiens
DFIEEAEVI

SEQ ID NO: 986810 - protein, 9 aa, Homo Sapiens
LQLWVQKQK

SEQ ID NO: 986811 - protein, 9 aa, Homo Sapiens
KLFRAKNVQ

SEQ ID NO: 986812 - protein, 9 aa, Homo Sapiens
NLYLGLQNF

SEQ ID NO: 986813 - protein, 9 aa, Homo Sapiens
DLRQNVEET

SEQ ID NO: 986814 - protein, 9 aa, Homo Sapiens
SGAHDGQPP

SEQ ID NO: 986815 - protein, 9 aa, Homo Sapiens
DEGKAIDAT

SEQ ID NO: 986816 - protein, 9 aa, Homo Sapiens
KEPLDFKEY

SEQ ID NO: 986817 - protein, 9 aa, Homo Sapiens
LNLCSIPVS

SEQ ID NO: 986818 - protein, 9 aa, Homo Sapiens
IDLIKNTKG

SEQ ID NO: 986819 - protein, 9 aa, Homo Sapiens
DKLHPVCSA

SEQ ID NO: 986820 - protein, 9 aa, Homo Sapiens
SDVESDAGK

SEQ ID NO: 986821 - protein, 9 aa, Homo Sapiens
IDGRGGGEE

SEQ ID NO: 986822 - protein, 9 aa, Homo Sapiens
AEISPSSSL

SEQ ID NO: 986823 - protein, 9 aa, Homo Sapiens
NFYCDVSQV

SEQ ID NO: 986824 - protein, 9 aa, Homo Sapiens
QIQLLMTDT

SEQ ID NO: 986825 - protein, 9 aa, Homo Sapiens
DHSESSFRS

SEQ ID NO: 986826 - protein, 9 aa, Homo Sapiens
PDYWILRGV

SEQ ID NO: 986827 - protein, 9 aa, Homo Sapiens
GKFVSEGFK

SEQ ID NO: 986828 - protein, 9 aa, Homo Sapiens
KLVHRFQEE

SEQ ID NO: 986829 - protein, 9 aa, Homo Sapiens
IEMNKRQLR

SEQ ID NO: 986830 - protein, 9 aa, Homo Sapiens
LGKHLNLME

SEQ ID NO: 986831 - protein, 9 aa, Homo Sapiens
YEEAKSYKI

SEQ ID NO: 986832 - protein, 9 aa, Homo Sapiens
AAIGPMILI

SEQ ID NO: 986833 - protein, 9 aa, Homo Sapiens
PCPIEPPPS

SEQ ID NO: 986834 - protein, 9 aa, Homo Sapiens
LTRQKVYFD

SEQ ID NO: 986835 - protein, 9 aa, Homo Sapiens
EVVIDLVRL

SEQ ID NO: 986836 - protein, 9 aa, Homo Sapiens
KGVVGGEDY

SEQ ID NO: 986837 - protein, 9 aa, Homo Sapiens
HRQTFSLNE

SEQ ID NO: 986838 - protein, 9 aa, Homo Sapiens
MDDFEWHRG

SEQ ID NO: 986839 - protein, 9 aa, Homo Sapiens
PSPWVSNEK

SEQ ID NO: 986840 - protein, 9 aa, Homo Sapiens
KEDRSSYPQ

SEQ ID NO: 986841 - protein, 9 aa, Homo Sapiens
LYSRHCDPE

SEQ ID NO: 986842 - protein, 9 aa, Homo Sapiens
DVPESRQRS

SEQ ID NO: 986843 - protein, 9 aa, Homo Sapiens
ERRPDYPTR

SEQ ID NO: 986844 - protein, 9 aa, Homo Sapiens
FYGIVTPML

SEQ ID NO: 986845 - protein, 9 aa, Homo Sapiens
EPTAQEAPT

SEQ ID NO: 986846 - protein, 9 aa, Homo Sapiens
RQLGNHRNN

SEQ ID NO: 986847 - protein, 9 aa, Homo Sapiens
DRIHCLQCN

SEQ ID NO: 986848 - protein, 9 aa, Homo Sapiens
NFYFILFNN

SEQ ID NO: 986849 - protein, 9 aa, Homo Sapiens
IKLVFSQDL

SEQ ID NO: 986850 - protein, 9 aa, Homo Sapiens
KAAQQYLMD

SEQ ID NO: 986851 - protein, 9 aa, Homo Sapiens
MIMLWHRLN

SEQ ID NO: 986852 - protein, 9 aa, Homo Sapiens
IDQLFAVEG

SEQ ID NO: 986853 - protein, 9 aa, Homo Sapiens
REVRCVPPR

SEQ ID NO: 986854 - protein, 9 aa, Homo Sapiens
SFSECKIQF

SEQ ID NO: 986855 - protein, 9 aa, Homo Sapiens
RDHSEYPFH

SEQ ID NO: 986856 - protein, 9 aa, Homo Sapiens
PFPTPLSPP

SEQ ID NO: 986857 - protein, 9 aa, Homo Sapiens
LYPLLLVNI

SEQ ID NO: 986858 - protein, 9 aa, Homo Sapiens
AVQPKALNL

SEQ ID NO: 986859 - protein, 9 aa, Homo Sapiens
FDPNATQFI

SEQ ID NO: 986860 - protein, 9 aa, Homo Sapiens
VPTAKLATE

SEQ ID NO: 986861 - protein, 9 aa, Homo Sapiens
QSIHWLFMG

SEQ ID NO: 986862 - protein, 9 aa, Homo Sapiens
NLTKDPRLA

SEQ ID NO: 986863 - protein, 9 aa, Homo Sapiens
KVECGPKYL

SEQ ID NO: 986864 - protein, 9 aa, Homo Sapiens
QYSRDAQTE

SEQ ID NO: 986865 - protein, 9 aa, Homo Sapiens
FLLWRQSCR

SEQ ID NO: 986866 - protein, 9 aa, Homo Sapiens
RTMKIYVAQ

SEQ ID NO: 986867 - protein, 9 aa, Homo Sapiens
LIRVIQRLR

SEQ ID NO: 986868 - protein, 9 aa, Homo Sapiens
CARCSPHSH

SEQ ID NO: 986869 - protein, 9 aa, Homo Sapiens
ETSVQPWDV

SEQ ID NO: 986870 - protein, 9 aa, Homo Sapiens
ISLSEIMIM

SEQ ID NO: 986871 - protein, 9 aa, Homo Sapiens
VQEKQFHWY

SEQ ID NO: 986872 - protein, 9 aa, Homo Sapiens
LGEIDPLCC

SEQ ID NO: 986873 - protein, 9 aa, Homo Sapiens
KKQQKKLHE

SEQ ID NO: 986874 - protein, 9 aa, Homo Sapiens
CGQRYQLSA

SEQ ID NO: 986875 - protein, 9 aa, Homo Sapiens
VMLLWHFFT

SEQ ID NO: 986876 - protein, 9 aa, Homo Sapiens
VDMLEVVLA

SEQ ID NO: 986877 - protein, 9 aa, Homo Sapiens
VNFYFILFN

SEQ ID NO: 986878 - protein, 9 aa, Homo Sapiens
ENICVSSAK

SEQ ID NO: 986879 - protein, 9 aa, Homo Sapiens
RAEDHRALE

SEQ ID NO: 986880 - protein, 9 aa, Homo Sapiens
LQKNSNLLV

SEQ ID NO: 986881 - protein, 9 aa, Homo Sapiens
SKIRFLEQR

SEQ ID NO: 986882 - protein, 9 aa, Homo Sapiens
PLLSAPPRP

SEQ ID NO: 986883 - protein, 9 aa, Homo Sapiens
HFFSAQPLR

SEQ ID NO: 986884 - protein, 9 aa, Homo Sapiens
IATPLFVPT

SEQ ID NO: 986885 - protein, 9 aa, Homo Sapiens
MEPTAQEAP

SEQ ID NO: 986886 - protein, 9 aa, Homo Sapiens
SRFEVFCGI

SEQ ID NO: 986887 - protein, 9 aa, Homo Sapiens
SDFAFSPSP

SEQ ID NO: 986888 - protein, 9 aa, Homo Sapiens
GNAIGRKAT

SEQ ID NO: 986889 - protein, 9 aa, Homo Sapiens
VQENGFLSL

SEQ ID NO: 986890 - protein, 9 aa, Homo Sapiens
LATVFQGLP

SEQ ID NO: 986891 - protein, 9 aa, Homo Sapiens
ELPENICVS

SEQ ID NO: 986892 - protein, 9 aa, Homo Sapiens
ALSSPPPPT

SEQ ID NO: 986893 - protein, 9 aa, Homo Sapiens
AMPGLFVPL

SEQ ID NO: 986894 - protein, 9 aa, Homo Sapiens
ECVAKNSRG

SEQ ID NO: 986895 - protein, 9 aa, Homo Sapiens
SLILLLLLK

SEQ ID NO: 986896 - protein, 9 aa, Homo Sapiens
AGPPESQGP

SEQ ID NO: 986897 - protein, 9 aa, Homo Sapiens
RLRFEACCY

SEQ ID NO: 986898 - protein, 9 aa, Homo Sapiens
VEGDVTDKD

SEQ ID NO: 986899 - protein, 9 aa, Homo Sapiens
VPSATSALR

SEQ ID NO: 986900 - protein, 9 aa, Homo Sapiens
LVRLAIALQ

SEQ ID NO: 986901 - protein, 9 aa, Homo Sapiens
PSPDHLYFF

SEQ ID NO: 986902 - protein, 9 aa, Homo Sapiens
LVFSQDLLE

SEQ ID NO: 986903 - protein, 9 aa, Homo Sapiens
NLLTELQDN

SEQ ID NO: 986904 - protein, 9 aa, Homo Sapiens
ILNMLCFFS

SEQ ID NO: 986905 - protein, 9 aa, Homo Sapiens
PTHCGQNSR

SEQ ID NO: 986906 - protein, 9 aa, Homo Sapiens
FTEIVVMML

SEQ ID NO: 986907 - protein, 9 aa, Homo Sapiens
LGIKFSAEA

SEQ ID NO: 986908 - protein, 9 aa, Homo Sapiens
GIDGLNREQ

SEQ ID NO: 986909 - protein, 9 aa, Homo Sapiens
NLPAGKRKA

SEQ ID NO: 986910 - protein, 9 aa, Homo Sapiens
MLEVVLAKK

SEQ ID NO: 986911 - protein, 9 aa, Homo Sapiens
WGSVTYMDK

SEQ ID NO: 986912 - protein, 9 aa, Homo Sapiens
DMSLASFVT

SEQ ID NO: 986913 - protein, 9 aa, Homo Sapiens
RGLDSEESY

SEQ ID NO: 986914 - protein, 9 aa, Homo Sapiens
ELVHGTEVT

SEQ ID NO: 986915 - protein, 9 aa, Homo Sapiens
YQVLVFYYS

SEQ ID NO: 986916 - protein, 9 aa, Homo Sapiens
HVLKLPYQE

SEQ ID NO: 986917 - protein, 9 aa, Homo Sapiens
GVKGDRSEV

SEQ ID NO: 986918 - protein, 9 aa, Homo Sapiens
NQANEDNCG

SEQ ID NO: 986919 - protein, 9 aa, Homo Sapiens
GVNGEIFYS

SEQ ID NO: 986920 - protein, 9 aa, Homo Sapiens
LYFFRILHK

SEQ ID NO: 986921 - protein, 9 aa, Homo Sapiens
KSSSEIQEP

SEQ ID NO: 986922 - protein, 9 aa, Homo Sapiens
ELLKKKPFH

SEQ ID NO: 986923 - protein, 9 aa, Homo Sapiens
SEPLKITLL

SEQ ID NO: 986924 - protein, 9 aa, Homo Sapiens
LLLLVLEKT

SEQ ID NO: 986925 - protein, 9 aa, Homo Sapiens
RFPMYFFLA

SEQ ID NO: 986926 - protein, 9 aa, Homo Sapiens
RKLGARRDF

SEQ ID NO: 986927 - protein, 9 aa, Homo Sapiens
PGKDLRARV

SEQ ID NO: 986928 - protein, 9 aa, Homo Sapiens
DYPTRPTLR

SEQ ID NO: 986929 - protein, 9 aa, Homo Sapiens
AAASFCLLG

SEQ ID NO: 986930 - protein, 9 aa, Homo Sapiens
HESCRVEPR

SEQ ID NO: 986931 - protein, 9 aa, Homo Sapiens
HFPIEMKNH

SEQ ID NO: 986932 - protein, 9 aa, Homo Sapiens
ASWRRAPSF

SEQ ID NO: 986933 - protein, 9 aa, Homo Sapiens
LLKKYENLL

SEQ ID NO: 986934 - protein, 9 aa, Homo Sapiens
NNRDHKEKL

SEQ ID NO: 986935 - protein, 9 aa, Homo Sapiens
ARLFTGKIL

SEQ ID NO: 986936 - protein, 9 aa, Homo Sapiens
DLKDSLLRE

SEQ ID NO: 986937 - protein, 9 aa, Homo Sapiens
RFENSLHPI

SEQ ID NO: 986938 - protein, 9 aa, Homo Sapiens
WALRPLGIL

SEQ ID NO: 986939 - protein, 9 aa, Homo Sapiens
VIMKLSHPK

SEQ ID NO: 986940 - protein, 9 aa, Homo Sapiens
QHELNDAEE

SEQ ID NO: 986941 - protein, 9 aa, Homo Sapiens
KAQHELNDA

SEQ ID NO: 986942 - protein, 9 aa, Homo Sapiens
RLACADTSL

SEQ ID NO: 986943 - protein, 9 aa, Homo Sapiens
IYSLRNNKV

SEQ ID NO: 986944 - protein, 9 aa, Homo Sapiens
EGAKRPLPV

SEQ ID NO: 986945 - protein, 9 aa, Homo Sapiens
KPESFANVS

SEQ ID NO: 986946 - protein, 9 aa, Homo Sapiens
EEQAYYTPR

SEQ ID NO: 986947 - protein, 9 aa, Homo Sapiens
AAQQYLMDY

SEQ ID NO: 986948 - protein, 9 aa, Homo Sapiens
GTQTLTRVK

SEQ ID NO: 986949 - protein, 9 aa, Homo Sapiens
AYSLGNLPM

SEQ ID NO: 986950 - protein, 9 aa, Homo Sapiens
LKKKPFHSV

SEQ ID NO: 986951 - protein, 9 aa, Homo Sapiens
VCREFVHCK

SEQ ID NO: 986952 - protein, 9 aa, Homo Sapiens
QSNLHRILM

SEQ ID NO: 986953 - protein, 9 aa, Homo Sapiens
GEDQTQDIE

SEQ ID NO: 986954 - protein, 9 aa, Homo Sapiens
GIVRNSAAT

SEQ ID NO: 986955 - protein, 9 aa, Homo Sapiens
RLKLSNDMM

SEQ ID NO: 986956 - protein, 9 aa, Homo Sapiens
EEPGLQGTQ

SEQ ID NO: 986957 - protein, 9 aa, Homo Sapiens
KGAKITEFQ

SEQ ID NO: 986958 - protein, 9 aa, Homo Sapiens
EKQSNLHRI

SEQ ID NO: 986959 - protein, 9 aa, Homo Sapiens
LLLLLVLEK

SEQ ID NO: 986960 - protein, 9 aa, Homo Sapiens
FSENFIYTY

SEQ ID NO: 986961 - protein, 9 aa, Homo Sapiens
DSKIRFLEQ

SEQ ID NO: 986962 - protein, 9 aa, Homo Sapiens
LNNDGGHCC

SEQ ID NO: 986963 - protein, 9 aa, Homo Sapiens
EEQAPEKIL

SEQ ID NO: 986964 - protein, 9 aa, Homo Sapiens
PSGSSQFLH

SEQ ID NO: 986965 - protein, 9 aa, Homo Sapiens
GQPPSFSPH

SEQ ID NO: 986966 - protein, 9 aa, Homo Sapiens
QLCARCSPH

SEQ ID NO: 986967 - protein, 9 aa, Homo Sapiens
EEKFIIKEE

SEQ ID NO: 986968 - protein, 9 aa, Homo Sapiens
PRVPWSISL

SEQ ID NO: 986969 - protein, 9 aa, Homo Sapiens
TRSLAVCEK

SEQ ID NO: 986970 - protein, 9 aa, Homo Sapiens
NKLRRADIH

SEQ ID NO: 986971 - protein, 9 aa, Homo Sapiens
VKAPALEEL

SEQ ID NO: 986972 - protein, 9 aa, Homo Sapiens
RVIIFSVRY

SEQ ID NO: 986973 - protein, 9 aa, Homo Sapiens
ICEKTYKPV

SEQ ID NO: 986974 - protein, 9 aa, Homo Sapiens
GPSAALVIT

SEQ ID NO: 986975 - protein, 9 aa, Homo Sapiens
ITRVHKDAE

SEQ ID NO: 986976 - protein, 9 aa, Homo Sapiens
LYSRFKALD

SEQ ID NO: 986977 - protein, 9 aa, Homo Sapiens
TSVGKASFR

SEQ ID NO: 986978 - protein, 9 aa, Homo Sapiens
IRYYRMAAF

SEQ ID NO: 986979 - protein, 9 aa, Homo Sapiens
TPPQASRVL

SEQ ID NO: 986980 - protein, 9 aa, Homo Sapiens
MDRSENRCE

SEQ ID NO: 986981 - protein, 9 aa, Homo Sapiens
KHQDEIFWA

SEQ ID NO: 986982 - protein, 9 aa, Homo Sapiens
AREVLESAV

SEQ ID NO: 986983 - protein, 9 aa, Homo Sapiens
ESQGPRGER

SEQ ID NO: 986984 - protein, 9 aa, Homo Sapiens
EEAVKIAEF

SEQ ID NO: 986985 - protein, 9 aa, Homo Sapiens
TIEKIYSYY

SEQ ID NO: 986986 - protein, 9 aa, Homo Sapiens
DKRAVQEIE

SEQ ID NO: 986987 - protein, 9 aa, Homo Sapiens
SFTGLLSSF

SEQ ID NO: 986988 - protein, 9 aa, Homo Sapiens
NSQAAAHYK

SEQ ID NO: 986989 - protein, 9 aa, Homo Sapiens
LIKKMDYLW

SEQ ID NO: 986990 - protein, 9 aa, Homo Sapiens
LTELQDNSL

SEQ ID NO: 986991 - protein, 9 aa, Homo Sapiens
LWVQKQKAT

SEQ ID NO: 986992 - protein, 9 aa, Homo Sapiens
GKERRPDYP

SEQ ID NO: 986993 - protein, 9 aa, Homo Sapiens
KKWKGLLTQ

SEQ ID NO: 986994 - protein, 9 aa, Homo Sapiens
KNNKKEALL

SEQ ID NO: 986995 - protein, 9 aa, Homo Sapiens
PCDRKARQQ

SEQ ID NO: 986996 - protein, 9 aa, Homo Sapiens
RTILLLKEA

SEQ ID NO: 986997 - protein, 9 aa, Homo Sapiens
ELASKKKVK

SEQ ID NO: 986998 - protein, 9 aa, Homo Sapiens
ACTSVPSGS

SEQ ID NO: 986999 - protein, 9 aa, Homo Sapiens
HGELRIKTK

SEQ ID NO: 987000 - protein, 9 aa, Homo Sapiens
LALSFQIIR

SEQ ID NO: 987001 - protein, 9 aa, Homo Sapiens
LANDNVAEI

SEQ ID NO: 987002 - protein, 9 aa, Homo Sapiens
EEKKEKIFL

SEQ ID NO: 987003 - protein, 9 aa, Homo Sapiens
LATPPQASR

SEQ ID NO: 987004 - protein, 9 aa, Homo Sapiens
EKNDFKKLK

SEQ ID NO: 987005 - protein, 9 aa, Homo Sapiens
YYMPVKNSQ

SEQ ID NO: 987006 - protein, 9 aa, Homo Sapiens
ISTMQAVFF

SEQ ID NO: 987007 - protein, 9 aa, Homo Sapiens
SRDETSVQP

SEQ ID NO: 987008 - protein, 9 aa, Homo Sapiens
ADAGKLCPP

SEQ ID NO: 987009 - protein, 9 aa, Homo Sapiens
EIYTYGQAF

SEQ ID NO: 987010 - protein, 9 aa, Homo Sapiens
VCSTAILGA

SEQ ID NO: 987011 - protein, 9 aa, Homo Sapiens
IALVLGRGG

SEQ ID NO: 987012 - protein, 9 aa, Homo Sapiens
KFMTSELEE

SEQ ID NO: 987013 - protein, 9 aa, Homo Sapiens
KIVDVVIKY

SEQ ID NO: 987014 - protein, 9 aa, Homo Sapiens
QKVIHTENY

SEQ ID NO: 987015 - protein, 9 aa, Homo Sapiens
IQRRTKISR

SEQ ID NO: 987016 - protein, 9 aa, Homo Sapiens
VCMQPHKDI

SEQ ID NO: 987017 - protein, 9 aa, Homo Sapiens
IRKKILSPV

SEQ ID NO: 987018 - protein, 9 aa, Homo Sapiens
HQEELSPPP

SEQ ID NO: 987019 - protein, 9 aa, Homo Sapiens
KLPKSHLDS

SEQ ID NO: 987020 - protein, 9 aa, Homo Sapiens
LHPVCSAGT

SEQ ID NO: 987021 - protein, 9 aa, Homo Sapiens
FRNTQFLIQ

SEQ ID NO: 987022 - protein, 9 aa, Homo Sapiens
QAFPFPRHP

SEQ ID NO: 987023 - protein, 9 aa, Homo Sapiens
FTFLLISCC

SEQ ID NO: 987024 - protein, 9 aa, Homo Sapiens
YTDIGVFIF

SEQ ID NO: 987025 - protein, 9 aa, Homo Sapiens
KWKMGPVLC

SEQ ID NO: 987026 - protein, 9 aa, Homo Sapiens
RCSDTGQCC

SEQ ID NO: 987027 - protein, 9 aa, Homo Sapiens
GLGTIKIKA

SEQ ID NO: 987028 - protein, 9 aa, Homo Sapiens
ALAGFCYDG

SEQ ID NO: 987029 - protein, 9 aa, Homo Sapiens
LEEVSPWLA

SEQ ID NO: 987030 - protein, 9 aa, Homo Sapiens
GGSPLLWAT

SEQ ID NO: 987031 - protein, 9 aa, Homo Sapiens
EKERVHHLV

SEQ ID NO: 987032 - protein, 9 aa, Homo Sapiens
QCRCSDTGQ

SEQ ID NO: 987033 - protein, 9 aa, Homo Sapiens
LDDSLYLEK

SEQ ID NO: 987034 - protein, 9 aa, Homo Sapiens
TVSSSSTGS

SEQ ID NO: 987035 - protein, 9 aa, Homo Sapiens
FSRGVSRSL

SEQ ID NO: 987036 - protein, 9 aa, Homo Sapiens
QEKANASAP

SEQ ID NO: 987037 - protein, 9 aa, Homo Sapiens
GAGEDPGQQ

SEQ ID NO: 987038 - protein, 9 aa, Homo Sapiens
GNTPSTLDA

SEQ ID NO: 987039 - protein, 9 aa, Homo Sapiens
KNPCEGMSR

SEQ ID NO: 987040 - protein, 9 aa, Homo Sapiens
YNELVAKSL

SEQ ID NO: 987041 - protein, 9 aa, Homo Sapiens
EQEEYNLES

SEQ ID NO: 987042 - protein, 9 aa, Homo Sapiens
FDVFQILDR

SEQ ID NO: 987043 - protein, 9 aa, Homo Sapiens
IFLPPKKPL

SEQ ID NO: 987044 - protein, 9 aa, Homo Sapiens
DPLQPTKTR

SEQ ID NO: 987045 - protein, 9 aa, Homo Sapiens
NKGVVGGED

SEQ ID NO: 987046 - protein, 9 aa, Homo Sapiens
RPGPAGPPE

SEQ ID NO: 987047 - protein, 9 aa, Homo Sapiens
TPKSGSTEQ

SEQ ID NO: 987048 - protein, 9 aa, Homo Sapiens
LSEQFGRGS

SEQ ID NO: 987049 - protein, 9 aa, Homo Sapiens
MVTLLDKLG

SEQ ID NO: 987050 - protein, 9 aa, Homo Sapiens
PTICSRVPT

SEQ ID NO: 987051 - protein, 9 aa, Homo Sapiens
SEGFKVREM

SEQ ID NO: 987052 - protein, 9 aa, Homo Sapiens
DHGPSRLSY

SEQ ID NO: 987053 - protein, 9 aa, Homo Sapiens
SMEAASIRE

SEQ ID NO: 987054 - protein, 9 aa, Homo Sapiens
PKRKRKKKR

SEQ ID NO: 987055 - protein, 9 aa, Homo Sapiens
NQFESEAMK

SEQ ID NO: 987056 - protein, 9 aa, Homo Sapiens
RLKVDSRAG

SEQ ID NO: 987057 - protein, 9 aa, Homo Sapiens
YNAKCPLCK

SEQ ID NO: 987058 - protein, 9 aa, Homo Sapiens
SSSLVPGNP

SEQ ID NO: 987059 - protein, 9 aa, Homo Sapiens
VNSSIGRLC

SEQ ID NO: 987060 - protein, 9 aa, Homo Sapiens
YLEQQNKVL

SEQ ID NO: 987061 - protein, 9 aa, Homo Sapiens
SLVRSFRLR

SEQ ID NO: 987062 - protein, 9 aa, Homo Sapiens
RLEVDINIK

SEQ ID NO: 987063 - protein, 9 aa, Homo Sapiens
QDPLQPTKT

SEQ ID NO: 987064 - protein, 9 aa, Homo Sapiens
SPHRGNNQG

SEQ ID NO: 987065 - protein, 9 aa, Homo Sapiens
VLVSITDEN

SEQ ID NO: 987066 - protein, 9 aa, Homo Sapiens
RLVRIGRIL

SEQ ID NO: 987067 - protein, 9 aa, Homo Sapiens
DPELAVSGA

SEQ ID NO: 987068 - protein, 9 aa, Homo Sapiens
ASALCLHGG

SEQ ID NO: 987069 - protein, 9 aa, Homo Sapiens
SDIEIENEF

SEQ ID NO: 987070 - protein, 9 aa, Homo Sapiens
VLAGTTKAI

SEQ ID NO: 987071 - protein, 9 aa, Homo Sapiens
FSDLGSEEE

SEQ ID NO: 987072 - protein, 9 aa, Homo Sapiens
FLREVIQGS

SEQ ID NO: 987073 - protein, 9 aa, Homo Sapiens
EVPFRGIDD

SEQ ID NO: 987074 - protein, 9 aa, Homo Sapiens
LPSNYLLGS

SEQ ID NO: 987075 - protein, 9 aa, Homo Sapiens
EISPSSSLL

SEQ ID NO: 987076 - protein, 9 aa, Homo Sapiens
CVISQEIMK

SEQ ID NO: 987077 - protein, 9 aa, Homo Sapiens
VDVVIKYKD

SEQ ID NO: 987078 - protein, 9 aa, Homo Sapiens
FGQYSLQVN

SEQ ID NO: 987079 - protein, 9 aa, Homo Sapiens
HDGQPPSFS

SEQ ID NO: 987080 - protein, 9 aa, Homo Sapiens
GRKLDVTNL

SEQ ID NO: 987081 - protein, 9 aa, Homo Sapiens
FIFGLFLFM

SEQ ID NO: 987082 - protein, 9 aa, Homo Sapiens
SLWEMVQDG

SEQ ID NO: 987083 - protein, 9 aa, Homo Sapiens
QDLLDGCYS

SEQ ID NO: 987084 - protein, 9 aa, Homo Sapiens
FFHFLGGAD

SEQ ID NO: 987085 - protein, 9 aa, Homo Sapiens
EIIAFAKLF

SEQ ID NO: 987086 - protein, 9 aa, Homo Sapiens
LTADHGPSR

SEQ ID NO: 987087 - protein, 9 aa, Homo Sapiens
FQGLPGTGP

SEQ ID NO: 987088 - protein, 9 aa, Homo Sapiens
GDEGKAIDA

SEQ ID NO: 987089 - protein, 9 aa, Homo Sapiens
LGLQNFDFE

SEQ ID NO: 987090 - protein, 9 aa, Homo Sapiens
QPYLCCLLL

SEQ ID NO: 987091 - protein, 9 aa, Homo Sapiens
QAREVLESA

SEQ ID NO: 987092 - protein, 9 aa, Homo Sapiens
IPNSLRQRL

SEQ ID NO: 987093 - protein, 9 aa, Homo Sapiens
TSNYQKISS

SEQ ID NO: 987094 - protein, 9 aa, Homo Sapiens
SPAMSEGIF

SEQ ID NO: 987095 - protein, 9 aa, Homo Sapiens
FSGEQAREV

SEQ ID NO: 987096 - protein, 9 aa, Homo Sapiens
QSQGAGEDP

SEQ ID NO: 987097 - protein, 9 aa, Homo Sapiens
VYTKDRTPI

SEQ ID NO: 987098 - protein, 9 aa, Homo Sapiens
YYIAAEKII

SEQ ID NO: 987099 - protein, 9 aa, Homo Sapiens
VRTNNYEIV

SEQ ID NO: 987100 - protein, 9 aa, Homo Sapiens
SELSEGEDP

SEQ ID NO: 987101 - protein, 9 aa, Homo Sapiens
PESSVASAM

SEQ ID NO: 987102 - protein, 9 aa, Homo Sapiens
TLFMNLMND

SEQ ID NO: 987103 - protein, 9 aa, Homo Sapiens
NAFILNSLY

SEQ ID NO: 987104 - protein, 9 aa, Homo Sapiens
CHEPGLQGS

SEQ ID NO: 987105 - protein, 9 aa, Homo Sapiens
YSYTALYVI

SEQ ID NO: 987106 - protein, 9 aa, Homo Sapiens
ILRIPFILK

SEQ ID NO: 987107 - protein, 9 aa, Homo Sapiens
LKSFTGLLS

SEQ ID NO: 987108 - protein, 9 aa, Homo Sapiens
NGNVIQLLH

SEQ ID NO: 987109 - protein, 9 aa, Homo Sapiens
SYRGISCYR

SEQ ID NO: 987110 - protein, 9 aa, Homo Sapiens
KQKLGMAMR

SEQ ID NO: 987111 - protein, 9 aa, Homo Sapiens
LLFDKKPIN

SEQ ID NO: 987112 - protein, 9 aa, Homo Sapiens
VTPEIIFER

SEQ ID NO: 987113 - protein, 9 aa, Homo Sapiens
LTESQFLKR

SEQ ID NO: 987114 - protein, 9 aa, Homo Sapiens
LDLEPRGAS

SEQ ID NO: 987115 - protein, 9 aa, Homo Sapiens
VTRHGLKSL

SEQ ID NO: 987116 - protein, 9 aa, Homo Sapiens
LASSPVLCL

SEQ ID NO: 987117 - protein, 9 aa, Homo Sapiens
KSQAADFLR

SEQ ID NO: 987118 - protein, 9 aa, Homo Sapiens
RLCVRVRPG

SEQ ID NO: 987119 - protein, 9 aa, Homo Sapiens
LGHNHKKVQ

SEQ ID NO: 987120 - protein, 9 aa, Homo Sapiens
CVSSAKKTE

SEQ ID NO: 987121 - protein, 9 aa, Homo Sapiens
KLYSRFKAL

SEQ ID NO: 987122 - protein, 9 aa, Homo Sapiens
SFMALARSQ

SEQ ID NO: 987123 - protein, 9 aa, Homo Sapiens
LLLVLEKTS

SEQ ID NO: 987124 - protein, 9 aa, Homo Sapiens
RDSFPKSKS

SEQ ID NO: 987125 - protein, 9 aa, Homo Sapiens
IFLLVSLIA

SEQ ID NO: 987126 - protein, 9 aa, Homo Sapiens
DIVLYKLGE

SEQ ID NO: 987127 - protein, 9 aa, Homo Sapiens
VSSVVRCIT

SEQ ID NO: 987128 - protein, 9 aa, Homo Sapiens
RHRIHSFHV

SEQ ID NO: 987129 - protein, 9 aa, Homo Sapiens
CHSNCTYGC

SEQ ID NO: 987130 - protein, 9 aa, Homo Sapiens
LLKSELWFV

SEQ ID NO: 987131 - protein, 9 aa, Homo Sapiens
DHAVPTAFP

SEQ ID NO: 987132 - protein, 9 aa, Homo Sapiens
KKVAAQKPS

SEQ ID NO: 987133 - protein, 9 aa, Homo Sapiens
TDKGEVSDG

SEQ ID NO: 987134 - protein, 9 aa, Homo Sapiens
FGPDSVQGF

SEQ ID NO: 987135 - protein, 9 aa, Homo Sapiens
RHGGNVALP

SEQ ID NO: 987136 - protein, 9 aa, Homo Sapiens
PVVANEKEY

SEQ ID NO: 987137 - protein, 9 aa, Homo Sapiens
VYSVSLTKT

SEQ ID NO: 987138 - protein, 9 aa, Homo Sapiens
FAFSPSPGG

SEQ ID NO: 987139 - protein, 9 aa, Homo Sapiens
IRFHQIPNS

SEQ ID NO: 987140 - protein, 9 aa, Homo Sapiens
ELHSQLDRS

SEQ ID NO: 987141 - protein, 9 aa, Homo Sapiens
GFRGAQQKR

SEQ ID NO: 987142 - protein, 9 aa, Homo Sapiens
PLLIAVQDQ

SEQ ID NO: 987143 - protein, 9 aa, Homo Sapiens
KRSIFSIHP

SEQ ID NO: 987144 - protein, 9 aa, Homo Sapiens
GKHKYGIVR

SEQ ID NO: 987145 - protein, 9 aa, Homo Sapiens
AESSQAVML

SEQ ID NO: 987146 - protein, 9 aa, Homo Sapiens
SSCIKNSKI

SEQ ID NO: 987147 - protein, 9 aa, Homo Sapiens
GPECRCNQR

SEQ ID NO: 987148 - protein, 9 aa, Homo Sapiens
EATGADAGK

SEQ ID NO: 987149 - protein, 9 aa, Homo Sapiens
TVQIHDEKA

SEQ ID NO: 987150 - protein, 9 aa, Homo Sapiens
DQNKQNLIA

SEQ ID NO: 987151 - protein, 9 aa, Homo Sapiens
EVSSCHCAL

SEQ ID NO: 987152 - protein, 9 aa, Homo Sapiens
IFPGQSIQE

SEQ ID NO: 987153 - protein, 9 aa, Homo Sapiens
VPEYYGSYS

SEQ ID NO: 987154 - protein, 9 aa, Homo Sapiens
YQYQYMNGK

SEQ ID NO: 987155 - protein, 9 aa, Homo Sapiens
AGGLLSTSI

SEQ ID NO: 987156 - protein, 9 aa, Homo Sapiens
IVLYKLGER

SEQ ID NO: 987157 - protein, 9 aa, Homo Sapiens
QGPPKPWWH

SEQ ID NO: 987158 - protein, 9 aa, Homo Sapiens
QTVEKEKTL

SEQ ID NO: 987159 - protein, 9 aa, Homo Sapiens
MTALNLFLT

SEQ ID NO: 987160 - protein, 9 aa, Homo Sapiens
VIVSKMLVN

SEQ ID NO: 987161 - protein, 9 aa, Homo Sapiens
VITRVHKDA

SEQ ID NO: 987162 - protein, 9 aa, Homo Sapiens
KAGYRKNLG

SEQ ID NO: 987163 - protein, 9 aa, Homo Sapiens
TEFQNDVPG

SEQ ID NO: 987164 - protein, 9 aa, Homo Sapiens
TSRDSFVLD

SEQ ID NO: 987165 - protein, 9 aa, Homo Sapiens
YRSSSLLRC

SEQ ID NO: 987166 - protein, 9 aa, Homo Sapiens
YEVAQRKPE

SEQ ID NO: 987167 - protein, 9 aa, Homo Sapiens
PFLEIFCMN

SEQ ID NO: 987168 - protein, 9 aa, Homo Sapiens
PEETRELAP

SEQ ID NO: 987169 - protein, 9 aa, Homo Sapiens
SKVLGLQGL

SEQ ID NO: 987170 - protein, 9 aa, Homo Sapiens
EVTYQCYPG

SEQ ID NO: 987171 - protein, 9 aa, Homo Sapiens
SGPEKINKR

SEQ ID NO: 987172 - protein, 9 aa, Homo Sapiens
KVSQERLKL

SEQ ID NO: 987173 - protein, 9 aa, Homo Sapiens
NLPTDSGPK

SEQ ID NO: 987174 - protein, 9 aa, Homo Sapiens
QNGSAAMYS

SEQ ID NO: 987175 - protein, 9 aa, Homo Sapiens
SSPPPPTRP

SEQ ID NO: 987176 - protein, 9 aa, Homo Sapiens
EIFWAEYRG

SEQ ID NO: 987177 - protein, 9 aa, Homo Sapiens
LKSELWFVN

SEQ ID NO: 987178 - protein, 9 aa, Homo Sapiens
FEENGSCVL

SEQ ID NO: 987179 - protein, 9 aa, Homo Sapiens
PMHRQTFSL

SEQ ID NO: 987180 - protein, 9 aa, Homo Sapiens
PRQQARPFR

SEQ ID NO: 987181 - protein, 9 aa, Homo Sapiens
VHGELRIKT

SEQ ID NO: 987182 - protein, 9 aa, Homo Sapiens
VEDGVLFMQ

SEQ ID NO: 987183 - protein, 9 aa, Homo Sapiens
PDMTSFSYG

SEQ ID NO: 987184 - protein, 9 aa, Homo Sapiens
RFRYPTKCE

SEQ ID NO: 987185 - protein, 9 aa, Homo Sapiens
SAQLVGRQT

SEQ ID NO: 987186 - protein, 9 aa, Homo Sapiens
GELRIKTKG

SEQ ID NO: 987187 - protein, 9 aa, Homo Sapiens
SPRSPPGKL

SEQ ID NO: 987188 - protein, 9 aa, Homo Sapiens
AWKQAELSR

SEQ ID NO: 987189 - protein, 9 aa, Homo Sapiens
YQEATKKVP

SEQ ID NO: 987190 - protein, 9 aa, Homo Sapiens
RKALKLEAL

SEQ ID NO: 987191 - protein, 9 aa, Homo Sapiens
DAMENTRQE

SEQ ID NO: 987192 - protein, 9 aa, Homo Sapiens
HAVVLSYRA

SEQ ID NO: 987193 - protein, 9 aa, Homo Sapiens
LSENLILDN

SEQ ID NO: 987194 - protein, 9 aa, Homo Sapiens
QALKIEMNK

SEQ ID NO: 987195 - protein, 9 aa, Homo Sapiens
YMIVVSISY

SEQ ID NO: 987196 - protein, 9 aa, Homo Sapiens
TKTMSKEVV

SEQ ID NO: 987197 - protein, 9 aa, Homo Sapiens
LILLEPILF

SEQ ID NO: 987198 - protein, 9 aa, Homo Sapiens
TSLILVGPI

SEQ ID NO: 987199 - protein, 9 aa, Homo Sapiens
LRILSASQR

SEQ ID NO: 987200 - protein, 9 aa, Homo Sapiens
SELIRVIQR

SEQ ID NO: 987201 - protein, 9 aa, Homo Sapiens
LTLLFLADD

SEQ ID NO: 987202 - protein, 9 aa, Homo Sapiens
TCNAPNVNT

SEQ ID NO: 987203 - protein, 9 aa, Homo Sapiens
PPPARFEAQ

SEQ ID NO: 987204 - protein, 9 aa, Homo Sapiens
IMKLSHPKL

SEQ ID NO: 987205 - protein, 9 aa, Homo Sapiens
AQAGAALKT

SEQ ID NO: 987206 - protein, 9 aa, Homo Sapiens
STNRSRNSS

SEQ ID NO: 987207 - protein, 9 aa, Homo Sapiens
SLGAMFATR

SEQ ID NO: 987208 - protein, 9 aa, Homo Sapiens
PKSGSTEQS

SEQ ID NO: 987209 - protein, 9 aa, Homo Sapiens
RTSSSPFSG

SEQ ID NO: 987210 - protein, 9 aa, Homo Sapiens
VLEKTSDTS

SEQ ID NO: 987211 - protein, 9 aa, Homo Sapiens
KSGGFLVIM

SEQ ID NO: 987212 - protein, 9 aa, Homo Sapiens
HRFMVDEKN

SEQ ID NO: 987213 - protein, 9 aa, Homo Sapiens
VHLAERKLG

SEQ ID NO: 987214 - protein, 9 aa, Homo Sapiens
SQAQVYFEE

SEQ ID NO: 987215 - protein, 9 aa, Homo Sapiens
LPFDLKNLY

SEQ ID NO: 987216 - protein, 9 aa, Homo Sapiens
TKADNNNRD

SEQ ID NO: 987217 - protein, 9 aa, Homo Sapiens
TGQCCLDHE

SEQ ID NO: 987218 - protein, 9 aa, Homo Sapiens
MVDEKNYTK

SEQ ID NO: 987219 - protein, 9 aa, Homo Sapiens
SRNVISIVN

SEQ ID NO: 987220 - protein, 9 aa, Homo Sapiens
KTLQEQLEK

SEQ ID NO: 987221 - protein, 9 aa, Homo Sapiens
PNVSKEKLR

SEQ ID NO: 987222 - protein, 9 aa, Homo Sapiens
EELSPPPLP

SEQ ID NO: 987223 - protein, 9 aa, Homo Sapiens
FTLFMNLMN

SEQ ID NO: 987224 - protein, 9 aa, Homo Sapiens
HLLHCLKKT

SEQ ID NO: 987225 - protein, 9 aa, Homo Sapiens
NRTTSEAQT

SEQ ID NO: 987226 - protein, 9 aa, Homo Sapiens
RGPVATISI

SEQ ID NO: 987227 - protein, 9 aa, Homo Sapiens
RNSQPLEYS

SEQ ID NO: 987228 - protein, 9 aa, Homo Sapiens
FMYLVTVLG

SEQ ID NO: 987229 - protein, 9 aa, Homo Sapiens
NRWIRNKKS

SEQ ID NO: 987230 - protein, 9 aa, Homo Sapiens
LCYGKKDLL

SEQ ID NO: 987231 - protein, 9 aa, Homo Sapiens
DYKNINVSA

SEQ ID NO: 987232 - protein, 9 aa, Homo Sapiens
AWRDYDDSA

SEQ ID NO: 987233 - protein, 9 aa, Homo Sapiens
ISFTCRLER

SEQ ID NO: 987234 - protein, 9 aa, Homo Sapiens
LVHSYSYDW

SEQ ID NO: 987235 - protein, 9 aa, Homo Sapiens
AIALVLGRG

SEQ ID NO: 987236 - protein, 9 aa, Homo Sapiens
LRKDLFSSK

SEQ ID NO: 987237 - protein, 9 aa, Homo Sapiens
LFRLEARLH

SEQ ID NO: 987238 - protein, 9 aa, Homo Sapiens
SVIDLIKNT

SEQ ID NO: 987239 - protein, 9 aa, Homo Sapiens
RSPPGKLQG

SEQ ID NO: 987240 - protein, 9 aa, Homo Sapiens
LLHCLKKTT

SEQ ID NO: 987241 - protein, 9 aa, Homo Sapiens
NSRRRKVVG

SEQ ID NO: 987242 - protein, 9 aa, Homo Sapiens
AGLRLGPDS

SEQ ID NO: 987243 - protein, 9 aa, Homo Sapiens
PPARFEAQK

SEQ ID NO: 987244 - protein, 9 aa, Homo Sapiens
SESSFRSYG

SEQ ID NO: 987245 - protein, 9 aa, Homo Sapiens
NKAGYRKNL

SEQ ID NO: 987246 - protein, 9 aa, Homo Sapiens
SKKQELEVL

SEQ ID NO: 987247 - protein, 9 aa, Homo Sapiens
LKNLYPLLL

SEQ ID NO: 987248 - protein, 9 aa, Homo Sapiens
VTPKMITDY

SEQ ID NO: 987249 - protein, 9 aa, Homo Sapiens
FSEPTNNTP

SEQ ID NO: 987250 - protein, 9 aa, Homo Sapiens
MMMNFNGNN

SEQ ID NO: 987251 - protein, 9 aa, Homo Sapiens
HHINCYTDY

SEQ ID NO: 987252 - protein, 9 aa, Homo Sapiens
PGVPEIPGA

SEQ ID NO: 987253 - protein, 9 aa, Homo Sapiens
SQERLKLSN

SEQ ID NO: 987254 - protein, 9 aa, Homo Sapiens
MGYGIETLF

SEQ ID NO: 987255 - protein, 9 aa, Homo Sapiens
NAIALVLGR

SEQ ID NO: 987256 - protein, 9 aa, Homo Sapiens
QNFDFEDQR

SEQ ID NO: 987257 - protein, 9 aa, Homo Sapiens
LPAELIREP

SEQ ID NO: 987258 - protein, 9 aa, Homo Sapiens
PWEGRPNQS

SEQ ID NO: 987259 - protein, 9 aa, Homo Sapiens
LELAEYSAI

SEQ ID NO: 987260 - protein, 9 aa, Homo Sapiens
PGKLQGPPP

SEQ ID NO: 987261 - protein, 9 aa, Homo Sapiens
LLYSRHCDP

SEQ ID NO: 987262 - protein, 9 aa, Homo Sapiens
TVNVEGSGK

SEQ ID NO: 987263 - protein, 9 aa, Homo Sapiens
IPAEPEVLP

SEQ ID NO: 987264 - protein, 9 aa, Homo Sapiens
NKEPLDFKE

SEQ ID NO: 987265 - protein, 9 aa, Homo Sapiens
EEASDKNKG

SEQ ID NO: 987266 - protein, 9 aa, Homo Sapiens
GIETLFGYL

SEQ ID NO: 987267 - protein, 9 aa, Homo Sapiens
VGNKLRRAD

SEQ ID NO: 987268 - protein, 9 aa, Homo Sapiens
HTFLDHCTF

SEQ ID NO: 987269 - protein, 9 aa, Homo Sapiens
EYRINKSAW

SEQ ID NO: 987270 - protein, 9 aa, Homo Sapiens
FSTEQSLAN

SEQ ID NO: 987271 - protein, 9 aa, Homo Sapiens
FRLEARLHT

SEQ ID NO: 987272 - protein, 9 aa, Homo Sapiens
ANKFEMKDM

SEQ ID NO: 987273 - protein, 9 aa, Homo Sapiens
TSGTSPPRT

SEQ ID NO: 987274 - protein, 9 aa, Homo Sapiens
EEYRFNGFR

SEQ ID NO: 987275 - protein, 9 aa, Homo Sapiens
LIQRRTKIS

SEQ ID NO: 987276 - protein, 9 aa, Homo Sapiens
ARLRALRPE

SEQ ID NO: 987277 - protein, 9 aa, Homo Sapiens
AFFGVQQLP

SEQ ID NO: 987278 - protein, 9 aa, Homo Sapiens
QEESEVELL

SEQ ID NO: 987279 - protein, 9 aa, Homo Sapiens
TALNLFLTN

SEQ ID NO: 987280 - protein, 9 aa, Homo Sapiens
SYRVIIFSV

SEQ ID NO: 987281 - protein, 9 aa, Homo Sapiens
IGLLQAKEK

SEQ ID NO: 987282 - protein, 9 aa, Homo Sapiens
KKVQANASV

SEQ ID NO: 987283 - protein, 9 aa, Homo Sapiens
FPYKQKIFE

SEQ ID NO: 987284 - protein, 9 aa, Homo Sapiens
YKPVEAAEP

SEQ ID NO: 987285 - protein, 9 aa, Homo Sapiens
TYKRLRTRE

SEQ ID NO: 987286 - protein, 9 aa, Homo Sapiens
PLYQPLPYH

SEQ ID NO: 987287 - protein, 9 aa, Homo Sapiens
ELEQINCIP

SEQ ID NO: 987288 - protein, 9 aa, Homo Sapiens
YLVQQSIHW

SEQ ID NO: 987289 - protein, 9 aa, Homo Sapiens
RSLHLSPLA

SEQ ID NO: 987290 - protein, 9 aa, Homo Sapiens
SFNFVPSDF

SEQ ID NO: 987291 - protein, 9 aa, Homo Sapiens
PSPTSSFSS

SEQ ID NO: 987292 - protein, 9 aa, Homo Sapiens
LQFFLKYIT

SEQ ID NO: 987293 - protein, 9 aa, Homo Sapiens
APIKLVFSQ

SEQ ID NO: 987294 - protein, 9 aa, Homo Sapiens
ILILLEPIL

SEQ ID NO: 987295 - protein, 9 aa, Homo Sapiens
YECVAKNSR

SEQ ID NO: 987296 - protein, 9 aa, Homo Sapiens
QAEGKKKVE

SEQ ID NO: 987297 - protein, 9 aa, Homo Sapiens
GPMILIHQI

SEQ ID NO: 987298 - protein, 9 aa, Homo Sapiens
PKVPSISYL

SEQ ID NO: 987299 - protein, 9 aa, Homo Sapiens
CGNILNMLC

SEQ ID NO: 987300 - protein, 9 aa, Homo Sapiens
AVLAGTTKA

SEQ ID NO: 987301 - protein, 9 aa, Homo Sapiens
KNLYPLLLV

SEQ ID NO: 987302 - protein, 9 aa, Homo Sapiens
MAVAVKTLQ

SEQ ID NO: 987303 - protein, 9 aa, Homo Sapiens
GFDVLNALD

SEQ ID NO: 987304 - protein, 9 aa, Homo Sapiens
KKNPEFDLH

SEQ ID NO: 987305 - protein, 9 aa, Homo Sapiens
DKVNFYFIL

SEQ ID NO: 987306 - protein, 9 aa, Homo Sapiens
NSKILLLKC

SEQ ID NO: 987307 - protein, 9 aa, Homo Sapiens
DREKERVHH

SEQ ID NO: 987308 - protein, 9 aa, Homo Sapiens
EKPVTTGVS

SEQ ID NO: 987309 - protein, 9 aa, Homo Sapiens
KKWTKGKTV

SEQ ID NO: 987310 - protein, 9 aa, Homo Sapiens
EFLEELRQD

SEQ ID NO: 987311 - protein, 9 aa, Homo Sapiens
LEVVLAKKC

SEQ ID NO: 987312 - protein, 9 aa, Homo Sapiens
CPSSHSSIS

SEQ ID NO: 987313 - protein, 9 aa, Homo Sapiens
APHSFGLGG

SEQ ID NO: 987314 - protein, 9 aa, Homo Sapiens
NPSALSSLP

SEQ ID NO: 987315 - protein, 9 aa, Homo Sapiens
YLLGSIIVE

SEQ ID NO: 987316 - protein, 9 aa, Homo Sapiens
RGLQIPHEL

SEQ ID NO: 987317 - protein, 9 aa, Homo Sapiens
TFHSWPSSM

SEQ ID NO: 987318 - protein, 9 aa, Homo Sapiens
GEYDSPEDN

SEQ ID NO: 987319 - protein, 9 aa, Homo Sapiens
DNVAEIVSF

SEQ ID NO: 987320 - protein, 9 aa, Homo Sapiens
KMVSQEESE

SEQ ID NO: 987321 - protein, 9 aa, Homo Sapiens
PPESQGPRG

SEQ ID NO: 987322 - protein, 9 aa, Homo Sapiens
ENGFLSLLP

SEQ ID NO: 987323 - protein, 9 aa, Homo Sapiens
STTSSERTI

SEQ ID NO: 987324 - protein, 9 aa, Homo Sapiens
VQEKIAKSH

SEQ ID NO: 987325 - protein, 9 aa, Homo Sapiens
SEVPYLHFG

SEQ ID NO: 987326 - protein, 9 aa, Homo Sapiens
KNYKSSSEI

SEQ ID NO: 987327 - protein, 9 aa, Homo Sapiens
QVTIWFQNQ

SEQ ID NO: 987328 - protein, 9 aa, Homo Sapiens
QVAGMLVFL

SEQ ID NO: 987329 - protein, 9 aa, Homo Sapiens
LGTIKIKAL

SEQ ID NO: 987330 - protein, 9 aa, Homo Sapiens
SPSSRSRNK

SEQ ID NO: 987331 - protein, 9 aa, Homo Sapiens
WKKLLDAFD

SEQ ID NO: 987332 - protein, 9 aa, Homo Sapiens
SYDCEPNRS

SEQ ID NO: 987333 - protein, 9 aa, Homo Sapiens
PLGILPPGM

SEQ ID NO: 987334 - protein, 9 aa, Homo Sapiens
VNGEIFYSL

SEQ ID NO: 987335 - protein, 9 aa, Homo Sapiens
GFGATTQIA

SEQ ID NO: 987336 - protein, 9 aa, Homo Sapiens
SHREWNLPI

SEQ ID NO: 987337 - protein, 9 aa, Homo Sapiens
LAGTTKAIF

SEQ ID NO: 987338 - protein, 9 aa, Homo Sapiens
LLRCCLHEG

SEQ ID NO: 987339 - protein, 9 aa, Homo Sapiens
LTLCQETLV

SEQ ID NO: 987340 - protein, 9 aa, Homo Sapiens
NYPPSSPDL

SEQ ID NO: 987341 - protein, 9 aa, Homo Sapiens
GEDEDEPDD

SEQ ID NO: 987342 - protein, 9 aa, Homo Sapiens
GVECTSSND

SEQ ID NO: 987343 - protein, 9 aa, Homo Sapiens
QLVKKGLAS

SEQ ID NO: 987344 - protein, 9 aa, Homo Sapiens
KKKRGHGWS

SEQ ID NO: 987345 - protein, 9 aa, Homo Sapiens
PVCSAGTFK

SEQ ID NO: 987346 - protein, 9 aa, Homo Sapiens
NSTIILLFR

SEQ ID NO: 987347 - protein, 9 aa, Homo Sapiens
NLISAHCLL

SEQ ID NO: 987348 - protein, 9 aa, Homo Sapiens
TNSASVERL

SEQ ID NO: 987349 - protein, 9 aa, Homo Sapiens
HQEGGSCPR

SEQ ID NO: 987350 - protein, 9 aa, Homo Sapiens
KKPINVQVG

SEQ ID NO: 987351 - protein, 9 aa, Homo Sapiens
FNIKEYTLG

SEQ ID NO: 987352 - protein, 9 aa, Homo Sapiens
KREWEKRSK

SEQ ID NO: 987353 - protein, 9 aa, Homo Sapiens
LREVRCVPP

SEQ ID NO: 987354 - protein, 9 aa, Homo Sapiens
FQTPNLPGS

SEQ ID NO: 987355 - protein, 9 aa, Homo Sapiens
VSAFFGVQQ

SEQ ID NO: 987356 - protein, 9 aa, Homo Sapiens
GMLVFLKCE

SEQ ID NO: 987357 - protein, 9 aa, Homo Sapiens
GIIFFFFLI

SEQ ID NO: 987358 - protein, 9 aa, Homo Sapiens
LGQGRNSRF

SEQ ID NO: 987359 - protein, 9 aa, Homo Sapiens
DSCSINSDS

SEQ ID NO: 987360 - protein, 9 aa, Homo Sapiens
YFSGEQARE

SEQ ID NO: 987361 - protein, 9 aa, Homo Sapiens
LYRKFVHPF

SEQ ID NO: 987362 - protein, 9 aa, Homo Sapiens
QSLKELQRL

SEQ ID NO: 987363 - protein, 9 aa, Homo Sapiens
KMCPNITRI

SEQ ID NO: 987364 - protein, 9 aa, Homo Sapiens
LLQTALSSP

SEQ ID NO: 987365 - protein, 9 aa, Homo Sapiens
VLVTQQFSC

SEQ ID NO: 987366 - protein, 9 aa, Homo Sapiens
DIRKAMAQK

SEQ ID NO: 987367 - protein, 9 aa, Homo Sapiens
CRCNQRWVY

SEQ ID NO: 987368 - protein, 9 aa, Homo Sapiens
FLLLLVSYR

SEQ ID NO: 987369 - protein, 9 aa, Homo Sapiens
NPRDRIHCL

SEQ ID NO: 987370 - protein, 9 aa, Homo Sapiens
AQRKPESFA

SEQ ID NO: 987371 - protein, 9 aa, Homo Sapiens
HQTIPVSFP

SEQ ID NO: 987372 - protein, 9 aa, Homo Sapiens
EYDSPEDNM

SEQ ID NO: 987373 - protein, 9 aa, Homo Sapiens
SRLTAEEKK

SEQ ID NO: 987374 - protein, 9 aa, Homo Sapiens
VKRVGNSEE

SEQ ID NO: 987375 - protein, 9 aa, Homo Sapiens
AVKIAEFIL

SEQ ID NO: 987376 - protein, 9 aa, Homo Sapiens
YGEDENPLP

SEQ ID NO: 987377 - protein, 9 aa, Homo Sapiens
PWWHKNLTG

SEQ ID NO: 987378 - protein, 9 aa, Homo Sapiens
KFKPVETPP

SEQ ID NO: 987379 - protein, 9 aa, Homo Sapiens
NQAEHAAKY

SEQ ID NO: 987380 - protein, 9 aa, Homo Sapiens
CCGGFCRRP

SEQ ID NO: 987381 - protein, 9 aa, Homo Sapiens
KGKKASTGR

SEQ ID NO: 987382 - protein, 9 aa, Homo Sapiens
SNYLLGSII

SEQ ID NO: 987383 - protein, 9 aa, Homo Sapiens
SDGFPAGPT

SEQ ID NO: 987384 - protein, 9 aa, Homo Sapiens
SYLSLGLKA

SEQ ID NO: 987385 - protein, 9 aa, Homo Sapiens
PGVSGDAGM

SEQ ID NO: 987386 - protein, 9 aa, Homo Sapiens
FHEVDYNTF

SEQ ID NO: 987387 - protein, 9 aa, Homo Sapiens
QRDINASDF

SEQ ID NO: 987388 - protein, 9 aa, Homo Sapiens
ACADTSLFE

SEQ ID NO: 987389 - protein, 9 aa, Homo Sapiens
WRIYYNITD

SEQ ID NO: 987390 - protein, 9 aa, Homo Sapiens
EKAKSQSSL

SEQ ID NO: 987391 - protein, 9 aa, Homo Sapiens
NLGKHLNLM

SEQ ID NO: 987392 - protein, 9 aa, Homo Sapiens
FNFVPSDFM

SEQ ID NO: 987393 - protein, 9 aa, Homo Sapiens
FQIQLLMTD

SEQ ID NO: 987394 - protein, 9 aa, Homo Sapiens
DRSEVLLLT

SEQ ID NO: 987395 - protein, 9 aa, Homo Sapiens
ISYRFSRGV

SEQ ID NO: 987396 - protein, 9 aa, Homo Sapiens
KPLCRKPGL

SEQ ID NO: 987397 - protein, 9 aa, Homo Sapiens
RKNNKKEAL

SEQ ID NO: 987398 - protein, 9 aa, Homo Sapiens
LLSTSIDNF

SEQ ID NO: 987399 - protein, 9 aa, Homo Sapiens
ECRCNQRWV

SEQ ID NO: 987400 - protein, 9 aa, Homo Sapiens
LPELPESSV

SEQ ID NO: 987401 - protein, 9 aa, Homo Sapiens
GFHEVDYNT

SEQ ID NO: 987402 - protein, 9 aa, Homo Sapiens
TSSERTITS

SEQ ID NO: 987403 - protein, 9 aa, Homo Sapiens
ENFLHTYSL

SEQ ID NO: 987404 - protein, 9 aa, Homo Sapiens
HINVTSVGK

SEQ ID NO: 987405 - protein, 9 aa, Homo Sapiens
LDTNNNSPE

SEQ ID NO: 987406 - protein, 9 aa, Homo Sapiens
LGLTQNPLR

SEQ ID NO: 987407 - protein, 9 aa, Homo Sapiens
THYFHGLVK

SEQ ID NO: 987408 - protein, 9 aa, Homo Sapiens
YLFFGSLAF

SEQ ID NO: 987409 - protein, 9 aa, Homo Sapiens
PQEINMKEP

SEQ ID NO: 987410 - protein, 9 aa, Homo Sapiens
PQTVPQSGN

SEQ ID NO: 987411 - protein, 9 aa, Homo Sapiens
VTQQFSCQN

SEQ ID NO: 987412 - protein, 9 aa, Homo Sapiens
VELLFQRRN

SEQ ID NO: 987413 - protein, 9 aa, Homo Sapiens
SNKMVSQEE

SEQ ID NO: 987414 - protein, 9 aa, Homo Sapiens
GKLRQSLKE

SEQ ID NO: 987415 - protein, 9 aa, Homo Sapiens
EARHGGNVA

SEQ ID NO: 987416 - protein, 9 aa, Homo Sapiens
SRAPSCSGS

SEQ ID NO: 987417 - protein, 9 aa, Homo Sapiens
YKVGQDLTV

SEQ ID NO: 987418 - protein, 9 aa, Homo Sapiens
NEHETQVVV

SEQ ID NO: 987419 - protein, 9 aa, Homo Sapiens
TALSSPPPP

SEQ ID NO: 987420 - protein, 9 aa, Homo Sapiens
TSVSVVTPT

SEQ ID NO: 987421 - protein, 9 aa, Homo Sapiens
LLPKLQQVP

SEQ ID NO: 987422 - protein, 9 aa, Homo Sapiens
GESGSGGGS

SEQ ID NO: 987423 - protein, 9 aa, Homo Sapiens
QAQVYFEEA

SEQ ID NO: 987424 - protein, 9 aa, Homo Sapiens
SKSRTDLKK

SEQ ID NO: 987425 - protein, 9 aa, Homo Sapiens
DKTSRIWFL

SEQ ID NO: 987426 - protein, 9 aa, Homo Sapiens
LQDKLRTQR

SEQ ID NO: 987427 - protein, 9 aa, Homo Sapiens
ENKFKWNLT

SEQ ID NO: 987428 - protein, 9 aa, Homo Sapiens
VFYPRSHFL

SEQ ID NO: 987429 - protein, 9 aa, Homo Sapiens
LNEQAFPFP

SEQ ID NO: 987430 - protein, 9 aa, Homo Sapiens
FFVLGLFLW

SEQ ID NO: 987431 - protein, 9 aa, Homo Sapiens
ERMKIETNR

SEQ ID NO: 987432 - protein, 9 aa, Homo Sapiens
VYSGILEIL

SEQ ID NO: 987433 - protein, 9 aa, Homo Sapiens
SVNNNVTEY

SEQ ID NO: 987434 - protein, 9 aa, Homo Sapiens
KVQANASVR

SEQ ID NO: 987435 - protein, 9 aa, Homo Sapiens
VTSELSEGE

SEQ ID NO: 987436 - protein, 9 aa, Homo Sapiens
LKLDLGKKV

SEQ ID NO: 987437 - protein, 9 aa, Homo Sapiens
NVSKEKLRS

SEQ ID NO: 987438 - protein, 9 aa, Homo Sapiens
SKFMTSELE

SEQ ID NO: 987439 - protein, 9 aa, Homo Sapiens
KYNECLSAP

SEQ ID NO: 987440 - protein, 9 aa, Homo Sapiens
SLPQVFIFF

SEQ ID NO: 987441 - protein, 9 aa, Homo Sapiens
LRTRECNNP

SEQ ID NO: 987442 - protein, 9 aa, Homo Sapiens
ETMRASSTL

SEQ ID NO: 987443 - protein, 9 aa, Homo Sapiens
DDVPVMLPS

SEQ ID NO: 987444 - protein, 9 aa, Homo Sapiens
KAPALEELV

SEQ ID NO: 987445 - protein, 9 aa, Homo Sapiens
TSLQWSNPT

SEQ ID NO: 987446 - protein, 9 aa, Homo Sapiens
KFESYAYTR

SEQ ID NO: 987447 - protein, 9 aa, Homo Sapiens
ENFSFLEIW

SEQ ID NO: 987448 - protein, 9 aa, Homo Sapiens
LKLEALDVT

SEQ ID NO: 987449 - protein, 9 aa, Homo Sapiens
KITLLAPER

SEQ ID NO: 987450 - protein, 9 aa, Homo Sapiens
LFNIKEYTL

SEQ ID NO: 987451 - protein, 9 aa, Homo Sapiens
QRDIRKAMA

SEQ ID NO: 987452 - protein, 9 aa, Homo Sapiens
NVDLTEWLW

SEQ ID NO: 987453 - protein, 9 aa, Homo Sapiens
MKNHNSHDV

SEQ ID NO: 987454 - protein, 9 aa, Homo Sapiens
HEQIKSLEQ

SEQ ID NO: 987455 - protein, 9 aa, Homo Sapiens
NGIDGLNRE

SEQ ID NO: 987456 - protein, 9 aa, Homo Sapiens
QQAAPVEEV

SEQ ID NO: 987457 - protein, 9 aa, Homo Sapiens
TSGLKDYPW

SEQ ID NO: 987458 - protein, 9 aa, Homo Sapiens
GIVAPHSFG

SEQ ID NO: 987459 - protein, 9 aa, Homo Sapiens
MAAVRDKID

SEQ ID NO: 987460 - protein, 9 aa, Homo Sapiens
VTDKDEGAE

SEQ ID NO: 987461 - protein, 9 aa, Homo Sapiens
NEKNTPSPV

SEQ ID NO: 987462 - protein, 9 aa, Homo Sapiens
YYEDITLGS

SEQ ID NO: 987463 - protein, 9 aa, Homo Sapiens
VGWLQRLQK

SEQ ID NO: 987464 - protein, 9 aa, Homo Sapiens
LTIPAITSN

SEQ ID NO: 987465 - protein, 9 aa, Homo Sapiens
RGASARPPP

SEQ ID NO: 987466 - protein, 9 aa, Homo Sapiens
DAAGGLHSF

SEQ ID NO: 987467 - protein, 9 aa, Homo Sapiens
WALLREEKK

SEQ ID NO: 987468 - protein, 9 aa, Homo Sapiens
GSVTYMDKN

SEQ ID NO: 987469 - protein, 9 aa, Homo Sapiens
CYQGDGQSY

SEQ ID NO: 987470 - protein, 9 aa, Homo Sapiens
QELPELPES

SEQ ID NO: 987471 - protein, 9 aa, Homo Sapiens
DSALFFQDY

SEQ ID NO: 987472 - protein, 9 aa, Homo Sapiens
KLLEMEKQA

SEQ ID NO: 987473 - protein, 9 aa, Homo Sapiens
QTPLTARLL

SEQ ID NO: 987474 - protein, 9 aa, Homo Sapiens
LVGPRPPRG

SEQ ID NO: 987475 - protein, 9 aa, Homo Sapiens
GSAQLVGRQ

SEQ ID NO: 987476 - protein, 9 aa, Homo Sapiens
NVKENKFKW

SEQ ID NO: 987477 - protein, 9 aa, Homo Sapiens
RGVSSSIAG

SEQ ID NO: 987478 - protein, 9 aa, Homo Sapiens
QTFTKWINS

SEQ ID NO: 987479 - protein, 9 aa, Homo Sapiens
DGVLFMQVA

SEQ ID NO: 987480 - protein, 9 aa, Homo Sapiens
ILNSPDNVP

SEQ ID NO: 987481 - protein, 9 aa, Homo Sapiens
LIKKPTVDP

SEQ ID NO: 987482 - protein, 9 aa, Homo Sapiens
TDSILNSPD

SEQ ID NO: 987483 - protein, 9 aa, Homo Sapiens
INADNDHLF

SEQ ID NO: 987484 - protein, 9 aa, Homo Sapiens
RPLPVDTFL

SEQ ID NO: 987485 - protein, 9 aa, Homo Sapiens
KEEEKEEGE

SEQ ID NO: 987486 - protein, 9 aa, Homo Sapiens
NHNSHDVLL

SEQ ID NO: 987487 - protein, 9 aa, Homo Sapiens
PVDMLEVVL

SEQ ID NO: 987488 - protein, 9 aa, Homo Sapiens
MARLYRKQP

SEQ ID NO: 987489 - protein, 9 aa, Homo Sapiens
RCCITAASY

SEQ ID NO: 987490 - protein, 9 aa, Homo Sapiens
CSTAILGAI

SEQ ID NO: 987491 - protein, 9 aa, Homo Sapiens
SINSDSEAK

SEQ ID NO: 987492 - protein, 9 aa, Homo Sapiens
TNQAEHAAK

SEQ ID NO: 987493 - protein, 9 aa, Homo Sapiens
DDGVGDGNE

SEQ ID NO: 987494 - protein, 9 aa, Homo Sapiens
SLLVLVGPR

SEQ ID NO: 987495 - protein, 9 aa, Homo Sapiens
FDPDVGENF

SEQ ID NO: 987496 - protein, 9 aa, Homo Sapiens
YLIYDKTDI

SEQ ID NO: 987497 - protein, 9 aa, Homo Sapiens
LAVCEKSSA

SEQ ID NO: 987498 - protein, 9 aa, Homo Sapiens
SFTCRLERD

SEQ ID NO: 987499 - protein, 9 aa, Homo Sapiens
QTTLKQPTT

SEQ ID NO: 987500 - protein, 9 aa, Homo Sapiens
GPPGFSFFQ

SEQ ID NO: 987501 - protein, 9 aa, Homo Sapiens
ALNYKIRGY

SEQ ID NO: 987502 - protein, 9 aa, Homo Sapiens
TIWFQNQRV

SEQ ID NO: 987503 - protein, 9 aa, Homo Sapiens
FDLKNLYPL

SEQ ID NO: 987504 - protein, 9 aa, Homo Sapiens
EKNLGKLVH

SEQ ID NO: 987505 - protein, 9 aa, Homo Sapiens
ERHVSLRLD

SEQ ID NO: 987506 - protein, 9 aa, Homo Sapiens
GFSEPTNNT

SEQ ID NO: 987507 - protein, 9 aa, Homo Sapiens
DGDEERLFQ

SEQ ID NO: 987508 - protein, 9 aa, Homo Sapiens
FLIGWDENQ

SEQ ID NO: 987509 - protein, 9 aa, Homo Sapiens
SLILVGPIM

SEQ ID NO: 987510 - protein, 9 aa, Homo Sapiens
GPPGFLGLP

SEQ ID NO: 987511 - protein, 9 aa, Homo Sapiens
MISFSECKI

SEQ ID NO: 987512 - protein, 9 aa, Homo Sapiens
LQNIFFPIW

SEQ ID NO: 987513 - protein, 9 aa, Homo Sapiens
EGSKSNEWR

SEQ ID NO: 987514 - protein, 9 aa, Homo Sapiens
LGGDDFLDC

SEQ ID NO: 987515 - protein, 9 aa, Homo Sapiens
VHKDAELAE

SEQ ID NO: 987516 - protein, 9 aa, Homo Sapiens
KQVSTLGKR

SEQ ID NO: 987517 - protein, 9 aa, Homo Sapiens
EEKEEGEEE

SEQ ID NO: 987518 - protein, 9 aa, Homo Sapiens
FRLRFEACC

SEQ ID NO: 987519 - protein, 9 aa, Homo Sapiens
LQKLFRAKN

SEQ ID NO: 987520 - protein, 9 aa, Homo Sapiens
REPLEDLDP

SEQ ID NO: 987521 - protein, 9 aa, Homo Sapiens
ETGVECTSS

SEQ ID NO: 987522 - protein, 9 aa, Homo Sapiens
VTNLLADPV

SEQ ID NO: 987523 - protein, 9 aa, Homo Sapiens
HGLKSLFAY

SEQ ID NO: 987524 - protein, 9 aa, Homo Sapiens
TAPWLFGYR

SEQ ID NO: 987525 - protein, 9 aa, Homo Sapiens
RRTKISRDL

SEQ ID NO: 987526 - protein, 9 aa, Homo Sapiens
SYSDKGPDA

SEQ ID NO: 987527 - protein, 9 aa, Homo Sapiens
QYVKENRGL

SEQ ID NO: 987528 - protein, 9 aa, Homo Sapiens
IDKDSTLRR

SEQ ID NO: 987529 - protein, 9 aa, Homo Sapiens
VVGFALQVE

SEQ ID NO: 987530 - protein, 9 aa, Homo Sapiens
ALNEDPRSW

SEQ ID NO: 987531 - protein, 9 aa, Homo Sapiens
GTRRAVMPP

SEQ ID NO: 987532 - protein, 9 aa, Homo Sapiens
VIADVNTKY

SEQ ID NO: 987533 - protein, 9 aa, Homo Sapiens
PAPAIRKKI

SEQ ID NO: 987534 - protein, 9 aa, Homo Sapiens
CDRKARQQW

SEQ ID NO: 987535 - protein, 9 aa, Homo Sapiens
CLKKTTNHE

SEQ ID NO: 987536 - protein, 9 aa, Homo Sapiens
QLRGETESV

SEQ ID NO: 987537 - protein, 9 aa, Homo Sapiens
AVSGATLPK

SEQ ID NO: 987538 - protein, 9 aa, Homo Sapiens
DMTSFSYGT

SEQ ID NO: 987539 - protein, 9 aa, Homo Sapiens
SVEVVQSKI

SEQ ID NO: 987540 - protein, 9 aa, Homo Sapiens
SPLEVLKRD

SEQ ID NO: 987541 - protein, 9 aa, Homo Sapiens
EVPYVHKNP

SEQ ID NO: 987542 - protein, 9 aa, Homo Sapiens
EFILKEAQI

SEQ ID NO: 987543 - protein, 9 aa, Homo Sapiens
EVSAFFGVQ

SEQ ID NO: 987544 - protein, 9 aa, Homo Sapiens
LCRCGSETM

SEQ ID NO: 987545 - protein, 9 aa, Homo Sapiens
EYENQFESE

SEQ ID NO: 987546 - protein, 9 aa, Homo Sapiens
ADNNNRDHK

SEQ ID NO: 987547 - protein, 9 aa, Homo Sapiens
NAPLDGLTV

SEQ ID NO: 987548 - protein, 9 aa, Homo Sapiens
SPGPPEDVQ

SEQ ID NO: 987549 - protein, 9 aa, Homo Sapiens
TFLDKKNWT

SEQ ID NO: 987550 - protein, 9 aa, Homo Sapiens
TTLKQPTTL

SEQ ID NO: 987551 - protein, 9 aa, Homo Sapiens
VEDAPRQTP

SEQ ID NO: 987552 - protein, 9 aa, Homo Sapiens
KKYNIKLKW

SEQ ID NO: 987553 - protein, 9 aa, Homo Sapiens
PKYLEAPPS

SEQ ID NO: 987554 - protein, 9 aa, Homo Sapiens
DAELAEHLN

SEQ ID NO: 987555 - protein, 9 aa, Homo Sapiens
VLPAEVEET

SEQ ID NO: 987556 - protein, 9 aa, Homo Sapiens
NISDLSLIC

SEQ ID NO: 987557 - protein, 9 aa, Homo Sapiens
AGAYLSNLS

SEQ ID NO: 987558 - protein, 9 aa, Homo Sapiens
MALSERRQK

SEQ ID NO: 987559 - protein, 9 aa, Homo Sapiens
YRLSCCVST

SEQ ID NO: 987560 - protein, 9 aa, Homo Sapiens
EALLQLSQI

SEQ ID NO: 987561 - protein, 9 aa, Homo Sapiens
SPLLWATAS

SEQ ID NO: 987562 - protein, 9 aa, Homo Sapiens
TMSKEVVRH

SEQ ID NO: 987563 - protein, 9 aa, Homo Sapiens
ITAASYRGI

SEQ ID NO: 987564 - protein, 9 aa, Homo Sapiens
MQELDCMKE

SEQ ID NO: 987565 - protein, 9 aa, Homo Sapiens
PPLYQPLPY

SEQ ID NO: 987566 - protein, 9 aa, Homo Sapiens
SPNINAVIS

SEQ ID NO: 987567 - protein, 9 aa, Homo Sapiens
LSCCVSTCC

SEQ ID NO: 987568 - protein, 9 aa, Homo Sapiens
RQDSSDDNH

SEQ ID NO: 987569 - protein, 9 aa, Homo Sapiens
SYPQDFHNV

SEQ ID NO: 987570 - protein, 9 aa, Homo Sapiens
IQAASSFSN

SEQ ID NO: 987571 - protein, 9 aa, Homo Sapiens
KAFPSDYYA

SEQ ID NO: 987572 - protein, 9 aa, Homo Sapiens
QKKIKSFQG

SEQ ID NO: 987573 - protein, 9 aa, Homo Sapiens
NWLSRVEGD

SEQ ID NO: 987574 - protein, 9 aa, Homo Sapiens
FLLVSLIAA

SEQ ID NO: 987575 - protein, 9 aa, Homo Sapiens
IVALVTIET

SEQ ID NO: 987576 - protein, 9 aa, Homo Sapiens
TPAPCPIEP

SEQ ID NO: 987577 - protein, 9 aa, Homo Sapiens
GDDFLDCYI

SEQ ID NO: 987578 - protein, 9 aa, Homo Sapiens
VEGLRHLMF

SEQ ID NO: 987579 - protein, 9 aa, Homo Sapiens
PACLPMHRQ

SEQ ID NO: 987580 - protein, 9 aa, Homo Sapiens
IGATRSSVS

SEQ ID NO: 987581 - protein, 9 aa, Homo Sapiens
VITSTPSAL

SEQ ID NO: 987582 - protein, 9 aa, Homo Sapiens
SLRFPMYFF

SEQ ID NO: 987583 - protein, 9 aa, Homo Sapiens
EQTSSRPVI

SEQ ID NO: 987584 - protein, 9 aa, Homo Sapiens
KKAPSQAPE

SEQ ID NO: 987585 - protein, 9 aa, Homo Sapiens
CSPHSHSAA

SEQ ID NO: 987586 - protein, 9 aa, Homo Sapiens
IQGKLPKSH

SEQ ID NO: 987587 - protein, 9 aa, Homo Sapiens
RICLNNDGG

SEQ ID NO: 987588 - protein, 9 aa, Homo Sapiens
KEQLGRGSR

SEQ ID NO: 987589 - protein, 9 aa, Homo Sapiens
ETQVVVRLK

SEQ ID NO: 987590 - protein, 9 aa, Homo Sapiens
KKYENLLAV

SEQ ID NO: 987591 - protein, 9 aa, Homo Sapiens
ASYFIDKDS

SEQ ID NO: 987592 - protein, 9 aa, Homo Sapiens
FFSDLGSEE

SEQ ID NO: 987593 - protein, 9 aa, Homo Sapiens
GKYQCFARN

SEQ ID NO: 987594 - protein, 9 aa, Homo Sapiens
GLQFFLKYI

SEQ ID NO: 987595 - protein, 9 aa, Homo Sapiens
VTLSDEIRE

SEQ ID NO: 987596 - protein, 9 aa, Homo Sapiens
TTLSRIAGL

SEQ ID NO: 987597 - protein, 9 aa, Homo Sapiens
ASISCAFFL

SEQ ID NO: 987598 - protein, 9 aa, Homo Sapiens
GIVLPAWIV

SEQ ID NO: 987599 - protein, 9 aa, Homo Sapiens
HLDMAPFFS

SEQ ID NO: 987600 - protein, 9 aa, Homo Sapiens
AHIKEGSKS

SEQ ID NO: 987601 - protein, 9 aa, Homo Sapiens
TLKTVPSAT

SEQ ID NO: 987602 - protein, 9 aa, Homo Sapiens
TGVECTSSN

SEQ ID NO: 987603 - protein, 9 aa, Homo Sapiens
AFIDDGGFN

SEQ ID NO: 987604 - protein, 9 aa, Homo Sapiens
SYDKDGLVT

SEQ ID NO: 987605 - protein, 9 aa, Homo Sapiens
SLPALSYFS

SEQ ID NO: 987606 - protein, 9 aa, Homo Sapiens
GYHVPGFSR

SEQ ID NO: 987607 - protein, 9 aa, Homo Sapiens
NAWKQAELS

SEQ ID NO: 987608 - protein, 9 aa, Homo Sapiens
ALNLFLTNQ

SEQ ID NO: 987609 - protein, 9 aa, Homo Sapiens
PELQGIIFF

SEQ ID NO: 987610 - protein, 9 aa, Homo Sapiens
REQGDNGLP

SEQ ID NO: 987611 - protein, 9 aa, Homo Sapiens
VSLLTLELS

SEQ ID NO: 987612 - protein, 9 aa, Homo Sapiens
KGDRSEVGV

SEQ ID NO: 987613 - protein, 9 aa, Homo Sapiens
RNVNIKPDD

SEQ ID NO: 987614 - protein, 9 aa, Homo Sapiens
KNHNSHDVL

SEQ ID NO: 987615 - protein, 9 aa, Homo Sapiens
SLRQLISER

SEQ ID NO: 987616 - protein, 9 aa, Homo Sapiens
PLSPPPPSI

SEQ ID NO: 987617 - protein, 9 aa, Homo Sapiens
GLGNESFLM

SEQ ID NO: 987618 - protein, 9 aa, Homo Sapiens
MAVMRPHFC

SEQ ID NO: 987619 - protein, 9 aa, Homo Sapiens
CLERVIPIK

SEQ ID NO: 987620 - protein, 9 aa, Homo Sapiens
YRSLELAEY

SEQ ID NO: 987621 - protein, 9 aa, Homo Sapiens
RFEVFCGIM

SEQ ID NO: 987622 - protein, 9 aa, Homo Sapiens
RHLVQEKAN

SEQ ID NO: 987623 - protein, 9 aa, Homo Sapiens
TYTLMGKWK

SEQ ID NO: 987624 - protein, 9 aa, Homo Sapiens
LSYFSRTAI

SEQ ID NO: 987625 - protein, 9 aa, Homo Sapiens
EDVSQEEFL

SEQ ID NO: 987626 - protein, 9 aa, Homo Sapiens
KITLRSRAV

SEQ ID NO: 987627 - protein, 9 aa, Homo Sapiens
DAKLNTPSF

SEQ ID NO: 987628 - protein, 9 aa, Homo Sapiens
KVDSDLEEE

SEQ ID NO: 987629 - protein, 9 aa, Homo Sapiens
SFPYKQKIF

SEQ ID NO: 987630 - protein, 9 aa, Homo Sapiens
IETLFGYLR

SEQ ID NO: 987631 - protein, 9 aa, Homo Sapiens
RVRWCRPDC

SEQ ID NO: 987632 - protein, 9 aa, Homo Sapiens
TRVEVSRQI

SEQ ID NO: 987633 - protein, 9 aa, Homo Sapiens
PPEAPEKIF

SEQ ID NO: 987634 - protein, 9 aa, Homo Sapiens
DFIPRLDLR

SEQ ID NO: 987635 - protein, 9 aa, Homo Sapiens
DEENYLNSK

SEQ ID NO: 987636 - protein, 9 aa, Homo Sapiens
QFFLKYITG

SEQ ID NO: 987637 - protein, 9 aa, Homo Sapiens
HHHLLHCLK

SEQ ID NO: 987638 - protein, 9 aa, Homo Sapiens
SKGAGTNQP

SEQ ID NO: 987639 - protein, 9 aa, Homo Sapiens
LALWNWELS

SEQ ID NO: 987640 - protein, 9 aa, Homo Sapiens
LVCNDKNPC

SEQ ID NO: 987641 - protein, 9 aa, Homo Sapiens
IAGAVICWL

SEQ ID NO: 987642 - protein, 9 aa, Homo Sapiens
TLSLLVDWS

SEQ ID NO: 987643 - protein, 9 aa, Homo Sapiens
DTHQDKLLC

SEQ ID NO: 987644 - protein, 9 aa, Homo Sapiens
GKKKVEADD

SEQ ID NO: 987645 - protein, 9 aa, Homo Sapiens
YFSRDEVSL

SEQ ID NO: 987646 - protein, 9 aa, Homo Sapiens
DYVESITSS

SEQ ID NO: 987647 - protein, 9 aa, Homo Sapiens
SWNVVMFVI

SEQ ID NO: 987648 - protein, 9 aa, Homo Sapiens
IICYKAIKK

SEQ ID NO: 987649 - protein, 9 aa, Homo Sapiens
DAATFSSLG

SEQ ID NO: 987650 - protein, 9 aa, Homo Sapiens
CMQPHKDIL

SEQ ID NO: 987651 - protein, 9 aa, Homo Sapiens
TFNEKGKKA

SEQ ID NO: 987652 - protein, 9 aa, Homo Sapiens
LPGPPGFSF

SEQ ID NO: 987653 - protein, 9 aa, Homo Sapiens
QQFSCQNPL

SEQ ID NO: 987654 - protein, 9 aa, Homo Sapiens
DLRYTTVTP

SEQ ID NO: 987655 - protein, 9 aa, Homo Sapiens
PPNVSKEKL

SEQ ID NO: 987656 - protein, 9 aa, Homo Sapiens
HQDKLLCTV

SEQ ID NO: 987657 - protein, 9 aa, Homo Sapiens
NDEQNSDNA

SEQ ID NO: 987658 - protein, 9 aa, Homo Sapiens
FCLLGGALL

SEQ ID NO: 987659 - protein, 9 aa, Homo Sapiens
DQTAPRCQL

SEQ ID NO: 987660 - protein, 9 aa, Homo Sapiens
PKPWWHKNL

SEQ ID NO: 987661 - protein, 9 aa, Homo Sapiens
VTWLRNEKP

SEQ ID NO: 987662 - protein, 9 aa, Homo Sapiens
GQSSGFRQH

SEQ ID NO: 987663 - protein, 9 aa, Homo Sapiens
FSSSLLTQS

SEQ ID NO: 987664 - protein, 9 aa, Homo Sapiens
IFERDTVSL

SEQ ID NO: 987665 - protein, 9 aa, Homo Sapiens
KKIYRWPAR

SEQ ID NO: 987666 - protein, 9 aa, Homo Sapiens
HSVRGQALY

SEQ ID NO: 987667 - protein, 9 aa, Homo Sapiens
RHFSRVMPL

SEQ ID NO: 987668 - protein, 9 aa, Homo Sapiens
WNVVMFVIY

SEQ ID NO: 987669 - protein, 9 aa, Homo Sapiens
GPEKINKRI

SEQ ID NO: 987670 - protein, 9 aa, Homo Sapiens
LEAPPSVRF

SEQ ID NO: 987671 - protein, 9 aa, Homo Sapiens
TCKILAVMK

SEQ ID NO: 987672 - protein, 9 aa, Homo Sapiens
AAESVNNNV

SEQ ID NO: 987673 - protein, 9 aa, Homo Sapiens
RTILRILSA

SEQ ID NO: 987674 - protein, 9 aa, Homo Sapiens
ARLYRKQPQ

SEQ ID NO: 987675 - protein, 9 aa, Homo Sapiens
HRPGSQKVD

SEQ ID NO: 987676 - protein, 9 aa, Homo Sapiens
DLGKKVERS

SEQ ID NO: 987677 - protein, 9 aa, Homo Sapiens
EVSRQIFQT

SEQ ID NO: 987678 - protein, 9 aa, Homo Sapiens
VSLWSSATE

SEQ ID NO: 987679 - protein, 9 aa, Homo Sapiens
RIVRLVRIG

SEQ ID NO: 987680 - protein, 9 aa, Homo Sapiens
EIGFSSSLL

SEQ ID NO: 987681 - protein, 9 aa, Homo Sapiens
CKKIHHNLT

SEQ ID NO: 987682 - protein, 9 aa, Homo Sapiens
GKHLNLMER

SEQ ID NO: 987683 - protein, 9 aa, Homo Sapiens
DDARLFTGK

SEQ ID NO: 987684 - protein, 9 aa, Homo Sapiens
GKFFNHSSS

SEQ ID NO: 987685 - protein, 9 aa, Homo Sapiens
TALTLRSKF

SEQ ID NO: 987686 - protein, 9 aa, Homo Sapiens
FSSLGAMFA

SEQ ID NO: 987687 - protein, 9 aa, Homo Sapiens
RFSRAVQDV

SEQ ID NO: 987688 - protein, 9 aa, Homo Sapiens
NAGKHVFVE

SEQ ID NO: 987689 - protein, 9 aa, Homo Sapiens
FRMNGDKFQ

SEQ ID NO: 987690 - protein, 9 aa, Homo Sapiens
ASDFAFSPS

SEQ ID NO: 987691 - protein, 9 aa, Homo Sapiens
EGGKTFCIL

SEQ ID NO: 987692 - protein, 9 aa, Homo Sapiens
DMAPFFSDL

SEQ ID NO: 987693 - protein, 9 aa, Homo Sapiens
DHLYFFRIL

SEQ ID NO: 987694 - protein, 9 aa, Homo Sapiens
DARLFTGKI

SEQ ID NO: 987695 - protein, 9 aa, Homo Sapiens
QFQALQNSL

SEQ ID NO: 987696 - protein, 9 aa, Homo Sapiens
LNLPAGKRK

SEQ ID NO: 987697 - protein, 9 aa, Homo Sapiens
VAFNFTATQ

SEQ ID NO: 987698 - protein, 9 aa, Homo Sapiens
GTMYNTERH

SEQ ID NO: 987699 - protein, 9 aa, Homo Sapiens
PLQPTKTRF

SEQ ID NO: 987700 - protein, 9 aa, Homo Sapiens
WSFPYKQKI

SEQ ID NO: 987701 - protein, 9 aa, Homo Sapiens
TQVVVRLKS

SEQ ID NO: 987702 - protein, 9 aa, Homo Sapiens
CTNTHTLGP

SEQ ID NO: 987703 - protein, 9 aa, Homo Sapiens
VVEDAPRQT

SEQ ID NO: 987704 - protein, 9 aa, Homo Sapiens
HKNPPLERD

SEQ ID NO: 987705 - protein, 9 aa, Homo Sapiens
RHSRRNKGV

SEQ ID NO: 987706 - protein, 9 aa, Homo Sapiens
SQFFFGNTP

SEQ ID NO: 987707 - protein, 9 aa, Homo Sapiens
CIWKQKGRC

SEQ ID NO: 987708 - protein, 9 aa, Homo Sapiens
ITSTPSALP

SEQ ID NO: 987709 - protein, 9 aa, Homo Sapiens
SYTALYVIY

SEQ ID NO: 987710 - protein, 9 aa, Homo Sapiens
PDHAVPTAF

SEQ ID NO: 987711 - protein, 9 aa, Homo Sapiens
QNLFRALWR

SEQ ID NO: 987712 - protein, 9 aa, Homo Sapiens
SETLLGTDT

SEQ ID NO: 987713 - protein, 9 aa, Homo Sapiens
DASKREWEK

SEQ ID NO: 987714 - protein, 9 aa, Homo Sapiens
ALQVEMNHF

SEQ ID NO: 987715 - protein, 9 aa, Homo Sapiens
VSSCHCALC

SEQ ID NO: 987716 - protein, 9 aa, Homo Sapiens
HAMALSERR

SEQ ID NO: 987717 - protein, 9 aa, Homo Sapiens
PQPASKKLK

SEQ ID NO: 987718 - protein, 9 aa, Homo Sapiens
PAIFNSLSL

SEQ ID NO: 987719 - protein, 9 aa, Homo Sapiens
EGAKGKLGP

SEQ ID NO: 987720 - protein, 9 aa, Homo Sapiens
PGLAIQGKL

SEQ ID NO: 987721 - protein, 9 aa, Homo Sapiens
VAYAASGPR

SEQ ID NO: 987722 - protein, 9 aa, Homo Sapiens
GEDENPLPD

SEQ ID NO: 987723 - protein, 9 aa, Homo Sapiens
LRRMEAAIT

SEQ ID NO: 987724 - protein, 9 aa, Homo Sapiens
SQEKDGKIN

SEQ ID NO: 987725 - protein, 9 aa, Homo Sapiens
EATARRERR

SEQ ID NO: 987726 - protein, 9 aa, Homo Sapiens
PLSRQVKKV

SEQ ID NO: 987727 - protein, 9 aa, Homo Sapiens
DQLVKKGLA

SEQ ID NO: 987728 - protein, 9 aa, Homo Sapiens
SKSKLQTVY

SEQ ID NO: 987729 - protein, 9 aa, Homo Sapiens
YQKVFSEQG

SEQ ID NO: 987730 - protein, 9 aa, Homo Sapiens
NQGKPRSRL

SEQ ID NO: 987731 - protein, 9 aa, Homo Sapiens
SSSLLTQSK

SEQ ID NO: 987732 - protein, 9 aa, Homo Sapiens
LLELACTNT

SEQ ID NO: 987733 - protein, 9 aa, Homo Sapiens
FSNRCFRKV

SEQ ID NO: 987734 - protein, 9 aa, Homo Sapiens
TAFASNIKE

SEQ ID NO: 987735 - protein, 9 aa, Homo Sapiens
RPCDRKARQ

SEQ ID NO: 987736 - protein, 9 aa, Homo Sapiens
GNSTIILLF

SEQ ID NO: 987737 - protein, 9 aa, Homo Sapiens
SMAGVLAQN

SEQ ID NO: 987738 - protein, 9 aa, Homo Sapiens
LSLLVDWSM

SEQ ID NO: 987739 - protein, 9 aa, Homo Sapiens
RGKKGRKRK

SEQ ID NO: 987740 - protein, 9 aa, Homo Sapiens
DYFNAMTSL

SEQ ID NO: 987741 - protein, 9 aa, Homo Sapiens
SPASCMSVQ

SEQ ID NO: 987742 - protein, 9 aa, Homo Sapiens
GSLLKSGGF

SEQ ID NO: 987743 - protein, 9 aa, Homo Sapiens
PPTRATANR

SEQ ID NO: 987744 - protein, 9 aa, Homo Sapiens
CLGHNHKKV

SEQ ID NO: 987745 - protein, 9 aa, Homo Sapiens
DPFLEIFCM

SEQ ID NO: 987746 - protein, 9 aa, Homo Sapiens
DHINVTSVG

SEQ ID NO: 987747 - protein, 9 aa, Homo Sapiens
KCEECGKFF

SEQ ID NO: 987748 - protein, 9 aa, Homo Sapiens
TWLRNEKPV

SEQ ID NO: 987749 - protein, 9 aa, Homo Sapiens
TLGRNHSGV

SEQ ID NO: 987750 - protein, 9 aa, Homo Sapiens
IILVSHVNF

SEQ ID NO: 987751 - protein, 9 aa, Homo Sapiens
SLLPAPGSL

SEQ ID NO: 987752 - protein, 9 aa, Homo Sapiens
ILTCELSQN

SEQ ID NO: 987753 - protein, 9 aa, Homo Sapiens
GPPGFPGIE

SEQ ID NO: 987754 - protein, 9 aa, Homo Sapiens
VRKAAQQYL

SEQ ID NO: 987755 - protein, 9 aa, Homo Sapiens
KYEFTDPRH

SEQ ID NO: 987756 - protein, 9 aa, Homo Sapiens
GPSRLSYCG

SEQ ID NO: 987757 - protein, 9 aa, Homo Sapiens
GHVCHLCHS

SEQ ID NO: 987758 - protein, 9 aa, Homo Sapiens
ELLNKYCVA

SEQ ID NO: 987759 - protein, 9 aa, Homo Sapiens
TKYQRDIRK

SEQ ID NO: 987760 - protein, 9 aa, Homo Sapiens
NDHLFALRS

SEQ ID NO: 987761 - protein, 9 aa, Homo Sapiens
HSAEESLVN

SEQ ID NO: 987762 - protein, 9 aa, Homo Sapiens
AQFGGIHFV

SEQ ID NO: 987763 - protein, 9 aa, Homo Sapiens
CHFNDGDEV

SEQ ID NO: 987764 - protein, 9 aa, Homo Sapiens
EYEGKYQCF

SEQ ID NO: 987765 - protein, 9 aa, Homo Sapiens
PEDNMNDRK

SEQ ID NO: 987766 - protein, 9 aa, Homo Sapiens
KRFSENFIY

SEQ ID NO: 987767 - protein, 9 aa, Homo Sapiens
TTFVRIGLM

SEQ ID NO: 987768 - protein, 9 aa, Homo Sapiens
SNDAGTYSC

SEQ ID NO: 987769 - protein, 9 aa, Homo Sapiens
SPVFGTFEA

SEQ ID NO: 987770 - protein, 9 aa, Homo Sapiens
HFSRVMPLS

SEQ ID NO: 987771 - protein, 9 aa, Homo Sapiens
EDNLVLPDD

SEQ ID NO: 987772 - protein, 9 aa, Homo Sapiens
LVNNAGIFL

SEQ ID NO: 987773 - protein, 9 aa, Homo Sapiens
TLKFEVYSV

SEQ ID NO: 987774 - protein, 9 aa, Homo Sapiens
LLGLALVIK

SEQ ID NO: 987775 - protein, 9 aa, Homo Sapiens
KEASDSAAR

SEQ ID NO: 987776 - protein, 9 aa, Homo Sapiens
NLLSLKEWL

SEQ ID NO: 987777 - protein, 9 aa, Homo Sapiens
LALDVPRRR

SEQ ID NO: 987778 - protein, 9 aa, Homo Sapiens
TGVQDCYQG

SEQ ID NO: 987779 - protein, 9 aa, Homo Sapiens
SAHCLLLEL

SEQ ID NO: 987780 - protein, 9 aa, Homo Sapiens
LAPADLLIK

SEQ ID NO: 987781 - protein, 9 aa, Homo Sapiens
FPAQFGGIH

SEQ ID NO: 987782 - protein, 9 aa, Homo Sapiens
VLKFYDFKE

SEQ ID NO: 987783 - protein, 9 aa, Homo Sapiens
VEKKWKGLL

SEQ ID NO: 987784 - protein, 9 aa, Homo Sapiens
FCLQLVTVA

SEQ ID NO: 987785 - protein, 9 aa, Homo Sapiens
LSMAGVLAQ

SEQ ID NO: 987786 - protein, 9 aa, Homo Sapiens
EERLSYDCE

SEQ ID NO: 987787 - protein, 9 aa, Homo Sapiens
RVFLVTVGN

SEQ ID NO: 987788 - protein, 9 aa, Homo Sapiens
PSCQPYLCC

SEQ ID NO: 987789 - protein, 9 aa, Homo Sapiens
HGSVTLQKN

SEQ ID NO: 987790 - protein, 9 aa, Homo Sapiens
GEKGDEGPL

SEQ ID NO: 987791 - protein, 9 aa, Homo Sapiens
RGPPPARFE

SEQ ID NO: 987792 - protein, 9 aa, Homo Sapiens
PSRRHFSRV

SEQ ID NO: 987793 - protein, 9 aa, Homo Sapiens
SGFRQHGSG

SEQ ID NO: 987794 - protein, 9 aa, Homo Sapiens
ERWGTVCHH

SEQ ID NO: 987795 - protein, 9 aa, Homo Sapiens
ATIFPGQSI

SEQ ID NO: 987796 - protein, 9 aa, Homo Sapiens
EVTSRAPSC

SEQ ID NO: 987797 - protein, 9 aa, Homo Sapiens
FLEIFCMND

SEQ ID NO: 987798 - protein, 9 aa, Homo Sapiens
GQESICSQA

SEQ ID NO: 987799 - protein, 9 aa, Homo Sapiens
VSNEHETQV

SEQ ID NO: 987800 - protein, 9 aa, Homo Sapiens
ENEFISESS

SEQ ID NO: 987801 - protein, 9 aa, Homo Sapiens
WQRLEEATA

SEQ ID NO: 987802 - protein, 9 aa, Homo Sapiens
SRDSFVLDG

SEQ ID NO: 987803 - protein, 9 aa, Homo Sapiens
YRKAQHELN

SEQ ID NO: 987804 - protein, 9 aa, Homo Sapiens
HSFPRQAPG

SEQ ID NO: 987805 - protein, 9 aa, Homo Sapiens
MAAAFSSDS

SEQ ID NO: 987806 - protein, 9 aa, Homo Sapiens
LQNIVFTVN

SEQ ID NO: 987807 - protein, 9 aa, Homo Sapiens
ESITSSSCA

SEQ ID NO: 987808 - protein, 9 aa, Homo Sapiens
KKEKYAEMA

SEQ ID NO: 987809 - protein, 9 aa, Homo Sapiens
ADSALFFQD

SEQ ID NO: 987810 - protein, 9 aa, Homo Sapiens
RNCLFLLLW

SEQ ID NO: 987811 - protein, 9 aa, Homo Sapiens
ASRRLVKIS

SEQ ID NO: 987812 - protein, 9 aa, Homo Sapiens
PSPGGGGDG

SEQ ID NO: 987813 - protein, 9 aa, Homo Sapiens
RSFRLRFEA

SEQ ID NO: 987814 - protein, 9 aa, Homo Sapiens
HSYLSLGLK

SEQ ID NO: 987815 - protein, 9 aa, Homo Sapiens
SGKLFRWNV

SEQ ID NO: 987816 - protein, 9 aa, Homo Sapiens
VQLERMKIE

SEQ ID NO: 987817 - protein, 9 aa, Homo Sapiens
FTVGSGLPV

SEQ ID NO: 987818 - protein, 9 aa, Homo Sapiens
MLTRNCLFL

SEQ ID NO: 987819 - protein, 9 aa, Homo Sapiens
PIDFFFLRR

SEQ ID NO: 987820 - protein, 9 aa, Homo Sapiens
ERVLDREKE

SEQ ID NO: 987821 - protein, 9 aa, Homo Sapiens
YEEEMGNYN

SEQ ID NO: 987822 - protein, 9 aa, Homo Sapiens
QLCCLCCAL

SEQ ID NO: 987823 - protein, 9 aa, Homo Sapiens
EGEDPIFLY

SEQ ID NO: 987824 - protein, 9 aa, Homo Sapiens
LYCEEKYNE

SEQ ID NO: 987825 - protein, 9 aa, Homo Sapiens
NTSGTSPPR

SEQ ID NO: 987826 - protein, 9 aa, Homo Sapiens
NVIFAVQEK

SEQ ID NO: 987827 - protein, 9 aa, Homo Sapiens
PGPAGPPES

SEQ ID NO: 987828 - protein, 9 aa, Homo Sapiens
KVKGSPSFL

SEQ ID NO: 987829 - protein, 9 aa, Homo Sapiens
QSRHYQQRL

SEQ ID NO: 987830 - protein, 9 aa, Homo Sapiens
SDPQPASKK

SEQ ID NO: 987831 - protein, 9 aa, Homo Sapiens
NEEGSQIYN

SEQ ID NO: 987832 - protein, 9 aa, Homo Sapiens
EDGCCCWDV

SEQ ID NO: 987833 - protein, 9 aa, Homo Sapiens
LEEATARRE

SEQ ID NO: 987834 - protein, 9 aa, Homo Sapiens
LNREQGDNG

SEQ ID NO: 987835 - protein, 9 aa, Homo Sapiens
HCGQNSRRR

SEQ ID NO: 987836 - protein, 9 aa, Homo Sapiens
HCLKKTTNH

SEQ ID NO: 987837 - protein, 9 aa, Homo Sapiens
VNPLKPLCR

SEQ ID NO: 987838 - protein, 9 aa, Homo Sapiens
QSSKNSYFF

SEQ ID NO: 987839 - protein, 9 aa, Homo Sapiens
MVSQEESEV

SEQ ID NO: 987840 - protein, 9 aa, Homo Sapiens
LHGQKGQHY

SEQ ID NO: 987841 - protein, 9 aa, Homo Sapiens
GDGVCHEPG

SEQ ID NO: 987842 - protein, 9 aa, Homo Sapiens
SNKEPLDFK

SEQ ID NO: 987843 - protein, 9 aa, Homo Sapiens
ELLLLKMEQ

SEQ ID NO: 987844 - protein, 9 aa, Homo Sapiens
LEGTFLKNH

SEQ ID NO: 987845 - protein, 9 aa, Homo Sapiens
GAWRDYDDS

SEQ ID NO: 987846 - protein, 9 aa, Homo Sapiens
PENICVSSA

SEQ ID NO: 987847 - protein, 9 aa, Homo Sapiens
KWKNDGKLY

SEQ ID NO: 987848 - protein, 9 aa, Homo Sapiens
AVFFSVFYF

SEQ ID NO: 987849 - protein, 9 aa, Homo Sapiens
LLIAVQDQQ

SEQ ID NO: 987850 - protein, 9 aa, Homo Sapiens
SLYRQQSRK

SEQ ID NO: 987851 - protein, 9 aa, Homo Sapiens
SFPAAGMGH

SEQ ID NO: 987852 - protein, 9 aa, Homo Sapiens
QERWGTVCH

SEQ ID NO: 987853 - protein, 9 aa, Homo Sapiens
AQLKELCYG

SEQ ID NO: 987854 - protein, 9 aa, Homo Sapiens
GPVATISIV

SEQ ID NO: 987855 - protein, 9 aa, Homo Sapiens
ELSPPPLPP

SEQ ID NO: 987856 - protein, 9 aa, Homo Sapiens
TDADEENYL

SEQ ID NO: 987857 - protein, 9 aa, Homo Sapiens
YTALYVIYN

SEQ ID NO: 987858 - protein, 9 aa, Homo Sapiens
IYTYGQAFG

SEQ ID NO: 987859 - protein, 9 aa, Homo Sapiens
YFKFKPVET

SEQ ID NO: 987860 - protein, 9 aa, Homo Sapiens
APCPIEPPP

SEQ ID NO: 987861 - protein, 9 aa, Homo Sapiens
RAKVETKTM

SEQ ID NO: 987862 - protein, 9 aa, Homo Sapiens
LERDHINVT

SEQ ID NO: 987863 - protein, 9 aa, Homo Sapiens
LGSMVYLPG

SEQ ID NO: 987864 - protein, 9 aa, Homo Sapiens
HLPLNYPPS

SEQ ID NO: 987865 - protein, 9 aa, Homo Sapiens
KCLERCLDY

SEQ ID NO: 987866 - protein, 9 aa, Homo Sapiens
KNWTGNELH

SEQ ID NO: 987867 - protein, 9 aa, Homo Sapiens
IGFSSSLLT

SEQ ID NO: 987868 - protein, 9 aa, Homo Sapiens
TENKEKFVY

SEQ ID NO: 987869 - protein, 9 aa, Homo Sapiens
ADTSLFENA

SEQ ID NO: 987870 - protein, 9 aa, Homo Sapiens
KAAIVVHIR

SEQ ID NO: 987871 - protein, 9 aa, Homo Sapiens
RRSRPSFRW

SEQ ID NO: 987872 - protein, 9 aa, Homo Sapiens
GAKGKLGPP

SEQ ID NO: 987873 - protein, 9 aa, Homo Sapiens
LKFEVYSVS

SEQ ID NO: 987874 - protein, 9 aa, Homo Sapiens
LLWATASVS

SEQ ID NO: 987875 - protein, 9 aa, Homo Sapiens
EEIFRRAAN

SEQ ID NO: 987876 - protein, 9 aa, Homo Sapiens
FFWILGSMD

SEQ ID NO: 987877 - protein, 9 aa, Homo Sapiens
FKLFKKIFS

SEQ ID NO: 987878 - protein, 9 aa, Homo Sapiens
RILSASQRK

SEQ ID NO: 987879 - protein, 9 aa, Homo Sapiens
ITQTQARCR

SEQ ID NO: 987880 - protein, 9 aa, Homo Sapiens
FNHTGQESI

SEQ ID NO: 987881 - protein, 9 aa, Homo Sapiens
LGLMEIIAF

SEQ ID NO: 987882 - protein, 9 aa, Homo Sapiens
DIYVTVSFM

SEQ ID NO: 987883 - protein, 9 aa, Homo Sapiens
PQPLELGAE

SEQ ID NO: 987884 - protein, 9 aa, Homo Sapiens
ELSKSIEIY

SEQ ID NO: 987885 - protein, 9 aa, Homo Sapiens
VWEKFDPNA

SEQ ID NO: 987886 - protein, 9 aa, Homo Sapiens
IAGNIYWLD

SEQ ID NO: 987887 - protein, 9 aa, Homo Sapiens
GKPKRKRKK

SEQ ID NO: 987888 - protein, 9 aa, Homo Sapiens
VPGSSPEET

SEQ ID NO: 987889 - protein, 9 aa, Homo Sapiens
RELLNKYCV

SEQ ID NO: 987890 - protein, 9 aa, Homo Sapiens
WKCPHNNIT

SEQ ID NO: 987891 - protein, 9 aa, Homo Sapiens
QKSLQQRAL

SEQ ID NO: 987892 - protein, 9 aa, Homo Sapiens
KERVHHLVL

SEQ ID NO: 987893 - protein, 9 aa, Homo Sapiens
GKKVERSVV

SEQ ID NO: 987894 - protein, 9 aa, Homo Sapiens
VPTAVLVSI

SEQ ID NO: 987895 - protein, 9 aa, Homo Sapiens
RDGGSPLLW

SEQ ID NO: 987896 - protein, 9 aa, Homo Sapiens
STEQSLANI

SEQ ID NO: 987897 - protein, 9 aa, Homo Sapiens
SEGEDPIFL

SEQ ID NO: 987898 - protein, 9 aa, Homo Sapiens
GLQIPHELE

SEQ ID NO: 987899 - protein, 9 aa, Homo Sapiens
PSTEGGKTF

SEQ ID NO: 987900 - protein, 9 aa, Homo Sapiens
QVLLPVPRS

SEQ ID NO: 987901 - protein, 9 aa, Homo Sapiens
LGNLPMKLQ

SEQ ID NO: 987902 - protein, 9 aa, Homo Sapiens
RNQSREHMG

SEQ ID NO: 987903 - protein, 9 aa, Homo Sapiens
FIIKEEMLL

SEQ ID NO: 987904 - protein, 9 aa, Homo Sapiens
FSIHPSFRI

SEQ ID NO: 987905 - protein, 9 aa, Homo Sapiens
NEDPRSWTA

SEQ ID NO: 987906 - protein, 9 aa, Homo Sapiens
KVTEHILPY

SEQ ID NO: 987907 - protein, 9 aa, Homo Sapiens
DNYNELVAK

SEQ ID NO: 987908 - protein, 9 aa, Homo Sapiens
MAAIGPMIL

SEQ ID NO: 987909 - protein, 9 aa, Homo Sapiens
AVSTRVRWC

SEQ ID NO: 987910 - protein, 9 aa, Homo Sapiens
IIDMVSDKG

SEQ ID NO: 987911 - protein, 9 aa, Homo Sapiens
SCAFFLARL

SEQ ID NO: 987912 - protein, 9 aa, Homo Sapiens
PYQENATML

SEQ ID NO: 987913 - protein, 9 aa, Homo Sapiens
NIADLRQNV

SEQ ID NO: 987914 - protein, 9 aa, Homo Sapiens
VMFVIYEQL

SEQ ID NO: 987915 - protein, 9 aa, Homo Sapiens
NKKITIPIT

SEQ ID NO: 987916 - protein, 9 aa, Homo Sapiens
LCSIPVSVE

SEQ ID NO: 987917 - protein, 9 aa, Homo Sapiens
FFFGNTPST

SEQ ID NO: 987918 - protein, 9 aa, Homo Sapiens
IADVNTKYQ

SEQ ID NO: 987919 - protein, 9 aa, Homo Sapiens
DVESDAGKK

SEQ ID NO: 987920 - protein, 9 aa, Homo Sapiens
FYAPSHPPR

SEQ ID NO: 987921 - protein, 9 aa, Homo Sapiens
VGKATTNAC

SEQ ID NO: 987922 - protein, 9 aa, Homo Sapiens
RSPGLCRAL

SEQ ID NO: 987923 - protein, 9 aa, Homo Sapiens
SFHVRQDSP

SEQ ID NO: 987924 - protein, 9 aa, Homo Sapiens
GYTPLLIAV

SEQ ID NO: 987925 - protein, 9 aa, Homo Sapiens
HQNIYTEER

SEQ ID NO: 987926 - protein, 9 aa, Homo Sapiens
NRTCRFKWG

SEQ ID NO: 987927 - protein, 9 aa, Homo Sapiens
RTVLSPDYW

SEQ ID NO: 987928 - protein, 9 aa, Homo Sapiens
EKDGKINFT

SEQ ID NO: 987929 - protein, 9 aa, Homo Sapiens
EKAGRFDRV

SEQ ID NO: 987930 - protein, 9 aa, Homo Sapiens
GAQQKRAQP

SEQ ID NO: 987931 - protein, 9 aa, Homo Sapiens
QYLMDYLNP

SEQ ID NO: 987932 - protein, 9 aa, Homo Sapiens
YFFLGLAPP

SEQ ID NO: 987933 - protein, 9 aa, Homo Sapiens
QVLVFYYSP

SEQ ID NO: 987934 - protein, 9 aa, Homo Sapiens
PEKIFKTNS

SEQ ID NO: 987935 - protein, 9 aa, Homo Sapiens
YYGSYSSQY

SEQ ID NO: 987936 - protein, 9 aa, Homo Sapiens
ALSDLEKND

SEQ ID NO: 987937 - protein, 9 aa, Homo Sapiens
LERDQSVSV

SEQ ID NO: 987938 - protein, 9 aa, Homo Sapiens
ALKTRQDML

SEQ ID NO: 987939 - protein, 9 aa, Homo Sapiens
TEPHKFPCG

SEQ ID NO: 987940 - protein, 9 aa, Homo Sapiens
EVSLCWPGW

SEQ ID NO: 987941 - protein, 9 aa, Homo Sapiens
PVTIEKIYS

SEQ ID NO: 987942 - protein, 9 aa, Homo Sapiens
YLSLGLKAK

SEQ ID NO: 987943 - protein, 9 aa, Homo Sapiens
ERKNYKSSS

SEQ ID NO: 987944 - protein, 9 aa, Homo Sapiens
NKSDNVKEN

SEQ ID NO: 987945 - protein, 9 aa, Homo Sapiens
TKDNDYFNA

SEQ ID NO: 987946 - protein, 9 aa, Homo Sapiens
LDMAPFFSD

SEQ ID NO: 987947 - protein, 9 aa, Homo Sapiens
EKQAAFLVG

SEQ ID NO: 987948 - protein, 9 aa, Homo Sapiens
YPRSHFLYA

SEQ ID NO: 987949 - protein, 9 aa, Homo Sapiens
VCSAGTFKL

SEQ ID NO: 987950 - protein, 9 aa, Homo Sapiens
NAFGPDSVQ

SEQ ID NO: 987951 - protein, 9 aa, Homo Sapiens
ENRCEGNFL

SEQ ID NO: 987952 - protein, 9 aa, Homo Sapiens
NKKSKSGLK

SEQ ID NO: 987953 - protein, 9 aa, Homo Sapiens
SIAGPAQPP

SEQ ID NO: 987954 - protein, 9 aa, Homo Sapiens
VTSRAPSCS

SEQ ID NO: 987955 - protein, 9 aa, Homo Sapiens
LPRLTNQPG

SEQ ID NO: 987956 - protein, 9 aa, Homo Sapiens
TQTLTRVKV

SEQ ID NO: 987957 - protein, 9 aa, Homo Sapiens
SFLAVCADG

SEQ ID NO: 987958 - protein, 9 aa, Homo Sapiens
FLSRDETSV

SEQ ID NO: 987959 - protein, 9 aa, Homo Sapiens
EPKVEKKWK

SEQ ID NO: 987960 - protein, 9 aa, Homo Sapiens
EYNEVAMPV

SEQ ID NO: 987961 - protein, 9 aa, Homo Sapiens
CSMLENFLG

SEQ ID NO: 987962 - protein, 9 aa, Homo Sapiens
LLGCFAIFL

SEQ ID NO: 987963 - protein, 9 aa, Homo Sapiens
IKNKPSRLL

SEQ ID NO: 987964 - protein, 9 aa, Homo Sapiens
LLREEKKEK

SEQ ID NO: 987965 - protein, 9 aa, Homo Sapiens
FQKFIKAPP

SEQ ID NO: 987966 - protein, 9 aa, Homo Sapiens
QIKSLEQAR

SEQ ID NO: 987967 - protein, 9 aa, Homo Sapiens
TLTESQFLK

SEQ ID NO: 987968 - protein, 9 aa, Homo Sapiens
RLLPFEPDS

SEQ ID NO: 987969 - protein, 9 aa, Homo Sapiens
SFPAIQAAS

SEQ ID NO: 987970 - protein, 9 aa, Homo Sapiens
CLFLLLWVL

SEQ ID NO: 987971 - protein, 9 aa, Homo Sapiens
ALSFQIIRC

SEQ ID NO: 987972 - protein, 9 aa, Homo Sapiens
EEKLGGINS

SEQ ID NO: 987973 - protein, 9 aa, Homo Sapiens
LSEIMIMLW

SEQ ID NO: 987974 - protein, 9 aa, Homo Sapiens
AALVITSTP

SEQ ID NO: 987975 - protein, 9 aa, Homo Sapiens
LQTALSSPP

SEQ ID NO: 987976 - protein, 9 aa, Homo Sapiens
GGFCRRPAS

SEQ ID NO: 987977 - protein, 9 aa, Homo Sapiens
TVDPELAVS

SEQ ID NO: 987978 - protein, 9 aa, Homo Sapiens
SSLLTQSKV

SEQ ID NO: 987979 - protein, 9 aa, Homo Sapiens
PGSSPEETR

SEQ ID NO: 987980 - protein, 9 aa, Homo Sapiens
ASQLFCIWR

SEQ ID NO: 987981 - protein, 9 aa, Homo Sapiens
APAIRKKIL

SEQ ID NO: 987982 - protein, 9 aa, Homo Sapiens
FVRIGLMME

SEQ ID NO: 987983 - protein, 9 aa, Homo Sapiens
ASPQPHPLL

SEQ ID NO: 987984 - protein, 9 aa, Homo Sapiens
LIAVQDQQP

SEQ ID NO: 987985 - protein, 9 aa, Homo Sapiens
HSRRNKGVV

SEQ ID NO: 987986 - protein, 9 aa, Homo Sapiens
FVPLVAPRP

SEQ ID NO: 987987 - protein, 9 aa, Homo Sapiens
YFTLFMNLM

SEQ ID NO: 987988 - protein, 9 aa, Homo Sapiens
EIENEFISE

SEQ ID NO: 987989 - protein, 9 aa, Homo Sapiens
SKVYTKDRT

SEQ ID NO: 987990 - protein, 9 aa, Homo Sapiens
AAPVEEVAG

SEQ ID NO: 987991 - protein, 9 aa, Homo Sapiens
RYNAHMMPE

SEQ ID NO: 987992 - protein, 9 aa, Homo Sapiens
IWFLEGKSI

SEQ ID NO: 987993 - protein, 9 aa, Homo Sapiens
GKVLYYKLY

SEQ ID NO: 987994 - protein, 9 aa, Homo Sapiens
PEAPEKIFK

SEQ ID NO: 987995 - protein, 9 aa, Homo Sapiens
NKVFKHLQN

SEQ ID NO: 987996 - protein, 9 aa, Homo Sapiens
SQREFQQKL

SEQ ID NO: 987997 - protein, 9 aa, Homo Sapiens
VPTAFPATD

SEQ ID NO: 987998 - protein, 9 aa, Homo Sapiens
TGVNGEIFY

SEQ ID NO: 987999 - protein, 9 aa, Homo Sapiens
SVTYPQDSL

SEQ ID NO: 988000 - protein, 9 aa, Homo Sapiens
ENVPNATIF

SEQ ID NO: 988001 - protein, 9 aa, Homo Sapiens
SVLEGTFLK

SEQ ID NO: 988002 - protein, 9 aa, Homo Sapiens
NEDEEERRG

SEQ ID NO: 988003 - protein, 9 aa, Homo Sapiens
TQIASSGSS

SEQ ID NO: 988004 - protein, 9 aa, Homo Sapiens
ALGGDDFLD

SEQ ID NO: 988005 - protein, 9 aa, Homo Sapiens
EQRSQNSRM

SEQ ID NO: 988006 - protein, 9 aa, Homo Sapiens
MVFYPRSHF

SEQ ID NO: 988007 - protein, 9 aa, Homo Sapiens
RNNKVRNAL

SEQ ID NO: 988008 - protein, 9 aa, Homo Sapiens
CYKAIKKKP

SEQ ID NO: 988009 - protein, 9 aa, Homo Sapiens
REKERVHHL

SEQ ID NO: 988010 - protein, 9 aa, Homo Sapiens
LERVIPIKR

SEQ ID NO: 988011 - protein, 9 aa, Homo Sapiens
IDRIATPLF

SEQ ID NO: 988012 - protein, 9 aa, Homo Sapiens
VECTSSNDL

SEQ ID NO: 988013 - protein, 9 aa, Homo Sapiens
LVFYYSPVA

SEQ ID NO: 988014 - protein, 9 aa, Homo Sapiens
LRALRPEEL

SEQ ID NO: 988015 - protein, 9 aa, Homo Sapiens
LISERVLWD

SEQ ID NO: 988016 - protein, 9 aa, Homo Sapiens
AGLTSRDSF

SEQ ID NO: 988017 - protein, 9 aa, Homo Sapiens
IGADSALFF

SEQ ID NO: 988018 - protein, 9 aa, Homo Sapiens
QRTDSILNS

SEQ ID NO: 988019 - protein, 9 aa, Homo Sapiens
ATGADAGKL

SEQ ID NO: 988020 - protein, 9 aa, Homo Sapiens
SSPVGMVFY

SEQ ID NO: 988021 - protein, 9 aa, Homo Sapiens
DNFDSSYDK

SEQ ID NO: 988022 - protein, 9 aa, Homo Sapiens
AVMRPHFCL

SEQ ID NO: 988023 - protein, 9 aa, Homo Sapiens
VECGPKYLE

SEQ ID NO: 988024 - protein, 9 aa, Homo Sapiens
YTEERPHKC

SEQ ID NO: 988025 - protein, 9 aa, Homo Sapiens
LGRGGARGC

SEQ ID NO: 988026 - protein, 9 aa, Homo Sapiens
YLNSKIAYK

SEQ ID NO: 988027 - protein, 9 aa, Homo Sapiens
ERDSFPKSK

SEQ ID NO: 988028 - protein, 9 aa, Homo Sapiens
QPTHCGQNS

SEQ ID NO: 988029 - protein, 9 aa, Homo Sapiens
RDYDDSAFM

SEQ ID NO: 988030 - protein, 9 aa, Homo Sapiens
MRPHFCLQL

SEQ ID NO: 988031 - protein, 9 aa, Homo Sapiens
VNVEGSGKL

SEQ ID NO: 988032 - protein, 9 aa, Homo Sapiens
ELLRLGKID

SEQ ID NO: 988033 - protein, 9 aa, Homo Sapiens
EEAEVIMKL

SEQ ID NO: 988034 - protein, 9 aa, Homo Sapiens
WTTLSRIAG

SEQ ID NO: 988035 - protein, 9 aa, Homo Sapiens
EGGSCPRLC

SEQ ID NO: 988036 - protein, 9 aa, Homo Sapiens
QINCIPDQP

SEQ ID NO: 988037 - protein, 9 aa, Homo Sapiens
YLEKEEYLG

SEQ ID NO: 988038 - protein, 9 aa, Homo Sapiens
EGTFLKNHP

SEQ ID NO: 988039 - protein, 9 aa, Homo Sapiens
EIEDIQNTT

SEQ ID NO: 988040 - protein, 9 aa, Homo Sapiens
DMGLGTIKI

SEQ ID NO: 988041 - protein, 9 aa, Homo Sapiens
SHLALSFQI

SEQ ID NO: 988042 - protein, 9 aa, Homo Sapiens
CSILPKAAL

SEQ ID NO: 988043 - protein, 9 aa, Homo Sapiens
QRWVYDAIV

SEQ ID NO: 988044 - protein, 9 aa, Homo Sapiens
KYWDTLLHA

SEQ ID NO: 988045 - protein, 9 aa, Homo Sapiens
VSITGRKNV

SEQ ID NO: 988046 - protein, 9 aa, Homo Sapiens
VGKASFRVH

SEQ ID NO: 988047 - protein, 9 aa, Homo Sapiens
QGLPGVPEI

SEQ ID NO: 988048 - protein, 9 aa, Homo Sapiens
VRDKIDRLL

SEQ ID NO: 988049 - protein, 9 aa, Homo Sapiens
SVPSGSRNV

SEQ ID NO: 988050 - protein, 9 aa, Homo Sapiens
AGSVIDLIK

SEQ ID NO: 988051 - protein, 9 aa, Homo Sapiens
YTCKQCGKV

SEQ ID NO: 988052 - protein, 9 aa, Homo Sapiens
TILLLKEAG

SEQ ID NO: 988053 - protein, 9 aa, Homo Sapiens
TMQAVFFSV

SEQ ID NO: 988054 - protein, 9 aa, Homo Sapiens
SALSSLPVS

SEQ ID NO: 988055 - protein, 9 aa, Homo Sapiens
GLQCRECAP

SEQ ID NO: 988056 - protein, 9 aa, Homo Sapiens
IEINRQSVV

SEQ ID NO: 988057 - protein, 9 aa, Homo Sapiens
RLKLSQAQV

SEQ ID NO: 988058 - protein, 9 aa, Homo Sapiens
ASDKNKGVG

SEQ ID NO: 988059 - protein, 9 aa, Homo Sapiens
SVISVVEKK

SEQ ID NO: 988060 - protein, 9 aa, Homo Sapiens
QSKIEQLRT

SEQ ID NO: 988061 - protein, 9 aa, Homo Sapiens
QIYNDAHIL

SEQ ID NO: 988062 - protein, 9 aa, Homo Sapiens
ICGLMTAFF

SEQ ID NO: 988063 - protein, 9 aa, Homo Sapiens
LGSAQLVGR

SEQ ID NO: 988064 - protein, 9 aa, Homo Sapiens
KNGPKPNSD

SEQ ID NO: 988065 - protein, 9 aa, Homo Sapiens
KPINVQVGF

SEQ ID NO: 988066 - protein, 9 aa, Homo Sapiens
RVLVTQQFS

SEQ ID NO: 988067 - protein, 9 aa, Homo Sapiens
GKLQGPPPQ

SEQ ID NO: 988068 - protein, 9 aa, Homo Sapiens
LVSMFYGIV

SEQ ID NO: 988069 - protein, 9 aa, Homo Sapiens
LAFLRSLSY

SEQ ID NO: 988070 - protein, 9 aa, Homo Sapiens
STDKAPKGL

SEQ ID NO: 988071 - protein, 9 aa, Homo Sapiens
ETRKADETL

SEQ ID NO: 988072 - protein, 9 aa, Homo Sapiens
VDESRNDYK

SEQ ID NO: 988073 - protein, 9 aa, Homo Sapiens
VLGRGGARG

SEQ ID NO: 988074 - protein, 9 aa, Homo Sapiens
EYSAIGATR

SEQ ID NO: 988075 - protein, 9 aa, Homo Sapiens
RKDCNKHGL

SEQ ID NO: 988076 - protein, 9 aa, Homo Sapiens
SLLPYLGSW

SEQ ID NO: 988077 - protein, 9 aa, Homo Sapiens
IHEFEYENQ

SEQ ID NO: 988078 - protein, 9 aa, Homo Sapiens
SLLRCCLHE

SEQ ID NO: 988079 - protein, 9 aa, Homo Sapiens
DSRAGKNQC

SEQ ID NO: 988080 - protein, 9 aa, Homo Sapiens
VETKTMSKE

SEQ ID NO: 988081 - protein, 9 aa, Homo Sapiens
KNYNIFNEY

SEQ ID NO: 988082 - protein, 9 aa, Homo Sapiens
LEQINCIPD

SEQ ID NO: 988083 - protein, 9 aa, Homo Sapiens
INRQSVVAT

SEQ ID NO: 988084 - protein, 9 aa, Homo Sapiens
ELIGLLQAK

SEQ ID NO: 988085 - protein, 9 aa, Homo Sapiens
AEPSSAAVS

SEQ ID NO: 988086 - protein, 9 aa, Homo Sapiens
DRTSSSPFS

SEQ ID NO: 988087 - protein, 9 aa, Homo Sapiens
IVTPMLNPI

SEQ ID NO: 988088 - protein, 9 aa, Homo Sapiens
LPFEPDSSE

SEQ ID NO: 988089 - protein, 9 aa, Homo Sapiens
PPPLPQQPL

SEQ ID NO: 988090 - protein, 9 aa, Homo Sapiens
SQEESEVEL

SEQ ID NO: 988091 - protein, 9 aa, Homo Sapiens
LARAYKHAK

SEQ ID NO: 988092 - protein, 9 aa, Homo Sapiens
FAPPEFLFE

SEQ ID NO: 988093 - protein, 9 aa, Homo Sapiens
RPCPLSSRN

SEQ ID NO: 988094 - protein, 9 aa, Homo Sapiens
NFKLHTPMY

SEQ ID NO: 988095 - protein, 9 aa, Homo Sapiens
TFLLISCCL

SEQ ID NO: 988096 - protein, 9 aa, Homo Sapiens
DSVQGFEAL

SEQ ID NO: 988097 - protein, 9 aa, Homo Sapiens
SPPSIAPKP

SEQ ID NO: 988098 - protein, 9 aa, Homo Sapiens
YAGVPQHAA

SEQ ID NO: 988099 - protein, 9 aa, Homo Sapiens
GTGILKITP

SEQ ID NO: 988100 - protein, 9 aa, Homo Sapiens
RDTVSLVCE

SEQ ID NO: 988101 - protein, 9 aa, Homo Sapiens
PALSYFSRT

SEQ ID NO: 988102 - protein, 9 aa, Homo Sapiens
ITPMLNPFI

SEQ ID NO: 988103 - protein, 9 aa, Homo Sapiens
GTETASSTK

SEQ ID NO: 988104 - protein, 9 aa, Homo Sapiens
ANRGTLSVI

SEQ ID NO: 988105 - protein, 9 aa, Homo Sapiens
PHELELMRK

SEQ ID NO: 988106 - protein, 9 aa, Homo Sapiens
NIINHFTCK

SEQ ID NO: 988107 - protein, 9 aa, Homo Sapiens
RGWGTRGNC

SEQ ID NO: 988108 - protein, 9 aa, Homo Sapiens
NSLTLLFLA

SEQ ID NO: 988109 - protein, 9 aa, Homo Sapiens
EISGPPLFI

SEQ ID NO: 988110 - protein, 9 aa, Homo Sapiens
DGQPPSFSP

SEQ ID NO: 988111 - protein, 9 aa, Homo Sapiens
VAGMLVFLK

SEQ ID NO: 988112 - protein, 9 aa, Homo Sapiens
WKLRSLHLS

SEQ ID NO: 988113 - protein, 9 aa, Homo Sapiens
GKLCPPPRS

SEQ ID NO: 988114 - protein, 9 aa, Homo Sapiens
GPHGYAGVP

SEQ ID NO: 988115 - protein, 9 aa, Homo Sapiens
NPWDCTCNL

SEQ ID NO: 988116 - protein, 9 aa, Homo Sapiens
KWKGLLTQN

SEQ ID NO: 988117 - protein, 9 aa, Homo Sapiens
LPYQENATM

SEQ ID NO: 988118 - protein, 9 aa, Homo Sapiens
AAGVMLLWH

SEQ ID NO: 988119 - protein, 9 aa, Homo Sapiens
CLPMHRQTF

SEQ ID NO: 988120 - protein, 9 aa, Homo Sapiens
NDAEERADM

SEQ ID NO: 988121 - protein, 9 aa, Homo Sapiens
DPSPDHLYF

SEQ ID NO: 988122 - protein, 9 aa, Homo Sapiens
YKLGERLAI

SEQ ID NO: 988123 - protein, 9 aa, Homo Sapiens
YVESITSSS

SEQ ID NO: 988124 - protein, 9 aa, Homo Sapiens
ELCYGKKDL

SEQ ID NO: 988125 - protein, 9 aa, Homo Sapiens
LIYDKTDIP

SEQ ID NO: 988126 - protein, 9 aa, Homo Sapiens
VQKQKATQK

SEQ ID NO: 988127 - protein, 9 aa, Homo Sapiens
SRHCDPETI

SEQ ID NO: 988128 - protein, 9 aa, Homo Sapiens
ALCLHGGSC

SEQ ID NO: 988129 - protein, 9 aa, Homo Sapiens
KEQPTFETL

SEQ ID NO: 988130 - protein, 9 aa, Homo Sapiens
VEAYNICTD

SEQ ID NO: 988131 - protein, 9 aa, Homo Sapiens
FIPRLDLRY

SEQ ID NO: 988132 - protein, 9 aa, Homo Sapiens
SILNSPDNV

SEQ ID NO: 988133 - protein, 9 aa, Homo Sapiens
GQGRNSRFG

SEQ ID NO: 988134 - protein, 9 aa, Homo Sapiens
RRSLSVSSP

SEQ ID NO: 988135 - protein, 9 aa, Homo Sapiens
REIRQTRNS

SEQ ID NO: 988136 - protein, 9 aa, Homo Sapiens
RAPSCSGSS

SEQ ID NO: 988137 - protein, 9 aa, Homo Sapiens
FKKIFSSLE

SEQ ID NO: 988138 - protein, 9 aa, Homo Sapiens
QVVVRLKSV

SEQ ID NO: 988139 - protein, 9 aa, Homo Sapiens
LCPANFLYF

SEQ ID NO: 988140 - protein, 9 aa, Homo Sapiens
PDKKDDDKN

SEQ ID NO: 988141 - protein, 9 aa, Homo Sapiens
GSYSSQYPD

SEQ ID NO: 988142 - protein, 9 aa, Homo Sapiens
IVTLSDEIR

SEQ ID NO: 988143 - protein, 9 aa, Homo Sapiens
TNNNSPEVA

SEQ ID NO: 988144 - protein, 9 aa, Homo Sapiens
TSSSPFSGR

SEQ ID NO: 988145 - protein, 9 aa, Homo Sapiens
LYLWSPASC

SEQ ID NO: 988146 - protein, 9 aa, Homo Sapiens
ISQKKIKSF

SEQ ID NO: 988147 - protein, 9 aa, Homo Sapiens
PLNYPPSSP

SEQ ID NO: 988148 - protein, 9 aa, Homo Sapiens
CSYRPAPGR

SEQ ID NO: 988149 - protein, 9 aa, Homo Sapiens
ISCAFFLAR

SEQ ID NO: 988150 - protein, 9 aa, Homo Sapiens
SNYQKISSG

SEQ ID NO: 988151 - protein, 9 aa, Homo Sapiens
TENLAEKLA

SEQ ID NO: 988152 - protein, 9 aa, Homo Sapiens
AATFSSLGA

SEQ ID NO: 988153 - protein, 9 aa, Homo Sapiens
PSALSSLPV

SEQ ID NO: 988154 - protein, 9 aa, Homo Sapiens
LYQPLPYHQ

SEQ ID NO: 988155 - protein, 9 aa, Homo Sapiens
LNSPDNVPL

SEQ ID NO: 988156 - protein, 9 aa, Homo Sapiens
WQLKTTESK

SEQ ID NO: 988157 - protein, 9 aa, Homo Sapiens
TLRSRAVHR

SEQ ID NO: 988158 - protein, 9 aa, Homo Sapiens
YAHETKLSY

SEQ ID NO: 988159 - protein, 9 aa, Homo Sapiens
GPQEEPGLQ

SEQ ID NO: 988160 - protein, 9 aa, Homo Sapiens
VGENFLHTY

SEQ ID NO: 988161 - protein, 9 aa, Homo Sapiens
AEHAAKYLP

SEQ ID NO: 988162 - protein, 9 aa, Homo Sapiens
AGVMLLWHF

SEQ ID NO: 988163 - protein, 9 aa, Homo Sapiens
YKIQVTATD

SEQ ID NO: 988164 - protein, 9 aa, Homo Sapiens
GRPRKIAWK

SEQ ID NO: 988165 - protein, 9 aa, Homo Sapiens
HIPMYLFFG

SEQ ID NO: 988166 - protein, 9 aa, Homo Sapiens
SITDENHSA

SEQ ID NO: 988167 - protein, 9 aa, Homo Sapiens
SVVTPTAST

SEQ ID NO: 988168 - protein, 9 aa, Homo Sapiens
WEKAGRFDR

SEQ ID NO: 988169 - protein, 9 aa, Homo Sapiens
LFCIWRYNQ

SEQ ID NO: 988170 - protein, 9 aa, Homo Sapiens
YYAIESQLQ

SEQ ID NO: 988171 - protein, 9 aa, Homo Sapiens
PTFPRLAAS

SEQ ID NO: 988172 - protein, 9 aa, Homo Sapiens
RSRPSFRWT

SEQ ID NO: 988173 - protein, 9 aa, Homo Sapiens
KLRSLHLSP

SEQ ID NO: 988174 - protein, 9 aa, Homo Sapiens
GRICLNNDG

SEQ ID NO: 988175 - protein, 9 aa, Homo Sapiens
ILLGCFAIF

SEQ ID NO: 988176 - protein, 9 aa, Homo Sapiens
LQSSKNSYF

SEQ ID NO: 988177 - protein, 9 aa, Homo Sapiens
LSVVHRFEN

SEQ ID NO: 988178 - protein, 9 aa, Homo Sapiens
NKFEMKDMR

SEQ ID NO: 988179 - protein, 9 aa, Homo Sapiens
SLWKCPHNN

SEQ ID NO: 988180 - protein, 9 aa, Homo Sapiens
QPPSFSPHS

SEQ ID NO: 988181 - protein, 9 aa, Homo Sapiens
MDQQPNLPS

SEQ ID NO: 988182 - protein, 9 aa, Homo Sapiens
DAIKKNPEF

SEQ ID NO: 988183 - protein, 9 aa, Homo Sapiens
LLLKSELWF

SEQ ID NO: 988184 - protein, 9 aa, Homo Sapiens
ITEFQNDVP

SEQ ID NO: 988185 - protein, 9 aa, Homo Sapiens
TAVLVSITG

SEQ ID NO: 988186 - protein, 9 aa, Homo Sapiens
LLATVFQGL

SEQ ID NO: 988187 - protein, 9 aa, Homo Sapiens
FMTSELEEL

SEQ ID NO: 988188 - protein, 9 aa, Homo Sapiens
LTAEEKKAP

SEQ ID NO: 988189 - protein, 9 aa, Homo Sapiens
VSPPVVANE

SEQ ID NO: 988190 - protein, 9 aa, Homo Sapiens
PGFSEPTNN

SEQ ID NO: 988191 - protein, 9 aa, Homo Sapiens
ATYEIFQEK

SEQ ID NO: 988192 - protein, 9 aa, Homo Sapiens
NGSLQVRSH

SEQ ID NO: 988193 - protein, 9 aa, Homo Sapiens
VHIRYYRMA

SEQ ID NO: 988194 - protein, 9 aa, Homo Sapiens
ERLASSPVL

SEQ ID NO: 988195 - protein, 9 aa, Homo Sapiens
PCPLSSRNM

SEQ ID NO: 988196 - protein, 9 aa, Homo Sapiens
KRVVLYVLN

SEQ ID NO: 988197 - protein, 9 aa, Homo Sapiens
RLSSSLVPG

SEQ ID NO: 988198 - protein, 9 aa, Homo Sapiens
PTPKSGSTE

SEQ ID NO: 988199 - protein, 9 aa, Homo Sapiens
LAGFCYDGL

SEQ ID NO: 988200 - protein, 9 aa, Homo Sapiens
YQGKLRENP

SEQ ID NO: 988201 - protein, 9 aa, Homo Sapiens
TPGKHSEIY

SEQ ID NO: 988202 - protein, 9 aa, Homo Sapiens
GPVVSLWPT

SEQ ID NO: 988203 - protein, 9 aa, Homo Sapiens
SGTMYNTER

SEQ ID NO: 988204 - protein, 9 aa, Homo Sapiens
LDKKNWTGN

SEQ ID NO: 988205 - protein, 9 aa, Homo Sapiens
GPPPARFEA

SEQ ID NO: 988206 - protein, 9 aa, Homo Sapiens
IMIMLWHRL

SEQ ID NO: 988207 - protein, 9 aa, Homo Sapiens
NAHMMPEDG

SEQ ID NO: 988208 - protein, 9 aa, Homo Sapiens
ARPFRGDSP

SEQ ID NO: 988209 - protein, 9 aa, Homo Sapiens
FLEQRIVEL

SEQ ID NO: 988210 - protein, 9 aa, Homo Sapiens
FGNFFVNYS

SEQ ID NO: 988211 - protein, 9 aa, Homo Sapiens
GNCSRGRLY

SEQ ID NO: 988212 - protein, 9 aa, Homo Sapiens
KISGGPHIF

SEQ ID NO: 988213 - protein, 9 aa, Homo Sapiens
TTSSERTIT

SEQ ID NO: 988214 - protein, 9 aa, Homo Sapiens
AVSDGFPAG

SEQ ID NO: 988215 - protein, 9 aa, Homo Sapiens
CQLSDISFG

SEQ ID NO: 988216 - protein, 9 aa, Homo Sapiens
WVQKQKATQ

SEQ ID NO: 988217 - protein, 9 aa, Homo Sapiens
SHQNIYTEE

SEQ ID NO: 988218 - protein, 9 aa, Homo Sapiens
THPQTVPQS

SEQ ID NO: 988219 - protein, 9 aa, Homo Sapiens
VRCITHPQT

SEQ ID NO: 988220 - protein, 9 aa, Homo Sapiens
DGCCCWDVR

SEQ ID NO: 988221 - protein, 9 aa, Homo Sapiens
YKGPGLGIK

SEQ ID NO: 988222 - protein, 9 aa, Homo Sapiens
GNESFLMDF

SEQ ID NO: 988223 - protein, 9 aa, Homo Sapiens
GLTSRDSFV

SEQ ID NO: 988224 - protein, 9 aa, Homo Sapiens
MGWSQNLFR

SEQ ID NO: 988225 - protein, 9 aa, Homo Sapiens
KIEKKRNLI

SEQ ID NO: 988226 - protein, 9 aa, Homo Sapiens
IEESANKFE

SEQ ID NO: 988227 - protein, 9 aa, Homo Sapiens
NDGGHCCLV

SEQ ID NO: 988228 - protein, 9 aa, Homo Sapiens
SHLLYQQSH

SEQ ID NO: 988229 - protein, 9 aa, Homo Sapiens
SYSAHYQFL

SEQ ID NO: 988230 - protein, 9 aa, Homo Sapiens
QGNYGFFPE

SEQ ID NO: 988231 - protein, 9 aa, Homo Sapiens
LLEIGFSSS

SEQ ID NO: 988232 - protein, 9 aa, Homo Sapiens
FLRSLSYHD

SEQ ID NO: 988233 - protein, 9 aa, Homo Sapiens
EVSPWLAAM

SEQ ID NO: 988234 - protein, 9 aa, Homo Sapiens
YEMRMMMNF

SEQ ID NO: 988235 - protein, 9 aa, Homo Sapiens
FKETVNNQK

SEQ ID NO: 988236 - protein, 9 aa, Homo Sapiens
LVPLLLSFF

SEQ ID NO: 988237 - protein, 9 aa, Homo Sapiens
TIETHARDV

SEQ ID NO: 988238 - protein, 9 aa, Homo Sapiens
ARCGDEGKA

SEQ ID NO: 988239 - protein, 9 aa, Homo Sapiens
STGVQDCYQ

SEQ ID NO: 988240 - protein, 9 aa, Homo Sapiens
TLSGLSRRQ

SEQ ID NO: 988241 - protein, 9 aa, Homo Sapiens
KLIKKMDYL

SEQ ID NO: 988242 - protein, 9 aa, Homo Sapiens
VAVRTNNYE

SEQ ID NO: 988243 - protein, 9 aa, Homo Sapiens
AMTSLILVG

SEQ ID NO: 988244 - protein, 9 aa, Homo Sapiens
KEKFVYTLP

SEQ ID NO: 988245 - protein, 9 aa, Homo Sapiens
DNNNRDHKE

SEQ ID NO: 988246 - protein, 9 aa, Homo Sapiens
IKTKGQYDE

SEQ ID NO: 988247 - protein, 9 aa, Homo Sapiens
EPLKITLLA

SEQ ID NO: 988248 - protein, 9 aa, Homo Sapiens
TATTTWMEP

SEQ ID NO: 988249 - protein, 9 aa, Homo Sapiens
KPLPREQPR

SEQ ID NO: 988250 - protein, 9 aa, Homo Sapiens
GSRDTESMD

SEQ ID NO: 988251 - protein, 9 aa, Homo Sapiens
RSPAMSEGI

SEQ ID NO: 988252 - protein, 9 aa, Homo Sapiens
QDTIERECM

SEQ ID NO: 988253 - protein, 9 aa, Homo Sapiens
HRSLNVQLE

SEQ ID NO: 988254 - protein, 9 aa, Homo Sapiens
YVAICNRLR

SEQ ID NO: 988255 - protein, 9 aa, Homo Sapiens
DLKKNDYSP

SEQ ID NO: 988256 - protein, 9 aa, Homo Sapiens
TSALRRMEA

SEQ ID NO: 988257 - protein, 9 aa, Homo Sapiens
SLGQCQDNT

SEQ ID NO: 988258 - protein, 9 aa, Homo Sapiens
NRGLQFFLK

SEQ ID NO: 988259 - protein, 9 aa, Homo Sapiens
SRDPFCNRM

SEQ ID NO: 988260 - protein, 9 aa, Homo Sapiens
PGRVFLVTV

SEQ ID NO: 988261 - protein, 9 aa, Homo Sapiens
SEKRAQKAM

SEQ ID NO: 988262 - protein, 9 aa, Homo Sapiens
DTIERECME

SEQ ID NO: 988263 - protein, 9 aa, Homo Sapiens
DKRSPTWTT

SEQ ID NO: 988264 - protein, 9 aa, Homo Sapiens
LFMQVASAR

SEQ ID NO: 988265 - protein, 9 aa, Homo Sapiens
FLHTYSLSA

SEQ ID NO: 988266 - protein, 9 aa, Homo Sapiens
CTSVPSGSR

SEQ ID NO: 988267 - protein, 9 aa, Homo Sapiens
PEIPGAKGV

SEQ ID NO: 988268 - protein, 9 aa, Homo Sapiens
FEYENQFES

SEQ ID NO: 988269 - protein, 9 aa, Homo Sapiens
FLDHCTFEK

SEQ ID NO: 988270 - protein, 9 aa, Homo Sapiens
LVLEKTSDT

SEQ ID NO: 988271 - protein, 9 aa, Homo Sapiens
GTRGNCSRG

SEQ ID NO: 988272 - protein, 9 aa, Homo Sapiens
HGQDEPAFI

SEQ ID NO: 988273 - protein, 9 aa, Homo Sapiens
TARRERRLQ

SEQ ID NO: 988274 - protein, 9 aa, Homo Sapiens
NPLRQKIVF

SEQ ID NO: 988275 - protein, 9 aa, Homo Sapiens
TPSPTSSFS

SEQ ID NO: 988276 - protein, 9 aa, Homo Sapiens
HGPSRLSYC

SEQ ID NO: 988277 - protein, 9 aa, Homo Sapiens
CYRLSCCVS

SEQ ID NO: 988278 - protein, 9 aa, Homo Sapiens
RPGSQKVDS

SEQ ID NO: 988279 - protein, 9 aa, Homo Sapiens
GSLQVRSHL

SEQ ID NO: 988280 - protein, 9 aa, Homo Sapiens
QLQESLPRL

SEQ ID NO: 988281 - protein, 9 aa, Homo Sapiens
DNCGNCVPL

SEQ ID NO: 988282 - protein, 9 aa, Homo Sapiens
VPEIPGAKG

SEQ ID NO: 988283 - protein, 9 aa, Homo Sapiens
ENATMLVVL

SEQ ID NO: 988284 - protein, 9 aa, Homo Sapiens
ELFQIQLLM

SEQ ID NO: 988285 - protein, 9 aa, Homo Sapiens
RILVVVELL

SEQ ID NO: 988286 - protein, 9 aa, Homo Sapiens
LGKRVVLYV

SEQ ID NO: 988287 - protein, 9 aa, Homo Sapiens
LNPSALSSL

SEQ ID NO: 988288 - protein, 9 aa, Homo Sapiens
LGLPGPPGP

SEQ ID NO: 988289 - protein, 9 aa, Homo Sapiens
EKEEEKEEG

SEQ ID NO: 988290 - protein, 9 aa, Homo Sapiens
EKNRTTSEA

SEQ ID NO: 988291 - protein, 9 aa, Homo Sapiens
ENKSEYFLR

SEQ ID NO: 988292 - protein, 9 aa, Homo Sapiens
SLLKSGGFL

SEQ ID NO: 988293 - protein, 9 aa, Homo Sapiens
FQILDRNTK

SEQ ID NO: 988294 - protein, 9 aa, Homo Sapiens
KSGSTEQSE

SEQ ID NO: 988295 - protein, 9 aa, Homo Sapiens
FRGPVATIS

SEQ ID NO: 988296 - protein, 9 aa, Homo Sapiens
IEPPPSPLI

SEQ ID NO: 988297 - protein, 9 aa, Homo Sapiens
DPRLKVDSR

SEQ ID NO: 988298 - protein, 9 aa, Homo Sapiens
YHRFMVDEK

SEQ ID NO: 988299 - protein, 9 aa, Homo Sapiens
TTFKGNEFF

SEQ ID NO: 988300 - protein, 9 aa, Homo Sapiens
SDPFLEIFC

SEQ ID NO: 988301 - protein, 9 aa, Homo Sapiens
YDKTDIPHN

SEQ ID NO: 988302 - protein, 9 aa, Homo Sapiens
SCFVYSRVG

SEQ ID NO: 988303 - protein, 9 aa, Homo Sapiens
IGNNIFFSS

SEQ ID NO: 988304 - protein, 9 aa, Homo Sapiens
YYSPVALEV

SEQ ID NO: 988305 - protein, 9 aa, Homo Sapiens
LPAGKRKAA

SEQ ID NO: 988306 - protein, 9 aa, Homo Sapiens
DALVYAQFS

SEQ ID NO: 988307 - protein, 9 aa, Homo Sapiens
RGRENFFRL

SEQ ID NO: 988308 - protein, 9 aa, Homo Sapiens
SLSLPRAVL

SEQ ID NO: 988309 - protein, 9 aa, Homo Sapiens
SLGNLPMKL

SEQ ID NO: 988310 - protein, 9 aa, Homo Sapiens
RCVPPRFSI

SEQ ID NO: 988311 - protein, 9 aa, Homo Sapiens
EEKEDASKR

SEQ ID NO: 988312 - protein, 9 aa, Homo Sapiens
AHDGQPPSF

SEQ ID NO: 988313 - protein, 9 aa, Homo Sapiens
ILLLKEAGA

SEQ ID NO: 988314 - protein, 9 aa, Homo Sapiens
WSGPKPGFS

SEQ ID NO: 988315 - protein, 9 aa, Homo Sapiens
SDFLDGLGS

SEQ ID NO: 988316 - protein, 9 aa, Homo Sapiens
FLKYITGDN

SEQ ID NO: 988317 - protein, 9 aa, Homo Sapiens
TDQLPRMQC

SEQ ID NO: 988318 - protein, 9 aa, Homo Sapiens
LEELRQDTI

SEQ ID NO: 988319 - protein, 9 aa, Homo Sapiens
GDDSTESEP

SEQ ID NO: 988320 - protein, 9 aa, Homo Sapiens
SRLSYCGGG

SEQ ID NO: 988321 - protein, 9 aa, Homo Sapiens
FLAGEKRGR

SEQ ID NO: 988322 - protein, 9 aa, Homo Sapiens
SPKELLKKK

SEQ ID NO: 988323 - protein, 9 aa, Homo Sapiens
WMEPTAQEA

SEQ ID NO: 988324 - protein, 9 aa, Homo Sapiens
SRVPTAKLA

SEQ ID NO: 988325 - protein, 9 aa, Homo Sapiens
APQLRAKEA

SEQ ID NO: 988326 - protein, 9 aa, Homo Sapiens
SDNVKENKF

SEQ ID NO: 988327 - protein, 9 aa, Homo Sapiens
IVDVVIKYK

SEQ ID NO: 988328 - protein, 9 aa, Homo Sapiens
ISGPPLFIP

SEQ ID NO: 988329 - protein, 9 aa, Homo Sapiens
RKKILSPVD

SEQ ID NO: 988330 - protein, 9 aa, Homo Sapiens
LSDLEKNDF

SEQ ID NO: 988331 - protein, 9 aa, Homo Sapiens
IPSLPTDFC

SEQ ID NO: 988332 - protein, 9 aa, Homo Sapiens
FQPPYFPPL

SEQ ID NO: 988333 - protein, 9 aa, Homo Sapiens
EFLLPAIFG

SEQ ID NO: 988334 - protein, 9 aa, Homo Sapiens
RIPFILKII

SEQ ID NO: 988335 - protein, 9 aa, Homo Sapiens
VFIFFLREV

SEQ ID NO: 988336 - protein, 9 aa, Homo Sapiens
LEDFQNIIL

SEQ ID NO: 988337 - protein, 9 aa, Homo Sapiens
SRAVHRLYT

SEQ ID NO: 988338 - protein, 9 aa, Homo Sapiens
ETSGERFQA

SEQ ID NO: 988339 - protein, 9 aa, Homo Sapiens
KTVRSERKA

SEQ ID NO: 988340 - protein, 9 aa, Homo Sapiens
SYRFSRGVS

SEQ ID NO: 988341 - protein, 9 aa, Homo Sapiens
AGRFDRVQM

SEQ ID NO: 988342 - protein, 9 aa, Homo Sapiens
VFLMNFKDS

SEQ ID NO: 988343 - protein, 9 aa, Homo Sapiens
EGPEGPITV

SEQ ID NO: 988344 - protein, 9 aa, Homo Sapiens
CGSETMRAS

SEQ ID NO: 988345 - protein, 9 aa, Homo Sapiens
NNDEYDNYN

SEQ ID NO: 988346 - protein, 9 aa, Homo Sapiens
KAPSQAPEG

SEQ ID NO: 988347 - protein, 9 aa, Homo Sapiens
QCAPEMNSV

SEQ ID NO: 988348 - protein, 9 aa, Homo Sapiens
GRFDRVQMR

SEQ ID NO: 988349 - protein, 9 aa, Homo Sapiens
LGCFAIFLL

SEQ ID NO: 988350 - protein, 9 aa, Homo Sapiens
GFLSLLPYL

SEQ ID NO: 988351 - protein, 9 aa, Homo Sapiens
RQKVYFDAQ

SEQ ID NO: 988352 - protein, 9 aa, Homo Sapiens
FFVNYSDFK

SEQ ID NO: 988353 - protein, 9 aa, Homo Sapiens
VDKLHPVCS

SEQ ID NO: 988354 - protein, 9 aa, Homo Sapiens
EGSQIYNDA

SEQ ID NO: 988355 - protein, 9 aa, Homo Sapiens
HPACLPMHR

SEQ ID NO: 988356 - protein, 9 aa, Homo Sapiens
GLQNFDFED

SEQ ID NO: 988357 - protein, 9 aa, Homo Sapiens
DVTDKDEGA

SEQ ID NO: 988358 - protein, 9 aa, Homo Sapiens
AAASAESAD

SEQ ID NO: 988359 - protein, 9 aa, Homo Sapiens
EIPGAKGVA

SEQ ID NO: 988360 - protein, 9 aa, Homo Sapiens
RHLPLCPAN

SEQ ID NO: 988361 - protein, 9 aa, Homo Sapiens
SEEQMGQLK

SEQ ID NO: 988362 - protein, 9 aa, Homo Sapiens
STSDLHISS

SEQ ID NO: 988363 - protein, 9 aa, Homo Sapiens
VHIAGAYLS

SEQ ID NO: 988364 - protein, 9 aa, Homo Sapiens
TVNNYPISD

SEQ ID NO: 988365 - protein, 9 aa, Homo Sapiens
LAIQGKLPK

SEQ ID NO: 988366 - protein, 9 aa, Homo Sapiens
YPTKCEVER

SEQ ID NO: 988367 - protein, 9 aa, Homo Sapiens
SINRYIAVT

SEQ ID NO: 988368 - protein, 9 aa, Homo Sapiens
IGGPAPSLS

SEQ ID NO: 988369 - protein, 9 aa, Homo Sapiens
HNHKKVQAN

SEQ ID NO: 988370 - protein, 9 aa, Homo Sapiens
QNSRMTFRE

SEQ ID NO: 988371 - protein, 9 aa, Homo Sapiens
QILDRNTKC

SEQ ID NO: 988372 - protein, 9 aa, Homo Sapiens
FNLCGKVFT

SEQ ID NO: 988373 - protein, 9 aa, Homo Sapiens
KTENLAEKL

SEQ ID NO: 988374 - protein, 9 aa, Homo Sapiens
PSFLAVCAD

SEQ ID NO: 988375 - protein, 9 aa, Homo Sapiens
NSNNIGNNI

SEQ ID NO: 988376 - protein, 9 aa, Homo Sapiens
LKELQRLHS

SEQ ID NO: 988377 - protein, 9 aa, Homo Sapiens
HPVQEKIAK

SEQ ID NO: 988378 - protein, 9 aa, Homo Sapiens
VGFALQVEM

SEQ ID NO: 988379 - protein, 9 aa, Homo Sapiens
TFLKNHPQA

SEQ ID NO: 988380 - protein, 9 aa, Homo Sapiens
THARDVLEK

SEQ ID NO: 988381 - protein, 9 aa, Homo Sapiens
NGTQTLTRV

SEQ ID NO: 988382 - protein, 9 aa, Homo Sapiens
QLERMKIET

SEQ ID NO: 988383 - protein, 9 aa, Homo Sapiens
YHIFLIGWD

SEQ ID NO: 988384 - protein, 9 aa, Homo Sapiens
PHAKDSFSF

SEQ ID NO: 988385 - protein, 9 aa, Homo Sapiens
LVAHIKEGS

SEQ ID NO: 988386 - protein, 9 aa, Homo Sapiens
TKTRFVDGR

SEQ ID NO: 988387 - protein, 9 aa, Homo Sapiens
TAVLVSITD

SEQ ID NO: 988388 - protein, 9 aa, Homo Sapiens
LVSYRVIIF

SEQ ID NO: 988389 - protein, 9 aa, Homo Sapiens
TIPAITSND

SEQ ID NO: 988390 - protein, 9 aa, Homo Sapiens
LQGQGRVRT

SEQ ID NO: 988391 - protein, 9 aa, Homo Sapiens
KIFELCIKR

SEQ ID NO: 988392 - protein, 9 aa, Homo Sapiens
QRSVLQVLL

SEQ ID NO: 988393 - protein, 9 aa, Homo Sapiens
AERQKNFTP

SEQ ID NO: 988394 - protein, 9 aa, Homo Sapiens
PKAAIVVHI

SEQ ID NO: 988395 - protein, 9 aa, Homo Sapiens
FGPLYTHEY

SEQ ID NO: 988396 - protein, 9 aa, Homo Sapiens
LTLRSKFMT

SEQ ID NO: 988397 - protein, 9 aa, Homo Sapiens
VTTFKGNEF

SEQ ID NO: 988398 - protein, 9 aa, Homo Sapiens
WKKKEDTPR

SEQ ID NO: 988399 - protein, 9 aa, Homo Sapiens
QMSDGDEER

SEQ ID NO: 988400 - protein, 9 aa, Homo Sapiens
NRQSVVATP

SEQ ID NO: 988401 - protein, 9 aa, Homo Sapiens
KEHKSSMMP

SEQ ID NO: 988402 - protein, 9 aa, Homo Sapiens
DFFFLRRLI

SEQ ID NO: 988403 - protein, 9 aa, Homo Sapiens
WSQNLFRAL

SEQ ID NO: 988404 - protein, 9 aa, Homo Sapiens
FESYAYTRA

SEQ ID NO: 988405 - protein, 9 aa, Homo Sapiens
DEPAFIDDG

SEQ ID NO: 988406 - protein, 9 aa, Homo Sapiens
TLVLTLKTV

SEQ ID NO: 988407 - protein, 9 aa, Homo Sapiens
REQPRRPIR

SEQ ID NO: 988408 - protein, 9 aa, Homo Sapiens
LWNWELSII

SEQ ID NO: 988409 - protein, 9 aa, Homo Sapiens
ICVSSAKKT

SEQ ID NO: 988410 - protein, 9 aa, Homo Sapiens
KSSSPSSLP

SEQ ID NO: 988411 - protein, 9 aa, Homo Sapiens
GGRSPGLCR

SEQ ID NO: 988412 - protein, 9 aa, Homo Sapiens
SNLHRILMD

SEQ ID NO: 988413 - protein, 9 aa, Homo Sapiens
SSPVDMLEV

SEQ ID NO: 988414 - protein, 9 aa, Homo Sapiens
QNIILRAPD

SEQ ID NO: 988415 - protein, 9 aa, Homo Sapiens
SLEDFQNII

SEQ ID NO: 988416 - protein, 9 aa, Homo Sapiens
GLGIKFSAE

SEQ ID NO: 988417 - protein, 9 aa, Homo Sapiens
GSGQSSGFR

SEQ ID NO: 988418 - protein, 9 aa, Homo Sapiens
LVLGRGGAR

SEQ ID NO: 988419 - protein, 9 aa, Homo Sapiens
CALVQTAPW

SEQ ID NO: 988420 - protein, 9 aa, Homo Sapiens
LELACTNTH

SEQ ID NO: 988421 - protein, 9 aa, Homo Sapiens
PWVSNEKNT

SEQ ID NO: 988422 - protein, 9 aa, Homo Sapiens
VVCWTLIHI

SEQ ID NO: 988423 - protein, 9 aa, Homo Sapiens
DINIKIRSC

SEQ ID NO: 988424 - protein, 9 aa, Homo Sapiens
ELRQDTIER

SEQ ID NO: 988425 - protein, 9 aa, Homo Sapiens
GNNQGKPRS

SEQ ID NO: 988426 - protein, 9 aa, Homo Sapiens
LDWQALNYK

SEQ ID NO: 988427 - protein, 9 aa, Homo Sapiens
PASKKLKTS

SEQ ID NO: 988428 - protein, 9 aa, Homo Sapiens
PPAIFNSLS

SEQ ID NO: 988429 - protein, 9 aa, Homo Sapiens
FGIVLPAWI

SEQ ID NO: 988430 - protein, 9 aa, Homo Sapiens
ERCLDYNAK

SEQ ID NO: 988431 - protein, 9 aa, Homo Sapiens
LGKHKYGIV

SEQ ID NO: 988432 - protein, 9 aa, Homo Sapiens
TSKQAKISM

SEQ ID NO: 988433 - protein, 9 aa, Homo Sapiens
ALSYFSRTA

SEQ ID NO: 988434 - protein, 9 aa, Homo Sapiens
LKITLLAPE

SEQ ID NO: 988435 - protein, 9 aa, Homo Sapiens
FLRELSQTC

SEQ ID NO: 988436 - protein, 9 aa, Homo Sapiens
PAVDRLCVR

SEQ ID NO: 988437 - protein, 9 aa, Homo Sapiens
LLWHFFTDQ

SEQ ID NO: 988438 - protein, 9 aa, Homo Sapiens
LVQEKANAS

SEQ ID NO: 988439 - protein, 9 aa, Homo Sapiens
DSDVESDAG

SEQ ID NO: 988440 - protein, 9 aa, Homo Sapiens
APVEEVAGE

SEQ ID NO: 988441 - protein, 9 aa, Homo Sapiens
LQDLLDGCY

SEQ ID NO: 988442 - protein, 9 aa, Homo Sapiens
HDRHAMALS

SEQ ID NO: 988443 - protein, 9 aa, Homo Sapiens
DAPRQTPLT

SEQ ID NO: 988444 - protein, 9 aa, Homo Sapiens
QKGLVASYK

SEQ ID NO: 988445 - protein, 9 aa, Homo Sapiens
DFISRFEVF

SEQ ID NO: 988446 - protein, 9 aa, Homo Sapiens
EVPGSSPEE

SEQ ID NO: 988447 - protein, 9 aa, Homo Sapiens
PEKINKRIE

SEQ ID NO: 988448 - protein, 9 aa, Homo Sapiens
STSVNLTSN

SEQ ID NO: 988449 - protein, 9 aa, Homo Sapiens
NYFKFKPVE

SEQ ID NO: 988450 - protein, 9 aa, Homo Sapiens
SRPSFRWTP

SEQ ID NO: 988451 - protein, 9 aa, Homo Sapiens
DDKGNAIGR

SEQ ID NO: 988452 - protein, 9 aa, Homo Sapiens
AFGNFFVNY

SEQ ID NO: 988453 - protein, 9 aa, Homo Sapiens
RLDLRYTTV

SEQ ID NO: 988454 - protein, 9 aa, Homo Sapiens
GLCRALEGG

SEQ ID NO: 988455 - protein, 9 aa, Homo Sapiens
GDQLCARCS

SEQ ID NO: 988456 - protein, 9 aa, Homo Sapiens
ITVNNYPIS

SEQ ID NO: 988457 - protein, 9 aa, Homo Sapiens
PPGPPTRAT

SEQ ID NO: 988458 - protein, 9 aa, Homo Sapiens
VVNELEQIN

SEQ ID NO: 988459 - protein, 9 aa, Homo Sapiens
NTPSFLAVC

SEQ ID NO: 988460 - protein, 9 aa, Homo Sapiens
QNSRRRKVV

SEQ ID NO: 988461 - protein, 9 aa, Homo Sapiens
EQPPEAPEK

SEQ ID NO: 988462 - protein, 9 aa, Homo Sapiens
LYEEEMGNY

SEQ ID NO: 988463 - protein, 9 aa, Homo Sapiens
CSRDCQTKT

SEQ ID NO: 988464 - protein, 9 aa, Homo Sapiens
PYLHFGNLA

SEQ ID NO: 988465 - protein, 9 aa, Homo Sapiens
TTFNEKGKK

SEQ ID NO: 988466 - protein, 9 aa, Homo Sapiens
IYTEERPHK

SEQ ID NO: 988467 - protein, 9 aa, Homo Sapiens
ERIYNVGMQ

SEQ ID NO: 988468 - protein, 9 aa, Homo Sapiens
MHIPSWFCS

SEQ ID NO: 988469 - protein, 9 aa, Homo Sapiens
TLLHAAAQQ

SEQ ID NO: 988470 - protein, 9 aa, Homo Sapiens
LGNHRNNVD

SEQ ID NO: 988471 - protein, 9 aa, Homo Sapiens
DPFCNRMKK

SEQ ID NO: 988472 - protein, 9 aa, Homo Sapiens
PILTRQKVY

SEQ ID NO: 988473 - protein, 9 aa, Homo Sapiens
SYSLRSTTI

SEQ ID NO: 988474 - protein, 9 aa, Homo Sapiens
VRSHLNKEE

SEQ ID NO: 988475 - protein, 9 aa, Homo Sapiens
EENIIYFFL

SEQ ID NO: 988476 - protein, 9 aa, Homo Sapiens
ESCRVEPRT

SEQ ID NO: 988477 - protein, 9 aa, Homo Sapiens
YDHESCRVE

SEQ ID NO: 988478 - protein, 9 aa, Homo Sapiens
MASFFTEIV

SEQ ID NO: 988479 - protein, 9 aa, Homo Sapiens
PPTICSRVP

SEQ ID NO: 988480 - protein, 9 aa, Homo Sapiens
EKTYKPVEA

SEQ ID NO: 988481 - protein, 9 aa, Homo Sapiens
KHLNLMERV

SEQ ID NO: 988482 - protein, 9 aa, Homo Sapiens
EENGSCVLH

SEQ ID NO: 988483 - protein, 9 aa, Homo Sapiens
AVQDQQPDL

SEQ ID NO: 988484 - protein, 9 aa, Homo Sapiens
VMQELDCMK

SEQ ID NO: 988485 - protein, 9 aa, Homo Sapiens
MKKYNIKLK

SEQ ID NO: 988486 - protein, 9 aa, Homo Sapiens
TPLSPPPPS

SEQ ID NO: 988487 - protein, 9 aa, Homo Sapiens
RQSVVATPH

SEQ ID NO: 988488 - protein, 9 aa, Homo Sapiens
MWPSAFGSG

SEQ ID NO: 988489 - protein, 9 aa, Homo Sapiens
ETESVSQSS

SEQ ID NO: 988490 - protein, 9 aa, Homo Sapiens
DGAHCERGR

SEQ ID NO: 988491 - protein, 9 aa, Homo Sapiens
VDSRAGKNQ

SEQ ID NO: 988492 - protein, 9 aa, Homo Sapiens
TGADAGKLC

SEQ ID NO: 988493 - protein, 9 aa, Homo Sapiens
LTLSGLSRR

SEQ ID NO: 988494 - protein, 9 aa, Homo Sapiens
EGPLGDPGL

SEQ ID NO: 988495 - protein, 9 aa, Homo Sapiens
LEPRGASAR

SEQ ID NO: 988496 - protein, 9 aa, Homo Sapiens
VGMVFYPRS

SEQ ID NO: 988497 - protein, 9 aa, Homo Sapiens
QKRAQPPAA

SEQ ID NO: 988498 - protein, 9 aa, Homo Sapiens
LISCCLTLN

SEQ ID NO: 988499 - protein, 9 aa, Homo Sapiens
TPMYMFLEN

SEQ ID NO: 988500 - protein, 9 aa, Homo Sapiens
VFTFLLISC

SEQ ID NO: 988501 - protein, 9 aa, Homo Sapiens
CHGHVPIRQ

SEQ ID NO: 988502 - protein, 9 aa, Homo Sapiens
ATPPQASRV

SEQ ID NO: 988503 - protein, 9 aa, Homo Sapiens
GFIDSFGPL

SEQ ID NO: 988504 - protein, 9 aa, Homo Sapiens
LWLLCSYRP

SEQ ID NO: 988505 - protein, 9 aa, Homo Sapiens
YTLGRNHSG

SEQ ID NO: 988506 - protein, 9 aa, Homo Sapiens
FCYDGLQGL

SEQ ID NO: 988507 - protein, 9 aa, Homo Sapiens
QLQVEYRIN

SEQ ID NO: 988508 - protein, 9 aa, Homo Sapiens
CSFFLCQTS

SEQ ID NO: 988509 - protein, 9 aa, Homo Sapiens
GLLIVANRG

SEQ ID NO: 988510 - protein, 9 aa, Homo Sapiens
VSTRVRWCR

SEQ ID NO: 988511 - protein, 9 aa, Homo Sapiens
EFQNDVPGE

SEQ ID NO: 988512 - protein, 9 aa, Homo Sapiens
FRGIDDLAV

SEQ ID NO: 988513 - protein, 9 aa, Homo Sapiens
QSSGFRQHG

SEQ ID NO: 988514 - protein, 9 aa, Homo Sapiens
CYYQGKLRE

SEQ ID NO: 988515 - protein, 9 aa, Homo Sapiens
KRAQPPAAS

SEQ ID NO: 988516 - protein, 9 aa, Homo Sapiens
VESITSSSC

SEQ ID NO: 988517 - protein, 9 aa, Homo Sapiens
EVDECASAL

SEQ ID NO: 988518 - protein, 9 aa, Homo Sapiens
GQMSRTRFI

SEQ ID NO: 988519 - protein, 9 aa, Homo Sapiens
FIQCRQDNP

SEQ ID NO: 988520 - protein, 9 aa, Homo Sapiens
CLSFMLLFL

SEQ ID NO: 988521 - protein, 9 aa, Homo Sapiens
SWRRAPSFS

SEQ ID NO: 988522 - protein, 9 aa, Homo Sapiens
ELLMWRDHS

SEQ ID NO: 988523 - protein, 9 aa, Homo Sapiens
PGSQKVDSD

SEQ ID NO: 988524 - protein, 9 aa, Homo Sapiens
LHSFPRQAP

SEQ ID NO: 988525 - protein, 9 aa, Homo Sapiens
YFIDKDSTL

SEQ ID NO: 988526 - protein, 9 aa, Homo Sapiens
FFGSLAFVD

SEQ ID NO: 988527 - protein, 9 aa, Homo Sapiens
DIVLYFSLL

SEQ ID NO: 988528 - protein, 9 aa, Homo Sapiens
SYQNTKKNL

SEQ ID NO: 988529 - protein, 9 aa, Homo Sapiens
PKSKSEDSV

SEQ ID NO: 988530 - protein, 9 aa, Homo Sapiens
TYRRLLVGE

SEQ ID NO: 988531 - protein, 9 aa, Homo Sapiens
DKLLCTVTS

SEQ ID NO: 988532 - protein, 9 aa, Homo Sapiens
WEVTSRAPS

SEQ ID NO: 988533 - protein, 9 aa, Homo Sapiens
GGKFVSEGF

SEQ ID NO: 988534 - protein, 9 aa, Homo Sapiens
RVPTAKLAT

SEQ ID NO: 988535 - protein, 9 aa, Homo Sapiens
RNVGKATTN

SEQ ID NO: 988536 - protein, 9 aa, Homo Sapiens
KLFTAAEFL

SEQ ID NO: 988537 - protein, 9 aa, Homo Sapiens
GLNREQGDN

SEQ ID NO: 988538 - protein, 9 aa, Homo Sapiens
TGQESICSQ

SEQ ID NO: 988539 - protein, 9 aa, Homo Sapiens
RIIEINRQS

SEQ ID NO: 988540 - protein, 9 aa, Homo Sapiens
RLLALIKKP

SEQ ID NO: 988541 - protein, 9 aa, Homo Sapiens
VTLTESQFL

SEQ ID NO: 988542 - protein, 9 aa, Homo Sapiens
KLGARRDFS

SEQ ID NO: 988543 - protein, 9 aa, Homo Sapiens
MLLFLLWRQ

SEQ ID NO: 988544 - protein, 9 aa, Homo Sapiens
TKAIFTSDI

SEQ ID NO: 988545 - protein, 9 aa, Homo Sapiens
NSEEEWNRD

SEQ ID NO: 988546 - protein, 9 aa, Homo Sapiens
NVGMQLKSQ

SEQ ID NO: 988547 - protein, 9 aa, Homo Sapiens
LYGYNFPTF

SEQ ID NO: 988548 - protein, 9 aa, Homo Sapiens
WNEHSKARY

SEQ ID NO: 988549 - protein, 9 aa, Homo Sapiens
AASYFIDKD

SEQ ID NO: 988550 - protein, 9 aa, Homo Sapiens
YVTSELSEG

SEQ ID NO: 988551 - protein, 9 aa, Homo Sapiens
KLEALDVTL

SEQ ID NO: 988552 - protein, 9 aa, Homo Sapiens
LENFSFLEI

SEQ ID NO: 988553 - protein, 9 aa, Homo Sapiens
FYSSQFQAL

SEQ ID NO: 988554 - protein, 9 aa, Homo Sapiens
RRFSRAVQD

SEQ ID NO: 988555 - protein, 9 aa, Homo Sapiens
PVATISIVL

SEQ ID NO: 988556 - protein, 9 aa, Homo Sapiens
AYNICTDSW

SEQ ID NO: 988557 - protein, 9 aa, Homo Sapiens
RIFVRALRS

SEQ ID NO: 988558 - protein, 9 aa, Homo Sapiens
CNQRWVYDA

SEQ ID NO: 988559 - protein, 9 aa, Homo Sapiens
YNFPTFPRL

SEQ ID NO: 988560 - protein, 9 aa, Homo Sapiens
LFVPTQQDV

SEQ ID NO: 988561 - protein, 9 aa, Homo Sapiens
KNSKILLLK

SEQ ID NO: 988562 - protein, 9 aa, Homo Sapiens
SKVGAWRDY

SEQ ID NO: 988563 - protein, 9 aa, Homo Sapiens
KNDPTHIQL

SEQ ID NO: 988564 - protein, 9 aa, Homo Sapiens
NGFLSLLPY

SEQ ID NO: 988565 - protein, 9 aa, Homo Sapiens
QLSDISFGS

SEQ ID NO: 988566 - protein, 9 aa, Homo Sapiens
FLAVCADGE

SEQ ID NO: 988567 - protein, 9 aa, Homo Sapiens
ELPELPESS

SEQ ID NO: 988568 - protein, 9 aa, Homo Sapiens
FHLCFISIN

SEQ ID NO: 988569 - protein, 9 aa, Homo Sapiens
PVLVPRHSK

SEQ ID NO: 988570 - protein, 9 aa, Homo Sapiens
FSRKSKKRA

SEQ ID NO: 988571 - protein, 9 aa, Homo Sapiens
RWQRLEEAT

SEQ ID NO: 988572 - protein, 9 aa, Homo Sapiens
NEDVIAALL

SEQ ID NO: 988573 - protein, 9 aa, Homo Sapiens
IHSFHVRQD

SEQ ID NO: 988574 - protein, 9 aa, Homo Sapiens
HSQLDRSEV

SEQ ID NO: 988575 - protein, 9 aa, Homo Sapiens
LNAGKHVFV

SEQ ID NO: 988576 - protein, 9 aa, Homo Sapiens
YTTFKKQQK

SEQ ID NO: 988577 - protein, 9 aa, Homo Sapiens
VSINADNDH

SEQ ID NO: 988578 - protein, 9 aa, Homo Sapiens
NQRVKDKKI

SEQ ID NO: 988579 - protein, 9 aa, Homo Sapiens
ASTHYFHGL

SEQ ID NO: 988580 - protein, 9 aa, Homo Sapiens
DQALKIEMN

SEQ ID NO: 988581 - protein, 9 aa, Homo Sapiens
IQSLARNVF

SEQ ID NO: 988582 - protein, 9 aa, Homo Sapiens
AVLVSITGR

SEQ ID NO: 988583 - protein, 9 aa, Homo Sapiens
ARLEEEVRS

SEQ ID NO: 988584 - protein, 9 aa, Homo Sapiens
ERKLGARRD

SEQ ID NO: 988585 - protein, 9 aa, Homo Sapiens
PTDFCSSLA

SEQ ID NO: 988586 - protein, 9 aa, Homo Sapiens
YSSIRPPIL

SEQ ID NO: 988587 - protein, 9 aa, Homo Sapiens
YQGDGQSYR

SEQ ID NO: 988588 - protein, 9 aa, Homo Sapiens
GSSLTPAHH

SEQ ID NO: 988589 - protein, 9 aa, Homo Sapiens
LEHHINCYT

SEQ ID NO: 988590 - protein, 9 aa, Homo Sapiens
LSKSIEIYT

SEQ ID NO: 988591 - protein, 9 aa, Homo Sapiens
FLNAGKHVF

SEQ ID NO: 988592 - protein, 9 aa, Homo Sapiens
QVFLPPRPS

SEQ ID NO: 988593 - protein, 9 aa, Homo Sapiens
TLRILTCEL

SEQ ID NO: 988594 - protein, 9 aa, Homo Sapiens
PLLELACTN

SEQ ID NO: 988595 - protein, 9 aa, Homo Sapiens
IEYGINKKI

SEQ ID NO: 988596 - protein, 9 aa, Homo Sapiens
SVTAMEFEF

SEQ ID NO: 988597 - protein, 9 aa, Homo Sapiens
RKLLEMEKQ

SEQ ID NO: 988598 - protein, 9 aa, Homo Sapiens
GYNRIQSLA

SEQ ID NO: 988599 - protein, 9 aa, Homo Sapiens
LKKEHKSSM

SEQ ID NO: 988600 - protein, 9 aa, Homo Sapiens
WDLGVCREF

SEQ ID NO: 988601 - protein, 9 aa, Homo Sapiens
HVSYICRYD

SEQ ID NO: 988602 - protein, 9 aa, Homo Sapiens
FMNLMNDCS

SEQ ID NO: 988603 - protein, 9 aa, Homo Sapiens
IPIDFFFLR

SEQ ID NO: 988604 - protein, 9 aa, Homo Sapiens
RVEVSRQIF

SEQ ID NO: 988605 - protein, 9 aa, Homo Sapiens
CEKTYKPVE

SEQ ID NO: 988606 - protein, 9 aa, Homo Sapiens
LSVLNVTGV

SEQ ID NO: 988607 - protein, 9 aa, Homo Sapiens
DSGGPTPSF

SEQ ID NO: 988608 - protein, 9 aa, Homo Sapiens
HVPGFSRKS

SEQ ID NO: 988609 - protein, 9 aa, Homo Sapiens
KEEGEEEGG

SEQ ID NO: 988610 - protein, 9 aa, Homo Sapiens
APSFSVQKG

SEQ ID NO: 988611 - protein, 9 aa, Homo Sapiens
LQLSQILSL

SEQ ID NO: 988612 - protein, 9 aa, Homo Sapiens
PPETSVSVV

SEQ ID NO: 988613 - protein, 9 aa, Homo Sapiens
TCGHGGQMS

SEQ ID NO: 988614 - protein, 9 aa, Homo Sapiens
NSFVEAFKR

SEQ ID NO: 988615 - protein, 9 aa, Homo Sapiens
FDSSYDKDG

SEQ ID NO: 988616 - protein, 9 aa, Homo Sapiens
PRSPPGKLQ

SEQ ID NO: 988617 - protein, 9 aa, Homo Sapiens
SLLERASLG

SEQ ID NO: 988618 - protein, 9 aa, Homo Sapiens
NYNENTGEK

SEQ ID NO: 988619 - protein, 9 aa, Homo Sapiens
PNATQFIEF

SEQ ID NO: 988620 - protein, 9 aa, Homo Sapiens
SPQPHPLLS

SEQ ID NO: 988621 - protein, 9 aa, Homo Sapiens
HHLLHCLKK

SEQ ID NO: 988622 - protein, 9 aa, Homo Sapiens
TSNDAGTYS

SEQ ID NO: 988623 - protein, 9 aa, Homo Sapiens
VVQSKIEQL

SEQ ID NO: 988624 - protein, 9 aa, Homo Sapiens
LTLEKGFHE

SEQ ID NO: 988625 - protein, 9 aa, Homo Sapiens
RKRFSENFI

SEQ ID NO: 988626 - protein, 9 aa, Homo Sapiens
HILPYDVVP

SEQ ID NO: 988627 - protein, 9 aa, Homo Sapiens
RNEKPVTTG

SEQ ID NO: 988628 - protein, 9 aa, Homo Sapiens
AGNIYWLDS

SEQ ID NO: 988629 - protein, 9 aa, Homo Sapiens
IDKVRYLEQ

SEQ ID NO: 988630 - protein, 9 aa, Homo Sapiens
NYGFFPELP

SEQ ID NO: 988631 - protein, 9 aa, Homo Sapiens
PPDMTSFSY

SEQ ID NO: 988632 - protein, 9 aa, Homo Sapiens
TTCYRLSCC

SEQ ID NO: 988633 - protein, 9 aa, Homo Sapiens
FIEEAEVIM

SEQ ID NO: 988634 - protein, 9 aa, Homo Sapiens
CGAGSVIDL

SEQ ID NO: 988635 - protein, 9 aa, Homo Sapiens
LLTELQDNS

SEQ ID NO: 988636 - protein, 9 aa, Homo Sapiens
AIRSAIDED

SEQ ID NO: 988637 - protein, 9 aa, Homo Sapiens
IAWKKKEDT

SEQ ID NO: 988638 - protein, 9 aa, Homo Sapiens
SDGDEERLF

SEQ ID NO: 988639 - protein, 9 aa, Homo Sapiens
CNKHGLTCG

SEQ ID NO: 988640 - protein, 9 aa, Homo Sapiens
LCGKVFTLT

SEQ ID NO: 988641 - protein, 9 aa, Homo Sapiens
ILANDNVAE

SEQ ID NO: 988642 - protein, 9 aa, Homo Sapiens
EPLDFKEYK

SEQ ID NO: 988643 - protein, 9 aa, Homo Sapiens
QKVFSEQGR

SEQ ID NO: 988644 - protein, 9 aa, Homo Sapiens
DGKINFTIN

SEQ ID NO: 988645 - protein, 9 aa, Homo Sapiens
DFVDQNKQN

SEQ ID NO: 988646 - protein, 9 aa, Homo Sapiens
GTSTPCDFF

SEQ ID NO: 988647 - protein, 9 aa, Homo Sapiens
DEYDNYNEL

SEQ ID NO: 988648 - protein, 9 aa, Homo Sapiens
DIGVKGDRS

SEQ ID NO: 988649 - protein, 9 aa, Homo Sapiens
AVRTNNYEI

SEQ ID NO: 988650 - protein, 9 aa, Homo Sapiens
PPGYGPQEE

SEQ ID NO: 988651 - protein, 9 aa, Homo Sapiens
RTPIFTLRD

SEQ ID NO: 988652 - protein, 9 aa, Homo Sapiens
GPPLFIPPL

SEQ ID NO: 988653 - protein, 9 aa, Homo Sapiens
RLVKISTML

SEQ ID NO: 988654 - protein, 9 aa, Homo Sapiens
PPFPTPLSP

SEQ ID NO: 988655 - protein, 9 aa, Homo Sapiens
ESQLEAREP

SEQ ID NO: 988656 - protein, 9 aa, Homo Sapiens
EPAFIDDGG

SEQ ID NO: 988657 - protein, 9 aa, Homo Sapiens
KESCFVYSR

SEQ ID NO: 988658 - protein, 9 aa, Homo Sapiens
HGTEVTYQC

SEQ ID NO: 988659 - protein, 9 aa, Homo Sapiens
LREEKKEKY

SEQ ID NO: 988660 - protein, 9 aa, Homo Sapiens
YLGLQNFDF

SEQ ID NO: 988661 - protein, 9 aa, Homo Sapiens
DKALLKKYE

SEQ ID NO: 988662 - protein, 9 aa, Homo Sapiens
KLGMAMRSL

SEQ ID NO: 988663 - protein, 9 aa, Homo Sapiens
NNKKEALLD

SEQ ID NO: 988664 - protein, 9 aa, Homo Sapiens
RLARVLIVS

SEQ ID NO: 988665 - protein, 9 aa, Homo Sapiens
GRPEEYEGK

SEQ ID NO: 988666 - protein, 9 aa, Homo Sapiens
KVEKNPKPQ

SEQ ID NO: 988667 - protein, 9 aa, Homo Sapiens
QKGKYWDTL

SEQ ID NO: 988668 - protein, 9 aa, Homo Sapiens
EGIFAIRRH

SEQ ID NO: 988669 - protein, 9 aa, Homo Sapiens
AEQPPEAPE

SEQ ID NO: 988670 - protein, 9 aa, Homo Sapiens
KVFSEQGRV

SEQ ID NO: 988671 - protein, 9 aa, Homo Sapiens
QSKRKGEEG

SEQ ID NO: 988672 - protein, 9 aa, Homo Sapiens
GQLEVSEEQ

SEQ ID NO: 988673 - protein, 9 aa, Homo Sapiens
AGKLCPPPR

SEQ ID NO: 988674 - protein, 9 aa, Homo Sapiens
IVSLLTLEL

SEQ ID NO: 988675 - protein, 9 aa, Homo Sapiens
LQTVEKEKT

SEQ ID NO: 988676 - protein, 9 aa, Homo Sapiens
VLYQVEKWK

SEQ ID NO: 988677 - protein, 9 aa, Homo Sapiens
LRENPHSFA

SEQ ID NO: 988678 - protein, 9 aa, Homo Sapiens
QVEMNHFHQ

SEQ ID NO: 988679 - protein, 9 aa, Homo Sapiens
NRKRKLNID

SEQ ID NO: 988680 - protein, 9 aa, Homo Sapiens
PAPCPIEPP

SEQ ID NO: 988681 - protein, 9 aa, Homo Sapiens
LLVPLLLSF

SEQ ID NO: 988682 - protein, 9 aa, Homo Sapiens
HCRKQCKDE

SEQ ID NO: 988683 - protein, 9 aa, Homo Sapiens
CFAIFLLVS

SEQ ID NO: 988684 - protein, 9 aa, Homo Sapiens
RFGRPAELK

SEQ ID NO: 988685 - protein, 9 aa, Homo Sapiens
FMLLFLLWR

SEQ ID NO: 988686 - protein, 9 aa, Homo Sapiens
PKQEKKLLP

SEQ ID NO: 988687 - protein, 9 aa, Homo Sapiens
VVSLWPTPG

SEQ ID NO: 988688 - protein, 9 aa, Homo Sapiens
KLLDRMKNY

SEQ ID NO: 988689 - protein, 9 aa, Homo Sapiens
VSNEKNTPS

SEQ ID NO: 988690 - protein, 9 aa, Homo Sapiens
SYFIDKDST

SEQ ID NO: 988691 - protein, 9 aa, Homo Sapiens
APSLSVLNV

SEQ ID NO: 988692 - protein, 9 aa, Homo Sapiens
AAEKIIWNY

SEQ ID NO: 988693 - protein, 9 aa, Homo Sapiens
LDRNTKCFI

SEQ ID NO: 988694 - protein, 9 aa, Homo Sapiens
PDYPTRPTL

SEQ ID NO: 988695 - protein, 9 aa, Homo Sapiens
HIPSWFCSI

SEQ ID NO: 988696 - protein, 9 aa, Homo Sapiens
SPPPPTRPV

SEQ ID NO: 988697 - protein, 9 aa, Homo Sapiens
QSGPEKINK

SEQ ID NO: 988698 - protein, 9 aa, Homo Sapiens
TEEQAPEKI

SEQ ID NO: 988699 - protein, 9 aa, Homo Sapiens
KPWWHKNLT

SEQ ID NO: 988700 - protein, 9 aa, Homo Sapiens
NLAEKLAEK

SEQ ID NO: 988701 - protein, 9 aa, Homo Sapiens
EKAYSLGNL

SEQ ID NO: 988702 - protein, 9 aa, Homo Sapiens
LVHLAERKL

SEQ ID NO: 988703 - protein, 9 aa, Homo Sapiens
GTEVTYQCY

SEQ ID NO: 988704 - protein, 9 aa, Homo Sapiens
EEKKAPSQA

SEQ ID NO: 988705 - protein, 9 aa, Homo Sapiens
SPVLCLSCA

SEQ ID NO: 988706 - protein, 9 aa, Homo Sapiens
GVSGDAGMP

SEQ ID NO: 988707 - protein, 9 aa, Homo Sapiens
QIASSGSSS

SEQ ID NO: 988708 - protein, 9 aa, Homo Sapiens
ARQCHLRFE

SEQ ID NO: 988709 - protein, 9 aa, Homo Sapiens
MYNTERHVS

SEQ ID NO: 988710 - protein, 9 aa, Homo Sapiens
IDDGGFNLR

SEQ ID NO: 988711 - protein, 9 aa, Homo Sapiens
QTAPRCQLR

SEQ ID NO: 988712 - protein, 9 aa, Homo Sapiens
VTNSASVER

SEQ ID NO: 988713 - protein, 9 aa, Homo Sapiens
GKATTNACT

SEQ ID NO: 988714 - protein, 9 aa, Homo Sapiens
PNLPGSGGF

SEQ ID NO: 988715 - protein, 9 aa, Homo Sapiens
ALKSFTGLL

SEQ ID NO: 988716 - protein, 9 aa, Homo Sapiens
RCSPHSHSA

SEQ ID NO: 988717 - protein, 9 aa, Homo Sapiens
ANGTLNAFI

SEQ ID NO: 988718 - protein, 9 aa, Homo Sapiens
DPDFVVVDD

SEQ ID NO: 988719 - protein, 9 aa, Homo Sapiens
FFFLIVYLV

SEQ ID NO: 988720 - protein, 9 aa, Homo Sapiens
VPRHSKYNP

SEQ ID NO: 988721 - protein, 9 aa, Homo Sapiens
PQPHPLLSA

SEQ ID NO: 988722 - protein, 9 aa, Homo Sapiens
LRFPMYFFL

SEQ ID NO: 988723 - protein, 9 aa, Homo Sapiens
SYECILATI

SEQ ID NO: 988724 - protein, 9 aa, Homo Sapiens
DQAVRTMKI

SEQ ID NO: 988725 - protein, 9 aa, Homo Sapiens
CNDKNPCEG

SEQ ID NO: 988726 - protein, 9 aa, Homo Sapiens
RFSENFIYT

SEQ ID NO: 988727 - protein, 9 aa, Homo Sapiens
SLTLLFLAD

SEQ ID NO: 988728 - protein, 9 aa, Homo Sapiens
AQCKKIHHN

SEQ ID NO: 988729 - protein, 9 aa, Homo Sapiens
QRHPEKTSV

SEQ ID NO: 988730 - protein, 9 aa, Homo Sapiens
IKKSLTSNY

SEQ ID NO: 988731 - protein, 9 aa, Homo Sapiens
RPEEYEGKY

SEQ ID NO: 988732 - protein, 9 aa, Homo Sapiens
SLFENAMYI

SEQ ID NO: 988733 - protein, 9 aa, Homo Sapiens
NGFISKQKL

SEQ ID NO: 988734 - protein, 9 aa, Homo Sapiens
LSFMLLFLL

SEQ ID NO: 988735 - protein, 9 aa, Homo Sapiens
NQTEKFPEV

SEQ ID NO: 988736 - protein, 9 aa, Homo Sapiens
LVLVGPRPP

SEQ ID NO: 988737 - protein, 9 aa, Homo Sapiens
EVYSVSLTK

SEQ ID NO: 988738 - protein, 9 aa, Homo Sapiens
GKVFSASTS

SEQ ID NO: 988739 - protein, 9 aa, Homo Sapiens
GNHRNNVDL

SEQ ID NO: 988740 - protein, 9 aa, Homo Sapiens
VSKEKLRSL

SEQ ID NO: 988741 - protein, 9 aa, Homo Sapiens
NEDNCGDNN

SEQ ID NO: 988742 - protein, 9 aa, Homo Sapiens
WRDYDDSAF

SEQ ID NO: 988743 - protein, 9 aa, Homo Sapiens
NILNMLCFF

SEQ ID NO: 988744 - protein, 9 aa, Homo Sapiens
AAAGVMLLW

SEQ ID NO: 988745 - protein, 9 aa, Homo Sapiens
VRYLEQQNK

SEQ ID NO: 988746 - protein, 9 aa, Homo Sapiens
KRPTRESEN

SEQ ID NO: 988747 - protein, 9 aa, Homo Sapiens
PVTSGLKDY

SEQ ID NO: 988748 - protein, 9 aa, Homo Sapiens
IIAFAKLFC

SEQ ID NO: 988749 - protein, 9 aa, Homo Sapiens
RKAMAQKED

SEQ ID NO: 988750 - protein, 9 aa, Homo Sapiens
TPLLIAVQD

SEQ ID NO: 988751 - protein, 9 aa, Homo Sapiens
VTIWFQNQR

SEQ ID NO: 988752 - protein, 9 aa, Homo Sapiens
LLTADHGPS

SEQ ID NO: 988753 - protein, 9 aa, Homo Sapiens
SWFCSILPK

SEQ ID NO: 988754 - protein, 9 aa, Homo Sapiens
DLFLALDVP

SEQ ID NO: 988755 - protein, 9 aa, Homo Sapiens
FSDGGNTWR

SEQ ID NO: 988756 - protein, 9 aa, Homo Sapiens
QFFFGNTPS

SEQ ID NO: 988757 - protein, 9 aa, Homo Sapiens
VHSVRGQAL

SEQ ID NO: 988758 - protein, 9 aa, Homo Sapiens
NSTISFGNV

SEQ ID NO: 988759 - protein, 9 aa, Homo Sapiens
PWLFGYRSL

SEQ ID NO: 988760 - protein, 9 aa, Homo Sapiens
IDPLCCVWE

SEQ ID NO: 988761 - protein, 9 aa, Homo Sapiens
AMENTRQEM

SEQ ID NO: 988762 - protein, 9 aa, Homo Sapiens
GAVSTRVRW

SEQ ID NO: 988763 - protein, 9 aa, Homo Sapiens
IFHYSYTAL

SEQ ID NO: 988764 - protein, 9 aa, Homo Sapiens
ENFIYTYIG

SEQ ID NO: 988765 - protein, 9 aa, Homo Sapiens
KQPQNWPEQ

SEQ ID NO: 988766 - protein, 9 aa, Homo Sapiens
KILAVVRKE

SEQ ID NO: 988767 - protein, 9 aa, Homo Sapiens
RPSFRWTPA

SEQ ID NO: 988768 - protein, 9 aa, Homo Sapiens
PRLTNQPGE

SEQ ID NO: 988769 - protein, 9 aa, Homo Sapiens
NYRHLPLCP

SEQ ID NO: 988770 - protein, 9 aa, Homo Sapiens
GPPKPWWHK

SEQ ID NO: 988771 - protein, 9 aa, Homo Sapiens
VSDGFPAGP

SEQ ID NO: 988772 - protein, 9 aa, Homo Sapiens
DNPWDCTCN

SEQ ID NO: 988773 - protein, 9 aa, Homo Sapiens
IIYFFLGLA

SEQ ID NO: 988774 - protein, 9 aa, Homo Sapiens
LFITVLSYE

SEQ ID NO: 988775 - protein, 9 aa, Homo Sapiens
VKENKFKWN

SEQ ID NO: 988776 - protein, 9 aa, Homo Sapiens
RKLQNIFFP

SEQ ID NO: 988777 - protein, 9 aa, Homo Sapiens
NHFFSAQPL

SEQ ID NO: 988778 - protein, 9 aa, Homo Sapiens
CFISINRYI

SEQ ID NO: 988779 - protein, 9 aa, Homo Sapiens
NSDNANMST

SEQ ID NO: 988780 - protein, 9 aa, Homo Sapiens
CYTDYLELY

SEQ ID NO: 988781 - protein, 9 aa, Homo Sapiens
ESMDPDVQL

SEQ ID NO: 988782 - protein, 9 aa, Homo Sapiens
SCCLTLNFR

SEQ ID NO: 988783 - protein, 9 aa, Homo Sapiens
KIYSYYVKA

SEQ ID NO: 988784 - protein, 9 aa, Homo Sapiens
LYIGEKPFK

SEQ ID NO: 988785 - protein, 9 aa, Homo Sapiens
ESGSGGGSG

SEQ ID NO: 988786 - protein, 9 aa, Homo Sapiens
ASRRSLSVS

SEQ ID NO: 988787 - protein, 9 aa, Homo Sapiens
ICNCSYCWK

SEQ ID NO: 988788 - protein, 9 aa, Homo Sapiens
YSYYVKAPS

SEQ ID NO: 988789 - protein, 9 aa, Homo Sapiens
ATATTTWME

SEQ ID NO: 988790 - protein, 9 aa, Homo Sapiens
EKKAPSQAP

SEQ ID NO: 988791 - protein, 9 aa, Homo Sapiens
DMLEVVLAK

SEQ ID NO: 988792 - protein, 9 aa, Homo Sapiens
VIYEQLKRA

SEQ ID NO: 988793 - protein, 9 aa, Homo Sapiens
LELSPMLPE

SEQ ID NO: 988794 - protein, 9 aa, Homo Sapiens
GVCREFVHC

SEQ ID NO: 988795 - protein, 9 aa, Homo Sapiens
PPPPPLPQQ

SEQ ID NO: 988796 - protein, 9 aa, Homo Sapiens
DDLAVAYGV

SEQ ID NO: 988797 - protein, 9 aa, Homo Sapiens
QEEYNLESI

SEQ ID NO: 988798 - protein, 9 aa, Homo Sapiens
SSFSSEDKQ

SEQ ID NO: 988799 - protein, 9 aa, Homo Sapiens
YDELFQIQL

SEQ ID NO: 988800 - protein, 9 aa, Homo Sapiens
SLPTDFCSS

SEQ ID NO: 988801 - protein, 9 aa, Homo Sapiens
EYKSELDKR

SEQ ID NO: 988802 - protein, 9 aa, Homo Sapiens
NAPAAESVN

SEQ ID NO: 988803 - protein, 9 aa, Homo Sapiens
GKWKMGPVL

SEQ ID NO: 988804 - protein, 9 aa, Homo Sapiens
HPAFQTPNL

SEQ ID NO: 988805 - protein, 9 aa, Homo Sapiens
LSQVAGMLV

SEQ ID NO: 988806 - protein, 9 aa, Homo Sapiens
LQNERKNDP

SEQ ID NO: 988807 - protein, 9 aa, Homo Sapiens
GAFGNFFVN

SEQ ID NO: 988808 - protein, 9 aa, Homo Sapiens
ECGPKYLEA

SEQ ID NO: 988809 - protein, 9 aa, Homo Sapiens
FCNRMKKPL

SEQ ID NO: 988810 - protein, 9 aa, Homo Sapiens
DHLLYSRHC

SEQ ID NO: 988811 - protein, 9 aa, Homo Sapiens
KNSRGKNVA

SEQ ID NO: 988812 - protein, 9 aa, Homo Sapiens
FYCDVSQVL

SEQ ID NO: 988813 - protein, 9 aa, Homo Sapiens
LFSSKSKLQ

SEQ ID NO: 988814 - protein, 9 aa, Homo Sapiens
QTALSSPPP

SEQ ID NO: 988815 - protein, 9 aa, Homo Sapiens
GCRGGFGSR

SEQ ID NO: 988816 - protein, 9 aa, Homo Sapiens
KDLFSSKSK

SEQ ID NO: 988817 - protein, 9 aa, Homo Sapiens
FKSRDPFCN

SEQ ID NO: 988818 - protein, 9 aa, Homo Sapiens
RESENEDEE

SEQ ID NO: 988819 - protein, 9 aa, Homo Sapiens
RRMWPSAFG

SEQ ID NO: 988820 - protein, 9 aa, Homo Sapiens
QRLQKSLQQ

SEQ ID NO: 988821 - protein, 9 aa, Homo Sapiens
ILLFRLEAR

SEQ ID NO: 988822 - protein, 9 aa, Homo Sapiens
CLERCLDYN

SEQ ID NO: 988823 - protein, 9 aa, Homo Sapiens
PNVNTTSAG

SEQ ID NO: 988824 - protein, 9 aa, Homo Sapiens
ETPSEDDRN

SEQ ID NO: 988825 - protein, 9 aa, Homo Sapiens
VDQNKQNLI

SEQ ID NO: 988826 - protein, 9 aa, Homo Sapiens
KNGSRDTES

SEQ ID NO: 988827 - protein, 9 aa, Homo Sapiens
KQSNLHRIL

SEQ ID NO: 988828 - protein, 9 aa, Homo Sapiens
FDRVQMRND

SEQ ID NO: 988829 - protein, 9 aa, Homo Sapiens
WFLEGKSIM

SEQ ID NO: 988830 - protein, 9 aa, Homo Sapiens
DLAVAYGVA

SEQ ID NO: 988831 - protein, 9 aa, Homo Sapiens
PMLPEFWEG

SEQ ID NO: 988832 - protein, 9 aa, Homo Sapiens
YEDITLGSR

SEQ ID NO: 988833 - protein, 9 aa, Homo Sapiens
LAGEKRGRC

SEQ ID NO: 988834 - protein, 9 aa, Homo Sapiens
QASRVLSAL

SEQ ID NO: 988835 - protein, 9 aa, Homo Sapiens
QPTFETLRW

SEQ ID NO: 988836 - protein, 9 aa, Homo Sapiens
KITEFQNDV

SEQ ID NO: 988837 - protein, 9 aa, Homo Sapiens
EDVIAALLN

SEQ ID NO: 988838 - protein, 9 aa, Homo Sapiens
SRSEKRAQK

SEQ ID NO: 988839 - protein, 9 aa, Homo Sapiens
ELELMRKEI

SEQ ID NO: 988840 - protein, 9 aa, Homo Sapiens
TPKTVRSER

SEQ ID NO: 988841 - protein, 9 aa, Homo Sapiens
TPCDFFGIG

SEQ ID NO: 988842 - protein, 9 aa, Homo Sapiens
LKTTESKPG

SEQ ID NO: 988843 - protein, 9 aa, Homo Sapiens
QLMKVVNKM

SEQ ID NO: 988844 - protein, 9 aa, Homo Sapiens
LRPLGILPP

SEQ ID NO: 988845 - protein, 9 aa, Homo Sapiens
QNSDNANMS

SEQ ID NO: 988846 - protein, 9 aa, Homo Sapiens
PTKTRFVDG

SEQ ID NO: 988847 - protein, 9 aa, Homo Sapiens
GLLSCGNIL

SEQ ID NO: 988848 - protein, 9 aa, Homo Sapiens
PEMNSVPHF

SEQ ID NO: 988849 - protein, 9 aa, Homo Sapiens
FSECKIQFF

SEQ ID NO: 988850 - protein, 9 aa, Homo Sapiens
FTGWAAASF

SEQ ID NO: 988851 - protein, 9 aa, Homo Sapiens
RSEVGVPGS

SEQ ID NO: 988852 - protein, 9 aa, Homo Sapiens
GKDTTTFVR

SEQ ID NO: 988853 - protein, 9 aa, Homo Sapiens
LIAEVKSKK

SEQ ID NO: 988854 - protein, 9 aa, Homo Sapiens
EKIFLPPKK

SEQ ID NO: 988855 - protein, 9 aa, Homo Sapiens
KFPCGEPCL

SEQ ID NO: 988856 - protein, 9 aa, Homo Sapiens
GAHCERGRE

SEQ ID NO: 988857 - protein, 9 aa, Homo Sapiens
HFLSEKKNI

SEQ ID NO: 988858 - protein, 9 aa, Homo Sapiens
IYNVGMQLK

SEQ ID NO: 988859 - protein, 9 aa, Homo Sapiens
GKKASTGRV

SEQ ID NO: 988860 - protein, 9 aa, Homo Sapiens
RCNQRWVYD

SEQ ID NO: 988861 - protein, 9 aa, Homo Sapiens
VAHIKEGSK

SEQ ID NO: 988862 - protein, 9 aa, Homo Sapiens
MTSFSYGTR

SEQ ID NO: 988863 - protein, 9 aa, Homo Sapiens
QILSLMETV

SEQ ID NO: 988864 - protein, 9 aa, Homo Sapiens
SAEQRHPEK

SEQ ID NO: 988865 - protein, 9 aa, Homo Sapiens
CRCGSETMR

SEQ ID NO: 988866 - protein, 9 aa, Homo Sapiens
CKILAVMKL

SEQ ID NO: 988867 - protein, 9 aa, Homo Sapiens
NVEGSGKLF

SEQ ID NO: 988868 - protein, 9 aa, Homo Sapiens
NTERHVSLR

SEQ ID NO: 988869 - protein, 9 aa, Homo Sapiens
SGGPHIFYP

SEQ ID NO: 988870 - protein, 9 aa, Homo Sapiens
KALDAISYS

SEQ ID NO: 988871 - protein, 9 aa, Homo Sapiens
TWTTLSRIA

SEQ ID NO: 988872 - protein, 9 aa, Homo Sapiens
RGFKAERNM

SEQ ID NO: 988873 - protein, 9 aa, Homo Sapiens
AQHELNDAE

SEQ ID NO: 988874 - protein, 9 aa, Homo Sapiens
INMKEPLAT

SEQ ID NO: 988875 - protein, 9 aa, Homo Sapiens
VKMKKKGDI

SEQ ID NO: 988876 - protein, 9 aa, Homo Sapiens
QVALLGLAL

SEQ ID NO: 988877 - protein, 9 aa, Homo Sapiens
LTQNPLRQK

SEQ ID NO: 988878 - protein, 9 aa, Homo Sapiens
TRRRRFSRA

SEQ ID NO: 988879 - protein, 9 aa, Homo Sapiens
YNLESIDWL

SEQ ID NO: 988880 - protein, 9 aa, Homo Sapiens
AGALAVSGQ

SEQ ID NO: 988881 - protein, 9 aa, Homo Sapiens
NLLKDLKDS

SEQ ID NO: 988882 - protein, 9 aa, Homo Sapiens
HTENYRLRL

SEQ ID NO: 988883 - protein, 9 aa, Homo Sapiens
KNFTPMAPK

SEQ ID NO: 988884 - protein, 9 aa, Homo Sapiens
GGQMSRTRF

SEQ ID NO: 988885 - protein, 9 aa, Homo Sapiens
PGSPGPKGI

SEQ ID NO: 988886 - protein, 9 aa, Homo Sapiens
PSTEEIFRR

SEQ ID NO: 988887 - protein, 9 aa, Homo Sapiens
IYEQLKRAL

SEQ ID NO: 988888 - protein, 9 aa, Homo Sapiens
SVSFEDRLN

SEQ ID NO: 988889 - protein, 9 aa, Homo Sapiens
SLELSPMLP

SEQ ID NO: 988890 - protein, 9 aa, Homo Sapiens
CSRVPTAKL

SEQ ID NO: 988891 - protein, 9 aa, Homo Sapiens
TSGERFQAR

SEQ ID NO: 988892 - protein, 9 aa, Homo Sapiens
YSAIGATRS

SEQ ID NO: 988893 - protein, 9 aa, Homo Sapiens
LLSFFVLGL

SEQ ID NO: 988894 - protein, 9 aa, Homo Sapiens
PAFIDDGGF

SEQ ID NO: 988895 - protein, 9 aa, Homo Sapiens
VSQEEFLFL

SEQ ID NO: 988896 - protein, 9 aa, Homo Sapiens
ELPVSCVCM

SEQ ID NO: 988897 - protein, 9 aa, Homo Sapiens
FILKEAQIK

SEQ ID NO: 988898 - protein, 9 aa, Homo Sapiens
FSSEDKQHL

SEQ ID NO: 988899 - protein, 9 aa, Homo Sapiens
GSPLLWATA

SEQ ID NO: 988900 - protein, 9 aa, Homo Sapiens
SPGGGGDGP

SEQ ID NO: 988901 - protein, 9 aa, Homo Sapiens
NDNLDPEKE

SEQ ID NO: 988902 - protein, 9 aa, Homo Sapiens
IHTENYRLR

SEQ ID NO: 988903 - protein, 9 aa, Homo Sapiens
YWDTLLHAA

SEQ ID NO: 988904 - protein, 9 aa, Homo Sapiens
HSYSYDWRT

SEQ ID NO: 988905 - protein, 9 aa, Homo Sapiens
FSRGVSSSI

SEQ ID NO: 988906 - protein, 9 aa, Homo Sapiens
LLISCGVIP

SEQ ID NO: 988907 - protein, 9 aa, Homo Sapiens
PSIAPKPVT

SEQ ID NO: 988908 - protein, 9 aa, Homo Sapiens
PVEAAEPAT

SEQ ID NO: 988909 - protein, 9 aa, Homo Sapiens
LHVQSGPEK

SEQ ID NO: 988910 - protein, 9 aa, Homo Sapiens
PFILKIINA

SEQ ID NO: 988911 - protein, 9 aa, Homo Sapiens
QCMTALNLF

SEQ ID NO: 988912 - protein, 9 aa, Homo Sapiens
KYLPVYSPK

SEQ ID NO: 988913 - protein, 9 aa, Homo Sapiens
SEGSHPGTL

SEQ ID NO: 988914 - protein, 9 aa, Homo Sapiens
AKSYKIQVT

SEQ ID NO: 988915 - protein, 9 aa, Homo Sapiens
ASSPVLCLS

SEQ ID NO: 988916 - protein, 9 aa, Homo Sapiens
LLDAFDAKA

SEQ ID NO: 988917 - protein, 9 aa, Homo Sapiens
KTLVSLAIQ

SEQ ID NO: 988918 - protein, 9 aa, Homo Sapiens
TLVNSSIGR

SEQ ID NO: 988919 - protein, 9 aa, Homo Sapiens
VPFRGIDDL

SEQ ID NO: 988920 - protein, 9 aa, Homo Sapiens
FQCRDTPIS

SEQ ID NO: 988921 - protein, 9 aa, Homo Sapiens
LDVIADVNT

SEQ ID NO: 988922 - protein, 9 aa, Homo Sapiens
VGNSEETPM

SEQ ID NO: 988923 - protein, 9 aa, Homo Sapiens
GFPGIEKPG

SEQ ID NO: 988924 - protein, 9 aa, Homo Sapiens
SGSRNVISI

SEQ ID NO: 988925 - protein, 9 aa, Homo Sapiens
SLSEIMIML

SEQ ID NO: 988926 - protein, 9 aa, Homo Sapiens
QLDRSEVLL

SEQ ID NO: 988927 - protein, 9 aa, Homo Sapiens
ENGCRGGFG

SEQ ID NO: 988928 - protein, 9 aa, Homo Sapiens
WEARHGGNV

SEQ ID NO: 988929 - protein, 9 aa, Homo Sapiens
KINFTINTN

SEQ ID NO: 988930 - protein, 9 aa, Homo Sapiens
KNDGKLYAK

SEQ ID NO: 988931 - protein, 9 aa, Homo Sapiens
ALRRMEAAI

SEQ ID NO: 988932 - protein, 9 aa, Homo Sapiens
GASHREWNL

SEQ ID NO: 988933 - protein, 9 aa, Homo Sapiens
RAGRPVTLS

SEQ ID NO: 988934 - protein, 9 aa, Homo Sapiens
SSVEAYNIC

SEQ ID NO: 988935 - protein, 9 aa, Homo Sapiens
LSTEEKFII

SEQ ID NO: 988936 - protein, 9 aa, Homo Sapiens
AKEDGREEG

SEQ ID NO: 988937 - protein, 9 aa, Homo Sapiens
NHFTCKILA

SEQ ID NO: 988938 - protein, 9 aa, Homo Sapiens
PHGYAGVPQ

SEQ ID NO: 988939 - protein, 9 aa, Homo Sapiens
SSVTLTESQ

SEQ ID NO: 988940 - protein, 9 aa, Homo Sapiens
CIKNSKILL

SEQ ID NO: 988941 - protein, 9 aa, Homo Sapiens
SVRGQALYL

SEQ ID NO: 988942 - protein, 9 aa, Homo Sapiens
KIDGRGGGE

SEQ ID NO: 988943 - protein, 9 aa, Homo Sapiens
LFRDYVESI

SEQ ID NO: 988944 - protein, 9 aa, Homo Sapiens
QNTKKNLCR

SEQ ID NO: 988945 - protein, 9 aa, Homo Sapiens
CCITAASYR

SEQ ID NO: 988946 - protein, 9 aa, Homo Sapiens
GDEERLFQD

SEQ ID NO: 988947 - protein, 9 aa, Homo Sapiens
AMALSERRQ

SEQ ID NO: 988948 - protein, 9 aa, Homo Sapiens
EQEIVQKQT

SEQ ID NO: 988949 - protein, 9 aa, Homo Sapiens
NTLFSTEQS

SEQ ID NO: 988950 - protein, 9 aa, Homo Sapiens
GLNLPAGKR

SEQ ID NO: 988951 - protein, 9 aa, Homo Sapiens
NWTGNELHE

SEQ ID NO: 988952 - protein, 9 aa, Homo Sapiens
SRSVQTTLK

SEQ ID NO: 988953 - protein, 9 aa, Homo Sapiens
YPTRPTLRG

SEQ ID NO: 988954 - protein, 9 aa, Homo Sapiens
EFVHCKGKI

SEQ ID NO: 988955 - protein, 9 aa, Homo Sapiens
RQDTIEREC

SEQ ID NO: 988956 - protein, 9 aa, Homo Sapiens
TEENRKNSY

SEQ ID NO: 988957 - protein, 9 aa, Homo Sapiens
KELLKKKPF

SEQ ID NO: 988958 - protein, 9 aa, Homo Sapiens
LDFKEYKMY

SEQ ID NO: 988959 - protein, 9 aa, Homo Sapiens
AGRPVTLSL

SEQ ID NO: 988960 - protein, 9 aa, Homo Sapiens
IFSWCIWKQ

SEQ ID NO: 988961 - protein, 9 aa, Homo Sapiens
NFSGPDYSS

SEQ ID NO: 988962 - protein, 9 aa, Homo Sapiens
NNVDLTEWL

SEQ ID NO: 988963 - protein, 9 aa, Homo Sapiens
LYVIYNIHT

SEQ ID NO: 988964 - protein, 9 aa, Homo Sapiens
GFKAERNMR

SEQ ID NO: 988965 - protein, 9 aa, Homo Sapiens
DKLRTQRDL

SEQ ID NO: 988966 - protein, 9 aa, Homo Sapiens
VPCSYSAHY

SEQ ID NO: 988967 - protein, 9 aa, Homo Sapiens
SRGTAQPTL

SEQ ID NO: 988968 - protein, 9 aa, Homo Sapiens
EVFSYGRAS

SEQ ID NO: 988969 - protein, 9 aa, Homo Sapiens
GPGLGIKFS

SEQ ID NO: 988970 - protein, 9 aa, Homo Sapiens
RTCRFKWGL

SEQ ID NO: 988971 - protein, 9 aa, Homo Sapiens
LSFQIIRCS

SEQ ID NO: 988972 - protein, 9 aa, Homo Sapiens
LSDEIREDY

SEQ ID NO: 988973 - protein, 9 aa, Homo Sapiens
DIQNTTLRD

SEQ ID NO: 988974 - protein, 9 aa, Homo Sapiens
NIIYFFLGL

SEQ ID NO: 988975 - protein, 9 aa, Homo Sapiens
YSLQVNGYR

SEQ ID NO: 988976 - protein, 9 aa, Homo Sapiens
IDDLAVAYG

SEQ ID NO: 988977 - protein, 9 aa, Homo Sapiens
GCSRDCQTK

SEQ ID NO: 988978 - protein, 9 aa, Homo Sapiens
SQAADFLRE

SEQ ID NO: 988979 - protein, 9 aa, Homo Sapiens
VGAWRDYDD

SEQ ID NO: 988980 - protein, 9 aa, Homo Sapiens
TTTWMEPTA

SEQ ID NO: 988981 - protein, 9 aa, Homo Sapiens
VIPNFLKTY

SEQ ID NO: 988982 - protein, 9 aa, Homo Sapiens
HCRPGTMGL

SEQ ID NO: 988983 - protein, 9 aa, Homo Sapiens
DKVRYLEQQ

SEQ ID NO: 988984 - protein, 9 aa, Homo Sapiens
ICNRLRYPV

SEQ ID NO: 988985 - protein, 9 aa, Homo Sapiens
GPDYSSIRP

SEQ ID NO: 988986 - protein, 9 aa, Homo Sapiens
TISLSEIMI

SEQ ID NO: 988987 - protein, 9 aa, Homo Sapiens
LWKCPHNNI

SEQ ID NO: 988988 - protein, 9 aa, Homo Sapiens
DIDRIATPL

SEQ ID NO: 988989 - protein, 9 aa, Homo Sapiens
IPCSMLENF

SEQ ID NO: 988990 - protein, 9 aa, Homo Sapiens
WLFGYRSLE

SEQ ID NO: 988991 - protein, 9 aa, Homo Sapiens
SRRSLSVSS

SEQ ID NO: 988992 - protein, 9 aa, Homo Sapiens
RLKEQLGRG

SEQ ID NO: 988993 - protein, 9 aa, Homo Sapiens
AASGPRGII

SEQ ID NO: 988994 - protein, 9 aa, Homo Sapiens
IEMKNHNSH

SEQ ID NO: 988995 - protein, 9 aa, Homo Sapiens
GPATYEIFQ

SEQ ID NO: 988996 - protein, 9 aa, Homo Sapiens
LFIPPLKVS

SEQ ID NO: 988997 - protein, 9 aa, Homo Sapiens
RHPREMLKE

SEQ ID NO: 988998 - protein, 9 aa, Homo Sapiens
PSLRFPMYF

SEQ ID NO: 988999 - protein, 9 aa, Homo Sapiens
APFFSDLGS

SEQ ID NO: 989000 - protein, 9 aa, Homo Sapiens
QCHQEGGSC

SEQ ID NO: 989001 - protein, 9 aa, Homo Sapiens
KFFNHSSSG

SEQ ID NO: 989002 - protein, 9 aa, Homo Sapiens
KLFKKIFSS

SEQ ID NO: 989003 - protein, 9 aa, Homo Sapiens
NDRLQGMAP

SEQ ID NO: 989004 - protein, 9 aa, Homo Sapiens
TCWCPIQGL

SEQ ID NO: 989005 - protein, 9 aa, Homo Sapiens
GIEKPGVAG

SEQ ID NO: 989006 - protein, 9 aa, Homo Sapiens
CVRVRPGEC

SEQ ID NO: 989007 - protein, 9 aa, Homo Sapiens
EVDINIKIR

SEQ ID NO: 989008 - protein, 9 aa, Homo Sapiens
PPGFPGIEK

SEQ ID NO: 989009 - protein, 9 aa, Homo Sapiens
SGSTEQSEK

SEQ ID NO: 989010 - protein, 9 aa, Homo Sapiens
GRFRYPTKC

SEQ ID NO: 989011 - protein, 9 aa, Homo Sapiens
FYFILFNNV

SEQ ID NO: 989012 - protein, 9 aa, Homo Sapiens
IENDRLQGM

SEQ ID NO: 989013 - protein, 9 aa, Homo Sapiens
YHAVVLSYR

SEQ ID NO: 989014 - protein, 9 aa, Homo Sapiens
YRYVYHSLK

SEQ ID NO: 989015 - protein, 9 aa, Homo Sapiens
IMLWHRLND

SEQ ID NO: 989016 - protein, 9 aa, Homo Sapiens
SKKEIEDIQ

SEQ ID NO: 989017 - protein, 9 aa, Homo Sapiens
PSELPGTET

SEQ ID NO: 989018 - protein, 9 aa, Homo Sapiens
AQPTLDLSR

SEQ ID NO: 989019 - protein, 9 aa, Homo Sapiens
HLLLQKLFR

SEQ ID NO: 989020 - protein, 9 aa, Homo Sapiens
FASNIKENA

SEQ ID NO: 989021 - protein, 9 aa, Homo Sapiens
HYNEEGSQI

SEQ ID NO: 989022 - protein, 9 aa, Homo Sapiens
VQKQTFTKW

SEQ ID NO: 989023 - protein, 9 aa, Homo Sapiens
DEEDGLCHG

SEQ ID NO: 989024 - protein, 9 aa, Homo Sapiens
SYDVKMKKK

SEQ ID NO: 989025 - protein, 9 aa, Homo Sapiens
VYHSLKWMV

SEQ ID NO: 989026 - protein, 9 aa, Homo Sapiens
SPPGKLQGP

SEQ ID NO: 989027 - protein, 9 aa, Homo Sapiens
DHGAIKVKT

SEQ ID NO: 989028 - protein, 9 aa, Homo Sapiens
ERGRENFFR

SEQ ID NO: 989029 - protein, 9 aa, Homo Sapiens
HSGVRNVGK

SEQ ID NO: 989030 - protein, 9 aa, Homo Sapiens
RKRKRKKPN

SEQ ID NO: 989031 - protein, 9 aa, Homo Sapiens
YWILRGVAL

SEQ ID NO: 989032 - protein, 9 aa, Homo Sapiens
VLSPALGPT

SEQ ID NO: 989033 - protein, 9 aa, Homo Sapiens
GNSEETPMI

SEQ ID NO: 989034 - protein, 9 aa, Homo Sapiens
FTGKILRAC

SEQ ID NO: 989035 - protein, 9 aa, Homo Sapiens
PLKFESYAY

SEQ ID NO: 989036 - protein, 9 aa, Homo Sapiens
EECGKFFNH

SEQ ID NO: 989037 - protein, 9 aa, Homo Sapiens
TLEKGFHEV

SEQ ID NO: 989038 - protein, 9 aa, Homo Sapiens
VLVFYYSPV

SEQ ID NO: 989039 - protein, 9 aa, Homo Sapiens
HKFPCGEPC

SEQ ID NO: 989040 - protein, 9 aa, Homo Sapiens
KSKMISFSE

SEQ ID NO: 989041 - protein, 9 aa, Homo Sapiens
QRHRIHSFH

SEQ ID NO: 989042 - protein, 9 aa, Homo Sapiens
FMQVASARQ

SEQ ID NO: 989043 - protein, 9 aa, Homo Sapiens
VFQILDRNT

SEQ ID NO: 989044 - protein, 9 aa, Homo Sapiens
KFLTPLQWC

SEQ ID NO: 989045 - protein, 9 aa, Homo Sapiens
RYGKDTTTF

SEQ ID NO: 989046 - protein, 9 aa, Homo Sapiens
AYLSNLSRL

SEQ ID NO: 989047 - protein, 9 aa, Homo Sapiens
DYWILRGVA

SEQ ID NO: 989048 - protein, 9 aa, Homo Sapiens
FFLCQTSKQ

SEQ ID NO: 989049 - protein, 9 aa, Homo Sapiens
GRQMSDGDE

SEQ ID NO: 989050 - protein, 9 aa, Homo Sapiens
QFGGIHFVN

SEQ ID NO: 989051 - protein, 9 aa, Homo Sapiens
TNNYEIVRL

SEQ ID NO: 989052 - protein, 9 aa, Homo Sapiens
TPTSSLNSL

SEQ ID NO: 989053 - protein, 9 aa, Homo Sapiens
DSGPKSSSP

SEQ ID NO: 989054 - protein, 9 aa, Homo Sapiens
RWSLRQLIS

SEQ ID NO: 989055 - protein, 9 aa, Homo Sapiens
QKGRCSVPA

SEQ ID NO: 989056 - protein, 9 aa, Homo Sapiens
TEVTYQCYP

SEQ ID NO: 989057 - protein, 9 aa, Homo Sapiens
SYKIQVTAT

SEQ ID NO: 989058 - protein, 9 aa, Homo Sapiens
ASKVYTKDR

SEQ ID NO: 989059 - protein, 9 aa, Homo Sapiens
DSFSFNFVP

SEQ ID NO: 989060 - protein, 9 aa, Homo Sapiens
FILNSLYNE

SEQ ID NO: 989061 - protein, 9 aa, Homo Sapiens
LLIVANRGT

SEQ ID NO: 989062 - protein, 9 aa, Homo Sapiens
YDFKETVNN

SEQ ID NO: 989063 - protein, 9 aa, Homo Sapiens
FFGNTPSTL

SEQ ID NO: 989064 - protein, 9 aa, Homo Sapiens
RKDAMENTR

SEQ ID NO: 989065 - protein, 9 aa, Homo Sapiens
KIVKRVGNS

SEQ ID NO: 989066 - protein, 9 aa, Homo Sapiens
SNPFLNDIT

SEQ ID NO: 989067 - protein, 9 aa, Homo Sapiens
QCKDEEAVK

SEQ ID NO: 989068 - protein, 9 aa, Homo Sapiens
ETKTMSKEV

SEQ ID NO: 989069 - protein, 9 aa, Homo Sapiens
WLLCSYRPA

SEQ ID NO: 989070 - protein, 9 aa, Homo Sapiens
NCSYCWKRD

SEQ ID NO: 989071 - protein, 9 aa, Homo Sapiens
KSSRSPSSR

SEQ ID NO: 989072 - protein, 9 aa, Homo Sapiens
DNLVLPDDV

SEQ ID NO: 989073 - protein, 9 aa, Homo Sapiens
REVLESAVL

SEQ ID NO: 989074 - protein, 9 aa, Homo Sapiens
GNEDTDSAI

SEQ ID NO: 989075 - protein, 9 aa, Homo Sapiens
PYFPPLYQP

SEQ ID NO: 989076 - protein, 9 aa, Homo Sapiens
GAGTNQPPS

SEQ ID NO: 989077 - protein, 9 aa, Homo Sapiens
CTSSNDLGK

SEQ ID NO: 989078 - protein, 9 aa, Homo Sapiens
FFGIGVSVE

SEQ ID NO: 989079 - protein, 9 aa, Homo Sapiens
FPAIQAASS

SEQ ID NO: 989080 - protein, 9 aa, Homo Sapiens
QRVKDKKIV

SEQ ID NO: 989081 - protein, 9 aa, Homo Sapiens
PESFANVSI

SEQ ID NO: 989082 - protein, 9 aa, Homo Sapiens
STQPETNSE

SEQ ID NO: 989083 - protein, 9 aa, Homo Sapiens
SRNMVLSYE

SEQ ID NO: 989084 - protein, 9 aa, Homo Sapiens
LVEKNLGKL

SEQ ID NO: 989085 - protein, 9 aa, Homo Sapiens
FVSEGFKVR

SEQ ID NO: 989086 - protein, 9 aa, Homo Sapiens
LQIPHELEL

SEQ ID NO: 989087 - protein, 9 aa, Homo Sapiens
SSSVKAPAL

SEQ ID NO: 989088 - protein, 9 aa, Homo Sapiens
NLESIDWLH

SEQ ID NO: 989089 - protein, 9 aa, Homo Sapiens
LKDLKDSLL

SEQ ID NO: 989090 - protein, 9 aa, Homo Sapiens
DYSSIRPPI

SEQ ID NO: 989091 - protein, 9 aa, Homo Sapiens
PNFLKTYSQ

SEQ ID NO: 989092 - protein, 9 aa, Homo Sapiens
ELNPSALSS

SEQ ID NO: 989093 - protein, 9 aa, Homo Sapiens
MGKKWTKGK

SEQ ID NO: 989094 - protein, 9 aa, Homo Sapiens
SSSCALVQT

SEQ ID NO: 989095 - protein, 9 aa, Homo Sapiens
SCRVEPRTP

SEQ ID NO: 989096 - protein, 9 aa, Homo Sapiens
FSLLNAIAS

SEQ ID NO: 989097 - protein, 9 aa, Homo Sapiens
VNNYPISDM

SEQ ID NO: 989098 - protein, 9 aa, Homo Sapiens
KDSKNPVVY

SEQ ID NO: 989099 - protein, 9 aa, Homo Sapiens
IIMAAIGPM

SEQ ID NO: 989100 - protein, 9 aa, Homo Sapiens
GRNSRFGRP

SEQ ID NO: 989101 - protein, 9 aa, Homo Sapiens
PKVEKKWKG

SEQ ID NO: 989102 - protein, 9 aa, Homo Sapiens
NRLLALIKK

SEQ ID NO: 989103 - protein, 9 aa, Homo Sapiens
VVVELLLGA

SEQ ID NO: 989104 - protein, 9 aa, Homo Sapiens
RARVFGCRK

SEQ ID NO: 989105 - protein, 9 aa, Homo Sapiens
AKAFPSDYY

SEQ ID NO: 989106 - protein, 9 aa, Homo Sapiens
LLKMEQLEK

SEQ ID NO: 989107 - protein, 9 aa, Homo Sapiens
SRGVSSSIA

SEQ ID NO: 989108 - protein, 9 aa, Homo Sapiens
LRQLISERV

SEQ ID NO: 989109 - protein, 9 aa, Homo Sapiens
APSTEGGKT

SEQ ID NO: 989110 - protein, 9 aa, Homo Sapiens
IADLRQNVE

SEQ ID NO: 989111 - protein, 9 aa, Homo Sapiens
QYFEMCETR

SEQ ID NO: 989112 - protein, 9 aa, Homo Sapiens
FDKIPKQEK

SEQ ID NO: 989113 - protein, 9 aa, Homo Sapiens
LPQQPLPPP

SEQ ID NO: 989114 - protein, 9 aa, Homo Sapiens
RAVQDVYYL

SEQ ID NO: 989115 - protein, 9 aa, Homo Sapiens
SIPIDFFFL

SEQ ID NO: 989116 - protein, 9 aa, Homo Sapiens
VQEKANASA

SEQ ID NO: 989117 - protein, 9 aa, Homo Sapiens
IKENAICSG

SEQ ID NO: 989118 - protein, 9 aa, Homo Sapiens
GTSPPRTFA

SEQ ID NO: 989119 - protein, 9 aa, Homo Sapiens
VVIKYKDSS

SEQ ID NO: 989120 - protein, 9 aa, Homo Sapiens
GKYEFTDPR

SEQ ID NO: 989121 - protein, 9 aa, Homo Sapiens
FPGTPGSPG

SEQ ID NO: 989122 - protein, 9 aa, Homo Sapiens
ERGPQGITG

SEQ ID NO: 989123 - protein, 9 aa, Homo Sapiens
ADHVIVTVA

SEQ ID NO: 989124 - protein, 9 aa, Homo Sapiens
PTSSFSSED

SEQ ID NO: 989125 - protein, 9 aa, Homo Sapiens
TARDGGSPL

SEQ ID NO: 989126 - protein, 9 aa, Homo Sapiens
LLRGPHPST

SEQ ID NO: 989127 - protein, 9 aa, Homo Sapiens
SSRPVIAKA

SEQ ID NO: 989128 - protein, 9 aa, Homo Sapiens
EGEDEDEPD

SEQ ID NO: 989129 - protein, 9 aa, Homo Sapiens
SNSQAAAHY

SEQ ID NO: 989130 - protein, 9 aa, Homo Sapiens
TCYRLSCCV

SEQ ID NO: 989131 - protein, 9 aa, Homo Sapiens
TSQREFQQK

SEQ ID NO: 989132 - protein, 9 aa, Homo Sapiens
EYTLGRNHS

SEQ ID NO: 989133 - protein, 9 aa, Homo Sapiens
TRLHPVQEK

SEQ ID NO: 989134 - protein, 9 aa, Homo Sapiens
NSSLLERAS

SEQ ID NO: 989135 - protein, 9 aa, Homo Sapiens
CGQNSRRRK

SEQ ID NO: 989136 - protein, 9 aa, Homo Sapiens
NGEIFYSLF

SEQ ID NO: 989137 - protein, 9 aa, Homo Sapiens
ASQHQEELS

SEQ ID NO: 989138 - protein, 9 aa, Homo Sapiens
VTTEENRKN

SEQ ID NO: 989139 - protein, 9 aa, Homo Sapiens
NSYFFQNPS

SEQ ID NO: 989140 - protein, 9 aa, Homo Sapiens
QLKWKNDGK

SEQ ID NO: 989141 - protein, 9 aa, Homo Sapiens
PSAFGSGMG

SEQ ID NO: 989142 - protein, 9 aa, Homo Sapiens
MCETRKADE

SEQ ID NO: 989143 - protein, 9 aa, Homo Sapiens
LSETFNNNK

SEQ ID NO: 989144 - protein, 9 aa, Homo Sapiens
KSKLQTVYS

SEQ ID NO: 989145 - protein, 9 aa, Homo Sapiens
SSYDKDGLV

SEQ ID NO: 989146 - protein, 9 aa, Homo Sapiens
RYVYHSLKW

SEQ ID NO: 989147 - protein, 9 aa, Homo Sapiens
HVNTSQREF

SEQ ID NO: 989148 - protein, 9 aa, Homo Sapiens
EMNKRQLRA

SEQ ID NO: 989149 - protein, 9 aa, Homo Sapiens
YGYNFPTFP

SEQ ID NO: 989150 - protein, 9 aa, Homo Sapiens
AASIREPST

SEQ ID NO: 989151 - protein, 9 aa, Homo Sapiens
LFQIQLLMT

SEQ ID NO: 989152 - protein, 9 aa, Homo Sapiens
GISFTCRLE

SEQ ID NO: 989153 - protein, 9 aa, Homo Sapiens
NNSPEVAVT

SEQ ID NO: 989154 - protein, 9 aa, Homo Sapiens
EQFGRGSRT

SEQ ID NO: 989155 - protein, 9 aa, Homo Sapiens
GPITVNNYP

SEQ ID NO: 989156 - protein, 9 aa, Homo Sapiens
SLNSLSSPS

SEQ ID NO: 989157 - protein, 9 aa, Homo Sapiens
VEYINTLFS

SEQ ID NO: 989158 - protein, 9 aa, Homo Sapiens
LSGDDSTES

SEQ ID NO: 989159 - protein, 9 aa, Homo Sapiens
LPLNYPPSS

SEQ ID NO: 989160 - protein, 9 aa, Homo Sapiens
DLEPRGASA

SEQ ID NO: 989161 - protein, 9 aa, Homo Sapiens
VFEEISLLA

SEQ ID NO: 989162 - protein, 9 aa, Homo Sapiens
NCLFLLLWV

SEQ ID NO: 989163 - protein, 9 aa, Homo Sapiens
EAGVTSQFI

SEQ ID NO: 989164 - protein, 9 aa, Homo Sapiens
VRTMKIYVA

SEQ ID NO: 989165 - protein, 9 aa, Homo Sapiens
KIIWNYAPS

SEQ ID NO: 989166 - protein, 9 aa, Homo Sapiens
RQQARPFRG

SEQ ID NO: 989167 - protein, 9 aa, Homo Sapiens
LVQQSIHWL

SEQ ID NO: 989168 - protein, 9 aa, Homo Sapiens
FNSLSLPRA

SEQ ID NO: 989169 - protein, 9 aa, Homo Sapiens
ASCMSVQVP

SEQ ID NO: 989170 - protein, 9 aa, Homo Sapiens
QEYKSELDK

SEQ ID NO: 989171 - protein, 9 aa, Homo Sapiens
PISHQRRSI

SEQ ID NO: 989172 - protein, 9 aa, Homo Sapiens
IQLLMTDTH

SEQ ID NO: 989173 - protein, 9 aa, Homo Sapiens
QYSLPALSY

SEQ ID NO: 989174 - protein, 9 aa, Homo Sapiens
RDAQTEWDL

SEQ ID NO: 989175 - protein, 9 aa, Homo Sapiens
FLGPFPLFL

SEQ ID NO: 989176 - protein, 9 aa, Homo Sapiens
TFSSLGAMF

SEQ ID NO: 989177 - protein, 9 aa, Homo Sapiens
SENRCEGNF

SEQ ID NO: 989178 - protein, 9 aa, Homo Sapiens
SRAGKNQCE

SEQ ID NO: 989179 - protein, 9 aa, Homo Sapiens
ANLLTELQD

SEQ ID NO: 989180 - protein, 9 aa, Homo Sapiens
FSRVMPLSK

SEQ ID NO: 989181 - protein, 9 aa, Homo Sapiens
GHQTIPVSF

SEQ ID NO: 989182 - protein, 9 aa, Homo Sapiens
DEIFWAEYR

SEQ ID NO: 989183 - protein, 9 aa, Homo Sapiens
MLGQVVSLI

SEQ ID NO: 989184 - protein, 9 aa, Homo Sapiens
HCERGRENF

SEQ ID NO: 989185 - protein, 9 aa, Homo Sapiens
GYALKSFTG

SEQ ID NO: 989186 - protein, 9 aa, Homo Sapiens
GPKYLEAPP

SEQ ID NO: 989187 - protein, 9 aa, Homo Sapiens
ADLLIKAIK

SEQ ID NO: 989188 - protein, 9 aa, Homo Sapiens
SERKAKGAK

SEQ ID NO: 989189 - protein, 9 aa, Homo Sapiens
VNELEQINC

SEQ ID NO: 989190 - protein, 9 aa, Homo Sapiens
GLVNNAGIF

SEQ ID NO: 989191 - protein, 9 aa, Homo Sapiens
PWSISLGSM

SEQ ID NO: 989192 - protein, 9 aa, Homo Sapiens
VPLSRQVKK

SEQ ID NO: 989193 - protein, 9 aa, Homo Sapiens
QARTENFLK

SEQ ID NO: 989194 - protein, 9 aa, Homo Sapiens
TLQKNSNLL

SEQ ID NO: 989195 - protein, 9 aa, Homo Sapiens
NMNDRKLLY

SEQ ID NO: 989196 - protein, 9 aa, Homo Sapiens
EVVQSKIEQ

SEQ ID NO: 989197 - protein, 9 aa, Homo Sapiens
KKEHKSSMM

SEQ ID NO: 989198 - protein, 9 aa, Homo Sapiens
RNNRTCRFK

SEQ ID NO: 989199 - protein, 9 aa, Homo Sapiens
IFSSLELNI

SEQ ID NO: 989200 - protein, 9 aa, Homo Sapiens
EQNEERLSY

SEQ ID NO: 989201 - protein, 9 aa, Homo Sapiens
AGLYECVAK

SEQ ID NO: 989202 - protein, 9 aa, Homo Sapiens
GSYNPRDRI

SEQ ID NO: 989203 - protein, 9 aa, Homo Sapiens
EKFLTPLQW

SEQ ID NO: 989204 - protein, 9 aa, Homo Sapiens
ETKLSYTCE

SEQ ID NO: 989205 - protein, 9 aa, Homo Sapiens
NKELASKKK

SEQ ID NO: 989206 - protein, 9 aa, Homo Sapiens
IIEINRQSV

SEQ ID NO: 989207 - protein, 9 aa, Homo Sapiens
GTTKAIFTS

SEQ ID NO: 989208 - protein, 9 aa, Homo Sapiens
EGKKKVEAD

SEQ ID NO: 989209 - protein, 9 aa, Homo Sapiens
VPYVHKNPP

SEQ ID NO: 989210 - protein, 9 aa, Homo Sapiens
PELVHGTEV

SEQ ID NO: 989211 - protein, 9 aa, Homo Sapiens
TSIDNFNVD

SEQ ID NO: 989212 - protein, 9 aa, Homo Sapiens
ESEPPLSPP

SEQ ID NO: 989213 - protein, 9 aa, Homo Sapiens
RKPESFANV

SEQ ID NO: 989214 - protein, 9 aa, Homo Sapiens
QELSKFNLC

SEQ ID NO: 989215 - protein, 9 aa, Homo Sapiens
PSSSLLPAP

SEQ ID NO: 989216 - protein, 9 aa, Homo Sapiens
WLSRVEGDR

SEQ ID NO: 989217 - protein, 9 aa, Homo Sapiens
LNSYQYQYM

SEQ ID NO: 989218 - protein, 9 aa, Homo Sapiens
KRKRKKKRG

SEQ ID NO: 989219 - protein, 9 aa, Homo Sapiens
SPSCQPYLC

SEQ ID NO: 989220 - protein, 9 aa, Homo Sapiens
PCDFFGIGV

SEQ ID NO: 989221 - protein, 9 aa, Homo Sapiens
SIGRAGRLK

SEQ ID NO: 989222 - protein, 9 aa, Homo Sapiens
SIAPKPVTI

SEQ ID NO: 989223 - protein, 9 aa, Homo Sapiens
LLYQQSHLS

SEQ ID NO: 989224 - protein, 9 aa, Homo Sapiens
GKKWTKGKT

SEQ ID NO: 989225 - protein, 9 aa, Homo Sapiens
SSMDTRPAP

SEQ ID NO: 989226 - protein, 9 aa, Homo Sapiens
NGFRFDGVT

SEQ ID NO: 989227 - protein, 9 aa, Homo Sapiens
MKVVNKMCP

SEQ ID NO: 989228 - protein, 9 aa, Homo Sapiens
LLRILVVVE

SEQ ID NO: 989229 - protein, 9 aa, Homo Sapiens
YEFTDPRHP

SEQ ID NO: 989230 - protein, 9 aa, Homo Sapiens
AGTTKAIFT

SEQ ID NO: 989231 - protein, 9 aa, Homo Sapiens
DIELVETRP

SEQ ID NO: 989232 - protein, 9 aa, Homo Sapiens
GPHPSTSDL

SEQ ID NO: 989233 - protein, 9 aa, Homo Sapiens
RQIFQTQTS

SEQ ID NO: 989234 - protein, 9 aa, Homo Sapiens
GPQEINMKE

SEQ ID NO: 989235 - protein, 9 aa, Homo Sapiens
IKVKTGALI

SEQ ID NO: 989236 - protein, 9 aa, Homo Sapiens
VLVGPRPPR

SEQ ID NO: 989237 - protein, 9 aa, Homo Sapiens
LLEMEKQAA

SEQ ID NO: 989238 - protein, 9 aa, Homo Sapiens
QTLTRVKVQ

SEQ ID NO: 989239 - protein, 9 aa, Homo Sapiens
GEQAREVLE

SEQ ID NO: 989240 - protein, 9 aa, Homo Sapiens
MKRLEVDIN

SEQ ID NO: 989241 - protein, 9 aa, Homo Sapiens
RMQCQQQSV

SEQ ID NO: 989242 - protein, 9 aa, Homo Sapiens
CCRTTCYRL

SEQ ID NO: 989243 - protein, 9 aa, Homo Sapiens
YCWKRDGRC

SEQ ID NO: 989244 - protein, 9 aa, Homo Sapiens
QKRSIFSIH

SEQ ID NO: 989245 - protein, 9 aa, Homo Sapiens
MSEGIFAIR

SEQ ID NO: 989246 - protein, 9 aa, Homo Sapiens
GFALQVEMN

SEQ ID NO: 989247 - protein, 9 aa, Homo Sapiens
AIGATRSSV

SEQ ID NO: 989248 - protein, 9 aa, Homo Sapiens
KIRFLEQRI

SEQ ID NO: 989249 - protein, 9 aa, Homo Sapiens
DECASALCL

SEQ ID NO: 989250 - protein, 9 aa, Homo Sapiens
FRDYVESIT

SEQ ID NO: 989251 - protein, 9 aa, Homo Sapiens
FMALARSQC

SEQ ID NO: 989252 - protein, 9 aa, Homo Sapiens
CKQCGKVFS

SEQ ID NO: 989253 - protein, 9 aa, Homo Sapiens
FTPMAPKKS

SEQ ID NO: 989254 - protein, 9 aa, Homo Sapiens
TTWMEPTAQ

SEQ ID NO: 989255 - protein, 9 aa, Homo Sapiens
EKIYSYYVK

SEQ ID NO: 989256 - protein, 9 aa, Homo Sapiens
DAVPFRETP

SEQ ID NO: 989257 - protein, 9 aa, Homo Sapiens
NNQGKPRSR

SEQ ID NO: 989258 - protein, 9 aa, Homo Sapiens
HYSYTALYV

SEQ ID NO: 989259 - protein, 9 aa, Homo Sapiens
VHGTEVTYQ

SEQ ID NO: 989260 - protein, 9 aa, Homo Sapiens
SAIRSAIDE

SEQ ID NO: 989261 - protein, 9 aa, Homo Sapiens
DSEAKCFAV

SEQ ID NO: 989262 - protein, 9 aa, Homo Sapiens
KKALDAISY

SEQ ID NO: 989263 - protein, 9 aa, Homo Sapiens
PTAFPATDS

SEQ ID NO: 989264 - protein, 9 aa, Homo Sapiens
AKMRYYMPV

SEQ ID NO: 989265 - protein, 9 aa, Homo Sapiens
IKNSKILLL

SEQ ID NO: 989266 - protein, 9 aa, Homo Sapiens
LRAKEASDS

SEQ ID NO: 989267 - protein, 9 aa, Homo Sapiens
IATYRRLLV

SEQ ID NO: 989268 - protein, 9 aa, Homo Sapiens
RMKNYNIFN

SEQ ID NO: 989269 - protein, 9 aa, Homo Sapiens
LDVTNLLAD

SEQ ID NO: 989270 - protein, 9 aa, Homo Sapiens
EMKDMRVQT

SEQ ID NO: 989271 - protein, 9 aa, Homo Sapiens
GLLRILVVV

SEQ ID NO: 989272 - protein, 9 aa, Homo Sapiens
HIHQRLYIG

SEQ ID NO: 989273 - protein, 9 aa, Homo Sapiens
LFTGKILRA

SEQ ID NO: 989274 - protein, 9 aa, Homo Sapiens
GSPGPKGIS

SEQ ID NO: 989275 - protein, 9 aa, Homo Sapiens
PECRCNQRW

SEQ ID NO: 989276 - protein, 9 aa, Homo Sapiens
WTLIHIFIL

SEQ ID NO: 989277 - protein, 9 aa, Homo Sapiens
VRSLPGKDL

SEQ ID NO: 989278 - protein, 9 aa, Homo Sapiens
EELRQDTIE

SEQ ID NO: 989279 - protein, 9 aa, Homo Sapiens
LLFLADDPS

SEQ ID NO: 989280 - protein, 9 aa, Homo Sapiens
RMEAAITCN

SEQ ID NO: 989281 - protein, 9 aa, Homo Sapiens
IRQTRNSQP

SEQ ID NO: 989282 - protein, 9 aa, Homo Sapiens
RAPQPLELG

SEQ ID NO: 989283 - protein, 9 aa, Homo Sapiens
LSQNKQKGV

SEQ ID NO: 989284 - protein, 9 aa, Homo Sapiens
QPELVHGTE

SEQ ID NO: 989285 - protein, 9 aa, Homo Sapiens
RFLEAGLRL

SEQ ID NO: 989286 - protein, 9 aa, Homo Sapiens
RHPEKTSVY

SEQ ID NO: 989287 - protein, 9 aa, Homo Sapiens
LFFQDYMDP

SEQ ID NO: 989288 - protein, 9 aa, Homo Sapiens
TGKILRACI

SEQ ID NO: 989289 - protein, 9 aa, Homo Sapiens
PPRPSKVLG

SEQ ID NO: 989290 - protein, 9 aa, Homo Sapiens
KADNNNRDH

SEQ ID NO: 989291 - protein, 9 aa, Homo Sapiens
KSIPIDFFF

SEQ ID NO: 989292 - protein, 9 aa, Homo Sapiens
RMMMNFNGN

SEQ ID NO: 989293 - protein, 9 aa, Homo Sapiens
DFVVVDDVP

SEQ ID NO: 989294 - protein, 9 aa, Homo Sapiens
EETRELAPC

SEQ ID NO: 989295 - protein, 9 aa, Homo Sapiens
YNKFNHYDT

SEQ ID NO: 989296 - protein, 9 aa, Homo Sapiens
FDIVLYFSL

SEQ ID NO: 989297 - protein, 9 aa, Homo Sapiens
RTNNYEIVR

SEQ ID NO: 989298 - protein, 9 aa, Homo Sapiens
QNSGAHDGQ

SEQ ID NO: 989299 - protein, 9 aa, Homo Sapiens
KAMAQKEDM

SEQ ID NO: 989300 - protein, 9 aa, Homo Sapiens
RLLVGEDAH

SEQ ID NO: 989301 - protein, 9 aa, Homo Sapiens
SQNLFRALW

SEQ ID NO: 989302 - protein, 9 aa, Homo Sapiens
AALLNVFVW

SEQ ID NO: 989303 - protein, 9 aa, Homo Sapiens
VLPAWIVDQ

SEQ ID NO: 989304 - protein, 9 aa, Homo Sapiens
VLYYKLYRR

SEQ ID NO: 989305 - protein, 9 aa, Homo Sapiens
TLSDEIRED

SEQ ID NO: 989306 - protein, 9 aa, Homo Sapiens
PEVLPAEVE

SEQ ID NO: 989307 - protein, 9 aa, Homo Sapiens
LFAVEGLRH

SEQ ID NO: 989308 - protein, 9 aa, Homo Sapiens
YMAVMRPHF

SEQ ID NO: 989309 - protein, 9 aa, Homo Sapiens
ATISIVLLL

SEQ ID NO: 989310 - protein, 9 aa, Homo Sapiens
PRKDCNKHG

SEQ ID NO: 989311 - protein, 9 aa, Homo Sapiens
DSILNSPDN

SEQ ID NO: 989312 - protein, 9 aa, Homo Sapiens
SQFQALQNS

SEQ ID NO: 989313 - protein, 9 aa, Homo Sapiens
QRLAVILEA

SEQ ID NO: 989314 - protein, 9 aa, Homo Sapiens
LEWEKLEEW

SEQ ID NO: 989315 - protein, 9 aa, Homo Sapiens
HIKEGSKSN

SEQ ID NO: 989316 - protein, 9 aa, Homo Sapiens
VVANEKEYP

SEQ ID NO: 989317 - protein, 9 aa, Homo Sapiens
AGDGVCHEP

SEQ ID NO: 989318 - protein, 9 aa, Homo Sapiens
FTSSEKFLT

SEQ ID NO: 989319 - protein, 9 aa, Homo Sapiens
FPGQSIQEL

SEQ ID NO: 989320 - protein, 9 aa, Homo Sapiens
NTSQREFQQ

SEQ ID NO: 989321 - protein, 9 aa, Homo Sapiens
VKKGLASYE

SEQ ID NO: 989322 - protein, 9 aa, Homo Sapiens
SQTCGHGGQ

SEQ ID NO: 989323 - protein, 9 aa, Homo Sapiens
LSLEDFQNI

SEQ ID NO: 989324 - protein, 9 aa, Homo Sapiens
RGSPRDSDV

SEQ ID NO: 989325 - protein, 9 aa, Homo Sapiens
KIFLPPKKP

SEQ ID NO: 989326 - protein, 9 aa, Homo Sapiens
LCKEMVTLL

SEQ ID NO: 989327 - protein, 9 aa, Homo Sapiens
TSSSCALVQ

SEQ ID NO: 989328 - protein, 9 aa, Homo Sapiens
GHGTGILKI

SEQ ID NO: 989329 - protein, 9 aa, Homo Sapiens
IEKIYSYYV

SEQ ID NO: 989330 - protein, 9 aa, Homo Sapiens
ASFCLLGGA

SEQ ID NO: 989331 - protein, 9 aa, Homo Sapiens
PPEFLFEVQ

SEQ ID NO: 989332 - protein, 9 aa, Homo Sapiens
HSSISRQLS

SEQ ID NO: 989333 - protein, 9 aa, Homo Sapiens
PVLSPALGP

SEQ ID NO: 989334 - protein, 9 aa, Homo Sapiens
FLEELRQDT

SEQ ID NO: 989335 - protein, 9 aa, Homo Sapiens
EEFVTTFKG

SEQ ID NO: 989336 - protein, 9 aa, Homo Sapiens
ELQGIIFFF

SEQ ID NO: 989337 - protein, 9 aa, Homo Sapiens
QRSIFEYHR

SEQ ID NO: 989338 - protein, 9 aa, Homo Sapiens
LLHIHQRLY

SEQ ID NO: 989339 - protein, 9 aa, Homo Sapiens
PNRKRKLNI

SEQ ID NO: 989340 - protein, 9 aa, Homo Sapiens
SRFKALDKV

SEQ ID NO: 989341 - protein, 9 aa, Homo Sapiens
HASTHYFHG

SEQ ID NO: 989342 - protein, 9 aa, Homo Sapiens
NPPLERDHI

SEQ ID NO: 989343 - protein, 9 aa, Homo Sapiens
LVTEEQAPE

SEQ ID NO: 989344 - protein, 9 aa, Homo Sapiens
RFKWGLETR

SEQ ID NO: 989345 - protein, 9 aa, Homo Sapiens
LPCENQIIL

SEQ ID NO: 989346 - protein, 9 aa, Homo Sapiens
GSQIYNDAH

SEQ ID NO: 989347 - protein, 9 aa, Homo Sapiens
CNEDVIAAL

SEQ ID NO: 989348 - protein, 9 aa, Homo Sapiens
KFYDFKETV

SEQ ID NO: 989349 - protein, 9 aa, Homo Sapiens
STLGKRVVL

SEQ ID NO: 989350 - protein, 9 aa, Homo Sapiens
QRSQNSRMT

SEQ ID NO: 989351 - protein, 9 aa, Homo Sapiens
TSQLAPADL

SEQ ID NO: 989352 - protein, 9 aa, Homo Sapiens
LQGPPPQGG

SEQ ID NO: 989353 - protein, 9 aa, Homo Sapiens
LSRDETSVQ

SEQ ID NO: 989354 - protein, 9 aa, Homo Sapiens
QNPLRQKIV

SEQ ID NO: 989355 - protein, 9 aa, Homo Sapiens
KELCYGKKD

SEQ ID NO: 989356 - protein, 9 aa, Homo Sapiens
GSRNVISIV

SEQ ID NO: 989357 - protein, 9 aa, Homo Sapiens
IQLKWKNDG

SEQ ID NO: 989358 - protein, 9 aa, Homo Sapiens
EAKAFPSDY

SEQ ID NO: 989359 - protein, 9 aa, Homo Sapiens
SVLQVLLPV

SEQ ID NO: 989360 - protein, 9 aa, Homo Sapiens
SRVEGDRQW

SEQ ID NO: 989361 - protein, 9 aa, Homo Sapiens
VFGTFEAGV

SEQ ID NO: 989362 - protein, 9 aa, Homo Sapiens
VCFLAGEKR

SEQ ID NO: 989363 - protein, 9 aa, Homo Sapiens
DSMDRIEND

SEQ ID NO: 989364 - protein, 9 aa, Homo Sapiens
KQKATQKAI

SEQ ID NO: 989365 - protein, 9 aa, Homo Sapiens
LKPLCRKPG

SEQ ID NO: 989366 - protein, 9 aa, Homo Sapiens
RRLKLSQAQ

SEQ ID NO: 989367 - protein, 9 aa, Homo Sapiens
AKKRKDAME

SEQ ID NO: 989368 - protein, 9 aa, Homo Sapiens
EGQLEVSEE

SEQ ID NO: 989369 - protein, 9 aa, Homo Sapiens
FFNHSSSGT

SEQ ID NO: 989370 - protein, 9 aa, Homo Sapiens
RGFRGAQQK

SEQ ID NO: 989371 - protein, 9 aa, Homo Sapiens
VQTAPWLFG

SEQ ID NO: 989372 - protein, 9 aa, Homo Sapiens
KRSPTWTTL

SEQ ID NO: 989373 - protein, 9 aa, Homo Sapiens
FPTFPRLAA

SEQ ID NO: 989374 - protein, 9 aa, Homo Sapiens
KFNLCGKVF

SEQ ID NO: 989375 - protein, 9 aa, Homo Sapiens
LLALIKKPT

SEQ ID NO: 989376 - protein, 9 aa, Homo Sapiens
IQGNYGFFP

SEQ ID NO: 989377 - protein, 9 aa, Homo Sapiens
SEDDRNQSR

SEQ ID NO: 989378 - protein, 9 aa, Homo Sapiens
LQGLPGVPE

SEQ ID NO: 989379 - protein, 9 aa, Homo Sapiens
SLAVCEKSS

SEQ ID NO: 989380 - protein, 9 aa, Homo Sapiens
LEIGFSSSL

SEQ ID NO: 989381 - protein, 9 aa, Homo Sapiens
GKDLRARVS

SEQ ID NO: 989382 - protein, 9 aa, Homo Sapiens
FARQSDQIN

SEQ ID NO: 989383 - protein, 9 aa, Homo Sapiens
ISFGSLCEE

SEQ ID NO: 989384 - protein, 9 aa, Homo Sapiens
SITGRKNVY

SEQ ID NO: 989385 - protein, 9 aa, Homo Sapiens
EDPRSWTAA

SEQ ID NO: 989386 - protein, 9 aa, Homo Sapiens
YYTPRAQAL

SEQ ID NO: 989387 - protein, 9 aa, Homo Sapiens
LVNYFKFKP

SEQ ID NO: 989388 - protein, 9 aa, Homo Sapiens
GVQDCYQGD

SEQ ID NO: 989389 - protein, 9 aa, Homo Sapiens
KFERRNWVK

SEQ ID NO: 989390 - protein, 9 aa, Homo Sapiens
FIFFLREVI

SEQ ID NO: 989391 - protein, 9 aa, Homo Sapiens
RQDNPASAA

SEQ ID NO: 989392 - protein, 9 aa, Homo Sapiens
KNLGKLVHR

SEQ ID NO: 989393 - protein, 9 aa, Homo Sapiens
YVYHSLKWM

SEQ ID NO: 989394 - protein, 9 aa, Homo Sapiens
PEDKALLKK

SEQ ID NO: 989395 - protein, 9 aa, Homo Sapiens
CEECGKFFN

SEQ ID NO: 989396 - protein, 9 aa, Homo Sapiens
SVTYMDKNG

SEQ ID NO: 989397 - protein, 9 aa, Homo Sapiens
QGITGKPGP

SEQ ID NO: 989398 - protein, 9 aa, Homo Sapiens
SPYRSSSLL

SEQ ID NO: 989399 - protein, 9 aa, Homo Sapiens
PFLNDITQL

SEQ ID NO: 989400 - protein, 9 aa, Homo Sapiens
LLLDMGLGT

SEQ ID NO: 989401 - protein, 9 aa, Homo Sapiens
RNTQFLIQY

SEQ ID NO: 989402 - protein, 9 aa, Homo Sapiens
KTMSKEVVR

SEQ ID NO: 989403 - protein, 9 aa, Homo Sapiens
SYDELFQIQ

SEQ ID NO: 989404 - protein, 9 aa, Homo Sapiens
FALQVEMNH

SEQ ID NO: 989405 - protein, 9 aa, Homo Sapiens
QDIELVETR

SEQ ID NO: 989406 - protein, 9 aa, Homo Sapiens
VHSYSYDWR

SEQ ID NO: 989407 - protein, 9 aa, Homo Sapiens
SLLNAIASI

SEQ ID NO: 989408 - protein, 9 aa, Homo Sapiens
DRYVAICNR

SEQ ID NO: 989409 - protein, 9 aa, Homo Sapiens
IWFQNQRVK

SEQ ID NO: 989410 - protein, 9 aa, Homo Sapiens
EEVAGEQRV

SEQ ID NO: 989411 - protein, 9 aa, Homo Sapiens
SSCALVQTA

SEQ ID NO: 989412 - protein, 9 aa, Homo Sapiens
LLDGCYSTP

SEQ ID NO: 989413 - protein, 9 aa, Homo Sapiens
NKRQLRAGN

SEQ ID NO: 989414 - protein, 9 aa, Homo Sapiens
MYTNQAEHA

SEQ ID NO: 989415 - protein, 9 aa, Homo Sapiens
SAALVITST

SEQ ID NO: 989416 - protein, 9 aa, Homo Sapiens
HYFHGLVKA

SEQ ID NO: 989417 - protein, 9 aa, Homo Sapiens
SQLDRSEVL

SEQ ID NO: 989418 - protein, 9 aa, Homo Sapiens
KRLRTRECN

SEQ ID NO: 989419 - protein, 9 aa, Homo Sapiens
PRKIAWKKK

SEQ ID NO: 989420 - protein, 9 aa, Homo Sapiens
ERQKNFTPM

SEQ ID NO: 989421 - protein, 9 aa, Homo Sapiens
AEVKSKKQE

SEQ ID NO: 989422 - protein, 9 aa, Homo Sapiens
VKRLREMSS

SEQ ID NO: 989423 - protein, 9 aa, Homo Sapiens
LIGWDENQA

SEQ ID NO: 989424 - protein, 9 aa, Homo Sapiens
LDKRAVQEI

SEQ ID NO: 989425 - protein, 9 aa, Homo Sapiens
KINKRIEHT

SEQ ID NO: 989426 - protein, 9 aa, Homo Sapiens
PHPSTSDLH

SEQ ID NO: 989427 - protein, 9 aa, Homo Sapiens
TEKEKKIYR

SEQ ID NO: 989428 - protein, 9 aa, Homo Sapiens
MDHGAIKVK

SEQ ID NO: 989429 - protein, 9 aa, Homo Sapiens
IISPEVSAF

SEQ ID NO: 989430 - protein, 9 aa, Homo Sapiens
KLPDLKKND

SEQ ID NO: 989431 - protein, 9 aa, Homo Sapiens
CRDTPISHQ

SEQ ID NO: 989432 - protein, 9 aa, Homo Sapiens
CRPGTMGLQ

SEQ ID NO: 989433 - protein, 9 aa, Homo Sapiens
HIFYPPLHE

SEQ ID NO: 989434 - protein, 9 aa, Homo Sapiens
EQINCIPDQ

SEQ ID NO: 989435 - protein, 9 aa, Homo Sapiens
VAKNSRGKN

SEQ ID NO: 989436 - protein, 9 aa, Homo Sapiens
VQDCYQGDG

SEQ ID NO: 989437 - protein, 9 aa, Homo Sapiens
VTLQKNSNL

SEQ ID NO: 989438 - protein, 9 aa, Homo Sapiens
KDAMENTRQ

SEQ ID NO: 989439 - protein, 9 aa, Homo Sapiens
GKKGRKRKR

SEQ ID NO: 989440 - protein, 9 aa, Homo Sapiens
YLHFGNLAP

SEQ ID NO: 989441 - protein, 9 aa, Homo Sapiens
LTINRYLAI

SEQ ID NO: 989442 - protein, 9 aa, Homo Sapiens
ITLRSRAVH

SEQ ID NO: 989443 - protein, 9 aa, Homo Sapiens
DGVCHEPGL

SEQ ID NO: 989444 - protein, 9 aa, Homo Sapiens
HKKVQANAS

SEQ ID NO: 989445 - protein, 9 aa, Homo Sapiens
EDFQNIILR

SEQ ID NO: 989446 - protein, 9 aa, Homo Sapiens
KLNTPSFLA

SEQ ID NO: 989447 - protein, 9 aa, Homo Sapiens
GERGPQGIT

SEQ ID NO: 989448 - protein, 9 aa, Homo Sapiens
EDDRNQSRE

SEQ ID NO: 989449 - protein, 9 aa, Homo Sapiens
DRIATPLFV

SEQ ID NO: 989450 - protein, 9 aa, Homo Sapiens
FKLEQEEYN

SEQ ID NO: 989451 - protein, 9 aa, Homo Sapiens
VDPELAVSG

SEQ ID NO: 989452 - protein, 9 aa, Homo Sapiens
RILMDLQNQ

SEQ ID NO: 989453 - protein, 9 aa, Homo Sapiens
FQNIILRAP

SEQ ID NO: 989454 - protein, 9 aa, Homo Sapiens
QLGNHRNNV

SEQ ID NO: 989455 - protein, 9 aa, Homo Sapiens
KIINAVPFI

SEQ ID NO: 989456 - protein, 9 aa, Homo Sapiens
NSLSLPRAV

SEQ ID NO: 989457 - protein, 9 aa, Homo Sapiens
DWQALNYKI

SEQ ID NO: 989458 - protein, 9 aa, Homo Sapiens
AAHAITKLY

SEQ ID NO: 989459 - protein, 9 aa, Homo Sapiens
GETESVSQS

SEQ ID NO: 989460 - protein, 9 aa, Homo Sapiens
RIENDRLQG

SEQ ID NO: 989461 - protein, 9 aa, Homo Sapiens
GEDPVLGEI

SEQ ID NO: 989462 - protein, 9 aa, Homo Sapiens
LKELCYGKK

SEQ ID NO: 989463 - protein, 9 aa, Homo Sapiens
ADFLRELSQ

SEQ ID NO: 989464 - protein, 9 aa, Homo Sapiens
HILFNIKEY

SEQ ID NO: 989465 - protein, 9 aa, Homo Sapiens
DKNPCEGMS

SEQ ID NO: 989466 - protein, 9 aa, Homo Sapiens
NRGEKIQLK

SEQ ID NO: 989467 - protein, 9 aa, Homo Sapiens
DVDTHQDKL

SEQ ID NO: 989468 - protein, 9 aa, Homo Sapiens
LKWKNDGKL

SEQ ID NO: 989469 - protein, 9 aa, Homo Sapiens
INSDSEAKC

SEQ ID NO: 989470 - protein, 9 aa, Homo Sapiens
RGNNQGKPR

SEQ ID NO: 989471 - protein, 9 aa, Homo Sapiens
AQQYLMDYL

SEQ ID NO: 989472 - protein, 9 aa, Homo Sapiens
FYDFKETVN

SEQ ID NO: 989473 - protein, 9 aa, Homo Sapiens
SPKVPSISY

SEQ ID NO: 989474 - protein, 9 aa, Homo Sapiens
EFLFEVQCM

SEQ ID NO: 989475 - protein, 9 aa, Homo Sapiens
LGVCREFVH

SEQ ID NO: 989476 - protein, 9 aa, Homo Sapiens
ALHLVNTKV

SEQ ID NO: 989477 - protein, 9 aa, Homo Sapiens
RQVKKVAAQ

SEQ ID NO: 989478 - protein, 9 aa, Homo Sapiens
SSRSPSSRS

SEQ ID NO: 989479 - protein, 9 aa, Homo Sapiens
REGPPGFLG

SEQ ID NO: 989480 - protein, 9 aa, Homo Sapiens
LMDDFEWHR

SEQ ID NO: 989481 - protein, 9 aa, Homo Sapiens
ISCCLTLNF

SEQ ID NO: 989482 - protein, 9 aa, Homo Sapiens
KPSRLLPFE

SEQ ID NO: 989483 - protein, 9 aa, Homo Sapiens
QRYQLSAAK

SEQ ID NO: 989484 - protein, 9 aa, Homo Sapiens
LLQKLFRAK

SEQ ID NO: 989485 - protein, 9 aa, Homo Sapiens
GAKITEFQN

SEQ ID NO: 989486 - protein, 9 aa, Homo Sapiens
KKGDIPEGY

SEQ ID NO: 989487 - protein, 9 aa, Homo Sapiens
PLERDHINV

SEQ ID NO: 989488 - protein, 9 aa, Homo Sapiens
EYFLRLTPV

SEQ ID NO: 989489 - protein, 9 aa, Homo Sapiens
PEVLQDLLD

SEQ ID NO: 989490 - protein, 9 aa, Homo Sapiens
RSIFSIHPS

SEQ ID NO: 989491 - protein, 9 aa, Homo Sapiens
GRKALKLEA

SEQ ID NO: 989492 - protein, 9 aa, Homo Sapiens
PSRLSYCGG

SEQ ID NO: 989493 - protein, 9 aa, Homo Sapiens
EDQTQDIEL

SEQ ID NO: 989494 - protein, 9 aa, Homo Sapiens
QCKKIHHNL

SEQ ID NO: 989495 - protein, 9 aa, Homo Sapiens
IVTNSASVE

SEQ ID NO: 989496 - protein, 9 aa, Homo Sapiens
KNPEFDLHF

SEQ ID NO: 989497 - protein, 9 aa, Homo Sapiens
FVVVDDVPV

SEQ ID NO: 989498 - protein, 9 aa, Homo Sapiens
NNWLSRVEG

SEQ ID NO: 989499 - protein, 9 aa, Homo Sapiens
LPDHAVPTA

SEQ ID NO: 989500 - protein, 9 aa, Homo Sapiens
SSLLPAPGS

SEQ ID NO: 989501 - protein, 9 aa, Homo Sapiens
EEDGLCHGH

SEQ ID NO: 989502 - protein, 9 aa, Homo Sapiens
IISSAIRSA

SEQ ID NO: 989503 - protein, 9 aa, Homo Sapiens
SKTERIYNV

SEQ ID NO: 989504 - protein, 9 aa, Homo Sapiens
KTFCILYAI

SEQ ID NO: 989505 - protein, 9 aa, Homo Sapiens
NINAVISLQ

SEQ ID NO: 989506 - protein, 9 aa, Homo Sapiens
DVKMKKKGD

SEQ ID NO: 989507 - protein, 9 aa, Homo Sapiens
TDEGEDEDE

SEQ ID NO: 989508 - protein, 9 aa, Homo Sapiens
KIDRLLQST

SEQ ID NO: 989509 - protein, 9 aa, Homo Sapiens
MSKEVVRHE

SEQ ID NO: 989510 - protein, 9 aa, Homo Sapiens
AGAVICWLR

SEQ ID NO: 989511 - protein, 9 aa, Homo Sapiens
TTHTFLDHC

SEQ ID NO: 989512 - protein, 9 aa, Homo Sapiens
EQSLYRQQS

SEQ ID NO: 989513 - protein, 9 aa, Homo Sapiens
YCDVSQVLR

SEQ ID NO: 989514 - protein, 9 aa, Homo Sapiens
STLKFEVYS

SEQ ID NO: 989515 - protein, 9 aa, Homo Sapiens
FWILGSMDA

SEQ ID NO: 989516 - protein, 9 aa, Homo Sapiens
FFSAQPLRE

SEQ ID NO: 989517 - protein, 9 aa, Homo Sapiens
AIKKNPEFD

SEQ ID NO: 989518 - protein, 9 aa, Homo Sapiens
LFKKIFSSL

SEQ ID NO: 989519 - protein, 9 aa, Homo Sapiens
SNLSRLGLI

SEQ ID NO: 989520 - protein, 9 aa, Homo Sapiens
SCIKNSKIL

SEQ ID NO: 989521 - protein, 9 aa, Homo Sapiens
LNKYCVAYG

SEQ ID NO: 989522 - protein, 9 aa, Homo Sapiens
KVRNALMKL

SEQ ID NO: 989523 - protein, 9 aa, Homo Sapiens
VLFMQVASA

SEQ ID NO: 989524 - protein, 9 aa, Homo Sapiens
YEELARAYK

SEQ ID NO: 989525 - protein, 9 aa, Homo Sapiens
LGLALVIKN

SEQ ID NO: 989526 - protein, 9 aa, Homo Sapiens
NGSRSVQTT

SEQ ID NO: 989527 - protein, 9 aa, Homo Sapiens
RRVPEYYGS

SEQ ID NO: 989528 - protein, 9 aa, Homo Sapiens
TKCFMASFF

SEQ ID NO: 989529 - protein, 9 aa, Homo Sapiens
GQRYQLSAA

SEQ ID NO: 989530 - protein, 9 aa, Homo Sapiens
QLFAVEGLR

SEQ ID NO: 989531 - protein, 9 aa, Homo Sapiens
NFTPMAPKK

SEQ ID NO: 989532 - protein, 9 aa, Homo Sapiens
SNIKENAIC

SEQ ID NO: 989533 - protein, 9 aa, Homo Sapiens
RGAARLRAL

SEQ ID NO: 989534 - protein, 9 aa, Homo Sapiens
EEAYGEDEN

SEQ ID NO: 989535 - protein, 9 aa, Homo Sapiens
TRSSVSSVV

SEQ ID NO: 989536 - protein, 9 aa, Homo Sapiens
VFIFSDGGN

SEQ ID NO: 989537 - protein, 9 aa, Homo Sapiens
ILTRQKVYF

SEQ ID NO: 989538 - protein, 9 aa, Homo Sapiens
AFDAKARER

SEQ ID NO: 989539 - protein, 9 aa, Homo Sapiens
GYNFPTFPR

SEQ ID NO: 989540 - protein, 9 aa, Homo Sapiens
LEPILFYCI

SEQ ID NO: 989541 - protein, 9 aa, Homo Sapiens
AGDIVLYKL

SEQ ID NO: 989542 - protein, 9 aa, Homo Sapiens
ESENEDEEE

SEQ ID NO: 989543 - protein, 9 aa, Homo Sapiens
RSSVSSVVR

SEQ ID NO: 989544 - protein, 9 aa, Homo Sapiens
KEKIFLPPK

SEQ ID NO: 989545 - protein, 9 aa, Homo Sapiens
EPKEQPTFE

SEQ ID NO: 989546 - protein, 9 aa, Homo Sapiens
PSRLLPFEP

SEQ ID NO: 989547 - protein, 9 aa, Homo Sapiens
MMNFNGNNR

SEQ ID NO: 989548 - protein, 9 aa, Homo Sapiens
KQRQNGSAA

SEQ ID NO: 989549 - protein, 9 aa, Homo Sapiens
LQKSLQQRA

SEQ ID NO: 989550 - protein, 9 aa, Homo Sapiens
FLRLTPVGV

SEQ ID NO: 989551 - protein, 9 aa, Homo Sapiens
KDLRARVSY

SEQ ID NO: 989552 - protein, 9 aa, Homo Sapiens
MLLWHFFTD

SEQ ID NO: 989553 - protein, 9 aa, Homo Sapiens
DSPEDNMND

SEQ ID NO: 989554 - protein, 9 aa, Homo Sapiens
HELELMRKE

SEQ ID NO: 989555 - protein, 9 aa, Homo Sapiens
STSIDNFNV

SEQ ID NO: 989556 - protein, 9 aa, Homo Sapiens
EFKEDRSSY

SEQ ID NO: 989557 - protein, 9 aa, Homo Sapiens
IETHARDVL

SEQ ID NO: 989558 - protein, 9 aa, Homo Sapiens
AAFSSDSDA

SEQ ID NO: 989559 - protein, 9 aa, Homo Sapiens
AITKLYSLD

SEQ ID NO: 989560 - protein, 9 aa, Homo Sapiens
GSLIIDMVS

SEQ ID NO: 989561 - protein, 9 aa, Homo Sapiens
KERWINSME

SEQ ID NO: 989562 - protein, 9 aa, Homo Sapiens
NSYQYQYMN

SEQ ID NO: 989563 - protein, 9 aa, Homo Sapiens
KGFDVLNAL

SEQ ID NO: 989564 - protein, 9 aa, Homo Sapiens
RGRARVFGC

SEQ ID NO: 989565 - protein, 9 aa, Homo Sapiens
AAGASQLFC

SEQ ID NO: 989566 - protein, 9 aa, Homo Sapiens
LQDSFPAQF

SEQ ID NO: 989567 - protein, 9 aa, Homo Sapiens
PYLCCLLLL

SEQ ID NO: 989568 - protein, 9 aa, Homo Sapiens
CRVGKRIIE

SEQ ID NO: 989569 - protein, 9 aa, Homo Sapiens
VSTTSSERT

SEQ ID NO: 989570 - protein, 9 aa, Homo Sapiens
HRIFVRALR

SEQ ID NO: 989571 - protein, 9 aa, Homo Sapiens
NPTQQTLYF

SEQ ID NO: 989572 - protein, 9 aa, Homo Sapiens
HVNFKLHTP

SEQ ID NO: 989573 - protein, 9 aa, Homo Sapiens
PHGSVTLQK

SEQ ID NO: 989574 - protein, 9 aa, Homo Sapiens
QFSCQNPLP

SEQ ID NO: 989575 - protein, 9 aa, Homo Sapiens
ICLERVIPI

SEQ ID NO: 989576 - protein, 9 aa, Homo Sapiens
GATRSSVSS

SEQ ID NO: 989577 - protein, 9 aa, Homo Sapiens
ADLGLPEDN

SEQ ID NO: 989578 - protein, 9 aa, Homo Sapiens
FHYSYTALY

SEQ ID NO: 989579 - protein, 9 aa, Homo Sapiens
FFGVQQLPL

SEQ ID NO: 989580 - protein, 9 aa, Homo Sapiens
AHVSYICRY

SEQ ID NO: 989581 - protein, 9 aa, Homo Sapiens
IHRIFVRAL

SEQ ID NO: 989582 - protein, 9 aa, Homo Sapiens
YQLQESLPR

SEQ ID NO: 989583 - protein, 9 aa, Homo Sapiens
YSVSLTKTE

SEQ ID NO: 989584 - protein, 9 aa, Homo Sapiens
WSLRQLISE

SEQ ID NO: 989585 - protein, 9 aa, Homo Sapiens
TRESENEDE

SEQ ID NO: 989586 - protein, 9 aa, Homo Sapiens
RGLQFFLKY

SEQ ID NO: 989587 - protein, 9 aa, Homo Sapiens
PNGKVLYYK

SEQ ID NO: 989588 - protein, 9 aa, Homo Sapiens
MSDGDEERL

SEQ ID NO: 989589 - protein, 9 aa, Homo Sapiens
PFCNRMKKP

SEQ ID NO: 989590 - protein, 9 aa, Homo Sapiens
ALVYAQFST

SEQ ID NO: 989591 - protein, 9 aa, Homo Sapiens
VALLGLALV

SEQ ID NO: 989592 - protein, 9 aa, Homo Sapiens
EVSEEQMGQ

SEQ ID NO: 989593 - protein, 9 aa, Homo Sapiens
NPLFERKNN

SEQ ID NO: 989594 - protein, 9 aa, Homo Sapiens
KNRTTSEAQ

SEQ ID NO: 989595 - protein, 9 aa, Homo Sapiens
ANCPSSHSS

SEQ ID NO: 989596 - protein, 9 aa, Homo Sapiens
QRGSLIIDM

SEQ ID NO: 989597 - protein, 9 aa, Homo Sapiens
HWSFPYKQK

SEQ ID NO: 989598 - protein, 9 aa, Homo Sapiens
PYKQKIFEL

SEQ ID NO: 989599 - protein, 9 aa, Homo Sapiens
EISLIHFNT

SEQ ID NO: 989600 - protein, 9 aa, Homo Sapiens
LNTSGTSPP

SEQ ID NO: 989601 - protein, 9 aa, Homo Sapiens
AARLRALRP

SEQ ID NO: 989602 - protein, 9 aa, Homo Sapiens
SSEKFLTPL

SEQ ID NO: 989603 - protein, 9 aa, Homo Sapiens
GILKITPLN

SEQ ID NO: 989604 - protein, 9 aa, Homo Sapiens
KVEKKWKGL

SEQ ID NO: 989605 - protein, 9 aa, Homo Sapiens
VVSLILLLL

SEQ ID NO: 989606 - protein, 9 aa, Homo Sapiens
ICQLRFNSN

SEQ ID NO: 989607 - protein, 9 aa, Homo Sapiens
EEAKEDGRE

SEQ ID NO: 989608 - protein, 9 aa, Homo Sapiens
ECASALCLH

SEQ ID NO: 989609 - protein, 9 aa, Homo Sapiens
NNIQLKWKN

SEQ ID NO: 989610 - protein, 9 aa, Homo Sapiens
NQPPSNLLY

SEQ ID NO: 989611 - protein, 9 aa, Homo Sapiens
AKMKGFDVL

SEQ ID NO: 989612 - protein, 9 aa, Homo Sapiens
LTPRKDCNK

SEQ ID NO: 989613 - protein, 9 aa, Homo Sapiens
NRCEGNFLK

SEQ ID NO: 989614 - protein, 9 aa, Homo Sapiens
SVVEKKILA

SEQ ID NO: 989615 - protein, 9 aa, Homo Sapiens
EKKEKYAEM

SEQ ID NO: 989616 - protein, 9 aa, Homo Sapiens
RRMEAAITC

SEQ ID NO: 989617 - protein, 9 aa, Homo Sapiens
LGKLVHRFQ

SEQ ID NO: 989618 - protein, 9 aa, Homo Sapiens
RQCHLRFEK

SEQ ID NO: 989619 - protein, 9 aa, Homo Sapiens
SKQAKISMG

SEQ ID NO: 989620 - protein, 9 aa, Homo Sapiens
LFLALDVPR

SEQ ID NO: 989621 - protein, 9 aa, Homo Sapiens
ISFGNVDCD

SEQ ID NO: 989622 - protein, 9 aa, Homo Sapiens
TDLKKEHKS

SEQ ID NO: 989623 - protein, 9 aa, Homo Sapiens
YDNYNELVA

SEQ ID NO: 989624 - protein, 9 aa, Homo Sapiens
FLSRHEKEI

SEQ ID NO: 989625 - protein, 9 aa, Homo Sapiens
PSSRSRNKK

SEQ ID NO: 989626 - protein, 9 aa, Homo Sapiens
SDDARLFTG

SEQ ID NO: 989627 - protein, 9 aa, Homo Sapiens
KHFPIEMKN

SEQ ID NO: 989628 - protein, 9 aa, Homo Sapiens
RGYDLVTEE

SEQ ID NO: 989629 - protein, 9 aa, Homo Sapiens
LQVEYRINK

SEQ ID NO: 989630 - protein, 9 aa, Homo Sapiens
HQVPCSYSA

SEQ ID NO: 989631 - protein, 9 aa, Homo Sapiens
LQESLPRLT

SEQ ID NO: 989632 - protein, 9 aa, Homo Sapiens
AYTTFKKQQ

SEQ ID NO: 989633 - protein, 9 aa, Homo Sapiens
SFRVHILFN

SEQ ID NO: 989634 - protein, 9 aa, Homo Sapiens
QEINMKEPL

SEQ ID NO: 989635 - protein, 9 aa, Homo Sapiens
AQDLQGQGR

SEQ ID NO: 989636 - protein, 9 aa, Homo Sapiens
YLCCLLLLP

SEQ ID NO: 989637 - protein, 9 aa, Homo Sapiens
YSLRSTTIM

SEQ ID NO: 989638 - protein, 9 aa, Homo Sapiens
NENDEQNSD

SEQ ID NO: 989639 - protein, 9 aa, Homo Sapiens
LGILPPGMV

SEQ ID NO: 989640 - protein, 9 aa, Homo Sapiens
IRSAIDEDS

SEQ ID NO: 989641 - protein, 9 aa, Homo Sapiens
APALEELVP

SEQ ID NO: 989642 - protein, 9 aa, Homo Sapiens
CVQYFEMCE

SEQ ID NO: 989643 - protein, 9 aa, Homo Sapiens
FFLGLAPPP

SEQ ID NO: 989644 - protein, 9 aa, Homo Sapiens
RSPSSRSRN

SEQ ID NO: 989645 - protein, 9 aa, Homo Sapiens
RAYKHAKME

SEQ ID NO: 989646 - protein, 9 aa, Homo Sapiens
GNFFVNYSD

SEQ ID NO: 989647 - protein, 9 aa, Homo Sapiens
TGILKITPL

SEQ ID NO: 989648 - protein, 9 aa, Homo Sapiens
GANSLTLLF

SEQ ID NO: 989649 - protein, 9 aa, Homo Sapiens
YNSSVSFED

SEQ ID NO: 989650 - protein, 9 aa, Homo Sapiens
LSLGLKAKM

SEQ ID NO: 989651 - protein, 9 aa, Homo Sapiens
DGGSPLLWA

SEQ ID NO: 989652 - protein, 9 aa, Homo Sapiens
TFKKQQKKL

SEQ ID NO: 989653 - protein, 9 aa, Homo Sapiens
FIFSDGGNT

SEQ ID NO: 989654 - protein, 9 aa, Homo Sapiens
FKFKPVETP

SEQ ID NO: 989655 - protein, 9 aa, Homo Sapiens
ENYRLRLIS

SEQ ID NO: 989656 - protein, 9 aa, Homo Sapiens
VTVSFMALA

SEQ ID NO: 989657 - protein, 9 aa, Homo Sapiens
KLSQAQVYF

SEQ ID NO: 989658 - protein, 9 aa, Homo Sapiens
FAVQEKQFH

SEQ ID NO: 989659 - protein, 9 aa, Homo Sapiens
EISPLEVLK

SEQ ID NO: 989660 - protein, 9 aa, Homo Sapiens
LNIDSKERL

SEQ ID NO: 989661 - protein, 9 aa, Homo Sapiens
ELPGTETAS

SEQ ID NO: 989662 - protein, 9 aa, Homo Sapiens
GFCYDGLQG

SEQ ID NO: 989663 - protein, 9 aa, Homo Sapiens
RFEACCYPN

SEQ ID NO: 989664 - protein, 9 aa, Homo Sapiens
ELRIKTKGQ

SEQ ID NO: 989665 - protein, 9 aa, Homo Sapiens
LPQVFIFFL

SEQ ID NO: 989666 - protein, 9 aa, Homo Sapiens
SKREWEKRS

SEQ ID NO: 989667 - protein, 9 aa, Homo Sapiens
SAPPNVSKE

SEQ ID NO: 989668 - protein, 9 aa, Homo Sapiens
VQPTHCGQN

SEQ ID NO: 989669 - protein, 9 aa, Homo Sapiens
SGPRGIIIN

SEQ ID NO: 989670 - protein, 9 aa, Homo Sapiens
QEGGSCPRL

SEQ ID NO: 989671 - protein, 9 aa, Homo Sapiens
LVNSSIGRL

SEQ ID NO: 989672 - protein, 9 aa, Homo Sapiens
DETSVQPWD

SEQ ID NO: 989673 - protein, 9 aa, Homo Sapiens
QHQEELSPP

SEQ ID NO: 989674 - protein, 9 aa, Homo Sapiens
KDYPWEVTF

SEQ ID NO: 989675 - protein, 9 aa, Homo Sapiens
GRIQIVTNS

SEQ ID NO: 989676 - protein, 9 aa, Homo Sapiens
IHQRLYIGE

SEQ ID NO: 989677 - protein, 9 aa, Homo Sapiens
RIHCLQCNS

SEQ ID NO: 989678 - protein, 9 aa, Homo Sapiens
VVDDVPVML

SEQ ID NO: 989679 - protein, 9 aa, Homo Sapiens
LSQAQVYFE

SEQ ID NO: 989680 - protein, 9 aa, Homo Sapiens
KRAQKAMSK

SEQ ID NO: 989681 - protein, 9 aa, Homo Sapiens
FENGTQTLT

SEQ ID NO: 989682 - protein, 9 aa, Homo Sapiens
RVEGDRQWC

SEQ ID NO: 989683 - protein, 9 aa, Homo Sapiens
FPCGEPCLQ

SEQ ID NO: 989684 - protein, 9 aa, Homo Sapiens
PSFYAPSHP

SEQ ID NO: 989685 - protein, 9 aa, Homo Sapiens
NIKIRSCRG

SEQ ID NO: 989686 - protein, 9 aa, Homo Sapiens
KIQERWGTV

SEQ ID NO: 989687 - protein, 9 aa, Homo Sapiens
IFLPTAPNE

SEQ ID NO: 989688 - protein, 9 aa, Homo Sapiens
QAYYTPRAQ

SEQ ID NO: 989689 - protein, 9 aa, Homo Sapiens
GAARLRALR

SEQ ID NO: 989690 - protein, 9 aa, Homo Sapiens
DLQGQGRVR

SEQ ID NO: 989691 - protein, 9 aa, Homo Sapiens
SQDPLQPTK

SEQ ID NO: 989692 - protein, 9 aa, Homo Sapiens
AFPTPKSGS

SEQ ID NO: 989693 - protein, 9 aa, Homo Sapiens
IKKKPLRKD

SEQ ID NO: 989694 - protein, 9 aa, Homo Sapiens
KKIVDVVIK

SEQ ID NO: 989695 - protein, 9 aa, Homo Sapiens
SFCLLGGAL

SEQ ID NO: 989696 - protein, 9 aa, Homo Sapiens
NSSVSFEDR

SEQ ID NO: 989697 - protein, 9 aa, Homo Sapiens
EKFDPNATQ

SEQ ID NO: 989698 - protein, 9 aa, Homo Sapiens
ITDKGEVSD

SEQ ID NO: 989699 - protein, 9 aa, Homo Sapiens
EEEKEEGEE

SEQ ID NO: 989700 - protein, 9 aa, Homo Sapiens
FVTTFKGNE

SEQ ID NO: 989701 - protein, 9 aa, Homo Sapiens
ATTTWMEPT

SEQ ID NO: 989702 - protein, 9 aa, Homo Sapiens
KSIEIYTYG

SEQ ID NO: 989703 - protein, 9 aa, Homo Sapiens
QIVTNSASV

SEQ ID NO: 989704 - protein, 9 aa, Homo Sapiens
GFCKHAHSK

SEQ ID NO: 989705 - protein, 9 aa, Homo Sapiens
AVAVKTLQE

SEQ ID NO: 989706 - protein, 9 aa, Homo Sapiens
LLRKSPWEG

SEQ ID NO: 989707 - protein, 9 aa, Homo Sapiens
MEAASIREP

SEQ ID NO: 989708 - protein, 9 aa, Homo Sapiens
NYNELVAKS

SEQ ID NO: 989709 - protein, 9 aa, Homo Sapiens
CPLSSRNMV

SEQ ID NO: 989710 - protein, 9 aa, Homo Sapiens
DLIQRRTKI

SEQ ID NO: 989711 - protein, 9 aa, Homo Sapiens
RQRDINASD

SEQ ID NO: 989712 - protein, 9 aa, Homo Sapiens
FIYTLRNTD

SEQ ID NO: 989713 - protein, 9 aa, Homo Sapiens
DHSEYPFHD

SEQ ID NO: 989714 - protein, 9 aa, Homo Sapiens
DEARCGDEG

SEQ ID NO: 989715 - protein, 9 aa, Homo Sapiens
YFPPLYQPL

SEQ ID NO: 989716 - protein, 9 aa, Homo Sapiens
AESVNNNVT

SEQ ID NO: 989717 - protein, 9 aa, Homo Sapiens
QTSKQAKIS

SEQ ID NO: 989718 - protein, 9 aa, Homo Sapiens
PVLCLSCAD

SEQ ID NO: 989719 - protein, 9 aa, Homo Sapiens
AVCEKSSAR

SEQ ID NO: 989720 - protein, 9 aa, Homo Sapiens
EKRGRCFTI

SEQ ID NO: 989721 - protein, 9 aa, Homo Sapiens
KYLEAPPSV

SEQ ID NO: 989722 - protein, 9 aa, Homo Sapiens
LKQPTTLVL

SEQ ID NO: 989723 - protein, 9 aa, Homo Sapiens
GAHDGQPPS

SEQ ID NO: 989724 - protein, 9 aa, Homo Sapiens
APGGTCWCP

SEQ ID NO: 989725 - protein, 9 aa, Homo Sapiens
GWAAASFCL

SEQ ID NO: 989726 - protein, 9 aa, Homo Sapiens
GKIDGRGGG

SEQ ID NO: 989727 - protein, 9 aa, Homo Sapiens
HSNCTYGCT

SEQ ID NO: 989728 - protein, 9 aa, Homo Sapiens
FGLFLFMYL

SEQ ID NO: 989729 - protein, 9 aa, Homo Sapiens
KKNWTGNEL

SEQ ID NO: 989730 - protein, 9 aa, Homo Sapiens
GYSDPQPAS

SEQ ID NO: 989731 - protein, 9 aa, Homo Sapiens
WTKGKTVPI

SEQ ID NO: 989732 - protein, 9 aa, Homo Sapiens
CSSPELLDS

SEQ ID NO: 989733 - protein, 9 aa, Homo Sapiens
TSSLNSLSS

SEQ ID NO: 989734 - protein, 9 aa, Homo Sapiens
TESEPPLSP

SEQ ID NO: 989735 - protein, 9 aa, Homo Sapiens
SLLRGPHPS

SEQ ID NO: 989736 - protein, 9 aa, Homo Sapiens
SIFARQSDQ

SEQ ID NO: 989737 - protein, 9 aa, Homo Sapiens
KEPTEPHKF

SEQ ID NO: 989738 - protein, 9 aa, Homo Sapiens
TSVNLTSNG

SEQ ID NO: 989739 - protein, 9 aa, Homo Sapiens
PITVNNYPI

SEQ ID NO: 989740 - protein, 9 aa, Homo Sapiens
TSRAPSCSG

SEQ ID NO: 989741 - protein, 9 aa, Homo Sapiens
PLLSMAGVL

SEQ ID NO: 989742 - protein, 9 aa, Homo Sapiens
NYLNSKIAY

SEQ ID NO: 989743 - protein, 9 aa, Homo Sapiens
LAEYSAIGA

SEQ ID NO: 989744 - protein, 9 aa, Homo Sapiens
QEEPGLQGT

SEQ ID NO: 989745 - protein, 9 aa, Homo Sapiens
PGFLGLPGP

SEQ ID NO: 989746 - protein, 9 aa, Homo Sapiens
TFNNNKIEK

SEQ ID NO: 989747 - protein, 9 aa, Homo Sapiens
KILSPVDII

SEQ ID NO: 989748 - protein, 9 aa, Homo Sapiens
QLSQILSLM

SEQ ID NO: 989749 - protein, 9 aa, Homo Sapiens
WKNSFVEAF

SEQ ID NO: 989750 - protein, 9 aa, Homo Sapiens
VGDLFLALD

SEQ ID NO: 989751 - protein, 9 aa, Homo Sapiens
VTYPQDSLA

SEQ ID NO: 989752 - protein, 9 aa, Homo Sapiens
SFGNVDCDF

SEQ ID NO: 989753 - protein, 9 aa, Homo Sapiens
SSLPVSSAD

SEQ ID NO: 989754 - protein, 9 aa, Homo Sapiens
SIDNFNVDG

SEQ ID NO: 989755 - protein, 9 aa, Homo Sapiens
ERDHINVTS

SEQ ID NO: 989756 - protein, 9 aa, Homo Sapiens
FFPELPAVG

SEQ ID NO: 989757 - protein, 9 aa, Homo Sapiens
YGFFPELPA

SEQ ID NO: 989758 - protein, 9 aa, Homo Sapiens
AGIYHRFMV

SEQ ID NO: 989759 - protein, 9 aa, Homo Sapiens
RNTKCFISG

SEQ ID NO: 989760 - protein, 9 aa, Homo Sapiens
SDVRAPQPL

SEQ ID NO: 989761 - protein, 9 aa, Homo Sapiens
GEIDPLCCV

SEQ ID NO: 989762 - protein, 9 aa, Homo Sapiens
CTDSWTTVT

SEQ ID NO: 989763 - protein, 9 aa, Homo Sapiens
VSEGFKVRE

SEQ ID NO: 989764 - protein, 9 aa, Homo Sapiens
DEGEDEDEP

SEQ ID NO: 989765 - protein, 9 aa, Homo Sapiens
KSKTERIYN

SEQ ID NO: 989766 - protein, 9 aa, Homo Sapiens
HRGNNQGKP

SEQ ID NO: 989767 - protein, 9 aa, Homo Sapiens
SPVDMLEVV

SEQ ID NO: 989768 - protein, 9 aa, Homo Sapiens
KGRKRKRKK

SEQ ID NO: 989769 - protein, 9 aa, Homo Sapiens
FAAHVSYIC

SEQ ID NO: 989770 - protein, 9 aa, Homo Sapiens
LLFRLEARL

SEQ ID NO: 989771 - protein, 9 aa, Homo Sapiens
SPTWTTLSR

SEQ ID NO: 989772 - protein, 9 aa, Homo Sapiens
ASKREWEKR

SEQ ID NO: 989773 - protein, 9 aa, Homo Sapiens
ISCGVIPNF

SEQ ID NO: 989774 - protein, 9 aa, Homo Sapiens
RVYQEATKK

SEQ ID NO: 989775 - protein, 9 aa, Homo Sapiens
EIVSFQTAS

SEQ ID NO: 989776 - protein, 9 aa, Homo Sapiens
NKHGLTCGS

SEQ ID NO: 989777 - protein, 9 aa, Homo Sapiens
VPKMLVHFL

SEQ ID NO: 989778 - protein, 9 aa, Homo Sapiens
GRPVTLSLL

SEQ ID NO: 989779 - protein, 9 aa, Homo Sapiens
EQRHPEKTS

SEQ ID NO: 989780 - protein, 9 aa, Homo Sapiens
KEGSKSNEW

SEQ ID NO: 989781 - protein, 9 aa, Homo Sapiens
LTRNCLFLL

SEQ ID NO: 989782 - protein, 9 aa, Homo Sapiens
SLRNNKVRN

SEQ ID NO: 989783 - protein, 9 aa, Homo Sapiens
VNVTWLRNE

SEQ ID NO: 989784 - protein, 9 aa, Homo Sapiens
TRATANRLR

SEQ ID NO: 989785 - protein, 9 aa, Homo Sapiens
PVDFVDQNK

SEQ ID NO: 989786 - protein, 9 aa, Homo Sapiens
EQARTENFL

SEQ ID NO: 989787 - protein, 9 aa, Homo Sapiens
DRSENRCEG

SEQ ID NO: 989788 - protein, 9 aa, Homo Sapiens
KIPKQEKKL

SEQ ID NO: 989789 - protein, 9 aa, Homo Sapiens
EERLFQDLY

SEQ ID NO: 989790 - protein, 9 aa, Homo Sapiens
ADQAVRTMK

SEQ ID NO: 989791 - protein, 9 aa, Homo Sapiens
SCQLSDISF

SEQ ID NO: 989792 - protein, 9 aa, Homo Sapiens
KWTKGKTVP

SEQ ID NO: 989793 - protein, 9 aa, Homo Sapiens
NSNSQAAAH

SEQ ID NO: 989794 - protein, 9 aa, Homo Sapiens
CLKGPSTEE

SEQ ID NO: 989795 - protein, 9 aa, Homo Sapiens
NLFSNRCFR

SEQ ID NO: 989796 - protein, 9 aa, Homo Sapiens
YNTERHVSL

SEQ ID NO: 989797 - protein, 9 aa, Homo Sapiens
LGQVVSLIL

SEQ ID NO: 989798 - protein, 9 aa, Homo Sapiens
NNDGGHCCL

SEQ ID NO: 989799 - protein, 9 aa, Homo Sapiens
PPLPQQPLP

SEQ ID NO: 989800 - protein, 9 aa, Homo Sapiens
GAVICWLRD

SEQ ID NO: 989801 - protein, 9 aa, Homo Sapiens
MNKRQLRAG

SEQ ID NO: 989802 - protein, 9 aa, Homo Sapiens
VGLTQYSRD

SEQ ID NO: 989803 - protein, 9 aa, Homo Sapiens
PSTSDLHIS

SEQ ID NO: 989804 - protein, 9 aa, Homo Sapiens
DYQVLVFYY

SEQ ID NO: 989805 - protein, 9 aa, Homo Sapiens
STAILGAIK

SEQ ID NO: 989806 - protein, 9 aa, Homo Sapiens
QQSIHWLFM

SEQ ID NO: 989807 - protein, 9 aa, Homo Sapiens
DVGENFLHT

SEQ ID NO: 989808 - protein, 9 aa, Homo Sapiens
LSDISFGSL

SEQ ID NO: 989809 - protein, 9 aa, Homo Sapiens
SISRQLSPL

SEQ ID NO: 989810 - protein, 9 aa, Homo Sapiens
FFRILHKGE

SEQ ID NO: 989811 - protein, 9 aa, Homo Sapiens
ASFVTPKMI

SEQ ID NO: 989812 - protein, 9 aa, Homo Sapiens
MKNYNIFNE

SEQ ID NO: 989813 - protein, 9 aa, Homo Sapiens
AVICWLRDN

SEQ ID NO: 989814 - protein, 9 aa, Homo Sapiens
APEMNSVPH

SEQ ID NO: 989815 - protein, 9 aa, Homo Sapiens
YQRDIRKAM

SEQ ID NO: 989816 - protein, 9 aa, Homo Sapiens
EFQQKLLYP

SEQ ID NO: 989817 - protein, 9 aa, Homo Sapiens
KIAEFILKE

SEQ ID NO: 989818 - protein, 9 aa, Homo Sapiens
GGASHREWN

SEQ ID NO: 989819 - protein, 9 aa, Homo Sapiens
SQVAGMLVF

SEQ ID NO: 989820 - protein, 9 aa, Homo Sapiens
MALMKVNLL

SEQ ID NO: 989821 - protein, 9 aa, Homo Sapiens
NATQFIEFA

SEQ ID NO: 989822 - protein, 9 aa, Homo Sapiens
SYFFQNPSS

SEQ ID NO: 989823 - protein, 9 aa, Homo Sapiens
RRAVMPPPM

SEQ ID NO: 989824 - protein, 9 aa, Homo Sapiens
LEQARTENF

SEQ ID NO: 989825 - protein, 9 aa, Homo Sapiens
PVVNELEQI

SEQ ID NO: 989826 - protein, 9 aa, Homo Sapiens
LVSHVNFKL

SEQ ID NO: 989827 - protein, 9 aa, Homo Sapiens
CSYCWKRDG

SEQ ID NO: 989828 - protein, 9 aa, Homo Sapiens
RSEKRAQKA

SEQ ID NO: 989829 - protein, 9 aa, Homo Sapiens
HLWRIYYNI

SEQ ID NO: 989830 - protein, 9 aa, Homo Sapiens
TSELSEGED

SEQ ID NO: 989831 - protein, 9 aa, Homo Sapiens
DRNTKCFIS

SEQ ID NO: 989832 - protein, 9 aa, Homo Sapiens
VRLVRIGRI

SEQ ID NO: 989833 - protein, 9 aa, Homo Sapiens
ENKEKFVYT

SEQ ID NO: 989834 - protein, 9 aa, Homo Sapiens
TCKQCGKVF

SEQ ID NO: 989835 - protein, 9 aa, Homo Sapiens
PAQPAPVLS

SEQ ID NO: 989836 - protein, 9 aa, Homo Sapiens
LFSNRCFRK

SEQ ID NO: 989837 - protein, 9 aa, Homo Sapiens
EIFYSLFQA

SEQ ID NO: 989838 - protein, 9 aa, Homo Sapiens
SFGPLYTHE

SEQ ID NO: 989839 - protein, 9 aa, Homo Sapiens
TRQKVYFDA

SEQ ID NO: 989840 - protein, 9 aa, Homo Sapiens
IMKKYNIKL

SEQ ID NO: 989841 - protein, 9 aa, Homo Sapiens
LGIVAPHSF

SEQ ID NO: 989842 - protein, 9 aa, Homo Sapiens
LKQVSTLGK

SEQ ID NO: 989843 - protein, 9 aa, Homo Sapiens
DGEDEEAKE

SEQ ID NO: 989844 - protein, 9 aa, Homo Sapiens
ATARRERRL

SEQ ID NO: 989845 - protein, 9 aa, Homo Sapiens
SRVLSALAD

SEQ ID NO: 989846 - protein, 9 aa, Homo Sapiens
CPHNNITAE

SEQ ID NO: 989847 - protein, 9 aa, Homo Sapiens
FEFKLLASS

SEQ ID NO: 989848 - protein, 9 aa, Homo Sapiens
GSRSVQTTL

SEQ ID NO: 989849 - protein, 9 aa, Homo Sapiens
LRLTPVGVV

SEQ ID NO: 989850 - protein, 9 aa, Homo Sapiens
ELSKFNLCG

SEQ ID NO: 989851 - protein, 9 aa, Homo Sapiens
KMKKKGDIP

SEQ ID NO: 989852 - protein, 9 aa, Homo Sapiens
SALCLHGGS

SEQ ID NO: 989853 - protein, 9 aa, Homo Sapiens
KKKGDIPEG

SEQ ID NO: 989854 - protein, 9 aa, Homo Sapiens
EKKIYRWPA

SEQ ID NO: 989855 - protein, 9 aa, Homo Sapiens
ADLRQNVEE

SEQ ID NO: 989856 - protein, 9 aa, Homo Sapiens
KMDYLWKIN

SEQ ID NO: 989857 - protein, 9 aa, Homo Sapiens
LGLPEDNLV

SEQ ID NO: 989858 - protein, 9 aa, Homo Sapiens
YFFRILHKG

SEQ ID NO: 989859 - protein, 9 aa, Homo Sapiens
KFEMKDMRV

SEQ ID NO: 989860 - protein, 9 aa, Homo Sapiens
PGPPTRATA

SEQ ID NO: 989861 - protein, 9 aa, Homo Sapiens
LREMSSLWE

SEQ ID NO: 989862 - protein, 9 aa, Homo Sapiens
DKKDDDKNG

SEQ ID NO: 989863 - protein, 9 aa, Homo Sapiens
SFRSYGNNS

SEQ ID NO: 989864 - protein, 9 aa, Homo Sapiens
KIEMNKRQL

SEQ ID NO: 989865 - protein, 9 aa, Homo Sapiens
GLKDYPWEV

SEQ ID NO: 989866 - protein, 9 aa, Homo Sapiens
LVASYKVGQ

SEQ ID NO: 989867 - protein, 9 aa, Homo Sapiens
SAAGGKFVS

SEQ ID NO: 989868 - protein, 9 aa, Homo Sapiens
QEKKLLPEL

SEQ ID NO: 989869 - protein, 9 aa, Homo Sapiens
NLGKLVHRF

SEQ ID NO: 989870 - protein, 9 aa, Homo Sapiens
RVDDKVNFY

SEQ ID NO: 989871 - protein, 9 aa, Homo Sapiens
YYLVQQSIH

SEQ ID NO: 989872 - protein, 9 aa, Homo Sapiens
STDYNLVQK

SEQ ID NO: 989873 - protein, 9 aa, Homo Sapiens
LVHFLSEKK

SEQ ID NO: 989874 - protein, 9 aa, Homo Sapiens
QQSRKYPDS

SEQ ID NO: 989875 - protein, 9 aa, Homo Sapiens
KNGSLQVRS

SEQ ID NO: 989876 - protein, 9 aa, Homo Sapiens
EEVVIDLVR

SEQ ID NO: 989877 - protein, 9 aa, Homo Sapiens
FRWTPAWEQ

SEQ ID NO: 989878 - protein, 9 aa, Homo Sapiens
GKINFTINT

SEQ ID NO: 989879 - protein, 9 aa, Homo Sapiens
RQLISERVL

SEQ ID NO: 989880 - protein, 9 aa, Homo Sapiens
RGIDDLAVA

SEQ ID NO: 989881 - protein, 9 aa, Homo Sapiens
YFEMCETRK

SEQ ID NO: 989882 - protein, 9 aa, Homo Sapiens
IANKVFKHL

SEQ ID NO: 989883 - protein, 9 aa, Homo Sapiens
QLWVQKQKA

SEQ ID NO: 989884 - protein, 9 aa, Homo Sapiens
DNVKENKFK

SEQ ID NO: 989885 - protein, 9 aa, Homo Sapiens
ANPLFERKN

SEQ ID NO: 989886 - protein, 9 aa, Homo Sapiens
FSRDEVSLC

SEQ ID NO: 989887 - protein, 9 aa, Homo Sapiens
GSCPRLCLT

SEQ ID NO: 989888 - protein, 9 aa, Homo Sapiens
WFYYEDITL

SEQ ID NO: 989889 - protein, 9 aa, Homo Sapiens
QKVTEHILP

SEQ ID NO: 989890 - protein, 9 aa, Homo Sapiens
SKKLKTSES

SEQ ID NO: 989891 - protein, 9 aa, Homo Sapiens
LAASYFIDK

SEQ ID NO: 989892 - protein, 9 aa, Homo Sapiens
VCHLCHSNC

SEQ ID NO: 989893 - protein, 9 aa, Homo Sapiens
LVYAQFSTH

SEQ ID NO: 989894 - protein, 9 aa, Homo Sapiens
DLKLDLGKK

SEQ ID NO: 989895 - protein, 9 aa, Homo Sapiens
VEEVAGEQR

SEQ ID NO: 989896 - protein, 9 aa, Homo Sapiens
GKILRACIE

SEQ ID NO: 989897 - protein, 9 aa, Homo Sapiens
EKTSVYTSP

SEQ ID NO: 989898 - protein, 9 aa, Homo Sapiens
HPETSGERF

SEQ ID NO: 989899 - protein, 9 aa, Homo Sapiens
NEEVVIDLV

SEQ ID NO: 989900 - protein, 9 aa, Homo Sapiens
PLREGALVE

SEQ ID NO: 989901 - protein, 9 aa, Homo Sapiens
TYMGYGIET

SEQ ID NO: 989902 - protein, 9 aa, Homo Sapiens
DKNGPKPNS

SEQ ID NO: 989903 - protein, 9 aa, Homo Sapiens
PATSSMEAA

SEQ ID NO: 989904 - protein, 9 aa, Homo Sapiens
AEFILKEAQ

SEQ ID NO: 989905 - protein, 9 aa, Homo Sapiens
VIRLGLMEI

SEQ ID NO: 989906 - protein, 9 aa, Homo Sapiens
PFIFGLFLF

SEQ ID NO: 989907 - protein, 9 aa, Homo Sapiens
VISPTKFEV

SEQ ID NO: 989908 - protein, 9 aa, Homo Sapiens
SSFRSYGNN

SEQ ID NO: 989909 - protein, 9 aa, Homo Sapiens
YGIVRNSAA

SEQ ID NO: 989910 - protein, 9 aa, Homo Sapiens
RKAQHELND

SEQ ID NO: 989911 - protein, 9 aa, Homo Sapiens
AAEFLLPAI

SEQ ID NO: 989912 - protein, 9 aa, Homo Sapiens
KEENIIYFF

SEQ ID NO: 989913 - protein, 9 aa, Homo Sapiens
PKMAEHSYL

SEQ ID NO: 989914 - protein, 9 aa, Homo Sapiens
YQENATMLV

SEQ ID NO: 989915 - protein, 9 aa, Homo Sapiens
AKASRRSLS

SEQ ID NO: 989916 - protein, 9 aa, Homo Sapiens
FLIQYQNVE

SEQ ID NO: 989917 - protein, 9 aa, Homo Sapiens
SEGSSLTPA

SEQ ID NO: 989918 - protein, 9 aa, Homo Sapiens
SETMRASST

SEQ ID NO: 989919 - protein, 9 aa, Homo Sapiens
FNRGFKAER

SEQ ID NO: 989920 - protein, 9 aa, Homo Sapiens
HPQQRLSSS

SEQ ID NO: 989921 - protein, 9 aa, Homo Sapiens
FSCQNPLPV

SEQ ID NO: 989922 - protein, 9 aa, Homo Sapiens
GNKLRRADI

SEQ ID NO: 989923 - protein, 9 aa, Homo Sapiens
ENHDIANKV

SEQ ID NO: 989924 - protein, 9 aa, Homo Sapiens
KEIEDIQNT

SEQ ID NO: 989925 - protein, 9 aa, Homo Sapiens
PAIQAASSF

SEQ ID NO: 989926 - protein, 9 aa, Homo Sapiens
RCAMTSLIL

SEQ ID NO: 989927 - protein, 9 aa, Homo Sapiens
RCLDYNAKC

SEQ ID NO: 989928 - protein, 9 aa, Homo Sapiens
VSPHRGNNQ

SEQ ID NO: 989929 - protein, 9 aa, Homo Sapiens
ELSQNKQKG

SEQ ID NO: 989930 - protein, 9 aa, Homo Sapiens
SQEEFLFLI

SEQ ID NO: 989931 - protein, 9 aa, Homo Sapiens
ESCNEDVIA

SEQ ID NO: 989932 - protein, 9 aa, Homo Sapiens
LCLHGGSCL

SEQ ID NO: 989933 - protein, 9 aa, Homo Sapiens
LDQCMTALN

SEQ ID NO: 989934 - protein, 9 aa, Homo Sapiens
AVEGLRHLM

SEQ ID NO: 989935 - protein, 9 aa, Homo Sapiens
LYWFYYEDI

SEQ ID NO: 989936 - protein, 9 aa, Homo Sapiens
LLNKYCVAY

SEQ ID NO: 989937 - protein, 9 aa, Homo Sapiens
KNHPQAQRA

SEQ ID NO: 989938 - protein, 9 aa, Homo Sapiens
NEEECWNEH

SEQ ID NO: 989939 - protein, 9 aa, Homo Sapiens
ICLNNDGGH

SEQ ID NO: 989940 - protein, 9 aa, Homo Sapiens
LSERRQKEE

SEQ ID NO: 989941 - protein, 9 aa, Homo Sapiens
PGFSRKSKK

SEQ ID NO: 989942 - protein, 9 aa, Homo Sapiens
ELREVRCVP

SEQ ID NO: 989943 - protein, 9 aa, Homo Sapiens
CSAEQRHPE

SEQ ID NO: 989944 - protein, 9 aa, Homo Sapiens
LKDSLLREL

SEQ ID NO: 989945 - protein, 9 aa, Homo Sapiens
TDKDEGAEM

SEQ ID NO: 989946 - protein, 9 aa, Homo Sapiens
ISLGSMVYL

SEQ ID NO: 989947 - protein, 9 aa, Homo Sapiens
LFMNLMNDC

SEQ ID NO: 989948 - protein, 9 aa, Homo Sapiens
DIIVRGSPG

SEQ ID NO: 989949 - protein, 9 aa, Homo Sapiens
RNKKSKSGL

SEQ ID NO: 989950 - protein, 9 aa, Homo Sapiens
ALFFQDYMD

SEQ ID NO: 989951 - protein, 9 aa, Homo Sapiens
RVGNSEETP

SEQ ID NO: 989952 - protein, 9 aa, Homo Sapiens
RIKTKGQYD

SEQ ID NO: 989953 - protein, 9 aa, Homo Sapiens
SPDYWILRG

SEQ ID NO: 989954 - protein, 9 aa, Homo Sapiens
FSEQGRVEH

SEQ ID NO: 989955 - protein, 9 aa, Homo Sapiens
SVNLTSNGQ

SEQ ID NO: 989956 - protein, 9 aa, Homo Sapiens
NKNLLKDLK

SEQ ID NO: 989957 - protein, 9 aa, Homo Sapiens
IVVHIRYYR

SEQ ID NO: 989958 - protein, 9 aa, Homo Sapiens
LQEGAKRPL

SEQ ID NO: 989959 - protein, 9 aa, Homo Sapiens
EMGNYNENT

SEQ ID NO: 989960 - protein, 9 aa, Homo Sapiens
EKFVYTLPL

SEQ ID NO: 989961 - protein, 9 aa, Homo Sapiens
WPSSMDTRP

SEQ ID NO: 989962 - protein, 9 aa, Homo Sapiens
EEEKEEEKE

SEQ ID NO: 989963 - protein, 9 aa, Homo Sapiens
QDEPAFIDD

SEQ ID NO: 989964 - protein, 9 aa, Homo Sapiens
NEDTDSAIG

SEQ ID NO: 989965 - protein, 9 aa, Homo Sapiens
SVGKASFRV

SEQ ID NO: 989966 - protein, 9 aa, Homo Sapiens
RRADIHLVE

SEQ ID NO: 989967 - protein, 9 aa, Homo Sapiens
SCGVIPNFL

SEQ ID NO: 989968 - protein, 9 aa, Homo Sapiens
YKLYRRQIA

SEQ ID NO: 989969 - protein, 9 aa, Homo Sapiens
RYYMPVKNS

SEQ ID NO: 989970 - protein, 9 aa, Homo Sapiens
SETFNNNKI

SEQ ID NO: 989971 - protein, 9 aa, Homo Sapiens
TLIHIFILV

SEQ ID NO: 989972 - protein, 9 aa, Homo Sapiens
TAMDHGAIK

SEQ ID NO: 989973 - protein, 9 aa, Homo Sapiens
ANKVFKHLQ

SEQ ID NO: 989974 - protein, 9 aa, Homo Sapiens
NRGLDSEES

SEQ ID NO: 989975 - protein, 9 aa, Homo Sapiens
ETLLGTDTF

SEQ ID NO: 989976 - protein, 9 aa, Homo Sapiens
NNIGNNIFF

SEQ ID NO: 989977 - protein, 9 aa, Homo Sapiens
IKKMDYLWK

SEQ ID NO: 989978 - protein, 9 aa, Homo Sapiens
FYYEDITLG

SEQ ID NO: 989979 - protein, 9 aa, Homo Sapiens
VPWSISLGS

SEQ ID NO: 989980 - protein, 9 aa, Homo Sapiens
NSGAHDGQP

SEQ ID NO: 989981 - protein, 9 aa, Homo Sapiens
NICTDSWTT

SEQ ID NO: 989982 - protein, 9 aa, Homo Sapiens
FPFPRHPHP

SEQ ID NO: 989983 - protein, 9 aa, Homo Sapiens
TLEWEKLEE

SEQ ID NO: 989984 - protein, 9 aa, Homo Sapiens
YYQGKLREN

SEQ ID NO: 989985 - protein, 9 aa, Homo Sapiens
LFTAAEFLL

SEQ ID NO: 989986 - protein, 9 aa, Homo Sapiens
SFRWTPAWE

SEQ ID NO: 989987 - protein, 9 aa, Homo Sapiens
SFSFNFVPS

SEQ ID NO: 989988 - protein, 9 aa, Homo Sapiens
LVPTAVLVS

SEQ ID NO: 989989 - protein, 9 aa, Homo Sapiens
WKTLVSLAI

SEQ ID NO: 989990 - protein, 9 aa, Homo Sapiens
LTEKEKKIY

SEQ ID NO: 989991 - protein, 9 aa, Homo Sapiens
KNDNLDPEK

SEQ ID NO: 989992 - protein, 9 aa, Homo Sapiens
LMKVNLLSG

SEQ ID NO: 989993 - protein, 9 aa, Homo Sapiens
DTGQCCLDH

SEQ ID NO: 989994 - protein, 9 aa, Homo Sapiens
SYKGPGLGI

SEQ ID NO: 989995 - protein, 9 aa, Homo Sapiens
RHYYIAAEK

SEQ ID NO: 989996 - protein, 9 aa, Homo Sapiens
VFSYMDQQP

SEQ ID NO: 989997 - protein, 9 aa, Homo Sapiens
GPSTEEIFR

SEQ ID NO: 989998 - protein, 9 aa, Homo Sapiens
DRKARQQWR

SEQ ID NO: 989999 - protein, 9 aa, Homo Sapiens
KGPSTEEIF

SEQ ID NO: 990000 - protein, 9 aa, Homo Sapiens
RSLNVQLER

SEQ ID NO: 990001 - protein, 9 aa, Homo Sapiens
EPGLQGSCY

SEQ ID NO: 990002 - protein, 9 aa, Homo Sapiens
RPHFCLQLV

SEQ ID NO: 990003 - protein, 9 aa, Homo Sapiens
ATTQIASSG

SEQ ID NO: 990004 - protein, 9 aa, Homo Sapiens
QLGLAFLRS

SEQ ID NO: 990005 - protein, 9 aa, Homo Sapiens
GSGGNYGGE

SEQ ID NO: 990006 - protein, 9 aa, Homo Sapiens
VEKKILAVV

SEQ ID NO: 990007 - protein, 9 aa, Homo Sapiens
APRHSRRNK

SEQ ID NO: 990008 - protein, 9 aa, Homo Sapiens
GVLFMQVAS

SEQ ID NO: 990009 - protein, 9 aa, Homo Sapiens
KIKSFQGSS

SEQ ID NO: 990010 - protein, 9 aa, Homo Sapiens
YKNGSRDTE

SEQ ID NO: 990011 - protein, 9 aa, Homo Sapiens
GHGGQMSRT

SEQ ID NO: 990012 - protein, 9 aa, Homo Sapiens
LRLGKIDGR

SEQ ID NO: 990013 - protein, 9 aa, Homo Sapiens
GNYNENTGE

SEQ ID NO: 990014 - protein, 9 aa, Homo Sapiens
DPDVGENFL

SEQ ID NO: 990015 - protein, 9 aa, Homo Sapiens
EAEVIMKLS

SEQ ID NO: 990016 - protein, 9 aa, Homo Sapiens
FLDCYIECV

SEQ ID NO: 990017 - protein, 9 aa, Homo Sapiens
GDKFQKFIK

SEQ ID NO: 990018 - protein, 9 aa, Homo Sapiens
KVETKTMSK

SEQ ID NO: 990019 - protein, 9 aa, Homo Sapiens
SEQFGRGSR

SEQ ID NO: 990020 - protein, 9 aa, Homo Sapiens
PMYLFFGSL

SEQ ID NO: 990021 - protein, 9 aa, Homo Sapiens
FKALDKVCI

SEQ ID NO: 990022 - protein, 9 aa, Homo Sapiens
PRDLSWEAR

SEQ ID NO: 990023 - protein, 9 aa, Homo Sapiens
EPTEPHKFP

SEQ ID NO: 990024 - protein, 9 aa, Homo Sapiens
SGEPGVSGD

SEQ ID NO: 990025 - protein, 9 aa, Homo Sapiens
SLQVNGYRN

SEQ ID NO: 990026 - protein, 9 aa, Homo Sapiens
GVSSSIAGP

SEQ ID NO: 990027 - protein, 9 aa, Homo Sapiens
MELRNVNIK

SEQ ID NO: 990028 - protein, 9 aa, Homo Sapiens
RGTLSVISF

SEQ ID NO: 990029 - protein, 9 aa, Homo Sapiens
NIKPDDESS

SEQ ID NO: 990030 - protein, 9 aa, Homo Sapiens
LVPRHSKYN

SEQ ID NO: 990031 - protein, 9 aa, Homo Sapiens
LISHQNIYT

SEQ ID NO: 990032 - protein, 9 aa, Homo Sapiens
FNNNKIEKK

SEQ ID NO: 990033 - protein, 9 aa, Homo Sapiens
FSPSPGGGG

SEQ ID NO: 990034 - protein, 9 aa, Homo Sapiens
SCQNPLPVN

SEQ ID NO: 990035 - protein, 9 aa, Homo Sapiens
RVRSLPGKD

SEQ ID NO: 990036 - protein, 9 aa, Homo Sapiens
FSTLEWEKL

SEQ ID NO: 990037 - protein, 9 aa, Homo Sapiens
LVHGTEVTY

SEQ ID NO: 990038 - protein, 9 aa, Homo Sapiens
KNLGAPKGI

SEQ ID NO: 990039 - protein, 9 aa, Homo Sapiens
YMPVKNSQG

SEQ ID NO: 990040 - protein, 9 aa, Homo Sapiens
RTDSILNSP

SEQ ID NO: 990041 - protein, 9 aa, Homo Sapiens
HRILMDLQN

SEQ ID NO: 990042 - protein, 9 aa, Homo Sapiens
CKDEEAVKD

SEQ ID NO: 990043 - protein, 9 aa, Homo Sapiens
VSFMALARS

SEQ ID NO: 990044 - protein, 9 aa, Homo Sapiens
LPTDSGPKS

SEQ ID NO: 990045 - protein, 9 aa, Homo Sapiens
QQARPFRGD

SEQ ID NO: 990046 - protein, 9 aa, Homo Sapiens
HQEGQLEVS

SEQ ID NO: 990047 - protein, 9 aa, Homo Sapiens
TIILLFRLE

SEQ ID NO: 990048 - protein, 9 aa, Homo Sapiens
PFRGDSPIM

SEQ ID NO: 990049 - protein, 9 aa, Homo Sapiens
FLGLPGPPG

SEQ ID NO: 990050 - protein, 9 aa, Homo Sapiens
KKERWINSM

SEQ ID NO: 990051 - protein, 9 aa, Homo Sapiens
MLPEFWEGS

SEQ ID NO: 990052 - protein, 9 aa, Homo Sapiens
SSSIAGPAQ

SEQ ID NO: 990053 - protein, 9 aa, Homo Sapiens
MKIYVAQFS

SEQ ID NO: 990054 - protein, 9 aa, Homo Sapiens
QNIVFTVNL

SEQ ID NO: 990055 - protein, 9 aa, Homo Sapiens
EEISLLAVG

SEQ ID NO: 990056 - protein, 9 aa, Homo Sapiens
QAASSFSNS

SEQ ID NO: 990057 - protein, 9 aa, Homo Sapiens
DEQEIVQKQ

SEQ ID NO: 990058 - protein, 9 aa, Homo Sapiens
ADNDHLFAL

SEQ ID NO: 990059 - protein, 9 aa, Homo Sapiens
YENQFESEA

SEQ ID NO: 990060 - protein, 9 aa, Homo Sapiens
EFEYENQFE

SEQ ID NO: 990061 - protein, 9 aa, Homo Sapiens
DSTLQTVEK

SEQ ID NO: 990062 - protein, 9 aa, Homo Sapiens
LNLFLTNQF

SEQ ID NO: 990063 - protein, 9 aa, Homo Sapiens
YRPAPGRPP

SEQ ID NO: 990064 - protein, 9 aa, Homo Sapiens
EGRDEYNEV

SEQ ID NO: 990065 - protein, 9 aa, Homo Sapiens
HELPVSCVC

SEQ ID NO: 990066 - protein, 9 aa, Homo Sapiens
LDREKERVH

SEQ ID NO: 990067 - protein, 9 aa, Homo Sapiens
RGETESVSQ

SEQ ID NO: 990068 - protein, 9 aa, Homo Sapiens
AQELARLEE

SEQ ID NO: 990069 - protein, 9 aa, Homo Sapiens
VFGCRKGPG

SEQ ID NO: 990070 - protein, 9 aa, Homo Sapiens
VFQCAPEMN

SEQ ID NO: 990071 - protein, 9 aa, Homo Sapiens
IRQDSSDDN

SEQ ID NO: 990072 - protein, 9 aa, Homo Sapiens
FSPIPFFLA

SEQ ID NO: 990073 - protein, 9 aa, Homo Sapiens
VICWLRDNL

SEQ ID NO: 990074 - protein, 9 aa, Homo Sapiens
CRCSDTGQC

SEQ ID NO: 990075 - protein, 9 aa, Homo Sapiens
VEEKLGGIN

SEQ ID NO: 990076 - protein, 9 aa, Homo Sapiens
PAEPEVLPA

SEQ ID NO: 990077 - protein, 9 aa, Homo Sapiens
CNNWLSRVE

SEQ ID NO: 990078 - protein, 9 aa, Homo Sapiens
LKLPYQENA

SEQ ID NO: 990079 - protein, 9 aa, Homo Sapiens
AEASPPSIA

SEQ ID NO: 990080 - protein, 9 aa, Homo Sapiens
WKQKGRCSV

SEQ ID NO: 990081 - protein, 9 aa, Homo Sapiens
ISPTKFEVV

SEQ ID NO: 990082 - protein, 9 aa, Homo Sapiens
CREQRSQNS

SEQ ID NO: 990083 - protein, 9 aa, Homo Sapiens
PMYMFLENF

SEQ ID NO: 990084 - protein, 9 aa, Homo Sapiens
ILVSHVNFK

SEQ ID NO: 990085 - protein, 9 aa, Homo Sapiens
SGPDYSSIR

SEQ ID NO: 990086 - protein, 9 aa, Homo Sapiens
EEGTDPELE

SEQ ID NO: 990087 - protein, 9 aa, Homo Sapiens
HPPHGSVTL

SEQ ID NO: 990088 - protein, 9 aa, Homo Sapiens
GFFPELPAV

SEQ ID NO: 990089 - protein, 9 aa, Homo Sapiens
TVPKMLVHF

SEQ ID NO: 990090 - protein, 9 aa, Homo Sapiens
SVSVVTPTA

SEQ ID NO: 990091 - protein, 9 aa, Homo Sapiens
SFEDRLNNI

SEQ ID NO: 990092 - protein, 9 aa, Homo Sapiens
RDTESMDPD

SEQ ID NO: 990093 - protein, 9 aa, Homo Sapiens
GSETMRASS

SEQ ID NO: 990094 - protein, 9 aa, Homo Sapiens
LKSLFAYCM

SEQ ID NO: 990095 - protein, 9 aa, Homo Sapiens
YSLGNLPMK

SEQ ID NO: 990096 - protein, 9 aa, Homo Sapiens
QCRQDNPAS

SEQ ID NO: 990097 - protein, 9 aa, Homo Sapiens
PARFLEAGL

SEQ ID NO: 990098 - protein, 9 aa, Homo Sapiens
YRKQPQNWP

SEQ ID NO: 990099 - protein, 9 aa, Homo Sapiens
DDDKNGPKP

SEQ ID NO: 990100 - protein, 9 aa, Homo Sapiens
IDFFFLRRL

SEQ ID NO: 990101 - protein, 9 aa, Homo Sapiens
WPTPGKHSE

SEQ ID NO: 990102 - protein, 9 aa, Homo Sapiens
RHSKYNPQH

SEQ ID NO: 990103 - protein, 9 aa, Homo Sapiens
KNSFVEAFK

SEQ ID NO: 990104 - protein, 9 aa, Homo Sapiens
SLPRLTNQP

SEQ ID NO: 990105 - protein, 9 aa, Homo Sapiens
DVIADVNTK

SEQ ID NO: 990106 - protein, 9 aa, Homo Sapiens
SLFAYCMMI

SEQ ID NO: 990107 - protein, 9 aa, Homo Sapiens
NKYCVAYGV

SEQ ID NO: 990108 - protein, 9 aa, Homo Sapiens
TVLSPDYWI

SEQ ID NO: 990109 - protein, 9 aa, Homo Sapiens
MNAPLDGLT

SEQ ID NO: 990110 - protein, 9 aa, Homo Sapiens
SIVLLLKAF

SEQ ID NO: 990111 - protein, 9 aa, Homo Sapiens
GNYGFFPEL

SEQ ID NO: 990112 - protein, 9 aa, Homo Sapiens
VITGPHGYA

SEQ ID NO: 990113 - protein, 9 aa, Homo Sapiens
RILKPPFSP

SEQ ID NO: 990114 - protein, 9 aa, Homo Sapiens
VSIFARQSD

SEQ ID NO: 990115 - protein, 9 aa, Homo Sapiens
TEKITLRSR

SEQ ID NO: 990116 - protein, 9 aa, Homo Sapiens
LVGNKLRRA

SEQ ID NO: 990117 - protein, 9 aa, Homo Sapiens
NVEETMSSL

SEQ ID NO: 990118 - protein, 9 aa, Homo Sapiens
LSGLSRRQM

SEQ ID NO: 990119 - protein, 9 aa, Homo Sapiens
FQVEEKLGG

SEQ ID NO: 990120 - protein, 9 aa, Homo Sapiens
STPCDFFGI

SEQ ID NO: 990121 - protein, 9 aa, Homo Sapiens
IIFERDTVS

SEQ ID NO: 990122 - protein, 9 aa, Homo Sapiens
NVLYFSRDE

SEQ ID NO: 990123 - protein, 9 aa, Homo Sapiens
FPTPLSPPP

SEQ ID NO: 990124 - protein, 9 aa, Homo Sapiens
AASFCLLGG

SEQ ID NO: 990125 - protein, 9 aa, Homo Sapiens
RLLAGCEDG

SEQ ID NO: 990126 - protein, 9 aa, Homo Sapiens
RNNVDLTEW

SEQ ID NO: 990127 - protein, 9 aa, Homo Sapiens
FSVQKGSQT

SEQ ID NO: 990128 - protein, 9 aa, Homo Sapiens
GLGSAQLVG

SEQ ID NO: 990129 - protein, 9 aa, Homo Sapiens
ANSLTLLFL

SEQ ID NO: 990130 - protein, 9 aa, Homo Sapiens
RDKIDRLLQ

SEQ ID NO: 990131 - protein, 9 aa, Homo Sapiens
FFLREVIQG

SEQ ID NO: 990132 - protein, 9 aa, Homo Sapiens
TVALGVLKR

SEQ ID NO: 990133 - protein, 9 aa, Homo Sapiens
FVTPKMITD

SEQ ID NO: 990134 - protein, 9 aa, Homo Sapiens
VEVSRQIFQ

SEQ ID NO: 990135 - protein, 9 aa, Homo Sapiens
RARSRFRRI

SEQ ID NO: 990136 - protein, 9 aa, Homo Sapiens
YTKDRTPIF

SEQ ID NO: 990137 - protein, 9 aa, Homo Sapiens
QPPSNLLYQ

SEQ ID NO: 990138 - protein, 9 aa, Homo Sapiens
SLASFVTPK

SEQ ID NO: 990139 - protein, 9 aa, Homo Sapiens
GALGQAVPE

SEQ ID NO: 990140 - protein, 9 aa, Homo Sapiens
STEVSIFAR

SEQ ID NO: 990141 - protein, 9 aa, Homo Sapiens
GLPGVPEIP

SEQ ID NO: 990142 - protein, 9 aa, Homo Sapiens
LLLVSYRVI

SEQ ID NO: 990143 - protein, 9 aa, Homo Sapiens
YMFLENFSF

SEQ ID NO: 990144 - protein, 9 aa, Homo Sapiens
IGLNLPAGK

SEQ ID NO: 990145 - protein, 9 aa, Homo Sapiens
GLTGERPLA

SEQ ID NO: 990146 - protein, 9 aa, Homo Sapiens
ECTSSNDLG

SEQ ID NO: 990147 - protein, 9 aa, Homo Sapiens
AIAGAVICW

SEQ ID NO: 990148 - protein, 9 aa, Homo Sapiens
EANLLTELQ

SEQ ID NO: 990149 - protein, 9 aa, Homo Sapiens
PAPSLSVLN

SEQ ID NO: 990150 - protein, 9 aa, Homo Sapiens
VFLVTVGNS

SEQ ID NO: 990151 - protein, 9 aa, Homo Sapiens
CREFVHCKG

SEQ ID NO: 990152 - protein, 9 aa, Homo Sapiens
KAIFTSDIA

SEQ ID NO: 990153 - protein, 9 aa, Homo Sapiens
NGTLNAFIL

SEQ ID NO: 990154 - protein, 9 aa, Homo Sapiens
RSTTIMIRP

SEQ ID NO: 990155 - protein, 9 aa, Homo Sapiens
AARGRARVF

SEQ ID NO: 990156 - protein, 9 aa, Homo Sapiens
KHAKMEEQL

SEQ ID NO: 990157 - protein, 9 aa, Homo Sapiens
AYKHAKMEE

SEQ ID NO: 990158 - protein, 9 aa, Homo Sapiens
GGPTPSFYA

SEQ ID NO: 990159 - protein, 9 aa, Homo Sapiens
LMTAFFWIL

SEQ ID NO: 990160 - protein, 9 aa, Homo Sapiens
TEEKFIIKE

SEQ ID NO: 990161 - protein, 9 aa, Homo Sapiens
VFYDHESCR

SEQ ID NO: 990162 - protein, 9 aa, Homo Sapiens
VAIAGAVIC

SEQ ID NO: 990163 - protein, 9 aa, Homo Sapiens
ENEKQRQNG

SEQ ID NO: 990164 - protein, 9 aa, Homo Sapiens
TAGAGPQEI

SEQ ID NO: 990165 - protein, 9 aa, Homo Sapiens
ESEVELLVS

SEQ ID NO: 990166 - protein, 9 aa, Homo Sapiens
TQMFFFHFL

SEQ ID NO: 990167 - protein, 9 aa, Homo Sapiens
ANSTISFGN

SEQ ID NO: 990168 - protein, 9 aa, Homo Sapiens
GSSPEETRE

SEQ ID NO: 990169 - protein, 9 aa, Homo Sapiens
GPHIFYPPL

SEQ ID NO: 990170 - protein, 9 aa, Homo Sapiens
SSGLTFTVG

SEQ ID NO: 990171 - protein, 9 aa, Homo Sapiens
SSVEVVQSK

SEQ ID NO: 990172 - protein, 9 aa, Homo Sapiens
CRKQCKDEE

SEQ ID NO: 990173 - protein, 9 aa, Homo Sapiens
LFYCIPTRY

SEQ ID NO: 990174 - protein, 9 aa, Homo Sapiens
KSLQQRALR

SEQ ID NO: 990175 - protein, 9 aa, Homo Sapiens
LRVRSLPGK

SEQ ID NO: 990176 - protein, 9 aa, Homo Sapiens
LHLSPLAPG

SEQ ID NO: 990177 - protein, 9 aa, Homo Sapiens
RNMVLSYEL

SEQ ID NO: 990178 - protein, 9 aa, Homo Sapiens
FSWCIWKQK

SEQ ID NO: 990179 - protein, 9 aa, Homo Sapiens
AFQYVKENR

SEQ ID NO: 990180 - protein, 9 aa, Homo Sapiens
NGKVLYYKL

SEQ ID NO: 990181 - protein, 9 aa, Homo Sapiens
LEKGFHEVD

SEQ ID NO: 990182 - protein, 9 aa, Homo Sapiens
SHLNKEETH

SEQ ID NO: 990183 - protein, 9 aa, Homo Sapiens
RSLSYHDGA

SEQ ID NO: 990184 - protein, 9 aa, Homo Sapiens
APWLFGYRS

SEQ ID NO: 990185 - protein, 9 aa, Homo Sapiens
LSAPPRPAQ

SEQ ID NO: 990186 - protein, 9 aa, Homo Sapiens
PEFLFEVQC

SEQ ID NO: 990187 - protein, 9 aa, Homo Sapiens
SIEIYTYGQ

SEQ ID NO: 990188 - protein, 9 aa, Homo Sapiens
RDCQTKTTP

SEQ ID NO: 990189 - protein, 9 aa, Homo Sapiens
CWLRDNLGI

SEQ ID NO: 990190 - protein, 9 aa, Homo Sapiens
LSWEARHGG

SEQ ID NO: 990191 - protein, 9 aa, Homo Sapiens
ELDCMKEGK

SEQ ID NO: 990192 - protein, 9 aa, Homo Sapiens
GKLVCNDKN

SEQ ID NO: 990193 - protein, 9 aa, Homo Sapiens
GLVASYKVG

SEQ ID NO: 990194 - protein, 9 aa, Homo Sapiens
YSHLLYQQS

SEQ ID NO: 990195 - protein, 9 aa, Homo Sapiens
GLKSLFAYC

SEQ ID NO: 990196 - protein, 9 aa, Homo Sapiens
LRSRAVHRL

SEQ ID NO: 990197 - protein, 9 aa, Homo Sapiens
EEECWNEHS

SEQ ID NO: 990198 - protein, 9 aa, Homo Sapiens
PPGFLGLPG

SEQ ID NO: 990199 - protein, 9 aa, Homo Sapiens
LLFLLWRQS

SEQ ID NO: 990200 - protein, 9 aa, Homo Sapiens
VQKVIHTEN

SEQ ID NO: 990201 - protein, 9 aa, Homo Sapiens
IIEEESRTG

SEQ ID NO: 990202 - protein, 9 aa, Homo Sapiens
AEEKKAPSQ

SEQ ID NO: 990203 - protein, 9 aa, Homo Sapiens
KLPYQENAT

SEQ ID NO: 990204 - protein, 9 aa, Homo Sapiens
GEVSDGYVV

SEQ ID NO: 990205 - protein, 9 aa, Homo Sapiens
DFLDCYIEC

SEQ ID NO: 990206 - protein, 9 aa, Homo Sapiens
QEIVQKQTF

SEQ ID NO: 990207 - protein, 9 aa, Homo Sapiens
CGKFFNHSS

SEQ ID NO: 990208 - protein, 9 aa, Homo Sapiens
PTCHFNDGD

SEQ ID NO: 990209 - protein, 9 aa, Homo Sapiens
PGFPGTPGS

SEQ ID NO: 990210 - protein, 9 aa, Homo Sapiens
SNGQVLDTV

SEQ ID NO: 990211 - protein, 9 aa, Homo Sapiens
KDSFSFNFV

SEQ ID NO: 990212 - protein, 9 aa, Homo Sapiens
DISFGSLCE

SEQ ID NO: 990213 - protein, 9 aa, Homo Sapiens
NVNTTSAGC

SEQ ID NO: 990214 - protein, 9 aa, Homo Sapiens
ERNMRRKLF

SEQ ID NO: 990215 - protein, 9 aa, Homo Sapiens
KIAWKKKED

SEQ ID NO: 990216 - protein, 9 aa, Homo Sapiens
GVLKCNISD

SEQ ID NO: 990217 - protein, 9 aa, Homo Sapiens
PCSMLENFL

SEQ ID NO: 990218 - protein, 9 aa, Homo Sapiens
RKFVHPFLS

SEQ ID NO: 990219 - protein, 9 aa, Homo Sapiens
NIHRIFVRA

SEQ ID NO: 990220 - protein, 9 aa, Homo Sapiens
FITVLSYEC

SEQ ID NO: 990221 - protein, 9 aa, Homo Sapiens
TKLYSLDSD

SEQ ID NO: 990222 - protein, 9 aa, Homo Sapiens
RSLAVCEKS

SEQ ID NO: 990223 - protein, 9 aa, Homo Sapiens
RQSLKELQR

SEQ ID NO: 990224 - protein, 9 aa, Homo Sapiens
ILSASQRKK

SEQ ID NO: 990225 - protein, 9 aa, Homo Sapiens
ITDQLPRMQ

SEQ ID NO: 990226 - protein, 9 aa, Homo Sapiens
SPTEEANLL

SEQ ID NO: 990227 - protein, 9 aa, Homo Sapiens
FLCQTSKQA

SEQ ID NO: 990228 - protein, 9 aa, Homo Sapiens
HTVHSVRGQ

SEQ ID NO: 990229 - protein, 9 aa, Homo Sapiens
NRYIAVTDP

SEQ ID NO: 990230 - protein, 9 aa, Homo Sapiens
LLSAPPRPA

SEQ ID NO: 990231 - protein, 9 aa, Homo Sapiens
LRAGRPVTL

SEQ ID NO: 990232 - protein, 9 aa, Homo Sapiens
QMFFFHFLG

SEQ ID NO: 990233 - protein, 9 aa, Homo Sapiens
QKKERWINS

SEQ ID NO: 990234 - protein, 9 aa, Homo Sapiens
MLENFLGPF

SEQ ID NO: 990235 - protein, 9 aa, Homo Sapiens
SGSSQFLHG

SEQ ID NO: 990236 - protein, 9 aa, Homo Sapiens
SLPRAVLAS

SEQ ID NO: 990237 - protein, 9 aa, Homo Sapiens
FILKIINAV

SEQ ID NO: 990238 - protein, 9 aa, Homo Sapiens
HKYGIVRNS

SEQ ID NO: 990239 - protein, 9 aa, Homo Sapiens
GPITDLNSY

SEQ ID NO: 990240 - protein, 9 aa, Homo Sapiens
TTIMIRPLD

SEQ ID NO: 990241 - protein, 9 aa, Homo Sapiens
VQRHRIHSF

SEQ ID NO: 990242 - protein, 9 aa, Homo Sapiens
KIAKSHGSQ

SEQ ID NO: 990243 - protein, 9 aa, Homo Sapiens
NLCSIPVSV

SEQ ID NO: 990244 - protein, 9 aa, Homo Sapiens
LVKISTMLI

SEQ ID NO: 990245 - protein, 9 aa, Homo Sapiens
GMHIPSWFC

SEQ ID NO: 990246 - protein, 9 aa, Homo Sapiens
SLIHFNTPI

SEQ ID NO: 990247 - protein, 9 aa, Homo Sapiens
ALGQAVPEG

SEQ ID NO: 990248 - protein, 9 aa, Homo Sapiens
YRVIIFSVR

SEQ ID NO: 990249 - protein, 9 aa, Homo Sapiens
AAVRDKIDR

SEQ ID NO: 990250 - protein, 9 aa, Homo Sapiens
PVLGEIDPL

SEQ ID NO: 990251 - protein, 9 aa, Homo Sapiens
FSTCSSYMI

SEQ ID NO: 990252 - protein, 9 aa, Homo Sapiens
DRTPIFTLR

SEQ ID NO: 990253 - protein, 9 aa, Homo Sapiens
SRRNEISLI

SEQ ID NO: 990254 - protein, 9 aa, Homo Sapiens
KNKPSRLLP

SEQ ID NO: 990255 - protein, 9 aa, Homo Sapiens
TWMEPTAQE

SEQ ID NO: 990256 - protein, 9 aa, Homo Sapiens
SVQGFEALL

SEQ ID NO: 990257 - protein, 9 aa, Homo Sapiens
NELVAKSLL

SEQ ID NO: 990258 - protein, 9 aa, Homo Sapiens
CDATYKRLR

SEQ ID NO: 990259 - protein, 9 aa, Homo Sapiens
LEMEKQAAF

SEQ ID NO: 990260 - protein, 9 aa, Homo Sapiens
SVKAPALEE

SEQ ID NO: 990261 - protein, 9 aa, Homo Sapiens
ERFQARVTV

SEQ ID NO: 990262 - protein, 9 aa, Homo Sapiens
AFFWILGSM

SEQ ID NO: 990263 - protein, 9 aa, Homo Sapiens
DEDEPDDGS

SEQ ID NO: 990264 - protein, 9 aa, Homo Sapiens
HSLKWMVAG

SEQ ID NO: 990265 - protein, 9 aa, Homo Sapiens
YGRASYPKM

SEQ ID NO: 990266 - protein, 9 aa, Homo Sapiens
NKGVGVFNT

SEQ ID NO: 990267 - protein, 9 aa, Homo Sapiens
MLVFLKCEN

SEQ ID NO: 990268 - protein, 9 aa, Homo Sapiens
WDCTCNLLS

SEQ ID NO: 990269 - protein, 9 aa, Homo Sapiens
LRQSLKELQ

SEQ ID NO: 990270 - protein, 9 aa, Homo Sapiens
HRIIEINRQ

SEQ ID NO: 990271 - protein, 9 aa, Homo Sapiens
EVVLAKKCQ

SEQ ID NO: 990272 - protein, 9 aa, Homo Sapiens
KQCKDEEAV

SEQ ID NO: 990273 - protein, 9 aa, Homo Sapiens
KKILSPVDI

SEQ ID NO: 990274 - protein, 9 aa, Homo Sapiens
KENRGLDSE

SEQ ID NO: 990275 - protein, 9 aa, Homo Sapiens
EVLKRDKVT

SEQ ID NO: 990276 - protein, 9 aa, Homo Sapiens
FAVEGLRHL

SEQ ID NO: 990277 - protein, 9 aa, Homo Sapiens
DLVRLAIAL

SEQ ID NO: 990278 - protein, 9 aa, Homo Sapiens
RTKISRDLD

SEQ ID NO: 990279 - protein, 9 aa, Homo Sapiens
TDPRHPREM

SEQ ID NO: 990280 - protein, 9 aa, Homo Sapiens
RQTRNSQPL

SEQ ID NO: 990281 - protein, 9 aa, Homo Sapiens
FIDKDSTLR

SEQ ID NO: 990282 - protein, 9 aa, Homo Sapiens
TAFFWILGS

SEQ ID NO: 990283 - protein, 9 aa, Homo Sapiens
ETVFENGTQ

SEQ ID NO: 990284 - protein, 9 aa, Homo Sapiens
MRASSTLLF

SEQ ID NO: 990285 - protein, 9 aa, Homo Sapiens
PLKPLCRKP

SEQ ID NO: 990286 - protein, 9 aa, Homo Sapiens
FVLDGTDSQ

SEQ ID NO: 990287 - protein, 9 aa, Homo Sapiens
YTVQIHDEK

SEQ ID NO: 990288 - protein, 9 aa, Homo Sapiens
RSVLQVLLP

SEQ ID NO: 990289 - protein, 9 aa, Homo Sapiens
FEEISLLAV

SEQ ID NO: 990290 - protein, 9 aa, Homo Sapiens
PQSPLDDKN

SEQ ID NO: 990291 - protein, 9 aa, Homo Sapiens
ALIKKPTVD

SEQ ID NO: 990292 - protein, 9 aa, Homo Sapiens
MFYGIVTPM

SEQ ID NO: 990293 - protein, 9 aa, Homo Sapiens
INIKIRSCR

SEQ ID NO: 990294 - protein, 9 aa, Homo Sapiens
RLERDQSVS

SEQ ID NO: 990295 - protein, 9 aa, Homo Sapiens
HNLGKHLNL

SEQ ID NO: 990296 - protein, 9 aa, Homo Sapiens
CVAKNSRGK

SEQ ID NO: 990297 - protein, 9 aa, Homo Sapiens
ENLSTEEKF

SEQ ID NO: 990298 - protein, 9 aa, Homo Sapiens
KKVEADDVM

SEQ ID NO: 990299 - protein, 9 aa, Homo Sapiens
PTEPHKFPC

SEQ ID NO: 990300 - protein, 9 aa, Homo Sapiens
QGPENGCRG

SEQ ID NO: 990301 - protein, 9 aa, Homo Sapiens
SCRVGKRII

SEQ ID NO: 990302 - protein, 9 aa, Homo Sapiens
QPTTLVLTL

SEQ ID NO: 990303 - protein, 9 aa, Homo Sapiens
LWSPASCMS

SEQ ID NO: 990304 - protein, 9 aa, Homo Sapiens
ENPHSFAAL

SEQ ID NO: 990305 - protein, 9 aa, Homo Sapiens
NFFVNYSDF

SEQ ID NO: 990306 - protein, 9 aa, Homo Sapiens
ACLPMHRQT

SEQ ID NO: 990307 - protein, 9 aa, Homo Sapiens
NHTGQESIC

SEQ ID NO: 990308 - protein, 9 aa, Homo Sapiens
RPGTMGLQC

SEQ ID NO: 990309 - protein, 9 aa, Homo Sapiens
RGNCSRGRL

SEQ ID NO: 990310 - protein, 9 aa, Homo Sapiens
QPLELGAES

SEQ ID NO: 990311 - protein, 9 aa, Homo Sapiens
FDCFVVYSG

SEQ ID NO: 990312 - protein, 9 aa, Homo Sapiens
LMWRDHSEY

SEQ ID NO: 990313 - protein, 9 aa, Homo Sapiens
TRKLLEMEK

SEQ ID NO: 990314 - protein, 9 aa, Homo Sapiens
TCELSQNKQ

SEQ ID NO: 990315 - protein, 9 aa, Homo Sapiens
SRNDYKNIN

SEQ ID NO: 990316 - protein, 9 aa, Homo Sapiens
IVQKQTFTK

SEQ ID NO: 990317 - protein, 9 aa, Homo Sapiens
MLESQLEAR

SEQ ID NO: 990318 - protein, 9 aa, Homo Sapiens
REGAKGKLG

SEQ ID NO: 990319 - protein, 9 aa, Homo Sapiens
PVQEKIAKS

SEQ ID NO: 990320 - protein, 9 aa, Homo Sapiens
QTIPVSFPA

SEQ ID NO: 990321 - protein, 9 aa, Homo Sapiens
RGKLRQSLK

SEQ ID NO: 990322 - protein, 9 aa, Homo Sapiens
TTTFVRIGL

SEQ ID NO: 990323 - protein, 9 aa, Homo Sapiens
PIKRAGTTG

SEQ ID NO: 990324 - protein, 9 aa, Homo Sapiens
KVLYYKLYR

SEQ ID NO: 990325 - protein, 9 aa, Homo Sapiens
SHDRHAMAL

SEQ ID NO: 990326 - protein, 9 aa, Homo Sapiens
IIRTILRIL

SEQ ID NO: 990327 - protein, 9 aa, Homo Sapiens
RSPTWTTLS

SEQ ID NO: 990328 - protein, 9 aa, Homo Sapiens
GQNSRRRKV

SEQ ID NO: 990329 - protein, 9 aa, Homo Sapiens
SAERQKNFT

SEQ ID NO: 990330 - protein, 9 aa, Homo Sapiens
YSDPQPASK

SEQ ID NO: 990331 - protein, 9 aa, Homo Sapiens
WWHKNLTGP

SEQ ID NO: 990332 - protein, 9 aa, Homo Sapiens
HYRSKHQDE

SEQ ID NO: 990333 - protein, 9 aa, Homo Sapiens
EDEDEPDDG

SEQ ID NO: 990334 - protein, 9 aa, Homo Sapiens
EKTSDTSFT

SEQ ID NO: 990335 - protein, 9 aa, Homo Sapiens
HLALSFQII

SEQ ID NO: 990336 - protein, 9 aa, Homo Sapiens
NYGGESGSG

SEQ ID NO: 990337 - protein, 9 aa, Homo Sapiens
NIYWLDSNL

SEQ ID NO: 990338 - protein, 9 aa, Homo Sapiens
DIGVFIFSD

SEQ ID NO: 990339 - protein, 9 aa, Homo Sapiens
LGRNHSGVR

SEQ ID NO: 990340 - protein, 9 aa, Homo Sapiens
DGSYQNTKK

SEQ ID NO: 990341 - protein, 9 aa, Homo Sapiens
LSYRAEDHR

SEQ ID NO: 990342 - protein, 9 aa, Homo Sapiens
STCSSYMIV

SEQ ID NO: 990343 - protein, 9 aa, Homo Sapiens
YMARLYRKQ

SEQ ID NO: 990344 - protein, 9 aa, Homo Sapiens
EENRKNSYN

SEQ ID NO: 990345 - protein, 9 aa, Homo Sapiens
LRNNKVRNA

SEQ ID NO: 990346 - protein, 9 aa, Homo Sapiens
TRNSQPLEY

SEQ ID NO: 990347 - protein, 9 aa, Homo Sapiens
ISIVLLLKA

SEQ ID NO: 990348 - protein, 9 aa, Homo Sapiens
HCLLLELCV

SEQ ID NO: 990349 - protein, 9 aa, Homo Sapiens
FVVCWTLIH

SEQ ID NO: 990350 - protein, 9 aa, Homo Sapiens
KLRENPHSF

SEQ ID NO: 990351 - protein, 9 aa, Homo Sapiens
EGPITVNNY

SEQ ID NO: 990352 - protein, 9 aa, Homo Sapiens
FKRRMWPSA

SEQ ID NO: 990353 - protein, 9 aa, Homo Sapiens
QESYAHETK

SEQ ID NO: 990354 - protein, 9 aa, Homo Sapiens
LNLMERVEW

SEQ ID NO: 990355 - protein, 9 aa, Homo Sapiens
FNSNSQAAA

SEQ ID NO: 990356 - protein, 9 aa, Homo Sapiens
SAEESLVNP

SEQ ID NO: 990357 - protein, 9 aa, Homo Sapiens
LPGVPEIPG

SEQ ID NO: 990358 - protein, 9 aa, Homo Sapiens
GPPGYGPQE

SEQ ID NO: 990359 - protein, 9 aa, Homo Sapiens
SVTLTESQF

SEQ ID NO: 990360 - protein, 9 aa, Homo Sapiens
GPENGCRGG

SEQ ID NO: 990361 - protein, 9 aa, Homo Sapiens
EEYNLESID

SEQ ID NO: 990362 - protein, 9 aa, Homo Sapiens
TTLVLTLKT

SEQ ID NO: 990363 - protein, 9 aa, Homo Sapiens
CELSQNKQK

SEQ ID NO: 990364 - protein, 9 aa, Homo Sapiens
ICTDSWTTV

SEQ ID NO: 990365 - protein, 9 aa, Homo Sapiens
ERGKKGRKR

SEQ ID NO: 990366 - protein, 9 aa, Homo Sapiens
SCSGSSITE

SEQ ID NO: 990367 - protein, 9 aa, Homo Sapiens
ISFYSTDYN

SEQ ID NO: 990368 - protein, 9 aa, Homo Sapiens
SYSYDWRTK

SEQ ID NO: 990369 - protein, 9 aa, Homo Sapiens
KGKLGPPGP

SEQ ID NO: 990370 - protein, 9 aa, Homo Sapiens
HQRLYIGEK

SEQ ID NO: 990371 - protein, 9 aa, Homo Sapiens
KKNDYSPER

SEQ ID NO: 990372 - protein, 9 aa, Homo Sapiens
KLGGINSED

SEQ ID NO: 990373 - protein, 9 aa, Homo Sapiens
CGNQANEDN

SEQ ID NO: 990374 - protein, 9 aa, Homo Sapiens
KQEKKLLPE

SEQ ID NO: 990375 - protein, 9 aa, Homo Sapiens
CAMTSLILV

SEQ ID NO: 990376 - protein, 9 aa, Homo Sapiens
STISFGNVD

SEQ ID NO: 990377 - protein, 9 aa, Homo Sapiens
FMASFFTEI

SEQ ID NO: 990378 - protein, 9 aa, Homo Sapiens
EYDNYNELV

SEQ ID NO: 990379 - protein, 9 aa, Homo Sapiens
QLEVSEEQM

SEQ ID NO: 990380 - protein, 9 aa, Homo Sapiens
PSLLVLVGP

SEQ ID NO: 990381 - protein, 9 aa, Homo Sapiens
LRSLSYHDG

SEQ ID NO: 990382 - protein, 9 aa, Homo Sapiens
RDSFVLDGT

SEQ ID NO: 990383 - protein, 9 aa, Homo Sapiens
IVKRVGNSE

SEQ ID NO: 990384 - protein, 9 aa, Homo Sapiens
HPGTLFPLK

SEQ ID NO: 990385 - protein, 9 aa, Homo Sapiens
LDRMKNYNI

SEQ ID NO: 990386 - protein, 9 aa, Homo Sapiens
LKSGGFLVI

SEQ ID NO: 990387 - protein, 9 aa, Homo Sapiens
VVHIRYYRM

SEQ ID NO: 990388 - protein, 9 aa, Homo Sapiens
PHIFYPPLH

SEQ ID NO: 990389 - protein, 9 aa, Homo Sapiens
LCRKPGLFL

SEQ ID NO: 990390 - protein, 9 aa, Homo Sapiens
PFIYTLRNT

SEQ ID NO: 990391 - protein, 9 aa, Homo Sapiens
PGYGPQEEP

SEQ ID NO: 990392 - protein, 9 aa, Homo Sapiens
NAIGRKATF

SEQ ID NO: 990393 - protein, 9 aa, Homo Sapiens
CPIEPPPSP

SEQ ID NO: 990394 - protein, 9 aa, Homo Sapiens
YEIFQEKKK

SEQ ID NO: 990395 - protein, 9 aa, Homo Sapiens
YRDHSESSF

SEQ ID NO: 990396 - protein, 9 aa, Homo Sapiens
EEGRDEYNE

SEQ ID NO: 990397 - protein, 9 aa, Homo Sapiens
RFHQIPNSL

SEQ ID NO: 990398 - protein, 9 aa, Homo Sapiens
YNITDVEFE

SEQ ID NO: 990399 - protein, 9 aa, Homo Sapiens
RVRPGECFG

SEQ ID NO: 990400 - protein, 9 aa, Homo Sapiens
NKMCPNITR

SEQ ID NO: 990401 - protein, 9 aa, Homo Sapiens
LEEYRFNGF

SEQ ID NO: 990402 - protein, 9 aa, Homo Sapiens
LAWQLKTTE

SEQ ID NO: 990403 - protein, 9 aa, Homo Sapiens
GVCHEPGLQ

SEQ ID NO: 990404 - protein, 9 aa, Homo Sapiens
QTKTTPHTQ

SEQ ID NO: 990405 - protein, 9 aa, Homo Sapiens
SDRRARSRF

SEQ ID NO: 990406 - protein, 9 aa, Homo Sapiens
ESFANVSID

SEQ ID NO: 990407 - protein, 9 aa, Homo Sapiens
FAYTTFKKQ

SEQ ID NO: 990408 - protein, 9 aa, Homo Sapiens
QWSNPTQQT

SEQ ID NO: 990409 - protein, 9 aa, Homo Sapiens
KKKPFHSVP

SEQ ID NO: 990410 - protein, 9 aa, Homo Sapiens
VTIETHARD

SEQ ID NO: 990411 - protein, 9 aa, Homo Sapiens
DKDEGAEMS

SEQ ID NO: 990412 - protein, 9 aa, Homo Sapiens
RIIEEESRT

SEQ ID NO: 990413 - protein, 9 aa, Homo Sapiens
YRHLPLCPA

SEQ ID NO: 990414 - protein, 9 aa, Homo Sapiens
WLQRLQKSL

SEQ ID NO: 990415 - protein, 9 aa, Homo Sapiens
NEKEYPLGR

SEQ ID NO: 990416 - protein, 9 aa, Homo Sapiens
FLLFDKKPI

SEQ ID NO: 990417 - protein, 9 aa, Homo Sapiens
RNQTEKFPE

SEQ ID NO: 990418 - protein, 9 aa, Homo Sapiens
LIVELLFQR

SEQ ID NO: 990419 - protein, 9 aa, Homo Sapiens
WIRNKKSKS

SEQ ID NO: 990420 - protein, 9 aa, Homo Sapiens
PSAALVITS

SEQ ID NO: 990421 - protein, 9 aa, Homo Sapiens
GVGDGNEDT

SEQ ID NO: 990422 - protein, 9 aa, Homo Sapiens
SYGTRRSPA

SEQ ID NO: 990423 - protein, 9 aa, Homo Sapiens
LRSLHLSPL

SEQ ID NO: 990424 - protein, 9 aa, Homo Sapiens
VFEENGSCV

SEQ ID NO: 990425 - protein, 9 aa, Homo Sapiens
LGKIDGRGG

SEQ ID NO: 990426 - protein, 9 aa, Homo Sapiens
GEPGVSGDA

SEQ ID NO: 990427 - protein, 9 aa, Homo Sapiens
FCSILPKAA

SEQ ID NO: 990428 - protein, 9 aa, Homo Sapiens
RNKGVVGGE

SEQ ID NO: 990429 - protein, 9 aa, Homo Sapiens
TKQLLSEQF

SEQ ID NO: 990430 - protein, 9 aa, Homo Sapiens
HLNLMERVE

SEQ ID NO: 990431 - protein, 9 aa, Homo Sapiens
EKFPEVTLQ

SEQ ID NO: 990432 - protein, 9 aa, Homo Sapiens
QRQNGSAAM

SEQ ID NO: 990433 - protein, 9 aa, Homo Sapiens
KRKDAMENT

SEQ ID NO: 990434 - protein, 9 aa, Homo Sapiens
DQQPNLPSP

SEQ ID NO: 990435 - protein, 9 aa, Homo Sapiens
TSVRKAAQQ

SEQ ID NO: 990436 - protein, 9 aa, Homo Sapiens
QEKDGKINF

SEQ ID NO: 990437 - protein, 9 aa, Homo Sapiens
LHCLKKTTN

SEQ ID NO: 990438 - protein, 9 aa, Homo Sapiens
TYKPVEAAE

SEQ ID NO: 990439 - protein, 9 aa, Homo Sapiens
ASYKVGQDL

SEQ ID NO: 990440 - protein, 9 aa, Homo Sapiens
VISVVEKKI

SEQ ID NO: 990441 - protein, 9 aa, Homo Sapiens
AEPEVLPAE

SEQ ID NO: 990442 - protein, 9 aa, Homo Sapiens
NGCRGGFGS

SEQ ID NO: 990443 - protein, 9 aa, Homo Sapiens
ALNIHRIFV

SEQ ID NO: 990444 - protein, 9 aa, Homo Sapiens
GYAGVPQHA

SEQ ID NO: 990445 - protein, 9 aa, Homo Sapiens
QPQNWPEQY

SEQ ID NO: 990446 - protein, 9 aa, Homo Sapiens
WALSDLEKN

SEQ ID NO: 990447 - protein, 9 aa, Homo Sapiens
EALYQKVFS

SEQ ID NO: 990448 - protein, 9 aa, Homo Sapiens
SQESYAHET

SEQ ID NO: 990449 - protein, 9 aa, Homo Sapiens
KLLATVFQG

SEQ ID NO: 990450 - protein, 9 aa, Homo Sapiens
GQPVDFVDQ

SEQ ID NO: 990451 - protein, 9 aa, Homo Sapiens
YQQRLAVIL

SEQ ID NO: 990452 - protein, 9 aa, Homo Sapiens
YFSTLEWEK

SEQ ID NO: 990453 - protein, 9 aa, Homo Sapiens
TKKQSEPLK

SEQ ID NO: 990454 - protein, 9 aa, Homo Sapiens
GDIRQDSSD

SEQ ID NO: 990455 - protein, 9 aa, Homo Sapiens
QVSTLGKRV

SEQ ID NO: 990456 - protein, 9 aa, Homo Sapiens
SPDHLYFFR

SEQ ID NO: 990457 - protein, 9 aa, Homo Sapiens
RRNPGVAWE

SEQ ID NO: 990458 - protein, 9 aa, Homo Sapiens
AISYSDKGP

SEQ ID NO: 990459 - protein, 9 aa, Homo Sapiens
ASVFPSMPF

SEQ ID NO: 990460 - protein, 9 aa, Homo Sapiens
MHRQTFSLN

SEQ ID NO: 990461 - protein, 9 aa, Homo Sapiens
KVNLLSGFM

SEQ ID NO: 990462 - protein, 9 aa, Homo Sapiens
TASVFPSMP

SEQ ID NO: 990463 - protein, 9 aa, Homo Sapiens
YFSLLNAIA

SEQ ID NO: 990464 - protein, 9 aa, Homo Sapiens
LKGPSTEEI

SEQ ID NO: 990465 - protein, 9 aa, Homo Sapiens
AGKRKAAHV

SEQ ID NO: 990466 - protein, 9 aa, Homo Sapiens
MMTKADNNN

SEQ ID NO: 990467 - protein, 9 aa, Homo Sapiens
TKFEVVLYL

SEQ ID NO: 990468 - protein, 9 aa, Homo Sapiens
VSKMLVNFL

SEQ ID NO: 990469 - protein, 9 aa, Homo Sapiens
TSSNDLGKN

SEQ ID NO: 990470 - protein, 9 aa, Homo Sapiens
ELIRVIQRL

SEQ ID NO: 990471 - protein, 9 aa, Homo Sapiens
SPSSSLLPA

SEQ ID NO: 990472 - protein, 9 aa, Homo Sapiens
KKEIEDIQN

SEQ ID NO: 990473 - protein, 9 aa, Homo Sapiens
EAYGEDENP

SEQ ID NO: 990474 - protein, 9 aa, Homo Sapiens
ECWNEHSKA

SEQ ID NO: 990475 - protein, 9 aa, Homo Sapiens
KKRKDAMEN

SEQ ID NO: 990476 - protein, 9 aa, Homo Sapiens
RYQLSAAKD

SEQ ID NO: 990477 - protein, 9 aa, Homo Sapiens
LKFESYAYT

SEQ ID NO: 990478 - protein, 9 aa, Homo Sapiens
DGVGDGNED

SEQ ID NO: 990479 - protein, 9 aa, Homo Sapiens
VNNNVTEYM

SEQ ID NO: 990480 - protein, 9 aa, Homo Sapiens
WFQNQRVKD

SEQ ID NO: 990481 - protein, 9 aa, Homo Sapiens
MQSKRKGEE

SEQ ID NO: 990482 - protein, 9 aa, Homo Sapiens
QKIFELCIK

SEQ ID NO: 990483 - protein, 9 aa, Homo Sapiens
MYLFFGSLA

SEQ ID NO: 990484 - protein, 9 aa, Homo Sapiens
HRFENSLHP

SEQ ID NO: 990485 - protein, 9 aa, Homo Sapiens
DVSQVLRLA

SEQ ID NO: 990486 - protein, 9 aa, Homo Sapiens
ELLFQRRNP

SEQ ID NO: 990487 - protein, 9 aa, Homo Sapiens
EPEVLQDLL

SEQ ID NO: 990488 - protein, 9 aa, Homo Sapiens
KKITIPITP

SEQ ID NO: 990489 - protein, 9 aa, Homo Sapiens
SKHQDEIFW

SEQ ID NO: 990490 - protein, 9 aa, Homo Sapiens
AGSVFEEIS

SEQ ID NO: 990491 - protein, 9 aa, Homo Sapiens
SRAVQDVYY

SEQ ID NO: 990492 - protein, 9 aa, Homo Sapiens
ALLKKYENL

SEQ ID NO: 990493 - protein, 9 aa, Homo Sapiens
LDCYIECVI

SEQ ID NO: 990494 - protein, 9 aa, Homo Sapiens
PVSCVCMQP

SEQ ID NO: 990495 - protein, 9 aa, Homo Sapiens
AHCLLLELC

SEQ ID NO: 990496 - protein, 9 aa, Homo Sapiens
QTAPWLFGY

SEQ ID NO: 990497 - protein, 9 aa, Homo Sapiens
NIQLKWKND

SEQ ID NO: 990498 - protein, 9 aa, Homo Sapiens
EKLQGKQHM

SEQ ID NO: 990499 - protein, 9 aa, Homo Sapiens
DKDSTLRRL

SEQ ID NO: 990500 - protein, 9 aa, Homo Sapiens
SEVGVPGSR

SEQ ID NO: 990501 - protein, 9 aa, Homo Sapiens
SLRSTTIMI

SEQ ID NO: 990502 - protein, 9 aa, Homo Sapiens
KDTTTFVRI

SEQ ID NO: 990503 - protein, 9 aa, Homo Sapiens
PLKITLLAP

SEQ ID NO: 990504 - protein, 9 aa, Homo Sapiens
ISHQNIYTE

SEQ ID NO: 990505 - protein, 9 aa, Homo Sapiens
QESICSQAI

SEQ ID NO: 990506 - protein, 9 aa, Homo Sapiens
HTFLDKKNW

SEQ ID NO: 990507 - protein, 9 aa, Homo Sapiens
GKHVFVEYP

SEQ ID NO: 990508 - protein, 9 aa, Homo Sapiens
VIVTVALGV

SEQ ID NO: 990509 - protein, 9 aa, Homo Sapiens
RSSYPQDFH

SEQ ID NO: 990510 - protein, 9 aa, Homo Sapiens
DKILYNKFN

SEQ ID NO: 990511 - protein, 9 aa, Homo Sapiens
ETFGQYSLQ

SEQ ID NO: 990512 - protein, 9 aa, Homo Sapiens
FIPPLKVSV

SEQ ID NO: 990513 - protein, 9 aa, Homo Sapiens
SQLEAREPK

SEQ ID NO: 990514 - protein, 9 aa, Homo Sapiens
HSFHVRQDS

SEQ ID NO: 990515 - protein, 9 aa, Homo Sapiens
MLVHFLSEK

SEQ ID NO: 990516 - protein, 9 aa, Homo Sapiens
RIYYNITDV

SEQ ID NO: 990517 - protein, 9 aa, Homo Sapiens
VYSPKVPSI

SEQ ID NO: 990518 - protein, 9 aa, Homo Sapiens
LRFEACCYP

SEQ ID NO: 990519 - protein, 9 aa, Homo Sapiens
EMCETRKAD

SEQ ID NO: 990520 - protein, 9 aa, Homo Sapiens
HSFGLGGGG

SEQ ID NO: 990521 - protein, 9 aa, Homo Sapiens
QRKPESFAN

SEQ ID NO: 990522 - protein, 9 aa, Homo Sapiens
PQLRAKEAS

SEQ ID NO: 990523 - protein, 9 aa, Homo Sapiens
IRTKDNDYF

SEQ ID NO: 990524 - protein, 9 aa, Homo Sapiens
REFVHCKGK

SEQ ID NO: 990525 - protein, 9 aa, Homo Sapiens
VASYKVGQD

SEQ ID NO: 990526 - protein, 9 aa, Homo Sapiens
LLLKMEQLE

SEQ ID NO: 990527 - protein, 9 aa, Homo Sapiens
STEGGKTFC

SEQ ID NO: 990528 - protein, 9 aa, Homo Sapiens
EYNLESIDW

SEQ ID NO: 990529 - protein, 9 aa, Homo Sapiens
SPGLCRALE

SEQ ID NO: 990530 - protein, 9 aa, Homo Sapiens
EVAQRKPES

SEQ ID NO: 990531 - protein, 9 aa, Homo Sapiens
SPVGMVFYP

SEQ ID NO: 990532 - protein, 9 aa, Homo Sapiens
LKIINAVPF

SEQ ID NO: 990533 - protein, 9 aa, Homo Sapiens
GKLVHRFQE

SEQ ID NO: 990534 - protein, 9 aa, Homo Sapiens
ISQEIMKKY

SEQ ID NO: 990535 - protein, 9 aa, Homo Sapiens
KCFMASFFT

SEQ ID NO: 990536 - protein, 9 aa, Homo Sapiens
IKRAGTTGS

SEQ ID NO: 990537 - protein, 9 aa, Homo Sapiens
RGPHPSTSD

SEQ ID NO: 990538 - protein, 9 aa, Homo Sapiens
TVHSVRGQA

SEQ ID NO: 990539 - protein, 9 aa, Homo Sapiens
AVMLLPKLQ

SEQ ID NO: 990540 - protein, 9 aa, Homo Sapiens
ESYDELFQI

SEQ ID NO: 990541 - protein, 9 aa, Homo Sapiens
GMVFYPRSH

SEQ ID NO: 990542 - protein, 9 aa, Homo Sapiens
MWWALRPLG

SEQ ID NO: 990543 - protein, 9 aa, Homo Sapiens
LRPCDRKAR

SEQ ID NO: 990544 - protein, 9 aa, Homo Sapiens
EKDVARQRD

SEQ ID NO: 990545 - protein, 9 aa, Homo Sapiens
KFDPNATQF

SEQ ID NO: 990546 - protein, 9 aa, Homo Sapiens
GNVDCDFCP

SEQ ID NO: 990547 - protein, 9 aa, Homo Sapiens
GKLRENPHS

SEQ ID NO: 990548 - protein, 9 aa, Homo Sapiens
FPMYFFLAY

SEQ ID NO: 990549 - protein, 9 aa, Homo Sapiens
TESVSQSSH

SEQ ID NO: 990550 - protein, 9 aa, Homo Sapiens
FVDQNKQNL

SEQ ID NO: 990551 - protein, 9 aa, Homo Sapiens
YLLLDMGLG

SEQ ID NO: 990552 - protein, 9 aa, Homo Sapiens
EKKWKGLLT

SEQ ID NO: 990553 - protein, 9 aa, Homo Sapiens
AKEASDSAA

SEQ ID NO: 990554 - protein, 9 aa, Homo Sapiens
SNPTQQTLY

SEQ ID NO: 990555 - protein, 9 aa, Homo Sapiens
KLIKTENLA

SEQ ID NO: 990556 - protein, 9 aa, Homo Sapiens
PASCMSVQV

SEQ ID NO: 990557 - protein, 9 aa, Homo Sapiens
FPRQAPGSQ

SEQ ID NO: 990558 - protein, 9 aa, Homo Sapiens
QSPLDDKND

SEQ ID NO: 990559 - protein, 9 aa, Homo Sapiens
DRWSLRQLI

SEQ ID NO: 990560 - protein, 9 aa, Homo Sapiens
IHDEKAKSQ

SEQ ID NO: 990561 - protein, 9 aa, Homo Sapiens
EEANLLTEL

SEQ ID NO: 990562 - protein, 9 aa, Homo Sapiens
PQSGNGSRS

SEQ ID NO: 990563 - protein, 9 aa, Homo Sapiens
RKGEEGTDP

SEQ ID NO: 990564 - protein, 9 aa, Homo Sapiens
YSLRNNKVR

SEQ ID NO: 990565 - protein, 9 aa, Homo Sapiens
EHLDMAPFF

SEQ ID NO: 990566 - protein, 9 aa, Homo Sapiens
NWELSIILC

SEQ ID NO: 990567 - protein, 9 aa, Homo Sapiens
YFILFNNVD

SEQ ID NO: 990568 - protein, 9 aa, Homo Sapiens
HIFLIGWDE

SEQ ID NO: 990569 - protein, 9 aa, Homo Sapiens
QVVSLILLL

SEQ ID NO: 990570 - protein, 9 aa, Homo Sapiens
QDKLRTQRD

SEQ ID NO: 990571 - protein, 9 aa, Homo Sapiens
LSYHIFLIG

SEQ ID NO: 990572 - protein, 9 aa, Homo Sapiens
LLGTVIQNG

SEQ ID NO: 990573 - protein, 9 aa, Homo Sapiens
ELSIILCKK

SEQ ID NO: 990574 - protein, 9 aa, Homo Sapiens
GSQKVDSDL

SEQ ID NO: 990575 - protein, 9 aa, Homo Sapiens
GPEGPITVN

SEQ ID NO: 990576 - protein, 9 aa, Homo Sapiens
WWLEEYRFN

SEQ ID NO: 990577 - protein, 9 aa, Homo Sapiens
QKQKATQKA

SEQ ID NO: 990578 - protein, 9 aa, Homo Sapiens
QKLQNERKN

SEQ ID NO: 990579 - protein, 9 aa, Homo Sapiens
TRGNCSRGR

SEQ ID NO: 990580 - protein, 9 aa, Homo Sapiens
PRLKVDSRA

SEQ ID NO: 990581 - protein, 9 aa, Homo Sapiens
VFSEQGRVE

SEQ ID NO: 990582 - protein, 9 aa, Homo Sapiens
TEEANLLTE

SEQ ID NO: 990583 - protein, 9 aa, Homo Sapiens
ASKKKVKGS

SEQ ID NO: 990584 - protein, 9 aa, Homo Sapiens
QLFCIWRYN

SEQ ID NO: 990585 - protein, 9 aa, Homo Sapiens
LVTIETHAR

SEQ ID NO: 990586 - protein, 9 aa, Homo Sapiens
GKTFCILYA

SEQ ID NO: 990587 - protein, 9 aa, Homo Sapiens
EGNFLKRGS

SEQ ID NO: 990588 - protein, 9 aa, Homo Sapiens
DFLRELSQT

SEQ ID NO: 990589 - protein, 9 aa, Homo Sapiens
LVVVELLLG

SEQ ID NO: 990590 - protein, 9 aa, Homo Sapiens
FLHGQKGQH

SEQ ID NO: 990591 - protein, 9 aa, Homo Sapiens
GEKRGRCFT

SEQ ID NO: 990592 - protein, 9 aa, Homo Sapiens
LVVEDAPRQ

SEQ ID NO: 990593 - protein, 9 aa, Homo Sapiens
THCGQNSRR

SEQ ID NO: 990594 - protein, 9 aa, Homo Sapiens
WSISLGSMV

SEQ ID NO: 990595 - protein, 9 aa, Homo Sapiens
EYINTLFST

SEQ ID NO: 990596 - protein, 9 aa, Homo Sapiens
SGLSRRQME

SEQ ID NO: 990597 - protein, 9 aa, Homo Sapiens
GVAPCSGES

SEQ ID NO: 990598 - protein, 9 aa, Homo Sapiens
YGINKKITI

SEQ ID NO: 990599 - protein, 9 aa, Homo Sapiens
LSASQRKKA

SEQ ID NO: 990600 - protein, 9 aa, Homo Sapiens
TEGGKTFCI

SEQ ID NO: 990601 - protein, 9 aa, Homo Sapiens
SENEKQRQN

SEQ ID NO: 990602 - protein, 9 aa, Homo Sapiens
YNRIQSLAR

SEQ ID NO: 990603 - protein, 9 aa, Homo Sapiens
EHILPYDVV

SEQ ID NO: 990604 - protein, 9 aa, Homo Sapiens
GGESGSGGG

SEQ ID NO: 990605 - protein, 9 aa, Homo Sapiens
TFVRIGLMM

SEQ ID NO: 990606 - protein, 9 aa, Homo Sapiens
AKEKEVHDL

SEQ ID NO: 990607 - protein, 9 aa, Homo Sapiens
APLDGLTVS

SEQ ID NO: 990608 - protein, 9 aa, Homo Sapiens
AQQKRAQPP

SEQ ID NO: 990609 - protein, 9 aa, Homo Sapiens
EYYGSYSSQ

SEQ ID NO: 990610 - protein, 9 aa, Homo Sapiens
CQEQTSSRP

SEQ ID NO: 990611 - protein, 9 aa, Homo Sapiens
LKVDSRAGK

SEQ ID NO: 990612 - protein, 9 aa, Homo Sapiens
GPLQTASVF

SEQ ID NO: 990613 - protein, 9 aa, Homo Sapiens
PSSMDTRPA

SEQ ID NO: 990614 - protein, 9 aa, Homo Sapiens
HSENEKQRQ

SEQ ID NO: 990615 - protein, 9 aa, Homo Sapiens
KIYVAQFSE

SEQ ID NO: 990616 - protein, 9 aa, Homo Sapiens
YDKTSRIWF

SEQ ID NO: 990617 - protein, 9 aa, Homo Sapiens
INRYIAVTD

SEQ ID NO: 990618 - protein, 9 aa, Homo Sapiens
IAALLNVFV

SEQ ID NO: 990619 - protein, 9 aa, Homo Sapiens
VLTLEKGFH

SEQ ID NO: 990620 - protein, 9 aa, Homo Sapiens
EVPYLHFGN

SEQ ID NO: 990621 - protein, 9 aa, Homo Sapiens
FGLGGGGVM

SEQ ID NO: 990622 - protein, 9 aa, Homo Sapiens
SEKFLTPLQ

SEQ ID NO: 990623 - protein, 9 aa, Homo Sapiens
YRKFVHPFL

SEQ ID NO: 990624 - protein, 9 aa, Homo Sapiens
WNWELSIIL

SEQ ID NO: 990625 - protein, 9 aa, Homo Sapiens
FIDKVRYLE

SEQ ID NO: 990626 - protein, 9 aa, Homo Sapiens
PRGASARPP

SEQ ID NO: 990627 - protein, 9 aa, Homo Sapiens
PFPRHPHPC

SEQ ID NO: 990628 - protein, 9 aa, Homo Sapiens
PAQFGGIHF

SEQ ID NO: 990629 - protein, 9 aa, Homo Sapiens
GLLQAKEKE

SEQ ID NO: 990630 - protein, 9 aa, Homo Sapiens
EKVFSYMDQ

SEQ ID NO: 990631 - protein, 9 aa, Homo Sapiens
DKTDIPHNS

SEQ ID NO: 990632 - protein, 9 aa, Homo Sapiens
CCLCCALVA

SEQ ID NO: 990633 - protein, 9 aa, Homo Sapiens
SISLGSMVY

SEQ ID NO: 990634 - protein, 9 aa, Homo Sapiens
MNFNGNNRG

SEQ ID NO: 990635 - protein, 9 aa, Homo Sapiens
LFPLKIAQD

SEQ ID NO: 990636 - protein, 9 aa, Homo Sapiens
PGPPGFSFF

SEQ ID NO: 990637 - protein, 9 aa, Homo Sapiens
SYRPAPGRP

SEQ ID NO: 990638 - protein, 9 aa, Homo Sapiens
LGAMFATRC

SEQ ID NO: 990639 - protein, 9 aa, Homo Sapiens
KPPETSVSV

SEQ ID NO: 990640 - protein, 9 aa, Homo Sapiens
PSHTVHSVR

SEQ ID NO: 990641 - protein, 9 aa, Homo Sapiens
YAASGPRGI

SEQ ID NO: 990642 - protein, 9 aa, Homo Sapiens
ENGIDGLNR

SEQ ID NO: 990643 - protein, 9 aa, Homo Sapiens
CQLRFNSNS

SEQ ID NO: 990644 - protein, 9 aa, Homo Sapiens
IFFFFLIVY

SEQ ID NO: 990645 - protein, 9 aa, Homo Sapiens
TSVPSGSRN

SEQ ID NO: 990646 - protein, 9 aa, Homo Sapiens
STIILLFRL

SEQ ID NO: 990647 - protein, 9 aa, Homo Sapiens
LFLLLWVLF

SEQ ID NO: 990648 - protein, 9 aa, Homo Sapiens
YTLMGKWKM

SEQ ID NO: 990649 - protein, 9 aa, Homo Sapiens
GQSQGAGED

SEQ ID NO: 990650 - protein, 9 aa, Homo Sapiens
SDGYVVSRS

SEQ ID NO: 990651 - protein, 9 aa, Homo Sapiens
HKDAELAEH

SEQ ID NO: 990652 - protein, 9 aa, Homo Sapiens
YWLDSNLDQ

SEQ ID NO: 990653 - protein, 9 aa, Homo Sapiens
ENTRQEMTH

SEQ ID NO: 990654 - protein, 9 aa, Homo Sapiens
APQPLELGA

SEQ ID NO: 990655 - protein, 9 aa, Homo Sapiens
VTEHILPYD

SEQ ID NO: 990656 - protein, 9 aa, Homo Sapiens
EESEVELLV

SEQ ID NO: 990657 - protein, 9 aa, Homo Sapiens
IKTHKDSDA

SEQ ID NO: 990658 - protein, 9 aa, Homo Sapiens
KWKTLVSLA

SEQ ID NO: 990659 - protein, 9 aa, Homo Sapiens
CNISDLSLI

SEQ ID NO: 990660 - protein, 9 aa, Homo Sapiens
ALVIKNTPL

SEQ ID NO: 990661 - protein, 9 aa, Homo Sapiens
AEKIIWNYA

SEQ ID NO: 990662 - protein, 9 aa, Homo Sapiens
VALNIHRIF

SEQ ID NO: 990663 - protein, 9 aa, Homo Sapiens
AASAESADL

SEQ ID NO: 990664 - protein, 9 aa, Homo Sapiens
CRLERDQSV

SEQ ID NO: 990665 - protein, 9 aa, Homo Sapiens
VDFVDQNKQ

SEQ ID NO: 990666 - protein, 9 aa, Homo Sapiens
NESFLMDFI

SEQ ID NO: 990667 - protein, 9 aa, Homo Sapiens
SYYVKAPSD

SEQ ID NO: 990668 - protein, 9 aa, Homo Sapiens
ERKNNKKEA

SEQ ID NO: 990669 - protein, 9 aa, Homo Sapiens
INFSGPDYS

SEQ ID NO: 990670 - protein, 9 aa, Homo Sapiens
PGFSFFQEL

SEQ ID NO: 990671 - protein, 9 aa, Homo Sapiens
ENDRLQGMA

SEQ ID NO: 990672 - protein, 9 aa, Homo Sapiens
QSLYRQQSR

SEQ ID NO: 990673 - protein, 9 aa, Homo Sapiens
GLVSMFYGI

SEQ ID NO: 990674 - protein, 9 aa, Homo Sapiens
PKALNLCSI

SEQ ID NO: 990675 - protein, 9 aa, Homo Sapiens
QAVRTMKIY

SEQ ID NO: 990676 - protein, 9 aa, Homo Sapiens
SSVSSVVRC

SEQ ID NO: 990677 - protein, 9 aa, Homo Sapiens
RKGAKITEF

SEQ ID NO: 990678 - protein, 9 aa, Homo Sapiens
SGLKDYPWE

SEQ ID NO: 990679 - protein, 9 aa, Homo Sapiens
PLVHLAERK

SEQ ID NO: 990680 - protein, 9 aa, Homo Sapiens
QIHDEKAKS

SEQ ID NO: 990681 - protein, 9 aa, Homo Sapiens
HMMPEDGNL

SEQ ID NO: 990682 - protein, 9 aa, Homo Sapiens
PTDSGPKSS

SEQ ID NO: 990683 - protein, 9 aa, Homo Sapiens
PDEEDGLCH

SEQ ID NO: 990684 - protein, 9 aa, Homo Sapiens
QDFIPRLDL

SEQ ID NO: 990685 - protein, 9 aa, Homo Sapiens
RSKFMTSEL

SEQ ID NO: 990686 - protein, 9 aa, Homo Sapiens
DATYKRLRT

SEQ ID NO: 990687 - protein, 9 aa, Homo Sapiens
PLLWATASV

SEQ ID NO: 990688 - protein, 9 aa, Homo Sapiens
IVRNSAATA

SEQ ID NO: 990689 - protein, 9 aa, Homo Sapiens
SFPKSKSED

SEQ ID NO: 990690 - protein, 9 aa, Homo Sapiens
NKPSRLLPF

SEQ ID NO: 990691 - protein, 9 aa, Homo Sapiens
FVEYPMTLS

SEQ ID NO: 990692 - protein, 9 aa, Homo Sapiens
AELAEHLNA

SEQ ID NO: 990693 - protein, 9 aa, Homo Sapiens
FPSEGSSLT

SEQ ID NO: 990694 - protein, 9 aa, Homo Sapiens
QRRNPGVAW

SEQ ID NO: 990695 - protein, 9 aa, Homo Sapiens
WLEEYRFNG

SEQ ID NO: 990696 - protein, 9 aa, Homo Sapiens
PWDCTCNLL

SEQ ID NO: 990697 - protein, 9 aa, Homo Sapiens
MNLMNDCSE

SEQ ID NO: 990698 - protein, 9 aa, Homo Sapiens
AQLITQTQA

SEQ ID NO: 990699 - protein, 9 aa, Homo Sapiens
FFLARLGYS

SEQ ID NO: 990700 - protein, 9 aa, Homo Sapiens
LQWSNPTQQ

SEQ ID NO: 990701 - protein, 9 aa, Homo Sapiens
YHVPGFSRK

SEQ ID NO: 990702 - protein, 9 aa, Homo Sapiens
QRLEEATAR

SEQ ID NO: 990703 - protein, 9 aa, Homo Sapiens
TMVSTTSSE

SEQ ID NO: 990704 - protein, 9 aa, Homo Sapiens
PNINAVISL

SEQ ID NO: 990705 - protein, 9 aa, Homo Sapiens
PGPATYEIF

SEQ ID NO: 990706 - protein, 9 aa, Homo Sapiens
AEYSAIGAT

SEQ ID NO: 990707 - protein, 9 aa, Homo Sapiens
QRLSSSLVP

SEQ ID NO: 990708 - protein, 9 aa, Homo Sapiens
DDFLDCYIE

SEQ ID NO: 990709 - protein, 9 aa, Homo Sapiens
IAVQDQQPD

SEQ ID NO: 990710 - protein, 9 aa, Homo Sapiens
KRPLPVDTF

SEQ ID NO: 990711 - protein, 9 aa, Homo Sapiens
EIREDYLLS

SEQ ID NO: 990712 - protein, 9 aa, Homo Sapiens
SCMSVQVPG

SEQ ID NO: 990713 - protein, 9 aa, Homo Sapiens
YILRLEEVS

SEQ ID NO: 990714 - protein, 9 aa, Homo Sapiens
YLQLWVQKQ

SEQ ID NO: 990715 - protein, 9 aa, Homo Sapiens
LQVLLPVPR

SEQ ID NO: 990716 - protein, 9 aa, Homo Sapiens
KVYTKDRTP

SEQ ID NO: 990717 - protein, 9 aa, Homo Sapiens
LRRADIHLV

SEQ ID NO: 990718 - protein, 9 aa, Homo Sapiens
DAFDAKARE

SEQ ID NO: 990719 - protein, 9 aa, Homo Sapiens
SSEIQEPIK

SEQ ID NO: 990720 - protein, 9 aa, Homo Sapiens
ILPYDVVPS

SEQ ID NO: 990721 - protein, 9 aa, Homo Sapiens
CNCSYCWKR

SEQ ID NO: 990722 - protein, 9 aa, Homo Sapiens
YFHGLVKAT

SEQ ID NO: 990723 - protein, 9 aa, Homo Sapiens
FKVSQERLK

SEQ ID NO: 990724 - protein, 9 aa, Homo Sapiens
LAEKLAEKK

SEQ ID NO: 990725 - protein, 9 aa, Homo Sapiens
GNYGGESGS

SEQ ID NO: 990726 - protein, 9 aa, Homo Sapiens
IVRLVRIGR

SEQ ID NO: 990727 - protein, 9 aa, Homo Sapiens
KLVFSQDLL

SEQ ID NO: 990728 - protein, 9 aa, Homo Sapiens
LMKVVNKMC

SEQ ID NO: 990729 - protein, 9 aa, Homo Sapiens
LHFGNLAPG

SEQ ID NO: 990730 - protein, 9 aa, Homo Sapiens
GTLNAFILN

SEQ ID NO: 990731 - protein, 9 aa, Homo Sapiens
QVEKWKTLV

SEQ ID NO: 990732 - protein, 9 aa, Homo Sapiens
EGREGAKGK

SEQ ID NO: 990733 - protein, 9 aa, Homo Sapiens
DDRNQSREH

SEQ ID NO: 990734 - protein, 9 aa, Homo Sapiens
YKNINVSAN

SEQ ID NO: 990735 - protein, 9 aa, Homo Sapiens
SCHCALCQG

SEQ ID NO: 990736 - protein, 9 aa, Homo Sapiens
PSGEPGVSG

SEQ ID NO: 990737 - protein, 9 aa, Homo Sapiens
LSSLPVSSA

SEQ ID NO: 990738 - protein, 9 aa, Homo Sapiens
LIYSLRNNK

SEQ ID NO: 990739 - protein, 9 aa, Homo Sapiens
VFTVNLGCK

SEQ ID NO: 990740 - protein, 9 aa, Homo Sapiens
TQDIELVET

SEQ ID NO: 990741 - protein, 9 aa, Homo Sapiens
NSRMTFRER

SEQ ID NO: 990742 - protein, 9 aa, Homo Sapiens
REWEKRSKG

SEQ ID NO: 990743 - protein, 9 aa, Homo Sapiens
CPDSVTYPQ

SEQ ID NO: 990744 - protein, 9 aa, Homo Sapiens
PGGRSPGLC

SEQ ID NO: 990745 - protein, 9 aa, Homo Sapiens
EPILFYCIP

SEQ ID NO: 990746 - protein, 9 aa, Homo Sapiens
LPYDVVPSM

SEQ ID NO: 990747 - protein, 9 aa, Homo Sapiens
IEKPGVAGL

SEQ ID NO: 990748 - protein, 9 aa, Homo Sapiens
QPAPVLSPA

SEQ ID NO: 990749 - protein, 9 aa, Homo Sapiens
LWALSDLEK

SEQ ID NO: 990750 - protein, 9 aa, Homo Sapiens
LPDLKKNDY

SEQ ID NO: 990751 - protein, 9 aa, Homo Sapiens
TSSRPVIAK

SEQ ID NO: 990752 - protein, 9 aa, Homo Sapiens
QNEERLSYD

SEQ ID NO: 990753 - protein, 9 aa, Homo Sapiens
MRRMGFPGK

SEQ ID NO: 990754 - protein, 9 aa, Homo Sapiens
PGGTCWCPI

SEQ ID NO: 990755 - protein, 9 aa, Homo Sapiens
QAVFFSVFY

SEQ ID NO: 990756 - protein, 9 aa, Homo Sapiens
MSPDYPNLM

SEQ ID NO: 990757 - protein, 9 aa, Homo Sapiens
SPDVPESRQ

SEQ ID NO: 990758 - protein, 9 aa, Homo Sapiens
EAGALAVSG

SEQ ID NO: 990759 - protein, 9 aa, Homo Sapiens
LETGVECTS

SEQ ID NO: 990760 - protein, 9 aa, Homo Sapiens
RFQARVTVS

SEQ ID NO: 990761 - protein, 9 aa, Homo Sapiens
GGNYGGESG

SEQ ID NO: 990762 - protein, 9 aa, Homo Sapiens
CEDGCCCWD

SEQ ID NO: 990763 - protein, 9 aa, Homo Sapiens
FLDNFDSSY

SEQ ID NO: 990764 - protein, 9 aa, Homo Sapiens
AEPKEQPTF

SEQ ID NO: 990765 - protein, 9 aa, Homo Sapiens
RWTPAWEQQ

SEQ ID NO: 990766 - protein, 9 aa, Homo Sapiens
EVLQDLLDG

SEQ ID NO: 990767 - protein, 9 aa, Homo Sapiens
SSYPQDFHN

SEQ ID NO: 990768 - protein, 9 aa, Homo Sapiens
NSLRQRLEE

SEQ ID NO: 990769 - protein, 9 aa, Homo Sapiens
KAYSLGNLP

SEQ ID NO: 990770 - protein, 9 aa, Homo Sapiens
SKILLLKCS

SEQ ID NO: 990771 - protein, 9 aa, Homo Sapiens
TSSFSSEDK

SEQ ID NO: 990772 - protein, 9 aa, Homo Sapiens
VQDQQPDLC

SEQ ID NO: 990773 - protein, 9 aa, Homo Sapiens
NPLKPLCRK

SEQ ID NO: 990774 - protein, 9 aa, Homo Sapiens
NERKNDPTH

SEQ ID NO: 990775 - protein, 9 aa, Homo Sapiens
LRGPHPSTS

SEQ ID NO: 990776 - protein, 9 aa, Homo Sapiens
WDTLLHAAA

SEQ ID NO: 990777 - protein, 9 aa, Homo Sapiens
FHVRQDSPT

SEQ ID NO: 990778 - protein, 9 aa, Homo Sapiens
ELARAYKHA

SEQ ID NO: 990779 - protein, 9 aa, Homo Sapiens
PAGPPESQG

SEQ ID NO: 990780 - protein, 9 aa, Homo Sapiens
SFFQELSDP

SEQ ID NO: 990781 - protein, 9 aa, Homo Sapiens
SEEASDKNK

SEQ ID NO: 990782 - protein, 9 aa, Homo Sapiens
NATIFPGQS

SEQ ID NO: 990783 - protein, 9 aa, Homo Sapiens
LCCALVAAA

SEQ ID NO: 990784 - protein, 9 aa, Homo Sapiens
TVPSATSAL

SEQ ID NO: 990785 - protein, 9 aa, Homo Sapiens
YECILATIL

SEQ ID NO: 990786 - protein, 9 aa, Homo Sapiens
REEKKEKYA

SEQ ID NO: 990787 - protein, 9 aa, Homo Sapiens
PLDFKEYKM

SEQ ID NO: 990788 - protein, 9 aa, Homo Sapiens
HDFAYTTFK

SEQ ID NO: 990789 - protein, 9 aa, Homo Sapiens
VVMQELDCM

SEQ ID NO: 990790 - protein, 9 aa, Homo Sapiens
DRSFDLVAI

SEQ ID NO: 990791 - protein, 9 aa, Homo Sapiens
FYYSPVALE

SEQ ID NO: 990792 - protein, 9 aa, Homo Sapiens
AAGGKFVSE

SEQ ID NO: 990793 - protein, 9 aa, Homo Sapiens
NSEETPMIG

SEQ ID NO: 990794 - protein, 9 aa, Homo Sapiens
SATSALRRM

SEQ ID NO: 990795 - protein, 9 aa, Homo Sapiens
PTLDLSRSC

SEQ ID NO: 990796 - protein, 9 aa, Homo Sapiens
AFFLARLGY

SEQ ID NO: 990797 - protein, 9 aa, Homo Sapiens
WFCSILPKA

SEQ ID NO: 990798 - protein, 9 aa, Homo Sapiens
PKELLKKKP

SEQ ID NO: 990799 - protein, 9 aa, Homo Sapiens
INRLLALIK

SEQ ID NO: 990800 - protein, 9 aa, Homo Sapiens
SASNPFLND

SEQ ID NO: 990801 - protein, 9 aa, Homo Sapiens
VIPIKRAGT

SEQ ID NO: 990802 - protein, 9 aa, Homo Sapiens
LSPMLPEFW

SEQ ID NO: 990803 - protein, 9 aa, Homo Sapiens
ELNSNNIGN

SEQ ID NO: 990804 - protein, 9 aa, Homo Sapiens
EKNTPSPVS

SEQ ID NO: 990805 - protein, 9 aa, Homo Sapiens
DFEWHRGYS

SEQ ID NO: 990806 - protein, 9 aa, Homo Sapiens
HLYFFRILH

SEQ ID NO: 990807 - protein, 9 aa, Homo Sapiens
TTPKTVRSE

SEQ ID NO: 990808 - protein, 9 aa, Homo Sapiens
LENFLGPFP

SEQ ID NO: 990809 - protein, 9 aa, Homo Sapiens
GKRIIEEES

SEQ ID NO: 990810 - protein, 9 aa, Homo Sapiens
GFCRRPASS

SEQ ID NO: 990811 - protein, 9 aa, Homo Sapiens
SSQAVMLLP

SEQ ID NO: 990812 - protein, 9 aa, Homo Sapiens
EASDKNKGV

SEQ ID NO: 990813 - protein, 9 aa, Homo Sapiens
NKSAWLKDT

SEQ ID NO: 990814 - protein, 9 aa, Homo Sapiens
ACFLSRDET

SEQ ID NO: 990815 - protein, 9 aa, Homo Sapiens
DSSYDKDGL

SEQ ID NO: 990816 - protein, 9 aa, Homo Sapiens
SVAYAASGP

SEQ ID NO: 990817 - protein, 9 aa, Homo Sapiens
LSEGEDPIF

SEQ ID NO: 990818 - protein, 9 aa, Homo Sapiens
RLYRKQPQN

SEQ ID NO: 990819 - protein, 9 aa, Homo Sapiens
KKVPTTDID

SEQ ID NO: 990820 - protein, 9 aa, Homo Sapiens
WCPIQGLVE

SEQ ID NO: 990821 - protein, 9 aa, Homo Sapiens
LLWRQSCRR

SEQ ID NO: 990822 - protein, 9 aa, Homo Sapiens
SSLVPGNPF

SEQ ID NO: 990823 - protein, 9 aa, Homo Sapiens
AERNMRRKL

SEQ ID NO: 990824 - protein, 9 aa, Homo Sapiens
LKIEMNKRQ

SEQ ID NO: 990825 - protein, 9 aa, Homo Sapiens
PLPREQPRR

SEQ ID NO: 990826 - protein, 9 aa, Homo Sapiens
FLALDVPRR

SEQ ID NO: 990827 - protein, 9 aa, Homo Sapiens
FKDSKNPVV

SEQ ID NO: 990828 - protein, 9 aa, Homo Sapiens
LLLELCVQY

SEQ ID NO: 990829 - protein, 9 aa, Homo Sapiens
QLDLEPRGA

SEQ ID NO: 990830 - protein, 9 aa, Homo Sapiens
FSVFYFASV

SEQ ID NO: 990831 - protein, 9 aa, Homo Sapiens
RELLRLGKI

SEQ ID NO: 990832 - protein, 9 aa, Homo Sapiens
KRGRCFTIE

SEQ ID NO: 990833 - protein, 9 aa, Homo Sapiens
CWCPIQGLV

SEQ ID NO: 990834 - protein, 9 aa, Homo Sapiens
EKSCQLSDI

SEQ ID NO: 990835 - protein, 9 aa, Homo Sapiens
NRYLAIVHA

SEQ ID NO: 990836 - protein, 9 aa, Homo Sapiens
VFSASTSLR

SEQ ID NO: 990837 - protein, 9 aa, Homo Sapiens
VSVVTPTAS

SEQ ID NO: 990838 - protein, 9 aa, Homo Sapiens
VALGVLKRQ

SEQ ID NO: 990839 - protein, 9 aa, Homo Sapiens
RFLEQRIVE

SEQ ID NO: 990840 - protein, 9 aa, Homo Sapiens
GHSAEESLV

SEQ ID NO: 990841 - protein, 9 aa, Homo Sapiens
RLTPVGVVV

SEQ ID NO: 990842 - protein, 9 aa, Homo Sapiens
KLAQKKERW

SEQ ID NO: 990843 - protein, 9 aa, Homo Sapiens
ISFSECKIQ

SEQ ID NO: 990844 - protein, 9 aa, Homo Sapiens
EKKILAVVR

SEQ ID NO: 990845 - protein, 9 aa, Homo Sapiens
WGTRGNCSR

SEQ ID NO: 990846 - protein, 9 aa, Homo Sapiens
KVGQDLTVM

SEQ ID NO: 990847 - protein, 9 aa, Homo Sapiens
QVPCSYSAH

SEQ ID NO: 990848 - protein, 9 aa, Homo Sapiens
LPVSCVCMQ

SEQ ID NO: 990849 - protein, 9 aa, Homo Sapiens
PFTHASTHY

SEQ ID NO: 990850 - protein, 9 aa, Homo Sapiens
LGSLLKSGG

SEQ ID NO: 990851 - protein, 9 aa, Homo Sapiens
CITAASYRG

SEQ ID NO: 990852 - protein, 9 aa, Homo Sapiens
VLGEIDPLC

SEQ ID NO: 990853 - protein, 9 aa, Homo Sapiens
KSLFAYCMM

SEQ ID NO: 990854 - protein, 9 aa, Homo Sapiens
ETTMVSTTS

SEQ ID NO: 990855 - protein, 9 aa, Homo Sapiens
APADLLIKA

SEQ ID NO: 990856 - protein, 9 aa, Homo Sapiens
LYRKQPQNW

SEQ ID NO: 990857 - protein, 9 aa, Homo Sapiens
SGAVSTRVR

SEQ ID NO: 990858 - protein, 9 aa, Homo Sapiens
DKKNWTGNE

SEQ ID NO: 990859 - protein, 9 aa, Homo Sapiens
FPRLAASPE

SEQ ID NO: 990860 - protein, 9 aa, Homo Sapiens
SSLWEMVQD

SEQ ID NO: 990861 - protein, 9 aa, Homo Sapiens
KDGKINFTI

SEQ ID NO: 990862 - protein, 9 aa, Homo Sapiens
HAAKYLPVY

SEQ ID NO: 990863 - protein, 9 aa, Homo Sapiens
ITKLYSLDS

SEQ ID NO: 990864 - protein, 9 aa, Homo Sapiens
REFYSSQFQ

SEQ ID NO: 990865 - protein, 9 aa, Homo Sapiens
KVDSRAGKN

SEQ ID NO: 990866 - protein, 9 aa, Homo Sapiens
PYSHLLYQQ

SEQ ID NO: 990867 - protein, 9 aa, Homo Sapiens
KEKLRSLSL

SEQ ID NO: 990868 - protein, 9 aa, Homo Sapiens
FYSTDYNLV

SEQ ID NO: 990869 - protein, 9 aa, Homo Sapiens
LALVIKNTP

SEQ ID NO: 990870 - protein, 9 aa, Homo Sapiens
GFSFFQELS

SEQ ID NO: 990871 - protein, 9 aa, Homo Sapiens
DSVWPCQPL

SEQ ID NO: 990872 - protein, 9 aa, Homo Sapiens
RNHSGVRNV

SEQ ID NO: 990873 - protein, 9 aa, Homo Sapiens
SQLFCIWRY

SEQ ID NO: 990874 - protein, 9 aa, Homo Sapiens
PRQTPLTAR

SEQ ID NO: 990875 - protein, 9 aa, Homo Sapiens
QLKELCYGK

SEQ ID NO: 990876 - protein, 9 aa, Homo Sapiens
QNGNVIQLL

SEQ ID NO: 990877 - protein, 9 aa, Homo Sapiens
ARNQTEKFP

SEQ ID NO: 990878 - protein, 9 aa, Homo Sapiens
LDMGLGTIK

SEQ ID NO: 990879 - protein, 9 aa, Homo Sapiens
TYTVQIHDE

SEQ ID NO: 990880 - protein, 9 aa, Homo Sapiens
HGTGILKIT

SEQ ID NO: 990881 - protein, 9 aa, Homo Sapiens
QEGQLEVSE

SEQ ID NO: 990882 - protein, 9 aa, Homo Sapiens
RVIPIKRAG

SEQ ID NO: 990883 - protein, 9 aa, Homo Sapiens
QREFQQKLL

SEQ ID NO: 990884 - protein, 9 aa, Homo Sapiens
SRNSSLLER

SEQ ID NO: 990885 - protein, 9 aa, Homo Sapiens
AIQAASSFS

SEQ ID NO: 990886 - protein, 9 aa, Homo Sapiens
GSVIDLIKN

SEQ ID NO: 990887 - protein, 9 aa, Homo Sapiens
CWKRDGRCA

SEQ ID NO: 990888 - protein, 9 aa, Homo Sapiens
ITVLSYECI

SEQ ID NO: 990889 - protein, 9 aa, Homo Sapiens
GICNCSYCW

SEQ ID NO: 990890 - protein, 9 aa, Homo Sapiens
LDCMKEGKL

SEQ ID NO: 990891 - protein, 9 aa, Homo Sapiens
EEEGRDEYN

SEQ ID NO: 990892 - protein, 9 aa, Homo Sapiens
EMRMMMNFN

SEQ ID NO: 990893 - protein, 9 aa, Homo Sapiens
ETASSTKPL

SEQ ID NO: 990894 - protein, 9 aa, Homo Sapiens
KFVHPFLSR

SEQ ID NO: 990895 - protein, 9 aa, Homo Sapiens
LSYDCEPNR

SEQ ID NO: 990896 - protein, 9 aa, Homo Sapiens
FDKKPINVQ

SEQ ID NO: 990897 - protein, 9 aa, Homo Sapiens
QPKALNLCS

SEQ ID NO: 990898 - protein, 9 aa, Homo Sapiens
RKNDPTHIQ

SEQ ID NO: 990899 - protein, 9 aa, Homo Sapiens
SSSPFSGRS

SEQ ID NO: 990900 - protein, 9 aa, Homo Sapiens
KVYFDAQKE

SEQ ID NO: 990901 - protein, 9 aa, Homo Sapiens
RENPHSFAA

SEQ ID NO: 990902 - protein, 9 aa, Homo Sapiens
TADHGPSRL

SEQ ID NO: 990903 - protein, 9 aa, Homo Sapiens
KNNIQLKWK

SEQ ID NO: 990904 - protein, 9 aa, Homo Sapiens
DDCGNQANE

SEQ ID NO: 990905 - protein, 9 aa, Homo Sapiens
WPSAFGSGM

SEQ ID NO: 990906 - protein, 9 aa, Homo Sapiens
PKEQPTFET

SEQ ID NO: 990907 - protein, 9 aa, Homo Sapiens
RGSPGPPED

SEQ ID NO: 990908 - protein, 9 aa, Homo Sapiens
SVISGRFRY

SEQ ID NO: 990909 - protein, 9 aa, Homo Sapiens
PARFEAQKG

SEQ ID NO: 990910 - protein, 9 aa, Homo Sapiens
QVFIFFLRE

SEQ ID NO: 990911 - protein, 9 aa, Homo Sapiens
PRHSKYNPQ

SEQ ID NO: 990912 - protein, 9 aa, Homo Sapiens
LLPVPRSCL

SEQ ID NO: 990913 - protein, 9 aa, Homo Sapiens
YQKISSGKS

SEQ ID NO: 990914 - protein, 9 aa, Homo Sapiens
KLIAEVKSK

SEQ ID NO: 990915 - protein, 9 aa, Homo Sapiens
PQEEPGLQG

SEQ ID NO: 990916 - protein, 9 aa, Homo Sapiens
AHETKLSYT

SEQ ID NO: 990917 - protein, 9 aa, Homo Sapiens
KAGSVFEEI

SEQ ID NO: 990918 - protein, 9 aa, Homo Sapiens
TNQPPSNLL

SEQ ID NO: 990919 - protein, 9 aa, Homo Sapiens
QYSLQVNGY

SEQ ID NO: 990920 - protein, 9 aa, Homo Sapiens
HLAERKLGA

SEQ ID NO: 990921 - protein, 9 aa, Homo Sapiens
AKGKLGPPG

SEQ ID NO: 990922 - protein, 9 aa, Homo Sapiens
DKIPKQEKK

SEQ ID NO: 990923 - protein, 9 aa, Homo Sapiens
DVIAALLNV

SEQ ID NO: 990924 - protein, 9 aa, Homo Sapiens
VQKLIKKMD

SEQ ID NO: 990925 - protein, 9 aa, Homo Sapiens
YDSPEDNMN

SEQ ID NO: 990926 - protein, 9 aa, Homo Sapiens
RDRIHCLQC

SEQ ID NO: 990927 - protein, 9 aa, Homo Sapiens
YGPQEEPGL

SEQ ID NO: 990928 - protein, 9 aa, Homo Sapiens
NYRLRLISL

SEQ ID NO: 990929 - protein, 9 aa, Homo Sapiens
ELALWNWEL

SEQ ID NO: 990930 - protein, 9 aa, Homo Sapiens
FLPPKKPLR

SEQ ID NO: 990931 - protein, 9 aa, Homo Sapiens
IAEFILKEA

SEQ ID NO: 990932 - protein, 9 aa, Homo Sapiens
RFNGFRFDG

SEQ ID NO: 990933 - protein, 9 aa, Homo Sapiens
FISRFEVFC

SEQ ID NO: 990934 - protein, 9 aa, Homo Sapiens
IRNKKSKSG

SEQ ID NO: 990935 - protein, 9 aa, Homo Sapiens
SRIWFLEGK

SEQ ID NO: 990936 - protein, 9 aa, Homo Sapiens
ESYAYTRAE

SEQ ID NO: 990937 - protein, 9 aa, Homo Sapiens
TSSEKFLTP

SEQ ID NO: 990938 - protein, 9 aa, Homo Sapiens
TLQTVEKEK

SEQ ID NO: 990939 - protein, 9 aa, Homo Sapiens
QEATKKVPT

SEQ ID NO: 990940 - protein, 9 aa, Homo Sapiens
SLNVQLERM

SEQ ID NO: 990941 - protein, 9 aa, Homo Sapiens
LCHSNCTYG

SEQ ID NO: 990942 - protein, 9 aa, Homo Sapiens
SASRRLVKI

SEQ ID NO: 990943 - protein, 9 aa, Homo Sapiens
YELPENICV

SEQ ID NO: 990944 - protein, 9 aa, Homo Sapiens
KDDDKNGPK

SEQ ID NO: 990945 - protein, 9 aa, Homo Sapiens
DLFSSKSKL

SEQ ID NO: 990946 - protein, 9 aa, Homo Sapiens
HPEKTSVYT

SEQ ID NO: 990947 - protein, 9 aa, Homo Sapiens
PLQTASVFP

SEQ ID NO: 990948 - protein, 9 aa, Homo Sapiens
EDDGVGDGN

SEQ ID NO: 990949 - protein, 9 aa, Homo Sapiens
FLEAGLRLG

SEQ ID NO: 990950 - protein, 9 aa, Homo Sapiens
YRRLLVGED

SEQ ID NO: 990951 - protein, 9 aa, Homo Sapiens
GMMRRMGFP

SEQ ID NO: 990952 - protein, 9 aa, Homo Sapiens
HRIHSFHVR

SEQ ID NO: 990953 - protein, 9 aa, Homo Sapiens
LHRILMDLQ

SEQ ID NO: 990954 - protein, 9 aa, Homo Sapiens
GFLGLPGPP

SEQ ID NO: 990955 - protein, 9 aa, Homo Sapiens
EKPGVAGLH

SEQ ID NO: 990956 - protein, 9 aa, Homo Sapiens
ESCFVYSRV

SEQ ID NO: 990957 - protein, 9 aa, Homo Sapiens
DEEAVKDTC

SEQ ID NO: 990958 - protein, 9 aa, Homo Sapiens
NNNVTEYMS

SEQ ID NO: 990959 - protein, 9 aa, Homo Sapiens
PQQPYSHLL

SEQ ID NO: 990960 - protein, 9 aa, Homo Sapiens
KKMDYLWKI

SEQ ID NO: 990961 - protein, 9 aa, Homo Sapiens
SRVMPLSKP

SEQ ID NO: 990962 - protein, 9 aa, Homo Sapiens
SLWPTPGKH

SEQ ID NO: 990963 - protein, 9 aa, Homo Sapiens
GGDIRQDSS

SEQ ID NO: 990964 - protein, 9 aa, Homo Sapiens
GTSQFFFGN

SEQ ID NO: 990965 - protein, 9 aa, Homo Sapiens
VSVCSTAIL

SEQ ID NO: 990966 - protein, 9 aa, Homo Sapiens
VLYFSRDEV

SEQ ID NO: 990967 - protein, 9 aa, Homo Sapiens
WVVMQELDC

SEQ ID NO: 990968 - protein, 9 aa, Homo Sapiens
QLPRMQCQQ

SEQ ID NO: 990969 - protein, 9 aa, Homo Sapiens
SVVRCITHP

SEQ ID NO: 990970 - protein, 9 aa, Homo Sapiens
ELAEYSAIG

SEQ ID NO: 990971 - protein, 9 aa, Homo Sapiens
ATKKVPTTD

SEQ ID NO: 990972 - protein, 9 aa, Homo Sapiens
ELKIQERWG

SEQ ID NO: 990973 - protein, 9 aa, Homo Sapiens
VDDVPVMLP

SEQ ID NO: 990974 - protein, 9 aa, Homo Sapiens
LDLSRSCQH

SEQ ID NO: 990975 - protein, 9 aa, Homo Sapiens
SGTSPPRTF

SEQ ID NO: 990976 - protein, 9 aa, Homo Sapiens
RRHFSRVMP

SEQ ID NO: 990977 - protein, 9 aa, Homo Sapiens
TAMEFEFKL

SEQ ID NO: 990978 - protein, 9 aa, Homo Sapiens
ILVGPIMWF

SEQ ID NO: 990979 - protein, 9 aa, Homo Sapiens
SIYFSTLEW

SEQ ID NO: 990980 - protein, 9 aa, Homo Sapiens
QGDGQSYRG

SEQ ID NO: 990981 - protein, 9 aa, Homo Sapiens
AIFLLVSLI

SEQ ID NO: 990982 - protein, 9 aa, Homo Sapiens
KISRDLDEV

SEQ ID NO: 990983 - protein, 9 aa, Homo Sapiens
VTAMEFEFK

SEQ ID NO: 990984 - protein, 9 aa, Homo Sapiens
CKEMVTLLD

SEQ ID NO: 990985 - protein, 9 aa, Homo Sapiens
VADIIVRGS

SEQ ID NO: 990986 - protein, 9 aa, Homo Sapiens
VTSVGKASF

SEQ ID NO: 990987 - protein, 9 aa, Homo Sapiens
SPMLPEFWE

SEQ ID NO: 990988 - protein, 9 aa, Homo Sapiens
DLGVCREFV

SEQ ID NO: 990989 - protein, 9 aa, Homo Sapiens
MGLQCRECA

SEQ ID NO: 990990 - protein, 9 aa, Homo Sapiens
MMPEDGNLT

SEQ ID NO: 990991 - protein, 9 aa, Homo Sapiens
PDVPESRQR

SEQ ID NO: 990992 - protein, 9 aa, Homo Sapiens
PELPESSVA

SEQ ID NO: 990993 - protein, 9 aa, Homo Sapiens
LPSGSSQFL

SEQ ID NO: 990994 - protein, 9 aa, Homo Sapiens
LEVDINIKI

SEQ ID NO: 990995 - protein, 9 aa, Homo Sapiens
ILFNIKEYT

SEQ ID NO: 990996 - protein, 9 aa, Homo Sapiens
KAIKKKPLR

SEQ ID NO: 990997 - protein, 9 aa, Homo Sapiens
SRHYQQRLA

SEQ ID NO: 990998 - protein, 9 aa, Homo Sapiens
IVSKMLVNF

SEQ ID NO: 990999 - protein, 9 aa, Homo Sapiens
QLLSEQFGR

SEQ ID NO: 991000 - protein, 9 aa, Homo Sapiens
LEIFCMNDD

SEQ ID NO: 991001 - protein, 9 aa, Homo Sapiens
NLVLPDDVV

SEQ ID NO: 991002 - protein, 9 aa, Homo Sapiens
FDAKARERG

SEQ ID NO: 991003 - protein, 9 aa, Homo Sapiens
GLTFTVGSG

SEQ ID NO: 991004 - protein, 9 aa, Homo Sapiens
PFYYLVQQS

SEQ ID NO: 991005 - protein, 9 aa, Homo Sapiens
DAYKESCFV

SEQ ID NO: 991006 - protein, 9 aa, Homo Sapiens
FFTEIVVMM

SEQ ID NO: 991007 - protein, 9 aa, Homo Sapiens
AQPLREGAL

SEQ ID NO: 991008 - protein, 9 aa, Homo Sapiens
VPGFSRKSK

SEQ ID NO: 991009 - protein, 9 aa, Homo Sapiens
NNITAEDCS

SEQ ID NO: 991010 - protein, 9 aa, Homo Sapiens
FEVQCMHET

SEQ ID NO: 991011 - protein, 9 aa, Homo Sapiens
DVSIYFSTL

SEQ ID NO: 991012 - protein, 9 aa, Homo Sapiens
CSYSAHYQF

SEQ ID NO: 991013 - protein, 9 aa, Homo Sapiens
KRIIEEESR

SEQ ID NO: 991014 - protein, 9 aa, Homo Sapiens
QQPNLPSPG

SEQ ID NO: 991015 - protein, 9 aa, Homo Sapiens
VRELREVRC

SEQ ID NO: 991016 - protein, 9 aa, Homo Sapiens
PVGMVFYPR

SEQ ID NO: 991017 - protein, 9 aa, Homo Sapiens
IRTILRILS

SEQ ID NO: 991018 - protein, 9 aa, Homo Sapiens
AGHGTGILK

SEQ ID NO: 991019 - protein, 9 aa, Homo Sapiens
VSFPAAGMG

SEQ ID NO: 991020 - protein, 9 aa, Homo Sapiens
GTDEGEDED

SEQ ID NO: 991021 - protein, 9 aa, Homo Sapiens
LKKTTNHEF

SEQ ID NO: 991022 - protein, 9 aa, Homo Sapiens
LGLAFLRSL

SEQ ID NO: 991023 - protein, 9 aa, Homo Sapiens
ELRNVNIKP

SEQ ID NO: 991024 - protein, 9 aa, Homo Sapiens
INVIFAVQE

SEQ ID NO: 991025 - protein, 9 aa, Homo Sapiens
PVVSLWPTP

SEQ ID NO: 991026 - protein, 9 aa, Homo Sapiens
IVANRGTLS

SEQ ID NO: 991027 - protein, 9 aa, Homo Sapiens
LQAKEKEVH

SEQ ID NO: 991028 - protein, 9 aa, Homo Sapiens
CDFFGIGVS

SEQ ID NO: 991029 - protein, 9 aa, Homo Sapiens
LQTASVFPS

SEQ ID NO: 991030 - protein, 9 aa, Homo Sapiens
LLKEAGALA

SEQ ID NO: 991031 - protein, 9 aa, Homo Sapiens
YDCEPNRST

SEQ ID NO: 991032 - protein, 9 aa, Homo Sapiens
ALMKVNLLS

SEQ ID NO: 991033 - protein, 9 aa, Homo Sapiens
IRHNLFSNR

SEQ ID NO: 991034 - protein, 9 aa, Homo Sapiens
FSGPDYSSI

SEQ ID NO: 991035 - protein, 9 aa, Homo Sapiens
PLCRKPGLF

SEQ ID NO: 991036 - protein, 9 aa, Homo Sapiens
EEVSPWLAA

SEQ ID NO: 991037 - protein, 9 aa, Homo Sapiens
VGAFGNFFV

SEQ ID NO: 991038 - protein, 9 aa, Homo Sapiens
AFAAHVSYI

SEQ ID NO: 991039 - protein, 9 aa, Homo Sapiens
LGTDTFSSS

SEQ ID NO: 991040 - protein, 9 aa, Homo Sapiens
GLRLGPDSL

SEQ ID NO: 991041 - protein, 9 aa, Homo Sapiens
SFFLCQTSK

SEQ ID NO: 991042 - protein, 9 aa, Homo Sapiens
EGKAIDATL

SEQ ID NO: 991043 - protein, 9 aa, Homo Sapiens
QFLIQYQNV

SEQ ID NO: 991044 - protein, 9 aa, Homo Sapiens
DVAFNFTAT

SEQ ID NO: 991045 - protein, 9 aa, Homo Sapiens
SSAIRSAID

SEQ ID NO: 991046 - protein, 9 aa, Homo Sapiens
KDSDAVPFR

SEQ ID NO: 991047 - protein, 9 aa, Homo Sapiens
TAQPTLDLS

SEQ ID NO: 991048 - protein, 9 aa, Homo Sapiens
PEYYGSYSS

SEQ ID NO: 991049 - protein, 9 aa, Homo Sapiens
RDIRKAMAQ

SEQ ID NO: 991050 - protein, 9 aa, Homo Sapiens
DAGKLCPPP

SEQ ID NO: 991051 - protein, 9 aa, Homo Sapiens
GSPCTPLLS

SEQ ID NO: 991052 - protein, 9 aa, Homo Sapiens
DGLNREQGD

SEQ ID NO: 991053 - protein, 9 aa, Homo Sapiens
CGGFCRRPA

SEQ ID NO: 991054 - protein, 9 aa, Homo Sapiens
LLLLKMEQL

SEQ ID NO: 991055 - protein, 9 aa, Homo Sapiens
KTLTEKEKK

SEQ ID NO: 991056 - protein, 9 aa, Homo Sapiens
KPGYHVPGF

SEQ ID NO: 991057 - protein, 9 aa, Homo Sapiens
FGSLAFVDA

SEQ ID NO: 991058 - protein, 9 aa, Homo Sapiens
QAVMLLPKL

SEQ ID NO: 991059 - protein, 9 aa, Homo Sapiens
LVSITDENH

SEQ ID NO: 991060 - protein, 9 aa, Homo Sapiens
PLPQQPLPP

SEQ ID NO: 991061 - protein, 9 aa, Homo Sapiens
LIREPLEDL

SEQ ID NO: 991062 - protein, 9 aa, Homo Sapiens
ILMDLQNQK

SEQ ID NO: 991063 - protein, 9 aa, Homo Sapiens
SPPTICSRV

SEQ ID NO: 991064 - protein, 9 aa, Homo Sapiens
EAKEDGREE

SEQ ID NO: 991065 - protein, 9 aa, Homo Sapiens
LAVILEAYL

SEQ ID NO: 991066 - protein, 9 aa, Homo Sapiens
RLREMSSLW

SEQ ID NO: 991067 - protein, 9 aa, Homo Sapiens
QPASKKLKT

SEQ ID NO: 991068 - protein, 9 aa, Homo Sapiens
TEEIFRRAA

SEQ ID NO: 991069 - protein, 9 aa, Homo Sapiens
GKLPKSHLD

SEQ ID NO: 991070 - protein, 9 aa, Homo Sapiens
TVFENGTQT

SEQ ID NO: 991071 - protein, 9 aa, Homo Sapiens
DTPISHQRR

SEQ ID NO: 991072 - protein, 9 aa, Homo Sapiens
MSSSVKAPA

SEQ ID NO: 991073 - protein, 9 aa, Homo Sapiens
RRMGFPGKD

SEQ ID NO: 991074 - protein, 9 aa, Homo Sapiens
VYAQFSTHH

SEQ ID NO: 991075 - protein, 9 aa, Homo Sapiens
LFERKNNKK

SEQ ID NO: 991076 - protein, 9 aa, Homo Sapiens
NADNDHLFA

SEQ ID NO: 991077 - protein, 9 aa, Homo Sapiens
GEIFYSLFQ

SEQ ID NO: 991078 - protein, 9 aa, Homo Sapiens
ILHQSPNIN

SEQ ID NO: 991079 - protein, 9 aa, Homo Sapiens
TTEENRKNS

SEQ ID NO: 991080 - protein, 9 aa, Homo Sapiens
SMDRIENDR

SEQ ID NO: 991081 - protein, 9 aa, Homo Sapiens
SAFFGVQQL

SEQ ID NO: 991082 - protein, 9 aa, Homo Sapiens
HAVPTAFPA

SEQ ID NO: 991083 - protein, 9 aa, Homo Sapiens
IITDQLPRM

SEQ ID NO: 991084 - protein, 9 aa, Homo Sapiens
LPDEEDGLC

SEQ ID NO: 991085 - protein, 9 aa, Homo Sapiens
YRFNGFRFD

SEQ ID NO: 991086 - protein, 9 aa, Homo Sapiens
QKLIKKMDY

SEQ ID NO: 991087 - protein, 9 aa, Homo Sapiens
AVGAFGNFF

SEQ ID NO: 991088 - protein, 9 aa, Homo Sapiens
ESQAEGKKK

SEQ ID NO: 991089 - protein, 9 aa, Homo Sapiens
KPVEAAEPA

SEQ ID NO: 991090 - protein, 9 aa, Homo Sapiens
VRSFRLRFE

SEQ ID NO: 991091 - protein, 9 aa, Homo Sapiens
PADLLIKAI

SEQ ID NO: 991092 - protein, 9 aa, Homo Sapiens
IEDIQNTTL

SEQ ID NO: 991093 - protein, 9 aa, Homo Sapiens
DPRSWTAAD

SEQ ID NO: 991094 - protein, 9 aa, Homo Sapiens
NLPMKLQRI

SEQ ID NO: 991095 - protein, 9 aa, Homo Sapiens
YDLVTEEQA

SEQ ID NO: 991096 - protein, 9 aa, Homo Sapiens
WSLMDDFEW

SEQ ID NO: 991097 - protein, 9 aa, Homo Sapiens
RKAAQQYLM

SEQ ID NO: 991098 - protein, 9 aa, Homo Sapiens
KLPFDLKNL

SEQ ID NO: 991099 - protein, 9 aa, Homo Sapiens
ESANKFEMK

SEQ ID NO: 991100 - protein, 9 aa, Homo Sapiens
SNNIGNNIF

SEQ ID NO: 991101 - protein, 9 aa, Homo Sapiens
VPLLLSFFV

SEQ ID NO: 991102 - protein, 9 aa, Homo Sapiens
LQPTKTRFV

SEQ ID NO: 991103 - protein, 9 aa, Homo Sapiens
APAAESVNN

SEQ ID NO: 991104 - protein, 9 aa, Homo Sapiens
KPKRKRKKK

SEQ ID NO: 991105 - protein, 9 aa, Homo Sapiens
DKGNAIGRK

SEQ ID NO: 991106 - protein, 9 aa, Homo Sapiens
PATYEIFQE

SEQ ID NO: 991107 - protein, 9 aa, Homo Sapiens
GWLQRLQKS

SEQ ID NO: 991108 - protein, 9 aa, Homo Sapiens
TKKVPTTDI

SEQ ID NO: 991109 - protein, 9 aa, Homo Sapiens
RFNSNSQAA

SEQ ID NO: 991110 - protein, 9 aa, Homo Sapiens
ATVFQGLPG

SEQ ID NO: 991111 - protein, 9 aa, Homo Sapiens
TESMDPDVQ

SEQ ID NO: 991112 - protein, 9 aa, Homo Sapiens
DRRARSRFR

SEQ ID NO: 991113 - protein, 9 aa, Homo Sapiens
QLITQTQAR

SEQ ID NO: 991114 - protein, 9 aa, Homo Sapiens
YNAHMMPED

SEQ ID NO: 991115 - protein, 9 aa, Homo Sapiens
IFARQSDQI

SEQ ID NO: 991116 - protein, 9 aa, Homo Sapiens
FIYTYIGTL

SEQ ID NO: 991117 - protein, 9 aa, Homo Sapiens
SCVCMQPHK

SEQ ID NO: 991118 - protein, 9 aa, Homo Sapiens
FHSWPSSMD

SEQ ID NO: 991119 - protein, 9 aa, Homo Sapiens
RVELKIQER

SEQ ID NO: 991120 - protein, 9 aa, Homo Sapiens
EKGFHEVDY

SEQ ID NO: 991121 - protein, 9 aa, Homo Sapiens
TKVDFGHCF

SEQ ID NO: 991122 - protein, 9 aa, Homo Sapiens
VSCVCMQPH

SEQ ID NO: 991123 - protein, 9 aa, Homo Sapiens
YNCTTTHTF

SEQ ID NO: 991124 - protein, 9 aa, Homo Sapiens
KHKYGIVRN

SEQ ID NO: 991125 - protein, 9 aa, Homo Sapiens
QNQRVKDKK

SEQ ID NO: 991126 - protein, 9 aa, Homo Sapiens
ITDLNSYQY

SEQ ID NO: 991127 - protein, 9 aa, Homo Sapiens
IKEGSKSNE

SEQ ID NO: 991128 - protein, 9 aa, Homo Sapiens
LFEVQCMHE

SEQ ID NO: 991129 - protein, 9 aa, Homo Sapiens
RKIAWKKKE

SEQ ID NO: 991130 - protein, 9 aa, Homo Sapiens
QAKEKEVHD

SEQ ID NO: 991131 - protein, 9 aa, Homo Sapiens
SLMDDFEWH

SEQ ID NO: 991132 - protein, 9 aa, Homo Sapiens
DVALNIHRI

SEQ ID NO: 991133 - protein, 9 aa, Homo Sapiens
FFQELSDPG

SEQ ID NO: 991134 - protein, 9 aa, Homo Sapiens
YTAWSLMDD

SEQ ID NO: 991135 - protein, 9 aa, Homo Sapiens
FPKSKSEDS

SEQ ID NO: 991136 - protein, 9 aa, Homo Sapiens
KENAICSGK

SEQ ID NO: 991137 - protein, 9 aa, Homo Sapiens
WQALNYKIR

SEQ ID NO: 991138 - protein, 9 aa, Homo Sapiens
AADFLRELS

SEQ ID NO: 991139 - protein, 9 aa, Homo Sapiens
DCQTKTTPH

SEQ ID NO: 991140 - protein, 9 aa, Homo Sapiens
KTKGQYDEE

SEQ ID NO: 991141 - protein, 9 aa, Homo Sapiens
LKFYDFKET

SEQ ID NO: 991142 - protein, 9 aa, Homo Sapiens
KVDFGHCFL

SEQ ID NO: 991143 - protein, 9 aa, Homo Sapiens
LLGLTQNPL

SEQ ID NO: 991144 - protein, 9 aa, Homo Sapiens
DDSDSLGNS

SEQ ID NO: 991145 - protein, 9 aa, Homo Sapiens
IWKQKGRCS

SEQ ID NO: 991146 - protein, 9 aa, Homo Sapiens
SSSLLRCCL

SEQ ID NO: 991147 - protein, 9 aa, Homo Sapiens
KEKDVARQR

SEQ ID NO: 991148 - protein, 9 aa, Homo Sapiens
NETFGQYSL

SEQ ID NO: 991149 - protein, 9 aa, Homo Sapiens
HIRYYRMAA

SEQ ID NO: 991150 - protein, 9 aa, Homo Sapiens
KFIIKEEML

SEQ ID NO: 991151 - protein, 9 aa, Homo Sapiens
NVQLERMKI

SEQ ID NO: 991152 - protein, 9 aa, Homo Sapiens
AHCERGREN

SEQ ID NO: 991153 - protein, 9 aa, Homo Sapiens
CGPECRCNQ

SEQ ID NO: 991154 - protein, 9 aa, Homo Sapiens
RLTNQPGEF

SEQ ID NO: 991155 - protein, 9 aa, Homo Sapiens
TPLFVPTQQ

SEQ ID NO: 991156 - protein, 9 aa, Homo Sapiens
VRVRPGECF

SEQ ID NO: 991157 - protein, 9 aa, Homo Sapiens
RFDCFVVYS

SEQ ID NO: 991158 - protein, 9 aa, Homo Sapiens
GHNHKKVQA

SEQ ID NO: 991159 - protein, 9 aa, Homo Sapiens
SSPEETREL

SEQ ID NO: 991160 - protein, 9 aa, Homo Sapiens
SFSVQKGSQ

SEQ ID NO: 991161 - protein, 9 aa, Homo Sapiens
WSNPTQQTL

SEQ ID NO: 991162 - protein, 9 aa, Homo Sapiens
PSFRWTPAW

SEQ ID NO: 991163 - protein, 9 aa, Homo Sapiens
DKLAQLITQ

SEQ ID NO: 991164 - protein, 9 aa, Homo Sapiens
PGSYNPRDR

SEQ ID NO: 991165 - protein, 9 aa, Homo Sapiens
NQSREHMGE

SEQ ID NO: 991166 - protein, 9 aa, Homo Sapiens
LPENICVSS

SEQ ID NO: 991167 - protein, 9 aa, Homo Sapiens
EDKALLKKY

SEQ ID NO: 991168 - protein, 9 aa, Homo Sapiens
AFQTPNLPG

SEQ ID NO: 991169 - protein, 9 aa, Homo Sapiens
GAIKVKTGA

SEQ ID NO: 991170 - protein, 9 aa, Homo Sapiens
DFLDGLGSA

SEQ ID NO: 991171 - protein, 9 aa, Homo Sapiens
AGEKRGRCF

SEQ ID NO: 991172 - protein, 9 aa, Homo Sapiens
NIKSQAADF

SEQ ID NO: 991173 - protein, 9 aa, Homo Sapiens
ALVLGRGGA

SEQ ID NO: 991174 - protein, 9 aa, Homo Sapiens
LVQTAPWLF

SEQ ID NO: 991175 - protein, 9 aa, Homo Sapiens
FSQDLLEKG

SEQ ID NO: 991176 - protein, 9 aa, Homo Sapiens
NNIFFSSLS

SEQ ID NO: 991177 - protein, 9 aa, Homo Sapiens
VTSGLKDYP

SEQ ID NO: 991178 - protein, 9 aa, Homo Sapiens
LISAHCLLL

SEQ ID NO: 991179 - protein, 9 aa, Homo Sapiens
PESRQRSIF

SEQ ID NO: 991180 - protein, 9 aa, Homo Sapiens
EKEDASKRE

SEQ ID NO: 991181 - protein, 9 aa, Homo Sapiens
DNDYFNAMT

SEQ ID NO: 991182 - protein, 9 aa, Homo Sapiens
NFTINTNGG

SEQ ID NO: 991183 - protein, 9 aa, Homo Sapiens
PTKFEVVLY

SEQ ID NO: 991184 - protein, 9 aa, Homo Sapiens
AMSEGIFAI

SEQ ID NO: 991185 - protein, 9 aa, Homo Sapiens
FSYGRASYP

SEQ ID NO: 991186 - protein, 9 aa, Homo Sapiens
NSLSSPSPV

SEQ ID NO: 991187 - protein, 9 aa, Homo Sapiens
WNRELLNKY

SEQ ID NO: 991188 - protein, 9 aa, Homo Sapiens
VTQMFFFHF

SEQ ID NO: 991189 - protein, 9 aa, Homo Sapiens
GQCCLDHEG

SEQ ID NO: 991190 - protein, 9 aa, Homo Sapiens
YFDAQKEIV

SEQ ID NO: 991191 - protein, 9 aa, Homo Sapiens
DDKNDNLDP

SEQ ID NO: 991192 - protein, 9 aa, Homo Sapiens
REELLLLKM

SEQ ID NO: 991193 - protein, 9 aa, Homo Sapiens
IQIVTNSAS

SEQ ID NO: 991194 - protein, 9 aa, Homo Sapiens
SGGFLVIMD

SEQ ID NO: 991195 - protein, 9 aa, Homo Sapiens
QTVPQSGNG

SEQ ID NO: 991196 - protein, 9 aa, Homo Sapiens
EVSDGYVVS

SEQ ID NO: 991197 - protein, 9 aa, Homo Sapiens
ARVLIVSLL

SEQ ID NO: 991198 - protein, 9 aa, Homo Sapiens
ESRNDYKNI

SEQ ID NO: 991199 - protein, 9 aa, Homo Sapiens
KFPEVTLQL

SEQ ID NO: 991200 - protein, 9 aa, Homo Sapiens
FYDHESCRV

SEQ ID NO: 991201 - protein, 9 aa, Homo Sapiens
ALTPRKDCN

SEQ ID NO: 991202 - protein, 9 aa, Homo Sapiens
FVEAFKRQT

SEQ ID NO: 991203 - protein, 9 aa, Homo Sapiens
EARCGDEGK

SEQ ID NO: 991204 - protein, 9 aa, Homo Sapiens
LEVISPTKF

SEQ ID NO: 991205 - protein, 9 aa, Homo Sapiens
RVRYFHDED

SEQ ID NO: 991206 - protein, 9 aa, Homo Sapiens
ARQREQKEQ

SEQ ID NO: 991207 - protein, 9 aa, Homo Sapiens
LEGSVYSRG

SEQ ID NO: 991208 - protein, 9 aa, Homo Sapiens
GLFSSGLYH

SEQ ID NO: 991209 - protein, 9 aa, Homo Sapiens
EAERELKRW

SEQ ID NO: 991210 - protein, 9 aa, Homo Sapiens
EITYLFACR

SEQ ID NO: 991211 - protein, 9 aa, Homo Sapiens
ELLSKLNDI

SEQ ID NO: 991212 - protein, 9 aa, Homo Sapiens
NPNKYFDLD

SEQ ID NO: 991213 - protein, 9 aa, Homo Sapiens
AMQIATGRN

SEQ ID NO: 991214 - protein, 9 aa, Homo Sapiens
AAALEASPK

SEQ ID NO: 991215 - protein, 9 aa, Homo Sapiens
EEEKDEEEE

SEQ ID NO: 991216 - protein, 9 aa, Homo Sapiens
KTLSDAGNS

SEQ ID NO: 991217 - protein, 9 aa, Homo Sapiens
AFGDNGSLA

SEQ ID NO: 991218 - protein, 9 aa, Homo Sapiens
LTAIKVLQR

SEQ ID NO: 991219 - protein, 9 aa, Homo Sapiens
TRDFIEGEA

SEQ ID NO: 991220 - protein, 9 aa, Homo Sapiens
IISWVATGF

SEQ ID NO: 991221 - protein, 9 aa, Homo Sapiens
VNSTITHPS

SEQ ID NO: 991222 - protein, 9 aa, Homo Sapiens
WFTFAVGPG

SEQ ID NO: 991223 - protein, 9 aa, Homo Sapiens
GVSFTFFKK

SEQ ID NO: 991224 - protein, 9 aa, Homo Sapiens
VLLCSSGSS

SEQ ID NO: 991225 - protein, 9 aa, Homo Sapiens
AQSIRTIKG

SEQ ID NO: 991226 - protein, 9 aa, Homo Sapiens
SSSLTRHQI

SEQ ID NO: 991227 - protein, 9 aa, Homo Sapiens
MGKMQYGLF

SEQ ID NO: 991228 - protein, 9 aa, Homo Sapiens
LASEALAGL

SEQ ID NO: 991229 - protein, 9 aa, Homo Sapiens
FGLILTSYV

SEQ ID NO: 991230 - protein, 9 aa, Homo Sapiens
VLQGKFYGN

SEQ ID NO: 991231 - protein, 9 aa, Homo Sapiens
QGLLNKLKN

SEQ ID NO: 991232 - protein, 9 aa, Homo Sapiens
WNLERNQFS

SEQ ID NO: 991233 - protein, 9 aa, Homo Sapiens
QPKAENSWK

SEQ ID NO: 991234 - protein, 9 aa, Homo Sapiens
YVVDIFTPL

SEQ ID NO: 991235 - protein, 9 aa, Homo Sapiens
ARYLILITN

SEQ ID NO: 991236 - protein, 9 aa, Homo Sapiens
PGNPQPVLS

SEQ ID NO: 991237 - protein, 9 aa, Homo Sapiens
FGPTEVSTA

SEQ ID NO: 991238 - protein, 9 aa, Homo Sapiens
YVFFQITLT

SEQ ID NO: 991239 - protein, 9 aa, Homo Sapiens
LDLLQLKKG

SEQ ID NO: 991240 - protein, 9 aa, Homo Sapiens
EALAGLIDI

SEQ ID NO: 991241 - protein, 9 aa, Homo Sapiens
RLGMGHVLT

SEQ ID NO: 991242 - protein, 9 aa, Homo Sapiens
AAAYFYLDT

SEQ ID NO: 991243 - protein, 9 aa, Homo Sapiens
GRQCQNSTV

SEQ ID NO: 991244 - protein, 9 aa, Homo Sapiens
LLHCGQLTD

SEQ ID NO: 991245 - protein, 9 aa, Homo Sapiens
NHPNHVLKE

SEQ ID NO: 991246 - protein, 9 aa, Homo Sapiens
ALYCWNLER

SEQ ID NO: 991247 - protein, 9 aa, Homo Sapiens
ALQKTEMVG

SEQ ID NO: 991248 - protein, 9 aa, Homo Sapiens
HLPAHSDFH

SEQ ID NO: 991249 - protein, 9 aa, Homo Sapiens
TPQDLKGPG

SEQ ID NO: 991250 - protein, 9 aa, Homo Sapiens
CDQHRLPPG

SEQ ID NO: 991251 - protein, 9 aa, Homo Sapiens
GAREAQHSD

SEQ ID NO: 991252 - protein, 9 aa, Homo Sapiens
VAESMASDP

SEQ ID NO: 991253 - protein, 9 aa, Homo Sapiens
KARINFGYN

SEQ ID NO: 991254 - protein, 9 aa, Homo Sapiens
GPISLAFIG

SEQ ID NO: 991255 - protein, 9 aa, Homo Sapiens
ANLSSIRIT

SEQ ID NO: 991256 - protein, 9 aa, Homo Sapiens
QAADAFLSK

SEQ ID NO: 991257 - protein, 9 aa, Homo Sapiens
VPDSIISWV

SEQ ID NO: 991258 - protein, 9 aa, Homo Sapiens
LGEITYLFA

SEQ ID NO: 991259 - protein, 9 aa, Homo Sapiens
QCWSDEYNC

SEQ ID NO: 991260 - protein, 9 aa, Homo Sapiens
PDSIISWVA

SEQ ID NO: 991261 - protein, 9 aa, Homo Sapiens
VEKNTLECS

SEQ ID NO: 991262 - protein, 9 aa, Homo Sapiens
FLSMLSGFL

SEQ ID NO: 991263 - protein, 9 aa, Homo Sapiens
PGPLRALTT

SEQ ID NO: 991264 - protein, 9 aa, Homo Sapiens
SKLNVPKIK

SEQ ID NO: 991265 - protein, 9 aa, Homo Sapiens
AYSGDHNRS

SEQ ID NO: 991266 - protein, 9 aa, Homo Sapiens
EQLSNPKQS

SEQ ID NO: 991267 - protein, 9 aa, Homo Sapiens
KDMILDIRF

SEQ ID NO: 991268 - protein, 9 aa, Homo Sapiens
GHTPEAMQI

SEQ ID NO: 991269 - protein, 9 aa, Homo Sapiens
GKTVRLSSV

SEQ ID NO: 991270 - protein, 9 aa, Homo Sapiens
DPKSDLETW

SEQ ID NO: 991271 - protein, 9 aa, Homo Sapiens
QLSNPKQSC

SEQ ID NO: 991272 - protein, 9 aa, Homo Sapiens
AEVASGYLK

SEQ ID NO: 991273 - protein, 9 aa, Homo Sapiens
ADDDPFTLA

SEQ ID NO: 991274 - protein, 9 aa, Homo Sapiens
RILASWRRA

SEQ ID NO: 991275 - protein, 9 aa, Homo Sapiens
AFCRSSSLT

SEQ ID NO: 991276 - protein, 9 aa, Homo Sapiens
NKDKSQEDS

SEQ ID NO: 991277 - protein, 9 aa, Homo Sapiens
EKDEEEEKR

SEQ ID NO: 991278 - protein, 9 aa, Homo Sapiens
PGSIFLSML

SEQ ID NO: 991279 - protein, 9 aa, Homo Sapiens
SSGLYHRPP

SEQ ID NO: 991280 - protein, 9 aa, Homo Sapiens
QDPKSDLET

SEQ ID NO: 991281 - protein, 9 aa, Homo Sapiens
PAVVAQLQA

SEQ ID NO: 991282 - protein, 9 aa, Homo Sapiens
LDKFMGKMQ

SEQ ID NO: 991283 - protein, 9 aa, Homo Sapiens
GEADDSITR

SEQ ID NO: 991284 - protein, 9 aa, Homo Sapiens
PASPTPLSP

SEQ ID NO: 991285 - protein, 9 aa, Homo Sapiens
RVMGKFSIR

SEQ ID NO: 991286 - protein, 9 aa, Homo Sapiens
PNKYFDLDV

SEQ ID NO: 991287 - protein, 9 aa, Homo Sapiens
KLDGYAYLE

SEQ ID NO: 991288 - protein, 9 aa, Homo Sapiens
KGMIFVCSA

SEQ ID NO: 991289 - protein, 9 aa, Homo Sapiens
ISQDRDEYV

SEQ ID NO: 991290 - protein, 9 aa, Homo Sapiens
ETGEQESSP

SEQ ID NO: 991291 - protein, 9 aa, Homo Sapiens
RKPLEVGYS

SEQ ID NO: 991292 - protein, 9 aa, Homo Sapiens
FNPEELRMA

SEQ ID NO: 991293 - protein, 9 aa, Homo Sapiens
EELRMAQQQ

SEQ ID NO: 991294 - protein, 9 aa, Homo Sapiens
CQKQDPLNE

SEQ ID NO: 991295 - protein, 9 aa, Homo Sapiens
ENASNSTLS

SEQ ID NO: 991296 - protein, 9 aa, Homo Sapiens
CCFWPLGIT

SEQ ID NO: 991297 - protein, 9 aa, Homo Sapiens
KETVNAIFP

SEQ ID NO: 991298 - protein, 9 aa, Homo Sapiens
EPCCGPRDL

SEQ ID NO: 991299 - protein, 9 aa, Homo Sapiens
KCGERMVCN

SEQ ID NO: 991300 - protein, 9 aa, Homo Sapiens
SHCEMHQCW

SEQ ID NO: 991301 - protein, 9 aa, Homo Sapiens
QKSVIFWLL

SEQ ID NO: 991302 - protein, 9 aa, Homo Sapiens
EEVIEMYKG

SEQ ID NO: 991303 - protein, 9 aa, Homo Sapiens
SFKGCMTQL

SEQ ID NO: 991304 - protein, 9 aa, Homo Sapiens
KCKYYYPER

SEQ ID NO: 991305 - protein, 9 aa, Homo Sapiens
SCVIRCHTD

SEQ ID NO: 991306 - protein, 9 aa, Homo Sapiens
VEEIEEEED

SEQ ID NO: 991307 - protein, 9 aa, Homo Sapiens
VVAQLQALL

SEQ ID NO: 991308 - protein, 9 aa, Homo Sapiens
FLALYYEEG

SEQ ID NO: 991309 - protein, 9 aa, Homo Sapiens
VCQKQDPLN

SEQ ID NO: 991310 - protein, 9 aa, Homo Sapiens
PAPFSNEIE

SEQ ID NO: 991311 - protein, 9 aa, Homo Sapiens
TDVPFIRIL

SEQ ID NO: 991312 - protein, 9 aa, Homo Sapiens
VPKIKVPKF

SEQ ID NO: 991313 - protein, 9 aa, Homo Sapiens
SYLHPEDCS

SEQ ID NO: 991314 - protein, 9 aa, Homo Sapiens
HMRKHTGKR

SEQ ID NO: 991315 - protein, 9 aa, Homo Sapiens
YKVEEEKLK

SEQ ID NO: 991316 - protein, 9 aa, Homo Sapiens
RVLQERADM

SEQ ID NO: 991317 - protein, 9 aa, Homo Sapiens
TGCFIFLIS

SEQ ID NO: 991318 - protein, 9 aa, Homo Sapiens
NGNFKPGKP

SEQ ID NO: 991319 - protein, 9 aa, Homo Sapiens
PPAVVAQLQ

SEQ ID NO: 991320 - protein, 9 aa, Homo Sapiens
LLLLDEFAV

SEQ ID NO: 991321 - protein, 9 aa, Homo Sapiens
EDFTPSGEW

SEQ ID NO: 991322 - protein, 9 aa, Homo Sapiens
AALEASPKW

SEQ ID NO: 991323 - protein, 9 aa, Homo Sapiens
EHVTDEEIK

SEQ ID NO: 991324 - protein, 9 aa, Homo Sapiens
HSVISTQTP

SEQ ID NO: 991325 - protein, 9 aa, Homo Sapiens
GPLRALTTL

SEQ ID NO: 991326 - protein, 9 aa, Homo Sapiens
LGTEEGKRP

SEQ ID NO: 991327 - protein, 9 aa, Homo Sapiens
SFTFFKKVH

SEQ ID NO: 991328 - protein, 9 aa, Homo Sapiens
RARLDLLQL

SEQ ID NO: 991329 - protein, 9 aa, Homo Sapiens
KLNEQGLLN

SEQ ID NO: 991330 - protein, 9 aa, Homo Sapiens
VTCEKDINE

SEQ ID NO: 991331 - protein, 9 aa, Homo Sapiens
SNLFWDTGV

SEQ ID NO: 991332 - protein, 9 aa, Homo Sapiens
KNQPTEKKV

SEQ ID NO: 991333 - protein, 9 aa, Homo Sapiens
FQETDKLAP

SEQ ID NO: 991334 - protein, 9 aa, Homo Sapiens
IYCSLRFSS

SEQ ID NO: 991335 - protein, 9 aa, Homo Sapiens
DLDDPEKGM

SEQ ID NO: 991336 - protein, 9 aa, Homo Sapiens
VFTSWNYLI

SEQ ID NO: 991337 - protein, 9 aa, Homo Sapiens
RDSWTLQSE

SEQ ID NO: 991338 - protein, 9 aa, Homo Sapiens
LSLKEASII

SEQ ID NO: 991339 - protein, 9 aa, Homo Sapiens
RLSSVYRNG

SEQ ID NO: 991340 - protein, 9 aa, Homo Sapiens
KMQYGLFHG

SEQ ID NO: 991341 - protein, 9 aa, Homo Sapiens
AGTTVNSTI

SEQ ID NO: 991342 - protein, 9 aa, Homo Sapiens
EQEEEEQAG

SEQ ID NO: 991343 - protein, 9 aa, Homo Sapiens
EMVGKIEGE

SEQ ID NO: 991344 - protein, 9 aa, Homo Sapiens
CDKAFVRNL

SEQ ID NO: 991345 - protein, 9 aa, Homo Sapiens
GVTCEKDIN

SEQ ID NO: 991346 - protein, 9 aa, Homo Sapiens
LLKLSCLDI

SEQ ID NO: 991347 - protein, 9 aa, Homo Sapiens
DDPEKGMIF

SEQ ID NO: 991348 - protein, 9 aa, Homo Sapiens
HSDFHVEPC

SEQ ID NO: 991349 - protein, 9 aa, Homo Sapiens
VARQLALRK

SEQ ID NO: 991350 - protein, 9 aa, Homo Sapiens
DVTNTTTTL

SEQ ID NO: 991351 - protein, 9 aa, Homo Sapiens
NSELVLEGS

SEQ ID NO: 991352 - protein, 9 aa, Homo Sapiens
MVARQPQAI

SEQ ID NO: 991353 - protein, 9 aa, Homo Sapiens
TDEEIKSLM

SEQ ID NO: 991354 - protein, 9 aa, Homo Sapiens
ANDFVGGLM

SEQ ID NO: 991355 - protein, 9 aa, Homo Sapiens
PKQSCNKTF

SEQ ID NO: 991356 - protein, 9 aa, Homo Sapiens
LNPNKYFDL

SEQ ID NO: 991357 - protein, 9 aa, Homo Sapiens
YLHDSTSYK

SEQ ID NO: 991358 - protein, 9 aa, Homo Sapiens
IASVWFGPT

SEQ ID NO: 991359 - protein, 9 aa, Homo Sapiens
IRAQAADAF

SEQ ID NO: 991360 - protein, 9 aa, Homo Sapiens
EFVFSEVES

SEQ ID NO: 991361 - protein, 9 aa, Homo Sapiens
PTDVPFIRI

SEQ ID NO: 991362 - protein, 9 aa, Homo Sapiens
REAQHSDPK

SEQ ID NO: 991363 - protein, 9 aa, Homo Sapiens
MEDFTPSGE

SEQ ID NO: 991364 - protein, 9 aa, Homo Sapiens
NDFVGGLMS

SEQ ID NO: 991365 - protein, 9 aa, Homo Sapiens
QEEEEQAGK

SEQ ID NO: 991366 - protein, 9 aa, Homo Sapiens
KKAKISIDS

SEQ ID NO: 991367 - protein, 9 aa, Homo Sapiens
LSPQAGRSL

SEQ ID NO: 991368 - protein, 9 aa, Homo Sapiens
FSPRRVRFR

SEQ ID NO: 991369 - protein, 9 aa, Homo Sapiens
DNDEPGDKD

SEQ ID NO: 991370 - protein, 9 aa, Homo Sapiens
KVLQGKFYG

SEQ ID NO: 991371 - protein, 9 aa, Homo Sapiens
SCLHWEDHG

SEQ ID NO: 991372 - protein, 9 aa, Homo Sapiens
PCCGPRDLE

SEQ ID NO: 991373 - protein, 9 aa, Homo Sapiens
LTGLASEAL

SEQ ID NO: 991374 - protein, 9 aa, Homo Sapiens
ILQLFKILC

SEQ ID NO: 991375 - protein, 9 aa, Homo Sapiens
LFSSGLYHR

SEQ ID NO: 991376 - protein, 9 aa, Homo Sapiens
TSTSQSSER

SEQ ID NO: 991377 - protein, 9 aa, Homo Sapiens
LNVPKIKVP

SEQ ID NO: 991378 - protein, 9 aa, Homo Sapiens
TLTALKHPR

SEQ ID NO: 991379 - protein, 9 aa, Homo Sapiens
DLNYKVEEE

SEQ ID NO: 991380 - protein, 9 aa, Homo Sapiens
GAFGDNGSL

SEQ ID NO: 991381 - protein, 9 aa, Homo Sapiens
VAKDEVAYT

SEQ ID NO: 991382 - protein, 9 aa, Homo Sapiens
HWEDHGLQC

SEQ ID NO: 991383 - protein, 9 aa, Homo Sapiens
ALHPSSPRA

SEQ ID NO: 991384 - protein, 9 aa, Homo Sapiens
EEKLKHKYT

SEQ ID NO: 991385 - protein, 9 aa, Homo Sapiens
EILQLFKIL

SEQ ID NO: 991386 - protein, 9 aa, Homo Sapiens
FIARYLILI

SEQ ID NO: 991387 - protein, 9 aa, Homo Sapiens
LRYRLNPNK

SEQ ID NO: 991388 - protein, 9 aa, Homo Sapiens
AYTTPGPLR

SEQ ID NO: 991389 - protein, 9 aa, Homo Sapiens
RVALGSFVG

SEQ ID NO: 991390 - protein, 9 aa, Homo Sapiens
LDGAPHSDY

SEQ ID NO: 991391 - protein, 9 aa, Homo Sapiens
NQPTEKKVD

SEQ ID NO: 991392 - protein, 9 aa, Homo Sapiens
NTILGIQPL

SEQ ID NO: 991393 - protein, 9 aa, Homo Sapiens
YSGDHNRSS

SEQ ID NO: 991394 - protein, 9 aa, Homo Sapiens
FAKHQKIHT

SEQ ID NO: 991395 - protein, 9 aa, Homo Sapiens
LKPSTLVPN

SEQ ID NO: 991396 - protein, 9 aa, Homo Sapiens
YGLHLPAHS

SEQ ID NO: 991397 - protein, 9 aa, Homo Sapiens
ITLTDVQKK

SEQ ID NO: 991398 - protein, 9 aa, Homo Sapiens
FGEQEVDLA

SEQ ID NO: 991399 - protein, 9 aa, Homo Sapiens
ASIIAEYIS

SEQ ID NO: 991400 - protein, 9 aa, Homo Sapiens
SKKKVQKKS

SEQ ID NO: 991401 - protein, 9 aa, Homo Sapiens
EAQHSDPKV

SEQ ID NO: 991402 - protein, 9 aa, Homo Sapiens
VIAMIDVEA

SEQ ID NO: 991403 - protein, 9 aa, Homo Sapiens
PVLWEETFD

SEQ ID NO: 991404 - protein, 9 aa, Homo Sapiens
LAMGANRGI

SEQ ID NO: 991405 - protein, 9 aa, Homo Sapiens
ERLENEEEV

SEQ ID NO: 991406 - protein, 9 aa, Homo Sapiens
YSWLFPLRW

SEQ ID NO: 991407 - protein, 9 aa, Homo Sapiens
KTVIPGRVM

SEQ ID NO: 991408 - protein, 9 aa, Homo Sapiens
ELTMSCSSL

SEQ ID NO: 991409 - protein, 9 aa, Homo Sapiens
DQHRLPPGM

SEQ ID NO: 991410 - protein, 9 aa, Homo Sapiens
SCYGLHLPA

SEQ ID NO: 991411 - protein, 9 aa, Homo Sapiens
FCKDIAKRI

SEQ ID NO: 991412 - protein, 9 aa, Homo Sapiens
VAQLQALLT

SEQ ID NO: 991413 - protein, 9 aa, Homo Sapiens
IAKRIAQVC

SEQ ID NO: 991414 - protein, 9 aa, Homo Sapiens
YVSSHAFNQ

SEQ ID NO: 991415 - protein, 9 aa, Homo Sapiens
EDNLSLNDL

SEQ ID NO: 991416 - protein, 9 aa, Homo Sapiens
KNNAQSIRT

SEQ ID NO: 991417 - protein, 9 aa, Homo Sapiens
VQKKVFFRR

SEQ ID NO: 991418 - protein, 9 aa, Homo Sapiens
SWLFPLRWS

SEQ ID NO: 991419 - protein, 9 aa, Homo Sapiens
RPEPISDQQ

SEQ ID NO: 991420 - protein, 9 aa, Homo Sapiens
CGERMVCNN

SEQ ID NO: 991421 - protein, 9 aa, Homo Sapiens
RELEGSVYS

SEQ ID NO: 991422 - protein, 9 aa, Homo Sapiens
ARSKRGLSL

SEQ ID NO: 991423 - protein, 9 aa, Homo Sapiens
QEAELLLLD

SEQ ID NO: 991424 - protein, 9 aa, Homo Sapiens
VIVRLPGLH

SEQ ID NO: 991425 - protein, 9 aa, Homo Sapiens
ILSLKEASI

SEQ ID NO: 991426 - protein, 9 aa, Homo Sapiens
LKQNKKKEE

SEQ ID NO: 991427 - protein, 9 aa, Homo Sapiens
NGFLPKPDP

SEQ ID NO: 991428 - protein, 9 aa, Homo Sapiens
LNQGSFQET

SEQ ID NO: 991429 - protein, 9 aa, Homo Sapiens
CLEGQERVA

SEQ ID NO: 991430 - protein, 9 aa, Homo Sapiens
KLVCQINLT

SEQ ID NO: 991431 - protein, 9 aa, Homo Sapiens
VPQAHADTE

SEQ ID NO: 991432 - protein, 9 aa, Homo Sapiens
ILTSYVRIV

SEQ ID NO: 991433 - protein, 9 aa, Homo Sapiens
LLRKGGAWA

SEQ ID NO: 991434 - protein, 9 aa, Homo Sapiens
VGAGAWGLA

SEQ ID NO: 991435 - protein, 9 aa, Homo Sapiens
LPPFCEVGA

SEQ ID NO: 991436 - protein, 9 aa, Homo Sapiens
KEHLNQGSF

SEQ ID NO: 991437 - protein, 9 aa, Homo Sapiens
PNTILGIQP

SEQ ID NO: 991438 - protein, 9 aa, Homo Sapiens
TVLKQNKKK

SEQ ID NO: 991439 - protein, 9 aa, Homo Sapiens
SECSDQRPA

SEQ ID NO: 991440 - protein, 9 aa, Homo Sapiens
IEEEEDEAA

SEQ ID NO: 991441 - protein, 9 aa, Homo Sapiens
VTNTTTTLK

SEQ ID NO: 991442 - protein, 9 aa, Homo Sapiens
LSSIRITLG

SEQ ID NO: 991443 - protein, 9 aa, Homo Sapiens
TCQANSATS

SEQ ID NO: 991444 - protein, 9 aa, Homo Sapiens
KLELSDNEI

SEQ ID NO: 991445 - protein, 9 aa, Homo Sapiens
AVFYRGRFF

SEQ ID NO: 991446 - protein, 9 aa, Homo Sapiens
PISDQQLNI

SEQ ID NO: 991447 - protein, 9 aa, Homo Sapiens
SCLDIFLNE

SEQ ID NO: 991448 - protein, 9 aa, Homo Sapiens
WNYLIGNPE

SEQ ID NO: 991449 - protein, 9 aa, Homo Sapiens
SVYSRGGSM

SEQ ID NO: 991450 - protein, 9 aa, Homo Sapiens
KPVVQLSKK

SEQ ID NO: 991451 - protein, 9 aa, Homo Sapiens
CHVISSVLG

SEQ ID NO: 991452 - protein, 9 aa, Homo Sapiens
HDISIYADK

SEQ ID NO: 991453 - protein, 9 aa, Homo Sapiens
NVPKIKVPK

SEQ ID NO: 991454 - protein, 9 aa, Homo Sapiens
SVIVRLPGL

SEQ ID NO: 991455 - protein, 9 aa, Homo Sapiens
KDINECERE

SEQ ID NO: 991456 - protein, 9 aa, Homo Sapiens
EDCSLMVAI

SEQ ID NO: 991457 - protein, 9 aa, Homo Sapiens
FHHRKDMIL

SEQ ID NO: 991458 - protein, 9 aa, Homo Sapiens
PQNSTGEIY

SEQ ID NO: 991459 - protein, 9 aa, Homo Sapiens
VRKAENSQC

SEQ ID NO: 991460 - protein, 9 aa, Homo Sapiens
LIKPFCEDP

SEQ ID NO: 991461 - protein, 9 aa, Homo Sapiens
GSIFLSMLS

SEQ ID NO: 991462 - protein, 9 aa, Homo Sapiens
HKKHRSIVG

SEQ ID NO: 991463 - protein, 9 aa, Homo Sapiens
LFACMDNML

SEQ ID NO: 991464 - protein, 9 aa, Homo Sapiens
APVLWEETF

SEQ ID NO: 991465 - protein, 9 aa, Homo Sapiens
RLNYITQSL

SEQ ID NO: 991466 - protein, 9 aa, Homo Sapiens
PAVSPGKKL

SEQ ID NO: 991467 - protein, 9 aa, Homo Sapiens
GFIMNGSCV

SEQ ID NO: 991468 - protein, 9 aa, Homo Sapiens
VAGEGQEEL

SEQ ID NO: 991469 - protein, 9 aa, Homo Sapiens
CQNSTVCKP

SEQ ID NO: 991470 - protein, 9 aa, Homo Sapiens
HTNELMVSE

SEQ ID NO: 991471 - protein, 9 aa, Homo Sapiens
TSRALSPQA

SEQ ID NO: 991472 - protein, 9 aa, Homo Sapiens
GIMQVEEIE

SEQ ID NO: 991473 - protein, 9 aa, Homo Sapiens
AKDEVAYTL

SEQ ID NO: 991474 - protein, 9 aa, Homo Sapiens
PKVVTVLKQ

SEQ ID NO: 991475 - protein, 9 aa, Homo Sapiens
KNHPNHVLK

SEQ ID NO: 991476 - protein, 9 aa, Homo Sapiens
PVATKNWEQ

SEQ ID NO: 991477 - protein, 9 aa, Homo Sapiens
GPCHVISSV

SEQ ID NO: 991478 - protein, 9 aa, Homo Sapiens
SWNYLIGNP

SEQ ID NO: 991479 - protein, 9 aa, Homo Sapiens
SSHAFNQSA

SEQ ID NO: 991480 - protein, 9 aa, Homo Sapiens
CRRLNYITQ

SEQ ID NO: 991481 - protein, 9 aa, Homo Sapiens
PEKGMIFVC

SEQ ID NO: 991482 - protein, 9 aa, Homo Sapiens
PAHSDFHVE

SEQ ID NO: 991483 - protein, 9 aa, Homo Sapiens
NSCRKGATC

SEQ ID NO: 991484 - protein, 9 aa, Homo Sapiens
QVTDTCQAN

SEQ ID NO: 991485 - protein, 9 aa, Homo Sapiens
MPQYILKEF

SEQ ID NO: 991486 - protein, 9 aa, Homo Sapiens
FHDEDNLSL

SEQ ID NO: 991487 - protein, 9 aa, Homo Sapiens
FTSWNYLIG

SEQ ID NO: 991488 - protein, 9 aa, Homo Sapiens
VQISQAQLK

SEQ ID NO: 991489 - protein, 9 aa, Homo Sapiens
WRPSRKNKK

SEQ ID NO: 991490 - protein, 9 aa, Homo Sapiens
IFWLLNHDP

SEQ ID NO: 991491 - protein, 9 aa, Homo Sapiens
GPLVRAVVQ

SEQ ID NO: 991492 - protein, 9 aa, Homo Sapiens
APGNPQPVL

SEQ ID NO: 991493 - protein, 9 aa, Homo Sapiens
KDEEEEKRE

SEQ ID NO: 991494 - protein, 9 aa, Homo Sapiens
KVVTVLKQN

SEQ ID NO: 991495 - protein, 9 aa, Homo Sapiens
QEPLGGPPV

SEQ ID NO: 991496 - protein, 9 aa, Homo Sapiens
AKRIAQVCL

SEQ ID NO: 991497 - protein, 9 aa, Homo Sapiens
VVTPQDLKG

SEQ ID NO: 991498 - protein, 9 aa, Homo Sapiens
INLALQKTE

SEQ ID NO: 991499 - protein, 9 aa, Homo Sapiens
FQYRVKVVL

SEQ ID NO: 991500 - protein, 9 aa, Homo Sapiens
HVTDEEIKS

SEQ ID NO: 991501 - protein, 9 aa, Homo Sapiens
EINLAATHK

SEQ ID NO: 991502 - protein, 9 aa, Homo Sapiens
KDIAKRIAQ

SEQ ID NO: 991503 - protein, 9 aa, Homo Sapiens
EDVTNTTTT

SEQ ID NO: 991504 - protein, 9 aa, Homo Sapiens
HLIVEDVTN

SEQ ID NO: 991505 - protein, 9 aa, Homo Sapiens
TSSQEPSEC

SEQ ID NO: 991506 - protein, 9 aa, Homo Sapiens
LPAHSDFHV

SEQ ID NO: 991507 - protein, 9 aa, Homo Sapiens
VIPGRVMGK

SEQ ID NO: 991508 - protein, 9 aa, Homo Sapiens
GWSPSLTLL

SEQ ID NO: 991509 - protein, 9 aa, Homo Sapiens
TSNRPEPIS

SEQ ID NO: 991510 - protein, 9 aa, Homo Sapiens
VALIVRLSF

SEQ ID NO: 991511 - protein, 9 aa, Homo Sapiens
KRKPLEVGY

SEQ ID NO: 991512 - protein, 9 aa, Homo Sapiens
TVPDSIISW

SEQ ID NO: 991513 - protein, 9 aa, Homo Sapiens
KFELTMSCS

SEQ ID NO: 991514 - protein, 9 aa, Homo Sapiens
RAQPTERCL

SEQ ID NO: 991515 - protein, 9 aa, Homo Sapiens
LIVRLSFCG

SEQ ID NO: 991516 - protein, 9 aa, Homo Sapiens
TSFASPHVT

SEQ ID NO: 991517 - protein, 9 aa, Homo Sapiens
QFCKDIAKR

SEQ ID NO: 991518 - protein, 9 aa, Homo Sapiens
SCRKGATCI

SEQ ID NO: 991519 - protein, 9 aa, Homo Sapiens
DADDDPFTL

SEQ ID NO: 991520 - protein, 9 aa, Homo Sapiens
TYLFACRKS

SEQ ID NO: 991521 - protein, 9 aa, Homo Sapiens
ENEEEVNAD

SEQ ID NO: 991522 - protein, 9 aa, Homo Sapiens
TEETGAPSA

SEQ ID NO: 991523 - protein, 9 aa, Homo Sapiens
IGFLFRRKK

SEQ ID NO: 991524 - protein, 9 aa, Homo Sapiens
HVAVFYRGR

SEQ ID NO: 991525 - protein, 9 aa, Homo Sapiens
HKCKYYYPE

SEQ ID NO: 991526 - protein, 9 aa, Homo Sapiens
GQTLDLNCM

SEQ ID NO: 991527 - protein, 9 aa, Homo Sapiens
WEETFDRRV

SEQ ID NO: 991528 - protein, 9 aa, Homo Sapiens
IKARINFGY

SEQ ID NO: 991529 - protein, 9 aa, Homo Sapiens
QHSDPKVQI

SEQ ID NO: 991530 - protein, 9 aa, Homo Sapiens
KQSCNKTFS

SEQ ID NO: 991531 - protein, 9 aa, Homo Sapiens
SELVLEGSL

SEQ ID NO: 991532 - protein, 9 aa, Homo Sapiens
ASDTCGHIG

SEQ ID NO: 991533 - protein, 9 aa, Homo Sapiens
PGRVMGKFS

SEQ ID NO: 991534 - protein, 9 aa, Homo Sapiens
CSSGSSCLP

SEQ ID NO: 991535 - protein, 9 aa, Homo Sapiens
FFSRGCSYT

SEQ ID NO: 991536 - protein, 9 aa, Homo Sapiens
ESQKDKKKD

SEQ ID NO: 991537 - protein, 9 aa, Homo Sapiens
DFVGGLMSD

SEQ ID NO: 991538 - protein, 9 aa, Homo Sapiens
QELDKFMGK

SEQ ID NO: 991539 - protein, 9 aa, Homo Sapiens
QKKVFFRRH

SEQ ID NO: 991540 - protein, 9 aa, Homo Sapiens
ISPFHDISI

SEQ ID NO: 991541 - protein, 9 aa, Homo Sapiens
HGSLKLLAD

SEQ ID NO: 991542 - protein, 9 aa, Homo Sapiens
NMLLSVMAY

SEQ ID NO: 991543 - protein, 9 aa, Homo Sapiens
SPASLHAVL

SEQ ID NO: 991544 - protein, 9 aa, Homo Sapiens
SIFSDTSSN

SEQ ID NO: 991545 - protein, 9 aa, Homo Sapiens
QSVSPVKTL

SEQ ID NO: 991546 - protein, 9 aa, Homo Sapiens
KHPRLCSCL

SEQ ID NO: 991547 - protein, 9 aa, Homo Sapiens
PSRYVSSHA

SEQ ID NO: 991548 - protein, 9 aa, Homo Sapiens
TSECQCVEK

SEQ ID NO: 991549 - protein, 9 aa, Homo Sapiens
GHGSLKLLA

SEQ ID NO: 991550 - protein, 9 aa, Homo Sapiens
EVAYTLTEN

SEQ ID NO: 991551 - protein, 8 aa, Homo Sapiens
DSSYKLIF

SEQ ID NO: 991552 - protein, 9 aa, Homo Sapiens
VFQYRVKVV

SEQ ID NO: 991553 - protein, 9 aa, Homo Sapiens
LVKLRKLEL

SEQ ID NO: 991554 - protein, 9 aa, Homo Sapiens
SLTQTPTGG

SEQ ID NO: 991555 - protein, 9 aa, Homo Sapiens
NELMVSEFV

SEQ ID NO: 991556 - protein, 9 aa, Homo Sapiens
KAENSQCLL

SEQ ID NO: 991557 - protein, 9 aa, Homo Sapiens
RNGFLPKPD

SEQ ID NO: 991558 - protein, 9 aa, Homo Sapiens
TIKDLFRVV

SEQ ID NO: 991559 - protein, 9 aa, Homo Sapiens
RGFSGERGL

SEQ ID NO: 991560 - protein, 9 aa, Homo Sapiens
NDEPGDKDE

SEQ ID NO: 991561 - protein, 9 aa, Homo Sapiens
HKELCILKR

SEQ ID NO: 991562 - protein, 9 aa, Homo Sapiens
STSYKEQEL

SEQ ID NO: 991563 - protein, 9 aa, Homo Sapiens
RGHYEFLVV

SEQ ID NO: 991564 - protein, 9 aa, Homo Sapiens
QSRGSMLAS

SEQ ID NO: 991565 - protein, 9 aa, Homo Sapiens
FPFIEALHK

SEQ ID NO: 991566 - protein, 9 aa, Homo Sapiens
LSMLSGFLY

SEQ ID NO: 991567 - protein, 9 aa, Homo Sapiens
LQGKFYGNP

SEQ ID NO: 991568 - protein, 9 aa, Homo Sapiens
RNKDKSQED

SEQ ID NO: 991569 - protein, 9 aa, Homo Sapiens
CFIFLISFG

SEQ ID NO: 991570 - protein, 9 aa, Homo Sapiens
LGIQPLHTF

SEQ ID NO: 991571 - protein, 9 aa, Homo Sapiens
GKMQYGLFH

SEQ ID NO: 991572 - protein, 9 aa, Homo Sapiens
AHTNELMVS

SEQ ID NO: 991573 - protein, 9 aa, Homo Sapiens
LCSSGSSCL

SEQ ID NO: 991574 - protein, 9 aa, Homo Sapiens
PAGQQPKVL

SEQ ID NO: 991575 - protein, 9 aa, Homo Sapiens
DIAKRIAQV

SEQ ID NO: 991576 - protein, 9 aa, Homo Sapiens
YTLTENRVL

SEQ ID NO: 991577 - protein, 9 aa, Homo Sapiens
HPTDVPFIR

SEQ ID NO: 991578 - protein, 9 aa, Homo Sapiens
TASMEDFTP

SEQ ID NO: 991579 - protein, 9 aa, Homo Sapiens
ASEALAGLI

SEQ ID NO: 991580 - protein, 9 aa, Homo Sapiens
VLGHTPEAM

SEQ ID NO: 991581 - protein, 9 aa, Homo Sapiens
MIPNTILGI

SEQ ID NO: 991582 - protein, 9 aa, Homo Sapiens
NYRGRVTDD

SEQ ID NO: 991583 - protein, 9 aa, Homo Sapiens
GSCVIRCHT

SEQ ID NO: 991584 - protein, 9 aa, Homo Sapiens
RHIIQGDYI

SEQ ID NO: 991585 - protein, 9 aa, Homo Sapiens
EIKLLSSLV

SEQ ID NO: 991586 - protein, 9 aa, Homo Sapiens
EPLGGPPVH

SEQ ID NO: 991587 - protein, 9 aa, Homo Sapiens
PRVFQYRVK

SEQ ID NO: 991588 - protein, 9 aa, Homo Sapiens
LSPPPPPSP

SEQ ID NO: 991589 - protein, 9 aa, Homo Sapiens
FLPKPDPQA

SEQ ID NO: 991590 - protein, 9 aa, Homo Sapiens
QPKVLLSPS

SEQ ID NO: 991591 - protein, 9 aa, Homo Sapiens
ARQLALRKK

SEQ ID NO: 991592 - protein, 9 aa, Homo Sapiens
DSDEEKNGQ

SEQ ID NO: 991593 - protein, 9 aa, Homo Sapiens
TEKSRWSGS

SEQ ID NO: 991594 - protein, 9 aa, Homo Sapiens
ILEQEEEEQ

SEQ ID NO: 991595 - protein, 9 aa, Homo Sapiens
RFSSGIAAM

SEQ ID NO: 991596 - protein, 9 aa, Homo Sapiens
MDNMLLSVM

SEQ ID NO: 991597 - protein, 9 aa, Homo Sapiens
PSLPNGNFK

SEQ ID NO: 991598 - protein, 9 aa, Homo Sapiens
SISQDRDEY

SEQ ID NO: 991599 - protein, 9 aa, Homo Sapiens
PGKKLWGEK

SEQ ID NO: 991600 - protein, 9 aa, Homo Sapiens
MLSGFLYPF

SEQ ID NO: 991601 - protein, 9 aa, Homo Sapiens
STRDFIEGE

SEQ ID NO: 991602 - protein, 9 aa, Homo Sapiens
GSVYSRGGS

SEQ ID NO: 991603 - protein, 9 aa, Homo Sapiens
SSMTSHSDT

SEQ ID NO: 991604 - protein, 9 aa, Homo Sapiens
RLENEEEVN

SEQ ID NO: 991605 - protein, 9 aa, Homo Sapiens
MGGGSCYGL

SEQ ID NO: 991606 - protein, 9 aa, Homo Sapiens
HNWIELLDL

SEQ ID NO: 991607 - protein, 9 aa, Homo Sapiens
TGNWFFPFI

SEQ ID NO: 991608 - protein, 9 aa, Homo Sapiens
RSGFFFSRG

SEQ ID NO: 991609 - protein, 9 aa, Homo Sapiens
QERADMSPA

SEQ ID NO: 991610 - protein, 9 aa, Homo Sapiens
PEAMQIATG

SEQ ID NO: 991611 - protein, 9 aa, Homo Sapiens
KQELKKLHK

SEQ ID NO: 991612 - protein, 9 aa, Homo Sapiens
HPRLCSCLH

SEQ ID NO: 991613 - protein, 9 aa, Homo Sapiens
VLKQNKKKE

SEQ ID NO: 991614 - protein, 9 aa, Homo Sapiens
LKIGAREAQ

SEQ ID NO: 991615 - protein, 9 aa, Homo Sapiens
PLGGPPVHL

SEQ ID NO: 991616 - protein, 9 aa, Homo Sapiens
EGQEELEGS

SEQ ID NO: 991617 - protein, 9 aa, Homo Sapiens
RELKRWQLK

SEQ ID NO: 991618 - protein, 9 aa, Homo Sapiens
KVLRKPLEP

SEQ ID NO: 991619 - protein, 9 aa, Homo Sapiens
KRPYLCIHC

SEQ ID NO: 991620 - protein, 9 aa, Homo Sapiens
RFNPEELRM

SEQ ID NO: 991621 - protein, 9 aa, Homo Sapiens
VTLTGLASE

SEQ ID NO: 991622 - protein, 9 aa, Homo Sapiens
LQCDQHRLP

SEQ ID NO: 991623 - protein, 9 aa, Homo Sapiens
SDLNYKVEE

SEQ ID NO: 991624 - protein, 9 aa, Homo Sapiens
AESMASDPR

SEQ ID NO: 991625 - protein, 9 aa, Homo Sapiens
DPQNSTGEI

SEQ ID NO: 991626 - protein, 9 aa, Homo Sapiens
VIFWLLNHD

SEQ ID NO: 991627 - protein, 9 aa, Homo Sapiens
SLLLHCGQL

SEQ ID NO: 991628 - protein, 9 aa, Homo Sapiens
RQREQKEQE

SEQ ID NO: 991629 - protein, 9 aa, Homo Sapiens
RVKVVLQAM

SEQ ID NO: 991630 - protein, 9 aa, Homo Sapiens
QYRVKVVLQ

SEQ ID NO: 991631 - protein, 9 aa, Homo Sapiens
DDPHANDFV

SEQ ID NO: 991632 - protein, 9 aa, Homo Sapiens
YNMPQYILK

SEQ ID NO: 991633 - protein, 9 aa, Homo Sapiens
SFGFVIISY

SEQ ID NO: 991634 - protein, 9 aa, Homo Sapiens
VTDEEIKSL

SEQ ID NO: 991635 - protein, 9 aa, Homo Sapiens
MLEQKRDSW

SEQ ID NO: 991636 - protein, 9 aa, Homo Sapiens
GSMLASGLH

SEQ ID NO: 991637 - protein, 9 aa, Homo Sapiens
KSVIFWLLN

SEQ ID NO: 991638 - protein, 9 aa, Homo Sapiens
VKNAYIKDD

SEQ ID NO: 991639 - protein, 9 aa, Homo Sapiens
LYCWNLERN

SEQ ID NO: 991640 - protein, 9 aa, Homo Sapiens
TDVQKKVFF

SEQ ID NO: 991641 - protein, 9 aa, Homo Sapiens
NPQPVLSQA

SEQ ID NO: 991642 - protein, 9 aa, Homo Sapiens
EPSECSDQR

SEQ ID NO: 991643 - protein, 9 aa, Homo Sapiens
QAKMVVRLQ

SEQ ID NO: 991644 - protein, 9 aa, Homo Sapiens
KPFCEDPDQ

SEQ ID NO: 991645 - protein, 9 aa, Homo Sapiens
GRVMGKFSI

SEQ ID NO: 991646 - protein, 9 aa, Homo Sapiens
LAPVLWEET

SEQ ID NO: 991647 - protein, 9 aa, Homo Sapiens
KLLSSLVLL

SEQ ID NO: 991648 - protein, 9 aa, Homo Sapiens
AQPTERCLK

SEQ ID NO: 991649 - protein, 9 aa, Homo Sapiens
FMGKMQYGL

SEQ ID NO: 991650 - protein, 9 aa, Homo Sapiens
MVCQKQDPL

SEQ ID NO: 991651 - protein, 9 aa, Homo Sapiens
ISSLAELET

SEQ ID NO: 991652 - protein, 9 aa, Homo Sapiens
LANCRTNEI

SEQ ID NO: 991653 - protein, 9 aa, Homo Sapiens
QKDKKKDKK

SEQ ID NO: 991654 - protein, 9 aa, Homo Sapiens
TRSVIVRLP

SEQ ID NO: 991655 - protein, 9 aa, Homo Sapiens
DSSFAKHQK

SEQ ID NO: 991656 - protein, 9 aa, Homo Sapiens
NGSCVIRCH

SEQ ID NO: 991657 - protein, 9 aa, Homo Sapiens
SYVRIVVAV

SEQ ID NO: 991658 - protein, 9 aa, Homo Sapiens
MGANRGIHV

SEQ ID NO: 991659 - protein, 9 aa, Homo Sapiens
RALSPQAGR

SEQ ID NO: 991660 - protein, 9 aa, Homo Sapiens
QKVLRKPLE

SEQ ID NO: 991661 - protein, 9 aa, Homo Sapiens
QDLKGPGRA

SEQ ID NO: 991662 - protein, 9 aa, Homo Sapiens
DNYAPDSIY

SEQ ID NO: 991663 - protein, 9 aa, Homo Sapiens
CSPPVGPPG

SEQ ID NO: 991664 - protein, 9 aa, Homo Sapiens
LNDTIKDLF

SEQ ID NO: 991665 - protein, 9 aa, Homo Sapiens
YYYPERGSQ

SEQ ID NO: 991666 - protein, 9 aa, Homo Sapiens
TSYKEQELL

SEQ ID NO: 991667 - protein, 9 aa, Homo Sapiens
QEVDLANCR

SEQ ID NO: 991668 - protein, 9 aa, Homo Sapiens
HIIQGDYID

SEQ ID NO: 991669 - protein, 9 aa, Homo Sapiens
QFESVCEFV

SEQ ID NO: 991670 - protein, 9 aa, Homo Sapiens
ECQCVEKNT

SEQ ID NO: 991671 - protein, 9 aa, Homo Sapiens
QELKKLHKE

SEQ ID NO: 991672 - protein, 9 aa, Homo Sapiens
SSQEPSECS

SEQ ID NO: 991673 - protein, 9 aa, Homo Sapiens
DHGQLISFK

SEQ ID NO: 991674 - protein, 9 aa, Homo Sapiens
SPRELEGSV

SEQ ID NO: 991675 - protein, 9 aa, Homo Sapiens
FHVEPCCGP

SEQ ID NO: 991676 - protein, 9 aa, Homo Sapiens
CEVGARLLE

SEQ ID NO: 991677 - protein, 9 aa, Homo Sapiens
NASNSTLSL

SEQ ID NO: 991678 - protein, 9 aa, Homo Sapiens
DKEFVVEVN

SEQ ID NO: 991679 - protein, 9 aa, Homo Sapiens
FACMDNMLL

SEQ ID NO: 991680 - protein, 9 aa, Homo Sapiens
WKVFTSWNY

SEQ ID NO: 991681 - protein, 9 aa, Homo Sapiens
AESGDIQAK

SEQ ID NO: 991682 - protein, 9 aa, Homo Sapiens
QNSTGEIYL

SEQ ID NO: 991683 - protein, 9 aa, Homo Sapiens
IFLSMLSGF

SEQ ID NO: 991684 - protein, 9 aa, Homo Sapiens
KRWQLKANE

SEQ ID NO: 991685 - protein, 9 aa, Homo Sapiens
SVQYLVNRP

SEQ ID NO: 991686 - protein, 9 aa, Homo Sapiens
LTIVQCFIS

SEQ ID NO: 991687 - protein, 9 aa, Homo Sapiens
LSGEIGPCH

SEQ ID NO: 991688 - protein, 9 aa, Homo Sapiens
YLFACRKSN

SEQ ID NO: 991689 - protein, 9 aa, Homo Sapiens
EVIEMYKGS

SEQ ID NO: 991690 - protein, 9 aa, Homo Sapiens
LLSLSCTDL

SEQ ID NO: 991691 - protein, 9 aa, Homo Sapiens
GHKCKYYYP

SEQ ID NO: 991692 - protein, 9 aa, Homo Sapiens
TMIPNTILG

SEQ ID NO: 991693 - protein, 9 aa, Homo Sapiens
KKHRSIVGP

SEQ ID NO: 991694 - protein, 9 aa, Homo Sapiens
SNSCRKGAT

SEQ ID NO: 991695 - protein, 9 aa, Homo Sapiens
KKLWGEKAG

SEQ ID NO: 991696 - protein, 9 aa, Homo Sapiens
KSQEDSSLH

SEQ ID NO: 991697 - protein, 9 aa, Homo Sapiens
VSPPGLDGV

SEQ ID NO: 991698 - protein, 9 aa, Homo Sapiens
PRELEGSVY

SEQ ID NO: 991699 - protein, 9 aa, Homo Sapiens
PKAENSWKP

SEQ ID NO: 991700 - protein, 9 aa, Homo Sapiens
RDGSVQYLV

SEQ ID NO: 991701 - protein, 9 aa, Homo Sapiens
KQNKKKEEK

SEQ ID NO: 991702 - protein, 9 aa, Homo Sapiens
VVQLSKKKV

SEQ ID NO: 991703 - protein, 9 aa, Homo Sapiens
GQQPKVLLS

SEQ ID NO: 991704 - protein, 9 aa, Homo Sapiens
ALKHPRLCS

SEQ ID NO: 991705 - protein, 9 aa, Homo Sapiens
APHSDYINA

SEQ ID NO: 991706 - protein, 9 aa, Homo Sapiens
EKNGQGEGK

SEQ ID NO: 991707 - protein, 9 aa, Homo Sapiens
TERCLKNAQ

SEQ ID NO: 991708 - protein, 9 aa, Homo Sapiens
DKAFVRNLY

SEQ ID NO: 991709 - protein, 9 aa, Homo Sapiens
LVNRPREPC

SEQ ID NO: 991710 - protein, 9 aa, Homo Sapiens
DDDPFTLAL

SEQ ID NO: 991711 - protein, 9 aa, Homo Sapiens
REALLDRKS

SEQ ID NO: 991712 - protein, 9 aa, Homo Sapiens
LALRKKLPL

SEQ ID NO: 991713 - protein, 9 aa, Homo Sapiens
CTDLFTNEL

SEQ ID NO: 991714 - protein, 9 aa, Homo Sapiens
EFLVVDDLS

SEQ ID NO: 991715 - protein, 9 aa, Homo Sapiens
DLLQLKKGD

SEQ ID NO: 991716 - protein, 9 aa, Homo Sapiens
ILWACPGLG

SEQ ID NO: 991717 - protein, 9 aa, Homo Sapiens
PLVRAVVQG

SEQ ID NO: 991718 - protein, 9 aa, Homo Sapiens
QLFQTTRFI

SEQ ID NO: 991719 - protein, 9 aa, Homo Sapiens
STARYASIN

SEQ ID NO: 991720 - protein, 9 aa, Homo Sapiens
ASMEDFTPS

SEQ ID NO: 991721 - protein, 9 aa, Homo Sapiens
PFTLALLQA

SEQ ID NO: 991722 - protein, 9 aa, Homo Sapiens
FIKTKDLPV

SEQ ID NO: 991723 - protein, 9 aa, Homo Sapiens
GHYEFLVVD

SEQ ID NO: 991724 - protein, 9 aa, Homo Sapiens
NTTTTLKWR

SEQ ID NO: 991725 - protein, 9 aa, Homo Sapiens
YYPERGSQP

SEQ ID NO: 991726 - protein, 9 aa, Homo Sapiens
DFSVIAMID

SEQ ID NO: 991727 - protein, 9 aa, Homo Sapiens
VTIKAQELS

SEQ ID NO: 991728 - protein, 9 aa, Homo Sapiens
TILGIQPLH

SEQ ID NO: 991729 - protein, 9 aa, Homo Sapiens
VPAGTTVNS

SEQ ID NO: 991730 - protein, 9 aa, Homo Sapiens
VVAGEGQEE

SEQ ID NO: 991731 - protein, 9 aa, Homo Sapiens
GPDICSPPV

SEQ ID NO: 991732 - protein, 9 aa, Homo Sapiens
DLFRVVPGN

SEQ ID NO: 991733 - protein, 9 aa, Homo Sapiens
GWGPSFLGG

SEQ ID NO: 991734 - protein, 9 aa, Homo Sapiens
HSFLALYYE

SEQ ID NO: 991735 - protein, 9 aa, Homo Sapiens
IVAKDEVAY

SEQ ID NO: 991736 - protein, 9 aa, Homo Sapiens
QRTAAAALE

SEQ ID NO: 991737 - protein, 9 aa, Homo Sapiens
GAGAWGLAP

SEQ ID NO: 991738 - protein, 9 aa, Homo Sapiens
TGVSFTFFK

SEQ ID NO: 991739 - protein, 9 aa, Homo Sapiens
GCSMGSRAA

SEQ ID NO: 991740 - protein, 9 aa, Homo Sapiens
SRYVSSHAF

SEQ ID NO: 991741 - protein, 9 aa, Homo Sapiens
GEEEEEKDE

SEQ ID NO: 991742 - protein, 9 aa, Homo Sapiens
LFTNELVIF

SEQ ID NO: 991743 - protein, 9 aa, Homo Sapiens
VCDKGFHRS

SEQ ID NO: 991744 - protein, 9 aa, Homo Sapiens
KFYGNPMHV

SEQ ID NO: 991745 - protein, 9 aa, Homo Sapiens
IPGSIFLSM

SEQ ID NO: 991746 - protein, 9 aa, Homo Sapiens
GVFLGGCSM

SEQ ID NO: 991747 - protein, 9 aa, Homo Sapiens
VLENVKNAY

SEQ ID NO: 991748 - protein, 9 aa, Homo Sapiens
PPGLDGVRW

SEQ ID NO: 991749 - protein, 9 aa, Homo Sapiens
LRALTTLGA

SEQ ID NO: 991750 - protein, 9 aa, Homo Sapiens
RKLELSDNE

SEQ ID NO: 991751 - protein, 9 aa, Homo Sapiens
SPRACPTAR

SEQ ID NO: 991752 - protein, 9 aa, Homo Sapiens
KSVCRRLNY

SEQ ID NO: 991753 - protein, 9 aa, Homo Sapiens
SDTCGHIGR

SEQ ID NO: 991754 - protein, 9 aa, Homo Sapiens
EGSVYSRGG

SEQ ID NO: 991755 - protein, 9 aa, Homo Sapiens
SRAPRILAS

SEQ ID NO: 991756 - protein, 9 aa, Homo Sapiens
EELEGSLLL

SEQ ID NO: 991757 - protein, 9 aa, Homo Sapiens
KILGFIKTK

SEQ ID NO: 991758 - protein, 9 aa, Homo Sapiens
EVTVPDSII

SEQ ID NO: 991759 - protein, 9 aa, Homo Sapiens
ASNSTLSLT

SEQ ID NO: 991760 - protein, 9 aa, Homo Sapiens
SKILGFIKT

SEQ ID NO: 991761 - protein, 9 aa, Homo Sapiens
SPRRVRFRL

SEQ ID NO: 991762 - protein, 9 aa, Homo Sapiens
IGDFGLATE

SEQ ID NO: 991763 - protein, 9 aa, Homo Sapiens
DDDPHANDF

SEQ ID NO: 991764 - protein, 9 aa, Homo Sapiens
GFPQFPLQI

SEQ ID NO: 991765 - protein, 9 aa, Homo Sapiens
KFMGKMQYG

SEQ ID NO: 991766 - protein, 9 aa, Homo Sapiens
DICSPPVGP

SEQ ID NO: 991767 - protein, 9 aa, Homo Sapiens
KNLTSTARY

SEQ ID NO: 991768 - protein, 9 aa, Homo Sapiens
KPLEPAALQ

SEQ ID NO: 991769 - protein, 9 aa, Homo Sapiens
PTASMEDFT

SEQ ID NO: 991770 - protein, 9 aa, Homo Sapiens
EEIKSLMKD

SEQ ID NO: 991771 - protein, 9 aa, Homo Sapiens
EGEEEEEKD

SEQ ID NO: 991772 - protein, 9 aa, Homo Sapiens
ARINFGYNL

SEQ ID NO: 991773 - protein, 9 aa, Homo Sapiens
LAEAPADPR

SEQ ID NO: 991774 - protein, 9 aa, Homo Sapiens
LATEKSRWS

SEQ ID NO: 991775 - protein, 9 aa, Homo Sapiens
RHSFLALYY

SEQ ID NO: 991776 - protein, 9 aa, Homo Sapiens
RAQAADAFL

SEQ ID NO: 991777 - protein, 9 aa, Homo Sapiens
VPFIRILSR

SEQ ID NO: 991778 - protein, 9 aa, Homo Sapiens
TSTLTALKH

SEQ ID NO: 991779 - protein, 9 aa, Homo Sapiens
QPTERCLKN

SEQ ID NO: 991780 - protein, 9 aa, Homo Sapiens
KELPLLRKG

SEQ ID NO: 991781 - protein, 9 aa, Homo Sapiens
LSNPKQSCN

SEQ ID NO: 991782 - protein, 9 aa, Homo Sapiens
EIHNWIELL

SEQ ID NO: 991783 - protein, 9 aa, Homo Sapiens
CQGMNFIAR

SEQ ID NO: 991784 - protein, 9 aa, Homo Sapiens
CSEHRHSFL

SEQ ID NO: 991785 - protein, 9 aa, Homo Sapiens
EEILGPILP

SEQ ID NO: 991786 - protein, 9 aa, Homo Sapiens
SPFHDISIY

SEQ ID NO: 991787 - protein, 9 aa, Homo Sapiens
KRRISIGFL

SEQ ID NO: 991788 - protein, 9 aa, Homo Sapiens
FYRGRFFRM

SEQ ID NO: 991789 - protein, 9 aa, Homo Sapiens
TAAAALEAS

SEQ ID NO: 991790 - protein, 9 aa, Homo Sapiens
GQFESVCEF

SEQ ID NO: 991791 - protein, 9 aa, Homo Sapiens
SEKNQPTEK

SEQ ID NO: 991792 - protein, 9 aa, Homo Sapiens
APVLLCSSG

SEQ ID NO: 991793 - protein, 9 aa, Homo Sapiens
SQTRRSIFS

SEQ ID NO: 991794 - protein, 9 aa, Homo Sapiens
EIRAQAADA

SEQ ID NO: 991795 - protein, 9 aa, Homo Sapiens
DGAPHSDYI

SEQ ID NO: 991796 - protein, 9 aa, Homo Sapiens
GNGKTVRLS

SEQ ID NO: 991797 - protein, 9 aa, Homo Sapiens
EGKRPGSLR

SEQ ID NO: 991798 - protein, 9 aa, Homo Sapiens
FCEVGARLL

SEQ ID NO: 991799 - protein, 9 aa, Homo Sapiens
RTIKGPHLA

SEQ ID NO: 991800 - protein, 9 aa, Homo Sapiens
MDQLLAHEA

SEQ ID NO: 991801 - protein, 9 aa, Homo Sapiens
FSNEIEVDF

SEQ ID NO: 991802 - protein, 9 aa, Homo Sapiens
SSLVLLVCC

SEQ ID NO: 991803 - protein, 9 aa, Homo Sapiens
QGLAEAPAD

SEQ ID NO: 991804 - protein, 9 aa, Homo Sapiens
GGGWGPSFL

SEQ ID NO: 991805 - protein, 9 aa, Homo Sapiens
WNQFSWPFG

SEQ ID NO: 991806 - protein, 9 aa, Homo Sapiens
KELSERLEN

SEQ ID NO: 991807 - protein, 9 aa, Homo Sapiens
AGEGQEELE

SEQ ID NO: 991808 - protein, 9 aa, Homo Sapiens
TALKHPRLC

SEQ ID NO: 991809 - protein, 9 aa, Homo Sapiens
VNWQDPKSD

SEQ ID NO: 991810 - protein, 9 aa, Homo Sapiens
SLRFSSGIA

SEQ ID NO: 991811 - protein, 9 aa, Homo Sapiens
CRSSSLTRH

SEQ ID NO: 991812 - protein, 9 aa, Homo Sapiens
ARLDLLQLK

SEQ ID NO: 991813 - protein, 9 aa, Homo Sapiens
AIKVLQRNC

SEQ ID NO: 991814 - protein, 9 aa, Homo Sapiens
WEHDKQETD

SEQ ID NO: 991815 - protein, 9 aa, Homo Sapiens
SMTSHSDTT

SEQ ID NO: 991816 - protein, 9 aa, Homo Sapiens
ISFKGCMTQ

SEQ ID NO: 991817 - protein, 9 aa, Homo Sapiens
RESVTIKAQ

SEQ ID NO: 991818 - protein, 9 aa, Homo Sapiens
NSTVCKPGW

SEQ ID NO: 991819 - protein, 9 aa, Homo Sapiens
HRSIVGPSK

SEQ ID NO: 991820 - protein, 9 aa, Homo Sapiens
ILGPILPIV

SEQ ID NO: 991821 - protein, 9 aa, Homo Sapiens
TGKYSPASL

SEQ ID NO: 991822 - protein, 9 aa, Homo Sapiens
EAMQIATGR

SEQ ID NO: 991823 - protein, 9 aa, Homo Sapiens
MTSHSDTTS

SEQ ID NO: 991824 - protein, 9 aa, Homo Sapiens
LNDIIKNSD

SEQ ID NO: 991825 - protein, 9 aa, Homo Sapiens
FPQFPLQIP

SEQ ID NO: 991826 - protein, 9 aa, Homo Sapiens
LPLACSPDY

SEQ ID NO: 991827 - protein, 9 aa, Homo Sapiens
RINFGYNLQ

SEQ ID NO: 991828 - protein, 9 aa, Homo Sapiens
IFPVAIVML

SEQ ID NO: 991829 - protein, 9 aa, Homo Sapiens
NPGLDARIS

SEQ ID NO: 991830 - protein, 9 aa, Homo Sapiens
NQGSFQETD

SEQ ID NO: 991831 - protein, 9 aa, Homo Sapiens
KVFTSWNYL

SEQ ID NO: 991832 - protein, 9 aa, Homo Sapiens
LERNQFSFV

SEQ ID NO: 991833 - protein, 9 aa, Homo Sapiens
AGYVFFQIT

SEQ ID NO: 991834 - protein, 9 aa, Homo Sapiens
NGDNYAPDS

SEQ ID NO: 991835 - protein, 9 aa, Homo Sapiens
CSCLHWEDH

SEQ ID NO: 991836 - protein, 9 aa, Homo Sapiens
QERVALGSF

SEQ ID NO: 991837 - protein, 9 aa, Homo Sapiens
TPLVDTKWR

SEQ ID NO: 991838 - protein, 9 aa, Homo Sapiens
LMVSEFVLL

SEQ ID NO: 991839 - protein, 9 aa, Homo Sapiens
FSAVFTDIC

SEQ ID NO: 991840 - protein, 9 aa, Homo Sapiens
YFHDEDNLS

SEQ ID NO: 991841 - protein, 9 aa, Homo Sapiens
LENVKNAYI

SEQ ID NO: 991842 - protein, 9 aa, Homo Sapiens
SLKLLADVQ

SEQ ID NO: 991843 - protein, 9 aa, Homo Sapiens
YISPFHDIS

SEQ ID NO: 991844 - protein, 9 aa, Homo Sapiens
DPEKGMIFV

SEQ ID NO: 991845 - protein, 9 aa, Homo Sapiens
FLVVDDLSS

SEQ ID NO: 991846 - protein, 9 aa, Homo Sapiens
HKPMVCQKQ

SEQ ID NO: 991847 - protein, 9 aa, Homo Sapiens
EPPASPTPL

SEQ ID NO: 991848 - protein, 9 aa, Homo Sapiens
EMHQCWSDE

SEQ ID NO: 991849 - protein, 9 aa, Homo Sapiens
QYLVNRPRE

SEQ ID NO: 991850 - protein, 9 aa, Homo Sapiens
PHPLDLLFH

SEQ ID NO: 991851 - protein, 9 aa, Homo Sapiens
AARARLDLL

SEQ ID NO: 991852 - protein, 9 aa, Homo Sapiens
YRSGFFFSR

SEQ ID NO: 991853 - protein, 9 aa, Homo Sapiens
KHTGKRPYL

SEQ ID NO: 991854 - protein, 9 aa, Homo Sapiens
ELDKFMGKM

SEQ ID NO: 991855 - protein, 9 aa, Homo Sapiens
SIFLSMLSG

SEQ ID NO: 991856 - protein, 9 aa, Homo Sapiens
CDKGFHRSS

SEQ ID NO: 991857 - protein, 9 aa, Homo Sapiens
KGMAKKSLV

SEQ ID NO: 991858 - protein, 9 aa, Homo Sapiens
KKVQKKSYR

SEQ ID NO: 991859 - protein, 9 aa, Homo Sapiens
SVTIKAQEL

SEQ ID NO: 991860 - protein, 9 aa, Homo Sapiens
GKRPYLCIH

SEQ ID NO: 991861 - protein, 9 aa, Homo Sapiens
KHLGEITYL

SEQ ID NO: 991862 - protein, 9 aa, Homo Sapiens
GHAPVLLCS

SEQ ID NO: 991863 - protein, 9 aa, Homo Sapiens
RTALAMGAN

SEQ ID NO: 991864 - protein, 9 aa, Homo Sapiens
TGKETVNAI

SEQ ID NO: 991865 - protein, 9 aa, Homo Sapiens
RAPRILASW

SEQ ID NO: 991866 - protein, 9 aa, Homo Sapiens
SERFNPEEL

SEQ ID NO: 991867 - protein, 9 aa, Homo Sapiens
TEVSTACAT

SEQ ID NO: 991868 - protein, 9 aa, Homo Sapiens
NFIARYLIL

SEQ ID NO: 991869 - protein, 9 aa, Homo Sapiens
ALSPQAGRS

SEQ ID NO: 991870 - protein, 9 aa, Homo Sapiens
SVLENVKNA

SEQ ID NO: 991871 - protein, 9 aa, Homo Sapiens
TIKGPHLAN

SEQ ID NO: 991872 - protein, 9 aa, Homo Sapiens
FSDTSSNKK

SEQ ID NO: 991873 - protein, 9 aa, Homo Sapiens
DTVGAGAWG

SEQ ID NO: 991874 - protein, 9 aa, Homo Sapiens
LCSCLHWED

SEQ ID NO: 991875 - protein, 9 aa, Homo Sapiens
TMSCSSLEI

SEQ ID NO: 991876 - protein, 9 aa, Homo Sapiens
TGLASEALA

SEQ ID NO: 991877 - protein, 9 aa, Homo Sapiens
KYYYPERGS

SEQ ID NO: 991878 - protein, 9 aa, Homo Sapiens
LEHECDTVG

SEQ ID NO: 991879 - protein, 9 aa, Homo Sapiens
NWQDPKSDL

SEQ ID NO: 991880 - protein, 9 aa, Homo Sapiens
KNTLECSAK

SEQ ID NO: 991881 - protein, 9 aa, Homo Sapiens
HECDTVGAG

SEQ ID NO: 991882 - protein, 9 aa, Homo Sapiens
NRSSNSYGR

SEQ ID NO: 991883 - protein, 9 aa, Homo Sapiens
QYILILSIS

SEQ ID NO: 991884 - protein, 9 aa, Homo Sapiens
IRITLGGLT

SEQ ID NO: 991885 - protein, 9 aa, Homo Sapiens
GTSTSQSSE

SEQ ID NO: 991886 - protein, 9 aa, Homo Sapiens
SPSLTLLLM

SEQ ID NO: 991887 - protein, 9 aa, Homo Sapiens
DPHANDFVG

SEQ ID NO: 991888 - protein, 9 aa, Homo Sapiens
DPSRYVSSH

SEQ ID NO: 991889 - protein, 9 aa, Homo Sapiens
CGQLTDGVS

SEQ ID NO: 991890 - protein, 9 aa, Homo Sapiens
WQDPKSDLE

SEQ ID NO: 991891 - protein, 9 aa, Homo Sapiens
DSSSSSSGE

SEQ ID NO: 991892 - protein, 9 aa, Homo Sapiens
GKYSPASLH

SEQ ID NO: 991893 - protein, 9 aa, Homo Sapiens
LDRKSENAS

SEQ ID NO: 991894 - protein, 9 aa, Homo Sapiens
AAAALEASP

SEQ ID NO: 991895 - protein, 9 aa, Homo Sapiens
YRGRVTDDW

SEQ ID NO: 991896 - protein, 9 aa, Homo Sapiens
LIVEDVTNT

SEQ ID NO: 991897 - protein, 9 aa, Homo Sapiens
KDKSQEDSS

SEQ ID NO: 991898 - protein, 9 aa, Homo Sapiens
VATKNWEQK

SEQ ID NO: 991899 - protein, 9 aa, Homo Sapiens
KNGQGEGKE

SEQ ID NO: 991900 - protein, 9 aa, Homo Sapiens
FLVNWQDPK

SEQ ID NO: 991901 - protein, 9 aa, Homo Sapiens
SDEEKNGQG

SEQ ID NO: 991902 - protein, 9 aa, Homo Sapiens
GLRGFSGER

SEQ ID NO: 991903 - protein, 9 aa, Homo Sapiens
LTGVTCEKD

SEQ ID NO: 991904 - protein, 9 aa, Homo Sapiens
TSWNYLIGN

SEQ ID NO: 991905 - protein, 9 aa, Homo Sapiens
RLSFCGPNE

SEQ ID NO: 991906 - protein, 9 aa, Homo Sapiens
MRKNRLLHL

SEQ ID NO: 991907 - protein, 9 aa, Homo Sapiens
DECASNSCR

SEQ ID NO: 991908 - protein, 9 aa, Homo Sapiens
GYAYLECLQ

SEQ ID NO: 991909 - protein, 9 aa, Homo Sapiens
NIWNQFSWP

SEQ ID NO: 991910 - protein, 9 aa, Homo Sapiens
LLLHCGQLT

SEQ ID NO: 991911 - protein, 9 aa, Homo Sapiens
QLQALLTTQ

SEQ ID NO: 991912 - protein, 9 aa, Homo Sapiens
GLHLPAHSD

SEQ ID NO: 991913 - protein, 9 aa, Homo Sapiens
FSWPFGALL

SEQ ID NO: 991914 - protein, 9 aa, Homo Sapiens
DLLFHSAKV

SEQ ID NO: 991915 - protein, 9 aa, Homo Sapiens
SCVYRSGFF

SEQ ID NO: 991916 - protein, 9 aa, Homo Sapiens
EEEEKDEEE

SEQ ID NO: 991917 - protein, 9 aa, Homo Sapiens
PRRVRFRLS

SEQ ID NO: 991918 - protein, 9 aa, Homo Sapiens
GFLFRRKKD

SEQ ID NO: 991919 - protein, 9 aa, Homo Sapiens
LKNLTFNFS

SEQ ID NO: 991920 - protein, 9 aa, Homo Sapiens
YLKGMAKKS

SEQ ID NO: 991921 - protein, 9 aa, Homo Sapiens
SYIVITAME

SEQ ID NO: 991922 - protein, 9 aa, Homo Sapiens
SFSSMTSHS

SEQ ID NO: 991923 - protein, 9 aa, Homo Sapiens
RGRSNLFWD

SEQ ID NO: 991924 - protein, 9 aa, Homo Sapiens
KKKVQKKSY

SEQ ID NO: 991925 - protein, 9 aa, Homo Sapiens
VSSHAFNQS

SEQ ID NO: 991926 - protein, 9 aa, Homo Sapiens
EHECDTVGA

SEQ ID NO: 991927 - protein, 9 aa, Homo Sapiens
GPGGAGTAP

SEQ ID NO: 991928 - protein, 9 aa, Homo Sapiens
HRIQRITSI

SEQ ID NO: 991929 - protein, 9 aa, Homo Sapiens
GEGDHGLLS

SEQ ID NO: 991930 - protein, 9 aa, Homo Sapiens
TSTARYASI

SEQ ID NO: 991931 - protein, 9 aa, Homo Sapiens
WLAPVLWEE

SEQ ID NO: 991932 - protein, 9 aa, Homo Sapiens
VTPQDLKGP

SEQ ID NO: 991933 - protein, 9 aa, Homo Sapiens
GDKDEEDEE

SEQ ID NO: 991934 - protein, 9 aa, Homo Sapiens
LLLMSGGPA

SEQ ID NO: 991935 - protein, 9 aa, Homo Sapiens
GEIGPCHVI

SEQ ID NO: 991936 - protein, 9 aa, Homo Sapiens
WFGPTEVST

SEQ ID NO: 991937 - protein, 9 aa, Homo Sapiens
LHDSTSYKE

SEQ ID NO: 991938 - protein, 9 aa, Homo Sapiens
PGMGGGSCY

SEQ ID NO: 991939 - protein, 9 aa, Homo Sapiens
KPLEVGYSA

SEQ ID NO: 991940 - protein, 9 aa, Homo Sapiens
AQQGCFCGS

SEQ ID NO: 991941 - protein, 9 aa, Homo Sapiens
NSQTRRSIF

SEQ ID NO: 991942 - protein, 9 aa, Homo Sapiens
PRLCSCLHW

SEQ ID NO: 991943 - protein, 9 aa, Homo Sapiens
AVGPLVRAV

SEQ ID NO: 991944 - protein, 9 aa, Homo Sapiens
MSCSSLEIN

SEQ ID NO: 991945 - protein, 9 aa, Homo Sapiens
TAFYLSHET

SEQ ID NO: 991946 - protein, 9 aa, Homo Sapiens
PLRALTTLG

SEQ ID NO: 991947 - protein, 9 aa, Homo Sapiens
ARALHPSSP

SEQ ID NO: 991948 - protein, 9 aa, Homo Sapiens
GQLTDGVSQ

SEQ ID NO: 991949 - protein, 9 aa, Homo Sapiens
HVEPCCGPR

SEQ ID NO: 991950 - protein, 9 aa, Homo Sapiens
SGWSPSLTL

SEQ ID NO: 991951 - protein, 9 aa, Homo Sapiens
SSELKKHSD

SEQ ID NO: 991952 - protein, 9 aa, Homo Sapiens
GLSLKTVDS

SEQ ID NO: 991953 - protein, 9 aa, Homo Sapiens
RNDLDDPEK

SEQ ID NO: 991954 - protein, 9 aa, Homo Sapiens
KRGLSLKTV

SEQ ID NO: 991955 - protein, 9 aa, Homo Sapiens
TVIPGRVMG

SEQ ID NO: 991956 - protein, 9 aa, Homo Sapiens
GLATEKSRW

SEQ ID NO: 991957 - protein, 9 aa, Homo Sapiens
LSCTDLFTN

SEQ ID NO: 991958 - protein, 9 aa, Homo Sapiens
ESSPSSHPA

SEQ ID NO: 991959 - protein, 9 aa, Homo Sapiens
KITREDMSS

SEQ ID NO: 991960 - protein, 9 aa, Homo Sapiens
IFTPLVDTK

SEQ ID NO: 991961 - protein, 9 aa, Homo Sapiens
SHKKHRSIV

SEQ ID NO: 991962 - protein, 9 aa, Homo Sapiens
GGSCYGLHL

SEQ ID NO: 991963 - protein, 9 aa, Homo Sapiens
LSLSCTDLF

SEQ ID NO: 991964 - protein, 9 aa, Homo Sapiens
YRENKNLTS

SEQ ID NO: 991965 - protein, 9 aa, Homo Sapiens
AQLQALLTT

SEQ ID NO: 991966 - protein, 9 aa, Homo Sapiens
SALYCWNLE

SEQ ID NO: 991967 - protein, 9 aa, Homo Sapiens
IDECASNSC

SEQ ID NO: 991968 - protein, 9 aa, Homo Sapiens
LVNWQDPKS

SEQ ID NO: 991969 - protein, 9 aa, Homo Sapiens
FWPLGITAF

SEQ ID NO: 991970 - protein, 9 aa, Homo Sapiens
LGGPPVHLA

SEQ ID NO: 991971 - protein, 9 aa, Homo Sapiens
EALLDRKSE

SEQ ID NO: 991972 - protein, 9 aa, Homo Sapiens
QLKPSTLVP

SEQ ID NO: 991973 - protein, 9 aa, Homo Sapiens
LHPSSPRAC

SEQ ID NO: 991974 - protein, 9 aa, Homo Sapiens
WIELLDLFN

SEQ ID NO: 991975 - protein, 9 aa, Homo Sapiens
IAILWACPG

SEQ ID NO: 991976 - protein, 9 aa, Homo Sapiens
FSFPGLFSS

SEQ ID NO: 991977 - protein, 9 aa, Homo Sapiens
ETSFASPHV

SEQ ID NO: 991978 - protein, 9 aa, Homo Sapiens
IKVPKFSVS

SEQ ID NO: 991979 - protein, 9 aa, Homo Sapiens
NYKVEEEKL

SEQ ID NO: 991980 - protein, 9 aa, Homo Sapiens
QHVAVFYRG

SEQ ID NO: 991981 - protein, 9 aa, Homo Sapiens
IAMIDVEAG

SEQ ID NO: 991982 - protein, 9 aa, Homo Sapiens
IQAKMVVRL

SEQ ID NO: 991983 - protein, 9 aa, Homo Sapiens
TGVTCEKDI

SEQ ID NO: 991984 - protein, 9 aa, Homo Sapiens
SPGKKLWGE

SEQ ID NO: 991985 - protein, 9 aa, Homo Sapiens
RYRLNPNKY

SEQ ID NO: 991986 - protein, 9 aa, Homo Sapiens
LDARISSLA

SEQ ID NO: 991987 - protein, 9 aa, Homo Sapiens
GAGTSTSQS

SEQ ID NO: 991988 - protein, 9 aa, Homo Sapiens
GESERFNPE

SEQ ID NO: 991989 - protein, 9 aa, Homo Sapiens
PNGNFKPGK

SEQ ID NO: 991990 - protein, 9 aa, Homo Sapiens
LWEETFDRR

SEQ ID NO: 991991 - protein, 9 aa, Homo Sapiens
TGKRPYLCI

SEQ ID NO: 991992 - protein, 9 aa, Homo Sapiens
DKFMGKMQY

SEQ ID NO: 991993 - protein, 9 aa, Homo Sapiens
RYFHDEDNL

SEQ ID NO: 991994 - protein, 9 aa, Homo Sapiens
LLDRKSENA

SEQ ID NO: 991995 - protein, 9 aa, Homo Sapiens
ASGYLKGMA

SEQ ID NO: 991996 - protein, 9 aa, Homo Sapiens
QNSTVCKPG

SEQ ID NO: 991997 - protein, 9 aa, Homo Sapiens
PVKTLSDAG

SEQ ID NO: 991998 - protein, 9 aa, Homo Sapiens
DCSLMVAIH

SEQ ID NO: 991999 - protein, 9 aa, Homo Sapiens
HPEDCSLMV

SEQ ID NO: 992000 - protein, 9 aa, Homo Sapiens
TLTDVQKKV

SEQ ID NO: 992001 - protein, 9 aa, Homo Sapiens
KMKASDSHR

SEQ ID NO: 992002 - protein, 9 aa, Homo Sapiens
KQKSVIFWL

SEQ ID NO: 992003 - protein, 9 aa, Homo Sapiens
MASDPRTLQ

SEQ ID NO: 992004 - protein, 9 aa, Homo Sapiens
HSVLENVKN

SEQ ID NO: 992005 - protein, 9 aa, Homo Sapiens
HPNHVLKES

SEQ ID NO: 992006 - protein, 9 aa, Homo Sapiens
SVIFWLLNH

SEQ ID NO: 992007 - protein, 9 aa, Homo Sapiens
IMNGSCVIR

SEQ ID NO: 992008 - protein, 9 aa, Homo Sapiens
AKHQKIHTG

SEQ ID NO: 992009 - protein, 9 aa, Homo Sapiens
GTAPLGTLR

SEQ ID NO: 992010 - protein, 9 aa, Homo Sapiens
LGPISLAFI

SEQ ID NO: 992011 - protein, 9 aa, Homo Sapiens
VRFRLSDAR

SEQ ID NO: 992012 - protein, 9 aa, Homo Sapiens
TEMVGKIEG

SEQ ID NO: 992013 - protein, 9 aa, Homo Sapiens
GSAAAAASC

SEQ ID NO: 992014 - protein, 9 aa, Homo Sapiens
WEDHGLQCD

SEQ ID NO: 992015 - protein, 9 aa, Homo Sapiens
DLEHECDTV

SEQ ID NO: 992016 - protein, 9 aa, Homo Sapiens
YEFLVVDDL

SEQ ID NO: 992017 - protein, 9 aa, Homo Sapiens
RYLILITNN

SEQ ID NO: 992018 - protein, 9 aa, Homo Sapiens
QLISFKGCM

SEQ ID NO: 992019 - protein, 9 aa, Homo Sapiens
DQETGEQES

SEQ ID NO: 992020 - protein, 9 aa, Homo Sapiens
NVKNAYIKD

SEQ ID NO: 992021 - protein, 9 aa, Homo Sapiens
LRFSSGIAA

SEQ ID NO: 992022 - protein, 9 aa, Homo Sapiens
TAAVGPLVR

SEQ ID NO: 992023 - protein, 9 aa, Homo Sapiens
LTLLLMSGG

SEQ ID NO: 992024 - protein, 9 aa, Homo Sapiens
YFYLDTAKM

SEQ ID NO: 992025 - protein, 9 aa, Homo Sapiens
MAHTNELMV

SEQ ID NO: 992026 - protein, 9 aa, Homo Sapiens
GLLNKLKNK

SEQ ID NO: 992027 - protein, 9 aa, Homo Sapiens
LVLDGAPHS

SEQ ID NO: 992028 - protein, 9 aa, Homo Sapiens
TVNSTITHP

SEQ ID NO: 992029 - protein, 9 aa, Homo Sapiens
GLVETSFAS

SEQ ID NO: 992030 - protein, 9 aa, Homo Sapiens
QCPNLLPLV

SEQ ID NO: 992031 - protein, 9 aa, Homo Sapiens
DHGLQCDQH

SEQ ID NO: 992032 - protein, 9 aa, Homo Sapiens
VVDIFTPLV

SEQ ID NO: 992033 - protein, 9 aa, Homo Sapiens
RRSIFSDTS

SEQ ID NO: 992034 - protein, 9 aa, Homo Sapiens
PKVLLSPSI

SEQ ID NO: 992035 - protein, 9 aa, Homo Sapiens
GEQESSPSS

SEQ ID NO: 992036 - protein, 9 aa, Homo Sapiens
QLVKLRKLE

SEQ ID NO: 992037 - protein, 9 aa, Homo Sapiens
QLFKILCNG

SEQ ID NO: 992038 - protein, 9 aa, Homo Sapiens
RADMSPASS

SEQ ID NO: 992039 - protein, 9 aa, Homo Sapiens
RDFIEGEAD

SEQ ID NO: 992040 - protein, 9 aa, Homo Sapiens
AGVFLGGCS

SEQ ID NO: 992041 - protein, 9 aa, Homo Sapiens
GDPSRYVSS

SEQ ID NO: 992042 - protein, 9 aa, Homo Sapiens
QQQLTAIKV

SEQ ID NO: 992043 - protein, 9 aa, Homo Sapiens
LDLNCMVAR

SEQ ID NO: 992044 - protein, 9 aa, Homo Sapiens
DLFTNELVI

SEQ ID NO: 992045 - protein, 9 aa, Homo Sapiens
VGPLVRAVV

SEQ ID NO: 992046 - protein, 9 aa, Homo Sapiens
VTVLKQNKK

SEQ ID NO: 992047 - protein, 9 aa, Homo Sapiens
DTEETGAPS

SEQ ID NO: 992048 - protein, 9 aa, Homo Sapiens
EIGPCHVIS

SEQ ID NO: 992049 - protein, 9 aa, Homo Sapiens
RSSELKKHS

SEQ ID NO: 992050 - protein, 9 aa, Homo Sapiens
CTVSPPGLD

SEQ ID NO: 992051 - protein, 9 aa, Homo Sapiens
PDICSPPVG

SEQ ID NO: 992052 - protein, 9 aa, Homo Sapiens
RFILIGETI

SEQ ID NO: 992053 - protein, 9 aa, Homo Sapiens
SVCRRLNYI

SEQ ID NO: 992054 - protein, 9 aa, Homo Sapiens
QQPKAENSW

SEQ ID NO: 992055 - protein, 9 aa, Homo Sapiens
IKSLMKDGD

SEQ ID NO: 992056 - protein, 9 aa, Homo Sapiens
SGFFFSRGC

SEQ ID NO: 992057 - protein, 9 aa, Homo Sapiens
AHSVLENVK

SEQ ID NO: 992058 - protein, 9 aa, Homo Sapiens
RIKMKASDS

SEQ ID NO: 992059 - protein, 9 aa, Homo Sapiens
MLASGLHMQ

SEQ ID NO: 992060 - protein, 9 aa, Homo Sapiens
TLDLNCMVA

SEQ ID NO: 992061 - protein, 9 aa, Homo Sapiens
EQKEQELTQ

SEQ ID NO: 992062 - protein, 9 aa, Homo Sapiens
CEMHQCWSD

SEQ ID NO: 992063 - protein, 9 aa, Homo Sapiens
SQKDKKKDK

SEQ ID NO: 992064 - protein, 9 aa, Homo Sapiens
PDQWLSEDD

SEQ ID NO: 992065 - protein, 9 aa, Homo Sapiens
KSIMKAMVS

SEQ ID NO: 992066 - protein, 9 aa, Homo Sapiens
KEFVVEVNT

SEQ ID NO: 992067 - protein, 9 aa, Homo Sapiens
RKLLMDQLL

SEQ ID NO: 992068 - protein, 9 aa, Homo Sapiens
TSHSDTTSP

SEQ ID NO: 992069 - protein, 9 aa, Homo Sapiens
QAQLKPSTL

SEQ ID NO: 992070 - protein, 9 aa, Homo Sapiens
EVDLANCRT

SEQ ID NO: 992071 - protein, 9 aa, Homo Sapiens
FKKVHLKLE

SEQ ID NO: 992072 - protein, 9 aa, Homo Sapiens
MRRFIGRKV

SEQ ID NO: 992073 - protein, 9 aa, Homo Sapiens
YKGSHVPLE

SEQ ID NO: 992074 - protein, 9 aa, Homo Sapiens
EEEKLKHKY

SEQ ID NO: 992075 - protein, 9 aa, Homo Sapiens
LSSLVLLVC

SEQ ID NO: 992076 - protein, 9 aa, Homo Sapiens
FPQCPNLLP

SEQ ID NO: 992077 - protein, 9 aa, Homo Sapiens
EDSSSSSSG

SEQ ID NO: 992078 - protein, 9 aa, Homo Sapiens
KKKDKKDSK

SEQ ID NO: 992079 - protein, 9 aa, Homo Sapiens
LTSYVRIVV

SEQ ID NO: 992080 - protein, 9 aa, Homo Sapiens
NWIELLDLF

SEQ ID NO: 992081 - protein, 9 aa, Homo Sapiens
KYSPASLHA

SEQ ID NO: 992082 - protein, 9 aa, Homo Sapiens
PVLSQAVAT

SEQ ID NO: 992083 - protein, 9 aa, Homo Sapiens
LPKPDPQAR

SEQ ID NO: 992084 - protein, 9 aa, Homo Sapiens
NMPQYILKE

SEQ ID NO: 992085 - protein, 9 aa, Homo Sapiens
PQPVLSQAV

SEQ ID NO: 992086 - protein, 9 aa, Homo Sapiens
ESGDIQAKM

SEQ ID NO: 992087 - protein, 9 aa, Homo Sapiens
FSSGLYHRP

SEQ ID NO: 992088 - protein, 9 aa, Homo Sapiens
PLLRKGGAW

SEQ ID NO: 992089 - protein, 9 aa, Homo Sapiens
HGGQAAAAS

SEQ ID NO: 992090 - protein, 9 aa, Homo Sapiens
LQQPKAENS

SEQ ID NO: 992091 - protein, 9 aa, Homo Sapiens
FTFFKKVHL

SEQ ID NO: 992092 - protein, 9 aa, Homo Sapiens
SMLSGFLYP

SEQ ID NO: 992093 - protein, 9 aa, Homo Sapiens
DSFSSMTSH

SEQ ID NO: 992094 - protein, 9 aa, Homo Sapiens
RGSMLASGL

SEQ ID NO: 992095 - protein, 9 aa, Homo Sapiens
PPFCEVGAR

SEQ ID NO: 992096 - protein, 9 aa, Homo Sapiens
SKLNDIIKN

SEQ ID NO: 992097 - protein, 9 aa, Homo Sapiens
EWFTFAVGP

SEQ ID NO: 992098 - protein, 9 aa, Homo Sapiens
CMVARQPQA

SEQ ID NO: 992099 - protein, 9 aa, Homo Sapiens
LEVGYSARK

SEQ ID NO: 992100 - protein, 9 aa, Homo Sapiens
GGAGTAPLG

SEQ ID NO: 992101 - protein, 9 aa, Homo Sapiens
DSIISWVAT

SEQ ID NO: 992102 - protein, 9 aa, Homo Sapiens
PVGPPGGNG

SEQ ID NO: 992103 - protein, 9 aa, Homo Sapiens
LEQKRDSWT

SEQ ID NO: 992104 - protein, 9 aa, Homo Sapiens
VRLSSVYRN

SEQ ID NO: 992105 - protein, 9 aa, Homo Sapiens
VQYLVNRPR

SEQ ID NO: 992106 - protein, 9 aa, Homo Sapiens
GTEEGKRPG

SEQ ID NO: 992107 - protein, 9 aa, Homo Sapiens
GWPVATKNW

SEQ ID NO: 992108 - protein, 9 aa, Homo Sapiens
FIEGEADDS

SEQ ID NO: 992109 - protein, 9 aa, Homo Sapiens
DFGLATEKS

SEQ ID NO: 992110 - protein, 9 aa, Homo Sapiens
SPTPLSPPP

SEQ ID NO: 992111 - protein, 9 aa, Homo Sapiens
GDNGSLAML

SEQ ID NO: 992112 - protein, 9 aa, Homo Sapiens
CVEKNTLEC

SEQ ID NO: 992113 - protein, 9 aa, Homo Sapiens
ETFDRRVLE

SEQ ID NO: 992114 - protein, 9 aa, Homo Sapiens
NLYLARHTR

SEQ ID NO: 992115 - protein, 9 aa, Homo Sapiens
TIKAQELSL

SEQ ID NO: 992116 - protein, 9 aa, Homo Sapiens
INLAATHKP

SEQ ID NO: 992117 - protein, 9 aa, Homo Sapiens
EHLNQGSFQ

SEQ ID NO: 992118 - protein, 9 aa, Homo Sapiens
WLFPLRWST

SEQ ID NO: 992119 - protein, 9 aa, Homo Sapiens
HADTEETGA

SEQ ID NO: 992120 - protein, 9 aa, Homo Sapiens
GPRVFQYRV

SEQ ID NO: 992121 - protein, 9 aa, Homo Sapiens
LHLPAHSDF

SEQ ID NO: 992122 - protein, 9 aa, Homo Sapiens
GSFQETDKL

SEQ ID NO: 992123 - protein, 9 aa, Homo Sapiens
VGPRVFQYR

SEQ ID NO: 992124 - protein, 9 aa, Homo Sapiens
RLRQKVLRK

SEQ ID NO: 992125 - protein, 9 aa, Homo Sapiens
GDHGLLSED

SEQ ID NO: 992126 - protein, 9 aa, Homo Sapiens
STLTALKHP

SEQ ID NO: 992127 - protein, 9 aa, Homo Sapiens
ISWVATGFV

SEQ ID NO: 992128 - protein, 9 aa, Homo Sapiens
NEEEVNADL

SEQ ID NO: 992129 - protein, 9 aa, Homo Sapiens
LKRWQLKAN

SEQ ID NO: 992130 - protein, 9 aa, Homo Sapiens
PGFKLDGYA

SEQ ID NO: 992131 - protein, 9 aa, Homo Sapiens
DEDNLSLND

SEQ ID NO: 992132 - protein, 9 aa, Homo Sapiens
GLAEAPADP

SEQ ID NO: 992133 - protein, 9 aa, Homo Sapiens
LAATHKPTY

SEQ ID NO: 992134 - protein, 9 aa, Homo Sapiens
ANCRTNEII

SEQ ID NO: 992135 - protein, 9 aa, Homo Sapiens
NAMRRFIGR

SEQ ID NO: 992136 - protein, 9 aa, Homo Sapiens
LSSVYRNGT

SEQ ID NO: 992137 - protein, 9 aa, Homo Sapiens
VVTVLKQNK

SEQ ID NO: 992138 - protein, 9 aa, Homo Sapiens
RTAAAALEA

SEQ ID NO: 992139 - protein, 9 aa, Homo Sapiens
GMNFIARYL

SEQ ID NO: 992140 - protein, 9 aa, Homo Sapiens
PVARQLALR

SEQ ID NO: 992141 - protein, 9 aa, Homo Sapiens
LALQKTEMV

SEQ ID NO: 992142 - protein, 9 aa, Homo Sapiens
FKPGKPQVK

SEQ ID NO: 992143 - protein, 9 aa, Homo Sapiens
KRGRSNLFW

SEQ ID NO: 992144 - protein, 9 aa, Homo Sapiens
SSIRITLGG

SEQ ID NO: 992145 - protein, 9 aa, Homo Sapiens
YGEGDHGLL

SEQ ID NO: 992146 - protein, 9 aa, Homo Sapiens
LGLVETSFA

SEQ ID NO: 992147 - protein, 9 aa, Homo Sapiens
KHKRKPLEV

SEQ ID NO: 992148 - protein, 9 aa, Homo Sapiens
SGYLKGMAK

SEQ ID NO: 992149 - protein, 9 aa, Homo Sapiens
SLKTVDSCF

SEQ ID NO: 992150 - protein, 9 aa, Homo Sapiens
VETSFASPH

SEQ ID NO: 992151 - protein, 9 aa, Homo Sapiens
FMNDSYIVI

SEQ ID NO: 992152 - protein, 9 aa, Homo Sapiens
VLDGAPHSD

SEQ ID NO: 992153 - protein, 9 aa, Homo Sapiens
CCGPRDLEH

SEQ ID NO: 992154 - protein, 9 aa, Homo Sapiens
IHNWIELLD

SEQ ID NO: 992155 - protein, 9 aa, Homo Sapiens
LFQTTRFIL

SEQ ID NO: 992156 - protein, 9 aa, Homo Sapiens
ERMVCNNGE

SEQ ID NO: 992157 - protein, 9 aa, Homo Sapiens
HDSTSYKEQ

SEQ ID NO: 992158 - protein, 9 aa, Homo Sapiens
EIEEEEDEA

SEQ ID NO: 992159 - protein, 9 aa, Homo Sapiens
LQLFKILCN

SEQ ID NO: 992160 - protein, 9 aa, Homo Sapiens
ESKESQKDK

SEQ ID NO: 992161 - protein, 9 aa, Homo Sapiens
MVSLLQIGL

SEQ ID NO: 992162 - protein, 9 aa, Homo Sapiens
EGQERVALG

SEQ ID NO: 992163 - protein, 9 aa, Homo Sapiens
FKGCMTQLY

SEQ ID NO: 992164 - protein, 9 aa, Homo Sapiens
AVVAGEGQE

SEQ ID NO: 992165 - protein, 9 aa, Homo Sapiens
HCEMHQCWS

SEQ ID NO: 992166 - protein, 9 aa, Homo Sapiens
EADDSITRD

SEQ ID NO: 992167 - protein, 9 aa, Homo Sapiens
ERFNPEELR

SEQ ID NO: 992168 - protein, 9 aa, Homo Sapiens
ERELKRWQL

SEQ ID NO: 992169 - protein, 9 aa, Homo Sapiens
QAHADTEET

SEQ ID NO: 992170 - protein, 9 aa, Homo Sapiens
LMTPTASME

SEQ ID NO: 992171 - protein, 9 aa, Homo Sapiens
EETFDRRVL

SEQ ID NO: 992172 - protein, 9 aa, Homo Sapiens
SRALSPQAG

SEQ ID NO: 992173 - protein, 9 aa, Homo Sapiens
PQAHADTEE

SEQ ID NO: 992174 - protein, 9 aa, Homo Sapiens
GECNYRGRV

SEQ ID NO: 992175 - protein, 9 aa, Homo Sapiens
SFLALYYEE

SEQ ID NO: 992176 - protein, 9 aa, Homo Sapiens
FLGGCSMGS

SEQ ID NO: 992177 - protein, 9 aa, Homo Sapiens
PGLDGVRWA

SEQ ID NO: 992178 - protein, 9 aa, Homo Sapiens
KMKRVLQER

SEQ ID NO: 992179 - protein, 9 aa, Homo Sapiens
QEELEGSLL

SEQ ID NO: 992180 - protein, 9 aa, Homo Sapiens
CFCGSSFSI

SEQ ID NO: 992181 - protein, 9 aa, Homo Sapiens
YCWNLERNQ

SEQ ID NO: 992182 - protein, 9 aa, Homo Sapiens
QPVLSQAVA

SEQ ID NO: 992183 - protein, 9 aa, Homo Sapiens
SFIAGYVFF

SEQ ID NO: 992184 - protein, 9 aa, Homo Sapiens
AMGANRGIH

SEQ ID NO: 992185 - protein, 9 aa, Homo Sapiens
LFWDTGVFR

SEQ ID NO: 992186 - protein, 9 aa, Homo Sapiens
TLSLTQTPT

SEQ ID NO: 992187 - protein, 9 aa, Homo Sapiens
ETSHPSQGL

SEQ ID NO: 992188 - protein, 9 aa, Homo Sapiens
DIDECASNS

SEQ ID NO: 992189 - protein, 9 aa, Homo Sapiens
SWTLQSEEK

SEQ ID NO: 992190 - protein, 9 aa, Homo Sapiens
ALLKLSCLD

SEQ ID NO: 992191 - protein, 9 aa, Homo Sapiens
RKVLQGKFY

SEQ ID NO: 992192 - protein, 9 aa, Homo Sapiens
QRHIIQGDY

SEQ ID NO: 992193 - protein, 9 aa, Homo Sapiens
CWNLERNQF

SEQ ID NO: 992194 - protein, 9 aa, Homo Sapiens
LEGQERVAL

SEQ ID NO: 992195 - protein, 9 aa, Homo Sapiens
DNMLLSVMA

SEQ ID NO: 992196 - protein, 9 aa, Homo Sapiens
ISQAQLKPS

SEQ ID NO: 992197 - protein, 9 aa, Homo Sapiens
KAQELSLSA

SEQ ID NO: 992198 - protein, 9 aa, Homo Sapiens
KTVRLSSVY

SEQ ID NO: 992199 - protein, 9 aa, Homo Sapiens
DEEKNGQGE

SEQ ID NO: 992200 - protein, 9 aa, Homo Sapiens
LPLLRKGGA

SEQ ID NO: 992201 - protein, 9 aa, Homo Sapiens
NKLKNKWWY

SEQ ID NO: 992202 - protein, 9 aa, Homo Sapiens
RGLSLKTVD

SEQ ID NO: 992203 - protein, 9 aa, Homo Sapiens
NGSLAMLST

SEQ ID NO: 992204 - protein, 9 aa, Homo Sapiens
CRVAESMAS

SEQ ID NO: 992205 - protein, 9 aa, Homo Sapiens
GEITYLFAC

SEQ ID NO: 992206 - protein, 9 aa, Homo Sapiens
GRTDGAKNS

SEQ ID NO: 992207 - protein, 9 aa, Homo Sapiens
RQEPLGGPP

SEQ ID NO: 992208 - protein, 9 aa, Homo Sapiens
DRKSENASL

SEQ ID NO: 992209 - protein, 9 aa, Homo Sapiens
TQKNHPNHV

SEQ ID NO: 992210 - protein, 9 aa, Homo Sapiens
SDFHVEPCC

SEQ ID NO: 992211 - protein, 9 aa, Homo Sapiens
ASVWFGPTE

SEQ ID NO: 992212 - protein, 9 aa, Homo Sapiens
YRVKVVLQA

SEQ ID NO: 992213 - protein, 9 aa, Homo Sapiens
TCEKDINEC

SEQ ID NO: 992214 - protein, 9 aa, Homo Sapiens
HPLDLLFHS

SEQ ID NO: 992215 - protein, 9 aa, Homo Sapiens
ISLAFIGII

SEQ ID NO: 992216 - protein, 9 aa, Homo Sapiens
TEEGKRPGS

SEQ ID NO: 992217 - protein, 9 aa, Homo Sapiens
FQTTRFILI

SEQ ID NO: 992218 - protein, 9 aa, Homo Sapiens
ASDPRTLQR

SEQ ID NO: 992219 - protein, 9 aa, Homo Sapiens
NHKPMVCQK

SEQ ID NO: 992220 - protein, 9 aa, Homo Sapiens
CEKDINECE

SEQ ID NO: 992221 - protein, 9 aa, Homo Sapiens
NSQCLLGDF

SEQ ID NO: 992222 - protein, 9 aa, Homo Sapiens
LKKLHKELC

SEQ ID NO: 992223 - protein, 9 aa, Homo Sapiens
QDRDEYVFG

SEQ ID NO: 992224 - protein, 9 aa, Homo Sapiens
DVPFIRILS

SEQ ID NO: 992225 - protein, 9 aa, Homo Sapiens
KLWGEKAGS

SEQ ID NO: 992226 - protein, 9 aa, Homo Sapiens
HPSSPRACP

SEQ ID NO: 992227 - protein, 9 aa, Homo Sapiens
KAMVSLLQI

SEQ ID NO: 992228 - protein, 9 aa, Homo Sapiens
DTQEAELLL

SEQ ID NO: 992229 - protein, 9 aa, Homo Sapiens
PAPGNPQPV

SEQ ID NO: 992230 - protein, 9 aa, Homo Sapiens
ARARLDLLQ

SEQ ID NO: 992231 - protein, 9 aa, Homo Sapiens
TAAARNGFL

SEQ ID NO: 992232 - protein, 9 aa, Homo Sapiens
SSFAKHQKI

SEQ ID NO: 992233 - protein, 9 aa, Homo Sapiens
LVLDSDEEK

SEQ ID NO: 992234 - protein, 9 aa, Homo Sapiens
VEPCCGPRD

SEQ ID NO: 992235 - protein, 9 aa, Homo Sapiens
HNRSSNSYG

SEQ ID NO: 992236 - protein, 9 aa, Homo Sapiens
RTDGAKNSE

SEQ ID NO: 992237 - protein, 9 aa, Homo Sapiens
ERADMSPAS

SEQ ID NO: 992238 - protein, 9 aa, Homo Sapiens
FTFAVGPGH

SEQ ID NO: 992239 - protein, 9 aa, Homo Sapiens
PLRIKMKAS

SEQ ID NO: 992240 - protein, 9 aa, Homo Sapiens
AYIKARINF

SEQ ID NO: 992241 - protein, 9 aa, Homo Sapiens
DLGEIHNWI

SEQ ID NO: 992242 - protein, 9 aa, Homo Sapiens
IVRLPGLHN

SEQ ID NO: 992243 - protein, 9 aa, Homo Sapiens
PSPRELEGS

SEQ ID NO: 992244 - protein, 9 aa, Homo Sapiens
WIAILWACP

SEQ ID NO: 992245 - protein, 9 aa, Homo Sapiens
FNFSAVFTD

SEQ ID NO: 992246 - protein, 9 aa, Homo Sapiens
FHDISIYAD

SEQ ID NO: 992247 - protein, 9 aa, Homo Sapiens
NNLNDTIKD

SEQ ID NO: 992248 - protein, 9 aa, Homo Sapiens
IEMYKGSHV

SEQ ID NO: 992249 - protein, 9 aa, Homo Sapiens
STGEIYLDD

SEQ ID NO: 992250 - protein, 9 aa, Homo Sapiens
CWSDEYNCS

SEQ ID NO: 992251 - protein, 9 aa, Homo Sapiens
LNYKVEEEK

SEQ ID NO: 992252 - protein, 9 aa, Homo Sapiens
SVWFGPTEV

SEQ ID NO: 992253 - protein, 9 aa, Homo Sapiens
GWTSRALSP

SEQ ID NO: 992254 - protein, 9 aa, Homo Sapiens
CVIRCHTDN

SEQ ID NO: 992255 - protein, 9 aa, Homo Sapiens
NAIFPVAIV

SEQ ID NO: 992256 - protein, 9 aa, Homo Sapiens
QAAAASDTC

SEQ ID NO: 992257 - protein, 9 aa, Homo Sapiens
NLTSTARYA

SEQ ID NO: 992258 - protein, 9 aa, Homo Sapiens
VDADDDPFT

SEQ ID NO: 992259 - protein, 9 aa, Homo Sapiens
QKTEMVGKI

SEQ ID NO: 992260 - protein, 9 aa, Homo Sapiens
HLNQGSFQE

SEQ ID NO: 992261 - protein, 9 aa, Homo Sapiens
EKDINECER

SEQ ID NO: 992262 - protein, 9 aa, Homo Sapiens
YCSLRFSSG

SEQ ID NO: 992263 - protein, 9 aa, Homo Sapiens
GEIYLDDIT

SEQ ID NO: 992264 - protein, 9 aa, Homo Sapiens
RRLNYITQS

SEQ ID NO: 992265 - protein, 9 aa, Homo Sapiens
TNTTTTLKW

SEQ ID NO: 992266 - protein, 9 aa, Homo Sapiens
IKDILKDKE

SEQ ID NO: 992267 - protein, 9 aa, Homo Sapiens
NCGKITRED

SEQ ID NO: 992268 - protein, 9 aa, Homo Sapiens
PDAYSGDHN

SEQ ID NO: 992269 - protein, 9 aa, Homo Sapiens
LRKPLEPAA

SEQ ID NO: 992270 - protein, 9 aa, Homo Sapiens
GYVFFQITL

SEQ ID NO: 992271 - protein, 9 aa, Homo Sapiens
VTDTCQANS

SEQ ID NO: 992272 - protein, 9 aa, Homo Sapiens
FSSMTSHSD

SEQ ID NO: 992273 - protein, 9 aa, Homo Sapiens
LDIFLNELV

SEQ ID NO: 992274 - protein, 9 aa, Homo Sapiens
EALGTEEGK

SEQ ID NO: 992275 - protein, 9 aa, Homo Sapiens
YLQQPKAEN

SEQ ID NO: 992276 - protein, 9 aa, Homo Sapiens
ITSIEISAS

SEQ ID NO: 992277 - protein, 9 aa, Homo Sapiens
VTVPDSIIS

SEQ ID NO: 992278 - protein, 9 aa, Homo Sapiens
NEIRRPNGD

SEQ ID NO: 992279 - protein, 9 aa, Homo Sapiens
LVETSFASP

SEQ ID NO: 992280 - protein, 9 aa, Homo Sapiens
RKHTGKRPY

SEQ ID NO: 992281 - protein, 9 aa, Homo Sapiens
KRPGSLRQM

SEQ ID NO: 992282 - protein, 9 aa, Homo Sapiens
AREAQHSDP

SEQ ID NO: 992283 - protein, 9 aa, Homo Sapiens
GVFPQCPNL

SEQ ID NO: 992284 - protein, 9 aa, Homo Sapiens
LHKELCILK

SEQ ID NO: 992285 - protein, 9 aa, Homo Sapiens
QLSKKKVQK

SEQ ID NO: 992286 - protein, 9 aa, Homo Sapiens
VRVRKAENS

SEQ ID NO: 992287 - protein, 9 aa, Homo Sapiens
REEAERELK

SEQ ID NO: 992288 - protein, 9 aa, Homo Sapiens
KGFHRSSEL

SEQ ID NO: 992289 - protein, 9 aa, Homo Sapiens
RLNPNKYFD

SEQ ID NO: 992290 - protein, 9 aa, Homo Sapiens
ENYGHGSLK

SEQ ID NO: 992291 - protein, 9 aa, Homo Sapiens
IPGRVMGKF

SEQ ID NO: 992292 - protein, 9 aa, Homo Sapiens
CKDIAKRIA

SEQ ID NO: 992293 - protein, 9 aa, Homo Sapiens
SGERGLPGT

SEQ ID NO: 992294 - protein, 9 aa, Homo Sapiens
GKKLWGEKA

SEQ ID NO: 992295 - protein, 9 aa, Homo Sapiens
LGITAFYLS

SEQ ID NO: 992296 - protein, 9 aa, Homo Sapiens
ISTQTPPPP

SEQ ID NO: 992297 - protein, 9 aa, Homo Sapiens
PAYIKARIN

SEQ ID NO: 992298 - protein, 9 aa, Homo Sapiens
NQFSWPFGA

SEQ ID NO: 992299 - protein, 9 aa, Homo Sapiens
DMILDIRFS

SEQ ID NO: 992300 - protein, 9 aa, Homo Sapiens
CQANSATSR

SEQ ID NO: 992301 - protein, 9 aa, Homo Sapiens
PQDLKGPGR

SEQ ID NO: 992302 - protein, 9 aa, Homo Sapiens
LEASPKWPP

SEQ ID NO: 992303 - protein, 9 aa, Homo Sapiens
VRLSFCGPN

SEQ ID NO: 992304 - protein, 9 aa, Homo Sapiens
QAQQGCFCG

SEQ ID NO: 992305 - protein, 9 aa, Homo Sapiens
VPSLPNGNF

SEQ ID NO: 992306 - protein, 9 aa, Homo Sapiens
NLSSIRITL

SEQ ID NO: 992307 - protein, 9 aa, Homo Sapiens
GCFCGSSFS

SEQ ID NO: 992308 - protein, 9 aa, Homo Sapiens
RKDMILDIR

SEQ ID NO: 992309 - protein, 9 aa, Homo Sapiens
TVNAIFPVA

SEQ ID NO: 992310 - protein, 9 aa, Homo Sapiens
GGQAAAASD

SEQ ID NO: 992311 - protein, 9 aa, Homo Sapiens
KGCMTQLYF

SEQ ID NO: 992312 - protein, 9 aa, Homo Sapiens
FARSKRGLS

SEQ ID NO: 992313 - protein, 9 aa, Homo Sapiens
DKKKDKKDS

SEQ ID NO: 992314 - protein, 9 aa, Homo Sapiens
CEFVFSEVE

SEQ ID NO: 992315 - protein, 9 aa, Homo Sapiens
DKSQEDSSL

SEQ ID NO: 992316 - protein, 9 aa, Homo Sapiens
HKPTYQGSP

SEQ ID NO: 992317 - protein, 9 aa, Homo Sapiens
FLGGGGEAS

SEQ ID NO: 992318 - protein, 9 aa, Homo Sapiens
FPLRWSTSI

SEQ ID NO: 992319 - protein, 9 aa, Homo Sapiens
HPSQGLAEA

SEQ ID NO: 992320 - protein, 9 aa, Homo Sapiens
IVEDVTNTT

SEQ ID NO: 992321 - protein, 9 aa, Homo Sapiens
LTSTARYAS

SEQ ID NO: 992322 - protein, 9 aa, Homo Sapiens
QETGEQESS

SEQ ID NO: 992323 - protein, 9 aa, Homo Sapiens
GERMVCNNG

SEQ ID NO: 992324 - protein, 9 aa, Homo Sapiens
RVRFRLSDA

SEQ ID NO: 992325 - protein, 9 aa, Homo Sapiens
HVLTIVQCF

SEQ ID NO: 992326 - protein, 9 aa, Homo Sapiens
LALYYEEGA

SEQ ID NO: 992327 - protein, 9 aa, Homo Sapiens
QFPLQIPVS

SEQ ID NO: 992328 - protein, 9 aa, Homo Sapiens
PCHVISSVL

SEQ ID NO: 992329 - protein, 9 aa, Homo Sapiens
LQALLTTQT

SEQ ID NO: 992330 - protein, 9 aa, Homo Sapiens
KRVLQERAD

SEQ ID NO: 992331 - protein, 9 aa, Homo Sapiens
AKMVVRLQA

SEQ ID NO: 992332 - protein, 9 aa, Homo Sapiens
QNKKKEEKK

SEQ ID NO: 992333 - protein, 9 aa, Homo Sapiens
PPVKVQEKE

SEQ ID NO: 992334 - protein, 9 aa, Homo Sapiens
KSLMKDGDK

SEQ ID NO: 992335 - protein, 9 aa, Homo Sapiens
YGNPMHVAV

SEQ ID NO: 992336 - protein, 9 aa, Homo Sapiens
ELEGSVYSR

SEQ ID NO: 992337 - protein, 9 aa, Homo Sapiens
GFIKTKDLP

SEQ ID NO: 992338 - protein, 9 aa, Homo Sapiens
HCGQLTDGV

SEQ ID NO: 992339 - protein, 9 aa, Homo Sapiens
PLRWSTSIP

SEQ ID NO: 992340 - protein, 9 aa, Homo Sapiens
PAGTTVNST

SEQ ID NO: 992341 - protein, 9 aa, Homo Sapiens
PTEVSTACA

SEQ ID NO: 992342 - protein, 9 aa, Homo Sapiens
PEQLSNPKQ

SEQ ID NO: 992343 - protein, 9 aa, Homo Sapiens
CSMGSRAAA

SEQ ID NO: 992344 - protein, 9 aa, Homo Sapiens
IKEFMNDSY

SEQ ID NO: 992345 - protein, 9 aa, Homo Sapiens
FFFSRGCSY

SEQ ID NO: 992346 - protein, 9 aa, Homo Sapiens
FIMNGSCVI

SEQ ID NO: 992347 - protein, 9 aa, Homo Sapiens
KMVVRLQAK

SEQ ID NO: 992348 - protein, 9 aa, Homo Sapiens
SIGFLFRRK

SEQ ID NO: 992349 - protein, 9 aa, Homo Sapiens
PAGLRGFSG

SEQ ID NO: 992350 - protein, 9 aa, Homo Sapiens
ELPLLRKGG

SEQ ID NO: 992351 - protein, 9 aa, Homo Sapiens
GAGTAPLGT

SEQ ID NO: 992352 - protein, 9 aa, Homo Sapiens
ERVRYFHDE

SEQ ID NO: 992353 - protein, 9 aa, Homo Sapiens
GDHNRSSNS

SEQ ID NO: 992354 - protein, 9 aa, Homo Sapiens
SDQQLNILN

SEQ ID NO: 992355 - protein, 9 aa, Homo Sapiens
ASNSCRKGA

SEQ ID NO: 992356 - protein, 9 aa, Homo Sapiens
LISFKGCMT

SEQ ID NO: 992357 - protein, 9 aa, Homo Sapiens
AKNSELVLE

SEQ ID NO: 992358 - protein, 9 aa, Homo Sapiens
NLTFNFSAV

SEQ ID NO: 992359 - protein, 9 aa, Homo Sapiens
RALHPSSPR

SEQ ID NO: 992360 - protein, 9 aa, Homo Sapiens
FFQITLTRS

SEQ ID NO: 992361 - protein, 9 aa, Homo Sapiens
NVPAGTTVN

SEQ ID NO: 992362 - protein, 9 aa, Homo Sapiens
SIIAEYISG

SEQ ID NO: 992363 - protein, 9 aa, Homo Sapiens
DLNCMVARQ

SEQ ID NO: 992364 - protein, 9 aa, Homo Sapiens
IKMKASDSH

SEQ ID NO: 992365 - protein, 9 aa, Homo Sapiens
PFIRILSRE

SEQ ID NO: 992366 - protein, 9 aa, Homo Sapiens
FESVCEFVF

SEQ ID NO: 992367 - protein, 9 aa, Homo Sapiens
QEEILGPIL

SEQ ID NO: 992368 - protein, 9 aa, Homo Sapiens
AMVSLLQIG

SEQ ID NO: 992369 - protein, 9 aa, Homo Sapiens
VSPVKTLSD

SEQ ID NO: 992370 - protein, 9 aa, Homo Sapiens
QESSPSSHP

SEQ ID NO: 992371 - protein, 9 aa, Homo Sapiens
QGCFCGSSF

SEQ ID NO: 992372 - protein, 9 aa, Homo Sapiens
QKRDSWTLQ

SEQ ID NO: 992373 - protein, 9 aa, Homo Sapiens
LNYITQSLQ

SEQ ID NO: 992374 - protein, 9 aa, Homo Sapiens
AQHSDPKVQ

SEQ ID NO: 992375 - protein, 9 aa, Homo Sapiens
SSGSSCLPS

SEQ ID NO: 992376 - protein, 9 aa, Homo Sapiens
GLTGVTCEK

SEQ ID NO: 992377 - protein, 9 aa, Homo Sapiens
LNKLKNKWW

SEQ ID NO: 992378 - protein, 9 aa, Homo Sapiens
RPAKELPLL

SEQ ID NO: 992379 - protein, 9 aa, Homo Sapiens
QINLTTFDF

SEQ ID NO: 992380 - protein, 9 aa, Homo Sapiens
MQVEEIEEE

SEQ ID NO: 992381 - protein, 9 aa, Homo Sapiens
TSIEISASS

SEQ ID NO: 992382 - protein, 9 aa, Homo Sapiens
KSDLETWLG

SEQ ID NO: 992383 - protein, 9 aa, Homo Sapiens
VSLLQIGLL

SEQ ID NO: 992384 - protein, 9 aa, Homo Sapiens
TFFKKVHLK

SEQ ID NO: 992385 - protein, 9 aa, Homo Sapiens
ECLEGQERV

SEQ ID NO: 992386 - protein, 9 aa, Homo Sapiens
SGTKCGERM

SEQ ID NO: 992387 - protein, 9 aa, Homo Sapiens
RLCSCLHWE

SEQ ID NO: 992388 - protein, 9 aa, Homo Sapiens
GEGQEELEG

SEQ ID NO: 992389 - protein, 9 aa, Homo Sapiens
FDNCGKITR

SEQ ID NO: 992390 - protein, 9 aa, Homo Sapiens
VISTQTPPP

SEQ ID NO: 992391 - protein, 9 aa, Homo Sapiens
AELLLLDEF

SEQ ID NO: 992392 - protein, 9 aa, Homo Sapiens
SLAFIGIIS

SEQ ID NO: 992393 - protein, 9 aa, Homo Sapiens
IKRGRSNLF

SEQ ID NO: 992394 - protein, 9 aa, Homo Sapiens
TRVRQEPLG

SEQ ID NO: 992395 - protein, 9 aa, Homo Sapiens
IKLVCQINL

SEQ ID NO: 992396 - protein, 9 aa, Homo Sapiens
AMRRFIGRK

SEQ ID NO: 992397 - protein, 9 aa, Homo Sapiens
GLDARISSL

SEQ ID NO: 992398 - protein, 9 aa, Homo Sapiens
QANSATSRK

SEQ ID NO: 992399 - protein, 9 aa, Homo Sapiens
DFDNCGKIT

SEQ ID NO: 992400 - protein, 9 aa, Homo Sapiens
NDIIKNSDK

SEQ ID NO: 992401 - protein, 9 aa, Homo Sapiens
GTTVNSTIT

SEQ ID NO: 992402 - protein, 9 aa, Homo Sapiens
ITMIPNTIL

SEQ ID NO: 992403 - protein, 9 aa, Homo Sapiens
ATSSQEPSE

SEQ ID NO: 992404 - protein, 9 aa, Homo Sapiens
LDSDEEKNG

SEQ ID NO: 992405 - protein, 9 aa, Homo Sapiens
LKLSCLDIF

SEQ ID NO: 992406 - protein, 9 aa, Homo Sapiens
SFSFPGLFS

SEQ ID NO: 992407 - protein, 9 aa, Homo Sapiens
ELSERLENE

SEQ ID NO: 992408 - protein, 9 aa, Homo Sapiens
AYFYLDTAK

SEQ ID NO: 992409 - protein, 9 aa, Homo Sapiens
HDEDNLSLN

SEQ ID NO: 992410 - protein, 9 aa, Homo Sapiens
ILGFIKTKD

SEQ ID NO: 992411 - protein, 9 aa, Homo Sapiens
RRFIGRKVI

SEQ ID NO: 992412 - protein, 9 aa, Homo Sapiens
RSKRGLSLK

SEQ ID NO: 992413 - protein, 9 aa, Homo Sapiens
EFDFAAAYF

SEQ ID NO: 992414 - protein, 9 aa, Homo Sapiens
FPLQIPVSS

SEQ ID NO: 992415 - protein, 9 aa, Homo Sapiens
LVRAVVQGT

SEQ ID NO: 992416 - protein, 9 aa, Homo Sapiens
IVRLSFCGP

SEQ ID NO: 992417 - protein, 9 aa, Homo Sapiens
ESVCEFVFS

SEQ ID NO: 992418 - protein, 9 aa, Homo Sapiens
QCDQHRLPP

SEQ ID NO: 992419 - protein, 9 aa, Homo Sapiens
KASDSHRPE

SEQ ID NO: 992420 - protein, 9 aa, Homo Sapiens
SNPKQSCNK

SEQ ID NO: 992421 - protein, 9 aa, Homo Sapiens
CASNSCRKG

SEQ ID NO: 992422 - protein, 9 aa, Homo Sapiens
PSSPRACPT

SEQ ID NO: 992423 - protein, 9 aa, Homo Sapiens
GSCYGLHLP

SEQ ID NO: 992424 - protein, 9 aa, Homo Sapiens
SQEPSECSD

SEQ ID NO: 992425 - protein, 9 aa, Homo Sapiens
QTPPPPSPL

SEQ ID NO: 992426 - protein, 9 aa, Homo Sapiens
VESQRHIIQ

SEQ ID NO: 992427 - protein, 9 aa, Homo Sapiens
IIKNSDKNV

SEQ ID NO: 992428 - protein, 9 aa, Homo Sapiens
PFSNEIEVD

SEQ ID NO: 992429 - protein, 9 aa, Homo Sapiens
TLSDAGNSP

SEQ ID NO: 992430 - protein, 9 aa, Homo Sapiens
RHRIQRITS

SEQ ID NO: 992431 - protein, 9 aa, Homo Sapiens
EIYLDDITL

SEQ ID NO: 992432 - protein, 9 aa, Homo Sapiens
PPGMGGGSC

SEQ ID NO: 992433 - protein, 9 aa, Homo Sapiens
HHRKDMILD

SEQ ID NO: 992434 - protein, 9 aa, Homo Sapiens
TDLFTNELV

SEQ ID NO: 992435 - protein, 9 aa, Homo Sapiens
VEEEKLKHK

SEQ ID NO: 992436 - protein, 9 aa, Homo Sapiens
GTKCGERMV

SEQ ID NO: 992437 - protein, 9 aa, Homo Sapiens
ENSQCLLGD

SEQ ID NO: 992438 - protein, 9 aa, Homo Sapiens
CGKITREDM

SEQ ID NO: 992439 - protein, 9 aa, Homo Sapiens
LILTSYVRI

SEQ ID NO: 992440 - protein, 9 aa, Homo Sapiens
RAVVQGTNS

SEQ ID NO: 992441 - protein, 9 aa, Homo Sapiens
TDGAKNSEL

SEQ ID NO: 992442 - protein, 9 aa, Homo Sapiens
ASPTPLSPP

SEQ ID NO: 992443 - protein, 9 aa, Homo Sapiens
FCRSSSLTR

SEQ ID NO: 992444 - protein, 9 aa, Homo Sapiens
HGLLSEDGS

SEQ ID NO: 992445 - protein, 9 aa, Homo Sapiens
YLVNRPREP

SEQ ID NO: 992446 - protein, 9 aa, Homo Sapiens
GGTGKYSPA

SEQ ID NO: 992447 - protein, 9 aa, Homo Sapiens
DEGGTGKYS

SEQ ID NO: 992448 - protein, 9 aa, Homo Sapiens
SVISTQTPP

SEQ ID NO: 992449 - protein, 9 aa, Homo Sapiens
VAVFYRGRF

SEQ ID NO: 992450 - protein, 9 aa, Homo Sapiens
NDLDDPEKG

SEQ ID NO: 992451 - protein, 9 aa, Homo Sapiens
SPLRIKMKA

SEQ ID NO: 992452 - protein, 9 aa, Homo Sapiens
MGHVLTIVQ

SEQ ID NO: 992453 - protein, 9 aa, Homo Sapiens
GITLTDVQK

SEQ ID NO: 992454 - protein, 9 aa, Homo Sapiens
TRRSIFSDT

SEQ ID NO: 992455 - protein, 9 aa, Homo Sapiens
SIISWVATG

SEQ ID NO: 992456 - protein, 9 aa, Homo Sapiens
ASKILGFIK

SEQ ID NO: 992457 - protein, 9 aa, Homo Sapiens
RSSSLTRHQ

SEQ ID NO: 992458 - protein, 9 aa, Homo Sapiens
LGPILPIVN

SEQ ID NO: 992459 - protein, 9 aa, Homo Sapiens
NSTLSLTQT

SEQ ID NO: 992460 - protein, 9 aa, Homo Sapiens
NFSAVFTDI

SEQ ID NO: 992461 - protein, 9 aa, Homo Sapiens
NKNLTSTAR

SEQ ID NO: 992462 - protein, 9 aa, Homo Sapiens
GITAFYLSH

SEQ ID NO: 992463 - protein, 9 aa, Homo Sapiens
NDSYIVITA

SEQ ID NO: 992464 - protein, 9 aa, Homo Sapiens
FCGSSFSIK

SEQ ID NO: 992465 - protein, 9 aa, Homo Sapiens
GKETVNAIF

SEQ ID NO: 992466 - protein, 9 aa, Homo Sapiens
KDEEDEEGD

SEQ ID NO: 992467 - protein, 9 aa, Homo Sapiens
SQEDSSLHS

SEQ ID NO: 992468 - protein, 9 aa, Homo Sapiens
TSYVRIVVA

SEQ ID NO: 992469 - protein, 9 aa, Homo Sapiens
YKEQELLRL

SEQ ID NO: 992470 - protein, 9 aa, Homo Sapiens
QKLPPFCEV

SEQ ID NO: 992471 - protein, 9 aa, Homo Sapiens
IKTKDLPVT

SEQ ID NO: 992472 - protein, 9 aa, Homo Sapiens
FILIGETIK

SEQ ID NO: 992473 - protein, 9 aa, Homo Sapiens
PTEKKVDCI

SEQ ID NO: 992474 - protein, 9 aa, Homo Sapiens
SPPGLDGVR

SEQ ID NO: 992475 - protein, 9 aa, Homo Sapiens
NSTGEIYLD

SEQ ID NO: 992476 - protein, 9 aa, Homo Sapiens
ILKDKEFVV

SEQ ID NO: 992477 - protein, 9 aa, Homo Sapiens
SQSSERTPG

SEQ ID NO: 992478 - protein, 9 aa, Homo Sapiens
WPLGITAFY

SEQ ID NO: 992479 - protein, 9 aa, Homo Sapiens
SGDIQAKMV

SEQ ID NO: 992480 - protein, 9 aa, Homo Sapiens
KPAGQQPKV

SEQ ID NO: 992481 - protein, 9 aa, Homo Sapiens
AHSDFHVEP

SEQ ID NO: 992482 - protein, 9 aa, Homo Sapiens
VCTRSVIVR

SEQ ID NO: 992483 - protein, 9 aa, Homo Sapiens
TVRLSSVYR

SEQ ID NO: 992484 - protein, 9 aa, Homo Sapiens
IKAQELSLS

SEQ ID NO: 992485 - protein, 9 aa, Homo Sapiens
SKESQKDKK

SEQ ID NO: 992486 - protein, 9 aa, Homo Sapiens
DTCQANSAT

SEQ ID NO: 992487 - protein, 9 aa, Homo Sapiens
MHQCWSDEY

SEQ ID NO: 992488 - protein, 9 aa, Homo Sapiens
AQLKPSTLV

SEQ ID NO: 992489 - protein, 9 aa, Homo Sapiens
AKQKSVIFW

SEQ ID NO: 992490 - protein, 9 aa, Homo Sapiens
KEASIIAEY

SEQ ID NO: 992491 - protein, 9 aa, Homo Sapiens
GARALHPSS

SEQ ID NO: 992492 - protein, 9 aa, Homo Sapiens
LGSAAAAAS

SEQ ID NO: 992493 - protein, 9 aa, Homo Sapiens
SQGLAEAPA

SEQ ID NO: 992494 - protein, 9 aa, Homo Sapiens
ISIKLVCQI

SEQ ID NO: 992495 - protein, 9 aa, Homo Sapiens
ERCLKNAQA

SEQ ID NO: 992496 - protein, 9 aa, Homo Sapiens
TPLSPPPPP

SEQ ID NO: 992497 - protein, 9 aa, Homo Sapiens
VRIVVAVLR

SEQ ID NO: 992498 - protein, 9 aa, Homo Sapiens
LKHPRLCSC

SEQ ID NO: 992499 - protein, 9 aa, Homo Sapiens
YRGRFFRMG

SEQ ID NO: 992500 - protein, 9 aa, Homo Sapiens
IELLDLFNH

SEQ ID NO: 992501 - protein, 9 aa, Homo Sapiens
IPNTILGIQ

SEQ ID NO: 992502 - protein, 9 aa, Homo Sapiens
SQRTAAAAL

SEQ ID NO: 992503 - protein, 9 aa, Homo Sapiens
LRDGSVQYL

SEQ ID NO: 992504 - protein, 9 aa, Homo Sapiens
LTEIKLLSS

SEQ ID NO: 992505 - protein, 9 aa, Homo Sapiens
QKLEIRAQA

SEQ ID NO: 992506 - protein, 9 aa, Homo Sapiens
QGSFQETDK

SEQ ID NO: 992507 - protein, 9 aa, Homo Sapiens
NAQSIRTIK

SEQ ID NO: 992508 - protein, 9 aa, Homo Sapiens
EGDHGLLSE

SEQ ID NO: 992509 - protein, 9 aa, Homo Sapiens
KRIAQVCLE

SEQ ID NO: 992510 - protein, 9 aa, Homo Sapiens
ITAFYLSHE

SEQ ID NO: 992511 - protein, 9 aa, Homo Sapiens
HTGKRPYLC

SEQ ID NO: 992512 - protein, 9 aa, Homo Sapiens
DILKDKEFV

SEQ ID NO: 992513 - protein, 9 aa, Homo Sapiens
GTGKYSPAS

SEQ ID NO: 992514 - protein, 9 aa, Homo Sapiens
VYRSGFFFS

SEQ ID NO: 992515 - protein, 9 aa, Homo Sapiens
TEIKLLSSL

SEQ ID NO: 992516 - protein, 9 aa, Homo Sapiens
PKPAGQQPK

SEQ ID NO: 992517 - protein, 9 aa, Homo Sapiens
TTPGPLRAL

SEQ ID NO: 992518 - protein, 9 aa, Homo Sapiens
GEQEVDLAN

SEQ ID NO: 992519 - protein, 9 aa, Homo Sapiens
SRKNKKAKI

SEQ ID NO: 992520 - protein, 9 aa, Homo Sapiens
NHVLKESKQ

SEQ ID NO: 992521 - protein, 9 aa, Homo Sapiens
SQRHIIQGD

SEQ ID NO: 992522 - protein, 9 aa, Homo Sapiens
ETVNAIFPV

SEQ ID NO: 992523 - protein, 9 aa, Homo Sapiens
FWDTGVFRG

SEQ ID NO: 992524 - protein, 9 aa, Homo Sapiens
VLFACMDNM

SEQ ID NO: 992525 - protein, 9 aa, Homo Sapiens
EIRRPNGDN

SEQ ID NO: 992526 - protein, 9 aa, Homo Sapiens
QKNHPNHVL

SEQ ID NO: 992527 - protein, 9 aa, Homo Sapiens
ESQRHIIQG

SEQ ID NO: 992528 - protein, 9 aa, Homo Sapiens
VSFTFFKKV

SEQ ID NO: 992529 - protein, 9 aa, Homo Sapiens
SCTDLFTNE

SEQ ID NO: 992530 - protein, 9 aa, Homo Sapiens
QTRRSIFSD

SEQ ID NO: 992531 - protein, 9 aa, Homo Sapiens
FHRSSELKK

SEQ ID NO: 992532 - protein, 9 aa, Homo Sapiens
TPGPLRALT

SEQ ID NO: 992533 - protein, 9 aa, Homo Sapiens
GPAGLRGFS

SEQ ID NO: 992534 - protein, 9 aa, Homo Sapiens
CKYYYPERG

SEQ ID NO: 992535 - protein, 9 aa, Homo Sapiens
NHPTDVPFI

SEQ ID NO: 992536 - protein, 9 aa, Homo Sapiens
DEYVFGPNG

SEQ ID NO: 992537 - protein, 9 aa, Homo Sapiens
YRLNPNKYF

SEQ ID NO: 992538 - protein, 9 aa, Homo Sapiens
VRQEPLGGP

SEQ ID NO: 992539 - protein, 9 aa, Homo Sapiens
ENKNLTSTA

SEQ ID NO: 992540 - protein, 9 aa, Homo Sapiens
ILILSISCN

SEQ ID NO: 992541 - protein, 9 aa, Homo Sapiens
EEKARQREQ

SEQ ID NO: 992542 - protein, 9 aa, Homo Sapiens
VDIFTPLVD

SEQ ID NO: 992543 - protein, 9 aa, Homo Sapiens
LQERADMSP

SEQ ID NO: 992544 - protein, 9 aa, Homo Sapiens
LSLKTVDSC

SEQ ID NO: 992545 - protein, 9 aa, Homo Sapiens
GLASEALAG

SEQ ID NO: 992546 - protein, 9 aa, Homo Sapiens
MQEEILGPI

SEQ ID NO: 992547 - protein, 9 aa, Homo Sapiens
LYLARHTRI

SEQ ID NO: 992548 - protein, 9 aa, Homo Sapiens
YLTGECNYR

SEQ ID NO: 992549 - protein, 9 aa, Homo Sapiens
RPNGDNYAP

SEQ ID NO: 992550 - protein, 9 aa, Homo Sapiens
LRQKVLRKP

SEQ ID NO: 992551 - protein, 9 aa, Homo Sapiens
LLSEDGSFI

SEQ ID NO: 992552 - protein, 9 aa, Homo Sapiens
TAIKVLQRN

SEQ ID NO: 992553 - protein, 9 aa, Homo Sapiens
KNSELVLEG

SEQ ID NO: 992554 - protein, 9 aa, Homo Sapiens
PISLAFIGI

SEQ ID NO: 992555 - protein, 9 aa, Homo Sapiens
MIDVEAGTQ

SEQ ID NO: 992556 - protein, 9 aa, Homo Sapiens
NEQGLLNKL

SEQ ID NO: 992557 - protein, 9 aa, Homo Sapiens
IYGWPVATK

SEQ ID NO: 992558 - protein, 9 aa, Homo Sapiens
VLKESKQNE

SEQ ID NO: 992559 - protein, 9 aa, Homo Sapiens
MYKGSHVPL

SEQ ID NO: 992560 - protein, 9 aa, Homo Sapiens
QLLAHEAQE

SEQ ID NO: 992561 - protein, 9 aa, Homo Sapiens
RSVIVRLPG

SEQ ID NO: 992562 - protein, 9 aa, Homo Sapiens
DSWTLQSEE

SEQ ID NO: 992563 - protein, 9 aa, Homo Sapiens
GHGRQCQNS

SEQ ID NO: 992564 - protein, 9 aa, Homo Sapiens
DFHVEPCCG

SEQ ID NO: 992565 - protein, 9 aa, Homo Sapiens
FPGLFSSGL

SEQ ID NO: 992566 - protein, 9 aa, Homo Sapiens
EEKNGQGEG

SEQ ID NO: 992567 - protein, 9 aa, Homo Sapiens
RISIGFLFR

SEQ ID NO: 992568 - protein, 9 aa, Homo Sapiens
GKFYGNPMH

SEQ ID NO: 992569 - protein, 9 aa, Homo Sapiens
FFKKVHLKL

SEQ ID NO: 992570 - protein, 9 aa, Homo Sapiens
KDKEFVVEV

SEQ ID NO: 992571 - protein, 9 aa, Homo Sapiens
FCEDPDQWL

SEQ ID NO: 992572 - protein, 9 aa, Homo Sapiens
HRKDMILDI

SEQ ID NO: 992573 - protein, 9 aa, Homo Sapiens
EYVFGPNGG

SEQ ID NO: 992574 - protein, 9 aa, Homo Sapiens
STVCKPGWD

SEQ ID NO: 992575 - protein, 9 aa, Homo Sapiens
FSSGIAAMS

SEQ ID NO: 992576 - protein, 9 aa, Homo Sapiens
LMDQLLAHE

SEQ ID NO: 992577 - protein, 9 aa, Homo Sapiens
FFPFIEALH

SEQ ID NO: 992578 - protein, 9 aa, Homo Sapiens
AQAADAFLS

SEQ ID NO: 992579 - protein, 9 aa, Homo Sapiens
FDFAAAYFY

SEQ ID NO: 992580 - protein, 9 aa, Homo Sapiens
RIQRITSIE

SEQ ID NO: 992581 - protein, 9 aa, Homo Sapiens
NPEELRMAQ

SEQ ID NO: 992582 - protein, 9 aa, Homo Sapiens
RQQQLTAIK

SEQ ID NO: 992583 - protein, 9 aa, Homo Sapiens
GPAYREWFT

SEQ ID NO: 992584 - protein, 9 aa, Homo Sapiens
FVRNLYLAR

SEQ ID NO: 992585 - protein, 9 aa, Homo Sapiens
LTDVQKKVF

SEQ ID NO: 992586 - protein, 9 aa, Homo Sapiens
KAENSWKPN

SEQ ID NO: 992587 - protein, 9 aa, Homo Sapiens
MTPTASMED

SEQ ID NO: 992588 - protein, 9 aa, Homo Sapiens
TGEIYLDDI

SEQ ID NO: 992589 - protein, 9 aa, Homo Sapiens
FSVIAMIDV

SEQ ID NO: 992590 - protein, 9 aa, Homo Sapiens
GLILTSYVR

SEQ ID NO: 992591 - protein, 9 aa, Homo Sapiens
ELSDNEIQR

SEQ ID NO: 992592 - protein, 9 aa, Homo Sapiens
NQFCKDIAK

SEQ ID NO: 992593 - protein, 9 aa, Homo Sapiens
TGECNYRGR

SEQ ID NO: 992594 - protein, 9 aa, Homo Sapiens
VSPPVKVQE

SEQ ID NO: 992595 - protein, 9 aa, Homo Sapiens
TLTEIKLLS

SEQ ID NO: 992596 - protein, 9 aa, Homo Sapiens
VLDSDEEKN

SEQ ID NO: 992597 - protein, 9 aa, Homo Sapiens
RRVRFRLSD

SEQ ID NO: 992598 - protein, 9 aa, Homo Sapiens
VLTIVQCFI

SEQ ID NO: 992599 - protein, 9 aa, Homo Sapiens
LENEEEVNA

SEQ ID NO: 992600 - protein, 9 aa, Homo Sapiens
QRITSIEIS

SEQ ID NO: 992601 - protein, 9 aa, Homo Sapiens
LKEFKVTDA

SEQ ID NO: 992602 - protein, 9 aa, Homo Sapiens
TKCGERMVC

SEQ ID NO: 992603 - protein, 9 aa, Homo Sapiens
RKSENASLR

SEQ ID NO: 992604 - protein, 9 aa, Homo Sapiens
FSISQDRDE

SEQ ID NO: 992605 - protein, 9 aa, Homo Sapiens
VLGPISLAF

SEQ ID NO: 992606 - protein, 9 aa, Homo Sapiens
HANDFVGGL

SEQ ID NO: 992607 - protein, 9 aa, Homo Sapiens
KLSCLDIFL

SEQ ID NO: 992608 - protein, 9 aa, Homo Sapiens
LPPGMGGGS

SEQ ID NO: 992609 - protein, 9 aa, Homo Sapiens
SRSFWIAIL

SEQ ID NO: 992610 - protein, 9 aa, Homo Sapiens
KQYILILSI

SEQ ID NO: 992611 - protein, 9 aa, Homo Sapiens
NFKPGKPQV

SEQ ID NO: 992612 - protein, 9 aa, Homo Sapiens
SGEIGPCHV

SEQ ID NO: 992613 - protein, 9 aa, Homo Sapiens
EPGDKDEED

SEQ ID NO: 992614 - protein, 9 aa, Homo Sapiens
LDGYAYLEC

SEQ ID NO: 992615 - protein, 9 aa, Homo Sapiens
LDLLFHSAK

SEQ ID NO: 992616 - protein, 9 aa, Homo Sapiens
ADTEETGAP

SEQ ID NO: 992617 - protein, 9 aa, Homo Sapiens
LGFIKTKDL

SEQ ID NO: 992618 - protein, 9 aa, Homo Sapiens
EKNQPTEKK

SEQ ID NO: 992619 - protein, 9 aa, Homo Sapiens
FTLALLQAV

SEQ ID NO: 992620 - protein, 9 aa, Homo Sapiens
SPPVGPPGG

SEQ ID NO: 992621 - protein, 9 aa, Homo Sapiens
PGDKDEEDE

SEQ ID NO: 992622 - protein, 9 aa, Homo Sapiens
EGFPQFPLQ

SEQ ID NO: 992623 - protein, 9 aa, Homo Sapiens
LKGPGRAES

SEQ ID NO: 992624 - protein, 9 aa, Homo Sapiens
DEEVIEMYK

SEQ ID NO: 992625 - protein, 9 aa, Homo Sapiens
KLGLVETSF

SEQ ID NO: 992626 - protein, 9 aa, Homo Sapiens
IWNQFSWPF

SEQ ID NO: 992627 - protein, 9 aa, Homo Sapiens
LPAVSPGKK

SEQ ID NO: 992628 - protein, 9 aa, Homo Sapiens
DDPFTLALL

SEQ ID NO: 992629 - protein, 9 aa, Homo Sapiens
FRLSDARLE

SEQ ID NO: 992630 - protein, 9 aa, Homo Sapiens
CGPRDLEHE

SEQ ID NO: 992631 - protein, 9 aa, Homo Sapiens
LASLLLHCG

SEQ ID NO: 992632 - protein, 9 aa, Homo Sapiens
LVCQINLTT

SEQ ID NO: 992633 - protein, 9 aa, Homo Sapiens
VFPQCPNLL

SEQ ID NO: 992634 - protein, 9 aa, Homo Sapiens
KVEEEKLKH

SEQ ID NO: 992635 - protein, 9 aa, Homo Sapiens
KRDSWTLQS

SEQ ID NO: 992636 - protein, 9 aa, Homo Sapiens
GDFGLATEK

SEQ ID NO: 992637 - protein, 9 aa, Homo Sapiens
VRLLVLDGA

SEQ ID NO: 992638 - protein, 9 aa, Homo Sapiens
ESERFNPEE

SEQ ID NO: 992639 - protein, 9 aa, Homo Sapiens
TLTGLASEA

SEQ ID NO: 992640 - protein, 9 aa, Homo Sapiens
HTPEAMQIA

SEQ ID NO: 992641 - protein, 9 aa, Homo Sapiens
TLLLMSGGP

SEQ ID NO: 992642 - protein, 9 aa, Homo Sapiens
LGGCSMGSR

SEQ ID NO: 992643 - protein, 9 aa, Homo Sapiens
GFFFSRGCS

SEQ ID NO: 992644 - protein, 9 aa, Homo Sapiens
CEDPDQWLS

SEQ ID NO: 992645 - protein, 9 aa, Homo Sapiens
QCQNSTVCK

SEQ ID NO: 992646 - protein, 9 aa, Homo Sapiens
TFNFSAVFT

SEQ ID NO: 992647 - protein, 9 aa, Homo Sapiens
LGEIHNWIE

SEQ ID NO: 992648 - protein, 9 aa, Homo Sapiens
QEPSECSDQ

SEQ ID NO: 992649 - protein, 9 aa, Homo Sapiens
SFASPHVTH

SEQ ID NO: 992650 - protein, 9 aa, Homo Sapiens
RVRQEPLGG

SEQ ID NO: 992651 - protein, 9 aa, Homo Sapiens
KIKVPKFSV

SEQ ID NO: 992652 - protein, 9 aa, Homo Sapiens
RSIVGPSKP

SEQ ID NO: 992653 - protein, 9 aa, Homo Sapiens
IQRITSIEI

SEQ ID NO: 992654 - protein, 9 aa, Homo Sapiens
VKLRKLELS

SEQ ID NO: 992655 - protein, 9 aa, Homo Sapiens
EPISDQQLN

SEQ ID NO: 992656 - protein, 9 aa, Homo Sapiens
RKNRLLHLC

SEQ ID NO: 992657 - protein, 9 aa, Homo Sapiens
PEDCSLMVA

SEQ ID NO: 992658 - protein, 9 aa, Homo Sapiens
KFKQYILIL

SEQ ID NO: 992659 - protein, 9 aa, Homo Sapiens
PFHDISIYA

SEQ ID NO: 992660 - protein, 9 aa, Homo Sapiens
PVMQEEILG

SEQ ID NO: 992661 - protein, 9 aa, Homo Sapiens
DLKGPGRAE

SEQ ID NO: 992662 - protein, 9 aa, Homo Sapiens
SVSPVKTLS

SEQ ID NO: 992663 - protein, 9 aa, Homo Sapiens
SFCGPNELD

SEQ ID NO: 992664 - protein, 9 aa, Homo Sapiens
WQKLPPFCE

SEQ ID NO: 992665 - protein, 9 aa, Homo Sapiens
NLFWDTGVF

SEQ ID NO: 992666 - protein, 9 aa, Homo Sapiens
FGDNGSLAM

SEQ ID NO: 992667 - protein, 9 aa, Homo Sapiens
QSIRTIKGP

SEQ ID NO: 992668 - protein, 9 aa, Homo Sapiens
GETGNWFFP

SEQ ID NO: 992669 - protein, 9 aa, Homo Sapiens
MRKHTGKRP

SEQ ID NO: 992670 - protein, 9 aa, Homo Sapiens
ISFGFVIIS

SEQ ID NO: 992671 - protein, 9 aa, Homo Sapiens
PMVCQKQDP

SEQ ID NO: 992672 - protein, 9 aa, Homo Sapiens
LEIRAQAAD

SEQ ID NO: 992673 - protein, 9 aa, Homo Sapiens
LELSDNEIQ

SEQ ID NO: 992674 - protein, 9 aa, Homo Sapiens
FWLLNHDPA

SEQ ID NO: 992675 - protein, 9 aa, Homo Sapiens
RSIFSDTSS

SEQ ID NO: 992676 - protein, 9 aa, Homo Sapiens
KLEIRAQAA

SEQ ID NO: 992677 - protein, 9 aa, Homo Sapiens
AENSWKPNK

SEQ ID NO: 992678 - protein, 9 aa, Homo Sapiens
SHAFNQSAE

SEQ ID NO: 992679 - protein, 9 aa, Homo Sapiens
KGSHVPLEQ

SEQ ID NO: 992680 - protein, 9 aa, Homo Sapiens
GDIQAKMVV

SEQ ID NO: 992681 - protein, 9 aa, Homo Sapiens
VAHSVISTQ

SEQ ID NO: 992682 - protein, 9 aa, Homo Sapiens
AKELPLLRK

SEQ ID NO: 992683 - protein, 9 aa, Homo Sapiens
FWIAILWAC

SEQ ID NO: 992684 - protein, 9 aa, Homo Sapiens
SEHRHSFLA

SEQ ID NO: 992685 - protein, 9 aa, Homo Sapiens
GPSFLGGGG

SEQ ID NO: 992686 - protein, 9 aa, Homo Sapiens
LWACPGLGV

SEQ ID NO: 992687 - protein, 9 aa, Homo Sapiens
LSYLHPEDC

SEQ ID NO: 992688 - protein, 9 aa, Homo Sapiens
SSGIAAMSL

SEQ ID NO: 992689 - protein, 9 aa, Homo Sapiens
GGWTSRALS

SEQ ID NO: 992690 - protein, 9 aa, Homo Sapiens
FLFRRKKDN

SEQ ID NO: 992691 - protein, 9 aa, Homo Sapiens
FGLATEKSR

SEQ ID NO: 992692 - protein, 9 aa, Homo Sapiens
CQCVEKNTL

SEQ ID NO: 992693 - protein, 9 aa, Homo Sapiens
IGPAYREWF

SEQ ID NO: 992694 - protein, 9 aa, Homo Sapiens
GFKLDGYAY

SEQ ID NO: 992695 - protein, 9 aa, Homo Sapiens
ATKNWEQKY

SEQ ID NO: 992696 - protein, 9 aa, Homo Sapiens
SIMKAMVSL

SEQ ID NO: 992697 - protein, 9 aa, Homo Sapiens
PVVTPQDLK

SEQ ID NO: 992698 - protein, 9 aa, Homo Sapiens
LILSISCNP

SEQ ID NO: 992699 - protein, 9 aa, Homo Sapiens
RRPNGDNYA

SEQ ID NO: 992700 - protein, 9 aa, Homo Sapiens
IRTIKGPHL

SEQ ID NO: 992701 - protein, 9 aa, Homo Sapiens
MNDSYIVIT

SEQ ID NO: 992702 - protein, 9 aa, Homo Sapiens
TSHKKHRSI

SEQ ID NO: 992703 - protein, 9 aa, Homo Sapiens
NEIEVDFSK

SEQ ID NO: 992704 - protein, 9 aa, Homo Sapiens
SMASDPRTL

SEQ ID NO: 992705 - protein, 9 aa, Homo Sapiens
SLSCTDLFT

SEQ ID NO: 992706 - protein, 9 aa, Homo Sapiens
LAGVFLGGC

SEQ ID NO: 992707 - protein, 9 aa, Homo Sapiens
PQCPNLLPL

SEQ ID NO: 992708 - protein, 9 aa, Homo Sapiens
CSLMVAIHQ

SEQ ID NO: 992709 - protein, 9 aa, Homo Sapiens
LNEQGLLNK

SEQ ID NO: 992710 - protein, 9 aa, Homo Sapiens
RFRLSDARL

SEQ ID NO: 992711 - protein, 9 aa, Homo Sapiens
MQIATGRNA

SEQ ID NO: 992712 - protein, 9 aa, Homo Sapiens
KDILKDKEF

SEQ ID NO: 992713 - protein, 9 aa, Homo Sapiens
YGHGSLKLL

SEQ ID NO: 992714 - protein, 9 aa, Homo Sapiens
NYGHGSLKL

SEQ ID NO: 992715 - protein, 9 aa, Homo Sapiens
SKRGLSLKT

SEQ ID NO: 992716 - protein, 9 aa, Homo Sapiens
NYITQSLQQ

SEQ ID NO: 992717 - protein, 9 aa, Homo Sapiens
FHSAKVQPQ

SEQ ID NO: 992718 - protein, 9 aa, Homo Sapiens
NPQAQQGCF

SEQ ID NO: 992719 - protein, 9 aa, Homo Sapiens
MNFIARYLI

SEQ ID NO: 992720 - protein, 9 aa, Homo Sapiens
SRGSMLASG

SEQ ID NO: 992721 - protein, 9 aa, Homo Sapiens
CNYRGRVTD

SEQ ID NO: 992722 - protein, 9 aa, Homo Sapiens
IVLGPISLA

SEQ ID NO: 992723 - protein, 9 aa, Homo Sapiens
SWVKGWEHD

SEQ ID NO: 992724 - protein, 9 aa, Homo Sapiens
YGWPVATKN

SEQ ID NO: 992725 - protein, 9 aa, Homo Sapiens
GPHPLDLLF

SEQ ID NO: 992726 - protein, 9 aa, Homo Sapiens
QECLEGQER

SEQ ID NO: 992727 - protein, 9 aa, Homo Sapiens
NRGIHVEVP

SEQ ID NO: 992728 - protein, 9 aa, Homo Sapiens
FTPLVDTKW

SEQ ID NO: 992729 - protein, 9 aa, Homo Sapiens
HREALLDRK

SEQ ID NO: 992730 - protein, 9 aa, Homo Sapiens
EVGYSARKS

SEQ ID NO: 992731 - protein, 9 aa, Homo Sapiens
DGSVQYLVN

SEQ ID NO: 992732 - protein, 9 aa, Homo Sapiens
YSPASLHAV

SEQ ID NO: 992733 - protein, 9 aa, Homo Sapiens
AHSVISTQT

SEQ ID NO: 992734 - protein, 9 aa, Homo Sapiens
EFMNDSYIV

SEQ ID NO: 992735 - protein, 9 aa, Homo Sapiens
SGLHMQLPS

SEQ ID NO: 992736 - protein, 9 aa, Homo Sapiens
GQEELEGSL

SEQ ID NO: 992737 - protein, 9 aa, Homo Sapiens
PKSDLETWL

SEQ ID NO: 992738 - protein, 9 aa, Homo Sapiens
LLPLVPSQS

SEQ ID NO: 992739 - protein, 9 aa, Homo Sapiens
SIVGPSKPV

SEQ ID NO: 992740 - protein, 9 aa, Homo Sapiens
QGKFYGNPM

SEQ ID NO: 992741 - protein, 9 aa, Homo Sapiens
RYVSSHAFN

SEQ ID NO: 992742 - protein, 9 aa, Homo Sapiens
THKPTYQGS

SEQ ID NO: 992743 - protein, 9 aa, Homo Sapiens
PTPLSPPPP

SEQ ID NO: 992744 - protein, 9 aa, Homo Sapiens
KDEVAYTLT

SEQ ID NO: 992745 - protein, 9 aa, Homo Sapiens
GRSNLFWDT

SEQ ID NO: 992746 - protein, 9 aa, Homo Sapiens
WSDEYNCSS

SEQ ID NO: 992747 - protein, 9 aa, Homo Sapiens
EKSRWSGSH

SEQ ID NO: 992748 - protein, 9 aa, Homo Sapiens
LAHEAQEEA

SEQ ID NO: 992749 - protein, 9 aa, Homo Sapiens
SLLQIGLLL

SEQ ID NO: 992750 - protein, 9 aa, Homo Sapiens
LTRESVTIK

SEQ ID NO: 992751 - protein, 9 aa, Homo Sapiens
ELKKLHKEL

SEQ ID NO: 992752 - protein, 9 aa, Homo Sapiens
AIFPVAIVM

SEQ ID NO: 992753 - protein, 9 aa, Homo Sapiens
GASKILGFI

SEQ ID NO: 992754 - protein, 9 aa, Homo Sapiens
HSDTTSPTG

SEQ ID NO: 992755 - protein, 9 aa, Homo Sapiens
IDKFKQYIL

SEQ ID NO: 992756 - protein, 9 aa, Homo Sapiens
ECASNSCRK

SEQ ID NO: 992757 - protein, 9 aa, Homo Sapiens
LTFNFSAVF

SEQ ID NO: 992758 - protein, 9 aa, Homo Sapiens
NRLLHLCLV

SEQ ID NO: 992759 - protein, 9 aa, Homo Sapiens
GGWGPSFLG

SEQ ID NO: 992760 - protein, 9 aa, Homo Sapiens
LSCLDIFLN

SEQ ID NO: 992761 - protein, 9 aa, Homo Sapiens
AFVRNLYLA

SEQ ID NO: 992762 - protein, 9 aa, Homo Sapiens
TSHPSQGLA

SEQ ID NO: 992763 - protein, 9 aa, Homo Sapiens
KKRRISIGF

SEQ ID NO: 992764 - protein, 9 aa, Homo Sapiens
AGQQPKVLL

SEQ ID NO: 992765 - protein, 9 aa, Homo Sapiens
PLKNLTFNF

SEQ ID NO: 992766 - protein, 9 aa, Homo Sapiens
LIKEFMNDS

SEQ ID NO: 992767 - protein, 9 aa, Homo Sapiens
GWEHDKQET

SEQ ID NO: 992768 - protein, 9 aa, Homo Sapiens
VFLGGCSMG

SEQ ID NO: 992769 - protein, 9 aa, Homo Sapiens
VMGKFSIRL

SEQ ID NO: 992770 - protein, 9 aa, Homo Sapiens
AVSPGKKLW

SEQ ID NO: 992771 - protein, 9 aa, Homo Sapiens
WGPSFLGGG

SEQ ID NO: 992772 - protein, 9 aa, Homo Sapiens
DIQAKMVVR

SEQ ID NO: 992773 - protein, 9 aa, Homo Sapiens
PGLDARISS

SEQ ID NO: 992774 - protein, 9 aa, Homo Sapiens
NWFFPFIEA

SEQ ID NO: 992775 - protein, 9 aa, Homo Sapiens
QLTAIKVLQ

SEQ ID NO: 992776 - protein, 9 aa, Homo Sapiens
LDIRFSPGS

SEQ ID NO: 992777 - protein, 9 aa, Homo Sapiens
NLALQKTEM

SEQ ID NO: 992778 - protein, 9 aa, Homo Sapiens
TGEQESSPS

SEQ ID NO: 992779 - protein, 9 aa, Homo Sapiens
LKGMAKKSL

SEQ ID NO: 992780 - protein, 9 aa, Homo Sapiens
AGTSTSQSS

SEQ ID NO: 992781 - protein, 9 aa, Homo Sapiens
RCLKNAQAA

SEQ ID NO: 992782 - protein, 9 aa, Homo Sapiens
WPVATKNWE

SEQ ID NO: 992783 - protein, 9 aa, Homo Sapiens
LRKKLPLSS

SEQ ID NO: 992784 - protein, 9 aa, Homo Sapiens
AARNGFLPK

SEQ ID NO: 992785 - protein, 9 aa, Homo Sapiens
ELKRWQLKA

SEQ ID NO: 992786 - protein, 9 aa, Homo Sapiens
QTLDLNCMV

SEQ ID NO: 992787 - protein, 9 aa, Homo Sapiens
GKITREDMS

SEQ ID NO: 992788 - protein, 9 aa, Homo Sapiens
ILKEFKVTD

SEQ ID NO: 992789 - protein, 9 aa, Homo Sapiens
LKEASIIAE

SEQ ID NO: 992790 - protein, 9 aa, Homo Sapiens
LYSWLFPLR

SEQ ID NO: 992791 - protein, 9 aa, Homo Sapiens
EDNDEPGDK

SEQ ID NO: 992792 - protein, 9 aa, Homo Sapiens
GMGHVLTIV

SEQ ID NO: 992793 - protein, 9 aa, Homo Sapiens
IVGPSKPVS

SEQ ID NO: 992794 - protein, 9 aa, Homo Sapiens
SIKLVCQIN

SEQ ID NO: 992795 - protein, 9 aa, Homo Sapiens
RVFQYRVKV

SEQ ID NO: 992796 - protein, 9 aa, Homo Sapiens
ITKFELTMS

SEQ ID NO: 992797 - protein, 9 aa, Homo Sapiens
LHPEDCSLM

SEQ ID NO: 992798 - protein, 9 aa, Homo Sapiens
GFLPKPDPQ

SEQ ID NO: 992799 - protein, 9 aa, Homo Sapiens
QISQAQLKP

SEQ ID NO: 992800 - protein, 9 aa, Homo Sapiens
VQEKEYPLG

SEQ ID NO: 992801 - protein, 9 aa, Homo Sapiens
EFSPRRVRF

SEQ ID NO: 992802 - protein, 9 aa, Homo Sapiens
VEDVTNTTT

SEQ ID NO: 992803 - protein, 9 aa, Homo Sapiens
DGYAYLECL

SEQ ID NO: 992804 - protein, 9 aa, Homo Sapiens
GFHRSSELK

SEQ ID NO: 992805 - protein, 9 aa, Homo Sapiens
VLQERADMS

SEQ ID NO: 992806 - protein, 9 aa, Homo Sapiens
NLNDTIKDL

SEQ ID NO: 992807 - protein, 9 aa, Homo Sapiens
SQAQLKPST

SEQ ID NO: 992808 - protein, 9 aa, Homo Sapiens
LSLTQTPTG

SEQ ID NO: 992809 - protein, 9 aa, Homo Sapiens
SLPNGNFKP

SEQ ID NO: 992810 - protein, 9 aa, Homo Sapiens
SYKEQELLR

SEQ ID NO: 992811 - protein, 9 aa, Homo Sapiens
SERLENEEE

SEQ ID NO: 992812 - protein, 9 aa, Homo Sapiens
DQVTDTCQA

SEQ ID NO: 992813 - protein, 9 aa, Homo Sapiens
SSLTRHQII

SEQ ID NO: 992814 - protein, 9 aa, Homo Sapiens
QSSERTPGA

SEQ ID NO: 992815 - protein, 9 aa, Homo Sapiens
AAASDTCGH

SEQ ID NO: 992816 - protein, 9 aa, Homo Sapiens
GLSGEIGPC

SEQ ID NO: 992817 - protein, 9 aa, Homo Sapiens
HVDADDDPF

SEQ ID NO: 992818 - protein, 9 aa, Homo Sapiens
HKRKPLEVG

SEQ ID NO: 992819 - protein, 9 aa, Homo Sapiens
AYREWFTFA

SEQ ID NO: 992820 - protein, 9 aa, Homo Sapiens
GPTEVSTAC

SEQ ID NO: 992821 - protein, 9 aa, Homo Sapiens
ILGIQPLHT

SEQ ID NO: 992822 - protein, 9 aa, Homo Sapiens
VASGYLKGM

SEQ ID NO: 992823 - protein, 9 aa, Homo Sapiens
HGLQCDQHR

SEQ ID NO: 992824 - protein, 9 aa, Homo Sapiens
RDEYVFGPN

SEQ ID NO: 992825 - protein, 9 aa, Homo Sapiens
RQCQNSTVC

SEQ ID NO: 992826 - protein, 9 aa, Homo Sapiens
KRRGHYEFL

SEQ ID NO: 992827 - protein, 9 aa, Homo Sapiens
FEGFPQFPL

SEQ ID NO: 992828 - protein, 9 aa, Homo Sapiens
TDTCQANSA

SEQ ID NO: 992829 - protein, 9 aa, Homo Sapiens
FSGERGLPG

SEQ ID NO: 992830 - protein, 9 aa, Homo Sapiens
QTTRFILIG

SEQ ID NO: 992831 - protein, 9 aa, Homo Sapiens
RQKVLRKPL

SEQ ID NO: 992832 - protein, 9 aa, Homo Sapiens
GHVLTIVQC

SEQ ID NO: 992833 - protein, 9 aa, Homo Sapiens
MKASDSHRP

SEQ ID NO: 992834 - protein, 9 aa, Homo Sapiens
KNKKAKISI

SEQ ID NO: 992835 - protein, 9 aa, Homo Sapiens
VKTLSDAGN

SEQ ID NO: 992836 - protein, 9 aa, Homo Sapiens
YDFDNCGKI

SEQ ID NO: 992837 - protein, 9 aa, Homo Sapiens
SNSTLSLTQ

SEQ ID NO: 992838 - protein, 9 aa, Homo Sapiens
FASPHVTHI

SEQ ID NO: 992839 - protein, 9 aa, Homo Sapiens
YVRIVVAVL

SEQ ID NO: 992840 - protein, 9 aa, Homo Sapiens
ARNGFLPKP

SEQ ID NO: 992841 - protein, 9 aa, Homo Sapiens
GGGSCYGLH

SEQ ID NO: 992842 - protein, 9 aa, Homo Sapiens
TSQSSERTP

SEQ ID NO: 992843 - protein, 9 aa, Homo Sapiens
PNGDNYAPD

SEQ ID NO: 992844 - protein, 9 aa, Homo Sapiens
RLPPGMGGG

SEQ ID NO: 992845 - protein, 9 aa, Homo Sapiens
KHRSIVGPS

SEQ ID NO: 992846 - protein, 9 aa, Homo Sapiens
EKGMIFVCS

SEQ ID NO: 992847 - protein, 9 aa, Homo Sapiens
KSENASLRE

SEQ ID NO: 992848 - protein, 9 aa, Homo Sapiens
CNHPTDVPF

SEQ ID NO: 992849 - protein, 9 aa, Homo Sapiens
DKFKQYILI

SEQ ID NO: 992850 - protein, 9 aa, Homo Sapiens
ILDIRFSPG

SEQ ID NO: 992851 - protein, 9 aa, Homo Sapiens
CYGLHLPAH

SEQ ID NO: 992852 - protein, 9 aa, Homo Sapiens
QGMNFIARY

SEQ ID NO: 992853 - protein, 9 aa, Homo Sapiens
AMIDVEAGT

SEQ ID NO: 992854 - protein, 9 aa, Homo Sapiens
ENVKNAYIK

SEQ ID NO: 992855 - protein, 9 aa, Homo Sapiens
EKNTLECSA

SEQ ID NO: 992856 - protein, 9 aa, Homo Sapiens
SIYADKDVF

SEQ ID NO: 992857 - protein, 9 aa, Homo Sapiens
FIFLISFGF

SEQ ID NO: 992858 - protein, 9 aa, Homo Sapiens
DFAAAYFYL

SEQ ID NO: 992859 - protein, 9 aa, Homo Sapiens
ASGTKCGER

SEQ ID NO: 992860 - protein, 9 aa, Homo Sapiens
LGMGHVLTI

SEQ ID NO: 992861 - protein, 9 aa, Homo Sapiens
GNPQPVLSQ

SEQ ID NO: 992862 - protein, 9 aa, Homo Sapiens
YIKARINFG

SEQ ID NO: 992863 - protein, 9 aa, Homo Sapiens
PLEVGYSAR

SEQ ID NO: 992864 - protein, 9 aa, Homo Sapiens
WRAQPTERC

SEQ ID NO: 992865 - protein, 9 aa, Homo Sapiens
DSQHVAVFY

SEQ ID NO: 992866 - protein, 9 aa, Homo Sapiens
LKDKEFVVE

SEQ ID NO: 992867 - protein, 9 aa, Homo Sapiens
SMEDFTPSG

SEQ ID NO: 992868 - protein, 9 aa, Homo Sapiens
SDPRTLQRM

SEQ ID NO: 992869 - protein, 9 aa, Homo Sapiens
EAELLLLDE

SEQ ID NO: 992870 - protein, 9 aa, Homo Sapiens
MSRAPRILA

SEQ ID NO: 992871 - protein, 9 aa, Homo Sapiens
PGFIMNGSC

SEQ ID NO: 992872 - protein, 9 aa, Homo Sapiens
KLHKELCIL

SEQ ID NO: 992873 - protein, 9 aa, Homo Sapiens
VRYFHDEDN

SEQ ID NO: 992874 - protein, 9 aa, Homo Sapiens
HRSSELKKH

SEQ ID NO: 992875 - protein, 9 aa, Homo Sapiens
SNRPEPISD

SEQ ID NO: 992876 - protein, 9 aa, Homo Sapiens
RLLVLDGAP

SEQ ID NO: 992877 - protein, 9 aa, Homo Sapiens
QQLTAIKVL

SEQ ID NO: 992878 - protein, 9 aa, Homo Sapiens
WTSRALSPQ

SEQ ID NO: 992879 - protein, 9 aa, Homo Sapiens
AAAASDTCG

SEQ ID NO: 992880 - protein, 9 aa, Homo Sapiens
SLTRHQIIH

SEQ ID NO: 992881 - protein, 9 aa, Homo Sapiens
LIYCSLRFS

SEQ ID NO: 992882 - protein, 9 aa, Homo Sapiens
TIVQCFISS

SEQ ID NO: 992883 - protein, 9 aa, Homo Sapiens
NFGYNLQAQ

SEQ ID NO: 992884 - protein, 9 aa, Homo Sapiens
AENSQCLLG

SEQ ID NO: 992885 - protein, 9 aa, Homo Sapiens
KKSVCRRLN

SEQ ID NO: 992886 - protein, 9 aa, Homo Sapiens
HQCWSDEYN

SEQ ID NO: 992887 - protein, 9 aa, Homo Sapiens
SSPRACPTA

SEQ ID NO: 992888 - protein, 9 aa, Homo Sapiens
GANRGIHVE

SEQ ID NO: 992889 - protein, 9 aa, Homo Sapiens
PSRKNKKAK

SEQ ID NO: 992890 - protein, 9 aa, Homo Sapiens
YAYLECLQN

SEQ ID NO: 992891 - protein, 9 aa, Homo Sapiens
HRLPPGMGG

SEQ ID NO: 992892 - protein, 9 aa, Homo Sapiens
SFWIAILWA

SEQ ID NO: 992893 - protein, 9 aa, Homo Sapiens
VKGWEHDKQ

SEQ ID NO: 992894 - protein, 9 aa, Homo Sapiens
YPERGSQPQ

SEQ ID NO: 992895 - protein, 9 aa, Homo Sapiens
RKPLEPAAL

SEQ ID NO: 992896 - protein, 9 aa, Homo Sapiens
SQCLLGDFV

SEQ ID NO: 992897 - protein, 9 aa, Homo Sapiens
ASLLLHCGQ

SEQ ID NO: 992898 - protein, 9 aa, Homo Sapiens
KESQKDKKK

SEQ ID NO: 992899 - protein, 9 aa, Homo Sapiens
LLLDEFAVL

SEQ ID NO: 992900 - protein, 9 aa, Homo Sapiens
AVCTRSVIV

SEQ ID NO: 992901 - protein, 9 aa, Homo Sapiens
RWSTSIPSP

SEQ ID NO: 992902 - protein, 9 aa, Homo Sapiens
RSFWIAILW

SEQ ID NO: 992903 - protein, 9 aa, Homo Sapiens
LLMDQLLAH

SEQ ID NO: 992904 - protein, 9 aa, Homo Sapiens
HGRQCQNST

SEQ ID NO: 992905 - protein, 9 aa, Homo Sapiens
CDTVGAGAW

SEQ ID NO: 992906 - protein, 9 aa, Homo Sapiens
LTMSCSSLE

SEQ ID NO: 992907 - protein, 9 aa, Homo Sapiens
PEPISDQQL

SEQ ID NO: 992908 - protein, 9 aa, Homo Sapiens
QLALRKKLP

SEQ ID NO: 992909 - protein, 9 aa, Homo Sapiens
CFWPLGITA

SEQ ID NO: 992910 - protein, 9 aa, Homo Sapiens
FVGGLMSDG

SEQ ID NO: 992911 - protein, 9 aa, Homo Sapiens
PVKVQEKEY

SEQ ID NO: 992912 - protein, 9 aa, Homo Sapiens
AASDTCGHI

SEQ ID NO: 992913 - protein, 9 aa, Homo Sapiens
DNCGKITRE

SEQ ID NO: 992914 - protein, 9 aa, Homo Sapiens
PSFLGGGGE

SEQ ID NO: 992915 - protein, 9 aa, Homo Sapiens
GNFKPGKPQ

SEQ ID NO: 992916 - protein, 9 aa, Homo Sapiens
ISIYADKDV

SEQ ID NO: 992917 - protein, 9 aa, Homo Sapiens
TNELMVSEF

SEQ ID NO: 992918 - protein, 9 aa, Homo Sapiens
EEGKRPGSL

SEQ ID NO: 992919 - protein, 9 aa, Homo Sapiens
YILILSISC

SEQ ID NO: 992920 - protein, 9 aa, Homo Sapiens
VLRKPLEPA

SEQ ID NO: 992921 - protein, 9 aa, Homo Sapiens
HVLKESKQN

SEQ ID NO: 992922 - protein, 9 aa, Homo Sapiens
VKVQEKEYP

SEQ ID NO: 992923 - protein, 9 aa, Homo Sapiens
SFLGGGGEA

SEQ ID NO: 992924 - protein, 9 aa, Homo Sapiens
DHGLLSEDG

SEQ ID NO: 992925 - protein, 9 aa, Homo Sapiens
AGLRGFSGE

SEQ ID NO: 992926 - protein, 9 aa, Homo Sapiens
PGGAGTAPL

SEQ ID NO: 992927 - protein, 9 aa, Homo Sapiens
TQTPPPPSP

SEQ ID NO: 992928 - protein, 9 aa, Homo Sapiens
IRRPNGDNY

SEQ ID NO: 992929 - protein, 9 aa, Homo Sapiens
KNWEQKYGA

SEQ ID NO: 992930 - protein, 9 aa, Homo Sapiens
PLDLLFHSA

SEQ ID NO: 992931 - protein, 9 aa, Homo Sapiens
CQINLTTFD

SEQ ID NO: 992932 - protein, 9 aa, Homo Sapiens
DSTSYKEQE

SEQ ID NO: 992933 - protein, 9 aa, Homo Sapiens
RQLALRKKL

SEQ ID NO: 992934 - protein, 9 aa, Homo Sapiens
VLSQAVATK

SEQ ID NO: 992935 - protein, 9 aa, Homo Sapiens
ALLDRKSEN

SEQ ID NO: 992936 - protein, 9 aa, Homo Sapiens
SAAAAASCH

SEQ ID NO: 992937 - protein, 9 aa, Homo Sapiens
DNGSLAMLS

SEQ ID NO: 992938 - protein, 9 aa, Homo Sapiens
KEFKVTDAR

SEQ ID NO: 992939 - protein, 9 aa, Homo Sapiens
ELLLLDEFA

SEQ ID NO: 992940 - protein, 9 aa, Homo Sapiens
GKRPGSLRQ

SEQ ID NO: 992941 - protein, 9 aa, Homo Sapiens
NLAATHKPT

SEQ ID NO: 992942 - protein, 9 aa, Homo Sapiens
EQLFQTTRF

SEQ ID NO: 992943 - protein, 9 aa, Homo Sapiens
DKGFHRSSE

SEQ ID NO: 992944 - protein, 9 aa, Homo Sapiens
DRDEYVFGP

SEQ ID NO: 992945 - protein, 9 aa, Homo Sapiens
GQAAAASDT

SEQ ID NO: 992946 - protein, 9 aa, Homo Sapiens
REQKEQELT

SEQ ID NO: 992947 - protein, 9 aa, Homo Sapiens
SWKVFTSWN

SEQ ID NO: 992948 - protein, 9 aa, Homo Sapiens
GLLSEDGSF

SEQ ID NO: 992949 - protein, 9 aa, Homo Sapiens
IGAREAQHS

SEQ ID NO: 992950 - protein, 9 aa, Homo Sapiens
DKDEEDEEG

SEQ ID NO: 992951 - protein, 9 aa, Homo Sapiens
KPMVCQKQD

SEQ ID NO: 992952 - protein, 9 aa, Homo Sapiens
KPTYQGSPQ

SEQ ID NO: 992953 - protein, 9 aa, Homo Sapiens
QQPKVLLSP

SEQ ID NO: 992954 - protein, 9 aa, Homo Sapiens
EGETGNWFF

SEQ ID NO: 992955 - protein, 9 aa, Homo Sapiens
PEELRMAQQ

SEQ ID NO: 992956 - protein, 9 aa, Homo Sapiens
EEIEEEEDE

SEQ ID NO: 992957 - protein, 9 aa, Homo Sapiens
KTEMVGKIE

SEQ ID NO: 992958 - protein, 9 aa, Homo Sapiens
ASGLHMQLP

SEQ ID NO: 992959 - protein, 9 aa, Homo Sapiens
IFLISFGFV

SEQ ID NO: 992960 - protein, 9 aa, Homo Sapiens
NLLPLVPSQ

SEQ ID NO: 992961 - protein, 9 aa, Homo Sapiens
KQDPLNETH

SEQ ID NO: 992962 - protein, 9 aa, Homo Sapiens
PGLFSSGLY

SEQ ID NO: 992963 - protein, 9 aa, Homo Sapiens
GSKLNVPKI

SEQ ID NO: 992964 - protein, 9 aa, Homo Sapiens
LTALKHPRL

SEQ ID NO: 992965 - protein, 9 aa, Homo Sapiens
ESPLRIKMK

SEQ ID NO: 992966 - protein, 9 aa, Homo Sapiens
LVVDDLSSG

SEQ ID NO: 992967 - protein, 9 aa, Homo Sapiens
WVKGWEHDK

SEQ ID NO: 992968 - protein, 9 aa, Homo Sapiens
VWFGPTEVS

SEQ ID NO: 992969 - protein, 9 aa, Homo Sapiens
EQEVDLANC

SEQ ID NO: 992970 - protein, 9 aa, Homo Sapiens
TPTASMEDF

SEQ ID NO: 992971 - protein, 9 aa, Homo Sapiens
VRAVVQGTN

SEQ ID NO: 992972 - protein, 9 aa, Homo Sapiens
SQDRDEYVF

SEQ ID NO: 992973 - protein, 9 aa, Homo Sapiens
REWFTFAVG

SEQ ID NO: 992974 - protein, 9 aa, Homo Sapiens
DTIKDLFRV

SEQ ID NO: 992975 - protein, 9 aa, Homo Sapiens
GFSGERGLP

SEQ ID NO: 992976 - protein, 9 aa, Homo Sapiens
HAKQKSVIF

SEQ ID NO: 992977 - protein, 9 aa, Homo Sapiens
RSNLFWDTG

SEQ ID NO: 992978 - protein, 9 aa, Homo Sapiens
CSLRFSSGI

SEQ ID NO: 992979 - protein, 9 aa, Homo Sapiens
QVEEIEEEE

SEQ ID NO: 992980 - protein, 9 aa, Homo Sapiens
SYVVDIFTP

SEQ ID NO: 992981 - protein, 9 aa, Homo Sapiens
DPDQWLSED

SEQ ID NO: 992982 - protein, 9 aa, Homo Sapiens
PLGITAFYL

SEQ ID NO: 992983 - protein, 9 aa, Homo Sapiens
LLCSSGSSC

SEQ ID NO: 992984 - protein, 9 aa, Homo Sapiens
ALAMGANRG

SEQ ID NO: 992985 - protein, 9 aa, Homo Sapiens
GPRDLEHEC

SEQ ID NO: 992986 - protein, 9 aa, Homo Sapiens
QEDSSLHSN

SEQ ID NO: 992987 - protein, 9 aa, Homo Sapiens
NKKAKISID

SEQ ID NO: 992988 - protein, 9 aa, Homo Sapiens
PGPGGAGTA

SEQ ID NO: 992989 - protein, 9 aa, Homo Sapiens
EFVVEVNTT

SEQ ID NO: 992990 - protein, 9 aa, Homo Sapiens
ESVTIKAQE

SEQ ID NO: 992991 - protein, 9 aa, Homo Sapiens
LLSKLNDII

SEQ ID NO: 992992 - protein, 9 aa, Homo Sapiens
CTRSVIVRL

SEQ ID NO: 992993 - protein, 9 aa, Homo Sapiens
VCQINLTTF

SEQ ID NO: 992994 - protein, 9 aa, Homo Sapiens
KNLTFNFSA

SEQ ID NO: 992995 - protein, 9 aa, Homo Sapiens
AGTAPLGTL

SEQ ID NO: 992996 - protein, 9 aa, Homo Sapiens
VNAIFPVAI

SEQ ID NO: 992997 - protein, 9 aa, Homo Sapiens
SWPFGALLC

SEQ ID NO: 992998 - protein, 9 aa, Homo Sapiens
VSPGKKLWG

SEQ ID NO: 992999 - protein, 9 aa, Homo Sapiens
GLQCDQHRL

SEQ ID NO: 993000 - protein, 9 aa, Homo Sapiens
EIKSLMKDG

SEQ ID NO: 993001 - protein, 9 aa, Homo Sapiens
CLHWEDHGL

SEQ ID NO: 993002 - protein, 9 aa, Homo Sapiens
EPGPGGAGT

SEQ ID NO: 993003 - protein, 9 aa, Homo Sapiens
SDQETGEQE

SEQ ID NO: 993004 - protein, 9 aa, Homo Sapiens
PVVQLSKKK

SEQ ID NO: 993005 - protein, 9 aa, Homo Sapiens
AALLKLSCL

SEQ ID NO: 993006 - protein, 9 aa, Homo Sapiens
MKAMVSLLQ

SEQ ID NO: 993007 - protein, 9 aa, Homo Sapiens
TFEGFPQFP

SEQ ID NO: 993008 - protein, 9 aa, Homo Sapiens
TRFILIGET

SEQ ID NO: 993009 - protein, 9 aa, Homo Sapiens
GDPQNSTGE

SEQ ID NO: 993010 - protein, 9 aa, Homo Sapiens
ALGTEEGKR

SEQ ID NO: 993011 - protein, 9 aa, Homo Sapiens
EKARQREQK

SEQ ID NO: 993012 - protein, 9 aa, Homo Sapiens
DPFTLALLQ

SEQ ID NO: 993013 - protein, 9 aa, Homo Sapiens
ENSWKPNKV

SEQ ID NO: 993014 - protein, 9 aa, Homo Sapiens
LRIKMKASD

SEQ ID NO: 993015 - protein, 9 aa, Homo Sapiens
VRNLYLARH

SEQ ID NO: 993016 - protein, 9 aa, Homo Sapiens
YGHKCKYYY

SEQ ID NO: 993017 - protein, 9 aa, Homo Sapiens
ELMVSEFVL

SEQ ID NO: 993018 - protein, 9 aa, Homo Sapiens
RVAESMASD

SEQ ID NO: 993019 - protein, 9 aa, Homo Sapiens
RVRKAENSQ

SEQ ID NO: 993020 - protein, 9 aa, Homo Sapiens
QCVEKNTLE

SEQ ID NO: 993021 - protein, 9 aa, Homo Sapiens
SCSSLEINV

SEQ ID NO: 993022 - protein, 9 aa, Homo Sapiens
GGGWTSRAL

SEQ ID NO: 993023 - protein, 9 aa, Homo Sapiens
ICSPPVGPP

SEQ ID NO: 993024 - protein, 9 aa, Homo Sapiens
RKAENSQCL

SEQ ID NO: 993025 - protein, 9 aa, Homo Sapiens
ENIWNQFSW

SEQ ID NO: 993026 - protein, 9 aa, Homo Sapiens
DISIYADKD

SEQ ID NO: 993027 - protein, 9 aa, Homo Sapiens
QREQKEQEL

SEQ ID NO: 993028 - protein, 9 aa, Homo Sapiens
KDKKKDKKD

SEQ ID NO: 993029 - protein, 9 aa, Homo Sapiens
ATEKSRWSG

SEQ ID NO: 993030 - protein, 9 aa, Homo Sapiens
KVLLSPSIP

SEQ ID NO: 993031 - protein, 9 aa, Homo Sapiens
LRQPAPFSN

SEQ ID NO: 993032 - protein, 9 aa, Homo Sapiens
SVIAMIDVE

SEQ ID NO: 993033 - protein, 9 aa, Homo Sapiens
FANLSSIRI

SEQ ID NO: 993034 - protein, 9 aa, Homo Sapiens
LRGFSGERG

SEQ ID NO: 993035 - protein, 9 aa, Homo Sapiens
IHMRKHTGK

SEQ ID NO: 993036 - protein, 9 aa, Homo Sapiens
LAFIGIISV

SEQ ID NO: 993037 - protein, 9 aa, Homo Sapiens
RENKNLTST

SEQ ID NO: 993038 - protein, 9 aa, Homo Sapiens
ECSDQRPAE

SEQ ID NO: 993039 - protein, 9 aa, Homo Sapiens
DVQKKVFFR

SEQ ID NO: 993040 - protein, 9 aa, Homo Sapiens
PLVDTKWRH

SEQ ID NO: 993041 - protein, 9 aa, Homo Sapiens
RPSRKNKKA

SEQ ID NO: 993042 - protein, 9 aa, Homo Sapiens
AVVAQLQAL

SEQ ID NO: 993043 - protein, 9 aa, Homo Sapiens
VWRAQPTER

SEQ ID NO: 993044 - protein, 9 aa, Homo Sapiens
LLAHEAQEE

SEQ ID NO: 993045 - protein, 9 aa, Homo Sapiens
NLERNQFSF

SEQ ID NO: 993046 - protein, 9 aa, Homo Sapiens
RITSIEISA

SEQ ID NO: 993047 - protein, 9 aa, Homo Sapiens
FYLDTAKMM

SEQ ID NO: 993048 - protein, 9 aa, Homo Sapiens
TKNWEQKYG

SEQ ID NO: 993049 - protein, 9 aa, Homo Sapiens
LSFCGPNEL

SEQ ID NO: 993050 - protein, 9 aa, Homo Sapiens
INFGYNLQA

SEQ ID NO: 993051 - protein, 9 aa, Homo Sapiens
VKSWVKGWE

SEQ ID NO: 993052 - protein, 9 aa, Homo Sapiens
HRHSFLALY

SEQ ID NO: 993053 - protein, 9 aa, Homo Sapiens
EKEYPLGRV

SEQ ID NO: 993054 - protein, 9 aa, Homo Sapiens
STSQSSERT

SEQ ID NO: 993055 - protein, 9 aa, Homo Sapiens
CAYTTPGPL

SEQ ID NO: 993056 - protein, 9 aa, Homo Sapiens
EEKDEEEEK

SEQ ID NO: 993057 - protein, 9 aa, Homo Sapiens
SHSDTTSPT

SEQ ID NO: 993058 - protein, 9 aa, Homo Sapiens
PSECSDQRP

SEQ ID NO: 993059 - protein, 9 aa, Homo Sapiens
LFPLRWSTS

SEQ ID NO: 993060 - protein, 9 aa, Homo Sapiens
KELCILKRS

SEQ ID NO: 993061 - protein, 9 aa, Homo Sapiens
SECQCVEKN

SEQ ID NO: 993062 - protein, 9 aa, Homo Sapiens
SFQETDKLA

SEQ ID NO: 993063 - protein, 9 aa, Homo Sapiens
STQTPPPPS

SEQ ID NO: 993064 - protein, 9 aa, Homo Sapiens
PKIKVPKFS

SEQ ID NO: 993065 - protein, 9 aa, Homo Sapiens
GSVQYLVNR

SEQ ID NO: 993066 - protein, 9 aa, Homo Sapiens
NGKTVRLSS

SEQ ID NO: 993067 - protein, 9 aa, Homo Sapiens
CLDIFLNEL

SEQ ID NO: 993068 - protein, 9 aa, Homo Sapiens
KILCNGPSI

SEQ ID NO: 993069 - protein, 9 aa, Homo Sapiens
PPPAVVAQL

SEQ ID NO: 993070 - protein, 9 aa, Homo Sapiens
RISSLAELE

SEQ ID NO: 993071 - protein, 9 aa, Homo Sapiens
IDVEAGTQE

SEQ ID NO: 993072 - protein, 9 aa, Homo Sapiens
FELTMSCSS

SEQ ID NO: 993073 - protein, 9 aa, Homo Sapiens
QPAPFSNEI

SEQ ID NO: 993074 - protein, 9 aa, Homo Sapiens
ECNYRGRVT

SEQ ID NO: 993075 - protein, 9 aa, Homo Sapiens
AGAWGLAPG

SEQ ID NO: 993076 - protein, 9 aa, Homo Sapiens
VMQEEILGP

SEQ ID NO: 993077 - protein, 9 aa, Homo Sapiens
IIAEYISGY

SEQ ID NO: 993078 - protein, 9 aa, Homo Sapiens
FVFSEVESQ

SEQ ID NO: 993079 - protein, 9 aa, Homo Sapiens
WFFPFIEAL

SEQ ID NO: 993080 - protein, 9 aa, Homo Sapiens
DQLLAHEAQ

SEQ ID NO: 993081 - protein, 9 aa, Homo Sapiens
LSKKKVQKK

SEQ ID NO: 993082 - protein, 9 aa, Homo Sapiens
AATHKPTYQ

SEQ ID NO: 993083 - protein, 9 aa, Homo Sapiens
LKLLADVQF

SEQ ID NO: 993084 - protein, 9 aa, Homo Sapiens
LISFGFVII

SEQ ID NO: 993085 - protein, 9 aa, Homo Sapiens
DARISSLAE

SEQ ID NO: 993086 - protein, 9 aa, Homo Sapiens
HGQLISFKG

SEQ ID NO: 993087 - protein, 9 aa, Homo Sapiens
DFIEGEADD

SEQ ID NO: 993088 - protein, 9 aa, Homo Sapiens
QEKEYPLGR

SEQ ID NO: 993089 - protein, 9 aa, Homo Sapiens
DIFTPLVDT

SEQ ID NO: 993090 - protein, 9 aa, Homo Sapiens
QKQDPLNET

SEQ ID NO: 993091 - protein, 9 aa, Homo Sapiens
KLNVPKIKV

SEQ ID NO: 993092 - protein, 9 aa, Homo Sapiens
PQAQQGCFC

SEQ ID NO: 993093 - protein, 9 aa, Homo Sapiens
EHRHSFLAL

SEQ ID NO: 993094 - protein, 9 aa, Homo Sapiens
ALRKKLPLS

SEQ ID NO: 993095 - protein, 9 aa, Homo Sapiens
PRILASWRR

SEQ ID NO: 993096 - protein, 9 aa, Homo Sapiens
PQFPLQIPV

SEQ ID NO: 993097 - protein, 9 aa, Homo Sapiens
APRILASWR

SEQ ID NO: 993098 - protein, 9 aa, Homo Sapiens
RNLYLARHT

SEQ ID NO: 993099 - protein, 9 aa, Homo Sapiens
IEGEADDSI

SEQ ID NO: 993100 - protein, 9 aa, Homo Sapiens
EVASGYLKG

SEQ ID NO: 993101 - protein, 9 aa, Homo Sapiens
EEEEEKDEE

SEQ ID NO: 993102 - protein, 9 aa, Homo Sapiens
ACMDNMLLS

SEQ ID NO: 993103 - protein, 9 aa, Homo Sapiens
NRPEPISDQ

SEQ ID NO: 993104 - protein, 9 aa, Homo Sapiens
PPASPTPLS

SEQ ID NO: 993105 - protein, 9 aa, Homo Sapiens
PAKELPLLR

SEQ ID NO: 993106 - protein, 9 aa, Homo Sapiens
KDLFRVVPG

SEQ ID NO: 993107 - protein, 9 aa, Homo Sapiens
HYEFLVVDD

SEQ ID NO: 993108 - protein, 9 aa, Homo Sapiens
RGRVTDDWD

SEQ ID NO: 993109 - protein, 9 aa, Homo Sapiens
RMVCNNGEC

SEQ ID NO: 993110 - protein, 9 aa, Homo Sapiens
SSLAELETI

SEQ ID NO: 993111 - protein, 9 aa, Homo Sapiens
TTVNSTITH

SEQ ID NO: 993112 - protein, 9 aa, Homo Sapiens
QHRLPPGMG

SEQ ID NO: 993113 - protein, 9 aa, Homo Sapiens
GCFIFLISF

SEQ ID NO: 993114 - protein, 9 aa, Homo Sapiens
WSPSLTLLL

SEQ ID NO: 993115 - protein, 9 aa, Homo Sapiens
PNHVLKESK

SEQ ID NO: 993116 - protein, 9 aa, Homo Sapiens
ESMASDPRT

SEQ ID NO: 993117 - protein, 9 aa, Homo Sapiens
SIRTIKGPH

SEQ ID NO: 993118 - protein, 9 aa, Homo Sapiens
CWQKLPPFC

SEQ ID NO: 993119 - protein, 9 aa, Homo Sapiens
FVLFACMDN

SEQ ID NO: 993120 - protein, 9 aa, Homo Sapiens
STLSLTQTP

SEQ ID NO: 993121 - protein, 9 aa, Homo Sapiens
VCEFVFSEV

SEQ ID NO: 993122 - protein, 9 aa, Homo Sapiens
LSEDGSFIG

SEQ ID NO: 993123 - protein, 9 aa, Homo Sapiens
NCMVARQPQ

SEQ ID NO: 993124 - protein, 9 aa, Homo Sapiens
SVCEFVFSE

SEQ ID NO: 993125 - protein, 9 aa, Homo Sapiens
VLWEETFDR

SEQ ID NO: 993126 - protein, 9 aa, Homo Sapiens
RITLGGLTS

SEQ ID NO: 993127 - protein, 9 aa, Homo Sapiens
KPSTLVPNC

SEQ ID NO: 993128 - protein, 9 aa, Homo Sapiens
EAARARLDL

SEQ ID NO: 993129 - protein, 9 aa, Homo Sapiens
KYFDLDVKT

SEQ ID NO: 993130 - protein, 9 aa, Homo Sapiens
SHPSQGLAE

SEQ ID NO: 993131 - protein, 9 aa, Homo Sapiens
AYTLTENRV

SEQ ID NO: 993132 - protein, 9 aa, Homo Sapiens
RRISIGFLF

SEQ ID NO: 993133 - protein, 9 aa, Homo Sapiens
FLISFGFVI

SEQ ID NO: 993134 - protein, 9 aa, Homo Sapiens
INLTTFDFI

SEQ ID NO: 993135 - protein, 9 aa, Homo Sapiens
HAPVLLCSS

SEQ ID NO: 993136 - protein, 9 aa, Homo Sapiens
GQERVALGS

SEQ ID NO: 993137 - protein, 9 aa, Homo Sapiens
GAPHSDYIN

SEQ ID NO: 993138 - protein, 9 aa, Homo Sapiens
PQYILKEFK

SEQ ID NO: 993139 - protein, 9 aa, Homo Sapiens
AADAFLSKF

SEQ ID NO: 993140 - protein, 9 aa, Homo Sapiens
EGGTGKYSP

SEQ ID NO: 993141 - protein, 9 aa, Homo Sapiens
CMDNMLLSV

SEQ ID NO: 993142 - protein, 9 aa, Homo Sapiens
IKPFCEDPD

SEQ ID NO: 993143 - protein, 9 aa, Homo Sapiens
EDPDQWLSE

SEQ ID NO: 993144 - protein, 9 aa, Homo Sapiens
AAVGPLVRA

SEQ ID NO: 993145 - protein, 9 aa, Homo Sapiens
ATHKPTYQG

SEQ ID NO: 993146 - protein, 9 aa, Homo Sapiens
LCNGPSINA

SEQ ID NO: 993147 - protein, 9 aa, Homo Sapiens
NNAQSIRTI

SEQ ID NO: 993148 - protein, 9 aa, Homo Sapiens
KLNDIIKNS

SEQ ID NO: 993149 - protein, 9 aa, Homo Sapiens
GFANLSSIR

SEQ ID NO: 993150 - protein, 9 aa, Homo Sapiens
NKYFDLDVK

SEQ ID NO: 993151 - protein, 9 aa, Homo Sapiens
GAKNSELVL

SEQ ID NO: 993152 - protein, 9 aa, Homo Sapiens
RTGVSFTFF

SEQ ID NO: 993153 - protein, 9 aa, Homo Sapiens
IFSDTSSNK

SEQ ID NO: 993154 - protein, 9 aa, Homo Sapiens
DGAKNSELV

SEQ ID NO: 993155 - protein, 9 aa, Homo Sapiens
LGHTPEAMQ

SEQ ID NO: 993156 - protein, 9 aa, Homo Sapiens
GQLISFKGC

SEQ ID NO: 993157 - protein, 9 aa, Homo Sapiens
SNEIEVDFS

SEQ ID NO: 993158 - protein, 9 aa, Homo Sapiens
AERELKRWQ

SEQ ID NO: 993159 - protein, 9 aa, Homo Sapiens
LDDPEKGMI

SEQ ID NO: 993160 - protein, 9 aa, Homo Sapiens
DSYIVITAM

SEQ ID NO: 993161 - protein, 9 aa, Homo Sapiens
KEFMNDSYI

SEQ ID NO: 993162 - protein, 9 aa, Homo Sapiens
DEPGDKDEE

SEQ ID NO: 993163 - protein, 9 aa, Homo Sapiens
KKVFFRRHY

SEQ ID NO: 993164 - protein, 9 aa, Homo Sapiens
AAYFYLDTA

SEQ ID NO: 993165 - protein, 9 aa, Homo Sapiens
QKEQELTQA

SEQ ID NO: 993166 - protein, 9 aa, Homo Sapiens
PVLLCSSGS

SEQ ID NO: 993167 - protein, 9 aa, Homo Sapiens
AAARNGFLP

SEQ ID NO: 993168 - protein, 9 aa, Homo Sapiens
DIIKNSDKN

SEQ ID NO: 993169 - protein, 9 aa, Homo Sapiens
FAAAYFYLD

SEQ ID NO: 993170 - protein, 9 aa, Homo Sapiens
FIRILSREP

SEQ ID NO: 993171 - protein, 9 aa, Homo Sapiens
QYILKEFKV

SEQ ID NO: 993172 - protein, 9 aa, Homo Sapiens
DLANCRTNE

SEQ ID NO: 993173 - protein, 9 aa, Homo Sapiens
APFSNEIEV

SEQ ID NO: 993174 - protein, 9 aa, Homo Sapiens
LLNKLKNKW

SEQ ID NO: 993175 - protein, 9 aa, Homo Sapiens
IMQVEEIEE

SEQ ID NO: 993176 - protein, 9 aa, Homo Sapiens
ILCNGPSIN

SEQ ID NO: 993177 - protein, 9 aa, Homo Sapiens
VGPPGGNGH

SEQ ID NO: 993178 - protein, 9 aa, Homo Sapiens
LNCMVARQP

SEQ ID NO: 993179 - protein, 9 aa, Homo Sapiens
SFPGLFSSG

SEQ ID NO: 993180 - protein, 9 aa, Homo Sapiens
LGAGTSTSQ

SEQ ID NO: 993181 - protein, 9 aa, Homo Sapiens
MILDIRFSP

SEQ ID NO: 993182 - protein, 9 aa, Homo Sapiens
TVSPPGLDG

SEQ ID NO: 993183 - protein, 9 aa, Homo Sapiens
KLLADVQFA

SEQ ID NO: 993184 - protein, 9 aa, Homo Sapiens
LHWEDHGLQ

SEQ ID NO: 993185 - protein, 9 aa, Homo Sapiens
RRGHYEFLV

SEQ ID NO: 993186 - protein, 9 aa, Homo Sapiens
SFAKHQKIH

SEQ ID NO: 993187 - protein, 9 aa, Homo Sapiens
GDNYAPDSI

SEQ ID NO: 993188 - protein, 9 aa, Homo Sapiens
HLGEITYLF

SEQ ID NO: 993189 - protein, 9 aa, Homo Sapiens
DAVCTRSVI

SEQ ID NO: 993190 - protein, 9 aa, Homo Sapiens
NYLIGNPET

SEQ ID NO: 993191 - protein, 9 aa, Homo Sapiens
RYVESQRHI

SEQ ID NO: 993192 - protein, 9 aa, Homo Sapiens
RDLEHECDT

SEQ ID NO: 993193 - protein, 9 aa, Homo Sapiens
MSALYCWNL

SEQ ID NO: 993194 - protein, 9 aa, Homo Sapiens
VFYRGRFFR

SEQ ID NO: 993195 - protein, 9 aa, Homo Sapiens
NRHRIQRIT

SEQ ID NO: 993196 - protein, 9 aa, Homo Sapiens
IKVLQRNCA

SEQ ID NO: 993197 - protein, 9 aa, Homo Sapiens
ALEASPKWP

SEQ ID NO: 993198 - protein, 9 aa, Homo Sapiens
LSKLNDIIK

SEQ ID NO: 993199 - protein, 9 aa, Homo Sapiens
KNRLLHLCL

SEQ ID NO: 993200 - protein, 9 aa, Homo Sapiens
TKFELTMSC

SEQ ID NO: 993201 - protein, 9 aa, Homo Sapiens
EGEADDSIT

SEQ ID NO: 993202 - protein, 9 aa, Homo Sapiens
PHANDFVGG

SEQ ID NO: 993203 - protein, 9 aa, Homo Sapiens
KAFVRNLYL

SEQ ID NO: 993204 - protein, 9 aa, Homo Sapiens
VCRRLNYIT

SEQ ID NO: 993205 - protein, 9 aa, Homo Sapiens
SLTLLLMSG

SEQ ID NO: 993206 - protein, 9 aa, Homo Sapiens
PNLLPLVPS

SEQ ID NO: 993207 - protein, 9 aa, Homo Sapiens
PFCEDPDQW

SEQ ID NO: 993208 - protein, 9 aa, Homo Sapiens
ITYLFACRK

SEQ ID NO: 993209 - protein, 9 aa, Homo Sapiens
GSLKLLADV

SEQ ID NO: 993210 - protein, 9 aa, Homo Sapiens
QQGCFCGSS

SEQ ID NO: 993211 - protein, 9 aa, Homo Sapiens
TALAMGANR

SEQ ID NO: 993212 - protein, 9 aa, Homo Sapiens
LLDEFAVLC

SEQ ID NO: 993213 - protein, 9 aa, Homo Sapiens
VAYTLTENR

SEQ ID NO: 993214 - protein, 9 aa, Homo Sapiens
QFSWPFGAL

SEQ ID NO: 993215 - protein, 9 aa, Homo Sapiens
TVGAGAWGL

SEQ ID NO: 993216 - protein, 9 aa, Homo Sapiens
KKLHKELCI

SEQ ID NO: 993217 - protein, 9 aa, Homo Sapiens
KGPGRAESK

SEQ ID NO: 993218 - protein, 9 aa, Homo Sapiens
EMYKGSHVP

SEQ ID NO: 993219 - protein, 9 aa, Homo Sapiens
PLSPPPPPS

SEQ ID NO: 993220 - protein, 9 aa, Homo Sapiens
HGGGWGPSF

SEQ ID NO: 993221 - protein, 9 aa, Homo Sapiens
LLFHSAKVQ

SEQ ID NO: 993222 - protein, 9 aa, Homo Sapiens
LLVLDGAPH

SEQ ID NO: 993223 - protein, 9 aa, Homo Sapiens
FPGFKLDGY

SEQ ID NO: 993224 - protein, 9 aa, Homo Sapiens
DAYSGDHNR

SEQ ID NO: 993225 - protein, 9 aa, Homo Sapiens
KIGAREAQH

SEQ ID NO: 993226 - protein, 9 aa, Homo Sapiens
QSCNKTFST

SEQ ID NO: 993227 - protein, 9 aa, Homo Sapiens
EQKRDSWTL

SEQ ID NO: 993228 - protein, 9 aa, Homo Sapiens
SPVKTLSDA

SEQ ID NO: 993229 - protein, 9 aa, Homo Sapiens
YVKSWVKGW

SEQ ID NO: 993230 - protein, 9 aa, Homo Sapiens
IARYLILIT

SEQ ID NO: 993231 - protein, 9 aa, Homo Sapiens
IIQGDYIDT

SEQ ID NO: 993232 - protein, 9 aa, Homo Sapiens
WGAFGDNGS

SEQ ID NO: 993233 - protein, 9 aa, Homo Sapiens
RDQVTDTCQ

SEQ ID NO: 993234 - protein, 9 aa, Homo Sapiens
SEAARARLD

SEQ ID NO: 993235 - protein, 9 aa, Homo Sapiens
EQGLLNKLK

SEQ ID NO: 993236 - protein, 9 aa, Homo Sapiens
AHADTEETG

SEQ ID NO: 993237 - protein, 9 aa, Homo Sapiens
LFKILCNGP

SEQ ID NO: 993238 - protein, 9 aa, Homo Sapiens
TTRFILIGE

SEQ ID NO: 993239 - protein, 9 aa, Homo Sapiens
RGNGKTVRL

SEQ ID NO: 993240 - protein, 9 aa, Homo Sapiens
KVQEKEYPL

SEQ ID NO: 993241 - protein, 9 aa, Homo Sapiens
LSERLENEE

SEQ ID NO: 993242 - protein, 9 aa, Homo Sapiens
LRWSTSIPS

SEQ ID NO: 993243 - protein, 9 aa, Homo Sapiens
LLSSLVLLV

SEQ ID NO: 993244 - protein, 9 aa, Homo Sapiens
PAYREWFTF

SEQ ID NO: 993245 - protein, 9 aa, Homo Sapiens
KSWVKGWEH

SEQ ID NO: 993246 - protein, 9 aa, Homo Sapiens
GMGGGSCYG

SEQ ID NO: 993247 - protein, 9 aa, Homo Sapiens
LTGECNYRG

SEQ ID NO: 993248 - protein, 9 aa, Homo Sapiens
YVESQRHII

SEQ ID NO: 993249 - protein, 9 aa, Homo Sapiens
LRKGGAWAP

SEQ ID NO: 993250 - protein, 9 aa, Homo Sapiens
DEEIKSLMK

SEQ ID NO: 993251 - protein, 9 aa, Homo Sapiens
QVALIVRLS

SEQ ID NO: 993252 - protein, 9 aa, Homo Sapiens
LFACRKSNC

SEQ ID NO: 993253 - protein, 9 aa, Homo Sapiens
SEALAGLID

SEQ ID NO: 993254 - protein, 9 aa, Homo Sapiens
ASFIAGYVF

SEQ ID NO: 993255 - protein, 9 aa, Homo Sapiens
KGWEHDKQE

SEQ ID NO: 993256 - protein, 9 aa, Homo Sapiens
RLDLLQLKK

SEQ ID NO: 993257 - protein, 9 aa, Homo Sapiens
EETGAPSAD

SEQ ID NO: 993258 - protein, 9 aa, Homo Sapiens
ERVALGSFV

SEQ ID NO: 993259 - protein, 9 aa, Homo Sapiens
FEDSSSSSS

SEQ ID NO: 993260 - protein, 9 aa, Homo Sapiens
EEAERELKR

SEQ ID NO: 993261 - protein, 9 aa, Homo Sapiens
ISDQQLNIL

SEQ ID NO: 993262 - protein, 9 aa, Homo Sapiens
SMLASGLHM

SEQ ID NO: 993263 - protein, 9 aa, Homo Sapiens
DTRVRQEPL

SEQ ID NO: 993264 - protein, 9 aa, Homo Sapiens
MGKFSIRLV

SEQ ID NO: 993265 - protein, 9 aa, Homo Sapiens
PRDLEHECD

SEQ ID NO: 993266 - protein, 9 aa, Homo Sapiens
EQESSPSSH

SEQ ID NO: 993267 - protein, 9 aa, Homo Sapiens
GNWFFPFIE

SEQ ID NO: 993268 - protein, 9 aa, Homo Sapiens
FGIMQVEEI

SEQ ID NO: 993269 - protein, 9 aa, Homo Sapiens
LHCGQLTDG

SEQ ID NO: 993270 - protein, 9 aa, Homo Sapiens
LPNGNFKPG

SEQ ID NO: 993271 - protein, 9 aa, Homo Sapiens
EDHGLQCDQ

SEQ ID NO: 993272 - protein, 9 aa, Homo Sapiens
KLPPFCEVG

SEQ ID NO: 993273 - protein, 9 aa, Homo Sapiens
EASIIAEYI

SEQ ID NO: 993274 - protein, 9 aa, Homo Sapiens
ARISSLAEL

SEQ ID NO: 993275 - protein, 9 aa, Homo Sapiens
VFFQITLTR

SEQ ID NO: 993276 - protein, 9 aa, Homo Sapiens
PSLTLLLMS

SEQ ID NO: 993277 - protein, 9 aa, Homo Sapiens
KRQQQLTAI

SEQ ID NO: 993278 - protein, 9 aa, Homo Sapiens
NPKQSCNKT

SEQ ID NO: 993279 - protein, 9 aa, Homo Sapiens
TQEAELLLL

SEQ ID NO: 993280 - protein, 9 aa, Homo Sapiens
GGCSMGSRA

SEQ ID NO: 993281 - protein, 9 aa, Homo Sapiens
LASGLHMQL

SEQ ID NO: 993282 - protein, 9 aa, Homo Sapiens
VIEMYKGSH

SEQ ID NO: 993283 - protein, 9 aa, Homo Sapiens
PSQGLAEAP

SEQ ID NO: 993284 - protein, 9 aa, Homo Sapiens
LSDAGNSPI

SEQ ID NO: 993285 - protein, 9 aa, Homo Sapiens
RQPAPFSNE

SEQ ID NO: 993286 - protein, 9 aa, Homo Sapiens
QPTEKKVDC

SEQ ID NO: 993287 - protein, 9 aa, Homo Sapiens
IKDLFRVVP

SEQ ID NO: 993288 - protein, 9 aa, Homo Sapiens
GYLKGMAKK

SEQ ID NO: 993289 - protein, 9 aa, Homo Sapiens
STFEGFPQF

SEQ ID NO: 993290 - protein, 9 aa, Homo Sapiens
SMLEQKRDS

SEQ ID NO: 993291 - protein, 9 aa, Homo Sapiens
KLLMDQLLA

SEQ ID NO: 993292 - protein, 9 aa, Homo Sapiens
MYLQQPKAE

SEQ ID NO: 993293 - protein, 9 aa, Homo Sapiens
LFHSAKVQP

SEQ ID NO: 993294 - protein, 9 aa, Homo Sapiens
TRESVTIKA

SEQ ID NO: 993295 - protein, 9 aa, Homo Sapiens
DEVAYTLTE

SEQ ID NO: 993296 - protein, 9 aa, Homo Sapiens
ISIGFLFRR

SEQ ID NO: 993297 - protein, 9 aa, Homo Sapiens
ALIVRLSFC

SEQ ID NO: 993298 - protein, 9 aa, Homo Sapiens
PFCEVGARL

SEQ ID NO: 993299 - protein, 9 aa, Homo Sapiens
IAGYVFFQI

SEQ ID NO: 993300 - protein, 9 aa, Homo Sapiens
TAPLGTLRA

SEQ ID NO: 993301 - protein, 9 aa, Homo Sapiens
RWRPSRKNK

SEQ ID NO: 993302 - protein, 9 aa, Homo Sapiens
VAHSVLENV

SEQ ID NO: 993303 - protein, 9 aa, Homo Sapiens
EILGPILPI

SEQ ID NO: 993304 - protein, 9 aa, Homo Sapiens
YTTPGPLRA

SEQ ID NO: 993305 - protein, 9 aa, Homo Sapiens
GDFSVIAMI

SEQ ID NO: 993306 - protein, 9 aa, Homo Sapiens
MNGSCVIRC

SEQ ID NO: 993307 - protein, 9 aa, Homo Sapiens
PTERCLKNA

SEQ ID NO: 993308 - protein, 9 aa, Homo Sapiens
GEIHNWIEL

SEQ ID NO: 993309 - protein, 9 aa, Homo Sapiens
RKHKRKPLE

SEQ ID NO: 993310 - protein, 9 aa, Homo Sapiens
SPPVKVQEK

SEQ ID NO: 993311 - protein, 9 aa, Homo Sapiens
FIAGYVFFQ

SEQ ID NO: 993312 - protein, 9 aa, Homo Sapiens
YLHPEDCSL

SEQ ID NO: 993313 - protein, 9 aa, Homo Sapiens
LEQEEEEQA

SEQ ID NO: 993314 - protein, 9 aa, Homo Sapiens
SIRITLGGL

SEQ ID NO: 993315 - protein, 9 aa, Homo Sapiens
APVARQLAL

SEQ ID NO: 993316 - protein, 9 aa, Homo Sapiens
AENIWNQFS

SEQ ID NO: 993317 - protein, 9 aa, Homo Sapiens
FKQYILILS

SEQ ID NO: 993318 - protein, 9 aa, Homo Sapiens
SGDHNRSSN

SEQ ID NO: 993319 - protein, 9 aa, Homo Sapiens
DHNRSSNSY

SEQ ID NO: 993320 - protein, 9 aa, Homo Sapiens
ECDTVGAGA

SEQ ID NO: 993321 - protein, 9 aa, Homo Sapiens
SLKEASIIA

SEQ ID NO: 993322 - protein, 9 aa, Homo Sapiens
NDTIKDLFR

SEQ ID NO: 993323 - protein, 9 aa, Homo Sapiens
MKRVLQERA

SEQ ID NO: 993324 - protein, 9 aa, Homo Sapiens
AILWACPGL

SEQ ID NO: 993325 - protein, 9 aa, Homo Sapiens
SQHVAVFYR

SEQ ID NO: 993326 - protein, 9 aa, Homo Sapiens
KARQREQKE

SEQ ID NO: 993327 - protein, 9 aa, Homo Sapiens
CPNLLPLVP

SEQ ID NO: 993328 - protein, 9 aa, Homo Sapiens
IKLLSSLVL

SEQ ID NO: 993329 - protein, 9 aa, Homo Sapiens
TPEAMQIAT

SEQ ID NO: 993330 - protein, 9 aa, Homo Sapiens
IGPCHVISS

SEQ ID NO: 993331 - protein, 9 aa, Homo Sapiens
FKILCNGPS

SEQ ID NO: 993332 - protein, 9 aa, Homo Sapiens
AFIGIISVH

SEQ ID NO: 993333 - protein, 9 aa, Homo Sapiens
ETGNWFFPF

SEQ ID NO: 993334 - protein, 9 aa, Homo Sapiens
YREWFTFAV

SEQ ID NO: 993335 - protein, 9 aa, Homo Sapiens
FYGNPMHVA

SEQ ID NO: 993336 - protein, 9 aa, Homo Sapiens
LQKTEMVGK

SEQ ID NO: 993337 - protein, 9 aa, Homo Sapiens
PPVGPPGGN

SEQ ID NO: 993338 - protein, 9 aa, Homo Sapiens
VDLANCRTN

SEQ ID NO: 993339 - protein, 9 aa, Homo Sapiens
NSTITHPSE

SEQ ID NO: 993340 - protein, 9 aa, Homo Sapiens
ITREDMSSL

SEQ ID NO: 993341 - protein, 9 aa, Homo Sapiens
VQLSKKKVQ

SEQ ID NO: 993342 - protein, 9 aa, Homo Sapiens
FKLDGYAYL

SEQ ID NO: 993343 - protein, 9 aa, Homo Sapiens
EPVMQEEIL

SEQ ID NO: 993344 - protein, 9 aa, Homo Sapiens
CVYRSGFFF

SEQ ID NO: 993345 - protein, 9 aa, Homo Sapiens
KEQELLRLI

SEQ ID NO: 993346 - protein, 9 aa, Homo Sapiens
RKNKKAKIS

SEQ ID NO: 993347 - protein, 9 aa, Homo Sapiens
YILKEFKVT

SEQ ID NO: 993348 - protein, 9 aa, Homo Sapiens
IMKAMVSLL

SEQ ID NO: 993349 - protein, 9 aa, Homo Sapiens
ANRGIHVEV

SEQ ID NO: 993350 - protein, 9 aa, Homo Sapiens
KYVLEKENP

SEQ ID NO: 993351 - protein, 9 aa, Homo Sapiens
DYESGCKIW

SEQ ID NO: 993352 - protein, 9 aa, Homo Sapiens
IKENIPENV

SEQ ID NO: 993353 - protein, 9 aa, Homo Sapiens
VILNNPYSE

SEQ ID NO: 993354 - protein, 9 aa, Homo Sapiens
AGMPNPTPP

SEQ ID NO: 993355 - protein, 9 aa, Homo Sapiens
RPFYRHIIY

SEQ ID NO: 993356 - protein, 9 aa, Homo Sapiens
GGHVGDSAL

SEQ ID NO: 993357 - protein, 9 aa, Homo Sapiens
CFEANNRYD

SEQ ID NO: 993358 - protein, 9 aa, Homo Sapiens
AHPLERSQL

SEQ ID NO: 993359 - protein, 9 aa, Homo Sapiens
ALNNVLQQP

SEQ ID NO: 993360 - protein, 9 aa, Homo Sapiens
LVERDYESG

SEQ ID NO: 993361 - protein, 9 aa, Homo Sapiens
GTHSPSYLR

SEQ ID NO: 993362 - protein, 9 aa, Homo Sapiens
LSRVEGLLP

SEQ ID NO: 993363 - protein, 9 aa, Homo Sapiens
ERGSDLVMV

SEQ ID NO: 993364 - protein, 9 aa, Homo Sapiens
VQTMGARAL

SEQ ID NO: 993365 - protein, 9 aa, Homo Sapiens
ESSGVRHVC

SEQ ID NO: 993366 - protein, 9 aa, Homo Sapiens
ALAIYTAVT

SEQ ID NO: 993367 - protein, 9 aa, Homo Sapiens
RNGELPDRE

SEQ ID NO: 993368 - protein, 9 aa, Homo Sapiens
LEPASLGTP

SEQ ID NO: 993369 - protein, 9 aa, Homo Sapiens
PMAGRRHAT

SEQ ID NO: 993370 - protein, 9 aa, Homo Sapiens
PYLQLPEAA

SEQ ID NO: 993371 - protein, 9 aa, Homo Sapiens
QVIKENIPE

SEQ ID NO: 993372 - protein, 9 aa, Homo Sapiens
IWVKWAHPL

SEQ ID NO: 993373 - protein, 9 aa, Homo Sapiens
CITEDTPPP

SEQ ID NO: 993374 - protein, 9 aa, Homo Sapiens
VPVILNNPY

SEQ ID NO: 993375 - protein, 9 aa, Homo Sapiens
HIIYAPSSH

SEQ ID NO: 993376 - protein, 9 aa, Homo Sapiens
RVTWASVTV

SEQ ID NO: 993377 - protein, 9 aa, Homo Sapiens
MTKKQTWVT

SEQ ID NO: 993378 - protein, 9 aa, Homo Sapiens
VRNGELPDR

SEQ ID NO: 993379 - protein, 9 aa, Homo Sapiens
VVSMESDCR

SEQ ID NO: 993380 - protein, 9 aa, Homo Sapiens
AWTPRKLVG

SEQ ID NO: 993381 - protein, 9 aa, Homo Sapiens
LVQTMGARA

SEQ ID NO: 993382 - protein, 9 aa, Homo Sapiens
TKEECGLSM

SEQ ID NO: 993383 - protein, 9 aa, Homo Sapiens
KESPAGMPN

SEQ ID NO: 993384 - protein, 9 aa, Homo Sapiens
SVQRTTPQT

SEQ ID NO: 993385 - protein, 9 aa, Homo Sapiens
HVLFTKEEC

SEQ ID NO: 993386 - protein, 9 aa, Homo Sapiens
GVRHVCRMF

SEQ ID NO: 993387 - protein, 9 aa, Homo Sapiens
LCFSTSPHK

SEQ ID NO: 993388 - protein, 9 aa, Homo Sapiens
CYNPKMEHY

SEQ ID NO: 993389 - protein, 9 aa, Homo Sapiens
AEPEKIEAF

SEQ ID NO: 993390 - protein, 9 aa, Homo Sapiens
GDANSKQPD

SEQ ID NO: 993391 - protein, 9 aa, Homo Sapiens
KWAHPLERS

SEQ ID NO: 993392 - protein, 9 aa, Homo Sapiens
KYRWNELFL

SEQ ID NO: 993393 - protein, 9 aa, Homo Sapiens
KKEDFFPCL

SEQ ID NO: 993394 - protein, 9 aa, Homo Sapiens
PWLCFSTSP

SEQ ID NO: 993395 - protein, 9 aa, Homo Sapiens
LKRNRKEGG

SEQ ID NO: 993396 - protein, 9 aa, Homo Sapiens
YSIWVKWAH

SEQ ID NO: 993397 - protein, 9 aa, Homo Sapiens
GGLIILEPA

SEQ ID NO: 993398 - protein, 9 aa, Homo Sapiens
KKIKAEPEK

SEQ ID NO: 993399 - protein, 9 aa, Homo Sapiens
FSQPYLQLP

SEQ ID NO: 993400 - protein, 9 aa, Homo Sapiens
LWYVVSMES

SEQ ID NO: 993401 - protein, 9 aa, Homo Sapiens
KAWTPRKLV

SEQ ID NO: 993402 - protein, 9 aa, Homo Sapiens
GTFTASREN

SEQ ID NO: 993403 - protein, 9 aa, Homo Sapiens
KHPFTCSHF

SEQ ID NO: 993404 - protein, 9 aa, Homo Sapiens
CETLQHPSC

SEQ ID NO: 993405 - protein, 9 aa, Homo Sapiens
PEAEQEITR

SEQ ID NO: 993406 - protein, 9 aa, Homo Sapiens
SMESDCRVF

SEQ ID NO: 993407 - protein, 9 aa, Homo Sapiens
HKRRSSGAT

SEQ ID NO: 993408 - protein, 9 aa, Homo Sapiens
SPHKRRSSG

SEQ ID NO: 993409 - protein, 9 aa, Homo Sapiens
NIPENVTAS

SEQ ID NO: 993410 - protein, 9 aa, Homo Sapiens
AYSILGHYQ

SEQ ID NO: 993411 - protein, 9 aa, Homo Sapiens
EHSRAILAQ

SEQ ID NO: 993412 - protein, 9 aa, Homo Sapiens
AGRRHATTN

SEQ ID NO: 993413 - protein, 9 aa, Homo Sapiens
MAIFRILAG

SEQ ID NO: 993414 - protein, 9 aa, Homo Sapiens
TSVTLCFPI

SEQ ID NO: 993415 - protein, 9 aa, Homo Sapiens
EHIQTRNRR

SEQ ID NO: 993416 - protein, 9 aa, Homo Sapiens
IYTAVTVSF

SEQ ID NO: 993417 - protein, 9 aa, Homo Sapiens
RAILAQSKL

SEQ ID NO: 993418 - protein, 9 aa, Homo Sapiens
VAEALEKYV

SEQ ID NO: 993419 - protein, 9 aa, Homo Sapiens
ANNRYDIKN

SEQ ID NO: 993420 - protein, 9 aa, Homo Sapiens
CTSKAWTPR

SEQ ID NO: 993421 - protein, 9 aa, Homo Sapiens
AENVAENSS

SEQ ID NO: 993422 - protein, 9 aa, Homo Sapiens
PASLGTPWL

SEQ ID NO: 993423 - protein, 9 aa, Homo Sapiens
YNPKMEHYT

SEQ ID NO: 993424 - protein, 9 aa, Homo Sapiens
EECGLSMIL

SEQ ID NO: 993425 - protein, 9 aa, Homo Sapiens
ESGCKIWSG

SEQ ID NO: 993426 - protein, 9 aa, Homo Sapiens
MANHRKPGA

SEQ ID NO: 993427 - protein, 9 aa, Homo Sapiens
PFKLSGLSL

SEQ ID NO: 993428 - protein, 9 aa, Homo Sapiens
FTKEECGLS

SEQ ID NO: 993429 - protein, 9 aa, Homo Sapiens
KQTWVTEFI

SEQ ID NO: 993430 - protein, 9 aa, Homo Sapiens
NGELPDRES

SEQ ID NO: 993431 - protein, 9 aa, Homo Sapiens
NVAENSSIS

SEQ ID NO: 993432 - protein, 9 aa, Homo Sapiens
VTWASVTVG

SEQ ID NO: 993433 - protein, 9 aa, Homo Sapiens
YLQGTFTAS

SEQ ID NO: 993434 - protein, 9 aa, Homo Sapiens
KEDFFPCLE

SEQ ID NO: 993435 - protein, 9 aa, Homo Sapiens
THWEPYTME

SEQ ID NO: 993436 - protein, 9 aa, Homo Sapiens
VLFTKEECG

SEQ ID NO: 993437 - protein, 9 aa, Homo Sapiens
TFTASRENY

SEQ ID NO: 993438 - protein, 9 aa, Homo Sapiens
HSRAILAQS

SEQ ID NO: 993439 - protein, 9 aa, Homo Sapiens
YHLRSEHEP

SEQ ID NO: 993440 - protein, 9 aa, Homo Sapiens
GLIILEPAS

SEQ ID NO: 993441 - protein, 9 aa, Homo Sapiens
HWEPYTMEN

SEQ ID NO: 993442 - protein, 9 aa, Homo Sapiens
PLFSQEAAD

SEQ ID NO: 993443 - protein, 9 aa, Homo Sapiens
AKKGDFMCD

SEQ ID NO: 993444 - protein, 9 aa, Homo Sapiens
WAHPLERSQ

SEQ ID NO: 993445 - protein, 9 aa, Homo Sapiens
YTMENSGYL

SEQ ID NO: 993446 - protein, 9 aa, Homo Sapiens
VDNLSRVEG

SEQ ID NO: 993447 - protein, 9 aa, Homo Sapiens
QCVQMKSVQ

SEQ ID NO: 993448 - protein, 9 aa, Homo Sapiens
SPAGMPNPT

SEQ ID NO: 993449 - protein, 9 aa, Homo Sapiens
EKGDVMYIG

SEQ ID NO: 993450 - protein, 9 aa, Homo Sapiens
LELVSAPRG

SEQ ID NO: 993451 - protein, 9 aa, Homo Sapiens
FTCSHFTQD

SEQ ID NO: 993452 - protein, 9 aa, Homo Sapiens
ANSKQPDVQ

SEQ ID NO: 993453 - protein, 9 aa, Homo Sapiens
VSMESDCRV

SEQ ID NO: 993454 - protein, 9 aa, Homo Sapiens
QSNQIQTQH

SEQ ID NO: 993455 - protein, 9 aa, Homo Sapiens
SDLVMVYNT

SEQ ID NO: 993456 - protein, 9 aa, Homo Sapiens
VLPSSEELS

SEQ ID NO: 993457 - protein, 9 aa, Homo Sapiens
GMPNPTPPS

SEQ ID NO: 993458 - protein, 9 aa, Homo Sapiens
YYHCYNPKM

SEQ ID NO: 993459 - protein, 9 aa, Homo Sapiens
QLPEAAPDQ

SEQ ID NO: 993460 - protein, 9 aa, Homo Sapiens
EGIKYRWNE

SEQ ID NO: 993461 - protein, 9 aa, Homo Sapiens
HQMAIFRIL

SEQ ID NO: 993462 - protein, 9 aa, Homo Sapiens
TMENSGYLE

SEQ ID NO: 993463 - protein, 9 aa, Homo Sapiens
QPYLQLPEA

SEQ ID NO: 993464 - protein, 9 aa, Homo Sapiens
HSPSYLRAV

SEQ ID NO: 993465 - protein, 9 aa, Homo Sapiens
ENVAENSSI

SEQ ID NO: 993466 - protein, 9 aa, Homo Sapiens
WKIEKGDVM

SEQ ID NO: 993467 - protein, 9 aa, Homo Sapiens
EAENVAENS

SEQ ID NO: 993468 - protein, 9 aa, Homo Sapiens
LEKYVLEKE

SEQ ID NO: 993469 - protein, 9 aa, Homo Sapiens
PAYSILGHY

SEQ ID NO: 993470 - protein, 9 aa, Homo Sapiens
ATTNKLSPS

SEQ ID NO: 993471 - protein, 9 aa, Homo Sapiens
FLAAITGQH

SEQ ID NO: 993472 - protein, 9 aa, Homo Sapiens
SVEALMANH

SEQ ID NO: 993473 - protein, 9 aa, Homo Sapiens
FSVEALMAN

SEQ ID NO: 993474 - protein, 9 aa, Homo Sapiens
PRKLVGRAV

SEQ ID NO: 993475 - protein, 9 aa, Homo Sapiens
EKYVLEKEN

SEQ ID NO: 993476 - protein, 9 aa, Homo Sapiens
GTYLQGTFT

SEQ ID NO: 993477 - protein, 9 aa, Homo Sapiens
SRAILAQSK

SEQ ID NO: 993478 - protein, 9 aa, Homo Sapiens
ILGHYQTKT

SEQ ID NO: 993479 - protein, 9 aa, Homo Sapiens
GPAYSILGH

SEQ ID NO: 993480 - protein, 9 aa, Homo Sapiens
KKQTWVTEF

SEQ ID NO: 993481 - protein, 9 aa, Homo Sapiens
MYIGGLPDK

SEQ ID NO: 993482 - protein, 9 aa, Homo Sapiens
EKEAKKGDF

SEQ ID NO: 993483 - protein, 9 aa, Homo Sapiens
ILQFLAAIT

SEQ ID NO: 993484 - protein, 9 aa, Homo Sapiens
LAQSKLESL

SEQ ID NO: 993485 - protein, 9 aa, Homo Sapiens
WVKWAHPLE

SEQ ID NO: 993486 - protein, 9 aa, Homo Sapiens
SHQMAIFRI

SEQ ID NO: 993487 - protein, 9 aa, Homo Sapiens
YLQLPEAAP

SEQ ID NO: 993488 - protein, 9 aa, Homo Sapiens
QRVTWASVT

SEQ ID NO: 993489 - protein, 9 aa, Homo Sapiens
GKKIKAEPE

SEQ ID NO: 993490 - protein, 9 aa, Homo Sapiens
MESDCRVFL

SEQ ID NO: 993491 - protein, 9 aa, Homo Sapiens
TWASVTVGG

SEQ ID NO: 993492 - protein, 9 aa, Homo Sapiens
RWNELFLDV

SEQ ID NO: 993493 - protein, 9 aa, Homo Sapiens
VAKHPFTCS

SEQ ID NO: 993494 - protein, 9 aa, Homo Sapiens
MISITSVTL

SEQ ID NO: 993495 - protein, 9 aa, Homo Sapiens
MMTCFEANN

SEQ ID NO: 993496 - protein, 9 aa, Homo Sapiens
GRVEVEVQE

SEQ ID NO: 993497 - protein, 9 aa, Homo Sapiens
LRAVLPSSE

SEQ ID NO: 993498 - protein, 9 aa, Homo Sapiens
KCSGRVEVE

SEQ ID NO: 993499 - protein, 9 aa, Homo Sapiens
TEDTPPPAC

SEQ ID NO: 993500 - protein, 9 aa, Homo Sapiens
AEQEITRLK

SEQ ID NO: 993501 - protein, 9 aa, Homo Sapiens
KENIPENVT

SEQ ID NO: 993502 - protein, 9 aa, Homo Sapiens
AITGQHSWI

SEQ ID NO: 993503 - protein, 9 aa, Homo Sapiens
PTHWEPYTM

SEQ ID NO: 993504 - protein, 9 aa, Homo Sapiens
PDRESQAVY

SEQ ID NO: 993505 - protein, 9 aa, Homo Sapiens
ENIPENVTA

SEQ ID NO: 993506 - protein, 9 aa, Homo Sapiens
AIYTAVTVS

SEQ ID NO: 993507 - protein, 9 aa, Homo Sapiens
ITEDTPPPA

SEQ ID NO: 993508 - protein, 9 aa, Homo Sapiens
RHVCRMFHP

SEQ ID NO: 993509 - protein, 9 aa, Homo Sapiens
IILEPASLG

SEQ ID NO: 993510 - protein, 9 aa, Homo Sapiens
APRGFSVPG

SEQ ID NO: 993511 - protein, 9 aa, Homo Sapiens
QTRNRRKSS

SEQ ID NO: 993512 - protein, 9 aa, Homo Sapiens
SRVEGLLPY

SEQ ID NO: 993513 - protein, 9 aa, Homo Sapiens
HIQTRNRRK

SEQ ID NO: 993514 - protein, 9 aa, Homo Sapiens
QSKLESLCR

SEQ ID NO: 993515 - protein, 9 aa, Homo Sapiens
FFPCLELVS

SEQ ID NO: 993516 - protein, 9 aa, Homo Sapiens
SAPRGFSVP

SEQ ID NO: 993517 - protein, 9 aa, Homo Sapiens
QPLFSQEAA

SEQ ID NO: 993518 - protein, 9 aa, Homo Sapiens
FAVDNLSRV

SEQ ID NO: 993519 - protein, 9 aa, Homo Sapiens
VRGYYHCYN

SEQ ID NO: 993520 - protein, 9 aa, Homo Sapiens
TAVTVSFLG

SEQ ID NO: 993521 - protein, 9 aa, Homo Sapiens
HPSCNIRRL

SEQ ID NO: 993522 - protein, 9 aa, Homo Sapiens
ILNNPYSEK

SEQ ID NO: 993523 - protein, 9 aa, Homo Sapiens
AIFRILAGI

SEQ ID NO: 993524 - protein, 9 aa, Homo Sapiens
WGKGNVPVI

SEQ ID NO: 993525 - protein, 9 aa, Homo Sapiens
ALEKYVLEK

SEQ ID NO: 993526 - protein, 9 aa, Homo Sapiens
NLSRVEGLL

SEQ ID NO: 993527 - protein, 9 aa, Homo Sapiens
PDRPFYRHI

SEQ ID NO: 993528 - protein, 9 aa, Homo Sapiens
LQQPLFSQE

SEQ ID NO: 993529 - protein, 9 aa, Homo Sapiens
FYRHIIYAP

SEQ ID NO: 993530 - protein, 9 aa, Homo Sapiens
LAAITGQHS

SEQ ID NO: 993531 - protein, 9 aa, Homo Sapiens
KAEPEKIEA

SEQ ID NO: 993532 - protein, 9 aa, Homo Sapiens
SILGHYQTK

SEQ ID NO: 993533 - protein, 9 aa, Homo Sapiens
YVVSMESDC

SEQ ID NO: 993534 - protein, 9 aa, Homo Sapiens
LSLKRNRKE

SEQ ID NO: 993535 - protein, 9 aa, Homo Sapiens
ILEPASLGT

SEQ ID NO: 993536 - protein, 9 aa, Homo Sapiens
YSILGHYQT

SEQ ID NO: 993537 - protein, 9 aa, Homo Sapiens
AENSSISNP

SEQ ID NO: 993538 - protein, 9 aa, Homo Sapiens
GFSVPGTHS

SEQ ID NO: 993539 - protein, 9 aa, Homo Sapiens
VPGTHSPSY

SEQ ID NO: 993540 - protein, 9 aa, Homo Sapiens
IKYRWNELF

SEQ ID NO: 993541 - protein, 9 aa, Homo Sapiens
PAGMPNPTP

SEQ ID NO: 993542 - protein, 9 aa, Homo Sapiens
PPPACTSKA

SEQ ID NO: 993543 - protein, 9 aa, Homo Sapiens
TYLQGTFTA

SEQ ID NO: 993544 - protein, 9 aa, Homo Sapiens
FPCLELVSA

SEQ ID NO: 993545 - protein, 9 aa, Homo Sapiens
EAKKGDFMC

SEQ ID NO: 993546 - protein, 9 aa, Homo Sapiens
QHPSCNIRR

SEQ ID NO: 993547 - protein, 9 aa, Homo Sapiens
NEMVAKHPF

SEQ ID NO: 993548 - protein, 9 aa, Homo Sapiens
SNQIQTQHT

SEQ ID NO: 993549 - protein, 9 aa, Homo Sapiens
LQGTFTASR

SEQ ID NO: 993550 - protein, 9 aa, Homo Sapiens
GHYQTKTML

SEQ ID NO: 993551 - protein, 9 aa, Homo Sapiens
QIQTQHTAR

SEQ ID NO: 993552 - protein, 9 aa, Homo Sapiens
LCFPISLPV

SEQ ID NO: 993553 - protein, 9 aa, Homo Sapiens
KIEKGDVMY

SEQ ID NO: 993554 - protein, 9 aa, Homo Sapiens
PGTHSPSYL

SEQ ID NO: 993555 - protein, 9 aa, Homo Sapiens
PFYRHIIYA

SEQ ID NO: 993556 - protein, 9 aa, Homo Sapiens
KIKAEPEKI

SEQ ID NO: 993557 - protein, 9 aa, Homo Sapiens
GLWYVVSME

SEQ ID NO: 993558 - protein, 9 aa, Homo Sapiens
GSDLVMVYN

SEQ ID NO: 993559 - protein, 9 aa, Homo Sapiens
MVAKHPFTC

SEQ ID NO: 993560 - protein, 9 aa, Homo Sapiens
YLRAVLPSS

SEQ ID NO: 993561 - protein, 9 aa, Homo Sapiens
AYHLRSEHE

SEQ ID NO: 993562 - protein, 9 aa, Homo Sapiens
ELPDRESQA

SEQ ID NO: 993563 - protein, 9 aa, Homo Sapiens
PEKIEAFRA

SEQ ID NO: 993564 - protein, 9 aa, Homo Sapiens
VMYIGGLPD

SEQ ID NO: 993565 - protein, 9 aa, Homo Sapiens
EANNRYDIK

SEQ ID NO: 993566 - protein, 9 aa, Homo Sapiens
AVLPSSEEL

SEQ ID NO: 993567 - protein, 9 aa, Homo Sapiens
CVQMKSVQR

SEQ ID NO: 993568 - protein, 9 aa, Homo Sapiens
SGCKIWSGN

SEQ ID NO: 993569 - protein, 9 aa, Homo Sapiens
QQPLFSQEA

SEQ ID NO: 993570 - protein, 9 aa, Homo Sapiens
ASLGTPWLC

SEQ ID NO: 993571 - protein, 9 aa, Homo Sapiens
RSEHEPISF

SEQ ID NO: 993572 - protein, 9 aa, Homo Sapiens
DTPPPACTS

SEQ ID NO: 993573 - protein, 9 aa, Homo Sapiens
RHATTNKLS

SEQ ID NO: 993574 - protein, 9 aa, Homo Sapiens
IIYAPSSHN

SEQ ID NO: 993575 - protein, 9 aa, Homo Sapiens
AGGHVGDSA

SEQ ID NO: 993576 - protein, 9 aa, Homo Sapiens
KLSGLSLKR

SEQ ID NO: 993577 - protein, 9 aa, Homo Sapiens
AVVQRVTWA

SEQ ID NO: 993578 - protein, 9 aa, Homo Sapiens
SYLRAVLPS

SEQ ID NO: 993579 - protein, 9 aa, Homo Sapiens
FKLSGLSLK

SEQ ID NO: 993580 - protein, 9 aa, Homo Sapiens
KEECGLSMI

SEQ ID NO: 993581 - protein, 9 aa, Homo Sapiens
VTVRNGELP

SEQ ID NO: 993582 - protein, 9 aa, Homo Sapiens
PCLELVSAP

SEQ ID NO: 993583 - protein, 9 aa, Homo Sapiens
RALKICDKP

SEQ ID NO: 993584 - protein, 9 aa, Homo Sapiens
SGRVEVEVQ

SEQ ID NO: 993585 - protein, 9 aa, Homo Sapiens
VSAPRGFSV

SEQ ID NO: 993586 - protein, 9 aa, Homo Sapiens
EALMANHRK

SEQ ID NO: 993587 - protein, 9 aa, Homo Sapiens
EALEKYVLE

SEQ ID NO: 993588 - protein, 9 aa, Homo Sapiens
DNLSRVEGL

SEQ ID NO: 993589 - protein, 9 aa, Homo Sapiens
CLELVSAPR

SEQ ID NO: 993590 - protein, 9 aa, Homo Sapiens
TQCVQMKSV

SEQ ID NO: 993591 - protein, 9 aa, Homo Sapiens
SVPGTHSPS

SEQ ID NO: 993592 - protein, 9 aa, Homo Sapiens
QGTFTASRE

SEQ ID NO: 993593 - protein, 9 aa, Homo Sapiens
QMKSVQRTT

SEQ ID NO: 993594 - protein, 9 aa, Homo Sapiens
ISITSVTLC

SEQ ID NO: 993595 - protein, 9 aa, Homo Sapiens
MKSVQRTTP

SEQ ID NO: 993596 - protein, 9 aa, Homo Sapiens
ATQCVQMKS

SEQ ID NO: 993597 - protein, 9 aa, Homo Sapiens
YHCYNPKME

SEQ ID NO: 993598 - protein, 9 aa, Homo Sapiens
VLQQPLFSQ

SEQ ID NO: 993599 - protein, 9 aa, Homo Sapiens
PKESPAGMP

SEQ ID NO: 993600 - protein, 9 aa, Homo Sapiens
EDTPPPACT

SEQ ID NO: 993601 - protein, 9 aa, Homo Sapiens
VGRAVRRKG

SEQ ID NO: 993602 - protein, 9 aa, Homo Sapiens
SVTLCFPIS

SEQ ID NO: 993603 - protein, 9 aa, Homo Sapiens
KGNVPVILN

SEQ ID NO: 993604 - protein, 9 aa, Homo Sapiens
HPFTCSHFT

SEQ ID NO: 993605 - protein, 9 aa, Homo Sapiens
CSGRVEVEV

SEQ ID NO: 993606 - protein, 9 aa, Homo Sapiens
LMANHRKPG

SEQ ID NO: 993607 - protein, 9 aa, Homo Sapiens
CRMFHPGRG

SEQ ID NO: 993608 - protein, 9 aa, Homo Sapiens
PGDANSKQP

SEQ ID NO: 993609 - protein, 9 aa, Homo Sapiens
MPNPTPPSS

SEQ ID NO: 993610 - protein, 9 aa, Homo Sapiens
TPKESPAGM

SEQ ID NO: 993611 - protein, 9 aa, Homo Sapiens
ANHRKPGAK

SEQ ID NO: 993612 - protein, 9 aa, Homo Sapiens
EMVAKHPFT

SEQ ID NO: 993613 - protein, 9 aa, Homo Sapiens
GKGNVPVIL

SEQ ID NO: 993614 - protein, 9 aa, Homo Sapiens
LEMMTCFEA

SEQ ID NO: 993615 - protein, 9 aa, Homo Sapiens
IFQVDPEAE

SEQ ID NO: 993616 - protein, 9 aa, Homo Sapiens
FSTSPHKRR

SEQ ID NO: 993617 - protein, 9 aa, Homo Sapiens
QFLAAITGQ

SEQ ID NO: 993618 - protein, 9 aa, Homo Sapiens
RREGIKYRW

SEQ ID NO: 993619 - protein, 9 aa, Homo Sapiens
LPDRESQAV

SEQ ID NO: 993620 - protein, 9 aa, Homo Sapiens
PAGGHVGDS

SEQ ID NO: 993621 - protein, 9 aa, Homo Sapiens
DPAGGHVGD

SEQ ID NO: 993622 - protein, 9 aa, Homo Sapiens
SLKRNRKEG

SEQ ID NO: 993623 - protein, 9 aa, Homo Sapiens
QTMGARALK

SEQ ID NO: 993624 - protein, 9 aa, Homo Sapiens
ILAQSKLES

SEQ ID NO: 993625 - protein, 9 aa, Homo Sapiens
AILAQSKLE

SEQ ID NO: 993626 - protein, 9 aa, Homo Sapiens
MGARALKIC

SEQ ID NO: 993627 - protein, 9 aa, Homo Sapiens
REGIKYRWN

SEQ ID NO: 993628 - protein, 9 aa, Homo Sapiens
LQFLAAITG

SEQ ID NO: 993629 - protein, 9 aa, Homo Sapiens
LGHYQTKTM

SEQ ID NO: 993630 - protein, 9 aa, Homo Sapiens
LQLPEAAPD

SEQ ID NO: 993631 - protein, 9 aa, Homo Sapiens
ETLQHPSCN

SEQ ID NO: 993632 - protein, 9 aa, Homo Sapiens
KSVQRTTPQ

SEQ ID NO: 993633 - protein, 9 aa, Homo Sapiens
LSGLSLKRN

SEQ ID NO: 993634 - protein, 9 aa, Homo Sapiens
YTAVTVSFL

SEQ ID NO: 993635 - protein, 9 aa, Homo Sapiens
KQPDVQTLS

SEQ ID NO: 993636 - protein, 9 aa, Homo Sapiens
RGFSVPGTH

SEQ ID NO: 993637 - protein, 9 aa, Homo Sapiens
RHIIYAPSS

SEQ ID NO: 993638 - protein, 9 aa, Homo Sapiens
AQSKLESLC

SEQ ID NO: 993639 - protein, 9 aa, Homo Sapiens
QHTARAKRK

SEQ ID NO: 993640 - protein, 9 aa, Homo Sapiens
TSKAWTPRK

SEQ ID NO: 993641 - protein, 9 aa, Homo Sapiens
QTQHTARAK

SEQ ID NO: 993642 - protein, 9 aa, Homo Sapiens
IKAEPEKIE

SEQ ID NO: 993643 - protein, 9 aa, Homo Sapiens
TGQHSWIEQ

SEQ ID NO: 993644 - protein, 9 aa, Homo Sapiens
AAITGQHSW

SEQ ID NO: 993645 - protein, 9 aa, Homo Sapiens
PSCNIRRLW

SEQ ID NO: 993646 - protein, 9 aa, Homo Sapiens
DANSKQPDV

SEQ ID NO: 993647 - protein, 9 aa, Homo Sapiens
VLVQTMGAR

SEQ ID NO: 993648 - protein, 9 aa, Homo Sapiens
NSKQPDVQT

SEQ ID NO: 993649 - protein, 9 aa, Homo Sapiens
GHVGDSALQ

SEQ ID NO: 993650 - protein, 9 aa, Homo Sapiens
KLVGRAVRR

SEQ ID NO: 993651 - protein, 9 aa, Homo Sapiens
TASRENYLE

SEQ ID NO: 993652 - protein, 9 aa, Homo Sapiens
GCKIWSGNE

SEQ ID NO: 993653 - protein, 9 aa, Homo Sapiens
PRGFSVPGT

SEQ ID NO: 993654 - protein, 9 aa, Homo Sapiens
RRHATTNKL

SEQ ID NO: 993655 - protein, 9 aa, Homo Sapiens
HCYNPKMEH

SEQ ID NO: 993656 - protein, 9 aa, Homo Sapiens
TTNKLSPSG

SEQ ID NO: 993657 - protein, 9 aa, Homo Sapiens
GDVMYIGGL

SEQ ID NO: 993658 - protein, 9 aa, Homo Sapiens
GLSLKRNRK

SEQ ID NO: 993659 - protein, 9 aa, Homo Sapiens
IQTQHTARA

SEQ ID NO: 993660 - protein, 9 aa, Homo Sapiens
SEKEAKKGD

SEQ ID NO: 993661 - protein, 9 aa, Homo Sapiens
HGIDPAGGH

SEQ ID NO: 993662 - protein, 9 aa, Homo Sapiens
LNNVLQQPL

SEQ ID NO: 993663 - protein, 9 aa, Homo Sapiens
KKGDFMCDY

SEQ ID NO: 993664 - protein, 9 aa, Homo Sapiens
FSVPGTHSP

SEQ ID NO: 993665 - protein, 9 aa, Homo Sapiens
LAIYTAVTV

SEQ ID NO: 993666 - protein, 9 aa, Homo Sapiens
NPKMEHYTS

SEQ ID NO: 993667 - protein, 9 aa, Homo Sapiens
WYVVSMESD

SEQ ID NO: 993668 - protein, 9 aa, Homo Sapiens
EVQEEWGTV

SEQ ID NO: 993669 - protein, 9 aa, Homo Sapiens
WNELFLDVL

SEQ ID NO: 993670 - protein, 9 aa, Homo Sapiens
NSSISNPAP

SEQ ID NO: 993671 - protein, 9 aa, Homo Sapiens
TSPHKRRSS

SEQ ID NO: 993672 - protein, 9 aa, Homo Sapiens
ITGQHSWIE

SEQ ID NO: 993673 - protein, 9 aa, Homo Sapiens
TMGARALKI

SEQ ID NO: 993674 - protein, 9 aa, Homo Sapiens
HVGDSALQL

SEQ ID NO: 993675 - protein, 9 aa, Homo Sapiens
SKAWTPRKL

SEQ ID NO: 993676 - protein, 9 aa, Homo Sapiens
WIHEHIQTR

SEQ ID NO: 993677 - protein, 9 aa, Homo Sapiens
PHKRRSSGA

SEQ ID NO: 993678 - protein, 9 aa, Homo Sapiens
TRNRRKSSR

SEQ ID NO: 993679 - protein, 9 aa, Homo Sapiens
VRHVCRMFH

SEQ ID NO: 993680 - protein, 9 aa, Homo Sapiens
LIILEPASL

SEQ ID NO: 993681 - protein, 9 aa, Homo Sapiens
SITSVTLCF

SEQ ID NO: 993682 - protein, 9 aa, Homo Sapiens
TKKQTWVTE

SEQ ID NO: 993683 - protein, 9 aa, Homo Sapiens
ARALKICDK

SEQ ID NO: 993684 - protein, 9 aa, Homo Sapiens
AVDNLSRVE

SEQ ID NO: 993685 - protein, 9 aa, Homo Sapiens
KTKKEDFFP

SEQ ID NO: 993686 - protein, 9 aa, Homo Sapiens
SLGTPWLCF

SEQ ID NO: 993687 - protein, 9 aa, Homo Sapiens
HEHIQTRNR

SEQ ID NO: 993688 - protein, 9 aa, Homo Sapiens
ESPAGMPNP

SEQ ID NO: 993689 - protein, 9 aa, Homo Sapiens
ALMANHRKP

SEQ ID NO: 993690 - protein, 9 aa, Homo Sapiens
GELPDRESQ

SEQ ID NO: 993691 - protein, 9 aa, Homo Sapiens
HTARAKRKY

SEQ ID NO: 993692 - protein, 9 aa, Homo Sapiens
SIWVKWAHP

SEQ ID NO: 993693 - protein, 9 aa, Homo Sapiens
LRSEHEPIS

SEQ ID NO: 993694 - protein, 9 aa, Homo Sapiens
TCFEANNRY

SEQ ID NO: 993695 - protein, 9 aa, Homo Sapiens
SSISNPAPQ

SEQ ID NO: 993696 - protein, 9 aa, Homo Sapiens
IPENVTASE

SEQ ID NO: 993697 - protein, 9 aa, Homo Sapiens
TQHTARAKR

SEQ ID NO: 993698 - protein, 9 aa, Homo Sapiens
LQVIKENIP

SEQ ID NO: 993699 - protein, 9 aa, Homo Sapiens
EPASLGTPW

SEQ ID NO: 993700 - protein, 9 aa, Homo Sapiens
PFTCSHFTQ

SEQ ID NO: 993701 - protein, 9 aa, Homo Sapiens
VIKENIPEN

SEQ ID NO: 993702 - protein, 9 aa, Homo Sapiens
VERDYESGC

SEQ ID NO: 993703 - protein, 9 aa, Homo Sapiens
PDVQTLSSA

SEQ ID NO: 993704 - protein, 9 aa, Homo Sapiens
GFSQPYLQL

SEQ ID NO: 993705 - protein, 9 aa, Homo Sapiens
GYYHCYNPK

SEQ ID NO: 993706 - protein, 9 aa, Homo Sapiens
SEHEPISFF

SEQ ID NO: 993707 - protein, 9 aa, Homo Sapiens
GNVPVILNN

SEQ ID NO: 993708 - protein, 9 aa, Homo Sapiens
SESHQMAIF

SEQ ID NO: 993709 - protein, 9 aa, Homo Sapiens
DFFPCLELV

SEQ ID NO: 993710 - protein, 9 aa, Homo Sapiens
LALAIYTAV

SEQ ID NO: 993711 - protein, 9 aa, Homo Sapiens
SPSYLRAVL

SEQ ID NO: 993712 - protein, 9 aa, Homo Sapiens
MENSGYLEI

SEQ ID NO: 993713 - protein, 9 aa, Homo Sapiens
LVSAPRGFS

SEQ ID NO: 993714 - protein, 9 aa, Homo Sapiens
RKLVGRAVR

SEQ ID NO: 993715 - protein, 9 aa, Homo Sapiens
LQHPSCNIR

SEQ ID NO: 993716 - protein, 9 aa, Homo Sapiens
IEKGDVMYI

SEQ ID NO: 993717 - protein, 9 aa, Homo Sapiens
DRPFYRHII

SEQ ID NO: 993718 - protein, 9 aa, Homo Sapiens
NHRKPGAKE

SEQ ID NO: 993719 - protein, 9 aa, Homo Sapiens
GDFMCDYCE

SEQ ID NO: 993720 - protein, 9 aa, Homo Sapiens
GRRHATTNK

SEQ ID NO: 993721 - protein, 9 aa, Homo Sapiens
KGDVMYIGG

SEQ ID NO: 993722 - protein, 9 aa, Homo Sapiens
HLRSEHEPI

SEQ ID NO: 993723 - protein, 9 aa, Homo Sapiens
TLCFPISLP

SEQ ID NO: 993724 - protein, 9 aa, Homo Sapiens
HYQTKTMLT

SEQ ID NO: 993725 - protein, 9 aa, Homo Sapiens
TPRKLVGRA

SEQ ID NO: 993726 - protein, 9 aa, Homo Sapiens
NNVLQQPLF

SEQ ID NO: 993727 - protein, 9 aa, Homo Sapiens
LCETLQHPS

SEQ ID NO: 993728 - protein, 9 aa, Homo Sapiens
HVCRMFHPG

SEQ ID NO: 993729 - protein, 9 aa, Homo Sapiens
EVEVQEEWG

SEQ ID NO: 993730 - protein, 9 aa, Homo Sapiens
EKIEAFRAS

SEQ ID NO: 993731 - protein, 9 aa, Homo Sapiens
LVMVYNTLS

SEQ ID NO: 993732 - protein, 9 aa, Homo Sapiens
NQIQTQHTA

SEQ ID NO: 993733 - protein, 9 aa, Homo Sapiens
WTPRKLVGR

SEQ ID NO: 993734 - protein, 9 aa, Homo Sapiens
DERGSDLVM

SEQ ID NO: 993735 - protein, 9 aa, Homo Sapiens
VEVQEEWGT

SEQ ID NO: 993736 - protein, 9 aa, Homo Sapiens
CFSTSPHKR

SEQ ID NO: 993737 - protein, 9 aa, Homo Sapiens
DPEAEQEIT

SEQ ID NO: 993738 - protein, 9 aa, Homo Sapiens
PPACTSKAW

SEQ ID NO: 993739 - protein, 9 aa, Homo Sapiens
MVYNTLSPM

SEQ ID NO: 993740 - protein, 9 aa, Homo Sapiens
IQTRNRRKS

SEQ ID NO: 993741 - protein, 9 aa, Homo Sapiens
ACTSKAWTP

SEQ ID NO: 993742 - protein, 9 aa, Homo Sapiens
GIDPAGGHV

SEQ ID NO: 993743 - protein, 9 aa, Homo Sapiens
EIFQVDPEA

SEQ ID NO: 993744 - protein, 9 aa, Homo Sapiens
EMMTCFEAN

SEQ ID NO: 993745 - protein, 9 aa, Homo Sapiens
YESGCKIWS

SEQ ID NO: 993746 - protein, 9 aa, Homo Sapiens
RVEVEVQEE

SEQ ID NO: 993747 - protein, 9 aa, Homo Sapiens
YRHIIYAPS

SEQ ID NO: 993748 - protein, 9 aa, Homo Sapiens
WLCFSTSPH

SEQ ID NO: 993749 - protein, 9 aa, Homo Sapiens
EPEKIEAFR

SEQ ID NO: 993750 - protein, 9 aa, Homo Sapiens
RGSDLVMVY

SEQ ID NO: 993751 - protein, 9 aa, Homo Sapiens
IHEHIQTRN

SEQ ID NO: 993752 - protein, 9 aa, Homo Sapiens
RDYESGCKI

SEQ ID NO: 993753 - protein, 9 aa, Homo Sapiens
NVPVILNNP

SEQ ID NO: 993754 - protein, 9 aa, Homo Sapiens
RNRRKSSRA

SEQ ID NO: 993755 - protein, 9 aa, Homo Sapiens
GARALKICD

SEQ ID NO: 993756 - protein, 9 aa, Homo Sapiens
LGTPWLCFS

SEQ ID NO: 993757 - protein, 9 aa, Homo Sapiens
LLFAVDNLS

SEQ ID NO: 993758 - protein, 9 aa, Homo Sapiens
SGVRHVCRM

SEQ ID NO: 993759 - protein, 9 aa, Homo Sapiens
GISESHQMA

SEQ ID NO: 993760 - protein, 9 aa, Homo Sapiens
SKQPDVQTL

SEQ ID NO: 993761 - protein, 9 aa, Homo Sapiens
VEALMANHR

SEQ ID NO: 993762 - protein, 9 aa, Homo Sapiens
SGLSLKRNR

SEQ ID NO: 993763 - protein, 9 aa, Homo Sapiens
VQMKSVQRT

SEQ ID NO: 993764 - protein, 9 aa, Homo Sapiens
MTCFEANNR

SEQ ID NO: 993765 - protein, 9 aa, Homo Sapiens
EPYTMENSG

SEQ ID NO: 993766 - protein, 9 aa, Homo Sapiens
VTLCFPISL

SEQ ID NO: 993767 - protein, 9 aa, Homo Sapiens
ENSSISNPA

SEQ ID NO: 993768 - protein, 9 aa, Homo Sapiens
GTPWLCFST

SEQ ID NO: 993769 - protein, 9 aa, Homo Sapiens
VDPEAEQEI

SEQ ID NO: 993770 - protein, 9 aa, Homo Sapiens
TPPPACTSK

SEQ ID NO: 993771 - protein, 9 aa, Homo Sapiens
IDPAGGHVG

SEQ ID NO: 993772 - protein, 9 aa, Homo Sapiens
FQVDPEAEQ

SEQ ID NO: 993773 - protein, 9 aa, Homo Sapiens
ELVSAPRGF

SEQ ID NO: 993774 - protein, 9 aa, Homo Sapiens
PSYLRAVLP

SEQ ID NO: 993775 - protein, 9 aa, Homo Sapiens
RGYYHCYNP

SEQ ID NO: 993776 - protein, 9 aa, Homo Sapiens
VKWAHPLER

SEQ ID NO: 993777 - protein, 9 aa, Homo Sapiens
TPWLCFSTS

SEQ ID NO: 993778 - protein, 9 aa, Homo Sapiens
HATTNKLSP

SEQ ID NO: 993779 - protein, 9 aa, Homo Sapiens
FEANNRYDI

SEQ ID NO: 993780 - protein, 9 aa, Homo Sapiens
STSPHKRRS

SEQ ID NO: 993781 - protein, 9 aa, Homo Sapiens
AKHPFTCSH

SEQ ID NO: 993782 - protein, 9 aa, Homo Sapiens
TVRNGELPD

SEQ ID NO: 993783 - protein, 9 aa, Homo Sapiens
SQPYLQLPE

SEQ ID NO: 993784 - protein, 9 aa, Homo Sapiens
ERDYESGCK

SEQ ID NO: 993785 - protein, 9 aa, Homo Sapiens
SCNIRRLWL

SEQ ID NO: 993786 - protein, 9 aa, Homo Sapiens
RAVLPSSEE

SEQ ID NO: 993787 - protein, 9 aa, Homo Sapiens
PACTSKAWT

SEQ ID NO: 993788 - protein, 9 aa, Homo Sapiens
ISESHQMAI

SEQ ID NO: 993789 - protein, 9 aa, Homo Sapiens
WASVTVGGE

SEQ ID NO: 993790 - protein, 9 aa, Homo Sapiens
HEPISFFPE

SEQ ID NO: 993791 - protein, 9 aa, Homo Sapiens
KGDFMCDYC

SEQ ID NO: 993792 - protein, 9 aa, Homo Sapiens
DGFSQPYLQ

SEQ ID NO: 993793 - protein, 9 aa, Homo Sapiens
LFTKEECGL

SEQ ID NO: 993794 - protein, 9 aa, Homo Sapiens
YRWNELFLD

SEQ ID NO: 993795 - protein, 9 aa, Homo Sapiens
VQRVTWASV

SEQ ID NO: 993796 - protein, 9 aa, Homo Sapiens
EPISFFPES

SEQ ID NO: 993797 - protein, 9 aa, Homo Sapiens
DLVMVYNTL

SEQ ID NO: 993798 - protein, 9 aa, Homo Sapiens
KSEKEAKKG

SEQ ID NO: 993799 - protein, 9 aa, Homo Sapiens
EHEPISFFP

SEQ ID NO: 993800 - protein, 9 aa, Homo Sapiens
KAVVQRVTW

SEQ ID NO: 993801 - protein, 9 aa, Homo Sapiens
VVQRVTWAS

SEQ ID NO: 993802 - protein, 9 aa, Homo Sapiens
GIKYRWNEL

SEQ ID NO: 993803 - protein, 9 aa, Homo Sapiens
VEVEVQEEW

SEQ ID NO: 993804 - protein, 9 aa, Homo Sapiens
TKKEDFFPC

SEQ ID NO: 993805 - protein, 9 aa, Homo Sapiens
VLEKENPKD

SEQ ID NO: 993806 - protein, 9 aa, Homo Sapiens
YVLEKENPK

SEQ ID NO: 993807 - protein, 9 aa, Homo Sapiens
QPDVQTLSS

SEQ ID NO: 993808 - protein, 9 aa, Homo Sapiens
AVTVSFLGR

SEQ ID NO: 993809 - protein, 9 aa, Homo Sapiens
TLQHPSCNI

SEQ ID NO: 993810 - protein, 9 aa, Homo Sapiens
DVMYIGGLP

SEQ ID NO: 993811 - protein, 9 aa, Homo Sapiens
WEPYTMENS

SEQ ID NO: 993812 - protein, 9 aa, Homo Sapiens
VCRMFHPGR

SEQ ID NO: 993813 - protein, 9 aa, Homo Sapiens
KEAKKGDFM

SEQ ID NO: 993814 - protein, 9 aa, Homo Sapiens
VAENSSISN

SEQ ID NO: 993815 - protein, 9 aa, Homo Sapiens
QMAIFRILA

SEQ ID NO: 993816 - protein, 9 aa, Homo Sapiens
HPLERSQLT

SEQ ID NO: 993817 - protein, 9 aa, Homo Sapiens
ITSVTLCFP

SEQ ID NO: 993818 - protein, 9 aa, Homo Sapiens
THSPSYLRA

SEQ ID NO: 993819 - protein, 9 aa, Homo Sapiens
NVLQQPLFS

SEQ ID NO: 993820 - protein, 9 aa, Homo Sapiens
ESDCRVFLG

SEQ ID NO: 993821 - protein, 9 aa, Homo Sapiens
VLALAIYTA

SEQ ID NO: 993822 - protein, 9 aa, Homo Sapiens
VMVYNTLSP

SEQ ID NO: 993823 - protein, 9 aa, Homo Sapiens
MAGRRHATT

SEQ ID NO: 993824 - protein, 9 aa, Homo Sapiens
SLQVIKENI

SEQ ID NO: 993825 - protein, 9 aa, Homo Sapiens
LFAVDNLSR

SEQ ID NO: 993826 - protein, 9 aa, Homo Sapiens
EDFFPCLEL

SEQ ID NO: 993827 - protein, 9 aa, Homo Sapiens
SSGVRHVCR

SEQ ID NO: 993828 - protein, 9 aa, Homo Sapiens
ESHQMAIFR

SEQ ID NO: 993829 - protein, 9 aa, Homo Sapiens
EAEQEITRL

SEQ ID NO: 993830 - protein, 9 aa, Homo Sapiens
QVDPEAEQE

SEQ ID NO: 993831 - protein, 9 aa, Homo Sapiens
PYTMENSGY

SEQ ID NO: 993832 - protein, 9 aa, Homo Sapiens
PVILNNPYS

SEQ ID NO: 993833 - protein, 9 aa, Homo Sapiens
AEALEKYVL

SEQ ID NO: 993834 - protein, 9 aa, Homo Sapiens
LVGRAVRRK

SEQ ID NO: 993835 - protein, 9 aa, Homo Sapiens
FTASRENYL

SEQ ID NO: 993836 - protein, 9 aa, Homo Sapiens
IKNQKCIPV

SEQ ID NO: 993837 - protein, 9 aa, Homo Sapiens
QNGDYQLWT

SEQ ID NO: 993838 - protein, 9 aa, Homo Sapiens
AVVLGFFEG

SEQ ID NO: 993839 - protein, 9 aa, Homo Sapiens
LAGHEDGVQ

SEQ ID NO: 993840 - protein, 9 aa, Homo Sapiens
RGHPKLLQL

SEQ ID NO: 993841 - protein, 9 aa, Homo Sapiens
GAAPYRGHP

SEQ ID NO: 993842 - protein, 9 aa, Homo Sapiens
QNRRIMPFP

SEQ ID NO: 993843 - protein, 9 aa, Homo Sapiens
QLSKNEQEG

SEQ ID NO: 993844 - protein, 9 aa, Homo Sapiens
WGAAPYRGH

SEQ ID NO: 993845 - protein, 9 aa, Homo Sapiens
IACSFPRRN

SEQ ID NO: 993846 - protein, 9 aa, Homo Sapiens
AIQLFGTNL

SEQ ID NO: 993847 - protein, 9 aa, Homo Sapiens
LSIVSRGGV

SEQ ID NO: 993848 - protein, 9 aa, Homo Sapiens
ESPHTRRKK

SEQ ID NO: 993849 - protein, 9 aa, Homo Sapiens
EALRLLAGH

SEQ ID NO: 993850 - protein, 9 aa, Homo Sapiens
YVHNTTARA

SEQ ID NO: 993851 - protein, 9 aa, Homo Sapiens
EDHKLVIEV

SEQ ID NO: 993852 - protein, 9 aa, Homo Sapiens
RTIEDHKLV

SEQ ID NO: 993853 - protein, 9 aa, Homo Sapiens
PMFVRKACP

SEQ ID NO: 993854 - protein, 9 aa, Homo Sapiens
PANEYAYRH

SEQ ID NO: 993855 - protein, 9 aa, Homo Sapiens
EQEGEAQLI

SEQ ID NO: 993856 - protein, 9 aa, Homo Sapiens
LSGQFKCIK

SEQ ID NO: 993857 - protein, 9 aa, Homo Sapiens
QVPPSMDTH

SEQ ID NO: 993858 - protein, 9 aa, Homo Sapiens
KWLTLEFCR

SEQ ID NO: 993859 - protein, 9 aa, Homo Sapiens
IIRMKRIFY

SEQ ID NO: 993860 - protein, 9 aa, Homo Sapiens
KACPHQLLT

SEQ ID NO: 993861 - protein, 9 aa, Homo Sapiens
QLQASWVRS

SEQ ID NO: 993862 - protein, 9 aa, Homo Sapiens
AAPYRGHPK

SEQ ID NO: 993863 - protein, 9 aa, Homo Sapiens
IIETERWNG

SEQ ID NO: 993864 - protein, 9 aa, Homo Sapiens
EAGTAPKPV

SEQ ID NO: 993865 - protein, 9 aa, Homo Sapiens
KSLLLGGPP

SEQ ID NO: 993866 - protein, 9 aa, Homo Sapiens
FKLLLLAVV

SEQ ID NO: 993867 - protein, 9 aa, Homo Sapiens
VAVLPLGTE

SEQ ID NO: 993868 - protein, 9 aa, Homo Sapiens
YRGHPKLLQ

SEQ ID NO: 993869 - protein, 9 aa, Homo Sapiens
VPPSMDTHS

SEQ ID NO: 993870 - protein, 9 aa, Homo Sapiens
TLSIVSRGG

SEQ ID NO: 993871 - protein, 9 aa, Homo Sapiens
LKSDPEPAA

SEQ ID NO: 993872 - protein, 9 aa, Homo Sapiens
SIVSRGGVS

SEQ ID NO: 993873 - protein, 9 aa, Homo Sapiens
THSWEGTKP

SEQ ID NO: 993874 - protein, 9 aa, Homo Sapiens
FFDKMLDDR

SEQ ID NO: 993875 - protein, 9 aa, Homo Sapiens
ERTIEDHKL

SEQ ID NO: 993876 - protein, 9 aa, Homo Sapiens
TIEDHKLVI

SEQ ID NO: 993877 - protein, 9 aa, Homo Sapiens
QLFGTNLDD

SEQ ID NO: 993878 - protein, 9 aa, Homo Sapiens
ASWVRSGVL

SEQ ID NO: 993879 - protein, 9 aa, Homo Sapiens
LLLLAVVLG

SEQ ID NO: 993880 - protein, 9 aa, Homo Sapiens
PHTRRKKSL

SEQ ID NO: 993881 - protein, 9 aa, Homo Sapiens
LEFCREFQR

SEQ ID NO: 993882 - protein, 9 aa, Homo Sapiens
DNMDEYVHN

SEQ ID NO: 993883 - protein, 9 aa, Homo Sapiens
DYIFFFDKM

SEQ ID NO: 993884 - protein, 9 aa, Homo Sapiens
PPSMDTHSW

SEQ ID NO: 993885 - protein, 9 aa, Homo Sapiens
QVLEALRLL

SEQ ID NO: 993886 - protein, 9 aa, Homo Sapiens
WLTLEFCRE

SEQ ID NO: 993887 - protein, 9 aa, Homo Sapiens
EGLYTLSIV

SEQ ID NO: 993888 - protein, 9 aa, Homo Sapiens
AQNRRIMPF

SEQ ID NO: 993889 - protein, 9 aa, Homo Sapiens
HTRRKKSLL

SEQ ID NO: 993890 - protein, 9 aa, Homo Sapiens
APYRGHPKL

SEQ ID NO: 993891 - protein, 9 aa, Homo Sapiens
GGPRSERRK

SEQ ID NO: 993892 - protein, 9 aa, Homo Sapiens
YTLSIVSRG

SEQ ID NO: 993893 - protein, 9 aa, Homo Sapiens
SNIPVFEYT

SEQ ID NO: 993894 - protein, 9 aa, Homo Sapiens
GLKSDPEPA

SEQ ID NO: 993895 - protein, 9 aa, Homo Sapiens
SIIRMKRIF

SEQ ID NO: 993896 - protein, 9 aa, Homo Sapiens
RKKSLLLGG

SEQ ID NO: 993897 - protein, 9 aa, Homo Sapiens
FVRKACPHQ

SEQ ID NO: 993898 - protein, 9 aa, Homo Sapiens
RHGIAEAVG

SEQ ID NO: 993899 - protein, 9 aa, Homo Sapiens
LSKNEQEGE

SEQ ID NO: 993900 - protein, 9 aa, Homo Sapiens
RSGVLWDVA

SEQ ID NO: 993901 - protein, 9 aa, Homo Sapiens
EGEAQLIHD

SEQ ID NO: 993902 - protein, 9 aa, Homo Sapiens
VRSGVLWDV

SEQ ID NO: 993903 - protein, 9 aa, Homo Sapiens
FCREFQRGT

SEQ ID NO: 993904 - protein, 9 aa, Homo Sapiens
NDYIFFFDK

SEQ ID NO: 993905 - protein, 9 aa, Homo Sapiens
KSIIRMKRI

SEQ ID NO: 993906 - protein, 9 aa, Homo Sapiens
REMKSIIRM

SEQ ID NO: 993907 - protein, 9 aa, Homo Sapiens
KLVIEVLSN

SEQ ID NO: 993908 - protein, 9 aa, Homo Sapiens
LGTENDLAR

SEQ ID NO: 993909 - protein, 9 aa, Homo Sapiens
ASNIPVFEY

SEQ ID NO: 993910 - protein, 9 aa, Homo Sapiens
YIFFFDKML

SEQ ID NO: 993911 - protein, 9 aa, Homo Sapiens
ANEYAYRHG

SEQ ID NO: 993912 - protein, 9 aa, Homo Sapiens
TENDLARCL

SEQ ID NO: 993913 - protein, 9 aa, Homo Sapiens
GTNLDDYLH

SEQ ID NO: 993914 - protein, 9 aa, Homo Sapiens
GPRSERRKW

SEQ ID NO: 993915 - protein, 9 aa, Homo Sapiens
GQFKCIKNQ

SEQ ID NO: 993916 - protein, 9 aa, Homo Sapiens
HKLVIEVLS

SEQ ID NO: 993917 - protein, 9 aa, Homo Sapiens
ALRLLAGHE

SEQ ID NO: 993918 - protein, 9 aa, Homo Sapiens
KNEQEGEAQ

SEQ ID NO: 993919 - protein, 9 aa, Homo Sapiens
EYTSAAAYI

SEQ ID NO: 993920 - protein, 9 aa, Homo Sapiens
IRMKRIFYR

SEQ ID NO: 993921 - protein, 9 aa, Homo Sapiens
KKSLLLGGP

SEQ ID NO: 993922 - protein, 9 aa, Homo Sapiens
TQNGDYQLW

SEQ ID NO: 993923 - protein, 9 aa, Homo Sapiens
MDTHSWEGT

SEQ ID NO: 993924 - protein, 9 aa, Homo Sapiens
GASNIPVFE

SEQ ID NO: 993925 - protein, 9 aa, Homo Sapiens
QFKCIKNQK

SEQ ID NO: 993926 - protein, 9 aa, Homo Sapiens
WTPIAQNRR

SEQ ID NO: 993927 - protein, 9 aa, Homo Sapiens
LAAIQLFGT

SEQ ID NO: 993928 - protein, 9 aa, Homo Sapiens
SWVRSGVLW

SEQ ID NO: 993929 - protein, 9 aa, Homo Sapiens
GPMFVRKAC

SEQ ID NO: 993930 - protein, 9 aa, Homo Sapiens
FGTNLDDYL

SEQ ID NO: 993931 - protein, 9 aa, Homo Sapiens
MFVRKACPH

SEQ ID NO: 993932 - protein, 9 aa, Homo Sapiens
AAIQLFGTN

SEQ ID NO: 993933 - protein, 9 aa, Homo Sapiens
LNDYIFFFD

SEQ ID NO: 993934 - protein, 9 aa, Homo Sapiens
LPLGTENDL

SEQ ID NO: 993935 - protein, 9 aa, Homo Sapiens
VERTIEDHK

SEQ ID NO: 993936 - protein, 9 aa, Homo Sapiens
TNLDDYLHL

SEQ ID NO: 993937 - protein, 9 aa, Homo Sapiens
QASWVRSGV

SEQ ID NO: 993938 - protein, 9 aa, Homo Sapiens
GLYTLSIVS

SEQ ID NO: 993939 - protein, 9 aa, Homo Sapiens
AVGPMFVRK

SEQ ID NO: 993940 - protein, 9 aa, Homo Sapiens
SKNEQEGEA

SEQ ID NO: 993941 - protein, 9 aa, Homo Sapiens
TPIAQNRRI

SEQ ID NO: 993942 - protein, 9 aa, Homo Sapiens
HPKLLQLPL

SEQ ID NO: 993943 - protein, 9 aa, Homo Sapiens
SPHTRRKKS

SEQ ID NO: 993944 - protein, 9 aa, Homo Sapiens
DEYVHNTTA

SEQ ID NO: 993945 - protein, 9 aa, Homo Sapiens
IQLFGTNLD

SEQ ID NO: 993946 - protein, 9 aa, Homo Sapiens
NEYAYRHGI

SEQ ID NO: 993947 - protein, 9 aa, Homo Sapiens
NRLNDYIFF

SEQ ID NO: 993948 - protein, 9 aa, Homo Sapiens
EYAYRHGIA

SEQ ID NO: 993949 - protein, 9 aa, Homo Sapiens
PIAQNRRIM

SEQ ID NO: 993950 - protein, 9 aa, Homo Sapiens
DDEGLYTLS

SEQ ID NO: 993951 - protein, 9 aa, Homo Sapiens
IPVFEYTSA

SEQ ID NO: 993952 - protein, 9 aa, Homo Sapiens
LLAVVLGFF

SEQ ID NO: 993953 - protein, 9 aa, Homo Sapiens
EEIIETERW

SEQ ID NO: 993954 - protein, 9 aa, Homo Sapiens
FKCIKNQKC

SEQ ID NO: 993955 - protein, 9 aa, Homo Sapiens
IAQNRRIMP

SEQ ID NO: 993956 - protein, 9 aa, Homo Sapiens
MDEYVHNTT

SEQ ID NO: 993957 - protein, 9 aa, Homo Sapiens
KSDPEPAAL

SEQ ID NO: 993958 - protein, 9 aa, Homo Sapiens
EMKSIIRMK

SEQ ID NO: 993959 - protein, 9 aa, Homo Sapiens
NGDYQLWTQ

SEQ ID NO: 993960 - protein, 9 aa, Homo Sapiens
SGVLWDVAL

SEQ ID NO: 993961 - protein, 9 aa, Homo Sapiens
PSMDTHSWE

SEQ ID NO: 993962 - protein, 9 aa, Homo Sapiens
EYVHNTTAR

SEQ ID NO: 993963 - protein, 9 aa, Homo Sapiens
SGQFKCIKN

SEQ ID NO: 993964 - protein, 9 aa, Homo Sapiens
SMGPPGLKS

SEQ ID NO: 993965 - protein, 9 aa, Homo Sapiens
LLKVPEAGT

SEQ ID NO: 993966 - protein, 9 aa, Homo Sapiens
DHKLVIEVL

SEQ ID NO: 993967 - protein, 9 aa, Homo Sapiens
VLGFFEGDA

SEQ ID NO: 993968 - protein, 9 aa, Homo Sapiens
DEGLYTLSI

SEQ ID NO: 993969 - protein, 9 aa, Homo Sapiens
VFEYTSAAA

SEQ ID NO: 993970 - protein, 9 aa, Homo Sapiens
RRKKSLLLG

SEQ ID NO: 993971 - protein, 9 aa, Homo Sapiens
GEAQLIHDR

SEQ ID NO: 993972 - protein, 9 aa, Homo Sapiens
EIIETERWN

SEQ ID NO: 993973 - protein, 9 aa, Homo Sapiens
VVLGFFEGD

SEQ ID NO: 993974 - protein, 9 aa, Homo Sapiens
LAVVLGFFE

SEQ ID NO: 993975 - protein, 9 aa, Homo Sapiens
FFFDKMLDD

SEQ ID NO: 993976 - protein, 9 aa, Homo Sapiens
IEDHKLVIE

SEQ ID NO: 993977 - protein, 9 aa, Homo Sapiens
LEALRLLAG

SEQ ID NO: 993978 - protein, 9 aa, Homo Sapiens
TRRKKSLLL

SEQ ID NO: 993979 - protein, 9 aa, Homo Sapiens
DTHSWEGTK

SEQ ID NO: 993980 - protein, 9 aa, Homo Sapiens
DVGGPRSER

SEQ ID NO: 993981 - protein, 9 aa, Homo Sapiens
DTKWLTLEF

SEQ ID NO: 993982 - protein, 9 aa, Homo Sapiens
VGGPRSERR

SEQ ID NO: 993983 - protein, 9 aa, Homo Sapiens
VPEAGTAPK

SEQ ID NO: 993984 - protein, 9 aa, Homo Sapiens
LLAGHEDGV

SEQ ID NO: 993985 - protein, 9 aa, Homo Sapiens
QEGEAQLIH

SEQ ID NO: 993986 - protein, 9 aa, Homo Sapiens
RLNDYIFFF

SEQ ID NO: 993987 - protein, 9 aa, Homo Sapiens
RIMPFPTEE

SEQ ID NO: 993988 - protein, 9 aa, Homo Sapiens
KLLLLAVVL

SEQ ID NO: 993989 - protein, 9 aa, Homo Sapiens
AALLKVPEA

SEQ ID NO: 993990 - protein, 9 aa, Homo Sapiens
VRKACPHQL

SEQ ID NO: 993991 - protein, 9 aa, Homo Sapiens
PLGTENDLA

SEQ ID NO: 993992 - protein, 9 aa, Homo Sapiens
VHNTTARAF

SEQ ID NO: 993993 - protein, 9 aa, Homo Sapiens
PAALLKVPE

SEQ ID NO: 993994 - protein, 9 aa, Homo Sapiens
HNTTARAFA

SEQ ID NO: 993995 - protein, 9 aa, Homo Sapiens
RRIMPFPTE

SEQ ID NO: 993996 - protein, 9 aa, Homo Sapiens
KCIKNQKCI

SEQ ID NO: 993997 - protein, 9 aa, Homo Sapiens
ALLKVPEAG

SEQ ID NO: 993998 - protein, 9 aa, Homo Sapiens
MVDVGGPRS

SEQ ID NO: 993999 - protein, 9 aa, Homo Sapiens
YAYRHGIAE

SEQ ID NO: 994000 - protein, 9 aa, Homo Sapiens
LQASWVRSG

SEQ ID NO: 994001 - protein, 9 aa, Homo Sapiens
LRLLAGHED

SEQ ID NO: 994002 - protein, 9 aa, Homo Sapiens
LSNEEIIET

SEQ ID NO: 994003 - protein, 9 aa, Homo Sapiens
SNEEIIETE

SEQ ID NO: 994004 - protein, 9 aa, Homo Sapiens
RMVDVGGPR

SEQ ID NO: 994005 - protein, 9 aa, Homo Sapiens
LLLAVVLGF

SEQ ID NO: 994006 - protein, 9 aa, Homo Sapiens
LKVPEAGTA

SEQ ID NO: 994007 - protein, 9 aa, Homo Sapiens
PYRGHPKLL

SEQ ID NO: 994008 - protein, 9 aa, Homo Sapiens
EFCREFQRG

SEQ ID NO: 994009 - protein, 9 aa, Homo Sapiens
ESLSNEEII

SEQ ID NO: 994010 - protein, 9 aa, Homo Sapiens
MKSIIRMKR

SEQ ID NO: 994011 - protein, 9 aa, Homo Sapiens
IFFFDKMLD

SEQ ID NO: 994012 - protein, 9 aa, Homo Sapiens
ESMGPPGLK

SEQ ID NO: 994013 - protein, 9 aa, Homo Sapiens
TLEFCREFQ

SEQ ID NO: 994014 - protein, 9 aa, Homo Sapiens
GPPGLKSDP

SEQ ID NO: 994015 - protein, 9 aa, Homo Sapiens
NRRIMPFPT

SEQ ID NO: 994016 - protein, 9 aa, Homo Sapiens
PRSERRKWI

SEQ ID NO: 994017 - protein, 9 aa, Homo Sapiens
GHPKLLQLP

SEQ ID NO: 994018 - protein, 9 aa, Homo Sapiens
NMDEYVHNT

SEQ ID NO: 994019 - protein, 9 aa, Homo Sapiens
LFGTNLDDY

SEQ ID NO: 994020 - protein, 9 aa, Homo Sapiens
PPGLKSDPE

SEQ ID NO: 994021 - protein, 9 aa, Homo Sapiens
AVLPLGTEN

SEQ ID NO: 994022 - protein, 9 aa, Homo Sapiens
IDNMDEYVH

SEQ ID NO: 994023 - protein, 9 aa, Homo Sapiens
VDVGGPRSE

SEQ ID NO: 994024 - protein, 9 aa, Homo Sapiens
TKWLTLEFC

SEQ ID NO: 994025 - protein, 9 aa, Homo Sapiens
LESLSNEEI

SEQ ID NO: 994026 - protein, 9 aa, Homo Sapiens
GTENDLARC

SEQ ID NO: 994027 - protein, 9 aa, Homo Sapiens
SLSNEEIIE

SEQ ID NO: 994028 - protein, 9 aa, Homo Sapiens
PGLKSDPEP

SEQ ID NO: 994029 - protein, 9 aa, Homo Sapiens
RKACPHQLL

SEQ ID NO: 994030 - protein, 9 aa, Homo Sapiens
HSWEGTKPP

SEQ ID NO: 994031 - protein, 9 aa, Homo Sapiens
YRHGIAEAV

SEQ ID NO: 994032 - protein, 9 aa, Homo Sapiens
NEEIIETER

SEQ ID NO: 994033 - protein, 9 aa, Homo Sapiens
RLLAGHEDG

SEQ ID NO: 994034 - protein, 9 aa, Homo Sapiens
NIPVFEYTS

SEQ ID NO: 994035 - protein, 9 aa, Homo Sapiens
SMDTHSWEG

SEQ ID NO: 994036 - protein, 9 aa, Homo Sapiens
SAREMKSII

SEQ ID NO: 994037 - protein, 9 aa, Homo Sapiens
LTLEFCREF

SEQ ID NO: 994038 - protein, 9 aa, Homo Sapiens
LYTLSIVSR

SEQ ID NO: 994039 - protein, 9 aa, Homo Sapiens
PVFEYTSAA

SEQ ID NO: 994040 - protein, 9 aa, Homo Sapiens
WVRSGVLWD

SEQ ID NO: 994041 - protein, 9 aa, Homo Sapiens
VLPLGTEND

SEQ ID NO: 994042 - protein, 9 aa, Homo Sapiens
FRMVDVGGP

SEQ ID NO: 994043 - protein, 9 aa, Homo Sapiens
AREMKSIIR

SEQ ID NO: 994044 - protein, 9 aa, Homo Sapiens
PEAGTAPKP

SEQ ID NO: 994045 - protein, 9 aa, Homo Sapiens
CIKNQKCIP

SEQ ID NO: 994046 - protein, 9 aa, Homo Sapiens
KVPEAGTAP

SEQ ID NO: 994047 - protein, 9 aa, Homo Sapiens
NEQEGEAQL

SEQ ID NO: 994048 - protein, 9 aa, Homo Sapiens
AYRHGIAEA

SEQ ID NO: 994049 - protein, 9 aa, Homo Sapiens
VGPMFVRKA

SEQ ID NO: 994050 - protein, 9 aa, Homo Sapiens
CLSGQFKCI

SEQ ID NO: 994051 - protein, 9 aa, Homo Sapiens
MGPPGLKSD

SEQ ID NO: 994052 - protein, 9 aa, Homo Sapiens
ENDLARCLR

SEQ ID NO: 994053 - protein, 9 aa, Homo Sapiens
HGIAEAVGL

SEQ ID NO: 994054 - protein, 9 aa, Homo Sapiens
VLEALRLLA

SEQ ID NO: 994055 - protein, 9 aa, Homo Sapiens
FEYTSAAAY

SEQ ID NO: 994056 - protein, 9 aa, Homo Sapiens
PIILGGFGN

SEQ ID NO: 994057 - protein, 9 aa, Homo Sapiens
KMTNYNVEH

SEQ ID NO: 994058 - protein, 9 aa, Homo Sapiens
NYRGPKQTA

SEQ ID NO: 994059 - protein, 9 aa, Homo Sapiens
TLNKKTYPG

SEQ ID NO: 994060 - protein, 9 aa, Homo Sapiens
DIKNDSKYV

SEQ ID NO: 994061 - protein, 9 aa, Homo Sapiens
CSSNLILHQ

SEQ ID NO: 994062 - protein, 9 aa, Homo Sapiens
RCIFGVTQK

SEQ ID NO: 994063 - protein, 9 aa, Homo Sapiens
TNYNVEHTI

SEQ ID NO: 994064 - protein, 9 aa, Homo Sapiens
EEHGVTQTD

SEQ ID NO: 994065 - protein, 9 aa, Homo Sapiens
LSKKQKETQ

SEQ ID NO: 994066 - protein, 9 aa, Homo Sapiens
CQKFFIDSC

SEQ ID NO: 994067 - protein, 9 aa, Homo Sapiens
IMDALRDLN

SEQ ID NO: 994068 - protein, 9 aa, Homo Sapiens
VAPKDRVAL

SEQ ID NO: 994069 - protein, 9 aa, Homo Sapiens
GEKVRTFVL

SEQ ID NO: 994070 - protein, 9 aa, Homo Sapiens
LMVGSAADA

SEQ ID NO: 994071 - protein, 9 aa, Homo Sapiens
SIISYIVKY

SEQ ID NO: 994072 - protein, 9 aa, Homo Sapiens
ASQIWNLNP

SEQ ID NO: 994073 - protein, 9 aa, Homo Sapiens
CIFGVTQKT

SEQ ID NO: 994074 - protein, 9 aa, Homo Sapiens
SLVHMIFGL

SEQ ID NO: 994075 - protein, 9 aa, Homo Sapiens
LQGVRRDFA

SEQ ID NO: 994076 - protein, 9 aa, Homo Sapiens
IELQCGTQL

SEQ ID NO: 994077 - protein, 9 aa, Homo Sapiens
AGEIIRGTE

SEQ ID NO: 994078 - protein, 9 aa, Homo Sapiens
IGEKVRTFV

SEQ ID NO: 994079 - protein, 9 aa, Homo Sapiens
ATQPHGYLA

SEQ ID NO: 994080 - protein, 9 aa, Homo Sapiens
GVSGGDQTL

SEQ ID NO: 994081 - protein, 9 aa, Homo Sapiens
GTVLYMDPE

SEQ ID NO: 994082 - protein, 9 aa, Homo Sapiens
PTGLLPNPR

SEQ ID NO: 994083 - protein, 9 aa, Homo Sapiens
KGWQALPTE

SEQ ID NO: 994084 - protein, 9 aa, Homo Sapiens
DSQACIEEQ

SEQ ID NO: 994085 - protein, 9 aa, Homo Sapiens
PAGDTRTPR

SEQ ID NO: 994086 - protein, 9 aa, Homo Sapiens
EPKAGQQLC

SEQ ID NO: 994087 - protein, 9 aa, Homo Sapiens
MTNYNVEHT

SEQ ID NO: 994088 - protein, 9 aa, Homo Sapiens
CIEGVVVRD

SEQ ID NO: 994089 - protein, 9 aa, Homo Sapiens
KKTYPGVKS

SEQ ID NO: 994090 - protein, 9 aa, Homo Sapiens
RRDSAAIGG

SEQ ID NO: 994091 - protein, 9 aa, Homo Sapiens
FGLSLQICL

SEQ ID NO: 994092 - protein, 9 aa, Homo Sapiens
NKKTYPGVK

SEQ ID NO: 994093 - protein, 9 aa, Homo Sapiens
QEPKAGQQL

SEQ ID NO: 994094 - protein, 9 aa, Homo Sapiens
KTYPGVKSC

SEQ ID NO: 994095 - protein, 9 aa, Homo Sapiens
CPSSSSSVS

SEQ ID NO: 994096 - protein, 9 aa, Homo Sapiens
ALKLEPKER

SEQ ID NO: 994097 - protein, 9 aa, Homo Sapiens
MTLSERFTS

SEQ ID NO: 994098 - protein, 9 aa, Homo Sapiens
IIRGTECKP

SEQ ID NO: 994099 - protein, 9 aa, Homo Sapiens
TGLLPNPRL

SEQ ID NO: 994100 - protein, 9 aa, Homo Sapiens
DTRTPRPPP

SEQ ID NO: 994101 - protein, 9 aa, Homo Sapiens
KTFGCSSNL

SEQ ID NO: 994102 - protein, 9 aa, Homo Sapiens
GEEEEEETG

SEQ ID NO: 994103 - protein, 9 aa, Homo Sapiens
RYGVSGGDQ

SEQ ID NO: 994104 - protein, 9 aa, Homo Sapiens
HVCAFFLQA

SEQ ID NO: 994105 - protein, 9 aa, Homo Sapiens
YGVSGGDQT

SEQ ID NO: 994106 - protein, 9 aa, Homo Sapiens
LTSLLMQPI

SEQ ID NO: 994107 - protein, 9 aa, Homo Sapiens
VRDKYGDGV

SEQ ID NO: 994108 - protein, 9 aa, Homo Sapiens
QDESEEEEG

SEQ ID NO: 994109 - protein, 9 aa, Homo Sapiens
FGCSSNLIL

SEQ ID NO: 994110 - protein, 9 aa, Homo Sapiens
HMIFGLSLQ

SEQ ID NO: 994111 - protein, 9 aa, Homo Sapiens
LVAEMNRLG

SEQ ID NO: 994112 - protein, 9 aa, Homo Sapiens
HRVAVKGWQ

SEQ ID NO: 994113 - protein, 9 aa, Homo Sapiens
EKIMKLSLP

SEQ ID NO: 994114 - protein, 9 aa, Homo Sapiens
EPFPAADMK

SEQ ID NO: 994115 - protein, 9 aa, Homo Sapiens
GGPTGLLPN

SEQ ID NO: 994116 - protein, 9 aa, Homo Sapiens
GINDKCTLN

SEQ ID NO: 994117 - protein, 9 aa, Homo Sapiens
EYRYGVSGG

SEQ ID NO: 994118 - protein, 9 aa, Homo Sapiens
EKVRTFVLA

SEQ ID NO: 994119 - protein, 9 aa, Homo Sapiens
PPAENLSAP

SEQ ID NO: 994120 - protein, 9 aa, Homo Sapiens
DSAAIGGVI

SEQ ID NO: 994121 - protein, 9 aa, Homo Sapiens
EMCQKFFID

SEQ ID NO: 994122 - protein, 9 aa, Homo Sapiens
CRQDIQHFT

SEQ ID NO: 994123 - protein, 9 aa, Homo Sapiens
TDFGEKLVA

SEQ ID NO: 994124 - protein, 9 aa, Homo Sapiens
IRGTECKPH

SEQ ID NO: 994125 - protein, 9 aa, Homo Sapiens
LVHMIFGLS

SEQ ID NO: 994126 - protein, 9 aa, Homo Sapiens
PRCIFGVTQ

SEQ ID NO: 994127 - protein, 9 aa, Homo Sapiens
LQDPALALQ

SEQ ID NO: 994128 - protein, 9 aa, Homo Sapiens
EAQEPKAGQ

SEQ ID NO: 994129 - protein, 9 aa, Homo Sapiens
RTFVLALVN

SEQ ID NO: 994130 - protein, 9 aa, Homo Sapiens
AEAGEIIRG

SEQ ID NO: 994131 - protein, 9 aa, Homo Sapiens
GPGRPESIK

SEQ ID NO: 994132 - protein, 9 aa, Homo Sapiens
LQCGTQLCL

SEQ ID NO: 994133 - protein, 9 aa, Homo Sapiens
NPNGSIISY

SEQ ID NO: 994134 - protein, 9 aa, Homo Sapiens
VHMIFGLSL

SEQ ID NO: 994135 - protein, 9 aa, Homo Sapiens
VRTFVLALV

SEQ ID NO: 994136 - protein, 9 aa, Homo Sapiens
QDPALALQG

SEQ ID NO: 994137 - protein, 9 aa, Homo Sapiens
NTALHIARY

SEQ ID NO: 994138 - protein, 9 aa, Homo Sapiens
FDISLVAPK

SEQ ID NO: 994139 - protein, 9 aa, Homo Sapiens
FPAADMKKK

SEQ ID NO: 994140 - protein, 9 aa, Homo Sapiens
LPHVCAFFL

SEQ ID NO: 994141 - protein, 9 aa, Homo Sapiens
PSSSSSVSC

SEQ ID NO: 994142 - protein, 9 aa, Homo Sapiens
TSYGNNLYF

SEQ ID NO: 994143 - protein, 9 aa, Homo Sapiens
ACIEGVVVR

SEQ ID NO: 994144 - protein, 9 aa, Homo Sapiens
ATFDISLVA

SEQ ID NO: 994145 - protein, 9 aa, Homo Sapiens
GLMVGSAAD

SEQ ID NO: 994146 - protein, 9 aa, Homo Sapiens
IARYNGQDA

SEQ ID NO: 994147 - protein, 9 aa, Homo Sapiens
IWLDIMIER

SEQ ID NO: 994148 - protein, 9 aa, Homo Sapiens
MPPPPPPAP

SEQ ID NO: 994149 - protein, 9 aa, Homo Sapiens
FGEKLVAEM

SEQ ID NO: 994150 - protein, 9 aa, Homo Sapiens
SALTNGSQL

SEQ ID NO: 994151 - protein, 9 aa, Homo Sapiens
IQHFTQATL

SEQ ID NO: 994152 - protein, 9 aa, Homo Sapiens
SFGINDKCT

SEQ ID NO: 994153 - protein, 9 aa, Homo Sapiens
TFVLALVNS

SEQ ID NO: 994154 - protein, 9 aa, Homo Sapiens
AVKGWQALP

SEQ ID NO: 994155 - protein, 9 aa, Homo Sapiens
TFGCSSNLI

SEQ ID NO: 994156 - protein, 9 aa, Homo Sapiens
INDKCTLNK

SEQ ID NO: 994157 - protein, 9 aa, Homo Sapiens
EIGEKVRTF

SEQ ID NO: 994158 - protein, 9 aa, Homo Sapiens
KLSKKQKET

SEQ ID NO: 994159 - protein, 9 aa, Homo Sapiens
VCAFFLQAT

SEQ ID NO: 994160 - protein, 9 aa, Homo Sapiens
RSNLTSLLM

SEQ ID NO: 994161 - protein, 9 aa, Homo Sapiens
RPRAPRPPP

SEQ ID NO: 994162 - protein, 9 aa, Homo Sapiens
NLSAPEAEQ

SEQ ID NO: 994163 - protein, 9 aa, Homo Sapiens
SYGNNLYFT

SEQ ID NO: 994164 - protein, 9 aa, Homo Sapiens
SGYGKYPGI

SEQ ID NO: 994165 - protein, 9 aa, Homo Sapiens
KPNKSEECG

SEQ ID NO: 994166 - protein, 9 aa, Homo Sapiens
VCRQDIQHF

SEQ ID NO: 994167 - protein, 9 aa, Homo Sapiens
DPPAENLSA

SEQ ID NO: 994168 - protein, 9 aa, Homo Sapiens
ELQCGTQLC

SEQ ID NO: 994169 - protein, 9 aa, Homo Sapiens
FGVTQKTIW

SEQ ID NO: 994170 - protein, 9 aa, Homo Sapiens
RPTSRSRPR

SEQ ID NO: 994171 - protein, 9 aa, Homo Sapiens
YLKLSKKQK

SEQ ID NO: 994172 - protein, 9 aa, Homo Sapiens
FGNSEGNVG

SEQ ID NO: 994173 - protein, 9 aa, Homo Sapiens
EAEILTGLM

SEQ ID NO: 994174 - protein, 9 aa, Homo Sapiens
WLDIMIERR

SEQ ID NO: 994175 - protein, 9 aa, Homo Sapiens
VYADGPGRP

SEQ ID NO: 994176 - protein, 9 aa, Homo Sapiens
FLVFLLMLS

SEQ ID NO: 994177 - protein, 9 aa, Homo Sapiens
EMTNTDSQN

SEQ ID NO: 994178 - protein, 9 aa, Homo Sapiens
EGVVVRDKY

SEQ ID NO: 994179 - protein, 9 aa, Homo Sapiens
KEERPTSRS

SEQ ID NO: 994180 - protein, 9 aa, Homo Sapiens
QQLQPRSNY

SEQ ID NO: 994181 - protein, 9 aa, Homo Sapiens
QIWNLNPVF

SEQ ID NO: 994182 - protein, 9 aa, Homo Sapiens
GGGPTGLLP

SEQ ID NO: 994183 - protein, 9 aa, Homo Sapiens
LALQGVRRD

SEQ ID NO: 994184 - protein, 9 aa, Homo Sapiens
KNVVHELTI

SEQ ID NO: 994185 - protein, 9 aa, Homo Sapiens
DFGEKLVAE

SEQ ID NO: 994186 - protein, 9 aa, Homo Sapiens
IERRKTEGV

SEQ ID NO: 994187 - protein, 9 aa, Homo Sapiens
SGGDQTLTI

SEQ ID NO: 994188 - protein, 9 aa, Homo Sapiens
GFGNSEGNV

SEQ ID NO: 994189 - protein, 9 aa, Homo Sapiens
LYCEMCQKF

SEQ ID NO: 994190 - protein, 9 aa, Homo Sapiens
MIERRKTEG

SEQ ID NO: 994191 - protein, 9 aa, Homo Sapiens
NVEHTIKKE

SEQ ID NO: 994192 - protein, 9 aa, Homo Sapiens
DGPGRPESI

SEQ ID NO: 994193 - protein, 9 aa, Homo Sapiens
TSLLMQPIS

SEQ ID NO: 994194 - protein, 9 aa, Homo Sapiens
GKTFGCSSN

SEQ ID NO: 994195 - protein, 9 aa, Homo Sapiens
PFIMDALRD

SEQ ID NO: 994196 - protein, 9 aa, Homo Sapiens
ALALQGVRR

SEQ ID NO: 994197 - protein, 9 aa, Homo Sapiens
LKLSKKQKE

SEQ ID NO: 994198 - protein, 9 aa, Homo Sapiens
PNKSEECGK

SEQ ID NO: 994199 - protein, 9 aa, Homo Sapiens
KEMTNTDSQ

SEQ ID NO: 994200 - protein, 9 aa, Homo Sapiens
YRYGVSGGD

SEQ ID NO: 994201 - protein, 9 aa, Homo Sapiens
SSARATQPH

SEQ ID NO: 994202 - protein, 9 aa, Homo Sapiens
NGSQLPSRD

SEQ ID NO: 994203 - protein, 9 aa, Homo Sapiens
ALHIARYNG

SEQ ID NO: 994204 - protein, 9 aa, Homo Sapiens
SRSRPRRRP

SEQ ID NO: 994205 - protein, 9 aa, Homo Sapiens
KIMKLSLPE

SEQ ID NO: 994206 - protein, 9 aa, Homo Sapiens
AGDTRTPRP

SEQ ID NO: 994207 - protein, 9 aa, Homo Sapiens
TGVVLNLDK

SEQ ID NO: 994208 - protein, 9 aa, Homo Sapiens
VTQTDHMAT

SEQ ID NO: 994209 - protein, 9 aa, Homo Sapiens
GSALTNGSQ

SEQ ID NO: 994210 - protein, 9 aa, Homo Sapiens
DYIWLDIMI

SEQ ID NO: 994211 - protein, 9 aa, Homo Sapiens
NLTSLLMQP

SEQ ID NO: 994212 - protein, 9 aa, Homo Sapiens
DDTLNKKTY

SEQ ID NO: 994213 - protein, 9 aa, Homo Sapiens
VSKEKEERP

SEQ ID NO: 994214 - protein, 9 aa, Homo Sapiens
RYNGQDAVV

SEQ ID NO: 994215 - protein, 9 aa, Homo Sapiens
TPPNPNGSI

SEQ ID NO: 994216 - protein, 9 aa, Homo Sapiens
ILGGFGNSE

SEQ ID NO: 994217 - protein, 9 aa, Homo Sapiens
NTPPNPNGS

SEQ ID NO: 994218 - protein, 9 aa, Homo Sapiens
RPRCIFGVT

SEQ ID NO: 994219 - protein, 9 aa, Homo Sapiens
NADRRDSAA

SEQ ID NO: 994220 - protein, 9 aa, Homo Sapiens
KSSLVHMIF

SEQ ID NO: 994221 - protein, 9 aa, Homo Sapiens
LGAWCLPHV

SEQ ID NO: 994222 - protein, 9 aa, Homo Sapiens
IFGVTQKTI

SEQ ID NO: 994223 - protein, 9 aa, Homo Sapiens
SYSYYLKLS

SEQ ID NO: 994224 - protein, 9 aa, Homo Sapiens
NGSIISYIV

SEQ ID NO: 994225 - protein, 9 aa, Homo Sapiens
LFLVFLLML

SEQ ID NO: 994226 - protein, 9 aa, Homo Sapiens
AATTTEAQE

SEQ ID NO: 994227 - protein, 9 aa, Homo Sapiens
PAENLSAPE

SEQ ID NO: 994228 - protein, 9 aa, Homo Sapiens
DPALALQGV

SEQ ID NO: 994229 - protein, 9 aa, Homo Sapiens
TTTEAQEPK

SEQ ID NO: 994230 - protein, 9 aa, Homo Sapiens
GWQALPTEA

SEQ ID NO: 994231 - protein, 9 aa, Homo Sapiens
NKSEECGKA

SEQ ID NO: 994232 - protein, 9 aa, Homo Sapiens
SARATQPHG

SEQ ID NO: 994233 - protein, 9 aa, Homo Sapiens
AWCLPHVCA

SEQ ID NO: 994234 - protein, 9 aa, Homo Sapiens
YSYYLKLSK

SEQ ID NO: 994235 - protein, 9 aa, Homo Sapiens
IFGLSLQIC

SEQ ID NO: 994236 - protein, 9 aa, Homo Sapiens
GPKQTAATT

SEQ ID NO: 994237 - protein, 9 aa, Homo Sapiens
TAATTTEAQ

SEQ ID NO: 994238 - protein, 9 aa, Homo Sapiens
LSAPEAEQG

SEQ ID NO: 994239 - protein, 9 aa, Homo Sapiens
HELTITNQV

SEQ ID NO: 994240 - protein, 9 aa, Homo Sapiens
AIGGVIAVV

SEQ ID NO: 994241 - protein, 9 aa, Homo Sapiens
EERPTSRSR

SEQ ID NO: 994242 - protein, 9 aa, Homo Sapiens
TTEAQEPKA

SEQ ID NO: 994243 - protein, 9 aa, Homo Sapiens
VSGGDQTLT

SEQ ID NO: 994244 - protein, 9 aa, Homo Sapiens
ARYNGQDAV

SEQ ID NO: 994245 - protein, 9 aa, Homo Sapiens
RDIKNDSKY

SEQ ID NO: 994246 - protein, 9 aa, Homo Sapiens
KLVAEMNRL

SEQ ID NO: 994247 - protein, 9 aa, Homo Sapiens
IMIERRKTE

SEQ ID NO: 994248 - protein, 9 aa, Homo Sapiens
SASQIWNLN

SEQ ID NO: 994249 - protein, 9 aa, Homo Sapiens
RATQPHGYL

SEQ ID NO: 994250 - protein, 9 aa, Homo Sapiens
LSERFTSYQ

SEQ ID NO: 994251 - protein, 9 aa, Homo Sapiens
EPAGDTRTP

SEQ ID NO: 994252 - protein, 9 aa, Homo Sapiens
NYNVEHTIK

SEQ ID NO: 994253 - protein, 9 aa, Homo Sapiens
ADGPGRPES

SEQ ID NO: 994254 - protein, 9 aa, Homo Sapiens
NDKCTLNKD

SEQ ID NO: 994255 - protein, 9 aa, Homo Sapiens
KSGYGKYPG

SEQ ID NO: 994256 - protein, 9 aa, Homo Sapiens
LVAPKDRVA

SEQ ID NO: 994257 - protein, 9 aa, Homo Sapiens
KPMLTRLGS

SEQ ID NO: 994258 - protein, 9 aa, Homo Sapiens
PGINSDELV

SEQ ID NO: 994259 - protein, 9 aa, Homo Sapiens
PHVCAFFLQ

SEQ ID NO: 994260 - protein, 9 aa, Homo Sapiens
VPNGSALTN

SEQ ID NO: 994261 - protein, 9 aa, Homo Sapiens
MGKPMLTRL

SEQ ID NO: 994262 - protein, 9 aa, Homo Sapiens
LPLVIGTVL

SEQ ID NO: 994263 - protein, 9 aa, Homo Sapiens
TGEKPNKSE

SEQ ID NO: 994264 - protein, 9 aa, Homo Sapiens
PNPNGSIIS

SEQ ID NO: 994265 - protein, 9 aa, Homo Sapiens
TLRPRCIFG

SEQ ID NO: 994266 - protein, 9 aa, Homo Sapiens
ERPTSRSRP

SEQ ID NO: 994267 - protein, 9 aa, Homo Sapiens
GMPPPPPPA

SEQ ID NO: 994268 - protein, 9 aa, Homo Sapiens
MTNTDSQNE

SEQ ID NO: 994269 - protein, 9 aa, Homo Sapiens
IKNVVHELT

SEQ ID NO: 994270 - protein, 9 aa, Homo Sapiens
FGINDKCTL

SEQ ID NO: 994271 - protein, 9 aa, Homo Sapiens
GQEIELQCG

SEQ ID NO: 994272 - protein, 9 aa, Homo Sapiens
EHGVTQTDH

SEQ ID NO: 994273 - protein, 9 aa, Homo Sapiens
TITNQVIYL

SEQ ID NO: 994274 - protein, 9 aa, Homo Sapiens
LTITNQVIY

SEQ ID NO: 994275 - protein, 9 aa, Homo Sapiens
ASFSSSARA

SEQ ID NO: 994276 - protein, 9 aa, Homo Sapiens
TNGSQLPSR

SEQ ID NO: 994277 - protein, 9 aa, Homo Sapiens
GSIISYIVK

SEQ ID NO: 994278 - protein, 9 aa, Homo Sapiens
DIMIERRKT

SEQ ID NO: 994279 - protein, 9 aa, Homo Sapiens
EIELQCGTQ

SEQ ID NO: 994280 - protein, 9 aa, Homo Sapiens
PFPAADMKK

SEQ ID NO: 994281 - protein, 9 aa, Homo Sapiens
ARATQPHGY

SEQ ID NO: 994282 - protein, 9 aa, Homo Sapiens
ISLVAPKDR

SEQ ID NO: 994283 - protein, 9 aa, Homo Sapiens
PRAPRPPPT

SEQ ID NO: 994284 - protein, 9 aa, Homo Sapiens
EKLVAEMNR

SEQ ID NO: 994285 - protein, 9 aa, Homo Sapiens
SEEEEGDVE

SEQ ID NO: 994286 - protein, 9 aa, Homo Sapiens
MVGSAADAG

SEQ ID NO: 994287 - protein, 9 aa, Homo Sapiens
TNTDSQNEG

SEQ ID NO: 994288 - protein, 9 aa, Homo Sapiens
GACIEGVVV

SEQ ID NO: 994289 - protein, 9 aa, Homo Sapiens
PVYADGPGR

SEQ ID NO: 994290 - protein, 9 aa, Homo Sapiens
KFFIDSCAA

SEQ ID NO: 994291 - protein, 9 aa, Homo Sapiens
LKSGYGKYP

SEQ ID NO: 994292 - protein, 9 aa, Homo Sapiens
DRRDSAAIG

SEQ ID NO: 994293 - protein, 9 aa, Homo Sapiens
SQKSIPEPF

SEQ ID NO: 994294 - protein, 9 aa, Homo Sapiens
DHMATIEAH

SEQ ID NO: 994295 - protein, 9 aa, Homo Sapiens
ATGVVLNLD

SEQ ID NO: 994296 - protein, 9 aa, Homo Sapiens
SQIWNLNPV

SEQ ID NO: 994297 - protein, 9 aa, Homo Sapiens
GPSKALKLE

SEQ ID NO: 994298 - protein, 9 aa, Homo Sapiens
WNLNPVFGG

SEQ ID NO: 994299 - protein, 9 aa, Homo Sapiens
KCTLNKDDA

SEQ ID NO: 994300 - protein, 9 aa, Homo Sapiens
KLSLPESLK

SEQ ID NO: 994301 - protein, 9 aa, Homo Sapiens
QLLKEMTNT

SEQ ID NO: 994302 - protein, 9 aa, Homo Sapiens
PPNPNGSII

SEQ ID NO: 994303 - protein, 9 aa, Homo Sapiens
QTDHMATIE

SEQ ID NO: 994304 - protein, 9 aa, Homo Sapiens
NDSKYVVKG

SEQ ID NO: 994305 - protein, 9 aa, Homo Sapiens
YPGINSDEL

SEQ ID NO: 994306 - protein, 9 aa, Homo Sapiens
DIQHFTQAT

SEQ ID NO: 994307 - protein, 9 aa, Homo Sapiens
PQQLQPRSN

SEQ ID NO: 994308 - protein, 9 aa, Homo Sapiens
DGQEIELQC

SEQ ID NO: 994309 - protein, 9 aa, Homo Sapiens
SNLTSLLMQ

SEQ ID NO: 994310 - protein, 9 aa, Homo Sapiens
LMQPISAPL

SEQ ID NO: 994311 - protein, 9 aa, Homo Sapiens
SRLSASQIW

SEQ ID NO: 994312 - protein, 9 aa, Homo Sapiens
SLLMQPISA

SEQ ID NO: 994313 - protein, 9 aa, Homo Sapiens
GEIIRGTEC

SEQ ID NO: 994314 - protein, 9 aa, Homo Sapiens
RPRRRPRAP

SEQ ID NO: 994315 - protein, 9 aa, Homo Sapiens
SKEKEERPT

SEQ ID NO: 994316 - protein, 9 aa, Homo Sapiens
GVVVRDKYG

SEQ ID NO: 994317 - protein, 9 aa, Homo Sapiens
PKAGQQLCA

SEQ ID NO: 994318 - protein, 9 aa, Homo Sapiens
GGFGNSEGN

SEQ ID NO: 994319 - protein, 9 aa, Homo Sapiens
VLNLDKSIK

SEQ ID NO: 994320 - protein, 9 aa, Homo Sapiens
QCGTQLCLL

SEQ ID NO: 994321 - protein, 9 aa, Homo Sapiens
HTGEKPNKS

SEQ ID NO: 994322 - protein, 9 aa, Homo Sapiens
LVIGTVLYM

SEQ ID NO: 994323 - protein, 9 aa, Homo Sapiens
KSIPEPFPA

SEQ ID NO: 994324 - protein, 9 aa, Homo Sapiens
YNVEHTIKK

SEQ ID NO: 994325 - protein, 9 aa, Homo Sapiens
LTDFGEKLV

SEQ ID NO: 994326 - protein, 9 aa, Homo Sapiens
IAATGVVLN

SEQ ID NO: 994327 - protein, 9 aa, Homo Sapiens
GDTRTPRPP

SEQ ID NO: 994328 - protein, 9 aa, Homo Sapiens
ALQGVRRDF

SEQ ID NO: 994329 - protein, 9 aa, Homo Sapiens
GRPESIKAY

SEQ ID NO: 994330 - protein, 9 aa, Homo Sapiens
APKDRVALS

SEQ ID NO: 994331 - protein, 9 aa, Homo Sapiens
LDIMIERRK

SEQ ID NO: 994332 - protein, 9 aa, Homo Sapiens
VAVKGWQAL

SEQ ID NO: 994333 - protein, 9 aa, Homo Sapiens
DKCTLNKDD

SEQ ID NO: 994334 - protein, 9 aa, Homo Sapiens
LSASQIWNL

SEQ ID NO: 994335 - protein, 9 aa, Homo Sapiens
ADRRDSAAI

SEQ ID NO: 994336 - protein, 9 aa, Homo Sapiens
QTAATTTEA

SEQ ID NO: 994337 - protein, 9 aa, Homo Sapiens
ALTNGSQLP

SEQ ID NO: 994338 - protein, 9 aa, Homo Sapiens
QKFFIDSCA

SEQ ID NO: 994339 - protein, 9 aa, Homo Sapiens
GSGGGGPTG

SEQ ID NO: 994340 - protein, 9 aa, Homo Sapiens
YCEMCQKFF

SEQ ID NO: 994341 - protein, 9 aa, Homo Sapiens
WCLPHVCAF

SEQ ID NO: 994342 - protein, 9 aa, Homo Sapiens
AMTLSERFT

SEQ ID NO: 994343 - protein, 9 aa, Homo Sapiens
KALKLEPKE

SEQ ID NO: 994344 - protein, 9 aa, Homo Sapiens
REKIMKLSL

SEQ ID NO: 994345 - protein, 9 aa, Homo Sapiens
SKALKLEPK

SEQ ID NO: 994346 - protein, 9 aa, Homo Sapiens
IKMTNYNVE

SEQ ID NO: 994347 - protein, 9 aa, Homo Sapiens
LKEMTNTDS

SEQ ID NO: 994348 - protein, 9 aa, Homo Sapiens
PSKALKLEP

SEQ ID NO: 994349 - protein, 9 aa, Homo Sapiens
RQDIQHFTQ

SEQ ID NO: 994350 - protein, 9 aa, Homo Sapiens
TFDISLVAP

SEQ ID NO: 994351 - protein, 9 aa, Homo Sapiens
EKPNKSEEC

SEQ ID NO: 994352 - protein, 9 aa, Homo Sapiens
RTPRPPPAA

SEQ ID NO: 994353 - protein, 9 aa, Homo Sapiens
PLVIGTVLY

SEQ ID NO: 994354 - protein, 9 aa, Homo Sapiens
RSNYRGPKQ

SEQ ID NO: 994355 - protein, 9 aa, Homo Sapiens
SFSSSARAT

SEQ ID NO: 994356 - protein, 9 aa, Homo Sapiens
EKEERPTSR

SEQ ID NO: 994357 - protein, 9 aa, Homo Sapiens
LVFLLMLSQ

SEQ ID NO: 994358 - protein, 9 aa, Homo Sapiens
MKLSLPESL

SEQ ID NO: 994359 - protein, 9 aa, Homo Sapiens
PNGSALTNG

SEQ ID NO: 994360 - protein, 9 aa, Homo Sapiens
GDQTLTIKQ

SEQ ID NO: 994361 - protein, 9 aa, Homo Sapiens
PEPFPAADM

SEQ ID NO: 994362 - protein, 9 aa, Homo Sapiens
PRSNYRGPK

SEQ ID NO: 994363 - protein, 9 aa, Homo Sapiens
SYYLKLSKK

SEQ ID NO: 994364 - protein, 9 aa, Homo Sapiens
LRDLNISEG

SEQ ID NO: 994365 - protein, 9 aa, Homo Sapiens
TRTPRPPPA

SEQ ID NO: 994366 - protein, 9 aa, Homo Sapiens
GKYPGINSD

SEQ ID NO: 994367 - protein, 9 aa, Homo Sapiens
ACRREDSQA

SEQ ID NO: 994368 - protein, 9 aa, Homo Sapiens
FHRVAVKGW

SEQ ID NO: 994369 - protein, 9 aa, Homo Sapiens
KNDSKYVVK

SEQ ID NO: 994370 - protein, 9 aa, Homo Sapiens
SLPESLKAY

SEQ ID NO: 994371 - protein, 9 aa, Homo Sapiens
QHFTQATLD

SEQ ID NO: 994372 - protein, 9 aa, Homo Sapiens
TVLYMDPEG

SEQ ID NO: 994373 - protein, 9 aa, Homo Sapiens
SAAMTLSER

SEQ ID NO: 994374 - protein, 9 aa, Homo Sapiens
EAGEIIRGT

SEQ ID NO: 994375 - protein, 9 aa, Homo Sapiens
GEKPNKSEE

SEQ ID NO: 994376 - protein, 9 aa, Homo Sapiens
TQTDHMATI

SEQ ID NO: 994377 - protein, 9 aa, Homo Sapiens
IKNDSKYVV

SEQ ID NO: 994378 - protein, 9 aa, Homo Sapiens
GACRREDSQ

SEQ ID NO: 994379 - protein, 9 aa, Homo Sapiens
ARDIKNDSK

SEQ ID NO: 994380 - protein, 9 aa, Homo Sapiens
PTSRSRPRR

SEQ ID NO: 994381 - protein, 9 aa, Homo Sapiens
TYPGVKSCE

SEQ ID NO: 994382 - protein, 9 aa, Homo Sapiens
QKSIPEPFP

SEQ ID NO: 994383 - protein, 9 aa, Homo Sapiens
HGVTQTDHM

SEQ ID NO: 994384 - protein, 9 aa, Homo Sapiens
HYPIILGGF

SEQ ID NO: 994385 - protein, 9 aa, Homo Sapiens
LKLEPKERK

SEQ ID NO: 994386 - protein, 9 aa, Homo Sapiens
SQACIEEQL

SEQ ID NO: 994387 - protein, 9 aa, Homo Sapiens
DTLNKKTYP

SEQ ID NO: 994388 - protein, 9 aa, Homo Sapiens
AAMTLSERF

SEQ ID NO: 994389 - protein, 9 aa, Homo Sapiens
LNLDKSIKI

SEQ ID NO: 994390 - protein, 9 aa, Homo Sapiens
YGKYPGINS

SEQ ID NO: 994391 - protein, 9 aa, Homo Sapiens
IGTVLYMDP

SEQ ID NO: 994392 - protein, 9 aa, Homo Sapiens
SNYRGPKQT

SEQ ID NO: 994393 - protein, 9 aa, Homo Sapiens
ILTGLMVGS

SEQ ID NO: 994394 - protein, 9 aa, Homo Sapiens
EILTGLMVG

SEQ ID NO: 994395 - protein, 9 aa, Homo Sapiens
YIWLDIMIE

SEQ ID NO: 994396 - protein, 9 aa, Homo Sapiens
DISLVAPKD

SEQ ID NO: 994397 - protein, 9 aa, Homo Sapiens
TPRPPPAAP

SEQ ID NO: 994398 - protein, 9 aa, Homo Sapiens
HDPMGKPML

SEQ ID NO: 994399 - protein, 9 aa, Homo Sapiens
MDALRDLNI

SEQ ID NO: 994400 - protein, 9 aa, Homo Sapiens
NVVHELTIT

SEQ ID NO: 994401 - protein, 9 aa, Homo Sapiens
DPMGKPMLT

SEQ ID NO: 994402 - protein, 9 aa, Homo Sapiens
YADGPGRPE

SEQ ID NO: 994403 - protein, 9 aa, Homo Sapiens
PKQTAATTT

SEQ ID NO: 994404 - protein, 9 aa, Homo Sapiens
GEKLVAEMN

SEQ ID NO: 994405 - protein, 9 aa, Homo Sapiens
VVLNLDKSI

SEQ ID NO: 994406 - protein, 9 aa, Homo Sapiens
YYLKLSKKQ

SEQ ID NO: 994407 - protein, 9 aa, Homo Sapiens
EIIRGTECK

SEQ ID NO: 994408 - protein, 9 aa, Homo Sapiens
GGGGPTGLL

SEQ ID NO: 994409 - protein, 9 aa, Homo Sapiens
VVVRDKYGD

SEQ ID NO: 994410 - protein, 9 aa, Homo Sapiens
EDSQACIEE

SEQ ID NO: 994411 - protein, 9 aa, Homo Sapiens
SAAIGGVIA

SEQ ID NO: 994412 - protein, 9 aa, Homo Sapiens
VHELTITNQ

SEQ ID NO: 994413 - protein, 9 aa, Homo Sapiens
ELTITNQVI

SEQ ID NO: 994414 - protein, 9 aa, Homo Sapiens
GCSSNLILH

SEQ ID NO: 994415 - protein, 9 aa, Homo Sapiens
SGGGGPTGL

SEQ ID NO: 994416 - protein, 9 aa, Homo Sapiens
TGLMVGSAA

SEQ ID NO: 994417 - protein, 9 aa, Homo Sapiens
ELPLVIGTV

SEQ ID NO: 994418 - protein, 9 aa, Homo Sapiens
SSLVHMIFG

SEQ ID NO: 994419 - protein, 9 aa, Homo Sapiens
SSSARATQP

SEQ ID NO: 994420 - protein, 9 aa, Homo Sapiens
YGNNLYFTD

SEQ ID NO: 994421 - protein, 9 aa, Homo Sapiens
PMGKPMLTR

SEQ ID NO: 994422 - protein, 9 aa, Homo Sapiens
GVTQTDHMA

SEQ ID NO: 994423 - protein, 9 aa, Homo Sapiens
VVRDKYGDG

SEQ ID NO: 994424 - protein, 9 aa, Homo Sapiens
LRPRCIFGV

SEQ ID NO: 994425 - protein, 9 aa, Homo Sapiens
RRPRAPRPP

SEQ ID NO: 994426 - protein, 9 aa, Homo Sapiens
KYPGINSDE

SEQ ID NO: 994427 - protein, 9 aa, Homo Sapiens
RAEAGEIIR

SEQ ID NO: 994428 - protein, 9 aa, Homo Sapiens
RPESIKAYL

SEQ ID NO: 994429 - protein, 9 aa, Homo Sapiens
VLYMDPEGD

SEQ ID NO: 994430 - protein, 9 aa, Homo Sapiens
RDSAAIGGV

SEQ ID NO: 994431 - protein, 9 aa, Homo Sapiens
REDSQACIE

SEQ ID NO: 994432 - protein, 9 aa, Homo Sapiens
MCQKFFIDS

SEQ ID NO: 994433 - protein, 9 aa, Homo Sapiens
IMKLSLPES

SEQ ID NO: 994434 - protein, 9 aa, Homo Sapiens
NLDKSIKIV

SEQ ID NO: 994435 - protein, 9 aa, Homo Sapiens
IWNLNPVFG

SEQ ID NO: 994436 - protein, 9 aa, Homo Sapiens
AQEPKAGQQ

SEQ ID NO: 994437 - protein, 9 aa, Homo Sapiens
NNLYFTDWK

SEQ ID NO: 994438 - protein, 9 aa, Homo Sapiens
QPRSNYRGP

SEQ ID NO: 994439 - protein, 9 aa, Homo Sapiens
RLSASQIWN

SEQ ID NO: 994440 - protein, 9 aa, Homo Sapiens
ADPPAENLS

SEQ ID NO: 994441 - protein, 9 aa, Homo Sapiens
EFIKMTNYN

SEQ ID NO: 994442 - protein, 9 aa, Homo Sapiens
TSRSRPRRR

SEQ ID NO: 994443 - protein, 9 aa, Homo Sapiens
RDGQEIELQ

SEQ ID NO: 994444 - protein, 9 aa, Homo Sapiens
RSRPRRRPR

SEQ ID NO: 994445 - protein, 9 aa, Homo Sapiens
APFIMDALR

SEQ ID NO: 994446 - protein, 9 aa, Homo Sapiens
CRREDSQAC

SEQ ID NO: 994447 - protein, 9 aa, Homo Sapiens
TALHIARYN

SEQ ID NO: 994448 - protein, 9 aa, Homo Sapiens
PRRRPRAPR

SEQ ID NO: 994449 - protein, 9 aa, Homo Sapiens
DALRDLNIS

SEQ ID NO: 994450 - protein, 9 aa, Homo Sapiens
PMLTRLGSW

SEQ ID NO: 994451 - protein, 9 aa, Homo Sapiens
HFTQATLDT

SEQ ID NO: 994452 - protein, 9 aa, Homo Sapiens
LREKIMKLS

SEQ ID NO: 994453 - protein, 9 aa, Homo Sapiens
MQPISAPLV

SEQ ID NO: 994454 - protein, 9 aa, Homo Sapiens
YRGPKQTAA

SEQ ID NO: 994455 - protein, 9 aa, Homo Sapiens
GGDQTLTIK

SEQ ID NO: 994456 - protein, 9 aa, Homo Sapiens
GVVLNLDKS

SEQ ID NO: 994457 - protein, 9 aa, Homo Sapiens
SERFTSYQK

SEQ ID NO: 994458 - protein, 9 aa, Homo Sapiens
WQALPTEAA

SEQ ID NO: 994459 - protein, 9 aa, Homo Sapiens
NTDSQNEGL

SEQ ID NO: 994460 - protein, 9 aa, Homo Sapiens
RRRPRAPRP

SEQ ID NO: 994461 - protein, 9 aa, Homo Sapiens
FIKMTNYNV

SEQ ID NO: 994462 - protein, 9 aa, Homo Sapiens
CLPHVCAFF

SEQ ID NO: 994463 - protein, 9 aa, Homo Sapiens
VIGTVLYMD

SEQ ID NO: 994464 - protein, 9 aa, Homo Sapiens
MIFGLSLQI

SEQ ID NO: 994465 - protein, 9 aa, Homo Sapiens
VFLLMLSQW

SEQ ID NO: 994466 - protein, 9 aa, Homo Sapiens
LQPRSNYRG

SEQ ID NO: 994467 - protein, 9 aa, Homo Sapiens
PALALQGVR

SEQ ID NO: 994468 - protein, 9 aa, Homo Sapiens
SIPEPFPAA

SEQ ID NO: 994469 - protein, 9 aa, Homo Sapiens
EVCRQDIQH

SEQ ID NO: 994470 - protein, 9 aa, Homo Sapiens
QEIELQCGT

SEQ ID NO: 994471 - protein, 9 aa, Homo Sapiens
VVHELTITN

SEQ ID NO: 994472 - protein, 9 aa, Homo Sapiens
AEPAGDTRT

SEQ ID NO: 994473 - protein, 9 aa, Homo Sapiens
LSLPESLKA

SEQ ID NO: 994474 - protein, 9 aa, Homo Sapiens
KVRTFVLAL

SEQ ID NO: 994475 - protein, 9 aa, Homo Sapiens
PFAVTSYGN

SEQ ID NO: 994476 - protein, 9 aa, Homo Sapiens
FIMDALRDL

SEQ ID NO: 994477 - protein, 9 aa, Homo Sapiens
LLMQPISAP

SEQ ID NO: 994478 - protein, 9 aa, Homo Sapiens
YLYCEMCQK

SEQ ID NO: 994479 - protein, 9 aa, Homo Sapiens
SGSGGGGPT

SEQ ID NO: 994480 - protein, 9 aa, Homo Sapiens
FKSAAMTLS

SEQ ID NO: 994481 - protein, 9 aa, Homo Sapiens
SAPFIMDAL

SEQ ID NO: 994482 - protein, 9 aa, Homo Sapiens
AADPPAENL

SEQ ID NO: 994483 - protein, 9 aa, Homo Sapiens
LGEEEEEET

SEQ ID NO: 994484 - protein, 9 aa, Homo Sapiens
SKKQKETQS

SEQ ID NO: 994485 - protein, 9 aa, Homo Sapiens
CEMCQKFFI

SEQ ID NO: 994486 - protein, 9 aa, Homo Sapiens
VTSYGNNLY

SEQ ID NO: 994487 - protein, 9 aa, Homo Sapiens
GPTGLLPNP

SEQ ID NO: 994488 - protein, 9 aa, Homo Sapiens
AENLSAPEA

SEQ ID NO: 994489 - protein, 9 aa, Homo Sapiens
RCPSSSSSV

SEQ ID NO: 994490 - protein, 9 aa, Homo Sapiens
HPQQLQPRS

SEQ ID NO: 994491 - protein, 9 aa, Homo Sapiens
ATTTEAQEP

SEQ ID NO: 994492 - protein, 9 aa, Homo Sapiens
FAVTSYGNN

SEQ ID NO: 994493 - protein, 9 aa, Homo Sapiens
TDSQNEGLL

SEQ ID NO: 994494 - protein, 9 aa, Homo Sapiens
KTLRPRCIF

SEQ ID NO: 994495 - protein, 9 aa, Homo Sapiens
SLVAPKDRV

SEQ ID NO: 994496 - protein, 9 aa, Homo Sapiens
PGRPESIKA

SEQ ID NO: 994497 - protein, 9 aa, Homo Sapiens
LTRLGSWQG

SEQ ID NO: 994498 - protein, 9 aa, Homo Sapiens
LNKKTYPGV

SEQ ID NO: 994499 - protein, 9 aa, Homo Sapiens
GNTALHIAR

SEQ ID NO: 994500 - protein, 9 aa, Homo Sapiens
SRPRRRPRA

SEQ ID NO: 994501 - protein, 9 aa, Homo Sapiens
GAWCLPHVC

SEQ ID NO: 994502 - protein, 9 aa, Homo Sapiens
GYGKYPGIN

SEQ ID NO: 994503 - protein, 9 aa, Homo Sapiens
DESEEEEGD

SEQ ID NO: 994504 - protein, 9 aa, Homo Sapiens
LHIARYNGQ

SEQ ID NO: 994505 - protein, 9 aa, Homo Sapiens
TLSERFTSY

SEQ ID NO: 994506 - protein, 9 aa, Homo Sapiens
PSFGINDKC

SEQ ID NO: 994507 - protein, 9 aa, Homo Sapiens
YPGVKSCES

SEQ ID NO: 994508 - protein, 9 aa, Homo Sapiens
KEKEERPTS

SEQ ID NO: 994509 - protein, 9 aa, Homo Sapiens
IILGGFGNS

SEQ ID NO: 994510 - protein, 9 aa, Homo Sapiens
GKPMLTRLG

SEQ ID NO: 994511 - protein, 9 aa, Homo Sapiens
QGACRREDS

SEQ ID NO: 994512 - protein, 9 aa, Homo Sapiens
HECGKTFGC

SEQ ID NO: 994513 - protein, 9 aa, Homo Sapiens
DSKYVVKGN

SEQ ID NO: 994514 - protein, 9 aa, Homo Sapiens
HIARYNGQD

SEQ ID NO: 994515 - protein, 9 aa, Homo Sapiens
FVLALVNST

SEQ ID NO: 994516 - protein, 9 aa, Homo Sapiens
QLQPRSNYR

SEQ ID NO: 994517 - protein, 9 aa, Homo Sapiens
ESEEEEGDV

SEQ ID NO: 994518 - protein, 9 aa, Homo Sapiens
RVAVKGWQA

SEQ ID NO: 994519 - protein, 9 aa, Homo Sapiens
AEILTGLMV

SEQ ID NO: 994520 - protein, 9 aa, Homo Sapiens
IPEPFPAAD

SEQ ID NO: 994521 - protein, 9 aa, Homo Sapiens
TEAQEPKAG

SEQ ID NO: 994522 - protein, 9 aa, Homo Sapiens
LGGFGNSEG

SEQ ID NO: 994523 - protein, 9 aa, Homo Sapiens
KYVVKGNAR

SEQ ID NO: 994524 - protein, 9 aa, Homo Sapiens
CGKTFGCSS

SEQ ID NO: 994525 - protein, 9 aa, Homo Sapiens
LLKEMTNTD

SEQ ID NO: 994526 - protein, 9 aa, Homo Sapiens
GNNLYFTDW

SEQ ID NO: 994527 - protein, 9 aa, Homo Sapiens
KSAAMTLSE

SEQ ID NO: 994528 - protein, 9 aa, Homo Sapiens
AAIGGVIAV

SEQ ID NO: 994529 - protein, 9 aa, Homo Sapiens
RREDSQACI

SEQ ID NO: 994530 - protein, 9 aa, Homo Sapiens
RGPKQTAAT

SEQ ID NO: 994531 - protein, 9 aa, Homo Sapiens
SEECGKAFS

SEQ ID NO: 994532 - protein, 9 aa, Homo Sapiens
KSEECGKAF

SEQ ID NO: 994533 - protein, 9 aa, Homo Sapiens
VKGWQALPT

SEQ ID NO: 994534 - protein, 9 aa, Homo Sapiens
SKYVVKGNA

SEQ ID NO: 994535 - protein, 9 aa, Homo Sapiens
KQTAATTTE

SEQ ID NO: 994536 - protein, 9 aa, Homo Sapiens
PNGSIISYI

SEQ ID NO: 994537 - protein, 9 aa, Homo Sapiens
RGTECKPHS

SEQ ID NO: 994538 - protein, 9 aa, Homo Sapiens
IEGVVVRDK

SEQ ID NO: 994539 - protein, 9 aa, Homo Sapiens
MLTRLGSWQ

SEQ ID NO: 994540 - protein, 9 aa, Homo Sapiens
YPIILGGFG

SEQ ID NO: 994541 - protein, 9 aa, Homo Sapiens
CTLNKDDAS

SEQ ID NO: 994542 - protein, 9 aa, Homo Sapiens
ENLSAPEAE

SEQ ID NO: 994543 - protein, 9 aa, Homo Sapiens
LTNGSQLPS

SEQ ID NO: 994544 - protein, 9 aa, Homo Sapiens
QGVRRDFAD

SEQ ID NO: 994545 - protein, 9 aa, Homo Sapiens
FSSSARATQ

SEQ ID NO: 994546 - protein, 9 aa, Homo Sapiens
ECGKTFGCS

SEQ ID NO: 994547 - protein, 9 aa, Homo Sapiens
GLTDFGEKL

SEQ ID NO: 994548 - protein, 9 aa, Homo Sapiens
LTGLMVGSA

SEQ ID NO: 994549 - protein, 9 aa, Homo Sapiens
ALRDLNISE

SEQ ID NO: 994550 - protein, 9 aa, Homo Sapiens
TDHMATIEA

SEQ ID NO: 994551 - protein, 9 aa, Homo Sapiens
NGSALTNGS

SEQ ID NO: 994552 - protein, 9 aa, Homo Sapiens
AATGVVLNL

SEQ ID NO: 994553 - protein, 9 aa, Homo Sapiens
QDIQHFTQA

SEQ ID NO: 994554 - protein, 9 aa, Homo Sapiens
AVTSYGNNL

SEQ ID NO: 994555 - protein, 9 aa, Homo Sapiens
IYAATFKKF

SEQ ID NO: 994556 - protein, 9 aa, Homo Sapiens
GLESKVSRG

SEQ ID NO: 994557 - protein, 9 aa, Homo Sapiens
TTLKTVATE

SEQ ID NO: 994558 - protein, 9 aa, Homo Sapiens
VGKNGAPKE

SEQ ID NO: 994559 - protein, 9 aa, Homo Sapiens
AATFKKFQI

SEQ ID NO: 994560 - protein, 9 aa, Homo Sapiens
AFHCVRPQH

SEQ ID NO: 994561 - protein, 9 aa, Homo Sapiens
VLAMIKLAC

SEQ ID NO: 994562 - protein, 9 aa, Homo Sapiens
SQKNKKCWN

SEQ ID NO: 994563 - protein, 9 aa, Homo Sapiens
PAGEKGAPE

SEQ ID NO: 994564 - protein, 9 aa, Homo Sapiens
PGFISNKGR

SEQ ID NO: 994565 - protein, 9 aa, Homo Sapiens
DSYVFLKAI

SEQ ID NO: 994566 - protein, 9 aa, Homo Sapiens
RNTSVETPF

SEQ ID NO: 994567 - protein, 9 aa, Homo Sapiens
TENEGEDPW

SEQ ID NO: 994568 - protein, 9 aa, Homo Sapiens
HILLCPDTY

SEQ ID NO: 994569 - protein, 9 aa, Homo Sapiens
GACFLCHGD

SEQ ID NO: 994570 - protein, 9 aa, Homo Sapiens
TPFWLLSPG

SEQ ID NO: 994571 - protein, 9 aa, Homo Sapiens
APTIDISPR

SEQ ID NO: 994572 - protein, 9 aa, Homo Sapiens
SSHYGQIDR

SEQ ID NO: 994573 - protein, 9 aa, Homo Sapiens
GQIDRKGQC

SEQ ID NO: 994574 - protein, 9 aa, Homo Sapiens
NLHFQDTTV

SEQ ID NO: 994575 - protein, 9 aa, Homo Sapiens
YCFKVFDLN

SEQ ID NO: 994576 - protein, 9 aa, Homo Sapiens
KFLENQQVS

SEQ ID NO: 994577 - protein, 9 aa, Homo Sapiens
WWFQVLNSS

SEQ ID NO: 994578 - protein, 9 aa, Homo Sapiens
LESCMKKYK

SEQ ID NO: 994579 - protein, 9 aa, Homo Sapiens
ATVPDQEKL

SEQ ID NO: 994580 - protein, 9 aa, Homo Sapiens
DLKHVIFSR

SEQ ID NO: 994581 - protein, 9 aa, Homo Sapiens
PEVGSCKLS

SEQ ID NO: 994582 - protein, 9 aa, Homo Sapiens
SIVLARELQ

SEQ ID NO: 994583 - protein, 9 aa, Homo Sapiens
DSLSVDKHE

SEQ ID NO: 994584 - protein, 9 aa, Homo Sapiens
LSNLTGNNY

SEQ ID NO: 994585 - protein, 9 aa, Homo Sapiens
GLLEKMRDE

SEQ ID NO: 994586 - protein, 9 aa, Homo Sapiens
LEPEDSSLR

SEQ ID NO: 994587 - protein, 9 aa, Homo Sapiens
VFMAVVMEQ

SEQ ID NO: 994588 - protein, 9 aa, Homo Sapiens
MVLTEMPHY

SEQ ID NO: 994589 - protein, 9 aa, Homo Sapiens
PGFFEYEYA

SEQ ID NO: 994590 - protein, 9 aa, Homo Sapiens
KKANSLLVY

SEQ ID NO: 994591 - protein, 9 aa, Homo Sapiens
VWRAKVGVA

SEQ ID NO: 994592 - protein, 9 aa, Homo Sapiens
KKDLGAPEG

SEQ ID NO: 994593 - protein, 9 aa, Homo Sapiens
EEDGNSDPE

SEQ ID NO: 994594 - protein, 9 aa, Homo Sapiens
TEMPHYSEE

SEQ ID NO: 994595 - protein, 9 aa, Homo Sapiens
HRRNTSVET

SEQ ID NO: 994596 - protein, 9 aa, Homo Sapiens
LNHNYTSLL

SEQ ID NO: 994597 - protein, 9 aa, Homo Sapiens
HPEMRCGEE

SEQ ID NO: 994598 - protein, 9 aa, Homo Sapiens
LTVLRSSWA

SEQ ID NO: 994599 - protein, 9 aa, Homo Sapiens
IQLKWKHPE

SEQ ID NO: 994600 - protein, 9 aa, Homo Sapiens
TKENEVNIS

SEQ ID NO: 994601 - protein, 9 aa, Homo Sapiens
LEGFPGVKR

SEQ ID NO: 994602 - protein, 9 aa, Homo Sapiens
SEIQLKWKH

SEQ ID NO: 994603 - protein, 9 aa, Homo Sapiens
YLDENEITA

SEQ ID NO: 994604 - protein, 9 aa, Homo Sapiens
MAYTTKFVD

SEQ ID NO: 994605 - protein, 9 aa, Homo Sapiens
EENRQVNLK

SEQ ID NO: 994606 - protein, 9 aa, Homo Sapiens
SVETPFWMA

SEQ ID NO: 994607 - protein, 9 aa, Homo Sapiens
PPGFPGPPG

SEQ ID NO: 994608 - protein, 9 aa, Homo Sapiens
TFMLFPVPE

SEQ ID NO: 994609 - protein, 9 aa, Homo Sapiens
QQKAPTQKS

SEQ ID NO: 994610 - protein, 9 aa, Homo Sapiens
ASRHLDSYV

SEQ ID NO: 994611 - protein, 9 aa, Homo Sapiens
NQPKGPPPP

SEQ ID NO: 994612 - protein, 9 aa, Homo Sapiens
LGFGSLTHK

SEQ ID NO: 994613 - protein, 9 aa, Homo Sapiens
VGVAEEELQ

SEQ ID NO: 994614 - protein, 9 aa, Homo Sapiens
SYRDTEDRE

SEQ ID NO: 994615 - protein, 9 aa, Homo Sapiens
HHPDEAVLP

SEQ ID NO: 994616 - protein, 9 aa, Homo Sapiens
EQETLLFFL

SEQ ID NO: 994617 - protein, 9 aa, Homo Sapiens
CVNLHFQDT

SEQ ID NO: 994618 - protein, 9 aa, Homo Sapiens
YGSPAAGSA

SEQ ID NO: 994619 - protein, 9 aa, Homo Sapiens
SNLFKSKSN

SEQ ID NO: 994620 - protein, 9 aa, Homo Sapiens
LDDLSYTPL

SEQ ID NO: 994621 - protein, 9 aa, Homo Sapiens
IHASDSDKK

SEQ ID NO: 994622 - protein, 9 aa, Homo Sapiens
TVPSHVFSK

SEQ ID NO: 994623 - protein, 9 aa, Homo Sapiens
EKPAVGKSK

SEQ ID NO: 994624 - protein, 9 aa, Homo Sapiens
FGSLTHKCS

SEQ ID NO: 994625 - protein, 9 aa, Homo Sapiens
SAQQKAPTQ

SEQ ID NO: 994626 - protein, 9 aa, Homo Sapiens
PRAGDSGLL

SEQ ID NO: 994627 - protein, 9 aa, Homo Sapiens
CKMGMIITT

SEQ ID NO: 994628 - protein, 9 aa, Homo Sapiens
WKKLTIVAG

SEQ ID NO: 994629 - protein, 9 aa, Homo Sapiens
LNYDIDPNA

SEQ ID NO: 994630 - protein, 9 aa, Homo Sapiens
INSGGHAKT

SEQ ID NO: 994631 - protein, 9 aa, Homo Sapiens
EDSQAVRPY

SEQ ID NO: 994632 - protein, 9 aa, Homo Sapiens
GGLGFGSLT

SEQ ID NO: 994633 - protein, 9 aa, Homo Sapiens
RPRLSFCSA

SEQ ID NO: 994634 - protein, 9 aa, Homo Sapiens
IYNQKKGHF

SEQ ID NO: 994635 - protein, 9 aa, Homo Sapiens
TVILFQVSF

SEQ ID NO: 994636 - protein, 9 aa, Homo Sapiens
CEAERPEVG

SEQ ID NO: 994637 - protein, 9 aa, Homo Sapiens
LRAALPAPN

SEQ ID NO: 994638 - protein, 9 aa, Homo Sapiens
KVPVKILNC

SEQ ID NO: 994639 - protein, 9 aa, Homo Sapiens
TSCPANNYQ

SEQ ID NO: 994640 - protein, 9 aa, Homo Sapiens
LIPGFISNK

SEQ ID NO: 994641 - protein, 9 aa, Homo Sapiens
VGSPTSEIQ

SEQ ID NO: 994642 - protein, 9 aa, Homo Sapiens
PEDSQAVRP

SEQ ID NO: 994643 - protein, 9 aa, Homo Sapiens
HLGPGDSFS

SEQ ID NO: 994644 - protein, 9 aa, Homo Sapiens
AGIPVAPFS

SEQ ID NO: 994645 - protein, 9 aa, Homo Sapiens
SLAGRDLNH

SEQ ID NO: 994646 - protein, 9 aa, Homo Sapiens
EVVSDPAKR

SEQ ID NO: 994647 - protein, 9 aa, Homo Sapiens
ASATPPRSS

SEQ ID NO: 994648 - protein, 9 aa, Homo Sapiens
ELEQAWREA

SEQ ID NO: 994649 - protein, 9 aa, Homo Sapiens
HFPASSFWS

SEQ ID NO: 994650 - protein, 9 aa, Homo Sapiens
IEKLFSCVI

SEQ ID NO: 994651 - protein, 9 aa, Homo Sapiens
DFYYDLKHV

SEQ ID NO: 994652 - protein, 9 aa, Homo Sapiens
QPSPKCTPK

SEQ ID NO: 994653 - protein, 9 aa, Homo Sapiens
WFQVLNSSS

SEQ ID NO: 994654 - protein, 9 aa, Homo Sapiens
HLDSYVFLK

SEQ ID NO: 994655 - protein, 9 aa, Homo Sapiens
QVNLKIGVN

SEQ ID NO: 994656 - protein, 9 aa, Homo Sapiens
NGPGLSPLL

SEQ ID NO: 994657 - protein, 9 aa, Homo Sapiens
ESCMKKYKD

SEQ ID NO: 994658 - protein, 9 aa, Homo Sapiens
TRGGHINSG

SEQ ID NO: 994659 - protein, 9 aa, Homo Sapiens
PGELLIALD

SEQ ID NO: 994660 - protein, 9 aa, Homo Sapiens
GLLLRRHHN

SEQ ID NO: 994661 - protein, 9 aa, Homo Sapiens
SRSSASATP

SEQ ID NO: 994662 - protein, 9 aa, Homo Sapiens
LATTLKTVA

SEQ ID NO: 994663 - protein, 9 aa, Homo Sapiens
SAGSYILHD

SEQ ID NO: 994664 - protein, 9 aa, Homo Sapiens
VCFSSFLGK

SEQ ID NO: 994665 - protein, 9 aa, Homo Sapiens
FMNPIYRVE

SEQ ID NO: 994666 - protein, 9 aa, Homo Sapiens
NSIQIEGLF

SEQ ID NO: 994667 - protein, 9 aa, Homo Sapiens
GWVGPLLAC

SEQ ID NO: 994668 - protein, 9 aa, Homo Sapiens
EASFTQEGK

SEQ ID NO: 994669 - protein, 9 aa, Homo Sapiens
EKLSLVEDF

SEQ ID NO: 994670 - protein, 9 aa, Homo Sapiens
QRRRGELGT

SEQ ID NO: 994671 - protein, 9 aa, Homo Sapiens
RIYKHFQQP

SEQ ID NO: 994672 - protein, 9 aa, Homo Sapiens
LGQGIGPIY

SEQ ID NO: 994673 - protein, 9 aa, Homo Sapiens
FFPVGFVAA

SEQ ID NO: 994674 - protein, 9 aa, Homo Sapiens
LSVDKHEDD

SEQ ID NO: 994675 - protein, 9 aa, Homo Sapiens
KTNKPSRLL

SEQ ID NO: 994676 - protein, 9 aa, Homo Sapiens
AVGKSKEEK

SEQ ID NO: 994677 - protein, 9 aa, Homo Sapiens
DEDECEEEK

SEQ ID NO: 994678 - protein, 9 aa, Homo Sapiens
YRVVRFKVI

SEQ ID NO: 994679 - protein, 9 aa, Homo Sapiens
TIVLLSIVY

SEQ ID NO: 994680 - protein, 9 aa, Homo Sapiens
GLGFGSLTH

SEQ ID NO: 994681 - protein, 9 aa, Homo Sapiens
VSWYLDENE

SEQ ID NO: 994682 - protein, 9 aa, Homo Sapiens
VTLCNCITE

SEQ ID NO: 994683 - protein, 9 aa, Homo Sapiens
ISSPPPPPL

SEQ ID NO: 994684 - protein, 9 aa, Homo Sapiens
RQSTFTLPL

SEQ ID NO: 994685 - protein, 9 aa, Homo Sapiens
RKYEEMRKE

SEQ ID NO: 994686 - protein, 9 aa, Homo Sapiens
PVDGAEAEA

SEQ ID NO: 994687 - protein, 9 aa, Homo Sapiens
THLTKENEV

SEQ ID NO: 994688 - protein, 9 aa, Homo Sapiens
LKFNLMETS

SEQ ID NO: 994689 - protein, 9 aa, Homo Sapiens
ATFKKFQIF

SEQ ID NO: 994690 - protein, 9 aa, Homo Sapiens
NPGGKTNEP

SEQ ID NO: 994691 - protein, 9 aa, Homo Sapiens
QFLPSLKDS

SEQ ID NO: 994692 - protein, 9 aa, Homo Sapiens
SNRTEEDGN

SEQ ID NO: 994693 - protein, 9 aa, Homo Sapiens
KRIKNTISY

SEQ ID NO: 994694 - protein, 9 aa, Homo Sapiens
SSRSSASAT

SEQ ID NO: 994695 - protein, 9 aa, Homo Sapiens
IWLCPYCRR

SEQ ID NO: 994696 - protein, 9 aa, Homo Sapiens
VLDIFALVE

SEQ ID NO: 994697 - protein, 9 aa, Homo Sapiens
THEVFPRLY

SEQ ID NO: 994698 - protein, 9 aa, Homo Sapiens
PEQSYLAIL

SEQ ID NO: 994699 - protein, 9 aa, Homo Sapiens
VDLSSREAR

SEQ ID NO: 994700 - protein, 9 aa, Homo Sapiens
KLTIVAGAV

SEQ ID NO: 994701 - protein, 9 aa, Homo Sapiens
VLESLFFSA

SEQ ID NO: 994702 - protein, 9 aa, Homo Sapiens
ERQDFVAKK

SEQ ID NO: 994703 - protein, 9 aa, Homo Sapiens
ATPSNRTEE

SEQ ID NO: 994704 - protein, 9 aa, Homo Sapiens
GLVLQRKSR

SEQ ID NO: 994705 - protein, 9 aa, Homo Sapiens
CGLSPSEEL

SEQ ID NO: 994706 - protein, 9 aa, Homo Sapiens
KEASNILLN

SEQ ID NO: 994707 - protein, 9 aa, Homo Sapiens
QSGNLEVKV

SEQ ID NO: 994708 - protein, 9 aa, Homo Sapiens
EYIATPRVW

SEQ ID NO: 994709 - protein, 9 aa, Homo Sapiens
GLKFNLMET

SEQ ID NO: 994710 - protein, 9 aa, Homo Sapiens
FYCECLHGR

SEQ ID NO: 994711 - protein, 9 aa, Homo Sapiens
YKCPGLWSY

SEQ ID NO: 994712 - protein, 9 aa, Homo Sapiens
ALNYDIDPN

SEQ ID NO: 994713 - protein, 9 aa, Homo Sapiens
PAPEDSQAV

SEQ ID NO: 994714 - protein, 9 aa, Homo Sapiens
SFSSPEPDS

SEQ ID NO: 994715 - protein, 9 aa, Homo Sapiens
ERELRAALP

SEQ ID NO: 994716 - protein, 9 aa, Homo Sapiens
NDGRIYKHF

SEQ ID NO: 994717 - protein, 9 aa, Homo Sapiens
LCVLLLGKN

SEQ ID NO: 994718 - protein, 9 aa, Homo Sapiens
KTVATEGVE

SEQ ID NO: 994719 - protein, 9 aa, Homo Sapiens
CHADAKCVN

SEQ ID NO: 994720 - protein, 9 aa, Homo Sapiens
QKSGCNKNS

SEQ ID NO: 994721 - protein, 9 aa, Homo Sapiens
RSVSASPPW

SEQ ID NO: 994722 - protein, 9 aa, Homo Sapiens
FCQVCRNKR

SEQ ID NO: 994723 - protein, 9 aa, Homo Sapiens
GKRIKNTIS

SEQ ID NO: 994724 - protein, 9 aa, Homo Sapiens
RCQCASQKN

SEQ ID NO: 994725 - protein, 9 aa, Homo Sapiens
ESIRKFSYC

SEQ ID NO: 994726 - protein, 9 aa, Homo Sapiens
DASAYLNLP

SEQ ID NO: 994727 - protein, 9 aa, Homo Sapiens
ILWNESHCC

SEQ ID NO: 994728 - protein, 9 aa, Homo Sapiens
GASRYTIMV

SEQ ID NO: 994729 - protein, 9 aa, Homo Sapiens
LSGEAAHLP

SEQ ID NO: 994730 - protein, 9 aa, Homo Sapiens
NWRAMFVYI

SEQ ID NO: 994731 - protein, 9 aa, Homo Sapiens
YDLLTMSPN

SEQ ID NO: 994732 - protein, 9 aa, Homo Sapiens
RQGIAVMRP

SEQ ID NO: 994733 - protein, 9 aa, Homo Sapiens
VGIDSLLIF

SEQ ID NO: 994734 - protein, 9 aa, Homo Sapiens
SARYICLRF

SEQ ID NO: 994735 - protein, 9 aa, Homo Sapiens
TESLKTKVF

SEQ ID NO: 994736 - protein, 9 aa, Homo Sapiens
LTKENEVNI

SEQ ID NO: 994737 - protein, 9 aa, Homo Sapiens
ATTLKTVAT

SEQ ID NO: 994738 - protein, 9 aa, Homo Sapiens
CQQRPLPWD

SEQ ID NO: 994739 - protein, 9 aa, Homo Sapiens
WWPVLDDLY

SEQ ID NO: 994740 - protein, 9 aa, Homo Sapiens
RACEAERPE

SEQ ID NO: 994741 - protein, 9 aa, Homo Sapiens
DFVAKKLDQ

SEQ ID NO: 994742 - protein, 9 aa, Homo Sapiens
VDFYYDLKH

SEQ ID NO: 994743 - protein, 9 aa, Homo Sapiens
RPSVCSGEG

SEQ ID NO: 994744 - protein, 9 aa, Homo Sapiens
KGDRESKKT

SEQ ID NO: 994745 - protein, 9 aa, Homo Sapiens
SMPEVQEKF

SEQ ID NO: 994746 - protein, 9 aa, Homo Sapiens
QLTDAQGKN

SEQ ID NO: 994747 - protein, 9 aa, Homo Sapiens
QGGNQPKGP

SEQ ID NO: 994748 - protein, 9 aa, Homo Sapiens
RQQLVGNGG

SEQ ID NO: 994749 - protein, 9 aa, Homo Sapiens
VHTQAVTED

SEQ ID NO: 994750 - protein, 9 aa, Homo Sapiens
YLFTLVGNT

SEQ ID NO: 994751 - protein, 9 aa, Homo Sapiens
NLSVRFKAE

SEQ ID NO: 994752 - protein, 9 aa, Homo Sapiens
NKGLIKECT

SEQ ID NO: 994753 - protein, 9 aa, Homo Sapiens
QWKRRQQLV

SEQ ID NO: 994754 - protein, 9 aa, Homo Sapiens
SNPGGKTNE

SEQ ID NO: 994755 - protein, 9 aa, Homo Sapiens
EKMFPHCKN

SEQ ID NO: 994756 - protein, 9 aa, Homo Sapiens
TNLEISKMK

SEQ ID NO: 994757 - protein, 9 aa, Homo Sapiens
MNPIYRVEK

SEQ ID NO: 994758 - protein, 9 aa, Homo Sapiens
MNKGLSSNE

SEQ ID NO: 994759 - protein, 9 aa, Homo Sapiens
LLQESRQRK

SEQ ID NO: 994760 - protein, 9 aa, Homo Sapiens
EGFLCEVLA

SEQ ID NO: 994761 - protein, 9 aa, Homo Sapiens
LESHSIVLA

SEQ ID NO: 994762 - protein, 9 aa, Homo Sapiens
FPGDHKSHR

SEQ ID NO: 994763 - protein, 9 aa, Homo Sapiens
AMLDAHPEM

SEQ ID NO: 994764 - protein, 9 aa, Homo Sapiens
STLTKHKRT

SEQ ID NO: 994765 - protein, 9 aa, Homo Sapiens
KYCFKVFDL

SEQ ID NO: 994766 - protein, 9 aa, Homo Sapiens
KGLIKECTL

SEQ ID NO: 994767 - protein, 9 aa, Homo Sapiens
GDGGLVLQR

SEQ ID NO: 994768 - protein, 9 aa, Homo Sapiens
CQIRSKGFF

SEQ ID NO: 994769 - protein, 9 aa, Homo Sapiens
YFFSPQNNT

SEQ ID NO: 994770 - protein, 9 aa, Homo Sapiens
ASDSDKKAN

SEQ ID NO: 994771 - protein, 9 aa, Homo Sapiens
GSEINSTGK

SEQ ID NO: 994772 - protein, 9 aa, Homo Sapiens
PLLFEIFNL

SEQ ID NO: 994773 - protein, 9 aa, Homo Sapiens
GVVKFFKLP

SEQ ID NO: 994774 - protein, 9 aa, Homo Sapiens
PIFNEDGLY

SEQ ID NO: 994775 - protein, 9 aa, Homo Sapiens
PLNTRHSFS

SEQ ID NO: 994776 - protein, 9 aa, Homo Sapiens
PGLWSYSSR

SEQ ID NO: 994777 - protein, 9 aa, Homo Sapiens
PDEAVLPRA

SEQ ID NO: 994778 - protein, 9 aa, Homo Sapiens
SFLLPVITL

SEQ ID NO: 994779 - protein, 9 aa, Homo Sapiens
VTFVKSSTE

SEQ ID NO: 994780 - protein, 9 aa, Homo Sapiens
QHLEASFTQ

SEQ ID NO: 994781 - protein, 9 aa, Homo Sapiens
LDLQEGKFY

SEQ ID NO: 994782 - protein, 9 aa, Homo Sapiens
SRQFLPSLK

SEQ ID NO: 994783 - protein, 9 aa, Homo Sapiens
ALVIVLVGL

SEQ ID NO: 994784 - protein, 9 aa, Homo Sapiens
TRLYNQLTD

SEQ ID NO: 994785 - protein, 9 aa, Homo Sapiens
HFPANKKKG

SEQ ID NO: 994786 - protein, 9 aa, Homo Sapiens
HSSVSSRLL

SEQ ID NO: 994787 - protein, 9 aa, Homo Sapiens
SAYLNLPSY

SEQ ID NO: 994788 - protein, 9 aa, Homo Sapiens
SDQMDFREL

SEQ ID NO: 994789 - protein, 9 aa, Homo Sapiens
VGKKDADVF

SEQ ID NO: 994790 - protein, 9 aa, Homo Sapiens
PSPKCTPKC

SEQ ID NO: 994791 - protein, 9 aa, Homo Sapiens
QSDENGILS

SEQ ID NO: 994792 - protein, 9 aa, Homo Sapiens
LGLSSTENE

SEQ ID NO: 994793 - protein, 9 aa, Homo Sapiens
PVGKKDADV

SEQ ID NO: 994794 - protein, 9 aa, Homo Sapiens
EGWHQICLL

SEQ ID NO: 994795 - protein, 9 aa, Homo Sapiens
PGAEGPAPE

SEQ ID NO: 994796 - protein, 9 aa, Homo Sapiens
IFALVIVLV

SEQ ID NO: 994797 - protein, 9 aa, Homo Sapiens
LVVLKVESR

SEQ ID NO: 994798 - protein, 9 aa, Homo Sapiens
KLSGEAAHL

SEQ ID NO: 994799 - protein, 9 aa, Homo Sapiens
GPGTCVLCQ

SEQ ID NO: 994800 - protein, 9 aa, Homo Sapiens
EDDQPDSSS

SEQ ID NO: 994801 - protein, 9 aa, Homo Sapiens
HLTKENEVN

SEQ ID NO: 994802 - protein, 9 aa, Homo Sapiens
LLRYGLPVN

SEQ ID NO: 994803 - protein, 9 aa, Homo Sapiens
TRQRYRKRS

SEQ ID NO: 994804 - protein, 9 aa, Homo Sapiens
WRGEIYGLV

SEQ ID NO: 994805 - protein, 9 aa, Homo Sapiens
VKLYKCQCG

SEQ ID NO: 994806 - protein, 9 aa, Homo Sapiens
ENEKKAECF

SEQ ID NO: 994807 - protein, 9 aa, Homo Sapiens
LLAYAAAGE

SEQ ID NO: 994808 - protein, 9 aa, Homo Sapiens
ILHDILHNG

SEQ ID NO: 994809 - protein, 9 aa, Homo Sapiens
VFSGGTPLL

SEQ ID NO: 994810 - protein, 9 aa, Homo Sapiens
DLVQTLYKV

SEQ ID NO: 994811 - protein, 9 aa, Homo Sapiens
AEGPAPEDS

SEQ ID NO: 994812 - protein, 9 aa, Homo Sapiens
EVDFYYDLK

SEQ ID NO: 994813 - protein, 9 aa, Homo Sapiens
RYNLLSFML

SEQ ID NO: 994814 - protein, 9 aa, Homo Sapiens
AALPAPNAP

SEQ ID NO: 994815 - protein, 9 aa, Homo Sapiens
SARKLKNFY

SEQ ID NO: 994816 - protein, 9 aa, Homo Sapiens
LTPLNTRHS

SEQ ID NO: 994817 - protein, 9 aa, Homo Sapiens
LILDPPKKD

SEQ ID NO: 994818 - protein, 9 aa, Homo Sapiens
YEGLGYGCG

SEQ ID NO: 994819 - protein, 9 aa, Homo Sapiens
IGIQPRATK

SEQ ID NO: 994820 - protein, 9 aa, Homo Sapiens
IVLARELQE

SEQ ID NO: 994821 - protein, 9 aa, Homo Sapiens
QNFPDLTSE

SEQ ID NO: 994822 - protein, 9 aa, Homo Sapiens
PCQESSFLP

SEQ ID NO: 994823 - protein, 9 aa, Homo Sapiens
KRLIPGFIS

SEQ ID NO: 994824 - protein, 9 aa, Homo Sapiens
ASLLLLLLR

SEQ ID NO: 994825 - protein, 9 aa, Homo Sapiens
IKHFIIYLI

SEQ ID NO: 994826 - protein, 9 aa, Homo Sapiens
LVGWFPANY

SEQ ID NO: 994827 - protein, 9 aa, Homo Sapiens
AWEGGGRMG

SEQ ID NO: 994828 - protein, 9 aa, Homo Sapiens
VSWSRCSKK

SEQ ID NO: 994829 - protein, 9 aa, Homo Sapiens
RSFEEAISA

SEQ ID NO: 994830 - protein, 9 aa, Homo Sapiens
SSASATPPR

SEQ ID NO: 994831 - protein, 9 aa, Homo Sapiens
WKSYRDTED

SEQ ID NO: 994832 - protein, 9 aa, Homo Sapiens
KERQDFVAK

SEQ ID NO: 994833 - protein, 9 aa, Homo Sapiens
KIHTYGQAF

SEQ ID NO: 994834 - protein, 9 aa, Homo Sapiens
PQERLLVSP

SEQ ID NO: 994835 - protein, 9 aa, Homo Sapiens
SDKKANSLL

SEQ ID NO: 994836 - protein, 9 aa, Homo Sapiens
PWNTRQKKQ

SEQ ID NO: 994837 - protein, 9 aa, Homo Sapiens
ISLSEGDDP

SEQ ID NO: 994838 - protein, 9 aa, Homo Sapiens
RGPGTCVLC

SEQ ID NO: 994839 - protein, 9 aa, Homo Sapiens
WSGAPRKVK

SEQ ID NO: 994840 - protein, 9 aa, Homo Sapiens
SIRKFSYCE

SEQ ID NO: 994841 - protein, 9 aa, Homo Sapiens
FPANKKKGI

SEQ ID NO: 994842 - protein, 9 aa, Homo Sapiens
STLRCLCVL

SEQ ID NO: 994843 - protein, 9 aa, Homo Sapiens
GGHINSGGH

SEQ ID NO: 994844 - protein, 9 aa, Homo Sapiens
SPRPKKPPE

SEQ ID NO: 994845 - protein, 9 aa, Homo Sapiens
LSVRFKAEK

SEQ ID NO: 994846 - protein, 9 aa, Homo Sapiens
YDLEKLSLV

SEQ ID NO: 994847 - protein, 9 aa, Homo Sapiens
GVLPNIQVV

SEQ ID NO: 994848 - protein, 9 aa, Homo Sapiens
KKIYTVEKP

SEQ ID NO: 994849 - protein, 9 aa, Homo Sapiens
QLRKFQKEL

SEQ ID NO: 994850 - protein, 9 aa, Homo Sapiens
LSSNERLEF

SEQ ID NO: 994851 - protein, 9 aa, Homo Sapiens
EGPAPEDSQ

SEQ ID NO: 994852 - protein, 9 aa, Homo Sapiens
GFPGVKRDR

SEQ ID NO: 994853 - protein, 9 aa, Homo Sapiens
GSPAAGSAS

SEQ ID NO: 994854 - protein, 9 aa, Homo Sapiens
FPVGFVAAE

SEQ ID NO: 994855 - protein, 9 aa, Homo Sapiens
EKRILVDLS

SEQ ID NO: 994856 - protein, 9 aa, Homo Sapiens
GSPTSEIQW

SEQ ID NO: 994857 - protein, 9 aa, Homo Sapiens
EAQGLLLRR

SEQ ID NO: 994858 - protein, 9 aa, Homo Sapiens
SLLRYGLPV

SEQ ID NO: 994859 - protein, 9 aa, Homo Sapiens
CPSTTLAAD

SEQ ID NO: 994860 - protein, 9 aa, Homo Sapiens
WWRGEIYGL

SEQ ID NO: 994861 - protein, 9 aa, Homo Sapiens
PFWLLSPGS

SEQ ID NO: 994862 - protein, 9 aa, Homo Sapiens
NNYQACLGS

SEQ ID NO: 994863 - protein, 9 aa, Homo Sapiens
KWSPPKKPN

SEQ ID NO: 994864 - protein, 9 aa, Homo Sapiens
RTNLEISKM

SEQ ID NO: 994865 - protein, 9 aa, Homo Sapiens
EATHTGVKL

SEQ ID NO: 994866 - protein, 9 aa, Homo Sapiens
FWLLSPGSE

SEQ ID NO: 994867 - protein, 9 aa, Homo Sapiens
DAWKKLTIV

SEQ ID NO: 994868 - protein, 9 aa, Homo Sapiens
IKGLPPGIP

SEQ ID NO: 994869 - protein, 9 aa, Homo Sapiens
LQRRRGELG

SEQ ID NO: 994870 - protein, 9 aa, Homo Sapiens
RQDFVAKKL

SEQ ID NO: 994871 - protein, 9 aa, Homo Sapiens
SALSGTIIP

SEQ ID NO: 994872 - protein, 9 aa, Homo Sapiens
WWMGGVPVS

SEQ ID NO: 994873 - protein, 9 aa, Homo Sapiens
KENEVNISP

SEQ ID NO: 994874 - protein, 9 aa, Homo Sapiens
ATWLRGLED

SEQ ID NO: 994875 - protein, 9 aa, Homo Sapiens
IHDLESHSI

SEQ ID NO: 994876 - protein, 9 aa, Homo Sapiens
YKHSQATQP

SEQ ID NO: 994877 - protein, 9 aa, Homo Sapiens
LAVRQPTER

SEQ ID NO: 994878 - protein, 9 aa, Homo Sapiens
SGSSSLSSS

SEQ ID NO: 994879 - protein, 9 aa, Homo Sapiens
ALFDYDLLT

SEQ ID NO: 994880 - protein, 9 aa, Homo Sapiens
EHQDPAFFW

SEQ ID NO: 994881 - protein, 9 aa, Homo Sapiens
KGTEGPMGP

SEQ ID NO: 994882 - protein, 9 aa, Homo Sapiens
NCPVGKKDA

SEQ ID NO: 994883 - protein, 9 aa, Homo Sapiens
KLSLVEDFM

SEQ ID NO: 994884 - protein, 9 aa, Homo Sapiens
PKMLVNFQF

SEQ ID NO: 994885 - protein, 9 aa, Homo Sapiens
PTVCNGRKV

SEQ ID NO: 994886 - protein, 9 aa, Homo Sapiens
PLIPVTFML

SEQ ID NO: 994887 - protein, 9 aa, Homo Sapiens
FHSMDIFFG

SEQ ID NO: 994888 - protein, 9 aa, Homo Sapiens
RKEASNILL

SEQ ID NO: 994889 - protein, 9 aa, Homo Sapiens
ERRGTKRIS

SEQ ID NO: 994890 - protein, 9 aa, Homo Sapiens
QEEQSLQRS

SEQ ID NO: 994891 - protein, 9 aa, Homo Sapiens
QYFFVASVV

SEQ ID NO: 994892 - protein, 9 aa, Homo Sapiens
VRFKVIPQS

SEQ ID NO: 994893 - protein, 9 aa, Homo Sapiens
NEDGLYLAS

SEQ ID NO: 994894 - protein, 9 aa, Homo Sapiens
ISKMKVLKF

SEQ ID NO: 994895 - protein, 9 aa, Homo Sapiens
KFFKLPYLS

SEQ ID NO: 994896 - protein, 9 aa, Homo Sapiens
LSPSEELEL

SEQ ID NO: 994897 - protein, 9 aa, Homo Sapiens
RSSASATPP

SEQ ID NO: 994898 - protein, 9 aa, Homo Sapiens
QKAPTQKSG

SEQ ID NO: 994899 - protein, 9 aa, Homo Sapiens
SSGPIFCQV

SEQ ID NO: 994900 - protein, 9 aa, Homo Sapiens
LLLLTVLRS

SEQ ID NO: 994901 - protein, 9 aa, Homo Sapiens
LEVRPWNTR

SEQ ID NO: 994902 - protein, 9 aa, Homo Sapiens
LLRRHHNYL

SEQ ID NO: 994903 - protein, 9 aa, Homo Sapiens
IMAYTTKFV

SEQ ID NO: 994904 - protein, 9 aa, Homo Sapiens
FTKKPIPDE

SEQ ID NO: 994905 - protein, 9 aa, Homo Sapiens
LKGLKFNLM

SEQ ID NO: 994906 - protein, 9 aa, Homo Sapiens
KKFTKKPIP

SEQ ID NO: 994907 - protein, 9 aa, Homo Sapiens
RRQQLVGNG

SEQ ID NO: 994908 - protein, 9 aa, Homo Sapiens
KSYRDTEDR

SEQ ID NO: 994909 - protein, 9 aa, Homo Sapiens
YLIPRYVRD

SEQ ID NO: 994910 - protein, 9 aa, Homo Sapiens
NMLCGIGET

SEQ ID NO: 994911 - protein, 9 aa, Homo Sapiens
QPRSLRWPV

SEQ ID NO: 994912 - protein, 9 aa, Homo Sapiens
LGAPASKLL

SEQ ID NO: 994913 - protein, 9 aa, Homo Sapiens
SSAMKNSPL

SEQ ID NO: 994914 - protein, 9 aa, Homo Sapiens
RGIKFEEKV

SEQ ID NO: 994915 - protein, 9 aa, Homo Sapiens
LLFFLFFCM

SEQ ID NO: 994916 - protein, 9 aa, Homo Sapiens
LFSIVKEET

SEQ ID NO: 994917 - protein, 9 aa, Homo Sapiens
EISKMKVLK

SEQ ID NO: 994918 - protein, 9 aa, Homo Sapiens
IRESIRKFS

SEQ ID NO: 994919 - protein, 9 aa, Homo Sapiens
HEDDQPDSS

SEQ ID NO: 994920 - protein, 9 aa, Homo Sapiens
VLSANNYQG

SEQ ID NO: 994921 - protein, 9 aa, Homo Sapiens
PSTRASSSR

SEQ ID NO: 994922 - protein, 9 aa, Homo Sapiens
YYDLKHVIF

SEQ ID NO: 994923 - protein, 9 aa, Homo Sapiens
RIGACFLCH

SEQ ID NO: 994924 - protein, 9 aa, Homo Sapiens
ANNYQACLG

SEQ ID NO: 994925 - protein, 9 aa, Homo Sapiens
NWAKVFGEG

SEQ ID NO: 994926 - protein, 9 aa, Homo Sapiens
HTYRVVRFK

SEQ ID NO: 994927 - protein, 9 aa, Homo Sapiens
ACTAVLESL

SEQ ID NO: 994928 - protein, 9 aa, Homo Sapiens
VVMEQGQRV

SEQ ID NO: 994929 - protein, 9 aa, Homo Sapiens
AGIQEVVEA

SEQ ID NO: 994930 - protein, 9 aa, Homo Sapiens
SQQRRPSVC

SEQ ID NO: 994931 - protein, 9 aa, Homo Sapiens
QLTTLCQNR

SEQ ID NO: 994932 - protein, 9 aa, Homo Sapiens
GPIFCQVCR

SEQ ID NO: 994933 - protein, 9 aa, Homo Sapiens
PNIQVVLLP

SEQ ID NO: 994934 - protein, 9 aa, Homo Sapiens
PDGPDPAWE

SEQ ID NO: 994935 - protein, 9 aa, Homo Sapiens
FVRPPAKDG

SEQ ID NO: 994936 - protein, 9 aa, Homo Sapiens
SQCLGSQKA

SEQ ID NO: 994937 - protein, 9 aa, Homo Sapiens
PEEPPAHRL

SEQ ID NO: 994938 - protein, 9 aa, Homo Sapiens
KKTDTNAPT

SEQ ID NO: 994939 - protein, 9 aa, Homo Sapiens
PRKVKQYLV

SEQ ID NO: 994940 - protein, 9 aa, Homo Sapiens
DSSLRITTV

SEQ ID NO: 994941 - protein, 9 aa, Homo Sapiens
FTSARYICL

SEQ ID NO: 994942 - protein, 9 aa, Homo Sapiens
LLQPGRDEE

SEQ ID NO: 994943 - protein, 9 aa, Homo Sapiens
PTIDISPRS

SEQ ID NO: 994944 - protein, 9 aa, Homo Sapiens
YICPSTTLA

SEQ ID NO: 994945 - protein, 9 aa, Homo Sapiens
PGDSFSTYV

SEQ ID NO: 994946 - protein, 9 aa, Homo Sapiens
VEKMFPHCK

SEQ ID NO: 994947 - protein, 9 aa, Homo Sapiens
GLLIAVEIN

SEQ ID NO: 994948 - protein, 9 aa, Homo Sapiens
SPKCTPKCP

SEQ ID NO: 994949 - protein, 9 aa, Homo Sapiens
AMKNSPLSK

SEQ ID NO: 994950 - protein, 9 aa, Homo Sapiens
KTTEPGLFG

SEQ ID NO: 994951 - protein, 9 aa, Homo Sapiens
LVSPKKLKK

SEQ ID NO: 994952 - protein, 9 aa, Homo Sapiens
SEDLCKGKD

SEQ ID NO: 994953 - protein, 9 aa, Homo Sapiens
PKKPPEEPG

SEQ ID NO: 994954 - protein, 9 aa, Homo Sapiens
PVITLVEIG

SEQ ID NO: 994955 - protein, 9 aa, Homo Sapiens
FAQPGFFEY

SEQ ID NO: 994956 - protein, 9 aa, Homo Sapiens
NGILSSPQK

SEQ ID NO: 994957 - protein, 9 aa, Homo Sapiens
DGRIYKHFQ

SEQ ID NO: 994958 - protein, 9 aa, Homo Sapiens
GKLRVHTQA

SEQ ID NO: 994959 - protein, 9 aa, Homo Sapiens
SLPTKKFTK

SEQ ID NO: 994960 - protein, 9 aa, Homo Sapiens
GADLTTKAD

SEQ ID NO: 994961 - protein, 9 aa, Homo Sapiens
PPFRFLKGG

SEQ ID NO: 994962 - protein, 9 aa, Homo Sapiens
VSVDGMDGS

SEQ ID NO: 994963 - protein, 9 aa, Homo Sapiens
MALTFFVFK

SEQ ID NO: 994964 - protein, 9 aa, Homo Sapiens
FMGNMLCGI

SEQ ID NO: 994965 - protein, 9 aa, Homo Sapiens
LLNRGQEEK

SEQ ID NO: 994966 - protein, 9 aa, Homo Sapiens
ESSFLPASF

SEQ ID NO: 994967 - protein, 9 aa, Homo Sapiens
KHRFRGSGK

SEQ ID NO: 994968 - protein, 9 aa, Homo Sapiens
PTQKSGCNK

SEQ ID NO: 994969 - protein, 9 aa, Homo Sapiens
NAFVSRLSL

SEQ ID NO: 994970 - protein, 9 aa, Homo Sapiens
GIPVAPFSG

SEQ ID NO: 994971 - protein, 9 aa, Homo Sapiens
LLPVITLVE

SEQ ID NO: 994972 - protein, 9 aa, Homo Sapiens
TFLDNLCAA

SEQ ID NO: 994973 - protein, 9 aa, Homo Sapiens
VNVAQPVCF

SEQ ID NO: 994974 - protein, 9 aa, Homo Sapiens
RSVMEASFP

SEQ ID NO: 994975 - protein, 9 aa, Homo Sapiens
HFQQPLITY

SEQ ID NO: 994976 - protein, 9 aa, Homo Sapiens
YGQIDRKGQ

SEQ ID NO: 994977 - protein, 9 aa, Homo Sapiens
SARRFFWNS

SEQ ID NO: 994978 - protein, 9 aa, Homo Sapiens
SPPKKPNGI

SEQ ID NO: 994979 - protein, 9 aa, Homo Sapiens
EDSLQDYPF

SEQ ID NO: 994980 - protein, 9 aa, Homo Sapiens
YLYTAPIFN

SEQ ID NO: 994981 - protein, 9 aa, Homo Sapiens
LIKECTLLK

SEQ ID NO: 994982 - protein, 9 aa, Homo Sapiens
FAAGFNSIG

SEQ ID NO: 994983 - protein, 9 aa, Homo Sapiens
PKGPPPPPG

SEQ ID NO: 994984 - protein, 9 aa, Homo Sapiens
VDGAEAEAF

SEQ ID NO: 994985 - protein, 9 aa, Homo Sapiens
PEKLVVLKV

SEQ ID NO: 994986 - protein, 9 aa, Homo Sapiens
SNDNYDLKP

SEQ ID NO: 994987 - protein, 9 aa, Homo Sapiens
LEEEQKKSI

SEQ ID NO: 994988 - protein, 9 aa, Homo Sapiens
SRLSLFSRM

SEQ ID NO: 994989 - protein, 9 aa, Homo Sapiens
KFNLMETSE

SEQ ID NO: 994990 - protein, 9 aa, Homo Sapiens
VIIMAYTTK

SEQ ID NO: 994991 - protein, 9 aa, Homo Sapiens
TAVLESLFF

SEQ ID NO: 994992 - protein, 9 aa, Homo Sapiens
PMFMYICPS

SEQ ID NO: 994993 - protein, 9 aa, Homo Sapiens
VKSSTENHG

SEQ ID NO: 994994 - protein, 9 aa, Homo Sapiens
LGPGDSFST

SEQ ID NO: 994995 - protein, 9 aa, Homo Sapiens
AKRAIHYFK

SEQ ID NO: 994996 - protein, 9 aa, Homo Sapiens
DGVFPGDHK

SEQ ID NO: 994997 - protein, 9 aa, Homo Sapiens
SPENGPGLS

SEQ ID NO: 994998 - protein, 9 aa, Homo Sapiens
INSTGKFAF

SEQ ID NO: 994999 - protein, 9 aa, Homo Sapiens
PEMRCGEET

SEQ ID NO: 995000 - protein, 9 aa, Homo Sapiens
ETPFWMAPE

SEQ ID NO: 995001 - protein, 9 aa, Homo Sapiens
GLANSSIVI

SEQ ID NO: 995002 - protein, 9 aa, Homo Sapiens
LAQHRKIYT

SEQ ID NO: 995003 - protein, 9 aa, Homo Sapiens
QELVAKLHS

SEQ ID NO: 995004 - protein, 9 aa, Homo Sapiens
VAKKLDQQF

SEQ ID NO: 995005 - protein, 9 aa, Homo Sapiens
VITLVEIGQ

SEQ ID NO: 995006 - protein, 9 aa, Homo Sapiens
DPTSLLKEI

SEQ ID NO: 995007 - protein, 9 aa, Homo Sapiens
CTRLYNQLT

SEQ ID NO: 995008 - protein, 9 aa, Homo Sapiens
ANSPKVPVK

SEQ ID NO: 995009 - protein, 9 aa, Homo Sapiens
SRPGCQQRP

SEQ ID NO: 995010 - protein, 9 aa, Homo Sapiens
VVEWWFQVL

SEQ ID NO: 995011 - protein, 9 aa, Homo Sapiens
KMKYCFKVF

SEQ ID NO: 995012 - protein, 9 aa, Homo Sapiens
CSDQMDFRE

SEQ ID NO: 995013 - protein, 9 aa, Homo Sapiens
YAPTMPYKH

SEQ ID NO: 995014 - protein, 9 aa, Homo Sapiens
DVVGSPTSE

SEQ ID NO: 995015 - protein, 9 aa, Homo Sapiens
KADSGYTPM

SEQ ID NO: 995016 - protein, 9 aa, Homo Sapiens
VSKMHKMPD

SEQ ID NO: 995017 - protein, 9 aa, Homo Sapiens
PGDHKSHRG

SEQ ID NO: 995018 - protein, 9 aa, Homo Sapiens
CEVLAMIKL

SEQ ID NO: 995019 - protein, 9 aa, Homo Sapiens
SERDVAKHK

SEQ ID NO: 995020 - protein, 9 aa, Homo Sapiens
QRNWAKVFG

SEQ ID NO: 995021 - protein, 9 aa, Homo Sapiens
LGLLEKMRD

SEQ ID NO: 995022 - protein, 9 aa, Homo Sapiens
EDASAYLNL

SEQ ID NO: 995023 - protein, 9 aa, Homo Sapiens
ARGADLTTK

SEQ ID NO: 995024 - protein, 9 aa, Homo Sapiens
LIYNQKKGH

SEQ ID NO: 995025 - protein, 9 aa, Homo Sapiens
KDEDECEEE

SEQ ID NO: 995026 - protein, 9 aa, Homo Sapiens
ELPFPRKGG

SEQ ID NO: 995027 - protein, 9 aa, Homo Sapiens
DSEIQLKWK

SEQ ID NO: 995028 - protein, 9 aa, Homo Sapiens
CFSSFLGKC

SEQ ID NO: 995029 - protein, 9 aa, Homo Sapiens
MLLVLSFPF

SEQ ID NO: 995030 - protein, 9 aa, Homo Sapiens
QVWRAKVGV

SEQ ID NO: 995031 - protein, 9 aa, Homo Sapiens
SCPEPLLVL

SEQ ID NO: 995032 - protein, 9 aa, Homo Sapiens
SENEKKAEC

SEQ ID NO: 995033 - protein, 9 aa, Homo Sapiens
LCPDTYIGS

SEQ ID NO: 995034 - protein, 9 aa, Homo Sapiens
PISISDLEL

SEQ ID NO: 995035 - protein, 9 aa, Homo Sapiens
APEDSQAVR

SEQ ID NO: 995036 - protein, 9 aa, Homo Sapiens
PQFKISLSE

SEQ ID NO: 995037 - protein, 9 aa, Homo Sapiens
SEAYDHCFE

SEQ ID NO: 995038 - protein, 9 aa, Homo Sapiens
QKKSIEERK

SEQ ID NO: 995039 - protein, 9 aa, Homo Sapiens
VFVESLLRY

SEQ ID NO: 995040 - protein, 9 aa, Homo Sapiens
TTKFVDLGN

SEQ ID NO: 995041 - protein, 9 aa, Homo Sapiens
YSSRLMRRQ

SEQ ID NO: 995042 - protein, 9 aa, Homo Sapiens
FVESLLRYG

SEQ ID NO: 995043 - protein, 9 aa, Homo Sapiens
GYPLPALIS

SEQ ID NO: 995044 - protein, 9 aa, Homo Sapiens
VSQRNWAKV

SEQ ID NO: 995045 - protein, 9 aa, Homo Sapiens
SENITTHEV

SEQ ID NO: 995046 - protein, 9 aa, Homo Sapiens
PGPVKLSGE

SEQ ID NO: 995047 - protein, 9 aa, Homo Sapiens
AKELPFPRK

SEQ ID NO: 995048 - protein, 9 aa, Homo Sapiens
RFLKGGHLL

SEQ ID NO: 995049 - protein, 9 aa, Homo Sapiens
CPVGKKDAD

SEQ ID NO: 995050 - protein, 9 aa, Homo Sapiens
TEKSRWSGS

SEQ ID NO: 995051 - protein, 9 aa, Homo Sapiens
PLKYIRPIW

SEQ ID NO: 995052 - protein, 9 aa, Homo Sapiens
GVLSANNYQ

SEQ ID NO: 995053 - protein, 9 aa, Homo Sapiens
GPGDSFSTY

SEQ ID NO: 995054 - protein, 9 aa, Homo Sapiens
WREAQRQVE

SEQ ID NO: 995055 - protein, 9 aa, Homo Sapiens
NITALNYDI

SEQ ID NO: 995056 - protein, 9 aa, Homo Sapiens
FVAPAKFLE

SEQ ID NO: 995057 - protein, 9 aa, Homo Sapiens
EVLAMIKLA

SEQ ID NO: 995058 - protein, 9 aa, Homo Sapiens
ALDLQEGKF

SEQ ID NO: 995059 - protein, 9 aa, Homo Sapiens
HRLEREFRN

SEQ ID NO: 995060 - protein, 9 aa, Homo Sapiens
PQTQATQKG

SEQ ID NO: 995061 - protein, 9 aa, Homo Sapiens
KTIVLLSIV

SEQ ID NO: 995062 - protein, 9 aa, Homo Sapiens
TEEDGNSDP

SEQ ID NO: 995063 - protein, 9 aa, Homo Sapiens
RDEEQGLEL

SEQ ID NO: 995064 - protein, 9 aa, Homo Sapiens
VFPGDHKSH

SEQ ID NO: 995065 - protein, 9 aa, Homo Sapiens
KVSRGPLQG

SEQ ID NO: 995066 - protein, 9 aa, Homo Sapiens
CHHPDEAVL

SEQ ID NO: 995067 - protein, 9 aa, Homo Sapiens
RVGKNGAPK

SEQ ID NO: 995068 - protein, 9 aa, Homo Sapiens
FNEDGLYLA

SEQ ID NO: 995069 - protein, 9 aa, Homo Sapiens
TFGKRIKNT

SEQ ID NO: 995070 - protein, 9 aa, Homo Sapiens
LSTLRCLCV

SEQ ID NO: 995071 - protein, 9 aa, Homo Sapiens
GIPGNPGLS

SEQ ID NO: 995072 - protein, 9 aa, Homo Sapiens
EEALRHTEV

SEQ ID NO: 995073 - protein, 9 aa, Homo Sapiens
QKEVMEKAR

SEQ ID NO: 995074 - protein, 9 aa, Homo Sapiens
QNLDLNQNF

SEQ ID NO: 995075 - protein, 9 aa, Homo Sapiens
FTQEGKSNG

SEQ ID NO: 995076 - protein, 9 aa, Homo Sapiens
RAPVLLQRR

SEQ ID NO: 995077 - protein, 9 aa, Homo Sapiens
RRYNLLSFM

SEQ ID NO: 995078 - protein, 9 aa, Homo Sapiens
GSSNLFKSK

SEQ ID NO: 995079 - protein, 9 aa, Homo Sapiens
RPGCQQRPL

SEQ ID NO: 995080 - protein, 9 aa, Homo Sapiens
VILNGLLIA

SEQ ID NO: 995081 - protein, 9 aa, Homo Sapiens
SYSNCVSID

SEQ ID NO: 995082 - protein, 9 aa, Homo Sapiens
YSSSLSQHE

SEQ ID NO: 995083 - protein, 9 aa, Homo Sapiens
CAPSDQSSD

SEQ ID NO: 995084 - protein, 9 aa, Homo Sapiens
PGVVGVPRA

SEQ ID NO: 995085 - protein, 9 aa, Homo Sapiens
SLNLSVRFK

SEQ ID NO: 995086 - protein, 9 aa, Homo Sapiens
PSSTVPLPH

SEQ ID NO: 995087 - protein, 9 aa, Homo Sapiens
RSENEKKAE

SEQ ID NO: 995088 - protein, 9 aa, Homo Sapiens
VFMGNMLCG

SEQ ID NO: 995089 - protein, 9 aa, Homo Sapiens
AIDVNGKEF

SEQ ID NO: 995090 - protein, 9 aa, Homo Sapiens
PYCRRSEKP

SEQ ID NO: 995091 - protein, 9 aa, Homo Sapiens
VLSFPFTLR

SEQ ID NO: 995092 - protein, 9 aa, Homo Sapiens
FFVFKATFC

SEQ ID NO: 995093 - protein, 9 aa, Homo Sapiens
IPGNPGLSG

SEQ ID NO: 995094 - protein, 9 aa, Homo Sapiens
VVVFTSYLF

SEQ ID NO: 995095 - protein, 9 aa, Homo Sapiens
YKHFQQPLI

SEQ ID NO: 995096 - protein, 9 aa, Homo Sapiens
CASQKNKKC

SEQ ID NO: 995097 - protein, 9 aa, Homo Sapiens
VIVLVGLVA

SEQ ID NO: 995098 - protein, 9 aa, Homo Sapiens
TLSLLQVQL

SEQ ID NO: 995099 - protein, 9 aa, Homo Sapiens
AEVKLVDFR

SEQ ID NO: 995100 - protein, 9 aa, Homo Sapiens
NQLTDAQGK

SEQ ID NO: 995101 - protein, 9 aa, Homo Sapiens
GDRESKKTD

SEQ ID NO: 995102 - protein, 9 aa, Homo Sapiens
HLILDPPKK

SEQ ID NO: 995103 - protein, 9 aa, Homo Sapiens
ENSENITTH

SEQ ID NO: 995104 - protein, 9 aa, Homo Sapiens
MAVVMEQGQ

SEQ ID NO: 995105 - protein, 9 aa, Homo Sapiens
YTVEKPYKC

SEQ ID NO: 995106 - protein, 9 aa, Homo Sapiens
MLDLLGNRK

SEQ ID NO: 995107 - protein, 9 aa, Homo Sapiens
RPPFRFLKG

SEQ ID NO: 995108 - protein, 9 aa, Homo Sapiens
PVSVDGMDG

SEQ ID NO: 995109 - protein, 9 aa, Homo Sapiens
GGLVLQRKS

SEQ ID NO: 995110 - protein, 9 aa, Homo Sapiens
TNKPSRLLF

SEQ ID NO: 995111 - protein, 9 aa, Homo Sapiens
CMKKYKDTF

SEQ ID NO: 995112 - protein, 9 aa, Homo Sapiens
GGVPVSVDG

SEQ ID NO: 995113 - protein, 9 aa, Homo Sapiens
PGSEDLCKG

SEQ ID NO: 995114 - protein, 9 aa, Homo Sapiens
PNWMKNPWV

SEQ ID NO: 995115 - protein, 9 aa, Homo Sapiens
FFIFPEEDM

SEQ ID NO: 995116 - protein, 9 aa, Homo Sapiens
LDNLCAAGL

SEQ ID NO: 995117 - protein, 9 aa, Homo Sapiens
KTVIPISIS

SEQ ID NO: 995118 - protein, 9 aa, Homo Sapiens
YCTLSLLQV

SEQ ID NO: 995119 - protein, 9 aa, Homo Sapiens
TDKFALSKI

SEQ ID NO: 995120 - protein, 9 aa, Homo Sapiens
SIKIHTYGQ

SEQ ID NO: 995121 - protein, 9 aa, Homo Sapiens
IDVNGKEFS

SEQ ID NO: 995122 - protein, 9 aa, Homo Sapiens
WKRRQQLVG

SEQ ID NO: 995123 - protein, 9 aa, Homo Sapiens
NYALTSRFC

SEQ ID NO: 995124 - protein, 9 aa, Homo Sapiens
EVGSCKLSS

SEQ ID NO: 995125 - protein, 9 aa, Homo Sapiens
EAGYKKDLG

SEQ ID NO: 995126 - protein, 9 aa, Homo Sapiens
LSLVEDFMC

SEQ ID NO: 995127 - protein, 9 aa, Homo Sapiens
RRVVPTAPK

SEQ ID NO: 995128 - protein, 9 aa, Homo Sapiens
RPSLHSEIW

SEQ ID NO: 995129 - protein, 9 aa, Homo Sapiens
RAIHYFKGW

SEQ ID NO: 995130 - protein, 9 aa, Homo Sapiens
MEGRKMATD

SEQ ID NO: 995131 - protein, 9 aa, Homo Sapiens
GSSSLSSSS

SEQ ID NO: 995132 - protein, 9 aa, Homo Sapiens
KETARGIKF

SEQ ID NO: 995133 - protein, 9 aa, Homo Sapiens
LQEGKFYWG

SEQ ID NO: 995134 - protein, 9 aa, Homo Sapiens
IWEIPFEKN

SEQ ID NO: 995135 - protein, 9 aa, Homo Sapiens
HADAKCVNL

SEQ ID NO: 995136 - protein, 9 aa, Homo Sapiens
GFFIFPEED

SEQ ID NO: 995137 - protein, 9 aa, Homo Sapiens
RPKKPPEEP

SEQ ID NO: 995138 - protein, 9 aa, Homo Sapiens
AVKVFFFAN

SEQ ID NO: 995139 - protein, 9 aa, Homo Sapiens
EEEKHDCTE

SEQ ID NO: 995140 - protein, 9 aa, Homo Sapiens
SLFSRMKPA

SEQ ID NO: 995141 - protein, 9 aa, Homo Sapiens
HYGQIDRKG

SEQ ID NO: 995142 - protein, 9 aa, Homo Sapiens
ASPFFTDKF

SEQ ID NO: 995143 - protein, 9 aa, Homo Sapiens
GEGSPKPRI

SEQ ID NO: 995144 - protein, 9 aa, Homo Sapiens
RCSKKDLER

SEQ ID NO: 995145 - protein, 9 aa, Homo Sapiens
IPVFSGGTP

SEQ ID NO: 995146 - protein, 9 aa, Homo Sapiens
KHFIIYLIP

SEQ ID NO: 995147 - protein, 9 aa, Homo Sapiens
QVLNSSSES

SEQ ID NO: 995148 - protein, 9 aa, Homo Sapiens
DFDQEKKID

SEQ ID NO: 995149 - protein, 9 aa, Homo Sapiens
KFSYCEATL

SEQ ID NO: 995150 - protein, 9 aa, Homo Sapiens
PVSHSWHNG

SEQ ID NO: 995151 - protein, 9 aa, Homo Sapiens
SLHSEIWEI

SEQ ID NO: 995152 - protein, 9 aa, Homo Sapiens
CQIEVLTTV

SEQ ID NO: 995153 - protein, 9 aa, Homo Sapiens
IKIHTYGQA

SEQ ID NO: 995154 - protein, 9 aa, Homo Sapiens
FVKSSTENH

SEQ ID NO: 995155 - protein, 9 aa, Homo Sapiens
CKGKDQMHS

SEQ ID NO: 995156 - protein, 9 aa, Homo Sapiens
FNSIGLPHS

SEQ ID NO: 995157 - protein, 9 aa, Homo Sapiens
NWMKNPWVK

SEQ ID NO: 995158 - protein, 9 aa, Homo Sapiens
PYLWKSTLP

SEQ ID NO: 995159 - protein, 9 aa, Homo Sapiens
ISSPELQEW

SEQ ID NO: 995160 - protein, 9 aa, Homo Sapiens
KAFMKEGLL

SEQ ID NO: 995161 - protein, 9 aa, Homo Sapiens
VGFVAAERV

SEQ ID NO: 995162 - protein, 9 aa, Homo Sapiens
WQQVATALM

SEQ ID NO: 995163 - protein, 9 aa, Homo Sapiens
KKKGIEQNE

SEQ ID NO: 995164 - protein, 9 aa, Homo Sapiens
DPSARRFFW

SEQ ID NO: 995165 - protein, 9 aa, Homo Sapiens
ILLCPDTYI

SEQ ID NO: 995166 - protein, 9 aa, Homo Sapiens
SPRSATIQM

SEQ ID NO: 995167 - protein, 9 aa, Homo Sapiens
IWQQVATAL

SEQ ID NO: 995168 - protein, 9 aa, Homo Sapiens
PAAAALAAA

SEQ ID NO: 995169 - protein, 9 aa, Homo Sapiens
YTPPGASRY

SEQ ID NO: 995170 - protein, 9 aa, Homo Sapiens
SYSQQRRPS

SEQ ID NO: 995171 - protein, 9 aa, Homo Sapiens
SSNERLEFI

SEQ ID NO: 995172 - protein, 9 aa, Homo Sapiens
VVPTAPKVL

SEQ ID NO: 995173 - protein, 9 aa, Homo Sapiens
ENEGEDPWY

SEQ ID NO: 995174 - protein, 9 aa, Homo Sapiens
KKLDQQFRE

SEQ ID NO: 995175 - protein, 9 aa, Homo Sapiens
LPVITLVEI

SEQ ID NO: 995176 - protein, 9 aa, Homo Sapiens
LLPSCPEPL

SEQ ID NO: 995177 - protein, 9 aa, Homo Sapiens
LESKVSRGP

SEQ ID NO: 995178 - protein, 9 aa, Homo Sapiens
NKGLANSSI

SEQ ID NO: 995179 - protein, 9 aa, Homo Sapiens
MDPSARRFF

SEQ ID NO: 995180 - protein, 9 aa, Homo Sapiens
SSTENEGED

SEQ ID NO: 995181 - protein, 9 aa, Homo Sapiens
SKESAGLIS

SEQ ID NO: 995182 - protein, 9 aa, Homo Sapiens
GQGIGPIYL

SEQ ID NO: 995183 - protein, 9 aa, Homo Sapiens
QQRPLPWDL

SEQ ID NO: 995184 - protein, 9 aa, Homo Sapiens
LNGLLIAVE

SEQ ID NO: 995185 - protein, 9 aa, Homo Sapiens
YDDLVQTLY

SEQ ID NO: 995186 - protein, 9 aa, Homo Sapiens
WPALATTLK

SEQ ID NO: 995187 - protein, 9 aa, Homo Sapiens
MVILNGLLI

SEQ ID NO: 995188 - protein, 9 aa, Homo Sapiens
PFPRKGGAW

SEQ ID NO: 995189 - protein, 9 aa, Homo Sapiens
DGWSNAFYD

SEQ ID NO: 995190 - protein, 9 aa, Homo Sapiens
FWQNSLLVK

SEQ ID NO: 995191 - protein, 9 aa, Homo Sapiens
DKSFESLLQ

SEQ ID NO: 995192 - protein, 9 aa, Homo Sapiens
KHEDVEKVY

SEQ ID NO: 995193 - protein, 9 aa, Homo Sapiens
NISNSEAYD

SEQ ID NO: 995194 - protein, 9 aa, Homo Sapiens
FPHCKNVNK

SEQ ID NO: 995195 - protein, 9 aa, Homo Sapiens
SPFFTDKFA

SEQ ID NO: 995196 - protein, 9 aa, Homo Sapiens
APGSVKLIY

SEQ ID NO: 995197 - protein, 9 aa, Homo Sapiens
NCITENDCT

SEQ ID NO: 995198 - protein, 9 aa, Homo Sapiens
PGSVKLIYK

SEQ ID NO: 995199 - protein, 9 aa, Homo Sapiens
KYEEMRKEA

SEQ ID NO: 995200 - protein, 9 aa, Homo Sapiens
LMALTFFVF

SEQ ID NO: 995201 - protein, 9 aa, Homo Sapiens
QKAFMKEGL

SEQ ID NO: 995202 - protein, 9 aa, Homo Sapiens
HSLQFDQRE

SEQ ID NO: 995203 - protein, 9 aa, Homo Sapiens
DIFALVECE

SEQ ID NO: 995204 - protein, 9 aa, Homo Sapiens
AGEKGAPEE

SEQ ID NO: 995205 - protein, 9 aa, Homo Sapiens
LKYIRPIWQ

SEQ ID NO: 995206 - protein, 9 aa, Homo Sapiens
LLIFFSYAL

SEQ ID NO: 995207 - protein, 9 aa, Homo Sapiens
FALVECESD

SEQ ID NO: 995208 - protein, 9 aa, Homo Sapiens
SNPVSMPEV

SEQ ID NO: 995209 - protein, 9 aa, Homo Sapiens
EEMRKEASN

SEQ ID NO: 995210 - protein, 9 aa, Homo Sapiens
MFMYICPST

SEQ ID NO: 995211 - protein, 9 aa, Homo Sapiens
DQMTFGKRI

SEQ ID NO: 995212 - protein, 9 aa, Homo Sapiens
DGICTPNWR

SEQ ID NO: 995213 - protein, 9 aa, Homo Sapiens
PTSLLKEIR

SEQ ID NO: 995214 - protein, 9 aa, Homo Sapiens
KPSRLLFLD

SEQ ID NO: 995215 - protein, 9 aa, Homo Sapiens
EEILKLKFL

SEQ ID NO: 995216 - protein, 9 aa, Homo Sapiens
QILACGGDG

SEQ ID NO: 995217 - protein, 9 aa, Homo Sapiens
KAECFSSPK

SEQ ID NO: 995218 - protein, 9 aa, Homo Sapiens
YNQKKGHFP

SEQ ID NO: 995219 - protein, 9 aa, Homo Sapiens
KDGWSNAFY

SEQ ID NO: 995220 - protein, 9 aa, Homo Sapiens
DEVDFYYDL

SEQ ID NO: 995221 - protein, 9 aa, Homo Sapiens
GVAEEELQK

SEQ ID NO: 995222 - protein, 9 aa, Homo Sapiens
GFISNKGRL

SEQ ID NO: 995223 - protein, 9 aa, Homo Sapiens
REQELEQAW

SEQ ID NO: 995224 - protein, 9 aa, Homo Sapiens
KRAIHYFKG

SEQ ID NO: 995225 - protein, 9 aa, Homo Sapiens
PKDRVGKNG

SEQ ID NO: 995226 - protein, 9 aa, Homo Sapiens
VTSASSAMK

SEQ ID NO: 995227 - protein, 9 aa, Homo Sapiens
LEISKMKVL

SEQ ID NO: 995228 - protein, 9 aa, Homo Sapiens
QRRPSVCSG

SEQ ID NO: 995229 - protein, 9 aa, Homo Sapiens
CECLHGRTG

SEQ ID NO: 995230 - protein, 9 aa, Homo Sapiens
GVFPGDHKS

SEQ ID NO: 995231 - protein, 9 aa, Homo Sapiens
KLTEFHVAF

SEQ ID NO: 995232 - protein, 9 aa, Homo Sapiens
LSEGDDPED

SEQ ID NO: 995233 - protein, 9 aa, Homo Sapiens
TYFFSPQNN

SEQ ID NO: 995234 - protein, 9 aa, Homo Sapiens
DLSYTPLRR

SEQ ID NO: 995235 - protein, 9 aa, Homo Sapiens
PPGASRYTI

SEQ ID NO: 995236 - protein, 9 aa, Homo Sapiens
EQAQPPYLW

SEQ ID NO: 995237 - protein, 9 aa, Homo Sapiens
CGLSHSVAW

SEQ ID NO: 995238 - protein, 9 aa, Homo Sapiens
AFPLLFEIF

SEQ ID NO: 995239 - protein, 9 aa, Homo Sapiens
AQELVAKLH

SEQ ID NO: 995240 - protein, 9 aa, Homo Sapiens
ITRVACGLS

SEQ ID NO: 995241 - protein, 9 aa, Homo Sapiens
AKVGVAEEE

SEQ ID NO: 995242 - protein, 9 aa, Homo Sapiens
RNWAKVFGE

SEQ ID NO: 995243 - protein, 9 aa, Homo Sapiens
LLEKMRDER

SEQ ID NO: 995244 - protein, 9 aa, Homo Sapiens
DSPENGPGL

SEQ ID NO: 995245 - protein, 9 aa, Homo Sapiens
RAGDSGLLA

SEQ ID NO: 995246 - protein, 9 aa, Homo Sapiens
IDSLLIFFS

SEQ ID NO: 995247 - protein, 9 aa, Homo Sapiens
PQPRSLRWP

SEQ ID NO: 995248 - protein, 9 aa, Homo Sapiens
DLESHSIVL

SEQ ID NO: 995249 - protein, 9 aa, Homo Sapiens
EKMKYCFKV

SEQ ID NO: 995250 - protein, 9 aa, Homo Sapiens
FSFSFLEDS

SEQ ID NO: 995251 - protein, 9 aa, Homo Sapiens
FQVSFWINK

SEQ ID NO: 995252 - protein, 9 aa, Homo Sapiens
SISDLELAS

SEQ ID NO: 995253 - protein, 9 aa, Homo Sapiens
ENRQVNLKI

SEQ ID NO: 995254 - protein, 9 aa, Homo Sapiens
SVSSRLLRL

SEQ ID NO: 995255 - protein, 9 aa, Homo Sapiens
AERPEVGSC

SEQ ID NO: 995256 - protein, 9 aa, Homo Sapiens
NRIHTGEKL

SEQ ID NO: 995257 - protein, 9 aa, Homo Sapiens
VEKVYVYLM

SEQ ID NO: 995258 - protein, 9 aa, Homo Sapiens
MRSVSASPP

SEQ ID NO: 995259 - protein, 9 aa, Homo Sapiens
LVNNKGLAN

SEQ ID NO: 995260 - protein, 9 aa, Homo Sapiens
IQVVLLPKK

SEQ ID NO: 995261 - protein, 9 aa, Homo Sapiens
QVCWKIIES

SEQ ID NO: 995262 - protein, 9 aa, Homo Sapiens
AGFNSIGLP

SEQ ID NO: 995263 - protein, 9 aa, Homo Sapiens
KFYWGDAKT

SEQ ID NO: 995264 - protein, 9 aa, Homo Sapiens
QHFKHRFRG

SEQ ID NO: 995265 - protein, 9 aa, Homo Sapiens
LLTMSPNPD

SEQ ID NO: 995266 - protein, 9 aa, Homo Sapiens
LVERGWVGP

SEQ ID NO: 995267 - protein, 9 aa, Homo Sapiens
SFRYEMLDL

SEQ ID NO: 995268 - protein, 9 aa, Homo Sapiens
FGSSNLFKS

SEQ ID NO: 995269 - protein, 9 aa, Homo Sapiens
ISNKGRLNC

SEQ ID NO: 995270 - protein, 9 aa, Homo Sapiens
AEPLVERGW

SEQ ID NO: 995271 - protein, 9 aa, Homo Sapiens
TKTFPNWMK

SEQ ID NO: 995272 - protein, 9 aa, Homo Sapiens
LRIKKVKGA

SEQ ID NO: 995273 - protein, 9 aa, Homo Sapiens
LIYTLRIKK

SEQ ID NO: 995274 - protein, 9 aa, Homo Sapiens
FPRKGGAWA

SEQ ID NO: 995275 - protein, 9 aa, Homo Sapiens
IGLPHSHST

SEQ ID NO: 995276 - protein, 9 aa, Homo Sapiens
PAAGSASAD

SEQ ID NO: 995277 - protein, 9 aa, Homo Sapiens
IGDAWKKLT

SEQ ID NO: 995278 - protein, 9 aa, Homo Sapiens
MSRHKIQGK

SEQ ID NO: 995279 - protein, 9 aa, Homo Sapiens
LATEKSRWS

SEQ ID NO: 995280 - protein, 9 aa, Homo Sapiens
AYDLEKLSL

SEQ ID NO: 995281 - protein, 9 aa, Homo Sapiens
STRASSSRH

SEQ ID NO: 995282 - protein, 9 aa, Homo Sapiens
PDQEKLGEV

SEQ ID NO: 995283 - protein, 9 aa, Homo Sapiens
RESIRKFSY

SEQ ID NO: 995284 - protein, 9 aa, Homo Sapiens
ENNKGLIKE

SEQ ID NO: 995285 - protein, 9 aa, Homo Sapiens
FIFPEEDMG

SEQ ID NO: 995286 - protein, 9 aa, Homo Sapiens
ERDVAKHKL

SEQ ID NO: 995287 - protein, 9 aa, Homo Sapiens
GQEEKIREQ

SEQ ID NO: 995288 - protein, 9 aa, Homo Sapiens
QAVTEDDED

SEQ ID NO: 995289 - protein, 9 aa, Homo Sapiens
PEPLLVLLD

SEQ ID NO: 995290 - protein, 9 aa, Homo Sapiens
TLSYHKKIY

SEQ ID NO: 995291 - protein, 9 aa, Homo Sapiens
EDLGMNDEE

SEQ ID NO: 995292 - protein, 9 aa, Homo Sapiens
DNANSPKVP

SEQ ID NO: 995293 - protein, 9 aa, Homo Sapiens
ITDVLTEEN

SEQ ID NO: 995294 - protein, 9 aa, Homo Sapiens
LQRKSRKHE

SEQ ID NO: 995295 - protein, 9 aa, Homo Sapiens
VVGVPRAGV

SEQ ID NO: 995296 - protein, 9 aa, Homo Sapiens
PIFCQVCRN

SEQ ID NO: 995297 - protein, 9 aa, Homo Sapiens
VNLHFQDTT

SEQ ID NO: 995298 - protein, 9 aa, Homo Sapiens
LVDLSSREA

SEQ ID NO: 995299 - protein, 9 aa, Homo Sapiens
HSIVLAREL

SEQ ID NO: 995300 - protein, 9 aa, Homo Sapiens
EGLFPRGAD

SEQ ID NO: 995301 - protein, 9 aa, Homo Sapiens
TLKTVATEG

SEQ ID NO: 995302 - protein, 9 aa, Homo Sapiens
EVMEKAREA

SEQ ID NO: 995303 - protein, 9 aa, Homo Sapiens
SYTPLRRQK

SEQ ID NO: 995304 - protein, 9 aa, Homo Sapiens
PCIMTVILF

SEQ ID NO: 995305 - protein, 9 aa, Homo Sapiens
EDLCKGKDQ

SEQ ID NO: 995306 - protein, 9 aa, Homo Sapiens
LRIWLCPYC

SEQ ID NO: 995307 - protein, 9 aa, Homo Sapiens
FKVFDLNGD

SEQ ID NO: 995308 - protein, 9 aa, Homo Sapiens
TQAVTEDDE

SEQ ID NO: 995309 - protein, 9 aa, Homo Sapiens
AQPPYLWKS

SEQ ID NO: 995310 - protein, 9 aa, Homo Sapiens
VVRFKVIPQ

SEQ ID NO: 995311 - protein, 9 aa, Homo Sapiens
NEAGYKKDL

SEQ ID NO: 995312 - protein, 9 aa, Homo Sapiens
GSWWPVLDD

SEQ ID NO: 995313 - protein, 9 aa, Homo Sapiens
QERLLVSPK

SEQ ID NO: 995314 - protein, 9 aa, Homo Sapiens
NLEISKMKV

SEQ ID NO: 995315 - protein, 9 aa, Homo Sapiens
VDVYEYIAT

SEQ ID NO: 995316 - protein, 9 aa, Homo Sapiens
DLEDAQESG

SEQ ID NO: 995317 - protein, 9 aa, Homo Sapiens
DSLLIFFSY

SEQ ID NO: 995318 - protein, 9 aa, Homo Sapiens
QVVLLPKKT

SEQ ID NO: 995319 - protein, 9 aa, Homo Sapiens
MRKEASNIL

SEQ ID NO: 995320 - protein, 9 aa, Homo Sapiens
VTFMLFPVP

SEQ ID NO: 995321 - protein, 9 aa, Homo Sapiens
LCSGGLGFG

SEQ ID NO: 995322 - protein, 9 aa, Homo Sapiens
VFSKLWDPS

SEQ ID NO: 995323 - protein, 9 aa, Homo Sapiens
DGAEAEAFL

SEQ ID NO: 995324 - protein, 9 aa, Homo Sapiens
EPLVERGWV

SEQ ID NO: 995325 - protein, 9 aa, Homo Sapiens
RESKKTDTN

SEQ ID NO: 995326 - protein, 9 aa, Homo Sapiens
NYDLKPASE

SEQ ID NO: 995327 - protein, 9 aa, Homo Sapiens
LLVLSFPFT

SEQ ID NO: 995328 - protein, 9 aa, Homo Sapiens
PDLSAVTLF

SEQ ID NO: 995329 - protein, 9 aa, Homo Sapiens
YIESLLRKK

SEQ ID NO: 995330 - protein, 9 aa, Homo Sapiens
IRSKGFFIF

SEQ ID NO: 995331 - protein, 9 aa, Homo Sapiens
RVVPTAPKV

SEQ ID NO: 995332 - protein, 9 aa, Homo Sapiens
RIYTNAGRI

SEQ ID NO: 995333 - protein, 9 aa, Homo Sapiens
TSSTYFFSP

SEQ ID NO: 995334 - protein, 9 aa, Homo Sapiens
FQVLNSSSE

SEQ ID NO: 995335 - protein, 9 aa, Homo Sapiens
IPGFISNKG

SEQ ID NO: 995336 - protein, 9 aa, Homo Sapiens
PFFMNPIYR

SEQ ID NO: 995337 - protein, 9 aa, Homo Sapiens
YSGSYYEGL

SEQ ID NO: 995338 - protein, 9 aa, Homo Sapiens
MYICPSTTL

SEQ ID NO: 995339 - protein, 9 aa, Homo Sapiens
KVSQRNWAK

SEQ ID NO: 995340 - protein, 9 aa, Homo Sapiens
SGGLGFGSL

SEQ ID NO: 995341 - protein, 9 aa, Homo Sapiens
NNKGLANSS

SEQ ID NO: 995342 - protein, 9 aa, Homo Sapiens
LTFFVFKAT

SEQ ID NO: 995343 - protein, 9 aa, Homo Sapiens
YEMLDLLGN

SEQ ID NO: 995344 - protein, 9 aa, Homo Sapiens
SKGFFIFPE

SEQ ID NO: 995345 - protein, 9 aa, Homo Sapiens
ILPYRSMKL

SEQ ID NO: 995346 - protein, 9 aa, Homo Sapiens
YTTKFVDLG

SEQ ID NO: 995347 - protein, 9 aa, Homo Sapiens
PAKELPFPR

SEQ ID NO: 995348 - protein, 9 aa, Homo Sapiens
QDFVAKKLD

SEQ ID NO: 995349 - protein, 9 aa, Homo Sapiens
IEGLFPRGA

SEQ ID NO: 995350 - protein, 9 aa, Homo Sapiens
VSSRLLRLS

SEQ ID NO: 995351 - protein, 9 aa, Homo Sapiens
RTEEDGNSD

SEQ ID NO: 995352 - protein, 9 aa, Homo Sapiens
HKIQGKKMA

SEQ ID NO: 995353 - protein, 9 aa, Homo Sapiens
VETPFWMAP

SEQ ID NO: 995354 - protein, 9 aa, Homo Sapiens
HQDPAFFWQ

SEQ ID NO: 995355 - protein, 9 aa, Homo Sapiens
EDVEKVYVY

SEQ ID NO: 995356 - protein, 9 aa, Homo Sapiens
HVFSKLWDP

SEQ ID NO: 995357 - protein, 9 aa, Homo Sapiens
VLNSSSESF

SEQ ID NO: 995358 - protein, 9 aa, Homo Sapiens
FSIVKEETG

SEQ ID NO: 995359 - protein, 9 aa, Homo Sapiens
TLCQNRTLV

SEQ ID NO: 995360 - protein, 9 aa, Homo Sapiens
ASSFWSVMF

SEQ ID NO: 995361 - protein, 9 aa, Homo Sapiens
CLCSGGLGF

SEQ ID NO: 995362 - protein, 9 aa, Homo Sapiens
NITTHEVFP

SEQ ID NO: 995363 - protein, 9 aa, Homo Sapiens
NPGLSGPKG

SEQ ID NO: 995364 - protein, 9 aa, Homo Sapiens
RFFWNSLLA

SEQ ID NO: 995365 - protein, 9 aa, Homo Sapiens
RPVSHSWHN

SEQ ID NO: 995366 - protein, 9 aa, Homo Sapiens
RYSSPSLET

SEQ ID NO: 995367 - protein, 9 aa, Homo Sapiens
GIDSLLIFF

SEQ ID NO: 995368 - protein, 9 aa, Homo Sapiens
FVDVYEYIA

SEQ ID NO: 995369 - protein, 9 aa, Homo Sapiens
FPGVKRDRG

SEQ ID NO: 995370 - protein, 9 aa, Homo Sapiens
QAQPPYLWK

SEQ ID NO: 995371 - protein, 9 aa, Homo Sapiens
IKKVKGALK

SEQ ID NO: 995372 - protein, 9 aa, Homo Sapiens
LFCHISSHK

SEQ ID NO: 995373 - protein, 9 aa, Homo Sapiens
SYLFTLVGN

SEQ ID NO: 995374 - protein, 9 aa, Homo Sapiens
RSLRWPVVV

SEQ ID NO: 995375 - protein, 9 aa, Homo Sapiens
FFEYEYAMR

SEQ ID NO: 995376 - protein, 9 aa, Homo Sapiens
WNESHCCME

SEQ ID NO: 995377 - protein, 9 aa, Homo Sapiens
QPVCFSSFL

SEQ ID NO: 995378 - protein, 9 aa, Homo Sapiens
PNLQILACG

SEQ ID NO: 995379 - protein, 9 aa, Homo Sapiens
LVEKPAVGK

SEQ ID NO: 995380 - protein, 9 aa, Homo Sapiens
EGFPGVKRD

SEQ ID NO: 995381 - protein, 9 aa, Homo Sapiens
DTRDPTSLL

SEQ ID NO: 995382 - protein, 9 aa, Homo Sapiens
DISSFRYEM

SEQ ID NO: 995383 - protein, 9 aa, Homo Sapiens
VKLVDFRVS

SEQ ID NO: 995384 - protein, 9 aa, Homo Sapiens
SSFWSVMFF

SEQ ID NO: 995385 - protein, 9 aa, Homo Sapiens
ETFLDNLCA

SEQ ID NO: 995386 - protein, 9 aa, Homo Sapiens
RHKIQGKKM

SEQ ID NO: 995387 - protein, 9 aa, Homo Sapiens
ASFPAPGRT

SEQ ID NO: 995388 - protein, 9 aa, Homo Sapiens
LANSSIVIQ

SEQ ID NO: 995389 - protein, 9 aa, Homo Sapiens
LTESLKTKV

SEQ ID NO: 995390 - protein, 9 aa, Homo Sapiens
KFTKKPIPD

SEQ ID NO: 995391 - protein, 9 aa, Homo Sapiens
PVFSGGTPL

SEQ ID NO: 995392 - protein, 9 aa, Homo Sapiens
LLLTVLRSS

SEQ ID NO: 995393 - protein, 9 aa, Homo Sapiens
IFALVECES

SEQ ID NO: 995394 - protein, 9 aa, Homo Sapiens
GGLLQPEKL

SEQ ID NO: 995395 - protein, 9 aa, Homo Sapiens
EIQLKWKHP

SEQ ID NO: 995396 - protein, 9 aa, Homo Sapiens
TSLLKEIRD

SEQ ID NO: 995397 - protein, 9 aa, Homo Sapiens
VLKFLLEHS

SEQ ID NO: 995398 - protein, 9 aa, Homo Sapiens
FYWGDAKTD

SEQ ID NO: 995399 - protein, 9 aa, Homo Sapiens
DISPRSATI

SEQ ID NO: 995400 - protein, 9 aa, Homo Sapiens
TKFVDLGNV

SEQ ID NO: 995401 - protein, 9 aa, Homo Sapiens
SVPQPRSLR

SEQ ID NO: 995402 - protein, 9 aa, Homo Sapiens
DGGLVLQRK

SEQ ID NO: 995403 - protein, 9 aa, Homo Sapiens
EVLKFLLEH

SEQ ID NO: 995404 - protein, 9 aa, Homo Sapiens
RKKPEINIE

SEQ ID NO: 995405 - protein, 9 aa, Homo Sapiens
ELIYNQKKG

SEQ ID NO: 995406 - protein, 9 aa, Homo Sapiens
DLLFSIVKE

SEQ ID NO: 995407 - protein, 9 aa, Homo Sapiens
SGNLEVKVK

SEQ ID NO: 995408 - protein, 9 aa, Homo Sapiens
VESLLRYGL

SEQ ID NO: 995409 - protein, 9 aa, Homo Sapiens
ATQKGALLN

SEQ ID NO: 995410 - protein, 9 aa, Homo Sapiens
THFPASSFW

SEQ ID NO: 995411 - protein, 9 aa, Homo Sapiens
FRVSAQLDR

SEQ ID NO: 995412 - protein, 9 aa, Homo Sapiens
AVMRPTVPG

SEQ ID NO: 995413 - protein, 9 aa, Homo Sapiens
EFHVAFPDA

SEQ ID NO: 995414 - protein, 9 aa, Homo Sapiens
RIAFPLLFE

SEQ ID NO: 995415 - protein, 9 aa, Homo Sapiens
RPWNTRQKK

SEQ ID NO: 995416 - protein, 9 aa, Homo Sapiens
GSKTVIPIS

SEQ ID NO: 995417 - protein, 9 aa, Homo Sapiens
FEIFNLVYW

SEQ ID NO: 995418 - protein, 9 aa, Homo Sapiens
IIKLFFCLQ

SEQ ID NO: 995419 - protein, 9 aa, Homo Sapiens
GKPPFQANG

SEQ ID NO: 995420 - protein, 9 aa, Homo Sapiens
RDLNHNYTS

SEQ ID NO: 995421 - protein, 9 aa, Homo Sapiens
DDRDQEAFH

SEQ ID NO: 995422 - protein, 9 aa, Homo Sapiens
PDQLRKFQK

SEQ ID NO: 995423 - protein, 9 aa, Homo Sapiens
PPLIPVTFM

SEQ ID NO: 995424 - protein, 9 aa, Homo Sapiens
SDSPENGPG

SEQ ID NO: 995425 - protein, 9 aa, Homo Sapiens
SASSAMKNS

SEQ ID NO: 995426 - protein, 9 aa, Homo Sapiens
PRPAKELPF

SEQ ID NO: 995427 - protein, 9 aa, Homo Sapiens
TRDPTSLLK

SEQ ID NO: 995428 - protein, 9 aa, Homo Sapiens
DNLCAAGLC

SEQ ID NO: 995429 - protein, 9 aa, Homo Sapiens
APVLLQRRR

SEQ ID NO: 995430 - protein, 9 aa, Homo Sapiens
QGIAVMRPT

SEQ ID NO: 995431 - protein, 9 aa, Homo Sapiens
LIPVFSGGT

SEQ ID NO: 995432 - protein, 9 aa, Homo Sapiens
ARIYAATFK

SEQ ID NO: 995433 - protein, 9 aa, Homo Sapiens
PLRQSTFTL

SEQ ID NO: 995434 - protein, 9 aa, Homo Sapiens
SMKLKTVKP

SEQ ID NO: 995435 - protein, 9 aa, Homo Sapiens
YEYIATPRV

SEQ ID NO: 995436 - protein, 9 aa, Homo Sapiens
AAALAAASP

SEQ ID NO: 995437 - protein, 9 aa, Homo Sapiens
KKLTIVAGA

SEQ ID NO: 995438 - protein, 9 aa, Homo Sapiens
DPPKKDVTV

SEQ ID NO: 995439 - protein, 9 aa, Homo Sapiens
DILADCPKE

SEQ ID NO: 995440 - protein, 9 aa, Homo Sapiens
CEEEKHDCT

SEQ ID NO: 995441 - protein, 9 aa, Homo Sapiens
AVNVAQPVC

SEQ ID NO: 995442 - protein, 9 aa, Homo Sapiens
PGASRYTIM

SEQ ID NO: 995443 - protein, 9 aa, Homo Sapiens
KGHFPRVTT

SEQ ID NO: 995444 - protein, 9 aa, Homo Sapiens
QPGPVKLSG

SEQ ID NO: 995445 - protein, 9 aa, Homo Sapiens
RGTKRISQA

SEQ ID NO: 995446 - protein, 9 aa, Homo Sapiens
FLPSLKDSC

SEQ ID NO: 995447 - protein, 9 aa, Homo Sapiens
EKKAECFSS

SEQ ID NO: 995448 - protein, 9 aa, Homo Sapiens
AKDGWSNAF

SEQ ID NO: 995449 - protein, 9 aa, Homo Sapiens
PECAGIQEV

SEQ ID NO: 995450 - protein, 9 aa, Homo Sapiens
VMRPTVPGS

SEQ ID NO: 995451 - protein, 9 aa, Homo Sapiens
RPIWQQVAT

SEQ ID NO: 995452 - protein, 9 aa, Homo Sapiens
EVRPWNTRQ

SEQ ID NO: 995453 - protein, 9 aa, Homo Sapiens
GIQEVVEAY

SEQ ID NO: 995454 - protein, 9 aa, Homo Sapiens
DPKDRVGKN

SEQ ID NO: 995455 - protein, 9 aa, Homo Sapiens
EEQKEVMEK

SEQ ID NO: 995456 - protein, 9 aa, Homo Sapiens
SFTQEGKSN

SEQ ID NO: 995457 - protein, 9 aa, Homo Sapiens
SQQQCQPSP

SEQ ID NO: 995458 - protein, 9 aa, Homo Sapiens
LDENEITAI

SEQ ID NO: 995459 - protein, 9 aa, Homo Sapiens
GLSTLRCLC

SEQ ID NO: 995460 - protein, 9 aa, Homo Sapiens
AEKSPLFHI

SEQ ID NO: 995461 - protein, 9 aa, Homo Sapiens
AISARKLKN

SEQ ID NO: 995462 - protein, 9 aa, Homo Sapiens
EDAQESGFS

SEQ ID NO: 995463 - protein, 9 aa, Homo Sapiens
RVSWYLDEN

SEQ ID NO: 995464 - protein, 9 aa, Homo Sapiens
SLLEVRPWN

SEQ ID NO: 995465 - protein, 9 aa, Homo Sapiens
RSSGPIFCQ

SEQ ID NO: 995466 - protein, 9 aa, Homo Sapiens
GAPASKLLP

SEQ ID NO: 995467 - protein, 9 aa, Homo Sapiens
IDRKGQCYH

SEQ ID NO: 995468 - protein, 9 aa, Homo Sapiens
QRPLPWDLP

SEQ ID NO: 995469 - protein, 9 aa, Homo Sapiens
FIIYLIPRY

SEQ ID NO: 995470 - protein, 9 aa, Homo Sapiens
EEKMKYCFK

SEQ ID NO: 995471 - protein, 9 aa, Homo Sapiens
KDVTVSPSS

SEQ ID NO: 995472 - protein, 9 aa, Homo Sapiens
AHPEMRCGE

SEQ ID NO: 995473 - protein, 9 aa, Homo Sapiens
KLFSCVILT

SEQ ID NO: 995474 - protein, 9 aa, Homo Sapiens
GHINSGGHA

SEQ ID NO: 995475 - protein, 9 aa, Homo Sapiens
KWKHPEALP

SEQ ID NO: 995476 - protein, 9 aa, Homo Sapiens
MKKYKDTFQ

SEQ ID NO: 995477 - protein, 9 aa, Homo Sapiens
DCKNISNSE

SEQ ID NO: 995478 - protein, 9 aa, Homo Sapiens
WFVHNNEEG

SEQ ID NO: 995479 - protein, 9 aa, Homo Sapiens
SFSSSSSPS

SEQ ID NO: 995480 - protein, 9 aa, Homo Sapiens
LSAVTLFRE

SEQ ID NO: 995481 - protein, 9 aa, Homo Sapiens
VCWKIIESY

SEQ ID NO: 995482 - protein, 9 aa, Homo Sapiens
PSAFVDVYE

SEQ ID NO: 995483 - protein, 9 aa, Homo Sapiens
SYVFLKAIL

SEQ ID NO: 995484 - protein, 9 aa, Homo Sapiens
FSFLEDSLV

SEQ ID NO: 995485 - protein, 9 aa, Homo Sapiens
GSASADTAA

SEQ ID NO: 995486 - protein, 9 aa, Homo Sapiens
TEGPMGPHG

SEQ ID NO: 995487 - protein, 9 aa, Homo Sapiens
PNWRAMFVY

SEQ ID NO: 995488 - protein, 9 aa, Homo Sapiens
VLLQRRRGE

SEQ ID NO: 995489 - protein, 9 aa, Homo Sapiens
QHRKIYTGE

SEQ ID NO: 995490 - protein, 9 aa, Homo Sapiens
MTFGKRIKN

SEQ ID NO: 995491 - protein, 9 aa, Homo Sapiens
LPTKKFTKK

SEQ ID NO: 995492 - protein, 9 aa, Homo Sapiens
FSYSSSLSQ

SEQ ID NO: 995493 - protein, 9 aa, Homo Sapiens
VVGSPTSEI

SEQ ID NO: 995494 - protein, 9 aa, Homo Sapiens
QTVTSCPAN

SEQ ID NO: 995495 - protein, 9 aa, Homo Sapiens
DECEEEKHD

SEQ ID NO: 995496 - protein, 9 aa, Homo Sapiens
NPECAGIQE

SEQ ID NO: 995497 - protein, 9 aa, Homo Sapiens
SKHVEVLRA

SEQ ID NO: 995498 - protein, 9 aa, Homo Sapiens
APAKFLENQ

SEQ ID NO: 995499 - protein, 9 aa, Homo Sapiens
DNIDSVKCD

SEQ ID NO: 995500 - protein, 9 aa, Homo Sapiens
FKISLSEGD

SEQ ID NO: 995501 - protein, 9 aa, Homo Sapiens
GLATEKSRW

SEQ ID NO: 995502 - protein, 9 aa, Homo Sapiens
VMDGVLSAN

SEQ ID NO: 995503 - protein, 9 aa, Homo Sapiens
ESLKTKVFQ

SEQ ID NO: 995504 - protein, 9 aa, Homo Sapiens
HNYTSLLKE

SEQ ID NO: 995505 - protein, 9 aa, Homo Sapiens
NLPSYRHHV

SEQ ID NO: 995506 - protein, 9 aa, Homo Sapiens
NPVSMPEVQ

SEQ ID NO: 995507 - protein, 9 aa, Homo Sapiens
KDTHLTKEN

SEQ ID NO: 995508 - protein, 9 aa, Homo Sapiens
ICTPNWRAM

SEQ ID NO: 995509 - protein, 9 aa, Homo Sapiens
MEDASAYLN

SEQ ID NO: 995510 - protein, 9 aa, Homo Sapiens
KHKLVVLVK

SEQ ID NO: 995511 - protein, 9 aa, Homo Sapiens
SLDVTLCNC

SEQ ID NO: 995512 - protein, 9 aa, Homo Sapiens
LSSPQKVAL

SEQ ID NO: 995513 - protein, 9 aa, Homo Sapiens
LLLRRHHNY

SEQ ID NO: 995514 - protein, 9 aa, Homo Sapiens
LVNFQFQNK

SEQ ID NO: 995515 - protein, 9 aa, Homo Sapiens
EENALEILQ

SEQ ID NO: 995516 - protein, 9 aa, Homo Sapiens
PSLHSEIWE

SEQ ID NO: 995517 - protein, 9 aa, Homo Sapiens
LSANNYQGG

SEQ ID NO: 995518 - protein, 9 aa, Homo Sapiens
LTGNNYKNK

SEQ ID NO: 995519 - protein, 9 aa, Homo Sapiens
VAQPVCFSS

SEQ ID NO: 995520 - protein, 9 aa, Homo Sapiens
ALISSPPPP

SEQ ID NO: 995521 - protein, 9 aa, Homo Sapiens
SSLRITTVK

SEQ ID NO: 995522 - protein, 9 aa, Homo Sapiens
ATVPAAAAL

SEQ ID NO: 995523 - protein, 9 aa, Homo Sapiens
DQLRKFQKE

SEQ ID NO: 995524 - protein, 9 aa, Homo Sapiens
MPGSEDLCK

SEQ ID NO: 995525 - protein, 9 aa, Homo Sapiens
VRQPTERGG

SEQ ID NO: 995526 - protein, 9 aa, Homo Sapiens
QTAIDVNGK

SEQ ID NO: 995527 - protein, 9 aa, Homo Sapiens
HNESCSPDT

SEQ ID NO: 995528 - protein, 9 aa, Homo Sapiens
SDENGILSS

SEQ ID NO: 995529 - protein, 9 aa, Homo Sapiens
KRRQQLVGN

SEQ ID NO: 995530 - protein, 9 aa, Homo Sapiens
IQYFFVASV

SEQ ID NO: 995531 - protein, 9 aa, Homo Sapiens
LHSEIWEIP

SEQ ID NO: 995532 - protein, 9 aa, Homo Sapiens
LKTVATEGV

SEQ ID NO: 995533 - protein, 9 aa, Homo Sapiens
LSNCPVGKK

SEQ ID NO: 995534 - protein, 9 aa, Homo Sapiens
GLSPSEELE

SEQ ID NO: 995535 - protein, 9 aa, Homo Sapiens
SLSLEEEQK

SEQ ID NO: 995536 - protein, 9 aa, Homo Sapiens
GRKVLDSTT

SEQ ID NO: 995537 - protein, 9 aa, Homo Sapiens
HSMDIFFGS

SEQ ID NO: 995538 - protein, 9 aa, Homo Sapiens
KDLERFLRS

SEQ ID NO: 995539 - protein, 9 aa, Homo Sapiens
CHISSHKHD

SEQ ID NO: 995540 - protein, 9 aa, Homo Sapiens
KLGEVWQRR

SEQ ID NO: 995541 - protein, 9 aa, Homo Sapiens
LTDAQGKNR

SEQ ID NO: 995542 - protein, 9 aa, Homo Sapiens
AYLNLPSYR

SEQ ID NO: 995543 - protein, 9 aa, Homo Sapiens
QDPAFFWQN

SEQ ID NO: 995544 - protein, 9 aa, Homo Sapiens
KVLGAVASL

SEQ ID NO: 995545 - protein, 9 aa, Homo Sapiens
PKGTEGPMG

SEQ ID NO: 995546 - protein, 9 aa, Homo Sapiens
SVCSGEGPH

SEQ ID NO: 995547 - protein, 9 aa, Homo Sapiens
SMLLVLSFP

SEQ ID NO: 995548 - protein, 9 aa, Homo Sapiens
ESKKTDTNA

SEQ ID NO: 995549 - protein, 9 aa, Homo Sapiens
PVTFMLFPV

SEQ ID NO: 995550 - protein, 9 aa, Homo Sapiens
ITTHEVFPR

SEQ ID NO: 995551 - protein, 9 aa, Homo Sapiens
FPNWMKNPW

SEQ ID NO: 995552 - protein, 9 aa, Homo Sapiens
SWWPVLDDL

SEQ ID NO: 995553 - protein, 9 aa, Homo Sapiens
RPLPWDLPE

SEQ ID NO: 995554 - protein, 9 aa, Homo Sapiens
TSASSAMKN

SEQ ID NO: 995555 - protein, 9 aa, Homo Sapiens
PRAPVLLQR

SEQ ID NO: 995556 - protein, 9 aa, Homo Sapiens
LWSYSSRLM

SEQ ID NO: 995557 - protein, 9 aa, Homo Sapiens
VYEYIATPR

SEQ ID NO: 995558 - protein, 9 aa, Homo Sapiens
QKELRQRSQ

SEQ ID NO: 995559 - protein, 9 aa, Homo Sapiens
LENQQVSYG

SEQ ID NO: 995560 - protein, 9 aa, Homo Sapiens
AASGPSSTV

SEQ ID NO: 995561 - protein, 9 aa, Homo Sapiens
KVPNLQILA

SEQ ID NO: 995562 - protein, 9 aa, Homo Sapiens
LVLQRKSRK

SEQ ID NO: 995563 - protein, 9 aa, Homo Sapiens
GRCKHNESC

SEQ ID NO: 995564 - protein, 9 aa, Homo Sapiens
NRIYLAGSS

SEQ ID NO: 995565 - protein, 9 aa, Homo Sapiens
NRQVNLKIG

SEQ ID NO: 995566 - protein, 9 aa, Homo Sapiens
SKIIKLFFC

SEQ ID NO: 995567 - protein, 9 aa, Homo Sapiens
PNAFVSRLS

SEQ ID NO: 995568 - protein, 9 aa, Homo Sapiens
RASSSRHSQ

SEQ ID NO: 995569 - protein, 9 aa, Homo Sapiens
KFKTIVLLS

SEQ ID NO: 995570 - protein, 9 aa, Homo Sapiens
QSEWKSYRD

SEQ ID NO: 995571 - protein, 9 aa, Homo Sapiens
EKIVGSEIN

SEQ ID NO: 995572 - protein, 9 aa, Homo Sapiens
FLENQQVSY

SEQ ID NO: 995573 - protein, 9 aa, Homo Sapiens
GIKFEEKVE

SEQ ID NO: 995574 - protein, 9 aa, Homo Sapiens
NLITRQRYR

SEQ ID NO: 995575 - protein, 9 aa, Homo Sapiens
DVLTEENAL

SEQ ID NO: 995576 - protein, 9 aa, Homo Sapiens
KSIKIHTYG

SEQ ID NO: 995577 - protein, 9 aa, Homo Sapiens
GVMDGVLSA

SEQ ID NO: 995578 - protein, 9 aa, Homo Sapiens
ITLVEIGQV

SEQ ID NO: 995579 - protein, 9 aa, Homo Sapiens
ENQQVSYGQ

SEQ ID NO: 995580 - protein, 9 aa, Homo Sapiens
KSMLLVLSF

SEQ ID NO: 995581 - protein, 9 aa, Homo Sapiens
FDRSSGPIF

SEQ ID NO: 995582 - protein, 9 aa, Homo Sapiens
HFKHRFRGS

SEQ ID NO: 995583 - protein, 9 aa, Homo Sapiens
EPLLVLLDS

SEQ ID NO: 995584 - protein, 9 aa, Homo Sapiens
LRIGACFLC

SEQ ID NO: 995585 - protein, 9 aa, Homo Sapiens
SDLMSNPVS

SEQ ID NO: 995586 - protein, 9 aa, Homo Sapiens
SASADTAAR

SEQ ID NO: 995587 - protein, 9 aa, Homo Sapiens
PRITASSNV

SEQ ID NO: 995588 - protein, 9 aa, Homo Sapiens
DRSSGPIFC

SEQ ID NO: 995589 - protein, 9 aa, Homo Sapiens
PLPALISSP

SEQ ID NO: 995590 - protein, 9 aa, Homo Sapiens
LHFPANKKK

SEQ ID NO: 995591 - protein, 9 aa, Homo Sapiens
FPGPPGQPG

SEQ ID NO: 995592 - protein, 9 aa, Homo Sapiens
GFFEYEYAM

SEQ ID NO: 995593 - protein, 9 aa, Homo Sapiens
KLRVHTQAV

SEQ ID NO: 995594 - protein, 9 aa, Homo Sapiens
DYYCTLSLL

SEQ ID NO: 995595 - protein, 9 aa, Homo Sapiens
KKSIEERKK

SEQ ID NO: 995596 - protein, 9 aa, Homo Sapiens
NLMETSEAE

SEQ ID NO: 995597 - protein, 9 aa, Homo Sapiens
SESSRQFLP

SEQ ID NO: 995598 - protein, 9 aa, Homo Sapiens
RQPTERGGL

SEQ ID NO: 995599 - protein, 9 aa, Homo Sapiens
CNCITENDC

SEQ ID NO: 995600 - protein, 9 aa, Homo Sapiens
DNYDLKPAS

SEQ ID NO: 995601 - protein, 9 aa, Homo Sapiens
DQCIQTEVD

SEQ ID NO: 995602 - protein, 9 aa, Homo Sapiens
ASFTQEGKS

SEQ ID NO: 995603 - protein, 9 aa, Homo Sapiens
GSEDLCKGK

SEQ ID NO: 995604 - protein, 9 aa, Homo Sapiens
HASDSDKKA

SEQ ID NO: 995605 - protein, 9 aa, Homo Sapiens
TGSWWPVLD

SEQ ID NO: 995606 - protein, 9 aa, Homo Sapiens
LCAAGLCVD

SEQ ID NO: 995607 - protein, 9 aa, Homo Sapiens
DMPEVLKFL

SEQ ID NO: 995608 - protein, 9 aa, Homo Sapiens
RDCKNISNS

SEQ ID NO: 995609 - protein, 9 aa, Homo Sapiens
LGKFKTIVL

SEQ ID NO: 995610 - protein, 9 aa, Homo Sapiens
LHGRTGLLC

SEQ ID NO: 995611 - protein, 9 aa, Homo Sapiens
PVHTSSTYF

SEQ ID NO: 995612 - protein, 9 aa, Homo Sapiens
SVNEAGYKK

SEQ ID NO: 995613 - protein, 9 aa, Homo Sapiens
PANKKKGIE

SEQ ID NO: 995614 - protein, 9 aa, Homo Sapiens
VCNGRKVLD

SEQ ID NO: 995615 - protein, 9 aa, Homo Sapiens
SLAVRQPTE

SEQ ID NO: 995616 - protein, 9 aa, Homo Sapiens
ICLVNNKGL

SEQ ID NO: 995617 - protein, 9 aa, Homo Sapiens
KVDPRAEKN

SEQ ID NO: 995618 - protein, 9 aa, Homo Sapiens
GSSTPFWLL

SEQ ID NO: 995619 - protein, 9 aa, Homo Sapiens
SSPSLETLS

SEQ ID NO: 995620 - protein, 9 aa, Homo Sapiens
RAALPAPNA

SEQ ID NO: 995621 - protein, 9 aa, Homo Sapiens
RKVPNLQIL

SEQ ID NO: 995622 - protein, 9 aa, Homo Sapiens
TTEPGLFGV

SEQ ID NO: 995623 - protein, 9 aa, Homo Sapiens
EHILLCPDT

SEQ ID NO: 995624 - protein, 9 aa, Homo Sapiens
ENITTHEVF

SEQ ID NO: 995625 - protein, 9 aa, Homo Sapiens
HSFSSPEPD

SEQ ID NO: 995626 - protein, 9 aa, Homo Sapiens
LMETSEAEI

SEQ ID NO: 995627 - protein, 9 aa, Homo Sapiens
LLVLLDSSS

SEQ ID NO: 995628 - protein, 9 aa, Homo Sapiens
NVAQPVCFS

SEQ ID NO: 995629 - protein, 9 aa, Homo Sapiens
PFGSSNLFK

SEQ ID NO: 995630 - protein, 9 aa, Homo Sapiens
ILSNLTGNN

SEQ ID NO: 995631 - protein, 9 aa, Homo Sapiens
KLKFLLSTK

SEQ ID NO: 995632 - protein, 9 aa, Homo Sapiens
IVLVGLVAV

SEQ ID NO: 995633 - protein, 9 aa, Homo Sapiens
LNLPSYRHH

SEQ ID NO: 995634 - protein, 9 aa, Homo Sapiens
LKWKHPEAL

SEQ ID NO: 995635 - protein, 9 aa, Homo Sapiens
CSHSLTEHV

SEQ ID NO: 995636 - protein, 9 aa, Homo Sapiens
DVYEYIATP

SEQ ID NO: 995637 - protein, 9 aa, Homo Sapiens
FMAVVMEQG

SEQ ID NO: 995638 - protein, 9 aa, Homo Sapiens
WPVLDDLYA

SEQ ID NO: 995639 - protein, 9 aa, Homo Sapiens
SLETLSASS

SEQ ID NO: 995640 - protein, 9 aa, Homo Sapiens
MMKHEDVEK

SEQ ID NO: 995641 - protein, 9 aa, Homo Sapiens
DKKANSLLV

SEQ ID NO: 995642 - protein, 9 aa, Homo Sapiens
KKFQIFFKE

SEQ ID NO: 995643 - protein, 9 aa, Homo Sapiens
PAKFLENQQ

SEQ ID NO: 995644 - protein, 9 aa, Homo Sapiens
DSAGSYILH

SEQ ID NO: 995645 - protein, 9 aa, Homo Sapiens
CIMTVILFQ

SEQ ID NO: 995646 - protein, 9 aa, Homo Sapiens
LRGLEDSLQ

SEQ ID NO: 995647 - protein, 9 aa, Homo Sapiens
KLSPQERLL

SEQ ID NO: 995648 - protein, 9 aa, Homo Sapiens
WGPRTNLEI

SEQ ID NO: 995649 - protein, 9 aa, Homo Sapiens
PALISSPPP

SEQ ID NO: 995650 - protein, 9 aa, Homo Sapiens
FMYICPSTT

SEQ ID NO: 995651 - protein, 9 aa, Homo Sapiens
YLAILASSW

SEQ ID NO: 995652 - protein, 9 aa, Homo Sapiens
GWGTRVPGG

SEQ ID NO: 995653 - protein, 9 aa, Homo Sapiens
RFAQPGFFE

SEQ ID NO: 995654 - protein, 9 aa, Homo Sapiens
AGSASADTA

SEQ ID NO: 995655 - protein, 9 aa, Homo Sapiens
PPYLWKSTL

SEQ ID NO: 995656 - protein, 9 aa, Homo Sapiens
VNGLVLDIF

SEQ ID NO: 995657 - protein, 9 aa, Homo Sapiens
VHNNEEGLI

SEQ ID NO: 995658 - protein, 9 aa, Homo Sapiens
PALATTLKT

SEQ ID NO: 995659 - protein, 9 aa, Homo Sapiens
FALVIVLVG

SEQ ID NO: 995660 - protein, 9 aa, Homo Sapiens
SWSRCSKKD

SEQ ID NO: 995661 - protein, 9 aa, Homo Sapiens
RETFLDNLC

SEQ ID NO: 995662 - protein, 9 aa, Homo Sapiens
DPQTAIDVN

SEQ ID NO: 995663 - protein, 9 aa, Homo Sapiens
MACTAVLES

SEQ ID NO: 995664 - protein, 9 aa, Homo Sapiens
AHRLEREFR

SEQ ID NO: 995665 - protein, 9 aa, Homo Sapiens
PEQETLLFF

SEQ ID NO: 995666 - protein, 9 aa, Homo Sapiens
FTDKFALSK

SEQ ID NO: 995667 - protein, 9 aa, Homo Sapiens
RQVNLKIGV

SEQ ID NO: 995668 - protein, 9 aa, Homo Sapiens
PGGKTNEPK

SEQ ID NO: 995669 - protein, 9 aa, Homo Sapiens
HINSGGHAK

SEQ ID NO: 995670 - protein, 9 aa, Homo Sapiens
DPGWGTRVP

SEQ ID NO: 995671 - protein, 9 aa, Homo Sapiens
ICLLVTEQD

SEQ ID NO: 995672 - protein, 9 aa, Homo Sapiens
QRYRKRSSP

SEQ ID NO: 995673 - protein, 9 aa, Homo Sapiens
SSRLLRLSI

SEQ ID NO: 995674 - protein, 9 aa, Homo Sapiens
GDSGLLAYA

SEQ ID NO: 995675 - protein, 9 aa, Homo Sapiens
DENGILSSP

SEQ ID NO: 995676 - protein, 9 aa, Homo Sapiens
KFLLEHSLP

SEQ ID NO: 995677 - protein, 9 aa, Homo Sapiens
CHGDQFSLY

SEQ ID NO: 995678 - protein, 9 aa, Homo Sapiens
PKVLGAVAS

SEQ ID NO: 995679 - protein, 9 aa, Homo Sapiens
EKSPLFHIL

SEQ ID NO: 995680 - protein, 9 aa, Homo Sapiens
SRLLFLDIA

SEQ ID NO: 995681 - protein, 9 aa, Homo Sapiens
RLKVDPRAE

SEQ ID NO: 995682 - protein, 9 aa, Homo Sapiens
LQEKISLNL

SEQ ID NO: 995683 - protein, 9 aa, Homo Sapiens
DFGLATEKS

SEQ ID NO: 995684 - protein, 9 aa, Homo Sapiens
FLLSTKREQ

SEQ ID NO: 995685 - protein, 9 aa, Homo Sapiens
GIQPRATKH

SEQ ID NO: 995686 - protein, 9 aa, Homo Sapiens
CTLSLLQVQ

SEQ ID NO: 995687 - protein, 9 aa, Homo Sapiens
LNTRHSFSS

SEQ ID NO: 995688 - protein, 9 aa, Homo Sapiens
TSEIQWWYA

SEQ ID NO: 995689 - protein, 9 aa, Homo Sapiens
WRAMFVYIM

SEQ ID NO: 995690 - protein, 9 aa, Homo Sapiens
TSYLFTLVG

SEQ ID NO: 995691 - protein, 9 aa, Homo Sapiens
CAGIQEVVE

SEQ ID NO: 995692 - protein, 9 aa, Homo Sapiens
ADAKCVNLH

SEQ ID NO: 995693 - protein, 9 aa, Homo Sapiens
AFFWQNSLL

SEQ ID NO: 995694 - protein, 9 aa, Homo Sapiens
PIYLNEIQC

SEQ ID NO: 995695 - protein, 9 aa, Homo Sapiens
SLLIFFSYA

SEQ ID NO: 995696 - protein, 9 aa, Homo Sapiens
GPAPEDSQA

SEQ ID NO: 995697 - protein, 9 aa, Homo Sapiens
TPFFMNPIY

SEQ ID NO: 995698 - protein, 9 aa, Homo Sapiens
CAAGLCVDQ

SEQ ID NO: 995699 - protein, 9 aa, Homo Sapiens
KDLLFSIVK

SEQ ID NO: 995700 - protein, 9 aa, Homo Sapiens
FRFLKGGHL

SEQ ID NO: 995701 - protein, 9 aa, Homo Sapiens
LTGSWWPVL

SEQ ID NO: 995702 - protein, 9 aa, Homo Sapiens
HDLESHSIV

SEQ ID NO: 995703 - protein, 9 aa, Homo Sapiens
SAMKNSPLS

SEQ ID NO: 995704 - protein, 9 aa, Homo Sapiens
LLRKKPEIN

SEQ ID NO: 995705 - protein, 9 aa, Homo Sapiens
TLLFFLFFC

SEQ ID NO: 995706 - protein, 9 aa, Homo Sapiens
LEREFRNRL

SEQ ID NO: 995707 - protein, 9 aa, Homo Sapiens
HNNEEGLID

SEQ ID NO: 995708 - protein, 9 aa, Homo Sapiens
LLKTTEPGL

SEQ ID NO: 995709 - protein, 9 aa, Homo Sapiens
NKKCWNFCQ

SEQ ID NO: 995710 - protein, 9 aa, Homo Sapiens
APEEKGPQG

SEQ ID NO: 995711 - protein, 9 aa, Homo Sapiens
PAASGPSST

SEQ ID NO: 995712 - protein, 9 aa, Homo Sapiens
FFGSCVSQM

SEQ ID NO: 995713 - protein, 9 aa, Homo Sapiens
ERQGIAVMR

SEQ ID NO: 995714 - protein, 9 aa, Homo Sapiens
SFESLLQES

SEQ ID NO: 995715 - protein, 9 aa, Homo Sapiens
SPDNANSPK

SEQ ID NO: 995716 - protein, 9 aa, Homo Sapiens
IYKHFQQPL

SEQ ID NO: 995717 - protein, 9 aa, Homo Sapiens
EVVEAYQSC

SEQ ID NO: 995718 - protein, 9 aa, Homo Sapiens
PFRFLKGGH

SEQ ID NO: 995719 - protein, 9 aa, Homo Sapiens
LCKGKDQMH

SEQ ID NO: 995720 - protein, 9 aa, Homo Sapiens
DVTLCNCIT

SEQ ID NO: 995721 - protein, 9 aa, Homo Sapiens
LQILACGGD

SEQ ID NO: 995722 - protein, 9 aa, Homo Sapiens
SYCEATLLQ

SEQ ID NO: 995723 - protein, 9 aa, Homo Sapiens
DDTRDPTSL

SEQ ID NO: 995724 - protein, 9 aa, Homo Sapiens
DKFALSKIF

SEQ ID NO: 995725 - protein, 9 aa, Homo Sapiens
KKYKDTFQD

SEQ ID NO: 995726 - protein, 9 aa, Homo Sapiens
VDSAGSYIL

SEQ ID NO: 995727 - protein, 9 aa, Homo Sapiens
WSPPKKPNG

SEQ ID NO: 995728 - protein, 9 aa, Homo Sapiens
TKRISQAEI

SEQ ID NO: 995729 - protein, 9 aa, Homo Sapiens
SLLLLLLRL

SEQ ID NO: 995730 - protein, 9 aa, Homo Sapiens
FVAAERVLY

SEQ ID NO: 995731 - protein, 9 aa, Homo Sapiens
PPKKDVTVS

SEQ ID NO: 995732 - protein, 9 aa, Homo Sapiens
GAEGPAPED

SEQ ID NO: 995733 - protein, 9 aa, Homo Sapiens
IYTLRIKKV

SEQ ID NO: 995734 - protein, 9 aa, Homo Sapiens
GIAVMRPTV

SEQ ID NO: 995735 - protein, 9 aa, Homo Sapiens
CSKKDLERF

SEQ ID NO: 995736 - protein, 9 aa, Homo Sapiens
EKHDCTEKQ

SEQ ID NO: 995737 - protein, 9 aa, Homo Sapiens
ENEITAIQK

SEQ ID NO: 995738 - protein, 9 aa, Homo Sapiens
GLIKECTLL

SEQ ID NO: 995739 - protein, 9 aa, Homo Sapiens
GLLQPEKLV

SEQ ID NO: 995740 - protein, 9 aa, Homo Sapiens
SFPAPGRTI

SEQ ID NO: 995741 - protein, 9 aa, Homo Sapiens
KGLKFNLME

SEQ ID NO: 995742 - protein, 9 aa, Homo Sapiens
WHQICLLVT

SEQ ID NO: 995743 - protein, 9 aa, Homo Sapiens
CGKTFLCSH

SEQ ID NO: 995744 - protein, 9 aa, Homo Sapiens
NPFGSSNLF

SEQ ID NO: 995745 - protein, 9 aa, Homo Sapiens
DFRELGRIF

SEQ ID NO: 995746 - protein, 9 aa, Homo Sapiens
YICLRFQRI

SEQ ID NO: 995747 - protein, 9 aa, Homo Sapiens
LLVSPKKLK

SEQ ID NO: 995748 - protein, 9 aa, Homo Sapiens
IVKEETGKD

SEQ ID NO: 995749 - protein, 9 aa, Homo Sapiens
KLHSLQFDQ

SEQ ID NO: 995750 - protein, 9 aa, Homo Sapiens
KVGVAEEEL

SEQ ID NO: 995751 - protein, 9 aa, Homo Sapiens
RGQEEKIRE

SEQ ID NO: 995752 - protein, 9 aa, Homo Sapiens
RGGHINSGG

SEQ ID NO: 995753 - protein, 9 aa, Homo Sapiens
EPPAHRLER

SEQ ID NO: 995754 - protein, 9 aa, Homo Sapiens
CPYCRRSEK

SEQ ID NO: 995755 - protein, 9 aa, Homo Sapiens
SPQERLLVS

SEQ ID NO: 995756 - protein, 9 aa, Homo Sapiens
ALPAPNAPA

SEQ ID NO: 995757 - protein, 9 aa, Homo Sapiens
LLTVLRSSW

SEQ ID NO: 995758 - protein, 9 aa, Homo Sapiens
AKCVNLHFQ

SEQ ID NO: 995759 - protein, 9 aa, Homo Sapiens
STPFWLLSP

SEQ ID NO: 995760 - protein, 9 aa, Homo Sapiens
NGAPKEAQP

SEQ ID NO: 995761 - protein, 9 aa, Homo Sapiens
AEKNQCELL

SEQ ID NO: 995762 - protein, 9 aa, Homo Sapiens
TQKGALLNK

SEQ ID NO: 995763 - protein, 9 aa, Homo Sapiens
SWYLDENEI

SEQ ID NO: 995764 - protein, 9 aa, Homo Sapiens
TSARYICLR

SEQ ID NO: 995765 - protein, 9 aa, Homo Sapiens
AKLHSLQFD

SEQ ID NO: 995766 - protein, 9 aa, Homo Sapiens
ILFQVSFWI

SEQ ID NO: 995767 - protein, 9 aa, Homo Sapiens
RKIYTGEKP

SEQ ID NO: 995768 - protein, 9 aa, Homo Sapiens
KCVNLHFQD

SEQ ID NO: 995769 - protein, 9 aa, Homo Sapiens
HCKNVNKPV

SEQ ID NO: 995770 - protein, 9 aa, Homo Sapiens
LIGDAWKKL

SEQ ID NO: 995771 - protein, 9 aa, Homo Sapiens
TFKKFQIFF

SEQ ID NO: 995772 - protein, 9 aa, Homo Sapiens
VEVLRAQLE

SEQ ID NO: 995773 - protein, 9 aa, Homo Sapiens
PAKDGWSNA

SEQ ID NO: 995774 - protein, 9 aa, Homo Sapiens
IFCQVCRNK

SEQ ID NO: 995775 - protein, 9 aa, Homo Sapiens
LQHLEASFT

SEQ ID NO: 995776 - protein, 9 aa, Homo Sapiens
SPSDSPENG

SEQ ID NO: 995777 - protein, 9 aa, Homo Sapiens
ESPSDSPEN

SEQ ID NO: 995778 - protein, 9 aa, Homo Sapiens
GSYILHDIL

SEQ ID NO: 995779 - protein, 9 aa, Homo Sapiens
PRTNLEISK

SEQ ID NO: 995780 - protein, 9 aa, Homo Sapiens
LCNCITEND

SEQ ID NO: 995781 - protein, 9 aa, Homo Sapiens
CLLTTEDIL

SEQ ID NO: 995782 - protein, 9 aa, Homo Sapiens
VHTSSTYFF

SEQ ID NO: 995783 - protein, 9 aa, Homo Sapiens
LPNIQVVLL

SEQ ID NO: 995784 - protein, 9 aa, Homo Sapiens
ELGRIFKGL

SEQ ID NO: 995785 - protein, 9 aa, Homo Sapiens
IYTVEKPYK

SEQ ID NO: 995786 - protein, 9 aa, Homo Sapiens
VVFTSYLFT

SEQ ID NO: 995787 - protein, 9 aa, Homo Sapiens
PCSLAVRQP

SEQ ID NO: 995788 - protein, 9 aa, Homo Sapiens
HEDPQTAID

SEQ ID NO: 995789 - protein, 9 aa, Homo Sapiens
KFVDLGNVS

SEQ ID NO: 995790 - protein, 9 aa, Homo Sapiens
LEVKVKGID

SEQ ID NO: 995791 - protein, 9 aa, Homo Sapiens
ELSKSIKIH

SEQ ID NO: 995792 - protein, 9 aa, Homo Sapiens
EIPVDGAEA

SEQ ID NO: 995793 - protein, 9 aa, Homo Sapiens
TIDISPRSA

SEQ ID NO: 995794 - protein, 9 aa, Homo Sapiens
LWNESHCCM

SEQ ID NO: 995795 - protein, 9 aa, Homo Sapiens
EAERPEVGS

SEQ ID NO: 995796 - protein, 9 aa, Homo Sapiens
GPVKLSGEA

SEQ ID NO: 995797 - protein, 9 aa, Homo Sapiens
EKLFSCVIL

SEQ ID NO: 995798 - protein, 9 aa, Homo Sapiens
KDTFQDYQE

SEQ ID NO: 995799 - protein, 9 aa, Homo Sapiens
LHDILHNGR

SEQ ID NO: 995800 - protein, 9 aa, Homo Sapiens
TFLCSHSLT

SEQ ID NO: 995801 - protein, 9 aa, Homo Sapiens
PSDSPENGP

SEQ ID NO: 995802 - protein, 9 aa, Homo Sapiens
QQRRPSVCS

SEQ ID NO: 995803 - protein, 9 aa, Homo Sapiens
KAPTQKSGC

SEQ ID NO: 995804 - protein, 9 aa, Homo Sapiens
IQIEGLFPR

SEQ ID NO: 995805 - protein, 9 aa, Homo Sapiens
QIRSKGFFI

SEQ ID NO: 995806 - protein, 9 aa, Homo Sapiens
SVDGMDGSL

SEQ ID NO: 995807 - protein, 9 aa, Homo Sapiens
TFVKSSTEN

SEQ ID NO: 995808 - protein, 9 aa, Homo Sapiens
EEIPVDGAE

SEQ ID NO: 995809 - protein, 9 aa, Homo Sapiens
EGGGRMGTW

SEQ ID NO: 995810 - protein, 9 aa, Homo Sapiens
AQHRKIYTG

SEQ ID NO: 995811 - protein, 9 aa, Homo Sapiens
FLFFCMYLV

SEQ ID NO: 995812 - protein, 9 aa, Homo Sapiens
MPPMFMYIC

SEQ ID NO: 995813 - protein, 9 aa, Homo Sapiens
QCIQTEVDN

SEQ ID NO: 995814 - protein, 9 aa, Homo Sapiens
GPKGTEGPM

SEQ ID NO: 995815 - protein, 9 aa, Homo Sapiens
VEKPAVGKS

SEQ ID NO: 995816 - protein, 9 aa, Homo Sapiens
KLSWSGAPR

SEQ ID NO: 995817 - protein, 9 aa, Homo Sapiens
LFEIFNLVY

SEQ ID NO: 995818 - protein, 9 aa, Homo Sapiens
FVALFDYDL

SEQ ID NO: 995819 - protein, 9 aa, Homo Sapiens
RHRRNTSVE

SEQ ID NO: 995820 - protein, 9 aa, Homo Sapiens
FMLFPVPET

SEQ ID NO: 995821 - protein, 9 aa, Homo Sapiens
RMIEKLFSC

SEQ ID NO: 995822 - protein, 9 aa, Homo Sapiens
QPQEEQSLQ

SEQ ID NO: 995823 - protein, 9 aa, Homo Sapiens
AQSGNLEVK

SEQ ID NO: 995824 - protein, 9 aa, Homo Sapiens
LDPPKKDVT

SEQ ID NO: 995825 - protein, 9 aa, Homo Sapiens
ACEAERPEV

SEQ ID NO: 995826 - protein, 9 aa, Homo Sapiens
TEENALEIL

SEQ ID NO: 995827 - protein, 9 aa, Homo Sapiens
KIREQEERL

SEQ ID NO: 995828 - protein, 9 aa, Homo Sapiens
GLVLDIFAL

SEQ ID NO: 995829 - protein, 9 aa, Homo Sapiens
VAEEELQKS

SEQ ID NO: 995830 - protein, 9 aa, Homo Sapiens
KLPYLSKGT

SEQ ID NO: 995831 - protein, 9 aa, Homo Sapiens
KSPLFHILK

SEQ ID NO: 995832 - protein, 9 aa, Homo Sapiens
IPVDGAEAE

SEQ ID NO: 995833 - protein, 9 aa, Homo Sapiens
IMTVILFQV

SEQ ID NO: 995834 - protein, 9 aa, Homo Sapiens
LPYRSMKLK

SEQ ID NO: 995835 - protein, 9 aa, Homo Sapiens
WLCPYCRRS

SEQ ID NO: 995836 - protein, 9 aa, Homo Sapiens
VPTAPKVLG

SEQ ID NO: 995837 - protein, 9 aa, Homo Sapiens
SKSIKIHTY

SEQ ID NO: 995838 - protein, 9 aa, Homo Sapiens
VMEQGQRVA

SEQ ID NO: 995839 - protein, 9 aa, Homo Sapiens
QLEHILLCP

SEQ ID NO: 995840 - protein, 9 aa, Homo Sapiens
PRPKKPPEE

SEQ ID NO: 995841 - protein, 9 aa, Homo Sapiens
HVPADFDQE

SEQ ID NO: 995842 - protein, 9 aa, Homo Sapiens
PQPQEEQSL

SEQ ID NO: 995843 - protein, 9 aa, Homo Sapiens
ETLLFFLFF

SEQ ID NO: 995844 - protein, 9 aa, Homo Sapiens
SEIQWWYAE

SEQ ID NO: 995845 - protein, 9 aa, Homo Sapiens
PQGGNQPKG

SEQ ID NO: 995846 - protein, 9 aa, Homo Sapiens
KHEDDQPDS

SEQ ID NO: 995847 - protein, 9 aa, Homo Sapiens
DAKCVNLHF

SEQ ID NO: 995848 - protein, 9 aa, Homo Sapiens
KISLNLSVR

SEQ ID NO: 995849 - protein, 9 aa, Homo Sapiens
SRHLDSYVF

SEQ ID NO: 995850 - protein, 9 aa, Homo Sapiens
ECEEEKHDC

SEQ ID NO: 995851 - protein, 9 aa, Homo Sapiens
CSKCGKSFS

SEQ ID NO: 995852 - protein, 9 aa, Homo Sapiens
NSPKVPVKI

SEQ ID NO: 995853 - protein, 9 aa, Homo Sapiens
TVPDQEKLG

SEQ ID NO: 995854 - protein, 9 aa, Homo Sapiens
PKKPNGIII

SEQ ID NO: 995855 - protein, 9 aa, Homo Sapiens
SRGPLQGSV

SEQ ID NO: 995856 - protein, 9 aa, Homo Sapiens
SHYGQIDRK

SEQ ID NO: 995857 - protein, 9 aa, Homo Sapiens
KANSLLVYK

SEQ ID NO: 995858 - protein, 9 aa, Homo Sapiens
QQQCQPSPK

SEQ ID NO: 995859 - protein, 9 aa, Homo Sapiens
EWKETARGI

SEQ ID NO: 995860 - protein, 9 aa, Homo Sapiens
TTHEVFPRL

SEQ ID NO: 995861 - protein, 9 aa, Homo Sapiens
RVSAQLDRT

SEQ ID NO: 995862 - protein, 9 aa, Homo Sapiens
LVGNGGPPE

SEQ ID NO: 995863 - protein, 9 aa, Homo Sapiens
TPPGASRYT

SEQ ID NO: 995864 - protein, 9 aa, Homo Sapiens
QSLQRSTSG

SEQ ID NO: 995865 - protein, 9 aa, Homo Sapiens
LSLFSRMKP

SEQ ID NO: 995866 - protein, 9 aa, Homo Sapiens
ASGPSSTVP

SEQ ID NO: 995867 - protein, 9 aa, Homo Sapiens
FEEIPVDGA

SEQ ID NO: 995868 - protein, 9 aa, Homo Sapiens
SHSIVLARE

SEQ ID NO: 995869 - protein, 9 aa, Homo Sapiens
YSQQRRPSV

SEQ ID NO: 995870 - protein, 9 aa, Homo Sapiens
FDEGWHQIC

SEQ ID NO: 995871 - protein, 9 aa, Homo Sapiens
SCPANNYQA

SEQ ID NO: 995872 - protein, 9 aa, Homo Sapiens
FVSRLSLFS

SEQ ID NO: 995873 - protein, 9 aa, Homo Sapiens
HKRTHTGEQ

SEQ ID NO: 995874 - protein, 9 aa, Homo Sapiens
KIQGKKMAY

SEQ ID NO: 995875 - protein, 9 aa, Homo Sapiens
YGLVGWFPA

SEQ ID NO: 995876 - protein, 9 aa, Homo Sapiens
LFQVSFWIN

SEQ ID NO: 995877 - protein, 9 aa, Homo Sapiens
GKFYWGDAK

SEQ ID NO: 995878 - protein, 9 aa, Homo Sapiens
GVKRDRGPA

SEQ ID NO: 995879 - protein, 9 aa, Homo Sapiens
MKYCFKVFD

SEQ ID NO: 995880 - protein, 9 aa, Homo Sapiens
RSTRGGHIN

SEQ ID NO: 995881 - protein, 9 aa, Homo Sapiens
VAFPDAQLP

SEQ ID NO: 995882 - protein, 9 aa, Homo Sapiens
TSQCLGSQK

SEQ ID NO: 995883 - protein, 9 aa, Homo Sapiens
PGFPGPPGQ

SEQ ID NO: 995884 - protein, 9 aa, Homo Sapiens
FQFQNKAIS

SEQ ID NO: 995885 - protein, 9 aa, Homo Sapiens
FLLPVITLV

SEQ ID NO: 995886 - protein, 9 aa, Homo Sapiens
EEPPAHRLE

SEQ ID NO: 995887 - protein, 9 aa, Homo Sapiens
RAMFVYIMR

SEQ ID NO: 995888 - protein, 9 aa, Homo Sapiens
GYVVVVIDG

SEQ ID NO: 995889 - protein, 9 aa, Homo Sapiens
ALRVFVESL

SEQ ID NO: 995890 - protein, 9 aa, Homo Sapiens
NSTGKFAFP

SEQ ID NO: 995891 - protein, 9 aa, Homo Sapiens
DKHEDDQPD

SEQ ID NO: 995892 - protein, 9 aa, Homo Sapiens
CTPNWRAMF

SEQ ID NO: 995893 - protein, 9 aa, Homo Sapiens
NTYAPTMPY

SEQ ID NO: 995894 - protein, 9 aa, Homo Sapiens
SKKDLERFL

SEQ ID NO: 995895 - protein, 9 aa, Homo Sapiens
EDECEEEKH

SEQ ID NO: 995896 - protein, 9 aa, Homo Sapiens
NSINITALN

SEQ ID NO: 995897 - protein, 9 aa, Homo Sapiens
VKYTPPGAS

SEQ ID NO: 995898 - protein, 9 aa, Homo Sapiens
KRDRGPAGP

SEQ ID NO: 995899 - protein, 9 aa, Homo Sapiens
NGLLIAVEI

SEQ ID NO: 995900 - protein, 9 aa, Homo Sapiens
LGSQKAFMK

SEQ ID NO: 995901 - protein, 9 aa, Homo Sapiens
ERGWVGPLL

SEQ ID NO: 995902 - protein, 9 aa, Homo Sapiens
LFRELQAMA

SEQ ID NO: 995903 - protein, 9 aa, Homo Sapiens
LLEVRPWNT

SEQ ID NO: 995904 - protein, 9 aa, Homo Sapiens
NRTEEDGNS

SEQ ID NO: 995905 - protein, 9 aa, Homo Sapiens
VERGWVGPL

SEQ ID NO: 995906 - protein, 9 aa, Homo Sapiens
TPQTQATQK

SEQ ID NO: 995907 - protein, 9 aa, Homo Sapiens
MTHFPASSF

SEQ ID NO: 995908 - protein, 9 aa, Homo Sapiens
RPAKELPFP

SEQ ID NO: 995909 - protein, 9 aa, Homo Sapiens
GVVGVPRAG

SEQ ID NO: 995910 - protein, 9 aa, Homo Sapiens
PGRDEEQGL

SEQ ID NO: 995911 - protein, 9 aa, Homo Sapiens
GLWSYSSRL

SEQ ID NO: 995912 - protein, 9 aa, Homo Sapiens
KGLANSSIV

SEQ ID NO: 995913 - protein, 9 aa, Homo Sapiens
FTSYLFTLV

SEQ ID NO: 995914 - protein, 9 aa, Homo Sapiens
KNGAPKEAQ

SEQ ID NO: 995915 - protein, 9 aa, Homo Sapiens
YTNAGRICR

SEQ ID NO: 995916 - protein, 9 aa, Homo Sapiens
KDRVGKNGA

SEQ ID NO: 995917 - protein, 9 aa, Homo Sapiens
RHEDPQTAI

SEQ ID NO: 995918 - protein, 9 aa, Homo Sapiens
ILSSPQKVA

SEQ ID NO: 995919 - protein, 9 aa, Homo Sapiens
SSTYFFSPQ

SEQ ID NO: 995920 - protein, 9 aa, Homo Sapiens
DLGMNDEED

SEQ ID NO: 995921 - protein, 9 aa, Homo Sapiens
VAAERVLYV

SEQ ID NO: 995922 - protein, 9 aa, Homo Sapiens
KIVGSEINS

SEQ ID NO: 995923 - protein, 9 aa, Homo Sapiens
SKLTEFHVA

SEQ ID NO: 995924 - protein, 9 aa, Homo Sapiens
MKNSPLSKV

SEQ ID NO: 995925 - protein, 9 aa, Homo Sapiens
ESHCCMETT

SEQ ID NO: 995926 - protein, 9 aa, Homo Sapiens
TAIDVNGKE

SEQ ID NO: 995927 - protein, 9 aa, Homo Sapiens
QANGPQDLR

SEQ ID NO: 995928 - protein, 9 aa, Homo Sapiens
NLEVKVKGI

SEQ ID NO: 995929 - protein, 9 aa, Homo Sapiens
QIEGLFPRG

SEQ ID NO: 995930 - protein, 9 aa, Homo Sapiens
STHSSVSSR

SEQ ID NO: 995931 - protein, 9 aa, Homo Sapiens
ENGPGLSPL

SEQ ID NO: 995932 - protein, 9 aa, Homo Sapiens
FMLEEDWKF

SEQ ID NO: 995933 - protein, 9 aa, Homo Sapiens
RDGHHRPVS

SEQ ID NO: 995934 - protein, 9 aa, Homo Sapiens
LAPPCASCH

SEQ ID NO: 995935 - protein, 9 aa, Homo Sapiens
SSYSNCVSI

SEQ ID NO: 995936 - protein, 9 aa, Homo Sapiens
TGVKLYKCQ

SEQ ID NO: 995937 - protein, 9 aa, Homo Sapiens
DLNQNFPDL

SEQ ID NO: 995938 - protein, 9 aa, Homo Sapiens
ECLHGRTGL

SEQ ID NO: 995939 - protein, 9 aa, Homo Sapiens
AVLESLFFS

SEQ ID NO: 995940 - protein, 9 aa, Homo Sapiens
LIERRGTKR

SEQ ID NO: 995941 - protein, 9 aa, Homo Sapiens
KRILVDLSS

SEQ ID NO: 995942 - protein, 9 aa, Homo Sapiens
VNEAGYKKD

SEQ ID NO: 995943 - protein, 9 aa, Homo Sapiens
LQLTTLCQN

SEQ ID NO: 995944 - protein, 9 aa, Homo Sapiens
FLDNLCAAG

SEQ ID NO: 995945 - protein, 9 aa, Homo Sapiens
GYGSPAAGS

SEQ ID NO: 995946 - protein, 9 aa, Homo Sapiens
IRKFSYCEA

SEQ ID NO: 995947 - protein, 9 aa, Homo Sapiens
VDFRVSAQL

SEQ ID NO: 995948 - protein, 9 aa, Homo Sapiens
LYKCQCGKA

SEQ ID NO: 995949 - protein, 9 aa, Homo Sapiens
DGPDPAWEG

SEQ ID NO: 995950 - protein, 9 aa, Homo Sapiens
IIYLIPRYV

SEQ ID NO: 995951 - protein, 9 aa, Homo Sapiens
LITRQRYRK

SEQ ID NO: 995952 - protein, 9 aa, Homo Sapiens
FQNKAISYA

SEQ ID NO: 995953 - protein, 9 aa, Homo Sapiens
TDQMTFGKR

SEQ ID NO: 995954 - protein, 9 aa, Homo Sapiens
RQFLPSLKD

SEQ ID NO: 995955 - protein, 9 aa, Homo Sapiens
DLLTMSPNP

SEQ ID NO: 995956 - protein, 9 aa, Homo Sapiens
SLLRKKPEI

SEQ ID NO: 995957 - protein, 9 aa, Homo Sapiens
PDPAWEGGG

SEQ ID NO: 995958 - protein, 9 aa, Homo Sapiens
ILKLKFLLS

SEQ ID NO: 995959 - protein, 9 aa, Homo Sapiens
FLCHGDQFS

SEQ ID NO: 995960 - protein, 9 aa, Homo Sapiens
GKKDADVFL

SEQ ID NO: 995961 - protein, 9 aa, Homo Sapiens
DVAKHKLVV

SEQ ID NO: 995962 - protein, 9 aa, Homo Sapiens
PRFAQPGFF

SEQ ID NO: 995963 - protein, 9 aa, Homo Sapiens
DTSGSSSLS

SEQ ID NO: 995964 - protein, 9 aa, Homo Sapiens
KQKPKYQVC

SEQ ID NO: 995965 - protein, 9 aa, Homo Sapiens
ESLLRYGLP

SEQ ID NO: 995966 - protein, 9 aa, Homo Sapiens
PRRPRLSFC

SEQ ID NO: 995967 - protein, 9 aa, Homo Sapiens
FVAKKLDQQ

SEQ ID NO: 995968 - protein, 9 aa, Homo Sapiens
YTLRIKKVK

SEQ ID NO: 995969 - protein, 9 aa, Homo Sapiens
SVDKHEDDQ

SEQ ID NO: 995970 - protein, 9 aa, Homo Sapiens
MIEKLFSCV

SEQ ID NO: 995971 - protein, 9 aa, Homo Sapiens
EPSTRASSS

SEQ ID NO: 995972 - protein, 9 aa, Homo Sapiens
APASKLLPP

SEQ ID NO: 995973 - protein, 9 aa, Homo Sapiens
VQSLPTKKF

SEQ ID NO: 995974 - protein, 9 aa, Homo Sapiens
MIMNKGLSS

SEQ ID NO: 995975 - protein, 9 aa, Homo Sapiens
ACFLCHGDQ

SEQ ID NO: 995976 - protein, 9 aa, Homo Sapiens
GCQQRPLPW

SEQ ID NO: 995977 - protein, 9 aa, Homo Sapiens
KRTHTGEQP

SEQ ID NO: 995978 - protein, 9 aa, Homo Sapiens
HRYDDLVQT

SEQ ID NO: 995979 - protein, 9 aa, Homo Sapiens
RPPLIPVTF

SEQ ID NO: 995980 - protein, 9 aa, Homo Sapiens
ELVLPENRI

SEQ ID NO: 995981 - protein, 9 aa, Homo Sapiens
FSKLWDPSE

SEQ ID NO: 995982 - protein, 9 aa, Homo Sapiens
YNRFLFPER

SEQ ID NO: 995983 - protein, 9 aa, Homo Sapiens
SFEEAISAR

SEQ ID NO: 995984 - protein, 9 aa, Homo Sapiens
DEEQGLELR

SEQ ID NO: 995985 - protein, 9 aa, Homo Sapiens
GAEAEAFLP

SEQ ID NO: 995986 - protein, 9 aa, Homo Sapiens
TVPAAAALA

SEQ ID NO: 995987 - protein, 9 aa, Homo Sapiens
GKTNEPKGK

SEQ ID NO: 995988 - protein, 9 aa, Homo Sapiens
KVFDLNGDG

SEQ ID NO: 995989 - protein, 9 aa, Homo Sapiens
GLVGWFPAN

SEQ ID NO: 995990 - protein, 9 aa, Homo Sapiens
PASKLLPPL

SEQ ID NO: 995991 - protein, 9 aa, Homo Sapiens
PKYQVCWKI

SEQ ID NO: 995992 - protein, 9 aa, Homo Sapiens
SVKLIYKKG

SEQ ID NO: 995993 - protein, 9 aa, Homo Sapiens
ERIKAMVEA

SEQ ID NO: 995994 - protein, 9 aa, Homo Sapiens
TVTSCPANN

SEQ ID NO: 995995 - protein, 9 aa, Homo Sapiens
EEDHDPVPL

SEQ ID NO: 995996 - protein, 9 aa, Homo Sapiens
KIGVNNEAP

SEQ ID NO: 995997 - protein, 9 aa, Homo Sapiens
RITASSNVN

SEQ ID NO: 995998 - protein, 9 aa, Homo Sapiens
PPAHRLERE

SEQ ID NO: 995999 - protein, 9 aa, Homo Sapiens
KHNESCSPD

SEQ ID NO: 996000 - protein, 9 aa, Homo Sapiens
RHSFSSPEP

SEQ ID NO: 996001 - protein, 9 aa, Homo Sapiens
ERSFEEAIS

SEQ ID NO: 996002 - protein, 9 aa, Homo Sapiens
MRSVMEASF

SEQ ID NO: 996003 - protein, 9 aa, Homo Sapiens
KYQVCWKII

SEQ ID NO: 996004 - protein, 9 aa, Homo Sapiens
RGWVGPLLA

SEQ ID NO: 996005 - protein, 9 aa, Homo Sapiens
GNGDGGLVL

SEQ ID NO: 996006 - protein, 9 aa, Homo Sapiens
QEGKFYWGD

SEQ ID NO: 996007 - protein, 9 aa, Homo Sapiens
ESLLQESRQ

SEQ ID NO: 996008 - protein, 9 aa, Homo Sapiens
TFPNWMKNP

SEQ ID NO: 996009 - protein, 9 aa, Homo Sapiens
ISESSRQFL

SEQ ID NO: 996010 - protein, 9 aa, Homo Sapiens
NEEGLIDGV

SEQ ID NO: 996011 - protein, 9 aa, Homo Sapiens
QCLGSQKAF

SEQ ID NO: 996012 - protein, 9 aa, Homo Sapiens
TLRIKKVKG

SEQ ID NO: 996013 - protein, 9 aa, Homo Sapiens
FDQEKKIDD

SEQ ID NO: 996014 - protein, 9 aa, Homo Sapiens
ACGLSHSVA

SEQ ID NO: 996015 - protein, 9 aa, Homo Sapiens
NGLVLDIFA

SEQ ID NO: 996016 - protein, 9 aa, Homo Sapiens
LKWSPPKKP

SEQ ID NO: 996017 - protein, 9 aa, Homo Sapiens
PGNPGLSGP

SEQ ID NO: 996018 - protein, 9 aa, Homo Sapiens
FIKHFIIYL

SEQ ID NO: 996019 - protein, 9 aa, Homo Sapiens
TGNNYKNKM

SEQ ID NO: 996020 - protein, 9 aa, Homo Sapiens
DVEKVYVYL

SEQ ID NO: 996021 - protein, 9 aa, Homo Sapiens
SIQIEGLFP

SEQ ID NO: 996022 - protein, 9 aa, Homo Sapiens
PVVEWWFQV

SEQ ID NO: 996023 - protein, 9 aa, Homo Sapiens
ESLLRKKPE

SEQ ID NO: 996024 - protein, 9 aa, Homo Sapiens
DLNHNYTSL

SEQ ID NO: 996025 - protein, 9 aa, Homo Sapiens
VSSNSIQIE

SEQ ID NO: 996026 - protein, 9 aa, Homo Sapiens
FLLEHSLPW

SEQ ID NO: 996027 - protein, 9 aa, Homo Sapiens
DRESKKTDT

SEQ ID NO: 996028 - protein, 9 aa, Homo Sapiens
FLSTFHIQI

SEQ ID NO: 996029 - protein, 9 aa, Homo Sapiens
IYTNAGRIC

SEQ ID NO: 996030 - protein, 9 aa, Homo Sapiens
SSPPPPPLG

SEQ ID NO: 996031 - protein, 9 aa, Homo Sapiens
PSRLLFLDI

SEQ ID NO: 996032 - protein, 9 aa, Homo Sapiens
SNKGRLNCD

SEQ ID NO: 996033 - protein, 9 aa, Homo Sapiens
SCGKTFLCS

SEQ ID NO: 996034 - protein, 9 aa, Homo Sapiens
SHSWHNGER

SEQ ID NO: 996035 - protein, 9 aa, Homo Sapiens
GSQKAFMKE

SEQ ID NO: 996036 - protein, 9 aa, Homo Sapiens
SIGLPHSHS

SEQ ID NO: 996037 - protein, 9 aa, Homo Sapiens
GNQPKGPPP

SEQ ID NO: 996038 - protein, 9 aa, Homo Sapiens
QTEVDNPGH

SEQ ID NO: 996039 - protein, 9 aa, Homo Sapiens
ATGYSFSFS

SEQ ID NO: 996040 - protein, 9 aa, Homo Sapiens
SKKTDTNAP

SEQ ID NO: 996041 - protein, 9 aa, Homo Sapiens
FKTIVLLSI

SEQ ID NO: 996042 - protein, 9 aa, Homo Sapiens
PPKKPNGII

SEQ ID NO: 996043 - protein, 9 aa, Homo Sapiens
SAFVDVYEY

SEQ ID NO: 996044 - protein, 9 aa, Homo Sapiens
LTTLCQNRT

SEQ ID NO: 996045 - protein, 9 aa, Homo Sapiens
ATPPRSSGS

SEQ ID NO: 996046 - protein, 9 aa, Homo Sapiens
EALRHTEVS

SEQ ID NO: 996047 - protein, 9 aa, Homo Sapiens
TTKADSGYT

SEQ ID NO: 996048 - protein, 9 aa, Homo Sapiens
EQGQRVAEL

SEQ ID NO: 996049 - protein, 9 aa, Homo Sapiens
DIFFGSCVS

SEQ ID NO: 996050 - protein, 9 aa, Homo Sapiens
SPAAGSASA

SEQ ID NO: 996051 - protein, 9 aa, Homo Sapiens
LSFMLEEDW

SEQ ID NO: 996052 - protein, 9 aa, Homo Sapiens
SPSLETLSA

SEQ ID NO: 996053 - protein, 9 aa, Homo Sapiens
LPYLSKGTD

SEQ ID NO: 996054 - protein, 9 aa, Homo Sapiens
SEINSTGKF

SEQ ID NO: 996055 - protein, 9 aa, Homo Sapiens
LHVPADFDQ

SEQ ID NO: 996056 - protein, 9 aa, Homo Sapiens
LMSNPVSMP

SEQ ID NO: 996057 - protein, 9 aa, Homo Sapiens
VLQRKSRKH

SEQ ID NO: 996058 - protein, 9 aa, Homo Sapiens
HFIIYLIPR

SEQ ID NO: 996059 - protein, 9 aa, Homo Sapiens
LLQPEKLVV

SEQ ID NO: 996060 - protein, 9 aa, Homo Sapiens
NHNYTSLLK

SEQ ID NO: 996061 - protein, 9 aa, Homo Sapiens
HKHDGMEAY

SEQ ID NO: 996062 - protein, 9 aa, Homo Sapiens
KSSTENHGF

SEQ ID NO: 996063 - protein, 9 aa, Homo Sapiens
RKFQKELRQ

SEQ ID NO: 996064 - protein, 9 aa, Homo Sapiens
WYLDENEIT

SEQ ID NO: 996065 - protein, 9 aa, Homo Sapiens
CQCASQKNK

SEQ ID NO: 996066 - protein, 9 aa, Homo Sapiens
NRFLFPERI

SEQ ID NO: 996067 - protein, 9 aa, Homo Sapiens
PKKDVTVSP

SEQ ID NO: 996068 - protein, 9 aa, Homo Sapiens
SEGDDPEDD

SEQ ID NO: 996069 - protein, 9 aa, Homo Sapiens
FKLPYLSKG

SEQ ID NO: 996070 - protein, 9 aa, Homo Sapiens
TPLNTRHSF

SEQ ID NO: 996071 - protein, 9 aa, Homo Sapiens
LFFPVGFVA

SEQ ID NO: 996072 - protein, 9 aa, Homo Sapiens
SLVEDFMCS

SEQ ID NO: 996073 - protein, 9 aa, Homo Sapiens
SRYTIMVLF

SEQ ID NO: 996074 - protein, 9 aa, Homo Sapiens
SYSGSYYEG

SEQ ID NO: 996075 - protein, 9 aa, Homo Sapiens
KPKYQVCWK

SEQ ID NO: 996076 - protein, 9 aa, Homo Sapiens
PASSFWSVM

SEQ ID NO: 996077 - protein, 9 aa, Homo Sapiens
SHCCMETTP

SEQ ID NO: 996078 - protein, 9 aa, Homo Sapiens
KTDTNAPTD

SEQ ID NO: 996079 - protein, 9 aa, Homo Sapiens
PRYSSPSLE

SEQ ID NO: 996080 - protein, 9 aa, Homo Sapiens
LLQRRRGEL

SEQ ID NO: 996081 - protein, 9 aa, Homo Sapiens
LDAHPEMRC

SEQ ID NO: 996082 - protein, 9 aa, Homo Sapiens
YLNLPSYRH

SEQ ID NO: 996083 - protein, 9 aa, Homo Sapiens
CPEPLLVLL

SEQ ID NO: 996084 - protein, 9 aa, Homo Sapiens
TALNYDIDP

SEQ ID NO: 996085 - protein, 9 aa, Homo Sapiens
LSFPFTLRN

SEQ ID NO: 996086 - protein, 9 aa, Homo Sapiens
GLLGLLEKM

SEQ ID NO: 996087 - protein, 9 aa, Homo Sapiens
LLCPDTYIG

SEQ ID NO: 996088 - protein, 9 aa, Homo Sapiens
ENEVNISPS

SEQ ID NO: 996089 - protein, 9 aa, Homo Sapiens
LPAPNAPAA

SEQ ID NO: 996090 - protein, 9 aa, Homo Sapiens
LKTTEPGLF

SEQ ID NO: 996091 - protein, 9 aa, Homo Sapiens
ALDNIDSVK

SEQ ID NO: 996092 - protein, 9 aa, Homo Sapiens
VVLLPKKTS

SEQ ID NO: 996093 - protein, 9 aa, Homo Sapiens
SSVSSRLLR

SEQ ID NO: 996094 - protein, 9 aa, Homo Sapiens
PGTCVLCQR

SEQ ID NO: 996095 - protein, 9 aa, Homo Sapiens
LIFFSYALI

SEQ ID NO: 996096 - protein, 9 aa, Homo Sapiens
IQTEVDNPG

SEQ ID NO: 996097 - protein, 9 aa, Homo Sapiens
LPFPRKGGA

SEQ ID NO: 996098 - protein, 9 aa, Homo Sapiens
GSVKLIYKK

SEQ ID NO: 996099 - protein, 9 aa, Homo Sapiens
PPMFMYICP

SEQ ID NO: 996100 - protein, 9 aa, Homo Sapiens
GLSHSVAWT

SEQ ID NO: 996101 - protein, 9 aa, Homo Sapiens
AGLISSPEL

SEQ ID NO: 996102 - protein, 9 aa, Homo Sapiens
LRKFQKELR

SEQ ID NO: 996103 - protein, 9 aa, Homo Sapiens
TSGSSSLSS

SEQ ID NO: 996104 - protein, 9 aa, Homo Sapiens
IQPRATKHK

SEQ ID NO: 996105 - protein, 9 aa, Homo Sapiens
ANKKKGIEQ

SEQ ID NO: 996106 - protein, 9 aa, Homo Sapiens
QQLVGNGGP

SEQ ID NO: 996107 - protein, 9 aa, Homo Sapiens
NGRKVLDST

SEQ ID NO: 996108 - protein, 9 aa, Homo Sapiens
LEAPLRQST

SEQ ID NO: 996109 - protein, 9 aa, Homo Sapiens
LQRSTSGYP

SEQ ID NO: 996110 - protein, 9 aa, Homo Sapiens
LLQVQLYED

SEQ ID NO: 996111 - protein, 9 aa, Homo Sapiens
SDQSSDTSS

SEQ ID NO: 996112 - protein, 9 aa, Homo Sapiens
EQKKSIEER

SEQ ID NO: 996113 - protein, 9 aa, Homo Sapiens
GFNSIGLPH

SEQ ID NO: 996114 - protein, 9 aa, Homo Sapiens
SSSRHSQVG

SEQ ID NO: 996115 - protein, 9 aa, Homo Sapiens
NRTLVGMKL

SEQ ID NO: 996116 - protein, 9 aa, Homo Sapiens
HEVFPRLYH

SEQ ID NO: 996117 - protein, 9 aa, Homo Sapiens
PLLVLLDSS

SEQ ID NO: 996118 - protein, 9 aa, Homo Sapiens
DFLSTFHIQ

SEQ ID NO: 996119 - protein, 9 aa, Homo Sapiens
IEEQKEVME

SEQ ID NO: 996120 - protein, 9 aa, Homo Sapiens
FVFKATFCG

SEQ ID NO: 996121 - protein, 9 aa, Homo Sapiens
ISNSEAYDH

SEQ ID NO: 996122 - protein, 9 aa, Homo Sapiens
EDGNSDPES

SEQ ID NO: 996123 - protein, 9 aa, Homo Sapiens
RPRIQYFFV

SEQ ID NO: 996124 - protein, 9 aa, Homo Sapiens
NAQNLDLNQ

SEQ ID NO: 996125 - protein, 9 aa, Homo Sapiens
NSNPGGKTN

SEQ ID NO: 996126 - protein, 9 aa, Homo Sapiens
SHVFSKLWD

SEQ ID NO: 996127 - protein, 9 aa, Homo Sapiens
MRPTVPGSP

SEQ ID NO: 996128 - protein, 9 aa, Homo Sapiens
LESLEPEDS

SEQ ID NO: 996129 - protein, 9 aa, Homo Sapiens
FESLLQESR

SEQ ID NO: 996130 - protein, 9 aa, Homo Sapiens
YEEMRKEAS

SEQ ID NO: 996131 - protein, 9 aa, Homo Sapiens
APTMPYKHS

SEQ ID NO: 996132 - protein, 9 aa, Homo Sapiens
HQICLLVTE

SEQ ID NO: 996133 - protein, 9 aa, Homo Sapiens
ELVAKLHSL

SEQ ID NO: 996134 - protein, 9 aa, Homo Sapiens
EEEQKKSIE

SEQ ID NO: 996135 - protein, 9 aa, Homo Sapiens
GQSSHYGQI

SEQ ID NO: 996136 - protein, 9 aa, Homo Sapiens
GRDEEQGLE

SEQ ID NO: 996137 - protein, 9 aa, Homo Sapiens
KEQAQPPYL

SEQ ID NO: 996138 - protein, 9 aa, Homo Sapiens
LSYTPLRRQ

SEQ ID NO: 996139 - protein, 9 aa, Homo Sapiens
EINSTGKFA

SEQ ID NO: 996140 - protein, 9 aa, Homo Sapiens
YNLLSFMLE

SEQ ID NO: 996141 - protein, 9 aa, Homo Sapiens
RLKWSPPKK

SEQ ID NO: 996142 - protein, 9 aa, Homo Sapiens
GLDDLSYTP

SEQ ID NO: 996143 - protein, 9 aa, Homo Sapiens
NESHCCMET

SEQ ID NO: 996144 - protein, 9 aa, Homo Sapiens
LCHGDQFSL

SEQ ID NO: 996145 - protein, 9 aa, Homo Sapiens
LFHILKTKE

SEQ ID NO: 996146 - protein, 9 aa, Homo Sapiens
SHKHDGMEA

SEQ ID NO: 996147 - protein, 9 aa, Homo Sapiens
IFFGSCVSQ

SEQ ID NO: 996148 - protein, 9 aa, Homo Sapiens
CDVVGSPTS

SEQ ID NO: 996149 - protein, 9 aa, Homo Sapiens
SEWKSYRDT

SEQ ID NO: 996150 - protein, 9 aa, Homo Sapiens
TDVLTEENA

SEQ ID NO: 996151 - protein, 9 aa, Homo Sapiens
PANNYQACL

SEQ ID NO: 996152 - protein, 9 aa, Homo Sapiens
PAQAIGIQP

SEQ ID NO: 996153 - protein, 9 aa, Homo Sapiens
AQQKAPTQK

SEQ ID NO: 996154 - protein, 9 aa, Homo Sapiens
KKDLERFLR

SEQ ID NO: 996155 - protein, 9 aa, Homo Sapiens
VASFYCECL

SEQ ID NO: 996156 - protein, 9 aa, Homo Sapiens
VNFQFQNKA

SEQ ID NO: 996157 - protein, 9 aa, Homo Sapiens
RALLEAPLR

SEQ ID NO: 996158 - protein, 9 aa, Homo Sapiens
DYDLLTMSP

SEQ ID NO: 996159 - protein, 9 aa, Homo Sapiens
AKHKLVVLV

SEQ ID NO: 996160 - protein, 9 aa, Homo Sapiens
TSLDVTLCN

SEQ ID NO: 996161 - protein, 9 aa, Homo Sapiens
SGGTPLLPP

SEQ ID NO: 996162 - protein, 9 aa, Homo Sapiens
PGVKRDRGP

SEQ ID NO: 996163 - protein, 9 aa, Homo Sapiens
APSDQSSDT

SEQ ID NO: 996164 - protein, 9 aa, Homo Sapiens
TPNWRAMFV

SEQ ID NO: 996165 - protein, 9 aa, Homo Sapiens
ASSSRHSQV

SEQ ID NO: 996166 - protein, 9 aa, Homo Sapiens
TLCNCITEN

SEQ ID NO: 996167 - protein, 9 aa, Homo Sapiens
PLSPRPKKP

SEQ ID NO: 996168 - protein, 9 aa, Homo Sapiens
KTKVFQAHT

SEQ ID NO: 996169 - protein, 9 aa, Homo Sapiens
VILFQVSFW

SEQ ID NO: 996170 - protein, 9 aa, Homo Sapiens
MEQGQRVAE

SEQ ID NO: 996171 - protein, 9 aa, Homo Sapiens
PRPCQESSF

SEQ ID NO: 996172 - protein, 9 aa, Homo Sapiens
KYTPPGASR

SEQ ID NO: 996173 - protein, 9 aa, Homo Sapiens
ATHTGVKLY

SEQ ID NO: 996174 - protein, 9 aa, Homo Sapiens
KVKGALKKV

SEQ ID NO: 996175 - protein, 9 aa, Homo Sapiens
LEDSLQDYP

SEQ ID NO: 996176 - protein, 9 aa, Homo Sapiens
NEGEDPWYQ

SEQ ID NO: 996177 - protein, 9 aa, Homo Sapiens
RKVKQYLVT

SEQ ID NO: 996178 - protein, 9 aa, Homo Sapiens
EVLRAQLEE

SEQ ID NO: 996179 - protein, 9 aa, Homo Sapiens
ENRIYLAGS

SEQ ID NO: 996180 - protein, 9 aa, Homo Sapiens
FQAGQHFKH

SEQ ID NO: 996181 - protein, 9 aa, Homo Sapiens
IESLLRKKP

SEQ ID NO: 996182 - protein, 9 aa, Homo Sapiens
YIRPIWQQV

SEQ ID NO: 996183 - protein, 9 aa, Homo Sapiens
SSRQFLPSL

SEQ ID NO: 996184 - protein, 9 aa, Homo Sapiens
GFVAAERVL

SEQ ID NO: 996185 - protein, 9 aa, Homo Sapiens
YALTSRFCQ

SEQ ID NO: 996186 - protein, 9 aa, Homo Sapiens
QKKGHFPRV

SEQ ID NO: 996187 - protein, 9 aa, Homo Sapiens
TVIPISISD

SEQ ID NO: 996188 - protein, 9 aa, Homo Sapiens
IVLLSIVYT

SEQ ID NO: 996189 - protein, 9 aa, Homo Sapiens
SYSSRLMRR

SEQ ID NO: 996190 - protein, 9 aa, Homo Sapiens
AAGFNSIGL

SEQ ID NO: 996191 - protein, 9 aa, Homo Sapiens
HVAFPDAQL

SEQ ID NO: 996192 - protein, 9 aa, Homo Sapiens
EQSLQRSTS

SEQ ID NO: 996193 - protein, 9 aa, Homo Sapiens
YKDTFQDYQ

SEQ ID NO: 996194 - protein, 9 aa, Homo Sapiens
GEIYGLVGW

SEQ ID NO: 996195 - protein, 9 aa, Homo Sapiens
NRGQEEKIR

SEQ ID NO: 996196 - protein, 9 aa, Homo Sapiens
FHVAFPDAQ

SEQ ID NO: 996197 - protein, 9 aa, Homo Sapiens
PRAGVPGVG

SEQ ID NO: 996198 - protein, 9 aa, Homo Sapiens
IELVLPENR

SEQ ID NO: 996199 - protein, 9 aa, Homo Sapiens
CPSCGLSPS

SEQ ID NO: 996200 - protein, 9 aa, Homo Sapiens
QRPPFRFLK

SEQ ID NO: 996201 - protein, 9 aa, Homo Sapiens
RCLCVLLLG

SEQ ID NO: 996202 - protein, 9 aa, Homo Sapiens
HSEIWEIPF

SEQ ID NO: 996203 - protein, 9 aa, Homo Sapiens
NLLSFMLEE

SEQ ID NO: 996204 - protein, 9 aa, Homo Sapiens
DCNECGKTF

SEQ ID NO: 996205 - protein, 9 aa, Homo Sapiens
ASQKNKKCW

SEQ ID NO: 996206 - protein, 9 aa, Homo Sapiens
PPLSPRPKK

SEQ ID NO: 996207 - protein, 9 aa, Homo Sapiens
MGNMLCGIG

SEQ ID NO: 996208 - protein, 9 aa, Homo Sapiens
PGPKGTEGP

SEQ ID NO: 996209 - protein, 9 aa, Homo Sapiens
LFLDIAPLD

SEQ ID NO: 996210 - protein, 9 aa, Homo Sapiens
LKLKFLLST

SEQ ID NO: 996211 - protein, 9 aa, Homo Sapiens
CGRCKHNES

SEQ ID NO: 996212 - protein, 9 aa, Homo Sapiens
WMKNPWVKV

SEQ ID NO: 996213 - protein, 9 aa, Homo Sapiens
PSARRFFWN

SEQ ID NO: 996214 - protein, 9 aa, Homo Sapiens
KGFFIFPEE

SEQ ID NO: 996215 - protein, 9 aa, Homo Sapiens
EIWEIPFEK

SEQ ID NO: 996216 - protein, 9 aa, Homo Sapiens
SLLKEIRDD

SEQ ID NO: 996217 - protein, 9 aa, Homo Sapiens
PQSEWKSYR

SEQ ID NO: 996218 - protein, 9 aa, Homo Sapiens
TYRVVRFKV

SEQ ID NO: 996219 - protein, 9 aa, Homo Sapiens
LRQSTFTLP

SEQ ID NO: 996220 - protein, 9 aa, Homo Sapiens
SIELVLPEN

SEQ ID NO: 996221 - protein, 9 aa, Homo Sapiens
KKPEINIEE

SEQ ID NO: 996222 - protein, 9 aa, Homo Sapiens
LEENNKGLI

SEQ ID NO: 996223 - protein, 9 aa, Homo Sapiens
KIIKLFFCL

SEQ ID NO: 996224 - protein, 9 aa, Homo Sapiens
FHILKTKEL

SEQ ID NO: 996225 - protein, 9 aa, Homo Sapiens
LYRKVPNLQ

SEQ ID NO: 996226 - protein, 9 aa, Homo Sapiens
LKPASELGE

SEQ ID NO: 996227 - protein, 9 aa, Homo Sapiens
PSNRTEEDG

SEQ ID NO: 996228 - protein, 9 aa, Homo Sapiens
SYYEGLGYG

SEQ ID NO: 996229 - protein, 9 aa, Homo Sapiens
GKTFLCSHS

SEQ ID NO: 996230 - protein, 9 aa, Homo Sapiens
VVVVIDGRG

SEQ ID NO: 996231 - protein, 9 aa, Homo Sapiens
SFSFSFLED

SEQ ID NO: 996232 - protein, 9 aa, Homo Sapiens
LRCLCVLLL

SEQ ID NO: 996233 - protein, 9 aa, Homo Sapiens
KNPKSKEPV

SEQ ID NO: 996234 - protein, 9 aa, Homo Sapiens
LDIFALVEC

SEQ ID NO: 996235 - protein, 9 aa, Homo Sapiens
RPPAKDGWS

SEQ ID NO: 996236 - protein, 9 aa, Homo Sapiens
QPPAASGPS

SEQ ID NO: 996237 - protein, 9 aa, Homo Sapiens
LRSSWADPP

SEQ ID NO: 996238 - protein, 9 aa, Homo Sapiens
LLIAVEINV

SEQ ID NO: 996239 - protein, 9 aa, Homo Sapiens
MPHYSEEEE

SEQ ID NO: 996240 - protein, 9 aa, Homo Sapiens
FMRSVMEAS

SEQ ID NO: 996241 - protein, 9 aa, Homo Sapiens
PGVMDGVLS

SEQ ID NO: 996242 - protein, 9 aa, Homo Sapiens
FRELGRIFK

SEQ ID NO: 996243 - protein, 9 aa, Homo Sapiens
KTFPNWMKN

SEQ ID NO: 996244 - protein, 9 aa, Homo Sapiens
NELSKSIKI

SEQ ID NO: 996245 - protein, 9 aa, Homo Sapiens
ENALEILQK

SEQ ID NO: 996246 - protein, 9 aa, Homo Sapiens
GRDLNHNYT

SEQ ID NO: 996247 - protein, 9 aa, Homo Sapiens
ESKVSRGPL

SEQ ID NO: 996248 - protein, 9 aa, Homo Sapiens
LFFLFFCMY

SEQ ID NO: 996249 - protein, 9 aa, Homo Sapiens
YNELSKSIK

SEQ ID NO: 996250 - protein, 9 aa, Homo Sapiens
DPAKRAIHY

SEQ ID NO: 996251 - protein, 9 aa, Homo Sapiens
EKLGEVWQR

SEQ ID NO: 996252 - protein, 9 aa, Homo Sapiens
KVIPQSIRL

SEQ ID NO: 996253 - protein, 9 aa, Homo Sapiens
LYTAPIFNE

SEQ ID NO: 996254 - protein, 9 aa, Homo Sapiens
AQGLLLRRH

SEQ ID NO: 996255 - protein, 9 aa, Homo Sapiens
THTGVKLYK

SEQ ID NO: 996256 - protein, 9 aa, Homo Sapiens
SRSENEKKA

SEQ ID NO: 996257 - protein, 9 aa, Homo Sapiens
PNPFGSSNL

SEQ ID NO: 996258 - protein, 9 aa, Homo Sapiens
NPIYRVEKR

SEQ ID NO: 996259 - protein, 9 aa, Homo Sapiens
LFSCVILTP

SEQ ID NO: 996260 - protein, 9 aa, Homo Sapiens
RELIYNQKK

SEQ ID NO: 996261 - protein, 9 aa, Homo Sapiens
YRSMKLKTV

SEQ ID NO: 996262 - protein, 9 aa, Homo Sapiens
VEGFLCEVL

SEQ ID NO: 996263 - protein, 9 aa, Homo Sapiens
CPDTYIGSV

SEQ ID NO: 996264 - protein, 9 aa, Homo Sapiens
YAATFKKFQ

SEQ ID NO: 996265 - protein, 9 aa, Homo Sapiens
TAPKVLGAV

SEQ ID NO: 996266 - protein, 9 aa, Homo Sapiens
RFKVIPQSI

SEQ ID NO: 996267 - protein, 9 aa, Homo Sapiens
DSDKKANSL

SEQ ID NO: 996268 - protein, 9 aa, Homo Sapiens
SNCVSIDLS

SEQ ID NO: 996269 - protein, 9 aa, Homo Sapiens
LFDYDLLTM

SEQ ID NO: 996270 - protein, 9 aa, Homo Sapiens
LPSCPEPLL

SEQ ID NO: 996271 - protein, 9 aa, Homo Sapiens
APLRQSTFT

SEQ ID NO: 996272 - protein, 9 aa, Homo Sapiens
LPALISSPP

SEQ ID NO: 996273 - protein, 9 aa, Homo Sapiens
KHDGMEAYV

SEQ ID NO: 996274 - protein, 9 aa, Homo Sapiens
HIFALVIVL

SEQ ID NO: 996275 - protein, 9 aa, Homo Sapiens
RELRAALPA

SEQ ID NO: 996276 - protein, 9 aa, Homo Sapiens
KMFPHCKNV

SEQ ID NO: 996277 - protein, 9 aa, Homo Sapiens
KHFQQPLIT

SEQ ID NO: 996278 - protein, 9 aa, Homo Sapiens
VKRDRGPAG

SEQ ID NO: 996279 - protein, 9 aa, Homo Sapiens
GQHFKHRFR

SEQ ID NO: 996280 - protein, 9 aa, Homo Sapiens
TRLSKHVEV

SEQ ID NO: 996281 - protein, 9 aa, Homo Sapiens
LDNIDSVKC

SEQ ID NO: 996282 - protein, 9 aa, Homo Sapiens
SYHKKIYTV

SEQ ID NO: 996283 - protein, 9 aa, Homo Sapiens
DLMSNPVSM

SEQ ID NO: 996284 - protein, 9 aa, Homo Sapiens
SSFSSSSSP

SEQ ID NO: 996285 - protein, 9 aa, Homo Sapiens
KLWDPSEAW

SEQ ID NO: 996286 - protein, 9 aa, Homo Sapiens
PFFTDKFAL

SEQ ID NO: 996287 - protein, 9 aa, Homo Sapiens
VSRLSLFSR

SEQ ID NO: 996288 - protein, 9 aa, Homo Sapiens
QESSFLPAS

SEQ ID NO: 996289 - protein, 9 aa, Homo Sapiens
SRLLRLSIF

SEQ ID NO: 996290 - protein, 9 aa, Homo Sapiens
IERELRAAL

SEQ ID NO: 996291 - protein, 9 aa, Homo Sapiens
VKAEKSPLF

SEQ ID NO: 996292 - protein, 9 aa, Homo Sapiens
EAPLRQSTF

SEQ ID NO: 996293 - protein, 9 aa, Homo Sapiens
EEGLIDGVH

SEQ ID NO: 996294 - protein, 9 aa, Homo Sapiens
MDFRELGRI

SEQ ID NO: 996295 - protein, 9 aa, Homo Sapiens
SSTVPLPHS

SEQ ID NO: 996296 - protein, 9 aa, Homo Sapiens
QSCGKTFLC

SEQ ID NO: 996297 - protein, 9 aa, Homo Sapiens
GPIYLNEIQ

SEQ ID NO: 996298 - protein, 9 aa, Homo Sapiens
LSKSIKIHT

SEQ ID NO: 996299 - protein, 9 aa, Homo Sapiens
GNLEVKVKG

SEQ ID NO: 996300 - protein, 9 aa, Homo Sapiens
RPAQAIGIQ

SEQ ID NO: 996301 - protein, 9 aa, Homo Sapiens
NLQILACGG

SEQ ID NO: 996302 - protein, 9 aa, Homo Sapiens
GPGVVGVPR

SEQ ID NO: 996303 - protein, 9 aa, Homo Sapiens
QPGFFEYEY

SEQ ID NO: 996304 - protein, 9 aa, Homo Sapiens
KVLDSTTSS

SEQ ID NO: 996305 - protein, 9 aa, Homo Sapiens
LDQCIQTEV

SEQ ID NO: 996306 - protein, 9 aa, Homo Sapiens
SLRWPVVVA

SEQ ID NO: 996307 - protein, 9 aa, Homo Sapiens
LKFLLSTKR

SEQ ID NO: 996308 - protein, 9 aa, Homo Sapiens
PKSKEPVTL

SEQ ID NO: 996309 - protein, 9 aa, Homo Sapiens
IGACFLCHG

SEQ ID NO: 996310 - protein, 9 aa, Homo Sapiens
MPYKHSQAT

SEQ ID NO: 996311 - protein, 9 aa, Homo Sapiens
EEQSLQRST

SEQ ID NO: 996312 - protein, 9 aa, Homo Sapiens
TFSYSSSLS

SEQ ID NO: 996313 - protein, 9 aa, Homo Sapiens
DLHFPANKK

SEQ ID NO: 996314 - protein, 9 aa, Homo Sapiens
IVGSEINST

SEQ ID NO: 996315 - protein, 9 aa, Homo Sapiens
SQRNWAKVF

SEQ ID NO: 996316 - protein, 9 aa, Homo Sapiens
KVFGEGNMF

SEQ ID NO: 996317 - protein, 9 aa, Homo Sapiens
VSRGPLQGS

SEQ ID NO: 996318 - protein, 9 aa, Homo Sapiens
CCMETTPSL

SEQ ID NO: 996319 - protein, 9 aa, Homo Sapiens
FFWQNSLLV

SEQ ID NO: 996320 - protein, 9 aa, Homo Sapiens
PSVCSGEGP

SEQ ID NO: 996321 - protein, 9 aa, Homo Sapiens
YQVCWKIIE

SEQ ID NO: 996322 - protein, 9 aa, Homo Sapiens
RPTVPGSPK

SEQ ID NO: 996323 - protein, 9 aa, Homo Sapiens
LDSYVFLKA

SEQ ID NO: 996324 - protein, 9 aa, Homo Sapiens
KTNEPKGKT

SEQ ID NO: 996325 - protein, 9 aa, Homo Sapiens
IIMAYTTKF

SEQ ID NO: 996326 - protein, 9 aa, Homo Sapiens
LTTKADSGY

SEQ ID NO: 996327 - protein, 9 aa, Homo Sapiens
IYLNEIQCT

SEQ ID NO: 996328 - protein, 9 aa, Homo Sapiens
KAEKSPLFH

SEQ ID NO: 996329 - protein, 9 aa, Homo Sapiens
NLKIGVNNE

SEQ ID NO: 996330 - protein, 9 aa, Homo Sapiens
LCPYCRRSE

SEQ ID NO: 996331 - protein, 9 aa, Homo Sapiens
PPQGGNQPK

SEQ ID NO: 996332 - protein, 9 aa, Homo Sapiens
PVGFVAAER

SEQ ID NO: 996333 - protein, 9 aa, Homo Sapiens
METSEAEIH

SEQ ID NO: 996334 - protein, 9 aa, Homo Sapiens
NALEILQKG

SEQ ID NO: 996335 - protein, 9 aa, Homo Sapiens
GVKLYKCQC

SEQ ID NO: 996336 - protein, 9 aa, Homo Sapiens
QCASQKNKK

SEQ ID NO: 996337 - protein, 9 aa, Homo Sapiens
TFAAGFNSI

SEQ ID NO: 996338 - protein, 9 aa, Homo Sapiens
LCGIGETPI

SEQ ID NO: 996339 - protein, 9 aa, Homo Sapiens
PAKRAIHYF

SEQ ID NO: 996340 - protein, 9 aa, Homo Sapiens
IYGLVGWFP

SEQ ID NO: 996341 - protein, 9 aa, Homo Sapiens
PSCGLSPSE

SEQ ID NO: 996342 - protein, 9 aa, Homo Sapiens
PAFFWQNSL

SEQ ID NO: 996343 - protein, 9 aa, Homo Sapiens
PFQANGPQD

SEQ ID NO: 996344 - protein, 9 aa, Homo Sapiens
KGAPEEKGP

SEQ ID NO: 996345 - protein, 9 aa, Homo Sapiens
SDSDKKANS

SEQ ID NO: 996346 - protein, 9 aa, Homo Sapiens
KPPFQANGP

SEQ ID NO: 996347 - protein, 9 aa, Homo Sapiens
EKIREQEER

SEQ ID NO: 996348 - protein, 9 aa, Homo Sapiens
PEDSSLRIT

SEQ ID NO: 996349 - protein, 9 aa, Homo Sapiens
CLGSQKAFM

SEQ ID NO: 996350 - protein, 9 aa, Homo Sapiens
HKLVVLVKD

SEQ ID NO: 996351 - protein, 9 aa, Homo Sapiens
LADCPKEIY

SEQ ID NO: 996352 - protein, 9 aa, Homo Sapiens
AQAIGIQPR

SEQ ID NO: 996353 - protein, 9 aa, Homo Sapiens
GGKTNEPKG

SEQ ID NO: 996354 - protein, 9 aa, Homo Sapiens
EQKEVMEKA

SEQ ID NO: 996355 - protein, 9 aa, Homo Sapiens
RLLRLSIFL

SEQ ID NO: 996356 - protein, 9 aa, Homo Sapiens
QPCPRGPGT

SEQ ID NO: 996357 - protein, 9 aa, Homo Sapiens
PPRFAQPGF

SEQ ID NO: 996358 - protein, 9 aa, Homo Sapiens
ICLRFQRIR

SEQ ID NO: 996359 - protein, 9 aa, Homo Sapiens
LISSPPPPP

SEQ ID NO: 996360 - protein, 9 aa, Homo Sapiens
KKPNGIIIA

SEQ ID NO: 996361 - protein, 9 aa, Homo Sapiens
HRFRGSGKE

SEQ ID NO: 996362 - protein, 9 aa, Homo Sapiens
YSSPSLETL

SEQ ID NO: 996363 - protein, 9 aa, Homo Sapiens
FLHPEPVVV

SEQ ID NO: 996364 - protein, 9 aa, Homo Sapiens
SRHKIQGKK

SEQ ID NO: 996365 - protein, 9 aa, Homo Sapiens
DGHHRPVSH

SEQ ID NO: 996366 - protein, 9 aa, Homo Sapiens
ELEEALRHT

SEQ ID NO: 996367 - protein, 9 aa, Homo Sapiens
GTCVLCQRQ

SEQ ID NO: 996368 - protein, 9 aa, Homo Sapiens
RLEREFRNR

SEQ ID NO: 996369 - protein, 9 aa, Homo Sapiens
SCSPDTGSC

SEQ ID NO: 996370 - protein, 9 aa, Homo Sapiens
ASFYCECLH

SEQ ID NO: 996371 - protein, 9 aa, Homo Sapiens
GNMLCGIGE

SEQ ID NO: 996372 - protein, 9 aa, Homo Sapiens
AKVFGEGNM

SEQ ID NO: 996373 - protein, 9 aa, Homo Sapiens
VRPWNTRQK

SEQ ID NO: 996374 - protein, 9 aa, Homo Sapiens
RQRYRKRSS

SEQ ID NO: 996375 - protein, 9 aa, Homo Sapiens
GPQDLRMFY

SEQ ID NO: 996376 - protein, 9 aa, Homo Sapiens
AKKLDQQFR

SEQ ID NO: 996377 - protein, 9 aa, Homo Sapiens
DQMDFRELG

SEQ ID NO: 996378 - protein, 9 aa, Homo Sapiens
KEPVTLDFL

SEQ ID NO: 996379 - protein, 9 aa, Homo Sapiens
NQKKGHFPR

SEQ ID NO: 996380 - protein, 9 aa, Homo Sapiens
YVFLKAILN

SEQ ID NO: 996381 - protein, 9 aa, Homo Sapiens
SLEPEDSSL

SEQ ID NO: 996382 - protein, 9 aa, Homo Sapiens
GDFGLATEK

SEQ ID NO: 996383 - protein, 9 aa, Homo Sapiens
RYEMLDLLG

SEQ ID NO: 996384 - protein, 9 aa, Homo Sapiens
RISQAEIRV

SEQ ID NO: 996385 - protein, 9 aa, Homo Sapiens
ALLEAPLRQ

SEQ ID NO: 996386 - protein, 9 aa, Homo Sapiens
YCECLHGRT

SEQ ID NO: 996387 - protein, 9 aa, Homo Sapiens
QPGRDEEQG

SEQ ID NO: 996388 - protein, 9 aa, Homo Sapiens
HYSEEEEEW

SEQ ID NO: 996389 - protein, 9 aa, Homo Sapiens
ELRAALPAP

SEQ ID NO: 996390 - protein, 9 aa, Homo Sapiens
LVIVLVGLV

SEQ ID NO: 996391 - protein, 9 aa, Homo Sapiens
DAYDLEKLS

SEQ ID NO: 996392 - protein, 9 aa, Homo Sapiens
AGDSGLLAY

SEQ ID NO: 996393 - protein, 9 aa, Homo Sapiens
ALAAASPPP

SEQ ID NO: 996394 - protein, 9 aa, Homo Sapiens
MLDAHPEMR

SEQ ID NO: 996395 - protein, 9 aa, Homo Sapiens
SPLFHILKT

SEQ ID NO: 996396 - protein, 9 aa, Homo Sapiens
PTMPYKHSQ

SEQ ID NO: 996397 - protein, 9 aa, Homo Sapiens
IAVEINVIR

SEQ ID NO: 996398 - protein, 8 aa, Homo Sapiens
GRKKKKQL

SEQ ID NO: 996399 - protein, 9 aa, Homo Sapiens
TLGLSSTEN

SEQ ID NO: 996400 - protein, 9 aa, Homo Sapiens
ECGKTFSYS

SEQ ID NO: 996401 - protein, 9 aa, Homo Sapiens
WSRCSKKDL

SEQ ID NO: 996402 - protein, 9 aa, Homo Sapiens
ECAGIQEVV

SEQ ID NO: 996403 - protein, 9 aa, Homo Sapiens
VAPAKFLEN

SEQ ID NO: 996404 - protein, 9 aa, Homo Sapiens
NLCAAGLCV

SEQ ID NO: 996405 - protein, 9 aa, Homo Sapiens
WEGGGRMGT

SEQ ID NO: 996406 - protein, 9 aa, Homo Sapiens
SYLAILASS

SEQ ID NO: 996407 - protein, 9 aa, Homo Sapiens
YLTGSWWPV

SEQ ID NO: 996408 - protein, 9 aa, Homo Sapiens
ASKLLPPLS

SEQ ID NO: 996409 - protein, 9 aa, Homo Sapiens
SLLQVQLYE

SEQ ID NO: 996410 - protein, 9 aa, Homo Sapiens
MKLKTVKPI

SEQ ID NO: 996411 - protein, 9 aa, Homo Sapiens
REIRIYTNA

SEQ ID NO: 996412 - protein, 9 aa, Homo Sapiens
ESAGLISSP

SEQ ID NO: 996413 - protein, 9 aa, Homo Sapiens
ISNDNYDLK

SEQ ID NO: 996414 - protein, 9 aa, Homo Sapiens
ITALNYDID

SEQ ID NO: 996415 - protein, 9 aa, Homo Sapiens
DQEAFHCVR

SEQ ID NO: 996416 - protein, 9 aa, Homo Sapiens
RVACGLSHS

SEQ ID NO: 996417 - protein, 9 aa, Homo Sapiens
TQKSGCNKN

SEQ ID NO: 996418 - protein, 9 aa, Homo Sapiens
FCHISSHKH

SEQ ID NO: 996419 - protein, 9 aa, Homo Sapiens
LKTKVFQAH

SEQ ID NO: 996420 - protein, 9 aa, Homo Sapiens
RGLDDLSYT

SEQ ID NO: 996421 - protein, 9 aa, Homo Sapiens
MKNPWVKVD

SEQ ID NO: 996422 - protein, 9 aa, Homo Sapiens
PPAASGPSS

SEQ ID NO: 996423 - protein, 9 aa, Homo Sapiens
LTEMPHYSE

SEQ ID NO: 996424 - protein, 9 aa, Homo Sapiens
AIGIQPRAT

SEQ ID NO: 996425 - protein, 9 aa, Homo Sapiens
DEEDHDPVP

SEQ ID NO: 996426 - protein, 9 aa, Homo Sapiens
CTAVLESLF

SEQ ID NO: 996427 - protein, 9 aa, Homo Sapiens
RCKHNESCS

SEQ ID NO: 996428 - protein, 9 aa, Homo Sapiens
DQSFLLPVI

SEQ ID NO: 996429 - protein, 9 aa, Homo Sapiens
TEDILADCP

SEQ ID NO: 996430 - protein, 9 aa, Homo Sapiens
QGLESKVSR

SEQ ID NO: 996431 - protein, 9 aa, Homo Sapiens
LSKHVEVLR

SEQ ID NO: 996432 - protein, 9 aa, Homo Sapiens
HKKIYTVEK

SEQ ID NO: 996433 - protein, 9 aa, Homo Sapiens
LLFSIVKEE

SEQ ID NO: 996434 - protein, 9 aa, Homo Sapiens
YTPLRRQKY

SEQ ID NO: 996435 - protein, 9 aa, Homo Sapiens
RRNTSVETP

SEQ ID NO: 996436 - protein, 9 aa, Homo Sapiens
TLDQCIQTE

SEQ ID NO: 996437 - protein, 9 aa, Homo Sapiens
SLFFSAVLL

SEQ ID NO: 996438 - protein, 9 aa, Homo Sapiens
QLKWKHPEA

SEQ ID NO: 996439 - protein, 9 aa, Homo Sapiens
SYQLLKTTE

SEQ ID NO: 996440 - protein, 9 aa, Homo Sapiens
TRHSFSSPE

SEQ ID NO: 996441 - protein, 9 aa, Homo Sapiens
KGLSSNERL

SEQ ID NO: 996442 - protein, 9 aa, Homo Sapiens
KLVVLVKDN

SEQ ID NO: 996443 - protein, 9 aa, Homo Sapiens
RPCQESSFL

SEQ ID NO: 996444 - protein, 9 aa, Homo Sapiens
GAPEEKGPQ

SEQ ID NO: 996445 - protein, 9 aa, Homo Sapiens
KESAGLISS

SEQ ID NO: 996446 - protein, 9 aa, Homo Sapiens
FFSPQNNTL

SEQ ID NO: 996447 - protein, 9 aa, Homo Sapiens
NEVNISPSH

SEQ ID NO: 996448 - protein, 9 aa, Homo Sapiens
GPDPAWEGG

SEQ ID NO: 996449 - protein, 9 aa, Homo Sapiens
VPRPCQESS

SEQ ID NO: 996450 - protein, 9 aa, Homo Sapiens
EGKLRVHTQ

SEQ ID NO: 996451 - protein, 9 aa, Homo Sapiens
QDYYCTLSL

SEQ ID NO: 996452 - protein, 9 aa, Homo Sapiens
SCVILTPLD

SEQ ID NO: 996453 - protein, 9 aa, Homo Sapiens
YFFVASVVA

SEQ ID NO: 996454 - protein, 9 aa, Homo Sapiens
SRSTRGGHI

SEQ ID NO: 996455 - protein, 9 aa, Homo Sapiens
YDLKHVIFS

SEQ ID NO: 996456 - protein, 9 aa, Homo Sapiens
NILHVPADF

SEQ ID NO: 996457 - protein, 9 aa, Homo Sapiens
GGVLPNIQV

SEQ ID NO: 996458 - protein, 9 aa, Homo Sapiens
NDNYDLKPA

SEQ ID NO: 996459 - protein, 9 aa, Homo Sapiens
PVKLSGEAA

SEQ ID NO: 996460 - protein, 9 aa, Homo Sapiens
FGLATEKSR

SEQ ID NO: 996461 - protein, 9 aa, Homo Sapiens
TDTNAPTDI

SEQ ID NO: 996462 - protein, 9 aa, Homo Sapiens
PENGPGLSP

SEQ ID NO: 996463 - protein, 9 aa, Homo Sapiens
HLEASFTQE

SEQ ID NO: 996464 - protein, 9 aa, Homo Sapiens
VAVKVFFFA

SEQ ID NO: 996465 - protein, 9 aa, Homo Sapiens
GSPKPRITA

SEQ ID NO: 996466 - protein, 9 aa, Homo Sapiens
HTQAVTEDD

SEQ ID NO: 996467 - protein, 9 aa, Homo Sapiens
IYLIPRYVR

SEQ ID NO: 996468 - protein, 9 aa, Homo Sapiens
LGMNDEEDH

SEQ ID NO: 996469 - protein, 9 aa, Homo Sapiens
VQTLYKVQN

SEQ ID NO: 996470 - protein, 9 aa, Homo Sapiens
FGKRIKNTI

SEQ ID NO: 996471 - protein, 9 aa, Homo Sapiens
LIPRYVRDL

SEQ ID NO: 996472 - protein, 9 aa, Homo Sapiens
AAGSASADT

SEQ ID NO: 996473 - protein, 9 aa, Homo Sapiens
GVPRAGVPG

SEQ ID NO: 996474 - protein, 9 aa, Homo Sapiens
GIKAQSGNL

SEQ ID NO: 996475 - protein, 9 aa, Homo Sapiens
LSPQERLLV

SEQ ID NO: 996476 - protein, 9 aa, Homo Sapiens
QTLYKVQNE

SEQ ID NO: 996477 - protein, 9 aa, Homo Sapiens
SLEEEQKKS

SEQ ID NO: 996478 - protein, 9 aa, Homo Sapiens
ISPRSATIQ

SEQ ID NO: 996479 - protein, 9 aa, Homo Sapiens
HKSHRGSLL

SEQ ID NO: 996480 - protein, 9 aa, Homo Sapiens
YVTFVKSST

SEQ ID NO: 996481 - protein, 9 aa, Homo Sapiens
LSLLQVQLY

SEQ ID NO: 996482 - protein, 9 aa, Homo Sapiens
LDVTLCNCI

SEQ ID NO: 996483 - protein, 9 aa, Homo Sapiens
QGLLLRRHH

SEQ ID NO: 996484 - protein, 9 aa, Homo Sapiens
KKDVTVSPS

SEQ ID NO: 996485 - protein, 9 aa, Homo Sapiens
EGLGYGCGG

SEQ ID NO: 996486 - protein, 9 aa, Homo Sapiens
CQNRTLVGM

SEQ ID NO: 996487 - protein, 9 aa, Homo Sapiens
FFWNSLLAV

SEQ ID NO: 996488 - protein, 9 aa, Homo Sapiens
NTSVETPFW

SEQ ID NO: 996489 - protein, 9 aa, Homo Sapiens
GDAWKKLTI

SEQ ID NO: 996490 - protein, 9 aa, Homo Sapiens
AWKKLTIVA

SEQ ID NO: 996491 - protein, 9 aa, Homo Sapiens
DLCKGKDQM

SEQ ID NO: 996492 - protein, 9 aa, Homo Sapiens
STRGGHINS

SEQ ID NO: 996493 - protein, 9 aa, Homo Sapiens
VLPNIQVVL

SEQ ID NO: 996494 - protein, 9 aa, Homo Sapiens
RDRGPAGPP

SEQ ID NO: 996495 - protein, 9 aa, Homo Sapiens
GILSNLTGN

SEQ ID NO: 996496 - protein, 9 aa, Homo Sapiens
FHCVRPQHM

SEQ ID NO: 996497 - protein, 9 aa, Homo Sapiens
GTKRISQAE

SEQ ID NO: 996498 - protein, 9 aa, Homo Sapiens
MFPHCKNVN

SEQ ID NO: 996499 - protein, 9 aa, Homo Sapiens
EKGAPEEKG

SEQ ID NO: 996500 - protein, 9 aa, Homo Sapiens
AVTLFRELQ

SEQ ID NO: 996501 - protein, 9 aa, Homo Sapiens
YSEEEEEWM

SEQ ID NO: 996502 - protein, 9 aa, Homo Sapiens
VALFDYDLL

SEQ ID NO: 996503 - protein, 9 aa, Homo Sapiens
SRFCQIEVL

SEQ ID NO: 996504 - protein, 9 aa, Homo Sapiens
GKFKTIVLL

SEQ ID NO: 996505 - protein, 9 aa, Homo Sapiens
QFKISLSEG

SEQ ID NO: 996506 - protein, 9 aa, Homo Sapiens
STYFFSPQN

SEQ ID NO: 996507 - protein, 9 aa, Homo Sapiens
QICLLVTEQ

SEQ ID NO: 996508 - protein, 9 aa, Homo Sapiens
AGRDLNHNY

SEQ ID NO: 996509 - protein, 9 aa, Homo Sapiens
EVKLVDFRV

SEQ ID NO: 996510 - protein, 9 aa, Homo Sapiens
GKNGAPKEA

SEQ ID NO: 996511 - protein, 9 aa, Homo Sapiens
YDCNECGKT

SEQ ID NO: 996512 - protein, 9 aa, Homo Sapiens
VKFFKLPYL

SEQ ID NO: 996513 - protein, 9 aa, Homo Sapiens
LPENRIYLA

SEQ ID NO: 996514 - protein, 9 aa, Homo Sapiens
LGEGSPKPR

SEQ ID NO: 996515 - protein, 9 aa, Homo Sapiens
VDKHEDDQP

SEQ ID NO: 996516 - protein, 9 aa, Homo Sapiens
NPGSVIIKG

SEQ ID NO: 996517 - protein, 9 aa, Homo Sapiens
LVLPENRIY

SEQ ID NO: 996518 - protein, 9 aa, Homo Sapiens
LQPKNPKSK

SEQ ID NO: 996519 - protein, 9 aa, Homo Sapiens
TYAPTMPYK

SEQ ID NO: 996520 - protein, 9 aa, Homo Sapiens
KELPFPRKG

SEQ ID NO: 996521 - protein, 9 aa, Homo Sapiens
AQPVCFSSF

SEQ ID NO: 996522 - protein, 9 aa, Homo Sapiens
LQPEKLVVL

SEQ ID NO: 996523 - protein, 9 aa, Homo Sapiens
SSTPFWLLS

SEQ ID NO: 996524 - protein, 9 aa, Homo Sapiens
KEVMEKARE

SEQ ID NO: 996525 - protein, 9 aa, Homo Sapiens
EKSRWSGSH

SEQ ID NO: 996526 - protein, 9 aa, Homo Sapiens
SLQRSTSGY

SEQ ID NO: 996527 - protein, 9 aa, Homo Sapiens
PYRSMKLKT

SEQ ID NO: 996528 - protein, 9 aa, Homo Sapiens
GNNYKNKMM

SEQ ID NO: 996529 - protein, 9 aa, Homo Sapiens
QLLKTTEPG

SEQ ID NO: 996530 - protein, 9 aa, Homo Sapiens
LCEVLAMIK

SEQ ID NO: 996531 - protein, 9 aa, Homo Sapiens
KAPTIDISP

SEQ ID NO: 996532 - protein, 9 aa, Homo Sapiens
KILPYRSMK

SEQ ID NO: 996533 - protein, 9 aa, Homo Sapiens
WHLGPGDSF

SEQ ID NO: 996534 - protein, 9 aa, Homo Sapiens
CWFVHNNEE

SEQ ID NO: 996535 - protein, 9 aa, Homo Sapiens
LLPPLSAPV

SEQ ID NO: 996536 - protein, 9 aa, Homo Sapiens
LKDKSFESL

SEQ ID NO: 996537 - protein, 9 aa, Homo Sapiens
VSDPAKRAI

SEQ ID NO: 996538 - protein, 9 aa, Homo Sapiens
KPRITASSN

SEQ ID NO: 996539 - protein, 9 aa, Homo Sapiens
HILWNESHC

SEQ ID NO: 996540 - protein, 9 aa, Homo Sapiens
AQPGFFEYE

SEQ ID NO: 996541 - protein, 9 aa, Homo Sapiens
YGVVKFFKL

SEQ ID NO: 996542 - protein, 9 aa, Homo Sapiens
PDNANSPKV

SEQ ID NO: 996543 - protein, 9 aa, Homo Sapiens
GNPGLSGPK

SEQ ID NO: 996544 - protein, 9 aa, Homo Sapiens
EDILADCPK

SEQ ID NO: 996545 - protein, 9 aa, Homo Sapiens
APRAPVLLQ

SEQ ID NO: 996546 - protein, 9 aa, Homo Sapiens
GPPGFPGPP

SEQ ID NO: 996547 - protein, 9 aa, Homo Sapiens
IRPIWQQVA

SEQ ID NO: 996548 - protein, 9 aa, Homo Sapiens
RILVDLSSR

SEQ ID NO: 996549 - protein, 9 aa, Homo Sapiens
NKPSRLLFL

SEQ ID NO: 996550 - protein, 9 aa, Homo Sapiens
KISLSEGDD

SEQ ID NO: 996551 - protein, 9 aa, Homo Sapiens
RPRAGDSGL

SEQ ID NO: 996552 - protein, 9 aa, Homo Sapiens
LMIMNKGLS

SEQ ID NO: 996553 - protein, 9 aa, Homo Sapiens
FWNSLLAVV

SEQ ID NO: 996554 - protein, 9 aa, Homo Sapiens
LFKSKSNDR

SEQ ID NO: 996555 - protein, 9 aa, Homo Sapiens
AECFSSPKT

SEQ ID NO: 996556 - protein, 9 aa, Homo Sapiens
FISNKGRLN

SEQ ID NO: 996557 - protein, 9 aa, Homo Sapiens
FSSSSSPSS

SEQ ID NO: 996558 - protein, 9 aa, Homo Sapiens
LVAKLHSLQ

SEQ ID NO: 996559 - protein, 9 aa, Homo Sapiens
PEPVVVSKM

SEQ ID NO: 996560 - protein, 9 aa, Homo Sapiens
SSNLFKSKS

SEQ ID NO: 996561 - protein, 9 aa, Homo Sapiens
LISSPELQE

SEQ ID NO: 996562 - protein, 9 aa, Homo Sapiens
QICELEEAL

SEQ ID NO: 996563 - protein, 9 aa, Homo Sapiens
PKNPKSKEP

SEQ ID NO: 996564 - protein, 9 aa, Homo Sapiens
GKSKEEKIE

SEQ ID NO: 996565 - protein, 9 aa, Homo Sapiens
GILSSPQKV

SEQ ID NO: 996566 - protein, 9 aa, Homo Sapiens
SYSSSLSQH

SEQ ID NO: 996567 - protein, 9 aa, Homo Sapiens
YYVPRPCQE

SEQ ID NO: 996568 - protein, 9 aa, Homo Sapiens
RIKKVKGAL

SEQ ID NO: 996569 - protein, 9 aa, Homo Sapiens
KQPGPVKLS

SEQ ID NO: 996570 - protein, 9 aa, Homo Sapiens
EKISLNLSV

SEQ ID NO: 996571 - protein, 9 aa, Homo Sapiens
CLHGRTGLL

SEQ ID NO: 996572 - protein, 9 aa, Homo Sapiens
LNRGQEEKI

SEQ ID NO: 996573 - protein, 9 aa, Homo Sapiens
EENNKGLIK

SEQ ID NO: 996574 - protein, 9 aa, Homo Sapiens
ICPSTTLAA

SEQ ID NO: 996575 - protein, 9 aa, Homo Sapiens
FYYDLKHVI

SEQ ID NO: 996576 - protein, 9 aa, Homo Sapiens
LKFLLEHSL

SEQ ID NO: 996577 - protein, 9 aa, Homo Sapiens
TLTKHKRTH

SEQ ID NO: 996578 - protein, 9 aa, Homo Sapiens
FQQPLITYE

SEQ ID NO: 996579 - protein, 9 aa, Homo Sapiens
NNKGLIKEC

SEQ ID NO: 996580 - protein, 9 aa, Homo Sapiens
GGNQPKGPP

SEQ ID NO: 996581 - protein, 9 aa, Homo Sapiens
PRGPGTCVL

SEQ ID NO: 996582 - protein, 9 aa, Homo Sapiens
DFRVSAQLD

SEQ ID NO: 996583 - protein, 9 aa, Homo Sapiens
LVQTLYKVQ

SEQ ID NO: 996584 - protein, 9 aa, Homo Sapiens
SAVTLFREL

SEQ ID NO: 996585 - protein, 9 aa, Homo Sapiens
EQAWREAQR

SEQ ID NO: 996586 - protein, 9 aa, Homo Sapiens
ESLEPEDSS

SEQ ID NO: 996587 - protein, 9 aa, Homo Sapiens
PPAKDGWSN

SEQ ID NO: 996588 - protein, 9 aa, Homo Sapiens
CSLAVRQPT

SEQ ID NO: 996589 - protein, 9 aa, Homo Sapiens
DSGLLAYAA

SEQ ID NO: 996590 - protein, 9 aa, Homo Sapiens
PGSVIIKGL

SEQ ID NO: 996591 - protein, 9 aa, Homo Sapiens
RPCSLAVRQ

SEQ ID NO: 996592 - protein, 9 aa, Homo Sapiens
YNQLTDAQG

SEQ ID NO: 996593 - protein, 9 aa, Homo Sapiens
CPRGPGTCV

SEQ ID NO: 996594 - protein, 9 aa, Homo Sapiens
IALDNIDSV

SEQ ID NO: 996595 - protein, 9 aa, Homo Sapiens
LCSHSLTEH

SEQ ID NO: 996596 - protein, 9 aa, Homo Sapiens
KNISNSEAY

SEQ ID NO: 996597 - protein, 9 aa, Homo Sapiens
FKVIPQSIR

SEQ ID NO: 996598 - protein, 9 aa, Homo Sapiens
KIYTVEKPY

SEQ ID NO: 996599 - protein, 9 aa, Homo Sapiens
LLTTEDILA

SEQ ID NO: 996600 - protein, 9 aa, Homo Sapiens
TGSVPSLAV

SEQ ID NO: 996601 - protein, 9 aa, Homo Sapiens
PTKKFTKKP

SEQ ID NO: 996602 - protein, 9 aa, Homo Sapiens
EWKSYRDTE

SEQ ID NO: 996603 - protein, 9 aa, Homo Sapiens
LNLSVRFKA

SEQ ID NO: 996604 - protein, 9 aa, Homo Sapiens
RYDDLVQTL

SEQ ID NO: 996605 - protein, 9 aa, Homo Sapiens
EIYGLVGWF

SEQ ID NO: 996606 - protein, 9 aa, Homo Sapiens
FCSAPTETH

SEQ ID NO: 996607 - protein, 9 aa, Homo Sapiens
PQTAIDVNG

SEQ ID NO: 996608 - protein, 9 aa, Homo Sapiens
PKPRITASS

SEQ ID NO: 996609 - protein, 9 aa, Homo Sapiens
KYIRPIWQQ

SEQ ID NO: 996610 - protein, 9 aa, Homo Sapiens
DEAVLPRAV

SEQ ID NO: 996611 - protein, 9 aa, Homo Sapiens
PERIKAMVE

SEQ ID NO: 996612 - protein, 9 aa, Homo Sapiens
ESSYSNCVS

SEQ ID NO: 996613 - protein, 9 aa, Homo Sapiens
ETARGIKFE

SEQ ID NO: 996614 - protein, 9 aa, Homo Sapiens
PSLETLSAS

SEQ ID NO: 996615 - protein, 9 aa, Homo Sapiens
MEASFPAPG

SEQ ID NO: 996616 - protein, 9 aa, Homo Sapiens
VPGVMDGVL

SEQ ID NO: 996617 - protein, 9 aa, Homo Sapiens
DHKSHRGSL

SEQ ID NO: 996618 - protein, 9 aa, Homo Sapiens
DRGLDDLSY

SEQ ID NO: 996619 - protein, 9 aa, Homo Sapiens
MLVNFQFQN

SEQ ID NO: 996620 - protein, 9 aa, Homo Sapiens
KHVEVLRAQ

SEQ ID NO: 996621 - protein, 9 aa, Homo Sapiens
LKHVIFSRL

SEQ ID NO: 996622 - protein, 9 aa, Homo Sapiens
RFLFPERIK

SEQ ID NO: 996623 - protein, 9 aa, Homo Sapiens
LAAASPPPP

SEQ ID NO: 996624 - protein, 9 aa, Homo Sapiens
MSNPVSMPE

SEQ ID NO: 996625 - protein, 9 aa, Homo Sapiens
GLSSTENEG

SEQ ID NO: 996626 - protein, 9 aa, Homo Sapiens
SFYCECLHG

SEQ ID NO: 996627 - protein, 9 aa, Homo Sapiens
CPGLWSYSS

SEQ ID NO: 996628 - protein, 9 aa, Homo Sapiens
AFVSRLSLF

SEQ ID NO: 996629 - protein, 9 aa, Homo Sapiens
TLRCLCVLL

SEQ ID NO: 996630 - protein, 9 aa, Homo Sapiens
QPPYLWKST

SEQ ID NO: 996631 - protein, 9 aa, Homo Sapiens
YCRRSEKPP

SEQ ID NO: 996632 - protein, 9 aa, Homo Sapiens
WFHSMDIFF

SEQ ID NO: 996633 - protein, 9 aa, Homo Sapiens
DAHPEMRCG

SEQ ID NO: 996634 - protein, 9 aa, Homo Sapiens
RRFFWNSLL

SEQ ID NO: 996635 - protein, 9 aa, Homo Sapiens
VMEASFPAP

SEQ ID NO: 996636 - protein, 9 aa, Homo Sapiens
LEHILLCPD

SEQ ID NO: 996637 - protein, 9 aa, Homo Sapiens
EEQGLELRV

SEQ ID NO: 996638 - protein, 9 aa, Homo Sapiens
TKVFQAHTP

SEQ ID NO: 996639 - protein, 9 aa, Homo Sapiens
PSSRSSASA

SEQ ID NO: 996640 - protein, 9 aa, Homo Sapiens
RGADLTTKA

SEQ ID NO: 996641 - protein, 9 aa, Homo Sapiens
NEKKAECFS

SEQ ID NO: 996642 - protein, 9 aa, Homo Sapiens
VSIDLSCKH

SEQ ID NO: 996643 - protein, 9 aa, Homo Sapiens
QELEQAWRE

SEQ ID NO: 996644 - protein, 9 aa, Homo Sapiens
APIFNEDGL

SEQ ID NO: 996645 - protein, 9 aa, Homo Sapiens
LLEAPLRQS

SEQ ID NO: 996646 - protein, 9 aa, Homo Sapiens
VLTEMPHYS

SEQ ID NO: 996647 - protein, 9 aa, Homo Sapiens
TKKFTKKPI

SEQ ID NO: 996648 - protein, 9 aa, Homo Sapiens
GAPRKVKQY

SEQ ID NO: 996649 - protein, 9 aa, Homo Sapiens
GSVIIKGLP

SEQ ID NO: 996650 - protein, 9 aa, Homo Sapiens
SATVPDQEK

SEQ ID NO: 996651 - protein, 9 aa, Homo Sapiens
QEKLGEVWQ

SEQ ID NO: 996652 - protein, 9 aa, Homo Sapiens
DDLSYTPLR

SEQ ID NO: 996653 - protein, 9 aa, Homo Sapiens
KVFQAHTPA

SEQ ID NO: 996654 - protein, 9 aa, Homo Sapiens
VDPRAEKNQ

SEQ ID NO: 996655 - protein, 9 aa, Homo Sapiens
IERRGTKRI

SEQ ID NO: 996656 - protein, 9 aa, Homo Sapiens
LKVDPRAEK

SEQ ID NO: 996657 - protein, 9 aa, Homo Sapiens
DQSSDTSSP

SEQ ID NO: 996658 - protein, 9 aa, Homo Sapiens
TCVLCQRQG

SEQ ID NO: 996659 - protein, 9 aa, Homo Sapiens
TNEPKGKTE

SEQ ID NO: 996660 - protein, 9 aa, Homo Sapiens
RELGRIFKG

SEQ ID NO: 996661 - protein, 9 aa, Homo Sapiens
QGPQSEWKS

SEQ ID NO: 996662 - protein, 9 aa, Homo Sapiens
VLRAQLEEA

SEQ ID NO: 996663 - protein, 9 aa, Homo Sapiens
MDGVLSANN

SEQ ID NO: 996664 - protein, 9 aa, Homo Sapiens
KGPPPPPGK

SEQ ID NO: 996665 - protein, 9 aa, Homo Sapiens
QSFLLPVIT

SEQ ID NO: 996666 - protein, 9 aa, Homo Sapiens
LAILASSWV

SEQ ID NO: 996667 - protein, 9 aa, Homo Sapiens
TNAGRICRP

SEQ ID NO: 996668 - protein, 9 aa, Homo Sapiens
PSHVFSKLW

SEQ ID NO: 996669 - protein, 9 aa, Homo Sapiens
FFVASVVAN

SEQ ID NO: 996670 - protein, 9 aa, Homo Sapiens
EMRCGEETR

SEQ ID NO: 996671 - protein, 9 aa, Homo Sapiens
GICTPNWRA

SEQ ID NO: 996672 - protein, 9 aa, Homo Sapiens
KTFSYSSSL

SEQ ID NO: 996673 - protein, 9 aa, Homo Sapiens
ICELEEALR

SEQ ID NO: 996674 - protein, 9 aa, Homo Sapiens
LRPSLHSEI

SEQ ID NO: 996675 - protein, 9 aa, Homo Sapiens
SSDTSSPLC

SEQ ID NO: 996676 - protein, 9 aa, Homo Sapiens
KNSPLSKVA

SEQ ID NO: 996677 - protein, 9 aa, Homo Sapiens
QETLLFFLF

SEQ ID NO: 996678 - protein, 9 aa, Homo Sapiens
RSSWADPPQ

SEQ ID NO: 996679 - protein, 9 aa, Homo Sapiens
GMNDEEDHD

SEQ ID NO: 996680 - protein, 9 aa, Homo Sapiens
GQIEEQKEV

SEQ ID NO: 996681 - protein, 9 aa, Homo Sapiens
RAGVPGVGV

SEQ ID NO: 996682 - protein, 9 aa, Homo Sapiens
FPASSFWSV

SEQ ID NO: 996683 - protein, 9 aa, Homo Sapiens
FFMNPIYRV

SEQ ID NO: 996684 - protein, 9 aa, Homo Sapiens
FRRYNLLSF

SEQ ID NO: 996685 - protein, 9 aa, Homo Sapiens
LLFLDIAPL

SEQ ID NO: 996686 - protein, 9 aa, Homo Sapiens
EILKLKFLL

SEQ ID NO: 996687 - protein, 9 aa, Homo Sapiens
YVVVVIDGR

SEQ ID NO: 996688 - protein, 9 aa, Homo Sapiens
FSGGTPLLP

SEQ ID NO: 996689 - protein, 9 aa, Homo Sapiens
ELLIALDNI

SEQ ID NO: 996690 - protein, 9 aa, Homo Sapiens
EKLVVLKVE

SEQ ID NO: 996691 - protein, 9 aa, Homo Sapiens
YILHDILHN

SEQ ID NO: 996692 - protein, 9 aa, Homo Sapiens
SATPPRSSG

SEQ ID NO: 996693 - protein, 9 aa, Homo Sapiens
QATQKGALL

SEQ ID NO: 996694 - protein, 9 aa, Homo Sapiens
YVFMGNMLC

SEQ ID NO: 996695 - protein, 9 aa, Homo Sapiens
SNSIQIEGL

SEQ ID NO: 996696 - protein, 9 aa, Homo Sapiens
APRKVKQYL

SEQ ID NO: 996697 - protein, 9 aa, Homo Sapiens
NQNFPDLTS

SEQ ID NO: 996698 - protein, 9 aa, Homo Sapiens
ASAYLNLPS

SEQ ID NO: 996699 - protein, 9 aa, Homo Sapiens
PVLLQRRRG

SEQ ID NO: 996700 - protein, 9 aa, Homo Sapiens
PENRIYLAG

SEQ ID NO: 996701 - protein, 9 aa, Homo Sapiens
SFLEDSLVK

SEQ ID NO: 996702 - protein, 9 aa, Homo Sapiens
YYEGLGYGC

SEQ ID NO: 996703 - protein, 9 aa, Homo Sapiens
MPEVLKFLL

SEQ ID NO: 996704 - protein, 9 aa, Homo Sapiens
AFVDVYEYI

SEQ ID NO: 996705 - protein, 9 aa, Homo Sapiens
NLFKSKSND

SEQ ID NO: 996706 - protein, 9 aa, Homo Sapiens
QSSDTSSPL

SEQ ID NO: 996707 - protein, 9 aa, Homo Sapiens
QKNKKCWNF

SEQ ID NO: 996708 - protein, 9 aa, Homo Sapiens
VLPRAVVSA

SEQ ID NO: 996709 - protein, 9 aa, Homo Sapiens
CLRFQRIRT

SEQ ID NO: 996710 - protein, 9 aa, Homo Sapiens
EASPFFTDK

SEQ ID NO: 996711 - protein, 9 aa, Homo Sapiens
VPDQEKLGE

SEQ ID NO: 996712 - protein, 9 aa, Homo Sapiens
LSPRPKKPP

SEQ ID NO: 996713 - protein, 9 aa, Homo Sapiens
LSLEEEQKK

SEQ ID NO: 996714 - protein, 9 aa, Homo Sapiens
FFKLPYLSK

SEQ ID NO: 996715 - protein, 9 aa, Homo Sapiens
QLVGNGGPP

SEQ ID NO: 996716 - protein, 9 aa, Homo Sapiens
RAKVGVAEE

SEQ ID NO: 996717 - protein, 9 aa, Homo Sapiens
CLLVTEQDV

SEQ ID NO: 996718 - protein, 9 aa, Homo Sapiens
DGVLSANNY

SEQ ID NO: 996719 - protein, 9 aa, Homo Sapiens
IKAQSGNLE

SEQ ID NO: 996720 - protein, 9 aa, Homo Sapiens
ILASSWVDD

SEQ ID NO: 996721 - protein, 9 aa, Homo Sapiens
PADFDQEKK

SEQ ID NO: 996722 - protein, 9 aa, Homo Sapiens
TARGIKFEE

SEQ ID NO: 996723 - protein, 9 aa, Homo Sapiens
RWAPGSVKL

SEQ ID NO: 996724 - protein, 9 aa, Homo Sapiens
DRDQEAFHC

SEQ ID NO: 996725 - protein, 9 aa, Homo Sapiens
EGSPKPRIT

SEQ ID NO: 996726 - protein, 9 aa, Homo Sapiens
VAKLHSLQF

SEQ ID NO: 996727 - protein, 9 aa, Homo Sapiens
PQEEQSLQR

SEQ ID NO: 996728 - protein, 9 aa, Homo Sapiens
LVLSFPFTL

SEQ ID NO: 996729 - protein, 9 aa, Homo Sapiens
AQGLESKVS

SEQ ID NO: 996730 - protein, 9 aa, Homo Sapiens
KKGHFPRVT

SEQ ID NO: 996731 - protein, 9 aa, Homo Sapiens
SLLQESRQR

SEQ ID NO: 996732 - protein, 9 aa, Homo Sapiens
SFSFLEDSL

SEQ ID NO: 996733 - protein, 9 aa, Homo Sapiens
VNNKGLANS

SEQ ID NO: 996734 - protein, 9 aa, Homo Sapiens
PRIQYFFVA

SEQ ID NO: 996735 - protein, 9 aa, Homo Sapiens
KLVVLKVES

SEQ ID NO: 996736 - protein, 9 aa, Homo Sapiens
KDKSFESLL

SEQ ID NO: 996737 - protein, 9 aa, Homo Sapiens
ESSRQFLPS

SEQ ID NO: 996738 - protein, 9 aa, Homo Sapiens
EKNQCELLS

SEQ ID NO: 996739 - protein, 9 aa, Homo Sapiens
ILVDLSSRE

SEQ ID NO: 996740 - protein, 9 aa, Homo Sapiens
FNLMETSEA

SEQ ID NO: 996741 - protein, 9 aa, Homo Sapiens
QMDFRELGR

SEQ ID NO: 996742 - protein, 9 aa, Homo Sapiens
AGYKKDLGA

SEQ ID NO: 996743 - protein, 9 aa, Homo Sapiens
YRKVPNLQI

SEQ ID NO: 996744 - protein, 9 aa, Homo Sapiens
RLSKHVEVL

SEQ ID NO: 996745 - protein, 9 aa, Homo Sapiens
SFPFTLRNL

SEQ ID NO: 996746 - protein, 9 aa, Homo Sapiens
TEFHVAFPD

SEQ ID NO: 996747 - protein, 9 aa, Homo Sapiens
RKVLDSTTS

SEQ ID NO: 996748 - protein, 9 aa, Homo Sapiens
YHKKIYTVE

SEQ ID NO: 996749 - protein, 9 aa, Homo Sapiens
NLTGNNYKN

SEQ ID NO: 996750 - protein, 9 aa, Homo Sapiens
SGSYYEGLG

SEQ ID NO: 996751 - protein, 9 aa, Homo Sapiens
ENGILSSPQ

SEQ ID NO: 996752 - protein, 9 aa, Homo Sapiens
VVKFFKLPY

SEQ ID NO: 996753 - protein, 9 aa, Homo Sapiens
VAKHKLVVL

SEQ ID NO: 996754 - protein, 9 aa, Homo Sapiens
QSQQQCQPS

SEQ ID NO: 996755 - protein, 9 aa, Homo Sapiens
ASSAMKNSP

SEQ ID NO: 996756 - protein, 9 aa, Homo Sapiens
RLLFLDIAP

SEQ ID NO: 996757 - protein, 9 aa, Homo Sapiens
CPRRPRLSF

SEQ ID NO: 996758 - protein, 9 aa, Homo Sapiens
YSNCVSIDL

SEQ ID NO: 996759 - protein, 9 aa, Homo Sapiens
WSYSSRLMR

SEQ ID NO: 996760 - protein, 9 aa, Homo Sapiens
PLSNCPVGK

SEQ ID NO: 996761 - protein, 9 aa, Homo Sapiens
QEVVEAYQS

SEQ ID NO: 996762 - protein, 9 aa, Homo Sapiens
AVVMEQGQR

SEQ ID NO: 996763 - protein, 9 aa, Homo Sapiens
LFPERIKAM

SEQ ID NO: 996764 - protein, 9 aa, Homo Sapiens
RGEIYGLVG

SEQ ID NO: 996765 - protein, 9 aa, Homo Sapiens
RGLEDSLQD

SEQ ID NO: 996766 - protein, 9 aa, Homo Sapiens
AAERVLYVP

SEQ ID NO: 996767 - protein, 9 aa, Homo Sapiens
QPTERGGLL

SEQ ID NO: 996768 - protein, 9 aa, Homo Sapiens
VCWFVHNNE

SEQ ID NO: 996769 - protein, 9 aa, Homo Sapiens
KGLPPGIPF

SEQ ID NO: 996770 - protein, 9 aa, Homo Sapiens
NFQFQNKAI

SEQ ID NO: 996771 - protein, 9 aa, Homo Sapiens
PTAPKVLGA

SEQ ID NO: 996772 - protein, 9 aa, Homo Sapiens
ISARKLKNF

SEQ ID NO: 996773 - protein, 9 aa, Homo Sapiens
IQRPPFRFL

SEQ ID NO: 996774 - protein, 9 aa, Homo Sapiens
RPEVGSCKL

SEQ ID NO: 996775 - protein, 9 aa, Homo Sapiens
FKSMLLVLS

SEQ ID NO: 996776 - protein, 9 aa, Homo Sapiens
SNCPVGKKD

SEQ ID NO: 996777 - protein, 9 aa, Homo Sapiens
VFQAHTPAQ

SEQ ID NO: 996778 - protein, 9 aa, Homo Sapiens
VASVVANGV

SEQ ID NO: 996779 - protein, 9 aa, Homo Sapiens
FQKELRQRS

SEQ ID NO: 996780 - protein, 9 aa, Homo Sapiens
CELEEALRH

SEQ ID NO: 996781 - protein, 9 aa, Homo Sapiens
VPTVCNGRK

SEQ ID NO: 996782 - protein, 9 aa, Homo Sapiens
TMPYKHSQA

SEQ ID NO: 996783 - protein, 9 aa, Homo Sapiens
DLSSREARQ

SEQ ID NO: 996784 - protein, 9 aa, Homo Sapiens
SYILHDILH

SEQ ID NO: 996785 - protein, 9 aa, Homo Sapiens
YRKRSSPET

SEQ ID NO: 996786 - protein, 9 aa, Homo Sapiens
SKTVIPISI

SEQ ID NO: 996787 - protein, 9 aa, Homo Sapiens
RDVAKHKLV

SEQ ID NO: 996788 - protein, 9 aa, Homo Sapiens
PAHRLEREF

SEQ ID NO: 996789 - protein, 9 aa, Homo Sapiens
SFCSAPTET

SEQ ID NO: 996790 - protein, 9 aa, Homo Sapiens
PSDQSSDTS

SEQ ID NO: 996791 - protein, 9 aa, Homo Sapiens
KGALLNKRR

SEQ ID NO: 996792 - protein, 9 aa, Homo Sapiens
EDHDPVPLP

SEQ ID NO: 996793 - protein, 9 aa, Homo Sapiens
LIPVTFMLF

SEQ ID NO: 996794 - protein, 9 aa, Homo Sapiens
FKAPTIDIS

SEQ ID NO: 996795 - protein, 9 aa, Homo Sapiens
NPQFKISLS

SEQ ID NO: 996796 - protein, 9 aa, Homo Sapiens
LPGPKGTEG

SEQ ID NO: 996797 - protein, 9 aa, Homo Sapiens
LLSIVYTIG

SEQ ID NO: 996798 - protein, 9 aa, Homo Sapiens
VFFFANRQN

SEQ ID NO: 996799 - protein, 9 aa, Homo Sapiens
LQPGRDEEQ

SEQ ID NO: 996800 - protein, 9 aa, Homo Sapiens
PVLDDLYAS

SEQ ID NO: 996801 - protein, 9 aa, Homo Sapiens
FTLVGNTLI

SEQ ID NO: 996802 - protein, 9 aa, Homo Sapiens
APTQKSGCN

SEQ ID NO: 996803 - protein, 9 aa, Homo Sapiens
WVGPLLACL

SEQ ID NO: 996804 - protein, 9 aa, Homo Sapiens
ACTRLYNQL

SEQ ID NO: 996805 - protein, 9 aa, Homo Sapiens
GHHRPVSHS

SEQ ID NO: 996806 - protein, 9 aa, Homo Sapiens
KLYKCQCGK

SEQ ID NO: 996807 - protein, 9 aa, Homo Sapiens
CLIGDAWKK

SEQ ID NO: 996808 - protein, 9 aa, Homo Sapiens
GPSSTVPLP

SEQ ID NO: 996809 - protein, 9 aa, Homo Sapiens
KLIYKKGPR

SEQ ID NO: 996810 - protein, 9 aa, Homo Sapiens
SVSASPPWP

SEQ ID NO: 996811 - protein, 9 aa, Homo Sapiens
ILNGLLIAV

SEQ ID NO: 996812 - protein, 9 aa, Homo Sapiens
EAFHCVRPQ

SEQ ID NO: 996813 - protein, 9 aa, Homo Sapiens
VATWLRGLE

SEQ ID NO: 996814 - protein, 9 aa, Homo Sapiens
VGNGGPPEG

SEQ ID NO: 996815 - protein, 9 aa, Homo Sapiens
DTSSPLCDS

SEQ ID NO: 996816 - protein, 9 aa, Homo Sapiens
QKGALLNKR

SEQ ID NO: 996817 - protein, 9 aa, Homo Sapiens
SPTSEIQWW

SEQ ID NO: 996818 - protein, 9 aa, Homo Sapiens
ISLNLSVRF

SEQ ID NO: 996819 - protein, 9 aa, Homo Sapiens
FFSYALILR

SEQ ID NO: 996820 - protein, 9 aa, Homo Sapiens
RPVAVKVFF

SEQ ID NO: 996821 - protein, 9 aa, Homo Sapiens
LTTEDILAD

SEQ ID NO: 996822 - protein, 9 aa, Homo Sapiens
LSYHKKIYT

SEQ ID NO: 996823 - protein, 9 aa, Homo Sapiens
LHSLQFDQR

SEQ ID NO: 996824 - protein, 9 aa, Homo Sapiens
CVSIDLSCK

SEQ ID NO: 996825 - protein, 9 aa, Homo Sapiens
IFFSYALIL

SEQ ID NO: 996826 - protein, 9 aa, Homo Sapiens
DPAFFWQNS

SEQ ID NO: 996827 - protein, 9 aa, Homo Sapiens
ISISDLELA

SEQ ID NO: 996828 - protein, 9 aa, Homo Sapiens
CKNISNSEA

SEQ ID NO: 996829 - protein, 9 aa, Homo Sapiens
KTFLCSHSL

SEQ ID NO: 996830 - protein, 9 aa, Homo Sapiens
MLAPPCASC

SEQ ID NO: 996831 - protein, 9 aa, Homo Sapiens
GDPGWGTRV

SEQ ID NO: 996832 - protein, 9 aa, Homo Sapiens
RIWLCPYCR

SEQ ID NO: 996833 - protein, 9 aa, Homo Sapiens
CKNVNKPVG

SEQ ID NO: 996834 - protein, 9 aa, Homo Sapiens
LRHTEVSGQ

SEQ ID NO: 996835 - protein, 9 aa, Homo Sapiens
FLFPERIKA

SEQ ID NO: 996836 - protein, 9 aa, Homo Sapiens
EEAQGLLLR

SEQ ID NO: 996837 - protein, 9 aa, Homo Sapiens
AVFMAVVME

SEQ ID NO: 996838 - protein, 9 aa, Homo Sapiens
PRAEKNQCE

SEQ ID NO: 996839 - protein, 9 aa, Homo Sapiens
IQEVVEAYQ

SEQ ID NO: 996840 - protein, 9 aa, Homo Sapiens
FSCVILTPL

SEQ ID NO: 996841 - protein, 9 aa, Homo Sapiens
EFTSARYIC

SEQ ID NO: 996842 - protein, 9 aa, Homo Sapiens
LEKLSLVED

SEQ ID NO: 996843 - protein, 9 aa, Homo Sapiens
NKGLSSNER

SEQ ID NO: 996844 - protein, 9 aa, Homo Sapiens
LEDAQESGF

SEQ ID NO: 996845 - protein, 9 aa, Homo Sapiens
VACGLSHSV

SEQ ID NO: 996846 - protein, 9 aa, Homo Sapiens
EDSSLRITT

SEQ ID NO: 996847 - protein, 9 aa, Homo Sapiens
DENEITAIQ

SEQ ID NO: 996848 - protein, 9 aa, Homo Sapiens
DLEKLSLVE

SEQ ID NO: 996849 - protein, 9 aa, Homo Sapiens
AGILSNLTG

SEQ ID NO: 996850 - protein, 9 aa, Homo Sapiens
TFFVFKATF

SEQ ID NO: 996851 - protein, 9 aa, Homo Sapiens
FPERIKAMV

SEQ ID NO: 996852 - protein, 9 aa, Homo Sapiens
HPDEAVLPR

SEQ ID NO: 996853 - protein, 9 aa, Homo Sapiens
LLFEIFNLV

SEQ ID NO: 996854 - protein, 9 aa, Homo Sapiens
SGLLAYAAA

SEQ ID NO: 996855 - protein, 9 aa, Homo Sapiens
LEEALRHTE

SEQ ID NO: 996856 - protein, 9 aa, Homo Sapiens
RVFVESLLR

SEQ ID NO: 996857 - protein, 9 aa, Homo Sapiens
SEIWEIPFE

SEQ ID NO: 996858 - protein, 9 aa, Homo Sapiens
TVLRSSWAD

SEQ ID NO: 996859 - protein, 9 aa, Homo Sapiens
VMEKAREAY

SEQ ID NO: 996860 - protein, 9 aa, Homo Sapiens
KVYVYLMHN

SEQ ID NO: 996861 - protein, 9 aa, Homo Sapiens
EGRKMATDE

SEQ ID NO: 996862 - protein, 9 aa, Homo Sapiens
RSMKLKTVK

SEQ ID NO: 996863 - protein, 9 aa, Homo Sapiens
GFLCEVLAM

SEQ ID NO: 996864 - protein, 9 aa, Homo Sapiens
WAPGSVKLI

SEQ ID NO: 996865 - protein, 9 aa, Homo Sapiens
WMGGVPVSV

SEQ ID NO: 996866 - protein, 9 aa, Homo Sapiens
EREIRIYTN

SEQ ID NO: 996867 - protein, 9 aa, Homo Sapiens
KKPPEEPGQ

SEQ ID NO: 996868 - protein, 9 aa, Homo Sapiens
LSWSGAPRK

SEQ ID NO: 996869 - protein, 9 aa, Homo Sapiens
RRPSVCSGE

SEQ ID NO: 996870 - protein, 9 aa, Homo Sapiens
SVMEASFPA

SEQ ID NO: 996871 - protein, 9 aa, Homo Sapiens
KPAVGKSKE

SEQ ID NO: 996872 - protein, 9 aa, Homo Sapiens
SKEPVTLDF

SEQ ID NO: 996873 - protein, 9 aa, Homo Sapiens
QGIGPIYLN

SEQ ID NO: 996874 - protein, 9 aa, Homo Sapiens
NGDGGLVLQ

SEQ ID NO: 996875 - protein, 9 aa, Homo Sapiens
LQSDENGIL

SEQ ID NO: 996876 - protein, 9 aa, Homo Sapiens
WLRGLEDSL

SEQ ID NO: 996877 - protein, 9 aa, Homo Sapiens
AYTTKFVDL

SEQ ID NO: 996878 - protein, 9 aa, Homo Sapiens
CQESSFLPA

SEQ ID NO: 996879 - protein, 9 aa, Homo Sapiens
ISSFRYEML

SEQ ID NO: 996880 - protein, 9 aa, Homo Sapiens
PRLSFCSAP

SEQ ID NO: 996881 - protein, 9 aa, Homo Sapiens
IMNKGLSSN

SEQ ID NO: 996882 - protein, 9 aa, Homo Sapiens
LSSREARQA

SEQ ID NO: 996883 - protein, 9 aa, Homo Sapiens
GSYYEGLGY

SEQ ID NO: 996884 - protein, 9 aa, Homo Sapiens
CLVNNKGLA

SEQ ID NO: 996885 - protein, 9 aa, Homo Sapiens
HSALSGTII

SEQ ID NO: 996886 - protein, 9 aa, Homo Sapiens
EEKHDCTEK

SEQ ID NO: 996887 - protein, 9 aa, Homo Sapiens
AMTHFPASS

SEQ ID NO: 996888 - protein, 9 aa, Homo Sapiens
LTSRFCQIE

SEQ ID NO: 996889 - protein, 9 aa, Homo Sapiens
LTDQMTFGK

SEQ ID NO: 996890 - protein, 9 aa, Homo Sapiens
DPRAEKNQC

SEQ ID NO: 996891 - protein, 9 aa, Homo Sapiens
QFQNKAISY

SEQ ID NO: 996892 - protein, 9 aa, Homo Sapiens
IAFPLLFEI

SEQ ID NO: 996893 - protein, 9 aa, Homo Sapiens
KKAECFSSP

SEQ ID NO: 996894 - protein, 9 aa, Homo Sapiens
PKVPVKILN

SEQ ID NO: 996895 - protein, 9 aa, Homo Sapiens
VKVFFFANR

SEQ ID NO: 996896 - protein, 9 aa, Homo Sapiens
TPSNRTEED

SEQ ID NO: 996897 - protein, 9 aa, Homo Sapiens
ALTFFVFKA

SEQ ID NO: 996898 - protein, 9 aa, Homo Sapiens
APKVLGAVA

SEQ ID NO: 996899 - protein, 9 aa, Homo Sapiens
VEWWFQVLN

SEQ ID NO: 996900 - protein, 9 aa, Homo Sapiens
LKIGVNNEA

SEQ ID NO: 996901 - protein, 9 aa, Homo Sapiens
SNSEAYDHC

SEQ ID NO: 996902 - protein, 9 aa, Homo Sapiens
IRVSWYLDE

SEQ ID NO: 996903 - protein, 9 aa, Homo Sapiens
VKLIYKKGP

SEQ ID NO: 996904 - protein, 9 aa, Homo Sapiens
RPTPFFMNP

SEQ ID NO: 996905 - protein, 9 aa, Homo Sapiens
PVCFSSFLG

SEQ ID NO: 996906 - protein, 9 aa, Homo Sapiens
VTSCPANNY

SEQ ID NO: 996907 - protein, 9 aa, Homo Sapiens
ESHSIVLAR

SEQ ID NO: 996908 - protein, 9 aa, Homo Sapiens
LKGGHLLQF

SEQ ID NO: 996909 - protein, 9 aa, Homo Sapiens
LTEFHVAFP

SEQ ID NO: 996910 - protein, 9 aa, Homo Sapiens
QAGQHFKHR

SEQ ID NO: 996911 - protein, 9 aa, Homo Sapiens
IKECTLLKE

SEQ ID NO: 996912 - protein, 9 aa, Homo Sapiens
ICKMGMIIT

SEQ ID NO: 996913 - protein, 9 aa, Homo Sapiens
RSKGFFIFP

SEQ ID NO: 996914 - protein, 9 aa, Homo Sapiens
HCVRPQHMP

SEQ ID NO: 996915 - protein, 9 aa, Homo Sapiens
NGPQDLRMF

SEQ ID NO: 996916 - protein, 9 aa, Homo Sapiens
SWSGAPRKV

SEQ ID NO: 996917 - protein, 9 aa, Homo Sapiens
EGPMGPHGP

SEQ ID NO: 996918 - protein, 9 aa, Homo Sapiens
VVSDPAKRA

SEQ ID NO: 996919 - protein, 9 aa, Homo Sapiens
LFTLVGNTL

SEQ ID NO: 996920 - protein, 9 aa, Homo Sapiens
ESLLEVRPW

SEQ ID NO: 996921 - protein, 9 aa, Homo Sapiens
HVEVLRAQL

SEQ ID NO: 996922 - protein, 9 aa, Homo Sapiens
LRVFVESLL

SEQ ID NO: 996923 - protein, 9 aa, Homo Sapiens
IGPIYLNEI

SEQ ID NO: 996924 - protein, 9 aa, Homo Sapiens
PAWEGGGRM

SEQ ID NO: 996925 - protein, 9 aa, Homo Sapiens
EEQKKSIEE

SEQ ID NO: 996926 - protein, 9 aa, Homo Sapiens
MEWKETARG

SEQ ID NO: 996927 - protein, 9 aa, Homo Sapiens
HHEPSTRAS

SEQ ID NO: 996928 - protein, 9 aa, Homo Sapiens
YVPRPCQES

SEQ ID NO: 996929 - protein, 9 aa, Homo Sapiens
VGVPRAGVP

SEQ ID NO: 996930 - protein, 9 aa, Homo Sapiens
LEKMRDERL

SEQ ID NO: 996931 - protein, 9 aa, Homo Sapiens
ATEKSRWSG

SEQ ID NO: 996932 - protein, 9 aa, Homo Sapiens
IFNEDGLYL

SEQ ID NO: 996933 - protein, 9 aa, Homo Sapiens
EAVLPRAVV

SEQ ID NO: 996934 - protein, 9 aa, Homo Sapiens
KVFFFANRQ

SEQ ID NO: 996935 - protein, 9 aa, Homo Sapiens
LSHSVAWTT

SEQ ID NO: 996936 - protein, 9 aa, Homo Sapiens
EPEDSSLRI

SEQ ID NO: 996937 - protein, 9 aa, Homo Sapiens
EDPQTAIDV

SEQ ID NO: 996938 - protein, 9 aa, Homo Sapiens
ILDPPKKDV

SEQ ID NO: 996939 - protein, 9 aa, Homo Sapiens
TQATQKGAL

SEQ ID NO: 996940 - protein, 9 aa, Homo Sapiens
TQLEHILLC

SEQ ID NO: 996941 - protein, 9 aa, Homo Sapiens
RIYAATFKK

SEQ ID NO: 996942 - protein, 9 aa, Homo Sapiens
SGAPRKVKQ

SEQ ID NO: 996943 - protein, 9 aa, Homo Sapiens
SPKVPVKIL

SEQ ID NO: 996944 - protein, 9 aa, Homo Sapiens
GLRIWLCPY

SEQ ID NO: 996945 - protein, 9 aa, Homo Sapiens
GEKGAPEEK

SEQ ID NO: 996946 - protein, 9 aa, Homo Sapiens
PTPCPSCGL

SEQ ID NO: 996947 - protein, 9 aa, Homo Sapiens
LYNQLTDAQ

SEQ ID NO: 996948 - protein, 9 aa, Homo Sapiens
SIDLSCKHR

SEQ ID NO: 996949 - protein, 9 aa, Homo Sapiens
VKEETGKDC

SEQ ID NO: 996950 - protein, 9 aa, Homo Sapiens
RRPRLSFCS

SEQ ID NO: 996951 - protein, 9 aa, Homo Sapiens
EMPHYSEEE

SEQ ID NO: 996952 - protein, 9 aa, Homo Sapiens
YDLKPASEL

SEQ ID NO: 996953 - protein, 9 aa, Homo Sapiens
GVPVSVDGM

SEQ ID NO: 996954 - protein, 9 aa, Homo Sapiens
EVDNPGHPF

SEQ ID NO: 996955 - protein, 9 aa, Homo Sapiens
KPEINIEEK

SEQ ID NO: 996956 - protein, 9 aa, Homo Sapiens
VPAAAALAA

SEQ ID NO: 996957 - protein, 9 aa, Homo Sapiens
DTHLTKENE

SEQ ID NO: 996958 - protein, 9 aa, Homo Sapiens
AWREAQRQV

SEQ ID NO: 996959 - protein, 9 aa, Homo Sapiens
RKFSYCEAT

SEQ ID NO: 996960 - protein, 9 aa, Homo Sapiens
EASFPAPGR

SEQ ID NO: 996961 - protein, 9 aa, Homo Sapiens
IAVMRPTVP

SEQ ID NO: 996962 - protein, 9 aa, Homo Sapiens
PTSEIQWWY

SEQ ID NO: 996963 - protein, 9 aa, Homo Sapiens
SFMLEEDWK

SEQ ID NO: 996964 - protein, 9 aa, Homo Sapiens
TAPIFNEDG

SEQ ID NO: 996965 - protein, 9 aa, Homo Sapiens
IIKGLPPGI

SEQ ID NO: 996966 - protein, 9 aa, Homo Sapiens
FKKFQIFFK

SEQ ID NO: 996967 - protein, 9 aa, Homo Sapiens
LSYQLLKTT

SEQ ID NO: 996968 - protein, 9 aa, Homo Sapiens
AVLPRAVVS

SEQ ID NO: 996969 - protein, 9 aa, Homo Sapiens
TSVETPFWM

SEQ ID NO: 996970 - protein, 9 aa, Homo Sapiens
YQLLKTTEP

SEQ ID NO: 996971 - protein, 9 aa, Homo Sapiens
AGQHFKHRF

SEQ ID NO: 996972 - protein, 9 aa, Homo Sapiens
LLSFMLEED

SEQ ID NO: 996973 - protein, 9 aa, Homo Sapiens
VIPISISDL

SEQ ID NO: 996974 - protein, 9 aa, Homo Sapiens
TTEDILADC

SEQ ID NO: 996975 - protein, 9 aa, Homo Sapiens
ALTSRFCQI

SEQ ID NO: 996976 - protein, 9 aa, Homo Sapiens
SSFRYEMLD

SEQ ID NO: 996977 - protein, 9 aa, Homo Sapiens
DRVGKNGAP

SEQ ID NO: 996978 - protein, 9 aa, Homo Sapiens
CKHNESCSP

SEQ ID NO: 996979 - protein, 9 aa, Homo Sapiens
EIRIYTNAG

SEQ ID NO: 996980 - protein, 9 aa, Homo Sapiens
RYRKRSSPE

SEQ ID NO: 996981 - protein, 9 aa, Homo Sapiens
KFALSKIFP

SEQ ID NO: 996982 - protein, 9 aa, Homo Sapiens
LRKKPEINI

SEQ ID NO: 996983 - protein, 9 aa, Homo Sapiens
KLVDFRVSA

SEQ ID NO: 996984 - protein, 9 aa, Homo Sapiens
GLPGPKGTE

SEQ ID NO: 996985 - protein, 9 aa, Homo Sapiens
ADFDQEKKI

SEQ ID NO: 996986 - protein, 9 aa, Homo Sapiens
WLLSPGSEG

SEQ ID NO: 996987 - protein, 9 aa, Homo Sapiens
IGDFGLATE

SEQ ID NO: 996988 - protein, 9 aa, Homo Sapiens
GSVNEAGYK

SEQ ID NO: 996989 - protein, 9 aa, Homo Sapiens
GLISSPELQ

SEQ ID NO: 996990 - protein, 9 aa, Homo Sapiens
CQPSPKCTP

SEQ ID NO: 996991 - protein, 9 aa, Homo Sapiens
LLGLLEKMR

SEQ ID NO: 996992 - protein, 9 aa, Homo Sapiens
EKVYVYLMH

SEQ ID NO: 996993 - protein, 9 aa, Homo Sapiens
CVLLLGKNR

SEQ ID NO: 996994 - protein, 9 aa, Homo Sapiens
NAGRICRPL

SEQ ID NO: 996995 - protein, 9 aa, Homo Sapiens
MLCGIGETP

SEQ ID NO: 996996 - protein, 9 aa, Homo Sapiens
PGWGTRVPG

SEQ ID NO: 996997 - protein, 9 aa, Homo Sapiens
VLVGLVAVF

SEQ ID NO: 996998 - protein, 9 aa, Homo Sapiens
VGSEINSTG

SEQ ID NO: 996999 - protein, 9 aa, Homo Sapiens
AKFLENQQV

SEQ ID NO: 997000 - protein, 9 aa, Homo Sapiens
GSRPGCQQR

SEQ ID NO: 997001 - protein, 9 aa, Homo Sapiens
KNPWVKVDT

SEQ ID NO: 997002 - protein, 9 aa, Homo Sapiens
LPQLIPVFS

SEQ ID NO: 997003 - protein, 9 aa, Homo Sapiens
PQLIPVFSG

SEQ ID NO: 997004 - protein, 9 aa, Homo Sapiens
RLIPGFISN

SEQ ID NO: 997005 - protein, 9 aa, Homo Sapiens
RKRSSPETL

SEQ ID NO: 997006 - protein, 9 aa, Homo Sapiens
CFKVFDLNG

SEQ ID NO: 997007 - protein, 9 aa, Homo Sapiens
CFLCHGDQF

SEQ ID NO: 997008 - protein, 9 aa, Homo Sapiens
VPQPRSLRW

SEQ ID NO: 997009 - protein, 9 aa, Homo Sapiens
TSRFCQIEV

SEQ ID NO: 997010 - protein, 9 aa, Homo Sapiens
VFEEAQGLL

SEQ ID NO: 997011 - protein, 9 aa, Homo Sapiens
PAGIPVAPF

SEQ ID NO: 997012 - protein, 9 aa, Homo Sapiens
QSYLAILAS

SEQ ID NO: 997013 - protein, 9 aa, Homo Sapiens
VFKATFCGP

SEQ ID NO: 997014 - protein, 9 aa, Homo Sapiens
PGLSGPKGE

SEQ ID NO: 997015 - protein, 9 aa, Homo Sapiens
TVCNGRKVL

SEQ ID NO: 997016 - protein, 9 aa, Homo Sapiens
INITALNYD

SEQ ID NO: 997017 - protein, 9 aa, Homo Sapiens
RLYNQLTDA

SEQ ID NO: 997018 - protein, 9 aa, Homo Sapiens
SLSVDKHED

SEQ ID NO: 997019 - protein, 9 aa, Homo Sapiens
RDPTSLLKE

SEQ ID NO: 997020 - protein, 9 aa, Homo Sapiens
PHYSEEEEE

SEQ ID NO: 997021 - protein, 9 aa, Homo Sapiens
EQGLELRVQ

SEQ ID NO: 997022 - protein, 9 aa, Homo Sapiens
EGKFYWGDA

SEQ ID NO: 997023 - protein, 9 aa, Homo Sapiens
GLEDSLQDY

SEQ ID NO: 997024 - protein, 9 aa, Homo Sapiens
LSDSEIQLK

SEQ ID NO: 997025 - protein, 9 aa, Homo Sapiens
VFTSYLFTL

SEQ ID NO: 997026 - protein, 9 aa, Homo Sapiens
TPCPSCGLS

SEQ ID NO: 997027 - protein, 9 aa, Homo Sapiens
CPANNYQAC

SEQ ID NO: 997028 - protein, 9 aa, Homo Sapiens
SKVSRGPLQ

SEQ ID NO: 997029 - protein, 9 aa, Homo Sapiens
NEPKGKTEA

SEQ ID NO: 997030 - protein, 9 aa, Homo Sapiens
ANGPQDLRM

SEQ ID NO: 997031 - protein, 9 aa, Homo Sapiens
YLAQHRKIY

SEQ ID NO: 997032 - protein, 9 aa, Homo Sapiens
SCGLSPSEE

SEQ ID NO: 997033 - protein, 9 aa, Homo Sapiens
SFWSVMFFL

SEQ ID NO: 997034 - protein, 9 aa, Homo Sapiens
RIQYFFVAS

SEQ ID NO: 997035 - protein, 9 aa, Homo Sapiens
AGSYILHDI

SEQ ID NO: 997036 - protein, 9 aa, Homo Sapiens
ARPAQAIGI

SEQ ID NO: 997037 - protein, 9 aa, Homo Sapiens
LVDFRVSAQ

SEQ ID NO: 997038 - protein, 9 aa, Homo Sapiens
VPNLQILAC

SEQ ID NO: 997039 - protein, 9 aa, Homo Sapiens
RLLVSPKKL

SEQ ID NO: 997040 - protein, 9 aa, Homo Sapiens
SIVKEETGK

SEQ ID NO: 997041 - protein, 9 aa, Homo Sapiens
LHPEPVVVS

SEQ ID NO: 997042 - protein, 9 aa, Homo Sapiens
SNLTGNNYK

SEQ ID NO: 997043 - protein, 9 aa, Homo Sapiens
FCQIEVLTT

SEQ ID NO: 997044 - protein, 9 aa, Homo Sapiens
HRPVSHSWH

SEQ ID NO: 997045 - protein, 9 aa, Homo Sapiens
SQKAFMKEG

SEQ ID NO: 997046 - protein, 9 aa, Homo Sapiens
LEQAWREAQ

SEQ ID NO: 997047 - protein, 9 aa, Homo Sapiens
LPPLSAPVA

SEQ ID NO: 997048 - protein, 9 aa, Homo Sapiens
SASATPPRS

SEQ ID NO: 997049 - protein, 9 aa, Homo Sapiens
GLSSNERLE

SEQ ID NO: 997050 - protein, 9 aa, Homo Sapiens
VSHSWHNGE

SEQ ID NO: 997051 - protein, 9 aa, Homo Sapiens
LSGPKGEPG

SEQ ID NO: 997052 - protein, 9 aa, Homo Sapiens
SISESSRQF

SEQ ID NO: 997053 - protein, 9 aa, Homo Sapiens
GLSGPKGEP

SEQ ID NO: 997054 - protein, 9 aa, Homo Sapiens
PVSMPEVQE

SEQ ID NO: 997055 - protein, 9 aa, Homo Sapiens
RVVRFKVIP

SEQ ID NO: 997056 - protein, 9 aa, Homo Sapiens
TRASSSRHS

SEQ ID NO: 997057 - protein, 9 aa, Homo Sapiens
PLVERGWVG

SEQ ID NO: 997058 - protein, 9 aa, Homo Sapiens
EMRKEASNI

SEQ ID NO: 997059 - protein, 9 aa, Homo Sapiens
PYKHSQATQ

SEQ ID NO: 997060 - protein, 9 aa, Homo Sapiens
VLLSIVYTI

SEQ ID NO: 997061 - protein, 9 aa, Homo Sapiens
FEEAISARK

SEQ ID NO: 997062 - protein, 9 aa, Homo Sapiens
SSHKHDGME

SEQ ID NO: 997063 - protein, 9 aa, Homo Sapiens
VPVSVDGMD

SEQ ID NO: 997064 - protein, 9 aa, Homo Sapiens
SAGLISSPE

SEQ ID NO: 997065 - protein, 9 aa, Homo Sapiens
KKVKGALKK

SEQ ID NO: 997066 - protein, 9 aa, Homo Sapiens
GRIYKHFQQ

SEQ ID NO: 997067 - protein, 9 aa, Homo Sapiens
PCPSCGLSP

SEQ ID NO: 997068 - protein, 9 aa, Homo Sapiens
SPKPRITAS

SEQ ID NO: 997069 - protein, 9 aa, Homo Sapiens
PGCQQRPLP

SEQ ID NO: 997070 - protein, 9 aa, Homo Sapiens
CWKIIESYE

SEQ ID NO: 997071 - protein, 9 aa, Homo Sapiens
SKLLPPLSA

SEQ ID NO: 997072 - protein, 9 aa, Homo Sapiens
TGYSFSFSF

SEQ ID NO: 997073 - protein, 9 aa, Homo Sapiens
AILASSWVD

SEQ ID NO: 997074 - protein, 9 aa, Homo Sapiens
CSGGLGFGS

SEQ ID NO: 997075 - protein, 9 aa, Homo Sapiens
NNEEGLIDG

SEQ ID NO: 997076 - protein, 9 aa, Homo Sapiens
ASRYTIMVL

SEQ ID NO: 997077 - protein, 9 aa, Homo Sapiens
TTLCQNRTL

SEQ ID NO: 997078 - protein, 9 aa, Homo Sapiens
QEAFHCVRP

SEQ ID NO: 997079 - protein, 9 aa, Homo Sapiens
SKCGKSFSQ

SEQ ID NO: 997080 - protein, 9 aa, Homo Sapiens
DLKPASELG

SEQ ID NO: 997081 - protein, 9 aa, Homo Sapiens
WQNSLLVKS

SEQ ID NO: 997082 - protein, 9 aa, Homo Sapiens
QCQPSPKCT

SEQ ID NO: 997083 - protein, 9 aa, Homo Sapiens
NTRHSFSSP

SEQ ID NO: 997084 - protein, 9 aa, Homo Sapiens
VSMPEVQEK

SEQ ID NO: 997085 - protein, 9 aa, Homo Sapiens
MTVILFQVS

SEQ ID NO: 997086 - protein, 9 aa, Homo Sapiens
WAKVFGEGN

SEQ ID NO: 997087 - protein, 9 aa, Homo Sapiens
QKPKYQVCW

SEQ ID NO: 997088 - protein, 9 aa, Homo Sapiens
AQNLDLNQN

SEQ ID NO: 997089 - protein, 9 aa, Homo Sapiens
LWFHSMDIF

SEQ ID NO: 997090 - protein, 9 aa, Homo Sapiens
FEEAQGLLL

SEQ ID NO: 997091 - protein, 9 aa, Homo Sapiens
LAMIKLACG

SEQ ID NO: 997092 - protein, 9 aa, Homo Sapiens
QIDRKGQCY

SEQ ID NO: 997093 - protein, 9 aa, Homo Sapiens
ILHVPADFD

SEQ ID NO: 997094 - protein, 9 aa, Homo Sapiens
FDYDLLTMS

SEQ ID NO: 997095 - protein, 9 aa, Homo Sapiens
GIGPIYLNE

SEQ ID NO: 997096 - protein, 9 aa, Homo Sapiens
NCVSIDLSC

SEQ ID NO: 997097 - protein, 9 aa, Homo Sapiens
LESLFFSAV

SEQ ID NO: 997098 - protein, 9 aa, Homo Sapiens
SSWADPPQE

SEQ ID NO: 997099 - protein, 9 aa, Homo Sapiens
DGLPGPPGF

SEQ ID NO: 997100 - protein, 9 aa, Homo Sapiens
NYDIDPNAG

SEQ ID NO: 997101 - protein, 9 aa, Homo Sapiens
NESCSPDTG

SEQ ID NO: 997102 - protein, 9 aa, Homo Sapiens
RLSFCSAPT

SEQ ID NO: 997103 - protein, 9 aa, Homo Sapiens
YTAPIFNED

SEQ ID NO: 997104 - protein, 9 aa, Homo Sapiens
NKKKGIEQN

SEQ ID NO: 997105 - protein, 9 aa, Homo Sapiens
EQELEQAWR

SEQ ID NO: 997106 - protein, 9 aa, Homo Sapiens
HHRPVSHSW

SEQ ID NO: 997107 - protein, 9 aa, Homo Sapiens
PVVVSKMHK

SEQ ID NO: 997108 - protein, 9 aa, Homo Sapiens
SFVRPPAKD

SEQ ID NO: 997109 - protein, 9 aa, Homo Sapiens
ARGIKFEEK

SEQ ID NO: 997110 - protein, 9 aa, Homo Sapiens
QMTFGKRIK

SEQ ID NO: 997111 - protein, 9 aa, Homo Sapiens
LRWPVVVAE

SEQ ID NO: 997112 - protein, 8 aa, Homo Sapiens
EWRNHSGR

SEQ ID NO: 997113 - protein, 9 aa, Homo Sapiens
VPSHVFSKL

SEQ ID NO: 997114 - protein, 9 aa, Homo Sapiens
ARPTPFFMN

SEQ ID NO: 997115 - protein, 9 aa, Homo Sapiens
QSSHYGQID

SEQ ID NO: 997116 - protein, 9 aa, Homo Sapiens
DEGWHQICL

SEQ ID NO: 997117 - protein, 9 aa, Homo Sapiens
AGLLGLLEK

SEQ ID NO: 997118 - protein, 9 aa, Homo Sapiens
MSYSGSYYE

SEQ ID NO: 997119 - protein, 9 aa, Homo Sapiens
MDMPEVLKF

SEQ ID NO: 997120 - protein, 9 aa, Homo Sapiens
LHIFALVIV

SEQ ID NO: 997121 - protein, 9 aa, Homo Sapiens
GYSFSFSFL

SEQ ID NO: 997122 - protein, 9 aa, Homo Sapiens
QTQATQKGA

SEQ ID NO: 997123 - protein, 9 aa, Homo Sapiens
FLKGGHLLQ

SEQ ID NO: 997124 - protein, 9 aa, Homo Sapiens
IRIYTNAGR

SEQ ID NO: 997125 - protein, 9 aa, Homo Sapiens
LNQNFPDLT

SEQ ID NO: 997126 - protein, 9 aa, Homo Sapiens
PHCKNVNKP

SEQ ID NO: 997127 - protein, 9 aa, Homo Sapiens
AALAAASPP

SEQ ID NO: 997128 - protein, 9 aa, Homo Sapiens
DLQEGKFYW

SEQ ID NO: 997129 - protein, 9 aa, Homo Sapiens
KSKEEKIEL

SEQ ID NO: 997130 - protein, 9 aa, Homo Sapiens
VGKSKEEKI

SEQ ID NO: 997131 - protein, 9 aa, Homo Sapiens
SKLWDPSEA

SEQ ID NO: 997132 - protein, 9 aa, Homo Sapiens
MEEILKLKF

SEQ ID NO: 997133 - protein, 8 aa, Homo Sapiens
ESPNRTTI

SEQ ID NO: 997134 - protein, 9 aa, Homo Sapiens
SGEAAHLPH

SEQ ID NO: 997135 - protein, 9 aa, Homo Sapiens
ERLLVSPKK

SEQ ID NO: 997136 - protein, 9 aa, Homo Sapiens
QLIPVFSGG

SEQ ID NO: 997137 - protein, 9 aa, Homo Sapiens
KELRQRSQE

SEQ ID NO: 997138 - protein, 9 aa, Homo Sapiens
ERMIEKLFS

SEQ ID NO: 997139 - protein, 9 aa, Homo Sapiens
LIALDNIDS

SEQ ID NO: 997140 - protein, 9 aa, Homo Sapiens
FFTDKFALS

SEQ ID NO: 997141 - protein, 9 aa, Homo Sapiens
RFCQIEVLT

SEQ ID NO: 997142 - protein, 9 aa, Homo Sapiens
QIEEQKEVM

SEQ ID NO: 997143 - protein, 9 aa, Homo Sapiens
SSREARQAM

SEQ ID NO: 997144 - protein, 9 aa, Homo Sapiens
ILADCPKEI

SEQ ID NO: 997145 - protein, 9 aa, Homo Sapiens
NSENITTHE

SEQ ID NO: 997146 - protein, 9 aa, Homo Sapiens
VLRSSWADP

SEQ ID NO: 997147 - protein, 9 aa, Homo Sapiens
KPPLSPRPK

SEQ ID NO: 997148 - protein, 9 aa, Homo Sapiens
VPADFDQEK

SEQ ID NO: 997149 - protein, 9 aa, Homo Sapiens
SSPELQEWR

SEQ ID NO: 997150 - protein, 9 aa, Homo Sapiens
LASSWVDDF

SEQ ID NO: 997151 - protein, 9 aa, Homo Sapiens
ETLSASSPS

SEQ ID NO: 997152 - protein, 9 aa, Homo Sapiens
FKHRFRGSG

SEQ ID NO: 997153 - protein, 9 aa, Homo Sapiens
CIQTEVDNP

SEQ ID NO: 997154 - protein, 9 aa, Homo Sapiens
LIAVEINVI

SEQ ID NO: 997155 - protein, 9 aa, Homo Sapiens
VLDDLYASN

SEQ ID NO: 997156 - protein, 9 aa, Homo Sapiens
KMRDERLSR

SEQ ID NO: 997157 - protein, 9 aa, Homo Sapiens
LLIALDNID

SEQ ID NO: 997158 - protein, 9 aa, Homo Sapiens
FSYCEATLL

SEQ ID NO: 997159 - protein, 9 aa, Homo Sapiens
LAGRDLNHN

SEQ ID NO: 997160 - protein, 9 aa, Homo Sapiens
VPRAGVPGV

SEQ ID NO: 997161 - protein, 9 aa, Homo Sapiens
RHLDSYVFL

SEQ ID NO: 997162 - protein, 9 aa, Homo Sapiens
LIYKKGPRW

SEQ ID NO: 997163 - protein, 9 aa, Homo Sapiens
MRCGEETRI

SEQ ID NO: 997164 - protein, 9 aa, Homo Sapiens
EQSYLAILA

SEQ ID NO: 997165 - protein, 9 aa, Homo Sapiens
SVIIKGLPP

SEQ ID NO: 997166 - protein, 9 aa, Homo Sapiens
KLQHLEASF

SEQ ID NO: 997167 - protein, 9 aa, Homo Sapiens
RIKAMVEAV

SEQ ID NO: 997168 - protein, 9 aa, Homo Sapiens
QNRTLVGMK

SEQ ID NO: 997169 - protein, 9 aa, Homo Sapiens
IDISPRSAT

SEQ ID NO: 997170 - protein, 9 aa, Homo Sapiens
PSCPEPLLV

SEQ ID NO: 997171 - protein, 9 aa, Homo Sapiens
SGPKGEPGF

SEQ ID NO: 997172 - protein, 9 aa, Homo Sapiens
SINITALNY

SEQ ID NO: 997173 - protein, 9 aa, Homo Sapiens
FLCSHSLTE

SEQ ID NO: 997174 - protein, 9 aa, Homo Sapiens
PPFQANGPQ

SEQ ID NO: 997175 - protein, 9 aa, Homo Sapiens
VLTEENALE

SEQ ID NO: 997176 - protein, 9 aa, Homo Sapiens
RRGTKRISQ

SEQ ID NO: 997177 - protein, 9 aa, Homo Sapiens
NDEEDHDPV

SEQ ID NO: 997178 - protein, 9 aa, Homo Sapiens
KSHRGSLLL

SEQ ID NO: 997179 - protein, 9 aa, Homo Sapiens
QQCQPSPKC

SEQ ID NO: 997180 - protein, 9 aa, Homo Sapiens
PAVGKSKEE

SEQ ID NO: 997181 - protein, 9 aa, Homo Sapiens
TRVACGLSH

SEQ ID NO: 997182 - protein, 9 aa, Homo Sapiens
ESLFFSAVL

SEQ ID NO: 997183 - protein, 9 aa, Homo Sapiens
HISSHKHDG

SEQ ID NO: 997184 - protein, 9 aa, Homo Sapiens
MDIFFGSCV

SEQ ID NO: 997185 - protein, 9 aa, Homo Sapiens
RYICLRFQR

SEQ ID NO: 997186 - protein, 9 aa, Homo Sapiens
KITRVACGL

SEQ ID NO: 997187 - protein, 9 aa, Homo Sapiens
GPQSEWKSY

SEQ ID NO: 997188 - protein, 9 aa, Homo Sapiens
SDPAKRAIH

SEQ ID NO: 997189 - protein, 9 aa, Homo Sapiens
ESCSPDTGS

SEQ ID NO: 997190 - protein, 9 aa, Homo Sapiens
WLSYQLLKT

SEQ ID NO: 997191 - protein, 9 aa, Homo Sapiens
FFFANRQNF

SEQ ID NO: 997192 - protein, 9 aa, Homo Sapiens
ALATTLKTV

SEQ ID NO: 997193 - protein, 9 aa, Homo Sapiens
KLLPPLSAP

SEQ ID NO: 997194 - protein, 9 aa, Homo Sapiens
KCPGLWSYS

SEQ ID NO: 997195 - protein, 9 aa, Homo Sapiens
YSFSFSFLE

SEQ ID NO: 997196 - protein, 9 aa, Homo Sapiens
DLTTKADSG

SEQ ID NO: 997197 - protein, 9 aa, Homo Sapiens
LEASFTQEG

SEQ ID NO: 997198 - protein, 9 aa, Homo Sapiens
GLLAYAAAG

SEQ ID NO: 997199 - protein, 9 aa, Homo Sapiens
MKHEDVEKV

SEQ ID NO: 997200 - protein, 9 aa, Homo Sapiens
QPKNPKSKE

SEQ ID NO: 997201 - protein, 9 aa, Homo Sapiens
VTLFRELQA

SEQ ID NO: 997202 - protein, 9 aa, Homo Sapiens
QPEKLVVLK

SEQ ID NO: 997203 - protein, 9 aa, Homo Sapiens
GCHHPDEAV

SEQ ID NO: 997204 - protein, 9 aa, Homo Sapiens
PLFHILKTK

SEQ ID NO: 997205 - protein, 9 aa, Homo Sapiens
NANSPKVPV

SEQ ID NO: 997206 - protein, 9 aa, Homo Sapiens
PRSLRWPVV

SEQ ID NO: 997207 - protein, 9 aa, Homo Sapiens
LDDTRDPTS

SEQ ID NO: 997208 - protein, 9 aa, Homo Sapiens
VNLKIGVNN

SEQ ID NO: 997209 - protein, 9 aa, Homo Sapiens
KSFESLLQE

SEQ ID NO: 997210 - protein, 9 aa, Homo Sapiens
HCCMETTPS

SEQ ID NO: 997211 - protein, 9 aa, Homo Sapiens
FVASVVANG

SEQ ID NO: 997212 - protein, 9 aa, Homo Sapiens
CLCVLLLGK

SEQ ID NO: 997213 - protein, 9 aa, Homo Sapiens
EDLHFPANK

SEQ ID NO: 997214 - protein, 9 aa, Homo Sapiens
VRKYEEMRK

SEQ ID NO: 997215 - protein, 9 aa, Homo Sapiens
VSVPQPRSL

SEQ ID NO: 997216 - protein, 9 aa, Homo Sapiens
SSNSIQIEG

SEQ ID NO: 997217 - protein, 9 aa, Homo Sapiens
WRAKVGVAE

SEQ ID NO: 997218 - protein, 9 aa, Homo Sapiens
VKLSGEAAH

SEQ ID NO: 997219 - protein, 9 aa, Homo Sapiens
LTEENALEI

SEQ ID NO: 997220 - protein, 9 aa, Homo Sapiens
NLDLNQNFP

SEQ ID NO: 997221 - protein, 9 aa, Homo Sapiens
RLSLFSRMK

SEQ ID NO: 997222 - protein, 9 aa, Homo Sapiens
SMDIFFGSC

SEQ ID NO: 997223 - protein, 9 aa, Homo Sapiens
SLSEGDDPE

SEQ ID NO: 997224 - protein, 9 aa, Homo Sapiens
PKEQAQPPY

SEQ ID NO: 997225 - protein, 9 aa, Homo Sapiens
ARRFFWNSL

SEQ ID NO: 997226 - protein, 9 aa, Homo Sapiens
EIFNLVYWA

SEQ ID NO: 997227 - protein, 9 aa, Homo Sapiens
DLSAVTLFR

SEQ ID NO: 997228 - protein, 9 aa, Homo Sapiens
NSIGLPHSH

SEQ ID NO: 997229 - protein, 9 aa, Homo Sapiens
ISSHKHDGM

SEQ ID NO: 997230 - protein, 9 aa, Homo Sapiens
TLFRELQAM

SEQ ID NO: 997231 - protein, 9 aa, Homo Sapiens
FFANRQNFI

SEQ ID NO: 997232 - protein, 9 aa, Homo Sapiens
HTSSTYFFS

SEQ ID NO: 997233 - protein, 9 aa, Homo Sapiens
SDTSSPLCD

SEQ ID NO: 997234 - protein, 9 aa, Homo Sapiens
LDLNQNFPD

SEQ ID NO: 997235 - protein, 9 aa, Homo Sapiens
YLWKSTLPD

SEQ ID NO: 997236 - protein, 9 aa, Homo Sapiens
PEVLKFLLE

SEQ ID NO: 997237 - protein, 9 aa, Homo Sapiens
DQEKLGEVW

SEQ ID NO: 997238 - protein, 9 aa, Homo Sapiens
YYCTLSLLQ

SEQ ID NO: 997239 - protein, 9 aa, Homo Sapiens
QEKISLNLS

SEQ ID NO: 997240 - protein, 9 aa, Homo Sapiens
KFQKELRQR

SEQ ID NO: 997241 - protein, 9 aa, Homo Sapiens
AFEEIPVDG

SEQ ID NO: 997242 - protein, 9 aa, Homo Sapiens
FLCEVLAMI

SEQ ID NO: 997243 - protein, 9 aa, Homo Sapiens
PIWQQVATA

SEQ ID NO: 997244 - protein, 9 aa, Homo Sapiens
WNTRQKKQE

SEQ ID NO: 997245 - protein, 9 aa, Homo Sapiens
NSEAYDHCF

SEQ ID NO: 997246 - protein, 9 aa, Homo Sapiens
WKETARGIK

SEQ ID NO: 997247 - protein, 9 aa, Homo Sapiens
FQANGPQDL

SEQ ID NO: 997248 - protein, 9 aa, Homo Sapiens
FKATFCGPC

SEQ ID NO: 997249 - protein, 9 aa, Homo Sapiens
FFLFFCMYL

SEQ ID NO: 997250 - protein, 9 aa, Homo Sapiens
TEVDNPGHP

SEQ ID NO: 997251 - protein, 9 aa, Homo Sapiens
VVVSKMHKM

SEQ ID NO: 997252 - protein, 9 aa, Homo Sapiens
GPRTNLEIS

SEQ ID NO: 997253 - protein, 9 aa, Homo Sapiens
HRKIYTGEK

SEQ ID NO: 997254 - protein, 9 aa, Homo Sapiens
EWWFQVLNS

SEQ ID NO: 997255 - protein, 9 aa, Homo Sapiens
ERPEVGSCK

SEQ ID NO: 997256 - protein, 9 aa, Homo Sapiens
EKMRDERLS

SEQ ID NO: 997257 - protein, 9 aa, Homo Sapiens
LLSPGSEGN

SEQ ID NO: 997258 - protein, 9 aa, Homo Sapiens
PVAVKVFFF

SEQ ID NO: 997259 - protein, 9 aa, Homo Sapiens
GFGSLTHKC

SEQ ID NO: 997260 - protein, 9 aa, Homo Sapiens
VLPENRIYL

SEQ ID NO: 997261 - protein, 9 aa, Homo Sapiens
PEEKGPQGP

SEQ ID NO: 997262 - protein, 9 aa, Homo Sapiens
RDQEAFHCV

SEQ ID NO: 997263 - protein, 9 aa, Homo Sapiens
EMLDLLGNR

SEQ ID NO: 997264 - protein, 9 aa, Homo Sapiens
IRLKWSPPK

SEQ ID NO: 997265 - protein, 9 aa, Homo Sapiens
RWHLGPGDS

SEQ ID NO: 997266 - protein, 9 aa, Homo Sapiens
KEETGKDCA

SEQ ID NO: 997267 - protein, 9 aa, Homo Sapiens
PGSSTPFWL

SEQ ID NO: 997268 - protein, 9 aa, Homo Sapiens
CNGRKVLDS

SEQ ID NO: 997269 - protein, 9 aa, Homo Sapiens
IPISISDLE

SEQ ID NO: 997270 - protein, 9 aa, Homo Sapiens
DDLVQTLYK

SEQ ID NO: 997271 - protein, 9 aa, Homo Sapiens
TWLRGLEDS

SEQ ID NO: 997272 - protein, 9 aa, Homo Sapiens
LCQNRTLVG

SEQ ID NO: 997273 - protein, 9 aa, Homo Sapiens
RVHTQAVTE

SEQ ID NO: 997274 - protein, 9 aa, Homo Sapiens
LSSTENEGE

SEQ ID NO: 997275 - protein, 9 aa, Homo Sapiens
GFPGPPGQP

SEQ ID NO: 997276 - protein, 9 aa, Homo Sapiens
SGPSSTVPL

SEQ ID NO: 997277 - protein, 9 aa, Homo Sapiens
NIQVVLLPK

SEQ ID NO: 997278 - protein, 9 aa, Homo Sapiens
QPKGPPPPP

SEQ ID NO: 997279 - protein, 9 aa, Homo Sapiens
ITRQRYRKR

SEQ ID NO: 997280 - protein, 9 aa, Homo Sapiens
SNPGSVIIK

SEQ ID NO: 997281 - protein, 9 aa, Homo Sapiens
ALRHTEVSG

SEQ ID NO: 997282 - protein, 9 aa, Homo Sapiens
QAIGIQPRA

SEQ ID NO: 997283 - protein, 9 aa, Homo Sapiens
LSFCSAPTE

SEQ ID NO: 997284 - protein, 9 aa, Homo Sapiens
SDSEIQLKW

SEQ ID NO: 997285 - protein, 9 aa, Homo Sapiens
ADLTTKADS

SEQ ID NO: 997286 - protein, 9 aa, Homo Sapiens
KSKEPVTLD

SEQ ID NO: 997287 - protein, 9 aa, Homo Sapiens
ARYICLRFQ

SEQ ID NO: 997288 - protein, 9 aa, Homo Sapiens
LVLDIFALV

SEQ ID NO: 997289 - protein, 9 aa, Homo Sapiens
RAEKNQCEL

SEQ ID NO: 997290 - protein, 9 aa, Homo Sapiens
KFLLSTKRE

SEQ ID NO: 997291 - protein, 9 aa, Homo Sapiens
LETLSASSP

SEQ ID NO: 997292 - protein, 9 aa, Homo Sapiens
KAQSGNLEV

SEQ ID NO: 997293 - protein, 9 aa, Homo Sapiens
FPLLFEIFN

SEQ ID NO: 997294 - protein, 9 aa, Homo Sapiens
KMLVNFQFQ

SEQ ID NO: 997295 - protein, 9 aa, Homo Sapiens
KPASELGED

SEQ ID NO: 997296 - protein, 9 aa, Homo Sapiens
CGIGETPIV

SEQ ID NO: 997297 - protein, 9 aa, Homo Sapiens
SCMKKYKDT

SEQ ID NO: 997298 - protein, 9 aa, Homo Sapiens
HPEPVVVSK

SEQ ID NO: 997299 - protein, 9 aa, Homo Sapiens
HEPSTRASS

SEQ ID NO: 997300 - protein, 9 aa, Homo Sapiens
EEAISARKL

SEQ ID NO: 997301 - protein, 9 aa, Homo Sapiens
AVRQPTERG

SEQ ID NO: 997302 - protein, 9 aa, Homo Sapiens
KRISQAEIR

SEQ ID NO: 997303 - protein, 9 aa, Homo Sapiens
YLNEIQCTG

SEQ ID NO: 997304 - protein, 9 aa, Homo Sapiens
KLKTVKPID

SEQ ID NO: 997305 - protein, 9 aa, Homo Sapiens
FRYEMLDLL

SEQ ID NO: 997306 - protein, 9 aa, Homo Sapiens
ESKLTEFHV

SEQ ID NO: 997307 - protein, 9 aa, Homo Sapiens
STENEGEDP

SEQ ID NO: 997308 - protein, 9 aa, Homo Sapiens
GELLIALDN

SEQ ID NO: 997309 - protein, 9 aa, Homo Sapiens
QAWREAQRQ

SEQ ID NO: 997310 - protein, 9 aa, Homo Sapiens
FVHNNEEGL

SEQ ID NO: 997311 - protein, 9 aa, Homo Sapiens
GWHQICLLV

SEQ ID NO: 997312 - protein, 9 aa, Homo Sapiens
AAAALAAAS

SEQ ID NO: 997313 - protein, 9 aa, Homo Sapiens
SRCSKKDLE

SEQ ID NO: 997314 - protein, 9 aa, Homo Sapiens
MGGVPVSVD

SEQ ID NO: 997315 - protein, 9 aa, Homo Sapiens
TKADSGYTP

SEQ ID NO: 997316 - protein, 9 aa, Homo Sapiens
NPKSKEPVT

SEQ ID NO: 997317 - protein, 9 aa, Homo Sapiens
EAISARKLK

SEQ ID NO: 997318 - protein, 9 aa, Homo Sapiens
EEKGPQGPA

SEQ ID NO: 997319 - protein, 9 aa, Homo Sapiens
LRVHTQAVT

SEQ ID NO: 997320 - protein, 9 aa, Homo Sapiens
VIIKGLPPG

SEQ ID NO: 997321 - protein, 9 aa, Homo Sapiens
THSSVSSRL

SEQ ID NO: 997322 - protein, 9 aa, Homo Sapiens
SGPIFCQVC

SEQ ID NO: 997323 - protein, 9 aa, Homo Sapiens
IPVTFMLFP

SEQ ID NO: 997324 - protein, 9 aa, Homo Sapiens
GDHKSHRGS

SEQ ID NO: 997325 - protein, 9 aa, Homo Sapiens
FRELQAMAE

SEQ ID NO: 997326 - protein, 9 aa, Homo Sapiens
KNKKCWNFC

SEQ ID NO: 997327 - protein, 9 aa, Homo Sapiens
MNDEEDHDP

SEQ ID NO: 997328 - protein, 9 aa, Homo Sapiens
GTEGPMGPH

SEQ ID NO: 997329 - protein, 9 aa, Homo Sapiens
QSLPTKKFT

SEQ ID NO: 997330 - protein, 9 aa, Homo Sapiens
YPLPALISS

SEQ ID NO: 997331 - protein, 9 aa, Homo Sapiens
PCPRGPGTC

SEQ ID NO: 997332 - protein, 9 aa, Homo Sapiens
VRPPAKDGW

SEQ ID NO: 997333 - protein, 9 aa, Homo Sapiens
DPAWEGGGR

SEQ ID NO: 997334 - protein, 9 aa, Homo Sapiens
KYKDTFQDY

SEQ ID NO: 997335 - protein, 9 aa, Homo Sapiens
HEDVEKVYV

SEQ ID NO: 997336 - protein, 9 aa, Homo Sapiens
HHRYDDLVQ

SEQ ID NO: 997337 - protein, 9 aa, Homo Sapiens
VVSKMHKMP

SEQ ID NO: 997338 - protein, 9 aa, Homo Sapiens
PTPFFMNPI

SEQ ID NO: 997339 - protein, 9 aa, Homo Sapiens
SDTSGSSSL

SEQ ID NO: 997340 - protein, 9 aa, Homo Sapiens
KVEKMFPHC

SEQ ID NO: 997341 - protein, 9 aa, Homo Sapiens
SLKTKVFQA

SEQ ID NO: 997342 - protein, 9 aa, Homo Sapiens
EPVVVSKMH

SEQ ID NO: 997343 - protein, 9 aa, Homo Sapiens
CETCANDNL

SEQ ID NO: 997344 - protein, 9 aa, Homo Sapiens
VLYGCTVLL

SEQ ID NO: 997345 - protein, 9 aa, Homo Sapiens
TDQVAKFYD

SEQ ID NO: 997346 - protein, 9 aa, Homo Sapiens
PFWAQKRGI

SEQ ID NO: 997347 - protein, 9 aa, Homo Sapiens
VEQLTQELC

SEQ ID NO: 997348 - protein, 9 aa, Homo Sapiens
SFVQDYGFF

SEQ ID NO: 997349 - protein, 9 aa, Homo Sapiens
EFLLVTAIS

SEQ ID NO: 997350 - protein, 9 aa, Homo Sapiens
LSEDHSNRN

SEQ ID NO: 997351 - protein, 9 aa, Homo Sapiens
SYRKVRKLK

SEQ ID NO: 997352 - protein, 9 aa, Homo Sapiens
ETTYRTQVS

SEQ ID NO: 997353 - protein, 9 aa, Homo Sapiens
KTTGLYSLS

SEQ ID NO: 997354 - protein, 9 aa, Homo Sapiens
LPLYGSDGH

SEQ ID NO: 997355 - protein, 9 aa, Homo Sapiens
SHKALTRVV

SEQ ID NO: 997356 - protein, 9 aa, Homo Sapiens
TLVQEAPIS

SEQ ID NO: 997357 - protein, 9 aa, Homo Sapiens
EMFSDFHSY

SEQ ID NO: 997358 - protein, 9 aa, Homo Sapiens
CSIFYLGAM

SEQ ID NO: 997359 - protein, 9 aa, Homo Sapiens
NWDLITYRE

SEQ ID NO: 997360 - protein, 9 aa, Homo Sapiens
ANQFPDIFF

SEQ ID NO: 997361 - protein, 9 aa, Homo Sapiens
YGYDDYKPP

SEQ ID NO: 997362 - protein, 9 aa, Homo Sapiens
ASRLTFSFG

SEQ ID NO: 997363 - protein, 9 aa, Homo Sapiens
LMEKDVGLG

SEQ ID NO: 997364 - protein, 9 aa, Homo Sapiens
PVDLDKACR

SEQ ID NO: 997365 - protein, 9 aa, Homo Sapiens
CMPRWQTCI

SEQ ID NO: 997366 - protein, 9 aa, Homo Sapiens
VFEFFSQDL

SEQ ID NO: 997367 - protein, 9 aa, Homo Sapiens
ISSSKRKFS

SEQ ID NO: 997368 - protein, 9 aa, Homo Sapiens
AESNLHHHS

SEQ ID NO: 997369 - protein, 9 aa, Homo Sapiens
WSNFRSLQP

SEQ ID NO: 997370 - protein, 9 aa, Homo Sapiens
IVHELFGNS

SEQ ID NO: 997371 - protein, 9 aa, Homo Sapiens
MLIMVWVLE

SEQ ID NO: 997372 - protein, 9 aa, Homo Sapiens
QASTDTLQC

SEQ ID NO: 997373 - protein, 9 aa, Homo Sapiens
FLLSDRKFF

SEQ ID NO: 997374 - protein, 9 aa, Homo Sapiens
KEKIEDICI

SEQ ID NO: 997375 - protein, 9 aa, Homo Sapiens
LIRRVANVF

SEQ ID NO: 997376 - protein, 9 aa, Homo Sapiens
GHSLELLEP

SEQ ID NO: 997377 - protein, 9 aa, Homo Sapiens
FSSTQPELV

SEQ ID NO: 997378 - protein, 9 aa, Homo Sapiens
WKQILRIPF

SEQ ID NO: 997379 - protein, 9 aa, Homo Sapiens
GPPGSMDCH

SEQ ID NO: 997380 - protein, 9 aa, Homo Sapiens
PFKCKDCKK

SEQ ID NO: 997381 - protein, 9 aa, Homo Sapiens
SWFECVSML

SEQ ID NO: 997382 - protein, 9 aa, Homo Sapiens
GNRDILCKA

SEQ ID NO: 997383 - protein, 9 aa, Homo Sapiens
VPSTHLIKV

SEQ ID NO: 997384 - protein, 9 aa, Homo Sapiens
GEETLIMIV

SEQ ID NO: 997385 - protein, 9 aa, Homo Sapiens
NVSCSQLDT

SEQ ID NO: 997386 - protein, 9 aa, Homo Sapiens
FCGNSPEMR

SEQ ID NO: 997387 - protein, 9 aa, Homo Sapiens
KKQELFFFH

SEQ ID NO: 997388 - protein, 9 aa, Homo Sapiens
LYGTKKSCM

SEQ ID NO: 997389 - protein, 9 aa, Homo Sapiens
QQFFSHHMF

SEQ ID NO: 997390 - protein, 9 aa, Homo Sapiens
LNTLANVPD

SEQ ID NO: 997391 - protein, 9 aa, Homo Sapiens
HYNSENIKA

SEQ ID NO: 997392 - protein, 9 aa, Homo Sapiens
TKKFKFRGF

SEQ ID NO: 997393 - protein, 9 aa, Homo Sapiens
YASVAYQNQ

SEQ ID NO: 997394 - protein, 9 aa, Homo Sapiens
AFTARVLSG

SEQ ID NO: 997395 - protein, 9 aa, Homo Sapiens
DFRQNPLDV

SEQ ID NO: 997396 - protein, 9 aa, Homo Sapiens
KVLIVRSTT

SEQ ID NO: 997397 - protein, 9 aa, Homo Sapiens
TECDFHPLP

SEQ ID NO: 997398 - protein, 9 aa, Homo Sapiens
YNGGNCKEF

SEQ ID NO: 997399 - protein, 9 aa, Homo Sapiens
YTTVCREFM

SEQ ID NO: 997400 - protein, 9 aa, Homo Sapiens
IAQFLSDIL

SEQ ID NO: 997401 - protein, 9 aa, Homo Sapiens
CIKMVCNSW

SEQ ID NO: 997402 - protein, 9 aa, Homo Sapiens
KLKKHPIFF

SEQ ID NO: 997403 - protein, 9 aa, Homo Sapiens
RRCYVKCHR

SEQ ID NO: 997404 - protein, 9 aa, Homo Sapiens
AGAIELLKI

SEQ ID NO: 997405 - protein, 9 aa, Homo Sapiens
GPKEERGDQ

SEQ ID NO: 997406 - protein, 9 aa, Homo Sapiens
LDKSIVIRL

SEQ ID NO: 997407 - protein, 9 aa, Homo Sapiens
NSTRHEPMY

SEQ ID NO: 997408 - protein, 9 aa, Homo Sapiens
YQFPYAHPL

SEQ ID NO: 997409 - protein, 9 aa, Homo Sapiens
SSTLALPVA

SEQ ID NO: 997410 - protein, 9 aa, Homo Sapiens
PSPYELSYP

SEQ ID NO: 997411 - protein, 9 aa, Homo Sapiens
FCICRMATE

SEQ ID NO: 997412 - protein, 9 aa, Homo Sapiens
VFSSYLAVR

SEQ ID NO: 997413 - protein, 9 aa, Homo Sapiens
SKKTMNVAS

SEQ ID NO: 997414 - protein, 9 aa, Homo Sapiens
ASIITDYNK

SEQ ID NO: 997415 - protein, 9 aa, Homo Sapiens
KEERGDQGI

SEQ ID NO: 997416 - protein, 9 aa, Homo Sapiens
ISGDSFSYR

SEQ ID NO: 997417 - protein, 9 aa, Homo Sapiens
EPVFPPRLD

SEQ ID NO: 997418 - protein, 9 aa, Homo Sapiens
FTQATVRDA

SEQ ID NO: 997419 - protein, 9 aa, Homo Sapiens
KAHKIMKDL

SEQ ID NO: 997420 - protein, 9 aa, Homo Sapiens
QTKMEGEPQ

SEQ ID NO: 997421 - protein, 9 aa, Homo Sapiens
GRRKFVDQP

SEQ ID NO: 997422 - protein, 9 aa, Homo Sapiens
PTVIYVFPV

SEQ ID NO: 997423 - protein, 9 aa, Homo Sapiens
IKLKKHPIF

SEQ ID NO: 997424 - protein, 9 aa, Homo Sapiens
GNLSTILPT

SEQ ID NO: 997425 - protein, 9 aa, Homo Sapiens
AHVDGIPAS

SEQ ID NO: 997426 - protein, 9 aa, Homo Sapiens
RHILSAELE

SEQ ID NO: 997427 - protein, 9 aa, Homo Sapiens
WLRPDVFSK

SEQ ID NO: 997428 - protein, 9 aa, Homo Sapiens
MAAKFSSGS

SEQ ID NO: 997429 - protein, 9 aa, Homo Sapiens
PNSFSSAGR

SEQ ID NO: 997430 - protein, 9 aa, Homo Sapiens
IFTEKPTVP

SEQ ID NO: 997431 - protein, 9 aa, Homo Sapiens
KELDFESSP

SEQ ID NO: 997432 - protein, 9 aa, Homo Sapiens
SYYNSLKDC

SEQ ID NO: 997433 - protein, 9 aa, Homo Sapiens
GSLVEFYRT

SEQ ID NO: 997434 - protein, 9 aa, Homo Sapiens
PGALASRGS

SEQ ID NO: 997435 - protein, 9 aa, Homo Sapiens
MQPIYEVLR

SEQ ID NO: 997436 - protein, 9 aa, Homo Sapiens
TSKLAAERN

SEQ ID NO: 997437 - protein, 9 aa, Homo Sapiens
LFSKARWLA

SEQ ID NO: 997438 - protein, 9 aa, Homo Sapiens
ESPKSDCND

SEQ ID NO: 997439 - protein, 9 aa, Homo Sapiens
ALFLLLLNI

SEQ ID NO: 997440 - protein, 9 aa, Homo Sapiens
HGPEKKISF

SEQ ID NO: 997441 - protein, 9 aa, Homo Sapiens
LEPPGILAP

SEQ ID NO: 997442 - protein, 9 aa, Homo Sapiens
FDLDSWTLR

SEQ ID NO: 997443 - protein, 9 aa, Homo Sapiens
TLNLGVMVL

SEQ ID NO: 997444 - protein, 9 aa, Homo Sapiens
FEFFSQDLK

SEQ ID NO: 997445 - protein, 9 aa, Homo Sapiens
PLEAPGEVV

SEQ ID NO: 997446 - protein, 9 aa, Homo Sapiens
DRKRNRMHN

SEQ ID NO: 997447 - protein, 9 aa, Homo Sapiens
YSLWTAYQN

SEQ ID NO: 997448 - protein, 9 aa, Homo Sapiens
LMRDCALAA

SEQ ID NO: 997449 - protein, 9 aa, Homo Sapiens
ITLSEDHSN

SEQ ID NO: 997450 - protein, 9 aa, Homo Sapiens
SKQCASVGV

SEQ ID NO: 997451 - protein, 9 aa, Homo Sapiens
HQAPISTVK

SEQ ID NO: 997452 - protein, 9 aa, Homo Sapiens
EAPLVEFSA

SEQ ID NO: 997453 - protein, 9 aa, Homo Sapiens
RSWCRSSGL

SEQ ID NO: 997454 - protein, 9 aa, Homo Sapiens
PRDVQYLLY

SEQ ID NO: 997455 - protein, 9 aa, Homo Sapiens
DPLRPEKGR

SEQ ID NO: 997456 - protein, 9 aa, Homo Sapiens
KPVCLNVKY

SEQ ID NO: 997457 - protein, 9 aa, Homo Sapiens
PLGFGPGVP

SEQ ID NO: 997458 - protein, 9 aa, Homo Sapiens
TPVARDVVL

SEQ ID NO: 997459 - protein, 9 aa, Homo Sapiens
SYATAPTQE

SEQ ID NO: 997460 - protein, 9 aa, Homo Sapiens
WEVEETRTS

SEQ ID NO: 997461 - protein, 9 aa, Homo Sapiens
DSQVLLEEE

SEQ ID NO: 997462 - protein, 9 aa, Homo Sapiens
LIYSVRGDE

SEQ ID NO: 997463 - protein, 9 aa, Homo Sapiens
EEDNDEFFM

SEQ ID NO: 997464 - protein, 9 aa, Homo Sapiens
RRCYTMQKV

SEQ ID NO: 997465 - protein, 9 aa, Homo Sapiens
FINEAEGNK

SEQ ID NO: 997466 - protein, 9 aa, Homo Sapiens
VVNRQMMMK

SEQ ID NO: 997467 - protein, 9 aa, Homo Sapiens
PDKVLIVRS

SEQ ID NO: 997468 - protein, 9 aa, Homo Sapiens
NNSGTSKDH

SEQ ID NO: 997469 - protein, 9 aa, Homo Sapiens
IFLRLRAGR

SEQ ID NO: 997470 - protein, 9 aa, Homo Sapiens
AERNLNVTI

SEQ ID NO: 997471 - protein, 9 aa, Homo Sapiens
LRGAGAIEL

SEQ ID NO: 997472 - protein, 9 aa, Homo Sapiens
LMVVMKVNS

SEQ ID NO: 997473 - protein, 9 aa, Homo Sapiens
KKSCMPRWQ

SEQ ID NO: 997474 - protein, 9 aa, Homo Sapiens
PEQSTENYS

SEQ ID NO: 997475 - protein, 9 aa, Homo Sapiens
SCAYKPTQG

SEQ ID NO: 997476 - protein, 9 aa, Homo Sapiens
CGNSPEMRV

SEQ ID NO: 997477 - protein, 9 aa, Homo Sapiens
KKVAGPAVL

SEQ ID NO: 997478 - protein, 9 aa, Homo Sapiens
LFVMGTSEK

SEQ ID NO: 997479 - protein, 9 aa, Homo Sapiens
VYCDMKTDG

SEQ ID NO: 997480 - protein, 9 aa, Homo Sapiens
LQPLAPWNK

SEQ ID NO: 997481 - protein, 9 aa, Homo Sapiens
APNPSNGAE

SEQ ID NO: 997482 - protein, 9 aa, Homo Sapiens
KEWTCSSSL

SEQ ID NO: 997483 - protein, 9 aa, Homo Sapiens
ERLLSAIES

SEQ ID NO: 997484 - protein, 9 aa, Homo Sapiens
GPPEPRGPP

SEQ ID NO: 997485 - protein, 9 aa, Homo Sapiens
GNRNKTPSD

SEQ ID NO: 997486 - protein, 9 aa, Homo Sapiens
WLNGSLVEF

SEQ ID NO: 997487 - protein, 9 aa, Homo Sapiens
KAKNAQTIT

SEQ ID NO: 997488 - protein, 9 aa, Homo Sapiens
PPGKMCNAD

SEQ ID NO: 997489 - protein, 9 aa, Homo Sapiens
CASVGVSQV

SEQ ID NO: 997490 - protein, 9 aa, Homo Sapiens
PMCFYQMER

SEQ ID NO: 997491 - protein, 9 aa, Homo Sapiens
AAWLAKIRL

SEQ ID NO: 997492 - protein, 9 aa, Homo Sapiens
YKGNIWKQI

SEQ ID NO: 997493 - protein, 9 aa, Homo Sapiens
TLRVVQKDE

SEQ ID NO: 997494 - protein, 9 aa, Homo Sapiens
MFTDFLLFM

SEQ ID NO: 997495 - protein, 9 aa, Homo Sapiens
KNFLDLILS

SEQ ID NO: 997496 - protein, 9 aa, Homo Sapiens
SSLSLPRSC

SEQ ID NO: 997497 - protein, 9 aa, Homo Sapiens
SQRAIFFAG

SEQ ID NO: 997498 - protein, 9 aa, Homo Sapiens
DSPEGLQHS

SEQ ID NO: 997499 - protein, 9 aa, Homo Sapiens
EKRILALAQ

SEQ ID NO: 997500 - protein, 9 aa, Homo Sapiens
PPALRPRVG

SEQ ID NO: 997501 - protein, 9 aa, Homo Sapiens
NLKHESAKA

SEQ ID NO: 997502 - protein, 9 aa, Homo Sapiens
SKSFKSSGS

SEQ ID NO: 997503 - protein, 9 aa, Homo Sapiens
AIGLHLWAA

SEQ ID NO: 997504 - protein, 9 aa, Homo Sapiens
LVDENLKKQ

SEQ ID NO: 997505 - protein, 9 aa, Homo Sapiens
SGNTGKSKK

SEQ ID NO: 997506 - protein, 9 aa, Homo Sapiens
KPVLTYQRN

SEQ ID NO: 997507 - protein, 9 aa, Homo Sapiens
RHQLQGHLT

SEQ ID NO: 997508 - protein, 9 aa, Homo Sapiens
VGDSDDEQK

SEQ ID NO: 997509 - protein, 9 aa, Homo Sapiens
ELNHLKNKV

SEQ ID NO: 997510 - protein, 9 aa, Homo Sapiens
DSNDNSPEL

SEQ ID NO: 997511 - protein, 9 aa, Homo Sapiens
SPARQRAVS

SEQ ID NO: 997512 - protein, 9 aa, Homo Sapiens
PELVPGKAQ

SEQ ID NO: 997513 - protein, 9 aa, Homo Sapiens
LSYNVDSLY

SEQ ID NO: 997514 - protein, 9 aa, Homo Sapiens
LPPGKMCNA

SEQ ID NO: 997515 - protein, 9 aa, Homo Sapiens
QPTQRCMGY

SEQ ID NO: 997516 - protein, 9 aa, Homo Sapiens
LDSDLLMTS

SEQ ID NO: 997517 - protein, 9 aa, Homo Sapiens
PPKTTAAPP

SEQ ID NO: 997518 - protein, 9 aa, Homo Sapiens
KKIPRDLPP

SEQ ID NO: 997519 - protein, 9 aa, Homo Sapiens
VFVRRGFRG

SEQ ID NO: 997520 - protein, 9 aa, Homo Sapiens
ILNNTQEAA

SEQ ID NO: 997521 - protein, 9 aa, Homo Sapiens
RISLLLLLV

SEQ ID NO: 997522 - protein, 9 aa, Homo Sapiens
RHLGDGTYG

SEQ ID NO: 997523 - protein, 9 aa, Homo Sapiens
VNWRPEVER

SEQ ID NO: 997524 - protein, 9 aa, Homo Sapiens
LCWPLEAPG

SEQ ID NO: 997525 - protein, 9 aa, Homo Sapiens
EGDALTLQC

SEQ ID NO: 997526 - protein, 9 aa, Homo Sapiens
MRFWRSPNS

SEQ ID NO: 997527 - protein, 9 aa, Homo Sapiens
VTVPEVQKK

SEQ ID NO: 997528 - protein, 9 aa, Homo Sapiens
CQKGHAHCQ

SEQ ID NO: 997529 - protein, 9 aa, Homo Sapiens
TSTLTFNIP

SEQ ID NO: 997530 - protein, 9 aa, Homo Sapiens
YFDEDDSFT

SEQ ID NO: 997531 - protein, 9 aa, Homo Sapiens
SLQEGATRG

SEQ ID NO: 997532 - protein, 9 aa, Homo Sapiens
LPPKKVVPE

SEQ ID NO: 997533 - protein, 9 aa, Homo Sapiens
ELLRKLQVD

SEQ ID NO: 997534 - protein, 9 aa, Homo Sapiens
FTDFLLFMV

SEQ ID NO: 997535 - protein, 9 aa, Homo Sapiens
IREESLIIC

SEQ ID NO: 997536 - protein, 9 aa, Homo Sapiens
SVKTCEVGA

SEQ ID NO: 997537 - protein, 9 aa, Homo Sapiens
VHVDNSRDF

SEQ ID NO: 997538 - protein, 9 aa, Homo Sapiens
RIAKDEIFS

SEQ ID NO: 997539 - protein, 9 aa, Homo Sapiens
YCDMKTDGG

SEQ ID NO: 997540 - protein, 9 aa, Homo Sapiens
GRARTAAAP

SEQ ID NO: 997541 - protein, 9 aa, Homo Sapiens
GIPPLGFGP

SEQ ID NO: 997542 - protein, 9 aa, Homo Sapiens
LTTCPRPLT

SEQ ID NO: 997543 - protein, 9 aa, Homo Sapiens
QKYNEVMAT

SEQ ID NO: 997544 - protein, 9 aa, Homo Sapiens
WLLSIVRPG

SEQ ID NO: 997545 - protein, 9 aa, Homo Sapiens
GRQRTCDIC

SEQ ID NO: 997546 - protein, 9 aa, Homo Sapiens
ATLLSQVSL

SEQ ID NO: 997547 - protein, 9 aa, Homo Sapiens
PKLLAQQHS

SEQ ID NO: 997548 - protein, 9 aa, Homo Sapiens
ELANAKGLG

SEQ ID NO: 997549 - protein, 9 aa, Homo Sapiens
AYSPSDAFK

SEQ ID NO: 997550 - protein, 9 aa, Homo Sapiens
ALEKSYDIL

SEQ ID NO: 997551 - protein, 9 aa, Homo Sapiens
GVVDLITTC

SEQ ID NO: 997552 - protein, 9 aa, Homo Sapiens
PNGAVPGAL

SEQ ID NO: 997553 - protein, 9 aa, Homo Sapiens
RVVQKDENS

SEQ ID NO: 997554 - protein, 9 aa, Homo Sapiens
PPLGIPPLG

SEQ ID NO: 997555 - protein, 9 aa, Homo Sapiens
SGTDLLNDL

SEQ ID NO: 997556 - protein, 9 aa, Homo Sapiens
TKVSFAHKP

SEQ ID NO: 997557 - protein, 9 aa, Homo Sapiens
IHVILAWST

SEQ ID NO: 997558 - protein, 9 aa, Homo Sapiens
TATFKDGQE

SEQ ID NO: 997559 - protein, 9 aa, Homo Sapiens
SSKRKFSME

SEQ ID NO: 997560 - protein, 9 aa, Homo Sapiens
HILSVHNSA

SEQ ID NO: 997561 - protein, 9 aa, Homo Sapiens
SSGSQRARV

SEQ ID NO: 997562 - protein, 9 aa, Homo Sapiens
WAPLSHGFK

SEQ ID NO: 997563 - protein, 9 aa, Homo Sapiens
DGEDPGNLQ

SEQ ID NO: 997564 - protein, 9 aa, Homo Sapiens
QEALHLTGM

SEQ ID NO: 997565 - protein, 9 aa, Homo Sapiens
TAGFETTTV

SEQ ID NO: 997566 - protein, 9 aa, Homo Sapiens
REAEHEGVF

SEQ ID NO: 997567 - protein, 9 aa, Homo Sapiens
LRQDMAHSN

SEQ ID NO: 997568 - protein, 9 aa, Homo Sapiens
LPFVLCQGV

SEQ ID NO: 997569 - protein, 9 aa, Homo Sapiens
AELANAKGL

SEQ ID NO: 997570 - protein, 9 aa, Homo Sapiens
LAEALPQRK

SEQ ID NO: 997571 - protein, 9 aa, Homo Sapiens
RCRSGFGLG

SEQ ID NO: 997572 - protein, 9 aa, Homo Sapiens
TTFFGMSSF

SEQ ID NO: 997573 - protein, 9 aa, Homo Sapiens
AAVYVMEIN

SEQ ID NO: 997574 - protein, 9 aa, Homo Sapiens
PSTLKYHKK

SEQ ID NO: 997575 - protein, 9 aa, Homo Sapiens
KKKAHKIMK

SEQ ID NO: 997576 - protein, 9 aa, Homo Sapiens
NCAAERNPA

SEQ ID NO: 997577 - protein, 9 aa, Homo Sapiens
NAVLEELPM

SEQ ID NO: 997578 - protein, 9 aa, Homo Sapiens
IAKDEIFSA

SEQ ID NO: 997579 - protein, 9 aa, Homo Sapiens
YQKHQRAKR

SEQ ID NO: 997580 - protein, 9 aa, Homo Sapiens
TSQPDKVLI

SEQ ID NO: 997581 - protein, 9 aa, Homo Sapiens
LQEAVLARQ

SEQ ID NO: 997582 - protein, 9 aa, Homo Sapiens
FLAAMGFDR

SEQ ID NO: 997583 - protein, 9 aa, Homo Sapiens
PLSFGKSQP

SEQ ID NO: 997584 - protein, 9 aa, Homo Sapiens
LERVMHGEA

SEQ ID NO: 997585 - protein, 9 aa, Homo Sapiens
ALVLAQVLG

SEQ ID NO: 997586 - protein, 9 aa, Homo Sapiens
ALSIMRSMK

SEQ ID NO: 997587 - protein, 9 aa, Homo Sapiens
LLFEDELVY

SEQ ID NO: 997588 - protein, 9 aa, Homo Sapiens
LSQVSLFKI

SEQ ID NO: 997589 - protein, 9 aa, Homo Sapiens
TLLSQVSLF

SEQ ID NO: 997590 - protein, 9 aa, Homo Sapiens
STSSSKIVA

SEQ ID NO: 997591 - protein, 9 aa, Homo Sapiens
YQKTHSGER

SEQ ID NO: 997592 - protein, 9 aa, Homo Sapiens
AMLKAEKTC

SEQ ID NO: 997593 - protein, 9 aa, Homo Sapiens
PSPSSNETP

SEQ ID NO: 997594 - protein, 9 aa, Homo Sapiens
ENGFLFKDE

SEQ ID NO: 997595 - protein, 9 aa, Homo Sapiens
IGRKLERNE

SEQ ID NO: 997596 - protein, 9 aa, Homo Sapiens
RKRQAPLAT

SEQ ID NO: 997597 - protein, 9 aa, Homo Sapiens
SWACTNCFF

SEQ ID NO: 997598 - protein, 9 aa, Homo Sapiens
RLLSISPTA

SEQ ID NO: 997599 - protein, 9 aa, Homo Sapiens
TCGDCPDSI

SEQ ID NO: 997600 - protein, 9 aa, Homo Sapiens
LRCKEWLAG

SEQ ID NO: 997601 - protein, 9 aa, Homo Sapiens
RELLRKLQV

SEQ ID NO: 997602 - protein, 9 aa, Homo Sapiens
TFQKGPVDK

SEQ ID NO: 997603 - protein, 9 aa, Homo Sapiens
GSPRIQESC

SEQ ID NO: 997604 - protein, 9 aa, Homo Sapiens
NYITFWGAC

SEQ ID NO: 997605 - protein, 9 aa, Homo Sapiens
NVELKFNLN

SEQ ID NO: 997606 - protein, 9 aa, Homo Sapiens
VSRAQAVVG

SEQ ID NO: 997607 - protein, 9 aa, Homo Sapiens
RPDVFSKAQ

SEQ ID NO: 997608 - protein, 9 aa, Homo Sapiens
TARVLSGSD

SEQ ID NO: 997609 - protein, 9 aa, Homo Sapiens
SVGRMLRYI

SEQ ID NO: 997610 - protein, 9 aa, Homo Sapiens
SSRYPPQQQ

SEQ ID NO: 997611 - protein, 9 aa, Homo Sapiens
NKVQVVEDI

SEQ ID NO: 997612 - protein, 9 aa, Homo Sapiens
CSTSIFLRL

SEQ ID NO: 997613 - protein, 9 aa, Homo Sapiens
PTVPRISWT

SEQ ID NO: 997614 - protein, 9 aa, Homo Sapiens
IFYGIRRLI

SEQ ID NO: 997615 - protein, 9 aa, Homo Sapiens
DYGDSVEVG

SEQ ID NO: 997616 - protein, 9 aa, Homo Sapiens
KDCSLPVGE

SEQ ID NO: 997617 - protein, 9 aa, Homo Sapiens
ALKVKKEAP

SEQ ID NO: 997618 - protein, 9 aa, Homo Sapiens
GIVPMCFYQ

SEQ ID NO: 997619 - protein, 9 aa, Homo Sapiens
GEPGPPEPR

SEQ ID NO: 997620 - protein, 9 aa, Homo Sapiens
NLVDENLKK

SEQ ID NO: 997621 - protein, 9 aa, Homo Sapiens
ADAIIKLQL

SEQ ID NO: 997622 - protein, 9 aa, Homo Sapiens
QWSNFRSLQ

SEQ ID NO: 997623 - protein, 9 aa, Homo Sapiens
SLVFNISDG

SEQ ID NO: 997624 - protein, 9 aa, Homo Sapiens
EGWNKYQDH

SEQ ID NO: 997625 - protein, 9 aa, Homo Sapiens
LPSPSSNET

SEQ ID NO: 997626 - protein, 9 aa, Homo Sapiens
FVSINIGMV

SEQ ID NO: 997627 - protein, 9 aa, Homo Sapiens
DPEVMPFWA

SEQ ID NO: 997628 - protein, 9 aa, Homo Sapiens
KTPCQQVLA

SEQ ID NO: 997629 - protein, 9 aa, Homo Sapiens
KEILLGCGF

SEQ ID NO: 997630 - protein, 9 aa, Homo Sapiens
VSYEWTDGI

SEQ ID NO: 997631 - protein, 9 aa, Homo Sapiens
QFDPVSYEW

SEQ ID NO: 997632 - protein, 9 aa, Homo Sapiens
QSEETSSTF

SEQ ID NO: 997633 - protein, 9 aa, Homo Sapiens
LAEMEQKVA

SEQ ID NO: 997634 - protein, 9 aa, Homo Sapiens
IHSWRTFQR

SEQ ID NO: 997635 - protein, 9 aa, Homo Sapiens
LESYEAEIF

SEQ ID NO: 997636 - protein, 9 aa, Homo Sapiens
PPGEPGPPE

SEQ ID NO: 997637 - protein, 9 aa, Homo Sapiens
FVEEGRKQL

SEQ ID NO: 997638 - protein, 9 aa, Homo Sapiens
LRWGDPELI

SEQ ID NO: 997639 - protein, 9 aa, Homo Sapiens
ALASGQWGL

SEQ ID NO: 997640 - protein, 9 aa, Homo Sapiens
LCKPVLTYQ

SEQ ID NO: 997641 - protein, 9 aa, Homo Sapiens
SECEKLFSC

SEQ ID NO: 997642 - protein, 9 aa, Homo Sapiens
GWHGEEKVV

SEQ ID NO: 997643 - protein, 9 aa, Homo Sapiens
HEAQLLEMR

SEQ ID NO: 997644 - protein, 9 aa, Homo Sapiens
EPPAPSPPL

SEQ ID NO: 997645 - protein, 9 aa, Homo Sapiens
TDYNKEGLL

SEQ ID NO: 997646 - protein, 9 aa, Homo Sapiens
VRLPSLIGQ

SEQ ID NO: 997647 - protein, 9 aa, Homo Sapiens
PQAPPQQFS

SEQ ID NO: 997648 - protein, 9 aa, Homo Sapiens
RKILSFFGE

SEQ ID NO: 997649 - protein, 9 aa, Homo Sapiens
YLARMAMVL

SEQ ID NO: 997650 - protein, 9 aa, Homo Sapiens
HLKKQQETI

SEQ ID NO: 997651 - protein, 9 aa, Homo Sapiens
FKDLLGKPP

SEQ ID NO: 997652 - protein, 9 aa, Homo Sapiens
SQRRKRQAP

SEQ ID NO: 997653 - protein, 9 aa, Homo Sapiens
LLGSTLGFH

SEQ ID NO: 997654 - protein, 9 aa, Homo Sapiens
DLDENGFLF

SEQ ID NO: 997655 - protein, 9 aa, Homo Sapiens
TVQEDLCVS

SEQ ID NO: 997656 - protein, 9 aa, Homo Sapiens
PPPFSPMGL

SEQ ID NO: 997657 - protein, 9 aa, Homo Sapiens
ATKLFGRIL

SEQ ID NO: 997658 - protein, 9 aa, Homo Sapiens
AYICLFTCV

SEQ ID NO: 997659 - protein, 9 aa, Homo Sapiens
KLRTKNEYS

SEQ ID NO: 997660 - protein, 9 aa, Homo Sapiens
NYYIFCLLP

SEQ ID NO: 997661 - protein, 9 aa, Homo Sapiens
SSHKALTRV

SEQ ID NO: 997662 - protein, 9 aa, Homo Sapiens
RQEHGPEKK

SEQ ID NO: 997663 - protein, 9 aa, Homo Sapiens
QTQGKDCSL

SEQ ID NO: 997664 - protein, 9 aa, Homo Sapiens
CDSISGHAT

SEQ ID NO: 997665 - protein, 9 aa, Homo Sapiens
PRQRASQDT

SEQ ID NO: 997666 - protein, 9 aa, Homo Sapiens
VKPVSSEIY

SEQ ID NO: 997667 - protein, 9 aa, Homo Sapiens
CRSSGLPNR

SEQ ID NO: 997668 - protein, 9 aa, Homo Sapiens
AGRQRTCDI

SEQ ID NO: 997669 - protein, 9 aa, Homo Sapiens
CEEQPEIRL

SEQ ID NO: 997670 - protein, 9 aa, Homo Sapiens
LKKQQETID

SEQ ID NO: 997671 - protein, 9 aa, Homo Sapiens
DILETVPLS

SEQ ID NO: 997672 - protein, 9 aa, Homo Sapiens
MAITANLVM

SEQ ID NO: 997673 - protein, 9 aa, Homo Sapiens
LVEFYRTTY

SEQ ID NO: 997674 - protein, 9 aa, Homo Sapiens
DVGFCGNSP

SEQ ID NO: 997675 - protein, 9 aa, Homo Sapiens
ATEEDNDEF

SEQ ID NO: 997676 - protein, 9 aa, Homo Sapiens
YEMLAGQAS

SEQ ID NO: 997677 - protein, 9 aa, Homo Sapiens
PSPPLPYCG

SEQ ID NO: 997678 - protein, 9 aa, Homo Sapiens
DRCEATKYY

SEQ ID NO: 997679 - protein, 9 aa, Homo Sapiens
PFLACPFST

SEQ ID NO: 997680 - protein, 9 aa, Homo Sapiens
KARRLQGSG

SEQ ID NO: 997681 - protein, 9 aa, Homo Sapiens
AAVCGSGAR

SEQ ID NO: 997682 - protein, 9 aa, Homo Sapiens
KVTPFSMSC

SEQ ID NO: 997683 - protein, 9 aa, Homo Sapiens
LSHGFKEKA

SEQ ID NO: 997684 - protein, 9 aa, Homo Sapiens
RNEQLTRER

SEQ ID NO: 997685 - protein, 9 aa, Homo Sapiens
GGAVSKLVP

SEQ ID NO: 997686 - protein, 9 aa, Homo Sapiens
KRPNPAAPM

SEQ ID NO: 997687 - protein, 9 aa, Homo Sapiens
QLQGRTDGA

SEQ ID NO: 997688 - protein, 9 aa, Homo Sapiens
ELPMMRRAF

SEQ ID NO: 997689 - protein, 9 aa, Homo Sapiens
NKLSPQGKR

SEQ ID NO: 997690 - protein, 9 aa, Homo Sapiens
AQTITFQQF

SEQ ID NO: 997691 - protein, 9 aa, Homo Sapiens
KADEPLSEE

SEQ ID NO: 997692 - protein, 9 aa, Homo Sapiens
QQHSPPDRQ

SEQ ID NO: 997693 - protein, 9 aa, Homo Sapiens
QVSHEKPPN

SEQ ID NO: 997694 - protein, 9 aa, Homo Sapiens
VNGHISGDS

SEQ ID NO: 997695 - protein, 9 aa, Homo Sapiens
DQLEISVTV

SEQ ID NO: 997696 - protein, 9 aa, Homo Sapiens
QQKNTSPTD

SEQ ID NO: 997697 - protein, 9 aa, Homo Sapiens
SQFSKEKRV

SEQ ID NO: 997698 - protein, 9 aa, Homo Sapiens
YNEVMATYI

SEQ ID NO: 997699 - protein, 9 aa, Homo Sapiens
TSSSKIVAP

SEQ ID NO: 997700 - protein, 9 aa, Homo Sapiens
ILHMFTSKL

SEQ ID NO: 997701 - protein, 9 aa, Homo Sapiens
EKIMKLTLP

SEQ ID NO: 997702 - protein, 9 aa, Homo Sapiens
SRAAAVYVM

SEQ ID NO: 997703 - protein, 9 aa, Homo Sapiens
VKQTKMEGE

SEQ ID NO: 997704 - protein, 9 aa, Homo Sapiens
DKQAQTPKT

SEQ ID NO: 997705 - protein, 9 aa, Homo Sapiens
HKSYARSDT

SEQ ID NO: 997706 - protein, 9 aa, Homo Sapiens
AVADSIPKV

SEQ ID NO: 997707 - protein, 9 aa, Homo Sapiens
SGHNINVIQ

SEQ ID NO: 997708 - protein, 9 aa, Homo Sapiens
GHYRLVRFE

SEQ ID NO: 997709 - protein, 9 aa, Homo Sapiens
EACISWFGS

SEQ ID NO: 997710 - protein, 9 aa, Homo Sapiens
APRDVQYLL

SEQ ID NO: 997711 - protein, 9 aa, Homo Sapiens
RKLERNEQL

SEQ ID NO: 997712 - protein, 9 aa, Homo Sapiens
KWPSTLKYH

SEQ ID NO: 997713 - protein, 9 aa, Homo Sapiens
TSPTDSPSK

SEQ ID NO: 997714 - protein, 9 aa, Homo Sapiens
NSEFLCVND

SEQ ID NO: 997715 - protein, 9 aa, Homo Sapiens
EMEQKVAEQ

SEQ ID NO: 997716 - protein, 9 aa, Homo Sapiens
GAAWAELSL

SEQ ID NO: 997717 - protein, 9 aa, Homo Sapiens
LIGNLLILL

SEQ ID NO: 997718 - protein, 9 aa, Homo Sapiens
AFLSIHGMC

SEQ ID NO: 997719 - protein, 9 aa, Homo Sapiens
CGSGARRFS

SEQ ID NO: 997720 - protein, 9 aa, Homo Sapiens
WKAMFARFT

SEQ ID NO: 997721 - protein, 9 aa, Homo Sapiens
EEAPLVEFS

SEQ ID NO: 997722 - protein, 9 aa, Homo Sapiens
AMVLGATLR

SEQ ID NO: 997723 - protein, 9 aa, Homo Sapiens
ESIPAPPPP

SEQ ID NO: 997724 - protein, 9 aa, Homo Sapiens
NIFGFSQSP

SEQ ID NO: 997725 - protein, 9 aa, Homo Sapiens
TSYLDIANQ

SEQ ID NO: 997726 - protein, 9 aa, Homo Sapiens
IKALSKDLL

SEQ ID NO: 997727 - protein, 9 aa, Homo Sapiens
GWLNGSLVE

SEQ ID NO: 997728 - protein, 9 aa, Homo Sapiens
GSNFQVNSL

SEQ ID NO: 997729 - protein, 9 aa, Homo Sapiens
GCVQALTLA

SEQ ID NO: 997730 - protein, 9 aa, Homo Sapiens
DQKTEKSPP

SEQ ID NO: 997731 - protein, 9 aa, Homo Sapiens
IKNLRKRRD

SEQ ID NO: 997732 - protein, 9 aa, Homo Sapiens
TPETSQPSP

SEQ ID NO: 997733 - protein, 9 aa, Homo Sapiens
EHGPEKKIS

SEQ ID NO: 997734 - protein, 9 aa, Homo Sapiens
LRLGLLGAL

SEQ ID NO: 997735 - protein, 9 aa, Homo Sapiens
AHMHLKKQQ

SEQ ID NO: 997736 - protein, 9 aa, Homo Sapiens
LKNIFGFSQ

SEQ ID NO: 997737 - protein, 9 aa, Homo Sapiens
SKPKWPPEN

SEQ ID NO: 997738 - protein, 9 aa, Homo Sapiens
WEVIYGSHF

SEQ ID NO: 997739 - protein, 9 aa, Homo Sapiens
KYKEKIEDI

SEQ ID NO: 997740 - protein, 9 aa, Homo Sapiens
QAPSLLLSS

SEQ ID NO: 997741 - protein, 9 aa, Homo Sapiens
QMKWRELEG

SEQ ID NO: 997742 - protein, 9 aa, Homo Sapiens
ADQSVRKGI

SEQ ID NO: 997743 - protein, 9 aa, Homo Sapiens
TYSCAYKPT

SEQ ID NO: 997744 - protein, 9 aa, Homo Sapiens
GCKIGPSIF

SEQ ID NO: 997745 - protein, 9 aa, Homo Sapiens
KIEDICISA

SEQ ID NO: 997746 - protein, 9 aa, Homo Sapiens
SFPSSAPSG

SEQ ID NO: 997747 - protein, 9 aa, Homo Sapiens
NQKIVTNNN

SEQ ID NO: 997748 - protein, 9 aa, Homo Sapiens
YFLSQRIPL

SEQ ID NO: 997749 - protein, 9 aa, Homo Sapiens
ISGSEASSR

SEQ ID NO: 997750 - protein, 9 aa, Homo Sapiens
SAAVAPKNM

SEQ ID NO: 997751 - protein, 9 aa, Homo Sapiens
RAYQSERFL

SEQ ID NO: 997752 - protein, 9 aa, Homo Sapiens
CIYRLTCIY

SEQ ID NO: 997753 - protein, 9 aa, Homo Sapiens
PRFSVCQLR

SEQ ID NO: 997754 - protein, 9 aa, Homo Sapiens
PKNMIFYGF

SEQ ID NO: 997755 - protein, 9 aa, Homo Sapiens
LALPVASPS

SEQ ID NO: 997756 - protein, 9 aa, Homo Sapiens
LSLNHEIEE

SEQ ID NO: 997757 - protein, 9 aa, Homo Sapiens
VRYCQGFNI

SEQ ID NO: 997758 - protein, 9 aa, Homo Sapiens
MRLAVTNKE

SEQ ID NO: 997759 - protein, 9 aa, Homo Sapiens
DEVDCISEW

SEQ ID NO: 997760 - protein, 9 aa, Homo Sapiens
GEEEDEEGA

SEQ ID NO: 997761 - protein, 9 aa, Homo Sapiens
KPPPFLRGH

SEQ ID NO: 997762 - protein, 9 aa, Homo Sapiens
MADRPRQRA

SEQ ID NO: 997763 - protein, 9 aa, Homo Sapiens
SYGVTCLRP

SEQ ID NO: 997764 - protein, 9 aa, Homo Sapiens
FNLKHESAK

SEQ ID NO: 997765 - protein, 9 aa, Homo Sapiens
DFLLFMVLF

SEQ ID NO: 997766 - protein, 9 aa, Homo Sapiens
VTYDFDKIV

SEQ ID NO: 997767 - protein, 9 aa, Homo Sapiens
KLEAAQKKK

SEQ ID NO: 997768 - protein, 9 aa, Homo Sapiens
PKVLTELGS

SEQ ID NO: 997769 - protein, 9 aa, Homo Sapiens
GILFPSIEV

SEQ ID NO: 997770 - protein, 9 aa, Homo Sapiens
MCGTNAFFP

SEQ ID NO: 997771 - protein, 9 aa, Homo Sapiens
VEADPELAD

SEQ ID NO: 997772 - protein, 9 aa, Homo Sapiens
LQPTQRCMG

SEQ ID NO: 997773 - protein, 9 aa, Homo Sapiens
SALGAGPTQ

SEQ ID NO: 997774 - protein, 9 aa, Homo Sapiens
SIGKWSISG

SEQ ID NO: 997775 - protein, 9 aa, Homo Sapiens
NEFFCPSWA

SEQ ID NO: 997776 - protein, 9 aa, Homo Sapiens
IKSYRKVRK

SEQ ID NO: 997777 - protein, 9 aa, Homo Sapiens
LTLDSDLLM

SEQ ID NO: 997778 - protein, 9 aa, Homo Sapiens
RNLNVTISL

SEQ ID NO: 997779 - protein, 9 aa, Homo Sapiens
ESMRKDHSL

SEQ ID NO: 997780 - protein, 9 aa, Homo Sapiens
TSKDHDSPE

SEQ ID NO: 997781 - protein, 9 aa, Homo Sapiens
HNINVIQAK

SEQ ID NO: 997782 - protein, 9 aa, Homo Sapiens
SETPCESQG

SEQ ID NO: 997783 - protein, 9 aa, Homo Sapiens
QQLPKPPDP

SEQ ID NO: 997784 - protein, 9 aa, Homo Sapiens
PAASGDFDY

SEQ ID NO: 997785 - protein, 9 aa, Homo Sapiens
GYVINIAHV

SEQ ID NO: 997786 - protein, 9 aa, Homo Sapiens
GKEIYLQKP

SEQ ID NO: 997787 - protein, 9 aa, Homo Sapiens
MTLALVLTT

SEQ ID NO: 997788 - protein, 9 aa, Homo Sapiens
FLDKVVSVF

SEQ ID NO: 997789 - protein, 9 aa, Homo Sapiens
KAPVMNCSI

SEQ ID NO: 997790 - protein, 9 aa, Homo Sapiens
KPTQCTMLY

SEQ ID NO: 997791 - protein, 9 aa, Homo Sapiens
ILAWSTSMP

SEQ ID NO: 997792 - protein, 9 aa, Homo Sapiens
PKAKVPLQA

SEQ ID NO: 997793 - protein, 9 aa, Homo Sapiens
PLPKCPPKC

SEQ ID NO: 997794 - protein, 9 aa, Homo Sapiens
GTFQAWHRM

SEQ ID NO: 997795 - protein, 9 aa, Homo Sapiens
FSGQSSFLW

SEQ ID NO: 997796 - protein, 9 aa, Homo Sapiens
LSPRASSSL

SEQ ID NO: 997797 - protein, 9 aa, Homo Sapiens
RGNRYTGKK

SEQ ID NO: 997798 - protein, 9 aa, Homo Sapiens
PERSYGSDK

SEQ ID NO: 997799 - protein, 9 aa, Homo Sapiens
LGDGAETLC

SEQ ID NO: 997800 - protein, 9 aa, Homo Sapiens
VDKTGWVIK

SEQ ID NO: 997801 - protein, 9 aa, Homo Sapiens
GQHESGTSC

SEQ ID NO: 997802 - protein, 9 aa, Homo Sapiens
QTGRHKPTG

SEQ ID NO: 997803 - protein, 9 aa, Homo Sapiens
PDSGMYSSS

SEQ ID NO: 997804 - protein, 9 aa, Homo Sapiens
SEKPLENNT

SEQ ID NO: 997805 - protein, 9 aa, Homo Sapiens
TTVSTAGFE

SEQ ID NO: 997806 - protein, 9 aa, Homo Sapiens
PSVLGKHTE

SEQ ID NO: 997807 - protein, 9 aa, Homo Sapiens
SKPTQCTML

SEQ ID NO: 997808 - protein, 9 aa, Homo Sapiens
FSFLCVQSP

SEQ ID NO: 997809 - protein, 9 aa, Homo Sapiens
FKDEFFTMM

SEQ ID NO: 997810 - protein, 9 aa, Homo Sapiens
WACTNCFFL

SEQ ID NO: 997811 - protein, 9 aa, Homo Sapiens
TKDTFTASS

SEQ ID NO: 997812 - protein, 9 aa, Homo Sapiens
EDDSFTDQS

SEQ ID NO: 997813 - protein, 9 aa, Homo Sapiens
EYKNKSDFW

SEQ ID NO: 997814 - protein, 9 aa, Homo Sapiens
GLTEKEAKH

SEQ ID NO: 997815 - protein, 9 aa, Homo Sapiens
AEALPQRKM

SEQ ID NO: 997816 - protein, 9 aa, Homo Sapiens
GKMCNADYA

SEQ ID NO: 997817 - protein, 9 aa, Homo Sapiens
VQKKIVTEE

SEQ ID NO: 997818 - protein, 9 aa, Homo Sapiens
ISTVKSDIL

SEQ ID NO: 997819 - protein, 9 aa, Homo Sapiens
SSSTLALPV

SEQ ID NO: 997820 - protein, 9 aa, Homo Sapiens
FSYYNSLKD

SEQ ID NO: 997821 - protein, 9 aa, Homo Sapiens
GAVPGALAS

SEQ ID NO: 997822 - protein, 9 aa, Homo Sapiens
ETLSKLLNP

SEQ ID NO: 997823 - protein, 9 aa, Homo Sapiens
IQHAILTKS

SEQ ID NO: 997824 - protein, 9 aa, Homo Sapiens
SHKEDAGVE

SEQ ID NO: 997825 - protein, 9 aa, Homo Sapiens
WQLLLTLTL

SEQ ID NO: 997826 - protein, 9 aa, Homo Sapiens
WCIKMVCNS

SEQ ID NO: 997827 - protein, 9 aa, Homo Sapiens
TCEECGKAY

SEQ ID NO: 997828 - protein, 9 aa, Homo Sapiens
DLILSSGRR

SEQ ID NO: 997829 - protein, 9 aa, Homo Sapiens
KVYEQKTKL

SEQ ID NO: 997830 - protein, 9 aa, Homo Sapiens
FLLWCMAPN

SEQ ID NO: 997831 - protein, 9 aa, Homo Sapiens
QVSPESLLL

SEQ ID NO: 997832 - protein, 9 aa, Homo Sapiens
KRGLALALL

SEQ ID NO: 997833 - protein, 9 aa, Homo Sapiens
TFYVADLGN

SEQ ID NO: 997834 - protein, 9 aa, Homo Sapiens
SPSDAFKIS

SEQ ID NO: 997835 - protein, 9 aa, Homo Sapiens
NGELVANPV

SEQ ID NO: 997836 - protein, 9 aa, Homo Sapiens
ELSDHLNAM

SEQ ID NO: 997837 - protein, 9 aa, Homo Sapiens
VVFSIFVMA

SEQ ID NO: 997838 - protein, 9 aa, Homo Sapiens
WVLEMMWSE

SEQ ID NO: 997839 - protein, 9 aa, Homo Sapiens
MGRTSFDLD

SEQ ID NO: 997840 - protein, 9 aa, Homo Sapiens
TNQLLRSLG

SEQ ID NO: 997841 - protein, 9 aa, Homo Sapiens
VRQEHGPEK

SEQ ID NO: 997842 - protein, 9 aa, Homo Sapiens
KKHPIFFMF

SEQ ID NO: 997843 - protein, 9 aa, Homo Sapiens
KVLDSNDNS

SEQ ID NO: 997844 - protein, 9 aa, Homo Sapiens
EGYGIRLPQ

SEQ ID NO: 997845 - protein, 9 aa, Homo Sapiens
LGRKKFLLV

SEQ ID NO: 997846 - protein, 9 aa, Homo Sapiens
YGIRLPQNS

SEQ ID NO: 997847 - protein, 9 aa, Homo Sapiens
NLNQYVNKR

SEQ ID NO: 997848 - protein, 9 aa, Homo Sapiens
HSGIISKRS

SEQ ID NO: 997849 - protein, 9 aa, Homo Sapiens
EAPALLWRL

SEQ ID NO: 997850 - protein, 9 aa, Homo Sapiens
LRQNLPLSF

SEQ ID NO: 997851 - protein, 9 aa, Homo Sapiens
ITGQFYDKP

SEQ ID NO: 997852 - protein, 9 aa, Homo Sapiens
ESQQKNTSP

SEQ ID NO: 997853 - protein, 9 aa, Homo Sapiens
KRSEPLLLQ

SEQ ID NO: 997854 - protein, 9 aa, Homo Sapiens
TFQAWHRMQ

SEQ ID NO: 997855 - protein, 9 aa, Homo Sapiens
FSADLVLLS

SEQ ID NO: 997856 - protein, 9 aa, Homo Sapiens
QGHSLELLE

SEQ ID NO: 997857 - protein, 9 aa, Homo Sapiens
SEETSSTFQ

SEQ ID NO: 997858 - protein, 9 aa, Homo Sapiens
QPDKVLIVR

SEQ ID NO: 997859 - protein, 9 aa, Homo Sapiens
DDDHQQGTS

SEQ ID NO: 997860 - protein, 9 aa, Homo Sapiens
IYIDLIREE

SEQ ID NO: 997861 - protein, 9 aa, Homo Sapiens
NIVYYKDDP

SEQ ID NO: 997862 - protein, 9 aa, Homo Sapiens
LLSLLDEEG

SEQ ID NO: 997863 - protein, 9 aa, Homo Sapiens
KMVAELTQK

SEQ ID NO: 997864 - protein, 9 aa, Homo Sapiens
PFNIWGTWH

SEQ ID NO: 997865 - protein, 9 aa, Homo Sapiens
LSAIESTAS

SEQ ID NO: 997866 - protein, 9 aa, Homo Sapiens
VVAGRRKFV

SEQ ID NO: 997867 - protein, 9 aa, Homo Sapiens
STAGFETTT

SEQ ID NO: 997868 - protein, 9 aa, Homo Sapiens
KKEYTVGAE

SEQ ID NO: 997869 - protein, 9 aa, Homo Sapiens
HFSGGLAKA

SEQ ID NO: 997870 - protein, 9 aa, Homo Sapiens
YNPRIRVEF

SEQ ID NO: 997871 - protein, 9 aa, Homo Sapiens
LVKQTKMEG

SEQ ID NO: 997872 - protein, 9 aa, Homo Sapiens
QSSSVQIDS

SEQ ID NO: 997873 - protein, 9 aa, Homo Sapiens
CGVVDLITT

SEQ ID NO: 997874 - protein, 9 aa, Homo Sapiens
GTNSELTYT

SEQ ID NO: 997875 - protein, 9 aa, Homo Sapiens
SAGSSGLLS

SEQ ID NO: 997876 - protein, 9 aa, Homo Sapiens
KLYLVFEFF

SEQ ID NO: 997877 - protein, 9 aa, Homo Sapiens
KSTMKKKLE

SEQ ID NO: 997878 - protein, 9 aa, Homo Sapiens
AWKIEDISA

SEQ ID NO: 997879 - protein, 9 aa, Homo Sapiens
DENSCAWCP

SEQ ID NO: 997880 - protein, 9 aa, Homo Sapiens
IAIKKIPER

SEQ ID NO: 997881 - protein, 9 aa, Homo Sapiens
GHLCCSRCG

SEQ ID NO: 997882 - protein, 9 aa, Homo Sapiens
KHMKFRKQQ

SEQ ID NO: 997883 - protein, 9 aa, Homo Sapiens
LLGAVVVAA

SEQ ID NO: 997884 - protein, 9 aa, Homo Sapiens
PWMEPLSLF

SEQ ID NO: 997885 - protein, 9 aa, Homo Sapiens
RSREVVNRQ

SEQ ID NO: 997886 - protein, 9 aa, Homo Sapiens
SGDSFSYRD

SEQ ID NO: 997887 - protein, 9 aa, Homo Sapiens
APDVISLRY

SEQ ID NO: 997888 - protein, 9 aa, Homo Sapiens
SFSFNDIGQ

SEQ ID NO: 997889 - protein, 9 aa, Homo Sapiens
FKQSSHFTR

SEQ ID NO: 997890 - protein, 9 aa, Homo Sapiens
EVDCISEWK

SEQ ID NO: 997891 - protein, 9 aa, Homo Sapiens
LTNLSEHVS

SEQ ID NO: 997892 - protein, 9 aa, Homo Sapiens
YCHTIITLT

SEQ ID NO: 997893 - protein, 9 aa, Homo Sapiens
KNLVDENLK

SEQ ID NO: 997894 - protein, 9 aa, Homo Sapiens
PDTQLGNHD

SEQ ID NO: 997895 - protein, 9 aa, Homo Sapiens
SGPLQGSGQ

SEQ ID NO: 997896 - protein, 9 aa, Homo Sapiens
GVATYNRFL

SEQ ID NO: 997897 - protein, 9 aa, Homo Sapiens
EVIYGSHFQ

SEQ ID NO: 997898 - protein, 9 aa, Homo Sapiens
KELWWEVEE

SEQ ID NO: 997899 - protein, 9 aa, Homo Sapiens
LNHEIEECR

SEQ ID NO: 997900 - protein, 9 aa, Homo Sapiens
VDLDKACRR

SEQ ID NO: 997901 - protein, 9 aa, Homo Sapiens
GLLAILETS

SEQ ID NO: 997902 - protein, 9 aa, Homo Sapiens
AQQEEEERQ

SEQ ID NO: 997903 - protein, 9 aa, Homo Sapiens
LLLKYAKQL

SEQ ID NO: 997904 - protein, 9 aa, Homo Sapiens
WVGDKTSAT

SEQ ID NO: 997905 - protein, 9 aa, Homo Sapiens
ELLSKEAAV

SEQ ID NO: 997906 - protein, 9 aa, Homo Sapiens
DQVLSLNHE

SEQ ID NO: 997907 - protein, 9 aa, Homo Sapiens
INVLHGRLK

SEQ ID NO: 997908 - protein, 9 aa, Homo Sapiens
SSLAVERLI

SEQ ID NO: 997909 - protein, 9 aa, Homo Sapiens
GLPPALLEP

SEQ ID NO: 997910 - protein, 9 aa, Homo Sapiens
KLQQFFSHH

SEQ ID NO: 997911 - protein, 9 aa, Homo Sapiens
IRSREVVNR

SEQ ID NO: 997912 - protein, 9 aa, Homo Sapiens
AACSIFYLG

SEQ ID NO: 997913 - protein, 9 aa, Homo Sapiens
RMPSIQESL

SEQ ID NO: 997914 - protein, 9 aa, Homo Sapiens
PPPLRLGLL

SEQ ID NO: 997915 - protein, 9 aa, Homo Sapiens
TSEESQVFQ

SEQ ID NO: 997916 - protein, 9 aa, Homo Sapiens
WDGKTPCQQ

SEQ ID NO: 997917 - protein, 9 aa, Homo Sapiens
KDPDKDFTP

SEQ ID NO: 997918 - protein, 9 aa, Homo Sapiens
PHQGLSACM

SEQ ID NO: 997919 - protein, 9 aa, Homo Sapiens
FYDHLEFDG

SEQ ID NO: 997920 - protein, 9 aa, Homo Sapiens
SPRIQESCG

SEQ ID NO: 997921 - protein, 9 aa, Homo Sapiens
VIGGGLSSV

SEQ ID NO: 997922 - protein, 9 aa, Homo Sapiens
STLGVSFPS

SEQ ID NO: 997923 - protein, 9 aa, Homo Sapiens
LLVALSAES

SEQ ID NO: 997924 - protein, 9 aa, Homo Sapiens
KSKVAPAKA

SEQ ID NO: 997925 - protein, 9 aa, Homo Sapiens
ELIAAVVFA

SEQ ID NO: 997926 - protein, 9 aa, Homo Sapiens
AKYADYFLK

SEQ ID NO: 997927 - protein, 9 aa, Homo Sapiens
MFQLYLENL

SEQ ID NO: 997928 - protein, 9 aa, Homo Sapiens
EKKPKFRSI

SEQ ID NO: 997929 - protein, 9 aa, Homo Sapiens
QAPPQQFSY

SEQ ID NO: 997930 - protein, 9 aa, Homo Sapiens
NSFSSAGRQ

SEQ ID NO: 997931 - protein, 9 aa, Homo Sapiens
EYVQFQAEC

SEQ ID NO: 997932 - protein, 9 aa, Homo Sapiens
CEATKYYIL

SEQ ID NO: 997933 - protein, 9 aa, Homo Sapiens
TGKFLELDL

SEQ ID NO: 997934 - protein, 9 aa, Homo Sapiens
VEFIQCQLI

SEQ ID NO: 997935 - protein, 9 aa, Homo Sapiens
SHPDSGKQT

SEQ ID NO: 997936 - protein, 9 aa, Homo Sapiens
DSTAQKNPT

SEQ ID NO: 997937 - protein, 9 aa, Homo Sapiens
SDSSRHLPE

SEQ ID NO: 997938 - protein, 9 aa, Homo Sapiens
KERYYGYTG

SEQ ID NO: 997939 - protein, 9 aa, Homo Sapiens
SRTKRDPKE

SEQ ID NO: 997940 - protein, 9 aa, Homo Sapiens
QAPLATRQG

SEQ ID NO: 997941 - protein, 9 aa, Homo Sapiens
KKLEAAQKK

SEQ ID NO: 997942 - protein, 9 aa, Homo Sapiens
LDKQAQTPK

SEQ ID NO: 997943 - protein, 9 aa, Homo Sapiens
SLAMSSHFI

SEQ ID NO: 997944 - protein, 9 aa, Homo Sapiens
HIRSREVVN

SEQ ID NO: 997945 - protein, 9 aa, Homo Sapiens
ELIRLLKTA

SEQ ID NO: 997946 - protein, 9 aa, Homo Sapiens
LDENGFLFK

SEQ ID NO: 997947 - protein, 9 aa, Homo Sapiens
RVLEEEVAR

SEQ ID NO: 997948 - protein, 9 aa, Homo Sapiens
AVSKLVPWS

SEQ ID NO: 997949 - protein, 9 aa, Homo Sapiens
RIKETLEKF

SEQ ID NO: 997950 - protein, 9 aa, Homo Sapiens
FTAPSVLGK

SEQ ID NO: 997951 - protein, 9 aa, Homo Sapiens
SYFDEDDSF

SEQ ID NO: 997952 - protein, 9 aa, Homo Sapiens
LLAFFIYVP

SEQ ID NO: 997953 - protein, 9 aa, Homo Sapiens
VFSCPGCEH

SEQ ID NO: 997954 - protein, 9 aa, Homo Sapiens
PFSPMGLPP

SEQ ID NO: 997955 - protein, 9 aa, Homo Sapiens
HYTFHGDSH

SEQ ID NO: 997956 - protein, 9 aa, Homo Sapiens
ALSKDLLKA

SEQ ID NO: 997957 - protein, 9 aa, Homo Sapiens
MVLFILCLI

SEQ ID NO: 997958 - protein, 9 aa, Homo Sapiens
YLVFEFFSQ

SEQ ID NO: 997959 - protein, 9 aa, Homo Sapiens
SGLKNIFGF

SEQ ID NO: 997960 - protein, 9 aa, Homo Sapiens
KWRELEGSG

SEQ ID NO: 997961 - protein, 9 aa, Homo Sapiens
CIEKSYKFI

SEQ ID NO: 997962 - protein, 9 aa, Homo Sapiens
SRAQAVVGD

SEQ ID NO: 997963 - protein, 9 aa, Homo Sapiens
WTCSSSLSL

SEQ ID NO: 997964 - protein, 9 aa, Homo Sapiens
QCDKVFRFF

SEQ ID NO: 997965 - protein, 9 aa, Homo Sapiens
AIELLKILP

SEQ ID NO: 997966 - protein, 9 aa, Homo Sapiens
NPVALKILS

SEQ ID NO: 997967 - protein, 9 aa, Homo Sapiens
LPSDSSRHL

SEQ ID NO: 997968 - protein, 9 aa, Homo Sapiens
AQVLGRVTQ

SEQ ID NO: 997969 - protein, 9 aa, Homo Sapiens
ILSSGRRDP

SEQ ID NO: 997970 - protein, 9 aa, Homo Sapiens
PPENEISKP

SEQ ID NO: 997971 - protein, 9 aa, Homo Sapiens
NSLKKAICQ

SEQ ID NO: 997972 - protein, 9 aa, Homo Sapiens
HSWRTFQRW

SEQ ID NO: 997973 - protein, 9 aa, Homo Sapiens
SGIVIWGAL

SEQ ID NO: 997974 - protein, 9 aa, Homo Sapiens
VCREFMDHS

SEQ ID NO: 997975 - protein, 9 aa, Homo Sapiens
FLESCGVVD

SEQ ID NO: 997976 - protein, 9 aa, Homo Sapiens
IKGETCFAK

SEQ ID NO: 997977 - protein, 9 aa, Homo Sapiens
EENSGLSLP

SEQ ID NO: 997978 - protein, 9 aa, Homo Sapiens
LCCSRCGAC

SEQ ID NO: 997979 - protein, 9 aa, Homo Sapiens
SLSAYLPTN

SEQ ID NO: 997980 - protein, 9 aa, Homo Sapiens
KKSRREVQR

SEQ ID NO: 997981 - protein, 9 aa, Homo Sapiens
KLEECLTDT

SEQ ID NO: 997982 - protein, 9 aa, Homo Sapiens
STADQSVRK

SEQ ID NO: 997983 - protein, 9 aa, Homo Sapiens
HQVLGLLNR

SEQ ID NO: 997984 - protein, 9 aa, Homo Sapiens
GSSKPPPAA

SEQ ID NO: 997985 - protein, 9 aa, Homo Sapiens
AISVRISLL

SEQ ID NO: 997986 - protein, 9 aa, Homo Sapiens
LEAPALLWR

SEQ ID NO: 997987 - protein, 9 aa, Homo Sapiens
SFSYRDTVV

SEQ ID NO: 997988 - protein, 9 aa, Homo Sapiens
RGFLSIAPV

SEQ ID NO: 997989 - protein, 9 aa, Homo Sapiens
WTNQLLRSL

SEQ ID NO: 997990 - protein, 9 aa, Homo Sapiens
SYGSDKFER

SEQ ID NO: 997991 - protein, 9 aa, Homo Sapiens
LDKACRRPR

SEQ ID NO: 997992 - protein, 9 aa, Homo Sapiens
KAFACAEKD

SEQ ID NO: 997993 - protein, 9 aa, Homo Sapiens
FLLVTAISK

SEQ ID NO: 997994 - protein, 9 aa, Homo Sapiens
FLSDILETV

SEQ ID NO: 997995 - protein, 9 aa, Homo Sapiens
CDFHPLPPS

SEQ ID NO: 997996 - protein, 9 aa, Homo Sapiens
RRIIKAESN

SEQ ID NO: 997997 - protein, 9 aa, Homo Sapiens
SPPLPPYAS

SEQ ID NO: 997998 - protein, 9 aa, Homo Sapiens
GVIFSVGRM

SEQ ID NO: 997999 - protein, 9 aa, Homo Sapiens
ETTVSTAGF

SEQ ID NO: 998000 - protein, 9 aa, Homo Sapiens
NNKERYYGY

SEQ ID NO: 998001 - protein, 9 aa, Homo Sapiens
DEEGRFPKA

SEQ ID NO: 998002 - protein, 9 aa, Homo Sapiens
WRSPNSGSW

SEQ ID NO: 998003 - protein, 9 aa, Homo Sapiens
AGLTESVQG

SEQ ID NO: 998004 - protein, 9 aa, Homo Sapiens
NSELTYTFS

SEQ ID NO: 998005 - protein, 9 aa, Homo Sapiens
VFAGFLLQE

SEQ ID NO: 998006 - protein, 9 aa, Homo Sapiens
KAQEALHLT

SEQ ID NO: 998007 - protein, 9 aa, Homo Sapiens
PSAESEDNG

SEQ ID NO: 998008 - protein, 9 aa, Homo Sapiens
DYDDSAMKT

SEQ ID NO: 998009 - protein, 9 aa, Homo Sapiens
TDKKKAGKK

SEQ ID NO: 998010 - protein, 9 aa, Homo Sapiens
GLGRPSMPT

SEQ ID NO: 998011 - protein, 9 aa, Homo Sapiens
LLDEEGRFP

SEQ ID NO: 998012 - protein, 9 aa, Homo Sapiens
TYCNLTFWG

SEQ ID NO: 998013 - protein, 9 aa, Homo Sapiens
KHESAKADL

SEQ ID NO: 998014 - protein, 9 aa, Homo Sapiens
QMKELWWEV

SEQ ID NO: 998015 - protein, 9 aa, Homo Sapiens
VAELTQKIG

SEQ ID NO: 998016 - protein, 9 aa, Homo Sapiens
DSGNKAGMT

SEQ ID NO: 998017 - protein, 9 aa, Homo Sapiens
EADRATSPL

SEQ ID NO: 998018 - protein, 9 aa, Homo Sapiens
ALRPRVGGQ

SEQ ID NO: 998019 - protein, 9 aa, Homo Sapiens
PIYKQYASV

SEQ ID NO: 998020 - protein, 9 aa, Homo Sapiens
ILAGSTKVS

SEQ ID NO: 998021 - protein, 9 aa, Homo Sapiens
VSPESLLLA

SEQ ID NO: 998022 - protein, 9 aa, Homo Sapiens
VTPMKELTH

SEQ ID NO: 998023 - protein, 9 aa, Homo Sapiens
GRTSFDLDS

SEQ ID NO: 998024 - protein, 9 aa, Homo Sapiens
RLLKTARLL

SEQ ID NO: 998025 - protein, 9 aa, Homo Sapiens
QKIGFDPEP

SEQ ID NO: 998026 - protein, 9 aa, Homo Sapiens
SVTVQEDLC

SEQ ID NO: 998027 - protein, 9 aa, Homo Sapiens
SEFSVLRAE

SEQ ID NO: 998028 - protein, 9 aa, Homo Sapiens
FSAEIQPPS

SEQ ID NO: 998029 - protein, 9 aa, Homo Sapiens
RADMKLRTF

SEQ ID NO: 998030 - protein, 9 aa, Homo Sapiens
PNESTLIDQ

SEQ ID NO: 998031 - protein, 9 aa, Homo Sapiens
TFCPNNVQI

SEQ ID NO: 998032 - protein, 9 aa, Homo Sapiens
VFSIFVMAI

SEQ ID NO: 998033 - protein, 9 aa, Homo Sapiens
MFTPLNRYS

SEQ ID NO: 998034 - protein, 9 aa, Homo Sapiens
EYIRNDYRE

SEQ ID NO: 998035 - protein, 9 aa, Homo Sapiens
APKPPEEPL

SEQ ID NO: 998036 - protein, 9 aa, Homo Sapiens
NFVISKIKR

SEQ ID NO: 998037 - protein, 9 aa, Homo Sapiens
KRHSSEDPE

SEQ ID NO: 998038 - protein, 9 aa, Homo Sapiens
LVYFFVGSR

SEQ ID NO: 998039 - protein, 9 aa, Homo Sapiens
YTMHIKRRE

SEQ ID NO: 998040 - protein, 9 aa, Homo Sapiens
NSCTAYRML

SEQ ID NO: 998041 - protein, 9 aa, Homo Sapiens
RKQLLCGRG

SEQ ID NO: 998042 - protein, 9 aa, Homo Sapiens
IGNFTQATV

SEQ ID NO: 998043 - protein, 9 aa, Homo Sapiens
CRCRSGFGL

SEQ ID NO: 998044 - protein, 9 aa, Homo Sapiens
GFKQIYLWT

SEQ ID NO: 998045 - protein, 9 aa, Homo Sapiens
WCDSISGHA

SEQ ID NO: 998046 - protein, 9 aa, Homo Sapiens
PDPEVMPFW

SEQ ID NO: 998047 - protein, 9 aa, Homo Sapiens
LRLFLSADF

SEQ ID NO: 998048 - protein, 9 aa, Homo Sapiens
PPGPPRKDG

SEQ ID NO: 998049 - protein, 9 aa, Homo Sapiens
TCEVGAWCP

SEQ ID NO: 998050 - protein, 9 aa, Homo Sapiens
STPKIYPFN

SEQ ID NO: 998051 - protein, 9 aa, Homo Sapiens
DISESKFLT

SEQ ID NO: 998052 - protein, 9 aa, Homo Sapiens
DDVINSSNY

SEQ ID NO: 998053 - protein, 9 aa, Homo Sapiens
TPRSVASPD

SEQ ID NO: 998054 - protein, 9 aa, Homo Sapiens
YFSLQLQGR

SEQ ID NO: 998055 - protein, 9 aa, Homo Sapiens
VSSVTALET

SEQ ID NO: 998056 - protein, 9 aa, Homo Sapiens
IMFTPLNRY

SEQ ID NO: 998057 - protein, 9 aa, Homo Sapiens
STFQLNELM

SEQ ID NO: 998058 - protein, 9 aa, Homo Sapiens
PPAASGDFD

SEQ ID NO: 998059 - protein, 9 aa, Homo Sapiens
LYGSDGHLP

SEQ ID NO: 998060 - protein, 9 aa, Homo Sapiens
LVSIYRTHH

SEQ ID NO: 998061 - protein, 9 aa, Homo Sapiens
GFCGNSPEM

SEQ ID NO: 998062 - protein, 9 aa, Homo Sapiens
GAVSQYTVQ

SEQ ID NO: 998063 - protein, 9 aa, Homo Sapiens
TRGVPDWFS

SEQ ID NO: 998064 - protein, 9 aa, Homo Sapiens
MGGVVQAFL

SEQ ID NO: 998065 - protein, 9 aa, Homo Sapiens
SVQTSTIKN

SEQ ID NO: 998066 - protein, 9 aa, Homo Sapiens
ENLWNTVSK

SEQ ID NO: 998067 - protein, 9 aa, Homo Sapiens
SVRISLLLL

SEQ ID NO: 998068 - protein, 9 aa, Homo Sapiens
PEPRGPPGE

SEQ ID NO: 998069 - protein, 9 aa, Homo Sapiens
LLEPQPAPH

SEQ ID NO: 998070 - protein, 9 aa, Homo Sapiens
QSGPDSPVT

SEQ ID NO: 998071 - protein, 9 aa, Homo Sapiens
EFMDVDQTP

SEQ ID NO: 998072 - protein, 9 aa, Homo Sapiens
LEPIPGTAQ

SEQ ID NO: 998073 - protein, 9 aa, Homo Sapiens
NADYADLLQ

SEQ ID NO: 998074 - protein, 9 aa, Homo Sapiens
FLSSFVQDY

SEQ ID NO: 998075 - protein, 9 aa, Homo Sapiens
NIVGKRGRL

SEQ ID NO: 998076 - protein, 9 aa, Homo Sapiens
SIPVRALCT

SEQ ID NO: 998077 - protein, 9 aa, Homo Sapiens
EPLSEESDL

SEQ ID NO: 998078 - protein, 9 aa, Homo Sapiens
GRTGRFGKE

SEQ ID NO: 998079 - protein, 9 aa, Homo Sapiens
HIGNFTQAT

SEQ ID NO: 998080 - protein, 9 aa, Homo Sapiens
FTSKLDKML

SEQ ID NO: 998081 - protein, 9 aa, Homo Sapiens
VTTKENREN

SEQ ID NO: 998082 - protein, 9 aa, Homo Sapiens
LVQEAPISA

SEQ ID NO: 998083 - protein, 9 aa, Homo Sapiens
EVPRHQLQG

SEQ ID NO: 998084 - protein, 9 aa, Homo Sapiens
LGGEPKNPG

SEQ ID NO: 998085 - protein, 9 aa, Homo Sapiens
GIRLPQNSP

SEQ ID NO: 998086 - protein, 9 aa, Homo Sapiens
LYSRAVCNL

SEQ ID NO: 998087 - protein, 9 aa, Homo Sapiens
DSISGHATL

SEQ ID NO: 998088 - protein, 9 aa, Homo Sapiens
YTMQKVNSA

SEQ ID NO: 998089 - protein, 9 aa, Homo Sapiens
ADRPRQRAS

SEQ ID NO: 998090 - protein, 9 aa, Homo Sapiens
ACLCCKKGS

SEQ ID NO: 998091 - protein, 9 aa, Homo Sapiens
TILLIFYGI

SEQ ID NO: 998092 - protein, 9 aa, Homo Sapiens
FLFVMGTSE

SEQ ID NO: 998093 - protein, 9 aa, Homo Sapiens
SFSYATAPT

SEQ ID NO: 998094 - protein, 9 aa, Homo Sapiens
CCSRCGACL

SEQ ID NO: 998095 - protein, 9 aa, Homo Sapiens
EFYRTTYTE

SEQ ID NO: 998096 - protein, 9 aa, Homo Sapiens
DSLYQKHQR

SEQ ID NO: 998097 - protein, 9 aa, Homo Sapiens
EGSSGSSAS

SEQ ID NO: 998098 - protein, 9 aa, Homo Sapiens
LLRKTTDME

SEQ ID NO: 998099 - protein, 9 aa, Homo Sapiens
ESEMSSHKA

SEQ ID NO: 998100 - protein, 9 aa, Homo Sapiens
KCNKQPCQT

SEQ ID NO: 998101 - protein, 9 aa, Homo Sapiens
ISQCDKVFR

SEQ ID NO: 998102 - protein, 9 aa, Homo Sapiens
FTRPCLALA

SEQ ID NO: 998103 - protein, 9 aa, Homo Sapiens
LLIFYGIRR

SEQ ID NO: 998104 - protein, 9 aa, Homo Sapiens
SPMVEKRMM

SEQ ID NO: 998105 - protein, 9 aa, Homo Sapiens
RRIPQNHSE

SEQ ID NO: 998106 - protein, 9 aa, Homo Sapiens
KQGFKPKRP

SEQ ID NO: 998107 - protein, 9 aa, Homo Sapiens
PVQYPYRTQ

SEQ ID NO: 998108 - protein, 9 aa, Homo Sapiens
ITLTNLSGP

SEQ ID NO: 998109 - protein, 9 aa, Homo Sapiens
KCGEGFSQS

SEQ ID NO: 998110 - protein, 9 aa, Homo Sapiens
ERQGKASEA

SEQ ID NO: 998111 - protein, 9 aa, Homo Sapiens
VIKKANDTS

SEQ ID NO: 998112 - protein, 9 aa, Homo Sapiens
ERVMHGEAN

SEQ ID NO: 998113 - protein, 9 aa, Homo Sapiens
GQASFEGED

SEQ ID NO: 998114 - protein, 9 aa, Homo Sapiens
QKLEECLTD

SEQ ID NO: 998115 - protein, 9 aa, Homo Sapiens
RAVAAAVCG

SEQ ID NO: 998116 - protein, 9 aa, Homo Sapiens
EESQVFQSS

SEQ ID NO: 998117 - protein, 9 aa, Homo Sapiens
PWDGKTPCQ

SEQ ID NO: 998118 - protein, 9 aa, Homo Sapiens
PELIAAVVF

SEQ ID NO: 998119 - protein, 9 aa, Homo Sapiens
LVGHVYEYI

SEQ ID NO: 998120 - protein, 9 aa, Homo Sapiens
FAFTARVLS

SEQ ID NO: 998121 - protein, 9 aa, Homo Sapiens
LRKRDQGGF

SEQ ID NO: 998122 - protein, 9 aa, Homo Sapiens
YNVDSLYQK

SEQ ID NO: 998123 - protein, 9 aa, Homo Sapiens
WVAGLTESV

SEQ ID NO: 998124 - protein, 9 aa, Homo Sapiens
QLERFIQRY

SEQ ID NO: 998125 - protein, 9 aa, Homo Sapiens
TFQLNELMM

SEQ ID NO: 998126 - protein, 9 aa, Homo Sapiens
PVARDVVLH

SEQ ID NO: 998127 - protein, 9 aa, Homo Sapiens
LWEVHRRPA

SEQ ID NO: 998128 - protein, 9 aa, Homo Sapiens
LFILCLISF

SEQ ID NO: 998129 - protein, 9 aa, Homo Sapiens
AIAYWKFTS

SEQ ID NO: 998130 - protein, 9 aa, Homo Sapiens
SSGCGLSCC

SEQ ID NO: 998131 - protein, 9 aa, Homo Sapiens
DATPLLDKM

SEQ ID NO: 998132 - protein, 9 aa, Homo Sapiens
AKDEIFSAD

SEQ ID NO: 998133 - protein, 9 aa, Homo Sapiens
GTCGHRDSG

SEQ ID NO: 998134 - protein, 9 aa, Homo Sapiens
QNIISYVVH

SEQ ID NO: 998135 - protein, 9 aa, Homo Sapiens
VMDILRKRD

SEQ ID NO: 998136 - protein, 9 aa, Homo Sapiens
KAFITHGET

SEQ ID NO: 998137 - protein, 9 aa, Homo Sapiens
GMKPHDIFK

SEQ ID NO: 998138 - protein, 9 aa, Homo Sapiens
WKVDVKDSC

SEQ ID NO: 998139 - protein, 9 aa, Homo Sapiens
AYQFPYAHP

SEQ ID NO: 998140 - protein, 9 aa, Homo Sapiens
ASSSLSLSL

SEQ ID NO: 998141 - protein, 9 aa, Homo Sapiens
MGGGNRDIL

SEQ ID NO: 998142 - protein, 9 aa, Homo Sapiens
SHERSYSCT

SEQ ID NO: 998143 - protein, 9 aa, Homo Sapiens
SLADHLNST

SEQ ID NO: 998144 - protein, 9 aa, Homo Sapiens
SPVQYPYRT

SEQ ID NO: 998145 - protein, 9 aa, Homo Sapiens
KPPNPAAVA

SEQ ID NO: 998146 - protein, 9 aa, Homo Sapiens
TELSKKECC

SEQ ID NO: 998147 - protein, 9 aa, Homo Sapiens
FFDPTADVS

SEQ ID NO: 998148 - protein, 9 aa, Homo Sapiens
ACPEKETSS

SEQ ID NO: 998149 - protein, 9 aa, Homo Sapiens
MQKVNSALS

SEQ ID NO: 998150 - protein, 9 aa, Homo Sapiens
REMGDLIRR

SEQ ID NO: 998151 - protein, 9 aa, Homo Sapiens
WKNVPRIFE

SEQ ID NO: 998152 - protein, 9 aa, Homo Sapiens
SVTVPPGTT

SEQ ID NO: 998153 - protein, 9 aa, Homo Sapiens
NLWNTVSKL

SEQ ID NO: 998154 - protein, 9 aa, Homo Sapiens
DCEEQPEIR

SEQ ID NO: 998155 - protein, 9 aa, Homo Sapiens
PGSMDCHRA

SEQ ID NO: 998156 - protein, 9 aa, Homo Sapiens
RVVVAMMDQ

SEQ ID NO: 998157 - protein, 9 aa, Homo Sapiens
RELKAVVPD

SEQ ID NO: 998158 - protein, 9 aa, Homo Sapiens
ILETSAKES

SEQ ID NO: 998159 - protein, 9 aa, Homo Sapiens
SGGCSRLSL

SEQ ID NO: 998160 - protein, 9 aa, Homo Sapiens
QRCMGYCAE

SEQ ID NO: 998161 - protein, 9 aa, Homo Sapiens
RDAGVVCTS

SEQ ID NO: 998162 - protein, 9 aa, Homo Sapiens
MLPLYGSDG

SEQ ID NO: 998163 - protein, 9 aa, Homo Sapiens
LVNVLRLFL

SEQ ID NO: 998164 - protein, 9 aa, Homo Sapiens
ESYGVTCLR

SEQ ID NO: 998165 - protein, 9 aa, Homo Sapiens
AGDVEADPE

SEQ ID NO: 998166 - protein, 9 aa, Homo Sapiens
ASDSPQCDR

SEQ ID NO: 998167 - protein, 9 aa, Homo Sapiens
VEVGHVFDD

SEQ ID NO: 998168 - protein, 9 aa, Homo Sapiens
PRHQLQGHL

SEQ ID NO: 998169 - protein, 9 aa, Homo Sapiens
PPPISHDGL

SEQ ID NO: 998170 - protein, 9 aa, Homo Sapiens
CDSSQKSEV

SEQ ID NO: 998171 - protein, 9 aa, Homo Sapiens
PVAYYLHYS

SEQ ID NO: 998172 - protein, 9 aa, Homo Sapiens
GPTKAASVE

SEQ ID NO: 998173 - protein, 9 aa, Homo Sapiens
LTYLNVSCS

SEQ ID NO: 998174 - protein, 9 aa, Homo Sapiens
PLVEFSAEI

SEQ ID NO: 998175 - protein, 9 aa, Homo Sapiens
LIKVRPTQD

SEQ ID NO: 998176 - protein, 9 aa, Homo Sapiens
DCSHKEDAG

SEQ ID NO: 998177 - protein, 9 aa, Homo Sapiens
NKVLKGEIL

SEQ ID NO: 998178 - protein, 9 aa, Homo Sapiens
LGLSANELI

SEQ ID NO: 998179 - protein, 9 aa, Homo Sapiens
DCMTVQQCN

SEQ ID NO: 998180 - protein, 9 aa, Homo Sapiens
SGDISGPLQ

SEQ ID NO: 998181 - protein, 9 aa, Homo Sapiens
AICQIIEHT

SEQ ID NO: 998182 - protein, 9 aa, Homo Sapiens
QKKIVTEEK

SEQ ID NO: 998183 - protein, 9 aa, Homo Sapiens
NEKLQQFFS

SEQ ID NO: 998184 - protein, 9 aa, Homo Sapiens
GELVANPVA

SEQ ID NO: 998185 - protein, 9 aa, Homo Sapiens
PVSYSSCPE

SEQ ID NO: 998186 - protein, 9 aa, Homo Sapiens
TKPGSSDIA

SEQ ID NO: 998187 - protein, 9 aa, Homo Sapiens
YNRFLYVVG

SEQ ID NO: 998188 - protein, 9 aa, Homo Sapiens
ACGRTIQRY

SEQ ID NO: 998189 - protein, 9 aa, Homo Sapiens
FFGMSSFNL

SEQ ID NO: 998190 - protein, 9 aa, Homo Sapiens
FQVNSLPAE

SEQ ID NO: 998191 - protein, 9 aa, Homo Sapiens
PLSLFEDVA

SEQ ID NO: 998192 - protein, 9 aa, Homo Sapiens
RIGCFIMGI

SEQ ID NO: 998193 - protein, 9 aa, Homo Sapiens
TLIMIVFGH

SEQ ID NO: 998194 - protein, 9 aa, Homo Sapiens
RTTVFSCPG

SEQ ID NO: 998195 - protein, 9 aa, Homo Sapiens
LFEDELVYA

SEQ ID NO: 998196 - protein, 9 aa, Homo Sapiens
CNSWFECVS

SEQ ID NO: 998197 - protein, 9 aa, Homo Sapiens
LKKQEDVLL

SEQ ID NO: 998198 - protein, 9 aa, Homo Sapiens
KVTEPKKFN

SEQ ID NO: 998199 - protein, 9 aa, Homo Sapiens
KPGDRGPKE

SEQ ID NO: 998200 - protein, 9 aa, Homo Sapiens
ADPELADLP

SEQ ID NO: 998201 - protein, 9 aa, Homo Sapiens
AIVFSIFVM

SEQ ID NO: 998202 - protein, 9 aa, Homo Sapiens
TGLQNKNYS

SEQ ID NO: 998203 - protein, 9 aa, Homo Sapiens
FSGGLAKAL

SEQ ID NO: 998204 - protein, 9 aa, Homo Sapiens
PSLIGQKIC

SEQ ID NO: 998205 - protein, 9 aa, Homo Sapiens
VANPVALKI

SEQ ID NO: 998206 - protein, 9 aa, Homo Sapiens
NANLKKIPR

SEQ ID NO: 998207 - protein, 9 aa, Homo Sapiens
LGRVTQLCR

SEQ ID NO: 998208 - protein, 9 aa, Homo Sapiens
WPKKSKVPQ

SEQ ID NO: 998209 - protein, 9 aa, Homo Sapiens
DCISEWKRR

SEQ ID NO: 998210 - protein, 9 aa, Homo Sapiens
EFSGRSEQA

SEQ ID NO: 998211 - protein, 9 aa, Homo Sapiens
ERFIQRYLV

SEQ ID NO: 998212 - protein, 9 aa, Homo Sapiens
SPQVDELDR

SEQ ID NO: 998213 - protein, 9 aa, Homo Sapiens
NIWGTWHST

SEQ ID NO: 998214 - protein, 9 aa, Homo Sapiens
TRPEALPSP

SEQ ID NO: 998215 - protein, 9 aa, Homo Sapiens
FRQNPLDVM

SEQ ID NO: 998216 - protein, 9 aa, Homo Sapiens
PCSHRPAPG

SEQ ID NO: 998217 - protein, 9 aa, Homo Sapiens
LLYPDSRSH

SEQ ID NO: 998218 - protein, 9 aa, Homo Sapiens
RWTTKDTFT

SEQ ID NO: 998219 - protein, 9 aa, Homo Sapiens
LLQEAVLAR

SEQ ID NO: 998220 - protein, 9 aa, Homo Sapiens
PLDVMVAVG

SEQ ID NO: 998221 - protein, 9 aa, Homo Sapiens
VQTSTIKNH

SEQ ID NO: 998222 - protein, 9 aa, Homo Sapiens
TQELCERMR

SEQ ID NO: 998223 - protein, 9 aa, Homo Sapiens
IYTASVSEM

SEQ ID NO: 998224 - protein, 9 aa, Homo Sapiens
TQPELVPGK

SEQ ID NO: 998225 - protein, 9 aa, Homo Sapiens
FPDIFFCPA

SEQ ID NO: 998226 - protein, 9 aa, Homo Sapiens
GRADVAVAS

SEQ ID NO: 998227 - protein, 9 aa, Homo Sapiens
NSGTSKDHD

SEQ ID NO: 998228 - protein, 9 aa, Homo Sapiens
KRFTPEKEM

SEQ ID NO: 998229 - protein, 9 aa, Homo Sapiens
ACRRPRPWL

SEQ ID NO: 998230 - protein, 9 aa, Homo Sapiens
IPSEKPTIF

SEQ ID NO: 998231 - protein, 9 aa, Homo Sapiens
SNSEFLCVN

SEQ ID NO: 998232 - protein, 9 aa, Homo Sapiens
KKKLEAAQK

SEQ ID NO: 998233 - protein, 9 aa, Homo Sapiens
GLGGPLLSP

SEQ ID NO: 998234 - protein, 9 aa, Homo Sapiens
LHPSSTSSS

SEQ ID NO: 998235 - protein, 9 aa, Homo Sapiens
EAELVRNGA

SEQ ID NO: 998236 - protein, 9 aa, Homo Sapiens
IFLSEVTIG

SEQ ID NO: 998237 - protein, 9 aa, Homo Sapiens
TEKEAKHCV

SEQ ID NO: 998238 - protein, 9 aa, Homo Sapiens
CEKLFSCKT

SEQ ID NO: 998239 - protein, 9 aa, Homo Sapiens
VFPVNTVKN

SEQ ID NO: 998240 - protein, 9 aa, Homo Sapiens
SQGIFLLAF

SEQ ID NO: 998241 - protein, 9 aa, Homo Sapiens
EGAFGHNPH

SEQ ID NO: 998242 - protein, 9 aa, Homo Sapiens
ATRGHSCPQ

SEQ ID NO: 998243 - protein, 9 aa, Homo Sapiens
HLSRKPRLL

SEQ ID NO: 998244 - protein, 9 aa, Homo Sapiens
PMQVALSEV

SEQ ID NO: 998245 - protein, 9 aa, Homo Sapiens
PQASPIFVY

SEQ ID NO: 998246 - protein, 9 aa, Homo Sapiens
EEVRGALKR

SEQ ID NO: 998247 - protein, 9 aa, Homo Sapiens
NISPAYMNI

SEQ ID NO: 998248 - protein, 9 aa, Homo Sapiens
EHVSHDPRL

SEQ ID NO: 998249 - protein, 9 aa, Homo Sapiens
FPISPTYSC

SEQ ID NO: 998250 - protein, 9 aa, Homo Sapiens
IKQTGRHKP

SEQ ID NO: 998251 - protein, 9 aa, Homo Sapiens
LALVLTTFD

SEQ ID NO: 998252 - protein, 9 aa, Homo Sapiens
FSCPGCEHD

SEQ ID NO: 998253 - protein, 9 aa, Homo Sapiens
VSIYRTHHN

SEQ ID NO: 998254 - protein, 9 aa, Homo Sapiens
KAGVIFSVG

SEQ ID NO: 998255 - protein, 9 aa, Homo Sapiens
IPLQRGQTE

SEQ ID NO: 998256 - protein, 9 aa, Homo Sapiens
YKDPDKDFT

SEQ ID NO: 998257 - protein, 9 aa, Homo Sapiens
FTTFTTILP

SEQ ID NO: 998258 - protein, 9 aa, Homo Sapiens
DLLKAVELL

SEQ ID NO: 998259 - protein, 9 aa, Homo Sapiens
ISPAYMNII

SEQ ID NO: 998260 - protein, 9 aa, Homo Sapiens
LSHLPEEIG

SEQ ID NO: 998261 - protein, 9 aa, Homo Sapiens
LSCCQSSCC

SEQ ID NO: 998262 - protein, 9 aa, Homo Sapiens
NNGEIGDAT

SEQ ID NO: 998263 - protein, 9 aa, Homo Sapiens
IIKAESNLH

SEQ ID NO: 998264 - protein, 9 aa, Homo Sapiens
NNTGFQAQD

SEQ ID NO: 998265 - protein, 9 aa, Homo Sapiens
MVSLFSKAR

SEQ ID NO: 998266 - protein, 9 aa, Homo Sapiens
HPDSGKQTV

SEQ ID NO: 998267 - protein, 9 aa, Homo Sapiens
IFSVGRMLR

SEQ ID NO: 998268 - protein, 9 aa, Homo Sapiens
PMIYTLRSQ

SEQ ID NO: 998269 - protein, 9 aa, Homo Sapiens
NLTATFKDG

SEQ ID NO: 998270 - protein, 9 aa, Homo Sapiens
ERFARTFKQ

SEQ ID NO: 998271 - protein, 9 aa, Homo Sapiens
SNGRNSEEE

SEQ ID NO: 998272 - protein, 9 aa, Homo Sapiens
KKTKEGKGR

SEQ ID NO: 998273 - protein, 9 aa, Homo Sapiens
EDSTAQKNP

SEQ ID NO: 998274 - protein, 9 aa, Homo Sapiens
ELCERMRAQ

SEQ ID NO: 998275 - protein, 9 aa, Homo Sapiens
YRSLLFEDE

SEQ ID NO: 998276 - protein, 9 aa, Homo Sapiens
LIRLLKTAR

SEQ ID NO: 998277 - protein, 9 aa, Homo Sapiens
APAWTSLGI

SEQ ID NO: 998278 - protein, 9 aa, Homo Sapiens
LDNIVGKRG

SEQ ID NO: 998279 - protein, 9 aa, Homo Sapiens
PVSYEWTDG

SEQ ID NO: 998280 - protein, 9 aa, Homo Sapiens
GGPAPPALR

SEQ ID NO: 998281 - protein, 9 aa, Homo Sapiens
ISANKMSIA

SEQ ID NO: 998282 - protein, 9 aa, Homo Sapiens
PEVMPFWAQ

SEQ ID NO: 998283 - protein, 9 aa, Homo Sapiens
IQVVGIPGW

SEQ ID NO: 998284 - protein, 9 aa, Homo Sapiens
MEPKEGTPL

SEQ ID NO: 998285 - protein, 9 aa, Homo Sapiens
NLKKIPRDL

SEQ ID NO: 998286 - protein, 9 aa, Homo Sapiens
LAAKLKVKH

SEQ ID NO: 998287 - protein, 9 aa, Homo Sapiens
WLKSELEDN

SEQ ID NO: 998288 - protein, 9 aa, Homo Sapiens
EKARRLQGS

SEQ ID NO: 998289 - protein, 9 aa, Homo Sapiens
VLRAENEKI

SEQ ID NO: 998290 - protein, 9 aa, Homo Sapiens
DTIMKDYEN

SEQ ID NO: 998291 - protein, 9 aa, Homo Sapiens
PILRDGEYV

SEQ ID NO: 998292 - protein, 9 aa, Homo Sapiens
VFLQLRVVV

SEQ ID NO: 998293 - protein, 9 aa, Homo Sapiens
EEEERQGKA

SEQ ID NO: 998294 - protein, 9 aa, Homo Sapiens
YLGEDLKSI

SEQ ID NO: 998295 - protein, 9 aa, Homo Sapiens
AWLAKIRLN

SEQ ID NO: 998296 - protein, 9 aa, Homo Sapiens
CVQALTLAF

SEQ ID NO: 998297 - protein, 9 aa, Homo Sapiens
HILSAELEE

SEQ ID NO: 998298 - protein, 9 aa, Homo Sapiens
DILSGLVAI

SEQ ID NO: 998299 - protein, 9 aa, Homo Sapiens
PRLDRVAIV

SEQ ID NO: 998300 - protein, 9 aa, Homo Sapiens
LRADAPSHA

SEQ ID NO: 998301 - protein, 9 aa, Homo Sapiens
RNSEEENLF

SEQ ID NO: 998302 - protein, 9 aa, Homo Sapiens
LNRYSDRNH

SEQ ID NO: 998303 - protein, 9 aa, Homo Sapiens
NNLAAISVR

SEQ ID NO: 998304 - protein, 9 aa, Homo Sapiens
MSSHKALTR

SEQ ID NO: 998305 - protein, 9 aa, Homo Sapiens
AKNAQTITF

SEQ ID NO: 998306 - protein, 9 aa, Homo Sapiens
GDSFSYRDT

SEQ ID NO: 998307 - protein, 9 aa, Homo Sapiens
PEKETSSLN

SEQ ID NO: 998308 - protein, 9 aa, Homo Sapiens
SIVRPGTQA

SEQ ID NO: 998309 - protein, 9 aa, Homo Sapiens
VTPFSMSCD

SEQ ID NO: 998310 - protein, 9 aa, Homo Sapiens
YLLRDSNKT

SEQ ID NO: 998311 - protein, 9 aa, Homo Sapiens
EGQKTFQSI

SEQ ID NO: 998312 - protein, 9 aa, Homo Sapiens
IGDDHYNSE

SEQ ID NO: 998313 - protein, 9 aa, Homo Sapiens
HSPPDRQAV

SEQ ID NO: 998314 - protein, 9 aa, Homo Sapiens
VEKFKIFKH

SEQ ID NO: 998315 - protein, 9 aa, Homo Sapiens
TVSTAGFET

SEQ ID NO: 998316 - protein, 9 aa, Homo Sapiens
RPARRSVLA

SEQ ID NO: 998317 - protein, 9 aa, Homo Sapiens
DTQLGNHDR

SEQ ID NO: 998318 - protein, 9 aa, Homo Sapiens
IQESLKERG

SEQ ID NO: 998319 - protein, 9 aa, Homo Sapiens
RRNCAAERN

SEQ ID NO: 998320 - protein, 9 aa, Homo Sapiens
ISAEPGALQ

SEQ ID NO: 998321 - protein, 9 aa, Homo Sapiens
EADPASLLG

SEQ ID NO: 998322 - protein, 9 aa, Homo Sapiens
NNYFSLQLQ

SEQ ID NO: 998323 - protein, 9 aa, Homo Sapiens
PNPAAVAAA

SEQ ID NO: 998324 - protein, 9 aa, Homo Sapiens
MLAMVEKAR

SEQ ID NO: 998325 - protein, 9 aa, Homo Sapiens
RCGTCFVTN

SEQ ID NO: 998326 - protein, 9 aa, Homo Sapiens
LKMFTDFLL

SEQ ID NO: 998327 - protein, 9 aa, Homo Sapiens
ELSYPQGYS

SEQ ID NO: 998328 - protein, 9 aa, Homo Sapiens
RLECRGRAR

SEQ ID NO: 998329 - protein, 9 aa, Homo Sapiens
VAKFYDHLE

SEQ ID NO: 998330 - protein, 9 aa, Homo Sapiens
PHAKRKATR

SEQ ID NO: 998331 - protein, 9 aa, Homo Sapiens
DIKGETCFA

SEQ ID NO: 998332 - protein, 9 aa, Homo Sapiens
VNKPKNCYA

SEQ ID NO: 998333 - protein, 9 aa, Homo Sapiens
YRLTCIYTL

SEQ ID NO: 998334 - protein, 9 aa, Homo Sapiens
RGRARTAAA

SEQ ID NO: 998335 - protein, 9 aa, Homo Sapiens
QNGELGKDV

SEQ ID NO: 998336 - protein, 9 aa, Homo Sapiens
PYLGFKQIY

SEQ ID NO: 998337 - protein, 9 aa, Homo Sapiens
EALPSPSSN

SEQ ID NO: 998338 - protein, 9 aa, Homo Sapiens
SPEVLRYDE

SEQ ID NO: 998339 - protein, 9 aa, Homo Sapiens
PEKAPLVGH

SEQ ID NO: 998340 - protein, 9 aa, Homo Sapiens
ESVTVHNPK

SEQ ID NO: 998341 - protein, 9 aa, Homo Sapiens
KTEDDADHE

SEQ ID NO: 998342 - protein, 9 aa, Homo Sapiens
VPLQALHMT

SEQ ID NO: 998343 - protein, 9 aa, Homo Sapiens
FFAPQRADM

SEQ ID NO: 998344 - protein, 9 aa, Homo Sapiens
CGEEEDEEG

SEQ ID NO: 998345 - protein, 9 aa, Homo Sapiens
RLTCIYTLY

SEQ ID NO: 998346 - protein, 9 aa, Homo Sapiens
LGLLNRKDP

SEQ ID NO: 998347 - protein, 9 aa, Homo Sapiens
NGAVPGALA

SEQ ID NO: 998348 - protein, 9 aa, Homo Sapiens
KDVGLGDGA

SEQ ID NO: 998349 - protein, 9 aa, Homo Sapiens
HDCSHKEDA

SEQ ID NO: 998350 - protein, 9 aa, Homo Sapiens
SGCGLSCCQ

SEQ ID NO: 998351 - protein, 9 aa, Homo Sapiens
GSSGLLSRT

SEQ ID NO: 998352 - protein, 9 aa, Homo Sapiens
KFYGANFSW

SEQ ID NO: 998353 - protein, 9 aa, Homo Sapiens
STHLIKVRP

SEQ ID NO: 998354 - protein, 9 aa, Homo Sapiens
KGNSLATRC

SEQ ID NO: 998355 - protein, 9 aa, Homo Sapiens
AKKSENVDS

SEQ ID NO: 998356 - protein, 9 aa, Homo Sapiens
YLNVSCSQL

SEQ ID NO: 998357 - protein, 9 aa, Homo Sapiens
GIHSWRTFQ

SEQ ID NO: 998358 - protein, 9 aa, Homo Sapiens
FLKRMPSIQ

SEQ ID NO: 998359 - protein, 9 aa, Homo Sapiens
ACTNCFFLA

SEQ ID NO: 998360 - protein, 9 aa, Homo Sapiens
NTESVQTAV

SEQ ID NO: 998361 - protein, 9 aa, Homo Sapiens
DGQVSPESL

SEQ ID NO: 998362 - protein, 9 aa, Homo Sapiens
LRSQDMQAA

SEQ ID NO: 998363 - protein, 9 aa, Homo Sapiens
TGKEEAFMV

SEQ ID NO: 998364 - protein, 9 aa, Homo Sapiens
TLEKFEARR

SEQ ID NO: 998365 - protein, 9 aa, Homo Sapiens
LKNVVVVGA

SEQ ID NO: 998366 - protein, 9 aa, Homo Sapiens
VTNKERLEE

SEQ ID NO: 998367 - protein, 9 aa, Homo Sapiens
LANQFPDIF

SEQ ID NO: 998368 - protein, 9 aa, Homo Sapiens
CGHRDSGNK

SEQ ID NO: 998369 - protein, 9 aa, Homo Sapiens
RHKPTGPWE

SEQ ID NO: 998370 - protein, 9 aa, Homo Sapiens
PHYFVMTAK

SEQ ID NO: 998371 - protein, 9 aa, Homo Sapiens
DHSAFIEPR

SEQ ID NO: 998372 - protein, 9 aa, Homo Sapiens
IISYVVHLT

SEQ ID NO: 998373 - protein, 9 aa, Homo Sapiens
LIFYGIRRL

SEQ ID NO: 998374 - protein, 9 aa, Homo Sapiens
EDKFSGQSS

SEQ ID NO: 998375 - protein, 9 aa, Homo Sapiens
DVGLGDGAE

SEQ ID NO: 998376 - protein, 9 aa, Homo Sapiens
QSERFLPSE

SEQ ID NO: 998377 - protein, 9 aa, Homo Sapiens
QPLAPWNKT

SEQ ID NO: 998378 - protein, 9 aa, Homo Sapiens
RLLRKTTDM

SEQ ID NO: 998379 - protein, 9 aa, Homo Sapiens
SKVKAKNAQ

SEQ ID NO: 998380 - protein, 9 aa, Homo Sapiens
RGCVQALTL

SEQ ID NO: 998381 - protein, 9 aa, Homo Sapiens
LITGQFYDK

SEQ ID NO: 998382 - protein, 9 aa, Homo Sapiens
EKDDGQEAN

SEQ ID NO: 998383 - protein, 9 aa, Homo Sapiens
NIFLSNAPL

SEQ ID NO: 998384 - protein, 9 aa, Homo Sapiens
EFFCPSWAA

SEQ ID NO: 998385 - protein, 9 aa, Homo Sapiens
LKSFSYATA

SEQ ID NO: 998386 - protein, 9 aa, Homo Sapiens
TQDGKEIYL

SEQ ID NO: 998387 - protein, 9 aa, Homo Sapiens
GKKLGLYFG

SEQ ID NO: 998388 - protein, 9 aa, Homo Sapiens
VNTLHSRTK

SEQ ID NO: 998389 - protein, 9 aa, Homo Sapiens
SGSNFQVNS

SEQ ID NO: 998390 - protein, 9 aa, Homo Sapiens
NRVPEEKAK

SEQ ID NO: 998391 - protein, 9 aa, Homo Sapiens
LLWWLLSIV

SEQ ID NO: 998392 - protein, 9 aa, Homo Sapiens
SEVDLTVLM

SEQ ID NO: 998393 - protein, 9 aa, Homo Sapiens
YEAKMSSKG

SEQ ID NO: 998394 - protein, 9 aa, Homo Sapiens
TGGAVSKLV

SEQ ID NO: 998395 - protein, 9 aa, Homo Sapiens
MNSAGLGRP

SEQ ID NO: 998396 - protein, 9 aa, Homo Sapiens
HVDNSRDFG

SEQ ID NO: 998397 - protein, 9 aa, Homo Sapiens
SLFKIPIEE

SEQ ID NO: 998398 - protein, 9 aa, Homo Sapiens
EECLTDTEA

SEQ ID NO: 998399 - protein, 9 aa, Homo Sapiens
AKKVYLGED

SEQ ID NO: 998400 - protein, 9 aa, Homo Sapiens
KHFSGGLAK

SEQ ID NO: 998401 - protein, 9 aa, Homo Sapiens
TYQQPVMSP

SEQ ID NO: 998402 - protein, 9 aa, Homo Sapiens
SKEKEYVQF

SEQ ID NO: 998403 - protein, 9 aa, Homo Sapiens
DFDKIVHEL

SEQ ID NO: 998404 - protein, 9 aa, Homo Sapiens
VHRRPARRS

SEQ ID NO: 998405 - protein, 9 aa, Homo Sapiens
FVKVRAYQS

SEQ ID NO: 998406 - protein, 9 aa, Homo Sapiens
NRSRTQVWL

SEQ ID NO: 998407 - protein, 9 aa, Homo Sapiens
EKYGLLAIL

SEQ ID NO: 998408 - protein, 9 aa, Homo Sapiens
TLKILNNTQ

SEQ ID NO: 998409 - protein, 9 aa, Homo Sapiens
ILLIFYGIR

SEQ ID NO: 998410 - protein, 9 aa, Homo Sapiens
PLEPIPGTA

SEQ ID NO: 998411 - protein, 9 aa, Homo Sapiens
KAEKQKCPV

SEQ ID NO: 998412 - protein, 9 aa, Homo Sapiens
THLIKVRPT

SEQ ID NO: 998413 - protein, 9 aa, Homo Sapiens
KKKTRKRIF

SEQ ID NO: 998414 - protein, 9 aa, Homo Sapiens
GGNCKEFQT

SEQ ID NO: 998415 - protein, 9 aa, Homo Sapiens
SPHQGLSAC

SEQ ID NO: 998416 - protein, 9 aa, Homo Sapiens
NFQVNSLPA

SEQ ID NO: 998417 - protein, 9 aa, Homo Sapiens
SPRGPPPLR

SEQ ID NO: 998418 - protein, 9 aa, Homo Sapiens
QDPPCLRLS

SEQ ID NO: 998419 - protein, 9 aa, Homo Sapiens
PTLDVLVSF

SEQ ID NO: 998420 - protein, 9 aa, Homo Sapiens
YTRRRIPQN

SEQ ID NO: 998421 - protein, 9 aa, Homo Sapiens
SGFGLGSDG

SEQ ID NO: 998422 - protein, 9 aa, Homo Sapiens
TFTTILPDD

SEQ ID NO: 998423 - protein, 9 aa, Homo Sapiens
TMHIKRREC

SEQ ID NO: 998424 - protein, 9 aa, Homo Sapiens
NQDPMTQSI

SEQ ID NO: 998425 - protein, 9 aa, Homo Sapiens
SLLELDNVL

SEQ ID NO: 998426 - protein, 9 aa, Homo Sapiens
EIKTSDHRP

SEQ ID NO: 998427 - protein, 9 aa, Homo Sapiens
FSVGRMLRY

SEQ ID NO: 998428 - protein, 9 aa, Homo Sapiens
RAMLKAEKT

SEQ ID NO: 998429 - protein, 9 aa, Homo Sapiens
GTFYVADLG

SEQ ID NO: 998430 - protein, 9 aa, Homo Sapiens
VAELLLLNR

SEQ ID NO: 998431 - protein, 9 aa, Homo Sapiens
GAGAIELLK

SEQ ID NO: 998432 - protein, 9 aa, Homo Sapiens
VLNRALDCE

SEQ ID NO: 998433 - protein, 9 aa, Homo Sapiens
GIPPPFSPM

SEQ ID NO: 998434 - protein, 9 aa, Homo Sapiens
KFSAHRRIH

SEQ ID NO: 998435 - protein, 9 aa, Homo Sapiens
IMKLTLPES

SEQ ID NO: 998436 - protein, 9 aa, Homo Sapiens
QEILMHHSP

SEQ ID NO: 998437 - protein, 9 aa, Homo Sapiens
FMVAISPLE

SEQ ID NO: 998438 - protein, 9 aa, Homo Sapiens
TVNWRSCIC

SEQ ID NO: 998439 - protein, 9 aa, Homo Sapiens
NLSTILPTE

SEQ ID NO: 998440 - protein, 9 aa, Homo Sapiens
SQLLCLCME

SEQ ID NO: 998441 - protein, 9 aa, Homo Sapiens
WPSTLKYHK

SEQ ID NO: 998442 - protein, 9 aa, Homo Sapiens
LEKFIHSGI

SEQ ID NO: 998443 - protein, 9 aa, Homo Sapiens
LPVTTKENR

SEQ ID NO: 998444 - protein, 9 aa, Homo Sapiens
MYSSSRYPP

SEQ ID NO: 998445 - protein, 9 aa, Homo Sapiens
DKPSLSVQP

SEQ ID NO: 998446 - protein, 9 aa, Homo Sapiens
TKLFGRILE

SEQ ID NO: 998447 - protein, 9 aa, Homo Sapiens
SPYELSYPQ

SEQ ID NO: 998448 - protein, 9 aa, Homo Sapiens
ISSLAVERL

SEQ ID NO: 998449 - protein, 9 aa, Homo Sapiens
CRCSKCGEG

SEQ ID NO: 998450 - protein, 9 aa, Homo Sapiens
PHDIFKAND

SEQ ID NO: 998451 - protein, 9 aa, Homo Sapiens
GTGDYKVTV

SEQ ID NO: 998452 - protein, 9 aa, Homo Sapiens
SHVFRKKNR

SEQ ID NO: 998453 - protein, 9 aa, Homo Sapiens
ILFTVWKHF

SEQ ID NO: 998454 - protein, 9 aa, Homo Sapiens
PIPEDEPFV

SEQ ID NO: 998455 - protein, 9 aa, Homo Sapiens
ATPETSQPS

SEQ ID NO: 998456 - protein, 9 aa, Homo Sapiens
SSLNPLAQS

SEQ ID NO: 998457 - protein, 9 aa, Homo Sapiens
KKLISGDIS

SEQ ID NO: 998458 - protein, 9 aa, Homo Sapiens
RHDNGNFFP

SEQ ID NO: 998459 - protein, 9 aa, Homo Sapiens
SSAYSPSDA

SEQ ID NO: 998460 - protein, 9 aa, Homo Sapiens
TTKDTFTAS

SEQ ID NO: 998461 - protein, 9 aa, Homo Sapiens
LQERSNLGT

SEQ ID NO: 998462 - protein, 9 aa, Homo Sapiens
QKGCIPLQR

SEQ ID NO: 998463 - protein, 9 aa, Homo Sapiens
TCPRPLTPL

SEQ ID NO: 998464 - protein, 9 aa, Homo Sapiens
QVLSLNHEI

SEQ ID NO: 998465 - protein, 9 aa, Homo Sapiens
HKFNLMYAK

SEQ ID NO: 998466 - protein, 9 aa, Homo Sapiens
DYENLWNTV

SEQ ID NO: 998467 - protein, 9 aa, Homo Sapiens
QGANPAFRI

SEQ ID NO: 998468 - protein, 9 aa, Homo Sapiens
MELNHLKNK

SEQ ID NO: 998469 - protein, 9 aa, Homo Sapiens
QWTDKKKAG

SEQ ID NO: 998470 - protein, 9 aa, Homo Sapiens
KGLRLKLPL

SEQ ID NO: 998471 - protein, 9 aa, Homo Sapiens
KMFTDFLLF

SEQ ID NO: 998472 - protein, 9 aa, Homo Sapiens
YLAFDILRH

SEQ ID NO: 998473 - protein, 9 aa, Homo Sapiens
VVGAGFCDG

SEQ ID NO: 998474 - protein, 9 aa, Homo Sapiens
GTINIGKAF

SEQ ID NO: 998475 - protein, 9 aa, Homo Sapiens
VYEQKTKLP

SEQ ID NO: 998476 - protein, 9 aa, Homo Sapiens
GLQHSPLAA

SEQ ID NO: 998477 - protein, 9 aa, Homo Sapiens
SCCTSYFCT

SEQ ID NO: 998478 - protein, 9 aa, Homo Sapiens
CGTNAFFPM

SEQ ID NO: 998479 - protein, 9 aa, Homo Sapiens
PKIYPFNLL

SEQ ID NO: 998480 - protein, 9 aa, Homo Sapiens
KEKRVAMKE

SEQ ID NO: 998481 - protein, 9 aa, Homo Sapiens
LGVSFPSSA

SEQ ID NO: 998482 - protein, 9 aa, Homo Sapiens
GHATHLSVT

SEQ ID NO: 998483 - protein, 9 aa, Homo Sapiens
ADAPSHASS

SEQ ID NO: 998484 - protein, 9 aa, Homo Sapiens
TPRTTVFSC

SEQ ID NO: 998485 - protein, 9 aa, Homo Sapiens
EEGRKQLQN

SEQ ID NO: 998486 - protein, 9 aa, Homo Sapiens
EFSRREKVE

SEQ ID NO: 998487 - protein, 9 aa, Homo Sapiens
RCGACLSAS

SEQ ID NO: 998488 - protein, 9 aa, Homo Sapiens
NKTPSDPVI

SEQ ID NO: 998489 - protein, 9 aa, Homo Sapiens
SSVTALETL

SEQ ID NO: 998490 - protein, 9 aa, Homo Sapiens
SRLGKKSRR

SEQ ID NO: 998491 - protein, 9 aa, Homo Sapiens
ASFEGEDED

SEQ ID NO: 998492 - protein, 9 aa, Homo Sapiens
TGMDRREFR

SEQ ID NO: 998493 - protein, 9 aa, Homo Sapiens
MRLVFKISH

SEQ ID NO: 998494 - protein, 9 aa, Homo Sapiens
RISWTAITT

SEQ ID NO: 998495 - protein, 9 aa, Homo Sapiens
DWKPFHSGR

SEQ ID NO: 998496 - protein, 9 aa, Homo Sapiens
SREMNKTVI

SEQ ID NO: 998497 - protein, 9 aa, Homo Sapiens
TSIDKDAGR

SEQ ID NO: 998498 - protein, 9 aa, Homo Sapiens
VCTSETRST

SEQ ID NO: 998499 - protein, 9 aa, Homo Sapiens
KPRRNCAAE

SEQ ID NO: 998500 - protein, 9 aa, Homo Sapiens
DRNQRWVQL

SEQ ID NO: 998501 - protein, 9 aa, Homo Sapiens
RFIQRYLVY

SEQ ID NO: 998502 - protein, 9 aa, Homo Sapiens
PRLVILDPA

SEQ ID NO: 998503 - protein, 9 aa, Homo Sapiens
ECPFSLADH

SEQ ID NO: 998504 - protein, 9 aa, Homo Sapiens
WAYQFPYAH

SEQ ID NO: 998505 - protein, 9 aa, Homo Sapiens
TESVLYGCT

SEQ ID NO: 998506 - protein, 9 aa, Homo Sapiens
NLDEDILDN

SEQ ID NO: 998507 - protein, 9 aa, Homo Sapiens
QQPVMSPNQ

SEQ ID NO: 998508 - protein, 9 aa, Homo Sapiens
YLQNRSRTQ

SEQ ID NO: 998509 - protein, 9 aa, Homo Sapiens
MSSHFIQDL

SEQ ID NO: 998510 - protein, 9 aa, Homo Sapiens
AIIKNLRKR

SEQ ID NO: 998511 - protein, 9 aa, Homo Sapiens
EDVGFCGNS

SEQ ID NO: 998512 - protein, 9 aa, Homo Sapiens
KPFHSGREH

SEQ ID NO: 998513 - protein, 9 aa, Homo Sapiens
ILTKSPFAY

SEQ ID NO: 998514 - protein, 9 aa, Homo Sapiens
LHLDSNKLT

SEQ ID NO: 998515 - protein, 9 aa, Homo Sapiens
HLRPLWEVP

SEQ ID NO: 998516 - protein, 9 aa, Homo Sapiens
TTSSQAPSL

SEQ ID NO: 998517 - protein, 9 aa, Homo Sapiens
LQRAEKTVD

SEQ ID NO: 998518 - protein, 9 aa, Homo Sapiens
KETLEKFEA

SEQ ID NO: 998519 - protein, 9 aa, Homo Sapiens
LDVLVSFSF

SEQ ID NO: 998520 - protein, 9 aa, Homo Sapiens
FFSTPKIYP

SEQ ID NO: 998521 - protein, 9 aa, Homo Sapiens
PPVPPTGDF

SEQ ID NO: 998522 - protein, 9 aa, Homo Sapiens
LVHLEENQL

SEQ ID NO: 998523 - protein, 9 aa, Homo Sapiens
SRCGACLSA

SEQ ID NO: 998524 - protein, 9 aa, Homo Sapiens
QIYLWTMFQ

SEQ ID NO: 998525 - protein, 9 aa, Homo Sapiens
CASDSPQCD

SEQ ID NO: 998526 - protein, 9 aa, Homo Sapiens
VDLFRAVSK

SEQ ID NO: 998527 - protein, 9 aa, Homo Sapiens
LFVENGHSE

SEQ ID NO: 998528 - protein, 9 aa, Homo Sapiens
CEECGKAYS

SEQ ID NO: 998529 - protein, 9 aa, Homo Sapiens
YVINIAHVD

SEQ ID NO: 998530 - protein, 9 aa, Homo Sapiens
AAAELAQSL

SEQ ID NO: 998531 - protein, 9 aa, Homo Sapiens
GEEKVVAAA

SEQ ID NO: 998532 - protein, 9 aa, Homo Sapiens
PLTKPGSSD

SEQ ID NO: 998533 - protein, 9 aa, Homo Sapiens
MPTLCSFFG

SEQ ID NO: 998534 - protein, 9 aa, Homo Sapiens
AELAQSLAS

SEQ ID NO: 998535 - protein, 9 aa, Homo Sapiens
DEKMLMKVI

SEQ ID NO: 998536 - protein, 9 aa, Homo Sapiens
VRQEACISW

SEQ ID NO: 998537 - protein, 9 aa, Homo Sapiens
QASPIFVYL

SEQ ID NO: 998538 - protein, 9 aa, Homo Sapiens
IPIFLSEVT

SEQ ID NO: 998539 - protein, 9 aa, Homo Sapiens
LILSSGRRD

SEQ ID NO: 998540 - protein, 9 aa, Homo Sapiens
LALALLGGE

SEQ ID NO: 998541 - protein, 9 aa, Homo Sapiens
PKKFNLTAP

SEQ ID NO: 998542 - protein, 9 aa, Homo Sapiens
MQSCGEEED

SEQ ID NO: 998543 - protein, 9 aa, Homo Sapiens
YWDLNVYFN

SEQ ID NO: 998544 - protein, 9 aa, Homo Sapiens
MSQRAIFFA

SEQ ID NO: 998545 - protein, 9 aa, Homo Sapiens
IFKGNSLAT

SEQ ID NO: 998546 - protein, 9 aa, Homo Sapiens
KKECCSTGR

SEQ ID NO: 998547 - protein, 9 aa, Homo Sapiens
LISIFEQTY

SEQ ID NO: 998548 - protein, 9 aa, Homo Sapiens
HSPHQGLSA

SEQ ID NO: 998549 - protein, 9 aa, Homo Sapiens
SAEPGALQE

SEQ ID NO: 998550 - protein, 9 aa, Homo Sapiens
PRCRSCDCH

SEQ ID NO: 998551 - protein, 9 aa, Homo Sapiens
RAAELANAK

SEQ ID NO: 998552 - protein, 9 aa, Homo Sapiens
TLSTTPVNT

SEQ ID NO: 998553 - protein, 9 aa, Homo Sapiens
ALLYPDSRS

SEQ ID NO: 998554 - protein, 9 aa, Homo Sapiens
AGFLLQEAV

SEQ ID NO: 998555 - protein, 9 aa, Homo Sapiens
PWLKSELED

SEQ ID NO: 998556 - protein, 9 aa, Homo Sapiens
MMELNHLKN

SEQ ID NO: 998557 - protein, 9 aa, Homo Sapiens
VTPRPFEEQ

SEQ ID NO: 998558 - protein, 9 aa, Homo Sapiens
ARLECRGRA

SEQ ID NO: 998559 - protein, 9 aa, Homo Sapiens
GTSGDYDDS

SEQ ID NO: 998560 - protein, 9 aa, Homo Sapiens
CAESFNQKG

SEQ ID NO: 998561 - protein, 9 aa, Homo Sapiens
GVLLQRAEK

SEQ ID NO: 998562 - protein, 9 aa, Homo Sapiens
NLTFWGELM

SEQ ID NO: 998563 - protein, 9 aa, Homo Sapiens
LSFYIFTLI

SEQ ID NO: 998564 - protein, 9 aa, Homo Sapiens
RLKLPLDRI

SEQ ID NO: 998565 - protein, 9 aa, Homo Sapiens
RSCICNSGK

SEQ ID NO: 998566 - protein, 9 aa, Homo Sapiens
LQKDTIYKF

SEQ ID NO: 998567 - protein, 9 aa, Homo Sapiens
TRMSVKPVS

SEQ ID NO: 998568 - protein, 9 aa, Homo Sapiens
ANNGEIGDA

SEQ ID NO: 998569 - protein, 9 aa, Homo Sapiens
FFQQELRKR

SEQ ID NO: 998570 - protein, 9 aa, Homo Sapiens
KSYRKVRKL

SEQ ID NO: 998571 - protein, 9 aa, Homo Sapiens
NLNVTISLS

SEQ ID NO: 998572 - protein, 9 aa, Homo Sapiens
YISFVCIYR

SEQ ID NO: 998573 - protein, 9 aa, Homo Sapiens
NQNCSNSEF

SEQ ID NO: 998574 - protein, 9 aa, Homo Sapiens
LSLQRLLVA

SEQ ID NO: 998575 - protein, 9 aa, Homo Sapiens
PSSSDTPET

SEQ ID NO: 998576 - protein, 9 aa, Homo Sapiens
YWDSATCKQ

SEQ ID NO: 998577 - protein, 9 aa, Homo Sapiens
QRKMNETPT

SEQ ID NO: 998578 - protein, 9 aa, Homo Sapiens
EVRGALKRS

SEQ ID NO: 998579 - protein, 9 aa, Homo Sapiens
DISGPLQGS

SEQ ID NO: 998580 - protein, 9 aa, Homo Sapiens
DVCMGGGNR

SEQ ID NO: 998581 - protein, 9 aa, Homo Sapiens
LTLSVSSLL

SEQ ID NO: 998582 - protein, 9 aa, Homo Sapiens
QPLPKCPPK

SEQ ID NO: 998583 - protein, 9 aa, Homo Sapiens
EAFMVRDSR

SEQ ID NO: 998584 - protein, 9 aa, Homo Sapiens
LAIMRNGVT

SEQ ID NO: 998585 - protein, 9 aa, Homo Sapiens
VSCSQLDTG

SEQ ID NO: 998586 - protein, 9 aa, Homo Sapiens
LLSRTHPPL

SEQ ID NO: 998587 - protein, 9 aa, Homo Sapiens
EEAFMVRDS

SEQ ID NO: 998588 - protein, 9 aa, Homo Sapiens
LFPLYGQEE

SEQ ID NO: 998589 - protein, 9 aa, Homo Sapiens
NLGVMVLFI

SEQ ID NO: 998590 - protein, 9 aa, Homo Sapiens
SRLSLAGSA

SEQ ID NO: 998591 - protein, 9 aa, Homo Sapiens
FKHLSRKPR

SEQ ID NO: 998592 - protein, 9 aa, Homo Sapiens
KFRGFLKRH

SEQ ID NO: 998593 - protein, 9 aa, Homo Sapiens
KLGLYFGAS

SEQ ID NO: 998594 - protein, 9 aa, Homo Sapiens
ETSSLNPLA

SEQ ID NO: 998595 - protein, 9 aa, Homo Sapiens
LALAQKHPY

SEQ ID NO: 998596 - protein, 9 aa, Homo Sapiens
SSSLSLSLP

SEQ ID NO: 998597 - protein, 9 aa, Homo Sapiens
RTIQRYLAF

SEQ ID NO: 998598 - protein, 9 aa, Homo Sapiens
VYCICLGKF

SEQ ID NO: 998599 - protein, 9 aa, Homo Sapiens
KLPLDRIVK

SEQ ID NO: 998600 - protein, 9 aa, Homo Sapiens
SKFLTEAEI

SEQ ID NO: 998601 - protein, 9 aa, Homo Sapiens
FLRNLFSPK

SEQ ID NO: 998602 - protein, 9 aa, Homo Sapiens
IKFNAVPYS

SEQ ID NO: 998603 - protein, 9 aa, Homo Sapiens
AGGEEFEVL

SEQ ID NO: 998604 - protein, 9 aa, Homo Sapiens
ILMHHSPQV

SEQ ID NO: 998605 - protein, 9 aa, Homo Sapiens
LSGSDGLDS

SEQ ID NO: 998606 - protein, 9 aa, Homo Sapiens
TTPVNTSIP

SEQ ID NO: 998607 - protein, 9 aa, Homo Sapiens
DIELMFLNC

SEQ ID NO: 998608 - protein, 9 aa, Homo Sapiens
RLFLSADFC

SEQ ID NO: 998609 - protein, 9 aa, Homo Sapiens
PPPPLPSSS

SEQ ID NO: 998610 - protein, 9 aa, Homo Sapiens
KMGLTGPLK

SEQ ID NO: 998611 - protein, 9 aa, Homo Sapiens
EQKVASHQA

SEQ ID NO: 998612 - protein, 9 aa, Homo Sapiens
PVTTKENRE

SEQ ID NO: 998613 - protein, 9 aa, Homo Sapiens
PVVCDSSQK

SEQ ID NO: 998614 - protein, 9 aa, Homo Sapiens
SHDGLRQDM

SEQ ID NO: 998615 - protein, 9 aa, Homo Sapiens
HGYKPHFVS

SEQ ID NO: 998616 - protein, 9 aa, Homo Sapiens
ESEKPLENN

SEQ ID NO: 998617 - protein, 9 aa, Homo Sapiens
PDSGKQTVR

SEQ ID NO: 998618 - protein, 9 aa, Homo Sapiens
FEEQFQFQS

SEQ ID NO: 998619 - protein, 9 aa, Homo Sapiens
KFASVFYTN

SEQ ID NO: 998620 - protein, 9 aa, Homo Sapiens
THRDPPHKP

SEQ ID NO: 998621 - protein, 9 aa, Homo Sapiens
EATKLFGRI

SEQ ID NO: 998622 - protein, 9 aa, Homo Sapiens
NVLDMPVDP

SEQ ID NO: 998623 - protein, 9 aa, Homo Sapiens
TRRRIPQNH

SEQ ID NO: 998624 - protein, 9 aa, Homo Sapiens
KTVRYCQGF

SEQ ID NO: 998625 - protein, 9 aa, Homo Sapiens
RNQRWVQLR

SEQ ID NO: 998626 - protein, 9 aa, Homo Sapiens
ASSHIGNFT

SEQ ID NO: 998627 - protein, 9 aa, Homo Sapiens
CMTVQQCNF

SEQ ID NO: 998628 - protein, 9 aa, Homo Sapiens
RNCAAERNP

SEQ ID NO: 998629 - protein, 9 aa, Homo Sapiens
WLSTECDFH

SEQ ID NO: 998630 - protein, 9 aa, Homo Sapiens
KKKAGKKPS

SEQ ID NO: 998631 - protein, 9 aa, Homo Sapiens
ITFWGACFA

SEQ ID NO: 998632 - protein, 9 aa, Homo Sapiens
GLSACMVCR

SEQ ID NO: 998633 - protein, 9 aa, Homo Sapiens
SPEKAPLVG

SEQ ID NO: 998634 - protein, 9 aa, Homo Sapiens
SNVGTSGDY

SEQ ID NO: 998635 - protein, 9 aa, Homo Sapiens
KVIRCLGSW

SEQ ID NO: 998636 - protein, 9 aa, Homo Sapiens
MWQNIISYV

SEQ ID NO: 998637 - protein, 9 aa, Homo Sapiens
QASFEGEDE

SEQ ID NO: 998638 - protein, 9 aa, Homo Sapiens
VLFILCLIS

SEQ ID NO: 998639 - protein, 9 aa, Homo Sapiens
QKHPYLTQL

SEQ ID NO: 998640 - protein, 9 aa, Homo Sapiens
KCAKCRLLL

SEQ ID NO: 998641 - protein, 9 aa, Homo Sapiens
DSTRMSVKP

SEQ ID NO: 998642 - protein, 9 aa, Homo Sapiens
FDSFFLDKV

SEQ ID NO: 998643 - protein, 9 aa, Homo Sapiens
PPPFLRGHY

SEQ ID NO: 998644 - protein, 9 aa, Homo Sapiens
DLEELERFA

SEQ ID NO: 998645 - protein, 9 aa, Homo Sapiens
LLTNNSGTS

SEQ ID NO: 998646 - protein, 9 aa, Homo Sapiens
FLLLLNICT

SEQ ID NO: 998647 - protein, 9 aa, Homo Sapiens
VMAITANLV

SEQ ID NO: 998648 - protein, 9 aa, Homo Sapiens
ALGIVPMCF

SEQ ID NO: 998649 - protein, 9 aa, Homo Sapiens
EKRVAMKEA

SEQ ID NO: 998650 - protein, 9 aa, Homo Sapiens
FGTFQAWHR

SEQ ID NO: 998651 - protein, 9 aa, Homo Sapiens
DSFTDQSSR

SEQ ID NO: 998652 - protein, 9 aa, Homo Sapiens
SSNYRIGPV

SEQ ID NO: 998653 - protein, 9 aa, Homo Sapiens
QRIPLPRRT

SEQ ID NO: 998654 - protein, 9 aa, Homo Sapiens
EQKVAEQDD

SEQ ID NO: 998655 - protein, 9 aa, Homo Sapiens
CDKVFRFFE

SEQ ID NO: 998656 - protein, 9 aa, Homo Sapiens
ARMAMVLGA

SEQ ID NO: 998657 - protein, 9 aa, Homo Sapiens
NKEGLLLQT

SEQ ID NO: 998658 - protein, 9 aa, Homo Sapiens
GLTGPLKTP

SEQ ID NO: 998659 - protein, 9 aa, Homo Sapiens
KKSKVAPAK

SEQ ID NO: 998660 - protein, 9 aa, Homo Sapiens
VYVMEINVE

SEQ ID NO: 998661 - protein, 9 aa, Homo Sapiens
VCMGGGNRD

SEQ ID NO: 998662 - protein, 9 aa, Homo Sapiens
EPKKFNLTA

SEQ ID NO: 998663 - protein, 9 aa, Homo Sapiens
LAAISVRIS

SEQ ID NO: 998664 - protein, 9 aa, Homo Sapiens
CSEILSGKF

SEQ ID NO: 998665 - protein, 9 aa, Homo Sapiens
PRIRVEFLL

SEQ ID NO: 998666 - protein, 9 aa, Homo Sapiens
FLASTSPLL

SEQ ID NO: 998667 - protein, 9 aa, Homo Sapiens
NPDSGMYSS

SEQ ID NO: 998668 - protein, 9 aa, Homo Sapiens
ALTTCPRPL

SEQ ID NO: 998669 - protein, 9 aa, Homo Sapiens
KKVYLGEDL

SEQ ID NO: 998670 - protein, 9 aa, Homo Sapiens
LRDSNKTTG

SEQ ID NO: 998671 - protein, 9 aa, Homo Sapiens
IVIRLLEPQ

SEQ ID NO: 998672 - protein, 9 aa, Homo Sapiens
KNKMGLTGP

SEQ ID NO: 998673 - protein, 9 aa, Homo Sapiens
MEKDVGLGD

SEQ ID NO: 998674 - protein, 9 aa, Homo Sapiens
QSHFKHLSR

SEQ ID NO: 998675 - protein, 9 aa, Homo Sapiens
WKHFSGGLA

SEQ ID NO: 998676 - protein, 9 aa, Homo Sapiens
DIFFCPALP

SEQ ID NO: 998677 - protein, 9 aa, Homo Sapiens
LCTGDYDRT

SEQ ID NO: 998678 - protein, 9 aa, Homo Sapiens
VDLITTCYG

SEQ ID NO: 998679 - protein, 9 aa, Homo Sapiens
MKRHSSEDP

SEQ ID NO: 998680 - protein, 9 aa, Homo Sapiens
FKCKDCKKV

SEQ ID NO: 998681 - protein, 9 aa, Homo Sapiens
VSLLQPVNE

SEQ ID NO: 998682 - protein, 9 aa, Homo Sapiens
IKRRECAYC

SEQ ID NO: 998683 - protein, 9 aa, Homo Sapiens
ASRGFLSIA

SEQ ID NO: 998684 - protein, 9 aa, Homo Sapiens
EIKGRDLDL

SEQ ID NO: 998685 - protein, 9 aa, Homo Sapiens
KKVVPEKKV

SEQ ID NO: 998686 - protein, 9 aa, Homo Sapiens
VVAMMDQGC

SEQ ID NO: 998687 - protein, 9 aa, Homo Sapiens
TCSNANLKK

SEQ ID NO: 998688 - protein, 9 aa, Homo Sapiens
SSSKIVAPR

SEQ ID NO: 998689 - protein, 9 aa, Homo Sapiens
LSVTGLSSA

SEQ ID NO: 998690 - protein, 9 aa, Homo Sapiens
YEILYWDSA

SEQ ID NO: 998691 - protein, 9 aa, Homo Sapiens
MNKTVILAD

SEQ ID NO: 998692 - protein, 9 aa, Homo Sapiens
DHLNAMDSN

SEQ ID NO: 998693 - protein, 9 aa, Homo Sapiens
PFSTGLWGR

SEQ ID NO: 998694 - protein, 9 aa, Homo Sapiens
SKKTPSEEN

SEQ ID NO: 998695 - protein, 9 aa, Homo Sapiens
LKPLVENCA

SEQ ID NO: 998696 - protein, 9 aa, Homo Sapiens
PQNHSESFF

SEQ ID NO: 998697 - protein, 9 aa, Homo Sapiens
SNDNSPELI

SEQ ID NO: 998698 - protein, 9 aa, Homo Sapiens
VSEMSVVGT

SEQ ID NO: 998699 - protein, 9 aa, Homo Sapiens
ALADAIIKL

SEQ ID NO: 998700 - protein, 9 aa, Homo Sapiens
TTDMEIREL

SEQ ID NO: 998701 - protein, 9 aa, Homo Sapiens
SLPFVLCQG

SEQ ID NO: 998702 - protein, 9 aa, Homo Sapiens
GKNFSYPEP

SEQ ID NO: 998703 - protein, 9 aa, Homo Sapiens
SQPDKVLIV

SEQ ID NO: 998704 - protein, 9 aa, Homo Sapiens
KWGPECNYL

SEQ ID NO: 998705 - protein, 9 aa, Homo Sapiens
VGDKTSATD

SEQ ID NO: 998706 - protein, 9 aa, Homo Sapiens
EPWEDEGAE

SEQ ID NO: 998707 - protein, 9 aa, Homo Sapiens
GLRLKLPLD

SEQ ID NO: 998708 - protein, 9 aa, Homo Sapiens
EPMDKNCYE

SEQ ID NO: 998709 - protein, 9 aa, Homo Sapiens
IWGALSIMR

SEQ ID NO: 998710 - protein, 9 aa, Homo Sapiens
PPHISQCDK

SEQ ID NO: 998711 - protein, 9 aa, Homo Sapiens
TPSEENFET

SEQ ID NO: 998712 - protein, 9 aa, Homo Sapiens
CALAAADPH

SEQ ID NO: 998713 - protein, 9 aa, Homo Sapiens
GEEDFDSDY

SEQ ID NO: 998714 - protein, 9 aa, Homo Sapiens
IVEDVMMSL

SEQ ID NO: 998715 - protein, 9 aa, Homo Sapiens
ASSDSNTES

SEQ ID NO: 998716 - protein, 9 aa, Homo Sapiens
SATDIKGKE

SEQ ID NO: 998717 - protein, 9 aa, Homo Sapiens
CNLKKKLLP

SEQ ID NO: 998718 - protein, 9 aa, Homo Sapiens
YTASVSEMS

SEQ ID NO: 998719 - protein, 9 aa, Homo Sapiens
DENGFLFKD

SEQ ID NO: 998720 - protein, 9 aa, Homo Sapiens
ELLKILPEI

SEQ ID NO: 998721 - protein, 9 aa, Homo Sapiens
RLTFSFGCK

SEQ ID NO: 998722 - protein, 9 aa, Homo Sapiens
SDLLMTSAD

SEQ ID NO: 998723 - protein, 9 aa, Homo Sapiens
RKKSSQELY

SEQ ID NO: 998724 - protein, 9 aa, Homo Sapiens
PDPEKPVCL

SEQ ID NO: 998725 - protein, 9 aa, Homo Sapiens
PRKDGLPGR

SEQ ID NO: 998726 - protein, 9 aa, Homo Sapiens
GKAYSRSST

SEQ ID NO: 998727 - protein, 9 aa, Homo Sapiens
GTTFFGMSS

SEQ ID NO: 998728 - protein, 9 aa, Homo Sapiens
YCHSPHQGL

SEQ ID NO: 998729 - protein, 9 aa, Homo Sapiens
ASVAPASRL

SEQ ID NO: 998730 - protein, 9 aa, Homo Sapiens
AIKSYRKVR

SEQ ID NO: 998731 - protein, 9 aa, Homo Sapiens
DEIFSADLV

SEQ ID NO: 998732 - protein, 9 aa, Homo Sapiens
QQLAAAAEL

SEQ ID NO: 998733 - protein, 9 aa, Homo Sapiens
DSGSNFQVN

SEQ ID NO: 998734 - protein, 9 aa, Homo Sapiens
EVLEYWMRL

SEQ ID NO: 998735 - protein, 9 aa, Homo Sapiens
VSTAGFETT

SEQ ID NO: 998736 - protein, 9 aa, Homo Sapiens
CAKCRLLLF

SEQ ID NO: 998737 - protein, 9 aa, Homo Sapiens
TSSKKTMNV

SEQ ID NO: 998738 - protein, 9 aa, Homo Sapiens
FHPLPPSYR

SEQ ID NO: 998739 - protein, 9 aa, Homo Sapiens
REKVEVNGF

SEQ ID NO: 998740 - protein, 9 aa, Homo Sapiens
FSQDLKKYM

SEQ ID NO: 998741 - protein, 9 aa, Homo Sapiens
VEKRMMGQR

SEQ ID NO: 998742 - protein, 9 aa, Homo Sapiens
ILKKKGIVV

SEQ ID NO: 998743 - protein, 9 aa, Homo Sapiens
FQDFKDAAP

SEQ ID NO: 998744 - protein, 9 aa, Homo Sapiens
VAGLTESVQ

SEQ ID NO: 998745 - protein, 9 aa, Homo Sapiens
SNLHSYQKT

SEQ ID NO: 998746 - protein, 9 aa, Homo Sapiens
EPLHKVYEQ

SEQ ID NO: 998747 - protein, 9 aa, Homo Sapiens
PLAIKLKKH

SEQ ID NO: 998748 - protein, 9 aa, Homo Sapiens
HSHERSYSC

SEQ ID NO: 998749 - protein, 9 aa, Homo Sapiens
SYSSCPEIK

SEQ ID NO: 998750 - protein, 9 aa, Homo Sapiens
WWEVEETRT

SEQ ID NO: 998751 - protein, 9 aa, Homo Sapiens
CAAERNPAL

SEQ ID NO: 998752 - protein, 9 aa, Homo Sapiens
RLGKKSRRE

SEQ ID NO: 998753 - protein, 9 aa, Homo Sapiens
ITKTCHKSY

SEQ ID NO: 998754 - protein, 9 aa, Homo Sapiens
RESMRKDHS

SEQ ID NO: 998755 - protein, 9 aa, Homo Sapiens
KGCIPLQRG

SEQ ID NO: 998756 - protein, 9 aa, Homo Sapiens
TESVQGVDA

SEQ ID NO: 998757 - protein, 9 aa, Homo Sapiens
PVGYEAKMS

SEQ ID NO: 998758 - protein, 9 aa, Homo Sapiens
TVIRPFLKK

SEQ ID NO: 998759 - protein, 9 aa, Homo Sapiens
NHGDLVFLH

SEQ ID NO: 998760 - protein, 9 aa, Homo Sapiens
AWSTSMPQL

SEQ ID NO: 998761 - protein, 9 aa, Homo Sapiens
RRRATTLRE

SEQ ID NO: 998762 - protein, 9 aa, Homo Sapiens
SEAKKSENV

SEQ ID NO: 998763 - protein, 9 aa, Homo Sapiens
IGAVLAGSL

SEQ ID NO: 998764 - protein, 9 aa, Homo Sapiens
GNFSLLELD

SEQ ID NO: 998765 - protein, 9 aa, Homo Sapiens
EVHLARSIV

SEQ ID NO: 998766 - protein, 9 aa, Homo Sapiens
QVYCDMKTD

SEQ ID NO: 998767 - protein, 9 aa, Homo Sapiens
MFRCGTCFV

SEQ ID NO: 998768 - protein, 9 aa, Homo Sapiens
GRGWHGEEK

SEQ ID NO: 998769 - protein, 9 aa, Homo Sapiens
FYIFTLIGN

SEQ ID NO: 998770 - protein, 9 aa, Homo Sapiens
PLGMRPPPP

SEQ ID NO: 998771 - protein, 9 aa, Homo Sapiens
PTGDFGAPP

SEQ ID NO: 998772 - protein, 9 aa, Homo Sapiens
ISHDGLRQD

SEQ ID NO: 998773 - protein, 9 aa, Homo Sapiens
YKYLNDLIY

SEQ ID NO: 998774 - protein, 9 aa, Homo Sapiens
TKENRENSY

SEQ ID NO: 998775 - protein, 9 aa, Homo Sapiens
RDIQHAILT

SEQ ID NO: 998776 - protein, 9 aa, Homo Sapiens
RAIFFAGCT

SEQ ID NO: 998777 - protein, 9 aa, Homo Sapiens
RVRKSLKKE

SEQ ID NO: 998778 - protein, 9 aa, Homo Sapiens
VKNFLDLIL

SEQ ID NO: 998779 - protein, 9 aa, Homo Sapiens
PALLEPPGI

SEQ ID NO: 998780 - protein, 9 aa, Homo Sapiens
LTGMDRREF

SEQ ID NO: 998781 - protein, 9 aa, Homo Sapiens
ELSTEAPKP

SEQ ID NO: 998782 - protein, 9 aa, Homo Sapiens
PHISQCDKV

SEQ ID NO: 998783 - protein, 9 aa, Homo Sapiens
KFSGQSSFL

SEQ ID NO: 998784 - protein, 9 aa, Homo Sapiens
PLVTGKFLE

SEQ ID NO: 998785 - protein, 9 aa, Homo Sapiens
LNVSCSQLD

SEQ ID NO: 998786 - protein, 9 aa, Homo Sapiens
VNWRSCICN

SEQ ID NO: 998787 - protein, 9 aa, Homo Sapiens
RDHRRIGKK

SEQ ID NO: 998788 - protein, 9 aa, Homo Sapiens
TPHAKRKAT

SEQ ID NO: 998789 - protein, 9 aa, Homo Sapiens
EKDVGLGDG

SEQ ID NO: 998790 - protein, 9 aa, Homo Sapiens
LRLCFFLFV

SEQ ID NO: 998791 - protein, 9 aa, Homo Sapiens
DSSRHLPEP

SEQ ID NO: 998792 - protein, 9 aa, Homo Sapiens
EALHLTGMD

SEQ ID NO: 998793 - protein, 9 aa, Homo Sapiens
KWPKKSKVP

SEQ ID NO: 998794 - protein, 9 aa, Homo Sapiens
FLHQRRPPK

SEQ ID NO: 998795 - protein, 9 aa, Homo Sapiens
MNHGKFASV

SEQ ID NO: 998796 - protein, 9 aa, Homo Sapiens
YVMEINVEK

SEQ ID NO: 998797 - protein, 9 aa, Homo Sapiens
NDTSNGISS

SEQ ID NO: 998798 - protein, 9 aa, Homo Sapiens
WMNSTRHEP

SEQ ID NO: 998799 - protein, 9 aa, Homo Sapiens
HILCWPLEA

SEQ ID NO: 998800 - protein, 9 aa, Homo Sapiens
GYKPHFVSN

SEQ ID NO: 998801 - protein, 9 aa, Homo Sapiens
WLNKLSPQG

SEQ ID NO: 998802 - protein, 9 aa, Homo Sapiens
FQKGPVDKT

SEQ ID NO: 998803 - protein, 9 aa, Homo Sapiens
KVNSEFIVE

SEQ ID NO: 998804 - protein, 9 aa, Homo Sapiens
SGPGPGPGA

SEQ ID NO: 998805 - protein, 9 aa, Homo Sapiens
MLTGECVPQ

SEQ ID NO: 998806 - protein, 9 aa, Homo Sapiens
SEDKVFVRR

SEQ ID NO: 998807 - protein, 9 aa, Homo Sapiens
WMEPLSLFE

SEQ ID NO: 998808 - protein, 9 aa, Homo Sapiens
DQPIMQMPQ

SEQ ID NO: 998809 - protein, 9 aa, Homo Sapiens
YADYFLKVS

SEQ ID NO: 998810 - protein, 9 aa, Homo Sapiens
AFCGNYITF

SEQ ID NO: 998811 - protein, 9 aa, Homo Sapiens
SVSEMSVVG

SEQ ID NO: 998812 - protein, 9 aa, Homo Sapiens
VINSSNYRI

SEQ ID NO: 998813 - protein, 9 aa, Homo Sapiens
AALMIEELN

SEQ ID NO: 998814 - protein, 9 aa, Homo Sapiens
FEARRKELE

SEQ ID NO: 998815 - protein, 9 aa, Homo Sapiens
PWSLPFVLC

SEQ ID NO: 998816 - protein, 9 aa, Homo Sapiens
LWCMAPNPS

SEQ ID NO: 998817 - protein, 9 aa, Homo Sapiens
NRNKTPSDP

SEQ ID NO: 998818 - protein, 9 aa, Homo Sapiens
DDEQKVASH

SEQ ID NO: 998819 - protein, 9 aa, Homo Sapiens
VNIWDLKLK

SEQ ID NO: 998820 - protein, 9 aa, Homo Sapiens
ELSLATQPC

SEQ ID NO: 998821 - protein, 9 aa, Homo Sapiens
SSEDPEATM

SEQ ID NO: 998822 - protein, 9 aa, Homo Sapiens
DRGPKEERG

SEQ ID NO: 998823 - protein, 9 aa, Homo Sapiens
QELQLRCKE

SEQ ID NO: 998824 - protein, 9 aa, Homo Sapiens
LPKCPPKCP

SEQ ID NO: 998825 - protein, 9 aa, Homo Sapiens
DGISLLISG

SEQ ID NO: 998826 - protein, 9 aa, Homo Sapiens
KRRELKAVV

SEQ ID NO: 998827 - protein, 9 aa, Homo Sapiens
PTADVSCMN

SEQ ID NO: 998828 - protein, 9 aa, Homo Sapiens
GSALLYPDS

SEQ ID NO: 998829 - protein, 9 aa, Homo Sapiens
PAPSPPLPP

SEQ ID NO: 998830 - protein, 9 aa, Homo Sapiens
TAIWMNSTR

SEQ ID NO: 998831 - protein, 9 aa, Homo Sapiens
YEQKTKLPS

SEQ ID NO: 998832 - protein, 9 aa, Homo Sapiens
DYGFFLFCR

SEQ ID NO: 998833 - protein, 9 aa, Homo Sapiens
SLQKFSSLS

SEQ ID NO: 998834 - protein, 9 aa, Homo Sapiens
TCANDNLFG

SEQ ID NO: 998835 - protein, 9 aa, Homo Sapiens
EAKKSENVD

SEQ ID NO: 998836 - protein, 9 aa, Homo Sapiens
YGLLAILET

SEQ ID NO: 998837 - protein, 9 aa, Homo Sapiens
MPFWAQKRG

SEQ ID NO: 998838 - protein, 9 aa, Homo Sapiens
FSYPEPSAK

SEQ ID NO: 998839 - protein, 9 aa, Homo Sapiens
QHESGTSCS

SEQ ID NO: 998840 - protein, 9 aa, Homo Sapiens
TNNNEPLPE

SEQ ID NO: 998841 - protein, 9 aa, Homo Sapiens
PCQIFLEKP

SEQ ID NO: 998842 - protein, 9 aa, Homo Sapiens
DFEMQPIYE

SEQ ID NO: 998843 - protein, 9 aa, Homo Sapiens
HYRLVRFED

SEQ ID NO: 998844 - protein, 9 aa, Homo Sapiens
STILPTEGT

SEQ ID NO: 998845 - protein, 9 aa, Homo Sapiens
VSFAHKPLL

SEQ ID NO: 998846 - protein, 9 aa, Homo Sapiens
VCASDSPQC

SEQ ID NO: 998847 - protein, 9 aa, Homo Sapiens
LVEFSAEIQ

SEQ ID NO: 998848 - protein, 9 aa, Homo Sapiens
KDQPIMQMP

SEQ ID NO: 998849 - protein, 9 aa, Homo Sapiens
GLGENLLSH

SEQ ID NO: 998850 - protein, 9 aa, Homo Sapiens
VVPRFSVCQ

SEQ ID NO: 998851 - protein, 9 aa, Homo Sapiens
FRGFLKRHM

SEQ ID NO: 998852 - protein, 9 aa, Homo Sapiens
NPAFRIDKG

SEQ ID NO: 998853 - protein, 9 aa, Homo Sapiens
FDHVFSRGR

SEQ ID NO: 998854 - protein, 9 aa, Homo Sapiens
LLTLTLAGS

SEQ ID NO: 998855 - protein, 9 aa, Homo Sapiens
KSVFMVAIS

SEQ ID NO: 998856 - protein, 9 aa, Homo Sapiens
LQCQGWKNT

SEQ ID NO: 998857 - protein, 9 aa, Homo Sapiens
SVHPSNVLD

SEQ ID NO: 998858 - protein, 9 aa, Homo Sapiens
VVFFQQELR

SEQ ID NO: 998859 - protein, 9 aa, Homo Sapiens
YYLHYSPWW

SEQ ID NO: 998860 - protein, 9 aa, Homo Sapiens
DPEKPVCLN

SEQ ID NO: 998861 - protein, 9 aa, Homo Sapiens
SRHLPEPEG

SEQ ID NO: 998862 - protein, 9 aa, Homo Sapiens
QKVASHQAN

SEQ ID NO: 998863 - protein, 9 aa, Homo Sapiens
SNSILFFGK

SEQ ID NO: 998864 - protein, 9 aa, Homo Sapiens
SVEDKDHMC

SEQ ID NO: 998865 - protein, 9 aa, Homo Sapiens
GAVLAGSLY

SEQ ID NO: 998866 - protein, 9 aa, Homo Sapiens
AAISVRISL

SEQ ID NO: 998867 - protein, 9 aa, Homo Sapiens
VDCLESPYG

SEQ ID NO: 998868 - protein, 9 aa, Homo Sapiens
GKEGLAFNM

SEQ ID NO: 998869 - protein, 9 aa, Homo Sapiens
HLDKQAQTP

SEQ ID NO: 998870 - protein, 9 aa, Homo Sapiens
GWLNKLSPQ

SEQ ID NO: 998871 - protein, 9 aa, Homo Sapiens
GAGGATNLR

SEQ ID NO: 998872 - protein, 9 aa, Homo Sapiens
VNVLRLFLS

SEQ ID NO: 998873 - protein, 9 aa, Homo Sapiens
SCPGCEHDV

SEQ ID NO: 998874 - protein, 9 aa, Homo Sapiens
HSSSHGQHE

SEQ ID NO: 998875 - protein, 9 aa, Homo Sapiens
SLVEFYRTT

SEQ ID NO: 998876 - protein, 9 aa, Homo Sapiens
HNPHLHGCL

SEQ ID NO: 998877 - protein, 9 aa, Homo Sapiens
PELADLPQQ

SEQ ID NO: 998878 - protein, 9 aa, Homo Sapiens
DLVFLHQAL

SEQ ID NO: 998879 - protein, 9 aa, Homo Sapiens
PEYQSLRLT

SEQ ID NO: 998880 - protein, 9 aa, Homo Sapiens
YSCAYKPTQ

SEQ ID NO: 998881 - protein, 9 aa, Homo Sapiens
VENCASIFE

SEQ ID NO: 998882 - protein, 9 aa, Homo Sapiens
VTAKKHAHQ

SEQ ID NO: 998883 - protein, 9 aa, Homo Sapiens
RPPRRLVAS

SEQ ID NO: 998884 - protein, 9 aa, Homo Sapiens
YVQFQAECE

SEQ ID NO: 998885 - protein, 9 aa, Homo Sapiens
FLHHAYCFH

SEQ ID NO: 998886 - protein, 9 aa, Homo Sapiens
QTAGVSRQR

SEQ ID NO: 998887 - protein, 9 aa, Homo Sapiens
LSKDLLKAV

SEQ ID NO: 998888 - protein, 9 aa, Homo Sapiens
KGLSSVSEI

SEQ ID NO: 998889 - protein, 9 aa, Homo Sapiens
IEDISANKM

SEQ ID NO: 998890 - protein, 9 aa, Homo Sapiens
CSKCDKTFQ

SEQ ID NO: 998891 - protein, 9 aa, Homo Sapiens
CRQRQVLFF

SEQ ID NO: 998892 - protein, 9 aa, Homo Sapiens
ALTLAFALR

SEQ ID NO: 998893 - protein, 9 aa, Homo Sapiens
SYKGNIWKQ

SEQ ID NO: 998894 - protein, 9 aa, Homo Sapiens
PPAPSPPLP

SEQ ID NO: 998895 - protein, 9 aa, Homo Sapiens
VQFVPFQDF

SEQ ID NO: 998896 - protein, 9 aa, Homo Sapiens
KSEFSVLRA

SEQ ID NO: 998897 - protein, 9 aa, Homo Sapiens
LKVKHCTDQ

SEQ ID NO: 998898 - protein, 9 aa, Homo Sapiens
NHFGEELYD

SEQ ID NO: 998899 - protein, 9 aa, Homo Sapiens
RAAWLAKIR

SEQ ID NO: 998900 - protein, 9 aa, Homo Sapiens
VQDYGFFLF

SEQ ID NO: 998901 - protein, 9 aa, Homo Sapiens
KVDVKDSCN

SEQ ID NO: 998902 - protein, 9 aa, Homo Sapiens
YEWTDGIVA

SEQ ID NO: 998903 - protein, 9 aa, Homo Sapiens
VINIAHVDG

SEQ ID NO: 998904 - protein, 9 aa, Homo Sapiens
DQVAKGNYG

SEQ ID NO: 998905 - protein, 9 aa, Homo Sapiens
LIKQTGRHK

SEQ ID NO: 998906 - protein, 9 aa, Homo Sapiens
TKKSCMPRW

SEQ ID NO: 998907 - protein, 9 aa, Homo Sapiens
TLSRTTPIP

SEQ ID NO: 998908 - protein, 9 aa, Homo Sapiens
SPTYSCAYK

SEQ ID NO: 998909 - protein, 9 aa, Homo Sapiens
SHATFASFF

SEQ ID NO: 998910 - protein, 9 aa, Homo Sapiens
YVKCHRDHL

SEQ ID NO: 998911 - protein, 9 aa, Homo Sapiens
NCYANVIAY

SEQ ID NO: 998912 - protein, 9 aa, Homo Sapiens
GPWPLLMLQ

SEQ ID NO: 998913 - protein, 9 aa, Homo Sapiens
ENLLSHLPE

SEQ ID NO: 998914 - protein, 9 aa, Homo Sapiens
HLIKVRPTQ

SEQ ID NO: 998915 - protein, 9 aa, Homo Sapiens
GVLVPAKNQ

SEQ ID NO: 998916 - protein, 9 aa, Homo Sapiens
QGFKPKRPN

SEQ ID NO: 998917 - protein, 9 aa, Homo Sapiens
LIRIGCFIM

SEQ ID NO: 998918 - protein, 9 aa, Homo Sapiens
KNCKVVFFQ

SEQ ID NO: 998919 - protein, 9 aa, Homo Sapiens
STECDFHPL

SEQ ID NO: 998920 - protein, 9 aa, Homo Sapiens
SDEVDCISE

SEQ ID NO: 998921 - protein, 9 aa, Homo Sapiens
NERLLSAIE

SEQ ID NO: 998922 - protein, 9 aa, Homo Sapiens
STLIDQVNS

SEQ ID NO: 998923 - protein, 9 aa, Homo Sapiens
KVASHQANR

SEQ ID NO: 998924 - protein, 9 aa, Homo Sapiens
LANPLRQSC

SEQ ID NO: 998925 - protein, 9 aa, Homo Sapiens
YTFHGDSHA

SEQ ID NO: 998926 - protein, 9 aa, Homo Sapiens
RENCNEFFC

SEQ ID NO: 998927 - protein, 9 aa, Homo Sapiens
CRGRARTAA

SEQ ID NO: 998928 - protein, 9 aa, Homo Sapiens
QLPKPPDPR

SEQ ID NO: 998929 - protein, 9 aa, Homo Sapiens
LKSRELKIQ

SEQ ID NO: 998930 - protein, 9 aa, Homo Sapiens
HWFHQAPIS

SEQ ID NO: 998931 - protein, 9 aa, Homo Sapiens
KIGPSIFNS

SEQ ID NO: 998932 - protein, 9 aa, Homo Sapiens
DMKLRTFSD

SEQ ID NO: 998933 - protein, 9 aa, Homo Sapiens
LVFLHQALE

SEQ ID NO: 998934 - protein, 9 aa, Homo Sapiens
TLALVLTTF

SEQ ID NO: 998935 - protein, 9 aa, Homo Sapiens
EELIRLLKT

SEQ ID NO: 998936 - protein, 9 aa, Homo Sapiens
GAAILWLPC

SEQ ID NO: 998937 - protein, 9 aa, Homo Sapiens
SSVSPAGPS

SEQ ID NO: 998938 - protein, 9 aa, Homo Sapiens
VLPPKKVVP

SEQ ID NO: 998939 - protein, 9 aa, Homo Sapiens
QDFKDAAPS

SEQ ID NO: 998940 - protein, 9 aa, Homo Sapiens
SCSTSIFLR

SEQ ID NO: 998941 - protein, 9 aa, Homo Sapiens
LASSLVFNI

SEQ ID NO: 998942 - protein, 9 aa, Homo Sapiens
FTPATCLKI

SEQ ID NO: 998943 - protein, 9 aa, Homo Sapiens
LVISIIQVV

SEQ ID NO: 998944 - protein, 9 aa, Homo Sapiens
TNHGDLVFL

SEQ ID NO: 998945 - protein, 9 aa, Homo Sapiens
KAFLDAKES

SEQ ID NO: 998946 - protein, 9 aa, Homo Sapiens
VPRFSVCQL

SEQ ID NO: 998947 - protein, 9 aa, Homo Sapiens
APSPPLPPY

SEQ ID NO: 998948 - protein, 9 aa, Homo Sapiens
SDLEELERF

SEQ ID NO: 998949 - protein, 9 aa, Homo Sapiens
TVHNPKNQS

SEQ ID NO: 998950 - protein, 9 aa, Homo Sapiens
PYWCSEDNC

SEQ ID NO: 998951 - protein, 9 aa, Homo Sapiens
PLPLLFHQW

SEQ ID NO: 998952 - protein, 9 aa, Homo Sapiens
FFSQDLKKY

SEQ ID NO: 998953 - protein, 9 aa, Homo Sapiens
RLVSMGSKA

SEQ ID NO: 998954 - protein, 9 aa, Homo Sapiens
KKKGIVVGI

SEQ ID NO: 998955 - protein, 9 aa, Homo Sapiens
INSSNYRIG

SEQ ID NO: 998956 - protein, 9 aa, Homo Sapiens
FGSVHPSNV

SEQ ID NO: 998957 - protein, 9 aa, Homo Sapiens
DDHYNSENI

SEQ ID NO: 998958 - protein, 9 aa, Homo Sapiens
STDTLQCPR

SEQ ID NO: 998959 - protein, 9 aa, Homo Sapiens
ARPFDSFFL

SEQ ID NO: 998960 - protein, 9 aa, Homo Sapiens
RQEACISWF

SEQ ID NO: 998961 - protein, 9 aa, Homo Sapiens
EALAAKLKV

SEQ ID NO: 998962 - protein, 9 aa, Homo Sapiens
LQLQGRTDG

SEQ ID NO: 998963 - protein, 9 aa, Homo Sapiens
EKEAKHCVR

SEQ ID NO: 998964 - protein, 9 aa, Homo Sapiens
RGTWTLELE

SEQ ID NO: 998965 - protein, 9 aa, Homo Sapiens
QNIFLSNAP

SEQ ID NO: 998966 - protein, 9 aa, Homo Sapiens
SKLVPWSVG

SEQ ID NO: 998967 - protein, 9 aa, Homo Sapiens
VAISPLENA

SEQ ID NO: 998968 - protein, 9 aa, Homo Sapiens
KKPKFRSIV

SEQ ID NO: 998969 - protein, 9 aa, Homo Sapiens
QPWSLPFVL

SEQ ID NO: 998970 - protein, 9 aa, Homo Sapiens
KQCASVGVS

SEQ ID NO: 998971 - protein, 9 aa, Homo Sapiens
LLYIRNSKR

SEQ ID NO: 998972 - protein, 9 aa, Homo Sapiens
EENVTDFLI

SEQ ID NO: 998973 - protein, 9 aa, Homo Sapiens
LEGSGLGYL

SEQ ID NO: 998974 - protein, 9 aa, Homo Sapiens
LHGRLKKLN

SEQ ID NO: 998975 - protein, 9 aa, Homo Sapiens
LQVEHPYQL

SEQ ID NO: 998976 - protein, 9 aa, Homo Sapiens
QALADAIIK

SEQ ID NO: 998977 - protein, 9 aa, Homo Sapiens
LASTSPLLP

SEQ ID NO: 998978 - protein, 9 aa, Homo Sapiens
FVLHGNRGV

SEQ ID NO: 998979 - protein, 9 aa, Homo Sapiens
SLSLPRSCK

SEQ ID NO: 998980 - protein, 9 aa, Homo Sapiens
WSISGSEAS

SEQ ID NO: 998981 - protein, 9 aa, Homo Sapiens
GTSSQFSAE

SEQ ID NO: 998982 - protein, 9 aa, Homo Sapiens
GDCMTVQQC

SEQ ID NO: 998983 - protein, 9 aa, Homo Sapiens
EDVMMSLEG

SEQ ID NO: 998984 - protein, 9 aa, Homo Sapiens
RQVLFFFLL

SEQ ID NO: 998985 - protein, 9 aa, Homo Sapiens
IQIMRQYTS

SEQ ID NO: 998986 - protein, 9 aa, Homo Sapiens
LREKIMKLT

SEQ ID NO: 998987 - protein, 9 aa, Homo Sapiens
EDGLTGCLF

SEQ ID NO: 998988 - protein, 9 aa, Homo Sapiens
SSVQIDSGS

SEQ ID NO: 998989 - protein, 9 aa, Homo Sapiens
SGLTEKEAK

SEQ ID NO: 998990 - protein, 9 aa, Homo Sapiens
LFLLLLNIC

SEQ ID NO: 998991 - protein, 9 aa, Homo Sapiens
EISSLAVER

SEQ ID NO: 998992 - protein, 9 aa, Homo Sapiens
VFKISHLRT

SEQ ID NO: 998993 - protein, 9 aa, Homo Sapiens
QTYQQPVMS

SEQ ID NO: 998994 - protein, 9 aa, Homo Sapiens
GENLLSHLP

SEQ ID NO: 998995 - protein, 9 aa, Homo Sapiens
HLWKNVPRI

SEQ ID NO: 998996 - protein, 9 aa, Homo Sapiens
YTSIPIFLS

SEQ ID NO: 998997 - protein, 9 aa, Homo Sapiens
SVAYQNQVE

SEQ ID NO: 998998 - protein, 9 aa, Homo Sapiens
TLAEYIRND

SEQ ID NO: 998999 - protein, 9 aa, Homo Sapiens
CREFMDHSI

SEQ ID NO: 999000 - protein, 9 aa, Homo Sapiens
AWWYANCHA

SEQ ID NO: 999001 - protein, 9 aa, Homo Sapiens
ELHLDSNKL

SEQ ID NO: 999002 - protein, 9 aa, Homo Sapiens
MSQELLTFK

SEQ ID NO: 999003 - protein, 9 aa, Homo Sapiens
KVKHCTDQI

SEQ ID NO: 999004 - protein, 9 aa, Homo Sapiens
TYKSIQIMR

SEQ ID NO: 999005 - protein, 9 aa, Homo Sapiens
TQSHFKHLS

SEQ ID NO: 999006 - protein, 9 aa, Homo Sapiens
PPSTLGVSF

SEQ ID NO: 999007 - protein, 9 aa, Homo Sapiens
GTQPEDLNS

SEQ ID NO: 999008 - protein, 9 aa, Homo Sapiens
LLEPPGILA

SEQ ID NO: 999009 - protein, 9 aa, Homo Sapiens
LEKSEFSVL

SEQ ID NO: 999010 - protein, 9 aa, Homo Sapiens
NTSQPDKVL

SEQ ID NO: 999011 - protein, 9 aa, Homo Sapiens
VNQDPMTQS

SEQ ID NO: 999012 - protein, 9 aa, Homo Sapiens
DEAMLTGEC

SEQ ID NO: 999013 - protein, 9 aa, Homo Sapiens
KNVVVVGAG

SEQ ID NO: 999014 - protein, 9 aa, Homo Sapiens
ATGAVSQYT

SEQ ID NO: 999015 - protein, 9 aa, Homo Sapiens
NLFLHQRRP

SEQ ID NO: 999016 - protein, 9 aa, Homo Sapiens
TAKKHAHQI

SEQ ID NO: 999017 - protein, 9 aa, Homo Sapiens
RLVFKISHL

SEQ ID NO: 999018 - protein, 9 aa, Homo Sapiens
NNKTSLTEK

SEQ ID NO: 999019 - protein, 9 aa, Homo Sapiens
ASLIAMVAT

SEQ ID NO: 999020 - protein, 9 aa, Homo Sapiens
CLDRGILFP

SEQ ID NO: 999021 - protein, 9 aa, Homo Sapiens
QGKPSYTVN

SEQ ID NO: 999022 - protein, 9 aa, Homo Sapiens
LERQQLRLW

SEQ ID NO: 999023 - protein, 9 aa, Homo Sapiens
KHAHQIQML

SEQ ID NO: 999024 - protein, 9 aa, Homo Sapiens
SSHFTRHKA

SEQ ID NO: 999025 - protein, 9 aa, Homo Sapiens
MGLGGPLLS

SEQ ID NO: 999026 - protein, 9 aa, Homo Sapiens
CRSCDCHEA

SEQ ID NO: 999027 - protein, 9 aa, Homo Sapiens
YPRCRSCDC

SEQ ID NO: 999028 - protein, 9 aa, Homo Sapiens
SGDYDDSAM

SEQ ID NO: 999029 - protein, 9 aa, Homo Sapiens
LYWDSATCK

SEQ ID NO: 999030 - protein, 9 aa, Homo Sapiens
SGMLPLYGS

SEQ ID NO: 999031 - protein, 9 aa, Homo Sapiens
EIITLSEDH

SEQ ID NO: 999032 - protein, 9 aa, Homo Sapiens
AAILWLPCS

SEQ ID NO: 999033 - protein, 9 aa, Homo Sapiens
SDFHSYIQN

SEQ ID NO: 999034 - protein, 9 aa, Homo Sapiens
TTFDPARGT

SEQ ID NO: 999035 - protein, 9 aa, Homo Sapiens
FSVCQLRDS

SEQ ID NO: 999036 - protein, 9 aa, Homo Sapiens
ANSLKKAIC

SEQ ID NO: 999037 - protein, 9 aa, Homo Sapiens
GKDQPIMQM

SEQ ID NO: 999038 - protein, 9 aa, Homo Sapiens
TMRLVFKIS

SEQ ID NO: 999039 - protein, 9 aa, Homo Sapiens
RSAIIKNLR

SEQ ID NO: 999040 - protein, 9 aa, Homo Sapiens
CQPAPFCQK

SEQ ID NO: 999041 - protein, 9 aa, Homo Sapiens
VEFLLVTAI

SEQ ID NO: 999042 - protein, 9 aa, Homo Sapiens
STKVSFAHK

SEQ ID NO: 999043 - protein, 9 aa, Homo Sapiens
QQLRLWERQ

SEQ ID NO: 999044 - protein, 9 aa, Homo Sapiens
PSEKPTIFT

SEQ ID NO: 999045 - protein, 9 aa, Homo Sapiens
CHKSYARSD

SEQ ID NO: 999046 - protein, 9 aa, Homo Sapiens
KFRKQQDLA

SEQ ID NO: 999047 - protein, 9 aa, Homo Sapiens
FDPVSYEWT

SEQ ID NO: 999048 - protein, 9 aa, Homo Sapiens
QNCSNSEFL

SEQ ID NO: 999049 - protein, 9 aa, Homo Sapiens
LSAVYCICL

SEQ ID NO: 999050 - protein, 9 aa, Homo Sapiens
KALSKDLLK

SEQ ID NO: 999051 - protein, 9 aa, Homo Sapiens
GTKKSCMPR

SEQ ID NO: 999052 - protein, 9 aa, Homo Sapiens
TADVSCMNT

SEQ ID NO: 999053 - protein, 9 aa, Homo Sapiens
FLSNAPLGP

SEQ ID NO: 999054 - protein, 9 aa, Homo Sapiens
QKAFACAEK

SEQ ID NO: 999055 - protein, 9 aa, Homo Sapiens
RELEGSGLG

SEQ ID NO: 999056 - protein, 9 aa, Homo Sapiens
LAMSSHFIQ

SEQ ID NO: 999057 - protein, 9 aa, Homo Sapiens
TSPLLPPAT

SEQ ID NO: 999058 - protein, 9 aa, Homo Sapiens
GSSAYSPSD

SEQ ID NO: 999059 - protein, 9 aa, Homo Sapiens
EVHRRPARR

SEQ ID NO: 999060 - protein, 9 aa, Homo Sapiens
GHNINVIQA

SEQ ID NO: 999061 - protein, 9 aa, Homo Sapiens
HMFQLYLEN

SEQ ID NO: 999062 - protein, 9 aa, Homo Sapiens
IWDLKLKRV

SEQ ID NO: 999063 - protein, 9 aa, Homo Sapiens
PVTPMKELT

SEQ ID NO: 999064 - protein, 9 aa, Homo Sapiens
GFKEKALFL

SEQ ID NO: 999065 - protein, 9 aa, Homo Sapiens
ILEKSEFSV

SEQ ID NO: 999066 - protein, 9 aa, Homo Sapiens
DDIELMFLN

SEQ ID NO: 999067 - protein, 9 aa, Homo Sapiens
NLMYAKRAF

SEQ ID NO: 999068 - protein, 9 aa, Homo Sapiens
KSLQEGATR

SEQ ID NO: 999069 - protein, 9 aa, Homo Sapiens
ISGPLQGSG

SEQ ID NO: 999070 - protein, 9 aa, Homo Sapiens
SSDSNTESV

SEQ ID NO: 999071 - protein, 9 aa, Homo Sapiens
PLSEESDLE

SEQ ID NO: 999072 - protein, 9 aa, Homo Sapiens
LKAVELLGD

SEQ ID NO: 999073 - protein, 9 aa, Homo Sapiens
GLGSDGKSC

SEQ ID NO: 999074 - protein, 9 aa, Homo Sapiens
VVQAFLSIH

SEQ ID NO: 999075 - protein, 9 aa, Homo Sapiens
IKGEMWQNI

SEQ ID NO: 999076 - protein, 9 aa, Homo Sapiens
EKFIHSGII

SEQ ID NO: 999077 - protein, 9 aa, Homo Sapiens
LELTFNLKH

SEQ ID NO: 999078 - protein, 9 aa, Homo Sapiens
TLIGNLLIL

SEQ ID NO: 999079 - protein, 9 aa, Homo Sapiens
LLFMVLFNF

SEQ ID NO: 999080 - protein, 9 aa, Homo Sapiens
LKEALGILA

SEQ ID NO: 999081 - protein, 9 aa, Homo Sapiens
LKILNNTQE

SEQ ID NO: 999082 - protein, 9 aa, Homo Sapiens
LGCSGGCSR

SEQ ID NO: 999083 - protein, 9 aa, Homo Sapiens
RIPLSAVYC

SEQ ID NO: 999084 - protein, 9 aa, Homo Sapiens
FYLGAMVSS

SEQ ID NO: 999085 - protein, 9 aa, Homo Sapiens
RRRIPQNHS

SEQ ID NO: 999086 - protein, 9 aa, Homo Sapiens
MPSIQESLK

SEQ ID NO: 999087 - protein, 9 aa, Homo Sapiens
PAQGSSKPP

SEQ ID NO: 999088 - protein, 9 aa, Homo Sapiens
KRKATRMYP

SEQ ID NO: 999089 - protein, 9 aa, Homo Sapiens
IQRYLAFDI

SEQ ID NO: 999090 - protein, 9 aa, Homo Sapiens
RRPARRSVL

SEQ ID NO: 999091 - protein, 9 aa, Homo Sapiens
GAPDVISLR

SEQ ID NO: 999092 - protein, 9 aa, Homo Sapiens
GREEEKKEE

SEQ ID NO: 999093 - protein, 9 aa, Homo Sapiens
KFTTFTTIL

SEQ ID NO: 999094 - protein, 9 aa, Homo Sapiens
GCGFTFWQW

SEQ ID NO: 999095 - protein, 9 aa, Homo Sapiens
RGAGAIELL

SEQ ID NO: 999096 - protein, 9 aa, Homo Sapiens
HSIEVPILR

SEQ ID NO: 999097 - protein, 9 aa, Homo Sapiens
LQRGQTEKA

SEQ ID NO: 999098 - protein, 9 aa, Homo Sapiens
QKPGKNFSY

SEQ ID NO: 999099 - protein, 9 aa, Homo Sapiens
KIPERDSRY

SEQ ID NO: 999100 - protein, 9 aa, Homo Sapiens
PFNQQLPKP

SEQ ID NO: 999101 - protein, 9 aa, Homo Sapiens
IQYNCSKCD

SEQ ID NO: 999102 - protein, 9 aa, Homo Sapiens
EKKRFTPEK

SEQ ID NO: 999103 - protein, 9 aa, Homo Sapiens
FNIWGTWHS

SEQ ID NO: 999104 - protein, 9 aa, Homo Sapiens
SAYICLFTC

SEQ ID NO: 999105 - protein, 9 aa, Homo Sapiens
FSTGLWGRW

SEQ ID NO: 999106 - protein, 9 aa, Homo Sapiens
QIEQLERFI

SEQ ID NO: 999107 - protein, 9 aa, Homo Sapiens
SFYIFTLIG

SEQ ID NO: 999108 - protein, 9 aa, Homo Sapiens
SGSEELIRL

SEQ ID NO: 999109 - protein, 9 aa, Homo Sapiens
YIDLIREES

SEQ ID NO: 999110 - protein, 9 aa, Homo Sapiens
QGERKFIFV

SEQ ID NO: 999111 - protein, 9 aa, Homo Sapiens
PPSSSAPPK

SEQ ID NO: 999112 - protein, 9 aa, Homo Sapiens
LKKKGIVVG

SEQ ID NO: 999113 - protein, 9 aa, Homo Sapiens
ESPDHQYYN

SEQ ID NO: 999114 - protein, 9 aa, Homo Sapiens
RADAPSHAS

SEQ ID NO: 999115 - protein, 9 aa, Homo Sapiens
NKNTMNGAS

SEQ ID NO: 999116 - protein, 9 aa, Homo Sapiens
GCTALFLLL

SEQ ID NO: 999117 - protein, 9 aa, Homo Sapiens
TVFSCPGCE

SEQ ID NO: 999118 - protein, 9 aa, Homo Sapiens
VVYRSLLFE

SEQ ID NO: 999119 - protein, 9 aa, Homo Sapiens
VDCISEWKR

SEQ ID NO: 999120 - protein, 9 aa, Homo Sapiens
ISKIKRDKD

SEQ ID NO: 999121 - protein, 9 aa, Homo Sapiens
ERKFIFVGL

SEQ ID NO: 999122 - protein, 9 aa, Homo Sapiens
ATHLSVTGL

SEQ ID NO: 999123 - protein, 9 aa, Homo Sapiens
QKNTSPTDS

SEQ ID NO: 999124 - protein, 9 aa, Homo Sapiens
FVISKIKRD

SEQ ID NO: 999125 - protein, 9 aa, Homo Sapiens
SAGRQRTCD

SEQ ID NO: 999126 - protein, 9 aa, Homo Sapiens
SNNKTSLTE

SEQ ID NO: 999127 - protein, 9 aa, Homo Sapiens
AAVAPKNMI

SEQ ID NO: 999128 - protein, 9 aa, Homo Sapiens
LNKLSPQGK

SEQ ID NO: 999129 - protein, 9 aa, Homo Sapiens
ADPASLLGG

SEQ ID NO: 999130 - protein, 9 aa, Homo Sapiens
TQVWLYEQV

SEQ ID NO: 999131 - protein, 9 aa, Homo Sapiens
YFLKVSLQD

SEQ ID NO: 999132 - protein, 9 aa, Homo Sapiens
MYSHVFRKK

SEQ ID NO: 999133 - protein, 9 aa, Homo Sapiens
LVFEFFSQD

SEQ ID NO: 999134 - protein, 9 aa, Homo Sapiens
LDTSMDSGK

SEQ ID NO: 999135 - protein, 9 aa, Homo Sapiens
LGFGPGVPP

SEQ ID NO: 999136 - protein, 9 aa, Homo Sapiens
AMNSAGLGR

SEQ ID NO: 999137 - protein, 9 aa, Homo Sapiens
PDVISLRYD

SEQ ID NO: 999138 - protein, 9 aa, Homo Sapiens
FSGTDLLND

SEQ ID NO: 999139 - protein, 9 aa, Homo Sapiens
WDEEEEESP

SEQ ID NO: 999140 - protein, 9 aa, Homo Sapiens
VAPASRLTF

SEQ ID NO: 999141 - protein, 9 aa, Homo Sapiens
EALPQRKMN

SEQ ID NO: 999142 - protein, 9 aa, Homo Sapiens
STTENGAEP

SEQ ID NO: 999143 - protein, 9 aa, Homo Sapiens
ISPAQGSSK

SEQ ID NO: 999144 - protein, 9 aa, Homo Sapiens
DLKLKRVHR

SEQ ID NO: 999145 - protein, 9 aa, Homo Sapiens
MEGEPQKGG

SEQ ID NO: 999146 - protein, 9 aa, Homo Sapiens
NTIFKGNSL

SEQ ID NO: 999147 - protein, 9 aa, Homo Sapiens
AITLGRKKF

SEQ ID NO: 999148 - protein, 9 aa, Homo Sapiens
LTFNLKHES

SEQ ID NO: 999149 - protein, 9 aa, Homo Sapiens
SASEPWEDE

SEQ ID NO: 999150 - protein, 9 aa, Homo Sapiens
TQTGVQWSN

SEQ ID NO: 999151 - protein, 9 aa, Homo Sapiens
NCSNSEFLC

SEQ ID NO: 999152 - protein, 9 aa, Homo Sapiens
ALETLSKLL

SEQ ID NO: 999153 - protein, 9 aa, Homo Sapiens
PDLPALRAI

SEQ ID NO: 999154 - protein, 9 aa, Homo Sapiens
RSWDGLLVA

SEQ ID NO: 999155 - protein, 9 aa, Homo Sapiens
SSTFQLNEL

SEQ ID NO: 999156 - protein, 9 aa, Homo Sapiens
KETTSEESQ

SEQ ID NO: 999157 - protein, 9 aa, Homo Sapiens
AATPETSQP

SEQ ID NO: 999158 - protein, 9 aa, Homo Sapiens
GDIKGETCF

SEQ ID NO: 999159 - protein, 9 aa, Homo Sapiens
DAVWKAMFA

SEQ ID NO: 999160 - protein, 9 aa, Homo Sapiens
TMKKKLEAA

SEQ ID NO: 999161 - protein, 9 aa, Homo Sapiens
EGAEISSLA

SEQ ID NO: 999162 - protein, 9 aa, Homo Sapiens
GYPRCRSCD

SEQ ID NO: 999163 - protein, 9 aa, Homo Sapiens
TGRFGKEGL

SEQ ID NO: 999164 - protein, 9 aa, Homo Sapiens
FLSTGDQVA

SEQ ID NO: 999165 - protein, 9 aa, Homo Sapiens
RQAPLATRQ

SEQ ID NO: 999166 - protein, 9 aa, Homo Sapiens
VTNNNEPLP

SEQ ID NO: 999167 - protein, 9 aa, Homo Sapiens
QRYLAFDIL

SEQ ID NO: 999168 - protein, 9 aa, Homo Sapiens
GSRETPVAR

SEQ ID NO: 999169 - protein, 9 aa, Homo Sapiens
PMTNYTTVC

SEQ ID NO: 999170 - protein, 9 aa, Homo Sapiens
PPPLTKPGS

SEQ ID NO: 999171 - protein, 9 aa, Homo Sapiens
ELLDWAAAK

SEQ ID NO: 999172 - protein, 9 aa, Homo Sapiens
LLKYFSSKM

SEQ ID NO: 999173 - protein, 9 aa, Homo Sapiens
FSGRSEQAT

SEQ ID NO: 999174 - protein, 9 aa, Homo Sapiens
CTALFLLLL

SEQ ID NO: 999175 - protein, 9 aa, Homo Sapiens
KSYARSDTK

SEQ ID NO: 999176 - protein, 9 aa, Homo Sapiens
AVVFSIFVM

SEQ ID NO: 999177 - protein, 9 aa, Homo Sapiens
FSQLEDKFS

SEQ ID NO: 999178 - protein, 9 aa, Homo Sapiens
KNCYANVIA

SEQ ID NO: 999179 - protein, 9 aa, Homo Sapiens
LEEVRGALK

SEQ ID NO: 999180 - protein, 9 aa, Homo Sapiens
APIYKQYAS

SEQ ID NO: 999181 - protein, 9 aa, Homo Sapiens
IKTESAPAW

SEQ ID NO: 999182 - protein, 9 aa, Homo Sapiens
STSIFLRLR

SEQ ID NO: 999183 - protein, 9 aa, Homo Sapiens
EAIAYWKFT

SEQ ID NO: 999184 - protein, 9 aa, Homo Sapiens
SQLEDKFSG

SEQ ID NO: 999185 - protein, 9 aa, Homo Sapiens
VPAKNQPGR

SEQ ID NO: 999186 - protein, 9 aa, Homo Sapiens
VHLEENQLT

SEQ ID NO: 999187 - protein, 9 aa, Homo Sapiens
RYLQNRSRT

SEQ ID NO: 999188 - protein, 9 aa, Homo Sapiens
YGQEEIPQG

SEQ ID NO: 999189 - protein, 9 aa, Homo Sapiens
ERLKAEEGS

SEQ ID NO: 999190 - protein, 9 aa, Homo Sapiens
SNGISSSSV

SEQ ID NO: 999191 - protein, 9 aa, Homo Sapiens
KEFQTELKC

SEQ ID NO: 999192 - protein, 9 aa, Homo Sapiens
EQLTQELCE

SEQ ID NO: 999193 - protein, 9 aa, Homo Sapiens
SHDPRLHNF

SEQ ID NO: 999194 - protein, 9 aa, Homo Sapiens
ALKNFVISK

SEQ ID NO: 999195 - protein, 9 aa, Homo Sapiens
ELLEPSGSP

SEQ ID NO: 999196 - protein, 9 aa, Homo Sapiens
SQRIPLPRR

SEQ ID NO: 999197 - protein, 9 aa, Homo Sapiens
FIQLMFINE

SEQ ID NO: 999198 - protein, 9 aa, Homo Sapiens
SLAVERLIS

SEQ ID NO: 999199 - protein, 9 aa, Homo Sapiens
RFGKEGLAF

SEQ ID NO: 999200 - protein, 9 aa, Homo Sapiens
MSRSPMVEK

SEQ ID NO: 999201 - protein, 9 aa, Homo Sapiens
SLELLEPSG

SEQ ID NO: 999202 - protein, 9 aa, Homo Sapiens
IYGSHFQGN

SEQ ID NO: 999203 - protein, 9 aa, Homo Sapiens
RLAVTNKER

SEQ ID NO: 999204 - protein, 9 aa, Homo Sapiens
TKKVEKFKI

SEQ ID NO: 999205 - protein, 9 aa, Homo Sapiens
APGEKGEKK

SEQ ID NO: 999206 - protein, 9 aa, Homo Sapiens
PNLFLHQRR

SEQ ID NO: 999207 - protein, 9 aa, Homo Sapiens
FLRLVHLEE

SEQ ID NO: 999208 - protein, 9 aa, Homo Sapiens
TSIPIFLSE

SEQ ID NO: 999209 - protein, 9 aa, Homo Sapiens
EDEPFVLEA

SEQ ID NO: 999210 - protein, 9 aa, Homo Sapiens
NLTLSVSSL

SEQ ID NO: 999211 - protein, 9 aa, Homo Sapiens
QAVAFWCDS

SEQ ID NO: 999212 - protein, 9 aa, Homo Sapiens
YSPWWFHRF

SEQ ID NO: 999213 - protein, 9 aa, Homo Sapiens
HMHLKKQQE

SEQ ID NO: 999214 - protein, 9 aa, Homo Sapiens
SISGSEASS

SEQ ID NO: 999215 - protein, 9 aa, Homo Sapiens
PEEKAKSLP

SEQ ID NO: 999216 - protein, 9 aa, Homo Sapiens
PRASSSLSL

SEQ ID NO: 999217 - protein, 9 aa, Homo Sapiens
GDISGPLQG

SEQ ID NO: 999218 - protein, 9 aa, Homo Sapiens
RCEATKYYI

SEQ ID NO: 999219 - protein, 9 aa, Homo Sapiens
PKWPPENEI

SEQ ID NO: 999220 - protein, 9 aa, Homo Sapiens
CPFSLADHL

SEQ ID NO: 999221 - protein, 9 aa, Homo Sapiens
SIFNSDLAN

SEQ ID NO: 999222 - protein, 9 aa, Homo Sapiens
VAAAVCGSG

SEQ ID NO: 999223 - protein, 9 aa, Homo Sapiens
KPPDPRCVL

SEQ ID NO: 999224 - protein, 9 aa, Homo Sapiens
RLDRVAIVT

SEQ ID NO: 999225 - protein, 9 aa, Homo Sapiens
LLQERSNLG

SEQ ID NO: 999226 - protein, 9 aa, Homo Sapiens
QQEEEERQG

SEQ ID NO: 999227 - protein, 9 aa, Homo Sapiens
HLSGMLPLY

SEQ ID NO: 999228 - protein, 9 aa, Homo Sapiens
SLLDEEGRF

SEQ ID NO: 999229 - protein, 9 aa, Homo Sapiens
PEAHLRFFE

SEQ ID NO: 999230 - protein, 9 aa, Homo Sapiens
LLVRQEACI

SEQ ID NO: 999231 - protein, 9 aa, Homo Sapiens
GKGREGKRR

SEQ ID NO: 999232 - protein, 9 aa, Homo Sapiens
LQKFSSLSA

SEQ ID NO: 999233 - protein, 9 aa, Homo Sapiens
AYTEARKAQ

SEQ ID NO: 999234 - protein, 9 aa, Homo Sapiens
YEAEIFTRP

SEQ ID NO: 999235 - protein, 9 aa, Homo Sapiens
HPEAHLRFF

SEQ ID NO: 999236 - protein, 9 aa, Homo Sapiens
LQGKVSANN

SEQ ID NO: 999237 - protein, 9 aa, Homo Sapiens
LDVCMGGGN

SEQ ID NO: 999238 - protein, 9 aa, Homo Sapiens
NMIFYGFLK

SEQ ID NO: 999239 - protein, 9 aa, Homo Sapiens
PESLLLAGA

SEQ ID NO: 999240 - protein, 9 aa, Homo Sapiens
VGFCGNSPE

SEQ ID NO: 999241 - protein, 9 aa, Homo Sapiens
LPGLPPALL

SEQ ID NO: 999242 - protein, 9 aa, Homo Sapiens
TVCREFMDH

SEQ ID NO: 999243 - protein, 9 aa, Homo Sapiens
ELTQKIGFD

SEQ ID NO: 999244 - protein, 9 aa, Homo Sapiens
EEKKEESDA

SEQ ID NO: 999245 - protein, 9 aa, Homo Sapiens
ISLRYDPDS

SEQ ID NO: 999246 - protein, 9 aa, Homo Sapiens
EKPVCLNVK

SEQ ID NO: 999247 - protein, 9 aa, Homo Sapiens
PPALLEPPG

SEQ ID NO: 999248 - protein, 9 aa, Homo Sapiens
ISETPCESQ

SEQ ID NO: 999249 - protein, 9 aa, Homo Sapiens
NTSTLTFNI

SEQ ID NO: 999250 - protein, 9 aa, Homo Sapiens
SFREMGDLI

SEQ ID NO: 999251 - protein, 9 aa, Homo Sapiens
VCDSSQKSE

SEQ ID NO: 999252 - protein, 9 aa, Homo Sapiens
APKNMIFYG

SEQ ID NO: 999253 - protein, 9 aa, Homo Sapiens
GQKTFQSIL

SEQ ID NO: 999254 - protein, 9 aa, Homo Sapiens
PGDRGPKEE

SEQ ID NO: 999255 - protein, 9 aa, Homo Sapiens
PSDQSSSVQ

SEQ ID NO: 999256 - protein, 9 aa, Homo Sapiens
SFCHMSLLD

SEQ ID NO: 999257 - protein, 9 aa, Homo Sapiens
GDSHATFAS

SEQ ID NO: 999258 - protein, 9 aa, Homo Sapiens
DDPHYFVMT

SEQ ID NO: 999259 - protein, 9 aa, Homo Sapiens
DDFRQNPLD

SEQ ID NO: 999260 - protein, 9 aa, Homo Sapiens
LESCGVVDL

SEQ ID NO: 999261 - protein, 9 aa, Homo Sapiens
PPHKPGSRH

SEQ ID NO: 999262 - protein, 9 aa, Homo Sapiens
EWLAGMGFA

SEQ ID NO: 999263 - protein, 9 aa, Homo Sapiens
SLIGQKICR

SEQ ID NO: 999264 - protein, 9 aa, Homo Sapiens
KSSTSIDKD

SEQ ID NO: 999265 - protein, 9 aa, Homo Sapiens
NVLHGRLKK

SEQ ID NO: 999266 - protein, 9 aa, Homo Sapiens
NWFLKEFPW

SEQ ID NO: 999267 - protein, 9 aa, Homo Sapiens
MLLETTSEA

SEQ ID NO: 999268 - protein, 9 aa, Homo Sapiens
ALINQKYNE

SEQ ID NO: 999269 - protein, 9 aa, Homo Sapiens
FNQQLPKPP

SEQ ID NO: 999270 - protein, 9 aa, Homo Sapiens
ASPTGQPTV

SEQ ID NO: 999271 - protein, 9 aa, Homo Sapiens
RPWVVDDDH

SEQ ID NO: 999272 - protein, 9 aa, Homo Sapiens
AKVTEPKKF

SEQ ID NO: 999273 - protein, 9 aa, Homo Sapiens
DWFSFLCVQ

SEQ ID NO: 999274 - protein, 9 aa, Homo Sapiens
PGLPPALLE

SEQ ID NO: 999275 - protein, 9 aa, Homo Sapiens
LSAYLPTNL

SEQ ID NO: 999276 - protein, 9 aa, Homo Sapiens
PRPFEEQFQ

SEQ ID NO: 999277 - protein, 9 aa, Homo Sapiens
QEGAEISSL

SEQ ID NO: 999278 - protein, 9 aa, Homo Sapiens
NTLANVPDS

SEQ ID NO: 999279 - protein, 9 aa, Homo Sapiens
DPEMTSYLD

SEQ ID NO: 999280 - protein, 9 aa, Homo Sapiens
FFFLLLGLS

SEQ ID NO: 999281 - protein, 9 aa, Homo Sapiens
GMYSSSRYP

SEQ ID NO: 999282 - protein, 9 aa, Homo Sapiens
KPYWCSEDN

SEQ ID NO: 999283 - protein, 9 aa, Homo Sapiens
VVNQDPMTQ

SEQ ID NO: 999284 - protein, 9 aa, Homo Sapiens
VDSLYQKHQ

SEQ ID NO: 999285 - protein, 9 aa, Homo Sapiens
SIQESLKER

SEQ ID NO: 999286 - protein, 9 aa, Homo Sapiens
SIIQVVGIP

SEQ ID NO: 999287 - protein, 9 aa, Homo Sapiens
GPDSPVTPM

SEQ ID NO: 999288 - protein, 9 aa, Homo Sapiens
CTKKFKFRG

SEQ ID NO: 999289 - protein, 9 aa, Homo Sapiens
IRNDYREEF

SEQ ID NO: 999290 - protein, 9 aa, Homo Sapiens
TPTVPRISW

SEQ ID NO: 999291 - protein, 9 aa, Homo Sapiens
LEATKLFGR

SEQ ID NO: 999292 - protein, 9 aa, Homo Sapiens
SRGRKKSSQ

SEQ ID NO: 999293 - protein, 9 aa, Homo Sapiens
QDGKEIYLQ

SEQ ID NO: 999294 - protein, 9 aa, Homo Sapiens
SVHKLQDSG

SEQ ID NO: 999295 - protein, 9 aa, Homo Sapiens
QSTENYSED

SEQ ID NO: 999296 - protein, 9 aa, Homo Sapiens
LSACMVCRR

SEQ ID NO: 999297 - protein, 9 aa, Homo Sapiens
SYQKTHSGE

SEQ ID NO: 999298 - protein, 9 aa, Homo Sapiens
LNCFEYNPR

SEQ ID NO: 999299 - protein, 9 aa, Homo Sapiens
DQLVISPEV

SEQ ID NO: 999300 - protein, 9 aa, Homo Sapiens
HSYQKTHSG

SEQ ID NO: 999301 - protein, 9 aa, Homo Sapiens
LTVMDRDEP

SEQ ID NO: 999302 - protein, 9 aa, Homo Sapiens
PQRKMNETP

SEQ ID NO: 999303 - protein, 9 aa, Homo Sapiens
SVSEIAEVE

SEQ ID NO: 999304 - protein, 9 aa, Homo Sapiens
KYGLLAILE

SEQ ID NO: 999305 - protein, 9 aa, Homo Sapiens
TLRSQDMQA

SEQ ID NO: 999306 - protein, 9 aa, Homo Sapiens
TYNRFLYVV

SEQ ID NO: 999307 - protein, 9 aa, Homo Sapiens
SILFFGKFS

SEQ ID NO: 999308 - protein, 9 aa, Homo Sapiens
DSNKLTRVP

SEQ ID NO: 999309 - protein, 9 aa, Homo Sapiens
SSHMFQLYL

SEQ ID NO: 999310 - protein, 9 aa, Homo Sapiens
RLVILDPAD

SEQ ID NO: 999311 - protein, 9 aa, Homo Sapiens
ILTLRVSRA

SEQ ID NO: 999312 - protein, 9 aa, Homo Sapiens
RLRQHSKHV

SEQ ID NO: 999313 - protein, 9 aa, Homo Sapiens
PLVVEVHLA

SEQ ID NO: 999314 - protein, 9 aa, Homo Sapiens
MEPLSLFED

SEQ ID NO: 999315 - protein, 9 aa, Homo Sapiens
QECRCQKGH

SEQ ID NO: 999316 - protein, 9 aa, Homo Sapiens
FVGLLLTSH

SEQ ID NO: 999317 - protein, 9 aa, Homo Sapiens
EFVGSAPQK

SEQ ID NO: 999318 - protein, 9 aa, Homo Sapiens
FLFPLYGQE

SEQ ID NO: 999319 - protein, 9 aa, Homo Sapiens
KHIRSREVV

SEQ ID NO: 999320 - protein, 9 aa, Homo Sapiens
PPRLDRVAI

SEQ ID NO: 999321 - protein, 9 aa, Homo Sapiens
RGPKEERGD

SEQ ID NO: 999322 - protein, 9 aa, Homo Sapiens
LWKNVPRIF

SEQ ID NO: 999323 - protein, 9 aa, Homo Sapiens
AQFLSDILE

SEQ ID NO: 999324 - protein, 9 aa, Homo Sapiens
DMKTDGGGW

SEQ ID NO: 999325 - protein, 9 aa, Homo Sapiens
GMTKKKPEK

SEQ ID NO: 999326 - protein, 9 aa, Homo Sapiens
LPCSHRPAP

SEQ ID NO: 999327 - protein, 9 aa, Homo Sapiens
KKEASGRTH

SEQ ID NO: 999328 - protein, 9 aa, Homo Sapiens
YELSYPQGY

SEQ ID NO: 999329 - protein, 9 aa, Homo Sapiens
LQVFSSYLA

SEQ ID NO: 999330 - protein, 9 aa, Homo Sapiens
KGTCGHRDS

SEQ ID NO: 999331 - protein, 9 aa, Homo Sapiens
EMLAGQASF

SEQ ID NO: 999332 - protein, 9 aa, Homo Sapiens
ELLTFKDVF

SEQ ID NO: 999333 - protein, 9 aa, Homo Sapiens
GRKKFLLVN

SEQ ID NO: 999334 - protein, 9 aa, Homo Sapiens
EHPYQLLLK

SEQ ID NO: 999335 - protein, 9 aa, Homo Sapiens
TGPLKTPIA

SEQ ID NO: 999336 - protein, 9 aa, Homo Sapiens
RLTCIYCAE

SEQ ID NO: 999337 - protein, 9 aa, Homo Sapiens
IFNSDLANL

SEQ ID NO: 999338 - protein, 9 aa, Homo Sapiens
KLRGAAAAA

SEQ ID NO: 999339 - protein, 9 aa, Homo Sapiens
GKRGRLDSE

SEQ ID NO: 999340 - protein, 9 aa, Homo Sapiens
AFKQSSHFT

SEQ ID NO: 999341 - protein, 9 aa, Homo Sapiens
EKIEDICIS

SEQ ID NO: 999342 - protein, 9 aa, Homo Sapiens
RQRQVLFFF

SEQ ID NO: 999343 - protein, 9 aa, Homo Sapiens
SDQLEISVT

SEQ ID NO: 999344 - protein, 9 aa, Homo Sapiens
VTVQEDLCV

SEQ ID NO: 999345 - protein, 9 aa, Homo Sapiens
IPSQFSKEK

SEQ ID NO: 999346 - protein, 9 aa, Homo Sapiens
ELQLRCKEW

SEQ ID NO: 999347 - protein, 9 aa, Homo Sapiens
QDRNQRWVQ

SEQ ID NO: 999348 - protein, 9 aa, Homo Sapiens
TQHLTQPHR

SEQ ID NO: 999349 - protein, 9 aa, Homo Sapiens
CQECRCQKG

SEQ ID NO: 999350 - protein, 9 aa, Homo Sapiens
GSQGIFLLA

SEQ ID NO: 999351 - protein, 9 aa, Homo Sapiens
DIFIVEFMD

SEQ ID NO: 999352 - protein, 9 aa, Homo Sapiens
YSNRSAIIK

SEQ ID NO: 999353 - protein, 9 aa, Homo Sapiens
TLAGSSDAF

SEQ ID NO: 999354 - protein, 9 aa, Homo Sapiens
MFQLQGIHS

SEQ ID NO: 999355 - protein, 9 aa, Homo Sapiens
LDQWTDKKK

SEQ ID NO: 999356 - protein, 9 aa, Homo Sapiens
WGLPFSPLA

SEQ ID NO: 999357 - protein, 9 aa, Homo Sapiens
IILMVVMKV

SEQ ID NO: 999358 - protein, 9 aa, Homo Sapiens
DSDSDEVDC

SEQ ID NO: 999359 - protein, 9 aa, Homo Sapiens
CFVKVRAYQ

SEQ ID NO: 999360 - protein, 9 aa, Homo Sapiens
CSQLDTGVP

SEQ ID NO: 999361 - protein, 9 aa, Homo Sapiens
NFSLLELDN

SEQ ID NO: 999362 - protein, 9 aa, Homo Sapiens
GWAPLSHGF

SEQ ID NO: 999363 - protein, 9 aa, Homo Sapiens
ISGQTFCPN

SEQ ID NO: 999364 - protein, 9 aa, Homo Sapiens
SSSRYPPQQ

SEQ ID NO: 999365 - protein, 9 aa, Homo Sapiens
EDPGNLQGE

SEQ ID NO: 999366 - protein, 9 aa, Homo Sapiens
SYFCTCGDC

SEQ ID NO: 999367 - protein, 9 aa, Homo Sapiens
TIMKDYENL

SEQ ID NO: 999368 - protein, 9 aa, Homo Sapiens
QKTKLPSSV

SEQ ID NO: 999369 - protein, 9 aa, Homo Sapiens
LINQKYNEV

SEQ ID NO: 999370 - protein, 9 aa, Homo Sapiens
KIYIDLIRE

SEQ ID NO: 999371 - protein, 9 aa, Homo Sapiens
KESNHLRDV

SEQ ID NO: 999372 - protein, 9 aa, Homo Sapiens
ALLGGEPKN

SEQ ID NO: 999373 - protein, 9 aa, Homo Sapiens
RGALKRSEP

SEQ ID NO: 999374 - protein, 9 aa, Homo Sapiens
RQQLRLWER

SEQ ID NO: 999375 - protein, 9 aa, Homo Sapiens
TLKYHKKIH

SEQ ID NO: 999376 - protein, 9 aa, Homo Sapiens
ESFNQKGSL

SEQ ID NO: 999377 - protein, 9 aa, Homo Sapiens
WNKTVRYCQ

SEQ ID NO: 999378 - protein, 9 aa, Homo Sapiens
LDRGILFPS

SEQ ID NO: 999379 - protein, 9 aa, Homo Sapiens
CNLCSTSPS

SEQ ID NO: 999380 - protein, 9 aa, Homo Sapiens
EKFEARRKE

SEQ ID NO: 999381 - protein, 9 aa, Homo Sapiens
CAEKDDGQE

SEQ ID NO: 999382 - protein, 9 aa, Homo Sapiens
IGPSIFNSD

SEQ ID NO: 999383 - protein, 9 aa, Homo Sapiens
PPGIPPPFS

SEQ ID NO: 999384 - protein, 9 aa, Homo Sapiens
ARKAQRKQQ

SEQ ID NO: 999385 - protein, 9 aa, Homo Sapiens
YCPNVIVTY

SEQ ID NO: 999386 - protein, 9 aa, Homo Sapiens
NYFSLQLQG

SEQ ID NO: 999387 - protein, 9 aa, Homo Sapiens
SFFLDKVVS

SEQ ID NO: 999388 - protein, 9 aa, Homo Sapiens
SNLHHHSSS

SEQ ID NO: 999389 - protein, 9 aa, Homo Sapiens
SESHPDSGK

SEQ ID NO: 999390 - protein, 9 aa, Homo Sapiens
LPVGYEAKM

SEQ ID NO: 999391 - protein, 9 aa, Homo Sapiens
DEGEEDFDS

SEQ ID NO: 999392 - protein, 9 aa, Homo Sapiens
LLDWAAAKE

SEQ ID NO: 999393 - protein, 9 aa, Homo Sapiens
CRMATEEDN

SEQ ID NO: 999394 - protein, 9 aa, Homo Sapiens
IYRTHHNPT

SEQ ID NO: 999395 - protein, 9 aa, Homo Sapiens
ALKSRELKI

SEQ ID NO: 999396 - protein, 9 aa, Homo Sapiens
PPPLPSSSD

SEQ ID NO: 999397 - protein, 9 aa, Homo Sapiens
LWLPCSHRP

SEQ ID NO: 999398 - protein, 9 aa, Homo Sapiens
KKKPEKKPK

SEQ ID NO: 999399 - protein, 9 aa, Homo Sapiens
VNSCTAYRM

SEQ ID NO: 999400 - protein, 9 aa, Homo Sapiens
ANTIFKGNS

SEQ ID NO: 999401 - protein, 9 aa, Homo Sapiens
IIVTAIWMN

SEQ ID NO: 999402 - protein, 9 aa, Homo Sapiens
EPGPPEPRG

SEQ ID NO: 999403 - protein, 9 aa, Homo Sapiens
SVTGLSSAS

SEQ ID NO: 999404 - protein, 9 aa, Homo Sapiens
TLRVSRAQA

SEQ ID NO: 999405 - protein, 9 aa, Homo Sapiens
KVRAYQSER

SEQ ID NO: 999406 - protein, 9 aa, Homo Sapiens
KRRECAYCL

SEQ ID NO: 999407 - protein, 9 aa, Homo Sapiens
VAFWCDSIS

SEQ ID NO: 999408 - protein, 9 aa, Homo Sapiens
GDATPLLDK

SEQ ID NO: 999409 - protein, 9 aa, Homo Sapiens
AFWCDSISG

SEQ ID NO: 999410 - protein, 9 aa, Homo Sapiens
YILIGFLEN

SEQ ID NO: 999411 - protein, 9 aa, Homo Sapiens
RLLLFYQSQ

SEQ ID NO: 999412 - protein, 9 aa, Homo Sapiens
FSHHMFVLE

SEQ ID NO: 999413 - protein, 9 aa, Homo Sapiens
PRSVASPDT

SEQ ID NO: 999414 - protein, 9 aa, Homo Sapiens
GPRPWVVDD

SEQ ID NO: 999415 - protein, 9 aa, Homo Sapiens
TKAASVELL

SEQ ID NO: 999416 - protein, 9 aa, Homo Sapiens
REMNKTVIL

SEQ ID NO: 999417 - protein, 9 aa, Homo Sapiens
SLVYFFVGS

SEQ ID NO: 999418 - protein, 9 aa, Homo Sapiens
QSRLGKKSR

SEQ ID NO: 999419 - protein, 9 aa, Homo Sapiens
YGVTCLRPN

SEQ ID NO: 999420 - protein, 9 aa, Homo Sapiens
REGVALGTT

SEQ ID NO: 999421 - protein, 9 aa, Homo Sapiens
CYNGGNCKE

SEQ ID NO: 999422 - protein, 9 aa, Homo Sapiens
RELKIQEMA

SEQ ID NO: 999423 - protein, 9 aa, Homo Sapiens
LVRNGAESV

SEQ ID NO: 999424 - protein, 9 aa, Homo Sapiens
RRIGKKQEL

SEQ ID NO: 999425 - protein, 9 aa, Homo Sapiens
EMKGKKLGL

SEQ ID NO: 999426 - protein, 9 aa, Homo Sapiens
EMTSYLDIA

SEQ ID NO: 999427 - protein, 9 aa, Homo Sapiens
ESLLLAGAI

SEQ ID NO: 999428 - protein, 9 aa, Homo Sapiens
SKKETLKNR

SEQ ID NO: 999429 - protein, 9 aa, Homo Sapiens
KLIGDDHYN

SEQ ID NO: 999430 - protein, 9 aa, Homo Sapiens
VSLFKIPIE

SEQ ID NO: 999431 - protein, 9 aa, Homo Sapiens
DCKLPCNLC

SEQ ID NO: 999432 - protein, 9 aa, Homo Sapiens
RKSLKKEYT

SEQ ID NO: 999433 - protein, 9 aa, Homo Sapiens
LAGQASFEG

SEQ ID NO: 999434 - protein, 9 aa, Homo Sapiens
PLYGSDGHL

SEQ ID NO: 999435 - protein, 9 aa, Homo Sapiens
TPGTGDYKV

SEQ ID NO: 999436 - protein, 9 aa, Homo Sapiens
VPGALASRG

SEQ ID NO: 999437 - protein, 9 aa, Homo Sapiens
KVNSALSKI

SEQ ID NO: 999438 - protein, 9 aa, Homo Sapiens
RVMHGEANI

SEQ ID NO: 999439 - protein, 9 aa, Homo Sapiens
TSFDLDSWT

SEQ ID NO: 999440 - protein, 9 aa, Homo Sapiens
AMVEKARRL

SEQ ID NO: 999441 - protein, 9 aa, Homo Sapiens
NDNSPELII

SEQ ID NO: 999442 - protein, 9 aa, Homo Sapiens
KFNLTAPRP

SEQ ID NO: 999443 - protein, 9 aa, Homo Sapiens
LYKTELSKK

SEQ ID NO: 999444 - protein, 9 aa, Homo Sapiens
AKQAWRNAS

SEQ ID NO: 999445 - protein, 9 aa, Homo Sapiens
QLLLTLTLA

SEQ ID NO: 999446 - protein, 9 aa, Homo Sapiens
SISSLGRLL

SEQ ID NO: 999447 - protein, 9 aa, Homo Sapiens
KMSKSFKSS

SEQ ID NO: 999448 - protein, 9 aa, Homo Sapiens
HLRFFEADA

SEQ ID NO: 999449 - protein, 9 aa, Homo Sapiens
SFTDQSSRD

SEQ ID NO: 999450 - protein, 9 aa, Homo Sapiens
RQEDVGFCG

SEQ ID NO: 999451 - protein, 9 aa, Homo Sapiens
NLKKQEDVL

SEQ ID NO: 999452 - protein, 9 aa, Homo Sapiens
CRLLLFYQS

SEQ ID NO: 999453 - protein, 9 aa, Homo Sapiens
QDSLTLDSD

SEQ ID NO: 999454 - protein, 9 aa, Homo Sapiens
PLRLGLLGA

SEQ ID NO: 999455 - protein, 9 aa, Homo Sapiens
WWLLSIVRP

SEQ ID NO: 999456 - protein, 9 aa, Homo Sapiens
EENFETIKL

SEQ ID NO: 999457 - protein, 9 aa, Homo Sapiens
QLPNESTLI

SEQ ID NO: 999458 - protein, 9 aa, Homo Sapiens
TVMDRDEPH

SEQ ID NO: 999459 - protein, 9 aa, Homo Sapiens
GAVVVAACV

SEQ ID NO: 999460 - protein, 9 aa, Homo Sapiens
PYCGVPVLP

SEQ ID NO: 999461 - protein, 9 aa, Homo Sapiens
VCGSGARRF

SEQ ID NO: 999462 - protein, 9 aa, Homo Sapiens
ELEKDIEAD

SEQ ID NO: 999463 - protein, 9 aa, Homo Sapiens
YDFNQCEKA

SEQ ID NO: 999464 - protein, 9 aa, Homo Sapiens
EKGLSSVSE

SEQ ID NO: 999465 - protein, 9 aa, Homo Sapiens
DSPRGPPPL

SEQ ID NO: 999466 - protein, 9 aa, Homo Sapiens
RGGSPVQYP

SEQ ID NO: 999467 - protein, 9 aa, Homo Sapiens
FVLCQGVAL

SEQ ID NO: 999468 - protein, 9 aa, Homo Sapiens
YNKEGLLLQ

SEQ ID NO: 999469 - protein, 9 aa, Homo Sapiens
ILWSQELRP

SEQ ID NO: 999470 - protein, 9 aa, Homo Sapiens
SESKFLTEA

SEQ ID NO: 999471 - protein, 9 aa, Homo Sapiens
TLDSDLLMT

SEQ ID NO: 999472 - protein, 9 aa, Homo Sapiens
IIQVVGIPG

SEQ ID NO: 999473 - protein, 9 aa, Homo Sapiens
MKDYENLWN

SEQ ID NO: 999474 - protein, 9 aa, Homo Sapiens
KNKVQVVED

SEQ ID NO: 999475 - protein, 9 aa, Homo Sapiens
SEIAEVEPS

SEQ ID NO: 999476 - protein, 9 aa, Homo Sapiens
RQSCISIVE

SEQ ID NO: 999477 - protein, 9 aa, Homo Sapiens
IVPMCFYQM

SEQ ID NO: 999478 - protein, 9 aa, Homo Sapiens
KFLELDLNT

SEQ ID NO: 999479 - protein, 9 aa, Homo Sapiens
RLLMAVGAV

SEQ ID NO: 999480 - protein, 9 aa, Homo Sapiens
DPPHKPGSR

SEQ ID NO: 999481 - protein, 9 aa, Homo Sapiens
STEAPKPPE

SEQ ID NO: 999482 - protein, 9 aa, Homo Sapiens
VWKAMFARF

SEQ ID NO: 999483 - protein, 9 aa, Homo Sapiens
FSRREKVEV

SEQ ID NO: 999484 - protein, 9 aa, Homo Sapiens
RLPSLIGQK

SEQ ID NO: 999485 - protein, 9 aa, Homo Sapiens
KTESAPAWT

SEQ ID NO: 999486 - protein, 9 aa, Homo Sapiens
QFSKEKRVA

SEQ ID NO: 999487 - protein, 9 aa, Homo Sapiens
KDENSCAWC

SEQ ID NO: 999488 - protein, 9 aa, Homo Sapiens
RIPQNHSES

SEQ ID NO: 999489 - protein, 9 aa, Homo Sapiens
SAYSPSDAF

SEQ ID NO: 999490 - protein, 9 aa, Homo Sapiens
QPIMQMPQY

SEQ ID NO: 999491 - protein, 9 aa, Homo Sapiens
HPSSTSSSK

SEQ ID NO: 999492 - protein, 9 aa, Homo Sapiens
KIRLNPEEC

SEQ ID NO: 999493 - protein, 9 aa, Homo Sapiens
NKYQDHCYR

SEQ ID NO: 999494 - protein, 9 aa, Homo Sapiens
YRDGKDQPI

SEQ ID NO: 999495 - protein, 9 aa, Homo Sapiens
CLRPNIYVT

SEQ ID NO: 999496 - protein, 9 aa, Homo Sapiens
EDKVFVRRG

SEQ ID NO: 999497 - protein, 9 aa, Homo Sapiens
RDWKPFHSG

SEQ ID NO: 999498 - protein, 9 aa, Homo Sapiens
KEDSGSNFQ

SEQ ID NO: 999499 - protein, 9 aa, Homo Sapiens
RKHMKFRKQ

SEQ ID NO: 999500 - protein, 9 aa, Homo Sapiens
FLKKKTRKR

SEQ ID NO: 999501 - protein, 9 aa, Homo Sapiens
RTHSHERSY

SEQ ID NO: 999502 - protein, 9 aa, Homo Sapiens
QEEEERQGK

SEQ ID NO: 999503 - protein, 9 aa, Homo Sapiens
EFFAPQRAD

SEQ ID NO: 999504 - protein, 9 aa, Homo Sapiens
TKELDFESS

SEQ ID NO: 999505 - protein, 9 aa, Homo Sapiens
QVMSQRAIF

SEQ ID NO: 999506 - protein, 9 aa, Homo Sapiens
LCFFLFVEN

SEQ ID NO: 999507 - protein, 9 aa, Homo Sapiens
ERSPQNGEL

SEQ ID NO: 999508 - protein, 9 aa, Homo Sapiens
SQVLLEEEE

SEQ ID NO: 999509 - protein, 9 aa, Homo Sapiens
ILLGCGFTF

SEQ ID NO: 999510 - protein, 9 aa, Homo Sapiens
DVGPEDELL

SEQ ID NO: 999511 - protein, 9 aa, Homo Sapiens
MDRDEPHSP

SEQ ID NO: 999512 - protein, 9 aa, Homo Sapiens
EEGAFGHNP

SEQ ID NO: 999513 - protein, 9 aa, Homo Sapiens
ELEKFIHSG

SEQ ID NO: 999514 - protein, 9 aa, Homo Sapiens
NRTVFVSIN

SEQ ID NO: 999515 - protein, 9 aa, Homo Sapiens
VYFFVGSRL

SEQ ID NO: 999516 - protein, 9 aa, Homo Sapiens
CEPNNKERY

SEQ ID NO: 999517 - protein, 9 aa, Homo Sapiens
SSAGRQRTC

SEQ ID NO: 999518 - protein, 9 aa, Homo Sapiens
LHYSPWWFH

SEQ ID NO: 999519 - protein, 9 aa, Homo Sapiens
TGDFGAPPV

SEQ ID NO: 999520 - protein, 9 aa, Homo Sapiens
FVSNFNGPN

SEQ ID NO: 999521 - protein, 9 aa, Homo Sapiens
LYFGASVCA

SEQ ID NO: 999522 - protein, 9 aa, Homo Sapiens
YYILIGFLE

SEQ ID NO: 999523 - protein, 9 aa, Homo Sapiens
LLCLCMETL

SEQ ID NO: 999524 - protein, 9 aa, Homo Sapiens
IHSGIISKR

SEQ ID NO: 999525 - protein, 9 aa, Homo Sapiens
RLLVALSAE

SEQ ID NO: 999526 - protein, 9 aa, Homo Sapiens
FVYLFPGER

SEQ ID NO: 999527 - protein, 9 aa, Homo Sapiens
RKSTMDAQS

SEQ ID NO: 999528 - protein, 9 aa, Homo Sapiens
YQASTDTLQ

SEQ ID NO: 999529 - protein, 9 aa, Homo Sapiens
TWTLELEFV

SEQ ID NO: 999530 - protein, 9 aa, Homo Sapiens
SRELKIQEM

SEQ ID NO: 999531 - protein, 9 aa, Homo Sapiens
RQNLPLSFG

SEQ ID NO: 999532 - protein, 9 aa, Homo Sapiens
KDAKFVEEG

SEQ ID NO: 999533 - protein, 9 aa, Homo Sapiens
EHRVLEEEV

SEQ ID NO: 999534 - protein, 9 aa, Homo Sapiens
SEMSSHKAL

SEQ ID NO: 999535 - protein, 9 aa, Homo Sapiens
PVCLNVKYD

SEQ ID NO: 999536 - protein, 9 aa, Homo Sapiens
QKCPVECPL

SEQ ID NO: 999537 - protein, 9 aa, Homo Sapiens
VEEISETPC

SEQ ID NO: 999538 - protein, 9 aa, Homo Sapiens
ATQRFSCLL

SEQ ID NO: 999539 - protein, 9 aa, Homo Sapiens
CMAPNPSNG

SEQ ID NO: 999540 - protein, 9 aa, Homo Sapiens
LYLVFEFFS

SEQ ID NO: 999541 - protein, 9 aa, Homo Sapiens
RGRKKSSQE

SEQ ID NO: 999542 - protein, 9 aa, Homo Sapiens
RAVCNLKKK

SEQ ID NO: 999543 - protein, 9 aa, Homo Sapiens
AHVNRVPEE

SEQ ID NO: 999544 - protein, 9 aa, Homo Sapiens
KQILRIPFI

SEQ ID NO: 999545 - protein, 9 aa, Homo Sapiens
FFGETPALL

SEQ ID NO: 999546 - protein, 9 aa, Homo Sapiens
VSKLVPWSV

SEQ ID NO: 999547 - protein, 9 aa, Homo Sapiens
NSGLSLPTS

SEQ ID NO: 999548 - protein, 9 aa, Homo Sapiens
WHGEEKVVA

SEQ ID NO: 999549 - protein, 9 aa, Homo Sapiens
SICSEESPE

SEQ ID NO: 999550 - protein, 9 aa, Homo Sapiens
WDLKLKRVH

SEQ ID NO: 999551 - protein, 9 aa, Homo Sapiens
RRSFKDLLG

SEQ ID NO: 999552 - protein, 9 aa, Homo Sapiens
TRNLTLSVS

SEQ ID NO: 999553 - protein, 9 aa, Homo Sapiens
SSQAPSLLL

SEQ ID NO: 999554 - protein, 9 aa, Homo Sapiens
VADSIPKVL

SEQ ID NO: 999555 - protein, 9 aa, Homo Sapiens
APLVVEVHL

SEQ ID NO: 999556 - protein, 9 aa, Homo Sapiens
LPPALLEPP

SEQ ID NO: 999557 - protein, 9 aa, Homo Sapiens
GDKTSATDI

SEQ ID NO: 999558 - protein, 9 aa, Homo Sapiens
IVRPGTQAL

SEQ ID NO: 999559 - protein, 9 aa, Homo Sapiens
ILKNAAPSS

SEQ ID NO: 999560 - protein, 9 aa, Homo Sapiens
GVEMAAKFS

SEQ ID NO: 999561 - protein, 9 aa, Homo Sapiens
IKAESNLHH

SEQ ID NO: 999562 - protein, 9 aa, Homo Sapiens
VGAAILWLP

SEQ ID NO: 999563 - protein, 9 aa, Homo Sapiens
SVELLSKEA

SEQ ID NO: 999564 - protein, 9 aa, Homo Sapiens
FQGNLSLLS

SEQ ID NO: 999565 - protein, 9 aa, Homo Sapiens
QAASALGAG

SEQ ID NO: 999566 - protein, 9 aa, Homo Sapiens
NTSIPVTTS

SEQ ID NO: 999567 - protein, 9 aa, Homo Sapiens
EAPKPPEEP

SEQ ID NO: 999568 - protein, 9 aa, Homo Sapiens
ESNLHHHSS

SEQ ID NO: 999569 - protein, 9 aa, Homo Sapiens
SHFKHLSRK

SEQ ID NO: 999570 - protein, 9 aa, Homo Sapiens
LHDISESKF

SEQ ID NO: 999571 - protein, 9 aa, Homo Sapiens
READSPEGL

SEQ ID NO: 999572 - protein, 9 aa, Homo Sapiens
LKKKTRKRI

SEQ ID NO: 999573 - protein, 9 aa, Homo Sapiens
SKVAPAKAR

SEQ ID NO: 999574 - protein, 9 aa, Homo Sapiens
PGIPPPFSP

SEQ ID NO: 999575 - protein, 9 aa, Homo Sapiens
SSGLLSRTH

SEQ ID NO: 999576 - protein, 9 aa, Homo Sapiens
TTILPDDSC

SEQ ID NO: 999577 - protein, 9 aa, Homo Sapiens
GQFDPVSYE

SEQ ID NO: 999578 - protein, 9 aa, Homo Sapiens
LFEDVAGTE

SEQ ID NO: 999579 - protein, 9 aa, Homo Sapiens
GVISTTKEL

SEQ ID NO: 999580 - protein, 9 aa, Homo Sapiens
AIFFAGCTA

SEQ ID NO: 999581 - protein, 9 aa, Homo Sapiens
SPPGSPRIQ

SEQ ID NO: 999582 - protein, 9 aa, Homo Sapiens
LVFNISDGQ

SEQ ID NO: 999583 - protein, 9 aa, Homo Sapiens
EEDQDPPCL

SEQ ID NO: 999584 - protein, 9 aa, Homo Sapiens
LTQKIGFDP

SEQ ID NO: 999585 - protein, 9 aa, Homo Sapiens
QRAEKTVDM

SEQ ID NO: 999586 - protein, 9 aa, Homo Sapiens
TSMDSGKIQ

SEQ ID NO: 999587 - protein, 9 aa, Homo Sapiens
VALMNHSYC

SEQ ID NO: 999588 - protein, 9 aa, Homo Sapiens
GEANITGFQ

SEQ ID NO: 999589 - protein, 9 aa, Homo Sapiens
AIEGYGIRL

SEQ ID NO: 999590 - protein, 9 aa, Homo Sapiens
WEVHRRPAR

SEQ ID NO: 999591 - protein, 9 aa, Homo Sapiens
WHCDSDNDC

SEQ ID NO: 999592 - protein, 9 aa, Homo Sapiens
AAELANAKG

SEQ ID NO: 999593 - protein, 9 aa, Homo Sapiens
YGPEYWDLN

SEQ ID NO: 999594 - protein, 9 aa, Homo Sapiens
RKAPVMNCS

SEQ ID NO: 999595 - protein, 9 aa, Homo Sapiens
PSLPWSSDP

SEQ ID NO: 999596 - protein, 9 aa, Homo Sapiens
HEGVFVLHG

SEQ ID NO: 999597 - protein, 9 aa, Homo Sapiens
VELLSKEAA

SEQ ID NO: 999598 - protein, 9 aa, Homo Sapiens
EVEEISETP

SEQ ID NO: 999599 - protein, 9 aa, Homo Sapiens
CFHYTLCAT

SEQ ID NO: 999600 - protein, 9 aa, Homo Sapiens
RKKSKVAPA

SEQ ID NO: 999601 - protein, 9 aa, Homo Sapiens
YSHVFRKKN

SEQ ID NO: 999602 - protein, 9 aa, Homo Sapiens
DFHSYIQNL

SEQ ID NO: 999603 - protein, 9 aa, Homo Sapiens
FPCTSSPEE

SEQ ID NO: 999604 - protein, 9 aa, Homo Sapiens
FFLLLGLSL

SEQ ID NO: 999605 - protein, 9 aa, Homo Sapiens
KPKSKFYGA

SEQ ID NO: 999606 - protein, 9 aa, Homo Sapiens
DSDDEQKVA

SEQ ID NO: 999607 - protein, 9 aa, Homo Sapiens
KIQEMASMG

SEQ ID NO: 999608 - protein, 9 aa, Homo Sapiens
KAYSRSSTL

SEQ ID NO: 999609 - protein, 9 aa, Homo Sapiens
GFSSSSGRV

SEQ ID NO: 999610 - protein, 9 aa, Homo Sapiens
LSGSQGIFL

SEQ ID NO: 999611 - protein, 9 aa, Homo Sapiens
VQALTLAFA

SEQ ID NO: 999612 - protein, 9 aa, Homo Sapiens
NNIKLKGKS

SEQ ID NO: 999613 - protein, 9 aa, Homo Sapiens
TVRYCQGFN

SEQ ID NO: 999614 - protein, 9 aa, Homo Sapiens
VLEELPMMR

SEQ ID NO: 999615 - protein, 9 aa, Homo Sapiens
KIHVILAWS

SEQ ID NO: 999616 - protein, 9 aa, Homo Sapiens
MVEKRMMGQ

SEQ ID NO: 999617 - protein, 9 aa, Homo Sapiens
IAPIHLSSE

SEQ ID NO: 999618 - protein, 9 aa, Homo Sapiens
KFVEEGRKQ

SEQ ID NO: 999619 - protein, 9 aa, Homo Sapiens
SVHNSARPM

SEQ ID NO: 999620 - protein, 9 aa, Homo Sapiens
SLFEDVAGT

SEQ ID NO: 999621 - protein, 9 aa, Homo Sapiens
LHKVYEQKT

SEQ ID NO: 999622 - protein, 9 aa, Homo Sapiens
CYTMQKVNS

SEQ ID NO: 999623 - protein, 9 aa, Homo Sapiens
LECRGRART

SEQ ID NO: 999624 - protein, 9 aa, Homo Sapiens
LAIKLKKHP

SEQ ID NO: 999625 - protein, 9 aa, Homo Sapiens
FQQELRKRL

SEQ ID NO: 999626 - protein, 9 aa, Homo Sapiens
GKPSYTVNW

SEQ ID NO: 999627 - protein, 9 aa, Homo Sapiens
KTMNVASSG

SEQ ID NO: 999628 - protein, 8 aa, Homo Sapiens
KNSRTWAW

SEQ ID NO: 999629 - protein, 9 aa, Homo Sapiens
KFKIFKHIS

SEQ ID NO: 999630 - protein, 9 aa, Homo Sapiens
LLSQVSLFK

SEQ ID NO: 999631 - protein, 9 aa, Homo Sapiens
LHLTGMDRR

SEQ ID NO: 999632 - protein, 9 aa, Homo Sapiens
RRKKANDRK

SEQ ID NO: 999633 - protein, 9 aa, Homo Sapiens
KNNIKLKGK

SEQ ID NO: 999634 - protein, 9 aa, Homo Sapiens
PPFSPMGLP

SEQ ID NO: 999635 - protein, 9 aa, Homo Sapiens
ILRDGEYVV

SEQ ID NO: 999636 - protein, 9 aa, Homo Sapiens
WCMAPNPSN

SEQ ID NO: 999637 - protein, 9 aa, Homo Sapiens
GTACETCAN

SEQ ID NO: 999638 - protein, 9 aa, Homo Sapiens
MSKSFKSSG

SEQ ID NO: 999639 - protein, 9 aa, Homo Sapiens
HFTRHKAIH

SEQ ID NO: 999640 - protein, 9 aa, Homo Sapiens
LGAGPTQPP

SEQ ID NO: 999641 - protein, 9 aa, Homo Sapiens
QKGHAHCQP

SEQ ID NO: 999642 - protein, 9 aa, Homo Sapiens
SGLLSRTHP

SEQ ID NO: 999643 - protein, 9 aa, Homo Sapiens
GFETTTVSI

SEQ ID NO: 999644 - protein, 9 aa, Homo Sapiens
RTSFDLDSW

SEQ ID NO: 999645 - protein, 9 aa, Homo Sapiens
LPLLFHQWF

SEQ ID NO: 999646 - protein, 9 aa, Homo Sapiens
SDFWDFKQS

SEQ ID NO: 999647 - protein, 9 aa, Homo Sapiens
KFLRNLFSP

SEQ ID NO: 999648 - protein, 9 aa, Homo Sapiens
EPLERGQQK

SEQ ID NO: 999649 - protein, 9 aa, Homo Sapiens
LTPRTTVFS

SEQ ID NO: 999650 - protein, 9 aa, Homo Sapiens
SPRASSSLS

SEQ ID NO: 999651 - protein, 9 aa, Homo Sapiens
AYKWPSTLK

SEQ ID NO: 999652 - protein, 9 aa, Homo Sapiens
SSEKGNFSL

SEQ ID NO: 999653 - protein, 9 aa, Homo Sapiens
APSVLGKHT

SEQ ID NO: 999654 - protein, 9 aa, Homo Sapiens
RRATTLREK

SEQ ID NO: 999655 - protein, 9 aa, Homo Sapiens
DTLQCPRCS

SEQ ID NO: 999656 - protein, 9 aa, Homo Sapiens
PSSTSSSKI

SEQ ID NO: 999657 - protein, 9 aa, Homo Sapiens
EQYCHTIIT

SEQ ID NO: 999658 - protein, 9 aa, Homo Sapiens
SNTESVQTA

SEQ ID NO: 999659 - protein, 9 aa, Homo Sapiens
NGQDRNQRW

SEQ ID NO: 999660 - protein, 9 aa, Homo Sapiens
NLHHHSSSL

SEQ ID NO: 999661 - protein, 9 aa, Homo Sapiens
FFLFVENGH

SEQ ID NO: 999662 - protein, 9 aa, Homo Sapiens
DSHATFASF

SEQ ID NO: 999663 - protein, 9 aa, Homo Sapiens
TVVAGRRKF

SEQ ID NO: 999664 - protein, 9 aa, Homo Sapiens
FTTILPDDS

SEQ ID NO: 999665 - protein, 9 aa, Homo Sapiens
DAKFVEEGR

SEQ ID NO: 999666 - protein, 9 aa, Homo Sapiens
NCNEFFCPS

SEQ ID NO: 999667 - protein, 9 aa, Homo Sapiens
PGSSASQTG

SEQ ID NO: 999668 - protein, 9 aa, Homo Sapiens
MRDCALAAA

SEQ ID NO: 999669 - protein, 9 aa, Homo Sapiens
SNYRIGPVE

SEQ ID NO: 999670 - protein, 9 aa, Homo Sapiens
SCQPAPFCQ

SEQ ID NO: 999671 - protein, 9 aa, Homo Sapiens
LGCGFTFWQ

SEQ ID NO: 999672 - protein, 9 aa, Homo Sapiens
RLLSAIEST

SEQ ID NO: 999673 - protein, 9 aa, Homo Sapiens
NAVPYSQEY

SEQ ID NO: 999674 - protein, 9 aa, Homo Sapiens
AMSSHFIQD

SEQ ID NO: 999675 - protein, 9 aa, Homo Sapiens
ECLTDTEAE

SEQ ID NO: 999676 - protein, 9 aa, Homo Sapiens
STSPLLPPA

SEQ ID NO: 999677 - protein, 9 aa, Homo Sapiens
VVVAACVLI

SEQ ID NO: 999678 - protein, 9 aa, Homo Sapiens
CICRMATEE

SEQ ID NO: 999679 - protein, 9 aa, Homo Sapiens
HPSNVLDMP

SEQ ID NO: 999680 - protein, 9 aa, Homo Sapiens
SSLPLVTGK

SEQ ID NO: 999681 - protein, 9 aa, Homo Sapiens
MSPNQSNQG

SEQ ID NO: 999682 - protein, 9 aa, Homo Sapiens
FPMCTSRQV

SEQ ID NO: 999683 - protein, 9 aa, Homo Sapiens
VVVVGAGFC

SEQ ID NO: 999684 - protein, 9 aa, Homo Sapiens
KPLENNTGF

SEQ ID NO: 999685 - protein, 9 aa, Homo Sapiens
DGILHMFTS

SEQ ID NO: 999686 - protein, 9 aa, Homo Sapiens
LMFINEAEG

SEQ ID NO: 999687 - protein, 9 aa, Homo Sapiens
EKEYVQFQA

SEQ ID NO: 999688 - protein, 9 aa, Homo Sapiens
PDIFIVEFM

SEQ ID NO: 999689 - protein, 9 aa, Homo Sapiens
IYSVRGDEF

SEQ ID NO: 999690 - protein, 9 aa, Homo Sapiens
FGEELYDFN

SEQ ID NO: 999691 - protein, 9 aa, Homo Sapiens
AVTNKERLE

SEQ ID NO: 999692 - protein, 9 aa, Homo Sapiens
SIGFKEFEN

SEQ ID NO: 999693 - protein, 9 aa, Homo Sapiens
NEDGQVSPE

SEQ ID NO: 999694 - protein, 9 aa, Homo Sapiens
IRCLGSWFN

SEQ ID NO: 999695 - protein, 9 aa, Homo Sapiens
IYTHLWKNV

SEQ ID NO: 999696 - protein, 9 aa, Homo Sapiens
HAPAPPAAS

SEQ ID NO: 999697 - protein, 9 aa, Homo Sapiens
DSGKQTVRC

SEQ ID NO: 999698 - protein, 9 aa, Homo Sapiens
KTCHKSYAR

SEQ ID NO: 999699 - protein, 9 aa, Homo Sapiens
PAAPPPLTK

SEQ ID NO: 999700 - protein, 9 aa, Homo Sapiens
RILALAQKH

SEQ ID NO: 999701 - protein, 9 aa, Homo Sapiens
ELAEALPQR

SEQ ID NO: 999702 - protein, 9 aa, Homo Sapiens
QLLCLCMET

SEQ ID NO: 999703 - protein, 9 aa, Homo Sapiens
LYPDSRSHP

SEQ ID NO: 999704 - protein, 9 aa, Homo Sapiens
SSTQPELVP

SEQ ID NO: 999705 - protein, 9 aa, Homo Sapiens
DLIREESLI

SEQ ID NO: 999706 - protein, 9 aa, Homo Sapiens
VALSAESRS

SEQ ID NO: 999707 - protein, 9 aa, Homo Sapiens
SPQQENRKQ

SEQ ID NO: 999708 - protein, 9 aa, Homo Sapiens
QNLTQDGKE

SEQ ID NO: 999709 - protein, 9 aa, Homo Sapiens
CIYCAESFN

SEQ ID NO: 999710 - protein, 9 aa, Homo Sapiens
VFIKLIIFS

SEQ ID NO: 999711 - protein, 9 aa, Homo Sapiens
ISVRISLLL

SEQ ID NO: 999712 - protein, 9 aa, Homo Sapiens
HSYIQNLII

SEQ ID NO: 999713 - protein, 9 aa, Homo Sapiens
PDQKTEKSP

SEQ ID NO: 999714 - protein, 9 aa, Homo Sapiens
EEVAREEQA

SEQ ID NO: 999715 - protein, 9 aa, Homo Sapiens
FREMGDLIR

SEQ ID NO: 999716 - protein, 9 aa, Homo Sapiens
VDLTVLMKI

SEQ ID NO: 999717 - protein, 9 aa, Homo Sapiens
WDGLLVAKL

SEQ ID NO: 999718 - protein, 9 aa, Homo Sapiens
LRKHMKFRK

SEQ ID NO: 999719 - protein, 9 aa, Homo Sapiens
KWPPENEIS

SEQ ID NO: 999720 - protein, 9 aa, Homo Sapiens
SLPWSSDPF

SEQ ID NO: 999721 - protein, 9 aa, Homo Sapiens
AASGDFDYL

SEQ ID NO: 999722 - protein, 9 aa, Homo Sapiens
RLQMKWREL

SEQ ID NO: 999723 - protein, 9 aa, Homo Sapiens
EPFNIWGTW

SEQ ID NO: 999724 - protein, 9 aa, Homo Sapiens
IGNLLILLA

SEQ ID NO: 999725 - protein, 9 aa, Homo Sapiens
GEKGEKKEE

SEQ ID NO: 999726 - protein, 9 aa, Homo Sapiens
GLLNRKDPD

SEQ ID NO: 999727 - protein, 9 aa, Homo Sapiens
RMSVKPVSS

SEQ ID NO: 999728 - protein, 9 aa, Homo Sapiens
DSFFLDKVV

SEQ ID NO: 999729 - protein, 9 aa, Homo Sapiens
FIVEFMDVD

SEQ ID NO: 999730 - protein, 9 aa, Homo Sapiens
LERFIQRYL

SEQ ID NO: 999731 - protein, 9 aa, Homo Sapiens
PEDEPQETT

SEQ ID NO: 999732 - protein, 9 aa, Homo Sapiens
YSSCPEIKT

SEQ ID NO: 999733 - protein, 9 aa, Homo Sapiens
NFESGHNIN

SEQ ID NO: 999734 - protein, 9 aa, Homo Sapiens
ELWWEVEET

SEQ ID NO: 999735 - protein, 9 aa, Homo Sapiens
NEISKPEVP

SEQ ID NO: 999736 - protein, 9 aa, Homo Sapiens
IDKDAGRRH

SEQ ID NO: 999737 - protein, 9 aa, Homo Sapiens
PAGNLVCHN

SEQ ID NO: 999738 - protein, 9 aa, Homo Sapiens
ANVPDSVVQ

SEQ ID NO: 999739 - protein, 9 aa, Homo Sapiens
KSRREVQRL

SEQ ID NO: 999740 - protein, 9 aa, Homo Sapiens
SSPSLPWSS

SEQ ID NO: 999741 - protein, 9 aa, Homo Sapiens
SEMSVVGTS

SEQ ID NO: 999742 - protein, 9 aa, Homo Sapiens
NGEEAELVR

SEQ ID NO: 999743 - protein, 9 aa, Homo Sapiens
QELCERMRA

SEQ ID NO: 999744 - protein, 9 aa, Homo Sapiens
YLGNLSTIL

SEQ ID NO: 999745 - protein, 9 aa, Homo Sapiens
IMRNGVTHW

SEQ ID NO: 999746 - protein, 9 aa, Homo Sapiens
RNDYREEFR

SEQ ID NO: 999747 - protein, 9 aa, Homo Sapiens
GILHMFTSK

SEQ ID NO: 999748 - protein, 9 aa, Homo Sapiens
QRFSCLLLS

SEQ ID NO: 999749 - protein, 9 aa, Homo Sapiens
SFVCIYRLT

SEQ ID NO: 999750 - protein, 9 aa, Homo Sapiens
DHEAQLLEM

SEQ ID NO: 999751 - protein, 9 aa, Homo Sapiens
KTTAAPPTP

SEQ ID NO: 999752 - protein, 9 aa, Homo Sapiens
VCNLKKKLL

SEQ ID NO: 999753 - protein, 9 aa, Homo Sapiens
YWKVDVKDS

SEQ ID NO: 999754 - protein, 9 aa, Homo Sapiens
QHAILTKSP

SEQ ID NO: 999755 - protein, 9 aa, Homo Sapiens
GQFYDKPSL

SEQ ID NO: 999756 - protein, 9 aa, Homo Sapiens
LEELERFAR

SEQ ID NO: 999757 - protein, 9 aa, Homo Sapiens
SIDKDAGRR

SEQ ID NO: 999758 - protein, 9 aa, Homo Sapiens
SSTDGAVYV

SEQ ID NO: 999759 - protein, 9 aa, Homo Sapiens
SEHFEVNPS

SEQ ID NO: 999760 - protein, 9 aa, Homo Sapiens
KKGSIGFKE

SEQ ID NO: 999761 - protein, 9 aa, Homo Sapiens
RCYTMQKVN

SEQ ID NO: 999762 - protein, 9 aa, Homo Sapiens
TCVPEYQSL

SEQ ID NO: 999763 - protein, 9 aa, Homo Sapiens
ESTLIDQVN

SEQ ID NO: 999764 - protein, 9 aa, Homo Sapiens
CQIFLEKPA

SEQ ID NO: 999765 - protein, 9 aa, Homo Sapiens
ALHLTGMDR

SEQ ID NO: 999766 - protein, 9 aa, Homo Sapiens
MCFYQMERM

SEQ ID NO: 999767 - protein, 9 aa, Homo Sapiens
AKIRLNPEE

SEQ ID NO: 999768 - protein, 9 aa, Homo Sapiens
LKAEEGSSG

SEQ ID NO: 999769 - protein, 9 aa, Homo Sapiens
IKLRGAAAA

SEQ ID NO: 999770 - protein, 9 aa, Homo Sapiens
PENEISKPE

SEQ ID NO: 999771 - protein, 9 aa, Homo Sapiens
IRLLKTARL

SEQ ID NO: 999772 - protein, 9 aa, Homo Sapiens
HKALTRVVL

SEQ ID NO: 999773 - protein, 9 aa, Homo Sapiens
LATQPCLGG

SEQ ID NO: 999774 - protein, 9 aa, Homo Sapiens
ASVSEMSVV

SEQ ID NO: 999775 - protein, 9 aa, Homo Sapiens
KVKSGWLNK

SEQ ID NO: 999776 - protein, 9 aa, Homo Sapiens
FLRRTTMLD

SEQ ID NO: 999777 - protein, 9 aa, Homo Sapiens
RDLFIQLMF

SEQ ID NO: 999778 - protein, 9 aa, Homo Sapiens
AVLEELPMM

SEQ ID NO: 999779 - protein, 9 aa, Homo Sapiens
LTLAGSSDA

SEQ ID NO: 999780 - protein, 9 aa, Homo Sapiens
SSLGRLLSI

SEQ ID NO: 999781 - protein, 9 aa, Homo Sapiens
ALPQRKMNE

SEQ ID NO: 999782 - protein, 9 aa, Homo Sapiens
RPSMPTDPV

SEQ ID NO: 999783 - protein, 9 aa, Homo Sapiens
SFPISPTYS

SEQ ID NO: 999784 - protein, 9 aa, Homo Sapiens
TMRHLGDGT

SEQ ID NO: 999785 - protein, 9 aa, Homo Sapiens
SSFVQDYGF

SEQ ID NO: 999786 - protein, 9 aa, Homo Sapiens
RVFLQLRVV

SEQ ID NO: 999787 - protein, 9 aa, Homo Sapiens
PALRAIGLH

SEQ ID NO: 999788 - protein, 9 aa, Homo Sapiens
ELSKKECCS

SEQ ID NO: 999789 - protein, 9 aa, Homo Sapiens
ESVQGVDAR

SEQ ID NO: 999790 - protein, 9 aa, Homo Sapiens
RRKRQAPLA

SEQ ID NO: 999791 - protein, 9 aa, Homo Sapiens
NVDSLYQKH

SEQ ID NO: 999792 - protein, 9 aa, Homo Sapiens
ISTTKELDF

SEQ ID NO: 999793 - protein, 9 aa, Homo Sapiens
DFATGAVSQ

SEQ ID NO: 999794 - protein, 9 aa, Homo Sapiens
DHNAYTEAR

SEQ ID NO: 999795 - protein, 9 aa, Homo Sapiens
VHNPKNQSY

SEQ ID NO: 999796 - protein, 9 aa, Homo Sapiens
VSKQCGKFL

SEQ ID NO: 999797 - protein, 9 aa, Homo Sapiens
MFLNCFEYN

SEQ ID NO: 999798 - protein, 9 aa, Homo Sapiens
NNSSKFSAH

SEQ ID NO: 999799 - protein, 9 aa, Homo Sapiens
EHHPGTTFF

SEQ ID NO: 999800 - protein, 9 aa, Homo Sapiens
PPKKVVPEK

SEQ ID NO: 999801 - protein, 9 aa, Homo Sapiens
KKTPSEENF

SEQ ID NO: 999802 - protein, 9 aa, Homo Sapiens
PPFLRGHYR

SEQ ID NO: 999803 - protein, 9 aa, Homo Sapiens
TVWKHFSGG

SEQ ID NO: 999804 - protein, 9 aa, Homo Sapiens
AKAGVIFSV

SEQ ID NO: 999805 - protein, 9 aa, Homo Sapiens
GTPIGMPPL

SEQ ID NO: 999806 - protein, 9 aa, Homo Sapiens
KSKFYGANF

SEQ ID NO: 999807 - protein, 9 aa, Homo Sapiens
YPFNLLLLN

SEQ ID NO: 999808 - protein, 9 aa, Homo Sapiens
CVVSRFSYY

SEQ ID NO: 999809 - protein, 9 aa, Homo Sapiens
YDKDNISPA

SEQ ID NO: 999810 - protein, 9 aa, Homo Sapiens
AWAELSLAT

SEQ ID NO: 999811 - protein, 9 aa, Homo Sapiens
EELERFART

SEQ ID NO: 999812 - protein, 9 aa, Homo Sapiens
HMFTSKLDK

SEQ ID NO: 999813 - protein, 9 aa, Homo Sapiens
PDIFFCPAL

SEQ ID NO: 999814 - protein, 9 aa, Homo Sapiens
SSKPTQCTM

SEQ ID NO: 999815 - protein, 9 aa, Homo Sapiens
EDEDDDIKL

SEQ ID NO: 999816 - protein, 9 aa, Homo Sapiens
MKVNSEFIV

SEQ ID NO: 999817 - protein, 9 aa, Homo Sapiens
KKANDTSNG

SEQ ID NO: 999818 - protein, 9 aa, Homo Sapiens
RDDFRQNPL

SEQ ID NO: 999819 - protein, 9 aa, Homo Sapiens
KTGWVIKNV

SEQ ID NO: 999820 - protein, 9 aa, Homo Sapiens
EKPTIFTEK

SEQ ID NO: 999821 - protein, 9 aa, Homo Sapiens
TTVFSCPGC

SEQ ID NO: 999822 - protein, 9 aa, Homo Sapiens
LSRSWDGLL

SEQ ID NO: 999823 - protein, 9 aa, Homo Sapiens
QAATPETSQ

SEQ ID NO: 999824 - protein, 9 aa, Homo Sapiens
CSECEKLFS

SEQ ID NO: 999825 - protein, 9 aa, Homo Sapiens
PRGPPPLRL

SEQ ID NO: 999826 - protein, 9 aa, Homo Sapiens
MLAGQASFE

SEQ ID NO: 999827 - protein, 9 aa, Homo Sapiens
YSRAVCNLK

SEQ ID NO: 999828 - protein, 9 aa, Homo Sapiens
SPPDRQAVP

SEQ ID NO: 999829 - protein, 9 aa, Homo Sapiens
GRTIQRYLA

SEQ ID NO: 999830 - protein, 9 aa, Homo Sapiens
PFQDFKDAA

SEQ ID NO: 999831 - protein, 9 aa, Homo Sapiens
RFFEADAFQ

SEQ ID NO: 999832 - protein, 9 aa, Homo Sapiens
QKSEVRSLF

SEQ ID NO: 999833 - protein, 9 aa, Homo Sapiens
HNYFIKTAQ

SEQ ID NO: 999834 - protein, 9 aa, Homo Sapiens
GRVKPQRVG

SEQ ID NO: 999835 - protein, 9 aa, Homo Sapiens
TGQFYDKPS

SEQ ID NO: 999836 - protein, 9 aa, Homo Sapiens
IMIVFGHFS

SEQ ID NO: 999837 - protein, 9 aa, Homo Sapiens
SADLVLLSS

SEQ ID NO: 999838 - protein, 9 aa, Homo Sapiens
LHSRTKRDP

SEQ ID NO: 999839 - protein, 9 aa, Homo Sapiens
ERSYGSDKF

SEQ ID NO: 999840 - protein, 9 aa, Homo Sapiens
VLGLLNRKD

SEQ ID NO: 999841 - protein, 9 aa, Homo Sapiens
RGSCQNIFL

SEQ ID NO: 999842 - protein, 9 aa, Homo Sapiens
HIKRRECAY

SEQ ID NO: 999843 - protein, 9 aa, Homo Sapiens
PEPPDGEDP

SEQ ID NO: 999844 - protein, 9 aa, Homo Sapiens
TAQKNPTPW

SEQ ID NO: 999845 - protein, 9 aa, Homo Sapiens
RQKLIASLI

SEQ ID NO: 999846 - protein, 9 aa, Homo Sapiens
YIPPDQKTE

SEQ ID NO: 999847 - protein, 9 aa, Homo Sapiens
WNKYQDHCY

SEQ ID NO: 999848 - protein, 9 aa, Homo Sapiens
LRGHYRLVR

SEQ ID NO: 999849 - protein, 9 aa, Homo Sapiens
AVPYSQEYF

SEQ ID NO: 999850 - protein, 9 aa, Homo Sapiens
HLRELHLDS

SEQ ID NO: 999851 - protein, 9 aa, Homo Sapiens
YTLCKPVLT

SEQ ID NO: 999852 - protein, 9 aa, Homo Sapiens
MCNADYADL

SEQ ID NO: 999853 - protein, 9 aa, Homo Sapiens
EPPDGEDPG

SEQ ID NO: 999854 - protein, 9 aa, Homo Sapiens
VVDDDHQQG

SEQ ID NO: 999855 - protein, 9 aa, Homo Sapiens
SSVSEIAEV

SEQ ID NO: 999856 - protein, 9 aa, Homo Sapiens
KEEAFMVRD

SEQ ID NO: 999857 - protein, 9 aa, Homo Sapiens
DNSPELIIS

SEQ ID NO: 999858 - protein, 9 aa, Homo Sapiens
KRRSFKDLL

SEQ ID NO: 999859 - protein, 9 aa, Homo Sapiens
ASAAVAPKN

SEQ ID NO: 999860 - protein, 9 aa, Homo Sapiens
KLQLLPASL

SEQ ID NO: 999861 - protein, 9 aa, Homo Sapiens
INQKIVTNN

SEQ ID NO: 999862 - protein, 9 aa, Homo Sapiens
FHSYIQNLI

SEQ ID NO: 999863 - protein, 9 aa, Homo Sapiens
QNKIKWQNF

SEQ ID NO: 999864 - protein, 9 aa, Homo Sapiens
KDDPHYFVM

SEQ ID NO: 999865 - protein, 9 aa, Homo Sapiens
PPLRLGLLG

SEQ ID NO: 999866 - protein, 9 aa, Homo Sapiens
QNPLDVMVA

SEQ ID NO: 999867 - protein, 9 aa, Homo Sapiens
KYFSSKMSE

SEQ ID NO: 999868 - protein, 9 aa, Homo Sapiens
QKKEASGRT

SEQ ID NO: 999869 - protein, 9 aa, Homo Sapiens
NFSYPEPSA

SEQ ID NO: 999870 - protein, 9 aa, Homo Sapiens
GNLVCHNHH

SEQ ID NO: 999871 - protein, 9 aa, Homo Sapiens
TGTPHAKRK

SEQ ID NO: 999872 - protein, 9 aa, Homo Sapiens
MATQRFSCL

SEQ ID NO: 999873 - protein, 9 aa, Homo Sapiens
TTSEESQVF

SEQ ID NO: 999874 - protein, 9 aa, Homo Sapiens
VTAIWMNST

SEQ ID NO: 999875 - protein, 9 aa, Homo Sapiens
RLDHKFNLM

SEQ ID NO: 999876 - protein, 9 aa, Homo Sapiens
APAPPAASG

SEQ ID NO: 999877 - protein, 9 aa, Homo Sapiens
TLNTLANVP

SEQ ID NO: 999878 - protein, 9 aa, Homo Sapiens
SSSLSLPRS

SEQ ID NO: 999879 - protein, 9 aa, Homo Sapiens
PNSGSWVSC

SEQ ID NO: 999880 - protein, 9 aa, Homo Sapiens
ALECRRCYV

SEQ ID NO: 999881 - protein, 9 aa, Homo Sapiens
GKFLELDLN

SEQ ID NO: 999882 - protein, 9 aa, Homo Sapiens
STSIDKDAG

SEQ ID NO: 999883 - protein, 9 aa, Homo Sapiens
EPLPLLFHQ

SEQ ID NO: 999884 - protein, 9 aa, Homo Sapiens
VTGLQNKNY

SEQ ID NO: 999885 - protein, 9 aa, Homo Sapiens
KKISFPQWE

SEQ ID NO: 999886 - protein, 9 aa, Homo Sapiens
VPDPEVMPF

SEQ ID NO: 999887 - protein, 9 aa, Homo Sapiens
SIMFTPLNR

SEQ ID NO: 999888 - protein, 9 aa, Homo Sapiens
LVANPVALK

SEQ ID NO: 999889 - protein, 9 aa, Homo Sapiens
VPRHQLQGH

SEQ ID NO: 999890 - protein, 9 aa, Homo Sapiens
EPNNKERYY

SEQ ID NO: 999891 - protein, 9 aa, Homo Sapiens
GKQGFKPKR

SEQ ID NO: 999892 - protein, 9 aa, Homo Sapiens
PYSQEYFLC

SEQ ID NO: 999893 - protein, 9 aa, Homo Sapiens
GAVYVMEIN

SEQ ID NO: 999894 - protein, 9 aa, Homo Sapiens
DTADVPTYK

SEQ ID NO: 999895 - protein, 9 aa, Homo Sapiens
KSYDILSGL

SEQ ID NO: 999896 - protein, 9 aa, Homo Sapiens
EPQETTYRT

SEQ ID NO: 999897 - protein, 9 aa, Homo Sapiens
LMGASRGFL

SEQ ID NO: 999898 - protein, 9 aa, Homo Sapiens
YFLLSDRKF

SEQ ID NO: 999899 - protein, 9 aa, Homo Sapiens
VVVGAGFCD

SEQ ID NO: 999900 - protein, 9 aa, Homo Sapiens
RVKPQRVGG

SEQ ID NO: 999901 - protein, 9 aa, Homo Sapiens
EKEMFKMVT

SEQ ID NO: 999902 - protein, 9 aa, Homo Sapiens
PGPPGPPRK

SEQ ID NO: 999903 - protein, 9 aa, Homo Sapiens
QLVISPEVL

SEQ ID NO: 999904 - protein, 9 aa, Homo Sapiens
QLRCKEWLA

SEQ ID NO: 999905 - protein, 9 aa, Homo Sapiens
ADSPEGLQH

SEQ ID NO: 999906 - protein, 9 aa, Homo Sapiens
FQAWHRMQF

SEQ ID NO: 999907 - protein, 9 aa, Homo Sapiens
KDTFTASSE

SEQ ID NO: 999908 - protein, 9 aa, Homo Sapiens
LGIVPMCFY

SEQ ID NO: 999909 - protein, 9 aa, Homo Sapiens
DDADHEAQL

SEQ ID NO: 999910 - protein, 9 aa, Homo Sapiens
HHPGTTFFG

SEQ ID NO: 999911 - protein, 9 aa, Homo Sapiens
LTKPGSSDI

SEQ ID NO: 999912 - protein, 9 aa, Homo Sapiens
NPHLHGCLQ

SEQ ID NO: 999913 - protein, 9 aa, Homo Sapiens
SDEMVSLFS

SEQ ID NO: 999914 - protein, 9 aa, Homo Sapiens
NTGFQAQDI

SEQ ID NO: 999915 - protein, 9 aa, Homo Sapiens
LKVSLQDYA

SEQ ID NO: 999916 - protein, 9 aa, Homo Sapiens
LQALHMTSE

SEQ ID NO: 999917 - protein, 9 aa, Homo Sapiens
THLSVTGLS

SEQ ID NO: 999918 - protein, 9 aa, Homo Sapiens
EFFDPTADV

SEQ ID NO: 999919 - protein, 9 aa, Homo Sapiens
LSTGDQVAK

SEQ ID NO: 999920 - protein, 9 aa, Homo Sapiens
HHSPQVDEL

SEQ ID NO: 999921 - protein, 9 aa, Homo Sapiens
QSCGEEEDE

SEQ ID NO: 999922 - protein, 9 aa, Homo Sapiens
NGRNSEEEN

SEQ ID NO: 999923 - protein, 9 aa, Homo Sapiens
VSFPSSAPS

SEQ ID NO: 999924 - protein, 9 aa, Homo Sapiens
VISIIQVVG

SEQ ID NO: 999925 - protein, 9 aa, Homo Sapiens
KPSYTVNWY

SEQ ID NO: 999926 - protein, 9 aa, Homo Sapiens
NQLLRSLGI

SEQ ID NO: 999927 - protein, 9 aa, Homo Sapiens
KANDRKRNR

SEQ ID NO: 999928 - protein, 9 aa, Homo Sapiens
FWGELMKSK

SEQ ID NO: 999929 - protein, 9 aa, Homo Sapiens
FLRLRAGRP

SEQ ID NO: 999930 - protein, 9 aa, Homo Sapiens
ICNSGKTVK

SEQ ID NO: 999931 - protein, 9 aa, Homo Sapiens
FDIIEGQKT

SEQ ID NO: 999932 - protein, 9 aa, Homo Sapiens
MPPLGMRPP

SEQ ID NO: 999933 - protein, 9 aa, Homo Sapiens
FLDAKESNH

SEQ ID NO: 999934 - protein, 9 aa, Homo Sapiens
ELKIQEMAS

SEQ ID NO: 999935 - protein, 9 aa, Homo Sapiens
LKIQEMASM

SEQ ID NO: 999936 - protein, 9 aa, Homo Sapiens
ESQVFQSSG

SEQ ID NO: 999937 - protein, 9 aa, Homo Sapiens
ETLEKFEAR

SEQ ID NO: 999938 - protein, 9 aa, Homo Sapiens
ASALGAGPT

SEQ ID NO: 999939 - protein, 9 aa, Homo Sapiens
NPLDVMVAV

SEQ ID NO: 999940 - protein, 9 aa, Homo Sapiens
TAPEAIAYW

SEQ ID NO: 999941 - protein, 9 aa, Homo Sapiens
VGYEAKMSS

SEQ ID NO: 999942 - protein, 9 aa, Homo Sapiens
DAQEPPAPS

SEQ ID NO: 999943 - protein, 9 aa, Homo Sapiens
GALASRGSP

SEQ ID NO: 999944 - protein, 9 aa, Homo Sapiens
LEPLPLLFH

SEQ ID NO: 999945 - protein, 9 aa, Homo Sapiens
EMWQNIISY

SEQ ID NO: 999946 - protein, 9 aa, Homo Sapiens
TILPTEGTL

SEQ ID NO: 999947 - protein, 9 aa, Homo Sapiens
NHGKFASVF

SEQ ID NO: 999948 - protein, 9 aa, Homo Sapiens
VSALVEFIQ

SEQ ID NO: 999949 - protein, 9 aa, Homo Sapiens
LLMLQLLWL

SEQ ID NO: 999950 - protein, 9 aa, Homo Sapiens
AIGRKLERN

SEQ ID NO: 999951 - protein, 9 aa, Homo Sapiens
EKSEFSVLR

SEQ ID NO: 999952 - protein, 9 aa, Homo Sapiens
PASQLLCLC

SEQ ID NO: 999953 - protein, 9 aa, Homo Sapiens
LSIVRPGTQ

SEQ ID NO: 999954 - protein, 9 aa, Homo Sapiens
KIVTEEKIH

SEQ ID NO: 999955 - protein, 9 aa, Homo Sapiens
ISEPMDKNC

SEQ ID NO: 999956 - protein, 9 aa, Homo Sapiens
EYWDLNVYF

SEQ ID NO: 999957 - protein, 9 aa, Homo Sapiens
KPKNCYANV

SEQ ID NO: 999958 - protein, 9 aa, Homo Sapiens
KDAVWKAMF

SEQ ID NO: 999959 - protein, 9 aa, Homo Sapiens
AVCNLKKKL

SEQ ID NO: 999960 - protein, 9 aa, Homo Sapiens
SSQFSAEAD

SEQ ID NO: 999961 - protein, 9 aa, Homo Sapiens
SGTQPEDLN

SEQ ID NO: 999962 - protein, 9 aa, Homo Sapiens
GYGYDDYKP

SEQ ID NO: 999963 - protein, 9 aa, Homo Sapiens
AEEFSGRSE

SEQ ID NO: 999964 - protein, 9 aa, Homo Sapiens
SQFSAEADR

SEQ ID NO: 999965 - protein, 9 aa, Homo Sapiens
HGFKEKALF

SEQ ID NO: 999966 - protein, 9 aa, Homo Sapiens
LLQPTQRCM

SEQ ID NO: 999967 - protein, 9 aa, Homo Sapiens
APLVEFSAE

SEQ ID NO: 999968 - protein, 9 aa, Homo Sapiens
VRGALKRSE

SEQ ID NO: 999969 - protein, 9 aa, Homo Sapiens
APEAIAYWK

SEQ ID NO: 999970 - protein, 9 aa, Homo Sapiens
FPPRLDRVA

SEQ ID NO: 999971 - protein, 9 aa, Homo Sapiens
RRAQESPKS

SEQ ID NO: 999972 - protein, 9 aa, Homo Sapiens
INIAHVDGI

SEQ ID NO: 999973 - protein, 9 aa, Homo Sapiens
TELSTEAPK

SEQ ID NO: 999974 - protein, 9 aa, Homo Sapiens
LDVDCLESP

SEQ ID NO: 999975 - protein, 9 aa, Homo Sapiens
SGRSEQATF

SEQ ID NO: 999976 - protein, 9 aa, Homo Sapiens
LVTGKFLEL

SEQ ID NO: 999977 - protein, 9 aa, Homo Sapiens
KRQAPLATR

SEQ ID NO: 999978 - protein, 9 aa, Homo Sapiens
IQDLLPEQG

SEQ ID NO: 999979 - protein, 9 aa, Homo Sapiens
FLRGHYRLV

SEQ ID NO: 999980 - protein, 9 aa, Homo Sapiens
AKRRSFKDL

SEQ ID NO: 999981 - protein, 9 aa, Homo Sapiens
NGVTHWSLS

SEQ ID NO: 999982 - protein, 9 aa, Homo Sapiens
VKAKNAQTI

SEQ ID NO: 999983 - protein, 9 aa, Homo Sapiens
LASRGSPLA

SEQ ID NO: 999984 - protein, 9 aa, Homo Sapiens
RNGVTHWSL

SEQ ID NO: 999985 - protein, 9 aa, Homo Sapiens
HQDLGYQNK

SEQ ID NO: 999986 - protein, 9 aa, Homo Sapiens
VASSDSNTE

SEQ ID NO: 999987 - protein, 9 aa, Homo Sapiens
RAQESPKSD

SEQ ID NO: 999988 - protein, 9 aa, Homo Sapiens
EILMHHSPQ

SEQ ID NO: 999989 - protein, 9 aa, Homo Sapiens
PQRVGGSGE

SEQ ID NO: 999990 - protein, 9 aa, Homo Sapiens
EEESPDHQY

SEQ ID NO: 999991 - protein, 9 aa, Homo Sapiens
SPELIISSL

SEQ ID NO: 999992 - protein, 9 aa, Homo Sapiens
PTIFTEKPT

SEQ ID NO: 999993 - protein, 9 aa, Homo Sapiens
WHRMQFLHK

SEQ ID NO: 999994 - protein, 9 aa, Homo Sapiens
FHSGREHER

SEQ ID NO: 999995 - protein, 9 aa, Homo Sapiens
IEIQELQVF

SEQ ID NO: 999996 - protein, 9 aa, Homo Sapiens
KKWPKKSKV

SEQ ID NO: 999997 - protein, 9 aa, Homo Sapiens
SNKLTRVPG

SEQ ID NO: 999998 - protein, 9 aa, Homo Sapiens
SALEPLPLL

SEQ ID NO: 999999 - protein, 9 aa, Homo Sapiens
HDSISSKPT

SEQ ID NO: 1000000 - protein, 9 aa, Homo Sapiens
RNILKKKGI

SEQ ID NO: 1000001 - protein, 9 aa, Homo Sapiens
ALHMTSENQ

SEQ ID NO: 1000002 - protein, 9 aa, Homo Sapiens
TSKLDKMLD

SEQ ID NO: 1000003 - protein, 9 aa, Homo Sapiens
ILPDDSCPT

SEQ ID NO: 1000004 - protein, 9 aa, Homo Sapiens
PLGIPPLGF

SEQ ID NO: 1000005 - protein, 9 aa, Homo Sapiens
HLKNKVQVV

SEQ ID NO: 1000006 - protein, 9 aa, Homo Sapiens
TKSPFAYYT

SEQ ID NO: 1000007 - protein, 9 aa, Homo Sapiens
LKRPRLVIL

SEQ ID NO: 1000008 - protein, 9 aa, Homo Sapiens
VSQYTVQCP

SEQ ID NO: 1000009 - protein, 9 aa, Homo Sapiens
EADSPEGLQ

SEQ ID NO: 1000010 - protein, 9 aa, Homo Sapiens
RSDSQVLLE

SEQ ID NO: 1000011 - protein, 9 aa, Homo Sapiens
LQGRTDGAK

SEQ ID NO: 1000012 - protein, 9 aa, Homo Sapiens
PLFPPAGNL

SEQ ID NO: 1000013 - protein, 9 aa, Homo Sapiens
PHFVSNFNG

SEQ ID NO: 1000014 - protein, 9 aa, Homo Sapiens
PKLIRIGCF

SEQ ID NO: 1000015 - protein, 9 aa, Homo Sapiens
NSWFECVSM

SEQ ID NO: 1000016 - protein, 9 aa, Homo Sapiens
LSLLDEEGR

SEQ ID NO: 1000017 - protein, 9 aa, Homo Sapiens
ELKFNLNQY

SEQ ID NO: 1000018 - protein, 9 aa, Homo Sapiens
KLERNEQLT

SEQ ID NO: 1000019 - protein, 9 aa, Homo Sapiens
LGKDVDDDK

SEQ ID NO: 1000020 - protein, 9 aa, Homo Sapiens
KKVKSGWLN

SEQ ID NO: 1000021 - protein, 9 aa, Homo Sapiens
LKRSEPLLL

SEQ ID NO: 1000022 - protein, 9 aa, Homo Sapiens
RNHFGEELY

SEQ ID NO: 1000023 - protein, 9 aa, Homo Sapiens
PEDEDDDIK

SEQ ID NO: 1000024 - protein, 9 aa, Homo Sapiens
FTPEKEMFK

SEQ ID NO: 1000025 - protein, 9 aa, Homo Sapiens
THGETNGIY

SEQ ID NO: 1000026 - protein, 9 aa, Homo Sapiens
FLLWWLLSI

SEQ ID NO: 1000027 - protein, 9 aa, Homo Sapiens
LTKSPFAYY

SEQ ID NO: 1000028 - protein, 9 aa, Homo Sapiens
CGLSCCQSS

SEQ ID NO: 1000029 - protein, 9 aa, Homo Sapiens
TSNNEIITL

SEQ ID NO: 1000030 - protein, 9 aa, Homo Sapiens
GFSQSPHRL

SEQ ID NO: 1000031 - protein, 9 aa, Homo Sapiens
SVGVLLQRA

SEQ ID NO: 1000032 - protein, 9 aa, Homo Sapiens
GFLVLVFKV

SEQ ID NO: 1000033 - protein, 9 aa, Homo Sapiens
WYANCHASN

SEQ ID NO: 1000034 - protein, 9 aa, Homo Sapiens
CDSDNDCGD

SEQ ID NO: 1000035 - protein, 9 aa, Homo Sapiens
HKLQDSGKA

SEQ ID NO: 1000036 - protein, 9 aa, Homo Sapiens
RTHHNPTVW

SEQ ID NO: 1000037 - protein, 9 aa, Homo Sapiens
HVILAWSTS

SEQ ID NO: 1000038 - protein, 9 aa, Homo Sapiens
WARLDHKFN

SEQ ID NO: 1000039 - protein, 9 aa, Homo Sapiens
IGSEADPAS

SEQ ID NO: 1000040 - protein, 9 aa, Homo Sapiens
LGNLSTILP

SEQ ID NO: 1000041 - protein, 9 aa, Homo Sapiens
KFNLMYAKR

SEQ ID NO: 1000042 - protein, 9 aa, Homo Sapiens
NGGNCKEFQ

SEQ ID NO: 1000043 - protein, 9 aa, Homo Sapiens
YQNKIKWQN

SEQ ID NO: 1000044 - protein, 9 aa, Homo Sapiens
LSQRIPLPR

SEQ ID NO: 1000045 - protein, 9 aa, Homo Sapiens
PGEPGPPEP

SEQ ID NO: 1000046 - protein, 9 aa, Homo Sapiens
DFWDFKQST

SEQ ID NO: 1000047 - protein, 9 aa, Homo Sapiens
PPISSSKRK

SEQ ID NO: 1000048 - protein, 9 aa, Homo Sapiens
LKAEKTCAP

SEQ ID NO: 1000049 - protein, 9 aa, Homo Sapiens
VLRLFLSAD

SEQ ID NO: 1000050 - protein, 9 aa, Homo Sapiens
DKDFTPATC

SEQ ID NO: 1000051 - protein, 9 aa, Homo Sapiens
KACRRPRPW

SEQ ID NO: 1000052 - protein, 9 aa, Homo Sapiens
LKKHPIFFM

SEQ ID NO: 1000053 - protein, 9 aa, Homo Sapiens
PKTTAAPPT

SEQ ID NO: 1000054 - protein, 9 aa, Homo Sapiens
IFIVEFMDV

SEQ ID NO: 1000055 - protein, 9 aa, Homo Sapiens
QDANTIFKG

SEQ ID NO: 1000056 - protein, 9 aa, Homo Sapiens
MKVIRCLGS

SEQ ID NO: 1000057 - protein, 9 aa, Homo Sapiens
SYLLRDSNK

SEQ ID NO: 1000058 - protein, 9 aa, Homo Sapiens
KFSSGSQRA

SEQ ID NO: 1000059 - protein, 9 aa, Homo Sapiens
VSIGKWSIS

SEQ ID NO: 1000060 - protein, 9 aa, Homo Sapiens
EYTVGAEAS

SEQ ID NO: 1000061 - protein, 9 aa, Homo Sapiens
LCSFFGLQV

SEQ ID NO: 1000062 - protein, 9 aa, Homo Sapiens
FFLDKVVSV

SEQ ID NO: 1000063 - protein, 9 aa, Homo Sapiens
KDIRVQLEA

SEQ ID NO: 1000064 - protein, 9 aa, Homo Sapiens
LTFSNTSTL

SEQ ID NO: 1000065 - protein, 9 aa, Homo Sapiens
GLSSVSEIA

SEQ ID NO: 1000066 - protein, 9 aa, Homo Sapiens
VPEVLPPKK

SEQ ID NO: 1000067 - protein, 9 aa, Homo Sapiens
CQNIFLSNA

SEQ ID NO: 1000068 - protein, 9 aa, Homo Sapiens
TEYTMHIKR

SEQ ID NO: 1000069 - protein, 9 aa, Homo Sapiens
AELSLATQP

SEQ ID NO: 1000070 - protein, 9 aa, Homo Sapiens
HLNAMDSNL

SEQ ID NO: 1000071 - protein, 9 aa, Homo Sapiens
AYSRSSTLT

SEQ ID NO: 1000072 - protein, 9 aa, Homo Sapiens
GLGDGAETL

SEQ ID NO: 1000073 - protein, 9 aa, Homo Sapiens
QGSSKPPPA

SEQ ID NO: 1000074 - protein, 9 aa, Homo Sapiens
LEDKFSGQS

SEQ ID NO: 1000075 - protein, 9 aa, Homo Sapiens
AFRIDKGQI

SEQ ID NO: 1000076 - protein, 9 aa, Homo Sapiens
PLPPESIPA

SEQ ID NO: 1000077 - protein, 9 aa, Homo Sapiens
GISLLISGT

SEQ ID NO: 1000078 - protein, 9 aa, Homo Sapiens
TYKEVTPYR

SEQ ID NO: 1000079 - protein, 9 aa, Homo Sapiens
HMLAMVEKA

SEQ ID NO: 1000080 - protein, 9 aa, Homo Sapiens
RSRPQTQGK

SEQ ID NO: 1000081 - protein, 9 aa, Homo Sapiens
KLPCNLCST

SEQ ID NO: 1000082 - protein, 9 aa, Homo Sapiens
WDSATCKQI

SEQ ID NO: 1000083 - protein, 9 aa, Homo Sapiens
QVQKLEECL

SEQ ID NO: 1000084 - protein, 9 aa, Homo Sapiens
PKKVVPEKK

SEQ ID NO: 1000085 - protein, 9 aa, Homo Sapiens
TNKERLEEE

SEQ ID NO: 1000086 - protein, 9 aa, Homo Sapiens
MVATAQDDI

SEQ ID NO: 1000087 - protein, 9 aa, Homo Sapiens
GRKECDCGS

SEQ ID NO: 1000088 - protein, 9 aa, Homo Sapiens
SILSLLKYF

SEQ ID NO: 1000089 - protein, 9 aa, Homo Sapiens
IMRQYTSFH

SEQ ID NO: 1000090 - protein, 9 aa, Homo Sapiens
ILMVVMKVN

SEQ ID NO: 1000091 - protein, 9 aa, Homo Sapiens
RRPPKLPKG

SEQ ID NO: 1000092 - protein, 9 aa, Homo Sapiens
ALVDMYSHV

SEQ ID NO: 1000093 - protein, 9 aa, Homo Sapiens
KLSEHFEVN

SEQ ID NO: 1000094 - protein, 9 aa, Homo Sapiens
SMDSGKIQR

SEQ ID NO: 1000095 - protein, 9 aa, Homo Sapiens
KLAAERNLN

SEQ ID NO: 1000096 - protein, 9 aa, Homo Sapiens
CSSGCGLSC

SEQ ID NO: 1000097 - protein, 9 aa, Homo Sapiens
SVSALVEFI

SEQ ID NO: 1000098 - protein, 9 aa, Homo Sapiens
KTCEVGAWC

SEQ ID NO: 1000099 - protein, 9 aa, Homo Sapiens
GLPFSPLAE

SEQ ID NO: 1000100 - protein, 9 aa, Homo Sapiens
RDGKDQPIM

SEQ ID NO: 1000101 - protein, 9 aa, Homo Sapiens
PPQQFSYQP

SEQ ID NO: 1000102 - protein, 9 aa, Homo Sapiens
VQKDENSCA

SEQ ID NO: 1000103 - protein, 9 aa, Homo Sapiens
RMQFLHKLI

SEQ ID NO: 1000104 - protein, 9 aa, Homo Sapiens
TPLPPESIP

SEQ ID NO: 1000105 - protein, 9 aa, Homo Sapiens
SLKSFSYAT

SEQ ID NO: 1000106 - protein, 9 aa, Homo Sapiens
SGSVLLLQE

SEQ ID NO: 1000107 - protein, 9 aa, Homo Sapiens
LETLSKLLN

SEQ ID NO: 1000108 - protein, 9 aa, Homo Sapiens
PWVVDDDHQ

SEQ ID NO: 1000109 - protein, 9 aa, Homo Sapiens
LENNTGFQA

SEQ ID NO: 1000110 - protein, 9 aa, Homo Sapiens
PLVENCASI

SEQ ID NO: 1000111 - protein, 9 aa, Homo Sapiens
PISPTYSCA

SEQ ID NO: 1000112 - protein, 9 aa, Homo Sapiens
SSLSLSLPH

SEQ ID NO: 1000113 - protein, 9 aa, Homo Sapiens
VAPKNMIFY

SEQ ID NO: 1000114 - protein, 9 aa, Homo Sapiens
TQDANTIFK

SEQ ID NO: 1000115 - protein, 9 aa, Homo Sapiens
YSVGVLLQR

SEQ ID NO: 1000116 - protein, 9 aa, Homo Sapiens
LPDIFIVEF

SEQ ID NO: 1000117 - protein, 9 aa, Homo Sapiens
DEMVSLFSK

SEQ ID NO: 1000118 - protein, 9 aa, Homo Sapiens
AGRRKFVDQ

SEQ ID NO: 1000119 - protein, 9 aa, Homo Sapiens
MHWFHQAPI

SEQ ID NO: 1000120 - protein, 9 aa, Homo Sapiens
NRYTTMRHL

SEQ ID NO: 1000121 - protein, 9 aa, Homo Sapiens
KEGLAFNMI

SEQ ID NO: 1000122 - protein, 9 aa, Homo Sapiens
QFVPFQDFK

SEQ ID NO: 1000123 - protein, 9 aa, Homo Sapiens
VRKSLKKEY

SEQ ID NO: 1000124 - protein, 9 aa, Homo Sapiens
MFTSKLDKM

SEQ ID NO: 1000125 - protein, 9 aa, Homo Sapiens
QERRAQESP

SEQ ID NO: 1000126 - protein, 9 aa, Homo Sapiens
EEVASSDSN

SEQ ID NO: 1000127 - protein, 9 aa, Homo Sapiens
GTVNWRSCI

SEQ ID NO: 1000128 - protein, 9 aa, Homo Sapiens
DYKVTVKVI

SEQ ID NO: 1000129 - protein, 9 aa, Homo Sapiens
EKKEESDAG

SEQ ID NO: 1000130 - protein, 9 aa, Homo Sapiens
RPEALPSPS

SEQ ID NO: 1000131 - protein, 9 aa, Homo Sapiens
TLANVPDSV

SEQ ID NO: 1000132 - protein, 9 aa, Homo Sapiens
PQQENRKQL

SEQ ID NO: 1000133 - protein, 9 aa, Homo Sapiens
QYASVAYQN

SEQ ID NO: 1000134 - protein, 9 aa, Homo Sapiens
QRKKTESVL

SEQ ID NO: 1000135 - protein, 9 aa, Homo Sapiens
LSVHNSARP

SEQ ID NO: 1000136 - protein, 9 aa, Homo Sapiens
LFSQRRKRQ

SEQ ID NO: 1000137 - protein, 9 aa, Homo Sapiens
AITPGPPGS

SEQ ID NO: 1000138 - protein, 9 aa, Homo Sapiens
TPVNTSIPV

SEQ ID NO: 1000139 - protein, 9 aa, Homo Sapiens
GEVPRHQLQ

SEQ ID NO: 1000140 - protein, 9 aa, Homo Sapiens
VMHGEANIT

SEQ ID NO: 1000141 - protein, 9 aa, Homo Sapiens
PSDLEELER

SEQ ID NO: 1000142 - protein, 9 aa, Homo Sapiens
CQGHWSPAR

SEQ ID NO: 1000143 - protein, 9 aa, Homo Sapiens
MKWRELEGS

SEQ ID NO: 1000144 - protein, 9 aa, Homo Sapiens
GVSFPSSAP

SEQ ID NO: 1000145 - protein, 9 aa, Homo Sapiens
EKKISFPQW

SEQ ID NO: 1000146 - protein, 9 aa, Homo Sapiens
KKEESDAGS

SEQ ID NO: 1000147 - protein, 9 aa, Homo Sapiens
LLGCGFTFW

SEQ ID NO: 1000148 - protein, 9 aa, Homo Sapiens
QFSYQPNYG

SEQ ID NO: 1000149 - protein, 9 aa, Homo Sapiens
NYRIGPVEV

SEQ ID NO: 1000150 - protein, 9 aa, Homo Sapiens
FQKSNLHSY

SEQ ID NO: 1000151 - protein, 9 aa, Homo Sapiens
HLARSIVPQ

SEQ ID NO: 1000152 - protein, 9 aa, Homo Sapiens
VDRRRATTL

SEQ ID NO: 1000153 - protein, 9 aa, Homo Sapiens
GSCQNIFLS

SEQ ID NO: 1000154 - protein, 9 aa, Homo Sapiens
KEWLAGMGF

SEQ ID NO: 1000155 - protein, 9 aa, Homo Sapiens
QLEDKFSGQ

SEQ ID NO: 1000156 - protein, 9 aa, Homo Sapiens
SSKPPPAAS

SEQ ID NO: 1000157 - protein, 9 aa, Homo Sapiens
KPEKKPKFR

SEQ ID NO: 1000158 - protein, 9 aa, Homo Sapiens
RPTGDFGFF

SEQ ID NO: 1000159 - protein, 9 aa, Homo Sapiens
TPIGMPPLG

SEQ ID NO: 1000160 - protein, 9 aa, Homo Sapiens
EHFEVNPSV

SEQ ID NO: 1000161 - protein, 9 aa, Homo Sapiens
YKEVTPYRR

SEQ ID NO: 1000162 - protein, 9 aa, Homo Sapiens
PTPPASQLL

SEQ ID NO: 1000163 - protein, 9 aa, Homo Sapiens
KERLEEEAV

SEQ ID NO: 1000164 - protein, 9 aa, Homo Sapiens
VYLLQPTQR

SEQ ID NO: 1000165 - protein, 9 aa, Homo Sapiens
TTSSRKSFK

SEQ ID NO: 1000166 - protein, 9 aa, Homo Sapiens
FNNSSKFSA

SEQ ID NO: 1000167 - protein, 9 aa, Homo Sapiens
GKRRELKAV

SEQ ID NO: 1000168 - protein, 9 aa, Homo Sapiens
PAWTSLGIT

SEQ ID NO: 1000169 - protein, 9 aa, Homo Sapiens
VKSVFMVAI

SEQ ID NO: 1000170 - protein, 9 aa, Homo Sapiens
RCMGYCAEA

SEQ ID NO: 1000171 - protein, 9 aa, Homo Sapiens
FSDFHSYIQ

SEQ ID NO: 1000172 - protein, 9 aa, Homo Sapiens
EENQLTKLH

SEQ ID NO: 1000173 - protein, 9 aa, Homo Sapiens
VQRQKLIAS

SEQ ID NO: 1000174 - protein, 9 aa, Homo Sapiens
GSMDCHRAL

SEQ ID NO: 1000175 - protein, 9 aa, Homo Sapiens
TCFAKQHLD

SEQ ID NO: 1000176 - protein, 9 aa, Homo Sapiens
LSISPTAPG

SEQ ID NO: 1000177 - protein, 9 aa, Homo Sapiens
DYKPPYAPP

SEQ ID NO: 1000178 - protein, 9 aa, Homo Sapiens
SVLYGCTVL

SEQ ID NO: 1000179 - protein, 9 aa, Homo Sapiens
ENYQASTDT

SEQ ID NO: 1000180 - protein, 9 aa, Homo Sapiens
KKEEDEDYP

SEQ ID NO: 1000181 - protein, 9 aa, Homo Sapiens
KVVAAAGQE

SEQ ID NO: 1000182 - protein, 9 aa, Homo Sapiens
EAPSKQCAS

SEQ ID NO: 1000183 - protein, 9 aa, Homo Sapiens
SPYGILAAS

SEQ ID NO: 1000184 - protein, 9 aa, Homo Sapiens
GEEFEVLEY

SEQ ID NO: 1000185 - protein, 9 aa, Homo Sapiens
QAPISTVKS

SEQ ID NO: 1000186 - protein, 9 aa, Homo Sapiens
AVSKPDLDS

SEQ ID NO: 1000187 - protein, 9 aa, Homo Sapiens
FLKEFPWLK

SEQ ID NO: 1000188 - protein, 9 aa, Homo Sapiens
RSRTQVWLY

SEQ ID NO: 1000189 - protein, 9 aa, Homo Sapiens
LWERQKFFE

SEQ ID NO: 1000190 - protein, 9 aa, Homo Sapiens
SIFEQTYEV

SEQ ID NO: 1000191 - protein, 9 aa, Homo Sapiens
PGPPGSMDC

SEQ ID NO: 1000192 - protein, 9 aa, Homo Sapiens
QEEIPQGFC

SEQ ID NO: 1000193 - protein, 9 aa, Homo Sapiens
FKHIRSREV

SEQ ID NO: 1000194 - protein, 9 aa, Homo Sapiens
RSLAIMRNG

SEQ ID NO: 1000195 - protein, 9 aa, Homo Sapiens
DQWTDKKKA

SEQ ID NO: 1000196 - protein, 9 aa, Homo Sapiens
KEDAGVECS

SEQ ID NO: 1000197 - protein, 9 aa, Homo Sapiens
SIPKVLTEL

SEQ ID NO: 1000198 - protein, 9 aa, Homo Sapiens
DKFERSSNL

SEQ ID NO: 1000199 - protein, 9 aa, Homo Sapiens
KKCAKCRLL

SEQ ID NO: 1000200 - protein, 9 aa, Homo Sapiens
LELEFVGSA

SEQ ID NO: 1000201 - protein, 9 aa, Homo Sapiens
GRHKPTGPW

SEQ ID NO: 1000202 - protein, 9 aa, Homo Sapiens
DHSATQHLT

SEQ ID NO: 1000203 - protein, 9 aa, Homo Sapiens
GFLSIAPVI

SEQ ID NO: 1000204 - protein, 9 aa, Homo Sapiens
LDVMVAVGE

SEQ ID NO: 1000205 - protein, 9 aa, Homo Sapiens
FTLIGNLLI

SEQ ID NO: 1000206 - protein, 9 aa, Homo Sapiens
LRLWERQKF

SEQ ID NO: 1000207 - protein, 9 aa, Homo Sapiens
RCRSCDCHE

SEQ ID NO: 1000208 - protein, 9 aa, Homo Sapiens
KNAAPSSRF

SEQ ID NO: 1000209 - protein, 9 aa, Homo Sapiens
STLTFNIPF

SEQ ID NO: 1000210 - protein, 9 aa, Homo Sapiens
QGKVSANNG

SEQ ID NO: 1000211 - protein, 9 aa, Homo Sapiens
VGPEDELLD

SEQ ID NO: 1000212 - protein, 9 aa, Homo Sapiens
DQELEKDIE

SEQ ID NO: 1000213 - protein, 9 aa, Homo Sapiens
YCAESFNQK

SEQ ID NO: 1000214 - protein, 9 aa, Homo Sapiens
TENYSEDEQ

SEQ ID NO: 1000215 - protein, 9 aa, Homo Sapiens
ILETVPLST

SEQ ID NO: 1000216 - protein, 9 aa, Homo Sapiens
TTFTTILPD

SEQ ID NO: 1000217 - protein, 9 aa, Homo Sapiens
DANTIFKGN

SEQ ID NO: 1000218 - protein, 9 aa, Homo Sapiens
RSLLFEDEL

SEQ ID NO: 1000219 - protein, 9 aa, Homo Sapiens
GVFVLHGNR

SEQ ID NO: 1000220 - protein, 9 aa, Homo Sapiens
NGHISGDSF

SEQ ID NO: 1000221 - protein, 9 aa, Homo Sapiens
FSLADHLNS

SEQ ID NO: 1000222 - protein, 9 aa, Homo Sapiens
SQDMQAAVR

SEQ ID NO: 1000223 - protein, 9 aa, Homo Sapiens
EEPFNIWGT

SEQ ID NO: 1000224 - protein, 9 aa, Homo Sapiens
AQTAGVSRQ

SEQ ID NO: 1000225 - protein, 9 aa, Homo Sapiens
CASIFEKCH

SEQ ID NO: 1000226 - protein, 9 aa, Homo Sapiens
IIKNLRKRR

SEQ ID NO: 1000227 - protein, 9 aa, Homo Sapiens
CLTDTEAEK

SEQ ID NO: 1000228 - protein, 9 aa, Homo Sapiens
MFINEAEGN

SEQ ID NO: 1000229 - protein, 9 aa, Homo Sapiens
KAEKTCAPS

SEQ ID NO: 1000230 - protein, 9 aa, Homo Sapiens
ANPAFRIDK

SEQ ID NO: 1000231 - protein, 9 aa, Homo Sapiens
TKYYILIGF

SEQ ID NO: 1000232 - protein, 9 aa, Homo Sapiens
GVFIKLIIF

SEQ ID NO: 1000233 - protein, 9 aa, Homo Sapiens
LRKLQVDVK

SEQ ID NO: 1000234 - protein, 9 aa, Homo Sapiens
FVPFQDFKD

SEQ ID NO: 1000235 - protein, 9 aa, Homo Sapiens
NKERYYGYT

SEQ ID NO: 1000236 - protein, 9 aa, Homo Sapiens
VCNSWFECV

SEQ ID NO: 1000237 - protein, 9 aa, Homo Sapiens
VPSDQSSSV

SEQ ID NO: 1000238 - protein, 9 aa, Homo Sapiens
RVIGGGLSS

SEQ ID NO: 1000239 - protein, 9 aa, Homo Sapiens
ATKYYILIG

SEQ ID NO: 1000240 - protein, 9 aa, Homo Sapiens
ESVLYGCTV

SEQ ID NO: 1000241 - protein, 9 aa, Homo Sapiens
TGDQVAKGN

SEQ ID NO: 1000242 - protein, 9 aa, Homo Sapiens
TGVISTTKE

SEQ ID NO: 1000243 - protein, 9 aa, Homo Sapiens
TSSTFQLNE

SEQ ID NO: 1000244 - protein, 9 aa, Homo Sapiens
TCIEKSYKF

SEQ ID NO: 1000245 - protein, 9 aa, Homo Sapiens
LSEVDLTVL

SEQ ID NO: 1000246 - protein, 9 aa, Homo Sapiens
PFVLEAHDQ

SEQ ID NO: 1000247 - protein, 9 aa, Homo Sapiens
SNSNGRNSE

SEQ ID NO: 1000248 - protein, 9 aa, Homo Sapiens
LEEEVAREE

SEQ ID NO: 1000249 - protein, 9 aa, Homo Sapiens
ECLDTSMDS

SEQ ID NO: 1000250 - protein, 9 aa, Homo Sapiens
AAELAQSLA

SEQ ID NO: 1000251 - protein, 9 aa, Homo Sapiens
AAAAELAQS

SEQ ID NO: 1000252 - protein, 9 aa, Homo Sapiens
AGHSRWHIF

SEQ ID NO: 1000253 - protein, 9 aa, Homo Sapiens
EKSYDILSG

SEQ ID NO: 1000254 - protein, 9 aa, Homo Sapiens
GKDCSLPVG

SEQ ID NO: 1000255 - protein, 9 aa, Homo Sapiens
RRELLRKLQ

SEQ ID NO: 1000256 - protein, 9 aa, Homo Sapiens
GPRGGSPVQ

SEQ ID NO: 1000257 - protein, 9 aa, Homo Sapiens
SWAYQFPYA

SEQ ID NO: 1000258 - protein, 9 aa, Homo Sapiens
KILASSLVF

SEQ ID NO: 1000259 - protein, 9 aa, Homo Sapiens
KAFKQSSHF

SEQ ID NO: 1000260 - protein, 9 aa, Homo Sapiens
EEGSSGSSA

SEQ ID NO: 1000261 - protein, 9 aa, Homo Sapiens
LAWSTSMPQ

SEQ ID NO: 1000262 - protein, 9 aa, Homo Sapiens
GPEYWDLNV

SEQ ID NO: 1000263 - protein, 9 aa, Homo Sapiens
CLNVKYDKD

SEQ ID NO: 1000264 - protein, 9 aa, Homo Sapiens
TQRCMGYCA

SEQ ID NO: 1000265 - protein, 9 aa, Homo Sapiens
RCDQAALMI

SEQ ID NO: 1000266 - protein, 9 aa, Homo Sapiens
AELLLLNRA

SEQ ID NO: 1000267 - protein, 9 aa, Homo Sapiens
DLKADEPLS

SEQ ID NO: 1000268 - protein, 9 aa, Homo Sapiens
LLISGTQPE

SEQ ID NO: 1000269 - protein, 9 aa, Homo Sapiens
KKHAHQIQM

SEQ ID NO: 1000270 - protein, 9 aa, Homo Sapiens
GKWSISGSE

SEQ ID NO: 1000271 - protein, 9 aa, Homo Sapiens
EAHLRFFEA

SEQ ID NO: 1000272 - protein, 9 aa, Homo Sapiens
KDIEADQTT

SEQ ID NO: 1000273 - protein, 9 aa, Homo Sapiens
MSSVSPAGP

SEQ ID NO: 1000274 - protein, 9 aa, Homo Sapiens
IYCAESFNQ

SEQ ID NO: 1000275 - protein, 9 aa, Homo Sapiens
VLAGSLYEY

SEQ ID NO: 1000276 - protein, 9 aa, Homo Sapiens
SYNVDSLYQ

SEQ ID NO: 1000277 - protein, 9 aa, Homo Sapiens
AKRKATRMY

SEQ ID NO: 1000278 - protein, 9 aa, Homo Sapiens
HGDCMTVQQ

SEQ ID NO: 1000279 - protein, 9 aa, Homo Sapiens
LLLQERSNL

SEQ ID NO: 1000280 - protein, 9 aa, Homo Sapiens
HFGEELYDF

SEQ ID NO: 1000281 - protein, 9 aa, Homo Sapiens
LLKYKEKIE

SEQ ID NO: 1000282 - protein, 9 aa, Homo Sapiens
FNISDGQFT

SEQ ID NO: 1000283 - protein, 9 aa, Homo Sapiens
APLSHGFKE

SEQ ID NO: 1000284 - protein, 9 aa, Homo Sapiens
GRVIGGGLS

SEQ ID NO: 1000285 - protein, 9 aa, Homo Sapiens
KWSISGSEA

SEQ ID NO: 1000286 - protein, 9 aa, Homo Sapiens
LLLTLTLAG

SEQ ID NO: 1000287 - protein, 9 aa, Homo Sapiens
KGNIWKQIL

SEQ ID NO: 1000288 - protein, 9 aa, Homo Sapiens
KGHVTFYKT

SEQ ID NO: 1000289 - protein, 9 aa, Homo Sapiens
HPTASLIAM

SEQ ID NO: 1000290 - protein, 9 aa, Homo Sapiens
RAIGLHLWA

SEQ ID NO: 1000291 - protein, 9 aa, Homo Sapiens
NDDVINSSN

SEQ ID NO: 1000292 - protein, 9 aa, Homo Sapiens
LPFSPLAEQ

SEQ ID NO: 1000293 - protein, 9 aa, Homo Sapiens
SIIVRLPSL

SEQ ID NO: 1000294 - protein, 9 aa, Homo Sapiens
SSLSAYLPT

SEQ ID NO: 1000295 - protein, 9 aa, Homo Sapiens
LIDQVNSNW

SEQ ID NO: 1000296 - protein, 9 aa, Homo Sapiens
AAPPPLTKP

SEQ ID NO: 1000297 - protein, 9 aa, Homo Sapiens
GYEAKMSSK

SEQ ID NO: 1000298 - protein, 9 aa, Homo Sapiens
GQPTVLQPN

SEQ ID NO: 1000299 - protein, 9 aa, Homo Sapiens
IWMNSTRHE

SEQ ID NO: 1000300 - protein, 9 aa, Homo Sapiens
ANDNLFGPS

SEQ ID NO: 1000301 - protein, 9 aa, Homo Sapiens
ELVPGKAQV

SEQ ID NO: 1000302 - protein, 9 aa, Homo Sapiens
AKLKVKHCT

SEQ ID NO: 1000303 - protein, 9 aa, Homo Sapiens
NQRWVQLRV

SEQ ID NO: 1000304 - protein, 9 aa, Homo Sapiens
YWCSEDNCT

SEQ ID NO: 1000305 - protein, 9 aa, Homo Sapiens
DLDKACRRP

SEQ ID NO: 1000306 - protein, 9 aa, Homo Sapiens
TEARKAQRK

SEQ ID NO: 1000307 - protein, 9 aa, Homo Sapiens
GFNFTAPSV

SEQ ID NO: 1000308 - protein, 9 aa, Homo Sapiens
GVVYRSLLF

SEQ ID NO: 1000309 - protein, 9 aa, Homo Sapiens
LKNSGLTEK

SEQ ID NO: 1000310 - protein, 9 aa, Homo Sapiens
FDEDDSFTD

SEQ ID NO: 1000311 - protein, 9 aa, Homo Sapiens
SDRKFFKMN

SEQ ID NO: 1000312 - protein, 9 aa, Homo Sapiens
LNHLKNKVQ

SEQ ID NO: 1000313 - protein, 9 aa, Homo Sapiens
FSVLRAENE

SEQ ID NO: 1000314 - protein, 9 aa, Homo Sapiens
ELVRNGAES

SEQ ID NO: 1000315 - protein, 9 aa, Homo Sapiens
SDDEQKVAS

SEQ ID NO: 1000316 - protein, 9 aa, Homo Sapiens
IAMVATAQD

SEQ ID NO: 1000317 - protein, 9 aa, Homo Sapiens
LSEHVSHDP

SEQ ID NO: 1000318 - protein, 9 aa, Homo Sapiens
PRLKGLRLK

SEQ ID NO: 1000319 - protein, 9 aa, Homo Sapiens
NRYSDRNHQ

SEQ ID NO: 1000320 - protein, 9 aa, Homo Sapiens
NYSEGWHIF

SEQ ID NO: 1000321 - protein, 9 aa, Homo Sapiens
KSEVRSLFE

SEQ ID NO: 1000322 - protein, 9 aa, Homo Sapiens
AGQASFEGE

SEQ ID NO: 1000323 - protein, 9 aa, Homo Sapiens
LVCHNHHNH

SEQ ID NO: 1000324 - protein, 9 aa, Homo Sapiens
SVLLLQERS

SEQ ID NO: 1000325 - protein, 9 aa, Homo Sapiens
CFYQMERMF

SEQ ID NO: 1000326 - protein, 9 aa, Homo Sapiens
SKQCGKFLR

SEQ ID NO: 1000327 - protein, 9 aa, Homo Sapiens
PGPGPGSGP

SEQ ID NO: 1000328 - protein, 9 aa, Homo Sapiens
VGVLLQRAE

SEQ ID NO: 1000329 - protein, 9 aa, Homo Sapiens
YKVTVKVIA

SEQ ID NO: 1000330 - protein, 9 aa, Homo Sapiens
SMRKDHSLP

SEQ ID NO: 1000331 - protein, 9 aa, Homo Sapiens
YFIKTAQPY

SEQ ID NO: 1000332 - protein, 9 aa, Homo Sapiens
EKPCRCSKC

SEQ ID NO: 1000333 - protein, 9 aa, Homo Sapiens
PEKKISFPQ

SEQ ID NO: 1000334 - protein, 9 aa, Homo Sapiens
EFIQCQLIE

SEQ ID NO: 1000335 - protein, 9 aa, Homo Sapiens
NKTTGLYSL

SEQ ID NO: 1000336 - protein, 9 aa, Homo Sapiens
GVGVATYNR

SEQ ID NO: 1000337 - protein, 9 aa, Homo Sapiens
KRFNNSSKF

SEQ ID NO: 1000338 - protein, 9 aa, Homo Sapiens
WGALSIMRS

SEQ ID NO: 1000339 - protein, 9 aa, Homo Sapiens
PDSPVTPMK

SEQ ID NO: 1000340 - protein, 9 aa, Homo Sapiens
LAEYIRNDY

SEQ ID NO: 1000341 - protein, 9 aa, Homo Sapiens
DPVSYEWTD

SEQ ID NO: 1000342 - protein, 9 aa, Homo Sapiens
YQEVTPRPF

SEQ ID NO: 1000343 - protein, 9 aa, Homo Sapiens
LLHDISESK

SEQ ID NO: 1000344 - protein, 9 aa, Homo Sapiens
KALTRVVLG

SEQ ID NO: 1000345 - protein, 9 aa, Homo Sapiens
KEREREREA

SEQ ID NO: 1000346 - protein, 9 aa, Homo Sapiens
TFFGMSSFN

SEQ ID NO: 1000347 - protein, 9 aa, Homo Sapiens
ICTKKFKFR

SEQ ID NO: 1000348 - protein, 9 aa, Homo Sapiens
GPTLDVLVS

SEQ ID NO: 1000349 - protein, 9 aa, Homo Sapiens
GAMENWDLI

SEQ ID NO: 1000350 - protein, 9 aa, Homo Sapiens
RPLTPLADR

SEQ ID NO: 1000351 - protein, 9 aa, Homo Sapiens
VAVADSIPK

SEQ ID NO: 1000352 - protein, 9 aa, Homo Sapiens
LCCKKGSIG

SEQ ID NO: 1000353 - protein, 9 aa, Homo Sapiens
DEDDDIKLR

SEQ ID NO: 1000354 - protein, 9 aa, Homo Sapiens
ADFLGLSAN

SEQ ID NO: 1000355 - protein, 9 aa, Homo Sapiens
SMDHLDKQA

SEQ ID NO: 1000356 - protein, 9 aa, Homo Sapiens
DKVLIVRST

SEQ ID NO: 1000357 - protein, 9 aa, Homo Sapiens
VRIAIKKIP

SEQ ID NO: 1000358 - protein, 9 aa, Homo Sapiens
LRELHLDSN

SEQ ID NO: 1000359 - protein, 9 aa, Homo Sapiens
HRRPARRSV

SEQ ID NO: 1000360 - protein, 9 aa, Homo Sapiens
KVEVNGFAT

SEQ ID NO: 1000361 - protein, 9 aa, Homo Sapiens
DHCYRHFPD

SEQ ID NO: 1000362 - protein, 9 aa, Homo Sapiens
NKSDFWDFK

SEQ ID NO: 1000363 - protein, 9 aa, Homo Sapiens
DSIPKVLTE

SEQ ID NO: 1000364 - protein, 9 aa, Homo Sapiens
QESLKERGV

SEQ ID NO: 1000365 - protein, 9 aa, Homo Sapiens
DQDPEQSTE

SEQ ID NO: 1000366 - protein, 9 aa, Homo Sapiens
LQEGATRGH

SEQ ID NO: 1000367 - protein, 9 aa, Homo Sapiens
EKVEVNGFA

SEQ ID NO: 1000368 - protein, 9 aa, Homo Sapiens
KRVAMKEAL

SEQ ID NO: 1000369 - protein, 9 aa, Homo Sapiens
PPLPSSSDT

SEQ ID NO: 1000370 - protein, 9 aa, Homo Sapiens
VGVATYNRF

SEQ ID NO: 1000371 - protein, 9 aa, Homo Sapiens
AIKLKKHPI

SEQ ID NO: 1000372 - protein, 9 aa, Homo Sapiens
FESGHNINV

SEQ ID NO: 1000373 - protein, 9 aa, Homo Sapiens
KPVSSEIYN

SEQ ID NO: 1000374 - protein, 9 aa, Homo Sapiens
GRKKSSQEL

SEQ ID NO: 1000375 - protein, 9 aa, Homo Sapiens
IGLHLWAAG

SEQ ID NO: 1000376 - protein, 9 aa, Homo Sapiens
KNQSYLIAY

SEQ ID NO: 1000377 - protein, 9 aa, Homo Sapiens
IEPRYHIRR

SEQ ID NO: 1000378 - protein, 9 aa, Homo Sapiens
TYEVKYTGK

SEQ ID NO: 1000379 - protein, 9 aa, Homo Sapiens
YKFIFVLSP

SEQ ID NO: 1000380 - protein, 9 aa, Homo Sapiens
KNEYSLWTA

SEQ ID NO: 1000381 - protein, 9 aa, Homo Sapiens
VWKHFSGGL

SEQ ID NO: 1000382 - protein, 9 aa, Homo Sapiens
SGSQGIFLL

SEQ ID NO: 1000383 - protein, 9 aa, Homo Sapiens
GCDDNYYIF

SEQ ID NO: 1000384 - protein, 9 aa, Homo Sapiens
IMQMPQYQG

SEQ ID NO: 1000385 - protein, 9 aa, Homo Sapiens
LDAKESNHL

SEQ ID NO: 1000386 - protein, 9 aa, Homo Sapiens
DEEGADAVP

SEQ ID NO: 1000387 - protein, 9 aa, Homo Sapiens
ETLAKRRSF

SEQ ID NO: 1000388 - protein, 9 aa, Homo Sapiens
LKLPLDRIV

SEQ ID NO: 1000389 - protein, 9 aa, Homo Sapiens
LRLVHLEEN

SEQ ID NO: 1000390 - protein, 9 aa, Homo Sapiens
TPFSMSCDL

SEQ ID NO: 1000391 - protein, 9 aa, Homo Sapiens
NRALDCEEQ

SEQ ID NO: 1000392 - protein, 9 aa, Homo Sapiens
YSKEKEYVQ

SEQ ID NO: 1000393 - protein, 9 aa, Homo Sapiens
WCRSSGLPN

SEQ ID NO: 1000394 - protein, 9 aa, Homo Sapiens
SPSSNETPA

SEQ ID NO: 1000395 - protein, 9 aa, Homo Sapiens
AEKDDGQEA

SEQ ID NO: 1000396 - protein, 9 aa, Homo Sapiens
DMLRKHMKF

SEQ ID NO: 1000397 - protein, 9 aa, Homo Sapiens
TVVPRFSVC

SEQ ID NO: 1000398 - protein, 9 aa, Homo Sapiens
SHFIQDLLP

SEQ ID NO: 1000399 - protein, 9 aa, Homo Sapiens
QFSSTQPEL

SEQ ID NO: 1000400 - protein, 9 aa, Homo Sapiens
YKPPYAPPS

SEQ ID NO: 1000401 - protein, 9 aa, Homo Sapiens
REVVNRQMM

SEQ ID NO: 1000402 - protein, 9 aa, Homo Sapiens
MLRKHMKFR

SEQ ID NO: 1000403 - protein, 9 aa, Homo Sapiens
PEYWDLNVY

SEQ ID NO: 1000404 - protein, 9 aa, Homo Sapiens
ISSLGRLLS

SEQ ID NO: 1000405 - protein, 9 aa, Homo Sapiens
EEAELVRNG

SEQ ID NO: 1000406 - protein, 9 aa, Homo Sapiens
RIIKAESNL

SEQ ID NO: 1000407 - protein, 9 aa, Homo Sapiens
ISIFEQTYE

SEQ ID NO: 1000408 - protein, 9 aa, Homo Sapiens
EILLGCGFT

SEQ ID NO: 1000409 - protein, 9 aa, Homo Sapiens
EPRGPPGEK

SEQ ID NO: 1000410 - protein, 9 aa, Homo Sapiens
DNSRDFGNK

SEQ ID NO: 1000411 - protein, 9 aa, Homo Sapiens
GVNSCTAYR

SEQ ID NO: 1000412 - protein, 9 aa, Homo Sapiens
DYSVGVLLQ

SEQ ID NO: 1000413 - protein, 9 aa, Homo Sapiens
LPCNLCSTS

SEQ ID NO: 1000414 - protein, 9 aa, Homo Sapiens
VLVSFSFND

SEQ ID NO: 1000415 - protein, 9 aa, Homo Sapiens
QVTHSNNKT

SEQ ID NO: 1000416 - protein, 9 aa, Homo Sapiens
KVLTELGSL

SEQ ID NO: 1000417 - protein, 9 aa, Homo Sapiens
FVMGTSEKK

SEQ ID NO: 1000418 - protein, 9 aa, Homo Sapiens
KSENVDSAE

SEQ ID NO: 1000419 - protein, 9 aa, Homo Sapiens
CFSPQQENR

SEQ ID NO: 1000420 - protein, 9 aa, Homo Sapiens
LKEFPWLKS

SEQ ID NO: 1000421 - protein, 9 aa, Homo Sapiens
SPDTQLGNH

SEQ ID NO: 1000422 - protein, 9 aa, Homo Sapiens
TIQRYLAFD

SEQ ID NO: 1000423 - protein, 9 aa, Homo Sapiens
DSDEVDCIS

SEQ ID NO: 1000424 - protein, 9 aa, Homo Sapiens
CTCGDCPDS

SEQ ID NO: 1000425 - protein, 9 aa, Homo Sapiens
VISTTKELD

SEQ ID NO: 1000426 - protein, 9 aa, Homo Sapiens
YECSECEKL

SEQ ID NO: 1000427 - protein, 9 aa, Homo Sapiens
GWTCVPEYQ

SEQ ID NO: 1000428 - protein, 9 aa, Homo Sapiens
IITDYNKEG

SEQ ID NO: 1000429 - protein, 9 aa, Homo Sapiens
RPQTQGKDC

SEQ ID NO: 1000430 - protein, 9 aa, Homo Sapiens
DKFSGQSSF

SEQ ID NO: 1000431 - protein, 9 aa, Homo Sapiens
DFTPATCLK

SEQ ID NO: 1000432 - protein, 9 aa, Homo Sapiens
YARPFDSFF

SEQ ID NO: 1000433 - protein, 9 aa, Homo Sapiens
MLEERLVSM

SEQ ID NO: 1000434 - protein, 9 aa, Homo Sapiens
MGTSEKKTS

SEQ ID NO: 1000435 - protein, 9 aa, Homo Sapiens
HTIITLTNL

SEQ ID NO: 1000436 - protein, 9 aa, Homo Sapiens
TQGKDCSLP

SEQ ID NO: 1000437 - protein, 9 aa, Homo Sapiens
MDILRKRDQ

SEQ ID NO: 1000438 - protein, 9 aa, Homo Sapiens
SNANLKKIP

SEQ ID NO: 1000439 - protein, 9 aa, Homo Sapiens
ADSYKDAVW

SEQ ID NO: 1000440 - protein, 9 aa, Homo Sapiens
NELSDHLNA

SEQ ID NO: 1000441 - protein, 9 aa, Homo Sapiens
KKVEKFKIF

SEQ ID NO: 1000442 - protein, 9 aa, Homo Sapiens
CHMSLLDIS

SEQ ID NO: 1000443 - protein, 9 aa, Homo Sapiens
IPPPFSPMG

SEQ ID NO: 1000444 - protein, 9 aa, Homo Sapiens
TILPDDSCP

SEQ ID NO: 1000445 - protein, 9 aa, Homo Sapiens
QEEGAFGHN

SEQ ID NO: 1000446 - protein, 9 aa, Homo Sapiens
LLSISPTAP

SEQ ID NO: 1000447 - protein, 9 aa, Homo Sapiens
VPFLASTSP

SEQ ID NO: 1000448 - protein, 9 aa, Homo Sapiens
VFFSTPKIY

SEQ ID NO: 1000449 - protein, 9 aa, Homo Sapiens
AELRKAPVM

SEQ ID NO: 1000450 - protein, 9 aa, Homo Sapiens
IFFCPALPA

SEQ ID NO: 1000451 - protein, 9 aa, Homo Sapiens
QKSVTVQED

SEQ ID NO: 1000452 - protein, 9 aa, Homo Sapiens
EAPISAEPG

SEQ ID NO: 1000453 - protein, 9 aa, Homo Sapiens
NIKLKGKSD

SEQ ID NO: 1000454 - protein, 9 aa, Homo Sapiens
LVLTTFDPA

SEQ ID NO: 1000455 - protein, 9 aa, Homo Sapiens
IFEQTYEVK

SEQ ID NO: 1000456 - protein, 9 aa, Homo Sapiens
GEELYDFNQ

SEQ ID NO: 1000457 - protein, 9 aa, Homo Sapiens
TSSQAPSLL

SEQ ID NO: 1000458 - protein, 9 aa, Homo Sapiens
EIFTRPCLA

SEQ ID NO: 1000459 - protein, 9 aa, Homo Sapiens
SPNQSNQGS

SEQ ID NO: 1000460 - protein, 9 aa, Homo Sapiens
KEFPWLKSE

SEQ ID NO: 1000461 - protein, 9 aa, Homo Sapiens
WAELSLATQ

SEQ ID NO: 1000462 - protein, 9 aa, Homo Sapiens
RKKTESVLY

SEQ ID NO: 1000463 - protein, 9 aa, Homo Sapiens
VPEEKAKSL

SEQ ID NO: 1000464 - protein, 9 aa, Homo Sapiens
KVKAKNAQT

SEQ ID NO: 1000465 - protein, 9 aa, Homo Sapiens
LSVEDKDHM

SEQ ID NO: 1000466 - protein, 9 aa, Homo Sapiens
KISHLRTAT

SEQ ID NO: 1000467 - protein, 9 aa, Homo Sapiens
NKERLEEEA

SEQ ID NO: 1000468 - protein, 9 aa, Homo Sapiens
RPFNQQLPK

SEQ ID NO: 1000469 - protein, 9 aa, Homo Sapiens
VVDLITTCY

SEQ ID NO: 1000470 - protein, 9 aa, Homo Sapiens
PGGTSGSRE

SEQ ID NO: 1000471 - protein, 9 aa, Homo Sapiens
KYHKKIHTG

SEQ ID NO: 1000472 - protein, 9 aa, Homo Sapiens
LTYCNLTFW

SEQ ID NO: 1000473 - protein, 9 aa, Homo Sapiens
VLLEEEERS

SEQ ID NO: 1000474 - protein, 9 aa, Homo Sapiens
FNSDLANLG

SEQ ID NO: 1000475 - protein, 9 aa, Homo Sapiens
ASTSPLLPP

SEQ ID NO: 1000476 - protein, 9 aa, Homo Sapiens
IKKANDTSN

SEQ ID NO: 1000477 - protein, 9 aa, Homo Sapiens
RFWRSPNSG

SEQ ID NO: 1000478 - protein, 9 aa, Homo Sapiens
SSHIGNFTQ

SEQ ID NO: 1000479 - protein, 9 aa, Homo Sapiens
MRHLGDGTY

SEQ ID NO: 1000480 - protein, 9 aa, Homo Sapiens
TWSTSSKKT

SEQ ID NO: 1000481 - protein, 9 aa, Homo Sapiens
MRKDHSLPW

SEQ ID NO: 1000482 - protein, 9 aa, Homo Sapiens
LSSGKHYWK

SEQ ID NO: 1000483 - protein, 9 aa, Homo Sapiens
KQCGKFLRN

SEQ ID NO: 1000484 - protein, 9 aa, Homo Sapiens
GAWWYANCH

SEQ ID NO: 1000485 - protein, 9 aa, Homo Sapiens
GTSGSREGV

SEQ ID NO: 1000486 - protein, 9 aa, Homo Sapiens
GDKLSEHFE

SEQ ID NO: 1000487 - protein, 9 aa, Homo Sapiens
KPHFVSNFN

SEQ ID NO: 1000488 - protein, 9 aa, Homo Sapiens
TSRAAAVYV

SEQ ID NO: 1000489 - protein, 9 aa, Homo Sapiens
YKWPSTLKY

SEQ ID NO: 1000490 - protein, 9 aa, Homo Sapiens
DPLLSVQTS

SEQ ID NO: 1000491 - protein, 9 aa, Homo Sapiens
DEPHSPNWN

SEQ ID NO: 1000492 - protein, 9 aa, Homo Sapiens
FLNCFEYNP

SEQ ID NO: 1000493 - protein, 9 aa, Homo Sapiens
AKVPLQALH

SEQ ID NO: 1000494 - protein, 9 aa, Homo Sapiens
HQLQGHLTH

SEQ ID NO: 1000495 - protein, 9 aa, Homo Sapiens
ALVPLEPIP

SEQ ID NO: 1000496 - protein, 9 aa, Homo Sapiens
LLWEVHRRP

SEQ ID NO: 1000497 - protein, 9 aa, Homo Sapiens
RSCDCHEAG

SEQ ID NO: 1000498 - protein, 9 aa, Homo Sapiens
NGELGKDVD

SEQ ID NO: 1000499 - protein, 9 aa, Homo Sapiens
WGHHDCSHK

SEQ ID NO: 1000500 - protein, 9 aa, Homo Sapiens
MAMSQELLT

SEQ ID NO: 1000501 - protein, 9 aa, Homo Sapiens
SYTVNWYYS

SEQ ID NO: 1000502 - protein, 9 aa, Homo Sapiens
EEIPQGFCR

SEQ ID NO: 1000503 - protein, 9 aa, Homo Sapiens
YTHLWKNVP

SEQ ID NO: 1000504 - protein, 9 aa, Homo Sapiens
PIYEVLRHT

SEQ ID NO: 1000505 - protein, 9 aa, Homo Sapiens
LNFESGHNI

SEQ ID NO: 1000506 - protein, 9 aa, Homo Sapiens
ENQLTKLHP

SEQ ID NO: 1000507 - protein, 9 aa, Homo Sapiens
FGLGSDGKS

SEQ ID NO: 1000508 - protein, 9 aa, Homo Sapiens
SAKAGVIFS

SEQ ID NO: 1000509 - protein, 9 aa, Homo Sapiens
GRGSCQNIF

SEQ ID NO: 1000510 - protein, 9 aa, Homo Sapiens
RIYVTAKKH

SEQ ID NO: 1000511 - protein, 9 aa, Homo Sapiens
FTGVISTTK

SEQ ID NO: 1000512 - protein, 9 aa, Homo Sapiens
HSATQHLTQ

SEQ ID NO: 1000513 - protein, 9 aa, Homo Sapiens
TFSNTSTLT

SEQ ID NO: 1000514 - protein, 9 aa, Homo Sapiens
EKLQQFFSH

SEQ ID NO: 1000515 - protein, 9 aa, Homo Sapiens
TIITLTNLS

SEQ ID NO: 1000516 - protein, 9 aa, Homo Sapiens
EESQQKNTS

SEQ ID NO: 1000517 - protein, 9 aa, Homo Sapiens
CMGGGNRDI

SEQ ID NO: 1000518 - protein, 9 aa, Homo Sapiens
KDAGRRHSW

SEQ ID NO: 1000519 - protein, 9 aa, Homo Sapiens
QKSNLHSYQ

SEQ ID NO: 1000520 - protein, 9 aa, Homo Sapiens
LNQYVNKRY

SEQ ID NO: 1000521 - protein, 9 aa, Homo Sapiens
VMSQRAIFF

SEQ ID NO: 1000522 - protein, 9 aa, Homo Sapiens
PFDSFFLDK

SEQ ID NO: 1000523 - protein, 9 aa, Homo Sapiens
WLAKIRLNP

SEQ ID NO: 1000524 - protein, 9 aa, Homo Sapiens
KSYKFIFVL

SEQ ID NO: 1000525 - protein, 9 aa, Homo Sapiens
KTDGGGWIV

SEQ ID NO: 1000526 - protein, 9 aa, Homo Sapiens
RKFVDQPEG

SEQ ID NO: 1000527 - protein, 9 aa, Homo Sapiens
LWRLLMAVG

SEQ ID NO: 1000528 - protein, 9 aa, Homo Sapiens
QEDVGFCGN

SEQ ID NO: 1000529 - protein, 9 aa, Homo Sapiens
HNKKKAHKI

SEQ ID NO: 1000530 - protein, 9 aa, Homo Sapiens
QVAKGNYGL

SEQ ID NO: 1000531 - protein, 9 aa, Homo Sapiens
SYCPNVIVT

SEQ ID NO: 1000532 - protein, 9 aa, Homo Sapiens
PASRLTFSF

SEQ ID NO: 1000533 - protein, 9 aa, Homo Sapiens
FETTTVSIT

SEQ ID NO: 1000534 - protein, 9 aa, Homo Sapiens
DLDSWTLRL

SEQ ID NO: 1000535 - protein, 9 aa, Homo Sapiens
SPDECLDTS

SEQ ID NO: 1000536 - protein, 9 aa, Homo Sapiens
LELLEPSGS

SEQ ID NO: 1000537 - protein, 9 aa, Homo Sapiens
NPSNGAELL

SEQ ID NO: 1000538 - protein, 9 aa, Homo Sapiens
PKKSKVPQS

SEQ ID NO: 1000539 - protein, 9 aa, Homo Sapiens
CNADYADLL

SEQ ID NO: 1000540 - protein, 9 aa, Homo Sapiens
PAFRIDKGQ

SEQ ID NO: 1000541 - protein, 9 aa, Homo Sapiens
PLLFHQWFL

SEQ ID NO: 1000542 - protein, 9 aa, Homo Sapiens
LTLRVSRAQ

SEQ ID NO: 1000543 - protein, 9 aa, Homo Sapiens
QLKRPRLVI

SEQ ID NO: 1000544 - protein, 9 aa, Homo Sapiens
KEGLLLQTA

SEQ ID NO: 1000545 - protein, 9 aa, Homo Sapiens
GLYFGASVC

SEQ ID NO: 1000546 - protein, 9 aa, Homo Sapiens
AERHILSAE

SEQ ID NO: 1000547 - protein, 9 aa, Homo Sapiens
NRDILCKAL

SEQ ID NO: 1000548 - protein, 9 aa, Homo Sapiens
GLLSRTHPP

SEQ ID NO: 1000549 - protein, 9 aa, Homo Sapiens
TNLSEHVSH

SEQ ID NO: 1000550 - protein, 9 aa, Homo Sapiens
KSIQIMRQY

SEQ ID NO: 1000551 - protein, 9 aa, Homo Sapiens
LAMVEKARR

SEQ ID NO: 1000552 - protein, 9 aa, Homo Sapiens
TLALPVASP

SEQ ID NO: 1000553 - protein, 9 aa, Homo Sapiens
GDSVEVGHV

SEQ ID NO: 1000554 - protein, 9 aa, Homo Sapiens
PKNCYANVI

SEQ ID NO: 1000555 - protein, 9 aa, Homo Sapiens
TPKKWPKKS

SEQ ID NO: 1000556 - protein, 9 aa, Homo Sapiens
LFPPAGNLV

SEQ ID NO: 1000557 - protein, 9 aa, Homo Sapiens
PRKKSKVAP

SEQ ID NO: 1000558 - protein, 9 aa, Homo Sapiens
KDDGQEAND

SEQ ID NO: 1000559 - protein, 9 aa, Homo Sapiens
QRADMKLRT

SEQ ID NO: 1000560 - protein, 9 aa, Homo Sapiens
CLESPYGIL

SEQ ID NO: 1000561 - protein, 9 aa, Homo Sapiens
NELIAIISS

SEQ ID NO: 1000562 - protein, 9 aa, Homo Sapiens
SPVTPMKEL

SEQ ID NO: 1000563 - protein, 9 aa, Homo Sapiens
DAPSHASSA

SEQ ID NO: 1000564 - protein, 9 aa, Homo Sapiens
LSLLKYFSS

SEQ ID NO: 1000565 - protein, 9 aa, Homo Sapiens
NWRPEVERP

SEQ ID NO: 1000566 - protein, 9 aa, Homo Sapiens
YATAPTQEK

SEQ ID NO: 1000567 - protein, 9 aa, Homo Sapiens
ALVLTTFDP

SEQ ID NO: 1000568 - protein, 9 aa, Homo Sapiens
DGKEIYLQK

SEQ ID NO: 1000569 - protein, 9 aa, Homo Sapiens
LKPHEEPLC

SEQ ID NO: 1000570 - protein, 9 aa, Homo Sapiens
AHPEAHLRF

SEQ ID NO: 1000571 - protein, 9 aa, Homo Sapiens
AASALGAGP

SEQ ID NO: 1000572 - protein, 9 aa, Homo Sapiens
GHNPHLHGC

SEQ ID NO: 1000573 - protein, 9 aa, Homo Sapiens
GKQTVRCRG

SEQ ID NO: 1000574 - protein, 9 aa, Homo Sapiens
CRRCYVKCH

SEQ ID NO: 1000575 - protein, 9 aa, Homo Sapiens
LKKLNLVNM

SEQ ID NO: 1000576 - protein, 9 aa, Homo Sapiens
LSRKPRLLQ

SEQ ID NO: 1000577 - protein, 9 aa, Homo Sapiens
SLQLQGRTD

SEQ ID NO: 1000578 - protein, 9 aa, Homo Sapiens
PSHGQPCQI

SEQ ID NO: 1000579 - protein, 9 aa, Homo Sapiens
KYLNDLIYS

SEQ ID NO: 1000580 - protein, 9 aa, Homo Sapiens
LKYFSSKMS

SEQ ID NO: 1000581 - protein, 9 aa, Homo Sapiens
EIFSADLVL

SEQ ID NO: 1000582 - protein, 9 aa, Homo Sapiens
GKKQELFFF

SEQ ID NO: 1000583 - protein, 9 aa, Homo Sapiens
ETPVARDVV

SEQ ID NO: 1000584 - protein, 9 aa, Homo Sapiens
AFLDAKESN

SEQ ID NO: 1000585 - protein, 9 aa, Homo Sapiens
DKDAGRRHS

SEQ ID NO: 1000586 - protein, 9 aa, Homo Sapiens
HNPKNQSYL

SEQ ID NO: 1000587 - protein, 9 aa, Homo Sapiens
ITNHGDLVF

SEQ ID NO: 1000588 - protein, 9 aa, Homo Sapiens
LIVEGRKEC

SEQ ID NO: 1000589 - protein, 9 aa, Homo Sapiens
PGPPRKDGL

SEQ ID NO: 1000590 - protein, 9 aa, Homo Sapiens
YQDHCYRHF

SEQ ID NO: 1000591 - protein, 9 aa, Homo Sapiens
EMSSHKALT

SEQ ID NO: 1000592 - protein, 9 aa, Homo Sapiens
QPVDLDKAC

SEQ ID NO: 1000593 - protein, 9 aa, Homo Sapiens
FLSKPSAYI

SEQ ID NO: 1000594 - protein, 9 aa, Homo Sapiens
GPAPPALRP

SEQ ID NO: 1000595 - protein, 9 aa, Homo Sapiens
AVLAGSLYE

SEQ ID NO: 1000596 - protein, 9 aa, Homo Sapiens
EDCKLPCNL

SEQ ID NO: 1000597 - protein, 9 aa, Homo Sapiens
IDDIELMFL

SEQ ID NO: 1000598 - protein, 9 aa, Homo Sapiens
KVPKPKSKF

SEQ ID NO: 1000599 - protein, 9 aa, Homo Sapiens
PCLRLSREL

SEQ ID NO: 1000600 - protein, 9 aa, Homo Sapiens
SGSREGVAL

SEQ ID NO: 1000601 - protein, 9 aa, Homo Sapiens
SSSKRKFSM

SEQ ID NO: 1000602 - protein, 9 aa, Homo Sapiens
TCSSSLSLP

SEQ ID NO: 1000603 - protein, 9 aa, Homo Sapiens
EIYLQKPEW

SEQ ID NO: 1000604 - protein, 9 aa, Homo Sapiens
VDDDHQQGT

SEQ ID NO: 1000605 - protein, 9 aa, Homo Sapiens
DMYSHVFRK

SEQ ID NO: 1000606 - protein, 9 aa, Homo Sapiens
HLTQPHRPS

SEQ ID NO: 1000607 - protein, 9 aa, Homo Sapiens
VEFMDVDQT

SEQ ID NO: 1000608 - protein, 9 aa, Homo Sapiens
KANDLFENG

SEQ ID NO: 1000609 - protein, 9 aa, Homo Sapiens
FTPLNRYSD

SEQ ID NO: 1000610 - protein, 9 aa, Homo Sapiens
VIYGSHFQG

SEQ ID NO: 1000611 - protein, 9 aa, Homo Sapiens
KERLRQHSK

SEQ ID NO: 1000612 - protein, 9 aa, Homo Sapiens
KYDQLVISP

SEQ ID NO: 1000613 - protein, 9 aa, Homo Sapiens
HRHDNGNFF

SEQ ID NO: 1000614 - protein, 9 aa, Homo Sapiens
TLGRKKFLL

SEQ ID NO: 1000615 - protein, 9 aa, Homo Sapiens
DPDKDFTPA

SEQ ID NO: 1000616 - protein, 9 aa, Homo Sapiens
FGETPALLK

SEQ ID NO: 1000617 - protein, 9 aa, Homo Sapiens
VSEASPGSS

SEQ ID NO: 1000618 - protein, 9 aa, Homo Sapiens
AMLYSRAVC

SEQ ID NO: 1000619 - protein, 9 aa, Homo Sapiens
STTPVNTSI

SEQ ID NO: 1000620 - protein, 9 aa, Homo Sapiens
FGFSQSPHR

SEQ ID NO: 1000621 - protein, 9 aa, Homo Sapiens
EYDKDNISP

SEQ ID NO: 1000622 - protein, 9 aa, Homo Sapiens
PWPLLMLQL

SEQ ID NO: 1000623 - protein, 9 aa, Homo Sapiens
AESEDNGRT

SEQ ID NO: 1000624 - protein, 9 aa, Homo Sapiens
LPSSSDTPE

SEQ ID NO: 1000625 - protein, 9 aa, Homo Sapiens
SEELIRLLK

SEQ ID NO: 1000626 - protein, 9 aa, Homo Sapiens
ACISWFGSP

SEQ ID NO: 1000627 - protein, 9 aa, Homo Sapiens
RHNYFIKTA

SEQ ID NO: 1000628 - protein, 9 aa, Homo Sapiens
EAKMSSKGA

SEQ ID NO: 1000629 - protein, 9 aa, Homo Sapiens
ALVEFIQCQ

SEQ ID NO: 1000630 - protein, 9 aa, Homo Sapiens
LVFKISHLR

SEQ ID NO: 1000631 - protein, 9 aa, Homo Sapiens
GKVSANNGE

SEQ ID NO: 1000632 - protein, 9 aa, Homo Sapiens
GSPVQYPYR

SEQ ID NO: 1000633 - protein, 9 aa, Homo Sapiens
RKTTDMEIR

SEQ ID NO: 1000634 - protein, 9 aa, Homo Sapiens
YLGFKQIYL

SEQ ID NO: 1000635 - protein, 9 aa, Homo Sapiens
HGQPCQIFL

SEQ ID NO: 1000636 - protein, 9 aa, Homo Sapiens
KPKRPNPAA

SEQ ID NO: 1000637 - protein, 9 aa, Homo Sapiens
LPDDSCPTV

SEQ ID NO: 1000638 - protein, 9 aa, Homo Sapiens
WTSLGITSV

SEQ ID NO: 1000639 - protein, 9 aa, Homo Sapiens
PPRRLVASS

SEQ ID NO: 1000640 - protein, 9 aa, Homo Sapiens
KTSATDIKG

SEQ ID NO: 1000641 - protein, 9 aa, Homo Sapiens
GDFGAPPVP

SEQ ID NO: 1000642 - protein, 9 aa, Homo Sapiens
PALVLAQVL

SEQ ID NO: 1000643 - protein, 9 aa, Homo Sapiens
GLSCCQSSC

SEQ ID NO: 1000644 - protein, 9 aa, Homo Sapiens
SPESLLLAG

SEQ ID NO: 1000645 - protein, 9 aa, Homo Sapiens
QVRIAIKKI

SEQ ID NO: 1000646 - protein, 9 aa, Homo Sapiens
ETSVSALVE

SEQ ID NO: 1000647 - protein, 9 aa, Homo Sapiens
LQGIHSWRT

SEQ ID NO: 1000648 - protein, 9 aa, Homo Sapiens
GCSGGCSRL

SEQ ID NO: 1000649 - protein, 9 aa, Homo Sapiens
SKFSAHRRI

SEQ ID NO: 1000650 - protein, 9 aa, Homo Sapiens
ERNEQLTRE

SEQ ID NO: 1000651 - protein, 9 aa, Homo Sapiens
LRDGEYVVE

SEQ ID NO: 1000652 - protein, 9 aa, Homo Sapiens
KVYLGEDLK

SEQ ID NO: 1000653 - protein, 9 aa, Homo Sapiens
MVAISPLEN

SEQ ID NO: 1000654 - protein, 9 aa, Homo Sapiens
SSGLPNRPY

SEQ ID NO: 1000655 - protein, 9 aa, Homo Sapiens
LTQRSDSQV

SEQ ID NO: 1000656 - protein, 9 aa, Homo Sapiens
CRVSTADQS

SEQ ID NO: 1000657 - protein, 9 aa, Homo Sapiens
SEDPEATMT

SEQ ID NO: 1000658 - protein, 9 aa, Homo Sapiens
ITDYNKEGL

SEQ ID NO: 1000659 - protein, 9 aa, Homo Sapiens
LMNHSYCPN

SEQ ID NO: 1000660 - protein, 9 aa, Homo Sapiens
DSAISGQTF

SEQ ID NO: 1000661 - protein, 9 aa, Homo Sapiens
GPVDKTGWV

SEQ ID NO: 1000662 - protein, 9 aa, Homo Sapiens
SNFRSLQPS

SEQ ID NO: 1000663 - protein, 9 aa, Homo Sapiens
HRVLEEEVA

SEQ ID NO: 1000664 - protein, 9 aa, Homo Sapiens
KKFLLVNNI

SEQ ID NO: 1000665 - protein, 9 aa, Homo Sapiens
FPVNTVKNV

SEQ ID NO: 1000666 - protein, 9 aa, Homo Sapiens
DNIVGKRGR

SEQ ID NO: 1000667 - protein, 9 aa, Homo Sapiens
ISPTYSCAY

SEQ ID NO: 1000668 - protein, 9 aa, Homo Sapiens
VILAWSTSM

SEQ ID NO: 1000669 - protein, 9 aa, Homo Sapiens
GVVCTSETR

SEQ ID NO: 1000670 - protein, 9 aa, Homo Sapiens
IYVTAKKHA

SEQ ID NO: 1000671 - protein, 9 aa, Homo Sapiens
HGQHESGTS

SEQ ID NO: 1000672 - protein, 9 aa, Homo Sapiens
FKGFLVLVF

SEQ ID NO: 1000673 - protein, 9 aa, Homo Sapiens
VFVLHGNRG

SEQ ID NO: 1000674 - protein, 9 aa, Homo Sapiens
HVTFYKTWY

SEQ ID NO: 1000675 - protein, 9 aa, Homo Sapiens
EEISETPCE

SEQ ID NO: 1000676 - protein, 9 aa, Homo Sapiens
ELQVFSSYL

SEQ ID NO: 1000677 - protein, 9 aa, Homo Sapiens
LLWRLLMAV

SEQ ID NO: 1000678 - protein, 9 aa, Homo Sapiens
GWNKYQDHC

SEQ ID NO: 1000679 - protein, 9 aa, Homo Sapiens
VLEEEVARE

SEQ ID NO: 1000680 - protein, 9 aa, Homo Sapiens
NINVIQAKF

SEQ ID NO: 1000681 - protein, 9 aa, Homo Sapiens
FHGYPRCRS

SEQ ID NO: 1000682 - protein, 9 aa, Homo Sapiens
LLAILETSA

SEQ ID NO: 1000683 - protein, 9 aa, Homo Sapiens
CSCSTSIFL

SEQ ID NO: 1000684 - protein, 9 aa, Homo Sapiens
IKLKGKSDR

SEQ ID NO: 1000685 - protein, 9 aa, Homo Sapiens
SQVSLFKIP

SEQ ID NO: 1000686 - protein, 9 aa, Homo Sapiens
PPGSPRIQE

SEQ ID NO: 1000687 - protein, 9 aa, Homo Sapiens
ALSEVDLTV

SEQ ID NO: 1000688 - protein, 9 aa, Homo Sapiens
EAPEPPDGE

SEQ ID NO: 1000689 - protein, 9 aa, Homo Sapiens
TTYRTQVSS

SEQ ID NO: 1000690 - protein, 9 aa, Homo Sapiens
DKAEKQKCP

SEQ ID NO: 1000691 - protein, 9 aa, Homo Sapiens
CDQAALMIE

SEQ ID NO: 1000692 - protein, 9 aa, Homo Sapiens
QITKTCHKS

SEQ ID NO: 1000693 - protein, 9 aa, Homo Sapiens
TVQQCNFTA

SEQ ID NO: 1000694 - protein, 9 aa, Homo Sapiens
ENRKQLLCG

SEQ ID NO: 1000695 - protein, 9 aa, Homo Sapiens
CVPEYQSLR

SEQ ID NO: 1000696 - protein, 9 aa, Homo Sapiens
CYANVIAYD

SEQ ID NO: 1000697 - protein, 9 aa, Homo Sapiens
STDGAVYVM

SEQ ID NO: 1000698 - protein, 9 aa, Homo Sapiens
TADQSVRKG

SEQ ID NO: 1000699 - protein, 9 aa, Homo Sapiens
ELRKAPVMN

SEQ ID NO: 1000700 - protein, 9 aa, Homo Sapiens
SSTSSSKIV

SEQ ID NO: 1000701 - protein, 9 aa, Homo Sapiens
AQKHPYLTQ

SEQ ID NO: 1000702 - protein, 9 aa, Homo Sapiens
YLWTMFQAA

SEQ ID NO: 1000703 - protein, 9 aa, Homo Sapiens
PSPPLPPYA

SEQ ID NO: 1000704 - protein, 9 aa, Homo Sapiens
PGSPRIQES

SEQ ID NO: 1000705 - protein, 9 aa, Homo Sapiens
NYFIKTAQP

SEQ ID NO: 1000706 - protein, 9 aa, Homo Sapiens
SEQATFDWL

SEQ ID NO: 1000707 - protein, 9 aa, Homo Sapiens
QFFSHHMFV

SEQ ID NO: 1000708 - protein, 9 aa, Homo Sapiens
FKEKALFLP

SEQ ID NO: 1000709 - protein, 9 aa, Homo Sapiens
STGTPHAKR

SEQ ID NO: 1000710 - protein, 9 aa, Homo Sapiens
IFGFSQSPH

SEQ ID NO: 1000711 - protein, 9 aa, Homo Sapiens
TMDAQSQVG

SEQ ID NO: 1000712 - protein, 9 aa, Homo Sapiens
VIRLLEPQP

SEQ ID NO: 1000713 - protein, 9 aa, Homo Sapiens
RTKNEYSLW

SEQ ID NO: 1000714 - protein, 9 aa, Homo Sapiens
QKIVTNNNE

SEQ ID NO: 1000715 - protein, 9 aa, Homo Sapiens
EGLQHSPLA

SEQ ID NO: 1000716 - protein, 9 aa, Homo Sapiens
NDKAEKQKC

SEQ ID NO: 1000717 - protein, 9 aa, Homo Sapiens
KHLSRKPRL

SEQ ID NO: 1000718 - protein, 9 aa, Homo Sapiens
IQELQVFSS

SEQ ID NO: 1000719 - protein, 9 aa, Homo Sapiens
VPFQDFKDA

SEQ ID NO: 1000720 - protein, 9 aa, Homo Sapiens
LDEEGRFPK

SEQ ID NO: 1000721 - protein, 9 aa, Homo Sapiens
RLVHLEENQ

SEQ ID NO: 1000722 - protein, 9 aa, Homo Sapiens
NEIITLSED

SEQ ID NO: 1000723 - protein, 9 aa, Homo Sapiens
HLSVTGLSS

SEQ ID NO: 1000724 - protein, 9 aa, Homo Sapiens
VQWSNFRSL

SEQ ID NO: 1000725 - protein, 9 aa, Homo Sapiens
LDTHYTLCK

SEQ ID NO: 1000726 - protein, 9 aa, Homo Sapiens
LSGLVAIFI

SEQ ID NO: 1000727 - protein, 9 aa, Homo Sapiens
TPMKELTHA

SEQ ID NO: 1000728 - protein, 9 aa, Homo Sapiens
TGKKQVERR

SEQ ID NO: 1000729 - protein, 9 aa, Homo Sapiens
VDMYSHVFR

SEQ ID NO: 1000730 - protein, 9 aa, Homo Sapiens
CSGGCSRLS

SEQ ID NO: 1000731 - protein, 9 aa, Homo Sapiens
MNGASVEPC

SEQ ID NO: 1000732 - protein, 9 aa, Homo Sapiens
LARGSLSVE

SEQ ID NO: 1000733 - protein, 9 aa, Homo Sapiens
GVMVLFILC

SEQ ID NO: 1000734 - protein, 9 aa, Homo Sapiens
EASVAPASR

SEQ ID NO: 1000735 - protein, 9 aa, Homo Sapiens
GSVLLLQER

SEQ ID NO: 1000736 - protein, 9 aa, Homo Sapiens
KVVPEKKVP

SEQ ID NO: 1000737 - protein, 9 aa, Homo Sapiens
KSRELKIQE

SEQ ID NO: 1000738 - protein, 9 aa, Homo Sapiens
TFKDGQEAN

SEQ ID NO: 1000739 - protein, 9 aa, Homo Sapiens
EKGRRLVED

SEQ ID NO: 1000740 - protein, 9 aa, Homo Sapiens
LRFFEADAF

SEQ ID NO: 1000741 - protein, 9 aa, Homo Sapiens
FDKIVHELF

SEQ ID NO: 1000742 - protein, 9 aa, Homo Sapiens
GKSDRKYYA

SEQ ID NO: 1000743 - protein, 9 aa, Homo Sapiens
IIVRLPSLI

SEQ ID NO: 1000744 - protein, 9 aa, Homo Sapiens
KCKDCKKVF

SEQ ID NO: 1000745 - protein, 9 aa, Homo Sapiens
FKFRGFLKR

SEQ ID NO: 1000746 - protein, 9 aa, Homo Sapiens
CLRLCFFLF

SEQ ID NO: 1000747 - protein, 9 aa, Homo Sapiens
RCQKGHAHC

SEQ ID NO: 1000748 - protein, 9 aa, Homo Sapiens
LPQRKMNET

SEQ ID NO: 1000749 - protein, 9 aa, Homo Sapiens
IKLIIFSWA

SEQ ID NO: 1000750 - protein, 9 aa, Homo Sapiens
DVMMSLEGR

SEQ ID NO: 1000751 - protein, 9 aa, Homo Sapiens
ACSIFYLGA

SEQ ID NO: 1000752 - protein, 9 aa, Homo Sapiens
HRRIGKKQE

SEQ ID NO: 1000753 - protein, 9 aa, Homo Sapiens
KLNLTATFK

SEQ ID NO: 1000754 - protein, 9 aa, Homo Sapiens
TLRESMRKD

SEQ ID NO: 1000755 - protein, 9 aa, Homo Sapiens
ELGKDVDDD

SEQ ID NO: 1000756 - protein, 9 aa, Homo Sapiens
KMLMKVIRC

SEQ ID NO: 1000757 - protein, 9 aa, Homo Sapiens
GFLLQEAVL

SEQ ID NO: 1000758 - protein, 9 aa, Homo Sapiens
SVFMVAISP

SEQ ID NO: 1000759 - protein, 9 aa, Homo Sapiens
KLTLPESLK

SEQ ID NO: 1000760 - protein, 9 aa, Homo Sapiens
SGNKAGMTS

SEQ ID NO: 1000761 - protein, 9 aa, Homo Sapiens
DGKDQPIMQ

SEQ ID NO: 1000762 - protein, 9 aa, Homo Sapiens
IVRLPSLIG

SEQ ID NO: 1000763 - protein, 9 aa, Homo Sapiens
HDGLRQDMA

SEQ ID NO: 1000764 - protein, 9 aa, Homo Sapiens
LCDRKSTMD

SEQ ID NO: 1000765 - protein, 9 aa, Homo Sapiens
GREGKRRET

SEQ ID NO: 1000766 - protein, 9 aa, Homo Sapiens
RKDPDSSSK

SEQ ID NO: 1000767 - protein, 9 aa, Homo Sapiens
QTITFQQFK

SEQ ID NO: 1000768 - protein, 9 aa, Homo Sapiens
DPSSSTLAL

SEQ ID NO: 1000769 - protein, 9 aa, Homo Sapiens
AYQSERFLP

SEQ ID NO: 1000770 - protein, 9 aa, Homo Sapiens
YFCTCGDCP

SEQ ID NO: 1000771 - protein, 9 aa, Homo Sapiens
KRMMGQRSP

SEQ ID NO: 1000772 - protein, 9 aa, Homo Sapiens
YQLLLKYAK

SEQ ID NO: 1000773 - protein, 9 aa, Homo Sapiens
SIITDYNKE

SEQ ID NO: 1000774 - protein, 9 aa, Homo Sapiens
LGLYFGASV

SEQ ID NO: 1000775 - protein, 9 aa, Homo Sapiens
GTSKDHDSP

SEQ ID NO: 1000776 - protein, 9 aa, Homo Sapiens
DKVFVRRGF

SEQ ID NO: 1000777 - protein, 9 aa, Homo Sapiens
NRYTGKKQV

SEQ ID NO: 1000778 - protein, 9 aa, Homo Sapiens
PGPPEPRGP

SEQ ID NO: 1000779 - protein, 9 aa, Homo Sapiens
CICLGKFTF

SEQ ID NO: 1000780 - protein, 9 aa, Homo Sapiens
RIDKGQIPA

SEQ ID NO: 1000781 - protein, 9 aa, Homo Sapiens
SEASPGSSA

SEQ ID NO: 1000782 - protein, 9 aa, Homo Sapiens
QVFSSYLAV

SEQ ID NO: 1000783 - protein, 9 aa, Homo Sapiens
VWVLEMMWS

SEQ ID NO: 1000784 - protein, 9 aa, Homo Sapiens
LKDQVLSLN

SEQ ID NO: 1000785 - protein, 9 aa, Homo Sapiens
KSFSYATAP

SEQ ID NO: 1000786 - protein, 9 aa, Homo Sapiens
NQPGRQEKM

SEQ ID NO: 1000787 - protein, 9 aa, Homo Sapiens
KTPSDPVII

SEQ ID NO: 1000788 - protein, 9 aa, Homo Sapiens
PIQYNCSKC

SEQ ID NO: 1000789 - protein, 9 aa, Homo Sapiens
HNSARPMLE

SEQ ID NO: 1000790 - protein, 9 aa, Homo Sapiens
GAYGPEYWD

SEQ ID NO: 1000791 - protein, 9 aa, Homo Sapiens
FFLRRTTML

SEQ ID NO: 1000792 - protein, 9 aa, Homo Sapiens
NSRDFGNKV

SEQ ID NO: 1000793 - protein, 9 aa, Homo Sapiens
VISLRYDPD

SEQ ID NO: 1000794 - protein, 9 aa, Homo Sapiens
SDKFERSSN

SEQ ID NO: 1000795 - protein, 9 aa, Homo Sapiens
WFSFLCVQS

SEQ ID NO: 1000796 - protein, 9 aa, Homo Sapiens
ITTRNLTLS

SEQ ID NO: 1000797 - protein, 9 aa, Homo Sapiens
HVPFLASTS

SEQ ID NO: 1000798 - protein, 9 aa, Homo Sapiens
HKVYEQKTK

SEQ ID NO: 1000799 - protein, 9 aa, Homo Sapiens
EEGWNKYQD

SEQ ID NO: 1000800 - protein, 9 aa, Homo Sapiens
AFNGQDRNQ

SEQ ID NO: 1000801 - protein, 9 aa, Homo Sapiens
PPESIPAPP

SEQ ID NO: 1000802 - protein, 9 aa, Homo Sapiens
PLLMLQLLW

SEQ ID NO: 1000803 - protein, 9 aa, Homo Sapiens
KGEKKEEDE

SEQ ID NO: 1000804 - protein, 9 aa, Homo Sapiens
WKFTSASDV

SEQ ID NO: 1000805 - protein, 9 aa, Homo Sapiens
SSSVQIDSG

SEQ ID NO: 1000806 - protein, 9 aa, Homo Sapiens
VLHGRLKKL

SEQ ID NO: 1000807 - protein, 9 aa, Homo Sapiens
EVGHVFDDF

SEQ ID NO: 1000808 - protein, 9 aa, Homo Sapiens
QEDLCVSVL

SEQ ID NO: 1000809 - protein, 9 aa, Homo Sapiens
VALKILSAI

SEQ ID NO: 1000810 - protein, 9 aa, Homo Sapiens
SLYEYVFCP

SEQ ID NO: 1000811 - protein, 9 aa, Homo Sapiens
QPESVHKLQ

SEQ ID NO: 1000812 - protein, 9 aa, Homo Sapiens
IFLLAFFIY

SEQ ID NO: 1000813 - protein, 9 aa, Homo Sapiens
IEGQKTFQS

SEQ ID NO: 1000814 - protein, 9 aa, Homo Sapiens
IITLTNLSG

SEQ ID NO: 1000815 - protein, 9 aa, Homo Sapiens
QKVAEQDDS

SEQ ID NO: 1000816 - protein, 9 aa, Homo Sapiens
VAVASLTIT

SEQ ID NO: 1000817 - protein, 9 aa, Homo Sapiens
GTPHAKRKA

SEQ ID NO: 1000818 - protein, 9 aa, Homo Sapiens
PPASQLLCL

SEQ ID NO: 1000819 - protein, 9 aa, Homo Sapiens
IKLQLLPAS

SEQ ID NO: 1000820 - protein, 9 aa, Homo Sapiens
LSEHFEVNP

SEQ ID NO: 1000821 - protein, 9 aa, Homo Sapiens
SKDLLKAVE

SEQ ID NO: 1000822 - protein, 9 aa, Homo Sapiens
FGFFLRRTT

SEQ ID NO: 1000823 - protein, 9 aa, Homo Sapiens
LRLKLPLDR

SEQ ID NO: 1000824 - protein, 9 aa, Homo Sapiens
LRTKNEYSL

SEQ ID NO: 1000825 - protein, 9 aa, Homo Sapiens
LLYFLLSDR

SEQ ID NO: 1000826 - protein, 9 aa, Homo Sapiens
SFLHHAYCF

SEQ ID NO: 1000827 - protein, 9 aa, Homo Sapiens
FEMQPIYEV

SEQ ID NO: 1000828 - protein, 9 aa, Homo Sapiens
IRPFLKKKT

SEQ ID NO: 1000829 - protein, 9 aa, Homo Sapiens
DMEIRELVT

SEQ ID NO: 1000830 - protein, 9 aa, Homo Sapiens
GKFLRNLFS

SEQ ID NO: 1000831 - protein, 9 aa, Homo Sapiens
TGVQWSNFR

SEQ ID NO: 1000832 - protein, 9 aa, Homo Sapiens
STTSSRKSF

SEQ ID NO: 1000833 - protein, 9 aa, Homo Sapiens
WTDKKKAGK

SEQ ID NO: 1000834 - protein, 9 aa, Homo Sapiens
LIREESLII

SEQ ID NO: 1000835 - protein, 9 aa, Homo Sapiens
YNSENIKAI

SEQ ID NO: 1000836 - protein, 9 aa, Homo Sapiens
CDGCDDNYY

SEQ ID NO: 1000837 - protein, 9 aa, Homo Sapiens
SNFQVNSLP

SEQ ID NO: 1000838 - protein, 9 aa, Homo Sapiens
IYTLRSQDM

SEQ ID NO: 1000839 - protein, 9 aa, Homo Sapiens
PLHPSSTSS

SEQ ID NO: 1000840 - protein, 9 aa, Homo Sapiens
ICSEESPEM

SEQ ID NO: 1000841 - protein, 9 aa, Homo Sapiens
DTHYTLCKP

SEQ ID NO: 1000842 - protein, 9 aa, Homo Sapiens
FSSPSLPWS

SEQ ID NO: 1000843 - protein, 9 aa, Homo Sapiens
GGEEFEVLE

SEQ ID NO: 1000844 - protein, 9 aa, Homo Sapiens
MKGKKLGLY

SEQ ID NO: 1000845 - protein, 9 aa, Homo Sapiens
KWHCDSDND

SEQ ID NO: 1000846 - protein, 9 aa, Homo Sapiens
NNEIITLSE

SEQ ID NO: 1000847 - protein, 9 aa, Homo Sapiens
NIISYVVHL

SEQ ID NO: 1000848 - protein, 9 aa, Homo Sapiens
QEGATRGHS

SEQ ID NO: 1000849 - protein, 9 aa, Homo Sapiens
PTASLIAMV

SEQ ID NO: 1000850 - protein, 9 aa, Homo Sapiens
SHLPEEIGT

SEQ ID NO: 1000851 - protein, 9 aa, Homo Sapiens
DSGMYSSSR

SEQ ID NO: 1000852 - protein, 9 aa, Homo Sapiens
LKRMPSIQE

SEQ ID NO: 1000853 - protein, 9 aa, Homo Sapiens
FEFSRREKV

SEQ ID NO: 1000854 - protein, 9 aa, Homo Sapiens
DPASLLGGR

SEQ ID NO: 1000855 - protein, 9 aa, Homo Sapiens
LPMMRRAFE

SEQ ID NO: 1000856 - protein, 9 aa, Homo Sapiens
HFKHLSRKP

SEQ ID NO: 1000857 - protein, 9 aa, Homo Sapiens
QPIYEVLRH

SEQ ID NO: 1000858 - protein, 9 aa, Homo Sapiens
ERHILSAEL

SEQ ID NO: 1000859 - protein, 9 aa, Homo Sapiens
TSGDYDDSA

SEQ ID NO: 1000860 - protein, 9 aa, Homo Sapiens
INQKYNEVM

SEQ ID NO: 1000861 - protein, 9 aa, Homo Sapiens
EMVSLFSKA

SEQ ID NO: 1000862 - protein, 9 aa, Homo Sapiens
KPCRCSKCG

SEQ ID NO: 1000863 - protein, 9 aa, Homo Sapiens
KRDQGGFGD

SEQ ID NO: 1000864 - protein, 9 aa, Homo Sapiens
RGQQKKEAS

SEQ ID NO: 1000865 - protein, 9 aa, Homo Sapiens
LLEPSGSPT

SEQ ID NO: 1000866 - protein, 9 aa, Homo Sapiens
EHTHNKKKA

SEQ ID NO: 1000867 - protein, 9 aa, Homo Sapiens
RSEQATFDW

SEQ ID NO: 1000868 - protein, 9 aa, Homo Sapiens
LLHLRPLWE

SEQ ID NO: 1000869 - protein, 9 aa, Homo Sapiens
LFKDEFFTM

SEQ ID NO: 1000870 - protein, 9 aa, Homo Sapiens
MVWVLEMMW

SEQ ID NO: 1000871 - protein, 9 aa, Homo Sapiens
KIEDISANK

SEQ ID NO: 1000872 - protein, 9 aa, Homo Sapiens
DDHQQGTSK

SEQ ID NO: 1000873 - protein, 9 aa, Homo Sapiens
DGCDDNYYI

SEQ ID NO: 1000874 - protein, 9 aa, Homo Sapiens
CKLPCNLCS

SEQ ID NO: 1000875 - protein, 9 aa, Homo Sapiens
AFLSSFVQD

SEQ ID NO: 1000876 - protein, 9 aa, Homo Sapiens
SKASGKPEE

SEQ ID NO: 1000877 - protein, 9 aa, Homo Sapiens
LLQRAEKTV

SEQ ID NO: 1000878 - protein, 9 aa, Homo Sapiens
KEGKGREGK

SEQ ID NO: 1000879 - protein, 9 aa, Homo Sapiens
FCPSWAASE

SEQ ID NO: 1000880 - protein, 9 aa, Homo Sapiens
GTVVPRFSV

SEQ ID NO: 1000881 - protein, 9 aa, Homo Sapiens
WPPENEISK

SEQ ID NO: 1000882 - protein, 9 aa, Homo Sapiens
DLCVSVLCS

SEQ ID NO: 1000883 - protein, 9 aa, Homo Sapiens
ELYDFNQCE

SEQ ID NO: 1000884 - protein, 9 aa, Homo Sapiens
RLWERQKFF

SEQ ID NO: 1000885 - protein, 9 aa, Homo Sapiens
SMNHGKFAS

SEQ ID NO: 1000886 - protein, 9 aa, Homo Sapiens
LRVVVAMMD

SEQ ID NO: 1000887 - protein, 9 aa, Homo Sapiens
PFSSPSLPW

SEQ ID NO: 1000888 - protein, 9 aa, Homo Sapiens
EILWSQELR

SEQ ID NO: 1000889 - protein, 9 aa, Homo Sapiens
STGDQVAKG

SEQ ID NO: 1000890 - protein, 9 aa, Homo Sapiens
LTYTFSHAS

SEQ ID NO: 1000891 - protein, 9 aa, Homo Sapiens
VLAQVLGRV

SEQ ID NO: 1000892 - protein, 9 aa, Homo Sapiens
SIFVMAITA

SEQ ID NO: 1000893 - protein, 9 aa, Homo Sapiens
TPCQQVLAH

SEQ ID NO: 1000894 - protein, 9 aa, Homo Sapiens
TAPRDVQYL

SEQ ID NO: 1000895 - protein, 9 aa, Homo Sapiens
FLLQEAVLA

SEQ ID NO: 1000896 - protein, 9 aa, Homo Sapiens
PVMNCSIAV

SEQ ID NO: 1000897 - protein, 9 aa, Homo Sapiens
GLKNIFGFS

SEQ ID NO: 1000898 - protein, 9 aa, Homo Sapiens
ILSGLVAIF

SEQ ID NO: 1000899 - protein, 9 aa, Homo Sapiens
LGTLNTLAN

SEQ ID NO: 1000900 - protein, 9 aa, Homo Sapiens
DSGTNSELT

SEQ ID NO: 1000901 - protein, 9 aa, Homo Sapiens
EPLSLFEDV

SEQ ID NO: 1000902 - protein, 9 aa, Homo Sapiens
ATLGVNSCT

SEQ ID NO: 1000903 - protein, 9 aa, Homo Sapiens
NTLHSRTKR

SEQ ID NO: 1000904 - protein, 9 aa, Homo Sapiens
MKTDGGGWI

SEQ ID NO: 1000905 - protein, 9 aa, Homo Sapiens
MDKNKMGLT

SEQ ID NO: 1000906 - protein, 9 aa, Homo Sapiens
SRSPMVEKR

SEQ ID NO: 1000907 - protein, 9 aa, Homo Sapiens
DDNYYIFCL

SEQ ID NO: 1000908 - protein, 9 aa, Homo Sapiens
LESEMSSHK

SEQ ID NO: 1000909 - protein, 9 aa, Homo Sapiens
MRHNYFIKT

SEQ ID NO: 1000910 - protein, 9 aa, Homo Sapiens
NLAAISVRI

SEQ ID NO: 1000911 - protein, 9 aa, Homo Sapiens
RPRVGGQDQ

SEQ ID NO: 1000912 - protein, 9 aa, Homo Sapiens
EYQSLRLTS

SEQ ID NO: 1000913 - protein, 9 aa, Homo Sapiens
AIIKLQLLP

SEQ ID NO: 1000914 - protein, 9 aa, Homo Sapiens
LEISVTVPP

SEQ ID NO: 1000915 - protein, 9 aa, Homo Sapiens
SYIQNLIIR

SEQ ID NO: 1000916 - protein, 9 aa, Homo Sapiens
QVAKFYDHL

SEQ ID NO: 1000917 - protein, 9 aa, Homo Sapiens
TLPSDSSRH

SEQ ID NO: 1000918 - protein, 9 aa, Homo Sapiens
QDLGYQNKI

SEQ ID NO: 1000919 - protein, 9 aa, Homo Sapiens
FCTCGDCPD

SEQ ID NO: 1000920 - protein, 9 aa, Homo Sapiens
RAAAVYVME

SEQ ID NO: 1000921 - protein, 9 aa, Homo Sapiens
VSHDPRLHN

SEQ ID NO: 1000922 - protein, 9 aa, Homo Sapiens
QDHCYRHFP

SEQ ID NO: 1000923 - protein, 9 aa, Homo Sapiens
SKEKRVAMK

SEQ ID NO: 1000924 - protein, 9 aa, Homo Sapiens
IDKGQIPAD

SEQ ID NO: 1000925 - protein, 9 aa, Homo Sapiens
KHPIFFMFI

SEQ ID NO: 1000926 - protein, 9 aa, Homo Sapiens
FSKAQILEL

SEQ ID NO: 1000927 - protein, 9 aa, Homo Sapiens
DRRRATTLR

SEQ ID NO: 1000928 - protein, 9 aa, Homo Sapiens
QLLRSLGIE

SEQ ID NO: 1000929 - protein, 9 aa, Homo Sapiens
FSIIVRLPS

SEQ ID NO: 1000930 - protein, 9 aa, Homo Sapiens
VELKFNLNQ

SEQ ID NO: 1000931 - protein, 9 aa, Homo Sapiens
KCDKTFQYP

SEQ ID NO: 1000932 - protein, 9 aa, Homo Sapiens
SLSVEDKDH

SEQ ID NO: 1000933 - protein, 9 aa, Homo Sapiens
LSKKECCST

SEQ ID NO: 1000934 - protein, 9 aa, Homo Sapiens
LEECLTDTE

SEQ ID NO: 1000935 - protein, 9 aa, Homo Sapiens
HWGCALEAT

SEQ ID NO: 1000936 - protein, 9 aa, Homo Sapiens
KFSSLSAYL

SEQ ID NO: 1000937 - protein, 9 aa, Homo Sapiens
KLFSCKTDL

SEQ ID NO: 1000938 - protein, 9 aa, Homo Sapiens
LTGECVPQM

SEQ ID NO: 1000939 - protein, 9 aa, Homo Sapiens
FSNTSTLTF

SEQ ID NO: 1000940 - protein, 9 aa, Homo Sapiens
VKSGWLNKL

SEQ ID NO: 1000941 - protein, 9 aa, Homo Sapiens
IDFEMQPIY

SEQ ID NO: 1000942 - protein, 9 aa, Homo Sapiens
DHKFNLMYA

SEQ ID NO: 1000943 - protein, 9 aa, Homo Sapiens
AAERNLNVT

SEQ ID NO: 1000944 - protein, 9 aa, Homo Sapiens
EESLIICSI

SEQ ID NO: 1000945 - protein, 9 aa, Homo Sapiens
RSPNSGSWV

SEQ ID NO: 1000946 - protein, 9 aa, Homo Sapiens
SSGKHYWKV

SEQ ID NO: 1000947 - protein, 9 aa, Homo Sapiens
KNAQTITFQ

SEQ ID NO: 1000948 - protein, 9 aa, Homo Sapiens
VPRISWTAI

SEQ ID NO: 1000949 - protein, 9 aa, Homo Sapiens
APPGPGPGS

SEQ ID NO: 1000950 - protein, 9 aa, Homo Sapiens
PNPSNGAEL

SEQ ID NO: 1000951 - protein, 9 aa, Homo Sapiens
DGTFYVADL

SEQ ID NO: 1000952 - protein, 9 aa, Homo Sapiens
LLSREMNKT

SEQ ID NO: 1000953 - protein, 9 aa, Homo Sapiens
KDHSLPWGK

SEQ ID NO: 1000954 - protein, 9 aa, Homo Sapiens
LNRALDCEE

SEQ ID NO: 1000955 - protein, 9 aa, Homo Sapiens
LSSPEKAPL

SEQ ID NO: 1000956 - protein, 9 aa, Homo Sapiens
LVISPEVLR

SEQ ID NO: 1000957 - protein, 9 aa, Homo Sapiens
QLDNIVGKR

SEQ ID NO: 1000958 - protein, 9 aa, Homo Sapiens
ECRGRARTA

SEQ ID NO: 1000959 - protein, 9 aa, Homo Sapiens
FCQKCILSH

SEQ ID NO: 1000960 - protein, 9 aa, Homo Sapiens
GKEEAFMVR

SEQ ID NO: 1000961 - protein, 9 aa, Homo Sapiens
TIFKGNSLA

SEQ ID NO: 1000962 - protein, 9 aa, Homo Sapiens
EEPLCSEIL

SEQ ID NO: 1000963 - protein, 9 aa, Homo Sapiens
IKMVCNSWF

SEQ ID NO: 1000964 - protein, 9 aa, Homo Sapiens
VMSPNQSNQ

SEQ ID NO: 1000965 - protein, 9 aa, Homo Sapiens
LTQPHRPSQ

SEQ ID NO: 1000966 - protein, 9 aa, Homo Sapiens
SQSLVYFFV

SEQ ID NO: 1000967 - protein, 9 aa, Homo Sapiens
LWQLLLTLT

SEQ ID NO: 1000968 - protein, 9 aa, Homo Sapiens
GIVIWGALS

SEQ ID NO: 1000969 - protein, 9 aa, Homo Sapiens
EDSGSNFQV

SEQ ID NO: 1000970 - protein, 9 aa, Homo Sapiens
DIRVQLEAC

SEQ ID NO: 1000971 - protein, 9 aa, Homo Sapiens
TTMRHLGDG

SEQ ID NO: 1000972 - protein, 9 aa, Homo Sapiens
RDSGNKAGM

SEQ ID NO: 1000973 - protein, 9 aa, Homo Sapiens
LRAIGLHLW

SEQ ID NO: 1000974 - protein, 9 aa, Homo Sapiens
DDIKLRGAA

SEQ ID NO: 1000975 - protein, 9 aa, Homo Sapiens
VGTSGDYDD

SEQ ID NO: 1000976 - protein, 9 aa, Homo Sapiens
SNKTTGLYS

SEQ ID NO: 1000977 - protein, 9 aa, Homo Sapiens
HAILTKSPF

SEQ ID NO: 1000978 - protein, 9 aa, Homo Sapiens
ENEISKPEV

SEQ ID NO: 1000979 - protein, 9 aa, Homo Sapiens
LYLENLNKK

SEQ ID NO: 1000980 - protein, 9 aa, Homo Sapiens
GNFTQATVR

SEQ ID NO: 1000981 - protein, 9 aa, Homo Sapiens
YANCHASNL

SEQ ID NO: 1000982 - protein, 9 aa, Homo Sapiens
STQPELVPG

SEQ ID NO: 1000983 - protein, 9 aa, Homo Sapiens
FIQDLLPEQ

SEQ ID NO: 1000984 - protein, 9 aa, Homo Sapiens
IMSLKSFSY

SEQ ID NO: 1000985 - protein, 9 aa, Homo Sapiens
DTGKEEAFM

SEQ ID NO: 1000986 - protein, 9 aa, Homo Sapiens
LGEGSALLY

SEQ ID NO: 1000987 - protein, 9 aa, Homo Sapiens
EDDADHEAQ

SEQ ID NO: 1000988 - protein, 9 aa, Homo Sapiens
NLIVEGRKE

SEQ ID NO: 1000989 - protein, 9 aa, Homo Sapiens
LLETTSEAL

SEQ ID NO: 1000990 - protein, 9 aa, Homo Sapiens
TGDYDRTVK

SEQ ID NO: 1000991 - protein, 9 aa, Homo Sapiens
YGYGYDDYK

SEQ ID NO: 1000992 - protein, 9 aa, Homo Sapiens
GDLIRRVAN

SEQ ID NO: 1000993 - protein, 9 aa, Homo Sapiens
EKRMMGQRS

SEQ ID NO: 1000994 - protein, 9 aa, Homo Sapiens
ISSKPTQCT

SEQ ID NO: 1000995 - protein, 9 aa, Homo Sapiens
PFHSGREHE

SEQ ID NO: 1000996 - protein, 9 aa, Homo Sapiens
GDLVFLHQA

SEQ ID NO: 1000997 - protein, 9 aa, Homo Sapiens
NCSKCDKTF

SEQ ID NO: 1000998 - protein, 9 aa, Homo Sapiens
RGLALALLG

SEQ ID NO: 1000999 - protein, 9 aa, Homo Sapiens
ELMFLNCFE

SEQ ID NO: 1001000 - protein, 9 aa, Homo Sapiens
GEKKEEDED

SEQ ID NO: 1001001 - protein, 9 aa, Homo Sapiens
NAYTEARKA

SEQ ID NO: 1001002 - protein, 9 aa, Homo Sapiens
FEQTYEVKY

SEQ ID NO: 1001003 - protein, 9 aa, Homo Sapiens
IKETLEKFE

SEQ ID NO: 1001004 - protein, 9 aa, Homo Sapiens
ATQHLTQPH

SEQ ID NO: 1001005 - protein, 9 aa, Homo Sapiens
FSSGSQRAR

SEQ ID NO: 1001006 - protein, 9 aa, Homo Sapiens
VMGGVVQAF

SEQ ID NO: 1001007 - protein, 9 aa, Homo Sapiens
AILTKSPFA

SEQ ID NO: 1001008 - protein, 9 aa, Homo Sapiens
NNTQEAARG

SEQ ID NO: 1001009 - protein, 9 aa, Homo Sapiens
IQESCGIAP

SEQ ID NO: 1001010 - protein, 9 aa, Homo Sapiens
GIFLLAFFI

SEQ ID NO: 1001011 - protein, 9 aa, Homo Sapiens
RPEKGRRLV

SEQ ID NO: 1001012 - protein, 9 aa, Homo Sapiens
SYQPNYGMG

SEQ ID NO: 1001013 - protein, 9 aa, Homo Sapiens
LSADFCNLH

SEQ ID NO: 1001014 - protein, 9 aa, Homo Sapiens
NYQASTDTL

SEQ ID NO: 1001015 - protein, 9 aa, Homo Sapiens
DGYVINIAH

SEQ ID NO: 1001016 - protein, 9 aa, Homo Sapiens
KLRSWCRSS

SEQ ID NO: 1001017 - protein, 9 aa, Homo Sapiens
TSVSALVEF

SEQ ID NO: 1001018 - protein, 9 aa, Homo Sapiens
APSHASSAA

SEQ ID NO: 1001019 - protein, 9 aa, Homo Sapiens
IRLLEPQPA

SEQ ID NO: 1001020 - protein, 9 aa, Homo Sapiens
SMGSKARKA

SEQ ID NO: 1001021 - protein, 9 aa, Homo Sapiens
PLYGQEEIP

SEQ ID NO: 1001022 - protein, 9 aa, Homo Sapiens
VMKVNSEFI

SEQ ID NO: 1001023 - protein, 9 aa, Homo Sapiens
QERSNLGTG

SEQ ID NO: 1001024 - protein, 9 aa, Homo Sapiens
SAISGQTFC

SEQ ID NO: 1001025 - protein, 9 aa, Homo Sapiens
PTKAASVEL

SEQ ID NO: 1001026 - protein, 9 aa, Homo Sapiens
LTATFKDGQ

SEQ ID NO: 1001027 - protein, 9 aa, Homo Sapiens
NKMGLTGPL

SEQ ID NO: 1001028 - protein, 9 aa, Homo Sapiens
DVPTYKEVT

SEQ ID NO: 1001029 - protein, 9 aa, Homo Sapiens
LVEFIQCQL

SEQ ID NO: 1001030 - protein, 9 aa, Homo Sapiens
DLFIQLMFI

SEQ ID NO: 1001031 - protein, 9 aa, Homo Sapiens
CTGDYDRTV

SEQ ID NO: 1001032 - protein, 9 aa, Homo Sapiens
MTSYLDIAN

SEQ ID NO: 1001033 - protein, 9 aa, Homo Sapiens
TLIDQVNSN

SEQ ID NO: 1001034 - protein, 9 aa, Homo Sapiens
EVPILRDGE

SEQ ID NO: 1001035 - protein, 9 aa, Homo Sapiens
QVVGIPGWG

SEQ ID NO: 1001036 - protein, 9 aa, Homo Sapiens
LIVRSTTIT

SEQ ID NO: 1001037 - protein, 9 aa, Homo Sapiens
GKPEECCDL

SEQ ID NO: 1001038 - protein, 9 aa, Homo Sapiens
KFNAVPYSQ

SEQ ID NO: 1001039 - protein, 9 aa, Homo Sapiens
TTLREKRRL

SEQ ID NO: 1001040 - protein, 9 aa, Homo Sapiens
GLTESVQGV

SEQ ID NO: 1001041 - protein, 9 aa, Homo Sapiens
IKGRDLDLL

SEQ ID NO: 1001042 - protein, 9 aa, Homo Sapiens
VRAYQSERF

SEQ ID NO: 1001043 - protein, 9 aa, Homo Sapiens
GCSRLSLAG

SEQ ID NO: 1001044 - protein, 9 aa, Homo Sapiens
PTVLQPNPL

SEQ ID NO: 1001045 - protein, 9 aa, Homo Sapiens
SAEADRATS

SEQ ID NO: 1001046 - protein, 9 aa, Homo Sapiens
DMISEPMDK

SEQ ID NO: 1001047 - protein, 9 aa, Homo Sapiens
PAPFCQKCI

SEQ ID NO: 1001048 - protein, 9 aa, Homo Sapiens
AAAVYVMEI

SEQ ID NO: 1001049 - protein, 9 aa, Homo Sapiens
IPLMRDCAL

SEQ ID NO: 1001050 - protein, 9 aa, Homo Sapiens
FFLAAMGFD

SEQ ID NO: 1001051 - protein, 9 aa, Homo Sapiens
TQRFSCLLL

SEQ ID NO: 1001052 - protein, 9 aa, Homo Sapiens
FKGNSLATR

SEQ ID NO: 1001053 - protein, 9 aa, Homo Sapiens
GKTPCQQVL

SEQ ID NO: 1001054 - protein, 9 aa, Homo Sapiens
NQFPDIFFC

SEQ ID NO: 1001055 - protein, 9 aa, Homo Sapiens
ALRAIGLHL

SEQ ID NO: 1001056 - protein, 9 aa, Homo Sapiens
LPLSFGKSQ

SEQ ID NO: 1001057 - protein, 9 aa, Homo Sapiens
ADYFLKVSL

SEQ ID NO: 1001058 - protein, 9 aa, Homo Sapiens
LTLQCQGWK

SEQ ID NO: 1001059 - protein, 9 aa, Homo Sapiens
SELKDIRVQ

SEQ ID NO: 1001060 - protein, 9 aa, Homo Sapiens
DENLKKQED

SEQ ID NO: 1001061 - protein, 9 aa, Homo Sapiens
WFHQAPIST

SEQ ID NO: 1001062 - protein, 9 aa, Homo Sapiens
TKNEYSLWT

SEQ ID NO: 1001063 - protein, 9 aa, Homo Sapiens
KKIPERDSR

SEQ ID NO: 1001064 - protein, 9 aa, Homo Sapiens
ALDCEEQPE

SEQ ID NO: 1001065 - protein, 9 aa, Homo Sapiens
LYKRSEAKK

SEQ ID NO: 1001066 - protein, 9 aa, Homo Sapiens
VVEQLTQEL

SEQ ID NO: 1001067 - protein, 9 aa, Homo Sapiens
NGASVEPCT

SEQ ID NO: 1001068 - protein, 9 aa, Homo Sapiens
SIVIRLLEP

SEQ ID NO: 1001069 - protein, 9 aa, Homo Sapiens
KILKNAAPS

SEQ ID NO: 1001070 - protein, 9 aa, Homo Sapiens
TFQSILEAS

SEQ ID NO: 1001071 - protein, 9 aa, Homo Sapiens
SQAPSLLLS

SEQ ID NO: 1001072 - protein, 9 aa, Homo Sapiens
RMAMVLGAT

SEQ ID NO: 1001073 - protein, 9 aa, Homo Sapiens
TSQPSPPGG

SEQ ID NO: 1001074 - protein, 9 aa, Homo Sapiens
KEALGILAA

SEQ ID NO: 1001075 - protein, 9 aa, Homo Sapiens
VVCTSETRS

SEQ ID NO: 1001076 - protein, 9 aa, Homo Sapiens
VEDKDHMCS

SEQ ID NO: 1001077 - protein, 9 aa, Homo Sapiens
ELKDIRVQL

SEQ ID NO: 1001078 - protein, 9 aa, Homo Sapiens
NFTQATVRD

SEQ ID NO: 1001079 - protein, 9 aa, Homo Sapiens
STAQKNPTP

SEQ ID NO: 1001080 - protein, 9 aa, Homo Sapiens
SRETPVARD

SEQ ID NO: 1001081 - protein, 9 aa, Homo Sapiens
EEEEESPDH

SEQ ID NO: 1001082 - protein, 9 aa, Homo Sapiens
YCFHYTLCA

SEQ ID NO: 1001083 - protein, 9 aa, Homo Sapiens
RCSKCGEGF

SEQ ID NO: 1001084 - protein, 9 aa, Homo Sapiens
GPSQAASAL

SEQ ID NO: 1001085 - protein, 9 aa, Homo Sapiens
WKPFHSGRE

SEQ ID NO: 1001086 - protein, 9 aa, Homo Sapiens
ASSLVFNIS

SEQ ID NO: 1001087 - protein, 9 aa, Homo Sapiens
SSSGRVIGG

SEQ ID NO: 1001088 - protein, 9 aa, Homo Sapiens
FPLYGQEEI

SEQ ID NO: 1001089 - protein, 9 aa, Homo Sapiens
EVTPRPFEE

SEQ ID NO: 1001090 - protein, 9 aa, Homo Sapiens
VSNFNGPNA

SEQ ID NO: 1001091 - protein, 9 aa, Homo Sapiens
MKELWWEVE

SEQ ID NO: 1001092 - protein, 9 aa, Homo Sapiens
VTEPKKFNL

SEQ ID NO: 1001093 - protein, 9 aa, Homo Sapiens
IEYKNKSDF

SEQ ID NO: 1001094 - protein, 9 aa, Homo Sapiens
IVYYKDDPH

SEQ ID NO: 1001095 - protein, 9 aa, Homo Sapiens
FVDQPEGTP

SEQ ID NO: 1001096 - protein, 9 aa, Homo Sapiens
GGNRDILCK

SEQ ID NO: 1001097 - protein, 9 aa, Homo Sapiens
NESTLIDQV

SEQ ID NO: 1001098 - protein, 9 aa, Homo Sapiens
DKTEDDADH

SEQ ID NO: 1001099 - protein, 9 aa, Homo Sapiens
LIGDDHYNS

SEQ ID NO: 1001100 - protein, 9 aa, Homo Sapiens
KCLRLCFFL

SEQ ID NO: 1001101 - protein, 9 aa, Homo Sapiens
VSHEKPPNP

SEQ ID NO: 1001102 - protein, 9 aa, Homo Sapiens
ISVTVPPGT

SEQ ID NO: 1001103 - protein, 9 aa, Homo Sapiens
KDYENLWNT

SEQ ID NO: 1001104 - protein, 9 aa, Homo Sapiens
TCRCRSGFG

SEQ ID NO: 1001105 - protein, 9 aa, Homo Sapiens
ILRKRDQGG

SEQ ID NO: 1001106 - protein, 9 aa, Homo Sapiens
TGTVEFKGF

SEQ ID NO: 1001107 - protein, 9 aa, Homo Sapiens
DGSRETPVA

SEQ ID NO: 1001108 - protein, 9 aa, Homo Sapiens
QASSHIGNF

SEQ ID NO: 1001109 - protein, 9 aa, Homo Sapiens
LPYCGVPVL

SEQ ID NO: 1001110 - protein, 9 aa, Homo Sapiens
FIFVLSPNF

SEQ ID NO: 1001111 - protein, 9 aa, Homo Sapiens
NVGTSGDYD

SEQ ID NO: 1001112 - protein, 9 aa, Homo Sapiens
QPVMSPNQS

SEQ ID NO: 1001113 - protein, 9 aa, Homo Sapiens
RFNNSSKFS

SEQ ID NO: 1001114 - protein, 9 aa, Homo Sapiens
QKDFCFIFQ

SEQ ID NO: 1001115 - protein, 9 aa, Homo Sapiens
YLLYIRNSK

SEQ ID NO: 1001116 - protein, 9 aa, Homo Sapiens
AIWMNSTRH

SEQ ID NO: 1001117 - protein, 9 aa, Homo Sapiens
IRLAEMEQK

SEQ ID NO: 1001118 - protein, 9 aa, Homo Sapiens
KFIFVLSPN

SEQ ID NO: 1001119 - protein, 9 aa, Homo Sapiens
GSSHETVQR

SEQ ID NO: 1001120 - protein, 9 aa, Homo Sapiens
DSFLHHAYC

SEQ ID NO: 1001121 - protein, 9 aa, Homo Sapiens
AAAVCGSGA

SEQ ID NO: 1001122 - protein, 9 aa, Homo Sapiens
TVPRISWTA

SEQ ID NO: 1001123 - protein, 9 aa, Homo Sapiens
FPTPPASQL

SEQ ID NO: 1001124 - protein, 9 aa, Homo Sapiens
DPPCLRLSR

SEQ ID NO: 1001125 - protein, 9 aa, Homo Sapiens
FGHNPHLHG

SEQ ID NO: 1001126 - protein, 9 aa, Homo Sapiens
LNNTQEAAR

SEQ ID NO: 1001127 - protein, 9 aa, Homo Sapiens
DSDNDCGDG

SEQ ID NO: 1001128 - protein, 9 aa, Homo Sapiens
KASGKPEEC

SEQ ID NO: 1001129 - protein, 9 aa, Homo Sapiens
SCGVVDLIT

SEQ ID NO: 1001130 - protein, 9 aa, Homo Sapiens
NKGVFIKLI

SEQ ID NO: 1001131 - protein, 9 aa, Homo Sapiens
LGMRPPPPG

SEQ ID NO: 1001132 - protein, 9 aa, Homo Sapiens
QLEISVTVP

SEQ ID NO: 1001133 - protein, 9 aa, Homo Sapiens
TSASFCHMS

SEQ ID NO: 1001134 - protein, 9 aa, Homo Sapiens
ISGTQPEDL

SEQ ID NO: 1001135 - protein, 9 aa, Homo Sapiens
SKHVGLDND

SEQ ID NO: 1001136 - protein, 9 aa, Homo Sapiens
DVQYLLYIR

SEQ ID NO: 1001137 - protein, 9 aa, Homo Sapiens
SGKPEECCD

SEQ ID NO: 1001138 - protein, 9 aa, Homo Sapiens
WGPWPLLML

SEQ ID NO: 1001139 - protein, 9 aa, Homo Sapiens
TTENGAEPL

SEQ ID NO: 1001140 - protein, 9 aa, Homo Sapiens
QSSHFTRHK

SEQ ID NO: 1001141 - protein, 9 aa, Homo Sapiens
KLLAQQHSP

SEQ ID NO: 1001142 - protein, 9 aa, Homo Sapiens
LSTECDFHP

SEQ ID NO: 1001143 - protein, 9 aa, Homo Sapiens
VSDEMVSLF

SEQ ID NO: 1001144 - protein, 9 aa, Homo Sapiens
AISPLENAI

SEQ ID NO: 1001145 - protein, 9 aa, Homo Sapiens
LEKDIEADQ

SEQ ID NO: 1001146 - protein, 9 aa, Homo Sapiens
PFSMSCDLQ

SEQ ID NO: 1001147 - protein, 9 aa, Homo Sapiens
GVTCLRPNI

SEQ ID NO: 1001148 - protein, 9 aa, Homo Sapiens
DIQHAILTK

SEQ ID NO: 1001149 - protein, 9 aa, Homo Sapiens
GSDKFERSS

SEQ ID NO: 1001150 - protein, 9 aa, Homo Sapiens
FSPQQENRK

SEQ ID NO: 1001151 - protein, 9 aa, Homo Sapiens
FFVGSRLAV

SEQ ID NO: 1001152 - protein, 9 aa, Homo Sapiens
PEKKPKFRS

SEQ ID NO: 1001153 - protein, 9 aa, Homo Sapiens
LMHHSPQVD

SEQ ID NO: 1001154 - protein, 9 aa, Homo Sapiens
WGPECNYLC

SEQ ID NO: 1001155 - protein, 9 aa, Homo Sapiens
LFLHQRRPP

SEQ ID NO: 1001156 - protein, 9 aa, Homo Sapiens
DEHHPGTTF

SEQ ID NO: 1001157 - protein, 9 aa, Homo Sapiens
SLPVTTKEN

SEQ ID NO: 1001158 - protein, 9 aa, Homo Sapiens
RIRVEFLLV

SEQ ID NO: 1001159 - protein, 9 aa, Homo Sapiens
GSSASQTGV

SEQ ID NO: 1001160 - protein, 9 aa, Homo Sapiens
RLKKLNLVN

SEQ ID NO: 1001161 - protein, 9 aa, Homo Sapiens
EAMLTGECV

SEQ ID NO: 1001162 - protein, 9 aa, Homo Sapiens
SDILETVPL

SEQ ID NO: 1001163 - protein, 9 aa, Homo Sapiens
RVEFLLVTA

SEQ ID NO: 1001164 - protein, 9 aa, Homo Sapiens
KKSENVDSA

SEQ ID NO: 1001165 - protein, 9 aa, Homo Sapiens
MVEKARRLQ

SEQ ID NO: 1001166 - protein, 9 aa, Homo Sapiens
DYFLKVSLQ

SEQ ID NO: 1001167 - protein, 9 aa, Homo Sapiens
PEKEMFKMV

SEQ ID NO: 1001168 - protein, 9 aa, Homo Sapiens
YTVNWYYSQ

SEQ ID NO: 1001169 - protein, 9 aa, Homo Sapiens
MGDLIRRVA

SEQ ID NO: 1001170 - protein, 9 aa, Homo Sapiens
SDSNTESVQ

SEQ ID NO: 1001171 - protein, 9 aa, Homo Sapiens
VEDVMMSLE

SEQ ID NO: 1001172 - protein, 9 aa, Homo Sapiens
APLLKYKEK

SEQ ID NO: 1001173 - protein, 9 aa, Homo Sapiens
RKFFKMNPN

SEQ ID NO: 1001174 - protein, 9 aa, Homo Sapiens
KMSSKGAGT

SEQ ID NO: 1001175 - protein, 9 aa, Homo Sapiens
NVPDSVVQG

SEQ ID NO: 1001176 - protein, 9 aa, Homo Sapiens
KYNEVMATY

SEQ ID NO: 1001177 - protein, 9 aa, Homo Sapiens
PSDSSRHLP

SEQ ID NO: 1001178 - protein, 9 aa, Homo Sapiens
NLELTFNLK

SEQ ID NO: 1001179 - protein, 9 aa, Homo Sapiens
LSKPSAYIC

SEQ ID NO: 1001180 - protein, 9 aa, Homo Sapiens
GTLNTLANV

SEQ ID NO: 1001181 - protein, 9 aa, Homo Sapiens
EIYTASVSE

SEQ ID NO: 1001182 - protein, 9 aa, Homo Sapiens
KGEMWQNII

SEQ ID NO: 1001183 - protein, 9 aa, Homo Sapiens
KNELSDHLN

SEQ ID NO: 1001184 - protein, 9 aa, Homo Sapiens
FLACPFSTG

SEQ ID NO: 1001185 - protein, 9 aa, Homo Sapiens
STPSPYELS

SEQ ID NO: 1001186 - protein, 9 aa, Homo Sapiens
SCPEIKTSD

SEQ ID NO: 1001187 - protein, 9 aa, Homo Sapiens
SSSAPPKTT

SEQ ID NO: 1001188 - protein, 9 aa, Homo Sapiens
THNKKKAHK

SEQ ID NO: 1001189 - protein, 9 aa, Homo Sapiens
ENSGLSLPT

SEQ ID NO: 1001190 - protein, 9 aa, Homo Sapiens
ENCNEFFCP

SEQ ID NO: 1001191 - protein, 9 aa, Homo Sapiens
CRRPRPWLS

SEQ ID NO: 1001192 - protein, 9 aa, Homo Sapiens
SSLVFNISD

SEQ ID NO: 1001193 - protein, 9 aa, Homo Sapiens
RVGGSGEAL

SEQ ID NO: 1001194 - protein, 9 aa, Homo Sapiens
ACETCANDN

SEQ ID NO: 1001195 - protein, 9 aa, Homo Sapiens
APSLLLSSD

SEQ ID NO: 1001196 - protein, 9 aa, Homo Sapiens
WKIEDISAN

SEQ ID NO: 1001197 - protein, 9 aa, Homo Sapiens
NSSKFSAHR

SEQ ID NO: 1001198 - protein, 9 aa, Homo Sapiens
HGKFASVFY

SEQ ID NO: 1001199 - protein, 9 aa, Homo Sapiens
VCIYRLTCI

SEQ ID NO: 1001200 - protein, 9 aa, Homo Sapiens
DQEILMHHS

SEQ ID NO: 1001201 - protein, 9 aa, Homo Sapiens
DKVFRFFEA

SEQ ID NO: 1001202 - protein, 9 aa, Homo Sapiens
SDAFKISIP

SEQ ID NO: 1001203 - protein, 9 aa, Homo Sapiens
NAKGLGLQG

SEQ ID NO: 1001204 - protein, 9 aa, Homo Sapiens
SFDLDSWTL

SEQ ID NO: 1001205 - protein, 9 aa, Homo Sapiens
AMENWDLIT

SEQ ID NO: 1001206 - protein, 9 aa, Homo Sapiens
IGKWSISGS

SEQ ID NO: 1001207 - protein, 9 aa, Homo Sapiens
AKKHAHQIQ

SEQ ID NO: 1001208 - protein, 9 aa, Homo Sapiens
RPFDSFFLD

SEQ ID NO: 1001209 - protein, 9 aa, Homo Sapiens
LKADEPLSE

SEQ ID NO: 1001210 - protein, 9 aa, Homo Sapiens
PQTQGKDCS

SEQ ID NO: 1001211 - protein, 9 aa, Homo Sapiens
SHGQPCQIF

SEQ ID NO: 1001212 - protein, 9 aa, Homo Sapiens
NRKQLLCGR

SEQ ID NO: 1001213 - protein, 9 aa, Homo Sapiens
VPMCFYQME

SEQ ID NO: 1001214 - protein, 9 aa, Homo Sapiens
EDGQVSPES

SEQ ID NO: 1001215 - protein, 9 aa, Homo Sapiens
LAQQEEEER

SEQ ID NO: 1001216 - protein, 9 aa, Homo Sapiens
YFFVGSRLA

SEQ ID NO: 1001217 - protein, 9 aa, Homo Sapiens
VFVSINIGM

SEQ ID NO: 1001218 - protein, 9 aa, Homo Sapiens
KKQQETIDK

SEQ ID NO: 1001219 - protein, 9 aa, Homo Sapiens
GATRGHSCP

SEQ ID NO: 1001220 - protein, 9 aa, Homo Sapiens
SHGFKEKAL

SEQ ID NO: 1001221 - protein, 9 aa, Homo Sapiens
SAPAWTSLG

SEQ ID NO: 1001222 - protein, 9 aa, Homo Sapiens
GSGSEELIR

SEQ ID NO: 1001223 - protein, 9 aa, Homo Sapiens
FNFTAPSVL

SEQ ID NO: 1001224 - protein, 9 aa, Homo Sapiens
ALTLQCQGW

SEQ ID NO: 1001225 - protein, 9 aa, Homo Sapiens
VSINIGMVS

SEQ ID NO: 1001226 - protein, 9 aa, Homo Sapiens
CGALKNVVV

SEQ ID NO: 1001227 - protein, 9 aa, Homo Sapiens
QGHLTHYTL

SEQ ID NO: 1001228 - protein, 9 aa, Homo Sapiens
PESVHKLQD

SEQ ID NO: 1001229 - protein, 9 aa, Homo Sapiens
ATYNRFLYV

SEQ ID NO: 1001230 - protein, 9 aa, Homo Sapiens
MSLEGRIED

SEQ ID NO: 1001231 - protein, 9 aa, Homo Sapiens
AWTSLGITS

SEQ ID NO: 1001232 - protein, 9 aa, Homo Sapiens
LSTILPTEG

SEQ ID NO: 1001233 - protein, 9 aa, Homo Sapiens
SLLQPVNEN

SEQ ID NO: 1001234 - protein, 9 aa, Homo Sapiens
QAFLSIHGM

SEQ ID NO: 1001235 - protein, 9 aa, Homo Sapiens
CDDNYYIFC

SEQ ID NO: 1001236 - protein, 9 aa, Homo Sapiens
IPKVLTELG

SEQ ID NO: 1001237 - protein, 9 aa, Homo Sapiens
EDLCVSVLC

SEQ ID NO: 1001238 - protein, 9 aa, Homo Sapiens
WGCALEATK

SEQ ID NO: 1001239 - protein, 9 aa, Homo Sapiens
PPISHDGLR

SEQ ID NO: 1001240 - protein, 9 aa, Homo Sapiens
VPIAPIHLS

SEQ ID NO: 1001241 - protein, 9 aa, Homo Sapiens
ADVAVASLT

SEQ ID NO: 1001242 - protein, 9 aa, Homo Sapiens
LPDPEKPVC

SEQ ID NO: 1001243 - protein, 9 aa, Homo Sapiens
WTCVPEYQS

SEQ ID NO: 1001244 - protein, 9 aa, Homo Sapiens
MNKGVFIKL

SEQ ID NO: 1001245 - protein, 9 aa, Homo Sapiens
HGETNGIYE

SEQ ID NO: 1001246 - protein, 9 aa, Homo Sapiens
AYCFHYTLC

SEQ ID NO: 1001247 - protein, 9 aa, Homo Sapiens
FKISHLRTA

SEQ ID NO: 1001248 - protein, 9 aa, Homo Sapiens
FTARVLSGS

SEQ ID NO: 1001249 - protein, 9 aa, Homo Sapiens
LANVPDSVV

SEQ ID NO: 1001250 - protein, 9 aa, Homo Sapiens
VLLLQERSN

SEQ ID NO: 1001251 - protein, 9 aa, Homo Sapiens
SRFSYYNSL

SEQ ID NO: 1001252 - protein, 9 aa, Homo Sapiens
LMLQLLWLL

SEQ ID NO: 1001253 - protein, 9 aa, Homo Sapiens
RIQESCGIA

SEQ ID NO: 1001254 - protein, 9 aa, Homo Sapiens
LLRKLQVDV

SEQ ID NO: 1001255 - protein, 9 aa, Homo Sapiens
PPPISSSKR

SEQ ID NO: 1001256 - protein, 9 aa, Homo Sapiens
YMGRTSFDL

SEQ ID NO: 1001257 - protein, 9 aa, Homo Sapiens
PEECCDLYE

SEQ ID NO: 1001258 - protein, 9 aa, Homo Sapiens
KPKWPPENE

SEQ ID NO: 1001259 - protein, 9 aa, Homo Sapiens
KKETLKNRV

SEQ ID NO: 1001260 - protein, 9 aa, Homo Sapiens
DQSRLGKKS

SEQ ID NO: 1001261 - protein, 9 aa, Homo Sapiens
AQEPPAPSP

SEQ ID NO: 1001262 - protein, 9 aa, Homo Sapiens
AVWKAMFAR

SEQ ID NO: 1001263 - protein, 9 aa, Homo Sapiens
GETPALLKL

SEQ ID NO: 1001264 - protein, 9 aa, Homo Sapiens
KPHDIFKAN

SEQ ID NO: 1001265 - protein, 9 aa, Homo Sapiens
RSQDMQAAV

SEQ ID NO: 1001266 - protein, 9 aa, Homo Sapiens
QPTVLQPNP

SEQ ID NO: 1001267 - protein, 9 aa, Homo Sapiens
EFSAEIQPP

SEQ ID NO: 1001268 - protein, 9 aa, Homo Sapiens
FSQRRKRQA

SEQ ID NO: 1001269 - protein, 9 aa, Homo Sapiens
KVFVRRGFR

SEQ ID NO: 1001270 - protein, 9 aa, Homo Sapiens
QAEEFSGRS

SEQ ID NO: 1001271 - protein, 9 aa, Homo Sapiens
ENSCAWCPQ

SEQ ID NO: 1001272 - protein, 9 aa, Homo Sapiens
SLGCSGGCS

SEQ ID NO: 1001273 - protein, 9 aa, Homo Sapiens
VYLGEDLKS

SEQ ID NO: 1001274 - protein, 9 aa, Homo Sapiens
ANPVALKIL

SEQ ID NO: 1001275 - protein, 9 aa, Homo Sapiens
AAKLKVKHC

SEQ ID NO: 1001276 - protein, 9 aa, Homo Sapiens
KQVPIAPIH

SEQ ID NO: 1001277 - protein, 9 aa, Homo Sapiens
MHLKKQQET

SEQ ID NO: 1001278 - protein, 9 aa, Homo Sapiens
TVNWYYSQT

SEQ ID NO: 1001279 - protein, 9 aa, Homo Sapiens
MKFRKQQDL

SEQ ID NO: 1001280 - protein, 9 aa, Homo Sapiens
TYRTQVSSC

SEQ ID NO: 1001281 - protein, 9 aa, Homo Sapiens
KTSLTEKSF

SEQ ID NO: 1001282 - protein, 9 aa, Homo Sapiens
LQVYCDMKT

SEQ ID NO: 1001283 - protein, 9 aa, Homo Sapiens
YDDYKPPYA

SEQ ID NO: 1001284 - protein, 9 aa, Homo Sapiens
EKMRHNYFI

SEQ ID NO: 1001285 - protein, 9 aa, Homo Sapiens
AEDSTAQKN

SEQ ID NO: 1001286 - protein, 9 aa, Homo Sapiens
AEMEQKVAE

SEQ ID NO: 1001287 - protein, 9 aa, Homo Sapiens
ERSNLGTGV

SEQ ID NO: 1001288 - protein, 9 aa, Homo Sapiens
VSTTSSRKS

SEQ ID NO: 1001289 - protein, 9 aa, Homo Sapiens
STENYSEDE

SEQ ID NO: 1001290 - protein, 9 aa, Homo Sapiens
RPKLIRIGC

SEQ ID NO: 1001291 - protein, 9 aa, Homo Sapiens
CRQEDVGFC

SEQ ID NO: 1001292 - protein, 9 aa, Homo Sapiens
WRELEGSGL

SEQ ID NO: 1001293 - protein, 9 aa, Homo Sapiens
ASEDKVFVR

SEQ ID NO: 1001294 - protein, 9 aa, Homo Sapiens
LEERLVSMG

SEQ ID NO: 1001295 - protein, 9 aa, Homo Sapiens
PALECRRCY

SEQ ID NO: 1001296 - protein, 9 aa, Homo Sapiens
AYYLHYSPW

SEQ ID NO: 1001297 - protein, 9 aa, Homo Sapiens
LGVNSCTAY

SEQ ID NO: 1001298 - protein, 9 aa, Homo Sapiens
CPEKETSSL

SEQ ID NO: 1001299 - protein, 9 aa, Homo Sapiens
IAHMHLKKQ

SEQ ID NO: 1001300 - protein, 9 aa, Homo Sapiens
EKKTSPHFQ

SEQ ID NO: 1001301 - protein, 9 aa, Homo Sapiens
EEDEGEEDF

SEQ ID NO: 1001302 - protein, 9 aa, Homo Sapiens
LVRQEACIS

SEQ ID NO: 1001303 - protein, 9 aa, Homo Sapiens
CSKCGEGFS

SEQ ID NO: 1001304 - protein, 9 aa, Homo Sapiens
KNTYKSIQI

SEQ ID NO: 1001305 - protein, 9 aa, Homo Sapiens
SFAHKPLLL

SEQ ID NO: 1001306 - protein, 9 aa, Homo Sapiens
AVAAAVCGS

SEQ ID NO: 1001307 - protein, 9 aa, Homo Sapiens
ASGKPEECC

SEQ ID NO: 1001308 - protein, 9 aa, Homo Sapiens
PVPPTGDFG

SEQ ID NO: 1001309 - protein, 9 aa, Homo Sapiens
SNVLDMPVD

SEQ ID NO: 1001310 - protein, 9 aa, Homo Sapiens
RQHSKHVGL

SEQ ID NO: 1001311 - protein, 9 aa, Homo Sapiens
CSHKEDAGV

SEQ ID NO: 1001312 - protein, 9 aa, Homo Sapiens
LGLGENLLS

SEQ ID NO: 1001313 - protein, 9 aa, Homo Sapiens
FNGQDRNQR

SEQ ID NO: 1001314 - protein, 9 aa, Homo Sapiens
SIFLRLRAG

SEQ ID NO: 1001315 - protein, 9 aa, Homo Sapiens
EECGKAYSR

SEQ ID NO: 1001316 - protein, 9 aa, Homo Sapiens
LLPFSSPSL

SEQ ID NO: 1001317 - protein, 9 aa, Homo Sapiens
QLRLWERQK

SEQ ID NO: 1001318 - protein, 9 aa, Homo Sapiens
GRFPKATDQ

SEQ ID NO: 1001319 - protein, 9 aa, Homo Sapiens
GCGLSCCQS

SEQ ID NO: 1001320 - protein, 9 aa, Homo Sapiens
ETTSEALSL

SEQ ID NO: 1001321 - protein, 9 aa, Homo Sapiens
FTVWKHFSG

SEQ ID NO: 1001322 - protein, 9 aa, Homo Sapiens
EKETSSLNP

SEQ ID NO: 1001323 - protein, 9 aa, Homo Sapiens
NFAERHILS

SEQ ID NO: 1001324 - protein, 9 aa, Homo Sapiens
SEADPASLL

SEQ ID NO: 1001325 - protein, 9 aa, Homo Sapiens
FNKEILLGC

SEQ ID NO: 1001326 - protein, 9 aa, Homo Sapiens
CKVVFFQQE

SEQ ID NO: 1001327 - protein, 9 aa, Homo Sapiens
KRILALAQK

SEQ ID NO: 1001328 - protein, 9 aa, Homo Sapiens
LTEKEAKHC

SEQ ID NO: 1001329 - protein, 9 aa, Homo Sapiens
PYQLLLKYA

SEQ ID NO: 1001330 - protein, 9 aa, Homo Sapiens
VKTCEVGAW

SEQ ID NO: 1001331 - protein, 9 aa, Homo Sapiens
LKYDQLVIS

SEQ ID NO: 1001332 - protein, 9 aa, Homo Sapiens
ATPLPPESI

SEQ ID NO: 1001333 - protein, 9 aa, Homo Sapiens
RDPPHKPGS

SEQ ID NO: 1001334 - protein, 9 aa, Homo Sapiens
MPRWQTCIS

SEQ ID NO: 1001335 - protein, 9 aa, Homo Sapiens
PLQRGQTEK

SEQ ID NO: 1001336 - protein, 9 aa, Homo Sapiens
QHSKHVGLD

SEQ ID NO: 1001337 - protein, 9 aa, Homo Sapiens
DVLVSFSFN

SEQ ID NO: 1001338 - protein, 9 aa, Homo Sapiens
NPSHGQPCQ

SEQ ID NO: 1001339 - protein, 9 aa, Homo Sapiens
LAVTNKERL

SEQ ID NO: 1001340 - protein, 9 aa, Homo Sapiens
LKYKEKIED

SEQ ID NO: 1001341 - protein, 9 aa, Homo Sapiens
YKPHFVSNF

SEQ ID NO: 1001342 - protein, 9 aa, Homo Sapiens
SVASPDTQL

SEQ ID NO: 1001343 - protein, 9 aa, Homo Sapiens
AKFSSGSQR

SEQ ID NO: 1001344 - protein, 9 aa, Homo Sapiens
SEEPFNIWG

SEQ ID NO: 1001345 - protein, 9 aa, Homo Sapiens
QQKKEASGR

SEQ ID NO: 1001346 - protein, 9 aa, Homo Sapiens
RVQLEACET

SEQ ID NO: 1001347 - protein, 9 aa, Homo Sapiens
RPNPAAPMT

SEQ ID NO: 1001348 - protein, 9 aa, Homo Sapiens
RLCFFLFVE

SEQ ID NO: 1001349 - protein, 9 aa, Homo Sapiens
DQVQKLEEC

SEQ ID NO: 1001350 - protein, 9 aa, Homo Sapiens
REEEKKEES

SEQ ID NO: 1001351 - protein, 9 aa, Homo Sapiens
LGIPWDGKT

SEQ ID NO: 1001352 - protein, 9 aa, Homo Sapiens
KAICQIIEH

SEQ ID NO: 1001353 - protein, 9 aa, Homo Sapiens
CFAKQHLDS

SEQ ID NO: 1001354 - protein, 9 aa, Homo Sapiens
SANELIAII

SEQ ID NO: 1001355 - protein, 9 aa, Homo Sapiens
LFFGKFSSP

SEQ ID NO: 1001356 - protein, 9 aa, Homo Sapiens
LHRPKLIRI

SEQ ID NO: 1001357 - protein, 9 aa, Homo Sapiens
PGEKGEKKE

SEQ ID NO: 1001358 - protein, 9 aa, Homo Sapiens
LAAASFKHV

SEQ ID NO: 1001359 - protein, 9 aa, Homo Sapiens
QVFQSSGWL

SEQ ID NO: 1001360 - protein, 9 aa, Homo Sapiens
TDGAVYVME

SEQ ID NO: 1001361 - protein, 9 aa, Homo Sapiens
DKNKMGLTG

SEQ ID NO: 1001362 - protein, 9 aa, Homo Sapiens
AVCGSGARR

SEQ ID NO: 1001363 - protein, 9 aa, Homo Sapiens
YCGVPVLPA

SEQ ID NO: 1001364 - protein, 9 aa, Homo Sapiens
PISHDGLRQ

SEQ ID NO: 1001365 - protein, 9 aa, Homo Sapiens
FGAPPVPPT

SEQ ID NO: 1001366 - protein, 9 aa, Homo Sapiens
DVALMNHSY

SEQ ID NO: 1001367 - protein, 9 aa, Homo Sapiens
SATCKQITS

SEQ ID NO: 1001368 - protein, 9 aa, Homo Sapiens
THLWKNVPR

SEQ ID NO: 1001369 - protein, 9 aa, Homo Sapiens
AIKKIPERD

SEQ ID NO: 1001370 - protein, 9 aa, Homo Sapiens
GQWGLPFSP

SEQ ID NO: 1001371 - protein, 9 aa, Homo Sapiens
QGAWWYANC

SEQ ID NO: 1001372 - protein, 9 aa, Homo Sapiens
VCLNVKYDK

SEQ ID NO: 1001373 - protein, 9 aa, Homo Sapiens
KTVILADEL

SEQ ID NO: 1001374 - protein, 9 aa, Homo Sapiens
CPFSTGLWG

SEQ ID NO: 1001375 - protein, 9 aa, Homo Sapiens
RQGKASEAQ

SEQ ID NO: 1001376 - protein, 9 aa, Homo Sapiens
LKGLRLKLP

SEQ ID NO: 1001377 - protein, 9 aa, Homo Sapiens
TLAFALRSW

SEQ ID NO: 1001378 - protein, 9 aa, Homo Sapiens
MGCTALFLL

SEQ ID NO: 1001379 - protein, 9 aa, Homo Sapiens
RVSTADQSV

SEQ ID NO: 1001380 - protein, 9 aa, Homo Sapiens
GALKNFVIS

SEQ ID NO: 1001381 - protein, 9 aa, Homo Sapiens
WDLITYRET

SEQ ID NO: 1001382 - protein, 9 aa, Homo Sapiens
PEMTSYLDI

SEQ ID NO: 1001383 - protein, 9 aa, Homo Sapiens
SVTALETLS

SEQ ID NO: 1001384 - protein, 9 aa, Homo Sapiens
CIPLQRGQT

SEQ ID NO: 1001385 - protein, 9 aa, Homo Sapiens
VTHSNNKTS

SEQ ID NO: 1001386 - protein, 9 aa, Homo Sapiens
LSDHLNAMD

SEQ ID NO: 1001387 - protein, 9 aa, Homo Sapiens
SQGHSLELL

SEQ ID NO: 1001388 - protein, 9 aa, Homo Sapiens
KVSANNGEI

SEQ ID NO: 1001389 - protein, 9 aa, Homo Sapiens
VVSWAYQFP

SEQ ID NO: 1001390 - protein, 9 aa, Homo Sapiens
VLLQRAEKT

SEQ ID NO: 1001391 - protein, 9 aa, Homo Sapiens
IYRLTCIYT

SEQ ID NO: 1001392 - protein, 9 aa, Homo Sapiens
KPSLSVQPV

SEQ ID NO: 1001393 - protein, 9 aa, Homo Sapiens
QVLGLLNRK

SEQ ID NO: 1001394 - protein, 9 aa, Homo Sapiens
FLSIHGMCG

SEQ ID NO: 1001395 - protein, 9 aa, Homo Sapiens
YVLLGAVVV

SEQ ID NO: 1001396 - protein, 9 aa, Homo Sapiens
GQQKKEASG

SEQ ID NO: 1001397 - protein, 9 aa, Homo Sapiens
VSKASGKPE

SEQ ID NO: 1001398 - protein, 9 aa, Homo Sapiens
PEALAAKLK

SEQ ID NO: 1001399 - protein, 9 aa, Homo Sapiens
RARLECRGR

SEQ ID NO: 1001400 - protein, 9 aa, Homo Sapiens
GMLPLYGSD

SEQ ID NO: 1001401 - protein, 9 aa, Homo Sapiens
DPELIAAVV

SEQ ID NO: 1001402 - protein, 9 aa, Homo Sapiens
QGAPDVISL

SEQ ID NO: 1001403 - protein, 9 aa, Homo Sapiens
FPPAGNLVC

SEQ ID NO: 1001404 - protein, 9 aa, Homo Sapiens
NLVCHNHHN

SEQ ID NO: 1001405 - protein, 9 aa, Homo Sapiens
GASEDKVFV

SEQ ID NO: 1001406 - protein, 9 aa, Homo Sapiens
FRCGTCFVT

SEQ ID NO: 1001407 - protein, 9 aa, Homo Sapiens
SAVYCICLG

SEQ ID NO: 1001408 - protein, 9 aa, Homo Sapiens
MAPNPSNGA

SEQ ID NO: 1001409 - protein, 9 aa, Homo Sapiens
QDYGFFLFC

SEQ ID NO: 1001410 - protein, 9 aa, Homo Sapiens
GLRQDMAHS

SEQ ID NO: 1001411 - protein, 9 aa, Homo Sapiens
EALGILAAA

SEQ ID NO: 1001412 - protein, 9 aa, Homo Sapiens
LCQGVALVE

SEQ ID NO: 1001413 - protein, 9 aa, Homo Sapiens
KSCGNRNKT

SEQ ID NO: 1001414 - protein, 9 aa, Homo Sapiens
MIMNKGVFI

SEQ ID NO: 1001415 - protein, 9 aa, Homo Sapiens
LKNAAPSSR

SEQ ID NO: 1001416 - protein, 9 aa, Homo Sapiens
IPLAIKLKK

SEQ ID NO: 1001417 - protein, 9 aa, Homo Sapiens
KSKKETLKN

SEQ ID NO: 1001418 - protein, 9 aa, Homo Sapiens
HAYCFHYTL

SEQ ID NO: 1001419 - protein, 9 aa, Homo Sapiens
CNLTFWGEL

SEQ ID NO: 1001420 - protein, 9 aa, Homo Sapiens
VRISLLLLL

SEQ ID NO: 1001421 - protein, 9 aa, Homo Sapiens
APWNKTRVV

SEQ ID NO: 1001422 - protein, 9 aa, Homo Sapiens
TFGSVHPSN

SEQ ID NO: 1001423 - protein, 9 aa, Homo Sapiens
IRVEFLLVT

SEQ ID NO: 1001424 - protein, 9 aa, Homo Sapiens
TVVDPEMTS

SEQ ID NO: 1001425 - protein, 9 aa, Homo Sapiens
VAKKVAGPA

SEQ ID NO: 1001426 - protein, 9 aa, Homo Sapiens
VAYYLHYSP

SEQ ID NO: 1001427 - protein, 9 aa, Homo Sapiens
QEACISWFG

SEQ ID NO: 1001428 - protein, 9 aa, Homo Sapiens
MTKKKPEKK

SEQ ID NO: 1001429 - protein, 9 aa, Homo Sapiens
QGIHSWRTF

SEQ ID NO: 1001430 - protein, 9 aa, Homo Sapiens
TSSQFSAEA

SEQ ID NO: 1001431 - protein, 9 aa, Homo Sapiens
SLAIMRNGV

SEQ ID NO: 1001432 - protein, 9 aa, Homo Sapiens
SASFCHMSL

SEQ ID NO: 1001433 - protein, 9 aa, Homo Sapiens
LPKPPDPRC

SEQ ID NO: 1001434 - protein, 9 aa, Homo Sapiens
LGKKSRREV

SEQ ID NO: 1001435 - protein, 9 aa, Homo Sapiens
PVFPPRLDR

SEQ ID NO: 1001436 - protein, 9 aa, Homo Sapiens
LHQRRPPKL

SEQ ID NO: 1001437 - protein, 9 aa, Homo Sapiens
IFSADLVLL

SEQ ID NO: 1001438 - protein, 9 aa, Homo Sapiens
PLQVYCDMK

SEQ ID NO: 1001439 - protein, 9 aa, Homo Sapiens
ADMKLRTFS

SEQ ID NO: 1001440 - protein, 9 aa, Homo Sapiens
ADHEAQLLE

SEQ ID NO: 1001441 - protein, 9 aa, Homo Sapiens
KIMKLTLPE

SEQ ID NO: 1001442 - protein, 9 aa, Homo Sapiens
QNQNCSNSE

SEQ ID NO: 1001443 - protein, 9 aa, Homo Sapiens
YGTKKSCMP

SEQ ID NO: 1001444 - protein, 9 aa, Homo Sapiens
HTGTVEFKG

SEQ ID NO: 1001445 - protein, 9 aa, Homo Sapiens
KAKVTEPKK

SEQ ID NO: 1001446 - protein, 9 aa, Homo Sapiens
PPRKDGLPG

SEQ ID NO: 1001447 - protein, 9 aa, Homo Sapiens
KRPRLVILD

SEQ ID NO: 1001448 - protein, 9 aa, Homo Sapiens
EKDIEADQT

SEQ ID NO: 1001449 - protein, 9 aa, Homo Sapiens
LLSAIESTA

SEQ ID NO: 1001450 - protein, 9 aa, Homo Sapiens
ILSLLKYFS

SEQ ID NO: 1001451 - protein, 9 aa, Homo Sapiens
SRTTPIPEY

SEQ ID NO: 1001452 - protein, 9 aa, Homo Sapiens
MPTVIYVFP

SEQ ID NO: 1001453 - protein, 9 aa, Homo Sapiens
LGENLLSHL

SEQ ID NO: 1001454 - protein, 9 aa, Homo Sapiens
SPIFVYLFP

SEQ ID NO: 1001455 - protein, 9 aa, Homo Sapiens
IPQNHSESF

SEQ ID NO: 1001456 - protein, 9 aa, Homo Sapiens
NIAHVDGIP

SEQ ID NO: 1001457 - protein, 9 aa, Homo Sapiens
DAGVVCTSE

SEQ ID NO: 1001458 - protein, 9 aa, Homo Sapiens
PSIFNSDLA

SEQ ID NO: 1001459 - protein, 9 aa, Homo Sapiens
FACAEKDDG

SEQ ID NO: 1001460 - protein, 9 aa, Homo Sapiens
FVQDYGFFL

SEQ ID NO: 1001461 - protein, 9 aa, Homo Sapiens
IQLMFINEA

SEQ ID NO: 1001462 - protein, 9 aa, Homo Sapiens
KHVGLDNDL

SEQ ID NO: 1001463 - protein, 9 aa, Homo Sapiens
LRDWRWHIF

SEQ ID NO: 1001464 - protein, 9 aa, Homo Sapiens
PDGTFYVAD

SEQ ID NO: 1001465 - protein, 9 aa, Homo Sapiens
KCRLLLFYQ

SEQ ID NO: 1001466 - protein, 9 aa, Homo Sapiens
GMLEERLVS

SEQ ID NO: 1001467 - protein, 9 aa, Homo Sapiens
MRNGVTHWS

SEQ ID NO: 1001468 - protein, 9 aa, Homo Sapiens
TLDVLVSFS

SEQ ID NO: 1001469 - protein, 9 aa, Homo Sapiens
NSEEENLFE

SEQ ID NO: 1001470 - protein, 9 aa, Homo Sapiens
TLGVSFPSS

SEQ ID NO: 1001471 - protein, 9 aa, Homo Sapiens
RDDMKRHSS

SEQ ID NO: 1001472 - protein, 9 aa, Homo Sapiens
LPSPPLPYC

SEQ ID NO: 1001473 - protein, 9 aa, Homo Sapiens
KVAPAKARP

SEQ ID NO: 1001474 - protein, 9 aa, Homo Sapiens
HSNNKTSLT

SEQ ID NO: 1001475 - protein, 9 aa, Homo Sapiens
NLTVMDRDE

SEQ ID NO: 1001476 - protein, 9 aa, Homo Sapiens
QKDTIYKFE

SEQ ID NO: 1001477 - protein, 9 aa, Homo Sapiens
PLENNTGFQ

SEQ ID NO: 1001478 - protein, 9 aa, Homo Sapiens
SSVPSDQSS

SEQ ID NO: 1001479 - protein, 9 aa, Homo Sapiens
PLERGQQKK

SEQ ID NO: 1001480 - protein, 9 aa, Homo Sapiens
SFFGLQVLL

SEQ ID NO: 1001481 - protein, 9 aa, Homo Sapiens
LYQKHQRAK

SEQ ID NO: 1001482 - protein, 9 aa, Homo Sapiens
VLFFFLLLG

SEQ ID NO: 1001483 - protein, 9 aa, Homo Sapiens
RTMRLVFKI

SEQ ID NO: 1001484 - protein, 9 aa, Homo Sapiens
AVAPKNMIF

SEQ ID NO: 1001485 - protein, 9 aa, Homo Sapiens
EETSSTFQL

SEQ ID NO: 1001486 - protein, 9 aa, Homo Sapiens
VVPDTVVEP

SEQ ID NO: 1001487 - protein, 9 aa, Homo Sapiens
TSSRKSFKS

SEQ ID NO: 1001488 - protein, 9 aa, Homo Sapiens
KDNISPAYM

SEQ ID NO: 1001489 - protein, 9 aa, Homo Sapiens
YCLDRGILF

SEQ ID NO: 1001490 - protein, 9 aa, Homo Sapiens
NWRSCICNS

SEQ ID NO: 1001491 - protein, 9 aa, Homo Sapiens
ICLVSIYRT

SEQ ID NO: 1001492 - protein, 9 aa, Homo Sapiens
SRTQVWLYE

SEQ ID NO: 1001493 - protein, 9 aa, Homo Sapiens
QVPIAPIHL

SEQ ID NO: 1001494 - protein, 9 aa, Homo Sapiens
LGRLLSISP

SEQ ID NO: 1001495 - protein, 9 aa, Homo Sapiens
EEGALVPLE

SEQ ID NO: 1001496 - protein, 9 aa, Homo Sapiens
TFHGDSHAT

SEQ ID NO: 1001497 - protein, 9 aa, Homo Sapiens
DSLTLDSDL

SEQ ID NO: 1001498 - protein, 9 aa, Homo Sapiens
SAGLGRPSM

SEQ ID NO: 1001499 - protein, 9 aa, Homo Sapiens
KMCNADYAD

SEQ ID NO: 1001500 - protein, 9 aa, Homo Sapiens
CEVGAWCPV

SEQ ID NO: 1001501 - protein, 9 aa, Homo Sapiens
EELPMMRRA

SEQ ID NO: 1001502 - protein, 9 aa, Homo Sapiens
VPILRDGEY

SEQ ID NO: 1001503 - protein, 9 aa, Homo Sapiens
LDSNKLTRV

SEQ ID NO: 1001504 - protein, 9 aa, Homo Sapiens
RDSNKTTGL

SEQ ID NO: 1001505 - protein, 9 aa, Homo Sapiens
VLGRVTQLC

SEQ ID NO: 1001506 - protein, 9 aa, Homo Sapiens
KGRRLVEDV

SEQ ID NO: 1001507 - protein, 9 aa, Homo Sapiens
QLYLENLNK

SEQ ID NO: 1001508 - protein, 9 aa, Homo Sapiens
WSTSMPQLG

SEQ ID NO: 1001509 - protein, 9 aa, Homo Sapiens
SHGQHESGT

SEQ ID NO: 1001510 - protein, 9 aa, Homo Sapiens
AEACSTTEN

SEQ ID NO: 1001511 - protein, 9 aa, Homo Sapiens
EGRFPKATD

SEQ ID NO: 1001512 - protein, 9 aa, Homo Sapiens
TKEGKGREG

SEQ ID NO: 1001513 - protein, 9 aa, Homo Sapiens
LFIQLMFIN

SEQ ID NO: 1001514 - protein, 9 aa, Homo Sapiens
LSIAPVIVP

SEQ ID NO: 1001515 - protein, 9 aa, Homo Sapiens
GAEISSLAV

SEQ ID NO: 1001516 - protein, 9 aa, Homo Sapiens
IEGYGIRLP

SEQ ID NO: 1001517 - protein, 9 aa, Homo Sapiens
ISLHRHDNG

SEQ ID NO: 1001518 - protein, 9 aa, Homo Sapiens
SRPQTQGKD

SEQ ID NO: 1001519 - protein, 9 aa, Homo Sapiens
EFFSQDLKK

SEQ ID NO: 1001520 - protein, 9 aa, Homo Sapiens
PYELSYPQG

SEQ ID NO: 1001521 - protein, 9 aa, Homo Sapiens
HLTGMDRRE

SEQ ID NO: 1001522 - protein, 9 aa, Homo Sapiens
HKPTGPWEQ

SEQ ID NO: 1001523 - protein, 9 aa, Homo Sapiens
EVDLTVLMK

SEQ ID NO: 1001524 - protein, 9 aa, Homo Sapiens
DELLDWAAA

SEQ ID NO: 1001525 - protein, 9 aa, Homo Sapiens
GLERWTTKD

SEQ ID NO: 1001526 - protein, 9 aa, Homo Sapiens
GVVQAFLSI

SEQ ID NO: 1001527 - protein, 9 aa, Homo Sapiens
TNCFFLAAM

SEQ ID NO: 1001528 - protein, 9 aa, Homo Sapiens
HRDPPHKPG

SEQ ID NO: 1001529 - protein, 9 aa, Homo Sapiens
PGTTFFGMS

SEQ ID NO: 1001530 - protein, 9 aa, Homo Sapiens
SVAPASRLT

SEQ ID NO: 1001531 - protein, 9 aa, Homo Sapiens
ECEKLFSCK

SEQ ID NO: 1001532 - protein, 9 aa, Homo Sapiens
WLYAACSIF

SEQ ID NO: 1001533 - protein, 9 aa, Homo Sapiens
LKKEYTVGA

SEQ ID NO: 1001534 - protein, 9 aa, Homo Sapiens
KEKMRHNYF

SEQ ID NO: 1001535 - protein, 9 aa, Homo Sapiens
ALSPRASSS

SEQ ID NO: 1001536 - protein, 9 aa, Homo Sapiens
IIKLQLLPA

SEQ ID NO: 1001537 - protein, 9 aa, Homo Sapiens
NTYKSIQIM

SEQ ID NO: 1001538 - protein, 9 aa, Homo Sapiens
VLCQGVALV

SEQ ID NO: 1001539 - protein, 9 aa, Homo Sapiens
FLLAFFIYV

SEQ ID NO: 1001540 - protein, 9 aa, Homo Sapiens
TINIGKAFH

SEQ ID NO: 1001541 - protein, 9 aa, Homo Sapiens
SGDFDYLGP

SEQ ID NO: 1001542 - protein, 9 aa, Homo Sapiens
ILSFFGETP

SEQ ID NO: 1001543 - protein, 9 aa, Homo Sapiens
GKHYWKVDV

SEQ ID NO: 1001544 - protein, 9 aa, Homo Sapiens
GSREGVALG

SEQ ID NO: 1001545 - protein, 9 aa, Homo Sapiens
FLGLSANEL

SEQ ID NO: 1001546 - protein, 9 aa, Homo Sapiens
SANNGEIGD

SEQ ID NO: 1001547 - protein, 9 aa, Homo Sapiens
MDHLDKQAQ

SEQ ID NO: 1001548 - protein, 9 aa, Homo Sapiens
AGVLVPAKN

SEQ ID NO: 1001549 - protein, 9 aa, Homo Sapiens
QEAPISAEP

SEQ ID NO: 1001550 - protein, 9 aa, Homo Sapiens
PKNQSYLIA

SEQ ID NO: 1001551 - protein, 9 aa, Homo Sapiens
HTHNKKKAH

SEQ ID NO: 1001552 - protein, 9 aa, Homo Sapiens
VLTYCNLTF

SEQ ID NO: 1001553 - protein, 9 aa, Homo Sapiens
DCALAAADP

SEQ ID NO: 1001554 - protein, 9 aa, Homo Sapiens
CTNCFFLAA

SEQ ID NO: 1001555 - protein, 9 aa, Homo Sapiens
PTYSCAYKP

SEQ ID NO: 1001556 - protein, 9 aa, Homo Sapiens
QFLSDILET

SEQ ID NO: 1001557 - protein, 9 aa, Homo Sapiens
LSANELIAI

SEQ ID NO: 1001558 - protein, 9 aa, Homo Sapiens
IAYWKFTSA

SEQ ID NO: 1001559 - protein, 9 aa, Homo Sapiens
CTSETRSTH

SEQ ID NO: 1001560 - protein, 9 aa, Homo Sapiens
ELEVKILKN

SEQ ID NO: 1001561 - protein, 9 aa, Homo Sapiens
ASGIVIWGA

SEQ ID NO: 1001562 - protein, 9 aa, Homo Sapiens
ENWDLITYR

SEQ ID NO: 1001563 - protein, 9 aa, Homo Sapiens
KLKVKHCTD

SEQ ID NO: 1001564 - protein, 9 aa, Homo Sapiens
PRPLTPLAD

SEQ ID NO: 1001565 - protein, 9 aa, Homo Sapiens
FWRSPNSGS

SEQ ID NO: 1001566 - protein, 9 aa, Homo Sapiens
CGNRNKTPS

SEQ ID NO: 1001567 - protein, 9 aa, Homo Sapiens
GSVKTCEVG

SEQ ID NO: 1001568 - protein, 9 aa, Homo Sapiens
PEIKTSDHR

SEQ ID NO: 1001569 - protein, 9 aa, Homo Sapiens
GTNAFFPMC

SEQ ID NO: 1001570 - protein, 9 aa, Homo Sapiens
ILPTEGTLQ

SEQ ID NO: 1001571 - protein, 9 aa, Homo Sapiens
QFSAEADRA

SEQ ID NO: 1001572 - protein, 9 aa, Homo Sapiens
CCCSSGCGL

SEQ ID NO: 1001573 - protein, 9 aa, Homo Sapiens
LTPLADRAF

SEQ ID NO: 1001574 - protein, 9 aa, Homo Sapiens
SLLGGRLLL

SEQ ID NO: 1001575 - protein, 9 aa, Homo Sapiens
KKTMNVASS

SEQ ID NO: 1001576 - protein, 9 aa, Homo Sapiens
ADVPTYKEV

SEQ ID NO: 1001577 - protein, 9 aa, Homo Sapiens
DKKKAGKKP

SEQ ID NO: 1001578 - protein, 9 aa, Homo Sapiens
LRVVQKDEN

SEQ ID NO: 1001579 - protein, 9 aa, Homo Sapiens
PWTNQLLRS

SEQ ID NO: 1001580 - protein, 9 aa, Homo Sapiens
KGFLVLVFK

SEQ ID NO: 1001581 - protein, 9 aa, Homo Sapiens
RKECDCGSF

SEQ ID NO: 1001582 - protein, 9 aa, Homo Sapiens
FDSDYEISA

SEQ ID NO: 1001583 - protein, 9 aa, Homo Sapiens
SVLRAENEK

SEQ ID NO: 1001584 - protein, 9 aa, Homo Sapiens
SPDHQYYND

SEQ ID NO: 1001585 - protein, 9 aa, Homo Sapiens
KNKSDFWDF

SEQ ID NO: 1001586 - protein, 9 aa, Homo Sapiens
AKESNHLRD

SEQ ID NO: 1001587 - protein, 9 aa, Homo Sapiens
PQNGELGKD

SEQ ID NO: 1001588 - protein, 9 aa, Homo Sapiens
GEEAELVRN

SEQ ID NO: 1001589 - protein, 9 aa, Homo Sapiens
EKMLMKVIR

SEQ ID NO: 1001590 - protein, 9 aa, Homo Sapiens
LEVKILKNA

SEQ ID NO: 1001591 - protein, 9 aa, Homo Sapiens
EADPELADL

SEQ ID NO: 1001592 - protein, 9 aa, Homo Sapiens
SRTLSRTTP

SEQ ID NO: 1001593 - protein, 9 aa, Homo Sapiens
TGDFGFFLR

SEQ ID NO: 1001594 - protein, 9 aa, Homo Sapiens
KENRENSYN

SEQ ID NO: 1001595 - protein, 9 aa, Homo Sapiens
LESPYGILA

SEQ ID NO: 1001596 - protein, 9 aa, Homo Sapiens
GPIQYNCSK

SEQ ID NO: 1001597 - protein, 9 aa, Homo Sapiens
GYDDYKPPY

SEQ ID NO: 1001598 - protein, 9 aa, Homo Sapiens
LQGHLTHYT

SEQ ID NO: 1001599 - protein, 9 aa, Homo Sapiens
NPAAVAAAR

SEQ ID NO: 1001600 - protein, 9 aa, Homo Sapiens
PVNTSIPVT

SEQ ID NO: 1001601 - protein, 9 aa, Homo Sapiens
LQAVRYSIC

SEQ ID NO: 1001602 - protein, 9 aa, Homo Sapiens
RYTGKKQVE

SEQ ID NO: 1001603 - protein, 9 aa, Homo Sapiens
TEKSPPPMD

SEQ ID NO: 1001604 - protein, 9 aa, Homo Sapiens
EGVFVLHGN

SEQ ID NO: 1001605 - protein, 9 aa, Homo Sapiens
KKGIVVGIK

SEQ ID NO: 1001606 - protein, 9 aa, Homo Sapiens
LAQKHPYLT

SEQ ID NO: 1001607 - protein, 9 aa, Homo Sapiens
EERLVSMGS

SEQ ID NO: 1001608 - protein, 9 aa, Homo Sapiens
WSLPFVLCQ

SEQ ID NO: 1001609 - protein, 9 aa, Homo Sapiens
AAKFSSGSQ

SEQ ID NO: 1001610 - protein, 9 aa, Homo Sapiens
YKDAVWKAM

SEQ ID NO: 1001611 - protein, 9 aa, Homo Sapiens
SLRYDPDSG

SEQ ID NO: 1001612 - protein, 9 aa, Homo Sapiens
LRYDPDSGH

SEQ ID NO: 1001613 - protein, 9 aa, Homo Sapiens
SLKKAICQI

SEQ ID NO: 1001614 - protein, 9 aa, Homo Sapiens
EYLGNLSTI

SEQ ID NO: 1001615 - protein, 9 aa, Homo Sapiens
AVVPDTVVE

SEQ ID NO: 1001616 - protein, 9 aa, Homo Sapiens
GFGLGSDGK

SEQ ID NO: 1001617 - protein, 9 aa, Homo Sapiens
TGRHKPTGP

SEQ ID NO: 1001618 - protein, 9 aa, Homo Sapiens
PSPPGSPRI

SEQ ID NO: 1001619 - protein, 9 aa, Homo Sapiens
SLEGRIEDL

SEQ ID NO: 1001620 - protein, 9 aa, Homo Sapiens
EFKGFLVLV

SEQ ID NO: 1001621 - protein, 9 aa, Homo Sapiens
QNHSESFFP

SEQ ID NO: 1001622 - protein, 9 aa, Homo Sapiens
KFNLNQYVN

SEQ ID NO: 1001623 - protein, 9 aa, Homo Sapiens
KLVPWSVGV

SEQ ID NO: 1001624 - protein, 9 aa, Homo Sapiens
VHNSARPML

SEQ ID NO: 1001625 - protein, 9 aa, Homo Sapiens
SGKQTVRCR

SEQ ID NO: 1001626 - protein, 9 aa, Homo Sapiens
QPAPFCQKC

SEQ ID NO: 1001627 - protein, 9 aa, Homo Sapiens
FSYQPNYGM

SEQ ID NO: 1001628 - protein, 9 aa, Homo Sapiens
SEPWEDEGA

SEQ ID NO: 1001629 - protein, 9 aa, Homo Sapiens
QETTYRTQV

SEQ ID NO: 1001630 - protein, 9 aa, Homo Sapiens
APSKQCASV

SEQ ID NO: 1001631 - protein, 9 aa, Homo Sapiens
KECDCGSFK

SEQ ID NO: 1001632 - protein, 9 aa, Homo Sapiens
LTCIYCAES

SEQ ID NO: 1001633 - protein, 9 aa, Homo Sapiens
TTVCREFMD

SEQ ID NO: 1001634 - protein, 9 aa, Homo Sapiens
VPEYQSLRL

SEQ ID NO: 1001635 - protein, 9 aa, Homo Sapiens
CDRKSTMDA

SEQ ID NO: 1001636 - protein, 9 aa, Homo Sapiens
IPSAESEDN

SEQ ID NO: 1001637 - protein, 9 aa, Homo Sapiens
VPEVQKKIV

SEQ ID NO: 1001638 - protein, 9 aa, Homo Sapiens
KKQVERRGG

SEQ ID NO: 1001639 - protein, 9 aa, Homo Sapiens
RSPMVEKRM

SEQ ID NO: 1001640 - protein, 9 aa, Homo Sapiens
GSIGFKEFE

SEQ ID NO: 1001641 - protein, 9 aa, Homo Sapiens
AAWAELSLA

SEQ ID NO: 1001642 - protein, 9 aa, Homo Sapiens
ENNTGFQAQ

SEQ ID NO: 1001643 - protein, 9 aa, Homo Sapiens
LMFLNCFEY

SEQ ID NO: 1001644 - protein, 9 aa, Homo Sapiens
SEPMDKNCY

SEQ ID NO: 1001645 - protein, 9 aa, Homo Sapiens
MDAQSQVGF

SEQ ID NO: 1001646 - protein, 9 aa, Homo Sapiens
EAEIFTRPC

SEQ ID NO: 1001647 - protein, 9 aa, Homo Sapiens
FLKVSLQDY

SEQ ID NO: 1001648 - protein, 9 aa, Homo Sapiens
PCRVSTADQ

SEQ ID NO: 1001649 - protein, 9 aa, Homo Sapiens
GAIELLKIL

SEQ ID NO: 1001650 - protein, 9 aa, Homo Sapiens
DFDSDYEIS

SEQ ID NO: 1001651 - protein, 9 aa, Homo Sapiens
EGALVPLEP

SEQ ID NO: 1001652 - protein, 9 aa, Homo Sapiens
TTWSTSSKK

SEQ ID NO: 1001653 - protein, 9 aa, Homo Sapiens
APQRADMKL

SEQ ID NO: 1001654 - protein, 9 aa, Homo Sapiens
GETCFAKQH

SEQ ID NO: 1001655 - protein, 9 aa, Homo Sapiens
NHEIEECRS

SEQ ID NO: 1001656 - protein, 9 aa, Homo Sapiens
PGPRGGSPV

SEQ ID NO: 1001657 - protein, 9 aa, Homo Sapiens
SMEENSGLS

SEQ ID NO: 1001658 - protein, 9 aa, Homo Sapiens
EISETPCES

SEQ ID NO: 1001659 - protein, 9 aa, Homo Sapiens
ASPGSSASQ

SEQ ID NO: 1001660 - protein, 9 aa, Homo Sapiens
LTESVQGVD

SEQ ID NO: 1001661 - protein, 9 aa, Homo Sapiens
GAVSKLVPW

SEQ ID NO: 1001662 - protein, 9 aa, Homo Sapiens
KKSKVPQST

SEQ ID NO: 1001663 - protein, 9 aa, Homo Sapiens
PVALKILSA

SEQ ID NO: 1001664 - protein, 9 aa, Homo Sapiens
RSLGIEMPL

SEQ ID NO: 1001665 - protein, 9 aa, Homo Sapiens
MLQAVRYSI

SEQ ID NO: 1001666 - protein, 9 aa, Homo Sapiens
GAFCGNYIT

SEQ ID NO: 1001667 - protein, 9 aa, Homo Sapiens
LQRLLVALS

SEQ ID NO: 1001668 - protein, 9 aa, Homo Sapiens
TVNIWDLKL

SEQ ID NO: 1001669 - protein, 9 aa, Homo Sapiens
PAKNQPGRQ

SEQ ID NO: 1001670 - protein, 9 aa, Homo Sapiens
FGKEGLAFN

SEQ ID NO: 1001671 - protein, 9 aa, Homo Sapiens
YSVRGDEFL

SEQ ID NO: 1001672 - protein, 9 aa, Homo Sapiens
FSYATAPTQ

SEQ ID NO: 1001673 - protein, 9 aa, Homo Sapiens
SPAYMNIIR

SEQ ID NO: 1001674 - protein, 9 aa, Homo Sapiens
PTEYTMHIK

SEQ ID NO: 1001675 - protein, 9 aa, Homo Sapiens
ELADLPQQL

SEQ ID NO: 1001676 - protein, 9 aa, Homo Sapiens
TVIYVFPVN

SEQ ID NO: 1001677 - protein, 9 aa, Homo Sapiens
IDQVNSNWK

SEQ ID NO: 1001678 - protein, 9 aa, Homo Sapiens
GALSIMRSM

SEQ ID NO: 1001679 - protein, 9 aa, Homo Sapiens
GSMNHGKFA

SEQ ID NO: 1001680 - protein, 9 aa, Homo Sapiens
YENYQASTD

SEQ ID NO: 1001681 - protein, 9 aa, Homo Sapiens
LKHESAKAD

SEQ ID NO: 1001682 - protein, 9 aa, Homo Sapiens
KVEKFKIFK

SEQ ID NO: 1001683 - protein, 9 aa, Homo Sapiens
THYTLCKPV

SEQ ID NO: 1001684 - protein, 9 aa, Homo Sapiens
AEADRATSP

SEQ ID NO: 1001685 - protein, 9 aa, Homo Sapiens
PGTGDYKVT

SEQ ID NO: 1001686 - protein, 9 aa, Homo Sapiens
THSHERSYS

SEQ ID NO: 1001687 - protein, 9 aa, Homo Sapiens
SISSKPTQC

SEQ ID NO: 1001688 - protein, 9 aa, Homo Sapiens
LERWTTKDT

SEQ ID NO: 1001689 - protein, 9 aa, Homo Sapiens
SVTVHNPKN

SEQ ID NO: 1001690 - protein, 9 aa, Homo Sapiens
DYNKEGLLL

SEQ ID NO: 1001691 - protein, 9 aa, Homo Sapiens
IKKIPERDS

SEQ ID NO: 1001692 - protein, 9 aa, Homo Sapiens
VKILKNAAP

SEQ ID NO: 1001693 - protein, 9 aa, Homo Sapiens
KYQDHCYRH

SEQ ID NO: 1001694 - protein, 9 aa, Homo Sapiens
TQEAARGQV

SEQ ID NO: 1001695 - protein, 9 aa, Homo Sapiens
MIYTLRSQD

SEQ ID NO: 1001696 - protein, 9 aa, Homo Sapiens
GEKPCRCSK

SEQ ID NO: 1001697 - protein, 9 aa, Homo Sapiens
VQAFLSIHG

SEQ ID NO: 1001698 - protein, 9 aa, Homo Sapiens
EVKILKNAA

SEQ ID NO: 1001699 - protein, 9 aa, Homo Sapiens
SIYTHLWKN

SEQ ID NO: 1001700 - protein, 9 aa, Homo Sapiens
ISLPVTTKE

SEQ ID NO: 1001701 - protein, 9 aa, Homo Sapiens
EPHSPNWNA

SEQ ID NO: 1001702 - protein, 9 aa, Homo Sapiens
HETVQRQKL

SEQ ID NO: 1001703 - protein, 9 aa, Homo Sapiens
WRRCYTMQK

SEQ ID NO: 1001704 - protein, 9 aa, Homo Sapiens
EVKSVFMVA

SEQ ID NO: 1001705 - protein, 9 aa, Homo Sapiens
KLKPLVENC

SEQ ID NO: 1001706 - protein, 9 aa, Homo Sapiens
LAAERNLNV

SEQ ID NO: 1001707 - protein, 9 aa, Homo Sapiens
IVEGRKECD

SEQ ID NO: 1001708 - protein, 9 aa, Homo Sapiens
VYRSLLFED

SEQ ID NO: 1001709 - protein, 9 aa, Homo Sapiens
QVEHPYQLL

SEQ ID NO: 1001710 - protein, 9 aa, Homo Sapiens
KETLKNRVF

SEQ ID NO: 1001711 - protein, 9 aa, Homo Sapiens
EHEGVFVLH

SEQ ID NO: 1001712 - protein, 9 aa, Homo Sapiens
EERGDQGIP

SEQ ID NO: 1001713 - protein, 9 aa, Homo Sapiens
QDPMTQSIF

SEQ ID NO: 1001714 - protein, 9 aa, Homo Sapiens
YTLRSQDMQ

SEQ ID NO: 1001715 - protein, 9 aa, Homo Sapiens
TVNWRPEVE

SEQ ID NO: 1001716 - protein, 9 aa, Homo Sapiens
FSKARWLAE

SEQ ID NO: 1001717 - protein, 9 aa, Homo Sapiens
ERSYSCTEC

SEQ ID NO: 1001718 - protein, 9 aa, Homo Sapiens
SLGIEMPLQ

SEQ ID NO: 1001719 - protein, 9 aa, Homo Sapiens
SKCGEGFSQ

SEQ ID NO: 1001720 - protein, 9 aa, Homo Sapiens
IRLPQNSPL

SEQ ID NO: 1001721 - protein, 9 aa, Homo Sapiens
SANKMSIAW

SEQ ID NO: 1001722 - protein, 9 aa, Homo Sapiens
VPLEPIPGT

SEQ ID NO: 1001723 - protein, 9 aa, Homo Sapiens
LANAKGLGL

SEQ ID NO: 1001724 - protein, 9 aa, Homo Sapiens
YRIYVTAKK

SEQ ID NO: 1001725 - protein, 9 aa, Homo Sapiens
CGAYGPEYW

SEQ ID NO: 1001726 - protein, 9 aa, Homo Sapiens
TGHATHLSV

SEQ ID NO: 1001727 - protein, 9 aa, Homo Sapiens
CVPQMKEPI

SEQ ID NO: 1001728 - protein, 9 aa, Homo Sapiens
QKFSSLSAY

SEQ ID NO: 1001729 - protein, 9 aa, Homo Sapiens
GEKPYWCSE

SEQ ID NO: 1001730 - protein, 9 aa, Homo Sapiens
VDNSRDFGN

SEQ ID NO: 1001731 - protein, 9 aa, Homo Sapiens
EDLKADEPL

SEQ ID NO: 1001732 - protein, 9 aa, Homo Sapiens
LPFSSPSLP

SEQ ID NO: 1001733 - protein, 9 aa, Homo Sapiens
VGLLLTSHR

SEQ ID NO: 1001734 - protein, 9 aa, Homo Sapiens
MVMDILRKR

SEQ ID NO: 1001735 - protein, 9 aa, Homo Sapiens
EVGAWCPVE

SEQ ID NO: 1001736 - protein, 9 aa, Homo Sapiens
GDPSSSTLA

SEQ ID NO: 1001737 - protein, 9 aa, Homo Sapiens
EKVVAAAGQ

SEQ ID NO: 1001738 - protein, 9 aa, Homo Sapiens
DGKTPCQQV

SEQ ID NO: 1001739 - protein, 9 aa, Homo Sapiens
YQFSSTQPE

SEQ ID NO: 1001740 - protein, 9 aa, Homo Sapiens
KFVSTTSSR

SEQ ID NO: 1001741 - protein, 9 aa, Homo Sapiens
VNITTRNLT

SEQ ID NO: 1001742 - protein, 9 aa, Homo Sapiens
DPMTQSIFN

SEQ ID NO: 1001743 - protein, 9 aa, Homo Sapiens
HFEVNPSVE

SEQ ID NO: 1001744 - protein, 9 aa, Homo Sapiens
PFEEQFQFQ

SEQ ID NO: 1001745 - protein, 9 aa, Homo Sapiens
VAREEQATL

SEQ ID NO: 1001746 - protein, 9 aa, Homo Sapiens
LQLRCKEWL

SEQ ID NO: 1001747 - protein, 9 aa, Homo Sapiens
YDHLEFDGV

SEQ ID NO: 1001748 - protein, 9 aa, Homo Sapiens
KTFQSILEA

SEQ ID NO: 1001749 - protein, 9 aa, Homo Sapiens
PRTTVFSCP

SEQ ID NO: 1001750 - protein, 9 aa, Homo Sapiens
AVVVAACVL

SEQ ID NO: 1001751 - protein, 9 aa, Homo Sapiens
PHKPGSRHR

SEQ ID NO: 1001752 - protein, 9 aa, Homo Sapiens
LKGAKKVYL

SEQ ID NO: 1001753 - protein, 9 aa, Homo Sapiens
ALMIEELNP

SEQ ID NO: 1001754 - protein, 9 aa, Homo Sapiens
QALHMTSEN

SEQ ID NO: 1001755 - protein, 9 aa, Homo Sapiens
MGASRGFLS

SEQ ID NO: 1001756 - protein, 9 aa, Homo Sapiens
ELRGAGAIE

SEQ ID NO: 1001757 - protein, 9 aa, Homo Sapiens
KVSLQDYAF

SEQ ID NO: 1001758 - protein, 9 aa, Homo Sapiens
SAFIEPRYH

SEQ ID NO: 1001759 - protein, 9 aa, Homo Sapiens
LQLRVVVAM

SEQ ID NO: 1001760 - protein, 9 aa, Homo Sapiens
NLTQDGKEI

SEQ ID NO: 1001761 - protein, 9 aa, Homo Sapiens
RLKGLRLKL

SEQ ID NO: 1001762 - protein, 9 aa, Homo Sapiens
ILCWPLEAP

SEQ ID NO: 1001763 - protein, 9 aa, Homo Sapiens
ASQLLCLCM

SEQ ID NO: 1001764 - protein, 9 aa, Homo Sapiens
KTKKVTPFS

SEQ ID NO: 1001765 - protein, 9 aa, Homo Sapiens
QCGKFLRNL

SEQ ID NO: 1001766 - protein, 9 aa, Homo Sapiens
ERGQQKKEA

SEQ ID NO: 1001767 - protein, 9 aa, Homo Sapiens
GASRGFLSI

SEQ ID NO: 1001768 - protein, 9 aa, Homo Sapiens
RYLAFDILR

SEQ ID NO: 1001769 - protein, 9 aa, Homo Sapiens
PSTLGVSFP

SEQ ID NO: 1001770 - protein, 9 aa, Homo Sapiens
GDVEADPEL

SEQ ID NO: 1001771 - protein, 9 aa, Homo Sapiens
FNAVLEELP

SEQ ID NO: 1001772 - protein, 9 aa, Homo Sapiens
PQETTYRTQ

SEQ ID NO: 1001773 - protein, 9 aa, Homo Sapiens
YKRSEAKKS

SEQ ID NO: 1001774 - protein, 9 aa, Homo Sapiens
TAPSVLGKH

SEQ ID NO: 1001775 - protein, 9 aa, Homo Sapiens
HATHLSVTG

SEQ ID NO: 1001776 - protein, 9 aa, Homo Sapiens
CHSPHQGLS

SEQ ID NO: 1001777 - protein, 9 aa, Homo Sapiens
LRKAPVMNC

SEQ ID NO: 1001778 - protein, 9 aa, Homo Sapiens
LLERVMHGE

SEQ ID NO: 1001779 - protein, 9 aa, Homo Sapiens
EACSTTENG

SEQ ID NO: 1001780 - protein, 9 aa, Homo Sapiens
NRSAIIKNL

SEQ ID NO: 1001781 - protein, 9 aa, Homo Sapiens
GEILWSQEL

SEQ ID NO: 1001782 - protein, 9 aa, Homo Sapiens
GSCQPAPFC

SEQ ID NO: 1001783 - protein, 9 aa, Homo Sapiens
YDHSAFIEP

SEQ ID NO: 1001784 - protein, 9 aa, Homo Sapiens
WTTKDTFTA

SEQ ID NO: 1001785 - protein, 9 aa, Homo Sapiens
GDRGPKEER

SEQ ID NO: 1001786 - protein, 9 aa, Homo Sapiens
ALAAKLKVK

SEQ ID NO: 1001787 - protein, 9 aa, Homo Sapiens
QAWKIEDIS

SEQ ID NO: 1001788 - protein, 9 aa, Homo Sapiens
FLSEVTIGA

SEQ ID NO: 1001789 - protein, 9 aa, Homo Sapiens
AMRLAVTNK

SEQ ID NO: 1001790 - protein, 9 aa, Homo Sapiens
RATTLREKR

SEQ ID NO: 1001791 - protein, 9 aa, Homo Sapiens
FWAQKRGIE

SEQ ID NO: 1001792 - protein, 9 aa, Homo Sapiens
TPPASQLLC

SEQ ID NO: 1001793 - protein, 9 aa, Homo Sapiens
ETRPEALPS

SEQ ID NO: 1001794 - protein, 9 aa, Homo Sapiens
PSSSTLALP

SEQ ID NO: 1001795 - protein, 9 aa, Homo Sapiens
EELYDFNQC

SEQ ID NO: 1001796 - protein, 9 aa, Homo Sapiens
GDFGFFLRR

SEQ ID NO: 1001797 - protein, 9 aa, Homo Sapiens
VPPTGDFGA

SEQ ID NO: 1001798 - protein, 9 aa, Homo Sapiens
SAIESTASL

SEQ ID NO: 1001799 - protein, 9 aa, Homo Sapiens
GRLLSISPT

SEQ ID NO: 1001800 - protein, 9 aa, Homo Sapiens
DRKFFKMNP

SEQ ID NO: 1001801 - protein, 9 aa, Homo Sapiens
SGQTFCPNN

SEQ ID NO: 1001802 - protein, 9 aa, Homo Sapiens
EENGEEAEL

SEQ ID NO: 1001803 - protein, 9 aa, Homo Sapiens
EESPDHQYY

SEQ ID NO: 1001804 - protein, 9 aa, Homo Sapiens
VLAIKSYRK

SEQ ID NO: 1001805 - protein, 9 aa, Homo Sapiens
SHSSASEPW

SEQ ID NO: 1001806 - protein, 9 aa, Homo Sapiens
GKKSRREVQ

SEQ ID NO: 1001807 - protein, 9 aa, Homo Sapiens
SGFNFTAPS

SEQ ID NO: 1001808 - protein, 9 aa, Homo Sapiens
DILRKRDQG

SEQ ID NO: 1001809 - protein, 9 aa, Homo Sapiens
SIPIFLSEV

SEQ ID NO: 1001810 - protein, 9 aa, Homo Sapiens
FLLFMVLFN

SEQ ID NO: 1001811 - protein, 9 aa, Homo Sapiens
WDSTRMSVK

SEQ ID NO: 1001812 - protein, 9 aa, Homo Sapiens
ALKRSEPLL

SEQ ID NO: 1001813 - protein, 9 aa, Homo Sapiens
EGCQGHWSP

SEQ ID NO: 1001814 - protein, 9 aa, Homo Sapiens
AGSTKVSFA

SEQ ID NO: 1001815 - protein, 9 aa, Homo Sapiens
GQVSPESLL

SEQ ID NO: 1001816 - protein, 9 aa, Homo Sapiens
VESNSNGRN

SEQ ID NO: 1001817 - protein, 9 aa, Homo Sapiens
CLVSIYRTH

SEQ ID NO: 1001818 - protein, 9 aa, Homo Sapiens
KANDTSNGI

SEQ ID NO: 1001819 - protein, 9 aa, Homo Sapiens
QFYDKPSLS

SEQ ID NO: 1001820 - protein, 9 aa, Homo Sapiens
ELERFARTF

SEQ ID NO: 1001821 - protein, 9 aa, Homo Sapiens
RPNIYVTGG

SEQ ID NO: 1001822 - protein, 9 aa, Homo Sapiens
SSASEPWED

SEQ ID NO: 1001823 - protein, 9 aa, Homo Sapiens
PFCQKCILS

SEQ ID NO: 1001824 - protein, 9 aa, Homo Sapiens
RDCALAAAD

SEQ ID NO: 1001825 - protein, 9 aa, Homo Sapiens
YEVLRHTSL

SEQ ID NO: 1001826 - protein, 9 aa, Homo Sapiens
TPGLSRSWD

SEQ ID NO: 1001827 - protein, 9 aa, Homo Sapiens
WRSCICNSG

SEQ ID NO: 1001828 - protein, 9 aa, Homo Sapiens
RGWHGEEKV

SEQ ID NO: 1001829 - protein, 9 aa, Homo Sapiens
LQLLWLLVK

SEQ ID NO: 1001830 - protein, 9 aa, Homo Sapiens
CKPVLTYQR

SEQ ID NO: 1001831 - protein, 9 aa, Homo Sapiens
RHSSEDPEA

SEQ ID NO: 1001832 - protein, 9 aa, Homo Sapiens
SWDGLLVAK

SEQ ID NO: 1001833 - protein, 9 aa, Homo Sapiens
KNQPGRQEK

SEQ ID NO: 1001834 - protein, 9 aa, Homo Sapiens
PSQFSKEKR

SEQ ID NO: 1001835 - protein, 9 aa, Homo Sapiens
GRLKKLNLV

SEQ ID NO: 1001836 - protein, 9 aa, Homo Sapiens
QRSDSQVLL

SEQ ID NO: 1001837 - protein, 9 aa, Homo Sapiens
GVQWSNFRS

SEQ ID NO: 1001838 - protein, 9 aa, Homo Sapiens
NTGKSKKET

SEQ ID NO: 1001839 - protein, 9 aa, Homo Sapiens
NQQLPKPPD

SEQ ID NO: 1001840 - protein, 9 aa, Homo Sapiens
VTCLRPNIY

SEQ ID NO: 1001841 - protein, 9 aa, Homo Sapiens
KNTMNGASV

SEQ ID NO: 1001842 - protein, 9 aa, Homo Sapiens
VQLEACETR

SEQ ID NO: 1001843 - protein, 9 aa, Homo Sapiens
LEPVFPPRL

SEQ ID NO: 1001844 - protein, 9 aa, Homo Sapiens
PGAMENWDL

SEQ ID NO: 1001845 - protein, 9 aa, Homo Sapiens
LNRADPLFR

SEQ ID NO: 1001846 - protein, 9 aa, Homo Sapiens
SGSEVEEIS

SEQ ID NO: 1001847 - protein, 9 aa, Homo Sapiens
LLLLNRADP

SEQ ID NO: 1001848 - protein, 9 aa, Homo Sapiens
TLCSFFGLQ

SEQ ID NO: 1001849 - protein, 9 aa, Homo Sapiens
QEPPAPSPP

SEQ ID NO: 1001850 - protein, 9 aa, Homo Sapiens
DNISPAYMN

SEQ ID NO: 1001851 - protein, 9 aa, Homo Sapiens
LDWAAAKEF

SEQ ID NO: 1001852 - protein, 9 aa, Homo Sapiens
ESVHKLQDS

SEQ ID NO: 1001853 - protein, 9 aa, Homo Sapiens
RPGPPGPPR

SEQ ID NO: 1001854 - protein, 9 aa, Homo Sapiens
SPNSGSWVS

SEQ ID NO: 1001855 - protein, 9 aa, Homo Sapiens
TEAPKPPEE

SEQ ID NO: 1001856 - protein, 9 aa, Homo Sapiens
AISGQTFCP

SEQ ID NO: 1001857 - protein, 9 aa, Homo Sapiens
QGRTDGAKN

SEQ ID NO: 1001858 - protein, 9 aa, Homo Sapiens
VIYVFPVNT

SEQ ID NO: 1001859 - protein, 9 aa, Homo Sapiens
IEKSYKFIF

SEQ ID NO: 1001860 - protein, 9 aa, Homo Sapiens
DKIVHELFG

SEQ ID NO: 1001861 - protein, 9 aa, Homo Sapiens
MVCNSWFEC

SEQ ID NO: 1001862 - protein, 9 aa, Homo Sapiens
RKDGLPGRA

SEQ ID NO: 1001863 - protein, 9 aa, Homo Sapiens
YVTAKKHAH

SEQ ID NO: 1001864 - protein, 9 aa, Homo Sapiens
ALAQKHPYL

SEQ ID NO: 1001865 - protein, 9 aa, Homo Sapiens
PDKDFTPAT

SEQ ID NO: 1001866 - protein, 9 aa, Homo Sapiens
ISWTAITTA

SEQ ID NO: 1001867 - protein, 9 aa, Homo Sapiens
DHMLAMVEK

SEQ ID NO: 1001868 - protein, 9 aa, Homo Sapiens
SSCPEIKTS

SEQ ID NO: 1001869 - protein, 9 aa, Homo Sapiens
SIYRTHHNP

SEQ ID NO: 1001870 - protein, 9 aa, Homo Sapiens
SDQSGKSNR

SEQ ID NO: 1001871 - protein, 9 aa, Homo Sapiens
KEKEYVQFQ

SEQ ID NO: 1001872 - protein, 9 aa, Homo Sapiens
EFSVLRAEN

SEQ ID NO: 1001873 - protein, 9 aa, Homo Sapiens
SPTDSPSKA

SEQ ID NO: 1001874 - protein, 9 aa, Homo Sapiens
SELTYTFSH

SEQ ID NO: 1001875 - protein, 9 aa, Homo Sapiens
SIFYLGAMV

SEQ ID NO: 1001876 - protein, 9 aa, Homo Sapiens
DIEADQTTL

SEQ ID NO: 1001877 - protein, 9 aa, Homo Sapiens
AQQHSPPDR

SEQ ID NO: 1001878 - protein, 9 aa, Homo Sapiens
KSTMDAQSQ

SEQ ID NO: 1001879 - protein, 9 aa, Homo Sapiens
LEKFEARRK

SEQ ID NO: 1001880 - protein, 9 aa, Homo Sapiens
PLVGHVYEY

SEQ ID NO: 1001881 - protein, 9 aa, Homo Sapiens
EIPLMRDCA

SEQ ID NO: 1001882 - protein, 9 aa, Homo Sapiens
EDFDSDYEI

SEQ ID NO: 1001883 - protein, 9 aa, Homo Sapiens
FTEKPTVPT

SEQ ID NO: 1001884 - protein, 9 aa, Homo Sapiens
VQEAPISAE

SEQ ID NO: 1001885 - protein, 9 aa, Homo Sapiens
AMLTGECVP

SEQ ID NO: 1001886 - protein, 9 aa, Homo Sapiens
APEPPDGED

SEQ ID NO: 1001887 - protein, 9 aa, Homo Sapiens
VRALCTGDY

SEQ ID NO: 1001888 - protein, 9 aa, Homo Sapiens
RWWLRPDVF

SEQ ID NO: 1001889 - protein, 9 aa, Homo Sapiens
YKDDPHYFV

SEQ ID NO: 1001890 - protein, 9 aa, Homo Sapiens
FSTPKIYPF

SEQ ID NO: 1001891 - protein, 9 aa, Homo Sapiens
DLFRAVSKP

SEQ ID NO: 1001892 - protein, 9 aa, Homo Sapiens
EEAPSKQCA

SEQ ID NO: 1001893 - protein, 9 aa, Homo Sapiens
EANITGFQI

SEQ ID NO: 1001894 - protein, 9 aa, Homo Sapiens
CSNSEFLCV

SEQ ID NO: 1001895 - protein, 9 aa, Homo Sapiens
VIRCLGSWF

SEQ ID NO: 1001896 - protein, 9 aa, Homo Sapiens
CICNSGKTV

SEQ ID NO: 1001897 - protein, 9 aa, Homo Sapiens
HVNRVPEEK

SEQ ID NO: 1001898 - protein, 9 aa, Homo Sapiens
LNDLIYSVR

SEQ ID NO: 1001899 - protein, 9 aa, Homo Sapiens
NGEIGDATP

SEQ ID NO: 1001900 - protein, 9 aa, Homo Sapiens
QAQMKELWW

SEQ ID NO: 1001901 - protein, 9 aa, Homo Sapiens
PVDKGHVTF

SEQ ID NO: 1001902 - protein, 9 aa, Homo Sapiens
SIQIMRQYT

SEQ ID NO: 1001903 - protein, 9 aa, Homo Sapiens
SKPDLDSYV

SEQ ID NO: 1001904 - protein, 9 aa, Homo Sapiens
LDRVAIVTG

SEQ ID NO: 1001905 - protein, 9 aa, Homo Sapiens
HSSEDPEAT

SEQ ID NO: 1001906 - protein, 9 aa, Homo Sapiens
LQVDVKLDP

SEQ ID NO: 1001907 - protein, 9 aa, Homo Sapiens
TTRNLTLSV

SEQ ID NO: 1001908 - protein, 9 aa, Homo Sapiens
KNVPRIFEA

SEQ ID NO: 1001909 - protein, 9 aa, Homo Sapiens
DTSMDSGKI

SEQ ID NO: 1001910 - protein, 9 aa, Homo Sapiens
NCKEFQTEL

SEQ ID NO: 1001911 - protein, 9 aa, Homo Sapiens
QEVTPRPFE

SEQ ID NO: 1001912 - protein, 9 aa, Homo Sapiens
SKIKRDKDG

SEQ ID NO: 1001913 - protein, 9 aa, Homo Sapiens
IQVTHSNNK

SEQ ID NO: 1001914 - protein, 9 aa, Homo Sapiens
KTPSEENFE

SEQ ID NO: 1001915 - protein, 9 aa, Homo Sapiens
NSENIKAIR

SEQ ID NO: 1001916 - protein, 9 aa, Homo Sapiens
NPMIYTLRS

SEQ ID NO: 1001917 - protein, 9 aa, Homo Sapiens
FDPTADVSC

SEQ ID NO: 1001918 - protein, 9 aa, Homo Sapiens
SIPAPPPPP

SEQ ID NO: 1001919 - protein, 9 aa, Homo Sapiens
STLSTTPVN

SEQ ID NO: 1001920 - protein, 9 aa, Homo Sapiens
EGLAFNMIE

SEQ ID NO: 1001921 - protein, 9 aa, Homo Sapiens
EMNKTVILA

SEQ ID NO: 1001922 - protein, 9 aa, Homo Sapiens
PQRKKTESV

SEQ ID NO: 1001923 - protein, 9 aa, Homo Sapiens
VISPEVLRY

SEQ ID NO: 1001924 - protein, 9 aa, Homo Sapiens
GTGGAVSKL

SEQ ID NO: 1001925 - protein, 9 aa, Homo Sapiens
ENGEEAELV

SEQ ID NO: 1001926 - protein, 9 aa, Homo Sapiens
NLLSHLPEE

SEQ ID NO: 1001927 - protein, 9 aa, Homo Sapiens
GDDHYNSEN

SEQ ID NO: 1001928 - protein, 9 aa, Homo Sapiens
DMKRHSSED

SEQ ID NO: 1001929 - protein, 9 aa, Homo Sapiens
SEYKLEDRS

SEQ ID NO: 1001930 - protein, 9 aa, Homo Sapiens
DQSVRKGIM

SEQ ID NO: 1001931 - protein, 9 aa, Homo Sapiens
SQLDTGVPL

SEQ ID NO: 1001932 - protein, 9 aa, Homo Sapiens
TNYTTVCRE

SEQ ID NO: 1001933 - protein, 9 aa, Homo Sapiens
SEVTIGAHQ

SEQ ID NO: 1001934 - protein, 9 aa, Homo Sapiens
VEFSAEIQP

SEQ ID NO: 1001935 - protein, 9 aa, Homo Sapiens
SGREHERAG

SEQ ID NO: 1001936 - protein, 9 aa, Homo Sapiens
EMGDLIRRV

SEQ ID NO: 1001937 - protein, 9 aa, Homo Sapiens
IRVQLEACE

SEQ ID NO: 1001938 - protein, 9 aa, Homo Sapiens
CGNYITFWG

SEQ ID NO: 1001939 - protein, 9 aa, Homo Sapiens
LLWCMAPNP

SEQ ID NO: 1001940 - protein, 9 aa, Homo Sapiens
LYFLLSDRK

SEQ ID NO: 1001941 - protein, 9 aa, Homo Sapiens
PPDQKTEKS

SEQ ID NO: 1001942 - protein, 9 aa, Homo Sapiens
PLRPEKGRR

SEQ ID NO: 1001943 - protein, 9 aa, Homo Sapiens
AKCRLLLFY

SEQ ID NO: 1001944 - protein, 9 aa, Homo Sapiens
AAEDSTAQK

SEQ ID NO: 1001945 - protein, 9 aa, Homo Sapiens
ETCANDNLF

SEQ ID NO: 1001946 - protein, 9 aa, Homo Sapiens
TKAFITHGE

SEQ ID NO: 1001947 - protein, 9 aa, Homo Sapiens
AEEGSSGSS

SEQ ID NO: 1001948 - protein, 9 aa, Homo Sapiens
QRQLKRPRL

SEQ ID NO: 1001949 - protein, 9 aa, Homo Sapiens
HKPGSRHRD

SEQ ID NO: 1001950 - protein, 9 aa, Homo Sapiens
VSRFSYYNS

SEQ ID NO: 1001951 - protein, 9 aa, Homo Sapiens
YDQLVISPE

SEQ ID NO: 1001952 - protein, 9 aa, Homo Sapiens
TWLSTECDF

SEQ ID NO: 1001953 - protein, 9 aa, Homo Sapiens
GEGCQGHWS

SEQ ID NO: 1001954 - protein, 9 aa, Homo Sapiens
ALRADAPSH

SEQ ID NO: 1001955 - protein, 9 aa, Homo Sapiens
TASLIAMVA

SEQ ID NO: 1001956 - protein, 9 aa, Homo Sapiens
WWLRPDVFS

SEQ ID NO: 1001957 - protein, 9 aa, Homo Sapiens
MENWDLITY

SEQ ID NO: 1001958 - protein, 9 aa, Homo Sapiens
SQKSEVRSL

SEQ ID NO: 1001959 - protein, 9 aa, Homo Sapiens
LGRPSMPTD

SEQ ID NO: 1001960 - protein, 9 aa, Homo Sapiens
FIFVGLLLT

SEQ ID NO: 1001961 - protein, 9 aa, Homo Sapiens
QRLLVALSA

SEQ ID NO: 1001962 - protein, 9 aa, Homo Sapiens
GGCSRLSLA

SEQ ID NO: 1001963 - protein, 9 aa, Homo Sapiens
QVLFFFLLL

SEQ ID NO: 1001964 - protein, 9 aa, Homo Sapiens
ASLTITLVR

SEQ ID NO: 1001965 - protein, 9 aa, Homo Sapiens
FFSHHMFVL

SEQ ID NO: 1001966 - protein, 9 aa, Homo Sapiens
ACAEKDDGQ

SEQ ID NO: 1001967 - protein, 9 aa, Homo Sapiens
RKRNRMHNL

SEQ ID NO: 1001968 - protein, 9 aa, Homo Sapiens
TFLESCGVV

SEQ ID NO: 1001969 - protein, 9 aa, Homo Sapiens
KECCSTGRL

SEQ ID NO: 1001970 - protein, 9 aa, Homo Sapiens
TATPGTGDY

SEQ ID NO: 1001971 - protein, 9 aa, Homo Sapiens
EKKEEDEDY

SEQ ID NO: 1001972 - protein, 9 aa, Homo Sapiens
KGETCFAKQ

SEQ ID NO: 1001973 - protein, 9 aa, Homo Sapiens
YLENLNKKD

SEQ ID NO: 1001974 - protein, 9 aa, Homo Sapiens
MNSTRHEPM

SEQ ID NO: 1001975 - protein, 9 aa, Homo Sapiens
GAGGEEFEV

SEQ ID NO: 1001976 - protein, 9 aa, Homo Sapiens
KPQRVGGSG

SEQ ID NO: 1001977 - protein, 9 aa, Homo Sapiens
EPKEGTPLW

SEQ ID NO: 1001978 - protein, 9 aa, Homo Sapiens
YLLQPTQRC

SEQ ID NO: 1001979 - protein, 9 aa, Homo Sapiens
FSAEADRAT

SEQ ID NO: 1001980 - protein, 9 aa, Homo Sapiens
IELMFLNCF

SEQ ID NO: 1001981 - protein, 9 aa, Homo Sapiens
KSLKKEYTV

SEQ ID NO: 1001982 - protein, 9 aa, Homo Sapiens
CRSGFGLGS

SEQ ID NO: 1001983 - protein, 9 aa, Homo Sapiens
FGNKVTSMT

SEQ ID NO: 1001984 - protein, 9 aa, Homo Sapiens
GDSDDEQKV

SEQ ID NO: 1001985 - protein, 9 aa, Homo Sapiens
SALLYPDSR

SEQ ID NO: 1001986 - protein, 9 aa, Homo Sapiens
HQRRPPKLP

SEQ ID NO: 1001987 - protein, 9 aa, Homo Sapiens
LLSHLPEEI

SEQ ID NO: 1001988 - protein, 9 aa, Homo Sapiens
NDLIYSVRG

SEQ ID NO: 1001989 - protein, 9 aa, Homo Sapiens
ECNYLCTAC

SEQ ID NO: 1001990 - protein, 9 aa, Homo Sapiens
LIAMVATAQ

SEQ ID NO: 1001991 - protein, 9 aa, Homo Sapiens
LLSIVRPGT

SEQ ID NO: 1001992 - protein, 9 aa, Homo Sapiens
GTVEFKGFL

SEQ ID NO: 1001993 - protein, 9 aa, Homo Sapiens
ALEPLPLLF

SEQ ID NO: 1001994 - protein, 9 aa, Homo Sapiens
YSICSEESP

SEQ ID NO: 1001995 - protein, 9 aa, Homo Sapiens
HVSHDPRLH

SEQ ID NO: 1001996 - protein, 9 aa, Homo Sapiens
PLMRDCALA

SEQ ID NO: 1001997 - protein, 9 aa, Homo Sapiens
DFLGLSANE

SEQ ID NO: 1001998 - protein, 9 aa, Homo Sapiens
KFIHSGIIS

SEQ ID NO: 1001999 - protein, 9 aa, Homo Sapiens
QVALSEVDL

SEQ ID NO: 1002000 - protein, 9 aa, Homo Sapiens
ERSLSIPSA

SEQ ID NO: 1002001 - protein, 9 aa, Homo Sapiens
EGSALLYPD

SEQ ID NO: 1002002 - protein, 9 aa, Homo Sapiens
DKSIVIRLL

SEQ ID NO: 1002003 - protein, 9 aa, Homo Sapiens
ALMNHSYCP

SEQ ID NO: 1002004 - protein, 9 aa, Homo Sapiens
FCHMSLLDI

SEQ ID NO: 1002005 - protein, 9 aa, Homo Sapiens
SSPEKAPLV

SEQ ID NO: 1002006 - protein, 9 aa, Homo Sapiens
QIRKCNKQP

SEQ ID NO: 1002007 - protein, 9 aa, Homo Sapiens
NLSEHVSHD

SEQ ID NO: 1002008 - protein, 9 aa, Homo Sapiens
KCPVECPLR

SEQ ID NO: 1002009 - protein, 9 aa, Homo Sapiens
NTQEAARGQ

SEQ ID NO: 1002010 - protein, 9 aa, Homo Sapiens
VLDVDCLES

SEQ ID NO: 1002011 - protein, 9 aa, Homo Sapiens
QRQVLFFFL

SEQ ID NO: 1002012 - protein, 9 aa, Homo Sapiens
GKSKKETLK

SEQ ID NO: 1002013 - protein, 9 aa, Homo Sapiens
ALPVASPSL

SEQ ID NO: 1002014 - protein, 9 aa, Homo Sapiens
GAWCPVEDD

SEQ ID NO: 1002015 - protein, 9 aa, Homo Sapiens
NQKYNEVMA

SEQ ID NO: 1002016 - protein, 9 aa, Homo Sapiens
LEMMWSECK

SEQ ID NO: 1002017 - protein, 9 aa, Homo Sapiens
PRPWVVDDD

SEQ ID NO: 1002018 - protein, 9 aa, Homo Sapiens
NWYYSQTNK

SEQ ID NO: 1002019 - protein, 9 aa, Homo Sapiens
QVLLEEEER

SEQ ID NO: 1002020 - protein, 9 aa, Homo Sapiens
VLVPAKNQP

SEQ ID NO: 1002021 - protein, 9 aa, Homo Sapiens
SHDSISSKP

SEQ ID NO: 1002022 - protein, 9 aa, Homo Sapiens
SETRSTHTL

SEQ ID NO: 1002023 - protein, 9 aa, Homo Sapiens
TGEKPYWCS

SEQ ID NO: 1002024 - protein, 9 aa, Homo Sapiens
IYLWTMFQA

SEQ ID NO: 1002025 - protein, 9 aa, Homo Sapiens
ESKFLTEAE

SEQ ID NO: 1002026 - protein, 9 aa, Homo Sapiens
PLLKYKEKI

SEQ ID NO: 1002027 - protein, 9 aa, Homo Sapiens
AFACAEKDD

SEQ ID NO: 1002028 - protein, 9 aa, Homo Sapiens
ETSSTFQLN

SEQ ID NO: 1002029 - protein, 9 aa, Homo Sapiens
FFAGCTAQH

SEQ ID NO: 1002030 - protein, 9 aa, Homo Sapiens
KFLTEAEII

SEQ ID NO: 1002031 - protein, 9 aa, Homo Sapiens
YRPRKKSKV

SEQ ID NO: 1002032 - protein, 9 aa, Homo Sapiens
GAFGHNPHL

SEQ ID NO: 1002033 - protein, 9 aa, Homo Sapiens
KPGSRHRDP

SEQ ID NO: 1002034 - protein, 9 aa, Homo Sapiens
ILALAQKHP

SEQ ID NO: 1002035 - protein, 9 aa, Homo Sapiens
FPWLKSELE

SEQ ID NO: 1002036 - protein, 9 aa, Homo Sapiens
STLALPVAS

SEQ ID NO: 1002037 - protein, 9 aa, Homo Sapiens
RGHSCPQAM

SEQ ID NO: 1002038 - protein, 9 aa, Homo Sapiens
TPLNRYSDR

SEQ ID NO: 1002039 - protein, 9 aa, Homo Sapiens
VAKGNYGLL

SEQ ID NO: 1002040 - protein, 9 aa, Homo Sapiens
DALINQKYN

SEQ ID NO: 1002041 - protein, 9 aa, Homo Sapiens
DKACRRPRP

SEQ ID NO: 1002042 - protein, 9 aa, Homo Sapiens
KFVDQPEGT

SEQ ID NO: 1002043 - protein, 9 aa, Homo Sapiens
TCLRPNIYV

SEQ ID NO: 1002044 - protein, 9 aa, Homo Sapiens
FWCDSISGH

SEQ ID NO: 1002045 - protein, 9 aa, Homo Sapiens
KGKKLGLYF

SEQ ID NO: 1002046 - protein, 9 aa, Homo Sapiens
PALLWRLLM

SEQ ID NO: 1002047 - protein, 9 aa, Homo Sapiens
FIKLIIFSW

SEQ ID NO: 1002048 - protein, 9 aa, Homo Sapiens
LAAAAELAQ

SEQ ID NO: 1002049 - protein, 9 aa, Homo Sapiens
VAPAKARPR

SEQ ID NO: 1002050 - protein, 9 aa, Homo Sapiens
RPGGTSGSR

SEQ ID NO: 1002051 - protein, 9 aa, Homo Sapiens
CGFTFWQWF

SEQ ID NO: 1002052 - protein, 9 aa, Homo Sapiens
NEYSLWTAY

SEQ ID NO: 1002053 - protein, 9 aa, Homo Sapiens
LLSVQTSTI

SEQ ID NO: 1002054 - protein, 9 aa, Homo Sapiens
SKLDKMLDP

SEQ ID NO: 1002055 - protein, 9 aa, Homo Sapiens
PWNKTRVVS

SEQ ID NO: 1002056 - protein, 9 aa, Homo Sapiens
KLQVDVKLD

SEQ ID NO: 1002057 - protein, 9 aa, Homo Sapiens
HGYPRCRSC

SEQ ID NO: 1002058 - protein, 9 aa, Homo Sapiens
CGKFLRNLF

SEQ ID NO: 1002059 - protein, 9 aa, Homo Sapiens
VFPPRLDRV

SEQ ID NO: 1002060 - protein, 9 aa, Homo Sapiens
DPTADVSCM

SEQ ID NO: 1002061 - protein, 9 aa, Homo Sapiens
RRELKAVVP

SEQ ID NO: 1002062 - protein, 9 aa, Homo Sapiens
ENLKKQEDV

SEQ ID NO: 1002063 - protein, 9 aa, Homo Sapiens
PETSQPSPP

SEQ ID NO: 1002064 - protein, 9 aa, Homo Sapiens
GALKRSEPL

SEQ ID NO: 1002065 - protein, 9 aa, Homo Sapiens
TFWGELMKS

SEQ ID NO: 1002066 - protein, 9 aa, Homo Sapiens
NKTVILADE

SEQ ID NO: 1002067 - protein, 9 aa, Homo Sapiens
QKTEKSPPP

SEQ ID NO: 1002068 - protein, 9 aa, Homo Sapiens
KLIRIGCFI

SEQ ID NO: 1002069 - protein, 9 aa, Homo Sapiens
RWGREEEKK

SEQ ID NO: 1002070 - protein, 9 aa, Homo Sapiens
DAQSQVGFI

SEQ ID NO: 1002071 - protein, 9 aa, Homo Sapiens
PIFVYLFPG

SEQ ID NO: 1002072 - protein, 9 aa, Homo Sapiens
SVLGKHTEP

SEQ ID NO: 1002073 - protein, 9 aa, Homo Sapiens
IEADQTTLE

SEQ ID NO: 1002074 - protein, 9 aa, Homo Sapiens
ICRMATEED

SEQ ID NO: 1002075 - protein, 9 aa, Homo Sapiens
LLNRKDPDS

SEQ ID NO: 1002076 - protein, 9 aa, Homo Sapiens
FYVADLGNV

SEQ ID NO: 1002077 - protein, 9 aa, Homo Sapiens
GLSANELIA

SEQ ID NO: 1002078 - protein, 9 aa, Homo Sapiens
QSVRKGIMA

SEQ ID NO: 1002079 - protein, 9 aa, Homo Sapiens
RKAQRKQQM

SEQ ID NO: 1002080 - protein, 9 aa, Homo Sapiens
DTIYKFEEE

SEQ ID NO: 1002081 - protein, 9 aa, Homo Sapiens
ENGAEPLLC

SEQ ID NO: 1002082 - protein, 9 aa, Homo Sapiens
SDHLNAMDS

SEQ ID NO: 1002083 - protein, 9 aa, Homo Sapiens
LQDSGKAEK

SEQ ID NO: 1002084 - protein, 9 aa, Homo Sapiens
DHSLPWGKP

SEQ ID NO: 1002085 - protein, 9 aa, Homo Sapiens
GPPRKDGLP

SEQ ID NO: 1002086 - protein, 9 aa, Homo Sapiens
NTSPTDSPS

SEQ ID NO: 1002087 - protein, 9 aa, Homo Sapiens
KPTIFTEKP

SEQ ID NO: 1002088 - protein, 9 aa, Homo Sapiens
LLRDSNKTT

SEQ ID NO: 1002089 - protein, 9 aa, Homo Sapiens
AGSLYEYVF

SEQ ID NO: 1002090 - protein, 9 aa, Homo Sapiens
PILTLRVSR

SEQ ID NO: 1002091 - protein, 9 aa, Homo Sapiens
NITTRNLTL

SEQ ID NO: 1002092 - protein, 9 aa, Homo Sapiens
AVPGALASR

SEQ ID NO: 1002093 - protein, 9 aa, Homo Sapiens
IFVGLLLTS

SEQ ID NO: 1002094 - protein, 9 aa, Homo Sapiens
PIAPIHLSS

SEQ ID NO: 1002095 - protein, 9 aa, Homo Sapiens
SYSCTECGK

SEQ ID NO: 1002096 - protein, 9 aa, Homo Sapiens
SWCRSSGLP

SEQ ID NO: 1002097 - protein, 9 aa, Homo Sapiens
KKIVTEEKI

SEQ ID NO: 1002098 - protein, 9 aa, Homo Sapiens
PFLASTSPL

SEQ ID NO: 1002099 - protein, 9 aa, Homo Sapiens
PTLPSDSSR

SEQ ID NO: 1002100 - protein, 9 aa, Homo Sapiens
ALGILAAAS

SEQ ID NO: 1002101 - protein, 9 aa, Homo Sapiens
DPELADLPQ

SEQ ID NO: 1002102 - protein, 9 aa, Homo Sapiens
CCTSYFCTC

SEQ ID NO: 1002103 - protein, 9 aa, Homo Sapiens
QSLVYFFVG

SEQ ID NO: 1002104 - protein, 9 aa, Homo Sapiens
EDDDIKLRG

SEQ ID NO: 1002105 - protein, 9 aa, Homo Sapiens
LNLGVMVLF

SEQ ID NO: 1002106 - protein, 9 aa, Homo Sapiens
DSISSKPTQ

SEQ ID NO: 1002107 - protein, 9 aa, Homo Sapiens
EYSLWTAYQ

SEQ ID NO: 1002108 - protein, 9 aa, Homo Sapiens
SGQWGLPFS

SEQ ID NO: 1002109 - protein, 9 aa, Homo Sapiens
SRARSDNLT

SEQ ID NO: 1002110 - protein, 9 aa, Homo Sapiens
RKKCAKCRL

SEQ ID NO: 1002111 - protein, 9 aa, Homo Sapiens
FKSSGSSSS

SEQ ID NO: 1002112 - protein, 9 aa, Homo Sapiens
KAKVPLQAL

SEQ ID NO: 1002113 - protein, 9 aa, Homo Sapiens
RKDHSLPWG

SEQ ID NO: 1002114 - protein, 9 aa, Homo Sapiens
YIFCLLPPL

SEQ ID NO: 1002115 - protein, 9 aa, Homo Sapiens
PPSTPSPYE

SEQ ID NO: 1002116 - protein, 9 aa, Homo Sapiens
RADPLFRND

SEQ ID NO: 1002117 - protein, 9 aa, Homo Sapiens
RYSICSEES

SEQ ID NO: 1002118 - protein, 9 aa, Homo Sapiens
PPFLACPFS

SEQ ID NO: 1002119 - protein, 9 aa, Homo Sapiens
IVIWGALSI

SEQ ID NO: 1002120 - protein, 9 aa, Homo Sapiens
DSPVTPMKE

SEQ ID NO: 1002121 - protein, 9 aa, Homo Sapiens
RLKAEEGSS

SEQ ID NO: 1002122 - protein, 9 aa, Homo Sapiens
SNHLRDVPE

SEQ ID NO: 1002123 - protein, 9 aa, Homo Sapiens
KQTKMEGEP

SEQ ID NO: 1002124 - protein, 9 aa, Homo Sapiens
FFAHFLLGS

SEQ ID NO: 1002125 - protein, 9 aa, Homo Sapiens
IICLVSIYR

SEQ ID NO: 1002126 - protein, 9 aa, Homo Sapiens
LKYHKKIHT

SEQ ID NO: 1002127 - protein, 9 aa, Homo Sapiens
LEDRSVSCL

SEQ ID NO: 1002128 - protein, 9 aa, Homo Sapiens
MQIEQLERF

SEQ ID NO: 1002129 - protein, 9 aa, Homo Sapiens
SHETVQRQK

SEQ ID NO: 1002130 - protein, 9 aa, Homo Sapiens
TALFLLLLN

SEQ ID NO: 1002131 - protein, 9 aa, Homo Sapiens
LLLSSDLPP

SEQ ID NO: 1002132 - protein, 9 aa, Homo Sapiens
ASPDTQLGN

SEQ ID NO: 1002133 - protein, 9 aa, Homo Sapiens
PSINQKIVT

SEQ ID NO: 1002134 - protein, 9 aa, Homo Sapiens
KFKFRGFLK

SEQ ID NO: 1002135 - protein, 9 aa, Homo Sapiens
LSSFVQDYG

SEQ ID NO: 1002136 - protein, 9 aa, Homo Sapiens
QKTFQSILE

SEQ ID NO: 1002137 - protein, 9 aa, Homo Sapiens
RSVASPDTQ

SEQ ID NO: 1002138 - protein, 9 aa, Homo Sapiens
LKGEILWSQ

SEQ ID NO: 1002139 - protein, 9 aa, Homo Sapiens
YLCTACMNN

SEQ ID NO: 1002140 - protein, 9 aa, Homo Sapiens
FLQLRVVVA

SEQ ID NO: 1002141 - protein, 9 aa, Homo Sapiens
SLTITLVRE

SEQ ID NO: 1002142 - protein, 9 aa, Homo Sapiens
LSSGRRDPK

SEQ ID NO: 1002143 - protein, 9 aa, Homo Sapiens
LDKVVSWAY

SEQ ID NO: 1002144 - protein, 9 aa, Homo Sapiens
KSFKSSGSS

SEQ ID NO: 1002145 - protein, 9 aa, Homo Sapiens
SGQSSFLWQ

SEQ ID NO: 1002146 - protein, 9 aa, Homo Sapiens
SLGRLLSIS

SEQ ID NO: 1002147 - protein, 9 aa, Homo Sapiens
FSSAGRQRT

SEQ ID NO: 1002148 - protein, 9 aa, Homo Sapiens
SGSDGLDSM

SEQ ID NO: 1002149 - protein, 9 aa, Homo Sapiens
ECRRCYVKC

SEQ ID NO: 1002150 - protein, 9 aa, Homo Sapiens
VHKLQDSGK

SEQ ID NO: 1002151 - protein, 9 aa, Homo Sapiens
FYGIRRLIK

SEQ ID NO: 1002152 - protein, 9 aa, Homo Sapiens
LSRTTPIPE

SEQ ID NO: 1002153 - protein, 9 aa, Homo Sapiens
ILFPSIEVG

SEQ ID NO: 1002154 - protein, 9 aa, Homo Sapiens
LTFWGELMK

SEQ ID NO: 1002155 - protein, 9 aa, Homo Sapiens
SSRARSDNL

SEQ ID NO: 1002156 - protein, 9 aa, Homo Sapiens
LGPVDKGHV

SEQ ID NO: 1002157 - protein, 9 aa, Homo Sapiens
LGSCQPAPF

SEQ ID NO: 1002158 - protein, 9 aa, Homo Sapiens
MHHSPQVDE

SEQ ID NO: 1002159 - protein, 9 aa, Homo Sapiens
DKTGWVIKN

SEQ ID NO: 1002160 - protein, 9 aa, Homo Sapiens
FHQAPISTV

SEQ ID NO: 1002161 - protein, 9 aa, Homo Sapiens
QQENRKQLL

SEQ ID NO: 1002162 - protein, 9 aa, Homo Sapiens
VQYLLYIRN

SEQ ID NO: 1002163 - protein, 9 aa, Homo Sapiens
VMGTSEKKT

SEQ ID NO: 1002164 - protein, 9 aa, Homo Sapiens
SPPLPYCGV

SEQ ID NO: 1002165 - protein, 9 aa, Homo Sapiens
IRLNPEECA

SEQ ID NO: 1002166 - protein, 9 aa, Homo Sapiens
AFGHNPHLH

SEQ ID NO: 1002167 - protein, 9 aa, Homo Sapiens
SHIGNFTQA

SEQ ID NO: 1002168 - protein, 9 aa, Homo Sapiens
PISSSKRKF

SEQ ID NO: 1002169 - protein, 9 aa, Homo Sapiens
QRRPPKLPK

SEQ ID NO: 1002170 - protein, 9 aa, Homo Sapiens
YARWNKTVR

SEQ ID NO: 1002171 - protein, 9 aa, Homo Sapiens
KFEARRKEL

SEQ ID NO: 1002172 - protein, 9 aa, Homo Sapiens
PPPPPLPSS

SEQ ID NO: 1002173 - protein, 9 aa, Homo Sapiens
SFGKSQPAP

SEQ ID NO: 1002174 - protein, 9 aa, Homo Sapiens
TPRPFEEQF

SEQ ID NO: 1002175 - protein, 9 aa, Homo Sapiens
KVPLQALHM

SEQ ID NO: 1002176 - protein, 9 aa, Homo Sapiens
ELKAVVPDT

SEQ ID NO: 1002177 - protein, 9 aa, Homo Sapiens
QWGLPFSPL

SEQ ID NO: 1002178 - protein, 9 aa, Homo Sapiens
SSAPPKTTA

SEQ ID NO: 1002179 - protein, 9 aa, Homo Sapiens
MKPHDIFKA

SEQ ID NO: 1002180 - protein, 9 aa, Homo Sapiens
IAHVDGIPA

SEQ ID NO: 1002181 - protein, 9 aa, Homo Sapiens
KPTGPWEQP

SEQ ID NO: 1002182 - protein, 9 aa, Homo Sapiens
KEYTVGAEA

SEQ ID NO: 1002183 - protein, 9 aa, Homo Sapiens
DTSNGISSS

SEQ ID NO: 1002184 - protein, 9 aa, Homo Sapiens
ISELKDIRV

SEQ ID NO: 1002185 - protein, 9 aa, Homo Sapiens
SHFTRHKAI

SEQ ID NO: 1002186 - protein, 9 aa, Homo Sapiens
AEKGLSSVS

SEQ ID NO: 1002187 - protein, 9 aa, Homo Sapiens
KNFVISKIK

SEQ ID NO: 1002188 - protein, 9 aa, Homo Sapiens
FNLNQYVNK

SEQ ID NO: 1002189 - protein, 9 aa, Homo Sapiens
HFIQDLLPE

SEQ ID NO: 1002190 - protein, 9 aa, Homo Sapiens
VMEINVEKD

SEQ ID NO: 1002191 - protein, 9 aa, Homo Sapiens
IMVWVLEMM

SEQ ID NO: 1002192 - protein, 9 aa, Homo Sapiens
ATVNWRPEV

SEQ ID NO: 1002193 - protein, 9 aa, Homo Sapiens
ILSAELEEQ

SEQ ID NO: 1002194 - protein, 9 aa, Homo Sapiens
DIFKANDLF

SEQ ID NO: 1002195 - protein, 9 aa, Homo Sapiens
RVPEEKAKS

SEQ ID NO: 1002196 - protein, 9 aa, Homo Sapiens
FHYTFHGDS

SEQ ID NO: 1002197 - protein, 9 aa, Homo Sapiens
FFGLQVLLP

SEQ ID NO: 1002198 - protein, 9 aa, Homo Sapiens
YSSSRYPPQ

SEQ ID NO: 1002199 - protein, 9 aa, Homo Sapiens
VNRVPEEKA

SEQ ID NO: 1002200 - protein, 9 aa, Homo Sapiens
QENRKQLLC

SEQ ID NO: 1002201 - protein, 9 aa, Homo Sapiens
SRAVCNLKK

SEQ ID NO: 1002202 - protein, 9 aa, Homo Sapiens
LQHSPLAAG

SEQ ID NO: 1002203 - protein, 9 aa, Homo Sapiens
ANAKGLGLQ

SEQ ID NO: 1002204 - protein, 9 aa, Homo Sapiens
PSIQESLKE

SEQ ID NO: 1002205 - protein, 9 aa, Homo Sapiens
HVDGIPASF

SEQ ID NO: 1002206 - protein, 9 aa, Homo Sapiens
FIHSGIISK

SEQ ID NO: 1002207 - protein, 9 aa, Homo Sapiens
RDFATGAVS

SEQ ID NO: 1002208 - protein, 9 aa, Homo Sapiens
AVASLTITL

SEQ ID NO: 1002209 - protein, 9 aa, Homo Sapiens
PLHKVYEQK

SEQ ID NO: 1002210 - protein, 9 aa, Homo Sapiens
LKKIPRDLP

SEQ ID NO: 1002211 - protein, 9 aa, Homo Sapiens
DKVVSWAYQ

SEQ ID NO: 1002212 - protein, 9 aa, Homo Sapiens
ILAAASFKH

SEQ ID NO: 1002213 - protein, 9 aa, Homo Sapiens
LALSPRASS

SEQ ID NO: 1002214 - protein, 9 aa, Homo Sapiens
VSFSFNDIG

SEQ ID NO: 1002215 - protein, 9 aa, Homo Sapiens
VSANNGEIG

SEQ ID NO: 1002216 - protein, 9 aa, Homo Sapiens
HGDSHATFA

SEQ ID NO: 1002217 - protein, 9 aa, Homo Sapiens
LEAPGEVVA

SEQ ID NO: 1002218 - protein, 9 aa, Homo Sapiens
LCEPNNKER

SEQ ID NO: 1002219 - protein, 9 aa, Homo Sapiens
LTLTLAGSS

SEQ ID NO: 1002220 - protein, 9 aa, Homo Sapiens
NSAGLGRPS

SEQ ID NO: 1002221 - protein, 9 aa, Homo Sapiens
SSKFSAHRR

SEQ ID NO: 1002222 - protein, 9 aa, Homo Sapiens
ATPLLDKMD

SEQ ID NO: 1002223 - protein, 9 aa, Homo Sapiens
MIEELNPYT

SEQ ID NO: 1002224 - protein, 9 aa, Homo Sapiens
RMATEEDND

SEQ ID NO: 1002225 - protein, 9 aa, Homo Sapiens
PMDKNCYEQ

SEQ ID NO: 1002226 - protein, 9 aa, Homo Sapiens
ETSILSLLK

SEQ ID NO: 1002227 - protein, 9 aa, Homo Sapiens
LEFVGSAPQ

SEQ ID NO: 1002228 - protein, 9 aa, Homo Sapiens
APLVGHVYE

SEQ ID NO: 1002229 - protein, 9 aa, Homo Sapiens
KEMFKMVTK

SEQ ID NO: 1002230 - protein, 9 aa, Homo Sapiens
AHFLLGSTL

SEQ ID NO: 1002231 - protein, 9 aa, Homo Sapiens
SPDGTFYVA

SEQ ID NO: 1002232 - protein, 9 aa, Homo Sapiens
QLVISIIQV

SEQ ID NO: 1002233 - protein, 9 aa, Homo Sapiens
NYTTVCREF

SEQ ID NO: 1002234 - protein, 9 aa, Homo Sapiens
DSATCKQIT

SEQ ID NO: 1002235 - protein, 9 aa, Homo Sapiens
KDTIYKFEE

SEQ ID NO: 1002236 - protein, 9 aa, Homo Sapiens
FSLLELDNV

SEQ ID NO: 1002237 - protein, 9 aa, Homo Sapiens
CKIGPSIFN

SEQ ID NO: 1002238 - protein, 9 aa, Homo Sapiens
FYGANFSWN

SEQ ID NO: 1002239 - protein, 9 aa, Homo Sapiens
DSPQCDREV

SEQ ID NO: 1002240 - protein, 9 aa, Homo Sapiens
STMKKKLEA

SEQ ID NO: 1002241 - protein, 9 aa, Homo Sapiens
VNWYYSQTN

SEQ ID NO: 1002242 - protein, 9 aa, Homo Sapiens
RWGDPELIA

SEQ ID NO: 1002243 - protein, 9 aa, Homo Sapiens
CISEWKRRD

SEQ ID NO: 1002244 - protein, 9 aa, Homo Sapiens
ATPGTGDYK

SEQ ID NO: 1002245 - protein, 9 aa, Homo Sapiens
KGSIGFKEF

SEQ ID NO: 1002246 - protein, 9 aa, Homo Sapiens
FATGAVSQY

SEQ ID NO: 1002247 - protein, 9 aa, Homo Sapiens
ASFCHMSLL

SEQ ID NO: 1002248 - protein, 9 aa, Homo Sapiens
ALASRGSPL

SEQ ID NO: 1002249 - protein, 9 aa, Homo Sapiens
NVLRLFLSA

SEQ ID NO: 1002250 - protein, 9 aa, Homo Sapiens
GQDRNQRWV

SEQ ID NO: 1002251 - protein, 9 aa, Homo Sapiens
KSNLHSYQK

SEQ ID NO: 1002252 - protein, 9 aa, Homo Sapiens
GGRVKPQRV

SEQ ID NO: 1002253 - protein, 9 aa, Homo Sapiens
TMQKVNSAL

SEQ ID NO: 1002254 - protein, 9 aa, Homo Sapiens
FKANDLFEN

SEQ ID NO: 1002255 - protein, 9 aa, Homo Sapiens
IGAGGEEFE

SEQ ID NO: 1002256 - protein, 9 aa, Homo Sapiens
LHMFTSKLD

SEQ ID NO: 1002257 - protein, 9 aa, Homo Sapiens
LCERMRAQP

SEQ ID NO: 1002258 - protein, 9 aa, Homo Sapiens
GGGNRDILC

SEQ ID NO: 1002259 - protein, 9 aa, Homo Sapiens
IFTLIGNLL

SEQ ID NO: 1002260 - protein, 9 aa, Homo Sapiens
QYLLYIRNS

SEQ ID NO: 1002261 - protein, 9 aa, Homo Sapiens
VQGVDARSH

SEQ ID NO: 1002262 - protein, 9 aa, Homo Sapiens
YYKDDPHYF

SEQ ID NO: 1002263 - protein, 9 aa, Homo Sapiens
DDSFTDQSS

SEQ ID NO: 1002264 - protein, 9 aa, Homo Sapiens
MIDGRLLEH

SEQ ID NO: 1002265 - protein, 9 aa, Homo Sapiens
DADHEAQLL

SEQ ID NO: 1002266 - protein, 9 aa, Homo Sapiens
SSSAGSSGL

SEQ ID NO: 1002267 - protein, 9 aa, Homo Sapiens
SALVEFIQC

SEQ ID NO: 1002268 - protein, 9 aa, Homo Sapiens
EAVLARQVP

SEQ ID NO: 1002269 - protein, 9 aa, Homo Sapiens
AASVELLSK

SEQ ID NO: 1002270 - protein, 9 aa, Homo Sapiens
GECPFSLAD

SEQ ID NO: 1002271 - protein, 9 aa, Homo Sapiens
QLSRTLSRT

SEQ ID NO: 1002272 - protein, 9 aa, Homo Sapiens
QTFCPNNVQ

SEQ ID NO: 1002273 - protein, 9 aa, Homo Sapiens
AKFYDHLEF

SEQ ID NO: 1002274 - protein, 9 aa, Homo Sapiens
IYEVLRHTS

SEQ ID NO: 1002275 - protein, 9 aa, Homo Sapiens
TMGCTALFL

SEQ ID NO: 1002276 - protein, 9 aa, Homo Sapiens
GLALALLGG

SEQ ID NO: 1002277 - protein, 9 aa, Homo Sapiens
FEVNPSVEL

SEQ ID NO: 1002278 - protein, 9 aa, Homo Sapiens
EKPLENNTG

SEQ ID NO: 1002279 - protein, 9 aa, Homo Sapiens
TCHKSYARS

SEQ ID NO: 1002280 - protein, 9 aa, Homo Sapiens
KVDLFRAVS

SEQ ID NO: 1002281 - protein, 9 aa, Homo Sapiens
ESCGVVDLI

SEQ ID NO: 1002282 - protein, 9 aa, Homo Sapiens
TIFTEKPTV

SEQ ID NO: 1002283 - protein, 9 aa, Homo Sapiens
SCGEEEDEE

SEQ ID NO: 1002284 - protein, 9 aa, Homo Sapiens
LYAACSIFY

SEQ ID NO: 1002285 - protein, 9 aa, Homo Sapiens
AEKYGLLAI

SEQ ID NO: 1002286 - protein, 9 aa, Homo Sapiens
IFKANDLFE

SEQ ID NO: 1002287 - protein, 9 aa, Homo Sapiens
DVFSKAQIL

SEQ ID NO: 1002288 - protein, 9 aa, Homo Sapiens
GFFLRRTTM

SEQ ID NO: 1002289 - protein, 9 aa, Homo Sapiens
GNCKEFQTE

SEQ ID NO: 1002290 - protein, 9 aa, Homo Sapiens
HGEEKVVAA

SEQ ID NO: 1002291 - protein, 9 aa, Homo Sapiens
CLRLSRELL

SEQ ID NO: 1002292 - protein, 9 aa, Homo Sapiens
QDPEQSTEN

SEQ ID NO: 1002293 - protein, 9 aa, Homo Sapiens
LGIPPLGFG

SEQ ID NO: 1002294 - protein, 9 aa, Homo Sapiens
QAWHRMQFL

SEQ ID NO: 1002295 - protein, 9 aa, Homo Sapiens
FLSADFCNL

SEQ ID NO: 1002296 - protein, 9 aa, Homo Sapiens
CQIIEHTEK

SEQ ID NO: 1002297 - protein, 9 aa, Homo Sapiens
LRAMLKAEK

SEQ ID NO: 1002298 - protein, 9 aa, Homo Sapiens
DYEILYWDS

SEQ ID NO: 1002299 - protein, 9 aa, Homo Sapiens
PFLRGHYRL

SEQ ID NO: 1002300 - protein, 9 aa, Homo Sapiens
FTRHKAIHT

SEQ ID NO: 1002301 - protein, 9 aa, Homo Sapiens
PEVQKKIVT

SEQ ID NO: 1002302 - protein, 9 aa, Homo Sapiens
LPPESIPAP

SEQ ID NO: 1002303 - protein, 9 aa, Homo Sapiens
QGLSACMVC

SEQ ID NO: 1002304 - protein, 9 aa, Homo Sapiens
VFFQQELRK

SEQ ID NO: 1002305 - protein, 9 aa, Homo Sapiens
LPNESTLID

SEQ ID NO: 1002306 - protein, 9 aa, Homo Sapiens
PDECLDTSM

SEQ ID NO: 1002307 - protein, 9 aa, Homo Sapiens
LSREMNKTV

SEQ ID NO: 1002308 - protein, 9 aa, Homo Sapiens
LRQHSKHVG

SEQ ID NO: 1002309 - protein, 9 aa, Homo Sapiens
FACPEKETS

SEQ ID NO: 1002310 - protein, 9 aa, Homo Sapiens
VSPDGTFYV

SEQ ID NO: 1002311 - protein, 9 aa, Homo Sapiens
LDSWTLRLH

SEQ ID NO: 1002312 - protein, 9 aa, Homo Sapiens
KQPCQTRWM

SEQ ID NO: 1002313 - protein, 9 aa, Homo Sapiens
NIWKQILRI

SEQ ID NO: 1002314 - protein, 9 aa, Homo Sapiens
SWTAITTAS

SEQ ID NO: 1002315 - protein, 9 aa, Homo Sapiens
GAKKVYLGE

SEQ ID NO: 1002316 - protein, 9 aa, Homo Sapiens
LLDTGKEEA

SEQ ID NO: 1002317 - protein, 9 aa, Homo Sapiens
RPFLKKKTR

SEQ ID NO: 1002318 - protein, 9 aa, Homo Sapiens
YTEARKAQR

SEQ ID NO: 1002319 - protein, 9 aa, Homo Sapiens
QGKDCSLPV

SEQ ID NO: 1002320 - protein, 9 aa, Homo Sapiens
LSEESDLEI

SEQ ID NO: 1002321 - protein, 9 aa, Homo Sapiens
PALRPRVGG

SEQ ID NO: 1002322 - protein, 9 aa, Homo Sapiens
GALVPLEPI

SEQ ID NO: 1002323 - protein, 9 aa, Homo Sapiens
GFKPKRPNP

SEQ ID NO: 1002324 - protein, 9 aa, Homo Sapiens
AIESTASLE

SEQ ID NO: 1002325 - protein, 9 aa, Homo Sapiens
ETSQPSPPG

SEQ ID NO: 1002326 - protein, 9 aa, Homo Sapiens
HFLLGSTLG

SEQ ID NO: 1002327 - protein, 9 aa, Homo Sapiens
VSLFSKARW

SEQ ID NO: 1002328 - protein, 9 aa, Homo Sapiens
AKLRSWCRS

SEQ ID NO: 1002329 - protein, 9 aa, Homo Sapiens
NFLDLILSS

SEQ ID NO: 1002330 - protein, 9 aa, Homo Sapiens
CWPLEAPGE

SEQ ID NO: 1002331 - protein, 9 aa, Homo Sapiens
QVSLFKIPI

SEQ ID NO: 1002332 - protein, 9 aa, Homo Sapiens
NGFLFKDEF

SEQ ID NO: 1002333 - protein, 9 aa, Homo Sapiens
APPQQFSYQ

SEQ ID NO: 1002334 - protein, 9 aa, Homo Sapiens
SCICNSGKT

SEQ ID NO: 1002335 - protein, 9 aa, Homo Sapiens
SYEWTDGIV

SEQ ID NO: 1002336 - protein, 9 aa, Homo Sapiens
LSMEENSGL

SEQ ID NO: 1002337 - protein, 9 aa, Homo Sapiens
LSVQTSTIK

SEQ ID NO: 1002338 - protein, 9 aa, Homo Sapiens
LNRKDPDSS

SEQ ID NO: 1002339 - protein, 9 aa, Homo Sapiens
LFRAVSKPD

SEQ ID NO: 1002340 - protein, 9 aa, Homo Sapiens
KGKSDRKYY

SEQ ID NO: 1002341 - protein, 9 aa, Homo Sapiens
DRDEPHSPN

SEQ ID NO: 1002342 - protein, 9 aa, Homo Sapiens
FSQSPHRLR

SEQ ID NO: 1002343 - protein, 9 aa, Homo Sapiens
ELLLLNRAD

SEQ ID NO: 1002344 - protein, 9 aa, Homo Sapiens
LRPDVFSKA

SEQ ID NO: 1002345 - protein, 9 aa, Homo Sapiens
AVSQYTVQC

SEQ ID NO: 1002346 - protein, 9 aa, Homo Sapiens
VSYSSCPEI

SEQ ID NO: 1002347 - protein, 9 aa, Homo Sapiens
RSSGLPNRP

SEQ ID NO: 1002348 - protein, 9 aa, Homo Sapiens
YGSHFQGNL

SEQ ID NO: 1002349 - protein, 9 aa, Homo Sapiens
FMDVDQTPS

SEQ ID NO: 1002350 - protein, 9 aa, Homo Sapiens
NGAEPLLCP

SEQ ID NO: 1002351 - protein, 9 aa, Homo Sapiens
GIPWDGKTP

SEQ ID NO: 1002352 - protein, 9 aa, Homo Sapiens
TLELEFVGS

SEQ ID NO: 1002353 - protein, 9 aa, Homo Sapiens
RCSCSTSIF

SEQ ID NO: 1002354 - protein, 9 aa, Homo Sapiens
AEYIRNDYR

SEQ ID NO: 1002355 - protein, 9 aa, Homo Sapiens
CFFLAAMGF

SEQ ID NO: 1002356 - protein, 9 aa, Homo Sapiens
KGHAHCQPR

SEQ ID NO: 1002357 - protein, 9 aa, Homo Sapiens
GCIPLQRGQ

SEQ ID NO: 1002358 - protein, 9 aa, Homo Sapiens
LKAVVPDTV

SEQ ID NO: 1002359 - protein, 9 aa, Homo Sapiens
SLWTAYQNE

SEQ ID NO: 1002360 - protein, 9 aa, Homo Sapiens
AESFNQKGS

SEQ ID NO: 1002361 - protein, 9 aa, Homo Sapiens
LGFKQIYLW

SEQ ID NO: 1002362 - protein, 9 aa, Homo Sapiens
SFFGETPAL

SEQ ID NO: 1002363 - protein, 9 aa, Homo Sapiens
SSSSGRVIG

SEQ ID NO: 1002364 - protein, 9 aa, Homo Sapiens
SRSWDGLLV

SEQ ID NO: 1002365 - protein, 9 aa, Homo Sapiens
IITLSEDHS

SEQ ID NO: 1002366 - protein, 9 aa, Homo Sapiens
RKFIFVGLL

SEQ ID NO: 1002367 - protein, 9 aa, Homo Sapiens
MKLTLPESL

SEQ ID NO: 1002368 - protein, 9 aa, Homo Sapiens
CYVKCHRDH

SEQ ID NO: 1002369 - protein, 9 aa, Homo Sapiens
SAPPKTTAA

SEQ ID NO: 1002370 - protein, 9 aa, Homo Sapiens
GKKQVERRG

SEQ ID NO: 1002371 - protein, 9 aa, Homo Sapiens
PIMQMPQYQ

SEQ ID NO: 1002372 - protein, 9 aa, Homo Sapiens
YIRNDYREE

SEQ ID NO: 1002373 - protein, 9 aa, Homo Sapiens
KNLRKRRDT

SEQ ID NO: 1002374 - protein, 9 aa, Homo Sapiens
VEEGRKQLQ

SEQ ID NO: 1002375 - protein, 9 aa, Homo Sapiens
FSIFVMAIT

SEQ ID NO: 1002376 - protein, 9 aa, Homo Sapiens
WRPEVERPP

SEQ ID NO: 1002377 - protein, 9 aa, Homo Sapiens
TKMEGEPQK

SEQ ID NO: 1002378 - protein, 9 aa, Homo Sapiens
SAATLGVNS

SEQ ID NO: 1002379 - protein, 9 aa, Homo Sapiens
RFLYVVGGH

SEQ ID NO: 1002380 - protein, 9 aa, Homo Sapiens
SDSQVLLEE

SEQ ID NO: 1002381 - protein, 9 aa, Homo Sapiens
AVCVVSRFS

SEQ ID NO: 1002382 - protein, 9 aa, Homo Sapiens
GVPDWFSFL

SEQ ID NO: 1002383 - protein, 9 aa, Homo Sapiens
FEVLEYWMR

SEQ ID NO: 1002384 - protein, 9 aa, Homo Sapiens
SHFQGNLSL

SEQ ID NO: 1002385 - protein, 9 aa, Homo Sapiens
EAEHEGVFV

SEQ ID NO: 1002386 - protein, 9 aa, Homo Sapiens
SETLSMEEN

SEQ ID NO: 1002387 - protein, 9 aa, Homo Sapiens
SHMFQLYLE

SEQ ID NO: 1002388 - protein, 9 aa, Homo Sapiens
PEVLPPKKV

SEQ ID NO: 1002389 - protein, 9 aa, Homo Sapiens
AEMFSDFHS

SEQ ID NO: 1002390 - protein, 9 aa, Homo Sapiens
SINIGMVSQ

SEQ ID NO: 1002391 - protein, 9 aa, Homo Sapiens
GRKQLQNYL

SEQ ID NO: 1002392 - protein, 9 aa, Homo Sapiens
LSFFGETPA

SEQ ID NO: 1002393 - protein, 9 aa, Homo Sapiens
PEVERPPEE

SEQ ID NO: 1002394 - protein, 9 aa, Homo Sapiens
KAASVELLS

SEQ ID NO: 1002395 - protein, 9 aa, Homo Sapiens
FRIDKGQIP

SEQ ID NO: 1002396 - protein, 9 aa, Homo Sapiens
GRRELLRKL

SEQ ID NO: 1002397 - protein, 9 aa, Homo Sapiens
PIHLSSEDG

SEQ ID NO: 1002398 - protein, 9 aa, Homo Sapiens
PEDEPFVLE

SEQ ID NO: 1002399 - protein, 9 aa, Homo Sapiens
VASPDTQLG

SEQ ID NO: 1002400 - protein, 9 aa, Homo Sapiens
HSKHVGLDN

SEQ ID NO: 1002401 - protein, 9 aa, Homo Sapiens
SLMEKDVGL

SEQ ID NO: 1002402 - protein, 9 aa, Homo Sapiens
ILSVHNSAR

SEQ ID NO: 1002403 - protein, 9 aa, Homo Sapiens
NCFFLAAMG

SEQ ID NO: 1002404 - protein, 9 aa, Homo Sapiens
EWTCSSSLS

SEQ ID NO: 1002405 - protein, 9 aa, Homo Sapiens
WGREEEKKE

SEQ ID NO: 1002406 - protein, 9 aa, Homo Sapiens
RALCTGDYD

SEQ ID NO: 1002407 - protein, 9 aa, Homo Sapiens
TLANPLRQS

SEQ ID NO: 1002408 - protein, 9 aa, Homo Sapiens
AGGRVKPQR

SEQ ID NO: 1002409 - protein, 9 aa, Homo Sapiens
GHWSPARQR

SEQ ID NO: 1002410 - protein, 9 aa, Homo Sapiens
EPQIRKCNK

SEQ ID NO: 1002411 - protein, 9 aa, Homo Sapiens
FWDFKQSTR

SEQ ID NO: 1002412 - protein, 9 aa, Homo Sapiens
EEKAKSLPV

SEQ ID NO: 1002413 - protein, 9 aa, Homo Sapiens
NYLCTACMN

SEQ ID NO: 1002414 - protein, 9 aa, Homo Sapiens
TRGHSCPQA

SEQ ID NO: 1002415 - protein, 9 aa, Homo Sapiens
HFVSNFNGP

SEQ ID NO: 1002416 - protein, 9 aa, Homo Sapiens
IFYLGAMVS

SEQ ID NO: 1002417 - protein, 9 aa, Homo Sapiens
HVFSRGRKK

SEQ ID NO: 1002418 - protein, 9 aa, Homo Sapiens
NHSYCPNVI

SEQ ID NO: 1002419 - protein, 9 aa, Homo Sapiens
ELVANPVAL

SEQ ID NO: 1002420 - protein, 9 aa, Homo Sapiens
EVCASDSPQ

SEQ ID NO: 1002421 - protein, 9 aa, Homo Sapiens
AEKTCAPSV

SEQ ID NO: 1002422 - protein, 9 aa, Homo Sapiens
KNTSPTDSP

SEQ ID NO: 1002423 - protein, 9 aa, Homo Sapiens
TLPESLKAY

SEQ ID NO: 1002424 - protein, 9 aa, Homo Sapiens
TTKELDFES

SEQ ID NO: 1002425 - protein, 9 aa, Homo Sapiens
KILNNTQEA

SEQ ID NO: 1002426 - protein, 9 aa, Homo Sapiens
VVDPEMTSY

SEQ ID NO: 1002427 - protein, 9 aa, Homo Sapiens
GRNSEEENL

SEQ ID NO: 1002428 - protein, 9 aa, Homo Sapiens
FSPMGLPPM

SEQ ID NO: 1002429 - protein, 9 aa, Homo Sapiens
ILKSTMKKK

SEQ ID NO: 1002430 - protein, 9 aa, Homo Sapiens
AGNLVCHNH

SEQ ID NO: 1002431 - protein, 9 aa, Homo Sapiens
FKQIYLWTM

SEQ ID NO: 1002432 - protein, 9 aa, Homo Sapiens
NKQPCQTRW

SEQ ID NO: 1002433 - protein, 9 aa, Homo Sapiens
LHLRPLWEV

SEQ ID NO: 1002434 - protein, 9 aa, Homo Sapiens
LDSNDNSPE

SEQ ID NO: 1002435 - protein, 9 aa, Homo Sapiens
FQLQGIHSW

SEQ ID NO: 1002436 - protein, 9 aa, Homo Sapiens
HPGTTFFGM

SEQ ID NO: 1002437 - protein, 9 aa, Homo Sapiens
EDQSRLGKK

SEQ ID NO: 1002438 - protein, 9 aa, Homo Sapiens
SQQLAAAAE

SEQ ID NO: 1002439 - protein, 9 aa, Homo Sapiens
PEKPVCLNV

SEQ ID NO: 1002440 - protein, 9 aa, Homo Sapiens
EEGRFPKAT

SEQ ID NO: 1002441 - protein, 9 aa, Homo Sapiens
DVEADPELA

SEQ ID NO: 1002442 - protein, 9 aa, Homo Sapiens
AEISSLAVE

SEQ ID NO: 1002443 - protein, 9 aa, Homo Sapiens
SLPLVTGKF

SEQ ID NO: 1002444 - protein, 9 aa, Homo Sapiens
SVCQLRDSA

SEQ ID NO: 1002445 - protein, 9 aa, Homo Sapiens
SYPEPSAKH

SEQ ID NO: 1002446 - protein, 9 aa, Homo Sapiens
EKLFSCKTD

SEQ ID NO: 1002447 - protein, 9 aa, Homo Sapiens
IESTASLEK

SEQ ID NO: 1002448 - protein, 9 aa, Homo Sapiens
LFKIPIEEL

SEQ ID NO: 1002449 - protein, 9 aa, Homo Sapiens
NEQLTRERR

SEQ ID NO: 1002450 - protein, 9 aa, Homo Sapiens
AGFETTTVS

SEQ ID NO: 1002451 - protein, 9 aa, Homo Sapiens
MHGEANITG

SEQ ID NO: 1002452 - protein, 9 aa, Homo Sapiens
RNLTLSVSS

SEQ ID NO: 1002453 - protein, 9 aa, Homo Sapiens
ALLWRLLMA

SEQ ID NO: 1002454 - protein, 9 aa, Homo Sapiens
STRMSVKPV

SEQ ID NO: 1002455 - protein, 9 aa, Homo Sapiens
AVSPDGTFY

SEQ ID NO: 1002456 - protein, 9 aa, Homo Sapiens
HAKRKATRM

SEQ ID NO: 1002457 - protein, 9 aa, Homo Sapiens
ENVTDFLIS

SEQ ID NO: 1002458 - protein, 9 aa, Homo Sapiens
VMNCSIAVC

SEQ ID NO: 1002459 - protein, 9 aa, Homo Sapiens
QRTHSHERS

SEQ ID NO: 1002460 - protein, 9 aa, Homo Sapiens
INIGMVSQR

SEQ ID NO: 1002461 - protein, 9 aa, Homo Sapiens
IFLSNAPLG

SEQ ID NO: 1002462 - protein, 9 aa, Homo Sapiens
LRPNIYVTG

SEQ ID NO: 1002463 - protein, 9 aa, Homo Sapiens
SAYLPTNLH

SEQ ID NO: 1002464 - protein, 9 aa, Homo Sapiens
TSIFLRLRA

SEQ ID NO: 1002465 - protein, 9 aa, Homo Sapiens
APFCQKCIL

SEQ ID NO: 1002466 - protein, 9 aa, Homo Sapiens
DLGYQNKIK

SEQ ID NO: 1002467 - protein, 9 aa, Homo Sapiens
SLIAMVATA

SEQ ID NO: 1002468 - protein, 9 aa, Homo Sapiens
ECVPQMKEP

SEQ ID NO: 1002469 - protein, 9 aa, Homo Sapiens
TTKENRENS

SEQ ID NO: 1002470 - protein, 9 aa, Homo Sapiens
YKQYASVAY

SEQ ID NO: 1002471 - protein, 9 aa, Homo Sapiens
NSSNYRIGP

SEQ ID NO: 1002472 - protein, 9 aa, Homo Sapiens
KNSGLTEKE

SEQ ID NO: 1002473 - protein, 9 aa, Homo Sapiens
DQAALMIEE

SEQ ID NO: 1002474 - protein, 9 aa, Homo Sapiens
DPEQSTENY

SEQ ID NO: 1002475 - protein, 9 aa, Homo Sapiens
GPSIFNSDL

SEQ ID NO: 1002476 - protein, 9 aa, Homo Sapiens
IGTILLIFY

SEQ ID NO: 1002477 - protein, 9 aa, Homo Sapiens
HSKMSKSFK

SEQ ID NO: 1002478 - protein, 9 aa, Homo Sapiens
TMNGASVEP

SEQ ID NO: 1002479 - protein, 9 aa, Homo Sapiens
FMTLALVLT

SEQ ID NO: 1002480 - protein, 9 aa, Homo Sapiens
REGKRRETE

SEQ ID NO: 1002481 - protein, 9 aa, Homo Sapiens
NLHSYQKTH

SEQ ID NO: 1002482 - protein, 9 aa, Homo Sapiens
TVLQPNPLD

SEQ ID NO: 1002483 - protein, 9 aa, Homo Sapiens
PECNYLCTA

SEQ ID NO: 1002484 - protein, 9 aa, Homo Sapiens
FVRRGFRGC

SEQ ID NO: 1002485 - protein, 9 aa, Homo Sapiens
KKPEKKPKF

SEQ ID NO: 1002486 - protein, 9 aa, Homo Sapiens
TEPKKFNLT

SEQ ID NO: 1002487 - protein, 9 aa, Homo Sapiens
SIPSAESED

SEQ ID NO: 1002488 - protein, 9 aa, Homo Sapiens
LAGSTKVSF

SEQ ID NO: 1002489 - protein, 9 aa, Homo Sapiens
KNCYEQMKA

SEQ ID NO: 1002490 - protein, 9 aa, Homo Sapiens
IPWDGKTPC

SEQ ID NO: 1002491 - protein, 9 aa, Homo Sapiens
VTVHNPKNQ

SEQ ID NO: 1002492 - protein, 9 aa, Homo Sapiens
ELISIFEQT

SEQ ID NO: 1002493 - protein, 9 aa, Homo Sapiens
LNGSLVEFY

SEQ ID NO: 1002494 - protein, 9 aa, Homo Sapiens
TSETRSTHT

SEQ ID NO: 1002495 - protein, 9 aa, Homo Sapiens
DHILCWPLE

SEQ ID NO: 1002496 - protein, 9 aa, Homo Sapiens
GTSEKKTSP

SEQ ID NO: 1002497 - protein, 9 aa, Homo Sapiens
KIPRDLPPE

SEQ ID NO: 1002498 - protein, 9 aa, Homo Sapiens
VEVTGLQNK

SEQ ID NO: 1002499 - protein, 9 aa, Homo Sapiens
DLIRRVANV

SEQ ID NO: 1002500 - protein, 9 aa, Homo Sapiens
RKRDQGGFG

SEQ ID NO: 1002501 - protein, 9 aa, Homo Sapiens
TQKIGFDPE

SEQ ID NO: 1002502 - protein, 9 aa, Homo Sapiens
GANPAFRID

SEQ ID NO: 1002503 - protein, 9 aa, Homo Sapiens
KKNCKVVFF

SEQ ID NO: 1002504 - protein, 9 aa, Homo Sapiens
QKTKKVEKF

SEQ ID NO: 1002505 - protein, 9 aa, Homo Sapiens
LIMVWVLEM

SEQ ID NO: 1002506 - protein, 9 aa, Homo Sapiens
EQKTKLPSS

SEQ ID NO: 1002507 - protein, 9 aa, Homo Sapiens
ITVLYFLSQ

SEQ ID NO: 1002508 - protein, 9 aa, Homo Sapiens
FSMSCDLQG

SEQ ID NO: 1002509 - protein, 9 aa, Homo Sapiens
FYQMERMFN

SEQ ID NO: 1002510 - protein, 9 aa, Homo Sapiens
RKMNETPTE

SEQ ID NO: 1002511 - protein, 9 aa, Homo Sapiens
PKPPEEPLL

SEQ ID NO: 1002512 - protein, 9 aa, Homo Sapiens
ISGDISGPL

SEQ ID NO: 1002513 - protein, 9 aa, Homo Sapiens
RCKEWLAGM

SEQ ID NO: 1002514 - protein, 9 aa, Homo Sapiens
KPGSSDIAT

SEQ ID NO: 1002515 - protein, 9 aa, Homo Sapiens
FLLVNNIFV

SEQ ID NO: 1002516 - protein, 9 aa, Homo Sapiens
SGTNSELTY

SEQ ID NO: 1002517 - protein, 9 aa, Homo Sapiens
RSLSIPSAE

SEQ ID NO: 1002518 - protein, 9 aa, Homo Sapiens
PKPPDPRCV

SEQ ID NO: 1002519 - protein, 9 aa, Homo Sapiens
SDSDEVDCI

SEQ ID NO: 1002520 - protein, 9 aa, Homo Sapiens
KYYILIGFL

SEQ ID NO: 1002521 - protein, 9 aa, Homo Sapiens
AAQTAGVSR

SEQ ID NO: 1002522 - protein, 9 aa, Homo Sapiens
TLHSRTKRD

SEQ ID NO: 1002523 - protein, 9 aa, Homo Sapiens
LYKDPDKDF

SEQ ID NO: 1002524 - protein, 9 aa, Homo Sapiens
PPCLRLSRE

SEQ ID NO: 1002525 - protein, 9 aa, Homo Sapiens
IIGAVLAGS

SEQ ID NO: 1002526 - protein, 9 aa, Homo Sapiens
KHYWKVDVK

SEQ ID NO: 1002527 - protein, 9 aa, Homo Sapiens
FKDGQEANN

SEQ ID NO: 1002528 - protein, 9 aa, Homo Sapiens
RNKTPSDPV

SEQ ID NO: 1002529 - protein, 9 aa, Homo Sapiens
VVSRFSYYN

SEQ ID NO: 1002530 - protein, 9 aa, Homo Sapiens
GIISKRSKN

SEQ ID NO: 1002531 - protein, 9 aa, Homo Sapiens
TPLLDKMDR

SEQ ID NO: 1002532 - protein, 9 aa, Homo Sapiens
SYEAEIFTR

SEQ ID NO: 1002533 - protein, 9 aa, Homo Sapiens
KQELFFFHE

SEQ ID NO: 1002534 - protein, 9 aa, Homo Sapiens
ASSRARSDN

SEQ ID NO: 1002535 - protein, 9 aa, Homo Sapiens
AQKNPTPWL

SEQ ID NO: 1002536 - protein, 9 aa, Homo Sapiens
LISGTQPED

SEQ ID NO: 1002537 - protein, 9 aa, Homo Sapiens
YSPSDAFKI

SEQ ID NO: 1002538 - protein, 9 aa, Homo Sapiens
FAKQHLDSH

SEQ ID NO: 1002539 - protein, 9 aa, Homo Sapiens
GKFASVFYT

SEQ ID NO: 1002540 - protein, 9 aa, Homo Sapiens
EEEKKEESD

SEQ ID NO: 1002541 - protein, 9 aa, Homo Sapiens
QKWGPECNY

SEQ ID NO: 1002542 - protein, 9 aa, Homo Sapiens
SQSHSSASE

SEQ ID NO: 1002543 - protein, 9 aa, Homo Sapiens
TALETLSKL

SEQ ID NO: 1002544 - protein, 9 aa, Homo Sapiens
PLRQSCISI

SEQ ID NO: 1002545 - protein, 9 aa, Homo Sapiens
ETCFAKQHL

SEQ ID NO: 1002546 - protein, 9 aa, Homo Sapiens
PNNKERYYG

SEQ ID NO: 1002547 - protein, 9 aa, Homo Sapiens
IVFGHFSHR

SEQ ID NO: 1002548 - protein, 9 aa, Homo Sapiens
DDPLLSVQT

SEQ ID NO: 1002549 - protein, 9 aa, Homo Sapiens
KYADYFLKV

SEQ ID NO: 1002550 - protein, 9 aa, Homo Sapiens
NSILFFGKF

SEQ ID NO: 1002551 - protein, 9 aa, Homo Sapiens
TALVDMYSH

SEQ ID NO: 1002552 - protein, 9 aa, Homo Sapiens
MQVALSEVD

SEQ ID NO: 1002553 - protein, 9 aa, Homo Sapiens
NLPVGYEAK

SEQ ID NO: 1002554 - protein, 9 aa, Homo Sapiens
TLAKRRSFK

SEQ ID NO: 1002555 - protein, 9 aa, Homo Sapiens
ELKGAKKVY

SEQ ID NO: 1002556 - protein, 9 aa, Homo Sapiens
AVRYSICSE

SEQ ID NO: 1002557 - protein, 9 aa, Homo Sapiens
YITFWGACF

SEQ ID NO: 1002558 - protein, 9 aa, Homo Sapiens
GILAAASFK

SEQ ID NO: 1002559 - protein, 9 aa, Homo Sapiens
KIKWQNFVE

SEQ ID NO: 1002560 - protein, 9 aa, Homo Sapiens
SVPSDQSSS

SEQ ID NO: 1002561 - protein, 9 aa, Homo Sapiens
LQNRSRTQV

SEQ ID NO: 1002562 - protein, 9 aa, Homo Sapiens
PGGWTCVPE

SEQ ID NO: 1002563 - protein, 9 aa, Homo Sapiens
KFIFVGLLL

SEQ ID NO: 1002564 - protein, 9 aa, Homo Sapiens
EMQPIYEVL

SEQ ID NO: 1002565 - protein, 9 aa, Homo Sapiens
SHEKPPNPA

SEQ ID NO: 1002566 - protein, 9 aa, Homo Sapiens
LKRVHRSLK

SEQ ID NO: 1002567 - protein, 9 aa, Homo Sapiens
MTNYTTVCR

SEQ ID NO: 1002568 - protein, 9 aa, Homo Sapiens
PASLLGGRL

SEQ ID NO: 1002569 - protein, 9 aa, Homo Sapiens
LLNRADPLF

SEQ ID NO: 1002570 - protein, 9 aa, Homo Sapiens
PSAYICLFT

SEQ ID NO: 1002571 - protein, 9 aa, Homo Sapiens
KIVTNNNEP

SEQ ID NO: 1002572 - protein, 9 aa, Homo Sapiens
EEEESPDHQ

SEQ ID NO: 1002573 - protein, 9 aa, Homo Sapiens
NLPLSFGKS

SEQ ID NO: 1002574 - protein, 9 aa, Homo Sapiens
HGECPFSLA

SEQ ID NO: 1002575 - protein, 9 aa, Homo Sapiens
LRSLAIMRN

SEQ ID NO: 1002576 - protein, 9 aa, Homo Sapiens
TYDFDKIVH

SEQ ID NO: 1002577 - protein, 9 aa, Homo Sapiens
QTYEVKYTG

SEQ ID NO: 1002578 - protein, 9 aa, Homo Sapiens
ETNGIYEAI

SEQ ID NO: 1002579 - protein, 9 aa, Homo Sapiens
ASPIFVYLF

SEQ ID NO: 1002580 - protein, 9 aa, Homo Sapiens
VNTSIPVTT

SEQ ID NO: 1002581 - protein, 9 aa, Homo Sapiens
ETLIMIVFG

SEQ ID NO: 1002582 - protein, 9 aa, Homo Sapiens
IFFAGCTAQ

SEQ ID NO: 1002583 - protein, 9 aa, Homo Sapiens
KAVVPDTVV

SEQ ID NO: 1002584 - protein, 9 aa, Homo Sapiens
SSSHGQHES

SEQ ID NO: 1002585 - protein, 9 aa, Homo Sapiens
LTLANPLRQ

SEQ ID NO: 1002586 - protein, 9 aa, Homo Sapiens
VLTGAVAKK

SEQ ID NO: 1002587 - protein, 9 aa, Homo Sapiens
SNTSTLTFN

SEQ ID NO: 1002588 - protein, 9 aa, Homo Sapiens
VVQKDENSC

SEQ ID NO: 1002589 - protein, 9 aa, Homo Sapiens
HALRADAPS

SEQ ID NO: 1002590 - protein, 9 aa, Homo Sapiens
QGIFLLAFF

SEQ ID NO: 1002591 - protein, 9 aa, Homo Sapiens
SLQPLAPWN

SEQ ID NO: 1002592 - protein, 9 aa, Homo Sapiens
ALLWEVHRR

SEQ ID NO: 1002593 - protein, 9 aa, Homo Sapiens
CKEWLAGMG

SEQ ID NO: 1002594 - protein, 9 aa, Homo Sapiens
QKDENSCAW

SEQ ID NO: 1002595 - protein, 9 aa, Homo Sapiens
DSNTESVQT

SEQ ID NO: 1002596 - protein, 9 aa, Homo Sapiens
GETNGIYEA

SEQ ID NO: 1002597 - protein, 9 aa, Homo Sapiens
YKSIQIMRQ

SEQ ID NO: 1002598 - protein, 9 aa, Homo Sapiens
GMPPLGMRP

SEQ ID NO: 1002599 - protein, 9 aa, Homo Sapiens
SSTSIDKDA

SEQ ID NO: 1002600 - protein, 9 aa, Homo Sapiens
GPEKKISFP

SEQ ID NO: 1002601 - protein, 9 aa, Homo Sapiens
NSNGRNSEE

SEQ ID NO: 1002602 - protein, 9 aa, Homo Sapiens
EKQVPIAPI

SEQ ID NO: 1002603 - protein, 9 aa, Homo Sapiens
LFMVLFNFI

SEQ ID NO: 1002604 - protein, 9 aa, Homo Sapiens
PLPSSSDTP

SEQ ID NO: 1002605 - protein, 9 aa, Homo Sapiens
AVLAIKSYR

SEQ ID NO: 1002606 - protein, 9 aa, Homo Sapiens
QAVRYSICS

SEQ ID NO: 1002607 - protein, 9 aa, Homo Sapiens
PVRALCTGD

SEQ ID NO: 1002608 - protein, 9 aa, Homo Sapiens
LERGQQKKE

SEQ ID NO: 1002609 - protein, 9 aa, Homo Sapiens
SMDCHRALE

SEQ ID NO: 1002610 - protein, 9 aa, Homo Sapiens
TTCPRPLTP

SEQ ID NO: 1002611 - protein, 9 aa, Homo Sapiens
KEESDAGSS

SEQ ID NO: 1002612 - protein, 9 aa, Homo Sapiens
GTHRDPPHK

SEQ ID NO: 1002613 - protein, 9 aa, Homo Sapiens
AELTQKIGF

SEQ ID NO: 1002614 - protein, 9 aa, Homo Sapiens
MMSLEGRIE

SEQ ID NO: 1002615 - protein, 9 aa, Homo Sapiens
CPRPLTPLA

SEQ ID NO: 1002616 - protein, 9 aa, Homo Sapiens
SEHVSHDPR

SEQ ID NO: 1002617 - protein, 9 aa, Homo Sapiens
IFVMAITAN

SEQ ID NO: 1002618 - protein, 9 aa, Homo Sapiens
LGAVVVAAC

SEQ ID NO: 1002619 - protein, 9 aa, Homo Sapiens
LSLPRSCKE

SEQ ID NO: 1002620 - protein, 9 aa, Homo Sapiens
DSDLLMTSA

SEQ ID NO: 1002621 - protein, 9 aa, Homo Sapiens
PPLPYCGVP

SEQ ID NO: 1002622 - protein, 9 aa, Homo Sapiens
DGAVYVMEI

SEQ ID NO: 1002623 - protein, 9 aa, Homo Sapiens
QQCNFTAWP

SEQ ID NO: 1002624 - protein, 9 aa, Homo Sapiens
CFFLFVENG

SEQ ID NO: 1002625 - protein, 9 aa, Homo Sapiens
ILFFGKFSS

SEQ ID NO: 1002626 - protein, 9 aa, Homo Sapiens
GERKFIFVG

SEQ ID NO: 1002627 - protein, 9 aa, Homo Sapiens
SSPEENVTD

SEQ ID NO: 1002628 - protein, 9 aa, Homo Sapiens
LPALRAIGL

SEQ ID NO: 1002629 - protein, 9 aa, Homo Sapiens
EVERPPEET

SEQ ID NO: 1002630 - protein, 9 aa, Homo Sapiens
LDLILSSGR

SEQ ID NO: 1002631 - protein, 9 aa, Homo Sapiens
VPDWFSFLC

SEQ ID NO: 1002632 - protein, 9 aa, Homo Sapiens
LSDRKFFKM

SEQ ID NO: 1002633 - protein, 9 aa, Homo Sapiens
KKAGKKPSN

SEQ ID NO: 1002634 - protein, 9 aa, Homo Sapiens
HISQCDKVF

SEQ ID NO: 1002635 - protein, 9 aa, Homo Sapiens
KNIFGFSQS

SEQ ID NO: 1002636 - protein, 9 aa, Homo Sapiens
LIAAVVFAC

SEQ ID NO: 1002637 - protein, 9 aa, Homo Sapiens
MKKKLEAAQ

SEQ ID NO: 1002638 - protein, 9 aa, Homo Sapiens
AMVATAQDD

SEQ ID NO: 1002639 - protein, 9 aa, Homo Sapiens
DFGNKVTSM

SEQ ID NO: 1002640 - protein, 9 aa, Homo Sapiens
FMCGTNAFF

SEQ ID NO: 1002641 - protein, 9 aa, Homo Sapiens
ANDRKRNRM

SEQ ID NO: 1002642 - protein, 9 aa, Homo Sapiens
NRADPLFRN

SEQ ID NO: 1002643 - protein, 9 aa, Homo Sapiens
ALPSPSSNE

SEQ ID NO: 1002644 - protein, 9 aa, Homo Sapiens
FKPKRPNPA

SEQ ID NO: 1002645 - protein, 9 aa, Homo Sapiens
APIHLSSED

SEQ ID NO: 1002646 - protein, 9 aa, Homo Sapiens
PKRPNPAAP

SEQ ID NO: 1002647 - protein, 9 aa, Homo Sapiens
ERLRQHSKH

SEQ ID NO: 1002648 - protein, 9 aa, Homo Sapiens
EETLIMIVF

SEQ ID NO: 1002649 - protein, 9 aa, Homo Sapiens
FSRGRKKSS

SEQ ID NO: 1002650 - protein, 9 aa, Homo Sapiens
RSGFGLGSD

SEQ ID NO: 1002651 - protein, 9 aa, Homo Sapiens
IFVYLFPGE

SEQ ID NO: 1002652 - protein, 9 aa, Homo Sapiens
PSTPSPYEL

SEQ ID NO: 1002653 - protein, 9 aa, Homo Sapiens
DKLSEHFEV

SEQ ID NO: 1002654 - protein, 9 aa, Homo Sapiens
SFKDLLGKP

SEQ ID NO: 1002655 - protein, 9 aa, Homo Sapiens
GRPSMPTDP

SEQ ID NO: 1002656 - protein, 9 aa, Homo Sapiens
VLIVRSTTI

SEQ ID NO: 1002657 - protein, 9 aa, Homo Sapiens
DHLDKQAQT

SEQ ID NO: 1002658 - protein, 9 aa, Homo Sapiens
LAPWNKTRV

SEQ ID NO: 1002659 - protein, 9 aa, Homo Sapiens
DVISLRYDP

SEQ ID NO: 1002660 - protein, 9 aa, Homo Sapiens
AWHRMQFLH

SEQ ID NO: 1002661 - protein, 9 aa, Homo Sapiens
KVLKGEILW

SEQ ID NO: 1002662 - protein, 9 aa, Homo Sapiens
EEFSGRSEQ

SEQ ID NO: 1002663 - protein, 9 aa, Homo Sapiens
EGRKQLQNY

SEQ ID NO: 1002664 - protein, 9 aa, Homo Sapiens
LRQSCISIV

SEQ ID NO: 1002665 - protein, 9 aa, Homo Sapiens
LRKTTDMEI

SEQ ID NO: 1002666 - protein, 9 aa, Homo Sapiens
YRKKCAKCR

SEQ ID NO: 1002667 - protein, 9 aa, Homo Sapiens
PLPSPPLPY

SEQ ID NO: 1002668 - protein, 9 aa, Homo Sapiens
KQIYLWTMF

SEQ ID NO: 1002669 - protein, 9 aa, Homo Sapiens
FITHGETNG

SEQ ID NO: 1002670 - protein, 9 aa, Homo Sapiens
SGWLNKLSP

SEQ ID NO: 1002671 - protein, 9 aa, Homo Sapiens
AIMRNGVTH

SEQ ID NO: 1002672 - protein, 9 aa, Homo Sapiens
CLCCKKGSI

SEQ ID NO: 1002673 - protein, 9 aa, Homo Sapiens
RRGCVQALT

SEQ ID NO: 1002674 - protein, 9 aa, Homo Sapiens
DLSEEPFNI

SEQ ID NO: 1002675 - protein, 9 aa, Homo Sapiens
SGIISKRSK

SEQ ID NO: 1002676 - protein, 9 aa, Homo Sapiens
DLIYSVRGD

SEQ ID NO: 1002677 - protein, 9 aa, Homo Sapiens
APISAEPGA

SEQ ID NO: 1002678 - protein, 9 aa, Homo Sapiens
VEMAAKFSS

SEQ ID NO: 1002679 - protein, 9 aa, Homo Sapiens
KETSSLNPL

SEQ ID NO: 1002680 - protein, 9 aa, Homo Sapiens
LDTGKEEAF

SEQ ID NO: 1002681 - protein, 9 aa, Homo Sapiens
QYCHTIITL

SEQ ID NO: 1002682 - protein, 9 aa, Homo Sapiens
ISESKFLTE

SEQ ID NO: 1002683 - protein, 9 aa, Homo Sapiens
KPLVENCAS

SEQ ID NO: 1002684 - protein, 9 aa, Homo Sapiens
ASTDTLQCP

SEQ ID NO: 1002685 - protein, 9 aa, Homo Sapiens
SVWVGDKTS

SEQ ID NO: 1002686 - protein, 9 aa, Homo Sapiens
MAMVLGATL

SEQ ID NO: 1002687 - protein, 9 aa, Homo Sapiens
RREKVEVNG

SEQ ID NO: 1002688 - protein, 9 aa, Homo Sapiens
GGTSGSREG

SEQ ID NO: 1002689 - protein, 9 aa, Homo Sapiens
TLTFNIPFG

SEQ ID NO: 1002690 - protein, 9 aa, Homo Sapiens
DVSCMNTYT

SEQ ID NO: 1002691 - protein, 9 aa, Homo Sapiens
PPLGMRPPP

SEQ ID NO: 1002692 - protein, 9 aa, Homo Sapiens
SGKSNRTRL

SEQ ID NO: 1002693 - protein, 9 aa, Homo Sapiens
GALKNVVVV

SEQ ID NO: 1002694 - protein, 9 aa, Homo Sapiens
IPAPPPPPP

SEQ ID NO: 1002695 - protein, 9 aa, Homo Sapiens
LLRSLGIEM

SEQ ID NO: 1002696 - protein, 9 aa, Homo Sapiens
QPCQIFLEK

SEQ ID NO: 1002697 - protein, 9 aa, Homo Sapiens
YLHYSPWWF

SEQ ID NO: 1002698 - protein, 9 aa, Homo Sapiens
GLSRSWDGL

SEQ ID NO: 1002699 - protein, 9 aa, Homo Sapiens
RSYSCTECG

SEQ ID NO: 1002700 - protein, 9 aa, Homo Sapiens
LSEVTIGAH

SEQ ID NO: 1002701 - protein, 9 aa, Homo Sapiens
LSSVSEIAE

SEQ ID NO: 1002702 - protein, 9 aa, Homo Sapiens
QLRVVVAMM

SEQ ID NO: 1002703 - protein, 9 aa, Homo Sapiens
RFARTFKQR

SEQ ID NO: 1002704 - protein, 9 aa, Homo Sapiens
VSCMNTYTK

SEQ ID NO: 1002705 - protein, 9 aa, Homo Sapiens
TGAVAKKVA

SEQ ID NO: 1002706 - protein, 9 aa, Homo Sapiens
VAACVLILA

SEQ ID NO: 1002707 - protein, 9 aa, Homo Sapiens
WSTSSKKTM

SEQ ID NO: 1002708 - protein, 9 aa, Homo Sapiens
RHGDCMTVQ

SEQ ID NO: 1002709 - protein, 9 aa, Homo Sapiens
LETVPLSTV

SEQ ID NO: 1002710 - protein, 9 aa, Homo Sapiens
AVYVMEINV

SEQ ID NO: 1002711 - protein, 9 aa, Homo Sapiens
ISIIQVVGI

SEQ ID NO: 1002712 - protein, 9 aa, Homo Sapiens
DDMKRHSSE

SEQ ID NO: 1002713 - protein, 9 aa, Homo Sapiens
YCICLGKFT

SEQ ID NO: 1002714 - protein, 9 aa, Homo Sapiens
ELAQSLASQ

SEQ ID NO: 1002715 - protein, 9 aa, Homo Sapiens
SKPSAYICL

SEQ ID NO: 1002716 - protein, 9 aa, Homo Sapiens
LEKSYDILS

SEQ ID NO: 1002717 - protein, 9 aa, Homo Sapiens
PSYTVNWYY

SEQ ID NO: 1002718 - protein, 9 aa, Homo Sapiens
YWKFTSASD

SEQ ID NO: 1002719 - protein, 9 aa, Homo Sapiens
LLLNRADPL

SEQ ID NO: 1002720 - protein, 9 aa, Homo Sapiens
SLLLSSDLP

SEQ ID NO: 1002721 - protein, 9 aa, Homo Sapiens
HLLSREMNK

SEQ ID NO: 1002722 - protein, 9 aa, Homo Sapiens
PSHASSAAT

SEQ ID NO: 1002723 - protein, 9 aa, Homo Sapiens
ATTLREKRR

SEQ ID NO: 1002724 - protein, 9 aa, Homo Sapiens
YNCSKCDKT

SEQ ID NO: 1002725 - protein, 9 aa, Homo Sapiens
CHTIITLTN

SEQ ID NO: 1002726 - protein, 9 aa, Homo Sapiens
EEKVVAAAG

SEQ ID NO: 1002727 - protein, 9 aa, Homo Sapiens
NIGMVSQRL

SEQ ID NO: 1002728 - protein, 9 aa, Homo Sapiens
KGAKKVYLG

SEQ ID NO: 1002729 - protein, 9 aa, Homo Sapiens
ADHSATQHL

SEQ ID NO: 1002730 - protein, 9 aa, Homo Sapiens
TVFVSINIG

SEQ ID NO: 1002731 - protein, 9 aa, Homo Sapiens
LSFGKSQPA

SEQ ID NO: 1002732 - protein, 9 aa, Homo Sapiens
GKRFNNSSK

SEQ ID NO: 1002733 - protein, 9 aa, Homo Sapiens
YTSASFCHM

SEQ ID NO: 1002734 - protein, 9 aa, Homo Sapiens
HGEANITGF

SEQ ID NO: 1002735 - protein, 9 aa, Homo Sapiens
QKGPVDKTG

SEQ ID NO: 1002736 - protein, 9 aa, Homo Sapiens
LPWSSDPFS

SEQ ID NO: 1002737 - protein, 9 aa, Homo Sapiens
VLTTFDPAR

SEQ ID NO: 1002738 - protein, 9 aa, Homo Sapiens
SQPESVHKL

SEQ ID NO: 1002739 - protein, 9 aa, Homo Sapiens
SSHETVQRQ

SEQ ID NO: 1002740 - protein, 9 aa, Homo Sapiens
LCSTSPSCV

SEQ ID NO: 1002741 - protein, 9 aa, Homo Sapiens
SQVFQSSGW

SEQ ID NO: 1002742 - protein, 9 aa, Homo Sapiens
TPKIYPFNL

SEQ ID NO: 1002743 - protein, 9 aa, Homo Sapiens
APASRLTFS

SEQ ID NO: 1002744 - protein, 9 aa, Homo Sapiens
RIGKKQELF

SEQ ID NO: 1002745 - protein, 9 aa, Homo Sapiens
ERWTTKDTF

SEQ ID NO: 1002746 - protein, 9 aa, Homo Sapiens
HDNGNFFPG

SEQ ID NO: 1002747 - protein, 9 aa, Homo Sapiens
EKMVAELTQ

SEQ ID NO: 1002748 - protein, 9 aa, Homo Sapiens
PCNLCSTSP

SEQ ID NO: 1002749 - protein, 9 aa, Homo Sapiens
PQRADMKLR

SEQ ID NO: 1002750 - protein, 9 aa, Homo Sapiens
LVPAKNQPG

SEQ ID NO: 1002751 - protein, 9 aa, Homo Sapiens
SWRTFQRWI

SEQ ID NO: 1002752 - protein, 9 aa, Homo Sapiens
YLNDLIYSV

SEQ ID NO: 1002753 - protein, 9 aa, Homo Sapiens
LKVKKEAPG

SEQ ID NO: 1002754 - protein, 9 aa, Homo Sapiens
LAQVLGRVT

SEQ ID NO: 1002755 - protein, 9 aa, Homo Sapiens
SFEGEDEDE

SEQ ID NO: 1002756 - protein, 9 aa, Homo Sapiens
RPILTLRVS

SEQ ID NO: 1002757 - protein, 9 aa, Homo Sapiens
MLYSRAVCN

SEQ ID NO: 1002758 - protein, 9 aa, Homo Sapiens
PFLKKKTRK

SEQ ID NO: 1002759 - protein, 9 aa, Homo Sapiens
PQQFSYQPN

SEQ ID NO: 1002760 - protein, 9 aa, Homo Sapiens
SRLTFSFGC

SEQ ID NO: 1002761 - protein, 9 aa, Homo Sapiens
LERFARTFK

SEQ ID NO: 1002762 - protein, 9 aa, Homo Sapiens
CCSSGCGLS

SEQ ID NO: 1002763 - protein, 9 aa, Homo Sapiens
SEKGNFSLL

SEQ ID NO: 1002764 - protein, 9 aa, Homo Sapiens
LGVMVLFIL

SEQ ID NO: 1002765 - protein, 9 aa, Homo Sapiens
QIFLEKPAA

SEQ ID NO: 1002766 - protein, 9 aa, Homo Sapiens
LHSYQKTHS

SEQ ID NO: 1002767 - protein, 9 aa, Homo Sapiens
AQGSSKPPP

SEQ ID NO: 1002768 - protein, 9 aa, Homo Sapiens
EQSTENYSE

SEQ ID NO: 1002769 - protein, 9 aa, Homo Sapiens
SSYFDEDDS

SEQ ID NO: 1002770 - protein, 9 aa, Homo Sapiens
CSRCGACLS

SEQ ID NO: 1002771 - protein, 9 aa, Homo Sapiens
AQEALHLTG

SEQ ID NO: 1002772 - protein, 9 aa, Homo Sapiens
TPGPPGSMD

SEQ ID NO: 1002773 - protein, 9 aa, Homo Sapiens
CNYLCTACM

SEQ ID NO: 1002774 - protein, 9 aa, Homo Sapiens
KVAEQDDSL

SEQ ID NO: 1002775 - protein, 9 aa, Homo Sapiens
EISVTVPPG

SEQ ID NO: 1002776 - protein, 9 aa, Homo Sapiens
GSEADPASL

SEQ ID NO: 1002777 - protein, 9 aa, Homo Sapiens
GGSPVQYPY

SEQ ID NO: 1002778 - protein, 9 aa, Homo Sapiens
PSKQCASVG

SEQ ID NO: 1002779 - protein, 9 aa, Homo Sapiens
THILSVHNS

SEQ ID NO: 1002780 - protein, 9 aa, Homo Sapiens
WQNIISYVV

SEQ ID NO: 1002781 - protein, 9 aa, Homo Sapiens
DSVEVGHVF

SEQ ID NO: 1002782 - protein, 9 aa, Homo Sapiens
EEIYTASVS

SEQ ID NO: 1002783 - protein, 9 aa, Homo Sapiens
NKEILLGCG

SEQ ID NO: 1002784 - protein, 9 aa, Homo Sapiens
RKKFLLVNN

SEQ ID NO: 1002785 - protein, 9 aa, Homo Sapiens
EMVMDILRK

SEQ ID NO: 1002786 - protein, 9 aa, Homo Sapiens
LEENQLTKL

SEQ ID NO: 1002787 - protein, 9 aa, Homo Sapiens
YKLEDRSVS

SEQ ID NO: 1002788 - protein, 9 aa, Homo Sapiens
SKPPPAASP

SEQ ID NO: 1002789 - protein, 9 aa, Homo Sapiens
RTPGLSRSW

SEQ ID NO: 1002790 - protein, 9 aa, Homo Sapiens
NSPELIISS

SEQ ID NO: 1002791 - protein, 9 aa, Homo Sapiens
KMRHNYFIK

SEQ ID NO: 1002792 - protein, 9 aa, Homo Sapiens
VAGRRKFVD

SEQ ID NO: 1002793 - protein, 9 aa, Homo Sapiens
IHLSSEDGG

SEQ ID NO: 1002794 - protein, 9 aa, Homo Sapiens
LEELPMMRR

SEQ ID NO: 1002795 - protein, 9 aa, Homo Sapiens
TVEFKGFLV

SEQ ID NO: 1002796 - protein, 9 aa, Homo Sapiens
KQAWRNASR

SEQ ID NO: 1002797 - protein, 9 aa, Homo Sapiens
GDYDDSAMK

SEQ ID NO: 1002798 - protein, 9 aa, Homo Sapiens
KGPVDKTGW

SEQ ID NO: 1002799 - protein, 9 aa, Homo Sapiens
QEAVLARQV

SEQ ID NO: 1002800 - protein, 9 aa, Homo Sapiens
ADVSCMNTY

SEQ ID NO: 1002801 - protein, 9 aa, Homo Sapiens
LARSIVPQG

SEQ ID NO: 1002802 - protein, 9 aa, Homo Sapiens
GDYKVTVKV

SEQ ID NO: 1002803 - protein, 9 aa, Homo Sapiens
VTGKFLELD

SEQ ID NO: 1002804 - protein, 9 aa, Homo Sapiens
PPLGFGPGV

SEQ ID NO: 1002805 - protein, 9 aa, Homo Sapiens
ESYEAEIFT

SEQ ID NO: 1002806 - protein, 9 aa, Homo Sapiens
TYTFSHASE

SEQ ID NO: 1002807 - protein, 9 aa, Homo Sapiens
EKPPNPAAV

SEQ ID NO: 1002808 - protein, 9 aa, Homo Sapiens
FNAVPYSQE

SEQ ID NO: 1002809 - protein, 9 aa, Homo Sapiens
LKNKVQVVE

SEQ ID NO: 1002810 - protein, 9 aa, Homo Sapiens
VMMSLEGRI

SEQ ID NO: 1002811 - protein, 9 aa, Homo Sapiens
GECVPQMKE

SEQ ID NO: 1002812 - protein, 9 aa, Homo Sapiens
SSSDTPETV

SEQ ID NO: 1002813 - protein, 9 aa, Homo Sapiens
QTSTIKNHE

SEQ ID NO: 1002814 - protein, 9 aa, Homo Sapiens
ERLVSMGSK

SEQ ID NO: 1002815 - protein, 9 aa, Homo Sapiens
HEEPLCSEI

SEQ ID NO: 1002816 - protein, 9 aa, Homo Sapiens
VLKGEILWS

SEQ ID NO: 1002817 - protein, 9 aa, Homo Sapiens
VQKLEECLT

SEQ ID NO: 1002818 - protein, 9 aa, Homo Sapiens
ESNHLRDVP

SEQ ID NO: 1002819 - protein, 9 aa, Homo Sapiens
YDKPSLSVQ

SEQ ID NO: 1002820 - protein, 9 aa, Homo Sapiens
PLAPWNKTR

SEQ ID NO: 1002821 - protein, 9 aa, Homo Sapiens
LVDMYSHVF

SEQ ID NO: 1002822 - protein, 9 aa, Homo Sapiens
PLSAVYCIC

SEQ ID NO: 1002823 - protein, 9 aa, Homo Sapiens
ITLGRKKFL

SEQ ID NO: 1002824 - protein, 9 aa, Homo Sapiens
RKLQVDVKL

SEQ ID NO: 1002825 - protein, 9 aa, Homo Sapiens
CSSSLSLPR

SEQ ID NO: 1002826 - protein, 9 aa, Homo Sapiens
SSRHLPEPE

SEQ ID NO: 1002827 - protein, 9 aa, Homo Sapiens
ASGDFDYLG

SEQ ID NO: 1002828 - protein, 9 aa, Homo Sapiens
KKTRKRIFL

SEQ ID NO: 1002829 - protein, 9 aa, Homo Sapiens
MAAQTAGVS

SEQ ID NO: 1002830 - protein, 9 aa, Homo Sapiens
GDQVAKGNY

SEQ ID NO: 1002831 - protein, 9 aa, Homo Sapiens
SGPDSPVTP

SEQ ID NO: 1002832 - protein, 9 aa, Homo Sapiens
LTGAVAKKV

SEQ ID NO: 1002833 - protein, 9 aa, Homo Sapiens
YPDSRSHPR

SEQ ID NO: 1002834 - protein, 9 aa, Homo Sapiens
ESGHNINVI

SEQ ID NO: 1002835 - protein, 9 aa, Homo Sapiens
LQKPGKNFS

SEQ ID NO: 1002836 - protein, 9 aa, Homo Sapiens
YTGKKQVER

SEQ ID NO: 1002837 - protein, 9 aa, Homo Sapiens
FFCPALPAV

SEQ ID NO: 1002838 - protein, 9 aa, Homo Sapiens
AATLGVNSC

SEQ ID NO: 1002839 - protein, 9 aa, Homo Sapiens
FGQFDPVSY

SEQ ID NO: 1002840 - protein, 9 aa, Homo Sapiens
DIVQFVPFQ

SEQ ID NO: 1002841 - protein, 9 aa, Homo Sapiens
PVMSPNQSN

SEQ ID NO: 1002842 - protein, 9 aa, Homo Sapiens
GHHDCSHKE

SEQ ID NO: 1002843 - protein, 9 aa, Homo Sapiens
LGILAAASF

SEQ ID NO: 1002844 - protein, 9 aa, Homo Sapiens
APPALRPRV

SEQ ID NO: 1002845 - protein, 9 aa, Homo Sapiens
IPPDQKTEK

SEQ ID NO: 1002846 - protein, 9 aa, Homo Sapiens
MIVFGHFSH

SEQ ID NO: 1002847 - protein, 9 aa, Homo Sapiens
RGPPPLRLG

SEQ ID NO: 1002848 - protein, 9 aa, Homo Sapiens
GSEELIRLL

SEQ ID NO: 1002849 - protein, 9 aa, Homo Sapiens
GLLVRQEAC

SEQ ID NO: 1002850 - protein, 9 aa, Homo Sapiens
NPRIRVEFL

SEQ ID NO: 1002851 - protein, 9 aa, Homo Sapiens
SVEVGHVFD

SEQ ID NO: 1002852 - protein, 9 aa, Homo Sapiens
FEGDALTLQ

SEQ ID NO: 1002853 - protein, 9 aa, Homo Sapiens
ACSTTENGA

SEQ ID NO: 1002854 - protein, 9 aa, Homo Sapiens
EMAAKFSSG

SEQ ID NO: 1002855 - protein, 9 aa, Homo Sapiens
PISAEPGAL

SEQ ID NO: 1002856 - protein, 9 aa, Homo Sapiens
STLKYHKKI

SEQ ID NO: 1002857 - protein, 9 aa, Homo Sapiens
IGAFCGNYI

SEQ ID NO: 1002858 - protein, 9 aa, Homo Sapiens
LSLATQPCL

SEQ ID NO: 1002859 - protein, 9 aa, Homo Sapiens
SEKKTSPHF

SEQ ID NO: 1002860 - protein, 9 aa, Homo Sapiens
PIVVNQDPM

SEQ ID NO: 1002861 - protein, 9 aa, Homo Sapiens
GNIWKQILR

SEQ ID NO: 1002862 - protein, 9 aa, Homo Sapiens
KGVFIKLII

SEQ ID NO: 1002863 - protein, 9 aa, Homo Sapiens
APPKTTAAP

SEQ ID NO: 1002864 - protein, 9 aa, Homo Sapiens
QDQELEKDI

SEQ ID NO: 1002865 - protein, 9 aa, Homo Sapiens
RQNPLDVMV

SEQ ID NO: 1002866 - protein, 9 aa, Homo Sapiens
PCRCSKCGE

SEQ ID NO: 1002867 - protein, 9 aa, Homo Sapiens
KFLLVNNIF

SEQ ID NO: 1002868 - protein, 9 aa, Homo Sapiens
PISTVKSDI

SEQ ID NO: 1002869 - protein, 9 aa, Homo Sapiens
RCYVKCHRD

SEQ ID NO: 1002870 - protein, 9 aa, Homo Sapiens
KDLSEEPFN

SEQ ID NO: 1002871 - protein, 9 aa, Homo Sapiens
EGTVVPRFS

SEQ ID NO: 1002872 - protein, 9 aa, Homo Sapiens
EDQDPPCLR

SEQ ID NO: 1002873 - protein, 9 aa, Homo Sapiens
YVSKQCGKF

SEQ ID NO: 1002874 - protein, 9 aa, Homo Sapiens
VQERRAQES

SEQ ID NO: 1002875 - protein, 9 aa, Homo Sapiens
LTLAFALRS

SEQ ID NO: 1002876 - protein, 9 aa, Homo Sapiens
PCQECRCQK

SEQ ID NO: 1002877 - protein, 9 aa, Homo Sapiens
DKDNISPAY

SEQ ID NO: 1002878 - protein, 9 aa, Homo Sapiens
HICTKKFKF

SEQ ID NO: 1002879 - protein, 9 aa, Homo Sapiens
MEQKVAEQD

SEQ ID NO: 1002880 - protein, 9 aa, Homo Sapiens
SKLAAERNL

SEQ ID NO: 1002881 - protein, 9 aa, Homo Sapiens
PKEGTPLWR

SEQ ID NO: 1002882 - protein, 9 aa, Homo Sapiens
LYFLSQRIP

SEQ ID NO: 1002883 - protein, 9 aa, Homo Sapiens
LEQYCHTII

SEQ ID NO: 1002884 - protein, 9 aa, Homo Sapiens
ELEFVGSAP

SEQ ID NO: 1002885 - protein, 9 aa, Homo Sapiens
AGLGRPSMP

SEQ ID NO: 1002886 - protein, 9 aa, Homo Sapiens
DISANKMSI

SEQ ID NO: 1002887 - protein, 9 aa, Homo Sapiens
TASVSEMSV

SEQ ID NO: 1002888 - protein, 9 aa, Homo Sapiens
KTTDMEIRE

SEQ ID NO: 1002889 - protein, 9 aa, Homo Sapiens
CTSYFCTCG

SEQ ID NO: 1002890 - protein, 9 aa, Homo Sapiens
SATQHLTQP

SEQ ID NO: 1002891 - protein, 9 aa, Homo Sapiens
SLFSKARWL

SEQ ID NO: 1002892 - protein, 9 aa, Homo Sapiens
RTGPPPISS

SEQ ID NO: 1002893 - protein, 9 aa, Homo Sapiens
PGEETLIMI

SEQ ID NO: 1002894 - protein, 9 aa, Homo Sapiens
LFLSADFCN

SEQ ID NO: 1002895 - protein, 9 aa, Homo Sapiens
LTFNIPFGS

SEQ ID NO: 1002896 - protein, 9 aa, Homo Sapiens
LVVEVHLAR

SEQ ID NO: 1002897 - protein, 9 aa, Homo Sapiens
WERQKFFED

SEQ ID NO: 1002898 - protein, 9 aa, Homo Sapiens
SPTGQPTVL

SEQ ID NO: 1002899 - protein, 9 aa, Homo Sapiens
SDSPQCDRE

SEQ ID NO: 1002900 - protein, 9 aa, Homo Sapiens
EECCDLYEC

SEQ ID NO: 1002901 - protein, 9 aa, Homo Sapiens
HLCCSRCGA

SEQ ID NO: 1002902 - protein, 9 aa, Homo Sapiens
FKIFKHISK

SEQ ID NO: 1002903 - protein, 9 aa, Homo Sapiens
IVEFMDVDQ

SEQ ID NO: 1002904 - protein, 9 aa, Homo Sapiens
VVCDSSQKS

SEQ ID NO: 1002905 - protein, 9 aa, Homo Sapiens
VWVGDKTSA

SEQ ID NO: 1002906 - protein, 9 aa, Homo Sapiens
IDGRLLEHP

SEQ ID NO: 1002907 - protein, 9 aa, Homo Sapiens
TRENCNEFF

SEQ ID NO: 1002908 - protein, 9 aa, Homo Sapiens
LETTSEALS

SEQ ID NO: 1002909 - protein, 9 aa, Homo Sapiens
PPNPAAVAA

SEQ ID NO: 1002910 - protein, 9 aa, Homo Sapiens
VPTYKEVTP

SEQ ID NO: 1002911 - protein, 9 aa, Homo Sapiens
YDILSGLVA

SEQ ID NO: 1002912 - protein, 9 aa, Homo Sapiens
LIMIVFGHF

SEQ ID NO: 1002913 - protein, 9 aa, Homo Sapiens
EVASSDSNT

SEQ ID NO: 1002914 - protein, 9 aa, Homo Sapiens
SGDKLSEHF

SEQ ID NO: 1002915 - protein, 9 aa, Homo Sapiens
YCNLTFWGE

SEQ ID NO: 1002916 - protein, 9 aa, Homo Sapiens
LVSMGSKAR

SEQ ID NO: 1002917 - protein, 9 aa, Homo Sapiens
AYGPEYWDL

SEQ ID NO: 1002918 - protein, 9 aa, Homo Sapiens
KVFRFFEAR

SEQ ID NO: 1002919 - protein, 9 aa, Homo Sapiens
QPELVPGKA

SEQ ID NO: 1002920 - protein, 9 aa, Homo Sapiens
PPDGEDPGN

SEQ ID NO: 1002921 - protein, 9 aa, Homo Sapiens
KTESVLYGC

SEQ ID NO: 1002922 - protein, 9 aa, Homo Sapiens
NHLKNKVQV

SEQ ID NO: 1002923 - protein, 9 aa, Homo Sapiens
GHVTFYKTW

SEQ ID NO: 1002924 - protein, 9 aa, Homo Sapiens
STMDAQSQV

SEQ ID NO: 1002925 - protein, 9 aa, Homo Sapiens
FRNILKKKG

SEQ ID NO: 1002926 - protein, 9 aa, Homo Sapiens
DIIEGQKTF

SEQ ID NO: 1002927 - protein, 9 aa, Homo Sapiens
MDKNCYEQM

SEQ ID NO: 1002928 - protein, 9 aa, Homo Sapiens
VDKGHVTFY

SEQ ID NO: 1002929 - protein, 9 aa, Homo Sapiens
LKLKRVHRS

SEQ ID NO: 1002930 - protein, 9 aa, Homo Sapiens
AEHEGVFVL

SEQ ID NO: 1002931 - protein, 9 aa, Homo Sapiens
HSLELLEPS

SEQ ID NO: 1002932 - protein, 9 aa, Homo Sapiens
KILSFFGET

SEQ ID NO: 1002933 - protein, 9 aa, Homo Sapiens
LKSTMKKKL

SEQ ID NO: 1002934 - protein, 9 aa, Homo Sapiens
KPGKNFSYP

SEQ ID NO: 1002935 - protein, 9 aa, Homo Sapiens
IVGKRGRLD

SEQ ID NO: 1002936 - protein, 9 aa, Homo Sapiens
AILETSAKE

SEQ ID NO: 1002937 - protein, 9 aa, Homo Sapiens
SQAASALGA

SEQ ID NO: 1002938 - protein, 9 aa, Homo Sapiens
GPLVKQTKM

SEQ ID NO: 1002939 - protein, 9 aa, Homo Sapiens
MISEPMDKN

SEQ ID NO: 1002940 - protein, 9 aa, Homo Sapiens
SDQSSSVQI

SEQ ID NO: 1002941 - protein, 9 aa, Homo Sapiens
IRIGCFIMG

SEQ ID NO: 1002942 - protein, 9 aa, Homo Sapiens
SLQRLLVAL

SEQ ID NO: 1002943 - protein, 9 aa, Homo Sapiens
VTALETLSK

SEQ ID NO: 1002944 - protein, 9 aa, Homo Sapiens
QSCISIVEW

SEQ ID NO: 1002945 - protein, 9 aa, Homo Sapiens
STTKELDFE

SEQ ID NO: 1002946 - protein, 9 aa, Homo Sapiens
AILWLPCSH

SEQ ID NO: 1002947 - protein, 9 aa, Homo Sapiens
RKKANDRKR

SEQ ID NO: 1002948 - protein, 9 aa, Homo Sapiens
SYKDAVWKA

SEQ ID NO: 1002949 - protein, 9 aa, Homo Sapiens
DFHPLPPSY

SEQ ID NO: 1002950 - protein, 9 aa, Homo Sapiens
VDENLKKQE

SEQ ID NO: 1002951 - protein, 9 aa, Homo Sapiens
VEHPYQLLL

SEQ ID NO: 1002952 - protein, 9 aa, Homo Sapiens
ECRCQKGHA

SEQ ID NO: 1002953 - protein, 9 aa, Homo Sapiens
KVAGPAVLL

SEQ ID NO: 1002954 - protein, 9 aa, Homo Sapiens
LWWLLSIVR

SEQ ID NO: 1002955 - protein, 9 aa, Homo Sapiens
DLPALRAIG

SEQ ID NO: 1002956 - protein, 9 aa, Homo Sapiens
IPLSAVYCI

SEQ ID NO: 1002957 - protein, 9 aa, Homo Sapiens
VEVHLARSI

SEQ ID NO: 1002958 - protein, 9 aa, Homo Sapiens
ERRAQESPK

SEQ ID NO: 1002959 - protein, 9 aa, Homo Sapiens
LVLNRALDC

SEQ ID NO: 1002960 - protein, 9 aa, Homo Sapiens
EEERQGKAS

SEQ ID NO: 1002961 - protein, 9 aa, Homo Sapiens
ERNLNVTIS

SEQ ID NO: 1002962 - protein, 9 aa, Homo Sapiens
PLTPLADRA

SEQ ID NO: 1002963 - protein, 9 aa, Homo Sapiens
YTTMRHLGD

SEQ ID NO: 1002964 - protein, 9 aa, Homo Sapiens
SGSWVSCEQ

SEQ ID NO: 1002965 - protein, 9 aa, Homo Sapiens
LSAELEEQS

SEQ ID NO: 1002966 - protein, 9 aa, Homo Sapiens
WCSEDNCTK

SEQ ID NO: 1002967 - protein, 9 aa, Homo Sapiens
HQGLSACMV

SEQ ID NO: 1002968 - protein, 9 aa, Homo Sapiens
IIEGQKTFQ

SEQ ID NO: 1002969 - protein, 9 aa, Homo Sapiens
TLQCQGWKN

SEQ ID NO: 1002970 - protein, 9 aa, Homo Sapiens
RSPQNGELG

SEQ ID NO: 1002971 - protein, 9 aa, Homo Sapiens
VSWAYQFPY

SEQ ID NO: 1002972 - protein, 9 aa, Homo Sapiens
QLMFINEAE

SEQ ID NO: 1002973 - protein, 9 aa, Homo Sapiens
PKSKFYGAN

SEQ ID NO: 1002974 - protein, 9 aa, Homo Sapiens
RTLSRTTPI

SEQ ID NO: 1002975 - protein, 9 aa, Homo Sapiens
THSNNKTSL

SEQ ID NO: 1002976 - protein, 9 aa, Homo Sapiens
GGASEDKVF

SEQ ID NO: 1002977 - protein, 9 aa, Homo Sapiens
QELQVFSSY

SEQ ID NO: 1002978 - protein, 9 aa, Homo Sapiens
SINQKIVTN

SEQ ID NO: 1002979 - protein, 9 aa, Homo Sapiens
MVLGATLRR

SEQ ID NO: 1002980 - protein, 9 aa, Homo Sapiens
VVVAMMDQG

SEQ ID NO: 1002981 - protein, 9 aa, Homo Sapiens
ELTYTFSHA

SEQ ID NO: 1002982 - protein, 9 aa, Homo Sapiens
WFLKEFPWL

SEQ ID NO: 1002983 - protein, 9 aa, Homo Sapiens
VGAWCPVED

SEQ ID NO: 1002984 - protein, 9 aa, Homo Sapiens
GPPPISSSK

SEQ ID NO: 1002985 - protein, 9 aa, Homo Sapiens
SKWHCDSDN

SEQ ID NO: 1002986 - protein, 9 aa, Homo Sapiens
SPEGLQHSP

SEQ ID NO: 1002987 - protein, 9 aa, Homo Sapiens
FLFKDEFFT

SEQ ID NO: 1002988 - protein, 9 aa, Homo Sapiens
VMDRDEPHS

SEQ ID NO: 1002989 - protein, 9 aa, Homo Sapiens
KMEGEPQKG

SEQ ID NO: 1002990 - protein, 9 aa, Homo Sapiens
REESLIICS

SEQ ID NO: 1002991 - protein, 9 aa, Homo Sapiens
DEDDSFTDQ

SEQ ID NO: 1002992 - protein, 9 aa, Homo Sapiens
SEESQVFQS

SEQ ID NO: 1002993 - protein, 9 aa, Homo Sapiens
LDCEEQPEI

SEQ ID NO: 1002994 - protein, 9 aa, Homo Sapiens
QFQAECECV

SEQ ID NO: 1002995 - protein, 9 aa, Homo Sapiens
CCKKGSIGF

SEQ ID NO: 1002996 - protein, 9 aa, Homo Sapiens
DRKSTMDAQ

SEQ ID NO: 1002997 - protein, 9 aa, Homo Sapiens
NRFLYVVGG

SEQ ID NO: 1002998 - protein, 9 aa, Homo Sapiens
FIQRYLVYA

SEQ ID NO: 1002999 - protein, 9 aa, Homo Sapiens
RVSRAQAVV

SEQ ID NO: 1003000 - protein, 9 aa, Homo Sapiens
SNNEIITLS

SEQ ID NO: 1003001 - protein, 9 aa, Homo Sapiens
QYIPPDQKT

SEQ ID NO: 1003002 - protein, 9 aa, Homo Sapiens
PSNVLDMPV

SEQ ID NO: 1003003 - protein, 9 aa, Homo Sapiens
RPRQRASQD

SEQ ID NO: 1003004 - protein, 9 aa, Homo Sapiens
WNKTRVVSY

SEQ ID NO: 1003005 - protein, 9 aa, Homo Sapiens
VLDQWTDKK

SEQ ID NO: 1003006 - protein, 9 aa, Homo Sapiens
VARDVVLHQ

SEQ ID NO: 1003007 - protein, 9 aa, Homo Sapiens
CGRTIQRYL

SEQ ID NO: 1003008 - protein, 9 aa, Homo Sapiens
RARTAAAPR

SEQ ID NO: 1003009 - protein, 9 aa, Homo Sapiens
PKKWPKKSK

SEQ ID NO: 1003010 - protein, 9 aa, Homo Sapiens
PIGMPPLGM

SEQ ID NO: 1003011 - protein, 9 aa, Homo Sapiens
IVTAIWMNS

SEQ ID NO: 1003012 - protein, 9 aa, Homo Sapiens
RELHLDSNK

SEQ ID NO: 1003013 - protein, 9 aa, Homo Sapiens
HPYQLLLKY

SEQ ID NO: 1003014 - protein, 9 aa, Homo Sapiens
FQLNELMMA

SEQ ID NO: 1003015 - protein, 9 aa, Homo Sapiens
AKNLVDENL

SEQ ID NO: 1003016 - protein, 9 aa, Homo Sapiens
TNNSGTSKD

SEQ ID NO: 1003017 - protein, 9 aa, Homo Sapiens
GFLSTGDQV

SEQ ID NO: 1003018 - protein, 9 aa, Homo Sapiens
TSYFCTCGD

SEQ ID NO: 1003019 - protein, 9 aa, Homo Sapiens
KSGWLNKLS

SEQ ID NO: 1003020 - protein, 9 aa, Homo Sapiens
YDDSAMKTL

SEQ ID NO: 1003021 - protein, 9 aa, Homo Sapiens
ILYWDSATC

SEQ ID NO: 1003022 - protein, 9 aa, Homo Sapiens
SIEVPILRD

SEQ ID NO: 1003023 - protein, 9 aa, Homo Sapiens
RPEVERPPE

SEQ ID NO: 1003024 - protein, 9 aa, Homo Sapiens
TCGHRDSGN

SEQ ID NO: 1003025 - protein, 9 aa, Homo Sapiens
LPSLIGQKI

SEQ ID NO: 1003026 - protein, 9 aa, Homo Sapiens
AFIEPRYHI

SEQ ID NO: 1003027 - protein, 9 aa, Homo Sapiens
TVLYFLSQR

SEQ ID NO: 1003028 - protein, 9 aa, Homo Sapiens
KKEKMRHNY

SEQ ID NO: 1003029 - protein, 9 aa, Homo Sapiens
LQQFFSHHM

SEQ ID NO: 1003030 - protein, 9 aa, Homo Sapiens
VSKPDLDSY

SEQ ID NO: 1003031 - protein, 9 aa, Homo Sapiens
RSYGSDKFE

SEQ ID NO: 1003032 - protein, 9 aa, Homo Sapiens
LVENCASIF

SEQ ID NO: 1003033 - protein, 9 aa, Homo Sapiens
PGKMCNADY

SEQ ID NO: 1003034 - protein, 9 aa, Homo Sapiens
QLAAAAELA

SEQ ID NO: 1003035 - protein, 9 aa, Homo Sapiens
QRAIFFAGC

SEQ ID NO: 1003036 - protein, 9 aa, Homo Sapiens
LECRRCYVK

SEQ ID NO: 1003037 - protein, 9 aa, Homo Sapiens
KKFKFRGFL

SEQ ID NO: 1003038 - protein, 9 aa, Homo Sapiens
WSPARQRAV

SEQ ID NO: 1003039 - protein, 9 aa, Homo Sapiens
VTHILSVHN

SEQ ID NO: 1003040 - protein, 9 aa, Homo Sapiens
HHAYCFHYT

SEQ ID NO: 1003041 - protein, 9 aa, Homo Sapiens
KSLQPLAPW

SEQ ID NO: 1003042 - protein, 9 aa, Homo Sapiens
SDNDCGDGS

SEQ ID NO: 1003043 - protein, 9 aa, Homo Sapiens
AQESPKSDC

SEQ ID NO: 1003044 - protein, 9 aa, Homo Sapiens
VGLGDGAET

SEQ ID NO: 1003045 - protein, 9 aa, Homo Sapiens
LGATLRRLL

SEQ ID NO: 1003046 - protein, 9 aa, Homo Sapiens
VSTADQSVR

SEQ ID NO: 1003047 - protein, 9 aa, Homo Sapiens
LISGDISGP

SEQ ID NO: 1003048 - protein, 9 aa, Homo Sapiens
KTKEGKGRE

SEQ ID NO: 1003049 - protein, 9 aa, Homo Sapiens
QRRKRQAPL

SEQ ID NO: 1003050 - protein, 9 aa, Homo Sapiens
MGLTGPLKT

SEQ ID NO: 1003051 - protein, 9 aa, Homo Sapiens
AVYCICLGK

SEQ ID NO: 1003052 - protein, 9 aa, Homo Sapiens
VERPPEETA

SEQ ID NO: 1003053 - protein, 9 aa, Homo Sapiens
FSIMFTPLN

SEQ ID NO: 1003054 - protein, 9 aa, Homo Sapiens
KKLGLYFGA

SEQ ID NO: 1003055 - protein, 9 aa, Homo Sapiens
TESAPAWTS

SEQ ID NO: 1003056 - protein, 9 aa, Homo Sapiens
SYLDIANQT

SEQ ID NO: 1003057 - protein, 9 aa, Homo Sapiens
RFSVCQLRD

SEQ ID NO: 1003058 - protein, 9 aa, Homo Sapiens
APPAASGDF

SEQ ID NO: 1003059 - protein, 9 aa, Homo Sapiens
FLSQRIPLP

SEQ ID NO: 1003060 - protein, 9 aa, Homo Sapiens
PSDAFKISI

SEQ ID NO: 1003061 - protein, 9 aa, Homo Sapiens
EDISANKMS

SEQ ID NO: 1003062 - protein, 9 aa, Homo Sapiens
LAQQHSPPD

SEQ ID NO: 1003063 - protein, 9 aa, Homo Sapiens
TVQRQKLIA

SEQ ID NO: 1003064 - protein, 9 aa, Homo Sapiens
TADVPTYKE

SEQ ID NO: 1003065 - protein, 9 aa, Homo Sapiens
ESQSLVYFF

SEQ ID NO: 1003066 - protein, 9 aa, Homo Sapiens
NPKNQSYLI

SEQ ID NO: 1003067 - protein, 9 aa, Homo Sapiens
QVLGRVTQL

SEQ ID NO: 1003068 - protein, 9 aa, Homo Sapiens
CCGAYGPEY

SEQ ID NO: 1003069 - protein, 9 aa, Homo Sapiens
KKAHKIMKD

SEQ ID NO: 1003070 - protein, 9 aa, Homo Sapiens
KSDRKYYAK

SEQ ID NO: 1003071 - protein, 9 aa, Homo Sapiens
PRIQESCGI

SEQ ID NO: 1003072 - protein, 9 aa, Homo Sapiens
FSSLSAYLP

SEQ ID NO: 1003073 - protein, 9 aa, Homo Sapiens
RPFEEQFQF

SEQ ID NO: 1003074 - protein, 9 aa, Homo Sapiens
SCGNRNKTP

SEQ ID NO: 1003075 - protein, 9 aa, Homo Sapiens
QTGVQWSNF

SEQ ID NO: 1003076 - protein, 9 aa, Homo Sapiens
QALKSRELK

SEQ ID NO: 1003077 - protein, 9 aa, Homo Sapiens
SRKILSFFG

SEQ ID NO: 1003078 - protein, 9 aa, Homo Sapiens
EDKDHMCSV

SEQ ID NO: 1003079 - protein, 9 aa, Homo Sapiens
TGQPTVLQP

SEQ ID NO: 1003080 - protein, 9 aa, Homo Sapiens
FEEEVQYNF

SEQ ID NO: 1003081 - protein, 9 aa, Homo Sapiens
FVGSRLAVA

SEQ ID NO: 1003082 - protein, 9 aa, Homo Sapiens
KQSSHFTRH

SEQ ID NO: 1003083 - protein, 9 aa, Homo Sapiens
NSGSWVSCE

SEQ ID NO: 1003084 - protein, 9 aa, Homo Sapiens
NAQTITFQQ

SEQ ID NO: 1003085 - protein, 9 aa, Homo Sapiens
VHLARSIVP

SEQ ID NO: 1003086 - protein, 9 aa, Homo Sapiens
RQRTCDICR

SEQ ID NO: 1003087 - protein, 9 aa, Homo Sapiens
EPSDQLEIS

SEQ ID NO: 1003088 - protein, 9 aa, Homo Sapiens
SPSLPWSSD

SEQ ID NO: 1003089 - protein, 9 aa, Homo Sapiens
GQAATPETS

SEQ ID NO: 1003090 - protein, 9 aa, Homo Sapiens
KIYPFNLLL

SEQ ID NO: 1003091 - protein, 9 aa, Homo Sapiens
NCASIFEKC

SEQ ID NO: 1003092 - protein, 9 aa, Homo Sapiens
EVVNRQMMM

SEQ ID NO: 1003093 - protein, 9 aa, Homo Sapiens
FFPMCTSRQ

SEQ ID NO: 1003094 - protein, 9 aa, Homo Sapiens
LTLPESLKA

SEQ ID NO: 1003095 - protein, 9 aa, Homo Sapiens
IVFSIFVMA

SEQ ID NO: 1003096 - protein, 9 aa, Homo Sapiens
EILYWDSAT

SEQ ID NO: 1003097 - protein, 9 aa, Homo Sapiens
LPMKPRRNC

SEQ ID NO: 1003098 - protein, 9 aa, Homo Sapiens
LIKFNAVPY

SEQ ID NO: 1003099 - protein, 9 aa, Homo Sapiens
DAIIKLQLL

SEQ ID NO: 1003100 - protein, 9 aa, Homo Sapiens
PLNRYSDRN

SEQ ID NO: 1003101 - protein, 9 aa, Homo Sapiens
LLGGEPKNP

SEQ ID NO: 1003102 - protein, 9 aa, Homo Sapiens
FHGDSHATF

SEQ ID NO: 1003103 - protein, 9 aa, Homo Sapiens
AFITHGETN

SEQ ID NO: 1003104 - protein, 9 aa, Homo Sapiens
PTGQPTVLQ

SEQ ID NO: 1003105 - protein, 9 aa, Homo Sapiens
PMTQSIFNE

SEQ ID NO: 1003106 - protein, 9 aa, Homo Sapiens
RRKFVDQPE

SEQ ID NO: 1003107 - protein, 9 aa, Homo Sapiens
DSFSYRDTV

SEQ ID NO: 1003108 - protein, 9 aa, Homo Sapiens
HKEDAGVEC

SEQ ID NO: 1003109 - protein, 9 aa, Homo Sapiens
TCYNGGNCK

SEQ ID NO: 1003110 - protein, 9 aa, Homo Sapiens
DQDPPCLRL

SEQ ID NO: 1003111 - protein, 9 aa, Homo Sapiens
SREGVALGT

SEQ ID NO: 1003112 - protein, 9 aa, Homo Sapiens
PEGLQHSPL

SEQ ID NO: 1003113 - protein, 9 aa, Homo Sapiens
EDEPQETTY

SEQ ID NO: 1003114 - protein, 9 aa, Homo Sapiens
MVAELTQKI

SEQ ID NO: 1003115 - protein, 9 aa, Homo Sapiens
IEELNPYTK

SEQ ID NO: 1003116 - protein, 9 aa, Homo Sapiens
MSVKPVSSE

SEQ ID NO: 1003117 - protein, 9 aa, Homo Sapiens
HLGDGTYGS

SEQ ID NO: 1003118 - protein, 9 aa, Homo Sapiens
GPPGPPRKD

SEQ ID NO: 1003119 - protein, 9 aa, Homo Sapiens
MSLKSFSYA

SEQ ID NO: 1003120 - protein, 9 aa, Homo Sapiens
DLITYRETS

SEQ ID NO: 1003121 - protein, 9 aa, Homo Sapiens
LFHQWFLKN

SEQ ID NO: 1003122 - protein, 9 aa, Homo Sapiens
QMPTVIYVF

SEQ ID NO: 1003123 - protein, 9 aa, Homo Sapiens
APVMNCSIA

SEQ ID NO: 1003124 - protein, 9 aa, Homo Sapiens
WTDQVAKFY

SEQ ID NO: 1003125 - protein, 9 aa, Homo Sapiens
VDPEMTSYL

SEQ ID NO: 1003126 - protein, 9 aa, Homo Sapiens
LLQPVNENM

SEQ ID NO: 1003127 - protein, 9 aa, Homo Sapiens
QKVNSALSK

SEQ ID NO: 1003128 - protein, 9 aa, Homo Sapiens
GPEDELLDW

SEQ ID NO: 1003129 - protein, 9 aa, Homo Sapiens
PFSLADHLN

SEQ ID NO: 1003130 - protein, 9 aa, Homo Sapiens
TNSELTYTF

SEQ ID NO: 1003131 - protein, 9 aa, Homo Sapiens
STGLWGRWQ

SEQ ID NO: 1003132 - protein, 9 aa, Homo Sapiens
EPLCSEILS

SEQ ID NO: 1003133 - protein, 9 aa, Homo Sapiens
TPEKEMFKM

SEQ ID NO: 1003134 - protein, 9 aa, Homo Sapiens
ENYSEDEQN

SEQ ID NO: 1003135 - protein, 9 aa, Homo Sapiens
MEIRELVTG

SEQ ID NO: 1003136 - protein, 9 aa, Homo Sapiens
LRPRVGGQD

SEQ ID NO: 1003137 - protein, 9 aa, Homo Sapiens
FLDLILSSG

SEQ ID NO: 1003138 - protein, 9 aa, Homo Sapiens
EGRKECDCG

SEQ ID NO: 1003139 - protein, 9 aa, Homo Sapiens
GRAVAAAVC

SEQ ID NO: 1003140 - protein, 9 aa, Homo Sapiens
IRKCNKQPC

SEQ ID NO: 1003141 - protein, 9 aa, Homo Sapiens
ADEPLSEES

SEQ ID NO: 1003142 - protein, 9 aa, Homo Sapiens
PPTGDFGAP

SEQ ID NO: 1003143 - protein, 9 aa, Homo Sapiens
LLFHQWFLK

SEQ ID NO: 1003144 - protein, 9 aa, Homo Sapiens
CKEFQTELK

SEQ ID NO: 1003145 - protein, 9 aa, Homo Sapiens
QYNCSKCDK

SEQ ID NO: 1003146 - protein, 9 aa, Homo Sapiens
EEDEEGADA

SEQ ID NO: 1003147 - protein, 9 aa, Homo Sapiens
ESGTSCSSS

SEQ ID NO: 1003148 - protein, 9 aa, Homo Sapiens
KGREGKRRE

SEQ ID NO: 1003149 - protein, 9 aa, Homo Sapiens
MEVSLLQPV

SEQ ID NO: 1003150 - protein, 9 aa, Homo Sapiens
AQMKELWWE

SEQ ID NO: 1003151 - protein, 9 aa, Homo Sapiens
PGSMNHGKF

SEQ ID NO: 1003152 - protein, 9 aa, Homo Sapiens
AKMSSKGAG

SEQ ID NO: 1003153 - protein, 9 aa, Homo Sapiens
FAGFLLQEA

SEQ ID NO: 1003154 - protein, 9 aa, Homo Sapiens
QQFSYQPNY

SEQ ID NO: 1003155 - protein, 9 aa, Homo Sapiens
QSHSSASEP

SEQ ID NO: 1003156 - protein, 9 aa, Homo Sapiens
KQKCPVECP

SEQ ID NO: 1003157 - protein, 9 aa, Homo Sapiens
HRPKLIRIG

SEQ ID NO: 1003158 - protein, 9 aa, Homo Sapiens
DEPLSEESD

SEQ ID NO: 1003159 - protein, 9 aa, Homo Sapiens
TCIYCAESF

SEQ ID NO: 1003160 - protein, 9 aa, Homo Sapiens
ANCHASNLN

SEQ ID NO: 1003161 - protein, 9 aa, Homo Sapiens
HISGDSFSY

SEQ ID NO: 1003162 - protein, 9 aa, Homo Sapiens
LEVNKPKNC

SEQ ID NO: 1003163 - protein, 9 aa, Homo Sapiens
GPVDKGHVT

SEQ ID NO: 1003164 - protein, 9 aa, Homo Sapiens
SLHRHDNGN

SEQ ID NO: 1003165 - protein, 9 aa, Homo Sapiens
TSGSREGVA

SEQ ID NO: 1003166 - protein, 9 aa, Homo Sapiens
DHRRIGKKQ

SEQ ID NO: 1003167 - protein, 9 aa, Homo Sapiens
VQYPYRTQD

SEQ ID NO: 1003168 - protein, 9 aa, Homo Sapiens
EAPGEVVAV

SEQ ID NO: 1003169 - protein, 9 aa, Homo Sapiens
ELTFNLKHE

SEQ ID NO: 1003170 - protein, 9 aa, Homo Sapiens
PLCSEILSG

SEQ ID NO: 1003171 - protein, 9 aa, Homo Sapiens
SVKPVSSEI

SEQ ID NO: 1003172 - protein, 9 aa, Homo Sapiens
LVILDPADP

SEQ ID NO: 1003173 - protein, 9 aa, Homo Sapiens
SASQTGVPT

SEQ ID NO: 1003174 - protein, 9 aa, Homo Sapiens
SFKSSGSSS

SEQ ID NO: 1003175 - protein, 9 aa, Homo Sapiens
DGLRQDMAH

SEQ ID NO: 1003176 - protein, 9 aa, Homo Sapiens
FAERHILSA

SEQ ID NO: 1003177 - protein, 9 aa, Homo Sapiens
SSAGSSGLL

SEQ ID NO: 1003178 - protein, 9 aa, Homo Sapiens
LARMAMVLG

SEQ ID NO: 1003179 - protein, 9 aa, Homo Sapiens
EEDFDSDYE

SEQ ID NO: 1003180 - protein, 9 aa, Homo Sapiens
PGKNFSYPE

SEQ ID NO: 1003181 - protein, 9 aa, Homo Sapiens
LAGSLYEYV

SEQ ID NO: 1003182 - protein, 9 aa, Homo Sapiens
LLLDTGKEE

SEQ ID NO: 1003183 - protein, 9 aa, Homo Sapiens
ETLSMEENS

SEQ ID NO: 1003184 - protein, 9 aa, Homo Sapiens
LLAQQHSPP

SEQ ID NO: 1003185 - protein, 9 aa, Homo Sapiens
PDGEDPGNL

SEQ ID NO: 1003186 - protein, 9 aa, Homo Sapiens
SEKPTIFTE

SEQ ID NO: 1003187 - protein, 9 aa, Homo Sapiens
SRGFLSIAP

SEQ ID NO: 1003188 - protein, 9 aa, Homo Sapiens
SYDILSGLV

SEQ ID NO: 1003189 - protein, 9 aa, Homo Sapiens
GHLSGMLPL

SEQ ID NO: 1003190 - protein, 9 aa, Homo Sapiens
LPIPEDEPF

SEQ ID NO: 1003191 - protein, 9 aa, Homo Sapiens
AGSSGLLSR

SEQ ID NO: 1003192 - protein, 9 aa, Homo Sapiens
AFFPMCTSR

SEQ ID NO: 1003193 - protein, 9 aa, Homo Sapiens
PTLCSFFGL

SEQ ID NO: 1003194 - protein, 9 aa, Homo Sapiens
EKPYWCSED

SEQ ID NO: 1003195 - protein, 9 aa, Homo Sapiens
RDFGNKVTS

SEQ ID NO: 1003196 - protein, 9 aa, Homo Sapiens
SNFNGPNAI

SEQ ID NO: 1003197 - protein, 9 aa, Homo Sapiens
NPVAYYLHY

SEQ ID NO: 1003198 - protein, 9 aa, Homo Sapiens
VDDPLLSVQ

SEQ ID NO: 1003199 - protein, 9 aa, Homo Sapiens
PVPSTHLIK

SEQ ID NO: 1003200 - protein, 9 aa, Homo Sapiens
EKTCAPSVS

SEQ ID NO: 1003201 - protein, 9 aa, Homo Sapiens
QLTQELCER

SEQ ID NO: 1003202 - protein, 9 aa, Homo Sapiens
NIWDLKLKR

SEQ ID NO: 1003203 - protein, 9 aa, Homo Sapiens
DDDIKLRGA

SEQ ID NO: 1003204 - protein, 9 aa, Homo Sapiens
VLGATLRRL

SEQ ID NO: 1003205 - protein, 9 aa, Homo Sapiens
LERNEQLTR

SEQ ID NO: 1003206 - protein, 9 aa, Homo Sapiens
ARTFFAHFL

SEQ ID NO: 1003207 - protein, 9 aa, Homo Sapiens
IDLIREESL

SEQ ID NO: 1003208 - protein, 9 aa, Homo Sapiens
DSYKDAVWK

SEQ ID NO: 1003209 - protein, 9 aa, Homo Sapiens
ARDWKPFHS

SEQ ID NO: 1003210 - protein, 9 aa, Homo Sapiens
KTELSKKEC

SEQ ID NO: 1003211 - protein, 9 aa, Homo Sapiens
LGAVLAIKS

SEQ ID NO: 1003212 - protein, 9 aa, Homo Sapiens
DALTLQCQG

SEQ ID NO: 1003213 - protein, 9 aa, Homo Sapiens
KSCMPRWQT

SEQ ID NO: 1003214 - protein, 9 aa, Homo Sapiens
GQEEIPQGF

SEQ ID NO: 1003215 - protein, 9 aa, Homo Sapiens
DEPQETTYR

SEQ ID NO: 1003216 - protein, 9 aa, Homo Sapiens
DFGAPPVPP

SEQ ID NO: 1003217 - protein, 9 aa, Homo Sapiens
KQTGRHKPT

SEQ ID NO: 1003218 - protein, 9 aa, Homo Sapiens
VVEVHLARS

SEQ ID NO: 1003219 - protein, 9 aa, Homo Sapiens
ILASSLVFN

SEQ ID NO: 1003220 - protein, 9 aa, Homo Sapiens
QHSPPDRQA

SEQ ID NO: 1003221 - protein, 9 aa, Homo Sapiens
QSGKSNRTR

SEQ ID NO: 1003222 - protein, 9 aa, Homo Sapiens
KAESNLHHH

SEQ ID NO: 1003223 - protein, 9 aa, Homo Sapiens
VRYSICSEE

SEQ ID NO: 1003224 - protein, 9 aa, Homo Sapiens
ECDFHPLPP

SEQ ID NO: 1003225 - protein, 9 aa, Homo Sapiens
KTKKVEKFK

SEQ ID NO: 1003226 - protein, 9 aa, Homo Sapiens
PSSSAPPKT

SEQ ID NO: 1003227 - protein, 9 aa, Homo Sapiens
HSPQVDELD

SEQ ID NO: 1003228 - protein, 9 aa, Homo Sapiens
IEVPILRDG

SEQ ID NO: 1003229 - protein, 9 aa, Homo Sapiens
MFLSKPSAY

SEQ ID NO: 1003230 - protein, 9 aa, Homo Sapiens
VATYNRFLY

SEQ ID NO: 1003231 - protein, 9 aa, Homo Sapiens
GAVLAIKSY

SEQ ID NO: 1003232 - protein, 9 aa, Homo Sapiens
ICQIIEHTE

SEQ ID NO: 1003233 - protein, 9 aa, Homo Sapiens
LNLTATFKD

SEQ ID NO: 1003234 - protein, 9 aa, Homo Sapiens
NFTAPSVLG

SEQ ID NO: 1003235 - protein, 9 aa, Homo Sapiens
HLEENQLTK

SEQ ID NO: 1003236 - protein, 9 aa, Homo Sapiens
ATFKDGQEA

SEQ ID NO: 1003237 - protein, 9 aa, Homo Sapiens
NCHASNLNG

SEQ ID NO: 1003238 - protein, 9 aa, Homo Sapiens
DHVFSRGRK

SEQ ID NO: 1003239 - protein, 9 aa, Homo Sapiens
AVAKKVAGP

SEQ ID NO: 1003240 - protein, 9 aa, Homo Sapiens
VYYKDDPHY

SEQ ID NO: 1003241 - protein, 9 aa, Homo Sapiens
YKTELSKKE

SEQ ID NO: 1003242 - protein, 9 aa, Homo Sapiens
ELKEALGIL

SEQ ID NO: 1003243 - protein, 9 aa, Homo Sapiens
VISKIKRDK

SEQ ID NO: 1003244 - protein, 9 aa, Homo Sapiens
LVPLEPIPG

SEQ ID NO: 1003245 - protein, 9 aa, Homo Sapiens
PSDQLEISV

SEQ ID NO: 1003246 - protein, 9 aa, Homo Sapiens
DQSGKSNRT

SEQ ID NO: 1003247 - protein, 9 aa, Homo Sapiens
HSGREHERA

SEQ ID NO: 1003248 - protein, 9 aa, Homo Sapiens
KFEEEVQYN

SEQ ID NO: 1003249 - protein, 9 aa, Homo Sapiens
AELVRNGAE

SEQ ID NO: 1003250 - protein, 9 aa, Homo Sapiens
EQLERFIQR

SEQ ID NO: 1003251 - protein, 9 aa, Homo Sapiens
GDPELIAAV

SEQ ID NO: 1003252 - protein, 9 aa, Homo Sapiens
LRESMRKDH

SEQ ID NO: 1003253 - protein, 9 aa, Homo Sapiens
ACPFSTGLW

SEQ ID NO: 1003254 - protein, 9 aa, Homo Sapiens
PRRNCAAER

SEQ ID NO: 1003255 - protein, 9 aa, Homo Sapiens
TLSVSSLLP

SEQ ID NO: 1003256 - protein, 9 aa, Homo Sapiens
CRCQKGHAH

SEQ ID NO: 1003257 - protein, 9 aa, Homo Sapiens
GNLIVEGRK

SEQ ID NO: 1003258 - protein, 9 aa, Homo Sapiens
NSGLTEKEA

SEQ ID NO: 1003259 - protein, 9 aa, Homo Sapiens
TSEKKTSPH

SEQ ID NO: 1003260 - protein, 9 aa, Homo Sapiens
VQQCNFTAW

SEQ ID NO: 1003261 - protein, 9 aa, Homo Sapiens
WPLEAPGEV

SEQ ID NO: 1003262 - protein, 9 aa, Homo Sapiens
KPPEEPLLG

SEQ ID NO: 1003263 - protein, 9 aa, Homo Sapiens
VIFSVGRML

SEQ ID NO: 1003264 - protein, 9 aa, Homo Sapiens
HRMQFLHKL

SEQ ID NO: 1003265 - protein, 9 aa, Homo Sapiens
LWWEVEETR

SEQ ID NO: 1003266 - protein, 9 aa, Homo Sapiens
NHSESFFPL

SEQ ID NO: 1003267 - protein, 9 aa, Homo Sapiens
KVVFFQQEL

SEQ ID NO: 1003268 - protein, 9 aa, Homo Sapiens
KFERSSNLS

SEQ ID NO: 1003269 - protein, 9 aa, Homo Sapiens
ATQSHFKHL

SEQ ID NO: 1003270 - protein, 9 aa, Homo Sapiens
LCSEILSGK

SEQ ID NO: 1003271 - protein, 9 aa, Homo Sapiens
SLTLDSDLL

SEQ ID NO: 1003272 - protein, 9 aa, Homo Sapiens
DYDHSAFIE

SEQ ID NO: 1003273 - protein, 9 aa, Homo Sapiens
AGLERWTTK

SEQ ID NO: 1003274 - protein, 9 aa, Homo Sapiens
QLQGIHSWR

SEQ ID NO: 1003275 - protein, 9 aa, Homo Sapiens
SMLLETTSE

SEQ ID NO: 1003276 - protein, 9 aa, Homo Sapiens
CNKQPCQTR

SEQ ID NO: 1003277 - protein, 9 aa, Homo Sapiens
PSLLLSSDL

SEQ ID NO: 1003278 - protein, 9 aa, Homo Sapiens
EATKYYILI

SEQ ID NO: 1003279 - protein, 9 aa, Homo Sapiens
VEFYRTTYT

SEQ ID NO: 1003280 - protein, 9 aa, Homo Sapiens
APGAMENWD

SEQ ID NO: 1003281 - protein, 9 aa, Homo Sapiens
AYTSASFCH

SEQ ID NO: 1003282 - protein, 9 aa, Homo Sapiens
SHHMFVLEQ

SEQ ID NO: 1003283 - protein, 9 aa, Homo Sapiens
LWSQELRPE

SEQ ID NO: 1003284 - protein, 9 aa, Homo Sapiens
QLLLKYAKQ

SEQ ID NO: 1003285 - protein, 9 aa, Homo Sapiens
ALEATKLFG

SEQ ID NO: 1003286 - protein, 9 aa, Homo Sapiens
SLLKYFSSK

SEQ ID NO: 1003287 - protein, 9 aa, Homo Sapiens
IVTNNNEPL

SEQ ID NO: 1003288 - protein, 9 aa, Homo Sapiens
ISPEVLRYD

SEQ ID NO: 1003289 - protein, 9 aa, Homo Sapiens
KLFRNILKK

SEQ ID NO: 1003290 - protein, 9 aa, Homo Sapiens
IMNKGVFIK

SEQ ID NO: 1003291 - protein, 9 aa, Homo Sapiens
AGVVCTSET

SEQ ID NO: 1003292 - protein, 9 aa, Homo Sapiens
FGKSQPAPA

SEQ ID NO: 1003293 - protein, 9 aa, Homo Sapiens
GSVHPSNVL

SEQ ID NO: 1003294 - protein, 9 aa, Homo Sapiens
TAGVSRQRA

SEQ ID NO: 1003295 - protein, 9 aa, Homo Sapiens
KEIYLQKPE

SEQ ID NO: 1003296 - protein, 9 aa, Homo Sapiens
EGATRGHSC

SEQ ID NO: 1003297 - protein, 9 aa, Homo Sapiens
SAIIKNLRK

SEQ ID NO: 1003298 - protein, 9 aa, Homo Sapiens
GEDPGNLQG

SEQ ID NO: 1003299 - protein, 9 aa, Homo Sapiens
MLMKVIRCL

SEQ ID NO: 1003300 - protein, 9 aa, Homo Sapiens
YQQPVMSPN

SEQ ID NO: 1003301 - protein, 9 aa, Homo Sapiens
SCDCHEAGT

SEQ ID NO: 1003302 - protein, 9 aa, Homo Sapiens
ESPYGILAA

SEQ ID NO: 1003303 - protein, 9 aa, Homo Sapiens
ADSIPKVLT

SEQ ID NO: 1003304 - protein, 9 aa, Homo Sapiens
RSEAKKSEN

SEQ ID NO: 1003305 - protein, 9 aa, Homo Sapiens
GQTFCPNNV

SEQ ID NO: 1003306 - protein, 9 aa, Homo Sapiens
RPRKKSKVA

SEQ ID NO: 1003307 - protein, 9 aa, Homo Sapiens
VAFNGQDRN

SEQ ID NO: 1003308 - protein, 9 aa, Homo Sapiens
YQSERFLPS

SEQ ID NO: 1003309 - protein, 9 aa, Homo Sapiens
DNYYIFCLL

SEQ ID NO: 1003310 - protein, 9 aa, Homo Sapiens
QPPSTLGVS

SEQ ID NO: 1003311 - protein, 9 aa, Homo Sapiens
NCKVVFFQQ

SEQ ID NO: 1003312 - protein, 9 aa, Homo Sapiens
SFSSAGRQR

SEQ ID NO: 1003313 - protein, 9 aa, Homo Sapiens
LRPEKGRRL

SEQ ID NO: 1003314 - protein, 9 aa, Homo Sapiens
KDEIFSADL

SEQ ID NO: 1003315 - protein, 9 aa, Homo Sapiens
QCQGWKNTP

SEQ ID NO: 1003316 - protein, 9 aa, Homo Sapiens
EQTYEVKYT

SEQ ID NO: 1003317 - protein, 9 aa, Homo Sapiens
RARSDNLTV

SEQ ID NO: 1003318 - protein, 9 aa, Homo Sapiens
PLLSVQTST

SEQ ID NO: 1003319 - protein, 9 aa, Homo Sapiens
LVLAQVLGR

SEQ ID NO: 1003320 - protein, 9 aa, Homo Sapiens
RYCQGFNIL

SEQ ID NO: 1003321 - protein, 9 aa, Homo Sapiens
TSSLNPLAQ

SEQ ID NO: 1003322 - protein, 9 aa, Homo Sapiens
CSTTENGAE

SEQ ID NO: 1003323 - protein, 9 aa, Homo Sapiens
IYKQYASVA

SEQ ID NO: 1003324 - protein, 9 aa, Homo Sapiens
SNRSAIIKN

SEQ ID NO: 1003325 - protein, 9 aa, Homo Sapiens
LSIPSAESE

SEQ ID NO: 1003326 - protein, 9 aa, Homo Sapiens
ANDTSNGIS

SEQ ID NO: 1003327 - protein, 9 aa, Homo Sapiens
KPSAYICLF

SEQ ID NO: 1003328 - protein, 9 aa, Homo Sapiens
DEEEEESPD

SEQ ID NO: 1003329 - protein, 9 aa, Homo Sapiens
SPQNGELGK

SEQ ID NO: 1003330 - protein, 9 aa, Homo Sapiens
EEFEVLEYW

SEQ ID NO: 1003331 - protein, 9 aa, Homo Sapiens
MFSDFHSYI

SEQ ID NO: 1003332 - protein, 9 aa, Homo Sapiens
RALDCEEQP

SEQ ID NO: 1003333 - protein, 9 aa, Homo Sapiens
NRAAWLAKI

SEQ ID NO: 1003334 - protein, 9 aa, Homo Sapiens
VMVLFILCL

SEQ ID NO: 1003335 - protein, 9 aa, Homo Sapiens
EVSLLQPVN

SEQ ID NO: 1003336 - protein, 9 aa, Homo Sapiens
GTILLIFYG

SEQ ID NO: 1003337 - protein, 9 aa, Homo Sapiens
SLKKEYTVG

SEQ ID NO: 1003338 - protein, 9 aa, Homo Sapiens
HFNAVLEEL

SEQ ID NO: 1003339 - protein, 9 aa, Homo Sapiens
QRVGGSGEA

SEQ ID NO: 1003340 - protein, 9 aa, Homo Sapiens
GGVVQAFLS

SEQ ID NO: 1003341 - protein, 9 aa, Homo Sapiens
AEVCASDSP

SEQ ID NO: 1003342 - protein, 9 aa, Homo Sapiens
EYTMHIKRR

SEQ ID NO: 1003343 - protein, 9 aa, Homo Sapiens
TSATDIKGK

SEQ ID NO: 1003344 - protein, 9 aa, Homo Sapiens
TLSEDHSNR

SEQ ID NO: 1003345 - protein, 9 aa, Homo Sapiens
WRLLMAVGA

SEQ ID NO: 1003346 - protein, 9 aa, Homo Sapiens
AWDEEEEES

SEQ ID NO: 1003347 - protein, 9 aa, Homo Sapiens
IRRVANVFT

SEQ ID NO: 1003348 - protein, 9 aa, Homo Sapiens
DQSSSVQID

SEQ ID NO: 1003349 - protein, 9 aa, Homo Sapiens
DKNCYEQMK

SEQ ID NO: 1003350 - protein, 9 aa, Homo Sapiens
LEPSGSPTS

SEQ ID NO: 1003351 - protein, 9 aa, Homo Sapiens
HYWKVDVKD

SEQ ID NO: 1003352 - protein, 9 aa, Homo Sapiens
PLSHGFKEK

SEQ ID NO: 1003353 - protein, 9 aa, Homo Sapiens
QHLTQPHRP

SEQ ID NO: 1003354 - protein, 9 aa, Homo Sapiens
TSSPEENVT

SEQ ID NO: 1003355 - protein, 9 aa, Homo Sapiens
CGACLSASL

SEQ ID NO: 1003356 - protein, 9 aa, Homo Sapiens
PVDKTGWVI

SEQ ID NO: 1003357 - protein, 9 aa, Homo Sapiens
ASVAYQNQV

SEQ ID NO: 1003358 - protein, 9 aa, Homo Sapiens
VFNISDGQF

SEQ ID NO: 1003359 - protein, 9 aa, Homo Sapiens
EVLPPKKVV

SEQ ID NO: 1003360 - protein, 9 aa, Homo Sapiens
CSNANLKKI

SEQ ID NO: 1003361 - protein, 9 aa, Homo Sapiens
EVNKPKNCY

SEQ ID NO: 1003362 - protein, 9 aa, Homo Sapiens
NAFFPMCTS

SEQ ID NO: 1003363 - protein, 9 aa, Homo Sapiens
ENCASIFEK

SEQ ID NO: 1003364 - protein, 9 aa, Homo Sapiens
WTAITTASI

SEQ ID NO: 1003365 - protein, 9 aa, Homo Sapiens
RKSSTSIDK

SEQ ID NO: 1003366 - protein, 9 aa, Homo Sapiens
NDNLFGPSC

SEQ ID NO: 1003367 - protein, 9 aa, Homo Sapiens
RDVQYLLYI

SEQ ID NO: 1003368 - protein, 9 aa, Homo Sapiens
RASSSLSLS

SEQ ID NO: 1003369 - protein, 9 aa, Homo Sapiens
RTTPIPEYL

SEQ ID NO: 1003370 - protein, 9 aa, Homo Sapiens
RLLEPQPAP

SEQ ID NO: 1003371 - protein, 9 aa, Homo Sapiens
RIAHMHLKK

SEQ ID NO: 1003372 - protein, 9 aa, Homo Sapiens
PDVFSKAQI

SEQ ID NO: 1003373 - protein, 9 aa, Homo Sapiens
MALKVKKEA

SEQ ID NO: 1003374 - protein, 9 aa, Homo Sapiens
QFPDIFFCP

SEQ ID NO: 1003375 - protein, 9 aa, Homo Sapiens
PTYKEVTPY

SEQ ID NO: 1003376 - protein, 9 aa, Homo Sapiens
RTFFAHFLL

SEQ ID NO: 1003377 - protein, 9 aa, Homo Sapiens
QAWRNASRC

SEQ ID NO: 1003378 - protein, 9 aa, Homo Sapiens
GNYITFWGA

SEQ ID NO: 1003379 - protein, 9 aa, Homo Sapiens
SVDRRRATT

SEQ ID NO: 1003380 - protein, 9 aa, Homo Sapiens
LAVSPDGTF

SEQ ID NO: 1003381 - protein, 9 aa, Homo Sapiens
DHYNSENIK

SEQ ID NO: 1003382 - protein, 9 aa, Homo Sapiens
GRKLERNEQ

SEQ ID NO: 1003383 - protein, 9 aa, Homo Sapiens
ELEGSGLGY

SEQ ID NO: 1003384 - protein, 9 aa, Homo Sapiens
APPPLTKPG

SEQ ID NO: 1003385 - protein, 9 aa, Homo Sapiens
CLDTSMDSG

SEQ ID NO: 1003386 - protein, 9 aa, Homo Sapiens
KNMIFYGFL

SEQ ID NO: 1003387 - protein, 9 aa, Homo Sapiens
VPKPKSKFY

SEQ ID NO: 1003388 - protein, 9 aa, Homo Sapiens
DRGILFPSI

SEQ ID NO: 1003389 - protein, 9 aa, Homo Sapiens
MFEFSRREK

SEQ ID NO: 1003390 - protein, 9 aa, Homo Sapiens
SSHFIQDLL

SEQ ID NO: 1003391 - protein, 9 aa, Homo Sapiens
KKTESVLYG

SEQ ID NO: 1003392 - protein, 9 aa, Homo Sapiens
RGILFPSIE

SEQ ID NO: 1003393 - protein, 9 aa, Homo Sapiens
TGKSKKETL

SEQ ID NO: 1003394 - protein, 9 aa, Homo Sapiens
DKGHVTFYK

SEQ ID NO: 1003395 - protein, 9 aa, Homo Sapiens
GRSEQATFD

SEQ ID NO: 1003396 - protein, 9 aa, Homo Sapiens
LYGQEEIPQ

SEQ ID NO: 1003397 - protein, 9 aa, Homo Sapiens
SGRVIGGGL

SEQ ID NO: 1003398 - protein, 9 aa, Homo Sapiens
IMKDYENLW

SEQ ID NO: 1003399 - protein, 9 aa, Homo Sapiens
VIRPFLKKK

SEQ ID NO: 1003400 - protein, 9 aa, Homo Sapiens
VPYSQEYFL

SEQ ID NO: 1003401 - protein, 9 aa, Homo Sapiens
ESAPAWTSL

SEQ ID NO: 1003402 - protein, 9 aa, Homo Sapiens
RYTTMRHLG

SEQ ID NO: 1003403 - protein, 9 aa, Homo Sapiens
YKEKIEDIC

SEQ ID NO: 1003404 - protein, 9 aa, Homo Sapiens
NDRKRNRMH

SEQ ID NO: 1003405 - protein, 9 aa, Homo Sapiens
LADAIIKLQ

SEQ ID NO: 1003406 - protein, 9 aa, Homo Sapiens
ISLLISGTQ

SEQ ID NO: 1003407 - protein, 9 aa, Homo Sapiens
YVFPVNTVK

SEQ ID NO: 1003408 - protein, 9 aa, Homo Sapiens
KEYVQFQAE

SEQ ID NO: 1003409 - protein, 9 aa, Homo Sapiens
FRAVSKPDL

SEQ ID NO: 1003410 - protein, 9 aa, Homo Sapiens
LKDIRVQLE

SEQ ID NO: 1003411 - protein, 9 aa, Homo Sapiens
FSKEKRVAM

SEQ ID NO: 1003412 - protein, 9 aa, Homo Sapiens
IPPLGFGPG

SEQ ID NO: 1003413 - protein, 9 aa, Homo Sapiens
FPGSMNHGK

SEQ ID NO: 1003414 - protein, 9 aa, Homo Sapiens
KVVSWAYQF

SEQ ID NO: 1003415 - protein, 9 aa, Homo Sapiens
FNLMYAKRA

SEQ ID NO: 1003416 - protein, 9 aa, Homo Sapiens
IPVRALCTG

SEQ ID NO: 1003417 - protein, 9 aa, Homo Sapiens
IYKFEEEVQ

SEQ ID NO: 1003418 - protein, 9 aa, Homo Sapiens
GHRDSGNKA

SEQ ID NO: 1003419 - protein, 9 aa, Homo Sapiens
SPEENVTDF

SEQ ID NO: 1003420 - protein, 9 aa, Homo Sapiens
KQYASVAYQ

SEQ ID NO: 1003421 - protein, 9 aa, Homo Sapiens
TPPLGIPPL

SEQ ID NO: 1003422 - protein, 9 aa, Homo Sapiens
KLISGDISG

SEQ ID NO: 1003423 - protein, 9 aa, Homo Sapiens
TKLNLTATF

SEQ ID NO: 1003424 - protein, 9 aa, Homo Sapiens
LAILETSAK

SEQ ID NO: 1003425 - protein, 9 aa, Homo Sapiens
LKFNLNQYV

SEQ ID NO: 1003426 - protein, 9 aa, Homo Sapiens
SPSEYKLED

SEQ ID NO: 1003427 - protein, 9 aa, Homo Sapiens
NKTVRYCQG

SEQ ID NO: 1003428 - protein, 9 aa, Homo Sapiens
KSIVIRLLE

SEQ ID NO: 1003429 - protein, 9 aa, Homo Sapiens
SCTAYRMLM

SEQ ID NO: 1003430 - protein, 9 aa, Homo Sapiens
QLQGHLTHY

SEQ ID NO: 1003431 - protein, 9 aa, Homo Sapiens
YAACSIFYL

SEQ ID NO: 1003432 - protein, 9 aa, Homo Sapiens
KVSFAHKPL

SEQ ID NO: 1003433 - protein, 9 aa, Homo Sapiens
LDHKFNLMY

SEQ ID NO: 1003434 - protein, 9 aa, Homo Sapiens
VIGTILLIF

SEQ ID NO: 1003435 - protein, 9 aa, Homo Sapiens
IPEDEPFVL

SEQ ID NO: 1003436 - protein, 9 aa, Homo Sapiens
QALTLAFAL

SEQ ID NO: 1003437 - protein, 9 aa, Homo Sapiens
TGPPPISSS

SEQ ID NO: 1003438 - protein, 9 aa, Homo Sapiens
VKVRAYQSE

SEQ ID NO: 1003439 - protein, 9 aa, Homo Sapiens
RADVAVASL

SEQ ID NO: 1003440 - protein, 9 aa, Homo Sapiens
NKKKAHKIM

SEQ ID NO: 1003441 - protein, 9 aa, Homo Sapiens
ASLLGGRLL

SEQ ID NO: 1003442 - protein, 9 aa, Homo Sapiens
TENGAEPLL

SEQ ID NO: 1003443 - protein, 9 aa, Homo Sapiens
HSRTKRDPK

SEQ ID NO: 1003444 - protein, 9 aa, Homo Sapiens
KKRFTPEKE

SEQ ID NO: 1003445 - protein, 9 aa, Homo Sapiens
KEGTPLWRL

SEQ ID NO: 1003446 - protein, 9 aa, Homo Sapiens
LLLLNICTS

SEQ ID NO: 1003447 - protein, 9 aa, Homo Sapiens
HLPQASPIF

SEQ ID NO: 1003448 - protein, 9 aa, Homo Sapiens
LIILMVVMK

SEQ ID NO: 1003449 - protein, 9 aa, Homo Sapiens
EKSYKFIFV

SEQ ID NO: 1003450 - protein, 9 aa, Homo Sapiens
KMVCNSWFE

SEQ ID NO: 1003451 - protein, 9 aa, Homo Sapiens
GDYDHSAFI

SEQ ID NO: 1003452 - protein, 9 aa, Homo Sapiens
TGECVPQMK

SEQ ID NO: 1003453 - protein, 9 aa, Homo Sapiens
THTGEKPYW

SEQ ID NO: 1003454 - protein, 9 aa, Homo Sapiens
LALLGGEPK

SEQ ID NO: 1003455 - protein, 9 aa, Homo Sapiens
FAHFLLGST

SEQ ID NO: 1003456 - protein, 9 aa, Homo Sapiens
PMVEKRMMG

SEQ ID NO: 1003457 - protein, 9 aa, Homo Sapiens
LGVVYRSLL

SEQ ID NO: 1003458 - protein, 9 aa, Homo Sapiens
VVGIPGWGV

SEQ ID NO: 1003459 - protein, 9 aa, Homo Sapiens
PLPYCGVPV

SEQ ID NO: 1003460 - protein, 9 aa, Homo Sapiens
KVRPTQDPA

SEQ ID NO: 1003461 - protein, 9 aa, Homo Sapiens
AEEGALVPL

SEQ ID NO: 1003462 - protein, 9 aa, Homo Sapiens
TKKVTPFSM

SEQ ID NO: 1003463 - protein, 9 aa, Homo Sapiens
GSHFQGNLS

SEQ ID NO: 1003464 - protein, 9 aa, Homo Sapiens
KQTVRCRGR

SEQ ID NO: 1003465 - protein, 9 aa, Homo Sapiens
ASGQWGLPF

SEQ ID NO: 1003466 - protein, 9 aa, Homo Sapiens
YSQEYFLCQ

SEQ ID NO: 1003467 - protein, 9 aa, Homo Sapiens
HYSPWWFHR

SEQ ID NO: 1003468 - protein, 9 aa, Homo Sapiens
PKPKSKFYG

SEQ ID NO: 1003469 - protein, 9 aa, Homo Sapiens
STGHATHLS

SEQ ID NO: 1003470 - protein, 9 aa, Homo Sapiens
CSFFGLQVL

SEQ ID NO: 1003471 - protein, 9 aa, Homo Sapiens
MTQSIFNES

SEQ ID NO: 1003472 - protein, 9 aa, Homo Sapiens
MTVQQCNFT

SEQ ID NO: 1003473 - protein, 9 aa, Homo Sapiens
KKANDRKRN

SEQ ID NO: 1003474 - protein, 9 aa, Homo Sapiens
EGEEDFDSD

SEQ ID NO: 1003475 - protein, 9 aa, Homo Sapiens
ITPGPPGSM

SEQ ID NO: 1003476 - protein, 9 aa, Homo Sapiens
RFTPEKEMF

SEQ ID NO: 1003477 - protein, 9 aa, Homo Sapiens
HEYDKDNIS

SEQ ID NO: 1003478 - protein, 9 aa, Homo Sapiens
QLPPGKMCN

SEQ ID NO: 1003479 - protein, 9 aa, Homo Sapiens
PSEENFETI

SEQ ID NO: 1003480 - protein, 9 aa, Homo Sapiens
INERLLSAI

SEQ ID NO: 1003481 - protein, 9 aa, Homo Sapiens
DECLDTSMD

SEQ ID NO: 1003482 - protein, 9 aa, Homo Sapiens
ASVGVSQVT

SEQ ID NO: 1003483 - protein, 9 aa, Homo Sapiens
HSSASEPWE

SEQ ID NO: 1003484 - protein, 9 aa, Homo Sapiens
NLCSTSPSC

SEQ ID NO: 1003485 - protein, 9 aa, Homo Sapiens
GYQNKIKWQ

SEQ ID NO: 1003486 - protein, 9 aa, Homo Sapiens
SGKHYWKVD

SEQ ID NO: 1003487 - protein, 9 aa, Homo Sapiens
DLLMTSADP

SEQ ID NO: 1003488 - protein, 9 aa, Homo Sapiens
LKGKSDRKY

SEQ ID NO: 1003489 - protein, 9 aa, Homo Sapiens
LMIEELNPY

SEQ ID NO: 1003490 - protein, 9 aa, Homo Sapiens
IGMPPLGMR

SEQ ID NO: 1003491 - protein, 9 aa, Homo Sapiens
YENLWNTVS

SEQ ID NO: 1003492 - protein, 9 aa, Homo Sapiens
PLQALHMTS

SEQ ID NO: 1003493 - protein, 9 aa, Homo Sapiens
TQRSDSQVL

SEQ ID NO: 1003494 - protein, 9 aa, Homo Sapiens
SAEIQPPSA

SEQ ID NO: 1003495 - protein, 9 aa, Homo Sapiens
IWKQILRIP

SEQ ID NO: 1003496 - protein, 9 aa, Homo Sapiens
SISGHATLY

SEQ ID NO: 1003497 - protein, 9 aa, Homo Sapiens
VCVVSRFSY

SEQ ID NO: 1003498 - protein, 9 aa, Homo Sapiens
DEQKVASHQ

SEQ ID NO: 1003499 - protein, 9 aa, Homo Sapiens
KDLLKAVEL

SEQ ID NO: 1003500 - protein, 9 aa, Homo Sapiens
IEQLERFIQ

SEQ ID NO: 1003501 - protein, 9 aa, Homo Sapiens
HSAFIEPRY

SEQ ID NO: 1003502 - protein, 9 aa, Homo Sapiens
KKSCGNRNK

SEQ ID NO: 1003503 - protein, 9 aa, Homo Sapiens
HGSSAYSPS

SEQ ID NO: 1003504 - protein, 9 aa, Homo Sapiens
LSDILETVP

SEQ ID NO: 1003505 - protein, 9 aa, Homo Sapiens
QIMRQYTSF

SEQ ID NO: 1003506 - protein, 9 aa, Homo Sapiens
LRGNRYTGK

SEQ ID NO: 1003507 - protein, 9 aa, Homo Sapiens
VHPSNVLDM

SEQ ID NO: 1003508 - protein, 9 aa, Homo Sapiens
PQIRKCNKQ

SEQ ID NO: 1003509 - protein, 9 aa, Homo Sapiens
RGHYRLVRF

SEQ ID NO: 1003510 - protein, 9 aa, Homo Sapiens
EASPGSSAS

SEQ ID NO: 1003511 - protein, 9 aa, Homo Sapiens
KGNFSLLEL

SEQ ID NO: 1003512 - protein, 9 aa, Homo Sapiens
TEEDNDEFF

SEQ ID NO: 1003513 - protein, 9 aa, Homo Sapiens
ESNSNGRNS

SEQ ID NO: 1003514 - protein, 9 aa, Homo Sapiens
RGVPDWFSF

SEQ ID NO: 1003515 - protein, 9 aa, Homo Sapiens
AKKVAGPAV

SEQ ID NO: 1003516 - protein, 9 aa, Homo Sapiens
IVQFVPFQD

SEQ ID NO: 1003517 - protein, 9 aa, Homo Sapiens
TYLNVSCSQ

SEQ ID NO: 1003518 - protein, 9 aa, Homo Sapiens
VFSRGRKKS

SEQ ID NO: 1003519 - protein, 9 aa, Homo Sapiens
GSSGSSASL

SEQ ID NO: 1003520 - protein, 9 aa, Homo Sapiens
SREVVNRQM

SEQ ID NO: 1003521 - protein, 9 aa, Homo Sapiens
VASLTITLV

SEQ ID NO: 1003522 - protein, 9 aa, Homo Sapiens
LGGPLLSPS

SEQ ID NO: 1003523 - protein, 9 aa, Homo Sapiens
AKGLGLQGA

SEQ ID NO: 1003524 - protein, 9 aa, Homo Sapiens
LMKVIRCLG

SEQ ID NO: 1003525 - protein, 9 aa, Homo Sapiens
FVMAITANL

SEQ ID NO: 1003526 - protein, 9 aa, Homo Sapiens
EPFVLEAHD

SEQ ID NO: 1003527 - protein, 9 aa, Homo Sapiens
MNRYTTMRH

SEQ ID NO: 1003528 - protein, 9 aa, Homo Sapiens
YYIFCLLPP

SEQ ID NO: 1003529 - protein, 9 aa, Homo Sapiens
SYKFIFVLS

SEQ ID NO: 1003530 - protein, 9 aa, Homo Sapiens
LFFFLLLGL

SEQ ID NO: 1003531 - protein, 9 aa, Homo Sapiens
CISWFGSPT

SEQ ID NO: 1003532 - protein, 9 aa, Homo Sapiens
SPAQGSSKP

SEQ ID NO: 1003533 - protein, 9 aa, Homo Sapiens
NRKDPDSSS

SEQ ID NO: 1003534 - protein, 9 aa, Homo Sapiens
QAALMIEEL

SEQ ID NO: 1003535 - protein, 9 aa, Homo Sapiens
HRDSGNKAG

SEQ ID NO: 1003536 - protein, 9 aa, Homo Sapiens
HDIFKANDL

SEQ ID NO: 1003537 - protein, 9 aa, Homo Sapiens
MATEEDNDE

SEQ ID NO: 1003538 - protein, 9 aa, Homo Sapiens
SFLCVQSPL

SEQ ID NO: 1003539 - protein, 9 aa, Homo Sapiens
SGTSKDHDS

SEQ ID NO: 1003540 - protein, 9 aa, Homo Sapiens
KGLGLQGAY

SEQ ID NO: 1003541 - protein, 9 aa, Homo Sapiens
SKFYGANFS

SEQ ID NO: 1003542 - protein, 9 aa, Homo Sapiens
LQMKWRELE

SEQ ID NO: 1003543 - protein, 9 aa, Homo Sapiens
TGAVSQYTV

SEQ ID NO: 1003544 - protein, 9 aa, Homo Sapiens
EVMPFWAQK

SEQ ID NO: 1003545 - protein, 9 aa, Homo Sapiens
EFPWLKSEL

SEQ ID NO: 1003546 - protein, 9 aa, Homo Sapiens
HLDSNKLTR

SEQ ID NO: 1003547 - protein, 9 aa, Homo Sapiens
YGDSVEVGH

SEQ ID NO: 1003548 - protein, 9 aa, Homo Sapiens
CTSSPEENV

SEQ ID NO: 1003549 - protein, 9 aa, Homo Sapiens
LSLFEDVAG

SEQ ID NO: 1003550 - protein, 9 aa, Homo Sapiens
PAPPALRPR

SEQ ID NO: 1003551 - protein, 9 aa, Homo Sapiens
NKIKWQNFV

SEQ ID NO: 1003552 - protein, 9 aa, Homo Sapiens
IYPFNLLLL

SEQ ID NO: 1003553 - protein, 9 aa, Homo Sapiens
ALGAGPTQP

SEQ ID NO: 1003554 - protein, 9 aa, Homo Sapiens
HYTLCKPVL

SEQ ID NO: 1003555 - protein, 9 aa, Homo Sapiens
LRVSRAQAV

SEQ ID NO: 1003556 - protein, 9 aa, Homo Sapiens
KRGRLDSEL

SEQ ID NO: 1003557 - protein, 9 aa, Homo Sapiens
FSLQLQGRT

SEQ ID NO: 1003558 - protein, 9 aa, Homo Sapiens
NPLRQSCIS

SEQ ID NO: 1003559 - protein, 9 aa, Homo Sapiens
PFVLCQGVA

SEQ ID NO: 1003560 - protein, 9 aa, Homo Sapiens
QCASVGVSQ

SEQ ID NO: 1003561 - protein, 9 aa, Homo Sapiens
TDTLQCPRC

SEQ ID NO: 1003562 - protein, 9 aa, Homo Sapiens
MNHSYCPNV

SEQ ID NO: 1003563 - protein, 9 aa, Homo Sapiens
GRFGKEGLA

SEQ ID NO: 1003564 - protein, 9 aa, Homo Sapiens
RAVSKPDLD

SEQ ID NO: 1003565 - protein, 9 aa, Homo Sapiens
LLELDNVLL

SEQ ID NO: 1003566 - protein, 9 aa, Homo Sapiens
SKKECCSTG

SEQ ID NO: 1003567 - protein, 9 aa, Homo Sapiens
HVNTLHSRT

SEQ ID NO: 1003568 - protein, 9 aa, Homo Sapiens
LKNFVISKI

SEQ ID NO: 1003569 - protein, 9 aa, Homo Sapiens
TIYKFEEEV

SEQ ID NO: 1003570 - protein, 9 aa, Homo Sapiens
KDQVLSLNH

SEQ ID NO: 1003571 - protein, 9 aa, Homo Sapiens
KKLNLVNMN

SEQ ID NO: 1003572 - protein, 9 aa, Homo Sapiens
TLTLAGSSD

SEQ ID NO: 1003573 - protein, 9 aa, Homo Sapiens
EKQKCPVEC

SEQ ID NO: 1003574 - protein, 9 aa, Homo Sapiens
HFQGNLSLL

SEQ ID NO: 1003575 - protein, 9 aa, Homo Sapiens
NTMNGASVE

SEQ ID NO: 1003576 - protein, 9 aa, Homo Sapiens
FQGAWWYAN

SEQ ID NO: 1003577 - protein, 9 aa, Homo Sapiens
FQLYLENLN

SEQ ID NO: 1003578 - protein, 9 aa, Homo Sapiens
YSRSSTLTN

SEQ ID NO: 1003579 - protein, 9 aa, Homo Sapiens
AHVPFLAST

SEQ ID NO: 1003580 - protein, 9 aa, Homo Sapiens
HERSYSCTE

SEQ ID NO: 1003581 - protein, 9 aa, Homo Sapiens
VLEMMWSEC

SEQ ID NO: 1003582 - protein, 9 aa, Homo Sapiens
EKAKSLPVQ

SEQ ID NO: 1003583 - protein, 9 aa, Homo Sapiens
APNLFLHQR

SEQ ID NO: 1003584 - protein, 9 aa, Homo Sapiens
AVAFWCDSI

SEQ ID NO: 1003585 - protein, 9 aa, Homo Sapiens
PAPPAASGD

SEQ ID NO: 1003586 - protein, 9 aa, Homo Sapiens
PPGSMDCHR

SEQ ID NO: 1003587 - protein, 9 aa, Homo Sapiens
KNPTPWLST

SEQ ID NO: 1003588 - protein, 9 aa, Homo Sapiens
VLSGSDGLD

SEQ ID NO: 1003589 - protein, 9 aa, Homo Sapiens
AEKQKCPVE

SEQ ID NO: 1003590 - protein, 9 aa, Homo Sapiens
LKKAICQII

SEQ ID NO: 1003591 - protein, 9 aa, Homo Sapiens
EMMWSECKE

SEQ ID NO: 1003592 - protein, 9 aa, Homo Sapiens
PESIPAPPP

SEQ ID NO: 1003593 - protein, 9 aa, Homo Sapiens
SLLISGTQP

SEQ ID NO: 1003594 - protein, 9 aa, Homo Sapiens
SQYTVQCPQ

SEQ ID NO: 1003595 - protein, 9 aa, Homo Sapiens
ERQQLRLWE

SEQ ID NO: 1003596 - protein, 9 aa, Homo Sapiens
TKTCHKSYA

SEQ ID NO: 1003597 - protein, 9 aa, Homo Sapiens
HNAYTEARK

SEQ ID NO: 1003598 - protein, 9 aa, Homo Sapiens
ILWLPCSHR

SEQ ID NO: 1003599 - protein, 9 aa, Homo Sapiens
DQVAKFYDH

SEQ ID NO: 1003600 - protein, 9 aa, Homo Sapiens
TLSMEENSG

SEQ ID NO: 1003601 - protein, 9 aa, Homo Sapiens
DVINSSNYR

SEQ ID NO: 1003602 - protein, 9 aa, Homo Sapiens
NSARPMLEG

SEQ ID NO: 1003603 - protein, 9 aa, Homo Sapiens
EARKAQRKQ

SEQ ID NO: 1003604 - protein, 9 aa, Homo Sapiens
LLSDRKFFK

SEQ ID NO: 1003605 - protein, 9 aa, Homo Sapiens
GQPCQIFLE

SEQ ID NO: 1003606 - protein, 9 aa, Homo Sapiens
FLLGSTLGF

SEQ ID NO: 1003607 - protein, 9 aa, Homo Sapiens
HMKFRKQQD

SEQ ID NO: 1003608 - protein, 9 aa, Homo Sapiens
PEKGRRLVE

SEQ ID NO: 1003609 - protein, 9 aa, Homo Sapiens
EIQELQVFS

SEQ ID NO: 1003610 - protein, 9 aa, Homo Sapiens
PEDELLDWA

SEQ ID NO: 1003611 - protein, 9 aa, Homo Sapiens
KNFSYPEPS

SEQ ID NO: 1003612 - protein, 9 aa, Homo Sapiens
ASEPWEDEG

SEQ ID NO: 1003613 - protein, 9 aa, Homo Sapiens
LLKAVELLG

SEQ ID NO: 1003614 - protein, 9 aa, Homo Sapiens
PEAIAYWKF

SEQ ID NO: 1003615 - protein, 9 aa, Homo Sapiens
EPWMEPLSL

SEQ ID NO: 1003616 - protein, 9 aa, Homo Sapiens
LHRHDNGNF

SEQ ID NO: 1003617 - protein, 9 aa, Homo Sapiens
KHSIEVPIL

SEQ ID NO: 1003618 - protein, 9 aa, Homo Sapiens
AGVIFSVGR

SEQ ID NO: 1003619 - protein, 9 aa, Homo Sapiens
GCQGHWSPA

SEQ ID NO: 1003620 - protein, 9 aa, Homo Sapiens
VGHVFDDFS

SEQ ID NO: 1003621 - protein, 9 aa, Homo Sapiens
WLPCSHRPA

SEQ ID NO: 1003622 - protein, 9 aa, Homo Sapiens
KAEEGSSGS

SEQ ID NO: 1003623 - protein, 9 aa, Homo Sapiens
EDMLRKHMK

SEQ ID NO: 1003624 - protein, 9 aa, Homo Sapiens
RETPVARDV

SEQ ID NO: 1003625 - protein, 9 aa, Homo Sapiens
MLQLLWLLV

SEQ ID NO: 1003626 - protein, 9 aa, Homo Sapiens
SRREKVEVN

SEQ ID NO: 1003627 - protein, 9 aa, Homo Sapiens
HHDCSHKED

SEQ ID NO: 1003628 - protein, 9 aa, Homo Sapiens
VLLGAVVVA

SEQ ID NO: 1003629 - protein, 9 aa, Homo Sapiens
KLKRVHRSL

SEQ ID NO: 1003630 - protein, 9 aa, Homo Sapiens
DRDPLRPEK

SEQ ID NO: 1003631 - protein, 9 aa, Homo Sapiens
GSEVEEISE

SEQ ID NO: 1003632 - protein, 9 aa, Homo Sapiens
KSVTVQEDL

SEQ ID NO: 1003633 - protein, 9 aa, Homo Sapiens
KSDFWDFKQ

SEQ ID NO: 1003634 - protein, 9 aa, Homo Sapiens
AKNQPGRQE

SEQ ID NO: 1003635 - protein, 9 aa, Homo Sapiens
KKAICQIIE

SEQ ID NO: 1003636 - protein, 9 aa, Homo Sapiens
LSGMLPLYG

SEQ ID NO: 1003637 - protein, 9 aa, Homo Sapiens
AMSQELLTF

SEQ ID NO: 1003638 - protein, 9 aa, Homo Sapiens
SLLFEDELV

SEQ ID NO: 1003639 - protein, 9 aa, Homo Sapiens
TTPIPEYLK

SEQ ID NO: 1003640 - protein, 9 aa, Homo Sapiens
CALEATKLF

SEQ ID NO: 1003641 - protein, 9 aa, Homo Sapiens
EVTGLQNKN

SEQ ID NO: 1003642 - protein, 9 aa, Homo Sapiens
KRSEAKKSE

SEQ ID NO: 1003643 - protein, 9 aa, Homo Sapiens
EGKGREGKR

SEQ ID NO: 1003644 - protein, 9 aa, Homo Sapiens
YRTHHNPTV

SEQ ID NO: 1003645 - protein, 9 aa, Homo Sapiens
MVVMKVNSE

SEQ ID NO: 1003646 - protein, 9 aa, Homo Sapiens
EYKLEDRSV

SEQ ID NO: 1003647 - protein, 9 aa, Homo Sapiens
SLATQPCLG

SEQ ID NO: 1003648 - protein, 9 aa, Homo Sapiens
KLEDRSVSC

SEQ ID NO: 1003649 - protein, 9 aa, Homo Sapiens
KGEILWSQE

SEQ ID NO: 1003650 - protein, 9 aa, Homo Sapiens
PEENVTDFL

SEQ ID NO: 1003651 - protein, 9 aa, Homo Sapiens
TLSKLLNPE

SEQ ID NO: 1003652 - protein, 9 aa, Homo Sapiens
IFTRPCLAL

SEQ ID NO: 1003653 - protein, 9 aa, Homo Sapiens
LNDKAEKQK

SEQ ID NO: 1003654 - protein, 9 aa, Homo Sapiens
SQQKNTSPT

SEQ ID NO: 1003655 - protein, 9 aa, Homo Sapiens
PRISWTAIT

SEQ ID NO: 1003656 - protein, 9 aa, Homo Sapiens
GELGKDVDD

SEQ ID NO: 1003657 - protein, 9 aa, Homo Sapiens
ALKNVVVVG

SEQ ID NO: 1003658 - protein, 9 aa, Homo Sapiens
QELEKDIEA

SEQ ID NO: 1003659 - protein, 9 aa, Homo Sapiens
LDYGDSVEV

SEQ ID NO: 1003660 - protein, 9 aa, Homo Sapiens
VFLHQALEL

SEQ ID NO: 1003661 - protein, 9 aa, Homo Sapiens
TFNLKHESA

SEQ ID NO: 1003662 - protein, 9 aa, Homo Sapiens
SSGRVIGGG

SEQ ID NO: 1003663 - protein, 9 aa, Homo Sapiens
GGHLCCSRC

SEQ ID NO: 1003664 - protein, 9 aa, Homo Sapiens
LTQELCERM

SEQ ID NO: 1003665 - protein, 9 aa, Homo Sapiens
RSFKDLLGK

SEQ ID NO: 1003666 - protein, 9 aa, Homo Sapiens
LRSWCRSSG

SEQ ID NO: 1003667 - protein, 9 aa, Homo Sapiens
LSYKGNIWK

SEQ ID NO: 1003668 - protein, 9 aa, Homo Sapiens
LTTFDPARG

SEQ ID NO: 1003669 - protein, 9 aa, Homo Sapiens
REKIMKLTL

SEQ ID NO: 1003670 - protein, 9 aa, Homo Sapiens
RTQVWLYEQ

SEQ ID NO: 1003671 - protein, 9 aa, Homo Sapiens
PTGDFGFFL

SEQ ID NO: 1003672 - protein, 9 aa, Homo Sapiens
SEVEEISET

SEQ ID NO: 1003673 - protein, 9 aa, Homo Sapiens
GHISGDSFS

SEQ ID NO: 1003674 - protein, 9 aa, Homo Sapiens
GPECNYLCT

SEQ ID NO: 1003675 - protein, 9 aa, Homo Sapiens
EVAREEQAT

SEQ ID NO: 1003676 - protein, 9 aa, Homo Sapiens
YKNKSDFWD

SEQ ID NO: 1003677 - protein, 9 aa, Homo Sapiens
SAESEDNGR

SEQ ID NO: 1003678 - protein, 9 aa, Homo Sapiens
GAVAKKVAG

SEQ ID NO: 1003679 - protein, 9 aa, Homo Sapiens
TGDYKVTVK

SEQ ID NO: 1003680 - protein, 9 aa, Homo Sapiens
PHEEPLCSE

SEQ ID NO: 1003681 - protein, 9 aa, Homo Sapiens
RKCNKQPCQ

SEQ ID NO: 1003682 - protein, 9 aa, Homo Sapiens
GSLSVEDKD

SEQ ID NO: 1003683 - protein, 9 aa, Homo Sapiens
PCTSSPEEN

SEQ ID NO: 1003684 - protein, 9 aa, Homo Sapiens
ANLKKIPRD

SEQ ID NO: 1003685 - protein, 9 aa, Homo Sapiens
KPPYAPPSG

SEQ ID NO: 1003686 - protein, 9 aa, Homo Sapiens
SVQGVDARS

SEQ ID NO: 1003687 - protein, 9 aa, Homo Sapiens
TDFLLFMVL

SEQ ID NO: 1003688 - protein, 9 aa, Homo Sapiens
SPMGLPPMS

SEQ ID NO: 1003689 - protein, 9 aa, Homo Sapiens
FLFVENGHS

SEQ ID NO: 1003690 - protein, 9 aa, Homo Sapiens
NILKKKGIV

SEQ ID NO: 1003691 - protein, 9 aa, Homo Sapiens
FVLEAHDQE

SEQ ID NO: 1003692 - protein, 9 aa, Homo Sapiens
PPAGNLVCH

SEQ ID NO: 1003693 - protein, 9 aa, Homo Sapiens
ASVELLSKE

SEQ ID NO: 1003694 - protein, 9 aa, Homo Sapiens
QCQNQNCSN

SEQ ID NO: 1003695 - protein, 9 aa, Homo Sapiens
RQLKRPRLV

SEQ ID NO: 1003696 - protein, 9 aa, Homo Sapiens
EKGNFSLLE

SEQ ID NO: 1003697 - protein, 9 aa, Homo Sapiens
GPPPLRLGL

SEQ ID NO: 1003698 - protein, 9 aa, Homo Sapiens
LACPFSTGL

SEQ ID NO: 1003699 - protein, 9 aa, Homo Sapiens
SRDFGNKVT

SEQ ID NO: 1003700 - protein, 9 aa, Homo Sapiens
NKTSLTEKS

SEQ ID NO: 1003701 - protein, 9 aa, Homo Sapiens
WGDPELIAA

SEQ ID NO: 1003702 - protein, 9 aa, Homo Sapiens
VMPFWAQKR

SEQ ID NO: 1003703 - protein, 9 aa, Homo Sapiens
WVVDDDHQQ

SEQ ID NO: 1003704 - protein, 9 aa, Homo Sapiens
KEVTPYRRQ

SEQ ID NO: 1003705 - protein, 9 aa, Homo Sapiens
FLHQALELD

SEQ ID NO: 1003706 - protein, 9 aa, Homo Sapiens
EDELLDWAA

SEQ ID NO: 1003707 - protein, 9 aa, Homo Sapiens
FAPQRADMK

SEQ ID NO: 1003708 - protein, 9 aa, Homo Sapiens
DVDCLESPY

SEQ ID NO: 1003709 - protein, 9 aa, Homo Sapiens
TACETCAND

SEQ ID NO: 1003710 - protein, 9 aa, Homo Sapiens
MHIKRRECA

SEQ ID NO: 1003711 - protein, 9 aa, Homo Sapiens
KRMPSIQES

SEQ ID NO: 1003712 - protein, 9 aa, Homo Sapiens
FFEADAFQD

SEQ ID NO: 1003713 - protein, 9 aa, Homo Sapiens
DYREEFRYF

SEQ ID NO: 1003714 - protein, 9 aa, Homo Sapiens
SHASSAATI

SEQ ID NO: 1003715 - protein, 9 aa, Homo Sapiens
RIAIKKIPE

SEQ ID NO: 1003716 - protein, 9 aa, Homo Sapiens
VSEIAEVEP

SEQ ID NO: 1003717 - protein, 9 aa, Homo Sapiens
EELEVKILK

SEQ ID NO: 1003718 - protein, 9 aa, Homo Sapiens
YISLHRHDN

SEQ ID NO: 1003719 - protein, 9 aa, Homo Sapiens
SCQNIFLSN

SEQ ID NO: 1003720 - protein, 9 aa, Homo Sapiens
QKNPTPWLS

SEQ ID NO: 1003721 - protein, 9 aa, Homo Sapiens
TDGSRETPV

SEQ ID NO: 1003722 - protein, 9 aa, Homo Sapiens
DPHYFVMTA

SEQ ID NO: 1003723 - protein, 9 aa, Homo Sapiens
HEKPPNPAA

SEQ ID NO: 1003724 - protein, 9 aa, Homo Sapiens
MKPRRNCAA

SEQ ID NO: 1003725 - protein, 9 aa, Homo Sapiens
RVLSGSDGL

SEQ ID NO: 1003726 - protein, 9 aa, Homo Sapiens
ANELIAIIS

SEQ ID NO: 1003727 - protein, 9 aa, Homo Sapiens
APISTVKSD

SEQ ID NO: 1003728 - protein, 9 aa, Homo Sapiens
KPFKCKDCK

SEQ ID NO: 1003729 - protein, 9 aa, Homo Sapiens
RDEPHSPNW

SEQ ID NO: 1003730 - protein, 9 aa, Homo Sapiens
LRLSRELLE

SEQ ID NO: 1003731 - protein, 9 aa, Homo Sapiens
NEVMATYIL

SEQ ID NO: 1003732 - protein, 9 aa, Homo Sapiens
VEGRKECDC

SEQ ID NO: 1003733 - protein, 9 aa, Homo Sapiens
VLYFLSQRI

SEQ ID NO: 1003734 - protein, 9 aa, Homo Sapiens
ARLDHKFNL

SEQ ID NO: 1003735 - protein, 9 aa, Homo Sapiens
CNEFFCPSW

SEQ ID NO: 1003736 - protein, 9 aa, Homo Sapiens
CSRLSLAGS

SEQ ID NO: 1003737 - protein, 9 aa, Homo Sapiens
ITHGETNGI

SEQ ID NO: 1003738 - protein, 9 aa, Homo Sapiens
TDMEIRELV

SEQ ID NO: 1003739 - protein, 9 aa, Homo Sapiens
DDYKPPYAP

SEQ ID NO: 1003740 - protein, 9 aa, Homo Sapiens
GEMWQNIIS

SEQ ID NO: 1003741 - protein, 9 aa, Homo Sapiens
SLSLQRLLV

SEQ ID NO: 1003742 - protein, 9 aa, Homo Sapiens
GSLYEYVFC

SEQ ID NO: 1003743 - protein, 9 aa, Homo Sapiens
PPLTKPGSS

SEQ ID NO: 1003744 - protein, 9 aa, Homo Sapiens
LSTEAPKPP

SEQ ID NO: 1003745 - protein, 9 aa, Homo Sapiens
LLTFKDVFV

SEQ ID NO: 1003746 - protein, 9 aa, Homo Sapiens
DCLESPYGI

SEQ ID NO: 1003747 - protein, 9 aa, Homo Sapiens
VSVDRRRAT

SEQ ID NO: 1003748 - protein, 9 aa, Homo Sapiens
ALCTGDYDR

SEQ ID NO: 1003749 - protein, 9 aa, Homo Sapiens
AHVNTLHSR

SEQ ID NO: 1003750 - protein, 9 aa, Homo Sapiens
KYCLDRGIL

SEQ ID NO: 1003751 - protein, 9 aa, Homo Sapiens
PIFLSEVTI

SEQ ID NO: 1003752 - protein, 9 aa, Homo Sapiens
KEAKHCVRI

SEQ ID NO: 1003753 - protein, 9 aa, Homo Sapiens
ARWNKTVRY

SEQ ID NO: 1003754 - protein, 9 aa, Homo Sapiens
ETVQRQKLI

SEQ ID NO: 1003755 - protein, 9 aa, Homo Sapiens
LAKRRSFKD

SEQ ID NO: 1003756 - protein, 9 aa, Homo Sapiens
VLQPNPLDL

SEQ ID NO: 1003757 - protein, 9 aa, Homo Sapiens
KEHTHNKKK

SEQ ID NO: 1003758 - protein, 9 aa, Homo Sapiens
PKEERGDQG

SEQ ID NO: 1003759 - protein, 9 aa, Homo Sapiens
AAYTSASFC

SEQ ID NO: 1003760 - protein, 9 aa, Homo Sapiens
LVSFSFNDI

SEQ ID NO: 1003761 - protein, 9 aa, Homo Sapiens
DKTSATDIK

SEQ ID NO: 1003762 - protein, 9 aa, Homo Sapiens
PGSGPGPGP

SEQ ID NO: 1003763 - protein, 9 aa, Homo Sapiens
QGHWSPARQ

SEQ ID NO: 1003764 - protein, 9 aa, Homo Sapiens
SAELEEQSN

SEQ ID NO: 1003765 - protein, 9 aa, Homo Sapiens
SEENFETIK

SEQ ID NO: 1003766 - protein, 9 aa, Homo Sapiens
EKAPLVGHV

SEQ ID NO: 1003767 - protein, 9 aa, Homo Sapiens
GEGSALLYP

SEQ ID NO: 1003768 - protein, 9 aa, Homo Sapiens
SKDHDSPEN

SEQ ID NO: 1003769 - protein, 9 aa, Homo Sapiens
NFRSLQPSP

SEQ ID NO: 1003770 - protein, 9 aa, Homo Sapiens
SKMSKSFKS

SEQ ID NO: 1003771 - protein, 9 aa, Homo Sapiens
RPRLVILDP

SEQ ID NO: 1003772 - protein, 9 aa, Homo Sapiens
VFSKAQILE

SEQ ID NO: 1003773 - protein, 9 aa, Homo Sapiens
WWYANCHAS

SEQ ID NO: 1003774 - protein, 9 aa, Homo Sapiens
VFMVAISPL

SEQ ID NO: 1003775 - protein, 9 aa, Homo Sapiens
RAPGEKGEK

SEQ ID NO: 1003776 - protein, 9 aa, Homo Sapiens
EKFKIFKHI

SEQ ID NO: 1003777 - protein, 9 aa, Homo Sapiens
FVSTTSSRK

SEQ ID NO: 1003778 - protein, 9 aa, Homo Sapiens
DEPFVLEAH

SEQ ID NO: 1003779 - protein, 9 aa, Homo Sapiens
RWNKTVRYC

SEQ ID NO: 1003780 - protein, 9 aa, Homo Sapiens
CQPLPKCPP

SEQ ID NO: 1003781 - protein, 9 aa, Homo Sapiens
VEFKGFLVL

SEQ ID NO: 1003782 - protein, 9 aa, Homo Sapiens
RLPQNSPLT

SEQ ID NO: 1003783 - protein, 9 aa, Homo Sapiens
RQLDNIVGK

SEQ ID NO: 1003784 - protein, 9 aa, Homo Sapiens
QESPKSDCN

SEQ ID NO: 1003785 - protein, 9 aa, Homo Sapiens
VIWGALSIM

SEQ ID NO: 1003786 - protein, 9 aa, Homo Sapiens
CANDNLFGP

SEQ ID NO: 1003787 - protein, 9 aa, Homo Sapiens
TFFAHFLLG

SEQ ID NO: 1003788 - protein, 9 aa, Homo Sapiens
LERLKAEEG

SEQ ID NO: 1003789 - protein, 9 aa, Homo Sapiens
PMKPRRNCA

SEQ ID NO: 1003790 - protein, 9 aa, Homo Sapiens
FSSYLAVRS

SEQ ID NO: 1003791 - protein, 9 aa, Homo Sapiens
KDFCFIFQN

SEQ ID NO: 1003792 - protein, 9 aa, Homo Sapiens
STSSKKTMN

SEQ ID NO: 1003793 - protein, 9 aa, Homo Sapiens
RFSYYNSLK

SEQ ID NO: 1003794 - protein, 9 aa, Homo Sapiens
YIFTLIGNL

SEQ ID NO: 1003795 - protein, 9 aa, Homo Sapiens
RLAEMEQKV

SEQ ID NO: 1003796 - protein, 9 aa, Homo Sapiens
SLSIPSAES

SEQ ID NO: 1003797 - protein, 9 aa, Homo Sapiens
AEIFTRPCL

SEQ ID NO: 1003798 - protein, 9 aa, Homo Sapiens
LAVERLISS

SEQ ID NO: 1003799 - protein, 9 aa, Homo Sapiens
MEENSGLSL

SEQ ID NO: 1003800 - protein, 9 aa, Homo Sapiens
VSSHMFQLY

SEQ ID NO: 1003801 - protein, 9 aa, Homo Sapiens
FFCPSWAAS

SEQ ID NO: 1003802 - protein, 9 aa, Homo Sapiens
VEKARRLQG

SEQ ID NO: 1003803 - protein, 9 aa, Homo Sapiens
ARVLSGSDG

SEQ ID NO: 1003804 - protein, 9 aa, Homo Sapiens
YKFEEEVQY

SEQ ID NO: 1003805 - protein, 9 aa, Homo Sapiens
LHHAYCFHY

SEQ ID NO: 1003806 - protein, 9 aa, Homo Sapiens
RGSLSVEDK

SEQ ID NO: 1003807 - protein, 9 aa, Homo Sapiens
HDISESKFL

SEQ ID NO: 1003808 - protein, 9 aa, Homo Sapiens
TKKKPEKKP

SEQ ID NO: 1003809 - protein, 9 aa, Homo Sapiens
AEIPLMRDC

SEQ ID NO: 1003810 - protein, 9 aa, Homo Sapiens
PSQAASALG

SEQ ID NO: 1003811 - protein, 9 aa, Homo Sapiens
YDFDKIVHE

SEQ ID NO: 1003812 - protein, 9 aa, Homo Sapiens
SMSCDLQGD

SEQ ID NO: 1003813 - protein, 9 aa, Homo Sapiens
LTQDGKEIY

SEQ ID NO: 1003814 - protein, 9 aa, Homo Sapiens
HGRLKKLNL

SEQ ID NO: 1003815 - protein, 9 aa, Homo Sapiens
ETTSEESQV

SEQ ID NO: 1003816 - protein, 9 aa, Homo Sapiens
SVSIGKWSI

SEQ ID NO: 1003817 - protein, 9 aa, Homo Sapiens
HSYCPNVIV

SEQ ID NO: 1003818 - protein, 9 aa, Homo Sapiens
AKFVEEGRK

SEQ ID NO: 1003819 - protein, 9 aa, Homo Sapiens
LSRTLSRTT

SEQ ID NO: 1003820 - protein, 9 aa, Homo Sapiens
EERQGKASE

SEQ ID NO: 1003821 - protein, 9 aa, Homo Sapiens
KSTGTPHAK

SEQ ID NO: 1003822 - protein, 9 aa, Homo Sapiens
DFGFFLRRT

SEQ ID NO: 1003823 - protein, 9 aa, Homo Sapiens
CDMKTDGGG

SEQ ID NO: 1003824 - protein, 9 aa, Homo Sapiens
ALLEPPGIL

SEQ ID NO: 1003825 - protein, 9 aa, Homo Sapiens
VGKRGRLDS

SEQ ID NO: 1003826 - protein, 9 aa, Homo Sapiens
VSIYTHLWK

SEQ ID NO: 1003827 - protein, 9 aa, Homo Sapiens
LAIKSYRKV

SEQ ID NO: 1003828 - protein, 9 aa, Homo Sapiens
DSNKTTGLY

SEQ ID NO: 1003829 - protein, 9 aa, Homo Sapiens
PEALPSPSS

SEQ ID NO: 1003830 - protein, 9 aa, Homo Sapiens
RKIHVILAW

SEQ ID NO: 1003831 - protein, 9 aa, Homo Sapiens
DSHDSISSK

SEQ ID NO: 1003832 - protein, 9 aa, Homo Sapiens
PQKGCIPLQ

SEQ ID NO: 1003833 - protein, 9 aa, Homo Sapiens
IKVRPTQDP

SEQ ID NO: 1003834 - protein, 9 aa, Homo Sapiens
EKGEKKEED

SEQ ID NO: 1003835 - protein, 9 aa, Homo Sapiens
SSKKTMNVA

SEQ ID NO: 1003836 - protein, 9 aa, Homo Sapiens
WTLELEFVG

SEQ ID NO: 1003837 - protein, 9 aa, Homo Sapiens
LVALSAESR

SEQ ID NO: 1003838 - protein, 9 aa, Homo Sapiens
SSQKSEVRS

SEQ ID NO: 1003839 - protein, 9 aa, Homo Sapiens
DVQERRAQE

SEQ ID NO: 1003840 - protein, 9 aa, Homo Sapiens
KLKGKSDRK

SEQ ID NO: 1003841 - protein, 9 aa, Homo Sapiens
CQNQNCSNS

SEQ ID NO: 1003842 - protein, 9 aa, Homo Sapiens
DVAVASLTI

SEQ ID NO: 1003843 - protein, 9 aa, Homo Sapiens
AHLRFFEAD

SEQ ID NO: 1003844 - protein, 9 aa, Homo Sapiens
LGYQNKIKW

SEQ ID NO: 1003845 - protein, 9 aa, Homo Sapiens
PPEPRGPPG

SEQ ID NO: 1003846 - protein, 9 aa, Homo Sapiens
GNRYTGKKQ

SEQ ID NO: 1003847 - protein, 9 aa, Homo Sapiens
DIKLRGAAA

SEQ ID NO: 1003848 - protein, 9 aa, Homo Sapiens
SSKIVAPRN

SEQ ID NO: 1003849 - protein, 9 aa, Homo Sapiens
VALSEVDLT

SEQ ID NO: 1003850 - protein, 9 aa, Homo Sapiens
LPQASPIFV

SEQ ID NO: 1003851 - protein, 9 aa, Homo Sapiens
SGMYSSSRY

SEQ ID NO: 1003852 - protein, 9 aa, Homo Sapiens
GDALTLQCQ

SEQ ID NO: 1003853 - protein, 9 aa, Homo Sapiens
GFLFKDEFF

SEQ ID NO: 1003854 - protein, 9 aa, Homo Sapiens
TNAFFPMCT

SEQ ID NO: 1003855 - protein, 9 aa, Homo Sapiens
LRSLGIEMP

SEQ ID NO: 1003856 - protein, 9 aa, Homo Sapiens
KKFNLTAPR

SEQ ID NO: 1003857 - protein, 9 aa, Homo Sapiens
EEEDEEGAD

SEQ ID NO: 1003858 - protein, 9 aa, Homo Sapiens
ISFVCIYRL

SEQ ID NO: 1003859 - protein, 9 aa, Homo Sapiens
GGWTCVPEY

SEQ ID NO: 1003860 - protein, 9 aa, Homo Sapiens
VLSLNHEIE

SEQ ID NO: 1003861 - protein, 9 aa, Homo Sapiens
KLHRPKLIR

SEQ ID NO: 1003862 - protein, 9 aa, Homo Sapiens
RTGRFGKEG

SEQ ID NO: 1003863 - protein, 9 aa, Homo Sapiens
DAKESNHLR

SEQ ID NO: 1003864 - protein, 9 aa, Homo Sapiens
KPEECCDLY

SEQ ID NO: 1003865 - protein, 9 aa, Homo Sapiens
SPGSSASQT

SEQ ID NO: 1003866 - protein, 9 aa, Homo Sapiens
AQITKTCHK

SEQ ID NO: 1003867 - protein, 9 aa, Homo Sapiens
FIEPRYHIR

SEQ ID NO: 1003868 - protein, 9 aa, Homo Sapiens
GNTGKSKKE

SEQ ID NO: 1003869 - protein, 9 aa, Homo Sapiens
LEGRIEDLN

SEQ ID NO: 1003870 - protein, 9 aa, Homo Sapiens
KTCAPSVSY

SEQ ID NO: 1003871 - protein, 9 aa, Homo Sapiens
VKPQRVGGS

SEQ ID NO: 1003872 - protein, 9 aa, Homo Sapiens
IGKKQELFF

SEQ ID NO: 1003873 - protein, 9 aa, Homo Sapiens
HCDSDNDCG

SEQ ID NO: 1003874 - protein, 9 aa, Homo Sapiens
RDPLRPEKG

SEQ ID NO: 1003875 - protein, 9 aa, Homo Sapiens
DSSQKSEVR

SEQ ID NO: 1003876 - protein, 9 aa, Homo Sapiens
IELLKILPE

SEQ ID NO: 1003877 - protein, 9 aa, Homo Sapiens
EPTLPSDSS

SEQ ID NO: 1003878 - protein, 9 aa, Homo Sapiens
KRNRMHNLN

SEQ ID NO: 1003879 - protein, 9 aa, Homo Sapiens
SKCDKTFQY

SEQ ID NO: 1003880 - protein, 9 aa, Homo Sapiens
ESHPDSGKQ

SEQ ID NO: 1003881 - protein, 9 aa, Homo Sapiens
APALLWRLL

SEQ ID NO: 1003882 - protein, 9 aa, Homo Sapiens
PRGGSPVQY

SEQ ID NO: 1003883 - protein, 9 aa, Homo Sapiens
NQYVNKRYP

SEQ ID NO: 1003884 - protein, 9 aa, Homo Sapiens
GTWTLELEF

SEQ ID NO: 1003885 - protein, 9 aa, Homo Sapiens
LSEEPFNIW

SEQ ID NO: 1003886 - protein, 9 aa, Homo Sapiens
NFETIKLIS

SEQ ID NO: 1003887 - protein, 9 aa, Homo Sapiens
KPHEEPLCS

SEQ ID NO: 1003888 - protein, 9 aa, Homo Sapiens
NRTMRLVFK

SEQ ID NO: 1003889 - protein, 9 aa, Homo Sapiens
PSTHLIKVR

SEQ ID NO: 1003890 - protein, 9 aa, Homo Sapiens
QRQKLIASL

SEQ ID NO: 1003891 - protein, 9 aa, Homo Sapiens
LTGPLKTPI

SEQ ID NO: 1003892 - protein, 9 aa, Homo Sapiens
RTVFVSINI

SEQ ID NO: 1003893 - protein, 9 aa, Homo Sapiens
IVVNQDPMT

SEQ ID NO: 1003894 - protein, 9 aa, Homo Sapiens
TLGVNSCTA

SEQ ID NO: 1003895 - protein, 9 aa, Homo Sapiens
LFTVWKHFS

SEQ ID NO: 1003896 - protein, 9 aa, Homo Sapiens
FCPNNVQIS

SEQ ID NO: 1003897 - protein, 9 aa, Homo Sapiens
FAIEGYGIR

SEQ ID NO: 1003898 - protein, 9 aa, Homo Sapiens
HISPAQGSS

SEQ ID NO: 1003899 - protein, 9 aa, Homo Sapiens
PGLSRSWDG

SEQ ID NO: 1003900 - protein, 9 aa, Homo Sapiens
NQVRIAIKK

SEQ ID NO: 1003901 - protein, 9 aa, Homo Sapiens
CPEIKTSDH

SEQ ID NO: 1003902 - protein, 9 aa, Homo Sapiens
QEAARGQVC

SEQ ID NO: 1003903 - protein, 9 aa, Homo Sapiens
SSHGQHESG

SEQ ID NO: 1003904 - protein, 9 aa, Homo Sapiens
SSASQTGVP

SEQ ID NO: 1003905 - protein, 9 aa, Homo Sapiens
MLKAEKTCA

SEQ ID NO: 1003906 - protein, 9 aa, Homo Sapiens
KAPLVGHVY

SEQ ID NO: 1003907 - protein, 9 aa, Homo Sapiens
SAEVCASDS

SEQ ID NO: 1003908 - protein, 9 aa, Homo Sapiens
LNAMDSNLD

SEQ ID NO: 1003909 - protein, 9 aa, Homo Sapiens
PDWFSFLCV

SEQ ID NO: 1003910 - protein, 9 aa, Homo Sapiens
LSTTPVNTS

SEQ ID NO: 1003911 - protein, 9 aa, Homo Sapiens
ANPLRQSCI

SEQ ID NO: 1003912 - protein, 9 aa, Homo Sapiens
MNCSIAVCQ

SEQ ID NO: 1003913 - protein, 9 aa, Homo Sapiens
VVMKVNSEF

SEQ ID NO: 1003914 - protein, 9 aa, Homo Sapiens
KQQETIDKL

SEQ ID NO: 1003915 - protein, 9 aa, Homo Sapiens
HWSPARQRA

SEQ ID NO: 1003916 - protein, 9 aa, Homo Sapiens
AYWKFTSAS

SEQ ID NO: 1003917 - protein, 9 aa, Homo Sapiens
LYDFNQCEK

SEQ ID NO: 1003918 - protein, 9 aa, Homo Sapiens
SQCDKVFRF

SEQ ID NO: 1003919 - protein, 9 aa, Homo Sapiens
LTNNSGTSK

SEQ ID NO: 1003920 - protein, 9 aa, Homo Sapiens
HESGTSCSS

SEQ ID NO: 1003921 - protein, 9 aa, Homo Sapiens
EDEGEEDFD

SEQ ID NO: 1003922 - protein, 9 aa, Homo Sapiens
CKKGSIGFK

SEQ ID NO: 1003923 - protein, 9 aa, Homo Sapiens
TLCKPVLTY

SEQ ID NO: 1003924 - protein, 9 aa, Homo Sapiens
VTALVDMYS

SEQ ID NO: 1003925 - protein, 9 aa, Homo Sapiens
PSEYKLEDR

SEQ ID NO: 1003926 - protein, 9 aa, Homo Sapiens
FCGNYITFW

SEQ ID NO: 1003927 - protein, 9 aa, Homo Sapiens
SLNHEIEEC

SEQ ID NO: 1003928 - protein, 9 aa, Homo Sapiens
EISLPVTTK

SEQ ID NO: 1003929 - protein, 9 aa, Homo Sapiens
HGDLVFLHQ

SEQ ID NO: 1003930 - protein, 9 aa, Homo Sapiens
NAMDSNLDN

SEQ ID NO: 1003931 - protein, 9 aa, Homo Sapiens
NDYREEFRY

SEQ ID NO: 1003932 - protein, 9 aa, Homo Sapiens
SCMPRWQTC

SEQ ID NO: 1003933 - protein, 9 aa, Homo Sapiens
QEHGPEKKI

SEQ ID NO: 1003934 - protein, 9 aa, Homo Sapiens
DRSVSCLKP

SEQ ID NO: 1003935 - protein, 9 aa, Homo Sapiens
ENFETIKLI

SEQ ID NO: 1003936 - protein, 9 aa, Homo Sapiens
TSNGISSSS

SEQ ID NO: 1003937 - protein, 9 aa, Homo Sapiens
KFYDHLEFD

SEQ ID NO: 1003938 - protein, 9 aa, Homo Sapiens
LAKIRLNPE

SEQ ID NO: 1003939 - protein, 9 aa, Homo Sapiens
EFEVLEYWM

SEQ ID NO: 1003940 - protein, 9 aa, Homo Sapiens
VQEDLCVSV

SEQ ID NO: 1003941 - protein, 9 aa, Homo Sapiens
QNRSRTQVW

SEQ ID NO: 1003942 - protein, 9 aa, Homo Sapiens
ALALLGGEP

SEQ ID NO: 1003943 - protein, 9 aa, Homo Sapiens
FSSSSGRVI

SEQ ID NO: 1003944 - protein, 9 aa, Homo Sapiens
KKEDSGSNF

SEQ ID NO: 1003945 - protein, 9 aa, Homo Sapiens
KLQDSGKAE

SEQ ID NO: 1003946 - protein, 9 aa, Homo Sapiens
PTQRCMGYC

SEQ ID NO: 1003947 - protein, 9 aa, Homo Sapiens
LFSCKTDLI

SEQ ID NO: 1003948 - protein, 9 aa, Homo Sapiens
WPLLMLQLL

SEQ ID NO: 1003949 - protein, 9 aa, Homo Sapiens
QNLPLSFGK

SEQ ID NO: 1003950 - protein, 9 aa, Homo Sapiens
VLNFESGHN

SEQ ID NO: 1003951 - protein, 9 aa, Homo Sapiens
QRGQTEKAD

SEQ ID NO: 1003952 - protein, 9 aa, Homo Sapiens
EVQKKIVTE

SEQ ID NO: 1003953 - protein, 9 aa, Homo Sapiens
TEDDADHEA

SEQ ID NO: 1003954 - protein, 9 aa, Homo Sapiens
VSMGSKARK

SEQ ID NO: 1003955 - protein, 9 aa, Homo Sapiens
NGSLVEFYR

SEQ ID NO: 1003956 - protein, 9 aa, Homo Sapiens
ECSECEKLF

SEQ ID NO: 1003957 - protein, 9 aa, Homo Sapiens
NKPKNCYAN

SEQ ID NO: 1003958 - protein, 9 aa, Homo Sapiens
FVCIYRLTC

SEQ ID NO: 1003959 - protein, 9 aa, Homo Sapiens
SCSQLDTGV

SEQ ID NO: 1003960 - protein, 9 aa, Homo Sapiens
RTKRDPKED

SEQ ID NO: 1003961 - protein, 9 aa, Homo Sapiens
VQFQAECEC

SEQ ID NO: 1003962 - protein, 9 aa, Homo Sapiens
LFPSIEVGP

SEQ ID NO: 1003963 - protein, 9 aa, Homo Sapiens
KDFTPATCL

SEQ ID NO: 1003964 - protein, 9 aa, Homo Sapiens
LFRNILKKK

SEQ ID NO: 1003965 - protein, 9 aa, Homo Sapiens
LASGQWGLP

SEQ ID NO: 1003966 - protein, 9 aa, Homo Sapiens
YLRWGDPEL

SEQ ID NO: 1003967 - protein, 9 aa, Homo Sapiens
GSTKVSFAH

SEQ ID NO: 1003968 - protein, 9 aa, Homo Sapiens
KVTYDFDKI

SEQ ID NO: 1003969 - protein, 9 aa, Homo Sapiens
TVPEVQKKI

SEQ ID NO: 1003970 - protein, 9 aa, Homo Sapiens
GYGIRLPQN

SEQ ID NO: 1003971 - protein, 9 aa, Homo Sapiens
LPLVTGKFL

SEQ ID NO: 1003972 - protein, 9 aa, Homo Sapiens
GCALEATKL

SEQ ID NO: 1003973 - protein, 9 aa, Homo Sapiens
FYDKPSLSV

SEQ ID NO: 1003974 - protein, 9 aa, Homo Sapiens
TSILSLLKY

SEQ ID NO: 1003975 - protein, 9 aa, Homo Sapiens
KTEKSPPPM

SEQ ID NO: 1003976 - protein, 9 aa, Homo Sapiens
PLVKQTKME

SEQ ID NO: 1003977 - protein, 9 aa, Homo Sapiens
EEEVAREEQ

SEQ ID NO: 1003978 - protein, 9 aa, Homo Sapiens
KIVHELFGN

SEQ ID NO: 1003979 - protein, 9 aa, Homo Sapiens
YGSDKFERS

SEQ ID NO: 1003980 - protein, 9 aa, Homo Sapiens
SLYQKHQRA

SEQ ID NO: 1003981 - protein, 9 aa, Homo Sapiens
GGTGGAVSK

SEQ ID NO: 1003982 - protein, 9 aa, Homo Sapiens
HHSKMSKSF

SEQ ID NO: 1003983 - protein, 9 aa, Homo Sapiens
IYVFPVNTV

SEQ ID NO: 1003984 - protein, 9 aa, Homo Sapiens
TPSPYELSY

SEQ ID NO: 1003985 - protein, 9 aa, Homo Sapiens
EDEEGADAV

SEQ ID NO: 1003986 - protein, 9 aa, Homo Sapiens
KKVTPFSMS

SEQ ID NO: 1003987 - protein, 9 aa, Homo Sapiens
FLSIAPVIV

SEQ ID NO: 1003988 - protein, 9 aa, Homo Sapiens
DRPRQRASQ

SEQ ID NO: 1003989 - protein, 9 aa, Homo Sapiens
EDRSVSCLK

SEQ ID NO: 1003990 - protein, 9 aa, Homo Sapiens
SQPSPPGGS

SEQ ID NO: 1003991 - protein, 9 aa, Homo Sapiens
VVAACVLIL

SEQ ID NO: 1003992 - protein, 9 aa, Homo Sapiens
SIDCAEGRA

SEQ ID NO: 1003993 - protein, 9 aa, Homo Sapiens
NFDRFSRHD

SEQ ID NO: 1003994 - protein, 9 aa, Homo Sapiens
TSPSFPDLS

SEQ ID NO: 1003995 - protein, 9 aa, Homo Sapiens
SFIKMLKKN

SEQ ID NO: 1003996 - protein, 9 aa, Homo Sapiens
EKTRTGGLR

SEQ ID NO: 1003997 - protein, 9 aa, Homo Sapiens
EDNVNMAIR

SEQ ID NO: 1003998 - protein, 9 aa, Homo Sapiens
SKRPCGRSS

SEQ ID NO: 1003999 - protein, 9 aa, Homo Sapiens
TKKNTLSKS

SEQ ID NO: 1004000 - protein, 9 aa, Homo Sapiens
GDYISKLSK

SEQ ID NO: 1004001 - protein, 9 aa, Homo Sapiens
LEQSLRDVV

SEQ ID NO: 1004002 - protein, 9 aa, Homo Sapiens
SCLFCTKVH

SEQ ID NO: 1004003 - protein, 9 aa, Homo Sapiens
SDVFNDPTT

SEQ ID NO: 1004004 - protein, 9 aa, Homo Sapiens
LFAVNMNRD

SEQ ID NO: 1004005 - protein, 9 aa, Homo Sapiens
DFKNNYTCR

SEQ ID NO: 1004006 - protein, 9 aa, Homo Sapiens
SGRCVRLTG

SEQ ID NO: 1004007 - protein, 9 aa, Homo Sapiens
AVTLSWELQ

SEQ ID NO: 1004008 - protein, 9 aa, Homo Sapiens
LKSINKGQV

SEQ ID NO: 1004009 - protein, 9 aa, Homo Sapiens
VGQKVEGMN

SEQ ID NO: 1004010 - protein, 9 aa, Homo Sapiens
KINQTILKK

SEQ ID NO: 1004011 - protein, 9 aa, Homo Sapiens
SQVQELERA

SEQ ID NO: 1004012 - protein, 9 aa, Homo Sapiens
CVLYMENDF

SEQ ID NO: 1004013 - protein, 9 aa, Homo Sapiens
VLNKKYESY

SEQ ID NO: 1004014 - protein, 9 aa, Homo Sapiens
IIMLWMIAS

SEQ ID NO: 1004015 - protein, 9 aa, Homo Sapiens
PSSTRVGGD

SEQ ID NO: 1004016 - protein, 9 aa, Homo Sapiens
QTLAVDYRS

SEQ ID NO: 1004017 - protein, 9 aa, Homo Sapiens
PRVKVGNKF

SEQ ID NO: 1004018 - protein, 9 aa, Homo Sapiens
NCGRVNSSE

SEQ ID NO: 1004019 - protein, 9 aa, Homo Sapiens
EDFSWSGKV

SEQ ID NO: 1004020 - protein, 9 aa, Homo Sapiens
PCLTFFIAV

SEQ ID NO: 1004021 - protein, 9 aa, Homo Sapiens
VHVQTNMPS

SEQ ID NO: 1004022 - protein, 9 aa, Homo Sapiens
FVRSFFVGE

SEQ ID NO: 1004023 - protein, 9 aa, Homo Sapiens
CASPQFDGP

SEQ ID NO: 1004024 - protein, 9 aa, Homo Sapiens
LAPARTNRG

SEQ ID NO: 1004025 - protein, 9 aa, Homo Sapiens
FHSLRLVRD

SEQ ID NO: 1004026 - protein, 9 aa, Homo Sapiens
PVLIGNHAQ

SEQ ID NO: 1004027 - protein, 9 aa, Homo Sapiens
LCQSSASPK

SEQ ID NO: 1004028 - protein, 9 aa, Homo Sapiens
EEEYRHISG

SEQ ID NO: 1004029 - protein, 9 aa, Homo Sapiens
LLLLYPGLA

SEQ ID NO: 1004030 - protein, 9 aa, Homo Sapiens
TYVFCVERE

SEQ ID NO: 1004031 - protein, 9 aa, Homo Sapiens
VHSLLKFAF

SEQ ID NO: 1004032 - protein, 9 aa, Homo Sapiens
PAGLPGFKD

SEQ ID NO: 1004033 - protein, 9 aa, Homo Sapiens
WNLGETVKL

SEQ ID NO: 1004034 - protein, 9 aa, Homo Sapiens
PTVVNPELF

SEQ ID NO: 1004035 - protein, 9 aa, Homo Sapiens
GDSEDKRGP

SEQ ID NO: 1004036 - protein, 9 aa, Homo Sapiens
LAGVRAAAG

SEQ ID NO: 1004037 - protein, 9 aa, Homo Sapiens
LTGLGHKSD

SEQ ID NO: 1004038 - protein, 9 aa, Homo Sapiens
SASPPSPPS

SEQ ID NO: 1004039 - protein, 9 aa, Homo Sapiens
RCHYSRDVQ

SEQ ID NO: 1004040 - protein, 9 aa, Homo Sapiens
SCCNSNLQD

SEQ ID NO: 1004041 - protein, 9 aa, Homo Sapiens
VLWAEGLPR

SEQ ID NO: 1004042 - protein, 9 aa, Homo Sapiens
RFPASYYHA

SEQ ID NO: 1004043 - protein, 9 aa, Homo Sapiens
ILVLILFFL

SEQ ID NO: 1004044 - protein, 9 aa, Homo Sapiens
PHARNGLLL

SEQ ID NO: 1004045 - protein, 9 aa, Homo Sapiens
KHLRVLLDN

SEQ ID NO: 1004046 - protein, 9 aa, Homo Sapiens
SVQTWIKTP

SEQ ID NO: 1004047 - protein, 9 aa, Homo Sapiens
PDPCCLLTN

SEQ ID NO: 1004048 - protein, 9 aa, Homo Sapiens
QHPAGPPGE

SEQ ID NO: 1004049 - protein, 9 aa, Homo Sapiens
GRMHKEKVD

SEQ ID NO: 1004050 - protein, 9 aa, Homo Sapiens
RSVNLLKTI

SEQ ID NO: 1004051 - protein, 9 aa, Homo Sapiens
ICNSLRYPT

SEQ ID NO: 1004052 - protein, 9 aa, Homo Sapiens
TEKGMKTLT

SEQ ID NO: 1004053 - protein, 9 aa, Homo Sapiens
RNSMKECRE

SEQ ID NO: 1004054 - protein, 9 aa, Homo Sapiens
FFYAAVHTG

SEQ ID NO: 1004055 - protein, 9 aa, Homo Sapiens
FIFLVYQLT

SEQ ID NO: 1004056 - protein, 9 aa, Homo Sapiens
ADETELRGT

SEQ ID NO: 1004057 - protein, 9 aa, Homo Sapiens
PDLKSSSSR

SEQ ID NO: 1004058 - protein, 9 aa, Homo Sapiens
LSERSTSSI

SEQ ID NO: 1004059 - protein, 9 aa, Homo Sapiens
QDDIQNCAT

SEQ ID NO: 1004060 - protein, 9 aa, Homo Sapiens
LGLIFDHED

SEQ ID NO: 1004061 - protein, 9 aa, Homo Sapiens
VPVGQKVEG

SEQ ID NO: 1004062 - protein, 9 aa, Homo Sapiens
PCRDRVVEK

SEQ ID NO: 1004063 - protein, 9 aa, Homo Sapiens
HKGYRKLVK

SEQ ID NO: 1004064 - protein, 9 aa, Homo Sapiens
VDYRSYIRL

SEQ ID NO: 1004065 - protein, 9 aa, Homo Sapiens
KTIKNKANF

SEQ ID NO: 1004066 - protein, 9 aa, Homo Sapiens
TWLSCFFYA

SEQ ID NO: 1004067 - protein, 9 aa, Homo Sapiens
KNCSSPAPR

SEQ ID NO: 1004068 - protein, 9 aa, Homo Sapiens
PQGENQSQG

SEQ ID NO: 1004069 - protein, 9 aa, Homo Sapiens
LTMDTEILN

SEQ ID NO: 1004070 - protein, 9 aa, Homo Sapiens
GVGAAAGAI

SEQ ID NO: 1004071 - protein, 9 aa, Homo Sapiens
GNFRRKRKH

SEQ ID NO: 1004072 - protein, 9 aa, Homo Sapiens
PPPSRSRGR

SEQ ID NO: 1004073 - protein, 9 aa, Homo Sapiens
SLDPDPCCL

SEQ ID NO: 1004074 - protein, 9 aa, Homo Sapiens
ASKENEAGQ

SEQ ID NO: 1004075 - protein, 9 aa, Homo Sapiens
FCDISPLLL

SEQ ID NO: 1004076 - protein, 9 aa, Homo Sapiens
KAKISSARS

SEQ ID NO: 1004077 - protein, 9 aa, Homo Sapiens
PFLELSDSD

SEQ ID NO: 1004078 - protein, 9 aa, Homo Sapiens
PQIFSSSYY

SEQ ID NO: 1004079 - protein, 9 aa, Homo Sapiens
HLYLRGQRN

SEQ ID NO: 1004080 - protein, 9 aa, Homo Sapiens
NLMRISGSS

SEQ ID NO: 1004081 - protein, 9 aa, Homo Sapiens
NECNVHKES

SEQ ID NO: 1004082 - protein, 9 aa, Homo Sapiens
LIAREINNV

SEQ ID NO: 1004083 - protein, 9 aa, Homo Sapiens
TKQKIFQVE

SEQ ID NO: 1004084 - protein, 9 aa, Homo Sapiens
MSVFDAYMK

SEQ ID NO: 1004085 - protein, 9 aa, Homo Sapiens
VSSSFNDIS

SEQ ID NO: 1004086 - protein, 9 aa, Homo Sapiens
FFEECITNP

SEQ ID NO: 1004087 - protein, 9 aa, Homo Sapiens
ELQILGKTL

SEQ ID NO: 1004088 - protein, 9 aa, Homo Sapiens
GLRFDNLRG

SEQ ID NO: 1004089 - protein, 9 aa, Homo Sapiens
LAWGDEEDS

SEQ ID NO: 1004090 - protein, 9 aa, Homo Sapiens
VEQWKTNKA

SEQ ID NO: 1004091 - protein, 9 aa, Homo Sapiens
DSQPAVRRA

SEQ ID NO: 1004092 - protein, 9 aa, Homo Sapiens
TGASGGPTV

SEQ ID NO: 1004093 - protein, 9 aa, Homo Sapiens
DNGDDGLIS

SEQ ID NO: 1004094 - protein, 9 aa, Homo Sapiens
KGPGPSLSP

SEQ ID NO: 1004095 - protein, 9 aa, Homo Sapiens
ANPGSEFVY

SEQ ID NO: 1004096 - protein, 9 aa, Homo Sapiens
VELDLTENA

SEQ ID NO: 1004097 - protein, 9 aa, Homo Sapiens
LSSPKATHR

SEQ ID NO: 1004098 - protein, 9 aa, Homo Sapiens
LNKHLQKTN

SEQ ID NO: 1004099 - protein, 9 aa, Homo Sapiens
NSVKYKCEQ

SEQ ID NO: 1004100 - protein, 9 aa, Homo Sapiens
FFREKKEQR

SEQ ID NO: 1004101 - protein, 9 aa, Homo Sapiens
FLSHAHAPG

SEQ ID NO: 1004102 - protein, 9 aa, Homo Sapiens
EFHYDKEKL

SEQ ID NO: 1004103 - protein, 9 aa, Homo Sapiens
EQILNNFSQ

SEQ ID NO: 1004104 - protein, 9 aa, Homo Sapiens
DEVILSAYI

SEQ ID NO: 1004105 - protein, 9 aa, Homo Sapiens
PTVLFFVES

SEQ ID NO: 1004106 - protein, 9 aa, Homo Sapiens
TSPLFSPPP

SEQ ID NO: 1004107 - protein, 9 aa, Homo Sapiens
KTIQTDYIV

SEQ ID NO: 1004108 - protein, 9 aa, Homo Sapiens
MLRGIASGI

SEQ ID NO: 1004109 - protein, 9 aa, Homo Sapiens
WFYMQIAPM

SEQ ID NO: 1004110 - protein, 9 aa, Homo Sapiens
AYLTLACCS

SEQ ID NO: 1004111 - protein, 9 aa, Homo Sapiens
LQEVSSASS

SEQ ID NO: 1004112 - protein, 9 aa, Homo Sapiens
SLAAKESSL

SEQ ID NO: 1004113 - protein, 9 aa, Homo Sapiens
TDKFFTYDF

SEQ ID NO: 1004114 - protein, 9 aa, Homo Sapiens
EQEEQGKIS

SEQ ID NO: 1004115 - protein, 9 aa, Homo Sapiens
VAVLSRSNP

SEQ ID NO: 1004116 - protein, 9 aa, Homo Sapiens
RQAFLEQAN

SEQ ID NO: 1004117 - protein, 9 aa, Homo Sapiens
VTLETPCEN

SEQ ID NO: 1004118 - protein, 9 aa, Homo Sapiens
PLGQQRPHP

SEQ ID NO: 1004119 - protein, 9 aa, Homo Sapiens
QRQAFLEQA

SEQ ID NO: 1004120 - protein, 9 aa, Homo Sapiens
TKKDNAALA

SEQ ID NO: 1004121 - protein, 9 aa, Homo Sapiens
IYFATLIII

SEQ ID NO: 1004122 - protein, 9 aa, Homo Sapiens
SNESPEESS

SEQ ID NO: 1004123 - protein, 9 aa, Homo Sapiens
VVAAFCCTI

SEQ ID NO: 1004124 - protein, 9 aa, Homo Sapiens
SVDILDPRA

SEQ ID NO: 1004125 - protein, 9 aa, Homo Sapiens
IFSDHGMTN

SEQ ID NO: 1004126 - protein, 9 aa, Homo Sapiens
LTLEGPSQQ

SEQ ID NO: 1004127 - protein, 9 aa, Homo Sapiens
DDLPWDDNE

SEQ ID NO: 1004128 - protein, 9 aa, Homo Sapiens
SGAPEAKGP

SEQ ID NO: 1004129 - protein, 9 aa, Homo Sapiens
ARWLQRVSF

SEQ ID NO: 1004130 - protein, 9 aa, Homo Sapiens
DVKGERWTS

SEQ ID NO: 1004131 - protein, 9 aa, Homo Sapiens
TFVRSIELM

SEQ ID NO: 1004132 - protein, 9 aa, Homo Sapiens
PLLQEVSSA

SEQ ID NO: 1004133 - protein, 9 aa, Homo Sapiens
KWTLRDDLV

SEQ ID NO: 1004134 - protein, 9 aa, Homo Sapiens
SLSPVCSRL

SEQ ID NO: 1004135 - protein, 9 aa, Homo Sapiens
EYVIGTLEL

SEQ ID NO: 1004136 - protein, 9 aa, Homo Sapiens
GANERSFDS

SEQ ID NO: 1004137 - protein, 9 aa, Homo Sapiens
GLCEVPRNL

SEQ ID NO: 1004138 - protein, 9 aa, Homo Sapiens
EYHNSEQKR

SEQ ID NO: 1004139 - protein, 9 aa, Homo Sapiens
DEMRTRALR

SEQ ID NO: 1004140 - protein, 9 aa, Homo Sapiens
RAQLEQSLR

SEQ ID NO: 1004141 - protein, 9 aa, Homo Sapiens
HPQKLFYTV

SEQ ID NO: 1004142 - protein, 9 aa, Homo Sapiens
LNFWNFNSN

SEQ ID NO: 1004143 - protein, 9 aa, Homo Sapiens
NLCRMSCQN

SEQ ID NO: 1004144 - protein, 9 aa, Homo Sapiens
LEGESPSLP

SEQ ID NO: 1004145 - protein, 9 aa, Homo Sapiens
LSPSLPHQA

SEQ ID NO: 1004146 - protein, 9 aa, Homo Sapiens
IKFSPDGSY

SEQ ID NO: 1004147 - protein, 9 aa, Homo Sapiens
GSLALTSLE

SEQ ID NO: 1004148 - protein, 9 aa, Homo Sapiens
PHVVSITMS

SEQ ID NO: 1004149 - protein, 9 aa, Homo Sapiens
WEPQNKLWI

SEQ ID NO: 1004150 - protein, 9 aa, Homo Sapiens
ISSNSSASL

SEQ ID NO: 1004151 - protein, 9 aa, Homo Sapiens
TDEAAIENI

SEQ ID NO: 1004152 - protein, 9 aa, Homo Sapiens
KKIIGTDVS

SEQ ID NO: 1004153 - protein, 9 aa, Homo Sapiens
LEIKKQLQA

SEQ ID NO: 1004154 - protein, 9 aa, Homo Sapiens
FLELPKFLQ

SEQ ID NO: 1004155 - protein, 9 aa, Homo Sapiens
TLEGPSQQG

SEQ ID NO: 1004156 - protein, 9 aa, Homo Sapiens
KKEQRGTFN

SEQ ID NO: 1004157 - protein, 9 aa, Homo Sapiens
HTKCPQNVD

SEQ ID NO: 1004158 - protein, 9 aa, Homo Sapiens
AFLCTKLVF

SEQ ID NO: 1004159 - protein, 9 aa, Homo Sapiens
CPPSPPLVI

SEQ ID NO: 1004160 - protein, 9 aa, Homo Sapiens
KMGKETFKN

SEQ ID NO: 1004161 - protein, 9 aa, Homo Sapiens
YSVPSFSEC

SEQ ID NO: 1004162 - protein, 9 aa, Homo Sapiens
IYTGQKPYK

SEQ ID NO: 1004163 - protein, 9 aa, Homo Sapiens
PLSHPSPYM

SEQ ID NO: 1004164 - protein, 9 aa, Homo Sapiens
ATEDQLSKR

SEQ ID NO: 1004165 - protein, 9 aa, Homo Sapiens
SKDTRHQRK

SEQ ID NO: 1004166 - protein, 9 aa, Homo Sapiens
KECGRAFKY

SEQ ID NO: 1004167 - protein, 9 aa, Homo Sapiens
EEYEKLRDI

SEQ ID NO: 1004168 - protein, 9 aa, Homo Sapiens
LILFFLNDA

SEQ ID NO: 1004169 - protein, 9 aa, Homo Sapiens
LSDVFNDPT

SEQ ID NO: 1004170 - protein, 9 aa, Homo Sapiens
IENSSNNSS

SEQ ID NO: 1004171 - protein, 9 aa, Homo Sapiens
YGGYASSDG

SEQ ID NO: 1004172 - protein, 9 aa, Homo Sapiens
TELKHGDQK

SEQ ID NO: 1004173 - protein, 9 aa, Homo Sapiens
NYGGYASSD

SEQ ID NO: 1004174 - protein, 9 aa, Homo Sapiens
LAREAGEDI

SEQ ID NO: 1004175 - protein, 9 aa, Homo Sapiens
YKHNRTELT

SEQ ID NO: 1004176 - protein, 9 aa, Homo Sapiens
VVNEGMLTE

SEQ ID NO: 1004177 - protein, 9 aa, Homo Sapiens
VLDKYMKNS

SEQ ID NO: 1004178 - protein, 9 aa, Homo Sapiens
GSFPTFQFQ

SEQ ID NO: 1004179 - protein, 9 aa, Homo Sapiens
AEERRLSWE

SEQ ID NO: 1004180 - protein, 9 aa, Homo Sapiens
RQFYGLLVK

SEQ ID NO: 1004181 - protein, 9 aa, Homo Sapiens
NAVVSFGKV

SEQ ID NO: 1004182 - protein, 9 aa, Homo Sapiens
RKNSYQCEE

SEQ ID NO: 1004183 - protein, 9 aa, Homo Sapiens
ALLADCAHA

SEQ ID NO: 1004184 - protein, 9 aa, Homo Sapiens
DPECSWGQG

SEQ ID NO: 1004185 - protein, 9 aa, Homo Sapiens
NKIVNEKSS

SEQ ID NO: 1004186 - protein, 9 aa, Homo Sapiens
SGFSRDSLI

SEQ ID NO: 1004187 - protein, 9 aa, Homo Sapiens
GSKQGSLTV

SEQ ID NO: 1004188 - protein, 9 aa, Homo Sapiens
PGMMLWRYS

SEQ ID NO: 1004189 - protein, 9 aa, Homo Sapiens
ALSFPHLYL

SEQ ID NO: 1004190 - protein, 9 aa, Homo Sapiens
DLMEVEFMS

SEQ ID NO: 1004191 - protein, 9 aa, Homo Sapiens
KFYTSLSRM

SEQ ID NO: 1004192 - protein, 9 aa, Homo Sapiens
CVLVFLLSI

SEQ ID NO: 1004193 - protein, 9 aa, Homo Sapiens
CILNMLKNF

SEQ ID NO: 1004194 - protein, 9 aa, Homo Sapiens
DPTVLFFVE

SEQ ID NO: 1004195 - protein, 9 aa, Homo Sapiens
SQRAIFFAG

SEQ ID NO: 1004196 - protein, 9 aa, Homo Sapiens
YLVCVDVDI

SEQ ID NO: 1004197 - protein, 9 aa, Homo Sapiens
WSTGKTERA

SEQ ID NO: 1004198 - protein, 9 aa, Homo Sapiens
FSCCNSNLQ

SEQ ID NO: 1004199 - protein, 9 aa, Homo Sapiens
SEDKRIFLA

SEQ ID NO: 1004200 - protein, 9 aa, Homo Sapiens
LTVASGENV

SEQ ID NO: 1004201 - protein, 9 aa, Homo Sapiens
KNSVLHCIN

SEQ ID NO: 1004202 - protein, 9 aa, Homo Sapiens
LWNFPPDSR

SEQ ID NO: 1004203 - protein, 9 aa, Homo Sapiens
GNKFVTKGQ

SEQ ID NO: 1004204 - protein, 9 aa, Homo Sapiens
VTPPGVAAL

SEQ ID NO: 1004205 - protein, 9 aa, Homo Sapiens
SSRSRSPSL

SEQ ID NO: 1004206 - protein, 9 aa, Homo Sapiens
IAVILENFI

SEQ ID NO: 1004207 - protein, 9 aa, Homo Sapiens
SIFVNGKKM

SEQ ID NO: 1004208 - protein, 9 aa, Homo Sapiens
AHEVRIKMM

SEQ ID NO: 1004209 - protein, 9 aa, Homo Sapiens
RVLRNFFDS

SEQ ID NO: 1004210 - protein, 9 aa, Homo Sapiens
CSDFAVSGQ

SEQ ID NO: 1004211 - protein, 9 aa, Homo Sapiens
RLQLNKDNK

SEQ ID NO: 1004212 - protein, 9 aa, Homo Sapiens
LRNPVAIVH

SEQ ID NO: 1004213 - protein, 9 aa, Homo Sapiens
ALIWRPGTE

SEQ ID NO: 1004214 - protein, 9 aa, Homo Sapiens
VLVFLLSIV

SEQ ID NO: 1004215 - protein, 9 aa, Homo Sapiens
RVLYTHSQT

SEQ ID NO: 1004216 - protein, 9 aa, Homo Sapiens
MIILVVICA

SEQ ID NO: 1004217 - protein, 9 aa, Homo Sapiens
RVLEKRPTR

SEQ ID NO: 1004218 - protein, 9 aa, Homo Sapiens
ECIVLAAIA

SEQ ID NO: 1004219 - protein, 9 aa, Homo Sapiens
PEPETSPSF

SEQ ID NO: 1004220 - protein, 9 aa, Homo Sapiens
VDENRNAVI

SEQ ID NO: 1004221 - protein, 9 aa, Homo Sapiens
VMSYNRYLA

SEQ ID NO: 1004222 - protein, 9 aa, Homo Sapiens
ASYYFLLDL

SEQ ID NO: 1004223 - protein, 9 aa, Homo Sapiens
DFTPTSRKK

SEQ ID NO: 1004224 - protein, 9 aa, Homo Sapiens
NNHDQHCRK

SEQ ID NO: 1004225 - protein, 9 aa, Homo Sapiens
SCKAPSVYP

SEQ ID NO: 1004226 - protein, 9 aa, Homo Sapiens
SPSSFFRAQ

SEQ ID NO: 1004227 - protein, 9 aa, Homo Sapiens
SGAWALSCF

SEQ ID NO: 1004228 - protein, 9 aa, Homo Sapiens
QVKDHKDSS

SEQ ID NO: 1004229 - protein, 9 aa, Homo Sapiens
GRLAWWNDF

SEQ ID NO: 1004230 - protein, 9 aa, Homo Sapiens
ASNNVREIS

SEQ ID NO: 1004231 - protein, 9 aa, Homo Sapiens
GDMRKLIDS

SEQ ID NO: 1004232 - protein, 9 aa, Homo Sapiens
VTMVGIRAR

SEQ ID NO: 1004233 - protein, 9 aa, Homo Sapiens
NPVREAFGN

SEQ ID NO: 1004234 - protein, 9 aa, Homo Sapiens
QIRDDHICF

SEQ ID NO: 1004235 - protein, 9 aa, Homo Sapiens
GDFGLATMK

SEQ ID NO: 1004236 - protein, 9 aa, Homo Sapiens
DDLNMPVLE

SEQ ID NO: 1004237 - protein, 9 aa, Homo Sapiens
AEYKYQLTV

SEQ ID NO: 1004238 - protein, 9 aa, Homo Sapiens
LKNNGKVHL

SEQ ID NO: 1004239 - protein, 9 aa, Homo Sapiens
VETIRSLVD

SEQ ID NO: 1004240 - protein, 9 aa, Homo Sapiens
AGQSRCGRF

SEQ ID NO: 1004241 - protein, 9 aa, Homo Sapiens
GPHEDPQCL

SEQ ID NO: 1004242 - protein, 9 aa, Homo Sapiens
YFRSQTLAN

SEQ ID NO: 1004243 - protein, 9 aa, Homo Sapiens
FLLDKEDVF

SEQ ID NO: 1004244 - protein, 9 aa, Homo Sapiens
CHPEEKERM

SEQ ID NO: 1004245 - protein, 9 aa, Homo Sapiens
LNVLDDDYF

SEQ ID NO: 1004246 - protein, 9 aa, Homo Sapiens
RACLSSPGS

SEQ ID NO: 1004247 - protein, 9 aa, Homo Sapiens
GLASFKTHE

SEQ ID NO: 1004248 - protein, 9 aa, Homo Sapiens
EELAWGDEE

SEQ ID NO: 1004249 - protein, 9 aa, Homo Sapiens
ANFEIDPKK

SEQ ID NO: 1004250 - protein, 9 aa, Homo Sapiens
SILNVKQSP

SEQ ID NO: 1004251 - protein, 9 aa, Homo Sapiens
RKLHFSVYN

SEQ ID NO: 1004252 - protein, 9 aa, Homo Sapiens
DFEMKYLLQ

SEQ ID NO: 1004253 - protein, 9 aa, Homo Sapiens
CGLQEGFEL

SEQ ID NO: 1004254 - protein, 9 aa, Homo Sapiens
VTLAFRPDV

SEQ ID NO: 1004255 - protein, 9 aa, Homo Sapiens
FLGTLVHKL

SEQ ID NO: 1004256 - protein, 9 aa, Homo Sapiens
LNMARKIDN

SEQ ID NO: 1004257 - protein, 9 aa, Homo Sapiens
KYKITEKSQ

SEQ ID NO: 1004258 - protein, 9 aa, Homo Sapiens
MTFGEKIKN

SEQ ID NO: 1004259 - protein, 9 aa, Homo Sapiens
PARPPKPGR

SEQ ID NO: 1004260 - protein, 9 aa, Homo Sapiens
QLEQSLRDV

SEQ ID NO: 1004261 - protein, 9 aa, Homo Sapiens
PWGNSPALE

SEQ ID NO: 1004262 - protein, 9 aa, Homo Sapiens
DLDNATFLS

SEQ ID NO: 1004263 - protein, 9 aa, Homo Sapiens
GSLSCTHPP

SEQ ID NO: 1004264 - protein, 9 aa, Homo Sapiens
LQDYEEFHY

SEQ ID NO: 1004265 - protein, 9 aa, Homo Sapiens
IYNIENRTR

SEQ ID NO: 1004266 - protein, 9 aa, Homo Sapiens
FTVIKDYCT

SEQ ID NO: 1004267 - protein, 9 aa, Homo Sapiens
EAAQFSDTY

SEQ ID NO: 1004268 - protein, 9 aa, Homo Sapiens
CISGKFYTS

SEQ ID NO: 1004269 - protein, 9 aa, Homo Sapiens
VVPEEVVAM

SEQ ID NO: 1004270 - protein, 9 aa, Homo Sapiens
RVLLDNVDA

SEQ ID NO: 1004271 - protein, 9 aa, Homo Sapiens
SAWVILGVI

SEQ ID NO: 1004272 - protein, 9 aa, Homo Sapiens
LLFHANSMM

SEQ ID NO: 1004273 - protein, 9 aa, Homo Sapiens
KELEKKYAA

SEQ ID NO: 1004274 - protein, 9 aa, Homo Sapiens
VEYEVTPDD

SEQ ID NO: 1004275 - protein, 9 aa, Homo Sapiens
HKLSSQGQD

SEQ ID NO: 1004276 - protein, 9 aa, Homo Sapiens
LLLLYPAGH

SEQ ID NO: 1004277 - protein, 9 aa, Homo Sapiens
YSNLNRYKI

SEQ ID NO: 1004278 - protein, 9 aa, Homo Sapiens
DPGFGGKKG

SEQ ID NO: 1004279 - protein, 9 aa, Homo Sapiens
EEDPAVGVI

SEQ ID NO: 1004280 - protein, 9 aa, Homo Sapiens
RYRERKRDR

SEQ ID NO: 1004281 - protein, 9 aa, Homo Sapiens
KLGVCANRL

SEQ ID NO: 1004282 - protein, 9 aa, Homo Sapiens
PEDRRVYGK

SEQ ID NO: 1004283 - protein, 9 aa, Homo Sapiens
KNIHTLVEE

SEQ ID NO: 1004284 - protein, 9 aa, Homo Sapiens
LELPKFLQD

SEQ ID NO: 1004285 - protein, 9 aa, Homo Sapiens
AVICFSWTL

SEQ ID NO: 1004286 - protein, 9 aa, Homo Sapiens
LYGICLEAC

SEQ ID NO: 1004287 - protein, 9 aa, Homo Sapiens
IWESPLFLA

SEQ ID NO: 1004288 - protein, 9 aa, Homo Sapiens
LFSYCKSHV

SEQ ID NO: 1004289 - protein, 9 aa, Homo Sapiens
VIFDRFRGG

SEQ ID NO: 1004290 - protein, 9 aa, Homo Sapiens
DGHKRKEKF

SEQ ID NO: 1004291 - protein, 9 aa, Homo Sapiens
EASITHFLQ

SEQ ID NO: 1004292 - protein, 9 aa, Homo Sapiens
LSQSEQTTT

SEQ ID NO: 1004293 - protein, 9 aa, Homo Sapiens
VHSNFHFDN

SEQ ID NO: 1004294 - protein, 9 aa, Homo Sapiens
SYDKAVKMA

SEQ ID NO: 1004295 - protein, 9 aa, Homo Sapiens
TRIKNLAAK

SEQ ID NO: 1004296 - protein, 9 aa, Homo Sapiens
LVICEDGNS

SEQ ID NO: 1004297 - protein, 9 aa, Homo Sapiens
DNQGFALNF

SEQ ID NO: 1004298 - protein, 9 aa, Homo Sapiens
PTNRKNHSV

SEQ ID NO: 1004299 - protein, 9 aa, Homo Sapiens
RGDGAPALS

SEQ ID NO: 1004300 - protein, 9 aa, Homo Sapiens
LGCWQRKPQ

SEQ ID NO: 1004301 - protein, 9 aa, Homo Sapiens
LDASKENEA

SEQ ID NO: 1004302 - protein, 9 aa, Homo Sapiens
MNRGEKIQL

SEQ ID NO: 1004303 - protein, 9 aa, Homo Sapiens
AKTTQPPSI

SEQ ID NO: 1004304 - protein, 9 aa, Homo Sapiens
WKVPRLGIE

SEQ ID NO: 1004305 - protein, 9 aa, Homo Sapiens
ALKTKVVPE

SEQ ID NO: 1004306 - protein, 9 aa, Homo Sapiens
KCLSQSEQT

SEQ ID NO: 1004307 - protein, 9 aa, Homo Sapiens
HWISNNLSV

SEQ ID NO: 1004308 - protein, 9 aa, Homo Sapiens
NKTCLEEFH

SEQ ID NO: 1004309 - protein, 9 aa, Homo Sapiens
DVDIEFRDH

SEQ ID NO: 1004310 - protein, 9 aa, Homo Sapiens
EEKDDVEFS

SEQ ID NO: 1004311 - protein, 9 aa, Homo Sapiens
GLYTCIAAN

SEQ ID NO: 1004312 - protein, 9 aa, Homo Sapiens
QFCKIYIGD

SEQ ID NO: 1004313 - protein, 9 aa, Homo Sapiens
KGKKGLLGI

SEQ ID NO: 1004314 - protein, 9 aa, Homo Sapiens
GRHIYSTDW

SEQ ID NO: 1004315 - protein, 9 aa, Homo Sapiens
FALQPSTEQ

SEQ ID NO: 1004316 - protein, 9 aa, Homo Sapiens
GLISPRKSR

SEQ ID NO: 1004317 - protein, 9 aa, Homo Sapiens
LHVEKRVLE

SEQ ID NO: 1004318 - protein, 9 aa, Homo Sapiens
RPDTSFFID

SEQ ID NO: 1004319 - protein, 9 aa, Homo Sapiens
RKIIKQEED

SEQ ID NO: 1004320 - protein, 9 aa, Homo Sapiens
WGQEKENEV

SEQ ID NO: 1004321 - protein, 9 aa, Homo Sapiens
LPFFWRASK

SEQ ID NO: 1004322 - protein, 9 aa, Homo Sapiens
LSFDLCSMA

SEQ ID NO: 1004323 - protein, 9 aa, Homo Sapiens
LAVRKYFQK

SEQ ID NO: 1004324 - protein, 9 aa, Homo Sapiens
ETFKNFQMA

SEQ ID NO: 1004325 - protein, 9 aa, Homo Sapiens
TNEVELQDK

SEQ ID NO: 1004326 - protein, 9 aa, Homo Sapiens
VKHLNVSKL

SEQ ID NO: 1004327 - protein, 9 aa, Homo Sapiens
PNAASLPGS

SEQ ID NO: 1004328 - protein, 9 aa, Homo Sapiens
VWSHVGHTG

SEQ ID NO: 1004329 - protein, 9 aa, Homo Sapiens
SYRGKMNKT

SEQ ID NO: 1004330 - protein, 9 aa, Homo Sapiens
LPKVTLETP

SEQ ID NO: 1004331 - protein, 9 aa, Homo Sapiens
QVFQAGDLL

SEQ ID NO: 1004332 - protein, 9 aa, Homo Sapiens
SRVGNSIDH

SEQ ID NO: 1004333 - protein, 9 aa, Homo Sapiens
SVARFRGTW

SEQ ID NO: 1004334 - protein, 9 aa, Homo Sapiens
EEKQIEVVK

SEQ ID NO: 1004335 - protein, 9 aa, Homo Sapiens
FEPGVTSIL

SEQ ID NO: 1004336 - protein, 9 aa, Homo Sapiens
QPKSLQGLS

SEQ ID NO: 1004337 - protein, 9 aa, Homo Sapiens
RAARPTMDS

SEQ ID NO: 1004338 - protein, 9 aa, Homo Sapiens
AFMLCRKNA

SEQ ID NO: 1004339 - protein, 9 aa, Homo Sapiens
FLDSFLLLI

SEQ ID NO: 1004340 - protein, 9 aa, Homo Sapiens
SKTDPTVLF

SEQ ID NO: 1004341 - protein, 9 aa, Homo Sapiens
VMENTIKQF

SEQ ID NO: 1004342 - protein, 9 aa, Homo Sapiens
AIPKLSSPK

SEQ ID NO: 1004343 - protein, 9 aa, Homo Sapiens
KILNKNAFF

SEQ ID NO: 1004344 - protein, 9 aa, Homo Sapiens
RYLNKKAFS

SEQ ID NO: 1004345 - protein, 9 aa, Homo Sapiens
GELSDVFND

SEQ ID NO: 1004346 - protein, 9 aa, Homo Sapiens
RPPPVTLAF

SEQ ID NO: 1004347 - protein, 9 aa, Homo Sapiens
HFARVLYTH

SEQ ID NO: 1004348 - protein, 9 aa, Homo Sapiens
QLSKLHCDK

SEQ ID NO: 1004349 - protein, 9 aa, Homo Sapiens
IYLYEEDKD

SEQ ID NO: 1004350 - protein, 9 aa, Homo Sapiens
PGLTVASGE

SEQ ID NO: 1004351 - protein, 9 aa, Homo Sapiens
HNLTYPLGL

SEQ ID NO: 1004352 - protein, 9 aa, Homo Sapiens
PECASPQFD

SEQ ID NO: 1004353 - protein, 9 aa, Homo Sapiens
FPTFQFQYV

SEQ ID NO: 1004354 - protein, 9 aa, Homo Sapiens
VRKYFQKIT

SEQ ID NO: 1004355 - protein, 9 aa, Homo Sapiens
VLSIAFREE

SEQ ID NO: 1004356 - protein, 9 aa, Homo Sapiens
PRSFNLERI

SEQ ID NO: 1004357 - protein, 9 aa, Homo Sapiens
VQFVQNTFI

SEQ ID NO: 1004358 - protein, 9 aa, Homo Sapiens
DGDYISKLS

SEQ ID NO: 1004359 - protein, 9 aa, Homo Sapiens
LRNPDLVSL

SEQ ID NO: 1004360 - protein, 9 aa, Homo Sapiens
AVLSRSNPS

SEQ ID NO: 1004361 - protein, 9 aa, Homo Sapiens
EYTFTRIYT

SEQ ID NO: 1004362 - protein, 9 aa, Homo Sapiens
VILRLFLFS

SEQ ID NO: 1004363 - protein, 9 aa, Homo Sapiens
VGKFSEDFE

SEQ ID NO: 1004364 - protein, 9 aa, Homo Sapiens
TSEKEAIEV

SEQ ID NO: 1004365 - protein, 9 aa, Homo Sapiens
VRSLLRLGR

SEQ ID NO: 1004366 - protein, 9 aa, Homo Sapiens
LIKTDSKDG

SEQ ID NO: 1004367 - protein, 9 aa, Homo Sapiens
DGYHKSFTK

SEQ ID NO: 1004368 - protein, 9 aa, Homo Sapiens
PRNLCRMSC

SEQ ID NO: 1004369 - protein, 9 aa, Homo Sapiens
SLVYFAYYY

SEQ ID NO: 1004370 - protein, 9 aa, Homo Sapiens
WTKTLPGSL

SEQ ID NO: 1004371 - protein, 9 aa, Homo Sapiens
GYRRTGERV

SEQ ID NO: 1004372 - protein, 9 aa, Homo Sapiens
LDLEVFLLE

SEQ ID NO: 1004373 - protein, 9 aa, Homo Sapiens
TSKSEHKNV

SEQ ID NO: 1004374 - protein, 9 aa, Homo Sapiens
AVLFLSHAH

SEQ ID NO: 1004375 - protein, 9 aa, Homo Sapiens
YGQFYDLCE

SEQ ID NO: 1004376 - protein, 9 aa, Homo Sapiens
DDKEEKGTN

SEQ ID NO: 1004377 - protein, 9 aa, Homo Sapiens
NLADETELR

SEQ ID NO: 1004378 - protein, 9 aa, Homo Sapiens
TSEIQKLFD

SEQ ID NO: 1004379 - protein, 9 aa, Homo Sapiens
ARKVEVNSI

SEQ ID NO: 1004380 - protein, 9 aa, Homo Sapiens
SQDEVEQAR

SEQ ID NO: 1004381 - protein, 9 aa, Homo Sapiens
GEDEPDEFL

SEQ ID NO: 1004382 - protein, 9 aa, Homo Sapiens
NKLWIEITK

SEQ ID NO: 1004383 - protein, 9 aa, Homo Sapiens
EAEVAQSPK

SEQ ID NO: 1004384 - protein, 9 aa, Homo Sapiens
SSQAILITE

SEQ ID NO: 1004385 - protein, 9 aa, Homo Sapiens
HEVRIKMMA

SEQ ID NO: 1004386 - protein, 9 aa, Homo Sapiens
IKEIKQMHP

SEQ ID NO: 1004387 - protein, 9 aa, Homo Sapiens
ECASPQFDG

SEQ ID NO: 1004388 - protein, 9 aa, Homo Sapiens
IWAKPHFMV

SEQ ID NO: 1004389 - protein, 9 aa, Homo Sapiens
CNENGLQSC

SEQ ID NO: 1004390 - protein, 9 aa, Homo Sapiens
AGGRGPGPL

SEQ ID NO: 1004391 - protein, 9 aa, Homo Sapiens
YAAICKPLR

SEQ ID NO: 1004392 - protein, 9 aa, Homo Sapiens
MVLNKKYES

SEQ ID NO: 1004393 - protein, 9 aa, Homo Sapiens
ENFIVATEE

SEQ ID NO: 1004394 - protein, 9 aa, Homo Sapiens
LDGVVEYEV

SEQ ID NO: 1004395 - protein, 9 aa, Homo Sapiens
KHDVLTLKK

SEQ ID NO: 1004396 - protein, 9 aa, Homo Sapiens
VEHALIWRP

SEQ ID NO: 1004397 - protein, 9 aa, Homo Sapiens
RSFFVGEAA

SEQ ID NO: 1004398 - protein, 9 aa, Homo Sapiens
IPDVDSLVD

SEQ ID NO: 1004399 - protein, 9 aa, Homo Sapiens
EVARQFSEP

SEQ ID NO: 1004400 - protein, 9 aa, Homo Sapiens
SLACVDPPH

SEQ ID NO: 1004401 - protein, 9 aa, Homo Sapiens
LRNEDLSLD

SEQ ID NO: 1004402 - protein, 9 aa, Homo Sapiens
GTRPTAIGS

SEQ ID NO: 1004403 - protein, 9 aa, Homo Sapiens
FISSWNKPE

SEQ ID NO: 1004404 - protein, 9 aa, Homo Sapiens
DEDLDSSEE

SEQ ID NO: 1004405 - protein, 9 aa, Homo Sapiens
CFFREKKEQ

SEQ ID NO: 1004406 - protein, 9 aa, Homo Sapiens
AFLDGVVEY

SEQ ID NO: 1004407 - protein, 9 aa, Homo Sapiens
SPPRTALSH

SEQ ID NO: 1004408 - protein, 9 aa, Homo Sapiens
DLQDFEMKY

SEQ ID NO: 1004409 - protein, 9 aa, Homo Sapiens
DQGWAKISN

SEQ ID NO: 1004410 - protein, 9 aa, Homo Sapiens
GDRIDLSSI

SEQ ID NO: 1004411 - protein, 9 aa, Homo Sapiens
EGLSELGRL

SEQ ID NO: 1004412 - protein, 9 aa, Homo Sapiens
CSDSEKSFI

SEQ ID NO: 1004413 - protein, 9 aa, Homo Sapiens
ATPEPWGNS

SEQ ID NO: 1004414 - protein, 9 aa, Homo Sapiens
RSDAVPSKV

SEQ ID NO: 1004415 - protein, 9 aa, Homo Sapiens
MMRSISLRG

SEQ ID NO: 1004416 - protein, 9 aa, Homo Sapiens
NENTFKQIY

SEQ ID NO: 1004417 - protein, 9 aa, Homo Sapiens
RMHKEKVDL

SEQ ID NO: 1004418 - protein, 9 aa, Homo Sapiens
LAPRSRSCS

SEQ ID NO: 1004419 - protein, 9 aa, Homo Sapiens
RAAAGALAG

SEQ ID NO: 1004420 - protein, 9 aa, Homo Sapiens
TLAVDYRSY

SEQ ID NO: 1004421 - protein, 9 aa, Homo Sapiens
SNSKFLCAD

SEQ ID NO: 1004422 - protein, 9 aa, Homo Sapiens
HYDFLTKLT

SEQ ID NO: 1004423 - protein, 9 aa, Homo Sapiens
CVSSILNVK

SEQ ID NO: 1004424 - protein, 9 aa, Homo Sapiens
LMALDCYVA

SEQ ID NO: 1004425 - protein, 9 aa, Homo Sapiens
MLTEESIPV

SEQ ID NO: 1004426 - protein, 9 aa, Homo Sapiens
TAALQQVLF

SEQ ID NO: 1004427 - protein, 9 aa, Homo Sapiens
LLTSNYIFF

SEQ ID NO: 1004428 - protein, 9 aa, Homo Sapiens
MAAVRDKID

SEQ ID NO: 1004429 - protein, 9 aa, Homo Sapiens
PPLIPASFP

SEQ ID NO: 1004430 - protein, 9 aa, Homo Sapiens
KDKENPPLS

SEQ ID NO: 1004431 - protein, 9 aa, Homo Sapiens
FSPVCDESC

SEQ ID NO: 1004432 - protein, 9 aa, Homo Sapiens
LMENNFRRP

SEQ ID NO: 1004433 - protein, 9 aa, Homo Sapiens
QVQPQIFSS

SEQ ID NO: 1004434 - protein, 9 aa, Homo Sapiens
SSSVQPLSG

SEQ ID NO: 1004435 - protein, 9 aa, Homo Sapiens
TYESSDCIT

SEQ ID NO: 1004436 - protein, 9 aa, Homo Sapiens
EHYDFLTKL

SEQ ID NO: 1004437 - protein, 9 aa, Homo Sapiens
TSFFIDKVV

SEQ ID NO: 1004438 - protein, 9 aa, Homo Sapiens
SAPGDSDLV

SEQ ID NO: 1004439 - protein, 9 aa, Homo Sapiens
SLALMENIF

SEQ ID NO: 1004440 - protein, 9 aa, Homo Sapiens
VLDILVLIL

SEQ ID NO: 1004441 - protein, 9 aa, Homo Sapiens
SVCPPGGIQ

SEQ ID NO: 1004442 - protein, 9 aa, Homo Sapiens
DCSWGKPIS

SEQ ID NO: 1004443 - protein, 9 aa, Homo Sapiens
MRTRALRFG

SEQ ID NO: 1004444 - protein, 9 aa, Homo Sapiens
QILNNFSQR

SEQ ID NO: 1004445 - protein, 9 aa, Homo Sapiens
TRVGGDVQV

SEQ ID NO: 1004446 - protein, 9 aa, Homo Sapiens
SSLPLSHPS

SEQ ID NO: 1004447 - protein, 9 aa, Homo Sapiens
FGLATMKSR

SEQ ID NO: 1004448 - protein, 9 aa, Homo Sapiens
FLRNHMRLH

SEQ ID NO: 1004449 - protein, 9 aa, Homo Sapiens
VEKTRRFMA

SEQ ID NO: 1004450 - protein, 9 aa, Homo Sapiens
VLYMGILLF

SEQ ID NO: 1004451 - protein, 9 aa, Homo Sapiens
QLEVALIRA

SEQ ID NO: 1004452 - protein, 9 aa, Homo Sapiens
EERKKQTRN

SEQ ID NO: 1004453 - protein, 9 aa, Homo Sapiens
WDWDRRGRS

SEQ ID NO: 1004454 - protein, 9 aa, Homo Sapiens
FSFRKSEKE

SEQ ID NO: 1004455 - protein, 9 aa, Homo Sapiens
LAAIALDRY

SEQ ID NO: 1004456 - protein, 9 aa, Homo Sapiens
LYLPSHPHH

SEQ ID NO: 1004457 - protein, 9 aa, Homo Sapiens
VNEPHELPL

SEQ ID NO: 1004458 - protein, 9 aa, Homo Sapiens
ENSQDQGKF

SEQ ID NO: 1004459 - protein, 9 aa, Homo Sapiens
VTQFLPTHA

SEQ ID NO: 1004460 - protein, 9 aa, Homo Sapiens
SGKFYTSLS

SEQ ID NO: 1004461 - protein, 9 aa, Homo Sapiens
GPTVVNPEL

SEQ ID NO: 1004462 - protein, 9 aa, Homo Sapiens
STLKAAIRA

SEQ ID NO: 1004463 - protein, 9 aa, Homo Sapiens
AFRGITNVK

SEQ ID NO: 1004464 - protein, 9 aa, Homo Sapiens
DLEDFFIKM

SEQ ID NO: 1004465 - protein, 9 aa, Homo Sapiens
YEPRFKFQV

SEQ ID NO: 1004466 - protein, 9 aa, Homo Sapiens
HITVLDKND

SEQ ID NO: 1004467 - protein, 9 aa, Homo Sapiens
MHYEILIHN

SEQ ID NO: 1004468 - protein, 9 aa, Homo Sapiens
LKWTLRDDL

SEQ ID NO: 1004469 - protein, 9 aa, Homo Sapiens
PTAAIQNEF

SEQ ID NO: 1004470 - protein, 9 aa, Homo Sapiens
CGHKVERQN

SEQ ID NO: 1004471 - protein, 9 aa, Homo Sapiens
GLFHTLRLC

SEQ ID NO: 1004472 - protein, 9 aa, Homo Sapiens
DYEEFHYDK

SEQ ID NO: 1004473 - protein, 9 aa, Homo Sapiens
ISTPVITST

SEQ ID NO: 1004474 - protein, 9 aa, Homo Sapiens
LVAQVSLSH

SEQ ID NO: 1004475 - protein, 9 aa, Homo Sapiens
ASFKTHEIT

SEQ ID NO: 1004476 - protein, 9 aa, Homo Sapiens
SYYRDPNKP

SEQ ID NO: 1004477 - protein, 9 aa, Homo Sapiens
NSSASLLES

SEQ ID NO: 1004478 - protein, 9 aa, Homo Sapiens
DRKEVIHEI

SEQ ID NO: 1004479 - protein, 9 aa, Homo Sapiens
EKNGIPICT

SEQ ID NO: 1004480 - protein, 9 aa, Homo Sapiens
KPFLELSDS

SEQ ID NO: 1004481 - protein, 9 aa, Homo Sapiens
QAQRQMDAR

SEQ ID NO: 1004482 - protein, 9 aa, Homo Sapiens
TVGMDMNED

SEQ ID NO: 1004483 - protein, 9 aa, Homo Sapiens
VICEDGNSI

SEQ ID NO: 1004484 - protein, 9 aa, Homo Sapiens
KNELLRVMP

SEQ ID NO: 1004485 - protein, 9 aa, Homo Sapiens
DQSFLSLEP

SEQ ID NO: 1004486 - protein, 9 aa, Homo Sapiens
CAPFQLHSA

SEQ ID NO: 1004487 - protein, 9 aa, Homo Sapiens
WTLFTSSVS

SEQ ID NO: 1004488 - protein, 9 aa, Homo Sapiens
QQKRQVEHL

SEQ ID NO: 1004489 - protein, 9 aa, Homo Sapiens
HSMPHEVEI

SEQ ID NO: 1004490 - protein, 9 aa, Homo Sapiens
RIYTFESLV

SEQ ID NO: 1004491 - protein, 9 aa, Homo Sapiens
KNTLSKSLE

SEQ ID NO: 1004492 - protein, 9 aa, Homo Sapiens
CENGRCVCW

SEQ ID NO: 1004493 - protein, 9 aa, Homo Sapiens
AAFLRLFQQ

SEQ ID NO: 1004494 - protein, 9 aa, Homo Sapiens
GQEKENEVE

SEQ ID NO: 1004495 - protein, 9 aa, Homo Sapiens
RFLSNGYIS

SEQ ID NO: 1004496 - protein, 9 aa, Homo Sapiens
FELFAVNMN

SEQ ID NO: 1004497 - protein, 9 aa, Homo Sapiens
DWITSNTEM

SEQ ID NO: 1004498 - protein, 9 aa, Homo Sapiens
LAQPVCGFD

SEQ ID NO: 1004499 - protein, 9 aa, Homo Sapiens
HGEEFSGKG

SEQ ID NO: 1004500 - protein, 9 aa, Homo Sapiens
LMENIFMVL

SEQ ID NO: 1004501 - protein, 9 aa, Homo Sapiens
ILNMLKNFL

SEQ ID NO: 1004502 - protein, 9 aa, Homo Sapiens
PRPPRSSSP

SEQ ID NO: 1004503 - protein, 9 aa, Homo Sapiens
QKYKGLTAP

SEQ ID NO: 1004504 - protein, 9 aa, Homo Sapiens
LYQEPIDEL

SEQ ID NO: 1004505 - protein, 9 aa, Homo Sapiens
YRLRTERDG

SEQ ID NO: 1004506 - protein, 9 aa, Homo Sapiens
TAASILQMW

SEQ ID NO: 1004507 - protein, 9 aa, Homo Sapiens
VEKSELART

SEQ ID NO: 1004508 - protein, 9 aa, Homo Sapiens
SAILNRKIQ

SEQ ID NO: 1004509 - protein, 9 aa, Homo Sapiens
KQEEDPPKS

SEQ ID NO: 1004510 - protein, 9 aa, Homo Sapiens
LRAEERRLS

SEQ ID NO: 1004511 - protein, 9 aa, Homo Sapiens
VKISDCFWP

SEQ ID NO: 1004512 - protein, 9 aa, Homo Sapiens
FHSMCFISS

SEQ ID NO: 1004513 - protein, 9 aa, Homo Sapiens
PYAINLREV

SEQ ID NO: 1004514 - protein, 9 aa, Homo Sapiens
VHGQVNNAS

SEQ ID NO: 1004515 - protein, 9 aa, Homo Sapiens
ELYFLLQEE

SEQ ID NO: 1004516 - protein, 9 aa, Homo Sapiens
KRSYQLIHA

SEQ ID NO: 1004517 - protein, 9 aa, Homo Sapiens
PSFPDLSAQ

SEQ ID NO: 1004518 - protein, 9 aa, Homo Sapiens
GTRGCAGPH

SEQ ID NO: 1004519 - protein, 9 aa, Homo Sapiens
RSTSSINSS

SEQ ID NO: 1004520 - protein, 9 aa, Homo Sapiens
SSLQIPQSP

SEQ ID NO: 1004521 - protein, 9 aa, Homo Sapiens
VIIGGHDSL

SEQ ID NO: 1004522 - protein, 9 aa, Homo Sapiens
TPLQTESCV

SEQ ID NO: 1004523 - protein, 9 aa, Homo Sapiens
RIKLEPESY

SEQ ID NO: 1004524 - protein, 9 aa, Homo Sapiens
DSSSYKHNR

SEQ ID NO: 1004525 - protein, 9 aa, Homo Sapiens
DSASAPDTV

SEQ ID NO: 1004526 - protein, 9 aa, Homo Sapiens
GVFAVCWAS

SEQ ID NO: 1004527 - protein, 9 aa, Homo Sapiens
VLMLMALDC

SEQ ID NO: 1004528 - protein, 9 aa, Homo Sapiens
RKIQDNYLL

SEQ ID NO: 1004529 - protein, 9 aa, Homo Sapiens
SDKEGESYS

SEQ ID NO: 1004530 - protein, 9 aa, Homo Sapiens
RTLLSYVSV

SEQ ID NO: 1004531 - protein, 9 aa, Homo Sapiens
ATVRHLEES

SEQ ID NO: 1004532 - protein, 9 aa, Homo Sapiens
SLQFDGALN

SEQ ID NO: 1004533 - protein, 9 aa, Homo Sapiens
LKHLRVLLD

SEQ ID NO: 1004534 - protein, 9 aa, Homo Sapiens
FEIDPKKGK

SEQ ID NO: 1004535 - protein, 9 aa, Homo Sapiens
EIAQREGTK

SEQ ID NO: 1004536 - protein, 9 aa, Homo Sapiens
CCNSNLQDS

SEQ ID NO: 1004537 - protein, 9 aa, Homo Sapiens
PGFAGNWGH

SEQ ID NO: 1004538 - protein, 9 aa, Homo Sapiens
TKLFALMER

SEQ ID NO: 1004539 - protein, 9 aa, Homo Sapiens
GHNKNQQGS

SEQ ID NO: 1004540 - protein, 9 aa, Homo Sapiens
GVTALLTLC

SEQ ID NO: 1004541 - protein, 9 aa, Homo Sapiens
RHSNPELLK

SEQ ID NO: 1004542 - protein, 9 aa, Homo Sapiens
AFCLGWELK

SEQ ID NO: 1004543 - protein, 9 aa, Homo Sapiens
PKVEGLLTL

SEQ ID NO: 1004544 - protein, 9 aa, Homo Sapiens
WCGRPEQVR

SEQ ID NO: 1004545 - protein, 9 aa, Homo Sapiens
RSSSGALNV

SEQ ID NO: 1004546 - protein, 9 aa, Homo Sapiens
HFSVYNFDR

SEQ ID NO: 1004547 - protein, 9 aa, Homo Sapiens
WAKPHFMVP

SEQ ID NO: 1004548 - protein, 9 aa, Homo Sapiens
PVLPAADHK

SEQ ID NO: 1004549 - protein, 9 aa, Homo Sapiens
VEVNSIVVP

SEQ ID NO: 1004550 - protein, 9 aa, Homo Sapiens
TIGVNCSQA

SEQ ID NO: 1004551 - protein, 9 aa, Homo Sapiens
SADMNGAPS

SEQ ID NO: 1004552 - protein, 9 aa, Homo Sapiens
LVCVDVDIE

SEQ ID NO: 1004553 - protein, 9 aa, Homo Sapiens
LTAASILQM

SEQ ID NO: 1004554 - protein, 9 aa, Homo Sapiens
VNITIHWIS

SEQ ID NO: 1004555 - protein, 9 aa, Homo Sapiens
LLSSTTTIL

SEQ ID NO: 1004556 - protein, 9 aa, Homo Sapiens
REKKEQRGT

SEQ ID NO: 1004557 - protein, 9 aa, Homo Sapiens
YIVFVSTSL

SEQ ID NO: 1004558 - protein, 9 aa, Homo Sapiens
VLENVSYIK

SEQ ID NO: 1004559 - protein, 9 aa, Homo Sapiens
LPCLTFFIA

SEQ ID NO: 1004560 - protein, 9 aa, Homo Sapiens
SVPSFSECS

SEQ ID NO: 1004561 - protein, 9 aa, Homo Sapiens
DVLTLKKEE

SEQ ID NO: 1004562 - protein, 9 aa, Homo Sapiens
FLDKTAIIS

SEQ ID NO: 1004563 - protein, 9 aa, Homo Sapiens
PEALPFARP

SEQ ID NO: 1004564 - protein, 9 aa, Homo Sapiens
PKGGEDEPA

SEQ ID NO: 1004565 - protein, 9 aa, Homo Sapiens
TAILAMAVG

SEQ ID NO: 1004566 - protein, 9 aa, Homo Sapiens
FEKLHVEKR

SEQ ID NO: 1004567 - protein, 9 aa, Homo Sapiens
ELRVDENRN

SEQ ID NO: 1004568 - protein, 9 aa, Homo Sapiens
HTLCASTNE

SEQ ID NO: 1004569 - protein, 9 aa, Homo Sapiens
ICNGMLQEI

SEQ ID NO: 1004570 - protein, 9 aa, Homo Sapiens
QLLSLSSSV

SEQ ID NO: 1004571 - protein, 9 aa, Homo Sapiens
APMRNEHEK

SEQ ID NO: 1004572 - protein, 9 aa, Homo Sapiens
FVHHQRNHS

SEQ ID NO: 1004573 - protein, 9 aa, Homo Sapiens
TVRCTCIGI

SEQ ID NO: 1004574 - protein, 9 aa, Homo Sapiens
HSFREQGHA

SEQ ID NO: 1004575 - protein, 9 aa, Homo Sapiens
NQNERDINS

SEQ ID NO: 1004576 - protein, 9 aa, Homo Sapiens
EGKTDELLK

SEQ ID NO: 1004577 - protein, 9 aa, Homo Sapiens
VLVSERICF

SEQ ID NO: 1004578 - protein, 9 aa, Homo Sapiens
APSPPPSPL

SEQ ID NO: 1004579 - protein, 9 aa, Homo Sapiens
RLLQSNPVR

SEQ ID NO: 1004580 - protein, 9 aa, Homo Sapiens
SLKKEQLSL

SEQ ID NO: 1004581 - protein, 9 aa, Homo Sapiens
MLSFFEQFC

SEQ ID NO: 1004582 - protein, 9 aa, Homo Sapiens
KEIVVAMYD

SEQ ID NO: 1004583 - protein, 9 aa, Homo Sapiens
KKVPGDSQQ

SEQ ID NO: 1004584 - protein, 9 aa, Homo Sapiens
PPMPTRPVP

SEQ ID NO: 1004585 - protein, 9 aa, Homo Sapiens
SLVVPVHVQ

SEQ ID NO: 1004586 - protein, 9 aa, Homo Sapiens
LVFLLSIVL

SEQ ID NO: 1004587 - protein, 9 aa, Homo Sapiens
WESSLGIAE

SEQ ID NO: 1004588 - protein, 9 aa, Homo Sapiens
GNSAILNRK

SEQ ID NO: 1004589 - protein, 9 aa, Homo Sapiens
QKVHSLLKF

SEQ ID NO: 1004590 - protein, 9 aa, Homo Sapiens
AASILQMWH

SEQ ID NO: 1004591 - protein, 9 aa, Homo Sapiens
TECTSNVAI

SEQ ID NO: 1004592 - protein, 9 aa, Homo Sapiens
KSGMDLTPR

SEQ ID NO: 1004593 - protein, 9 aa, Homo Sapiens
LINRKISFL

SEQ ID NO: 1004594 - protein, 9 aa, Homo Sapiens
ETSGKLNID

SEQ ID NO: 1004595 - protein, 9 aa, Homo Sapiens
DLIKTDSKD

SEQ ID NO: 1004596 - protein, 9 aa, Homo Sapiens
HKYSNLNRY

SEQ ID NO: 1004597 - protein, 9 aa, Homo Sapiens
SNYIFFTGC

SEQ ID NO: 1004598 - protein, 9 aa, Homo Sapiens
ALTLQPRGK

SEQ ID NO: 1004599 - protein, 9 aa, Homo Sapiens
PGFGGKKGS

SEQ ID NO: 1004600 - protein, 9 aa, Homo Sapiens
KNTTLQSLD

SEQ ID NO: 1004601 - protein, 9 aa, Homo Sapiens
VPKLMLHGI

SEQ ID NO: 1004602 - protein, 9 aa, Homo Sapiens
ANGFIMTIH

SEQ ID NO: 1004603 - protein, 9 aa, Homo Sapiens
RIKNLAAKM

SEQ ID NO: 1004604 - protein, 9 aa, Homo Sapiens
YVKMRNNRE

SEQ ID NO: 1004605 - protein, 9 aa, Homo Sapiens
APLFQELNS

SEQ ID NO: 1004606 - protein, 9 aa, Homo Sapiens
LAGVGAAAG

SEQ ID NO: 1004607 - protein, 9 aa, Homo Sapiens
LWPPVWEKR

SEQ ID NO: 1004608 - protein, 9 aa, Homo Sapiens
RRSWCGRPE

SEQ ID NO: 1004609 - protein, 9 aa, Homo Sapiens
TRVKAVKIL

SEQ ID NO: 1004610 - protein, 9 aa, Homo Sapiens
DIQNCATSF

SEQ ID NO: 1004611 - protein, 9 aa, Homo Sapiens
DKGKKGLLG

SEQ ID NO: 1004612 - protein, 9 aa, Homo Sapiens
DIVRDRNAE

SEQ ID NO: 1004613 - protein, 9 aa, Homo Sapiens
PVGQKVEGM

SEQ ID NO: 1004614 - protein, 9 aa, Homo Sapiens
FRNKIDLQN

SEQ ID NO: 1004615 - protein, 9 aa, Homo Sapiens
IMTIHAAEW

SEQ ID NO: 1004616 - protein, 9 aa, Homo Sapiens
QMTNNDIKR

SEQ ID NO: 1004617 - protein, 9 aa, Homo Sapiens
GSCPPSPPL

SEQ ID NO: 1004618 - protein, 9 aa, Homo Sapiens
QMTFGEKIK

SEQ ID NO: 1004619 - protein, 9 aa, Homo Sapiens
YNNLCVSEI

SEQ ID NO: 1004620 - protein, 9 aa, Homo Sapiens
SPSEPFQII

SEQ ID NO: 1004621 - protein, 9 aa, Homo Sapiens
NTCSWIRNS

SEQ ID NO: 1004622 - protein, 9 aa, Homo Sapiens
ITGGYLDRS

SEQ ID NO: 1004623 - protein, 9 aa, Homo Sapiens
EGPSQQGVG

SEQ ID NO: 1004624 - protein, 9 aa, Homo Sapiens
GGFTCFFQD

SEQ ID NO: 1004625 - protein, 9 aa, Homo Sapiens
TVISDSCLH

SEQ ID NO: 1004626 - protein, 9 aa, Homo Sapiens
IREEDKNEL

SEQ ID NO: 1004627 - protein, 9 aa, Homo Sapiens
SDTGPISEG

SEQ ID NO: 1004628 - protein, 9 aa, Homo Sapiens
TRKDNLGDD

SEQ ID NO: 1004629 - protein, 9 aa, Homo Sapiens
MNKEEKLYA

SEQ ID NO: 1004630 - protein, 9 aa, Homo Sapiens
QERTESTTD

SEQ ID NO: 1004631 - protein, 9 aa, Homo Sapiens
KMKSKVDTI

SEQ ID NO: 1004632 - protein, 9 aa, Homo Sapiens
YDFLTKLTE

SEQ ID NO: 1004633 - protein, 9 aa, Homo Sapiens
IVSYYRDPN

SEQ ID NO: 1004634 - protein, 9 aa, Homo Sapiens
ICSRVSGWR

SEQ ID NO: 1004635 - protein, 9 aa, Homo Sapiens
ENLTKNTTL

SEQ ID NO: 1004636 - protein, 9 aa, Homo Sapiens
FKNFQMAQP

SEQ ID NO: 1004637 - protein, 9 aa, Homo Sapiens
NIDEYNFFL

SEQ ID NO: 1004638 - protein, 9 aa, Homo Sapiens
AFNPDVGEN

SEQ ID NO: 1004639 - protein, 9 aa, Homo Sapiens
LEKKYAASK

SEQ ID NO: 1004640 - protein, 9 aa, Homo Sapiens
YPRVKVGNK

SEQ ID NO: 1004641 - protein, 9 aa, Homo Sapiens
QLANKLQCL

SEQ ID NO: 1004642 - protein, 9 aa, Homo Sapiens
GGSYYRVSF

SEQ ID NO: 1004643 - protein, 9 aa, Homo Sapiens
LSWELQAMA

SEQ ID NO: 1004644 - protein, 9 aa, Homo Sapiens
PLQTESCVP

SEQ ID NO: 1004645 - protein, 9 aa, Homo Sapiens
TDCSWGKPI

SEQ ID NO: 1004646 - protein, 9 aa, Homo Sapiens
PQRACLSSP

SEQ ID NO: 1004647 - protein, 9 aa, Homo Sapiens
QPQEERKSK

SEQ ID NO: 1004648 - protein, 9 aa, Homo Sapiens
APVIGLTSS

SEQ ID NO: 1004649 - protein, 9 aa, Homo Sapiens
PCCLLTNGK

SEQ ID NO: 1004650 - protein, 9 aa, Homo Sapiens
GIVFARMAP

SEQ ID NO: 1004651 - protein, 9 aa, Homo Sapiens
FIDKVVSVF

SEQ ID NO: 1004652 - protein, 9 aa, Homo Sapiens
PGPPGFIGH

SEQ ID NO: 1004653 - protein, 9 aa, Homo Sapiens
QVDSSPNRF

SEQ ID NO: 1004654 - protein, 9 aa, Homo Sapiens
SREKTGSLE

SEQ ID NO: 1004655 - protein, 9 aa, Homo Sapiens
IRKLVDFKK

SEQ ID NO: 1004656 - protein, 9 aa, Homo Sapiens
ERCELVKKI

SEQ ID NO: 1004657 - protein, 9 aa, Homo Sapiens
GRQGSHYNQ

SEQ ID NO: 1004658 - protein, 9 aa, Homo Sapiens
SLYGICLEA

SEQ ID NO: 1004659 - protein, 9 aa, Homo Sapiens
WYHDQGWAK

SEQ ID NO: 1004660 - protein, 9 aa, Homo Sapiens
VSITMSYVH

SEQ ID NO: 1004661 - protein, 9 aa, Homo Sapiens
TLVHKLSSQ

SEQ ID NO: 1004662 - protein, 9 aa, Homo Sapiens
VEESRASTA

SEQ ID NO: 1004663 - protein, 9 aa, Homo Sapiens
FSSRDRSSS

SEQ ID NO: 1004664 - protein, 9 aa, Homo Sapiens
CLFCTKVHP

SEQ ID NO: 1004665 - protein, 9 aa, Homo Sapiens
GCLQEEDSV

SEQ ID NO: 1004666 - protein, 9 aa, Homo Sapiens
KKDNAALAR

SEQ ID NO: 1004667 - protein, 9 aa, Homo Sapiens
KATEDQLSK

SEQ ID NO: 1004668 - protein, 9 aa, Homo Sapiens
MLAKLQRTQ

SEQ ID NO: 1004669 - protein, 9 aa, Homo Sapiens
GKKGSSPVG

SEQ ID NO: 1004670 - protein, 9 aa, Homo Sapiens
IFVNGKKMK

SEQ ID NO: 1004671 - protein, 9 aa, Homo Sapiens
YSLVICEDG

SEQ ID NO: 1004672 - protein, 9 aa, Homo Sapiens
SFLLLISLF

SEQ ID NO: 1004673 - protein, 9 aa, Homo Sapiens
DLVGIVPLT

SEQ ID NO: 1004674 - protein, 9 aa, Homo Sapiens
PGSEFVYVV

SEQ ID NO: 1004675 - protein, 9 aa, Homo Sapiens
VFHLFGECL

SEQ ID NO: 1004676 - protein, 9 aa, Homo Sapiens
LVYFAYYYG

SEQ ID NO: 1004677 - protein, 9 aa, Homo Sapiens
VQFWAIQRR

SEQ ID NO: 1004678 - protein, 9 aa, Homo Sapiens
KKGDKGKKG

SEQ ID NO: 1004679 - protein, 9 aa, Homo Sapiens
TCKRSYQLI

SEQ ID NO: 1004680 - protein, 9 aa, Homo Sapiens
FVTSNESPE

SEQ ID NO: 1004681 - protein, 9 aa, Homo Sapiens
IQAGCLQEE

SEQ ID NO: 1004682 - protein, 9 aa, Homo Sapiens
PLVDNQNER

SEQ ID NO: 1004683 - protein, 9 aa, Homo Sapiens
PGFKDWQCQ

SEQ ID NO: 1004684 - protein, 9 aa, Homo Sapiens
GENIYLYEE

SEQ ID NO: 1004685 - protein, 9 aa, Homo Sapiens
ANFDLSVSR

SEQ ID NO: 1004686 - protein, 9 aa, Homo Sapiens
LSGKQLLSL

SEQ ID NO: 1004687 - protein, 9 aa, Homo Sapiens
ILEIKKQLQ

SEQ ID NO: 1004688 - protein, 9 aa, Homo Sapiens
NQAQDSSRH

SEQ ID NO: 1004689 - protein, 9 aa, Homo Sapiens
PAALISSEN

SEQ ID NO: 1004690 - protein, 9 aa, Homo Sapiens
YTTWTLFTS

SEQ ID NO: 1004691 - protein, 9 aa, Homo Sapiens
GPLTSGTSP

SEQ ID NO: 1004692 - protein, 9 aa, Homo Sapiens
TLCLCLIFF

SEQ ID NO: 1004693 - protein, 9 aa, Homo Sapiens
LVYQLTYCG

SEQ ID NO: 1004694 - protein, 9 aa, Homo Sapiens
TSGTSPTQL

SEQ ID NO: 1004695 - protein, 9 aa, Homo Sapiens
RFDNLRGQP

SEQ ID NO: 1004696 - protein, 9 aa, Homo Sapiens
SVKPGTEEK

SEQ ID NO: 1004697 - protein, 9 aa, Homo Sapiens
GRKDSGSTE

SEQ ID NO: 1004698 - protein, 9 aa, Homo Sapiens
ILNKHLQKT

SEQ ID NO: 1004699 - protein, 9 aa, Homo Sapiens
SRPLSGSQL

SEQ ID NO: 1004700 - protein, 9 aa, Homo Sapiens
LLDLTPNYR

SEQ ID NO: 1004701 - protein, 9 aa, Homo Sapiens
SREVNGLIN

SEQ ID NO: 1004702 - protein, 9 aa, Homo Sapiens
NKEKMQCDN

SEQ ID NO: 1004703 - protein, 9 aa, Homo Sapiens
NAISKSETT

SEQ ID NO: 1004704 - protein, 9 aa, Homo Sapiens
LVGIVPLTM

SEQ ID NO: 1004705 - protein, 9 aa, Homo Sapiens
RWSGAWALS

SEQ ID NO: 1004706 - protein, 9 aa, Homo Sapiens
EERAEFLQQ

SEQ ID NO: 1004707 - protein, 9 aa, Homo Sapiens
ARKVGLKKR

SEQ ID NO: 1004708 - protein, 9 aa, Homo Sapiens
EGAQRVVTS

SEQ ID NO: 1004709 - protein, 9 aa, Homo Sapiens
DMEHLQRQN

SEQ ID NO: 1004710 - protein, 9 aa, Homo Sapiens
RAEFLQQEV

SEQ ID NO: 1004711 - protein, 9 aa, Homo Sapiens
DPSRPLSGS

SEQ ID NO: 1004712 - protein, 9 aa, Homo Sapiens
KQTRNARAE

SEQ ID NO: 1004713 - protein, 9 aa, Homo Sapiens
AKIQNKNCS

SEQ ID NO: 1004714 - protein, 9 aa, Homo Sapiens
FGGPGFSVC

SEQ ID NO: 1004715 - protein, 9 aa, Homo Sapiens
SCTHPPLQS

SEQ ID NO: 1004716 - protein, 9 aa, Homo Sapiens
LPEALPFAR

SEQ ID NO: 1004717 - protein, 9 aa, Homo Sapiens
DGTSEQRKS

SEQ ID NO: 1004718 - protein, 9 aa, Homo Sapiens
HILLSNFYL

SEQ ID NO: 1004719 - protein, 9 aa, Homo Sapiens
ENSSNNSSH

SEQ ID NO: 1004720 - protein, 9 aa, Homo Sapiens
VKPYVCTEC

SEQ ID NO: 1004721 - protein, 9 aa, Homo Sapiens
DLGTYTCKV

SEQ ID NO: 1004722 - protein, 9 aa, Homo Sapiens
ELPPAALIS

SEQ ID NO: 1004723 - protein, 9 aa, Homo Sapiens
KEKDIIKKT

SEQ ID NO: 1004724 - protein, 9 aa, Homo Sapiens
SMIDLPRST

SEQ ID NO: 1004725 - protein, 9 aa, Homo Sapiens
DVSSLPLSH

SEQ ID NO: 1004726 - protein, 9 aa, Homo Sapiens
RNGLLLKEE

SEQ ID NO: 1004727 - protein, 9 aa, Homo Sapiens
SQFFHGSLA

SEQ ID NO: 1004728 - protein, 9 aa, Homo Sapiens
ILVTVISDS

SEQ ID NO: 1004729 - protein, 9 aa, Homo Sapiens
LCGIDFPIK

SEQ ID NO: 1004730 - protein, 9 aa, Homo Sapiens
ACILLLVIS

SEQ ID NO: 1004731 - protein, 9 aa, Homo Sapiens
SPCGEQFKS

SEQ ID NO: 1004732 - protein, 9 aa, Homo Sapiens
MAVGICGTD

SEQ ID NO: 1004733 - protein, 9 aa, Homo Sapiens
EVAQSPKYK

SEQ ID NO: 1004734 - protein, 9 aa, Homo Sapiens
PQTDTEEDP

SEQ ID NO: 1004735 - protein, 9 aa, Homo Sapiens
FVRSIELMF

SEQ ID NO: 1004736 - protein, 9 aa, Homo Sapiens
VRPNAASLP

SEQ ID NO: 1004737 - protein, 9 aa, Homo Sapiens
YLVKTSDLG

SEQ ID NO: 1004738 - protein, 9 aa, Homo Sapiens
VGLFHTLRL

SEQ ID NO: 1004739 - protein, 9 aa, Homo Sapiens
EQWKTNKAQ

SEQ ID NO: 1004740 - protein, 9 aa, Homo Sapiens
KKEKDIIKK

SEQ ID NO: 1004741 - protein, 9 aa, Homo Sapiens
GAPALSGPP

SEQ ID NO: 1004742 - protein, 9 aa, Homo Sapiens
LLYPGLADS

SEQ ID NO: 1004743 - protein, 9 aa, Homo Sapiens
KIIRSATPF

SEQ ID NO: 1004744 - protein, 9 aa, Homo Sapiens
ALQPSTEQA

SEQ ID NO: 1004745 - protein, 9 aa, Homo Sapiens
GDQKICAQY

SEQ ID NO: 1004746 - protein, 9 aa, Homo Sapiens
DLPRSTVPD

SEQ ID NO: 1004747 - protein, 9 aa, Homo Sapiens
GKLFSKKFD

SEQ ID NO: 1004748 - protein, 9 aa, Homo Sapiens
RAQAALRER

SEQ ID NO: 1004749 - protein, 9 aa, Homo Sapiens
LFALRLLDY

SEQ ID NO: 1004750 - protein, 9 aa, Homo Sapiens
CIDKPSRCY

SEQ ID NO: 1004751 - protein, 9 aa, Homo Sapiens
IGKKGDKGK

SEQ ID NO: 1004752 - protein, 9 aa, Homo Sapiens
NAGVSPIEN

SEQ ID NO: 1004753 - protein, 9 aa, Homo Sapiens
PGNSENGHS

SEQ ID NO: 1004754 - protein, 9 aa, Homo Sapiens
NTFIPLGQG

SEQ ID NO: 1004755 - protein, 9 aa, Homo Sapiens
PPGSRPRRG

SEQ ID NO: 1004756 - protein, 9 aa, Homo Sapiens
RVPVQVRSF

SEQ ID NO: 1004757 - protein, 9 aa, Homo Sapiens
RDETFVDMK

SEQ ID NO: 1004758 - protein, 9 aa, Homo Sapiens
ETSPSFPDL

SEQ ID NO: 1004759 - protein, 9 aa, Homo Sapiens
VKDCVTNRP

SEQ ID NO: 1004760 - protein, 9 aa, Homo Sapiens
TSNYIFFTG

SEQ ID NO: 1004761 - protein, 9 aa, Homo Sapiens
RKLVDFKKI

SEQ ID NO: 1004762 - protein, 9 aa, Homo Sapiens
RKTGAHHEP

SEQ ID NO: 1004763 - protein, 9 aa, Homo Sapiens
SSREQERTE

SEQ ID NO: 1004764 - protein, 9 aa, Homo Sapiens
NSMKECREG

SEQ ID NO: 1004765 - protein, 9 aa, Homo Sapiens
TWVYEYIVF

SEQ ID NO: 1004766 - protein, 9 aa, Homo Sapiens
LQQVLFTRI

SEQ ID NO: 1004767 - protein, 9 aa, Homo Sapiens
MGDPGFGGK

SEQ ID NO: 1004768 - protein, 9 aa, Homo Sapiens
SGELSDVFN

SEQ ID NO: 1004769 - protein, 9 aa, Homo Sapiens
QSRVGNSID

SEQ ID NO: 1004770 - protein, 9 aa, Homo Sapiens
HALHEVLEG

SEQ ID NO: 1004771 - protein, 9 aa, Homo Sapiens
PLETFHCLS

SEQ ID NO: 1004772 - protein, 9 aa, Homo Sapiens
NMLKNFLGE

SEQ ID NO: 1004773 - protein, 9 aa, Homo Sapiens
CSCPERLQL

SEQ ID NO: 1004774 - protein, 9 aa, Homo Sapiens
TLVLPPNKK

SEQ ID NO: 1004775 - protein, 9 aa, Homo Sapiens
TKVIVKLNG

SEQ ID NO: 1004776 - protein, 9 aa, Homo Sapiens
RFGSRMNMG

SEQ ID NO: 1004777 - protein, 9 aa, Homo Sapiens
SIFTLLQFF

SEQ ID NO: 1004778 - protein, 9 aa, Homo Sapiens
CKGFGFVIM

SEQ ID NO: 1004779 - protein, 9 aa, Homo Sapiens
AISMGSAVF

SEQ ID NO: 1004780 - protein, 9 aa, Homo Sapiens
PPEGLATVA

SEQ ID NO: 1004781 - protein, 9 aa, Homo Sapiens
RSSVVSSSH

SEQ ID NO: 1004782 - protein, 9 aa, Homo Sapiens
YTGQKPYKC

SEQ ID NO: 1004783 - protein, 9 aa, Homo Sapiens
RGPGPLSLP

SEQ ID NO: 1004784 - protein, 9 aa, Homo Sapiens
TSLGHNKNQ

SEQ ID NO: 1004785 - protein, 9 aa, Homo Sapiens
TPRSDNAKL

SEQ ID NO: 1004786 - protein, 9 aa, Homo Sapiens
ILAASSYHG

SEQ ID NO: 1004787 - protein, 9 aa, Homo Sapiens
KKIGAIAQV

SEQ ID NO: 1004788 - protein, 9 aa, Homo Sapiens
LTFVHHQRN

SEQ ID NO: 1004789 - protein, 9 aa, Homo Sapiens
IGISNQPVN

SEQ ID NO: 1004790 - protein, 9 aa, Homo Sapiens
DGPLSPPPI

SEQ ID NO: 1004791 - protein, 9 aa, Homo Sapiens
SRRIDYMLH

SEQ ID NO: 1004792 - protein, 9 aa, Homo Sapiens
LLASNVICL

SEQ ID NO: 1004793 - protein, 9 aa, Homo Sapiens
CRDRVVEKS

SEQ ID NO: 1004794 - protein, 9 aa, Homo Sapiens
LSNFYLLVP

SEQ ID NO: 1004795 - protein, 9 aa, Homo Sapiens
STQRAQLEQ

SEQ ID NO: 1004796 - protein, 9 aa, Homo Sapiens
LCRMSCQNH

SEQ ID NO: 1004797 - protein, 9 aa, Homo Sapiens
SNLNRYKIR

SEQ ID NO: 1004798 - protein, 9 aa, Homo Sapiens
MYIFCTDCL

SEQ ID NO: 1004799 - protein, 9 aa, Homo Sapiens
AHVPISPSE

SEQ ID NO: 1004800 - protein, 9 aa, Homo Sapiens
ILGVISVYD

SEQ ID NO: 1004801 - protein, 9 aa, Homo Sapiens
KRTLRKHSD

SEQ ID NO: 1004802 - protein, 9 aa, Homo Sapiens
SEEVIIEKK

SEQ ID NO: 1004803 - protein, 9 aa, Homo Sapiens
IDLDNATFL

SEQ ID NO: 1004804 - protein, 9 aa, Homo Sapiens
KPEQEITPR

SEQ ID NO: 1004805 - protein, 9 aa, Homo Sapiens
QGIFSLDGG

SEQ ID NO: 1004806 - protein, 9 aa, Homo Sapiens
GDLVALGQT

SEQ ID NO: 1004807 - protein, 9 aa, Homo Sapiens
EIDPKKGKI

SEQ ID NO: 1004808 - protein, 9 aa, Homo Sapiens
WGRLHSHCP

SEQ ID NO: 1004809 - protein, 9 aa, Homo Sapiens
KQSSNKNIF

SEQ ID NO: 1004810 - protein, 9 aa, Homo Sapiens
HNQKGSCFI

SEQ ID NO: 1004811 - protein, 9 aa, Homo Sapiens
AGQDGAPGN

SEQ ID NO: 1004812 - protein, 9 aa, Homo Sapiens
IFYSTLIFM

SEQ ID NO: 1004813 - protein, 9 aa, Homo Sapiens
ENFTIIIIS

SEQ ID NO: 1004814 - protein, 9 aa, Homo Sapiens
ILAAITGGY

SEQ ID NO: 1004815 - protein, 9 aa, Homo Sapiens
NKKDTWKFL

SEQ ID NO: 1004816 - protein, 9 aa, Homo Sapiens
LMDSKMTPT

SEQ ID NO: 1004817 - protein, 9 aa, Homo Sapiens
KTGSLEGFS

SEQ ID NO: 1004818 - protein, 9 aa, Homo Sapiens
DLREAATVR

SEQ ID NO: 1004819 - protein, 9 aa, Homo Sapiens
AKTPPPPAI

SEQ ID NO: 1004820 - protein, 9 aa, Homo Sapiens
ASDGKATRT

SEQ ID NO: 1004821 - protein, 9 aa, Homo Sapiens
IGNPVLSLR

SEQ ID NO: 1004822 - protein, 9 aa, Homo Sapiens
CPERLQLNK

SEQ ID NO: 1004823 - protein, 9 aa, Homo Sapiens
CGIQHLEQI

SEQ ID NO: 1004824 - protein, 9 aa, Homo Sapiens
SRSPSLAPR

SEQ ID NO: 1004825 - protein, 9 aa, Homo Sapiens
FSEPMPVVL

SEQ ID NO: 1004826 - protein, 9 aa, Homo Sapiens
ANEYCVSCC

SEQ ID NO: 1004827 - protein, 9 aa, Homo Sapiens
TAYPNAFCI

SEQ ID NO: 1004828 - protein, 9 aa, Homo Sapiens
LDKFYIELL

SEQ ID NO: 1004829 - protein, 9 aa, Homo Sapiens
KYGMGGIII

SEQ ID NO: 1004830 - protein, 9 aa, Homo Sapiens
KFFTYDFVF

SEQ ID NO: 1004831 - protein, 9 aa, Homo Sapiens
VLAREAGED

SEQ ID NO: 1004832 - protein, 9 aa, Homo Sapiens
VRHLEESGL

SEQ ID NO: 1004833 - protein, 9 aa, Homo Sapiens
DISTPVITS

SEQ ID NO: 1004834 - protein, 9 aa, Homo Sapiens
DVCRVESGK

SEQ ID NO: 1004835 - protein, 9 aa, Homo Sapiens
RLFQQALQN

SEQ ID NO: 1004836 - protein, 9 aa, Homo Sapiens
FRSQTLANN

SEQ ID NO: 1004837 - protein, 9 aa, Homo Sapiens
KQFSCLSLQ

SEQ ID NO: 1004838 - protein, 9 aa, Homo Sapiens
VDLLNGENL

SEQ ID NO: 1004839 - protein, 9 aa, Homo Sapiens
SFREQGHAP

SEQ ID NO: 1004840 - protein, 9 aa, Homo Sapiens
IVFTRKDNL

SEQ ID NO: 1004841 - protein, 9 aa, Homo Sapiens
EDGMKFKKY

SEQ ID NO: 1004842 - protein, 9 aa, Homo Sapiens
WVHSNFHFD

SEQ ID NO: 1004843 - protein, 9 aa, Homo Sapiens
SELNSVKYK

SEQ ID NO: 1004844 - protein, 9 aa, Homo Sapiens
TGNKIVNEK

SEQ ID NO: 1004845 - protein, 9 aa, Homo Sapiens
SNVAITTLF

SEQ ID NO: 1004846 - protein, 9 aa, Homo Sapiens
PEMPGLKGL

SEQ ID NO: 1004847 - protein, 9 aa, Homo Sapiens
AFLEQANSF

SEQ ID NO: 1004848 - protein, 9 aa, Homo Sapiens
RQGSHYNQA

SEQ ID NO: 1004849 - protein, 9 aa, Homo Sapiens
LDSSSPDSP

SEQ ID NO: 1004850 - protein, 9 aa, Homo Sapiens
RDRSSSGAL

SEQ ID NO: 1004851 - protein, 9 aa, Homo Sapiens
PPLSCKPRN

SEQ ID NO: 1004852 - protein, 9 aa, Homo Sapiens
CLEACQVPG

SEQ ID NO: 1004853 - protein, 9 aa, Homo Sapiens
SPILAASSY

SEQ ID NO: 1004854 - protein, 9 aa, Homo Sapiens
KQSLPPRFG

SEQ ID NO: 1004855 - protein, 9 aa, Homo Sapiens
ILLEVRWWI

SEQ ID NO: 1004856 - protein, 9 aa, Homo Sapiens
NNVREISVS

SEQ ID NO: 1004857 - protein, 9 aa, Homo Sapiens
NENGLQSCQ

SEQ ID NO: 1004858 - protein, 9 aa, Homo Sapiens
KRVSSLPLQ

SEQ ID NO: 1004859 - protein, 9 aa, Homo Sapiens
QSFHLLVFT

SEQ ID NO: 1004860 - protein, 9 aa, Homo Sapiens
MILNDGDIK

SEQ ID NO: 1004861 - protein, 9 aa, Homo Sapiens
KNISLHNFT

SEQ ID NO: 1004862 - protein, 9 aa, Homo Sapiens
VQIIQELLG

SEQ ID NO: 1004863 - protein, 9 aa, Homo Sapiens
RDVSSRKEA

SEQ ID NO: 1004864 - protein, 9 aa, Homo Sapiens
GGSGSMSLD

SEQ ID NO: 1004865 - protein, 9 aa, Homo Sapiens
IHTGVKPYV

SEQ ID NO: 1004866 - protein, 9 aa, Homo Sapiens
SGKMHIDKR

SEQ ID NO: 1004867 - protein, 9 aa, Homo Sapiens
DKKRSEISC

SEQ ID NO: 1004868 - protein, 9 aa, Homo Sapiens
NSAILNRKI

SEQ ID NO: 1004869 - protein, 9 aa, Homo Sapiens
EHNCKEDDI

SEQ ID NO: 1004870 - protein, 9 aa, Homo Sapiens
VGNSIDHLY

SEQ ID NO: 1004871 - protein, 9 aa, Homo Sapiens
FIETGFCVS

SEQ ID NO: 1004872 - protein, 9 aa, Homo Sapiens
APFCPNGLL

SEQ ID NO: 1004873 - protein, 9 aa, Homo Sapiens
NKIDLQNTV

SEQ ID NO: 1004874 - protein, 9 aa, Homo Sapiens
SLSPSLPHQ

SEQ ID NO: 1004875 - protein, 9 aa, Homo Sapiens
ERSFDSKDT

SEQ ID NO: 1004876 - protein, 9 aa, Homo Sapiens
TRPTAIGSF

SEQ ID NO: 1004877 - protein, 9 aa, Homo Sapiens
EQQKRQVEH

SEQ ID NO: 1004878 - protein, 9 aa, Homo Sapiens
MTKVIVKLN

SEQ ID NO: 1004879 - protein, 9 aa, Homo Sapiens
RDIDTLHES

SEQ ID NO: 1004880 - protein, 9 aa, Homo Sapiens
PAHSILRPG

SEQ ID NO: 1004881 - protein, 9 aa, Homo Sapiens
SQGFLEGAS

SEQ ID NO: 1004882 - protein, 9 aa, Homo Sapiens
VGIRARTGR

SEQ ID NO: 1004883 - protein, 9 aa, Homo Sapiens
SVHSFSDWD

SEQ ID NO: 1004884 - protein, 9 aa, Homo Sapiens
ESGKNCSSP

SEQ ID NO: 1004885 - protein, 9 aa, Homo Sapiens
VSYYRDPNK

SEQ ID NO: 1004886 - protein, 9 aa, Homo Sapiens
FLQDHLDKA

SEQ ID NO: 1004887 - protein, 9 aa, Homo Sapiens
HKGRVLRNF

SEQ ID NO: 1004888 - protein, 9 aa, Homo Sapiens
LHPVYEENK

SEQ ID NO: 1004889 - protein, 9 aa, Homo Sapiens
AKIMTPPTK

SEQ ID NO: 1004890 - protein, 9 aa, Homo Sapiens
PRSDNAKLS

SEQ ID NO: 1004891 - protein, 9 aa, Homo Sapiens
LAIYSDSRL

SEQ ID NO: 1004892 - protein, 9 aa, Homo Sapiens
EDSLSSLQI

SEQ ID NO: 1004893 - protein, 9 aa, Homo Sapiens
TFKNFQMAQ

SEQ ID NO: 1004894 - protein, 9 aa, Homo Sapiens
TDQMTFGEK

SEQ ID NO: 1004895 - protein, 9 aa, Homo Sapiens
DDEDENKEK

SEQ ID NO: 1004896 - protein, 9 aa, Homo Sapiens
GKETFKNFQ

SEQ ID NO: 1004897 - protein, 9 aa, Homo Sapiens
HSGLYQEPI

SEQ ID NO: 1004898 - protein, 9 aa, Homo Sapiens
FAAYLTLAC

SEQ ID NO: 1004899 - protein, 9 aa, Homo Sapiens
CELVKKIFQ

SEQ ID NO: 1004900 - protein, 9 aa, Homo Sapiens
PILAASSYH

SEQ ID NO: 1004901 - protein, 9 aa, Homo Sapiens
LQEPHSGSP

SEQ ID NO: 1004902 - protein, 9 aa, Homo Sapiens
LGTYTCKVS

SEQ ID NO: 1004903 - protein, 9 aa, Homo Sapiens
GSMSLDSSS

SEQ ID NO: 1004904 - protein, 9 aa, Homo Sapiens
SRLENEQFK

SEQ ID NO: 1004905 - protein, 9 aa, Homo Sapiens
ERGELGIGL

SEQ ID NO: 1004906 - protein, 9 aa, Homo Sapiens
SKSEHKNVV

SEQ ID NO: 1004907 - protein, 9 aa, Homo Sapiens
VSDEMRTRA

SEQ ID NO: 1004908 - protein, 9 aa, Homo Sapiens
NQRGRCENG

SEQ ID NO: 1004909 - protein, 9 aa, Homo Sapiens
CAGPHQAGH

SEQ ID NO: 1004910 - protein, 9 aa, Homo Sapiens
EDKRIFLAG

SEQ ID NO: 1004911 - protein, 9 aa, Homo Sapiens
DNAISKSET

SEQ ID NO: 1004912 - protein, 9 aa, Homo Sapiens
ELTRSTRPT

SEQ ID NO: 1004913 - protein, 9 aa, Homo Sapiens
HFAHNKAQW

SEQ ID NO: 1004914 - protein, 9 aa, Homo Sapiens
NWTFYASSI

SEQ ID NO: 1004915 - protein, 9 aa, Homo Sapiens
DCLRISSTK

SEQ ID NO: 1004916 - protein, 9 aa, Homo Sapiens
HFHSMCFIS

SEQ ID NO: 1004917 - protein, 9 aa, Homo Sapiens
DCLLIAVLY

SEQ ID NO: 1004918 - protein, 9 aa, Homo Sapiens
YLMDNLFEY

SEQ ID NO: 1004919 - protein, 9 aa, Homo Sapiens
REAFGNAKT

SEQ ID NO: 1004920 - protein, 9 aa, Homo Sapiens
VKVGNKFVT

SEQ ID NO: 1004921 - protein, 9 aa, Homo Sapiens
LSGPSPTQL

SEQ ID NO: 1004922 - protein, 9 aa, Homo Sapiens
SKLFIIEVV

SEQ ID NO: 1004923 - protein, 9 aa, Homo Sapiens
SSINSSPPR

SEQ ID NO: 1004924 - protein, 9 aa, Homo Sapiens
IPKLSSPKA

SEQ ID NO: 1004925 - protein, 9 aa, Homo Sapiens
ILITELTKS

SEQ ID NO: 1004926 - protein, 9 aa, Homo Sapiens
KSNIKTRSE

SEQ ID NO: 1004927 - protein, 9 aa, Homo Sapiens
KLIDSARRH

SEQ ID NO: 1004928 - protein, 9 aa, Homo Sapiens
DQTDQQKAE

SEQ ID NO: 1004929 - protein, 9 aa, Homo Sapiens
SSSPRLTKP

SEQ ID NO: 1004930 - protein, 9 aa, Homo Sapiens
RTTEEGIIR

SEQ ID NO: 1004931 - protein, 9 aa, Homo Sapiens
LRDYVIEDN

SEQ ID NO: 1004932 - protein, 9 aa, Homo Sapiens
LSSQGEIIE

SEQ ID NO: 1004933 - protein, 9 aa, Homo Sapiens
GFTIIGEDE

SEQ ID NO: 1004934 - protein, 9 aa, Homo Sapiens
SEHNCKEDD

SEQ ID NO: 1004935 - protein, 9 aa, Homo Sapiens
LKMMIILVV

SEQ ID NO: 1004936 - protein, 9 aa, Homo Sapiens
KLFIIEVVN

SEQ ID NO: 1004937 - protein, 9 aa, Homo Sapiens
FFWQTWHDE

SEQ ID NO: 1004938 - protein, 9 aa, Homo Sapiens
IAANLVGAD

SEQ ID NO: 1004939 - protein, 9 aa, Homo Sapiens
FILFTKKKE

SEQ ID NO: 1004940 - protein, 9 aa, Homo Sapiens
WSGAWALSC

SEQ ID NO: 1004941 - protein, 9 aa, Homo Sapiens
TTVCRLVTC

SEQ ID NO: 1004942 - protein, 9 aa, Homo Sapiens
AAKESSLMN

SEQ ID NO: 1004943 - protein, 9 aa, Homo Sapiens
DKGQKKVPG

SEQ ID NO: 1004944 - protein, 9 aa, Homo Sapiens
DKENPPLSS

SEQ ID NO: 1004945 - protein, 9 aa, Homo Sapiens
AAARPPATL

SEQ ID NO: 1004946 - protein, 9 aa, Homo Sapiens
KFKKYECVK

SEQ ID NO: 1004947 - protein, 9 aa, Homo Sapiens
ADLESPILA

SEQ ID NO: 1004948 - protein, 9 aa, Homo Sapiens
RTQANSMEG

SEQ ID NO: 1004949 - protein, 9 aa, Homo Sapiens
EVIIEKKKI

SEQ ID NO: 1004950 - protein, 9 aa, Homo Sapiens
MAFDCFVAI

SEQ ID NO: 1004951 - protein, 9 aa, Homo Sapiens
DKEGESYSK

SEQ ID NO: 1004952 - protein, 9 aa, Homo Sapiens
LSFFEQFCK

SEQ ID NO: 1004953 - protein, 9 aa, Homo Sapiens
LLHPRIVQL

SEQ ID NO: 1004954 - protein, 9 aa, Homo Sapiens
SIPKDKLEG

SEQ ID NO: 1004955 - protein, 9 aa, Homo Sapiens
YITKEEKKV

SEQ ID NO: 1004956 - protein, 9 aa, Homo Sapiens
TMKSRWSGS

SEQ ID NO: 1004957 - protein, 9 aa, Homo Sapiens
YHDQGWAKI

SEQ ID NO: 1004958 - protein, 9 aa, Homo Sapiens
SGLYQEPID

SEQ ID NO: 1004959 - protein, 9 aa, Homo Sapiens
INNKPEESL

SEQ ID NO: 1004960 - protein, 9 aa, Homo Sapiens
WEAPFCPNG

SEQ ID NO: 1004961 - protein, 9 aa, Homo Sapiens
YETLSEKMT

SEQ ID NO: 1004962 - protein, 9 aa, Homo Sapiens
KPHFMVPKE

SEQ ID NO: 1004963 - protein, 9 aa, Homo Sapiens
PMDPSRPLS

SEQ ID NO: 1004964 - protein, 9 aa, Homo Sapiens
SVSNLHVKP

SEQ ID NO: 1004965 - protein, 9 aa, Homo Sapiens
TRPDTSFFI

SEQ ID NO: 1004966 - protein, 9 aa, Homo Sapiens
PGQLSSPRA

SEQ ID NO: 1004967 - protein, 9 aa, Homo Sapiens
SRPTGTLKL

SEQ ID NO: 1004968 - protein, 9 aa, Homo Sapiens
GGIIIVLLI

SEQ ID NO: 1004969 - protein, 9 aa, Homo Sapiens
NGDDGLISP

SEQ ID NO: 1004970 - protein, 9 aa, Homo Sapiens
ITKEEKKVP

SEQ ID NO: 1004971 - protein, 9 aa, Homo Sapiens
RAERNNARE

SEQ ID NO: 1004972 - protein, 9 aa, Homo Sapiens
DSLSSLQIP

SEQ ID NO: 1004973 - protein, 9 aa, Homo Sapiens
QEPVRFENI

SEQ ID NO: 1004974 - protein, 9 aa, Homo Sapiens
CIKNSVLHC

SEQ ID NO: 1004975 - protein, 9 aa, Homo Sapiens
LLRVGPSPR

SEQ ID NO: 1004976 - protein, 9 aa, Homo Sapiens
LDSSFRNKI

SEQ ID NO: 1004977 - protein, 9 aa, Homo Sapiens
TAKIMTPPT

SEQ ID NO: 1004978 - protein, 9 aa, Homo Sapiens
ELGIGLPGS

SEQ ID NO: 1004979 - protein, 9 aa, Homo Sapiens
TDTWVYEYI

SEQ ID NO: 1004980 - protein, 9 aa, Homo Sapiens
VSTVASSTD

SEQ ID NO: 1004981 - protein, 9 aa, Homo Sapiens
LTFFIAVTE

SEQ ID NO: 1004982 - protein, 9 aa, Homo Sapiens
VGTVGMDMN

SEQ ID NO: 1004983 - protein, 9 aa, Homo Sapiens
MIDLPRSTV

SEQ ID NO: 1004984 - protein, 9 aa, Homo Sapiens
KWGSGDPEA

SEQ ID NO: 1004985 - protein, 9 aa, Homo Sapiens
AREINNVAG

SEQ ID NO: 1004986 - protein, 9 aa, Homo Sapiens
CKVRKITVR

SEQ ID NO: 1004987 - protein, 9 aa, Homo Sapiens
FGLNKLTTF

SEQ ID NO: 1004988 - protein, 9 aa, Homo Sapiens
RVLFPESLS

SEQ ID NO: 1004989 - protein, 9 aa, Homo Sapiens
EVILSAYIT

SEQ ID NO: 1004990 - protein, 9 aa, Homo Sapiens
SYSLYGICL

SEQ ID NO: 1004991 - protein, 9 aa, Homo Sapiens
GAGVTALLT

SEQ ID NO: 1004992 - protein, 9 aa, Homo Sapiens
GKDDLGVVR

SEQ ID NO: 1004993 - protein, 9 aa, Homo Sapiens
GQDVWADEL

SEQ ID NO: 1004994 - protein, 9 aa, Homo Sapiens
HISGRCVRL

SEQ ID NO: 1004995 - protein, 9 aa, Homo Sapiens
VCSRLENEQ

SEQ ID NO: 1004996 - protein, 9 aa, Homo Sapiens
KLQTCKRSY

SEQ ID NO: 1004997 - protein, 9 aa, Homo Sapiens
PLFLGQHGF

SEQ ID NO: 1004998 - protein, 9 aa, Homo Sapiens
DTPKTATGS

SEQ ID NO: 1004999 - protein, 9 aa, Homo Sapiens
TANFEIDPK

SEQ ID NO: 1005000 - protein, 9 aa, Homo Sapiens
LKCTPRVCS

SEQ ID NO: 1005001 - protein, 9 aa, Homo Sapiens
DKIDRLLQS

SEQ ID NO: 1005002 - protein, 9 aa, Homo Sapiens
PLRKEAKKF

SEQ ID NO: 1005003 - protein, 9 aa, Homo Sapiens
LSSPGSRPC

SEQ ID NO: 1005004 - protein, 9 aa, Homo Sapiens
SPKAMLPLY

SEQ ID NO: 1005005 - protein, 9 aa, Homo Sapiens
PTSRKKETR

SEQ ID NO: 1005006 - protein, 9 aa, Homo Sapiens
SKLQKLARS

SEQ ID NO: 1005007 - protein, 9 aa, Homo Sapiens
CEEEPFIDP

SEQ ID NO: 1005008 - protein, 9 aa, Homo Sapiens
AGEDINVQQ

SEQ ID NO: 1005009 - protein, 9 aa, Homo Sapiens
RLHSHCPRH

SEQ ID NO: 1005010 - protein, 9 aa, Homo Sapiens
TTQPPSIDC

SEQ ID NO: 1005011 - protein, 9 aa, Homo Sapiens
NAWQLHRTC

SEQ ID NO: 1005012 - protein, 9 aa, Homo Sapiens
LDYLLLLAL

SEQ ID NO: 1005013 - protein, 9 aa, Homo Sapiens
MRARFRTLL

SEQ ID NO: 1005014 - protein, 9 aa, Homo Sapiens
QTILKKFIL

SEQ ID NO: 1005015 - protein, 9 aa, Homo Sapiens
HLLVFTKST

SEQ ID NO: 1005016 - protein, 9 aa, Homo Sapiens
TVEHALIWR

SEQ ID NO: 1005017 - protein, 9 aa, Homo Sapiens
PRAGVREDV

SEQ ID NO: 1005018 - protein, 9 aa, Homo Sapiens
SDLPFFWRA

SEQ ID NO: 1005019 - protein, 9 aa, Homo Sapiens
RIGIPAQRL

SEQ ID NO: 1005020 - protein, 9 aa, Homo Sapiens
KFSEDFESC

SEQ ID NO: 1005021 - protein, 9 aa, Homo Sapiens
MKVLLRVGP

SEQ ID NO: 1005022 - protein, 9 aa, Homo Sapiens
DVWADELCQ

SEQ ID NO: 1005023 - protein, 9 aa, Homo Sapiens
PPRAGVRED

SEQ ID NO: 1005024 - protein, 9 aa, Homo Sapiens
PCAFLCTKL

SEQ ID NO: 1005025 - protein, 9 aa, Homo Sapiens
LTRLKHLRV

SEQ ID NO: 1005026 - protein, 9 aa, Homo Sapiens
IFCTDCLLI

SEQ ID NO: 1005027 - protein, 9 aa, Homo Sapiens
EPTDWITSN

SEQ ID NO: 1005028 - protein, 9 aa, Homo Sapiens
CRGPTDCSW

SEQ ID NO: 1005029 - protein, 9 aa, Homo Sapiens
EKQEQMFAF

SEQ ID NO: 1005030 - protein, 9 aa, Homo Sapiens
HEDPQCLSR

SEQ ID NO: 1005031 - protein, 9 aa, Homo Sapiens
VVGTDKFFT

SEQ ID NO: 1005032 - protein, 9 aa, Homo Sapiens
EGGFTCFFQ

SEQ ID NO: 1005033 - protein, 9 aa, Homo Sapiens
IGSFSSHMT

SEQ ID NO: 1005034 - protein, 9 aa, Homo Sapiens
GGQCQDNQG

SEQ ID NO: 1005035 - protein, 9 aa, Homo Sapiens
IEDNVNMAI

SEQ ID NO: 1005036 - protein, 9 aa, Homo Sapiens
RRFMAVLRR

SEQ ID NO: 1005037 - protein, 9 aa, Homo Sapiens
QVLFPYPEN

SEQ ID NO: 1005038 - protein, 9 aa, Homo Sapiens
HAASILVLN

SEQ ID NO: 1005039 - protein, 9 aa, Homo Sapiens
EGESPSLPQ

SEQ ID NO: 1005040 - protein, 9 aa, Homo Sapiens
HFALQPSTE

SEQ ID NO: 1005041 - protein, 9 aa, Homo Sapiens
GTDSAGESL

SEQ ID NO: 1005042 - protein, 9 aa, Homo Sapiens
IAYRHNQKG

SEQ ID NO: 1005043 - protein, 9 aa, Homo Sapiens
QTDQQKAEW

SEQ ID NO: 1005044 - protein, 9 aa, Homo Sapiens
YMGILLFHA

SEQ ID NO: 1005045 - protein, 9 aa, Homo Sapiens
LGTIGVNCS

SEQ ID NO: 1005046 - protein, 9 aa, Homo Sapiens
AFQGPTFFH

SEQ ID NO: 1005047 - protein, 9 aa, Homo Sapiens
EEHVLGTIF

SEQ ID NO: 1005048 - protein, 9 aa, Homo Sapiens
VVVSMYYLR

SEQ ID NO: 1005049 - protein, 9 aa, Homo Sapiens
TSTGVMLAL

SEQ ID NO: 1005050 - protein, 9 aa, Homo Sapiens
AQIEDEAHP

SEQ ID NO: 1005051 - protein, 9 aa, Homo Sapiens
SETQPFSSN

SEQ ID NO: 1005052 - protein, 9 aa, Homo Sapiens
GYHSMPHEV

SEQ ID NO: 1005053 - protein, 9 aa, Homo Sapiens
LYRDVMLKN

SEQ ID NO: 1005054 - protein, 9 aa, Homo Sapiens
KRPCGRSSS

SEQ ID NO: 1005055 - protein, 8 aa, Homo Sapiens
DCAEGRAA

SEQ ID NO: 1005056 - protein, 9 aa, Homo Sapiens
FFPRNADID

SEQ ID NO: 1005057 - protein, 9 aa, Homo Sapiens
IGIPAQRLG

SEQ ID NO: 1005058 - protein, 9 aa, Homo Sapiens
HYNQAQDSS

SEQ ID NO: 1005059 - protein, 9 aa, Homo Sapiens
VSCLFCTKV

SEQ ID NO: 1005060 - protein, 9 aa, Homo Sapiens
RGDSHLQLE

SEQ ID NO: 1005061 - protein, 9 aa, Homo Sapiens
NCSRPSEVP

SEQ ID NO: 1005062 - protein, 9 aa, Homo Sapiens
ESYNELNQY

SEQ ID NO: 1005063 - protein, 9 aa, Homo Sapiens
NVAGEIDSV

SEQ ID NO: 1005064 - protein, 9 aa, Homo Sapiens
SIPHFLLWK

SEQ ID NO: 1005065 - protein, 9 aa, Homo Sapiens
DPGFAGNWG

SEQ ID NO: 1005066 - protein, 9 aa, Homo Sapiens
GVFILLVRY

SEQ ID NO: 1005067 - protein, 9 aa, Homo Sapiens
KERMHDELL

SEQ ID NO: 1005068 - protein, 9 aa, Homo Sapiens
RHREWVHSN

SEQ ID NO: 1005069 - protein, 9 aa, Homo Sapiens
ENNGQRKNI

SEQ ID NO: 1005070 - protein, 9 aa, Homo Sapiens
QWEKKSGES

SEQ ID NO: 1005071 - protein, 9 aa, Homo Sapiens
RSSVTSPLV

SEQ ID NO: 1005072 - protein, 9 aa, Homo Sapiens
GRNLLLPSP

SEQ ID NO: 1005073 - protein, 9 aa, Homo Sapiens
FDCFVAICY

SEQ ID NO: 1005074 - protein, 9 aa, Homo Sapiens
SINSSPPRC

SEQ ID NO: 1005075 - protein, 9 aa, Homo Sapiens
RSRVSSRKQ

SEQ ID NO: 1005076 - protein, 9 aa, Homo Sapiens
NKRQFYAIT

SEQ ID NO: 1005077 - protein, 9 aa, Homo Sapiens
KPIHMDFLR

SEQ ID NO: 1005078 - protein, 9 aa, Homo Sapiens
VYKKRVSAA

SEQ ID NO: 1005079 - protein, 9 aa, Homo Sapiens
GDLIVKVNK

SEQ ID NO: 1005080 - protein, 9 aa, Homo Sapiens
KTLHRASYY

SEQ ID NO: 1005081 - protein, 9 aa, Homo Sapiens
LHSHCPRHC

SEQ ID NO: 1005082 - protein, 9 aa, Homo Sapiens
GIPQKIFLQ

SEQ ID NO: 1005083 - protein, 9 aa, Homo Sapiens
ARWSGAWAL

SEQ ID NO: 1005084 - protein, 9 aa, Homo Sapiens
VFWKVPRLG

SEQ ID NO: 1005085 - protein, 9 aa, Homo Sapiens
FNSNPLQRH

SEQ ID NO: 1005086 - protein, 9 aa, Homo Sapiens
PSLYRDYRG

SEQ ID NO: 1005087 - protein, 9 aa, Homo Sapiens
VFFAAYLTL

SEQ ID NO: 1005088 - protein, 9 aa, Homo Sapiens
GERGFQEKP

SEQ ID NO: 1005089 - protein, 9 aa, Homo Sapiens
RTESTTDEG

SEQ ID NO: 1005090 - protein, 9 aa, Homo Sapiens
VLFCLLLLY

SEQ ID NO: 1005091 - protein, 9 aa, Homo Sapiens
RDVMLKNYS

SEQ ID NO: 1005092 - protein, 9 aa, Homo Sapiens
CLLIAVLYF

SEQ ID NO: 1005093 - protein, 9 aa, Homo Sapiens
SYSLFTIVL

SEQ ID NO: 1005094 - protein, 9 aa, Homo Sapiens
MTIHAAEWV

SEQ ID NO: 1005095 - protein, 9 aa, Homo Sapiens
RSPVVPEEV

SEQ ID NO: 1005096 - protein, 9 aa, Homo Sapiens
TKPQFSQFF

SEQ ID NO: 1005097 - protein, 9 aa, Homo Sapiens
GICLEACQV

SEQ ID NO: 1005098 - protein, 9 aa, Homo Sapiens
QANSMEGLM

SEQ ID NO: 1005099 - protein, 9 aa, Homo Sapiens
TERDGVYTL

SEQ ID NO: 1005100 - protein, 9 aa, Homo Sapiens
NQLTERDKF

SEQ ID NO: 1005101 - protein, 9 aa, Homo Sapiens
LQHVYNPVD

SEQ ID NO: 1005102 - protein, 9 aa, Homo Sapiens
WDHDPIERD

SEQ ID NO: 1005103 - protein, 9 aa, Homo Sapiens
GVVVIPRSF

SEQ ID NO: 1005104 - protein, 9 aa, Homo Sapiens
ARPPDQKDN

SEQ ID NO: 1005105 - protein, 9 aa, Homo Sapiens
GDSDLVGAL

SEQ ID NO: 1005106 - protein, 9 aa, Homo Sapiens
FKTHEITQL

SEQ ID NO: 1005107 - protein, 9 aa, Homo Sapiens
TEKVPLFPL

SEQ ID NO: 1005108 - protein, 9 aa, Homo Sapiens
LNLASVARF

SEQ ID NO: 1005109 - protein, 9 aa, Homo Sapiens
FSDKEVKDC

SEQ ID NO: 1005110 - protein, 9 aa, Homo Sapiens
FWAIQRRLL

SEQ ID NO: 1005111 - protein, 9 aa, Homo Sapiens
LGINEPLHL

SEQ ID NO: 1005112 - protein, 9 aa, Homo Sapiens
TAKGAQEEP

SEQ ID NO: 1005113 - protein, 9 aa, Homo Sapiens
PLFLAAKDN

SEQ ID NO: 1005114 - protein, 9 aa, Homo Sapiens
TQFLPTHAR

SEQ ID NO: 1005115 - protein, 9 aa, Homo Sapiens
EELDYLLLL

SEQ ID NO: 1005116 - protein, 9 aa, Homo Sapiens
QKGKEYYIK

SEQ ID NO: 1005117 - protein, 9 aa, Homo Sapiens
LTENALEDL

SEQ ID NO: 1005118 - protein, 9 aa, Homo Sapiens
HELPLTDRY

SEQ ID NO: 1005119 - protein, 9 aa, Homo Sapiens
VLPPNKKEQ

SEQ ID NO: 1005120 - protein, 9 aa, Homo Sapiens
FWSQVLPQE

SEQ ID NO: 1005121 - protein, 9 aa, Homo Sapiens
PVSLRVKRP

SEQ ID NO: 1005122 - protein, 9 aa, Homo Sapiens
MATSQYFNF

SEQ ID NO: 1005123 - protein, 9 aa, Homo Sapiens
MASSEESTE

SEQ ID NO: 1005124 - protein, 9 aa, Homo Sapiens
KTAIISLAE

SEQ ID NO: 1005125 - protein, 9 aa, Homo Sapiens
LEACQVPGP

SEQ ID NO: 1005126 - protein, 9 aa, Homo Sapiens
YEENKSEYF

SEQ ID NO: 1005127 - protein, 9 aa, Homo Sapiens
YTAQDKWAL

SEQ ID NO: 1005128 - protein, 9 aa, Homo Sapiens
TFFIVPSHC

SEQ ID NO: 1005129 - protein, 9 aa, Homo Sapiens
SWAQIRLPT

SEQ ID NO: 1005130 - protein, 9 aa, Homo Sapiens
TSPREDLIK

SEQ ID NO: 1005131 - protein, 9 aa, Homo Sapiens
NFKTSEIQK

SEQ ID NO: 1005132 - protein, 9 aa, Homo Sapiens
LPLSLFFLL

SEQ ID NO: 1005133 - protein, 9 aa, Homo Sapiens
FCPNGLLTH

SEQ ID NO: 1005134 - protein, 9 aa, Homo Sapiens
CVSWESSLG

SEQ ID NO: 1005135 - protein, 9 aa, Homo Sapiens
KPGPRRQSS

SEQ ID NO: 1005136 - protein, 9 aa, Homo Sapiens
KYESYLGVN

SEQ ID NO: 1005137 - protein, 9 aa, Homo Sapiens
YVSLVEPGF

SEQ ID NO: 1005138 - protein, 9 aa, Homo Sapiens
VLYTHSQTN

SEQ ID NO: 1005139 - protein, 9 aa, Homo Sapiens
TLKLPPPAG

SEQ ID NO: 1005140 - protein, 9 aa, Homo Sapiens
LSRHSKELQ

SEQ ID NO: 1005141 - protein, 9 aa, Homo Sapiens
TDNASILLQ

SEQ ID NO: 1005142 - protein, 9 aa, Homo Sapiens
PYFYGDRID

SEQ ID NO: 1005143 - protein, 9 aa, Homo Sapiens
DVSDEMRTR

SEQ ID NO: 1005144 - protein, 9 aa, Homo Sapiens
YREDLIVYE

SEQ ID NO: 1005145 - protein, 9 aa, Homo Sapiens
ISGTKQKIF

SEQ ID NO: 1005146 - protein, 9 aa, Homo Sapiens
HGIVFARMA

SEQ ID NO: 1005147 - protein, 9 aa, Homo Sapiens
TQVFQAGDL

SEQ ID NO: 1005148 - protein, 9 aa, Homo Sapiens
FLVEESRAS

SEQ ID NO: 1005149 - protein, 9 aa, Homo Sapiens
EPEDSASAP

SEQ ID NO: 1005150 - protein, 9 aa, Homo Sapiens
VPLFPLPGP

SEQ ID NO: 1005151 - protein, 9 aa, Homo Sapiens
QREGTKYVS

SEQ ID NO: 1005152 - protein, 9 aa, Homo Sapiens
MGCDLPQTH

SEQ ID NO: 1005153 - protein, 9 aa, Homo Sapiens
LDRWGQEKE

SEQ ID NO: 1005154 - protein, 9 aa, Homo Sapiens
DIIKKTINF

SEQ ID NO: 1005155 - protein, 9 aa, Homo Sapiens
ESSDCITLE

SEQ ID NO: 1005156 - protein, 9 aa, Homo Sapiens
CSQAPVLLS

SEQ ID NO: 1005157 - protein, 9 aa, Homo Sapiens
EQKRMRNEI

SEQ ID NO: 1005158 - protein, 9 aa, Homo Sapiens
GLGHKSDHY

SEQ ID NO: 1005159 - protein, 9 aa, Homo Sapiens
QVLHERFHF

SEQ ID NO: 1005160 - protein, 9 aa, Homo Sapiens
EYRHISGRC

SEQ ID NO: 1005161 - protein, 9 aa, Homo Sapiens
MLFAIDKIN

SEQ ID NO: 1005162 - protein, 9 aa, Homo Sapiens
TGSNLVAQV

SEQ ID NO: 1005163 - protein, 9 aa, Homo Sapiens
NIFSPHTPS

SEQ ID NO: 1005164 - protein, 9 aa, Homo Sapiens
VVIKAGKDD

SEQ ID NO: 1005165 - protein, 9 aa, Homo Sapiens
IILPENFLI

SEQ ID NO: 1005166 - protein, 9 aa, Homo Sapiens
PSISTKKNT

SEQ ID NO: 1005167 - protein, 9 aa, Homo Sapiens
SGKLNIDEY

SEQ ID NO: 1005168 - protein, 9 aa, Homo Sapiens
AYYYGLLGN

SEQ ID NO: 1005169 - protein, 9 aa, Homo Sapiens
QKAEWLVLL

SEQ ID NO: 1005170 - protein, 9 aa, Homo Sapiens
LPSLYRDYR

SEQ ID NO: 1005171 - protein, 9 aa, Homo Sapiens
LAMAVGFPV

SEQ ID NO: 1005172 - protein, 9 aa, Homo Sapiens
KISSARSLD

SEQ ID NO: 1005173 - protein, 9 aa, Homo Sapiens
RPHYPPMPT

SEQ ID NO: 1005174 - protein, 9 aa, Homo Sapiens
LGASLWLQV

SEQ ID NO: 1005175 - protein, 9 aa, Homo Sapiens
NEYCVSCCL

SEQ ID NO: 1005176 - protein, 9 aa, Homo Sapiens
EGDLIVKVN

SEQ ID NO: 1005177 - protein, 9 aa, Homo Sapiens
RSYQLIHAA

SEQ ID NO: 1005178 - protein, 9 aa, Homo Sapiens
NKKYESYLG

SEQ ID NO: 1005179 - protein, 9 aa, Homo Sapiens
RSQVQELER

SEQ ID NO: 1005180 - protein, 9 aa, Homo Sapiens
PEAKGPLPC

SEQ ID NO: 1005181 - protein, 9 aa, Homo Sapiens
GLPGFKDWQ

SEQ ID NO: 1005182 - protein, 9 aa, Homo Sapiens
DSEKSFINH

SEQ ID NO: 1005183 - protein, 9 aa, Homo Sapiens
SLYRDYRGK

SEQ ID NO: 1005184 - protein, 9 aa, Homo Sapiens
LPLLENLII

SEQ ID NO: 1005185 - protein, 9 aa, Homo Sapiens
AILTLEGPS

SEQ ID NO: 1005186 - protein, 9 aa, Homo Sapiens
PKVTLETPC

SEQ ID NO: 1005187 - protein, 9 aa, Homo Sapiens
FTCFFQDHS

SEQ ID NO: 1005188 - protein, 9 aa, Homo Sapiens
YRHNQKGSC

SEQ ID NO: 1005189 - protein, 9 aa, Homo Sapiens
LRNRGDDVF

SEQ ID NO: 1005190 - protein, 9 aa, Homo Sapiens
TAFLQEPHS

SEQ ID NO: 1005191 - protein, 9 aa, Homo Sapiens
DASKENEAG

SEQ ID NO: 1005192 - protein, 9 aa, Homo Sapiens
NPSLVLAFL

SEQ ID NO: 1005193 - protein, 9 aa, Homo Sapiens
ISGLVTSAA

SEQ ID NO: 1005194 - protein, 9 aa, Homo Sapiens
SHCRKIFPG

SEQ ID NO: 1005195 - protein, 9 aa, Homo Sapiens
VARQFSEPM

SEQ ID NO: 1005196 - protein, 9 aa, Homo Sapiens
ADPGVALSS

SEQ ID NO: 1005197 - protein, 9 aa, Homo Sapiens
AQTQGLVKA

SEQ ID NO: 1005198 - protein, 9 aa, Homo Sapiens
FDSKDTRHQ

SEQ ID NO: 1005199 - protein, 9 aa, Homo Sapiens
DVPGPPRAS

SEQ ID NO: 1005200 - protein, 9 aa, Homo Sapiens
IEQSGPPYE

SEQ ID NO: 1005201 - protein, 9 aa, Homo Sapiens
LSWERGGRA

SEQ ID NO: 1005202 - protein, 9 aa, Homo Sapiens
SGKTSLVSL

SEQ ID NO: 1005203 - protein, 9 aa, Homo Sapiens
ICEDGNSIS

SEQ ID NO: 1005204 - protein, 9 aa, Homo Sapiens
CGRHIYSTD

SEQ ID NO: 1005205 - protein, 9 aa, Homo Sapiens
CSSVKVWSH

SEQ ID NO: 1005206 - protein, 9 aa, Homo Sapiens
NAVISDMAF

SEQ ID NO: 1005207 - protein, 9 aa, Homo Sapiens
TVKKRKQQN

SEQ ID NO: 1005208 - protein, 9 aa, Homo Sapiens
DGDYNYDQD

SEQ ID NO: 1005209 - protein, 9 aa, Homo Sapiens
HGQVNNASA

SEQ ID NO: 1005210 - protein, 9 aa, Homo Sapiens
LSRQNCLFL

SEQ ID NO: 1005211 - protein, 9 aa, Homo Sapiens
LFCLLLLYP

SEQ ID NO: 1005212 - protein, 9 aa, Homo Sapiens
PVWEKRVRI

SEQ ID NO: 1005213 - protein, 9 aa, Homo Sapiens
PLDLSVRPN

SEQ ID NO: 1005214 - protein, 9 aa, Homo Sapiens
PGRYFEHYQ

SEQ ID NO: 1005215 - protein, 9 aa, Homo Sapiens
KTRRFMAVL

SEQ ID NO: 1005216 - protein, 9 aa, Homo Sapiens
GFETDLQDF

SEQ ID NO: 1005217 - protein, 9 aa, Homo Sapiens
LAVTPPGVA

SEQ ID NO: 1005218 - protein, 9 aa, Homo Sapiens
REVNGLING

SEQ ID NO: 1005219 - protein, 9 aa, Homo Sapiens
SLNDDKEEK

SEQ ID NO: 1005220 - protein, 9 aa, Homo Sapiens
LHERFHFPY

SEQ ID NO: 1005221 - protein, 9 aa, Homo Sapiens
QNRIAHSPE

SEQ ID NO: 1005222 - protein, 9 aa, Homo Sapiens
PRVLFPESL

SEQ ID NO: 1005223 - protein, 9 aa, Homo Sapiens
DKEQELQNV

SEQ ID NO: 1005224 - protein, 9 aa, Homo Sapiens
HVKPCGTNT

SEQ ID NO: 1005225 - protein, 9 aa, Homo Sapiens
VFLTMDTWP

SEQ ID NO: 1005226 - protein, 9 aa, Homo Sapiens
RAVRSLLRL

SEQ ID NO: 1005227 - protein, 9 aa, Homo Sapiens
NHKGYRKLV

SEQ ID NO: 1005228 - protein, 9 aa, Homo Sapiens
PSLSADMNG

SEQ ID NO: 1005229 - protein, 9 aa, Homo Sapiens
CHKCGRVGP

SEQ ID NO: 1005230 - protein, 9 aa, Homo Sapiens
VDSLVDSTV

SEQ ID NO: 1005231 - protein, 9 aa, Homo Sapiens
PLISLLLRG

SEQ ID NO: 1005232 - protein, 9 aa, Homo Sapiens
RRKRKHRSE

SEQ ID NO: 1005233 - protein, 9 aa, Homo Sapiens
QSRCGRFLV

SEQ ID NO: 1005234 - protein, 9 aa, Homo Sapiens
NFIVATEES

SEQ ID NO: 1005235 - protein, 9 aa, Homo Sapiens
FRRKRKHRS

SEQ ID NO: 1005236 - protein, 9 aa, Homo Sapiens
LAAKESSLM

SEQ ID NO: 1005237 - protein, 9 aa, Homo Sapiens
LSLPLSLFF

SEQ ID NO: 1005238 - protein, 9 aa, Homo Sapiens
RSLPRVLFP

SEQ ID NO: 1005239 - protein, 9 aa, Homo Sapiens
ILMENNFRR

SEQ ID NO: 1005240 - protein, 9 aa, Homo Sapiens
GWLKVRQFY

SEQ ID NO: 1005241 - protein, 9 aa, Homo Sapiens
GLVTPTEKG

SEQ ID NO: 1005242 - protein, 9 aa, Homo Sapiens
PVVARVNCR

SEQ ID NO: 1005243 - protein, 9 aa, Homo Sapiens
NIKTRSESI

SEQ ID NO: 1005244 - protein, 9 aa, Homo Sapiens
RVNCRMQHI

SEQ ID NO: 1005245 - protein, 9 aa, Homo Sapiens
MNKTVNQHA

SEQ ID NO: 1005246 - protein, 9 aa, Homo Sapiens
LCNKEVRET

SEQ ID NO: 1005247 - protein, 9 aa, Homo Sapiens
GPTDCSWGK

SEQ ID NO: 1005248 - protein, 9 aa, Homo Sapiens
SAIPLTLGM

SEQ ID NO: 1005249 - protein, 9 aa, Homo Sapiens
IFPRTWCFP

SEQ ID NO: 1005250 - protein, 9 aa, Homo Sapiens
NVATVLLLN

SEQ ID NO: 1005251 - protein, 9 aa, Homo Sapiens
KVRKITVRT

SEQ ID NO: 1005252 - protein, 9 aa, Homo Sapiens
SFLVEESRA

SEQ ID NO: 1005253 - protein, 9 aa, Homo Sapiens
PLSGSQLSL

SEQ ID NO: 1005254 - protein, 9 aa, Homo Sapiens
WPPVWEKRV

SEQ ID NO: 1005255 - protein, 9 aa, Homo Sapiens
QAILITELT

SEQ ID NO: 1005256 - protein, 9 aa, Homo Sapiens
LLRSVFWKK

SEQ ID NO: 1005257 - protein, 9 aa, Homo Sapiens
GVTQFLPTH

SEQ ID NO: 1005258 - protein, 9 aa, Homo Sapiens
PVLETYGAQ

SEQ ID NO: 1005259 - protein, 9 aa, Homo Sapiens
KRIYTREKA

SEQ ID NO: 1005260 - protein, 9 aa, Homo Sapiens
LFLFFTGHR

SEQ ID NO: 1005261 - protein, 9 aa, Homo Sapiens
ALSSQGEII

SEQ ID NO: 1005262 - protein, 9 aa, Homo Sapiens
EPGVLGPSG

SEQ ID NO: 1005263 - protein, 9 aa, Homo Sapiens
VFSECIEGV

SEQ ID NO: 1005264 - protein, 9 aa, Homo Sapiens
PQKIFLQDH

SEQ ID NO: 1005265 - protein, 9 aa, Homo Sapiens
NLQEEIEKQ

SEQ ID NO: 1005266 - protein, 9 aa, Homo Sapiens
TLRTPSNGP

SEQ ID NO: 1005267 - protein, 9 aa, Homo Sapiens
AILAMAVGF

SEQ ID NO: 1005268 - protein, 9 aa, Homo Sapiens
NKPEESLKE

SEQ ID NO: 1005269 - protein, 9 aa, Homo Sapiens
SLIFYRKEI

SEQ ID NO: 1005270 - protein, 9 aa, Homo Sapiens
VESSQAQSC

SEQ ID NO: 1005271 - protein, 9 aa, Homo Sapiens
SRHSKELQI

SEQ ID NO: 1005272 - protein, 9 aa, Homo Sapiens
SGTKQKIFQ

SEQ ID NO: 1005273 - protein, 9 aa, Homo Sapiens
LSSQGQDRH

SEQ ID NO: 1005274 - protein, 9 aa, Homo Sapiens
GGKKGSSPV

SEQ ID NO: 1005275 - protein, 9 aa, Homo Sapiens
TPTNRKNHS

SEQ ID NO: 1005276 - protein, 9 aa, Homo Sapiens
IELTRSTRP

SEQ ID NO: 1005277 - protein, 9 aa, Homo Sapiens
GNSPALEAS

SEQ ID NO: 1005278 - protein, 9 aa, Homo Sapiens
YICMSEAQS

SEQ ID NO: 1005279 - protein, 9 aa, Homo Sapiens
FLYTVMSYN

SEQ ID NO: 1005280 - protein, 9 aa, Homo Sapiens
RTERDGVYT

SEQ ID NO: 1005281 - protein, 9 aa, Homo Sapiens
VNKNKNSSI

SEQ ID NO: 1005282 - protein, 9 aa, Homo Sapiens
SDSEKSFIN

SEQ ID NO: 1005283 - protein, 9 aa, Homo Sapiens
APGQLSSPR

SEQ ID NO: 1005284 - protein, 9 aa, Homo Sapiens
KKCLSQSEQ

SEQ ID NO: 1005285 - protein, 9 aa, Homo Sapiens
GLSASPPSP

SEQ ID NO: 1005286 - protein, 9 aa, Homo Sapiens
SEKETSKLP

SEQ ID NO: 1005287 - protein, 9 aa, Homo Sapiens
AGVGAASGA

SEQ ID NO: 1005288 - protein, 9 aa, Homo Sapiens
EPQNKLWIE

SEQ ID NO: 1005289 - protein, 9 aa, Homo Sapiens
TRLKHLRVL

SEQ ID NO: 1005290 - protein, 9 aa, Homo Sapiens
KTTQPPSID

SEQ ID NO: 1005291 - protein, 9 aa, Homo Sapiens
KDTPTNRKN

SEQ ID NO: 1005292 - protein, 9 aa, Homo Sapiens
GAIQRSDAG

SEQ ID NO: 1005293 - protein, 9 aa, Homo Sapiens
LNCSRPSEV

SEQ ID NO: 1005294 - protein, 9 aa, Homo Sapiens
YISKLSKSN

SEQ ID NO: 1005295 - protein, 9 aa, Homo Sapiens
LQTESCVPE

SEQ ID NO: 1005296 - protein, 9 aa, Homo Sapiens
WLERAKEAA

SEQ ID NO: 1005297 - protein, 9 aa, Homo Sapiens
RNAEIVVKD

SEQ ID NO: 1005298 - protein, 9 aa, Homo Sapiens
LAPGQDVWA

SEQ ID NO: 1005299 - protein, 9 aa, Homo Sapiens
LPRSTVPDA

SEQ ID NO: 1005300 - protein, 9 aa, Homo Sapiens
PVCDESCKT

SEQ ID NO: 1005301 - protein, 9 aa, Homo Sapiens
GEDPLVDNQ

SEQ ID NO: 1005302 - protein, 9 aa, Homo Sapiens
DFFPMSDKN

SEQ ID NO: 1005303 - protein, 9 aa, Homo Sapiens
ETFVDMKPI

SEQ ID NO: 1005304 - protein, 9 aa, Homo Sapiens
LKGPESLTV

SEQ ID NO: 1005305 - protein, 9 aa, Homo Sapiens
ACSSVKVWS

SEQ ID NO: 1005306 - protein, 9 aa, Homo Sapiens
KKEEKKKYY

SEQ ID NO: 1005307 - protein, 9 aa, Homo Sapiens
VWDHDPIER

SEQ ID NO: 1005308 - protein, 9 aa, Homo Sapiens
KPLKCSDCG

SEQ ID NO: 1005309 - protein, 9 aa, Homo Sapiens
ENERTQGIF

SEQ ID NO: 1005310 - protein, 9 aa, Homo Sapiens
GSGAPEAKG

SEQ ID NO: 1005311 - protein, 9 aa, Homo Sapiens
PVAIVHARD

SEQ ID NO: 1005312 - protein, 9 aa, Homo Sapiens
FFIETGFCV

SEQ ID NO: 1005313 - protein, 9 aa, Homo Sapiens
REEEQTAKE

SEQ ID NO: 1005314 - protein, 9 aa, Homo Sapiens
SKPAVSTVA

SEQ ID NO: 1005315 - protein, 9 aa, Homo Sapiens
LEEGQSEGS

SEQ ID NO: 1005316 - protein, 9 aa, Homo Sapiens
HNSEQKRMR

SEQ ID NO: 1005317 - protein, 9 aa, Homo Sapiens
YQREIDKLK

SEQ ID NO: 1005318 - protein, 9 aa, Homo Sapiens
IDVTDKNIS

SEQ ID NO: 1005319 - protein, 9 aa, Homo Sapiens
VPVHVQTNM

SEQ ID NO: 1005320 - protein, 9 aa, Homo Sapiens
SPPLVISSI

SEQ ID NO: 1005321 - protein, 9 aa, Homo Sapiens
LSHAHAPGT

SEQ ID NO: 1005322 - protein, 9 aa, Homo Sapiens
MGRFGSRMN

SEQ ID NO: 1005323 - protein, 9 aa, Homo Sapiens
EEQSDQSFL

SEQ ID NO: 1005324 - protein, 9 aa, Homo Sapiens
KKVESSQAQ

SEQ ID NO: 1005325 - protein, 9 aa, Homo Sapiens
DTQVFQAGD

SEQ ID NO: 1005326 - protein, 9 aa, Homo Sapiens
PPAALISSE

SEQ ID NO: 1005327 - protein, 9 aa, Homo Sapiens
GGQGSQSTV

SEQ ID NO: 1005328 - protein, 9 aa, Homo Sapiens
LLKFHQEPP

SEQ ID NO: 1005329 - protein, 9 aa, Homo Sapiens
FEHYQSIIN

SEQ ID NO: 1005330 - protein, 9 aa, Homo Sapiens
GMKFKKYEC

SEQ ID NO: 1005331 - protein, 9 aa, Homo Sapiens
ARLYECGQC

SEQ ID NO: 1005332 - protein, 9 aa, Homo Sapiens
KMVQCNKGA

SEQ ID NO: 1005333 - protein, 9 aa, Homo Sapiens
LFKLGKPYH

SEQ ID NO: 1005334 - protein, 9 aa, Homo Sapiens
ISLNDDKEE

SEQ ID NO: 1005335 - protein, 9 aa, Homo Sapiens
TNSAPGILG

SEQ ID NO: 1005336 - protein, 9 aa, Homo Sapiens
YRGDSHLQL

SEQ ID NO: 1005337 - protein, 9 aa, Homo Sapiens
VLFFFFFSG

SEQ ID NO: 1005338 - protein, 9 aa, Homo Sapiens
TTGVILLSG

SEQ ID NO: 1005339 - protein, 9 aa, Homo Sapiens
LKKEEKKKY

SEQ ID NO: 1005340 - protein, 9 aa, Homo Sapiens
ATFSVIIDV

SEQ ID NO: 1005341 - protein, 9 aa, Homo Sapiens
PTFQFQYVM

SEQ ID NO: 1005342 - protein, 9 aa, Homo Sapiens
KQHPAGPPG

SEQ ID NO: 1005343 - protein, 9 aa, Homo Sapiens
DLSAVTLSW

SEQ ID NO: 1005344 - protein, 9 aa, Homo Sapiens
ETGLQETQL

SEQ ID NO: 1005345 - protein, 9 aa, Homo Sapiens
VLSFDLCSM

SEQ ID NO: 1005346 - protein, 9 aa, Homo Sapiens
EIDKLKQRP

SEQ ID NO: 1005347 - protein, 9 aa, Homo Sapiens
IHTRKNSYQ

SEQ ID NO: 1005348 - protein, 9 aa, Homo Sapiens
PTTVNGSKQ

SEQ ID NO: 1005349 - protein, 9 aa, Homo Sapiens
FYTSLSRMT

SEQ ID NO: 1005350 - protein, 9 aa, Homo Sapiens
MRNNRELRG

SEQ ID NO: 1005351 - protein, 9 aa, Homo Sapiens
ECITNPLLR

SEQ ID NO: 1005352 - protein, 9 aa, Homo Sapiens
KTPPPPAII

SEQ ID NO: 1005353 - protein, 9 aa, Homo Sapiens
PLRSVNLLK

SEQ ID NO: 1005354 - protein, 9 aa, Homo Sapiens
QHRIKEIKQ

SEQ ID NO: 1005355 - protein, 9 aa, Homo Sapiens
IQKLFDIFT

SEQ ID NO: 1005356 - protein, 9 aa, Homo Sapiens
ASSDGYYRG

SEQ ID NO: 1005357 - protein, 9 aa, Homo Sapiens
ADYLGILPA

SEQ ID NO: 1005358 - protein, 9 aa, Homo Sapiens
NFISSYLIK

SEQ ID NO: 1005359 - protein, 9 aa, Homo Sapiens
NEKRVLSNI

SEQ ID NO: 1005360 - protein, 9 aa, Homo Sapiens
RFHFPYDYP

SEQ ID NO: 1005361 - protein, 9 aa, Homo Sapiens
FNCIDKPSR

SEQ ID NO: 1005362 - protein, 9 aa, Homo Sapiens
AVRDKIDRL

SEQ ID NO: 1005363 - protein, 9 aa, Homo Sapiens
SFFEQFCKI

SEQ ID NO: 1005364 - protein, 9 aa, Homo Sapiens
DVLFVCEEE

SEQ ID NO: 1005365 - protein, 9 aa, Homo Sapiens
YYRVSFSAA

SEQ ID NO: 1005366 - protein, 9 aa, Homo Sapiens
SYYRVSFSA

SEQ ID NO: 1005367 - protein, 9 aa, Homo Sapiens
DEPAIAIDL

SEQ ID NO: 1005368 - protein, 9 aa, Homo Sapiens
GPGPSLSPS

SEQ ID NO: 1005369 - protein, 9 aa, Homo Sapiens
KDRTWNETK

SEQ ID NO: 1005370 - protein, 9 aa, Homo Sapiens
MLMALDCYV

SEQ ID NO: 1005371 - protein, 9 aa, Homo Sapiens
KEIKQMHPN

SEQ ID NO: 1005372 - protein, 9 aa, Homo Sapiens
SVMDFKNNY

SEQ ID NO: 1005373 - protein, 9 aa, Homo Sapiens
IKPLKCSDC

SEQ ID NO: 1005374 - protein, 9 aa, Homo Sapiens
HKDSSLQWS

SEQ ID NO: 1005375 - protein, 9 aa, Homo Sapiens
AIVHARDGT

SEQ ID NO: 1005376 - protein, 9 aa, Homo Sapiens
KEDDIAGYD

SEQ ID NO: 1005377 - protein, 9 aa, Homo Sapiens
QSEQTTTSP

SEQ ID NO: 1005378 - protein, 9 aa, Homo Sapiens
NPVLSLRSM

SEQ ID NO: 1005379 - protein, 9 aa, Homo Sapiens
KSLDSFWSQ

SEQ ID NO: 1005380 - protein, 9 aa, Homo Sapiens
MKAYTTRVG

SEQ ID NO: 1005381 - protein, 9 aa, Homo Sapiens
KNVEYTFTR

SEQ ID NO: 1005382 - protein, 9 aa, Homo Sapiens
TLPCLTFFI

SEQ ID NO: 1005383 - protein, 9 aa, Homo Sapiens
RKQHPAGPP

SEQ ID NO: 1005384 - protein, 9 aa, Homo Sapiens
NRLLIYKDR

SEQ ID NO: 1005385 - protein, 9 aa, Homo Sapiens
RSISLRGFD

SEQ ID NO: 1005386 - protein, 9 aa, Homo Sapiens
SCTQCGQAF

SEQ ID NO: 1005387 - protein, 9 aa, Homo Sapiens
VKEIKTQLI

SEQ ID NO: 1005388 - protein, 9 aa, Homo Sapiens
RLSWERGGR

SEQ ID NO: 1005389 - protein, 9 aa, Homo Sapiens
PPLPETTMH

SEQ ID NO: 1005390 - protein, 9 aa, Homo Sapiens
DISGPAFCQ

SEQ ID NO: 1005391 - protein, 9 aa, Homo Sapiens
TKSLDSFWS

SEQ ID NO: 1005392 - protein, 9 aa, Homo Sapiens
LKRHYAAFL

SEQ ID NO: 1005393 - protein, 9 aa, Homo Sapiens
SRSRGRPRF

SEQ ID NO: 1005394 - protein, 9 aa, Homo Sapiens
RFMAVLRRC

SEQ ID NO: 1005395 - protein, 9 aa, Homo Sapiens
FSKNLTNSS

SEQ ID NO: 1005396 - protein, 9 aa, Homo Sapiens
EEGIIRVRK

SEQ ID NO: 1005397 - protein, 9 aa, Homo Sapiens
DTSFFIDKV

SEQ ID NO: 1005398 - protein, 9 aa, Homo Sapiens
NSSVRIKLE

SEQ ID NO: 1005399 - protein, 9 aa, Homo Sapiens
NIYLYEEDK

SEQ ID NO: 1005400 - protein, 9 aa, Homo Sapiens
VIPRSFNLE

SEQ ID NO: 1005401 - protein, 9 aa, Homo Sapiens
LRVLGHTLC

SEQ ID NO: 1005402 - protein, 9 aa, Homo Sapiens
IDPLRSVNL

SEQ ID NO: 1005403 - protein, 9 aa, Homo Sapiens
RCLLNEEVI

SEQ ID NO: 1005404 - protein, 9 aa, Homo Sapiens
GLRDPGQGT

SEQ ID NO: 1005405 - protein, 9 aa, Homo Sapiens
ESGSGHSSS

SEQ ID NO: 1005406 - protein, 9 aa, Homo Sapiens
RLAWWNDFM

SEQ ID NO: 1005407 - protein, 9 aa, Homo Sapiens
GGEDEPAIA

SEQ ID NO: 1005408 - protein, 9 aa, Homo Sapiens
RRLSWERGG

SEQ ID NO: 1005409 - protein, 9 aa, Homo Sapiens
TLRKHSDYA

SEQ ID NO: 1005410 - protein, 9 aa, Homo Sapiens
KAQAIETAR

SEQ ID NO: 1005411 - protein, 9 aa, Homo Sapiens
NGAPSSAVG

SEQ ID NO: 1005412 - protein, 9 aa, Homo Sapiens
GPSPRGGAV

SEQ ID NO: 1005413 - protein, 9 aa, Homo Sapiens
TARRTPLGQ

SEQ ID NO: 1005414 - protein, 9 aa, Homo Sapiens
PLLAVTPPG

SEQ ID NO: 1005415 - protein, 9 aa, Homo Sapiens
SILLQIDNA

SEQ ID NO: 1005416 - protein, 9 aa, Homo Sapiens
VEKRVLEKR

SEQ ID NO: 1005417 - protein, 9 aa, Homo Sapiens
AFLLPSRTS

SEQ ID NO: 1005418 - protein, 9 aa, Homo Sapiens
LKNYSHLIS

SEQ ID NO: 1005419 - protein, 9 aa, Homo Sapiens
GSPGSFDFL

SEQ ID NO: 1005420 - protein, 9 aa, Homo Sapiens
FEQFCKIYI

SEQ ID NO: 1005421 - protein, 9 aa, Homo Sapiens
GGQDIVVGE

SEQ ID NO: 1005422 - protein, 9 aa, Homo Sapiens
GTEDFICIS

SEQ ID NO: 1005423 - protein, 9 aa, Homo Sapiens
TKDTPTNRK

SEQ ID NO: 1005424 - protein, 9 aa, Homo Sapiens
WKRVSSLPL

SEQ ID NO: 1005425 - protein, 9 aa, Homo Sapiens
SNDDEDENK

SEQ ID NO: 1005426 - protein, 9 aa, Homo Sapiens
PRLGIENST

SEQ ID NO: 1005427 - protein, 9 aa, Homo Sapiens
TCSPSAPHF

SEQ ID NO: 1005428 - protein, 9 aa, Homo Sapiens
VHHQRNHSG

SEQ ID NO: 1005429 - protein, 9 aa, Homo Sapiens
RIKSQTEGS

SEQ ID NO: 1005430 - protein, 9 aa, Homo Sapiens
ILLPSLYRD

SEQ ID NO: 1005431 - protein, 9 aa, Homo Sapiens
IFSLDGGCS

SEQ ID NO: 1005432 - protein, 9 aa, Homo Sapiens
RSNPSLVLA

SEQ ID NO: 1005433 - protein, 9 aa, Homo Sapiens
FIGHPGARG

SEQ ID NO: 1005434 - protein, 9 aa, Homo Sapiens
TSSINSSPP

SEQ ID NO: 1005435 - protein, 9 aa, Homo Sapiens
LENFIVATE

SEQ ID NO: 1005436 - protein, 9 aa, Homo Sapiens
LDSFLLLIS

SEQ ID NO: 1005437 - protein, 9 aa, Homo Sapiens
MQNRIAHSP

SEQ ID NO: 1005438 - protein, 9 aa, Homo Sapiens
DQSEYTSLI

SEQ ID NO: 1005439 - protein, 9 aa, Homo Sapiens
KAERYSFPI

SEQ ID NO: 1005440 - protein, 9 aa, Homo Sapiens
AEFLQQEVE

SEQ ID NO: 1005441 - protein, 9 aa, Homo Sapiens
LLQHVYNPV

SEQ ID NO: 1005442 - protein, 9 aa, Homo Sapiens
RQAETQAWQ

SEQ ID NO: 1005443 - protein, 9 aa, Homo Sapiens
WFTYNNLCV

SEQ ID NO: 1005444 - protein, 9 aa, Homo Sapiens
KLNTFCVIV

SEQ ID NO: 1005445 - protein, 9 aa, Homo Sapiens
AYMKPGPRR

SEQ ID NO: 1005446 - protein, 9 aa, Homo Sapiens
RLFLFSYCK

SEQ ID NO: 1005447 - protein, 9 aa, Homo Sapiens
SCPPSPPLV

SEQ ID NO: 1005448 - protein, 9 aa, Homo Sapiens
TVMGRCHYS

SEQ ID NO: 1005449 - protein, 9 aa, Homo Sapiens
VLNGGQPQM

SEQ ID NO: 1005450 - protein, 9 aa, Homo Sapiens
LRPHYPPMP

SEQ ID NO: 1005451 - protein, 9 aa, Homo Sapiens
KRSSVVSSS

SEQ ID NO: 1005452 - protein, 9 aa, Homo Sapiens
THGFYRVRI

SEQ ID NO: 1005453 - protein, 9 aa, Homo Sapiens
SIDVTDKNI

SEQ ID NO: 1005454 - protein, 9 aa, Homo Sapiens
SNIFLRLFY

SEQ ID NO: 1005455 - protein, 9 aa, Homo Sapiens
YTLCNKEVR

SEQ ID NO: 1005456 - protein, 9 aa, Homo Sapiens
LLKGNSRRI

SEQ ID NO: 1005457 - protein, 9 aa, Homo Sapiens
NRGDDVFKA

SEQ ID NO: 1005458 - protein, 9 aa, Homo Sapiens
AALKTKVVP

SEQ ID NO: 1005459 - protein, 9 aa, Homo Sapiens
MSQRAIFFA

SEQ ID NO: 1005460 - protein, 9 aa, Homo Sapiens
IGVFLRLSH

SEQ ID NO: 1005461 - protein, 9 aa, Homo Sapiens
KMHIDKRSH

SEQ ID NO: 1005462 - protein, 9 aa, Homo Sapiens
DGVVEYEVT

SEQ ID NO: 1005463 - protein, 9 aa, Homo Sapiens
LKELLKRTL

SEQ ID NO: 1005464 - protein, 9 aa, Homo Sapiens
PLTLGMKIH

SEQ ID NO: 1005465 - protein, 9 aa, Homo Sapiens
NRVRRWQKL

SEQ ID NO: 1005466 - protein, 9 aa, Homo Sapiens
SGSRGFFCK

SEQ ID NO: 1005467 - protein, 9 aa, Homo Sapiens
ETTHTPPVP

SEQ ID NO: 1005468 - protein, 9 aa, Homo Sapiens
GPPGFIGHP

SEQ ID NO: 1005469 - protein, 9 aa, Homo Sapiens
DLVGALRAL

SEQ ID NO: 1005470 - protein, 9 aa, Homo Sapiens
GPQGPAGQD

SEQ ID NO: 1005471 - protein, 9 aa, Homo Sapiens
CIGISNQPV

SEQ ID NO: 1005472 - protein, 9 aa, Homo Sapiens
LVFTLFTLA

SEQ ID NO: 1005473 - protein, 9 aa, Homo Sapiens
ASLGLASFK

SEQ ID NO: 1005474 - protein, 9 aa, Homo Sapiens
FATLIIIGS

SEQ ID NO: 1005475 - protein, 9 aa, Homo Sapiens
IQHKRIYTG

SEQ ID NO: 1005476 - protein, 9 aa, Homo Sapiens
NLGDDLLQD

SEQ ID NO: 1005477 - protein, 9 aa, Homo Sapiens
CEVPRNLCR

SEQ ID NO: 1005478 - protein, 9 aa, Homo Sapiens
EDPQCLSRP

SEQ ID NO: 1005479 - protein, 9 aa, Homo Sapiens
PSPPSFPLS

SEQ ID NO: 1005480 - protein, 9 aa, Homo Sapiens
ELSQVPPLV

SEQ ID NO: 1005481 - protein, 9 aa, Homo Sapiens
HEPGVLGPS

SEQ ID NO: 1005482 - protein, 9 aa, Homo Sapiens
TALLTLCLC

SEQ ID NO: 1005483 - protein, 9 aa, Homo Sapiens
RPSPLKAPN

SEQ ID NO: 1005484 - protein, 9 aa, Homo Sapiens
TCNPGASLD

SEQ ID NO: 1005485 - protein, 9 aa, Homo Sapiens
PPAAAAARP

SEQ ID NO: 1005486 - protein, 9 aa, Homo Sapiens
VMLGCWQRK

SEQ ID NO: 1005487 - protein, 9 aa, Homo Sapiens
LSLVGGLGL

SEQ ID NO: 1005488 - protein, 9 aa, Homo Sapiens
DNWKRVSSL

SEQ ID NO: 1005489 - protein, 9 aa, Homo Sapiens
GQKVEGMNI

SEQ ID NO: 1005490 - protein, 9 aa, Homo Sapiens
ELSDVFNDP

SEQ ID NO: 1005491 - protein, 9 aa, Homo Sapiens
ICFISELAR

SEQ ID NO: 1005492 - protein, 9 aa, Homo Sapiens
KIVNEKSSL

SEQ ID NO: 1005493 - protein, 9 aa, Homo Sapiens
EHYQSIINI

SEQ ID NO: 1005494 - protein, 9 aa, Homo Sapiens
KHLNVSKLQ

SEQ ID NO: 1005495 - protein, 9 aa, Homo Sapiens
KNSYQCEEC

SEQ ID NO: 1005496 - protein, 9 aa, Homo Sapiens
SLDSSSPDS

SEQ ID NO: 1005497 - protein, 9 aa, Homo Sapiens
CQPVGRIFF

SEQ ID NO: 1005498 - protein, 9 aa, Homo Sapiens
MESPKAMLP

SEQ ID NO: 1005499 - protein, 9 aa, Homo Sapiens
CQVKDHKDS

SEQ ID NO: 1005500 - protein, 9 aa, Homo Sapiens
VREISVSTR

SEQ ID NO: 1005501 - protein, 9 aa, Homo Sapiens
KYLINLCGI

SEQ ID NO: 1005502 - protein, 9 aa, Homo Sapiens
FVTADGCKD

SEQ ID NO: 1005503 - protein, 9 aa, Homo Sapiens
NSAKSLLKF

SEQ ID NO: 1005504 - protein, 9 aa, Homo Sapiens
DAFQVGKFS

SEQ ID NO: 1005505 - protein, 9 aa, Homo Sapiens
TDPTVLFFV

SEQ ID NO: 1005506 - protein, 9 aa, Homo Sapiens
KVDTSPRED

SEQ ID NO: 1005507 - protein, 9 aa, Homo Sapiens
SLPPRFGSE

SEQ ID NO: 1005508 - protein, 9 aa, Homo Sapiens
AQQESLKKE

SEQ ID NO: 1005509 - protein, 9 aa, Homo Sapiens
ILNMARKID

SEQ ID NO: 1005510 - protein, 9 aa, Homo Sapiens
LLKRTLRKH

SEQ ID NO: 1005511 - protein, 9 aa, Homo Sapiens
AILITELTK

SEQ ID NO: 1005512 - protein, 9 aa, Homo Sapiens
KGNCANKKD

SEQ ID NO: 1005513 - protein, 9 aa, Homo Sapiens
APGNSENGH

SEQ ID NO: 1005514 - protein, 9 aa, Homo Sapiens
QNVATVLLL

SEQ ID NO: 1005515 - protein, 9 aa, Homo Sapiens
PSEPFQIIF

SEQ ID NO: 1005516 - protein, 9 aa, Homo Sapiens
VSGILSHSL

SEQ ID NO: 1005517 - protein, 9 aa, Homo Sapiens
GRPSPLKAP

SEQ ID NO: 1005518 - protein, 9 aa, Homo Sapiens
FLSLEPDNE

SEQ ID NO: 1005519 - protein, 9 aa, Homo Sapiens
LESPILAAS

SEQ ID NO: 1005520 - protein, 9 aa, Homo Sapiens
MYRQLNGLS

SEQ ID NO: 1005521 - protein, 9 aa, Homo Sapiens
YTRPDTSFF

SEQ ID NO: 1005522 - protein, 9 aa, Homo Sapiens
WQMHSGLYQ

SEQ ID NO: 1005523 - protein, 9 aa, Homo Sapiens
EVTKPQFSQ

SEQ ID NO: 1005524 - protein, 9 aa, Homo Sapiens
KPSRCYFHD

SEQ ID NO: 1005525 - protein, 9 aa, Homo Sapiens
ARLRSHSAQ

SEQ ID NO: 1005526 - protein, 9 aa, Homo Sapiens
KVLESTKET

SEQ ID NO: 1005527 - protein, 9 aa, Homo Sapiens
EGTKYVSHG

SEQ ID NO: 1005528 - protein, 9 aa, Homo Sapiens
KVAEYKYQL

SEQ ID NO: 1005529 - protein, 9 aa, Homo Sapiens
HKRIYTGQK

SEQ ID NO: 1005530 - protein, 9 aa, Homo Sapiens
DTALTALEE

SEQ ID NO: 1005531 - protein, 9 aa, Homo Sapiens
SECSSQCGL

SEQ ID NO: 1005532 - protein, 9 aa, Homo Sapiens
IYVKMRNNR

SEQ ID NO: 1005533 - protein, 9 aa, Homo Sapiens
RHSKELQIL

SEQ ID NO: 1005534 - protein, 9 aa, Homo Sapiens
QAETQAWQS

SEQ ID NO: 1005535 - protein, 9 aa, Homo Sapiens
HPEEKERMH

SEQ ID NO: 1005536 - protein, 9 aa, Homo Sapiens
VTSNESPEE

SEQ ID NO: 1005537 - protein, 9 aa, Homo Sapiens
FGFVIMTNY

SEQ ID NO: 1005538 - protein, 9 aa, Homo Sapiens
KEGTMEEAG

SEQ ID NO: 1005539 - protein, 9 aa, Homo Sapiens
GFYRVRISV

SEQ ID NO: 1005540 - protein, 9 aa, Homo Sapiens
VCGFDGHTY

SEQ ID NO: 1005541 - protein, 9 aa, Homo Sapiens
HSMQNRIAH

SEQ ID NO: 1005542 - protein, 9 aa, Homo Sapiens
IGEDEPDEF

SEQ ID NO: 1005543 - protein, 9 aa, Homo Sapiens
LAVLILASY

SEQ ID NO: 1005544 - protein, 9 aa, Homo Sapiens
TSVPTPVFL

SEQ ID NO: 1005545 - protein, 9 aa, Homo Sapiens
GKLPPRAGV

SEQ ID NO: 1005546 - protein, 9 aa, Homo Sapiens
ILNDGDIKK

SEQ ID NO: 1005547 - protein, 9 aa, Homo Sapiens
QLKIYNIEN

SEQ ID NO: 1005548 - protein, 9 aa, Homo Sapiens
YIKILLQEY

SEQ ID NO: 1005549 - protein, 9 aa, Homo Sapiens
YGENIYLYE

SEQ ID NO: 1005550 - protein, 9 aa, Homo Sapiens
ERTESTTDE

SEQ ID NO: 1005551 - protein, 9 aa, Homo Sapiens
SERKRRDSS

SEQ ID NO: 1005552 - protein, 9 aa, Homo Sapiens
FPIEDMIST

SEQ ID NO: 1005553 - protein, 9 aa, Homo Sapiens
DQLSKRPCG

SEQ ID NO: 1005554 - protein, 9 aa, Homo Sapiens
KKGKITGGG

SEQ ID NO: 1005555 - protein, 9 aa, Homo Sapiens
VSYIKQPAG

SEQ ID NO: 1005556 - protein, 9 aa, Homo Sapiens
GALGNTPLF

SEQ ID NO: 1005557 - protein, 9 aa, Homo Sapiens
FSQFFHGSL

SEQ ID NO: 1005558 - protein, 9 aa, Homo Sapiens
GSPSSHLTQ

SEQ ID NO: 1005559 - protein, 9 aa, Homo Sapiens
FFSANPKKL

SEQ ID NO: 1005560 - protein, 9 aa, Homo Sapiens
KELQILGKT

SEQ ID NO: 1005561 - protein, 9 aa, Homo Sapiens
EPGFLAEKE

SEQ ID NO: 1005562 - protein, 9 aa, Homo Sapiens
GFVIMTNYD

SEQ ID NO: 1005563 - protein, 9 aa, Homo Sapiens
LGDGPPGSR

SEQ ID NO: 1005564 - protein, 9 aa, Homo Sapiens
LRVKRPIEN

SEQ ID NO: 1005565 - protein, 9 aa, Homo Sapiens
KDNLGDDLL

SEQ ID NO: 1005566 - protein, 9 aa, Homo Sapiens
PFIFLVYQL

SEQ ID NO: 1005567 - protein, 9 aa, Homo Sapiens
KESYNELNQ

SEQ ID NO: 1005568 - protein, 9 aa, Homo Sapiens
AAYLTLACC

SEQ ID NO: 1005569 - protein, 9 aa, Homo Sapiens
EQERTESTT

SEQ ID NO: 1005570 - protein, 9 aa, Homo Sapiens
GDKDNKYVS

SEQ ID NO: 1005571 - protein, 9 aa, Homo Sapiens
APHARNGLL

SEQ ID NO: 1005572 - protein, 9 aa, Homo Sapiens
KKNTLSKSL

SEQ ID NO: 1005573 - protein, 9 aa, Homo Sapiens
TAGRNLLLP

SEQ ID NO: 1005574 - protein, 9 aa, Homo Sapiens
GAPEAKGPL

SEQ ID NO: 1005575 - protein, 9 aa, Homo Sapiens
FFSLVTIPK

SEQ ID NO: 1005576 - protein, 9 aa, Homo Sapiens
FYAAVHTGN

SEQ ID NO: 1005577 - protein, 9 aa, Homo Sapiens
WKNIHTLVE

SEQ ID NO: 1005578 - protein, 9 aa, Homo Sapiens
QEQRAQAAL

SEQ ID NO: 1005579 - protein, 9 aa, Homo Sapiens
KWKDTQVFQ

SEQ ID NO: 1005580 - protein, 9 aa, Homo Sapiens
ATHFGLWRI

SEQ ID NO: 1005581 - protein, 9 aa, Homo Sapiens
DRNAEIVVK

SEQ ID NO: 1005582 - protein, 9 aa, Homo Sapiens
WLKVRQFYG

SEQ ID NO: 1005583 - protein, 9 aa, Homo Sapiens
GGRYETTKD

SEQ ID NO: 1005584 - protein, 9 aa, Homo Sapiens
FYTQTTDAL

SEQ ID NO: 1005585 - protein, 9 aa, Homo Sapiens
KEIGRKDSG

SEQ ID NO: 1005586 - protein, 9 aa, Homo Sapiens
VTLPVPPEG

SEQ ID NO: 1005587 - protein, 9 aa, Homo Sapiens
IVKLNGTVV

SEQ ID NO: 1005588 - protein, 9 aa, Homo Sapiens
MLWMIASQA

SEQ ID NO: 1005589 - protein, 9 aa, Homo Sapiens
ERYSFPIVN

SEQ ID NO: 1005590 - protein, 9 aa, Homo Sapiens
ELLQQLNDL

SEQ ID NO: 1005591 - protein, 9 aa, Homo Sapiens
EDNSKEIVV

SEQ ID NO: 1005592 - protein, 9 aa, Homo Sapiens
LSVSRNSTV

SEQ ID NO: 1005593 - protein, 9 aa, Homo Sapiens
ARPVGTSLS

SEQ ID NO: 1005594 - protein, 9 aa, Homo Sapiens
KANPGSEFV

SEQ ID NO: 1005595 - protein, 9 aa, Homo Sapiens
RGPTDCSWG

SEQ ID NO: 1005596 - protein, 9 aa, Homo Sapiens
GHDLDLYIS

SEQ ID NO: 1005597 - protein, 9 aa, Homo Sapiens
VEDVRSVTQ

SEQ ID NO: 1005598 - protein, 9 aa, Homo Sapiens
GVILLSGNT

SEQ ID NO: 1005599 - protein, 9 aa, Homo Sapiens
AVPVLPAAD

SEQ ID NO: 1005600 - protein, 9 aa, Homo Sapiens
QRACLSSPG

SEQ ID NO: 1005601 - protein, 9 aa, Homo Sapiens
NWYSLVICE

SEQ ID NO: 1005602 - protein, 9 aa, Homo Sapiens
AVILENFIV

SEQ ID NO: 1005603 - protein, 9 aa, Homo Sapiens
QRHSNSLGL

SEQ ID NO: 1005604 - protein, 9 aa, Homo Sapiens
ILVLNGGQP

SEQ ID NO: 1005605 - protein, 9 aa, Homo Sapiens
QIAPMRNEH

SEQ ID NO: 1005606 - protein, 9 aa, Homo Sapiens
CAVIDEKEM

SEQ ID NO: 1005607 - protein, 9 aa, Homo Sapiens
PGPSLSPSL

SEQ ID NO: 1005608 - protein, 9 aa, Homo Sapiens
HGDMRKLID

SEQ ID NO: 1005609 - protein, 9 aa, Homo Sapiens
LNSAILMAM

SEQ ID NO: 1005610 - protein, 9 aa, Homo Sapiens
LLIYSLRNG

SEQ ID NO: 1005611 - protein, 9 aa, Homo Sapiens
IEKMVQCNK

SEQ ID NO: 1005612 - protein, 9 aa, Homo Sapiens
RENMKWNYK

SEQ ID NO: 1005613 - protein, 9 aa, Homo Sapiens
RGSAGLKKE

SEQ ID NO: 1005614 - protein, 9 aa, Homo Sapiens
YISIFTLLQ

SEQ ID NO: 1005615 - protein, 9 aa, Homo Sapiens
SACSSVKVW

SEQ ID NO: 1005616 - protein, 9 aa, Homo Sapiens
ATIPLLAVT

SEQ ID NO: 1005617 - protein, 9 aa, Homo Sapiens
HDLDLYISI

SEQ ID NO: 1005618 - protein, 9 aa, Homo Sapiens
AEGLPRPPR

SEQ ID NO: 1005619 - protein, 9 aa, Homo Sapiens
CIVLAAIAL

SEQ ID NO: 1005620 - protein, 9 aa, Homo Sapiens
PYVKISDCF

SEQ ID NO: 1005621 - protein, 9 aa, Homo Sapiens
HFFCNPSEV

SEQ ID NO: 1005622 - protein, 9 aa, Homo Sapiens
ASSFPLISL

SEQ ID NO: 1005623 - protein, 9 aa, Homo Sapiens
QYNSPGLGV

SEQ ID NO: 1005624 - protein, 9 aa, Homo Sapiens
STQGELVAL

SEQ ID NO: 1005625 - protein, 9 aa, Homo Sapiens
PAIIPMGPA

SEQ ID NO: 1005626 - protein, 9 aa, Homo Sapiens
EKMKIRIID

SEQ ID NO: 1005627 - protein, 9 aa, Homo Sapiens
LLKHTKCPQ

SEQ ID NO: 1005628 - protein, 9 aa, Homo Sapiens
QKIFQVELN

SEQ ID NO: 1005629 - protein, 9 aa, Homo Sapiens
IQNKNCSGI

SEQ ID NO: 1005630 - protein, 9 aa, Homo Sapiens
CPQNVDSLS

SEQ ID NO: 1005631 - protein, 9 aa, Homo Sapiens
PPDQKDNQP

SEQ ID NO: 1005632 - protein, 9 aa, Homo Sapiens
DGDIKKCKR

SEQ ID NO: 1005633 - protein, 9 aa, Homo Sapiens
KYSNLNRYK

SEQ ID NO: 1005634 - protein, 9 aa, Homo Sapiens
SGGPTVSKA

SEQ ID NO: 1005635 - protein, 9 aa, Homo Sapiens
NVLVSFVLL

SEQ ID NO: 1005636 - protein, 9 aa, Homo Sapiens
DYQATSLPS

SEQ ID NO: 1005637 - protein, 9 aa, Homo Sapiens
LIISDINPY

SEQ ID NO: 1005638 - protein, 9 aa, Homo Sapiens
TQDQTDQQK

SEQ ID NO: 1005639 - protein, 9 aa, Homo Sapiens
EDFFIKMFD

SEQ ID NO: 1005640 - protein, 9 aa, Homo Sapiens
EAAIENILK

SEQ ID NO: 1005641 - protein, 9 aa, Homo Sapiens
INNVAGEID

SEQ ID NO: 1005642 - protein, 9 aa, Homo Sapiens
NKEEKLYAK

SEQ ID NO: 1005643 - protein, 9 aa, Homo Sapiens
LVNFMRIKS

SEQ ID NO: 1005644 - protein, 9 aa, Homo Sapiens
NSLYLFAAP

SEQ ID NO: 1005645 - protein, 9 aa, Homo Sapiens
YRRTGERVK

SEQ ID NO: 1005646 - protein, 9 aa, Homo Sapiens
PPWGRLHSH

SEQ ID NO: 1005647 - protein, 9 aa, Homo Sapiens
MGSLEKEGT

SEQ ID NO: 1005648 - protein, 9 aa, Homo Sapiens
QPLPPRFKQ

SEQ ID NO: 1005649 - protein, 9 aa, Homo Sapiens
ILTLEGPSQ

SEQ ID NO: 1005650 - protein, 9 aa, Homo Sapiens
TQKKVEKKA

SEQ ID NO: 1005651 - protein, 9 aa, Homo Sapiens
TPDQLYRTK

SEQ ID NO: 1005652 - protein, 9 aa, Homo Sapiens
LKGNSRRID

SEQ ID NO: 1005653 - protein, 9 aa, Homo Sapiens
VSRWYFGRL

SEQ ID NO: 1005654 - protein, 9 aa, Homo Sapiens
VLTPMLNLL

SEQ ID NO: 1005655 - protein, 9 aa, Homo Sapiens
PEELAWGDE

SEQ ID NO: 1005656 - protein, 9 aa, Homo Sapiens
ESSQEDEDL

SEQ ID NO: 1005657 - protein, 9 aa, Homo Sapiens
EKDIIKKTI

SEQ ID NO: 1005658 - protein, 9 aa, Homo Sapiens
DLVIEGPMY

SEQ ID NO: 1005659 - protein, 9 aa, Homo Sapiens
SEDFEIVII

SEQ ID NO: 1005660 - protein, 9 aa, Homo Sapiens
RSRPTGTLK

SEQ ID NO: 1005661 - protein, 9 aa, Homo Sapiens
YLGILPAMD

SEQ ID NO: 1005662 - protein, 9 aa, Homo Sapiens
SEEEEEEMA

SEQ ID NO: 1005663 - protein, 9 aa, Homo Sapiens
IDGSRKIES

SEQ ID NO: 1005664 - protein, 9 aa, Homo Sapiens
PKEASLPSV

SEQ ID NO: 1005665 - protein, 9 aa, Homo Sapiens
RSWCGRPEQ

SEQ ID NO: 1005666 - protein, 9 aa, Homo Sapiens
QIEVVKKMN

SEQ ID NO: 1005667 - protein, 9 aa, Homo Sapiens
CPFRHSNPE

SEQ ID NO: 1005668 - protein, 9 aa, Homo Sapiens
FPVKGLSST

SEQ ID NO: 1005669 - protein, 9 aa, Homo Sapiens
RSKPFLELS

SEQ ID NO: 1005670 - protein, 9 aa, Homo Sapiens
MMLWRYSEP

SEQ ID NO: 1005671 - protein, 9 aa, Homo Sapiens
QNKNCSGIG

SEQ ID NO: 1005672 - protein, 9 aa, Homo Sapiens
TLSWELQAM

SEQ ID NO: 1005673 - protein, 9 aa, Homo Sapiens
LSCVNKNKN

SEQ ID NO: 1005674 - protein, 9 aa, Homo Sapiens
IYTREKAYK

SEQ ID NO: 1005675 - protein, 9 aa, Homo Sapiens
FQELNSTYS

SEQ ID NO: 1005676 - protein, 9 aa, Homo Sapiens
NGKKMKSKV

SEQ ID NO: 1005677 - protein, 9 aa, Homo Sapiens
AGCLQEEDS

SEQ ID NO: 1005678 - protein, 9 aa, Homo Sapiens
TFGPDLHYW

SEQ ID NO: 1005679 - protein, 9 aa, Homo Sapiens
SPRKSRTPE

SEQ ID NO: 1005680 - protein, 9 aa, Homo Sapiens
YLNKKAFSY

SEQ ID NO: 1005681 - protein, 9 aa, Homo Sapiens
FEECITNPL

SEQ ID NO: 1005682 - protein, 9 aa, Homo Sapiens
GLTSSSVQP

SEQ ID NO: 1005683 - protein, 9 aa, Homo Sapiens
GLQEGFELF

SEQ ID NO: 1005684 - protein, 9 aa, Homo Sapiens
VIKDYCTGL

SEQ ID NO: 1005685 - protein, 9 aa, Homo Sapiens
QVLANGPEA

SEQ ID NO: 1005686 - protein, 9 aa, Homo Sapiens
PLAPTPTPS

SEQ ID NO: 1005687 - protein, 9 aa, Homo Sapiens
LGVTQFLPT

SEQ ID NO: 1005688 - protein, 9 aa, Homo Sapiens
VALSSQGEI

SEQ ID NO: 1005689 - protein, 9 aa, Homo Sapiens
QFSCLSLQS

SEQ ID NO: 1005690 - protein, 9 aa, Homo Sapiens
VRIKMMAVG

SEQ ID NO: 1005691 - protein, 9 aa, Homo Sapiens
EPLGINEPL

SEQ ID NO: 1005692 - protein, 9 aa, Homo Sapiens
RTLLTVISW

SEQ ID NO: 1005693 - protein, 9 aa, Homo Sapiens
IIGEDEPDE

SEQ ID NO: 1005694 - protein, 9 aa, Homo Sapiens
KAVKILACG

SEQ ID NO: 1005695 - protein, 9 aa, Homo Sapiens
FLLPSRTSF

SEQ ID NO: 1005696 - protein, 9 aa, Homo Sapiens
PRGSPGSPG

SEQ ID NO: 1005697 - protein, 9 aa, Homo Sapiens
IFSDTADGK

SEQ ID NO: 1005698 - protein, 9 aa, Homo Sapiens
VRIEAAQFS

SEQ ID NO: 1005699 - protein, 9 aa, Homo Sapiens
FFFYGIVVG

SEQ ID NO: 1005700 - protein, 9 aa, Homo Sapiens
ASKIELTIW

SEQ ID NO: 1005701 - protein, 9 aa, Homo Sapiens
SNIKTRSES

SEQ ID NO: 1005702 - protein, 9 aa, Homo Sapiens
DMISTLKAA

SEQ ID NO: 1005703 - protein, 9 aa, Homo Sapiens
KKAFSYRQM

SEQ ID NO: 1005704 - protein, 9 aa, Homo Sapiens
QSLPPRFGS

SEQ ID NO: 1005705 - protein, 9 aa, Homo Sapiens
VLTLKKEEK

SEQ ID NO: 1005706 - protein, 9 aa, Homo Sapiens
TFHCLSPKK

SEQ ID NO: 1005707 - protein, 9 aa, Homo Sapiens
GGHNLLPPR

SEQ ID NO: 1005708 - protein, 9 aa, Homo Sapiens
NMPVLETYG

SEQ ID NO: 1005709 - protein, 9 aa, Homo Sapiens
LVKKIFQNH

SEQ ID NO: 1005710 - protein, 9 aa, Homo Sapiens
QNCLFLAGE

SEQ ID NO: 1005711 - protein, 9 aa, Homo Sapiens
QNMIVTGRL

SEQ ID NO: 1005712 - protein, 9 aa, Homo Sapiens
KSDHYNCVS

SEQ ID NO: 1005713 - protein, 9 aa, Homo Sapiens
VDFTPTSRK

SEQ ID NO: 1005714 - protein, 9 aa, Homo Sapiens
SINKGQVSA

SEQ ID NO: 1005715 - protein, 9 aa, Homo Sapiens
KFYIELLQQ

SEQ ID NO: 1005716 - protein, 9 aa, Homo Sapiens
AVKILACGV

SEQ ID NO: 1005717 - protein, 9 aa, Homo Sapiens
KLHCDKLHV

SEQ ID NO: 1005718 - protein, 9 aa, Homo Sapiens
KIQNLSLIF

SEQ ID NO: 1005719 - protein, 9 aa, Homo Sapiens
KVEGLLTLS

SEQ ID NO: 1005720 - protein, 9 aa, Homo Sapiens
SFWSQVLPQ

SEQ ID NO: 1005721 - protein, 9 aa, Homo Sapiens
VAFMLCRKN

SEQ ID NO: 1005722 - protein, 9 aa, Homo Sapiens
KLWIEITKC

SEQ ID NO: 1005723 - protein, 9 aa, Homo Sapiens
AMPTHKNLC

SEQ ID NO: 1005724 - protein, 9 aa, Homo Sapiens
GDNLRDIKN

SEQ ID NO: 1005725 - protein, 9 aa, Homo Sapiens
RNLCRMSCQ

SEQ ID NO: 1005726 - protein, 9 aa, Homo Sapiens
EERRLSWER

SEQ ID NO: 1005727 - protein, 9 aa, Homo Sapiens
IKQPAGASP

SEQ ID NO: 1005728 - protein, 9 aa, Homo Sapiens
TRRFMAVLR

SEQ ID NO: 1005729 - protein, 9 aa, Homo Sapiens
RIDLSSITD

SEQ ID NO: 1005730 - protein, 9 aa, Homo Sapiens
PRVCSFAGI

SEQ ID NO: 1005731 - protein, 9 aa, Homo Sapiens
SASLPKVTL

SEQ ID NO: 1005732 - protein, 9 aa, Homo Sapiens
ENRNAVISD

SEQ ID NO: 1005733 - protein, 9 aa, Homo Sapiens
KTGAHHEPG

SEQ ID NO: 1005734 - protein, 9 aa, Homo Sapiens
DGAPALSGP

SEQ ID NO: 1005735 - protein, 9 aa, Homo Sapiens
SEQTTTSPK

SEQ ID NO: 1005736 - protein, 9 aa, Homo Sapiens
FERCELVKK

SEQ ID NO: 1005737 - protein, 9 aa, Homo Sapiens
TSNDDEDEN

SEQ ID NO: 1005738 - protein, 9 aa, Homo Sapiens
MIASQANLW

SEQ ID NO: 1005739 - protein, 9 aa, Homo Sapiens
LSAVTLSWE

SEQ ID NO: 1005740 - protein, 9 aa, Homo Sapiens
FSLDGGCSA

SEQ ID NO: 1005741 - protein, 9 aa, Homo Sapiens
TPTSRKKET

SEQ ID NO: 1005742 - protein, 9 aa, Homo Sapiens
LGETVKLKC

SEQ ID NO: 1005743 - protein, 9 aa, Homo Sapiens
PEIGKQPEQ

SEQ ID NO: 1005744 - protein, 9 aa, Homo Sapiens
IHLVSEASI

SEQ ID NO: 1005745 - protein, 9 aa, Homo Sapiens
FTRNMVKLA

SEQ ID NO: 1005746 - protein, 9 aa, Homo Sapiens
PRIFSDTAD

SEQ ID NO: 1005747 - protein, 9 aa, Homo Sapiens
QIIHTRKNS

SEQ ID NO: 1005748 - protein, 9 aa, Homo Sapiens
QGCGAKATP

SEQ ID NO: 1005749 - protein, 9 aa, Homo Sapiens
LDEKQEQMF

SEQ ID NO: 1005750 - protein, 9 aa, Homo Sapiens
SEKWGSGDP

SEQ ID NO: 1005751 - protein, 9 aa, Homo Sapiens
DLKSSSSRM

SEQ ID NO: 1005752 - protein, 9 aa, Homo Sapiens
SAGTYRGDS

SEQ ID NO: 1005753 - protein, 9 aa, Homo Sapiens
TNNIVYFFP

SEQ ID NO: 1005754 - protein, 9 aa, Homo Sapiens
RYSEPRVLT

SEQ ID NO: 1005755 - protein, 9 aa, Homo Sapiens
EHWRICTGE

SEQ ID NO: 1005756 - protein, 9 aa, Homo Sapiens
VDEDCLRIS

SEQ ID NO: 1005757 - protein, 9 aa, Homo Sapiens
GPPMHLYLP

SEQ ID NO: 1005758 - protein, 9 aa, Homo Sapiens
KQNGGPLTS

SEQ ID NO: 1005759 - protein, 9 aa, Homo Sapiens
ISHLVPATS

SEQ ID NO: 1005760 - protein, 9 aa, Homo Sapiens
PGQDVWADE

SEQ ID NO: 1005761 - protein, 9 aa, Homo Sapiens
LASVARFRG

SEQ ID NO: 1005762 - protein, 9 aa, Homo Sapiens
RAIFFAGCT

SEQ ID NO: 1005763 - protein, 9 aa, Homo Sapiens
GKLDISGPA

SEQ ID NO: 1005764 - protein, 9 aa, Homo Sapiens
QKLFDIFTY

SEQ ID NO: 1005765 - protein, 9 aa, Homo Sapiens
VNSSEQGTL

SEQ ID NO: 1005766 - protein, 9 aa, Homo Sapiens
ASTLPVDIS

SEQ ID NO: 1005767 - protein, 9 aa, Homo Sapiens
LQPPSENSQ

SEQ ID NO: 1005768 - protein, 9 aa, Homo Sapiens
KAFDCSDSE

SEQ ID NO: 1005769 - protein, 9 aa, Homo Sapiens
LSMIDLPRS

SEQ ID NO: 1005770 - protein, 9 aa, Homo Sapiens
EQSLRDVVE

SEQ ID NO: 1005771 - protein, 9 aa, Homo Sapiens
LQSCQICNQ

SEQ ID NO: 1005772 - protein, 9 aa, Homo Sapiens
QGWAKISNM

SEQ ID NO: 1005773 - protein, 9 aa, Homo Sapiens
HLVELDLTE

SEQ ID NO: 1005774 - protein, 9 aa, Homo Sapiens
QEEQGKISE

SEQ ID NO: 1005775 - protein, 9 aa, Homo Sapiens
DPAVGVIVL

SEQ ID NO: 1005776 - protein, 9 aa, Homo Sapiens
GCSLGQLSQ

SEQ ID NO: 1005777 - protein, 9 aa, Homo Sapiens
ARPPKPGRS

SEQ ID NO: 1005778 - protein, 9 aa, Homo Sapiens
EEKVEIFHS

SEQ ID NO: 1005779 - protein, 9 aa, Homo Sapiens
SSIFLYICM

SEQ ID NO: 1005780 - protein, 9 aa, Homo Sapiens
IILVVICAI

SEQ ID NO: 1005781 - protein, 9 aa, Homo Sapiens
IQHLEQIGK

SEQ ID NO: 1005782 - protein, 9 aa, Homo Sapiens
PDQKDNQPY

SEQ ID NO: 1005783 - protein, 9 aa, Homo Sapiens
PPSPPLVIS

SEQ ID NO: 1005784 - protein, 9 aa, Homo Sapiens
LQVGSLCLL

SEQ ID NO: 1005785 - protein, 9 aa, Homo Sapiens
EVDEDKCAS

SEQ ID NO: 1005786 - protein, 9 aa, Homo Sapiens
LTMDTWPTR

SEQ ID NO: 1005787 - protein, 9 aa, Homo Sapiens
AKALEHCGS

SEQ ID NO: 1005788 - protein, 9 aa, Homo Sapiens
ASYSLFTIV

SEQ ID NO: 1005789 - protein, 9 aa, Homo Sapiens
FIPSQPERV

SEQ ID NO: 1005790 - protein, 9 aa, Homo Sapiens
LVTVISDSC

SEQ ID NO: 1005791 - protein, 9 aa, Homo Sapiens
SFSAARSRK

SEQ ID NO: 1005792 - protein, 9 aa, Homo Sapiens
IKLGVCANR

SEQ ID NO: 1005793 - protein, 9 aa, Homo Sapiens
PHQAGHASR

SEQ ID NO: 1005794 - protein, 9 aa, Homo Sapiens
SMDPAHSIL

SEQ ID NO: 1005795 - protein, 9 aa, Homo Sapiens
DILDPRASP

SEQ ID NO: 1005796 - protein, 9 aa, Homo Sapiens
GPPGPPGFI

SEQ ID NO: 1005797 - protein, 9 aa, Homo Sapiens
LYLVKTSDL

SEQ ID NO: 1005798 - protein, 9 aa, Homo Sapiens
DKPSRCYFH

SEQ ID NO: 1005799 - protein, 9 aa, Homo Sapiens
QDYEEFHYD

SEQ ID NO: 1005800 - protein, 9 aa, Homo Sapiens
TGLQASNIM

SEQ ID NO: 1005801 - protein, 9 aa, Homo Sapiens
LRNFFDSLN

SEQ ID NO: 1005802 - protein, 9 aa, Homo Sapiens
MLDHIARKV

SEQ ID NO: 1005803 - protein, 9 aa, Homo Sapiens
VLSLIDQYF

SEQ ID NO: 1005804 - protein, 9 aa, Homo Sapiens
TIRSLVDSY

SEQ ID NO: 1005805 - protein, 9 aa, Homo Sapiens
DEAAIENIL

SEQ ID NO: 1005806 - protein, 9 aa, Homo Sapiens
QIPVAARDE

SEQ ID NO: 1005807 - protein, 9 aa, Homo Sapiens
ALTALEEAL

SEQ ID NO: 1005808 - protein, 9 aa, Homo Sapiens
PKDQPQEER

SEQ ID NO: 1005809 - protein, 9 aa, Homo Sapiens
LSSREQERT

SEQ ID NO: 1005810 - protein, 9 aa, Homo Sapiens
CLLLLYPAG

SEQ ID NO: 1005811 - protein, 9 aa, Homo Sapiens
QPLFQPLDY

SEQ ID NO: 1005812 - protein, 9 aa, Homo Sapiens
LQRVSFSLY

SEQ ID NO: 1005813 - protein, 9 aa, Homo Sapiens
SFREKKFFC

SEQ ID NO: 1005814 - protein, 9 aa, Homo Sapiens
HGLANFISS

SEQ ID NO: 1005815 - protein, 9 aa, Homo Sapiens
MDARRNVPQ

SEQ ID NO: 1005816 - protein, 9 aa, Homo Sapiens
LFAVGLFHT

SEQ ID NO: 1005817 - protein, 9 aa, Homo Sapiens
SIELMFQNS

SEQ ID NO: 1005818 - protein, 9 aa, Homo Sapiens
NFWARWSGA

SEQ ID NO: 1005819 - protein, 9 aa, Homo Sapiens
QGELVALLH

SEQ ID NO: 1005820 - protein, 9 aa, Homo Sapiens
DDHICFISE

SEQ ID NO: 1005821 - protein, 9 aa, Homo Sapiens
KEASLPSVQ

SEQ ID NO: 1005822 - protein, 9 aa, Homo Sapiens
SLSPEKVFS

SEQ ID NO: 1005823 - protein, 9 aa, Homo Sapiens
HIISFLPVG

SEQ ID NO: 1005824 - protein, 9 aa, Homo Sapiens
SPKEASLPS

SEQ ID NO: 1005825 - protein, 9 aa, Homo Sapiens
NAFCIAKLM

SEQ ID NO: 1005826 - protein, 9 aa, Homo Sapiens
ASLLESKSL

SEQ ID NO: 1005827 - protein, 9 aa, Homo Sapiens
EKRVLEKRP

SEQ ID NO: 1005828 - protein, 9 aa, Homo Sapiens
QKITLYLTE

SEQ ID NO: 1005829 - protein, 9 aa, Homo Sapiens
STTTVEHAL

SEQ ID NO: 1005830 - protein, 9 aa, Homo Sapiens
NNGKVHLVV

SEQ ID NO: 1005831 - protein, 9 aa, Homo Sapiens
VPASENSFR

SEQ ID NO: 1005832 - protein, 9 aa, Homo Sapiens
TQPRRVVAM

SEQ ID NO: 1005833 - protein, 9 aa, Homo Sapiens
LTKNTTLQS

SEQ ID NO: 1005834 - protein, 9 aa, Homo Sapiens
HLYLPSHPH

SEQ ID NO: 1005835 - protein, 9 aa, Homo Sapiens
SANPKKLKG

SEQ ID NO: 1005836 - protein, 9 aa, Homo Sapiens
RTWNETKPV

SEQ ID NO: 1005837 - protein, 9 aa, Homo Sapiens
RNFFDSLNE

SEQ ID NO: 1005838 - protein, 9 aa, Homo Sapiens
RKQQNQLTE

SEQ ID NO: 1005839 - protein, 9 aa, Homo Sapiens
KNFQMAQPP

SEQ ID NO: 1005840 - protein, 9 aa, Homo Sapiens
DILMENNFR

SEQ ID NO: 1005841 - protein, 9 aa, Homo Sapiens
RKIESMDEL

SEQ ID NO: 1005842 - protein, 9 aa, Homo Sapiens
GELFAVGLF

SEQ ID NO: 1005843 - protein, 9 aa, Homo Sapiens
TTFMRARFR

SEQ ID NO: 1005844 - protein, 9 aa, Homo Sapiens
KVNHKGYRK

SEQ ID NO: 1005845 - protein, 9 aa, Homo Sapiens
RLGDLREAA

SEQ ID NO: 1005846 - protein, 9 aa, Homo Sapiens
VKRQWEKKS

SEQ ID NO: 1005847 - protein, 9 aa, Homo Sapiens
LHRASYYFL

SEQ ID NO: 1005848 - protein, 9 aa, Homo Sapiens
AAITGGYLD

SEQ ID NO: 1005849 - protein, 9 aa, Homo Sapiens
KLTEVLNGK

SEQ ID NO: 1005850 - protein, 9 aa, Homo Sapiens
MMILLEVRW

SEQ ID NO: 1005851 - protein, 9 aa, Homo Sapiens
QAWQSFLQE

SEQ ID NO: 1005852 - protein, 9 aa, Homo Sapiens
GAKEQEEPR

SEQ ID NO: 1005853 - protein, 9 aa, Homo Sapiens
GPRGSPGSP

SEQ ID NO: 1005854 - protein, 9 aa, Homo Sapiens
VSSRKEATE

SEQ ID NO: 1005855 - protein, 9 aa, Homo Sapiens
GIPAQRLGR

SEQ ID NO: 1005856 - protein, 9 aa, Homo Sapiens
CLFLAGETE

SEQ ID NO: 1005857 - protein, 9 aa, Homo Sapiens
PGFSVCPPG

SEQ ID NO: 1005858 - protein, 9 aa, Homo Sapiens
KFHQEPPTK

SEQ ID NO: 1005859 - protein, 9 aa, Homo Sapiens
SMHHLFLFF

SEQ ID NO: 1005860 - protein, 9 aa, Homo Sapiens
LSIVLHNMS

SEQ ID NO: 1005861 - protein, 9 aa, Homo Sapiens
EPPPSYDKA

SEQ ID NO: 1005862 - protein, 9 aa, Homo Sapiens
PVPASENSF

SEQ ID NO: 1005863 - protein, 9 aa, Homo Sapiens
IMYVEDVRS

SEQ ID NO: 1005864 - protein, 9 aa, Homo Sapiens
KVERQNRSD

SEQ ID NO: 1005865 - protein, 9 aa, Homo Sapiens
IFMVLLIYI

SEQ ID NO: 1005866 - protein, 9 aa, Homo Sapiens
EIQKLFDIF

SEQ ID NO: 1005867 - protein, 9 aa, Homo Sapiens
ELFAVGLFH

SEQ ID NO: 1005868 - protein, 9 aa, Homo Sapiens
TYRGDSHLQ

SEQ ID NO: 1005869 - protein, 9 aa, Homo Sapiens
AKEAAISMG

SEQ ID NO: 1005870 - protein, 9 aa, Homo Sapiens
CMRIGIPAQ

SEQ ID NO: 1005871 - protein, 9 aa, Homo Sapiens
DQPQEERKS

SEQ ID NO: 1005872 - protein, 9 aa, Homo Sapiens
DLFKLGKPY

SEQ ID NO: 1005873 - protein, 9 aa, Homo Sapiens
NKFVTKGQT

SEQ ID NO: 1005874 - protein, 9 aa, Homo Sapiens
PTLARWLQR

SEQ ID NO: 1005875 - protein, 9 aa, Homo Sapiens
LEPSAKPNN

SEQ ID NO: 1005876 - protein, 9 aa, Homo Sapiens
RDPPHQPGS

SEQ ID NO: 1005877 - protein, 9 aa, Homo Sapiens
VHKLSSQGQ

SEQ ID NO: 1005878 - protein, 9 aa, Homo Sapiens
VALLHPRIV

SEQ ID NO: 1005879 - protein, 9 aa, Homo Sapiens
DVFKASVYG

SEQ ID NO: 1005880 - protein, 9 aa, Homo Sapiens
QKRQVEHLE

SEQ ID NO: 1005881 - protein, 9 aa, Homo Sapiens
AILRYLKNN

SEQ ID NO: 1005882 - protein, 9 aa, Homo Sapiens
ILSAYITIA

SEQ ID NO: 1005883 - protein, 9 aa, Homo Sapiens
DRYAAICKP

SEQ ID NO: 1005884 - protein, 9 aa, Homo Sapiens
VDRPLQVFY

SEQ ID NO: 1005885 - protein, 9 aa, Homo Sapiens
FRLFAKLNT

SEQ ID NO: 1005886 - protein, 9 aa, Homo Sapiens
NSRPFSKNL

SEQ ID NO: 1005887 - protein, 9 aa, Homo Sapiens
EYYIKILLQ

SEQ ID NO: 1005888 - protein, 9 aa, Homo Sapiens
TPLGQQRPH

SEQ ID NO: 1005889 - protein, 9 aa, Homo Sapiens
FPLETFHCL

SEQ ID NO: 1005890 - protein, 9 aa, Homo Sapiens
KFSAVKKKF

SEQ ID NO: 1005891 - protein, 9 aa, Homo Sapiens
QFDGALNVD

SEQ ID NO: 1005892 - protein, 9 aa, Homo Sapiens
KVIVKLNGT

SEQ ID NO: 1005893 - protein, 9 aa, Homo Sapiens
VLFPYPENN

SEQ ID NO: 1005894 - protein, 9 aa, Homo Sapiens
DGLISPRKS

SEQ ID NO: 1005895 - protein, 9 aa, Homo Sapiens
LRLFQQALQ

SEQ ID NO: 1005896 - protein, 9 aa, Homo Sapiens
TAQDKWALD

SEQ ID NO: 1005897 - protein, 9 aa, Homo Sapiens
RLRSHSAQL

SEQ ID NO: 1005898 - protein, 9 aa, Homo Sapiens
PQDFKRTDD

SEQ ID NO: 1005899 - protein, 9 aa, Homo Sapiens
NMGRFGSRM

SEQ ID NO: 1005900 - protein, 9 aa, Homo Sapiens
AFDCSDSEK

SEQ ID NO: 1005901 - protein, 9 aa, Homo Sapiens
VDNQNERDI

SEQ ID NO: 1005902 - protein, 9 aa, Homo Sapiens
RIHLVSEAS

SEQ ID NO: 1005903 - protein, 9 aa, Homo Sapiens
VAGPVGGFL

SEQ ID NO: 1005904 - protein, 9 aa, Homo Sapiens
LSFPHLYLR

SEQ ID NO: 1005905 - protein, 9 aa, Homo Sapiens
LSLFFLLAM

SEQ ID NO: 1005906 - protein, 9 aa, Homo Sapiens
LPLFVTADG

SEQ ID NO: 1005907 - protein, 9 aa, Homo Sapiens
LMVLFCLLL

SEQ ID NO: 1005908 - protein, 9 aa, Homo Sapiens
TLRNRGDDV

SEQ ID NO: 1005909 - protein, 9 aa, Homo Sapiens
FPLISLLLR

SEQ ID NO: 1005910 - protein, 9 aa, Homo Sapiens
RWGQEKENE

SEQ ID NO: 1005911 - protein, 9 aa, Homo Sapiens
MDMNEDDDF

SEQ ID NO: 1005912 - protein, 9 aa, Homo Sapiens
VNVKVDTSP

SEQ ID NO: 1005913 - protein, 9 aa, Homo Sapiens
FRHSNPELL

SEQ ID NO: 1005914 - protein, 9 aa, Homo Sapiens
ASENSFREK

SEQ ID NO: 1005915 - protein, 9 aa, Homo Sapiens
MPVLETYGA

SEQ ID NO: 1005916 - protein, 9 aa, Homo Sapiens
DAEEAQIED

SEQ ID NO: 1005917 - protein, 9 aa, Homo Sapiens
GRPLANQGF

SEQ ID NO: 1005918 - protein, 9 aa, Homo Sapiens
SFTKLFALM

SEQ ID NO: 1005919 - protein, 9 aa, Homo Sapiens
AAIQNEFYS

SEQ ID NO: 1005920 - protein, 9 aa, Homo Sapiens
ARRSKPFLE

SEQ ID NO: 1005921 - protein, 9 aa, Homo Sapiens
IERCPNTYA

SEQ ID NO: 1005922 - protein, 9 aa, Homo Sapiens
EDLIVYEIH

SEQ ID NO: 1005923 - protein, 9 aa, Homo Sapiens
TCEATHFGL

SEQ ID NO: 1005924 - protein, 9 aa, Homo Sapiens
HLVPATSGI

SEQ ID NO: 1005925 - protein, 9 aa, Homo Sapiens
QARRLVFTL

SEQ ID NO: 1005926 - protein, 9 aa, Homo Sapiens
RNPDLVSLL

SEQ ID NO: 1005927 - protein, 9 aa, Homo Sapiens
RIVSYYRDP

SEQ ID NO: 1005928 - protein, 9 aa, Homo Sapiens
TTIMMRSIS

SEQ ID NO: 1005929 - protein, 9 aa, Homo Sapiens
ATRTAYNLY

SEQ ID NO: 1005930 - protein, 9 aa, Homo Sapiens
GHLKVLEST

SEQ ID NO: 1005931 - protein, 9 aa, Homo Sapiens
ELKHGDQKI

SEQ ID NO: 1005932 - protein, 9 aa, Homo Sapiens
KMNKTVNQH

SEQ ID NO: 1005933 - protein, 9 aa, Homo Sapiens
NFLDKTAII

SEQ ID NO: 1005934 - protein, 9 aa, Homo Sapiens
NVKVDTSPR

SEQ ID NO: 1005935 - protein, 9 aa, Homo Sapiens
ESTVNVLKI

SEQ ID NO: 1005936 - protein, 9 aa, Homo Sapiens
SSENVYSQW

SEQ ID NO: 1005937 - protein, 9 aa, Homo Sapiens
KVFHKYSNL

SEQ ID NO: 1005938 - protein, 9 aa, Homo Sapiens
LSLLQDYMQ

SEQ ID NO: 1005939 - protein, 9 aa, Homo Sapiens
GDHMVLGSL

SEQ ID NO: 1005940 - protein, 9 aa, Homo Sapiens
DEDCLRISS

SEQ ID NO: 1005941 - protein, 9 aa, Homo Sapiens
IHNLQEEIE

SEQ ID NO: 1005942 - protein, 9 aa, Homo Sapiens
DNLRGQPVG

SEQ ID NO: 1005943 - protein, 9 aa, Homo Sapiens
DSSLCSYYG

SEQ ID NO: 1005944 - protein, 9 aa, Homo Sapiens
PPSYDKAVK

SEQ ID NO: 1005945 - protein, 9 aa, Homo Sapiens
DPWHLNHLD

SEQ ID NO: 1005946 - protein, 9 aa, Homo Sapiens
GQGSQSTVA

SEQ ID NO: 1005947 - protein, 9 aa, Homo Sapiens
SENMLGHFA

SEQ ID NO: 1005948 - protein, 9 aa, Homo Sapiens
HNLQEEIEK

SEQ ID NO: 1005949 - protein, 9 aa, Homo Sapiens
HPGLTVASG

SEQ ID NO: 1005950 - protein, 9 aa, Homo Sapiens
KDYCTGLKA

SEQ ID NO: 1005951 - protein, 9 aa, Homo Sapiens
LDSFWSQVL

SEQ ID NO: 1005952 - protein, 9 aa, Homo Sapiens
HFLLWKMFS

SEQ ID NO: 1005953 - protein, 9 aa, Homo Sapiens
KSLNSRFAT

SEQ ID NO: 1005954 - protein, 9 aa, Homo Sapiens
VCVDVDIEF

SEQ ID NO: 1005955 - protein, 9 aa, Homo Sapiens
GGPTVSKAP

SEQ ID NO: 1005956 - protein, 9 aa, Homo Sapiens
HALTQVLAN

SEQ ID NO: 1005957 - protein, 9 aa, Homo Sapiens
KTRVQNVCA

SEQ ID NO: 1005958 - protein, 9 aa, Homo Sapiens
QEILSFADG

SEQ ID NO: 1005959 - protein, 9 aa, Homo Sapiens
QPGWRNLEG

SEQ ID NO: 1005960 - protein, 9 aa, Homo Sapiens
RVGPSPRGG

SEQ ID NO: 1005961 - protein, 9 aa, Homo Sapiens
DKEEKGTNP

SEQ ID NO: 1005962 - protein, 9 aa, Homo Sapiens
RPAESARGP

SEQ ID NO: 1005963 - protein, 9 aa, Homo Sapiens
RPPKPGRSF

SEQ ID NO: 1005964 - protein, 9 aa, Homo Sapiens
LAEHWRICT

SEQ ID NO: 1005965 - protein, 9 aa, Homo Sapiens
TEDLVDTDG

SEQ ID NO: 1005966 - protein, 9 aa, Homo Sapiens
DSAGTYRGD

SEQ ID NO: 1005967 - protein, 9 aa, Homo Sapiens
PPQGENQSQ

SEQ ID NO: 1005968 - protein, 9 aa, Homo Sapiens
VYNPVDWYP

SEQ ID NO: 1005969 - protein, 9 aa, Homo Sapiens
GRFLVREDF

SEQ ID NO: 1005970 - protein, 9 aa, Homo Sapiens
NTTLQSLDP

SEQ ID NO: 1005971 - protein, 9 aa, Homo Sapiens
LSKLHCDKL

SEQ ID NO: 1005972 - protein, 9 aa, Homo Sapiens
ALNHTDMAL

SEQ ID NO: 1005973 - protein, 9 aa, Homo Sapiens
IIQELLGHA

SEQ ID NO: 1005974 - protein, 9 aa, Homo Sapiens
VKVWSHVGH

SEQ ID NO: 1005975 - protein, 9 aa, Homo Sapiens
SFPVKGLSS

SEQ ID NO: 1005976 - protein, 9 aa, Homo Sapiens
VSFNCIDKP

SEQ ID NO: 1005977 - protein, 9 aa, Homo Sapiens
VVSMYYLRS

SEQ ID NO: 1005978 - protein, 9 aa, Homo Sapiens
ITCQNFIGK

SEQ ID NO: 1005979 - protein, 9 aa, Homo Sapiens
IQNCATSFA

SEQ ID NO: 1005980 - protein, 9 aa, Homo Sapiens
EAQCLLGQF

SEQ ID NO: 1005981 - protein, 9 aa, Homo Sapiens
RLLDYEALQ

SEQ ID NO: 1005982 - protein, 9 aa, Homo Sapiens
SSFFRAQRS

SEQ ID NO: 1005983 - protein, 9 aa, Homo Sapiens
DQQKAEWLV

SEQ ID NO: 1005984 - protein, 9 aa, Homo Sapiens
PDVSDEMRT

SEQ ID NO: 1005985 - protein, 9 aa, Homo Sapiens
LTLVENFTI

SEQ ID NO: 1005986 - protein, 9 aa, Homo Sapiens
PSPLKAPNE

SEQ ID NO: 1005987 - protein, 9 aa, Homo Sapiens
RHPDLPRWL

SEQ ID NO: 1005988 - protein, 9 aa, Homo Sapiens
KQKIFQVEL

SEQ ID NO: 1005989 - protein, 9 aa, Homo Sapiens
RRSKPFLEL

SEQ ID NO: 1005990 - protein, 9 aa, Homo Sapiens
DSSEESSQE

SEQ ID NO: 1005991 - protein, 9 aa, Homo Sapiens
PGTRPTAIG

SEQ ID NO: 1005992 - protein, 9 aa, Homo Sapiens
SWNKDKMQS

SEQ ID NO: 1005993 - protein, 9 aa, Homo Sapiens
RSEISCYWE

SEQ ID NO: 1005994 - protein, 9 aa, Homo Sapiens
GNSIDHLYS

SEQ ID NO: 1005995 - protein, 9 aa, Homo Sapiens
KLFALMERW

SEQ ID NO: 1005996 - protein, 9 aa, Homo Sapiens
VDIFFSLVT

SEQ ID NO: 1005997 - protein, 9 aa, Homo Sapiens
HSRDYKNSE

SEQ ID NO: 1005998 - protein, 9 aa, Homo Sapiens
NLASVARFR

SEQ ID NO: 1005999 - protein, 9 aa, Homo Sapiens
QSLPVSLRV

SEQ ID NO: 1006000 - protein, 9 aa, Homo Sapiens
EQRKSIKTY

SEQ ID NO: 1006001 - protein, 9 aa, Homo Sapiens
VTDPVQIIQ

SEQ ID NO: 1006002 - protein, 9 aa, Homo Sapiens
RALSNIFLR

SEQ ID NO: 1006003 - protein, 9 aa, Homo Sapiens
KLFSWAQIR

SEQ ID NO: 1006004 - protein, 9 aa, Homo Sapiens
VGPSPRGGA

SEQ ID NO: 1006005 - protein, 9 aa, Homo Sapiens
ANRLIGGLA

SEQ ID NO: 1006006 - protein, 9 aa, Homo Sapiens
KLTTFLLQH

SEQ ID NO: 1006007 - protein, 9 aa, Homo Sapiens
SSPTSEGAS

SEQ ID NO: 1006008 - protein, 9 aa, Homo Sapiens
SFAGILENG

SEQ ID NO: 1006009 - protein, 9 aa, Homo Sapiens
LVKAETPKA

SEQ ID NO: 1006010 - protein, 9 aa, Homo Sapiens
VQIRDDHIC

SEQ ID NO: 1006011 - protein, 9 aa, Homo Sapiens
LEEEDNSKE

SEQ ID NO: 1006012 - protein, 9 aa, Homo Sapiens
CTVKSFLSK

SEQ ID NO: 1006013 - protein, 9 aa, Homo Sapiens
SDVLDILVL

SEQ ID NO: 1006014 - protein, 9 aa, Homo Sapiens
SSVTSPLVV

SEQ ID NO: 1006015 - protein, 9 aa, Homo Sapiens
GFLYLPKDK

SEQ ID NO: 1006016 - protein, 9 aa, Homo Sapiens
TSPLVVNEN

SEQ ID NO: 1006017 - protein, 9 aa, Homo Sapiens
PPMHLYLPS

SEQ ID NO: 1006018 - protein, 9 aa, Homo Sapiens
PPSELNSVK

SEQ ID NO: 1006019 - protein, 9 aa, Homo Sapiens
KITLYLTEK

SEQ ID NO: 1006020 - protein, 9 aa, Homo Sapiens
MDLTPRSDN

SEQ ID NO: 1006021 - protein, 9 aa, Homo Sapiens
KGKEYYIKI

SEQ ID NO: 1006022 - protein, 9 aa, Homo Sapiens
PTMDSSAHR

SEQ ID NO: 1006023 - protein, 9 aa, Homo Sapiens
EVPRNLCRM

SEQ ID NO: 1006024 - protein, 9 aa, Homo Sapiens
QLSKRPCGR

SEQ ID NO: 1006025 - protein, 9 aa, Homo Sapiens
YVKISDCFW

SEQ ID NO: 1006026 - protein, 9 aa, Homo Sapiens
PKDVKLILP

SEQ ID NO: 1006027 - protein, 9 aa, Homo Sapiens
PRGKDSRLS

SEQ ID NO: 1006028 - protein, 9 aa, Homo Sapiens
QPPSPAFTS

SEQ ID NO: 1006029 - protein, 9 aa, Homo Sapiens
KAKRERGIT

SEQ ID NO: 1006030 - protein, 9 aa, Homo Sapiens
EKETSKLPS

SEQ ID NO: 1006031 - protein, 9 aa, Homo Sapiens
RGVVVIPRS

SEQ ID NO: 1006032 - protein, 9 aa, Homo Sapiens
LIFDHEDLL

SEQ ID NO: 1006033 - protein, 9 aa, Homo Sapiens
SNIMWTISD

SEQ ID NO: 1006034 - protein, 9 aa, Homo Sapiens
YPPLDTPKT

SEQ ID NO: 1006035 - protein, 9 aa, Homo Sapiens
MRSISLRGF

SEQ ID NO: 1006036 - protein, 9 aa, Homo Sapiens
SKLSKSNQY

SEQ ID NO: 1006037 - protein, 9 aa, Homo Sapiens
HLEQIGKKL

SEQ ID NO: 1006038 - protein, 9 aa, Homo Sapiens
QQSFHLLVF

SEQ ID NO: 1006039 - protein, 9 aa, Homo Sapiens
FSPHTPSPV

SEQ ID NO: 1006040 - protein, 9 aa, Homo Sapiens
GKIMYVEDV

SEQ ID NO: 1006041 - protein, 9 aa, Homo Sapiens
TDTALTALE

SEQ ID NO: 1006042 - protein, 9 aa, Homo Sapiens
GLLLKEEHR

SEQ ID NO: 1006043 - protein, 9 aa, Homo Sapiens
TLDQSEYTS

SEQ ID NO: 1006044 - protein, 9 aa, Homo Sapiens
KVPLFPLPG

SEQ ID NO: 1006045 - protein, 9 aa, Homo Sapiens
CIAANLVGA

SEQ ID NO: 1006046 - protein, 9 aa, Homo Sapiens
GFVDLLNGE

SEQ ID NO: 1006047 - protein, 9 aa, Homo Sapiens
FIPLGQGLV

SEQ ID NO: 1006048 - protein, 9 aa, Homo Sapiens
AGEDGTSEQ

SEQ ID NO: 1006049 - protein, 9 aa, Homo Sapiens
LFVDVPAGT

SEQ ID NO: 1006050 - protein, 9 aa, Homo Sapiens
VLILFFLND

SEQ ID NO: 1006051 - protein, 9 aa, Homo Sapiens
YRLSGDWNL

SEQ ID NO: 1006052 - protein, 9 aa, Homo Sapiens
TCEAKEGKT

SEQ ID NO: 1006053 - protein, 9 aa, Homo Sapiens
NKNSSIADI

SEQ ID NO: 1006054 - protein, 9 aa, Homo Sapiens
TQRAQLEQS

SEQ ID NO: 1006055 - protein, 9 aa, Homo Sapiens
ERICFLLIA

SEQ ID NO: 1006056 - protein, 9 aa, Homo Sapiens
GKPYHKKEH

SEQ ID NO: 1006057 - protein, 9 aa, Homo Sapiens
LGKPYHKKE

SEQ ID NO: 1006058 - protein, 9 aa, Homo Sapiens
AKEPRDSRP

SEQ ID NO: 1006059 - protein, 9 aa, Homo Sapiens
SPPSPPSFP

SEQ ID NO: 1006060 - protein, 9 aa, Homo Sapiens
LTSLGHNKN

SEQ ID NO: 1006061 - protein, 9 aa, Homo Sapiens
AFLISNHQR

SEQ ID NO: 1006062 - protein, 9 aa, Homo Sapiens
LSGNTLRVK

SEQ ID NO: 1006063 - protein, 9 aa, Homo Sapiens
TTEEGIIRV

SEQ ID NO: 1006064 - protein, 9 aa, Homo Sapiens
PSAPHFFSS

SEQ ID NO: 1006065 - protein, 9 aa, Homo Sapiens
GIASGIKYL

SEQ ID NO: 1006066 - protein, 9 aa, Homo Sapiens
ESSWNKDKM

SEQ ID NO: 1006067 - protein, 9 aa, Homo Sapiens
LELEFTRNM

SEQ ID NO: 1006068 - protein, 9 aa, Homo Sapiens
RIYTGQKPY

SEQ ID NO: 1006069 - protein, 9 aa, Homo Sapiens
QGLVTPTEK

SEQ ID NO: 1006070 - protein, 9 aa, Homo Sapiens
RKDSGSTEG

SEQ ID NO: 1006071 - protein, 9 aa, Homo Sapiens
CKIYIGDQV

SEQ ID NO: 1006072 - protein, 9 aa, Homo Sapiens
KVVKVAEYK

SEQ ID NO: 1006073 - protein, 9 aa, Homo Sapiens
LRGIASGIK

SEQ ID NO: 1006074 - protein, 9 aa, Homo Sapiens
STGVMLALV

SEQ ID NO: 1006075 - protein, 9 aa, Homo Sapiens
YGDRIDLSS

SEQ ID NO: 1006076 - protein, 9 aa, Homo Sapiens
RSIPKDKLE

SEQ ID NO: 1006077 - protein, 9 aa, Homo Sapiens
SDAGTRGCA

SEQ ID NO: 1006078 - protein, 9 aa, Homo Sapiens
HCGSVDFLV

SEQ ID NO: 1006079 - protein, 9 aa, Homo Sapiens
DPLVDNQNE

SEQ ID NO: 1006080 - protein, 9 aa, Homo Sapiens
FKNNYTCRL

SEQ ID NO: 1006081 - protein, 9 aa, Homo Sapiens
SWGCRRNPA

SEQ ID NO: 1006082 - protein, 9 aa, Homo Sapiens
ALEILNKHL

SEQ ID NO: 1006083 - protein, 9 aa, Homo Sapiens
LKVLESTKE

SEQ ID NO: 1006084 - protein, 9 aa, Homo Sapiens
LDKTAIISL

SEQ ID NO: 1006085 - protein, 9 aa, Homo Sapiens
PTAIGSFSS

SEQ ID NO: 1006086 - protein, 9 aa, Homo Sapiens
IDVFFWQTW

SEQ ID NO: 1006087 - protein, 9 aa, Homo Sapiens
LVIEGPMYV

SEQ ID NO: 1006088 - protein, 9 aa, Homo Sapiens
SCGAEKQKE

SEQ ID NO: 1006089 - protein, 9 aa, Homo Sapiens
LHYKVNHKG

SEQ ID NO: 1006090 - protein, 9 aa, Homo Sapiens
EKVFSECIE

SEQ ID NO: 1006091 - protein, 9 aa, Homo Sapiens
NSNPLQRHT

SEQ ID NO: 1006092 - protein, 9 aa, Homo Sapiens
MVFVRSFFV

SEQ ID NO: 1006093 - protein, 9 aa, Homo Sapiens
VVPVHVQTN

SEQ ID NO: 1006094 - protein, 9 aa, Homo Sapiens
TPPGVAALS

SEQ ID NO: 1006095 - protein, 9 aa, Homo Sapiens
GISNQPVNP

SEQ ID NO: 1006096 - protein, 9 aa, Homo Sapiens
FWQTWHDER

SEQ ID NO: 1006097 - protein, 9 aa, Homo Sapiens
DHKDSSLQW

SEQ ID NO: 1006098 - protein, 9 aa, Homo Sapiens
FPKEEWVEQ

SEQ ID NO: 1006099 - protein, 9 aa, Homo Sapiens
SSVRIKLEP

SEQ ID NO: 1006100 - protein, 9 aa, Homo Sapiens
PQKLFYTVG

SEQ ID NO: 1006101 - protein, 9 aa, Homo Sapiens
ERPFSCTQC

SEQ ID NO: 1006102 - protein, 9 aa, Homo Sapiens
ETGFCVSGI

SEQ ID NO: 1006103 - protein, 9 aa, Homo Sapiens
LFKKSNIKT

SEQ ID NO: 1006104 - protein, 9 aa, Homo Sapiens
LSIALPLFV

SEQ ID NO: 1006105 - protein, 9 aa, Homo Sapiens
KEAAISMGS

SEQ ID NO: 1006106 - protein, 9 aa, Homo Sapiens
KGDKGKKGL

SEQ ID NO: 1006107 - protein, 9 aa, Homo Sapiens
TSVESYESQ

SEQ ID NO: 1006108 - protein, 9 aa, Homo Sapiens
GHKVERQNR

SEQ ID NO: 1006109 - protein, 9 aa, Homo Sapiens
RQEPVRFEN

SEQ ID NO: 1006110 - protein, 9 aa, Homo Sapiens
LEYNAIKKI

SEQ ID NO: 1006111 - protein, 9 aa, Homo Sapiens
PSQGQVAGA

SEQ ID NO: 1006112 - protein, 9 aa, Homo Sapiens
GPLAGVRAA

SEQ ID NO: 1006113 - protein, 9 aa, Homo Sapiens
GGLRDPGQG

SEQ ID NO: 1006114 - protein, 9 aa, Homo Sapiens
ESSLGIAEF

SEQ ID NO: 1006115 - protein, 9 aa, Homo Sapiens
IDGSFEIEN

SEQ ID NO: 1006116 - protein, 9 aa, Homo Sapiens
QRLGRYHQC

SEQ ID NO: 1006117 - protein, 9 aa, Homo Sapiens
SKVRAERNN

SEQ ID NO: 1006118 - protein, 9 aa, Homo Sapiens
SHLVPATSG

SEQ ID NO: 1006119 - protein, 9 aa, Homo Sapiens
VSGMMILLE

SEQ ID NO: 1006120 - protein, 9 aa, Homo Sapiens
AEVAQSPKY

SEQ ID NO: 1006121 - protein, 9 aa, Homo Sapiens
PLGLRNEDL

SEQ ID NO: 1006122 - protein, 9 aa, Homo Sapiens
ECVASNNVR

SEQ ID NO: 1006123 - protein, 9 aa, Homo Sapiens
WPWIYFATL

SEQ ID NO: 1006124 - protein, 9 aa, Homo Sapiens
ETKPVCKAL

SEQ ID NO: 1006125 - protein, 9 aa, Homo Sapiens
LNPFIYTLC

SEQ ID NO: 1006126 - protein, 9 aa, Homo Sapiens
GDKGKKGLL

SEQ ID NO: 1006127 - protein, 9 aa, Homo Sapiens
AFQVGKFSE

SEQ ID NO: 1006128 - protein, 9 aa, Homo Sapiens
RERNSRPFS

SEQ ID NO: 1006129 - protein, 9 aa, Homo Sapiens
SSLGIAEFW

SEQ ID NO: 1006130 - protein, 9 aa, Homo Sapiens
HILLPSLYR

SEQ ID NO: 1006131 - protein, 9 aa, Homo Sapiens
QLMQDMEHL

SEQ ID NO: 1006132 - protein, 9 aa, Homo Sapiens
IYFLFFFYG

SEQ ID NO: 1006133 - protein, 9 aa, Homo Sapiens
AWQGYHSMP

SEQ ID NO: 1006134 - protein, 9 aa, Homo Sapiens
GFIGHPGAR

SEQ ID NO: 1006135 - protein, 9 aa, Homo Sapiens
QDNQGFALN

SEQ ID NO: 1006136 - protein, 9 aa, Homo Sapiens
PGFIGHPGA

SEQ ID NO: 1006137 - protein, 9 aa, Homo Sapiens
LSVLLKNLE

SEQ ID NO: 1006138 - protein, 9 aa, Homo Sapiens
VLSLRTEDL

SEQ ID NO: 1006139 - protein, 9 aa, Homo Sapiens
KKFIPFSRI

SEQ ID NO: 1006140 - protein, 9 aa, Homo Sapiens
NDLEDFFIK

SEQ ID NO: 1006141 - protein, 9 aa, Homo Sapiens
LSTPDPSEK

SEQ ID NO: 1006142 - protein, 9 aa, Homo Sapiens
AISKSETTI

SEQ ID NO: 1006143 - protein, 9 aa, Homo Sapiens
LCSMADVAI

SEQ ID NO: 1006144 - protein, 9 aa, Homo Sapiens
GDVVVSMYY

SEQ ID NO: 1006145 - protein, 9 aa, Homo Sapiens
GFDGHTYPS

SEQ ID NO: 1006146 - protein, 9 aa, Homo Sapiens
SRPRPPRSS

SEQ ID NO: 1006147 - protein, 9 aa, Homo Sapiens
IIAPLFQEL

SEQ ID NO: 1006148 - protein, 9 aa, Homo Sapiens
TIMAVICFS

SEQ ID NO: 1006149 - protein, 9 aa, Homo Sapiens
LYFLLQEED

SEQ ID NO: 1006150 - protein, 9 aa, Homo Sapiens
NNAWQLHRT

SEQ ID NO: 1006151 - protein, 9 aa, Homo Sapiens
IQVFVKNVD

SEQ ID NO: 1006152 - protein, 9 aa, Homo Sapiens
SAVVNWTFY

SEQ ID NO: 1006153 - protein, 9 aa, Homo Sapiens
DKPPGIIQR

SEQ ID NO: 1006154 - protein, 9 aa, Homo Sapiens
IESMDELEE

SEQ ID NO: 1006155 - protein, 9 aa, Homo Sapiens
FKEETLRTP

SEQ ID NO: 1006156 - protein, 9 aa, Homo Sapiens
DVYGVMKAY

SEQ ID NO: 1006157 - protein, 9 aa, Homo Sapiens
LMQDMEHLQ

SEQ ID NO: 1006158 - protein, 9 aa, Homo Sapiens
GNIELTRST

SEQ ID NO: 1006159 - protein, 9 aa, Homo Sapiens
VVVIKAGKD

SEQ ID NO: 1006160 - protein, 9 aa, Homo Sapiens
SSTKRVCLV

SEQ ID NO: 1006161 - protein, 9 aa, Homo Sapiens
KGAYFSDDI

SEQ ID NO: 1006162 - protein, 9 aa, Homo Sapiens
VKPCGTNTH

SEQ ID NO: 1006163 - protein, 9 aa, Homo Sapiens
LILGRHPII

SEQ ID NO: 1006164 - protein, 9 aa, Homo Sapiens
HPGQSQGFL

SEQ ID NO: 1006165 - protein, 9 aa, Homo Sapiens
DLQDDIQNC

SEQ ID NO: 1006166 - protein, 9 aa, Homo Sapiens
TQGLVKAET

SEQ ID NO: 1006167 - protein, 9 aa, Homo Sapiens
SRDYKNSEA

SEQ ID NO: 1006168 - protein, 9 aa, Homo Sapiens
GMTNIFWMD

SEQ ID NO: 1006169 - protein, 9 aa, Homo Sapiens
NQQQGEDEH

SEQ ID NO: 1006170 - protein, 9 aa, Homo Sapiens
DHMVLGSLV

SEQ ID NO: 1006171 - protein, 9 aa, Homo Sapiens
ICTVKSFLS

SEQ ID NO: 1006172 - protein, 9 aa, Homo Sapiens
QGSQSTVAV

SEQ ID NO: 1006173 - protein, 9 aa, Homo Sapiens
LVPATSGIA

SEQ ID NO: 1006174 - protein, 9 aa, Homo Sapiens
LTDRYGRPP

SEQ ID NO: 1006175 - protein, 9 aa, Homo Sapiens
ERLAGPEEL

SEQ ID NO: 1006176 - protein, 9 aa, Homo Sapiens
MIIAPLFQE

SEQ ID NO: 1006177 - protein, 9 aa, Homo Sapiens
VDISTPVIT

SEQ ID NO: 1006178 - protein, 9 aa, Homo Sapiens
CWQRKPQQR

SEQ ID NO: 1006179 - protein, 9 aa, Homo Sapiens
QIIQELLGH

SEQ ID NO: 1006180 - protein, 9 aa, Homo Sapiens
DGELFAVGL

SEQ ID NO: 1006181 - protein, 9 aa, Homo Sapiens
GCPLVPSGV

SEQ ID NO: 1006182 - protein, 9 aa, Homo Sapiens
SLQDYEEFH

SEQ ID NO: 1006183 - protein, 9 aa, Homo Sapiens
GFLSVQCRY

SEQ ID NO: 1006184 - protein, 9 aa, Homo Sapiens
LLEVVYTSH

SEQ ID NO: 1006185 - protein, 9 aa, Homo Sapiens
IGKQPEQPP

SEQ ID NO: 1006186 - protein, 9 aa, Homo Sapiens
GGHDSLSPR

SEQ ID NO: 1006187 - protein, 9 aa, Homo Sapiens
APFHFARVL

SEQ ID NO: 1006188 - protein, 9 aa, Homo Sapiens
GCWQRKPQQ

SEQ ID NO: 1006189 - protein, 9 aa, Homo Sapiens
LSFYTQTTD

SEQ ID NO: 1006190 - protein, 9 aa, Homo Sapiens
SFFVGEAAR

SEQ ID NO: 1006191 - protein, 9 aa, Homo Sapiens
VKTSDLGTY

SEQ ID NO: 1006192 - protein, 9 aa, Homo Sapiens
KDDLGVVRA

SEQ ID NO: 1006193 - protein, 9 aa, Homo Sapiens
CLLLLYPGL

SEQ ID NO: 1006194 - protein, 9 aa, Homo Sapiens
IIQRKMCIL

SEQ ID NO: 1006195 - protein, 9 aa, Homo Sapiens
SYLTAASIL

SEQ ID NO: 1006196 - protein, 9 aa, Homo Sapiens
AKSLLKFHQ

SEQ ID NO: 1006197 - protein, 9 aa, Homo Sapiens
CVLRKKLKS

SEQ ID NO: 1006198 - protein, 9 aa, Homo Sapiens
TLFTSSVSS

SEQ ID NO: 1006199 - protein, 9 aa, Homo Sapiens
WQSFLQESQ

SEQ ID NO: 1006200 - protein, 9 aa, Homo Sapiens
LDSLAELYF

SEQ ID NO: 1006201 - protein, 9 aa, Homo Sapiens
ICTGEKPYK

SEQ ID NO: 1006202 - protein, 9 aa, Homo Sapiens
YTIDVFFWQ

SEQ ID NO: 1006203 - protein, 9 aa, Homo Sapiens
YYRLRTERD

SEQ ID NO: 1006204 - protein, 9 aa, Homo Sapiens
EVELQDKRI

SEQ ID NO: 1006205 - protein, 9 aa, Homo Sapiens
IGGLASENV

SEQ ID NO: 1006206 - protein, 9 aa, Homo Sapiens
FKKYECVKE

SEQ ID NO: 1006207 - protein, 9 aa, Homo Sapiens
TALEEALAE

SEQ ID NO: 1006208 - protein, 9 aa, Homo Sapiens
STLIFMYLR

SEQ ID NO: 1006209 - protein, 9 aa, Homo Sapiens
QGLVKAETP

SEQ ID NO: 1006210 - protein, 9 aa, Homo Sapiens
TLKKEEKKK

SEQ ID NO: 1006211 - protein, 9 aa, Homo Sapiens
MDNLFEYVI

SEQ ID NO: 1006212 - protein, 9 aa, Homo Sapiens
PPAIIPMGP

SEQ ID NO: 1006213 - protein, 9 aa, Homo Sapiens
RHGPPMHLY

SEQ ID NO: 1006214 - protein, 9 aa, Homo Sapiens
KVLLRVGPS

SEQ ID NO: 1006215 - protein, 9 aa, Homo Sapiens
FDLSVSRNS

SEQ ID NO: 1006216 - protein, 9 aa, Homo Sapiens
ASGMGSLEK

SEQ ID NO: 1006217 - protein, 9 aa, Homo Sapiens
NVICLAVLI

SEQ ID NO: 1006218 - protein, 9 aa, Homo Sapiens
TVLFFVESQ

SEQ ID NO: 1006219 - protein, 9 aa, Homo Sapiens
TGTLKLPPP

SEQ ID NO: 1006220 - protein, 9 aa, Homo Sapiens
KVHSLLKFA

SEQ ID NO: 1006221 - protein, 9 aa, Homo Sapiens
HKFQAFMKN

SEQ ID NO: 1006222 - protein, 9 aa, Homo Sapiens
LGSFPTFQF

SEQ ID NO: 1006223 - protein, 9 aa, Homo Sapiens
PPVTLAFRP

SEQ ID NO: 1006224 - protein, 9 aa, Homo Sapiens
SKEIVVAMY

SEQ ID NO: 1006225 - protein, 9 aa, Homo Sapiens
LRPGWRDFD

SEQ ID NO: 1006226 - protein, 9 aa, Homo Sapiens
SVDFLVCSA

SEQ ID NO: 1006227 - protein, 9 aa, Homo Sapiens
VTTWLSCFF

SEQ ID NO: 1006228 - protein, 9 aa, Homo Sapiens
KQVDSSPNR

SEQ ID NO: 1006229 - protein, 9 aa, Homo Sapiens
PLGSSVKPG

SEQ ID NO: 1006230 - protein, 9 aa, Homo Sapiens
RASPRGNRS

SEQ ID NO: 1006231 - protein, 9 aa, Homo Sapiens
MVLGSLVTD

SEQ ID NO: 1006232 - protein, 9 aa, Homo Sapiens
LWRYLHHLD

SEQ ID NO: 1006233 - protein, 9 aa, Homo Sapiens
KTNKAQAIE

SEQ ID NO: 1006234 - protein, 9 aa, Homo Sapiens
QLYRTKKDN

SEQ ID NO: 1006235 - protein, 9 aa, Homo Sapiens
NASASPLHM

SEQ ID NO: 1006236 - protein, 9 aa, Homo Sapiens
LSGSQLSLS

SEQ ID NO: 1006237 - protein, 9 aa, Homo Sapiens
ENIYLYEED

SEQ ID NO: 1006238 - protein, 9 aa, Homo Sapiens
LEKEGTMEE

SEQ ID NO: 1006239 - protein, 9 aa, Homo Sapiens
TLHRASYYF

SEQ ID NO: 1006240 - protein, 9 aa, Homo Sapiens
HYNFVLNSA

SEQ ID NO: 1006241 - protein, 9 aa, Homo Sapiens
SQQGVGGIT

SEQ ID NO: 1006242 - protein, 9 aa, Homo Sapiens
LTQEFPKEE

SEQ ID NO: 1006243 - protein, 9 aa, Homo Sapiens
KCTCYPPED

SEQ ID NO: 1006244 - protein, 9 aa, Homo Sapiens
KKFDLIVHE

SEQ ID NO: 1006245 - protein, 9 aa, Homo Sapiens
HVIDLDNAT

SEQ ID NO: 1006246 - protein, 9 aa, Homo Sapiens
LRYALSFYT

SEQ ID NO: 1006247 - protein, 9 aa, Homo Sapiens
VPSHCRKIF

SEQ ID NO: 1006248 - protein, 9 aa, Homo Sapiens
KEEWVEQDP

SEQ ID NO: 1006249 - protein, 9 aa, Homo Sapiens
NKLQCLFVD

SEQ ID NO: 1006250 - protein, 9 aa, Homo Sapiens
SSSYKHNRT

SEQ ID NO: 1006251 - protein, 9 aa, Homo Sapiens
SLKRLQKET

SEQ ID NO: 1006252 - protein, 9 aa, Homo Sapiens
FFSRTDSDT

SEQ ID NO: 1006253 - protein, 9 aa, Homo Sapiens
AVFFAAYLT

SEQ ID NO: 1006254 - protein, 9 aa, Homo Sapiens
VLSRSNPSL

SEQ ID NO: 1006255 - protein, 9 aa, Homo Sapiens
IMAPIEIRY

SEQ ID NO: 1006256 - protein, 9 aa, Homo Sapiens
AAVRDKIDR

SEQ ID NO: 1006257 - protein, 9 aa, Homo Sapiens
FEIENLFVI

SEQ ID NO: 1006258 - protein, 9 aa, Homo Sapiens
MRKLIDSAR

SEQ ID NO: 1006259 - protein, 9 aa, Homo Sapiens
PGSPGSFDF

SEQ ID NO: 1006260 - protein, 9 aa, Homo Sapiens
FKPRIVSYY

SEQ ID NO: 1006261 - protein, 9 aa, Homo Sapiens
GYIAYRHNQ

SEQ ID NO: 1006262 - protein, 9 aa, Homo Sapiens
VRAQTCSSV

SEQ ID NO: 1006263 - protein, 9 aa, Homo Sapiens
AECRGKKEK

SEQ ID NO: 1006264 - protein, 9 aa, Homo Sapiens
NQGFALNFT

SEQ ID NO: 1006265 - protein, 9 aa, Homo Sapiens
TCVNLHLPR

SEQ ID NO: 1006266 - protein, 9 aa, Homo Sapiens
KCTPRVCSF

SEQ ID NO: 1006267 - protein, 9 aa, Homo Sapiens
NGENLKNEE

SEQ ID NO: 1006268 - protein, 9 aa, Homo Sapiens
PGERGFQEK

SEQ ID NO: 1006269 - protein, 9 aa, Homo Sapiens
LQAGFFEHL

SEQ ID NO: 1006270 - protein, 9 aa, Homo Sapiens
IKDYCTGLK

SEQ ID NO: 1006271 - protein, 9 aa, Homo Sapiens
AASGALAGV

SEQ ID NO: 1006272 - protein, 9 aa, Homo Sapiens
TQAQRQMDA

SEQ ID NO: 1006273 - protein, 9 aa, Homo Sapiens
LHYNFVLNS

SEQ ID NO: 1006274 - protein, 9 aa, Homo Sapiens
CGSVDFLVC

SEQ ID NO: 1006275 - protein, 9 aa, Homo Sapiens
AQRGDHSFR

SEQ ID NO: 1006276 - protein, 9 aa, Homo Sapiens
QALQNKQDS

SEQ ID NO: 1006277 - protein, 9 aa, Homo Sapiens
TDVSCLFCT

SEQ ID NO: 1006278 - protein, 9 aa, Homo Sapiens
ISTLKAAIR

SEQ ID NO: 1006279 - protein, 9 aa, Homo Sapiens
WNFPPDSRS

SEQ ID NO: 1006280 - protein, 9 aa, Homo Sapiens
LTKSKSKKV

SEQ ID NO: 1006281 - protein, 9 aa, Homo Sapiens
ATSNEPRIF

SEQ ID NO: 1006282 - protein, 9 aa, Homo Sapiens
YLKNNGKVH

SEQ ID NO: 1006283 - protein, 9 aa, Homo Sapiens
GKLRPHYPP

SEQ ID NO: 1006284 - protein, 9 aa, Homo Sapiens
DMKPIHMDF

SEQ ID NO: 1006285 - protein, 9 aa, Homo Sapiens
TQAWQSFLQ

SEQ ID NO: 1006286 - protein, 9 aa, Homo Sapiens
EEDNSKEIV

SEQ ID NO: 1006287 - protein, 9 aa, Homo Sapiens
LVTPTEKGM

SEQ ID NO: 1006288 - protein, 9 aa, Homo Sapiens
SEEVFQELE

SEQ ID NO: 1006289 - protein, 9 aa, Homo Sapiens
SKQEGLICS

SEQ ID NO: 1006290 - protein, 9 aa, Homo Sapiens
SVKLPLASL

SEQ ID NO: 1006291 - protein, 9 aa, Homo Sapiens
SSSGALNVY

SEQ ID NO: 1006292 - protein, 9 aa, Homo Sapiens
LREKLTCFI

SEQ ID NO: 1006293 - protein, 9 aa, Homo Sapiens
TKWKDTQVF

SEQ ID NO: 1006294 - protein, 9 aa, Homo Sapiens
ATSEHNCKE

SEQ ID NO: 1006295 - protein, 9 aa, Homo Sapiens
SEASITHFL

SEQ ID NO: 1006296 - protein, 9 aa, Homo Sapiens
NHLDSASAD

SEQ ID NO: 1006297 - protein, 9 aa, Homo Sapiens
NKGAYFSDD

SEQ ID NO: 1006298 - protein, 9 aa, Homo Sapiens
DLIVKVNKK

SEQ ID NO: 1006299 - protein, 9 aa, Homo Sapiens
EQPGWRNLE

SEQ ID NO: 1006300 - protein, 9 aa, Homo Sapiens
RHIYSTDWV

SEQ ID NO: 1006301 - protein, 9 aa, Homo Sapiens
FRPEASGFS

SEQ ID NO: 1006302 - protein, 9 aa, Homo Sapiens
TLSKDNLLR

SEQ ID NO: 1006303 - protein, 9 aa, Homo Sapiens
FFLLAMGAN

SEQ ID NO: 1006304 - protein, 9 aa, Homo Sapiens
KQSPQSLHV

SEQ ID NO: 1006305 - protein, 9 aa, Homo Sapiens
AYRHNQKGS

SEQ ID NO: 1006306 - protein, 9 aa, Homo Sapiens
KSPYLLQHV

SEQ ID NO: 1006307 - protein, 9 aa, Homo Sapiens
TTDNASILL

SEQ ID NO: 1006308 - protein, 9 aa, Homo Sapiens
DSCLHSSPM

SEQ ID NO: 1006309 - protein, 9 aa, Homo Sapiens
DLPFFWRAS

SEQ ID NO: 1006310 - protein, 9 aa, Homo Sapiens
LPPRFKQFS

SEQ ID NO: 1006311 - protein, 9 aa, Homo Sapiens
PDTRRELAK

SEQ ID NO: 1006312 - protein, 9 aa, Homo Sapiens
NPACSGPKD

SEQ ID NO: 1006313 - protein, 9 aa, Homo Sapiens
STWQMHSGL

SEQ ID NO: 1006314 - protein, 9 aa, Homo Sapiens
NFSTLGGQG

SEQ ID NO: 1006315 - protein, 9 aa, Homo Sapiens
GKHWYQQCT

SEQ ID NO: 1006316 - protein, 9 aa, Homo Sapiens
LLYRLAAET

SEQ ID NO: 1006317 - protein, 9 aa, Homo Sapiens
TEESIPVTK

SEQ ID NO: 1006318 - protein, 9 aa, Homo Sapiens
FLSERSTSS

SEQ ID NO: 1006319 - protein, 9 aa, Homo Sapiens
KPPGIIQRK

SEQ ID NO: 1006320 - protein, 9 aa, Homo Sapiens
RYLHHLDSQ

SEQ ID NO: 1006321 - protein, 9 aa, Homo Sapiens
GSESSWNKD

SEQ ID NO: 1006322 - protein, 9 aa, Homo Sapiens
SNPVREAFG

SEQ ID NO: 1006323 - protein, 9 aa, Homo Sapiens
GKQLLSLSS

SEQ ID NO: 1006324 - protein, 9 aa, Homo Sapiens
ACSRVNTCS

SEQ ID NO: 1006325 - protein, 9 aa, Homo Sapiens
QHKRIYTGQ

SEQ ID NO: 1006326 - protein, 9 aa, Homo Sapiens
SFSDWDWDR

SEQ ID NO: 1006327 - protein, 9 aa, Homo Sapiens
VYFAYYYGL

SEQ ID NO: 1006328 - protein, 9 aa, Homo Sapiens
RKDNLGDDL

SEQ ID NO: 1006329 - protein, 9 aa, Homo Sapiens
NRATCHRKP

SEQ ID NO: 1006330 - protein, 9 aa, Homo Sapiens
WINEKTGEI

SEQ ID NO: 1006331 - protein, 9 aa, Homo Sapiens
VFILLVRYR

SEQ ID NO: 1006332 - protein, 9 aa, Homo Sapiens
YRHISGRCV

SEQ ID NO: 1006333 - protein, 9 aa, Homo Sapiens
FLLQHNQIK

SEQ ID NO: 1006334 - protein, 9 aa, Homo Sapiens
RQQYDLMEV

SEQ ID NO: 1006335 - protein, 9 aa, Homo Sapiens
VTIMAVICF

SEQ ID NO: 1006336 - protein, 9 aa, Homo Sapiens
EAAISMGSA

SEQ ID NO: 1006337 - protein, 9 aa, Homo Sapiens
ERNSRPFSK

SEQ ID NO: 1006338 - protein, 9 aa, Homo Sapiens
PGCPLVPSG

SEQ ID NO: 1006339 - protein, 9 aa, Homo Sapiens
RHFLWSLRS

SEQ ID NO: 1006340 - protein, 9 aa, Homo Sapiens
KLQCLFVDV

SEQ ID NO: 1006341 - protein, 9 aa, Homo Sapiens
HSLSRQNCL

SEQ ID NO: 1006342 - protein, 9 aa, Homo Sapiens
AKVAAALKT

SEQ ID NO: 1006343 - protein, 9 aa, Homo Sapiens
PVQIIQELL

SEQ ID NO: 1006344 - protein, 9 aa, Homo Sapiens
TIHGDMRKL

SEQ ID NO: 1006345 - protein, 9 aa, Homo Sapiens
GTIGVNCSQ

SEQ ID NO: 1006346 - protein, 9 aa, Homo Sapiens
EECGTAFNR

SEQ ID NO: 1006347 - protein, 9 aa, Homo Sapiens
DRYFRSQTL

SEQ ID NO: 1006348 - protein, 9 aa, Homo Sapiens
PKRSSVVSS

SEQ ID NO: 1006349 - protein, 9 aa, Homo Sapiens
DKNELLRVM

SEQ ID NO: 1006350 - protein, 9 aa, Homo Sapiens
NASILLQID

SEQ ID NO: 1006351 - protein, 9 aa, Homo Sapiens
KEVIHEIKF

SEQ ID NO: 1006352 - protein, 9 aa, Homo Sapiens
SIFSYREDL

SEQ ID NO: 1006353 - protein, 9 aa, Homo Sapiens
DKAVKMAKP

SEQ ID NO: 1006354 - protein, 9 aa, Homo Sapiens
NKNKNSSIA

SEQ ID NO: 1006355 - protein, 9 aa, Homo Sapiens
SSSNLSDLK

SEQ ID NO: 1006356 - protein, 9 aa, Homo Sapiens
GPDLHYWSC

SEQ ID NO: 1006357 - protein, 9 aa, Homo Sapiens
PPGPPGFIG

SEQ ID NO: 1006358 - protein, 9 aa, Homo Sapiens
CHRKPDNSK

SEQ ID NO: 1006359 - protein, 9 aa, Homo Sapiens
VCRVESGKN

SEQ ID NO: 1006360 - protein, 9 aa, Homo Sapiens
TMVFVRSFF

SEQ ID NO: 1006361 - protein, 9 aa, Homo Sapiens
FPESLSCTE

SEQ ID NO: 1006362 - protein, 9 aa, Homo Sapiens
FFYLLTLVE

SEQ ID NO: 1006363 - protein, 9 aa, Homo Sapiens
DSLSPRGVG

SEQ ID NO: 1006364 - protein, 9 aa, Homo Sapiens
GIIRVRKSK

SEQ ID NO: 1006365 - protein, 9 aa, Homo Sapiens
VFAVCWASY

SEQ ID NO: 1006366 - protein, 9 aa, Homo Sapiens
VAINPTNTV

SEQ ID NO: 1006367 - protein, 9 aa, Homo Sapiens
KQLLSLSSS

SEQ ID NO: 1006368 - protein, 9 aa, Homo Sapiens
HKESYNELN

SEQ ID NO: 1006369 - protein, 9 aa, Homo Sapiens
KLKQRPYGS

SEQ ID NO: 1006370 - protein, 9 aa, Homo Sapiens
ESLKELRKA

SEQ ID NO: 1006371 - protein, 9 aa, Homo Sapiens
KLPLASLSK

SEQ ID NO: 1006372 - protein, 9 aa, Homo Sapiens
PILTAFCLG

SEQ ID NO: 1006373 - protein, 9 aa, Homo Sapiens
ADNAISKSE

SEQ ID NO: 1006374 - protein, 9 aa, Homo Sapiens
GKNCSSPAP

SEQ ID NO: 1006375 - protein, 9 aa, Homo Sapiens
SWELQAMAE

SEQ ID NO: 1006376 - protein, 9 aa, Homo Sapiens
KAMRTPRCE

SEQ ID NO: 1006377 - protein, 9 aa, Homo Sapiens
FMRARFRTL

SEQ ID NO: 1006378 - protein, 9 aa, Homo Sapiens
EVNSIVVPL

SEQ ID NO: 1006379 - protein, 9 aa, Homo Sapiens
NELSQVPPL

SEQ ID NO: 1006380 - protein, 9 aa, Homo Sapiens
PPWSSYKKQ

SEQ ID NO: 1006381 - protein, 9 aa, Homo Sapiens
STSQLSLVG

SEQ ID NO: 1006382 - protein, 9 aa, Homo Sapiens
NWKRVSSLP

SEQ ID NO: 1006383 - protein, 9 aa, Homo Sapiens
MLQEILSFA

SEQ ID NO: 1006384 - protein, 9 aa, Homo Sapiens
LFAIDKINK

SEQ ID NO: 1006385 - protein, 9 aa, Homo Sapiens
FEYVIGTLE

SEQ ID NO: 1006386 - protein, 9 aa, Homo Sapiens
VHKESYNEL

SEQ ID NO: 1006387 - protein, 9 aa, Homo Sapiens
GVLAQAKFS

SEQ ID NO: 1006388 - protein, 9 aa, Homo Sapiens
FLFHPGYTV

SEQ ID NO: 1006389 - protein, 9 aa, Homo Sapiens
PWIYFATLI

SEQ ID NO: 1006390 - protein, 9 aa, Homo Sapiens
HLQRQNVAV

SEQ ID NO: 1006391 - protein, 9 aa, Homo Sapiens
WPNTSPPLP

SEQ ID NO: 1006392 - protein, 9 aa, Homo Sapiens
ISLANRLIG

SEQ ID NO: 1006393 - protein, 9 aa, Homo Sapiens
GRFGSRMNM

SEQ ID NO: 1006394 - protein, 9 aa, Homo Sapiens
CFWPPYVEL

SEQ ID NO: 1006395 - protein, 9 aa, Homo Sapiens
NSEQKRMRN

SEQ ID NO: 1006396 - protein, 9 aa, Homo Sapiens
TVTAKDKEN

SEQ ID NO: 1006397 - protein, 9 aa, Homo Sapiens
ASLWLQVGS

SEQ ID NO: 1006398 - protein, 9 aa, Homo Sapiens
FDGHTYPSE

SEQ ID NO: 1006399 - protein, 9 aa, Homo Sapiens
ARRLVFTLS

SEQ ID NO: 1006400 - protein, 9 aa, Homo Sapiens
AGVRAAAGA

SEQ ID NO: 1006401 - protein, 9 aa, Homo Sapiens
EAQQESLKK

SEQ ID NO: 1006402 - protein, 9 aa, Homo Sapiens
GFGGKKGSS

SEQ ID NO: 1006403 - protein, 9 aa, Homo Sapiens
LGHFAHNKA

SEQ ID NO: 1006404 - protein, 9 aa, Homo Sapiens
SCFFYAAVH

SEQ ID NO: 1006405 - protein, 9 aa, Homo Sapiens
DTRIKNLAA

SEQ ID NO: 1006406 - protein, 9 aa, Homo Sapiens
HNKNQQGSF

SEQ ID NO: 1006407 - protein, 9 aa, Homo Sapiens
WVILGVISV

SEQ ID NO: 1006408 - protein, 9 aa, Homo Sapiens
VCSFAGILE

SEQ ID NO: 1006409 - protein, 9 aa, Homo Sapiens
QEYRIERCP

SEQ ID NO: 1006410 - protein, 9 aa, Homo Sapiens
AAALKTKVV

SEQ ID NO: 1006411 - protein, 9 aa, Homo Sapiens
YKKQSPQTL

SEQ ID NO: 1006412 - protein, 9 aa, Homo Sapiens
SRDPECSWG

SEQ ID NO: 1006413 - protein, 9 aa, Homo Sapiens
KAQLISFLA

SEQ ID NO: 1006414 - protein, 9 aa, Homo Sapiens
ASILLQIDN

SEQ ID NO: 1006415 - protein, 9 aa, Homo Sapiens
NEPHELPLT

SEQ ID NO: 1006416 - protein, 9 aa, Homo Sapiens
RRNPACSGP

SEQ ID NO: 1006417 - protein, 9 aa, Homo Sapiens
FYSTLIFMY

SEQ ID NO: 1006418 - protein, 9 aa, Homo Sapiens
VWIAAFSPV

SEQ ID NO: 1006419 - protein, 9 aa, Homo Sapiens
MENTIKQFE

SEQ ID NO: 1006420 - protein, 9 aa, Homo Sapiens
AIIPMGPAY

SEQ ID NO: 1006421 - protein, 9 aa, Homo Sapiens
VTPSSALET

SEQ ID NO: 1006422 - protein, 9 aa, Homo Sapiens
ATQKKVEKK

SEQ ID NO: 1006423 - protein, 9 aa, Homo Sapiens
RIEAAQFSD

SEQ ID NO: 1006424 - protein, 9 aa, Homo Sapiens
RANLSPSSF

SEQ ID NO: 1006425 - protein, 9 aa, Homo Sapiens
NKKAFSYRQ

SEQ ID NO: 1006426 - protein, 9 aa, Homo Sapiens
LRTEDLVDT

SEQ ID NO: 1006427 - protein, 9 aa, Homo Sapiens
DHAFSPPRT

SEQ ID NO: 1006428 - protein, 9 aa, Homo Sapiens
TCIGISNQP

SEQ ID NO: 1006429 - protein, 9 aa, Homo Sapiens
AAIALDRYV

SEQ ID NO: 1006430 - protein, 9 aa, Homo Sapiens
RPLQVFYVD

SEQ ID NO: 1006431 - protein, 9 aa, Homo Sapiens
LKELEKKYA

SEQ ID NO: 1006432 - protein, 9 aa, Homo Sapiens
SDGKATRTA

SEQ ID NO: 1006433 - protein, 9 aa, Homo Sapiens
KEGDLIVKV

SEQ ID NO: 1006434 - protein, 9 aa, Homo Sapiens
EGGDGTTSS

SEQ ID NO: 1006435 - protein, 9 aa, Homo Sapiens
LETSGKLNI

SEQ ID NO: 1006436 - protein, 9 aa, Homo Sapiens
NPKKLKGTT

SEQ ID NO: 1006437 - protein, 9 aa, Homo Sapiens
AKLQRTQAN

SEQ ID NO: 1006438 - protein, 9 aa, Homo Sapiens
AKATPGRRP

SEQ ID NO: 1006439 - protein, 9 aa, Homo Sapiens
IPICTVKSF

SEQ ID NO: 1006440 - protein, 9 aa, Homo Sapiens
PASENSFRE

SEQ ID NO: 1006441 - protein, 9 aa, Homo Sapiens
PIERDFIGQ

SEQ ID NO: 1006442 - protein, 9 aa, Homo Sapiens
DENKEKMQC

SEQ ID NO: 1006443 - protein, 9 aa, Homo Sapiens
SLLLRGKSV

SEQ ID NO: 1006444 - protein, 9 aa, Homo Sapiens
IASGIKYLS

SEQ ID NO: 1006445 - protein, 9 aa, Homo Sapiens
IRASPRGNR

SEQ ID NO: 1006446 - protein, 9 aa, Homo Sapiens
AMAFDCFVA

SEQ ID NO: 1006447 - protein, 9 aa, Homo Sapiens
LSLLEDIMY

SEQ ID NO: 1006448 - protein, 9 aa, Homo Sapiens
QEPTDWITS

SEQ ID NO: 1006449 - protein, 9 aa, Homo Sapiens
AQLEQSLRD

SEQ ID NO: 1006450 - protein, 9 aa, Homo Sapiens
VKMRNNREL

SEQ ID NO: 1006451 - protein, 9 aa, Homo Sapiens
VKDHKDSSL

SEQ ID NO: 1006452 - protein, 9 aa, Homo Sapiens
VLVSFVLLL

SEQ ID NO: 1006453 - protein, 9 aa, Homo Sapiens
KSINKGQVS

SEQ ID NO: 1006454 - protein, 9 aa, Homo Sapiens
AWAVPPGSR

SEQ ID NO: 1006455 - protein, 9 aa, Homo Sapiens
LSPSSFFRA

SEQ ID NO: 1006456 - protein, 9 aa, Homo Sapiens
RPEASGFSR

SEQ ID NO: 1006457 - protein, 9 aa, Homo Sapiens
NERSFDSKD

SEQ ID NO: 1006458 - protein, 9 aa, Homo Sapiens
EYKYQLTVR

SEQ ID NO: 1006459 - protein, 9 aa, Homo Sapiens
DIYGQFYDL

SEQ ID NO: 1006460 - protein, 9 aa, Homo Sapiens
AIQNEFYSS

SEQ ID NO: 1006461 - protein, 9 aa, Homo Sapiens
LAAITGGYL

SEQ ID NO: 1006462 - protein, 9 aa, Homo Sapiens
RKSEKETSK

SEQ ID NO: 1006463 - protein, 9 aa, Homo Sapiens
RLYECGQCG

SEQ ID NO: 1006464 - protein, 9 aa, Homo Sapiens
PYPYAKFSL

SEQ ID NO: 1006465 - protein, 9 aa, Homo Sapiens
GKTNLRRTA

SEQ ID NO: 1006466 - protein, 9 aa, Homo Sapiens
EQFCKIYIG

SEQ ID NO: 1006467 - protein, 9 aa, Homo Sapiens
TYIDTRIKN

SEQ ID NO: 1006468 - protein, 9 aa, Homo Sapiens
HENQQQGED

SEQ ID NO: 1006469 - protein, 9 aa, Homo Sapiens
FLRLFQQAL

SEQ ID NO: 1006470 - protein, 9 aa, Homo Sapiens
IELLQQLND

SEQ ID NO: 1006471 - protein, 9 aa, Homo Sapiens
NDGDIKKCK

SEQ ID NO: 1006472 - protein, 9 aa, Homo Sapiens
PNKKEQEGG

SEQ ID NO: 1006473 - protein, 9 aa, Homo Sapiens
LQASVSTKR

SEQ ID NO: 1006474 - protein, 9 aa, Homo Sapiens
HRDVSSRKE

SEQ ID NO: 1006475 - protein, 9 aa, Homo Sapiens
EISCYWENQ

SEQ ID NO: 1006476 - protein, 9 aa, Homo Sapiens
LQRQNVAVN

SEQ ID NO: 1006477 - protein, 9 aa, Homo Sapiens
ALSGPPPPG

SEQ ID NO: 1006478 - protein, 9 aa, Homo Sapiens
SKQGSLTVQ

SEQ ID NO: 1006479 - protein, 9 aa, Homo Sapiens
FAKVVLSLI

SEQ ID NO: 1006480 - protein, 9 aa, Homo Sapiens
FTPLQTESC

SEQ ID NO: 1006481 - protein, 9 aa, Homo Sapiens
EAPFCPNGL

SEQ ID NO: 1006482 - protein, 9 aa, Homo Sapiens
DQEMCHKFQ

SEQ ID NO: 1006483 - protein, 9 aa, Homo Sapiens
KRHYAAFLL

SEQ ID NO: 1006484 - protein, 9 aa, Homo Sapiens
NVVDGKISE

SEQ ID NO: 1006485 - protein, 9 aa, Homo Sapiens
HKRKEKFFI

SEQ ID NO: 1006486 - protein, 9 aa, Homo Sapiens
RSLLRLGRG

SEQ ID NO: 1006487 - protein, 9 aa, Homo Sapiens
STDVSCLFC

SEQ ID NO: 1006488 - protein, 9 aa, Homo Sapiens
CNQRGRCEN

SEQ ID NO: 1006489 - protein, 9 aa, Homo Sapiens
ELDLTENAL

SEQ ID NO: 1006490 - protein, 9 aa, Homo Sapiens
ELRDIDTLH

SEQ ID NO: 1006491 - protein, 9 aa, Homo Sapiens
PLIPASFPV

SEQ ID NO: 1006492 - protein, 9 aa, Homo Sapiens
LEVVYTSHL

SEQ ID NO: 1006493 - protein, 8 aa, Homo Sapiens
NWENESSP

SEQ ID NO: 1006494 - protein, 9 aa, Homo Sapiens
WRYSEPRVL

SEQ ID NO: 1006495 - protein, 9 aa, Homo Sapiens
LASNVICLA

SEQ ID NO: 1006496 - protein, 9 aa, Homo Sapiens
SPLPQKKIT

SEQ ID NO: 1006497 - protein, 9 aa, Homo Sapiens
EASGFSRDS

SEQ ID NO: 1006498 - protein, 9 aa, Homo Sapiens
KEQLSLKSN

SEQ ID NO: 1006499 - protein, 9 aa, Homo Sapiens
NFMRIKSQT

SEQ ID NO: 1006500 - protein, 9 aa, Homo Sapiens
QCQDNQGFA

SEQ ID NO: 1006501 - protein, 9 aa, Homo Sapiens
KHAPHVVSI

SEQ ID NO: 1006502 - protein, 9 aa, Homo Sapiens
EDLFKLGKP

SEQ ID NO: 1006503 - protein, 9 aa, Homo Sapiens
ETTKDYPDD

SEQ ID NO: 1006504 - protein, 9 aa, Homo Sapiens
FAFNSIAIE

SEQ ID NO: 1006505 - protein, 9 aa, Homo Sapiens
YTVMSYNRY

SEQ ID NO: 1006506 - protein, 9 aa, Homo Sapiens
EIILRKIFT

SEQ ID NO: 1006507 - protein, 9 aa, Homo Sapiens
VPRLGIENS

SEQ ID NO: 1006508 - protein, 9 aa, Homo Sapiens
EVEQARRLV

SEQ ID NO: 1006509 - protein, 9 aa, Homo Sapiens
SSVVSSSHP

SEQ ID NO: 1006510 - protein, 9 aa, Homo Sapiens
SSASSSPTK

SEQ ID NO: 1006511 - protein, 9 aa, Homo Sapiens
LIFYRKEIR

SEQ ID NO: 1006512 - protein, 9 aa, Homo Sapiens
GGFQGVGNR

SEQ ID NO: 1006513 - protein, 9 aa, Homo Sapiens
ECNVHKESY

SEQ ID NO: 1006514 - protein, 9 aa, Homo Sapiens
NLHLPRFKM

SEQ ID NO: 1006515 - protein, 9 aa, Homo Sapiens
LQQLNDLEA

SEQ ID NO: 1006516 - protein, 9 aa, Homo Sapiens
GSVDFLVCS

SEQ ID NO: 1006517 - protein, 9 aa, Homo Sapiens
KNNALDLPV

SEQ ID NO: 1006518 - protein, 9 aa, Homo Sapiens
IVPSHCRKI

SEQ ID NO: 1006519 - protein, 9 aa, Homo Sapiens
IKNEIAELT

SEQ ID NO: 1006520 - protein, 9 aa, Homo Sapiens
WCHPEEKER

SEQ ID NO: 1006521 - protein, 9 aa, Homo Sapiens
PVFLTMDTW

SEQ ID NO: 1006522 - protein, 9 aa, Homo Sapiens
MKFKKYECV

SEQ ID NO: 1006523 - protein, 9 aa, Homo Sapiens
KTDPTVLFF

SEQ ID NO: 1006524 - protein, 9 aa, Homo Sapiens
SVVSSSHPP

SEQ ID NO: 1006525 - protein, 9 aa, Homo Sapiens
ERNNAREEG

SEQ ID NO: 1006526 - protein, 9 aa, Homo Sapiens
KFQAFMKNG

SEQ ID NO: 1006527 - protein, 9 aa, Homo Sapiens
FTSSVSSQG

SEQ ID NO: 1006528 - protein, 9 aa, Homo Sapiens
DLESRTLLS

SEQ ID NO: 1006529 - protein, 9 aa, Homo Sapiens
ESRASTARV

SEQ ID NO: 1006530 - protein, 9 aa, Homo Sapiens
ILRPGWRDF

SEQ ID NO: 1006531 - protein, 9 aa, Homo Sapiens
VAQSPKYKI

SEQ ID NO: 1006532 - protein, 8 aa, Homo Sapiens
EQGKGLAV

SEQ ID NO: 1006533 - protein, 9 aa, Homo Sapiens
QSFLSLEPD

SEQ ID NO: 1006534 - protein, 9 aa, Homo Sapiens
HKSRSSRDK

SEQ ID NO: 1006535 - protein, 9 aa, Homo Sapiens
DWVSAGGRG

SEQ ID NO: 1006536 - protein, 9 aa, Homo Sapiens
GSLEKEGTM

SEQ ID NO: 1006537 - protein, 9 aa, Homo Sapiens
LTQVLANGP

SEQ ID NO: 1006538 - protein, 9 aa, Homo Sapiens
IISFLPVGD

SEQ ID NO: 1006539 - protein, 9 aa, Homo Sapiens
TGIKPLKCS

SEQ ID NO: 1006540 - protein, 9 aa, Homo Sapiens
KLTCFICLD

SEQ ID NO: 1006541 - protein, 9 aa, Homo Sapiens
QSDQSFLSL

SEQ ID NO: 1006542 - protein, 9 aa, Homo Sapiens
EQSGPPYEP

SEQ ID NO: 1006543 - protein, 9 aa, Homo Sapiens
HGCPFRHSN

SEQ ID NO: 1006544 - protein, 9 aa, Homo Sapiens
NEPLHLLKA

SEQ ID NO: 1006545 - protein, 9 aa, Homo Sapiens
KHMAIPKLS

SEQ ID NO: 1006546 - protein, 9 aa, Homo Sapiens
LLPEALPFA

SEQ ID NO: 1006547 - protein, 9 aa, Homo Sapiens
EVADHAFSP

SEQ ID NO: 1006548 - protein, 9 aa, Homo Sapiens
VVNENCMRP

SEQ ID NO: 1006549 - protein, 9 aa, Homo Sapiens
PKLMLHGIV

SEQ ID NO: 1006550 - protein, 9 aa, Homo Sapiens
WVYEYIVFV

SEQ ID NO: 1006551 - protein, 9 aa, Homo Sapiens
KAVKMAKPR

SEQ ID NO: 1006552 - protein, 9 aa, Homo Sapiens
DLYISIFTL

SEQ ID NO: 1006553 - protein, 9 aa, Homo Sapiens
LQVSALEIL

SEQ ID NO: 1006554 - protein, 9 aa, Homo Sapiens
TYHAHLQRH

SEQ ID NO: 1006555 - protein, 9 aa, Homo Sapiens
VAIVHARDG

SEQ ID NO: 1006556 - protein, 9 aa, Homo Sapiens
FSWAQIRLP

SEQ ID NO: 1006557 - protein, 9 aa, Homo Sapiens
KVAAALKTK

SEQ ID NO: 1006558 - protein, 9 aa, Homo Sapiens
RLGIENSTV

SEQ ID NO: 1006559 - protein, 9 aa, Homo Sapiens
SIVLHNMSC

SEQ ID NO: 1006560 - protein, 9 aa, Homo Sapiens
WDLREERSH

SEQ ID NO: 1006561 - protein, 9 aa, Homo Sapiens
ATLIIIGSF

SEQ ID NO: 1006562 - protein, 9 aa, Homo Sapiens
RVICQPVGR

SEQ ID NO: 1006563 - protein, 9 aa, Homo Sapiens
SYSCFFREK

SEQ ID NO: 1006564 - protein, 9 aa, Homo Sapiens
VPEEVVAMD

SEQ ID NO: 1006565 - protein, 9 aa, Homo Sapiens
LVWDHDPIE

SEQ ID NO: 1006566 - protein, 9 aa, Homo Sapiens
GGGHNLLPP

SEQ ID NO: 1006567 - protein, 9 aa, Homo Sapiens
LDWSTGKTE

SEQ ID NO: 1006568 - protein, 9 aa, Homo Sapiens
EKSELARTA

SEQ ID NO: 1006569 - protein, 9 aa, Homo Sapiens
QKKVEKKAP

SEQ ID NO: 1006570 - protein, 9 aa, Homo Sapiens
FFTGCFAQM

SEQ ID NO: 1006571 - protein, 9 aa, Homo Sapiens
IFINFTCAF

SEQ ID NO: 1006572 - protein, 9 aa, Homo Sapiens
MGILLFHAN

SEQ ID NO: 1006573 - protein, 9 aa, Homo Sapiens
NFNSNPLQR

SEQ ID NO: 1006574 - protein, 9 aa, Homo Sapiens
AIENILKAE

SEQ ID NO: 1006575 - protein, 9 aa, Homo Sapiens
ECRGPTDCS

SEQ ID NO: 1006576 - protein, 9 aa, Homo Sapiens
HTDMALLAD

SEQ ID NO: 1006577 - protein, 9 aa, Homo Sapiens
KKAPDAGGC

SEQ ID NO: 1006578 - protein, 9 aa, Homo Sapiens
RLRTERDGV

SEQ ID NO: 1006579 - protein, 9 aa, Homo Sapiens
VEKKAPDAG

SEQ ID NO: 1006580 - protein, 9 aa, Homo Sapiens
DEDVTDMVE

SEQ ID NO: 1006581 - protein, 9 aa, Homo Sapiens
LCEVDEDKC

SEQ ID NO: 1006582 - protein, 9 aa, Homo Sapiens
TAVIIFYST

SEQ ID NO: 1006583 - protein, 9 aa, Homo Sapiens
QFGFWRQHG

SEQ ID NO: 1006584 - protein, 9 aa, Homo Sapiens
QETSTFYSL

SEQ ID NO: 1006585 - protein, 9 aa, Homo Sapiens
GKCTCYPPE

SEQ ID NO: 1006586 - protein, 9 aa, Homo Sapiens
AAKVAAALK

SEQ ID NO: 1006587 - protein, 9 aa, Homo Sapiens
KNQQGSFSS

SEQ ID NO: 1006588 - protein, 9 aa, Homo Sapiens
ALHLAVDLR

SEQ ID NO: 1006589 - protein, 9 aa, Homo Sapiens
ALEEALAEK

SEQ ID NO: 1006590 - protein, 9 aa, Homo Sapiens
LSNVYKKRV

SEQ ID NO: 1006591 - protein, 9 aa, Homo Sapiens
GTFAQLSKL

SEQ ID NO: 1006592 - protein, 9 aa, Homo Sapiens
PQFSQFFHG

SEQ ID NO: 1006593 - protein, 9 aa, Homo Sapiens
VISAIPLTL

SEQ ID NO: 1006594 - protein, 9 aa, Homo Sapiens
NNSDLTLYL

SEQ ID NO: 1006595 - protein, 9 aa, Homo Sapiens
TKERWKAFS

SEQ ID NO: 1006596 - protein, 9 aa, Homo Sapiens
QPLDYQATS

SEQ ID NO: 1006597 - protein, 9 aa, Homo Sapiens
ASPPSPPSF

SEQ ID NO: 1006598 - protein, 9 aa, Homo Sapiens
LGGMASSPC

SEQ ID NO: 1006599 - protein, 9 aa, Homo Sapiens
YFFPRNADI

SEQ ID NO: 1006600 - protein, 9 aa, Homo Sapiens
THKNLCSLK

SEQ ID NO: 1006601 - protein, 9 aa, Homo Sapiens
GVGVLFFFF

SEQ ID NO: 1006602 - protein, 9 aa, Homo Sapiens
KSPLPQKKI

SEQ ID NO: 1006603 - protein, 9 aa, Homo Sapiens
KRQFYAITL

SEQ ID NO: 1006604 - protein, 9 aa, Homo Sapiens
CILRNLLYR

SEQ ID NO: 1006605 - protein, 9 aa, Homo Sapiens
DLEVFLLEV

SEQ ID NO: 1006606 - protein, 9 aa, Homo Sapiens
VKILACGVA

SEQ ID NO: 1006607 - protein, 9 aa, Homo Sapiens
HLVSEASIT

SEQ ID NO: 1006608 - protein, 9 aa, Homo Sapiens
LDSSEESSQ

SEQ ID NO: 1006609 - protein, 9 aa, Homo Sapiens
WAEGLPRPP

SEQ ID NO: 1006610 - protein, 9 aa, Homo Sapiens
YIKQPAGAS

SEQ ID NO: 1006611 - protein, 9 aa, Homo Sapiens
MASSPCGEQ

SEQ ID NO: 1006612 - protein, 9 aa, Homo Sapiens
SSHPPPAPP

SEQ ID NO: 1006613 - protein, 9 aa, Homo Sapiens
ENGRCVCWP

SEQ ID NO: 1006614 - protein, 9 aa, Homo Sapiens
QVPPLVMLL

SEQ ID NO: 1006615 - protein, 9 aa, Homo Sapiens
YPLGLRNED

SEQ ID NO: 1006616 - protein, 9 aa, Homo Sapiens
FQEKPGLQG

SEQ ID NO: 1006617 - protein, 9 aa, Homo Sapiens
LTTKLFQAG

SEQ ID NO: 1006618 - protein, 9 aa, Homo Sapiens
SPPSFPLSP

SEQ ID NO: 1006619 - protein, 9 aa, Homo Sapiens
DNEVEWEED

SEQ ID NO: 1006620 - protein, 9 aa, Homo Sapiens
WSAWVILGV

SEQ ID NO: 1006621 - protein, 9 aa, Homo Sapiens
FLELSDSDL

SEQ ID NO: 1006622 - protein, 9 aa, Homo Sapiens
ELSERKRRD

SEQ ID NO: 1006623 - protein, 9 aa, Homo Sapiens
REAGEDINV

SEQ ID NO: 1006624 - protein, 9 aa, Homo Sapiens
SPAFTSSQE

SEQ ID NO: 1006625 - protein, 9 aa, Homo Sapiens
ATTFLTVVP

SEQ ID NO: 1006626 - protein, 9 aa, Homo Sapiens
NLTTDNASI

SEQ ID NO: 1006627 - protein, 9 aa, Homo Sapiens
TWPNTSPPL

SEQ ID NO: 1006628 - protein, 9 aa, Homo Sapiens
DFIPSQPER

SEQ ID NO: 1006629 - protein, 9 aa, Homo Sapiens
LKLPPPAGP

SEQ ID NO: 1006630 - protein, 9 aa, Homo Sapiens
SMCEKMKIR

SEQ ID NO: 1006631 - protein, 9 aa, Homo Sapiens
PGPPRASFA

SEQ ID NO: 1006632 - protein, 9 aa, Homo Sapiens
GKGSFPVAE

SEQ ID NO: 1006633 - protein, 9 aa, Homo Sapiens
LQEEDSVSL

SEQ ID NO: 1006634 - protein, 9 aa, Homo Sapiens
ASGIKYLSD

SEQ ID NO: 1006635 - protein, 9 aa, Homo Sapiens
WLAVPGRTC

SEQ ID NO: 1006636 - protein, 9 aa, Homo Sapiens
PAFTSSQES

SEQ ID NO: 1006637 - protein, 9 aa, Homo Sapiens
DTEKVPLFP

SEQ ID NO: 1006638 - protein, 9 aa, Homo Sapiens
AFSRCKKIG

SEQ ID NO: 1006639 - protein, 9 aa, Homo Sapiens
LLVFTKSTP

SEQ ID NO: 1006640 - protein, 9 aa, Homo Sapiens
LAVDLRNPD

SEQ ID NO: 1006641 - protein, 9 aa, Homo Sapiens
FCTKVHPPT

SEQ ID NO: 1006642 - protein, 9 aa, Homo Sapiens
KIMYVEDVR

SEQ ID NO: 1006643 - protein, 9 aa, Homo Sapiens
HSFSDWDWD

SEQ ID NO: 1006644 - protein, 9 aa, Homo Sapiens
NPTIAEGSS

SEQ ID NO: 1006645 - protein, 9 aa, Homo Sapiens
KDCVTNRPC

SEQ ID NO: 1006646 - protein, 9 aa, Homo Sapiens
SRVNTCSWI

SEQ ID NO: 1006647 - protein, 9 aa, Homo Sapiens
LLEVRWWIK

SEQ ID NO: 1006648 - protein, 9 aa, Homo Sapiens
PEPPPSYDK

SEQ ID NO: 1006649 - protein, 9 aa, Homo Sapiens
SFLSLEPDN

SEQ ID NO: 1006650 - protein, 9 aa, Homo Sapiens
KVMTLFSCP

SEQ ID NO: 1006651 - protein, 9 aa, Homo Sapiens
EEFLELPKF

SEQ ID NO: 1006652 - protein, 9 aa, Homo Sapiens
KKITNIIEY

SEQ ID NO: 1006653 - protein, 9 aa, Homo Sapiens
EDENKEKMQ

SEQ ID NO: 1006654 - protein, 9 aa, Homo Sapiens
SRSNPSLVL

SEQ ID NO: 1006655 - protein, 9 aa, Homo Sapiens
QFFSRTDSD

SEQ ID NO: 1006656 - protein, 9 aa, Homo Sapiens
ILRNLLYRL

SEQ ID NO: 1006657 - protein, 9 aa, Homo Sapiens
NLREKLTCF

SEQ ID NO: 1006658 - protein, 9 aa, Homo Sapiens
PPDLKSSSS

SEQ ID NO: 1006659 - protein, 9 aa, Homo Sapiens
SMYYLRSTI

SEQ ID NO: 1006660 - protein, 9 aa, Homo Sapiens
RSIELMFQN

SEQ ID NO: 1006661 - protein, 9 aa, Homo Sapiens
IRARTGREK

SEQ ID NO: 1006662 - protein, 9 aa, Homo Sapiens
SKAKISSAR

SEQ ID NO: 1006663 - protein, 9 aa, Homo Sapiens
PLQVFYVDV

SEQ ID NO: 1006664 - protein, 9 aa, Homo Sapiens
LRDISYPEM

SEQ ID NO: 1006665 - protein, 9 aa, Homo Sapiens
RWEAPFCPN

SEQ ID NO: 1006666 - protein, 9 aa, Homo Sapiens
TIKENSRCL

SEQ ID NO: 1006667 - protein, 9 aa, Homo Sapiens
VICQPVGRI

SEQ ID NO: 1006668 - protein, 9 aa, Homo Sapiens
MGNIELTRS

SEQ ID NO: 1006669 - protein, 9 aa, Homo Sapiens
PPPSPLAPT

SEQ ID NO: 1006670 - protein, 9 aa, Homo Sapiens
SQGHCGHLK

SEQ ID NO: 1006671 - protein, 9 aa, Homo Sapiens
YIFCTDCLL

SEQ ID NO: 1006672 - protein, 9 aa, Homo Sapiens
DWPWIYFAT

SEQ ID NO: 1006673 - protein, 9 aa, Homo Sapiens
KVEKVKHEN

SEQ ID NO: 1006674 - protein, 9 aa, Homo Sapiens
SSDCITLEL

SEQ ID NO: 1006675 - protein, 9 aa, Homo Sapiens
PGLSASPPS

SEQ ID NO: 1006676 - protein, 9 aa, Homo Sapiens
YSCFFREKK

SEQ ID NO: 1006677 - protein, 9 aa, Homo Sapiens
SSILNVKQS

SEQ ID NO: 1006678 - protein, 9 aa, Homo Sapiens
GIDFPIKTN

SEQ ID NO: 1006679 - protein, 9 aa, Homo Sapiens
DTFKEETLR

SEQ ID NO: 1006680 - protein, 9 aa, Homo Sapiens
LVISGLVTS

SEQ ID NO: 1006681 - protein, 9 aa, Homo Sapiens
ASFAMRNVC

SEQ ID NO: 1006682 - protein, 9 aa, Homo Sapiens
CFFQDHSYQ

SEQ ID NO: 1006683 - protein, 9 aa, Homo Sapiens
SLNSRFATF

SEQ ID NO: 1006684 - protein, 9 aa, Homo Sapiens
HGFYRVRIS

SEQ ID NO: 1006685 - protein, 9 aa, Homo Sapiens
SDCITLELL

SEQ ID NO: 1006686 - protein, 9 aa, Homo Sapiens
QEGLICSRV

SEQ ID NO: 1006687 - protein, 9 aa, Homo Sapiens
DWDWDRRGR

SEQ ID NO: 1006688 - protein, 9 aa, Homo Sapiens
RGITNVKNL

SEQ ID NO: 1006689 - protein, 9 aa, Homo Sapiens
VILLSGNTL

SEQ ID NO: 1006690 - protein, 9 aa, Homo Sapiens
AFCIAKLML

SEQ ID NO: 1006691 - protein, 9 aa, Homo Sapiens
MMAVGICGT

SEQ ID NO: 1006692 - protein, 9 aa, Homo Sapiens
ANHTESCHK

SEQ ID NO: 1006693 - protein, 9 aa, Homo Sapiens
SDSCLHSSP

SEQ ID NO: 1006694 - protein, 9 aa, Homo Sapiens
RSQTLANNR

SEQ ID NO: 1006695 - protein, 9 aa, Homo Sapiens
LLNNLLPYA

SEQ ID NO: 1006696 - protein, 9 aa, Homo Sapiens
IERDFIGQR

SEQ ID NO: 1006697 - protein, 9 aa, Homo Sapiens
DETELRGTW

SEQ ID NO: 1006698 - protein, 9 aa, Homo Sapiens
RAIQAGCLQ

SEQ ID NO: 1006699 - protein, 9 aa, Homo Sapiens
LYPVLVSER

SEQ ID NO: 1006700 - protein, 9 aa, Homo Sapiens
SSGALNVYV

SEQ ID NO: 1006701 - protein, 9 aa, Homo Sapiens
ETQAWQSFL

SEQ ID NO: 1006702 - protein, 9 aa, Homo Sapiens
IFHSLRLVR

SEQ ID NO: 1006703 - protein, 9 aa, Homo Sapiens
GGSESSWNK

SEQ ID NO: 1006704 - protein, 9 aa, Homo Sapiens
SIALPLFVT

SEQ ID NO: 1006705 - protein, 9 aa, Homo Sapiens
VTVISDSCL

SEQ ID NO: 1006706 - protein, 9 aa, Homo Sapiens
KMASSEEST

SEQ ID NO: 1006707 - protein, 9 aa, Homo Sapiens
KRKHRSEAS

SEQ ID NO: 1006708 - protein, 9 aa, Homo Sapiens
YGEKITCQN

SEQ ID NO: 1006709 - protein, 9 aa, Homo Sapiens
YGLLVKRFH

SEQ ID NO: 1006710 - protein, 9 aa, Homo Sapiens
LLKTIGISK

SEQ ID NO: 1006711 - protein, 9 aa, Homo Sapiens
LTLGMKIHF

SEQ ID NO: 1006712 - protein, 9 aa, Homo Sapiens
VSPIENSSN

SEQ ID NO: 1006713 - protein, 9 aa, Homo Sapiens
IHGDMRKLI

SEQ ID NO: 1006714 - protein, 9 aa, Homo Sapiens
LICKGKSKE

SEQ ID NO: 1006715 - protein, 9 aa, Homo Sapiens
PKTATGSFL

SEQ ID NO: 1006716 - protein, 9 aa, Homo Sapiens
TIIGEDEPD

SEQ ID NO: 1006717 - protein, 9 aa, Homo Sapiens
RFQLKGPES

SEQ ID NO: 1006718 - protein, 9 aa, Homo Sapiens
PTGTLKLPP

SEQ ID NO: 1006719 - protein, 9 aa, Homo Sapiens
KECREGGLN

SEQ ID NO: 1006720 - protein, 9 aa, Homo Sapiens
NKNQQGSFS

SEQ ID NO: 1006721 - protein, 9 aa, Homo Sapiens
AVSGMMILL

SEQ ID NO: 1006722 - protein, 9 aa, Homo Sapiens
VGGVGVLFF

SEQ ID NO: 1006723 - protein, 9 aa, Homo Sapiens
LNLELEFTR

SEQ ID NO: 1006724 - protein, 9 aa, Homo Sapiens
VAAALKTKV

SEQ ID NO: 1006725 - protein, 9 aa, Homo Sapiens
CWASYSLFT

SEQ ID NO: 1006726 - protein, 9 aa, Homo Sapiens
HKRIYTREK

SEQ ID NO: 1006727 - protein, 9 aa, Homo Sapiens
AGSSGSLSC

SEQ ID NO: 1006728 - protein, 9 aa, Homo Sapiens
EDCLRISST

SEQ ID NO: 1006729 - protein, 9 aa, Homo Sapiens
SANEYCVSC

SEQ ID NO: 1006730 - protein, 9 aa, Homo Sapiens
KPYHKKEHY

SEQ ID NO: 1006731 - protein, 9 aa, Homo Sapiens
LKNLEEGQS

SEQ ID NO: 1006732 - protein, 9 aa, Homo Sapiens
DLIVYEIHP

SEQ ID NO: 1006733 - protein, 9 aa, Homo Sapiens
HQIIHTRKN

SEQ ID NO: 1006734 - protein, 9 aa, Homo Sapiens
ILENFIVAT

SEQ ID NO: 1006735 - protein, 9 aa, Homo Sapiens
PENNGQRKN

SEQ ID NO: 1006736 - protein, 9 aa, Homo Sapiens
AKVVLSLID

SEQ ID NO: 1006737 - protein, 9 aa, Homo Sapiens
PGSLALTSL

SEQ ID NO: 1006738 - protein, 9 aa, Homo Sapiens
FPASYYHAV

SEQ ID NO: 1006739 - protein, 9 aa, Homo Sapiens
GFCVSGILS

SEQ ID NO: 1006740 - protein, 9 aa, Homo Sapiens
ISCYWENQP

SEQ ID NO: 1006741 - protein, 9 aa, Homo Sapiens
QDILMENNF

SEQ ID NO: 1006742 - protein, 9 aa, Homo Sapiens
ISGRCVRLT

SEQ ID NO: 1006743 - protein, 9 aa, Homo Sapiens
EPSQGQVAG

SEQ ID NO: 1006744 - protein, 9 aa, Homo Sapiens
ACYRDMSFF

SEQ ID NO: 1006745 - protein, 9 aa, Homo Sapiens
FPSKLFIIE

SEQ ID NO: 1006746 - protein, 9 aa, Homo Sapiens
SGDWNLLHI

SEQ ID NO: 1006747 - protein, 9 aa, Homo Sapiens
LLYPAGHCP

SEQ ID NO: 1006748 - protein, 9 aa, Homo Sapiens
DRPLQVFYV

SEQ ID NO: 1006749 - protein, 9 aa, Homo Sapiens
EGLPRPPRN

SEQ ID NO: 1006750 - protein, 9 aa, Homo Sapiens
ALGNTPLFL

SEQ ID NO: 1006751 - protein, 9 aa, Homo Sapiens
LNNLLPYAI

SEQ ID NO: 1006752 - protein, 9 aa, Homo Sapiens
LQNVLDKYM

SEQ ID NO: 1006753 - protein, 9 aa, Homo Sapiens
GERGELGIG

SEQ ID NO: 1006754 - protein, 9 aa, Homo Sapiens
RPPLIPASF

SEQ ID NO: 1006755 - protein, 9 aa, Homo Sapiens
NTSPTAAFV

SEQ ID NO: 1006756 - protein, 9 aa, Homo Sapiens
FMRIKSQTE

SEQ ID NO: 1006757 - protein, 9 aa, Homo Sapiens
AIFFAGCTA

SEQ ID NO: 1006758 - protein, 9 aa, Homo Sapiens
VESGKNCSS

SEQ ID NO: 1006759 - protein, 9 aa, Homo Sapiens
KLNIDEYNF

SEQ ID NO: 1006760 - protein, 9 aa, Homo Sapiens
YVIEDNVNM

SEQ ID NO: 1006761 - protein, 9 aa, Homo Sapiens
LPLASLSKP

SEQ ID NO: 1006762 - protein, 9 aa, Homo Sapiens
PEQEITPRH

SEQ ID NO: 1006763 - protein, 9 aa, Homo Sapiens
EDQLSKRPC

SEQ ID NO: 1006764 - protein, 9 aa, Homo Sapiens
FGRLASCGA

SEQ ID NO: 1006765 - protein, 9 aa, Homo Sapiens
HCPRHCPPW

SEQ ID NO: 1006766 - protein, 9 aa, Homo Sapiens
PEGLATVAP

SEQ ID NO: 1006767 - protein, 9 aa, Homo Sapiens
PGIIQRKMC

SEQ ID NO: 1006768 - protein, 9 aa, Homo Sapiens
KQQNQLTER

SEQ ID NO: 1006769 - protein, 9 aa, Homo Sapiens
HRKPDNSKN

SEQ ID NO: 1006770 - protein, 9 aa, Homo Sapiens
VVDLLQELR

SEQ ID NO: 1006771 - protein, 9 aa, Homo Sapiens
DNQPYYSNT

SEQ ID NO: 1006772 - protein, 9 aa, Homo Sapiens
IRSPVVPEE

SEQ ID NO: 1006773 - protein, 9 aa, Homo Sapiens
QKRMRNEIS

SEQ ID NO: 1006774 - protein, 9 aa, Homo Sapiens
VGPLAGVRA

SEQ ID NO: 1006775 - protein, 9 aa, Homo Sapiens
TRKNSYQCE

SEQ ID NO: 1006776 - protein, 9 aa, Homo Sapiens
NFFDSLNEA

SEQ ID NO: 1006777 - protein, 9 aa, Homo Sapiens
PLVPSGVSD

SEQ ID NO: 1006778 - protein, 9 aa, Homo Sapiens
PPRFGSEGT

SEQ ID NO: 1006779 - protein, 9 aa, Homo Sapiens
FFTYDFVFD

SEQ ID NO: 1006780 - protein, 9 aa, Homo Sapiens
YKYQLTVRP

SEQ ID NO: 1006781 - protein, 9 aa, Homo Sapiens
YLNKDPQDF

SEQ ID NO: 1006782 - protein, 9 aa, Homo Sapiens
AVGLFHTLR

SEQ ID NO: 1006783 - protein, 9 aa, Homo Sapiens
ATGNKMFVW

SEQ ID NO: 1006784 - protein, 9 aa, Homo Sapiens
IAREINNVA

SEQ ID NO: 1006785 - protein, 9 aa, Homo Sapiens
VSMYYLRST

SEQ ID NO: 1006786 - protein, 9 aa, Homo Sapiens
SQYFNFAQG

SEQ ID NO: 1006787 - protein, 9 aa, Homo Sapiens
AWPGVLDSK

SEQ ID NO: 1006788 - protein, 9 aa, Homo Sapiens
VTAKDKENP

SEQ ID NO: 1006789 - protein, 9 aa, Homo Sapiens
SESWEPQNK

SEQ ID NO: 1006790 - protein, 9 aa, Homo Sapiens
HYWSCEKAS

SEQ ID NO: 1006791 - protein, 9 aa, Homo Sapiens
KTERAGDQP

SEQ ID NO: 1006792 - protein, 9 aa, Homo Sapiens
TPLLQTAKI

SEQ ID NO: 1006793 - protein, 9 aa, Homo Sapiens
GVTSILKTT

SEQ ID NO: 1006794 - protein, 9 aa, Homo Sapiens
GRASASDFS

SEQ ID NO: 1006795 - protein, 9 aa, Homo Sapiens
CVSEDKRIF

SEQ ID NO: 1006796 - protein, 9 aa, Homo Sapiens
KAPSVYPLD

SEQ ID NO: 1006797 - protein, 9 aa, Homo Sapiens
TLNIRPSTS

SEQ ID NO: 1006798 - protein, 9 aa, Homo Sapiens
RKMASSEES

SEQ ID NO: 1006799 - protein, 9 aa, Homo Sapiens
KIMTPPTKT

SEQ ID NO: 1006800 - protein, 9 aa, Homo Sapiens
CRSQEYRIE

SEQ ID NO: 1006801 - protein, 9 aa, Homo Sapiens
ESQVLEQLH

SEQ ID NO: 1006802 - protein, 9 aa, Homo Sapiens
LQTCKRSYQ

SEQ ID NO: 1006803 - protein, 9 aa, Homo Sapiens
FGSRMNMGR

SEQ ID NO: 1006804 - protein, 9 aa, Homo Sapiens
VSGENLKKA

SEQ ID NO: 1006805 - protein, 9 aa, Homo Sapiens
RCTCIGISN

SEQ ID NO: 1006806 - protein, 9 aa, Homo Sapiens
EKEGTMEEA

SEQ ID NO: 1006807 - protein, 9 aa, Homo Sapiens
GATFSVIID

SEQ ID NO: 1006808 - protein, 9 aa, Homo Sapiens
APLSLTTPL

SEQ ID NO: 1006809 - protein, 9 aa, Homo Sapiens
IGLTSSSVQ

SEQ ID NO: 1006810 - protein, 9 aa, Homo Sapiens
TDVKGERWT

SEQ ID NO: 1006811 - protein, 9 aa, Homo Sapiens
NFWNFNSNP

SEQ ID NO: 1006812 - protein, 9 aa, Homo Sapiens
LILPMPKGP

SEQ ID NO: 1006813 - protein, 9 aa, Homo Sapiens
RARTGREKI

SEQ ID NO: 1006814 - protein, 9 aa, Homo Sapiens
ETLSEKMTY

SEQ ID NO: 1006815 - protein, 9 aa, Homo Sapiens
SKSKKVESS

SEQ ID NO: 1006816 - protein, 9 aa, Homo Sapiens
QVAINPTNT

SEQ ID NO: 1006817 - protein, 9 aa, Homo Sapiens
QLKELEKKY

SEQ ID NO: 1006818 - protein, 9 aa, Homo Sapiens
FFAKVVLSL

SEQ ID NO: 1006819 - protein, 9 aa, Homo Sapiens
DFEIVIILE

SEQ ID NO: 1006820 - protein, 9 aa, Homo Sapiens
IRGDGAPAL

SEQ ID NO: 1006821 - protein, 9 aa, Homo Sapiens
FFHVIQTSS

SEQ ID NO: 1006822 - protein, 9 aa, Homo Sapiens
GTLVHKLSS

SEQ ID NO: 1006823 - protein, 9 aa, Homo Sapiens
RQTWGGQGS

SEQ ID NO: 1006824 - protein, 9 aa, Homo Sapiens
NNDIKRIGV

SEQ ID NO: 1006825 - protein, 9 aa, Homo Sapiens
KIGAIAQVH

SEQ ID NO: 1006826 - protein, 9 aa, Homo Sapiens
IALPLFVTA

SEQ ID NO: 1006827 - protein, 9 aa, Homo Sapiens
LGYRRTGER

SEQ ID NO: 1006828 - protein, 9 aa, Homo Sapiens
RRFQLKGPE

SEQ ID NO: 1006829 - protein, 9 aa, Homo Sapiens
RKVGLKKRV

SEQ ID NO: 1006830 - protein, 9 aa, Homo Sapiens
VPRNLCRMS

SEQ ID NO: 1006831 - protein, 9 aa, Homo Sapiens
KVVLSLIDQ

SEQ ID NO: 1006832 - protein, 9 aa, Homo Sapiens
TTCEATHFG

SEQ ID NO: 1006833 - protein, 9 aa, Homo Sapiens
DLLNGENLK

SEQ ID NO: 1006834 - protein, 9 aa, Homo Sapiens
DSLVDSTVV

SEQ ID NO: 1006835 - protein, 9 aa, Homo Sapiens
YKSICSMGC

SEQ ID NO: 1006836 - protein, 9 aa, Homo Sapiens
SFPHLYLRG

SEQ ID NO: 1006837 - protein, 9 aa, Homo Sapiens
IIRSATPFP

SEQ ID NO: 1006838 - protein, 9 aa, Homo Sapiens
NNKISTLSN

SEQ ID NO: 1006839 - protein, 9 aa, Homo Sapiens
LKVRQFYGL

SEQ ID NO: 1006840 - protein, 9 aa, Homo Sapiens
EESSQEDED

SEQ ID NO: 1006841 - protein, 9 aa, Homo Sapiens
LDEDVTDMV

SEQ ID NO: 1006842 - protein, 9 aa, Homo Sapiens
PEEVVAMDR

SEQ ID NO: 1006843 - protein, 9 aa, Homo Sapiens
TVSKAPTMD

SEQ ID NO: 1006844 - protein, 9 aa, Homo Sapiens
SQGQVAGAL

SEQ ID NO: 1006845 - protein, 9 aa, Homo Sapiens
KEAQCLLGQ

SEQ ID NO: 1006846 - protein, 9 aa, Homo Sapiens
HSSIPPSGP

SEQ ID NO: 1006847 - protein, 9 aa, Homo Sapiens
FVKNVDFTR

SEQ ID NO: 1006848 - protein, 9 aa, Homo Sapiens
SLLKFAFNS

SEQ ID NO: 1006849 - protein, 9 aa, Homo Sapiens
FYGLLVKRF

SEQ ID NO: 1006850 - protein, 9 aa, Homo Sapiens
KNLEEGQSE

SEQ ID NO: 1006851 - protein, 9 aa, Homo Sapiens
PETSPSFPD

SEQ ID NO: 1006852 - protein, 9 aa, Homo Sapiens
GNSLKRLQK

SEQ ID NO: 1006853 - protein, 9 aa, Homo Sapiens
PRASFAMRN

SEQ ID NO: 1006854 - protein, 9 aa, Homo Sapiens
GYISIPGQQ

SEQ ID NO: 1006855 - protein, 9 aa, Homo Sapiens
LPSPDGDYN

SEQ ID NO: 1006856 - protein, 9 aa, Homo Sapiens
HRASYYFLL

SEQ ID NO: 1006857 - protein, 9 aa, Homo Sapiens
QNFLLDKED

SEQ ID NO: 1006858 - protein, 9 aa, Homo Sapiens
RSPSLAPRS

SEQ ID NO: 1006859 - protein, 9 aa, Homo Sapiens
SICSMGCDL

SEQ ID NO: 1006860 - protein, 9 aa, Homo Sapiens
PGKLDISGP

SEQ ID NO: 1006861 - protein, 9 aa, Homo Sapiens
MKECREGGL

SEQ ID NO: 1006862 - protein, 9 aa, Homo Sapiens
PLQSRVGNS

SEQ ID NO: 1006863 - protein, 9 aa, Homo Sapiens
KEEKGTNPE

SEQ ID NO: 1006864 - protein, 9 aa, Homo Sapiens
GFGFVIMTN

SEQ ID NO: 1006865 - protein, 9 aa, Homo Sapiens
EKKAPDAGG

SEQ ID NO: 1006866 - protein, 9 aa, Homo Sapiens
NEFYSSPYS

SEQ ID NO: 1006867 - protein, 9 aa, Homo Sapiens
RGSGAPEAK

SEQ ID NO: 1006868 - protein, 9 aa, Homo Sapiens
KEILSKGLS

SEQ ID NO: 1006869 - protein, 9 aa, Homo Sapiens
SILRPGWRD

SEQ ID NO: 1006870 - protein, 9 aa, Homo Sapiens
SEISCYWEN

SEQ ID NO: 1006871 - protein, 9 aa, Homo Sapiens
LPVILRLFL

SEQ ID NO: 1006872 - protein, 9 aa, Homo Sapiens
ANLSPSSFF

SEQ ID NO: 1006873 - protein, 9 aa, Homo Sapiens
TLMTHGFYR

SEQ ID NO: 1006874 - protein, 9 aa, Homo Sapiens
CGRPEQVRL

SEQ ID NO: 1006875 - protein, 9 aa, Homo Sapiens
GGPLTSGTS

SEQ ID NO: 1006876 - protein, 9 aa, Homo Sapiens
SPCISGKFY

SEQ ID NO: 1006877 - protein, 9 aa, Homo Sapiens
GKDRKLFVG

SEQ ID NO: 1006878 - protein, 9 aa, Homo Sapiens
VEIFHSLRL

SEQ ID NO: 1006879 - protein, 9 aa, Homo Sapiens
QKIFLQDHL

SEQ ID NO: 1006880 - protein, 9 aa, Homo Sapiens
DGSRKIESM

SEQ ID NO: 1006881 - protein, 9 aa, Homo Sapiens
VCILRNLLY

SEQ ID NO: 1006882 - protein, 9 aa, Homo Sapiens
VEKVKHENQ

SEQ ID NO: 1006883 - protein, 9 aa, Homo Sapiens
NCIDKPSRC

SEQ ID NO: 1006884 - protein, 9 aa, Homo Sapiens
LANFISSYL

SEQ ID NO: 1006885 - protein, 9 aa, Homo Sapiens
GKFYTSLSR

SEQ ID NO: 1006886 - protein, 9 aa, Homo Sapiens
GARERPAES

SEQ ID NO: 1006887 - protein, 9 aa, Homo Sapiens
FTSSQESKL

SEQ ID NO: 1006888 - protein, 9 aa, Homo Sapiens
DVQSLLDEK

SEQ ID NO: 1006889 - protein, 9 aa, Homo Sapiens
NRTRVPNKF

SEQ ID NO: 1006890 - protein, 9 aa, Homo Sapiens
SGALAGVGA

SEQ ID NO: 1006891 - protein, 9 aa, Homo Sapiens
HRQRLSGNV

SEQ ID NO: 1006892 - protein, 9 aa, Homo Sapiens
SKSNQYPSP

SEQ ID NO: 1006893 - protein, 9 aa, Homo Sapiens
MIEQSGPPY

SEQ ID NO: 1006894 - protein, 9 aa, Homo Sapiens
ATFIDKVRF

SEQ ID NO: 1006895 - protein, 9 aa, Homo Sapiens
FDNLRGQPV

SEQ ID NO: 1006896 - protein, 9 aa, Homo Sapiens
YKCEECGTA

SEQ ID NO: 1006897 - protein, 9 aa, Homo Sapiens
KLKSINKGQ

SEQ ID NO: 1006898 - protein, 9 aa, Homo Sapiens
RVDENRNAV

SEQ ID NO: 1006899 - protein, 9 aa, Homo Sapiens
KIFGKDAKS

SEQ ID NO: 1006900 - protein, 9 aa, Homo Sapiens
RLAGPEELA

SEQ ID NO: 1006901 - protein, 9 aa, Homo Sapiens
FYFIILPEN

SEQ ID NO: 1006902 - protein, 9 aa, Homo Sapiens
EKRVLSNIS

SEQ ID NO: 1006903 - protein, 9 aa, Homo Sapiens
NGCCSANEY

SEQ ID NO: 1006904 - protein, 9 aa, Homo Sapiens
PKKLKGTTH

SEQ ID NO: 1006905 - protein, 9 aa, Homo Sapiens
SSALETTHT

SEQ ID NO: 1006906 - protein, 9 aa, Homo Sapiens
RCSWGCRRN

SEQ ID NO: 1006907 - protein, 9 aa, Homo Sapiens
KEYYIKILL

SEQ ID NO: 1006908 - protein, 9 aa, Homo Sapiens
KELKPEQEI

SEQ ID NO: 1006909 - protein, 9 aa, Homo Sapiens
LFVTADGCK

SEQ ID NO: 1006910 - protein, 9 aa, Homo Sapiens
AWNEKRVLS

SEQ ID NO: 1006911 - protein, 9 aa, Homo Sapiens
IENILKAEL

SEQ ID NO: 1006912 - protein, 9 aa, Homo Sapiens
RRNSMKECR

SEQ ID NO: 1006913 - protein, 9 aa, Homo Sapiens
KTVLSIAFR

SEQ ID NO: 1006914 - protein, 9 aa, Homo Sapiens
NGGIPQKIF

SEQ ID NO: 1006915 - protein, 9 aa, Homo Sapiens
MQIAPMRNE

SEQ ID NO: 1006916 - protein, 9 aa, Homo Sapiens
FNAQHKSRS

SEQ ID NO: 1006917 - protein, 9 aa, Homo Sapiens
VVNWTFYAS

SEQ ID NO: 1006918 - protein, 9 aa, Homo Sapiens
SRKKETRNT

SEQ ID NO: 1006919 - protein, 9 aa, Homo Sapiens
GHASRGHVS

SEQ ID NO: 1006920 - protein, 9 aa, Homo Sapiens
VLFVCEEEP

SEQ ID NO: 1006921 - protein, 9 aa, Homo Sapiens
SRQNCLFLA

SEQ ID NO: 1006922 - protein, 9 aa, Homo Sapiens
FRGITNVKN

SEQ ID NO: 1006923 - protein, 9 aa, Homo Sapiens
ISTKKNTLS

SEQ ID NO: 1006924 - protein, 9 aa, Homo Sapiens
TYNNLCVSE

SEQ ID NO: 1006925 - protein, 9 aa, Homo Sapiens
LGRLGDLRE

SEQ ID NO: 1006926 - protein, 9 aa, Homo Sapiens
IEDEAHPVL

SEQ ID NO: 1006927 - protein, 9 aa, Homo Sapiens
VRDGGFPLL

SEQ ID NO: 1006928 - protein, 9 aa, Homo Sapiens
IKMLKKNVK

SEQ ID NO: 1006929 - protein, 9 aa, Homo Sapiens
CSWGQGACQ

SEQ ID NO: 1006930 - protein, 9 aa, Homo Sapiens
YYTAQDKWA

SEQ ID NO: 1006931 - protein, 9 aa, Homo Sapiens
VRSIELMFQ

SEQ ID NO: 1006932 - protein, 9 aa, Homo Sapiens
LPQKKITNI

SEQ ID NO: 1006933 - protein, 9 aa, Homo Sapiens
NQAFSLSPG

SEQ ID NO: 1006934 - protein, 9 aa, Homo Sapiens
VSYLTAASI

SEQ ID NO: 1006935 - protein, 9 aa, Homo Sapiens
IDLSNNKIS

SEQ ID NO: 1006936 - protein, 9 aa, Homo Sapiens
DLHYWSCEK

SEQ ID NO: 1006937 - protein, 9 aa, Homo Sapiens
QNGGPLTSG

SEQ ID NO: 1006938 - protein, 9 aa, Homo Sapiens
IQGRKREPG

SEQ ID NO: 1006939 - protein, 9 aa, Homo Sapiens
LNGGQPQMT

SEQ ID NO: 1006940 - protein, 9 aa, Homo Sapiens
EEENIQSSS

SEQ ID NO: 1006941 - protein, 9 aa, Homo Sapiens
FEMKYLLQK

SEQ ID NO: 1006942 - protein, 9 aa, Homo Sapiens
RVESGKNCS

SEQ ID NO: 1006943 - protein, 9 aa, Homo Sapiens
WGQGACQAA

SEQ ID NO: 1006944 - protein, 9 aa, Homo Sapiens
GHDSLSPRG

SEQ ID NO: 1006945 - protein, 9 aa, Homo Sapiens
NKDPQDFKR

SEQ ID NO: 1006946 - protein, 9 aa, Homo Sapiens
MITTVVAVG

SEQ ID NO: 1006947 - protein, 9 aa, Homo Sapiens
VVLSLIDQY

SEQ ID NO: 1006948 - protein, 9 aa, Homo Sapiens
PKLSSPKAT

SEQ ID NO: 1006949 - protein, 9 aa, Homo Sapiens
RGIPSLNDH

SEQ ID NO: 1006950 - protein, 9 aa, Homo Sapiens
NLLPPRAHA

SEQ ID NO: 1006951 - protein, 9 aa, Homo Sapiens
LPSVQTWIK

SEQ ID NO: 1006952 - protein, 9 aa, Homo Sapiens
EIENLFVIV

SEQ ID NO: 1006953 - protein, 9 aa, Homo Sapiens
EKLYAKKEC

SEQ ID NO: 1006954 - protein, 9 aa, Homo Sapiens
AEERAEFLQ

SEQ ID NO: 1006955 - protein, 9 aa, Homo Sapiens
FTAPLSPPP

SEQ ID NO: 1006956 - protein, 9 aa, Homo Sapiens
MGPLSAPSC

SEQ ID NO: 1006957 - protein, 9 aa, Homo Sapiens
FSDTADGKC

SEQ ID NO: 1006958 - protein, 9 aa, Homo Sapiens
ISPSEPFQI

SEQ ID NO: 1006959 - protein, 9 aa, Homo Sapiens
LPVDISTPV

SEQ ID NO: 1006960 - protein, 9 aa, Homo Sapiens
HHNTTCEAT

SEQ ID NO: 1006961 - protein, 9 aa, Homo Sapiens
QGPPPQGEN

SEQ ID NO: 1006962 - protein, 9 aa, Homo Sapiens
KSELARTAG

SEQ ID NO: 1006963 - protein, 9 aa, Homo Sapiens
NSAPGILGP

SEQ ID NO: 1006964 - protein, 9 aa, Homo Sapiens
IFSASMGLE

SEQ ID NO: 1006965 - protein, 9 aa, Homo Sapiens
LLKFAFNSI

SEQ ID NO: 1006966 - protein, 9 aa, Homo Sapiens
REIDKLKQR

SEQ ID NO: 1006967 - protein, 9 aa, Homo Sapiens
WGGQGSQST

SEQ ID NO: 1006968 - protein, 9 aa, Homo Sapiens
LRHGPPMHL

SEQ ID NO: 1006969 - protein, 9 aa, Homo Sapiens
RGCAGPHQA

SEQ ID NO: 1006970 - protein, 9 aa, Homo Sapiens
KIESMDELE

SEQ ID NO: 1006971 - protein, 9 aa, Homo Sapiens
SLNDHGSLK

SEQ ID NO: 1006972 - protein, 9 aa, Homo Sapiens
EGIIRVRKS

SEQ ID NO: 1006973 - protein, 9 aa, Homo Sapiens
KSEKETSKL

SEQ ID NO: 1006974 - protein, 9 aa, Homo Sapiens
HGPPMHLYL

SEQ ID NO: 1006975 - protein, 9 aa, Homo Sapiens
AFLGERVYE

SEQ ID NO: 1006976 - protein, 9 aa, Homo Sapiens
GQSQGFLEG

SEQ ID NO: 1006977 - protein, 9 aa, Homo Sapiens
PSSHLTQAS

SEQ ID NO: 1006978 - protein, 9 aa, Homo Sapiens
EENKSEYFL

SEQ ID NO: 1006979 - protein, 9 aa, Homo Sapiens
NAQHKSRSS

SEQ ID NO: 1006980 - protein, 9 aa, Homo Sapiens
ETLRTPSNG

SEQ ID NO: 1006981 - protein, 9 aa, Homo Sapiens
TERAGDQPL

SEQ ID NO: 1006982 - protein, 9 aa, Homo Sapiens
GSPGCPLVP

SEQ ID NO: 1006983 - protein, 9 aa, Homo Sapiens
PKKGKITGG

SEQ ID NO: 1006984 - protein, 9 aa, Homo Sapiens
SRPWDLREE

SEQ ID NO: 1006985 - protein, 9 aa, Homo Sapiens
AIDSAGTYR

SEQ ID NO: 1006986 - protein, 9 aa, Homo Sapiens
LNIDEYNFF

SEQ ID NO: 1006987 - protein, 9 aa, Homo Sapiens
QTCKRSYQL

SEQ ID NO: 1006988 - protein, 9 aa, Homo Sapiens
PAVSTVASS

SEQ ID NO: 1006989 - protein, 9 aa, Homo Sapiens
TEEGIIRVR

SEQ ID NO: 1006990 - protein, 9 aa, Homo Sapiens
ESLKKEQLS

SEQ ID NO: 1006991 - protein, 9 aa, Homo Sapiens
EEDKNELLR

SEQ ID NO: 1006992 - protein, 9 aa, Homo Sapiens
KKLNLELEF

SEQ ID NO: 1006993 - protein, 9 aa, Homo Sapiens
QRKPQQRLN

SEQ ID NO: 1006994 - protein, 9 aa, Homo Sapiens
GTIFSASMG

SEQ ID NO: 1006995 - protein, 9 aa, Homo Sapiens
SLQTALRGW

SEQ ID NO: 1006996 - protein, 9 aa, Homo Sapiens
CEECGTAFN

SEQ ID NO: 1006997 - protein, 9 aa, Homo Sapiens
AQCLLGQFG

SEQ ID NO: 1006998 - protein, 9 aa, Homo Sapiens
VMKRKIIKQ

SEQ ID NO: 1006999 - protein, 9 aa, Homo Sapiens
DGGFPLLSS

SEQ ID NO: 1007000 - protein, 9 aa, Homo Sapiens
DTDHDLIKT

SEQ ID NO: 1007001 - protein, 9 aa, Homo Sapiens
QGYHSMPHE

SEQ ID NO: 1007002 - protein, 9 aa, Homo Sapiens
MHSGLYQEP

SEQ ID NO: 1007003 - protein, 9 aa, Homo Sapiens
WAHACNFST

SEQ ID NO: 1007004 - protein, 9 aa, Homo Sapiens
HYKVNHKGY

SEQ ID NO: 1007005 - protein, 9 aa, Homo Sapiens
IKCKAPGNS

SEQ ID NO: 1007006 - protein, 9 aa, Homo Sapiens
LQCLFVDVP

SEQ ID NO: 1007007 - protein, 9 aa, Homo Sapiens
EVFLLEVVY

SEQ ID NO: 1007008 - protein, 9 aa, Homo Sapiens
NPYKPKCPE

SEQ ID NO: 1007009 - protein, 9 aa, Homo Sapiens
EQARRLVFT

SEQ ID NO: 1007010 - protein, 9 aa, Homo Sapiens
HYGNKKYKK

SEQ ID NO: 1007011 - protein, 9 aa, Homo Sapiens
FQKITLYLT

SEQ ID NO: 1007012 - protein, 9 aa, Homo Sapiens
DILVLILFF

SEQ ID NO: 1007013 - protein, 9 aa, Homo Sapiens
IKNLAAKME

SEQ ID NO: 1007014 - protein, 9 aa, Homo Sapiens
ITSDPQSND

SEQ ID NO: 1007015 - protein, 9 aa, Homo Sapiens
GHFAHNKAQ

SEQ ID NO: 1007016 - protein, 9 aa, Homo Sapiens
WDDNEVEWE

SEQ ID NO: 1007017 - protein, 9 aa, Homo Sapiens
FVLNSAILM

SEQ ID NO: 1007018 - protein, 9 aa, Homo Sapiens
CNGMLQEIL

SEQ ID NO: 1007019 - protein, 9 aa, Homo Sapiens
EKSPLPQKK

SEQ ID NO: 1007020 - protein, 9 aa, Homo Sapiens
SGKGSFPVA

SEQ ID NO: 1007021 - protein, 9 aa, Homo Sapiens
HRIKEIKQM

SEQ ID NO: 1007022 - protein, 9 aa, Homo Sapiens
KVGLKKRVV

SEQ ID NO: 1007023 - protein, 9 aa, Homo Sapiens
SSSEEVFQE

SEQ ID NO: 1007024 - protein, 9 aa, Homo Sapiens
ELQDKRINQ

SEQ ID NO: 1007025 - protein, 9 aa, Homo Sapiens
PSLAPRSRS

SEQ ID NO: 1007026 - protein, 9 aa, Homo Sapiens
VLPYALIKE

SEQ ID NO: 1007027 - protein, 9 aa, Homo Sapiens
PVHVQTNMP

SEQ ID NO: 1007028 - protein, 9 aa, Homo Sapiens
LRDIDTLHE

SEQ ID NO: 1007029 - protein, 9 aa, Homo Sapiens
TSEQRKSIK

SEQ ID NO: 1007030 - protein, 9 aa, Homo Sapiens
SNHQRLGTH

SEQ ID NO: 1007031 - protein, 9 aa, Homo Sapiens
GVGNRVRRW

SEQ ID NO: 1007032 - protein, 9 aa, Homo Sapiens
GVMKAYTTR

SEQ ID NO: 1007033 - protein, 9 aa, Homo Sapiens
REPGEGAYV

SEQ ID NO: 1007034 - protein, 9 aa, Homo Sapiens
AGPHALTQV

SEQ ID NO: 1007035 - protein, 9 aa, Homo Sapiens
DTFGPDLHY

SEQ ID NO: 1007036 - protein, 9 aa, Homo Sapiens
VVEKSELAR

SEQ ID NO: 1007037 - protein, 9 aa, Homo Sapiens
SKDNLLRIS

SEQ ID NO: 1007038 - protein, 9 aa, Homo Sapiens
YEEIPLPIG

SEQ ID NO: 1007039 - protein, 9 aa, Homo Sapiens
LTLSSRDKE

SEQ ID NO: 1007040 - protein, 9 aa, Homo Sapiens
EPGRQQYDL

SEQ ID NO: 1007041 - protein, 9 aa, Homo Sapiens
LLPSLYRDY

SEQ ID NO: 1007042 - protein, 9 aa, Homo Sapiens
CGRVNSSEQ

SEQ ID NO: 1007043 - protein, 9 aa, Homo Sapiens
YEVCLTEGS

SEQ ID NO: 1007044 - protein, 9 aa, Homo Sapiens
CYPPEDRRV

SEQ ID NO: 1007045 - protein, 9 aa, Homo Sapiens
FKLSRHSKE

SEQ ID NO: 1007046 - protein, 9 aa, Homo Sapiens
KQKEAKSSA

SEQ ID NO: 1007047 - protein, 9 aa, Homo Sapiens
PGIQGRKRE

SEQ ID NO: 1007048 - protein, 9 aa, Homo Sapiens
SLSGKQLLS

SEQ ID NO: 1007049 - protein, 9 aa, Homo Sapiens
TPGRRPRRG

SEQ ID NO: 1007050 - protein, 9 aa, Homo Sapiens
ALRPPPVTL

SEQ ID NO: 1007051 - protein, 9 aa, Homo Sapiens
GREEEQTAK

SEQ ID NO: 1007052 - protein, 9 aa, Homo Sapiens
KSKKVESSQ

SEQ ID NO: 1007053 - protein, 9 aa, Homo Sapiens
STPDPSEKW

SEQ ID NO: 1007054 - protein, 9 aa, Homo Sapiens
EVSFNCIDK

SEQ ID NO: 1007055 - protein, 9 aa, Homo Sapiens
LSVDILDPR

SEQ ID NO: 1007056 - protein, 9 aa, Homo Sapiens
IEKKKIIGT

SEQ ID NO: 1007057 - protein, 9 aa, Homo Sapiens
PWHLNHLDS

SEQ ID NO: 1007058 - protein, 9 aa, Homo Sapiens
TSGIAQALS

SEQ ID NO: 1007059 - protein, 9 aa, Homo Sapiens
PTDCSWGKP

SEQ ID NO: 1007060 - protein, 9 aa, Homo Sapiens
PPSIDCAEG

SEQ ID NO: 1007061 - protein, 9 aa, Homo Sapiens
YCAPFQLHS

SEQ ID NO: 1007062 - protein, 9 aa, Homo Sapiens
SQSEQTTTS

SEQ ID NO: 1007063 - protein, 9 aa, Homo Sapiens
KWPQSNSKF

SEQ ID NO: 1007064 - protein, 9 aa, Homo Sapiens
SEQRKSIKT

SEQ ID NO: 1007065 - protein, 9 aa, Homo Sapiens
PERLQLNKD

SEQ ID NO: 1007066 - protein, 9 aa, Homo Sapiens
AKLVKRKQE

SEQ ID NO: 1007067 - protein, 9 aa, Homo Sapiens
HSKQEGLIC

SEQ ID NO: 1007068 - protein, 9 aa, Homo Sapiens
PSELNSVKY

SEQ ID NO: 1007069 - protein, 9 aa, Homo Sapiens
NEVELQDKR

SEQ ID NO: 1007070 - protein, 9 aa, Homo Sapiens
YHPGQSQGF

SEQ ID NO: 1007071 - protein, 9 aa, Homo Sapiens
VRCTCIGIS

SEQ ID NO: 1007072 - protein, 9 aa, Homo Sapiens
KKGSSPVGP

SEQ ID NO: 1007073 - protein, 9 aa, Homo Sapiens
NGTNPYKPK

SEQ ID NO: 1007074 - protein, 9 aa, Homo Sapiens
PAAAAARPP

SEQ ID NO: 1007075 - protein, 9 aa, Homo Sapiens
YNLADETEL

SEQ ID NO: 1007076 - protein, 9 aa, Homo Sapiens
QYETLSEKM

SEQ ID NO: 1007077 - protein, 9 aa, Homo Sapiens
VTGRLAWWN

SEQ ID NO: 1007078 - protein, 9 aa, Homo Sapiens
QESLKKEQL

SEQ ID NO: 1007079 - protein, 9 aa, Homo Sapiens
VSFHCDNGF

SEQ ID NO: 1007080 - protein, 9 aa, Homo Sapiens
TAVSGMMIL

SEQ ID NO: 1007081 - protein, 9 aa, Homo Sapiens
HTGIKPLKC

SEQ ID NO: 1007082 - protein, 9 aa, Homo Sapiens
QSLSPVCSR

SEQ ID NO: 1007083 - protein, 9 aa, Homo Sapiens
IIKQEEDPP

SEQ ID NO: 1007084 - protein, 9 aa, Homo Sapiens
KIDLQNTVS

SEQ ID NO: 1007085 - protein, 9 aa, Homo Sapiens
FEDGMKFKK

SEQ ID NO: 1007086 - protein, 9 aa, Homo Sapiens
QVVVGTDKF

SEQ ID NO: 1007087 - protein, 9 aa, Homo Sapiens
GRVLRNFFD

SEQ ID NO: 1007088 - protein, 9 aa, Homo Sapiens
LIWRPGTEQ

SEQ ID NO: 1007089 - protein, 9 aa, Homo Sapiens
WKKENRRNE

SEQ ID NO: 1007090 - protein, 9 aa, Homo Sapiens
RNAVISDMA

SEQ ID NO: 1007091 - protein, 9 aa, Homo Sapiens
QFYGLLVKR

SEQ ID NO: 1007092 - protein, 9 aa, Homo Sapiens
IVCSCPERL

SEQ ID NO: 1007093 - protein, 9 aa, Homo Sapiens
LLQEVSSAS

SEQ ID NO: 1007094 - protein, 9 aa, Homo Sapiens
NSLRYPTIM

SEQ ID NO: 1007095 - protein, 9 aa, Homo Sapiens
LETPCENEF

SEQ ID NO: 1007096 - protein, 9 aa, Homo Sapiens
QFSKNNALD

SEQ ID NO: 1007097 - protein, 9 aa, Homo Sapiens
NNRELRGRL

SEQ ID NO: 1007098 - protein, 9 aa, Homo Sapiens
TRIYTFESL

SEQ ID NO: 1007099 - protein, 9 aa, Homo Sapiens
LRKTGAHHE

SEQ ID NO: 1007100 - protein, 9 aa, Homo Sapiens
LCASTNEFL

SEQ ID NO: 1007101 - protein, 9 aa, Homo Sapiens
EEVFQELES

SEQ ID NO: 1007102 - protein, 9 aa, Homo Sapiens
MNEDDDFSK

SEQ ID NO: 1007103 - protein, 9 aa, Homo Sapiens
ELWNFPPDS

SEQ ID NO: 1007104 - protein, 9 aa, Homo Sapiens
TMRSIPKDK

SEQ ID NO: 1007105 - protein, 9 aa, Homo Sapiens
DSKMTPTIE

SEQ ID NO: 1007106 - protein, 9 aa, Homo Sapiens
CSLGQLSQD

SEQ ID NO: 1007107 - protein, 9 aa, Homo Sapiens
GYHKSFTKL

SEQ ID NO: 1007108 - protein, 9 aa, Homo Sapiens
FATNGKLFS

SEQ ID NO: 1007109 - protein, 9 aa, Homo Sapiens
TKYVSHGAT

SEQ ID NO: 1007110 - protein, 9 aa, Homo Sapiens
AAAARPPAT

SEQ ID NO: 1007111 - protein, 9 aa, Homo Sapiens
LNHLDSASA

SEQ ID NO: 1007112 - protein, 9 aa, Homo Sapiens
AKPNNSDLT

SEQ ID NO: 1007113 - protein, 9 aa, Homo Sapiens
AANGTPKHS

SEQ ID NO: 1007114 - protein, 9 aa, Homo Sapiens
GPAKENEHL

SEQ ID NO: 1007115 - protein, 9 aa, Homo Sapiens
NRTELTLRY

SEQ ID NO: 1007116 - protein, 9 aa, Homo Sapiens
NLSYCAPFQ

SEQ ID NO: 1007117 - protein, 9 aa, Homo Sapiens
CLFVDVPAG

SEQ ID NO: 1007118 - protein, 9 aa, Homo Sapiens
FRKSEKETS

SEQ ID NO: 1007119 - protein, 9 aa, Homo Sapiens
PRCEVPDLG

SEQ ID NO: 1007120 - protein, 9 aa, Homo Sapiens
MTLFSCPVT

SEQ ID NO: 1007121 - protein, 9 aa, Homo Sapiens
KVWSHVGHT

SEQ ID NO: 1007122 - protein, 9 aa, Homo Sapiens
AKPHFMVPK

SEQ ID NO: 1007123 - protein, 9 aa, Homo Sapiens
GSLVTDKKA

SEQ ID NO: 1007124 - protein, 9 aa, Homo Sapiens
DISPLLLLS

SEQ ID NO: 1007125 - protein, 9 aa, Homo Sapiens
SSRKQHPAG

SEQ ID NO: 1007126 - protein, 9 aa, Homo Sapiens
QAFLEQANS

SEQ ID NO: 1007127 - protein, 9 aa, Homo Sapiens
DTGTLSKDN

SEQ ID NO: 1007128 - protein, 9 aa, Homo Sapiens
ICLAVLILA

SEQ ID NO: 1007129 - protein, 9 aa, Homo Sapiens
CLRISSTKR

SEQ ID NO: 1007130 - protein, 9 aa, Homo Sapiens
FVWFVSDAS

SEQ ID NO: 1007131 - protein, 9 aa, Homo Sapiens
VWEKRVRIY

SEQ ID NO: 1007132 - protein, 9 aa, Homo Sapiens
PLAEEKDDV

SEQ ID NO: 1007133 - protein, 9 aa, Homo Sapiens
TFFHVIQTS

SEQ ID NO: 1007134 - protein, 9 aa, Homo Sapiens
RYETTKDYP

SEQ ID NO: 1007135 - protein, 9 aa, Homo Sapiens
RTYESSDCI

SEQ ID NO: 1007136 - protein, 9 aa, Homo Sapiens
RRELAKLVK

SEQ ID NO: 1007137 - protein, 9 aa, Homo Sapiens
PLKGPGPSL

SEQ ID NO: 1007138 - protein, 9 aa, Homo Sapiens
SSSPRTRAR

SEQ ID NO: 1007139 - protein, 9 aa, Homo Sapiens
PVIGLTSSS

SEQ ID NO: 1007140 - protein, 9 aa, Homo Sapiens
GEEFSGKGS

SEQ ID NO: 1007141 - protein, 9 aa, Homo Sapiens
YVISAIPLT

SEQ ID NO: 1007142 - protein, 9 aa, Homo Sapiens
LCTKLVFWL

SEQ ID NO: 1007143 - protein, 9 aa, Homo Sapiens
IIFYSTLIF

SEQ ID NO: 1007144 - protein, 9 aa, Homo Sapiens
DDDYFENEE

SEQ ID NO: 1007145 - protein, 9 aa, Homo Sapiens
SDGHKRKEK

SEQ ID NO: 1007146 - protein, 9 aa, Homo Sapiens
IILEGMVEA

SEQ ID NO: 1007147 - protein, 9 aa, Homo Sapiens
EAMAAVRDK

SEQ ID NO: 1007148 - protein, 9 aa, Homo Sapiens
AQRVVTSPL

SEQ ID NO: 1007149 - protein, 9 aa, Homo Sapiens
TLLRSVFWK

SEQ ID NO: 1007150 - protein, 9 aa, Homo Sapiens
LKCSDCGKT

SEQ ID NO: 1007151 - protein, 9 aa, Homo Sapiens
TTKPKDVKL

SEQ ID NO: 1007152 - protein, 9 aa, Homo Sapiens
FSKNNALDL

SEQ ID NO: 1007153 - protein, 9 aa, Homo Sapiens
TTWLSCFFY

SEQ ID NO: 1007154 - protein, 9 aa, Homo Sapiens
ENPPLSSQA

SEQ ID NO: 1007155 - protein, 9 aa, Homo Sapiens
SGPVPMGMP

SEQ ID NO: 1007156 - protein, 9 aa, Homo Sapiens
EFTRNMVKL

SEQ ID NO: 1007157 - protein, 9 aa, Homo Sapiens
PHFFCNPSE

SEQ ID NO: 1007158 - protein, 9 aa, Homo Sapiens
WLQRVSFSL

SEQ ID NO: 1007159 - protein, 9 aa, Homo Sapiens
GPPYEPRFK

SEQ ID NO: 1007160 - protein, 9 aa, Homo Sapiens
IDIPLSVDI

SEQ ID NO: 1007161 - protein, 9 aa, Homo Sapiens
IENRTRVPN

SEQ ID NO: 1007162 - protein, 9 aa, Homo Sapiens
VDMPVSSSF

SEQ ID NO: 1007163 - protein, 9 aa, Homo Sapiens
VPVLPAADH

SEQ ID NO: 1007164 - protein, 9 aa, Homo Sapiens
VSLVEPGFL

SEQ ID NO: 1007165 - protein, 9 aa, Homo Sapiens
VLFLSHAHA

SEQ ID NO: 1007166 - protein, 9 aa, Homo Sapiens
RYFRSQTLA

SEQ ID NO: 1007167 - protein, 9 aa, Homo Sapiens
VIDLDNATF

SEQ ID NO: 1007168 - protein, 9 aa, Homo Sapiens
VVKVAEYKY

SEQ ID NO: 1007169 - protein, 9 aa, Homo Sapiens
INEPLHLLK

SEQ ID NO: 1007170 - protein, 9 aa, Homo Sapiens
YLEYNAIKK

SEQ ID NO: 1007171 - protein, 9 aa, Homo Sapiens
SPNRFADKP

SEQ ID NO: 1007172 - protein, 9 aa, Homo Sapiens
QDFEMKYLL

SEQ ID NO: 1007173 - protein, 9 aa, Homo Sapiens
ESRTLLSYV

SEQ ID NO: 1007174 - protein, 9 aa, Homo Sapiens
PLFQPLDYQ

SEQ ID NO: 1007175 - protein, 9 aa, Homo Sapiens
LLNKTCLEE

SEQ ID NO: 1007176 - protein, 9 aa, Homo Sapiens
DGPPGSRPR

SEQ ID NO: 1007177 - protein, 9 aa, Homo Sapiens
AFLRLFQQA

SEQ ID NO: 1007178 - protein, 9 aa, Homo Sapiens
DNLLRISIP

SEQ ID NO: 1007179 - protein, 9 aa, Homo Sapiens
PSIDCAEGR

SEQ ID NO: 1007180 - protein, 9 aa, Homo Sapiens
HDVLTLKKE

SEQ ID NO: 1007181 - protein, 9 aa, Homo Sapiens
RLIGGLASE

SEQ ID NO: 1007182 - protein, 9 aa, Homo Sapiens
ACLSSPGSR

SEQ ID NO: 1007183 - protein, 9 aa, Homo Sapiens
HRTSEKEAI

SEQ ID NO: 1007184 - protein, 9 aa, Homo Sapiens
SRRGPPPSR

SEQ ID NO: 1007185 - protein, 9 aa, Homo Sapiens
IPLLAVTPP

SEQ ID NO: 1007186 - protein, 9 aa, Homo Sapiens
ICKPLRYPL

SEQ ID NO: 1007187 - protein, 9 aa, Homo Sapiens
ASFPVKGLS

SEQ ID NO: 1007188 - protein, 9 aa, Homo Sapiens
DGPHEDPQC

SEQ ID NO: 1007189 - protein, 9 aa, Homo Sapiens
RPVGTSLSL

SEQ ID NO: 1007190 - protein, 9 aa, Homo Sapiens
IFFTGCFAQ

SEQ ID NO: 1007191 - protein, 9 aa, Homo Sapiens
NLKFQEEFL

SEQ ID NO: 1007192 - protein, 9 aa, Homo Sapiens
TPMLNLLIY

SEQ ID NO: 1007193 - protein, 9 aa, Homo Sapiens
RDSSQAILI

SEQ ID NO: 1007194 - protein, 9 aa, Homo Sapiens
LNKDPQDFK

SEQ ID NO: 1007195 - protein, 9 aa, Homo Sapiens
VESYESQVL

SEQ ID NO: 1007196 - protein, 9 aa, Homo Sapiens
LRAIQAGCL

SEQ ID NO: 1007197 - protein, 9 aa, Homo Sapiens
ENQSQGPPP

SEQ ID NO: 1007198 - protein, 9 aa, Homo Sapiens
KLHFSVYNF

SEQ ID NO: 1007199 - protein, 9 aa, Homo Sapiens
LQQSTNSAP

SEQ ID NO: 1007200 - protein, 9 aa, Homo Sapiens
PPPSYDKAV

SEQ ID NO: 1007201 - protein, 9 aa, Homo Sapiens
DDKEPRHKG

SEQ ID NO: 1007202 - protein, 9 aa, Homo Sapiens
VVKYGMGGI

SEQ ID NO: 1007203 - protein, 9 aa, Homo Sapiens
YPYAKFSLA

SEQ ID NO: 1007204 - protein, 9 aa, Homo Sapiens
GSRLLPEAL

SEQ ID NO: 1007205 - protein, 9 aa, Homo Sapiens
LRISSTKRV

SEQ ID NO: 1007206 - protein, 9 aa, Homo Sapiens
RKMTLDQSE

SEQ ID NO: 1007207 - protein, 9 aa, Homo Sapiens
SCLCYDPEI

SEQ ID NO: 1007208 - protein, 9 aa, Homo Sapiens
LKNFLGEEK

SEQ ID NO: 1007209 - protein, 9 aa, Homo Sapiens
KNGIPICTV

SEQ ID NO: 1007210 - protein, 9 aa, Homo Sapiens
HQPGSRHRD

SEQ ID NO: 1007211 - protein, 9 aa, Homo Sapiens
ICLEACQVP

SEQ ID NO: 1007212 - protein, 9 aa, Homo Sapiens
MVSLAAKES

SEQ ID NO: 1007213 - protein, 9 aa, Homo Sapiens
FYPSTMAFS

SEQ ID NO: 1007214 - protein, 9 aa, Homo Sapiens
SQVLEQLHY

SEQ ID NO: 1007215 - protein, 9 aa, Homo Sapiens
ENNFRRPNL

SEQ ID NO: 1007216 - protein, 9 aa, Homo Sapiens
LVELDLTEN

SEQ ID NO: 1007217 - protein, 9 aa, Homo Sapiens
YTSLSRMTK

SEQ ID NO: 1007218 - protein, 9 aa, Homo Sapiens
FVDMKPIHM

SEQ ID NO: 1007219 - protein, 9 aa, Homo Sapiens
TFMRARFRT

SEQ ID NO: 1007220 - protein, 9 aa, Homo Sapiens
SPVCDESCK

SEQ ID NO: 1007221 - protein, 9 aa, Homo Sapiens
YRDYRGKNA

SEQ ID NO: 1007222 - protein, 9 aa, Homo Sapiens
MLDEDVTDM

SEQ ID NO: 1007223 - protein, 9 aa, Homo Sapiens
HMVLNKKYE

SEQ ID NO: 1007224 - protein, 9 aa, Homo Sapiens
ISSTKRVCL

SEQ ID NO: 1007225 - protein, 9 aa, Homo Sapiens
ASGALAGVG

SEQ ID NO: 1007226 - protein, 9 aa, Homo Sapiens
GTLKLPPPA

SEQ ID NO: 1007227 - protein, 9 aa, Homo Sapiens
KPDNSKNHK

SEQ ID NO: 1007228 - protein, 9 aa, Homo Sapiens
SLSPRGVGY

SEQ ID NO: 1007229 - protein, 9 aa, Homo Sapiens
LSPKKMSFR

SEQ ID NO: 1007230 - protein, 9 aa, Homo Sapiens
VNEKSSLEG

SEQ ID NO: 1007231 - protein, 9 aa, Homo Sapiens
LTALEEALA

SEQ ID NO: 1007232 - protein, 9 aa, Homo Sapiens
GIIQRKMCI

SEQ ID NO: 1007233 - protein, 9 aa, Homo Sapiens
SLLDEKQEQ

SEQ ID NO: 1007234 - protein, 9 aa, Homo Sapiens
SQPERVYLY

SEQ ID NO: 1007235 - protein, 9 aa, Homo Sapiens
HSNPELLKQ

SEQ ID NO: 1007236 - protein, 9 aa, Homo Sapiens
CVCILRNLL

SEQ ID NO: 1007237 - protein, 9 aa, Homo Sapiens
PLFQELNST

SEQ ID NO: 1007238 - protein, 9 aa, Homo Sapiens
SLGIAEFWI

SEQ ID NO: 1007239 - protein, 9 aa, Homo Sapiens
GMGSLEKEG

SEQ ID NO: 1007240 - protein, 9 aa, Homo Sapiens
FPRTWCFPA

SEQ ID NO: 1007241 - protein, 9 aa, Homo Sapiens
WNLLHIDPN

SEQ ID NO: 1007242 - protein, 9 aa, Homo Sapiens
QLSSPRAHS

SEQ ID NO: 1007243 - protein, 9 aa, Homo Sapiens
KDSGSTEGK

SEQ ID NO: 1007244 - protein, 9 aa, Homo Sapiens
TDHDLIKTD

SEQ ID NO: 1007245 - protein, 9 aa, Homo Sapiens
LSAPSCTQR

SEQ ID NO: 1007246 - protein, 9 aa, Homo Sapiens
CPSGVVNEN

SEQ ID NO: 1007247 - protein, 9 aa, Homo Sapiens
TGGYLDRSV

SEQ ID NO: 1007248 - protein, 9 aa, Homo Sapiens
ENSFREKKF

SEQ ID NO: 1007249 - protein, 9 aa, Homo Sapiens
AAFSPVCDE

SEQ ID NO: 1007250 - protein, 9 aa, Homo Sapiens
MKRKIIKQE

SEQ ID NO: 1007251 - protein, 9 aa, Homo Sapiens
GMLTEESIP

SEQ ID NO: 1007252 - protein, 9 aa, Homo Sapiens
PVIREEDKN

SEQ ID NO: 1007253 - protein, 9 aa, Homo Sapiens
LQGLSDTGY

SEQ ID NO: 1007254 - protein, 9 aa, Homo Sapiens
PSEKWGSGD

SEQ ID NO: 1007255 - protein, 9 aa, Homo Sapiens
GNTPLFLGQ

SEQ ID NO: 1007256 - protein, 9 aa, Homo Sapiens
RVHITVLDK

SEQ ID NO: 1007257 - protein, 9 aa, Homo Sapiens
TTWTLFTSS

SEQ ID NO: 1007258 - protein, 9 aa, Homo Sapiens
PDVDSLVDS

SEQ ID NO: 1007259 - protein, 9 aa, Homo Sapiens
VVSGENLKK

SEQ ID NO: 1007260 - protein, 9 aa, Homo Sapiens
ATMKSRWSG

SEQ ID NO: 1007261 - protein, 9 aa, Homo Sapiens
KMTPTIEGC

SEQ ID NO: 1007262 - protein, 9 aa, Homo Sapiens
PEAMPTHKN

SEQ ID NO: 1007263 - protein, 9 aa, Homo Sapiens
LISSENVYS

SEQ ID NO: 1007264 - protein, 9 aa, Homo Sapiens
AKFSAVKKK

SEQ ID NO: 1007265 - protein, 9 aa, Homo Sapiens
MRSIPKDKL

SEQ ID NO: 1007266 - protein, 9 aa, Homo Sapiens
DPQDFKRTD

SEQ ID NO: 1007267 - protein, 9 aa, Homo Sapiens
GPLSAPSCT

SEQ ID NO: 1007268 - protein, 9 aa, Homo Sapiens
ELGRLGDLR

SEQ ID NO: 1007269 - protein, 9 aa, Homo Sapiens
DKRIFLAGC

SEQ ID NO: 1007270 - protein, 9 aa, Homo Sapiens
EQTAKEILS

SEQ ID NO: 1007271 - protein, 9 aa, Homo Sapiens
VKVPVGQKV

SEQ ID NO: 1007272 - protein, 9 aa, Homo Sapiens
SLIRLGKHW

SEQ ID NO: 1007273 - protein, 9 aa, Homo Sapiens
EAGEDINVQ

SEQ ID NO: 1007274 - protein, 9 aa, Homo Sapiens
VGIGVFILL

SEQ ID NO: 1007275 - protein, 9 aa, Homo Sapiens
AWQLHRTCN

SEQ ID NO: 1007276 - protein, 9 aa, Homo Sapiens
NHDQHCRKI

SEQ ID NO: 1007277 - protein, 9 aa, Homo Sapiens
NIFLRLFYE

SEQ ID NO: 1007278 - protein, 9 aa, Homo Sapiens
GTYRGDSHL

SEQ ID NO: 1007279 - protein, 9 aa, Homo Sapiens
AFVSADLNG

SEQ ID NO: 1007280 - protein, 9 aa, Homo Sapiens
CFSWTLHTP

SEQ ID NO: 1007281 - protein, 9 aa, Homo Sapiens
QSKAKISSA

SEQ ID NO: 1007282 - protein, 9 aa, Homo Sapiens
QQYDLMEVE

SEQ ID NO: 1007283 - protein, 9 aa, Homo Sapiens
ERTQGIFSL

SEQ ID NO: 1007284 - protein, 9 aa, Homo Sapiens
SQEQRAQAA

SEQ ID NO: 1007285 - protein, 9 aa, Homo Sapiens
KKRKQQNQL

SEQ ID NO: 1007286 - protein, 9 aa, Homo Sapiens
IENLFVIVF

SEQ ID NO: 1007287 - protein, 9 aa, Homo Sapiens
TIHAAEWVQ

SEQ ID NO: 1007288 - protein, 9 aa, Homo Sapiens
PKPFIWAKP

SEQ ID NO: 1007289 - protein, 9 aa, Homo Sapiens
TVDMPVSSS

SEQ ID NO: 1007290 - protein, 9 aa, Homo Sapiens
PTHKNLCSL

SEQ ID NO: 1007291 - protein, 9 aa, Homo Sapiens
EALSFPHLY

SEQ ID NO: 1007292 - protein, 9 aa, Homo Sapiens
SSDWCTQIF

SEQ ID NO: 1007293 - protein, 9 aa, Homo Sapiens
KLRPHYPPM

SEQ ID NO: 1007294 - protein, 9 aa, Homo Sapiens
RRGPPPSRS

SEQ ID NO: 1007295 - protein, 9 aa, Homo Sapiens
TLCASTNEF

SEQ ID NO: 1007296 - protein, 9 aa, Homo Sapiens
VLFTRILAM

SEQ ID NO: 1007297 - protein, 9 aa, Homo Sapiens
ERCPNTYAC

SEQ ID NO: 1007298 - protein, 9 aa, Homo Sapiens
LRLFLFSYC

SEQ ID NO: 1007299 - protein, 9 aa, Homo Sapiens
LVTDKKAII

SEQ ID NO: 1007300 - protein, 9 aa, Homo Sapiens
ANGTPKHSF

SEQ ID NO: 1007301 - protein, 9 aa, Homo Sapiens
KENPPLSSQ

SEQ ID NO: 1007302 - protein, 9 aa, Homo Sapiens
TFGEKIKNT

SEQ ID NO: 1007303 - protein, 9 aa, Homo Sapiens
VGNKFVTKG

SEQ ID NO: 1007304 - protein, 9 aa, Homo Sapiens
RALRPPPVT

SEQ ID NO: 1007305 - protein, 9 aa, Homo Sapiens
TPEPWGNSP

SEQ ID NO: 1007306 - protein, 9 aa, Homo Sapiens
VREAFGNAK

SEQ ID NO: 1007307 - protein, 9 aa, Homo Sapiens
FSASMGLEH

SEQ ID NO: 1007308 - protein, 9 aa, Homo Sapiens
YNAIKKILP

SEQ ID NO: 1007309 - protein, 9 aa, Homo Sapiens
EEQGKISEG

SEQ ID NO: 1007310 - protein, 9 aa, Homo Sapiens
ERKRRDSSL

SEQ ID NO: 1007311 - protein, 9 aa, Homo Sapiens
FWKVPRLGI

SEQ ID NO: 1007312 - protein, 9 aa, Homo Sapiens
FLVYQLTYC

SEQ ID NO: 1007313 - protein, 9 aa, Homo Sapiens
LLQSNPVRE

SEQ ID NO: 1007314 - protein, 9 aa, Homo Sapiens
FSAVKKKFM

SEQ ID NO: 1007315 - protein, 9 aa, Homo Sapiens
EILHKDLKS

SEQ ID NO: 1007316 - protein, 9 aa, Homo Sapiens
KTQLILGRH

SEQ ID NO: 1007317 - protein, 9 aa, Homo Sapiens
LASLSKPNE

SEQ ID NO: 1007318 - protein, 9 aa, Homo Sapiens
AREAGEDIN

SEQ ID NO: 1007319 - protein, 9 aa, Homo Sapiens
GLICSRVSG

SEQ ID NO: 1007320 - protein, 9 aa, Homo Sapiens
AKSIEERKK

SEQ ID NO: 1007321 - protein, 9 aa, Homo Sapiens
PARTNRGGD

SEQ ID NO: 1007322 - protein, 9 aa, Homo Sapiens
PRGIPSLND

SEQ ID NO: 1007323 - protein, 9 aa, Homo Sapiens
LTNEVELQD

SEQ ID NO: 1007324 - protein, 9 aa, Homo Sapiens
MHHLFLFFT

SEQ ID NO: 1007325 - protein, 9 aa, Homo Sapiens
QEKENEVEV

SEQ ID NO: 1007326 - protein, 9 aa, Homo Sapiens
MVFWKVPRL

SEQ ID NO: 1007327 - protein, 9 aa, Homo Sapiens
EECITNPLL

SEQ ID NO: 1007328 - protein, 9 aa, Homo Sapiens
DPGVALSSQ

SEQ ID NO: 1007329 - protein, 9 aa, Homo Sapiens
KLNLELEFT

SEQ ID NO: 1007330 - protein, 9 aa, Homo Sapiens
EINNVAGEI

SEQ ID NO: 1007331 - protein, 9 aa, Homo Sapiens
CRKNAVVSF

SEQ ID NO: 1007332 - protein, 9 aa, Homo Sapiens
PDQLYRTKK

SEQ ID NO: 1007333 - protein, 9 aa, Homo Sapiens
VDLRNPDLV

SEQ ID NO: 1007334 - protein, 9 aa, Homo Sapiens
RSFDSKDTR

SEQ ID NO: 1007335 - protein, 9 aa, Homo Sapiens
EWVHSNFHF

SEQ ID NO: 1007336 - protein, 9 aa, Homo Sapiens
PDTSFFIDK

SEQ ID NO: 1007337 - protein, 9 aa, Homo Sapiens
YGRVICQPV

SEQ ID NO: 1007338 - protein, 9 aa, Homo Sapiens
GVEDEVILS

SEQ ID NO: 1007339 - protein, 9 aa, Homo Sapiens
FNYNLADET

SEQ ID NO: 1007340 - protein, 9 aa, Homo Sapiens
FSKKFDLIV

SEQ ID NO: 1007341 - protein, 9 aa, Homo Sapiens
SYKSICSMG

SEQ ID NO: 1007342 - protein, 9 aa, Homo Sapiens
VRDRNAEIV

SEQ ID NO: 1007343 - protein, 9 aa, Homo Sapiens
KPQFSQFFH

SEQ ID NO: 1007344 - protein, 9 aa, Homo Sapiens
LKRLQKETG

SEQ ID NO: 1007345 - protein, 9 aa, Homo Sapiens
FGKSKTIQT

SEQ ID NO: 1007346 - protein, 9 aa, Homo Sapiens
DSIFVNGKK

SEQ ID NO: 1007347 - protein, 9 aa, Homo Sapiens
CLSSPGSRP

SEQ ID NO: 1007348 - protein, 9 aa, Homo Sapiens
EIFHSLRLV

SEQ ID NO: 1007349 - protein, 9 aa, Homo Sapiens
ELNSVKYKC

SEQ ID NO: 1007350 - protein, 9 aa, Homo Sapiens
EDFKPRIVS

SEQ ID NO: 1007351 - protein, 9 aa, Homo Sapiens
DFLTKLTEV

SEQ ID NO: 1007352 - protein, 9 aa, Homo Sapiens
QVQELERAL

SEQ ID NO: 1007353 - protein, 9 aa, Homo Sapiens
TGLGHKSDH

SEQ ID NO: 1007354 - protein, 9 aa, Homo Sapiens
NRIAHSPEV

SEQ ID NO: 1007355 - protein, 9 aa, Homo Sapiens
LTSGTSPTQ

SEQ ID NO: 1007356 - protein, 9 aa, Homo Sapiens
EVRKMTLDQ

SEQ ID NO: 1007357 - protein, 9 aa, Homo Sapiens
VRIKLEPES

SEQ ID NO: 1007358 - protein, 9 aa, Homo Sapiens
PQGPPPQGE

SEQ ID NO: 1007359 - protein, 9 aa, Homo Sapiens
GLVKAETPK

SEQ ID NO: 1007360 - protein, 9 aa, Homo Sapiens
AQEPTDWIT

SEQ ID NO: 1007361 - protein, 9 aa, Homo Sapiens
EKENEVEVG

SEQ ID NO: 1007362 - protein, 9 aa, Homo Sapiens
CLAVLILAS

SEQ ID NO: 1007363 - protein, 9 aa, Homo Sapiens
IIHTRKNSY

SEQ ID NO: 1007364 - protein, 9 aa, Homo Sapiens
SLSSLQIPQ

SEQ ID NO: 1007365 - protein, 9 aa, Homo Sapiens
ALPLLENLI

SEQ ID NO: 1007366 - protein, 9 aa, Homo Sapiens
NSRFATFID

SEQ ID NO: 1007367 - protein, 9 aa, Homo Sapiens
LWAEGLPRP

SEQ ID NO: 1007368 - protein, 9 aa, Homo Sapiens
VSHALHEVL

SEQ ID NO: 1007369 - protein, 9 aa, Homo Sapiens
KVEGMNILG

SEQ ID NO: 1007370 - protein, 9 aa, Homo Sapiens
VLSLRSMQS

SEQ ID NO: 1007371 - protein, 9 aa, Homo Sapiens
CGRFLVRED

SEQ ID NO: 1007372 - protein, 9 aa, Homo Sapiens
SISGTKQKI

SEQ ID NO: 1007373 - protein, 9 aa, Homo Sapiens
LKSLIRLGK

SEQ ID NO: 1007374 - protein, 9 aa, Homo Sapiens
GPGFSVCPP

SEQ ID NO: 1007375 - protein, 9 aa, Homo Sapiens
VLGHTLCAS

SEQ ID NO: 1007376 - protein, 9 aa, Homo Sapiens
IPLDSAFNP

SEQ ID NO: 1007377 - protein, 9 aa, Homo Sapiens
HAPHVVSIT

SEQ ID NO: 1007378 - protein, 9 aa, Homo Sapiens
YVSYSESFS

SEQ ID NO: 1007379 - protein, 9 aa, Homo Sapiens
DVDSKKAQL

SEQ ID NO: 1007380 - protein, 9 aa, Homo Sapiens
GADNAISKS

SEQ ID NO: 1007381 - protein, 9 aa, Homo Sapiens
EEVIIEKKK

SEQ ID NO: 1007382 - protein, 9 aa, Homo Sapiens
EQKNLMRIS

SEQ ID NO: 1007383 - protein, 9 aa, Homo Sapiens
CPNGLLTHS

SEQ ID NO: 1007384 - protein, 9 aa, Homo Sapiens
HCRKIFGKD

SEQ ID NO: 1007385 - protein, 9 aa, Homo Sapiens
FDRFRGGQD

SEQ ID NO: 1007386 - protein, 9 aa, Homo Sapiens
LFLGQHGFN

SEQ ID NO: 1007387 - protein, 9 aa, Homo Sapiens
GASGGPTVS

SEQ ID NO: 1007388 - protein, 9 aa, Homo Sapiens
RDKEKLPPG

SEQ ID NO: 1007389 - protein, 9 aa, Homo Sapiens
PSMCEKMKI

SEQ ID NO: 1007390 - protein, 9 aa, Homo Sapiens
SFFAQEFTT

SEQ ID NO: 1007391 - protein, 9 aa, Homo Sapiens
RVNTCSWIR

SEQ ID NO: 1007392 - protein, 9 aa, Homo Sapiens
NMLGHFAHN

SEQ ID NO: 1007393 - protein, 9 aa, Homo Sapiens
IFSALGATF

SEQ ID NO: 1007394 - protein, 9 aa, Homo Sapiens
EEPFIDPQT

SEQ ID NO: 1007395 - protein, 9 aa, Homo Sapiens
INEKTGEIK

SEQ ID NO: 1007396 - protein, 9 aa, Homo Sapiens
NPELLKQKL

SEQ ID NO: 1007397 - protein, 9 aa, Homo Sapiens
CKECGRAFK

SEQ ID NO: 1007398 - protein, 9 aa, Homo Sapiens
YVDVEVRDI

SEQ ID NO: 1007399 - protein, 9 aa, Homo Sapiens
LENLIISDI

SEQ ID NO: 1007400 - protein, 9 aa, Homo Sapiens
AKISSARSL

SEQ ID NO: 1007401 - protein, 9 aa, Homo Sapiens
VNVLKIIRS

SEQ ID NO: 1007402 - protein, 9 aa, Homo Sapiens
FNFAQGGGP

SEQ ID NO: 1007403 - protein, 9 aa, Homo Sapiens
KTDELLKAA

SEQ ID NO: 1007404 - protein, 9 aa, Homo Sapiens
SALGATFSV

SEQ ID NO: 1007405 - protein, 9 aa, Homo Sapiens
PPLVMLLPD

SEQ ID NO: 1007406 - protein, 9 aa, Homo Sapiens
LAMAFDCFV

SEQ ID NO: 1007407 - protein, 9 aa, Homo Sapiens
SPLFLAAKD

SEQ ID NO: 1007408 - protein, 9 aa, Homo Sapiens
LTSSSVQPL

SEQ ID NO: 1007409 - protein, 9 aa, Homo Sapiens
MMIILVVIC

SEQ ID NO: 1007410 - protein, 9 aa, Homo Sapiens
ANQGFLRNH

SEQ ID NO: 1007411 - protein, 9 aa, Homo Sapiens
TPEPETSPS

SEQ ID NO: 1007412 - protein, 9 aa, Homo Sapiens
ANPKKLKGT

SEQ ID NO: 1007413 - protein, 9 aa, Homo Sapiens
EKKEQRGTF

SEQ ID NO: 1007414 - protein, 9 aa, Homo Sapiens
ALLTLCLCL

SEQ ID NO: 1007415 - protein, 9 aa, Homo Sapiens
NKEDFSWSG

SEQ ID NO: 1007416 - protein, 9 aa, Homo Sapiens
QKVLAREAG

SEQ ID NO: 1007417 - protein, 9 aa, Homo Sapiens
TEIGVFLRL

SEQ ID NO: 1007418 - protein, 9 aa, Homo Sapiens
GNKMFVWFV

SEQ ID NO: 1007419 - protein, 9 aa, Homo Sapiens
HQGKIMYVE

SEQ ID NO: 1007420 - protein, 9 aa, Homo Sapiens
YTFTRIYTF

SEQ ID NO: 1007421 - protein, 9 aa, Homo Sapiens
QSGPPYEPR

SEQ ID NO: 1007422 - protein, 9 aa, Homo Sapiens
ATSQYFNFA

SEQ ID NO: 1007423 - protein, 9 aa, Homo Sapiens
LLSNFYLLV

SEQ ID NO: 1007424 - protein, 9 aa, Homo Sapiens
INLCGIDFP

SEQ ID NO: 1007425 - protein, 9 aa, Homo Sapiens
VSLAAKESS

SEQ ID NO: 1007426 - protein, 9 aa, Homo Sapiens
PLSGPSPTQ

SEQ ID NO: 1007427 - protein, 9 aa, Homo Sapiens
RDSSLCSYY

SEQ ID NO: 1007428 - protein, 9 aa, Homo Sapiens
YRQEPVRFE

SEQ ID NO: 1007429 - protein, 9 aa, Homo Sapiens
KGLTAPDAE

SEQ ID NO: 1007430 - protein, 9 aa, Homo Sapiens
DPEIKMLLS

SEQ ID NO: 1007431 - protein, 9 aa, Homo Sapiens
GDDGLISPR

SEQ ID NO: 1007432 - protein, 9 aa, Homo Sapiens
PAKENEHLQ

SEQ ID NO: 1007433 - protein, 9 aa, Homo Sapiens
AAFLLPSRT

SEQ ID NO: 1007434 - protein, 9 aa, Homo Sapiens
YLAMNKEEK

SEQ ID NO: 1007435 - protein, 9 aa, Homo Sapiens
WQLHRTCNP

SEQ ID NO: 1007436 - protein, 9 aa, Homo Sapiens
CEKMKIRII

SEQ ID NO: 1007437 - protein, 9 aa, Homo Sapiens
DVKLILPMP

SEQ ID NO: 1007438 - protein, 9 aa, Homo Sapiens
PSYDKAVKM

SEQ ID NO: 1007439 - protein, 9 aa, Homo Sapiens
ILLLVISGL

SEQ ID NO: 1007440 - protein, 9 aa, Homo Sapiens
AIPDVDSLV

SEQ ID NO: 1007441 - protein, 9 aa, Homo Sapiens
LRDIKNEIA

SEQ ID NO: 1007442 - protein, 9 aa, Homo Sapiens
SVTVSCKAP

SEQ ID NO: 1007443 - protein, 9 aa, Homo Sapiens
PHFFSSLLY

SEQ ID NO: 1007444 - protein, 9 aa, Homo Sapiens
LPAADHKGW

SEQ ID NO: 1007445 - protein, 9 aa, Homo Sapiens
RDRVVEKSE

SEQ ID NO: 1007446 - protein, 9 aa, Homo Sapiens
LIVYEIHPT

SEQ ID NO: 1007447 - protein, 9 aa, Homo Sapiens
TFERCELVK

SEQ ID NO: 1007448 - protein, 9 aa, Homo Sapiens
SRFATFIDK

SEQ ID NO: 1007449 - protein, 9 aa, Homo Sapiens
FIKMFDRWT

SEQ ID NO: 1007450 - protein, 9 aa, Homo Sapiens
LGVCANRLL

SEQ ID NO: 1007451 - protein, 9 aa, Homo Sapiens
DYLLLLALM

SEQ ID NO: 1007452 - protein, 9 aa, Homo Sapiens
NNEIGNPVL

SEQ ID NO: 1007453 - protein, 9 aa, Homo Sapiens
EDDNNDDDV

SEQ ID NO: 1007454 - protein, 9 aa, Homo Sapiens
ASYYHAVET

SEQ ID NO: 1007455 - protein, 9 aa, Homo Sapiens
VPEMPGLKG

SEQ ID NO: 1007456 - protein, 9 aa, Homo Sapiens
DYRSYIRLN

SEQ ID NO: 1007457 - protein, 9 aa, Homo Sapiens
LLDKEDVFP

SEQ ID NO: 1007458 - protein, 9 aa, Homo Sapiens
SGIGKVDSH

SEQ ID NO: 1007459 - protein, 9 aa, Homo Sapiens
AVIDEKEMM

SEQ ID NO: 1007460 - protein, 9 aa, Homo Sapiens
PPRASFAMR

SEQ ID NO: 1007461 - protein, 9 aa, Homo Sapiens
NLQDSAQNS

SEQ ID NO: 1007462 - protein, 9 aa, Homo Sapiens
NMARKIDNF

SEQ ID NO: 1007463 - protein, 9 aa, Homo Sapiens
FFAQEFTTP

SEQ ID NO: 1007464 - protein, 9 aa, Homo Sapiens
DYKNSEAFK

SEQ ID NO: 1007465 - protein, 9 aa, Homo Sapiens
TPVFLTMDT

SEQ ID NO: 1007466 - protein, 9 aa, Homo Sapiens
KKAQLISFL

SEQ ID NO: 1007467 - protein, 9 aa, Homo Sapiens
GHNLLPPRA

SEQ ID NO: 1007468 - protein, 9 aa, Homo Sapiens
EGRPSPLKA

SEQ ID NO: 1007469 - protein, 9 aa, Homo Sapiens
SSYKHNRTE

SEQ ID NO: 1007470 - protein, 9 aa, Homo Sapiens
KGYRKLVKD

SEQ ID NO: 1007471 - protein, 9 aa, Homo Sapiens
TKKKETMTC

SEQ ID NO: 1007472 - protein, 9 aa, Homo Sapiens
DTEEDPLMN

SEQ ID NO: 1007473 - protein, 9 aa, Homo Sapiens
LPKDKEEDL

SEQ ID NO: 1007474 - protein, 9 aa, Homo Sapiens
SLSSWYHDQ

SEQ ID NO: 1007475 - protein, 9 aa, Homo Sapiens
MIEGRMHKE

SEQ ID NO: 1007476 - protein, 9 aa, Homo Sapiens
HLNHLDSAS

SEQ ID NO: 1007477 - protein, 9 aa, Homo Sapiens
ISNHQRLGT

SEQ ID NO: 1007478 - protein, 9 aa, Homo Sapiens
SGIAQALSC

SEQ ID NO: 1007479 - protein, 9 aa, Homo Sapiens
NKISTLSNQ

SEQ ID NO: 1007480 - protein, 9 aa, Homo Sapiens
EAGQICELA

SEQ ID NO: 1007481 - protein, 9 aa, Homo Sapiens
ARFRGTWEK

SEQ ID NO: 1007482 - protein, 9 aa, Homo Sapiens
ILAMAVGFP

SEQ ID NO: 1007483 - protein, 9 aa, Homo Sapiens
PGVLDSKRD

SEQ ID NO: 1007484 - protein, 9 aa, Homo Sapiens
FQPLDYQAT

SEQ ID NO: 1007485 - protein, 9 aa, Homo Sapiens
LGNTPLFLG

SEQ ID NO: 1007486 - protein, 9 aa, Homo Sapiens
IFTPLQTES

SEQ ID NO: 1007487 - protein, 9 aa, Homo Sapiens
WQRKPQQRL

SEQ ID NO: 1007488 - protein, 9 aa, Homo Sapiens
LLDEKQEQM

SEQ ID NO: 1007489 - protein, 9 aa, Homo Sapiens
LNGENLKNE

SEQ ID NO: 1007490 - protein, 9 aa, Homo Sapiens
QSQGFLEGA

SEQ ID NO: 1007491 - protein, 9 aa, Homo Sapiens
KYKCEQGYG

SEQ ID NO: 1007492 - protein, 9 aa, Homo Sapiens
AITTLFLPI

SEQ ID NO: 1007493 - protein, 9 aa, Homo Sapiens
RICTGEKPY

SEQ ID NO: 1007494 - protein, 9 aa, Homo Sapiens
LQTAKIMTP

SEQ ID NO: 1007495 - protein, 9 aa, Homo Sapiens
DIKKCKRGF

SEQ ID NO: 1007496 - protein, 9 aa, Homo Sapiens
CSANEYCVS

SEQ ID NO: 1007497 - protein, 9 aa, Homo Sapiens
MALLADCAH

SEQ ID NO: 1007498 - protein, 9 aa, Homo Sapiens
LFFFFFSGR

SEQ ID NO: 1007499 - protein, 9 aa, Homo Sapiens
SYNRYLAIS

SEQ ID NO: 1007500 - protein, 9 aa, Homo Sapiens
MPTHKNLCS

SEQ ID NO: 1007501 - protein, 9 aa, Homo Sapiens
WTGLQASNI

SEQ ID NO: 1007502 - protein, 9 aa, Homo Sapiens
LPPARPPKP

SEQ ID NO: 1007503 - protein, 9 aa, Homo Sapiens
FLRLSHPNI

SEQ ID NO: 1007504 - protein, 9 aa, Homo Sapiens
VSELWNFPP

SEQ ID NO: 1007505 - protein, 9 aa, Homo Sapiens
DYNYDQDDY

SEQ ID NO: 1007506 - protein, 9 aa, Homo Sapiens
PGQSQGFLE

SEQ ID NO: 1007507 - protein, 9 aa, Homo Sapiens
TPPVVSGEN

SEQ ID NO: 1007508 - protein, 9 aa, Homo Sapiens
LFTLAGLWI

SEQ ID NO: 1007509 - protein, 9 aa, Homo Sapiens
VVNENTFKQ

SEQ ID NO: 1007510 - protein, 9 aa, Homo Sapiens
PSEVPFYYN

SEQ ID NO: 1007511 - protein, 9 aa, Homo Sapiens
KDTQVFQAG

SEQ ID NO: 1007512 - protein, 9 aa, Homo Sapiens
RLFAKLNTF

SEQ ID NO: 1007513 - protein, 9 aa, Homo Sapiens
TTKLFQAGD

SEQ ID NO: 1007514 - protein, 9 aa, Homo Sapiens
QMLGDSQFF

SEQ ID NO: 1007515 - protein, 9 aa, Homo Sapiens
IFLVYQLTY

SEQ ID NO: 1007516 - protein, 9 aa, Homo Sapiens
NPLLREHLS

SEQ ID NO: 1007517 - protein, 9 aa, Homo Sapiens
HLFLFFTGH

SEQ ID NO: 1007518 - protein, 9 aa, Homo Sapiens
LAQAKFSAV

SEQ ID NO: 1007519 - protein, 9 aa, Homo Sapiens
LLENLIISD

SEQ ID NO: 1007520 - protein, 9 aa, Homo Sapiens
EENIQSSSP

SEQ ID NO: 1007521 - protein, 9 aa, Homo Sapiens
AKEILSKGL

SEQ ID NO: 1007522 - protein, 9 aa, Homo Sapiens
SFFPETKAE

SEQ ID NO: 1007523 - protein, 9 aa, Homo Sapiens
DVSSRKEAT

SEQ ID NO: 1007524 - protein, 9 aa, Homo Sapiens
AKRERGITI

SEQ ID NO: 1007525 - protein, 9 aa, Homo Sapiens
AIQAGCLQE

SEQ ID NO: 1007526 - protein, 9 aa, Homo Sapiens
QCLLGQFGF

SEQ ID NO: 1007527 - protein, 9 aa, Homo Sapiens
NSPALEASL

SEQ ID NO: 1007528 - protein, 9 aa, Homo Sapiens
CNKEVRETL

SEQ ID NO: 1007529 - protein, 9 aa, Homo Sapiens
DQMLGDSQF

SEQ ID NO: 1007530 - protein, 9 aa, Homo Sapiens
LASFKTHEI

SEQ ID NO: 1007531 - protein, 9 aa, Homo Sapiens
FWINEKTGE

SEQ ID NO: 1007532 - protein, 9 aa, Homo Sapiens
IQSHPQKLF

SEQ ID NO: 1007533 - protein, 9 aa, Homo Sapiens
KFFAKVVLS

SEQ ID NO: 1007534 - protein, 9 aa, Homo Sapiens
RNSRPFSKN

SEQ ID NO: 1007535 - protein, 9 aa, Homo Sapiens
ALISSENVY

SEQ ID NO: 1007536 - protein, 9 aa, Homo Sapiens
IQSSSPRLT

SEQ ID NO: 1007537 - protein, 9 aa, Homo Sapiens
LETTHTPPV

SEQ ID NO: 1007538 - protein, 9 aa, Homo Sapiens
QVFVKNVDF

SEQ ID NO: 1007539 - protein, 9 aa, Homo Sapiens
LEQQKRQVE

SEQ ID NO: 1007540 - protein, 9 aa, Homo Sapiens
MVQCNKGAY

SEQ ID NO: 1007541 - protein, 9 aa, Homo Sapiens
ITTVVAVGD

SEQ ID NO: 1007542 - protein, 9 aa, Homo Sapiens
WSHVGHTGV

SEQ ID NO: 1007543 - protein, 9 aa, Homo Sapiens
WCTQIFLFS

SEQ ID NO: 1007544 - protein, 9 aa, Homo Sapiens
LFIIEVVNI

SEQ ID NO: 1007545 - protein, 9 aa, Homo Sapiens
EMIEGRMHK

SEQ ID NO: 1007546 - protein, 9 aa, Homo Sapiens
TIPLLAVTP

SEQ ID NO: 1007547 - protein, 9 aa, Homo Sapiens
YRTKKDNAA

SEQ ID NO: 1007548 - protein, 9 aa, Homo Sapiens
GTDKFFTYD

SEQ ID NO: 1007549 - protein, 9 aa, Homo Sapiens
EKSPLRKEA

SEQ ID NO: 1007550 - protein, 9 aa, Homo Sapiens
MYPCAFLCT

SEQ ID NO: 1007551 - protein, 9 aa, Homo Sapiens
LRYLKNNGK

SEQ ID NO: 1007552 - protein, 9 aa, Homo Sapiens
GNRGVPEMP

SEQ ID NO: 1007553 - protein, 9 aa, Homo Sapiens
GSMHHLFLF

SEQ ID NO: 1007554 - protein, 9 aa, Homo Sapiens
KFIPFSRIT

SEQ ID NO: 1007555 - protein, 9 aa, Homo Sapiens
IASQANLWL

SEQ ID NO: 1007556 - protein, 9 aa, Homo Sapiens
IVRTEIGVF

SEQ ID NO: 1007557 - protein, 9 aa, Homo Sapiens
LFYTVGEKV

SEQ ID NO: 1007558 - protein, 9 aa, Homo Sapiens
EPHELPLTD

SEQ ID NO: 1007559 - protein, 9 aa, Homo Sapiens
RFLGVTQFL

SEQ ID NO: 1007560 - protein, 9 aa, Homo Sapiens
VDSSPNRFA

SEQ ID NO: 1007561 - protein, 9 aa, Homo Sapiens
GQKKVPGDS

SEQ ID NO: 1007562 - protein, 9 aa, Homo Sapiens
VAMSVAKRV

SEQ ID NO: 1007563 - protein, 9 aa, Homo Sapiens
PLVMLLPDD

SEQ ID NO: 1007564 - protein, 9 aa, Homo Sapiens
AANLVGADL

SEQ ID NO: 1007565 - protein, 9 aa, Homo Sapiens
PVTLAFRPD

SEQ ID NO: 1007566 - protein, 9 aa, Homo Sapiens
LHRTCNPGA

SEQ ID NO: 1007567 - protein, 9 aa, Homo Sapiens
HKKTIKNKA

SEQ ID NO: 1007568 - protein, 9 aa, Homo Sapiens
RNSSVRIKL

SEQ ID NO: 1007569 - protein, 9 aa, Homo Sapiens
LVVICAIIL

SEQ ID NO: 1007570 - protein, 9 aa, Homo Sapiens
RYLKNNGKV

SEQ ID NO: 1007571 - protein, 9 aa, Homo Sapiens
QQESLKKEQ

SEQ ID NO: 1007572 - protein, 9 aa, Homo Sapiens
NRELRGRLH

SEQ ID NO: 1007573 - protein, 9 aa, Homo Sapiens
SQRIEGAKE

SEQ ID NO: 1007574 - protein, 9 aa, Homo Sapiens
GLSVLLKNL

SEQ ID NO: 1007575 - protein, 9 aa, Homo Sapiens
FQQALQNKQ

SEQ ID NO: 1007576 - protein, 9 aa, Homo Sapiens
QLTYCGRNI

SEQ ID NO: 1007577 - protein, 9 aa, Homo Sapiens
HKSDHYNCV

SEQ ID NO: 1007578 - protein, 9 aa, Homo Sapiens
ISGPAFCQM

SEQ ID NO: 1007579 - protein, 9 aa, Homo Sapiens
ESYESQVLE

SEQ ID NO: 1007580 - protein, 9 aa, Homo Sapiens
VSSLPLQLA

SEQ ID NO: 1007581 - protein, 9 aa, Homo Sapiens
CTPRVCSFA

SEQ ID NO: 1007582 - protein, 9 aa, Homo Sapiens
KMEKSPLRK

SEQ ID NO: 1007583 - protein, 9 aa, Homo Sapiens
VMGRCHYSR

SEQ ID NO: 1007584 - protein, 9 aa, Homo Sapiens
SVYNFDRFS

SEQ ID NO: 1007585 - protein, 9 aa, Homo Sapiens
KDHKDSSLQ

SEQ ID NO: 1007586 - protein, 9 aa, Homo Sapiens
LLTTKLFQA

SEQ ID NO: 1007587 - protein, 9 aa, Homo Sapiens
VVNPELFRK

SEQ ID NO: 1007588 - protein, 9 aa, Homo Sapiens
KDDLPWDDN

SEQ ID NO: 1007589 - protein, 9 aa, Homo Sapiens
HSSATEFYL

SEQ ID NO: 1007590 - protein, 9 aa, Homo Sapiens
FSPPRTALS

SEQ ID NO: 1007591 - protein, 9 aa, Homo Sapiens
MFFSANPKK

SEQ ID NO: 1007592 - protein, 9 aa, Homo Sapiens
NLRRTAYLV

SEQ ID NO: 1007593 - protein, 9 aa, Homo Sapiens
ITASLQFDG

SEQ ID NO: 1007594 - protein, 9 aa, Homo Sapiens
AIPLTLGMK

SEQ ID NO: 1007595 - protein, 9 aa, Homo Sapiens
RQVETIRSL

SEQ ID NO: 1007596 - protein, 9 aa, Homo Sapiens
QVFYVDVEV

SEQ ID NO: 1007597 - protein, 9 aa, Homo Sapiens
SLGQLSQDG

SEQ ID NO: 1007598 - protein, 9 aa, Homo Sapiens
DTAWAVPPG

SEQ ID NO: 1007599 - protein, 9 aa, Homo Sapiens
KCQVKDHKD

SEQ ID NO: 1007600 - protein, 9 aa, Homo Sapiens
GDPGFGGKK

SEQ ID NO: 1007601 - protein, 9 aa, Homo Sapiens
SEDSAANGT

SEQ ID NO: 1007602 - protein, 9 aa, Homo Sapiens
KGQKKVPGD

SEQ ID NO: 1007603 - protein, 9 aa, Homo Sapiens
NLKKASVIP

SEQ ID NO: 1007604 - protein, 9 aa, Homo Sapiens
VLFFVESQY

SEQ ID NO: 1007605 - protein, 9 aa, Homo Sapiens
ALRALSNIF

SEQ ID NO: 1007606 - protein, 9 aa, Homo Sapiens
WPGVLDSKR

SEQ ID NO: 1007607 - protein, 9 aa, Homo Sapiens
GFPSKLFII

SEQ ID NO: 1007608 - protein, 9 aa, Homo Sapiens
FLTKLTEVL

SEQ ID NO: 1007609 - protein, 9 aa, Homo Sapiens
SVRIKLEPE

SEQ ID NO: 1007610 - protein, 9 aa, Homo Sapiens
PSETQPFSS

SEQ ID NO: 1007611 - protein, 9 aa, Homo Sapiens
SRPSEVPFY

SEQ ID NO: 1007612 - protein, 9 aa, Homo Sapiens
FLAAKDNDV

SEQ ID NO: 1007613 - protein, 9 aa, Homo Sapiens
LNKKYESYL

SEQ ID NO: 1007614 - protein, 9 aa, Homo Sapiens
IVGIGVFIL

SEQ ID NO: 1007615 - protein, 9 aa, Homo Sapiens
LYECGQCGK

SEQ ID NO: 1007616 - protein, 9 aa, Homo Sapiens
LKIIRSATP

SEQ ID NO: 1007617 - protein, 9 aa, Homo Sapiens
VILENFIVA

SEQ ID NO: 1007618 - protein, 9 aa, Homo Sapiens
LVDNQNERD

SEQ ID NO: 1007619 - protein, 9 aa, Homo Sapiens
GLPRPPRNV

SEQ ID NO: 1007620 - protein, 9 aa, Homo Sapiens
IQYETLSEK

SEQ ID NO: 1007621 - protein, 9 aa, Homo Sapiens
SYSESFSQV

SEQ ID NO: 1007622 - protein, 9 aa, Homo Sapiens
LQQYNSPGL

SEQ ID NO: 1007623 - protein, 9 aa, Homo Sapiens
FIAVTEVQK

SEQ ID NO: 1007624 - protein, 9 aa, Homo Sapiens
DVFFWQTWH

SEQ ID NO: 1007625 - protein, 9 aa, Homo Sapiens
NNFSQRKQI

SEQ ID NO: 1007626 - protein, 9 aa, Homo Sapiens
QHQIIHTRK

SEQ ID NO: 1007627 - protein, 9 aa, Homo Sapiens
MTNNDIKRI

SEQ ID NO: 1007628 - protein, 9 aa, Homo Sapiens
APGKLDISG

SEQ ID NO: 1007629 - protein, 9 aa, Homo Sapiens
VGTDKFFTY

SEQ ID NO: 1007630 - protein, 9 aa, Homo Sapiens
LSNIFLRLF

SEQ ID NO: 1007631 - protein, 9 aa, Homo Sapiens
GFKDWQCQA

SEQ ID NO: 1007632 - protein, 9 aa, Homo Sapiens
IVPLTMDTE

SEQ ID NO: 1007633 - protein, 9 aa, Homo Sapiens
SVFWKKENR

SEQ ID NO: 1007634 - protein, 9 aa, Homo Sapiens
GKHAPHVVS

SEQ ID NO: 1007635 - protein, 9 aa, Homo Sapiens
IIGGHDSLS

SEQ ID NO: 1007636 - protein, 9 aa, Homo Sapiens
AVCWASYSL

SEQ ID NO: 1007637 - protein, 9 aa, Homo Sapiens
PLPETTMHP

SEQ ID NO: 1007638 - protein, 9 aa, Homo Sapiens
LPPRAGVRE

SEQ ID NO: 1007639 - protein, 9 aa, Homo Sapiens
LVLPPNKKE

SEQ ID NO: 1007640 - protein, 9 aa, Homo Sapiens
HSAQLKHKR

SEQ ID NO: 1007641 - protein, 9 aa, Homo Sapiens
GNCANKKDT

SEQ ID NO: 1007642 - protein, 9 aa, Homo Sapiens
MYYLRSTIG

SEQ ID NO: 1007643 - protein, 9 aa, Homo Sapiens
TPLSGPSPT

SEQ ID NO: 1007644 - protein, 9 aa, Homo Sapiens
PLANQGFLR

SEQ ID NO: 1007645 - protein, 9 aa, Homo Sapiens
LITAILAMA

SEQ ID NO: 1007646 - protein, 9 aa, Homo Sapiens
ICKGKSKEC

SEQ ID NO: 1007647 - protein, 9 aa, Homo Sapiens
LWRYSEPRV

SEQ ID NO: 1007648 - protein, 9 aa, Homo Sapiens
KYVISAIPL

SEQ ID NO: 1007649 - protein, 9 aa, Homo Sapiens
CLQEEDSVS

SEQ ID NO: 1007650 - protein, 9 aa, Homo Sapiens
NGGPLTSGT

SEQ ID NO: 1007651 - protein, 9 aa, Homo Sapiens
TALTALEEA

SEQ ID NO: 1007652 - protein, 9 aa, Homo Sapiens
WGCRRNPAC

SEQ ID NO: 1007653 - protein, 9 aa, Homo Sapiens
VIHEIKFSP

SEQ ID NO: 1007654 - protein, 9 aa, Homo Sapiens
NIRPSTSTG

SEQ ID NO: 1007655 - protein, 9 aa, Homo Sapiens
SPGSPGSFD

SEQ ID NO: 1007656 - protein, 9 aa, Homo Sapiens
YRDVMLKNY

SEQ ID NO: 1007657 - protein, 9 aa, Homo Sapiens
CLCYDPEIK

SEQ ID NO: 1007658 - protein, 9 aa, Homo Sapiens
EMAEERAEF

SEQ ID NO: 1007659 - protein, 9 aa, Homo Sapiens
KWALDSIYI

SEQ ID NO: 1007660 - protein, 9 aa, Homo Sapiens
KGRVLRNFF

SEQ ID NO: 1007661 - protein, 9 aa, Homo Sapiens
VDMKPIHMD

SEQ ID NO: 1007662 - protein, 9 aa, Homo Sapiens
IETGFCVSG

SEQ ID NO: 1007663 - protein, 9 aa, Homo Sapiens
ANKKDTWKF

SEQ ID NO: 1007664 - protein, 9 aa, Homo Sapiens
LKQRPYGSH

SEQ ID NO: 1007665 - protein, 9 aa, Homo Sapiens
LNKLTTFLL

SEQ ID NO: 1007666 - protein, 9 aa, Homo Sapiens
FGADNAISK

SEQ ID NO: 1007667 - protein, 9 aa, Homo Sapiens
PECSWGQGA

SEQ ID NO: 1007668 - protein, 9 aa, Homo Sapiens
QAQHRIKEI

SEQ ID NO: 1007669 - protein, 9 aa, Homo Sapiens
TQGYLYTAK

SEQ ID NO: 1007670 - protein, 9 aa, Homo Sapiens
SWYHDQGWA

SEQ ID NO: 1007671 - protein, 9 aa, Homo Sapiens
CPSRVPVQV

SEQ ID NO: 1007672 - protein, 9 aa, Homo Sapiens
VQNTFIPLG

SEQ ID NO: 1007673 - protein, 9 aa, Homo Sapiens
HNRTELTLR

SEQ ID NO: 1007674 - protein, 9 aa, Homo Sapiens
LNQETSTFY

SEQ ID NO: 1007675 - protein, 9 aa, Homo Sapiens
YDLMEVEFM

SEQ ID NO: 1007676 - protein, 9 aa, Homo Sapiens
KGPLPCPSP

SEQ ID NO: 1007677 - protein, 9 aa, Homo Sapiens
SLSPGHAVC

SEQ ID NO: 1007678 - protein, 9 aa, Homo Sapiens
TVTFVRSIE

SEQ ID NO: 1007679 - protein, 9 aa, Homo Sapiens
GRTCTDTCL

SEQ ID NO: 1007680 - protein, 9 aa, Homo Sapiens
LNNIINLCQ

SEQ ID NO: 1007681 - protein, 9 aa, Homo Sapiens
ERAGDQPLK

SEQ ID NO: 1007682 - protein, 9 aa, Homo Sapiens
KDNKYVSYS

SEQ ID NO: 1007683 - protein, 9 aa, Homo Sapiens
KLDISGPAF

SEQ ID NO: 1007684 - protein, 9 aa, Homo Sapiens
VYQLTYCGR

SEQ ID NO: 1007685 - protein, 9 aa, Homo Sapiens
ASNIMWTIS

SEQ ID NO: 1007686 - protein, 9 aa, Homo Sapiens
GSSGVCGHK

SEQ ID NO: 1007687 - protein, 9 aa, Homo Sapiens
PPSRSRGRP

SEQ ID NO: 1007688 - protein, 9 aa, Homo Sapiens
TLAFRPDVP

SEQ ID NO: 1007689 - protein, 9 aa, Homo Sapiens
MHKEKVDLW

SEQ ID NO: 1007690 - protein, 9 aa, Homo Sapiens
GFLEGASRD

SEQ ID NO: 1007691 - protein, 9 aa, Homo Sapiens
FATFIDKVR

SEQ ID NO: 1007692 - protein, 9 aa, Homo Sapiens
DGFVDLLNG

SEQ ID NO: 1007693 - protein, 9 aa, Homo Sapiens
GSRGFFCKA

SEQ ID NO: 1007694 - protein, 9 aa, Homo Sapiens
LFSKKFDLI

SEQ ID NO: 1007695 - protein, 9 aa, Homo Sapiens
GPAGQDGAP

SEQ ID NO: 1007696 - protein, 9 aa, Homo Sapiens
LGKHWYQQC

SEQ ID NO: 1007697 - protein, 9 aa, Homo Sapiens
PEIKMLLSG

SEQ ID NO: 1007698 - protein, 9 aa, Homo Sapiens
MLWRYSEPR

SEQ ID NO: 1007699 - protein, 9 aa, Homo Sapiens
RIYVKMRNN

SEQ ID NO: 1007700 - protein, 9 aa, Homo Sapiens
VWFVSDASV

SEQ ID NO: 1007701 - protein, 9 aa, Homo Sapiens
PNIYFLFFF

SEQ ID NO: 1007702 - protein, 9 aa, Homo Sapiens
LENVSYIKQ

SEQ ID NO: 1007703 - protein, 9 aa, Homo Sapiens
LIPASFPVK

SEQ ID NO: 1007704 - protein, 9 aa, Homo Sapiens
RTQGIFSLD

SEQ ID NO: 1007705 - protein, 9 aa, Homo Sapiens
YYYGLLGNR

SEQ ID NO: 1007706 - protein, 9 aa, Homo Sapiens
DQMTFGEKI

SEQ ID NO: 1007707 - protein, 9 aa, Homo Sapiens
FLRLFYEDG

SEQ ID NO: 1007708 - protein, 9 aa, Homo Sapiens
VHPGLTVAS

SEQ ID NO: 1007709 - protein, 9 aa, Homo Sapiens
LLLVISGLV

SEQ ID NO: 1007710 - protein, 9 aa, Homo Sapiens
DPIERDFIG

SEQ ID NO: 1007711 - protein, 9 aa, Homo Sapiens
ADMNGAPSS

SEQ ID NO: 1007712 - protein, 9 aa, Homo Sapiens
NFEIDPKKG

SEQ ID NO: 1007713 - protein, 9 aa, Homo Sapiens
ISSARSLDE

SEQ ID NO: 1007714 - protein, 9 aa, Homo Sapiens
SGMMILLEV

SEQ ID NO: 1007715 - protein, 9 aa, Homo Sapiens
PENPPATTF

SEQ ID NO: 1007716 - protein, 9 aa, Homo Sapiens
IELMFQNSL

SEQ ID NO: 1007717 - protein, 9 aa, Homo Sapiens
KDVKLILPM

SEQ ID NO: 1007718 - protein, 9 aa, Homo Sapiens
RACYRDMSF

SEQ ID NO: 1007719 - protein, 9 aa, Homo Sapiens
PQFDGPLSP

SEQ ID NO: 1007720 - protein, 9 aa, Homo Sapiens
FQEEFLELP

SEQ ID NO: 1007721 - protein, 9 aa, Homo Sapiens
IDKLKQRPY

SEQ ID NO: 1007722 - protein, 9 aa, Homo Sapiens
SDPGFAGNW

SEQ ID NO: 1007723 - protein, 9 aa, Homo Sapiens
YERGMESPK

SEQ ID NO: 1007724 - protein, 9 aa, Homo Sapiens
KHSMQNRIA

SEQ ID NO: 1007725 - protein, 9 aa, Homo Sapiens
ALAQPVCGF

SEQ ID NO: 1007726 - protein, 9 aa, Homo Sapiens
MGGIIIVLL

SEQ ID NO: 1007727 - protein, 9 aa, Homo Sapiens
LLSLSSSVH

SEQ ID NO: 1007728 - protein, 9 aa, Homo Sapiens
ASILVLNGG

SEQ ID NO: 1007729 - protein, 9 aa, Homo Sapiens
FVSADLNGQ

SEQ ID NO: 1007730 - protein, 9 aa, Homo Sapiens
HRDSSQAIL

SEQ ID NO: 1007731 - protein, 9 aa, Homo Sapiens
GDGAPALSG

SEQ ID NO: 1007732 - protein, 9 aa, Homo Sapiens
ISKSETTIT

SEQ ID NO: 1007733 - protein, 9 aa, Homo Sapiens
KDSRLSTAR

SEQ ID NO: 1007734 - protein, 9 aa, Homo Sapiens
MCEKMKIRI

SEQ ID NO: 1007735 - protein, 9 aa, Homo Sapiens
ERKKQTRNA

SEQ ID NO: 1007736 - protein, 9 aa, Homo Sapiens
TQGLSNVYK

SEQ ID NO: 1007737 - protein, 9 aa, Homo Sapiens
ICGIQHLEQ

SEQ ID NO: 1007738 - protein, 9 aa, Homo Sapiens
FFSSLLYSL

SEQ ID NO: 1007739 - protein, 9 aa, Homo Sapiens
STSSINSSP

SEQ ID NO: 1007740 - protein, 9 aa, Homo Sapiens
QKDNQPYYS

SEQ ID NO: 1007741 - protein, 9 aa, Homo Sapiens
NPDVGENSL

SEQ ID NO: 1007742 - protein, 9 aa, Homo Sapiens
SKKAQLISF

SEQ ID NO: 1007743 - protein, 9 aa, Homo Sapiens
NQTILKKFI

SEQ ID NO: 1007744 - protein, 9 aa, Homo Sapiens
RQNVATVLL

SEQ ID NO: 1007745 - protein, 9 aa, Homo Sapiens
AHHEPGVLG

SEQ ID NO: 1007746 - protein, 9 aa, Homo Sapiens
PTSTSQLSL

SEQ ID NO: 1007747 - protein, 9 aa, Homo Sapiens
ECSWGQGAC

SEQ ID NO: 1007748 - protein, 9 aa, Homo Sapiens
LDQPKVEGL

SEQ ID NO: 1007749 - protein, 9 aa, Homo Sapiens
DKLKQRPYG

SEQ ID NO: 1007750 - protein, 9 aa, Homo Sapiens
SAANGTPKH

SEQ ID NO: 1007751 - protein, 9 aa, Homo Sapiens
DPYVKISDC

SEQ ID NO: 1007752 - protein, 9 aa, Homo Sapiens
DTWVYEYIV

SEQ ID NO: 1007753 - protein, 9 aa, Homo Sapiens
CQTTVCRLV

SEQ ID NO: 1007754 - protein, 9 aa, Homo Sapiens
SGLVTSAAI

SEQ ID NO: 1007755 - protein, 9 aa, Homo Sapiens
LTYPLGLRN

SEQ ID NO: 1007756 - protein, 9 aa, Homo Sapiens
VSNLHVKPC

SEQ ID NO: 1007757 - protein, 9 aa, Homo Sapiens
DSESRGGKD

SEQ ID NO: 1007758 - protein, 9 aa, Homo Sapiens
ENSRCLLNE

SEQ ID NO: 1007759 - protein, 9 aa, Homo Sapiens
CSFAGILEN

SEQ ID NO: 1007760 - protein, 9 aa, Homo Sapiens
VGGFLSVQC

SEQ ID NO: 1007761 - protein, 9 aa, Homo Sapiens
GCPFRHSNP

SEQ ID NO: 1007762 - protein, 9 aa, Homo Sapiens
DHLGASLWL

SEQ ID NO: 1007763 - protein, 9 aa, Homo Sapiens
CHKFQAFMK

SEQ ID NO: 1007764 - protein, 9 aa, Homo Sapiens
PDIAFLGER

SEQ ID NO: 1007765 - protein, 9 aa, Homo Sapiens
NVKNLQLDN

SEQ ID NO: 1007766 - protein, 9 aa, Homo Sapiens
EPRGTQALR

SEQ ID NO: 1007767 - protein, 9 aa, Homo Sapiens
HREWVHSNF

SEQ ID NO: 1007768 - protein, 9 aa, Homo Sapiens
KEAIEVFMK

SEQ ID NO: 1007769 - protein, 9 aa, Homo Sapiens
SREQERTES

SEQ ID NO: 1007770 - protein, 9 aa, Homo Sapiens
DQKICAQYW

SEQ ID NO: 1007771 - protein, 9 aa, Homo Sapiens
STDEAAIEN

SEQ ID NO: 1007772 - protein, 9 aa, Homo Sapiens
NVLDDDYFE

SEQ ID NO: 1007773 - protein, 9 aa, Homo Sapiens
RYFEHYQSI

SEQ ID NO: 1007774 - protein, 9 aa, Homo Sapiens
NGLRNPVAI

SEQ ID NO: 1007775 - protein, 9 aa, Homo Sapiens
RNNAREEGR

SEQ ID NO: 1007776 - protein, 9 aa, Homo Sapiens
TLPVDISTP

SEQ ID NO: 1007777 - protein, 9 aa, Homo Sapiens
IFLAGCGAQ

SEQ ID NO: 1007778 - protein, 9 aa, Homo Sapiens
SDTDHDLIK

SEQ ID NO: 1007779 - protein, 9 aa, Homo Sapiens
SGMDLTPRS

SEQ ID NO: 1007780 - protein, 9 aa, Homo Sapiens
IKSQTEGSI

SEQ ID NO: 1007781 - protein, 9 aa, Homo Sapiens
MSFFPETKA

SEQ ID NO: 1007782 - protein, 9 aa, Homo Sapiens
EEQTAKEIL

SEQ ID NO: 1007783 - protein, 9 aa, Homo Sapiens
SSCSFLVEE

SEQ ID NO: 1007784 - protein, 9 aa, Homo Sapiens
RIHTGARLY

SEQ ID NO: 1007785 - protein, 9 aa, Homo Sapiens
VNGSKQGSL

SEQ ID NO: 1007786 - protein, 9 aa, Homo Sapiens
CYRDMSFFP

SEQ ID NO: 1007787 - protein, 9 aa, Homo Sapiens
TKLFQAGDV

SEQ ID NO: 1007788 - protein, 9 aa, Homo Sapiens
YFGRLASCG

SEQ ID NO: 1007789 - protein, 9 aa, Homo Sapiens
GVKWPQSNS

SEQ ID NO: 1007790 - protein, 9 aa, Homo Sapiens
TGVILLSGN

SEQ ID NO: 1007791 - protein, 9 aa, Homo Sapiens
AARPPATLP

SEQ ID NO: 1007792 - protein, 9 aa, Homo Sapiens
HLEESGLCW

SEQ ID NO: 1007793 - protein, 9 aa, Homo Sapiens
VSGSRGFFC

SEQ ID NO: 1007794 - protein, 9 aa, Homo Sapiens
FPYPENNGQ

SEQ ID NO: 1007795 - protein, 9 aa, Homo Sapiens
IKKQLQAGF

SEQ ID NO: 1007796 - protein, 9 aa, Homo Sapiens
VVEQWKTNK

SEQ ID NO: 1007797 - protein, 9 aa, Homo Sapiens
FRTLLTVIS

SEQ ID NO: 1007798 - protein, 9 aa, Homo Sapiens
IFLYICMSE

SEQ ID NO: 1007799 - protein, 9 aa, Homo Sapiens
NYNLADETE

SEQ ID NO: 1007800 - protein, 9 aa, Homo Sapiens
NFVLNSAIL

SEQ ID NO: 1007801 - protein, 9 aa, Homo Sapiens
PVVSGENLK

SEQ ID NO: 1007802 - protein, 9 aa, Homo Sapiens
EKKYAASKF

SEQ ID NO: 1007803 - protein, 9 aa, Homo Sapiens
AELYFLLQE

SEQ ID NO: 1007804 - protein, 9 aa, Homo Sapiens
REHYDFLTK

SEQ ID NO: 1007805 - protein, 9 aa, Homo Sapiens
GCGAKATPG

SEQ ID NO: 1007806 - protein, 9 aa, Homo Sapiens
DPKKGKITG

SEQ ID NO: 1007807 - protein, 9 aa, Homo Sapiens
FILLVRYRK

SEQ ID NO: 1007808 - protein, 9 aa, Homo Sapiens
TFCVIVCNE

SEQ ID NO: 1007809 - protein, 9 aa, Homo Sapiens
TGSLEGFSP

SEQ ID NO: 1007810 - protein, 9 aa, Homo Sapiens
SLNRVRIEA

SEQ ID NO: 1007811 - protein, 9 aa, Homo Sapiens
EDEVILSAY

SEQ ID NO: 1007812 - protein, 9 aa, Homo Sapiens
VLFPESLSC

SEQ ID NO: 1007813 - protein, 9 aa, Homo Sapiens
WNKDKMQSP

SEQ ID NO: 1007814 - protein, 9 aa, Homo Sapiens
SFRNKIDLQ

SEQ ID NO: 1007815 - protein, 9 aa, Homo Sapiens
CSGIGKVDS

SEQ ID NO: 1007816 - protein, 9 aa, Homo Sapiens
SKVNGGRYE

SEQ ID NO: 1007817 - protein, 9 aa, Homo Sapiens
SRIHLVSEA

SEQ ID NO: 1007818 - protein, 9 aa, Homo Sapiens
MGKETFKNF

SEQ ID NO: 1007819 - protein, 9 aa, Homo Sapiens
KGFGFVIMT

SEQ ID NO: 1007820 - protein, 9 aa, Homo Sapiens
EFLELPKFL

SEQ ID NO: 1007821 - protein, 9 aa, Homo Sapiens
WISNNLSVV

SEQ ID NO: 1007822 - protein, 9 aa, Homo Sapiens
EQGKISEGL

SEQ ID NO: 1007823 - protein, 9 aa, Homo Sapiens
PEESSNCEN

SEQ ID NO: 1007824 - protein, 9 aa, Homo Sapiens
IEDMISTLK

SEQ ID NO: 1007825 - protein, 9 aa, Homo Sapiens
WLAPLAEEK

SEQ ID NO: 1007826 - protein, 9 aa, Homo Sapiens
SFVLLLALT

SEQ ID NO: 1007827 - protein, 9 aa, Homo Sapiens
KSICSMGCD

SEQ ID NO: 1007828 - protein, 9 aa, Homo Sapiens
QLEQQKRQV

SEQ ID NO: 1007829 - protein, 9 aa, Homo Sapiens
FCLGWELKE

SEQ ID NO: 1007830 - protein, 9 aa, Homo Sapiens
EIKKQLQAG

SEQ ID NO: 1007831 - protein, 9 aa, Homo Sapiens
KKYECVKEH

SEQ ID NO: 1007832 - protein, 9 aa, Homo Sapiens
ECGTAFNRS

SEQ ID NO: 1007833 - protein, 9 aa, Homo Sapiens
GLQASNIMW

SEQ ID NO: 1007834 - protein, 9 aa, Homo Sapiens
DCSDSEKSF

SEQ ID NO: 1007835 - protein, 9 aa, Homo Sapiens
NPVAIVHAR

SEQ ID NO: 1007836 - protein, 9 aa, Homo Sapiens
LDYQATSLP

SEQ ID NO: 1007837 - protein, 9 aa, Homo Sapiens
NGLLLKEEH

SEQ ID NO: 1007838 - protein, 9 aa, Homo Sapiens
SALEILNKH

SEQ ID NO: 1007839 - protein, 9 aa, Homo Sapiens
KGFEPGVTS

SEQ ID NO: 1007840 - protein, 9 aa, Homo Sapiens
VELGYRRTG

SEQ ID NO: 1007841 - protein, 9 aa, Homo Sapiens
QNQLTERDK

SEQ ID NO: 1007842 - protein, 9 aa, Homo Sapiens
CQSSASPKA

SEQ ID NO: 1007843 - protein, 9 aa, Homo Sapiens
DLRAEERRL

SEQ ID NO: 1007844 - protein, 9 aa, Homo Sapiens
LRNLLYRLA

SEQ ID NO: 1007845 - protein, 9 aa, Homo Sapiens
TFVDMKPIH

SEQ ID NO: 1007846 - protein, 9 aa, Homo Sapiens
SASSGDTTP

SEQ ID NO: 1007847 - protein, 9 aa, Homo Sapiens
GIVPLTMDT

SEQ ID NO: 1007848 - protein, 9 aa, Homo Sapiens
NLCGIDFPI

SEQ ID NO: 1007849 - protein, 9 aa, Homo Sapiens
TDPWHLNHL

SEQ ID NO: 1007850 - protein, 9 aa, Homo Sapiens
EDEAHPVLL

SEQ ID NO: 1007851 - protein, 9 aa, Homo Sapiens
KVEIFHSLR

SEQ ID NO: 1007852 - protein, 9 aa, Homo Sapiens
KRERGITID

SEQ ID NO: 1007853 - protein, 9 aa, Homo Sapiens
LPLTDRYGR

SEQ ID NO: 1007854 - protein, 9 aa, Homo Sapiens
EKDDVEFSG

SEQ ID NO: 1007855 - protein, 9 aa, Homo Sapiens
KQAVSELWN

SEQ ID NO: 1007856 - protein, 9 aa, Homo Sapiens
KWARSLTLF

SEQ ID NO: 1007857 - protein, 9 aa, Homo Sapiens
LAGPAKENE

SEQ ID NO: 1007858 - protein, 9 aa, Homo Sapiens
LPSDKEGES

SEQ ID NO: 1007859 - protein, 9 aa, Homo Sapiens
TLETPCENE

SEQ ID NO: 1007860 - protein, 9 aa, Homo Sapiens
FARVLYTHS

SEQ ID NO: 1007861 - protein, 9 aa, Homo Sapiens
ELCEVDEDK

SEQ ID NO: 1007862 - protein, 9 aa, Homo Sapiens
KSKSKKVES

SEQ ID NO: 1007863 - protein, 9 aa, Homo Sapiens
RPLSGSQLS

SEQ ID NO: 1007864 - protein, 9 aa, Homo Sapiens
VSFSAARSR

SEQ ID NO: 1007865 - protein, 9 aa, Homo Sapiens
PVLVSERIC

SEQ ID NO: 1007866 - protein, 9 aa, Homo Sapiens
VAFLDGVVE

SEQ ID NO: 1007867 - protein, 9 aa, Homo Sapiens
SPQFDGPLS

SEQ ID NO: 1007868 - protein, 9 aa, Homo Sapiens
WQGYHSMPH

SEQ ID NO: 1007869 - protein, 9 aa, Homo Sapiens
LESRTLLSY

SEQ ID NO: 1007870 - protein, 9 aa, Homo Sapiens
NQKGSCFIQ

SEQ ID NO: 1007871 - protein, 9 aa, Homo Sapiens
EPVRFENIG

SEQ ID NO: 1007872 - protein, 9 aa, Homo Sapiens
LTTDNASIL

SEQ ID NO: 1007873 - protein, 9 aa, Homo Sapiens
LTEESIPVT

SEQ ID NO: 1007874 - protein, 9 aa, Homo Sapiens
QIFSSSYYS

SEQ ID NO: 1007875 - protein, 9 aa, Homo Sapiens
RQGCGAKAT

SEQ ID NO: 1007876 - protein, 9 aa, Homo Sapiens
CVDVDIEFR

SEQ ID NO: 1007877 - protein, 9 aa, Homo Sapiens
SGMGSLEKE

SEQ ID NO: 1007878 - protein, 9 aa, Homo Sapiens
RVVVIKAGK

SEQ ID NO: 1007879 - protein, 9 aa, Homo Sapiens
MKPGPRRQS

SEQ ID NO: 1007880 - protein, 9 aa, Homo Sapiens
DLSNNKIST

SEQ ID NO: 1007881 - protein, 9 aa, Homo Sapiens
LKGNCANKK

SEQ ID NO: 1007882 - protein, 9 aa, Homo Sapiens
LFFFYGIVV

SEQ ID NO: 1007883 - protein, 9 aa, Homo Sapiens
CILLLVISG

SEQ ID NO: 1007884 - protein, 9 aa, Homo Sapiens
PENSLYLFA

SEQ ID NO: 1007885 - protein, 9 aa, Homo Sapiens
YNFDRFSRH

SEQ ID NO: 1007886 - protein, 9 aa, Homo Sapiens
PVGDLVALG

SEQ ID NO: 1007887 - protein, 9 aa, Homo Sapiens
LVIVGIGVF

SEQ ID NO: 1007888 - protein, 9 aa, Homo Sapiens
LDSKRDRLI

SEQ ID NO: 1007889 - protein, 8 aa, Homo Sapiens
EPFVVLVL

SEQ ID NO: 1007890 - protein, 9 aa, Homo Sapiens
NGTPKHSFR

SEQ ID NO: 1007891 - protein, 9 aa, Homo Sapiens
LRDPGQGTV

SEQ ID NO: 1007892 - protein, 9 aa, Homo Sapiens
HWRICTGEK

SEQ ID NO: 1007893 - protein, 9 aa, Homo Sapiens
YFLLQEEDM

SEQ ID NO: 1007894 - protein, 9 aa, Homo Sapiens
QNMRETCVN

SEQ ID NO: 1007895 - protein, 9 aa, Homo Sapiens
FFGADNAIS

SEQ ID NO: 1007896 - protein, 9 aa, Homo Sapiens
LNDGDIKKC

SEQ ID NO: 1007897 - protein, 9 aa, Homo Sapiens
IYSTDWVRR

SEQ ID NO: 1007898 - protein, 9 aa, Homo Sapiens
FAVCWASYS

SEQ ID NO: 1007899 - protein, 9 aa, Homo Sapiens
FVGEAARAL

SEQ ID NO: 1007900 - protein, 9 aa, Homo Sapiens
AEEAQIEDE

SEQ ID NO: 1007901 - protein, 9 aa, Homo Sapiens
SNPLQRHTF

SEQ ID NO: 1007902 - protein, 9 aa, Homo Sapiens
TLPGSLALT

SEQ ID NO: 1007903 - protein, 9 aa, Homo Sapiens
VHSFSDWDW

SEQ ID NO: 1007904 - protein, 9 aa, Homo Sapiens
LPVPPEGLA

SEQ ID NO: 1007905 - protein, 9 aa, Homo Sapiens
LHQKYKGLT

SEQ ID NO: 1007906 - protein, 9 aa, Homo Sapiens
DSFLLLISL

SEQ ID NO: 1007907 - protein, 9 aa, Homo Sapiens
YISIPGQQD

SEQ ID NO: 1007908 - protein, 9 aa, Homo Sapiens
LNSVKYKCE

SEQ ID NO: 1007909 - protein, 9 aa, Homo Sapiens
LVAFNAQHK

SEQ ID NO: 1007910 - protein, 9 aa, Homo Sapiens
ALSNIFLRL

SEQ ID NO: 1007911 - protein, 9 aa, Homo Sapiens
FTPTSRKKE

SEQ ID NO: 1007912 - protein, 9 aa, Homo Sapiens
DIEFRDHVG

SEQ ID NO: 1007913 - protein, 9 aa, Homo Sapiens
LFHPGYTVP

SEQ ID NO: 1007914 - protein, 9 aa, Homo Sapiens
CPQTRDTAW

SEQ ID NO: 1007915 - protein, 9 aa, Homo Sapiens
SITTSFFAQ

SEQ ID NO: 1007916 - protein, 9 aa, Homo Sapiens
EDFICISMT

SEQ ID NO: 1007917 - protein, 9 aa, Homo Sapiens
ISLLLRGKS

SEQ ID NO: 1007918 - protein, 9 aa, Homo Sapiens
NSLKRLQKE

SEQ ID NO: 1007919 - protein, 9 aa, Homo Sapiens
GSRPRRGMF

SEQ ID NO: 1007920 - protein, 9 aa, Homo Sapiens
VICLAVLIL

SEQ ID NO: 1007921 - protein, 9 aa, Homo Sapiens
GGIPQKIFL

SEQ ID NO: 1007922 - protein, 9 aa, Homo Sapiens
ENMLGHFAH

SEQ ID NO: 1007923 - protein, 9 aa, Homo Sapiens
KTNLRRTAY

SEQ ID NO: 1007924 - protein, 9 aa, Homo Sapiens
ASILQMWHV

SEQ ID NO: 1007925 - protein, 9 aa, Homo Sapiens
SSNSSASLL

SEQ ID NO: 1007926 - protein, 9 aa, Homo Sapiens
SLAPRSRSC

SEQ ID NO: 1007927 - protein, 9 aa, Homo Sapiens
TGFCVSGIL

SEQ ID NO: 1007928 - protein, 9 aa, Homo Sapiens
ERSTSSINS

SEQ ID NO: 1007929 - protein, 9 aa, Homo Sapiens
NEKSSLEGA

SEQ ID NO: 1007930 - protein, 9 aa, Homo Sapiens
VDILDPRAS

SEQ ID NO: 1007931 - protein, 9 aa, Homo Sapiens
GNFLYVFHL

SEQ ID NO: 1007932 - protein, 9 aa, Homo Sapiens
KYLNKDPQD

SEQ ID NO: 1007933 - protein, 9 aa, Homo Sapiens
DLESPILAA

SEQ ID NO: 1007934 - protein, 9 aa, Homo Sapiens
GPTVDMPVS

SEQ ID NO: 1007935 - protein, 9 aa, Homo Sapiens
KRKIIKQEE

SEQ ID NO: 1007936 - protein, 9 aa, Homo Sapiens
RHNQKGSCF

SEQ ID NO: 1007937 - protein, 9 aa, Homo Sapiens
TQLILGRHP

SEQ ID NO: 1007938 - protein, 9 aa, Homo Sapiens
HDQHCRKIF

SEQ ID NO: 1007939 - protein, 9 aa, Homo Sapiens
DFSAPWSRS

SEQ ID NO: 1007940 - protein, 9 aa, Homo Sapiens
SSDTGPISE

SEQ ID NO: 1007941 - protein, 9 aa, Homo Sapiens
HPVYEENKS

SEQ ID NO: 1007942 - protein, 9 aa, Homo Sapiens
RTSEKEAIE

SEQ ID NO: 1007943 - protein, 9 aa, Homo Sapiens
NGKVHLVVF

SEQ ID NO: 1007944 - protein, 9 aa, Homo Sapiens
SRMNMGRIN

SEQ ID NO: 1007945 - protein, 9 aa, Homo Sapiens
IKYLSDMGY

SEQ ID NO: 1007946 - protein, 9 aa, Homo Sapiens
LHVKPCGTN

SEQ ID NO: 1007947 - protein, 9 aa, Homo Sapiens
ISDCFWPPY

SEQ ID NO: 1007948 - protein, 9 aa, Homo Sapiens
NLCVSEISE

SEQ ID NO: 1007949 - protein, 9 aa, Homo Sapiens
IGDFGLATM

SEQ ID NO: 1007950 - protein, 9 aa, Homo Sapiens
SEGGDGTTS

SEQ ID NO: 1007951 - protein, 9 aa, Homo Sapiens
QRAQAALRE

SEQ ID NO: 1007952 - protein, 9 aa, Homo Sapiens
LRALSNIFL

SEQ ID NO: 1007953 - protein, 9 aa, Homo Sapiens
LYTVMSYNR

SEQ ID NO: 1007954 - protein, 9 aa, Homo Sapiens
TSPPLPETT

SEQ ID NO: 1007955 - protein, 9 aa, Homo Sapiens
QSHPQKLFY

SEQ ID NO: 1007956 - protein, 9 aa, Homo Sapiens
IDEKEMMEW

SEQ ID NO: 1007957 - protein, 9 aa, Homo Sapiens
ASASPLHML

SEQ ID NO: 1007958 - protein, 9 aa, Homo Sapiens
QDFTVIKDY

SEQ ID NO: 1007959 - protein, 9 aa, Homo Sapiens
NNLCVSEIS

SEQ ID NO: 1007960 - protein, 9 aa, Homo Sapiens
HCLSPKKMS

SEQ ID NO: 1007961 - protein, 9 aa, Homo Sapiens
IGVFILLVR

SEQ ID NO: 1007962 - protein, 9 aa, Homo Sapiens
LAQEPTDWI

SEQ ID NO: 1007963 - protein, 9 aa, Homo Sapiens
GDYGENIYL

SEQ ID NO: 1007964 - protein, 9 aa, Homo Sapiens
RVSSRKQHP

SEQ ID NO: 1007965 - protein, 9 aa, Homo Sapiens
TAKEILSKG

SEQ ID NO: 1007966 - protein, 9 aa, Homo Sapiens
AGAIQRSDA

SEQ ID NO: 1007967 - protein, 9 aa, Homo Sapiens
KDELFPVMS

SEQ ID NO: 1007968 - protein, 9 aa, Homo Sapiens
LYTCIAANL

SEQ ID NO: 1007969 - protein, 9 aa, Homo Sapiens
TVNVLKIIR

SEQ ID NO: 1007970 - protein, 9 aa, Homo Sapiens
VMSQRAIFF

SEQ ID NO: 1007971 - protein, 9 aa, Homo Sapiens
GSSIFLYIC

SEQ ID NO: 1007972 - protein, 9 aa, Homo Sapiens
GSECPSRVP

SEQ ID NO: 1007973 - protein, 9 aa, Homo Sapiens
YTQHESGSG

SEQ ID NO: 1007974 - protein, 9 aa, Homo Sapiens
DYFENEEEY

SEQ ID NO: 1007975 - protein, 9 aa, Homo Sapiens
ILGRHPIIS

SEQ ID NO: 1007976 - protein, 9 aa, Homo Sapiens
QKETGAKMS

SEQ ID NO: 1007977 - protein, 9 aa, Homo Sapiens
SSGNVNSSF

SEQ ID NO: 1007978 - protein, 9 aa, Homo Sapiens
PGSPGCPLV

SEQ ID NO: 1007979 - protein, 9 aa, Homo Sapiens
PHALTQVLA

SEQ ID NO: 1007980 - protein, 9 aa, Homo Sapiens
PMPTRPVPS

SEQ ID NO: 1007981 - protein, 9 aa, Homo Sapiens
IVTGRLAWW

SEQ ID NO: 1007982 - protein, 9 aa, Homo Sapiens
KFQEEFLEL

SEQ ID NO: 1007983 - protein, 9 aa, Homo Sapiens
EHAFQGPTF

SEQ ID NO: 1007984 - protein, 9 aa, Homo Sapiens
GMDLTPRSD

SEQ ID NO: 1007985 - protein, 9 aa, Homo Sapiens
SVTEPSQGQ

SEQ ID NO: 1007986 - protein, 9 aa, Homo Sapiens
ERWTSFGCV

SEQ ID NO: 1007987 - protein, 9 aa, Homo Sapiens
KLKSLIRLG

SEQ ID NO: 1007988 - protein, 9 aa, Homo Sapiens
NLLHIDPNF

SEQ ID NO: 1007989 - protein, 9 aa, Homo Sapiens
GCQPTCGCS

SEQ ID NO: 1007990 - protein, 9 aa, Homo Sapiens
ALSFYTQTT

SEQ ID NO: 1007991 - protein, 9 aa, Homo Sapiens
KFILVGFSV

SEQ ID NO: 1007992 - protein, 9 aa, Homo Sapiens
VSLVVPVHV

SEQ ID NO: 1007993 - protein, 9 aa, Homo Sapiens
FLANLPPSG

SEQ ID NO: 1007994 - protein, 9 aa, Homo Sapiens
SEPRVLTLV

SEQ ID NO: 1007995 - protein, 9 aa, Homo Sapiens
PLSAPSCTQ

SEQ ID NO: 1007996 - protein, 9 aa, Homo Sapiens
VSSILNVKQ

SEQ ID NO: 1007997 - protein, 9 aa, Homo Sapiens
KSKECWEEL

SEQ ID NO: 1007998 - protein, 9 aa, Homo Sapiens
RKAERYSFP

SEQ ID NO: 1007999 - protein, 9 aa, Homo Sapiens
MRIKSQTEG

SEQ ID NO: 1008000 - protein, 9 aa, Homo Sapiens
RNNRELRGR

SEQ ID NO: 1008001 - protein, 9 aa, Homo Sapiens
ESARGPRAA

SEQ ID NO: 1008002 - protein, 9 aa, Homo Sapiens
KAFRGITNV

SEQ ID NO: 1008003 - protein, 9 aa, Homo Sapiens
ISDSCLHSS

SEQ ID NO: 1008004 - protein, 9 aa, Homo Sapiens
VSLRVKRPI

SEQ ID NO: 1008005 - protein, 9 aa, Homo Sapiens
LQKETGAKM

SEQ ID NO: 1008006 - protein, 9 aa, Homo Sapiens
VDIEFRDHV

SEQ ID NO: 1008007 - protein, 9 aa, Homo Sapiens
ARNGLLLKE

SEQ ID NO: 1008008 - protein, 9 aa, Homo Sapiens
HSNSLGLIF

SEQ ID NO: 1008009 - protein, 9 aa, Homo Sapiens
EWVEQDPKE

SEQ ID NO: 1008010 - protein, 9 aa, Homo Sapiens
VPPEGLATV

SEQ ID NO: 1008011 - protein, 9 aa, Homo Sapiens
DEDENKEKM

SEQ ID NO: 1008012 - protein, 9 aa, Homo Sapiens
GKKGLLGIP

SEQ ID NO: 1008013 - protein, 9 aa, Homo Sapiens
YNQAQDSSR

SEQ ID NO: 1008014 - protein, 9 aa, Homo Sapiens
SGPPYEPRF

SEQ ID NO: 1008015 - protein, 9 aa, Homo Sapiens
MTLDQSEYT

SEQ ID NO: 1008016 - protein, 9 aa, Homo Sapiens
SLIDQYFKN

SEQ ID NO: 1008017 - protein, 9 aa, Homo Sapiens
YNSPGLGVK

SEQ ID NO: 1008018 - protein, 9 aa, Homo Sapiens
ERDFIGQRT

SEQ ID NO: 1008019 - protein, 9 aa, Homo Sapiens
VSLNRVRIE

SEQ ID NO: 1008020 - protein, 9 aa, Homo Sapiens
SEPFQIIFE

SEQ ID NO: 1008021 - protein, 9 aa, Homo Sapiens
IRPSTSTGV

SEQ ID NO: 1008022 - protein, 9 aa, Homo Sapiens
DSAFNPDVG

SEQ ID NO: 1008023 - protein, 9 aa, Homo Sapiens
EQTTTSPKR

SEQ ID NO: 1008024 - protein, 9 aa, Homo Sapiens
LLHQKYKGL

SEQ ID NO: 1008025 - protein, 9 aa, Homo Sapiens
NYIFFTGCF

SEQ ID NO: 1008026 - protein, 9 aa, Homo Sapiens
LGQFGFWRQ

SEQ ID NO: 1008027 - protein, 9 aa, Homo Sapiens
NKAQAIETA

SEQ ID NO: 1008028 - protein, 9 aa, Homo Sapiens
QTRDTAWAV

SEQ ID NO: 1008029 - protein, 9 aa, Homo Sapiens
MEHLQRQNV

SEQ ID NO: 1008030 - protein, 9 aa, Homo Sapiens
GVCGHKVER

SEQ ID NO: 1008031 - protein, 9 aa, Homo Sapiens
IPSQPERVY

SEQ ID NO: 1008032 - protein, 9 aa, Homo Sapiens
ERDGVYTLN

SEQ ID NO: 1008033 - protein, 9 aa, Homo Sapiens
QELQNVLDK

SEQ ID NO: 1008034 - protein, 9 aa, Homo Sapiens
PAGQSRCGR

SEQ ID NO: 1008035 - protein, 9 aa, Homo Sapiens
SSPRAHSLN

SEQ ID NO: 1008036 - protein, 9 aa, Homo Sapiens
ELDYLLLLA

SEQ ID NO: 1008037 - protein, 9 aa, Homo Sapiens
KDPQDFKRT

SEQ ID NO: 1008038 - protein, 9 aa, Homo Sapiens
IKMLLSGIL

SEQ ID NO: 1008039 - protein, 9 aa, Homo Sapiens
HSILRPGWR

SEQ ID NO: 1008040 - protein, 9 aa, Homo Sapiens
QSSNKNIFS

SEQ ID NO: 1008041 - protein, 9 aa, Homo Sapiens
GFPLLSSTT

SEQ ID NO: 1008042 - protein, 9 aa, Homo Sapiens
LYRTKKDNA

SEQ ID NO: 1008043 - protein, 9 aa, Homo Sapiens
LFHTLRLCD

SEQ ID NO: 1008044 - protein, 9 aa, Homo Sapiens
LQSRVGNSI

SEQ ID NO: 1008045 - protein, 9 aa, Homo Sapiens
KGERGELGI

SEQ ID NO: 1008046 - protein, 9 aa, Homo Sapiens
QVGKFSEDF

SEQ ID NO: 1008047 - protein, 9 aa, Homo Sapiens
LKFAFNSIA

SEQ ID NO: 1008048 - protein, 9 aa, Homo Sapiens
SSSFNDISQ

SEQ ID NO: 1008049 - protein, 9 aa, Homo Sapiens
ELVKKIFQN

SEQ ID NO: 1008050 - protein, 9 aa, Homo Sapiens
NNLLPYAIN

SEQ ID NO: 1008051 - protein, 9 aa, Homo Sapiens
QRSDAGTRG

SEQ ID NO: 1008052 - protein, 9 aa, Homo Sapiens
ISFLPVGDL

SEQ ID NO: 1008053 - protein, 9 aa, Homo Sapiens
EAKGPLPCP

SEQ ID NO: 1008054 - protein, 9 aa, Homo Sapiens
LRTPSNGPG

SEQ ID NO: 1008055 - protein, 9 aa, Homo Sapiens
KRIFLAGCG

SEQ ID NO: 1008056 - protein, 9 aa, Homo Sapiens
GPMTYLNKR

SEQ ID NO: 1008057 - protein, 9 aa, Homo Sapiens
YSTDWVRRA

SEQ ID NO: 1008058 - protein, 9 aa, Homo Sapiens
LAEEKDDVE

SEQ ID NO: 1008059 - protein, 9 aa, Homo Sapiens
KPGRSFPGA

SEQ ID NO: 1008060 - protein, 9 aa, Homo Sapiens
EITPRHKQE

SEQ ID NO: 1008061 - protein, 9 aa, Homo Sapiens
TIAEGSSPT

SEQ ID NO: 1008062 - protein, 9 aa, Homo Sapiens
KGNSRRIDY

SEQ ID NO: 1008063 - protein, 9 aa, Homo Sapiens
VSSASSSPT

SEQ ID NO: 1008064 - protein, 9 aa, Homo Sapiens
EIGKQPEQP

SEQ ID NO: 1008065 - protein, 9 aa, Homo Sapiens
IIMAPIEIR

SEQ ID NO: 1008066 - protein, 9 aa, Homo Sapiens
HLQRHPDLP

SEQ ID NO: 1008067 - protein, 9 aa, Homo Sapiens
FKTSEIQKL

SEQ ID NO: 1008068 - protein, 9 aa, Homo Sapiens
KQSPQTLLE

SEQ ID NO: 1008069 - protein, 9 aa, Homo Sapiens
IKQFENDLN

SEQ ID NO: 1008070 - protein, 9 aa, Homo Sapiens
LYLRGQRND

SEQ ID NO: 1008071 - protein, 9 aa, Homo Sapiens
TTVEHALIW

SEQ ID NO: 1008072 - protein, 9 aa, Homo Sapiens
ESVCPTQIP

SEQ ID NO: 1008073 - protein, 9 aa, Homo Sapiens
ENEAGQICE

SEQ ID NO: 1008074 - protein, 9 aa, Homo Sapiens
NFLGEEKFQ

SEQ ID NO: 1008075 - protein, 9 aa, Homo Sapiens
VMKAYTTRV

SEQ ID NO: 1008076 - protein, 9 aa, Homo Sapiens
GNKIVNEKS

SEQ ID NO: 1008077 - protein, 9 aa, Homo Sapiens
PPTSTSQLS

SEQ ID NO: 1008078 - protein, 9 aa, Homo Sapiens
KRSEISCYW

SEQ ID NO: 1008079 - protein, 9 aa, Homo Sapiens
SVKVWSHVG

SEQ ID NO: 1008080 - protein, 9 aa, Homo Sapiens
VKKMNSELS

SEQ ID NO: 1008081 - protein, 9 aa, Homo Sapiens
LYEEDKDEK

SEQ ID NO: 1008082 - protein, 9 aa, Homo Sapiens
LQSNPVREA

SEQ ID NO: 1008083 - protein, 9 aa, Homo Sapiens
ASQANLWLA

SEQ ID NO: 1008084 - protein, 9 aa, Homo Sapiens
KNSEAFKGK

SEQ ID NO: 1008085 - protein, 9 aa, Homo Sapiens
EEEQTAKEI

SEQ ID NO: 1008086 - protein, 9 aa, Homo Sapiens
EKQKEAKSS

SEQ ID NO: 1008087 - protein, 9 aa, Homo Sapiens
VRKITVRTK

SEQ ID NO: 1008088 - protein, 9 aa, Homo Sapiens
PQEERKSKR

SEQ ID NO: 1008089 - protein, 9 aa, Homo Sapiens
QSYYTAQDK

SEQ ID NO: 1008090 - protein, 9 aa, Homo Sapiens
ETCVNLHLP

SEQ ID NO: 1008091 - protein, 9 aa, Homo Sapiens
ALARLRSHS

SEQ ID NO: 1008092 - protein, 9 aa, Homo Sapiens
LFAKLNTFC

SEQ ID NO: 1008093 - protein, 9 aa, Homo Sapiens
NTFKQIYAQ

SEQ ID NO: 1008094 - protein, 9 aa, Homo Sapiens
GRPEQVRLL

SEQ ID NO: 1008095 - protein, 9 aa, Homo Sapiens
PLVISSIAA

SEQ ID NO: 1008096 - protein, 9 aa, Homo Sapiens
ECPSRVPVQ

SEQ ID NO: 1008097 - protein, 9 aa, Homo Sapiens
PPYEPRFKF

SEQ ID NO: 1008098 - protein, 9 aa, Homo Sapiens
SWGKPISES

SEQ ID NO: 1008099 - protein, 9 aa, Homo Sapiens
QRKSIKTYR

SEQ ID NO: 1008100 - protein, 9 aa, Homo Sapiens
KIIKQEEDP

SEQ ID NO: 1008101 - protein, 9 aa, Homo Sapiens
NCSGIGKVD

SEQ ID NO: 1008102 - protein, 9 aa, Homo Sapiens
FFCNPSEVL

SEQ ID NO: 1008103 - protein, 9 aa, Homo Sapiens
AKKKSIRVL

SEQ ID NO: 1008104 - protein, 9 aa, Homo Sapiens
RKELLKGNS

SEQ ID NO: 1008105 - protein, 9 aa, Homo Sapiens
AQAALRERY

SEQ ID NO: 1008106 - protein, 9 aa, Homo Sapiens
WCYTHAVAG

SEQ ID NO: 1008107 - protein, 9 aa, Homo Sapiens
FIPFSRITS

SEQ ID NO: 1008108 - protein, 9 aa, Homo Sapiens
LGATFSVII

SEQ ID NO: 1008109 - protein, 9 aa, Homo Sapiens
SSVTVSCKA

SEQ ID NO: 1008110 - protein, 9 aa, Homo Sapiens
SLSKPNENE

SEQ ID NO: 1008111 - protein, 9 aa, Homo Sapiens
SITMSYVHF

SEQ ID NO: 1008112 - protein, 9 aa, Homo Sapiens
LFTRILAMK

SEQ ID NO: 1008113 - protein, 9 aa, Homo Sapiens
ALQQVLFTR

SEQ ID NO: 1008114 - protein, 9 aa, Homo Sapiens
FWARWSGAW

SEQ ID NO: 1008115 - protein, 9 aa, Homo Sapiens
PHYPPMPTR

SEQ ID NO: 1008116 - protein, 9 aa, Homo Sapiens
PVPPEGLAT

SEQ ID NO: 1008117 - protein, 9 aa, Homo Sapiens
STKERWKAF

SEQ ID NO: 1008118 - protein, 9 aa, Homo Sapiens
GGFLSVQCR

SEQ ID NO: 1008119 - protein, 9 aa, Homo Sapiens
KDWQCQAYS

SEQ ID NO: 1008120 - protein, 9 aa, Homo Sapiens
VNWTFYASS

SEQ ID NO: 1008121 - protein, 9 aa, Homo Sapiens
PSRSRGRPR

SEQ ID NO: 1008122 - protein, 9 aa, Homo Sapiens
EAQIEDEAH

SEQ ID NO: 1008123 - protein, 9 aa, Homo Sapiens
PSGVVNENT

SEQ ID NO: 1008124 - protein, 9 aa, Homo Sapiens
SWEPQNKLW

SEQ ID NO: 1008125 - protein, 9 aa, Homo Sapiens
DRIDLSSIT

SEQ ID NO: 1008126 - protein, 9 aa, Homo Sapiens
GEVTKPQFS

SEQ ID NO: 1008127 - protein, 9 aa, Homo Sapiens
KAPGNSENG

SEQ ID NO: 1008128 - protein, 9 aa, Homo Sapiens
PTVSKAPTM

SEQ ID NO: 1008129 - protein, 9 aa, Homo Sapiens
AMLFAIDKI

SEQ ID NO: 1008130 - protein, 9 aa, Homo Sapiens
AAFCCTIVD

SEQ ID NO: 1008131 - protein, 9 aa, Homo Sapiens
GLVRAQTCS

SEQ ID NO: 1008132 - protein, 9 aa, Homo Sapiens
KIQDNYLLI

SEQ ID NO: 1008133 - protein, 9 aa, Homo Sapiens
RTKGIPHLV

SEQ ID NO: 1008134 - protein, 9 aa, Homo Sapiens
SGTSPTQLA

SEQ ID NO: 1008135 - protein, 9 aa, Homo Sapiens
KNHFHSMCF

SEQ ID NO: 1008136 - protein, 9 aa, Homo Sapiens
QRTQANSME

SEQ ID NO: 1008137 - protein, 9 aa, Homo Sapiens
AAGALAGVG

SEQ ID NO: 1008138 - protein, 9 aa, Homo Sapiens
NKANFFFQS

SEQ ID NO: 1008139 - protein, 9 aa, Homo Sapiens
IVIILEGMV

SEQ ID NO: 1008140 - protein, 9 aa, Homo Sapiens
KEGESYSKE

SEQ ID NO: 1008141 - protein, 9 aa, Homo Sapiens
CTSNVAITT

SEQ ID NO: 1008142 - protein, 9 aa, Homo Sapiens
QDGAPGNPG

SEQ ID NO: 1008143 - protein, 9 aa, Homo Sapiens
NTTCEATHF

SEQ ID NO: 1008144 - protein, 9 aa, Homo Sapiens
GLAEHWRIC

SEQ ID NO: 1008145 - protein, 9 aa, Homo Sapiens
PPPVTLAFR

SEQ ID NO: 1008146 - protein, 9 aa, Homo Sapiens
PLVVTMRSI

SEQ ID NO: 1008147 - protein, 9 aa, Homo Sapiens
LDTEKVPLF

SEQ ID NO: 1008148 - protein, 9 aa, Homo Sapiens
YTSVLSFDL

SEQ ID NO: 1008149 - protein, 9 aa, Homo Sapiens
LKGKLPPRA

SEQ ID NO: 1008150 - protein, 9 aa, Homo Sapiens
CITLELLIG

SEQ ID NO: 1008151 - protein, 9 aa, Homo Sapiens
QQYNSPGLG

SEQ ID NO: 1008152 - protein, 9 aa, Homo Sapiens
FETDLQDFE

SEQ ID NO: 1008153 - protein, 9 aa, Homo Sapiens
ICFSWTLHT

SEQ ID NO: 1008154 - protein, 9 aa, Homo Sapiens
SNWKDYDDK

SEQ ID NO: 1008155 - protein, 9 aa, Homo Sapiens
NLTYPLGLR

SEQ ID NO: 1008156 - protein, 9 aa, Homo Sapiens
KETGLQETQ

SEQ ID NO: 1008157 - protein, 9 aa, Homo Sapiens
DNASILLQI

SEQ ID NO: 1008158 - protein, 9 aa, Homo Sapiens
WRICTGEKP

SEQ ID NO: 1008159 - protein, 9 aa, Homo Sapiens
LSIDVTDKN

SEQ ID NO: 1008160 - protein, 9 aa, Homo Sapiens
LVITSSSNL

SEQ ID NO: 1008161 - protein, 9 aa, Homo Sapiens
LGDSQFFSR

SEQ ID NO: 1008162 - protein, 9 aa, Homo Sapiens
FKDWQCQAY

SEQ ID NO: 1008163 - protein, 9 aa, Homo Sapiens
LITELTKSQ

SEQ ID NO: 1008164 - protein, 9 aa, Homo Sapiens
WLQVGSLCL

SEQ ID NO: 1008165 - protein, 9 aa, Homo Sapiens
PTTGVILLS

SEQ ID NO: 1008166 - protein, 9 aa, Homo Sapiens
SPPLPETTM

SEQ ID NO: 1008167 - protein, 9 aa, Homo Sapiens
KILACGVAK

SEQ ID NO: 1008168 - protein, 9 aa, Homo Sapiens
RKEATEKPW

SEQ ID NO: 1008169 - protein, 9 aa, Homo Sapiens
VCSCPERLQ

SEQ ID NO: 1008170 - protein, 9 aa, Homo Sapiens
QFENDLNKL

SEQ ID NO: 1008171 - protein, 9 aa, Homo Sapiens
GITNVKNLQ

SEQ ID NO: 1008172 - protein, 9 aa, Homo Sapiens
SELWNFPPD

SEQ ID NO: 1008173 - protein, 9 aa, Homo Sapiens
IEGAKEPRD

SEQ ID NO: 1008174 - protein, 9 aa, Homo Sapiens
LPIGNKTLS

SEQ ID NO: 1008175 - protein, 9 aa, Homo Sapiens
FLLQEEDMW

SEQ ID NO: 1008176 - protein, 9 aa, Homo Sapiens
FIVPSHCRK

SEQ ID NO: 1008177 - protein, 9 aa, Homo Sapiens
PSLSPSLPH

SEQ ID NO: 1008178 - protein, 9 aa, Homo Sapiens
AIKKILPGT

SEQ ID NO: 1008179 - protein, 9 aa, Homo Sapiens
LVLILFFLN

SEQ ID NO: 1008180 - protein, 9 aa, Homo Sapiens
YETTKDYPD

SEQ ID NO: 1008181 - protein, 9 aa, Homo Sapiens
LLQELRDID

SEQ ID NO: 1008182 - protein, 9 aa, Homo Sapiens
EGLICSRVS

SEQ ID NO: 1008183 - protein, 9 aa, Homo Sapiens
HVEKRVLEK

SEQ ID NO: 1008184 - protein, 9 aa, Homo Sapiens
NNFRRPNLE

SEQ ID NO: 1008185 - protein, 9 aa, Homo Sapiens
KEEKKVPAG

SEQ ID NO: 1008186 - protein, 9 aa, Homo Sapiens
ARKIDNFYP

SEQ ID NO: 1008187 - protein, 9 aa, Homo Sapiens
NLTKNTTLQ

SEQ ID NO: 1008188 - protein, 9 aa, Homo Sapiens
DSKKAQLIS

SEQ ID NO: 1008189 - protein, 9 aa, Homo Sapiens
LRDDLVIEG

SEQ ID NO: 1008190 - protein, 9 aa, Homo Sapiens
SSGSLSCTH

SEQ ID NO: 1008191 - protein, 9 aa, Homo Sapiens
IFFSLVTIP

SEQ ID NO: 1008192 - protein, 9 aa, Homo Sapiens
GPAFYPSTM

SEQ ID NO: 1008193 - protein, 9 aa, Homo Sapiens
ILIHNLQEE

SEQ ID NO: 1008194 - protein, 9 aa, Homo Sapiens
QNEFYSSPY

SEQ ID NO: 1008195 - protein, 9 aa, Homo Sapiens
NVHKESYNE

SEQ ID NO: 1008196 - protein, 9 aa, Homo Sapiens
NLSPSSFFR

SEQ ID NO: 1008197 - protein, 9 aa, Homo Sapiens
TSQYFNFAQ

SEQ ID NO: 1008198 - protein, 9 aa, Homo Sapiens
SNPSLVLAF

SEQ ID NO: 1008199 - protein, 9 aa, Homo Sapiens
HKNLCSLKT

SEQ ID NO: 1008200 - protein, 9 aa, Homo Sapiens
GQDGAPGNP

SEQ ID NO: 1008201 - protein, 9 aa, Homo Sapiens
HNPQEQFSK

SEQ ID NO: 1008202 - protein, 9 aa, Homo Sapiens
TCTDTCLDH

SEQ ID NO: 1008203 - protein, 9 aa, Homo Sapiens
KKKSIRVLL

SEQ ID NO: 1008204 - protein, 9 aa, Homo Sapiens
MVLFCLLLL

SEQ ID NO: 1008205 - protein, 9 aa, Homo Sapiens
DKEVKDCVT

SEQ ID NO: 1008206 - protein, 9 aa, Homo Sapiens
ITSNTEMCE

SEQ ID NO: 1008207 - protein, 9 aa, Homo Sapiens
ERENMKWNY

SEQ ID NO: 1008208 - protein, 9 aa, Homo Sapiens
LIRKLVDFK

SEQ ID NO: 1008209 - protein, 9 aa, Homo Sapiens
ARTNRGGDS

SEQ ID NO: 1008210 - protein, 9 aa, Homo Sapiens
ELMFQNSLY

SEQ ID NO: 1008211 - protein, 9 aa, Homo Sapiens
TCGCSLGQL

SEQ ID NO: 1008212 - protein, 9 aa, Homo Sapiens
IALDRYVAI

SEQ ID NO: 1008213 - protein, 9 aa, Homo Sapiens
TCIAANLVG

SEQ ID NO: 1008214 - protein, 9 aa, Homo Sapiens
FSSSYYSNL

SEQ ID NO: 1008215 - protein, 9 aa, Homo Sapiens
TLLSYVSVS

SEQ ID NO: 1008216 - protein, 9 aa, Homo Sapiens
SLVGGLGLA

SEQ ID NO: 1008217 - protein, 9 aa, Homo Sapiens
DRVVEKSEL

SEQ ID NO: 1008218 - protein, 9 aa, Homo Sapiens
PEPGRQQYD

SEQ ID NO: 1008219 - protein, 9 aa, Homo Sapiens
GVFLRLSHP

SEQ ID NO: 1008220 - protein, 9 aa, Homo Sapiens
GTLRRNSMK

SEQ ID NO: 1008221 - protein, 9 aa, Homo Sapiens
MDSKMTPTI

SEQ ID NO: 1008222 - protein, 9 aa, Homo Sapiens
SLLKFHQEP

SEQ ID NO: 1008223 - protein, 9 aa, Homo Sapiens
RSDAGTRGC

SEQ ID NO: 1008224 - protein, 9 aa, Homo Sapiens
WSLRSRASP

SEQ ID NO: 1008225 - protein, 9 aa, Homo Sapiens
KVRQFYGLL

SEQ ID NO: 1008226 - protein, 9 aa, Homo Sapiens
KRKWFGKSK

SEQ ID NO: 1008227 - protein, 9 aa, Homo Sapiens
CLGGMASSP

SEQ ID NO: 1008228 - protein, 9 aa, Homo Sapiens
VALIRASPR

SEQ ID NO: 1008229 - protein, 9 aa, Homo Sapiens
GSFEIENLF

SEQ ID NO: 1008230 - protein, 9 aa, Homo Sapiens
AVRKYFQKI

SEQ ID NO: 1008231 - protein, 9 aa, Homo Sapiens
IAPLFQELN

SEQ ID NO: 1008232 - protein, 9 aa, Homo Sapiens
VNSIVVPLP

SEQ ID NO: 1008233 - protein, 9 aa, Homo Sapiens
QRIEGAKEP

SEQ ID NO: 1008234 - protein, 9 aa, Homo Sapiens
TWTLFTSSV

SEQ ID NO: 1008235 - protein, 9 aa, Homo Sapiens
RVLSNISSI

SEQ ID NO: 1008236 - protein, 9 aa, Homo Sapiens
AVPSKVRDW

SEQ ID NO: 1008237 - protein, 9 aa, Homo Sapiens
SRISLNDDK

SEQ ID NO: 1008238 - protein, 9 aa, Homo Sapiens
GKDSRLSTA

SEQ ID NO: 1008239 - protein, 9 aa, Homo Sapiens
SVTLPVPPE

SEQ ID NO: 1008240 - protein, 9 aa, Homo Sapiens
FYMQIAPMR

SEQ ID NO: 1008241 - protein, 9 aa, Homo Sapiens
EKSFINHSH

SEQ ID NO: 1008242 - protein, 9 aa, Homo Sapiens
KLINRKISF

SEQ ID NO: 1008243 - protein, 9 aa, Homo Sapiens
PRFGSEGTE

SEQ ID NO: 1008244 - protein, 9 aa, Homo Sapiens
LIDGSFEIE

SEQ ID NO: 1008245 - protein, 9 aa, Homo Sapiens
MAIPKLSSP

SEQ ID NO: 1008246 - protein, 9 aa, Homo Sapiens
NLEEGQSEG

SEQ ID NO: 1008247 - protein, 9 aa, Homo Sapiens
IGRKDSGST

SEQ ID NO: 1008248 - protein, 9 aa, Homo Sapiens
SCVNKNKNS

SEQ ID NO: 1008249 - protein, 9 aa, Homo Sapiens
FTLFTLAGL

SEQ ID NO: 1008250 - protein, 9 aa, Homo Sapiens
GTTSSQIRV

SEQ ID NO: 1008251 - protein, 9 aa, Homo Sapiens
SLVEPGFLA

SEQ ID NO: 1008252 - protein, 9 aa, Homo Sapiens
RTSVESYES

SEQ ID NO: 1008253 - protein, 9 aa, Homo Sapiens
PRSAPGQLS

SEQ ID NO: 1008254 - protein, 9 aa, Homo Sapiens
KLPPPAGPG

SEQ ID NO: 1008255 - protein, 9 aa, Homo Sapiens
DDNNDDDVS

SEQ ID NO: 1008256 - protein, 9 aa, Homo Sapiens
KETEKPPLS

SEQ ID NO: 1008257 - protein, 9 aa, Homo Sapiens
QMVFIWKNI

SEQ ID NO: 1008258 - protein, 9 aa, Homo Sapiens
GLMDSKMTP

SEQ ID NO: 1008259 - protein, 9 aa, Homo Sapiens
NIENRTRVP

SEQ ID NO: 1008260 - protein, 9 aa, Homo Sapiens
MISTLKAAI

SEQ ID NO: 1008261 - protein, 9 aa, Homo Sapiens
HTESCHKCG

SEQ ID NO: 1008262 - protein, 9 aa, Homo Sapiens
FGEKIKNTI

SEQ ID NO: 1008263 - protein, 9 aa, Homo Sapiens
LPKPFIWAK

SEQ ID NO: 1008264 - protein, 9 aa, Homo Sapiens
QYGRVICQP

SEQ ID NO: 1008265 - protein, 9 aa, Homo Sapiens
LKPEQEITP

SEQ ID NO: 1008266 - protein, 9 aa, Homo Sapiens
REKTGSLEG

SEQ ID NO: 1008267 - protein, 9 aa, Homo Sapiens
PIFINFTCA

SEQ ID NO: 1008268 - protein, 9 aa, Homo Sapiens
PQNVDSLSA

SEQ ID NO: 1008269 - protein, 9 aa, Homo Sapiens
VGGLRFDNL

SEQ ID NO: 1008270 - protein, 9 aa, Homo Sapiens
RKPDNSKNH

SEQ ID NO: 1008271 - protein, 9 aa, Homo Sapiens
YQLIHAASL

SEQ ID NO: 1008272 - protein, 9 aa, Homo Sapiens
DKEDVFPLQ

SEQ ID NO: 1008273 - protein, 9 aa, Homo Sapiens
LRSDAVPSK

SEQ ID NO: 1008274 - protein, 9 aa, Homo Sapiens
QNQDFTVIK

SEQ ID NO: 1008275 - protein, 9 aa, Homo Sapiens
KETMTCVFF

SEQ ID NO: 1008276 - protein, 9 aa, Homo Sapiens
SWSGKVKDI

SEQ ID NO: 1008277 - protein, 9 aa, Homo Sapiens
ASSEESTES

SEQ ID NO: 1008278 - protein, 9 aa, Homo Sapiens
FQGVGNRVR

SEQ ID NO: 1008279 - protein, 9 aa, Homo Sapiens
RLSGDWNLL

SEQ ID NO: 1008280 - protein, 9 aa, Homo Sapiens
TDPVQIIQE

SEQ ID NO: 1008281 - protein, 9 aa, Homo Sapiens
CAFLCTKLV

SEQ ID NO: 1008282 - protein, 9 aa, Homo Sapiens
MVSLVVPVH

SEQ ID NO: 1008283 - protein, 9 aa, Homo Sapiens
CRRNPACSG

SEQ ID NO: 1008284 - protein, 9 aa, Homo Sapiens
HHHRQRLSG

SEQ ID NO: 1008285 - protein, 9 aa, Homo Sapiens
TVLTPMLNL

SEQ ID NO: 1008286 - protein, 9 aa, Homo Sapiens
LPVSLRVKR

SEQ ID NO: 1008287 - protein, 9 aa, Homo Sapiens
VEQARRLVF

SEQ ID NO: 1008288 - protein, 9 aa, Homo Sapiens
SPIENSSNN

SEQ ID NO: 1008289 - protein, 9 aa, Homo Sapiens
LSNNKISTL

SEQ ID NO: 1008290 - protein, 9 aa, Homo Sapiens
KPLRYPLLL

SEQ ID NO: 1008291 - protein, 9 aa, Homo Sapiens
SHEEDDNND

SEQ ID NO: 1008292 - protein, 9 aa, Homo Sapiens
LVALLHPRI

SEQ ID NO: 1008293 - protein, 9 aa, Homo Sapiens
SLDSFWSQV

SEQ ID NO: 1008294 - protein, 9 aa, Homo Sapiens
GELVALLHP

SEQ ID NO: 1008295 - protein, 9 aa, Homo Sapiens
TCSSVCSCS

SEQ ID NO: 1008296 - protein, 9 aa, Homo Sapiens
SSTRVGGDV

SEQ ID NO: 1008297 - protein, 9 aa, Homo Sapiens
TGMYPCAFL

SEQ ID NO: 1008298 - protein, 9 aa, Homo Sapiens
PSREVNGLI

SEQ ID NO: 1008299 - protein, 9 aa, Homo Sapiens
RPSEVPFYY

SEQ ID NO: 1008300 - protein, 9 aa, Homo Sapiens
YRVSFSAAR

SEQ ID NO: 1008301 - protein, 9 aa, Homo Sapiens
FCLLLLYPG

SEQ ID NO: 1008302 - protein, 9 aa, Homo Sapiens
KQFENDLNK

SEQ ID NO: 1008303 - protein, 9 aa, Homo Sapiens
NNDDDVSTE

SEQ ID NO: 1008304 - protein, 9 aa, Homo Sapiens
QRKMASSEE

SEQ ID NO: 1008305 - protein, 9 aa, Homo Sapiens
KLPPRAGVR

SEQ ID NO: 1008306 - protein, 9 aa, Homo Sapiens
CKAPGNSEN

SEQ ID NO: 1008307 - protein, 9 aa, Homo Sapiens
KSLQGLSDT

SEQ ID NO: 1008308 - protein, 9 aa, Homo Sapiens
SSFPLISLL

SEQ ID NO: 1008309 - protein, 9 aa, Homo Sapiens
IFSPHTPSP

SEQ ID NO: 1008310 - protein, 9 aa, Homo Sapiens
NCATSFATV

SEQ ID NO: 1008311 - protein, 9 aa, Homo Sapiens
TKLTEVLNG

SEQ ID NO: 1008312 - protein, 9 aa, Homo Sapiens
AEHWRICTG

SEQ ID NO: 1008313 - protein, 9 aa, Homo Sapiens
KKKIIGTDV

SEQ ID NO: 1008314 - protein, 9 aa, Homo Sapiens
SRAQTQGLV

SEQ ID NO: 1008315 - protein, 9 aa, Homo Sapiens
DKEKLPPGP

SEQ ID NO: 1008316 - protein, 9 aa, Homo Sapiens
TAIISLAEC

SEQ ID NO: 1008317 - protein, 9 aa, Homo Sapiens
SQFFSRTDS

SEQ ID NO: 1008318 - protein, 9 aa, Homo Sapiens
FFQDHSYQE

SEQ ID NO: 1008319 - protein, 9 aa, Homo Sapiens
SLPVSLRVK

SEQ ID NO: 1008320 - protein, 9 aa, Homo Sapiens
ALETTHTPP

SEQ ID NO: 1008321 - protein, 9 aa, Homo Sapiens
SPGSFDFLL

SEQ ID NO: 1008322 - protein, 9 aa, Homo Sapiens
LFVCEEEPF

SEQ ID NO: 1008323 - protein, 9 aa, Homo Sapiens
SLTFQRQAF

SEQ ID NO: 1008324 - protein, 9 aa, Homo Sapiens
PVRFENIGF

SEQ ID NO: 1008325 - protein, 9 aa, Homo Sapiens
SYNELNQYL

SEQ ID NO: 1008326 - protein, 9 aa, Homo Sapiens
AMRTPRCEV

SEQ ID NO: 1008327 - protein, 9 aa, Homo Sapiens
QPPSENSQD

SEQ ID NO: 1008328 - protein, 9 aa, Homo Sapiens
VNENTFKQI

SEQ ID NO: 1008329 - protein, 9 aa, Homo Sapiens
AKGAQEEPQ

SEQ ID NO: 1008330 - protein, 9 aa, Homo Sapiens
DYDDKEPRH

SEQ ID NO: 1008331 - protein, 9 aa, Homo Sapiens
LARWLQRVS

SEQ ID NO: 1008332 - protein, 9 aa, Homo Sapiens
RTARRTPLG

SEQ ID NO: 1008333 - protein, 9 aa, Homo Sapiens
CLLGQFGFW

SEQ ID NO: 1008334 - protein, 9 aa, Homo Sapiens
GIKYLSDMG

SEQ ID NO: 1008335 - protein, 9 aa, Homo Sapiens
PVVPEEVVA

SEQ ID NO: 1008336 - protein, 9 aa, Homo Sapiens
ILNRKIQDN

SEQ ID NO: 1008337 - protein, 9 aa, Homo Sapiens
FQGPTFFHV

SEQ ID NO: 1008338 - protein, 9 aa, Homo Sapiens
QETQAQRQM

SEQ ID NO: 1008339 - protein, 9 aa, Homo Sapiens
KELLKGNSR

SEQ ID NO: 1008340 - protein, 9 aa, Homo Sapiens
DDGFVDLLN

SEQ ID NO: 1008341 - protein, 9 aa, Homo Sapiens
VVGGVPVLI

SEQ ID NO: 1008342 - protein, 9 aa, Homo Sapiens
RSLIFYRKE

SEQ ID NO: 1008343 - protein, 9 aa, Homo Sapiens
SRGHVSHAL

SEQ ID NO: 1008344 - protein, 9 aa, Homo Sapiens
QAWFTYNNL

SEQ ID NO: 1008345 - protein, 9 aa, Homo Sapiens
YTCIAANLV

SEQ ID NO: 1008346 - protein, 9 aa, Homo Sapiens
SLLSKPAVS

SEQ ID NO: 1008347 - protein, 9 aa, Homo Sapiens
DVTDKNISL

SEQ ID NO: 1008348 - protein, 9 aa, Homo Sapiens
HNCKEDDIA

SEQ ID NO: 1008349 - protein, 9 aa, Homo Sapiens
FLYVFHLFG

SEQ ID NO: 1008350 - protein, 9 aa, Homo Sapiens
AFCCTIVDG

SEQ ID NO: 1008351 - protein, 9 aa, Homo Sapiens
ALPLFVTAD

SEQ ID NO: 1008352 - protein, 9 aa, Homo Sapiens
SWESSLGIA

SEQ ID NO: 1008353 - protein, 9 aa, Homo Sapiens
VPVQVRSFV

SEQ ID NO: 1008354 - protein, 9 aa, Homo Sapiens
NLCQSSASP

SEQ ID NO: 1008355 - protein, 9 aa, Homo Sapiens
GFSVCPPGG

SEQ ID NO: 1008356 - protein, 9 aa, Homo Sapiens
SSYKKQSPQ

SEQ ID NO: 1008357 - protein, 9 aa, Homo Sapiens
PSPPLVISS

SEQ ID NO: 1008358 - protein, 9 aa, Homo Sapiens
TNVKNLQLD

SEQ ID NO: 1008359 - protein, 9 aa, Homo Sapiens
WSSYKKQSP

SEQ ID NO: 1008360 - protein, 9 aa, Homo Sapiens
GVVAAFCCT

SEQ ID NO: 1008361 - protein, 9 aa, Homo Sapiens
GPISEGGLV

SEQ ID NO: 1008362 - protein, 9 aa, Homo Sapiens
ISLRGFDQQ

SEQ ID NO: 1008363 - protein, 9 aa, Homo Sapiens
EHLQRQNVA

SEQ ID NO: 1008364 - protein, 9 aa, Homo Sapiens
KAPNERQRE

SEQ ID NO: 1008365 - protein, 9 aa, Homo Sapiens
PLMANFDLS

SEQ ID NO: 1008366 - protein, 9 aa, Homo Sapiens
AHLQRHPDL

SEQ ID NO: 1008367 - protein, 9 aa, Homo Sapiens
LTPMLNLLI

SEQ ID NO: 1008368 - protein, 9 aa, Homo Sapiens
GERPFSCTQ

SEQ ID NO: 1008369 - protein, 9 aa, Homo Sapiens
EKVVQMTNN

SEQ ID NO: 1008370 - protein, 9 aa, Homo Sapiens
KGPESLTVQ

SEQ ID NO: 1008371 - protein, 9 aa, Homo Sapiens
ENEHLQLFG

SEQ ID NO: 1008372 - protein, 9 aa, Homo Sapiens
AASILVLNG

SEQ ID NO: 1008373 - protein, 9 aa, Homo Sapiens
HLNVSKLQK

SEQ ID NO: 1008374 - protein, 9 aa, Homo Sapiens
SDLESRTLL

SEQ ID NO: 1008375 - protein, 9 aa, Homo Sapiens
HLKVLESTK

SEQ ID NO: 1008376 - protein, 9 aa, Homo Sapiens
GVTMVGIRA

SEQ ID NO: 1008377 - protein, 9 aa, Homo Sapiens
EVTRVKAVK

SEQ ID NO: 1008378 - protein, 9 aa, Homo Sapiens
RKEVIHEIK

SEQ ID NO: 1008379 - protein, 9 aa, Homo Sapiens
DLDSSEESS

SEQ ID NO: 1008380 - protein, 9 aa, Homo Sapiens
GLSIALPLF

SEQ ID NO: 1008381 - protein, 9 aa, Homo Sapiens
QDFKRTDDF

SEQ ID NO: 1008382 - protein, 9 aa, Homo Sapiens
RTLRKHSDY

SEQ ID NO: 1008383 - protein, 9 aa, Homo Sapiens
SCKPRNMTG

SEQ ID NO: 1008384 - protein, 9 aa, Homo Sapiens
EKLPPGPRP

SEQ ID NO: 1008385 - protein, 9 aa, Homo Sapiens
LDKLKAKRE

SEQ ID NO: 1008386 - protein, 9 aa, Homo Sapiens
LFQPLDYQA

SEQ ID NO: 1008387 - protein, 9 aa, Homo Sapiens
LLPYAINLR

SEQ ID NO: 1008388 - protein, 9 aa, Homo Sapiens
IYKASDGKA

SEQ ID NO: 1008389 - protein, 9 aa, Homo Sapiens
EEEDNSKEI

SEQ ID NO: 1008390 - protein, 9 aa, Homo Sapiens
IMMRSISLR

SEQ ID NO: 1008391 - protein, 9 aa, Homo Sapiens
GYTQHESGS

SEQ ID NO: 1008392 - protein, 9 aa, Homo Sapiens
YNRYLAISY

SEQ ID NO: 1008393 - protein, 9 aa, Homo Sapiens
PHQPGSRHR

SEQ ID NO: 1008394 - protein, 9 aa, Homo Sapiens
ITPRHKQEF

SEQ ID NO: 1008395 - protein, 9 aa, Homo Sapiens
LYTAKGAQE

SEQ ID NO: 1008396 - protein, 9 aa, Homo Sapiens
DLCSMADVA

SEQ ID NO: 1008397 - protein, 9 aa, Homo Sapiens
VERENMKWN

SEQ ID NO: 1008398 - protein, 9 aa, Homo Sapiens
ELLKRTLRK

SEQ ID NO: 1008399 - protein, 9 aa, Homo Sapiens
CNPSEVLKL

SEQ ID NO: 1008400 - protein, 9 aa, Homo Sapiens
HGMTNIFWM

SEQ ID NO: 1008401 - protein, 9 aa, Homo Sapiens
RSRSPSLAP

SEQ ID NO: 1008402 - protein, 9 aa, Homo Sapiens
FYRVRISVL

SEQ ID NO: 1008403 - protein, 9 aa, Homo Sapiens
TVMSYNRYL

SEQ ID NO: 1008404 - protein, 9 aa, Homo Sapiens
AVSELWNFP

SEQ ID NO: 1008405 - protein, 9 aa, Homo Sapiens
VTMRSIPKD

SEQ ID NO: 1008406 - protein, 9 aa, Homo Sapiens
NGYISIPGQ

SEQ ID NO: 1008407 - protein, 9 aa, Homo Sapiens
TWQMHSGLY

SEQ ID NO: 1008408 - protein, 9 aa, Homo Sapiens
LLLYPAGHC

SEQ ID NO: 1008409 - protein, 9 aa, Homo Sapiens
IINLCQSSA

SEQ ID NO: 1008410 - protein, 9 aa, Homo Sapiens
YSEGGDGTT

SEQ ID NO: 1008411 - protein, 9 aa, Homo Sapiens
AMAVGFPVS

SEQ ID NO: 1008412 - protein, 9 aa, Homo Sapiens
NAPIFINFT

SEQ ID NO: 1008413 - protein, 9 aa, Homo Sapiens
SLVDSTVVH

SEQ ID NO: 1008414 - protein, 9 aa, Homo Sapiens
GEKITCQNF

SEQ ID NO: 1008415 - protein, 9 aa, Homo Sapiens
QSLRYALSF

SEQ ID NO: 1008416 - protein, 9 aa, Homo Sapiens
IKDELFPVM

SEQ ID NO: 1008417 - protein, 9 aa, Homo Sapiens
MENIFMVLL

SEQ ID NO: 1008418 - protein, 9 aa, Homo Sapiens
AFREERAKA

SEQ ID NO: 1008419 - protein, 9 aa, Homo Sapiens
PENLTKNTT

SEQ ID NO: 1008420 - protein, 9 aa, Homo Sapiens
GQSRCGRFL

SEQ ID NO: 1008421 - protein, 9 aa, Homo Sapiens
GILLFHANS

SEQ ID NO: 1008422 - protein, 9 aa, Homo Sapiens
CSMGCDLPQ

SEQ ID NO: 1008423 - protein, 9 aa, Homo Sapiens
GLYTTWTLF

SEQ ID NO: 1008424 - protein, 9 aa, Homo Sapiens
ESWEPQNKL

SEQ ID NO: 1008425 - protein, 9 aa, Homo Sapiens
IDSAGTYRG

SEQ ID NO: 1008426 - protein, 9 aa, Homo Sapiens
AAAGALAGV

SEQ ID NO: 1008427 - protein, 9 aa, Homo Sapiens
QCLSRPFSL

SEQ ID NO: 1008428 - protein, 9 aa, Homo Sapiens
LLSKPAVST

SEQ ID NO: 1008429 - protein, 9 aa, Homo Sapiens
ERRLSWERG

SEQ ID NO: 1008430 - protein, 9 aa, Homo Sapiens
IKAGKDDLG

SEQ ID NO: 1008431 - protein, 9 aa, Homo Sapiens
DHIARKVGL

SEQ ID NO: 1008432 - protein, 9 aa, Homo Sapiens
EEEPFIDPQ

SEQ ID NO: 1008433 - protein, 9 aa, Homo Sapiens
ASLPKVTLE

SEQ ID NO: 1008434 - protein, 9 aa, Homo Sapiens
RCGRHIYST

SEQ ID NO: 1008435 - protein, 9 aa, Homo Sapiens
VNMPPENSL

SEQ ID NO: 1008436 - protein, 9 aa, Homo Sapiens
TELRSQVQE

SEQ ID NO: 1008437 - protein, 9 aa, Homo Sapiens
SRKEATEKP

SEQ ID NO: 1008438 - protein, 9 aa, Homo Sapiens
VFTRKDNLG

SEQ ID NO: 1008439 - protein, 9 aa, Homo Sapiens
GGPGFSVCP

SEQ ID NO: 1008440 - protein, 9 aa, Homo Sapiens
VSSLPLSHP

SEQ ID NO: 1008441 - protein, 9 aa, Homo Sapiens
DNAGVSPIE

SEQ ID NO: 1008442 - protein, 9 aa, Homo Sapiens
IMYRQLNGL

SEQ ID NO: 1008443 - protein, 9 aa, Homo Sapiens
NSEAFKGKR

SEQ ID NO: 1008444 - protein, 9 aa, Homo Sapiens
RARFRTLLT

SEQ ID NO: 1008445 - protein, 9 aa, Homo Sapiens
VKVAEYKYQ

SEQ ID NO: 1008446 - protein, 9 aa, Homo Sapiens
YFAYYYGLL

SEQ ID NO: 1008447 - protein, 9 aa, Homo Sapiens
LADETELRG

SEQ ID NO: 1008448 - protein, 9 aa, Homo Sapiens
KISTLSNQS

SEQ ID NO: 1008449 - protein, 9 aa, Homo Sapiens
VSEDSAANG

SEQ ID NO: 1008450 - protein, 9 aa, Homo Sapiens
SFHLLVFTK

SEQ ID NO: 1008451 - protein, 9 aa, Homo Sapiens
TAFCLGWEL

SEQ ID NO: 1008452 - protein, 9 aa, Homo Sapiens
RSQEYRIER

SEQ ID NO: 1008453 - protein, 9 aa, Homo Sapiens
YLRGQRNDR

SEQ ID NO: 1008454 - protein, 9 aa, Homo Sapiens
KLFQAGDVC

SEQ ID NO: 1008455 - protein, 9 aa, Homo Sapiens
PRRVVAMSV

SEQ ID NO: 1008456 - protein, 9 aa, Homo Sapiens
LRRNSMKEC

SEQ ID NO: 1008457 - protein, 9 aa, Homo Sapiens
MLRAVRSLL

SEQ ID NO: 1008458 - protein, 9 aa, Homo Sapiens
ETQPFSSNE

SEQ ID NO: 1008459 - protein, 9 aa, Homo Sapiens
TYLNKRQFY

SEQ ID NO: 1008460 - protein, 9 aa, Homo Sapiens
ERGFQEKPG

SEQ ID NO: 1008461 - protein, 9 aa, Homo Sapiens
IALWPPVWE

SEQ ID NO: 1008462 - protein, 9 aa, Homo Sapiens
YKNSEAFKG

SEQ ID NO: 1008463 - protein, 9 aa, Homo Sapiens
IYGQFYDLC

SEQ ID NO: 1008464 - protein, 9 aa, Homo Sapiens
SSDGYYRGN

SEQ ID NO: 1008465 - protein, 9 aa, Homo Sapiens
IPRSFNLER

SEQ ID NO: 1008466 - protein, 9 aa, Homo Sapiens
SFSECSSQC

SEQ ID NO: 1008467 - protein, 9 aa, Homo Sapiens
QRHGLANFI

SEQ ID NO: 1008468 - protein, 9 aa, Homo Sapiens
IIKKTINFA

SEQ ID NO: 1008469 - protein, 9 aa, Homo Sapiens
LPPRFGSEG

SEQ ID NO: 1008470 - protein, 9 aa, Homo Sapiens
TPDPSEKWG

SEQ ID NO: 1008471 - protein, 9 aa, Homo Sapiens
VTKCSDFAV

SEQ ID NO: 1008472 - protein, 9 aa, Homo Sapiens
LFLAAKDND

SEQ ID NO: 1008473 - protein, 9 aa, Homo Sapiens
PPLDTPKTA

SEQ ID NO: 1008474 - protein, 9 aa, Homo Sapiens
SPEESSNCE

SEQ ID NO: 1008475 - protein, 9 aa, Homo Sapiens
DRTWNETKP

SEQ ID NO: 1008476 - protein, 9 aa, Homo Sapiens
DAILAAITG

SEQ ID NO: 1008477 - protein, 9 aa, Homo Sapiens
KIRIIDWDR

SEQ ID NO: 1008478 - protein, 9 aa, Homo Sapiens
YAINLREVN

SEQ ID NO: 1008479 - protein, 9 aa, Homo Sapiens
LAVPGRTCT

SEQ ID NO: 1008480 - protein, 9 aa, Homo Sapiens
GRYETTKDY

SEQ ID NO: 1008481 - protein, 9 aa, Homo Sapiens
RPTAIGSFS

SEQ ID NO: 1008482 - protein, 9 aa, Homo Sapiens
VFVKNVDFT

SEQ ID NO: 1008483 - protein, 9 aa, Homo Sapiens
EDKCASSPC

SEQ ID NO: 1008484 - protein, 9 aa, Homo Sapiens
NQGFLRNHM

SEQ ID NO: 1008485 - protein, 9 aa, Homo Sapiens
DWNLLHIDP

SEQ ID NO: 1008486 - protein, 9 aa, Homo Sapiens
RHGLANFIS

SEQ ID NO: 1008487 - protein, 9 aa, Homo Sapiens
IRSLVDSYM

SEQ ID NO: 1008488 - protein, 9 aa, Homo Sapiens
AIQRSDAGT

SEQ ID NO: 1008489 - protein, 9 aa, Homo Sapiens
YFQKITLYL

SEQ ID NO: 1008490 - protein, 9 aa, Homo Sapiens
WEKRVRIYL

SEQ ID NO: 1008491 - protein, 9 aa, Homo Sapiens
FTRKDNLGD

SEQ ID NO: 1008492 - protein, 9 aa, Homo Sapiens
KSFTKLFAL

SEQ ID NO: 1008493 - protein, 9 aa, Homo Sapiens
FDGPLSPPP

SEQ ID NO: 1008494 - protein, 9 aa, Homo Sapiens
LDNATFLSA

SEQ ID NO: 1008495 - protein, 9 aa, Homo Sapiens
LIGNHAQRV

SEQ ID NO: 1008496 - protein, 9 aa, Homo Sapiens
FCCTIVDGV

SEQ ID NO: 1008497 - protein, 9 aa, Homo Sapiens
RDPGQGTVA

SEQ ID NO: 1008498 - protein, 9 aa, Homo Sapiens
CANRLLIYK

SEQ ID NO: 1008499 - protein, 9 aa, Homo Sapiens
FLHYNFVLN

SEQ ID NO: 1008500 - protein, 9 aa, Homo Sapiens
SAFNPDVGE

SEQ ID NO: 1008501 - protein, 9 aa, Homo Sapiens
KEATEKPWL

SEQ ID NO: 1008502 - protein, 9 aa, Homo Sapiens
EERSHHHYP

SEQ ID NO: 1008503 - protein, 9 aa, Homo Sapiens
GQVNNASAS

SEQ ID NO: 1008504 - protein, 9 aa, Homo Sapiens
RGDHSFREQ

SEQ ID NO: 1008505 - protein, 9 aa, Homo Sapiens
DNGFVKTQG

SEQ ID NO: 1008506 - protein, 9 aa, Homo Sapiens
GDDVFKASV

SEQ ID NO: 1008507 - protein, 9 aa, Homo Sapiens
QNKLWIEIT

SEQ ID NO: 1008508 - protein, 9 aa, Homo Sapiens
GLSNVYKKR

SEQ ID NO: 1008509 - protein, 9 aa, Homo Sapiens
ASYAVFFAA

SEQ ID NO: 1008510 - protein, 9 aa, Homo Sapiens
IHWISNNLS

SEQ ID NO: 1008511 - protein, 9 aa, Homo Sapiens
RASFAMRNV

SEQ ID NO: 1008512 - protein, 9 aa, Homo Sapiens
GSLEGFSPR

SEQ ID NO: 1008513 - protein, 9 aa, Homo Sapiens
ESPLFLAAK

SEQ ID NO: 1008514 - protein, 9 aa, Homo Sapiens
RGELGIGLP

SEQ ID NO: 1008515 - protein, 9 aa, Homo Sapiens
CITNPLLRE

SEQ ID NO: 1008516 - protein, 9 aa, Homo Sapiens
FSDWDWDRR

SEQ ID NO: 1008517 - protein, 9 aa, Homo Sapiens
NETKPVCKA

SEQ ID NO: 1008518 - protein, 9 aa, Homo Sapiens
PRSSSPRTR

SEQ ID NO: 1008519 - protein, 9 aa, Homo Sapiens
PLDSAFNPD

SEQ ID NO: 1008520 - protein, 9 aa, Homo Sapiens
EALPFARPL

SEQ ID NO: 1008521 - protein, 9 aa, Homo Sapiens
VNCSQAPVL

SEQ ID NO: 1008522 - protein, 9 aa, Homo Sapiens
EDPLVDNQN

SEQ ID NO: 1008523 - protein, 9 aa, Homo Sapiens
PAQRLGRYH

SEQ ID NO: 1008524 - protein, 9 aa, Homo Sapiens
LARKVEVNS

SEQ ID NO: 1008525 - protein, 9 aa, Homo Sapiens
LVLLTTKLF

SEQ ID NO: 1008526 - protein, 9 aa, Homo Sapiens
NSRCLLNEE

SEQ ID NO: 1008527 - protein, 9 aa, Homo Sapiens
APRGIPSLN

SEQ ID NO: 1008528 - protein, 9 aa, Homo Sapiens
PVCGFDGHT

SEQ ID NO: 1008529 - protein, 9 aa, Homo Sapiens
RVKRQWEKK

SEQ ID NO: 1008530 - protein, 9 aa, Homo Sapiens
QQNQLTERD

SEQ ID NO: 1008531 - protein, 9 aa, Homo Sapiens
TLVENFTII

SEQ ID NO: 1008532 - protein, 9 aa, Homo Sapiens
GQLGSFPTF

SEQ ID NO: 1008533 - protein, 9 aa, Homo Sapiens
EESIPVTKT

SEQ ID NO: 1008534 - protein, 9 aa, Homo Sapiens
LAPTPTPSP

SEQ ID NO: 1008535 - protein, 9 aa, Homo Sapiens
RRVVAMSVA

SEQ ID NO: 1008536 - protein, 9 aa, Homo Sapiens
CEVDEDKCA

SEQ ID NO: 1008537 - protein, 9 aa, Homo Sapiens
EDVRSVTQK

SEQ ID NO: 1008538 - protein, 9 aa, Homo Sapiens
DVVVSMYYL

SEQ ID NO: 1008539 - protein, 9 aa, Homo Sapiens
LGERVYEVV

SEQ ID NO: 1008540 - protein, 9 aa, Homo Sapiens
ACVLVFLLS

SEQ ID NO: 1008541 - protein, 9 aa, Homo Sapiens
KMLKKNVKV

SEQ ID NO: 1008542 - protein, 9 aa, Homo Sapiens
EDEPDEFLQ

SEQ ID NO: 1008543 - protein, 9 aa, Homo Sapiens
TRGCAGPHQ

SEQ ID NO: 1008544 - protein, 9 aa, Homo Sapiens
KKTIKNKAN

SEQ ID NO: 1008545 - protein, 9 aa, Homo Sapiens
KMKIRIIDW

SEQ ID NO: 1008546 - protein, 9 aa, Homo Sapiens
KSKTIQTDY

SEQ ID NO: 1008547 - protein, 9 aa, Homo Sapiens
PDGDYNYDQ

SEQ ID NO: 1008548 - protein, 9 aa, Homo Sapiens
PSTEQACLI

SEQ ID NO: 1008549 - protein, 9 aa, Homo Sapiens
SLSRQNCLF

SEQ ID NO: 1008550 - protein, 9 aa, Homo Sapiens
LFTSSVSSQ

SEQ ID NO: 1008551 - protein, 9 aa, Homo Sapiens
SPEKVFSEC

SEQ ID NO: 1008552 - protein, 9 aa, Homo Sapiens
SGSLSCTHP

SEQ ID NO: 1008553 - protein, 9 aa, Homo Sapiens
GFEPGVTSI

SEQ ID NO: 1008554 - protein, 9 aa, Homo Sapiens
NLLTSNYIF

SEQ ID NO: 1008555 - protein, 9 aa, Homo Sapiens
NNYTCRLWS

SEQ ID NO: 1008556 - protein, 9 aa, Homo Sapiens
TQPPSIDCA

SEQ ID NO: 1008557 - protein, 9 aa, Homo Sapiens
MENNFRRPN

SEQ ID NO: 1008558 - protein, 9 aa, Homo Sapiens
RKLIDSARR

SEQ ID NO: 1008559 - protein, 9 aa, Homo Sapiens
RDYVIEDNV

SEQ ID NO: 1008560 - protein, 9 aa, Homo Sapiens
VLGTIFSAS

SEQ ID NO: 1008561 - protein, 9 aa, Homo Sapiens
LDLYISIFT

SEQ ID NO: 1008562 - protein, 9 aa, Homo Sapiens
SEVPFYYNE

SEQ ID NO: 1008563 - protein, 9 aa, Homo Sapiens
GNSENGHSS

SEQ ID NO: 1008564 - protein, 9 aa, Homo Sapiens
FTKLFALME

SEQ ID NO: 1008565 - protein, 9 aa, Homo Sapiens
YELIRKLVD

SEQ ID NO: 1008566 - protein, 9 aa, Homo Sapiens
KRLQKETGA

SEQ ID NO: 1008567 - protein, 9 aa, Homo Sapiens
TIHWISNNL

SEQ ID NO: 1008568 - protein, 9 aa, Homo Sapiens
NGNFLYVFH

SEQ ID NO: 1008569 - protein, 9 aa, Homo Sapiens
LTQGLSNVY

SEQ ID NO: 1008570 - protein, 9 aa, Homo Sapiens
DKLKAKRER

SEQ ID NO: 1008571 - protein, 9 aa, Homo Sapiens
DGSFEIENL

SEQ ID NO: 1008572 - protein, 9 aa, Homo Sapiens
KSIRVLLDL

SEQ ID NO: 1008573 - protein, 9 aa, Homo Sapiens
STLPVDIST

SEQ ID NO: 1008574 - protein, 9 aa, Homo Sapiens
RGSPSSHLT

SEQ ID NO: 1008575 - protein, 9 aa, Homo Sapiens
ENGLQSCQI

SEQ ID NO: 1008576 - protein, 9 aa, Homo Sapiens
GYLHAKEIL

SEQ ID NO: 1008577 - protein, 9 aa, Homo Sapiens
RGTQALRSC

SEQ ID NO: 1008578 - protein, 9 aa, Homo Sapiens
FLGERVYEV

SEQ ID NO: 1008579 - protein, 9 aa, Homo Sapiens
YPPEDRRVY

SEQ ID NO: 1008580 - protein, 9 aa, Homo Sapiens
ENMKWNYKY

SEQ ID NO: 1008581 - protein, 9 aa, Homo Sapiens
AMAAVRDKI

SEQ ID NO: 1008582 - protein, 9 aa, Homo Sapiens
DAVPSKVRD

SEQ ID NO: 1008583 - protein, 9 aa, Homo Sapiens
VTGAVLFLS

SEQ ID NO: 1008584 - protein, 9 aa, Homo Sapiens
FQFQYVMQA

SEQ ID NO: 1008585 - protein, 9 aa, Homo Sapiens
FFVESQYSQ

SEQ ID NO: 1008586 - protein, 9 aa, Homo Sapiens
VHKTRVQNV

SEQ ID NO: 1008587 - protein, 9 aa, Homo Sapiens
PLFPLPGPK

SEQ ID NO: 1008588 - protein, 9 aa, Homo Sapiens
SNSLGLIFD

SEQ ID NO: 1008589 - protein, 9 aa, Homo Sapiens
PLPQKKITN

SEQ ID NO: 1008590 - protein, 9 aa, Homo Sapiens
MKIRIIDWD

SEQ ID NO: 1008591 - protein, 9 aa, Homo Sapiens
VPIKDELFP

SEQ ID NO: 1008592 - protein, 9 aa, Homo Sapiens
HCSPNGTNP

SEQ ID NO: 1008593 - protein, 9 aa, Homo Sapiens
IADYLGILP

SEQ ID NO: 1008594 - protein, 9 aa, Homo Sapiens
LTQQSFHLL

SEQ ID NO: 1008595 - protein, 9 aa, Homo Sapiens
IPEVARQFS

SEQ ID NO: 1008596 - protein, 9 aa, Homo Sapiens
QDNYGGYAS

SEQ ID NO: 1008597 - protein, 9 aa, Homo Sapiens
ASVARFRGT

SEQ ID NO: 1008598 - protein, 9 aa, Homo Sapiens
IEAAQFSDT

SEQ ID NO: 1008599 - protein, 9 aa, Homo Sapiens
QHVYNPVDW

SEQ ID NO: 1008600 - protein, 9 aa, Homo Sapiens
FLSVQCRYE

SEQ ID NO: 1008601 - protein, 9 aa, Homo Sapiens
TQEFPKEEW

SEQ ID NO: 1008602 - protein, 9 aa, Homo Sapiens
TQYGRVICQ

SEQ ID NO: 1008603 - protein, 9 aa, Homo Sapiens
HLSLLQDYM

SEQ ID NO: 1008604 - protein, 9 aa, Homo Sapiens
KKQTRNARA

SEQ ID NO: 1008605 - protein, 9 aa, Homo Sapiens
FYGDRIDLS

SEQ ID NO: 1008606 - protein, 9 aa, Homo Sapiens
KEQEEPRGT

SEQ ID NO: 1008607 - protein, 9 aa, Homo Sapiens
QLHRTCNPG

SEQ ID NO: 1008608 - protein, 9 aa, Homo Sapiens
PGDSDLVGA

SEQ ID NO: 1008609 - protein, 9 aa, Homo Sapiens
QTTVCRLVT

SEQ ID NO: 1008610 - protein, 9 aa, Homo Sapiens
PGVALSSQG

SEQ ID NO: 1008611 - protein, 9 aa, Homo Sapiens
SSVKPGTEE

SEQ ID NO: 1008612 - protein, 9 aa, Homo Sapiens
SYIKQPAGA

SEQ ID NO: 1008613 - protein, 9 aa, Homo Sapiens
NLLKTIGIS

SEQ ID NO: 1008614 - protein, 9 aa, Homo Sapiens
KMMIILVVI

SEQ ID NO: 1008615 - protein, 9 aa, Homo Sapiens
PQKKITNII

SEQ ID NO: 1008616 - protein, 9 aa, Homo Sapiens
LSSLQIPQS

SEQ ID NO: 1008617 - protein, 9 aa, Homo Sapiens
NFLTGLGHK

SEQ ID NO: 1008618 - protein, 9 aa, Homo Sapiens
TRRELAKLV

SEQ ID NO: 1008619 - protein, 9 aa, Homo Sapiens
SNRATCHRK

SEQ ID NO: 1008620 - protein, 9 aa, Homo Sapiens
EGSSPTSEG

SEQ ID NO: 1008621 - protein, 9 aa, Homo Sapiens
LHVIDLDNA

SEQ ID NO: 1008622 - protein, 9 aa, Homo Sapiens
RRLVFTLST

SEQ ID NO: 1008623 - protein, 9 aa, Homo Sapiens
PSQPERVYL

SEQ ID NO: 1008624 - protein, 9 aa, Homo Sapiens
HLTKHKRIY

SEQ ID NO: 1008625 - protein, 9 aa, Homo Sapiens
KILSVIMGV

SEQ ID NO: 1008626 - protein, 9 aa, Homo Sapiens
KKSIRVLLD

SEQ ID NO: 1008627 - protein, 9 aa, Homo Sapiens
SSVSFHCDN

SEQ ID NO: 1008628 - protein, 9 aa, Homo Sapiens
KEIRKVTGK

SEQ ID NO: 1008629 - protein, 9 aa, Homo Sapiens
SSRDKEKLP

SEQ ID NO: 1008630 - protein, 9 aa, Homo Sapiens
WSQVLPQEG

SEQ ID NO: 1008631 - protein, 9 aa, Homo Sapiens
TFYSLKDYV

SEQ ID NO: 1008632 - protein, 9 aa, Homo Sapiens
CQLEVALIR

SEQ ID NO: 1008633 - protein, 9 aa, Homo Sapiens
VSAGGRGPG

SEQ ID NO: 1008634 - protein, 9 aa, Homo Sapiens
PSLNDHGSL

SEQ ID NO: 1008635 - protein, 9 aa, Homo Sapiens
YSRYLNKKA

SEQ ID NO: 1008636 - protein, 9 aa, Homo Sapiens
PMTYLNKRQ

SEQ ID NO: 1008637 - protein, 9 aa, Homo Sapiens
QDMEHLQRQ

SEQ ID NO: 1008638 - protein, 9 aa, Homo Sapiens
VSKLQKLAR

SEQ ID NO: 1008639 - protein, 9 aa, Homo Sapiens
EMCHKFQAF

SEQ ID NO: 1008640 - protein, 9 aa, Homo Sapiens
LELICKGKS

SEQ ID NO: 1008641 - protein, 9 aa, Homo Sapiens
TLSEKMTYL

SEQ ID NO: 1008642 - protein, 9 aa, Homo Sapiens
FLLEVVYTS

SEQ ID NO: 1008643 - protein, 9 aa, Homo Sapiens
TSRKKETRN

SEQ ID NO: 1008644 - protein, 9 aa, Homo Sapiens
MLHGIVFAR

SEQ ID NO: 1008645 - protein, 9 aa, Homo Sapiens
QVGPLAGVR

SEQ ID NO: 1008646 - protein, 9 aa, Homo Sapiens
ARFRTLLTV

SEQ ID NO: 1008647 - protein, 9 aa, Homo Sapiens
TLHYKVNHK

SEQ ID NO: 1008648 - protein, 9 aa, Homo Sapiens
KVPVGQKVE

SEQ ID NO: 1008649 - protein, 9 aa, Homo Sapiens
SVLHCINPG

SEQ ID NO: 1008650 - protein, 9 aa, Homo Sapiens
DPILTAFCL

SEQ ID NO: 1008651 - protein, 9 aa, Homo Sapiens
IKILLQEYR

SEQ ID NO: 1008652 - protein, 9 aa, Homo Sapiens
MEIPHFFCN

SEQ ID NO: 1008653 - protein, 9 aa, Homo Sapiens
DLTSLGHNK

SEQ ID NO: 1008654 - protein, 9 aa, Homo Sapiens
PLLENLIIS

SEQ ID NO: 1008655 - protein, 9 aa, Homo Sapiens
RGRWCYTHA

SEQ ID NO: 1008656 - protein, 9 aa, Homo Sapiens
SNNVREISV

SEQ ID NO: 1008657 - protein, 9 aa, Homo Sapiens
TEGSESNDF

SEQ ID NO: 1008658 - protein, 9 aa, Homo Sapiens
LPGSLALTS

SEQ ID NO: 1008659 - protein, 9 aa, Homo Sapiens
CEAKEGKTD

SEQ ID NO: 1008660 - protein, 9 aa, Homo Sapiens
QFWAIQRRL

SEQ ID NO: 1008661 - protein, 9 aa, Homo Sapiens
APHVVSITM

SEQ ID NO: 1008662 - protein, 9 aa, Homo Sapiens
RVVAMSVAK

SEQ ID NO: 1008663 - protein, 9 aa, Homo Sapiens
SEAFKGKRV

SEQ ID NO: 1008664 - protein, 9 aa, Homo Sapiens
SYAVFFAAY

SEQ ID NO: 1008665 - protein, 9 aa, Homo Sapiens
PNTSPTAAF

SEQ ID NO: 1008666 - protein, 9 aa, Homo Sapiens
LNKKAFSYR

SEQ ID NO: 1008667 - protein, 9 aa, Homo Sapiens
GDVYGVMKA

SEQ ID NO: 1008668 - protein, 9 aa, Homo Sapiens
MPPENSLYL

SEQ ID NO: 1008669 - protein, 9 aa, Homo Sapiens
SLIFLANLP

SEQ ID NO: 1008670 - protein, 9 aa, Homo Sapiens
AALAPARTN

SEQ ID NO: 1008671 - protein, 9 aa, Homo Sapiens
RVKAVKILA

SEQ ID NO: 1008672 - protein, 9 aa, Homo Sapiens
ATCHRKPDN

SEQ ID NO: 1008673 - protein, 9 aa, Homo Sapiens
GVRAAAGAL

SEQ ID NO: 1008674 - protein, 9 aa, Homo Sapiens
HCDNGFVKT

SEQ ID NO: 1008675 - protein, 9 aa, Homo Sapiens
KLVKRKQEL

SEQ ID NO: 1008676 - protein, 9 aa, Homo Sapiens
GVVNENTFK

SEQ ID NO: 1008677 - protein, 9 aa, Homo Sapiens
GHCGHLKVL

SEQ ID NO: 1008678 - protein, 9 aa, Homo Sapiens
LPENFLIIF

SEQ ID NO: 1008679 - protein, 9 aa, Homo Sapiens
DIKNEIAEL

SEQ ID NO: 1008680 - protein, 9 aa, Homo Sapiens
AALISSENV

SEQ ID NO: 1008681 - protein, 9 aa, Homo Sapiens
FSEDFESCD

SEQ ID NO: 1008682 - protein, 9 aa, Homo Sapiens
ITYHAHLQR

SEQ ID NO: 1008683 - protein, 9 aa, Homo Sapiens
QGFLRNHMR

SEQ ID NO: 1008684 - protein, 9 aa, Homo Sapiens
TSSQIRVPS

SEQ ID NO: 1008685 - protein, 9 aa, Homo Sapiens
LDCYVAICY

SEQ ID NO: 1008686 - protein, 9 aa, Homo Sapiens
CPLVVTMRS

SEQ ID NO: 1008687 - protein, 9 aa, Homo Sapiens
FDSAPGDSD

SEQ ID NO: 1008688 - protein, 9 aa, Homo Sapiens
GGKDRKLFV

SEQ ID NO: 1008689 - protein, 9 aa, Homo Sapiens
TISLANRLI

SEQ ID NO: 1008690 - protein, 9 aa, Homo Sapiens
EILSFADGC

SEQ ID NO: 1008691 - protein, 9 aa, Homo Sapiens
DKNISLHNF

SEQ ID NO: 1008692 - protein, 9 aa, Homo Sapiens
FQELESDDG

SEQ ID NO: 1008693 - protein, 9 aa, Homo Sapiens
IDTRIKNLA

SEQ ID NO: 1008694 - protein, 9 aa, Homo Sapiens
SGVCGHKVE

SEQ ID NO: 1008695 - protein, 9 aa, Homo Sapiens
RYAAICKPL

SEQ ID NO: 1008696 - protein, 9 aa, Homo Sapiens
ESYLGVNLG

SEQ ID NO: 1008697 - protein, 9 aa, Homo Sapiens
PEEKERMHD

SEQ ID NO: 1008698 - protein, 9 aa, Homo Sapiens
TTVNGSKQG

SEQ ID NO: 1008699 - protein, 9 aa, Homo Sapiens
PLDYQATSL

SEQ ID NO: 1008700 - protein, 9 aa, Homo Sapiens
QEEFLELPK

SEQ ID NO: 1008701 - protein, 9 aa, Homo Sapiens
TMDTEILNT

SEQ ID NO: 1008702 - protein, 9 aa, Homo Sapiens
LQELRDIDT

SEQ ID NO: 1008703 - protein, 9 aa, Homo Sapiens
FCVERENMK

SEQ ID NO: 1008704 - protein, 9 aa, Homo Sapiens
FEEDPAVGV

SEQ ID NO: 1008705 - protein, 9 aa, Homo Sapiens
IDCAEGRAA

SEQ ID NO: 1008706 - protein, 9 aa, Homo Sapiens
YDRYAAICK

SEQ ID NO: 1008707 - protein, 9 aa, Homo Sapiens
FFKLDKGQK

SEQ ID NO: 1008708 - protein, 9 aa, Homo Sapiens
RLSLLEDIM

SEQ ID NO: 1008709 - protein, 9 aa, Homo Sapiens
RFRTLLTVI

SEQ ID NO: 1008710 - protein, 9 aa, Homo Sapiens
YIAYRHNQK

SEQ ID NO: 1008711 - protein, 9 aa, Homo Sapiens
EQIGKKLNL

SEQ ID NO: 1008712 - protein, 9 aa, Homo Sapiens
AASNLSYCA

SEQ ID NO: 1008713 - protein, 9 aa, Homo Sapiens
GRLASCGAA

SEQ ID NO: 1008714 - protein, 9 aa, Homo Sapiens
FGFTIIGED

SEQ ID NO: 1008715 - protein, 9 aa, Homo Sapiens
VLLAMAFDC

SEQ ID NO: 1008716 - protein, 9 aa, Homo Sapiens
NLELEFTRN

SEQ ID NO: 1008717 - protein, 9 aa, Homo Sapiens
ALGATFSVI

SEQ ID NO: 1008718 - protein, 9 aa, Homo Sapiens
SEIQKLFDI

SEQ ID NO: 1008719 - protein, 9 aa, Homo Sapiens
SRSRSPSLA

SEQ ID NO: 1008720 - protein, 9 aa, Homo Sapiens
EKVKHENQQ

SEQ ID NO: 1008721 - protein, 9 aa, Homo Sapiens
EGRMHKEKV

SEQ ID NO: 1008722 - protein, 9 aa, Homo Sapiens
FSVCPPGGI

SEQ ID NO: 1008723 - protein, 9 aa, Homo Sapiens
RHYAAFLLP

SEQ ID NO: 1008724 - protein, 9 aa, Homo Sapiens
EGQDKPPGI

SEQ ID NO: 1008725 - protein, 9 aa, Homo Sapiens
NFLYVFHLF

SEQ ID NO: 1008726 - protein, 9 aa, Homo Sapiens
LTAFCLGWE

SEQ ID NO: 1008727 - protein, 9 aa, Homo Sapiens
KGMKTLTQL

SEQ ID NO: 1008728 - protein, 9 aa, Homo Sapiens
LYTHSQTNN

SEQ ID NO: 1008729 - protein, 9 aa, Homo Sapiens
GVISVYDLV

SEQ ID NO: 1008730 - protein, 9 aa, Homo Sapiens
HKSFTKLFA

SEQ ID NO: 1008731 - protein, 9 aa, Homo Sapiens
RISSTKRVC

SEQ ID NO: 1008732 - protein, 9 aa, Homo Sapiens
KGQDVDSKK

SEQ ID NO: 1008733 - protein, 9 aa, Homo Sapiens
DSAANGTPK

SEQ ID NO: 1008734 - protein, 9 aa, Homo Sapiens
KNWYSLVIC

SEQ ID NO: 1008735 - protein, 9 aa, Homo Sapiens
ENLIISDIN

SEQ ID NO: 1008736 - protein, 9 aa, Homo Sapiens
AGTYRGDSH

SEQ ID NO: 1008737 - protein, 9 aa, Homo Sapiens
LSPVCSRLE

SEQ ID NO: 1008738 - protein, 9 aa, Homo Sapiens
LEQIGKKLN

SEQ ID NO: 1008739 - protein, 9 aa, Homo Sapiens
SRTYESSDC

SEQ ID NO: 1008740 - protein, 9 aa, Homo Sapiens
SVSTKRLEK

SEQ ID NO: 1008741 - protein, 9 aa, Homo Sapiens
FVNGKKMKS

SEQ ID NO: 1008742 - protein, 9 aa, Homo Sapiens
GPTAGRNLL

SEQ ID NO: 1008743 - protein, 9 aa, Homo Sapiens
VKYKCEQGY

SEQ ID NO: 1008744 - protein, 9 aa, Homo Sapiens
QRHPDLPRW

SEQ ID NO: 1008745 - protein, 9 aa, Homo Sapiens
ESGLCWVQF

SEQ ID NO: 1008746 - protein, 9 aa, Homo Sapiens
RQFYAITLS

SEQ ID NO: 1008747 - protein, 9 aa, Homo Sapiens
LRTERDGVY

SEQ ID NO: 1008748 - protein, 9 aa, Homo Sapiens
GPVGGFLSV

SEQ ID NO: 1008749 - protein, 9 aa, Homo Sapiens
IKLEPESYL

SEQ ID NO: 1008750 - protein, 9 aa, Homo Sapiens
MEKSPLRKE

SEQ ID NO: 1008751 - protein, 9 aa, Homo Sapiens
FCVSGILSH

SEQ ID NO: 1008752 - protein, 9 aa, Homo Sapiens
CYVAICYPL

SEQ ID NO: 1008753 - protein, 9 aa, Homo Sapiens
EDIMYRQLN

SEQ ID NO: 1008754 - protein, 9 aa, Homo Sapiens
FREQGHAPG

SEQ ID NO: 1008755 - protein, 9 aa, Homo Sapiens
QTDTEEDPL

SEQ ID NO: 1008756 - protein, 9 aa, Homo Sapiens
NCKEDDIAG

SEQ ID NO: 1008757 - protein, 9 aa, Homo Sapiens
SPNGTNPYK

SEQ ID NO: 1008758 - protein, 9 aa, Homo Sapiens
SHPSPYMPR

SEQ ID NO: 1008759 - protein, 9 aa, Homo Sapiens
DFQEPSETQ

SEQ ID NO: 1008760 - protein, 9 aa, Homo Sapiens
PSRPLSGSQ

SEQ ID NO: 1008761 - protein, 9 aa, Homo Sapiens
SPSFPDLSA

SEQ ID NO: 1008762 - protein, 9 aa, Homo Sapiens
SYKHNRTEL

SEQ ID NO: 1008763 - protein, 9 aa, Homo Sapiens
FLLSIVLHN

SEQ ID NO: 1008764 - protein, 9 aa, Homo Sapiens
LFTAPLSPP

SEQ ID NO: 1008765 - protein, 9 aa, Homo Sapiens
RTELTLRYS

SEQ ID NO: 1008766 - protein, 9 aa, Homo Sapiens
VVIPRSFNL

SEQ ID NO: 1008767 - protein, 9 aa, Homo Sapiens
MYQVLHERF

SEQ ID NO: 1008768 - protein, 9 aa, Homo Sapiens
KPNNSDLTL

SEQ ID NO: 1008769 - protein, 9 aa, Homo Sapiens
SEKEAIEVF

SEQ ID NO: 1008770 - protein, 9 aa, Homo Sapiens
HDSLSPRGV

SEQ ID NO: 1008771 - protein, 9 aa, Homo Sapiens
QPVCGFDGH

SEQ ID NO: 1008772 - protein, 9 aa, Homo Sapiens
MARKIDNFY

SEQ ID NO: 1008773 - protein, 9 aa, Homo Sapiens
YPNAFCIAK

SEQ ID NO: 1008774 - protein, 9 aa, Homo Sapiens
TTPLSGPSP

SEQ ID NO: 1008775 - protein, 9 aa, Homo Sapiens
ESEDFEIVI

SEQ ID NO: 1008776 - protein, 9 aa, Homo Sapiens
HIPQTDTEE

SEQ ID NO: 1008777 - protein, 9 aa, Homo Sapiens
HCRKIFPGL

SEQ ID NO: 1008778 - protein, 9 aa, Homo Sapiens
NLHVKPCGT

SEQ ID NO: 1008779 - protein, 9 aa, Homo Sapiens
REQERTEST

SEQ ID NO: 1008780 - protein, 9 aa, Homo Sapiens
IRKANPGSE

SEQ ID NO: 1008781 - protein, 9 aa, Homo Sapiens
PYALIKEII

SEQ ID NO: 1008782 - protein, 9 aa, Homo Sapiens
EKSSLEGAW

SEQ ID NO: 1008783 - protein, 9 aa, Homo Sapiens
QGQVAGALI

SEQ ID NO: 1008784 - protein, 9 aa, Homo Sapiens
DEKEMMEWT

SEQ ID NO: 1008785 - protein, 9 aa, Homo Sapiens
LICSRVSGW

SEQ ID NO: 1008786 - protein, 9 aa, Homo Sapiens
DSSQAILIT

SEQ ID NO: 1008787 - protein, 9 aa, Homo Sapiens
ICSMGCDLP

SEQ ID NO: 1008788 - protein, 9 aa, Homo Sapiens
APEAKGPLP

SEQ ID NO: 1008789 - protein, 9 aa, Homo Sapiens
VFYVDVEVR

SEQ ID NO: 1008790 - protein, 9 aa, Homo Sapiens
VFLLEVVYT

SEQ ID NO: 1008791 - protein, 9 aa, Homo Sapiens
MDSSAHRSR

SEQ ID NO: 1008792 - protein, 9 aa, Homo Sapiens
EQEITPRHK

SEQ ID NO: 1008793 - protein, 9 aa, Homo Sapiens
PNGCCSANE

SEQ ID NO: 1008794 - protein, 9 aa, Homo Sapiens
REWVHSNFH

SEQ ID NO: 1008795 - protein, 9 aa, Homo Sapiens
YFATLIIIG

SEQ ID NO: 1008796 - protein, 9 aa, Homo Sapiens
NVNVKVDTS

SEQ ID NO: 1008797 - protein, 9 aa, Homo Sapiens
LIHNLQEEI

SEQ ID NO: 1008798 - protein, 9 aa, Homo Sapiens
NVAVLSRSN

SEQ ID NO: 1008799 - protein, 9 aa, Homo Sapiens
VSSSHPPPA

SEQ ID NO: 1008800 - protein, 9 aa, Homo Sapiens
ERKSKRRVR

SEQ ID NO: 1008801 - protein, 9 aa, Homo Sapiens
FLFFFYGIV

SEQ ID NO: 1008802 - protein, 9 aa, Homo Sapiens
TCQNFIGKQ

SEQ ID NO: 1008803 - protein, 9 aa, Homo Sapiens
LMTHGFYRV

SEQ ID NO: 1008804 - protein, 9 aa, Homo Sapiens
LSYCAPFQL

SEQ ID NO: 1008805 - protein, 9 aa, Homo Sapiens
PALSGPPPP

SEQ ID NO: 1008806 - protein, 9 aa, Homo Sapiens
FLEQANSFP

SEQ ID NO: 1008807 - protein, 9 aa, Homo Sapiens
LQVFYVDVE

SEQ ID NO: 1008808 - protein, 9 aa, Homo Sapiens
KVTLETPCE

SEQ ID NO: 1008809 - protein, 9 aa, Homo Sapiens
RKYFQKITL

SEQ ID NO: 1008810 - protein, 9 aa, Homo Sapiens
DWCTQIFLF

SEQ ID NO: 1008811 - protein, 9 aa, Homo Sapiens
AERYSFPIV

SEQ ID NO: 1008812 - protein, 9 aa, Homo Sapiens
GSSGSLSCT

SEQ ID NO: 1008813 - protein, 9 aa, Homo Sapiens
VDSKKAQLI

SEQ ID NO: 1008814 - protein, 9 aa, Homo Sapiens
LEGLSELGR

SEQ ID NO: 1008815 - protein, 9 aa, Homo Sapiens
PQPLEELDY

SEQ ID NO: 1008816 - protein, 9 aa, Homo Sapiens
KKLKGTTHS

SEQ ID NO: 1008817 - protein, 9 aa, Homo Sapiens
RPQRACLSS

SEQ ID NO: 1008818 - protein, 9 aa, Homo Sapiens
KISEGLQGA

SEQ ID NO: 1008819 - protein, 9 aa, Homo Sapiens
LKKEQLSLK

SEQ ID NO: 1008820 - protein, 9 aa, Homo Sapiens
DKFYIELLQ

SEQ ID NO: 1008821 - protein, 9 aa, Homo Sapiens
KENSRCLLN

SEQ ID NO: 1008822 - protein, 9 aa, Homo Sapiens
NHFHSMCFI

SEQ ID NO: 1008823 - protein, 9 aa, Homo Sapiens
GMGYLHAKE

SEQ ID NO: 1008824 - protein, 9 aa, Homo Sapiens
LCYDPEIKM

SEQ ID NO: 1008825 - protein, 9 aa, Homo Sapiens
NRGGDSGGG

SEQ ID NO: 1008826 - protein, 9 aa, Homo Sapiens
LEHCGSVDF

SEQ ID NO: 1008827 - protein, 9 aa, Homo Sapiens
AVVNWTFYA

SEQ ID NO: 1008828 - protein, 9 aa, Homo Sapiens
AYLVLDEAD

SEQ ID NO: 1008829 - protein, 9 aa, Homo Sapiens
KETGAKMSI

SEQ ID NO: 1008830 - protein, 9 aa, Homo Sapiens
EKLRDISYP

SEQ ID NO: 1008831 - protein, 9 aa, Homo Sapiens
QSIININRR

SEQ ID NO: 1008832 - protein, 9 aa, Homo Sapiens
HVQTNMPSY

SEQ ID NO: 1008833 - protein, 9 aa, Homo Sapiens
EKQIEVVKK

SEQ ID NO: 1008834 - protein, 9 aa, Homo Sapiens
TGPISEGGL

SEQ ID NO: 1008835 - protein, 9 aa, Homo Sapiens
VIILEGMVE

SEQ ID NO: 1008836 - protein, 9 aa, Homo Sapiens
VPVLIGNHA

SEQ ID NO: 1008837 - protein, 9 aa, Homo Sapiens
NGMLQEILS

SEQ ID NO: 1008838 - protein, 9 aa, Homo Sapiens
LSVRPNAAS

SEQ ID NO: 1008839 - protein, 9 aa, Homo Sapiens
KASDGKATR

SEQ ID NO: 1008840 - protein, 9 aa, Homo Sapiens
DKCASSPCQ

SEQ ID NO: 1008841 - protein, 9 aa, Homo Sapiens
LGHKSDHYN

SEQ ID NO: 1008842 - protein, 9 aa, Homo Sapiens
KPFIWAKPH

SEQ ID NO: 1008843 - protein, 9 aa, Homo Sapiens
YFENEEEYE

SEQ ID NO: 1008844 - protein, 9 aa, Homo Sapiens
QLQAGFFEH

SEQ ID NO: 1008845 - protein, 9 aa, Homo Sapiens
KASPPDLKS

SEQ ID NO: 1008846 - protein, 9 aa, Homo Sapiens
DEVEQARRL

SEQ ID NO: 1008847 - protein, 9 aa, Homo Sapiens
GMESPKAML

SEQ ID NO: 1008848 - protein, 9 aa, Homo Sapiens
IGDVYGVMK

SEQ ID NO: 1008849 - protein, 9 aa, Homo Sapiens
LFCTKVHPP

SEQ ID NO: 1008850 - protein, 9 aa, Homo Sapiens
EKVEIFHSL

SEQ ID NO: 1008851 - protein, 9 aa, Homo Sapiens
KYECVKEHG

SEQ ID NO: 1008852 - protein, 9 aa, Homo Sapiens
RERKRDRER

SEQ ID NO: 1008853 - protein, 9 aa, Homo Sapiens
VSEASITHF

SEQ ID NO: 1008854 - protein, 9 aa, Homo Sapiens
VPSKVRDWL

SEQ ID NO: 1008855 - protein, 9 aa, Homo Sapiens
NVEYTFTRI

SEQ ID NO: 1008856 - protein, 9 aa, Homo Sapiens
EIKTQLILG

SEQ ID NO: 1008857 - protein, 9 aa, Homo Sapiens
TFFIAVTEV

SEQ ID NO: 1008858 - protein, 9 aa, Homo Sapiens
HICFISELA

SEQ ID NO: 1008859 - protein, 9 aa, Homo Sapiens
WMIASQANL

SEQ ID NO: 1008860 - protein, 9 aa, Homo Sapiens
SIPGQQDKD

SEQ ID NO: 1008861 - protein, 9 aa, Homo Sapiens
KQEGLICSR

SEQ ID NO: 1008862 - protein, 9 aa, Homo Sapiens
FPYPYAKFS

SEQ ID NO: 1008863 - protein, 9 aa, Homo Sapiens
RGFFCKAGG

SEQ ID NO: 1008864 - protein, 9 aa, Homo Sapiens
NAIKKILPG

SEQ ID NO: 1008865 - protein, 9 aa, Homo Sapiens
QEEYEKLRD

SEQ ID NO: 1008866 - protein, 9 aa, Homo Sapiens
NKLTTFLLQ

SEQ ID NO: 1008867 - protein, 9 aa, Homo Sapiens
TVTPSSALE

SEQ ID NO: 1008868 - protein, 9 aa, Homo Sapiens
TSFFAQEFT

SEQ ID NO: 1008869 - protein, 9 aa, Homo Sapiens
WESPLFLAA

SEQ ID NO: 1008870 - protein, 9 aa, Homo Sapiens
CRMQHITGL

SEQ ID NO: 1008871 - protein, 9 aa, Homo Sapiens
GVKPYVCTE

SEQ ID NO: 1008872 - protein, 9 aa, Homo Sapiens
QNCATSFAT

SEQ ID NO: 1008873 - protein, 9 aa, Homo Sapiens
EEFSGKGSF

SEQ ID NO: 1008874 - protein, 9 aa, Homo Sapiens
SCHKCGRVG

SEQ ID NO: 1008875 - protein, 9 aa, Homo Sapiens
KEKVDLWCI

SEQ ID NO: 1008876 - protein, 9 aa, Homo Sapiens
NSIVVPLPF

SEQ ID NO: 1008877 - protein, 9 aa, Homo Sapiens
VIIFYSTLI

SEQ ID NO: 1008878 - protein, 9 aa, Homo Sapiens
LAPGKLDIS

SEQ ID NO: 1008879 - protein, 9 aa, Homo Sapiens
FFFFFSGRI

SEQ ID NO: 1008880 - protein, 9 aa, Homo Sapiens
SEKMTYLKK

SEQ ID NO: 1008881 - protein, 9 aa, Homo Sapiens
DEKQEQMFA

SEQ ID NO: 1008882 - protein, 9 aa, Homo Sapiens
APLGPTVVN

SEQ ID NO: 1008883 - protein, 9 aa, Homo Sapiens
LSCFFYAAV

SEQ ID NO: 1008884 - protein, 9 aa, Homo Sapiens
SEHKNVVDG

SEQ ID NO: 1008885 - protein, 9 aa, Homo Sapiens
TSNESPEES

SEQ ID NO: 1008886 - protein, 9 aa, Homo Sapiens
QFVQNTFIP

SEQ ID NO: 1008887 - protein, 9 aa, Homo Sapiens
VLDKNDNAP

SEQ ID NO: 1008888 - protein, 9 aa, Homo Sapiens
VLDSKRDRL

SEQ ID NO: 1008889 - protein, 9 aa, Homo Sapiens
VRDKIDRLL

SEQ ID NO: 1008890 - protein, 9 aa, Homo Sapiens
AGVTALLTL

SEQ ID NO: 1008891 - protein, 9 aa, Homo Sapiens
SKPFLELSD

SEQ ID NO: 1008892 - protein, 9 aa, Homo Sapiens
HSNFHFDNV

SEQ ID NO: 1008893 - protein, 9 aa, Homo Sapiens
HDLIKTDSK

SEQ ID NO: 1008894 - protein, 9 aa, Homo Sapiens
QSEYTSLIP

SEQ ID NO: 1008895 - protein, 9 aa, Homo Sapiens
NGTLMTHGF

SEQ ID NO: 1008896 - protein, 9 aa, Homo Sapiens
CGAKATPGR

SEQ ID NO: 1008897 - protein, 9 aa, Homo Sapiens
SILQMWHVV

SEQ ID NO: 1008898 - protein, 9 aa, Homo Sapiens
AVGVIVLTG

SEQ ID NO: 1008899 - protein, 9 aa, Homo Sapiens
TSGKTSLVS

SEQ ID NO: 1008900 - protein, 9 aa, Homo Sapiens
SSNKNIFSP

SEQ ID NO: 1008901 - protein, 9 aa, Homo Sapiens
LEELDYLLL

SEQ ID NO: 1008902 - protein, 9 aa, Homo Sapiens
SPALEASLV

SEQ ID NO: 1008903 - protein, 9 aa, Homo Sapiens
NATFLSAKF

SEQ ID NO: 1008904 - protein, 9 aa, Homo Sapiens
QARQQHLSL

SEQ ID NO: 1008905 - protein, 9 aa, Homo Sapiens
KRQVEHLEQ

SEQ ID NO: 1008906 - protein, 9 aa, Homo Sapiens
IVLAAIALD

SEQ ID NO: 1008907 - protein, 9 aa, Homo Sapiens
TMVGIRART

SEQ ID NO: 1008908 - protein, 9 aa, Homo Sapiens
VITSSSNLS

SEQ ID NO: 1008909 - protein, 9 aa, Homo Sapiens
LPTHARKAF

SEQ ID NO: 1008910 - protein, 9 aa, Homo Sapiens
CSRVSGWRA

SEQ ID NO: 1008911 - protein, 9 aa, Homo Sapiens
GLYQEPIDE

SEQ ID NO: 1008912 - protein, 9 aa, Homo Sapiens
LQDFEMKYL

SEQ ID NO: 1008913 - protein, 9 aa, Homo Sapiens
ALTQVLANG

SEQ ID NO: 1008914 - protein, 9 aa, Homo Sapiens
IKTQLILGR

SEQ ID NO: 1008915 - protein, 9 aa, Homo Sapiens
FRRPNLEAF

SEQ ID NO: 1008916 - protein, 9 aa, Homo Sapiens
RYLMDNLFE

SEQ ID NO: 1008917 - protein, 9 aa, Homo Sapiens
DDVFKASVY

SEQ ID NO: 1008918 - protein, 9 aa, Homo Sapiens
LIQVFVKNV

SEQ ID NO: 1008919 - protein, 9 aa, Homo Sapiens
DQKDNQPYY

SEQ ID NO: 1008920 - protein, 9 aa, Homo Sapiens
DEKNGIPIC

SEQ ID NO: 1008921 - protein, 9 aa, Homo Sapiens
PFSKNLTNS

SEQ ID NO: 1008922 - protein, 9 aa, Homo Sapiens
SFRKSEKET

SEQ ID NO: 1008923 - protein, 9 aa, Homo Sapiens
FENIGFGTP

SEQ ID NO: 1008924 - protein, 9 aa, Homo Sapiens
CKGKSKECW

SEQ ID NO: 1008925 - protein, 9 aa, Homo Sapiens
KLSRHSKEL

SEQ ID NO: 1008926 - protein, 9 aa, Homo Sapiens
WRDIVRDRN

SEQ ID NO: 1008927 - protein, 9 aa, Homo Sapiens
HPSREVNGL

SEQ ID NO: 1008928 - protein, 9 aa, Homo Sapiens
PYAKFSLAC

SEQ ID NO: 1008929 - protein, 9 aa, Homo Sapiens
SSSDTGPIS

SEQ ID NO: 1008930 - protein, 9 aa, Homo Sapiens
QPGSRHRDP

SEQ ID NO: 1008931 - protein, 9 aa, Homo Sapiens
VRQFYGLLV

SEQ ID NO: 1008932 - protein, 9 aa, Homo Sapiens
YLYEEDKDE

SEQ ID NO: 1008933 - protein, 9 aa, Homo Sapiens
GPSLSADMN

SEQ ID NO: 1008934 - protein, 9 aa, Homo Sapiens
VHTGIKPLK

SEQ ID NO: 1008935 - protein, 9 aa, Homo Sapiens
PTSGKMHID

SEQ ID NO: 1008936 - protein, 9 aa, Homo Sapiens
DSLDPDPCC

SEQ ID NO: 1008937 - protein, 9 aa, Homo Sapiens
CTQPRRVVA

SEQ ID NO: 1008938 - protein, 9 aa, Homo Sapiens
SVTSPLVVN

SEQ ID NO: 1008939 - protein, 9 aa, Homo Sapiens
NCANKKDTW

SEQ ID NO: 1008940 - protein, 9 aa, Homo Sapiens
EGGGHNLLP

SEQ ID NO: 1008941 - protein, 9 aa, Homo Sapiens
PQSNSKFLC

SEQ ID NO: 1008942 - protein, 9 aa, Homo Sapiens
AESARGPRA

SEQ ID NO: 1008943 - protein, 9 aa, Homo Sapiens
RGDSEDKRG

SEQ ID NO: 1008944 - protein, 9 aa, Homo Sapiens
IHTGERPFS

SEQ ID NO: 1008945 - protein, 9 aa, Homo Sapiens
CQPTCGCSL

SEQ ID NO: 1008946 - protein, 9 aa, Homo Sapiens
DWSTGKTER

SEQ ID NO: 1008947 - protein, 9 aa, Homo Sapiens
KRLEKYLGG

SEQ ID NO: 1008948 - protein, 9 aa, Homo Sapiens
RPPATLPFP

SEQ ID NO: 1008949 - protein, 9 aa, Homo Sapiens
DVNITIHWI

SEQ ID NO: 1008950 - protein, 9 aa, Homo Sapiens
IKMFDRWTY

SEQ ID NO: 1008951 - protein, 9 aa, Homo Sapiens
GGLRFDNLR

SEQ ID NO: 1008952 - protein, 9 aa, Homo Sapiens
EKPGLQGLP

SEQ ID NO: 1008953 - protein, 9 aa, Homo Sapiens
LSTGLMDSK

SEQ ID NO: 1008954 - protein, 9 aa, Homo Sapiens
SYYTAQDKW

SEQ ID NO: 1008955 - protein, 9 aa, Homo Sapiens
KLSKSNQYP

SEQ ID NO: 1008956 - protein, 9 aa, Homo Sapiens
IGVTMVGIR

SEQ ID NO: 1008957 - protein, 9 aa, Homo Sapiens
REERSHHHY

SEQ ID NO: 1008958 - protein, 9 aa, Homo Sapiens
LFFVESQYS

SEQ ID NO: 1008959 - protein, 9 aa, Homo Sapiens
LVDIFFSLV

SEQ ID NO: 1008960 - protein, 9 aa, Homo Sapiens
EKIKNTISY

SEQ ID NO: 1008961 - protein, 9 aa, Homo Sapiens
GCRRNPACS

SEQ ID NO: 1008962 - protein, 9 aa, Homo Sapiens
RSHSAQLKH

SEQ ID NO: 1008963 - protein, 9 aa, Homo Sapiens
GPHQAGHAS

SEQ ID NO: 1008964 - protein, 9 aa, Homo Sapiens
RKVSGSRGF

SEQ ID NO: 1008965 - protein, 9 aa, Homo Sapiens
YAAFLLPSR

SEQ ID NO: 1008966 - protein, 9 aa, Homo Sapiens
EPFQIIFEG

SEQ ID NO: 1008967 - protein, 9 aa, Homo Sapiens
EAATVRHLE

SEQ ID NO: 1008968 - protein, 9 aa, Homo Sapiens
DPQCLSRPF

SEQ ID NO: 1008969 - protein, 9 aa, Homo Sapiens
GQGACQAAP

SEQ ID NO: 1008970 - protein, 9 aa, Homo Sapiens
NKDKMQSPF

SEQ ID NO: 1008971 - protein, 9 aa, Homo Sapiens
IDLSSITDP

SEQ ID NO: 1008972 - protein, 9 aa, Homo Sapiens
AKENEHLQL

SEQ ID NO: 1008973 - protein, 9 aa, Homo Sapiens
NKMFVWFVS

SEQ ID NO: 1008974 - protein, 9 aa, Homo Sapiens
NSRRIDYML

SEQ ID NO: 1008975 - protein, 9 aa, Homo Sapiens
KKFILVGFS

SEQ ID NO: 1008976 - protein, 9 aa, Homo Sapiens
SLSSSVHSS

SEQ ID NO: 1008977 - protein, 9 aa, Homo Sapiens
LLPSRTSFN

SEQ ID NO: 1008978 - protein, 9 aa, Homo Sapiens
HECGKLFSK

SEQ ID NO: 1008979 - protein, 9 aa, Homo Sapiens
YTAKGAQEE

SEQ ID NO: 1008980 - protein, 9 aa, Homo Sapiens
SHAHAPGTA

SEQ ID NO: 1008981 - protein, 9 aa, Homo Sapiens
NLDSSFRNK

SEQ ID NO: 1008982 - protein, 9 aa, Homo Sapiens
NYTCRLWSD

SEQ ID NO: 1008983 - protein, 9 aa, Homo Sapiens
SISLRGFDQ

SEQ ID NO: 1008984 - protein, 9 aa, Homo Sapiens
VVSITMSYV

SEQ ID NO: 1008985 - protein, 9 aa, Homo Sapiens
GTAFNRSST

SEQ ID NO: 1008986 - protein, 9 aa, Homo Sapiens
QSPKYKITE

SEQ ID NO: 1008987 - protein, 9 aa, Homo Sapiens
DKTLHRASY

SEQ ID NO: 1008988 - protein, 9 aa, Homo Sapiens
LPRPPRNVR

SEQ ID NO: 1008989 - protein, 9 aa, Homo Sapiens
LFQELNSTY

SEQ ID NO: 1008990 - protein, 9 aa, Homo Sapiens
LSADMNGAP

SEQ ID NO: 1008991 - protein, 9 aa, Homo Sapiens
LLTLCLCLI

SEQ ID NO: 1008992 - protein, 9 aa, Homo Sapiens
TLRDDLVIE

SEQ ID NO: 1008993 - protein, 9 aa, Homo Sapiens
VFKASVYGN

SEQ ID NO: 1008994 - protein, 9 aa, Homo Sapiens
LDGPHEDPQ

SEQ ID NO: 1008995 - protein, 9 aa, Homo Sapiens
MAVICFSWT

SEQ ID NO: 1008996 - protein, 9 aa, Homo Sapiens
NHTESCHKC

SEQ ID NO: 1008997 - protein, 9 aa, Homo Sapiens
RVKVPVGQK

SEQ ID NO: 1008998 - protein, 9 aa, Homo Sapiens
CTCYPPEDR

SEQ ID NO: 1008999 - protein, 9 aa, Homo Sapiens
GSDPGFAGN

SEQ ID NO: 1009000 - protein, 9 aa, Homo Sapiens
STGKTERAG

SEQ ID NO: 1009001 - protein, 9 aa, Homo Sapiens
RKIDNFYPE

SEQ ID NO: 1009002 - protein, 9 aa, Homo Sapiens
LVHKLSSQG

SEQ ID NO: 1009003 - protein, 9 aa, Homo Sapiens
DVFPLQPEL

SEQ ID NO: 1009004 - protein, 9 aa, Homo Sapiens
RCGRFLVRE

SEQ ID NO: 1009005 - protein, 9 aa, Homo Sapiens
TLFTAPLSP

SEQ ID NO: 1009006 - protein, 9 aa, Homo Sapiens
IIRVRKSKG

SEQ ID NO: 1009007 - protein, 9 aa, Homo Sapiens
FLISNHQRL

SEQ ID NO: 1009008 - protein, 9 aa, Homo Sapiens
RLVTCVPRC

SEQ ID NO: 1009009 - protein, 9 aa, Homo Sapiens
CSVTKCSDF

SEQ ID NO: 1009010 - protein, 9 aa, Homo Sapiens
TYPLGLRNE

SEQ ID NO: 1009011 - protein, 9 aa, Homo Sapiens
AQRQMDARR

SEQ ID NO: 1009012 - protein, 9 aa, Homo Sapiens
SPPAAAAAR

SEQ ID NO: 1009013 - protein, 9 aa, Homo Sapiens
NLRGQPVGG

SEQ ID NO: 1009014 - protein, 9 aa, Homo Sapiens
AQHKSRSSR

SEQ ID NO: 1009015 - protein, 9 aa, Homo Sapiens
EGLATVAPP

SEQ ID NO: 1009016 - protein, 9 aa, Homo Sapiens
LDKEDVFPL

SEQ ID NO: 1009017 - protein, 9 aa, Homo Sapiens
WNFNSNPLQ

SEQ ID NO: 1009018 - protein, 9 aa, Homo Sapiens
ASRGHVSHA

SEQ ID NO: 1009019 - protein, 9 aa, Homo Sapiens
PVGGFLSVQ

SEQ ID NO: 1009020 - protein, 9 aa, Homo Sapiens
NFHFDNVLS

SEQ ID NO: 1009021 - protein, 9 aa, Homo Sapiens
QTWGGQGSQ

SEQ ID NO: 1009022 - protein, 9 aa, Homo Sapiens
KKPGPNFVT

SEQ ID NO: 1009023 - protein, 9 aa, Homo Sapiens
SFEIENLFV

SEQ ID NO: 1009024 - protein, 9 aa, Homo Sapiens
SRCGRFLVR

SEQ ID NO: 1009025 - protein, 9 aa, Homo Sapiens
SRTLLSYVS

SEQ ID NO: 1009026 - protein, 9 aa, Homo Sapiens
FLFSLFLVT

SEQ ID NO: 1009027 - protein, 9 aa, Homo Sapiens
VKYGMGGII

SEQ ID NO: 1009028 - protein, 9 aa, Homo Sapiens
EDPILTAFC

SEQ ID NO: 1009029 - protein, 9 aa, Homo Sapiens
VYFFPRNAD

SEQ ID NO: 1009030 - protein, 9 aa, Homo Sapiens
ENKEKMQCD

SEQ ID NO: 1009031 - protein, 9 aa, Homo Sapiens
EDSASAPDT

SEQ ID NO: 1009032 - protein, 9 aa, Homo Sapiens
FEIVIILEG

SEQ ID NO: 1009033 - protein, 9 aa, Homo Sapiens
RAPRGIPSL

SEQ ID NO: 1009034 - protein, 9 aa, Homo Sapiens
PAGQDGAPG

SEQ ID NO: 1009035 - protein, 9 aa, Homo Sapiens
GVVEYEVTP

SEQ ID NO: 1009036 - protein, 9 aa, Homo Sapiens
LLADCAHAA

SEQ ID NO: 1009037 - protein, 9 aa, Homo Sapiens
TVCRLVTCV

SEQ ID NO: 1009038 - protein, 9 aa, Homo Sapiens
NTFCVIVCN

SEQ ID NO: 1009039 - protein, 9 aa, Homo Sapiens
PVLSLRSMQ

SEQ ID NO: 1009040 - protein, 9 aa, Homo Sapiens
KNIFSPHTP

SEQ ID NO: 1009041 - protein, 9 aa, Homo Sapiens
AERNNAREE

SEQ ID NO: 1009042 - protein, 9 aa, Homo Sapiens
FCTDCLLIA

SEQ ID NO: 1009043 - protein, 9 aa, Homo Sapiens
GSKETGLQE

SEQ ID NO: 1009044 - protein, 9 aa, Homo Sapiens
KDIIKKTIN

SEQ ID NO: 1009045 - protein, 9 aa, Homo Sapiens
EGSESNDFK

SEQ ID NO: 1009046 - protein, 9 aa, Homo Sapiens
SLLESKSLY

SEQ ID NO: 1009047 - protein, 9 aa, Homo Sapiens
LPETTMHPT

SEQ ID NO: 1009048 - protein, 9 aa, Homo Sapiens
SSRDRSSSG

SEQ ID NO: 1009049 - protein, 9 aa, Homo Sapiens
EKMTYLKKN

SEQ ID NO: 1009050 - protein, 9 aa, Homo Sapiens
LVKTSDLGT

SEQ ID NO: 1009051 - protein, 9 aa, Homo Sapiens
ESPILAASS

SEQ ID NO: 1009052 - protein, 9 aa, Homo Sapiens
KTSEIQKLF

SEQ ID NO: 1009053 - protein, 9 aa, Homo Sapiens
NIMWTISDT

SEQ ID NO: 1009054 - protein, 9 aa, Homo Sapiens
YIHILLSNF

SEQ ID NO: 1009055 - protein, 9 aa, Homo Sapiens
LISNHQRLG

SEQ ID NO: 1009056 - protein, 9 aa, Homo Sapiens
LFLFSYCKS

SEQ ID NO: 1009057 - protein, 9 aa, Homo Sapiens
IMTNYDEAA

SEQ ID NO: 1009058 - protein, 9 aa, Homo Sapiens
NTIKQFEND

SEQ ID NO: 1009059 - protein, 9 aa, Homo Sapiens
FYASSIEAL

SEQ ID NO: 1009060 - protein, 9 aa, Homo Sapiens
SGPAFCQMI

SEQ ID NO: 1009061 - protein, 9 aa, Homo Sapiens
TQVLANGPE

SEQ ID NO: 1009062 - protein, 9 aa, Homo Sapiens
LAPLAEEKD

SEQ ID NO: 1009063 - protein, 9 aa, Homo Sapiens
TAYLVLDEA

SEQ ID NO: 1009064 - protein, 9 aa, Homo Sapiens
GFSRDSLIS

SEQ ID NO: 1009065 - protein, 9 aa, Homo Sapiens
ARRTPLGQQ

SEQ ID NO: 1009066 - protein, 9 aa, Homo Sapiens
PTAAFVSAD

SEQ ID NO: 1009067 - protein, 9 aa, Homo Sapiens
QPQIFSSSY

SEQ ID NO: 1009068 - protein, 9 aa, Homo Sapiens
AYPNAFCIA

SEQ ID NO: 1009069 - protein, 9 aa, Homo Sapiens
LGHTLCAST

SEQ ID NO: 1009070 - protein, 9 aa, Homo Sapiens
GHKSDHYNC

SEQ ID NO: 1009071 - protein, 9 aa, Homo Sapiens
ILLFHANSM

SEQ ID NO: 1009072 - protein, 9 aa, Homo Sapiens
DPPHQPGSR

SEQ ID NO: 1009073 - protein, 9 aa, Homo Sapiens
SGYTQHESG

SEQ ID NO: 1009074 - protein, 9 aa, Homo Sapiens
VARVNCRMQ

SEQ ID NO: 1009075 - protein, 9 aa, Homo Sapiens
TNGVHPSRE

SEQ ID NO: 1009076 - protein, 9 aa, Homo Sapiens
SASDFSAPW

SEQ ID NO: 1009077 - protein, 9 aa, Homo Sapiens
VGAAAGAIQ

SEQ ID NO: 1009078 - protein, 9 aa, Homo Sapiens
GLATMKSRW

SEQ ID NO: 1009079 - protein, 9 aa, Homo Sapiens
CKPLRYPLL

SEQ ID NO: 1009080 - protein, 9 aa, Homo Sapiens
VKLPLASLS

SEQ ID NO: 1009081 - protein, 9 aa, Homo Sapiens
STVNVLKII

SEQ ID NO: 1009082 - protein, 9 aa, Homo Sapiens
PEPWGNSPA

SEQ ID NO: 1009083 - protein, 9 aa, Homo Sapiens
PLAGVRAAA

SEQ ID NO: 1009084 - protein, 9 aa, Homo Sapiens
CTHPPLQST

SEQ ID NO: 1009085 - protein, 9 aa, Homo Sapiens
EYTIDVFFW

SEQ ID NO: 1009086 - protein, 9 aa, Homo Sapiens
SCLHSSPMY

SEQ ID NO: 1009087 - protein, 9 aa, Homo Sapiens
LSLSSSVHS

SEQ ID NO: 1009088 - protein, 9 aa, Homo Sapiens
PLGPTVVNP

SEQ ID NO: 1009089 - protein, 9 aa, Homo Sapiens
FLDGVVEYE

SEQ ID NO: 1009090 - protein, 9 aa, Homo Sapiens
LGQQRPHPR

SEQ ID NO: 1009091 - protein, 9 aa, Homo Sapiens
WARSLTLFT

SEQ ID NO: 1009092 - protein, 9 aa, Homo Sapiens
LSRPQRACL

SEQ ID NO: 1009093 - protein, 9 aa, Homo Sapiens
LAGPEELAW

SEQ ID NO: 1009094 - protein, 9 aa, Homo Sapiens
TPLFLGQHG

SEQ ID NO: 1009095 - protein, 9 aa, Homo Sapiens
FMAVLRRCQ

SEQ ID NO: 1009096 - protein, 9 aa, Homo Sapiens
SPREDLIKV

SEQ ID NO: 1009097 - protein, 9 aa, Homo Sapiens
SAPSCTQRI

SEQ ID NO: 1009098 - protein, 9 aa, Homo Sapiens
PMIIAPLFQ

SEQ ID NO: 1009099 - protein, 9 aa, Homo Sapiens
KNVDFTRIL

SEQ ID NO: 1009100 - protein, 9 aa, Homo Sapiens
GFQGVGNRV

SEQ ID NO: 1009101 - protein, 9 aa, Homo Sapiens
FFPETKAEK

SEQ ID NO: 1009102 - protein, 9 aa, Homo Sapiens
RPPRSSSPR

SEQ ID NO: 1009103 - protein, 9 aa, Homo Sapiens
NTSPPLPET

SEQ ID NO: 1009104 - protein, 9 aa, Homo Sapiens
KGERWTSFG

SEQ ID NO: 1009105 - protein, 9 aa, Homo Sapiens
QDKRINQFE

SEQ ID NO: 1009106 - protein, 9 aa, Homo Sapiens
RERPAESAR

SEQ ID NO: 1009107 - protein, 9 aa, Homo Sapiens
KKQSPQTLL

SEQ ID NO: 1009108 - protein, 9 aa, Homo Sapiens
VLKIIRSAT

SEQ ID NO: 1009109 - protein, 9 aa, Homo Sapiens
YRGKMNKTV

SEQ ID NO: 1009110 - protein, 9 aa, Homo Sapiens
LSLIFLANL

SEQ ID NO: 1009111 - protein, 9 aa, Homo Sapiens
RVGNSIDHL

SEQ ID NO: 1009112 - protein, 9 aa, Homo Sapiens
FHANSMMNP

SEQ ID NO: 1009113 - protein, 9 aa, Homo Sapiens
LISPRKSRT

SEQ ID NO: 1009114 - protein, 9 aa, Homo Sapiens
YSEPRVLTL

SEQ ID NO: 1009115 - protein, 9 aa, Homo Sapiens
NMIVTGRLA

SEQ ID NO: 1009116 - protein, 9 aa, Homo Sapiens
LALMENIFM

SEQ ID NO: 1009117 - protein, 9 aa, Homo Sapiens
VKLILPMPK

SEQ ID NO: 1009118 - protein, 9 aa, Homo Sapiens
REISVSTRL

SEQ ID NO: 1009119 - protein, 9 aa, Homo Sapiens
TENALEDLG

SEQ ID NO: 1009120 - protein, 9 aa, Homo Sapiens
EETVPTSGK

SEQ ID NO: 1009121 - protein, 9 aa, Homo Sapiens
KEILHKDLK

SEQ ID NO: 1009122 - protein, 9 aa, Homo Sapiens
YFYGDRIDL

SEQ ID NO: 1009123 - protein, 9 aa, Homo Sapiens
KFAFNSIAI

SEQ ID NO: 1009124 - protein, 9 aa, Homo Sapiens
VDVDIEFRD

SEQ ID NO: 1009125 - protein, 9 aa, Homo Sapiens
GGVRMLDED

SEQ ID NO: 1009126 - protein, 9 aa, Homo Sapiens
GPPPQGENQ

SEQ ID NO: 1009127 - protein, 9 aa, Homo Sapiens
DAFLISNHQ

SEQ ID NO: 1009128 - protein, 9 aa, Homo Sapiens
SDKEVKDCV

SEQ ID NO: 1009129 - protein, 9 aa, Homo Sapiens
AICNGMLQE

SEQ ID NO: 1009130 - protein, 9 aa, Homo Sapiens
FAVGLFHTL

SEQ ID NO: 1009131 - protein, 9 aa, Homo Sapiens
KNLCSLKTP

SEQ ID NO: 1009132 - protein, 9 aa, Homo Sapiens
LSERKRRDS

SEQ ID NO: 1009133 - protein, 9 aa, Homo Sapiens
LCRKNAVVS

SEQ ID NO: 1009134 - protein, 9 aa, Homo Sapiens
SLRVKRPIE

SEQ ID NO: 1009135 - protein, 9 aa, Homo Sapiens
RPWDLREER

SEQ ID NO: 1009136 - protein, 9 aa, Homo Sapiens
DMRKLIDSA

SEQ ID NO: 1009137 - protein, 9 aa, Homo Sapiens
EQFSKNNAL

SEQ ID NO: 1009138 - protein, 9 aa, Homo Sapiens
IAICNSLRY

SEQ ID NO: 1009139 - protein, 9 aa, Homo Sapiens
VSNPDIAFL

SEQ ID NO: 1009140 - protein, 9 aa, Homo Sapiens
PAESARGPR

SEQ ID NO: 1009141 - protein, 9 aa, Homo Sapiens
PGPRGSPGS

SEQ ID NO: 1009142 - protein, 9 aa, Homo Sapiens
GIPICTVKS

SEQ ID NO: 1009143 - protein, 9 aa, Homo Sapiens
DFFIKMFDR

SEQ ID NO: 1009144 - protein, 9 aa, Homo Sapiens
TNPYKPKCP

SEQ ID NO: 1009145 - protein, 9 aa, Homo Sapiens
WLSCFFYAA

SEQ ID NO: 1009146 - protein, 9 aa, Homo Sapiens
YKASDGKAT

SEQ ID NO: 1009147 - protein, 9 aa, Homo Sapiens
LFPVMSLPS

SEQ ID NO: 1009148 - protein, 9 aa, Homo Sapiens
QNVDSLSAL

SEQ ID NO: 1009149 - protein, 9 aa, Homo Sapiens
RISGSSDGS

SEQ ID NO: 1009150 - protein, 9 aa, Homo Sapiens
EMVSLAAKE

SEQ ID NO: 1009151 - protein, 9 aa, Homo Sapiens
ESCHKCGRV

SEQ ID NO: 1009152 - protein, 9 aa, Homo Sapiens
KLHVEKRVL

SEQ ID NO: 1009153 - protein, 9 aa, Homo Sapiens
LNVSKLQKL

SEQ ID NO: 1009154 - protein, 9 aa, Homo Sapiens
LLDYEALQA

SEQ ID NO: 1009155 - protein, 9 aa, Homo Sapiens
ESPEESSNC

SEQ ID NO: 1009156 - protein, 9 aa, Homo Sapiens
CQNFIGKQL

SEQ ID NO: 1009157 - protein, 9 aa, Homo Sapiens
HVWCHPEEK

SEQ ID NO: 1009158 - protein, 9 aa, Homo Sapiens
SGALNVYVK

SEQ ID NO: 1009159 - protein, 9 aa, Homo Sapiens
FIWAKPHFM

SEQ ID NO: 1009160 - protein, 9 aa, Homo Sapiens
DMPVSSSFN

SEQ ID NO: 1009161 - protein, 9 aa, Homo Sapiens
TNIFWMDKV

SEQ ID NO: 1009162 - protein, 9 aa, Homo Sapiens
IQEEYEKLR

SEQ ID NO: 1009163 - protein, 9 aa, Homo Sapiens
KKIFQNHRV

SEQ ID NO: 1009164 - protein, 9 aa, Homo Sapiens
RLLPEALPF

SEQ ID NO: 1009165 - protein, 9 aa, Homo Sapiens
CEVPDLGRF

SEQ ID NO: 1009166 - protein, 9 aa, Homo Sapiens
VPGPPRASF

SEQ ID NO: 1009167 - protein, 9 aa, Homo Sapiens
DVQVGPLAG

SEQ ID NO: 1009168 - protein, 9 aa, Homo Sapiens
TKTLPGSLA

SEQ ID NO: 1009169 - protein, 9 aa, Homo Sapiens
TKCSDFAVS

SEQ ID NO: 1009170 - protein, 9 aa, Homo Sapiens
HAFQGPTFF

SEQ ID NO: 1009171 - protein, 9 aa, Homo Sapiens
NPFIYTLCN

SEQ ID NO: 1009172 - protein, 9 aa, Homo Sapiens
AVDLRNPDL

SEQ ID NO: 1009173 - protein, 9 aa, Homo Sapiens
DYGENIYLY

SEQ ID NO: 1009174 - protein, 9 aa, Homo Sapiens
FDAYMKPGP

SEQ ID NO: 1009175 - protein, 9 aa, Homo Sapiens
QRLGTHWDI

SEQ ID NO: 1009176 - protein, 9 aa, Homo Sapiens
TFVHHQRNH

SEQ ID NO: 1009177 - protein, 9 aa, Homo Sapiens
LRSVNLLKT

SEQ ID NO: 1009178 - protein, 9 aa, Homo Sapiens
RPLANQGFL

SEQ ID NO: 1009179 - protein, 9 aa, Homo Sapiens
DDLVIEGPM

SEQ ID NO: 1009180 - protein, 9 aa, Homo Sapiens
CCTIVDGVF

SEQ ID NO: 1009181 - protein, 9 aa, Homo Sapiens
NSFREKKFF

SEQ ID NO: 1009182 - protein, 9 aa, Homo Sapiens
LHRTSEKEA

SEQ ID NO: 1009183 - protein, 9 aa, Homo Sapiens
IEERKKQTR

SEQ ID NO: 1009184 - protein, 9 aa, Homo Sapiens
NPDIAFLGE

SEQ ID NO: 1009185 - protein, 9 aa, Homo Sapiens
NSVLHCINP

SEQ ID NO: 1009186 - protein, 9 aa, Homo Sapiens
FFIVPSHCR

SEQ ID NO: 1009187 - protein, 9 aa, Homo Sapiens
GVLFFFFFS

SEQ ID NO: 1009188 - protein, 9 aa, Homo Sapiens
EHVLGTIFS

SEQ ID NO: 1009189 - protein, 9 aa, Homo Sapiens
RWYFGRLAS

SEQ ID NO: 1009190 - protein, 9 aa, Homo Sapiens
GLRNEDLSL

SEQ ID NO: 1009191 - protein, 9 aa, Homo Sapiens
DFILFTKKK

SEQ ID NO: 1009192 - protein, 9 aa, Homo Sapiens
IAPMRNEHE

SEQ ID NO: 1009193 - protein, 9 aa, Homo Sapiens
VSFIKMLKK

SEQ ID NO: 1009194 - protein, 9 aa, Homo Sapiens
TGGSESSWN

SEQ ID NO: 1009195 - protein, 9 aa, Homo Sapiens
YDPEIKMLL

SEQ ID NO: 1009196 - protein, 9 aa, Homo Sapiens
VRFENIGFG

SEQ ID NO: 1009197 - protein, 9 aa, Homo Sapiens
VQMTNNDIK

SEQ ID NO: 1009198 - protein, 9 aa, Homo Sapiens
LINLCGIDF

SEQ ID NO: 1009199 - protein, 9 aa, Homo Sapiens
RGIASGIKY

SEQ ID NO: 1009200 - protein, 9 aa, Homo Sapiens
YEAFSRCKK

SEQ ID NO: 1009201 - protein, 9 aa, Homo Sapiens
IPHFLLWKM

SEQ ID NO: 1009202 - protein, 9 aa, Homo Sapiens
AKEGKTDEL

SEQ ID NO: 1009203 - protein, 9 aa, Homo Sapiens
PLFVTADGC

SEQ ID NO: 1009204 - protein, 9 aa, Homo Sapiens
KKETRNTLK

SEQ ID NO: 1009205 - protein, 9 aa, Homo Sapiens
QSSASPKAA

SEQ ID NO: 1009206 - protein, 9 aa, Homo Sapiens
VLPAADHKG

SEQ ID NO: 1009207 - protein, 9 aa, Homo Sapiens
EDSAANGTP

SEQ ID NO: 1009208 - protein, 9 aa, Homo Sapiens
LKTKVVPET

SEQ ID NO: 1009209 - protein, 9 aa, Homo Sapiens
NITIHWISN

SEQ ID NO: 1009210 - protein, 9 aa, Homo Sapiens
KGGVEDEVI

SEQ ID NO: 1009211 - protein, 9 aa, Homo Sapiens
LGLRNEDLS

SEQ ID NO: 1009212 - protein, 9 aa, Homo Sapiens
NLRDIKNEI

SEQ ID NO: 1009213 - protein, 9 aa, Homo Sapiens
EESTESEHL

SEQ ID NO: 1009214 - protein, 9 aa, Homo Sapiens
YPENNGQRK

SEQ ID NO: 1009215 - protein, 9 aa, Homo Sapiens
ILAIYSDSR

SEQ ID NO: 1009216 - protein, 9 aa, Homo Sapiens
RLFKKSNIK

SEQ ID NO: 1009217 - protein, 9 aa, Homo Sapiens
PISPSEPFQ

SEQ ID NO: 1009218 - protein, 9 aa, Homo Sapiens
KPKDVKLIL

SEQ ID NO: 1009219 - protein, 9 aa, Homo Sapiens
GDIKKCKRG

SEQ ID NO: 1009220 - protein, 9 aa, Homo Sapiens
ENQQQGEDE

SEQ ID NO: 1009221 - protein, 9 aa, Homo Sapiens
QTESCVPEH

SEQ ID NO: 1009222 - protein, 9 aa, Homo Sapiens
NTPLFLGQH

SEQ ID NO: 1009223 - protein, 9 aa, Homo Sapiens
YLLGFPGSQ

SEQ ID NO: 1009224 - protein, 9 aa, Homo Sapiens
QEFPKEEWV

SEQ ID NO: 1009225 - protein, 9 aa, Homo Sapiens
FKKSNIKTR

SEQ ID NO: 1009226 - protein, 9 aa, Homo Sapiens
TVPTSGKMH

SEQ ID NO: 1009227 - protein, 9 aa, Homo Sapiens
GLVITSSSN

SEQ ID NO: 1009228 - protein, 9 aa, Homo Sapiens
QDQTDQQKA

SEQ ID NO: 1009229 - protein, 9 aa, Homo Sapiens
KNVVDGKIS

SEQ ID NO: 1009230 - protein, 9 aa, Homo Sapiens
TESCHKCGR

SEQ ID NO: 1009231 - protein, 9 aa, Homo Sapiens
LQEILSFAD

SEQ ID NO: 1009232 - protein, 9 aa, Homo Sapiens
RDMSFFPET

SEQ ID NO: 1009233 - protein, 9 aa, Homo Sapiens
EKTGSLEGF

SEQ ID NO: 1009234 - protein, 9 aa, Homo Sapiens
PNRFADKPS

SEQ ID NO: 1009235 - protein, 9 aa, Homo Sapiens
SYREDLIVY

SEQ ID NO: 1009236 - protein, 9 aa, Homo Sapiens
YVEDVRSVT

SEQ ID NO: 1009237 - protein, 9 aa, Homo Sapiens
RTGERVKRE

SEQ ID NO: 1009238 - protein, 9 aa, Homo Sapiens
WHLNHLDSA

SEQ ID NO: 1009239 - protein, 9 aa, Homo Sapiens
AQERRFQLK

SEQ ID NO: 1009240 - protein, 9 aa, Homo Sapiens
LVPSGVSDK

SEQ ID NO: 1009241 - protein, 9 aa, Homo Sapiens
VLNSAILMA

SEQ ID NO: 1009242 - protein, 9 aa, Homo Sapiens
RLASCGAAC

SEQ ID NO: 1009243 - protein, 9 aa, Homo Sapiens
HACNFSTLG

SEQ ID NO: 1009244 - protein, 9 aa, Homo Sapiens
LDSAFNPDV

SEQ ID NO: 1009245 - protein, 9 aa, Homo Sapiens
IINNKPEES

SEQ ID NO: 1009246 - protein, 9 aa, Homo Sapiens
NLVAQVSLS

SEQ ID NO: 1009247 - protein, 9 aa, Homo Sapiens
FAYYYGLLG

SEQ ID NO: 1009248 - protein, 9 aa, Homo Sapiens
VSWESSLGI

SEQ ID NO: 1009249 - protein, 9 aa, Homo Sapiens
CANKKDTWK

SEQ ID NO: 1009250 - protein, 9 aa, Homo Sapiens
EDGTSEQRK

SEQ ID NO: 1009251 - protein, 9 aa, Homo Sapiens
DTRRELAKL

SEQ ID NO: 1009252 - protein, 9 aa, Homo Sapiens
PMRNEHEKV

SEQ ID NO: 1009253 - protein, 9 aa, Homo Sapiens
WELQAMAEQ

SEQ ID NO: 1009254 - protein, 9 aa, Homo Sapiens
LKHGDQKIC

SEQ ID NO: 1009255 - protein, 9 aa, Homo Sapiens
DNYGGYASS

SEQ ID NO: 1009256 - protein, 9 aa, Homo Sapiens
VNTCSWIRN

SEQ ID NO: 1009257 - protein, 9 aa, Homo Sapiens
NPPASTAFL

SEQ ID NO: 1009258 - protein, 9 aa, Homo Sapiens
VLHCINPGE

SEQ ID NO: 1009259 - protein, 9 aa, Homo Sapiens
RACSRVNTC

SEQ ID NO: 1009260 - protein, 9 aa, Homo Sapiens
KLKGKLPPR

SEQ ID NO: 1009261 - protein, 9 aa, Homo Sapiens
SSLPLQLAC

SEQ ID NO: 1009262 - protein, 9 aa, Homo Sapiens
STRVGGDVQ

SEQ ID NO: 1009263 - protein, 9 aa, Homo Sapiens
FGPDLHYWS

SEQ ID NO: 1009264 - protein, 9 aa, Homo Sapiens
GFFCKAGGT

SEQ ID NO: 1009265 - protein, 9 aa, Homo Sapiens
YWSCEKASI

SEQ ID NO: 1009266 - protein, 9 aa, Homo Sapiens
QFLPTHARK

SEQ ID NO: 1009267 - protein, 9 aa, Homo Sapiens
RSTRPTPVQ

SEQ ID NO: 1009268 - protein, 9 aa, Homo Sapiens
ASTDEAAIE

SEQ ID NO: 1009269 - protein, 9 aa, Homo Sapiens
FCKIYIGDQ

SEQ ID NO: 1009270 - protein, 9 aa, Homo Sapiens
NAASLPGSS

SEQ ID NO: 1009271 - protein, 9 aa, Homo Sapiens
YVLSLRTED

SEQ ID NO: 1009272 - protein, 9 aa, Homo Sapiens
EFYSSPYSI

SEQ ID NO: 1009273 - protein, 9 aa, Homo Sapiens
HGSRLLPEA

SEQ ID NO: 1009274 - protein, 9 aa, Homo Sapiens
RQNCLFLAG

SEQ ID NO: 1009275 - protein, 9 aa, Homo Sapiens
VKKRKQQNQ

SEQ ID NO: 1009276 - protein, 9 aa, Homo Sapiens
WQTWHDERL

SEQ ID NO: 1009277 - protein, 9 aa, Homo Sapiens
RKITVRTKG

SEQ ID NO: 1009278 - protein, 9 aa, Homo Sapiens
DPAHSILRP

SEQ ID NO: 1009279 - protein, 9 aa, Homo Sapiens
GTKYVSHGA

SEQ ID NO: 1009280 - protein, 9 aa, Homo Sapiens
RISLNDDKE

SEQ ID NO: 1009281 - protein, 9 aa, Homo Sapiens
VLLRVGPSP

SEQ ID NO: 1009282 - protein, 9 aa, Homo Sapiens
VIEDNVNMA

SEQ ID NO: 1009283 - protein, 9 aa, Homo Sapiens
YNYDQDDYE

SEQ ID NO: 1009284 - protein, 9 aa, Homo Sapiens
NFLLDKEDV

SEQ ID NO: 1009285 - protein, 9 aa, Homo Sapiens
GLSELGRLG

SEQ ID NO: 1009286 - protein, 9 aa, Homo Sapiens
AGRNLLLPS

SEQ ID NO: 1009287 - protein, 9 aa, Homo Sapiens
DNNDDDVST

SEQ ID NO: 1009288 - protein, 9 aa, Homo Sapiens
GKATRTAYN

SEQ ID NO: 1009289 - protein, 9 aa, Homo Sapiens
ENIFMVLLI

SEQ ID NO: 1009290 - protein, 9 aa, Homo Sapiens
TVKLKCQVL

SEQ ID NO: 1009291 - protein, 9 aa, Homo Sapiens
SRPFSKNLT

SEQ ID NO: 1009292 - protein, 9 aa, Homo Sapiens
RVSSLPLQL

SEQ ID NO: 1009293 - protein, 9 aa, Homo Sapiens
TWCFPADYG

SEQ ID NO: 1009294 - protein, 9 aa, Homo Sapiens
SQANLWLAA

SEQ ID NO: 1009295 - protein, 9 aa, Homo Sapiens
TVAGPVGGF

SEQ ID NO: 1009296 - protein, 9 aa, Homo Sapiens
NVSKLQKLA

SEQ ID NO: 1009297 - protein, 9 aa, Homo Sapiens
KLFDIFTYS

SEQ ID NO: 1009298 - protein, 9 aa, Homo Sapiens
TWNETKPVC

SEQ ID NO: 1009299 - protein, 9 aa, Homo Sapiens
DPSEKWGSG

SEQ ID NO: 1009300 - protein, 9 aa, Homo Sapiens
IRDDHICFI

SEQ ID NO: 1009301 - protein, 9 aa, Homo Sapiens
RDIKNEIAE

SEQ ID NO: 1009302 - protein, 9 aa, Homo Sapiens
ALVNFMRIK

SEQ ID NO: 1009303 - protein, 9 aa, Homo Sapiens
KPPLSCKPR

SEQ ID NO: 1009304 - protein, 9 aa, Homo Sapiens
LEFTRNMVK

SEQ ID NO: 1009305 - protein, 9 aa, Homo Sapiens
MANFDLSVS

SEQ ID NO: 1009306 - protein, 9 aa, Homo Sapiens
AGVSPIENS

SEQ ID NO: 1009307 - protein, 9 aa, Homo Sapiens
NRVRIEAAQ

SEQ ID NO: 1009308 - protein, 9 aa, Homo Sapiens
IHILLSNFY

SEQ ID NO: 1009309 - protein, 9 aa, Homo Sapiens
VQVGPLAGV

SEQ ID NO: 1009310 - protein, 9 aa, Homo Sapiens
WFGKSKTIQ

SEQ ID NO: 1009311 - protein, 9 aa, Homo Sapiens
LKILSVIMG

SEQ ID NO: 1009312 - protein, 9 aa, Homo Sapiens
FAHNKAQWK

SEQ ID NO: 1009313 - protein, 9 aa, Homo Sapiens
PAWQGYHSM

SEQ ID NO: 1009314 - protein, 9 aa, Homo Sapiens
CVSGILSHS

SEQ ID NO: 1009315 - protein, 9 aa, Homo Sapiens
ISIFTLLQF

SEQ ID NO: 1009316 - protein, 9 aa, Homo Sapiens
SPSSHLTQA

SEQ ID NO: 1009317 - protein, 9 aa, Homo Sapiens
QGKISEGLQ

SEQ ID NO: 1009318 - protein, 9 aa, Homo Sapiens
TDMALLADC

SEQ ID NO: 1009319 - protein, 9 aa, Homo Sapiens
LRSQVQELE

SEQ ID NO: 1009320 - protein, 9 aa, Homo Sapiens
TNGKLFSWA

SEQ ID NO: 1009321 - protein, 9 aa, Homo Sapiens
EAMLFAIDK

SEQ ID NO: 1009322 - protein, 9 aa, Homo Sapiens
SRYLNKKAF

SEQ ID NO: 1009323 - protein, 9 aa, Homo Sapiens
GSHYNQAQD

SEQ ID NO: 1009324 - protein, 9 aa, Homo Sapiens
GGSMHHLFL

SEQ ID NO: 1009325 - protein, 9 aa, Homo Sapiens
PSRPRPPRS

SEQ ID NO: 1009326 - protein, 9 aa, Homo Sapiens
SGSMSLDSS

SEQ ID NO: 1009327 - protein, 9 aa, Homo Sapiens
FGARQNVAT

SEQ ID NO: 1009328 - protein, 9 aa, Homo Sapiens
SGSQLSLSS

SEQ ID NO: 1009329 - protein, 9 aa, Homo Sapiens
PPASTAFLQ

SEQ ID NO: 1009330 - protein, 9 aa, Homo Sapiens
AATSEHNCK

SEQ ID NO: 1009331 - protein, 9 aa, Homo Sapiens
KGTFAQLSK

SEQ ID NO: 1009332 - protein, 9 aa, Homo Sapiens
QSNPVREAF

SEQ ID NO: 1009333 - protein, 9 aa, Homo Sapiens
SDYDLDQPK

SEQ ID NO: 1009334 - protein, 9 aa, Homo Sapiens
LRVLLDNVD

SEQ ID NO: 1009335 - protein, 9 aa, Homo Sapiens
STAFLQEPH

SEQ ID NO: 1009336 - protein, 9 aa, Homo Sapiens
KDNQPYYSN

SEQ ID NO: 1009337 - protein, 9 aa, Homo Sapiens
TIMMRSISL

SEQ ID NO: 1009338 - protein, 9 aa, Homo Sapiens
RDYKNSEAF

SEQ ID NO: 1009339 - protein, 9 aa, Homo Sapiens
IDKPSRCYF

SEQ ID NO: 1009340 - protein, 9 aa, Homo Sapiens
EHCSPNGTN

SEQ ID NO: 1009341 - protein, 9 aa, Homo Sapiens
LRKHSDYAA

SEQ ID NO: 1009342 - protein, 9 aa, Homo Sapiens
LKTVLSIAF

SEQ ID NO: 1009343 - protein, 9 aa, Homo Sapiens
PLHLLKAFS

SEQ ID NO: 1009344 - protein, 9 aa, Homo Sapiens
DYISKLSKS

SEQ ID NO: 1009345 - protein, 9 aa, Homo Sapiens
SRPRRGMFR

SEQ ID NO: 1009346 - protein, 9 aa, Homo Sapiens
RRQAETQAW

SEQ ID NO: 1009347 - protein, 9 aa, Homo Sapiens
LETFHCLSP

SEQ ID NO: 1009348 - protein, 9 aa, Homo Sapiens
HHHHHHRQR

SEQ ID NO: 1009349 - protein, 9 aa, Homo Sapiens
NSLSPEKVF

SEQ ID NO: 1009350 - protein, 9 aa, Homo Sapiens
CTCIGISNQ

SEQ ID NO: 1009351 - protein, 9 aa, Homo Sapiens
KTRSESIRS

SEQ ID NO: 1009352 - protein, 9 aa, Homo Sapiens
ASASDFSAP

SEQ ID NO: 1009353 - protein, 9 aa, Homo Sapiens
QPRRVVAMS

SEQ ID NO: 1009354 - protein, 9 aa, Homo Sapiens
PPSGPVPMG

SEQ ID NO: 1009355 - protein, 9 aa, Homo Sapiens
LWSLRSRAS

SEQ ID NO: 1009356 - protein, 9 aa, Homo Sapiens
TVLDKNDNA

SEQ ID NO: 1009357 - protein, 9 aa, Homo Sapiens
MSYNRYLAI

SEQ ID NO: 1009358 - protein, 9 aa, Homo Sapiens
KMTLDQSEY

SEQ ID NO: 1009359 - protein, 9 aa, Homo Sapiens
MAVGFPVSQ

SEQ ID NO: 1009360 - protein, 9 aa, Homo Sapiens
AVRSLLRLG

SEQ ID NO: 1009361 - protein, 9 aa, Homo Sapiens
IFSYREDLI

SEQ ID NO: 1009362 - protein, 9 aa, Homo Sapiens
PARPPDQKD

SEQ ID NO: 1009363 - protein, 9 aa, Homo Sapiens
VRSFFVGEA

SEQ ID NO: 1009364 - protein, 9 aa, Homo Sapiens
LPPNKKEQE

SEQ ID NO: 1009365 - protein, 9 aa, Homo Sapiens
PPSPPSFPL

SEQ ID NO: 1009366 - protein, 9 aa, Homo Sapiens
NSLIQVFVK

SEQ ID NO: 1009367 - protein, 9 aa, Homo Sapiens
VAFNAQHKS

SEQ ID NO: 1009368 - protein, 9 aa, Homo Sapiens
SFFIDKVVS

SEQ ID NO: 1009369 - protein, 9 aa, Homo Sapiens
GILPAMDGF

SEQ ID NO: 1009370 - protein, 9 aa, Homo Sapiens
EVLEGLSEL

SEQ ID NO: 1009371 - protein, 9 aa, Homo Sapiens
TFQRQAFLE

SEQ ID NO: 1009372 - protein, 9 aa, Homo Sapiens
IFSSSYYSN

SEQ ID NO: 1009373 - protein, 9 aa, Homo Sapiens
AALQQVLFT

SEQ ID NO: 1009374 - protein, 9 aa, Homo Sapiens
TQGIFSLDG

SEQ ID NO: 1009375 - protein, 9 aa, Homo Sapiens
EETLRTPSN

SEQ ID NO: 1009376 - protein, 9 aa, Homo Sapiens
AHSPEVKQQ

SEQ ID NO: 1009377 - protein, 9 aa, Homo Sapiens
GRQQYDLME

SEQ ID NO: 1009378 - protein, 9 aa, Homo Sapiens
NNAREEGRQ

SEQ ID NO: 1009379 - protein, 9 aa, Homo Sapiens
VWCHPEEKE

SEQ ID NO: 1009380 - protein, 9 aa, Homo Sapiens
IVYFFPRNA

SEQ ID NO: 1009381 - protein, 9 aa, Homo Sapiens
RAQTCSSVC

SEQ ID NO: 1009382 - protein, 9 aa, Homo Sapiens
ISGKFYTSL

SEQ ID NO: 1009383 - protein, 9 aa, Homo Sapiens
VKNVDFTRI

SEQ ID NO: 1009384 - protein, 9 aa, Homo Sapiens
ISISGTKQK

SEQ ID NO: 1009385 - protein, 9 aa, Homo Sapiens
EPSAKPNNS

SEQ ID NO: 1009386 - protein, 9 aa, Homo Sapiens
GGVPVLIGN

SEQ ID NO: 1009387 - protein, 9 aa, Homo Sapiens
PDLHYWSCE

SEQ ID NO: 1009388 - protein, 9 aa, Homo Sapiens
TVLSIAFRE

SEQ ID NO: 1009389 - protein, 9 aa, Homo Sapiens
SQEYRIERC

SEQ ID NO: 1009390 - protein, 9 aa, Homo Sapiens
ARQQHLSLL

SEQ ID NO: 1009391 - protein, 9 aa, Homo Sapiens
YLTAASILQ

SEQ ID NO: 1009392 - protein, 9 aa, Homo Sapiens
LSPEKVFSE

SEQ ID NO: 1009393 - protein, 9 aa, Homo Sapiens
APIFINFTC

SEQ ID NO: 1009394 - protein, 9 aa, Homo Sapiens
EKKVPAGAK

SEQ ID NO: 1009395 - protein, 9 aa, Homo Sapiens
FMLQQSTNS

SEQ ID NO: 1009396 - protein, 9 aa, Homo Sapiens
VTSPLFSPP

SEQ ID NO: 1009397 - protein, 9 aa, Homo Sapiens
AGALAGVGA

SEQ ID NO: 1009398 - protein, 9 aa, Homo Sapiens
YQYEVCLTE

SEQ ID NO: 1009399 - protein, 9 aa, Homo Sapiens
CVAFLDGVV

SEQ ID NO: 1009400 - protein, 9 aa, Homo Sapiens
AIALDRYVA

SEQ ID NO: 1009401 - protein, 9 aa, Homo Sapiens
VIVLTGGDK

SEQ ID NO: 1009402 - protein, 9 aa, Homo Sapiens
SGLVITSSS

SEQ ID NO: 1009403 - protein, 9 aa, Homo Sapiens
NSLGLIFDH

SEQ ID NO: 1009404 - protein, 9 aa, Homo Sapiens
IVFARMAPD

SEQ ID NO: 1009405 - protein, 9 aa, Homo Sapiens
EAMPTHKNL

SEQ ID NO: 1009406 - protein, 9 aa, Homo Sapiens
EKLHVEKRV

SEQ ID NO: 1009407 - protein, 9 aa, Homo Sapiens
KKYLNKDPQ

SEQ ID NO: 1009408 - protein, 9 aa, Homo Sapiens
PMHLYLPSH

SEQ ID NO: 1009409 - protein, 9 aa, Homo Sapiens
AIGSFSSHM

SEQ ID NO: 1009410 - protein, 9 aa, Homo Sapiens
IWKNIHTLV

SEQ ID NO: 1009411 - protein, 9 aa, Homo Sapiens
AFSPPRTAL

SEQ ID NO: 1009412 - protein, 9 aa, Homo Sapiens
FVLLLALTA

SEQ ID NO: 1009413 - protein, 9 aa, Homo Sapiens
FYIELLQQL

SEQ ID NO: 1009414 - protein, 9 aa, Homo Sapiens
RTAYLVLDE

SEQ ID NO: 1009415 - protein, 9 aa, Homo Sapiens
LVTIPKMLA

SEQ ID NO: 1009416 - protein, 9 aa, Homo Sapiens
GVNCSQAPV

SEQ ID NO: 1009417 - protein, 9 aa, Homo Sapiens
YYLRSTIGS

SEQ ID NO: 1009418 - protein, 9 aa, Homo Sapiens
DDGLISPRK

SEQ ID NO: 1009419 - protein, 9 aa, Homo Sapiens
RIEGAKEPR

SEQ ID NO: 1009420 - protein, 9 aa, Homo Sapiens
SIDHLYSMQ

SEQ ID NO: 1009421 - protein, 9 aa, Homo Sapiens
SMSLDSSSP

SEQ ID NO: 1009422 - protein, 9 aa, Homo Sapiens
LPAWQGYHS

SEQ ID NO: 1009423 - protein, 9 aa, Homo Sapiens
PHLYLRGQR

SEQ ID NO: 1009424 - protein, 9 aa, Homo Sapiens
IVNEKSSLE

SEQ ID NO: 1009425 - protein, 9 aa, Homo Sapiens
QMDARRNVP

SEQ ID NO: 1009426 - protein, 9 aa, Homo Sapiens
IFYRKEIRK

SEQ ID NO: 1009427 - protein, 9 aa, Homo Sapiens
KTGEIKVND

SEQ ID NO: 1009428 - protein, 9 aa, Homo Sapiens
SEKSFINHS

SEQ ID NO: 1009429 - protein, 9 aa, Homo Sapiens
WTFYASSIE

SEQ ID NO: 1009430 - protein, 9 aa, Homo Sapiens
CATSFATVV

SEQ ID NO: 1009431 - protein, 9 aa, Homo Sapiens
RWCYTHAVA

SEQ ID NO: 1009432 - protein, 9 aa, Homo Sapiens
LNHTDMALL

SEQ ID NO: 1009433 - protein, 9 aa, Homo Sapiens
VGNRVRRWQ

SEQ ID NO: 1009434 - protein, 9 aa, Homo Sapiens
ERVYLYSKY

SEQ ID NO: 1009435 - protein, 9 aa, Homo Sapiens
FIMTIHAAE

SEQ ID NO: 1009436 - protein, 9 aa, Homo Sapiens
GVHPSREVN

SEQ ID NO: 1009437 - protein, 9 aa, Homo Sapiens
ESTESEHLE

SEQ ID NO: 1009438 - protein, 9 aa, Homo Sapiens
TIKNKANFF

SEQ ID NO: 1009439 - protein, 9 aa, Homo Sapiens
IEFRDHVGV

SEQ ID NO: 1009440 - protein, 9 aa, Homo Sapiens
LTKLTEVLN

SEQ ID NO: 1009441 - protein, 9 aa, Homo Sapiens
FTIIGEDEP

SEQ ID NO: 1009442 - protein, 9 aa, Homo Sapiens
PFRPEASGF

SEQ ID NO: 1009443 - protein, 9 aa, Homo Sapiens
SEESSQEDE

SEQ ID NO: 1009444 - protein, 9 aa, Homo Sapiens
DSSPNRFAD

SEQ ID NO: 1009445 - protein, 9 aa, Homo Sapiens
IISLAECIT

SEQ ID NO: 1009446 - protein, 9 aa, Homo Sapiens
KRVLSNISS

SEQ ID NO: 1009447 - protein, 9 aa, Homo Sapiens
TLCNKEVRE

SEQ ID NO: 1009448 - protein, 9 aa, Homo Sapiens
IRVLLDLTP

SEQ ID NO: 1009449 - protein, 9 aa, Homo Sapiens
MLKNFLGEE

SEQ ID NO: 1009450 - protein, 9 aa, Homo Sapiens
LVEESRAST

SEQ ID NO: 1009451 - protein, 9 aa, Homo Sapiens
NFYLLVPPF

SEQ ID NO: 1009452 - protein, 9 aa, Homo Sapiens
VPSFSECSS

SEQ ID NO: 1009453 - protein, 9 aa, Homo Sapiens
VLIGNHAQR

SEQ ID NO: 1009454 - protein, 9 aa, Homo Sapiens
YYIKILLQE

SEQ ID NO: 1009455 - protein, 9 aa, Homo Sapiens
SLPLSLFFL

SEQ ID NO: 1009456 - protein, 9 aa, Homo Sapiens
AAIENILKA

SEQ ID NO: 1009457 - protein, 9 aa, Homo Sapiens
SLEGFSPRG

SEQ ID NO: 1009458 - protein, 9 aa, Homo Sapiens
EESVCPTQI

SEQ ID NO: 1009459 - protein, 9 aa, Homo Sapiens
GCCSANEYC

SEQ ID NO: 1009460 - protein, 9 aa, Homo Sapiens
PLTSGTSPT

SEQ ID NO: 1009461 - protein, 9 aa, Homo Sapiens
PPHQPGSRH

SEQ ID NO: 1009462 - protein, 9 aa, Homo Sapiens
KEETLRTPS

SEQ ID NO: 1009463 - protein, 9 aa, Homo Sapiens
NNGQRKNIE

SEQ ID NO: 1009464 - protein, 9 aa, Homo Sapiens
PNTSPPLPE

SEQ ID NO: 1009465 - protein, 9 aa, Homo Sapiens
KSGESQRLS

SEQ ID NO: 1009466 - protein, 9 aa, Homo Sapiens
STLISIPHF

SEQ ID NO: 1009467 - protein, 9 aa, Homo Sapiens
GKSKTIQTD

SEQ ID NO: 1009468 - protein, 9 aa, Homo Sapiens
IDPKKGKIT

SEQ ID NO: 1009469 - protein, 9 aa, Homo Sapiens
TKEEKKVPA

SEQ ID NO: 1009470 - protein, 9 aa, Homo Sapiens
SGIKYLSDM

SEQ ID NO: 1009471 - protein, 9 aa, Homo Sapiens
NEKTGEIKV

SEQ ID NO: 1009472 - protein, 9 aa, Homo Sapiens
QDHSYQEEA

SEQ ID NO: 1009473 - protein, 9 aa, Homo Sapiens
GDAEEAQIE

SEQ ID NO: 1009474 - protein, 9 aa, Homo Sapiens
TEPSQGQVA

SEQ ID NO: 1009475 - protein, 9 aa, Homo Sapiens
ENIGFGTPY

SEQ ID NO: 1009476 - protein, 9 aa, Homo Sapiens
SISTKKNTL

SEQ ID NO: 1009477 - protein, 9 aa, Homo Sapiens
SSEESTESE

SEQ ID NO: 1009478 - protein, 9 aa, Homo Sapiens
EHALIWRPG

SEQ ID NO: 1009479 - protein, 9 aa, Homo Sapiens
LDSQPAVRR

SEQ ID NO: 1009480 - protein, 9 aa, Homo Sapiens
VGMDMNEDD

SEQ ID NO: 1009481 - protein, 9 aa, Homo Sapiens
SLGHNKNQQ

SEQ ID NO: 1009482 - protein, 9 aa, Homo Sapiens
PIKDELFPV

SEQ ID NO: 1009483 - protein, 9 aa, Homo Sapiens
PSKVRDWLA

SEQ ID NO: 1009484 - protein, 9 aa, Homo Sapiens
HIRNSSVRI

SEQ ID NO: 1009485 - protein, 9 aa, Homo Sapiens
PPPPAIIPM

SEQ ID NO: 1009486 - protein, 9 aa, Homo Sapiens
CKEDDIAGY

SEQ ID NO: 1009487 - protein, 9 aa, Homo Sapiens
LLAVTPPGV

SEQ ID NO: 1009488 - protein, 9 aa, Homo Sapiens
NNVAGEIDS

SEQ ID NO: 1009489 - protein, 9 aa, Homo Sapiens
LSKDNLLRI

SEQ ID NO: 1009490 - protein, 9 aa, Homo Sapiens
SPGSITTSF

SEQ ID NO: 1009491 - protein, 9 aa, Homo Sapiens
MLKKNVKVS

SEQ ID NO: 1009492 - protein, 9 aa, Homo Sapiens
KITCQNFIG

SEQ ID NO: 1009493 - protein, 9 aa, Homo Sapiens
SQVPPLVML

SEQ ID NO: 1009494 - protein, 9 aa, Homo Sapiens
RFRGGQDIV

SEQ ID NO: 1009495 - protein, 9 aa, Homo Sapiens
GIQGRKREP

SEQ ID NO: 1009496 - protein, 9 aa, Homo Sapiens
QDKPPGIIQ

SEQ ID NO: 1009497 - protein, 9 aa, Homo Sapiens
VGGDVQVGP

SEQ ID NO: 1009498 - protein, 9 aa, Homo Sapiens
VCANRLLIY

SEQ ID NO: 1009499 - protein, 9 aa, Homo Sapiens
INQTILKKF

SEQ ID NO: 1009500 - protein, 9 aa, Homo Sapiens
YTHAVAGVQ

SEQ ID NO: 1009501 - protein, 9 aa, Homo Sapiens
CTDCLLIAV

SEQ ID NO: 1009502 - protein, 9 aa, Homo Sapiens
GVLDSKRDR

SEQ ID NO: 1009503 - protein, 9 aa, Homo Sapiens
FHQEPPTKV

SEQ ID NO: 1009504 - protein, 9 aa, Homo Sapiens
VQSLLDEKQ

SEQ ID NO: 1009505 - protein, 9 aa, Homo Sapiens
YFEHYQSII

SEQ ID NO: 1009506 - protein, 9 aa, Homo Sapiens
RPPRNVRAV

SEQ ID NO: 1009507 - protein, 9 aa, Homo Sapiens
SLTTPLSGP

SEQ ID NO: 1009508 - protein, 9 aa, Homo Sapiens
GDIYGQFYD

SEQ ID NO: 1009509 - protein, 9 aa, Homo Sapiens
ACNFSTLGG

SEQ ID NO: 1009510 - protein, 9 aa, Homo Sapiens
RKQSKAKIS

SEQ ID NO: 1009511 - protein, 9 aa, Homo Sapiens
HASRGHVSH

SEQ ID NO: 1009512 - protein, 9 aa, Homo Sapiens
LNTTGSNLV

SEQ ID NO: 1009513 - protein, 9 aa, Homo Sapiens
QLKGPESLT

SEQ ID NO: 1009514 - protein, 9 aa, Homo Sapiens
PGVTSILKT

SEQ ID NO: 1009515 - protein, 9 aa, Homo Sapiens
HILNMARKI

SEQ ID NO: 1009516 - protein, 9 aa, Homo Sapiens
ITTSFFAQE

SEQ ID NO: 1009517 - protein, 9 aa, Homo Sapiens
QEKPGLQGL

SEQ ID NO: 1009518 - protein, 9 aa, Homo Sapiens
WSTDVKGER

SEQ ID NO: 1009519 - protein, 9 aa, Homo Sapiens
PYPPLDTPK

SEQ ID NO: 1009520 - protein, 9 aa, Homo Sapiens
KEEDLEEHY

SEQ ID NO: 1009521 - protein, 9 aa, Homo Sapiens
SLGLASFKT

SEQ ID NO: 1009522 - protein, 9 aa, Homo Sapiens
SNKNIFSPH

SEQ ID NO: 1009523 - protein, 9 aa, Homo Sapiens
GHTLCASTN

SEQ ID NO: 1009524 - protein, 9 aa, Homo Sapiens
SLSCTHPPL

SEQ ID NO: 1009525 - protein, 9 aa, Homo Sapiens
RLARKVEVN

SEQ ID NO: 1009526 - protein, 9 aa, Homo Sapiens
AEGSSPTSE

SEQ ID NO: 1009527 - protein, 9 aa, Homo Sapiens
ERAEFLQQE

SEQ ID NO: 1009528 - protein, 9 aa, Homo Sapiens
YESYLGVNL

SEQ ID NO: 1009529 - protein, 9 aa, Homo Sapiens
KRDRLILIN

SEQ ID NO: 1009530 - protein, 9 aa, Homo Sapiens
PVQVRSFVL

SEQ ID NO: 1009531 - protein, 9 aa, Homo Sapiens
EKWGSGDPE

SEQ ID NO: 1009532 - protein, 9 aa, Homo Sapiens
PEGEDSLSS

SEQ ID NO: 1009533 - protein, 9 aa, Homo Sapiens
EVRIKMMAV

SEQ ID NO: 1009534 - protein, 9 aa, Homo Sapiens
SDCFWPPYV

SEQ ID NO: 1009535 - protein, 9 aa, Homo Sapiens
CINPGENGL

SEQ ID NO: 1009536 - protein, 9 aa, Homo Sapiens
TEQLQQYNS

SEQ ID NO: 1009537 - protein, 9 aa, Homo Sapiens
ARQFSEPMP

SEQ ID NO: 1009538 - protein, 9 aa, Homo Sapiens
RRTGERVKR

SEQ ID NO: 1009539 - protein, 9 aa, Homo Sapiens
IAFREERAK

SEQ ID NO: 1009540 - protein, 9 aa, Homo Sapiens
RPFSCTQCG

SEQ ID NO: 1009541 - protein, 9 aa, Homo Sapiens
YAVFFAAYL

SEQ ID NO: 1009542 - protein, 9 aa, Homo Sapiens
EGYIAYRHN

SEQ ID NO: 1009543 - protein, 9 aa, Homo Sapiens
SVNLLKTIG

SEQ ID NO: 1009544 - protein, 9 aa, Homo Sapiens
LFSFRKSEK

SEQ ID NO: 1009545 - protein, 9 aa, Homo Sapiens
MLQQSTNSA

SEQ ID NO: 1009546 - protein, 9 aa, Homo Sapiens
FLFSYCKSH

SEQ ID NO: 1009547 - protein, 9 aa, Homo Sapiens
NLIISDINP

SEQ ID NO: 1009548 - protein, 9 aa, Homo Sapiens
NDIKRIGVR

SEQ ID NO: 1009549 - protein, 9 aa, Homo Sapiens
CKAPSVYPL

SEQ ID NO: 1009550 - protein, 9 aa, Homo Sapiens
DFKPRIVSY

SEQ ID NO: 1009551 - protein, 9 aa, Homo Sapiens
ASQRIEGAK

SEQ ID NO: 1009552 - protein, 9 aa, Homo Sapiens
PFFWRASKI

SEQ ID NO: 1009553 - protein, 9 aa, Homo Sapiens
TTGSNLVAQ

SEQ ID NO: 1009554 - protein, 9 aa, Homo Sapiens
SLAELYFLL

SEQ ID NO: 1009555 - protein, 9 aa, Homo Sapiens
KDTWKFLDM

SEQ ID NO: 1009556 - protein, 9 aa, Homo Sapiens
WRYLHHLDS

SEQ ID NO: 1009557 - protein, 9 aa, Homo Sapiens
NIVYFFPRN

SEQ ID NO: 1009558 - protein, 9 aa, Homo Sapiens
FHLFGECLF

SEQ ID NO: 1009559 - protein, 9 aa, Homo Sapiens
SVTKCSDFA

SEQ ID NO: 1009560 - protein, 9 aa, Homo Sapiens
DENFWARWS

SEQ ID NO: 1009561 - protein, 9 aa, Homo Sapiens
FSECIEGVK

SEQ ID NO: 1009562 - protein, 9 aa, Homo Sapiens
KTYIDTRIK

SEQ ID NO: 1009563 - protein, 9 aa, Homo Sapiens
PQVQPQIFS

SEQ ID NO: 1009564 - protein, 9 aa, Homo Sapiens
SLPRVLFPE

SEQ ID NO: 1009565 - protein, 9 aa, Homo Sapiens
LVDFKKIKE

SEQ ID NO: 1009566 - protein, 9 aa, Homo Sapiens
MLGHFAHNK

SEQ ID NO: 1009567 - protein, 9 aa, Homo Sapiens
KRIWESPLF

SEQ ID NO: 1009568 - protein, 9 aa, Homo Sapiens
KFYSVPSFS

SEQ ID NO: 1009569 - protein, 9 aa, Homo Sapiens
KRDRERDRD

SEQ ID NO: 1009570 - protein, 9 aa, Homo Sapiens
KAEWLVLLS

SEQ ID NO: 1009571 - protein, 9 aa, Homo Sapiens
NGRCVCWPG

SEQ ID NO: 1009572 - protein, 9 aa, Homo Sapiens
FSLSPGHAV

SEQ ID NO: 1009573 - protein, 9 aa, Homo Sapiens
NRGVPEMPG

SEQ ID NO: 1009574 - protein, 9 aa, Homo Sapiens
APLAEEKDD

SEQ ID NO: 1009575 - protein, 9 aa, Homo Sapiens
VMDFKNNYT

SEQ ID NO: 1009576 - protein, 9 aa, Homo Sapiens
MRNEHEKVV

SEQ ID NO: 1009577 - protein, 9 aa, Homo Sapiens
QNQAFSLSP

SEQ ID NO: 1009578 - protein, 9 aa, Homo Sapiens
KVPRLGIEN

SEQ ID NO: 1009579 - protein, 9 aa, Homo Sapiens
VCRLVTCVP

SEQ ID NO: 1009580 - protein, 9 aa, Homo Sapiens
VFLRLSHPN

SEQ ID NO: 1009581 - protein, 9 aa, Homo Sapiens
QKNLMRISG

SEQ ID NO: 1009582 - protein, 9 aa, Homo Sapiens
QGHCGHLKV

SEQ ID NO: 1009583 - protein, 9 aa, Homo Sapiens
YRDMSFFPE

SEQ ID NO: 1009584 - protein, 9 aa, Homo Sapiens
LMRISGSSD

SEQ ID NO: 1009585 - protein, 9 aa, Homo Sapiens
HYPPMPTRP

SEQ ID NO: 1009586 - protein, 9 aa, Homo Sapiens
GVPVLIGNH

SEQ ID NO: 1009587 - protein, 9 aa, Homo Sapiens
RAVQFWAIQ

SEQ ID NO: 1009588 - protein, 9 aa, Homo Sapiens
LLTLVENFT

SEQ ID NO: 1009589 - protein, 9 aa, Homo Sapiens
RFRGTWEKL

SEQ ID NO: 1009590 - protein, 9 aa, Homo Sapiens
DSDLVGALR

SEQ ID NO: 1009591 - protein, 9 aa, Homo Sapiens
TTLQSLDPS

SEQ ID NO: 1009592 - protein, 9 aa, Homo Sapiens
STKRLEKYL

SEQ ID NO: 1009593 - protein, 9 aa, Homo Sapiens
MTQYGRVIC

SEQ ID NO: 1009594 - protein, 9 aa, Homo Sapiens
YLNKRQFYA

SEQ ID NO: 1009595 - protein, 9 aa, Homo Sapiens
KIDRLLQST

SEQ ID NO: 1009596 - protein, 9 aa, Homo Sapiens
EMCAVIDEK

SEQ ID NO: 1009597 - protein, 9 aa, Homo Sapiens
TGARLYECG

SEQ ID NO: 1009598 - protein, 9 aa, Homo Sapiens
DKEEDLEEH

SEQ ID NO: 1009599 - protein, 9 aa, Homo Sapiens
PAMDGFVDQ

SEQ ID NO: 1009600 - protein, 9 aa, Homo Sapiens
KKFLFHPGY

SEQ ID NO: 1009601 - protein, 9 aa, Homo Sapiens
NGQSLPVSL

SEQ ID NO: 1009602 - protein, 9 aa, Homo Sapiens
GTSLSLQTA

SEQ ID NO: 1009603 - protein, 9 aa, Homo Sapiens
QQKAEWLVL

SEQ ID NO: 1009604 - protein, 9 aa, Homo Sapiens
EFSGKGSFP

SEQ ID NO: 1009605 - protein, 9 aa, Homo Sapiens
RPPDQKDNQ

SEQ ID NO: 1009606 - protein, 9 aa, Homo Sapiens
QLSLVGGLG

SEQ ID NO: 1009607 - protein, 9 aa, Homo Sapiens
IIPMGPAYN

SEQ ID NO: 1009608 - protein, 9 aa, Homo Sapiens
SSASSGDTT

SEQ ID NO: 1009609 - protein, 9 aa, Homo Sapiens
LDLTENALE

SEQ ID NO: 1009610 - protein, 9 aa, Homo Sapiens
GLQETQLAS

SEQ ID NO: 1009611 - protein, 9 aa, Homo Sapiens
SRRGRWCYT

SEQ ID NO: 1009612 - protein, 9 aa, Homo Sapiens
LDILVLILF

SEQ ID NO: 1009613 - protein, 9 aa, Homo Sapiens
LAKLVKRKQ

SEQ ID NO: 1009614 - protein, 9 aa, Homo Sapiens
PIIMAPIEI

SEQ ID NO: 1009615 - protein, 9 aa, Homo Sapiens
LERAKEAAI

SEQ ID NO: 1009616 - protein, 9 aa, Homo Sapiens
DLMENLREK

SEQ ID NO: 1009617 - protein, 9 aa, Homo Sapiens
NGGRYETTK

SEQ ID NO: 1009618 - protein, 9 aa, Homo Sapiens
GPTTVNGSK

SEQ ID NO: 1009619 - protein, 9 aa, Homo Sapiens
VAAFCCTIV

SEQ ID NO: 1009620 - protein, 9 aa, Homo Sapiens
DKTAIISLA

SEQ ID NO: 1009621 - protein, 9 aa, Homo Sapiens
IKEIILRKI

SEQ ID NO: 1009622 - protein, 9 aa, Homo Sapiens
AFNAQHKSR

SEQ ID NO: 1009623 - protein, 9 aa, Homo Sapiens
AGPHQAGHA

SEQ ID NO: 1009624 - protein, 9 aa, Homo Sapiens
APALSGPPP

SEQ ID NO: 1009625 - protein, 9 aa, Homo Sapiens
TSGKLNIDE

SEQ ID NO: 1009626 - protein, 9 aa, Homo Sapiens
CSRCGRHIY

SEQ ID NO: 1009627 - protein, 9 aa, Homo Sapiens
SLLEDIMYR

SEQ ID NO: 1009628 - protein, 9 aa, Homo Sapiens
GSPGSPGSF

SEQ ID NO: 1009629 - protein, 9 aa, Homo Sapiens
IAAFSPVCD

SEQ ID NO: 1009630 - protein, 9 aa, Homo Sapiens
PFIYTLCNK

SEQ ID NO: 1009631 - protein, 9 aa, Homo Sapiens
KDKTLHRAS

SEQ ID NO: 1009632 - protein, 9 aa, Homo Sapiens
KEDFSWSGK

SEQ ID NO: 1009633 - protein, 9 aa, Homo Sapiens
PTCGCSLGQ

SEQ ID NO: 1009634 - protein, 9 aa, Homo Sapiens
KVNKKNVQA

SEQ ID NO: 1009635 - protein, 9 aa, Homo Sapiens
TGERPFSCT

SEQ ID NO: 1009636 - protein, 9 aa, Homo Sapiens
ASSPCGEQF

SEQ ID NO: 1009637 - protein, 9 aa, Homo Sapiens
RELAKLVKR

SEQ ID NO: 1009638 - protein, 9 aa, Homo Sapiens
CTKDRTWNE

SEQ ID NO: 1009639 - protein, 9 aa, Homo Sapiens
KRVLEKRPT

SEQ ID NO: 1009640 - protein, 9 aa, Homo Sapiens
SNNKISTLS

SEQ ID NO: 1009641 - protein, 9 aa, Homo Sapiens
QQKKEKDII

SEQ ID NO: 1009642 - protein, 9 aa, Homo Sapiens
SNEPRIFSD

SEQ ID NO: 1009643 - protein, 9 aa, Homo Sapiens
GQCQDNQGF

SEQ ID NO: 1009644 - protein, 9 aa, Homo Sapiens
PYPENNGQR

SEQ ID NO: 1009645 - protein, 9 aa, Homo Sapiens
YLHHLDSQP

SEQ ID NO: 1009646 - protein, 9 aa, Homo Sapiens
EQRAQAALR

SEQ ID NO: 1009647 - protein, 9 aa, Homo Sapiens
EFFEECITN

SEQ ID NO: 1009648 - protein, 9 aa, Homo Sapiens
RAKEAAISM

SEQ ID NO: 1009649 - protein, 9 aa, Homo Sapiens
RNKIDLQNT

SEQ ID NO: 1009650 - protein, 9 aa, Homo Sapiens
ASSGDTTPL

SEQ ID NO: 1009651 - protein, 9 aa, Homo Sapiens
TLARWLQRV

SEQ ID NO: 1009652 - protein, 9 aa, Homo Sapiens
SYKKQSPQT

SEQ ID NO: 1009653 - protein, 9 aa, Homo Sapiens
YASSDGYYR

SEQ ID NO: 1009654 - protein, 9 aa, Homo Sapiens
KYVSYSESF

SEQ ID NO: 1009655 - protein, 9 aa, Homo Sapiens
PQNKLWIEI

SEQ ID NO: 1009656 - protein, 9 aa, Homo Sapiens
LRSVFWKKE

SEQ ID NO: 1009657 - protein, 9 aa, Homo Sapiens
NCRMQHITG

SEQ ID NO: 1009658 - protein, 9 aa, Homo Sapiens
NSENGHSSG

SEQ ID NO: 1009659 - protein, 9 aa, Homo Sapiens
KITNIIEYL

SEQ ID NO: 1009660 - protein, 9 aa, Homo Sapiens
DVDSLVDST

SEQ ID NO: 1009661 - protein, 9 aa, Homo Sapiens
YNFVLNSAI

SEQ ID NO: 1009662 - protein, 9 aa, Homo Sapiens
HDPIERDFI

SEQ ID NO: 1009663 - protein, 9 aa, Homo Sapiens
QVTELRSQV

SEQ ID NO: 1009664 - protein, 9 aa, Homo Sapiens
KVRAERNNA

SEQ ID NO: 1009665 - protein, 9 aa, Homo Sapiens
IAQREGTKY

SEQ ID NO: 1009666 - protein, 9 aa, Homo Sapiens
LDKNDNAPQ

SEQ ID NO: 1009667 - protein, 9 aa, Homo Sapiens
MEEEYRHIS

SEQ ID NO: 1009668 - protein, 9 aa, Homo Sapiens
NFRRKRKHR

SEQ ID NO: 1009669 - protein, 9 aa, Homo Sapiens
YIELLQQLN

SEQ ID NO: 1009670 - protein, 9 aa, Homo Sapiens
SSPRLTKPQ

SEQ ID NO: 1009671 - protein, 9 aa, Homo Sapiens
GSNLVAQVS

SEQ ID NO: 1009672 - protein, 9 aa, Homo Sapiens
RQMDARRNV

SEQ ID NO: 1009673 - protein, 9 aa, Homo Sapiens
CPTQIPVAA

SEQ ID NO: 1009674 - protein, 9 aa, Homo Sapiens
KVEKKAPDA

SEQ ID NO: 1009675 - protein, 9 aa, Homo Sapiens
KRMRNEISD

SEQ ID NO: 1009676 - protein, 9 aa, Homo Sapiens
TSPTAAFVS

SEQ ID NO: 1009677 - protein, 9 aa, Homo Sapiens
TKCPQNVDS

SEQ ID NO: 1009678 - protein, 9 aa, Homo Sapiens
EEKLYAKKE

SEQ ID NO: 1009679 - protein, 9 aa, Homo Sapiens
AWNKEDFSW

SEQ ID NO: 1009680 - protein, 9 aa, Homo Sapiens
CKRSYQLIH

SEQ ID NO: 1009681 - protein, 9 aa, Homo Sapiens
SMKECREGG

SEQ ID NO: 1009682 - protein, 9 aa, Homo Sapiens
VLLTTKLFQ

SEQ ID NO: 1009683 - protein, 9 aa, Homo Sapiens
YHKSFTKLF

SEQ ID NO: 1009684 - protein, 9 aa, Homo Sapiens
VVARVNCRM

SEQ ID NO: 1009685 - protein, 9 aa, Homo Sapiens
LQKLARSPA

SEQ ID NO: 1009686 - protein, 9 aa, Homo Sapiens
ENFLIIFTI

SEQ ID NO: 1009687 - protein, 9 aa, Homo Sapiens
FCIAKLMLY

SEQ ID NO: 1009688 - protein, 9 aa, Homo Sapiens
RTPLGQQRP

SEQ ID NO: 1009689 - protein, 9 aa, Homo Sapiens
QHLEQIGKK

SEQ ID NO: 1009690 - protein, 9 aa, Homo Sapiens
QVLFTRILA

SEQ ID NO: 1009691 - protein, 9 aa, Homo Sapiens
RLNFWNFNS

SEQ ID NO: 1009692 - protein, 9 aa, Homo Sapiens
PATTFLTVV

SEQ ID NO: 1009693 - protein, 9 aa, Homo Sapiens
GDVQVGPLA

SEQ ID NO: 1009694 - protein, 9 aa, Homo Sapiens
QRVSFSLYK

SEQ ID NO: 1009695 - protein, 9 aa, Homo Sapiens
LSERAVQFW

SEQ ID NO: 1009696 - protein, 9 aa, Homo Sapiens
TDQQKAEWL

SEQ ID NO: 1009697 - protein, 9 aa, Homo Sapiens
SENGHSSGE

SEQ ID NO: 1009698 - protein, 9 aa, Homo Sapiens
ITAILAMAV

SEQ ID NO: 1009699 - protein, 9 aa, Homo Sapiens
SNLVAQVSL

SEQ ID NO: 1009700 - protein, 9 aa, Homo Sapiens
ALMENIFMV

SEQ ID NO: 1009701 - protein, 9 aa, Homo Sapiens
EEDDNNDDD

SEQ ID NO: 1009702 - protein, 9 aa, Homo Sapiens
SPLVVNENC

SEQ ID NO: 1009703 - protein, 9 aa, Homo Sapiens
TLIDLSNNK

SEQ ID NO: 1009704 - protein, 9 aa, Homo Sapiens
ARVNCRMQH

SEQ ID NO: 1009705 - protein, 9 aa, Homo Sapiens
KMMAVGICG

SEQ ID NO: 1009706 - protein, 9 aa, Homo Sapiens
VTEPSQGQV

SEQ ID NO: 1009707 - protein, 9 aa, Homo Sapiens
VFIWKNIHT

SEQ ID NO: 1009708 - protein, 9 aa, Homo Sapiens
CLSQSEQTT

SEQ ID NO: 1009709 - protein, 9 aa, Homo Sapiens
VAPIIMAPI

SEQ ID NO: 1009710 - protein, 9 aa, Homo Sapiens
TLYRDVMLK

SEQ ID NO: 1009711 - protein, 9 aa, Homo Sapiens
MKKPGPNFV

SEQ ID NO: 1009712 - protein, 9 aa, Homo Sapiens
PLEELDYLL

SEQ ID NO: 1009713 - protein, 9 aa, Homo Sapiens
ETQLASFPD

SEQ ID NO: 1009714 - protein, 9 aa, Homo Sapiens
AQDKWALDS

SEQ ID NO: 1009715 - protein, 9 aa, Homo Sapiens
YTREKAYKC

SEQ ID NO: 1009716 - protein, 9 aa, Homo Sapiens
MNGAPSSAV

SEQ ID NO: 1009717 - protein, 9 aa, Homo Sapiens
ETIRSLVDS

SEQ ID NO: 1009718 - protein, 9 aa, Homo Sapiens
RMNMGRINE

SEQ ID NO: 1009719 - protein, 9 aa, Homo Sapiens
NHTDMALLA

SEQ ID NO: 1009720 - protein, 9 aa, Homo Sapiens
QLLNNLLPY

SEQ ID NO: 1009721 - protein, 9 aa, Homo Sapiens
REGPAFYPS

SEQ ID NO: 1009722 - protein, 9 aa, Homo Sapiens
SIEERKKQT

SEQ ID NO: 1009723 - protein, 9 aa, Homo Sapiens
PVTVCGDIY

SEQ ID NO: 1009724 - protein, 9 aa, Homo Sapiens
PVSSSFNDI

SEQ ID NO: 1009725 - protein, 9 aa, Homo Sapiens
SRCGRHIYS

SEQ ID NO: 1009726 - protein, 9 aa, Homo Sapiens
DSEDKRGPG

SEQ ID NO: 1009727 - protein, 9 aa, Homo Sapiens
SGKNCSSPA

SEQ ID NO: 1009728 - protein, 9 aa, Homo Sapiens
QEEPRGTQA

SEQ ID NO: 1009729 - protein, 9 aa, Homo Sapiens
WPTLARWLQ

SEQ ID NO: 1009730 - protein, 9 aa, Homo Sapiens
VTLSWELQA

SEQ ID NO: 1009731 - protein, 9 aa, Homo Sapiens
KTKVVPETP

SEQ ID NO: 1009732 - protein, 9 aa, Homo Sapiens
LFLSHAHAP

SEQ ID NO: 1009733 - protein, 9 aa, Homo Sapiens
HFSCCNSNL

SEQ ID NO: 1009734 - protein, 9 aa, Homo Sapiens
VPISPSEPF

SEQ ID NO: 1009735 - protein, 9 aa, Homo Sapiens
EVFQELESD

SEQ ID NO: 1009736 - protein, 9 aa, Homo Sapiens
TQIFLFSLF

SEQ ID NO: 1009737 - protein, 9 aa, Homo Sapiens
AQREGTKYV

SEQ ID NO: 1009738 - protein, 9 aa, Homo Sapiens
GSSPTSEGA

SEQ ID NO: 1009739 - protein, 9 aa, Homo Sapiens
GFLRNHMRL

SEQ ID NO: 1009740 - protein, 9 aa, Homo Sapiens
ERLQLNKDN

SEQ ID NO: 1009741 - protein, 9 aa, Homo Sapiens
SRCLLNEEV

SEQ ID NO: 1009742 - protein, 9 aa, Homo Sapiens
PHEDPQCLS

SEQ ID NO: 1009743 - protein, 9 aa, Homo Sapiens
DFTVIKDYC

SEQ ID NO: 1009744 - protein, 9 aa, Homo Sapiens
GKISEGLQG

SEQ ID NO: 1009745 - protein, 9 aa, Homo Sapiens
TGVKPYVCT

SEQ ID NO: 1009746 - protein, 9 aa, Homo Sapiens
MHLYLPSHP

SEQ ID NO: 1009747 - protein, 9 aa, Homo Sapiens
LASLGLASF

SEQ ID NO: 1009748 - protein, 9 aa, Homo Sapiens
PFHFARVLY

SEQ ID NO: 1009749 - protein, 9 aa, Homo Sapiens
AAEEPEDSA

SEQ ID NO: 1009750 - protein, 9 aa, Homo Sapiens
RVGGDVQVG

SEQ ID NO: 1009751 - protein, 9 aa, Homo Sapiens
LSSRDKEKL

SEQ ID NO: 1009752 - protein, 9 aa, Homo Sapiens
SQAILITEL

SEQ ID NO: 1009753 - protein, 9 aa, Homo Sapiens
ILKKFILVG

SEQ ID NO: 1009754 - protein, 9 aa, Homo Sapiens
ARERPAESA

SEQ ID NO: 1009755 - protein, 9 aa, Homo Sapiens
RIERCPNTY

SEQ ID NO: 1009756 - protein, 9 aa, Homo Sapiens
HKEKVDLWC

SEQ ID NO: 1009757 - protein, 9 aa, Homo Sapiens
HALIWRPGT

SEQ ID NO: 1009758 - protein, 9 aa, Homo Sapiens
KHKRIYTRE

SEQ ID NO: 1009759 - protein, 9 aa, Homo Sapiens
CFISSWNKP

SEQ ID NO: 1009760 - protein, 9 aa, Homo Sapiens
TCQTTVCRL

SEQ ID NO: 1009761 - protein, 9 aa, Homo Sapiens
LMENLREKL

SEQ ID NO: 1009762 - protein, 9 aa, Homo Sapiens
EQLQQYNSP

SEQ ID NO: 1009763 - protein, 9 aa, Homo Sapiens
RKEIRKVTG

SEQ ID NO: 1009764 - protein, 9 aa, Homo Sapiens
AAGAIQRSD

SEQ ID NO: 1009765 - protein, 9 aa, Homo Sapiens
EPAIAIDLS

SEQ ID NO: 1009766 - protein, 9 aa, Homo Sapiens
FLTGLGHKS

SEQ ID NO: 1009767 - protein, 9 aa, Homo Sapiens
LVLNGGQPQ

SEQ ID NO: 1009768 - protein, 9 aa, Homo Sapiens
GKMNKTVNQ

SEQ ID NO: 1009769 - protein, 9 aa, Homo Sapiens
EDFEIVIIL

SEQ ID NO: 1009770 - protein, 9 aa, Homo Sapiens
DASTDEAAI

SEQ ID NO: 1009771 - protein, 9 aa, Homo Sapiens
MENLREKLT

SEQ ID NO: 1009772 - protein, 9 aa, Homo Sapiens
FLQEPHSGS

SEQ ID NO: 1009773 - protein, 9 aa, Homo Sapiens
RLGKHWYQQ

SEQ ID NO: 1009774 - protein, 9 aa, Homo Sapiens
EKMVQCNKG

SEQ ID NO: 1009775 - protein, 9 aa, Homo Sapiens
TSNEPRIFS

SEQ ID NO: 1009776 - protein, 9 aa, Homo Sapiens
SENSQDQGK

SEQ ID NO: 1009777 - protein, 9 aa, Homo Sapiens
APIIMAPIE

SEQ ID NO: 1009778 - protein, 9 aa, Homo Sapiens
HLRVLLDNV

SEQ ID NO: 1009779 - protein, 9 aa, Homo Sapiens
YLLTLVENF

SEQ ID NO: 1009780 - protein, 9 aa, Homo Sapiens
SPLLLLSRS

SEQ ID NO: 1009781 - protein, 9 aa, Homo Sapiens
NHQRLGTHW

SEQ ID NO: 1009782 - protein, 9 aa, Homo Sapiens
ILVVICAII

SEQ ID NO: 1009783 - protein, 9 aa, Homo Sapiens
DPDPCCLLT

SEQ ID NO: 1009784 - protein, 9 aa, Homo Sapiens
KRIYTGQKP

SEQ ID NO: 1009785 - protein, 9 aa, Homo Sapiens
DLDLYISIF

SEQ ID NO: 1009786 - protein, 9 aa, Homo Sapiens
REGTKYVSH

SEQ ID NO: 1009787 - protein, 9 aa, Homo Sapiens
HHRQRLSGN

SEQ ID NO: 1009788 - protein, 9 aa, Homo Sapiens
GLWAWNEKR

SEQ ID NO: 1009789 - protein, 9 aa, Homo Sapiens
TAIGSFSSH

SEQ ID NO: 1009790 - protein, 9 aa, Homo Sapiens
LNGTVVWTP

SEQ ID NO: 1009791 - protein, 9 aa, Homo Sapiens
GAKATPGRR

SEQ ID NO: 1009792 - protein, 9 aa, Homo Sapiens
VVVIPRSFN

SEQ ID NO: 1009793 - protein, 9 aa, Homo Sapiens
PKYKITEKS

SEQ ID NO: 1009794 - protein, 9 aa, Homo Sapiens
RERYRERKR

SEQ ID NO: 1009795 - protein, 9 aa, Homo Sapiens
RIFSDTADG

SEQ ID NO: 1009796 - protein, 9 aa, Homo Sapiens
VIVGIGVFI

SEQ ID NO: 1009797 - protein, 9 aa, Homo Sapiens
AKLNTFCVI

SEQ ID NO: 1009798 - protein, 9 aa, Homo Sapiens
AGPAKENEH

SEQ ID NO: 1009799 - protein, 9 aa, Homo Sapiens
KIKNTISYS

SEQ ID NO: 1009800 - protein, 9 aa, Homo Sapiens
LYLPKDKEE

SEQ ID NO: 1009801 - protein, 9 aa, Homo Sapiens
SASLLESKS

SEQ ID NO: 1009802 - protein, 9 aa, Homo Sapiens
ECGKLFSKK

SEQ ID NO: 1009803 - protein, 9 aa, Homo Sapiens
PWDLREERS

SEQ ID NO: 1009804 - protein, 9 aa, Homo Sapiens
LQRHPDLPR

SEQ ID NO: 1009805 - protein, 9 aa, Homo Sapiens
LCEVPRNLC

SEQ ID NO: 1009806 - protein, 9 aa, Homo Sapiens
ERSHHHYPD

SEQ ID NO: 1009807 - protein, 9 aa, Homo Sapiens
FPLLSSTTT

SEQ ID NO: 1009808 - protein, 9 aa, Homo Sapiens
VGDLVALGQ

SEQ ID NO: 1009809 - protein, 9 aa, Homo Sapiens
KINKDDYLL

SEQ ID NO: 1009810 - protein, 9 aa, Homo Sapiens
LTLLRSVFW

SEQ ID NO: 1009811 - protein, 9 aa, Homo Sapiens
VSSRKQHPA

SEQ ID NO: 1009812 - protein, 9 aa, Homo Sapiens
PAVAATSAS

SEQ ID NO: 1009813 - protein, 9 aa, Homo Sapiens
GTGPTAGRN

SEQ ID NO: 1009814 - protein, 9 aa, Homo Sapiens
KNLMRISGS

SEQ ID NO: 1009815 - protein, 9 aa, Homo Sapiens
PVYEENKSE

SEQ ID NO: 1009816 - protein, 9 aa, Homo Sapiens
KDYDDKEPR

SEQ ID NO: 1009817 - protein, 9 aa, Homo Sapiens
IDFPIKTNL

SEQ ID NO: 1009818 - protein, 9 aa, Homo Sapiens
HSAVVNWTF

SEQ ID NO: 1009819 - protein, 9 aa, Homo Sapiens
QVSALEILN

SEQ ID NO: 1009820 - protein, 9 aa, Homo Sapiens
PICTVKSFL

SEQ ID NO: 1009821 - protein, 9 aa, Homo Sapiens
TTSSQIRVP

SEQ ID NO: 1009822 - protein, 9 aa, Homo Sapiens
AKNQVAINP

SEQ ID NO: 1009823 - protein, 9 aa, Homo Sapiens
KVSGSRGFF

SEQ ID NO: 1009824 - protein, 9 aa, Homo Sapiens
FFAGCTAQH

SEQ ID NO: 1009825 - protein, 9 aa, Homo Sapiens
KDSSLQWSN

SEQ ID NO: 1009826 - protein, 9 aa, Homo Sapiens
GRCHYSRDV

SEQ ID NO: 1009827 - protein, 9 aa, Homo Sapiens
ADSESRGGK

SEQ ID NO: 1009828 - protein, 9 aa, Homo Sapiens
FYLLTLVEN

SEQ ID NO: 1009829 - protein, 9 aa, Homo Sapiens
LSSWYHDQG

SEQ ID NO: 1009830 - protein, 9 aa, Homo Sapiens
TASTLPVDI

SEQ ID NO: 1009831 - protein, 9 aa, Homo Sapiens
LLKEEHRAY

SEQ ID NO: 1009832 - protein, 9 aa, Homo Sapiens
KEEKLYAKK

SEQ ID NO: 1009833 - protein, 9 aa, Homo Sapiens
NRLIGGLAS

SEQ ID NO: 1009834 - protein, 9 aa, Homo Sapiens
FAEALPSDK

SEQ ID NO: 1009835 - protein, 9 aa, Homo Sapiens
KDKEEDLEE

SEQ ID NO: 1009836 - protein, 9 aa, Homo Sapiens
SNGYISIPG

SEQ ID NO: 1009837 - protein, 9 aa, Homo Sapiens
YDDKEPRHK

SEQ ID NO: 1009838 - protein, 9 aa, Homo Sapiens
NFSDKEVKD

SEQ ID NO: 1009839 - protein, 9 aa, Homo Sapiens
IDKKRSEIS

SEQ ID NO: 1009840 - protein, 9 aa, Homo Sapiens
MTYLNKRQF

SEQ ID NO: 1009841 - protein, 9 aa, Homo Sapiens
PLTDRYGRP

SEQ ID NO: 1009842 - protein, 9 aa, Homo Sapiens
KSEHKNVVD

SEQ ID NO: 1009843 - protein, 9 aa, Homo Sapiens
PDPSEKWGS

SEQ ID NO: 1009844 - protein, 9 aa, Homo Sapiens
IKQEEDPPK

SEQ ID NO: 1009845 - protein, 9 aa, Homo Sapiens
VPSSTRVGG

SEQ ID NO: 1009846 - protein, 9 aa, Homo Sapiens
NCSQAPVLL

SEQ ID NO: 1009847 - protein, 9 aa, Homo Sapiens
KLQRTQANS

SEQ ID NO: 1009848 - protein, 9 aa, Homo Sapiens
QKKVPGDSQ

SEQ ID NO: 1009849 - protein, 9 aa, Homo Sapiens
HYAAFLLPS

SEQ ID NO: 1009850 - protein, 9 aa, Homo Sapiens
FFIAVTEVQ

SEQ ID NO: 1009851 - protein, 9 aa, Homo Sapiens
IPHFFCNPS

SEQ ID NO: 1009852 - protein, 9 aa, Homo Sapiens
RKEAKKFWH

SEQ ID NO: 1009853 - protein, 9 aa, Homo Sapiens
TFKEETLRT

SEQ ID NO: 1009854 - protein, 9 aa, Homo Sapiens
GSGSMSLDS

SEQ ID NO: 1009855 - protein, 9 aa, Homo Sapiens
SECPSRVPV

SEQ ID NO: 1009856 - protein, 9 aa, Homo Sapiens
VNGGRYETT

SEQ ID NO: 1009857 - protein, 9 aa, Homo Sapiens
EEPEDSASA

SEQ ID NO: 1009858 - protein, 9 aa, Homo Sapiens
EKGNRGVPE

SEQ ID NO: 1009859 - protein, 9 aa, Homo Sapiens
SLANRLIGG

SEQ ID NO: 1009860 - protein, 9 aa, Homo Sapiens
VLAQAKFSA

SEQ ID NO: 1009861 - protein, 9 aa, Homo Sapiens
PIGNKTLSG

SEQ ID NO: 1009862 - protein, 9 aa, Homo Sapiens
TFLTVVPDK

SEQ ID NO: 1009863 - protein, 9 aa, Homo Sapiens
TTFLLQHNQ

SEQ ID NO: 1009864 - protein, 9 aa, Homo Sapiens
AHACNFSTL

SEQ ID NO: 1009865 - protein, 9 aa, Homo Sapiens
TLSSRDKEK

SEQ ID NO: 1009866 - protein, 9 aa, Homo Sapiens
RETCVNLHL

SEQ ID NO: 1009867 - protein, 9 aa, Homo Sapiens
SVCPTQIPV

SEQ ID NO: 1009868 - protein, 9 aa, Homo Sapiens
KPEESLKEL

SEQ ID NO: 1009869 - protein, 9 aa, Homo Sapiens
CRKIFPGLI

SEQ ID NO: 1009870 - protein, 9 aa, Homo Sapiens
SLRTEDLVD

SEQ ID NO: 1009871 - protein, 9 aa, Homo Sapiens
HYEILIHNL

SEQ ID NO: 1009872 - protein, 9 aa, Homo Sapiens
LLQQLNDLE

SEQ ID NO: 1009873 - protein, 9 aa, Homo Sapiens
KCKGFGFVI

SEQ ID NO: 1009874 - protein, 9 aa, Homo Sapiens
RSSSPRTRA

SEQ ID NO: 1009875 - protein, 9 aa, Homo Sapiens
GVCANRLLI

SEQ ID NO: 1009876 - protein, 9 aa, Homo Sapiens
SSRRGPPPS

SEQ ID NO: 1009877 - protein, 9 aa, Homo Sapiens
RVYLYSKYR

SEQ ID NO: 1009878 - protein, 9 aa, Homo Sapiens
GMDMNEDDD

SEQ ID NO: 1009879 - protein, 9 aa, Homo Sapiens
EPSETQPFS

SEQ ID NO: 1009880 - protein, 9 aa, Homo Sapiens
KALEHCGSV

SEQ ID NO: 1009881 - protein, 9 aa, Homo Sapiens
EDKNELLRV

SEQ ID NO: 1009882 - protein, 9 aa, Homo Sapiens
FPQVQPQIF

SEQ ID NO: 1009883 - protein, 9 aa, Homo Sapiens
EALPSDKEG

SEQ ID NO: 1009884 - protein, 9 aa, Homo Sapiens
PVDISTPVI

SEQ ID NO: 1009885 - protein, 9 aa, Homo Sapiens
VGGVPVLIG

SEQ ID NO: 1009886 - protein, 9 aa, Homo Sapiens
SDLGTYTCK

SEQ ID NO: 1009887 - protein, 9 aa, Homo Sapiens
KGKLPPRAG

SEQ ID NO: 1009888 - protein, 9 aa, Homo Sapiens
VLDKLKAKR

SEQ ID NO: 1009889 - protein, 9 aa, Homo Sapiens
GASLWLQVG

SEQ ID NO: 1009890 - protein, 9 aa, Homo Sapiens
GSRMNMGRI

SEQ ID NO: 1009891 - protein, 9 aa, Homo Sapiens
SRVSSRKQH

SEQ ID NO: 1009892 - protein, 9 aa, Homo Sapiens
NSKFLCADY

SEQ ID NO: 1009893 - protein, 9 aa, Homo Sapiens
LPYALIKEI

SEQ ID NO: 1009894 - protein, 9 aa, Homo Sapiens
SLPSVQTWI

SEQ ID NO: 1009895 - protein, 9 aa, Homo Sapiens
LHLLKAFSK

SEQ ID NO: 1009896 - protein, 9 aa, Homo Sapiens
GARLYECGQ

SEQ ID NO: 1009897 - protein, 9 aa, Homo Sapiens
LVSFVLLLA

SEQ ID NO: 1009898 - protein, 9 aa, Homo Sapiens
PAVGVIVLT

SEQ ID NO: 1009899 - protein, 9 aa, Homo Sapiens
LDTPKTATG

SEQ ID NO: 1009900 - protein, 9 aa, Homo Sapiens
IAFLGERVY

SEQ ID NO: 1009901 - protein, 9 aa, Homo Sapiens
AEEKDDVEF

SEQ ID NO: 1009902 - protein, 9 aa, Homo Sapiens
GVIVLTGGD

SEQ ID NO: 1009903 - protein, 9 aa, Homo Sapiens
RASKIELTI

SEQ ID NO: 1009904 - protein, 9 aa, Homo Sapiens
EFPKEEWVE

SEQ ID NO: 1009905 - protein, 9 aa, Homo Sapiens
FHPGYTVPS

SEQ ID NO: 1009906 - protein, 9 aa, Homo Sapiens
LSKRPCGRS

SEQ ID NO: 1009907 - protein, 9 aa, Homo Sapiens
KIFLQDHLD

SEQ ID NO: 1009908 - protein, 9 aa, Homo Sapiens
CCLLTNGKL

SEQ ID NO: 1009909 - protein, 9 aa, Homo Sapiens
DCFWPPYVE

SEQ ID NO: 1009910 - protein, 9 aa, Homo Sapiens
WKTNKAQAI

SEQ ID NO: 1009911 - protein, 9 aa, Homo Sapiens
VMLKNYSHL

SEQ ID NO: 1009912 - protein, 9 aa, Homo Sapiens
GLIFDHEDL

SEQ ID NO: 1009913 - protein, 9 aa, Homo Sapiens
RDTAWAVPP

SEQ ID NO: 1009914 - protein, 9 aa, Homo Sapiens
ATPLLQTAK

SEQ ID NO: 1009915 - protein, 9 aa, Homo Sapiens
TSSSVQPLS

SEQ ID NO: 1009916 - protein, 9 aa, Homo Sapiens
SGSTEGKDL

SEQ ID NO: 1009917 - protein, 9 aa, Homo Sapiens
ILPENFLII

SEQ ID NO: 1009918 - protein, 9 aa, Homo Sapiens
LLNGENLKN

SEQ ID NO: 1009919 - protein, 9 aa, Homo Sapiens
GYTVPSTAR

SEQ ID NO: 1009920 - protein, 9 aa, Homo Sapiens
GPPPSRSRG

SEQ ID NO: 1009921 - protein, 9 aa, Homo Sapiens
TCFFQDHSY

SEQ ID NO: 1009922 - protein, 9 aa, Homo Sapiens
SFFRAQRSA

SEQ ID NO: 1009923 - protein, 9 aa, Homo Sapiens
LEILNKHLQ

SEQ ID NO: 1009924 - protein, 9 aa, Homo Sapiens
RGDDVFKAS

SEQ ID NO: 1009925 - protein, 9 aa, Homo Sapiens
YLYTAKGAQ

SEQ ID NO: 1009926 - protein, 9 aa, Homo Sapiens
GLNKLTTFL

SEQ ID NO: 1009927 - protein, 9 aa, Homo Sapiens
TLFTLAGLW

SEQ ID NO: 1009928 - protein, 9 aa, Homo Sapiens
RKKQTRNAR

SEQ ID NO: 1009929 - protein, 9 aa, Homo Sapiens
IDDLNMPVL

SEQ ID NO: 1009930 - protein, 9 aa, Homo Sapiens
AKESSLMND

SEQ ID NO: 1009931 - protein, 9 aa, Homo Sapiens
QAVSELWNF

SEQ ID NO: 1009932 - protein, 9 aa, Homo Sapiens
LLLYPGLAD

SEQ ID NO: 1009933 - protein, 9 aa, Homo Sapiens
VLSIDVTDK

SEQ ID NO: 1009934 - protein, 9 aa, Homo Sapiens
WNETKPVCK

SEQ ID NO: 1009935 - protein, 9 aa, Homo Sapiens
GIFSLDGGC

SEQ ID NO: 1009936 - protein, 9 aa, Homo Sapiens
CPFIFLVYQ

SEQ ID NO: 1009937 - protein, 9 aa, Homo Sapiens
NVREISVST

SEQ ID NO: 1009938 - protein, 9 aa, Homo Sapiens
VPSGVSDKW

SEQ ID NO: 1009939 - protein, 9 aa, Homo Sapiens
ASGGPTVSK

SEQ ID NO: 1009940 - protein, 9 aa, Homo Sapiens
SLQIPQSPL

SEQ ID NO: 1009941 - protein, 9 aa, Homo Sapiens
PPKDQPQEE

SEQ ID NO: 1009942 - protein, 9 aa, Homo Sapiens
KGAQEEPQV

SEQ ID NO: 1009943 - protein, 9 aa, Homo Sapiens
RRIHTGARL

SEQ ID NO: 1009944 - protein, 9 aa, Homo Sapiens
EKGMKTLTQ

SEQ ID NO: 1009945 - protein, 9 aa, Homo Sapiens
YGLLGNRLW

SEQ ID NO: 1009946 - protein, 9 aa, Homo Sapiens
FIILPENFL

SEQ ID NO: 1009947 - protein, 9 aa, Homo Sapiens
LSKPAVSTV

SEQ ID NO: 1009948 - protein, 9 aa, Homo Sapiens
VPTSGKMHI

SEQ ID NO: 1009949 - protein, 9 aa, Homo Sapiens
KGSFPVAEK

SEQ ID NO: 1009950 - protein, 9 aa, Homo Sapiens
LEGPSQQGV

SEQ ID NO: 1009951 - protein, 9 aa, Homo Sapiens
FSRDSLISQ

SEQ ID NO: 1009952 - protein, 9 aa, Homo Sapiens
CFAVPVLPA

SEQ ID NO: 1009953 - protein, 9 aa, Homo Sapiens
DENRNAVIS

SEQ ID NO: 1009954 - protein, 9 aa, Homo Sapiens
DFSWSGKVK

SEQ ID NO: 1009955 - protein, 9 aa, Homo Sapiens
RPTMDSSAH

SEQ ID NO: 1009956 - protein, 9 aa, Homo Sapiens
LMDNLFEYV

SEQ ID NO: 1009957 - protein, 9 aa, Homo Sapiens
DVREGPAFY

SEQ ID NO: 1009958 - protein, 9 aa, Homo Sapiens
KLRDISYPE

SEQ ID NO: 1009959 - protein, 9 aa, Homo Sapiens
SRDKEKLPP

SEQ ID NO: 1009960 - protein, 9 aa, Homo Sapiens
VSCKAPSVY

SEQ ID NO: 1009961 - protein, 9 aa, Homo Sapiens
IYTLCNKEV

SEQ ID NO: 1009962 - protein, 9 aa, Homo Sapiens
VRTKGIPHL

SEQ ID NO: 1009963 - protein, 9 aa, Homo Sapiens
TSVLSFDLC

SEQ ID NO: 1009964 - protein, 9 aa, Homo Sapiens
FTRILAMKA

SEQ ID NO: 1009965 - protein, 9 aa, Homo Sapiens
TFSVIIDVD

SEQ ID NO: 1009966 - protein, 9 aa, Homo Sapiens
MAEERAEFL

SEQ ID NO: 1009967 - protein, 9 aa, Homo Sapiens
LSHPSPYMP

SEQ ID NO: 1009968 - protein, 9 aa, Homo Sapiens
FYRKEIRKV

SEQ ID NO: 1009969 - protein, 9 aa, Homo Sapiens
SLRGFDQQM

SEQ ID NO: 1009970 - protein, 9 aa, Homo Sapiens
GYLYTAKGA

SEQ ID NO: 1009971 - protein, 9 aa, Homo Sapiens
EVNMPPENS

SEQ ID NO: 1009972 - protein, 9 aa, Homo Sapiens
LISIPHFLL

SEQ ID NO: 1009973 - protein, 9 aa, Homo Sapiens
RTEDLVDTD

SEQ ID NO: 1009974 - protein, 9 aa, Homo Sapiens
QYEVCLTEG

SEQ ID NO: 1009975 - protein, 9 aa, Homo Sapiens
SRKQHPAGP

SEQ ID NO: 1009976 - protein, 9 aa, Homo Sapiens
LNLTTDNAS

SEQ ID NO: 1009977 - protein, 9 aa, Homo Sapiens
DLNMPVLET

SEQ ID NO: 1009978 - protein, 9 aa, Homo Sapiens
TNNDIKRIG

SEQ ID NO: 1009979 - protein, 9 aa, Homo Sapiens
DHGSRLLPE

SEQ ID NO: 1009980 - protein, 9 aa, Homo Sapiens
IIIVLLICI

SEQ ID NO: 1009981 - protein, 9 aa, Homo Sapiens
SFPTFQFQY

SEQ ID NO: 1009982 - protein, 9 aa, Homo Sapiens
RGPPPSRSR

SEQ ID NO: 1009983 - protein, 9 aa, Homo Sapiens
VILSAYITI

SEQ ID NO: 1009984 - protein, 9 aa, Homo Sapiens
ILLSNFYLL

SEQ ID NO: 1009985 - protein, 9 aa, Homo Sapiens
AAAGAIQRS

SEQ ID NO: 1009986 - protein, 9 aa, Homo Sapiens
KIDNFYPER

SEQ ID NO: 1009987 - protein, 9 aa, Homo Sapiens
NEGMLTEES

SEQ ID NO: 1009988 - protein, 9 aa, Homo Sapiens
EQNMIVTGR

SEQ ID NO: 1009989 - protein, 9 aa, Homo Sapiens
PSPAFTSSQ

SEQ ID NO: 1009990 - protein, 9 aa, Homo Sapiens
KLFSKKFDL

SEQ ID NO: 1009991 - protein, 9 aa, Homo Sapiens
VPTPVFLTM

SEQ ID NO: 1009992 - protein, 9 aa, Homo Sapiens
VRWEAPFCP

SEQ ID NO: 1009993 - protein, 9 aa, Homo Sapiens
VPLTMDTEI

SEQ ID NO: 1009994 - protein, 9 aa, Homo Sapiens
PSSFFRAQR

SEQ ID NO: 1009995 - protein, 9 aa, Homo Sapiens
KEIILRKIF

SEQ ID NO: 1009996 - protein, 9 aa, Homo Sapiens
FLYLPKDKE

SEQ ID NO: 1009997 - protein, 9 aa, Homo Sapiens
ERRFQLKGP

SEQ ID NO: 1009998 - protein, 9 aa, Homo Sapiens
EILIHNLQE

SEQ ID NO: 1009999 - protein, 9 aa, Homo Sapiens
SKECWEELH

SEQ ID NO: 1010000 - protein, 9 aa, Homo Sapiens
YAKFSLACV

SEQ ID NO: 1010001 - protein, 9 aa, Homo Sapiens
RLLIYKDRL

SEQ ID NO: 1010002 - protein, 9 aa, Homo Sapiens
FHCLSPKKM

SEQ ID NO: 1010003 - protein, 9 aa, Homo Sapiens
SVFDAYMKP

SEQ ID NO: 1010004 - protein, 9 aa, Homo Sapiens
NHSSATEFY

SEQ ID NO: 1010005 - protein, 9 aa, Homo Sapiens
RCEVPDLGR

SEQ ID NO: 1010006 - protein, 9 aa, Homo Sapiens
SSFRNKIDL

SEQ ID NO: 1010007 - protein, 9 aa, Homo Sapiens
ATKDTPTNR

SEQ ID NO: 1010008 - protein, 9 aa, Homo Sapiens
ITNPLLREH

SEQ ID NO: 1010009 - protein, 9 aa, Homo Sapiens
VYEENKSEY

SEQ ID NO: 1010010 - protein, 9 aa, Homo Sapiens
KKILPGTFN

SEQ ID NO: 1010011 - protein, 9 aa, Homo Sapiens
VEVADFDFF

SEQ ID NO: 1010012 - protein, 9 aa, Homo Sapiens
PPGIIQRKM

SEQ ID NO: 1010013 - protein, 9 aa, Homo Sapiens
GDFQEPSET

SEQ ID NO: 1010014 - protein, 9 aa, Homo Sapiens
DVSCLFCTK

SEQ ID NO: 1010015 - protein, 9 aa, Homo Sapiens
PNNSDLTLY

SEQ ID NO: 1010016 - protein, 9 aa, Homo Sapiens
ARSLTLFTA

SEQ ID NO: 1010017 - protein, 9 aa, Homo Sapiens
VFVRSFFVG

SEQ ID NO: 1010018 - protein, 9 aa, Homo Sapiens
GGDGTTSSQ

SEQ ID NO: 1010019 - protein, 9 aa, Homo Sapiens
ASITHFLQV

SEQ ID NO: 1010020 - protein, 9 aa, Homo Sapiens
SRPQRACLS

SEQ ID NO: 1010021 - protein, 9 aa, Homo Sapiens
LTAVIIFYS

SEQ ID NO: 1010022 - protein, 9 aa, Homo Sapiens
AWVILGVIS

SEQ ID NO: 1010023 - protein, 9 aa, Homo Sapiens
DPVVARVNC

SEQ ID NO: 1010024 - protein, 9 aa, Homo Sapiens
SPVVPEEVV

SEQ ID NO: 1010025 - protein, 9 aa, Homo Sapiens
DFGLATMKS

SEQ ID NO: 1010026 - protein, 9 aa, Homo Sapiens
AGPVGGFLS

SEQ ID NO: 1010027 - protein, 9 aa, Homo Sapiens
RFGSEGTEM

SEQ ID NO: 1010028 - protein, 9 aa, Homo Sapiens
HSLRLVRDP

SEQ ID NO: 1010029 - protein, 9 aa, Homo Sapiens
TFLLQHNQI

SEQ ID NO: 1010030 - protein, 9 aa, Homo Sapiens
NLEGESPSL

SEQ ID NO: 1010031 - protein, 9 aa, Homo Sapiens
TPTEKGMKT

SEQ ID NO: 1010032 - protein, 9 aa, Homo Sapiens
VSERICFLL

SEQ ID NO: 1010033 - protein, 9 aa, Homo Sapiens
GLKKERPPK

SEQ ID NO: 1010034 - protein, 9 aa, Homo Sapiens
KPCGTNTHA

SEQ ID NO: 1010035 - protein, 9 aa, Homo Sapiens
NQVAINPTN

SEQ ID NO: 1010036 - protein, 9 aa, Homo Sapiens
RNLLYRLAA

SEQ ID NO: 1010037 - protein, 9 aa, Homo Sapiens
DMSFFPETK

SEQ ID NO: 1010038 - protein, 9 aa, Homo Sapiens
CPAGLPGFK

SEQ ID NO: 1010039 - protein, 9 aa, Homo Sapiens
PTQIPVAAR

SEQ ID NO: 1010040 - protein, 9 aa, Homo Sapiens
LNSRFATFI

SEQ ID NO: 1010041 - protein, 9 aa, Homo Sapiens
FLAEKEGLR

SEQ ID NO: 1010042 - protein, 9 aa, Homo Sapiens
RFADKPSDG

SEQ ID NO: 1010043 - protein, 9 aa, Homo Sapiens
WMYQVLHER

SEQ ID NO: 1010044 - protein, 9 aa, Homo Sapiens
FQRQAFLEQ

SEQ ID NO: 1010045 - protein, 9 aa, Homo Sapiens
GVALSSQGE

SEQ ID NO: 1010046 - protein, 9 aa, Homo Sapiens
LKFHQEPPT

SEQ ID NO: 1010047 - protein, 9 aa, Homo Sapiens
SLPLSHPSP

SEQ ID NO: 1010048 - protein, 9 aa, Homo Sapiens
GQSLPVSLR

SEQ ID NO: 1010049 - protein, 9 aa, Homo Sapiens
TSLSLQTAL

SEQ ID NO: 1010050 - protein, 9 aa, Homo Sapiens
LWMIASQAN

SEQ ID NO: 1010051 - protein, 9 aa, Homo Sapiens
NTTGSNLVA

SEQ ID NO: 1010052 - protein, 9 aa, Homo Sapiens
CGFDGHTYP

SEQ ID NO: 1010053 - protein, 9 aa, Homo Sapiens
PFCPNGLLT

SEQ ID NO: 1010054 - protein, 9 aa, Homo Sapiens
LGIENSTVT

SEQ ID NO: 1010055 - protein, 9 aa, Homo Sapiens
HLAVDLRNP

SEQ ID NO: 1010056 - protein, 9 aa, Homo Sapiens
FLTMDTWPT

SEQ ID NO: 1010057 - protein, 9 aa, Homo Sapiens
NIFPRTWCF

SEQ ID NO: 1010058 - protein, 9 aa, Homo Sapiens
RSLVDSYMS

SEQ ID NO: 1010059 - protein, 9 aa, Homo Sapiens
GIKPLKCSD

SEQ ID NO: 1010060 - protein, 9 aa, Homo Sapiens
KLQKLARSP

SEQ ID NO: 1010061 - protein, 9 aa, Homo Sapiens
KFLFHPGYT

SEQ ID NO: 1010062 - protein, 9 aa, Homo Sapiens
DSEEEEEEM

SEQ ID NO: 1010063 - protein, 9 aa, Homo Sapiens
SLEKEGTME

SEQ ID NO: 1010064 - protein, 9 aa, Homo Sapiens
ASTAFLQEP

SEQ ID NO: 1010065 - protein, 9 aa, Homo Sapiens
VNNASASPL

SEQ ID NO: 1010066 - protein, 9 aa, Homo Sapiens
ALLHPRIVQ

SEQ ID NO: 1010067 - protein, 9 aa, Homo Sapiens
GFDRYFRSQ

SEQ ID NO: 1010068 - protein, 9 aa, Homo Sapiens
VLRKKLKSI

SEQ ID NO: 1010069 - protein, 9 aa, Homo Sapiens
GPEELAWGD

SEQ ID NO: 1010070 - protein, 9 aa, Homo Sapiens
LDHIARKVG

SEQ ID NO: 1010071 - protein, 9 aa, Homo Sapiens
SSGYTQHES

SEQ ID NO: 1010072 - protein, 9 aa, Homo Sapiens
ISAIPLTLG

SEQ ID NO: 1010073 - protein, 9 aa, Homo Sapiens
SAKPNNSDL

SEQ ID NO: 1010074 - protein, 9 aa, Homo Sapiens
FDRYFRSQT

SEQ ID NO: 1010075 - protein, 9 aa, Homo Sapiens
CNFSDKEVK

SEQ ID NO: 1010076 - protein, 9 aa, Homo Sapiens
AVPGRTCTD

SEQ ID NO: 1010077 - protein, 9 aa, Homo Sapiens
PVILRLFLF

SEQ ID NO: 1010078 - protein, 9 aa, Homo Sapiens
CRVESGKNC

SEQ ID NO: 1010079 - protein, 9 aa, Homo Sapiens
CSRPSEVPF

SEQ ID NO: 1010080 - protein, 9 aa, Homo Sapiens
IPPSGPVPM

SEQ ID NO: 1010081 - protein, 9 aa, Homo Sapiens
SWCGRPEQV

SEQ ID NO: 1010082 - protein, 9 aa, Homo Sapiens
PRTWCFPAD

SEQ ID NO: 1010083 - protein, 9 aa, Homo Sapiens
FSWSGKVKD

SEQ ID NO: 1010084 - protein, 9 aa, Homo Sapiens
LNDDKEEKG

SEQ ID NO: 1010085 - protein, 9 aa, Homo Sapiens
PFRHSNPEL

SEQ ID NO: 1010086 - protein, 9 aa, Homo Sapiens
LLVISGLVT

SEQ ID NO: 1010087 - protein, 9 aa, Homo Sapiens
LYISIFTLL

SEQ ID NO: 1010088 - protein, 9 aa, Homo Sapiens
YRSYIRLNS

SEQ ID NO: 1010089 - protein, 9 aa, Homo Sapiens
RAEERRLSW

SEQ ID NO: 1010090 - protein, 9 aa, Homo Sapiens
MKPIHMDFL

SEQ ID NO: 1010091 - protein, 9 aa, Homo Sapiens
DFLDSFLLL

SEQ ID NO: 1010092 - protein, 9 aa, Homo Sapiens
ISNNLSVVF

SEQ ID NO: 1010093 - protein, 9 aa, Homo Sapiens
FVCEEEPFI

SEQ ID NO: 1010094 - protein, 9 aa, Homo Sapiens
LVQFVQNTF

SEQ ID NO: 1010095 - protein, 9 aa, Homo Sapiens
FNPDVGENS

SEQ ID NO: 1010096 - protein, 9 aa, Homo Sapiens
RYALSFYTQ

SEQ ID NO: 1010097 - protein, 9 aa, Homo Sapiens
RRTARRTPL

SEQ ID NO: 1010098 - protein, 9 aa, Homo Sapiens
VRKAERYSF

SEQ ID NO: 1010099 - protein, 9 aa, Homo Sapiens
LSGDWNLLH

SEQ ID NO: 1010100 - protein, 9 aa, Homo Sapiens
DAAKNQVAI

SEQ ID NO: 1010101 - protein, 9 aa, Homo Sapiens
MVFIWKNIH

SEQ ID NO: 1010102 - protein, 9 aa, Homo Sapiens
DLREERSHH

SEQ ID NO: 1010103 - protein, 9 aa, Homo Sapiens
LIDLSNNKI

SEQ ID NO: 1010104 - protein, 9 aa, Homo Sapiens
PVSEDSAAN

SEQ ID NO: 1010105 - protein, 9 aa, Homo Sapiens
STEQACLIP

SEQ ID NO: 1010106 - protein, 9 aa, Homo Sapiens
KKGLLGIPG

SEQ ID NO: 1010107 - protein, 9 aa, Homo Sapiens
PSTKERWKA

SEQ ID NO: 1010108 - protein, 9 aa, Homo Sapiens
QASVSTKRL

SEQ ID NO: 1010109 - protein, 9 aa, Homo Sapiens
LTLKKEEKK

SEQ ID NO: 1010110 - protein, 9 aa, Homo Sapiens
SAPHFFSSL

SEQ ID NO: 1010111 - protein, 9 aa, Homo Sapiens
KNKNSSIAD

SEQ ID NO: 1010112 - protein, 9 aa, Homo Sapiens
ELEFTRNMV

SEQ ID NO: 1010113 - protein, 9 aa, Homo Sapiens
TVIKDYCTG

SEQ ID NO: 1010114 - protein, 9 aa, Homo Sapiens
TKVLKILSV

SEQ ID NO: 1010115 - protein, 9 aa, Homo Sapiens
GFIMTIHAA

SEQ ID NO: 1010116 - protein, 9 aa, Homo Sapiens
CVNLHLPRF

SEQ ID NO: 1010117 - protein, 9 aa, Homo Sapiens
RASYYFLLD

SEQ ID NO: 1010118 - protein, 9 aa, Homo Sapiens
EKTRRFMAV

SEQ ID NO: 1010119 - protein, 9 aa, Homo Sapiens
SVESYESQV

SEQ ID NO: 1010120 - protein, 9 aa, Homo Sapiens
PPSENSQDQ

SEQ ID NO: 1010121 - protein, 9 aa, Homo Sapiens
NEDDDFSKW

SEQ ID NO: 1010122 - protein, 9 aa, Homo Sapiens
ENTIKQFEN

SEQ ID NO: 1010123 - protein, 9 aa, Homo Sapiens
GFELFAVNM

SEQ ID NO: 1010124 - protein, 9 aa, Homo Sapiens
VICFSWTLH

SEQ ID NO: 1010125 - protein, 9 aa, Homo Sapiens
SQTLANNRR

SEQ ID NO: 1010126 - protein, 9 aa, Homo Sapiens
GRLHSHCPR

SEQ ID NO: 1010127 - protein, 9 aa, Homo Sapiens
PLKCSDCGK

SEQ ID NO: 1010128 - protein, 9 aa, Homo Sapiens
APLMANFDL

SEQ ID NO: 1010129 - protein, 9 aa, Homo Sapiens
RASASDFSA

SEQ ID NO: 1010130 - protein, 9 aa, Homo Sapiens
SQQPKSLQG

SEQ ID NO: 1010131 - protein, 9 aa, Homo Sapiens
HEIKFSPDG

SEQ ID NO: 1010132 - protein, 9 aa, Homo Sapiens
FTYNNLCVS

SEQ ID NO: 1010133 - protein, 9 aa, Homo Sapiens
ICMSEAQSK

SEQ ID NO: 1010134 - protein, 9 aa, Homo Sapiens
GIQSHPQKL

SEQ ID NO: 1010135 - protein, 9 aa, Homo Sapiens
KKLKSINKG

SEQ ID NO: 1010136 - protein, 9 aa, Homo Sapiens
GTKQKIFQV

SEQ ID NO: 1010137 - protein, 9 aa, Homo Sapiens
YLPKDKEED

SEQ ID NO: 1010138 - protein, 9 aa, Homo Sapiens
EVIHEIKFS

SEQ ID NO: 1010139 - protein, 9 aa, Homo Sapiens
PLVFTLFTL

SEQ ID NO: 1010140 - protein, 9 aa, Homo Sapiens
LLYPVLVSE

SEQ ID NO: 1010141 - protein, 9 aa, Homo Sapiens
RDPECSWGQ

SEQ ID NO: 1010142 - protein, 9 aa, Homo Sapiens
VISDSCLHS

SEQ ID NO: 1010143 - protein, 9 aa, Homo Sapiens
KATRTAYNL

SEQ ID NO: 1010144 - protein, 9 aa, Homo Sapiens
KEIKTQLIL

SEQ ID NO: 1010145 - protein, 9 aa, Homo Sapiens
HTGARLYEC

SEQ ID NO: 1010146 - protein, 9 aa, Homo Sapiens
PRGTQALRS

SEQ ID NO: 1010147 - protein, 9 aa, Homo Sapiens
TEEDPLMNM

SEQ ID NO: 1010148 - protein, 9 aa, Homo Sapiens
FTKKKETMT

SEQ ID NO: 1010149 - protein, 9 aa, Homo Sapiens
RQWEKKSGE

SEQ ID NO: 1010150 - protein, 9 aa, Homo Sapiens
QKLFYTVGE

SEQ ID NO: 1010151 - protein, 9 aa, Homo Sapiens
ALIKEIILR

SEQ ID NO: 1010152 - protein, 9 aa, Homo Sapiens
RYSFPIVNL

SEQ ID NO: 1010153 - protein, 9 aa, Homo Sapiens
GMGGIIIVL

SEQ ID NO: 1010154 - protein, 9 aa, Homo Sapiens
IKKTINFAR

SEQ ID NO: 1010155 - protein, 9 aa, Homo Sapiens
VCGDIYGQF

SEQ ID NO: 1010156 - protein, 9 aa, Homo Sapiens
FQDHSYQEE

SEQ ID NO: 1010157 - protein, 9 aa, Homo Sapiens
KENEVEVGR

SEQ ID NO: 1010158 - protein, 9 aa, Homo Sapiens
AKEILHKDL

SEQ ID NO: 1010159 - protein, 9 aa, Homo Sapiens
LHFSVYNFD

SEQ ID NO: 1010160 - protein, 9 aa, Homo Sapiens
HVRWEAPFC

SEQ ID NO: 1010161 - protein, 9 aa, Homo Sapiens
QQALQNKQD

SEQ ID NO: 1010162 - protein, 9 aa, Homo Sapiens
GNSRRIDYM

SEQ ID NO: 1010163 - protein, 9 aa, Homo Sapiens
ILQMWHVVD

SEQ ID NO: 1010164 - protein, 9 aa, Homo Sapiens
KTVNQHACL

SEQ ID NO: 1010165 - protein, 9 aa, Homo Sapiens
NHSGERPYE

SEQ ID NO: 1010166 - protein, 9 aa, Homo Sapiens
SLSLQTALR

SEQ ID NO: 1010167 - protein, 9 aa, Homo Sapiens
SAPGILGPP

SEQ ID NO: 1010168 - protein, 9 aa, Homo Sapiens
ISPRKSRTP

SEQ ID NO: 1010169 - protein, 9 aa, Homo Sapiens
DNSKEIVVA

SEQ ID NO: 1010170 - protein, 9 aa, Homo Sapiens
KKVEKKAPD

SEQ ID NO: 1010171 - protein, 9 aa, Homo Sapiens
IQNLSLIFL

SEQ ID NO: 1010172 - protein, 9 aa, Homo Sapiens
TDCLLIAVL

SEQ ID NO: 1010173 - protein, 9 aa, Homo Sapiens
QFDGPLSPP

SEQ ID NO: 1010174 - protein, 9 aa, Homo Sapiens
VGTSLSLQT

SEQ ID NO: 1010175 - protein, 9 aa, Homo Sapiens
VDEDKCASS

SEQ ID NO: 1010176 - protein, 9 aa, Homo Sapiens
FPADYGDFQ

SEQ ID NO: 1010177 - protein, 9 aa, Homo Sapiens
ETSTFYSLK

SEQ ID NO: 1010178 - protein, 9 aa, Homo Sapiens
GFGFTIIGE

SEQ ID NO: 1010179 - protein, 9 aa, Homo Sapiens
APGDSDLVG

SEQ ID NO: 1010180 - protein, 9 aa, Homo Sapiens
SAQLKHKRD

SEQ ID NO: 1010181 - protein, 9 aa, Homo Sapiens
FFIDKVVSV

SEQ ID NO: 1010182 - protein, 9 aa, Homo Sapiens
TFIPLGQGL

SEQ ID NO: 1010183 - protein, 9 aa, Homo Sapiens
EPGVTSILK

SEQ ID NO: 1010184 - protein, 9 aa, Homo Sapiens
GAASNLSYC

SEQ ID NO: 1010185 - protein, 9 aa, Homo Sapiens
HMAIPKLSS

SEQ ID NO: 1010186 - protein, 9 aa, Homo Sapiens
VVAMSVAKR

SEQ ID NO: 1010187 - protein, 9 aa, Homo Sapiens
IHTGARLYE

SEQ ID NO: 1010188 - protein, 9 aa, Homo Sapiens
QHLSLLQDY

SEQ ID NO: 1010189 - protein, 9 aa, Homo Sapiens
RYSRYLNKK

SEQ ID NO: 1010190 - protein, 9 aa, Homo Sapiens
VKAVKILAC

SEQ ID NO: 1010191 - protein, 9 aa, Homo Sapiens
RGFQEKPGL

SEQ ID NO: 1010192 - protein, 9 aa, Homo Sapiens
ERYRERKRD

SEQ ID NO: 1010193 - protein, 9 aa, Homo Sapiens
AQSPKYKIT

SEQ ID NO: 1010194 - protein, 9 aa, Homo Sapiens
VKWPQSNSK

SEQ ID NO: 1010195 - protein, 9 aa, Homo Sapiens
LNNFSQRKQ

SEQ ID NO: 1010196 - protein, 9 aa, Homo Sapiens
TQYITKEEK

SEQ ID NO: 1010197 - protein, 9 aa, Homo Sapiens
VKHENQQQG

SEQ ID NO: 1010198 - protein, 9 aa, Homo Sapiens
FMVLLIYIE

SEQ ID NO: 1010199 - protein, 9 aa, Homo Sapiens
KMFVWFVSD

SEQ ID NO: 1010200 - protein, 9 aa, Homo Sapiens
ADHAFSPPR

SEQ ID NO: 1010201 - protein, 9 aa, Homo Sapiens
IPQTDTEED

SEQ ID NO: 1010202 - protein, 9 aa, Homo Sapiens
NGSKQGSLT

SEQ ID NO: 1010203 - protein, 9 aa, Homo Sapiens
GHVSHALHE

SEQ ID NO: 1010204 - protein, 9 aa, Homo Sapiens
IKTDSKDGA

SEQ ID NO: 1010205 - protein, 9 aa, Homo Sapiens
GQVTELRSQ

SEQ ID NO: 1010206 - protein, 9 aa, Homo Sapiens
VTVCGDIYG

SEQ ID NO: 1010207 - protein, 9 aa, Homo Sapiens
TSILKTTQG

SEQ ID NO: 1010208 - protein, 9 aa, Homo Sapiens
CPLVPSGVS

SEQ ID NO: 1010209 - protein, 9 aa, Homo Sapiens
GDSQFFSRT

SEQ ID NO: 1010210 - protein, 9 aa, Homo Sapiens
FHLLVFTKS

SEQ ID NO: 1010211 - protein, 9 aa, Homo Sapiens
QLILGRHPI

SEQ ID NO: 1010212 - protein, 9 aa, Homo Sapiens
HEVLEGLSE

SEQ ID NO: 1010213 - protein, 9 aa, Homo Sapiens
NLGETVKLK

SEQ ID NO: 1010214 - protein, 9 aa, Homo Sapiens
RKWFGKSKT

SEQ ID NO: 1010215 - protein, 9 aa, Homo Sapiens
SSSHPPPAP

SEQ ID NO: 1010216 - protein, 9 aa, Homo Sapiens
LKAKRERGI

SEQ ID NO: 1010217 - protein, 9 aa, Homo Sapiens
PSPLAPTPT

SEQ ID NO: 1010218 - protein, 9 aa, Homo Sapiens
IRNSSVRIK

SEQ ID NO: 1010219 - protein, 9 aa, Homo Sapiens
TSEHNCKED

SEQ ID NO: 1010220 - protein, 9 aa, Homo Sapiens
FTLAGLWIV

SEQ ID NO: 1010221 - protein, 9 aa, Homo Sapiens
IPLSVDILD

SEQ ID NO: 1010222 - protein, 9 aa, Homo Sapiens
HSLLKFAFN

SEQ ID NO: 1010223 - protein, 9 aa, Homo Sapiens
DHDPIERDF

SEQ ID NO: 1010224 - protein, 9 aa, Homo Sapiens
GDWNLLHID

SEQ ID NO: 1010225 - protein, 9 aa, Homo Sapiens
GFGGPGFSV

SEQ ID NO: 1010226 - protein, 9 aa, Homo Sapiens
LENDFAVHK

SEQ ID NO: 1010227 - protein, 9 aa, Homo Sapiens
FLQQEVEAL

SEQ ID NO: 1010228 - protein, 9 aa, Homo Sapiens
DVFNDPTTS

SEQ ID NO: 1010229 - protein, 9 aa, Homo Sapiens
PATSGIAQA

SEQ ID NO: 1010230 - protein, 9 aa, Homo Sapiens
TSQLSLVGG

SEQ ID NO: 1010231 - protein, 9 aa, Homo Sapiens
VIKAGKDDL

SEQ ID NO: 1010232 - protein, 9 aa, Homo Sapiens
NVKQSPQSL

SEQ ID NO: 1010233 - protein, 9 aa, Homo Sapiens
TDLQDFEMK

SEQ ID NO: 1010234 - protein, 9 aa, Homo Sapiens
LTTFLLQHN

SEQ ID NO: 1010235 - protein, 9 aa, Homo Sapiens
PSGPVPMGM

SEQ ID NO: 1010236 - protein, 9 aa, Homo Sapiens
SSGVCGHKV

SEQ ID NO: 1010237 - protein, 9 aa, Homo Sapiens
EEPRGTQAL

SEQ ID NO: 1010238 - protein, 9 aa, Homo Sapiens
SDHGMTNIF

SEQ ID NO: 1010239 - protein, 9 aa, Homo Sapiens
DLDQPKVEG

SEQ ID NO: 1010240 - protein, 9 aa, Homo Sapiens
SSEEVFQEL

SEQ ID NO: 1010241 - protein, 9 aa, Homo Sapiens
SHYNQAQDS

SEQ ID NO: 1010242 - protein, 9 aa, Homo Sapiens
NVNMAIRVM

SEQ ID NO: 1010243 - protein, 9 aa, Homo Sapiens
SLGDGPPGS

SEQ ID NO: 1010244 - protein, 9 aa, Homo Sapiens
TKDRTWNET

SEQ ID NO: 1010245 - protein, 9 aa, Homo Sapiens
KLMLHGIVF

SEQ ID NO: 1010246 - protein, 9 aa, Homo Sapiens
YMENDFSEG

SEQ ID NO: 1010247 - protein, 9 aa, Homo Sapiens
TVNGSKQGS

SEQ ID NO: 1010248 - protein, 9 aa, Homo Sapiens
ILRLFLFSY

SEQ ID NO: 1010249 - protein, 9 aa, Homo Sapiens
LLGQFGFWR

SEQ ID NO: 1010250 - protein, 9 aa, Homo Sapiens
ADFDFFPMS

SEQ ID NO: 1010251 - protein, 9 aa, Homo Sapiens
TKPKDVKLI

SEQ ID NO: 1010252 - protein, 9 aa, Homo Sapiens
LPVGDLVAL

SEQ ID NO: 1010253 - protein, 9 aa, Homo Sapiens
VFHKYSNLN

SEQ ID NO: 1010254 - protein, 9 aa, Homo Sapiens
GEKIKNTIS

SEQ ID NO: 1010255 - protein, 9 aa, Homo Sapiens
VSEDKRIFL

SEQ ID NO: 1010256 - protein, 9 aa, Homo Sapiens
PGRQQYDLM

SEQ ID NO: 1010257 - protein, 9 aa, Homo Sapiens
PWGRLHSHC

SEQ ID NO: 1010258 - protein, 9 aa, Homo Sapiens
LSLEPDNEQ

SEQ ID NO: 1010259 - protein, 9 aa, Homo Sapiens
VEYTFTRIY

SEQ ID NO: 1010260 - protein, 9 aa, Homo Sapiens
QKEAKSSAD

SEQ ID NO: 1010261 - protein, 9 aa, Homo Sapiens
QAAEEPEDS

SEQ ID NO: 1010262 - protein, 9 aa, Homo Sapiens
KKYESYLGV

SEQ ID NO: 1010263 - protein, 9 aa, Homo Sapiens
KREPGEGAY

SEQ ID NO: 1010264 - protein, 9 aa, Homo Sapiens
RRKFWINEK

SEQ ID NO: 1010265 - protein, 9 aa, Homo Sapiens
LSQVPPLVM

SEQ ID NO: 1010266 - protein, 9 aa, Homo Sapiens
HYQSIININ

SEQ ID NO: 1010267 - protein, 9 aa, Homo Sapiens
NDDKEEKGT

SEQ ID NO: 1010268 - protein, 9 aa, Homo Sapiens
CGDIYGQFY

SEQ ID NO: 1010269 - protein, 9 aa, Homo Sapiens
QPTCGCSLG

SEQ ID NO: 1010270 - protein, 9 aa, Homo Sapiens
RIKMMAVGI

SEQ ID NO: 1010271 - protein, 9 aa, Homo Sapiens
AFDCFVAIC

SEQ ID NO: 1010272 - protein, 9 aa, Homo Sapiens
LRLLDYEAL

SEQ ID NO: 1010273 - protein, 9 aa, Homo Sapiens
QEGGGHNLL

SEQ ID NO: 1010274 - protein, 9 aa, Homo Sapiens
SCYWENQPT

SEQ ID NO: 1010275 - protein, 9 aa, Homo Sapiens
KLFYTVGEK

SEQ ID NO: 1010276 - protein, 9 aa, Homo Sapiens
FPMSDKNPE

SEQ ID NO: 1010277 - protein, 9 aa, Homo Sapiens
WRQTWGGQG

SEQ ID NO: 1010278 - protein, 9 aa, Homo Sapiens
RTCNPGASL

SEQ ID NO: 1010279 - protein, 9 aa, Homo Sapiens
QFSQFFHGS

SEQ ID NO: 1010280 - protein, 9 aa, Homo Sapiens
WITSNTEMC

SEQ ID NO: 1010281 - protein, 9 aa, Homo Sapiens
ICVSWESSL

SEQ ID NO: 1010282 - protein, 9 aa, Homo Sapiens
KNNYTCRLW

SEQ ID NO: 1010283 - protein, 9 aa, Homo Sapiens
HSMCFISSW

SEQ ID NO: 1010284 - protein, 9 aa, Homo Sapiens
LNDHGSLKA

SEQ ID NO: 1010285 - protein, 9 aa, Homo Sapiens
DQMVFIWKN

SEQ ID NO: 1010286 - protein, 9 aa, Homo Sapiens
IIEVVNITK

SEQ ID NO: 1010287 - protein, 9 aa, Homo Sapiens
SLVTDKKAI

SEQ ID NO: 1010288 - protein, 9 aa, Homo Sapiens
PGRASASDF

SEQ ID NO: 1010289 - protein, 9 aa, Homo Sapiens
NQETSTFYS

SEQ ID NO: 1010290 - protein, 9 aa, Homo Sapiens
NGFIMTIHA

SEQ ID NO: 1010291 - protein, 9 aa, Homo Sapiens
RNPVAIVHA

SEQ ID NO: 1010292 - protein, 9 aa, Homo Sapiens
GDHSFREQG

SEQ ID NO: 1010293 - protein, 9 aa, Homo Sapiens
VAEYKYQLT

SEQ ID NO: 1010294 - protein, 9 aa, Homo Sapiens
PFISVHPGL

SEQ ID NO: 1010295 - protein, 9 aa, Homo Sapiens
AETQAWQSF

SEQ ID NO: 1010296 - protein, 9 aa, Homo Sapiens
LHLAVDLRN

SEQ ID NO: 1010297 - protein, 9 aa, Homo Sapiens
QQRHGLANF

SEQ ID NO: 1010298 - protein, 9 aa, Homo Sapiens
TQNQAFSLS

SEQ ID NO: 1010299 - protein, 9 aa, Homo Sapiens
YDKAVKMAK

SEQ ID NO: 1010300 - protein, 9 aa, Homo Sapiens
PAFYPSTMA

SEQ ID NO: 1010301 - protein, 9 aa, Homo Sapiens
GAVPSSTRV

SEQ ID NO: 1010302 - protein, 9 aa, Homo Sapiens
LSCTHPPLQ

SEQ ID NO: 1010303 - protein, 9 aa, Homo Sapiens
FSALGATFS

SEQ ID NO: 1010304 - protein, 9 aa, Homo Sapiens
TWNLGETVK

SEQ ID NO: 1010305 - protein, 9 aa, Homo Sapiens
SPLAPTPTP

SEQ ID NO: 1010306 - protein, 9 aa, Homo Sapiens
GKLFSWAQI

SEQ ID NO: 1010307 - protein, 9 aa, Homo Sapiens
FYSLKDYVS

SEQ ID NO: 1010308 - protein, 9 aa, Homo Sapiens
KLVDFKKIK

SEQ ID NO: 1010309 - protein, 9 aa, Homo Sapiens
DHDLIKTDS

SEQ ID NO: 1010310 - protein, 9 aa, Homo Sapiens
EHFALQPST

SEQ ID NO: 1010311 - protein, 9 aa, Homo Sapiens
SPLLQEVSS

SEQ ID NO: 1010312 - protein, 9 aa, Homo Sapiens
PWCFAVPVL

SEQ ID NO: 1010313 - protein, 9 aa, Homo Sapiens
LSNGYISIP

SEQ ID NO: 1010314 - protein, 9 aa, Homo Sapiens
GGYLDRSVF

SEQ ID NO: 1010315 - protein, 9 aa, Homo Sapiens
QPLEELDYL

SEQ ID NO: 1010316 - protein, 9 aa, Homo Sapiens
DQHCRKIFG

SEQ ID NO: 1010317 - protein, 9 aa, Homo Sapiens
TFTRIYTFE

SEQ ID NO: 1010318 - protein, 9 aa, Homo Sapiens
KVGNKFVTK

SEQ ID NO: 1010319 - protein, 9 aa, Homo Sapiens
YIFFTGCFA

SEQ ID NO: 1010320 - protein, 9 aa, Homo Sapiens
PGSRPRRGM

SEQ ID NO: 1010321 - protein, 9 aa, Homo Sapiens
SSVKVWSHV

SEQ ID NO: 1010322 - protein, 9 aa, Homo Sapiens
MCHKFQAFM

SEQ ID NO: 1010323 - protein, 9 aa, Homo Sapiens
ISKLSKSNQ

SEQ ID NO: 1010324 - protein, 9 aa, Homo Sapiens
WYSLVICED

SEQ ID NO: 1010325 - protein, 9 aa, Homo Sapiens
ITVRTKGIP

SEQ ID NO: 1010326 - protein, 9 aa, Homo Sapiens
FHCDNGFVK

SEQ ID NO: 1010327 - protein, 9 aa, Homo Sapiens
PQCLSRPFS

SEQ ID NO: 1010328 - protein, 9 aa, Homo Sapiens
GCAGPHQAG

SEQ ID NO: 1010329 - protein, 9 aa, Homo Sapiens
PQTRDTAWA

SEQ ID NO: 1010330 - protein, 9 aa, Homo Sapiens
ITIHWISNN

SEQ ID NO: 1010331 - protein, 9 aa, Homo Sapiens
PIENSSNNS

SEQ ID NO: 1010332 - protein, 9 aa, Homo Sapiens
FAVSGQWEV

SEQ ID NO: 1010333 - protein, 9 aa, Homo Sapiens
RWLQRVSFS

SEQ ID NO: 1010334 - protein, 9 aa, Homo Sapiens
QNFIGKQLK

SEQ ID NO: 1010335 - protein, 9 aa, Homo Sapiens
RGKMNKTVN

SEQ ID NO: 1010336 - protein, 9 aa, Homo Sapiens
KETFKNFQM

SEQ ID NO: 1010337 - protein, 9 aa, Homo Sapiens
LTRSTRPTP

SEQ ID NO: 1010338 - protein, 9 aa, Homo Sapiens
ILNNFSQRK

SEQ ID NO: 1010339 - protein, 9 aa, Homo Sapiens
LVENFTIII

SEQ ID NO: 1010340 - protein, 9 aa, Homo Sapiens
NLDASKENE

SEQ ID NO: 1010341 - protein, 9 aa, Homo Sapiens
ELAKLVKRK

SEQ ID NO: 1010342 - protein, 9 aa, Homo Sapiens
KKEQEGGGA

SEQ ID NO: 1010343 - protein, 9 aa, Homo Sapiens
ERERNSRPF

SEQ ID NO: 1010344 - protein, 9 aa, Homo Sapiens
ATSGIAQAL

SEQ ID NO: 1010345 - protein, 9 aa, Homo Sapiens
KWFGKSKTI

SEQ ID NO: 1010346 - protein, 9 aa, Homo Sapiens
YHKKTIKNK

SEQ ID NO: 1010347 - protein, 9 aa, Homo Sapiens
HFLWSLRSR

SEQ ID NO: 1010348 - protein, 9 aa, Homo Sapiens
VFWKKENRR

SEQ ID NO: 1010349 - protein, 9 aa, Homo Sapiens
LYICMSEAQ

SEQ ID NO: 1010350 - protein, 9 aa, Homo Sapiens
PHHHHHHHR

SEQ ID NO: 1010351 - protein, 9 aa, Homo Sapiens
KFWINEKTG

SEQ ID NO: 1010352 - protein, 9 aa, Homo Sapiens
YVFCVEREN

SEQ ID NO: 1010353 - protein, 9 aa, Homo Sapiens
LRPPPVTLA

SEQ ID NO: 1010354 - protein, 9 aa, Homo Sapiens
AGTRGCAGP

SEQ ID NO: 1010355 - protein, 9 aa, Homo Sapiens
VLYMENDFS

SEQ ID NO: 1010356 - protein, 9 aa, Homo Sapiens
REKLTCFIC

SEQ ID NO: 1010357 - protein, 9 aa, Homo Sapiens
NVYKKRVSA

SEQ ID NO: 1010358 - protein, 9 aa, Homo Sapiens
GKKGDKGKK

SEQ ID NO: 1010359 - protein, 9 aa, Homo Sapiens
AAFVSADLN

SEQ ID NO: 1010360 - protein, 9 aa, Homo Sapiens
SSVMDFKNN

SEQ ID NO: 1010361 - protein, 9 aa, Homo Sapiens
DLPWDDNEV

SEQ ID NO: 1010362 - protein, 9 aa, Homo Sapiens
CNVHKESYN

SEQ ID NO: 1010363 - protein, 9 aa, Homo Sapiens
AQKVLAREA

SEQ ID NO: 1010364 - protein, 9 aa, Homo Sapiens
SFDSKDTRH

SEQ ID NO: 1010365 - protein, 9 aa, Homo Sapiens
DIFFSLVTI

SEQ ID NO: 1010366 - protein, 9 aa, Homo Sapiens
CFISELARY

SEQ ID NO: 1010367 - protein, 9 aa, Homo Sapiens
MVVGGVPVL

SEQ ID NO: 1010368 - protein, 9 aa, Homo Sapiens
LLNEEVIVQ

SEQ ID NO: 1010369 - protein, 9 aa, Homo Sapiens
GAAAGAIQR

SEQ ID NO: 1010370 - protein, 9 aa, Homo Sapiens
RGMESPKAM

SEQ ID NO: 1010371 - protein, 9 aa, Homo Sapiens
GELGIGLPG

SEQ ID NO: 1010372 - protein, 9 aa, Homo Sapiens
VAITTLFLP

SEQ ID NO: 1010373 - protein, 9 aa, Homo Sapiens
FFRAQRSAR

SEQ ID NO: 1010374 - protein, 9 aa, Homo Sapiens
RVSFSAARS

SEQ ID NO: 1010375 - protein, 9 aa, Homo Sapiens
LMLHGIVFA

SEQ ID NO: 1010376 - protein, 9 aa, Homo Sapiens
SQRACSRVN

SEQ ID NO: 1010377 - protein, 9 aa, Homo Sapiens
HCGHLKVLE

SEQ ID NO: 1010378 - protein, 9 aa, Homo Sapiens
TTSFFAQEF

SEQ ID NO: 1010379 - protein, 9 aa, Homo Sapiens
LQFDGALNV

SEQ ID NO: 1010380 - protein, 9 aa, Homo Sapiens
LSPLLQEVS

SEQ ID NO: 1010381 - protein, 9 aa, Homo Sapiens
MSLDSSSPD

SEQ ID NO: 1010382 - protein, 9 aa, Homo Sapiens
CRKIFGKDA

SEQ ID NO: 1010383 - protein, 9 aa, Homo Sapiens
AAAAARPPA

SEQ ID NO: 1010384 - protein, 9 aa, Homo Sapiens
TCYPPEDRR

SEQ ID NO: 1010385 - protein, 9 aa, Homo Sapiens
YFNFAQGGG

SEQ ID NO: 1010386 - protein, 9 aa, Homo Sapiens
KCASSPCQH

SEQ ID NO: 1010387 - protein, 9 aa, Homo Sapiens
MDPAHSILR

SEQ ID NO: 1010388 - protein, 9 aa, Homo Sapiens
WKDTQVFQA

SEQ ID NO: 1010389 - protein, 9 aa, Homo Sapiens
YIDTRIKNL

SEQ ID NO: 1010390 - protein, 9 aa, Homo Sapiens
QQPKSLQGL

SEQ ID NO: 1010391 - protein, 9 aa, Homo Sapiens
VNEGMLTEE

SEQ ID NO: 1010392 - protein, 9 aa, Homo Sapiens
ISVHPGLTV

SEQ ID NO: 1010393 - protein, 9 aa, Homo Sapiens
FLCTKLVFW

SEQ ID NO: 1010394 - protein, 9 aa, Homo Sapiens
NSKEIVVAM

SEQ ID NO: 1010395 - protein, 9 aa, Homo Sapiens
QDVWADELC

SEQ ID NO: 1010396 - protein, 9 aa, Homo Sapiens
PPRSSSPRT

SEQ ID NO: 1010397 - protein, 9 aa, Homo Sapiens
GWRNLEGES

SEQ ID NO: 1010398 - protein, 9 aa, Homo Sapiens
VIDEKEMME

SEQ ID NO: 1010399 - protein, 9 aa, Homo Sapiens
KEGKTDELL

SEQ ID NO: 1010400 - protein, 9 aa, Homo Sapiens
LMTKVIVKL

SEQ ID NO: 1010401 - protein, 9 aa, Homo Sapiens
RSVFWKKEN

SEQ ID NO: 1010402 - protein, 9 aa, Homo Sapiens
VTPTEKGMK

SEQ ID NO: 1010403 - protein, 9 aa, Homo Sapiens
TGGLRDPGQ

SEQ ID NO: 1010404 - protein, 9 aa, Homo Sapiens
LFFLLAMGA

SEQ ID NO: 1010405 - protein, 9 aa, Homo Sapiens
VIGLTSSSV

SEQ ID NO: 1010406 - protein, 9 aa, Homo Sapiens
DIFTPLQTE

SEQ ID NO: 1010407 - protein, 9 aa, Homo Sapiens
NIQSSSPRL

SEQ ID NO: 1010408 - protein, 9 aa, Homo Sapiens
SKENEAGQI

SEQ ID NO: 1010409 - protein, 9 aa, Homo Sapiens
ITVTAKDKE

SEQ ID NO: 1010410 - protein, 9 aa, Homo Sapiens
RDNWKRVSS

SEQ ID NO: 1010411 - protein, 9 aa, Homo Sapiens
LNMPVLETY

SEQ ID NO: 1010412 - protein, 9 aa, Homo Sapiens
CESVAPIIM

SEQ ID NO: 1010413 - protein, 9 aa, Homo Sapiens
IGGVRMLDE

SEQ ID NO: 1010414 - protein, 9 aa, Homo Sapiens
HPGYTVPST

SEQ ID NO: 1010415 - protein, 9 aa, Homo Sapiens
QKKEKDIIK

SEQ ID NO: 1010416 - protein, 9 aa, Homo Sapiens
AFYPSTMAF

SEQ ID NO: 1010417 - protein, 9 aa, Homo Sapiens
FTRIYTFES

SEQ ID NO: 1010418 - protein, 9 aa, Homo Sapiens
QRGDHSFRE

SEQ ID NO: 1010419 - protein, 9 aa, Homo Sapiens
RTCTDTCLD

SEQ ID NO: 1010420 - protein, 9 aa, Homo Sapiens
FYLAMNKEE

SEQ ID NO: 1010421 - protein, 9 aa, Homo Sapiens
EASLPSVQT

SEQ ID NO: 1010422 - protein, 9 aa, Homo Sapiens
SWRQTWGGQ

SEQ ID NO: 1010423 - protein, 9 aa, Homo Sapiens
LSPRGVGYA

SEQ ID NO: 1010424 - protein, 9 aa, Homo Sapiens
KEAKKFWHH

SEQ ID NO: 1010425 - protein, 9 aa, Homo Sapiens
LIQHKRIYT

SEQ ID NO: 1010426 - protein, 9 aa, Homo Sapiens
ASLQFDGAL

SEQ ID NO: 1010427 - protein, 9 aa, Homo Sapiens
ISPLLLLSR

SEQ ID NO: 1010428 - protein, 9 aa, Homo Sapiens
EEVVAMDRH

SEQ ID NO: 1010429 - protein, 9 aa, Homo Sapiens
EVTDPVQII

SEQ ID NO: 1010430 - protein, 9 aa, Homo Sapiens
FGGKKGSSP

SEQ ID NO: 1010431 - protein, 9 aa, Homo Sapiens
KHNRTELTL

SEQ ID NO: 1010432 - protein, 9 aa, Homo Sapiens
RGEDPLVDN

SEQ ID NO: 1010433 - protein, 9 aa, Homo Sapiens
DSSAHRSRA

SEQ ID NO: 1010434 - protein, 9 aa, Homo Sapiens
DDNEVEWEE

SEQ ID NO: 1010435 - protein, 9 aa, Homo Sapiens
KTRTGGLRD

SEQ ID NO: 1010436 - protein, 9 aa, Homo Sapiens
KKCKRGFIT

SEQ ID NO: 1010437 - protein, 9 aa, Homo Sapiens
HGDNLRDIK

SEQ ID NO: 1010438 - protein, 9 aa, Homo Sapiens
TAFNRSSTL

SEQ ID NO: 1010439 - protein, 9 aa, Homo Sapiens
SFLPVGDLV

SEQ ID NO: 1010440 - protein, 9 aa, Homo Sapiens
ENGNFLYVF

SEQ ID NO: 1010441 - protein, 9 aa, Homo Sapiens
KMRNNRELR

SEQ ID NO: 1010442 - protein, 9 aa, Homo Sapiens
SVLVNNGQR

SEQ ID NO: 1010443 - protein, 9 aa, Homo Sapiens
KEDVFPLQP

SEQ ID NO: 1010444 - protein, 9 aa, Homo Sapiens
NNKPEESLK

SEQ ID NO: 1010445 - protein, 9 aa, Homo Sapiens
GDLREAATV

SEQ ID NO: 1010446 - protein, 9 aa, Homo Sapiens
GPSQQGVGG

SEQ ID NO: 1010447 - protein, 9 aa, Homo Sapiens
RTAYPNAFC

SEQ ID NO: 1010448 - protein, 9 aa, Homo Sapiens
QYITKEEKK

SEQ ID NO: 1010449 - protein, 9 aa, Homo Sapiens
EDEPAIAID

SEQ ID NO: 1010450 - protein, 9 aa, Homo Sapiens
CSRLENEQF

SEQ ID NO: 1010451 - protein, 9 aa, Homo Sapiens
TEDQLSKRP

SEQ ID NO: 1010452 - protein, 9 aa, Homo Sapiens
LNKTCLEEF

SEQ ID NO: 1010453 - protein, 9 aa, Homo Sapiens
LLSYVSVSA

SEQ ID NO: 1010454 - protein, 9 aa, Homo Sapiens
FRGGQDIVV

SEQ ID NO: 1010455 - protein, 9 aa, Homo Sapiens
RPTGTLKLP

SEQ ID NO: 1010456 - protein, 9 aa, Homo Sapiens
SGVVNENTF

SEQ ID NO: 1010457 - protein, 9 aa, Homo Sapiens
LIVKVNKKN

SEQ ID NO: 1010458 - protein, 9 aa, Homo Sapiens
NRGEKIQLK

SEQ ID NO: 1010459 - protein, 9 aa, Homo Sapiens
IYSDSRLHT

SEQ ID NO: 1010460 - protein, 9 aa, Homo Sapiens
TLAGLWIVY

SEQ ID NO: 1010461 - protein, 9 aa, Homo Sapiens
PPATTFLTV

SEQ ID NO: 1010462 - protein, 9 aa, Homo Sapiens
VCGHKVERQ

SEQ ID NO: 1010463 - protein, 9 aa, Homo Sapiens
LPRVLFPES

SEQ ID NO: 1010464 - protein, 9 aa, Homo Sapiens
APARTNRGG

SEQ ID NO: 1010465 - protein, 9 aa, Homo Sapiens
EVPDLGRFQ

SEQ ID NO: 1010466 - protein, 9 aa, Homo Sapiens
FDCSDSEKS

SEQ ID NO: 1010467 - protein, 9 aa, Homo Sapiens
LSIAFREER

SEQ ID NO: 1010468 - protein, 9 aa, Homo Sapiens
ASPLGSSVK

SEQ ID NO: 1010469 - protein, 9 aa, Homo Sapiens
ALEHCGSVD

SEQ ID NO: 1010470 - protein, 9 aa, Homo Sapiens
IPLTLGMKI

SEQ ID NO: 1010471 - protein, 9 aa, Homo Sapiens
ASPQFDGPL

SEQ ID NO: 1010472 - protein, 9 aa, Homo Sapiens
QASNIMWTI

SEQ ID NO: 1010473 - protein, 9 aa, Homo Sapiens
ERERYRERK

SEQ ID NO: 1010474 - protein, 9 aa, Homo Sapiens
NLSLIFLAN

SEQ ID NO: 1010475 - protein, 9 aa, Homo Sapiens
KGGEDEPAI

SEQ ID NO: 1010476 - protein, 9 aa, Homo Sapiens
IPLPIGNKT

SEQ ID NO: 1010477 - protein, 9 aa, Homo Sapiens
MLGDSQFFS

SEQ ID NO: 1010478 - protein, 9 aa, Homo Sapiens
RITSDPQSN

SEQ ID NO: 1010479 - protein, 9 aa, Homo Sapiens
ERPAESARG

SEQ ID NO: 1010480 - protein, 9 aa, Homo Sapiens
GVDLHPVYE

SEQ ID NO: 1010481 - protein, 9 aa, Homo Sapiens
YESQVLEQL

SEQ ID NO: 1010482 - protein, 9 aa, Homo Sapiens
DFAVHKTRV

SEQ ID NO: 1010483 - protein, 9 aa, Homo Sapiens
KGKSKECWE

SEQ ID NO: 1010484 - protein, 9 aa, Homo Sapiens
YMKPGPRRQ

SEQ ID NO: 1010485 - protein, 9 aa, Homo Sapiens
DPVQIIQEL

SEQ ID NO: 1010486 - protein, 9 aa, Homo Sapiens
YYHAVETVV

SEQ ID NO: 1010487 - protein, 9 aa, Homo Sapiens
KKSGESQRL

SEQ ID NO: 1010488 - protein, 9 aa, Homo Sapiens
IEVVKKMNS

SEQ ID NO: 1010489 - protein, 9 aa, Homo Sapiens
QTLANNRRN

SEQ ID NO: 1010490 - protein, 9 aa, Homo Sapiens
TDTEEDPLM

SEQ ID NO: 1010491 - protein, 9 aa, Homo Sapiens
YFIILPENF

SEQ ID NO: 1010492 - protein, 9 aa, Homo Sapiens
FSVYNFDRF

SEQ ID NO: 1010493 - protein, 9 aa, Homo Sapiens
INLCQSSAS

SEQ ID NO: 1010494 - protein, 9 aa, Homo Sapiens
VEMVSLAAK

SEQ ID NO: 1010495 - protein, 9 aa, Homo Sapiens
TGLMDSKMT

SEQ ID NO: 1010496 - protein, 9 aa, Homo Sapiens
AILAAITGG

SEQ ID NO: 1010497 - protein, 9 aa, Homo Sapiens
NRNAVISDM

SEQ ID NO: 1010498 - protein, 9 aa, Homo Sapiens
AKEQEEPRG

SEQ ID NO: 1010499 - protein, 9 aa, Homo Sapiens
ENLKKASVI

SEQ ID NO: 1010500 - protein, 9 aa, Homo Sapiens
ALIAREINN

SEQ ID NO: 1010501 - protein, 9 aa, Homo Sapiens
MGRCHYSRD

SEQ ID NO: 1010502 - protein, 9 aa, Homo Sapiens
EVALIRASP

SEQ ID NO: 1010503 - protein, 9 aa, Homo Sapiens
CGCSLGQLS

SEQ ID NO: 1010504 - protein, 9 aa, Homo Sapiens
PTDWITSNT

SEQ ID NO: 1010505 - protein, 9 aa, Homo Sapiens
YHAVETVVN

SEQ ID NO: 1010506 - protein, 9 aa, Homo Sapiens
RKRRDSSLC

SEQ ID NO: 1010507 - protein, 9 aa, Homo Sapiens
LQDDIQNCA

SEQ ID NO: 1010508 - protein, 9 aa, Homo Sapiens
VTSILKTTQ

SEQ ID NO: 1010509 - protein, 9 aa, Homo Sapiens
NFQMAQPPP

SEQ ID NO: 1010510 - protein, 9 aa, Homo Sapiens
VFTLFTLAG

SEQ ID NO: 1010511 - protein, 9 aa, Homo Sapiens
LAMNKEEKL

SEQ ID NO: 1010512 - protein, 9 aa, Homo Sapiens
FSAPWSRST

SEQ ID NO: 1010513 - protein, 9 aa, Homo Sapiens
RTPRCEVPD

SEQ ID NO: 1010514 - protein, 9 aa, Homo Sapiens
ELRSQVQEL

SEQ ID NO: 1010515 - protein, 9 aa, Homo Sapiens
VSALEILNK

SEQ ID NO: 1010516 - protein, 9 aa, Homo Sapiens
KNAVVSFGK

SEQ ID NO: 1010517 - protein, 9 aa, Homo Sapiens
GPPGSRPRR

SEQ ID NO: 1010518 - protein, 9 aa, Homo Sapiens
KDNLLRISI

SEQ ID NO: 1010519 - protein, 9 aa, Homo Sapiens
KPGPNFVTV

SEQ ID NO: 1010520 - protein, 9 aa, Homo Sapiens
VIIEKKKII

SEQ ID NO: 1010521 - protein, 9 aa, Homo Sapiens
DHGMTNIFW

SEQ ID NO: 1010522 - protein, 9 aa, Homo Sapiens
FQAGDLLIE

SEQ ID NO: 1010523 - protein, 9 aa, Homo Sapiens
YDLDQPKVE

SEQ ID NO: 1010524 - protein, 9 aa, Homo Sapiens
DTPTNRKNH

SEQ ID NO: 1010525 - protein, 9 aa, Homo Sapiens
QIGKKLNLF

SEQ ID NO: 1010526 - protein, 9 aa, Homo Sapiens
VNFMRIKSQ

SEQ ID NO: 1010527 - protein, 9 aa, Homo Sapiens
LVFTKSTPL

SEQ ID NO: 1010528 - protein, 9 aa, Homo Sapiens
KERWKAFST

SEQ ID NO: 1010529 - protein, 9 aa, Homo Sapiens
DLLQELRDI

SEQ ID NO: 1010530 - protein, 9 aa, Homo Sapiens
DAGTRGCAG

SEQ ID NO: 1010531 - protein, 9 aa, Homo Sapiens
EIKQMHPNG

SEQ ID NO: 1010532 - protein, 9 aa, Homo Sapiens
RRSLIFYRK

SEQ ID NO: 1010533 - protein, 9 aa, Homo Sapiens
QYFNFAQGG

SEQ ID NO: 1010534 - protein, 9 aa, Homo Sapiens
WNEKRVLSN

SEQ ID NO: 1010535 - protein, 9 aa, Homo Sapiens
MILLEVRWW

SEQ ID NO: 1010536 - protein, 9 aa, Homo Sapiens
LSCKPRNMT

SEQ ID NO: 1010537 - protein, 9 aa, Homo Sapiens
PLTMDTEIL

SEQ ID NO: 1010538 - protein, 9 aa, Homo Sapiens
QRQMDARRN

SEQ ID NO: 1010539 - protein, 9 aa, Homo Sapiens
LHRDVSSRK

SEQ ID NO: 1010540 - protein, 9 aa, Homo Sapiens
ITVLDKNDN

SEQ ID NO: 1010541 - protein, 9 aa, Homo Sapiens
WGNSPALEA

SEQ ID NO: 1010542 - protein, 9 aa, Homo Sapiens
WEKKSGESQ

SEQ ID NO: 1010543 - protein, 9 aa, Homo Sapiens
WAWNEKRVL

SEQ ID NO: 1010544 - protein, 9 aa, Homo Sapiens
GLVLLTTKL

SEQ ID NO: 1010545 - protein, 9 aa, Homo Sapiens
NMPPENSLY

SEQ ID NO: 1010546 - protein, 9 aa, Homo Sapiens
ENALEDLGL

SEQ ID NO: 1010547 - protein, 9 aa, Homo Sapiens
PLSCKPRNM

SEQ ID NO: 1010548 - protein, 9 aa, Homo Sapiens
NLLYRLAAE

SEQ ID NO: 1010549 - protein, 9 aa, Homo Sapiens
NNIINLCQS

SEQ ID NO: 1010550 - protein, 9 aa, Homo Sapiens
ENFWARWSG

SEQ ID NO: 1010551 - protein, 9 aa, Homo Sapiens
LTTPLSGPS

SEQ ID NO: 1010552 - protein, 9 aa, Homo Sapiens
FAIDKINKD

SEQ ID NO: 1010553 - protein, 9 aa, Homo Sapiens
QVMSQRAIF

SEQ ID NO: 1010554 - protein, 9 aa, Homo Sapiens
RTNRGGDSG

SEQ ID NO: 1010555 - protein, 9 aa, Homo Sapiens
RIAHSPEVK

SEQ ID NO: 1010556 - protein, 9 aa, Homo Sapiens
DIMYRQLNG

SEQ ID NO: 1010557 - protein, 9 aa, Homo Sapiens
HKNVVDGKI

SEQ ID NO: 1010558 - protein, 9 aa, Homo Sapiens
GFQEKPGLQ

SEQ ID NO: 1010559 - protein, 9 aa, Homo Sapiens
CEHFALQPS

SEQ ID NO: 1010560 - protein, 9 aa, Homo Sapiens
GGFGGPGFS

SEQ ID NO: 1010561 - protein, 9 aa, Homo Sapiens
VCPTQIPVA

SEQ ID NO: 1010562 - protein, 9 aa, Homo Sapiens
RVLLDLTPN

SEQ ID NO: 1010563 - protein, 9 aa, Homo Sapiens
SLVDSYMSI

SEQ ID NO: 1010564 - protein, 9 aa, Homo Sapiens
NSIDHLYSM

SEQ ID NO: 1010565 - protein, 9 aa, Homo Sapiens
GALAGVGAA

SEQ ID NO: 1010566 - protein, 9 aa, Homo Sapiens
KLGKPYHKK

SEQ ID NO: 1010567 - protein, 9 aa, Homo Sapiens
ILNVKQSPQ

SEQ ID NO: 1010568 - protein, 9 aa, Homo Sapiens
GPTFFHVIQ

SEQ ID NO: 1010569 - protein, 9 aa, Homo Sapiens
FDFFPMSDK

SEQ ID NO: 1010570 - protein, 9 aa, Homo Sapiens
NFDLSVSRN

SEQ ID NO: 1010571 - protein, 9 aa, Homo Sapiens
CGTAFNRSS

SEQ ID NO: 1010572 - protein, 9 aa, Homo Sapiens
KLILPMPKG

SEQ ID NO: 1010573 - protein, 9 aa, Homo Sapiens
LANRLIGGL

SEQ ID NO: 1010574 - protein, 9 aa, Homo Sapiens
VARFRGTWE

SEQ ID NO: 1010575 - protein, 9 aa, Homo Sapiens
AAICKPLRY

SEQ ID NO: 1010576 - protein, 9 aa, Homo Sapiens
LNIRPSTST

SEQ ID NO: 1010577 - protein, 9 aa, Homo Sapiens
DKFFTYDFV

SEQ ID NO: 1010578 - protein, 9 aa, Homo Sapiens
KLSSPKATH

SEQ ID NO: 1010579 - protein, 9 aa, Homo Sapiens
ANRLLIYKD

SEQ ID NO: 1010580 - protein, 9 aa, Homo Sapiens
DHFSCCNSN

SEQ ID NO: 1010581 - protein, 9 aa, Homo Sapiens
PERVYLYSK

SEQ ID NO: 1010582 - protein, 9 aa, Homo Sapiens
CGHLKVLES

SEQ ID NO: 1010583 - protein, 9 aa, Homo Sapiens
AEQPPSPAF

SEQ ID NO: 1010584 - protein, 9 aa, Homo Sapiens
TPKTATGSF

SEQ ID NO: 1010585 - protein, 9 aa, Homo Sapiens
KICAQYWGE

SEQ ID NO: 1010586 - protein, 9 aa, Homo Sapiens
PLASLSKPN

SEQ ID NO: 1010587 - protein, 9 aa, Homo Sapiens
SMCFISSWN

SEQ ID NO: 1010588 - protein, 9 aa, Homo Sapiens
RRTPLGQQR

SEQ ID NO: 1010589 - protein, 9 aa, Homo Sapiens
YGMGGIIIV

SEQ ID NO: 1010590 - protein, 9 aa, Homo Sapiens
SEDFESCDS

SEQ ID NO: 1010591 - protein, 9 aa, Homo Sapiens
ASVSTKRLE

SEQ ID NO: 1010592 - protein, 9 aa, Homo Sapiens
SRITSDPQS

SEQ ID NO: 1010593 - protein, 9 aa, Homo Sapiens
NIALWPPVW

SEQ ID NO: 1010594 - protein, 9 aa, Homo Sapiens
GQFGFWRQH

SEQ ID NO: 1010595 - protein, 9 aa, Homo Sapiens
SSARSLDEI

SEQ ID NO: 1010596 - protein, 9 aa, Homo Sapiens
TIDVFFWQT

SEQ ID NO: 1010597 - protein, 9 aa, Homo Sapiens
LNKRQFYAI

SEQ ID NO: 1010598 - protein, 9 aa, Homo Sapiens
SNAPIFINF

SEQ ID NO: 1010599 - protein, 9 aa, Homo Sapiens
ITNVKNLQL

SEQ ID NO: 1010600 - protein, 9 aa, Homo Sapiens
EATHFGLWR

SEQ ID NO: 1010601 - protein, 9 aa, Homo Sapiens
PLSLFFLLA

SEQ ID NO: 1010602 - protein, 9 aa, Homo Sapiens
ENRTRVPNK

SEQ ID NO: 1010603 - protein, 9 aa, Homo Sapiens
KNSSIADIF

SEQ ID NO: 1010604 - protein, 9 aa, Homo Sapiens
RSFNLERIK

SEQ ID NO: 1010605 - protein, 9 aa, Homo Sapiens
SPVCSRLEN

SEQ ID NO: 1010606 - protein, 9 aa, Homo Sapiens
LGIAEFWIN

SEQ ID NO: 1010607 - protein, 9 aa, Homo Sapiens
IFFAGCTAQ

SEQ ID NO: 1010608 - protein, 9 aa, Homo Sapiens
ILSVIMGVF

SEQ ID NO: 1010609 - protein, 9 aa, Homo Sapiens
LSLIDQYFK

SEQ ID NO: 1010610 - protein, 9 aa, Homo Sapiens
NLLPYAINL

SEQ ID NO: 1010611 - protein, 9 aa, Homo Sapiens
VSFVLLLAL

SEQ ID NO: 1010612 - protein, 9 aa, Homo Sapiens
QTTTSPKRL

SEQ ID NO: 1010613 - protein, 9 aa, Homo Sapiens
TAKDKENPP

SEQ ID NO: 1010614 - protein, 9 aa, Homo Sapiens
GQDKPPGII

SEQ ID NO: 1010615 - protein, 9 aa, Homo Sapiens
RDISYPEMV

SEQ ID NO: 1010616 - protein, 9 aa, Homo Sapiens
QEVSSASSS

SEQ ID NO: 1010617 - protein, 9 aa, Homo Sapiens
WVLDKLKAK

SEQ ID NO: 1010618 - protein, 9 aa, Homo Sapiens
GGRGPGPLS

SEQ ID NO: 1010619 - protein, 9 aa, Homo Sapiens
EGFELFAVN

SEQ ID NO: 1010620 - protein, 9 aa, Homo Sapiens
DIPPEIGKQ

SEQ ID NO: 1010621 - protein, 9 aa, Homo Sapiens
PPPAIIPMG

SEQ ID NO: 1010622 - protein, 9 aa, Homo Sapiens
SEFVYVVDT

SEQ ID NO: 1010623 - protein, 9 aa, Homo Sapiens
GPTVSKAPT

SEQ ID NO: 1010624 - protein, 9 aa, Homo Sapiens
STDVKGERW

SEQ ID NO: 1010625 - protein, 9 aa, Homo Sapiens
FLFFTGHRK

SEQ ID NO: 1010626 - protein, 9 aa, Homo Sapiens
EYNAIKKIL

SEQ ID NO: 1010627 - protein, 9 aa, Homo Sapiens
NLKMMIILV

SEQ ID NO: 1010628 - protein, 9 aa, Homo Sapiens
VPSTKERWK

SEQ ID NO: 1010629 - protein, 9 aa, Homo Sapiens
VLLKNLEEG

SEQ ID NO: 1010630 - protein, 9 aa, Homo Sapiens
SKNNALDLP

SEQ ID NO: 1010631 - protein, 9 aa, Homo Sapiens
PSAKPNNSD

SEQ ID NO: 1010632 - protein, 9 aa, Homo Sapiens
HHHHHRQRL

SEQ ID NO: 1010633 - protein, 9 aa, Homo Sapiens
GSITTSFFA

SEQ ID NO: 1010634 - protein, 9 aa, Homo Sapiens
VDTSPREDL

SEQ ID NO: 1010635 - protein, 9 aa, Homo Sapiens
MCAVIDEKE

SEQ ID NO: 1010636 - protein, 9 aa, Homo Sapiens
TKSKSKKVE

SEQ ID NO: 1010637 - protein, 9 aa, Homo Sapiens
PTFFHVIQT

SEQ ID NO: 1010638 - protein, 9 aa, Homo Sapiens
LDQSEYTSL

SEQ ID NO: 1010639 - protein, 9 aa, Homo Sapiens
INPTIAEGS

SEQ ID NO: 1010640 - protein, 9 aa, Homo Sapiens
FSLACVDPP

SEQ ID NO: 1010641 - protein, 9 aa, Homo Sapiens
WARWSGAWA

SEQ ID NO: 1010642 - protein, 9 aa, Homo Sapiens
ANLVGADLK

SEQ ID NO: 1010643 - protein, 9 aa, Homo Sapiens
VRMLDEDVT

SEQ ID NO: 1010644 - protein, 9 aa, Homo Sapiens
TDWITSNTE

SEQ ID NO: 1010645 - protein, 9 aa, Homo Sapiens
IIVFTRKDN

SEQ ID NO: 1010646 - protein, 9 aa, Homo Sapiens
ASGFSRDSL

SEQ ID NO: 1010647 - protein, 9 aa, Homo Sapiens
GTHRDPPHQ

SEQ ID NO: 1010648 - protein, 9 aa, Homo Sapiens
PSSASSGDT

SEQ ID NO: 1010649 - protein, 9 aa, Homo Sapiens
FPSMCEKMK

SEQ ID NO: 1010650 - protein, 9 aa, Homo Sapiens
DSVLVNNGQ

SEQ ID NO: 1010651 - protein, 9 aa, Homo Sapiens
GPSLSPSLP

SEQ ID NO: 1010652 - protein, 9 aa, Homo Sapiens
LGTLVHKLS

SEQ ID NO: 1010653 - protein, 9 aa, Homo Sapiens
RPFSKNLTN

SEQ ID NO: 1010654 - protein, 9 aa, Homo Sapiens
VTFVRSIEL

SEQ ID NO: 1010655 - protein, 9 aa, Homo Sapiens
HTRKNSYQC

SEQ ID NO: 1010656 - protein, 9 aa, Homo Sapiens
AGKDDLGVV

SEQ ID NO: 1010657 - protein, 9 aa, Homo Sapiens
LYMGILLFH

SEQ ID NO: 1010658 - protein, 9 aa, Homo Sapiens
SRCKKIGAI

SEQ ID NO: 1010659 - protein, 9 aa, Homo Sapiens
LLAMAFDCF

SEQ ID NO: 1010660 - protein, 9 aa, Homo Sapiens
PLGINEPLH

SEQ ID NO: 1010661 - protein, 9 aa, Homo Sapiens
AVDYRSYIR

SEQ ID NO: 1010662 - protein, 9 aa, Homo Sapiens
YLRSTIGSR

SEQ ID NO: 1010663 - protein, 9 aa, Homo Sapiens
QSSSPRLTK

SEQ ID NO: 1010664 - protein, 9 aa, Homo Sapiens
LGVISVYDL

SEQ ID NO: 1010665 - protein, 9 aa, Homo Sapiens
LLIAVLYFT

SEQ ID NO: 1010666 - protein, 9 aa, Homo Sapiens
QEPSETQPF

SEQ ID NO: 1010667 - protein, 9 aa, Homo Sapiens
QTCSSVCSC

SEQ ID NO: 1010668 - protein, 9 aa, Homo Sapiens
ASNVICLAV

SEQ ID NO: 1010669 - protein, 9 aa, Homo Sapiens
HKCGRVGPG

SEQ ID NO: 1010670 - protein, 9 aa, Homo Sapiens
TPSSALETT

SEQ ID NO: 1010671 - protein, 9 aa, Homo Sapiens
QAALRERYL

SEQ ID NO: 1010672 - protein, 9 aa, Homo Sapiens
EAKSSADCA

SEQ ID NO: 1010673 - protein, 9 aa, Homo Sapiens
SDFSAPWSR

SEQ ID NO: 1010674 - protein, 9 aa, Homo Sapiens
LWAWNEKRV

SEQ ID NO: 1010675 - protein, 9 aa, Homo Sapiens
PLDTPKTAT

SEQ ID NO: 1010676 - protein, 9 aa, Homo Sapiens
CSWGKPISE

SEQ ID NO: 1010677 - protein, 9 aa, Homo Sapiens
GQLSSPRAH

SEQ ID NO: 1010678 - protein, 9 aa, Homo Sapiens
LNTFCVIVC

SEQ ID NO: 1010679 - protein, 9 aa, Homo Sapiens
ENIQSSSPR

SEQ ID NO: 1010680 - protein, 9 aa, Homo Sapiens
QERRFQLKG

SEQ ID NO: 1010681 - protein, 9 aa, Homo Sapiens
LDPDPCCLL

SEQ ID NO: 1010682 - protein, 9 aa, Homo Sapiens
LHAKEILHK

SEQ ID NO: 1010683 - protein, 9 aa, Homo Sapiens
HAFSPPRTA

SEQ ID NO: 1010684 - protein, 9 aa, Homo Sapiens
KKERPPKPE

SEQ ID NO: 1010685 - protein, 9 aa, Homo Sapiens
GETVKLKCQ

SEQ ID NO: 1010686 - protein, 9 aa, Homo Sapiens
VVVGTDKFF

SEQ ID NO: 1010687 - protein, 9 aa, Homo Sapiens
GAVLFLSHA

SEQ ID NO: 1010688 - protein, 9 aa, Homo Sapiens
WAVPPGSRE

SEQ ID NO: 1010689 - protein, 9 aa, Homo Sapiens
SFPLISLLL

SEQ ID NO: 1010690 - protein, 9 aa, Homo Sapiens
YQSIININR

SEQ ID NO: 1010691 - protein, 9 aa, Homo Sapiens
PPEIGKQPE

SEQ ID NO: 1010692 - protein, 9 aa, Homo Sapiens
IFDRFRGGQ

SEQ ID NO: 1010693 - protein, 9 aa, Homo Sapiens
VVKKMNSEL

SEQ ID NO: 1010694 - protein, 9 aa, Homo Sapiens
RLPPARPPK

SEQ ID NO: 1010695 - protein, 9 aa, Homo Sapiens
TCHRKPDNS

SEQ ID NO: 1010696 - protein, 9 aa, Homo Sapiens
LKRTLRKHS

SEQ ID NO: 1010697 - protein, 9 aa, Homo Sapiens
THRDPPHQP

SEQ ID NO: 1010698 - protein, 9 aa, Homo Sapiens
APGQDVWAD

SEQ ID NO: 1010699 - protein, 9 aa, Homo Sapiens
EAKEGKTDE

SEQ ID NO: 1010700 - protein, 9 aa, Homo Sapiens
THAVAGVQV

SEQ ID NO: 1010701 - protein, 9 aa, Homo Sapiens
LQETQLASF

SEQ ID NO: 1010702 - protein, 9 aa, Homo Sapiens
GRWCYTHAV

SEQ ID NO: 1010703 - protein, 9 aa, Homo Sapiens
VGLLSMIDL

SEQ ID NO: 1010704 - protein, 9 aa, Homo Sapiens
AQHRIKEIK

SEQ ID NO: 1010705 - protein, 9 aa, Homo Sapiens
RGVPEMPGL

SEQ ID NO: 1010706 - protein, 9 aa, Homo Sapiens
FLRGSAGLK

SEQ ID NO: 1010707 - protein, 9 aa, Homo Sapiens
LRGSAGLKK

SEQ ID NO: 1010708 - protein, 9 aa, Homo Sapiens
NSPGLGVKY

SEQ ID NO: 1010709 - protein, 9 aa, Homo Sapiens
LVRDGGFPL

SEQ ID NO: 1010710 - protein, 9 aa, Homo Sapiens
CTGEKPYKC

SEQ ID NO: 1010711 - protein, 9 aa, Homo Sapiens
LVVNENCMR

SEQ ID NO: 1010712 - protein, 9 aa, Homo Sapiens
LRKEAKKFW

SEQ ID NO: 1010713 - protein, 9 aa, Homo Sapiens
HQAGHASRG

SEQ ID NO: 1010714 - protein, 9 aa, Homo Sapiens
VTKPQFSQF

SEQ ID NO: 1010715 - protein, 9 aa, Homo Sapiens
ECTSNVAIT

SEQ ID NO: 1010716 - protein, 9 aa, Homo Sapiens
LSASPPSPP

SEQ ID NO: 1010717 - protein, 9 aa, Homo Sapiens
GIVCSCPER

SEQ ID NO: 1010718 - protein, 9 aa, Homo Sapiens
YSDSRLHTP

SEQ ID NO: 1010719 - protein, 9 aa, Homo Sapiens
IFYFIILPE

SEQ ID NO: 1010720 - protein, 9 aa, Homo Sapiens
NFRRPNLEA

SEQ ID NO: 1010721 - protein, 9 aa, Homo Sapiens
PFIWAKPHF

SEQ ID NO: 1010722 - protein, 9 aa, Homo Sapiens
SKLHCDKLH

SEQ ID NO: 1010723 - protein, 9 aa, Homo Sapiens
VLHERFHFP

SEQ ID NO: 1010724 - protein, 9 aa, Homo Sapiens
FISVHPGLT

SEQ ID NO: 1010725 - protein, 9 aa, Homo Sapiens
GQKGERGEL

SEQ ID NO: 1010726 - protein, 9 aa, Homo Sapiens
YKGLTAPDA

SEQ ID NO: 1010727 - protein, 9 aa, Homo Sapiens
AILNRKIQD

SEQ ID NO: 1010728 - protein, 9 aa, Homo Sapiens
HDVSSLPLS

SEQ ID NO: 1010729 - protein, 9 aa, Homo Sapiens
LFQQALQNK

SEQ ID NO: 1010730 - protein, 9 aa, Homo Sapiens
IVATEESTE

SEQ ID NO: 1010731 - protein, 9 aa, Homo Sapiens
QGFLEGASR

SEQ ID NO: 1010732 - protein, 9 aa, Homo Sapiens
KYQLTVRPD

SEQ ID NO: 1010733 - protein, 9 aa, Homo Sapiens
LTLFTAPLS

SEQ ID NO: 1010734 - protein, 9 aa, Homo Sapiens
LRFDNLRGQ

SEQ ID NO: 1010735 - protein, 9 aa, Homo Sapiens
DTSPREDLI

SEQ ID NO: 1010736 - protein, 9 aa, Homo Sapiens
GSYYRVSFS

SEQ ID NO: 1010737 - protein, 9 aa, Homo Sapiens
IPASFPVKG

SEQ ID NO: 1010738 - protein, 9 aa, Homo Sapiens
RIYTREKAY

SEQ ID NO: 1010739 - protein, 9 aa, Homo Sapiens
KISDCFWPP

SEQ ID NO: 1010740 - protein, 9 aa, Homo Sapiens
APADLESPI

SEQ ID NO: 1010741 - protein, 9 aa, Homo Sapiens
LSGPPPPGS

SEQ ID NO: 1010742 - protein, 9 aa, Homo Sapiens
DMNGAPSSA

SEQ ID NO: 1010743 - protein, 9 aa, Homo Sapiens
LGWAHACNF

SEQ ID NO: 1010744 - protein, 9 aa, Homo Sapiens
SAVTLSWEL

SEQ ID NO: 1010745 - protein, 9 aa, Homo Sapiens
CKKIGAIAQ

SEQ ID NO: 1010746 - protein, 9 aa, Homo Sapiens
ARPTMDSSA

SEQ ID NO: 1010747 - protein, 9 aa, Homo Sapiens
DHSFREQGH

SEQ ID NO: 1010748 - protein, 9 aa, Homo Sapiens
NKNIFSPHT

SEQ ID NO: 1010749 - protein, 9 aa, Homo Sapiens
ASDFSAPWS

SEQ ID NO: 1010750 - protein, 9 aa, Homo Sapiens
RSYIRLNSR

SEQ ID NO: 1010751 - protein, 9 aa, Homo Sapiens
ESRGGKDRK

SEQ ID NO: 1010752 - protein, 9 aa, Homo Sapiens
SDFAVSGQW

SEQ ID NO: 1010753 - protein, 9 aa, Homo Sapiens
LYRLAAETS

SEQ ID NO: 1010754 - protein, 9 aa, Homo Sapiens
IKTRSESIR

SEQ ID NO: 1010755 - protein, 9 aa, Homo Sapiens
FIKMLKKNV

SEQ ID NO: 1010756 - protein, 9 aa, Homo Sapiens
VVTMRSIPK

SEQ ID NO: 1010757 - protein, 9 aa, Homo Sapiens
SLTLFTAPL

SEQ ID NO: 1010758 - protein, 9 aa, Homo Sapiens
ERFHFPYDY

SEQ ID NO: 1010759 - protein, 9 aa, Homo Sapiens
ETQAQRQMD

SEQ ID NO: 1010760 - protein, 9 aa, Homo Sapiens
MLKNYSHLI

SEQ ID NO: 1010761 - protein, 9 aa, Homo Sapiens
YIAICNSLR

SEQ ID NO: 1010762 - protein, 9 aa, Homo Sapiens
LKIYNIENR

SEQ ID NO: 1010763 - protein, 9 aa, Homo Sapiens
VIVKLNGTV

SEQ ID NO: 1010764 - protein, 9 aa, Homo Sapiens
EVNGLINGK

SEQ ID NO: 1010765 - protein, 9 aa, Homo Sapiens
TPRVCSFAG

SEQ ID NO: 1010766 - protein, 9 aa, Homo Sapiens
LLESKSLYD

SEQ ID NO: 1010767 - protein, 9 aa, Homo Sapiens
NEDQEMCHK

SEQ ID NO: 1010768 - protein, 9 aa, Homo Sapiens
GAQRVVTSP

SEQ ID NO: 1010769 - protein, 9 aa, Homo Sapiens
RNLEGESPS

SEQ ID NO: 1010770 - protein, 9 aa, Homo Sapiens
STSTGVMLA

SEQ ID NO: 1010771 - protein, 9 aa, Homo Sapiens
QKVEGMNIL

SEQ ID NO: 1010772 - protein, 9 aa, Homo Sapiens
SFYTQTTDA

SEQ ID NO: 1010773 - protein, 9 aa, Homo Sapiens
SLKELRKAA

SEQ ID NO: 1010774 - protein, 9 aa, Homo Sapiens
LGSLVTDKK

SEQ ID NO: 1010775 - protein, 9 aa, Homo Sapiens
CVERENMKW

SEQ ID NO: 1010776 - protein, 9 aa, Homo Sapiens
GARQNVATV

SEQ ID NO: 1010777 - protein, 9 aa, Homo Sapiens
RQRLSGNVS

SEQ ID NO: 1010778 - protein, 9 aa, Homo Sapiens
WLSLPLSLF

SEQ ID NO: 1010779 - protein, 9 aa, Homo Sapiens
LKTYIDTRI

SEQ ID NO: 1010780 - protein, 9 aa, Homo Sapiens
LCESVAPII

SEQ ID NO: 1010781 - protein, 9 aa, Homo Sapiens
EKEAIEVFM

SEQ ID NO: 1010782 - protein, 9 aa, Homo Sapiens
KHGDNLRDI

SEQ ID NO: 1010783 - protein, 9 aa, Homo Sapiens
DLRNPDLVS

SEQ ID NO: 1010784 - protein, 9 aa, Homo Sapiens
LTEGSESND

SEQ ID NO: 1010785 - protein, 9 aa, Homo Sapiens
LPWDDNEVE

SEQ ID NO: 1010786 - protein, 9 aa, Homo Sapiens
ESQEQRAQA

SEQ ID NO: 1010787 - protein, 9 aa, Homo Sapiens
CFFYAAVHT

SEQ ID NO: 1010788 - protein, 9 aa, Homo Sapiens
HVSHALHEV

SEQ ID NO: 1010789 - protein, 9 aa, Homo Sapiens
ASLSKPNEN

SEQ ID NO: 1010790 - protein, 9 aa, Homo Sapiens
KYAASKFIT

SEQ ID NO: 1010791 - protein, 9 aa, Homo Sapiens
KKETKVLKI

SEQ ID NO: 1010792 - protein, 9 aa, Homo Sapiens
SHCPRHCPP

SEQ ID NO: 1010793 - protein, 9 aa, Homo Sapiens
PVGTSLSLQ

SEQ ID NO: 1010794 - protein, 9 aa, Homo Sapiens
YHAHLQRHP

SEQ ID NO: 1010795 - protein, 9 aa, Homo Sapiens
CSPSAPHFF

SEQ ID NO: 1010796 - protein, 9 aa, Homo Sapiens
GHKRKEKFF

SEQ ID NO: 1010797 - protein, 9 aa, Homo Sapiens
LIGGLASEN

SEQ ID NO: 1010798 - protein, 9 aa, Homo Sapiens
RVKVGNKFV

SEQ ID NO: 1010799 - protein, 9 aa, Homo Sapiens
TVAIPDVDS

SEQ ID NO: 1010800 - protein, 9 aa, Homo Sapiens
NNASASPLH

SEQ ID NO: 1010801 - protein, 9 aa, Homo Sapiens
CSRVNTCSW

SEQ ID NO: 1010802 - protein, 9 aa, Homo Sapiens
KENEAGQIC

SEQ ID NO: 1010803 - protein, 9 aa, Homo Sapiens
NIFGARQNV

SEQ ID NO: 1010804 - protein, 9 aa, Homo Sapiens
LAVDYRSYI

SEQ ID NO: 1010805 - protein, 9 aa, Homo Sapiens
EKKSGESQR

SEQ ID NO: 1010806 - protein, 9 aa, Homo Sapiens
KQPEQPPLE

SEQ ID NO: 1010807 - protein, 9 aa, Homo Sapiens
VHPSREVNG

SEQ ID NO: 1010808 - protein, 9 aa, Homo Sapiens
QTAKEILSK

SEQ ID NO: 1010809 - protein, 9 aa, Homo Sapiens
AARPTMDSS

SEQ ID NO: 1010810 - protein, 9 aa, Homo Sapiens
IFLQDHLDK

SEQ ID NO: 1010811 - protein, 9 aa, Homo Sapiens
WIAAFSPVC

SEQ ID NO: 1010812 - protein, 9 aa, Homo Sapiens
VEDEVILSA

SEQ ID NO: 1010813 - protein, 9 aa, Homo Sapiens
LWLQVGSLC

SEQ ID NO: 1010814 - protein, 9 aa, Homo Sapiens
SCSFLVEES

SEQ ID NO: 1010815 - protein, 9 aa, Homo Sapiens
KRRDSSLCS

SEQ ID NO: 1010816 - protein, 9 aa, Homo Sapiens
EWTKTLPGS

SEQ ID NO: 1010817 - protein, 9 aa, Homo Sapiens
YRKEIRKVT

SEQ ID NO: 1010818 - protein, 9 aa, Homo Sapiens
AVSTVASST

SEQ ID NO: 1010819 - protein, 9 aa, Homo Sapiens
LYVRHFLWS

SEQ ID NO: 1010820 - protein, 9 aa, Homo Sapiens
SFHCDNGFV

SEQ ID NO: 1010821 - protein, 9 aa, Homo Sapiens
KEAKSSADC

SEQ ID NO: 1010822 - protein, 9 aa, Homo Sapiens
DSFWSQVLP

SEQ ID NO: 1010823 - protein, 9 aa, Homo Sapiens
FSECSSQCG

SEQ ID NO: 1010824 - protein, 9 aa, Homo Sapiens
EKERMHDEL

SEQ ID NO: 1010825 - protein, 9 aa, Homo Sapiens
SDEMRTRAL

SEQ ID NO: 1010826 - protein, 9 aa, Homo Sapiens
SVRPNAASL

SEQ ID NO: 1010827 - protein, 9 aa, Homo Sapiens
PSRVPVQVR

SEQ ID NO: 1010828 - protein, 9 aa, Homo Sapiens
RVSRWYFGR

SEQ ID NO: 1010829 - protein, 9 aa, Homo Sapiens
ENTFKQIYA

SEQ ID NO: 1010830 - protein, 9 aa, Homo Sapiens
SNVICLAVL

SEQ ID NO: 1010831 - protein, 9 aa, Homo Sapiens
VVGGVGVLF

SEQ ID NO: 1010832 - protein, 9 aa, Homo Sapiens
ILFTKKKET

SEQ ID NO: 1010833 - protein, 9 aa, Homo Sapiens
KLKGTTHSL

SEQ ID NO: 1010834 - protein, 9 aa, Homo Sapiens
LPSISTKKN

SEQ ID NO: 1010835 - protein, 9 aa, Homo Sapiens
DKEPRHKGQ

SEQ ID NO: 1010836 - protein, 9 aa, Homo Sapiens
IILAIYSDS

SEQ ID NO: 1010837 - protein, 9 aa, Homo Sapiens
SNSSASLLE

SEQ ID NO: 1010838 - protein, 9 aa, Homo Sapiens
NFAQGGGPQ

SEQ ID NO: 1010839 - protein, 9 aa, Homo Sapiens
VQPQIFSSS

SEQ ID NO: 1010840 - protein, 9 aa, Homo Sapiens
KESSLMNDL

SEQ ID NO: 1010841 - protein, 9 aa, Homo Sapiens
RNGGQCQDN

SEQ ID NO: 1010842 - protein, 9 aa, Homo Sapiens
RLTNEVELQ

SEQ ID NO: 1010843 - protein, 9 aa, Homo Sapiens
EYIVFVSTS

SEQ ID NO: 1010844 - protein, 9 aa, Homo Sapiens
SSQQPKSLQ

SEQ ID NO: 1010845 - protein, 9 aa, Homo Sapiens
ELLKGNSRR

SEQ ID NO: 1010846 - protein, 9 aa, Homo Sapiens
EVCLTEGSE

SEQ ID NO: 1010847 - protein, 9 aa, Homo Sapiens
RDIVRDRNA

SEQ ID NO: 1010848 - protein, 9 aa, Homo Sapiens
KDQPQEERK

SEQ ID NO: 1010849 - protein, 9 aa, Homo Sapiens
MRETCVNLH

SEQ ID NO: 1010850 - protein, 9 aa, Homo Sapiens
IKKCKRGFI

SEQ ID NO: 1010851 - protein, 9 aa, Homo Sapiens
STKSLDSFW

SEQ ID NO: 1010852 - protein, 9 aa, Homo Sapiens
HQKYKGLTA

SEQ ID NO: 1010853 - protein, 9 aa, Homo Sapiens
RCKKIGAIA

SEQ ID NO: 1010854 - protein, 9 aa, Homo Sapiens
VGAASGALA

SEQ ID NO: 1010855 - protein, 9 aa, Homo Sapiens
HVVSITMSY

SEQ ID NO: 1010856 - protein, 9 aa, Homo Sapiens
DKDNKYVSY

SEQ ID NO: 1010857 - protein, 9 aa, Homo Sapiens
SSPNRFADK

SEQ ID NO: 1010858 - protein, 9 aa, Homo Sapiens
TTLPCLTFF

SEQ ID NO: 1010859 - protein, 9 aa, Homo Sapiens
AFTSSQESK

SEQ ID NO: 1010860 - protein, 9 aa, Homo Sapiens
ISSENVYSQ

SEQ ID NO: 1010861 - protein, 9 aa, Homo Sapiens
QEITPRHKQ

SEQ ID NO: 1010862 - protein, 9 aa, Homo Sapiens
VMTLFSCPV

SEQ ID NO: 1010863 - protein, 9 aa, Homo Sapiens
YEEFHYDKE

SEQ ID NO: 1010864 - protein, 9 aa, Homo Sapiens
VRAERNNAR

SEQ ID NO: 1010865 - protein, 9 aa, Homo Sapiens
MPVSSSFND

SEQ ID NO: 1010866 - protein, 9 aa, Homo Sapiens
LFSWAQIRL

SEQ ID NO: 1010867 - protein, 9 aa, Homo Sapiens
QHCRKIFGK

SEQ ID NO: 1010868 - protein, 9 aa, Homo Sapiens
LRRTAYLVL

SEQ ID NO: 1010869 - protein, 9 aa, Homo Sapiens
SRGFFCKAG

SEQ ID NO: 1010870 - protein, 9 aa, Homo Sapiens
RDRNAEIVV

SEQ ID NO: 1010871 - protein, 9 aa, Homo Sapiens
QGYLYTAKG

SEQ ID NO: 1010872 - protein, 9 aa, Homo Sapiens
STIHGDMRK

SEQ ID NO: 1010873 - protein, 9 aa, Homo Sapiens
FIYTLCNKE

SEQ ID NO: 1010874 - protein, 9 aa, Homo Sapiens
WTLRDDLVI

SEQ ID NO: 1010875 - protein, 9 aa, Homo Sapiens
AGLKKERPP

SEQ ID NO: 1010876 - protein, 9 aa, Homo Sapiens
TSGKMHIDK

SEQ ID NO: 1010877 - protein, 9 aa, Homo Sapiens
KVFSECIEG

SEQ ID NO: 1010878 - protein, 9 aa, Homo Sapiens
EVKDCVTNR

SEQ ID NO: 1010879 - protein, 9 aa, Homo Sapiens
AQRLGRYHQ

SEQ ID NO: 1010880 - protein, 9 aa, Homo Sapiens
ITNNIVYFF

SEQ ID NO: 1010881 - protein, 9 aa, Homo Sapiens
KISLQDYEE

SEQ ID NO: 1010882 - protein, 9 aa, Homo Sapiens
SPSLAPRSR

SEQ ID NO: 1010883 - protein, 9 aa, Homo Sapiens
SVPIKDELF

SEQ ID NO: 1010884 - protein, 9 aa, Homo Sapiens
KHYGNKKYK

SEQ ID NO: 1010885 - protein, 9 aa, Homo Sapiens
KVKHENQQQ

SEQ ID NO: 1010886 - protein, 9 aa, Homo Sapiens
QNVLDKYMK

SEQ ID NO: 1010887 - protein, 9 aa, Homo Sapiens
KMTYLKKNH

SEQ ID NO: 1010888 - protein, 9 aa, Homo Sapiens
SQLSLVGGL

SEQ ID NO: 1010889 - protein, 9 aa, Homo Sapiens
SPKYKITEK

SEQ ID NO: 1010890 - protein, 9 aa, Homo Sapiens
KYFQKITLY

SEQ ID NO: 1010891 - protein, 9 aa, Homo Sapiens
PSPDGDYNY

SEQ ID NO: 1010892 - protein, 9 aa, Homo Sapiens
RRGRWCYTH

SEQ ID NO: 1010893 - protein, 9 aa, Homo Sapiens
RKRDRERDR

SEQ ID NO: 1010894 - protein, 9 aa, Homo Sapiens
DCITLELLI

SEQ ID NO: 1010895 - protein, 9 aa, Homo Sapiens
GIPSLNDHG

SEQ ID NO: 1010896 - protein, 9 aa, Homo Sapiens
FIIEVVNIT

SEQ ID NO: 1010897 - protein, 9 aa, Homo Sapiens
FHFARVLYT

SEQ ID NO: 1010898 - protein, 9 aa, Homo Sapiens
DLHRTSEKE

SEQ ID NO: 1010899 - protein, 9 aa, Homo Sapiens
MRTPRCEVP

SEQ ID NO: 1010900 - protein, 9 aa, Homo Sapiens
NGFVKTQGS

SEQ ID NO: 1010901 - protein, 9 aa, Homo Sapiens
SFPDLSAQL

SEQ ID NO: 1010902 - protein, 9 aa, Homo Sapiens
DRWGQEKEN

SEQ ID NO: 1010903 - protein, 9 aa, Homo Sapiens
ARQNVATVL

SEQ ID NO: 1010904 - protein, 9 aa, Homo Sapiens
VADFDFFPM

SEQ ID NO: 1010905 - protein, 9 aa, Homo Sapiens
ELGYRRTGE

SEQ ID NO: 1010906 - protein, 9 aa, Homo Sapiens
VELQDKRIN

SEQ ID NO: 1010907 - protein, 9 aa, Homo Sapiens
RPNAASLPG

SEQ ID NO: 1010908 - protein, 9 aa, Homo Sapiens
PLPIGNKTL

SEQ ID NO: 1010909 - protein, 9 aa, Homo Sapiens
WCFAVPVLP

SEQ ID NO: 1010910 - protein, 9 aa, Homo Sapiens
GMYPCAFLC

SEQ ID NO: 1010911 - protein, 9 aa, Homo Sapiens
GEDEPAIAI

SEQ ID NO: 1010912 - protein, 9 aa, Homo Sapiens
SEESTESEH

SEQ ID NO: 1010913 - protein, 9 aa, Homo Sapiens
NIELTRSTR

SEQ ID NO: 1010914 - protein, 9 aa, Homo Sapiens
LAGVGAASG

SEQ ID NO: 1010915 - protein, 9 aa, Homo Sapiens
PGWRNLEGE

SEQ ID NO: 1010916 - protein, 9 aa, Homo Sapiens
RKFWINEKT

SEQ ID NO: 1010917 - protein, 9 aa, Homo Sapiens
MYVEDVRSV

SEQ ID NO: 1010918 - protein, 9 aa, Homo Sapiens
ASPPDLKSS

SEQ ID NO: 1010919 - protein, 9 aa, Homo Sapiens
CQDNQGFAL

SEQ ID NO: 1010920 - protein, 9 aa, Homo Sapiens
EPRIFSDTA

SEQ ID NO: 1010921 - protein, 9 aa, Homo Sapiens
GSSVKPGTE

SEQ ID NO: 1010922 - protein, 9 aa, Homo Sapiens
FKLGKPYHK

SEQ ID NO: 1010923 - protein, 9 aa, Homo Sapiens
VRKMTLDQS

SEQ ID NO: 1010924 - protein, 9 aa, Homo Sapiens
FLEGASRDV

SEQ ID NO: 1010925 - protein, 9 aa, Homo Sapiens
HNLLPPRAH

SEQ ID NO: 1010926 - protein, 9 aa, Homo Sapiens
EQSDQSFLS

SEQ ID NO: 1010927 - protein, 9 aa, Homo Sapiens
KVHTGIKPL

SEQ ID NO: 1010928 - protein, 9 aa, Homo Sapiens
GYASSDGYY

SEQ ID NO: 1010929 - protein, 9 aa, Homo Sapiens
QAFSLSPGH

SEQ ID NO: 1010930 - protein, 9 aa, Homo Sapiens
TSDLGTYTC

SEQ ID NO: 1010931 - protein, 9 aa, Homo Sapiens
HQRLGTHWD

SEQ ID NO: 1010932 - protein, 9 aa, Homo Sapiens
SEQKRMRNE

SEQ ID NO: 1010933 - protein, 9 aa, Homo Sapiens
SGDTTPLPV

SEQ ID NO: 1010934 - protein, 9 aa, Homo Sapiens
LRVGPSPRG

SEQ ID NO: 1010935 - protein, 9 aa, Homo Sapiens
GVPEMPGLK

SEQ ID NO: 1010936 - protein, 9 aa, Homo Sapiens
SARGPRAAR

SEQ ID NO: 1010937 - protein, 9 aa, Homo Sapiens
IGNKTLSGL

SEQ ID NO: 1010938 - protein, 9 aa, Homo Sapiens
LEESGLCWV

SEQ ID NO: 1010939 - protein, 9 aa, Homo Sapiens
EVVYTSHLQ

SEQ ID NO: 1010940 - protein, 9 aa, Homo Sapiens
KGNRGVPEM

SEQ ID NO: 1010941 - protein, 9 aa, Homo Sapiens
WPNGCCSAN

SEQ ID NO: 1010942 - protein, 9 aa, Homo Sapiens
GHLFALRLL

SEQ ID NO: 1010943 - protein, 9 aa, Homo Sapiens
EGMLTEESI

SEQ ID NO: 1010944 - protein, 9 aa, Homo Sapiens
CSSVCSCSN

SEQ ID NO: 1010945 - protein, 9 aa, Homo Sapiens
SCFFREKKE

SEQ ID NO: 1010946 - protein, 9 aa, Homo Sapiens
KKETMTCVF

SEQ ID NO: 1010947 - protein, 9 aa, Homo Sapiens
NAEIVVKDN

SEQ ID NO: 1010948 - protein, 9 aa, Homo Sapiens
HAKEILHKD

SEQ ID NO: 1010949 - protein, 9 aa, Homo Sapiens
PKPGRSFPG

SEQ ID NO: 1010950 - protein, 9 aa, Homo Sapiens
NVAITTLFL

SEQ ID NO: 1010951 - protein, 9 aa, Homo Sapiens
STGLMDSKM

SEQ ID NO: 1010952 - protein, 9 aa, Homo Sapiens
PGGSGSMSL

SEQ ID NO: 1010953 - protein, 9 aa, Homo Sapiens
VVEYEVTPD

SEQ ID NO: 1010954 - protein, 9 aa, Homo Sapiens
LGSSVKPGT

SEQ ID NO: 1010955 - protein, 9 aa, Homo Sapiens
QVNNASASP

SEQ ID NO: 1010956 - protein, 9 aa, Homo Sapiens
SKFLCADYA

SEQ ID NO: 1010957 - protein, 9 aa, Homo Sapiens
LQLAPGQDV

SEQ ID NO: 1010958 - protein, 9 aa, Homo Sapiens
TVRTKGIPH

SEQ ID NO: 1010959 - protein, 9 aa, Homo Sapiens
TEDFICISM

SEQ ID NO: 1010960 - protein, 9 aa, Homo Sapiens
AVTPPGVAA

SEQ ID NO: 1010961 - protein, 9 aa, Homo Sapiens
DTGPISEGG

SEQ ID NO: 1010962 - protein, 9 aa, Homo Sapiens
QRGVVVIPR

SEQ ID NO: 1010963 - protein, 9 aa, Homo Sapiens
SLVDIFFSL

SEQ ID NO: 1010964 - protein, 9 aa, Homo Sapiens
HHHHRQRLS

SEQ ID NO: 1010965 - protein, 9 aa, Homo Sapiens
GKEYYIKIL

SEQ ID NO: 1010966 - protein, 9 aa, Homo Sapiens
SWGQGACQA

SEQ ID NO: 1010967 - protein, 9 aa, Homo Sapiens
PPVWEKRVR

SEQ ID NO: 1010968 - protein, 9 aa, Homo Sapiens
ELIRKLVDF

SEQ ID NO: 1010969 - protein, 9 aa, Homo Sapiens
EKTGEIKVN

SEQ ID NO: 1010970 - protein, 9 aa, Homo Sapiens
AINPTNTVF

SEQ ID NO: 1010971 - protein, 9 aa, Homo Sapiens
SLFSFRKSE

SEQ ID NO: 1010972 - protein, 9 aa, Homo Sapiens
TPPWSSYKK

SEQ ID NO: 1010973 - protein, 9 aa, Homo Sapiens
TTFLTVVPD

SEQ ID NO: 1010974 - protein, 9 aa, Homo Sapiens
GWTGLQASN

SEQ ID NO: 1010975 - protein, 9 aa, Homo Sapiens
DSKRDRLIL

SEQ ID NO: 1010976 - protein, 9 aa, Homo Sapiens
RKPQQRLNI

SEQ ID NO: 1010977 - protein, 9 aa, Homo Sapiens
PENFLIIFT

SEQ ID NO: 1010978 - protein, 9 aa, Homo Sapiens
NCLFLAGET

SEQ ID NO: 1010979 - protein, 9 aa, Homo Sapiens
KVEVNSIVV

SEQ ID NO: 1010980 - protein, 9 aa, Homo Sapiens
VRTEIGVFL

SEQ ID NO: 1010981 - protein, 9 aa, Homo Sapiens
PPSPAFTSS

SEQ ID NO: 1010982 - protein, 9 aa, Homo Sapiens
TMDSSAHRS

SEQ ID NO: 1010983 - protein, 9 aa, Homo Sapiens
DLTPRSDNA

SEQ ID NO: 1010984 - protein, 9 aa, Homo Sapiens
QREIDKLKQ

SEQ ID NO: 1010985 - protein, 9 aa, Homo Sapiens
RIPLDSAFN

SEQ ID NO: 1010986 - protein, 9 aa, Homo Sapiens
ILSCVNKNK

SEQ ID NO: 1010987 - protein, 9 aa, Homo Sapiens
FPVMSLPSS

SEQ ID NO: 1010988 - protein, 9 aa, Homo Sapiens
GKTDELLKA

SEQ ID NO: 1010989 - protein, 9 aa, Homo Sapiens
LSSPRAHSL

SEQ ID NO: 1010990 - protein, 9 aa, Homo Sapiens
MVEKTRRFM

SEQ ID NO: 1010991 - protein, 9 aa, Homo Sapiens
KEMMEWTSY

SEQ ID NO: 1010992 - protein, 9 aa, Homo Sapiens
IKNKANFFF

SEQ ID NO: 1010993 - protein, 9 aa, Homo Sapiens
ACNENGLQS

SEQ ID NO: 1010994 - protein, 9 aa, Homo Sapiens
VTVSCKAPS

SEQ ID NO: 1010995 - protein, 9 aa, Homo Sapiens
WRASKIELT

SEQ ID NO: 1010996 - protein, 9 aa, Homo Sapiens
NVTIMAVIC

SEQ ID NO: 1010997 - protein, 9 aa, Homo Sapiens
KITVRTKGI

SEQ ID NO: 1010998 - protein, 9 aa, Homo Sapiens
ENEVEVGRP

SEQ ID NO: 1010999 - protein, 9 aa, Homo Sapiens
KFSLACVDP

SEQ ID NO: 1011000 - protein, 9 aa, Homo Sapiens
PPEDRRVYG

SEQ ID NO: 1011001 - protein, 9 aa, Homo Sapiens
LNVKQSPQS

SEQ ID NO: 1011002 - protein, 9 aa, Homo Sapiens
SKVRDWLAS

SEQ ID NO: 1011003 - protein, 9 aa, Homo Sapiens
ATPGRRPRR

SEQ ID NO: 1011004 - protein, 9 aa, Homo Sapiens
DYDLDQPKV

SEQ ID NO: 1011005 - protein, 9 aa, Homo Sapiens
SKSETTITS

SEQ ID NO: 1011006 - protein, 9 aa, Homo Sapiens
ELKPEQEIT

SEQ ID NO: 1011007 - protein, 9 aa, Homo Sapiens
VKGERWTSF

SEQ ID NO: 1011008 - protein, 9 aa, Homo Sapiens
TNRGGDSGG

SEQ ID NO: 1011009 - protein, 9 aa, Homo Sapiens
EDVFPLQPE

SEQ ID NO: 1011010 - protein, 9 aa, Homo Sapiens
PSRAQTQGL

SEQ ID NO: 1011011 - protein, 9 aa, Homo Sapiens
TLISIPHFL

SEQ ID NO: 1011012 - protein, 9 aa, Homo Sapiens
KEQELQNVL

SEQ ID NO: 1011013 - protein, 9 aa, Homo Sapiens
LKQSLPPRF

SEQ ID NO: 1011014 - protein, 9 aa, Homo Sapiens
HHQRNHSGE

SEQ ID NO: 1011015 - protein, 9 aa, Homo Sapiens
NWKDYDDKE

SEQ ID NO: 1011016 - protein, 9 aa, Homo Sapiens
FVQNTFIPL

SEQ ID NO: 1011017 - protein, 9 aa, Homo Sapiens
TVVNPELFR

SEQ ID NO: 1011018 - protein, 9 aa, Homo Sapiens
SSGDTTPLP

SEQ ID NO: 1011019 - protein, 9 aa, Homo Sapiens
LVSERICFL

SEQ ID NO: 1011020 - protein, 9 aa, Homo Sapiens
GKKMKSKVD

SEQ ID NO: 1011021 - protein, 9 aa, Homo Sapiens
DPCCLLTNG

SEQ ID NO: 1011022 - protein, 9 aa, Homo Sapiens
IIEKKKIIG

SEQ ID NO: 1011023 - protein, 9 aa, Homo Sapiens
DRSSSGALN

SEQ ID NO: 1011024 - protein, 9 aa, Homo Sapiens
SKKFDLIVH

SEQ ID NO: 1011025 - protein, 9 aa, Homo Sapiens
SILKTTQGS

SEQ ID NO: 1011026 - protein, 9 aa, Homo Sapiens
FDLCSMADV

SEQ ID NO: 1011027 - protein, 9 aa, Homo Sapiens
SSEQGTLKL

SEQ ID NO: 1011028 - protein, 9 aa, Homo Sapiens
FVRTTEEGI

SEQ ID NO: 1011029 - protein, 9 aa, Homo Sapiens
STRPTPVQK

SEQ ID NO: 1011030 - protein, 9 aa, Homo Sapiens
SPYLLQHVY

SEQ ID NO: 1011031 - protein, 9 aa, Homo Sapiens
WPQSNSKFL

SEQ ID NO: 1011032 - protein, 9 aa, Homo Sapiens
VLEGLSELG

SEQ ID NO: 1011033 - protein, 9 aa, Homo Sapiens
ARPPATLPF

SEQ ID NO: 1011034 - protein, 9 aa, Homo Sapiens
QLVELGYRR

SEQ ID NO: 1011035 - protein, 9 aa, Homo Sapiens
PNGTNPYKP

SEQ ID NO: 1011036 - protein, 9 aa, Homo Sapiens
THFGLWRIC

SEQ ID NO: 1011037 - protein, 9 aa, Homo Sapiens
IKNSVLHCI

SEQ ID NO: 1011038 - protein, 9 aa, Homo Sapiens
NGGQPQMTT

SEQ ID NO: 1011039 - protein, 9 aa, Homo Sapiens
FTSKSEHKN

SEQ ID NO: 1011040 - protein, 9 aa, Homo Sapiens
FISSYLIKP

SEQ ID NO: 1011041 - protein, 9 aa, Homo Sapiens
GTVGMDMNE

SEQ ID NO: 1011042 - protein, 9 aa, Homo Sapiens
KQGSLTVQC

SEQ ID NO: 1011043 - protein, 9 aa, Homo Sapiens
KKDTWKFLD

SEQ ID NO: 1011044 - protein, 9 aa, Homo Sapiens
TQIPVAARD

SEQ ID NO: 1011045 - protein, 9 aa, Homo Sapiens
DDYFENEEE

SEQ ID NO: 1011046 - protein, 9 aa, Homo Sapiens
FYVDVEVRD

SEQ ID NO: 1011047 - protein, 9 aa, Homo Sapiens
AEEPEDSAS

SEQ ID NO: 1011048 - protein, 9 aa, Homo Sapiens
WYFGRLASC

SEQ ID NO: 1011049 - protein, 9 aa, Homo Sapiens
HERFHFPYD

SEQ ID NO: 1011050 - protein, 9 aa, Homo Sapiens
VKLKCQVLL

SEQ ID NO: 1011051 - protein, 9 aa, Homo Sapiens
LGHNKNQQG

SEQ ID NO: 1011052 - protein, 9 aa, Homo Sapiens
EESRASTAR

SEQ ID NO: 1011053 - protein, 9 aa, Homo Sapiens
TGPTAGRNL

SEQ ID NO: 1011054 - protein, 9 aa, Homo Sapiens
HHLFLFFTG

SEQ ID NO: 1011055 - protein, 9 aa, Homo Sapiens
REAATVRHL

SEQ ID NO: 1011056 - protein, 9 aa, Homo Sapiens
CLLNEEVIV

SEQ ID NO: 1011057 - protein, 9 aa, Homo Sapiens
HKVERQNRS

SEQ ID NO: 1011058 - protein, 9 aa, Homo Sapiens
AEGRPSPLK

SEQ ID NO: 1011059 - protein, 9 aa, Homo Sapiens
RLENEQFKS

SEQ ID NO: 1011060 - protein, 9 aa, Homo Sapiens
TLQSLDPSA

SEQ ID NO: 1011061 - protein, 9 aa, Homo Sapiens
FFIKMFDRW

SEQ ID NO: 1011062 - protein, 9 aa, Homo Sapiens
KIFQVELNL

SEQ ID NO: 1011063 - protein, 9 aa, Homo Sapiens
RLQKETGAK

SEQ ID NO: 1011064 - protein, 9 aa, Homo Sapiens
PTVDMPVSS

SEQ ID NO: 1011065 - protein, 9 aa, Homo Sapiens
QDVDSKKAQ

SEQ ID NO: 1011066 - protein, 9 aa, Homo Sapiens
EILNKHLQK

SEQ ID NO: 1011067 - protein, 9 aa, Homo Sapiens
RSDNAKLSL

SEQ ID NO: 1011068 - protein, 9 aa, Homo Sapiens
HEEDDNNDD

SEQ ID NO: 1011069 - protein, 9 aa, Homo Sapiens
AATQKKVEK

SEQ ID NO: 1011070 - protein, 9 aa, Homo Sapiens
FFPMSDKNP

SEQ ID NO: 1011071 - protein, 9 aa, Homo Sapiens
QGSHYNQAQ

SEQ ID NO: 1011072 - protein, 9 aa, Homo Sapiens
GIQHLEQIG

SEQ ID NO: 1011073 - protein, 9 aa, Homo Sapiens
IKMMAVGIC

SEQ ID NO: 1011074 - protein, 9 aa, Homo Sapiens
AVQFWAIQR

SEQ ID NO: 1011075 - protein, 9 aa, Homo Sapiens
SLRYALSFY

SEQ ID NO: 1011076 - protein, 9 aa, Homo Sapiens
SPLRKEAKK

SEQ ID NO: 1011077 - protein, 9 aa, Homo Sapiens
PQEQFSKNN

SEQ ID NO: 1011078 - protein, 9 aa, Homo Sapiens
VADHAFSPP

SEQ ID NO: 1011079 - protein, 9 aa, Homo Sapiens
FHPDVSDEM

SEQ ID NO: 1011080 - protein, 9 aa, Homo Sapiens
NKNCSGIGK

SEQ ID NO: 1011081 - protein, 9 aa, Homo Sapiens
KTLPGSLAL

SEQ ID NO: 1011082 - protein, 9 aa, Homo Sapiens
STKKNTLSK

SEQ ID NO: 1011083 - protein, 9 aa, Homo Sapiens
HHEPGVLGP

SEQ ID NO: 1011084 - protein, 9 aa, Homo Sapiens
EESLKELRK

SEQ ID NO: 1011085 - protein, 9 aa, Homo Sapiens
SCQEGGGHN

SEQ ID NO: 1011086 - protein, 9 aa, Homo Sapiens
YQVLHERFH

SEQ ID NO: 1011087 - protein, 9 aa, Homo Sapiens
CGKLFSKKF

SEQ ID NO: 1011088 - protein, 9 aa, Homo Sapiens
FRGTWEKLP

SEQ ID NO: 1011089 - protein, 9 aa, Homo Sapiens
QGRKREPGE

SEQ ID NO: 1011090 - protein, 9 aa, Homo Sapiens
DKNDNAPQF

SEQ ID NO: 1011091 - protein, 9 aa, Homo Sapiens
KEQEGGGAR

SEQ ID NO: 1011092 - protein, 9 aa, Homo Sapiens
LLQDYMQRC

SEQ ID NO: 1011093 - protein, 9 aa, Homo Sapiens
SLPLQLACH

SEQ ID NO: 1011094 - protein, 9 aa, Homo Sapiens
NSNLQDSAQ

SEQ ID NO: 1011095 - protein, 9 aa, Homo Sapiens
LISLLLRGK

SEQ ID NO: 1011096 - protein, 9 aa, Homo Sapiens
SRSLPRVLF

SEQ ID NO: 1011097 - protein, 9 aa, Homo Sapiens
KRQWEKKSG

SEQ ID NO: 1011098 - protein, 9 aa, Homo Sapiens
PEDSASAPD

SEQ ID NO: 1011099 - protein, 9 aa, Homo Sapiens
SSAHRSRAA

SEQ ID NO: 1011100 - protein, 9 aa, Homo Sapiens
YEYIVFVST

SEQ ID NO: 1011101 - protein, 9 aa, Homo Sapiens
QKGERGELG

SEQ ID NO: 1011102 - protein, 9 aa, Homo Sapiens
AIDKINKDD

SEQ ID NO: 1011103 - protein, 9 aa, Homo Sapiens
LSLQTALRG

SEQ ID NO: 1011104 - protein, 9 aa, Homo Sapiens
PPENSLYLF

SEQ ID NO: 1011105 - protein, 9 aa, Homo Sapiens
IHEIKFSPD

SEQ ID NO: 1011106 - protein, 9 aa, Homo Sapiens
EKVPLFPLP

SEQ ID NO: 1011107 - protein, 9 aa, Homo Sapiens
TNTDTALTA

SEQ ID NO: 1011108 - protein, 9 aa, Homo Sapiens
VQLKELEKK

SEQ ID NO: 1011109 - protein, 9 aa, Homo Sapiens
VKVNKKNVQ

SEQ ID NO: 1011110 - protein, 9 aa, Homo Sapiens
SAPGQLSSP

SEQ ID NO: 1011111 - protein, 9 aa, Homo Sapiens
VPATSGIAQ

SEQ ID NO: 1011112 - protein, 9 aa, Homo Sapiens
LESQEQRAQ

SEQ ID NO: 1011113 - protein, 9 aa, Homo Sapiens
ANFISSYLI

SEQ ID NO: 1011114 - protein, 9 aa, Homo Sapiens
KVESSQAQS

SEQ ID NO: 1011115 - protein, 9 aa, Homo Sapiens
FMLCRKNAV

SEQ ID NO: 1011116 - protein, 9 aa, Homo Sapiens
AGHASRGHV

SEQ ID NO: 1011117 - protein, 9 aa, Homo Sapiens
HVLGTIFSA

SEQ ID NO: 1011118 - protein, 9 aa, Homo Sapiens
TNRKNHSVS

SEQ ID NO: 1011119 - protein, 9 aa, Homo Sapiens
MLNLLIYSL

SEQ ID NO: 1011120 - protein, 9 aa, Homo Sapiens
NEVEWEEDV

SEQ ID NO: 1011121 - protein, 9 aa, Homo Sapiens
LNMLKNFLG

SEQ ID NO: 1011122 - protein, 9 aa, Homo Sapiens
GGMASSPCG

SEQ ID NO: 1011123 - protein, 9 aa, Homo Sapiens
SYESQVLEQ

SEQ ID NO: 1011124 - protein, 9 aa, Homo Sapiens
SLVICEDGN

SEQ ID NO: 1011125 - protein, 9 aa, Homo Sapiens
LNRKIQDNY

SEQ ID NO: 1011126 - protein, 9 aa, Homo Sapiens
FLSNGYISI

SEQ ID NO: 1011127 - protein, 9 aa, Homo Sapiens
QCNKGAYFS

SEQ ID NO: 1011128 - protein, 9 aa, Homo Sapiens
SAGLKKERP

SEQ ID NO: 1011129 - protein, 9 aa, Homo Sapiens
DSQFFSRTD

SEQ ID NO: 1011130 - protein, 9 aa, Homo Sapiens
VSSSDTGPI

SEQ ID NO: 1011131 - protein, 9 aa, Homo Sapiens
KSPLRKEAK

SEQ ID NO: 1011132 - protein, 9 aa, Homo Sapiens
QGKIMYVED

SEQ ID NO: 1011133 - protein, 9 aa, Homo Sapiens
LTPRSDNAK

SEQ ID NO: 1011134 - protein, 9 aa, Homo Sapiens
SESSWNKDK

SEQ ID NO: 1011135 - protein, 9 aa, Homo Sapiens
DAYMKPGPR

SEQ ID NO: 1011136 - protein, 9 aa, Homo Sapiens
GEDGTSEQR

SEQ ID NO: 1011137 - protein, 9 aa, Homo Sapiens
LYTTWTLFT

SEQ ID NO: 1011138 - protein, 9 aa, Homo Sapiens
GGLYTCIAA

SEQ ID NO: 1011139 - protein, 9 aa, Homo Sapiens
AIYSDSRLH

SEQ ID NO: 1011140 - protein, 9 aa, Homo Sapiens
VCEEEPFID

SEQ ID NO: 1011141 - protein, 9 aa, Homo Sapiens
NSSEQGTLK

SEQ ID NO: 1011142 - protein, 9 aa, Homo Sapiens
SYQLIHAAS

SEQ ID NO: 1011143 - protein, 9 aa, Homo Sapiens
AKGPLPCPS

SEQ ID NO: 1011144 - protein, 9 aa, Homo Sapiens
TKHKRIYTR

SEQ ID NO: 1011145 - protein, 9 aa, Homo Sapiens
AVAATSASL

SEQ ID NO: 1011146 - protein, 9 aa, Homo Sapiens
SHALHEVLE

SEQ ID NO: 1011147 - protein, 9 aa, Homo Sapiens
RVVTSPLFS

SEQ ID NO: 1011148 - protein, 9 aa, Homo Sapiens
TSTFYSLKD

SEQ ID NO: 1011149 - protein, 9 aa, Homo Sapiens
IFLANLPPS

SEQ ID NO: 1011150 - protein, 9 aa, Homo Sapiens
IANGFIMTI

SEQ ID NO: 1011151 - protein, 9 aa, Homo Sapiens
HFFSSLLYS

SEQ ID NO: 1011152 - protein, 9 aa, Homo Sapiens
TQGELVALL

SEQ ID NO: 1011153 - protein, 9 aa, Homo Sapiens
QEGFELFAV

SEQ ID NO: 1011154 - protein, 9 aa, Homo Sapiens
EIPHFFCNP

SEQ ID NO: 1011155 - protein, 9 aa, Homo Sapiens
GIRARTGRE

SEQ ID NO: 1011156 - protein, 9 aa, Homo Sapiens
YVRHFLWSL

SEQ ID NO: 1011157 - protein, 9 aa, Homo Sapiens
SQGEIIEGC

SEQ ID NO: 1011158 - protein, 9 aa, Homo Sapiens
DVMLKNYSH

SEQ ID NO: 1011159 - protein, 9 aa, Homo Sapiens
GEVNMPPEN

SEQ ID NO: 1011160 - protein, 9 aa, Homo Sapiens
PPVVSGENL

SEQ ID NO: 1011161 - protein, 9 aa, Homo Sapiens
MLGCWQRKP

SEQ ID NO: 1011162 - protein, 9 aa, Homo Sapiens
LQDKRINQF

SEQ ID NO: 1011163 - protein, 9 aa, Homo Sapiens
TSSSNLSDL

SEQ ID NO: 1011164 - protein, 9 aa, Homo Sapiens
EGAKEPRDS

SEQ ID NO: 1011165 - protein, 9 aa, Homo Sapiens
NDFAVHKTR

SEQ ID NO: 1011166 - protein, 9 aa, Homo Sapiens
NVLKIIRSA

SEQ ID NO: 1011167 - protein, 9 aa, Homo Sapiens
SLVTIPKML

SEQ ID NO: 1011168 - protein, 9 aa, Homo Sapiens
LHYWSCEKA

SEQ ID NO: 1011169 - protein, 9 aa, Homo Sapiens
KHRSEASNG

SEQ ID NO: 1011170 - protein, 9 aa, Homo Sapiens
YHSMPHEVE

SEQ ID NO: 1011171 - protein, 9 aa, Homo Sapiens
QRAIFFAGC

SEQ ID NO: 1011172 - protein, 9 aa, Homo Sapiens
LLLKEEHRA

SEQ ID NO: 1011173 - protein, 9 aa, Homo Sapiens
YLHAKEILH

SEQ ID NO: 1011174 - protein, 9 aa, Homo Sapiens
DNLGDDLLQ

SEQ ID NO: 1011175 - protein, 9 aa, Homo Sapiens
LSKSNQYPS

SEQ ID NO: 1011176 - protein, 9 aa, Homo Sapiens
YSFPIVNLK

SEQ ID NO: 1011177 - protein, 9 aa, Homo Sapiens
NEAGQICEL

SEQ ID NO: 1011178 - protein, 9 aa, Homo Sapiens
LAGLWIVYF

SEQ ID NO: 1011179 - protein, 9 aa, Homo Sapiens
YQATSLPSR

SEQ ID NO: 1011180 - protein, 9 aa, Homo Sapiens
KMLDHIARK

SEQ ID NO: 1011181 - protein, 9 aa, Homo Sapiens
YESSDCITL

SEQ ID NO: 1011182 - protein, 9 aa, Homo Sapiens
AGLPGFKDW

SEQ ID NO: 1011183 - protein, 9 aa, Homo Sapiens
SLRLVRDPL

SEQ ID NO: 1011184 - protein, 9 aa, Homo Sapiens
PLSLTTPLS

SEQ ID NO: 1011185 - protein, 9 aa, Homo Sapiens
LDKGQKKVP

SEQ ID NO: 1011186 - protein, 9 aa, Homo Sapiens
NQDFTVIKD

SEQ ID NO: 1011187 - protein, 9 aa, Homo Sapiens
GAHHEPGVL

SEQ ID NO: 1011188 - protein, 9 aa, Homo Sapiens
QNIFGARQN

SEQ ID NO: 1011189 - protein, 9 aa, Homo Sapiens
EDVTDMVEA

SEQ ID NO: 1011190 - protein, 9 aa, Homo Sapiens
WASYSLFTI

SEQ ID NO: 1011191 - protein, 9 aa, Homo Sapiens
SLWLQVGSL

SEQ ID NO: 1011192 - protein, 9 aa, Homo Sapiens
SLALTSLEH

SEQ ID NO: 1011193 - protein, 9 aa, Homo Sapiens
RPSTSTGVM

SEQ ID NO: 1011194 - protein, 9 aa, Homo Sapiens
GLNTTGSNL

SEQ ID NO: 1011195 - protein, 9 aa, Homo Sapiens
DLHPVYEEN

SEQ ID NO: 1011196 - protein, 9 aa, Homo Sapiens
NEIGNPVLS

SEQ ID NO: 1011197 - protein, 9 aa, Homo Sapiens
SPGTRPTAI

SEQ ID NO: 1011198 - protein, 9 aa, Homo Sapiens
QQVLFTRIL

SEQ ID NO: 1011199 - protein, 9 aa, Homo Sapiens
GERWTSFGC

SEQ ID NO: 1011200 - protein, 9 aa, Homo Sapiens
QPKVEGLLT

SEQ ID NO: 1011201 - protein, 9 aa, Homo Sapiens
DSKDTRHQR

SEQ ID NO: 1011202 - protein, 9 aa, Homo Sapiens
CTIVDGVFA

SEQ ID NO: 1011203 - protein, 9 aa, Homo Sapiens
RDKIDRLLQ

SEQ ID NO: 1011204 - protein, 9 aa, Homo Sapiens
QPERVYLYS

SEQ ID NO: 1011205 - protein, 9 aa, Homo Sapiens
KILPGTFNP

SEQ ID NO: 1011206 - protein, 9 aa, Homo Sapiens
FAVHKTRVQ

SEQ ID NO: 1011207 - protein, 9 aa, Homo Sapiens
QHKSRSSRD

SEQ ID NO: 1011208 - protein, 9 aa, Homo Sapiens
PNAFCIAKL

SEQ ID NO: 1011209 - protein, 9 aa, Homo Sapiens
SASPLHMLA

SEQ ID NO: 1011210 - protein, 9 aa, Homo Sapiens
DQPKVEGLL

SEQ ID NO: 1011211 - protein, 9 aa, Homo Sapiens
NRFADKPSD

SEQ ID NO: 1011212 - protein, 9 aa, Homo Sapiens
TLRRNSMKE

SEQ ID NO: 1011213 - protein, 9 aa, Homo Sapiens
NPGERGFQE

SEQ ID NO: 1011214 - protein, 9 aa, Homo Sapiens
LKEIGRKDS

SEQ ID NO: 1011215 - protein, 9 aa, Homo Sapiens
YGLVLLTTK

SEQ ID NO: 1011216 - protein, 9 aa, Homo Sapiens
KNKANFFFQ

SEQ ID NO: 1011217 - protein, 9 aa, Homo Sapiens
PSQQGVGGI

SEQ ID NO: 1011218 - protein, 9 aa, Homo Sapiens
ISGSSDGSS

SEQ ID NO: 1011219 - protein, 9 aa, Homo Sapiens
CEDGNSISS

SEQ ID NO: 1011220 - protein, 9 aa, Homo Sapiens
DHGEEFSGK

SEQ ID NO: 1011221 - protein, 9 aa, Homo Sapiens
SNFYLLVPP

SEQ ID NO: 1011222 - protein, 9 aa, Homo Sapiens
HSHCPRHCP

SEQ ID NO: 1011223 - protein, 9 aa, Homo Sapiens
FIWKNIHTL

SEQ ID NO: 1011224 - protein, 9 aa, Homo Sapiens
STFYSLKDY

SEQ ID NO: 1011225 - protein, 9 aa, Homo Sapiens
GRVICQPVG

SEQ ID NO: 1011226 - protein, 9 aa, Homo Sapiens
SHPQKLFYT

SEQ ID NO: 1011227 - protein, 9 aa, Homo Sapiens
FYGIVVGLG

SEQ ID NO: 1011228 - protein, 9 aa, Homo Sapiens
VKKIFQNHR

SEQ ID NO: 1011229 - protein, 9 aa, Homo Sapiens
KNDLEDFFI

SEQ ID NO: 1011230 - protein, 9 aa, Homo Sapiens
HDQGWAKIS

SEQ ID NO: 1011231 - protein, 9 aa, Homo Sapiens
EIVIILEGM

SEQ ID NO: 1011232 - protein, 9 aa, Homo Sapiens
YLINLCGID

SEQ ID NO: 1011233 - protein, 9 aa, Homo Sapiens
EIGRKDSGS

SEQ ID NO: 1011234 - protein, 9 aa, Homo Sapiens
SELGRLGDL

SEQ ID NO: 1011235 - protein, 9 aa, Homo Sapiens
HPYFYGDRI

SEQ ID NO: 1011236 - protein, 9 aa, Homo Sapiens
KEEKKKYYD

SEQ ID NO: 1011237 - protein, 9 aa, Homo Sapiens
KKKETMTCV

SEQ ID NO: 1011238 - protein, 9 aa, Homo Sapiens
IAPKGGEDE

SEQ ID NO: 1011239 - protein, 9 aa, Homo Sapiens
IKQMHPNGE

SEQ ID NO: 1011240 - protein, 9 aa, Homo Sapiens
SIFLYICMS

SEQ ID NO: 1011241 - protein, 9 aa, Homo Sapiens
TVCGDIYGQ

SEQ ID NO: 1011242 - protein, 9 aa, Homo Sapiens
SAVKKKFMA

SEQ ID NO: 1011243 - protein, 9 aa, Homo Sapiens
SSIPPSGPV

SEQ ID NO: 1011244 - protein, 9 aa, Homo Sapiens
VSYSESFSQ

SEQ ID NO: 1011245 - protein, 9 aa, Homo Sapiens
GGDFQEPSE

SEQ ID NO: 1011246 - protein, 9 aa, Homo Sapiens
LNRVRIEAA

SEQ ID NO: 1011247 - protein, 9 aa, Homo Sapiens
KSRSSRDKY

SEQ ID NO: 1011248 - protein, 9 aa, Homo Sapiens
SNPELLKQK

SEQ ID NO: 1011249 - protein, 9 aa, Homo Sapiens
DRYIAICNS

SEQ ID NO: 1011250 - protein, 9 aa, Homo Sapiens
SKRDRLILI

SEQ ID NO: 1011251 - protein, 9 aa, Homo Sapiens
GDGTTSSQI

SEQ ID NO: 1011252 - protein, 9 aa, Homo Sapiens
KLDFLDSFL

SEQ ID NO: 1011253 - protein, 9 aa, Homo Sapiens
QEVTDPVQI

SEQ ID NO: 1011254 - protein, 9 aa, Homo Sapiens
SNPDIAFLG

SEQ ID NO: 1011255 - protein, 9 aa, Homo Sapiens
LGILPAMDG

SEQ ID NO: 1011256 - protein, 9 aa, Homo Sapiens
SLSADMNGA

SEQ ID NO: 1011257 - protein, 9 aa, Homo Sapiens
KQRPYGSHR

SEQ ID NO: 1011258 - protein, 9 aa, Homo Sapiens
CNSNLQDSA

SEQ ID NO: 1011259 - protein, 9 aa, Homo Sapiens
CSFLVEESR

SEQ ID NO: 1011260 - protein, 9 aa, Homo Sapiens
HSKELQILG

SEQ ID NO: 1011261 - protein, 9 aa, Homo Sapiens
FLYICMSEA

SEQ ID NO: 1011262 - protein, 9 aa, Homo Sapiens
AKDKENPPL

SEQ ID NO: 1011263 - protein, 9 aa, Homo Sapiens
YYELIRKLV

SEQ ID NO: 1011264 - protein, 9 aa, Homo Sapiens
THILNMARK

SEQ ID NO: 1011265 - protein, 9 aa, Homo Sapiens
CGIDFPIKT

SEQ ID NO: 1011266 - protein, 9 aa, Homo Sapiens
QPRGKDSRL

SEQ ID NO: 1011267 - protein, 9 aa, Homo Sapiens
NEHLQLFGL

SEQ ID NO: 1011268 - protein, 9 aa, Homo Sapiens
AICNSLRYP

SEQ ID NO: 1011269 - protein, 9 aa, Homo Sapiens
RRTAYLVLD

SEQ ID NO: 1011270 - protein, 9 aa, Homo Sapiens
KKVPAGAKV

SEQ ID NO: 1011271 - protein, 9 aa, Homo Sapiens
ETFHCLSPK

SEQ ID NO: 1011272 - protein, 9 aa, Homo Sapiens
PGSITTSFF

SEQ ID NO: 1011273 - protein, 9 aa, Homo Sapiens
SFAMRNVCP

SEQ ID NO: 1011274 - protein, 9 aa, Homo Sapiens
NPQEQFSKN

SEQ ID NO: 1011275 - protein, 9 aa, Homo Sapiens
GLRNPVAIV

SEQ ID NO: 1011276 - protein, 9 aa, Homo Sapiens
GDGPPGSRP

SEQ ID NO: 1011277 - protein, 9 aa, Homo Sapiens
IAEGSSPTS

SEQ ID NO: 1011278 - protein, 9 aa, Homo Sapiens
QLGSFPTFQ

SEQ ID NO: 1011279 - protein, 9 aa, Homo Sapiens
GIGVFILLV

SEQ ID NO: 1011280 - protein, 9 aa, Homo Sapiens
SYYHAVETV

SEQ ID NO: 1011281 - protein, 9 aa, Homo Sapiens
SCPERLQLN

SEQ ID NO: 1011282 - protein, 9 aa, Homo Sapiens
DSAPGDSDL

SEQ ID NO: 1011283 - protein, 9 aa, Homo Sapiens
SILVLNGGQ

SEQ ID NO: 1011284 - protein, 9 aa, Homo Sapiens
NGGSMHHLF

SEQ ID NO: 1011285 - protein, 9 aa, Homo Sapiens
RNRGDDVFK

SEQ ID NO: 1011286 - protein, 9 aa, Homo Sapiens
GGYASSDGY

SEQ ID NO: 1011287 - protein, 9 aa, Homo Sapiens
ALRLLDYEA

SEQ ID NO: 1011288 - protein, 9 aa, Homo Sapiens
MLCRKNAVV

SEQ ID NO: 1011289 - protein, 9 aa, Homo Sapiens
SNLQDSAQN

SEQ ID NO: 1011290 - protein, 9 aa, Homo Sapiens
EQPPSPAFT

SEQ ID NO: 1011291 - protein, 9 aa, Homo Sapiens
YSYRGKMNK

SEQ ID NO: 1011292 - protein, 9 aa, Homo Sapiens
VGVLFFFFF

SEQ ID NO: 1011293 - protein, 9 aa, Homo Sapiens
TDKNISLHN

SEQ ID NO: 1011294 - protein, 9 aa, Homo Sapiens
ITGNKIVNE

SEQ ID NO: 1011295 - protein, 9 aa, Homo Sapiens
GLLSMIDLP

SEQ ID NO: 1011296 - protein, 9 aa, Homo Sapiens
AVHKTRVQN

SEQ ID NO: 1011297 - protein, 9 aa, Homo Sapiens
MLQASVSTK

SEQ ID NO: 1011298 - protein, 9 aa, Homo Sapiens
FLGVTQFLP

SEQ ID NO: 1011299 - protein, 9 aa, Homo Sapiens
KQIEVVKKM

SEQ ID NO: 1011300 - protein, 9 aa, Homo Sapiens
IISDINPYG

SEQ ID NO: 1011301 - protein, 9 aa, Homo Sapiens
KPGTEEKSL

SEQ ID NO: 1011302 - protein, 9 aa, Homo Sapiens
TLQPRGKDS

SEQ ID NO: 1011303 - protein, 9 aa, Homo Sapiens
TGAVLFLSH

SEQ ID NO: 1011304 - protein, 9 aa, Homo Sapiens
HRTCNPGAS

SEQ ID NO: 1011305 - protein, 9 aa, Homo Sapiens
GEDSLSSLQ

SEQ ID NO: 1011306 - protein, 9 aa, Homo Sapiens
LSRSNPSLV

SEQ ID NO: 1011307 - protein, 9 aa, Homo Sapiens
TPKASPPDL

SEQ ID NO: 1011308 - protein, 9 aa, Homo Sapiens
RGHVSHALH

SEQ ID NO: 1011309 - protein, 9 aa, Homo Sapiens
PTAGRNLLL

SEQ ID NO: 1011310 - protein, 9 aa, Homo Sapiens
IARKVGLKK

SEQ ID NO: 1011311 - protein, 9 aa, Homo Sapiens
EESGLCWVQ

SEQ ID NO: 1011312 - protein, 9 aa, Homo Sapiens
PCLGGMASS

SEQ ID NO: 1011313 - protein, 9 aa, Homo Sapiens
IIANGFIMT

SEQ ID NO: 1011314 - protein, 9 aa, Homo Sapiens
TIFSASMGL

SEQ ID NO: 1011315 - protein, 9 aa, Homo Sapiens
QETQLASFP

SEQ ID NO: 1011316 - protein, 9 aa, Homo Sapiens
YALIKEIIL

SEQ ID NO: 1011317 - protein, 9 aa, Homo Sapiens
PLSVDILDP

SEQ ID NO: 1011318 - protein, 9 aa, Homo Sapiens
LDLHRTSEK

SEQ ID NO: 1011319 - protein, 9 aa, Homo Sapiens
LLITAILAM

SEQ ID NO: 1011320 - protein, 9 aa, Homo Sapiens
LHGIVFARM

SEQ ID NO: 1011321 - protein, 9 aa, Homo Sapiens
LSENMLGHF

SEQ ID NO: 1011322 - protein, 9 aa, Homo Sapiens
PSHCRKIFP

SEQ ID NO: 1011323 - protein, 9 aa, Homo Sapiens
LVELGYRRT

SEQ ID NO: 1011324 - protein, 9 aa, Homo Sapiens
ELVALLHPR

SEQ ID NO: 1011325 - protein, 9 aa, Homo Sapiens
RTEIGVFLR

SEQ ID NO: 1011326 - protein, 9 aa, Homo Sapiens
PEESLKELR

SEQ ID NO: 1011327 - protein, 9 aa, Homo Sapiens
QKQAVSELW

SEQ ID NO: 1011328 - protein, 9 aa, Homo Sapiens
AEALPSDKE

SEQ ID NO: 1011329 - protein, 9 aa, Homo Sapiens
SNVYKKRVS

SEQ ID NO: 1011330 - protein, 9 aa, Homo Sapiens
EVSSASSSP

SEQ ID NO: 1011331 - protein, 9 aa, Homo Sapiens
VLDDDYFEN

SEQ ID NO: 1011332 - protein, 9 aa, Homo Sapiens
RVNSSEQGT

SEQ ID NO: 1011333 - protein, 9 aa, Homo Sapiens
RTVRCTCIG

SEQ ID NO: 1011334 - protein, 9 aa, Homo Sapiens
HLDSQPAVR

SEQ ID NO: 1011335 - protein, 9 aa, Homo Sapiens
SSVCSCSNQ

SEQ ID NO: 1011336 - protein, 9 aa, Homo Sapiens
PARGDSEDK

SEQ ID NO: 1011337 - protein, 9 aa, Homo Sapiens
VNCRMQHIT

SEQ ID NO: 1011338 - protein, 9 aa, Homo Sapiens
TPPPPAIIP

SEQ ID NO: 1011339 - protein, 9 aa, Homo Sapiens
NSDLTLYLV

SEQ ID NO: 1011340 - protein, 9 aa, Homo Sapiens
VLLDNVDAN

SEQ ID NO: 1011341 - protein, 9 aa, Homo Sapiens
PHELPLTDR

SEQ ID NO: 1011342 - protein, 9 aa, Homo Sapiens
PVCSRLENE

SEQ ID NO: 1011343 - protein, 9 aa, Homo Sapiens
VISGLVTSA

SEQ ID NO: 1011344 - protein, 9 aa, Homo Sapiens
PSTSTGVML

SEQ ID NO: 1011345 - protein, 9 aa, Homo Sapiens
TPEAMPTHK

SEQ ID NO: 1011346 - protein, 9 aa, Homo Sapiens
KEPRHKGQS

SEQ ID NO: 1011347 - protein, 9 aa, Homo Sapiens
NSAILMAMA

SEQ ID NO: 1011348 - protein, 9 aa, Homo Sapiens
RKREPGEGA

SEQ ID NO: 1011349 - protein, 9 aa, Homo Sapiens
CYTHAVAGV

SEQ ID NO: 1011350 - protein, 9 aa, Homo Sapiens
PIRSPVVPE

SEQ ID NO: 1011351 - protein, 9 aa, Homo Sapiens
VAPLGPTVV

SEQ ID NO: 1011352 - protein, 9 aa, Homo Sapiens
GKFSEDFES

SEQ ID NO: 1011353 - protein, 9 aa, Homo Sapiens
SDLVGALRA

SEQ ID NO: 1011354 - protein, 9 aa, Homo Sapiens
MIVTGRLAW

SEQ ID NO: 1011355 - protein, 9 aa, Homo Sapiens
NDDDVSTEY

SEQ ID NO: 1011356 - protein, 9 aa, Homo Sapiens
SIRVLLDLT

SEQ ID NO: 1011357 - protein, 9 aa, Homo Sapiens
FSYREDLIV

SEQ ID NO: 1011358 - protein, 9 aa, Homo Sapiens
ALAGVGAAA

SEQ ID NO: 1011359 - protein, 9 aa, Homo Sapiens
SLIQVFVKN

SEQ ID NO: 1011360 - protein, 9 aa, Homo Sapiens
LRVDENRNA

SEQ ID NO: 1011361 - protein, 9 aa, Homo Sapiens
QRVVTSPLF

SEQ ID NO: 1011362 - protein, 9 aa, Homo Sapiens
TQQSFHLLV

SEQ ID NO: 1011363 - protein, 9 aa, Homo Sapiens
ALAGVGAAS

SEQ ID NO: 1011364 - protein, 9 aa, Homo Sapiens
ILRYLKNNG

SEQ ID NO: 1011365 - protein, 9 aa, Homo Sapiens
VHITVLDKN

SEQ ID NO: 1011366 - protein, 9 aa, Homo Sapiens
QGPAGQDGA

SEQ ID NO: 1011367 - protein, 9 aa, Homo Sapiens
YTVPSTARI

SEQ ID NO: 1011368 - protein, 9 aa, Homo Sapiens
APHFFSSLL

SEQ ID NO: 1011369 - protein, 9 aa, Homo Sapiens
QPSTEQACL

SEQ ID NO: 1011370 - protein, 9 aa, Homo Sapiens
GWAHACNFS

SEQ ID NO: 1011371 - protein, 9 aa, Homo Sapiens
VGVIVLTGG

SEQ ID NO: 1011372 - protein, 9 aa, Homo Sapiens
PPARPPKPG

SEQ ID NO: 1011373 - protein, 9 aa, Homo Sapiens
RIFLAGCGA

SEQ ID NO: 1011374 - protein, 9 aa, Homo Sapiens
QSSGYTQHE

SEQ ID NO: 1011375 - protein, 9 aa, Homo Sapiens
TSTSQLSLV

SEQ ID NO: 1011376 - protein, 9 aa, Homo Sapiens
YKKRVSAAR

SEQ ID NO: 1011377 - protein, 9 aa, Homo Sapiens
VNFLDKTAI

SEQ ID NO: 1011378 - protein, 9 aa, Homo Sapiens
VRHFLWSLR

SEQ ID NO: 1011379 - protein, 9 aa, Homo Sapiens
QAGCLQEED

SEQ ID NO: 1011380 - protein, 9 aa, Homo Sapiens
ICQPVGRIF

SEQ ID NO: 1011381 - protein, 9 aa, Homo Sapiens
VLRNFFDSL

SEQ ID NO: 1011382 - protein, 9 aa, Homo Sapiens
EIGNPVLSL

SEQ ID NO: 1011383 - protein, 9 aa, Homo Sapiens
MFVWFVSDA

SEQ ID NO: 1011384 - protein, 9 aa, Homo Sapiens
SFKTHEITQ

SEQ ID NO: 1011385 - protein, 9 aa, Homo Sapiens
PSKLFIIEV

SEQ ID NO: 1011386 - protein, 9 aa, Homo Sapiens
LRAVRSLLR

SEQ ID NO: 1011387 - protein, 9 aa, Homo Sapiens
QRAQLEQSL

SEQ ID NO: 1011388 - protein, 9 aa, Homo Sapiens
TRTGGLRDP

SEQ ID NO: 1011389 - protein, 9 aa, Homo Sapiens
RTGGLRDPG

SEQ ID NO: 1011390 - protein, 9 aa, Homo Sapiens
SGSSDGSSS

SEQ ID NO: 1011391 - protein, 9 aa, Homo Sapiens
GGDVQVGPL

SEQ ID NO: 1011392 - protein, 9 aa, Homo Sapiens
IDKINKDDY

SEQ ID NO: 1011393 - protein, 9 aa, Homo Sapiens
MCFISSWNK

SEQ ID NO: 1011394 - protein, 9 aa, Homo Sapiens
SERAVQFWA

SEQ ID NO: 1011395 - protein, 9 aa, Homo Sapiens
NIYFLFFFY

SEQ ID NO: 1011396 - protein, 9 aa, Homo Sapiens
TLGTIGVNC

SEQ ID NO: 1011397 - protein, 9 aa, Homo Sapiens
GSRKIESMD

SEQ ID NO: 1011398 - protein, 9 aa, Homo Sapiens
DNKYVSYSE

SEQ ID NO: 1011399 - protein, 9 aa, Homo Sapiens
ETDLQDFEM

SEQ ID NO: 1011400 - protein, 9 aa, Homo Sapiens
SDWCTQIFL

SEQ ID NO: 1011401 - protein, 9 aa, Homo Sapiens
FLLWKMFSP

SEQ ID NO: 1011402 - protein, 9 aa, Homo Sapiens
WIYFATLII

SEQ ID NO: 1011403 - protein, 9 aa, Homo Sapiens
PIEDMISTL

SEQ ID NO: 1011404 - protein, 9 aa, Homo Sapiens
QFSEPMPVV

SEQ ID NO: 1011405 - protein, 9 aa, Homo Sapiens
LFLAGETES

SEQ ID NO: 1011406 - protein, 9 aa, Homo Sapiens
RDYRGKNAV

SEQ ID NO: 1011407 - protein, 9 aa, Homo Sapiens
CFVAICYPL

SEQ ID NO: 1011408 - protein, 9 aa, Homo Sapiens
DYLGILPAM

SEQ ID NO: 1011409 - protein, 9 aa, Homo Sapiens
LRSHSAQLK

SEQ ID NO: 1011410 - protein, 9 aa, Homo Sapiens
LLALTAFLN

SEQ ID NO: 1011411 - protein, 9 aa, Homo Sapiens
KNQVAINPT

SEQ ID NO: 1011412 - protein, 9 aa, Homo Sapiens
NIGDVYGVM

SEQ ID NO: 1011413 - protein, 9 aa, Homo Sapiens
SDAVPSKVR

SEQ ID NO: 1011414 - protein, 9 aa, Homo Sapiens
HGFPSKLFI

SEQ ID NO: 1011415 - protein, 9 aa, Homo Sapiens
AVIIFYSTL

SEQ ID NO: 1011416 - protein, 9 aa, Homo Sapiens
IGVNCSQAP

SEQ ID NO: 1011417 - protein, 9 aa, Homo Sapiens
DNLRDIKNE

SEQ ID NO: 1011418 - protein, 9 aa, Homo Sapiens
SNSSSEEVF

SEQ ID NO: 1011419 - protein, 9 aa, Homo Sapiens
LHSRDYKNS

SEQ ID NO: 1011420 - protein, 9 aa, Homo Sapiens
ENDFSEGVN

SEQ ID NO: 1011421 - protein, 9 aa, Homo Sapiens
YGICLEACQ

SEQ ID NO: 1011422 - protein, 9 aa, Homo Sapiens
EKITCQNFI

SEQ ID NO: 1011423 - protein, 9 aa, Homo Sapiens
VCDESCKTC

SEQ ID NO: 1011424 - protein, 9 aa, Homo Sapiens
AGPEELAWG

SEQ ID NO: 1011425 - protein, 9 aa, Homo Sapiens
EDMISTLKA

SEQ ID NO: 1011426 - protein, 9 aa, Homo Sapiens
SSNLSDLKE

SEQ ID NO: 1011427 - protein, 9 aa, Homo Sapiens
RDGGFPLLS

SEQ ID NO: 1011428 - protein, 9 aa, Homo Sapiens
SIEQILNNF

SEQ ID NO: 1011429 - protein, 9 aa, Homo Sapiens
DFDFFPMSD

SEQ ID NO: 1011430 - protein, 9 aa, Homo Sapiens
FPIVNLKGQ

SEQ ID NO: 1011431 - protein, 9 aa, Homo Sapiens
EEDPLMNML

SEQ ID NO: 1011432 - protein, 9 aa, Homo Sapiens
GSREKTGSL

SEQ ID NO: 1011433 - protein, 9 aa, Homo Sapiens
KKRSEISCY

SEQ ID NO: 1011434 - protein, 9 aa, Homo Sapiens
VNLHLPRFK

SEQ ID NO: 1011435 - protein, 9 aa, Homo Sapiens
SERSTSSIN

SEQ ID NO: 1011436 - protein, 9 aa, Homo Sapiens
FSANPKKLK

SEQ ID NO: 1011437 - protein, 9 aa, Homo Sapiens
GCTQPRRVV

SEQ ID NO: 1011438 - protein, 9 aa, Homo Sapiens
SNLSYCAPF

SEQ ID NO: 1011439 - protein, 9 aa, Homo Sapiens
LAELYFLLQ

SEQ ID NO: 1011440 - protein, 9 aa, Homo Sapiens
EEKKVPAGA

SEQ ID NO: 1011441 - protein, 9 aa, Homo Sapiens
AFSPVCDES

SEQ ID NO: 1011442 - protein, 9 aa, Homo Sapiens
LHEVLEGLS

SEQ ID NO: 1011443 - protein, 9 aa, Homo Sapiens
LFPYPENNG

SEQ ID NO: 1011444 - protein, 9 aa, Homo Sapiens
ILPAMDGFV

SEQ ID NO: 1011445 - protein, 9 aa, Homo Sapiens
TSGELSDVF

SEQ ID NO: 1011446 - protein, 9 aa, Homo Sapiens
DLSVRPNAA

SEQ ID NO: 1011447 - protein, 9 aa, Homo Sapiens
LPYAINLRE

SEQ ID NO: 1011448 - protein, 9 aa, Homo Sapiens
YYGLLGNRL

SEQ ID NO: 1011449 - protein, 9 aa, Homo Sapiens
LARLRSHSA

SEQ ID NO: 1011450 - protein, 9 aa, Homo Sapiens
EIKFSPDGS

SEQ ID NO: 1011451 - protein, 9 aa, Homo Sapiens
LEVADHAFS

SEQ ID NO: 1011452 - protein, 9 aa, Homo Sapiens
DIPLSVDIL

SEQ ID NO: 1011453 - protein, 9 aa, Homo Sapiens
KFVTKGQTV

SEQ ID NO: 1011454 - protein, 9 aa, Homo Sapiens
DPENPPATT

SEQ ID NO: 1011455 - protein, 9 aa, Homo Sapiens
KHENQQQGE

SEQ ID NO: 1011456 - protein, 9 aa, Homo Sapiens
VLAAIALDR

SEQ ID NO: 1011457 - protein, 9 aa, Homo Sapiens
LLQTAKIMT

SEQ ID NO: 1011458 - protein, 9 aa, Homo Sapiens
PCISGKFYT

SEQ ID NO: 1011459 - protein, 9 aa, Homo Sapiens
PKSLQGLSD

SEQ ID NO: 1011460 - protein, 9 aa, Homo Sapiens
SLQGLSDTG

SEQ ID NO: 1011461 - protein, 9 aa, Homo Sapiens
CASTNEFLL

SEQ ID NO: 1011462 - protein, 9 aa, Homo Sapiens
WAIQRRLLA

SEQ ID NO: 1011463 - protein, 9 aa, Homo Sapiens
SEGLQGAED

SEQ ID NO: 1011464 - protein, 9 aa, Homo Sapiens
RPRPPRSSS

SEQ ID NO: 1011465 - protein, 9 aa, Homo Sapiens
ENPPATTFL

SEQ ID NO: 1011466 - protein, 9 aa, Homo Sapiens
GFLAEKEGL

SEQ ID NO: 1011467 - protein, 9 aa, Homo Sapiens
TRDTAWAVP

SEQ ID NO: 1011468 - protein, 9 aa, Homo Sapiens
RFLVREDFV

SEQ ID NO: 1011469 - protein, 9 aa, Homo Sapiens
HIYSTDWVR

SEQ ID NO: 1011470 - protein, 9 aa, Homo Sapiens
DETFVDMKP

SEQ ID NO: 1011471 - protein, 9 aa, Homo Sapiens
KTDSKDGAS

SEQ ID NO: 1011472 - protein, 9 aa, Homo Sapiens
VKVDTSPRE

SEQ ID NO: 1011473 - protein, 9 aa, Homo Sapiens
WCFPADYGD

SEQ ID NO: 1011474 - protein, 9 aa, Homo Sapiens
ELAWGDEED

SEQ ID NO: 1011475 - protein, 9 aa, Homo Sapiens
IDEYNFFLR

SEQ ID NO: 1011476 - protein, 9 aa, Homo Sapiens
QAGHASRGH

SEQ ID NO: 1011477 - protein, 9 aa, Homo Sapiens
CVNKNKNSS

SEQ ID NO: 1011478 - protein, 9 aa, Homo Sapiens
ISEGGLVAT

SEQ ID NO: 1011479 - protein, 9 aa, Homo Sapiens
VSTKRLEKY

SEQ ID NO: 1011480 - protein, 9 aa, Homo Sapiens
GMMILLEVR

SEQ ID NO: 1011481 - protein, 9 aa, Homo Sapiens
RTWCFPADY

SEQ ID NO: 1011482 - protein, 9 aa, Homo Sapiens
KANFFFQSL

SEQ ID NO: 1011483 - protein, 9 aa, Homo Sapiens
VASNNVREI

SEQ ID NO: 1011484 - protein, 9 aa, Homo Sapiens
QSLLDEKQE

SEQ ID NO: 1011485 - protein, 9 aa, Homo Sapiens
GGFPLLSST

SEQ ID NO: 1011486 - protein, 9 aa, Homo Sapiens
SVLSFDLCS

SEQ ID NO: 1011487 - protein, 9 aa, Homo Sapiens
VTALLTLCL

SEQ ID NO: 1011488 - protein, 9 aa, Homo Sapiens
SHSAQLKHK

SEQ ID NO: 1011489 - protein, 9 aa, Homo Sapiens
ENLREKLTC

SEQ ID NO: 1011490 - protein, 9 aa, Homo Sapiens
DSSFRNKID

SEQ ID NO: 1011491 - protein, 9 aa, Homo Sapiens
VHSSIPPSG

SEQ ID NO: 1011492 - protein, 9 aa, Homo Sapiens
ARLNCSRPS

SEQ ID NO: 1011493 - protein, 9 aa, Homo Sapiens
VALLHQKYK

SEQ ID NO: 1011494 - protein, 9 aa, Homo Sapiens
TGAHHEPGV

SEQ ID NO: 1011495 - protein, 9 aa, Homo Sapiens
PGRTCTDTC

SEQ ID NO: 1011496 - protein, 9 aa, Homo Sapiens
YLSSREQER

SEQ ID NO: 1011497 - protein, 9 aa, Homo Sapiens
DGTTSSQIR

SEQ ID NO: 1011498 - protein, 9 aa, Homo Sapiens
VEPGFLAEK

SEQ ID NO: 1011499 - protein, 9 aa, Homo Sapiens
VPGRTCTDT

SEQ ID NO: 1011500 - protein, 9 aa, Homo Sapiens
IALVNFMRI

SEQ ID NO: 1011501 - protein, 9 aa, Homo Sapiens
RSHEEDDNN

SEQ ID NO: 1011502 - protein, 9 aa, Homo Sapiens
MKSRWSGSH

SEQ ID NO: 1011503 - protein, 9 aa, Homo Sapiens
EEAQIEDEA

SEQ ID NO: 1011504 - protein, 9 aa, Homo Sapiens
NVSYIKQPA

SEQ ID NO: 1011505 - protein, 9 aa, Homo Sapiens
SFPIVNLKG

SEQ ID NO: 1011506 - protein, 9 aa, Homo Sapiens
LKKERPPKP

SEQ ID NO: 1011507 - protein, 9 aa, Homo Sapiens
DCYVAICYP

SEQ ID NO: 1011508 - protein, 9 aa, Homo Sapiens
PHFLLWKMF

SEQ ID NO: 1011509 - protein, 9 aa, Homo Sapiens
FAKLNTFCV

SEQ ID NO: 1011510 - protein, 9 aa, Homo Sapiens
DNATFLSAK

SEQ ID NO: 1011511 - protein, 9 aa, Homo Sapiens
ESPKAMLPL

SEQ ID NO: 1011512 - protein, 9 aa, Homo Sapiens
PLLSSTTTI

SEQ ID NO: 1011513 - protein, 9 aa, Homo Sapiens
NRYLAISYP

SEQ ID NO: 1011514 - protein, 9 aa, Homo Sapiens
FFCKAGGTL

SEQ ID NO: 1011515 - protein, 9 aa, Homo Sapiens
FAVPVLPAA

SEQ ID NO: 1011516 - protein, 9 aa, Homo Sapiens
VLETYGAQP

SEQ ID NO: 1011517 - protein, 9 aa, Homo Sapiens
LGLASFKTH

SEQ ID NO: 1011518 - protein, 9 aa, Homo Sapiens
CQEGGGHNL

SEQ ID NO: 1011519 - protein, 9 aa, Homo Sapiens
PEASGFSRD

SEQ ID NO: 1011520 - protein, 9 aa, Homo Sapiens
AKFSLACVD

SEQ ID NO: 1011521 - protein, 9 aa, Homo Sapiens
KSIEERKKQ

SEQ ID NO: 1011522 - protein, 9 aa, Homo Sapiens
FLPTHARKA

SEQ ID NO: 1011523 - protein, 9 aa, Homo Sapiens
LKKNVKVSY

SEQ ID NO: 1011524 - protein, 9 aa, Homo Sapiens
TTTVEHALI

SEQ ID NO: 1011525 - protein, 9 aa, Homo Sapiens
ETVPTSGKM

SEQ ID NO: 1011526 - protein, 9 aa, Homo Sapiens
IVHARDGTH

SEQ ID NO: 1011527 - protein, 9 aa, Homo Sapiens
AAKNQVAIN

SEQ ID NO: 1011528 - protein, 9 aa, Homo Sapiens
TLPVPPEGL

SEQ ID NO: 1011529 - protein, 9 aa, Homo Sapiens
CHYSRDVQD

SEQ ID NO: 1011530 - protein, 9 aa, Homo Sapiens
YRIERCPNT

SEQ ID NO: 1011531 - protein, 9 aa, Homo Sapiens
TASLQFDGA

SEQ ID NO: 1011532 - protein, 9 aa, Homo Sapiens
LKLDFLDSF

SEQ ID NO: 1011533 - protein, 9 aa, Homo Sapiens
TAWAVPPGS

SEQ ID NO: 1011534 - protein, 9 aa, Homo Sapiens
LYVFHLFGE

SEQ ID NO: 1011535 - protein, 9 aa, Homo Sapiens
DELFPVMSL

SEQ ID NO: 1011536 - protein, 9 aa, Homo Sapiens
PGYTVPSTA

SEQ ID NO: 1011537 - protein, 9 aa, Homo Sapiens
ASNLSYCAP

SEQ ID NO: 1011538 - protein, 9 aa, Homo Sapiens
RAGVREDVF

SEQ ID NO: 1011539 - protein, 9 aa, Homo Sapiens
FSGKGSFPV

SEQ ID NO: 1011540 - protein, 9 aa, Homo Sapiens
LIRLGKHWY

SEQ ID NO: 1011541 - protein, 9 aa, Homo Sapiens
STNSAPGIL

SEQ ID NO: 1011542 - protein, 9 aa, Homo Sapiens
TGTLSKDNL

SEQ ID NO: 1011543 - protein, 9 aa, Homo Sapiens
MTSGKTSLV

SEQ ID NO: 1011544 - protein, 9 aa, Homo Sapiens
SKKVESSQA

SEQ ID NO: 1011545 - protein, 9 aa, Homo Sapiens
NTDTALTAL

SEQ ID NO: 1011546 - protein, 9 aa, Homo Sapiens
DEDKCASSP

SEQ ID NO: 1011547 - protein, 9 aa, Homo Sapiens
PSPRGGAVP

SEQ ID NO: 1011548 - protein, 9 aa, Homo Sapiens
TTCEAKEGK

SEQ ID NO: 1011549 - protein, 9 aa, Homo Sapiens
LLSGNTLRV

SEQ ID NO: 1011550 - protein, 9 aa, Homo Sapiens
PVMKRKIIK

SEQ ID NO: 1011551 - protein, 9 aa, Homo Sapiens
VPPLVMLLP

SEQ ID NO: 1011552 - protein, 9 aa, Homo Sapiens
RGGKDRKLF

SEQ ID NO: 1011553 - protein, 9 aa, Homo Sapiens
EKLTCFICL

SEQ ID NO: 1011554 - protein, 9 aa, Homo Sapiens
CNSLRYPTI

SEQ ID NO: 1011555 - protein, 9 aa, Homo Sapiens
RVRIEAAQF

SEQ ID NO: 1011556 - protein, 9 aa, Homo Sapiens
QEQFSKNNA

SEQ ID NO: 1011557 - protein, 9 aa, Homo Sapiens
DHICFISEL

SEQ ID NO: 1011558 - protein, 9 aa, Homo Sapiens
FFVGEAARA

SEQ ID NO: 1011559 - protein, 9 aa, Homo Sapiens
KHKGRVLRN

SEQ ID NO: 1011560 - protein, 9 aa, Homo Sapiens
NIFMVLLIY

SEQ ID NO: 1011561 - protein, 9 aa, Homo Sapiens
YLIQHKRIY

SEQ ID NO: 1011562 - protein, 9 aa, Homo Sapiens
LLSIVLHNM

SEQ ID NO: 1011563 - protein, 9 aa, Homo Sapiens
PSENSQDQG

SEQ ID NO: 1011564 - protein, 9 aa, Homo Sapiens
PRPPRNVRA

SEQ ID NO: 1011565 - protein, 9 aa, Homo Sapiens
KNFLGEEKF

SEQ ID NO: 1011566 - protein, 9 aa, Homo Sapiens
ALPSDKEGE

SEQ ID NO: 1011567 - protein, 9 aa, Homo Sapiens
LVVPVHVQT

SEQ ID NO: 1011568 - protein, 9 aa, Homo Sapiens
CLTEGSESN

SEQ ID NO: 1011569 - protein, 9 aa, Homo Sapiens
PADLESPIL

SEQ ID NO: 1011570 - protein, 9 aa, Homo Sapiens
KELLKRTLR

SEQ ID NO: 1011571 - protein, 9 aa, Homo Sapiens
RVLGHTLCA

SEQ ID NO: 1011572 - protein, 9 aa, Homo Sapiens
FREERAKAL

SEQ ID NO: 1011573 - protein, 9 aa, Homo Sapiens
IFLRLFYED

SEQ ID NO: 1011574 - protein, 9 aa, Homo Sapiens
KPRIVSYYR

SEQ ID NO: 1011575 - protein, 9 aa, Homo Sapiens
NGKLFSWAQ

SEQ ID NO: 1011576 - protein, 9 aa, Homo Sapiens
KHGDQKICA

SEQ ID NO: 1011577 - protein, 9 aa, Homo Sapiens
SFDLCSMAD

SEQ ID NO: 1011578 - protein, 9 aa, Homo Sapiens
PKEEWVEQD

SEQ ID NO: 1011579 - protein, 9 aa, Homo Sapiens
LEDFFIKMF

SEQ ID NO: 1011580 - protein, 9 aa, Homo Sapiens
VKQSPQSLH

SEQ ID NO: 1011581 - protein, 9 aa, Homo Sapiens
VRAAAGALA

SEQ ID NO: 1011582 - protein, 9 aa, Homo Sapiens
GSAGLKKER

SEQ ID NO: 1011583 - protein, 9 aa, Homo Sapiens
NGLQSCQIC

SEQ ID NO: 1011584 - protein, 9 aa, Homo Sapiens
QELNSTYSE

SEQ ID NO: 1011585 - protein, 9 aa, Homo Sapiens
ERAVQFWAI

SEQ ID NO: 1011586 - protein, 9 aa, Homo Sapiens
ELEKKYAAS

SEQ ID NO: 1011587 - protein, 9 aa, Homo Sapiens
VEIAQREGT

SEQ ID NO: 1011588 - protein, 9 aa, Homo Sapiens
LFPESLSCT

SEQ ID NO: 1011589 - protein, 9 aa, Homo Sapiens
LLLALTAFL

SEQ ID NO: 1011590 - protein, 9 aa, Homo Sapiens
GSEFVYVVD

SEQ ID NO: 1011591 - protein, 9 aa, Homo Sapiens
LKFQEEFLE

SEQ ID NO: 1011592 - protein, 9 aa, Homo Sapiens
VSSITASLQ

SEQ ID NO: 1011593 - protein, 9 aa, Homo Sapiens
HVPISPSEP

SEQ ID NO: 1011594 - protein, 9 aa, Homo Sapiens
SITASLQFD

SEQ ID NO: 1011595 - protein, 9 aa, Homo Sapiens
FLAGCGAQL

SEQ ID NO: 1011596 - protein, 9 aa, Homo Sapiens
GTNPYKPKC

SEQ ID NO: 1011597 - protein, 9 aa, Homo Sapiens
EMPGLKGLK

SEQ ID NO: 1011598 - protein, 9 aa, Homo Sapiens
CSWGCRRNP

SEQ ID NO: 1011599 - protein, 9 aa, Homo Sapiens
PLPPRFKQF

SEQ ID NO: 1011600 - protein, 9 aa, Homo Sapiens
TIKQFENDL

SEQ ID NO: 1011601 - protein, 9 aa, Homo Sapiens
LRGQPVGGL

SEQ ID NO: 1011602 - protein, 9 aa, Homo Sapiens
KNNGKVHLV

SEQ ID NO: 1011603 - protein, 9 aa, Homo Sapiens
LVRAQTCSS

SEQ ID NO: 1011604 - protein, 9 aa, Homo Sapiens
KIYNIENRT

SEQ ID NO: 1011605 - protein, 9 aa, Homo Sapiens
HGDQKICAQ

SEQ ID NO: 1011606 - protein, 9 aa, Homo Sapiens
DQLYRTKKD

SEQ ID NO: 1011607 - protein, 9 aa, Homo Sapiens
MTHGFYRVR

SEQ ID NO: 1011608 - protein, 9 aa, Homo Sapiens
AQLSKLHCD

SEQ ID NO: 1011609 - protein, 9 aa, Homo Sapiens
RKRKHRSEA

SEQ ID NO: 1011610 - protein, 9 aa, Homo Sapiens
AFLQEPHSG

SEQ ID NO: 1011611 - protein, 9 aa, Homo Sapiens
TFQFQYVMQ

SEQ ID NO: 1011612 - protein, 9 aa, Homo Sapiens
MRISGSSDG

SEQ ID NO: 1011613 - protein, 9 aa, Homo Sapiens
LSPGHAVCC

SEQ ID NO: 1011614 - protein, 9 aa, Homo Sapiens
VDLHPVYEE

SEQ ID NO: 1011615 - protein, 9 aa, Homo Sapiens
NIINLCQSS

SEQ ID NO: 1011616 - protein, 9 aa, Homo Sapiens
PGALGNTPL

SEQ ID NO: 1011617 - protein, 9 aa, Homo Sapiens
LMANFDLSV

SEQ ID NO: 1011618 - protein, 9 aa, Homo Sapiens
KCSDFAVSG

SEQ ID NO: 1011619 - protein, 9 aa, Homo Sapiens
SSASLLESK

SEQ ID NO: 1011620 - protein, 9 aa, Homo Sapiens
PLEEEDNSK

SEQ ID NO: 1011621 - protein, 9 aa, Homo Sapiens
HIARKVGLK

SEQ ID NO: 1011622 - protein, 9 aa, Homo Sapiens
DGKATRTAY

SEQ ID NO: 1011623 - protein, 9 aa, Homo Sapiens
KYKGLTAPD

SEQ ID NO: 1011624 - protein, 9 aa, Homo Sapiens
SIAFREERA

SEQ ID NO: 1011625 - protein, 9 aa, Homo Sapiens
PTEKGMKTL

SEQ ID NO: 1011626 - protein, 9 aa, Homo Sapiens
LKAPNERQR

SEQ ID NO: 1011627 - protein, 9 aa, Homo Sapiens
ELFPVMSLP

SEQ ID NO: 1011628 - protein, 9 aa, Homo Sapiens
VFCVERENM

SEQ ID NO: 1011629 - protein, 9 aa, Homo Sapiens
GLTVASGEN

SEQ ID NO: 1011630 - protein, 9 aa, Homo Sapiens
IQNEFYSSP

SEQ ID NO: 1011631 - protein, 9 aa, Homo Sapiens
VCLTEGSES

SEQ ID NO: 1011632 - protein, 9 aa, Homo Sapiens
SPLFSPPPV

SEQ ID NO: 1011633 - protein, 9 aa, Homo Sapiens
SPSAPHFFS

SEQ ID NO: 1011634 - protein, 9 aa, Homo Sapiens
TVSCKAPSV

SEQ ID NO: 1011635 - protein, 9 aa, Homo Sapiens
NVLDKYMKN

SEQ ID NO: 1011636 - protein, 9 aa, Homo Sapiens
DNQNERDIN

SEQ ID NO: 1011637 - protein, 9 aa, Homo Sapiens
GPGPLSLPS

SEQ ID NO: 1011638 - protein, 9 aa, Homo Sapiens
AWQSFLQES

SEQ ID NO: 1011639 - protein, 9 aa, Homo Sapiens
VQCNKGAYF

SEQ ID NO: 1011640 - protein, 9 aa, Homo Sapiens
WKDYDDKEP

SEQ ID NO: 1011641 - protein, 9 aa, Homo Sapiens
SYYFLLDLC

SEQ ID NO: 1011642 - protein, 9 aa, Homo Sapiens
RDDLVIEGP

SEQ ID NO: 1011643 - protein, 9 aa, Homo Sapiens
YALSFYTQT

SEQ ID NO: 1011644 - protein, 9 aa, Homo Sapiens
GQDIVVGEG

SEQ ID NO: 1011645 - protein, 9 aa, Homo Sapiens
RKHRSEASN

SEQ ID NO: 1011646 - protein, 9 aa, Homo Sapiens
SKMTPTIEG

SEQ ID NO: 1011647 - protein, 9 aa, Homo Sapiens
EEWVEQDPK

SEQ ID NO: 1011648 - protein, 9 aa, Homo Sapiens
KILLQEYRL

SEQ ID NO: 1011649 - protein, 9 aa, Homo Sapiens
EEYHNSEQK

SEQ ID NO: 1011650 - protein, 9 aa, Homo Sapiens
RIWESPLFL

SEQ ID NO: 1011651 - protein, 9 aa, Homo Sapiens
PYEPRFKFQ

SEQ ID NO: 1011652 - protein, 9 aa, Homo Sapiens
VTSPLVVNE

SEQ ID NO: 1011653 - protein, 9 aa, Homo Sapiens
AWFTYNNLC

SEQ ID NO: 1011654 - protein, 9 aa, Homo Sapiens
ELPLTDRYG

SEQ ID NO: 1011655 - protein, 9 aa, Homo Sapiens
GVSPIENSS

SEQ ID NO: 1011656 - protein, 9 aa, Homo Sapiens
LANKLQCLF

SEQ ID NO: 1011657 - protein, 9 aa, Homo Sapiens
PSDKEGESY

SEQ ID NO: 1011658 - protein, 9 aa, Homo Sapiens
QCLFVDVPA

SEQ ID NO: 1011659 - protein, 9 aa, Homo Sapiens
LDFLDSFLL

SEQ ID NO: 1011660 - protein, 9 aa, Homo Sapiens
SLLQDYMQR

SEQ ID NO: 1011661 - protein, 9 aa, Homo Sapiens
DNLFEYVIG

SEQ ID NO: 1011662 - protein, 9 aa, Homo Sapiens
PFSCTQCGQ

SEQ ID NO: 1011663 - protein, 9 aa, Homo Sapiens
QKKITNIIE

SEQ ID NO: 1011664 - protein, 9 aa, Homo Sapiens
GARRSKPFL

SEQ ID NO: 1011665 - protein, 9 aa, Homo Sapiens
VKPGTEEKS

SEQ ID NO: 1011666 - protein, 9 aa, Homo Sapiens
VGIVPLTMD

SEQ ID NO: 1011667 - protein, 9 aa, Homo Sapiens
LYERGMESP

SEQ ID NO: 1011668 - protein, 9 aa, Homo Sapiens
WNKEDFSWS

SEQ ID NO: 1011669 - protein, 9 aa, Homo Sapiens
VFNDPTTSV

SEQ ID NO: 1011670 - protein, 9 aa, Homo Sapiens
NRKIQDNYL

SEQ ID NO: 1011671 - protein, 9 aa, Homo Sapiens
NKTVNQHAC

SEQ ID NO: 1011672 - protein, 9 aa, Homo Sapiens
SPDGDYNYD

SEQ ID NO: 1011673 - protein, 9 aa, Homo Sapiens
FFWRASKIE

SEQ ID NO: 1011674 - protein, 9 aa, Homo Sapiens
LTFQRQAFL

SEQ ID NO: 1011675 - protein, 9 aa, Homo Sapiens
CLSPKKMSF

SEQ ID NO: 1011676 - protein, 9 aa, Homo Sapiens
TFNYNLADE

SEQ ID NO: 1011677 - protein, 9 aa, Homo Sapiens
FQVGKFSED

SEQ ID NO: 1011678 - protein, 9 aa, Homo Sapiens
TNLRRTAYL

SEQ ID NO: 1011679 - protein, 9 aa, Homo Sapiens
NLFEYVIGT

SEQ ID NO: 1011680 - protein, 9 aa, Homo Sapiens
LQEGFELFA

SEQ ID NO: 1011681 - protein, 9 aa, Homo Sapiens
SLGLIFDHE

SEQ ID NO: 1011682 - protein, 9 aa, Homo Sapiens
IMLWMIASQ

SEQ ID NO: 1011683 - protein, 9 aa, Homo Sapiens
LRVPSTKER

SEQ ID NO: 1011684 - protein, 9 aa, Homo Sapiens
TWGGQGSQS

SEQ ID NO: 1011685 - protein, 9 aa, Homo Sapiens
ACILNMLKN

SEQ ID NO: 1011686 - protein, 9 aa, Homo Sapiens
YFLFFFYGI

SEQ ID NO: 1011687 - protein, 9 aa, Homo Sapiens
VLKILSVIM

SEQ ID NO: 1011688 - protein, 9 aa, Homo Sapiens
CMSEAQSKL

SEQ ID NO: 1011689 - protein, 9 aa, Homo Sapiens
STVASSTDM

SEQ ID NO: 1011690 - protein, 9 aa, Homo Sapiens
RRDSSLCSY

SEQ ID NO: 1011691 - protein, 9 aa, Homo Sapiens
EIPLPIGNK

SEQ ID NO: 1011692 - protein, 9 aa, Homo Sapiens
RAQTQGLVK

SEQ ID NO: 1011693 - protein, 9 aa, Homo Sapiens
NSSSEEVFQ

SEQ ID NO: 1011694 - protein, 9 aa, Homo Sapiens
RLNCSRPSE

SEQ ID NO: 1011695 - protein, 9 aa, Homo Sapiens
SRLLPEALP

SEQ ID NO: 1011696 - protein, 9 aa, Homo Sapiens
RCELVKKIF

SEQ ID NO: 1011697 - protein, 9 aa, Homo Sapiens
KNDNAPQFS

SEQ ID NO: 1011698 - protein, 9 aa, Homo Sapiens
TVRHLEESG

SEQ ID NO: 1011699 - protein, 9 aa, Homo Sapiens
EMRTRALRF

SEQ ID NO: 1011700 - protein, 9 aa, Homo Sapiens
SRDRSSSGA

SEQ ID NO: 1011701 - protein, 9 aa, Homo Sapiens
ELICKGKSK

SEQ ID NO: 1011702 - protein, 9 aa, Homo Sapiens
QSTNSAPGI

SEQ ID NO: 1011703 - protein, 9 aa, Homo Sapiens
LFTKKKETM

SEQ ID NO: 1011704 - protein, 9 aa, Homo Sapiens
VDLLQELRD

SEQ ID NO: 1011705 - protein, 9 aa, Homo Sapiens
KRKQQNQLT

SEQ ID NO: 1011706 - protein, 9 aa, Homo Sapiens
LKKFILVGF

SEQ ID NO: 1011707 - protein, 9 aa, Homo Sapiens
PGFLAEKEG

SEQ ID NO: 1011708 - protein, 9 aa, Homo Sapiens
YTEQLQQYN

SEQ ID NO: 1011709 - protein, 9 aa, Homo Sapiens
HVYNPVDWY

SEQ ID NO: 1011710 - protein, 9 aa, Homo Sapiens
IEGRMHKEK

SEQ ID NO: 1011711 - protein, 9 aa, Homo Sapiens
LQASNIMWT

SEQ ID NO: 1011712 - protein, 9 aa, Homo Sapiens
KTATGSFLF

SEQ ID NO: 1011713 - protein, 9 aa, Homo Sapiens
IMAVICFSW

SEQ ID NO: 1011714 - protein, 9 aa, Homo Sapiens
KNYSHLISL

SEQ ID NO: 1011715 - protein, 9 aa, Homo Sapiens
PVREAFGNA

SEQ ID NO: 1011716 - protein, 9 aa, Homo Sapiens
RMLDEDVTD

SEQ ID NO: 1011717 - protein, 9 aa, Homo Sapiens
VLGSLVTDK

SEQ ID NO: 1011718 - protein, 9 aa, Homo Sapiens
LLSMIDLPR

SEQ ID NO: 1011719 - protein, 9 aa, Homo Sapiens
YLLLLALMT

SEQ ID NO: 1011720 - protein, 9 aa, Homo Sapiens
TECIVLAAI

SEQ ID NO: 1011721 - protein, 9 aa, Homo Sapiens
CIAKLMLYI

SEQ ID NO: 1011722 - protein, 9 aa, Homo Sapiens
LLHIDPNFA

SEQ ID NO: 1011723 - protein, 9 aa, Homo Sapiens
AATVRHLEE

SEQ ID NO: 1011724 - protein, 9 aa, Homo Sapiens
PPKPGRSFP

SEQ ID NO: 1011725 - protein, 9 aa, Homo Sapiens
LKSSSSRMT

SEQ ID NO: 1011726 - protein, 9 aa, Homo Sapiens
RRYSRYLNK

SEQ ID NO: 1011727 - protein, 9 aa, Homo Sapiens
AQPVCGFDG

SEQ ID NO: 1011728 - protein, 9 aa, Homo Sapiens
YMQIAPMRN

SEQ ID NO: 1011729 - protein, 9 aa, Homo Sapiens
LKGPGPSLS

SEQ ID NO: 1011730 - protein, 9 aa, Homo Sapiens
SLFFLLAMG

SEQ ID NO: 1011731 - protein, 9 aa, Homo Sapiens
IPPEIGKQP

SEQ ID NO: 1011732 - protein, 9 aa, Homo Sapiens
SLRYPTIMI

SEQ ID NO: 1011733 - protein, 9 aa, Homo Sapiens
LPLSHPSPY

SEQ ID NO: 1011734 - protein, 9 aa, Homo Sapiens
YGVMKAYTT

SEQ ID NO: 1011735 - protein, 9 aa, Homo Sapiens
KSLIRLGKH

SEQ ID NO: 1011736 - protein, 9 aa, Homo Sapiens
GGVGVLFFF

SEQ ID NO: 1011737 - protein, 9 aa, Homo Sapiens
ETVKLKCQV

SEQ ID NO: 1011738 - protein, 9 aa, Homo Sapiens
LQTLAVDYR

SEQ ID NO: 1011739 - protein, 9 aa, Homo Sapiens
SESRGGKDR

SEQ ID NO: 1011740 - protein, 9 aa, Homo Sapiens
FINFTCAFI

SEQ ID NO: 1011741 - protein, 9 aa, Homo Sapiens
KVVQMTNND

SEQ ID NO: 1011742 - protein, 9 aa, Homo Sapiens
GQDVDSKKA

SEQ ID NO: 1011743 - protein, 9 aa, Homo Sapiens
VYNFDRFSR

SEQ ID NO: 1011744 - protein, 9 aa, Homo Sapiens
RQFSEPMPV

SEQ ID NO: 1011745 - protein, 9 aa, Homo Sapiens
EEIPLPIGN

SEQ ID NO: 1011746 - protein, 9 aa, Homo Sapiens
FCNPSEVLK

SEQ ID NO: 1011747 - protein, 9 aa, Homo Sapiens
TIVDGVFAA

SEQ ID NO: 1011748 - protein, 9 aa, Homo Sapiens
CRLVTCVPR

SEQ ID NO: 1011749 - protein, 9 aa, Homo Sapiens
VILGVISVY

SEQ ID NO: 1011750 - protein, 9 aa, Homo Sapiens
VAIPDVDSL

SEQ ID NO: 1011751 - protein, 9 aa, Homo Sapiens
QGLSNVYKK

SEQ ID NO: 1011752 - protein, 9 aa, Homo Sapiens
NAREEGRQL

SEQ ID NO: 1011753 - protein, 9 aa, Homo Sapiens
GMLQEILSF

SEQ ID NO: 1011754 - protein, 9 aa, Homo Sapiens
QTQGLVKAE

SEQ ID NO: 1011755 - protein, 9 aa, Homo Sapiens
NPGSEFVYV

SEQ ID NO: 1011756 - protein, 9 aa, Homo Sapiens
GKLNIDEYN

SEQ ID NO: 1011757 - protein, 9 aa, Homo Sapiens
ALAPARTNR

SEQ ID NO: 1011758 - protein, 9 aa, Homo Sapiens
RKNHSVSRH

SEQ ID NO: 1011759 - protein, 9 aa, Homo Sapiens
YRERKRDRE

SEQ ID NO: 1011760 - protein, 9 aa, Homo Sapiens
SPTAAFVSA

SEQ ID NO: 1011761 - protein, 9 aa, Homo Sapiens
LVMLLPDDF

SEQ ID NO: 1011762 - protein, 9 aa, Homo Sapiens
AGVGAAAGA

SEQ ID NO: 1011763 - protein, 9 aa, Homo Sapiens
EPLHLLKAF

SEQ ID NO: 1011764 - protein, 9 aa, Homo Sapiens
YVFHLFGEC

SEQ ID NO: 1011765 - protein, 9 aa, Homo Sapiens
LDQMVFIWK

SEQ ID NO: 1011766 - protein, 9 aa, Homo Sapiens
LQPSTEQAC

SEQ ID NO: 1011767 - protein, 9 aa, Homo Sapiens
EYGEKITCQ

SEQ ID NO: 1011768 - protein, 9 aa, Homo Sapiens
QDEVEQARR

SEQ ID NO: 1011769 - protein, 9 aa, Homo Sapiens
SPSSASSGD

SEQ ID NO: 1011770 - protein, 9 aa, Homo Sapiens
NDDEDENKE

SEQ ID NO: 1011771 - protein, 9 aa, Homo Sapiens
TFYASSIEA

SEQ ID NO: 1011772 - protein, 9 aa, Homo Sapiens
SPLKAPNER

SEQ ID NO: 1011773 - protein, 9 aa, Homo Sapiens
GENQSQGPP

SEQ ID NO: 1011774 - protein, 9 aa, Homo Sapiens
ERKRDRERD

SEQ ID NO: 1011775 - protein, 9 aa, Homo Sapiens
ENVSYIKQP

SEQ ID NO: 1011776 - protein, 9 aa, Homo Sapiens
KSLLKFHQE

SEQ ID NO: 1011777 - protein, 9 aa, Homo Sapiens
LIRASPRGN

SEQ ID NO: 1011778 - protein, 9 aa, Homo Sapiens
QSNSKFLCA

SEQ ID NO: 1011779 - protein, 9 aa, Homo Sapiens
RKKETRNTL

SEQ ID NO: 1011780 - protein, 9 aa, Homo Sapiens
FASSFPLIS

SEQ ID NO: 1011781 - protein, 9 aa, Homo Sapiens
DPTAAIQNE

SEQ ID NO: 1011782 - protein, 9 aa, Homo Sapiens
QSLRDVVEK

SEQ ID NO: 1011783 - protein, 9 aa, Homo Sapiens
DNVNMAIRV

SEQ ID NO: 1011784 - protein, 9 aa, Homo Sapiens
NKKEQEGGG

SEQ ID NO: 1011785 - protein, 9 aa, Homo Sapiens
QAGFFEHLE

SEQ ID NO: 1011786 - protein, 9 aa, Homo Sapiens
MDPSRPLSG

SEQ ID NO: 1011787 - protein, 9 aa, Homo Sapiens
LFHANSMMN

SEQ ID NO: 1011788 - protein, 9 aa, Homo Sapiens
RDIPPEIGK

SEQ ID NO: 1011789 - protein, 9 aa, Homo Sapiens
CCSANEYCV

SEQ ID NO: 1011790 - protein, 9 aa, Homo Sapiens
CTQIFLFSL

SEQ ID NO: 1011791 - protein, 9 aa, Homo Sapiens
KKEQLSLKS

SEQ ID NO: 1011792 - protein, 9 aa, Homo Sapiens
NNIVYFFPR

SEQ ID NO: 1011793 - protein, 9 aa, Homo Sapiens
FCLLLLYPA

SEQ ID NO: 1011794 - protein, 9 aa, Homo Sapiens
GNRVRRWQK

SEQ ID NO: 1011795 - protein, 9 aa, Homo Sapiens
HARNGLLLK

SEQ ID NO: 1011796 - protein, 9 aa, Homo Sapiens
HKTRVQNVC

SEQ ID NO: 1011797 - protein, 9 aa, Homo Sapiens
RFATFIDKV

SEQ ID NO: 1011798 - protein, 9 aa, Homo Sapiens
NESPEESSN

SEQ ID NO: 1011799 - protein, 9 aa, Homo Sapiens
DFPIEDMIS

SEQ ID NO: 1011800 - protein, 9 aa, Homo Sapiens
LIFLANLPP

SEQ ID NO: 1011801 - protein, 9 aa, Homo Sapiens
LQPRGKDSR

SEQ ID NO: 1011802 - protein, 9 aa, Homo Sapiens
FWRASKIEL

SEQ ID NO: 1011803 - protein, 9 aa, Homo Sapiens
YNIENRTRV

SEQ ID NO: 1011804 - protein, 9 aa, Homo Sapiens
GRKREPGEG

SEQ ID NO: 1011805 - protein, 9 aa, Homo Sapiens
IRLGKHWYQ

SEQ ID NO: 1011806 - protein, 9 aa, Homo Sapiens
VFQAGDLLI

SEQ ID NO: 1011807 - protein, 9 aa, Homo Sapiens
SVHPGLTVA

SEQ ID NO: 1011808 - protein, 9 aa, Homo Sapiens
TFAQLSKLH

SEQ ID NO: 1011809 - protein, 9 aa, Homo Sapiens
GFTCFFQDH

SEQ ID NO: 1011810 - protein, 9 aa, Homo Sapiens
YKVNHKGYR

SEQ ID NO: 1011811 - protein, 9 aa, Homo Sapiens
EFVYVVDTR

SEQ ID NO: 1011812 - protein, 9 aa, Homo Sapiens
SNFHFDNVL

SEQ ID NO: 1011813 - protein, 9 aa, Homo Sapiens
TKRLEKYLG

SEQ ID NO: 1011814 - protein, 9 aa, Homo Sapiens
DGMKFKKYE

SEQ ID NO: 1011815 - protein, 9 aa, Homo Sapiens
LDLSVRPNA

SEQ ID NO: 1011816 - protein, 9 aa, Homo Sapiens
ANKLQCLFV

SEQ ID NO: 1011817 - protein, 9 aa, Homo Sapiens
YPCAFLCTK

SEQ ID NO: 1011818 - protein, 9 aa, Homo Sapiens
PPGFIGHPG

SEQ ID NO: 1011819 - protein, 9 aa, Homo Sapiens
SRKIESMDE

SEQ ID NO: 1011820 - protein, 9 aa, Homo Sapiens
EKEMMEWTS

SEQ ID NO: 1011821 - protein, 9 aa, Homo Sapiens
REEDKNELL

SEQ ID NO: 1011822 - protein, 9 aa, Homo Sapiens
QGVGNRVRR

SEQ ID NO: 1011823 - protein, 9 aa, Homo Sapiens
ETKVLKILS

SEQ ID NO: 1011824 - protein, 9 aa, Homo Sapiens
YEKLRDISY

SEQ ID NO: 1011825 - protein, 9 aa, Homo Sapiens
HRDPPHQPG

SEQ ID NO: 1011826 - protein, 9 aa, Homo Sapiens
LDISGPAFC

SEQ ID NO: 1011827 - protein, 9 aa, Homo Sapiens
KTSDLGTYT

SEQ ID NO: 1011828 - protein, 9 aa, Homo Sapiens
VVQMTNNDI

SEQ ID NO: 1011829 - protein, 9 aa, Homo Sapiens
IQRSDAGTR

SEQ ID NO: 1011830 - protein, 9 aa, Homo Sapiens
GLANFISSY

SEQ ID NO: 1011831 - protein, 9 aa, Homo Sapiens
DSGSTEGKD

SEQ ID NO: 1011832 - protein, 9 aa, Homo Sapiens
LREERSHHH

SEQ ID NO: 1011833 - protein, 9 aa, Homo Sapiens
DLSVSRNST

SEQ ID NO: 1011834 - protein, 9 aa, Homo Sapiens
CEESVCPTQ

SEQ ID NO: 1011835 - protein, 9 aa, Homo Sapiens
PVHSSIPPS

SEQ ID NO: 1011836 - protein, 9 aa, Homo Sapiens
KRGPGQKTG

SEQ ID NO: 1011837 - protein, 9 aa, Homo Sapiens
EKPPLSCKP

SEQ ID NO: 1011838 - protein, 9 aa, Homo Sapiens
DSLAELYFL

SEQ ID NO: 1011839 - protein, 9 aa, Homo Sapiens
NLLLPSPVS

SEQ ID NO: 1011840 - protein, 9 aa, Homo Sapiens
GIIIVLLIC

SEQ ID NO: 1011841 - protein, 9 aa, Homo Sapiens
KQLQAGFFE

SEQ ID NO: 1011842 - protein, 9 aa, Homo Sapiens
AITGGYLDR

SEQ ID NO: 1011843 - protein, 9 aa, Homo Sapiens
LANQGFLRN

SEQ ID NO: 1011844 - protein, 9 aa, Homo Sapiens
SRGGKDRKL

SEQ ID NO: 1011845 - protein, 9 aa, Homo Sapiens
CFPADYGDF

SEQ ID NO: 1011846 - protein, 9 aa, Homo Sapiens
IEQILNNFS

SEQ ID NO: 1011847 - protein, 9 aa, Homo Sapiens
VNPELFRKF

SEQ ID NO: 1011848 - protein, 9 aa, Homo Sapiens
IDLPRSTVP

SEQ ID NO: 1011849 - protein, 9 aa, Homo Sapiens
ERQVETIRS

SEQ ID NO: 1011850 - protein, 9 aa, Homo Sapiens
GAASGALAG

SEQ ID NO: 1011851 - protein, 9 aa, Homo Sapiens
SEDKRGPGQ

SEQ ID NO: 1011852 - protein, 9 aa, Homo Sapiens
FSAARSRKL

SEQ ID NO: 1011853 - protein, 9 aa, Homo Sapiens
HPDVSDEMR

SEQ ID NO: 1011854 - protein, 9 aa, Homo Sapiens
LEVFLLEVV

SEQ ID NO: 1011855 - protein, 9 aa, Homo Sapiens
AQAKFSAVK

SEQ ID NO: 1011856 - protein, 9 aa, Homo Sapiens
KAGKDDLGV

SEQ ID NO: 1011857 - protein, 9 aa, Homo Sapiens
AWLAVPGRT

SEQ ID NO: 1011858 - protein, 9 aa, Homo Sapiens
SGKQLLSLS

SEQ ID NO: 1011859 - protein, 9 aa, Homo Sapiens
QNTFIPLGQ

SEQ ID NO: 1011860 - protein, 9 aa, Homo Sapiens
ILTAFCLGW

SEQ ID NO: 1011861 - protein, 9 aa, Homo Sapiens
RHLEESGLC

SEQ ID NO: 1011862 - protein, 9 aa, Homo Sapiens
FIDDLNMPV

SEQ ID NO: 1011863 - protein, 9 aa, Homo Sapiens
CVASNNVRE

SEQ ID NO: 1011864 - protein, 9 aa, Homo Sapiens
FLPVGDLVA

SEQ ID NO: 1011865 - protein, 9 aa, Homo Sapiens
SERICFLLI

SEQ ID NO: 1011866 - protein, 9 aa, Homo Sapiens
AFSLSPGHA

SEQ ID NO: 1011867 - protein, 9 aa, Homo Sapiens
NELLRVMPS

SEQ ID NO: 1011868 - protein, 9 aa, Homo Sapiens
LFSCPVTLF

SEQ ID NO: 1011869 - protein, 9 aa, Homo Sapiens
NPSEVLKLA

SEQ ID NO: 1011870 - protein, 9 aa, Homo Sapiens
KCKAPGNSE

SEQ ID NO: 1011871 - protein, 9 aa, Homo Sapiens
ANERSFDSK

SEQ ID NO: 1011872 - protein, 9 aa, Homo Sapiens
ALWPPVWEK

SEQ ID NO: 1011873 - protein, 9 aa, Homo Sapiens
EGQLEQQKR

SEQ ID NO: 1011874 - protein, 9 aa, Homo Sapiens
LPAMDGFVD

SEQ ID NO: 1011875 - protein, 9 aa, Homo Sapiens
AMNKEEKLY

SEQ ID NO: 1011876 - protein, 9 aa, Homo Sapiens
APKGGEDEP

SEQ ID NO: 1011877 - protein, 9 aa, Homo Sapiens
FHKYSNLNR

SEQ ID NO: 1011878 - protein, 9 aa, Homo Sapiens
KEKLPPGPR

SEQ ID NO: 1011879 - protein, 9 aa, Homo Sapiens
DYVIEDNVN

SEQ ID NO: 1011880 - protein, 9 aa, Homo Sapiens
ATDPWHLNH

SEQ ID NO: 1011881 - protein, 9 aa, Homo Sapiens
VVTSPLFSP

SEQ ID NO: 1011882 - protein, 9 aa, Homo Sapiens
KENEHLQLF

SEQ ID NO: 1011883 - protein, 9 aa, Homo Sapiens
DKWALDSIY

SEQ ID NO: 1011884 - protein, 9 aa, Homo Sapiens
SALETTHTP

SEQ ID NO: 1011885 - protein, 9 aa, Homo Sapiens
EEYRHISGR

SEQ ID NO: 1011886 - protein, 9 aa, Homo Sapiens
QRFPASYYH

SEQ ID NO: 1011887 - protein, 9 aa, Homo Sapiens
TILKKFILV

SEQ ID NO: 1011888 - protein, 9 aa, Homo Sapiens
QQHLSLLQD

SEQ ID NO: 1011889 - protein, 9 aa, Homo Sapiens
YEILIHNLQ

SEQ ID NO: 1011890 - protein, 9 aa, Homo Sapiens
KVRDWLAST

SEQ ID NO: 1011891 - protein, 9 aa, Homo Sapiens
TAAIQNEFY

SEQ ID NO: 1011892 - protein, 9 aa, Homo Sapiens
FSEGVNPSV

SEQ ID NO: 1011893 - protein, 9 aa, Homo Sapiens
PLKAPNERQ

SEQ ID NO: 1011894 - protein, 9 aa, Homo Sapiens
SDQSFLSLE

SEQ ID NO: 1011895 - protein, 9 aa, Homo Sapiens
KKSNIKTRS

SEQ ID NO: 1011896 - protein, 9 aa, Homo Sapiens
LSLRSMQSQ

SEQ ID NO: 1011897 - protein, 9 aa, Homo Sapiens
RLKHLRVLL

SEQ ID NO: 1011898 - protein, 9 aa, Homo Sapiens
QAKFSAVKK

SEQ ID NO: 1011899 - protein, 9 aa, Homo Sapiens
TAAFVSADL

SEQ ID NO: 1011900 - protein, 9 aa, Homo Sapiens
CGAEKQKEA

SEQ ID NO: 1011901 - protein, 9 aa, Homo Sapiens
KCEECGTAF

SEQ ID NO: 1011902 - protein, 9 aa, Homo Sapiens
LEDLFKLGK

SEQ ID NO: 1011903 - protein, 9 aa, Homo Sapiens
NLLRISIPL

SEQ ID NO: 1011904 - protein, 9 aa, Homo Sapiens
DIAFLGERV

SEQ ID NO: 1011905 - protein, 9 aa, Homo Sapiens
LTSNYIFFT

SEQ ID NO: 1011906 - protein, 9 aa, Homo Sapiens
NKYVSYSES

SEQ ID NO: 1011907 - protein, 9 aa, Homo Sapiens
GINEPLHLL

SEQ ID NO: 1011908 - protein, 9 aa, Homo Sapiens
QEERKSKRR

SEQ ID NO: 1011909 - protein, 9 aa, Homo Sapiens
RFENIGFGT

SEQ ID NO: 1011910 - protein, 9 aa, Homo Sapiens
EDQEMCHKF

SEQ ID NO: 1011911 - protein, 9 aa, Homo Sapiens
SIPPSGPVP

SEQ ID NO: 1011912 - protein, 9 aa, Homo Sapiens
VFQELESDD

SEQ ID NO: 1011913 - protein, 9 aa, Homo Sapiens
ISEGLQGAE

SEQ ID NO: 1011914 - protein, 9 aa, Homo Sapiens
KLNGTVVWT

SEQ ID NO: 1011915 - protein, 9 aa, Homo Sapiens
KLDKGQKKV

SEQ ID NO: 1011916 - protein, 9 aa, Homo Sapiens
IFGARQNVA

SEQ ID NO: 1011917 - protein, 9 aa, Homo Sapiens
KVNGGRYET

SEQ ID NO: 1011918 - protein, 9 aa, Homo Sapiens
RQQHLSLLQ

SEQ ID NO: 1011919 - protein, 9 aa, Homo Sapiens
QQSTNSAPG

SEQ ID NO: 1011920 - protein, 9 aa, Homo Sapiens
CLGWELKEL

SEQ ID NO: 1011921 - protein, 9 aa, Homo Sapiens
CDNGFVKTQ

SEQ ID NO: 1011922 - protein, 9 aa, Homo Sapiens
FVIMTNYDE

SEQ ID NO: 1011923 - protein, 9 aa, Homo Sapiens
ISIPGQQDK

SEQ ID NO: 1011924 - protein, 9 aa, Homo Sapiens
QELRDIDTL

SEQ ID NO: 1011925 - protein, 9 aa, Homo Sapiens
RHSNSLGLI

SEQ ID NO: 1011926 - protein, 9 aa, Homo Sapiens
HLGASLWLQ

SEQ ID NO: 1011927 - protein, 9 aa, Homo Sapiens
EGPAFYPST

SEQ ID NO: 1011928 - protein, 9 aa, Homo Sapiens
SVKYKCEQG

SEQ ID NO: 1011929 - protein, 9 aa, Homo Sapiens
ALHEVLEGL

SEQ ID NO: 1011930 - protein, 9 aa, Homo Sapiens
HTGVKPYVC

SEQ ID NO: 1011931 - protein, 9 aa, Homo Sapiens
GVRMLDEDV

SEQ ID NO: 1011932 - protein, 9 aa, Homo Sapiens
VVICAIILI

SEQ ID NO: 1011933 - protein, 9 aa, Homo Sapiens
YQLTYCGRN

SEQ ID NO: 1011934 - protein, 9 aa, Homo Sapiens
QYDLMEVEF

SEQ ID NO: 1011935 - protein, 9 aa, Homo Sapiens
KQAWFTYNN

SEQ ID NO: 1011936 - protein, 9 aa, Homo Sapiens
MGYLHAKEI

SEQ ID NO: 1011937 - protein, 9 aa, Homo Sapiens
TGKTERAGD

SEQ ID NO: 1011938 - protein, 9 aa, Homo Sapiens
LREAATVRH

SEQ ID NO: 1011939 - protein, 9 aa, Homo Sapiens
TQHESGSGH

SEQ ID NO: 1011940 - protein, 9 aa, Homo Sapiens
GRGPGPLSL

SEQ ID NO: 1011941 - protein, 9 aa, Homo Sapiens
FSCTQCGQA

SEQ ID NO: 1011942 - protein, 9 aa, Homo Sapiens
KKHMAIPKL

SEQ ID NO: 1011943 - protein, 9 aa, Homo Sapiens
LGPTVVNPE

SEQ ID NO: 1011944 - protein, 9 aa, Homo Sapiens
AQTCSSVCS

SEQ ID NO: 1011945 - protein, 9 aa, Homo Sapiens
NGGQCQDNQ

SEQ ID NO: 1011946 - protein, 9 aa, Homo Sapiens
EEFHYDKEK

SEQ ID NO: 1011947 - protein, 9 aa, Homo Sapiens
RKNAVVSFG

SEQ ID NO: 1011948 - protein, 9 aa, Homo Sapiens
APSVYPLDR

SEQ ID NO: 1011949 - protein, 9 aa, Homo Sapiens
PWSSYKKQS

SEQ ID NO: 1011950 - protein, 9 aa, Homo Sapiens
EDKRGPGQK

SEQ ID NO: 1011951 - protein, 9 aa, Homo Sapiens
EIGVFLRLS

SEQ ID NO: 1011952 - protein, 9 aa, Homo Sapiens
DPLRSVNLL

SEQ ID NO: 1011953 - protein, 9 aa, Homo Sapiens
GPHALTQVL

SEQ ID NO: 1011954 - protein, 9 aa, Homo Sapiens
FIVATEEST

SEQ ID NO: 1011955 - protein, 9 aa, Homo Sapiens
PEVARQFSE

SEQ ID NO: 1011956 - protein, 9 aa, Homo Sapiens
VVSSSHPPP

SEQ ID NO: 1011957 - protein, 9 aa, Homo Sapiens
CEATHFGLW

SEQ ID NO: 1011958 - protein, 9 aa, Homo Sapiens
RVCSFAGIL

SEQ ID NO: 1011959 - protein, 9 aa, Homo Sapiens
GAKEPRDSR

SEQ ID NO: 1011960 - protein, 9 aa, Homo Sapiens
QPPSIDCAE

SEQ ID NO: 1011961 - protein, 9 aa, Homo Sapiens
FQEPSETQP

SEQ ID NO: 1011962 - protein, 9 aa, Homo Sapiens
KPAVSTVAS

SEQ ID NO: 1011963 - protein, 9 aa, Homo Sapiens
GKTERAGDQ

SEQ ID NO: 1011964 - protein, 9 aa, Homo Sapiens
TEKPPLSCK

SEQ ID NO: 1011965 - protein, 9 aa, Homo Sapiens
SFNCIDKPS

SEQ ID NO: 1011966 - protein, 9 aa, Homo Sapiens
PSSALETTH

SEQ ID NO: 1011967 - protein, 9 aa, Homo Sapiens
INPTNTVFD

SEQ ID NO: 1011968 - protein, 9 aa, Homo Sapiens
GTLMTHGFY

SEQ ID NO: 1011969 - protein, 9 aa, Homo Sapiens
KDRKLFVGM

SEQ ID NO: 1011970 - protein, 9 aa, Homo Sapiens
GQVAGALIG

SEQ ID NO: 1011971 - protein, 9 aa, Homo Sapiens
VIMTNYDEA

SEQ ID NO: 1011972 - protein, 9 aa, Homo Sapiens
CNKGAYFSD

SEQ ID NO: 1011973 - protein, 9 aa, Homo Sapiens
KVLKILSVI

SEQ ID NO: 1011974 - protein, 9 aa, Homo Sapiens
SPRLTKPQS

SEQ ID NO: 1011975 - protein, 9 aa, Homo Sapiens
GLQLAPGQD

SEQ ID NO: 1011976 - protein, 9 aa, Homo Sapiens
PRIVSYYRD

SEQ ID NO: 1011977 - protein, 9 aa, Homo Sapiens
SPPDLKSSS

SEQ ID NO: 1011978 - protein, 9 aa, Homo Sapiens
SVPTPVFLT

SEQ ID NO: 1011979 - protein, 9 aa, Homo Sapiens
LVEPGFLAE

SEQ ID NO: 1011980 - protein, 9 aa, Homo Sapiens
RHISGRCVR

SEQ ID NO: 1011981 - protein, 9 aa, Homo Sapiens
PASTAFLQE

SEQ ID NO: 1011982 - protein, 9 aa, Homo Sapiens
RDWPWIYFA

SEQ ID NO: 1011983 - protein, 9 aa, Homo Sapiens
LFEYVIGTL

SEQ ID NO: 1011984 - protein, 9 aa, Homo Sapiens
GTSEQRKSI

SEQ ID NO: 1011985 - protein, 9 aa, Homo Sapiens
VLLLALTAF

SEQ ID NO: 1011986 - protein, 9 aa, Homo Sapiens
ILLSGNTLR

SEQ ID NO: 1011987 - protein, 9 aa, Homo Sapiens
FSDHGMTNI

SEQ ID NO: 1011988 - protein, 9 aa, Homo Sapiens
KPQQRLNIK

SEQ ID NO: 1011989 - protein, 9 aa, Homo Sapiens
EDLDSSEES

SEQ ID NO: 1011990 - protein, 9 aa, Homo Sapiens
GKMHIDKRS

SEQ ID NO: 1011991 - protein, 9 aa, Homo Sapiens
DDIQNCATS

SEQ ID NO: 1011992 - protein, 9 aa, Homo Sapiens
ALLHQKYKG

SEQ ID NO: 1011993 - protein, 9 aa, Homo Sapiens
ESMDELEEG

SEQ ID NO: 1011994 - protein, 9 aa, Homo Sapiens
SLPKVTLET

SEQ ID NO: 1011995 - protein, 9 aa, Homo Sapiens
LLKLDFLDS

SEQ ID NO: 1011996 - protein, 9 aa, Homo Sapiens
KEVKDCVTN

SEQ ID NO: 1011997 - protein, 9 aa, Homo Sapiens
NDFSEGVNP

SEQ ID NO: 1011998 - protein, 9 aa, Homo Sapiens
EPETSPSFP

SEQ ID NO: 1011999 - protein, 9 aa, Homo Sapiens
SSWNKDKMQ

SEQ ID NO: 1012000 - protein, 9 aa, Homo Sapiens
FQLKGPESL

SEQ ID NO: 1012001 - protein, 9 aa, Homo Sapiens
DIDIPLSVD

SEQ ID NO: 1012002 - protein, 9 aa, Homo Sapiens
ATNGKLFSW

SEQ ID NO: 1012003 - protein, 9 aa, Homo Sapiens
SSVQPLSGS

SEQ ID NO: 1012004 - protein, 9 aa, Homo Sapiens
QGENQSQGP

SEQ ID NO: 1012005 - protein, 9 aa, Homo Sapiens
TGNKMFVWF

SEQ ID NO: 1012006 - protein, 9 aa, Homo Sapiens
RGKDSRLST

SEQ ID NO: 1012007 - protein, 9 aa, Homo Sapiens
RKANPGSEF

SEQ ID NO: 1012008 - protein, 9 aa, Homo Sapiens
FSVIIDVDM

SEQ ID NO: 1012009 - protein, 9 aa, Homo Sapiens
QWKTNKAQA

SEQ ID NO: 1012010 - protein, 9 aa, Homo Sapiens
LYRDYRGKN

SEQ ID NO: 1012011 - protein, 9 aa, Homo Sapiens
EQELQNVLD

SEQ ID NO: 1012012 - protein, 9 aa, Homo Sapiens
EKKKIIGTD

SEQ ID NO: 1012013 - protein, 9 aa, Homo Sapiens
VIREEDKNE

SEQ ID NO: 1012014 - protein, 9 aa, Homo Sapiens
REINNVAGE

SEQ ID NO: 1012015 - protein, 9 aa, Homo Sapiens
EHLQLFGLF

SEQ ID NO: 1012016 - protein, 9 aa, Homo Sapiens
TLFSCPVTL

SEQ ID NO: 1012017 - protein, 9 aa, Homo Sapiens
FENEEEYED

SEQ ID NO: 1012018 - protein, 9 aa, Homo Sapiens
ENDFAVHKT

SEQ ID NO: 1012019 - protein, 9 aa, Homo Sapiens
EEKERMHDE

SEQ ID NO: 1012020 - protein, 9 aa, Homo Sapiens
LELSDSDLE

SEQ ID NO: 1012021 - protein, 9 aa, Homo Sapiens
WFVSDASVQ

SEQ ID NO: 1012022 - protein, 9 aa, Homo Sapiens
ETEKPPLSC

SEQ ID NO: 1012023 - protein, 9 aa, Homo Sapiens
KCGRVGPGH

SEQ ID NO: 1012024 - protein, 9 aa, Homo Sapiens
PTPVFLTMD

SEQ ID NO: 1012025 - protein, 9 aa, Homo Sapiens
PQGPAGQDG

SEQ ID NO: 1012026 - protein, 9 aa, Homo Sapiens
SYCAPFQLH

SEQ ID NO: 1012027 - protein, 9 aa, Homo Sapiens
RDDHICFIS

SEQ ID NO: 1012028 - protein, 9 aa, Homo Sapiens
SMGCDLPQT

SEQ ID NO: 1012029 - protein, 9 aa, Homo Sapiens
FLPSISTKK

SEQ ID NO: 1012030 - protein, 9 aa, Homo Sapiens
FSRITSDPQ

SEQ ID NO: 1012031 - protein, 9 aa, Homo Sapiens
QDKWALDSI

SEQ ID NO: 1012032 - protein, 9 aa, Homo Sapiens
DRFRGGQDI

SEQ ID NO: 1012033 - protein, 9 aa, Homo Sapiens
QGPTFFHVI

SEQ ID NO: 1012034 - protein, 9 aa, Homo Sapiens
LEDIMYRQL

SEQ ID NO: 1012035 - protein, 9 aa, Homo Sapiens
QVETIRSLV

SEQ ID NO: 1012036 - protein, 9 aa, Homo Sapiens
MRIGIPAQR

SEQ ID NO: 1012037 - protein, 9 aa, Homo Sapiens
PLLQTAKIM

SEQ ID NO: 1012038 - protein, 9 aa, Homo Sapiens
GQLEQQKRQ

SEQ ID NO: 1012039 - protein, 9 aa, Homo Sapiens
NGIPICTVK

SEQ ID NO: 1012040 - protein, 9 aa, Homo Sapiens
SKTIQTDYI

SEQ ID NO: 1012041 - protein, 9 aa, Homo Sapiens
QKICAQYWG

SEQ ID NO: 1012042 - protein, 9 aa, Homo Sapiens
KKMKSKVDT

SEQ ID NO: 1012043 - protein, 9 aa, Homo Sapiens
RTKKDNAAL

SEQ ID NO: 1012044 - protein, 9 aa, Homo Sapiens
NPPATTFLT

SEQ ID NO: 1012045 - protein, 9 aa, Homo Sapiens
FAQLSKLHC

SEQ ID NO: 1012046 - protein, 9 aa, Homo Sapiens
PYLLQHVYN

SEQ ID NO: 1012047 - protein, 9 aa, Homo Sapiens
QEGQLEQQK

SEQ ID NO: 1012048 - protein, 9 aa, Homo Sapiens
PSFSECSSQ

SEQ ID NO: 1012049 - protein, 9 aa, Homo Sapiens
RYIAICNSL

SEQ ID NO: 1012050 - protein, 9 aa, Homo Sapiens
HRSEASNGS

SEQ ID NO: 1012051 - protein, 9 aa, Homo Sapiens
CTKVHPPTE

SEQ ID NO: 1012052 - protein, 9 aa, Homo Sapiens
LGIGLPGSP

SEQ ID NO: 1012053 - protein, 9 aa, Homo Sapiens
SVLLKNLEE

SEQ ID NO: 1012054 - protein, 9 aa, Homo Sapiens
MGTEDFICI

SEQ ID NO: 1012055 - protein, 9 aa, Homo Sapiens
CDISPLLLL

SEQ ID NO: 1012056 - protein, 9 aa, Homo Sapiens
EYRIERCPN

SEQ ID NO: 1012057 - protein, 9 aa, Homo Sapiens
NGVHPSREV

SEQ ID NO: 1012058 - protein, 9 aa, Homo Sapiens
NYDQDDYED

SEQ ID NO: 1012059 - protein, 9 aa, Homo Sapiens
REDLIVYEI

SEQ ID NO: 1012060 - protein, 9 aa, Homo Sapiens
VFDAYMKPG

SEQ ID NO: 1012061 - protein, 9 aa, Homo Sapiens
GMASSPCGE

SEQ ID NO: 1012062 - protein, 9 aa, Homo Sapiens
SKELQILGK

SEQ ID NO: 1012063 - protein, 9 aa, Homo Sapiens
IPSLNDHGS

SEQ ID NO: 1012064 - protein, 9 aa, Homo Sapiens
SSWYHDQGW

SEQ ID NO: 1012065 - protein, 9 aa, Homo Sapiens
EDPLMNMLM

SEQ ID NO: 1012066 - protein, 9 aa, Homo Sapiens
TNPLLREHL

SEQ ID NO: 1012067 - protein, 9 aa, Homo Sapiens
KDTFKEETL

SEQ ID NO: 1012068 - protein, 9 aa, Homo Sapiens
HSVHSFSDW

SEQ ID NO: 1012069 - protein, 9 aa, Homo Sapiens
SPGCPLVPS

SEQ ID NO: 1012070 - protein, 9 aa, Homo Sapiens
RNPACSGPK

SEQ ID NO: 1012071 - protein, 9 aa, Homo Sapiens
VCWASYSLF

SEQ ID NO: 1012072 - protein, 9 aa, Homo Sapiens
SSQGEIIEG

SEQ ID NO: 1012073 - protein, 9 aa, Homo Sapiens
SAKSLLKFH

SEQ ID NO: 1012074 - protein, 9 aa, Homo Sapiens
CLTFFIAVT

SEQ ID NO: 1012075 - protein, 9 aa, Homo Sapiens
SSVSNLHVK

SEQ ID NO: 1012076 - protein, 9 aa, Homo Sapiens
SAGGRGPGP

SEQ ID NO: 1012077 - protein, 9 aa, Homo Sapiens
RATCHRKPD

SEQ ID NO: 1012078 - protein, 9 aa, Homo Sapiens
LVVTMRSIP

SEQ ID NO: 1012079 - protein, 9 aa, Homo Sapiens
EQEEPRGTQ

SEQ ID NO: 1012080 - protein, 9 aa, Homo Sapiens
DMNEDDDFS

SEQ ID NO: 1012081 - protein, 9 aa, Homo Sapiens
QRACSRVNT

SEQ ID NO: 1012082 - protein, 9 aa, Homo Sapiens
GLQSCQICN

SEQ ID NO: 1012083 - protein, 9 aa, Homo Sapiens
QEMCHKFQA

SEQ ID NO: 1012084 - protein, 9 aa, Homo Sapiens
HHLDSQPAV

SEQ ID NO: 1012085 - protein, 9 aa, Homo Sapiens
NGHLFALRL

SEQ ID NO: 1012086 - protein, 9 aa, Homo Sapiens
HNTTCEATH

SEQ ID NO: 1012087 - protein, 9 aa, Homo Sapiens
YLLQHVYNP

SEQ ID NO: 1012088 - protein, 9 aa, Homo Sapiens
PPNKKEQEG

SEQ ID NO: 1012089 - protein, 9 aa, Homo Sapiens
PPPQGENQS

SEQ ID NO: 1012090 - protein, 9 aa, Homo Sapiens
KVLAREAGE

SEQ ID NO: 1012091 - protein, 9 aa, Homo Sapiens
EPWGNSPAL

SEQ ID NO: 1012092 - protein, 9 aa, Homo Sapiens
LSYKSICSM

SEQ ID NO: 1012093 - protein, 9 aa, Homo Sapiens
GRYFEHYQS

SEQ ID NO: 1012094 - protein, 9 aa, Homo Sapiens
ETELRGTWS

SEQ ID NO: 1012095 - protein, 9 aa, Homo Sapiens
HAHLQRHPD

SEQ ID NO: 1012096 - protein, 9 aa, Homo Sapiens
VKLNGTVVW

SEQ ID NO: 1012097 - protein, 9 aa, Homo Sapiens
RKKLKSINK

SEQ ID NO: 1012098 - protein, 9 aa, Homo Sapiens
FPGIQGRKR

SEQ ID NO: 1012099 - protein, 9 aa, Homo Sapiens
DVLDILVLI

SEQ ID NO: 1012100 - protein, 9 aa, Homo Sapiens
RAQRGDHSF

SEQ ID NO: 1012101 - protein, 9 aa, Homo Sapiens
KLKAKRERG

SEQ ID NO: 1012102 - protein, 8 aa, Homo Sapiens
DPGLQQAL

SEQ ID NO: 1012103 - protein, 9 aa, Homo Sapiens
YSLYGICLE

SEQ ID NO: 1012104 - protein, 9 aa, Homo Sapiens
CSPNGTNPY

SEQ ID NO: 1012105 - protein, 9 aa, Homo Sapiens
LLEDIMYRQ

SEQ ID NO: 1012106 - protein, 9 aa, Homo Sapiens
GVGAASGAL

SEQ ID NO: 1012107 - protein, 9 aa, Homo Sapiens
FYSVPSFSE

SEQ ID NO: 1012108 - protein, 9 aa, Homo Sapiens
RIKEIKQMH

SEQ ID NO: 1012109 - protein, 9 aa, Homo Sapiens
ESVAPIIMA

SEQ ID NO: 1012110 - protein, 9 aa, Homo Sapiens
TIDGSRKIE

SEQ ID NO: 1012111 - protein, 9 aa, Homo Sapiens
VLLDLTPNY

SEQ ID NO: 1012112 - protein, 9 aa, Homo Sapiens
VYEYIVFVS

SEQ ID NO: 1012113 - protein, 9 aa, Homo Sapiens
EHKNVVDGK

SEQ ID NO: 1012114 - protein, 9 aa, Homo Sapiens
DKINKDDYL

SEQ ID NO: 1012115 - protein, 9 aa, Homo Sapiens
RVVEKSELA

SEQ ID NO: 1012116 - protein, 9 aa, Homo Sapiens
GENLKKASV

SEQ ID NO: 1012117 - protein, 9 aa, Homo Sapiens
VREGPAFYP

SEQ ID NO: 1012118 - protein, 9 aa, Homo Sapiens
TPRCEVPDL

SEQ ID NO: 1012119 - protein, 9 aa, Homo Sapiens
LIKEIILRK

SEQ ID NO: 1012120 - protein, 9 aa, Homo Sapiens
NLHVIDLDN

SEQ ID NO: 1012121 - protein, 9 aa, Homo Sapiens
LSLTTPLSG

SEQ ID NO: 1012122 - protein, 9 aa, Homo Sapiens
ERGMESPKA

SEQ ID NO: 1012123 - protein, 9 aa, Homo Sapiens
SPLGSSVKP

SEQ ID NO: 1012124 - protein, 9 aa, Homo Sapiens
RNLLLPSPV

SEQ ID NO: 1012125 - protein, 9 aa, Homo Sapiens
EFLQQEVEA

SEQ ID NO: 1012126 - protein, 9 aa, Homo Sapiens
MTNIFWMDK

SEQ ID NO: 1012127 - protein, 9 aa, Homo Sapiens
SRVPVQVRS

SEQ ID NO: 1012128 - protein, 9 aa, Homo Sapiens
LSKPNENEA

SEQ ID NO: 1012129 - protein, 9 aa, Homo Sapiens
LPPAALISS

SEQ ID NO: 1012130 - protein, 9 aa, Homo Sapiens
TQANSMEGL

SEQ ID NO: 1012131 - protein, 9 aa, Homo Sapiens
GKSKECWEE

SEQ ID NO: 1012132 - protein, 9 aa, Homo Sapiens
SLRSRASPG

SEQ ID NO: 1012133 - protein, 9 aa, Homo Sapiens
KHTKCPQNV

SEQ ID NO: 1012134 - protein, 9 aa, Homo Sapiens
SMPHEVEIA

SEQ ID NO: 1012135 - protein, 9 aa, Homo Sapiens
KLKCQVLLS

SEQ ID NO: 1012136 - protein, 9 aa, Homo Sapiens
PKDKEEDLE

SEQ ID NO: 1012137 - protein, 9 aa, Homo Sapiens
ISLQDYEEF

SEQ ID NO: 1012138 - protein, 9 aa, Homo Sapiens
EVADFDFFP

SEQ ID NO: 1012139 - protein, 9 aa, Homo Sapiens
TGLQETQLA

SEQ ID NO: 1012140 - protein, 9 aa, Homo Sapiens
VFLLSIVLH

SEQ ID NO: 1012141 - protein, 9 aa, Homo Sapiens
PEKVFSECI

SEQ ID NO: 1012142 - protein, 9 aa, Homo Sapiens
ENMGRFGSR

SEQ ID NO: 1012143 - protein, 9 aa, Homo Sapiens
PISEGGLVA

SEQ ID NO: 1012144 - protein, 9 aa, Homo Sapiens
SSPCGEQFK

SEQ ID NO: 1012145 - protein, 9 aa, Homo Sapiens
LKHTKCPQN

SEQ ID NO: 1012146 - protein, 9 aa, Homo Sapiens
FFEQFCKIY

SEQ ID NO: 1012147 - protein, 9 aa, Homo Sapiens
LHCINPGEN

SEQ ID NO: 1012148 - protein, 9 aa, Homo Sapiens
ASLPSVQTW

SEQ ID NO: 1012149 - protein, 9 aa, Homo Sapiens
FLWSLRSRA

SEQ ID NO: 1012150 - protein, 9 aa, Homo Sapiens
FVDLLNGEN

SEQ ID NO: 1012151 - protein, 9 aa, Homo Sapiens
TRSTRPTPV

SEQ ID NO: 1012152 - protein, 9 aa, Homo Sapiens
ATGASGGPT

SEQ ID NO: 1012153 - protein, 9 aa, Homo Sapiens
ELFAVNMNR

SEQ ID NO: 1012154 - protein, 9 aa, Homo Sapiens
EFVTSNESP

SEQ ID NO: 1012155 - protein, 9 aa, Homo Sapiens
VNHKGYRKL

SEQ ID NO: 1012156 - protein, 9 aa, Homo Sapiens
LVTCVPRCT

SEQ ID NO: 1012157 - protein, 9 aa, Homo Sapiens
NEPRIFSDT

SEQ ID NO: 1012158 - protein, 9 aa, Homo Sapiens
TPVPASENS

SEQ ID NO: 1012159 - protein, 9 aa, Homo Sapiens
AVPSSTRVG

SEQ ID NO: 1012160 - protein, 9 aa, Homo Sapiens
MENDFSEGV

SEQ ID NO: 1012161 - protein, 9 aa, Homo Sapiens
EIKMLLSGI

SEQ ID NO: 1012162 - protein, 9 aa, Homo Sapiens
EYEKLRDIS

SEQ ID NO: 1012163 - protein, 9 aa, Homo Sapiens
SSITASLQF

SEQ ID NO: 1012164 - protein, 9 aa, Homo Sapiens
FPLPGPKQT

SEQ ID NO: 1012165 - protein, 9 aa, Homo Sapiens
FNDPTTSVC

SEQ ID NO: 1012166 - protein, 9 aa, Homo Sapiens
VFFWQTWHD

SEQ ID NO: 1012167 - protein, 9 aa, Homo Sapiens
TSIEQILNN

SEQ ID NO: 1012168 - protein, 9 aa, Homo Sapiens
GMMLWRYSE

SEQ ID NO: 1012169 - protein, 9 aa, Homo Sapiens
RVPSTKERW

SEQ ID NO: 1012170 - protein, 9 aa, Homo Sapiens
QVAGALIGV

SEQ ID NO: 1012171 - protein, 9 aa, Homo Sapiens
RVRRWQKLE

SEQ ID NO: 1012172 - protein, 9 aa, Homo Sapiens
LQRTQANSM

SEQ ID NO: 1012173 - protein, 9 aa, Homo Sapiens
QIEDEAHPV

SEQ ID NO: 1012174 - protein, 9 aa, Homo Sapiens
AAWNKEDFS

SEQ ID NO: 1012175 - protein, 9 aa, Homo Sapiens
HCINPGENG

SEQ ID NO: 1012176 - protein, 9 aa, Homo Sapiens
VYGVMKAYT

SEQ ID NO: 1012177 - protein, 9 aa, Homo Sapiens
KDSLDPDPC

SEQ ID NO: 1012178 - protein, 9 aa, Homo Sapiens
LGDLREAAT

SEQ ID NO: 1012179 - protein, 9 aa, Homo Sapiens
PLVVNENCM

SEQ ID NO: 1012180 - protein, 9 aa, Homo Sapiens
LEVALIRAS

SEQ ID NO: 1012181 - protein, 9 aa, Homo Sapiens
KKQLQAGFF

SEQ ID NO: 1012182 - protein, 9 aa, Homo Sapiens
GAEKQKEAK

SEQ ID NO: 1012183 - protein, 9 aa, Homo Sapiens
ARGDSEDKR

SEQ ID NO: 1012184 - protein, 9 aa, Homo Sapiens
CYDPEIKML

SEQ ID NO: 1012185 - protein, 9 aa, Homo Sapiens
VENFTIIII

SEQ ID NO: 1012186 - protein, 9 aa, Homo Sapiens
VNLLKTIGI

SEQ ID NO: 1012187 - protein, 9 aa, Homo Sapiens
NAECRGKKE

SEQ ID NO: 1012188 - protein, 9 aa, Homo Sapiens
CNFSTLGGQ

SEQ ID NO: 1012189 - protein, 9 aa, Homo Sapiens
ELQNVLDKY

SEQ ID NO: 1012190 - protein, 9 aa, Homo Sapiens
SSSQQPKSL

SEQ ID NO: 1012191 - protein, 9 aa, Homo Sapiens
KQEQMFAFR

SEQ ID NO: 1012192 - protein, 9 aa, Homo Sapiens
AEKQKEAKS

SEQ ID NO: 1012193 - protein, 9 aa, Homo Sapiens
PPSPLAPTP

SEQ ID NO: 1012194 - protein, 9 aa, Homo Sapiens
LDDDYFENE

SEQ ID NO: 1012195 - protein, 9 aa, Homo Sapiens
RKVEVNSIV

SEQ ID NO: 1012196 - protein, 9 aa, Homo Sapiens
SNLHVKPCG

SEQ ID NO: 1012197 - protein, 9 aa, Homo Sapiens
PASFPVKGL

SEQ ID NO: 1012198 - protein, 9 aa, Homo Sapiens
PVLENVSYI

SEQ ID NO: 1012199 - protein, 9 aa, Homo Sapiens
IVRDRNAEI

SEQ ID NO: 1012200 - protein, 9 aa, Homo Sapiens
ENLFVIVFV

SEQ ID NO: 1012201 - protein, 9 aa, Homo Sapiens
LSEKMTYLK

SEQ ID NO: 1012202 - protein, 9 aa, Homo Sapiens
KDDVEFSGE

SEQ ID NO: 1012203 - protein, 9 aa, Homo Sapiens
FYLLVPPFL

SEQ ID NO: 1012204 - protein, 9 aa, Homo Sapiens
ITSSSNLSD

SEQ ID NO: 1012205 - protein, 9 aa, Homo Sapiens
FPHLYLRGQ

SEQ ID NO: 1012206 - protein, 9 aa, Homo Sapiens
PKAMLPLYD

SEQ ID NO: 1012207 - protein, 9 aa, Homo Sapiens
YVCTECGKS

SEQ ID NO: 1012208 - protein, 9 aa, Homo Sapiens
PWDDNEVEW

SEQ ID NO: 1012209 - protein, 9 aa, Homo Sapiens
RSLTLFTAP

SEQ ID NO: 1012210 - protein, 9 aa, Homo Sapiens
GRLGDLREA

SEQ ID NO: 1012211 - protein, 9 aa, Homo Sapiens
HLFALRLLD

SEQ ID NO: 1012212 - protein, 9 aa, Homo Sapiens
FFYGIVVGL

SEQ ID NO: 1012213 - protein, 9 aa, Homo Sapiens
RGSPGSPGS

SEQ ID NO: 1012214 - protein, 9 aa, Homo Sapiens
GTLSKDNLL

SEQ ID NO: 1012215 - protein, 9 aa, Homo Sapiens
VNGKKMKSK

SEQ ID NO: 1012216 - protein, 9 aa, Homo Sapiens
RKIFGKDAK

SEQ ID NO: 1012217 - protein, 9 aa, Homo Sapiens
QTAKIMTPP

SEQ ID NO: 1012218 - protein, 9 aa, Homo Sapiens
KATPGRRPR

SEQ ID NO: 1012219 - protein, 9 aa, Homo Sapiens
SGENLKKAS

SEQ ID NO: 1012220 - protein, 9 aa, Homo Sapiens
LVISSIAAL

SEQ ID NO: 1012221 - protein, 9 aa, Homo Sapiens
GPPRASFAM

SEQ ID NO: 1012222 - protein, 9 aa, Homo Sapiens
YSLKDYVSV

SEQ ID NO: 1012223 - protein, 9 aa, Homo Sapiens
SASAPDTVL

SEQ ID NO: 1012224 - protein, 9 aa, Homo Sapiens
QLQQYNSPG

SEQ ID NO: 1012225 - protein, 9 aa, Homo Sapiens
KLKQSLPPR

SEQ ID NO: 1012226 - protein, 9 aa, Homo Sapiens
FSTLGGQGR

SEQ ID NO: 1012227 - protein, 9 aa, Homo Sapiens
LGTIFSASM

SEQ ID NO: 1012228 - protein, 9 aa, Homo Sapiens
FENDLNKLL

SEQ ID NO: 1012229 - protein, 9 aa, Homo Sapiens
IGGHDSLSP

SEQ ID NO: 1012230 - protein, 9 aa, Homo Sapiens
NYYRLRTER

SEQ ID NO: 1012231 - protein, 9 aa, Homo Sapiens
PMLNLLIYS

SEQ ID NO: 1012232 - protein, 9 aa, Homo Sapiens
NIFWMDKVI

SEQ ID NO: 1012233 - protein, 9 aa, Homo Sapiens
FSRCKKIGA

SEQ ID NO: 1012234 - protein, 9 aa, Homo Sapiens
RDGVYTLND

SEQ ID NO: 1012235 - protein, 9 aa, Homo Sapiens
LKEGDLIVK

SEQ ID NO: 1012236 - protein, 9 aa, Homo Sapiens
SATDPWHLN

SEQ ID NO: 1012237 - protein, 9 aa, Homo Sapiens
LPGFKDWQC

SEQ ID NO: 1012238 - protein, 9 aa, Homo Sapiens
SKETGLQET

SEQ ID NO: 1012239 - protein, 9 aa, Homo Sapiens
YPVLVSERI

SEQ ID NO: 1012240 - protein, 9 aa, Homo Sapiens
ALIRASPRG

SEQ ID NO: 1012241 - protein, 9 aa, Homo Sapiens
MQDMEHLQR

SEQ ID NO: 1012242 - protein, 9 aa, Homo Sapiens
DNCGRVNSS

SEQ ID NO: 1012243 - protein, 9 aa, Homo Sapiens
NQRFPASYY

SEQ ID NO: 1012244 - protein, 9 aa, Homo Sapiens
PFSRITSDP

SEQ ID NO: 1012245 - protein, 9 aa, Homo Sapiens
GNPVLSLRS

SEQ ID NO: 1012246 - protein, 9 aa, Homo Sapiens
NMRETCVNL

SEQ ID NO: 1012247 - protein, 9 aa, Homo Sapiens
FKLDKGQKK

SEQ ID NO: 1012248 - protein, 9 aa, Homo Sapiens
QLAPGQDVW

SEQ ID NO: 1012249 - protein, 9 aa, Homo Sapiens
EYYELIRKL

SEQ ID NO: 1012250 - protein, 9 aa, Homo Sapiens
YHNSEQKRM

SEQ ID NO: 1012251 - protein, 9 aa, Homo Sapiens
TKNTTLQSL

SEQ ID NO: 1012252 - protein, 9 aa, Homo Sapiens
LSLRTEDLV

SEQ ID NO: 1012253 - protein, 9 aa, Homo Sapiens
VLRVPSTKE

SEQ ID NO: 1012254 - protein, 9 aa, Homo Sapiens
KNCSGIGKV

SEQ ID NO: 1012255 - protein, 9 aa, Homo Sapiens
IAHSPEVKQ

SEQ ID NO: 1012256 - protein, 9 aa, Homo Sapiens
KQSKAKISS

SEQ ID NO: 1012257 - protein, 9 aa, Homo Sapiens
PTIAEGSSP

SEQ ID NO: 1012258 - protein, 9 aa, Homo Sapiens
QNLSLIFLA

SEQ ID NO: 1012259 - protein, 9 aa, Homo Sapiens
LTLQPRGKD

SEQ ID NO: 1012260 - protein, 9 aa, Homo Sapiens
DFSEGVNPS

SEQ ID NO: 1012261 - protein, 9 aa, Homo Sapiens
LVSEASITH

SEQ ID NO: 1012262 - protein, 9 aa, Homo Sapiens
KCPQNVDSL

SEQ ID NO: 1012263 - protein, 9 aa, Homo Sapiens
SEPMPVVLK

SEQ ID NO: 1012264 - protein, 9 aa, Homo Sapiens
LHHLDSQPA

SEQ ID NO: 1012265 - protein, 9 aa, Homo Sapiens
EAFSRCKKI

SEQ ID NO: 1012266 - protein, 9 aa, Homo Sapiens
EHCGSVDFL

SEQ ID NO: 1012267 - protein, 9 aa, Homo Sapiens
EERKSKRRV

SEQ ID NO: 1012268 - protein, 9 aa, Homo Sapiens
IPAQRLGRY

SEQ ID NO: 1012269 - protein, 9 aa, Homo Sapiens
DCFVAICYP

SEQ ID NO: 1012270 - protein, 9 aa, Homo Sapiens
YSTLIFMYL

SEQ ID NO: 1012271 - protein, 9 aa, Homo Sapiens
FREKKEQRG

SEQ ID NO: 1012272 - protein, 9 aa, Homo Sapiens
IKKILPGTF

SEQ ID NO: 1012273 - protein, 9 aa, Homo Sapiens
YPSTMAFSV

SEQ ID NO: 1012274 - protein, 9 aa, Homo Sapiens
LRKKLKSIN

SEQ ID NO: 1012275 - protein, 9 aa, Homo Sapiens
SWSTDVKGE

SEQ ID NO: 1012276 - protein, 9 aa, Homo Sapiens
LTLCLCLIF

SEQ ID NO: 1012277 - protein, 9 aa, Homo Sapiens
FSLVTIPKM

SEQ ID NO: 1012278 - protein, 9 aa, Homo Sapiens
AAISMGSAV

SEQ ID NO: 1012279 - protein, 9 aa, Homo Sapiens
SENSFREKK

SEQ ID NO: 1012280 - protein, 9 aa, Homo Sapiens
PPLVISSIA

SEQ ID NO: 1012281 - protein, 9 aa, Homo Sapiens
VTELRSQVQ

SEQ ID NO: 1012282 - protein, 9 aa, Homo Sapiens
PASYYHAVE

SEQ ID NO: 1012283 - protein, 9 aa, Homo Sapiens
NERTQGIFS

SEQ ID NO: 1012284 - protein, 9 aa, Homo Sapiens
IKENSRCLL

SEQ ID NO: 1012285 - protein, 9 aa, Homo Sapiens
KEPRDSRPR

SEQ ID NO: 1012286 - protein, 9 aa, Homo Sapiens
IVKVNKKNV

SEQ ID NO: 1012287 - protein, 9 aa, Homo Sapiens
AIISLAECI

SEQ ID NO: 1012288 - protein, 9 aa, Homo Sapiens
ISIPHFLLW

SEQ ID NO: 1012289 - protein, 9 aa, Homo Sapiens
RGGQDIVVG

SEQ ID NO: 1012290 - protein, 9 aa, Homo Sapiens
RSAPGQLSS

SEQ ID NO: 1012291 - protein, 9 aa, Homo Sapiens
QMHSGLYQE

SEQ ID NO: 1012292 - protein, 9 aa, Homo Sapiens
EVVKKMNSE

SEQ ID NO: 1012293 - protein, 9 aa, Homo Sapiens
AHSILRPGW

SEQ ID NO: 1012294 - protein, 9 aa, Homo Sapiens
HHHHHHHRQ

SEQ ID NO: 1012295 - protein, 9 aa, Homo Sapiens
SSEESSQED

SEQ ID NO: 1012296 - protein, 9 aa, Homo Sapiens
RKAFRGITN

SEQ ID NO: 1012297 - protein, 9 aa, Homo Sapiens
GGVEDEVIL

SEQ ID NO: 1012298 - protein, 9 aa, Homo Sapiens
SRWYFGRLA

SEQ ID NO: 1012299 - protein, 9 aa, Homo Sapiens
VTRVKAVKI

SEQ ID NO: 1012300 - protein, 9 aa, Homo Sapiens
FALRLLDYE

SEQ ID NO: 1012301 - protein, 9 aa, Homo Sapiens
LYMENDFSE

SEQ ID NO: 1012302 - protein, 9 aa, Homo Sapiens
LFPLPGPKQ

SEQ ID NO: 1012303 - protein, 9 aa, Homo Sapiens
SVSFHCDNG

SEQ ID NO: 1012304 - protein, 9 aa, Homo Sapiens
VTDKNISLH

SEQ ID NO: 1012305 - protein, 9 aa, Homo Sapiens
GDYNYDQDD

SEQ ID NO: 1012306 - protein, 9 aa, Homo Sapiens
DDVLFVCEE

SEQ ID NO: 1012307 - protein, 9 aa, Homo Sapiens
SMQNRIAHS

SEQ ID NO: 1012308 - protein, 9 aa, Homo Sapiens
EDPAVGVIV

SEQ ID NO: 1012309 - protein, 9 aa, Homo Sapiens
TSGLVITSS

SEQ ID NO: 1012310 - protein, 9 aa, Homo Sapiens
LMLMALDCY

SEQ ID NO: 1012311 - protein, 9 aa, Homo Sapiens
LLKNLEEGQ

SEQ ID NO: 1012312 - protein, 9 aa, Homo Sapiens
ITTLFLPIF

SEQ ID NO: 1012313 - protein, 9 aa, Homo Sapiens
ARVLYTHSQ

SEQ ID NO: 1012314 - protein, 9 aa, Homo Sapiens
GGRQGSHYN

SEQ ID NO: 1012315 - protein, 9 aa, Homo Sapiens
MVGIRARTG

SEQ ID NO: 1012316 - protein, 9 aa, Homo Sapiens
LKCQVKDHK

SEQ ID NO: 1012317 - protein, 9 aa, Homo Sapiens
IPQKIFLQD

SEQ ID NO: 1012318 - protein, 9 aa, Homo Sapiens
IPFSRITSD

SEQ ID NO: 1012319 - protein, 9 aa, Homo Sapiens
DFAVSGQWE

SEQ ID NO: 1012320 - protein, 9 aa, Homo Sapiens
MPTTGVILL

SEQ ID NO: 1012321 - protein, 9 aa, Homo Sapiens
FWNFNSNPL

SEQ ID NO: 1012322 - protein, 9 aa, Homo Sapiens
NFSQRKQIS

SEQ ID NO: 1012323 - protein, 9 aa, Homo Sapiens
SSRKEATEK

SEQ ID NO: 1012324 - protein, 9 aa, Homo Sapiens
EDRRVYGKT

SEQ ID NO: 1012325 - protein, 9 aa, Homo Sapiens
KLSSQGQDR

SEQ ID NO: 1012326 - protein, 9 aa, Homo Sapiens
LAKLQRTQA

SEQ ID NO: 1012327 - protein, 9 aa, Homo Sapiens
IVFVSTSLF

SEQ ID NO: 1012328 - protein, 9 aa, Homo Sapiens
GKQPEQPPL

SEQ ID NO: 1012329 - protein, 9 aa, Homo Sapiens
LATMKSRWS

SEQ ID NO: 1012330 - protein, 9 aa, Homo Sapiens
DLTENALED

SEQ ID NO: 1012331 - protein, 9 aa, Homo Sapiens
LSELGRLGD

SEQ ID NO: 1012332 - protein, 9 aa, Homo Sapiens
EMVEKTRRF

SEQ ID NO: 1012333 - protein, 9 aa, Homo Sapiens
FFAAYLTLA

SEQ ID NO: 1012334 - protein, 9 aa, Homo Sapiens
NRKNHSVSR

SEQ ID NO: 1012335 - protein, 9 aa, Homo Sapiens
WVSAGGRGP

SEQ ID NO: 1012336 - protein, 9 aa, Homo Sapiens
SPGHAVCCF

SEQ ID NO: 1012337 - protein, 9 aa, Homo Sapiens
TNKAQAIET

SEQ ID NO: 1012338 - protein, 9 aa, Homo Sapiens
ERAKEAAIS

SEQ ID NO: 1012339 - protein, 9 aa, Homo Sapiens
YPPMPTRPV

SEQ ID NO: 1012340 - protein, 9 aa, Homo Sapiens
TFIDKVRFL

SEQ ID NO: 1012341 - protein, 9 aa, Homo Sapiens
MDFKNNYTC

SEQ ID NO: 1012342 - protein, 9 aa, Homo Sapiens
KETKVLKIL

SEQ ID NO: 1012343 - protein, 9 aa, Homo Sapiens
GRVNSSEQG

SEQ ID NO: 1012344 - protein, 9 aa, Homo Sapiens
KIQNKNCSG

SEQ ID NO: 1012345 - protein, 9 aa, Homo Sapiens
HMVLGSLVT

SEQ ID NO: 1012346 - protein, 9 aa, Homo Sapiens
SDWDWDRRG

SEQ ID NO: 1012347 - protein, 9 aa, Homo Sapiens
ENSLYLFAA

SEQ ID NO: 1012348 - protein, 9 aa, Homo Sapiens
FPRNADIDQ

SEQ ID NO: 1012349 - protein, 9 aa, Homo Sapiens
FWKKENRRN

SEQ ID NO: 1012350 - protein, 9 aa, Homo Sapiens
WRNLEGESP

SEQ ID NO: 1012351 - protein, 9 aa, Homo Sapiens
PKASPPDLK

SEQ ID NO: 1012352 - protein, 9 aa, Homo Sapiens
VRTTEEGII

SEQ ID NO: 1012353 - protein, 9 aa, Homo Sapiens
PSVQTWIKT

SEQ ID NO: 1012354 - protein, 9 aa, Homo Sapiens
TGRLAWWND

SEQ ID NO: 1012355 - protein, 9 aa, Homo Sapiens
TSNVAITTL

SEQ ID NO: 1012356 - protein, 9 aa, Homo Sapiens
KKYAASKFI

SEQ ID NO: 1012357 - protein, 9 aa, Homo Sapiens
DKRGPGQKT

SEQ ID NO: 1012358 - protein, 9 aa, Homo Sapiens
DYFTFAFTF

SEQ ID NO: 1012359 - protein, 9 aa, Homo Sapiens
EQVNAVTLS

SEQ ID NO: 1012360 - protein, 9 aa, Homo Sapiens
STTMSVDGH

SEQ ID NO: 1012361 - protein, 9 aa, Homo Sapiens
EKKEDTKMY

SEQ ID NO: 1012362 - protein, 9 aa, Homo Sapiens
SIIRMNRNR

SEQ ID NO: 1012363 - protein, 9 aa, Homo Sapiens
PLFRDQEDA

SEQ ID NO: 1012364 - protein, 9 aa, Homo Sapiens
LWQHNKKSL

SEQ ID NO: 1012365 - protein, 9 aa, Homo Sapiens
IVDFVKDHR

SEQ ID NO: 1012366 - protein, 9 aa, Homo Sapiens
AKKQEEEKE

SEQ ID NO: 1012367 - protein, 9 aa, Homo Sapiens
DQACGTMNT

SEQ ID NO: 1012368 - protein, 9 aa, Homo Sapiens
LRGAGRAAG

SEQ ID NO: 1012369 - protein, 9 aa, Homo Sapiens
AHTDCLLLV

SEQ ID NO: 1012370 - protein, 9 aa, Homo Sapiens
QVMEDKFDL

SEQ ID NO: 1012371 - protein, 9 aa, Homo Sapiens
SQSHVFFLD

SEQ ID NO: 1012372 - protein, 9 aa, Homo Sapiens
TAILIALSK

SEQ ID NO: 1012373 - protein, 9 aa, Homo Sapiens
QGSCAGLHE

SEQ ID NO: 1012374 - protein, 9 aa, Homo Sapiens
CVGAAPASL

SEQ ID NO: 1012375 - protein, 9 aa, Homo Sapiens
STHPLKRSP

SEQ ID NO: 1012376 - protein, 9 aa, Homo Sapiens
PVHISILQV

SEQ ID NO: 1012377 - protein, 9 aa, Homo Sapiens
YTTLALQQA

SEQ ID NO: 1012378 - protein, 9 aa, Homo Sapiens
KSDVGPNGQ

SEQ ID NO: 1012379 - protein, 9 aa, Homo Sapiens
SEMTTGSPP

SEQ ID NO: 1012380 - protein, 9 aa, Homo Sapiens
MEDKFDLDS

SEQ ID NO: 1012381 - protein, 9 aa, Homo Sapiens
EEDEDDFYT

SEQ ID NO: 1012382 - protein, 9 aa, Homo Sapiens
PCSPCRLCA

SEQ ID NO: 1012383 - protein, 9 aa, Homo Sapiens
IRPTYAGSN

SEQ ID NO: 1012384 - protein, 9 aa, Homo Sapiens
VEAFIRAKL

SEQ ID NO: 1012385 - protein, 9 aa, Homo Sapiens
HKTTHYYQL

SEQ ID NO: 1012386 - protein, 9 aa, Homo Sapiens
LSLPTVGAS

SEQ ID NO: 1012387 - protein, 9 aa, Homo Sapiens
MESLLNELE

SEQ ID NO: 1012388 - protein, 9 aa, Homo Sapiens
GRLKQQTPS

SEQ ID NO: 1012389 - protein, 9 aa, Homo Sapiens
FAKNKKSQR

SEQ ID NO: 1012390 - protein, 9 aa, Homo Sapiens
KMAHGYGEK

SEQ ID NO: 1012391 - protein, 9 aa, Homo Sapiens
PRTPTIVLV

SEQ ID NO: 1012392 - protein, 9 aa, Homo Sapiens
SLMNILPTV

SEQ ID NO: 1012393 - protein, 9 aa, Homo Sapiens
ITQKKCKVT

SEQ ID NO: 1012394 - protein, 9 aa, Homo Sapiens
IDGQPGVPG

SEQ ID NO: 1012395 - protein, 9 aa, Homo Sapiens
NYPTSSSTS

SEQ ID NO: 1012396 - protein, 9 aa, Homo Sapiens
YETNSALKT

SEQ ID NO: 1012397 - protein, 9 aa, Homo Sapiens
EDTKMYLLA

SEQ ID NO: 1012398 - protein, 9 aa, Homo Sapiens
GSGFSVSDS

SEQ ID NO: 1012399 - protein, 9 aa, Homo Sapiens
KKLTDNQTL

SEQ ID NO: 1012400 - protein, 9 aa, Homo Sapiens
AASPRRTLS

SEQ ID NO: 1012401 - protein, 9 aa, Homo Sapiens
YNLRNAEVK

SEQ ID NO: 1012402 - protein, 9 aa, Homo Sapiens
GATFRLKNG

SEQ ID NO: 1012403 - protein, 9 aa, Homo Sapiens
THRGTYRCF

SEQ ID NO: 1012404 - protein, 9 aa, Homo Sapiens
LRLDFLVRS

SEQ ID NO: 1012405 - protein, 9 aa, Homo Sapiens
CSLTEKEIA

SEQ ID NO: 1012406 - protein, 9 aa, Homo Sapiens
GTSPKLDTA

SEQ ID NO: 1012407 - protein, 9 aa, Homo Sapiens
INEDGQEVL

SEQ ID NO: 1012408 - protein, 9 aa, Homo Sapiens
ERRKNGVLR

SEQ ID NO: 1012409 - protein, 9 aa, Homo Sapiens
RFLSPRSLM

SEQ ID NO: 1012410 - protein, 9 aa, Homo Sapiens
EPENLIVTG

SEQ ID NO: 1012411 - protein, 9 aa, Homo Sapiens
AGNDFVESS

SEQ ID NO: 1012412 - protein, 9 aa, Homo Sapiens
CTNSPYEEP

SEQ ID NO: 1012413 - protein, 9 aa, Homo Sapiens
DCVGWALDV

SEQ ID NO: 1012414 - protein, 9 aa, Homo Sapiens
QAEQVNAVT

SEQ ID NO: 1012415 - protein, 9 aa, Homo Sapiens
TSYNDSAWQ

SEQ ID NO: 1012416 - protein, 9 aa, Homo Sapiens
VGGDQKKSK

SEQ ID NO: 1012417 - protein, 9 aa, Homo Sapiens
NRDQVPYSI

SEQ ID NO: 1012418 - protein, 9 aa, Homo Sapiens
SCGLGKKKR

SEQ ID NO: 1012419 - protein, 9 aa, Homo Sapiens
QKKCKVTAT

SEQ ID NO: 1012420 - protein, 9 aa, Homo Sapiens
QSGQWAGSS

SEQ ID NO: 1012421 - protein, 9 aa, Homo Sapiens
SSDEKGIFP

SEQ ID NO: 1012422 - protein, 9 aa, Homo Sapiens
TLCNLNDFR

SEQ ID NO: 1012423 - protein, 9 aa, Homo Sapiens
QLLQQQQQT

SEQ ID NO: 1012424 - protein, 9 aa, Homo Sapiens
GQLKNKYED

SEQ ID NO: 1012425 - protein, 9 aa, Homo Sapiens
KKADIPKRP

SEQ ID NO: 1012426 - protein, 9 aa, Homo Sapiens
GFSKMNRFR

SEQ ID NO: 1012427 - protein, 9 aa, Homo Sapiens
PCTWMRSGT

SEQ ID NO: 1012428 - protein, 9 aa, Homo Sapiens
KRSPSPRAV

SEQ ID NO: 1012429 - protein, 9 aa, Homo Sapiens
FGYRFLSPR

SEQ ID NO: 1012430 - protein, 9 aa, Homo Sapiens
HGVVLRLDF

SEQ ID NO: 1012431 - protein, 9 aa, Homo Sapiens
RVDTMDNSA

SEQ ID NO: 1012432 - protein, 9 aa, Homo Sapiens
RPLLVEYLI

SEQ ID NO: 1012433 - protein, 9 aa, Homo Sapiens
PKRFLAVLK

SEQ ID NO: 1012434 - protein, 9 aa, Homo Sapiens
CSCIKRKTE

SEQ ID NO: 1012435 - protein, 9 aa, Homo Sapiens
LLNELEKQE

SEQ ID NO: 1012436 - protein, 9 aa, Homo Sapiens
AYFYSGIDI

SEQ ID NO: 1012437 - protein, 9 aa, Homo Sapiens
MIAIYVLLT

SEQ ID NO: 1012438 - protein, 9 aa, Homo Sapiens
IVLQRIDLI

SEQ ID NO: 1012439 - protein, 9 aa, Homo Sapiens
FQVVVSTTM

SEQ ID NO: 1012440 - protein, 9 aa, Homo Sapiens
FQSKKQFDA

SEQ ID NO: 1012441 - protein, 9 aa, Homo Sapiens
PRKYLFTML

SEQ ID NO: 1012442 - protein, 9 aa, Homo Sapiens
ACGTMNTVD

SEQ ID NO: 1012443 - protein, 9 aa, Homo Sapiens
LRSSVKPSS

SEQ ID NO: 1012444 - protein, 9 aa, Homo Sapiens
GSRVGGGGT

SEQ ID NO: 1012445 - protein, 9 aa, Homo Sapiens
NEKIKIEEC

SEQ ID NO: 1012446 - protein, 9 aa, Homo Sapiens
ANEKITPSP

SEQ ID NO: 1012447 - protein, 9 aa, Homo Sapiens
SPYNGSLFT

SEQ ID NO: 1012448 - protein, 9 aa, Homo Sapiens
GSILLITGS

SEQ ID NO: 1012449 - protein, 9 aa, Homo Sapiens
LNISTNTSE

SEQ ID NO: 1012450 - protein, 9 aa, Homo Sapiens
KTQDLAPLE

SEQ ID NO: 1012451 - protein, 9 aa, Homo Sapiens
SISVEHGQW

SEQ ID NO: 1012452 - protein, 9 aa, Homo Sapiens
YDHKAMVSF

SEQ ID NO: 1012453 - protein, 9 aa, Homo Sapiens
LDIQDRINR

SEQ ID NO: 1012454 - protein, 9 aa, Homo Sapiens
RPVCCDPCF

SEQ ID NO: 1012455 - protein, 9 aa, Homo Sapiens
PPPPSPPPH

SEQ ID NO: 1012456 - protein, 9 aa, Homo Sapiens
FTFAFTFEN

SEQ ID NO: 1012457 - protein, 9 aa, Homo Sapiens
QGHLCFYIP

SEQ ID NO: 1012458 - protein, 9 aa, Homo Sapiens
VYGQEDFLY

SEQ ID NO: 1012459 - protein, 9 aa, Homo Sapiens
LNSSLKSRN

SEQ ID NO: 1012460 - protein, 9 aa, Homo Sapiens
QGTGLQGAS

SEQ ID NO: 1012461 - protein, 9 aa, Homo Sapiens
IQFHLDPAG

SEQ ID NO: 1012462 - protein, 9 aa, Homo Sapiens
TKAARKSAL

SEQ ID NO: 1012463 - protein, 9 aa, Homo Sapiens
LSGKEGSET

SEQ ID NO: 1012464 - protein, 9 aa, Homo Sapiens
YAMAANGLF

SEQ ID NO: 1012465 - protein, 9 aa, Homo Sapiens
QPPHYTTLA

SEQ ID NO: 1012466 - protein, 9 aa, Homo Sapiens
ECPLHCEIC

SEQ ID NO: 1012467 - protein, 9 aa, Homo Sapiens
LVEHQAILF

SEQ ID NO: 1012468 - protein, 9 aa, Homo Sapiens
KEEYSAMRD

SEQ ID NO: 1012469 - protein, 9 aa, Homo Sapiens
GSKKNIKKD

SEQ ID NO: 1012470 - protein, 9 aa, Homo Sapiens
NFSGQGDPG

SEQ ID NO: 1012471 - protein, 9 aa, Homo Sapiens
AGPPDLPGP

SEQ ID NO: 1012472 - protein, 9 aa, Homo Sapiens
KKNIKKDAR

SEQ ID NO: 1012473 - protein, 9 aa, Homo Sapiens
DNQTLTMIK

SEQ ID NO: 1012474 - protein, 9 aa, Homo Sapiens
ATHRGTYRC

SEQ ID NO: 1012475 - protein, 9 aa, Homo Sapiens
LEGDVNSAK

SEQ ID NO: 1012476 - protein, 9 aa, Homo Sapiens
VKIDTALVK

SEQ ID NO: 1012477 - protein, 9 aa, Homo Sapiens
ASAPCTWMR

SEQ ID NO: 1012478 - protein, 9 aa, Homo Sapiens
FLTEHVRTH

SEQ ID NO: 1012479 - protein, 9 aa, Homo Sapiens
PIIGEGLGS

SEQ ID NO: 1012480 - protein, 9 aa, Homo Sapiens
KKCGKAFTF

SEQ ID NO: 1012481 - protein, 9 aa, Homo Sapiens
KKPMAEVTP

SEQ ID NO: 1012482 - protein, 9 aa, Homo Sapiens
SLHNPNVWD

SEQ ID NO: 1012483 - protein, 9 aa, Homo Sapiens
RDQVPYSIM

SEQ ID NO: 1012484 - protein, 9 aa, Homo Sapiens
TIWNGGSKN

SEQ ID NO: 1012485 - protein, 9 aa, Homo Sapiens
VAELPVSPG

SEQ ID NO: 1012486 - protein, 9 aa, Homo Sapiens
THSLPVSFA

SEQ ID NO: 1012487 - protein, 9 aa, Homo Sapiens
SPPPHIYDF

SEQ ID NO: 1012488 - protein, 9 aa, Homo Sapiens
PHNDLLGHS

SEQ ID NO: 1012489 - protein, 9 aa, Homo Sapiens
QPPTLSLPT

SEQ ID NO: 1012490 - protein, 9 aa, Homo Sapiens
SSNSGSKKK

SEQ ID NO: 1012491 - protein, 9 aa, Homo Sapiens
SSMDKEDQS

SEQ ID NO: 1012492 - protein, 9 aa, Homo Sapiens
LIYNLRNAE

SEQ ID NO: 1012493 - protein, 9 aa, Homo Sapiens
IFDKGQVRF

SEQ ID NO: 1012494 - protein, 9 aa, Homo Sapiens
ATKKMACKD

SEQ ID NO: 1012495 - protein, 9 aa, Homo Sapiens
AAFTDDGRV

SEQ ID NO: 1012496 - protein, 9 aa, Homo Sapiens
SLSTATFYF

SEQ ID NO: 1012497 - protein, 9 aa, Homo Sapiens
AYQLYQNPR

SEQ ID NO: 1012498 - protein, 9 aa, Homo Sapiens
KTKIETMVE

SEQ ID NO: 1012499 - protein, 9 aa, Homo Sapiens
PTLTGLAAT

SEQ ID NO: 1012500 - protein, 9 aa, Homo Sapiens
SDLSLNIST

SEQ ID NO: 1012501 - protein, 9 aa, Homo Sapiens
PLGRPSGQR

SEQ ID NO: 1012502 - protein, 9 aa, Homo Sapiens
LLIRVILSY

SEQ ID NO: 1012503 - protein, 9 aa, Homo Sapiens
AFEAVRDLD

SEQ ID NO: 1012504 - protein, 9 aa, Homo Sapiens
RLKNGVLAY

SEQ ID NO: 1012505 - protein, 9 aa, Homo Sapiens
FRICFHDPS

SEQ ID NO: 1012506 - protein, 9 aa, Homo Sapiens
DNCAGFLWE

SEQ ID NO: 1012507 - protein, 9 aa, Homo Sapiens
YRIFHVWQS

SEQ ID NO: 1012508 - protein, 9 aa, Homo Sapiens
PQANSLDSL

SEQ ID NO: 1012509 - protein, 9 aa, Homo Sapiens
EADKYCLTY

SEQ ID NO: 1012510 - protein, 9 aa, Homo Sapiens
QRESPIEGR

SEQ ID NO: 1012511 - protein, 9 aa, Homo Sapiens
RTLSAPLRS

SEQ ID NO: 1012512 - protein, 9 aa, Homo Sapiens
YNCSCIKRK

SEQ ID NO: 1012513 - protein, 9 aa, Homo Sapiens
KNENCSIIR

SEQ ID NO: 1012514 - protein, 9 aa, Homo Sapiens
CSGPSRVCQ

SEQ ID NO: 1012515 - protein, 9 aa, Homo Sapiens
RQQEGTEDI

SEQ ID NO: 1012516 - protein, 9 aa, Homo Sapiens
RNPLTSASE

SEQ ID NO: 1012517 - protein, 9 aa, Homo Sapiens
MLGASSPEA

SEQ ID NO: 1012518 - protein, 9 aa, Homo Sapiens
DITFSWPQW

SEQ ID NO: 1012519 - protein, 9 aa, Homo Sapiens
EDAFIRGNN

SEQ ID NO: 1012520 - protein, 9 aa, Homo Sapiens
TQPFCCPSW

SEQ ID NO: 1012521 - protein, 9 aa, Homo Sapiens
GSAAERDFA

SEQ ID NO: 1012522 - protein, 9 aa, Homo Sapiens
DCISTGDKI

SEQ ID NO: 1012523 - protein, 9 aa, Homo Sapiens
TNARFDFPE

SEQ ID NO: 1012524 - protein, 9 aa, Homo Sapiens
AVRDLDACA

SEQ ID NO: 1012525 - protein, 9 aa, Homo Sapiens
DFRFSRLTT

SEQ ID NO: 1012526 - protein, 9 aa, Homo Sapiens
VILSSLKSY

SEQ ID NO: 1012527 - protein, 9 aa, Homo Sapiens
FESILKASV

SEQ ID NO: 1012528 - protein, 9 aa, Homo Sapiens
SMRRESGRP

SEQ ID NO: 1012529 - protein, 9 aa, Homo Sapiens
VGAAPASLH

SEQ ID NO: 1012530 - protein, 9 aa, Homo Sapiens
MNTVDIANN

SEQ ID NO: 1012531 - protein, 9 aa, Homo Sapiens
LLENVPNRT

SEQ ID NO: 1012532 - protein, 9 aa, Homo Sapiens
AKRGQKREE

SEQ ID NO: 1012533 - protein, 9 aa, Homo Sapiens
PLTSASEPR

SEQ ID NO: 1012534 - protein, 9 aa, Homo Sapiens
PLGSSIELT

SEQ ID NO: 1012535 - protein, 9 aa, Homo Sapiens
FNGVYQPPI

SEQ ID NO: 1012536 - protein, 9 aa, Homo Sapiens
AEQVMEDKF

SEQ ID NO: 1012537 - protein, 9 aa, Homo Sapiens
LELGEGYSL

SEQ ID NO: 1012538 - protein, 9 aa, Homo Sapiens
LNLEGDVNS

SEQ ID NO: 1012539 - protein, 9 aa, Homo Sapiens
MNILPTVAS

SEQ ID NO: 1012540 - protein, 9 aa, Homo Sapiens
CELELGEGY

SEQ ID NO: 1012541 - protein, 9 aa, Homo Sapiens
KLFLEEGGK

SEQ ID NO: 1012542 - protein, 9 aa, Homo Sapiens
RRALQRWAW

SEQ ID NO: 1012543 - protein, 9 aa, Homo Sapiens
DTMDNSAIK

SEQ ID NO: 1012544 - protein, 9 aa, Homo Sapiens
RPSGQREFV

SEQ ID NO: 1012545 - protein, 9 aa, Homo Sapiens
ILNLEGDVN

SEQ ID NO: 1012546 - protein, 9 aa, Homo Sapiens
MKNTEEKWN

SEQ ID NO: 1012547 - protein, 9 aa, Homo Sapiens
MIFYGYIGI

SEQ ID NO: 1012548 - protein, 9 aa, Homo Sapiens
LGKKKRSVQ

SEQ ID NO: 1012549 - protein, 9 aa, Homo Sapiens
DRLERRVVL

SEQ ID NO: 1012550 - protein, 9 aa, Homo Sapiens
RKLHKEEKL

SEQ ID NO: 1012551 - protein, 9 aa, Homo Sapiens
GRQAGNDFV

SEQ ID NO: 1012552 - protein, 9 aa, Homo Sapiens
PSSPSWASA

SEQ ID NO: 1012553 - protein, 9 aa, Homo Sapiens
TIIDKNDNV

SEQ ID NO: 1012554 - protein, 9 aa, Homo Sapiens
LKKNDTDPT

SEQ ID NO: 1012555 - protein, 9 aa, Homo Sapiens
QVQGILFSS

SEQ ID NO: 1012556 - protein, 9 aa, Homo Sapiens
QASMAPAVA

SEQ ID NO: 1012557 - protein, 9 aa, Homo Sapiens
PRKLHKEEK

SEQ ID NO: 1012558 - protein, 9 aa, Homo Sapiens
PHLSRRLII

SEQ ID NO: 1012559 - protein, 9 aa, Homo Sapiens
IALSKREYE

SEQ ID NO: 1012560 - protein, 9 aa, Homo Sapiens
EAFIRAKLI

SEQ ID NO: 1012561 - protein, 9 aa, Homo Sapiens
TAELERATN

SEQ ID NO: 1012562 - protein, 9 aa, Homo Sapiens
FPLGPATHR

SEQ ID NO: 1012563 - protein, 9 aa, Homo Sapiens
SILQVGETR

SEQ ID NO: 1012564 - protein, 9 aa, Homo Sapiens
VDSDLSLNI

SEQ ID NO: 1012565 - protein, 9 aa, Homo Sapiens
GAREKTQDL

SEQ ID NO: 1012566 - protein, 9 aa, Homo Sapiens
LDDSEYSIQ

SEQ ID NO: 1012567 - protein, 9 aa, Homo Sapiens
LKGKKPLLQ

SEQ ID NO: 1012568 - protein, 9 aa, Homo Sapiens
AERDFAGME

SEQ ID NO: 1012569 - protein, 9 aa, Homo Sapiens
LASSNPQKT

SEQ ID NO: 1012570 - protein, 9 aa, Homo Sapiens
PLRSSVKPS

SEQ ID NO: 1012571 - protein, 9 aa, Homo Sapiens
LYHAKKKIS

SEQ ID NO: 1012572 - protein, 9 aa, Homo Sapiens
QIQECVGFK

SEQ ID NO: 1012573 - protein, 9 aa, Homo Sapiens
SGSKKKKKK

SEQ ID NO: 1012574 - protein, 9 aa, Homo Sapiens
DTFQSKKQF

SEQ ID NO: 1012575 - protein, 9 aa, Homo Sapiens
YKKTTRTSD

SEQ ID NO: 1012576 - protein, 9 aa, Homo Sapiens
AWRRALQRW

SEQ ID NO: 1012577 - protein, 9 aa, Homo Sapiens
LETKIKGKG

SEQ ID NO: 1012578 - protein, 9 aa, Homo Sapiens
DGSTSKFHC

SEQ ID NO: 1012579 - protein, 9 aa, Homo Sapiens
KNLHPSYFC

SEQ ID NO: 1012580 - protein, 9 aa, Homo Sapiens
FFIAVVAYA

SEQ ID NO: 1012581 - protein, 9 aa, Homo Sapiens
QQLEGRGLL

SEQ ID NO: 1012582 - protein, 9 aa, Homo Sapiens
TDTEFFQKF

SEQ ID NO: 1012583 - protein, 9 aa, Homo Sapiens
HQRPRKLHK

SEQ ID NO: 1012584 - protein, 9 aa, Homo Sapiens
LKSMEYFNP

SEQ ID NO: 1012585 - protein, 9 aa, Homo Sapiens
RGGNEPPSP

SEQ ID NO: 1012586 - protein, 9 aa, Homo Sapiens
VGLEEKDPN

SEQ ID NO: 1012587 - protein, 9 aa, Homo Sapiens
SVRGVKGKE

SEQ ID NO: 1012588 - protein, 9 aa, Homo Sapiens
AIQGRQAGN

SEQ ID NO: 1012589 - protein, 9 aa, Homo Sapiens
QKVHVGEKI

SEQ ID NO: 1012590 - protein, 9 aa, Homo Sapiens
VHISILQVG

SEQ ID NO: 1012591 - protein, 9 aa, Homo Sapiens
AILIALSKR

SEQ ID NO: 1012592 - protein, 9 aa, Homo Sapiens
FVKDHRNIK

SEQ ID NO: 1012593 - protein, 9 aa, Homo Sapiens
TGRICASLV

SEQ ID NO: 1012594 - protein, 9 aa, Homo Sapiens
TALVKADNF

SEQ ID NO: 1012595 - protein, 9 aa, Homo Sapiens
AVTDVDKPP

SEQ ID NO: 1012596 - protein, 9 aa, Homo Sapiens
VYREPNVSP

SEQ ID NO: 1012597 - protein, 9 aa, Homo Sapiens
SYETNSALK

SEQ ID NO: 1012598 - protein, 9 aa, Homo Sapiens
FLIGTPGLE

SEQ ID NO: 1012599 - protein, 9 aa, Homo Sapiens
TDVSCPVGI

SEQ ID NO: 1012600 - protein, 9 aa, Homo Sapiens
PRAMATHHP

SEQ ID NO: 1012601 - protein, 9 aa, Homo Sapiens
PKTEQHKLF

SEQ ID NO: 1012602 - protein, 9 aa, Homo Sapiens
SRSSLDLSN

SEQ ID NO: 1012603 - protein, 9 aa, Homo Sapiens
LSQDFPYVH

SEQ ID NO: 1012604 - protein, 9 aa, Homo Sapiens
VQEKPDSSG

SEQ ID NO: 1012605 - protein, 9 aa, Homo Sapiens
IKDLQMQLN

SEQ ID NO: 1012606 - protein, 9 aa, Homo Sapiens
GYRIFHVWQ

SEQ ID NO: 1012607 - protein, 9 aa, Homo Sapiens
VTDVNDNLP

SEQ ID NO: 1012608 - protein, 9 aa, Homo Sapiens
GLECPLHCE

SEQ ID NO: 1012609 - protein, 9 aa, Homo Sapiens
SDVFEMSLV

SEQ ID NO: 1012610 - protein, 9 aa, Homo Sapiens
GYLDDSEYS

SEQ ID NO: 1012611 - protein, 9 aa, Homo Sapiens
EVKLDNEPP

SEQ ID NO: 1012612 - protein, 9 aa, Homo Sapiens
RVGGGGTVR

SEQ ID NO: 1012613 - protein, 9 aa, Homo Sapiens
TTGSPPPPP

SEQ ID NO: 1012614 - protein, 9 aa, Homo Sapiens
KKMACKDPE

SEQ ID NO: 1012615 - protein, 9 aa, Homo Sapiens
FFVEGECCP

SEQ ID NO: 1012616 - protein, 9 aa, Homo Sapiens
ILSYINTGK

SEQ ID NO: 1012617 - protein, 9 aa, Homo Sapiens
SQLFAKNKK

SEQ ID NO: 1012618 - protein, 9 aa, Homo Sapiens
KVTAYFYSG

SEQ ID NO: 1012619 - protein, 9 aa, Homo Sapiens
LFTMLMLGN

SEQ ID NO: 1012620 - protein, 9 aa, Homo Sapiens
NVHKEKIKN

SEQ ID NO: 1012621 - protein, 9 aa, Homo Sapiens
GLPRTPTIV

SEQ ID NO: 1012622 - protein, 9 aa, Homo Sapiens
THQPQQHWI

SEQ ID NO: 1012623 - protein, 9 aa, Homo Sapiens
TNSPYEEPF

SEQ ID NO: 1012624 - protein, 9 aa, Homo Sapiens
KLPSTFTLV

SEQ ID NO: 1012625 - protein, 9 aa, Homo Sapiens
NCSIIRMNR

SEQ ID NO: 1012626 - protein, 9 aa, Homo Sapiens
RKNMDLYHC

SEQ ID NO: 1012627 - protein, 9 aa, Homo Sapiens
PSMRRESGR

SEQ ID NO: 1012628 - protein, 9 aa, Homo Sapiens
LSPPSTMIF

SEQ ID NO: 1012629 - protein, 9 aa, Homo Sapiens
DFYTFHHGI

SEQ ID NO: 1012630 - protein, 9 aa, Homo Sapiens
ISRQQSQVD

SEQ ID NO: 1012631 - protein, 9 aa, Homo Sapiens
TGSPLCIQT

SEQ ID NO: 1012632 - protein, 9 aa, Homo Sapiens
TFQRHHDPK

SEQ ID NO: 1012633 - protein, 9 aa, Homo Sapiens
GEGPEKTCS

SEQ ID NO: 1012634 - protein, 9 aa, Homo Sapiens
GLEEKDPNL

SEQ ID NO: 1012635 - protein, 9 aa, Homo Sapiens
LTLSLPMFL

SEQ ID NO: 1012636 - protein, 9 aa, Homo Sapiens
YDYESYKKT

SEQ ID NO: 1012637 - protein, 9 aa, Homo Sapiens
NYVQYEIKL

SEQ ID NO: 1012638 - protein, 9 aa, Homo Sapiens
GLKRKSPSE

SEQ ID NO: 1012639 - protein, 9 aa, Homo Sapiens
KKVDQLLHF

SEQ ID NO: 1012640 - protein, 9 aa, Homo Sapiens
KLMRTDTSI

SEQ ID NO: 1012641 - protein, 9 aa, Homo Sapiens
ACHPPSWLA

SEQ ID NO: 1012642 - protein, 9 aa, Homo Sapiens
KRKFLSLAS

SEQ ID NO: 1012643 - protein, 9 aa, Homo Sapiens
SFAHTDCLL

SEQ ID NO: 1012644 - protein, 9 aa, Homo Sapiens
YPPPPSPPP

SEQ ID NO: 1012645 - protein, 9 aa, Homo Sapiens
HKLFYVALL

SEQ ID NO: 1012646 - protein, 9 aa, Homo Sapiens
SRNVCASGL

SEQ ID NO: 1012647 - protein, 9 aa, Homo Sapiens
FLYILLSEN

SEQ ID NO: 1012648 - protein, 9 aa, Homo Sapiens
PCFLQEGCC

SEQ ID NO: 1012649 - protein, 9 aa, Homo Sapiens
GPGAGAGIL

SEQ ID NO: 1012650 - protein, 9 aa, Homo Sapiens
ISSLEAQSL

SEQ ID NO: 1012651 - protein, 9 aa, Homo Sapiens
DSVRGVKGK

SEQ ID NO: 1012652 - protein, 9 aa, Homo Sapiens
VNDTDPCTK

SEQ ID NO: 1012653 - protein, 9 aa, Homo Sapiens
NDFRFSRLT

SEQ ID NO: 1012654 - protein, 9 aa, Homo Sapiens
TLLGLECPL

SEQ ID NO: 1012655 - protein, 9 aa, Homo Sapiens
HIVEAFIRA

SEQ ID NO: 1012656 - protein, 9 aa, Homo Sapiens
LPNKAARTA

SEQ ID NO: 1012657 - protein, 9 aa, Homo Sapiens
TTDFPLYFL

SEQ ID NO: 1012658 - protein, 9 aa, Homo Sapiens
ILEIFVMIN

SEQ ID NO: 1012659 - protein, 9 aa, Homo Sapiens
AGQQNNGIR

SEQ ID NO: 1012660 - protein, 9 aa, Homo Sapiens
TGTPVHISI

SEQ ID NO: 1012661 - protein, 9 aa, Homo Sapiens
SISGKEKNT

SEQ ID NO: 1012662 - protein, 9 aa, Homo Sapiens
FILGMIGPF

SEQ ID NO: 1012663 - protein, 9 aa, Homo Sapiens
ESQNRGPAV

SEQ ID NO: 1012664 - protein, 9 aa, Homo Sapiens
CLSLRDITF

SEQ ID NO: 1012665 - protein, 9 aa, Homo Sapiens
INRSTLNEP

SEQ ID NO: 1012666 - protein, 9 aa, Homo Sapiens
SAPLRSSVK

SEQ ID NO: 1012667 - protein, 9 aa, Homo Sapiens
KIKGWYKKC

SEQ ID NO: 1012668 - protein, 9 aa, Homo Sapiens
SSSGNRAIQ

SEQ ID NO: 1012669 - protein, 9 aa, Homo Sapiens
YAGSNSAME

SEQ ID NO: 1012670 - protein, 9 aa, Homo Sapiens
DSAWQKRIP

SEQ ID NO: 1012671 - protein, 9 aa, Homo Sapiens
SRDSVVEDL

SEQ ID NO: 1012672 - protein, 9 aa, Homo Sapiens
TFSWPQWLL

SEQ ID NO: 1012673 - protein, 9 aa, Homo Sapiens
ISLVAGLSA

SEQ ID NO: 1012674 - protein, 9 aa, Homo Sapiens
RQYSAWAES

SEQ ID NO: 1012675 - protein, 9 aa, Homo Sapiens
DWLIAQEDC

SEQ ID NO: 1012676 - protein, 9 aa, Homo Sapiens
IIDKNDNVP

SEQ ID NO: 1012677 - protein, 9 aa, Homo Sapiens
LGFSKMNRF

SEQ ID NO: 1012678 - protein, 9 aa, Homo Sapiens
GFLWEVIKQ

SEQ ID NO: 1012679 - protein, 9 aa, Homo Sapiens
LNDTYSGRR

SEQ ID NO: 1012680 - protein, 9 aa, Homo Sapiens
GIFPAHKTS

SEQ ID NO: 1012681 - protein, 9 aa, Homo Sapiens
VEHGQWRLI

SEQ ID NO: 1012682 - protein, 9 aa, Homo Sapiens
MKTILCGVV

SEQ ID NO: 1012683 - protein, 9 aa, Homo Sapiens
YNVGEKVYG

SEQ ID NO: 1012684 - protein, 9 aa, Homo Sapiens
CGTMNTVDI

SEQ ID NO: 1012685 - protein, 9 aa, Homo Sapiens
KDNVCELVI

SEQ ID NO: 1012686 - protein, 9 aa, Homo Sapiens
NLYPNSSSG

SEQ ID NO: 1012687 - protein, 9 aa, Homo Sapiens
GPEIGPGVG

SEQ ID NO: 1012688 - protein, 9 aa, Homo Sapiens
MHCHYQEYA

SEQ ID NO: 1012689 - protein, 9 aa, Homo Sapiens
NQLKKYKEQ

SEQ ID NO: 1012690 - protein, 9 aa, Homo Sapiens
QLTVVRKIS

SEQ ID NO: 1012691 - protein, 9 aa, Homo Sapiens
YKEQNDLEE

SEQ ID NO: 1012692 - protein, 9 aa, Homo Sapiens
GKALLITPV

SEQ ID NO: 1012693 - protein, 9 aa, Homo Sapiens
RMLGASSPE

SEQ ID NO: 1012694 - protein, 9 aa, Homo Sapiens
GKEGSETRL

SEQ ID NO: 1012695 - protein, 9 aa, Homo Sapiens
FPRCLSTNE

SEQ ID NO: 1012696 - protein, 9 aa, Homo Sapiens
PDSSGGSTQ

SEQ ID NO: 1012697 - protein, 9 aa, Homo Sapiens
ANGLFFQVF

SEQ ID NO: 1012698 - protein, 9 aa, Homo Sapiens
TSASEPRFY

SEQ ID NO: 1012699 - protein, 9 aa, Homo Sapiens
EKLFLEEGG

SEQ ID NO: 1012700 - protein, 9 aa, Homo Sapiens
SLAYLVKKM

SEQ ID NO: 1012701 - protein, 9 aa, Homo Sapiens
FVDIQAESQ

SEQ ID NO: 1012702 - protein, 9 aa, Homo Sapiens
DGQPGVPGQ

SEQ ID NO: 1012703 - protein, 9 aa, Homo Sapiens
AKKKDKKIT

SEQ ID NO: 1012704 - protein, 9 aa, Homo Sapiens
ALSKREYEI

SEQ ID NO: 1012705 - protein, 9 aa, Homo Sapiens
EKITPSPAE

SEQ ID NO: 1012706 - protein, 9 aa, Homo Sapiens
RDRQGSCAG

SEQ ID NO: 1012707 - protein, 9 aa, Homo Sapiens
LHNPNVWDK

SEQ ID NO: 1012708 - protein, 9 aa, Homo Sapiens
FVVLLIRVI

SEQ ID NO: 1012709 - protein, 9 aa, Homo Sapiens
PYLEVYKDM

SEQ ID NO: 1012710 - protein, 9 aa, Homo Sapiens
EEPFCKKEV

SEQ ID NO: 1012711 - protein, 9 aa, Homo Sapiens
LPAKRGKDA

SEQ ID NO: 1012712 - protein, 9 aa, Homo Sapiens
KQTQKKVTV

SEQ ID NO: 1012713 - protein, 9 aa, Homo Sapiens
CNLNDFRFS

SEQ ID NO: 1012714 - protein, 9 aa, Homo Sapiens
YLDDSEYSI

SEQ ID NO: 1012715 - protein, 9 aa, Homo Sapiens
GPPDLPGPP

SEQ ID NO: 1012716 - protein, 9 aa, Homo Sapiens
SGKIPHYKS

SEQ ID NO: 1012717 - protein, 9 aa, Homo Sapiens
HTTLICNPP

SEQ ID NO: 1012718 - protein, 9 aa, Homo Sapiens
LGGGRRSGT

SEQ ID NO: 1012719 - protein, 9 aa, Homo Sapiens
DPNPLLPVL

SEQ ID NO: 1012720 - protein, 9 aa, Homo Sapiens
SAVRINEDG

SEQ ID NO: 1012721 - protein, 9 aa, Homo Sapiens
FYTFHHGIT

SEQ ID NO: 1012722 - protein, 9 aa, Homo Sapiens
PVPDCGCTH

SEQ ID NO: 1012723 - protein, 9 aa, Homo Sapiens
KHKIIYTGK

SEQ ID NO: 1012724 - protein, 9 aa, Homo Sapiens
LALRGIRSG

SEQ ID NO: 1012725 - protein, 9 aa, Homo Sapiens
FFLDPRQRQ

SEQ ID NO: 1012726 - protein, 9 aa, Homo Sapiens
QKKSKGGEG

SEQ ID NO: 1012727 - protein, 9 aa, Homo Sapiens
KIDPRSGLI

SEQ ID NO: 1012728 - protein, 9 aa, Homo Sapiens
KLMMAWWDN

SEQ ID NO: 1012729 - protein, 9 aa, Homo Sapiens
MAWWDNKIF

SEQ ID NO: 1012730 - protein, 9 aa, Homo Sapiens
ELERATNAY

SEQ ID NO: 1012731 - protein, 9 aa, Homo Sapiens
AGAMPISLR

SEQ ID NO: 1012732 - protein, 9 aa, Homo Sapiens
IFRQQEGTE

SEQ ID NO: 1012733 - protein, 9 aa, Homo Sapiens
DDCISPSKL

SEQ ID NO: 1012734 - protein, 9 aa, Homo Sapiens
AAMQSSNSG

SEQ ID NO: 1012735 - protein, 9 aa, Homo Sapiens
RPFRGLFCR

SEQ ID NO: 1012736 - protein, 9 aa, Homo Sapiens
HCSWVFELQ

SEQ ID NO: 1012737 - protein, 9 aa, Homo Sapiens
SFNGVYQPP

SEQ ID NO: 1012738 - protein, 9 aa, Homo Sapiens
GCTDAILNF

SEQ ID NO: 1012739 - protein, 9 aa, Homo Sapiens
QLKKYKEQN

SEQ ID NO: 1012740 - protein, 9 aa, Homo Sapiens
HYQEYAAEF

SEQ ID NO: 1012741 - protein, 9 aa, Homo Sapiens
LKKKGIVVG

SEQ ID NO: 1012742 - protein, 9 aa, Homo Sapiens
NTAILIALS

SEQ ID NO: 1012743 - protein, 9 aa, Homo Sapiens
CAGFLWEVI

SEQ ID NO: 1012744 - protein, 9 aa, Homo Sapiens
QEDCRTREE

SEQ ID NO: 1012745 - protein, 9 aa, Homo Sapiens
FYGYIGISI

SEQ ID NO: 1012746 - protein, 9 aa, Homo Sapiens
CLSTNENLH

SEQ ID NO: 1012747 - protein, 9 aa, Homo Sapiens
VGSQSHVFF

SEQ ID NO: 1012748 - protein, 9 aa, Homo Sapiens
FTLVNLTLG

SEQ ID NO: 1012749 - protein, 9 aa, Homo Sapiens
RNQLSSFLY

SEQ ID NO: 1012750 - protein, 9 aa, Homo Sapiens
GLFCRNARR

SEQ ID NO: 1012751 - protein, 9 aa, Homo Sapiens
GTDVSCPVG

SEQ ID NO: 1012752 - protein, 9 aa, Homo Sapiens
IGNACWKLY

SEQ ID NO: 1012753 - protein, 9 aa, Homo Sapiens
GVPENFNKA

SEQ ID NO: 1012754 - protein, 9 aa, Homo Sapiens
FSSFRTLGS

SEQ ID NO: 1012755 - protein, 9 aa, Homo Sapiens
AFTDDGRVF

SEQ ID NO: 1012756 - protein, 9 aa, Homo Sapiens
AESPSDLLV

SEQ ID NO: 1012757 - protein, 9 aa, Homo Sapiens
GGAGGSPKL

SEQ ID NO: 1012758 - protein, 9 aa, Homo Sapiens
HFILGMIGP

SEQ ID NO: 1012759 - protein, 9 aa, Homo Sapiens
QGILFSSNN

SEQ ID NO: 1012760 - protein, 9 aa, Homo Sapiens
RPERMLGAS

SEQ ID NO: 1012761 - protein, 9 aa, Homo Sapiens
LGGTDVSCP

SEQ ID NO: 1012762 - protein, 9 aa, Homo Sapiens
AEPGNTISL

SEQ ID NO: 1012763 - protein, 9 aa, Homo Sapiens
EPRSCSSIL

SEQ ID NO: 1012764 - protein, 9 aa, Homo Sapiens
WIHTTLICN

SEQ ID NO: 1012765 - protein, 9 aa, Homo Sapiens
KAEKLFLEE

SEQ ID NO: 1012766 - protein, 9 aa, Homo Sapiens
SPLCIQTSP

SEQ ID NO: 1012767 - protein, 9 aa, Homo Sapiens
AEKKEDTKM

SEQ ID NO: 1012768 - protein, 9 aa, Homo Sapiens
ILIALSKRE

SEQ ID NO: 1012769 - protein, 9 aa, Homo Sapiens
KKRYGLLTA

SEQ ID NO: 1012770 - protein, 9 aa, Homo Sapiens
ELVYLEVFS

SEQ ID NO: 1012771 - protein, 9 aa, Homo Sapiens
GSKKKKKKK

SEQ ID NO: 1012772 - protein, 9 aa, Homo Sapiens
DLETKIKGK

SEQ ID NO: 1012773 - protein, 9 aa, Homo Sapiens
LYQNPRNVW

SEQ ID NO: 1012774 - protein, 9 aa, Homo Sapiens
SPCRLCAPC

SEQ ID NO: 1012775 - protein, 9 aa, Homo Sapiens
DYSWVMRDW

SEQ ID NO: 1012776 - protein, 9 aa, Homo Sapiens
GPQGIDGQP

SEQ ID NO: 1012777 - protein, 9 aa, Homo Sapiens
KRQYSAWAE

SEQ ID NO: 1012778 - protein, 9 aa, Homo Sapiens
LTMIKATAR

SEQ ID NO: 1012779 - protein, 9 aa, Homo Sapiens
LIALSKREY

SEQ ID NO: 1012780 - protein, 9 aa, Homo Sapiens
QRLKKNDTD

SEQ ID NO: 1012781 - protein, 9 aa, Homo Sapiens
QLIGIIIDT

SEQ ID NO: 1012782 - protein, 9 aa, Homo Sapiens
ASPRRTLSA

SEQ ID NO: 1012783 - protein, 9 aa, Homo Sapiens
LQGYLDDSE

SEQ ID NO: 1012784 - protein, 9 aa, Homo Sapiens
PHGVVLRLD

SEQ ID NO: 1012785 - protein, 9 aa, Homo Sapiens
AAPASLHGP

SEQ ID NO: 1012786 - protein, 9 aa, Homo Sapiens
MASCITQKK

SEQ ID NO: 1012787 - protein, 9 aa, Homo Sapiens
SFFSGIKTI

SEQ ID NO: 1012788 - protein, 9 aa, Homo Sapiens
SSGSGFLRT

SEQ ID NO: 1012789 - protein, 9 aa, Homo Sapiens
SLLKKRKFL

SEQ ID NO: 1012790 - protein, 9 aa, Homo Sapiens
LNFIAEHGA

SEQ ID NO: 1012791 - protein, 9 aa, Homo Sapiens
LFAKNKKSQ

SEQ ID NO: 1012792 - protein, 9 aa, Homo Sapiens
LQQRESPIE

SEQ ID NO: 1012793 - protein, 9 aa, Homo Sapiens
PVDTNLINR

SEQ ID NO: 1012794 - protein, 9 aa, Homo Sapiens
PRPFRGLFC

SEQ ID NO: 1012795 - protein, 9 aa, Homo Sapiens
FSWPQWLLI

SEQ ID NO: 1012796 - protein, 9 aa, Homo Sapiens
GIPGLSGKR

SEQ ID NO: 1012797 - protein, 9 aa, Homo Sapiens
FKIERRQLL

SEQ ID NO: 1012798 - protein, 9 aa, Homo Sapiens
HYTSLEQYV

SEQ ID NO: 1012799 - protein, 9 aa, Homo Sapiens
SNSGSKKKK

SEQ ID NO: 1012800 - protein, 9 aa, Homo Sapiens
YFSDRLERR

SEQ ID NO: 1012801 - protein, 9 aa, Homo Sapiens
SYSQEKRGK

SEQ ID NO: 1012802 - protein, 9 aa, Homo Sapiens
SPSWASAPC

SEQ ID NO: 1012803 - protein, 9 aa, Homo Sapiens
ILFSSNNEV

SEQ ID NO: 1012804 - protein, 9 aa, Homo Sapiens
QNSKDRGIC

SEQ ID NO: 1012805 - protein, 9 aa, Homo Sapiens
GKELENFPD

SEQ ID NO: 1012806 - protein, 9 aa, Homo Sapiens
EYPPPPSPP

SEQ ID NO: 1012807 - protein, 9 aa, Homo Sapiens
CLAEFSSQA

SEQ ID NO: 1012808 - protein, 9 aa, Homo Sapiens
NRSFFSGIK

SEQ ID NO: 1012809 - protein, 9 aa, Homo Sapiens
VLELALSIT

SEQ ID NO: 1012810 - protein, 9 aa, Homo Sapiens
DDSEYSIQD

SEQ ID NO: 1012811 - protein, 9 aa, Homo Sapiens
FFSGIKTIL

SEQ ID NO: 1012812 - protein, 9 aa, Homo Sapiens
SPPATKKMA

SEQ ID NO: 1012813 - protein, 9 aa, Homo Sapiens
VLFGYRFLS

SEQ ID NO: 1012814 - protein, 9 aa, Homo Sapiens
EPTSLMNIL

SEQ ID NO: 1012815 - protein, 9 aa, Homo Sapiens
CLKSMEYFN

SEQ ID NO: 1012816 - protein, 9 aa, Homo Sapiens
NLPEFTAMT

SEQ ID NO: 1012817 - protein, 9 aa, Homo Sapiens
SNSAMERLK

SEQ ID NO: 1012818 - protein, 9 aa, Homo Sapiens
PTNARFDFP

SEQ ID NO: 1012819 - protein, 9 aa, Homo Sapiens
AKKPMAEVT

SEQ ID NO: 1012820 - protein, 9 aa, Homo Sapiens
EMLAASFFI

SEQ ID NO: 1012821 - protein, 9 aa, Homo Sapiens
KKVTVLLEH

SEQ ID NO: 1012822 - protein, 9 aa, Homo Sapiens
HVGETLPPE

SEQ ID NO: 1012823 - protein, 9 aa, Homo Sapiens
VYKDMIRWI

SEQ ID NO: 1012824 - protein, 9 aa, Homo Sapiens
KKFTEWAYG

SEQ ID NO: 1012825 - protein, 9 aa, Homo Sapiens
SLHGPHLPG

SEQ ID NO: 1012826 - protein, 9 aa, Homo Sapiens
KIDTALVKA

SEQ ID NO: 1012827 - protein, 9 aa, Homo Sapiens
MQQLRSAHK

SEQ ID NO: 1012828 - protein, 9 aa, Homo Sapiens
QRIIRPGIL

SEQ ID NO: 1012829 - protein, 9 aa, Homo Sapiens
VWDKPGLER

SEQ ID NO: 1012830 - protein, 9 aa, Homo Sapiens
HGQWRLIFE

SEQ ID NO: 1012831 - protein, 9 aa, Homo Sapiens
LDLCLLPYD

SEQ ID NO: 1012832 - protein, 9 aa, Homo Sapiens
TLSAPLRSS

SEQ ID NO: 1012833 - protein, 9 aa, Homo Sapiens
YPNSSSGNR

SEQ ID NO: 1012834 - protein, 9 aa, Homo Sapiens
GLGKKKRSV

SEQ ID NO: 1012835 - protein, 9 aa, Homo Sapiens
ELEKQIKKL

SEQ ID NO: 1012836 - protein, 9 aa, Homo Sapiens
HKEEKLKRE

SEQ ID NO: 1012837 - protein, 9 aa, Homo Sapiens
VSSRSPSGT

SEQ ID NO: 1012838 - protein, 9 aa, Homo Sapiens
FKQKDVETK

SEQ ID NO: 1012839 - protein, 9 aa, Homo Sapiens
FLLFFLFPL

SEQ ID NO: 1012840 - protein, 9 aa, Homo Sapiens
SALATGGVK

SEQ ID NO: 1012841 - protein, 9 aa, Homo Sapiens
LPGPKSDVG

SEQ ID NO: 1012842 - protein, 9 aa, Homo Sapiens
ERTLGAREK

SEQ ID NO: 1012843 - protein, 9 aa, Homo Sapiens
NGKLTVASA

SEQ ID NO: 1012844 - protein, 9 aa, Homo Sapiens
AGFLWEVIK

SEQ ID NO: 1012845 - protein, 9 aa, Homo Sapiens
NSTKRDRET

SEQ ID NO: 1012846 - protein, 9 aa, Homo Sapiens
EEEKEIIGG

SEQ ID NO: 1012847 - protein, 9 aa, Homo Sapiens
ASVLFFDRN

SEQ ID NO: 1012848 - protein, 9 aa, Homo Sapiens
SSLKSRNVC

SEQ ID NO: 1012849 - protein, 9 aa, Homo Sapiens
RRTLSAPLR

SEQ ID NO: 1012850 - protein, 9 aa, Homo Sapiens
KSQREKEKL

SEQ ID NO: 1012851 - protein, 9 aa, Homo Sapiens
SPGPHPRFW

SEQ ID NO: 1012852 - protein, 9 aa, Homo Sapiens
AFTFENGNV

SEQ ID NO: 1012853 - protein, 9 aa, Homo Sapiens
CSIIRMNRN

SEQ ID NO: 1012854 - protein, 9 aa, Homo Sapiens
FFAKEYGKN

SEQ ID NO: 1012855 - protein, 9 aa, Homo Sapiens
KEFGSGFSV

SEQ ID NO: 1012856 - protein, 9 aa, Homo Sapiens
EMILNLEGD

SEQ ID NO: 1012857 - protein, 9 aa, Homo Sapiens
PILNPLIYN

SEQ ID NO: 1012858 - protein, 9 aa, Homo Sapiens
CAGQQNNGI

SEQ ID NO: 1012859 - protein, 9 aa, Homo Sapiens
LKPLKTQIV

SEQ ID NO: 1012860 - protein, 9 aa, Homo Sapiens
EKSEEERGL

SEQ ID NO: 1012861 - protein, 9 aa, Homo Sapiens
RAGAMPISL

SEQ ID NO: 1012862 - protein, 9 aa, Homo Sapiens
ISYETNSAL

SEQ ID NO: 1012863 - protein, 9 aa, Homo Sapiens
PFFVEGECC

SEQ ID NO: 1012864 - protein, 9 aa, Homo Sapiens
IHTGEQPYE

SEQ ID NO: 1012865 - protein, 9 aa, Homo Sapiens
KKLSKQQSQ

SEQ ID NO: 1012866 - protein, 9 aa, Homo Sapiens
RNIKDLLSQ

SEQ ID NO: 1012867 - protein, 9 aa, Homo Sapiens
SPPPPPSVS

SEQ ID NO: 1012868 - protein, 9 aa, Homo Sapiens
TMIFSGGTA

SEQ ID NO: 1012869 - protein, 9 aa, Homo Sapiens
KMCIASHFH

SEQ ID NO: 1012870 - protein, 9 aa, Homo Sapiens
ALQNHVGET

SEQ ID NO: 1012871 - protein, 9 aa, Homo Sapiens
DYTNPNFSG

SEQ ID NO: 1012872 - protein, 9 aa, Homo Sapiens
KKKGIVVGI

SEQ ID NO: 1012873 - protein, 9 aa, Homo Sapiens
YTNPNFSGQ

SEQ ID NO: 1012874 - protein, 9 aa, Homo Sapiens
ATCASPFFV

SEQ ID NO: 1012875 - protein, 9 aa, Homo Sapiens
DEHSPYNGS

SEQ ID NO: 1012876 - protein, 9 aa, Homo Sapiens
LDFKDTQCP

SEQ ID NO: 1012877 - protein, 9 aa, Homo Sapiens
SALVIMIFY

SEQ ID NO: 1012878 - protein, 9 aa, Homo Sapiens
KRNIKDLLS

SEQ ID NO: 1012879 - protein, 9 aa, Homo Sapiens
VGPGPWGSR

SEQ ID NO: 1012880 - protein, 9 aa, Homo Sapiens
IFYGYIGIS

SEQ ID NO: 1012881 - protein, 9 aa, Homo Sapiens
ESELVYLEV

SEQ ID NO: 1012882 - protein, 9 aa, Homo Sapiens
AAAFKIDPR

SEQ ID NO: 1012883 - protein, 9 aa, Homo Sapiens
LRGKSRNQL

SEQ ID NO: 1012884 - protein, 9 aa, Homo Sapiens
QPGVPGQPG

SEQ ID NO: 1012885 - protein, 9 aa, Homo Sapiens
LLVEHQAIL

SEQ ID NO: 1012886 - protein, 9 aa, Homo Sapiens
EEDDNDDTE

SEQ ID NO: 1012887 - protein, 9 aa, Homo Sapiens
LEKQIKKLS

SEQ ID NO: 1012888 - protein, 9 aa, Homo Sapiens
PFIRVSPHR

SEQ ID NO: 1012889 - protein, 9 aa, Homo Sapiens
ILWQHNKKS

SEQ ID NO: 1012890 - protein, 9 aa, Homo Sapiens
DRTAELERA

SEQ ID NO: 1012891 - protein, 9 aa, Homo Sapiens
EGLGSLLYD

SEQ ID NO: 1012892 - protein, 9 aa, Homo Sapiens
PHCPPFLLF

SEQ ID NO: 1012893 - protein, 9 aa, Homo Sapiens
AGSNSAMER

SEQ ID NO: 1012894 - protein, 9 aa, Homo Sapiens
DGEAGPPDL

SEQ ID NO: 1012895 - protein, 9 aa, Homo Sapiens
LGAEDSSGE

SEQ ID NO: 1012896 - protein, 9 aa, Homo Sapiens
KAKNIFRIC

SEQ ID NO: 1012897 - protein, 9 aa, Homo Sapiens
TANEKITPS

SEQ ID NO: 1012898 - protein, 9 aa, Homo Sapiens
VKVCQVGSE

SEQ ID NO: 1012899 - protein, 9 aa, Homo Sapiens
FCRNARRRP

SEQ ID NO: 1012900 - protein, 9 aa, Homo Sapiens
ALQFFAKEY

SEQ ID NO: 1012901 - protein, 9 aa, Homo Sapiens
KERKLLEDC

SEQ ID NO: 1012902 - protein, 9 aa, Homo Sapiens
SKDRGICEL

SEQ ID NO: 1012903 - protein, 9 aa, Homo Sapiens
TFNQTLITD

SEQ ID NO: 1012904 - protein, 9 aa, Homo Sapiens
FIVYREPNV

SEQ ID NO: 1012905 - protein, 9 aa, Homo Sapiens
PGAGAGILA

SEQ ID NO: 1012906 - protein, 9 aa, Homo Sapiens
ERATNAYRR

SEQ ID NO: 1012907 - protein, 9 aa, Homo Sapiens
GHRAGLPKD

SEQ ID NO: 1012908 - protein, 9 aa, Homo Sapiens
GSETRLSPQ

SEQ ID NO: 1012909 - protein, 9 aa, Homo Sapiens
RKARTREQL

SEQ ID NO: 1012910 - protein, 9 aa, Homo Sapiens
DNEPPNSGG

SEQ ID NO: 1012911 - protein, 9 aa, Homo Sapiens
AGSSSVLCR

SEQ ID NO: 1012912 - protein, 9 aa, Homo Sapiens
EGKELENFP

SEQ ID NO: 1012913 - protein, 9 aa, Homo Sapiens
PPDPLPNKA

SEQ ID NO: 1012914 - protein, 9 aa, Homo Sapiens
KIKGKGMQV

SEQ ID NO: 1012915 - protein, 9 aa, Homo Sapiens
YILLSENFQ

SEQ ID NO: 1012916 - protein, 9 aa, Homo Sapiens
PVSTTLVAS

SEQ ID NO: 1012917 - protein, 9 aa, Homo Sapiens
WDNKIFRDR

SEQ ID NO: 1012918 - protein, 9 aa, Homo Sapiens
KKNDTDPTA

SEQ ID NO: 1012919 - protein, 9 aa, Homo Sapiens
GNTISLIFT

SEQ ID NO: 1012920 - protein, 9 aa, Homo Sapiens
NIFRICFHD

SEQ ID NO: 1012921 - protein, 9 aa, Homo Sapiens
LLVEYLIID

SEQ ID NO: 1012922 - protein, 9 aa, Homo Sapiens
HFLTEHVRT

SEQ ID NO: 1012923 - protein, 9 aa, Homo Sapiens
EELEKQIKK

SEQ ID NO: 1012924 - protein, 9 aa, Homo Sapiens
VYYNCSCIK

SEQ ID NO: 1012925 - protein, 9 aa, Homo Sapiens
CWKLYCLEH

SEQ ID NO: 1012926 - protein, 9 aa, Homo Sapiens
SPRAVSGAT

SEQ ID NO: 1012927 - protein, 9 aa, Homo Sapiens
EVIDSHDAV

SEQ ID NO: 1012928 - protein, 9 aa, Homo Sapiens
SLRNKDIKN

SEQ ID NO: 1012929 - protein, 9 aa, Homo Sapiens
LITGSPGCG

SEQ ID NO: 1012930 - protein, 9 aa, Homo Sapiens
CLLPSFEED

SEQ ID NO: 1012931 - protein, 9 aa, Homo Sapiens
ASLHGPHLP

SEQ ID NO: 1012932 - protein, 9 aa, Homo Sapiens
KALQFFAKE

SEQ ID NO: 1012933 - protein, 9 aa, Homo Sapiens
SYKKTTRTS

SEQ ID NO: 1012934 - protein, 9 aa, Homo Sapiens
RQRWRLQSR

SEQ ID NO: 1012935 - protein, 9 aa, Homo Sapiens
LPAARAISR

SEQ ID NO: 1012936 - protein, 9 aa, Homo Sapiens
MVSFGFPEF

SEQ ID NO: 1012937 - protein, 9 aa, Homo Sapiens
LERILPKRF

SEQ ID NO: 1012938 - protein, 9 aa, Homo Sapiens
EKTCSQLLI

SEQ ID NO: 1012939 - protein, 9 aa, Homo Sapiens
LMMAWWDNK

SEQ ID NO: 1012940 - protein, 9 aa, Homo Sapiens
STTLVASSA

SEQ ID NO: 1012941 - protein, 9 aa, Homo Sapiens
RTLKPLKTQ

SEQ ID NO: 1012942 - protein, 9 aa, Homo Sapiens
FAKMEDTDC

SEQ ID NO: 1012943 - protein, 9 aa, Homo Sapiens
LNELEKQES

SEQ ID NO: 1012944 - protein, 9 aa, Homo Sapiens
PPSPPPYRM

SEQ ID NO: 1012945 - protein, 9 aa, Homo Sapiens
PATCASPFF

SEQ ID NO: 1012946 - protein, 9 aa, Homo Sapiens
SHIVEAFIR

SEQ ID NO: 1012947 - protein, 9 aa, Homo Sapiens
KTKCENMKN

SEQ ID NO: 1012948 - protein, 9 aa, Homo Sapiens
SRGDCDMGC

SEQ ID NO: 1012949 - protein, 9 aa, Homo Sapiens
PTYKLGQKD

SEQ ID NO: 1012950 - protein, 9 aa, Homo Sapiens
RVSPHRNPT

SEQ ID NO: 1012951 - protein, 9 aa, Homo Sapiens
VLTIIDKND

SEQ ID NO: 1012952 - protein, 9 aa, Homo Sapiens
TKRDRETLL

SEQ ID NO: 1012953 - protein, 9 aa, Homo Sapiens
EYFNPHTNK

SEQ ID NO: 1012954 - protein, 9 aa, Homo Sapiens
YFNPHTNKW

SEQ ID NO: 1012955 - protein, 9 aa, Homo Sapiens
PLPGGLPRT

SEQ ID NO: 1012956 - protein, 9 aa, Homo Sapiens
SPRRTLSAP

SEQ ID NO: 1012957 - protein, 9 aa, Homo Sapiens
KYCLTYAYF

SEQ ID NO: 1012958 - protein, 9 aa, Homo Sapiens
DNIFWGKHF

SEQ ID NO: 1012959 - protein, 9 aa, Homo Sapiens
VDTNLINRS

SEQ ID NO: 1012960 - protein, 9 aa, Homo Sapiens
ASPFFVEGE

SEQ ID NO: 1012961 - protein, 9 aa, Homo Sapiens
IMIAIYVLL

SEQ ID NO: 1012962 - protein, 9 aa, Homo Sapiens
FEEKTKIET

SEQ ID NO: 1012963 - protein, 9 aa, Homo Sapiens
LGSSIELTI

SEQ ID NO: 1012964 - protein, 9 aa, Homo Sapiens
VSFGFPEFF

SEQ ID NO: 1012965 - protein, 9 aa, Homo Sapiens
GQPGVPGQP

SEQ ID NO: 1012966 - protein, 9 aa, Homo Sapiens
EAVLELALS

SEQ ID NO: 1012967 - protein, 9 aa, Homo Sapiens
DFPYVHIIY

SEQ ID NO: 1012968 - protein, 9 aa, Homo Sapiens
SCIKRKTEI

SEQ ID NO: 1012969 - protein, 9 aa, Homo Sapiens
TDNQTLTMI

SEQ ID NO: 1012970 - protein, 9 aa, Homo Sapiens
CTLLGLECP

SEQ ID NO: 1012971 - protein, 9 aa, Homo Sapiens
EESLSTATF

SEQ ID NO: 1012972 - protein, 9 aa, Homo Sapiens
AYLVKKMMK

SEQ ID NO: 1012973 - protein, 9 aa, Homo Sapiens
AAERDFAGM

SEQ ID NO: 1012974 - protein, 9 aa, Homo Sapiens
RDLETKIKG

SEQ ID NO: 1012975 - protein, 9 aa, Homo Sapiens
CPTQPFCCP

SEQ ID NO: 1012976 - protein, 9 aa, Homo Sapiens
ERNPLTSAS

SEQ ID NO: 1012977 - protein, 9 aa, Homo Sapiens
ECVGFKISV

SEQ ID NO: 1012978 - protein, 9 aa, Homo Sapiens
LQRIDLIGV

SEQ ID NO: 1012979 - protein, 9 aa, Homo Sapiens
CSQLLIMDR

SEQ ID NO: 1012980 - protein, 9 aa, Homo Sapiens
QRVDTMDNS

SEQ ID NO: 1012981 - protein, 9 aa, Homo Sapiens
YRDLKDCQQ

SEQ ID NO: 1012982 - protein, 9 aa, Homo Sapiens
NRKRNIKDL

SEQ ID NO: 1012983 - protein, 9 aa, Homo Sapiens
DFVKDHRNI

SEQ ID NO: 1012984 - protein, 9 aa, Homo Sapiens
KRYGLLTAD

SEQ ID NO: 1012985 - protein, 9 aa, Homo Sapiens
FSVSDSKRH

SEQ ID NO: 1012986 - protein, 9 aa, Homo Sapiens
FKKILSYIN

SEQ ID NO: 1012987 - protein, 9 aa, Homo Sapiens
EEDQQRIIR

SEQ ID NO: 1012988 - protein, 9 aa, Homo Sapiens
QLLWGKALL

SEQ ID NO: 1012989 - protein, 9 aa, Homo Sapiens
YEDAFIRGN

SEQ ID NO: 1012990 - protein, 9 aa, Homo Sapiens
RRSGTSPAL

SEQ ID NO: 1012991 - protein, 9 aa, Homo Sapiens
LNSQLAPPA

SEQ ID NO: 1012992 - protein, 9 aa, Homo Sapiens
PHKADSIQE

SEQ ID NO: 1012993 - protein, 9 aa, Homo Sapiens
LEDCLAEFS

SEQ ID NO: 1012994 - protein, 9 aa, Homo Sapiens
EAANEGQLW

SEQ ID NO: 1012995 - protein, 9 aa, Homo Sapiens
VLQLTLSLP

SEQ ID NO: 1012996 - protein, 9 aa, Homo Sapiens
WQHNKKSLL

SEQ ID NO: 1012997 - protein, 9 aa, Homo Sapiens
LQYMVKVCQ

SEQ ID NO: 1012998 - protein, 9 aa, Homo Sapiens
LVEYLIIDI

SEQ ID NO: 1012999 - protein, 9 aa, Homo Sapiens
NAVTLSGED

SEQ ID NO: 1013000 - protein, 9 aa, Homo Sapiens
KRKTEITST

SEQ ID NO: 1013001 - protein, 9 aa, Homo Sapiens
NCSCIKRKT

SEQ ID NO: 1013002 - protein, 9 aa, Homo Sapiens
TYRDLKDCQ

SEQ ID NO: 1013003 - protein, 9 aa, Homo Sapiens
EAGPPDLPG

SEQ ID NO: 1013004 - protein, 9 aa, Homo Sapiens
ELWNCLNQQ

SEQ ID NO: 1013005 - protein, 9 aa, Homo Sapiens
MIDPSRAAV

SEQ ID NO: 1013006 - protein, 9 aa, Homo Sapiens
YGEKSEEER

SEQ ID NO: 1013007 - protein, 9 aa, Homo Sapiens
TGRCVNRRF

SEQ ID NO: 1013008 - protein, 9 aa, Homo Sapiens
TTLALQQAL

SEQ ID NO: 1013009 - protein, 9 aa, Homo Sapiens
GEKIKCDEC

SEQ ID NO: 1013010 - protein, 9 aa, Homo Sapiens
EHQAILFML

SEQ ID NO: 1013011 - protein, 9 aa, Homo Sapiens
SNFLPKKTS

SEQ ID NO: 1013012 - protein, 9 aa, Homo Sapiens
ISGKIPHYK

SEQ ID NO: 1013013 - protein, 9 aa, Homo Sapiens
AIAAGVLVV

SEQ ID NO: 1013014 - protein, 9 aa, Homo Sapiens
PPTLSLPTV

SEQ ID NO: 1013015 - protein, 9 aa, Homo Sapiens
QLKNKYEDA

SEQ ID NO: 1013016 - protein, 9 aa, Homo Sapiens
RSGTSPALL

SEQ ID NO: 1013017 - protein, 9 aa, Homo Sapiens
IIGEGLGSL

SEQ ID NO: 1013018 - protein, 9 aa, Homo Sapiens
TESNISLVA

SEQ ID NO: 1013019 - protein, 9 aa, Homo Sapiens
TITDTYLLN

SEQ ID NO: 1013020 - protein, 9 aa, Homo Sapiens
QKIKGWYKK

SEQ ID NO: 1013021 - protein, 9 aa, Homo Sapiens
KAEKKEDTK

SEQ ID NO: 1013022 - protein, 9 aa, Homo Sapiens
CRRLGSKIW

SEQ ID NO: 1013023 - protein, 9 aa, Homo Sapiens
AKNIFRICF

SEQ ID NO: 1013024 - protein, 9 aa, Homo Sapiens
ERILPKRFL

SEQ ID NO: 1013025 - protein, 9 aa, Homo Sapiens
ISVEHGQWR

SEQ ID NO: 1013026 - protein, 9 aa, Homo Sapiens
IVRGGLQNA

SEQ ID NO: 1013027 - protein, 9 aa, Homo Sapiens
LNSSLGEVI

SEQ ID NO: 1013028 - protein, 9 aa, Homo Sapiens
LNKKVDQLL

SEQ ID NO: 1013029 - protein, 9 aa, Homo Sapiens
ARDRQGSCA

SEQ ID NO: 1013030 - protein, 9 aa, Homo Sapiens
CKKIGAIAQ

SEQ ID NO: 1013031 - protein, 9 aa, Homo Sapiens
QSLGNFIVR

SEQ ID NO: 1013032 - protein, 9 aa, Homo Sapiens
YTQLIGIII

SEQ ID NO: 1013033 - protein, 9 aa, Homo Sapiens
GPVVAPGKS

SEQ ID NO: 1013034 - protein, 9 aa, Homo Sapiens
RAAAAAAFK

SEQ ID NO: 1013035 - protein, 9 aa, Homo Sapiens
KPTYKLGQK

SEQ ID NO: 1013036 - protein, 9 aa, Homo Sapiens
RKEDVAMVK

SEQ ID NO: 1013037 - protein, 9 aa, Homo Sapiens
NGGSKNPAE

SEQ ID NO: 1013038 - protein, 9 aa, Homo Sapiens
RFDFPESHV

SEQ ID NO: 1013039 - protein, 9 aa, Homo Sapiens
EIFVMINNI

SEQ ID NO: 1013040 - protein, 9 aa, Homo Sapiens
LGLECPLHC

SEQ ID NO: 1013041 - protein, 9 aa, Homo Sapiens
TISLASSNP

SEQ ID NO: 1013042 - protein, 9 aa, Homo Sapiens
QLGSRGASH

SEQ ID NO: 1013043 - protein, 9 aa, Homo Sapiens
SKREYEIPS

SEQ ID NO: 1013044 - protein, 9 aa, Homo Sapiens
PLESKFFKQ

SEQ ID NO: 1013045 - protein, 9 aa, Homo Sapiens
HWNIDPHLS

SEQ ID NO: 1013046 - protein, 9 aa, Homo Sapiens
ELGGGRRSG

SEQ ID NO: 1013047 - protein, 9 aa, Homo Sapiens
IGTPGLEDF

SEQ ID NO: 1013048 - protein, 9 aa, Homo Sapiens
PDCGCTHNG

SEQ ID NO: 1013049 - protein, 9 aa, Homo Sapiens
PEKTCSQLL

SEQ ID NO: 1013050 - protein, 9 aa, Homo Sapiens
LDLLLSPSL

SEQ ID NO: 1013051 - protein, 9 aa, Homo Sapiens
RDNISYETN

SEQ ID NO: 1013052 - protein, 9 aa, Homo Sapiens
TSHKRIHTR

SEQ ID NO: 1013053 - protein, 9 aa, Homo Sapiens
QRIDLIGVA

SEQ ID NO: 1013054 - protein, 9 aa, Homo Sapiens
NELEKQESL

SEQ ID NO: 1013055 - protein, 9 aa, Homo Sapiens
VLLIRVILS

SEQ ID NO: 1013056 - protein, 9 aa, Homo Sapiens
EFKFRFTDC

SEQ ID NO: 1013057 - protein, 9 aa, Homo Sapiens
AILFMLAEM

SEQ ID NO: 1013058 - protein, 9 aa, Homo Sapiens
ATHSLPVSF

SEQ ID NO: 1013059 - protein, 9 aa, Homo Sapiens
RSAHKTTHY

SEQ ID NO: 1013060 - protein, 9 aa, Homo Sapiens
HFRHTDNIV

SEQ ID NO: 1013061 - protein, 9 aa, Homo Sapiens
KNDTDPTAP

SEQ ID NO: 1013062 - protein, 9 aa, Homo Sapiens
FNKAKPIGF

SEQ ID NO: 1013063 - protein, 9 aa, Homo Sapiens
GWYKKCEPG

SEQ ID NO: 1013064 - protein, 9 aa, Homo Sapiens
LNDFRFSRL

SEQ ID NO: 1013065 - protein, 9 aa, Homo Sapiens
FCKYEGKCV

SEQ ID NO: 1013066 - protein, 9 aa, Homo Sapiens
SSLKSYSQE

SEQ ID NO: 1013067 - protein, 9 aa, Homo Sapiens
SPPPPFRGA

SEQ ID NO: 1013068 - protein, 9 aa, Homo Sapiens
QHNKKSLLN

SEQ ID NO: 1013069 - protein, 9 aa, Homo Sapiens
STFTLVNLT

SEQ ID NO: 1013070 - protein, 9 aa, Homo Sapiens
NCAGFLWEV

SEQ ID NO: 1013071 - protein, 9 aa, Homo Sapiens
VKESTDSFH

SEQ ID NO: 1013072 - protein, 9 aa, Homo Sapiens
CASPFFVEG

SEQ ID NO: 1013073 - protein, 9 aa, Homo Sapiens
LLPSFEEDY

SEQ ID NO: 1013074 - protein, 9 aa, Homo Sapiens
TDCVGWALD

SEQ ID NO: 1013075 - protein, 9 aa, Homo Sapiens
SQLLQQRES

SEQ ID NO: 1013076 - protein, 9 aa, Homo Sapiens
PPSQTGPEK

SEQ ID NO: 1013077 - protein, 9 aa, Homo Sapiens
KRKQTQKKV

SEQ ID NO: 1013078 - protein, 9 aa, Homo Sapiens
PFRGLFCRN

SEQ ID NO: 1013079 - protein, 9 aa, Homo Sapiens
TTMSVDGHV

SEQ ID NO: 1013080 - protein, 9 aa, Homo Sapiens
LTLHHRIHS

SEQ ID NO: 1013081 - protein, 9 aa, Homo Sapiens
GSQSPLILY

SEQ ID NO: 1013082 - protein, 9 aa, Homo Sapiens
NHVGETLPP

SEQ ID NO: 1013083 - protein, 9 aa, Homo Sapiens
LKNYSLLKK

SEQ ID NO: 1013084 - protein, 9 aa, Homo Sapiens
LIRVILSYK

SEQ ID NO: 1013085 - protein, 9 aa, Homo Sapiens
VTISLAYLV

SEQ ID NO: 1013086 - protein, 9 aa, Homo Sapiens
PDLTIQFHL

SEQ ID NO: 1013087 - protein, 9 aa, Homo Sapiens
IVYAMAANG

SEQ ID NO: 1013088 - protein, 9 aa, Homo Sapiens
RPRKLHKEE

SEQ ID NO: 1013089 - protein, 9 aa, Homo Sapiens
EMKTILCGV

SEQ ID NO: 1013090 - protein, 9 aa, Homo Sapiens
PPTLTGLAA

SEQ ID NO: 1013091 - protein, 9 aa, Homo Sapiens
CCDPCFLQE

SEQ ID NO: 1013092 - protein, 9 aa, Homo Sapiens
DKEDQSLKF

SEQ ID NO: 1013093 - protein, 9 aa, Homo Sapiens
AMQSSNSGS

SEQ ID NO: 1013094 - protein, 9 aa, Homo Sapiens
SSMCSGPSR

SEQ ID NO: 1013095 - protein, 9 aa, Homo Sapiens
NSLDSLKSP

SEQ ID NO: 1013096 - protein, 9 aa, Homo Sapiens
DSGEVKLDN

SEQ ID NO: 1013097 - protein, 9 aa, Homo Sapiens
KLLMVDRET

SEQ ID NO: 1013098 - protein, 9 aa, Homo Sapiens
ILKKKGIVV

SEQ ID NO: 1013099 - protein, 9 aa, Homo Sapiens
LPAAVNLSS

SEQ ID NO: 1013100 - protein, 9 aa, Homo Sapiens
ARKSALATG

SEQ ID NO: 1013101 - protein, 9 aa, Homo Sapiens
KKGSKKNIK

SEQ ID NO: 1013102 - protein, 9 aa, Homo Sapiens
IVAEPGNTI

SEQ ID NO: 1013103 - protein, 9 aa, Homo Sapiens
YGQEDFLYS

SEQ ID NO: 1013104 - protein, 9 aa, Homo Sapiens
RAGLPKDKG

SEQ ID NO: 1013105 - protein, 9 aa, Homo Sapiens
PGGPEIGPG

SEQ ID NO: 1013106 - protein, 9 aa, Homo Sapiens
GPEADKYCL

SEQ ID NO: 1013107 - protein, 9 aa, Homo Sapiens
LPEFTAMTF

SEQ ID NO: 1013108 - protein, 9 aa, Homo Sapiens
LTGLAATSD

SEQ ID NO: 1013109 - protein, 9 aa, Homo Sapiens
SAKRGQKRE

SEQ ID NO: 1013110 - protein, 9 aa, Homo Sapiens
LSTNENLHD

SEQ ID NO: 1013111 - protein, 9 aa, Homo Sapiens
TFAFTFENG

SEQ ID NO: 1013112 - protein, 9 aa, Homo Sapiens
NEKITPSPA

SEQ ID NO: 1013113 - protein, 9 aa, Homo Sapiens
TLKPLKTQI

SEQ ID NO: 1013114 - protein, 9 aa, Homo Sapiens
EHEDPSRSL

SEQ ID NO: 1013115 - protein, 9 aa, Homo Sapiens
VMPWKENII

SEQ ID NO: 1013116 - protein, 9 aa, Homo Sapiens
DYKRDLETK

SEQ ID NO: 1013117 - protein, 9 aa, Homo Sapiens
EQVMEDKFD

SEQ ID NO: 1013118 - protein, 9 aa, Homo Sapiens
QDFPYVHII

SEQ ID NO: 1013119 - protein, 9 aa, Homo Sapiens
CTKLMRTDT

SEQ ID NO: 1013120 - protein, 9 aa, Homo Sapiens
KKKISKKKT

SEQ ID NO: 1013121 - protein, 9 aa, Homo Sapiens
PGKSLTLQC

SEQ ID NO: 1013122 - protein, 9 aa, Homo Sapiens
LECPLHCEI

SEQ ID NO: 1013123 - protein, 9 aa, Homo Sapiens
AVLELALSI

SEQ ID NO: 1013124 - protein, 9 aa, Homo Sapiens
FQFAGGFFK

SEQ ID NO: 1013125 - protein, 9 aa, Homo Sapiens
GVCIPVPDC

SEQ ID NO: 1013126 - protein, 9 aa, Homo Sapiens
FRALFAIAK

SEQ ID NO: 1013127 - protein, 9 aa, Homo Sapiens
KLYCLEHGI

SEQ ID NO: 1013128 - protein, 9 aa, Homo Sapiens
FFLIGTPGL

SEQ ID NO: 1013129 - protein, 9 aa, Homo Sapiens
TREKPYQCN

SEQ ID NO: 1013130 - protein, 9 aa, Homo Sapiens
DKGQVRFWL

SEQ ID NO: 1013131 - protein, 9 aa, Homo Sapiens
PATKKMACK

SEQ ID NO: 1013132 - protein, 9 aa, Homo Sapiens
GDSHTAAFT

SEQ ID NO: 1013133 - protein, 9 aa, Homo Sapiens
WVFELQLEL

SEQ ID NO: 1013134 - protein, 9 aa, Homo Sapiens
LLLPAARAI

SEQ ID NO: 1013135 - protein, 9 aa, Homo Sapiens
RKSALATGG

SEQ ID NO: 1013136 - protein, 9 aa, Homo Sapiens
ALSRDSVVE

SEQ ID NO: 1013137 - protein, 9 aa, Homo Sapiens
NRTLVIKLN

SEQ ID NO: 1013138 - protein, 9 aa, Homo Sapiens
YWPKDNVCE

SEQ ID NO: 1013139 - protein, 9 aa, Homo Sapiens
KSRNQLSSF

SEQ ID NO: 1013140 - protein, 9 aa, Homo Sapiens
RKNGVLRPV

SEQ ID NO: 1013141 - protein, 9 aa, Homo Sapiens
DPSRTLNSQ

SEQ ID NO: 1013142 - protein, 9 aa, Homo Sapiens
ELAKAEKLF

SEQ ID NO: 1013143 - protein, 9 aa, Homo Sapiens
ISLRRCGMI

SEQ ID NO: 1013144 - protein, 9 aa, Homo Sapiens
NAPYLEVYK

SEQ ID NO: 1013145 - protein, 9 aa, Homo Sapiens
SNYPTSSST

SEQ ID NO: 1013146 - protein, 9 aa, Homo Sapiens
TKLIEWLPH

SEQ ID NO: 1013147 - protein, 9 aa, Homo Sapiens
RIFHVWQSA

SEQ ID NO: 1013148 - protein, 9 aa, Homo Sapiens
STMIFSGGT

SEQ ID NO: 1013149 - protein, 9 aa, Homo Sapiens
YQEYAAEFP

SEQ ID NO: 1013150 - protein, 9 aa, Homo Sapiens
FIDHISCKL

SEQ ID NO: 1013151 - protein, 9 aa, Homo Sapiens
IRDYFTFAF

SEQ ID NO: 1013152 - protein, 9 aa, Homo Sapiens
ECRHLSKKF

SEQ ID NO: 1013153 - protein, 9 aa, Homo Sapiens
FPAREVYVP

SEQ ID NO: 1013154 - protein, 9 aa, Homo Sapiens
ESLSTATFY

SEQ ID NO: 1013155 - protein, 9 aa, Homo Sapiens
ELELGEGYS

SEQ ID NO: 1013156 - protein, 9 aa, Homo Sapiens
IQAESQNRG

SEQ ID NO: 1013157 - protein, 9 aa, Homo Sapiens
EENELWNCL

SEQ ID NO: 1013158 - protein, 9 aa, Homo Sapiens
PSRTLNSQL

SEQ ID NO: 1013159 - protein, 9 aa, Homo Sapiens
RILPKRFLA

SEQ ID NO: 1013160 - protein, 9 aa, Homo Sapiens
YRRTGKGVL

SEQ ID NO: 1013161 - protein, 9 aa, Homo Sapiens
VNDNLPEFT

SEQ ID NO: 1013162 - protein, 9 aa, Homo Sapiens
DYDYESYKK

SEQ ID NO: 1013163 - protein, 9 aa, Homo Sapiens
VQGILFSSN

SEQ ID NO: 1013164 - protein, 9 aa, Homo Sapiens
EKNTDWSYE

SEQ ID NO: 1013165 - protein, 9 aa, Homo Sapiens
MYRKDFIVY

SEQ ID NO: 1013166 - protein, 9 aa, Homo Sapiens
QTISLASSN

SEQ ID NO: 1013167 - protein, 9 aa, Homo Sapiens
GRQVTGRIC

SEQ ID NO: 1013168 - protein, 9 aa, Homo Sapiens
VVRGHARGL

SEQ ID NO: 1013169 - protein, 9 aa, Homo Sapiens
MDKEDQSLK

SEQ ID NO: 1013170 - protein, 9 aa, Homo Sapiens
CRVAFGPKV

SEQ ID NO: 1013171 - protein, 9 aa, Homo Sapiens
YVPHTSYRN

SEQ ID NO: 1013172 - protein, 9 aa, Homo Sapiens
ENRDQVPYS

SEQ ID NO: 1013173 - protein, 9 aa, Homo Sapiens
TVTDVNDNL

SEQ ID NO: 1013174 - protein, 9 aa, Homo Sapiens
ILKASVLFF

SEQ ID NO: 1013175 - protein, 9 aa, Homo Sapiens
KGSKKNIKK

SEQ ID NO: 1013176 - protein, 9 aa, Homo Sapiens
SGFLRTNQK

SEQ ID NO: 1013177 - protein, 9 aa, Homo Sapiens
QLNDSTQLN

SEQ ID NO: 1013178 - protein, 9 aa, Homo Sapiens
DCLAEFSSQ

SEQ ID NO: 1013179 - protein, 9 aa, Homo Sapiens
LALQQALLS

SEQ ID NO: 1013180 - protein, 9 aa, Homo Sapiens
LKTITDTYL

SEQ ID NO: 1013181 - protein, 9 aa, Homo Sapiens
PTLSLPTVG

SEQ ID NO: 1013182 - protein, 9 aa, Homo Sapiens
KDLGAEDSS

SEQ ID NO: 1013183 - protein, 9 aa, Homo Sapiens
KKQFDALEV

SEQ ID NO: 1013184 - protein, 9 aa, Homo Sapiens
TFTLVNLTL

SEQ ID NO: 1013185 - protein, 9 aa, Homo Sapiens
DSDLSLNIS

SEQ ID NO: 1013186 - protein, 9 aa, Homo Sapiens
AVNLSSTGE

SEQ ID NO: 1013187 - protein, 9 aa, Homo Sapiens
VPHTSYRNL

SEQ ID NO: 1013188 - protein, 9 aa, Homo Sapiens
LAYLVKKMM

SEQ ID NO: 1013189 - protein, 9 aa, Homo Sapiens
DIQDRINRL

SEQ ID NO: 1013190 - protein, 9 aa, Homo Sapiens
SGSGFLRTN

SEQ ID NO: 1013191 - protein, 9 aa, Homo Sapiens
LGMIGPFLG

SEQ ID NO: 1013192 - protein, 9 aa, Homo Sapiens
VASAKRGQK

SEQ ID NO: 1013193 - protein, 9 aa, Homo Sapiens
FAILERGSF

SEQ ID NO: 1013194 - protein, 9 aa, Homo Sapiens
LRQRVDTMD

SEQ ID NO: 1013195 - protein, 9 aa, Homo Sapiens
DTKLNMLNK

SEQ ID NO: 1013196 - protein, 9 aa, Homo Sapiens
MRNRNVVLT

SEQ ID NO: 1013197 - protein, 9 aa, Homo Sapiens
APASLHGPH

SEQ ID NO: 1013198 - protein, 9 aa, Homo Sapiens
KLHIIIYRL

SEQ ID NO: 1013199 - protein, 9 aa, Homo Sapiens
TSLEQYVPR

SEQ ID NO: 1013200 - protein, 9 aa, Homo Sapiens
VCIPVPDCG

SEQ ID NO: 1013201 - protein, 9 aa, Homo Sapiens
AMVSFGFPE

SEQ ID NO: 1013202 - protein, 9 aa, Homo Sapiens
RNVVLTTTF

SEQ ID NO: 1013203 - protein, 9 aa, Homo Sapiens
RWINLHRHL

SEQ ID NO: 1013204 - protein, 9 aa, Homo Sapiens
ILLFDAHNL

SEQ ID NO: 1013205 - protein, 9 aa, Homo Sapiens
CVGFKISVF

SEQ ID NO: 1013206 - protein, 9 aa, Homo Sapiens
FKFRFTDCE

SEQ ID NO: 1013207 - protein, 9 aa, Homo Sapiens
ASFFIAVVA

SEQ ID NO: 1013208 - protein, 9 aa, Homo Sapiens
DNLPEFTAM

SEQ ID NO: 1013209 - protein, 9 aa, Homo Sapiens
LKQQTPSRT

SEQ ID NO: 1013210 - protein, 9 aa, Homo Sapiens
RALFAIAKL

SEQ ID NO: 1013211 - protein, 9 aa, Homo Sapiens
LENVPNRTL

SEQ ID NO: 1013212 - protein, 9 aa, Homo Sapiens
ELVGYRIFH

SEQ ID NO: 1013213 - protein, 9 aa, Homo Sapiens
LHTGKKPYA

SEQ ID NO: 1013214 - protein, 9 aa, Homo Sapiens
KTFQRHHDP

SEQ ID NO: 1013215 - protein, 9 aa, Homo Sapiens
FKIDPRSGL

SEQ ID NO: 1013216 - protein, 9 aa, Homo Sapiens
SVLFFDRNP

SEQ ID NO: 1013217 - protein, 9 aa, Homo Sapiens
PTYAGSNSA

SEQ ID NO: 1013218 - protein, 9 aa, Homo Sapiens
KEHLCDYTE

SEQ ID NO: 1013219 - protein, 9 aa, Homo Sapiens
QEALDKAKK

SEQ ID NO: 1013220 - protein, 9 aa, Homo Sapiens
ALSGKEGSE

SEQ ID NO: 1013221 - protein, 9 aa, Homo Sapiens
HQPQQHWIK

SEQ ID NO: 1013222 - protein, 9 aa, Homo Sapiens
TNNRKRNIK

SEQ ID NO: 1013223 - protein, 9 aa, Homo Sapiens
EVYVPHTSY

SEQ ID NO: 1013224 - protein, 9 aa, Homo Sapiens
LKKYKEQND

SEQ ID NO: 1013225 - protein, 9 aa, Homo Sapiens
DSSKLDTAE

SEQ ID NO: 1013226 - protein, 9 aa, Homo Sapiens
LTIQFHLDP

SEQ ID NO: 1013227 - protein, 9 aa, Homo Sapiens
LLLDIQDRI

SEQ ID NO: 1013228 - protein, 9 aa, Homo Sapiens
KKILSYINT

SEQ ID NO: 1013229 - protein, 9 aa, Homo Sapiens
TQFKKILSY

SEQ ID NO: 1013230 - protein, 9 aa, Homo Sapiens
SSHIVEAFI

SEQ ID NO: 1013231 - protein, 9 aa, Homo Sapiens
NQTLITDNN

SEQ ID NO: 1013232 - protein, 9 aa, Homo Sapiens
RSSLDLSNY

SEQ ID NO: 1013233 - protein, 9 aa, Homo Sapiens
YRFLSPRSL

SEQ ID NO: 1013234 - protein, 9 aa, Homo Sapiens
LLFDAHNLD

SEQ ID NO: 1013235 - protein, 9 aa, Homo Sapiens
YWVGPIIGE

SEQ ID NO: 1013236 - protein, 9 aa, Homo Sapiens
PLSQDFPYV

SEQ ID NO: 1013237 - protein, 9 aa, Homo Sapiens
TDPCTKLMR

SEQ ID NO: 1013238 - protein, 9 aa, Homo Sapiens
RGLFCRNAR

SEQ ID NO: 1013239 - protein, 9 aa, Homo Sapiens
PPGGPEIGP

SEQ ID NO: 1013240 - protein, 9 aa, Homo Sapiens
ALRKHKIIY

SEQ ID NO: 1013241 - protein, 9 aa, Homo Sapiens
DHISCKLLA

SEQ ID NO: 1013242 - protein, 9 aa, Homo Sapiens
PKVVACTFA

SEQ ID NO: 1013243 - protein, 9 aa, Homo Sapiens
IQECVGFKI

SEQ ID NO: 1013244 - protein, 9 aa, Homo Sapiens
DDNDDTEDF

SEQ ID NO: 1013245 - protein, 9 aa, Homo Sapiens
VFEMSLVPG

SEQ ID NO: 1013246 - protein, 9 aa, Homo Sapiens
PLKRSPSPR

SEQ ID NO: 1013247 - protein, 9 aa, Homo Sapiens
EWEEESLST

SEQ ID NO: 1013248 - protein, 9 aa, Homo Sapiens
KIWELLVLP

SEQ ID NO: 1013249 - protein, 9 aa, Homo Sapiens
HCHYQEYAA

SEQ ID NO: 1013250 - protein, 9 aa, Homo Sapiens
MAEQVMEDK

SEQ ID NO: 1013251 - protein, 9 aa, Homo Sapiens
FLCNGDNDC

SEQ ID NO: 1013252 - protein, 9 aa, Homo Sapiens
ELPAAVNLS

SEQ ID NO: 1013253 - protein, 9 aa, Homo Sapiens
GVILSSLKS

SEQ ID NO: 1013254 - protein, 9 aa, Homo Sapiens
PNSSSGNRA

SEQ ID NO: 1013255 - protein, 9 aa, Homo Sapiens
IWELLVLPI

SEQ ID NO: 1013256 - protein, 9 aa, Homo Sapiens
LTIIDKNDN

SEQ ID NO: 1013257 - protein, 9 aa, Homo Sapiens
LVGYRIFHV

SEQ ID NO: 1013258 - protein, 9 aa, Homo Sapiens
SGATHSLPV

SEQ ID NO: 1013259 - protein, 9 aa, Homo Sapiens
KKPLLQCDK

SEQ ID NO: 1013260 - protein, 9 aa, Homo Sapiens
PSPAPGQAS

SEQ ID NO: 1013261 - protein, 9 aa, Homo Sapiens
SCSSILTAL

SEQ ID NO: 1013262 - protein, 9 aa, Homo Sapiens
FIRAKLIRS

SEQ ID NO: 1013263 - protein, 9 aa, Homo Sapiens
HLCDYTEDE

SEQ ID NO: 1013264 - protein, 9 aa, Homo Sapiens
TPLGSSIEL

SEQ ID NO: 1013265 - protein, 9 aa, Homo Sapiens
SDRLERRVV

SEQ ID NO: 1013266 - protein, 9 aa, Homo Sapiens
CVKSSDQTN

SEQ ID NO: 1013267 - protein, 9 aa, Homo Sapiens
APAVALPPV

SEQ ID NO: 1013268 - protein, 9 aa, Homo Sapiens
AISRREVCD

SEQ ID NO: 1013269 - protein, 9 aa, Homo Sapiens
TNPNFSGQG

SEQ ID NO: 1013270 - protein, 9 aa, Homo Sapiens
DCLLLVVMS

SEQ ID NO: 1013271 - protein, 9 aa, Homo Sapiens
AMAANGLFF

SEQ ID NO: 1013272 - protein, 9 aa, Homo Sapiens
RKYLFTMLM

SEQ ID NO: 1013273 - protein, 9 aa, Homo Sapiens
AILNFIAEH

SEQ ID NO: 1013274 - protein, 9 aa, Homo Sapiens
SSVKPSSPS

SEQ ID NO: 1013275 - protein, 9 aa, Homo Sapiens
QKKVTVLLE

SEQ ID NO: 1013276 - protein, 9 aa, Homo Sapiens
QVYEDLESW

SEQ ID NO: 1013277 - protein, 9 aa, Homo Sapiens
HNDLLGHSK

SEQ ID NO: 1013278 - protein, 9 aa, Homo Sapiens
GSTSKFHCN

SEQ ID NO: 1013279 - protein, 9 aa, Homo Sapiens
GSFLDLLLS

SEQ ID NO: 1013280 - protein, 9 aa, Homo Sapiens
KPMAEVTPP

SEQ ID NO: 1013281 - protein, 9 aa, Homo Sapiens
QTSFNGVYQ

SEQ ID NO: 1013282 - protein, 9 aa, Homo Sapiens
SSSDEHSPY

SEQ ID NO: 1013283 - protein, 9 aa, Homo Sapiens
KNIFRICFH

SEQ ID NO: 1013284 - protein, 9 aa, Homo Sapiens
ANKKRYGLL

SEQ ID NO: 1013285 - protein, 9 aa, Homo Sapiens
VWEHFSSMD

SEQ ID NO: 1013286 - protein, 9 aa, Homo Sapiens
PEADKYCLT

SEQ ID NO: 1013287 - protein, 9 aa, Homo Sapiens
LKPCKKADI

SEQ ID NO: 1013288 - protein, 9 aa, Homo Sapiens
PAARAISRR

SEQ ID NO: 1013289 - protein, 9 aa, Homo Sapiens
PCDLDFKDT

SEQ ID NO: 1013290 - protein, 9 aa, Homo Sapiens
PIFGSGDYS

SEQ ID NO: 1013291 - protein, 9 aa, Homo Sapiens
VKRPRAMAT

SEQ ID NO: 1013292 - protein, 9 aa, Homo Sapiens
RLRGAGRAA

SEQ ID NO: 1013293 - protein, 9 aa, Homo Sapiens
GEKSEEERG

SEQ ID NO: 1013294 - protein, 9 aa, Homo Sapiens
TILCGVVLK

SEQ ID NO: 1013295 - protein, 9 aa, Homo Sapiens
RQVTGRICA

SEQ ID NO: 1013296 - protein, 9 aa, Homo Sapiens
SPCSPCRLC

SEQ ID NO: 1013297 - protein, 9 aa, Homo Sapiens
LKTVEREKT

SEQ ID NO: 1013298 - protein, 9 aa, Homo Sapiens
EEMTPLGSS

SEQ ID NO: 1013299 - protein, 9 aa, Homo Sapiens
DHRNIKAFI

SEQ ID NO: 1013300 - protein, 9 aa, Homo Sapiens
LSFAHTDCL

SEQ ID NO: 1013301 - protein, 9 aa, Homo Sapiens
EGPEKTCSQ

SEQ ID NO: 1013302 - protein, 9 aa, Homo Sapiens
QSTHPLKRS

SEQ ID NO: 1013303 - protein, 9 aa, Homo Sapiens
SCKLLAVVR

SEQ ID NO: 1013304 - protein, 9 aa, Homo Sapiens
RAHQALSRD

SEQ ID NO: 1013305 - protein, 9 aa, Homo Sapiens
SPFFVEGEC

SEQ ID NO: 1013306 - protein, 9 aa, Homo Sapiens
PPPSPPPHI

SEQ ID NO: 1013307 - protein, 9 aa, Homo Sapiens
QPFCCPSWQ

SEQ ID NO: 1013308 - protein, 9 aa, Homo Sapiens
GQLWGGTQP

SEQ ID NO: 1013309 - protein, 9 aa, Homo Sapiens
TLDAERKAR

SEQ ID NO: 1013310 - protein, 9 aa, Homo Sapiens
IPHYKSEID

SEQ ID NO: 1013311 - protein, 9 aa, Homo Sapiens
KCENMKNTE

SEQ ID NO: 1013312 - protein, 9 aa, Homo Sapiens
AILERGSFN

SEQ ID NO: 1013313 - protein, 9 aa, Homo Sapiens
EIGPGVGPG

SEQ ID NO: 1013314 - protein, 9 aa, Homo Sapiens
SPSPRAVSG

SEQ ID NO: 1013315 - protein, 9 aa, Homo Sapiens
DFINQRLKK

SEQ ID NO: 1013316 - protein, 9 aa, Homo Sapiens
RRTGKGVLR

SEQ ID NO: 1013317 - protein, 9 aa, Homo Sapiens
TKIETMVED

SEQ ID NO: 1013318 - protein, 9 aa, Homo Sapiens
YEIFDKGQV

SEQ ID NO: 1013319 - protein, 9 aa, Homo Sapiens
GFSVSDSKR

SEQ ID NO: 1013320 - protein, 9 aa, Homo Sapiens
QLSSFLYQE

SEQ ID NO: 1013321 - protein, 9 aa, Homo Sapiens
PDHRQKRLI

SEQ ID NO: 1013322 - protein, 9 aa, Homo Sapiens
LPIQILSSQ

SEQ ID NO: 1013323 - protein, 9 aa, Homo Sapiens
REQVGGAAW

SEQ ID NO: 1013324 - protein, 9 aa, Homo Sapiens
HCELELGEG

SEQ ID NO: 1013325 - protein, 9 aa, Homo Sapiens
TGSPPPPPS

SEQ ID NO: 1013326 - protein, 9 aa, Homo Sapiens
VNAVTLSGE

SEQ ID NO: 1013327 - protein, 9 aa, Homo Sapiens
FAKEYGKNN

SEQ ID NO: 1013328 - protein, 9 aa, Homo Sapiens
ENLIVTGPT

SEQ ID NO: 1013329 - protein, 9 aa, Homo Sapiens
ENRDSTLKT

SEQ ID NO: 1013330 - protein, 9 aa, Homo Sapiens
NEGQLWGGT

SEQ ID NO: 1013331 - protein, 9 aa, Homo Sapiens
KKTSLGEEM

SEQ ID NO: 1013332 - protein, 9 aa, Homo Sapiens
EDPSRSLHL

SEQ ID NO: 1013333 - protein, 9 aa, Homo Sapiens
VRKISFNPK

SEQ ID NO: 1013334 - protein, 9 aa, Homo Sapiens
KAARLPSMR

SEQ ID NO: 1013335 - protein, 9 aa, Homo Sapiens
LTNEKIKIE

SEQ ID NO: 1013336 - protein, 9 aa, Homo Sapiens
DFPESHVGV

SEQ ID NO: 1013337 - protein, 9 aa, Homo Sapiens
ENELWNCLN

SEQ ID NO: 1013338 - protein, 9 aa, Homo Sapiens
KRDRETLLK

SEQ ID NO: 1013339 - protein, 9 aa, Homo Sapiens
LDREWEEES

SEQ ID NO: 1013340 - protein, 9 aa, Homo Sapiens
NLSSTGEPS

SEQ ID NO: 1013341 - protein, 9 aa, Homo Sapiens
PDAAAAVLK

SEQ ID NO: 1013342 - protein, 9 aa, Homo Sapiens
EEEEEDDND

SEQ ID NO: 1013343 - protein, 9 aa, Homo Sapiens
QEYAAEFPN

SEQ ID NO: 1013344 - protein, 9 aa, Homo Sapiens
ENFPDIHIV

SEQ ID NO: 1013345 - protein, 9 aa, Homo Sapiens
IVEAFIRAK

SEQ ID NO: 1013346 - protein, 9 aa, Homo Sapiens
DTKMYLLAL

SEQ ID NO: 1013347 - protein, 9 aa, Homo Sapiens
PPSWLAPRQ

SEQ ID NO: 1013348 - protein, 9 aa, Homo Sapiens
KPKMETMRM

SEQ ID NO: 1013349 - protein, 9 aa, Homo Sapiens
LSAVRINED

SEQ ID NO: 1013350 - protein, 9 aa, Homo Sapiens
EPECRHLSK

SEQ ID NO: 1013351 - protein, 9 aa, Homo Sapiens
RTANEKITP

SEQ ID NO: 1013352 - protein, 9 aa, Homo Sapiens
MTTGSPPPP

SEQ ID NO: 1013353 - protein, 9 aa, Homo Sapiens
LVASSAIST

SEQ ID NO: 1013354 - protein, 9 aa, Homo Sapiens
ASAWRRALQ

SEQ ID NO: 1013355 - protein, 9 aa, Homo Sapiens
IEGEEDQQR

SEQ ID NO: 1013356 - protein, 9 aa, Homo Sapiens
VYAMAANGL

SEQ ID NO: 1013357 - protein, 9 aa, Homo Sapiens
APCTWMRSG

SEQ ID NO: 1013358 - protein, 9 aa, Homo Sapiens
QIGNACWKL

SEQ ID NO: 1013359 - protein, 9 aa, Homo Sapiens
VGEKVYGQE

SEQ ID NO: 1013360 - protein, 9 aa, Homo Sapiens
LPGGLPRTP

SEQ ID NO: 1013361 - protein, 9 aa, Homo Sapiens
NMDLYHCLL

SEQ ID NO: 1013362 - protein, 9 aa, Homo Sapiens
GTMNTVDIA

SEQ ID NO: 1013363 - protein, 9 aa, Homo Sapiens
TQKKCKVTA

SEQ ID NO: 1013364 - protein, 9 aa, Homo Sapiens
NISLVAGLS

SEQ ID NO: 1013365 - protein, 9 aa, Homo Sapiens
EGDPNPLLP

SEQ ID NO: 1013366 - protein, 9 aa, Homo Sapiens
QNEPERRKN

SEQ ID NO: 1013367 - protein, 9 aa, Homo Sapiens
APAKGDSPV

SEQ ID NO: 1013368 - protein, 9 aa, Homo Sapiens
LGAREKTQD

SEQ ID NO: 1013369 - protein, 9 aa, Homo Sapiens
TKQVQGILF

SEQ ID NO: 1013370 - protein, 9 aa, Homo Sapiens
THWNIDPHL

SEQ ID NO: 1013371 - protein, 9 aa, Homo Sapiens
DFKDTQCPN

SEQ ID NO: 1013372 - protein, 9 aa, Homo Sapiens
PDLPGPPGP

SEQ ID NO: 1013373 - protein, 9 aa, Homo Sapiens
RCVNRRFLC

SEQ ID NO: 1013374 - protein, 9 aa, Homo Sapiens
GYFSDRLER

SEQ ID NO: 1013375 - protein, 9 aa, Homo Sapiens
LYLKGKKPL

SEQ ID NO: 1013376 - protein, 9 aa, Homo Sapiens
SSFRTLGSS

SEQ ID NO: 1013377 - protein, 9 aa, Homo Sapiens
AIAKLPSEM

SEQ ID NO: 1013378 - protein, 9 aa, Homo Sapiens
EHCELELGE

SEQ ID NO: 1013379 - protein, 9 aa, Homo Sapiens
WYWPKDNVC

SEQ ID NO: 1013380 - protein, 9 aa, Homo Sapiens
VSPGFPPIQ

SEQ ID NO: 1013381 - protein, 9 aa, Homo Sapiens
ILLSENFQK

SEQ ID NO: 1013382 - protein, 9 aa, Homo Sapiens
SGTSPALLQ

SEQ ID NO: 1013383 - protein, 9 aa, Homo Sapiens
CFLQEGCCR

SEQ ID NO: 1013384 - protein, 9 aa, Homo Sapiens
GQEDFLYSG

SEQ ID NO: 1013385 - protein, 9 aa, Homo Sapiens
LQMQLNDST

SEQ ID NO: 1013386 - protein, 9 aa, Homo Sapiens
IDHISCKLL

SEQ ID NO: 1013387 - protein, 9 aa, Homo Sapiens
FSGIKTILK

SEQ ID NO: 1013388 - protein, 9 aa, Homo Sapiens
NSQLAPPAM

SEQ ID NO: 1013389 - protein, 9 aa, Homo Sapiens
AVRINEDGQ

SEQ ID NO: 1013390 - protein, 9 aa, Homo Sapiens
QTQKKVTVL

SEQ ID NO: 1013391 - protein, 9 aa, Homo Sapiens
YLFTMLMLG

SEQ ID NO: 1013392 - protein, 9 aa, Homo Sapiens
KKCKVTATA

SEQ ID NO: 1013393 - protein, 9 aa, Homo Sapiens
HRQRWRLQS

SEQ ID NO: 1013394 - protein, 9 aa, Homo Sapiens
EKVYGQEDF

SEQ ID NO: 1013395 - protein, 9 aa, Homo Sapiens
IFSLRNKDI

SEQ ID NO: 1013396 - protein, 9 aa, Homo Sapiens
MEDTDCVGW

SEQ ID NO: 1013397 - protein, 9 aa, Homo Sapiens
GSCAGLHEL

SEQ ID NO: 1013398 - protein, 9 aa, Homo Sapiens
SDEKGIFPA

SEQ ID NO: 1013399 - protein, 9 aa, Homo Sapiens
KYEDAFIRG

SEQ ID NO: 1013400 - protein, 9 aa, Homo Sapiens
KYLFTMLML

SEQ ID NO: 1013401 - protein, 9 aa, Homo Sapiens
QASGPAAAA

SEQ ID NO: 1013402 - protein, 9 aa, Homo Sapiens
GLLTADGTT

SEQ ID NO: 1013403 - protein, 9 aa, Homo Sapiens
AVTISLAYL

SEQ ID NO: 1013404 - protein, 9 aa, Homo Sapiens
DETKLLMVD

SEQ ID NO: 1013405 - protein, 9 aa, Homo Sapiens
KKCEPGSSR

SEQ ID NO: 1013406 - protein, 9 aa, Homo Sapiens
KDCPTQPFC

SEQ ID NO: 1013407 - protein, 9 aa, Homo Sapiens
EDYDYESYK

SEQ ID NO: 1013408 - protein, 9 aa, Homo Sapiens
GVWLMAPLI

SEQ ID NO: 1013409 - protein, 9 aa, Homo Sapiens
NIMLVDPVC

SEQ ID NO: 1013410 - protein, 9 aa, Homo Sapiens
KIKCDECGK

SEQ ID NO: 1013411 - protein, 9 aa, Homo Sapiens
MLAASFFIA

SEQ ID NO: 1013412 - protein, 9 aa, Homo Sapiens
KFDLDSDDE

SEQ ID NO: 1013413 - protein, 9 aa, Homo Sapiens
EILEIFVMI

SEQ ID NO: 1013414 - protein, 9 aa, Homo Sapiens
KEDTKMYLL

SEQ ID NO: 1013415 - protein, 9 aa, Homo Sapiens
VRDLDACAL

SEQ ID NO: 1013416 - protein, 9 aa, Homo Sapiens
FEMSLVPGP

SEQ ID NO: 1013417 - protein, 9 aa, Homo Sapiens
PGPWGSRVG

SEQ ID NO: 1013418 - protein, 9 aa, Homo Sapiens
RTLNSQLAP

SEQ ID NO: 1013419 - protein, 9 aa, Homo Sapiens
KEKIKNGQA

SEQ ID NO: 1013420 - protein, 9 aa, Homo Sapiens
QGQLGSRGA

SEQ ID NO: 1013421 - protein, 9 aa, Homo Sapiens
RAMATHHPL

SEQ ID NO: 1013422 - protein, 9 aa, Homo Sapiens
GRICASLVL

SEQ ID NO: 1013423 - protein, 9 aa, Homo Sapiens
AHNLDISDE

SEQ ID NO: 1013424 - protein, 9 aa, Homo Sapiens
AVLKDRLHP

SEQ ID NO: 1013425 - protein, 9 aa, Homo Sapiens
DRETLLKAQ

SEQ ID NO: 1013426 - protein, 9 aa, Homo Sapiens
RWRLQSRGD

SEQ ID NO: 1013427 - protein, 9 aa, Homo Sapiens
SMDKEDQSL

SEQ ID NO: 1013428 - protein, 9 aa, Homo Sapiens
ETQTSFNGV

SEQ ID NO: 1013429 - protein, 9 aa, Homo Sapiens
GEQPYECTQ

SEQ ID NO: 1013430 - protein, 9 aa, Homo Sapiens
QLARPLLVE

SEQ ID NO: 1013431 - protein, 9 aa, Homo Sapiens
EAEAVLELA

SEQ ID NO: 1013432 - protein, 9 aa, Homo Sapiens
LHRHLEKCG

SEQ ID NO: 1013433 - protein, 9 aa, Homo Sapiens
IFHVWQSAG

SEQ ID NO: 1013434 - protein, 9 aa, Homo Sapiens
TLPTNNRKR

SEQ ID NO: 1013435 - protein, 9 aa, Homo Sapiens
QGPPGGPEI

SEQ ID NO: 1013436 - protein, 9 aa, Homo Sapiens
SGNRAIQSI

SEQ ID NO: 1013437 - protein, 9 aa, Homo Sapiens
QEASEMVFV

SEQ ID NO: 1013438 - protein, 9 aa, Homo Sapiens
KVCQVGSEE

SEQ ID NO: 1013439 - protein, 9 aa, Homo Sapiens
VVACTFARE

SEQ ID NO: 1013440 - protein, 9 aa, Homo Sapiens
GDPNPLLPV

SEQ ID NO: 1013441 - protein, 9 aa, Homo Sapiens
NSGSKKKKK

SEQ ID NO: 1013442 - protein, 9 aa, Homo Sapiens
RLQSRGDCD

SEQ ID NO: 1013443 - protein, 9 aa, Homo Sapiens
ITFSWPQWL

SEQ ID NO: 1013444 - protein, 9 aa, Homo Sapiens
QISRQQSQV

SEQ ID NO: 1013445 - protein, 9 aa, Homo Sapiens
VAEPGNTIS

SEQ ID NO: 1013446 - protein, 9 aa, Homo Sapiens
ALPGSFLDL

SEQ ID NO: 1013447 - protein, 9 aa, Homo Sapiens
NKDIKNAFR

SEQ ID NO: 1013448 - protein, 9 aa, Homo Sapiens
NEPENLIVT

SEQ ID NO: 1013449 - protein, 9 aa, Homo Sapiens
ASCITQKKC

SEQ ID NO: 1013450 - protein, 9 aa, Homo Sapiens
GLVGPRGEQ

SEQ ID NO: 1013451 - protein, 9 aa, Homo Sapiens
YWYWPKDNV

SEQ ID NO: 1013452 - protein, 9 aa, Homo Sapiens
SPSKLCVAC

SEQ ID NO: 1013453 - protein, 9 aa, Homo Sapiens
GYRFLSPRS

SEQ ID NO: 1013454 - protein, 9 aa, Homo Sapiens
ISLASSNPQ

SEQ ID NO: 1013455 - protein, 9 aa, Homo Sapiens
KDKGPKPFG

SEQ ID NO: 1013456 - protein, 9 aa, Homo Sapiens
VSEGSAAER

SEQ ID NO: 1013457 - protein, 9 aa, Homo Sapiens
LKRKSPSEA

SEQ ID NO: 1013458 - protein, 9 aa, Homo Sapiens
EANRSFFSG

SEQ ID NO: 1013459 - protein, 9 aa, Homo Sapiens
ADNIFWGKH

SEQ ID NO: 1013460 - protein, 9 aa, Homo Sapiens
APVVKRPRA

SEQ ID NO: 1013461 - protein, 9 aa, Homo Sapiens
SCAGLHELI

SEQ ID NO: 1013462 - protein, 9 aa, Homo Sapiens
FVDTFQSKK

SEQ ID NO: 1013463 - protein, 9 aa, Homo Sapiens
SHFHAFATV

SEQ ID NO: 1013464 - protein, 9 aa, Homo Sapiens
RQAGNDFVE

SEQ ID NO: 1013465 - protein, 9 aa, Homo Sapiens
PAPVVKRPR

SEQ ID NO: 1013466 - protein, 9 aa, Homo Sapiens
PIQILSSQA

SEQ ID NO: 1013467 - protein, 9 aa, Homo Sapiens
PSRSLHLAA

SEQ ID NO: 1013468 - protein, 9 aa, Homo Sapiens
RKQTQKKVT

SEQ ID NO: 1013469 - protein, 9 aa, Homo Sapiens
ISMIDPSRA

SEQ ID NO: 1013470 - protein, 9 aa, Homo Sapiens
MILNLEGDV

SEQ ID NO: 1013471 - protein, 9 aa, Homo Sapiens
QMFRALFAI

SEQ ID NO: 1013472 - protein, 9 aa, Homo Sapiens
QETARTLSP

SEQ ID NO: 1013473 - protein, 9 aa, Homo Sapiens
KNDNVPVVI

SEQ ID NO: 1013474 - protein, 9 aa, Homo Sapiens
MMHCHYQEY

SEQ ID NO: 1013475 - protein, 9 aa, Homo Sapiens
TVVLTIIDK

SEQ ID NO: 1013476 - protein, 9 aa, Homo Sapiens
DCTNSPYEE

SEQ ID NO: 1013477 - protein, 9 aa, Homo Sapiens
TGRLKQQTP

SEQ ID NO: 1013478 - protein, 9 aa, Homo Sapiens
FDFPESHVG

SEQ ID NO: 1013479 - protein, 9 aa, Homo Sapiens
MQSSNSGSK

SEQ ID NO: 1013480 - protein, 9 aa, Homo Sapiens
LYKCKKCGK

SEQ ID NO: 1013481 - protein, 9 aa, Homo Sapiens
CQQLLAYRS

SEQ ID NO: 1013482 - protein, 9 aa, Homo Sapiens
LAKAEKLFL

SEQ ID NO: 1013483 - protein, 9 aa, Homo Sapiens
GKKPYACSQ

SEQ ID NO: 1013484 - protein, 9 aa, Homo Sapiens
IPCDLDFKD

SEQ ID NO: 1013485 - protein, 9 aa, Homo Sapiens
IDTTSIEKM

SEQ ID NO: 1013486 - protein, 9 aa, Homo Sapiens
GHHSPLFRD

SEQ ID NO: 1013487 - protein, 9 aa, Homo Sapiens
FHKKDLGAE

SEQ ID NO: 1013488 - protein, 9 aa, Homo Sapiens
ARDAPPSPP

SEQ ID NO: 1013489 - protein, 9 aa, Homo Sapiens
VDIQAESQN

SEQ ID NO: 1013490 - protein, 9 aa, Homo Sapiens
AYEIFDKGQ

SEQ ID NO: 1013491 - protein, 9 aa, Homo Sapiens
SILLITGSP

SEQ ID NO: 1013492 - protein, 9 aa, Homo Sapiens
SQTGPEKPL

SEQ ID NO: 1013493 - protein, 9 aa, Homo Sapiens
KLLEDCLAE

SEQ ID NO: 1013494 - protein, 9 aa, Homo Sapiens
HQLLWGKAL

SEQ ID NO: 1013495 - protein, 9 aa, Homo Sapiens
FTHWNIDPH

SEQ ID NO: 1013496 - protein, 9 aa, Homo Sapiens
QEKPDSSGG

SEQ ID NO: 1013497 - protein, 9 aa, Homo Sapiens
FAIAKLPSE

SEQ ID NO: 1013498 - protein, 9 aa, Homo Sapiens
YSAQPPTLS

SEQ ID NO: 1013499 - protein, 9 aa, Homo Sapiens
DILDTAGKE

SEQ ID NO: 1013500 - protein, 9 aa, Homo Sapiens
EGQLWGGTQ

SEQ ID NO: 1013501 - protein, 9 aa, Homo Sapiens
TFRLKNGVL

SEQ ID NO: 1013502 - protein, 9 aa, Homo Sapiens
FMMHCHYQE

SEQ ID NO: 1013503 - protein, 9 aa, Homo Sapiens
FGFEILEIF

SEQ ID NO: 1013504 - protein, 9 aa, Homo Sapiens
HHSPLFRDQ

SEQ ID NO: 1013505 - protein, 9 aa, Homo Sapiens
VFGPTLMRF

SEQ ID NO: 1013506 - protein, 9 aa, Homo Sapiens
PSFEEDYSC

SEQ ID NO: 1013507 - protein, 9 aa, Homo Sapiens
RVLFNFGSQ

SEQ ID NO: 1013508 - protein, 9 aa, Homo Sapiens
KILSYINTG

SEQ ID NO: 1013509 - protein, 9 aa, Homo Sapiens
THNVHKEKI

SEQ ID NO: 1013510 - protein, 9 aa, Homo Sapiens
IKKDHNLHE

SEQ ID NO: 1013511 - protein, 9 aa, Homo Sapiens
PNRTLVIKL

SEQ ID NO: 1013512 - protein, 9 aa, Homo Sapiens
FGYFSDRLE

SEQ ID NO: 1013513 - protein, 9 aa, Homo Sapiens
QLYQNPRNV

SEQ ID NO: 1013514 - protein, 9 aa, Homo Sapiens
QETLISEYF

SEQ ID NO: 1013515 - protein, 9 aa, Homo Sapiens
GVVLRLDFL

SEQ ID NO: 1013516 - protein, 9 aa, Homo Sapiens
KISKKKTHV

SEQ ID NO: 1013517 - protein, 9 aa, Homo Sapiens
RSHFLTEHV

SEQ ID NO: 1013518 - protein, 9 aa, Homo Sapiens
TQIVPDSSK

SEQ ID NO: 1013519 - protein, 9 aa, Homo Sapiens
NVPNRTLVI

SEQ ID NO: 1013520 - protein, 9 aa, Homo Sapiens
NSPYEEPFC

SEQ ID NO: 1013521 - protein, 9 aa, Homo Sapiens
LSYINTGKQ

SEQ ID NO: 1013522 - protein, 9 aa, Homo Sapiens
IAIYVLLTE

SEQ ID NO: 1013523 - protein, 9 aa, Homo Sapiens
EKQIKKLSK

SEQ ID NO: 1013524 - protein, 9 aa, Homo Sapiens
SPLFRDQED

SEQ ID NO: 1013525 - protein, 9 aa, Homo Sapiens
QKRIPFSKT

SEQ ID NO: 1013526 - protein, 9 aa, Homo Sapiens
KSLTLQCVS

SEQ ID NO: 1013527 - protein, 9 aa, Homo Sapiens
LVIMIFYGY

SEQ ID NO: 1013528 - protein, 9 aa, Homo Sapiens
VLLTETVYA

SEQ ID NO: 1013529 - protein, 9 aa, Homo Sapiens
VSGATHSLP

SEQ ID NO: 1013530 - protein, 9 aa, Homo Sapiens
AREVYVPHT

SEQ ID NO: 1013531 - protein, 9 aa, Homo Sapiens
RCSLTEKEI

SEQ ID NO: 1013532 - protein, 9 aa, Homo Sapiens
ANRSFFSGI

SEQ ID NO: 1013533 - protein, 9 aa, Homo Sapiens
GGLPAKRGK

SEQ ID NO: 1013534 - protein, 9 aa, Homo Sapiens
PGLSGKRGP

SEQ ID NO: 1013535 - protein, 9 aa, Homo Sapiens
PPSTMIFSG

SEQ ID NO: 1013536 - protein, 9 aa, Homo Sapiens
NVWDKPGLE

SEQ ID NO: 1013537 - protein, 9 aa, Homo Sapiens
GGNEPPSPP

SEQ ID NO: 1013538 - protein, 9 aa, Homo Sapiens
QRLHTGKKP

SEQ ID NO: 1013539 - protein, 9 aa, Homo Sapiens
WLIAQEDCR

SEQ ID NO: 1013540 - protein, 9 aa, Homo Sapiens
KGWYKKCEP

SEQ ID NO: 1013541 - protein, 9 aa, Homo Sapiens
QREMILNLE

SEQ ID NO: 1013542 - protein, 9 aa, Homo Sapiens
QVVVSTTMS

SEQ ID NO: 1013543 - protein, 9 aa, Homo Sapiens
NFPDIHIVQ

SEQ ID NO: 1013544 - protein, 9 aa, Homo Sapiens
FRNILKKKG

SEQ ID NO: 1013545 - protein, 9 aa, Homo Sapiens
KKIGAIAQV

SEQ ID NO: 1013546 - protein, 9 aa, Homo Sapiens
PPSPPPPFR

SEQ ID NO: 1013547 - protein, 9 aa, Homo Sapiens
VTFFLIGTP

SEQ ID NO: 1013548 - protein, 9 aa, Homo Sapiens
KIPHYKSEI

SEQ ID NO: 1013549 - protein, 9 aa, Homo Sapiens
KLLAVVRLA

SEQ ID NO: 1013550 - protein, 9 aa, Homo Sapiens
MDLYHCLLE

SEQ ID NO: 1013551 - protein, 9 aa, Homo Sapiens
GDETKLLMV

SEQ ID NO: 1013552 - protein, 9 aa, Homo Sapiens
LLGVKQKLL

SEQ ID NO: 1013553 - protein, 9 aa, Homo Sapiens
HVFFLDPRQ

SEQ ID NO: 1013554 - protein, 9 aa, Homo Sapiens
VYEDLESWF

SEQ ID NO: 1013555 - protein, 9 aa, Homo Sapiens
IPREEVENR

SEQ ID NO: 1013556 - protein, 9 aa, Homo Sapiens
GPGRAKREQ

SEQ ID NO: 1013557 - protein, 9 aa, Homo Sapiens
AYRRTGKGV

SEQ ID NO: 1013558 - protein, 9 aa, Homo Sapiens
FVMINNIQC

SEQ ID NO: 1013559 - protein, 9 aa, Homo Sapiens
NLEGDVNSA

SEQ ID NO: 1013560 - protein, 9 aa, Homo Sapiens
FRAFEAVRD

SEQ ID NO: 1013561 - protein, 9 aa, Homo Sapiens
TKIKGKGMQ

SEQ ID NO: 1013562 - protein, 9 aa, Homo Sapiens
SPGCGKTTT

SEQ ID NO: 1013563 - protein, 9 aa, Homo Sapiens
VLFNFGSQS

SEQ ID NO: 1013564 - protein, 9 aa, Homo Sapiens
PTSLMNILP

SEQ ID NO: 1013565 - protein, 9 aa, Homo Sapiens
NIKKDARKD

SEQ ID NO: 1013566 - protein, 9 aa, Homo Sapiens
IKLYLKGKK

SEQ ID NO: 1013567 - protein, 9 aa, Homo Sapiens
PSPPPPFRG

SEQ ID NO: 1013568 - protein, 9 aa, Homo Sapiens
EASEMVFVP

SEQ ID NO: 1013569 - protein, 9 aa, Homo Sapiens
AAVLKDRLH

SEQ ID NO: 1013570 - protein, 9 aa, Homo Sapiens
DTQCPNPSS

SEQ ID NO: 1013571 - protein, 9 aa, Homo Sapiens
AELPLGFSK

SEQ ID NO: 1013572 - protein, 9 aa, Homo Sapiens
AREKTQDLA

SEQ ID NO: 1013573 - protein, 9 aa, Homo Sapiens
LDILDTAGK

SEQ ID NO: 1013574 - protein, 9 aa, Homo Sapiens
ATFRLKNGV

SEQ ID NO: 1013575 - protein, 9 aa, Homo Sapiens
PKAARLPSM

SEQ ID NO: 1013576 - protein, 9 aa, Homo Sapiens
FEKLTATLA

SEQ ID NO: 1013577 - protein, 9 aa, Homo Sapiens
RSKTFTGRL

SEQ ID NO: 1013578 - protein, 9 aa, Homo Sapiens
DQKKSKGGE

SEQ ID NO: 1013579 - protein, 9 aa, Homo Sapiens
RDSTLKTVE

SEQ ID NO: 1013580 - protein, 9 aa, Homo Sapiens
AEQVNAVTL

SEQ ID NO: 1013581 - protein, 9 aa, Homo Sapiens
FRQQEGTED

SEQ ID NO: 1013582 - protein, 9 aa, Homo Sapiens
CSWVFELQL

SEQ ID NO: 1013583 - protein, 9 aa, Homo Sapiens
WKDPEAEAV

SEQ ID NO: 1013584 - protein, 9 aa, Homo Sapiens
WYKKCEPGS

SEQ ID NO: 1013585 - protein, 9 aa, Homo Sapiens
IRMNRNRCQ

SEQ ID NO: 1013586 - protein, 9 aa, Homo Sapiens
RISISGKEK

SEQ ID NO: 1013587 - protein, 9 aa, Homo Sapiens
SMEYFNPHT

SEQ ID NO: 1013588 - protein, 9 aa, Homo Sapiens
EQYVPRNYV

SEQ ID NO: 1013589 - protein, 9 aa, Homo Sapiens
HKAMVSFGF

SEQ ID NO: 1013590 - protein, 9 aa, Homo Sapiens
DRIYWYWPK

SEQ ID NO: 1013591 - protein, 9 aa, Homo Sapiens
CLEDMPELV

SEQ ID NO: 1013592 - protein, 9 aa, Homo Sapiens
EVGEFLPKG

SEQ ID NO: 1013593 - protein, 9 aa, Homo Sapiens
TLTGLAATS

SEQ ID NO: 1013594 - protein, 9 aa, Homo Sapiens
QDRINRLAP

SEQ ID NO: 1013595 - protein, 9 aa, Homo Sapiens
CPVLLGVKQ

SEQ ID NO: 1013596 - protein, 9 aa, Homo Sapiens
VMEDKFDLD

SEQ ID NO: 1013597 - protein, 9 aa, Homo Sapiens
VAVTDVDKP

SEQ ID NO: 1013598 - protein, 9 aa, Homo Sapiens
FKRLKTITD

SEQ ID NO: 1013599 - protein, 9 aa, Homo Sapiens
TTLICNPPL

SEQ ID NO: 1013600 - protein, 9 aa, Homo Sapiens
KLTVHRVVH

SEQ ID NO: 1013601 - protein, 9 aa, Homo Sapiens
LLEDCLAEF

SEQ ID NO: 1013602 - protein, 9 aa, Homo Sapiens
HRVVHTGEK

SEQ ID NO: 1013603 - protein, 9 aa, Homo Sapiens
ELPLGFSKM

SEQ ID NO: 1013604 - protein, 9 aa, Homo Sapiens
DVDKPPEFR

SEQ ID NO: 1013605 - protein, 9 aa, Homo Sapiens
TVHRVVHTG

SEQ ID NO: 1013606 - protein, 9 aa, Homo Sapiens
SENFQKRLP

SEQ ID NO: 1013607 - protein, 9 aa, Homo Sapiens
IIRMNRNRC

SEQ ID NO: 1013608 - protein, 9 aa, Homo Sapiens
ASALVIMIF

SEQ ID NO: 1013609 - protein, 9 aa, Homo Sapiens
HQALSRDSV

SEQ ID NO: 1013610 - protein, 9 aa, Homo Sapiens
QANSLDSLK

SEQ ID NO: 1013611 - protein, 9 aa, Homo Sapiens
IELALSALG

SEQ ID NO: 1013612 - protein, 9 aa, Homo Sapiens
TNETQTSFN

SEQ ID NO: 1013613 - protein, 9 aa, Homo Sapiens
PSWASAPCT

SEQ ID NO: 1013614 - protein, 9 aa, Homo Sapiens
IMLVDPVCQ

SEQ ID NO: 1013615 - protein, 9 aa, Homo Sapiens
ARGLWATGH

SEQ ID NO: 1013616 - protein, 9 aa, Homo Sapiens
NDSTQLNSD

SEQ ID NO: 1013617 - protein, 9 aa, Homo Sapiens
RRLGSKIWE

SEQ ID NO: 1013618 - protein, 9 aa, Homo Sapiens
SNPQKTVTM

SEQ ID NO: 1013619 - protein, 9 aa, Homo Sapiens
ERTANEKIT

SEQ ID NO: 1013620 - protein, 9 aa, Homo Sapiens
NLDISDEFS

SEQ ID NO: 1013621 - protein, 9 aa, Homo Sapiens
GRFVMRNRN

SEQ ID NO: 1013622 - protein, 9 aa, Homo Sapiens
EQNEPERRK

SEQ ID NO: 1013623 - protein, 9 aa, Homo Sapiens
IVQWLRAME

SEQ ID NO: 1013624 - protein, 9 aa, Homo Sapiens
LTDNQTLTM

SEQ ID NO: 1013625 - protein, 9 aa, Homo Sapiens
FHLDPAGLI

SEQ ID NO: 1013626 - protein, 9 aa, Homo Sapiens
LQQQQQTQV

SEQ ID NO: 1013627 - protein, 9 aa, Homo Sapiens
HPSYFCKYE

SEQ ID NO: 1013628 - protein, 9 aa, Homo Sapiens
WNCLNQQQE

SEQ ID NO: 1013629 - protein, 9 aa, Homo Sapiens
FIRVSPHRN

SEQ ID NO: 1013630 - protein, 9 aa, Homo Sapiens
KSEIDENTF

SEQ ID NO: 1013631 - protein, 9 aa, Homo Sapiens
LRNKDIKNA

SEQ ID NO: 1013632 - protein, 9 aa, Homo Sapiens
STNENLHDY

SEQ ID NO: 1013633 - protein, 9 aa, Homo Sapiens
QEKFTIWNG

SEQ ID NO: 1013634 - protein, 9 aa, Homo Sapiens
DCPTQPFCC

SEQ ID NO: 1013635 - protein, 9 aa, Homo Sapiens
AEAVLELAL

SEQ ID NO: 1013636 - protein, 9 aa, Homo Sapiens
ENCSIIRMN

SEQ ID NO: 1013637 - protein, 9 aa, Homo Sapiens
SKLDTAENL

SEQ ID NO: 1013638 - protein, 9 aa, Homo Sapiens
KKDLGAEDS

SEQ ID NO: 1013639 - protein, 9 aa, Homo Sapiens
EMSLVPGPV

SEQ ID NO: 1013640 - protein, 9 aa, Homo Sapiens
FEILEIFVM

SEQ ID NO: 1013641 - protein, 9 aa, Homo Sapiens
YGLLTADGT

SEQ ID NO: 1013642 - protein, 9 aa, Homo Sapiens
SFGFPEFFR

SEQ ID NO: 1013643 - protein, 9 aa, Homo Sapiens
EPERRKNGV

SEQ ID NO: 1013644 - protein, 9 aa, Homo Sapiens
LCIQTSPDP

SEQ ID NO: 1013645 - protein, 9 aa, Homo Sapiens
VVSTTMSVD

SEQ ID NO: 1013646 - protein, 9 aa, Homo Sapiens
CKKADIPKR

SEQ ID NO: 1013647 - protein, 9 aa, Homo Sapiens
KKKRSVQSG

SEQ ID NO: 1013648 - protein, 9 aa, Homo Sapiens
LQFFAKEYG

SEQ ID NO: 1013649 - protein, 9 aa, Homo Sapiens
LIGTPGLED

SEQ ID NO: 1013650 - protein, 9 aa, Homo Sapiens
ILDTAGKEE

SEQ ID NO: 1013651 - protein, 9 aa, Homo Sapiens
EQKIKGWYK

SEQ ID NO: 1013652 - protein, 9 aa, Homo Sapiens
VYPLSQDFP

SEQ ID NO: 1013653 - protein, 9 aa, Homo Sapiens
LLLSPSLME

SEQ ID NO: 1013654 - protein, 9 aa, Homo Sapiens
PYDCISTGD

SEQ ID NO: 1013655 - protein, 9 aa, Homo Sapiens
KIKIEECIK

SEQ ID NO: 1013656 - protein, 9 aa, Homo Sapiens
IPEMKTILC

SEQ ID NO: 1013657 - protein, 9 aa, Homo Sapiens
EGLEIVRGG

SEQ ID NO: 1013658 - protein, 9 aa, Homo Sapiens
PIVLQRIDL

SEQ ID NO: 1013659 - protein, 9 aa, Homo Sapiens
NPAGNKRQY

SEQ ID NO: 1013660 - protein, 9 aa, Homo Sapiens
QGVCIPVPD

SEQ ID NO: 1013661 - protein, 9 aa, Homo Sapiens
GKSRNQLSS

SEQ ID NO: 1013662 - protein, 9 aa, Homo Sapiens
LTALPQVNE

SEQ ID NO: 1013663 - protein, 9 aa, Homo Sapiens
AAAVLKDRL

SEQ ID NO: 1013664 - protein, 9 aa, Homo Sapiens
KADSIQETA

SEQ ID NO: 1013665 - protein, 9 aa, Homo Sapiens
KLTDNQTLT

SEQ ID NO: 1013666 - protein, 9 aa, Homo Sapiens
DLQMQLNDS

SEQ ID NO: 1013667 - protein, 9 aa, Homo Sapiens
NIPKTEQHK

SEQ ID NO: 1013668 - protein, 9 aa, Homo Sapiens
QACGTMNTV

SEQ ID NO: 1013669 - protein, 9 aa, Homo Sapiens
TSFNGVYQP

SEQ ID NO: 1013670 - protein, 9 aa, Homo Sapiens
NTVDIANNS

SEQ ID NO: 1013671 - protein, 9 aa, Homo Sapiens
LHPSYFCKY

SEQ ID NO: 1013672 - protein, 9 aa, Homo Sapiens
PSDLLVFNL

SEQ ID NO: 1013673 - protein, 9 aa, Homo Sapiens
EPFCKKEVS

SEQ ID NO: 1013674 - protein, 9 aa, Homo Sapiens
SPPSTMIFS

SEQ ID NO: 1013675 - protein, 9 aa, Homo Sapiens
TCSQLLIMD

SEQ ID NO: 1013676 - protein, 9 aa, Homo Sapiens
ADSIQETAR

SEQ ID NO: 1013677 - protein, 9 aa, Homo Sapiens
IYWYWPKDN

SEQ ID NO: 1013678 - protein, 9 aa, Homo Sapiens
TIVAEPGNT

SEQ ID NO: 1013679 - protein, 9 aa, Homo Sapiens
LENRDSTLK

SEQ ID NO: 1013680 - protein, 9 aa, Homo Sapiens
ACWKLYCLE

SEQ ID NO: 1013681 - protein, 9 aa, Homo Sapiens
FLDLLLSPS

SEQ ID NO: 1013682 - protein, 9 aa, Homo Sapiens
ENVPNRTLV

SEQ ID NO: 1013683 - protein, 9 aa, Homo Sapiens
NKTENVSVY

SEQ ID NO: 1013684 - protein, 9 aa, Homo Sapiens
SPPRPERML

SEQ ID NO: 1013685 - protein, 9 aa, Homo Sapiens
NDDTEDFAD

SEQ ID NO: 1013686 - protein, 9 aa, Homo Sapiens
VYVPHTSYR

SEQ ID NO: 1013687 - protein, 9 aa, Homo Sapiens
ESNISLVAG

SEQ ID NO: 1013688 - protein, 9 aa, Homo Sapiens
SFEEDYSCT

SEQ ID NO: 1013689 - protein, 9 aa, Homo Sapiens
LIEWLPHND

SEQ ID NO: 1013690 - protein, 9 aa, Homo Sapiens
VHRVVHTGE

SEQ ID NO: 1013691 - protein, 9 aa, Homo Sapiens
IEFPLPDHR

SEQ ID NO: 1013692 - protein, 9 aa, Homo Sapiens
FLIMSRLCQ

SEQ ID NO: 1013693 - protein, 9 aa, Homo Sapiens
GEKVYGQED

SEQ ID NO: 1013694 - protein, 9 aa, Homo Sapiens
VTGPTNETL

SEQ ID NO: 1013695 - protein, 9 aa, Homo Sapiens
SDQEPGAKK

SEQ ID NO: 1013696 - protein, 9 aa, Homo Sapiens
LKTQIVPDS

SEQ ID NO: 1013697 - protein, 9 aa, Homo Sapiens
VNFMEGDPN

SEQ ID NO: 1013698 - protein, 9 aa, Homo Sapiens
PLLVEYLII

SEQ ID NO: 1013699 - protein, 9 aa, Homo Sapiens
LPTNNRKRN

SEQ ID NO: 1013700 - protein, 9 aa, Homo Sapiens
GPTLMRFPE

SEQ ID NO: 1013701 - protein, 9 aa, Homo Sapiens
RIQAEQVNA

SEQ ID NO: 1013702 - protein, 9 aa, Homo Sapiens
WNIDPHLSR

SEQ ID NO: 1013703 - protein, 9 aa, Homo Sapiens
TPVHISILQ

SEQ ID NO: 1013704 - protein, 9 aa, Homo Sapiens
KEPTSLMNI

SEQ ID NO: 1013705 - protein, 9 aa, Homo Sapiens
MCSGPSRVC

SEQ ID NO: 1013706 - protein, 9 aa, Homo Sapiens
RGEQGFPGE

SEQ ID NO: 1013707 - protein, 9 aa, Homo Sapiens
LHHRIHSGE

SEQ ID NO: 1013708 - protein, 9 aa, Homo Sapiens
YNGSLFTME

SEQ ID NO: 1013709 - protein, 9 aa, Homo Sapiens
IQETLISEY

SEQ ID NO: 1013710 - protein, 9 aa, Homo Sapiens
LVDPVCQPY

SEQ ID NO: 1013711 - protein, 9 aa, Homo Sapiens
HARGLWATG

SEQ ID NO: 1013712 - protein, 9 aa, Homo Sapiens
KESTDSFHR

SEQ ID NO: 1013713 - protein, 9 aa, Homo Sapiens
VMRNRNVVL

SEQ ID NO: 1013714 - protein, 9 aa, Homo Sapiens
GPWGSRVGG

SEQ ID NO: 1013715 - protein, 9 aa, Homo Sapiens
INVGLEEKD

SEQ ID NO: 1013716 - protein, 9 aa, Homo Sapiens
CLTYAYFAG

SEQ ID NO: 1013717 - protein, 9 aa, Homo Sapiens
LLLLDIQDR

SEQ ID NO: 1013718 - protein, 9 aa, Homo Sapiens
LRRCGMITK

SEQ ID NO: 1013719 - protein, 9 aa, Homo Sapiens
TKPKMETMR

SEQ ID NO: 1013720 - protein, 9 aa, Homo Sapiens
YCLTYAYFA

SEQ ID NO: 1013721 - protein, 9 aa, Homo Sapiens
VTHNVHKEK

SEQ ID NO: 1013722 - protein, 9 aa, Homo Sapiens
NRDSTLKTV

SEQ ID NO: 1013723 - protein, 9 aa, Homo Sapiens
SVLQLTLSL

SEQ ID NO: 1013724 - protein, 9 aa, Homo Sapiens
RGSFNLSSN

SEQ ID NO: 1013725 - protein, 9 aa, Homo Sapiens
YVLLTETVY

SEQ ID NO: 1013726 - protein, 9 aa, Homo Sapiens
FAGGFFKGP

SEQ ID NO: 1013727 - protein, 9 aa, Homo Sapiens
SPYEEPFCK

SEQ ID NO: 1013728 - protein, 9 aa, Homo Sapiens
DPVCQPYRV

SEQ ID NO: 1013729 - protein, 9 aa, Homo Sapiens
YSGIDIKTV

SEQ ID NO: 1013730 - protein, 9 aa, Homo Sapiens
RGVKGKEAT

SEQ ID NO: 1013731 - protein, 9 aa, Homo Sapiens
QQSQVDRLY

SEQ ID NO: 1013732 - protein, 9 aa, Homo Sapiens
AAGVLVVPG

SEQ ID NO: 1013733 - protein, 9 aa, Homo Sapiens
ILERDKNRR

SEQ ID NO: 1013734 - protein, 9 aa, Homo Sapiens
QGYLDDSEY

SEQ ID NO: 1013735 - protein, 9 aa, Homo Sapiens
NLHRHLEKC

SEQ ID NO: 1013736 - protein, 9 aa, Homo Sapiens
LPSMRRESG

SEQ ID NO: 1013737 - protein, 9 aa, Homo Sapiens
KVTVLLEHQ

SEQ ID NO: 1013738 - protein, 9 aa, Homo Sapiens
MDNSAIKIL

SEQ ID NO: 1013739 - protein, 9 aa, Homo Sapiens
QQRESPIEG

SEQ ID NO: 1013740 - protein, 9 aa, Homo Sapiens
FINQRLKKN

SEQ ID NO: 1013741 - protein, 9 aa, Homo Sapiens
EYSIQDLKS

SEQ ID NO: 1013742 - protein, 9 aa, Homo Sapiens
SRVCQCREH

SEQ ID NO: 1013743 - protein, 9 aa, Homo Sapiens
KLYLKGKKP

SEQ ID NO: 1013744 - protein, 9 aa, Homo Sapiens
HFHAFATVS

SEQ ID NO: 1013745 - protein, 9 aa, Homo Sapiens
KPDPSRTLN

SEQ ID NO: 1013746 - protein, 9 aa, Homo Sapiens
TQLIGIIID

SEQ ID NO: 1013747 - protein, 9 aa, Homo Sapiens
AERKARTRE

SEQ ID NO: 1013748 - protein, 9 aa, Homo Sapiens
MPWKENIIF

SEQ ID NO: 1013749 - protein, 9 aa, Homo Sapiens
TLTNEKIKI

SEQ ID NO: 1013750 - protein, 9 aa, Homo Sapiens
NCLNQQQEE

SEQ ID NO: 1013751 - protein, 9 aa, Homo Sapiens
QSHVFFLDP

SEQ ID NO: 1013752 - protein, 9 aa, Homo Sapiens
PFQFAGGFF

SEQ ID NO: 1013753 - protein, 9 aa, Homo Sapiens
QNAPYLEVY

SEQ ID NO: 1013754 - protein, 9 aa, Homo Sapiens
CIKRKTEIT

SEQ ID NO: 1013755 - protein, 9 aa, Homo Sapiens
EHSPYNGSL

SEQ ID NO: 1013756 - protein, 9 aa, Homo Sapiens
KKYKEQNDL

SEQ ID NO: 1013757 - protein, 9 aa, Homo Sapiens
QYSAWAESV

SEQ ID NO: 1013758 - protein, 9 aa, Homo Sapiens
ETKQVQGIL

SEQ ID NO: 1013759 - protein, 9 aa, Homo Sapiens
ILGMIGPFL

SEQ ID NO: 1013760 - protein, 9 aa, Homo Sapiens
KIEFPLPDH

SEQ ID NO: 1013761 - protein, 9 aa, Homo Sapiens
VYKVTAYFY

SEQ ID NO: 1013762 - protein, 9 aa, Homo Sapiens
SASEPRFYE

SEQ ID NO: 1013763 - protein, 9 aa, Homo Sapiens
SSGGSTQIQ

SEQ ID NO: 1013764 - protein, 9 aa, Homo Sapiens
YVVFVVLLI

SEQ ID NO: 1013765 - protein, 9 aa, Homo Sapiens
SSLDLSNYP

SEQ ID NO: 1013766 - protein, 9 aa, Homo Sapiens
PECRHLSKK

SEQ ID NO: 1013767 - protein, 9 aa, Homo Sapiens
PYEEPFCKK

SEQ ID NO: 1013768 - protein, 9 aa, Homo Sapiens
EEVGEFLPK

SEQ ID NO: 1013769 - protein, 9 aa, Homo Sapiens
KRPRAMATH

SEQ ID NO: 1013770 - protein, 9 aa, Homo Sapiens
VQYEIKLLE

SEQ ID NO: 1013771 - protein, 9 aa, Homo Sapiens
EEEEDEDDF

SEQ ID NO: 1013772 - protein, 9 aa, Homo Sapiens
PERRKNGVL

SEQ ID NO: 1013773 - protein, 9 aa, Homo Sapiens
WRLQSRGDC

SEQ ID NO: 1013774 - protein, 9 aa, Homo Sapiens
KMEDTDCVG

SEQ ID NO: 1013775 - protein, 9 aa, Homo Sapiens
PEIGPGVGP

SEQ ID NO: 1013776 - protein, 9 aa, Homo Sapiens
SEALSGSLP

SEQ ID NO: 1013777 - protein, 9 aa, Homo Sapiens
VVVSTTMSV

SEQ ID NO: 1013778 - protein, 9 aa, Homo Sapiens
SPGFPPIQG

SEQ ID NO: 1013779 - protein, 9 aa, Homo Sapiens
GIIIDTTSI

SEQ ID NO: 1013780 - protein, 9 aa, Homo Sapiens
KAARKSALA

SEQ ID NO: 1013781 - protein, 9 aa, Homo Sapiens
LTSASEPRF

SEQ ID NO: 1013782 - protein, 9 aa, Homo Sapiens
YMVKVCQVG

SEQ ID NO: 1013783 - protein, 9 aa, Homo Sapiens
PQGIDGQPG

SEQ ID NO: 1013784 - protein, 9 aa, Homo Sapiens
LGRPSGQRE

SEQ ID NO: 1013785 - protein, 9 aa, Homo Sapiens
DVFEMSLVP

SEQ ID NO: 1013786 - protein, 9 aa, Homo Sapiens
KKSLLNFVE

SEQ ID NO: 1013787 - protein, 9 aa, Homo Sapiens
LLCTLLGLE

SEQ ID NO: 1013788 - protein, 9 aa, Homo Sapiens
EDCLAEFSS

SEQ ID NO: 1013789 - protein, 9 aa, Homo Sapiens
LRKHKIIYT

SEQ ID NO: 1013790 - protein, 9 aa, Homo Sapiens
YKSEIDENT

SEQ ID NO: 1013791 - protein, 9 aa, Homo Sapiens
AFSRCKKIG

SEQ ID NO: 1013792 - protein, 9 aa, Homo Sapiens
TDFPLYFLI

SEQ ID NO: 1013793 - protein, 9 aa, Homo Sapiens
SKEFGSGFS

SEQ ID NO: 1013794 - protein, 9 aa, Homo Sapiens
FEEDYSCTQ

SEQ ID NO: 1013795 - protein, 9 aa, Homo Sapiens
AGILAGKDA

SEQ ID NO: 1013796 - protein, 9 aa, Homo Sapiens
HQAILFMLA

SEQ ID NO: 1013797 - protein, 9 aa, Homo Sapiens
GQWAGSSSV

SEQ ID NO: 1013798 - protein, 9 aa, Homo Sapiens
KREQVGGAA

SEQ ID NO: 1013799 - protein, 9 aa, Homo Sapiens
VTGRICASL

SEQ ID NO: 1013800 - protein, 9 aa, Homo Sapiens
GEKLYKCKK

SEQ ID NO: 1013801 - protein, 9 aa, Homo Sapiens
MAHGYGEKS

SEQ ID NO: 1013802 - protein, 9 aa, Homo Sapiens
KNKKSQREK

SEQ ID NO: 1013803 - protein, 9 aa, Homo Sapiens
GQQNNGIRC

SEQ ID NO: 1013804 - protein, 9 aa, Homo Sapiens
NLTWIHTTL

SEQ ID NO: 1013805 - protein, 9 aa, Homo Sapiens
RVQEKPDSS

SEQ ID NO: 1013806 - protein, 9 aa, Homo Sapiens
QILSSQATR

SEQ ID NO: 1013807 - protein, 9 aa, Homo Sapiens
ILCGVVLKE

SEQ ID NO: 1013808 - protein, 9 aa, Homo Sapiens
EWLPHNDLL

SEQ ID NO: 1013809 - protein, 9 aa, Homo Sapiens
RFPELDAMA

SEQ ID NO: 1013810 - protein, 9 aa, Homo Sapiens
HSMSSGSGF

SEQ ID NO: 1013811 - protein, 9 aa, Homo Sapiens
IAQEDCRTR

SEQ ID NO: 1013812 - protein, 9 aa, Homo Sapiens
IYNLRNAEV

SEQ ID NO: 1013813 - protein, 9 aa, Homo Sapiens
PEYPPPPSP

SEQ ID NO: 1013814 - protein, 9 aa, Homo Sapiens
SPVGLGTPG

SEQ ID NO: 1013815 - protein, 9 aa, Homo Sapiens
EAVRDLDAC

SEQ ID NO: 1013816 - protein, 9 aa, Homo Sapiens
PREEVENRD

SEQ ID NO: 1013817 - protein, 9 aa, Homo Sapiens
RESPIEGRQ

SEQ ID NO: 1013818 - protein, 9 aa, Homo Sapiens
KDRGICELR

SEQ ID NO: 1013819 - protein, 9 aa, Homo Sapiens
PPATKKMAC

SEQ ID NO: 1013820 - protein, 9 aa, Homo Sapiens
LILERDKNR

SEQ ID NO: 1013821 - protein, 9 aa, Homo Sapiens
FAHTDCLLL

SEQ ID NO: 1013822 - protein, 9 aa, Homo Sapiens
PSPPPHIYD

SEQ ID NO: 1013823 - protein, 9 aa, Homo Sapiens
PAGNKRQYS

SEQ ID NO: 1013824 - protein, 9 aa, Homo Sapiens
KTQIVPDSS

SEQ ID NO: 1013825 - protein, 9 aa, Homo Sapiens
NSSLKSRNV

SEQ ID NO: 1013826 - protein, 9 aa, Homo Sapiens
RQGSCAGLH

SEQ ID NO: 1013827 - protein, 9 aa, Homo Sapiens
WLKPCKKAD

SEQ ID NO: 1013828 - protein, 9 aa, Homo Sapiens
IKLLELIQR

SEQ ID NO: 1013829 - protein, 9 aa, Homo Sapiens
LHIIIYRLV

SEQ ID NO: 1013830 - protein, 9 aa, Homo Sapiens
SYINTGKQE

SEQ ID NO: 1013831 - protein, 9 aa, Homo Sapiens
CRPQANSLD

SEQ ID NO: 1013832 - protein, 9 aa, Homo Sapiens
PDLPFIRVS

SEQ ID NO: 1013833 - protein, 9 aa, Homo Sapiens
EPKAARLPS

SEQ ID NO: 1013834 - protein, 9 aa, Homo Sapiens
TKKMACKDP

SEQ ID NO: 1013835 - protein, 9 aa, Homo Sapiens
LQQQLEGRG

SEQ ID NO: 1013836 - protein, 9 aa, Homo Sapiens
LISMIDPSR

SEQ ID NO: 1013837 - protein, 9 aa, Homo Sapiens
PRGEQGFPG

SEQ ID NO: 1013838 - protein, 9 aa, Homo Sapiens
VENRDQVPY

SEQ ID NO: 1013839 - protein, 9 aa, Homo Sapiens
GPSRVCQCR

SEQ ID NO: 1013840 - protein, 9 aa, Homo Sapiens
KKEFPRCLS

SEQ ID NO: 1013841 - protein, 9 aa, Homo Sapiens
LGCPVLLGV

SEQ ID NO: 1013842 - protein, 9 aa, Homo Sapiens
GPAGIPGLS

SEQ ID NO: 1013843 - protein, 9 aa, Homo Sapiens
GDQGQLGSR

SEQ ID NO: 1013844 - protein, 9 aa, Homo Sapiens
HFSSMDKED

SEQ ID NO: 1013845 - protein, 9 aa, Homo Sapiens
EQLTVVRKI

SEQ ID NO: 1013846 - protein, 9 aa, Homo Sapiens
ETLPPEMVT

SEQ ID NO: 1013847 - protein, 9 aa, Homo Sapiens
ILERGSFNL

SEQ ID NO: 1013848 - protein, 9 aa, Homo Sapiens
RGICELRAE

SEQ ID NO: 1013849 - protein, 9 aa, Homo Sapiens
KKTTRTSDV

SEQ ID NO: 1013850 - protein, 9 aa, Homo Sapiens
AWWDNKIFR

SEQ ID NO: 1013851 - protein, 9 aa, Homo Sapiens
FLRTNQKRS

SEQ ID NO: 1013852 - protein, 9 aa, Homo Sapiens
LVLVLFGYR

SEQ ID NO: 1013853 - protein, 9 aa, Homo Sapiens
GTLDAERKA

SEQ ID NO: 1013854 - protein, 9 aa, Homo Sapiens
STPPTLTGL

SEQ ID NO: 1013855 - protein, 9 aa, Homo Sapiens
ESKFFKQKD

SEQ ID NO: 1013856 - protein, 9 aa, Homo Sapiens
ERRVVLWAT

SEQ ID NO: 1013857 - protein, 9 aa, Homo Sapiens
GFSSFRTLG

SEQ ID NO: 1013858 - protein, 9 aa, Homo Sapiens
SLGEVIDSH

SEQ ID NO: 1013859 - protein, 9 aa, Homo Sapiens
GPHPRFWSS

SEQ ID NO: 1013860 - protein, 9 aa, Homo Sapiens
EDDFYTFHH

SEQ ID NO: 1013861 - protein, 9 aa, Homo Sapiens
TSLGEEMTP

SEQ ID NO: 1013862 - protein, 9 aa, Homo Sapiens
VTLCNLNDF

SEQ ID NO: 1013863 - protein, 9 aa, Homo Sapiens
GEVIDSHDA

SEQ ID NO: 1013864 - protein, 9 aa, Homo Sapiens
SGQWAGSSS

SEQ ID NO: 1013865 - protein, 9 aa, Homo Sapiens
VAMVKREIL

SEQ ID NO: 1013866 - protein, 9 aa, Homo Sapiens
FLALRGIRS

SEQ ID NO: 1013867 - protein, 9 aa, Homo Sapiens
DVAMVKREI

SEQ ID NO: 1013868 - protein, 9 aa, Homo Sapiens
PSPPPYRMH

SEQ ID NO: 1013869 - protein, 9 aa, Homo Sapiens
SYNDSAWQK

SEQ ID NO: 1013870 - protein, 9 aa, Homo Sapiens
PAREVYVPH

SEQ ID NO: 1013871 - protein, 9 aa, Homo Sapiens
PLIYNLRNA

SEQ ID NO: 1013872 - protein, 9 aa, Homo Sapiens
TLTMIKATA

SEQ ID NO: 1013873 - protein, 9 aa, Homo Sapiens
GPTGSPLCI

SEQ ID NO: 1013874 - protein, 9 aa, Homo Sapiens
DTDCVGWAL

SEQ ID NO: 1013875 - protein, 9 aa, Homo Sapiens
EDLESWFQA

SEQ ID NO: 1013876 - protein, 9 aa, Homo Sapiens
AWPIVLQRI

SEQ ID NO: 1013877 - protein, 9 aa, Homo Sapiens
GSKIWELLV

SEQ ID NO: 1013878 - protein, 9 aa, Homo Sapiens
AANGLFFQV

SEQ ID NO: 1013879 - protein, 9 aa, Homo Sapiens
FQKFATGNC

SEQ ID NO: 1013880 - protein, 9 aa, Homo Sapiens
GEDSVRGVK

SEQ ID NO: 1013881 - protein, 9 aa, Homo Sapiens
LLIKKDHNL

SEQ ID NO: 1013882 - protein, 9 aa, Homo Sapiens
RRQLLAVAG

SEQ ID NO: 1013883 - protein, 9 aa, Homo Sapiens
VGPRGEQGF

SEQ ID NO: 1013884 - protein, 9 aa, Homo Sapiens
QSSNSGSKK

SEQ ID NO: 1013885 - protein, 9 aa, Homo Sapiens
LRGIRSGNT

SEQ ID NO: 1013886 - protein, 9 aa, Homo Sapiens
LCGVVLKEY

SEQ ID NO: 1013887 - protein, 9 aa, Homo Sapiens
GLTPGEKIE

SEQ ID NO: 1013888 - protein, 9 aa, Homo Sapiens
HLSRRLIII

SEQ ID NO: 1013889 - protein, 9 aa, Homo Sapiens
WGKALLITP

SEQ ID NO: 1013890 - protein, 9 aa, Homo Sapiens
VFFLDPRQR

SEQ ID NO: 1013891 - protein, 9 aa, Homo Sapiens
SKTPVGGDQ

SEQ ID NO: 1013892 - protein, 9 aa, Homo Sapiens
IGIIIDTTS

SEQ ID NO: 1013893 - protein, 9 aa, Homo Sapiens
SAPCTWMRS

SEQ ID NO: 1013894 - protein, 9 aa, Homo Sapiens
SDLLVFNLT

SEQ ID NO: 1013895 - protein, 9 aa, Homo Sapiens
GRLRGAGRA

SEQ ID NO: 1013896 - protein, 9 aa, Homo Sapiens
AARAISRRE

SEQ ID NO: 1013897 - protein, 9 aa, Homo Sapiens
WHCSWVFEL

SEQ ID NO: 1013898 - protein, 9 aa, Homo Sapiens
MEGDPNPLL

SEQ ID NO: 1013899 - protein, 9 aa, Homo Sapiens
WELLVLPIY

SEQ ID NO: 1013900 - protein, 9 aa, Homo Sapiens
AANEGQLWG

SEQ ID NO: 1013901 - protein, 9 aa, Homo Sapiens
VFVVLLIRV

SEQ ID NO: 1013902 - protein, 9 aa, Homo Sapiens
NESELVYLE

SEQ ID NO: 1013903 - protein, 9 aa, Homo Sapiens
NDSAWQKRI

SEQ ID NO: 1013904 - protein, 9 aa, Homo Sapiens
THPLKRSPS

SEQ ID NO: 1013905 - protein, 9 aa, Homo Sapiens
IFSGGTALK

SEQ ID NO: 1013906 - protein, 9 aa, Homo Sapiens
EEEEDDNDD

SEQ ID NO: 1013907 - protein, 9 aa, Homo Sapiens
TPTIVLVGS

SEQ ID NO: 1013908 - protein, 9 aa, Homo Sapiens
AKREQVGGA

SEQ ID NO: 1013909 - protein, 9 aa, Homo Sapiens
RCLSTNENL

SEQ ID NO: 1013910 - protein, 9 aa, Homo Sapiens
RSSHIVEAF

SEQ ID NO: 1013911 - protein, 9 aa, Homo Sapiens
SRTLNSQLA

SEQ ID NO: 1013912 - protein, 9 aa, Homo Sapiens
NARFDFPES

SEQ ID NO: 1013913 - protein, 9 aa, Homo Sapiens
VGYRIFHVW

SEQ ID NO: 1013914 - protein, 9 aa, Homo Sapiens
SGNTGSQDH

SEQ ID NO: 1013915 - protein, 9 aa, Homo Sapiens
WLPHNDLLG

SEQ ID NO: 1013916 - protein, 9 aa, Homo Sapiens
GEEVGEFLP

SEQ ID NO: 1013917 - protein, 9 aa, Homo Sapiens
YDSSKLDTA

SEQ ID NO: 1013918 - protein, 9 aa, Homo Sapiens
GQLGSRGAS

SEQ ID NO: 1013919 - protein, 9 aa, Homo Sapiens
KNKYEDAFI

SEQ ID NO: 1013920 - protein, 9 aa, Homo Sapiens
SVYPLSQDF

SEQ ID NO: 1013921 - protein, 9 aa, Homo Sapiens
LEAQSLGNF

SEQ ID NO: 1013922 - protein, 9 aa, Homo Sapiens
PKDKGPKPF

SEQ ID NO: 1013923 - protein, 9 aa, Homo Sapiens
TFLRSHFLT

SEQ ID NO: 1013924 - protein, 9 aa, Homo Sapiens
EKFTIWNGG

SEQ ID NO: 1013925 - protein, 9 aa, Homo Sapiens
VEELEKQIK

SEQ ID NO: 1013926 - protein, 9 aa, Homo Sapiens
SPAPGQASG

SEQ ID NO: 1013927 - protein, 9 aa, Homo Sapiens
QVTGRICAS

SEQ ID NO: 1013928 - protein, 9 aa, Homo Sapiens
HSDVFEMSL

SEQ ID NO: 1013929 - protein, 9 aa, Homo Sapiens
NVGEKVYGQ

SEQ ID NO: 1013930 - protein, 9 aa, Homo Sapiens
LKDCQQLLA

SEQ ID NO: 1013931 - protein, 9 aa, Homo Sapiens
SYWHCSWVF

SEQ ID NO: 1013932 - protein, 9 aa, Homo Sapiens
EEANRSFFS

SEQ ID NO: 1013933 - protein, 9 aa, Homo Sapiens
DQQRIIRPG

SEQ ID NO: 1013934 - protein, 9 aa, Homo Sapiens
GVKIKLHII

SEQ ID NO: 1013935 - protein, 9 aa, Homo Sapiens
RSPSPRAVS

SEQ ID NO: 1013936 - protein, 9 aa, Homo Sapiens
KTCAGQQNN

SEQ ID NO: 1013937 - protein, 9 aa, Homo Sapiens
ENIIFRNVN

SEQ ID NO: 1013938 - protein, 9 aa, Homo Sapiens
GFFKGPPVS

SEQ ID NO: 1013939 - protein, 9 aa, Homo Sapiens
SAWQKRIPF

SEQ ID NO: 1013940 - protein, 9 aa, Homo Sapiens
IFWGKHFEF

SEQ ID NO: 1013941 - protein, 9 aa, Homo Sapiens
VKGKEATDA

SEQ ID NO: 1013942 - protein, 9 aa, Homo Sapiens
LSQLLQQRE

SEQ ID NO: 1013943 - protein, 9 aa, Homo Sapiens
LTVHRVVHT

SEQ ID NO: 1013944 - protein, 9 aa, Homo Sapiens
LNDSTQLNS

SEQ ID NO: 1013945 - protein, 9 aa, Homo Sapiens
PQQHWIKRG

SEQ ID NO: 1013946 - protein, 9 aa, Homo Sapiens
AGVLVVPGT

SEQ ID NO: 1013947 - protein, 9 aa, Homo Sapiens
PGPKSDVGP

SEQ ID NO: 1013948 - protein, 9 aa, Homo Sapiens
MVDRETDEF

SEQ ID NO: 1013949 - protein, 9 aa, Homo Sapiens
TNLINRSTL

SEQ ID NO: 1013950 - protein, 9 aa, Homo Sapiens
KGVKIKLHI

SEQ ID NO: 1013951 - protein, 9 aa, Homo Sapiens
LFDAHNLDI

SEQ ID NO: 1013952 - protein, 9 aa, Homo Sapiens
WRRALQRWA

SEQ ID NO: 1013953 - protein, 9 aa, Homo Sapiens
HDGRLRGAG

SEQ ID NO: 1013954 - protein, 9 aa, Homo Sapiens
DKAKKKDKK

SEQ ID NO: 1013955 - protein, 9 aa, Homo Sapiens
RGGLQNAGL

SEQ ID NO: 1013956 - protein, 9 aa, Homo Sapiens
TMSVDGHVL

SEQ ID NO: 1013957 - protein, 9 aa, Homo Sapiens
ALAKAPVSS

SEQ ID NO: 1013958 - protein, 9 aa, Homo Sapiens
ISILQVGET

SEQ ID NO: 1013959 - protein, 9 aa, Homo Sapiens
LWATGHRVW

SEQ ID NO: 1013960 - protein, 9 aa, Homo Sapiens
TDKPTYKLG

SEQ ID NO: 1013961 - protein, 9 aa, Homo Sapiens
AMVKREILS

SEQ ID NO: 1013962 - protein, 9 aa, Homo Sapiens
LGEVIDSHD

SEQ ID NO: 1013963 - protein, 9 aa, Homo Sapiens
GAPAKGDSP

SEQ ID NO: 1013964 - protein, 9 aa, Homo Sapiens
IFVMINNIQ

SEQ ID NO: 1013965 - protein, 9 aa, Homo Sapiens
FFKQKDVET

SEQ ID NO: 1013966 - protein, 9 aa, Homo Sapiens
SPIEGRQGH

SEQ ID NO: 1013967 - protein, 9 aa, Homo Sapiens
VLVLFGYRF

SEQ ID NO: 1013968 - protein, 9 aa, Homo Sapiens
VLLGVKQKL

SEQ ID NO: 1013969 - protein, 9 aa, Homo Sapiens
DSLKSPFIE

SEQ ID NO: 1013970 - protein, 9 aa, Homo Sapiens
SKLTVHRVV

SEQ ID NO: 1013971 - protein, 9 aa, Homo Sapiens
DLLLSPSLM

SEQ ID NO: 1013972 - protein, 9 aa, Homo Sapiens
QAILFMLAE

SEQ ID NO: 1013973 - protein, 9 aa, Homo Sapiens
SDRLALFLL

SEQ ID NO: 1013974 - protein, 9 aa, Homo Sapiens
KVVACTFAR

SEQ ID NO: 1013975 - protein, 9 aa, Homo Sapiens
KENIIFRNV

SEQ ID NO: 1013976 - protein, 9 aa, Homo Sapiens
QQLRSAHKT

SEQ ID NO: 1013977 - protein, 9 aa, Homo Sapiens
QGIDGQPGV

SEQ ID NO: 1013978 - protein, 9 aa, Homo Sapiens
KSEEERGLE

SEQ ID NO: 1013979 - protein, 9 aa, Homo Sapiens
SLRRCGMIT

SEQ ID NO: 1013980 - protein, 9 aa, Homo Sapiens
KKISKKKTH

SEQ ID NO: 1013981 - protein, 9 aa, Homo Sapiens
PAPIPGDLV

SEQ ID NO: 1013982 - protein, 9 aa, Homo Sapiens
YDCISTGDK

SEQ ID NO: 1013983 - protein, 9 aa, Homo Sapiens
RINEDGQEV

SEQ ID NO: 1013984 - protein, 9 aa, Homo Sapiens
NLYHAKKKI

SEQ ID NO: 1013985 - protein, 9 aa, Homo Sapiens
LFAIAKLPS

SEQ ID NO: 1013986 - protein, 9 aa, Homo Sapiens
LDTAGKEEY

SEQ ID NO: 1013987 - protein, 9 aa, Homo Sapiens
CENMKNTEE

SEQ ID NO: 1013988 - protein, 9 aa, Homo Sapiens
DPKGLSPRD

SEQ ID NO: 1013989 - protein, 9 aa, Homo Sapiens
PTHQPQQHW

SEQ ID NO: 1013990 - protein, 9 aa, Homo Sapiens
VCWKPWVIG

SEQ ID NO: 1013991 - protein, 9 aa, Homo Sapiens
DLDFKDTQC

SEQ ID NO: 1013992 - protein, 9 aa, Homo Sapiens
IQETARTLS

SEQ ID NO: 1013993 - protein, 9 aa, Homo Sapiens
GGSPKLAVY

SEQ ID NO: 1013994 - protein, 9 aa, Homo Sapiens
NFLPKKTSL

SEQ ID NO: 1013995 - protein, 9 aa, Homo Sapiens
SPSDLLVFN

SEQ ID NO: 1013996 - protein, 9 aa, Homo Sapiens
IAAGVLVVP

SEQ ID NO: 1013997 - protein, 9 aa, Homo Sapiens
QIVPDSSKP

SEQ ID NO: 1013998 - protein, 9 aa, Homo Sapiens
LADLSRKNM

SEQ ID NO: 1013999 - protein, 9 aa, Homo Sapiens
YEAFSRCKK

SEQ ID NO: 1014000 - protein, 9 aa, Homo Sapiens
RLERRVVLW

SEQ ID NO: 1014001 - protein, 9 aa, Homo Sapiens
IYVLLTETV

SEQ ID NO: 1014002 - protein, 9 aa, Homo Sapiens
KRLKTITDT

SEQ ID NO: 1014003 - protein, 9 aa, Homo Sapiens
VKLDNEPPN

SEQ ID NO: 1014004 - protein, 9 aa, Homo Sapiens
GAYQLYQNP

SEQ ID NO: 1014005 - protein, 9 aa, Homo Sapiens
ESPSDLLVF

SEQ ID NO: 1014006 - protein, 9 aa, Homo Sapiens
PSPRAVSGA

SEQ ID NO: 1014007 - protein, 9 aa, Homo Sapiens
FGSGDYSWV

SEQ ID NO: 1014008 - protein, 9 aa, Homo Sapiens
PSYFCKYEG

SEQ ID NO: 1014009 - protein, 9 aa, Homo Sapiens
SGFSVSDSK

SEQ ID NO: 1014010 - protein, 9 aa, Homo Sapiens
HRNIKAFIS

SEQ ID NO: 1014011 - protein, 9 aa, Homo Sapiens
LPVSFAASP

SEQ ID NO: 1014012 - protein, 9 aa, Homo Sapiens
WTIVAEPGN

SEQ ID NO: 1014013 - protein, 9 aa, Homo Sapiens
AIAIAAGVL

SEQ ID NO: 1014014 - protein, 9 aa, Homo Sapiens
ATVTHNVHK

SEQ ID NO: 1014015 - protein, 9 aa, Homo Sapiens
GEAGPPDLP

SEQ ID NO: 1014016 - protein, 9 aa, Homo Sapiens
DAILNFIAE

SEQ ID NO: 1014017 - protein, 9 aa, Homo Sapiens
SLPVSFAAS

SEQ ID NO: 1014018 - protein, 9 aa, Homo Sapiens
DIKNAFRRM

SEQ ID NO: 1014019 - protein, 9 aa, Homo Sapiens
PGQASGPAA

SEQ ID NO: 1014020 - protein, 9 aa, Homo Sapiens
VKPSSPSWA

SEQ ID NO: 1014021 - protein, 9 aa, Homo Sapiens
PFEEKTKIE

SEQ ID NO: 1014022 - protein, 9 aa, Homo Sapiens
PNVWDKPGL

SEQ ID NO: 1014023 - protein, 9 aa, Homo Sapiens
RAISRREVC

SEQ ID NO: 1014024 - protein, 9 aa, Homo Sapiens
FTGRLKQQT

SEQ ID NO: 1014025 - protein, 9 aa, Homo Sapiens
YSWVMRDWL

SEQ ID NO: 1014026 - protein, 9 aa, Homo Sapiens
GKDAGMSSE

SEQ ID NO: 1014027 - protein, 9 aa, Homo Sapiens
SPLPIQILS

SEQ ID NO: 1014028 - protein, 9 aa, Homo Sapiens
RLALFLLLP

SEQ ID NO: 1014029 - protein, 9 aa, Homo Sapiens
AKGDSPVGL

SEQ ID NO: 1014030 - protein, 9 aa, Homo Sapiens
NENCSIIRM

SEQ ID NO: 1014031 - protein, 9 aa, Homo Sapiens
HTDNIVQWL

SEQ ID NO: 1014032 - protein, 9 aa, Homo Sapiens
QVRFWLQAE

SEQ ID NO: 1014033 - protein, 9 aa, Homo Sapiens
RNKDIKNAF

SEQ ID NO: 1014034 - protein, 9 aa, Homo Sapiens
GPGPWGSRV

SEQ ID NO: 1014035 - protein, 9 aa, Homo Sapiens
NFNKAKPIG

SEQ ID NO: 1014036 - protein, 9 aa, Homo Sapiens
PISLRRCGM

SEQ ID NO: 1014037 - protein, 9 aa, Homo Sapiens
KSTKPKMET

SEQ ID NO: 1014038 - protein, 9 aa, Homo Sapiens
TGLQGASIQ

SEQ ID NO: 1014039 - protein, 9 aa, Homo Sapiens
VISLGEEVG

SEQ ID NO: 1014040 - protein, 9 aa, Homo Sapiens
DNIVQWLRA

SEQ ID NO: 1014041 - protein, 9 aa, Homo Sapiens
LVGPRGEQG

SEQ ID NO: 1014042 - protein, 9 aa, Homo Sapiens
VLYGYCNLK

SEQ ID NO: 1014043 - protein, 9 aa, Homo Sapiens
AFKIDPRSG

SEQ ID NO: 1014044 - protein, 9 aa, Homo Sapiens
EGSETRLSP

SEQ ID NO: 1014045 - protein, 9 aa, Homo Sapiens
PHPRFWSSS

SEQ ID NO: 1014046 - protein, 9 aa, Homo Sapiens
AGKEEYSAM

SEQ ID NO: 1014047 - protein, 9 aa, Homo Sapiens
GTGLQGASI

SEQ ID NO: 1014048 - protein, 9 aa, Homo Sapiens
VMLLLLDIQ

SEQ ID NO: 1014049 - protein, 9 aa, Homo Sapiens
SLGEEVGEF

SEQ ID NO: 1014050 - protein, 9 aa, Homo Sapiens
KTFTGRLKQ

SEQ ID NO: 1014051 - protein, 9 aa, Homo Sapiens
YPLSQDFPY

SEQ ID NO: 1014052 - protein, 9 aa, Homo Sapiens
IDPHLSRRL

SEQ ID NO: 1014053 - protein, 9 aa, Homo Sapiens
ITGSPGCGK

SEQ ID NO: 1014054 - protein, 9 aa, Homo Sapiens
KSYSQEKRG

SEQ ID NO: 1014055 - protein, 9 aa, Homo Sapiens
KPLEPAPRL

SEQ ID NO: 1014056 - protein, 9 aa, Homo Sapiens
ILSSQATRG

SEQ ID NO: 1014057 - protein, 9 aa, Homo Sapiens
SSLEAQSLG

SEQ ID NO: 1014058 - protein, 9 aa, Homo Sapiens
ELPVSPGFP

SEQ ID NO: 1014059 - protein, 9 aa, Homo Sapiens
MVKREILSA

SEQ ID NO: 1014060 - protein, 9 aa, Homo Sapiens
NFGSQSPLI

SEQ ID NO: 1014061 - protein, 9 aa, Homo Sapiens
TLALQQALL

SEQ ID NO: 1014062 - protein, 9 aa, Homo Sapiens
VNLSSTGEP

SEQ ID NO: 1014063 - protein, 9 aa, Homo Sapiens
DKPPEFRPP

SEQ ID NO: 1014064 - protein, 9 aa, Homo Sapiens
KIERRQLLA

SEQ ID NO: 1014065 - protein, 9 aa, Homo Sapiens
SGDYSWVMR

SEQ ID NO: 1014066 - protein, 9 aa, Homo Sapiens
SFLDLLLSP

SEQ ID NO: 1014067 - protein, 9 aa, Homo Sapiens
GILFSSNNE

SEQ ID NO: 1014068 - protein, 9 aa, Homo Sapiens
RLPRKYLFT

SEQ ID NO: 1014069 - protein, 9 aa, Homo Sapiens
KAARTAAKA

SEQ ID NO: 1014070 - protein, 9 aa, Homo Sapiens
EMTPLGSSI

SEQ ID NO: 1014071 - protein, 9 aa, Homo Sapiens
ESPIEGRQG

SEQ ID NO: 1014072 - protein, 9 aa, Homo Sapiens
NQRLKKNDT

SEQ ID NO: 1014073 - protein, 9 aa, Homo Sapiens
PCKKADIPK

SEQ ID NO: 1014074 - protein, 9 aa, Homo Sapiens
GSPLCIQTS

SEQ ID NO: 1014075 - protein, 9 aa, Homo Sapiens
TLAKPTKSE

SEQ ID NO: 1014076 - protein, 9 aa, Homo Sapiens
GAKKPMAEV

SEQ ID NO: 1014077 - protein, 9 aa, Homo Sapiens
LDREQQSLY

SEQ ID NO: 1014078 - protein, 9 aa, Homo Sapiens
AKNKKSQRE

SEQ ID NO: 1014079 - protein, 9 aa, Homo Sapiens
VDKPPEFRP

SEQ ID NO: 1014080 - protein, 9 aa, Homo Sapiens
RGLWATGHR

SEQ ID NO: 1014081 - protein, 9 aa, Homo Sapiens
QRWRLQSRG

SEQ ID NO: 1014082 - protein, 9 aa, Homo Sapiens
TLSLPMFLQ

SEQ ID NO: 1014083 - protein, 9 aa, Homo Sapiens
AGGSPKLAV

SEQ ID NO: 1014084 - protein, 9 aa, Homo Sapiens
DSTLKTVER

SEQ ID NO: 1014085 - protein, 9 aa, Homo Sapiens
RIYWYWPKD

SEQ ID NO: 1014086 - protein, 9 aa, Homo Sapiens
QFHLDPAGL

SEQ ID NO: 1014087 - protein, 9 aa, Homo Sapiens
EVLYGYCNL

SEQ ID NO: 1014088 - protein, 9 aa, Homo Sapiens
ANSLDSLKS

SEQ ID NO: 1014089 - protein, 9 aa, Homo Sapiens
KEKNTDWSY

SEQ ID NO: 1014090 - protein, 9 aa, Homo Sapiens
GRGDQGQLG

SEQ ID NO: 1014091 - protein, 9 aa, Homo Sapiens
AALQSGQWA

SEQ ID NO: 1014092 - protein, 9 aa, Homo Sapiens
EDQQRIIRP

SEQ ID NO: 1014093 - protein, 9 aa, Homo Sapiens
WLMAPLIAK

SEQ ID NO: 1014094 - protein, 9 aa, Homo Sapiens
MSLVPGPVL

SEQ ID NO: 1014095 - protein, 9 aa, Homo Sapiens
SSISVEHGQ

SEQ ID NO: 1014096 - protein, 9 aa, Homo Sapiens
LSAPLRSSV

SEQ ID NO: 1014097 - protein, 9 aa, Homo Sapiens
SWLAPRQAA

SEQ ID NO: 1014098 - protein, 9 aa, Homo Sapiens
NPLLPVLGM

SEQ ID NO: 1014099 - protein, 9 aa, Homo Sapiens
HRQKRLIFS

SEQ ID NO: 1014100 - protein, 9 aa, Homo Sapiens
KFATGNCPI

SEQ ID NO: 1014101 - protein, 9 aa, Homo Sapiens
LGAYQLYQN

SEQ ID NO: 1014102 - protein, 9 aa, Homo Sapiens
FKISVFLQT

SEQ ID NO: 1014103 - protein, 9 aa, Homo Sapiens
EIPTHQPQQ

SEQ ID NO: 1014104 - protein, 9 aa, Homo Sapiens
VKDHRNIKA

SEQ ID NO: 1014105 - protein, 9 aa, Homo Sapiens
CGVVLKEYL

SEQ ID NO: 1014106 - protein, 9 aa, Homo Sapiens
NPHTNKWSL

SEQ ID NO: 1014107 - protein, 9 aa, Homo Sapiens
ILSSLKSYS

SEQ ID NO: 1014108 - protein, 9 aa, Homo Sapiens
QLTLSLPMF

SEQ ID NO: 1014109 - protein, 9 aa, Homo Sapiens
LESKFFKQK

SEQ ID NO: 1014110 - protein, 9 aa, Homo Sapiens
CRLCAPCSV

SEQ ID NO: 1014111 - protein, 9 aa, Homo Sapiens
VKIKLHIII

SEQ ID NO: 1014112 - protein, 9 aa, Homo Sapiens
TYAGSNSAM

SEQ ID NO: 1014113 - protein, 9 aa, Homo Sapiens
KGQVRFWLQ

SEQ ID NO: 1014114 - protein, 9 aa, Homo Sapiens
LYNISVRAT

SEQ ID NO: 1014115 - protein, 9 aa, Homo Sapiens
KSSSLNSEN

SEQ ID NO: 1014116 - protein, 9 aa, Homo Sapiens
VCCDPCFLQ

SEQ ID NO: 1014117 - protein, 9 aa, Homo Sapiens
YQNPRNVWG

SEQ ID NO: 1014118 - protein, 9 aa, Homo Sapiens
FPELDAMAA

SEQ ID NO: 1014119 - protein, 9 aa, Homo Sapiens
VGPEADKYC

SEQ ID NO: 1014120 - protein, 9 aa, Homo Sapiens
KTFLRSHFL

SEQ ID NO: 1014121 - protein, 9 aa, Homo Sapiens
TLITDNNGL

SEQ ID NO: 1014122 - protein, 9 aa, Homo Sapiens
KSRNVCASG

SEQ ID NO: 1014123 - protein, 9 aa, Homo Sapiens
NHYDGSTSK

SEQ ID NO: 1014124 - protein, 9 aa, Homo Sapiens
KEGSETRLS

SEQ ID NO: 1014125 - protein, 9 aa, Homo Sapiens
GYGEKSEEE

SEQ ID NO: 1014126 - protein, 9 aa, Homo Sapiens
DDFYTFHHG

SEQ ID NO: 1014127 - protein, 9 aa, Homo Sapiens
YFYSGIDIK

SEQ ID NO: 1014128 - protein, 9 aa, Homo Sapiens
LHKEEKLKR

SEQ ID NO: 1014129 - protein, 9 aa, Homo Sapiens
YNKGEVLYG

SEQ ID NO: 1014130 - protein, 9 aa, Homo Sapiens
QWAGSSSVL

SEQ ID NO: 1014131 - protein, 9 aa, Homo Sapiens
SKMCIASHF

SEQ ID NO: 1014132 - protein, 9 aa, Homo Sapiens
FDKGQVRFW

SEQ ID NO: 1014133 - protein, 9 aa, Homo Sapiens
GHLCFYIPG

SEQ ID NO: 1014134 - protein, 9 aa, Homo Sapiens
SMAPAVALP

SEQ ID NO: 1014135 - protein, 9 aa, Homo Sapiens
ISGKEKNTD

SEQ ID NO: 1014136 - protein, 9 aa, Homo Sapiens
LLQQRESPI

SEQ ID NO: 1014137 - protein, 9 aa, Homo Sapiens
DLPFIRVSP

SEQ ID NO: 1014138 - protein, 9 aa, Homo Sapiens
KQEEEKEII

SEQ ID NO: 1014139 - protein, 9 aa, Homo Sapiens
RQQSQVDRL

SEQ ID NO: 1014140 - protein, 9 aa, Homo Sapiens
KEIARQQLE

SEQ ID NO: 1014141 - protein, 9 aa, Homo Sapiens
FQGPPGGPE

SEQ ID NO: 1014142 - protein, 9 aa, Homo Sapiens
KNGVLRPVP

SEQ ID NO: 1014143 - protein, 9 aa, Homo Sapiens
LENFPDIHI

SEQ ID NO: 1014144 - protein, 9 aa, Homo Sapiens
EIARQQLEF

SEQ ID NO: 1014145 - protein, 9 aa, Homo Sapiens
TLLLLIKKD

SEQ ID NO: 1014146 - protein, 9 aa, Homo Sapiens
LEEKDPNLE

SEQ ID NO: 1014147 - protein, 9 aa, Homo Sapiens
SNISLVAGL

SEQ ID NO: 1014148 - protein, 9 aa, Homo Sapiens
VVRKISFNP

SEQ ID NO: 1014149 - protein, 9 aa, Homo Sapiens
AAFKIDPRS

SEQ ID NO: 1014150 - protein, 9 aa, Homo Sapiens
EEKDPNLED

SEQ ID NO: 1014151 - protein, 9 aa, Homo Sapiens
EQQSLYNIS

SEQ ID NO: 1014152 - protein, 9 aa, Homo Sapiens
QECVGFKIS

SEQ ID NO: 1014153 - protein, 9 aa, Homo Sapiens
EKIKCDECG

SEQ ID NO: 1014154 - protein, 9 aa, Homo Sapiens
VIMIFYGYI

SEQ ID NO: 1014155 - protein, 9 aa, Homo Sapiens
MLVDPVCQP

SEQ ID NO: 1014156 - protein, 9 aa, Homo Sapiens
SDVGPNGQP

SEQ ID NO: 1014157 - protein, 9 aa, Homo Sapiens
IQILSSQAT

SEQ ID NO: 1014158 - protein, 9 aa, Homo Sapiens
EYAAEFPNS

SEQ ID NO: 1014159 - protein, 9 aa, Homo Sapiens
VGFKISVFL

SEQ ID NO: 1014160 - protein, 9 aa, Homo Sapiens
PAPGQASGP

SEQ ID NO: 1014161 - protein, 9 aa, Homo Sapiens
DKYCLTYAY

SEQ ID NO: 1014162 - protein, 9 aa, Homo Sapiens
DLTIQFHLD

SEQ ID NO: 1014163 - protein, 9 aa, Homo Sapiens
SGRREPFSG

SEQ ID NO: 1014164 - protein, 9 aa, Homo Sapiens
RCKKIGAIA

SEQ ID NO: 1014165 - protein, 9 aa, Homo Sapiens
KSQNSKDRG

SEQ ID NO: 1014166 - protein, 9 aa, Homo Sapiens
QLWGGTQPR

SEQ ID NO: 1014167 - protein, 9 aa, Homo Sapiens
KFFKQKDVE

SEQ ID NO: 1014168 - protein, 9 aa, Homo Sapiens
IAIAAGVLV

SEQ ID NO: 1014169 - protein, 9 aa, Homo Sapiens
EFGSGFSVS

SEQ ID NO: 1014170 - protein, 9 aa, Homo Sapiens
FHAFATVSF

SEQ ID NO: 1014171 - protein, 9 aa, Homo Sapiens
YLEVYKDMI

SEQ ID NO: 1014172 - protein, 9 aa, Homo Sapiens
GRQGHLCFY

SEQ ID NO: 1014173 - protein, 9 aa, Homo Sapiens
RTLVIKLNA

SEQ ID NO: 1014174 - protein, 9 aa, Homo Sapiens
ALFAIAKLP

SEQ ID NO: 1014175 - protein, 9 aa, Homo Sapiens
GHPDGTSPK

SEQ ID NO: 1014176 - protein, 9 aa, Homo Sapiens
LCLLPYDCI

SEQ ID NO: 1014177 - protein, 9 aa, Homo Sapiens
NSSLGEVID

SEQ ID NO: 1014178 - protein, 9 aa, Homo Sapiens
AVTLCNLND

SEQ ID NO: 1014179 - protein, 9 aa, Homo Sapiens
SEQISRQQS

SEQ ID NO: 1014180 - protein, 9 aa, Homo Sapiens
KKGIVVGIK

SEQ ID NO: 1014181 - protein, 9 aa, Homo Sapiens
RGLLRQTSR

SEQ ID NO: 1014182 - protein, 9 aa, Homo Sapiens
NLHPSYFCK

SEQ ID NO: 1014183 - protein, 9 aa, Homo Sapiens
GAGILAGKD

SEQ ID NO: 1014184 - protein, 9 aa, Homo Sapiens
EKLYKCKKC

SEQ ID NO: 1014185 - protein, 9 aa, Homo Sapiens
PWGSRVGGG

SEQ ID NO: 1014186 - protein, 9 aa, Homo Sapiens
LLSENFQKR

SEQ ID NO: 1014187 - protein, 9 aa, Homo Sapiens
HRAGLPKDK

SEQ ID NO: 1014188 - protein, 9 aa, Homo Sapiens
KSLLNFVET

SEQ ID NO: 1014189 - protein, 9 aa, Homo Sapiens
PVGGDQKKS

SEQ ID NO: 1014190 - protein, 9 aa, Homo Sapiens
IFGSGDYSW

SEQ ID NO: 1014191 - protein, 9 aa, Homo Sapiens
KGKKPLLQC

SEQ ID NO: 1014192 - protein, 9 aa, Homo Sapiens
IPTHQPQQH

SEQ ID NO: 1014193 - protein, 9 aa, Homo Sapiens
FLSFAHTDC

SEQ ID NO: 1014194 - protein, 9 aa, Homo Sapiens
KNRRENVVR

SEQ ID NO: 1014195 - protein, 9 aa, Homo Sapiens
GNKRQYSAW

SEQ ID NO: 1014196 - protein, 9 aa, Homo Sapiens
GEAKLPSTF

SEQ ID NO: 1014197 - protein, 9 aa, Homo Sapiens
TQKKVTVLL

SEQ ID NO: 1014198 - protein, 9 aa, Homo Sapiens
LWGGTQPRV

SEQ ID NO: 1014199 - protein, 9 aa, Homo Sapiens
RNILKKKGI

SEQ ID NO: 1014200 - protein, 9 aa, Homo Sapiens
WKEHLCDYT

SEQ ID NO: 1014201 - protein, 9 aa, Homo Sapiens
IGEGLGSLL

SEQ ID NO: 1014202 - protein, 9 aa, Homo Sapiens
SMIDPSRAA

SEQ ID NO: 1014203 - protein, 9 aa, Homo Sapiens
EDGQEVLYL

SEQ ID NO: 1014204 - protein, 9 aa, Homo Sapiens
EKTQDLAPL

SEQ ID NO: 1014205 - protein, 9 aa, Homo Sapiens
VVFVVLLIR

SEQ ID NO: 1014206 - protein, 9 aa, Homo Sapiens
DLSLNISTN

SEQ ID NO: 1014207 - protein, 9 aa, Homo Sapiens
EKPLEPAPR

SEQ ID NO: 1014208 - protein, 9 aa, Homo Sapiens
RHTDNIVQW

SEQ ID NO: 1014209 - protein, 9 aa, Homo Sapiens
LPKRFLAVL

SEQ ID NO: 1014210 - protein, 9 aa, Homo Sapiens
PGNTISLIF

SEQ ID NO: 1014211 - protein, 9 aa, Homo Sapiens
ERDKNRREN

SEQ ID NO: 1014212 - protein, 9 aa, Homo Sapiens
IGLTPGEKI

SEQ ID NO: 1014213 - protein, 9 aa, Homo Sapiens
NMKNTEEKW

SEQ ID NO: 1014214 - protein, 9 aa, Homo Sapiens
EPGNTISLI

SEQ ID NO: 1014215 - protein, 9 aa, Homo Sapiens
REEIQETLI

SEQ ID NO: 1014216 - protein, 9 aa, Homo Sapiens
DINFKIERR

SEQ ID NO: 1014217 - protein, 9 aa, Homo Sapiens
SPLESKFFK

SEQ ID NO: 1014218 - protein, 9 aa, Homo Sapiens
YEEHEDPSR

SEQ ID NO: 1014219 - protein, 9 aa, Homo Sapiens
VLLGCPVLL

SEQ ID NO: 1014220 - protein, 9 aa, Homo Sapiens
SWVFELQLE

SEQ ID NO: 1014221 - protein, 9 aa, Homo Sapiens
DQEDASPDR

SEQ ID NO: 1014222 - protein, 9 aa, Homo Sapiens
EQISRQQSQ

SEQ ID NO: 1014223 - protein, 9 aa, Homo Sapiens
KTGFSSFRT

SEQ ID NO: 1014224 - protein, 9 aa, Homo Sapiens
IIYTGKKPY

SEQ ID NO: 1014225 - protein, 9 aa, Homo Sapiens
DGRLRGAGR

SEQ ID NO: 1014226 - protein, 9 aa, Homo Sapiens
NFIAEHGAS

SEQ ID NO: 1014227 - protein, 9 aa, Homo Sapiens
FTDDGRVFL

SEQ ID NO: 1014228 - protein, 9 aa, Homo Sapiens
LMEKSTKPK

SEQ ID NO: 1014229 - protein, 9 aa, Homo Sapiens
ARAISRREV

SEQ ID NO: 1014230 - protein, 9 aa, Homo Sapiens
QPQQHWIKR

SEQ ID NO: 1014231 - protein, 9 aa, Homo Sapiens
KCGKAFTFS

SEQ ID NO: 1014232 - protein, 9 aa, Homo Sapiens
PYNGSLFTM

SEQ ID NO: 1014233 - protein, 9 aa, Homo Sapiens
WQKRIPFSK

SEQ ID NO: 1014234 - protein, 9 aa, Homo Sapiens
VSTTMSVDG

SEQ ID NO: 1014235 - protein, 9 aa, Homo Sapiens
EFFQKFATG

SEQ ID NO: 1014236 - protein, 9 aa, Homo Sapiens
SAQPPTLSL

SEQ ID NO: 1014237 - protein, 9 aa, Homo Sapiens
RHHDPKGLS

SEQ ID NO: 1014238 - protein, 9 aa, Homo Sapiens
WSSKLTVHR

SEQ ID NO: 1014239 - protein, 9 aa, Homo Sapiens
ISEYFQICK

SEQ ID NO: 1014240 - protein, 9 aa, Homo Sapiens
STSKFHCNI

SEQ ID NO: 1014241 - protein, 9 aa, Homo Sapiens
SLGNFIVRY

SEQ ID NO: 1014242 - protein, 9 aa, Homo Sapiens
AAAAAFKID

SEQ ID NO: 1014243 - protein, 9 aa, Homo Sapiens
GGDQKKSKG

SEQ ID NO: 1014244 - protein, 9 aa, Homo Sapiens
SKIWELLVL

SEQ ID NO: 1014245 - protein, 9 aa, Homo Sapiens
EFPAREVYV

SEQ ID NO: 1014246 - protein, 9 aa, Homo Sapiens
REWEEESLS

SEQ ID NO: 1014247 - protein, 9 aa, Homo Sapiens
LLLLIKKDH

SEQ ID NO: 1014248 - protein, 9 aa, Homo Sapiens
GGDETKLLM

SEQ ID NO: 1014249 - protein, 9 aa, Homo Sapiens
DSEQISRQQ

SEQ ID NO: 1014250 - protein, 9 aa, Homo Sapiens
LSRKNMDLY

SEQ ID NO: 1014251 - protein, 9 aa, Homo Sapiens
YFCKYEGKC

SEQ ID NO: 1014252 - protein, 9 aa, Homo Sapiens
GQEEMTPLG

SEQ ID NO: 1014253 - protein, 9 aa, Homo Sapiens
GCPVLLGVK

SEQ ID NO: 1014254 - protein, 9 aa, Homo Sapiens
YVQYEIKLL

SEQ ID NO: 1014255 - protein, 9 aa, Homo Sapiens
PCRLCAPCS

SEQ ID NO: 1014256 - protein, 9 aa, Homo Sapiens
PGDLVPISI

SEQ ID NO: 1014257 - protein, 9 aa, Homo Sapiens
NEDGQEVLY

SEQ ID NO: 1014258 - protein, 9 aa, Homo Sapiens
KYSCGLGKK

SEQ ID NO: 1014259 - protein, 9 aa, Homo Sapiens
LFNFGSQSP

SEQ ID NO: 1014260 - protein, 9 aa, Homo Sapiens
KKSQREKEK

SEQ ID NO: 1014261 - protein, 9 aa, Homo Sapiens
CLNQQQEEK

SEQ ID NO: 1014262 - protein, 9 aa, Homo Sapiens
LRSHFLTEH

SEQ ID NO: 1014263 - protein, 9 aa, Homo Sapiens
EDDNDDTED

SEQ ID NO: 1014264 - protein, 9 aa, Homo Sapiens
SWASAPCTW

SEQ ID NO: 1014265 - protein, 9 aa, Homo Sapiens
HQQVNESEL

SEQ ID NO: 1014266 - protein, 9 aa, Homo Sapiens
ISEMTTGSP

SEQ ID NO: 1014267 - protein, 9 aa, Homo Sapiens
ELGEGYSLP

SEQ ID NO: 1014268 - protein, 9 aa, Homo Sapiens
EFPRCLSTN

SEQ ID NO: 1014269 - protein, 9 aa, Homo Sapiens
LVYLEVFSD

SEQ ID NO: 1014270 - protein, 9 aa, Homo Sapiens
QEEEKEIIG

SEQ ID NO: 1014271 - protein, 9 aa, Homo Sapiens
DQGQLGSRG

SEQ ID NO: 1014272 - protein, 9 aa, Homo Sapiens
CGLGKKKRS

SEQ ID NO: 1014273 - protein, 9 aa, Homo Sapiens
SQNRGPAVP

SEQ ID NO: 1014274 - protein, 9 aa, Homo Sapiens
NGVLAYARL

SEQ ID NO: 1014275 - protein, 9 aa, Homo Sapiens
RFVMRNRNV

SEQ ID NO: 1014276 - protein, 9 aa, Homo Sapiens
STLKTVERE

SEQ ID NO: 1014277 - protein, 9 aa, Homo Sapiens
NSSSGNRAI

SEQ ID NO: 1014278 - protein, 9 aa, Homo Sapiens
KLNMLNKKV

SEQ ID NO: 1014279 - protein, 9 aa, Homo Sapiens
HDDCISPSK

SEQ ID NO: 1014280 - protein, 9 aa, Homo Sapiens
MQLNDSTQL

SEQ ID NO: 1014281 - protein, 9 aa, Homo Sapiens
DCISPSKLC

SEQ ID NO: 1014282 - protein, 9 aa, Homo Sapiens
KFTIWNGGS

SEQ ID NO: 1014283 - protein, 9 aa, Homo Sapiens
KLFRNILKK

SEQ ID NO: 1014284 - protein, 9 aa, Homo Sapiens
EAQSLGNFI

SEQ ID NO: 1014285 - protein, 9 aa, Homo Sapiens
LVPISIPEV

SEQ ID NO: 1014286 - protein, 9 aa, Homo Sapiens
KSPSEALSG

SEQ ID NO: 1014287 - protein, 9 aa, Homo Sapiens
MFESILKAS

SEQ ID NO: 1014288 - protein, 9 aa, Homo Sapiens
IIFRQQEGT

SEQ ID NO: 1014289 - protein, 9 aa, Homo Sapiens
QGSPLGRPS

SEQ ID NO: 1014290 - protein, 9 aa, Homo Sapiens
YEIKLLELI

SEQ ID NO: 1014291 - protein, 9 aa, Homo Sapiens
QLRSAHKTT

SEQ ID NO: 1014292 - protein, 9 aa, Homo Sapiens
NISYETNSA

SEQ ID NO: 1014293 - protein, 9 aa, Homo Sapiens
WPVDTNLIN

SEQ ID NO: 1014294 - protein, 9 aa, Homo Sapiens
RNIKAFISI

SEQ ID NO: 1014295 - protein, 9 aa, Homo Sapiens
IEWLPHNDL

SEQ ID NO: 1014296 - protein, 9 aa, Homo Sapiens
TLISEYFQI

SEQ ID NO: 1014297 - protein, 9 aa, Homo Sapiens
MAANGLFFQ

SEQ ID NO: 1014298 - protein, 9 aa, Homo Sapiens
AGDSHTAAF

SEQ ID NO: 1014299 - protein, 9 aa, Homo Sapiens
TSLMNILPT

SEQ ID NO: 1014300 - protein, 9 aa, Homo Sapiens
ERCGKAFSK

SEQ ID NO: 1014301 - protein, 9 aa, Homo Sapiens
RGIRSGNTG

SEQ ID NO: 1014302 - protein, 9 aa, Homo Sapiens
IERRQLLAV

SEQ ID NO: 1014303 - protein, 9 aa, Homo Sapiens
GAMPISLRR

SEQ ID NO: 1014304 - protein, 9 aa, Homo Sapiens
GDYSWVMRD

SEQ ID NO: 1014305 - protein, 9 aa, Homo Sapiens
VVLLIRVIL

SEQ ID NO: 1014306 - protein, 9 aa, Homo Sapiens
NYDHKAMVS

SEQ ID NO: 1014307 - protein, 9 aa, Homo Sapiens
LEQYVPRNY

SEQ ID NO: 1014308 - protein, 9 aa, Homo Sapiens
GRKEDVAMV

SEQ ID NO: 1014309 - protein, 9 aa, Homo Sapiens
QRHHDPKGL

SEQ ID NO: 1014310 - protein, 9 aa, Homo Sapiens
PLDREQQSL

SEQ ID NO: 1014311 - protein, 9 aa, Homo Sapiens
SKFFKQKDV

SEQ ID NO: 1014312 - protein, 9 aa, Homo Sapiens
ELILERDKN

SEQ ID NO: 1014313 - protein, 9 aa, Homo Sapiens
EGRGLLRQT

SEQ ID NO: 1014314 - protein, 9 aa, Homo Sapiens
LLYNKGEVL

SEQ ID NO: 1014315 - protein, 9 aa, Homo Sapiens
TVVRKISFN

SEQ ID NO: 1014316 - protein, 9 aa, Homo Sapiens
AQSLGNFIV

SEQ ID NO: 1014317 - protein, 9 aa, Homo Sapiens
ANSTKRDRE

SEQ ID NO: 1014318 - protein, 9 aa, Homo Sapiens
SVEHGQWRL

SEQ ID NO: 1014319 - protein, 9 aa, Homo Sapiens
MLNKKVDQL

SEQ ID NO: 1014320 - protein, 9 aa, Homo Sapiens
HNLDISDEF

SEQ ID NO: 1014321 - protein, 9 aa, Homo Sapiens
SLEQYVPRN

SEQ ID NO: 1014322 - protein, 9 aa, Homo Sapiens
KDPEAEAVL

SEQ ID NO: 1014323 - protein, 9 aa, Homo Sapiens
NSKDRGICE

SEQ ID NO: 1014324 - protein, 9 aa, Homo Sapiens
PRAVSGATH

SEQ ID NO: 1014325 - protein, 9 aa, Homo Sapiens
RNVCASGLG

SEQ ID NO: 1014326 - protein, 9 aa, Homo Sapiens
DLVPISIPE

SEQ ID NO: 1014327 - protein, 9 aa, Homo Sapiens
LICNPPLSS

SEQ ID NO: 1014328 - protein, 9 aa, Homo Sapiens
KPCKKADIP

SEQ ID NO: 1014329 - protein, 9 aa, Homo Sapiens
SLPTVGASY

SEQ ID NO: 1014330 - protein, 9 aa, Homo Sapiens
MAPLIAKLP

SEQ ID NO: 1014331 - protein, 9 aa, Homo Sapiens
PTNNRKRNI

SEQ ID NO: 1014332 - protein, 9 aa, Homo Sapiens
SLDLSNYPT

SEQ ID NO: 1014333 - protein, 9 aa, Homo Sapiens
NFKIERRQL

SEQ ID NO: 1014334 - protein, 9 aa, Homo Sapiens
CITQKKCKV

SEQ ID NO: 1014335 - protein, 9 aa, Homo Sapiens
IRVILSYKL

SEQ ID NO: 1014336 - protein, 9 aa, Homo Sapiens
KQVQGILFS

SEQ ID NO: 1014337 - protein, 9 aa, Homo Sapiens
PSGQREFVS

SEQ ID NO: 1014338 - protein, 9 aa, Homo Sapiens
QYMVKVCQV

SEQ ID NO: 1014339 - protein, 9 aa, Homo Sapiens
APGKSLTLQ

SEQ ID NO: 1014340 - protein, 9 aa, Homo Sapiens
ERRQLLAVA

SEQ ID NO: 1014341 - protein, 9 aa, Homo Sapiens
NQLSSFLYQ

SEQ ID NO: 1014342 - protein, 9 aa, Homo Sapiens
TALVKESTD

SEQ ID NO: 1014343 - protein, 9 aa, Homo Sapiens
IYFKRLKTI

SEQ ID NO: 1014344 - protein, 9 aa, Homo Sapiens
KALLITPVL

SEQ ID NO: 1014345 - protein, 9 aa, Homo Sapiens
RGKSRNQLS

SEQ ID NO: 1014346 - protein, 9 aa, Homo Sapiens
ALQSGQWAG

SEQ ID NO: 1014347 - protein, 9 aa, Homo Sapiens
IDTALVKAD

SEQ ID NO: 1014348 - protein, 9 aa, Homo Sapiens
KIETMVEDY

SEQ ID NO: 1014349 - protein, 9 aa, Homo Sapiens
RICFHDPSP

SEQ ID NO: 1014350 - protein, 9 aa, Homo Sapiens
DCQQLLAYR

SEQ ID NO: 1014351 - protein, 9 aa, Homo Sapiens
LGEGYSLPS

SEQ ID NO: 1014352 - protein, 9 aa, Homo Sapiens
HPDGTSPKL

SEQ ID NO: 1014353 - protein, 9 aa, Homo Sapiens
RTPTIVLVG

SEQ ID NO: 1014354 - protein, 9 aa, Homo Sapiens
NKKSQREKE

SEQ ID NO: 1014355 - protein, 9 aa, Homo Sapiens
YEIIFRQQE

SEQ ID NO: 1014356 - protein, 9 aa, Homo Sapiens
ENFNKAKPI

SEQ ID NO: 1014357 - protein, 9 aa, Homo Sapiens
EKKGSKKNI

SEQ ID NO: 1014358 - protein, 9 aa, Homo Sapiens
WEHFSSMDK

SEQ ID NO: 1014359 - protein, 9 aa, Homo Sapiens
HTDCLLLVV

SEQ ID NO: 1014360 - protein, 9 aa, Homo Sapiens
YKDMIRWIL

SEQ ID NO: 1014361 - protein, 9 aa, Homo Sapiens
APLRSSVKP

SEQ ID NO: 1014362 - protein, 9 aa, Homo Sapiens
VQIGNACWK

SEQ ID NO: 1014363 - protein, 9 aa, Homo Sapiens
LPKKTSLGE

SEQ ID NO: 1014364 - protein, 9 aa, Homo Sapiens
LSLPMFLQQ

SEQ ID NO: 1014365 - protein, 9 aa, Homo Sapiens
EFPLPDHRQ

SEQ ID NO: 1014366 - protein, 9 aa, Homo Sapiens
DFPLYFLIM

SEQ ID NO: 1014367 - protein, 9 aa, Homo Sapiens
PGAKKPMAE

SEQ ID NO: 1014368 - protein, 9 aa, Homo Sapiens
KLFYVALLT

SEQ ID NO: 1014369 - protein, 9 aa, Homo Sapiens
PRPERMLGA

SEQ ID NO: 1014370 - protein, 9 aa, Homo Sapiens
TMDNSAIKI

SEQ ID NO: 1014371 - protein, 9 aa, Homo Sapiens
TMNTVDIAN

SEQ ID NO: 1014372 - protein, 9 aa, Homo Sapiens
PVSPGFPPI

SEQ ID NO: 1014373 - protein, 9 aa, Homo Sapiens
SEGSAAERD

SEQ ID NO: 1014374 - protein, 9 aa, Homo Sapiens
HPLKRSPSP

SEQ ID NO: 1014375 - protein, 9 aa, Homo Sapiens
TLGAREKTQ

SEQ ID NO: 1014376 - protein, 9 aa, Homo Sapiens
IIDTTSIEK

SEQ ID NO: 1014377 - protein, 9 aa, Homo Sapiens
PIEGRQGHL

SEQ ID NO: 1014378 - protein, 9 aa, Homo Sapiens
RLKTITDTY

SEQ ID NO: 1014379 - protein, 9 aa, Homo Sapiens
EAEQLTVVR

SEQ ID NO: 1014380 - protein, 9 aa, Homo Sapiens
IDWLIAQED

SEQ ID NO: 1014381 - protein, 9 aa, Homo Sapiens
STKRDRETL

SEQ ID NO: 1014382 - protein, 9 aa, Homo Sapiens
RDYFTFAFT

SEQ ID NO: 1014383 - protein, 9 aa, Homo Sapiens
SSKLTVHRV

SEQ ID NO: 1014384 - protein, 9 aa, Homo Sapiens
QVNAVTLSG

SEQ ID NO: 1014385 - protein, 9 aa, Homo Sapiens
NGTFNQTLI

SEQ ID NO: 1014386 - protein, 9 aa, Homo Sapiens
YCGLGGTDV

SEQ ID NO: 1014387 - protein, 9 aa, Homo Sapiens
NEPPSPPPP

SEQ ID NO: 1014388 - protein, 9 aa, Homo Sapiens
ELVGGSSRR

SEQ ID NO: 1014389 - protein, 9 aa, Homo Sapiens
QLEGRGLLR

SEQ ID NO: 1014390 - protein, 9 aa, Homo Sapiens
SCITQKKCK

SEQ ID NO: 1014391 - protein, 9 aa, Homo Sapiens
EKDPNLEDA

SEQ ID NO: 1014392 - protein, 9 aa, Homo Sapiens
EMESLLNEL

SEQ ID NO: 1014393 - protein, 9 aa, Homo Sapiens
PSEALSGSL

SEQ ID NO: 1014394 - protein, 9 aa, Homo Sapiens
WDKPGLERF

SEQ ID NO: 1014395 - protein, 9 aa, Homo Sapiens
SSNPQKTVT

SEQ ID NO: 1014396 - protein, 9 aa, Homo Sapiens
RSFFSGIKT

SEQ ID NO: 1014397 - protein, 9 aa, Homo Sapiens
PEKPLEPAP

SEQ ID NO: 1014398 - protein, 9 aa, Homo Sapiens
PSWLAPRQA

SEQ ID NO: 1014399 - protein, 9 aa, Homo Sapiens
SKKQFDALE

SEQ ID NO: 1014400 - protein, 9 aa, Homo Sapiens
GEVKLDNEP

SEQ ID NO: 1014401 - protein, 9 aa, Homo Sapiens
KDCQQLLAY

SEQ ID NO: 1014402 - protein, 9 aa, Homo Sapiens
KRDLETKIK

SEQ ID NO: 1014403 - protein, 9 aa, Homo Sapiens
HIIIYRLVE

SEQ ID NO: 1014404 - protein, 9 aa, Homo Sapiens
PFLLFFLFP

SEQ ID NO: 1014405 - protein, 9 aa, Homo Sapiens
TPELPAAVN

SEQ ID NO: 1014406 - protein, 9 aa, Homo Sapiens
RTAELERAT

SEQ ID NO: 1014407 - protein, 9 aa, Homo Sapiens
YSGRREPFS

SEQ ID NO: 1014408 - protein, 9 aa, Homo Sapiens
WPIVLQRID

SEQ ID NO: 1014409 - protein, 9 aa, Homo Sapiens
PVSFAASPR

SEQ ID NO: 1014410 - protein, 9 aa, Homo Sapiens
SLVAGLSAA

SEQ ID NO: 1014411 - protein, 9 aa, Homo Sapiens
NVGLEEKDP

SEQ ID NO: 1014412 - protein, 9 aa, Homo Sapiens
KITPSPAEP

SEQ ID NO: 1014413 - protein, 9 aa, Homo Sapiens
VDVAELPVS

SEQ ID NO: 1014414 - protein, 9 aa, Homo Sapiens
RVAVTDVDK

SEQ ID NO: 1014415 - protein, 9 aa, Homo Sapiens
SEYSIQDLK

SEQ ID NO: 1014416 - protein, 9 aa, Homo Sapiens
GKEEYSAMR

SEQ ID NO: 1014417 - protein, 9 aa, Homo Sapiens
ASPPRPERM

SEQ ID NO: 1014418 - protein, 9 aa, Homo Sapiens
YFKRLKTIT

SEQ ID NO: 1014419 - protein, 9 aa, Homo Sapiens
TFQSKKQFD

SEQ ID NO: 1014420 - protein, 9 aa, Homo Sapiens
NRNVVLTTT

SEQ ID NO: 1014421 - protein, 9 aa, Homo Sapiens
GDSWKEHLC

SEQ ID NO: 1014422 - protein, 9 aa, Homo Sapiens
EDVAMVKRE

SEQ ID NO: 1014423 - protein, 9 aa, Homo Sapiens
TTLERILPK

SEQ ID NO: 1014424 - protein, 9 aa, Homo Sapiens
ATLAKPTKS

SEQ ID NO: 1014425 - protein, 9 aa, Homo Sapiens
RLKKNDTDP

SEQ ID NO: 1014426 - protein, 9 aa, Homo Sapiens
RVAFGPKVV

SEQ ID NO: 1014427 - protein, 9 aa, Homo Sapiens
NVVLTTTFV

SEQ ID NO: 1014428 - protein, 9 aa, Homo Sapiens
IIIDTTSIE

SEQ ID NO: 1014429 - protein, 9 aa, Homo Sapiens
NLQYMVKVC

SEQ ID NO: 1014430 - protein, 9 aa, Homo Sapiens
FTFENGNVQ

SEQ ID NO: 1014431 - protein, 9 aa, Homo Sapiens
ARFDFPESH

SEQ ID NO: 1014432 - protein, 9 aa, Homo Sapiens
GDSPVGLGT

SEQ ID NO: 1014433 - protein, 9 aa, Homo Sapiens
AKAEKLFLE

SEQ ID NO: 1014434 - protein, 9 aa, Homo Sapiens
AAAAVLKDR

SEQ ID NO: 1014435 - protein, 9 aa, Homo Sapiens
AVSGATHSL

SEQ ID NO: 1014436 - protein, 9 aa, Homo Sapiens
GDLVPISIP

SEQ ID NO: 1014437 - protein, 9 aa, Homo Sapiens
NPNVWDKPG

SEQ ID NO: 1014438 - protein, 9 aa, Homo Sapiens
EEKEIIGGD

SEQ ID NO: 1014439 - protein, 9 aa, Homo Sapiens
CKHDGRLRG

SEQ ID NO: 1014440 - protein, 9 aa, Homo Sapiens
DSHTAAFTD

SEQ ID NO: 1014441 - protein, 9 aa, Homo Sapiens
NKKSLLNFV

SEQ ID NO: 1014442 - protein, 9 aa, Homo Sapiens
RIVYAMAAN

SEQ ID NO: 1014443 - protein, 9 aa, Homo Sapiens
SWVMRDWLN

SEQ ID NO: 1014444 - protein, 9 aa, Homo Sapiens
RALQRWAWP

SEQ ID NO: 1014445 - protein, 9 aa, Homo Sapiens
GAGAGILAG

SEQ ID NO: 1014446 - protein, 9 aa, Homo Sapiens
SRAAVPDAV

SEQ ID NO: 1014447 - protein, 9 aa, Homo Sapiens
AGLPKDKGP

SEQ ID NO: 1014448 - protein, 9 aa, Homo Sapiens
AKAPVSSRS

SEQ ID NO: 1014449 - protein, 9 aa, Homo Sapiens
PSVLQLTLS

SEQ ID NO: 1014450 - protein, 9 aa, Homo Sapiens
LDLSNYPTS

SEQ ID NO: 1014451 - protein, 9 aa, Homo Sapiens
SQNSKDRGI

SEQ ID NO: 1014452 - protein, 9 aa, Homo Sapiens
HSLPVSFAA

SEQ ID NO: 1014453 - protein, 9 aa, Homo Sapiens
MMAWWDNKI

SEQ ID NO: 1014454 - protein, 9 aa, Homo Sapiens
FTIWNGGSK

SEQ ID NO: 1014455 - protein, 9 aa, Homo Sapiens
DNDDTEDFA

SEQ ID NO: 1014456 - protein, 9 aa, Homo Sapiens
SDEHSPYNG

SEQ ID NO: 1014457 - protein, 9 aa, Homo Sapiens
FAASPRRTL

SEQ ID NO: 1014458 - protein, 9 aa, Homo Sapiens
YEEPFCKKE

SEQ ID NO: 1014459 - protein, 9 aa, Homo Sapiens
NLNDFRFSR

SEQ ID NO: 1014460 - protein, 9 aa, Homo Sapiens
DAHNLDISD

SEQ ID NO: 1014461 - protein, 9 aa, Homo Sapiens
FNQTLITDN

SEQ ID NO: 1014462 - protein, 9 aa, Homo Sapiens
PNFSGQGDP

SEQ ID NO: 1014463 - protein, 9 aa, Homo Sapiens
NNLYPNSSS

SEQ ID NO: 1014464 - protein, 9 aa, Homo Sapiens
QSRGDCDMG

SEQ ID NO: 1014465 - protein, 9 aa, Homo Sapiens
SPKLDTANG

SEQ ID NO: 1014466 - protein, 9 aa, Homo Sapiens
GFKISVFLQ

SEQ ID NO: 1014467 - protein, 9 aa, Homo Sapiens
KVHVGEKIK

SEQ ID NO: 1014468 - protein, 9 aa, Homo Sapiens
IKLHIIIYR

SEQ ID NO: 1014469 - protein, 9 aa, Homo Sapiens
VGEFLPKGY

SEQ ID NO: 1014470 - protein, 9 aa, Homo Sapiens
DNISYETNS

SEQ ID NO: 1014471 - protein, 9 aa, Homo Sapiens
ERMLGASSP

SEQ ID NO: 1014472 - protein, 9 aa, Homo Sapiens
SLKSRNVCA

SEQ ID NO: 1014473 - protein, 9 aa, Homo Sapiens
LTALVKEST

SEQ ID NO: 1014474 - protein, 9 aa, Homo Sapiens
QFFAKEYGK

SEQ ID NO: 1014475 - protein, 9 aa, Homo Sapiens
RGHARGLWA

SEQ ID NO: 1014476 - protein, 9 aa, Homo Sapiens
LLVFNLTSP

SEQ ID NO: 1014477 - protein, 9 aa, Homo Sapiens
SLKSYSQEK

SEQ ID NO: 1014478 - protein, 9 aa, Homo Sapiens
MIFSGGTAL

SEQ ID NO: 1014479 - protein, 9 aa, Homo Sapiens
CISPSKLCV

SEQ ID NO: 1014480 - protein, 9 aa, Homo Sapiens
WDYTNPNFS

SEQ ID NO: 1014481 - protein, 9 aa, Homo Sapiens
FSGQGDPGS

SEQ ID NO: 1014482 - protein, 9 aa, Homo Sapiens
EIIFRQQEG

SEQ ID NO: 1014483 - protein, 9 aa, Homo Sapiens
GFEILEIFV

SEQ ID NO: 1014484 - protein, 9 aa, Homo Sapiens
YWHCSWVFE

SEQ ID NO: 1014485 - protein, 9 aa, Homo Sapiens
GRGGNEPPS

SEQ ID NO: 1014486 - protein, 9 aa, Homo Sapiens
QQQLEGRGL

SEQ ID NO: 1014487 - protein, 9 aa, Homo Sapiens
EGTEDIFLG

SEQ ID NO: 1014488 - protein, 9 aa, Homo Sapiens
ESILKASVL

SEQ ID NO: 1014489 - protein, 9 aa, Homo Sapiens
REKPYQCNK

SEQ ID NO: 1014490 - protein, 9 aa, Homo Sapiens
KNIKKDARK

SEQ ID NO: 1014491 - protein, 9 aa, Homo Sapiens
RATNAYRRT

SEQ ID NO: 1014492 - protein, 9 aa, Homo Sapiens
LERATNAYR

SEQ ID NO: 1014493 - protein, 9 aa, Homo Sapiens
FTMLMLGNI

SEQ ID NO: 1014494 - protein, 9 aa, Homo Sapiens
GNDFVESSI

SEQ ID NO: 1014495 - protein, 9 aa, Homo Sapiens
PPSPPPHIY

SEQ ID NO: 1014496 - protein, 9 aa, Homo Sapiens
NPNFSGQGD

SEQ ID NO: 1014497 - protein, 9 aa, Homo Sapiens
LAKPTKSEN

SEQ ID NO: 1014498 - protein, 9 aa, Homo Sapiens
TEQHKLFYV

SEQ ID NO: 1014499 - protein, 9 aa, Homo Sapiens
LEKCGSGEA

SEQ ID NO: 1014500 - protein, 9 aa, Homo Sapiens
KASVLFFDR

SEQ ID NO: 1014501 - protein, 9 aa, Homo Sapiens
QFKKILSYI

SEQ ID NO: 1014502 - protein, 9 aa, Homo Sapiens
SGGSTQIQR

SEQ ID NO: 1014503 - protein, 9 aa, Homo Sapiens
HKEKIKNGQ

SEQ ID NO: 1014504 - protein, 9 aa, Homo Sapiens
RLLENVPNR

SEQ ID NO: 1014505 - protein, 9 aa, Homo Sapiens
WKPWVIGLV

SEQ ID NO: 1014506 - protein, 9 aa, Homo Sapiens
KQIKKLSKQ

SEQ ID NO: 1014507 - protein, 9 aa, Homo Sapiens
KTEQHKLFY

SEQ ID NO: 1014508 - protein, 9 aa, Homo Sapiens
LKDRLHPRQ

SEQ ID NO: 1014509 - protein, 9 aa, Homo Sapiens
DTEFFQKFA

SEQ ID NO: 1014510 - protein, 9 aa, Homo Sapiens
CLLPYDCIS

SEQ ID NO: 1014511 - protein, 9 aa, Homo Sapiens
PGLKRKSPS

SEQ ID NO: 1014512 - protein, 9 aa, Homo Sapiens
VAFGPKVVA

SEQ ID NO: 1014513 - protein, 9 aa, Homo Sapiens
GKLTVASAK

SEQ ID NO: 1014514 - protein, 9 aa, Homo Sapiens
DPLPNKAAR

SEQ ID NO: 1014515 - protein, 9 aa, Homo Sapiens
TFTGRLKQQ

SEQ ID NO: 1014516 - protein, 9 aa, Homo Sapiens
DMPELVGGS

SEQ ID NO: 1014517 - protein, 9 aa, Homo Sapiens
SLRDITFSW

SEQ ID NO: 1014518 - protein, 9 aa, Homo Sapiens
TGPEKPLEP

SEQ ID NO: 1014519 - protein, 9 aa, Homo Sapiens
FRLKNGVLA

SEQ ID NO: 1014520 - protein, 9 aa, Homo Sapiens
PENLIVTGP

SEQ ID NO: 1014521 - protein, 9 aa, Homo Sapiens
DPSRAAVPD

SEQ ID NO: 1014522 - protein, 9 aa, Homo Sapiens
ALVKADNFL

SEQ ID NO: 1014523 - protein, 9 aa, Homo Sapiens
MPELVGGSS

SEQ ID NO: 1014524 - protein, 9 aa, Homo Sapiens
GCGSTPPTL

SEQ ID NO: 1014525 - protein, 9 aa, Homo Sapiens
SLYNISVRA

SEQ ID NO: 1014526 - protein, 9 aa, Homo Sapiens
SLHACHPPS

SEQ ID NO: 1014527 - protein, 9 aa, Homo Sapiens
DREQQSLYN

SEQ ID NO: 1014528 - protein, 9 aa, Homo Sapiens
RSGVWLMAP

SEQ ID NO: 1014529 - protein, 9 aa, Homo Sapiens
CRNARRRPS

SEQ ID NO: 1014530 - protein, 9 aa, Homo Sapiens
RIDLIGVAQ

SEQ ID NO: 1014531 - protein, 9 aa, Homo Sapiens
TEFFQKFAT

SEQ ID NO: 1014532 - protein, 9 aa, Homo Sapiens
KAKPIGFTM

SEQ ID NO: 1014533 - protein, 9 aa, Homo Sapiens
EALDKAKKK

SEQ ID NO: 1014534 - protein, 9 aa, Homo Sapiens
SNTLTNEKI

SEQ ID NO: 1014535 - protein, 9 aa, Homo Sapiens
PKDNVCELV

SEQ ID NO: 1014536 - protein, 9 aa, Homo Sapiens
ATNAYRRTG

SEQ ID NO: 1014537 - protein, 9 aa, Homo Sapiens
GLSGKRGPR

SEQ ID NO: 1014538 - protein, 9 aa, Homo Sapiens
FFKGPPVSF

SEQ ID NO: 1014539 - protein, 9 aa, Homo Sapiens
FPLYFLIMS

SEQ ID NO: 1014540 - protein, 9 aa, Homo Sapiens
SPLGRPSGQ

SEQ ID NO: 1014541 - protein, 9 aa, Homo Sapiens
ETNSALKTL

SEQ ID NO: 1014542 - protein, 9 aa, Homo Sapiens
EDSVRGVKG

SEQ ID NO: 1014543 - protein, 9 aa, Homo Sapiens
LEITQEASE

SEQ ID NO: 1014544 - protein, 9 aa, Homo Sapiens
GIRSGNTGS

SEQ ID NO: 1014545 - protein, 9 aa, Homo Sapiens
MSVDGHVLA

SEQ ID NO: 1014546 - protein, 9 aa, Homo Sapiens
LFGYRFLSP

SEQ ID NO: 1014547 - protein, 9 aa, Homo Sapiens
EEKTKIETM

SEQ ID NO: 1014548 - protein, 9 aa, Homo Sapiens
ILQVGETRC

SEQ ID NO: 1014549 - protein, 9 aa, Homo Sapiens
RLGSKIWEL

SEQ ID NO: 1014550 - protein, 9 aa, Homo Sapiens
DPHLSRRLI

SEQ ID NO: 1014551 - protein, 9 aa, Homo Sapiens
YAGYDSSKL

SEQ ID NO: 1014552 - protein, 9 aa, Homo Sapiens
LKSRNVCAS

SEQ ID NO: 1014553 - protein, 9 aa, Homo Sapiens
HISCKLLAV

SEQ ID NO: 1014554 - protein, 9 aa, Homo Sapiens
LPFIRVSPH

SEQ ID NO: 1014555 - protein, 9 aa, Homo Sapiens
HNVHKEKIK

SEQ ID NO: 1014556 - protein, 9 aa, Homo Sapiens
ETQFKKILS

SEQ ID NO: 1014557 - protein, 9 aa, Homo Sapiens
ITQLARPLL

SEQ ID NO: 1014558 - protein, 9 aa, Homo Sapiens
SDQACGTMN

SEQ ID NO: 1014559 - protein, 9 aa, Homo Sapiens
ICASLVLIL

SEQ ID NO: 1014560 - protein, 9 aa, Homo Sapiens
EEVENRDQV

SEQ ID NO: 1014561 - protein, 9 aa, Homo Sapiens
QNPRNVWGF

SEQ ID NO: 1014562 - protein, 9 aa, Homo Sapiens
VGETLPPEM

SEQ ID NO: 1014563 - protein, 9 aa, Homo Sapiens
RNRNVVLTT

SEQ ID NO: 1014564 - protein, 9 aa, Homo Sapiens
ADKYCLTYA

SEQ ID NO: 1014565 - protein, 9 aa, Homo Sapiens
QAGNDFVES

SEQ ID NO: 1014566 - protein, 9 aa, Homo Sapiens
NKAARTAAK

SEQ ID NO: 1014567 - protein, 9 aa, Homo Sapiens
IKNAFRRMM

SEQ ID NO: 1014568 - protein, 9 aa, Homo Sapiens
CQPYRVKVI

SEQ ID NO: 1014569 - protein, 9 aa, Homo Sapiens
DLGAEDSSG

SEQ ID NO: 1014570 - protein, 9 aa, Homo Sapiens
DGAPAKGDS

SEQ ID NO: 1014571 - protein, 9 aa, Homo Sapiens
DLSNYPTSS

SEQ ID NO: 1014572 - protein, 9 aa, Homo Sapiens
AWQKRIPFS

SEQ ID NO: 1014573 - protein, 9 aa, Homo Sapiens
SFFIAVVAY

SEQ ID NO: 1014574 - protein, 9 aa, Homo Sapiens
LDGLPGPKS

SEQ ID NO: 1014575 - protein, 9 aa, Homo Sapiens
TISLAYLVK

SEQ ID NO: 1014576 - protein, 9 aa, Homo Sapiens
REVYVPHTS

SEQ ID NO: 1014577 - protein, 9 aa, Homo Sapiens
KTITDTYLL

SEQ ID NO: 1014578 - protein, 9 aa, Homo Sapiens
TAAFTDDGR

SEQ ID NO: 1014579 - protein, 9 aa, Homo Sapiens
RQRVDTMDN

SEQ ID NO: 1014580 - protein, 9 aa, Homo Sapiens
VWLMAPLIA

SEQ ID NO: 1014581 - protein, 9 aa, Homo Sapiens
RARKRVCWK

SEQ ID NO: 1014582 - protein, 9 aa, Homo Sapiens
RAVSGATHS

SEQ ID NO: 1014583 - protein, 9 aa, Homo Sapiens
RDRETLLKA

SEQ ID NO: 1014584 - protein, 9 aa, Homo Sapiens
LAKAPVSSR

SEQ ID NO: 1014585 - protein, 9 aa, Homo Sapiens
KDTQCPNPS

SEQ ID NO: 1014586 - protein, 9 aa, Homo Sapiens
QSLYNISVR

SEQ ID NO: 1014587 - protein, 9 aa, Homo Sapiens
RSGNTGSQD

SEQ ID NO: 1014588 - protein, 9 aa, Homo Sapiens
TWIHTTLIC

SEQ ID NO: 1014589 - protein, 9 aa, Homo Sapiens
GEVLYGYCN

SEQ ID NO: 1014590 - protein, 9 aa, Homo Sapiens
LFLLLPKVL

SEQ ID NO: 1014591 - protein, 9 aa, Homo Sapiens
TDNIVQWLR

SEQ ID NO: 1014592 - protein, 9 aa, Homo Sapiens
IPVPDCGCT

SEQ ID NO: 1014593 - protein, 9 aa, Homo Sapiens
WASAPCTWM

SEQ ID NO: 1014594 - protein, 9 aa, Homo Sapiens
LSKKFTEWA

SEQ ID NO: 1014595 - protein, 9 aa, Homo Sapiens
LTAKKQEEE

SEQ ID NO: 1014596 - protein, 9 aa, Homo Sapiens
LGSRGASHA

SEQ ID NO: 1014597 - protein, 9 aa, Homo Sapiens
LSKREYEIP

SEQ ID NO: 1014598 - protein, 9 aa, Homo Sapiens
PRSCSSILT

SEQ ID NO: 1014599 - protein, 9 aa, Homo Sapiens
FTDCERHCS

SEQ ID NO: 1014600 - protein, 9 aa, Homo Sapiens
DPCTKLMRT

SEQ ID NO: 1014601 - protein, 9 aa, Homo Sapiens
YNEPENLIV

SEQ ID NO: 1014602 - protein, 9 aa, Homo Sapiens
GSGDYSWVM

SEQ ID NO: 1014603 - protein, 9 aa, Homo Sapiens
LGSKIWELL

SEQ ID NO: 1014604 - protein, 9 aa, Homo Sapiens
PGPAGIPGL

SEQ ID NO: 1014605 - protein, 9 aa, Homo Sapiens
LATGGVKKP

SEQ ID NO: 1014606 - protein, 9 aa, Homo Sapiens
GEHKIHFIL

SEQ ID NO: 1014607 - protein, 9 aa, Homo Sapiens
TQGHPDGTS

SEQ ID NO: 1014608 - protein, 9 aa, Homo Sapiens
NGQLKNKYE

SEQ ID NO: 1014609 - protein, 9 aa, Homo Sapiens
LMAPLIAKL

SEQ ID NO: 1014610 - protein, 9 aa, Homo Sapiens
INFKIERRQ

SEQ ID NO: 1014611 - protein, 9 aa, Homo Sapiens
SKTFTGRLK

SEQ ID NO: 1014612 - protein, 9 aa, Homo Sapiens
LPDHRQKRL

SEQ ID NO: 1014613 - protein, 9 aa, Homo Sapiens
GLGGTDVSC

SEQ ID NO: 1014614 - protein, 9 aa, Homo Sapiens
VEHQAILFM

SEQ ID NO: 1014615 - protein, 9 aa, Homo Sapiens
DRQGSCAGL

SEQ ID NO: 1014616 - protein, 9 aa, Homo Sapiens
SHSDVFEMS

SEQ ID NO: 1014617 - protein, 9 aa, Homo Sapiens
HNKKSLLNF

SEQ ID NO: 1014618 - protein, 9 aa, Homo Sapiens
QSPLPIQIL

SEQ ID NO: 1014619 - protein, 9 aa, Homo Sapiens
FPDIHIVQA

SEQ ID NO: 1014620 - protein, 9 aa, Homo Sapiens
PLEITQEAS

SEQ ID NO: 1014621 - protein, 9 aa, Homo Sapiens
LACLLPSFE

SEQ ID NO: 1014622 - protein, 9 aa, Homo Sapiens
EQNDLEEVK

SEQ ID NO: 1014623 - protein, 9 aa, Homo Sapiens
ASGPAAAAP

SEQ ID NO: 1014624 - protein, 9 aa, Homo Sapiens
LSENFQKRL

SEQ ID NO: 1014625 - protein, 9 aa, Homo Sapiens
SAWRRALQR

SEQ ID NO: 1014626 - protein, 9 aa, Homo Sapiens
KTSLGEEMT

SEQ ID NO: 1014627 - protein, 9 aa, Homo Sapiens
LLACLLPSF

SEQ ID NO: 1014628 - protein, 9 aa, Homo Sapiens
EITQEASEM

SEQ ID NO: 1014629 - protein, 9 aa, Homo Sapiens
ALRGIRSGN

SEQ ID NO: 1014630 - protein, 9 aa, Homo Sapiens
TDAILNFIA

SEQ ID NO: 1014631 - protein, 9 aa, Homo Sapiens
IFRICFHDP

SEQ ID NO: 1014632 - protein, 9 aa, Homo Sapiens
KNMDLYHCL

SEQ ID NO: 1014633 - protein, 9 aa, Homo Sapiens
TLERILPKR

SEQ ID NO: 1014634 - protein, 9 aa, Homo Sapiens
TCAGQQNNG

SEQ ID NO: 1014635 - protein, 9 aa, Homo Sapiens
LTVASAKRG

SEQ ID NO: 1014636 - protein, 9 aa, Homo Sapiens
LSSLKSYSQ

SEQ ID NO: 1014637 - protein, 9 aa, Homo Sapiens
GEGLGSLLY

SEQ ID NO: 1014638 - protein, 9 aa, Homo Sapiens
YVMPWKENI

SEQ ID NO: 1014639 - protein, 9 aa, Homo Sapiens
RARDNISYE

SEQ ID NO: 1014640 - protein, 9 aa, Homo Sapiens
KEDVAMVKR

SEQ ID NO: 1014641 - protein, 9 aa, Homo Sapiens
LLGCPVLLG

SEQ ID NO: 1014642 - protein, 9 aa, Homo Sapiens
KAKKKDKKI

SEQ ID NO: 1014643 - protein, 9 aa, Homo Sapiens
RSCSSILTA

SEQ ID NO: 1014644 - protein, 9 aa, Homo Sapiens
SFAASPRRT

SEQ ID NO: 1014645 - protein, 9 aa, Homo Sapiens
EKIKIEECI

SEQ ID NO: 1014646 - protein, 9 aa, Homo Sapiens
QQEGTEDIF

SEQ ID NO: 1014647 - protein, 9 aa, Homo Sapiens
LIMIAIYVL

SEQ ID NO: 1014648 - protein, 9 aa, Homo Sapiens
SIQETARTL

SEQ ID NO: 1014649 - protein, 9 aa, Homo Sapiens
NRGFAILER

SEQ ID NO: 1014650 - protein, 9 aa, Homo Sapiens
YSCGLGKKK

SEQ ID NO: 1014651 - protein, 9 aa, Homo Sapiens
SLLNELEKQ

SEQ ID NO: 1014652 - protein, 9 aa, Homo Sapiens
ESTDSFHRE

SEQ ID NO: 1014653 - protein, 9 aa, Homo Sapiens
AQPPTLSLP

SEQ ID NO: 1014654 - protein, 9 aa, Homo Sapiens
PELVGGSSR

SEQ ID NO: 1014655 - protein, 9 aa, Homo Sapiens
RKHKIIYTG

SEQ ID NO: 1014656 - protein, 9 aa, Homo Sapiens
GKKKRSVQS

SEQ ID NO: 1014657 - protein, 9 aa, Homo Sapiens
IKRKTEITS

SEQ ID NO: 1014658 - protein, 9 aa, Homo Sapiens
GAGGSPKLA

SEQ ID NO: 1014659 - protein, 9 aa, Homo Sapiens
GGGRRSGTS

SEQ ID NO: 1014660 - protein, 9 aa, Homo Sapiens
PTLMRFPEL

SEQ ID NO: 1014661 - protein, 9 aa, Homo Sapiens
NKGEVLYGY

SEQ ID NO: 1014662 - protein, 9 aa, Homo Sapiens
GRRSGTSPA

SEQ ID NO: 1014663 - protein, 9 aa, Homo Sapiens
RKRVCWKPW

SEQ ID NO: 1014664 - protein, 9 aa, Homo Sapiens
HGYGEKSEE

SEQ ID NO: 1014665 - protein, 9 aa, Homo Sapiens
AGIPGLSGK

SEQ ID NO: 1014666 - protein, 9 aa, Homo Sapiens
VHVGEKIKC

SEQ ID NO: 1014667 - protein, 9 aa, Homo Sapiens
ILNSSLGEV

SEQ ID NO: 1014668 - protein, 9 aa, Homo Sapiens
EKPDSSGGS

SEQ ID NO: 1014669 - protein, 9 aa, Homo Sapiens
DKNDNVPVV

SEQ ID NO: 1014670 - protein, 9 aa, Homo Sapiens
LFFLFPLLL

SEQ ID NO: 1014671 - protein, 9 aa, Homo Sapiens
FKDTQCPNP

SEQ ID NO: 1014672 - protein, 9 aa, Homo Sapiens
AFGPKVVAC

SEQ ID NO: 1014673 - protein, 9 aa, Homo Sapiens
MAPAVALPP

SEQ ID NO: 1014674 - protein, 9 aa, Homo Sapiens
IHTTLICNP

SEQ ID NO: 1014675 - protein, 9 aa, Homo Sapiens
SRVGGGGTV

SEQ ID NO: 1014676 - protein, 9 aa, Homo Sapiens
LPGSFLDLL

SEQ ID NO: 1014677 - protein, 9 aa, Homo Sapiens
IKCDECGKE

SEQ ID NO: 1014678 - protein, 9 aa, Homo Sapiens
KGDSPVGLG

SEQ ID NO: 1014679 - protein, 9 aa, Homo Sapiens
LQSRGDCDM

SEQ ID NO: 1014680 - protein, 9 aa, Homo Sapiens
FLQEGCCRP

SEQ ID NO: 1014681 - protein, 9 aa, Homo Sapiens
SYFCKYEGK

SEQ ID NO: 1014682 - protein, 9 aa, Homo Sapiens
ENMKNTEEK

SEQ ID NO: 1014683 - protein, 9 aa, Homo Sapiens
PLGFSKMNR

SEQ ID NO: 1014684 - protein, 9 aa, Homo Sapiens
LGPATHRGT

SEQ ID NO: 1014685 - protein, 9 aa, Homo Sapiens
LHACHPPSW

SEQ ID NO: 1014686 - protein, 9 aa, Homo Sapiens
RERNPLTSA

SEQ ID NO: 1014687 - protein, 9 aa, Homo Sapiens
CIASHFHAF

SEQ ID NO: 1014688 - protein, 9 aa, Homo Sapiens
CEGKELENF

SEQ ID NO: 1014689 - protein, 9 aa, Homo Sapiens
LPVDSDLSL

SEQ ID NO: 1014690 - protein, 9 aa, Homo Sapiens
NTISLIFTD

SEQ ID NO: 1014691 - protein, 9 aa, Homo Sapiens
QYVPRNYVM

SEQ ID NO: 1014692 - protein, 9 aa, Homo Sapiens
GGLQNAGLN

SEQ ID NO: 1014693 - protein, 9 aa, Homo Sapiens
LGEEVGEFL

SEQ ID NO: 1014694 - protein, 9 aa, Homo Sapiens
EIQETLISE

SEQ ID NO: 1014695 - protein, 9 aa, Homo Sapiens
SPPDPLPNK

SEQ ID NO: 1014696 - protein, 9 aa, Homo Sapiens
DSPVGLGTP

SEQ ID NO: 1014697 - protein, 9 aa, Homo Sapiens
KSMEYFNPH

SEQ ID NO: 1014698 - protein, 9 aa, Homo Sapiens
LTATLAKPT

SEQ ID NO: 1014699 - protein, 9 aa, Homo Sapiens
DAERKARTR

SEQ ID NO: 1014700 - protein, 9 aa, Homo Sapiens
LISEYFQIC

SEQ ID NO: 1014701 - protein, 9 aa, Homo Sapiens
ASHFHAFAT

SEQ ID NO: 1014702 - protein, 9 aa, Homo Sapiens
FWGKHFEFF

SEQ ID NO: 1014703 - protein, 9 aa, Homo Sapiens
SASAWRRAL

SEQ ID NO: 1014704 - protein, 9 aa, Homo Sapiens
GATHSLPVS

SEQ ID NO: 1014705 - protein, 9 aa, Homo Sapiens
LEIVRGGLQ

SEQ ID NO: 1014706 - protein, 9 aa, Homo Sapiens
FRHTDNIVQ

SEQ ID NO: 1014707 - protein, 9 aa, Homo Sapiens
LVFNLTSPF

SEQ ID NO: 1014708 - protein, 9 aa, Homo Sapiens
VPNRTLVIK

SEQ ID NO: 1014709 - protein, 9 aa, Homo Sapiens
PLYFLIMSR

SEQ ID NO: 1014710 - protein, 9 aa, Homo Sapiens
SRSLHLAAT

SEQ ID NO: 1014711 - protein, 9 aa, Homo Sapiens
GPATHRGTY

SEQ ID NO: 1014712 - protein, 9 aa, Homo Sapiens
ALQRWAWPL

SEQ ID NO: 1014713 - protein, 9 aa, Homo Sapiens
PVSSRSPSG

SEQ ID NO: 1014714 - protein, 9 aa, Homo Sapiens
VRGHARGLW

SEQ ID NO: 1014715 - protein, 9 aa, Homo Sapiens
DVAELPVSP

SEQ ID NO: 1014716 - protein, 9 aa, Homo Sapiens
LQLTLSLPM

SEQ ID NO: 1014717 - protein, 9 aa, Homo Sapiens
TNEKIKIEE

SEQ ID NO: 1014718 - protein, 9 aa, Homo Sapiens
EGSAAERDF

SEQ ID NO: 1014719 - protein, 9 aa, Homo Sapiens
ALVIMIFYG

SEQ ID NO: 1014720 - protein, 9 aa, Homo Sapiens
RDAPPSPPP

SEQ ID NO: 1014721 - protein, 9 aa, Homo Sapiens
DPSRSLHLA

SEQ ID NO: 1014722 - protein, 9 aa, Homo Sapiens
QHKLFYVAL

SEQ ID NO: 1014723 - protein, 9 aa, Homo Sapiens
EEEDEDDFY

SEQ ID NO: 1014724 - protein, 9 aa, Homo Sapiens
GDQKKSKGG

SEQ ID NO: 1014725 - protein, 9 aa, Homo Sapiens
LYPNSSSGN

SEQ ID NO: 1014726 - protein, 9 aa, Homo Sapiens
QSKKQFDAL

SEQ ID NO: 1014727 - protein, 9 aa, Homo Sapiens
EGQEEMTPL

SEQ ID NO: 1014728 - protein, 9 aa, Homo Sapiens
HPRFWSSSR

SEQ ID NO: 1014729 - protein, 9 aa, Homo Sapiens
YVPRNYVMI

SEQ ID NO: 1014730 - protein, 9 aa, Homo Sapiens
NRRFLCNGD

SEQ ID NO: 1014731 - protein, 9 aa, Homo Sapiens
KNGVLAYAR

SEQ ID NO: 1014732 - protein, 9 aa, Homo Sapiens
ENFQKRLPQ

SEQ ID NO: 1014733 - protein, 9 aa, Homo Sapiens
ETKLLMVDR

SEQ ID NO: 1014734 - protein, 9 aa, Homo Sapiens
GRGLLRQTS

SEQ ID NO: 1014735 - protein, 9 aa, Homo Sapiens
LCTLLGLEC

SEQ ID NO: 1014736 - protein, 9 aa, Homo Sapiens
SQDFPYVHI

SEQ ID NO: 1014737 - protein, 9 aa, Homo Sapiens
SKKFTEWAY

SEQ ID NO: 1014738 - protein, 9 aa, Homo Sapiens
RGRGDQGQL

SEQ ID NO: 1014739 - protein, 9 aa, Homo Sapiens
ILLITGSPG

SEQ ID NO: 1014740 - protein, 9 aa, Homo Sapiens
YQLYQNPRN

SEQ ID NO: 1014741 - protein, 9 aa, Homo Sapiens
NGDSWKEHL

SEQ ID NO: 1014742 - protein, 9 aa, Homo Sapiens
SKSSSLNSE

SEQ ID NO: 1014743 - protein, 9 aa, Homo Sapiens
KTNETQTSF

SEQ ID NO: 1014744 - protein, 9 aa, Homo Sapiens
LITDNNGLA

SEQ ID NO: 1014745 - protein, 9 aa, Homo Sapiens
PELPAAVNL

SEQ ID NO: 1014746 - protein, 9 aa, Homo Sapiens
RVVHTGEKP

SEQ ID NO: 1014747 - protein, 9 aa, Homo Sapiens
MVISLGEEV

SEQ ID NO: 1014748 - protein, 9 aa, Homo Sapiens
TVTHNVHKE

SEQ ID NO: 1014749 - protein, 9 aa, Homo Sapiens
DTAGKEEYS

SEQ ID NO: 1014750 - protein, 9 aa, Homo Sapiens
LIMSRLCQD

SEQ ID NO: 1014751 - protein, 9 aa, Homo Sapiens
SKMNRFRQS

SEQ ID NO: 1014752 - protein, 9 aa, Homo Sapiens
VIDSHDAVL

SEQ ID NO: 1014753 - protein, 9 aa, Homo Sapiens
SSLGEVIDS

SEQ ID NO: 1014754 - protein, 9 aa, Homo Sapiens
EPSPPATKK

SEQ ID NO: 1014755 - protein, 9 aa, Homo Sapiens
MVSEGSAAE

SEQ ID NO: 1014756 - protein, 9 aa, Homo Sapiens
LWGKALLIT

SEQ ID NO: 1014757 - protein, 9 aa, Homo Sapiens
KKRKFLSLA

SEQ ID NO: 1014758 - protein, 9 aa, Homo Sapiens
EDCRTREEA

SEQ ID NO: 1014759 - protein, 9 aa, Homo Sapiens
PIPGDLVPI

SEQ ID NO: 1014760 - protein, 9 aa, Homo Sapiens
TKLMRTDTS

SEQ ID NO: 1014761 - protein, 9 aa, Homo Sapiens
KSSDQTNVL

SEQ ID NO: 1014762 - protein, 9 aa, Homo Sapiens
TEEANRSFF

SEQ ID NO: 1014763 - protein, 9 aa, Homo Sapiens
YPDLPFIRV

SEQ ID NO: 1014764 - protein, 9 aa, Homo Sapiens
MKTGFSSFR

SEQ ID NO: 1014765 - protein, 9 aa, Homo Sapiens
GKSLTLQCV

SEQ ID NO: 1014766 - protein, 9 aa, Homo Sapiens
HYKSEIDEN

SEQ ID NO: 1014767 - protein, 9 aa, Homo Sapiens
YTGKKPYKC

SEQ ID NO: 1014768 - protein, 9 aa, Homo Sapiens
SEMLAASFF

SEQ ID NO: 1014769 - protein, 9 aa, Homo Sapiens
RKISFNPKD

SEQ ID NO: 1014770 - protein, 9 aa, Homo Sapiens
EEESLSTAT

SEQ ID NO: 1014771 - protein, 9 aa, Homo Sapiens
PPFLLFFLF

SEQ ID NO: 1014772 - protein, 9 aa, Homo Sapiens
EVIKQGYRC

SEQ ID NO: 1014773 - protein, 9 aa, Homo Sapiens
IDPSRAAVP

SEQ ID NO: 1014774 - protein, 9 aa, Homo Sapiens
ILNFIAEHG

SEQ ID NO: 1014775 - protein, 9 aa, Homo Sapiens
SHKRIHTRE

SEQ ID NO: 1014776 - protein, 9 aa, Homo Sapiens
SRNQLSSFL

SEQ ID NO: 1014777 - protein, 9 aa, Homo Sapiens
DKPTYKLGQ

SEQ ID NO: 1014778 - protein, 9 aa, Homo Sapiens
TDVDKPPEF

SEQ ID NO: 1014779 - protein, 9 aa, Homo Sapiens
GICELRAEL

SEQ ID NO: 1014780 - protein, 9 aa, Homo Sapiens
NLIVTGPTN

SEQ ID NO: 1014781 - protein, 9 aa, Homo Sapiens
DSEYSIQDL

SEQ ID NO: 1014782 - protein, 9 aa, Homo Sapiens
KADNIFWGK

SEQ ID NO: 1014783 - protein, 9 aa, Homo Sapiens
DQEPGAKKP

SEQ ID NO: 1014784 - protein, 9 aa, Homo Sapiens
MWLKPCKKA

SEQ ID NO: 1014785 - protein, 9 aa, Homo Sapiens
LDKAKKKDK

SEQ ID NO: 1014786 - protein, 9 aa, Homo Sapiens
LKKRKFLSL

SEQ ID NO: 1014787 - protein, 9 aa, Homo Sapiens
NSENYLNPA

SEQ ID NO: 1014788 - protein, 9 aa, Homo Sapiens
QPYECTQCA

SEQ ID NO: 1014789 - protein, 9 aa, Homo Sapiens
QTLITDNNG

SEQ ID NO: 1014790 - protein, 9 aa, Homo Sapiens
IVTGPTNET

SEQ ID NO: 1014791 - protein, 9 aa, Homo Sapiens
LVKADNFLL

SEQ ID NO: 1014792 - protein, 9 aa, Homo Sapiens
DMKTGFSSF

SEQ ID NO: 1014793 - protein, 9 aa, Homo Sapiens
GGLPRTPTI

SEQ ID NO: 1014794 - protein, 9 aa, Homo Sapiens
NINVGLEEK

SEQ ID NO: 1014795 - protein, 9 aa, Homo Sapiens
AVALPPVPS

SEQ ID NO: 1014796 - protein, 9 aa, Homo Sapiens
WAGSSSVLC

SEQ ID NO: 1014797 - protein, 9 aa, Homo Sapiens
SSPSWASAP

SEQ ID NO: 1014798 - protein, 9 aa, Homo Sapiens
ISLAYLVKK

SEQ ID NO: 1014799 - protein, 9 aa, Homo Sapiens
FELQLELHC

SEQ ID NO: 1014800 - protein, 9 aa, Homo Sapiens
DPEAEAVLE

SEQ ID NO: 1014801 - protein, 9 aa, Homo Sapiens
SVKPSSPSW

SEQ ID NO: 1014802 - protein, 9 aa, Homo Sapiens
MLLLLDIQD

SEQ ID NO: 1014803 - protein, 9 aa, Homo Sapiens
HNPNVWDKP

SEQ ID NO: 1014804 - protein, 9 aa, Homo Sapiens
SGPSRVCQC

SEQ ID NO: 1014805 - protein, 9 aa, Homo Sapiens
VPDCGCTHN

SEQ ID NO: 1014806 - protein, 9 aa, Homo Sapiens
RGPQGIDGQ

SEQ ID NO: 1014807 - protein, 9 aa, Homo Sapiens
AIYVLLTET

SEQ ID NO: 1014808 - protein, 9 aa, Homo Sapiens
DNPAGNKRQ

SEQ ID NO: 1014809 - protein, 9 aa, Homo Sapiens
SMCSGPSRV

SEQ ID NO: 1014810 - protein, 9 aa, Homo Sapiens
QKIHTGEQP

SEQ ID NO: 1014811 - protein, 9 aa, Homo Sapiens
FSDRLERRV

SEQ ID NO: 1014812 - protein, 9 aa, Homo Sapiens
YEDLESWFQ

SEQ ID NO: 1014813 - protein, 9 aa, Homo Sapiens
VLQRIDLIG

SEQ ID NO: 1014814 - protein, 9 aa, Homo Sapiens
KDHRNIKAF

SEQ ID NO: 1014815 - protein, 9 aa, Homo Sapiens
HACHPPSWL

SEQ ID NO: 1014816 - protein, 9 aa, Homo Sapiens
YKRDLETKI

SEQ ID NO: 1014817 - protein, 9 aa, Homo Sapiens
YSLLKKRKF

SEQ ID NO: 1014818 - protein, 9 aa, Homo Sapiens
TKLNMLNKK

SEQ ID NO: 1014819 - protein, 9 aa, Homo Sapiens
DTALVKADN

SEQ ID NO: 1014820 - protein, 9 aa, Homo Sapiens
WKLYCLEHG

SEQ ID NO: 1014821 - protein, 9 aa, Homo Sapiens
GLSQLLQQR

SEQ ID NO: 1014822 - protein, 9 aa, Homo Sapiens
CLQQQLEGR

SEQ ID NO: 1014823 - protein, 9 aa, Homo Sapiens
VTDVDKPPE

SEQ ID NO: 1014824 - protein, 9 aa, Homo Sapiens
SSRSPSGTP

SEQ ID NO: 1014825 - protein, 9 aa, Homo Sapiens
KIIYTGKKP

SEQ ID NO: 1014826 - protein, 9 aa, Homo Sapiens
LARPLLVEY

SEQ ID NO: 1014827 - protein, 9 aa, Homo Sapiens
LFSSNNEVK

SEQ ID NO: 1014828 - protein, 9 aa, Homo Sapiens
PSRVCQCRE

SEQ ID NO: 1014829 - protein, 9 aa, Homo Sapiens
PGRAKREQV

SEQ ID NO: 1014830 - protein, 9 aa, Homo Sapiens
FSLRNKDIK

SEQ ID NO: 1014831 - protein, 9 aa, Homo Sapiens
FWSSSRSPS

SEQ ID NO: 1014832 - protein, 9 aa, Homo Sapiens
WVGPIIGEG

SEQ ID NO: 1014833 - protein, 9 aa, Homo Sapiens
DREWEEESL

SEQ ID NO: 1014834 - protein, 9 aa, Homo Sapiens
ETKIKGKGM

SEQ ID NO: 1014835 - protein, 9 aa, Homo Sapiens
VMQGTGLQG

SEQ ID NO: 1014836 - protein, 9 aa, Homo Sapiens
KDPNLEDAF

SEQ ID NO: 1014837 - protein, 9 aa, Homo Sapiens
IKGWYKKCE

SEQ ID NO: 1014838 - protein, 9 aa, Homo Sapiens
IWNGGSKNP

SEQ ID NO: 1014839 - protein, 9 aa, Homo Sapiens
NIDPHLSRR

SEQ ID NO: 1014840 - protein, 9 aa, Homo Sapiens
EHFSSMDKE

SEQ ID NO: 1014841 - protein, 9 aa, Homo Sapiens
GFLRTNQKR

SEQ ID NO: 1014842 - protein, 9 aa, Homo Sapiens
DGTSPKLDT

SEQ ID NO: 1014843 - protein, 9 aa, Homo Sapiens
IASHFHAFA

SEQ ID NO: 1014844 - protein, 9 aa, Homo Sapiens
ARKRVCWKP

SEQ ID NO: 1014845 - protein, 9 aa, Homo Sapiens
RIIRPGILQ

SEQ ID NO: 1014846 - protein, 9 aa, Homo Sapiens
DTYSGRREP

SEQ ID NO: 1014847 - protein, 9 aa, Homo Sapiens
GYDSSKLDT

SEQ ID NO: 1014848 - protein, 9 aa, Homo Sapiens
LLDIQDRIN

SEQ ID NO: 1014849 - protein, 9 aa, Homo Sapiens
QLLQQRESP

SEQ ID NO: 1014850 - protein, 9 aa, Homo Sapiens
HCVKSSDQT

SEQ ID NO: 1014851 - protein, 9 aa, Homo Sapiens
GGRRSGTSP

SEQ ID NO: 1014852 - protein, 9 aa, Homo Sapiens
ILFMLAEMA

SEQ ID NO: 1014853 - protein, 9 aa, Homo Sapiens
LFLEEGGKD

SEQ ID NO: 1014854 - protein, 9 aa, Homo Sapiens
KKDKKITEL

SEQ ID NO: 1014855 - protein, 9 aa, Homo Sapiens
KLIEWLPHN

SEQ ID NO: 1014856 - protein, 9 aa, Homo Sapiens
TLTAKKQEE

SEQ ID NO: 1014857 - protein, 9 aa, Homo Sapiens
AHKTTHYYQ

SEQ ID NO: 1014858 - protein, 9 aa, Homo Sapiens
IMIFYGYIG

SEQ ID NO: 1014859 - protein, 9 aa, Homo Sapiens
GLPGPKSDV

SEQ ID NO: 1014860 - protein, 9 aa, Homo Sapiens
TLSLPTVGA

SEQ ID NO: 1014861 - protein, 9 aa, Homo Sapiens
SRQQSQVDR

SEQ ID NO: 1014862 - protein, 9 aa, Homo Sapiens
VRFRAFEAV

SEQ ID NO: 1014863 - protein, 9 aa, Homo Sapiens
HDPKGLSPR

SEQ ID NO: 1014864 - protein, 9 aa, Homo Sapiens
LFMLAEMAM

SEQ ID NO: 1014865 - protein, 9 aa, Homo Sapiens
FQRHHDPKG

SEQ ID NO: 1014866 - protein, 9 aa, Homo Sapiens
SWKEHLCDY

SEQ ID NO: 1014867 - protein, 9 aa, Homo Sapiens
CLLYNKGEV

SEQ ID NO: 1014868 - protein, 9 aa, Homo Sapiens
RERTANEKI

SEQ ID NO: 1014869 - protein, 9 aa, Homo Sapiens
NETQTSFNG

SEQ ID NO: 1014870 - protein, 9 aa, Homo Sapiens
PEAEAVLEL

SEQ ID NO: 1014871 - protein, 9 aa, Homo Sapiens
ARLPSMRRE

SEQ ID NO: 1014872 - protein, 9 aa, Homo Sapiens
TLICNPPLS

SEQ ID NO: 1014873 - protein, 9 aa, Homo Sapiens
NGARDAPPS

SEQ ID NO: 1014874 - protein, 9 aa, Homo Sapiens
VPVMQGTGL

SEQ ID NO: 1014875 - protein, 9 aa, Homo Sapiens
SENYLNPAC

SEQ ID NO: 1014876 - protein, 9 aa, Homo Sapiens
GNEPPSPPP

SEQ ID NO: 1014877 - protein, 9 aa, Homo Sapiens
HLEKCGSGE

SEQ ID NO: 1014878 - protein, 9 aa, Homo Sapiens
CRHLSKKFT

SEQ ID NO: 1014879 - protein, 9 aa, Homo Sapiens
MSSDEKGIF

SEQ ID NO: 1014880 - protein, 9 aa, Homo Sapiens
KVYGQEDFL

SEQ ID NO: 1014881 - protein, 9 aa, Homo Sapiens
NNRKRNIKD

SEQ ID NO: 1014882 - protein, 9 aa, Homo Sapiens
EDKFDLDSD

SEQ ID NO: 1014883 - protein, 9 aa, Homo Sapiens
GKHFEFFSL

SEQ ID NO: 1014884 - protein, 9 aa, Homo Sapiens
LEIFVMINN

SEQ ID NO: 1014885 - protein, 9 aa, Homo Sapiens
RETLLKAQI

SEQ ID NO: 1014886 - protein, 9 aa, Homo Sapiens
IPKTEQHKL

SEQ ID NO: 1014887 - protein, 9 aa, Homo Sapiens
ISRREVCDC

SEQ ID NO: 1014888 - protein, 9 aa, Homo Sapiens
QTLTMIKAT

SEQ ID NO: 1014889 - protein, 9 aa, Homo Sapiens
ENLQYMVKV

SEQ ID NO: 1014890 - protein, 9 aa, Homo Sapiens
LPLGFSKMN

SEQ ID NO: 1014891 - protein, 9 aa, Homo Sapiens
KEYGKNNEP

SEQ ID NO: 1014892 - protein, 9 aa, Homo Sapiens
HTREKPYQC

SEQ ID NO: 1014893 - protein, 9 aa, Homo Sapiens
RKSPSEALS

SEQ ID NO: 1014894 - protein, 9 aa, Homo Sapiens
PRCLSTNEN

SEQ ID NO: 1014895 - protein, 9 aa, Homo Sapiens
MCIASHFHA

SEQ ID NO: 1014896 - protein, 9 aa, Homo Sapiens
VRGVKGKEA

SEQ ID NO: 1014897 - protein, 9 aa, Homo Sapiens
EKIELALSA

SEQ ID NO: 1014898 - protein, 9 aa, Homo Sapiens
AAVNLSSTG

SEQ ID NO: 1014899 - protein, 9 aa, Homo Sapiens
AAAAAAFKI

SEQ ID NO: 1014900 - protein, 9 aa, Homo Sapiens
QFAGGFFKG

SEQ ID NO: 1014901 - protein, 9 aa, Homo Sapiens
WPKDNVCEL

SEQ ID NO: 1014902 - protein, 9 aa, Homo Sapiens
QRPRKLHKE

SEQ ID NO: 1014903 - protein, 9 aa, Homo Sapiens
MSSGSGFLR

SEQ ID NO: 1014904 - protein, 9 aa, Homo Sapiens
CFHDPSPAQ

SEQ ID NO: 1014905 - protein, 9 aa, Homo Sapiens
REQQSLYNI

SEQ ID NO: 1014906 - protein, 9 aa, Homo Sapiens
TAKKQEEEK

SEQ ID NO: 1014907 - protein, 9 aa, Homo Sapiens
KDHNLHEPM

SEQ ID NO: 1014908 - protein, 9 aa, Homo Sapiens
LSSFLYQED

SEQ ID NO: 1014909 - protein, 9 aa, Homo Sapiens
LMYRKDFIV

SEQ ID NO: 1014910 - protein, 9 aa, Homo Sapiens
RSPGPHPRF

SEQ ID NO: 1014911 - protein, 9 aa, Homo Sapiens
AGGFFKGPP

SEQ ID NO: 1014912 - protein, 9 aa, Homo Sapiens
RPQANSLDS

SEQ ID NO: 1014913 - protein, 9 aa, Homo Sapiens
ALFLLLPKV

SEQ ID NO: 1014914 - protein, 9 aa, Homo Sapiens
KGEVLYGYC

SEQ ID NO: 1014915 - protein, 9 aa, Homo Sapiens
RPRAMATHH

SEQ ID NO: 1014916 - protein, 9 aa, Homo Sapiens
KNTEEKWNW

SEQ ID NO: 1014917 - protein, 9 aa, Homo Sapiens
KKKDKKITE

SEQ ID NO: 1014918 - protein, 9 aa, Homo Sapiens
YKKCEPGSS

SEQ ID NO: 1014919 - protein, 9 aa, Homo Sapiens
EKEIARQQL

SEQ ID NO: 1014920 - protein, 9 aa, Homo Sapiens
VRINEDGQE

SEQ ID NO: 1014921 - protein, 9 aa, Homo Sapiens
IQASMAPAV

SEQ ID NO: 1014922 - protein, 9 aa, Homo Sapiens
TSGPTGSPL

SEQ ID NO: 1014923 - protein, 9 aa, Homo Sapiens
KTPVGGDQK

SEQ ID NO: 1014924 - protein, 9 aa, Homo Sapiens
SLDSLKSPF

SEQ ID NO: 1014925 - protein, 9 aa, Homo Sapiens
WSDRLALFL

SEQ ID NO: 1014926 - protein, 9 aa, Homo Sapiens
NIVQWLRAM

SEQ ID NO: 1014927 - protein, 9 aa, Homo Sapiens
PENFNKAKP

SEQ ID NO: 1014928 - protein, 9 aa, Homo Sapiens
LTVVRKISF

SEQ ID NO: 1014929 - protein, 9 aa, Homo Sapiens
LIKKDHNLH

SEQ ID NO: 1014930 - protein, 9 aa, Homo Sapiens
PHYTTLALQ

SEQ ID NO: 1014931 - protein, 9 aa, Homo Sapiens
QKNLHPSYF

SEQ ID NO: 1014932 - protein, 9 aa, Homo Sapiens
DVNDNLPEF

SEQ ID NO: 1014933 - protein, 9 aa, Homo Sapiens
IRSGNTGSQ

SEQ ID NO: 1014934 - protein, 9 aa, Homo Sapiens
FCCPSWQWQ

SEQ ID NO: 1014935 - protein, 9 aa, Homo Sapiens
SLMEKSTKP

SEQ ID NO: 1014936 - protein, 9 aa, Homo Sapiens
GSQSHVFFL

SEQ ID NO: 1014937 - protein, 9 aa, Homo Sapiens
EIFDKGQVR

SEQ ID NO: 1014938 - protein, 9 aa, Homo Sapiens
GGPGAGAGI

SEQ ID NO: 1014939 - protein, 9 aa, Homo Sapiens
LVKIDTALV

SEQ ID NO: 1014940 - protein, 9 aa, Homo Sapiens
ERKARTREQ

SEQ ID NO: 1014941 - protein, 9 aa, Homo Sapiens
KTILCGVVL

SEQ ID NO: 1014942 - protein, 9 aa, Homo Sapiens
AGNKRQYSA

SEQ ID NO: 1014943 - protein, 9 aa, Homo Sapiens
LPSTFTLVN

SEQ ID NO: 1014944 - protein, 9 aa, Homo Sapiens
IHFILGMIG

SEQ ID NO: 1014945 - protein, 9 aa, Homo Sapiens
PGPVVAPGK

SEQ ID NO: 1014946 - protein, 9 aa, Homo Sapiens
VGPIIGEGL

SEQ ID NO: 1014947 - protein, 9 aa, Homo Sapiens
RCGKAFSKV

SEQ ID NO: 1014948 - protein, 9 aa, Homo Sapiens
VLVVPGTDA

SEQ ID NO: 1014949 - protein, 9 aa, Homo Sapiens
GTLLLLIKK

SEQ ID NO: 1014950 - protein, 9 aa, Homo Sapiens
RDKNRRENV

SEQ ID NO: 1014951 - protein, 9 aa, Homo Sapiens
YKLGQKDVN

SEQ ID NO: 1014952 - protein, 9 aa, Homo Sapiens
NYSLLKKRK

SEQ ID NO: 1014953 - protein, 9 aa, Homo Sapiens
SQGVCIPVP

SEQ ID NO: 1014954 - protein, 9 aa, Homo Sapiens
TPPTLTGLA

SEQ ID NO: 1014955 - protein, 9 aa, Homo Sapiens
ISLGEEVGE

SEQ ID NO: 1014956 - protein, 9 aa, Homo Sapiens
SSGNRAIQS

SEQ ID NO: 1014957 - protein, 9 aa, Homo Sapiens
PFCCPSWQW

SEQ ID NO: 1014958 - protein, 9 aa, Homo Sapiens
QNHYDGSTS

SEQ ID NO: 1014959 - protein, 9 aa, Homo Sapiens
CDLDFKDTQ

SEQ ID NO: 1014960 - protein, 9 aa, Homo Sapiens
KELENFPDI

SEQ ID NO: 1014961 - protein, 9 aa, Homo Sapiens
DPSVLQLTL

SEQ ID NO: 1014962 - protein, 9 aa, Homo Sapiens
KLTATLAKP

SEQ ID NO: 1014963 - protein, 9 aa, Homo Sapiens
ITDNNGLAP

SEQ ID NO: 1014964 - protein, 9 aa, Homo Sapiens
DAAAAVLKD

SEQ ID NO: 1014965 - protein, 9 aa, Homo Sapiens
VDPVCQPYR

SEQ ID NO: 1014966 - protein, 9 aa, Homo Sapiens
FRGLFCRNA

SEQ ID NO: 1014967 - protein, 9 aa, Homo Sapiens
QEEMTPLGS

SEQ ID NO: 1014968 - protein, 9 aa, Homo Sapiens
RREPFSGDH

SEQ ID NO: 1014969 - protein, 9 aa, Homo Sapiens
IIFRNVNLK

SEQ ID NO: 1014970 - protein, 9 aa, Homo Sapiens
RDITFSWPQ

SEQ ID NO: 1014971 - protein, 9 aa, Homo Sapiens
PGPHPRFWS

SEQ ID NO: 1014972 - protein, 9 aa, Homo Sapiens
FRTLGSSSN

SEQ ID NO: 1014973 - protein, 9 aa, Homo Sapiens
PVMQGTGLQ

SEQ ID NO: 1014974 - protein, 9 aa, Homo Sapiens
GETLPPEMV

SEQ ID NO: 1014975 - protein, 9 aa, Homo Sapiens
GQASGPAAA

SEQ ID NO: 1014976 - protein, 9 aa, Homo Sapiens
VLKDRLHPR

SEQ ID NO: 1014977 - protein, 9 aa, Homo Sapiens
RKLLEDCLA

SEQ ID NO: 1014978 - protein, 9 aa, Homo Sapiens
AELERATNA

SEQ ID NO: 1014979 - protein, 9 aa, Homo Sapiens
MRFPELDAM

SEQ ID NO: 1014980 - protein, 9 aa, Homo Sapiens
QWRLIFETQ

SEQ ID NO: 1014981 - protein, 9 aa, Homo Sapiens
GSNSAMERL

SEQ ID NO: 1014982 - protein, 9 aa, Homo Sapiens
NRRENVVRD

SEQ ID NO: 1014983 - protein, 9 aa, Homo Sapiens
LFRDQEDAS

SEQ ID NO: 1014984 - protein, 9 aa, Homo Sapiens
SGEVKLDNE

SEQ ID NO: 1014985 - protein, 9 aa, Homo Sapiens
RFWSSSRSP

SEQ ID NO: 1014986 - protein, 9 aa, Homo Sapiens
PSTMIFSGG

SEQ ID NO: 1014987 - protein, 9 aa, Homo Sapiens
IETMVEDYL

SEQ ID NO: 1014988 - protein, 9 aa, Homo Sapiens
ENYLNPACR

SEQ ID NO: 1014989 - protein, 9 aa, Homo Sapiens
LCNLNDFRF

SEQ ID NO: 1014990 - protein, 9 aa, Homo Sapiens
FGPKVVACT

SEQ ID NO: 1014991 - protein, 9 aa, Homo Sapiens
LPRKYLFTM

SEQ ID NO: 1014992 - protein, 9 aa, Homo Sapiens
PVVAPGKSL

SEQ ID NO: 1014993 - protein, 9 aa, Homo Sapiens
RHQRLHTGK

SEQ ID NO: 1014994 - protein, 9 aa, Homo Sapiens
KLLELIQRR

SEQ ID NO: 1014995 - protein, 9 aa, Homo Sapiens
GPIIGEGLG

SEQ ID NO: 1014996 - protein, 9 aa, Homo Sapiens
GPPGGPEIG

SEQ ID NO: 1014997 - protein, 9 aa, Homo Sapiens
FLRSHFLTE

SEQ ID NO: 1014998 - protein, 9 aa, Homo Sapiens
VPAPIPGDL

SEQ ID NO: 1014999 - protein, 9 aa, Homo Sapiens
YESYKKTTR

SEQ ID NO: 1015000 - protein, 9 aa, Homo Sapiens
PGEKIELAL

SEQ ID NO: 1015001 - protein, 9 aa, Homo Sapiens
LYFLIMSRL

SEQ ID NO: 1015002 - protein, 9 aa, Homo Sapiens
RSSVKPSSP

SEQ ID NO: 1015003 - protein, 9 aa, Homo Sapiens
HQKIHTGEQ

SEQ ID NO: 1015004 - protein, 9 aa, Homo Sapiens
ETLLKAQIR

SEQ ID NO: 1015005 - protein, 9 aa, Homo Sapiens
IKKLSKQQS

SEQ ID NO: 1015006 - protein, 9 aa, Homo Sapiens
LNSENYLNP

SEQ ID NO: 1015007 - protein, 9 aa, Homo Sapiens
ERKLLEDCL

SEQ ID NO: 1015008 - protein, 9 aa, Homo Sapiens
MEKSTKPKM

SEQ ID NO: 1015009 - protein, 9 aa, Homo Sapiens
PTGSPLCIQ

SEQ ID NO: 1015010 - protein, 9 aa, Homo Sapiens
DLLVFNLTS

SEQ ID NO: 1015011 - protein, 9 aa, Homo Sapiens
QTGPEKPLE

SEQ ID NO: 1015012 - protein, 9 aa, Homo Sapiens
PNKAARTAA

SEQ ID NO: 1015013 - protein, 9 aa, Homo Sapiens
EMASCITQK

SEQ ID NO: 1015014 - protein, 9 aa, Homo Sapiens
PGSFLDLLL

SEQ ID NO: 1015015 - protein, 9 aa, Homo Sapiens
SSDEHSPYN

SEQ ID NO: 1015016 - protein, 9 aa, Homo Sapiens
ITQEASEMV

SEQ ID NO: 1015017 - protein, 9 aa, Homo Sapiens
VSPHRNPTA

SEQ ID NO: 1015018 - protein, 9 aa, Homo Sapiens
ERGSFNLSS

SEQ ID NO: 1015019 - protein, 9 aa, Homo Sapiens
MPFQFAGGF

SEQ ID NO: 1015020 - protein, 9 aa, Homo Sapiens
VDTFQSKKQ

SEQ ID NO: 1015021 - protein, 9 aa, Homo Sapiens
SFRTLGSSS

SEQ ID NO: 1015022 - protein, 9 aa, Homo Sapiens
TQSTHPLKR

SEQ ID NO: 1015023 - protein, 9 aa, Homo Sapiens
FLEEGGKDA

SEQ ID NO: 1015024 - protein, 9 aa, Homo Sapiens
CSPCSPCRL

SEQ ID NO: 1015025 - protein, 9 aa, Homo Sapiens
ASAKRGQKR

SEQ ID NO: 1015026 - protein, 9 aa, Homo Sapiens
RHLSKKFTE

SEQ ID NO: 1015027 - protein, 9 aa, Homo Sapiens
GQVRFWLQA

SEQ ID NO: 1015028 - protein, 9 aa, Homo Sapiens
LLPYDCIST

SEQ ID NO: 1015029 - protein, 9 aa, Homo Sapiens
FLLLPKVLQ

SEQ ID NO: 1015030 - protein, 9 aa, Homo Sapiens
WGKHFEFFS

SEQ ID NO: 1015031 - protein, 9 aa, Homo Sapiens
SELVYLEVF

SEQ ID NO: 1015032 - protein, 9 aa, Homo Sapiens
EVYKDMIRW

SEQ ID NO: 1015033 - protein, 9 aa, Homo Sapiens
EKGIFPAHK

SEQ ID NO: 1015034 - protein, 9 aa, Homo Sapiens
PVDSDLSLN

SEQ ID NO: 1015035 - protein, 9 aa, Homo Sapiens
DFIVYREPN

SEQ ID NO: 1015036 - protein, 9 aa, Homo Sapiens
LVVPGTDAP

SEQ ID NO: 1015037 - protein, 9 aa, Homo Sapiens
YYNCSCIKR

SEQ ID NO: 1015038 - protein, 9 aa, Homo Sapiens
ICFHDPSPA

SEQ ID NO: 1015039 - protein, 9 aa, Homo Sapiens
GLWATGHRV

SEQ ID NO: 1015040 - protein, 9 aa, Homo Sapiens
GQWRLIFET

SEQ ID NO: 1015041 - protein, 9 aa, Homo Sapiens
KPPEFRPPS

SEQ ID NO: 1015042 - protein, 9 aa, Homo Sapiens
VAPGKSLTL

SEQ ID NO: 1015043 - protein, 9 aa, Homo Sapiens
SKKNIKKDA

SEQ ID NO: 1015044 - protein, 9 aa, Homo Sapiens
AKMEDTDCV

SEQ ID NO: 1015045 - protein, 9 aa, Homo Sapiens
LKSYSQEKR

SEQ ID NO: 1015046 - protein, 9 aa, Homo Sapiens
FCHDDCISP

SEQ ID NO: 1015047 - protein, 9 aa, Homo Sapiens
TKCENMKNT

SEQ ID NO: 1015048 - protein, 9 aa, Homo Sapiens
SAHKTTHYY

SEQ ID NO: 1015049 - protein, 9 aa, Homo Sapiens
LWEVIKQGY

SEQ ID NO: 1015050 - protein, 9 aa, Homo Sapiens
SKFHCNIPG

SEQ ID NO: 1015051 - protein, 9 aa, Homo Sapiens
PVCQPYRVK

SEQ ID NO: 1015052 - protein, 9 aa, Homo Sapiens
YNDSAWQKR

SEQ ID NO: 1015053 - protein, 9 aa, Homo Sapiens
GIDGQPGVP

SEQ ID NO: 1015054 - protein, 9 aa, Homo Sapiens
ISISGKEKN

SEQ ID NO: 1015055 - protein, 9 aa, Homo Sapiens
YKVTAYFYS

SEQ ID NO: 1015056 - protein, 9 aa, Homo Sapiens
PRFWSSSRS

SEQ ID NO: 1015057 - protein, 9 aa, Homo Sapiens
TDVNDNLPE

SEQ ID NO: 1015058 - protein, 9 aa, Homo Sapiens
MKLMMAWWD

SEQ ID NO: 1015059 - protein, 9 aa, Homo Sapiens
AEKLFLEEG

SEQ ID NO: 1015060 - protein, 9 aa, Homo Sapiens
ALATGGVKK

SEQ ID NO: 1015061 - protein, 9 aa, Homo Sapiens
IDKNDNVPV

SEQ ID NO: 1015062 - protein, 9 aa, Homo Sapiens
GEEDQQRII

SEQ ID NO: 1015063 - protein, 9 aa, Homo Sapiens
KKDHNLHEP

SEQ ID NO: 1015064 - protein, 9 aa, Homo Sapiens
QGHPDGTSP

SEQ ID NO: 1015065 - protein, 9 aa, Homo Sapiens
RQLLAVAGS

SEQ ID NO: 1015066 - protein, 9 aa, Homo Sapiens
EEMESLLNE

SEQ ID NO: 1015067 - protein, 9 aa, Homo Sapiens
NPQKTVTMI

SEQ ID NO: 1015068 - protein, 9 aa, Homo Sapiens
FGPTLMRFP

SEQ ID NO: 1015069 - protein, 9 aa, Homo Sapiens
HSPYNGSLF

SEQ ID NO: 1015070 - protein, 9 aa, Homo Sapiens
LLPAARAIS

SEQ ID NO: 1015071 - protein, 9 aa, Homo Sapiens
KDLQMQLND

SEQ ID NO: 1015072 - protein, 9 aa, Homo Sapiens
MQGTGLQGA

SEQ ID NO: 1015073 - protein, 9 aa, Homo Sapiens
QQPPHYTTL

SEQ ID NO: 1015074 - protein, 9 aa, Homo Sapiens
CERHCSPTD

SEQ ID NO: 1015075 - protein, 9 aa, Homo Sapiens
LMNILPTVA

SEQ ID NO: 1015076 - protein, 9 aa, Homo Sapiens
VKSSDQTNV

SEQ ID NO: 1015077 - protein, 9 aa, Homo Sapiens
FPYVHIIYQ

SEQ ID NO: 1015078 - protein, 9 aa, Homo Sapiens
VALPPVPSP

SEQ ID NO: 1015079 - protein, 9 aa, Homo Sapiens
NKKRYGLLT

SEQ ID NO: 1015080 - protein, 9 aa, Homo Sapiens
ESLLNELEK

SEQ ID NO: 1015081 - protein, 9 aa, Homo Sapiens
PHYKSEIDE

SEQ ID NO: 1015082 - protein, 9 aa, Homo Sapiens
KKRSVQSGE

SEQ ID NO: 1015083 - protein, 9 aa, Homo Sapiens
AKRGKDAGM

SEQ ID NO: 1015084 - protein, 9 aa, Homo Sapiens
LERSGVWLM

SEQ ID NO: 1015085 - protein, 9 aa, Homo Sapiens
DSWKEHLCD

SEQ ID NO: 1015086 - protein, 9 aa, Homo Sapiens
TLHHRIHSG

SEQ ID NO: 1015087 - protein, 9 aa, Homo Sapiens
RVCQCREHV

SEQ ID NO: 1015088 - protein, 9 aa, Homo Sapiens
CASLVLILK

SEQ ID NO: 1015089 - protein, 9 aa, Homo Sapiens
NRVLFNFGS

SEQ ID NO: 1015090 - protein, 9 aa, Homo Sapiens
FGSGFSVSD

SEQ ID NO: 1015091 - protein, 9 aa, Homo Sapiens
MRAHQALSR

SEQ ID NO: 1015092 - protein, 9 aa, Homo Sapiens
SEEMESLLN

SEQ ID NO: 1015093 - protein, 9 aa, Homo Sapiens
EAKLPSTFT

SEQ ID NO: 1015094 - protein, 9 aa, Homo Sapiens
GELVGYRIF

SEQ ID NO: 1015095 - protein, 9 aa, Homo Sapiens
DYESYKKTT

SEQ ID NO: 1015096 - protein, 9 aa, Homo Sapiens
SILKASVLF

SEQ ID NO: 1015097 - protein, 9 aa, Homo Sapiens
AFCHDDCIS

SEQ ID NO: 1015098 - protein, 9 aa, Homo Sapiens
KDAGMSSED

SEQ ID NO: 1015099 - protein, 9 aa, Homo Sapiens
WKENIIFRN

SEQ ID NO: 1015100 - protein, 9 aa, Homo Sapiens
AEDSSGEPG

SEQ ID NO: 1015101 - protein, 9 aa, Homo Sapiens
EEEDDNDDT

SEQ ID NO: 1015102 - protein, 9 aa, Homo Sapiens
CHDDCISPS

SEQ ID NO: 1015103 - protein, 9 aa, Homo Sapiens
INKTENVSV

SEQ ID NO: 1015104 - protein, 9 aa, Homo Sapiens
LMKLMMAWW

SEQ ID NO: 1015105 - protein, 9 aa, Homo Sapiens
KRFLAVLKQ

SEQ ID NO: 1015106 - protein, 9 aa, Homo Sapiens
AARKSALAT

SEQ ID NO: 1015107 - protein, 9 aa, Homo Sapiens
HSPLFRDQE

SEQ ID NO: 1015108 - protein, 9 aa, Homo Sapiens
KIKLHIIIY

SEQ ID NO: 1015109 - protein, 9 aa, Homo Sapiens
HCPPFLLFF

SEQ ID NO: 1015110 - protein, 9 aa, Homo Sapiens
EQGFPGERG

SEQ ID NO: 1015111 - protein, 9 aa, Homo Sapiens
GEGYSLPST

SEQ ID NO: 1015112 - protein, 9 aa, Homo Sapiens
AKLPSTFTL

SEQ ID NO: 1015113 - protein, 9 aa, Homo Sapiens
NILKKKGIV

SEQ ID NO: 1015114 - protein, 9 aa, Homo Sapiens
SLVPGPVLL

SEQ ID NO: 1015115 - protein, 9 aa, Homo Sapiens
DRGICELRA

SEQ ID NO: 1015116 - protein, 9 aa, Homo Sapiens
ADLSRKNMD

SEQ ID NO: 1015117 - protein, 9 aa, Homo Sapiens
FPESHVGVA

SEQ ID NO: 1015118 - protein, 9 aa, Homo Sapiens
TCASPFFVE

SEQ ID NO: 1015119 - protein, 9 aa, Homo Sapiens
AELPVSPGF

SEQ ID NO: 1015120 - protein, 9 aa, Homo Sapiens
TSPKLDTAN

SEQ ID NO: 1015121 - protein, 9 aa, Homo Sapiens
KPSSPSWAS

SEQ ID NO: 1015122 - protein, 9 aa, Homo Sapiens
DHRQKRLIF

SEQ ID NO: 1015123 - protein, 9 aa, Homo Sapiens
RYGLLTADG

SEQ ID NO: 1015124 - protein, 9 aa, Homo Sapiens
DELGGGRRS

SEQ ID NO: 1015125 - protein, 9 aa, Homo Sapiens
YLKGKKPLL

SEQ ID NO: 1015126 - protein, 9 aa, Homo Sapiens
CHYQEYAAE

SEQ ID NO: 1015127 - protein, 9 aa, Homo Sapiens
ASSNPQKTV

SEQ ID NO: 1015128 - protein, 9 aa, Homo Sapiens
VDFVKDHRN

SEQ ID NO: 1015129 - protein, 9 aa, Homo Sapiens
ESYKKTTRT

SEQ ID NO: 1015130 - protein, 9 aa, Homo Sapiens
QQSLYNISV

SEQ ID NO: 1015131 - protein, 9 aa, Homo Sapiens
AQEDCRTRE

SEQ ID NO: 1015132 - protein, 9 aa, Homo Sapiens
QRLPRKYLF

SEQ ID NO: 1015133 - protein, 9 aa, Homo Sapiens
LGEGPEKTC

SEQ ID NO: 1015134 - protein, 9 aa, Homo Sapiens
PRERNPLTS

SEQ ID NO: 1015135 - protein, 9 aa, Homo Sapiens
LEVYKDMIR

SEQ ID NO: 1015136 - protein, 9 aa, Homo Sapiens
SEMVFVPSG

SEQ ID NO: 1015137 - protein, 9 aa, Homo Sapiens
ERDFAGMEE

SEQ ID NO: 1015138 - protein, 9 aa, Homo Sapiens
QEPGAKKPM

SEQ ID NO: 1015139 - protein, 9 aa, Homo Sapiens
VSFAASPRR

SEQ ID NO: 1015140 - protein, 9 aa, Homo Sapiens
LQGASIQGG

SEQ ID NO: 1015141 - protein, 9 aa, Homo Sapiens
VFNLTSPFQ

SEQ ID NO: 1015142 - protein, 9 aa, Homo Sapiens
PPRPERMLG

SEQ ID NO: 1015143 - protein, 9 aa, Homo Sapiens
ISPSKLCVA

SEQ ID NO: 1015144 - protein, 9 aa, Homo Sapiens
TPGLEDFHM

SEQ ID NO: 1015145 - protein, 9 aa, Homo Sapiens
HYTTLALQQ

SEQ ID NO: 1015146 - protein, 9 aa, Homo Sapiens
LDTAENLLS

SEQ ID NO: 1015147 - protein, 9 aa, Homo Sapiens
LYNKGEVLY

SEQ ID NO: 1015148 - protein, 9 aa, Homo Sapiens
RFRAFEAVR

SEQ ID NO: 1015149 - protein, 9 aa, Homo Sapiens
IFPAHKTST

SEQ ID NO: 1015150 - protein, 9 aa, Homo Sapiens
LGNAHCVKS

SEQ ID NO: 1015151 - protein, 9 aa, Homo Sapiens
PAVALPPVP

SEQ ID NO: 1015152 - protein, 9 aa, Homo Sapiens
NFMEGDPNP

SEQ ID NO: 1015153 - protein, 9 aa, Homo Sapiens
LSNYPTSSS

SEQ ID NO: 1015154 - protein, 9 aa, Homo Sapiens
ETARTLSPV

SEQ ID NO: 1015155 - protein, 9 aa, Homo Sapiens
TQTSFNGVY

SEQ ID NO: 1015156 - protein, 9 aa, Homo Sapiens
LDSLKSPFI

SEQ ID NO: 1015157 - protein, 9 aa, Homo Sapiens
KKEDTKMYL

SEQ ID NO: 1015158 - protein, 9 aa, Homo Sapiens
VNESELVYL

SEQ ID NO: 1015159 - protein, 9 aa, Homo Sapiens
LERRVVLWA

SEQ ID NO: 1015160 - protein, 9 aa, Homo Sapiens
QNNGIRCRD

SEQ ID NO: 1015161 - protein, 9 aa, Homo Sapiens
YFLIMSRLC

SEQ ID NO: 1015162 - protein, 9 aa, Homo Sapiens
APYLEVYKD

SEQ ID NO: 1015163 - protein, 9 aa, Homo Sapiens
CGLGGTDVS

SEQ ID NO: 1015164 - protein, 9 aa, Homo Sapiens
PSQTGPEKP

SEQ ID NO: 1015165 - protein, 9 aa, Homo Sapiens
LVKESTDSF

SEQ ID NO: 1015166 - protein, 9 aa, Homo Sapiens
MEYFNPHTN

SEQ ID NO: 1015167 - protein, 9 aa, Homo Sapiens
SILTALPQV

SEQ ID NO: 1015168 - protein, 9 aa, Homo Sapiens
SGKEGSETR

SEQ ID NO: 1015169 - protein, 9 aa, Homo Sapiens
PLPDHRQKR

SEQ ID NO: 1015170 - protein, 9 aa, Homo Sapiens
SPPPYRMHG

SEQ ID NO: 1015171 - protein, 9 aa, Homo Sapiens
KARTREQLQ

SEQ ID NO: 1015172 - protein, 9 aa, Homo Sapiens
ITPSPAEPT

SEQ ID NO: 1015173 - protein, 9 aa, Homo Sapiens
NDTYSGRRE

SEQ ID NO: 1015174 - protein, 9 aa, Homo Sapiens
PASLHGPHL

SEQ ID NO: 1015175 - protein, 9 aa, Homo Sapiens
QMQLNDSTQ

SEQ ID NO: 1015176 - protein, 9 aa, Homo Sapiens
LTWIHTTLI

SEQ ID NO: 1015177 - protein, 9 aa, Homo Sapiens
GFAILERGS

SEQ ID NO: 1015178 - protein, 9 aa, Homo Sapiens
TPTNARFDF

SEQ ID NO: 1015179 - protein, 9 aa, Homo Sapiens
EQPYECTQC

SEQ ID NO: 1015180 - protein, 9 aa, Homo Sapiens
AGYDSSKLD

SEQ ID NO: 1015181 - protein, 9 aa, Homo Sapiens
PLPIQILSS

SEQ ID NO: 1015182 - protein, 9 aa, Homo Sapiens
CCPSWQWQC

SEQ ID NO: 1015183 - protein, 9 aa, Homo Sapiens
TPVGGDQKK

SEQ ID NO: 1015184 - protein, 9 aa, Homo Sapiens
CWKPWVIGL

SEQ ID NO: 1015185 - protein, 9 aa, Homo Sapiens
SSSLNSENY

SEQ ID NO: 1015186 - protein, 9 aa, Homo Sapiens
LEDMPELVG

SEQ ID NO: 1015187 - protein, 9 aa, Homo Sapiens
YFTFAFTFE

SEQ ID NO: 1015188 - protein, 9 aa, Homo Sapiens
PAAVNLSST

SEQ ID NO: 1015189 - protein, 9 aa, Homo Sapiens
MFRALFAIA

SEQ ID NO: 1015190 - protein, 9 aa, Homo Sapiens
KNTDWSYEK

SEQ ID NO: 1015191 - protein, 9 aa, Homo Sapiens
KNYSLLKKR

SEQ ID NO: 1015192 - protein, 9 aa, Homo Sapiens
HYDGSTSKF

SEQ ID NO: 1015193 - protein, 9 aa, Homo Sapiens
GDCLEDMPE

SEQ ID NO: 1015194 - protein, 9 aa, Homo Sapiens
GARDAPPSP

SEQ ID NO: 1015195 - protein, 9 aa, Homo Sapiens
LNMLNKKVD

SEQ ID NO: 1015196 - protein, 9 aa, Homo Sapiens
ISCKLLAVV

SEQ ID NO: 1015197 - protein, 9 aa, Homo Sapiens
GLQNAGLNV

SEQ ID NO: 1015198 - protein, 9 aa, Homo Sapiens
DLNDTYSGR

SEQ ID NO: 1015199 - protein, 9 aa, Homo Sapiens
FRFTDCERH

SEQ ID NO: 1015200 - protein, 9 aa, Homo Sapiens
EHKIHFILG

SEQ ID NO: 1015201 - protein, 9 aa, Homo Sapiens
TSLHNPNVW

SEQ ID NO: 1015202 - protein, 9 aa, Homo Sapiens
HLSKKFTEW

SEQ ID NO: 1015203 - protein, 9 aa, Homo Sapiens
HKKDLGAED

SEQ ID NO: 1015204 - protein, 9 aa, Homo Sapiens
FSSMDKEDQ

SEQ ID NO: 1015205 - protein, 9 aa, Homo Sapiens
VNRRFLCNG

SEQ ID NO: 1015206 - protein, 9 aa, Homo Sapiens
APTESNISL

SEQ ID NO: 1015207 - protein, 9 aa, Homo Sapiens
RGDQGQLGS

SEQ ID NO: 1015208 - protein, 9 aa, Homo Sapiens
FNFGSQSPL

SEQ ID NO: 1015209 - protein, 9 aa, Homo Sapiens
VFELQLELH

SEQ ID NO: 1015210 - protein, 9 aa, Homo Sapiens
YILWQHNKK

SEQ ID NO: 1015211 - protein, 9 aa, Homo Sapiens
QALSRDSVV

SEQ ID NO: 1015212 - protein, 9 aa, Homo Sapiens
CGSTPPTLT

SEQ ID NO: 1015213 - protein, 9 aa, Homo Sapiens
EHGQWRLIF

SEQ ID NO: 1015214 - protein, 9 aa, Homo Sapiens
PDPLPNKAA

SEQ ID NO: 1015215 - protein, 9 aa, Homo Sapiens
NSAMERLKR

SEQ ID NO: 1015216 - protein, 9 aa, Homo Sapiens
NNGIRCRDA

SEQ ID NO: 1015217 - protein, 9 aa, Homo Sapiens
ALDKAKKKD

SEQ ID NO: 1015218 - protein, 9 aa, Homo Sapiens
KISVFLQTL

SEQ ID NO: 1015219 - protein, 9 aa, Homo Sapiens
NKKVDQLLH

SEQ ID NO: 1015220 - protein, 9 aa, Homo Sapiens
VPENFNKAK

SEQ ID NO: 1015221 - protein, 9 aa, Homo Sapiens
SPSEALSGS

SEQ ID NO: 1015222 - protein, 9 aa, Homo Sapiens
RGVPENFNK

SEQ ID NO: 1015223 - protein, 9 aa, Homo Sapiens
CVNRRFLCN

SEQ ID NO: 1015224 - protein, 9 aa, Homo Sapiens
KIELALSAL

SEQ ID NO: 1015225 - protein, 9 aa, Homo Sapiens
REKTQDLAP

SEQ ID NO: 1015226 - protein, 9 aa, Homo Sapiens
FLPKKTSLG

SEQ ID NO: 1015227 - protein, 9 aa, Homo Sapiens
VDTMDNSAI

SEQ ID NO: 1015228 - protein, 9 aa, Homo Sapiens
GRAKREQVG

SEQ ID NO: 1015229 - protein, 9 aa, Homo Sapiens
NEPPNSGGG

SEQ ID NO: 1015230 - protein, 9 aa, Homo Sapiens
DPCFLQEGC

SEQ ID NO: 1015231 - protein, 9 aa, Homo Sapiens
KYKEQNDLE

SEQ ID NO: 1015232 - protein, 9 aa, Homo Sapiens
HISILQVGE

SEQ ID NO: 1015233 - protein, 9 aa, Homo Sapiens
GGFFKGPPV

SEQ ID NO: 1015234 - protein, 9 aa, Homo Sapiens
PSTFTLVNL

SEQ ID NO: 1015235 - protein, 9 aa, Homo Sapiens
PDSEQISRQ

SEQ ID NO: 1015236 - protein, 9 aa, Homo Sapiens
GRCVNRRFL

SEQ ID NO: 1015237 - protein, 9 aa, Homo Sapiens
NPLTSASEP

SEQ ID NO: 1015238 - protein, 9 aa, Homo Sapiens
KKQEEEKEI

SEQ ID NO: 1015239 - protein, 9 aa, Homo Sapiens
EEHEDPSRS

SEQ ID NO: 1015240 - protein, 9 aa, Homo Sapiens
LPSFEEDYS

SEQ ID NO: 1015241 - protein, 9 aa, Homo Sapiens
RDLKDCQQL

SEQ ID NO: 1015242 - protein, 9 aa, Homo Sapiens
IFVDTFQSK

SEQ ID NO: 1015243 - protein, 9 aa, Homo Sapiens
KQKDVETKP

SEQ ID NO: 1015244 - protein, 9 aa, Homo Sapiens
PLGPATHRG

SEQ ID NO: 1015245 - protein, 9 aa, Homo Sapiens
PFLYILLSE

SEQ ID NO: 1015246 - protein, 9 aa, Homo Sapiens
VKADNFLLE

SEQ ID NO: 1015247 - protein, 9 aa, Homo Sapiens
SRCKKIGAI

SEQ ID NO: 1015248 - protein, 9 aa, Homo Sapiens
EISEMTTGS

SEQ ID NO: 1015249 - protein, 9 aa, Homo Sapiens
FFLFPLLLP

SEQ ID NO: 1015250 - protein, 9 aa, Homo Sapiens
SGPTGSPLC

SEQ ID NO: 1015251 - protein, 9 aa, Homo Sapiens
AHCVKSSDQ

SEQ ID NO: 1015252 - protein, 9 aa, Homo Sapiens
QKFATGNCP

SEQ ID NO: 1015253 - protein, 9 aa, Homo Sapiens
EFEKLTATL

SEQ ID NO: 1015254 - protein, 9 aa, Homo Sapiens
LSLNISTNT

SEQ ID NO: 1015255 - protein, 9 aa, Homo Sapiens
LKNGVLAYA

SEQ ID NO: 1015256 - protein, 9 aa, Homo Sapiens
TGEQPYECT

SEQ ID NO: 1015257 - protein, 9 aa, Homo Sapiens
IEGRQGHLC

SEQ ID NO: 1015258 - protein, 9 aa, Homo Sapiens
NMLNKKVDQ

SEQ ID NO: 1015259 - protein, 9 aa, Homo Sapiens
EQVGGAAWR

SEQ ID NO: 1015260 - protein, 9 aa, Homo Sapiens
FVMRNRNVV

SEQ ID NO: 1015261 - protein, 9 aa, Homo Sapiens
TYSGRREPF

SEQ ID NO: 1015262 - protein, 9 aa, Homo Sapiens
GQEKFTIWN

SEQ ID NO: 1015263 - protein, 9 aa, Homo Sapiens
QVGGAAWRQ

SEQ ID NO: 1015264 - protein, 9 aa, Homo Sapiens
DLPGPPGPK

SEQ ID NO: 1015265 - protein, 9 aa, Homo Sapiens
GSPGCGKTT

SEQ ID NO: 1015266 - protein, 9 aa, Homo Sapiens
PSPPATKKM

SEQ ID NO: 1015267 - protein, 9 aa, Homo Sapiens
TKTFQRHHD

SEQ ID NO: 1015268 - protein, 9 aa, Homo Sapiens
FEAVRDLDA

SEQ ID NO: 1015269 - protein, 9 aa, Homo Sapiens
HAKKKISKK

SEQ ID NO: 1015270 - protein, 9 aa, Homo Sapiens
EDEDDFYTF

SEQ ID NO: 1015271 - protein, 9 aa, Homo Sapiens
LSSQATRGP

SEQ ID NO: 1015272 - protein, 9 aa, Homo Sapiens
LLLIKKDHN

SEQ ID NO: 1015273 - protein, 9 aa, Homo Sapiens
FIAVVAYAI

SEQ ID NO: 1015274 - protein, 9 aa, Homo Sapiens
KPWVIGLVI

SEQ ID NO: 1015275 - protein, 9 aa, Homo Sapiens
EIKLLELIQ

SEQ ID NO: 1015276 - protein, 9 aa, Homo Sapiens
LIAQEDCRT

SEQ ID NO: 1015277 - protein, 9 aa, Homo Sapiens
CTWMRSGTS

SEQ ID NO: 1015278 - protein, 9 aa, Homo Sapiens
LLIMIAIYV

SEQ ID NO: 1015279 - protein, 9 aa, Homo Sapiens
IAKLPSEMS

SEQ ID NO: 1015280 - protein, 9 aa, Homo Sapiens
SQVYEDLES

SEQ ID NO: 1015281 - protein, 9 aa, Homo Sapiens
SLNISTNTS

SEQ ID NO: 1015282 - protein, 9 aa, Homo Sapiens
PTQPFCCPS

SEQ ID NO: 1015283 - protein, 9 aa, Homo Sapiens
SGCTDAILN

SEQ ID NO: 1015284 - protein, 9 aa, Homo Sapiens
KEKKGSKKN

SEQ ID NO: 1015285 - protein, 9 aa, Homo Sapiens
EGYSLPSTL

SEQ ID NO: 1015286 - protein, 9 aa, Homo Sapiens
PATHRGTYR

SEQ ID NO: 1015287 - protein, 9 aa, Homo Sapiens
WNGGSKNPA

SEQ ID NO: 1015288 - protein, 9 aa, Homo Sapiens
KHFEFFSLP

SEQ ID NO: 1015289 - protein, 9 aa, Homo Sapiens
FPLPDHRQK

SEQ ID NO: 1015290 - protein, 9 aa, Homo Sapiens
HRHLEKCGS

SEQ ID NO: 1015291 - protein, 9 aa, Homo Sapiens
PAGIPGLSG

SEQ ID NO: 1015292 - protein, 9 aa, Homo Sapiens
HPPSWLAPR

SEQ ID NO: 1015293 - protein, 9 aa, Homo Sapiens
RFLCNGDND

SEQ ID NO: 1015294 - protein, 9 aa, Homo Sapiens
KPLKTQIVP

SEQ ID NO: 1015295 - protein, 9 aa, Homo Sapiens
HVGEKIKCD

SEQ ID NO: 1015296 - protein, 9 aa, Homo Sapiens
FNPHTNKWS

SEQ ID NO: 1015297 - protein, 9 aa, Homo Sapiens
GPEKTCSQL

SEQ ID NO: 1015298 - protein, 9 aa, Homo Sapiens
KPLLQCDKE

SEQ ID NO: 1015299 - protein, 9 aa, Homo Sapiens
PERMLGASS

SEQ ID NO: 1015300 - protein, 9 aa, Homo Sapiens
LSRDSVVED

SEQ ID NO: 1015301 - protein, 9 aa, Homo Sapiens
PRRTLSAPL

SEQ ID NO: 1015302 - protein, 9 aa, Homo Sapiens
NEPERRKNG

SEQ ID NO: 1015303 - protein, 9 aa, Homo Sapiens
FRDQEDASP

SEQ ID NO: 1015304 - protein, 9 aa, Homo Sapiens
PVCCDPCFL

SEQ ID NO: 1015305 - protein, 9 aa, Homo Sapiens
LWNCLNQQQ

SEQ ID NO: 1015306 - protein, 9 aa, Homo Sapiens
GTPVHISIL

SEQ ID NO: 1015307 - protein, 9 aa, Homo Sapiens
TKLLMVDRE

SEQ ID NO: 1015308 - protein, 9 aa, Homo Sapiens
DTYRDLKDC

SEQ ID NO: 1015309 - protein, 9 aa, Homo Sapiens
AHGYGEKSE

SEQ ID NO: 1015310 - protein, 9 aa, Homo Sapiens
LKNENCSII

SEQ ID NO: 1015311 - protein, 9 aa, Homo Sapiens
GNAHCVKSS

SEQ ID NO: 1015312 - protein, 9 aa, Homo Sapiens
LLTLHHRIH

SEQ ID NO: 1015313 - protein, 9 aa, Homo Sapiens
VVKRPRAMA

SEQ ID NO: 1015314 - protein, 9 aa, Homo Sapiens
APGQASGPA

SEQ ID NO: 1015315 - protein, 9 aa, Homo Sapiens
LLQQQQQTQ

SEQ ID NO: 1015316 - protein, 9 aa, Homo Sapiens
GSTPPTLTG

SEQ ID NO: 1015317 - protein, 9 aa, Homo Sapiens
ACLLPSFEE

SEQ ID NO: 1015318 - protein, 9 aa, Homo Sapiens
KRGKDAGMS

SEQ ID NO: 1015319 - protein, 9 aa, Homo Sapiens
RRKNGVLRP

SEQ ID NO: 1015320 - protein, 9 aa, Homo Sapiens
FSGGTALKP

SEQ ID NO: 1015321 - protein, 9 aa, Homo Sapiens
HARDRQGSC

SEQ ID NO: 1015322 - protein, 9 aa, Homo Sapiens
SHYTSLEQY

SEQ ID NO: 1015323 - protein, 9 aa, Homo Sapiens
YDGSTSKFH

SEQ ID NO: 1015324 - protein, 9 aa, Homo Sapiens
VEENELWNC

SEQ ID NO: 1015325 - protein, 9 aa, Homo Sapiens
SLGEEMTPP

SEQ ID NO: 1015326 - protein, 9 aa, Homo Sapiens
SETRLSPQP

SEQ ID NO: 1015327 - protein, 9 aa, Homo Sapiens
KDIKNAFRR

SEQ ID NO: 1015328 - protein, 9 aa, Homo Sapiens
PAKRGKDAG

SEQ ID NO: 1015329 - protein, 9 aa, Homo Sapiens
IDGEAGPPD

SEQ ID NO: 1015330 - protein, 9 aa, Homo Sapiens
KPDSSGGST

SEQ ID NO: 1015331 - protein, 9 aa, Homo Sapiens
VVLTIIDKN

SEQ ID NO: 1015332 - protein, 9 aa, Homo Sapiens
TQEASEMVF

SEQ ID NO: 1015333 - protein, 9 aa, Homo Sapiens
REAANEGQL

SEQ ID NO: 1015334 - protein, 9 aa, Homo Sapiens
LLITGSPGC

SEQ ID NO: 1015335 - protein, 9 aa, Homo Sapiens
ELENFPDIH

SEQ ID NO: 1015336 - protein, 9 aa, Homo Sapiens
PGGLPRTPT

SEQ ID NO: 1015337 - protein, 9 aa, Homo Sapiens
VDHQLLWGK

SEQ ID NO: 1015338 - protein, 9 aa, Homo Sapiens
FSKMNRFRQ

SEQ ID NO: 1015339 - protein, 9 aa, Homo Sapiens
EIVRGGLQN

SEQ ID NO: 1015340 - protein, 9 aa, Homo Sapiens
TDCERHCSP

SEQ ID NO: 1015341 - protein, 9 aa, Homo Sapiens
SRKNMDLYH

SEQ ID NO: 1015342 - protein, 9 aa, Homo Sapiens
ALTALVKES

SEQ ID NO: 1015343 - protein, 9 aa, Homo Sapiens
TWDYTNPNF

SEQ ID NO: 1015344 - protein, 9 aa, Homo Sapiens
YRKDFIVYR

SEQ ID NO: 1015345 - protein, 9 aa, Homo Sapiens
ALVKESTDS

SEQ ID NO: 1015346 - protein, 9 aa, Homo Sapiens
ERSGVWLMA

SEQ ID NO: 1015347 - protein, 9 aa, Homo Sapiens
LCDYTEDEL

SEQ ID NO: 1015348 - protein, 9 aa, Homo Sapiens
EDMPELVGG

SEQ ID NO: 1015349 - protein, 9 aa, Homo Sapiens
IIIYRLVED

SEQ ID NO: 1015350 - protein, 9 aa, Homo Sapiens
KKPYACSQC

SEQ ID NO: 1015351 - protein, 9 aa, Homo Sapiens
CHPPSWLAP

SEQ ID NO: 1015352 - protein, 9 aa, Homo Sapiens
NIIFRNVNL

SEQ ID NO: 1015353 - protein, 9 aa, Homo Sapiens
DVSCPVGIK

SEQ ID NO: 1015354 - protein, 9 aa, Homo Sapiens
KAMVSFGFP

SEQ ID NO: 1015355 - protein, 9 aa, Homo Sapiens
RLPSMRRES

SEQ ID NO: 1015356 - protein, 9 aa, Homo Sapiens
TKMYLLALK

SEQ ID NO: 1015357 - protein, 9 aa, Homo Sapiens
EQHKLFYVA

SEQ ID NO: 1015358 - protein, 9 aa, Homo Sapiens
CSSILTALP

SEQ ID NO: 1015359 - protein, 9 aa, Homo Sapiens
DKRKQTQKK

SEQ ID NO: 1015360 - protein, 9 aa, Homo Sapiens
RQGHLCFYI

SEQ ID NO: 1015361 - protein, 9 aa, Homo Sapiens
HKADSIQET

SEQ ID NO: 1015362 - protein, 9 aa, Homo Sapiens
QQVNESELV

SEQ ID NO: 1015363 - protein, 9 aa, Homo Sapiens
LLGLECPLH

SEQ ID NO: 1015364 - protein, 9 aa, Homo Sapiens
LIDWLIAQE

SEQ ID NO: 1015365 - protein, 9 aa, Homo Sapiens
QGRQAGNDF

SEQ ID NO: 1015366 - protein, 9 aa, Homo Sapiens
GPKVVACTF

SEQ ID NO: 1015367 - protein, 9 aa, Homo Sapiens
LPYDCISTG

SEQ ID NO: 1015368 - protein, 9 aa, Homo Sapiens
GPKSDVGPN

SEQ ID NO: 1015369 - protein, 9 aa, Homo Sapiens
EDTDCVGWA

SEQ ID NO: 1015370 - protein, 9 aa, Homo Sapiens
VKTCAGQQN

SEQ ID NO: 1015371 - protein, 9 aa, Homo Sapiens
PTESNISLV

SEQ ID NO: 1015372 - protein, 9 aa, Homo Sapiens
KTDTEFFQK

SEQ ID NO: 1015373 - protein, 9 aa, Homo Sapiens
PCTKLMRTD

SEQ ID NO: 1015374 - protein, 9 aa, Homo Sapiens
GEKIELALS

SEQ ID NO: 1015375 - protein, 9 aa, Homo Sapiens
NKYEDAFIR

SEQ ID NO: 1015376 - protein, 9 aa, Homo Sapiens
GEQGFPGER

SEQ ID NO: 1015377 - protein, 9 aa, Homo Sapiens
IANKKRYGL

SEQ ID NO: 1015378 - protein, 9 aa, Homo Sapiens
RLKQQTPSR

SEQ ID NO: 1015379 - protein, 9 aa, Homo Sapiens
MPISLRRCG

SEQ ID NO: 1015380 - protein, 9 aa, Homo Sapiens
TLPPEMVTR

SEQ ID NO: 1015381 - protein, 9 aa, Homo Sapiens
FDAHNLDIS

SEQ ID NO: 1015382 - protein, 9 aa, Homo Sapiens
GKKPLLQCD

SEQ ID NO: 1015383 - protein, 9 aa, Homo Sapiens
KSALATGGV

SEQ ID NO: 1015384 - protein, 9 aa, Homo Sapiens
RFTDCERHC

SEQ ID NO: 1015385 - protein, 9 aa, Homo Sapiens
KTTHYYQLS

SEQ ID NO: 1015386 - protein, 9 aa, Homo Sapiens
WWDNKIFRD

SEQ ID NO: 1015387 - protein, 9 aa, Homo Sapiens
QQRIIRPGI

SEQ ID NO: 1015388 - protein, 9 aa, Homo Sapiens
VRGGLQNAG

SEQ ID NO: 1015389 - protein, 9 aa, Homo Sapiens
DLKDCQQLL

SEQ ID NO: 1015390 - protein, 9 aa, Homo Sapiens
ARDNISYET

SEQ ID NO: 1015391 - protein, 9 aa, Homo Sapiens
GKEKNTDWS

SEQ ID NO: 1015392 - protein, 9 aa, Homo Sapiens
LPKDKGPKP

SEQ ID NO: 1015393 - protein, 9 aa, Homo Sapiens
WISSLEAQS

SEQ ID NO: 1015394 - protein, 9 aa, Homo Sapiens
EYGKNNEPL

SEQ ID NO: 1015395 - protein, 9 aa, Homo Sapiens
SGQREFVSS

SEQ ID NO: 1015396 - protein, 9 aa, Homo Sapiens
NTEEKWNWL

SEQ ID NO: 1015397 - protein, 9 aa, Homo Sapiens
HTAAFTDDG

SEQ ID NO: 1015398 - protein, 9 aa, Homo Sapiens
KLYKCKKCG

SEQ ID NO: 1015399 - protein, 9 aa, Homo Sapiens
QIKKLSKQQ

SEQ ID NO: 1015400 - protein, 9 aa, Homo Sapiens
AGCKHDGRL

SEQ ID NO: 1015401 - protein, 9 aa, Homo Sapiens
GLQGASIQG

SEQ ID NO: 1015402 - protein, 9 aa, Homo Sapiens
AARLPSMRR

SEQ ID NO: 1015403 - protein, 9 aa, Homo Sapiens
KHDGRLRGA

SEQ ID NO: 1015404 - protein, 9 aa, Homo Sapiens
IHTREKPYQ

SEQ ID NO: 1015405 - protein, 9 aa, Homo Sapiens
GGTDVSCPV

SEQ ID NO: 1015406 - protein, 9 aa, Homo Sapiens
PNPLLPVLG

SEQ ID NO: 1015407 - protein, 9 aa, Homo Sapiens
WINLHRHLE

SEQ ID NO: 1015408 - protein, 9 aa, Homo Sapiens
LRDITFSWP

SEQ ID NO: 1015409 - protein, 9 aa, Homo Sapiens
FFQKFATGN

SEQ ID NO: 1015410 - protein, 9 aa, Homo Sapiens
GLPKDKGPK

SEQ ID NO: 1015411 - protein, 9 aa, Homo Sapiens
SLEAQSLGN

SEQ ID NO: 1015412 - protein, 9 aa, Homo Sapiens
KAPVSSRSP

SEQ ID NO: 1015413 - protein, 9 aa, Homo Sapiens
GSPLGRPSG

SEQ ID NO: 1015414 - protein, 9 aa, Homo Sapiens
VVLRLDFLV

SEQ ID NO: 1015415 - protein, 9 aa, Homo Sapiens
EKTKIETMV

SEQ ID NO: 1015416 - protein, 9 aa, Homo Sapiens
NGLFFQVFA

SEQ ID NO: 1015417 - protein, 9 aa, Homo Sapiens
APIPGDLVP

SEQ ID NO: 1015418 - protein, 9 aa, Homo Sapiens
RKRNIKDLL

SEQ ID NO: 1015419 - protein, 9 aa, Homo Sapiens
NRSTLNEPP

SEQ ID NO: 1015420 - protein, 9 aa, Homo Sapiens
QGFPGERGS

SEQ ID NO: 1015421 - protein, 9 aa, Homo Sapiens
EVENRDQVP

SEQ ID NO: 1015422 - protein, 9 aa, Homo Sapiens
LKNKYEDAF

SEQ ID NO: 1015423 - protein, 9 aa, Homo Sapiens
LPHNDLLGH

SEQ ID NO: 1015424 - protein, 9 aa, Homo Sapiens
PVVKRPRAM

SEQ ID NO: 1015425 - protein, 9 aa, Homo Sapiens
KIHFILGMI

SEQ ID NO: 1015426 - protein, 9 aa, Homo Sapiens
RAFEAVRDL

SEQ ID NO: 1015427 - protein, 9 aa, Homo Sapiens
KGKEATDAS

SEQ ID NO: 1015428 - protein, 9 aa, Homo Sapiens
GVLVVPGTD

SEQ ID NO: 1015429 - protein, 9 aa, Homo Sapiens
CIPVPDCGC

SEQ ID NO: 1015430 - protein, 9 aa, Homo Sapiens
IVYREPNVS

SEQ ID NO: 1015431 - protein, 9 aa, Homo Sapiens
DCLEDMPEL

SEQ ID NO: 1015432 - protein, 9 aa, Homo Sapiens
SLASSNPQK

SEQ ID NO: 1015433 - protein, 9 aa, Homo Sapiens
GTFNQTLIT

SEQ ID NO: 1015434 - protein, 9 aa, Homo Sapiens
KRKSPSEAL

SEQ ID NO: 1015435 - protein, 9 aa, Homo Sapiens
APVSSRSPS

SEQ ID NO: 1015436 - protein, 9 aa, Homo Sapiens
ITDTYLLNL

SEQ ID NO: 1015437 - protein, 9 aa, Homo Sapiens
TATLAKPTK

SEQ ID NO: 1015438 - protein, 9 aa, Homo Sapiens
CDPCFLQEG

SEQ ID NO: 1015439 - protein, 9 aa, Homo Sapiens
VMWLKPCKK

SEQ ID NO: 1015440 - protein, 9 aa, Homo Sapiens
GLISMIDPS

SEQ ID NO: 1015441 - protein, 9 aa, Homo Sapiens
GCKHDGRLR

SEQ ID NO: 1015442 - protein, 9 aa, Homo Sapiens
FGSQSPLIL

SEQ ID NO: 1015443 - protein, 9 aa, Homo Sapiens
SVSDSKRHL

SEQ ID NO: 1015444 - protein, 9 aa, Homo Sapiens
LLLPKVLQK

SEQ ID NO: 1015445 - protein, 9 aa, Homo Sapiens
CKLLAVVRL

SEQ ID NO: 1015446 - protein, 9 aa, Homo Sapiens
GHARGLWAT

SEQ ID NO: 1015447 - protein, 9 aa, Homo Sapiens
RKDFIVYRE

SEQ ID NO: 1015448 - protein, 9 aa, Homo Sapiens
YHAKKKISK

SEQ ID NO: 1015449 - protein, 9 aa, Homo Sapiens
KFIDHISCK

SEQ ID NO: 1015450 - protein, 9 aa, Homo Sapiens
PWKENIIFR

SEQ ID NO: 1015451 - protein, 9 aa, Homo Sapiens
VVAPGKSLT

SEQ ID NO: 1015452 - protein, 9 aa, Homo Sapiens
FPAHKTSTP

SEQ ID NO: 1015453 - protein, 9 aa, Homo Sapiens
AVGSQSHVF

SEQ ID NO: 1015454 - protein, 9 aa, Homo Sapiens
SPDAAAAVL

SEQ ID NO: 1015455 - protein, 9 aa, Homo Sapiens
TGKKPYACS

SEQ ID NO: 1015456 - protein, 9 aa, Homo Sapiens
DEDDFYTFH

SEQ ID NO: 1015457 - protein, 9 aa, Homo Sapiens
VCQVGSEEE

SEQ ID NO: 1015458 - protein, 9 aa, Homo Sapiens
CPPFLLFFL

SEQ ID NO: 1015459 - protein, 9 aa, Homo Sapiens
NQTLTMIKA

SEQ ID NO: 1015460 - protein, 9 aa, Homo Sapiens
LQRWAWPLR

SEQ ID NO: 1015461 - protein, 9 aa, Homo Sapiens
AMPISLRRC

SEQ ID NO: 1015462 - protein, 9 aa, Homo Sapiens
IARQQLEFE

SEQ ID NO: 1015463 - protein, 9 aa, Homo Sapiens
NAHCVKSSD

SEQ ID NO: 1015464 - protein, 9 aa, Homo Sapiens
ANEGQLWGG

SEQ ID NO: 1015465 - protein, 9 aa, Homo Sapiens
RGKDAGMSS

SEQ ID NO: 1015466 - protein, 9 aa, Homo Sapiens
DSIQETART

SEQ ID NO: 1015467 - protein, 9 aa, Homo Sapiens
LSLRDITFS

SEQ ID NO: 1015468 - protein, 9 aa, Homo Sapiens
LQNHVGETL

SEQ ID NO: 1015469 - protein, 9 aa, Homo Sapiens
PPDLPGPPG

SEQ ID NO: 1015470 - protein, 9 aa, Homo Sapiens
PAKGDSPVG

SEQ ID NO: 1015471 - protein, 9 aa, Homo Sapiens
DQREMILNL

SEQ ID NO: 1015472 - protein, 9 aa, Homo Sapiens
NKRQYSAWA

SEQ ID NO: 1015473 - protein, 9 aa, Homo Sapiens
STKPKMETM

SEQ ID NO: 1015474 - protein, 9 aa, Homo Sapiens
GPEKPLEPA

SEQ ID NO: 1015475 - protein, 9 aa, Homo Sapiens
TVASAKRGQ

SEQ ID NO: 1015476 - protein, 9 aa, Homo Sapiens
EEIQETLIS

SEQ ID NO: 1015477 - protein, 9 aa, Homo Sapiens
KGHRAGLPK

SEQ ID NO: 1015478 - protein, 9 aa, Homo Sapiens
LERGSFNLS

SEQ ID NO: 1015479 - protein, 9 aa, Homo Sapiens
PEPSPPATK

SEQ ID NO: 1015480 - protein, 9 aa, Homo Sapiens
VTAYFYSGI

SEQ ID NO: 1015481 - protein, 9 aa, Homo Sapiens
TIQFHLDPA

SEQ ID NO: 1015482 - protein, 9 aa, Homo Sapiens
DLCLLPYDC

SEQ ID NO: 1015483 - protein, 9 aa, Homo Sapiens
ASEMVFVPS

SEQ ID NO: 1015484 - protein, 9 aa, Homo Sapiens
EKLTATLAK

SEQ ID NO: 1015485 - protein, 9 aa, Homo Sapiens
QQHWIKRGV

SEQ ID NO: 1015486 - protein, 9 aa, Homo Sapiens
AGATFRLKN

SEQ ID NO: 1015487 - protein, 9 aa, Homo Sapiens
AGAGILAGK

SEQ ID NO: 1015488 - protein, 9 aa, Homo Sapiens
SLTEKEIAR

SEQ ID NO: 1015489 - protein, 9 aa, Homo Sapiens
QAESQNRGP

SEQ ID NO: 1015490 - protein, 9 aa, Homo Sapiens
SLLTLHHRI

SEQ ID NO: 1015491 - protein, 9 aa, Homo Sapiens
DNSAIKILR

SEQ ID NO: 1015492 - protein, 9 aa, Homo Sapiens
TSKFHCNIP

SEQ ID NO: 1015493 - protein, 9 aa, Homo Sapiens
GKIPHYKSE

SEQ ID NO: 1015494 - protein, 9 aa, Homo Sapiens
LFLSFAHTD

SEQ ID NO: 1015495 - protein, 9 aa, Homo Sapiens
GYCGLGGTD

SEQ ID NO: 1015496 - protein, 9 aa, Homo Sapiens
SMSSGSGFL

SEQ ID NO: 1015497 - protein, 9 aa, Homo Sapiens
NAYRRTGKG

SEQ ID NO: 1015498 - protein, 9 aa, Homo Sapiens
SHVFFLDPR

SEQ ID NO: 1015499 - protein, 9 aa, Homo Sapiens
AKEYGKNNE

SEQ ID NO: 1015500 - protein, 9 aa, Homo Sapiens
IQDRINRLA

SEQ ID NO: 1015501 - protein, 9 aa, Homo Sapiens
GRREPFSGD

SEQ ID NO: 1015502 - protein, 9 aa, Homo Sapiens
PDPSRTLNS

SEQ ID NO: 1015503 - protein, 9 aa, Homo Sapiens
FHVWQSAGI

SEQ ID NO: 1015504 - protein, 9 aa, Homo Sapiens
KLHKEEKLK

SEQ ID NO: 1015505 - protein, 9 aa, Homo Sapiens
LDAERKART

SEQ ID NO: 1015506 - protein, 9 aa, Homo Sapiens
NTLTNEKIK

SEQ ID NO: 1015507 - protein, 9 aa, Homo Sapiens
GGPEIGPGV

SEQ ID NO: 1015508 - protein, 9 aa, Homo Sapiens
LKRSPSPRA

SEQ ID NO: 1015509 - protein, 9 aa, Homo Sapiens
FSRCKKIGA

SEQ ID NO: 1015510 - protein, 9 aa, Homo Sapiens
TAYFYSGID

SEQ ID NO: 1015511 - protein, 9 aa, Homo Sapiens
HLDPAGLIF

SEQ ID NO: 1015512 - protein, 9 aa, Homo Sapiens
LQSGQWAGS

SEQ ID NO: 1015513 - protein, 9 aa, Homo Sapiens
KMYLLALKN

SEQ ID NO: 1015514 - protein, 9 aa, Homo Sapiens
LDPAGLIFG

SEQ ID NO: 1015515 - protein, 9 aa, Homo Sapiens
QYEIKLLEL

SEQ ID NO: 1015516 - protein, 9 aa, Homo Sapiens
ILTALPQVN

SEQ ID NO: 1015517 - protein, 9 aa, Homo Sapiens
LLWGKALLI

SEQ ID NO: 1015518 - protein, 9 aa, Homo Sapiens
QAWPIVLQR

SEQ ID NO: 1015519 - protein, 9 aa, Homo Sapiens
GLPAKRGKD

SEQ ID NO: 1015520 - protein, 9 aa, Homo Sapiens
TLMRFPELD

SEQ ID NO: 1015521 - protein, 9 aa, Homo Sapiens
SGKEKNTDW

SEQ ID NO: 1015522 - protein, 9 aa, Homo Sapiens
NACWKLYCL

SEQ ID NO: 1015523 - protein, 9 aa, Homo Sapiens
NDTDPCTKL

SEQ ID NO: 1015524 - protein, 9 aa, Homo Sapiens
GPRGEQGFP

SEQ ID NO: 1015525 - protein, 9 aa, Homo Sapiens
TGSPGCGKT

SEQ ID NO: 1015526 - protein, 9 aa, Homo Sapiens
NILPTVASV

SEQ ID NO: 1015527 - protein, 9 aa, Homo Sapiens
PKSDVGPNG

SEQ ID NO: 1015528 - protein, 9 aa, Homo Sapiens
RTLGAREKT

SEQ ID NO: 1015529 - protein, 9 aa, Homo Sapiens
HEDPSRSLH

SEQ ID NO: 1015530 - protein, 9 aa, Homo Sapiens
CAGLHELIQ

SEQ ID NO: 1015531 - protein, 9 aa, Homo Sapiens
IKEPTSLMN

SEQ ID NO: 1015532 - protein, 9 aa, Homo Sapiens
ILNPLIYNL

SEQ ID NO: 1015533 - protein, 9 aa, Homo Sapiens
KSLMEKSTK

SEQ ID NO: 1015534 - protein, 9 aa, Homo Sapiens
NDFVESSIL

SEQ ID NO: 1015535 - protein, 9 aa, Homo Sapiens
PLGNAHCVK

SEQ ID NO: 1015536 - protein, 9 aa, Homo Sapiens
LERDKNRRE

SEQ ID NO: 1015537 - protein, 9 aa, Homo Sapiens
APPSPPPYR

SEQ ID NO: 1015538 - protein, 9 aa, Homo Sapiens
HHDPKGLSP

SEQ ID NO: 1015539 - protein, 9 aa, Homo Sapiens
NIFWGKHFE

SEQ ID NO: 1015540 - protein, 9 aa, Homo Sapiens
NPRNVWGFL

SEQ ID NO: 1015541 - protein, 9 aa, Homo Sapiens
KLDNEPPNS

SEQ ID NO: 1015542 - protein, 9 aa, Homo Sapiens
LRSAHKTTH

SEQ ID NO: 1015543 - protein, 9 aa, Homo Sapiens
TLKTVEREK

SEQ ID NO: 1015544 - protein, 9 aa, Homo Sapiens
SAAERDFAG

SEQ ID NO: 1015545 - protein, 9 aa, Homo Sapiens
CSPCRLCAP

SEQ ID NO: 1015546 - protein, 9 aa, Homo Sapiens
EGRQGHLCF

SEQ ID NO: 1015547 - protein, 9 aa, Homo Sapiens
AFVDIQAES

SEQ ID NO: 1015548 - protein, 9 aa, Homo Sapiens
KEQNDLEEV

SEQ ID NO: 1015549 - protein, 9 aa, Homo Sapiens
GSGFLRTNQ

SEQ ID NO: 1015550 - protein, 9 aa, Homo Sapiens
VHKEKIKNG

SEQ ID NO: 1015551 - protein, 9 aa, Homo Sapiens
LGLSQLLQQ

SEQ ID NO: 1015552 - protein, 9 aa, Homo Sapiens
LYILLSENF

SEQ ID NO: 1015553 - protein, 9 aa, Homo Sapiens
QNHVGETLP

SEQ ID NO: 1015554 - protein, 9 aa, Homo Sapiens
PPATCASPF

SEQ ID NO: 1015555 - protein, 9 aa, Homo Sapiens
NVCASGLGL

SEQ ID NO: 1015556 - protein, 9 aa, Homo Sapiens
VKREILSAA

SEQ ID NO: 1015557 - protein, 9 aa, Homo Sapiens
KLDTAENLL

SEQ ID NO: 1015558 - protein, 9 aa, Homo Sapiens
WEEESLSTA

SEQ ID NO: 1015559 - protein, 9 aa, Homo Sapiens
RRFLCNGDN

SEQ ID NO: 1015560 - protein, 9 aa, Homo Sapiens
HQRLHTGKK

SEQ ID NO: 1015561 - protein, 9 aa, Homo Sapiens
TNAYRRTGK

SEQ ID NO: 1015562 - protein, 9 aa, Homo Sapiens
NLINRSTLN

SEQ ID NO: 1015563 - protein, 9 aa, Homo Sapiens
LLTADGTTA

SEQ ID NO: 1015564 - protein, 9 aa, Homo Sapiens
IRVSPHRNP

SEQ ID NO: 1015565 - protein, 9 aa, Homo Sapiens
PLCIQTSPD

SEQ ID NO: 1015566 - protein, 9 aa, Homo Sapiens
EAFSRCKKI

SEQ ID NO: 1015567 - protein, 9 aa, Homo Sapiens
QLFAKNKKS

SEQ ID NO: 1015568 - protein, 9 aa, Homo Sapiens
LTPGEKIEL

SEQ ID NO: 1015569 - protein, 9 aa, Homo Sapiens
REEVENRDQ

SEQ ID NO: 1015570 - protein, 9 aa, Homo Sapiens
LAASFFIAV

SEQ ID NO: 1015571 - protein, 9 aa, Homo Sapiens
KIGAIAQVH

SEQ ID NO: 1015572 - protein, 9 aa, Homo Sapiens
QEGTEDIFL

SEQ ID NO: 1015573 - protein, 9 aa, Homo Sapiens
RHLEKCGSG

SEQ ID NO: 1015574 - protein, 9 aa, Homo Sapiens
TPGEKIELA

SEQ ID NO: 1015575 - protein, 9 aa, Homo Sapiens
DGLPGPKSD

SEQ ID NO: 1015576 - protein, 9 aa, Homo Sapiens
SHFLTEHVR

SEQ ID NO: 1015577 - protein, 9 aa, Homo Sapiens
LGQKDVNGI

SEQ ID NO: 1015578 - protein, 9 aa, Homo Sapiens
YTSLEQYVP

SEQ ID NO: 1015579 - protein, 9 aa, Homo Sapiens
AEQLTVVRK

SEQ ID NO: 1015580 - protein, 9 aa, Homo Sapiens
NDNLPEFTA

SEQ ID NO: 1015581 - protein, 9 aa, Homo Sapiens
PLPNKAART

SEQ ID NO: 1015582 - protein, 9 aa, Homo Sapiens
RPTYAGSNS

SEQ ID NO: 1015583 - protein, 9 aa, Homo Sapiens
LLKKRKFLS

SEQ ID NO: 1015584 - protein, 9 aa, Homo Sapiens
DAPPSPPPY

SEQ ID NO: 1015585 - protein, 9 aa, Homo Sapiens
LDNEPPNSG

SEQ ID NO: 1015586 - protein, 9 aa, Homo Sapiens
RICASLVLI

SEQ ID NO: 1015587 - protein, 9 aa, Homo Sapiens
EVLLGCPVL

SEQ ID NO: 1015588 - protein, 9 aa, Homo Sapiens
INQRLKKND

SEQ ID NO: 1015589 - protein, 9 aa, Homo Sapiens
FMEGDPNPL

SEQ ID NO: 1015590 - protein, 9 aa, Homo Sapiens
KDFIVYREP

SEQ ID NO: 1015591 - protein, 9 aa, Homo Sapiens
GNACWKLYC

SEQ ID NO: 1015592 - protein, 9 aa, Homo Sapiens
LMVDRETDE

SEQ ID NO: 1015593 - protein, 9 aa, Homo Sapiens
HKIIYTGKK

SEQ ID NO: 1015594 - protein, 9 aa, Homo Sapiens
YLVKKMMKD

SEQ ID NO: 1015595 - protein, 9 aa, Homo Sapiens
DTNLINRST

SEQ ID NO: 1015596 - protein, 9 aa, Homo Sapiens
IQAEQVNAV

SEQ ID NO: 1015597 - protein, 9 aa, Homo Sapiens
LLFFLFPLL

SEQ ID NO: 1015598 - protein, 9 aa, Homo Sapiens
IKIEECIKK

SEQ ID NO: 1015599 - protein, 9 aa, Homo Sapiens
TLNSQLAPP

SEQ ID NO: 1015600 - protein, 9 aa, Homo Sapiens
WGSRVGGGG

SEQ ID NO: 1015601 - protein, 9 aa, Homo Sapiens
TFFLIGTPG

SEQ ID NO: 1015602 - protein, 9 aa, Homo Sapiens
DHQLLWGKA

SEQ ID NO: 1015603 - protein, 9 aa, Homo Sapiens
FYSGIDIKT

SEQ ID NO: 1015604 - protein, 9 aa, Homo Sapiens
RDQEDASPD

SEQ ID NO: 1015605 - protein, 9 aa, Homo Sapiens
PEMKTILCG

SEQ ID NO: 1015606 - protein, 9 aa, Homo Sapiens
NELWNCLNQ

SEQ ID NO: 1015607 - protein, 9 aa, Homo Sapiens
GGTLDAERK

SEQ ID NO: 1015608 - protein, 9 aa, Homo Sapiens
DKNRRENVV

SEQ ID NO: 1015609 - protein, 9 aa, Homo Sapiens
SRSPSGTPA

SEQ ID NO: 1015610 - protein, 9 aa, Homo Sapiens
LLSAVRINE

SEQ ID NO: 1015611 - protein, 9 aa, Homo Sapiens
QHWIKRGVA

SEQ ID NO: 1015612 - protein, 9 aa, Homo Sapiens
PVLLGVKQK

SEQ ID NO: 1015613 - protein, 9 aa, Homo Sapiens
EMTTGSPPP

SEQ ID NO: 1015614 - protein, 9 aa, Homo Sapiens
ETMVEDYLA

SEQ ID NO: 1015615 - protein, 9 aa, Homo Sapiens
KLTVASAKR

SEQ ID NO: 1015616 - protein, 9 aa, Homo Sapiens
IYTGKKPYK

SEQ ID NO: 1015617 - protein, 9 aa, Homo Sapiens
ETLISEYFQ

SEQ ID NO: 1015618 - protein, 9 aa, Homo Sapiens
DHKAMVSFG

SEQ ID NO: 1015619 - protein, 9 aa, Homo Sapiens
ANQLKKYKE

SEQ ID NO: 1015620 - protein, 9 aa, Homo Sapiens
EPGAKKPMA

SEQ ID NO: 1015621 - protein, 9 aa, Homo Sapiens
GRPSGQREF

SEQ ID NO: 1015622 - protein, 9 aa, Homo Sapiens
PDGTSPKLD

SEQ ID NO: 1015623 - protein, 9 aa, Homo Sapiens
TAGKEEYSA

SEQ ID NO: 1015624 - protein, 9 aa, Homo Sapiens
VGEKIKCDE

SEQ ID NO: 1015625 - protein, 9 aa, Homo Sapiens
AESQNRGPA

SEQ ID NO: 1015626 - protein, 9 aa, Homo Sapiens
WEVIKQGYR

SEQ ID NO: 1015627 - protein, 9 aa, Homo Sapiens
PPHYTTLAL

SEQ ID NO: 1015628 - protein, 9 aa, Homo Sapiens
DIQAESQNR

SEQ ID NO: 1015629 - protein, 9 aa, Homo Sapiens
FAFTFENGN

SEQ ID NO: 1015630 - protein, 9 aa, Homo Sapiens
LIVTGPTNE

SEQ ID NO: 1015631 - protein, 9 aa, Homo Sapiens
KMNRFRQSL

SEQ ID NO: 1015632 - protein, 9 aa, Homo Sapiens
EGEEDQQRI

SEQ ID NO: 1015633 - protein, 9 aa, Homo Sapiens
KTVEREKTL

SEQ ID NO: 1015634 - protein, 9 aa, Homo Sapiens
SLNSENYLN

SEQ ID NO: 1015635 - protein, 9 aa, Homo Sapiens
LALFLLLPK

SEQ ID NO: 1015636 - protein, 9 aa, Homo Sapiens
KLGQKDVNG

SEQ ID NO: 1015637 - protein, 9 aa, Homo Sapiens
STDSFHREI

SEQ ID NO: 1015638 - protein, 9 aa, Homo Sapiens
SQSPLILYY

SEQ ID NO: 1015639 - protein, 9 aa, Homo Sapiens
CTDAILNFI

SEQ ID NO: 1015640 - protein, 9 aa, Homo Sapiens
WPHGVVLRL

SEQ ID NO: 1015641 - protein, 9 aa, Homo Sapiens
QQNNGIRCR

SEQ ID NO: 1015642 - protein, 9 aa, Homo Sapiens
MVKVCQVGS

SEQ ID NO: 1015643 - protein, 9 aa, Homo Sapiens
LLMVDRETD

SEQ ID NO: 1015644 - protein, 9 aa, Homo Sapiens
PKKTSLGEE

SEQ ID NO: 1015645 - protein, 9 aa, Homo Sapiens
AAAAFKIDP

SEQ ID NO: 1015646 - protein, 9 aa, Homo Sapiens
VNLYHAKKK

SEQ ID NO: 1015647 - protein, 9 aa, Homo Sapiens
GTPGLEDFH

SEQ ID NO: 1015648 - protein, 9 aa, Homo Sapiens
GKTFLRSHF

SEQ ID NO: 1015649 - protein, 9 aa, Homo Sapiens
DEKGIFPAH

SEQ ID NO: 1015650 - protein, 9 aa, Homo Sapiens
TYKLGQKDV

SEQ ID NO: 1015651 - protein, 9 aa, Homo Sapiens
KRVCWKPWV

SEQ ID NO: 1015652 - protein, 9 aa, Homo Sapiens
GAAPASLHG

SEQ ID NO: 1015653 - protein, 9 aa, Homo Sapiens
ILPKRFLAV

SEQ ID NO: 1015654 - protein, 9 aa, Homo Sapiens
ARPLLVEYL

SEQ ID NO: 1015655 - protein, 9 aa, Homo Sapiens
EHLCDYTED

SEQ ID NO: 1015656 - protein, 9 aa, Homo Sapiens
KADIPKRPS

SEQ ID NO: 1015657 - protein, 9 aa, Homo Sapiens
GVKGKEATD

SEQ ID NO: 1015658 - protein, 9 aa, Homo Sapiens
LPRTPTIVL

SEQ ID NO: 1015659 - protein, 9 aa, Homo Sapiens
IQGRQAGND

SEQ ID NO: 1015660 - protein, 9 aa, Homo Sapiens
DRLALFLLL

SEQ ID NO: 1015661 - protein, 9 aa, Homo Sapiens
LSGKRGPRG

SEQ ID NO: 1015662 - protein, 9 aa, Homo Sapiens
NLRNAEVKG

SEQ ID NO: 1015663 - protein, 9 aa, Homo Sapiens
RVCWKPWVI

SEQ ID NO: 1015664 - protein, 9 aa, Homo Sapiens
LVKKMMKDN

SEQ ID NO: 1015665 - protein, 9 aa, Homo Sapiens
QTDKPTYKL

SEQ ID NO: 1015666 - protein, 9 aa, Homo Sapiens
SSLNSENYL

SEQ ID NO: 1015667 - protein, 9 aa, Homo Sapiens
IILLFDAHN

SEQ ID NO: 1015668 - protein, 9 aa, Homo Sapiens
REMILNLEG

SEQ ID NO: 1015669 - protein, 9 aa, Homo Sapiens
SHTAAFTDD

SEQ ID NO: 1015670 - protein, 9 aa, Homo Sapiens
QVNESELVY

SEQ ID NO: 1015671 - protein, 9 aa, Homo Sapiens
LEGRGLLRQ

SEQ ID NO: 1015672 - protein, 9 aa, Homo Sapiens
EAPTESNIS

SEQ ID NO: 1015673 - protein, 9 aa, Homo Sapiens
TGFSSFRTL

SEQ ID NO: 1015674 - protein, 9 aa, Homo Sapiens
GSPPPPPSV

SEQ ID NO: 1015675 - protein, 9 aa, Homo Sapiens
IPGLSGKRG

SEQ ID NO: 1015676 - protein, 9 aa, Homo Sapiens
VLRLDFLVR

SEQ ID NO: 1015677 - protein, 9 aa, Homo Sapiens
TEKEIARQQ

SEQ ID NO: 1015678 - protein, 9 aa, Homo Sapiens
LFRNILKKK

SEQ ID NO: 1015679 - protein, 9 aa, Homo Sapiens
RALSGKEGS

SEQ ID NO: 1015680 - protein, 9 aa, Homo Sapiens
LTEKEIARQ

SEQ ID NO: 1015681 - protein, 9 aa, Homo Sapiens
GLEIVRGGL

SEQ ID NO: 1015682 - protein, 9 aa, Homo Sapiens
NKAKPIGFT

SEQ ID NO: 1015683 - protein, 9 aa, Homo Sapiens
LVLFGYRFL

SEQ ID NO: 1015684 - protein, 9 aa, Homo Sapiens
IPGDLVPIS

SEQ ID NO: 1015685 - protein, 9 aa, Homo Sapiens
PLKTQIVPD

SEQ ID NO: 1015686 - protein, 9 aa, Homo Sapiens
LFCRNARRR

SEQ ID NO: 1015687 - protein, 9 aa, Homo Sapiens
AASFFIAVV

SEQ ID NO: 1015688 - protein, 9 aa, Homo Sapiens
DCERHCSPT

SEQ ID NO: 1015689 - protein, 9 aa, Homo Sapiens
SGPAAAAPA

SEQ ID NO: 1015690 - protein, 9 aa, Homo Sapiens
RAKREQVGG

SEQ ID NO: 1015691 - protein, 9 aa, Homo Sapiens
LIGIIIDTT

SEQ ID NO: 1015692 - protein, 9 aa, Homo Sapiens
PVTFFLIGT

SEQ ID NO: 1015693 - protein, 9 aa, Homo Sapiens
INLHRHLEK

SEQ ID NO: 1015694 - protein, 9 aa, Homo Sapiens
KFRFTDCER

SEQ ID NO: 1015695 - protein, 9 aa, Homo Sapiens
MTPLGSSIE

SEQ ID NO: 1015696 - protein, 9 aa, Homo Sapiens
ASMAPAVAL

SEQ ID NO: 1015697 - protein, 9 aa, Homo Sapiens
INYVQYEIK

SEQ ID NO: 1015698 - protein, 9 aa, Homo Sapiens
TQLARPLLV

SEQ ID NO: 1015699 - protein, 9 aa, Homo Sapiens
KEFPRCLST

SEQ ID NO: 1015700 - protein, 9 aa, Homo Sapiens
KEEKLKREE

SEQ ID NO: 1015701 - protein, 9 aa, Homo Sapiens
LPVSPGFPP

SEQ ID NO: 1015702 - protein, 9 aa, Homo Sapiens
AKKKISKKK

SEQ ID NO: 1015703 - protein, 9 aa, Homo Sapiens
HKIHFILGM

SEQ ID NO: 1015704 - protein, 9 aa, Homo Sapiens
AHQALSRDS

SEQ ID NO: 1015705 - protein, 9 aa, Homo Sapiens
LHGPHLPGG

SEQ ID NO: 1015706 - protein, 9 aa, Homo Sapiens
RLDFLVRSK

SEQ ID NO: 1015707 - protein, 9 aa, Homo Sapiens
DSSGGSTQI

SEQ ID NO: 1015708 - protein, 9 aa, Homo Sapiens
AFIRAKLIR

SEQ ID NO: 1015709 - protein, 9 aa, Homo Sapiens
CVGWALDVL

SEQ ID NO: 1015710 - protein, 9 aa, Homo Sapiens
LKASVLFFD

SEQ ID NO: 1015711 - protein, 9 aa, Homo Sapiens
TDCLLLVVM

SEQ ID NO: 1015712 - protein, 9 aa, Homo Sapiens
VCQPYRVKV

SEQ ID NO: 1015713 - protein, 9 aa, Homo Sapiens
KTCSQLLIM

SEQ ID NO: 1015714 - protein, 9 aa, Homo Sapiens
PPEYPPPPS

SEQ ID NO: 1015715 - protein, 9 aa, Homo Sapiens
KGIFPAHKT

SEQ ID NO: 1015716 - protein, 9 aa, Homo Sapiens
DLSRKNMDL

SEQ ID NO: 1015717 - protein, 9 aa, Homo Sapiens
RGFAILERG

SEQ ID NO: 1015718 - protein, 9 aa, Homo Sapiens
SSILTALPQ

SEQ ID NO: 1015719 - protein, 9 aa, Homo Sapiens
PSRAAVPDA

SEQ ID NO: 1015720 - protein, 9 aa, Homo Sapiens
SSKLDTAEN

SEQ ID NO: 1015721 - protein, 9 aa, Homo Sapiens
WWPHGVVLR

SEQ ID NO: 1015722 - protein, 9 aa, Homo Sapiens
YMRAHQALS

SEQ ID NO: 1015723 - protein, 9 aa, Homo Sapiens
EKSTKPKME

SEQ ID NO: 1015724 - protein, 9 aa, Homo Sapiens
ERIQAEQVN

SEQ ID NO: 1015725 - protein, 9 aa, Homo Sapiens
RSLHLAATS

SEQ ID NO: 1015726 - protein, 9 aa, Homo Sapiens
DKFDLDSDD

SEQ ID NO: 1015727 - protein, 9 aa, Homo Sapiens
LINRSTLNE

SEQ ID NO: 1015728 - protein, 9 aa, Homo Sapiens
FLWEVIKQG

SEQ ID NO: 1015729 - protein, 9 aa, Homo Sapiens
DTDPCTKLM

SEQ ID NO: 1015730 - protein, 9 aa, Homo Sapiens
SGVWLMAPL

SEQ ID NO: 1015731 - protein, 9 aa, Homo Sapiens
LMRFPELDA

SEQ ID NO: 1015732 - protein, 9 aa, Homo Sapiens
GAEDSSGEP

SEQ ID NO: 1015733 - protein, 9 aa, Homo Sapiens
EDSSGEPGA

SEQ ID NO: 1015734 - protein, 9 aa, Homo Sapiens
ASQVAASQL

SEQ ID NO: 1015735 - protein, 9 aa, Homo Sapiens
LTGLNYEVP

SEQ ID NO: 1015736 - protein, 9 aa, Homo Sapiens
GKKIGEKEI

SEQ ID NO: 1015737 - protein, 9 aa, Homo Sapiens
SMFPLGVAT

SEQ ID NO: 1015738 - protein, 9 aa, Homo Sapiens
AIGEARKVL

SEQ ID NO: 1015739 - protein, 9 aa, Homo Sapiens
KHRVRFRGK

SEQ ID NO: 1015740 - protein, 9 aa, Homo Sapiens
DAVFSFGEL

SEQ ID NO: 1015741 - protein, 9 aa, Homo Sapiens
FSASTFFWA

SEQ ID NO: 1015742 - protein, 9 aa, Homo Sapiens
RGDPSASSS

SEQ ID NO: 1015743 - protein, 9 aa, Homo Sapiens
EFGEDNFSK

SEQ ID NO: 1015744 - protein, 9 aa, Homo Sapiens
LCNVLLIAG

SEQ ID NO: 1015745 - protein, 9 aa, Homo Sapiens
GSLAAGILD

SEQ ID NO: 1015746 - protein, 9 aa, Homo Sapiens
AKAFRNRLS

SEQ ID NO: 1015747 - protein, 9 aa, Homo Sapiens
NEKKGKKDS

SEQ ID NO: 1015748 - protein, 9 aa, Homo Sapiens
GVPPSFPPI

SEQ ID NO: 1015749 - protein, 9 aa, Homo Sapiens
GEKIKNTIS

SEQ ID NO: 1015750 - protein, 9 aa, Homo Sapiens
HRVRFRGKR

SEQ ID NO: 1015751 - protein, 9 aa, Homo Sapiens
ASLHELCVA

SEQ ID NO: 1015752 - protein, 9 aa, Homo Sapiens
APLQLLKGA

SEQ ID NO: 1015753 - protein, 9 aa, Homo Sapiens
LPHLLDKLC

SEQ ID NO: 1015754 - protein, 9 aa, Homo Sapiens
TNNLRLKDW

SEQ ID NO: 1015755 - protein, 9 aa, Homo Sapiens
EEEDVVNSW

SEQ ID NO: 1015756 - protein, 9 aa, Homo Sapiens
RRRLSPPSL

SEQ ID NO: 1015757 - protein, 9 aa, Homo Sapiens
DALRLGLVV

SEQ ID NO: 1015758 - protein, 9 aa, Homo Sapiens
PDFLYICSW

SEQ ID NO: 1015759 - protein, 9 aa, Homo Sapiens
KINRDKTDY

SEQ ID NO: 1015760 - protein, 9 aa, Homo Sapiens
ETILSEFYI

SEQ ID NO: 1015761 - protein, 9 aa, Homo Sapiens
VPEGSYKVA

SEQ ID NO: 1015762 - protein, 9 aa, Homo Sapiens
HGNTPHASN

SEQ ID NO: 1015763 - protein, 9 aa, Homo Sapiens
NKLMHQKQL

SEQ ID NO: 1015764 - protein, 9 aa, Homo Sapiens
LLNLHNMIL

SEQ ID NO: 1015765 - protein, 9 aa, Homo Sapiens
AETARKLAG

SEQ ID NO: 1015766 - protein, 9 aa, Homo Sapiens
VLMGYVAAV

SEQ ID NO: 1015767 - protein, 9 aa, Homo Sapiens
RFSASTFFW

SEQ ID NO: 1015768 - protein, 9 aa, Homo Sapiens
RNLCRRVPT

SEQ ID NO: 1015769 - protein, 9 aa, Homo Sapiens
PFLFFIWHN

SEQ ID NO: 1015770 - protein, 9 aa, Homo Sapiens
TSALWINVA

SEQ ID NO: 1015771 - protein, 9 aa, Homo Sapiens
EKELRISIN

SEQ ID NO: 1015772 - protein, 9 aa, Homo Sapiens
EEEEDVVNS

SEQ ID NO: 1015773 - protein, 9 aa, Homo Sapiens
FVEGRFSVP

SEQ ID NO: 1015774 - protein, 9 aa, Homo Sapiens
RCENLIVEG

SEQ ID NO: 1015775 - protein, 9 aa, Homo Sapiens
LYCSSDWAL

SEQ ID NO: 1015776 - protein, 9 aa, Homo Sapiens
NRDKTDYLT

SEQ ID NO: 1015777 - protein, 9 aa, Homo Sapiens
QRPKAQDKP

SEQ ID NO: 1015778 - protein, 9 aa, Homo Sapiens
VDYSETSSQ

SEQ ID NO: 1015779 - protein, 9 aa, Homo Sapiens
YPDIQASYF

SEQ ID NO: 1015780 - protein, 9 aa, Homo Sapiens
PLSQAPGPP

SEQ ID NO: 1015781 - protein, 9 aa, Homo Sapiens
PILITCSET

SEQ ID NO: 1015782 - protein, 9 aa, Homo Sapiens
QLLQQQQQT

SEQ ID NO: 1015783 - protein, 9 aa, Homo Sapiens
AARQHTVVL

SEQ ID NO: 1015784 - protein, 9 aa, Homo Sapiens
DENEDIFIA

SEQ ID NO: 1015785 - protein, 9 aa, Homo Sapiens
NNKLEGILG

SEQ ID NO: 1015786 - protein, 9 aa, Homo Sapiens
FCNVPQVIK

SEQ ID NO: 1015787 - protein, 9 aa, Homo Sapiens
DYSETSSQC

SEQ ID NO: 1015788 - protein, 9 aa, Homo Sapiens
NNLRLKDWE

SEQ ID NO: 1015789 - protein, 9 aa, Homo Sapiens
CPFLADENY

SEQ ID NO: 1015790 - protein, 9 aa, Homo Sapiens
TYSQKSAKE

SEQ ID NO: 1015791 - protein, 9 aa, Homo Sapiens
LLGFTNYPK

SEQ ID NO: 1015792 - protein, 9 aa, Homo Sapiens
FRNRLSLIE

SEQ ID NO: 1015793 - protein, 9 aa, Homo Sapiens
EPAGWKEMQ

SEQ ID NO: 1015794 - protein, 9 aa, Homo Sapiens
SRAQFSSTS

SEQ ID NO: 1015795 - protein, 9 aa, Homo Sapiens
RRQRKEEEC

SEQ ID NO: 1015796 - protein, 9 aa, Homo Sapiens
PLRGQTSKT

SEQ ID NO: 1015797 - protein, 9 aa, Homo Sapiens
GVNFLQSYQ

SEQ ID NO: 1015798 - protein, 9 aa, Homo Sapiens
YGVRLLFKA

SEQ ID NO: 1015799 - protein, 9 aa, Homo Sapiens
EVSAAGLSS

SEQ ID NO: 1015800 - protein, 9 aa, Homo Sapiens
TNVYEDALR

SEQ ID NO: 1015801 - protein, 9 aa, Homo Sapiens
FIYGLLIGG

SEQ ID NO: 1015802 - protein, 9 aa, Homo Sapiens
ILVSDILSC

SEQ ID NO: 1015803 - protein, 9 aa, Homo Sapiens
TEQEIEEWL

SEQ ID NO: 1015804 - protein, 9 aa, Homo Sapiens
RGNYSNYAG

SEQ ID NO: 1015805 - protein, 9 aa, Homo Sapiens
AQQQQQQQH

SEQ ID NO: 1015806 - protein, 9 aa, Homo Sapiens
FFCNVPQVI

SEQ ID NO: 1015807 - protein, 9 aa, Homo Sapiens
LAAGILDLL

SEQ ID NO: 1015808 - protein, 9 aa, Homo Sapiens
AAALMELLW

SEQ ID NO: 1015809 - protein, 9 aa, Homo Sapiens
FGEKIKNTI

SEQ ID NO: 1015810 - protein, 9 aa, Homo Sapiens
TDDSSKDSQ

SEQ ID NO: 1015811 - protein, 9 aa, Homo Sapiens
SCSRINKTF

SEQ ID NO: 1015812 - protein, 9 aa, Homo Sapiens
VFVDNFYYD

SEQ ID NO: 1015813 - protein, 9 aa, Homo Sapiens
FPLGVATLT

SEQ ID NO: 1015814 - protein, 9 aa, Homo Sapiens
LKKMSLTTE

SEQ ID NO: 1015815 - protein, 9 aa, Homo Sapiens
EKDFLKEKE

SEQ ID NO: 1015816 - protein, 9 aa, Homo Sapiens
HWEENTVYQ

SEQ ID NO: 1015817 - protein, 9 aa, Homo Sapiens
IMYFTEKPP

SEQ ID NO: 1015818 - protein, 9 aa, Homo Sapiens
YSQSLLKQM

SEQ ID NO: 1015819 - protein, 9 aa, Homo Sapiens
ILYCSSDWA

SEQ ID NO: 1015820 - protein, 9 aa, Homo Sapiens
SLYPIKQCR

SEQ ID NO: 1015821 - protein, 9 aa, Homo Sapiens
QSRACRGAS

SEQ ID NO: 1015822 - protein, 9 aa, Homo Sapiens
RPDVQLRFS

SEQ ID NO: 1015823 - protein, 9 aa, Homo Sapiens
PGFAKRYSR

SEQ ID NO: 1015824 - protein, 9 aa, Homo Sapiens
PHLLDKLCC

SEQ ID NO: 1015825 - protein, 9 aa, Homo Sapiens
SSQARHDFD

SEQ ID NO: 1015826 - protein, 9 aa, Homo Sapiens
KDTTEYFVR

SEQ ID NO: 1015827 - protein, 9 aa, Homo Sapiens
GETLASQVA

SEQ ID NO: 1015828 - protein, 9 aa, Homo Sapiens
VETCDKRAL

SEQ ID NO: 1015829 - protein, 9 aa, Homo Sapiens
KTKRSGGHA

SEQ ID NO: 1015830 - protein, 9 aa, Homo Sapiens
PEKNEAIAS

SEQ ID NO: 1015831 - protein, 9 aa, Homo Sapiens
LPKDTTEYF

SEQ ID NO: 1015832 - protein, 9 aa, Homo Sapiens
GSPSHCLPH

SEQ ID NO: 1015833 - protein, 9 aa, Homo Sapiens
GRPGFAKRY

SEQ ID NO: 1015834 - protein, 9 aa, Homo Sapiens
PQRPDVQLR

SEQ ID NO: 1015835 - protein, 9 aa, Homo Sapiens
LLEKIQVAH

SEQ ID NO: 1015836 - protein, 9 aa, Homo Sapiens
SDPLELVRT

SEQ ID NO: 1015837 - protein, 9 aa, Homo Sapiens
LRLGLVVTG

SEQ ID NO: 1015838 - protein, 9 aa, Homo Sapiens
HCWACGYVV

SEQ ID NO: 1015839 - protein, 9 aa, Homo Sapiens
REPPGRRSR

SEQ ID NO: 1015840 - protein, 9 aa, Homo Sapiens
VLRRGYFQL

SEQ ID NO: 1015841 - protein, 9 aa, Homo Sapiens
PIDGYIMEF

SEQ ID NO: 1015842 - protein, 9 aa, Homo Sapiens
NILIMDTGE

SEQ ID NO: 1015843 - protein, 9 aa, Homo Sapiens
SKSAVLRTC

SEQ ID NO: 1015844 - protein, 9 aa, Homo Sapiens
NFYYDYNFI

SEQ ID NO: 1015845 - protein, 9 aa, Homo Sapiens
GFGQRFDLV

SEQ ID NO: 1015846 - protein, 9 aa, Homo Sapiens
RKLAGPGST

SEQ ID NO: 1015847 - protein, 9 aa, Homo Sapiens
WINVAATEV

SEQ ID NO: 1015848 - protein, 9 aa, Homo Sapiens
STELTGAVK

SEQ ID NO: 1015849 - protein, 9 aa, Homo Sapiens
DIHVAMEKN

SEQ ID NO: 1015850 - protein, 9 aa, Homo Sapiens
IGNLGDYYH

SEQ ID NO: 1015851 - protein, 9 aa, Homo Sapiens
GKTKRSGGH

SEQ ID NO: 1015852 - protein, 9 aa, Homo Sapiens
PHSPQYPHN

SEQ ID NO: 1015853 - protein, 9 aa, Homo Sapiens
FAKRYSRSD

SEQ ID NO: 1015854 - protein, 9 aa, Homo Sapiens
TTPSGENTT

SEQ ID NO: 1015855 - protein, 9 aa, Homo Sapiens
IHNEFFWPY

SEQ ID NO: 1015856 - protein, 9 aa, Homo Sapiens
QREALPIDT

SEQ ID NO: 1015857 - protein, 9 aa, Homo Sapiens
GKGFGQRFD

SEQ ID NO: 1015858 - protein, 9 aa, Homo Sapiens
KAETARKLA

SEQ ID NO: 1015859 - protein, 9 aa, Homo Sapiens
GKGLAEGTP

SEQ ID NO: 1015860 - protein, 9 aa, Homo Sapiens
AGHSSSFPY

SEQ ID NO: 1015861 - protein, 9 aa, Homo Sapiens
PISGSLGVT

SEQ ID NO: 1015862 - protein, 9 aa, Homo Sapiens
GDWVILANA

SEQ ID NO: 1015863 - protein, 9 aa, Homo Sapiens
AKVQALSRE

SEQ ID NO: 1015864 - protein, 9 aa, Homo Sapiens
LNKKFGSYL

SEQ ID NO: 1015865 - protein, 9 aa, Homo Sapiens
SPPILYFFY

SEQ ID NO: 1015866 - protein, 9 aa, Homo Sapiens
SEDKIYRFN

SEQ ID NO: 1015867 - protein, 9 aa, Homo Sapiens
EGVAAPLRR

SEQ ID NO: 1015868 - protein, 9 aa, Homo Sapiens
GVKKKFGHE

SEQ ID NO: 1015869 - protein, 9 aa, Homo Sapiens
KMWKTSPDL

SEQ ID NO: 1015870 - protein, 9 aa, Homo Sapiens
LKDDSTVIT

SEQ ID NO: 1015871 - protein, 9 aa, Homo Sapiens
PGRRSRPRA

SEQ ID NO: 1015872 - protein, 9 aa, Homo Sapiens
QTGSPLLSA

SEQ ID NO: 1015873 - protein, 9 aa, Homo Sapiens
TTGIFPGNG

SEQ ID NO: 1015874 - protein, 9 aa, Homo Sapiens
VPIEEQHGD

SEQ ID NO: 1015875 - protein, 9 aa, Homo Sapiens
GSYFAGSQG

SEQ ID NO: 1015876 - protein, 9 aa, Homo Sapiens
DGSPYPDPS

SEQ ID NO: 1015877 - protein, 9 aa, Homo Sapiens
VMHPEYIVV

SEQ ID NO: 1015878 - protein, 9 aa, Homo Sapiens
LVLPKDTTE

SEQ ID NO: 1015879 - protein, 9 aa, Homo Sapiens
PQRPSPAFS

SEQ ID NO: 1015880 - protein, 9 aa, Homo Sapiens
NQCWTTTQE

SEQ ID NO: 1015881 - protein, 9 aa, Homo Sapiens
VSTELTGAV

SEQ ID NO: 1015882 - protein, 9 aa, Homo Sapiens
RTKKREEDR

SEQ ID NO: 1015883 - protein, 9 aa, Homo Sapiens
LKAHQSKVS

SEQ ID NO: 1015884 - protein, 9 aa, Homo Sapiens
NVAATEVVN

SEQ ID NO: 1015885 - protein, 9 aa, Homo Sapiens
VKPLQKQPL

SEQ ID NO: 1015886 - protein, 9 aa, Homo Sapiens
DVVNSWFWS

SEQ ID NO: 1015887 - protein, 9 aa, Homo Sapiens
LTANKHRVR

SEQ ID NO: 1015888 - protein, 9 aa, Homo Sapiens
GITNVRIVF

SEQ ID NO: 1015889 - protein, 9 aa, Homo Sapiens
GKIRDSNCS

SEQ ID NO: 1015890 - protein, 9 aa, Homo Sapiens
ARDMLGMEE

SEQ ID NO: 1015891 - protein, 9 aa, Homo Sapiens
KNILCVERG

SEQ ID NO: 1015892 - protein, 9 aa, Homo Sapiens
TFSHKSFLT

SEQ ID NO: 1015893 - protein, 9 aa, Homo Sapiens
LTSDKLGYS

SEQ ID NO: 1015894 - protein, 9 aa, Homo Sapiens
LHLFKGTQT

SEQ ID NO: 1015895 - protein, 9 aa, Homo Sapiens
PIEEQHGDY

SEQ ID NO: 1015896 - protein, 9 aa, Homo Sapiens
DPILKDDST

SEQ ID NO: 1015897 - protein, 9 aa, Homo Sapiens
WGNHECRHL

SEQ ID NO: 1015898 - protein, 9 aa, Homo Sapiens
AALQETRGI

SEQ ID NO: 1015899 - protein, 9 aa, Homo Sapiens
KEWVKKNKL

SEQ ID NO: 1015900 - protein, 9 aa, Homo Sapiens
PGKIRDSNC

SEQ ID NO: 1015901 - protein, 9 aa, Homo Sapiens
IAQVLSKWD

SEQ ID NO: 1015902 - protein, 9 aa, Homo Sapiens
SLPPADGRL

SEQ ID NO: 1015903 - protein, 9 aa, Homo Sapiens
AETEQEIEE

SEQ ID NO: 1015904 - protein, 9 aa, Homo Sapiens
YYAARSFAL

SEQ ID NO: 1015905 - protein, 9 aa, Homo Sapiens
ATAATQRPK

SEQ ID NO: 1015906 - protein, 9 aa, Homo Sapiens
RTGFYNKPT

SEQ ID NO: 1015907 - protein, 9 aa, Homo Sapiens
GILKQVSIS

SEQ ID NO: 1015908 - protein, 9 aa, Homo Sapiens
PDRTLGLTP

SEQ ID NO: 1015909 - protein, 9 aa, Homo Sapiens
LVIHGKQKQ

SEQ ID NO: 1015910 - protein, 9 aa, Homo Sapiens
WACGYVVCA

SEQ ID NO: 1015911 - protein, 9 aa, Homo Sapiens
PREVLLHWD

SEQ ID NO: 1015912 - protein, 9 aa, Homo Sapiens
KEVARQQLK

SEQ ID NO: 1015913 - protein, 9 aa, Homo Sapiens
EFIRNKSFY

SEQ ID NO: 1015914 - protein, 9 aa, Homo Sapiens
FQFSSTEQR

SEQ ID NO: 1015915 - protein, 9 aa, Homo Sapiens
LLDGTIQRD

SEQ ID NO: 1015916 - protein, 9 aa, Homo Sapiens
LAQQDCSPS

SEQ ID NO: 1015917 - protein, 9 aa, Homo Sapiens
RIVFSNVFN

SEQ ID NO: 1015918 - protein, 9 aa, Homo Sapiens
IDTTPSGEN

SEQ ID NO: 1015919 - protein, 9 aa, Homo Sapiens
PLRRAPFKG

SEQ ID NO: 1015920 - protein, 9 aa, Homo Sapiens
LFFFWGVSL

SEQ ID NO: 1015921 - protein, 9 aa, Homo Sapiens
SSALKIEIH

SEQ ID NO: 1015922 - protein, 9 aa, Homo Sapiens
PKDTTEYFV

SEQ ID NO: 1015923 - protein, 9 aa, Homo Sapiens
LRRGYFQLF

SEQ ID NO: 1015924 - protein, 9 aa, Homo Sapiens
KFPLAFRIA

SEQ ID NO: 1015925 - protein, 9 aa, Homo Sapiens
KIGEKEIQK

SEQ ID NO: 1015926 - protein, 9 aa, Homo Sapiens
EDVQVDRRK

SEQ ID NO: 1015927 - protein, 9 aa, Homo Sapiens
MEASYKAQN

SEQ ID NO: 1015928 - protein, 9 aa, Homo Sapiens
ILAMVDFAA

SEQ ID NO: 1015929 - protein, 9 aa, Homo Sapiens
WATQKNKIQ

SEQ ID NO: 1015930 - protein, 9 aa, Homo Sapiens
DRRKDSHSS

SEQ ID NO: 1015931 - protein, 9 aa, Homo Sapiens
QAAENAVKR

SEQ ID NO: 1015932 - protein, 9 aa, Homo Sapiens
EPPGRRSRP

SEQ ID NO: 1015933 - protein, 9 aa, Homo Sapiens
RDGLSSQAR

SEQ ID NO: 1015934 - protein, 9 aa, Homo Sapiens
KKIGEKEIQ

SEQ ID NO: 1015935 - protein, 9 aa, Homo Sapiens
HFADPVDVN

SEQ ID NO: 1015936 - protein, 9 aa, Homo Sapiens
LSYLTEYRF

SEQ ID NO: 1015937 - protein, 9 aa, Homo Sapiens
PGVLDEATE

SEQ ID NO: 1015938 - protein, 9 aa, Homo Sapiens
SDKDSGDWV

SEQ ID NO: 1015939 - protein, 9 aa, Homo Sapiens
PDGSPYPDP

SEQ ID NO: 1015940 - protein, 9 aa, Homo Sapiens
DNKTCEIVN

SEQ ID NO: 1015941 - protein, 9 aa, Homo Sapiens
RNKSFYLNN

SEQ ID NO: 1015942 - protein, 9 aa, Homo Sapiens
EYKESGQRN

SEQ ID NO: 1015943 - protein, 9 aa, Homo Sapiens
MSSTAISLQ

SEQ ID NO: 1015944 - protein, 9 aa, Homo Sapiens
KDYSEDKIY

SEQ ID NO: 1015945 - protein, 9 aa, Homo Sapiens
FGTYDEQVS

SEQ ID NO: 1015946 - protein, 9 aa, Homo Sapiens
VATLAKKAA

SEQ ID NO: 1015947 - protein, 9 aa, Homo Sapiens
TKTFPNYYS

SEQ ID NO: 1015948 - protein, 9 aa, Homo Sapiens
CWTTTQEKI

SEQ ID NO: 1015949 - protein, 9 aa, Homo Sapiens
LRGLDDIKN

SEQ ID NO: 1015950 - protein, 9 aa, Homo Sapiens
KTKLLGCQS

SEQ ID NO: 1015951 - protein, 9 aa, Homo Sapiens
SKTKLLGCQ

SEQ ID NO: 1015952 - protein, 9 aa, Homo Sapiens
LLFKAMTED

SEQ ID NO: 1015953 - protein, 9 aa, Homo Sapiens
DEATELLGL

SEQ ID NO: 1015954 - protein, 9 aa, Homo Sapiens
LGMDGMKCG

SEQ ID NO: 1015955 - protein, 9 aa, Homo Sapiens
EKLGGQSYF

SEQ ID NO: 1015956 - protein, 9 aa, Homo Sapiens
KMKNVTRMV

SEQ ID NO: 1015957 - protein, 9 aa, Homo Sapiens
VPVAVQGEN

SEQ ID NO: 1015958 - protein, 9 aa, Homo Sapiens
LAEDVQVDR

SEQ ID NO: 1015959 - protein, 9 aa, Homo Sapiens
SQKSAKEVG

SEQ ID NO: 1015960 - protein, 9 aa, Homo Sapiens
RKSFSSLKQ

SEQ ID NO: 1015961 - protein, 9 aa, Homo Sapiens
STYSQKSAK

SEQ ID NO: 1015962 - protein, 9 aa, Homo Sapiens
DGERLVPVP

SEQ ID NO: 1015963 - protein, 9 aa, Homo Sapiens
LGMEETQVI

SEQ ID NO: 1015964 - protein, 9 aa, Homo Sapiens
RLSRKLLCK

SEQ ID NO: 1015965 - protein, 9 aa, Homo Sapiens
EETGEGRGE

SEQ ID NO: 1015966 - protein, 9 aa, Homo Sapiens
IKFSEVDYF

SEQ ID NO: 1015967 - protein, 9 aa, Homo Sapiens
YSETSSQCP

SEQ ID NO: 1015968 - protein, 9 aa, Homo Sapiens
ADGDSYNEM

SEQ ID NO: 1015969 - protein, 9 aa, Homo Sapiens
VLEKDFLKE

SEQ ID NO: 1015970 - protein, 9 aa, Homo Sapiens
VPPSFPPIQ

SEQ ID NO: 1015971 - protein, 9 aa, Homo Sapiens
LFSLGKRVC

SEQ ID NO: 1015972 - protein, 9 aa, Homo Sapiens
AECGASVKR

SEQ ID NO: 1015973 - protein, 9 aa, Homo Sapiens
CGKGFGQRF

SEQ ID NO: 1015974 - protein, 9 aa, Homo Sapiens
LLLSKVERL

SEQ ID NO: 1015975 - protein, 9 aa, Homo Sapiens
GEFGSRSLY

SEQ ID NO: 1015976 - protein, 9 aa, Homo Sapiens
SACISQVTR

SEQ ID NO: 1015977 - protein, 9 aa, Homo Sapiens
SVFYFRSPG

SEQ ID NO: 1015978 - protein, 9 aa, Homo Sapiens
NKISTLLIV

SEQ ID NO: 1015979 - protein, 9 aa, Homo Sapiens
AGLASKEEQ

SEQ ID NO: 1015980 - protein, 9 aa, Homo Sapiens
PYPDPSAGA

SEQ ID NO: 1015981 - protein, 9 aa, Homo Sapiens
FLASHFRTT

SEQ ID NO: 1015982 - protein, 9 aa, Homo Sapiens
RPISGSLGV

SEQ ID NO: 1015983 - protein, 9 aa, Homo Sapiens
YPTKTFPNY

SEQ ID NO: 1015984 - protein, 9 aa, Homo Sapiens
ADAILYCSS

SEQ ID NO: 1015985 - protein, 9 aa, Homo Sapiens
IKFPLAFRI

SEQ ID NO: 1015986 - protein, 9 aa, Homo Sapiens
EEVSAAGLS

SEQ ID NO: 1015987 - protein, 9 aa, Homo Sapiens
GIHLSKPSY

SEQ ID NO: 1015988 - protein, 9 aa, Homo Sapiens
LKEVNKEID

SEQ ID NO: 1015989 - protein, 9 aa, Homo Sapiens
KIQVAHTKI

SEQ ID NO: 1015990 - protein, 9 aa, Homo Sapiens
KLEDEDEDL

SEQ ID NO: 1015991 - protein, 9 aa, Homo Sapiens
VPKYHIPYW

SEQ ID NO: 1015992 - protein, 9 aa, Homo Sapiens
PATMMPDRT

SEQ ID NO: 1015993 - protein, 9 aa, Homo Sapiens
QSWYLTENI

SEQ ID NO: 1015994 - protein, 9 aa, Homo Sapiens
STQIKFPLA

SEQ ID NO: 1015995 - protein, 9 aa, Homo Sapiens
HGDYDLNAV

SEQ ID NO: 1015996 - protein, 9 aa, Homo Sapiens
SHFRTTSLG

SEQ ID NO: 1015997 - protein, 9 aa, Homo Sapiens
LLCKPSGDF

SEQ ID NO: 1015998 - protein, 9 aa, Homo Sapiens
DSYNEMNSR

SEQ ID NO: 1015999 - protein, 9 aa, Homo Sapiens
FMSVLDQDR

SEQ ID NO: 1016000 - protein, 9 aa, Homo Sapiens
ACRGASRWD

SEQ ID NO: 1016001 - protein, 9 aa, Homo Sapiens
PARGRPGFA

SEQ ID NO: 1016002 - protein, 9 aa, Homo Sapiens
FIYKGEGKW

SEQ ID NO: 1016003 - protein, 9 aa, Homo Sapiens
RGLDDIKNL

SEQ ID NO: 1016004 - protein, 9 aa, Homo Sapiens
DLLEKIQVA

SEQ ID NO: 1016005 - protein, 9 aa, Homo Sapiens
FQVPIEEQH

SEQ ID NO: 1016006 - protein, 9 aa, Homo Sapiens
TKVEAHQLA

SEQ ID NO: 1016007 - protein, 9 aa, Homo Sapiens
LRGQTSKTK

SEQ ID NO: 1016008 - protein, 9 aa, Homo Sapiens
RRLQAAENA

SEQ ID NO: 1016009 - protein, 9 aa, Homo Sapiens
GFILLAVLL

SEQ ID NO: 1016010 - protein, 9 aa, Homo Sapiens
ILKDDSTVI

SEQ ID NO: 1016011 - protein, 9 aa, Homo Sapiens
INQINNKLE

SEQ ID NO: 1016012 - protein, 9 aa, Homo Sapiens
DYEEKELRI

SEQ ID NO: 1016013 - protein, 9 aa, Homo Sapiens
AHQSGGGGL

SEQ ID NO: 1016014 - protein, 9 aa, Homo Sapiens
CVAESQYGQ

SEQ ID NO: 1016015 - protein, 9 aa, Homo Sapiens
CLAPKLYNG

SEQ ID NO: 1016016 - protein, 9 aa, Homo Sapiens
QGENTVQSL

SEQ ID NO: 1016017 - protein, 9 aa, Homo Sapiens
NKTFIYGLL

SEQ ID NO: 1016018 - protein, 9 aa, Homo Sapiens
PAGWKEMQC

SEQ ID NO: 1016019 - protein, 9 aa, Homo Sapiens
FPTVFSFPP

SEQ ID NO: 1016020 - protein, 9 aa, Homo Sapiens
LSRPHSYQN

SEQ ID NO: 1016021 - protein, 9 aa, Homo Sapiens
QFSSTSGGS

SEQ ID NO: 1016022 - protein, 9 aa, Homo Sapiens
GKKVIPRLT

SEQ ID NO: 1016023 - protein, 9 aa, Homo Sapiens
KKLKEMKRS

SEQ ID NO: 1016024 - protein, 9 aa, Homo Sapiens
KEMQCHLRA

SEQ ID NO: 1016025 - protein, 9 aa, Homo Sapiens
DWVILANAG

SEQ ID NO: 1016026 - protein, 9 aa, Homo Sapiens
DAAPKPPIS

SEQ ID NO: 1016027 - protein, 9 aa, Homo Sapiens
GAPQSTQIK

SEQ ID NO: 1016028 - protein, 9 aa, Homo Sapiens
IIFEAALQE

SEQ ID NO: 1016029 - protein, 9 aa, Homo Sapiens
ITPELPEKK

SEQ ID NO: 1016030 - protein, 9 aa, Homo Sapiens
QAPGPPTPA

SEQ ID NO: 1016031 - protein, 9 aa, Homo Sapiens
YTAAARQHT

SEQ ID NO: 1016032 - protein, 9 aa, Homo Sapiens
QIKFPLAFR

SEQ ID NO: 1016033 - protein, 9 aa, Homo Sapiens
ELLWEKEER

SEQ ID NO: 1016034 - protein, 9 aa, Homo Sapiens
MTFGEKIKN

SEQ ID NO: 1016035 - protein, 9 aa, Homo Sapiens
KPEPKKEVV

SEQ ID NO: 1016036 - protein, 9 aa, Homo Sapiens
SQKNDDQKN

SEQ ID NO: 1016037 - protein, 9 aa, Homo Sapiens
IGNPKLPSV

SEQ ID NO: 1016038 - protein, 9 aa, Homo Sapiens
AYKHMKLHK

SEQ ID NO: 1016039 - protein, 9 aa, Homo Sapiens
KKGKKNEKK

SEQ ID NO: 1016040 - protein, 9 aa, Homo Sapiens
FNLPKQDLP

SEQ ID NO: 1016041 - protein, 9 aa, Homo Sapiens
VNFDKFLLI

SEQ ID NO: 1016042 - protein, 9 aa, Homo Sapiens
GSYKVAEDE

SEQ ID NO: 1016043 - protein, 9 aa, Homo Sapiens
NLFSFHLAT

SEQ ID NO: 1016044 - protein, 9 aa, Homo Sapiens
SLSAASSYS

SEQ ID NO: 1016045 - protein, 9 aa, Homo Sapiens
RGQTSKTKL

SEQ ID NO: 1016046 - protein, 9 aa, Homo Sapiens
NSRAQFSST

SEQ ID NO: 1016047 - protein, 9 aa, Homo Sapiens
DSFLGGGPE

SEQ ID NO: 1016048 - protein, 9 aa, Homo Sapiens
AFLLFSLGK

SEQ ID NO: 1016049 - protein, 9 aa, Homo Sapiens
VMRHLPFMR

SEQ ID NO: 1016050 - protein, 9 aa, Homo Sapiens
ILITCSETP

SEQ ID NO: 1016051 - protein, 9 aa, Homo Sapiens
QVNRLRAKS

SEQ ID NO: 1016052 - protein, 9 aa, Homo Sapiens
MSSGVKKKF

SEQ ID NO: 1016053 - protein, 9 aa, Homo Sapiens
LKGDLGEKG

SEQ ID NO: 1016054 - protein, 9 aa, Homo Sapiens
QEIEEWLIT

SEQ ID NO: 1016055 - protein, 9 aa, Homo Sapiens
TRMYSLRPG

SEQ ID NO: 1016056 - protein, 9 aa, Homo Sapiens
WSACISQVT

SEQ ID NO: 1016057 - protein, 9 aa, Homo Sapiens
QLRFSLFRD

SEQ ID NO: 1016058 - protein, 9 aa, Homo Sapiens
LADPSDNTK

SEQ ID NO: 1016059 - protein, 9 aa, Homo Sapiens
EKNILCVER

SEQ ID NO: 1016060 - protein, 9 aa, Homo Sapiens
IVYSTYSQK

SEQ ID NO: 1016061 - protein, 9 aa, Homo Sapiens
QSTQIKFPL

SEQ ID NO: 1016062 - protein, 9 aa, Homo Sapiens
LIMDTGENP

SEQ ID NO: 1016063 - protein, 9 aa, Homo Sapiens
VPPTGDSGP

SEQ ID NO: 1016064 - protein, 9 aa, Homo Sapiens
RIKNAIGEA

SEQ ID NO: 1016065 - protein, 9 aa, Homo Sapiens
TVAGLASKE

SEQ ID NO: 1016066 - protein, 9 aa, Homo Sapiens
EPEEPEDLA

SEQ ID NO: 1016067 - protein, 9 aa, Homo Sapiens
ILKQVSISF

SEQ ID NO: 1016068 - protein, 9 aa, Homo Sapiens
RHHCWACGY

SEQ ID NO: 1016069 - protein, 9 aa, Homo Sapiens
KLEVQATDL

SEQ ID NO: 1016070 - protein, 9 aa, Homo Sapiens
TLKAHQSKV

SEQ ID NO: 1016071 - protein, 9 aa, Homo Sapiens
HETCLAPKL

SEQ ID NO: 1016072 - protein, 9 aa, Homo Sapiens
CILSYLEWE

SEQ ID NO: 1016073 - protein, 9 aa, Homo Sapiens
EESSCLICL

SEQ ID NO: 1016074 - protein, 9 aa, Homo Sapiens
RRHHCWACG

SEQ ID NO: 1016075 - protein, 9 aa, Homo Sapiens
KFSEVDYFG

SEQ ID NO: 1016076 - protein, 9 aa, Homo Sapiens
RDPLDLKMF

SEQ ID NO: 1016077 - protein, 9 aa, Homo Sapiens
LDIITVLSD

SEQ ID NO: 1016078 - protein, 9 aa, Homo Sapiens
AQLKNLYLK

SEQ ID NO: 1016079 - protein, 9 aa, Homo Sapiens
IIECFLVPV

SEQ ID NO: 1016080 - protein, 9 aa, Homo Sapiens
KTFATCSSH

SEQ ID NO: 1016081 - protein, 9 aa, Homo Sapiens
SPLLSAASP

SEQ ID NO: 1016082 - protein, 9 aa, Homo Sapiens
DGKKVIPRL

SEQ ID NO: 1016083 - protein, 9 aa, Homo Sapiens
VGFGTYDEQ

SEQ ID NO: 1016084 - protein, 9 aa, Homo Sapiens
QVPIEEQHG

SEQ ID NO: 1016085 - protein, 9 aa, Homo Sapiens
QASYFVEGR

SEQ ID NO: 1016086 - protein, 9 aa, Homo Sapiens
SPDLSPVSA

SEQ ID NO: 1016087 - protein, 9 aa, Homo Sapiens
DPDVGVNFL

SEQ ID NO: 1016088 - protein, 9 aa, Homo Sapiens
EGRRKTFAT

SEQ ID NO: 1016089 - protein, 9 aa, Homo Sapiens
WQETINQIN

SEQ ID NO: 1016090 - protein, 9 aa, Homo Sapiens
KPFIYKGEG

SEQ ID NO: 1016091 - protein, 9 aa, Homo Sapiens
YYYAARSFA

SEQ ID NO: 1016092 - protein, 9 aa, Homo Sapiens
DPSMFPLGV

SEQ ID NO: 1016093 - protein, 9 aa, Homo Sapiens
AGLRGEKAG

SEQ ID NO: 1016094 - protein, 9 aa, Homo Sapiens
DPKKLIGKH

SEQ ID NO: 1016095 - protein, 9 aa, Homo Sapiens
YLWSACISQ

SEQ ID NO: 1016096 - protein, 9 aa, Homo Sapiens
NKRNRIFQD

SEQ ID NO: 1016097 - protein, 9 aa, Homo Sapiens
WVHREHTHP

SEQ ID NO: 1016098 - protein, 9 aa, Homo Sapiens
RSVSVPNTG

SEQ ID NO: 1016099 - protein, 9 aa, Homo Sapiens
LLWFRDRVL

SEQ ID NO: 1016100 - protein, 9 aa, Homo Sapiens
TSKTKLLGC

SEQ ID NO: 1016101 - protein, 9 aa, Homo Sapiens
PECDSWPLD

SEQ ID NO: 1016102 - protein, 9 aa, Homo Sapiens
PAPLSQAPG

SEQ ID NO: 1016103 - protein, 9 aa, Homo Sapiens
VAGLASKEE

SEQ ID NO: 1016104 - protein, 9 aa, Homo Sapiens
FILLAVLLL

SEQ ID NO: 1016105 - protein, 9 aa, Homo Sapiens
AHMERLKEV

SEQ ID NO: 1016106 - protein, 9 aa, Homo Sapiens
ENSRYTDCC

SEQ ID NO: 1016107 - protein, 9 aa, Homo Sapiens
SAGLRGEKA

SEQ ID NO: 1016108 - protein, 9 aa, Homo Sapiens
SFLGGGPEP

SEQ ID NO: 1016109 - protein, 9 aa, Homo Sapiens
RKTMGSQTV

SEQ ID NO: 1016110 - protein, 9 aa, Homo Sapiens
DRGTDDSSK

SEQ ID NO: 1016111 - protein, 9 aa, Homo Sapiens
DGDSYNEMN

SEQ ID NO: 1016112 - protein, 9 aa, Homo Sapiens
SRINKTFIY

SEQ ID NO: 1016113 - protein, 9 aa, Homo Sapiens
RFDLVVHQR

SEQ ID NO: 1016114 - protein, 9 aa, Homo Sapiens
PGGPAAKKG

SEQ ID NO: 1016115 - protein, 9 aa, Homo Sapiens
GLPASQGRG

SEQ ID NO: 1016116 - protein, 9 aa, Homo Sapiens
GFTNYPKLQ

SEQ ID NO: 1016117 - protein, 9 aa, Homo Sapiens
VGGHITEVS

SEQ ID NO: 1016118 - protein, 9 aa, Homo Sapiens
HEDIFDCSK

SEQ ID NO: 1016119 - protein, 9 aa, Homo Sapiens
TEVKVRVMS

SEQ ID NO: 1016120 - protein, 9 aa, Homo Sapiens
LWFRDRVLL

SEQ ID NO: 1016121 - protein, 9 aa, Homo Sapiens
FGLHLFKGT

SEQ ID NO: 1016122 - protein, 9 aa, Homo Sapiens
FRGNKIHFS

SEQ ID NO: 1016123 - protein, 9 aa, Homo Sapiens
LEENKQIAL

SEQ ID NO: 1016124 - protein, 9 aa, Homo Sapiens
VFLNSQPSH

SEQ ID NO: 1016125 - protein, 9 aa, Homo Sapiens
VVNFQIISA

SEQ ID NO: 1016126 - protein, 9 aa, Homo Sapiens
QNMDLLEKI

SEQ ID NO: 1016127 - protein, 9 aa, Homo Sapiens
SGPPPVPPT

SEQ ID NO: 1016128 - protein, 9 aa, Homo Sapiens
CGKLFSQIY

SEQ ID NO: 1016129 - protein, 9 aa, Homo Sapiens
LNYPGQISA

SEQ ID NO: 1016130 - protein, 9 aa, Homo Sapiens
KQPLAKDVA

SEQ ID NO: 1016131 - protein, 9 aa, Homo Sapiens
ETCYRTVLG

SEQ ID NO: 1016132 - protein, 9 aa, Homo Sapiens
LASQVAASQ

SEQ ID NO: 1016133 - protein, 9 aa, Homo Sapiens
VHREHTHPA

SEQ ID NO: 1016134 - protein, 9 aa, Homo Sapiens
AGTEPPRRH

SEQ ID NO: 1016135 - protein, 9 aa, Homo Sapiens
SRGNYSNYA

SEQ ID NO: 1016136 - protein, 9 aa, Homo Sapiens
GVKPLQKQP

SEQ ID NO: 1016137 - protein, 9 aa, Homo Sapiens
RLRAKSRDV

SEQ ID NO: 1016138 - protein, 9 aa, Homo Sapiens
IDAAATAAA

SEQ ID NO: 1016139 - protein, 9 aa, Homo Sapiens
VAEVFPKLA

SEQ ID NO: 1016140 - protein, 9 aa, Homo Sapiens
SHRGPSESR

SEQ ID NO: 1016141 - protein, 9 aa, Homo Sapiens
PHNGRDDRE

SEQ ID NO: 1016142 - protein, 9 aa, Homo Sapiens
NVLEKDFLK

SEQ ID NO: 1016143 - protein, 9 aa, Homo Sapiens
NYYSIVTGL

SEQ ID NO: 1016144 - protein, 9 aa, Homo Sapiens
YFEGCLACL

SEQ ID NO: 1016145 - protein, 9 aa, Homo Sapiens
KKVIPRLTH

SEQ ID NO: 1016146 - protein, 9 aa, Homo Sapiens
VANLFVAGT

SEQ ID NO: 1016147 - protein, 9 aa, Homo Sapiens
LVRTGFYNK

SEQ ID NO: 1016148 - protein, 9 aa, Homo Sapiens
MPGETLASQ

SEQ ID NO: 1016149 - protein, 9 aa, Homo Sapiens
FEADLDENE

SEQ ID NO: 1016150 - protein, 9 aa, Homo Sapiens
VDRRKDSHS

SEQ ID NO: 1016151 - protein, 9 aa, Homo Sapiens
LGLPHTKLE

SEQ ID NO: 1016152 - protein, 9 aa, Homo Sapiens
VIAIVDSLT

SEQ ID NO: 1016153 - protein, 9 aa, Homo Sapiens
EAALQETRG

SEQ ID NO: 1016154 - protein, 9 aa, Homo Sapiens
PGPVFVDNF

SEQ ID NO: 1016155 - protein, 9 aa, Homo Sapiens
LKEKQLCNV

SEQ ID NO: 1016156 - protein, 9 aa, Homo Sapiens
KSFYLNNST

SEQ ID NO: 1016157 - protein, 9 aa, Homo Sapiens
HFLPAYLNS

SEQ ID NO: 1016158 - protein, 9 aa, Homo Sapiens
RGRPGFAKR

SEQ ID NO: 1016159 - protein, 9 aa, Homo Sapiens
SKAHMERLK

SEQ ID NO: 1016160 - protein, 9 aa, Homo Sapiens
SSTSGGSGY

SEQ ID NO: 1016161 - protein, 9 aa, Homo Sapiens
MDLLEKIQV

SEQ ID NO: 1016162 - protein, 9 aa, Homo Sapiens
LPHTKLEDE

SEQ ID NO: 1016163 - protein, 9 aa, Homo Sapiens
TFALLGFTN

SEQ ID NO: 1016164 - protein, 9 aa, Homo Sapiens
EDRFMLLLS

SEQ ID NO: 1016165 - protein, 9 aa, Homo Sapiens
HNMILGLPA

SEQ ID NO: 1016166 - protein, 9 aa, Homo Sapiens
TARKLAGPG

SEQ ID NO: 1016167 - protein, 9 aa, Homo Sapiens
RALCQETIL

SEQ ID NO: 1016168 - protein, 9 aa, Homo Sapiens
CSSGEFGSR

SEQ ID NO: 1016169 - protein, 9 aa, Homo Sapiens
HLLDKLCCD

SEQ ID NO: 1016170 - protein, 9 aa, Homo Sapiens
KSWVQVVCE

SEQ ID NO: 1016171 - protein, 9 aa, Homo Sapiens
PGTPTVDLE

SEQ ID NO: 1016172 - protein, 9 aa, Homo Sapiens
PAQNPPMEK

SEQ ID NO: 1016173 - protein, 9 aa, Homo Sapiens
QGPRKTMGS

SEQ ID NO: 1016174 - protein, 9 aa, Homo Sapiens
KAFRNRLSL

SEQ ID NO: 1016175 - protein, 9 aa, Homo Sapiens
GGGGLSCTA

SEQ ID NO: 1016176 - protein, 9 aa, Homo Sapiens
HLFKGTQTP

SEQ ID NO: 1016177 - protein, 9 aa, Homo Sapiens
NRDKEFYSH

SEQ ID NO: 1016178 - protein, 9 aa, Homo Sapiens
MWVASEAWA

SEQ ID NO: 1016179 - protein, 9 aa, Homo Sapiens
LPGPVFVDN

SEQ ID NO: 1016180 - protein, 9 aa, Homo Sapiens
AVATLAKKA

SEQ ID NO: 1016181 - protein, 9 aa, Homo Sapiens
DSLTREAQK

SEQ ID NO: 1016182 - protein, 9 aa, Homo Sapiens
GQKGDNGRQ

SEQ ID NO: 1016183 - protein, 9 aa, Homo Sapiens
TEKSRWSGS

SEQ ID NO: 1016184 - protein, 9 aa, Homo Sapiens
GVGLPASQG

SEQ ID NO: 1016185 - protein, 9 aa, Homo Sapiens
RLMKSWVQV

SEQ ID NO: 1016186 - protein, 9 aa, Homo Sapiens
IEEWLITLK

SEQ ID NO: 1016187 - protein, 9 aa, Homo Sapiens
NVPQVIKLA

SEQ ID NO: 1016188 - protein, 9 aa, Homo Sapiens
ATQKNKIQA

SEQ ID NO: 1016189 - protein, 9 aa, Homo Sapiens
VVLPEKLQE

SEQ ID NO: 1016190 - protein, 9 aa, Homo Sapiens
VAANQSRAC

SEQ ID NO: 1016191 - protein, 9 aa, Homo Sapiens
VNFQIISAY

SEQ ID NO: 1016192 - protein, 9 aa, Homo Sapiens
KFGHEFDLY

SEQ ID NO: 1016193 - protein, 9 aa, Homo Sapiens
KMSLTTEQR

SEQ ID NO: 1016194 - protein, 9 aa, Homo Sapiens
VVKAEKSPL

SEQ ID NO: 1016195 - protein, 9 aa, Homo Sapiens
ALRLGLVVT

SEQ ID NO: 1016196 - protein, 9 aa, Homo Sapiens
EFVLGDNQD

SEQ ID NO: 1016197 - protein, 9 aa, Homo Sapiens
VDNFYYDYN

SEQ ID NO: 1016198 - protein, 9 aa, Homo Sapiens
FYLLGDAVP

SEQ ID NO: 1016199 - protein, 9 aa, Homo Sapiens
TRSVSVPNT

SEQ ID NO: 1016200 - protein, 9 aa, Homo Sapiens
KQLKVMFIG

SEQ ID NO: 1016201 - protein, 9 aa, Homo Sapiens
YFTEKPPEL

SEQ ID NO: 1016202 - protein, 9 aa, Homo Sapiens
QCSLHGNTP

SEQ ID NO: 1016203 - protein, 9 aa, Homo Sapiens
MARFQRTKK

SEQ ID NO: 1016204 - protein, 9 aa, Homo Sapiens
NFNKVVFVF

SEQ ID NO: 1016205 - protein, 9 aa, Homo Sapiens
SQGPRKTMG

SEQ ID NO: 1016206 - protein, 9 aa, Homo Sapiens
VIHGKQKQN

SEQ ID NO: 1016207 - protein, 9 aa, Homo Sapiens
ILSCKIADF

SEQ ID NO: 1016208 - protein, 9 aa, Homo Sapiens
PAKAETARK

SEQ ID NO: 1016209 - protein, 9 aa, Homo Sapiens
MEKNVFWEC

SEQ ID NO: 1016210 - protein, 9 aa, Homo Sapiens
ADGRLSRPH

SEQ ID NO: 1016211 - protein, 9 aa, Homo Sapiens
FFQGCMGQL

SEQ ID NO: 1016212 - protein, 9 aa, Homo Sapiens
TSPDLSPVS

SEQ ID NO: 1016213 - protein, 9 aa, Homo Sapiens
VLSDNVVMV

SEQ ID NO: 1016214 - protein, 9 aa, Homo Sapiens
YEDALRLGL

SEQ ID NO: 1016215 - protein, 9 aa, Homo Sapiens
ANGVKPLQK

SEQ ID NO: 1016216 - protein, 9 aa, Homo Sapiens
PKKLIGKHK

SEQ ID NO: 1016217 - protein, 9 aa, Homo Sapiens
KSFLTCHRR

SEQ ID NO: 1016218 - protein, 9 aa, Homo Sapiens
ASHGSVFYF

SEQ ID NO: 1016219 - protein, 9 aa, Homo Sapiens
NAETTVAFE

SEQ ID NO: 1016220 - protein, 9 aa, Homo Sapiens
SSNFFYESE

SEQ ID NO: 1016221 - protein, 9 aa, Homo Sapiens
NPPMEKALS

SEQ ID NO: 1016222 - protein, 9 aa, Homo Sapiens
LWEVLPGNR

SEQ ID NO: 1016223 - protein, 9 aa, Homo Sapiens
NNITNNLRL

SEQ ID NO: 1016224 - protein, 9 aa, Homo Sapiens
KIQASESPP

SEQ ID NO: 1016225 - protein, 9 aa, Homo Sapiens
FFYESELPQ

SEQ ID NO: 1016226 - protein, 9 aa, Homo Sapiens
HIAQEIYSA

SEQ ID NO: 1016227 - protein, 9 aa, Homo Sapiens
AFNKIAQVL

SEQ ID NO: 1016228 - protein, 9 aa, Homo Sapiens
NMDLLEKIQ

SEQ ID NO: 1016229 - protein, 9 aa, Homo Sapiens
TSPDFLYIC

SEQ ID NO: 1016230 - protein, 9 aa, Homo Sapiens
PPSKSAVLR

SEQ ID NO: 1016231 - protein, 9 aa, Homo Sapiens
VGSLFYIAL

SEQ ID NO: 1016232 - protein, 9 aa, Homo Sapiens
PEYIVVKAE

SEQ ID NO: 1016233 - protein, 9 aa, Homo Sapiens
IQGQKGDNG

SEQ ID NO: 1016234 - protein, 9 aa, Homo Sapiens
VFPKLAASP

SEQ ID NO: 1016235 - protein, 9 aa, Homo Sapiens
QRPSPAFSE

SEQ ID NO: 1016236 - protein, 9 aa, Homo Sapiens
EKNVFWECK

SEQ ID NO: 1016237 - protein, 9 aa, Homo Sapiens
KEIQKPEEK

SEQ ID NO: 1016238 - protein, 9 aa, Homo Sapiens
QFAIDAAAT

SEQ ID NO: 1016239 - protein, 9 aa, Homo Sapiens
DVVMRHLPF

SEQ ID NO: 1016240 - protein, 9 aa, Homo Sapiens
PRKPPAQQP

SEQ ID NO: 1016241 - protein, 9 aa, Homo Sapiens
QGQKGDNGR

SEQ ID NO: 1016242 - protein, 9 aa, Homo Sapiens
EDMQWVHRE

SEQ ID NO: 1016243 - protein, 9 aa, Homo Sapiens
HNEFFWPYE

SEQ ID NO: 1016244 - protein, 9 aa, Homo Sapiens
SALNPHWEE

SEQ ID NO: 1016245 - protein, 9 aa, Homo Sapiens
CKPSGDFTD

SEQ ID NO: 1016246 - protein, 9 aa, Homo Sapiens
FSDVLCLGL

SEQ ID NO: 1016247 - protein, 9 aa, Homo Sapiens
NTGSIWELQ

SEQ ID NO: 1016248 - protein, 9 aa, Homo Sapiens
AEFLIAVIP

SEQ ID NO: 1016249 - protein, 9 aa, Homo Sapiens
LELVRTGAY

SEQ ID NO: 1016250 - protein, 9 aa, Homo Sapiens
KPSASAPIL

SEQ ID NO: 1016251 - protein, 9 aa, Homo Sapiens
DKDSGDWVL

SEQ ID NO: 1016252 - protein, 9 aa, Homo Sapiens
LEKIQVAHT

SEQ ID NO: 1016253 - protein, 9 aa, Homo Sapiens
MAEFLIAVI

SEQ ID NO: 1016254 - protein, 9 aa, Homo Sapiens
LFLTSDKLG

SEQ ID NO: 1016255 - protein, 9 aa, Homo Sapiens
LDVNFDKFL

SEQ ID NO: 1016256 - protein, 9 aa, Homo Sapiens
YLFSLNEIV

SEQ ID NO: 1016257 - protein, 9 aa, Homo Sapiens
AFNCSSALM

SEQ ID NO: 1016258 - protein, 9 aa, Homo Sapiens
LPSYLSFGS

SEQ ID NO: 1016259 - protein, 9 aa, Homo Sapiens
ESSCLICLE

SEQ ID NO: 1016260 - protein, 9 aa, Homo Sapiens
QDVLPNVAF

SEQ ID NO: 1016261 - protein, 9 aa, Homo Sapiens
VPGGPAAKK

SEQ ID NO: 1016262 - protein, 9 aa, Homo Sapiens
KREEDRCSL

SEQ ID NO: 1016263 - protein, 9 aa, Homo Sapiens
TLLRDPSMF

SEQ ID NO: 1016264 - protein, 9 aa, Homo Sapiens
SVVLPEKLQ

SEQ ID NO: 1016265 - protein, 9 aa, Homo Sapiens
PTPPLHRFS

SEQ ID NO: 1016266 - protein, 9 aa, Homo Sapiens
KFGSYLGVN

SEQ ID NO: 1016267 - protein, 9 aa, Homo Sapiens
KTEDKDKPF

SEQ ID NO: 1016268 - protein, 9 aa, Homo Sapiens
IKIMGSAKR

SEQ ID NO: 1016269 - protein, 9 aa, Homo Sapiens
VAMEKNVFW

SEQ ID NO: 1016270 - protein, 9 aa, Homo Sapiens
NLQEESSCL

SEQ ID NO: 1016271 - protein, 9 aa, Homo Sapiens
NFRGNKIHF

SEQ ID NO: 1016272 - protein, 9 aa, Homo Sapiens
NCSSALMQH

SEQ ID NO: 1016273 - protein, 9 aa, Homo Sapiens
EKNEAIASF

SEQ ID NO: 1016274 - protein, 9 aa, Homo Sapiens
HVPWQGGGQ

SEQ ID NO: 1016275 - protein, 9 aa, Homo Sapiens
SGSLGVTID

SEQ ID NO: 1016276 - protein, 9 aa, Homo Sapiens
ETSLTEKLF

SEQ ID NO: 1016277 - protein, 9 aa, Homo Sapiens
WENSRYTDC

SEQ ID NO: 1016278 - protein, 9 aa, Homo Sapiens
DIENNESSS

SEQ ID NO: 1016279 - protein, 9 aa, Homo Sapiens
CDKRALCQE

SEQ ID NO: 1016280 - protein, 9 aa, Homo Sapiens
PTVLRRGYF

SEQ ID NO: 1016281 - protein, 9 aa, Homo Sapiens
LSCEYKMKN

SEQ ID NO: 1016282 - protein, 9 aa, Homo Sapiens
KDFLKEKEQ

SEQ ID NO: 1016283 - protein, 9 aa, Homo Sapiens
DGTIQRDPL

SEQ ID NO: 1016284 - protein, 9 aa, Homo Sapiens
SSSQQKRMS

SEQ ID NO: 1016285 - protein, 9 aa, Homo Sapiens
KEKRRQRKE

SEQ ID NO: 1016286 - protein, 9 aa, Homo Sapiens
DVQVDRRKD

SEQ ID NO: 1016287 - protein, 9 aa, Homo Sapiens
IPSSHPVFL

SEQ ID NO: 1016288 - protein, 9 aa, Homo Sapiens
EVARQQLKF

SEQ ID NO: 1016289 - protein, 9 aa, Homo Sapiens
QTLKAHQSK

SEQ ID NO: 1016290 - protein, 9 aa, Homo Sapiens
SNRCHQETL

SEQ ID NO: 1016291 - protein, 9 aa, Homo Sapiens
KTMGSQTVT

SEQ ID NO: 1016292 - protein, 9 aa, Homo Sapiens
PQYPQQILI

SEQ ID NO: 1016293 - protein, 9 aa, Homo Sapiens
GGLSCTAGT

SEQ ID NO: 1016294 - protein, 9 aa, Homo Sapiens
RLKEVNKEI

SEQ ID NO: 1016295 - protein, 9 aa, Homo Sapiens
NMILGLPAK

SEQ ID NO: 1016296 - protein, 9 aa, Homo Sapiens
ALKIEIHPT

SEQ ID NO: 1016297 - protein, 9 aa, Homo Sapiens
NPNKPQIER

SEQ ID NO: 1016298 - protein, 9 aa, Homo Sapiens
GQGLHVFNL

SEQ ID NO: 1016299 - protein, 9 aa, Homo Sapiens
GVRLLFKAM

SEQ ID NO: 1016300 - protein, 9 aa, Homo Sapiens
FRDRVLLDG

SEQ ID NO: 1016301 - protein, 9 aa, Homo Sapiens
QFSSTEQRA

SEQ ID NO: 1016302 - protein, 9 aa, Homo Sapiens
ENQSWYLTE

SEQ ID NO: 1016303 - protein, 9 aa, Homo Sapiens
PRRHRTPHG

SEQ ID NO: 1016304 - protein, 9 aa, Homo Sapiens
GEYWCVAES

SEQ ID NO: 1016305 - protein, 9 aa, Homo Sapiens
NMASSSQQK

SEQ ID NO: 1016306 - protein, 9 aa, Homo Sapiens
GLSSPPQSP

SEQ ID NO: 1016307 - protein, 9 aa, Homo Sapiens
RLLFKAMTE

SEQ ID NO: 1016308 - protein, 9 aa, Homo Sapiens
MIQVSYRAV

SEQ ID NO: 1016309 - protein, 9 aa, Homo Sapiens
FPVGGHITE

SEQ ID NO: 1016310 - protein, 9 aa, Homo Sapiens
EGLLTKPTE

SEQ ID NO: 1016311 - protein, 9 aa, Homo Sapiens
HNGRDDREV

SEQ ID NO: 1016312 - protein, 9 aa, Homo Sapiens
QSYFEGCLA

SEQ ID NO: 1016313 - protein, 9 aa, Homo Sapiens
AQQDCSPSW

SEQ ID NO: 1016314 - protein, 9 aa, Homo Sapiens
FPNYYSIVT

SEQ ID NO: 1016315 - protein, 9 aa, Homo Sapiens
PSASSSMAG

SEQ ID NO: 1016316 - protein, 9 aa, Homo Sapiens
AFEIKETND

SEQ ID NO: 1016317 - protein, 9 aa, Homo Sapiens
ENTTPSGTG

SEQ ID NO: 1016318 - protein, 9 aa, Homo Sapiens
NYSNYAGNP

SEQ ID NO: 1016319 - protein, 9 aa, Homo Sapiens
NKHRVRFRG

SEQ ID NO: 1016320 - protein, 9 aa, Homo Sapiens
PVGAPISDS

SEQ ID NO: 1016321 - protein, 9 aa, Homo Sapiens
LRNLCRRVP

SEQ ID NO: 1016322 - protein, 9 aa, Homo Sapiens
FDVPEGSYK

SEQ ID NO: 1016323 - protein, 9 aa, Homo Sapiens
VLPEKLQEI

SEQ ID NO: 1016324 - protein, 9 aa, Homo Sapiens
IDWATQKNK

SEQ ID NO: 1016325 - protein, 9 aa, Homo Sapiens
ERKPEPKKE

SEQ ID NO: 1016326 - protein, 9 aa, Homo Sapiens
ANLFVAGTE

SEQ ID NO: 1016327 - protein, 9 aa, Homo Sapiens
GNTPHASNL

SEQ ID NO: 1016328 - protein, 9 aa, Homo Sapiens
QTSKTKLLG

SEQ ID NO: 1016329 - protein, 9 aa, Homo Sapiens
RNPEKNEAI

SEQ ID NO: 1016330 - protein, 9 aa, Homo Sapiens
PVGGHITEV

SEQ ID NO: 1016331 - protein, 9 aa, Homo Sapiens
FLKKMSLTT

SEQ ID NO: 1016332 - protein, 9 aa, Homo Sapiens
EWVKKNKLV

SEQ ID NO: 1016333 - protein, 9 aa, Homo Sapiens
MEGLLTKPT

SEQ ID NO: 1016334 - protein, 9 aa, Homo Sapiens
LHCAGKTKR

SEQ ID NO: 1016335 - protein, 9 aa, Homo Sapiens
LSQAPGPPT

SEQ ID NO: 1016336 - protein, 9 aa, Homo Sapiens
GENTVQSLT

SEQ ID NO: 1016337 - protein, 9 aa, Homo Sapiens
PPILYFFYL

SEQ ID NO: 1016338 - protein, 9 aa, Homo Sapiens
LKQEEYSQS

SEQ ID NO: 1016339 - protein, 9 aa, Homo Sapiens
SSQQKRMSP

SEQ ID NO: 1016340 - protein, 9 aa, Homo Sapiens
AMEKNVFWE

SEQ ID NO: 1016341 - protein, 9 aa, Homo Sapiens
RYTDCCLCV

SEQ ID NO: 1016342 - protein, 9 aa, Homo Sapiens
TCDKRALCQ

SEQ ID NO: 1016343 - protein, 9 aa, Homo Sapiens
TVLSDNVVM

SEQ ID NO: 1016344 - protein, 9 aa, Homo Sapiens
HVGFILLAV

SEQ ID NO: 1016345 - protein, 9 aa, Homo Sapiens
RSLEKARKA

SEQ ID NO: 1016346 - protein, 9 aa, Homo Sapiens
PQKEWVKKN

SEQ ID NO: 1016347 - protein, 9 aa, Homo Sapiens
TVDLETSGT

SEQ ID NO: 1016348 - protein, 9 aa, Homo Sapiens
EPNEQSEDQ

SEQ ID NO: 1016349 - protein, 9 aa, Homo Sapiens
KKFGHEFDL

SEQ ID NO: 1016350 - protein, 9 aa, Homo Sapiens
AKAETARKL

SEQ ID NO: 1016351 - protein, 9 aa, Homo Sapiens
ILSYLEWEQ

SEQ ID NO: 1016352 - protein, 9 aa, Homo Sapiens
KVQALSREN

SEQ ID NO: 1016353 - protein, 9 aa, Homo Sapiens
MSVLDQDRE

SEQ ID NO: 1016354 - protein, 9 aa, Homo Sapiens
LSDNVVMVH

SEQ ID NO: 1016355 - protein, 9 aa, Homo Sapiens
LQEESSCLI

SEQ ID NO: 1016356 - protein, 9 aa, Homo Sapiens
ETLASQVAA

SEQ ID NO: 1016357 - protein, 9 aa, Homo Sapiens
GPDGSPYPD

SEQ ID NO: 1016358 - protein, 9 aa, Homo Sapiens
LANAGLGTW

SEQ ID NO: 1016359 - protein, 9 aa, Homo Sapiens
ALLGFTNYP

SEQ ID NO: 1016360 - protein, 9 aa, Homo Sapiens
KSPSAPIST

SEQ ID NO: 1016361 - protein, 9 aa, Homo Sapiens
SQVAASQLT

SEQ ID NO: 1016362 - protein, 9 aa, Homo Sapiens
WYDPEGYHF

SEQ ID NO: 1016363 - protein, 9 aa, Homo Sapiens
PILKDDSTV

SEQ ID NO: 1016364 - protein, 9 aa, Homo Sapiens
KKLIGKHKD

SEQ ID NO: 1016365 - protein, 9 aa, Homo Sapiens
EQSEDQPEV

SEQ ID NO: 1016366 - protein, 9 aa, Homo Sapiens
SPAFSECAS

SEQ ID NO: 1016367 - protein, 9 aa, Homo Sapiens
ACISQVTRL

SEQ ID NO: 1016368 - protein, 9 aa, Homo Sapiens
KVEDMQWVH

SEQ ID NO: 1016369 - protein, 9 aa, Homo Sapiens
FDENQSWYL

SEQ ID NO: 1016370 - protein, 9 aa, Homo Sapiens
CLPHLLDKL

SEQ ID NO: 1016371 - protein, 9 aa, Homo Sapiens
AEAQKGELG

SEQ ID NO: 1016372 - protein, 9 aa, Homo Sapiens
QKAFIGIED

SEQ ID NO: 1016373 - protein, 9 aa, Homo Sapiens
PTVDLETSG

SEQ ID NO: 1016374 - protein, 9 aa, Homo Sapiens
FEIKETNDT

SEQ ID NO: 1016375 - protein, 9 aa, Homo Sapiens
LMKSWVQVV

SEQ ID NO: 1016376 - protein, 9 aa, Homo Sapiens
KIPSSHPVF

SEQ ID NO: 1016377 - protein, 9 aa, Homo Sapiens
ASSNFFYES

SEQ ID NO: 1016378 - protein, 9 aa, Homo Sapiens
ETGEGRGEG

SEQ ID NO: 1016379 - protein, 9 aa, Homo Sapiens
SVVMDRWLW

SEQ ID NO: 1016380 - protein, 9 aa, Homo Sapiens
CAKAFRNRL

SEQ ID NO: 1016381 - protein, 9 aa, Homo Sapiens
LIIHGIHLE

SEQ ID NO: 1016382 - protein, 9 aa, Homo Sapiens
SYKVAEDEF

SEQ ID NO: 1016383 - protein, 9 aa, Homo Sapiens
DIIECFLVP

SEQ ID NO: 1016384 - protein, 9 aa, Homo Sapiens
LQNSDKDSG

SEQ ID NO: 1016385 - protein, 9 aa, Homo Sapiens
LWSACISQV

SEQ ID NO: 1016386 - protein, 9 aa, Homo Sapiens
TGKMWVASE

SEQ ID NO: 1016387 - protein, 9 aa, Homo Sapiens
NLHNMILGL

SEQ ID NO: 1016388 - protein, 9 aa, Homo Sapiens
VPPGPSLSG

SEQ ID NO: 1016389 - protein, 9 aa, Homo Sapiens
EKLQEIILT

SEQ ID NO: 1016390 - protein, 9 aa, Homo Sapiens
VVLADAVFS

SEQ ID NO: 1016391 - protein, 9 aa, Homo Sapiens
YKMKNVTRM

SEQ ID NO: 1016392 - protein, 9 aa, Homo Sapiens
ETLKEDKEV

SEQ ID NO: 1016393 - protein, 9 aa, Homo Sapiens
DFIIFEAAL

SEQ ID NO: 1016394 - protein, 9 aa, Homo Sapiens
IHGIHLETL

SEQ ID NO: 1016395 - protein, 9 aa, Homo Sapiens
LFSDGKKVI

SEQ ID NO: 1016396 - protein, 9 aa, Homo Sapiens
VFNLPKQDL

SEQ ID NO: 1016397 - protein, 9 aa, Homo Sapiens
TEDKDKPFI

SEQ ID NO: 1016398 - protein, 9 aa, Homo Sapiens
YKPLKKHVD

SEQ ID NO: 1016399 - protein, 9 aa, Homo Sapiens
EEDVVNSWF

SEQ ID NO: 1016400 - protein, 9 aa, Homo Sapiens
TEKPPELPA

SEQ ID NO: 1016401 - protein, 9 aa, Homo Sapiens
NTDQDGRGD

SEQ ID NO: 1016402 - protein, 9 aa, Homo Sapiens
AGLSSPPQS

SEQ ID NO: 1016403 - protein, 9 aa, Homo Sapiens
CRGASRWDY

SEQ ID NO: 1016404 - protein, 9 aa, Homo Sapiens
QRFDLVVHQ

SEQ ID NO: 1016405 - protein, 9 aa, Homo Sapiens
NFDDYEEKE

SEQ ID NO: 1016406 - protein, 9 aa, Homo Sapiens
YYSIVTGLY

SEQ ID NO: 1016407 - protein, 9 aa, Homo Sapiens
RIRKHSSEG

SEQ ID NO: 1016408 - protein, 9 aa, Homo Sapiens
PLQLLKGAP

SEQ ID NO: 1016409 - protein, 9 aa, Homo Sapiens
DTTPSGENT

SEQ ID NO: 1016410 - protein, 9 aa, Homo Sapiens
PPGPSLSGG

SEQ ID NO: 1016411 - protein, 9 aa, Homo Sapiens
LATEKSRWS

SEQ ID NO: 1016412 - protein, 9 aa, Homo Sapiens
RFSLFRDSQ

SEQ ID NO: 1016413 - protein, 9 aa, Homo Sapiens
LCRIRKHSS

SEQ ID NO: 1016414 - protein, 9 aa, Homo Sapiens
FSSTSGGSG

SEQ ID NO: 1016415 - protein, 9 aa, Homo Sapiens
PEPEEPEDL

SEQ ID NO: 1016416 - protein, 9 aa, Homo Sapiens
NHVQIMKEM

SEQ ID NO: 1016417 - protein, 9 aa, Homo Sapiens
FGSWYSPSQ

SEQ ID NO: 1016418 - protein, 9 aa, Homo Sapiens
LKPGDWVIL

SEQ ID NO: 1016419 - protein, 9 aa, Homo Sapiens
KKSASYSSG

SEQ ID NO: 1016420 - protein, 9 aa, Homo Sapiens
GEGRGEGRG

SEQ ID NO: 1016421 - protein, 9 aa, Homo Sapiens
RSFALERPF

SEQ ID NO: 1016422 - protein, 9 aa, Homo Sapiens
ENLIVEGRE

SEQ ID NO: 1016423 - protein, 9 aa, Homo Sapiens
DVLPNVAFN

SEQ ID NO: 1016424 - protein, 9 aa, Homo Sapiens
VFYLLGDAV

SEQ ID NO: 1016425 - protein, 9 aa, Homo Sapiens
AYTAAARQH

SEQ ID NO: 1016426 - protein, 9 aa, Homo Sapiens
SRHHSPSKR

SEQ ID NO: 1016427 - protein, 9 aa, Homo Sapiens
TPSGENTTP

SEQ ID NO: 1016428 - protein, 9 aa, Homo Sapiens
NNESSSTKP

SEQ ID NO: 1016429 - protein, 9 aa, Homo Sapiens
AQKAFIGIE

SEQ ID NO: 1016430 - protein, 9 aa, Homo Sapiens
EYSQSLLKQ

SEQ ID NO: 1016431 - protein, 9 aa, Homo Sapiens
PLVKLLCAK

SEQ ID NO: 1016432 - protein, 9 aa, Homo Sapiens
AMLLSFSDV

SEQ ID NO: 1016433 - protein, 9 aa, Homo Sapiens
NEQSEDQPE

SEQ ID NO: 1016434 - protein, 9 aa, Homo Sapiens
AYALLEEFT

SEQ ID NO: 1016435 - protein, 9 aa, Homo Sapiens
EMQCHLRAN

SEQ ID NO: 1016436 - protein, 9 aa, Homo Sapiens
EKSRWSGSH

SEQ ID NO: 1016437 - protein, 9 aa, Homo Sapiens
LDQDREGAG

SEQ ID NO: 1016438 - protein, 9 aa, Homo Sapiens
DKPFIYKGE

SEQ ID NO: 1016439 - protein, 9 aa, Homo Sapiens
SQGILKQVS

SEQ ID NO: 1016440 - protein, 9 aa, Homo Sapiens
QVVCENQPL

SEQ ID NO: 1016441 - protein, 9 aa, Homo Sapiens
KLQEIILTF

SEQ ID NO: 1016442 - protein, 9 aa, Homo Sapiens
NETSLTEKL

SEQ ID NO: 1016443 - protein, 9 aa, Homo Sapiens
FFIGLMFMM

SEQ ID NO: 1016444 - protein, 9 aa, Homo Sapiens
GGFPIIANM

SEQ ID NO: 1016445 - protein, 9 aa, Homo Sapiens
SSLRCHCRL

SEQ ID NO: 1016446 - protein, 9 aa, Homo Sapiens
WQGGGQLDL

SEQ ID NO: 1016447 - protein, 9 aa, Homo Sapiens
LPQYPQQIL

SEQ ID NO: 1016448 - protein, 9 aa, Homo Sapiens
SFIKYGEFL

SEQ ID NO: 1016449 - protein, 9 aa, Homo Sapiens
LLSKVERLT

SEQ ID NO: 1016450 - protein, 9 aa, Homo Sapiens
KANILIMDT

SEQ ID NO: 1016451 - protein, 9 aa, Homo Sapiens
SYSRKVPMA

SEQ ID NO: 1016452 - protein, 9 aa, Homo Sapiens
YSQKSAKEV

SEQ ID NO: 1016453 - protein, 9 aa, Homo Sapiens
QRDPLDLKM

SEQ ID NO: 1016454 - protein, 9 aa, Homo Sapiens
LHVPWQGGG

SEQ ID NO: 1016455 - protein, 9 aa, Homo Sapiens
NYPKLQIPL

SEQ ID NO: 1016456 - protein, 9 aa, Homo Sapiens
APDGSYFAG

SEQ ID NO: 1016457 - protein, 9 aa, Homo Sapiens
TIDTTPSGE

SEQ ID NO: 1016458 - protein, 9 aa, Homo Sapiens
KIVYSTYSQ

SEQ ID NO: 1016459 - protein, 9 aa, Homo Sapiens
SKPSYSRKV

SEQ ID NO: 1016460 - protein, 9 aa, Homo Sapiens
GSLLHVPWQ

SEQ ID NO: 1016461 - protein, 9 aa, Homo Sapiens
QCRVYFRLW

SEQ ID NO: 1016462 - protein, 9 aa, Homo Sapiens
PIQQPTPRK

SEQ ID NO: 1016463 - protein, 9 aa, Homo Sapiens
NYIDLPVLV

SEQ ID NO: 1016464 - protein, 9 aa, Homo Sapiens
SSMAGARKR

SEQ ID NO: 1016465 - protein, 9 aa, Homo Sapiens
GLKGDLGEK

SEQ ID NO: 1016466 - protein, 9 aa, Homo Sapiens
ESQYGQRAT

SEQ ID NO: 1016467 - protein, 9 aa, Homo Sapiens
WEKEERILA

SEQ ID NO: 1016468 - protein, 9 aa, Homo Sapiens
MLGMEETQV

SEQ ID NO: 1016469 - protein, 9 aa, Homo Sapiens
GIHLETLSE

SEQ ID NO: 1016470 - protein, 9 aa, Homo Sapiens
KLMHQKQLK

SEQ ID NO: 1016471 - protein, 9 aa, Homo Sapiens
NQLDNFFCN

SEQ ID NO: 1016472 - protein, 9 aa, Homo Sapiens
EYWCVAESQ

SEQ ID NO: 1016473 - protein, 9 aa, Homo Sapiens
KLLFSDGKK

SEQ ID NO: 1016474 - protein, 9 aa, Homo Sapiens
KDIENNESS

SEQ ID NO: 1016475 - protein, 9 aa, Homo Sapiens
QVGDGERLV

SEQ ID NO: 1016476 - protein, 9 aa, Homo Sapiens
IECFLVPVS

SEQ ID NO: 1016477 - protein, 9 aa, Homo Sapiens
FNVIAIVDS

SEQ ID NO: 1016478 - protein, 9 aa, Homo Sapiens
SSHPVFLNS

SEQ ID NO: 1016479 - protein, 9 aa, Homo Sapiens
INRDKTDYL

SEQ ID NO: 1016480 - protein, 9 aa, Homo Sapiens
QMTFGEKIK

SEQ ID NO: 1016481 - protein, 9 aa, Homo Sapiens
LMELLWEKE

SEQ ID NO: 1016482 - protein, 9 aa, Homo Sapiens
WVQVVCENQ

SEQ ID NO: 1016483 - protein, 9 aa, Homo Sapiens
LQAAENAVK

SEQ ID NO: 1016484 - protein, 9 aa, Homo Sapiens
QEETGEGRG

SEQ ID NO: 1016485 - protein, 9 aa, Homo Sapiens
KVAVATLAK

SEQ ID NO: 1016486 - protein, 9 aa, Homo Sapiens
DMQWVHREH

SEQ ID NO: 1016487 - protein, 9 aa, Homo Sapiens
VTSSKDIEN

SEQ ID NO: 1016488 - protein, 9 aa, Homo Sapiens
VQVDRRKDS

SEQ ID NO: 1016489 - protein, 9 aa, Homo Sapiens
EEEVSAAGL

SEQ ID NO: 1016490 - protein, 9 aa, Homo Sapiens
RRLSPPSLS

SEQ ID NO: 1016491 - protein, 9 aa, Homo Sapiens
RQRKEEECS

SEQ ID NO: 1016492 - protein, 9 aa, Homo Sapiens
AAPKPPISI

SEQ ID NO: 1016493 - protein, 9 aa, Homo Sapiens
KGQILQGDR

SEQ ID NO: 1016494 - protein, 9 aa, Homo Sapiens
IYSAESRDH

SEQ ID NO: 1016495 - protein, 9 aa, Homo Sapiens
GTPTVDLET

SEQ ID NO: 1016496 - protein, 9 aa, Homo Sapiens
HPKTLFLLW

SEQ ID NO: 1016497 - protein, 9 aa, Homo Sapiens
EFLIAVIPF

SEQ ID NO: 1016498 - protein, 9 aa, Homo Sapiens
RLSLIEHQR

SEQ ID NO: 1016499 - protein, 9 aa, Homo Sapiens
TLKEDKEVN

SEQ ID NO: 1016500 - protein, 9 aa, Homo Sapiens
RLSPPSLSA

SEQ ID NO: 1016501 - protein, 9 aa, Homo Sapiens
YHFLPAYLN

SEQ ID NO: 1016502 - protein, 9 aa, Homo Sapiens
FTGILAMVD

SEQ ID NO: 1016503 - protein, 9 aa, Homo Sapiens
MRHLPFMRY

SEQ ID NO: 1016504 - protein, 9 aa, Homo Sapiens
SYRAVSGPG

SEQ ID NO: 1016505 - protein, 9 aa, Homo Sapiens
SRKLLCKPS

SEQ ID NO: 1016506 - protein, 9 aa, Homo Sapiens
MMPDRTLGL

SEQ ID NO: 1016507 - protein, 9 aa, Homo Sapiens
IQVSYRAVS

SEQ ID NO: 1016508 - protein, 9 aa, Homo Sapiens
EKIFQCNKY

SEQ ID NO: 1016509 - protein, 9 aa, Homo Sapiens
GNLGDYYHF

SEQ ID NO: 1016510 - protein, 9 aa, Homo Sapiens
LLQDFTGIL

SEQ ID NO: 1016511 - protein, 9 aa, Homo Sapiens
NRKRKSFSS

SEQ ID NO: 1016512 - protein, 9 aa, Homo Sapiens
VSFLASHFR

SEQ ID NO: 1016513 - protein, 9 aa, Homo Sapiens
PPISIQSKP

SEQ ID NO: 1016514 - protein, 9 aa, Homo Sapiens
LLSSVTSRT

SEQ ID NO: 1016515 - protein, 9 aa, Homo Sapiens
IENNESSST

SEQ ID NO: 1016516 - protein, 9 aa, Homo Sapiens
SMPAYALLE

SEQ ID NO: 1016517 - protein, 9 aa, Homo Sapiens
GSQGHRTVK

SEQ ID NO: 1016518 - protein, 9 aa, Homo Sapiens
SAEGRRKTF

SEQ ID NO: 1016519 - protein, 9 aa, Homo Sapiens
GNLFSFHLA

SEQ ID NO: 1016520 - protein, 9 aa, Homo Sapiens
CSKDLFSVT

SEQ ID NO: 1016521 - protein, 9 aa, Homo Sapiens
LEFVLGDNQ

SEQ ID NO: 1016522 - protein, 9 aa, Homo Sapiens
SGEFGSRSL

SEQ ID NO: 1016523 - protein, 9 aa, Homo Sapiens
VEFIRNKSF

SEQ ID NO: 1016524 - protein, 9 aa, Homo Sapiens
KEEQRRAFQ

SEQ ID NO: 1016525 - protein, 9 aa, Homo Sapiens
APQSTQIKF

SEQ ID NO: 1016526 - protein, 9 aa, Homo Sapiens
SFGELLAEL

SEQ ID NO: 1016527 - protein, 9 aa, Homo Sapiens
LMGYVAAVR

SEQ ID NO: 1016528 - protein, 9 aa, Homo Sapiens
LWENSRYTD

SEQ ID NO: 1016529 - protein, 9 aa, Homo Sapiens
LSKPSYSRK

SEQ ID NO: 1016530 - protein, 9 aa, Homo Sapiens
NKIHFSIFR

SEQ ID NO: 1016531 - protein, 9 aa, Homo Sapiens
LSAASSYSF

SEQ ID NO: 1016532 - protein, 9 aa, Homo Sapiens
GGPAAKKGQ

SEQ ID NO: 1016533 - protein, 9 aa, Homo Sapiens
RVMLKYLFS

SEQ ID NO: 1016534 - protein, 9 aa, Homo Sapiens
KQTLKAHQS

SEQ ID NO: 1016535 - protein, 9 aa, Homo Sapiens
KVRVMSSTA

SEQ ID NO: 1016536 - protein, 9 aa, Homo Sapiens
AGVGLPASQ

SEQ ID NO: 1016537 - protein, 9 aa, Homo Sapiens
LFLLWGNHE

SEQ ID NO: 1016538 - protein, 9 aa, Homo Sapiens
FAPRWPQSS

SEQ ID NO: 1016539 - protein, 9 aa, Homo Sapiens
MHQKQLKVM

SEQ ID NO: 1016540 - protein, 9 aa, Homo Sapiens
SVMHPEYIV

SEQ ID NO: 1016541 - protein, 9 aa, Homo Sapiens
TGDSGPPPV

SEQ ID NO: 1016542 - protein, 9 aa, Homo Sapiens
YSLRPGPPD

SEQ ID NO: 1016543 - protein, 9 aa, Homo Sapiens
QIERKVSLF

SEQ ID NO: 1016544 - protein, 9 aa, Homo Sapiens
ERFSASTFF

SEQ ID NO: 1016545 - protein, 9 aa, Homo Sapiens
NRQLLAKVQ

SEQ ID NO: 1016546 - protein, 9 aa, Homo Sapiens
QVDRRKDSH

SEQ ID NO: 1016547 - protein, 9 aa, Homo Sapiens
VEDMQWVHR

SEQ ID NO: 1016548 - protein, 9 aa, Homo Sapiens
KDKPFIYKG

SEQ ID NO: 1016549 - protein, 9 aa, Homo Sapiens
NFSKQVFAD

SEQ ID NO: 1016550 - protein, 9 aa, Homo Sapiens
TLFLLWGNH

SEQ ID NO: 1016551 - protein, 9 aa, Homo Sapiens
NMADGDSYN

SEQ ID NO: 1016552 - protein, 9 aa, Homo Sapiens
LKQVSISFC

SEQ ID NO: 1016553 - protein, 9 aa, Homo Sapiens
KDLDIITVL

SEQ ID NO: 1016554 - protein, 9 aa, Homo Sapiens
VSVPNTGSI

SEQ ID NO: 1016555 - protein, 9 aa, Homo Sapiens
GPAAKKGQI

SEQ ID NO: 1016556 - protein, 9 aa, Homo Sapiens
EADLDENED

SEQ ID NO: 1016557 - protein, 9 aa, Homo Sapiens
VFRPLIIHG

SEQ ID NO: 1016558 - protein, 9 aa, Homo Sapiens
RVKKESGSL

SEQ ID NO: 1016559 - protein, 9 aa, Homo Sapiens
PSWSLPIRA

SEQ ID NO: 1016560 - protein, 9 aa, Homo Sapiens
RVLLDGATF

SEQ ID NO: 1016561 - protein, 9 aa, Homo Sapiens
GAGRCSSGE

SEQ ID NO: 1016562 - protein, 9 aa, Homo Sapiens
VAATEVVNI

SEQ ID NO: 1016563 - protein, 9 aa, Homo Sapiens
AVRTPREVL

SEQ ID NO: 1016564 - protein, 9 aa, Homo Sapiens
NQINNKLEG

SEQ ID NO: 1016565 - protein, 9 aa, Homo Sapiens
MILGLPAKM

SEQ ID NO: 1016566 - protein, 9 aa, Homo Sapiens
MKNVTRMVV

SEQ ID NO: 1016567 - protein, 9 aa, Homo Sapiens
PEKLQEIIL

SEQ ID NO: 1016568 - protein, 9 aa, Homo Sapiens
EDKDKPFIY

SEQ ID NO: 1016569 - protein, 9 aa, Homo Sapiens
AALQNSDKD

SEQ ID NO: 1016570 - protein, 9 aa, Homo Sapiens
PEEEEDVVN

SEQ ID NO: 1016571 - protein, 9 aa, Homo Sapiens
KFEEAENSA

SEQ ID NO: 1016572 - protein, 9 aa, Homo Sapiens
GEDNFSKQV

SEQ ID NO: 1016573 - protein, 9 aa, Homo Sapiens
MASSSQQKR

SEQ ID NO: 1016574 - protein, 9 aa, Homo Sapiens
LVAEAQKGE

SEQ ID NO: 1016575 - protein, 9 aa, Homo Sapiens
WSSLWHVGF

SEQ ID NO: 1016576 - protein, 9 aa, Homo Sapiens
PPAPLSQAP

SEQ ID NO: 1016577 - protein, 9 aa, Homo Sapiens
YFQLFTEEC

SEQ ID NO: 1016578 - protein, 9 aa, Homo Sapiens
FLQSYQLSP

SEQ ID NO: 1016579 - protein, 9 aa, Homo Sapiens
NLLFMSVLD

SEQ ID NO: 1016580 - protein, 9 aa, Homo Sapiens
CISQVTRLC

SEQ ID NO: 1016581 - protein, 9 aa, Homo Sapiens
GLMFMMIPL

SEQ ID NO: 1016582 - protein, 9 aa, Homo Sapiens
QGLHVFNLP

SEQ ID NO: 1016583 - protein, 9 aa, Homo Sapiens
PFLADENYR

SEQ ID NO: 1016584 - protein, 9 aa, Homo Sapiens
SSFGLHLFK

SEQ ID NO: 1016585 - protein, 9 aa, Homo Sapiens
DFLYICSWL

SEQ ID NO: 1016586 - protein, 9 aa, Homo Sapiens
RTLGLTPPT

SEQ ID NO: 1016587 - protein, 9 aa, Homo Sapiens
QKEWVKKNK

SEQ ID NO: 1016588 - protein, 9 aa, Homo Sapiens
ETSGTPVSK

SEQ ID NO: 1016589 - protein, 9 aa, Homo Sapiens
EEQHGDYDL

SEQ ID NO: 1016590 - protein, 9 aa, Homo Sapiens
VRTGAYSKP

SEQ ID NO: 1016591 - protein, 9 aa, Homo Sapiens
ERLKEVNKE

SEQ ID NO: 1016592 - protein, 9 aa, Homo Sapiens
IDLPVLVIH

SEQ ID NO: 1016593 - protein, 9 aa, Homo Sapiens
LHELCVARV

SEQ ID NO: 1016594 - protein, 9 aa, Homo Sapiens
DKLGYSYAI

SEQ ID NO: 1016595 - protein, 9 aa, Homo Sapiens
ENEDIFIAL

SEQ ID NO: 1016596 - protein, 9 aa, Homo Sapiens
YLPSYLSFG

SEQ ID NO: 1016597 - protein, 9 aa, Homo Sapiens
HITEVSAID

SEQ ID NO: 1016598 - protein, 9 aa, Homo Sapiens
NLVGTVANL

SEQ ID NO: 1016599 - protein, 9 aa, Homo Sapiens
ISGSLGVTI

SEQ ID NO: 1016600 - protein, 9 aa, Homo Sapiens
LGGFPIIAN

SEQ ID NO: 1016601 - protein, 9 aa, Homo Sapiens
NVRIVFSNV

SEQ ID NO: 1016602 - protein, 9 aa, Homo Sapiens
PPSFPPIQG

SEQ ID NO: 1016603 - protein, 9 aa, Homo Sapiens
EGRGEGRGR

SEQ ID NO: 1016604 - protein, 9 aa, Homo Sapiens
SLCSELQRH

SEQ ID NO: 1016605 - protein, 9 aa, Homo Sapiens
SAASPETAK

SEQ ID NO: 1016606 - protein, 9 aa, Homo Sapiens
HTKLEDEDE

SEQ ID NO: 1016607 - protein, 9 aa, Homo Sapiens
MKSWVQVVC

SEQ ID NO: 1016608 - protein, 9 aa, Homo Sapiens
LPFMRYTPV

SEQ ID NO: 1016609 - protein, 9 aa, Homo Sapiens
GTFVFYLLG

SEQ ID NO: 1016610 - protein, 9 aa, Homo Sapiens
VPWQGGGQL

SEQ ID NO: 1016611 - protein, 9 aa, Homo Sapiens
ALPIDTEVY

SEQ ID NO: 1016612 - protein, 9 aa, Homo Sapiens
GRCSSGEFG

SEQ ID NO: 1016613 - protein, 9 aa, Homo Sapiens
RGPSESRHH

SEQ ID NO: 1016614 - protein, 9 aa, Homo Sapiens
VLNNITNNL

SEQ ID NO: 1016615 - protein, 9 aa, Homo Sapiens
SSKDIENNE

SEQ ID NO: 1016616 - protein, 9 aa, Homo Sapiens
KYLFSLNEI

SEQ ID NO: 1016617 - protein, 9 aa, Homo Sapiens
SFSSLKQRL

SEQ ID NO: 1016618 - protein, 9 aa, Homo Sapiens
HCLPHLLDK

SEQ ID NO: 1016619 - protein, 9 aa, Homo Sapiens
NPHWEENTV

SEQ ID NO: 1016620 - protein, 9 aa, Homo Sapiens
ENHATPGSA

SEQ ID NO: 1016621 - protein, 9 aa, Homo Sapiens
DTNHFADPV

SEQ ID NO: 1016622 - protein, 9 aa, Homo Sapiens
GDSGPPPVP

SEQ ID NO: 1016623 - protein, 9 aa, Homo Sapiens
PNLLGMEGL

SEQ ID NO: 1016624 - protein, 9 aa, Homo Sapiens
RKPEPKKEV

SEQ ID NO: 1016625 - protein, 9 aa, Homo Sapiens
SFALERPFG

SEQ ID NO: 1016626 - protein, 9 aa, Homo Sapiens
GWKEMQCHL

SEQ ID NO: 1016627 - protein, 9 aa, Homo Sapiens
FEAALQETR

SEQ ID NO: 1016628 - protein, 9 aa, Homo Sapiens
LFSFHLATL

SEQ ID NO: 1016629 - protein, 9 aa, Homo Sapiens
GILAMVDFA

SEQ ID NO: 1016630 - protein, 9 aa, Homo Sapiens
PHNSRAQFS

SEQ ID NO: 1016631 - protein, 9 aa, Homo Sapiens
KDAVSTELT

SEQ ID NO: 1016632 - protein, 9 aa, Homo Sapiens
ETARKLAGP

SEQ ID NO: 1016633 - protein, 9 aa, Homo Sapiens
MHPEYIVVK

SEQ ID NO: 1016634 - protein, 9 aa, Homo Sapiens
NNEKNILCV

SEQ ID NO: 1016635 - protein, 9 aa, Homo Sapiens
SKLESLCSE

SEQ ID NO: 1016636 - protein, 9 aa, Homo Sapiens
GLATEKSRW

SEQ ID NO: 1016637 - protein, 9 aa, Homo Sapiens
DCSKDLFSV

SEQ ID NO: 1016638 - protein, 9 aa, Homo Sapiens
QNNEKNILC

SEQ ID NO: 1016639 - protein, 9 aa, Homo Sapiens
GQIGNLGDY

SEQ ID NO: 1016640 - protein, 9 aa, Homo Sapiens
TFATCSSHI

SEQ ID NO: 1016641 - protein, 9 aa, Homo Sapiens
LLKGAPFIF

SEQ ID NO: 1016642 - protein, 9 aa, Homo Sapiens
YLKKPKDEA

SEQ ID NO: 1016643 - protein, 9 aa, Homo Sapiens
RACRGASRW

SEQ ID NO: 1016644 - protein, 9 aa, Homo Sapiens
LEWEQKCFI

SEQ ID NO: 1016645 - protein, 9 aa, Homo Sapiens
RDKEFYSHL

SEQ ID NO: 1016646 - protein, 9 aa, Homo Sapiens
PLIIHGIHL

SEQ ID NO: 1016647 - protein, 9 aa, Homo Sapiens
NLYLKKPKD

SEQ ID NO: 1016648 - protein, 9 aa, Homo Sapiens
RTPREVLLH

SEQ ID NO: 1016649 - protein, 9 aa, Homo Sapiens
ALWINVAAT

SEQ ID NO: 1016650 - protein, 9 aa, Homo Sapiens
RKHSSEGKS

SEQ ID NO: 1016651 - protein, 9 aa, Homo Sapiens
KAHQSKVSS

SEQ ID NO: 1016652 - protein, 9 aa, Homo Sapiens
LSSPPQSPQ

SEQ ID NO: 1016653 - protein, 9 aa, Homo Sapiens
GEKAGATKG

SEQ ID NO: 1016654 - protein, 9 aa, Homo Sapiens
GYFQLFTEE

SEQ ID NO: 1016655 - protein, 9 aa, Homo Sapiens
EASLESTKV

SEQ ID NO: 1016656 - protein, 9 aa, Homo Sapiens
YSTYSQKSA

SEQ ID NO: 1016657 - protein, 9 aa, Homo Sapiens
LVRTGAYSK

SEQ ID NO: 1016658 - protein, 9 aa, Homo Sapiens
PDLSPVSAA

SEQ ID NO: 1016659 - protein, 9 aa, Homo Sapiens
FSSTEQRAV

SEQ ID NO: 1016660 - protein, 9 aa, Homo Sapiens
GTEPPRRHR

SEQ ID NO: 1016661 - protein, 9 aa, Homo Sapiens
QGGGQLDLL

SEQ ID NO: 1016662 - protein, 9 aa, Homo Sapiens
LSKVERLTQ

SEQ ID NO: 1016663 - protein, 9 aa, Homo Sapiens
LDENEDIFI

SEQ ID NO: 1016664 - protein, 9 aa, Homo Sapiens
TVAFEIKET

SEQ ID NO: 1016665 - protein, 9 aa, Homo Sapiens
PECGKLFSQ

SEQ ID NO: 1016666 - protein, 9 aa, Homo Sapiens
TPELPEKKD

SEQ ID NO: 1016667 - protein, 9 aa, Homo Sapiens
MYFTEKPPE

SEQ ID NO: 1016668 - protein, 9 aa, Homo Sapiens
LPEKKDKTD

SEQ ID NO: 1016669 - protein, 9 aa, Homo Sapiens
TSDKLGYSY

SEQ ID NO: 1016670 - protein, 9 aa, Homo Sapiens
NQSWYLTEN

SEQ ID NO: 1016671 - protein, 9 aa, Homo Sapiens
FIRNKSFYL

SEQ ID NO: 1016672 - protein, 9 aa, Homo Sapiens
FSFPPDPLL

SEQ ID NO: 1016673 - protein, 9 aa, Homo Sapiens
YRFYNPQKG

SEQ ID NO: 1016674 - protein, 9 aa, Homo Sapiens
EELFLTSDK

SEQ ID NO: 1016675 - protein, 9 aa, Homo Sapiens
MKEMEASYK

SEQ ID NO: 1016676 - protein, 9 aa, Homo Sapiens
CLSSKPEDN

SEQ ID NO: 1016677 - protein, 9 aa, Homo Sapiens
TADDPSLSF

SEQ ID NO: 1016678 - protein, 9 aa, Homo Sapiens
FDDYEEKEL

SEQ ID NO: 1016679 - protein, 9 aa, Homo Sapiens
LSPPSLSAA

SEQ ID NO: 1016680 - protein, 9 aa, Homo Sapiens
QIISAYKHM

SEQ ID NO: 1016681 - protein, 9 aa, Homo Sapiens
VKKNKLVNG

SEQ ID NO: 1016682 - protein, 9 aa, Homo Sapiens
AAARQHTVV

SEQ ID NO: 1016683 - protein, 9 aa, Homo Sapiens
PSLSAASSY

SEQ ID NO: 1016684 - protein, 9 aa, Homo Sapiens
PTVFSFPPD

SEQ ID NO: 1016685 - protein, 9 aa, Homo Sapiens
EQEIEEWLI

SEQ ID NO: 1016686 - protein, 9 aa, Homo Sapiens
ERAMRQFAI

SEQ ID NO: 1016687 - protein, 9 aa, Homo Sapiens
EYKMKNVTR

SEQ ID NO: 1016688 - protein, 9 aa, Homo Sapiens
GVAAPLRRA

SEQ ID NO: 1016689 - protein, 9 aa, Homo Sapiens
GSPYPDPSA

SEQ ID NO: 1016690 - protein, 9 aa, Homo Sapiens
QKQPLAKDV

SEQ ID NO: 1016691 - protein, 9 aa, Homo Sapiens
KPEDNAEPW

SEQ ID NO: 1016692 - protein, 9 aa, Homo Sapiens
YAARSFALE

SEQ ID NO: 1016693 - protein, 9 aa, Homo Sapiens
RQHTVVLEG

SEQ ID NO: 1016694 - protein, 9 aa, Homo Sapiens
KFLLILFAE

SEQ ID NO: 1016695 - protein, 9 aa, Homo Sapiens
GGQSYFEGC

SEQ ID NO: 1016696 - protein, 9 aa, Homo Sapiens
TFPNYYSIV

SEQ ID NO: 1016697 - protein, 9 aa, Homo Sapiens
NAQKAFIGI

SEQ ID NO: 1016698 - protein, 9 aa, Homo Sapiens
GGGPEPEEP

SEQ ID NO: 1016699 - protein, 9 aa, Homo Sapiens
NKKFGSYLG

SEQ ID NO: 1016700 - protein, 9 aa, Homo Sapiens
TFNKISTLL

SEQ ID NO: 1016701 - protein, 9 aa, Homo Sapiens
PTPRKPPAQ

SEQ ID NO: 1016702 - protein, 9 aa, Homo Sapiens
LLFMSVLDQ

SEQ ID NO: 1016703 - protein, 9 aa, Homo Sapiens
VKRNEGTLL

SEQ ID NO: 1016704 - protein, 9 aa, Homo Sapiens
NLGQIGNLG

SEQ ID NO: 1016705 - protein, 9 aa, Homo Sapiens
EGSYKVAED

SEQ ID NO: 1016706 - protein, 9 aa, Homo Sapiens
PDIQASYFV

SEQ ID NO: 1016707 - protein, 9 aa, Homo Sapiens
DPEGYHFLP

SEQ ID NO: 1016708 - protein, 9 aa, Homo Sapiens
LAPKLYNGN

SEQ ID NO: 1016709 - protein, 9 aa, Homo Sapiens
EAQKGELGA

SEQ ID NO: 1016710 - protein, 9 aa, Homo Sapiens
IITVLSDNV

SEQ ID NO: 1016711 - protein, 9 aa, Homo Sapiens
RKANILIMD

SEQ ID NO: 1016712 - protein, 9 aa, Homo Sapiens
KPPELPANS

SEQ ID NO: 1016713 - protein, 9 aa, Homo Sapiens
APISDSLNL

SEQ ID NO: 1016714 - protein, 9 aa, Homo Sapiens
EKEIQKPEE

SEQ ID NO: 1016715 - protein, 9 aa, Homo Sapiens
LFKGTQTPL

SEQ ID NO: 1016716 - protein, 9 aa, Homo Sapiens
DVIMVFQFS

SEQ ID NO: 1016717 - protein, 9 aa, Homo Sapiens
SKEEQRRAF

SEQ ID NO: 1016718 - protein, 9 aa, Homo Sapiens
VARVSEVLQ

SEQ ID NO: 1016719 - protein, 9 aa, Homo Sapiens
NFFYESELP

SEQ ID NO: 1016720 - protein, 9 aa, Homo Sapiens
LFNRKRKSF

SEQ ID NO: 1016721 - protein, 9 aa, Homo Sapiens
NDDQKNTDQ

SEQ ID NO: 1016722 - protein, 9 aa, Homo Sapiens
KLGGQSYFE

SEQ ID NO: 1016723 - protein, 9 aa, Homo Sapiens
TNVRIVFSN

SEQ ID NO: 1016724 - protein, 9 aa, Homo Sapiens
LSRKLLCKP

SEQ ID NO: 1016725 - protein, 9 aa, Homo Sapiens
EKIKNTISY

SEQ ID NO: 1016726 - protein, 9 aa, Homo Sapiens
SFPIDGYIM

SEQ ID NO: 1016727 - protein, 9 aa, Homo Sapiens
VGDGERLVP

SEQ ID NO: 1016728 - protein, 9 aa, Homo Sapiens
SSLWHVGFI

SEQ ID NO: 1016729 - protein, 9 aa, Homo Sapiens
DNFYYDYNF

SEQ ID NO: 1016730 - protein, 9 aa, Homo Sapiens
LSYLEWEQK

SEQ ID NO: 1016731 - protein, 9 aa, Homo Sapiens
LASKEEQRR

SEQ ID NO: 1016732 - protein, 9 aa, Homo Sapiens
LHVFNLPKQ

SEQ ID NO: 1016733 - protein, 9 aa, Homo Sapiens
GVLDEATEL

SEQ ID NO: 1016734 - protein, 9 aa, Homo Sapiens
VDLVLPKDT

SEQ ID NO: 1016735 - protein, 9 aa, Homo Sapiens
PGNGSGKQE

SEQ ID NO: 1016736 - protein, 9 aa, Homo Sapiens
VAVQGENTV

SEQ ID NO: 1016737 - protein, 9 aa, Homo Sapiens
LFLFFFWGV

SEQ ID NO: 1016738 - protein, 9 aa, Homo Sapiens
APVGAPISD

SEQ ID NO: 1016739 - protein, 9 aa, Homo Sapiens
ELTGAVKLA

SEQ ID NO: 1016740 - protein, 9 aa, Homo Sapiens
CNVLLIAGH

SEQ ID NO: 1016741 - protein, 9 aa, Homo Sapiens
NKTCEIVNY

SEQ ID NO: 1016742 - protein, 9 aa, Homo Sapiens
NFFCNVPQV

SEQ ID NO: 1016743 - protein, 9 aa, Homo Sapiens
RKRKSFSSL

SEQ ID NO: 1016744 - protein, 9 aa, Homo Sapiens
HPTSLTKTE

SEQ ID NO: 1016745 - protein, 9 aa, Homo Sapiens
CVARVSEVL

SEQ ID NO: 1016746 - protein, 9 aa, Homo Sapiens
LFPSASSNF

SEQ ID NO: 1016747 - protein, 9 aa, Homo Sapiens
SALMQHKRI

SEQ ID NO: 1016748 - protein, 9 aa, Homo Sapiens
EDIFDCSKD

SEQ ID NO: 1016749 - protein, 9 aa, Homo Sapiens
KKGQILQGD

SEQ ID NO: 1016750 - protein, 9 aa, Homo Sapiens
LQQQQQTQV

SEQ ID NO: 1016751 - protein, 9 aa, Homo Sapiens
NGNLFSFHL

SEQ ID NO: 1016752 - protein, 9 aa, Homo Sapiens
KRNRIFQDS

SEQ ID NO: 1016753 - protein, 9 aa, Homo Sapiens
FYSHLTSHE

SEQ ID NO: 1016754 - protein, 9 aa, Homo Sapiens
HVLMGYVAA

SEQ ID NO: 1016755 - protein, 9 aa, Homo Sapiens
HRGPSESRH

SEQ ID NO: 1016756 - protein, 9 aa, Homo Sapiens
HTDITPSMA

SEQ ID NO: 1016757 - protein, 9 aa, Homo Sapiens
LCVERGWST

SEQ ID NO: 1016758 - protein, 9 aa, Homo Sapiens
RFYNPQKGI

SEQ ID NO: 1016759 - protein, 9 aa, Homo Sapiens
AEGRRKTFA

SEQ ID NO: 1016760 - protein, 9 aa, Homo Sapiens
GMEGLLTKP

SEQ ID NO: 1016761 - protein, 9 aa, Homo Sapiens
LLAKVQALS

SEQ ID NO: 1016762 - protein, 9 aa, Homo Sapiens
CIWMAEFLI

SEQ ID NO: 1016763 - protein, 9 aa, Homo Sapiens
SVKRNEGTL

SEQ ID NO: 1016764 - protein, 9 aa, Homo Sapiens
KLYNGNYST

SEQ ID NO: 1016765 - protein, 9 aa, Homo Sapiens
RSKLESLCS

SEQ ID NO: 1016766 - protein, 9 aa, Homo Sapiens
IGKKIGEKE

SEQ ID NO: 1016767 - protein, 9 aa, Homo Sapiens
YDPEGYHFL

SEQ ID NO: 1016768 - protein, 9 aa, Homo Sapiens
FYIALPHCS

SEQ ID NO: 1016769 - protein, 9 aa, Homo Sapiens
HRVDLVLPK

SEQ ID NO: 1016770 - protein, 9 aa, Homo Sapiens
RGSPPILYF

SEQ ID NO: 1016771 - protein, 9 aa, Homo Sapiens
LDSEYKESG

SEQ ID NO: 1016772 - protein, 9 aa, Homo Sapiens
SQAPGPPTP

SEQ ID NO: 1016773 - protein, 9 aa, Homo Sapiens
FEGCLACLT

SEQ ID NO: 1016774 - protein, 9 aa, Homo Sapiens
PQIERKVSL

SEQ ID NO: 1016775 - protein, 9 aa, Homo Sapiens
SPQRPSPAF

SEQ ID NO: 1016776 - protein, 9 aa, Homo Sapiens
AHMVLNKKF

SEQ ID NO: 1016777 - protein, 9 aa, Homo Sapiens
NHFADPVDV

SEQ ID NO: 1016778 - protein, 9 aa, Homo Sapiens
IVDYSETSS

SEQ ID NO: 1016779 - protein, 9 aa, Homo Sapiens
SRACRGASR

SEQ ID NO: 1016780 - protein, 9 aa, Homo Sapiens
ETCLAPKLY

SEQ ID NO: 1016781 - protein, 9 aa, Homo Sapiens
KLFNRKRKS

SEQ ID NO: 1016782 - protein, 9 aa, Homo Sapiens
QLKFEEAEN

SEQ ID NO: 1016783 - protein, 9 aa, Homo Sapiens
HSFPIDGYI

SEQ ID NO: 1016784 - protein, 9 aa, Homo Sapiens
RKTFATCSS

SEQ ID NO: 1016785 - protein, 9 aa, Homo Sapiens
SPSWSLPIR

SEQ ID NO: 1016786 - protein, 9 aa, Homo Sapiens
FQRTKKREE

SEQ ID NO: 1016787 - protein, 9 aa, Homo Sapiens
SVSVPNTGS

SEQ ID NO: 1016788 - protein, 9 aa, Homo Sapiens
LNYEVPKYH

SEQ ID NO: 1016789 - protein, 9 aa, Homo Sapiens
LDFPERFSA

SEQ ID NO: 1016790 - protein, 9 aa, Homo Sapiens
QYYYAARSF

SEQ ID NO: 1016791 - protein, 9 aa, Homo Sapiens
GHITEVSAI

SEQ ID NO: 1016792 - protein, 9 aa, Homo Sapiens
EGFCGETIL

SEQ ID NO: 1016793 - protein, 9 aa, Homo Sapiens
WMAEFLIAV

SEQ ID NO: 1016794 - protein, 9 aa, Homo Sapiens
GLRGEKAGA

SEQ ID NO: 1016795 - protein, 9 aa, Homo Sapiens
HPANISFRQ

SEQ ID NO: 1016796 - protein, 9 aa, Homo Sapiens
DEYKPLKKH

SEQ ID NO: 1016797 - protein, 9 aa, Homo Sapiens
FFWGVSLAG

SEQ ID NO: 1016798 - protein, 9 aa, Homo Sapiens
SQYGQRATA

SEQ ID NO: 1016799 - protein, 9 aa, Homo Sapiens
STKVEAHQL

SEQ ID NO: 1016800 - protein, 9 aa, Homo Sapiens
PRKTMGSQT

SEQ ID NO: 1016801 - protein, 9 aa, Homo Sapiens
TTSQGPRKT

SEQ ID NO: 1016802 - protein, 9 aa, Homo Sapiens
CVYLWSACI

SEQ ID NO: 1016803 - protein, 9 aa, Homo Sapiens
VARQQLKFE

SEQ ID NO: 1016804 - protein, 9 aa, Homo Sapiens
LYICSWLPC

SEQ ID NO: 1016805 - protein, 9 aa, Homo Sapiens
SFHLATLQG

SEQ ID NO: 1016806 - protein, 9 aa, Homo Sapiens
HEAFLLFSL

SEQ ID NO: 1016807 - protein, 9 aa, Homo Sapiens
SEVLEFVLG

SEQ ID NO: 1016808 - protein, 9 aa, Homo Sapiens
QLLKGAPFI

SEQ ID NO: 1016809 - protein, 9 aa, Homo Sapiens
KDSGDWVLL

SEQ ID NO: 1016810 - protein, 9 aa, Homo Sapiens
INKTFIYGL

SEQ ID NO: 1016811 - protein, 9 aa, Homo Sapiens
SFGSWYSPS

SEQ ID NO: 1016812 - protein, 9 aa, Homo Sapiens
LPNLLGMEG

SEQ ID NO: 1016813 - protein, 9 aa, Homo Sapiens
DSGPPPVPP

SEQ ID NO: 1016814 - protein, 9 aa, Homo Sapiens
IGEARKVLE

SEQ ID NO: 1016815 - protein, 9 aa, Homo Sapiens
PKPPISIQS

SEQ ID NO: 1016816 - protein, 9 aa, Homo Sapiens
KAIKFSEVD

SEQ ID NO: 1016817 - protein, 9 aa, Homo Sapiens
LKSPSAPIS

SEQ ID NO: 1016818 - protein, 9 aa, Homo Sapiens
LAMVDFAAM

SEQ ID NO: 1016819 - protein, 9 aa, Homo Sapiens
VILANAGLG

SEQ ID NO: 1016820 - protein, 9 aa, Homo Sapiens
PKKEVVLKS

SEQ ID NO: 1016821 - protein, 9 aa, Homo Sapiens
FDTNHFADP

SEQ ID NO: 1016822 - protein, 9 aa, Homo Sapiens
RFSSWESRI

SEQ ID NO: 1016823 - protein, 9 aa, Homo Sapiens
TDRGTDDSS

SEQ ID NO: 1016824 - protein, 9 aa, Homo Sapiens
NFDKFLLIL

SEQ ID NO: 1016825 - protein, 9 aa, Homo Sapiens
SYFEGCLAC

SEQ ID NO: 1016826 - protein, 9 aa, Homo Sapiens
TDQMTFGEK

SEQ ID NO: 1016827 - protein, 9 aa, Homo Sapiens
QRTKKREED

SEQ ID NO: 1016828 - protein, 9 aa, Homo Sapiens
FPIDGYIME

SEQ ID NO: 1016829 - protein, 9 aa, Homo Sapiens
LLNAQKAFI

SEQ ID NO: 1016830 - protein, 9 aa, Homo Sapiens
VSAAGLSSP

SEQ ID NO: 1016831 - protein, 9 aa, Homo Sapiens
ADIIECFLV

SEQ ID NO: 1016832 - protein, 9 aa, Homo Sapiens
NHATPGSAP

SEQ ID NO: 1016833 - protein, 9 aa, Homo Sapiens
SGGGGLSCT

SEQ ID NO: 1016834 - protein, 9 aa, Homo Sapiens
FNSTAYDPV

SEQ ID NO: 1016835 - protein, 9 aa, Homo Sapiens
CLHVLMGYV

SEQ ID NO: 1016836 - protein, 9 aa, Homo Sapiens
APLSQAPGP

SEQ ID NO: 1016837 - protein, 9 aa, Homo Sapiens
LRAMLLSFS

SEQ ID NO: 1016838 - protein, 9 aa, Homo Sapiens
PSPAFSECA

SEQ ID NO: 1016839 - protein, 9 aa, Homo Sapiens
IFFQGCMGQ

SEQ ID NO: 1016840 - protein, 9 aa, Homo Sapiens
AGRCSSGEF

SEQ ID NO: 1016841 - protein, 9 aa, Homo Sapiens
LEKDFLKEK

SEQ ID NO: 1016842 - protein, 9 aa, Homo Sapiens
SIVEWKPFN

SEQ ID NO: 1016843 - protein, 9 aa, Homo Sapiens
KKMSLTTEQ

SEQ ID NO: 1016844 - protein, 9 aa, Homo Sapiens
SGQRNWVQV

SEQ ID NO: 1016845 - protein, 9 aa, Homo Sapiens
GQPYQPLWE

SEQ ID NO: 1016846 - protein, 9 aa, Homo Sapiens
LLFSDGKKV

SEQ ID NO: 1016847 - protein, 9 aa, Homo Sapiens
YKVAEDEFD

SEQ ID NO: 1016848 - protein, 9 aa, Homo Sapiens
NITNNLRLK

SEQ ID NO: 1016849 - protein, 9 aa, Homo Sapiens
RKPPAQQPG

SEQ ID NO: 1016850 - protein, 9 aa, Homo Sapiens
ARKLAGPGS

SEQ ID NO: 1016851 - protein, 9 aa, Homo Sapiens
ANILVSDIL

SEQ ID NO: 1016852 - protein, 9 aa, Homo Sapiens
EEKELRISI

SEQ ID NO: 1016853 - protein, 9 aa, Homo Sapiens
FLTSDKLGY

SEQ ID NO: 1016854 - protein, 9 aa, Homo Sapiens
SKDIENNES

SEQ ID NO: 1016855 - protein, 9 aa, Homo Sapiens
CDSWPLDMQ

SEQ ID NO: 1016856 - protein, 9 aa, Homo Sapiens
TAQVIILNY

SEQ ID NO: 1016857 - protein, 9 aa, Homo Sapiens
SESRHHSPS

SEQ ID NO: 1016858 - protein, 9 aa, Homo Sapiens
NKPQIERKV

SEQ ID NO: 1016859 - protein, 9 aa, Homo Sapiens
VILCRIRKH

SEQ ID NO: 1016860 - protein, 9 aa, Homo Sapiens
ISFRQPPSF

SEQ ID NO: 1016861 - protein, 9 aa, Homo Sapiens
DYSEDKIYR

SEQ ID NO: 1016862 - protein, 9 aa, Homo Sapiens
NCSTLLATI

SEQ ID NO: 1016863 - protein, 9 aa, Homo Sapiens
LGMEGLLTK

SEQ ID NO: 1016864 - protein, 9 aa, Homo Sapiens
TPRKPPAQQ

SEQ ID NO: 1016865 - protein, 9 aa, Homo Sapiens
SDKLGYSYA

SEQ ID NO: 1016866 - protein, 9 aa, Homo Sapiens
AEDVQVDRR

SEQ ID NO: 1016867 - protein, 9 aa, Homo Sapiens
IVVKAEKSP

SEQ ID NO: 1016868 - protein, 9 aa, Homo Sapiens
ATQRPKAQD

SEQ ID NO: 1016869 - protein, 9 aa, Homo Sapiens
ILNMIQVSY

SEQ ID NO: 1016870 - protein, 9 aa, Homo Sapiens
ESQVNRLRA

SEQ ID NO: 1016871 - protein, 9 aa, Homo Sapiens
ERLVPVPSL

SEQ ID NO: 1016872 - protein, 9 aa, Homo Sapiens
IVEWKPFNI

SEQ ID NO: 1016873 - protein, 9 aa, Homo Sapiens
GFGTYDEQV

SEQ ID NO: 1016874 - protein, 9 aa, Homo Sapiens
DKEFYSHLT

SEQ ID NO: 1016875 - protein, 9 aa, Homo Sapiens
KPLKKHVDA

SEQ ID NO: 1016876 - protein, 9 aa, Homo Sapiens
FLGGGPEPE

SEQ ID NO: 1016877 - protein, 9 aa, Homo Sapiens
DRVLLDGAT

SEQ ID NO: 1016878 - protein, 9 aa, Homo Sapiens
KNDDQKNTD

SEQ ID NO: 1016879 - protein, 9 aa, Homo Sapiens
SEVDYFGNV

SEQ ID NO: 1016880 - protein, 9 aa, Homo Sapiens
TVRCENLIV

SEQ ID NO: 1016881 - protein, 9 aa, Homo Sapiens
HPEYIVVKA

SEQ ID NO: 1016882 - protein, 9 aa, Homo Sapiens
KRRQRKEEE

SEQ ID NO: 1016883 - protein, 9 aa, Homo Sapiens
QSEDQPEVE

SEQ ID NO: 1016884 - protein, 9 aa, Homo Sapiens
AEDRFMLLL

SEQ ID NO: 1016885 - protein, 9 aa, Homo Sapiens
NGQENHATP

SEQ ID NO: 1016886 - protein, 9 aa, Homo Sapiens
SKDSQEDLQ

SEQ ID NO: 1016887 - protein, 9 aa, Homo Sapiens
GELGASLYL

SEQ ID NO: 1016888 - protein, 9 aa, Homo Sapiens
PSGENTTPS

SEQ ID NO: 1016889 - protein, 9 aa, Homo Sapiens
FVDNFYYDY

SEQ ID NO: 1016890 - protein, 9 aa, Homo Sapiens
NSRYTDCCL

SEQ ID NO: 1016891 - protein, 9 aa, Homo Sapiens
PDGSYFAGS

SEQ ID NO: 1016892 - protein, 9 aa, Homo Sapiens
GPRKTMGSQ

SEQ ID NO: 1016893 - protein, 9 aa, Homo Sapiens
EARKVLEHT

SEQ ID NO: 1016894 - protein, 9 aa, Homo Sapiens
RNEGTLLSP

SEQ ID NO: 1016895 - protein, 9 aa, Homo Sapiens
GLHLFKGTQ

SEQ ID NO: 1016896 - protein, 9 aa, Homo Sapiens
IDIHNEFFW

SEQ ID NO: 1016897 - protein, 9 aa, Homo Sapiens
GFAKRYSRS

SEQ ID NO: 1016898 - protein, 9 aa, Homo Sapiens
EEYSQSLLK

SEQ ID NO: 1016899 - protein, 9 aa, Homo Sapiens
LRGEKAGAT

SEQ ID NO: 1016900 - protein, 9 aa, Homo Sapiens
IAESQVNRL

SEQ ID NO: 1016901 - protein, 9 aa, Homo Sapiens
SFPPIQGCM

SEQ ID NO: 1016902 - protein, 9 aa, Homo Sapiens
LFYIALPHC

SEQ ID NO: 1016903 - protein, 9 aa, Homo Sapiens
GPQREALPI

SEQ ID NO: 1016904 - protein, 9 aa, Homo Sapiens
DQKNTDQDG

SEQ ID NO: 1016905 - protein, 9 aa, Homo Sapiens
SAPILITCS

SEQ ID NO: 1016906 - protein, 9 aa, Homo Sapiens
RPGFAKRYS

SEQ ID NO: 1016907 - protein, 9 aa, Homo Sapiens
PGALGLRGL

SEQ ID NO: 1016908 - protein, 9 aa, Homo Sapiens
AFNSTAYDP

SEQ ID NO: 1016909 - protein, 9 aa, Homo Sapiens
WVILANAGL

SEQ ID NO: 1016910 - protein, 9 aa, Homo Sapiens
QEEYSQSLL

SEQ ID NO: 1016911 - protein, 9 aa, Homo Sapiens
GALGLRGLK

SEQ ID NO: 1016912 - protein, 9 aa, Homo Sapiens
RGYFQLFTE

SEQ ID NO: 1016913 - protein, 9 aa, Homo Sapiens
LSSQARHDF

SEQ ID NO: 1016914 - protein, 9 aa, Homo Sapiens
AADIIECFL

SEQ ID NO: 1016915 - protein, 9 aa, Homo Sapiens
ENLVGTVAN

SEQ ID NO: 1016916 - protein, 9 aa, Homo Sapiens
VDYFGNVLQ

SEQ ID NO: 1016917 - protein, 9 aa, Homo Sapiens
FSEVDYFGN

SEQ ID NO: 1016918 - protein, 9 aa, Homo Sapiens
EIEEWLITL

SEQ ID NO: 1016919 - protein, 9 aa, Homo Sapiens
SAFDTNHFA

SEQ ID NO: 1016920 - protein, 9 aa, Homo Sapiens
KQCRVYFRL

SEQ ID NO: 1016921 - protein, 9 aa, Homo Sapiens
FSFHLATLQ

SEQ ID NO: 1016922 - protein, 9 aa, Homo Sapiens
NQSRACRGA

SEQ ID NO: 1016923 - protein, 9 aa, Homo Sapiens
TANKHRVRF

SEQ ID NO: 1016924 - protein, 9 aa, Homo Sapiens
VYEDALRLG

SEQ ID NO: 1016925 - protein, 9 aa, Homo Sapiens
IVIRVLRNL

SEQ ID NO: 1016926 - protein, 9 aa, Homo Sapiens
SLWHVGFIL

SEQ ID NO: 1016927 - protein, 9 aa, Homo Sapiens
KAHMERLKE

SEQ ID NO: 1016928 - protein, 9 aa, Homo Sapiens
LSFIKYGEF

SEQ ID NO: 1016929 - protein, 9 aa, Homo Sapiens
PFNILILLT

SEQ ID NO: 1016930 - protein, 9 aa, Homo Sapiens
FSATKQTLK

SEQ ID NO: 1016931 - protein, 9 aa, Homo Sapiens
PQQILIQIA

SEQ ID NO: 1016932 - protein, 9 aa, Homo Sapiens
KRALCQETI

SEQ ID NO: 1016933 - protein, 9 aa, Homo Sapiens
DKKTIFFQG

SEQ ID NO: 1016934 - protein, 9 aa, Homo Sapiens
GETCYRTVL

SEQ ID NO: 1016935 - protein, 9 aa, Homo Sapiens
RDMLGMEET

SEQ ID NO: 1016936 - protein, 9 aa, Homo Sapiens
LRGLKGDLG

SEQ ID NO: 1016937 - protein, 9 aa, Homo Sapiens
PFPTVFSFP

SEQ ID NO: 1016938 - protein, 9 aa, Homo Sapiens
CGETILSEF

SEQ ID NO: 1016939 - protein, 9 aa, Homo Sapiens
RPKAQDKPY

SEQ ID NO: 1016940 - protein, 9 aa, Homo Sapiens
DERQEETGE

SEQ ID NO: 1016941 - protein, 9 aa, Homo Sapiens
PFLGRIKIM

SEQ ID NO: 1016942 - protein, 9 aa, Homo Sapiens
IRVLRNLCR

SEQ ID NO: 1016943 - protein, 9 aa, Homo Sapiens
LYLKKPKDE

SEQ ID NO: 1016944 - protein, 9 aa, Homo Sapiens
GKLFSQIYS

SEQ ID NO: 1016945 - protein, 9 aa, Homo Sapiens
TIRKLGGFP

SEQ ID NO: 1016946 - protein, 9 aa, Homo Sapiens
QPTPRKPPA

SEQ ID NO: 1016947 - protein, 9 aa, Homo Sapiens
IPRPPSKSA

SEQ ID NO: 1016948 - protein, 9 aa, Homo Sapiens
PQSTQIKFP

SEQ ID NO: 1016949 - protein, 9 aa, Homo Sapiens
QQILIQIAE

SEQ ID NO: 1016950 - protein, 9 aa, Homo Sapiens
EQLHCAGKT

SEQ ID NO: 1016951 - protein, 9 aa, Homo Sapiens
ISAYKHMKL

SEQ ID NO: 1016952 - protein, 9 aa, Homo Sapiens
DFGLATEKS

SEQ ID NO: 1016953 - protein, 9 aa, Homo Sapiens
VAFEADLDE

SEQ ID NO: 1016954 - protein, 9 aa, Homo Sapiens
ANHSFPIDG

SEQ ID NO: 1016955 - protein, 9 aa, Homo Sapiens
IEIHPTSLT

SEQ ID NO: 1016956 - protein, 9 aa, Homo Sapiens
SFYLNNSTL

SEQ ID NO: 1016957 - protein, 9 aa, Homo Sapiens
CEIVNYCSN

SEQ ID NO: 1016958 - protein, 9 aa, Homo Sapiens
LNNITNNLR

SEQ ID NO: 1016959 - protein, 9 aa, Homo Sapiens
AQTGSPLLS

SEQ ID NO: 1016960 - protein, 9 aa, Homo Sapiens
GLPNLLGME

SEQ ID NO: 1016961 - protein, 9 aa, Homo Sapiens
SFLTCHRRL

SEQ ID NO: 1016962 - protein, 9 aa, Homo Sapiens
FSKQVFADD

SEQ ID NO: 1016963 - protein, 9 aa, Homo Sapiens
LHGNTPHAS

SEQ ID NO: 1016964 - protein, 9 aa, Homo Sapiens
AATAATQRP

SEQ ID NO: 1016965 - protein, 9 aa, Homo Sapiens
QGILKQVSI

SEQ ID NO: 1016966 - protein, 9 aa, Homo Sapiens
GYIMEFRVA

SEQ ID NO: 1016967 - protein, 9 aa, Homo Sapiens
MQCHLRANG

SEQ ID NO: 1016968 - protein, 9 aa, Homo Sapiens
PEDNAEPWG

SEQ ID NO: 1016969 - protein, 9 aa, Homo Sapiens
LNPNKPQIE

SEQ ID NO: 1016970 - protein, 9 aa, Homo Sapiens
QRPDVQLRF

SEQ ID NO: 1016971 - protein, 9 aa, Homo Sapiens
GRPISGSLG

SEQ ID NO: 1016972 - protein, 9 aa, Homo Sapiens
EKAGATKGQ

SEQ ID NO: 1016973 - protein, 9 aa, Homo Sapiens
EWEQKCFIC

SEQ ID NO: 1016974 - protein, 9 aa, Homo Sapiens
TWDTPSGKG

SEQ ID NO: 1016975 - protein, 9 aa, Homo Sapiens
RGEKAGATK

SEQ ID NO: 1016976 - protein, 9 aa, Homo Sapiens
NISFRQPPS

SEQ ID NO: 1016977 - protein, 9 aa, Homo Sapiens
KNTDQDGRG

SEQ ID NO: 1016978 - protein, 9 aa, Homo Sapiens
TRRRHHCWA

SEQ ID NO: 1016979 - protein, 9 aa, Homo Sapiens
LAKKAAVTP

SEQ ID NO: 1016980 - protein, 9 aa, Homo Sapiens
GDSYNEMNS

SEQ ID NO: 1016981 - protein, 9 aa, Homo Sapiens
QDAAGVGLP

SEQ ID NO: 1016982 - protein, 9 aa, Homo Sapiens
RLEGVAAPL

SEQ ID NO: 1016983 - protein, 9 aa, Homo Sapiens
PEGSYKVAE

SEQ ID NO: 1016984 - protein, 9 aa, Homo Sapiens
CGASVKRNE

SEQ ID NO: 1016985 - protein, 9 aa, Homo Sapiens
TELTGAVKL

SEQ ID NO: 1016986 - protein, 9 aa, Homo Sapiens
ESLCSELQR

SEQ ID NO: 1016987 - protein, 9 aa, Homo Sapiens
NFLQSYQLS

SEQ ID NO: 1016988 - protein, 9 aa, Homo Sapiens
FFWPYELSS

SEQ ID NO: 1016989 - protein, 9 aa, Homo Sapiens
KEVNKEIDT

SEQ ID NO: 1016990 - protein, 9 aa, Homo Sapiens
PTSRGNYSN

SEQ ID NO: 1016991 - protein, 9 aa, Homo Sapiens
TAATQRPKA

SEQ ID NO: 1016992 - protein, 9 aa, Homo Sapiens
ENTVQSLTQ

SEQ ID NO: 1016993 - protein, 9 aa, Homo Sapiens
FDLVVHQRI

SEQ ID NO: 1016994 - protein, 9 aa, Homo Sapiens
IGIEDPVTK

SEQ ID NO: 1016995 - protein, 9 aa, Homo Sapiens
NSDKDSGDW

SEQ ID NO: 1016996 - protein, 9 aa, Homo Sapiens
PLLSAASPE

SEQ ID NO: 1016997 - protein, 9 aa, Homo Sapiens
KQYYYAARS

SEQ ID NO: 1016998 - protein, 9 aa, Homo Sapiens
RAQFSSTSG

SEQ ID NO: 1016999 - protein, 9 aa, Homo Sapiens
FGEDNFSKQ

SEQ ID NO: 1017000 - protein, 9 aa, Homo Sapiens
YKSSLRCHC

SEQ ID NO: 1017001 - protein, 9 aa, Homo Sapiens
GDSKKGKKN

SEQ ID NO: 1017002 - protein, 9 aa, Homo Sapiens
RMYSLRPGP

SEQ ID NO: 1017003 - protein, 9 aa, Homo Sapiens
LKGAPFIFI

SEQ ID NO: 1017004 - protein, 9 aa, Homo Sapiens
EDKIYRFNS

SEQ ID NO: 1017005 - protein, 9 aa, Homo Sapiens
SSSFALKSP

SEQ ID NO: 1017006 - protein, 9 aa, Homo Sapiens
KQVGDGERL

SEQ ID NO: 1017007 - protein, 9 aa, Homo Sapiens
SFPPDPLLG

SEQ ID NO: 1017008 - protein, 9 aa, Homo Sapiens
RSRPRALLE

SEQ ID NO: 1017009 - protein, 9 aa, Homo Sapiens
NHSFPIDGY

SEQ ID NO: 1017010 - protein, 9 aa, Homo Sapiens
AQEGAGHSS

SEQ ID NO: 1017011 - protein, 9 aa, Homo Sapiens
KDPGVLDEA

SEQ ID NO: 1017012 - protein, 9 aa, Homo Sapiens
SSKPEDNAE

SEQ ID NO: 1017013 - protein, 9 aa, Homo Sapiens
IRKHSSEGK

SEQ ID NO: 1017014 - protein, 9 aa, Homo Sapiens
TTQEKIFQC

SEQ ID NO: 1017015 - protein, 9 aa, Homo Sapiens
PGRTSVGFG

SEQ ID NO: 1017016 - protein, 9 aa, Homo Sapiens
AANILVSDI

SEQ ID NO: 1017017 - protein, 9 aa, Homo Sapiens
ELVRTGAYS

SEQ ID NO: 1017018 - protein, 9 aa, Homo Sapiens
PFIYKGEGK

SEQ ID NO: 1017019 - protein, 9 aa, Homo Sapiens
IAVPRNPEK

SEQ ID NO: 1017020 - protein, 9 aa, Homo Sapiens
TSSKDIENN

SEQ ID NO: 1017021 - protein, 9 aa, Homo Sapiens
AFDTNHFAD

SEQ ID NO: 1017022 - protein, 9 aa, Homo Sapiens
SDGKKVIPR

SEQ ID NO: 1017023 - protein, 9 aa, Homo Sapiens
LFFLATFNK

SEQ ID NO: 1017024 - protein, 9 aa, Homo Sapiens
SYLSFGSWY

SEQ ID NO: 1017025 - protein, 9 aa, Homo Sapiens
IRKANILIM

SEQ ID NO: 1017026 - protein, 9 aa, Homo Sapiens
STPLNGSNS

SEQ ID NO: 1017027 - protein, 9 aa, Homo Sapiens
HTVAGLASK

SEQ ID NO: 1017028 - protein, 9 aa, Homo Sapiens
DSSSFALKS

SEQ ID NO: 1017029 - protein, 9 aa, Homo Sapiens
QKNTDQDGR

SEQ ID NO: 1017030 - protein, 9 aa, Homo Sapiens
DIKNLKVGS

SEQ ID NO: 1017031 - protein, 9 aa, Homo Sapiens
QNPPMEKAL

SEQ ID NO: 1017032 - protein, 9 aa, Homo Sapiens
LRFSLFRDS

SEQ ID NO: 1017033 - protein, 9 aa, Homo Sapiens
VKVRVMSST

SEQ ID NO: 1017034 - protein, 9 aa, Homo Sapiens
KPQIERKVS

SEQ ID NO: 1017035 - protein, 9 aa, Homo Sapiens
ASRALPAQN

SEQ ID NO: 1017036 - protein, 9 aa, Homo Sapiens
FSLNEIVVD

SEQ ID NO: 1017037 - protein, 9 aa, Homo Sapiens
AQVIILNYP

SEQ ID NO: 1017038 - protein, 9 aa, Homo Sapiens
SQARHDFDR

SEQ ID NO: 1017039 - protein, 9 aa, Homo Sapiens
LLWGNHECR

SEQ ID NO: 1017040 - protein, 9 aa, Homo Sapiens
NLKVGSVEE

SEQ ID NO: 1017041 - protein, 9 aa, Homo Sapiens
GPEPEEPED

SEQ ID NO: 1017042 - protein, 9 aa, Homo Sapiens
QLDNFFCNV

SEQ ID NO: 1017043 - protein, 9 aa, Homo Sapiens
DRTLGLTPP

SEQ ID NO: 1017044 - protein, 9 aa, Homo Sapiens
LRDPSMFPL

SEQ ID NO: 1017045 - protein, 9 aa, Homo Sapiens
CWACGYVVC

SEQ ID NO: 1017046 - protein, 9 aa, Homo Sapiens
LKNLYLKKP

SEQ ID NO: 1017047 - protein, 9 aa, Homo Sapiens
IHLSKPSYS

SEQ ID NO: 1017048 - protein, 9 aa, Homo Sapiens
GQENHATPG

SEQ ID NO: 1017049 - protein, 9 aa, Homo Sapiens
TSRTTMTMQ

SEQ ID NO: 1017050 - protein, 9 aa, Homo Sapiens
AVQGENTVQ

SEQ ID NO: 1017051 - protein, 9 aa, Homo Sapiens
QLKNLYLKK

SEQ ID NO: 1017052 - protein, 9 aa, Homo Sapiens
EVETCDKRA

SEQ ID NO: 1017053 - protein, 9 aa, Homo Sapiens
GNKIHFSIF

SEQ ID NO: 1017054 - protein, 9 aa, Homo Sapiens
TQRPKAQDK

SEQ ID NO: 1017055 - protein, 9 aa, Homo Sapiens
LWAVPPGPS

SEQ ID NO: 1017056 - protein, 9 aa, Homo Sapiens
ALQCSLHGN

SEQ ID NO: 1017057 - protein, 9 aa, Homo Sapiens
PAYALLEEF

SEQ ID NO: 1017058 - protein, 9 aa, Homo Sapiens
LKFEEAENS

SEQ ID NO: 1017059 - protein, 9 aa, Homo Sapiens
QILIQIAEL

SEQ ID NO: 1017060 - protein, 9 aa, Homo Sapiens
PSFPPIQGC

SEQ ID NO: 1017061 - protein, 9 aa, Homo Sapiens
GERLVPVPS

SEQ ID NO: 1017062 - protein, 9 aa, Homo Sapiens
INFNKVVFV

SEQ ID NO: 1017063 - protein, 9 aa, Homo Sapiens
VGAPISDSL

SEQ ID NO: 1017064 - protein, 9 aa, Homo Sapiens
KARDMLGME

SEQ ID NO: 1017065 - protein, 9 aa, Homo Sapiens
FMRYTPVGR

SEQ ID NO: 1017066 - protein, 9 aa, Homo Sapiens
LNMIQVSYR

SEQ ID NO: 1017067 - protein, 9 aa, Homo Sapiens
KPSYSRKVP

SEQ ID NO: 1017068 - protein, 9 aa, Homo Sapiens
DREPPGRRS

SEQ ID NO: 1017069 - protein, 9 aa, Homo Sapiens
SFALKSPSA

SEQ ID NO: 1017070 - protein, 9 aa, Homo Sapiens
EKLFEQFSK

SEQ ID NO: 1017071 - protein, 9 aa, Homo Sapiens
VRTPREVLL

SEQ ID NO: 1017072 - protein, 9 aa, Homo Sapiens
VAPLVKLLC

SEQ ID NO: 1017073 - protein, 9 aa, Homo Sapiens
RDKTDYLTV

SEQ ID NO: 1017074 - protein, 9 aa, Homo Sapiens
SMAGARKRT

SEQ ID NO: 1017075 - protein, 9 aa, Homo Sapiens
TGEGRGEGR

SEQ ID NO: 1017076 - protein, 9 aa, Homo Sapiens
GQSYFEGCL

SEQ ID NO: 1017077 - protein, 9 aa, Homo Sapiens
EVSAIDIDE

SEQ ID NO: 1017078 - protein, 9 aa, Homo Sapiens
QVLFLFFFW

SEQ ID NO: 1017079 - protein, 9 aa, Homo Sapiens
PLHRFSSWE

SEQ ID NO: 1017080 - protein, 9 aa, Homo Sapiens
KTLFLLWGN

SEQ ID NO: 1017081 - protein, 9 aa, Homo Sapiens
EWKPFNILI

SEQ ID NO: 1017082 - protein, 9 aa, Homo Sapiens
GTVANLFVA

SEQ ID NO: 1017083 - protein, 9 aa, Homo Sapiens
NKIQASESP

SEQ ID NO: 1017084 - protein, 9 aa, Homo Sapiens
YFAGSQGHR

SEQ ID NO: 1017085 - protein, 9 aa, Homo Sapiens
PIDTEVYES

SEQ ID NO: 1017086 - protein, 9 aa, Homo Sapiens
PWQGGGQLD

SEQ ID NO: 1017087 - protein, 9 aa, Homo Sapiens
HGSVFYFRS

SEQ ID NO: 1017088 - protein, 9 aa, Homo Sapiens
GIQGQKGDN

SEQ ID NO: 1017089 - protein, 9 aa, Homo Sapiens
ENRQLLAKV

SEQ ID NO: 1017090 - protein, 9 aa, Homo Sapiens
NILCVERGW

SEQ ID NO: 1017091 - protein, 9 aa, Homo Sapiens
DIITVLSDN

SEQ ID NO: 1017092 - protein, 9 aa, Homo Sapiens
PVFVDNFYY

SEQ ID NO: 1017093 - protein, 9 aa, Homo Sapiens
RFMLLLSKV

SEQ ID NO: 1017094 - protein, 9 aa, Homo Sapiens
GTIQRDPLD

SEQ ID NO: 1017095 - protein, 9 aa, Homo Sapiens
EGAGHSSSF

SEQ ID NO: 1017096 - protein, 9 aa, Homo Sapiens
RQFAIDAAA

SEQ ID NO: 1017097 - protein, 9 aa, Homo Sapiens
APKPPISIQ

SEQ ID NO: 1017098 - protein, 9 aa, Homo Sapiens
LPAQNPPME

SEQ ID NO: 1017099 - protein, 9 aa, Homo Sapiens
ETTVAFEIK

SEQ ID NO: 1017100 - protein, 9 aa, Homo Sapiens
ITNNLRLKD

SEQ ID NO: 1017101 - protein, 9 aa, Homo Sapiens
IGKHKDNEA

SEQ ID NO: 1017102 - protein, 9 aa, Homo Sapiens
VRVMSSTAI

SEQ ID NO: 1017103 - protein, 9 aa, Homo Sapiens
KGAPFIFIK

SEQ ID NO: 1017104 - protein, 9 aa, Homo Sapiens
QQPTPRKPP

SEQ ID NO: 1017105 - protein, 9 aa, Homo Sapiens
AFRNRLSLI

SEQ ID NO: 1017106 - protein, 9 aa, Homo Sapiens
EFYSHLTSH

SEQ ID NO: 1017107 - protein, 9 aa, Homo Sapiens
LADAVFSFG

SEQ ID NO: 1017108 - protein, 9 aa, Homo Sapiens
EIHPTSLTK

SEQ ID NO: 1017109 - protein, 9 aa, Homo Sapiens
LIQIAELLD

SEQ ID NO: 1017110 - protein, 9 aa, Homo Sapiens
ATMMPDRTL

SEQ ID NO: 1017111 - protein, 9 aa, Homo Sapiens
QNSDKDSGD

SEQ ID NO: 1017112 - protein, 9 aa, Homo Sapiens
VGLPASQGR

SEQ ID NO: 1017113 - protein, 9 aa, Homo Sapiens
ALLEEFTQA

SEQ ID NO: 1017114 - protein, 9 aa, Homo Sapiens
NPECDSWPL

SEQ ID NO: 1017115 - protein, 9 aa, Homo Sapiens
GFCGETILS

SEQ ID NO: 1017116 - protein, 9 aa, Homo Sapiens
KEIRKANIL

SEQ ID NO: 1017117 - protein, 9 aa, Homo Sapiens
SLGTFVFYL

SEQ ID NO: 1017118 - protein, 9 aa, Homo Sapiens
DNFFCNVPQ

SEQ ID NO: 1017119 - protein, 9 aa, Homo Sapiens
EFLKKMSLT

SEQ ID NO: 1017120 - protein, 9 aa, Homo Sapiens
SSKDSQEDL

SEQ ID NO: 1017121 - protein, 9 aa, Homo Sapiens
TLLSSVTSR

SEQ ID NO: 1017122 - protein, 9 aa, Homo Sapiens
PELLWFRDR

SEQ ID NO: 1017123 - protein, 9 aa, Homo Sapiens
FNCSSALMQ

SEQ ID NO: 1017124 - protein, 9 aa, Homo Sapiens
AIKFSEVDY

SEQ ID NO: 1017125 - protein, 9 aa, Homo Sapiens
AARSFALER

SEQ ID NO: 1017126 - protein, 9 aa, Homo Sapiens
VGVNFLQSY

SEQ ID NO: 1017127 - protein, 9 aa, Homo Sapiens
AAGVGLPAS

SEQ ID NO: 1017128 - protein, 9 aa, Homo Sapiens
ASYFVEGRF

SEQ ID NO: 1017129 - protein, 9 aa, Homo Sapiens
SPSHCLPHL

SEQ ID NO: 1017130 - protein, 9 aa, Homo Sapiens
SHLRTGVPP

SEQ ID NO: 1017131 - protein, 9 aa, Homo Sapiens
SSGEFGSRS

SEQ ID NO: 1017132 - protein, 9 aa, Homo Sapiens
FLGRIKIMG

SEQ ID NO: 1017133 - protein, 9 aa, Homo Sapiens
CRVYFRLWN

SEQ ID NO: 1017134 - protein, 9 aa, Homo Sapiens
GLWENSRYT

SEQ ID NO: 1017135 - protein, 9 aa, Homo Sapiens
NSIMYFTEK

SEQ ID NO: 1017136 - protein, 9 aa, Homo Sapiens
KAGATKGQK

SEQ ID NO: 1017137 - protein, 9 aa, Homo Sapiens
VSDILSCKI

SEQ ID NO: 1017138 - protein, 9 aa, Homo Sapiens
VLDQDREGA

SEQ ID NO: 1017139 - protein, 9 aa, Homo Sapiens
IAQEIYSAE

SEQ ID NO: 1017140 - protein, 9 aa, Homo Sapiens
AENAVKRAS

SEQ ID NO: 1017141 - protein, 9 aa, Homo Sapiens
KNVTRMVVC

SEQ ID NO: 1017142 - protein, 9 aa, Homo Sapiens
PERFSASTF

SEQ ID NO: 1017143 - protein, 9 aa, Homo Sapiens
EFGSRSLYN

SEQ ID NO: 1017144 - protein, 9 aa, Homo Sapiens
TVLRRGYFQ

SEQ ID NO: 1017145 - protein, 9 aa, Homo Sapiens
LPPAPLSQA

SEQ ID NO: 1017146 - protein, 9 aa, Homo Sapiens
NLGDYYHFY

SEQ ID NO: 1017147 - protein, 9 aa, Homo Sapiens
GRSRDGLSS

SEQ ID NO: 1017148 - protein, 9 aa, Homo Sapiens
ESGQRNWVQ

SEQ ID NO: 1017149 - protein, 9 aa, Homo Sapiens
DAILYCSSD

SEQ ID NO: 1017150 - protein, 9 aa, Homo Sapiens
TMMPDRTLG

SEQ ID NO: 1017151 - protein, 9 aa, Homo Sapiens
YFRSPGRDI

SEQ ID NO: 1017152 - protein, 9 aa, Homo Sapiens
AEVFPKLAA

SEQ ID NO: 1017153 - protein, 9 aa, Homo Sapiens
MVAEVFPKL

SEQ ID NO: 1017154 - protein, 9 aa, Homo Sapiens
SASSSMAGA

SEQ ID NO: 1017155 - protein, 9 aa, Homo Sapiens
GSLYPIKQC

SEQ ID NO: 1017156 - protein, 9 aa, Homo Sapiens
ASVKRNEGT

SEQ ID NO: 1017157 - protein, 9 aa, Homo Sapiens
DDQKNTDQD

SEQ ID NO: 1017158 - protein, 9 aa, Homo Sapiens
GENTTPSGT

SEQ ID NO: 1017159 - protein, 9 aa, Homo Sapiens
SSSMAGARK

SEQ ID NO: 1017160 - protein, 9 aa, Homo Sapiens
PTTGIFPGN

SEQ ID NO: 1017161 - protein, 9 aa, Homo Sapiens
SGVKKKFGH

SEQ ID NO: 1017162 - protein, 9 aa, Homo Sapiens
PSDNTKGFF

SEQ ID NO: 1017163 - protein, 9 aa, Homo Sapiens
QKRMSPKPE

SEQ ID NO: 1017164 - protein, 9 aa, Homo Sapiens
DDSSKDSQE

SEQ ID NO: 1017165 - protein, 9 aa, Homo Sapiens
TSQGPRKTM

SEQ ID NO: 1017166 - protein, 9 aa, Homo Sapiens
PGDWVILAN

SEQ ID NO: 1017167 - protein, 9 aa, Homo Sapiens
NLRLKDWEH

SEQ ID NO: 1017168 - protein, 9 aa, Homo Sapiens
YKESGQRNW

SEQ ID NO: 1017169 - protein, 9 aa, Homo Sapiens
IQVAHTKIQ

SEQ ID NO: 1017170 - protein, 9 aa, Homo Sapiens
LSFSDVLCL

SEQ ID NO: 1017171 - protein, 9 aa, Homo Sapiens
SNYAGNPAN

SEQ ID NO: 1017172 - protein, 9 aa, Homo Sapiens
DVNFDKFLL

SEQ ID NO: 1017173 - protein, 9 aa, Homo Sapiens
VLTNLTGKM

SEQ ID NO: 1017174 - protein, 9 aa, Homo Sapiens
KEMEASYKA

SEQ ID NO: 1017175 - protein, 9 aa, Homo Sapiens
RAGTEPPRR

SEQ ID NO: 1017176 - protein, 9 aa, Homo Sapiens
MGYVAAVRC

SEQ ID NO: 1017177 - protein, 9 aa, Homo Sapiens
PPTSRGNYS

SEQ ID NO: 1017178 - protein, 9 aa, Homo Sapiens
LADENYRPL

SEQ ID NO: 1017179 - protein, 9 aa, Homo Sapiens
AESQYGQRA

SEQ ID NO: 1017180 - protein, 9 aa, Homo Sapiens
KLLCAKHGL

SEQ ID NO: 1017181 - protein, 9 aa, Homo Sapiens
SLSSISLPP

SEQ ID NO: 1017182 - protein, 9 aa, Homo Sapiens
PQSSHLRTG

SEQ ID NO: 1017183 - protein, 9 aa, Homo Sapiens
QYPQQILIQ

SEQ ID NO: 1017184 - protein, 9 aa, Homo Sapiens
SNSLSSISL

SEQ ID NO: 1017185 - protein, 9 aa, Homo Sapiens
GGPDGSPYP

SEQ ID NO: 1017186 - protein, 9 aa, Homo Sapiens
PNGNLFSFH

SEQ ID NO: 1017187 - protein, 9 aa, Homo Sapiens
TQEKIFQCN

SEQ ID NO: 1017188 - protein, 9 aa, Homo Sapiens
AESQVNRLR

SEQ ID NO: 1017189 - protein, 9 aa, Homo Sapiens
TFGEKIKNT

SEQ ID NO: 1017190 - protein, 9 aa, Homo Sapiens
SDILSCKIA

SEQ ID NO: 1017191 - protein, 9 aa, Homo Sapiens
DGYIMEFRV

SEQ ID NO: 1017192 - protein, 9 aa, Homo Sapiens
RRKTFATCS

SEQ ID NO: 1017193 - protein, 9 aa, Homo Sapiens
RALPAQNPP

SEQ ID NO: 1017194 - protein, 9 aa, Homo Sapiens
TDITPSMAI

SEQ ID NO: 1017195 - protein, 9 aa, Homo Sapiens
SSQCPKPGV

SEQ ID NO: 1017196 - protein, 9 aa, Homo Sapiens
RVLRNLCRR

SEQ ID NO: 1017197 - protein, 9 aa, Homo Sapiens
HVAMEKNVF

SEQ ID NO: 1017198 - protein, 9 aa, Homo Sapiens
QDFTGILAM

SEQ ID NO: 1017199 - protein, 9 aa, Homo Sapiens
IQQPTPRKP

SEQ ID NO: 1017200 - protein, 9 aa, Homo Sapiens
ESRHHSPSK

SEQ ID NO: 1017201 - protein, 9 aa, Homo Sapiens
SKQVFADDP

SEQ ID NO: 1017202 - protein, 9 aa, Homo Sapiens
KDDSTVITQ

SEQ ID NO: 1017203 - protein, 9 aa, Homo Sapiens
PLNPNKPQI

SEQ ID NO: 1017204 - protein, 9 aa, Homo Sapiens
SHKSFLTCH

SEQ ID NO: 1017205 - protein, 9 aa, Homo Sapiens
SEFGEDNFS

SEQ ID NO: 1017206 - protein, 9 aa, Homo Sapiens
RNRIFQDSQ

SEQ ID NO: 1017207 - protein, 9 aa, Homo Sapiens
IWMAEFLIA

SEQ ID NO: 1017208 - protein, 9 aa, Homo Sapiens
ALKQEEYSQ

SEQ ID NO: 1017209 - protein, 9 aa, Homo Sapiens
LKAIKFSEV

SEQ ID NO: 1017210 - protein, 9 aa, Homo Sapiens
SVGITNVRI

SEQ ID NO: 1017211 - protein, 9 aa, Homo Sapiens
TGLNYEVPK

SEQ ID NO: 1017212 - protein, 9 aa, Homo Sapiens
WKEMQCHLR

SEQ ID NO: 1017213 - protein, 9 aa, Homo Sapiens
AILYCSSDW

SEQ ID NO: 1017214 - protein, 9 aa, Homo Sapiens
TEYRFYNPQ

SEQ ID NO: 1017215 - protein, 9 aa, Homo Sapiens
KIRDSNCST

SEQ ID NO: 1017216 - protein, 9 aa, Homo Sapiens
ELLWFRDRV

SEQ ID NO: 1017217 - protein, 9 aa, Homo Sapiens
PHWEENTVY

SEQ ID NO: 1017218 - protein, 9 aa, Homo Sapiens
VYSTYSQKS

SEQ ID NO: 1017219 - protein, 9 aa, Homo Sapiens
LLHVPWQGG

SEQ ID NO: 1017220 - protein, 9 aa, Homo Sapiens
AVILCRIRK

SEQ ID NO: 1017221 - protein, 9 aa, Homo Sapiens
TQKNKIQAS

SEQ ID NO: 1017222 - protein, 9 aa, Homo Sapiens
PSASAPILI

SEQ ID NO: 1017223 - protein, 9 aa, Homo Sapiens
HQSGGGGLS

SEQ ID NO: 1017224 - protein, 9 aa, Homo Sapiens
ETCDKRALC

SEQ ID NO: 1017225 - protein, 9 aa, Homo Sapiens
SVGFGTYDE

SEQ ID NO: 1017226 - protein, 9 aa, Homo Sapiens
GAPLQLLKG

SEQ ID NO: 1017227 - protein, 9 aa, Homo Sapiens
QKQLKVMFI

SEQ ID NO: 1017228 - protein, 9 aa, Homo Sapiens
DNTKGFFDP

SEQ ID NO: 1017229 - protein, 9 aa, Homo Sapiens
DNGRQGIPG

SEQ ID NO: 1017230 - protein, 9 aa, Homo Sapiens
IERKVSLFL

SEQ ID NO: 1017231 - protein, 9 aa, Homo Sapiens
EKKDKTDSL

SEQ ID NO: 1017232 - protein, 9 aa, Homo Sapiens
NGRDDREVW

SEQ ID NO: 1017233 - protein, 9 aa, Homo Sapiens
TDTEPNEQS

SEQ ID NO: 1017234 - protein, 9 aa, Homo Sapiens
LFSLNEIVV

SEQ ID NO: 1017235 - protein, 9 aa, Homo Sapiens
WHNSSGSIL

SEQ ID NO: 1017236 - protein, 9 aa, Homo Sapiens
TPREVLLHW

SEQ ID NO: 1017237 - protein, 9 aa, Homo Sapiens
VAFEIKETN

SEQ ID NO: 1017238 - protein, 9 aa, Homo Sapiens
YSAESRDHS

SEQ ID NO: 1017239 - protein, 9 aa, Homo Sapiens
ELPEKKDKT

SEQ ID NO: 1017240 - protein, 9 aa, Homo Sapiens
ISIQSKPPV

SEQ ID NO: 1017241 - protein, 9 aa, Homo Sapiens
SSVTSRTTM

SEQ ID NO: 1017242 - protein, 9 aa, Homo Sapiens
LELVRTGFY

SEQ ID NO: 1017243 - protein, 9 aa, Homo Sapiens
GKMWVASEA

SEQ ID NO: 1017244 - protein, 9 aa, Homo Sapiens
NPKLPSVVM

SEQ ID NO: 1017245 - protein, 9 aa, Homo Sapiens
PNAETTVAF

SEQ ID NO: 1017246 - protein, 9 aa, Homo Sapiens
SSFALKSPS

SEQ ID NO: 1017247 - protein, 9 aa, Homo Sapiens
RGLKGDLGE

SEQ ID NO: 1017248 - protein, 9 aa, Homo Sapiens
GLNYEVPKY

SEQ ID NO: 1017249 - protein, 9 aa, Homo Sapiens
VMLKYLFSL

SEQ ID NO: 1017250 - protein, 9 aa, Homo Sapiens
GLDDIKNLK

SEQ ID NO: 1017251 - protein, 9 aa, Homo Sapiens
PSSFGLHLF

SEQ ID NO: 1017252 - protein, 9 aa, Homo Sapiens
LGRIKIMGS

SEQ ID NO: 1017253 - protein, 9 aa, Homo Sapiens
CHTDITPSM

SEQ ID NO: 1017254 - protein, 9 aa, Homo Sapiens
QHGDYDLNA

SEQ ID NO: 1017255 - protein, 9 aa, Homo Sapiens
EDNAEPWGQ

SEQ ID NO: 1017256 - protein, 9 aa, Homo Sapiens
IVEFIRNKS

SEQ ID NO: 1017257 - protein, 9 aa, Homo Sapiens
SLFYIALPH

SEQ ID NO: 1017258 - protein, 9 aa, Homo Sapiens
LNPHWEENT

SEQ ID NO: 1017259 - protein, 9 aa, Homo Sapiens
QYLPSYLSF

SEQ ID NO: 1017260 - protein, 9 aa, Homo Sapiens
DKDKPFIYK

SEQ ID NO: 1017261 - protein, 9 aa, Homo Sapiens
TKDAVSTEL

SEQ ID NO: 1017262 - protein, 9 aa, Homo Sapiens
MAIIVPPAS

SEQ ID NO: 1017263 - protein, 9 aa, Homo Sapiens
EMKRSLEKA

SEQ ID NO: 1017264 - protein, 9 aa, Homo Sapiens
KMWVASEAW

SEQ ID NO: 1017265 - protein, 9 aa, Homo Sapiens
FRKHEAFLL

SEQ ID NO: 1017266 - protein, 9 aa, Homo Sapiens
DTEPNEQSE

SEQ ID NO: 1017267 - protein, 9 aa, Homo Sapiens
IMVFQFSST

SEQ ID NO: 1017268 - protein, 9 aa, Homo Sapiens
WAVPPGPSL

SEQ ID NO: 1017269 - protein, 9 aa, Homo Sapiens
NVYEDALRL

SEQ ID NO: 1017270 - protein, 9 aa, Homo Sapiens
KTSPDLSPV

SEQ ID NO: 1017271 - protein, 9 aa, Homo Sapiens
NKSFYLNNS

SEQ ID NO: 1017272 - protein, 9 aa, Homo Sapiens
IGDFGLATE

SEQ ID NO: 1017273 - protein, 9 aa, Homo Sapiens
KTNGQENHA

SEQ ID NO: 1017274 - protein, 9 aa, Homo Sapiens
KSFSSLKQR

SEQ ID NO: 1017275 - protein, 9 aa, Homo Sapiens
FPPDPLLGA

SEQ ID NO: 1017276 - protein, 9 aa, Homo Sapiens
RQEETGEGR

SEQ ID NO: 1017277 - protein, 9 aa, Homo Sapiens
PPIQQPTPR

SEQ ID NO: 1017278 - protein, 9 aa, Homo Sapiens
FPIIANMIN

SEQ ID NO: 1017279 - protein, 9 aa, Homo Sapiens
QKSAKEVGE

SEQ ID NO: 1017280 - protein, 9 aa, Homo Sapiens
DHIAQEIYS

SEQ ID NO: 1017281 - protein, 9 aa, Homo Sapiens
DLDENEDIF

SEQ ID NO: 1017282 - protein, 9 aa, Homo Sapiens
RRHRTPHGG

SEQ ID NO: 1017283 - protein, 9 aa, Homo Sapiens
LLSAASPET

SEQ ID NO: 1017284 - protein, 9 aa, Homo Sapiens
LWINVAATE

SEQ ID NO: 1017285 - protein, 9 aa, Homo Sapiens
IIHGIHLET

SEQ ID NO: 1017286 - protein, 9 aa, Homo Sapiens
MPAYALLEE

SEQ ID NO: 1017287 - protein, 9 aa, Homo Sapiens
ARQHTVVLE

SEQ ID NO: 1017288 - protein, 9 aa, Homo Sapiens
KLPSVVMDR

SEQ ID NO: 1017289 - protein, 9 aa, Homo Sapiens
PELPEKKDK

SEQ ID NO: 1017290 - protein, 9 aa, Homo Sapiens
TSSQCPKPG

SEQ ID NO: 1017291 - protein, 9 aa, Homo Sapiens
GAPISDSLN

SEQ ID NO: 1017292 - protein, 9 aa, Homo Sapiens
LVGTVANLF

SEQ ID NO: 1017293 - protein, 9 aa, Homo Sapiens
VSAGLRGEK

SEQ ID NO: 1017294 - protein, 9 aa, Homo Sapiens
ANQSRACRG

SEQ ID NO: 1017295 - protein, 9 aa, Homo Sapiens
RDSNCSTLL

SEQ ID NO: 1017296 - protein, 9 aa, Homo Sapiens
KGELGASLY

SEQ ID NO: 1017297 - protein, 9 aa, Homo Sapiens
GPATMMPDR

SEQ ID NO: 1017298 - protein, 9 aa, Homo Sapiens
STVITQDLL

SEQ ID NO: 1017299 - protein, 9 aa, Homo Sapiens
KAFNCSSAL

SEQ ID NO: 1017300 - protein, 9 aa, Homo Sapiens
QPKRNKRNR

SEQ ID NO: 1017301 - protein, 9 aa, Homo Sapiens
LITCSETPT

SEQ ID NO: 1017302 - protein, 9 aa, Homo Sapiens
KGLAEGTPT

SEQ ID NO: 1017303 - protein, 9 aa, Homo Sapiens
ISQVTRLCD

SEQ ID NO: 1017304 - protein, 9 aa, Homo Sapiens
FCGETILSE

SEQ ID NO: 1017305 - protein, 9 aa, Homo Sapiens
QEKIFQCNK

SEQ ID NO: 1017306 - protein, 9 aa, Homo Sapiens
HQKQLKVMF

SEQ ID NO: 1017307 - protein, 9 aa, Homo Sapiens
GTSHSSSGK

SEQ ID NO: 1017308 - protein, 9 aa, Homo Sapiens
AQEIYSAES

SEQ ID NO: 1017309 - protein, 9 aa, Homo Sapiens
NEGFCGETI

SEQ ID NO: 1017310 - protein, 9 aa, Homo Sapiens
KGDNGRQGI

SEQ ID NO: 1017311 - protein, 9 aa, Homo Sapiens
YWCVAESQY

SEQ ID NO: 1017312 - protein, 9 aa, Homo Sapiens
KISTLLIVL

SEQ ID NO: 1017313 - protein, 9 aa, Homo Sapiens
PGPSLSGGL

SEQ ID NO: 1017314 - protein, 9 aa, Homo Sapiens
SSTEQRAVR

SEQ ID NO: 1017315 - protein, 9 aa, Homo Sapiens
LEVQATDLE

SEQ ID NO: 1017316 - protein, 9 aa, Homo Sapiens
DSKKGKKNE

SEQ ID NO: 1017317 - protein, 9 aa, Homo Sapiens
SFGLHLFKG

SEQ ID NO: 1017318 - protein, 9 aa, Homo Sapiens
VSYRAVSGP

SEQ ID NO: 1017319 - protein, 9 aa, Homo Sapiens
VVCENQPLD

SEQ ID NO: 1017320 - protein, 9 aa, Homo Sapiens
YPIKQCRVY

SEQ ID NO: 1017321 - protein, 9 aa, Homo Sapiens
EIVNYCSNH

SEQ ID NO: 1017322 - protein, 9 aa, Homo Sapiens
GLPHTKLED

SEQ ID NO: 1017323 - protein, 9 aa, Homo Sapiens
SLTREAQKM

SEQ ID NO: 1017324 - protein, 9 aa, Homo Sapiens
AVSTELTGA

SEQ ID NO: 1017325 - protein, 9 aa, Homo Sapiens
APLVKLLCA

SEQ ID NO: 1017326 - protein, 9 aa, Homo Sapiens
FLLWGNHEC

SEQ ID NO: 1017327 - protein, 9 aa, Homo Sapiens
LDSLGTFVF

SEQ ID NO: 1017328 - protein, 9 aa, Homo Sapiens
YCILSYLEW

SEQ ID NO: 1017329 - protein, 9 aa, Homo Sapiens
PPTGDSGPP

SEQ ID NO: 1017330 - protein, 9 aa, Homo Sapiens
DDYEEKELR

SEQ ID NO: 1017331 - protein, 9 aa, Homo Sapiens
GRRKTFATC

SEQ ID NO: 1017332 - protein, 9 aa, Homo Sapiens
GETILSEFY

SEQ ID NO: 1017333 - protein, 9 aa, Homo Sapiens
LLCAKHGLS

SEQ ID NO: 1017334 - protein, 9 aa, Homo Sapiens
TLASQVAAS

SEQ ID NO: 1017335 - protein, 9 aa, Homo Sapiens
IKNLKVGSV

SEQ ID NO: 1017336 - protein, 9 aa, Homo Sapiens
ALKSPSAPI

SEQ ID NO: 1017337 - protein, 9 aa, Homo Sapiens
VLFLFFFWG

SEQ ID NO: 1017338 - protein, 9 aa, Homo Sapiens
KNLKVGSVE

SEQ ID NO: 1017339 - protein, 9 aa, Homo Sapiens
DLEENKQIA

SEQ ID NO: 1017340 - protein, 9 aa, Homo Sapiens
VCNKLMHQK

SEQ ID NO: 1017341 - protein, 9 aa, Homo Sapiens
FLLILFAEI

SEQ ID NO: 1017342 - protein, 9 aa, Homo Sapiens
HLSKPSYSR

SEQ ID NO: 1017343 - protein, 9 aa, Homo Sapiens
PSASSNFFY

SEQ ID NO: 1017344 - protein, 9 aa, Homo Sapiens
TPPLHRFSS

SEQ ID NO: 1017345 - protein, 9 aa, Homo Sapiens
TDLEENKQI

SEQ ID NO: 1017346 - protein, 9 aa, Homo Sapiens
FLTCHRRLH

SEQ ID NO: 1017347 - protein, 9 aa, Homo Sapiens
EDLFKKINR

SEQ ID NO: 1017348 - protein, 9 aa, Homo Sapiens
MVLNKKFGS

SEQ ID NO: 1017349 - protein, 9 aa, Homo Sapiens
VLGMDGMKC

SEQ ID NO: 1017350 - protein, 9 aa, Homo Sapiens
LCSELQRHN

SEQ ID NO: 1017351 - protein, 9 aa, Homo Sapiens
PKLYNGNYS

SEQ ID NO: 1017352 - protein, 9 aa, Homo Sapiens
LKEDKEVNL

SEQ ID NO: 1017353 - protein, 9 aa, Homo Sapiens
RLDSEYKES

SEQ ID NO: 1017354 - protein, 9 aa, Homo Sapiens
WTWDTPSGK

SEQ ID NO: 1017355 - protein, 9 aa, Homo Sapiens
LRRAPFKGS

SEQ ID NO: 1017356 - protein, 9 aa, Homo Sapiens
SSGVKKKFG

SEQ ID NO: 1017357 - protein, 9 aa, Homo Sapiens
DNFSKQVFA

SEQ ID NO: 1017358 - protein, 9 aa, Homo Sapiens
SASTFFWAL

SEQ ID NO: 1017359 - protein, 9 aa, Homo Sapiens
VIILNYPGQ

SEQ ID NO: 1017360 - protein, 9 aa, Homo Sapiens
FNILILLTI

SEQ ID NO: 1017361 - protein, 9 aa, Homo Sapiens
AIGKKIGEK

SEQ ID NO: 1017362 - protein, 9 aa, Homo Sapiens
KSSLRCHCR

SEQ ID NO: 1017363 - protein, 9 aa, Homo Sapiens
EVFPKLAAS

SEQ ID NO: 1017364 - protein, 9 aa, Homo Sapiens
AGWKEMQCH

SEQ ID NO: 1017365 - protein, 9 aa, Homo Sapiens
NLFVAGTET

SEQ ID NO: 1017366 - protein, 9 aa, Homo Sapiens
KLGGFPIIA

SEQ ID NO: 1017367 - protein, 9 aa, Homo Sapiens
LPFPTVFSF

SEQ ID NO: 1017368 - protein, 9 aa, Homo Sapiens
LICIWMAEF

SEQ ID NO: 1017369 - protein, 9 aa, Homo Sapiens
KLFEQFSKL

SEQ ID NO: 1017370 - protein, 9 aa, Homo Sapiens
SQCPKPGVI

SEQ ID NO: 1017371 - protein, 9 aa, Homo Sapiens
GTKDAVSTE

SEQ ID NO: 1017372 - protein, 9 aa, Homo Sapiens
GFPIIANMI

SEQ ID NO: 1017373 - protein, 9 aa, Homo Sapiens
NKLVNGHTL

SEQ ID NO: 1017374 - protein, 9 aa, Homo Sapiens
RRKDSHSSS

SEQ ID NO: 1017375 - protein, 9 aa, Homo Sapiens
ADPSDNTKG

SEQ ID NO: 1017376 - protein, 9 aa, Homo Sapiens
TGSPLLSAA

SEQ ID NO: 1017377 - protein, 9 aa, Homo Sapiens
ENTVYQEAR

SEQ ID NO: 1017378 - protein, 9 aa, Homo Sapiens
TPSGKGLAE

SEQ ID NO: 1017379 - protein, 9 aa, Homo Sapiens
ILIMDTGEN

SEQ ID NO: 1017380 - protein, 9 aa, Homo Sapiens
HFRTTSLGD

SEQ ID NO: 1017381 - protein, 9 aa, Homo Sapiens
AFIGIEDPV

SEQ ID NO: 1017382 - protein, 9 aa, Homo Sapiens
ESTKVEAHQ

SEQ ID NO: 1017383 - protein, 9 aa, Homo Sapiens
LPVLVIHGK

SEQ ID NO: 1017384 - protein, 9 aa, Homo Sapiens
DLDIITVLS

SEQ ID NO: 1017385 - protein, 9 aa, Homo Sapiens
NILVSDILS

SEQ ID NO: 1017386 - protein, 9 aa, Homo Sapiens
SGSLAAGIL

SEQ ID NO: 1017387 - protein, 9 aa, Homo Sapiens
CHCRLHTGI

SEQ ID NO: 1017388 - protein, 9 aa, Homo Sapiens
ARGRPGFAK

SEQ ID NO: 1017389 - protein, 9 aa, Homo Sapiens
AKLLFSDGK

SEQ ID NO: 1017390 - protein, 9 aa, Homo Sapiens
VKLLCAKHG

SEQ ID NO: 1017391 - protein, 9 aa, Homo Sapiens
KVLNNITNN

SEQ ID NO: 1017392 - protein, 9 aa, Homo Sapiens
RTVLGMDGM

SEQ ID NO: 1017393 - protein, 9 aa, Homo Sapiens
GKAFNCSSA

SEQ ID NO: 1017394 - protein, 9 aa, Homo Sapiens
PLDFPERFS

SEQ ID NO: 1017395 - protein, 9 aa, Homo Sapiens
PLWEVLPGN

SEQ ID NO: 1017396 - protein, 9 aa, Homo Sapiens
KKTIFFQGC

SEQ ID NO: 1017397 - protein, 9 aa, Homo Sapiens
ARVADAILY

SEQ ID NO: 1017398 - protein, 9 aa, Homo Sapiens
VAFNKIAQV

SEQ ID NO: 1017399 - protein, 9 aa, Homo Sapiens
LCKPSGDFT

SEQ ID NO: 1017400 - protein, 9 aa, Homo Sapiens
PSVVMDRWL

SEQ ID NO: 1017401 - protein, 9 aa, Homo Sapiens
IRNKSFYLN

SEQ ID NO: 1017402 - protein, 9 aa, Homo Sapiens
QKGELGASL

SEQ ID NO: 1017403 - protein, 9 aa, Homo Sapiens
VKKKFGHEF

SEQ ID NO: 1017404 - protein, 9 aa, Homo Sapiens
DPGVLDEAT

SEQ ID NO: 1017405 - protein, 9 aa, Homo Sapiens
EVKVRVMSS

SEQ ID NO: 1017406 - protein, 9 aa, Homo Sapiens
TPLNGSNSL

SEQ ID NO: 1017407 - protein, 9 aa, Homo Sapiens
FGQRFDLVV

SEQ ID NO: 1017408 - protein, 9 aa, Homo Sapiens
VLEFVLGDN

SEQ ID NO: 1017409 - protein, 9 aa, Homo Sapiens
RIKIMGSAK

SEQ ID NO: 1017410 - protein, 9 aa, Homo Sapiens
RWKNNCPFL

SEQ ID NO: 1017411 - protein, 9 aa, Homo Sapiens
SVLDQDREG

SEQ ID NO: 1017412 - protein, 9 aa, Homo Sapiens
YSHLTSHEK

SEQ ID NO: 1017413 - protein, 9 aa, Homo Sapiens
QWVHREHTH

SEQ ID NO: 1017414 - protein, 9 aa, Homo Sapiens
FPKLAASPM

SEQ ID NO: 1017415 - protein, 9 aa, Homo Sapiens
AFEADLDEN

SEQ ID NO: 1017416 - protein, 9 aa, Homo Sapiens
ETINQINNK

SEQ ID NO: 1017417 - protein, 9 aa, Homo Sapiens
SNCSTLLAT

SEQ ID NO: 1017418 - protein, 9 aa, Homo Sapiens
PNTGSIWEL

SEQ ID NO: 1017419 - protein, 9 aa, Homo Sapiens
LDEATELLG

SEQ ID NO: 1017420 - protein, 9 aa, Homo Sapiens
FLNSQPSHC

SEQ ID NO: 1017421 - protein, 9 aa, Homo Sapiens
DPSLSFIKY

SEQ ID NO: 1017422 - protein, 9 aa, Homo Sapiens
IVNYCSNHL

SEQ ID NO: 1017423 - protein, 9 aa, Homo Sapiens
EAFLLFSLG

SEQ ID NO: 1017424 - protein, 9 aa, Homo Sapiens
VLDEATELL

SEQ ID NO: 1017425 - protein, 9 aa, Homo Sapiens
MFPLGVATL

SEQ ID NO: 1017426 - protein, 9 aa, Homo Sapiens
EYRFYNPQK

SEQ ID NO: 1017427 - protein, 9 aa, Homo Sapiens
LGLRGLKGD

SEQ ID NO: 1017428 - protein, 9 aa, Homo Sapiens
TEVSAIDID

SEQ ID NO: 1017429 - protein, 9 aa, Homo Sapiens
SSTAISLQW

SEQ ID NO: 1017430 - protein, 9 aa, Homo Sapiens
IRKLGGFPI

SEQ ID NO: 1017431 - protein, 9 aa, Homo Sapiens
SQVNRLRAK

SEQ ID NO: 1017432 - protein, 9 aa, Homo Sapiens
GPSLSGGLS

SEQ ID NO: 1017433 - protein, 9 aa, Homo Sapiens
LESAPVGAP

SEQ ID NO: 1017434 - protein, 9 aa, Homo Sapiens
AQNPPMEKA

SEQ ID NO: 1017435 - protein, 9 aa, Homo Sapiens
CLICLEYLK

SEQ ID NO: 1017436 - protein, 9 aa, Homo Sapiens
EYIVVKAEK

SEQ ID NO: 1017437 - protein, 9 aa, Homo Sapiens
KNEAIASFV

SEQ ID NO: 1017438 - protein, 9 aa, Homo Sapiens
GPVFVDNFY

SEQ ID NO: 1017439 - protein, 9 aa, Homo Sapiens
QVIILNYPG

SEQ ID NO: 1017440 - protein, 9 aa, Homo Sapiens
TCEIVNYCS

SEQ ID NO: 1017441 - protein, 9 aa, Homo Sapiens
SELQRHNRS

SEQ ID NO: 1017442 - protein, 9 aa, Homo Sapiens
KPLQKQPLA

SEQ ID NO: 1017443 - protein, 9 aa, Homo Sapiens
TFVFYLLGD

SEQ ID NO: 1017444 - protein, 9 aa, Homo Sapiens
HPVFLNSQP

SEQ ID NO: 1017445 - protein, 9 aa, Homo Sapiens
QLLAKVQAL

SEQ ID NO: 1017446 - protein, 9 aa, Homo Sapiens
KDGRPISGS

SEQ ID NO: 1017447 - protein, 9 aa, Homo Sapiens
EPPRRHRTP

SEQ ID NO: 1017448 - protein, 9 aa, Homo Sapiens
EDNFSKQVF

SEQ ID NO: 1017449 - protein, 9 aa, Homo Sapiens
YSEDKIYRF

SEQ ID NO: 1017450 - protein, 9 aa, Homo Sapiens
LFSQIYSLN

SEQ ID NO: 1017451 - protein, 9 aa, Homo Sapiens
LHRFSSWES

SEQ ID NO: 1017452 - protein, 9 aa, Homo Sapiens
DAYTAAARQ

SEQ ID NO: 1017453 - protein, 9 aa, Homo Sapiens
ILYFFYLDE

SEQ ID NO: 1017454 - protein, 9 aa, Homo Sapiens
PVFLNSQPS

SEQ ID NO: 1017455 - protein, 9 aa, Homo Sapiens
SLNEIVVDF

SEQ ID NO: 1017456 - protein, 9 aa, Homo Sapiens
GNYSNYAGN

SEQ ID NO: 1017457 - protein, 9 aa, Homo Sapiens
LIGKHKDNE

SEQ ID NO: 1017458 - protein, 9 aa, Homo Sapiens
YIDLPVLVI

SEQ ID NO: 1017459 - protein, 9 aa, Homo Sapiens
SYLEWEQKC

SEQ ID NO: 1017460 - protein, 9 aa, Homo Sapiens
PSEFLKKMS

SEQ ID NO: 1017461 - protein, 9 aa, Homo Sapiens
ERQEETGEG

SEQ ID NO: 1017462 - protein, 9 aa, Homo Sapiens
CSTLLATIQ

SEQ ID NO: 1017463 - protein, 9 aa, Homo Sapiens
AAENAVKRA

SEQ ID NO: 1017464 - protein, 9 aa, Homo Sapiens
TDHIAQEIY

SEQ ID NO: 1017465 - protein, 9 aa, Homo Sapiens
VLSVVLPEK

SEQ ID NO: 1017466 - protein, 9 aa, Homo Sapiens
DIHNEFFWP

SEQ ID NO: 1017467 - protein, 9 aa, Homo Sapiens
EGYHFLPAY

SEQ ID NO: 1017468 - protein, 9 aa, Homo Sapiens
KKKFGHEFD

SEQ ID NO: 1017469 - protein, 9 aa, Homo Sapiens
SPDFLYICS

SEQ ID NO: 1017470 - protein, 9 aa, Homo Sapiens
DHPFLFFIW

SEQ ID NO: 1017471 - protein, 9 aa, Homo Sapiens
ILICIWMAE

SEQ ID NO: 1017472 - protein, 9 aa, Homo Sapiens
PIKQCRVYF

SEQ ID NO: 1017473 - protein, 9 aa, Homo Sapiens
GDFGLATEK

SEQ ID NO: 1017474 - protein, 9 aa, Homo Sapiens
LSVVLPEKL

SEQ ID NO: 1017475 - protein, 9 aa, Homo Sapiens
LPSVVMDRW

SEQ ID NO: 1017476 - protein, 9 aa, Homo Sapiens
LSCTAGTPG

SEQ ID NO: 1017477 - protein, 9 aa, Homo Sapiens
DLVLPKDTT

SEQ ID NO: 1017478 - protein, 9 aa, Homo Sapiens
KGKKNEKKG

SEQ ID NO: 1017479 - protein, 9 aa, Homo Sapiens
STTSQGPRK

SEQ ID NO: 1017480 - protein, 9 aa, Homo Sapiens
SLRCHCRLH

SEQ ID NO: 1017481 - protein, 9 aa, Homo Sapiens
CLGVPPSFP

SEQ ID NO: 1017482 - protein, 9 aa, Homo Sapiens
PYQPLWEVL

SEQ ID NO: 1017483 - protein, 9 aa, Homo Sapiens
MERLKEVNK

SEQ ID NO: 1017484 - protein, 9 aa, Homo Sapiens
SPPSLSAAS

SEQ ID NO: 1017485 - protein, 9 aa, Homo Sapiens
QIMKEMEAS

SEQ ID NO: 1017486 - protein, 9 aa, Homo Sapiens
WFRDRVLLD

SEQ ID NO: 1017487 - protein, 9 aa, Homo Sapiens
RRSRPRALL

SEQ ID NO: 1017488 - protein, 9 aa, Homo Sapiens
SKPEDNAEP

SEQ ID NO: 1017489 - protein, 9 aa, Homo Sapiens
TEPNEQSED

SEQ ID NO: 1017490 - protein, 9 aa, Homo Sapiens
PLNGSNSLS

SEQ ID NO: 1017491 - protein, 9 aa, Homo Sapiens
LGVPPSFPP

SEQ ID NO: 1017492 - protein, 9 aa, Homo Sapiens
VFDENQSWY

SEQ ID NO: 1017493 - protein, 9 aa, Homo Sapiens
GQRFDLVVH

SEQ ID NO: 1017494 - protein, 9 aa, Homo Sapiens
INNKLEGIL

SEQ ID NO: 1017495 - protein, 9 aa, Homo Sapiens
KDSSSFALK

SEQ ID NO: 1017496 - protein, 9 aa, Homo Sapiens
PLKKHVDAL

SEQ ID NO: 1017497 - protein, 9 aa, Homo Sapiens
SLTEKLFEQ

SEQ ID NO: 1017498 - protein, 9 aa, Homo Sapiens
RTGAYSKPT

SEQ ID NO: 1017499 - protein, 9 aa, Homo Sapiens
KEKQLCNVL

SEQ ID NO: 1017500 - protein, 9 aa, Homo Sapiens
ADLDENEDI

SEQ ID NO: 1017501 - protein, 9 aa, Homo Sapiens
KRNKRNRIF

SEQ ID NO: 1017502 - protein, 9 aa, Homo Sapiens
DKFLLILFA

SEQ ID NO: 1017503 - protein, 9 aa, Homo Sapiens
IEEQHGDYD

SEQ ID NO: 1017504 - protein, 9 aa, Homo Sapiens
FLFFFWGVS

SEQ ID NO: 1017505 - protein, 9 aa, Homo Sapiens
AALMELLWE

SEQ ID NO: 1017506 - protein, 9 aa, Homo Sapiens
TITPELPEK

SEQ ID NO: 1017507 - protein, 9 aa, Homo Sapiens
SYFVEGRFS

SEQ ID NO: 1017508 - protein, 9 aa, Homo Sapiens
QPLWEVLPG

SEQ ID NO: 1017509 - protein, 9 aa, Homo Sapiens
PNYYSIVTG

SEQ ID NO: 1017510 - protein, 9 aa, Homo Sapiens
CSSVGSLFY

SEQ ID NO: 1017511 - protein, 9 aa, Homo Sapiens
ENNESSSTK

SEQ ID NO: 1017512 - protein, 9 aa, Homo Sapiens
GSNSLSSIS

SEQ ID NO: 1017513 - protein, 9 aa, Homo Sapiens
LMPHPANIS

SEQ ID NO: 1017514 - protein, 9 aa, Homo Sapiens
IDTEVYESP

SEQ ID NO: 1017515 - protein, 9 aa, Homo Sapiens
LKDYSEDKI

SEQ ID NO: 1017516 - protein, 9 aa, Homo Sapiens
IMKEMEASY

SEQ ID NO: 1017517 - protein, 9 aa, Homo Sapiens
EKIQVAHTK

SEQ ID NO: 1017518 - protein, 9 aa, Homo Sapiens
ILGLPAKMR

SEQ ID NO: 1017519 - protein, 9 aa, Homo Sapiens
KKDKTDSLR

SEQ ID NO: 1017520 - protein, 9 aa, Homo Sapiens
FLATFNKIS

SEQ ID NO: 1017521 - protein, 9 aa, Homo Sapiens
DAVSTELTG

SEQ ID NO: 1017522 - protein, 9 aa, Homo Sapiens
ARAGTEPPR

SEQ ID NO: 1017523 - protein, 9 aa, Homo Sapiens
QETINQINN

SEQ ID NO: 1017524 - protein, 9 aa, Homo Sapiens
VQVVCENQP

SEQ ID NO: 1017525 - protein, 9 aa, Homo Sapiens
SATKQTLKA

SEQ ID NO: 1017526 - protein, 9 aa, Homo Sapiens
NFQIISAYK

SEQ ID NO: 1017527 - protein, 9 aa, Homo Sapiens
VRLLFKAMT

SEQ ID NO: 1017528 - protein, 9 aa, Homo Sapiens
WKNNCPFLA

SEQ ID NO: 1017529 - protein, 9 aa, Homo Sapiens
SSSFPYSPS

SEQ ID NO: 1017530 - protein, 9 aa, Homo Sapiens
ISQGILKQV

SEQ ID NO: 1017531 - protein, 9 aa, Homo Sapiens
ITVLSDNVV

SEQ ID NO: 1017532 - protein, 9 aa, Homo Sapiens
KESEVLEFV

SEQ ID NO: 1017533 - protein, 9 aa, Homo Sapiens
LWEKEERIL

SEQ ID NO: 1017534 - protein, 9 aa, Homo Sapiens
PLVAEAQKG

SEQ ID NO: 1017535 - protein, 9 aa, Homo Sapiens
SSALMQHKR

SEQ ID NO: 1017536 - protein, 9 aa, Homo Sapiens
MLDVNFDKF

SEQ ID NO: 1017537 - protein, 9 aa, Homo Sapiens
SLKDYSEDK

SEQ ID NO: 1017538 - protein, 9 aa, Homo Sapiens
KDLFSVTFD

SEQ ID NO: 1017539 - protein, 9 aa, Homo Sapiens
EMEASYKAQ

SEQ ID NO: 1017540 - protein, 9 aa, Homo Sapiens
PPADGRLSR

SEQ ID NO: 1017541 - protein, 9 aa, Homo Sapiens
QQDCSPSWS

SEQ ID NO: 1017542 - protein, 9 aa, Homo Sapiens
NCPFLADEN

SEQ ID NO: 1017543 - protein, 9 aa, Homo Sapiens
PSDPLELVR

SEQ ID NO: 1017544 - protein, 9 aa, Homo Sapiens
FGLATEKSR

SEQ ID NO: 1017545 - protein, 9 aa, Homo Sapiens
TEKLFEQFS

SEQ ID NO: 1017546 - protein, 9 aa, Homo Sapiens
QRLSRKLLC

SEQ ID NO: 1017547 - protein, 9 aa, Homo Sapiens
GDNGRQGIP

SEQ ID NO: 1017548 - protein, 9 aa, Homo Sapiens
MLKYLFSLN

SEQ ID NO: 1017549 - protein, 9 aa, Homo Sapiens
GSPLLSAAS

SEQ ID NO: 1017550 - protein, 9 aa, Homo Sapiens
QINNKLEGI

SEQ ID NO: 1017551 - protein, 9 aa, Homo Sapiens
RVDLVLPKD

SEQ ID NO: 1017552 - protein, 9 aa, Homo Sapiens
PRPPSKSAV

SEQ ID NO: 1017553 - protein, 9 aa, Homo Sapiens
ENAVKRASD

SEQ ID NO: 1017554 - protein, 9 aa, Homo Sapiens
RPLIIHGIH

SEQ ID NO: 1017555 - protein, 9 aa, Homo Sapiens
SQSLLKQMD

SEQ ID NO: 1017556 - protein, 9 aa, Homo Sapiens
TSLTEKLFE

SEQ ID NO: 1017557 - protein, 9 aa, Homo Sapiens
ANMASSSQQ

SEQ ID NO: 1017558 - protein, 9 aa, Homo Sapiens
SRPEEEEDV

SEQ ID NO: 1017559 - protein, 9 aa, Homo Sapiens
QSLLKQMDN

SEQ ID NO: 1017560 - protein, 9 aa, Homo Sapiens
FSECASLSP

SEQ ID NO: 1017561 - protein, 9 aa, Homo Sapiens
DIQASYFVE

SEQ ID NO: 1017562 - protein, 9 aa, Homo Sapiens
AATQRPKAQ

SEQ ID NO: 1017563 - protein, 9 aa, Homo Sapiens
CYRTVLGMD

SEQ ID NO: 1017564 - protein, 9 aa, Homo Sapiens
RAATAATQR

SEQ ID NO: 1017565 - protein, 9 aa, Homo Sapiens
EKQLCNVLL

SEQ ID NO: 1017566 - protein, 9 aa, Homo Sapiens
CDKKTIFFQ

SEQ ID NO: 1017567 - protein, 9 aa, Homo Sapiens
APILITCSE

SEQ ID NO: 1017568 - protein, 9 aa, Homo Sapiens
GGGLSCTAG

SEQ ID NO: 1017569 - protein, 9 aa, Homo Sapiens
FDCSKDLFS

SEQ ID NO: 1017570 - protein, 9 aa, Homo Sapiens
SCLICLEYL

SEQ ID NO: 1017571 - protein, 9 aa, Homo Sapiens
PFMRYTPVG

SEQ ID NO: 1017572 - protein, 9 aa, Homo Sapiens
QYPHNGRDD

SEQ ID NO: 1017573 - protein, 9 aa, Homo Sapiens
PDREPPGRR

SEQ ID NO: 1017574 - protein, 9 aa, Homo Sapiens
ATKQTLKAH

SEQ ID NO: 1017575 - protein, 9 aa, Homo Sapiens
DISQGILKQ

SEQ ID NO: 1017576 - protein, 9 aa, Homo Sapiens
IKQCRVYFR

SEQ ID NO: 1017577 - protein, 9 aa, Homo Sapiens
EDPKKLIGK

SEQ ID NO: 1017578 - protein, 9 aa, Homo Sapiens
GRLSRPHSY

SEQ ID NO: 1017579 - protein, 9 aa, Homo Sapiens
GMEETQVIL

SEQ ID NO: 1017580 - protein, 9 aa, Homo Sapiens
MLLSFSDVL

SEQ ID NO: 1017581 - protein, 9 aa, Homo Sapiens
GQTSKTKLL

SEQ ID NO: 1017582 - protein, 9 aa, Homo Sapiens
LPNVAFNST

SEQ ID NO: 1017583 - protein, 9 aa, Homo Sapiens
GNFRGNKIH

SEQ ID NO: 1017584 - protein, 9 aa, Homo Sapiens
IVDSLTREA

SEQ ID NO: 1017585 - protein, 9 aa, Homo Sapiens
KVDISQGIL

SEQ ID NO: 1017586 - protein, 9 aa, Homo Sapiens
KVVFVFYSV

SEQ ID NO: 1017587 - protein, 9 aa, Homo Sapiens
TAAARQHTV

SEQ ID NO: 1017588 - protein, 9 aa, Homo Sapiens
AFSECASLS

SEQ ID NO: 1017589 - protein, 9 aa, Homo Sapiens
PLSCEYKMK

SEQ ID NO: 1017590 - protein, 9 aa, Homo Sapiens
SLLHVPWQG

SEQ ID NO: 1017591 - protein, 9 aa, Homo Sapiens
ALQETRGIP

SEQ ID NO: 1017592 - protein, 9 aa, Homo Sapiens
SFRQPPSFL

SEQ ID NO: 1017593 - protein, 9 aa, Homo Sapiens
TLAKKAAVT

SEQ ID NO: 1017594 - protein, 9 aa, Homo Sapiens
FPGNGSGKQ

SEQ ID NO: 1017595 - protein, 9 aa, Homo Sapiens
SHGSVFYFR

SEQ ID NO: 1017596 - protein, 9 aa, Homo Sapiens
RVRFRGKRE

SEQ ID NO: 1017597 - protein, 9 aa, Homo Sapiens
TNRDKEFYS

SEQ ID NO: 1017598 - protein, 9 aa, Homo Sapiens
LSSVTSRTT

SEQ ID NO: 1017599 - protein, 9 aa, Homo Sapiens
TTVRCENLI

SEQ ID NO: 1017600 - protein, 9 aa, Homo Sapiens
DAAGVGLPA

SEQ ID NO: 1017601 - protein, 9 aa, Homo Sapiens
VLVIHGKQK

SEQ ID NO: 1017602 - protein, 9 aa, Homo Sapiens
LLWEKEERI

SEQ ID NO: 1017603 - protein, 9 aa, Homo Sapiens
TTTQEKIFQ

SEQ ID NO: 1017604 - protein, 9 aa, Homo Sapiens
FNKISTLLI

SEQ ID NO: 1017605 - protein, 9 aa, Homo Sapiens
SLAAGILDL

SEQ ID NO: 1017606 - protein, 9 aa, Homo Sapiens
YPGQISAGY

SEQ ID NO: 1017607 - protein, 9 aa, Homo Sapiens
WKPFNILIL

SEQ ID NO: 1017608 - protein, 9 aa, Homo Sapiens
EKRRQRKEE

SEQ ID NO: 1017609 - protein, 9 aa, Homo Sapiens
LESTKVEAH

SEQ ID NO: 1017610 - protein, 9 aa, Homo Sapiens
VFYFRSPGR

SEQ ID NO: 1017611 - protein, 9 aa, Homo Sapiens
AAPLRRAPF

SEQ ID NO: 1017612 - protein, 9 aa, Homo Sapiens
AAGLSSPPQ

SEQ ID NO: 1017613 - protein, 9 aa, Homo Sapiens
GGPEPEEPE

SEQ ID NO: 1017614 - protein, 9 aa, Homo Sapiens
FRTTSLGDD

SEQ ID NO: 1017615 - protein, 9 aa, Homo Sapiens
TVFSFPPDP

SEQ ID NO: 1017616 - protein, 9 aa, Homo Sapiens
SMSSGVKKK

SEQ ID NO: 1017617 - protein, 9 aa, Homo Sapiens
VVMDRWLWG

SEQ ID NO: 1017618 - protein, 9 aa, Homo Sapiens
RINKTFIYG

SEQ ID NO: 1017619 - protein, 9 aa, Homo Sapiens
KIMGSAKRI

SEQ ID NO: 1017620 - protein, 9 aa, Homo Sapiens
SNMADGDSY

SEQ ID NO: 1017621 - protein, 9 aa, Homo Sapiens
AETTVAFEI

SEQ ID NO: 1017622 - protein, 9 aa, Homo Sapiens
KLESLCSEL

SEQ ID NO: 1017623 - protein, 9 aa, Homo Sapiens
VLRNLCRRV

SEQ ID NO: 1017624 - protein, 9 aa, Homo Sapiens
PSHCLPHLL

SEQ ID NO: 1017625 - protein, 9 aa, Homo Sapiens
QIGNLGDYY

SEQ ID NO: 1017626 - protein, 9 aa, Homo Sapiens
LPASQGRGP

SEQ ID NO: 1017627 - protein, 9 aa, Homo Sapiens
GLSSQARHD

SEQ ID NO: 1017628 - protein, 9 aa, Homo Sapiens
RHLPFMRYT

SEQ ID NO: 1017629 - protein, 9 aa, Homo Sapiens
QPYQPLWEV

SEQ ID NO: 1017630 - protein, 9 aa, Homo Sapiens
LCVARVSEV

SEQ ID NO: 1017631 - protein, 9 aa, Homo Sapiens
ASLESTKVE

SEQ ID NO: 1017632 - protein, 9 aa, Homo Sapiens
NCSSVGSLF

SEQ ID NO: 1017633 - protein, 9 aa, Homo Sapiens
LFCDKKTIF

SEQ ID NO: 1017634 - protein, 9 aa, Homo Sapiens
ARQQLKFEE

SEQ ID NO: 1017635 - protein, 9 aa, Homo Sapiens
FALLGFTNY

SEQ ID NO: 1017636 - protein, 9 aa, Homo Sapiens
GSPPILYFF

SEQ ID NO: 1017637 - protein, 9 aa, Homo Sapiens
FVFYLLGDA

SEQ ID NO: 1017638 - protein, 9 aa, Homo Sapiens
DFCLGVPPS

SEQ ID NO: 1017639 - protein, 9 aa, Homo Sapiens
LGQIGNLGD

SEQ ID NO: 1017640 - protein, 9 aa, Homo Sapiens
FFGNFRGNK

SEQ ID NO: 1017641 - protein, 9 aa, Homo Sapiens
GPSESRHHS

SEQ ID NO: 1017642 - protein, 9 aa, Homo Sapiens
FMMIPLCSI

SEQ ID NO: 1017643 - protein, 9 aa, Homo Sapiens
VAVATLAKK

SEQ ID NO: 1017644 - protein, 9 aa, Homo Sapiens
IDGYIMEFR

SEQ ID NO: 1017645 - protein, 9 aa, Homo Sapiens
GRDTYGVRL

SEQ ID NO: 1017646 - protein, 9 aa, Homo Sapiens
LFSVFDENQ

SEQ ID NO: 1017647 - protein, 9 aa, Homo Sapiens
RPEEEEDVV

SEQ ID NO: 1017648 - protein, 9 aa, Homo Sapiens
ARFQRTKKR

SEQ ID NO: 1017649 - protein, 9 aa, Homo Sapiens
VRCENLIVE

SEQ ID NO: 1017650 - protein, 9 aa, Homo Sapiens
KNNCPFLAD

SEQ ID NO: 1017651 - protein, 9 aa, Homo Sapiens
QVSYRAVSG

SEQ ID NO: 1017652 - protein, 9 aa, Homo Sapiens
VNFLQSYQL

SEQ ID NO: 1017653 - protein, 9 aa, Homo Sapiens
DGIHLSKPS

SEQ ID NO: 1017654 - protein, 9 aa, Homo Sapiens
PEKKDKTDS

SEQ ID NO: 1017655 - protein, 9 aa, Homo Sapiens
LTNLTGKMW

SEQ ID NO: 1017656 - protein, 9 aa, Homo Sapiens
MADGDSYNE

SEQ ID NO: 1017657 - protein, 9 aa, Homo Sapiens
FNKVVFVFY

SEQ ID NO: 1017658 - protein, 9 aa, Homo Sapiens
QQKRMSPKP

SEQ ID NO: 1017659 - protein, 9 aa, Homo Sapiens
YRTVLGMDG

SEQ ID NO: 1017660 - protein, 9 aa, Homo Sapiens
QCWTTTQEK

SEQ ID NO: 1017661 - protein, 9 aa, Homo Sapiens
NVIAIVDSL

SEQ ID NO: 1017662 - protein, 9 aa, Homo Sapiens
KLFSQIYSL

SEQ ID NO: 1017663 - protein, 9 aa, Homo Sapiens
KELRISINE

SEQ ID NO: 1017664 - protein, 9 aa, Homo Sapiens
DPLELVRTG

SEQ ID NO: 1017665 - protein, 9 aa, Homo Sapiens
EVDYFGNVL

SEQ ID NO: 1017666 - protein, 9 aa, Homo Sapiens
KNKIQASES

SEQ ID NO: 1017667 - protein, 9 aa, Homo Sapiens
DGSYFAGSQ

SEQ ID NO: 1017668 - protein, 9 aa, Homo Sapiens
VTRSVSVPN

SEQ ID NO: 1017669 - protein, 9 aa, Homo Sapiens
TTVAFEIKE

SEQ ID NO: 1017670 - protein, 9 aa, Homo Sapiens
DKIYRFNSP

SEQ ID NO: 1017671 - protein, 9 aa, Homo Sapiens
PKRNKRNRI

SEQ ID NO: 1017672 - protein, 9 aa, Homo Sapiens
LQDFTGILA

SEQ ID NO: 1017673 - protein, 9 aa, Homo Sapiens
LTEKLFEQF

SEQ ID NO: 1017674 - protein, 9 aa, Homo Sapiens
PDVGVNFLQ

SEQ ID NO: 1017675 - protein, 9 aa, Homo Sapiens
QCHLRANGY

SEQ ID NO: 1017676 - protein, 9 aa, Homo Sapiens
DGRLSRPHS

SEQ ID NO: 1017677 - protein, 9 aa, Homo Sapiens
SIMYFTEKP

SEQ ID NO: 1017678 - protein, 9 aa, Homo Sapiens
LPIDTEVYE

SEQ ID NO: 1017679 - protein, 9 aa, Homo Sapiens
SLHGNTPHA

SEQ ID NO: 1017680 - protein, 9 aa, Homo Sapiens
AAKKGQILQ

SEQ ID NO: 1017681 - protein, 9 aa, Homo Sapiens
VRIVFSNVF

SEQ ID NO: 1017682 - protein, 9 aa, Homo Sapiens
KLIGKHKDN

SEQ ID NO: 1017683 - protein, 9 aa, Homo Sapiens
DSTVITQDL

SEQ ID NO: 1017684 - protein, 9 aa, Homo Sapiens
QEGAGHSSS

SEQ ID NO: 1017685 - protein, 9 aa, Homo Sapiens
KKVAVATLA

SEQ ID NO: 1017686 - protein, 9 aa, Homo Sapiens
KKARDMLGM

SEQ ID NO: 1017687 - protein, 9 aa, Homo Sapiens
PLPPAPLSQ

SEQ ID NO: 1017688 - protein, 9 aa, Homo Sapiens
VGFILLAVL

SEQ ID NO: 1017689 - protein, 9 aa, Homo Sapiens
AMRRLQAAE

SEQ ID NO: 1017690 - protein, 9 aa, Homo Sapiens
KSAVLRTCE

SEQ ID NO: 1017691 - protein, 9 aa, Homo Sapiens
LTPSEFLKK

SEQ ID NO: 1017692 - protein, 9 aa, Homo Sapiens
VIMVFQFSS

SEQ ID NO: 1017693 - protein, 9 aa, Homo Sapiens
PTKTFPNYY

SEQ ID NO: 1017694 - protein, 9 aa, Homo Sapiens
VAALQNSDK

SEQ ID NO: 1017695 - protein, 9 aa, Homo Sapiens
PFKTNGQEN

SEQ ID NO: 1017696 - protein, 9 aa, Homo Sapiens
HGIHLETLS

SEQ ID NO: 1017697 - protein, 9 aa, Homo Sapiens
KTFIYGLLI

SEQ ID NO: 1017698 - protein, 9 aa, Homo Sapiens
KKNKLVNGH

SEQ ID NO: 1017699 - protein, 9 aa, Homo Sapiens
KQLCNVLLI

SEQ ID NO: 1017700 - protein, 9 aa, Homo Sapiens
AILNMIQVS

SEQ ID NO: 1017701 - protein, 9 aa, Homo Sapiens
TVLGMDGMK

SEQ ID NO: 1017702 - protein, 9 aa, Homo Sapiens
KPFNILILL

SEQ ID NO: 1017703 - protein, 9 aa, Homo Sapiens
ASAPILITC

SEQ ID NO: 1017704 - protein, 9 aa, Homo Sapiens
IQRDPLDLK

SEQ ID NO: 1017705 - protein, 9 aa, Homo Sapiens
VVNSWFWSR

SEQ ID NO: 1017706 - protein, 9 aa, Homo Sapiens
YVAAVRCVQ

SEQ ID NO: 1017707 - protein, 9 aa, Homo Sapiens
VDLETSGTP

SEQ ID NO: 1017708 - protein, 9 aa, Homo Sapiens
IHVAMEKNV

SEQ ID NO: 1017709 - protein, 9 aa, Homo Sapiens
PEGYHFLPA

SEQ ID NO: 1017710 - protein, 9 aa, Homo Sapiens
ALQNSDKDS

SEQ ID NO: 1017711 - protein, 9 aa, Homo Sapiens
VNYCSNHLK

SEQ ID NO: 1017712 - protein, 9 aa, Homo Sapiens
GDYYHFYHS

SEQ ID NO: 1017713 - protein, 9 aa, Homo Sapiens
LVAVRTPRE

SEQ ID NO: 1017714 - protein, 9 aa, Homo Sapiens
QETLKEDKE

SEQ ID NO: 1017715 - protein, 9 aa, Homo Sapiens
SAYKHMKLH

SEQ ID NO: 1017716 - protein, 9 aa, Homo Sapiens
VLPKDTTEY

SEQ ID NO: 1017717 - protein, 9 aa, Homo Sapiens
MRRLQAAEN

SEQ ID NO: 1017718 - protein, 9 aa, Homo Sapiens
LWGNHECRH

SEQ ID NO: 1017719 - protein, 9 aa, Homo Sapiens
LKIEIHPTS

SEQ ID NO: 1017720 - protein, 9 aa, Homo Sapiens
FFIWHNSSG

SEQ ID NO: 1017721 - protein, 9 aa, Homo Sapiens
PVLVIHGKQ

SEQ ID NO: 1017722 - protein, 9 aa, Homo Sapiens
CSELQRHNR

SEQ ID NO: 1017723 - protein, 9 aa, Homo Sapiens
SWVQVVCEN

SEQ ID NO: 1017724 - protein, 9 aa, Homo Sapiens
LGGGPEPEE

SEQ ID NO: 1017725 - protein, 9 aa, Homo Sapiens
ETEQEIEEW

SEQ ID NO: 1017726 - protein, 9 aa, Homo Sapiens
SKDLFSVTF

SEQ ID NO: 1017727 - protein, 9 aa, Homo Sapiens
EKPPELPAN

SEQ ID NO: 1017728 - protein, 9 aa, Homo Sapiens
RCHQETLKE

SEQ ID NO: 1017729 - protein, 9 aa, Homo Sapiens
GRIKIMGSA

SEQ ID NO: 1017730 - protein, 9 aa, Homo Sapiens
NLTGKMWVA

SEQ ID NO: 1017731 - protein, 9 aa, Homo Sapiens
RSHRGPSES

SEQ ID NO: 1017732 - protein, 9 aa, Homo Sapiens
SETSSQCPK

SEQ ID NO: 1017733 - protein, 9 aa, Homo Sapiens
LYFFYLDEK

SEQ ID NO: 1017734 - protein, 9 aa, Homo Sapiens
LDGTIQRDP

SEQ ID NO: 1017735 - protein, 9 aa, Homo Sapiens
QATDLEENK

SEQ ID NO: 1017736 - protein, 9 aa, Homo Sapiens
QVAASQLTC

SEQ ID NO: 1017737 - protein, 9 aa, Homo Sapiens
ECFLVPVSY

SEQ ID NO: 1017738 - protein, 9 aa, Homo Sapiens
LMFMMIPLC

SEQ ID NO: 1017739 - protein, 9 aa, Homo Sapiens
NRLSLIEHQ

SEQ ID NO: 1017740 - protein, 9 aa, Homo Sapiens
VFVFYSVVT

SEQ ID NO: 1017741 - protein, 9 aa, Homo Sapiens
KEVVLKSVL

SEQ ID NO: 1017742 - protein, 9 aa, Homo Sapiens
TKKVAVATL

SEQ ID NO: 1017743 - protein, 9 aa, Homo Sapiens
GFDVPEGSY

SEQ ID NO: 1017744 - protein, 9 aa, Homo Sapiens
RTTSLGDDL

SEQ ID NO: 1017745 - protein, 9 aa, Homo Sapiens
LVPVSYRNA

SEQ ID NO: 1017746 - protein, 9 aa, Homo Sapiens
SAAGLSSPP

SEQ ID NO: 1017747 - protein, 9 aa, Homo Sapiens
VAAPLRRAP

SEQ ID NO: 1017748 - protein, 9 aa, Homo Sapiens
ITEVSAIDI

SEQ ID NO: 1017749 - protein, 9 aa, Homo Sapiens
DGLSSQARH

SEQ ID NO: 1017750 - protein, 9 aa, Homo Sapiens
DQMTFGEKI

SEQ ID NO: 1017751 - protein, 9 aa, Homo Sapiens
NRCHQETLK

SEQ ID NO: 1017752 - protein, 9 aa, Homo Sapiens
FDKFLLILF

SEQ ID NO: 1017753 - protein, 9 aa, Homo Sapiens
NILILLTIF

SEQ ID NO: 1017754 - protein, 9 aa, Homo Sapiens
EVAFNKIAQ

SEQ ID NO: 1017755 - protein, 9 aa, Homo Sapiens
EVQATDLEE

SEQ ID NO: 1017756 - protein, 9 aa, Homo Sapiens
MYSLRPGPP

SEQ ID NO: 1017757 - protein, 9 aa, Homo Sapiens
PNEQSEDQP

SEQ ID NO: 1017758 - protein, 9 aa, Homo Sapiens
TIQRDPLDL

SEQ ID NO: 1017759 - protein, 9 aa, Homo Sapiens
NEFFWPYEL

SEQ ID NO: 1017760 - protein, 9 aa, Homo Sapiens
ANKHRVRFR

SEQ ID NO: 1017761 - protein, 9 aa, Homo Sapiens
PKTLFLLWG

SEQ ID NO: 1017762 - protein, 9 aa, Homo Sapiens
LNAQKAFIG

SEQ ID NO: 1017763 - protein, 9 aa, Homo Sapiens
HLPFMRYTP

SEQ ID NO: 1017764 - protein, 9 aa, Homo Sapiens
ADAVFSFGE

SEQ ID NO: 1017765 - protein, 9 aa, Homo Sapiens
PQREALPID

SEQ ID NO: 1017766 - protein, 9 aa, Homo Sapiens
PAAKKGQIL

SEQ ID NO: 1017767 - protein, 9 aa, Homo Sapiens
EFFWPYELS

SEQ ID NO: 1017768 - protein, 9 aa, Homo Sapiens
GAGHSSSFP

SEQ ID NO: 1017769 - protein, 9 aa, Homo Sapiens
KEEECSLPG

SEQ ID NO: 1017770 - protein, 9 aa, Homo Sapiens
FWPYELSSF

SEQ ID NO: 1017771 - protein, 9 aa, Homo Sapiens
FLYICSWLP

SEQ ID NO: 1017772 - protein, 9 aa, Homo Sapiens
DGRPISGSL

SEQ ID NO: 1017773 - protein, 9 aa, Homo Sapiens
CAGKTKRSG

SEQ ID NO: 1017774 - protein, 9 aa, Homo Sapiens
TKLEDEDED

SEQ ID NO: 1017775 - protein, 9 aa, Homo Sapiens
AGSQGHRTV

SEQ ID NO: 1017776 - protein, 9 aa, Homo Sapiens
ADDPSLSFI

SEQ ID NO: 1017777 - protein, 9 aa, Homo Sapiens
KESGQRNWV

SEQ ID NO: 1017778 - protein, 9 aa, Homo Sapiens
TIFFQGCMG

SEQ ID NO: 1017779 - protein, 9 aa, Homo Sapiens
ICIWMAEFL

SEQ ID NO: 1017780 - protein, 9 aa, Homo Sapiens
IILNYPGQI

SEQ ID NO: 1017781 - protein, 9 aa, Homo Sapiens
VAVRTPREV

SEQ ID NO: 1017782 - protein, 9 aa, Homo Sapiens
EEFTQAKVI

SEQ ID NO: 1017783 - protein, 9 aa, Homo Sapiens
FSHKSFLTC

SEQ ID NO: 1017784 - protein, 9 aa, Homo Sapiens
QSGGGGLSC

SEQ ID NO: 1017785 - protein, 9 aa, Homo Sapiens
GEARKVLEH

SEQ ID NO: 1017786 - protein, 9 aa, Homo Sapiens
PSYLSFGSW

SEQ ID NO: 1017787 - protein, 9 aa, Homo Sapiens
SGKKSASYS

SEQ ID NO: 1017788 - protein, 9 aa, Homo Sapiens
ALGLRGLKG

SEQ ID NO: 1017789 - protein, 9 aa, Homo Sapiens
VGTVANLFV

SEQ ID NO: 1017790 - protein, 9 aa, Homo Sapiens
ASSSMAGAR

SEQ ID NO: 1017791 - protein, 9 aa, Homo Sapiens
EDVVNSWFW

SEQ ID NO: 1017792 - protein, 9 aa, Homo Sapiens
DCSPSWSLP

SEQ ID NO: 1017793 - protein, 9 aa, Homo Sapiens
NYEVPKYHI

SEQ ID NO: 1017794 - protein, 9 aa, Homo Sapiens
SDNTKGFFD

SEQ ID NO: 1017795 - protein, 9 aa, Homo Sapiens
IVFSNVFNN

SEQ ID NO: 1017796 - protein, 9 aa, Homo Sapiens
KDPILKDDS

SEQ ID NO: 1017797 - protein, 9 aa, Homo Sapiens
RGTDDSSKD

SEQ ID NO: 1017798 - protein, 9 aa, Homo Sapiens
NYCSNHLKC

SEQ ID NO: 1017799 - protein, 9 aa, Homo Sapiens
SSSGKKSAS

SEQ ID NO: 1017800 - protein, 9 aa, Homo Sapiens
FTEKPPELP

SEQ ID NO: 1017801 - protein, 9 aa, Homo Sapiens
YLTEYRFYN

SEQ ID NO: 1017802 - protein, 9 aa, Homo Sapiens
PSYSRKVPM

SEQ ID NO: 1017803 - protein, 9 aa, Homo Sapiens
SALWINVAA

SEQ ID NO: 1017804 - protein, 9 aa, Homo Sapiens
GLASKEEQR

SEQ ID NO: 1017805 - protein, 9 aa, Homo Sapiens
YPQQILIQI

SEQ ID NO: 1017806 - protein, 9 aa, Homo Sapiens
IFPGNGSGK

SEQ ID NO: 1017807 - protein, 9 aa, Homo Sapiens
SGENTTPSG

SEQ ID NO: 1017808 - protein, 9 aa, Homo Sapiens
DVGVNFLQS

SEQ ID NO: 1017809 - protein, 9 aa, Homo Sapiens
YEVPKYHIP

SEQ ID NO: 1017810 - protein, 9 aa, Homo Sapiens
MLLNPECDS

SEQ ID NO: 1017811 - protein, 9 aa, Homo Sapiens
LTGKMWVAS

SEQ ID NO: 1017812 - protein, 9 aa, Homo Sapiens
TFIYGLLIG

SEQ ID NO: 1017813 - protein, 9 aa, Homo Sapiens
ETSSQCPKP

SEQ ID NO: 1017814 - protein, 9 aa, Homo Sapiens
NAIGEARKV

SEQ ID NO: 1017815 - protein, 9 aa, Homo Sapiens
LGGQSYFEG

SEQ ID NO: 1017816 - protein, 9 aa, Homo Sapiens
FALKSPSAP

SEQ ID NO: 1017817 - protein, 9 aa, Homo Sapiens
FPLRGQTSK

SEQ ID NO: 1017818 - protein, 9 aa, Homo Sapiens
KGFGQRFDL

SEQ ID NO: 1017819 - protein, 9 aa, Homo Sapiens
NSAEGRRKT

SEQ ID NO: 1017820 - protein, 9 aa, Homo Sapiens
QSSHLRTGV

SEQ ID NO: 1017821 - protein, 9 aa, Homo Sapiens
AQFSSTSGG

SEQ ID NO: 1017822 - protein, 9 aa, Homo Sapiens
YNEMNSRRR

SEQ ID NO: 1017823 - protein, 9 aa, Homo Sapiens
RDTYGVRLL

SEQ ID NO: 1017824 - protein, 9 aa, Homo Sapiens
AASLHELCV

SEQ ID NO: 1017825 - protein, 9 aa, Homo Sapiens
KNVFWECKA

SEQ ID NO: 1017826 - protein, 9 aa, Homo Sapiens
PDVQLRFSL

SEQ ID NO: 1017827 - protein, 9 aa, Homo Sapiens
PLGLPHTKL

SEQ ID NO: 1017828 - protein, 9 aa, Homo Sapiens
VYLWSACIS

SEQ ID NO: 1017829 - protein, 9 aa, Homo Sapiens
EIRKANILI

SEQ ID NO: 1017830 - protein, 9 aa, Homo Sapiens
DPARGRPGF

SEQ ID NO: 1017831 - protein, 9 aa, Homo Sapiens
SLESTKVEA

SEQ ID NO: 1017832 - protein, 9 aa, Homo Sapiens
CHQETLKED

SEQ ID NO: 1017833 - protein, 9 aa, Homo Sapiens
SMAIIVPPA

SEQ ID NO: 1017834 - protein, 9 aa, Homo Sapiens
DLETSGTPV

SEQ ID NO: 1017835 - protein, 9 aa, Homo Sapiens
KKEVVLKSV

SEQ ID NO: 1017836 - protein, 9 aa, Homo Sapiens
MKRSLEKAR

SEQ ID NO: 1017837 - protein, 9 aa, Homo Sapiens
IHPTSLTKT

SEQ ID NO: 1017838 - protein, 9 aa, Homo Sapiens
EALPIDTEV

SEQ ID NO: 1017839 - protein, 9 aa, Homo Sapiens
LAKVQALSR

SEQ ID NO: 1017840 - protein, 9 aa, Homo Sapiens
CSSALMQHK

SEQ ID NO: 1017841 - protein, 9 aa, Homo Sapiens
ILCRIRKHS

SEQ ID NO: 1017842 - protein, 9 aa, Homo Sapiens
YQPLWEVLP

SEQ ID NO: 1017843 - protein, 9 aa, Homo Sapiens
RKHEAFLLF

SEQ ID NO: 1017844 - protein, 9 aa, Homo Sapiens
GIPRPPSKS

SEQ ID NO: 1017845 - protein, 9 aa, Homo Sapiens
PGPPDTGVS

SEQ ID NO: 1017846 - protein, 9 aa, Homo Sapiens
DYLTANKHR

SEQ ID NO: 1017847 - protein, 9 aa, Homo Sapiens
YLKEKQLCN

SEQ ID NO: 1017848 - protein, 9 aa, Homo Sapiens
EVPKYHIPY

SEQ ID NO: 1017849 - protein, 9 aa, Homo Sapiens
AVPPGPSLS

SEQ ID NO: 1017850 - protein, 9 aa, Homo Sapiens
LLEEFTQAK

SEQ ID NO: 1017851 - protein, 9 aa, Homo Sapiens
VPRNPEKNE

SEQ ID NO: 1017852 - protein, 9 aa, Homo Sapiens
ANILIMDTG

SEQ ID NO: 1017853 - protein, 9 aa, Homo Sapiens
PSESRHHSP

SEQ ID NO: 1017854 - protein, 9 aa, Homo Sapiens
MELLWEKEE

SEQ ID NO: 1017855 - protein, 9 aa, Homo Sapiens
NGVKPLQKQ

SEQ ID NO: 1017856 - protein, 9 aa, Homo Sapiens
ARSFALERP

SEQ ID NO: 1017857 - protein, 9 aa, Homo Sapiens
MVFQFSSTE

SEQ ID NO: 1017858 - protein, 9 aa, Homo Sapiens
FIIFEAALQ

SEQ ID NO: 1017859 - protein, 9 aa, Homo Sapiens
SSGKKSASY

SEQ ID NO: 1017860 - protein, 9 aa, Homo Sapiens
SLSFIKYGE

SEQ ID NO: 1017861 - protein, 9 aa, Homo Sapiens
HREVAFNKI

SEQ ID NO: 1017862 - protein, 9 aa, Homo Sapiens
GKKSASYSS

SEQ ID NO: 1017863 - protein, 9 aa, Homo Sapiens
PEPKKEVVL

SEQ ID NO: 1017864 - protein, 9 aa, Homo Sapiens
LRPGPPDTG

SEQ ID NO: 1017865 - protein, 9 aa, Homo Sapiens
PRNPEKNEA

SEQ ID NO: 1017866 - protein, 9 aa, Homo Sapiens
GKTFSHKSF

SEQ ID NO: 1017867 - protein, 9 aa, Homo Sapiens
KIKNTISYS

SEQ ID NO: 1017868 - protein, 9 aa, Homo Sapiens
REVAFNKIA

SEQ ID NO: 1017869 - protein, 9 aa, Homo Sapiens
QPFLGRIKI

SEQ ID NO: 1017870 - protein, 9 aa, Homo Sapiens
RKLGGFPII

SEQ ID NO: 1017871 - protein, 9 aa, Homo Sapiens
RCSSGEFGS

SEQ ID NO: 1017872 - protein, 9 aa, Homo Sapiens
DENQSWYLT

SEQ ID NO: 1017873 - protein, 9 aa, Homo Sapiens
WEENTVYQE

SEQ ID NO: 1017874 - protein, 9 aa, Homo Sapiens
LFEQFSKLH

SEQ ID NO: 1017875 - protein, 9 aa, Homo Sapiens
NPEKNEAIA

SEQ ID NO: 1017876 - protein, 9 aa, Homo Sapiens
PLELVRTGA

SEQ ID NO: 1017877 - protein, 9 aa, Homo Sapiens
FMLLLSKVE

SEQ ID NO: 1017878 - protein, 9 aa, Homo Sapiens
GLHVFNLPK

SEQ ID NO: 1017879 - protein, 9 aa, Homo Sapiens
KEMKRSLEK

SEQ ID NO: 1017880 - protein, 9 aa, Homo Sapiens
PLELVRTGF

SEQ ID NO: 1017881 - protein, 9 aa, Homo Sapiens
LSPVSAAPS

SEQ ID NO: 1017882 - protein, 9 aa, Homo Sapiens
EQHGDYDLN

SEQ ID NO: 1017883 - protein, 9 aa, Homo Sapiens
QENHATPGS

SEQ ID NO: 1017884 - protein, 9 aa, Homo Sapiens
DLSPVSAAP

SEQ ID NO: 1017885 - protein, 9 aa, Homo Sapiens
RPSPAFSEC

SEQ ID NO: 1017886 - protein, 9 aa, Homo Sapiens
EEECSLPGL

SEQ ID NO: 1017887 - protein, 9 aa, Homo Sapiens
RTSVGFGTY

SEQ ID NO: 1017888 - protein, 9 aa, Homo Sapiens
LEASLESTK

SEQ ID NO: 1017889 - protein, 9 aa, Homo Sapiens
PADGRLSRP

SEQ ID NO: 1017890 - protein, 9 aa, Homo Sapiens
LYPIKQCRV

SEQ ID NO: 1017891 - protein, 9 aa, Homo Sapiens
RFQRTKKRE

SEQ ID NO: 1017892 - protein, 9 aa, Homo Sapiens
GLSCTAGTP

SEQ ID NO: 1017893 - protein, 9 aa, Homo Sapiens
VLPNVAFNS

SEQ ID NO: 1017894 - protein, 9 aa, Homo Sapiens
RWPQSSHLR

SEQ ID NO: 1017895 - protein, 9 aa, Homo Sapiens
TGILAMVDF

SEQ ID NO: 1017896 - protein, 9 aa, Homo Sapiens
LFFIWHNSS

SEQ ID NO: 1017897 - protein, 9 aa, Homo Sapiens
YLEWEQKCF

SEQ ID NO: 1017898 - protein, 9 aa, Homo Sapiens
LAQLKNLYL

SEQ ID NO: 1017899 - protein, 9 aa, Homo Sapiens
SFSDVLCLG

SEQ ID NO: 1017900 - protein, 9 aa, Homo Sapiens
YSNYAGNPA

SEQ ID NO: 1017901 - protein, 9 aa, Homo Sapiens
FAGSQGHRT

SEQ ID NO: 1017902 - protein, 9 aa, Homo Sapiens
VKKESGSLA

SEQ ID NO: 1017903 - protein, 9 aa, Homo Sapiens
PRWPQSSHL

SEQ ID NO: 1017904 - protein, 9 aa, Homo Sapiens
HSSSFPYSP

SEQ ID NO: 1017905 - protein, 9 aa, Homo Sapiens
GNGSGKQET

SEQ ID NO: 1017906 - protein, 9 aa, Homo Sapiens
VKQVGDGER

SEQ ID NO: 1017907 - protein, 9 aa, Homo Sapiens
HDEYKPLKK

SEQ ID NO: 1017908 - protein, 9 aa, Homo Sapiens
GKKNEKKGK

SEQ ID NO: 1017909 - protein, 9 aa, Homo Sapiens
LNGSNSLSS

SEQ ID NO: 1017910 - protein, 9 aa, Homo Sapiens
KTFPNYYSI

SEQ ID NO: 1017911 - protein, 9 aa, Homo Sapiens
RNKRNRIFQ

SEQ ID NO: 1017912 - protein, 9 aa, Homo Sapiens
LLQQQQQTQ

SEQ ID NO: 1017913 - protein, 9 aa, Homo Sapiens
SRALPAQNP

SEQ ID NO: 1017914 - protein, 9 aa, Homo Sapiens
LKKHVDALR

SEQ ID NO: 1017915 - protein, 9 aa, Homo Sapiens
EDALRLGLV

SEQ ID NO: 1017916 - protein, 9 aa, Homo Sapiens
LMHQKQLKV

SEQ ID NO: 1017917 - protein, 9 aa, Homo Sapiens
FHLATLQGL

SEQ ID NO: 1017918 - protein, 9 aa, Homo Sapiens
RQLLAKVQA

SEQ ID NO: 1017919 - protein, 9 aa, Homo Sapiens
ECDSWPLDM

SEQ ID NO: 1017920 - protein, 9 aa, Homo Sapiens
EENEGFCGE

SEQ ID NO: 1017921 - protein, 9 aa, Homo Sapiens
RIFQDSQDT

SEQ ID NO: 1017922 - protein, 9 aa, Homo Sapiens
YALLEEFTQ

SEQ ID NO: 1017923 - protein, 9 aa, Homo Sapiens
QQLKFEEAE

SEQ ID NO: 1017924 - protein, 9 aa, Homo Sapiens
NTKGFFDPN

SEQ ID NO: 1017925 - protein, 9 aa, Homo Sapiens
PSSHPVFLN

SEQ ID NO: 1017926 - protein, 9 aa, Homo Sapiens
PSMFPLGVA

SEQ ID NO: 1017927 - protein, 9 aa, Homo Sapiens
KNKLVNGHT

SEQ ID NO: 1017928 - protein, 9 aa, Homo Sapiens
FYFRSPGRD

SEQ ID NO: 1017929 - protein, 9 aa, Homo Sapiens
TQDAAGVGL

SEQ ID NO: 1017930 - protein, 9 aa, Homo Sapiens
DSSKDSQED

SEQ ID NO: 1017931 - protein, 9 aa, Homo Sapiens
RCHCRLHTG

SEQ ID NO: 1017932 - protein, 9 aa, Homo Sapiens
RPGPPDTGV

SEQ ID NO: 1017933 - protein, 9 aa, Homo Sapiens
PISIQSKPP

SEQ ID NO: 1017934 - protein, 9 aa, Homo Sapiens
ETIRKLGGF

SEQ ID NO: 1017935 - protein, 9 aa, Homo Sapiens
EIYSAESRD

SEQ ID NO: 1017936 - protein, 9 aa, Homo Sapiens
LSAASPETA

SEQ ID NO: 1017937 - protein, 9 aa, Homo Sapiens
FKKINRDKT

SEQ ID NO: 1017938 - protein, 9 aa, Homo Sapiens
LEEFTQAKV

SEQ ID NO: 1017939 - protein, 9 aa, Homo Sapiens
WTTTQEKIF

SEQ ID NO: 1017940 - protein, 9 aa, Homo Sapiens
RPPSKSAVL

SEQ ID NO: 1017941 - protein, 9 aa, Homo Sapiens
STLLSSVTS

SEQ ID NO: 1017942 - protein, 9 aa, Homo Sapiens
PILYFFYLD

SEQ ID NO: 1017943 - protein, 9 aa, Homo Sapiens
KNEKKGKKD

SEQ ID NO: 1017944 - protein, 9 aa, Homo Sapiens
SPNGNLFSF

SEQ ID NO: 1017945 - protein, 9 aa, Homo Sapiens
IFDCSKDLF

SEQ ID NO: 1017946 - protein, 9 aa, Homo Sapiens
RLQAAENAV

SEQ ID NO: 1017947 - protein, 9 aa, Homo Sapiens
NTPHASNLS

SEQ ID NO: 1017948 - protein, 9 aa, Homo Sapiens
RRGYFQLFT

SEQ ID NO: 1017949 - protein, 9 aa, Homo Sapiens
MLLLSKVER

SEQ ID NO: 1017950 - protein, 9 aa, Homo Sapiens
TVANLFVAG

SEQ ID NO: 1017951 - protein, 9 aa, Homo Sapiens
GRRSRPRAL

SEQ ID NO: 1017952 - protein, 9 aa, Homo Sapiens
KIHFSIFRD

SEQ ID NO: 1017953 - protein, 9 aa, Homo Sapiens
DSEYKESGQ

SEQ ID NO: 1017954 - protein, 9 aa, Homo Sapiens
SVTSRTTMT

SEQ ID NO: 1017955 - protein, 9 aa, Homo Sapiens
MRQFAIDAA

SEQ ID NO: 1017956 - protein, 9 aa, Homo Sapiens
DLPVLVIHG

SEQ ID NO: 1017957 - protein, 9 aa, Homo Sapiens
APLRRAPFK

SEQ ID NO: 1017958 - protein, 9 aa, Homo Sapiens
FSFGELLAE

SEQ ID NO: 1017959 - protein, 9 aa, Homo Sapiens
HNSRAQFSS

SEQ ID NO: 1017960 - protein, 9 aa, Homo Sapiens
EYKPLKKHV

SEQ ID NO: 1017961 - protein, 9 aa, Homo Sapiens
ILCVERGWS

SEQ ID NO: 1017962 - protein, 9 aa, Homo Sapiens
HELCVARVS

SEQ ID NO: 1017963 - protein, 9 aa, Homo Sapiens
FLLFSLGKR

SEQ ID NO: 1017964 - protein, 9 aa, Homo Sapiens
SSHLRTGVP

SEQ ID NO: 1017965 - protein, 9 aa, Homo Sapiens
VLEASLEST

SEQ ID NO: 1017966 - protein, 9 aa, Homo Sapiens
DKRALCQET

SEQ ID NO: 1017967 - protein, 9 aa, Homo Sapiens
KKINRDKTD

SEQ ID NO: 1017968 - protein, 9 aa, Homo Sapiens
LQCSLHGNT

SEQ ID NO: 1017969 - protein, 9 aa, Homo Sapiens
TQIKFPLAF

SEQ ID NO: 1017970 - protein, 9 aa, Homo Sapiens
LWHVGFILL

SEQ ID NO: 1017971 - protein, 9 aa, Homo Sapiens
TINQINNKL

SEQ ID NO: 1017972 - protein, 9 aa, Homo Sapiens
DNAEPWGQP

SEQ ID NO: 1017973 - protein, 9 aa, Homo Sapiens
RKLLCKPSG

SEQ ID NO: 1017974 - protein, 9 aa, Homo Sapiens
TNGQENHAT

SEQ ID NO: 1017975 - protein, 9 aa, Homo Sapiens
DITPSMAII

SEQ ID NO: 1017976 - protein, 9 aa, Homo Sapiens
PISDSLNLT

SEQ ID NO: 1017977 - protein, 9 aa, Homo Sapiens
KHSSEGKSK

SEQ ID NO: 1017978 - protein, 9 aa, Homo Sapiens
ESGSLAAGI

SEQ ID NO: 1017979 - protein, 9 aa, Homo Sapiens
LVSDILSCK

SEQ ID NO: 1017980 - protein, 9 aa, Homo Sapiens
AMRQFAIDA

SEQ ID NO: 1017981 - protein, 9 aa, Homo Sapiens
SRYTDCCLC

SEQ ID NO: 1017982 - protein, 9 aa, Homo Sapiens
ILNYPGQIS

SEQ ID NO: 1017983 - protein, 9 aa, Homo Sapiens
SYNEMNSRR

SEQ ID NO: 1017984 - protein, 9 aa, Homo Sapiens
NTVQSLTQG

SEQ ID NO: 1017985 - protein, 9 aa, Homo Sapiens
WPYELSSFD

SEQ ID NO: 1017986 - protein, 9 aa, Homo Sapiens
SRTTMTMQT

SEQ ID NO: 1017987 - protein, 9 aa, Homo Sapiens
LATFNKIST

SEQ ID NO: 1017988 - protein, 9 aa, Homo Sapiens
AIVDSLTRE

SEQ ID NO: 1017989 - protein, 9 aa, Homo Sapiens
VQATDLEEN

SEQ ID NO: 1017990 - protein, 9 aa, Homo Sapiens
SEYKESGQR

SEQ ID NO: 1017991 - protein, 9 aa, Homo Sapiens
TPSMAIIVP

SEQ ID NO: 1017992 - protein, 9 aa, Homo Sapiens
PERKPEPKK

SEQ ID NO: 1017993 - protein, 9 aa, Homo Sapiens
VAEAQKGEL

SEQ ID NO: 1017994 - protein, 9 aa, Homo Sapiens
VFSFPPDPL

SEQ ID NO: 1017995 - protein, 9 aa, Homo Sapiens
VAFNSTAYD

SEQ ID NO: 1017996 - protein, 9 aa, Homo Sapiens
HPFLFFIWH

SEQ ID NO: 1017997 - protein, 9 aa, Homo Sapiens
VPNTGSIWE

SEQ ID NO: 1017998 - protein, 9 aa, Homo Sapiens
LFMSVLDQD

SEQ ID NO: 1017999 - protein, 9 aa, Homo Sapiens
WPQSSHLRT

SEQ ID NO: 1018000 - protein, 9 aa, Homo Sapiens
LQNNEKNIL

SEQ ID NO: 1018001 - protein, 9 aa, Homo Sapiens
EVLLHWDPP

SEQ ID NO: 1018002 - protein, 9 aa, Homo Sapiens
HRFSSWESR

SEQ ID NO: 1018003 - protein, 9 aa, Homo Sapiens
REALPIDTE

SEQ ID NO: 1018004 - protein, 9 aa, Homo Sapiens
SCEYKMKNV

SEQ ID NO: 1018005 - protein, 9 aa, Homo Sapiens
DTYGVRLLF

SEQ ID NO: 1018006 - protein, 9 aa, Homo Sapiens
TKKREEDRC

SEQ ID NO: 1018007 - protein, 9 aa, Homo Sapiens
CENLIVEGR

SEQ ID NO: 1018008 - protein, 9 aa, Homo Sapiens
NDIHVAMEK

SEQ ID NO: 1018009 - protein, 9 aa, Homo Sapiens
RASHGSVFY

SEQ ID NO: 1018010 - protein, 9 aa, Homo Sapiens
FNRKRKSFS

SEQ ID NO: 1018011 - protein, 9 aa, Homo Sapiens
TKQTLKAHQ

SEQ ID NO: 1018012 - protein, 9 aa, Homo Sapiens
IRDSNCSTL

SEQ ID NO: 1018013 - protein, 9 aa, Homo Sapiens
SGKGLAEGT

SEQ ID NO: 1018014 - protein, 9 aa, Homo Sapiens
GSLFYIALP

SEQ ID NO: 1018015 - protein, 9 aa, Homo Sapiens
LKEMKRSLE

SEQ ID NO: 1018016 - protein, 9 aa, Homo Sapiens
NLLGMEGLL

SEQ ID NO: 1018017 - protein, 9 aa, Homo Sapiens
LLGMEGLLT

SEQ ID NO: 1018018 - protein, 9 aa, Homo Sapiens
VQIMKEMEA

SEQ ID NO: 1018019 - protein, 9 aa, Homo Sapiens
DTPSGKGLA

SEQ ID NO: 1018020 - protein, 9 aa, Homo Sapiens
CSPSWSLPI

SEQ ID NO: 1018021 - protein, 9 aa, Homo Sapiens
RQVLFLFFF

SEQ ID NO: 1018022 - protein, 9 aa, Homo Sapiens
PPGRRSRPR

SEQ ID NO: 1018023 - protein, 9 aa, Homo Sapiens
ALMELLWEK

SEQ ID NO: 1018024 - protein, 9 aa, Homo Sapiens
IWHNSSGSI

SEQ ID NO: 1018025 - protein, 9 aa, Homo Sapiens
ATEKSRWSG

SEQ ID NO: 1018026 - protein, 9 aa, Homo Sapiens
ALPAQNPPM

SEQ ID NO: 1018027 - protein, 9 aa, Homo Sapiens
KTCEIVNYC

SEQ ID NO: 1018028 - protein, 9 aa, Homo Sapiens
CRLHTGIKP

SEQ ID NO: 1018029 - protein, 9 aa, Homo Sapiens
VEWKPFNIL

SEQ ID NO: 1018030 - protein, 9 aa, Homo Sapiens
MPDRTLGLT

SEQ ID NO: 1018031 - protein, 9 aa, Homo Sapiens
EEVETCDKR

SEQ ID NO: 1018032 - protein, 9 aa, Homo Sapiens
ICSWLPCIF

SEQ ID NO: 1018033 - protein, 9 aa, Homo Sapiens
KLAGPGSTG

SEQ ID NO: 1018034 - protein, 9 aa, Homo Sapiens
DIAESQVNR

SEQ ID NO: 1018035 - protein, 9 aa, Homo Sapiens
KQEEYSQSL

SEQ ID NO: 1018036 - protein, 9 aa, Homo Sapiens
IQASYFVEG

SEQ ID NO: 1018037 - protein, 9 aa, Homo Sapiens
KKNEKKGKK

SEQ ID NO: 1018038 - protein, 9 aa, Homo Sapiens
ILANAGLGT

SEQ ID NO: 1018039 - protein, 9 aa, Homo Sapiens
FKESEVLEF

SEQ ID NO: 1018040 - protein, 9 aa, Homo Sapiens
AVPRNPEKN

SEQ ID NO: 1018041 - protein, 9 aa, Homo Sapiens
IAIVDSLTR

SEQ ID NO: 1018042 - protein, 9 aa, Homo Sapiens
VMSSTAISL

SEQ ID NO: 1018043 - protein, 9 aa, Homo Sapiens
ITNVRIVFS

SEQ ID NO: 1018044 - protein, 9 aa, Homo Sapiens
MTTVRCENL

SEQ ID NO: 1018045 - protein, 9 aa, Homo Sapiens
NYPGQISAG

SEQ ID NO: 1018046 - protein, 9 aa, Homo Sapiens
TPSEFLKKM

SEQ ID NO: 1018047 - protein, 9 aa, Homo Sapiens
AQKGELGAS

SEQ ID NO: 1018048 - protein, 9 aa, Homo Sapiens
KEFYSHLTS

SEQ ID NO: 1018049 - protein, 9 aa, Homo Sapiens
WVEDPKKLI

SEQ ID NO: 1018050 - protein, 9 aa, Homo Sapiens
FIGIEDPVT

SEQ ID NO: 1018051 - protein, 9 aa, Homo Sapiens
SINFNKVVF

SEQ ID NO: 1018052 - protein, 9 aa, Homo Sapiens
PHPANISFR

SEQ ID NO: 1018053 - protein, 9 aa, Homo Sapiens
SSVGSLFYI

SEQ ID NO: 1018054 - protein, 9 aa, Homo Sapiens
GDPSASSSM

SEQ ID NO: 1018055 - protein, 9 aa, Homo Sapiens
GNLLFMSVL

SEQ ID NO: 1018056 - protein, 9 aa, Homo Sapiens
HMVLNKKFG

SEQ ID NO: 1018057 - protein, 9 aa, Homo Sapiens
SASAPILIT

SEQ ID NO: 1018058 - protein, 9 aa, Homo Sapiens
AAETEQEIE

SEQ ID NO: 1018059 - protein, 9 aa, Homo Sapiens
NGSGKQETR

SEQ ID NO: 1018060 - protein, 9 aa, Homo Sapiens
RQQLKFEEA

SEQ ID NO: 1018061 - protein, 9 aa, Homo Sapiens
LGDYYHFYH

SEQ ID NO: 1018062 - protein, 9 aa, Homo Sapiens
YLSFGSWYS

SEQ ID NO: 1018063 - protein, 9 aa, Homo Sapiens
CSWLPCIFF

SEQ ID NO: 1018064 - protein, 9 aa, Homo Sapiens
AIDAAATAA

SEQ ID NO: 1018065 - protein, 9 aa, Homo Sapiens
PDGQGLHVF

SEQ ID NO: 1018066 - protein, 9 aa, Homo Sapiens
NGSNSLSSI

SEQ ID NO: 1018067 - protein, 9 aa, Homo Sapiens
RAMLLSFSD

SEQ ID NO: 1018068 - protein, 9 aa, Homo Sapiens
PTGDSGPPP

SEQ ID NO: 1018069 - protein, 9 aa, Homo Sapiens
ASKEEQRRA

SEQ ID NO: 1018070 - protein, 9 aa, Homo Sapiens
FLFFIWHNS

SEQ ID NO: 1018071 - protein, 9 aa, Homo Sapiens
SSFPYSPSE

SEQ ID NO: 1018072 - protein, 9 aa, Homo Sapiens
FGNFRGNKI

SEQ ID NO: 1018073 - protein, 9 aa, Homo Sapiens
CPECGKLFS

SEQ ID NO: 1018074 - protein, 9 aa, Homo Sapiens
HQETLKEDK

SEQ ID NO: 1018075 - protein, 9 aa, Homo Sapiens
QCLHVLMGY

SEQ ID NO: 1018076 - protein, 9 aa, Homo Sapiens
VTSRTTMTM

SEQ ID NO: 1018077 - protein, 9 aa, Homo Sapiens
CSLHGNTPH

SEQ ID NO: 1018078 - protein, 9 aa, Homo Sapiens
ASSSQQKRM

SEQ ID NO: 1018079 - protein, 9 aa, Homo Sapiens
ASHFRTTSL

SEQ ID NO: 1018080 - protein, 9 aa, Homo Sapiens
HKSFLTCHR

SEQ ID NO: 1018081 - protein, 9 aa, Homo Sapiens
GGHITEVSA

SEQ ID NO: 1018082 - protein, 9 aa, Homo Sapiens
PHTKLEDED

SEQ ID NO: 1018083 - protein, 9 aa, Homo Sapiens
DSWPLDMQP

SEQ ID NO: 1018084 - protein, 9 aa, Homo Sapiens
LQKQPLAKD

SEQ ID NO: 1018085 - protein, 9 aa, Homo Sapiens
WVKKNKLVN

SEQ ID NO: 1018086 - protein, 9 aa, Homo Sapiens
LTSALWINV

SEQ ID NO: 1018087 - protein, 9 aa, Homo Sapiens
APRWPQSSH

SEQ ID NO: 1018088 - protein, 9 aa, Homo Sapiens
SLHELCVAR

SEQ ID NO: 1018089 - protein, 9 aa, Homo Sapiens
LNPECDSWP

SEQ ID NO: 1018090 - protein, 9 aa, Homo Sapiens
PPSLSAASS

SEQ ID NO: 1018091 - protein, 9 aa, Homo Sapiens
PSGKGLAEG

SEQ ID NO: 1018092 - protein, 9 aa, Homo Sapiens
YEEKELRIS

SEQ ID NO: 1018093 - protein, 9 aa, Homo Sapiens
SVFDENQSW

SEQ ID NO: 1018094 - protein, 9 aa, Homo Sapiens
VNRLRAKSR

SEQ ID NO: 1018095 - protein, 9 aa, Homo Sapiens
VEDPKKLIG

SEQ ID NO: 1018096 - protein, 9 aa, Homo Sapiens
SPQYPHNGR

SEQ ID NO: 1018097 - protein, 9 aa, Homo Sapiens
TSVGFGTYD

SEQ ID NO: 1018098 - protein, 9 aa, Homo Sapiens
FVKQVGDGE

SEQ ID NO: 1018099 - protein, 9 aa, Homo Sapiens
EKDPGVLDE

SEQ ID NO: 1018100 - protein, 9 aa, Homo Sapiens
LHNMILGLP

SEQ ID NO: 1018101 - protein, 9 aa, Homo Sapiens
HSSSGKKSA

SEQ ID NO: 1018102 - protein, 9 aa, Homo Sapiens
DPSASSSMA

SEQ ID NO: 1018103 - protein, 9 aa, Homo Sapiens
KLGYSYAID

SEQ ID NO: 1018104 - protein, 9 aa, Homo Sapiens
RVAPLVKLL

SEQ ID NO: 1018105 - protein, 9 aa, Homo Sapiens
FPERFSAST

SEQ ID NO: 1018106 - protein, 9 aa, Homo Sapiens
GDGERLVPV

SEQ ID NO: 1018107 - protein, 9 aa, Homo Sapiens
LRCHCRLHT

SEQ ID NO: 1018108 - protein, 9 aa, Homo Sapiens
ILTGLNYEV

SEQ ID NO: 1018109 - protein, 9 aa, Homo Sapiens
GIFPGNGSG

SEQ ID NO: 1018110 - protein, 9 aa, Homo Sapiens
ATLAKKAAV

SEQ ID NO: 1018111 - protein, 9 aa, Homo Sapiens
FLPAYLNSL

SEQ ID NO: 1018112 - protein, 9 aa, Homo Sapiens
DWATQKNKI

SEQ ID NO: 1018113 - protein, 9 aa, Homo Sapiens
FIWHNSSGS

SEQ ID NO: 1018114 - protein, 9 aa, Homo Sapiens
LGFTNYPKL

SEQ ID NO: 1018115 - protein, 9 aa, Homo Sapiens
LESLCSELQ

SEQ ID NO: 1018116 - protein, 9 aa, Homo Sapiens
PAFSECASL

SEQ ID NO: 1018117 - protein, 9 aa, Homo Sapiens
ANISFRQPP

SEQ ID NO: 1018118 - protein, 9 aa, Homo Sapiens
AVFSFGELL

SEQ ID NO: 1018119 - protein, 9 aa, Homo Sapiens
PSLSGGLSP

SEQ ID NO: 1018120 - protein, 9 aa, Homo Sapiens
VFQFSSTEQ

SEQ ID NO: 1018121 - protein, 9 aa, Homo Sapiens
LKYLFSLNE

SEQ ID NO: 1018122 - protein, 9 aa, Homo Sapiens
VGITNVRIV

SEQ ID NO: 1018123 - protein, 9 aa, Homo Sapiens
EENTVYQEA

SEQ ID NO: 1018124 - protein, 9 aa, Homo Sapiens
WDTPSGKGL

SEQ ID NO: 1018125 - protein, 9 aa, Homo Sapiens
QHTVVLEGP

SEQ ID NO: 1018126 - protein, 9 aa, Homo Sapiens
CEYKMKNVT

SEQ ID NO: 1018127 - protein, 9 aa, Homo Sapiens
LSSKPEDNA

SEQ ID NO: 1018128 - protein, 9 aa, Homo Sapiens
IPGRTSVGF

SEQ ID NO: 1018129 - protein, 9 aa, Homo Sapiens
RKEEECSLP

SEQ ID NO: 1018130 - protein, 9 aa, Homo Sapiens
FVFYSVVTP

SEQ ID NO: 1018131 - protein, 9 aa, Homo Sapiens
NKVVFVFYS

SEQ ID NO: 1018132 - protein, 9 aa, Homo Sapiens
FFFWGVSLA

SEQ ID NO: 1018133 - protein, 9 aa, Homo Sapiens
KRKSFSSLK

SEQ ID NO: 1018134 - protein, 9 aa, Homo Sapiens
AGKTKRSGG

SEQ ID NO: 1018135 - protein, 9 aa, Homo Sapiens
HNVLEKDFL

SEQ ID NO: 1018136 - protein, 9 aa, Homo Sapiens
TPTVDLETS

SEQ ID NO: 1018137 - protein, 9 aa, Homo Sapiens
KHEAFLLFS

SEQ ID NO: 1018138 - protein, 9 aa, Homo Sapiens
YTDCCLCVA

SEQ ID NO: 1018139 - protein, 9 aa, Homo Sapiens
NSLSSISLP

SEQ ID NO: 1018140 - protein, 9 aa, Homo Sapiens
DFLKEKEQE

SEQ ID NO: 1018141 - protein, 9 aa, Homo Sapiens
LSLIEHQRI

SEQ ID NO: 1018142 - protein, 9 aa, Homo Sapiens
KNLYLKKPK

SEQ ID NO: 1018143 - protein, 9 aa, Homo Sapiens
ELCVARVSE

SEQ ID NO: 1018144 - protein, 9 aa, Homo Sapiens
SALKIEIHP

SEQ ID NO: 1018145 - protein, 9 aa, Homo Sapiens
SRVAPLVKL

SEQ ID NO: 1018146 - protein, 9 aa, Homo Sapiens
KIEIHPTSL

SEQ ID NO: 1018147 - protein, 9 aa, Homo Sapiens
FKTNGQENH

SEQ ID NO: 1018148 - protein, 9 aa, Homo Sapiens
SGQPYQPLW

SEQ ID NO: 1018149 - protein, 9 aa, Homo Sapiens
ESAPVGAPI

SEQ ID NO: 1018150 - protein, 9 aa, Homo Sapiens
SNFDDYEEK

SEQ ID NO: 1018151 - protein, 9 aa, Homo Sapiens
DFPERFSAS

SEQ ID NO: 1018152 - protein, 9 aa, Homo Sapiens
KLKEMKRSL

SEQ ID NO: 1018153 - protein, 9 aa, Homo Sapiens
GSVFYFRSP

SEQ ID NO: 1018154 - protein, 9 aa, Homo Sapiens
SLSGGLSPD

SEQ ID NO: 1018155 - protein, 9 aa, Homo Sapiens
IGLMFMMIP

SEQ ID NO: 1018156 - protein, 9 aa, Homo Sapiens
DDPSLSFIK

SEQ ID NO: 1018157 - protein, 9 aa, Homo Sapiens
YFVEGRFSV

SEQ ID NO: 1018158 - protein, 9 aa, Homo Sapiens
LKKPKDEAF

SEQ ID NO: 1018159 - protein, 9 aa, Homo Sapiens
KLLCKPSGD

SEQ ID NO: 1018160 - protein, 9 aa, Homo Sapiens
YPDPSAGAK

SEQ ID NO: 1018161 - protein, 9 aa, Homo Sapiens
SWPLDMQPL

SEQ ID NO: 1018162 - protein, 9 aa, Homo Sapiens
AANQSRACR

SEQ ID NO: 1018163 - protein, 9 aa, Homo Sapiens
DLFKKINRD

SEQ ID NO: 1018164 - protein, 9 aa, Homo Sapiens
SASSNFFYE

SEQ ID NO: 1018165 - protein, 9 aa, Homo Sapiens
IKNAIGEAR

SEQ ID NO: 1018166 - protein, 9 aa, Homo Sapiens
VARVADAIL

SEQ ID NO: 1018167 - protein, 9 aa, Homo Sapiens
PPLHRFSSW

SEQ ID NO: 1018168 - protein, 9 aa, Homo Sapiens
GLRGLKGDL

SEQ ID NO: 1018169 - protein, 9 aa, Homo Sapiens
FPSASSNFF

SEQ ID NO: 1018170 - protein, 9 aa, Homo Sapiens
DPSDNTKGF

SEQ ID NO: 1018171 - protein, 9 aa, Homo Sapiens
FLADENYRP

SEQ ID NO: 1018172 - protein, 9 aa, Homo Sapiens
CSRINKTFI

SEQ ID NO: 1018173 - protein, 9 aa, Homo Sapiens
CNVPQVIKL

SEQ ID NO: 1018174 - protein, 9 aa, Homo Sapiens
QKNKIQASE

SEQ ID NO: 1018175 - protein, 9 aa, Homo Sapiens
KPPISIQSK

SEQ ID NO: 1018176 - protein, 9 aa, Homo Sapiens
GHSSSFPYS

SEQ ID NO: 1018177 - protein, 9 aa, Homo Sapiens
DSLGTFVFY

SEQ ID NO: 1018178 - protein, 9 aa, Homo Sapiens
ATFNKISTL

SEQ ID NO: 1018179 - protein, 9 aa, Homo Sapiens
WEVLPGNRR

SEQ ID NO: 1018180 - protein, 9 aa, Homo Sapiens
WHVGFILLA

SEQ ID NO: 1018181 - protein, 9 aa, Homo Sapiens
GEKEIQKPE

SEQ ID NO: 1018182 - protein, 9 aa, Homo Sapiens
KKHVDALRM

SEQ ID NO: 1018183 - protein, 9 aa, Homo Sapiens
KHVDALRMT

SEQ ID NO: 1018184 - protein, 9 aa, Homo Sapiens
SFFFIGLMF

SEQ ID NO: 1018185 - protein, 9 aa, Homo Sapiens
CRIRKHSSE

SEQ ID NO: 1018186 - protein, 9 aa, Homo Sapiens
SHPVFLNSQ

SEQ ID NO: 1018187 - protein, 9 aa, Homo Sapiens
MPHPANISF

SEQ ID NO: 1018188 - protein, 9 aa, Homo Sapiens
ITPSMAIIV

SEQ ID NO: 1018189 - protein, 9 aa, Homo Sapiens
ALMQHKRIH

SEQ ID NO: 1018190 - protein, 9 aa, Homo Sapiens
LKVEDMQWV

SEQ ID NO: 1018191 - protein, 9 aa, Homo Sapiens
DIFDCSKDL

SEQ ID NO: 1018192 - protein, 9 aa, Homo Sapiens
LLSFSDVLC

SEQ ID NO: 1018193 - protein, 9 aa, Homo Sapiens
LGTFVFYLL

SEQ ID NO: 1018194 - protein, 9 aa, Homo Sapiens
IFEAALQET

SEQ ID NO: 1018195 - protein, 9 aa, Homo Sapiens
DSNCSTLLA

SEQ ID NO: 1018196 - protein, 9 aa, Homo Sapiens
YFFYLDEKI

SEQ ID NO: 1018197 - protein, 9 aa, Homo Sapiens
DVQLRFSLF

SEQ ID NO: 1018198 - protein, 9 aa, Homo Sapiens
FCDKKTIFF

SEQ ID NO: 1018199 - protein, 9 aa, Homo Sapiens
QEESSCLIC

SEQ ID NO: 1018200 - protein, 9 aa, Homo Sapiens
ILIQIAELL

SEQ ID NO: 1018201 - protein, 9 aa, Homo Sapiens
SEFLKKMSL

SEQ ID NO: 1018202 - protein, 9 aa, Homo Sapiens
SRDGLSSQA

SEQ ID NO: 1018203 - protein, 9 aa, Homo Sapiens
NAEPWGQPQ

SEQ ID NO: 1018204 - protein, 9 aa, Homo Sapiens
KAFIGIEDP

SEQ ID NO: 1018205 - protein, 9 aa, Homo Sapiens
SYLTEYRFY

SEQ ID NO: 1018206 - protein, 9 aa, Homo Sapiens
LETSGTPVS

SEQ ID NO: 1018207 - protein, 9 aa, Homo Sapiens
LDNFFCNVP

SEQ ID NO: 1018208 - protein, 9 aa, Homo Sapiens
FYNPQKGIG

SEQ ID NO: 1018209 - protein, 9 aa, Homo Sapiens
NMIQVSYRA

SEQ ID NO: 1018210 - protein, 9 aa, Homo Sapiens
VGIPRPPSK

SEQ ID NO: 1018211 - protein, 9 aa, Homo Sapiens
ELFLTSDKL

SEQ ID NO: 1018212 - protein, 9 aa, Homo Sapiens
PPRRHRTPH

SEQ ID NO: 1018213 - protein, 9 aa, Homo Sapiens
RDPSMFPLG

SEQ ID NO: 1018214 - protein, 9 aa, Homo Sapiens
RVMSSTAIS

SEQ ID NO: 1018215 - protein, 9 aa, Homo Sapiens
KTFSHKSFL

SEQ ID NO: 1018216 - protein, 9 aa, Homo Sapiens
GNPKLPSVV

SEQ ID NO: 1018217 - protein, 9 aa, Homo Sapiens
EVLEFVLGD

SEQ ID NO: 1018218 - protein, 9 aa, Homo Sapiens
RVLADPSDN

SEQ ID NO: 1018219 - protein, 9 aa, Homo Sapiens
SLRPGPPDT

SEQ ID NO: 1018220 - protein, 9 aa, Homo Sapiens
NEKNILCVE

SEQ ID NO: 1018221 - protein, 9 aa, Homo Sapiens
LICLEYLKD

SEQ ID NO: 1018222 - protein, 9 aa, Homo Sapiens
NKIAQVLSK

SEQ ID NO: 1018223 - protein, 9 aa, Homo Sapiens
SSCLICLEY

SEQ ID NO: 1018224 - protein, 9 aa, Homo Sapiens
KRNEGTLLS

SEQ ID NO: 1018225 - protein, 9 aa, Homo Sapiens
PSLSFIKYG

SEQ ID NO: 1018226 - protein, 9 aa, Homo Sapiens
REVLLHWDP

SEQ ID NO: 1018227 - protein, 9 aa, Homo Sapiens
TNLTGKMWV

SEQ ID NO: 1018228 - protein, 9 aa, Homo Sapiens
LDDIKNLKV

SEQ ID NO: 1018229 - protein, 9 aa, Homo Sapiens
PNKPQIERK

SEQ ID NO: 1018230 - protein, 9 aa, Homo Sapiens
VRTGFYNKP

SEQ ID NO: 1018231 - protein, 9 aa, Homo Sapiens
LNLHNMILG

SEQ ID NO: 1018232 - protein, 9 aa, Homo Sapiens
ATNRDKEFY

SEQ ID NO: 1018233 - protein, 9 aa, Homo Sapiens
TYGVRLLFK

SEQ ID NO: 1018234 - protein, 9 aa, Homo Sapiens
MSAFDTNHF

SEQ ID NO: 1018235 - protein, 9 aa, Homo Sapiens
FGSYLGVNL

SEQ ID NO: 1018236 - protein, 9 aa, Homo Sapiens
WKTSPDLSP

SEQ ID NO: 1018237 - protein, 9 aa, Homo Sapiens
LLNPECDSW

SEQ ID NO: 1018238 - protein, 9 aa, Homo Sapiens
VQGENTVQS

SEQ ID NO: 1018239 - protein, 9 aa, Homo Sapiens
TGGPDGSPY

SEQ ID NO: 1018240 - protein, 9 aa, Homo Sapiens
FSVFDENQS

SEQ ID NO: 1018241 - protein, 9 aa, Homo Sapiens
HVQIMKEME

SEQ ID NO: 1018242 - protein, 9 aa, Homo Sapiens
QLCNVLLIA

SEQ ID NO: 1018243 - protein, 9 aa, Homo Sapiens
KTIFFQGCM

SEQ ID NO: 1018244 - protein, 9 aa, Homo Sapiens
LTEYRFYNP

SEQ ID NO: 1018245 - protein, 9 aa, Homo Sapiens
QLHCAGKTK

SEQ ID NO: 1018246 - protein, 9 aa, Homo Sapiens
RAMRQFAID

SEQ ID NO: 1018247 - protein, 9 aa, Homo Sapiens
KKESGSLAA

SEQ ID NO: 1018248 - protein, 9 aa, Homo Sapiens
VDSLTREAQ

SEQ ID NO: 1018249 - protein, 9 aa, Homo Sapiens
KESGSLAAG

SEQ ID NO: 1018250 - protein, 9 aa, Homo Sapiens
WQKDGRPIS

SEQ ID NO: 1018251 - protein, 9 aa, Homo Sapiens
FVLGDNQDK

SEQ ID NO: 1018252 - protein, 9 aa, Homo Sapiens
KKREEDRCS

SEQ ID NO: 1018253 - protein, 9 aa, Homo Sapiens
SQQKRMSPK

SEQ ID NO: 1018254 - protein, 9 aa, Homo Sapiens
VLADPSDNT

SEQ ID NO: 1018255 - protein, 9 aa, Homo Sapiens
LPEKLQEII

SEQ ID NO: 1018256 - protein, 9 aa, Homo Sapiens
GYVAAVRCV

SEQ ID NO: 1018257 - protein, 9 aa, Homo Sapiens
VIRVLRNLC

SEQ ID NO: 1018258 - protein, 9 aa, Homo Sapiens
YLTANKHRV

SEQ ID NO: 1018259 - protein, 9 aa, Homo Sapiens
ECGKLFSQI

SEQ ID NO: 1018260 - protein, 9 aa, Homo Sapiens
PQYPHNGRD

SEQ ID NO: 1018261 - protein, 9 aa, Homo Sapiens
APKLYNGNY

SEQ ID NO: 1018262 - protein, 9 aa, Homo Sapiens
DGQGLHVFN

SEQ ID NO: 1018263 - protein, 9 aa, Homo Sapiens
SIQSKPPVA

SEQ ID NO: 1018264 - protein, 9 aa, Homo Sapiens
HSPQYPHNG

SEQ ID NO: 1018265 - protein, 9 aa, Homo Sapiens
VQLRFSLFR

SEQ ID NO: 1018266 - protein, 9 aa, Homo Sapiens
MFMMIPLCS

SEQ ID NO: 1018267 - protein, 9 aa, Homo Sapiens
QTDTEPNEQ

SEQ ID NO: 1018268 - protein, 9 aa, Homo Sapiens
IGEKEIQKP

SEQ ID NO: 1018269 - protein, 9 aa, Homo Sapiens
SFLASHFRT

SEQ ID NO: 1018270 - protein, 9 aa, Homo Sapiens
RDPDVGVNF

SEQ ID NO: 1018271 - protein, 9 aa, Homo Sapiens
KIYRFNSPL

SEQ ID NO: 1018272 - protein, 9 aa, Homo Sapiens
VIVIRVLRN

SEQ ID NO: 1018273 - protein, 9 aa, Homo Sapiens
LHVLMGYVA

SEQ ID NO: 1018274 - protein, 9 aa, Homo Sapiens
RGNKIHFSI

SEQ ID NO: 1018275 - protein, 9 aa, Homo Sapiens
FTNYPKLQI

SEQ ID NO: 1018276 - protein, 9 aa, Homo Sapiens
VVMRHLPFM

SEQ ID NO: 1018277 - protein, 9 aa, Homo Sapiens
LASHFRTTS

SEQ ID NO: 1018278 - protein, 9 aa, Homo Sapiens
SVGSLFYIA

SEQ ID NO: 1018279 - protein, 9 aa, Homo Sapiens
DRFMLLLSK

SEQ ID NO: 1018280 - protein, 9 aa, Homo Sapiens
ATDLEENKQ

SEQ ID NO: 1018281 - protein, 9 aa, Homo Sapiens
NVAFNSTAY

SEQ ID NO: 1018282 - protein, 9 aa, Homo Sapiens
FQPFLGRIK

SEQ ID NO: 1018283 - protein, 9 aa, Homo Sapiens
ELVRTGFYN

SEQ ID NO: 1018284 - protein, 9 aa, Homo Sapiens
NNCPFLADE

SEQ ID NO: 1018285 - protein, 9 aa, Homo Sapiens
KHNVLEKDF

SEQ ID NO: 1018286 - protein, 9 aa, Homo Sapiens
PKLPSVVMD

SEQ ID NO: 1018287 - protein, 9 aa, Homo Sapiens
FFLATFNKI

SEQ ID NO: 1018288 - protein, 9 aa, Homo Sapiens
PGETLASQV

SEQ ID NO: 1018289 - protein, 9 aa, Homo Sapiens
ALNPHWEEN

SEQ ID NO: 1018290 - protein, 9 aa, Homo Sapiens
FRPLIIHGI

SEQ ID NO: 1018291 - protein, 9 aa, Homo Sapiens
YIVVKAEKS

SEQ ID NO: 1018292 - protein, 9 aa, Homo Sapiens
LPPADGRLS

SEQ ID NO: 1018293 - protein, 9 aa, Homo Sapiens
LAAETEQEI

SEQ ID NO: 1018294 - protein, 9 aa, Homo Sapiens
RNRLSLIEH

SEQ ID NO: 1018295 - protein, 9 aa, Homo Sapiens
VADAILYCS

SEQ ID NO: 1018296 - protein, 9 aa, Homo Sapiens
PPSSFGLHL

SEQ ID NO: 1018297 - protein, 9 aa, Homo Sapiens
EKHNVLEKD

SEQ ID NO: 1018298 - protein, 9 aa, Homo Sapiens
KGIQGQKGD

SEQ ID NO: 1018299 - protein, 9 aa, Homo Sapiens
TSHSSSGKK

SEQ ID NO: 1018300 - protein, 9 aa, Homo Sapiens
LFKKINRDK

SEQ ID NO: 1018301 - protein, 9 aa, Homo Sapiens
MWKTSPDLS

SEQ ID NO: 1018302 - protein, 9 aa, Homo Sapiens
FFFIGLMFM

SEQ ID NO: 1018303 - protein, 9 aa, Homo Sapiens
MEETQVILK

SEQ ID NO: 1018304 - protein, 9 aa, Homo Sapiens
WEQKCFICD

SEQ ID NO: 1018305 - protein, 9 aa, Homo Sapiens
FIKYGEFLY

SEQ ID NO: 1018306 - protein, 9 aa, Homo Sapiens
PNVAFNSTA

SEQ ID NO: 1018307 - protein, 9 aa, Homo Sapiens
HCAGKTKRS

SEQ ID NO: 1018308 - protein, 9 aa, Homo Sapiens
FNKIAQVLS

SEQ ID NO: 1018309 - protein, 9 aa, Homo Sapiens
FLVPVSYRN

SEQ ID NO: 1018310 - protein, 9 aa, Homo Sapiens
EHETCLAPK

SEQ ID NO: 1018311 - protein, 9 aa, Homo Sapiens
TCLAPKLYN

SEQ ID NO: 1018312 - protein, 9 aa, Homo Sapiens
TEPPRRHRT

SEQ ID NO: 1018313 - protein, 9 aa, Homo Sapiens
YPHNGRDDR

SEQ ID NO: 1018314 - protein, 9 aa, Homo Sapiens
LGLPAKMRI

SEQ ID NO: 1018315 - protein, 9 aa, Homo Sapiens
SWSLPIRAM

SEQ ID NO: 1018316 - protein, 9 aa, Homo Sapiens
AKKGQILQG

SEQ ID NO: 1018317 - protein, 9 aa, Homo Sapiens
CNKLMHQKQ

SEQ ID NO: 1018318 - protein, 9 aa, Homo Sapiens
GTDDSSKDS

SEQ ID NO: 1018319 - protein, 9 aa, Homo Sapiens
SPYPDPSAG

SEQ ID NO: 1018320 - protein, 9 aa, Homo Sapiens
FFYLDEKIV

SEQ ID NO: 1018321 - protein, 9 aa, Homo Sapiens
WCVAESQYG

SEQ ID NO: 1018322 - protein, 9 aa, Homo Sapiens
VDISQGILK

SEQ ID NO: 1018323 - protein, 9 aa, Homo Sapiens
HVFNLPKQD

SEQ ID NO: 1018324 - protein, 9 aa, Homo Sapiens
HHCWACGYV

SEQ ID NO: 1018325 - protein, 9 aa, Homo Sapiens
KNAIGEARK

SEQ ID NO: 1018326 - protein, 9 aa, Homo Sapiens
QRQVLFLFF

SEQ ID NO: 1018327 - protein, 9 aa, Homo Sapiens
TGIFPGNGS

SEQ ID NO: 1018328 - protein, 9 aa, Homo Sapiens
HMERLKEVN

SEQ ID NO: 1018329 - protein, 9 aa, Homo Sapiens
RLSRPHSYQ

SEQ ID NO: 1018330 - protein, 9 aa, Homo Sapiens
TNYPKLQIP

SEQ ID NO: 1018331 - protein, 9 aa, Homo Sapiens
PLQKQPLAK

SEQ ID NO: 1018332 - protein, 9 aa, Homo Sapiens
SDVLCLGLM

SEQ ID NO: 1018333 - protein, 9 aa, Homo Sapiens
DILSCKIAD

SEQ ID NO: 1018334 - protein, 9 aa, Homo Sapiens
VAESQYGQR

SEQ ID NO: 1018335 - protein, 9 aa, Homo Sapiens
TSRGNYSNY

SEQ ID NO: 1018336 - protein, 9 aa, Homo Sapiens
IISAYKHMK

SEQ ID NO: 1018337 - protein, 9 aa, Homo Sapiens
DMLGMEETQ

SEQ ID NO: 1018338 - protein, 9 aa, Homo Sapiens
RVADAILYC

SEQ ID NO: 1018339 - protein, 9 aa, Homo Sapiens
EPKKEVVLK

SEQ ID NO: 1018340 - protein, 9 aa, Homo Sapiens
PANISFRQP

SEQ ID NO: 1018341 - protein, 9 aa, Homo Sapiens
FSDGKKVIP

SEQ ID NO: 1018342 - protein, 9 aa, Homo Sapiens
EENRQLLAK

SEQ ID NO: 1018343 - protein, 9 aa, Homo Sapiens
QDCSPSWSL

SEQ ID NO: 1018344 - protein, 9 aa, Homo Sapiens
SKKGKKNEK

SEQ ID NO: 1018345 - protein, 9 aa, Homo Sapiens
PSKSAVLRT

SEQ ID NO: 1018346 - protein, 9 aa, Homo Sapiens
CFLVPVSYR

SEQ ID NO: 1018347 - protein, 9 aa, Homo Sapiens
DDSTVITQD

SEQ ID NO: 1018348 - protein, 9 aa, Homo Sapiens
LLRDPSMFP

SEQ ID NO: 1018349 - protein, 9 aa, Homo Sapiens
INVAATEVV

SEQ ID NO: 1018350 - protein, 9 aa, Homo Sapiens
VLADAVFSF

SEQ ID NO: 1018351 - protein, 9 aa, Homo Sapiens
ECGASVKRN

SEQ ID NO: 1018352 - protein, 9 aa, Homo Sapiens
NVLLIAGHL

SEQ ID NO: 1018353 - protein, 9 aa, Homo Sapiens
NRIFQDSQD

SEQ ID NO: 1018354 - protein, 9 aa, Homo Sapiens
LVKLLCAKH

SEQ ID NO: 1018355 - protein, 9 aa, Homo Sapiens
FQIISAYKH

SEQ ID NO: 1018356 - protein, 9 aa, Homo Sapiens
SHCLPHLLD

SEQ ID NO: 1018357 - protein, 9 aa, Homo Sapiens
GRTSVGFGT

SEQ ID NO: 1018358 - protein, 9 aa, Homo Sapiens
GGLWENSRY

SEQ ID NO: 1018359 - protein, 9 aa, Homo Sapiens
FAIDAAATA

SEQ ID NO: 1018360 - protein, 9 aa, Homo Sapiens
APLGLPHTK

SEQ ID NO: 1018361 - protein, 9 aa, Homo Sapiens
HCRLHTGIK

SEQ ID NO: 1018362 - protein, 9 aa, Homo Sapiens
SAPVGAPIS

SEQ ID NO: 1018363 - protein, 9 aa, Homo Sapiens
LQLLKGAPF

SEQ ID NO: 1018364 - protein, 9 aa, Homo Sapiens
RRIKNAIGE

SEQ ID NO: 1018365 - protein, 9 aa, Homo Sapiens
FQLFTEECL

SEQ ID NO: 1018366 - protein, 9 aa, Homo Sapiens
VVFVFYSVV

SEQ ID NO: 1018367 - protein, 9 aa, Homo Sapiens
KIAQVLSKW

SEQ ID NO: 1018368 - protein, 9 aa, Homo Sapiens
TKRSGGHAP

SEQ ID NO: 1018369 - protein, 9 aa, Homo Sapiens
GASVKRNEG

SEQ ID NO: 1018370 - protein, 9 aa, Homo Sapiens
FIGLMFMMI

SEQ ID NO: 1018371 - protein, 9 aa, Homo Sapiens
KPGDWVILA

SEQ ID NO: 1018372 - protein, 9 aa, Homo Sapiens
KKKLKEMKR

SEQ ID NO: 1018373 - protein, 9 aa, Homo Sapiens
QKDGRPISG

SEQ ID NO: 1018374 - protein, 9 aa, Homo Sapiens
RSRDGLSSQ

SEQ ID NO: 1018375 - protein, 9 aa, Homo Sapiens
QEIYSAESR

SEQ ID NO: 1018376 - protein, 9 aa, Homo Sapiens
SNFFYESEL

SEQ ID NO: 1018377 - protein, 9 aa, Homo Sapiens
LSFGSWYSP

SEQ ID NO: 1018378 - protein, 9 aa, Homo Sapiens
GYHFLPAYL

SEQ ID NO: 1018379 - protein, 9 aa, Homo Sapiens
VLNKKFGSY

SEQ ID NO: 1018380 - protein, 9 aa, Homo Sapiens
MQWVHREHT

SEQ ID NO: 1018381 - protein, 9 aa, Homo Sapiens
TNHFADPVD

SEQ ID NO: 1018382 - protein, 9 aa, Homo Sapiens
LQETRGIPS

SEQ ID NO: 1018383 - protein, 9 aa, Homo Sapiens
SHSSSGKKS

SEQ ID NO: 1018384 - protein, 9 aa, Homo Sapiens
YICSWLPCI

SEQ ID NO: 1018385 - protein, 9 aa, Homo Sapiens
LLFSLGKRV

SEQ ID NO: 1018386 - protein, 9 aa, Homo Sapiens
NRLRAKSRD

SEQ ID NO: 1018387 - protein, 9 aa, Homo Sapiens
NLCRRVPTW

SEQ ID NO: 1018388 - protein, 9 aa, Homo Sapiens
KRSLEKARK

SEQ ID NO: 1018389 - protein, 9 aa, Homo Sapiens
TCYRTVLGM

SEQ ID NO: 1018390 - protein, 9 aa, Homo Sapiens
QRKEEECSL

SEQ ID NO: 1018391 - protein, 9 aa, Homo Sapiens
QKGDNGRQG

SEQ ID NO: 1018392 - protein, 9 aa, Homo Sapiens
ESEVLEFVL

SEQ ID NO: 1018393 - protein, 9 aa, Homo Sapiens
DVPEGSYKV

SEQ ID NO: 1018394 - protein, 9 aa, Homo Sapiens
FCLGVPPSF

SEQ ID NO: 1018395 - protein, 9 aa, Homo Sapiens
RRRHHCWAC

SEQ ID NO: 1018396 - protein, 9 aa, Homo Sapiens
DDIKNLKVG

SEQ ID NO: 1018397 - protein, 9 aa, Homo Sapiens
ILLDGTIQR

SEQ ID NO: 1018398 - protein, 9 aa, Homo Sapiens
KKFGSYLGV

SEQ ID NO: 1018399 - protein, 9 aa, Homo Sapiens
EATELLGLG

SEQ ID NO: 1018400 - protein, 9 aa, Homo Sapiens
SYFAGSQGH

SEQ ID NO: 1018401 - protein, 9 aa, Homo Sapiens
PVAVQGENT

SEQ ID NO: 1018402 - protein, 9 aa, Homo Sapiens
RLGLVVTGT

SEQ ID NO: 1018403 - protein, 9 aa, Homo Sapiens
SVPNTGSIW

SEQ ID NO: 1018404 - protein, 9 aa, Homo Sapiens
VFSFGELLA

SEQ ID NO: 1018405 - protein, 9 aa, Homo Sapiens
PSMAIIVPP

SEQ ID NO: 1018406 - protein, 9 aa, Homo Sapiens
QKNDDQKNT

SEQ ID NO: 1018407 - protein, 9 aa, Homo Sapiens
GPPDTGVSH

SEQ ID NO: 1018408 - protein, 9 aa, Homo Sapiens
LTRRRHHCW

SEQ ID NO: 1018409 - protein, 9 aa, Homo Sapiens
LEGVAAPLR

SEQ ID NO: 1018410 - protein, 9 aa, Homo Sapiens
DFTGILAMV

SEQ ID NO: 1018411 - protein, 9 aa, Homo Sapiens
RDRVLLDGA

SEQ ID NO: 1018412 - protein, 9 aa, Homo Sapiens
ENEGFCGET

SEQ ID NO: 1018413 - protein, 9 aa, Homo Sapiens
IQKLLSPQE

SEQ ID NO: 1018414 - protein, 9 aa, Homo Sapiens
QAFTETKEN

SEQ ID NO: 1018415 - protein, 9 aa, Homo Sapiens
TKEGSTEDA

SEQ ID NO: 1018416 - protein, 9 aa, Homo Sapiens
EERGARMGV

SEQ ID NO: 1018417 - protein, 9 aa, Homo Sapiens
TVPLAMQSS

SEQ ID NO: 1018418 - protein, 9 aa, Homo Sapiens
PSTSSRLAC

SEQ ID NO: 1018419 - protein, 9 aa, Homo Sapiens
WISTSCEVR

SEQ ID NO: 1018420 - protein, 9 aa, Homo Sapiens
FIKKEERPL

SEQ ID NO: 1018421 - protein, 9 aa, Homo Sapiens
LYHDILGDT

SEQ ID NO: 1018422 - protein, 9 aa, Homo Sapiens
YGKVVQKLQ

SEQ ID NO: 1018423 - protein, 9 aa, Homo Sapiens
TAAKYGRLN

SEQ ID NO: 1018424 - protein, 9 aa, Homo Sapiens
LDMSNNCIS

SEQ ID NO: 1018425 - protein, 9 aa, Homo Sapiens
ISWVKGAPP

SEQ ID NO: 1018426 - protein, 9 aa, Homo Sapiens
RSNRLSLKG

SEQ ID NO: 1018427 - protein, 9 aa, Homo Sapiens
GKSTSRIFP

SEQ ID NO: 1018428 - protein, 9 aa, Homo Sapiens
GAEPLKKEF
